United States Patent 7,709,616 (MICRORNAS AND USES THEREOF) - sequence listing, part 23

SEQ ID NO: 719277 - RNA, 63 nt, hsa; identical to SEQ ID NO: 101170

SEQ ID NO: 719278 - RNA, 63 nt, hsa; identical to SEQ ID NO: 101171

SEQ ID NO: 719279 - RNA, 63 nt, hsa; identical to SEQ ID NO: 101172

SEQ ID NO: 719280 - RNA, 63 nt, hsa; identical to SEQ ID NO: 101173

SEQ ID NO: 719281 - RNA, 63 nt, hsa; identical to SEQ ID NO: 101174

SEQ ID NO: 719282 - RNA, 63 nt, hsa; identical to SEQ ID NO: 101175

SEQ ID NO: 719283 - RNA, 63 nt, hsa; identical to SEQ ID NO: 101176

SEQ ID NO: 719284 - RNA, 63 nt, hsa; identical to SEQ ID NO: 101177

SEQ ID NO: 719285 - RNA, 63 nt, hsa; identical to SEQ ID NO: 101178

SEQ ID NO: 719286 - RNA, 63 nt, hsa; identical to SEQ ID NO: 101179

SEQ ID NO: 719287 - RNA, 63 nt, hsa; identical to SEQ ID NO: 101180

SEQ ID NO: 719288 - RNA, 63 nt, hsa; identical to SEQ ID NO: 101181

SEQ ID NO: 719289 - RNA, 63 nt, hsa; identical to SEQ ID NO: 101182

SEQ ID NO: 719290 - RNA, 63 nt, hsa; identical to SEQ ID NO: 101183

SEQ ID NO: 719291 - RNA, 63 nt, hsa; identical to SEQ ID NO: 101184

SEQ ID NO: 719292 - RNA, 63 nt, hsa; identical to SEQ ID NO: 101185

SEQ ID NO: 719293 - RNA, 63 nt, hsa; identical to SEQ ID NO: 101186

SEQ ID NO: 719294 - RNA, 63 nt, hsa; identical to SEQ ID NO: 101187

SEQ ID NO: 719295 - RNA, 63 nt, hsa; identical to SEQ ID NO: 101188

SEQ ID NO: 719296 - RNA, 63 nt, hsa; identical to SEQ ID NO: 101189

SEQ ID NO: 719297 - RNA, 63 nt, hsa; identical to SEQ ID NO: 101190

SEQ ID NO: 719298 - RNA, 63 nt, hsa; identical to SEQ ID NO: 101191

SEQ ID NO: 719299 - RNA, 63 nt, hsa; identical to SEQ ID NO: 101192

SEQ ID NO: 719300 - RNA, 63 nt, hsa; identical to SEQ ID NO: 101193

SEQ ID NO: 719301 - RNA, 63 nt, hsa; identical to SEQ ID NO: 101194

SEQ ID NO: 719302 - RNA, 63 nt, hsa; identical to SEQ ID NO: 101195

SEQ ID NO: 719303 - RNA, 63 nt, hsa; identical to SEQ ID NO: 101196

SEQ ID NO: 719304 - RNA, 63 nt, hsa; identical to SEQ ID NO: 101197

SEQ ID NO: 719305 - RNA, 63 nt, hsa; identical to SEQ ID NO: 101198

SEQ ID NO: 719306 - RNA, 63 nt, hsa; identical to SEQ ID NO: 101199

SEQ ID NO: 719307 - RNA, 63 nt, hsa; identical to SEQ ID NO: 101200

SEQ ID NO: 719308 - RNA, 63 nt, hsa; identical to SEQ ID NO: 101201

SEQ ID NO: 719309 - RNA, 63 nt, hsa; identical to SEQ ID NO: 101202

SEQ ID NO: 719310 - RNA, 63 nt, hsa; identical to SEQ ID NO: 101203

SEQ ID NO: 719311 - RNA, 63 nt, hsa; identical to SEQ ID NO: 101204

SEQ ID NO: 719312 - RNA, 63 nt, hsa; identical to SEQ ID NO: 101205

SEQ ID NO: 719313 - RNA, 63 nt, hsa; identical to SEQ ID NO: 101206

SEQ ID NO: 719314 - RNA, 63 nt, hsa; identical to SEQ ID NO: 101207

SEQ ID NO: 719315 - RNA, 63 nt, hsa; identical to SEQ ID NO: 101208

SEQ ID NO: 719316 - RNA, 63 nt, hsa; identical to SEQ ID NO: 101209

SEQ ID NO: 719317 - RNA, 63 nt, hsa; identical to SEQ ID NO: 101210

SEQ ID NO: 719318 - RNA, 63 nt, hsa; identical to SEQ ID NO: 101211

SEQ ID NO: 719319 - RNA, 63 nt, hsa; identical to SEQ ID NO: 101212

SEQ ID NO: 719320 - RNA, 63 nt, hsa; identical to SEQ ID NO: 101213

SEQ ID NO: 719321 - RNA, 63 nt, hsa; identical to SEQ ID NO: 101214

SEQ ID NO: 719322 - RNA, 63 nt, hsa; identical to SEQ ID NO: 101215

SEQ ID NO: 719323 - RNA, 63 nt, hsa; identical to SEQ ID NO: 101216

SEQ ID NO: 719324 - RNA, 63 nt, hsa; identical to SEQ ID NO: 101217

SEQ ID NO: 719325 - RNA, 63 nt, hsa; identical to SEQ ID NO: 101218

SEQ ID NO: 719326 - RNA, 63 nt, hsa; identical to SEQ ID NO: 101219

SEQ ID NO: 719327 - RNA, 63 nt, hsa; identical to SEQ ID NO: 101220

SEQ ID NO: 719328 - RNA, 63 nt, hsa; identical to SEQ ID NO: 101221

SEQ ID NO: 719329 - RNA, 63 nt, hsa; identical to SEQ ID NO: 101222

SEQ ID NO: 719330 - RNA, 63 nt, hsa; identical to SEQ ID NO: 101223

SEQ ID NO: 719331 - RNA, 63 nt, hsa; identical to SEQ ID NO: 101224

SEQ ID NO: 719332 - RNA, 63 nt, hsa; identical to SEQ ID NO: 101225

SEQ ID NO: 719333 - RNA, 63 nt, hsa; identical to SEQ ID NO: 101226

SEQ ID NO: 719334 - RNA, 63 nt, hsa; identical to SEQ ID NO: 101227

SEQ ID NO: 719335 - RNA, 63 nt, hsa; identical to SEQ ID NO: 101228

SEQ ID NO: 719336 - RNA, 63 nt, hsa; identical to SEQ ID NO: 101229

SEQ ID NO: 719337 - RNA, 63 nt, hsa; identical to SEQ ID NO: 101230

SEQ ID NO: 719338 - RNA, 63 nt, hsa; identical to SEQ ID NO: 101231

SEQ ID NO: 719339 - RNA, 63 nt, hsa; identical to SEQ ID NO: 101232

SEQ ID NO: 719340 - RNA, 63 nt, hsa; identical to SEQ ID NO: 101233

SEQ ID NO: 719341 - RNA, 63 nt, hsa; identical to SEQ ID NO: 101234

SEQ ID NO: 719342 - RNA, 63 nt, hsa; identical to SEQ ID NO: 101235

SEQ ID NO: 719343 - RNA, 63 nt, hsa; identical to SEQ ID NO: 101236

SEQ ID NO: 719344 - RNA, 63 nt, hsa; identical to SEQ ID NO: 101237

SEQ ID NO: 719345 - RNA, 63 nt, hsa; identical to SEQ ID NO: 101238

SEQ ID NO: 719346 - RNA, 63 nt, hsa; identical to SEQ ID NO: 101239

SEQ ID NO: 719347 - RNA, 63 nt, hsa; identical to SEQ ID NO: 101240

SEQ ID NO: 719348 - RNA, 63 nt, hsa; identical to SEQ ID NO: 101241

SEQ ID NO: 719349 - RNA, 63 nt, hsa; identical to SEQ ID NO: 101242

SEQ ID NO: 719350 - RNA, 63 nt, hsa; identical to SEQ ID NO: 101243

SEQ ID NO: 719351 - RNA, 63 nt, hsa; identical to SEQ ID NO: 101244

SEQ ID NO: 719352 - RNA, 63 nt, hsa; identical to SEQ ID NO: 101245

SEQ ID NO: 719353 - RNA, 63 nt, hsa; identical to SEQ ID NO: 101246

SEQ ID NO: 719354 - RNA, 63 nt, hsa; identical to SEQ ID NO: 101247

SEQ ID NO: 719355 - RNA, 63 nt, hsa; identical to SEQ ID NO: 101248

SEQ ID NO: 719356 - RNA, 63 nt, hsa; identical to SEQ ID NO: 101249

SEQ ID NO: 719357 - RNA, 63 nt, hsa; identical to SEQ ID NO: 101250

SEQ ID NO: 719358 - RNA, 63 nt, hsa; identical to SEQ ID NO: 101251

SEQ ID NO: 719359 - RNA, 63 nt, hsa; identical to SEQ ID NO: 101252

SEQ ID NO: 719360 - RNA, 63 nt, hsa; identical to SEQ ID NO: 101253

SEQ ID NO: 719361 - RNA, 63 nt, hsa; identical to SEQ ID NO: 101254

SEQ ID NO: 719362 - RNA, 63 nt, hsa; identical to SEQ ID NO: 101255

SEQ ID NO: 719363 - RNA, 63 nt, hsa; identical to SEQ ID NO: 101256

SEQ ID NO: 719364 - RNA, 63 nt, hsa; identical to SEQ ID NO: 101257

SEQ ID NO: 719365 - RNA, 63 nt, hsa; identical to SEQ ID NO: 101258

SEQ ID NO: 719366 - RNA, 63 nt, hsa; identical to SEQ ID NO: 101259

SEQ ID NO: 719367 - RNA, 63 nt, hsa; identical to SEQ ID NO: 101260

SEQ ID NO: 719368 - RNA, 63 nt, hsa; identical to SEQ ID NO: 101261

SEQ ID NO: 719369 - RNA, 63 nt, hsa; identical to SEQ ID NO: 101262

SEQ ID NO: 719370 - RNA, 63 nt, hsa; identical to SEQ ID NO: 101263

SEQ ID NO: 719371 - RNA, 63 nt, hsa; identical to SEQ ID NO: 101264

SEQ ID NO: 719372 - RNA, 63 nt, hsa; identical to SEQ ID NO: 101265

SEQ ID NO: 719373 - RNA, 63 nt, hsa; identical to SEQ ID NO: 101266

SEQ ID NO: 719374 - RNA, 63 nt, hsa; identical to SEQ ID NO: 101267

SEQ ID NO: 719375 - RNA, 63 nt, hsa; identical to SEQ ID NO: 101268

SEQ ID NO: 719376 - RNA, 63 nt, hsa; identical to SEQ ID NO: 101269

SEQ ID NO: 719377 - RNA, 63 nt, hsa; identical to SEQ ID NO: 101270

SEQ ID NO: 719378 - RNA, 63 nt, hsa; identical to SEQ ID NO: 101271

SEQ ID NO: 719379 - RNA, 63 nt, hsa; identical to SEQ ID NO: 101272

SEQ ID NO: 719380 - RNA, 63 nt, hsa; identical to SEQ ID NO: 101273

SEQ ID NO: 719381 - RNA, 63 nt, hsa; identical to SEQ ID NO: 101274

SEQ ID NO: 719382 - RNA, 63 nt, hsa; identical to SEQ ID NO: 101275

SEQ ID NO: 719383 - RNA, 63 nt, hsa; identical to SEQ ID NO: 101276

SEQ ID NO: 719384 - RNA, 63 nt, hsa; identical to SEQ ID NO: 101277

SEQ ID NO: 719385 - RNA, 63 nt, hsa; identical to SEQ ID NO: 101278

SEQ ID NO: 719386 - RNA, 63 nt, hsa; identical to SEQ ID NO: 101279

SEQ ID NO: 719387 - RNA, 63 nt, hsa; identical to SEQ ID NO: 101280

SEQ ID NO: 719388 - RNA, 63 nt, hsa; identical to SEQ ID NO: 101281

SEQ ID NO: 719389 - RNA, 63 nt, hsa; identical to SEQ ID NO: 101282

SEQ ID NO: 719390 - RNA, 63 nt, hsa; identical to SEQ ID NO: 101283

SEQ ID NO: 719391 - RNA, 63 nt, hsa; identical to SEQ ID NO: 101284

SEQ ID NO: 719392 - RNA, 63 nt, hsa; identical to SEQ ID NO: 101285

SEQ ID NO: 719393 - RNA, 63 nt, hsa; identical to SEQ ID NO: 101286

SEQ ID NO: 719394 - RNA, 63 nt, hsa; identical to SEQ ID NO: 101287

SEQ ID NO: 719395 - RNA, 63 nt, hsa; identical to SEQ ID NO: 101288

SEQ ID NO: 719396 - RNA, 63 nt, hsa; identical to SEQ ID NO: 101289

SEQ ID NO: 719397 - RNA, 63 nt, hsa; identical to SEQ ID NO: 101290

SEQ ID NO: 719398 - RNA, 59 nt, hsa; identical to SEQ ID NO: 101291

SEQ ID NO: 719399 - RNA, 63 nt, hsa; identical to SEQ ID NO: 101292

SEQ ID NO: 719400 - RNA, 63 nt, hsa; identical to SEQ ID NO: 101293

SEQ ID NO: 719401 - RNA, 63 nt, hsa; identical to SEQ ID NO: 101294

SEQ ID NO: 719402 - RNA, 63 nt, hsa; identical to SEQ ID NO: 101295

SEQ ID NO: 719403 - RNA, 63 nt, hsa; identical to SEQ ID NO: 101296

SEQ ID NO: 719404 - RNA, 63 nt, hsa; identical to SEQ ID NO: 101297

SEQ ID NO: 719405 - RNA, 63 nt, hsa; identical to SEQ ID NO: 101298

SEQ ID NO: 719406 - RNA, 63 nt, hsa; identical to SEQ ID NO: 101299

SEQ ID NO: 719407 - RNA, 63 nt, hsa; identical to SEQ ID NO: 101300

SEQ ID NO: 719408 - RNA, 63 nt, hsa; identical to SEQ ID NO: 101301

SEQ ID NO: 719409 - RNA, 63 nt, hsa; identical to SEQ ID NO: 101302

SEQ ID NO: 719410 - RNA, 63 nt, hsa; identical to SEQ ID NO: 101303

SEQ ID NO: 719411 - RNA, 63 nt, hsa; identical to SEQ ID NO: 101304

SEQ ID NO: 719412 - RNA, 63 nt, hsa; identical to SEQ ID NO: 101305

SEQ ID NO: 719413 - RNA, 63 nt, hsa; identical to SEQ ID NO: 101306

SEQ ID NO: 719414 - RNA, 63 nt, hsa; identical to SEQ ID NO: 101307

SEQ ID NO: 719415 - RNA, 63 nt, hsa; identical to SEQ ID NO: 101308

SEQ ID NO: 719416 - RNA, 63 nt, hsa; identical to SEQ ID NO: 101309

SEQ ID NO: 719417 - RNA, 63 nt, hsa; identical to SEQ ID NO: 101310

SEQ ID NO: 719418 - RNA, 63 nt, hsa; identical to SEQ ID NO: 101311

SEQ ID NO: 719419 - RNA, 63 nt, hsa; identical to SEQ ID NO: 101312

SEQ ID NO: 719420 - RNA, 63 nt, hsa; identical to SEQ ID NO: 101313

SEQ ID NO: 719421 - RNA, 63 nt, hsa; identical to SEQ ID NO: 101314

SEQ ID NO: 719422 - RNA, 63 nt, hsa; identical to SEQ ID NO: 101315

SEQ ID NO: 719423 - RNA, 63 nt, hsa; identical to SEQ ID NO: 101316

SEQ ID NO: 719424 - RNA, 63 nt, hsa; identical to SEQ ID NO: 101317

SEQ ID NO: 719425 - RNA, 64 nt, hsa; identical to SEQ ID NO: 101318

SEQ ID NO: 719426 - RNA, 64 nt, hsa; identical to SEQ ID NO: 101319

SEQ ID NO: 719427 - RNA, 64 nt, hsa; identical to SEQ ID NO: 101320

SEQ ID NO: 719428 - RNA, 64 nt, hsa; identical to SEQ ID NO: 101321

SEQ ID NO: 719429 - RNA, 64 nt, hsa; identical to SEQ ID NO: 101322

SEQ ID NO: 719430 - RNA, 64 nt, hsa; identical to SEQ ID NO: 101323

SEQ ID NO: 719431 - RNA, 64 nt, hsa; identical to SEQ ID NO: 101324

SEQ ID NO: 719432 - RNA, 64 nt, hsa; identical to SEQ ID NO: 101325

SEQ ID NO: 719433 - RNA, 64 nt, hsa; identical to SEQ ID NO: 101326

SEQ ID NO: 719434 - RNA, 64 nt, hsa; identical to SEQ ID NO: 101327

SEQ ID NO: 719435 - RNA, 64 nt, hsa; identical to SEQ ID NO: 101328

SEQ ID NO: 719436 - RNA, 64 nt, hsa; identical to SEQ ID NO: 101329

SEQ ID NO: 719437 - RNA, 64 nt, hsa; identical to SEQ ID NO: 101330

SEQ ID NO: 719438 - RNA, 64 nt, hsa; identical to SEQ ID NO: 101331

SEQ ID NO: 719439 - RNA, 64 nt, hsa; identical to SEQ ID NO: 101332

SEQ ID NO: 719440 - RNA, 64 nt, hsa; identical to SEQ ID NO: 101333

SEQ ID NO: 719441 - RNA, 64 nt, hsa; identical to SEQ ID NO: 101334

SEQ ID NO: 719442 - RNA, 64 nt, hsa; identical to SEQ ID NO: 101335

SEQ ID NO: 719443 - RNA, 64 nt, hsa; identical to SEQ ID NO: 101336

SEQ ID NO: 719444 - RNA, 64 nt, hsa; identical to SEQ ID NO: 101337

SEQ ID NO: 719445 - RNA, 64 nt, hsa; identical to SEQ ID NO: 101338

SEQ ID NO: 719446 - RNA, 64 nt, hsa; identical to SEQ ID NO: 101339

SEQ ID NO: 719447 - RNA, 64 nt, hsa; identical to SEQ ID NO: 101340

SEQ ID NO: 719448 - RNA, 64 nt, hsa; identical to SEQ ID NO: 101341

SEQ ID NO: 719449 - RNA, 64 nt, hsa; identical to SEQ ID NO: 101342

SEQ ID NO: 719450 - RNA, 64 nt, hsa; identical to SEQ ID NO: 101343

SEQ ID NO: 719451 - RNA, 64 nt, hsa; identical to SEQ ID NO: 101344

SEQ ID NO: 719452 - RNA, 64 nt, hsa; identical to SEQ ID NO: 101345

SEQ ID NO: 719453 - RNA, 64 nt, hsa; identical to SEQ ID NO: 101346

SEQ ID NO: 719454 - RNA, 64 nt, hsa; identical to SEQ ID NO: 101347

SEQ ID NO: 719455 - RNA, 64 nt, hsa; identical to SEQ ID NO: 101348

SEQ ID NO: 719456 - RNA, 64 nt, hsa; identical to SEQ ID NO: 101349

SEQ ID NO: 719457 - RNA, 64 nt, hsa; identical to SEQ ID NO: 101350

SEQ ID NO: 719458 - RNA, 64 nt, hsa; identical to SEQ ID NO: 101351

SEQ ID NO: 719459 - RNA, 64 nt, hsa; identical to SEQ ID NO: 101352

SEQ ID NO: 719460 - RNA, 64 nt, hsa; identical to SEQ ID NO: 101353

SEQ ID NO: 719461 - RNA, 64 nt, hsa; identical to SEQ ID NO: 101354

SEQ ID NO: 719462 - RNA, 64 nt, hsa; identical to SEQ ID NO: 101355

SEQ ID NO: 719463 - RNA, 64 nt, hsa; identical to SEQ ID NO: 101356

SEQ ID NO: 719464 - RNA, 64 nt, hsa; identical to SEQ ID NO: 101357

SEQ ID NO: 719465 - RNA, 64 nt, hsa; identical to SEQ ID NO: 101358

SEQ ID NO: 719466 - RNA, 64 nt, hsa; identical to SEQ ID NO: 101359

SEQ ID NO: 719467 - RNA, 64 nt, hsa; identical to SEQ ID NO: 101360

SEQ ID NO: 719468 - RNA, 64 nt, hsa; identical to SEQ ID NO: 101361

SEQ ID NO: 719469 - RNA, 64 nt, hsa; identical to SEQ ID NO: 101362

SEQ ID NO: 719470 - RNA, 64 nt, hsa; identical to SEQ ID NO: 101363

SEQ ID NO: 719471 - RNA, 64 nt, hsa; identical to SEQ ID NO: 101364

SEQ ID NO: 719472 - RNA, 64 nt, hsa; identical to SEQ ID NO: 101365

SEQ ID NO: 719473 - RNA, 52 nt, hsa; identical to SEQ ID NO: 100853

SEQ ID NO: 719474 - RNA, 64 nt, hsa; identical to SEQ ID NO: 101367

SEQ ID NO: 719475 - RNA, 64 nt, hsa; identical to SEQ ID NO: 101368

SEQ ID NO: 719476 - RNA, 64 nt, hsa; identical to SEQ ID NO: 101369

SEQ ID NO: 719477 - RNA, 64 nt, hsa; identical to SEQ ID NO: 101370

SEQ ID NO: 719478 - RNA, 64 nt, hsa; identical to SEQ ID NO: 101371

SEQ ID NO: 719479 - RNA, 64 nt, hsa; identical to SEQ ID NO: 101372

SEQ ID NO: 719480 - RNA, 64 nt, hsa; identical to SEQ ID NO: 101373

SEQ ID NO: 719481 - RNA, 64 nt, hsa; identical to SEQ ID NO: 101374

SEQ ID NO: 719482 - RNA, 64 nt, hsa; identical to SEQ ID NO: 101375

SEQ ID NO: 719483 - RNA, 64 nt, hsa; identical to SEQ ID NO: 101376

SEQ ID NO: 719484 - RNA, 64 nt, hsa; identical to SEQ ID NO: 101377

SEQ ID NO: 719485 - RNA, 64 nt, hsa; identical to SEQ ID NO: 101378

SEQ ID NO: 719486 - RNA, 64 nt, hsa; identical to SEQ ID NO: 101379

SEQ ID NO: 719487 - RNA, 64 nt, hsa; identical to SEQ ID NO: 101380

SEQ ID NO: 719488 - RNA, 64 nt, hsa; identical to SEQ ID NO: 101381

SEQ ID NO: 719489 - RNA, 64 nt, hsa; identical to SEQ ID NO: 101382

SEQ ID NO: 719490 - RNA, 64 nt, hsa; identical to SEQ ID NO: 101383

SEQ ID NO: 719491 - RNA, 64 nt, hsa; identical to SEQ ID NO: 101384

SEQ ID NO: 719492 - RNA, 64 nt, hsa; identical to SEQ ID NO: 101385

SEQ ID NO: 719493 - RNA, 64 nt, hsa; identical to SEQ ID NO: 101386

SEQ ID NO: 719494 - RNA, 64 nt, hsa; identical to SEQ ID NO: 101387

SEQ ID NO: 719495 - RNA, 64 nt, hsa; identical to SEQ ID NO: 101388

SEQ ID NO: 719496 - RNA, 64 nt, hsa; identical to SEQ ID NO: 101389

SEQ ID NO: 719497 - RNA, 64 nt, hsa; identical to SEQ ID NO: 101390

SEQ ID NO: 719498 - RNA, 64 nt, hsa; identical to SEQ ID NO: 101391

SEQ ID NO: 719499 - RNA, 64 nt, hsa; identical to SEQ ID NO: 101392

SEQ ID NO: 719500 - RNA, 64 nt, hsa; identical to SEQ ID NO: 101393

SEQ ID NO: 719501 - RNA, 64 nt, hsa; identical to SEQ ID NO: 101394

SEQ ID NO: 719502 - RNA, 64 nt, hsa; identical to SEQ ID NO: 101395

SEQ ID NO: 719503 - RNA, 64 nt, hsa; identical to SEQ ID NO: 101396

SEQ ID NO: 719504 - RNA, 64 nt, hsa; identical to SEQ ID NO: 101397

SEQ ID NO: 719505 - RNA, 64 nt, hsa; identical to SEQ ID NO: 101398

SEQ ID NO: 719506 - RNA, 64 nt, hsa; identical to SEQ ID NO: 101399

SEQ ID NO: 719507 - RNA, 64 nt, hsa; identical to SEQ ID NO: 101400

SEQ ID NO: 719508 - RNA, 64 nt, hsa; identical to SEQ ID NO: 101401

SEQ ID NO: 719509 - RNA, 64 nt, hsa; identical to SEQ ID NO: 101402

SEQ ID NO: 719510 - RNA, 64 nt, hsa; identical to SEQ ID NO: 101403

SEQ ID NO: 719511 - RNA, 64 nt, hsa; identical to SEQ ID NO: 101404

SEQ ID NO: 719512 - RNA, 64 nt, hsa; identical to SEQ ID NO: 101405

SEQ ID NO: 719513 - RNA, 64 nt, hsa; identical to SEQ ID NO: 101406

SEQ ID NO: 719514 - RNA, 64 nt, hsa; identical to SEQ ID NO: 101407

SEQ ID NO: 719515 - RNA, 64 nt, hsa; identical to SEQ ID NO: 101408

SEQ ID NO: 719516 - RNA, 64 nt, hsa; identical to SEQ ID NO: 101409

SEQ ID NO: 719517 - RNA, 64 nt, hsa; identical to SEQ ID NO: 101410

SEQ ID NO: 719518 - RNA, 64 nt, hsa; identical to SEQ ID NO: 101411

SEQ ID NO: 719519 - RNA, 64 nt, hsa; identical to SEQ ID NO: 101412

SEQ ID NO: 719520 - RNA, 64 nt, hsa; identical to SEQ ID NO: 101413

SEQ ID NO: 719521 - RNA, 64 nt, hsa; identical to SEQ ID NO: 101414

SEQ ID NO: 719522 - RNA, 64 nt, hsa; identical to SEQ ID NO: 101415

SEQ ID NO: 719523 - RNA, 64 nt, hsa; identical to SEQ ID NO: 101416

SEQ ID NO: 719524 - RNA, 64 nt, hsa; identical to SEQ ID NO: 101417

SEQ ID NO: 719525 - RNA, 64 nt, hsa; identical to SEQ ID NO: 101418

SEQ ID NO: 719526 - RNA, 64 nt, hsa; identical to SEQ ID NO: 101419

SEQ ID NO: 719527 - RNA, 64 nt, hsa; identical to SEQ ID NO: 101420

SEQ ID NO: 719528 - RNA, 64 nt, hsa; identical to SEQ ID NO: 101421

SEQ ID NO: 719529 - RNA, 64 nt, hsa; identical to SEQ ID NO: 101422

SEQ ID NO: 719530 - RNA, 64 nt, hsa; identical to SEQ ID NO: 101423

SEQ ID NO: 719531 - RNA, 64 nt, hsa; identical to SEQ ID NO: 101424

SEQ ID NO: 719532 - RNA, 64 nt, hsa; identical to SEQ ID NO: 101425

SEQ ID NO: 719533 - RNA, 64 nt, hsa; identical to SEQ ID NO: 101426

SEQ ID NO: 719534 - RNA, 64 nt, hsa; identical to SEQ ID NO: 101427

SEQ ID NO: 719535 - RNA, 64 nt, hsa; identical to SEQ ID NO: 101428

SEQ ID NO: 719536 - RNA, 64 nt, hsa; identical to SEQ ID NO: 101429

SEQ ID NO: 719537 - RNA, 64 nt, hsa; identical to SEQ ID NO: 101430

SEQ ID NO: 719538 - RNA, 64 nt, hsa; identical to SEQ ID NO: 101431

SEQ ID NO: 719539 - RNA, 64 nt, hsa; identical to SEQ ID NO: 101432

SEQ ID NO: 719540 - RNA, 64 nt, hsa; identical to SEQ ID NO: 101433

SEQ ID NO: 719541 - RNA, 64 nt, hsa; identical to SEQ ID NO: 101434

SEQ ID NO: 719542 - RNA, 64 nt, hsa; identical to SEQ ID NO: 101435

SEQ ID NO: 719543 - RNA, 64 nt, hsa; identical to SEQ ID NO: 101436

SEQ ID NO: 719544 - RNA, 64 nt, hsa; identical to SEQ ID NO: 101437

SEQ ID NO: 719545 - RNA, 64 nt, hsa; identical to SEQ ID NO: 101438

SEQ ID NO: 719546 - RNA, 64 nt, hsa; identical to SEQ ID NO: 101439

SEQ ID NO: 719547 - RNA, 64 nt, hsa; identical to SEQ ID NO: 101440

SEQ ID NO: 719548 - RNA, 64 nt, hsa; identical to SEQ ID NO: 101441

SEQ ID NO: 719549 - RNA, 64 nt, hsa; identical to SEQ ID NO: 101442

SEQ ID NO: 719550 - RNA, 64 nt, hsa; identical to SEQ ID NO: 101443

SEQ ID NO: 719551 - RNA, 64 nt, hsa; identical to SEQ ID NO: 101444

SEQ ID NO: 719552 - RNA, 64 nt, hsa; identical to SEQ ID NO: 101445

SEQ ID NO: 719553 - RNA, 64 nt, hsa; identical to SEQ ID NO: 101446

SEQ ID NO: 719554 - RNA, 64 nt, hsa; identical to SEQ ID NO: 101447

SEQ ID NO: 719555 - RNA, 64 nt, hsa; identical to SEQ ID NO: 101448

SEQ ID NO: 719556 - RNA, 64 nt, hsa; identical to SEQ ID NO: 101449

SEQ ID NO: 719557 - RNA, 64 nt, hsa; identical to SEQ ID NO: 101450

SEQ ID NO: 719558 - RNA, 64 nt, hsa; identical to SEQ ID NO: 101451

SEQ ID NO: 719559 - RNA, 64 nt, hsa; identical to SEQ ID NO: 101452

SEQ ID NO: 719560 - RNA, 64 nt, hsa; identical to SEQ ID NO: 101453

SEQ ID NO: 719561 - RNA, 64 nt, hsa; identical to SEQ ID NO: 101454

SEQ ID NO: 719562 - RNA, 64 nt, hsa; identical to SEQ ID NO: 101455

SEQ ID NO: 719563 - RNA, 64 nt, hsa; identical to SEQ ID NO: 101456

SEQ ID NO: 719564 - RNA, 64 nt, hsa; identical to SEQ ID NO: 101457

SEQ ID NO: 719565 - RNA, 64 nt, hsa; identical to SEQ ID NO: 101458

SEQ ID NO: 719566 - RNA, 64 nt, hsa; identical to SEQ ID NO: 101459

SEQ ID NO: 719567 - RNA, 64 nt, hsa; identical to SEQ ID NO: 101460

SEQ ID NO: 719568 - RNA, 64 nt, hsa; identical to SEQ ID NO: 101461

SEQ ID NO: 719569 - RNA, 64 nt, hsa; identical to SEQ ID NO: 101462

SEQ ID NO: 719570 - RNA, 64 nt, hsa; identical to SEQ ID NO: 101463

SEQ ID NO: 719571 - RNA, 64 nt, hsa; identical to SEQ ID NO: 101464

SEQ ID NO: 719572 - RNA, 64 nt, hsa; identical to SEQ ID NO: 101465

SEQ ID NO: 719573 - RNA, 64 nt, hsa; identical to SEQ ID NO: 101466

SEQ ID NO: 719574 - RNA, 64 nt, hsa; identical to SEQ ID NO: 101467

SEQ ID NO: 719575 - RNA, 64 nt, hsa; identical to SEQ ID NO: 101468

SEQ ID NO: 719576 - RNA, 64 nt, hsa; identical to SEQ ID NO: 101469

SEQ ID NO: 719577 - RNA, 64 nt, hsa; identical to SEQ ID NO: 101470

SEQ ID NO: 719578 - RNA, 64 nt, hsa; identical to SEQ ID NO: 101471

SEQ ID NO: 719579 - RNA, 64 nt, hsa; identical to SEQ ID NO: 101472

SEQ ID NO: 719580 - RNA, 64 nt, hsa; identical to SEQ ID NO: 101473

SEQ ID NO: 719581 - RNA, 64 nt, hsa; identical to SEQ ID NO: 101474

SEQ ID NO: 719582 - RNA, 64 nt, hsa; identical to SEQ ID NO: 101475

SEQ ID NO: 719583 - RNA, 64 nt, hsa; identical to SEQ ID NO: 101476

SEQ ID NO: 719584 - RNA, 64 nt, hsa; identical to SEQ ID NO: 101477

SEQ ID NO: 719585 - RNA, 64 nt, hsa; identical to SEQ ID NO: 101478

SEQ ID NO: 719586 - RNA, 64 nt, hsa; identical to SEQ ID NO: 101479

SEQ ID NO: 719587 - RNA, 64 nt, hsa; identical to SEQ ID NO: 101480

SEQ ID NO: 719588 - RNA, 63 nt, hsa; identical to SEQ ID NO: 101481

SEQ ID NO: 719589 - RNA, 64 nt, hsa; identical to SEQ ID NO: 101482

SEQ ID NO: 719590 - RNA, 64 nt, hsa; identical to SEQ ID NO: 101483

SEQ ID NO: 719591 - RNA, 64 nt, hsa; identical to SEQ ID NO: 101484

SEQ ID NO: 719592 - RNA, 64 nt, hsa; identical to SEQ ID NO: 101485

SEQ ID NO: 719593 - RNA, 64 nt, hsa; identical to SEQ ID NO: 101486

SEQ ID NO: 719594 - RNA, 64 nt, hsa; identical to SEQ ID NO: 101487

SEQ ID NO: 719595 - RNA, 64 nt, hsa; identical to SEQ ID NO: 101488

SEQ ID NO: 719596 - RNA, 64 nt, hsa; identical to SEQ ID NO: 101489

SEQ ID NO: 719597 - RNA, 64 nt, hsa; identical to SEQ ID NO: 101490

SEQ ID NO: 719598 - RNA, 64 nt, hsa; identical to SEQ ID NO: 101491

SEQ ID NO: 719599 - RNA, 64 nt, hsa; identical to SEQ ID NO: 101492

SEQ ID NO: 719600 - RNA, 64 nt, hsa; identical to SEQ ID NO: 101493

SEQ ID NO: 719601 - RNA, 64 nt, hsa; identical to SEQ ID NO: 101494

SEQ ID NO: 719602 - RNA, 64 nt, hsa; identical to SEQ ID NO: 101495

SEQ ID NO: 719603 - RNA, 64 nt, hsa; identical to SEQ ID NO: 101496

SEQ ID NO: 719604 - RNA, 64 nt, hsa; identical to SEQ ID NO: 101497

SEQ ID NO: 719605 - RNA, 64 nt, hsa; identical to SEQ ID NO: 101498

SEQ ID NO: 719606 - RNA, 64 nt, hsa; identical to SEQ ID NO: 101499

SEQ ID NO: 719607 - RNA, 64 nt, hsa; identical to SEQ ID NO: 101500

SEQ ID NO: 719608 - RNA, 64 nt, hsa; identical to SEQ ID NO: 101501

SEQ ID NO: 719609 - RNA, 64 nt, hsa; identical to SEQ ID NO: 101502

SEQ ID NO: 719610 - RNA, 64 nt, hsa; identical to SEQ ID NO: 101503

SEQ ID NO: 719611 - RNA, 64 nt, hsa; identical to SEQ ID NO: 101504

SEQ ID NO: 719612 - RNA, 64 nt, hsa; identical to SEQ ID NO: 101505

SEQ ID NO: 719613 - RNA, 64 nt, hsa; identical to SEQ ID NO: 101506

SEQ ID NO: 719614 - RNA, 64 nt, hsa; identical to SEQ ID NO: 101507

SEQ ID NO: 719615 - RNA, 64 nt, hsa; identical to SEQ ID NO: 101508

SEQ ID NO: 719616 - RNA, 64 nt, hsa; identical to SEQ ID NO: 101509

SEQ ID NO: 719617 - RNA, 64 nt, hsa; identical to SEQ ID NO: 101510

SEQ ID NO: 719618 - RNA, 64 nt, hsa; identical to SEQ ID NO: 101511

SEQ ID NO: 719619 - RNA, 64 nt, hsa; identical to SEQ ID NO: 101512

SEQ ID NO: 719620 - RNA, 64 nt, hsa; identical to SEQ ID NO: 101513

SEQ ID NO: 719621 - RNA, 64 nt, hsa; identical to SEQ ID NO: 101514

SEQ ID NO: 719622 - RNA, 64 nt, hsa; identical to SEQ ID NO: 101515

SEQ ID NO: 719623 - RNA, 64 nt, hsa; identical to SEQ ID NO: 101516

SEQ ID NO: 719624 - RNA, 64 nt, hsa; identical to SEQ ID NO: 101517

SEQ ID NO: 719625 - RNA, 64 nt, hsa; identical to SEQ ID NO: 101518

SEQ ID NO: 719626 - RNA, 64 nt, hsa; identical to SEQ ID NO: 101519

SEQ ID NO: 719627 - RNA, 64 nt, hsa; identical to SEQ ID NO: 101520

SEQ ID NO: 719628 - RNA, 64 nt, hsa; identical to SEQ ID NO: 101521

SEQ ID NO: 719629 - RNA, 64 nt, hsa; identical to SEQ ID NO: 101522

SEQ ID NO: 719630 - RNA, 64 nt, hsa; identical to SEQ ID NO: 101523

SEQ ID NO: 719631 - RNA, 64 nt, hsa; identical to SEQ ID NO: 101524

SEQ ID NO: 719632 - RNA, 64 nt, hsa; identical to SEQ ID NO: 101525

SEQ ID NO: 719633 - RNA, 64 nt, hsa; identical to SEQ ID NO: 101526

SEQ ID NO: 719634 - RNA, 64 nt, hsa; identical to SEQ ID NO: 101527

SEQ ID NO: 719635 - RNA, 64 nt, hsa; identical to SEQ ID NO: 101528

SEQ ID NO: 719636 - RNA, 64 nt, hsa; identical to SEQ ID NO: 101529

SEQ ID NO: 719637 - RNA, 64 nt, hsa; identical to SEQ ID NO: 101530

SEQ ID NO: 719638 - RNA, 64 nt, hsa; identical to SEQ ID NO: 101531

SEQ ID NO: 719639 - RNA, 64 nt, hsa; identical to SEQ ID NO: 101532

SEQ ID NO: 719640 - RNA, 64 nt, hsa; identical to SEQ ID NO: 101533

SEQ ID NO: 719641 - RNA, 64 nt, hsa; identical to SEQ ID NO: 101534

SEQ ID NO: 719642 - RNA, 64 nt, hsa; identical to SEQ ID NO: 101535

SEQ ID NO: 719643 - RNA, 64 nt, hsa; identical to SEQ ID NO: 101536

SEQ ID NO: 719644 - RNA, 64 nt, hsa; identical to SEQ ID NO: 101537

SEQ ID NO: 719645 - RNA, 64 nt, hsa; identical to SEQ ID NO: 101538

SEQ ID NO: 719646 - RNA, 64 nt, hsa; identical to SEQ ID NO: 101539

SEQ ID NO: 719647 - RNA, 64 nt, hsa; identical to SEQ ID NO: 101540

SEQ ID NO: 719648 - RNA, 64 nt, hsa; identical to SEQ ID NO: 101541

SEQ ID NO: 719649 - RNA, 64 nt, hsa; identical to SEQ ID NO: 101542

SEQ ID NO: 719650 - RNA, 64 nt, hsa; identical to SEQ ID NO: 101543

SEQ ID NO: 719651 - RNA, 64 nt, hsa; identical to SEQ ID NO: 101544

SEQ ID NO: 719652 - RNA, 64 nt, hsa; identical to SEQ ID NO: 101545

SEQ ID NO: 719653 - RNA, 64 nt, hsa; identical to SEQ ID NO: 101546

SEQ ID NO: 719654 - RNA, 64 nt, hsa; identical to SEQ ID NO: 101547

SEQ ID NO: 719655 - RNA, 64 nt, hsa; identical to SEQ ID NO: 101548

SEQ ID NO: 719656 - RNA, 64 nt, hsa; identical to SEQ ID NO: 101549

SEQ ID NO: 719657 - RNA, 64 nt, hsa; identical to SEQ ID NO: 101550

SEQ ID NO: 719658 - RNA, 64 nt, hsa; identical to SEQ ID NO: 101551

SEQ ID NO: 719659 - RNA, 64 nt, hsa; identical to SEQ ID NO: 101552

SEQ ID NO: 719660 - RNA, 64 nt, hsa; identical to SEQ ID NO: 101553

SEQ ID NO: 719661 - RNA, 64 nt, hsa; identical to SEQ ID NO: 101554

SEQ ID NO: 719662 - RNA, 64 nt, hsa; identical to SEQ ID NO: 101555

SEQ ID NO: 719663 - RNA, 64 nt, hsa; identical to SEQ ID NO: 101556

SEQ ID NO: 719664 - RNA, 64 nt, hsa; identical to SEQ ID NO: 101557

SEQ ID NO: 719665 - RNA, 64 nt, hsa; identical to SEQ ID NO: 101558

SEQ ID NO: 719666 - RNA, 64 nt, hsa; identical to SEQ ID NO: 101559

SEQ ID NO: 719667 - RNA, 64 nt, hsa; identical to SEQ ID NO: 101560

SEQ ID NO: 719668 - RNA, 64 nt, hsa; identical to SEQ ID NO: 101561

SEQ ID NO: 719669 - RNA, 64 nt, hsa; identical to SEQ ID NO: 101562

SEQ ID NO: 719670 - RNA, 64 nt, hsa; identical to SEQ ID NO: 101563

SEQ ID NO: 719671 - RNA, 64 nt, hsa; identical to SEQ ID NO: 101564

SEQ ID NO: 719672 - RNA, 64 nt, hsa; identical to SEQ ID NO: 101565

SEQ ID NO: 719673 - RNA, 64 nt, hsa; identical to SEQ ID NO: 101566

SEQ ID NO: 719674 - RNA, 64 nt, hsa; identical to SEQ ID NO: 101567

SEQ ID NO: 719675 - RNA, 64 nt, hsa; identical to SEQ ID NO: 101568

SEQ ID NO: 719676 - RNA, 64 nt, hsa; identical to SEQ ID NO: 101569

SEQ ID NO: 719677 - RNA, 64 nt, hsa; identical to SEQ ID NO: 101570

SEQ ID NO: 719678 - RNA, 64 nt, hsa; identical to SEQ ID NO: 101571

SEQ ID NO: 719679 - RNA, 64 nt, hsa; identical to SEQ ID NO: 101572

SEQ ID NO: 719680 - RNA, 64 nt, hsa; identical to SEQ ID NO: 101573

SEQ ID NO: 719681 - RNA, 64 nt, hsa; identical to SEQ ID NO: 101574

SEQ ID NO: 719682 - RNA, 64 nt, hsa; identical to SEQ ID NO: 101575

SEQ ID NO: 719683 - RNA, 64 nt, hsa; identical to SEQ ID NO: 101576

SEQ ID NO: 719684 - RNA, 64 nt, hsa; identical to SEQ ID NO: 101577

SEQ ID NO: 719685 - RNA, 64 nt, hsa; identical to SEQ ID NO: 101578

SEQ ID NO: 719686 - RNA, 64 nt, hsa; identical to SEQ ID NO: 101579

SEQ ID NO: 719687 - RNA, 64 nt, hsa; identical to SEQ ID NO: 101580

SEQ ID NO: 719688 - RNA, 64 nt, hsa; identical to SEQ ID NO: 101581

SEQ ID NO: 719689 - RNA, 64 nt, hsa; identical to SEQ ID NO: 101582

SEQ ID NO: 719690 - RNA, 64 nt, hsa; identical to SEQ ID NO: 101583

SEQ ID NO: 719691 - RNA, 64 nt, hsa; identical to SEQ ID NO: 101584

SEQ ID NO: 719692 - RNA, 64 nt, hsa; identical to SEQ ID NO: 101585

SEQ ID NO: 719693 - RNA, 64 nt, hsa; identical to SEQ ID NO: 101586

SEQ ID NO: 719694 - RNA, 64 nt, hsa; identical to SEQ ID NO: 101587

SEQ ID NO: 719695 - RNA, 64 nt, hsa; identical to SEQ ID NO: 101588

SEQ ID NO: 719696 - RNA, 64 nt, hsa; identical to SEQ ID NO: 101589

SEQ ID NO: 719697 - RNA, 64 nt, hsa; identical to SEQ ID NO: 101590

SEQ ID NO: 719698 - RNA, 64 nt, hsa; identical to SEQ ID NO: 101591

SEQ ID NO: 719699 - RNA, 64 nt, hsa; identical to SEQ ID NO: 101592

SEQ ID NO: 719700 - RNA, 64 nt, hsa; identical to SEQ ID NO: 101593

SEQ ID NO: 719701 - RNA, 64 nt, hsa; identical to SEQ ID NO: 101594

SEQ ID NO: 719702 - RNA, 64 nt, hsa; identical to SEQ ID NO: 101595

SEQ ID NO: 719703 - RNA, 64 nt, hsa; identical to SEQ ID NO: 101596

SEQ ID NO: 719704 - RNA, 64 nt, hsa; identical to SEQ ID NO: 101597

SEQ ID NO: 719705 - RNA, 64 nt, hsa; identical to SEQ ID NO: 101598

SEQ ID NO: 719706 - RNA, 64 nt, hsa; identical to SEQ ID NO: 101599

SEQ ID NO: 719707 - RNA, 64 nt, hsa; identical to SEQ ID NO: 101600

SEQ ID NO: 719708 - RNA, 64 nt, hsa; identical to SEQ ID NO: 101601

SEQ ID NO: 719709 - RNA, 64 nt, hsa; identical to SEQ ID NO: 101602

SEQ ID NO: 719710 - RNA, 64 nt, hsa; identical to SEQ ID NO: 101603

SEQ ID NO: 719711 - RNA, 64 nt, hsa; identical to SEQ ID NO: 101604

SEQ ID NO: 719712 - RNA, 64 nt, hsa; identical to SEQ ID NO: 101605

SEQ ID NO: 719713 - RNA, 64 nt, hsa; identical to SEQ ID NO: 101606

SEQ ID NO: 719714 - RNA, 64 nt, hsa; identical to SEQ ID NO: 101607

SEQ ID NO: 719715 - RNA, 64 nt, hsa; identical to SEQ ID NO: 101608

SEQ ID NO: 719716 - RNA, 64 nt, hsa; identical to SEQ ID NO: 101609

SEQ ID NO: 719717 - RNA, 64 nt, hsa; identical to SEQ ID NO: 101610

SEQ ID NO: 719718 - RNA, 64 nt, hsa; identical to SEQ ID NO: 101611

SEQ ID NO: 719719 - RNA, 64 nt, hsa; identical to SEQ ID NO: 101612

SEQ ID NO: 719720 - RNA, 64 nt, hsa; identical to SEQ ID NO: 101613

SEQ ID NO: 719721 - RNA, 64 nt, hsa; identical to SEQ ID NO: 101614

SEQ ID NO: 719722 - RNA, 64 nt, hsa; identical to SEQ ID NO: 101615

SEQ ID NO: 719723 - RNA, 64 nt, hsa; identical to SEQ ID NO: 101616

SEQ ID NO: 719724 - RNA, 64 nt, hsa; identical to SEQ ID NO: 101617

SEQ ID NO: 719725 - RNA, 64 nt, hsa; identical to SEQ ID NO: 101618

SEQ ID NO: 719726 - RNA, 64 nt, hsa; identical to SEQ ID NO: 101619

SEQ ID NO: 719727 - RNA, 64 nt, hsa; identical to SEQ ID NO: 101620

SEQ ID NO: 719728 - RNA, 64 nt, hsa; identical to SEQ ID NO: 101621

SEQ ID NO: 719729 - RNA, 64 nt, hsa; identical to SEQ ID NO: 101622

SEQ ID NO: 719730 - RNA, 64 nt, hsa; identical to SEQ ID NO: 101623

SEQ ID NO: 719731 - RNA, 64 nt, hsa; identical to SEQ ID NO: 101624

SEQ ID NO: 719732 - RNA, 64 nt, hsa; identical to SEQ ID NO: 101625

SEQ ID NO: 719733 - RNA, 64 nt, hsa; identical to SEQ ID NO: 101626

SEQ ID NO: 719734 - RNA, 64 nt, hsa; identical to SEQ ID NO: 101627

SEQ ID NO: 719735 - RNA, 64 nt, hsa; identical to SEQ ID NO: 101628

SEQ ID NO: 719736 - RNA, 64 nt, hsa; identical to SEQ ID NO: 101629

SEQ ID NO: 719737 - RNA, 64 nt, hsa; identical to SEQ ID NO: 101630

SEQ ID NO: 719738 - RNA, 64 nt, hsa; identical to SEQ ID NO: 101631

SEQ ID NO: 719739 - RNA, 64 nt, hsa; identical to SEQ ID NO: 101632

SEQ ID NO: 719740 - RNA, 64 nt, hsa; identical to SEQ ID NO: 101633

SEQ ID NO: 719741 - RNA, 64 nt, hsa; identical to SEQ ID NO: 101634

SEQ ID NO: 719742 - RNA, 64 nt, hsa; identical to SEQ ID NO: 101635

SEQ ID NO: 719743 - RNA, 64 nt, hsa; identical to SEQ ID NO: 101636

SEQ ID NO: 719744 - RNA, 64 nt, hsa; identical to SEQ ID NO: 101637

SEQ ID NO: 719745 - RNA, 64 nt, hsa; identical to SEQ ID NO: 101638

SEQ ID NO: 719746 - RNA, 64 nt, hsa; identical to SEQ ID NO: 101639

SEQ ID NO: 719747 - RNA, 64 nt, hsa; identical to SEQ ID NO: 101640

SEQ ID NO: 719748 - RNA, 64 nt, hsa; identical to SEQ ID NO: 101641

SEQ ID NO: 719749 - RNA, 64 nt, hsa; identical to SEQ ID NO: 101642

SEQ ID NO: 719750 - RNA, 64 nt, hsa; identical to SEQ ID NO: 101643

SEQ ID NO: 719751 - RNA, 64 nt, hsa; identical to SEQ ID NO: 101644

SEQ ID NO: 719752 - RNA, 64 nt, hsa; identical to SEQ ID NO: 101645

SEQ ID NO: 719753 - RNA, 64 nt, hsa; identical to SEQ ID NO: 101646

SEQ ID NO: 719754 - RNA, 64 nt, hsa; identical to SEQ ID NO: 101647

SEQ ID NO: 719755 - RNA, 64 nt, hsa; identical to SEQ ID NO: 101648

SEQ ID NO: 719756 - RNA, 64 nt, hsa; identical to SEQ ID NO: 101649

SEQ ID NO: 719757 - RNA, 64 nt, hsa; identical to SEQ ID NO: 101650

SEQ ID NO: 719758 - RNA, 64 nt, hsa; identical to SEQ ID NO: 101651

SEQ ID NO: 719759 - RNA, 64 nt, hsa; identical to SEQ ID NO: 101652

SEQ ID NO: 719760 - RNA, 64 nt, hsa; identical to SEQ ID NO: 101653

SEQ ID NO: 719761 - RNA, 64 nt, hsa; identical to SEQ ID NO: 101654

SEQ ID NO: 719762 - RNA, 64 nt, hsa; identical to SEQ ID NO: 101655

SEQ ID NO: 719763 - RNA, 64 nt, hsa; identical to SEQ ID NO: 101656

SEQ ID NO: 719764 - RNA, 64 nt, hsa; identical to SEQ ID NO: 101657

SEQ ID NO: 719765 - RNA, 64 nt, hsa; identical to SEQ ID NO: 101658

SEQ ID NO: 719766 - RNA, 64 nt, hsa; identical to SEQ ID NO: 101659

SEQ ID NO: 719767 - RNA, 64 nt, hsa; identical to SEQ ID NO: 101660

SEQ ID NO: 719768 - RNA, 64 nt, hsa; identical to SEQ ID NO: 101661

SEQ ID NO: 719769 - RNA, 64 nt, hsa; identical to SEQ ID NO: 101662

SEQ ID NO: 719770 - RNA, 64 nt, hsa; identical to SEQ ID NO: 101663

SEQ ID NO: 719771 - RNA, 64 nt, hsa; identical to SEQ ID NO: 101664

SEQ ID NO: 719772 - RNA, 64 nt, hsa; identical to SEQ ID NO: 101665

SEQ ID NO: 719773 - RNA, 64 nt, hsa; identical to SEQ ID NO: 101666

SEQ ID NO: 719774 - RNA, 64 nt, hsa; identical to SEQ ID NO: 101667

SEQ ID NO: 719775 - RNA, 64 nt, hsa; identical to SEQ ID NO: 101668

SEQ ID NO: 719776 - RNA, 64 nt, hsa; identical to SEQ ID NO: 101669

SEQ ID NO: 719777 - RNA, 64 nt, hsa; identical to SEQ ID NO: 101670

SEQ ID NO: 719778 - RNA, 64 nt, hsa; identical to SEQ ID NO: 101671

SEQ ID NO: 719779 - RNA, 64 nt, hsa; identical to SEQ ID NO: 101672

SEQ ID NO: 719780 - RNA, 64 nt, hsa; identical to SEQ ID NO: 101673

SEQ ID NO: 719781 - RNA, 64 nt, hsa; identical to SEQ ID NO: 101674

SEQ ID NO: 719782 - RNA, 64 nt, hsa; identical to SEQ ID NO: 101675

SEQ ID NO: 719783 - RNA, 64 nt, hsa; identical to SEQ ID NO: 101676

SEQ ID NO: 719784 - RNA, 64 nt, hsa; identical to SEQ ID NO: 101677

SEQ ID NO: 719785 - RNA, 64 nt, hsa; identical to SEQ ID NO: 101678

SEQ ID NO: 719786 - RNA, 64 nt, hsa; identical to SEQ ID NO: 101679

SEQ ID NO: 719787 - RNA, 64 nt, hsa; identical to SEQ ID NO: 101680

SEQ ID NO: 719788 - RNA, 64 nt, hsa; identical to SEQ ID NO: 101681

SEQ ID NO: 719789 - RNA, 64 nt, hsa; identical to SEQ ID NO: 101682

SEQ ID NO: 719790 - RNA, 64 nt, hsa; identical to SEQ ID NO: 101683

SEQ ID NO: 719791 - RNA, 64 nt, hsa; identical to SEQ ID NO: 101684

SEQ ID NO: 719792 - RNA, 64 nt, hsa; identical to SEQ ID NO: 101685

SEQ ID NO: 719793 - RNA, 64 nt, hsa; identical to SEQ ID NO: 101686

SEQ ID NO: 719794 - RNA, 64 nt, hsa; identical to SEQ ID NO: 101687

SEQ ID NO: 719795 - RNA, 64 nt, hsa; identical to SEQ ID NO: 101688

SEQ ID NO: 719796 - RNA, 64 nt, hsa; identical to SEQ ID NO: 101689

SEQ ID NO: 719797 - RNA, 64 nt, hsa; identical to SEQ ID NO: 101690

SEQ ID NO: 719798 - RNA, 64 nt, hsa; identical to SEQ ID NO: 101691

SEQ ID NO: 719799 - RNA, 64 nt, hsa; identical to SEQ ID NO: 101692

SEQ ID NO: 719800 - RNA, 64 nt, hsa; identical to SEQ ID NO: 101693

SEQ ID NO: 719801 - RNA, 64 nt, hsa; identical to SEQ ID NO: 101694

SEQ ID NO: 719802 - RNA, 64 nt, hsa; identical to SEQ ID NO: 101695

SEQ ID NO: 719803 - RNA, 64 nt, hsa; identical to SEQ ID NO: 101696

SEQ ID NO: 719804 - RNA, 64 nt, hsa; identical to SEQ ID NO: 101697

SEQ ID NO: 719805 - RNA, 64 nt, hsa; identical to SEQ ID NO: 101698

SEQ ID NO: 719806 - RNA, 64 nt, hsa; identical to SEQ ID NO: 101699

SEQ ID NO: 719807 - RNA, 64 nt, hsa; identical to SEQ ID NO: 101700

SEQ ID NO: 719808 - RNA, 64 nt, hsa; identical to SEQ ID NO: 101701

SEQ ID NO: 719809 - RNA, 64 nt, hsa; identical to SEQ ID NO: 101702

SEQ ID NO: 719810 - RNA, 64 nt, hsa; identical to SEQ ID NO: 101703

SEQ ID NO: 719811 - RNA, 64 nt, hsa; identical to SEQ ID NO: 101704

SEQ ID NO: 719812 - RNA, 64 nt, hsa; identical to SEQ ID NO: 101705

SEQ ID NO: 719813 - RNA, 64 nt, hsa; identical to SEQ ID NO: 101706

SEQ ID NO: 719814 - RNA, 64 nt, hsa; identical to SEQ ID NO: 101707

SEQ ID NO: 719815 - RNA, 64 nt, hsa; identical to SEQ ID NO: 101708

SEQ ID NO: 719816 - RNA, 64 nt, hsa; identical to SEQ ID NO: 101709

SEQ ID NO: 719817 - RNA, 64 nt, hsa; identical to SEQ ID NO: 101710

SEQ ID NO: 719818 - RNA, 64 nt, hsa; identical to SEQ ID NO: 101711

SEQ ID NO: 719819 - RNA, 64 nt, hsa; identical to SEQ ID NO: 101712

SEQ ID NO: 719820 - RNA, 64 nt, hsa; identical to SEQ ID NO: 101713

SEQ ID NO: 719821 - RNA, 64 nt, hsa; identical to SEQ ID NO: 101714

SEQ ID NO: 719822 - RNA, 64 nt, hsa; identical to SEQ ID NO: 101715

SEQ ID NO: 719823 - RNA, 64 nt, hsa; identical to SEQ ID NO: 101716

SEQ ID NO: 719824 - RNA, 64 nt, hsa; identical to SEQ ID NO: 101717

SEQ ID NO: 719825 - RNA, 64 nt, hsa; identical to SEQ ID NO: 101718

SEQ ID NO: 719826 - RNA, 64 nt, hsa; identical to SEQ ID NO: 101719

SEQ ID NO: 719827 - RNA, 64 nt, hsa; identical to SEQ ID NO: 101720

SEQ ID NO: 719828 - RNA, 64 nt, hsa; identical to SEQ ID NO: 101721

SEQ ID NO: 719829 - RNA, 64 nt, hsa; identical to SEQ ID NO: 101722

SEQ ID NO: 719830 - RNA, 64 nt, hsa; identical to SEQ ID NO: 101723

SEQ ID NO: 719831 - RNA, 64 nt, hsa; identical to SEQ ID NO: 101724

SEQ ID NO: 719832 - RNA, 64 nt, hsa; identical to SEQ ID NO: 101725

SEQ ID NO: 719833 - RNA, 64 nt, hsa; identical to SEQ ID NO: 101726

SEQ ID NO: 719834 - RNA, 64 nt, hsa; identical to SEQ ID NO: 101727

SEQ ID NO: 719835 - RNA, 64 nt, hsa; identical to SEQ ID NO: 101728

SEQ ID NO: 719836 - RNA, 64 nt, hsa; identical to SEQ ID NO: 101729

SEQ ID NO: 719837 - RNA, 64 nt, hsa; identical to SEQ ID NO: 101730

SEQ ID NO: 719838 - RNA, 64 nt, hsa; identical to SEQ ID NO: 101731

SEQ ID NO: 719839 - RNA, 64 nt, hsa; identical to SEQ ID NO: 101732

SEQ ID NO: 719840 - RNA, 64 nt, hsa; identical to SEQ ID NO: 101733

SEQ ID NO: 719841 - RNA, 64 nt, hsa; identical to SEQ ID NO: 101734

SEQ ID NO: 719842 - RNA, 64 nt, hsa; identical to SEQ ID NO: 101735

SEQ ID NO: 719843 - RNA, 64 nt, hsa; identical to SEQ ID NO: 101736

SEQ ID NO: 719844 - RNA, 64 nt, hsa; identical to SEQ ID NO: 101737

SEQ ID NO: 719845 - RNA, 64 nt, hsa; identical to SEQ ID NO: 101738

SEQ ID NO: 719846 - RNA, 64 nt, hsa; identical to SEQ ID NO: 101739

SEQ ID NO: 719847 - RNA, 64 nt, hsa; identical to SEQ ID NO: 101740

SEQ ID NO: 719848 - RNA, 64 nt, hsa; identical to SEQ ID NO: 101741

SEQ ID NO: 719849 - RNA, 64 nt, hsa; identical to SEQ ID NO: 101742

SEQ ID NO: 719850 - RNA, 64 nt, hsa; identical to SEQ ID NO: 101743

SEQ ID NO: 719851 - RNA, 64 nt, hsa; identical to SEQ ID NO: 101744

SEQ ID NO: 719852 - RNA, 64 nt, hsa; identical to SEQ ID NO: 101745

SEQ ID NO: 719853 - RNA, 64 nt, hsa; identical to SEQ ID NO: 101746

SEQ ID NO: 719854 - RNA, 64 nt, hsa; identical to SEQ ID NO: 101747

SEQ ID NO: 719855 - RNA, 64 nt, hsa; identical to SEQ ID NO: 101748

SEQ ID NO: 719856 - RNA, 64 nt, hsa; identical to SEQ ID NO: 101749

SEQ ID NO: 719857 - RNA, 64 nt, hsa; identical to SEQ ID NO: 101750

SEQ ID NO: 719858 - RNA, 64 nt, hsa; identical to SEQ ID NO: 101751

SEQ ID NO: 719859 - RNA, 64 nt, hsa; identical to SEQ ID NO: 101752

SEQ ID NO: 719860 - RNA, 64 nt, hsa; identical to SEQ ID NO: 101753

SEQ ID NO: 719861 - RNA, 64 nt, hsa; identical to SEQ ID NO: 101754

SEQ ID NO: 719862 - RNA, 64 nt, hsa; identical to SEQ ID NO: 101755

SEQ ID NO: 719863 - RNA, 64 nt, hsa; identical to SEQ ID NO: 101756

SEQ ID NO: 719864 - RNA, 64 nt, hsa; identical to SEQ ID NO: 101757

SEQ ID NO: 719865 - RNA, 64 nt, hsa; identical to SEQ ID NO: 101758

SEQ ID NO: 719866 - RNA, 64 nt, hsa; identical to SEQ ID NO: 101759

SEQ ID NO: 719867 - RNA, 64 nt, hsa; identical to SEQ ID NO: 101760

SEQ ID NO: 719868 - RNA, 64 nt, hsa; identical to SEQ ID NO: 101761

SEQ ID NO: 719869 - RNA, 64 nt, hsa; identical to SEQ ID NO: 101762

SEQ ID NO: 719870 - RNA, 64 nt, hsa; identical to SEQ ID NO: 101763

SEQ ID NO: 719871 - RNA, 64 nt, hsa; identical to SEQ ID NO: 101764

SEQ ID NO: 719872 - RNA, 64 nt, hsa; identical to SEQ ID NO: 101765

SEQ ID NO: 719873 - RNA, 64 nt, hsa; identical to SEQ ID NO: 101766

SEQ ID NO: 719874 - RNA, 64 nt, hsa; identical to SEQ ID NO: 101767

SEQ ID NO: 719875 - RNA, 64 nt, hsa; identical to SEQ ID NO: 101768

SEQ ID NO: 719876 - RNA, 64 nt, hsa; identical to SEQ ID NO: 101769

SEQ ID NO: 719877 - RNA, 64 nt, hsa; identical to SEQ ID NO: 101770

SEQ ID NO: 719878 - RNA, 64 nt, hsa; identical to SEQ ID NO: 101771

SEQ ID NO: 719879 - RNA, 64 nt, hsa; identical to SEQ ID NO: 101772

SEQ ID NO: 719880 - RNA, 64 nt, hsa; identical to SEQ ID NO: 101773

SEQ ID NO: 719881 - RNA, 64 nt, hsa; identical to SEQ ID NO: 101774

SEQ ID NO: 719882 - RNA, 64 nt, hsa; identical to SEQ ID NO: 101775

SEQ ID NO: 719883 - RNA, 64 nt, hsa; identical to SEQ ID NO: 101776

SEQ ID NO: 719884 - RNA, 64 nt, hsa; identical to SEQ ID NO: 101777

SEQ ID NO: 719885 - RNA, 64 nt, hsa; identical to SEQ ID NO: 101778

SEQ ID NO: 719886 - RNA, 64 nt, hsa; identical to SEQ ID NO: 101779

SEQ ID NO: 719887 - RNA, 64 nt, hsa; identical to SEQ ID NO: 101780

SEQ ID NO: 719888 - RNA, 64 nt, hsa; identical to SEQ ID NO: 101781

SEQ ID NO: 719889 - RNA, 64 nt, hsa; identical to SEQ ID NO: 101782

SEQ ID NO: 719890 - RNA, 64 nt, hsa; identical to SEQ ID NO: 101783

SEQ ID NO: 719891 - RNA, 64 nt, hsa; identical to SEQ ID NO: 101784

SEQ ID NO: 719892 - RNA, 64 nt, hsa; identical to SEQ ID NO: 101785

SEQ ID NO: 719893 - RNA, 64 nt, hsa; identical to SEQ ID NO: 101786

SEQ ID NO: 719894 - RNA, 64 nt, hsa; identical to SEQ ID NO: 101787

SEQ ID NO: 719895 - RNA, 64 nt, hsa; identical to SEQ ID NO: 101788

SEQ ID NO: 719896 - RNA, 64 nt, hsa; identical to SEQ ID NO: 101789

SEQ ID NO: 719897 - RNA, 64 nt, hsa; identical to SEQ ID NO: 101790

SEQ ID NO: 719898 - RNA, 64 nt, hsa; identical to SEQ ID NO: 101791

SEQ ID NO: 719899 - RNA, 64 nt, hsa; identical to SEQ ID NO: 101792

SEQ ID NO: 719900 - RNA, 64 nt, hsa; identical to SEQ ID NO: 101793

SEQ ID NO: 719901 - RNA, 64 nt, hsa; identical to SEQ ID NO: 101794

SEQ ID NO: 719902 - RNA, 64 nt, hsa; identical to SEQ ID NO: 101795

SEQ ID NO: 719903 - RNA, 64 nt, hsa; identical to SEQ ID NO: 101796

SEQ ID NO: 719904 - RNA, 64 nt, hsa; identical to SEQ ID NO: 101797

SEQ ID NO: 719905 - RNA, 64 nt, hsa; identical to SEQ ID NO: 101798

SEQ ID NO: 719906 - RNA, 64 nt, hsa; identical to SEQ ID NO: 101799

SEQ ID NO: 719907 - RNA, 64 nt, hsa; identical to SEQ ID NO: 101800

SEQ ID NO: 719908 - RNA, 64 nt, hsa; identical to SEQ ID NO: 101801

SEQ ID NO: 719909 - RNA, 64 nt, hsa; identical to SEQ ID NO: 101802

SEQ ID NO: 719910 - RNA, 64 nt, hsa; identical to SEQ ID NO: 101803

SEQ ID NO: 719911 - RNA, 59 nt, hsa; identical to SEQ ID NO: 101291

SEQ ID NO: 719912 - RNA, 64 nt, hsa; identical to SEQ ID NO: 101805

SEQ ID NO: 719913 - RNA, 64 nt, hsa; identical to SEQ ID NO: 101806

SEQ ID NO: 719914 - RNA, 64 nt, hsa; identical to SEQ ID NO: 101807

SEQ ID NO: 719915 - RNA, 64 nt, hsa; identical to SEQ ID NO: 101808

SEQ ID NO: 719916 - RNA, 64 nt, hsa; identical to SEQ ID NO: 101809

SEQ ID NO: 719917 - RNA, 64 nt, hsa; identical to SEQ ID NO: 101810

SEQ ID NO: 719918 - RNA, 64 nt, hsa; identical to SEQ ID NO: 101811

SEQ ID NO: 719919 - RNA, 64 nt, hsa; identical to SEQ ID NO: 101812

SEQ ID NO: 719920 - RNA, 64 nt, hsa; identical to SEQ ID NO: 101813

SEQ ID NO: 719921 - RNA, 64 nt, hsa; identical to SEQ ID NO: 101814

SEQ ID NO: 719922 - RNA, 64 nt, hsa; identical to SEQ ID NO: 101815

SEQ ID NO: 719923 - RNA, 64 nt, hsa; identical to SEQ ID NO: 101816

SEQ ID NO: 719924 - RNA, 64 nt, hsa; identical to SEQ ID NO: 101817

SEQ ID NO: 719925 - RNA, 64 nt, hsa; identical to SEQ ID NO: 101818

SEQ ID NO: 719926 - RNA, 64 nt, hsa; identical to SEQ ID NO: 101819

SEQ ID NO: 719927 - RNA, 64 nt, hsa; identical to SEQ ID NO: 101820

SEQ ID NO: 719928 - RNA, 64 nt, hsa; identical to SEQ ID NO: 101821

SEQ ID NO: 719929 - RNA, 64 nt, hsa; identical to SEQ ID NO: 101822

SEQ ID NO: 719930 - RNA, 64 nt, hsa; identical to SEQ ID NO: 101823

SEQ ID NO: 719931 - RNA, 64 nt, hsa; identical to SEQ ID NO: 101824

SEQ ID NO: 719932 - RNA, 64 nt, hsa; identical to SEQ ID NO: 101825

SEQ ID NO: 719933 - RNA, 64 nt, hsa; identical to SEQ ID NO: 101826

SEQ ID NO: 719934 - RNA, 64 nt, hsa; identical to SEQ ID NO: 101827

SEQ ID NO: 719935 - RNA, 64 nt, hsa; identical to SEQ ID NO: 101828

SEQ ID NO: 719936 - RNA, 64 nt, hsa; identical to SEQ ID NO: 101829

SEQ ID NO: 719937 - RNA, 64 nt, hsa; identical to SEQ ID NO: 101830

SEQ ID NO: 719938 - RNA, 64 nt, hsa; identical to SEQ ID NO: 94944

SEQ ID NO: 719939 - RNA, 64 nt, hsa; identical to SEQ ID NO: 94945

SEQ ID NO: 719940 - RNA, 64 nt, hsa; identical to SEQ ID NO: 94946

SEQ ID NO: 719941 - RNA, 64 nt, hsa; identical to SEQ ID NO: 94947

SEQ ID NO: 719942 - RNA, 64 nt, hsa; identical to SEQ ID NO: 94948

SEQ ID NO: 719943 - RNA, 64 nt, hsa; identical to SEQ ID NO: 94949

SEQ ID NO: 719944 - RNA, 64 nt, hsa; identical to SEQ ID NO: 94950

SEQ ID NO: 719945 - RNA, 59 nt, hsa; identical to SEQ ID NO: 94951

SEQ ID NO: 719946 - RNA, 64 nt, hsa; identical to SEQ ID NO: 94952

SEQ ID NO: 719947 - RNA, 64 nt, hsa; identical to SEQ ID NO: 94953

SEQ ID NO: 719948 - RNA, 62 nt, hsa; identical to SEQ ID NO: 94954

SEQ ID NO: 719949 - RNA, 64 nt, hsa; identical to SEQ ID NO: 94955

SEQ ID NO: 719950 - RNA, 64 nt, hsa
uguuaaugcccuauuuucuaauuuggcaccucuugaugccuaagcagguaagcagaugccuaag

SEQ ID NO: 719951 - RNA, 64 nt, hsa
auuuggcaccucuugaugccuaagcagguaagcagaugccuaagcuguauuucuccaaauaaau

SEQ ID NO: 719952 - RNA, 64 nt, hsa
ggccugagauucugcauuucuaaggagucucagggaugccuaugcugcuggccuaaaaccacac

SEQ ID NO: 719953 - RNA, 64 nt, hsa
accugcugcuaacaccaaggugugaacaugcccugaugccuaaccaaagaugaguuaaccaaag

SEQ ID NO: 719954 - RNA, 64 nt, hsa
gcucagccucggccgucugcccugcacuaccaaggccgaccacuagaggucagcgucgcgccgc

SEQ ID NO: 719955 - RNA, 64 nt, hsa
gaagaauuacacuggccuuuguuuuucuggaaaugccgaccauggagaugcuuuagagucuucu

SEQ ID NO: 719956 - RNA, 64 nt, hsa
aagggaauauugaggaaucaucuagaacaauuaagccgaccaggaaaccucauuccuaccuaca

SEQ ID NO: 719957 - RNA, 62 nt, hsa
uuugcacguuucgaucccaaaggcccuuuuuagggccgaccacuugcucaucugaggaguug

SEQ ID NO: 719958 - RNA, 64 nt, hsa
agcgugaaauuagagcuggacuuaagacucauuggccgaccauccuguguccuggccuggcccu

SEQ ID NO: 719959 - RNA, 64 nt, hsa
gcggcuccagauagauggggaugccgggcuccaggccgaccagcacuugggaucugaugggaca

SEQ ID NO: 719960 - RNA, 64 nt, hsa
ugacagagccaaaugagggcugcaguugcugagggccgaccacccaugccaagggaauccaccc

SEQ ID NO: 719961 - RNA, 64 nt, hsa
guuugcuaaugcugcuuugcaaauaaaacuugcugccgaccacccacgggcauaaaaucaagug

SEQ ID NO: 719962 - RNA, 64 nt, hsa
gguuucgcgcugcuccugaccgcggugaggccgcgccgaccaucucugcacugaagggcccucu

SEQ ID NO: 719963 - RNA, 64 nt, hsa
cccucuaggcccugugccuggaggugccuccacagccgaccagcagccaccccgccugcuucau

SEQ ID NO: 719964 - RNA, 64 nt, hsa
uccuccuuccucugaguugaccagcagcaggucugccgaccaccagcaccauccucuccuccca

SEQ ID NO: 719965 - RNA, 64 nt, hsa
caaagugcugggauuccaggugugagccgcugcggccgaccacauuugauguuugaaguuguaa

SEQ ID NO: 719966 - RNA, 64 nt, hsa
ccugcugugauuaacgaguaacuccaaguacaaggccgaccacaauggaugcugcaaaaacguu

SEQ ID NO: 719967 - RNA, 64 nt, hsa
ccccagcacauacucccauaguguccuagguccagccgaccauuccuuauucucuucuaucucc

SEQ ID NO: 719968 - RNA, 64 nt, hsa
ggcagcguacuucuaacucauuguuucccucauggccgaccagggcggggauagcaugcccaau

SEQ ID NO: 719969 - RNA, 64 nt, hsa
cccagaaggcagggaaaggcucugaaagccagcugccgaccagagccccacacggaggcaucug

SEQ ID NO: 719970 - RNA, 64 nt, hsa
uucucaugacagcuccaucaagaaugugggaugugccgaccaaggauuugagaaaguuguacag

SEQ ID NO: 719971 - RNA, 64 nt, hsa
gucugucuugcccgccugcccgccugccccuccugccgaccacacggaguucagugccugggug

SEQ ID NO: 719972 - RNA, 64 nt, hsa
cccguggaaugcucaccacauguuggucgaagcggccgaccacugacuuugugacuuaggcggc

SEQ ID NO: 719973 - RNA, 64 nt, hsa
gggacccagagcgagauggguuuguucggugccagccgaccaagauugacuaguuuguuggacu

SEQ ID NO: 719974 - RNA, 64 nt, hsa
uaucucccaccuaaaauagagaauguugucuuuugccgaccaggagcacuacagauugagcuuu

SEQ ID NO: 719975 - RNA, 64 nt, hsa
ucacgauugcugaagccugagcaggucucugugggccgaccagaggggggcuucgagguggucc

SEQ ID NO: 719976 - RNA, 64 nt, hsa
uucgggcgucugugugcgcucuguggaugccagggccgaccagaggagccuuuuuaaaacacau

SEQ ID NO: 719977 - RNA, 64 nt, hsa
acccuucgcccagcaccgcgguuccgcuuugggagccgaccauccucgcaguugcaugugacag

SEQ ID NO: 719978 - RNA, 64 nt, hsa
uuccuugccccugacauuuggacucuucccuugggccgaccacucuguucucauucuccuuccc

SEQ ID NO: 719979 - RNA, 64 nt, hsa
gccaacgcccccucuguccuucccuggcccugcugccgaccaggagcugcccagccugugggcg

SEQ ID NO: 719980 - RNA, 64 nt, hsa
ugaagaagaaagacaugguauuuguucagcagacgccgaccacucagacggaggggccccuggg

SEQ ID NO: 719981 - RNA, 64 nt, hsa
aaaugaggaggcuguuuuccucugauucuccucggccgaccaccuguccaaugcugcugguuuc

SEQ ID NO: 719982 - RNA, 64 nt, hsa
gcugcacuacagcccuggccuccacccccaccccgccgaccauccaagggagagugagaccugg

SEQ ID NO: 719983 - RNA, 64 nt, hsa
cuauuaugcagcuuauuuuaccugaaacuguuaagccgaccaagaucccucccugcaagacaga

SEQ ID NO: 719984 - RNA, 64 nt, hsa
gagccuguuggcaagagcugguauucccugcccagccgaccaaaugaccucugcauucuucagg

SEQ ID NO: 719985 - RNA, 64 nt, hsa
augcggcuucucugccauuagcagcccugggcgggccgaccacacucgaggcugcggugcuacg

SEQ ID NO: 719986 - RNA, 64 nt, hsa
ucccagccacgcagggccauccacugugacgucggccgaccaggcuggacacccucugccgagu

SEQ ID NO: 719987 - RNA, 64 nt, hsa
cugccagacacugcgccccgccugaccugggggagccgaccaauuagucacugcugcuacugcc

SEQ ID NO: 719988 - RNA, 64 nt, hsa
cucugcagugcaggagucacugauugaugggugugccgaccagcagcuucacaaaugucugcug

SEQ ID NO: 719989 - RNA, 64 nt, hsa
aaaaaaagacaaaaaaaaaaaagccaagccgugagccgaccagaaggccguccucuuugauauc

SEQ ID NO: 719990 - RNA, 64 nt, hsa
cacacccagcaggcgcaaccagagucucgugugugccgaccacaggagccaagccuuuuccacu

SEQ ID NO: 719991 - RNA, 64 nt, hsa
cgcccucccggagagguggccgccaugcuucugugccgaccacgccccaggaccuccggagcgc

SEQ ID NO: 719992 - RNA, 64 nt, hsa
ucgcauugcuguugaauggugagcacgugaccaugccgaccacaaaggugucugcggaaacucg

SEQ ID NO: 719993 - RNA, 64 nt, hsa
ucugguccccugcuuuuugagguuggguuaaaaugccgaccauggcagaggggucacagcucag

SEQ ID NO: 719994 - RNA, 64 nt, hsa
gguucaggagaccggccuguuccugaguuugagugccgaccaacccccaggauggcggaagcuc

SEQ ID NO: 719995 - RNA, 64 nt, hsa
aaugccugcuauaaaaauuugaaauauuagaauggccgaccauggcagugaccaggccucacua

SEQ ID NO: 719996 - RNA, 64 nt, hsa; identical to SEQ ID NO: 670571

SEQ ID NO: 719997 - RNA, 64 nt, hsa; identical to SEQ ID NO: 670572

SEQ ID NO: 719998 - RNA, 64 nt, hsa; identical to SEQ ID NO: 670573

SEQ ID NO: 719999 - RNA, 64 nt, hsa; identical to SEQ ID NO: 670574

SEQ ID NO: 720000 - RNA, 64 nt, hsa; identical to SEQ ID NO: 670575

SEQ ID NO: 720001 - RNA, 64 nt, hsa; identical to SEQ ID NO: 670576

SEQ ID NO: 720002 - RNA, 64 nt, hsa; identical to SEQ ID NO: 670577

SEQ ID NO: 720003 - RNA, 64 nt, hsa; identical to SEQ ID NO: 670578

SEQ ID NO: 720004 - RNA, 64 nt, hsa; identical to SEQ ID NO: 670579

SEQ ID NO: 720005 - RNA, 64 nt, hsa; identical to SEQ ID NO: 670580

SEQ ID NO: 720006 - RNA, 64 nt, hsa; identical to SEQ ID NO: 670581

SEQ ID NO: 720007 - RNA, 64 nt, hsa; identical to SEQ ID NO: 670582

SEQ ID NO: 720008 - RNA, 64 nt, hsa; identical to SEQ ID NO: 670583

SEQ ID NO: 720009 - RNA, 64 nt, hsa; identical to SEQ ID NO: 670584

SEQ ID NO: 720010 - RNA, 64 nt, hsa; identical to SEQ ID NO: 670585

SEQ ID NO: 720011 - RNA, 64 nt, hsa; identical to SEQ ID NO: 670586

SEQ ID NO: 720012 - RNA, 64 nt, hsa; identical to SEQ ID NO: 670587

SEQ ID NO: 720013 - RNA, 64 nt, hsa; identical to SEQ ID NO: 670588

SEQ ID NO: 720014 - RNA, 64 nt, hsa; identical to SEQ ID NO: 670589

SEQ ID NO: 720015 - RNA, 64 nt, hsa; identical to SEQ ID NO: 670590

SEQ ID NO: 720016 - RNA, 64 nt, hsa; identical to SEQ ID NO: 670591

SEQ ID NO: 720017 - RNA, 64 nt, hsa; identical to SEQ ID NO: 670592

SEQ ID NO: 720018 - RNA, 64 nt, hsa; identical to SEQ ID NO: 670593

SEQ ID NO: 720019 - RNA, 64 nt, hsa; identical to SEQ ID NO: 670594

SEQ ID NO: 720020 - RNA, 64 nt, hsa; identical to SEQ ID NO: 670595

SEQ ID NO: 720021 - RNA, 64 nt, hsa; identical to SEQ ID NO: 670596

SEQ ID NO: 720022 - RNA, 64 nt, hsa; identical to SEQ ID NO: 670597

SEQ ID NO: 720023 - RNA, 64 nt, hsa; identical to SEQ ID NO: 670598

SEQ ID NO: 720024 - RNA, 64 nt, hsa; identical to SEQ ID NO: 670599

SEQ ID NO: 720025 - RNA, 64 nt, hsa; identical to SEQ ID NO: 670600

SEQ ID NO: 720026 - RNA, 64 nt, hsa; identical to SEQ ID NO: 670601

SEQ ID NO: 720027 - RNA, 64 nt, hsa; identical to SEQ ID NO: 670602

SEQ ID NO: 720028 - RNA, 64 nt, hsa; identical to SEQ ID NO: 670603

SEQ ID NO: 720029 - RNA, 64 nt, hsa; identical to SEQ ID NO: 108409

SEQ ID NO: 720030 - RNA, 64 nt, hsa; identical to SEQ ID NO: 108410

SEQ ID NO: 720031 - RNA, 64 nt, hsa; identical to SEQ ID NO: 108411

SEQ ID NO: 720032 - RNA, 64 nt, hsa; identical to SEQ ID NO: 108412

SEQ ID NO: 720033 - RNA, 63 nt, hsa
gguuggaaagucucuuuuuuguaauuuguuuuugcaaaucauugugaggccacuuuuucuuuc

SEQ ID NO: 720034 - RNA, 63 nt, hsa
ccuucuuucaucucuuuuuuguaauuuguuguugcaaaucauugugaggccacuuuucuuucc

SEQ ID NO: 720035 - RNA, 63 nt, hsa
auguaccucguggaauucagccagcuucauguugcaaaucagaaagcugaccccaagacugca

SEQ ID NO: 720036 - RNA, 63 nt, hsa
cauguugcaaaucagaaagcugaccccaagacugcaaaucaaugaagguauuggcauuguuaa

SEQ ID NO: 720037 - RNA, 63 nt, hsa
aggcaucgucaugcacaguauuuguaauuaaaagcaaaucauuuguuuaaaaaggcaguuugc

SEQ ID NO: 720038 - RNA, 63 nt, hsa
agguuagagaauaaauugauuuuuauaaauacugcaaaucaggcuuuuguuuccuuuuucaga

SEQ ID NO: 720039 - RNA, 63 nt, hsa
agccuuugcacuuuuaaaauaaaaaccaaguaugcaaaucaaagauauuugguagucaaaaua

SEQ ID NO: 720040 - RNA, 63 nt, hsa
uugccuaaaaaggaaauuggaugggauacuguggcaaaucauaaaaaaccagauaauugaacu

SEQ ID NO: 720041 - RNA, 63 nt, hsa
ugucacaaaguuuucaguaaugcuacaaccauugcaaaucauuggagaauccauaaugagaga

SEQ ID NO: 720042 - RNA, 63 nt, hsa
acaaauaggaagaaugugacaaaguuuucgguugcaaaucaaaccuugaaacacauaagaaaa

SEQ ID NO: 720043 - RNA, 63 nt, hsa
uaaauaugaucuaugauuuugcuucauaaaacagcaaaucaauguuuuauguaaaauauuaaa

SEQ ID NO: 720044 - RNA, 63 nt, hsa
aagucauuauuauauuuuucagcccuucauccagcaaaucagaaggacucaguacaaacuccg

SEQ ID NO: 720045 - RNA, 64 nt, hsa
auugucugagaauaggauuaaugagcaaaaguuaugauaauagaguuauaugaugguuuaaugg

SEQ ID NO: 720046 - RNA, 64 nt, hsa
cuaacaaauauaaaggaacuugaaauguggggagugauaauaguccagugauuaaacuacaguc

SEQ ID NO: 720047 - RNA, 64 nt, hsa
cuaccuuagcuaaccagaauuguucauagacuugugauaauaugguguuaugggaaaacacauu

SEQ ID NO: 720048 - RNA, 64 nt, hsa
auuuuuuaaugagguauuuaccacugaagaaauaugauaauauaaaaccaucaaauuuuauaau

SEQ ID NO: 720049 - RNA, 64 nt, hsa
ucacuauccauuaggaguuuuucuuaaacuugucugauaauaagaaucaccuggaguuaggagg

SEQ ID NO: 720050 - RNA, 64 nt, hsa
ucaguucucuuaguaagaacuuuagaaguaaucuugauaauaagcacagacagccuaacagcag

SEQ ID NO: 720051 - RNA, 64 nt, hsa
acaaacuccuaugucaugagaauaaccgauguucugauaauaguagcaucuagguacagaugcu

SEQ ID NO: 720052 - RNA, 64 nt, hsa
uacuagaagcagaaugaaaccacauuuuuugguuugauaauaugcacuuauugacucccacuca

SEQ ID NO: 720053 - RNA, 64 nt, hsa
aaauuauuucauuugcacacaaugauaauaaugaugauaauaauaauaauaauaauaauaauaa

SEQ ID NO: 720054 - RNA, 64 nt, hsa
uauuauuaaaauaaauuauuucauuugcacacaaugauaauaaugaugauaauaauaauaauaa

SEQ ID NO: 720055 - RNA, 64 nt, hsa
acguguuugaaaagccuguaagaaauacaggauuugauaauauuuugaaggcaggaaaaaccca

SEQ ID NO: 720056 - RNA, 64 nt, hsa
aaccuaacuguuuuuaccauugaaauuuaaauugugauaauagguuuuaaaugucuagaaugca

SEQ ID NO: 720057 - RNA, 64 nt, hsa
uauuuaaaauauauuugagacaugaaauacauacugauaauacauaccucaugaaagauuuuau

SEQ ID NO: 720058 - RNA, 64 nt, hsa
cuugauuaaggaauucuacuuucaaaaauuaaucugauaauaguaacaagguauauuauacuuu

SEQ ID NO: 720059 - RNA, 64 nt, hsa
guuuaaaaacugcguuguuauuuuuagagauuugugauaauacaacuuguuauaaaauuuauuc

SEQ ID NO: 720060 - RNA, 64 nt, hsa
auugcauacacaugccuccaugcauauaugugugugauaauacacaugcauuuaugugcgugug

SEQ ID NO: 720061 - RNA, 64 nt, hsa
auucuaaucuauguugaacuuuguauacuugaaaugauaauaaaaaggauauaauuucuuagua

SEQ ID NO: 720062 - RNA, 64 nt, hsa
auauauugccauacaaaaacuuaacauuuaaaacugauaauaucuguaaugacaucagaaugaa

SEQ ID NO: 720063 - RNA, 64 nt, hsa
auacacugucagaaacuugagaucuuuuggccuaugauaauaccauuaauuuuugcauugcuuc

SEQ ID NO: 720064 - RNA, 64 nt, hsa
acuacuguuagcaccacuacuaauuaucauucauugauaauauuaauugcaaugauguuguaau

SEQ ID NO: 720065 - RNA, 64 nt, hsa
uacuaugguugcuuucccuauuuguucaauagacugauaauacuggaauuuauagaguuugagc

SEQ ID NO: 720066 - RNA, 64 nt, hsa
aaacaaauacauaaguaaccauugaacauuaauuugauaauaggucuagagacucuaaaaacua

SEQ ID NO: 720067 - RNA, 64 nt, hsa
guuauaguuugaaaguccaacuguauuaauugacugauaauaugauaauauagagauuaaauug

SEQ ID NO: 720068 - RNA, 64 nt, hsa
uugaaaguccaacuguauuaauugacugauaauaugauaauauagagauuaaauuguuugucuu

SEQ ID NO: 720069 - RNA, 64 nt, hsa
cauaugaauuauuaagcauaugugcuuucgcagcugauaauauaaaaggaaaucccacagucua

SEQ ID NO: 720070 - RNA, 64 nt, hsa
ucaaauaucucaccacagugaauuauggguaaggugauaauauguuuaauuagcuugauuuaau

SEQ ID NO: 720071 - RNA, 64 nt, hsa
agaaaaagauuauaguuauuaauauugauaccucugauaauauuuuauucuuaaaucuucagug

SEQ ID NO: 720072 - RNA, 64 nt, hsa
uuuguuucuaagauauuuuugguuuuuuuaaaacugauaauaaugcugaauuaucuuaagugag

SEQ ID NO: 720073 - RNA, 64 nt, hsa
cagcuucccuacauuacacacacucagguugagucauucuaacuauaaaagugcaaugacuaag

SEQ ID NO: 720074 - RNA, 64 nt, hsa
accuaaaucaccccagagcuuuaugucuuuuauucauucuaauucuuauuaaccggaauaugua

SEQ ID NO: 720075 - RNA, 64 nt, hsa
guuauauuucacuuaaaauacuauucauacuauacauucuaagacuggugcuucugcuuuugaa

SEQ ID NO: 720076 - RNA, 64 nt, hsa
guuuuuauuuuguuauucagcaugacauuauuuccauucuaacauuucagugugugaaauuacu

SEQ ID NO: 720077 - RNA, 64 nt, hsa
ggaaaaugcacacuuuguuuuuacuuuuccguuucauucuaaagguaguuaagaugaaauuuau

SEQ ID NO: 720078 - RNA, 64 nt, hsa
ugucagccucuuucauagugugcaaacauuuuaucauucuaaauggugacucucugcccuugga

SEQ ID NO: 720079 - RNA, 64 nt, hsa
gauaugucagccucuacagucacaagagcuaauucauucuaauaaaccaaucuuucuguaugug

SEQ ID NO: 720080 - RNA, 64 nt, hsa
ugauucagugggucugcguagagccugagacugccauucuaacauguucccaggggaugcugau

SEQ ID NO: 720081 - RNA, 64 nt, hsa
gaaaaaaaccggaaaaauacgccaagguuagguucauucuaagagucuaaaaauuucaaaaacc

SEQ ID NO: 720082 - RNA, 64 nt, hsa
guacccagccauuuuuugacuuuuuaauaauagccauucuaacugguuuaagagaguaucucau

SEQ ID NO: 720083 - RNA, 64 nt, hsa
ucaggcauucucuauucuuuucccccuguagacccauucuaaaugugggccugaggucaauggg

SEQ ID NO: 720084 - RNA, 64 nt, hsa
aauauuucaucuaacugcuuagaacuauaaauagcauucuaaauuugaguaaauacaauuuuuu

SEQ ID NO: 720085 - RNA, 64 nt, hsa
ugauuuaggaugcucuauuacuaauaacugaagacauucuaauugguacagacugaaaccuuua

SEQ ID NO: 720086 - RNA, 64 nt, hsa
ugcucuacuccuuccuguuaaugaauuaagaacacauucuaacaagggucuguggcagacauug

SEQ ID NO: 720087 - RNA, 64 nt, hsa; identical to SEQ ID NO: 720086

SEQ ID NO: 720088 - RNA, 64 nt, hsa
auucuacaugaacaauacccuuuucaguucccuucauucuaauguccucaacuguuaccaaaua

SEQ ID NO: 720089 - RNA, 64 nt, hsa
uagaugccucuuaaaaaugaagauuucagagacccauucuaaacaagggcauucacucucugga

SEQ ID NO: 720090 - RNA, 64 nt, hsa
gguagugggaggagaacggucagaaucaaagugacauucuaagaaaaacuguaccuuagagauu

SEQ ID NO: 720091 - RNA, 64 nt, hsa
ccccaagguuuaaacugcccaguuagcauucugacauucuaaaagccggcaaagcagcuuuuag

SEQ ID NO: 720092 - RNA, 64 nt, hsa
uugucuccaucaguggucaccuugagggauuagacauucuaauggaauguccuggcuccacccu

SEQ ID NO: 720093 - RNA, 64 nt, hsa
aacaaugacaguugaguggagugggaagggaagucauucuaaagaguccaaagucaguagcgcc

SEQ ID NO: 720094 - RNA, 64 nt, hsa; identical to SEQ ID NO: 720045

SEQ ID NO: 720095 - RNA, 64 nt, hsa; identical to SEQ ID NO: 720046

SEQ ID NO: 720096 - RNA, 64 nt, hsa; identical to SEQ ID NO: 720047

SEQ ID NO: 720097 - RNA, 64 nt, hsa; identical to SEQ ID NO: 720048

SEQ ID NO: 720098 - RNA, 64 nt, hsa; identical to SEQ ID NO: 720049

SEQ ID NO: 720099 - RNA, 64 nt, hsa; identical to SEQ ID NO: 720050

SEQ ID NO: 720100 - RNA, 64 nt, hsa; identical to SEQ ID NO: 720051

SEQ ID NO: 720101 - RNA, 64 nt, hsa; identical to SEQ ID NO: 720052

SEQ ID NO: 720102 - RNA, 64 nt, hsa; identical to SEQ ID NO: 720053

SEQ ID NO: 720103 - RNA, 64 nt, hsa; identical to SEQ ID NO: 720054

SEQ ID NO: 720104 - RNA, 64 nt, hsa; identical to SEQ ID NO: 720055

SEQ ID NO: 720105 - RNA, 64 nt, hsa; identical to SEQ ID NO: 720056

SEQ ID NO: 720106 - RNA, 64 nt, hsa; identical to SEQ ID NO: 720057

SEQ ID NO: 720107 - RNA, 64 nt, hsa; identical to SEQ ID NO: 720058

SEQ ID NO: 720108 - RNA, 64 nt, hsa; identical to SEQ ID NO: 720059

SEQ ID NO: 720109 - RNA, 64 nt, hsa; identical to SEQ ID NO: 720060

SEQ ID NO: 720110 - RNA, 64 nt, hsa; identical to SEQ ID NO: 720061

SEQ ID NO: 720111 - RNA, 64 nt, hsa; identical to SEQ ID NO: 720062

SEQ ID NO: 720112 - RNA, 64 nt, hsa; identical to SEQ ID NO: 720063

SEQ ID NO: 720113 - RNA, 64 nt, hsa; identical to SEQ ID NO: 720064

SEQ ID NO: 720114 - RNA, 64 nt, hsa; identical to SEQ ID NO: 720065

SEQ ID NO: 720115 - RNA, 64 nt, hsa; identical to SEQ ID NO: 720066

SEQ ID NO: 720116 - RNA, 64 nt, hsa; identical to SEQ ID NO: 720067

SEQ ID NO: 720117 - RNA, 64 nt, hsa; identical to SEQ ID NO: 720068

SEQ ID NO: 720118 - RNA, 64 nt, hsa; identical to SEQ ID NO: 720069

SEQ ID NO: 720119 - RNA, 64 nt, hsa; identical to SEQ ID NO: 720070

SEQ ID NO: 720120 - RNA, 64 nt, hsa; identical to SEQ ID NO: 720071

SEQ ID NO: 720121 - RNA, 64 nt, hsa; identical to SEQ ID NO: 720072

SEQ ID NO: 720122 - RNA, 64 nt, hsa; identical to SEQ ID NO: 720073

SEQ ID NO: 720123 - RNA, 64 nt, hsa; identical to SEQ ID NO: 720074

SEQ ID NO: 720124 - RNA, 64 nt, hsa; identical to SEQ ID NO: 720075

SEQ ID NO: 720125 - RNA, 64 nt, hsa; identical to SEQ ID NO: 720076

SEQ ID NO: 720126 - RNA, 64 nt, hsa; identical to SEQ ID NO: 720077

SEQ ID NO: 720127 - RNA, 64 nt, hsa; identical to SEQ ID NO: 720078

SEQ ID NO: 720128 - RNA, 64 nt, hsa; identical to SEQ ID NO: 720079

SEQ ID NO: 720129 - RNA, 64 nt, hsa; identical to SEQ ID NO: 720080

SEQ ID NO: 720130 - RNA, 64 nt, hsa; identical to SEQ ID NO: 720081

SEQ ID NO: 720131 - RNA, 64 nt, hsa; identical to SEQ ID NO: 720082

SEQ ID NO: 720132 - RNA, 64 nt, hsa; identical to SEQ ID NO: 720083

SEQ ID NO: 720133 - RNA, 64 nt, hsa; identical to SEQ ID NO: 720084

SEQ ID NO: 720134 - RNA, 64 nt, hsa; identical to SEQ ID NO: 720085

SEQ ID NO: 720135 - RNA, 64 nt, hsa; identical to SEQ ID NO: 720086

SEQ ID NO: 720136 - RNA, 64 nt, hsa; identical to SEQ ID NO: 720086

SEQ ID NO: 720137 - RNA, 64 nt, hsa; identical to SEQ ID NO: 720088

SEQ ID NO: 720138 - RNA, 64 nt, hsa; identical to SEQ ID NO: 720089

SEQ ID NO: 720139 - RNA, 64 nt, hsa; identical to SEQ ID NO: 720090

SEQ ID NO: 720140 - RNA, 64 nt, hsa; identical to SEQ ID NO: 720091

SEQ ID NO: 720141 - RNA, 64 nt, hsa; identical to SEQ ID NO: 720092

SEQ ID NO: 720142 - RNA, 64 nt, hsa; identical to SEQ ID NO: 720093

SEQ ID NO: 720143 - RNA, 64 nt, hsa; identical to SEQ ID NO: 211620

SEQ ID NO: 720144 - RNA, 64 nt, hsa; identical to SEQ ID NO: 211621

SEQ ID NO: 720145 - RNA, 64 nt, hsa; identical to SEQ ID NO: 211622

SEQ ID NO: 720146 - RNA, 64 nt, hsa; identical to SEQ ID NO: 211623

SEQ ID NO: 720147 - RNA, 64 nt, hsa; identical to SEQ ID NO: 211624

SEQ ID NO: 720148 - RNA, 64 nt, hsa; identical to SEQ ID NO: 211625

SEQ ID NO: 720149 - RNA, 64 nt, hsa; identical to SEQ ID NO: 211626

SEQ ID NO: 720150 - RNA, 64 nt, hsa; identical to SEQ ID NO: 211627

SEQ ID NO: 720151 - RNA, 64 nt, hsa; identical to SEQ ID NO: 211628

SEQ ID NO: 720152 - RNA, 64 nt, hsa; identical to SEQ ID NO: 211629

SEQ ID NO: 720153 - RNA, 64 nt, hsa; identical to SEQ ID NO: 211630

SEQ ID NO: 720154 - RNA, 64 nt, hsa; identical to SEQ ID NO: 211631

SEQ ID NO: 720155 - RNA, 64 nt, hsa; identical to SEQ ID NO: 211632

SEQ ID NO: 720156 - RNA, 64 nt, hsa; identical to SEQ ID NO: 211633

SEQ ID NO: 720157 - RNA, 64 nt, hsa; identical to SEQ ID NO: 211634

SEQ ID NO: 720158 - RNA, 64 nt, hsa; identical to SEQ ID NO: 211635

SEQ ID NO: 720159 - RNA, 64 nt, hsa; identical to SEQ ID NO: 211636

SEQ ID NO: 720160 - RNA, 64 nt, hsa; identical to SEQ ID NO: 211637

SEQ ID NO: 720161 - RNA, 64 nt, hsa; identical to SEQ ID NO: 211638

SEQ ID NO: 720162 - RNA, 64 nt, hsa
caccagaggcugcagaaggccaagaaucaagcuagaaggccacaugucaccguggaccuuccug

SEQ ID NO: 720163 - RNA, 64 nt, hsa
ccagagaguccucuggauggcaccagaggcugcagaaggccaagaaucaagcuagaaggccaca

SEQ ID NO: 720164 - RNA, 64 nt, hsa
uaaugccagucccaggggagggugugauaguaaggaaggccacuguuagguuuccuuuagaaau

SEQ ID NO: 720165 - RNA, 64 nt, hsa
acucagugaguucaucagggccacacccaguagagaaggccaagcaaccuccacuucuucagca

SEQ ID NO: 720166 - RNA, 64 nt, hsa
gaccccuccugcucgcucuggggacccugccagggaaggccacuggguguucaccugcaaaguu

SEQ ID NO: 720167 - RNA, 64 nt, hsa
gagucacgacagugugagagcagaggcccggaaggaaggccaugaccaccacugagggcccgga

SEQ ID NO: 720168 - RNA, 64 nt, hsa
gcccuuuugagaauucaagauggcacugacacgggaaggccagcuacagguggacuccuggaau

SEQ ID NO: 720169 - RNA, 64 nt, hsa
uccaagaguauucaggucuccucuugugagauaggaaggccaugaaaacaauuagauuucaaga

SEQ ID NO: 720170 - RNA, 64 nt, hsa
gagucaggggugggaggagaaggaggaagaggaggaaggccagacuggccugcccuuucuccca

SEQ ID NO: 720171 - RNA, 64 nt, hsa
caaucaauacacacacacugcagaacccagaacagaaggccacaggcuggcacuacugcauucu

SEQ ID NO: 720172 - RNA, 64 nt, hsa
ugugcaggcagggagcacaguuugagaucaugcugaaggccaagcaggcccggaacucccaguu

SEQ ID NO: 720173 - RNA, 64 nt, hsa
agaugaugacagugaugaugaugaagaaagcaaagaaggccaagaaaguucuaguagugcugca

SEQ ID NO: 720174 - RNA, 64 nt, hsa
gcccgcccacuccuaccacaaggacuuugccucugaaggccaguggcagcaggugguggugggu

SEQ ID NO: 720175 - RNA, 64 nt, hsa
gagaggcccgggucagagcccugggggugagccugaaggccacagagaaagaaccuugcccaaa

SEQ ID NO: 720176 - RNA, 64 nt, hsa
guguggaauugcccuuugggguccuuccuuaauugaaggccaccuucucacagguuucauucug

SEQ ID NO: 720177 - RNA, 64 nt, hsa
acuucagaaucaggacacucaagcucuggcagaggaaggccaaguuacuuucauggucuuaccc

SEQ ID NO: 720178 - RNA, 64 nt, hsa
agcuccugguauggguuucucccaguucucuagggaaggccaccugcaggucacugaaacuuca

SEQ ID NO: 720179 - RNA, 64 nt, hsa
gcagugugucuccugcaugcagaaagggagcagagaaggccaggggcuuuugcuaaaaauagug

SEQ ID NO: 720180 - RNA, 64 nt, hsa
cugugaccuuagcccagcaagccaggcccuucaugaaggccaagaaggcugccaccauucccug

SEQ ID NO: 720181 - RNA, 64 nt, hsa
ccccacugccucugugugccccuuugcguccugugaaggccauugagaaaugcccagugugccc

SEQ ID NO: 720182 - RNA, 64 nt, hsa
cacacaguggccggggcugaagccacacagcccagaaggccagaaaaggcagccagauccccag

SEQ ID NO: 720183 - RNA, 64 nt, hsa
cagaugauggggucagcaggcccaggagaauuaggaaggccauggggcagccuccagucugcuc

SEQ ID NO: 720184 - RNA, 64 nt, hsa
gucuggggguaaggcuggggcuuccugggaaaaggaaggccaugagaaggcagagaaguaggcc

SEQ ID NO: 720185 - RNA, 64 nt, hsa
ccugugccagccacccccugccccacugcugaaugaaggccauuucaagcgcugcuucucacuc

SEQ ID NO: 720186 - RNA, 64 nt, hsa
uuauuuagggguauauguccccugcuugaacccugaaggccagguaaugagccauggccauugu

SEQ ID NO: 720187 - RNA, 64 nt, hsa
gaauagaggggaggugugcaggaaccagcaaugagaaggccaggaaaagaaagagcugaaaaug

SEQ ID NO: 720188 - RNA, 64 nt, hsa
gguggagugggaagggagcauugcagccuaagaagaaggccagagagggaaaaggcaggugcuu

SEQ ID NO: 720189 - RNA, 64 nt, hsa
ugguuucugggugcuagauccagcccaaaccugggaaggccagccuuguacagucugcuccucu

SEQ ID NO: 720190 - RNA, 64 nt, hsa; identical to SEQ ID NO: 124377

SEQ ID NO: 720191 - RNA, 64 nt, hsa; identical to SEQ ID NO: 124378

SEQ ID NO: 720192 - RNA, 64 nt, hsa; identical to SEQ ID NO: 124379

SEQ ID NO: 720193 - RNA, 64 nt, hsa; identical to SEQ ID NO: 124380

SEQ ID NO: 720194 - RNA, 64 nt, hsa; identical to SEQ ID NO: 124381

SEQ ID NO: 720195 - RNA, 64 nt, hsa; identical to SEQ ID NO: 124382

SEQ ID NO: 720196 - RNA, 64 nt, hsa; identical to SEQ ID NO: 124383

SEQ ID NO: 720197 - RNA, 64 nt, hsa; identical to SEQ ID NO: 124384

SEQ ID NO: 720198 - RNA, 64 nt, hsa
ccucaugcuuaggacuacccaugaauguuguggaaugcuacaccuggagaguucugguuuucca

SEQ ID NO: 720199 - RNA, 64 nt, hsa
ucacugcugcauugguguggcagcaagugaccaaaugcuacaggucuuacuauggacaccaggu

SEQ ID NO: 720200 - RNA, 64 nt, hsa
gguaucauguauggugauagguaucuagagcuuaaugcuacaugugagugacgaugauguacag

SEQ ID NO: 720201 - RNA, 64 nt, hsa
cauuuaguaagaauaccacaucaaauaagaaauaaugcuacaauuuuaagaggggagggaaggg

SEQ ID NO: 720202 - RNA, 64 nt, hsa
uuuuaaauuuucccuuaaaacacacuuuuggaauaugcuacaauauuacauguuuuuugucuuu

SEQ ID NO: 720203 - RNA, 64 nt, hsa
cccagguaucugauuauuugaugugaauagagggaugcuacagaugucauuugucucccgcccu

SEQ ID NO: 720204 - RNA, 64 nt, hsa
aagcuauaugugcauauguuauuuaauucaucuaaugcuacacaaaagcauaaaauaaugauuu

SEQ ID NO: 720205 - RNA, 64 nt, hsa
cagaaucucagacuacagcacuaaauaugcuuugaugcuacaucaaacggaauggaagcauagc

SEQ ID NO: 720206 - RNA, 64 nt, hsa
acugaucuucacuccagucacuagggacaauagaaaccugcaaaacacagauucauucguaaau

SEQ ID NO: 720207 - RNA, 64 nt, hsa
gagaaaagcagucaaguuccaaggaacugacagcaaccugcaaagaggaaaacagcaucuccuc

SEQ ID NO: 720208 - RNA, 64 nt, hsa
uuauguaaaaguaauaguaaaaugcuuacaggaaaaccugcagaguaguuagagaauauguaug

SEQ ID NO: 720209 - RNA, 64 nt, hsa
gcagguuuccuaggucugaaucugcgaguagaugaaccugcagcaagcagcguuuauggugcuu

SEQ ID NO: 720210 - RNA, 64 nt, hsa; identical to SEQ ID NO: 70765

SEQ ID NO: 720211 - RNA, 64 nt, hsa; identical to SEQ ID NO: 70766

SEQ ID NO: 720212 - RNA, 64 nt, hsa; identical to SEQ ID NO: 70767

SEQ ID NO: 720213 - RNA, 64 nt, hsa; identical to SEQ ID NO: 70768

SEQ ID NO: 720214 - RNA, 64 nt, hsa; identical to SEQ ID NO: 70769

SEQ ID NO: 720215 - RNA, 64 nt, hsa; identical to SEQ ID NO: 70770

SEQ ID NO: 720216 - RNA, 64 nt, hsa; identical to SEQ ID NO: 70771

SEQ ID NO: 720217 - RNA, 64 nt, hsa; identical to SEQ ID NO: 70772

SEQ ID NO: 720218 - RNA, 64 nt, hsa; identical to SEQ ID NO: 70773

SEQ ID NO: 720219 - RNA, 64 nt, hsa; identical to SEQ ID NO: 70774

SEQ ID NO: 720220 - RNA, 64 nt, hsa; identical to SEQ ID NO: 70775

SEQ ID NO: 720221 - RNA, 64 nt, hsa; identical to SEQ ID NO: 70776

SEQ ID NO: 720222 - RNA, 64 nt, hsa; identical to SEQ ID NO: 70777

SEQ ID NO: 720223 - RNA, 64 nt, hsa; identical to SEQ ID NO: 70778

SEQ ID NO: 720224 - RNA, 64 nt, hsa; identical to SEQ ID NO: 70779

SEQ ID NO: 720225 - RNA, 64 nt, hsa; identical to SEQ ID NO: 70780

SEQ ID NO: 720226 - RNA, 64 nt, hsa; identical to SEQ ID NO: 70781

SEQ ID NO: 720227 - RNA, 64 nt, hsa; identical to SEQ ID NO: 70782

SEQ ID NO: 720228 - RNA, 64 nt, hsa; identical to SEQ ID NO: 70783

SEQ ID NO: 720229 - RNA, 64 nt, hsa; identical to SEQ ID NO: 70784

SEQ ID NO: 720230 - RNA, 64 nt, hsa; identical to SEQ ID NO: 70785

SEQ ID NO: 720231 - RNA, 64 nt, hsa; identical to SEQ ID NO: 70786

SEQ ID NO: 720232 - RNA, 64 nt, hsa; identical to SEQ ID NO: 70787

SEQ ID NO: 720233 - RNA, 64 nt, hsa; identical to SEQ ID NO: 70788

SEQ ID NO: 720234 - RNA, 64 nt, hsa; identical to SEQ ID NO: 70789

SEQ ID NO: 720235 - RNA, 64 nt, hsa; identical to SEQ ID NO: 70790

SEQ ID NO: 720236 - RNA, 64 nt, hsa; identical to SEQ ID NO: 70791

SEQ ID NO: 720237 - RNA, 64 nt, hsa; identical to SEQ ID NO: 70792

SEQ ID NO: 720238 - RNA, 64 nt, hsa; identical to SEQ ID NO: 70793

SEQ ID NO: 720239 - RNA, 64 nt, hsa; identical to SEQ ID NO: 70794

SEQ ID NO: 720240 - RNA, 64 nt, hsa; identical to SEQ ID NO: 70795

SEQ ID NO: 720241 - RNA, 64 nt, hsa; identical to SEQ ID NO: 70796

SEQ ID NO: 720242 - RNA, 64 nt, hsa; identical to SEQ ID NO: 70797

SEQ ID NO: 720243 - RNA, 64 nt, hsa; identical to SEQ ID NO: 70798

SEQ ID NO: 720244 - RNA, 64 nt, hsa; identical to SEQ ID NO: 70799

SEQ ID NO: 720245 - RNA, 64 nt, hsa; identical to SEQ ID NO: 70800

SEQ ID NO: 720246 - RNA, 64 nt, hsa; identical to SEQ ID NO: 70801

SEQ ID NO: 720247 - RNA, 64 nt, hsa; identical to SEQ ID NO: 70802

SEQ ID NO: 720248 - RNA, 64 nt, hsa; identical to SEQ ID NO: 70803

SEQ ID NO: 720249 - RNA, 64 nt, hsa; identical to SEQ ID NO: 70804

SEQ ID NO: 720250 - RNA, 64 nt, hsa; identical to SEQ ID NO: 70805

SEQ ID NO: 720251 - RNA, 64 nt, hsa; identical to SEQ ID NO: 70806

SEQ ID NO: 720252 - RNA, 64 nt, hsa; identical to SEQ ID NO: 70807

SEQ ID NO: 720253 - RNA, 64 nt, hsa; identical to SEQ ID NO: 70808

SEQ ID NO: 720254 - RNA, 64 nt, hsa; identical to SEQ ID NO: 70809

SEQ ID NO: 720255 - RNA, 64 nt, hsa; identical to SEQ ID NO: 70810

SEQ ID NO: 720256 - RNA, 64 nt, hsa; identical to SEQ ID NO: 70811

SEQ ID NO: 720257 - RNA, 64 nt, hsa; identical to SEQ ID NO: 70812

SEQ ID NO: 720258 - RNA, 64 nt, hsa; identical to SEQ ID NO: 70813

SEQ ID NO: 720259 - RNA, 64 nt, hsa; identical to SEQ ID NO: 70814

SEQ ID NO: 720260 - RNA, 64 nt, hsa; identical to SEQ ID NO: 70814

SEQ ID NO: 720261 - RNA, 64 nt, hsa; identical to SEQ ID NO: 70816

SEQ ID NO: 720262 - RNA, 64 nt, hsa; identical to SEQ ID NO: 70817

SEQ ID NO: 720263 - RNA, 64 nt, hsa; identical to SEQ ID NO: 70818

SEQ ID NO: 720264 - RNA, 64 nt, hsa; identical to SEQ ID NO: 70819

SEQ ID NO: 720265 - RNA, 64 nt, hsa; identical to SEQ ID NO: 70820

SEQ ID NO: 720266 - RNA, 64 nt, hsa; identical to SEQ ID NO: 70821

SEQ ID NO: 720267 - RNA, 64 nt, hsa; identical to SEQ ID NO: 70822

SEQ ID NO: 720268 - RNA, 64 nt, hsa; identical to SEQ ID NO: 70823

SEQ ID NO: 720269 - RNA, 64 nt, hsa; identical to SEQ ID NO: 70824

SEQ ID NO: 720270 - RNA, 64 nt, hsa; identical to SEQ ID NO: 70825

SEQ ID NO: 720271 - RNA, 64 nt, hsa; identical to SEQ ID NO: 70826

SEQ ID NO: 720272 - RNA, 64 nt, hsa; identical to SEQ ID NO: 70827

SEQ ID NO: 720273 - RNA, 64 nt, hsa; identical to SEQ ID NO: 70828

SEQ ID NO: 720274 - RNA, 64 nt, hsa; identical to SEQ ID NO: 70829

SEQ ID NO: 720275 - RNA, 64 nt, hsa; identical to SEQ ID NO: 126265

SEQ ID NO: 720276 - RNA, 64 nt, hsa; identical to SEQ ID NO: 126266

SEQ ID NO: 720277 - RNA, 64 nt, hsa; identical to SEQ ID NO: 126267

SEQ ID NO: 720278 - RNA, 64 nt, hsa; identical to SEQ ID NO: 126268

SEQ ID NO: 720279 - RNA, 64 nt, hsa; identical to SEQ ID NO: 126269

SEQ ID NO: 720280 - RNA, 64 nt, hsa; identical to SEQ ID NO: 126270

SEQ ID NO: 720281 - RNA, 64 nt, hsa; identical to SEQ ID NO: 126271

SEQ ID NO: 720282 - RNA, 64 nt, hsa; identical to SEQ ID NO: 126272

SEQ ID NO: 720283 - RNA, 64 nt, hsa; identical to SEQ ID NO: 126273

SEQ ID NO: 720284 - RNA, 64 nt, hsa; identical to SEQ ID NO: 126274

SEQ ID NO: 720285 - RNA, 64 nt, hsa; identical to SEQ ID NO: 126275

SEQ ID NO: 720286 - RNA, 64 nt, hsa; identical to SEQ ID NO: 126276

SEQ ID NO: 720287 - RNA, 64 nt, hsa; identical to SEQ ID NO: 126277

SEQ ID NO: 720288 - RNA, 64 nt, hsa; identical to SEQ ID NO: 126278

SEQ ID NO: 720289 - RNA, 64 nt, hsa; identical to SEQ ID NO: 126279

SEQ ID NO: 720290 - RNA, 64 nt, hsa; identical to SEQ ID NO: 126280

SEQ ID NO: 720291 - RNA, 64 nt, hsa; identical to SEQ ID NO: 259689

SEQ ID NO: 720292 - RNA, 64 nt, hsa; identical to SEQ ID NO: 259690

SEQ ID NO: 720293 - RNA, 64 nt, hsa; identical to SEQ ID NO: 259691

SEQ ID NO: 720294 - RNA, 64 nt, hsa; identical to SEQ ID NO: 259692

SEQ ID NO: 720295 - RNA, 64 nt, hsa; identical to SEQ ID NO: 259693

SEQ ID NO: 720296 - RNA, 64 nt, hsa; identical to SEQ ID NO: 259694

SEQ ID NO: 720297 - RNA, 64 nt, hsa; identical to SEQ ID NO: 259695

SEQ ID NO: 720298 - RNA, 64 nt, hsa; identical to SEQ ID NO: 259696

SEQ ID NO: 720299 - RNA, 64 nt, hsa; identical to SEQ ID NO: 238243

SEQ ID NO: 720300 - RNA, 64 nt, hsa; identical to SEQ ID NO: 238244

SEQ ID NO: 720301 - RNA, 64 nt, hsa; identical to SEQ ID NO: 238245

SEQ ID NO: 720302 - RNA, 64 nt, hsa; identical to SEQ ID NO: 238246

SEQ ID NO: 720303 - RNA, 64 nt, hsa; identical to SEQ ID NO: 238247

SEQ ID NO: 720304 - RNA, 64 nt, hsa; identical to SEQ ID NO: 238248

SEQ ID NO: 720305 - RNA, 64 nt, hsa; identical to SEQ ID NO: 238249

SEQ ID NO: 720306 - RNA, 64 nt, hsa; identical to SEQ ID NO: 238250

SEQ ID NO: 720307 - RNA, 64 nt, hsa; identical to SEQ ID NO: 238251

SEQ ID NO: 720308 - RNA, 64 nt, hsa; identical to SEQ ID NO: 238252

SEQ ID NO: 720309 - RNA, 64 nt, hsa; identical to SEQ ID NO: 238253

SEQ ID NO: 720310 - RNA, 64 nt, hsa; identical to SEQ ID NO: 238254

SEQ ID NO: 720311 - RNA, 64 nt, hsa; identical to SEQ ID NO: 238255

SEQ ID NO: 720312 - RNA, 64 nt, hsa; identical to SEQ ID NO: 238256

SEQ ID NO: 720313 - RNA, 64 nt, hsa; identical to SEQ ID NO: 238257

SEQ ID NO: 720314 - RNA, 64 nt, hsa; identical to SEQ ID NO: 238258

SEQ ID NO: 720315 - RNA, 64 nt, hsa; identical to SEQ ID NO: 238259

SEQ ID NO: 720316 - RNA, 64 nt, hsa; identical to SEQ ID NO: 238260

SEQ ID NO: 720317 - RNA, 64 nt, hsa; identical to SEQ ID NO: 238261

SEQ ID NO: 720318 - RNA, 64 nt, hsa; identical to SEQ ID NO: 238262

SEQ ID NO: 720319 - RNA, 64 nt, hsa; identical to SEQ ID NO: 238263

SEQ ID NO: 720320 - RNA, 64 nt, hsa; identical to SEQ ID NO: 238264

SEQ ID NO: 720321 - RNA, 64 nt, hsa; identical to SEQ ID NO: 238265

SEQ ID NO: 720322 - RNA, 64 nt, hsa; identical to SEQ ID NO: 238266

SEQ ID NO: 720323 - RNA, 64 nt, hsa; identical to SEQ ID NO: 238267

SEQ ID NO: 720324 - RNA, 64 nt, hsa; identical to SEQ ID NO: 238268

SEQ ID NO: 720325 - RNA, 64 nt, hsa; identical to SEQ ID NO: 238269

SEQ ID NO: 720326 - RNA, 64 nt, hsa; identical to SEQ ID NO: 238270

SEQ ID NO: 720327 - RNA, 64 nt, hsa; identical to SEQ ID NO: 238271

SEQ ID NO: 720328 - RNA, 64 nt, hsa; identical to SEQ ID NO: 238272

SEQ ID NO: 720329 - RNA, 64 nt, hsa; identical to SEQ ID NO: 238273

SEQ ID NO: 720330 - RNA, 64 nt, hsa; identical to SEQ ID NO: 238274

SEQ ID NO: 720331 - RNA, 64 nt, hsa; identical to SEQ ID NO: 238275

SEQ ID NO: 720332 - RNA, 64 nt, hsa; identical to SEQ ID NO: 238276

SEQ ID NO: 720333 - RNA, 64 nt, hsa; identical to SEQ ID NO: 238277

SEQ ID NO: 720334 - RNA, 64 nt, hsa; identical to SEQ ID NO: 238278

SEQ ID NO: 720335 - RNA, 64 nt, hsa; identical to SEQ ID NO: 238279

SEQ ID NO: 720336 - RNA, 64 nt, hsa; identical to SEQ ID NO: 238280

SEQ ID NO: 720337 - RNA, 64 nt, hsa; identical to SEQ ID NO: 238281

SEQ ID NO: 720338 - RNA, 64 nt, hsa; identical to SEQ ID NO: 238282

SEQ ID NO: 720339 - RNA, 64 nt, hsa; identical to SEQ ID NO: 238283

SEQ ID NO: 720340 - RNA, 64 nt, hsa; identical to SEQ ID NO: 238284

SEQ ID NO: 720341 - RNA, 64 nt, hsa; identical to SEQ ID NO: 238285

SEQ ID NO: 720342 - RNA, 64 nt, hsa; identical to SEQ ID NO: 238286

SEQ ID NO: 720343 - RNA, 64 nt, hsa; identical to SEQ ID NO: 238287

SEQ ID NO: 720344 - RNA, 64 nt, hsa; identical to SEQ ID NO: 238288

SEQ ID NO: 720345 - RNA, 64 nt, hsa; identical to SEQ ID NO: 238289

SEQ ID NO: 720346 - RNA, 64 nt, hsa; identical to SEQ ID NO: 238290

SEQ ID NO: 720347 - RNA, 64 nt, hsa; identical to SEQ ID NO: 238291

SEQ ID NO: 720348 - RNA, 64 nt, hsa; identical to SEQ ID NO: 238292

SEQ ID NO: 720349 - RNA, 64 nt, hsa; identical to SEQ ID NO: 238293

SEQ ID NO: 720350 - RNA, 64 nt, hsa; identical to SEQ ID NO: 238294

SEQ ID NO: 720351 - RNA, 64 nt, hsa; identical to SEQ ID NO: 238295

SEQ ID NO: 720352 - RNA, 64 nt, hsa; identical to SEQ ID NO: 238296

SEQ ID NO: 720353 - RNA, 64 nt, hsa; identical to SEQ ID NO: 238297

SEQ ID NO: 720354 - RNA, 64 nt, hsa; identical to SEQ ID NO: 238298

SEQ ID NO: 720355 - RNA, 64 nt, hsa; identical to SEQ ID NO: 238299

SEQ ID NO: 720356 - RNA, 64 nt, hsa; identical to SEQ ID NO: 238300

SEQ ID NO: 720357 - RNA, 64 nt, hsa; identical to SEQ ID NO: 238301

SEQ ID NO: 720358 - RNA, 64 nt, hsa; identical to SEQ ID NO: 238302

SEQ ID NO: 720359 - RNA, 64 nt, hsa; identical to SEQ ID NO: 238303

SEQ ID NO: 720360 - RNA, 64 nt, hsa; identical to SEQ ID NO: 238304

SEQ ID NO: 720361 - RNA, 64 nt, hsa; identical to SEQ ID NO: 238305

SEQ ID NO: 720362 - RNA, 64 nt, hsa; identical to SEQ ID NO: 238306

SEQ ID NO: 720363 - RNA, 64 nt, hsa; identical to SEQ ID NO: 238307

SEQ ID NO: 720364 - RNA, 64 nt, hsa; identical to SEQ ID NO: 238308

SEQ ID NO: 720365 - RNA, 64 nt, hsa; identical to SEQ ID NO: 238309

SEQ ID NO: 720366 - RNA, 64 nt, hsa; identical to SEQ ID NO: 238310

SEQ ID NO: 720367 - RNA, 64 nt, hsa; identical to SEQ ID NO: 238311

SEQ ID NO: 720368 - RNA, 64 nt, hsa; identical to SEQ ID NO: 238312

SEQ ID NO: 720369 - RNA, 64 nt, hsa; identical to SEQ ID NO: 238313

SEQ ID NO: 720370 - RNA, 64 nt, hsa; identical to SEQ ID NO: 238314

SEQ ID NO: 720371 - RNA, 64 nt, hsa; identical to SEQ ID NO: 238315

SEQ ID NO: 720372 - RNA, 64 nt, hsa; identical to SEQ ID NO: 238316

SEQ ID NO: 720373 - RNA, 64 nt, hsa; identical to SEQ ID NO: 238317

SEQ ID NO: 720374 - RNA, 64 nt, hsa; identical to SEQ ID NO: 238318

SEQ ID NO: 720375 - RNA, 64 nt, hsa; identical to SEQ ID NO: 238319

SEQ ID NO: 720376 - RNA, 64 nt, hsa; identical to SEQ ID NO: 238320

SEQ ID NO: 720377 - RNA, 64 nt, hsa; identical to SEQ ID NO: 238321

SEQ ID NO: 720378 - RNA, 64 nt, hsa; identical to SEQ ID NO: 238322

SEQ ID NO: 720379 - RNA, 64 nt, hsa; identical to SEQ ID NO: 238323

SEQ ID NO: 720380 - RNA, 64 nt, hsa; identical to SEQ ID NO: 238324

SEQ ID NO: 720381 - RNA, 64 nt, hsa; identical to SEQ ID NO: 238325

SEQ ID NO: 720382 - RNA, 64 nt, hsa; identical to SEQ ID NO: 238326

SEQ ID NO: 720383 - RNA, 64 nt, hsa; identical to SEQ ID NO: 238327

SEQ ID NO: 720384 - RNA, 64 nt, hsa; identical to SEQ ID NO: 238328

SEQ ID NO: 720385 - RNA, 64 nt, hsa; identical to SEQ ID NO: 238329

SEQ ID NO: 720386 - RNA, 64 nt, hsa; identical to SEQ ID NO: 238330

SEQ ID NO: 720387 - RNA, 64 nt, hsa; identical to SEQ ID NO: 238331

SEQ ID NO: 720388 - RNA, 64 nt, hsa; identical to SEQ ID NO: 238332

SEQ ID NO: 720389 - RNA, 64 nt, hsa; identical to SEQ ID NO: 238333

SEQ ID NO: 720390 - RNA, 64 nt, hsa; identical to SEQ ID NO: 238334

SEQ ID NO: 720391 - RNA, 64 nt, hsa; identical to SEQ ID NO: 238335

SEQ ID NO: 720392 - RNA, 64 nt, hsa; identical to SEQ ID NO: 238336

SEQ ID NO: 720393 - RNA, 64 nt, hsa; identical to SEQ ID NO: 238337

SEQ ID NO: 720394 - RNA, 64 nt, hsa; identical to SEQ ID NO: 238338

SEQ ID NO: 720395 - RNA, 64 nt, hsa; identical to SEQ ID NO: 238339

SEQ ID NO: 720396 - RNA, 64 nt, hsa; identical to SEQ ID NO: 238340

SEQ ID NO: 720397 - RNA, 64 nt, hsa; identical to SEQ ID NO: 238341

SEQ ID NO: 720398 - RNA, 64 nt, hsa; identical to SEQ ID NO: 238342

SEQ ID NO: 720399 - RNA, 64 nt, hsa; identical to SEQ ID NO: 238343

SEQ ID NO: 720400 - RNA, 64 nt, hsa; identical to SEQ ID NO: 238344

SEQ ID NO: 720401 - RNA, 64 nt, hsa; identical to SEQ ID NO: 238345

SEQ ID NO: 720402 - RNA, 64 nt, hsa; identical to SEQ ID NO: 238346

SEQ ID NO: 720403 - RNA, 64 nt, hsa; identical to SEQ ID NO: 238347

SEQ ID NO: 720404 - RNA, 64 nt, hsa; identical to SEQ ID NO: 238348

SEQ ID NO: 720405 - RNA, 64 nt, hsa; identical to SEQ ID NO: 238349

SEQ ID NO: 720406 - RNA, 64 nt, hsa; identical to SEQ ID NO: 238350

SEQ ID NO: 720407 - RNA, 64 nt, hsa; identical to SEQ ID NO: 238351

SEQ ID NO: 720408 - RNA, 64 nt, hsa; identical to SEQ ID NO: 238352

SEQ ID NO: 720409 - RNA, 64 nt, hsa; identical to SEQ ID NO: 238353

SEQ ID NO: 720410 - RNA, 64 nt, hsa
auacugccucuugaguaaucuuucugaaauuuaaacuugauauuuuucgcccucuugcuugaaa

SEQ ID NO: 720411 - RNA, 64 nt, hsa
acaucuuuccuucuuauucugcaaacauuagaccacuugauauucuuuaaauaugucauguacu

SEQ ID NO: 720412 - RNA, 64 nt, hsa
caucuucccuuuccacagauaacuucuguuaacaacuugauaucuauuguacaagauguguuac

SEQ ID NO: 720413 - RNA, 64 nt, hsa
aaaauguuuuaauauauucuuuguuaaucugagaacuugauacugaaucguuuaugugggagaa

SEQ ID NO: 720414 - RNA, 64 nt, hsa
aagauaaaucucaacuuuaauaaguuauccugacacuugauaaaaauaaauauuugguauuuug

SEQ ID NO: 720415 - RNA, 64 nt, hsa; identical to SEQ ID NO: 22017

SEQ ID NO: 720416 - RNA, 64 nt, hsa; identical to SEQ ID NO: 22018

SEQ ID NO: 720417 - RNA, 64 nt, hsa; identical to SEQ ID NO: 22019

SEQ ID NO: 720418 - RNA, 64 nt, hsa; identical to SEQ ID NO: 22020

SEQ ID NO: 720419 - RNA, 64 nt, hsa; identical to SEQ ID NO: 22021

SEQ ID NO: 720420 - RNA, 64 nt, hsa; identical to SEQ ID NO: 22022

SEQ ID NO: 720421 - RNA, 64 nt, hsa; identical to SEQ ID NO: 22023

SEQ ID NO: 720422 - RNA, 64 nt, hsa; identical to SEQ ID NO: 22024

SEQ ID NO: 720423 - RNA, 64 nt, hsa; identical to SEQ ID NO: 22025

SEQ ID NO: 720424 - RNA, 64 nt, hsa; identical to SEQ ID NO: 22026

SEQ ID NO: 720425 - RNA, 64 nt, hsa; identical to SEQ ID NO: 22027

SEQ ID NO: 720426 - RNA, 64 nt, hsa; identical to SEQ ID NO: 22028

SEQ ID NO: 720427 - RNA, 64 nt, hsa; identical to SEQ ID NO: 22029

SEQ ID NO: 720428 - RNA, 64 nt, hsa; identical to SEQ ID NO: 22030

SEQ ID NO: 720429 - RNA, 64 nt, hsa
gguacugugccaggcacugauaagccagugguaagggaaacacagcucuaaccucaccucauuc

SEQ ID NO: 720430 - RNA, 64 nt, hsa
uauacauugagccaaguuuguauagcaagaauuugggaaacacagauggccugagauaagcagu

SEQ ID NO: 720431 - RNA, 64 nt, hsa
acucuggccccuuucucagugcuaucugaugacggggaaacaaaauuauucucugagagggaaa

SEQ ID NO: 720432 - RNA, 64 nt, hsa
caaaauuauucucugagagggaaaggacauuugagggaaacaucaaauuuccccauaaauaaau

SEQ ID NO: 720433 - RNA, 64 nt, hsa
ugacagagcguuccuuuuaucaauggcaaaucgagggaaacauaccaaugguucccaguuuuuc

SEQ ID NO: 720434 - RNA, 64 nt, hsa
cagcauguccgaaaguaaaguguugggugaaguggggaaacaggacagcagcucugcuagcuug

SEQ ID NO: 720435 - RNA, 64 nt, hsa
auucauaauccgcaggaucuguagaagacauuuugggaaacacugucuuaaauaaaaacucaau

SEQ ID NO: 720436 - RNA, 64 nt, hsa
ggggcagauuucauaacaacaucucaaaaauuuggggaaacacaacguugaaaacuuccuaaga

SEQ ID NO: 720437 - RNA, 64 nt, hsa
gggccagagaugggaaaauuucuuguucaguccggggaaacacaccuaggugcuggugaugggc

SEQ ID NO: 720438 - RNA, 64 nt, hsa
cccaaguggccugaaacaguguagggaaagaccugggaaacacuggaccaaaaaagccugaucu

SEQ ID NO: 720439 - RNA, 64 nt, hsa
caaagguaauuuuauuaccuguagaccugucuuugggaaacauuaaaggauguuugagggcagc

SEQ ID NO: 720440 - RNA, 64 nt, hsa
ccgcauggcaguuccuagguugcaguucagggaagggaaacaauaaaucucgcugaauugaaga

SEQ ID NO: 720441 - RNA, 64 nt, hsa
ucacuuguuagcugucacuaauaauggaauuaaugggaaacacuugauaaaugaaacuguaccg

SEQ ID NO: 720442 - RNA, 56 nt, hsa
ugauguauggcaaugagugagcccaugggaaacagguggagauggggaagccgucu

SEQ ID NO: 720443 - RNA, 64 nt, hsa
aacaggacagggugaaaaugcugggaauuauuaugggaaacaaaacuaucuauguucauauuuu

SEQ ID NO: 720444 - RNA, 64 nt, hsa
guugagauuuagcucauggauauauuuuuugguagggaaacauuagggucuccuuuucuuccuu

SEQ ID NO: 720445 - RNA, 64 nt, hsa
acgugcuguuccuaaucuggcacucagccccucugggaaacaucuuuuaauuagcaucucagaa

SEQ ID NO: 720446 - RNA, 64 nt, hsa
aguucccagggcacauuucuggaucagaacccaugggaaacaggagguacuaagugcaaugucu

SEQ ID NO: 720447 - RNA, 64 nt, hsa
caggcccugagcucacaggcagccaauguaaagagggaaacacagugaguuaugcaguucccag

SEQ ID NO: 720448 - RNA, 64 nt, hsa
cuuuaaucuguaagauucaugaaauucggggccagggaaacaguuuagccuuagggaagggaaa

SEQ ID NO: 720449 - RNA, 64 nt, hsa
aucuucacuacaaacacgccugagaguggcacuggggaaacauaacuccaucuacaccuuggau

SEQ ID NO: 720450 - RNA, 64 nt, hsa
gauuuuucugaagggcauacaaugaaaagugaaggggaaacacacacacacaaaaaaacaagua

SEQ ID NO: 720451 - RNA, 64 nt, hsa
gccauaccucuuaacaccucauagaacacacuuugggaaacaguggggguaggaaaacucggcc

SEQ ID NO: 720452 - RNA, 64 nt, hsa
cucugaauaaccuagccaauaucaaacgagaacagggaaacauugaagaggcaguucgcuugua

SEQ ID NO: 720453 - RNA, 64 nt, hsa
ucaguccuaccuuugcugaugccuacucuaauaugggaaacacucuaaaggagaugcaggaugu

SEQ ID NO: 720454 - RNA, 60 nt, hsa
acuuuagaggacuuauuuaagaauugcuaagggaaacaggucuuacacaaauugacacua

SEQ ID NO: 720455 - RNA, 64 nt, hsa
aagauuuuauaauauuuuuaguuaaacaagaguugggaaacagguggagaauaaugcaagagag

SEQ ID NO: 720456 - RNA, 64 nt, hsa; identical to SEQ ID NO: 625832

SEQ ID NO: 720457 - RNA, 64 nt, hsa; identical to SEQ ID NO: 625833

SEQ ID NO: 720458 - RNA, 64 nt, hsa; identical to SEQ ID NO: 625834

SEQ ID NO: 720459 - RNA, 64 nt, hsa; identical to SEQ ID NO: 625835

SEQ ID NO: 720460 - RNA, 64 nt, hsa; identical to SEQ ID NO: 625836

SEQ ID NO: 720461 - RNA, 64 nt, hsa; identical to SEQ ID NO: 625837

SEQ ID NO: 720462 - RNA, 64 nt, hsa; identical to SEQ ID NO: 625838

SEQ ID NO: 720463 - RNA, 64 nt, hsa; identical to SEQ ID NO: 625839

SEQ ID NO: 720464 - RNA, 64 nt, hsa; identical to SEQ ID NO: 625840

SEQ ID NO: 720465 - RNA, 64 nt, hsa; identical to SEQ ID NO: 625841

SEQ ID NO: 720466 - RNA, 64 nt, hsa; identical to SEQ ID NO: 625842

SEQ ID NO: 720467 - RNA, 64 nt, hsa; identical to SEQ ID NO: 625843

SEQ ID NO: 720468 - RNA, 64 nt, hsa; identical to SEQ ID NO: 625844

SEQ ID NO: 720469 - RNA, 64 nt, hsa; identical to SEQ ID NO: 625845

SEQ ID NO: 720470 - RNA, 64 nt, hsa; identical to SEQ ID NO: 625846

SEQ ID NO: 720471 - RNA, 64 nt, hsa; identical to SEQ ID NO: 625847

SEQ ID NO: 720472 - RNA, 64 nt, hsa; identical to SEQ ID NO: 625848

SEQ ID NO: 720473 - RNA, 64 nt, hsa; identical to SEQ ID NO: 625849

SEQ ID NO: 720474 - RNA, 64 nt, hsa; identical to SEQ ID NO: 625850

SEQ ID NO: 720475 - RNA, 64 nt, hsa; identical to SEQ ID NO: 625851

SEQ ID NO: 720476 - RNA, 59 nt, hsa; identical to SEQ ID NO: 625852

SEQ ID NO: 720477 - RNA, 64 nt, hsa; identical to SEQ ID NO: 625853

SEQ ID NO: 720478 - RNA, 64 nt, hsa
gccucaggccaugggucaaaccugggagggaaagagacccuacacauggccuagaaaugagaga

SEQ ID NO: 720479 - RNA, 64 nt, hsa
gaacauuccaggugaggcacuucaaaguuuccuuagacccuauaguguuaagagguauuuuaaa

SEQ ID NO: 720480 - RNA, 64 nt, hsa
gauuuuauucaagcuuucuaaauaucugugaaguagacccuagaaaauugucucguuuauuuua

SEQ ID NO: 720481 - RNA, 64 nt, hsa
ccaggaguucaagaucagccuaggcaacauagggagacccuaucccuacaaaaaauuucugaaa

SEQ ID NO: 720482 - RNA, 64 nt, hsa
aaagagcaacucagcaggacacagaacuaaaacuacuacuuacaucuaacagacacacuacaag

SEQ ID NO: 720483 - RNA, 64 nt, hsa
caggacagcauuugacuuuuauuuaaaaggcggcacuacuuauguaaaucugagcugugggaua

SEQ ID NO: 720484 - RNA, 64 nt, hsa; identical to SEQ ID NO: 544429

SEQ ID NO: 720485 - RNA, 64 nt, hsa; identical to SEQ ID NO: 544430

SEQ ID NO: 720486 - RNA, 64 nt, hsa; identical to SEQ ID NO: 544431

SEQ ID NO: 720487 - RNA, 64 nt, hsa; identical to SEQ ID NO: 544432

SEQ ID NO: 720488 - RNA, 64 nt, hsa; identical to SEQ ID NO: 544433

SEQ ID NO: 720489 - RNA, 64 nt, hsa; identical to SEQ ID NO: 544434

SEQ ID NO: 720490 - RNA, 64 nt, hsa; identical to SEQ ID NO: 544435

SEQ ID NO: 720491 - RNA, 64 nt, hsa; identical to SEQ ID NO: 544436

SEQ ID NO: 720492 - RNA, 64 nt, hsa; identical to SEQ ID NO: 544437

SEQ ID NO: 720493 - RNA, 64 nt, hsa; identical to SEQ ID NO: 544438

SEQ ID NO: 720494 - RNA, 64 nt, hsa; identical to SEQ ID NO: 544439

SEQ ID NO: 720495 - RNA, 64 nt, hsa; identical to SEQ ID NO: 544440

SEQ ID NO: 720496 - RNA, 64 nt, hsa; identical to SEQ ID NO: 544441

SEQ ID NO: 720497 - RNA, 64 nt, hsa; identical to SEQ ID NO: 544442

SEQ ID NO: 720498 - RNA, 64 nt, hsa; identical to SEQ ID NO: 537024

SEQ ID NO: 720499 - RNA, 64 nt, hsa; identical to SEQ ID NO: 537025

SEQ ID NO: 720500 - RNA, 64 nt, hsa; identical to SEQ ID NO: 537026

SEQ ID NO: 720501 - RNA, 64 nt, hsa; identical to SEQ ID NO: 537027

SEQ ID NO: 720502 - RNA, 64 nt, hsa; identical to SEQ ID NO: 282773

SEQ ID NO: 720503 - RNA, 64 nt, hsa; identical to SEQ ID NO: 282774

SEQ ID NO: 720504 - RNA, 64 nt, hsa; identical to SEQ ID NO: 282775

SEQ ID NO: 720505 - RNA, 64 nt, hsa; identical to SEQ ID NO: 282776

SEQ ID NO: 720506 - RNA, 64 nt, hsa; identical to SEQ ID NO: 282777

SEQ ID NO: 720507 - RNA, 64 nt, hsa; identical to SEQ ID NO: 282778

SEQ ID NO: 720508 - RNA, 64 nt, hsa; identical to SEQ ID NO: 282779

SEQ ID NO: 720509 - RNA, 64 nt, hsa; identical to SEQ ID NO: 282780

SEQ ID NO: 720510 - RNA, 64 nt, hsa; identical to SEQ ID NO: 282781

SEQ ID NO: 720511 - RNA, 64 nt, hsa; identical to SEQ ID NO: 282782

SEQ ID NO: 720512 - RNA, 64 nt, hsa; identical to SEQ ID NO: 282783

SEQ ID NO: 720513 - RNA, 54 nt, hsa; identical to SEQ ID NO: 282784

SEQ ID NO: 720514 - RNA, 64 nt, hsa; identical to SEQ ID NO: 282785

SEQ ID NO: 720515 - RNA, 64 nt, hsa; identical to SEQ ID NO: 282786

SEQ ID NO: 720516 - RNA, 64 nt, hsa; identical to SEQ ID NO: 282787

SEQ ID NO: 720517 - RNA, 64 nt, hsa; identical to SEQ ID NO: 282788

SEQ ID NO: 720518 - RNA, 64 nt, hsa; identical to SEQ ID NO: 282789

SEQ ID NO: 720519 - RNA, 64 nt, hsa; identical to SEQ ID NO: 282790

SEQ ID NO: 720520 - RNA, 64 nt, hsa; identical to SEQ ID NO: 282791

SEQ ID NO: 720521 - RNA, 64 nt, hsa; identical to SEQ ID NO: 282792

SEQ ID NO: 720522 - RNA, 64 nt, hsa; identical to SEQ ID NO: 282793

SEQ ID NO: 720523 - RNA, 64 nt, hsa; identical to SEQ ID NO: 282794

SEQ ID NO: 720524 - RNA, 64 nt, hsa; identical to SEQ ID NO: 282795

SEQ ID NO: 720525 - RNA, 64 nt, hsa; identical to SEQ ID NO: 282796

SEQ ID NO: 720526 - RNA, 64 nt, hsa; identical to SEQ ID NO: 282797

SEQ ID NO: 720527 - RNA, 64 nt, hsa; identical to SEQ ID NO: 282798

SEQ ID NO: 720528 - RNA, 64 nt, hsa; identical to SEQ ID NO: 282799

SEQ ID NO: 720529 - RNA, 64 nt, hsa; identical to SEQ ID NO: 282800

SEQ ID NO: 720530 - RNA, 64 nt, hsa; identical to SEQ ID NO: 282801

SEQ ID NO: 720531 - RNA, 64 nt, hsa; identical to SEQ ID NO: 282802

SEQ ID NO: 720532 - RNA, 64 nt, hsa; identical to SEQ ID NO: 282803

SEQ ID NO: 720533 - RNA, 64 nt, hsa; identical to SEQ ID NO: 282804

SEQ ID NO: 720534 - RNA, 64 nt, hsa; identical to SEQ ID NO: 282805

SEQ ID NO: 720535 - RNA, 64 nt, hsa; identical to SEQ ID NO: 282806

SEQ ID NO: 720536 - RNA, 64 nt, hsa; identical to SEQ ID NO: 282807

SEQ ID NO: 720537 - RNA, 64 nt, hsa; identical to SEQ ID NO: 282808

SEQ ID NO: 720538 - RNA, 64 nt, hsa; identical to SEQ ID NO: 282809

SEQ ID NO: 720539 - RNA, 64 nt, hsa; identical to SEQ ID NO: 282810

SEQ ID NO: 720540 - RNA, 64 nt, hsa; identical to SEQ ID NO: 282811

SEQ ID NO: 720541 - RNA, 64 nt, hsa; identical to SEQ ID NO: 282812

SEQ ID NO: 720542 - RNA, 64 nt, hsa; identical to SEQ ID NO: 282813

SEQ ID NO: 720543 - RNA, 64 nt, hsa; identical to SEQ ID NO: 282814

SEQ ID NO: 720544 - RNA, 64 nt, hsa; identical to SEQ ID NO: 282815

SEQ ID NO: 720545 - RNA, 64 nt, hsa; identical to SEQ ID NO: 282816

SEQ ID NO: 720546 - RNA, 64 nt, hsa; identical to SEQ ID NO: 282817

SEQ ID NO: 720547 - RNA, 64 nt, hsa; identical to SEQ ID NO: 282818

SEQ ID NO: 720548 - RNA, 64 nt, hsa; identical to SEQ ID NO: 282819

SEQ ID NO: 720549 - RNA, 64 nt, hsa; identical to SEQ ID NO: 282820

SEQ ID NO: 720550 - RNA, 64 nt, hsa; identical to SEQ ID NO: 282821

SEQ ID NO: 720551 - RNA, 64 nt, hsa; identical to SEQ ID NO: 282822

SEQ ID NO: 720552 - RNA, 64 nt, hsa; identical to SEQ ID NO: 282823

SEQ ID NO: 720553 - RNA, 64 nt, hsa; identical to SEQ ID NO: 282824

SEQ ID NO: 720554 - RNA, 64 nt, hsa; identical to SEQ ID NO: 282825

SEQ ID NO: 720555 - RNA, 64 nt, hsa; identical to SEQ ID NO: 282826

SEQ ID NO: 720556 - RNA, 64 nt, hsa; identical to SEQ ID NO: 282827

SEQ ID NO: 720557 - RNA, 64 nt, hsa; identical to SEQ ID NO: 282828

SEQ ID NO: 720558 - RNA, 64 nt, hsa; identical to SEQ ID NO: 282829

SEQ ID NO: 720559 - RNA, 64 nt, hsa; identical to SEQ ID NO: 282830

SEQ ID NO: 720560 - RNA, 64 nt, hsa; identical to SEQ ID NO: 282831

SEQ ID NO: 720561 - RNA, 64 nt, hsa; identical to SEQ ID NO: 282832

SEQ ID NO: 720562 - RNA, 64 nt, hsa; identical to SEQ ID NO: 282833

SEQ ID NO: 720563 - RNA, 53 nt, hsa; identical to SEQ ID NO: 282834

SEQ ID NO: 720564 - RNA, 64 nt, hsa; identical to SEQ ID NO: 282835

SEQ ID NO: 720565 - RNA, 64 nt, hsa; identical to SEQ ID NO: 282836

SEQ ID NO: 720566 - RNA, 64 nt, hsa; identical to SEQ ID NO: 282837

SEQ ID NO: 720567 - RNA, 64 nt, hsa; identical to SEQ ID NO: 282838

SEQ ID NO: 720568 - RNA, 64 nt, hsa; identical to SEQ ID NO: 282839

SEQ ID NO: 720569 - RNA, 64 nt, hsa; identical to SEQ ID NO: 282840

SEQ ID NO: 720570 - RNA, 64 nt, hsa; identical to SEQ ID NO: 282841

SEQ ID NO: 720571 - RNA, 64 nt, hsa; identical to SEQ ID NO: 282842

SEQ ID NO: 720572 - RNA, 64 nt, hsa; identical to SEQ ID NO: 282843

SEQ ID NO: 720573 - RNA, 64 nt, hsa; identical to SEQ ID NO: 282844

SEQ ID NO: 720574 - RNA, 64 nt, hsa; identical to SEQ ID NO: 282845

SEQ ID NO: 720575 - RNA, 64 nt, hsa; identical to SEQ ID NO: 282846

SEQ ID NO: 720576 - RNA, 53 nt, hsa; identical to SEQ ID NO: 282847

SEQ ID NO: 720577 - RNA, 64 nt, hsa; identical to SEQ ID NO: 282848

SEQ ID NO: 720578 - RNA, 64 nt, hsa; identical to SEQ ID NO: 282849

SEQ ID NO: 720579 - RNA, 64 nt, hsa; identical to SEQ ID NO: 282850

SEQ ID NO: 720580 - RNA, 64 nt, hsa; identical to SEQ ID NO: 282851

SEQ ID NO: 720581 - RNA, 64 nt, hsa; identical to SEQ ID NO: 282852

SEQ ID NO: 720582 - RNA, 64 nt, hsa; identical to SEQ ID NO: 282853

SEQ ID NO: 720583 - RNA, 64 nt, hsa; identical to SEQ ID NO: 282854

SEQ ID NO: 720584 - RNA, 64 nt, hsa; identical to SEQ ID NO: 282855

SEQ ID NO: 720585 - RNA, 64 nt, hsa; identical to SEQ ID NO: 282856

SEQ ID NO: 720586 - RNA, 64 nt, hsa; identical to SEQ ID NO: 282857

SEQ ID NO: 720587 - RNA, 64 nt, hsa; identical to SEQ ID NO: 282858

SEQ ID NO: 720588 - RNA, 64 nt, hsa; identical to SEQ ID NO: 282859

SEQ ID NO: 720589 - RNA, 64 nt, hsa; identical to SEQ ID NO: 282860

SEQ ID NO: 720590 - RNA, 64 nt, hsa; identical to SEQ ID NO: 282861

SEQ ID NO: 720591 - RNA, 64 nt, hsa; identical to SEQ ID NO: 282862

SEQ ID NO: 720592 - RNA, 64 nt, hsa; identical to SEQ ID NO: 282863

SEQ ID NO: 720593 - RNA, 64 nt, hsa; identical to SEQ ID NO: 282864

SEQ ID NO: 720594 - RNA, 64 nt, hsa; identical to SEQ ID NO: 282865

SEQ ID NO: 720595 - RNA, 64 nt, hsa; identical to SEQ ID NO: 282866

SEQ ID NO: 720596 - RNA, 64 nt, hsa; identical to SEQ ID NO: 282867

SEQ ID NO: 720597 - RNA, 64 nt, hsa; identical to SEQ ID NO: 282868

SEQ ID NO: 720598 - RNA, 64 nt, hsa; identical to SEQ ID NO: 282869

SEQ ID NO: 720599 - RNA, 64 nt, hsa; identical to SEQ ID NO: 282870

SEQ ID NO: 720600 - RNA, 64 nt, hsa; identical to SEQ ID NO: 282871

SEQ ID NO: 720601 - RNA, 64 nt, hsa; identical to SEQ ID NO: 282872

SEQ ID NO: 720602 - RNA, 64 nt, hsa; identical to SEQ ID NO: 282873

SEQ ID NO: 720603 - RNA, 64 nt, hsa; identical to SEQ ID NO: 282874

SEQ ID NO: 720604 - RNA, 64 nt, hsa; identical to SEQ ID NO: 282875

SEQ ID NO: 720605 - RNA, 64 nt, hsa; identical to SEQ ID NO: 282876

SEQ ID NO: 720606 - RNA, 64 nt, hsa; identical to SEQ ID NO: 282877

SEQ ID NO: 720607 - RNA, 64 nt, hsa; identical to SEQ ID NO: 282878

SEQ ID NO: 720608 - RNA, 64 nt, hsa; identical to SEQ ID NO: 282879

SEQ ID NO: 720609 - RNA, 64 nt, hsa; identical to SEQ ID NO: 282880

SEQ ID NO: 720610 - RNA, 64 nt, hsa; identical to SEQ ID NO: 282881

SEQ ID NO: 720611 - RNA, 64 nt, hsa; identical to SEQ ID NO: 282882

SEQ ID NO: 720612 - RNA, 64 nt, hsa; identical to SEQ ID NO: 282883

SEQ ID NO: 720613 - RNA, 64 nt, hsa; identical to SEQ ID NO: 282884

SEQ ID NO: 720614 - RNA, 64 nt, hsa; identical to SEQ ID NO: 282885

SEQ ID NO: 720615 - RNA, 64 nt, hsa; identical to SEQ ID NO: 282886

SEQ ID NO: 720616 - RNA, 64 nt, hsa; identical to SEQ ID NO: 282887

SEQ ID NO: 720617 - RNA, 64 nt, hsa; identical to SEQ ID NO: 282888

SEQ ID NO: 720618 - RNA, 64 nt, hsa; identical to SEQ ID NO: 282889

SEQ ID NO: 720619 - RNA, 64 nt, hsa; identical to SEQ ID NO: 282890

SEQ ID NO: 720620 - RNA, 64 nt, hsa; identical to SEQ ID NO: 282891

SEQ ID NO: 720621 - RNA, 64 nt, hsa; identical to SEQ ID NO: 282892

SEQ ID NO: 720622 - RNA, 64 nt, hsa; identical to SEQ ID NO: 282893

SEQ ID NO: 720623 - RNA, 64 nt, hsa; identical to SEQ ID NO: 282894

SEQ ID NO: 720624 - RNA, 64 nt, hsa; identical to SEQ ID NO: 282895

SEQ ID NO: 720625 - RNA, 64 nt, hsa; identical to SEQ ID NO: 282896

SEQ ID NO: 720626 - RNA, 64 nt, hsa; identical to SEQ ID NO: 282897

SEQ ID NO: 720627 - RNA, 64 nt, hsa; identical to SEQ ID NO: 282898

SEQ ID NO: 720628 - RNA, 64 nt, hsa; identical to SEQ ID NO: 282899

SEQ ID NO: 720629 - RNA, 64 nt, hsa; identical to SEQ ID NO: 282900

SEQ ID NO: 720630 - RNA, 64 nt, hsa; identical to SEQ ID NO: 282901

SEQ ID NO: 720631 - RNA, 64 nt, hsa; identical to SEQ ID NO: 282902

SEQ ID NO: 720632 - RNA, 64 nt, hsa; identical to SEQ ID NO: 282903

SEQ ID NO: 720633 - RNA, 64 nt, hsa; identical to SEQ ID NO: 282904

SEQ ID NO: 720634 - RNA, 64 nt, hsa; identical to SEQ ID NO: 282905

SEQ ID NO: 720635 - RNA, 64 nt, hsa; identical to SEQ ID NO: 282906

SEQ ID NO: 720636 - RNA, 64 nt, hsa; identical to SEQ ID NO: 282907

SEQ ID NO: 720637 - RNA, 64 nt, hsa; identical to SEQ ID NO: 282908

SEQ ID NO: 720638 - RNA, 64 nt, hsa; identical to SEQ ID NO: 282909

SEQ ID NO: 720639 - RNA, 64 nt, hsa; identical to SEQ ID NO: 282910

SEQ ID NO: 720640 - RNA, 64 nt, hsa; identical to SEQ ID NO: 282911

SEQ ID NO: 720641 - RNA, 53 nt, hsa; identical to SEQ ID NO: 615283

SEQ ID NO: 720642 - RNA, 64 nt, hsa; identical to SEQ ID NO: 615284

SEQ ID NO: 720643 - RNA, 64 nt, hsa; identical to SEQ ID NO: 615285

SEQ ID NO: 720644 - RNA, 64 nt, hsa; identical to SEQ ID NO: 615286

SEQ ID NO: 720645 - RNA, 64 nt, hsa; identical to SEQ ID NO: 615287

SEQ ID NO: 720646 - RNA, 64 nt, hsa; identical to SEQ ID NO: 615288

SEQ ID NO: 720647 - RNA, 64 nt, hsa; identical to SEQ ID NO: 615289

SEQ ID NO: 720648 - RNA, 64 nt, hsa; identical to SEQ ID NO: 615290

SEQ ID NO: 720649 - RNA, 64 nt, hsa; identical to SEQ ID NO: 615291

SEQ ID NO: 720650 - RNA, 62 nt, hsa; identical to SEQ ID NO: 615292

SEQ ID NO: 720651 - RNA, 64 nt, hsa; identical to SEQ ID NO: 615293

SEQ ID NO: 720652 - RNA, 64 nt, hsa; identical to SEQ ID NO: 615294

SEQ ID NO: 720653 - RNA, 64 nt, hsa; identical to SEQ ID NO: 615295

SEQ ID NO: 720654 - RNA, 64 nt, hsa; identical to SEQ ID NO: 615296

SEQ ID NO: 720655 - RNA, 64 nt, hsa; identical to SEQ ID NO: 615297

SEQ ID NO: 720656 - RNA, 64 nt, hsa; identical to SEQ ID NO: 615298

SEQ ID NO: 720657 - RNA, 64 nt, hsa; identical to SEQ ID NO: 615299

SEQ ID NO: 720658 - RNA, 64 nt, hsa; identical to SEQ ID NO: 615300

SEQ ID NO: 720659 - RNA, 64 nt, hsa; identical to SEQ ID NO: 615301

SEQ ID NO: 720660 - RNA, 64 nt, hsa; identical to SEQ ID NO: 615302

SEQ ID NO: 720661 - RNA, 64 nt, hsa; identical to SEQ ID NO: 615303

SEQ ID NO: 720662 - RNA, 64 nt, hsa; identical to SEQ ID NO: 615304

SEQ ID NO: 720663 - RNA, 64 nt, hsa; identical to SEQ ID NO: 615305

SEQ ID NO: 720664 - RNA, 64 nt, hsa; identical to SEQ ID NO: 615306

SEQ ID NO: 720665 - RNA, 64 nt, hsa; identical to SEQ ID NO: 615307

SEQ ID NO: 720666 - RNA, 64 nt, hsa; identical to SEQ ID NO: 615308

SEQ ID NO: 720667 - RNA, 64 nt, hsa; identical to SEQ ID NO: 615309

SEQ ID NO: 720668 - RNA, 64 nt, hsa; identical to SEQ ID NO: 615310

SEQ ID NO: 720669 - RNA, 64 nt, hsa; identical to SEQ ID NO: 615311

SEQ ID NO: 720670 - RNA, 64 nt, hsa; identical to SEQ ID NO: 559716

SEQ ID NO: 720671 - RNA, 64 nt, hsa; identical to SEQ ID NO: 559717

SEQ ID NO: 720672 - RNA, 64 nt, hsa; identical to SEQ ID NO: 559718

SEQ ID NO: 720673 - RNA, 64 nt, hsa; identical to SEQ ID NO: 559719

SEQ ID NO: 720674 - RNA, 64 nt, hsa; identical to SEQ ID NO: 559720

SEQ ID NO: 720675 - RNA, 64 nt, hsa; identical to SEQ ID NO: 559721

SEQ ID NO: 720676 - RNA, 64 nt, hsa; identical to SEQ ID NO: 559722

SEQ ID NO: 720677 - RNA, 64 nt, hsa; identical to SEQ ID NO: 559723

SEQ ID NO: 720678 - RNA, 64 nt, hsa; identical to SEQ ID NO: 559724

SEQ ID NO: 720679 - RNA, 64 nt, hsa; identical to SEQ ID NO: 559725

SEQ ID NO: 720680 - RNA, 64 nt, hsa; identical to SEQ ID NO: 559726

SEQ ID NO: 720681 - RNA, 64 nt, hsa; identical to SEQ ID NO: 68936

SEQ ID NO: 720682 - RNA, 64 nt, hsa; identical to SEQ ID NO: 68937

SEQ ID NO: 720683 - RNA, 64 nt, hsa; identical to SEQ ID NO: 68938

SEQ ID NO: 720684 - RNA, 64 nt, hsa; identical to SEQ ID NO: 68939

SEQ ID NO: 720685 - RNA, 64 nt, hsa; identical to SEQ ID NO: 68940

SEQ ID NO: 720686 - RNA, 64 nt, hsa; identical to SEQ ID NO: 68941

SEQ ID NO: 720687 - RNA, 64 nt, hsa; identical to SEQ ID NO: 68942

SEQ ID NO: 720688 - RNA, 64 nt, hsa; identical to SEQ ID NO: 68943

SEQ ID NO: 720689 - RNA, 64 nt, hsa; identical to SEQ ID NO: 68944

SEQ ID NO: 720690 - RNA, 64 nt, hsa; identical to SEQ ID NO: 68945

SEQ ID NO: 720691 - RNA, 64 nt, hsa; identical to SEQ ID NO: 68946

SEQ ID NO: 720692 - RNA, 64 nt, hsa; identical to SEQ ID NO: 68947

SEQ ID NO: 720693 - RNA, 64 nt, hsa; identical to SEQ ID NO: 68948

SEQ ID NO: 720694 - RNA, 64 nt, hsa; identical to SEQ ID NO: 68949

SEQ ID NO: 720695 - RNA, 64 nt, hsa; identical to SEQ ID NO: 68950

SEQ ID NO: 720696 - RNA, 64 nt, hsa; identical to SEQ ID NO: 68951

SEQ ID NO: 720697 - RNA, 64 nt, hsa; identical to SEQ ID NO: 68952

SEQ ID NO: 720698 - RNA, 64 nt, hsa; identical to SEQ ID NO: 68953

SEQ ID NO: 720699 - RNA, 64 nt, hsa; identical to SEQ ID NO: 68954

SEQ ID NO: 720700 - RNA, 64 nt, hsa; identical to SEQ ID NO: 68955

SEQ ID NO: 720701 - RNA, 64 nt, hsa; identical to SEQ ID NO: 68956

SEQ ID NO: 720702 - RNA, 64 nt, hsa; identical to SEQ ID NO: 68957

SEQ ID NO: 720703 - RNA, 64 nt, hsa; identical to SEQ ID NO: 68958

SEQ ID NO: 720704 - RNA, 64 nt, hsa; identical to SEQ ID NO: 68959

SEQ ID NO: 720705 - RNA, 64 nt, hsa; identical to SEQ ID NO: 68960

SEQ ID NO: 720706 - RNA, 64 nt, hsa; identical to SEQ ID NO: 68961

SEQ ID NO: 720707 - RNA, 64 nt, hsa; identical to SEQ ID NO: 68962

SEQ ID NO: 720708 - RNA, 64 nt, hsa; identical to SEQ ID NO: 68963

SEQ ID NO: 720709 - RNA, 64 nt, hsa; identical to SEQ ID NO: 68964

SEQ ID NO: 720710 - RNA, 64 nt, hsa; identical to SEQ ID NO: 68965

SEQ ID NO: 720711 - RNA, 64 nt, hsa; identical to SEQ ID NO: 68966

SEQ ID NO: 720712 - RNA, 64 nt, hsa; identical to SEQ ID NO: 68967

SEQ ID NO: 720713 - RNA, 64 nt, hsa; identical to SEQ ID NO: 68968

SEQ ID NO: 720714 - RNA, 64 nt, hsa; identical to SEQ ID NO: 68969

SEQ ID NO: 720715 - RNA, 64 nt, hsa; identical to SEQ ID NO: 68970

SEQ ID NO: 720716 - RNA, 64 nt, hsa; identical to SEQ ID NO: 68971

SEQ ID NO: 720717 - RNA, 64 nt, hsa; identical to SEQ ID NO: 68972

SEQ ID NO: 720718 - RNA, 64 nt, hsa; identical to SEQ ID NO: 68973

SEQ ID NO: 720719 - RNA, 64 nt, hsa; identical to SEQ ID NO: 68974

SEQ ID NO: 720720 - RNA, 64 nt, hsa; identical to SEQ ID NO: 68975

SEQ ID NO: 720721 - RNA, 64 nt, hsa; identical to SEQ ID NO: 68976

SEQ ID NO: 720722 - RNA, 64 nt, hsa; identical to SEQ ID NO: 68977

SEQ ID NO: 720723 - RNA, 64 nt, hsa; identical to SEQ ID NO: 68978

SEQ ID NO: 720724 - RNA, 64 nt, hsa; identical to SEQ ID NO: 68979

SEQ ID NO: 720725 - RNA, 64 nt, hsa; identical to SEQ ID NO: 68980

SEQ ID NO: 720726 - RNA, 64 nt, hsa; identical to SEQ ID NO: 68981

SEQ ID NO: 720727 - RNA, 62 nt, hsa; identical to SEQ ID NO: 68982

SEQ ID NO: 720728 - RNA, 64 nt, hsa; identical to SEQ ID NO: 68983

SEQ ID NO: 720729 - RNA, 64 nt, hsa; identical to SEQ ID NO: 68984

SEQ ID NO: 720730 - RNA, 64 nt, hsa; identical to SEQ ID NO: 68985

SEQ ID NO: 720731 - RNA, 64 nt, hsa; identical to SEQ ID NO: 68986

SEQ ID NO: 720732 - RNA, 64 nt, hsa; identical to SEQ ID NO: 68987

SEQ ID NO: 720733 - RNA, 64 nt, hsa; identical to SEQ ID NO: 68988

SEQ ID NO: 720734 - RNA, 64 nt, hsa; identical to SEQ ID NO: 68989

SEQ ID NO: 720735 - RNA, 64 nt, hsa; identical to SEQ ID NO: 68990

SEQ ID NO: 720736 - RNA, 64 nt, hsa; identical to SEQ ID NO: 68991

SEQ ID NO: 720737 - RNA, 64 nt, hsa; identical to SEQ ID NO: 68992

SEQ ID NO: 720738 - RNA, 64 nt, hsa; identical to SEQ ID NO: 68993

SEQ ID NO: 720739 - RNA, 64 nt, hsa; identical to SEQ ID NO: 68994

SEQ ID NO: 720740 - RNA, 64 nt, hsa; identical to SEQ ID NO: 68995

SEQ ID NO: 720741 - RNA, 64 nt, hsa; identical to SEQ ID NO: 68996

SEQ ID NO: 720742 - RNA, 64 nt, hsa; identical to SEQ ID NO: 68997

SEQ ID NO: 720743 - RNA, 64 nt, hsa; identical to SEQ ID NO: 68998

SEQ ID NO: 720744 - RNA, 64 nt, hsa; identical to SEQ ID NO: 68999

SEQ ID NO: 720745 - RNA, 64 nt, hsa; identical to SEQ ID NO: 69000

SEQ ID NO: 720746 - RNA, 64 nt, hsa; identical to SEQ ID NO: 69001

SEQ ID NO: 720747 - RNA, 64 nt, hsa; identical to SEQ ID NO: 69002

SEQ ID NO: 720748 - RNA, 64 nt, hsa; identical to SEQ ID NO: 69003

SEQ ID NO: 720749 - RNA, 64 nt, hsa; identical to SEQ ID NO: 69004

SEQ ID NO: 720750 - RNA, 64 nt, hsa; identical to SEQ ID NO: 69005

SEQ ID NO: 720751 - RNA, 64 nt, hsa; identical to SEQ ID NO: 69006

SEQ ID NO: 720752 - RNA, 64 nt, hsa; identical to SEQ ID NO: 69007

SEQ ID NO: 720753 - RNA, 64 nt, hsa; identical to SEQ ID NO: 69008

SEQ ID NO: 720754 - RNA, 64 nt, hsa; identical to SEQ ID NO: 69009

SEQ ID NO: 720755 - RNA, 64 nt, hsa; identical to SEQ ID NO: 69010

SEQ ID NO: 720756 - RNA, 64 nt, hsa; identical to SEQ ID NO: 69011

SEQ ID NO: 720757 - RNA, 64 nt, hsa; identical to SEQ ID NO: 69012

SEQ ID NO: 720758 - RNA, 64 nt, hsa; identical to SEQ ID NO: 69013

SEQ ID NO: 720759 - RNA, 64 nt, hsa; identical to SEQ ID NO: 69014

SEQ ID NO: 720760 - RNA, 64 nt, hsa; identical to SEQ ID NO: 69015

SEQ ID NO: 720761 - RNA, 64 nt, hsa; identical to SEQ ID NO: 69016

SEQ ID NO: 720762 - RNA, 64 nt, hsa; identical to SEQ ID NO: 69017

SEQ ID NO: 720763 - RNA, 64 nt, hsa; identical to SEQ ID NO: 69018

SEQ ID NO: 720764 - RNA, 64 nt, hsa; identical to SEQ ID NO: 69019

SEQ ID NO: 720765 - RNA, 64 nt, hsa; identical to SEQ ID NO: 69020

SEQ ID NO: 720766 - RNA, 64 nt, hsa; identical to SEQ ID NO: 69021

SEQ ID NO: 720767 - RNA, 64 nt, hsa; identical to SEQ ID NO: 69022

SEQ ID NO: 720768 - RNA, 64 nt, hsa; identical to SEQ ID NO: 69023

SEQ ID NO: 720769 - RNA, 64 nt, hsa; identical to SEQ ID NO: 69024

SEQ ID NO: 720770 - RNA, 64 nt, hsa; identical to SEQ ID NO: 69025

SEQ ID NO: 720771 - RNA, 64 nt, hsa; identical to SEQ ID NO: 69026

SEQ ID NO: 720772 - RNA, 64 nt, hsa; identical to SEQ ID NO: 69027

SEQ ID NO: 720773 - RNA, 64 nt, hsa; identical to SEQ ID NO: 69028

SEQ ID NO: 720774 - RNA, 64 nt, hsa; identical to SEQ ID NO: 69029

SEQ ID NO: 720775 - RNA, 64 nt, hsa; identical to SEQ ID NO: 69030

SEQ ID NO: 720776 - RNA, 64 nt, hsa; identical to SEQ ID NO: 69031

SEQ ID NO: 720777 - RNA, 64 nt, hsa; identical to SEQ ID NO: 69032

SEQ ID NO: 720778 - RNA, 64 nt, hsa; identical to SEQ ID NO: 69033

SEQ ID NO: 720779 - RNA, 64 nt, hsa; identical to SEQ ID NO: 69034

SEQ ID NO: 720780 - RNA, 64 nt, hsa; identical to SEQ ID NO: 69035

SEQ ID NO: 720781 - RNA, 64 nt, hsa; identical to SEQ ID NO: 69036

SEQ ID NO: 720782 - RNA, 64 nt, hsa; identical to SEQ ID NO: 69037

SEQ ID NO: 720783 - RNA, 64 nt, hsa; identical to SEQ ID NO: 69038

SEQ ID NO: 720784 - RNA, 64 nt, hsa; identical to SEQ ID NO: 69039

SEQ ID NO: 720785 - RNA, 64 nt, hsa; identical to SEQ ID NO: 69040

SEQ ID NO: 720786 - RNA, 64 nt, hsa; identical to SEQ ID NO: 69041

SEQ ID NO: 720787 - RNA, 64 nt, hsa; identical to SEQ ID NO: 69042

SEQ ID NO: 720788 - RNA, 64 nt, hsa; identical to SEQ ID NO: 69043

SEQ ID NO: 720789 - RNA, 64 nt, hsa; identical to SEQ ID NO: 69044

SEQ ID NO: 720790 - RNA, 64 nt, hsa; identical to SEQ ID NO: 69045

SEQ ID NO: 720791 - RNA, 64 nt, hsa; identical to SEQ ID NO: 69046

SEQ ID NO: 720792 - RNA, 64 nt, hsa; identical to SEQ ID NO: 69047

SEQ ID NO: 720793 - RNA, 64 nt, hsa; identical to SEQ ID NO: 69048

SEQ ID NO: 720794 - RNA, 64 nt, hsa; identical to SEQ ID NO: 69049

SEQ ID NO: 720795 - RNA, 64 nt, hsa; identical to SEQ ID NO: 69050

SEQ ID NO: 720796 - RNA, 64 nt, hsa; identical to SEQ ID NO: 69051

SEQ ID NO: 720797 - RNA, 64 nt, hsa; identical to SEQ ID NO: 69052

SEQ ID NO: 720798 - RNA, 64 nt, hsa; identical to SEQ ID NO: 69053

SEQ ID NO: 720799 - RNA, 64 nt, hsa; identical to SEQ ID NO: 69054

SEQ ID NO: 720800 - RNA, 64 nt, hsa; identical to SEQ ID NO: 69055

SEQ ID NO: 720801 - RNA, 64 nt, hsa; identical to SEQ ID NO: 69056

SEQ ID NO: 720802 - RNA, 64 nt, hsa; identical to SEQ ID NO: 69057

SEQ ID NO: 720803 - RNA, 64 nt, hsa; identical to SEQ ID NO: 69058

SEQ ID NO: 720804 - RNA, 64 nt, hsa; identical to SEQ ID NO: 69059

SEQ ID NO: 720805 - RNA, 64 nt, hsa; identical to SEQ ID NO: 69060

SEQ ID NO: 720806 - RNA, 64 nt, hsa; identical to SEQ ID NO: 69061

SEQ ID NO: 720807 - RNA, 64 nt, hsa; identical to SEQ ID NO: 69062

SEQ ID NO: 720808 - RNA, 64 nt, hsa; identical to SEQ ID NO: 69063

SEQ ID NO: 720809 - RNA, 64 nt, hsa; identical to SEQ ID NO: 69064

SEQ ID NO: 720810 - RNA, 64 nt, hsa; identical to SEQ ID NO: 69065

SEQ ID NO: 720811 - RNA, 64 nt, hsa; identical to SEQ ID NO: 69066

SEQ ID NO: 720812 - RNA, 64 nt, hsa; identical to SEQ ID NO: 69067

SEQ ID NO: 720813 - RNA, 64 nt, hsa; identical to SEQ ID NO: 69068

SEQ ID NO: 720814 - RNA, 64 nt, hsa; identical to SEQ ID NO: 69069

SEQ ID NO: 720815 - RNA, 64 nt, hsa; identical to SEQ ID NO: 69070

SEQ ID NO: 720816 - RNA, 64 nt, hsa; identical to SEQ ID NO: 69071

SEQ ID NO: 720817 - RNA, 64 nt, hsa; identical to SEQ ID NO: 69072

SEQ ID NO: 720818 - RNA, 64 nt, hsa; identical to SEQ ID NO: 69073

SEQ ID NO: 720819 - RNA, 64 nt, hsa; identical to SEQ ID NO: 69074

SEQ ID NO: 720820 - RNA, 64 nt, hsa; identical to SEQ ID NO: 69075

SEQ ID NO: 720821 - RNA, 64 nt, hsa; identical to SEQ ID NO: 69076

SEQ ID NO: 720822 - RNA, 64 nt, hsa; identical to SEQ ID NO: 69077

SEQ ID NO: 720823 - RNA, 64 nt, hsa; identical to SEQ ID NO: 69078

SEQ ID NO: 720824 - RNA, 64 nt, hsa; identical to SEQ ID NO: 69079

SEQ ID NO: 720825 - RNA, 64 nt, hsa; identical to SEQ ID NO: 69080

SEQ ID NO: 720826 - RNA, 64 nt, hsa; identical to SEQ ID NO: 69081

SEQ ID NO: 720827 - RNA, 64 nt, hsa; identical to SEQ ID NO: 69082

SEQ ID NO: 720828 - RNA, 64 nt, hsa; identical to SEQ ID NO: 69083

SEQ ID NO: 720829 - RNA, 64 nt, hsa; identical to SEQ ID NO: 69084

SEQ ID NO: 720830 - RNA, 64 nt, hsa; identical to SEQ ID NO: 69085

SEQ ID NO: 720831 - RNA, 64 nt, hsa; identical to SEQ ID NO: 69086

SEQ ID NO: 720832 - RNA, 64 nt, hsa; identical to SEQ ID NO: 69087

SEQ ID NO: 720833 - RNA, 64 nt, hsa; identical to SEQ ID NO: 69088

SEQ ID NO: 720834 - RNA, 64 nt, hsa; identical to SEQ ID NO: 69089

SEQ ID NO: 720835 - RNA, 64 nt, hsa; identical to SEQ ID NO: 69090

SEQ ID NO: 720836 - RNA, 64 nt, hsa; identical to SEQ ID NO: 69091

SEQ ID NO: 720837 - RNA, 64 nt, hsa; identical to SEQ ID NO: 69092

SEQ ID NO: 720838 - RNA, 64 nt, hsa; identical to SEQ ID NO: 69093

SEQ ID NO: 720839 - RNA, 64 nt, hsa; identical to SEQ ID NO: 88665

SEQ ID NO: 720840 - RNA, 64 nt, hsa; identical to SEQ ID NO: 88666

SEQ ID NO: 720841 - RNA, 64 nt, hsa; identical to SEQ ID NO: 88667

SEQ ID NO: 720842 - RNA, 64 nt, hsa; identical to SEQ ID NO: 88668

SEQ ID NO: 720843 - RNA, 64 nt, hsa; identical to SEQ ID NO: 88669

SEQ ID NO: 720844 - RNA, 64 nt, hsa; identical to SEQ ID NO: 88670

SEQ ID NO: 720845 - RNA, 64 nt, hsa; identical to SEQ ID NO: 88671

SEQ ID NO: 720846 - RNA, 64 nt, hsa; identical to SEQ ID NO: 88672

SEQ ID NO: 720847 - RNA, 64 nt, hsa; identical to SEQ ID NO: 88673

SEQ ID NO: 720848 - RNA, 64 nt, hsa; identical to SEQ ID NO: 88674

SEQ ID NO: 720849 - RNA, 64 nt, hsa; identical to SEQ ID NO: 88675

SEQ ID NO: 720850 - RNA, 64 nt, hsa; identical to SEQ ID NO: 88676

SEQ ID NO: 720851 - RNA, 64 nt, hsa; identical to SEQ ID NO: 88677

SEQ ID NO: 720852 - RNA, 64 nt, hsa; identical to SEQ ID NO: 88678

SEQ ID NO: 720853 - RNA, 64 nt, hsa; identical to SEQ ID NO: 88679

SEQ ID NO: 720854 - RNA, 64 nt, hsa; identical to SEQ ID NO: 88680

SEQ ID NO: 720855 - RNA, 64 nt, hsa; identical to SEQ ID NO: 88681

SEQ ID NO: 720856 - RNA, 64 nt, hsa; identical to SEQ ID NO: 88682

SEQ ID NO: 720857 - RNA, 64 nt, hsa; identical to SEQ ID NO: 88683

SEQ ID NO: 720858 - RNA, 64 nt, hsa; identical to SEQ ID NO: 88684

SEQ ID NO: 720859 - RNA, 64 nt, hsa; identical to SEQ ID NO: 88685

SEQ ID NO: 720860 - RNA, 64 nt, hsa; identical to SEQ ID NO: 88686

SEQ ID NO: 720861 - RNA, 64 nt, hsa; identical to SEQ ID NO: 88687

SEQ ID NO: 720862 - RNA, 64 nt, hsa; identical to SEQ ID NO: 88688

SEQ ID NO: 720863 - RNA, 64 nt, hsa; identical to SEQ ID NO: 88689

SEQ ID NO: 720864 - RNA, 64 nt, hsa; identical to SEQ ID NO: 88690

SEQ ID NO: 720865 - RNA, 64 nt, hsa; identical to SEQ ID NO: 88691

SEQ ID NO: 720866 - RNA, 50 nt, hsa; identical to SEQ ID NO: 88692

SEQ ID NO: 720867 - RNA, 64 nt, hsa; identical to SEQ ID NO: 88693

SEQ ID NO: 720868 - RNA, 64 nt, hsa; identical to SEQ ID NO: 88694

SEQ ID NO: 720869 - RNA, 64 nt, hsa; identical to SEQ ID NO: 88695

SEQ ID NO: 720870 - RNA, 64 nt, hsa; identical to SEQ ID NO: 88696

SEQ ID NO: 720871 - RNA, 64 nt, hsa; identical to SEQ ID NO: 88697

SEQ ID NO: 720872 - RNA, 64 nt, hsa; identical to SEQ ID NO: 88698

SEQ ID NO: 720873 - RNA, 64 nt, hsa; identical to SEQ ID NO: 88699

SEQ ID NO: 720874 - RNA, 64 nt, hsa; identical to SEQ ID NO: 88700

SEQ ID NO: 720875 - RNA, 64 nt, hsa; identical to SEQ ID NO: 88701

SEQ ID NO: 720876 - RNA, 64 nt, hsa; identical to SEQ ID NO: 88702

SEQ ID NO: 720877 - RNA, 64 nt, hsa; identical to SEQ ID NO: 88703

SEQ ID NO: 720878 - RNA, 64 nt, hsa; identical to SEQ ID NO: 88704

SEQ ID NO: 720879 - RNA, 64 nt, hsa; identical to SEQ ID NO: 88705

SEQ ID NO: 720880 - RNA, 64 nt, hsa; identical to SEQ ID NO: 88706

SEQ ID NO: 720881 - RNA, 64 nt, hsa; identical to SEQ ID NO: 88707

SEQ ID NO: 720882 - RNA, 64 nt, hsa; identical to SEQ ID NO: 88708

SEQ ID NO: 720883 - RNA, 64 nt, hsa; identical to SEQ ID NO: 88709

SEQ ID NO: 720884 - RNA, 64 nt, hsa; identical to SEQ ID NO: 88710

SEQ ID NO: 720885 - RNA, 64 nt, hsa; identical to SEQ ID NO: 88711

SEQ ID NO: 720886 - RNA, 64 nt, hsa; identical to SEQ ID NO: 88712

SEQ ID NO: 720887 - RNA, 64 nt, hsa; identical to SEQ ID NO: 88713

SEQ ID NO: 720888 - RNA, 64 nt, hsa; identical to SEQ ID NO: 88714

SEQ ID NO: 720889 - RNA, 64 nt, hsa; identical to SEQ ID NO: 88715

SEQ ID NO: 720890 - RNA, 64 nt, hsa; identical to SEQ ID NO: 88716

SEQ ID NO: 720891 - RNA, 64 nt, hsa; identical to SEQ ID NO: 88717

SEQ ID NO: 720892 - RNA, 64 nt, hsa; identical to SEQ ID NO: 88718

SEQ ID NO: 720893 - RNA, 64 nt, hsa; identical to SEQ ID NO: 88719

SEQ ID NO: 720894 - RNA, 64 nt, hsa; identical to SEQ ID NO: 88720

SEQ ID NO: 720895 - RNA, 64 nt, hsa; identical to SEQ ID NO: 88721

SEQ ID NO: 720896 - RNA, 64 nt, hsa; identical to SEQ ID NO: 88722

SEQ ID NO: 720897 - RNA, 64 nt, hsa; identical to SEQ ID NO: 88723

SEQ ID NO: 720898 - RNA, 64 nt, hsa; identical to SEQ ID NO: 88724

SEQ ID NO: 720899 - RNA, 64 nt, hsa; identical to SEQ ID NO: 88725

SEQ ID NO: 720900 - RNA, 64 nt, hsa; identical to SEQ ID NO: 88726

SEQ ID NO: 720901 - RNA, 64 nt, hsa; identical to SEQ ID NO: 88727

SEQ ID NO: 720902 - RNA, 64 nt, hsa; identical to SEQ ID NO: 88728

SEQ ID NO: 720903 - RNA, 64 nt, hsa; identical to SEQ ID NO: 88729

SEQ ID NO: 720904 - RNA, 64 nt, hsa; identical to SEQ ID NO: 88730

SEQ ID NO: 720905 - RNA, 64 nt, hsa; identical to SEQ ID NO: 88731

SEQ ID NO: 720906 - RNA, 64 nt, hsa; identical to SEQ ID NO: 88732

SEQ ID NO: 720907 - RNA, 64 nt, hsa; identical to SEQ ID NO: 88733

SEQ ID NO: 720908 - RNA, 64 nt, hsa; identical to SEQ ID NO: 88734

SEQ ID NO: 720909 - RNA, 64 nt, hsa; identical to SEQ ID NO: 88735

SEQ ID NO: 720910 - RNA, 64 nt, hsa; identical to SEQ ID NO: 88736

SEQ ID NO: 720911 - RNA, 64 nt, hsa; identical to SEQ ID NO: 88737

SEQ ID NO: 720912 - RNA, 64 nt, hsa; identical to SEQ ID NO: 88738

SEQ ID NO: 720913 - RNA, 64 nt, hsa; identical to SEQ ID NO: 88739

SEQ ID NO: 720914 - RNA, 64 nt, hsa; identical to SEQ ID NO: 88740

SEQ ID NO: 720915 - RNA, 64 nt, hsa; identical to SEQ ID NO: 88741

SEQ ID NO: 720916 - RNA, 64 nt, hsa; identical to SEQ ID NO: 88742

SEQ ID NO: 720917 - RNA, 64 nt, hsa; identical to SEQ ID NO: 88743

SEQ ID NO: 720918 - RNA, 64 nt, hsa; identical to SEQ ID NO: 88744

SEQ ID NO: 720919 - RNA, 64 nt, hsa; identical to SEQ ID NO: 88745

SEQ ID NO: 720920 - RNA, 64 nt, hsa; identical to SEQ ID NO: 88746

SEQ ID NO: 720921 - RNA, 64 nt, hsa; identical to SEQ ID NO: 88747

SEQ ID NO: 720922 - RNA, 64 nt, hsa; identical to SEQ ID NO: 88748

SEQ ID NO: 720923 - RNA, 64 nt, hsa; identical to SEQ ID NO: 88749

SEQ ID NO: 720924 - RNA, 64 nt, hsa; identical to SEQ ID NO: 88750

SEQ ID NO: 720925 - RNA, 64 nt, hsa; identical to SEQ ID NO: 88751

SEQ ID NO: 720926 - RNA, 64 nt, hsa; identical to SEQ ID NO: 88752

SEQ ID NO: 720927 - RNA, 64 nt, hsa; identical to SEQ ID NO: 88753

SEQ ID NO: 720928 - RNA, 64 nt, hsa; identical to SEQ ID NO: 88754

SEQ ID NO: 720929 - RNA, 64 nt, hsa; identical to SEQ ID NO: 88755

SEQ ID NO: 720930 - RNA, 64 nt, hsa; identical to SEQ ID NO: 88756

SEQ ID NO: 720931 - RNA, 64 nt, hsa; identical to SEQ ID NO: 88757

SEQ ID NO: 720932 - RNA, 64 nt, hsa; identical to SEQ ID NO: 88758

SEQ ID NO: 720933 - RNA, 64 nt, hsa; identical to SEQ ID NO: 88759

SEQ ID NO: 720934 - RNA, 64 nt, hsa; identical to SEQ ID NO: 88760

SEQ ID NO: 720935 - RNA, 64 nt, hsa; identical to SEQ ID NO: 88761

SEQ ID NO: 720936 - RNA, 64 nt, hsa; identical to SEQ ID NO: 88762

SEQ ID NO: 720937 - RNA, 64 nt, hsa; identical to SEQ ID NO: 88763

SEQ ID NO: 720938 - RNA, 64 nt, hsa; identical to SEQ ID NO: 88764

SEQ ID NO: 720939 - RNA, 64 nt, hsa; identical to SEQ ID NO: 88765

SEQ ID NO: 720940 - RNA, 64 nt, hsa; identical to SEQ ID NO: 78937

SEQ ID NO: 720941 - RNA, 64 nt, hsa; identical to SEQ ID NO: 78938

SEQ ID NO: 720942 - RNA, 64 nt, hsa; identical to SEQ ID NO: 78939

SEQ ID NO: 720943 - RNA, 64 nt, hsa; identical to SEQ ID NO: 78940

SEQ ID NO: 720944 - RNA, 64 nt, hsa; identical to SEQ ID NO: 78941

SEQ ID NO: 720945 - RNA, 64 nt, hsa; identical to SEQ ID NO: 78942

SEQ ID NO: 720946 - RNA, 64 nt, hsa; identical to SEQ ID NO: 78943

SEQ ID NO: 720947 - RNA, 64 nt, hsa; identical to SEQ ID NO: 78944

SEQ ID NO: 720948 - RNA, 64 nt, hsa; identical to SEQ ID NO: 78945

SEQ ID NO: 720949 - RNA, 64 nt, hsa; identical to SEQ ID NO: 78946

SEQ ID NO: 720950 - RNA, 64 nt, hsa; identical to SEQ ID NO: 78947

SEQ ID NO: 720951 - RNA, 64 nt, hsa; identical to SEQ ID NO: 78948

SEQ ID NO: 720952 - RNA, 64 nt, hsa; identical to SEQ ID NO: 78949

SEQ ID NO: 720953 - RNA, 64 nt, hsa; identical to SEQ ID NO: 78950

SEQ ID NO: 720954 - RNA, 64 nt, hsa; identical to SEQ ID NO: 78951

SEQ ID NO: 720955 - RNA, 64 nt, hsa; identical to SEQ ID NO: 78952

SEQ ID NO: 720956 - RNA, 64 nt, hsa; identical to SEQ ID NO: 78953

SEQ ID NO: 720957 - RNA, 64 nt, hsa; identical to SEQ ID NO: 78954

SEQ ID NO: 720958 - RNA, 64 nt, hsa; identical to SEQ ID NO: 78955

SEQ ID NO: 720959 - RNA, 64 nt, hsa; identical to SEQ ID NO: 78956

SEQ ID NO: 720960 - RNA, 64 nt, hsa; identical to SEQ ID NO: 78957

SEQ ID NO: 720961 - RNA, 64 nt, hsa; identical to SEQ ID NO: 78958

SEQ ID NO: 720962 - RNA, 64 nt, hsa; identical to SEQ ID NO: 78959

SEQ ID NO: 720963 - RNA, 64 nt, hsa; identical to SEQ ID NO: 78960

SEQ ID NO: 720964 - RNA, 64 nt, hsa; identical to SEQ ID NO: 78961

SEQ ID NO: 720965 - RNA, 64 nt, hsa; identical to SEQ ID NO: 78962

SEQ ID NO: 720966 - RNA, 64 nt, hsa; identical to SEQ ID NO: 78963

SEQ ID NO: 720967 - RNA, 64 nt, hsa; identical to SEQ ID NO: 78964

SEQ ID NO: 720968 - RNA, 64 nt, hsa; identical to SEQ ID NO: 78965

SEQ ID NO: 720969 - RNA, 64 nt, hsa; identical to SEQ ID NO: 78966

SEQ ID NO: 720970 - RNA, 64 nt, hsa; identical to SEQ ID NO: 78967

SEQ ID NO: 720971 - RNA, 64 nt, hsa; identical to SEQ ID NO: 78968

SEQ ID NO: 720972 - RNA, 64 nt, hsa; identical to SEQ ID NO: 78969

SEQ ID NO: 720973 - RNA, 64 nt, hsa; identical to SEQ ID NO: 78970

SEQ ID NO: 720974 - RNA, 64 nt, hsa; identical to SEQ ID NO: 78971

SEQ ID NO: 720975 - RNA, 64 nt, hsa; identical to SEQ ID NO: 78972

SEQ ID NO: 720976 - RNA, 64 nt, hsa; identical to SEQ ID NO: 78973

SEQ ID NO: 720977 - RNA, 64 nt, hsa; identical to SEQ ID NO: 78974

SEQ ID NO: 720978 - RNA, 64 nt, hsa; identical to SEQ ID NO: 78975

SEQ ID NO: 720979 - RNA, 64 nt, hsa; identical to SEQ ID NO: 78976

SEQ ID NO: 720980 - RNA, 64 nt, hsa; identical to SEQ ID NO: 78977

SEQ ID NO: 720981 - RNA, 64 nt, hsa; identical to SEQ ID NO: 78978

SEQ ID NO: 720982 - RNA, 64 nt, hsa; identical to SEQ ID NO: 78979

SEQ ID NO: 720983 - RNA, 64 nt, hsa; identical to SEQ ID NO: 78980

SEQ ID NO: 720984 - RNA, 64 nt, hsa; identical to SEQ ID NO: 78981

SEQ ID NO: 720985 - RNA, 64 nt, hsa; identical to SEQ ID NO: 78982

SEQ ID NO: 720986 - RNA, 64 nt, hsa; identical to SEQ ID NO: 78983

SEQ ID NO: 720987 - RNA, 64 nt, hsa; identical to SEQ ID NO: 78984

SEQ ID NO: 720988 - RNA, 64 nt, hsa; identical to SEQ ID NO: 78985

SEQ ID NO: 720989 - RNA, 64 nt, hsa; identical to SEQ ID NO: 78986

SEQ ID NO: 720990 - RNA, 64 nt, hsa; identical to SEQ ID NO: 78987

SEQ ID NO: 720991 - RNA, 64 nt, hsa; identical to SEQ ID NO: 78988

SEQ ID NO: 720992 - RNA, 64 nt, hsa; identical to SEQ ID NO: 78989

SEQ ID NO: 720993 - RNA, 64 nt, hsa; identical to SEQ ID NO: 78990

SEQ ID NO: 720994 - RNA, 64 nt, hsa; identical to SEQ ID NO: 78991

SEQ ID NO: 720995 - RNA, 64 nt, hsa; identical to SEQ ID NO: 78992

SEQ ID NO: 720996 - RNA, 64 nt, hsa; identical to SEQ ID NO: 78993

SEQ ID NO: 720997 - RNA, 64 nt, hsa; identical to SEQ ID NO: 78994

SEQ ID NO: 720998 - RNA, 64 nt, hsa; identical to SEQ ID NO: 78995

SEQ ID NO: 720999 - RNA, 64 nt, hsa; identical to SEQ ID NO: 78996

SEQ ID NO: 721000 - RNA, 64 nt, hsa; identical to SEQ ID NO: 78997

SEQ ID NO: 721001 - RNA, 64 nt, hsa; identical to SEQ ID NO: 78998

SEQ ID NO: 721002 - RNA, 64 nt, hsa; identical to SEQ ID NO: 78999

SEQ ID NO: 721003 - RNA, 64 nt, hsa; identical to SEQ ID NO: 79000

SEQ ID NO: 721004 - RNA, 64 nt, hsa; identical to SEQ ID NO: 79001

SEQ ID NO: 721005 - RNA, 64 nt, hsa; identical to SEQ ID NO: 79002

SEQ ID NO: 721006 - RNA, 64 nt, hsa; identical to SEQ ID NO: 79003

SEQ ID NO: 721007 - RNA, 64 nt, hsa; identical to SEQ ID NO: 79004

SEQ ID NO: 721008 - RNA, 64 nt, hsa; identical to SEQ ID NO: 79005

SEQ ID NO: 721009 - RNA, 64 nt, hsa; identical to SEQ ID NO: 79006

SEQ ID NO: 721010 - RNA, 64 nt, hsa; identical to SEQ ID NO: 79007

SEQ ID NO: 721011 - RNA, 64 nt, hsa; identical to SEQ ID NO: 79008

SEQ ID NO: 721012 - RNA, 64 nt, hsa; identical to SEQ ID NO: 79009

SEQ ID NO: 721013 - RNA, 64 nt, hsa; identical to SEQ ID NO: 79010

SEQ ID NO: 721014 - RNA, 64 nt, hsa; identical to SEQ ID NO: 79011

SEQ ID NO: 721015 - RNA, 64 nt, hsa; identical to SEQ ID NO: 79012

SEQ ID NO: 721016 - RNA, 64 nt, hsa; identical to SEQ ID NO: 79013

SEQ ID NO: 721017 - RNA, 64 nt, hsa; identical to SEQ ID NO: 79014

SEQ ID NO: 721018 - RNA, 64 nt, hsa; identical to SEQ ID NO: 79015

SEQ ID NO: 721019 - RNA, 64 nt, hsa; identical to SEQ ID NO: 79016

SEQ ID NO: 721020 - RNA, 64 nt, hsa; identical to SEQ ID NO: 79017

SEQ ID NO: 721021 - RNA, 64 nt, hsa; identical to SEQ ID NO: 79018

SEQ ID NO: 721022 - RNA, 64 nt, hsa; identical to SEQ ID NO: 79019

SEQ ID NO: 721023 - RNA, 64 nt, hsa; identical to SEQ ID NO: 79020

SEQ ID NO: 721024 - RNA, 64 nt, hsa; identical to SEQ ID NO: 79021

SEQ ID NO: 721025 - RNA, 64 nt, hsa; identical to SEQ ID NO: 79022

SEQ ID NO: 721026 - RNA, 64 nt, hsa; identical to SEQ ID NO: 79023

SEQ ID NO: 721027 - RNA, 64 nt, hsa; identical to SEQ ID NO: 79024

SEQ ID NO: 721028 - RNA, 64 nt, hsa; identical to SEQ ID NO: 79025

SEQ ID NO: 721029 - RNA, 64 nt, hsa; identical to SEQ ID NO: 79026

SEQ ID NO: 721030 - RNA, 64 nt, hsa; identical to SEQ ID NO: 79027

SEQ ID NO: 721031 - RNA, 64 nt, hsa; identical to SEQ ID NO: 79028

SEQ ID NO: 721032 - RNA, 64 nt, hsa; identical to SEQ ID NO: 79029

SEQ ID NO: 721033 - RNA, 64 nt, hsa; identical to SEQ ID NO: 79030

SEQ ID NO: 721034 - RNA, 64 nt, hsa; identical to SEQ ID NO: 79031

SEQ ID NO: 721035 - RNA, 64 nt, hsa; identical to SEQ ID NO: 79032

SEQ ID NO: 721036 - RNA, 64 nt, hsa; identical to SEQ ID NO: 79033

SEQ ID NO: 721037 - RNA, 64 nt, hsa; identical to SEQ ID NO: 79034

SEQ ID NO: 721038 - RNA, 64 nt, hsa; identical to SEQ ID NO: 79035

SEQ ID NO: 721039 - RNA, 64 nt, hsa; identical to SEQ ID NO: 79036

SEQ ID NO: 721040 - RNA, 64 nt, hsa; identical to SEQ ID NO: 79037

SEQ ID NO: 721041 - RNA, 64 nt, hsa; identical to SEQ ID NO: 79038

SEQ ID NO: 721042 - RNA, 64 nt, hsa; identical to SEQ ID NO: 79039

SEQ ID NO: 721043 - RNA, 64 nt, hsa; identical to SEQ ID NO: 79040

SEQ ID NO: 721044 - RNA, 64 nt, hsa; identical to SEQ ID NO: 79041

SEQ ID NO: 721045 - RNA, 64 nt, hsa; identical to SEQ ID NO: 79042

SEQ ID NO: 721046 - RNA, 64 nt, hsa; identical to SEQ ID NO: 79043

SEQ ID NO: 721047 - RNA, 64 nt, hsa; identical to SEQ ID NO: 79044

SEQ ID NO: 721048 - RNA, 64 nt, hsa; identical to SEQ ID NO: 79045

SEQ ID NO: 721049 - RNA, 64 nt, hsa; identical to SEQ ID NO: 79046

SEQ ID NO: 721050 - RNA, 64 nt, hsa; identical to SEQ ID NO: 79047

SEQ ID NO: 721051 - RNA, 64 nt, hsa; identical to SEQ ID NO: 79048

SEQ ID NO: 721052 - RNA, 64 nt, hsa; identical to SEQ ID NO: 79049

SEQ ID NO: 721053 - RNA, 64 nt, hsa; identical to SEQ ID NO: 79050

SEQ ID NO: 721054 - RNA, 61 nt, hsa
ucuucucagcugguccccaggcccacgggcacagggagagggacaacugcagcagugggga

SEQ ID NO: 721055 - RNA, 61 nt, hsa
ugaacaucauugaagcgugacugccugucugcagggagaaggauuccauuuuucuucucag

SEQ ID NO: 721056 - RNA, 61 nt, hsa
ugcuccuuguugggcagacaccagcggugugcagggagagaccaaguaccaucuuuaucua

SEQ ID NO: 721057 - RNA, 61 nt, hsa
ugcuuccauacagugguuucugaagcuuuugcagggagagaagauggcuuaguguuuagac

SEQ ID NO: 721058 - RNA, 61 nt, hsa
gugucucagucccuguaagucauguccuucacagggagaauuaacccuucgauauacaugg

SEQ ID NO: 721059 - RNA, 61 nt, hsa
aucagugacuuaagagagauuuucuuguauacagggagagugagauaacuuauugugaagg

SEQ ID NO: 721060 - RNA, 61 nt, hsa
ccagaaguggaugaugugggaguugacaggccagggagagggugaagcagguaucagaguc

SEQ ID NO: 721061 - RNA, 61 nt, hsa
aacaugaaaaccuccacagcaacaucgaaaccagggagaaagugauccuugcucccugcag

SEQ ID NO: 721062 - RNA, 61 nt, hsa
guuuauuuuuagagauuacagaauuuuuaaacagggagacgugugauauacucccucccuu

SEQ ID NO: 721063 - RNA, 61 nt, hsa
cuggucagucauuucagaggcagcagaugcccagggagacccaagaaagagucagguuagg

SEQ ID NO: 721064 - RNA, 61 nt, hsa
cccacaagccccuccccugggcucucccaggcagggagaauggggagagggaccuccuugu

SEQ ID NO: 721065 - RNA, 61 nt, hsa
gacauucccucaguguggggggcaggggacacagggagaggaugguugucccuggggaggg

SEQ ID NO: 721066 - RNA, 61 nt, hsa
uuagccccucagaacagggagucccaggacccagggagaguguggggacaggacagccugu

SEQ ID NO: 721067 - RNA, 61 nt, hsa
aaaaaaaacaugaauucuuuuucuggaaaaucagggagacauggguaauaauagguacuaa

SEQ ID NO: 721068 - RNA, 61 nt, hsa
caccuaggugagugcacagccugugacgcuacagggagaggcugaguaaaccgagauccag

SEQ ID NO: 721069 - RNA, 61 nt, hsa
aguucccugugcucauggagcuuacauucuacagggagaaagagauagccaauacauagga

SEQ ID NO: 721070 - RNA, 61 nt, hsa
ugagaacuugcucuacguggucaggaaagagcagggagaccaagcagagucgugggcaggg

SEQ ID NO: 721071 - RNA, 61 nt, hsa
cugucuagaugugggacucauugccccaaaccagggagaggaagagcucccacagggagag

SEQ ID NO: 721072 - RNA, 61 nt, hsa
ugccccaaaccagggagaggaagagcucccacagggagagcccaggcucucuuugcagccu

SEQ ID NO: 721073 - RNA, 61 nt, hsa
auguuuauuggcucauguggacagaaauguacagggagaauuacauuauuuuaacacacag

SEQ ID NO: 721074 - RNA, 61 nt, hsa
uuucuuguucuauggaagaggaagcugagcucagggagauaugagcuccacagccacagcu

SEQ ID NO: 721075 - RNA, 61 nt, hsa
ccagaccugcgugucagcccuuggugguggccagggagaggcgcccggugcagauggcccc

SEQ ID NO: 721076 - RNA, 61 nt, hsa
uccccgcucggggagggcccggccgagcgggcagggagagccaguccugucggcugggccc

SEQ ID NO: 721077 - RNA, 61 nt, hsa
caaacccaagaaggucuggcaaagucaggcucagggagacucugcccugcugcagaccucg

SEQ ID NO: 721078 - RNA, 61 nt, hsa
gcggccccgugggguaggagggacagagagacagggagagucagccuccacauucagaggc

SEQ ID NO: 721079 - RNA, 61 nt, hsa
auccaggacgcccugcaggacucagccuguacagggagaugaagugccccagguugggagc

SEQ ID NO: 721080 - RNA, 61 nt, hsa
ccugaacuggccacuccccagugcucccgugcagggagaggaagcacccaguuugagagug

SEQ ID NO: 721081 - RNA, 61 nt, hsa
gucaugaaggacacucugcagggugaagcaccagggagaggccucggcugucuccuguccc

SEQ ID NO: 721082 - RNA, 61 nt, hsa
ggucaucccuuccuccucuccuggaaacagacagggagaaguugagcagguaucaacuagg

SEQ ID NO: 721083 - RNA, 53 nt, hsa; identical to SEQ ID NO: 473025

SEQ ID NO: 721084 - RNA, 61 nt, hsa
ggagacuugggucggccuccugaaaugacagcagggagacuugggugaccccccuuccagg

SEQ ID NO: 721085 - RNA, 61 nt, hsa
gagcugcugugaaagccccugcacaaucagccagggagaacugggcggguuuaguggcccc

SEQ ID NO: 721086 - RNA, 61 nt, hsa
cuuaggccuacgaugccacacaaagguuguucagggagaagggggugcaggaggcagaggg

SEQ ID NO: 721087 - RNA, 61 nt, hsa
ggcuccugggcccuguucuuaggaucaguggcagggagaaacggguaucucuuuucucucu

SEQ ID NO: 721088 - RNA, 61 nt, hsa
cucugagguuuccccaagagaaccagauuggcagggagaagcauuguggggcaauuguucc

SEQ ID NO: 721089 - RNA, 61 nt, hsa
gccgaggaguucaagaccagccuggguaucacagggagaccccgucucuacaaaauaaaaa

SEQ ID NO: 721090 - RNA, 53 nt, hsa; identical to SEQ ID NO: 473032

SEQ ID NO: 721091 - RNA, 61 nt, hsa
cggugaggccugacauccuggggaagggcaacagggagaccuacaggauguuggcugcuug

SEQ ID NO: 721092 - RNA, 61 nt, hsa
cugggugguugaggggacugacauuugaggacagggagauggagcagugucauugucagug

SEQ ID NO: 721093 - RNA, 61 nt, hsa
guggcauuguuucugcuguggugggaacuggcagggagagggucaccuccacucugguugg

SEQ ID NO: 721094 - RNA, 61 nt, hsa
uggugcacucaccguccaccguuccccaaggcagggagagggaguggcccgucccugggag

SEQ ID NO: 721095 - RNA, 61 nt, hsa
ucugcggcuuaaacucaucucgcuugaagggcagggagaaacccaugaaucucaggcacgg

SEQ ID NO: 721096 - RNA, 61 nt, hsa
ucuaacaaaucuguaguaaguauacggacuccagggagagaggcugggcuucuuucucuca

SEQ ID NO: 721097 - RNA, 61 nt, hsa
gagcgagcagcguggagcucagugacagcagcagggagaaauccacugaaggaaaaaaccc

SEQ ID NO: 721098 - RNA, 61 nt, hsa
aaucagugggcacaccaagggcccugaggggcagggagaugccaccaugcuucucugucac

SEQ ID NO: 721099 - RNA, 61 nt, hsa
accucgggagugaggacgcagggguaugaggcagggagagggugugccgcucguacuccug

SEQ ID NO: 721100 - RNA, 61 nt, hsa
guguuucucuacugagccuggggucucuagccagggagaccccaucuuauucaccaugucc

SEQ ID NO: 721101 - RNA, 61 nt, hsa
uauucagggaggaggaaaaguggugcagggacagggagauggggcgcuagggguucuuagu

SEQ ID NO: 721102 - RNA, 61 nt, hsa
aaacgauggaguagccagugguaauacaaagcagggagaacagaaagguagaguuacuaag

SEQ ID NO: 721103 - RNA, 61 nt, hsa
uauacuugagaaagcacuaguggcuuguguucagggagaggagcuggcaguuuuuaaccac

SEQ ID NO: 721104 - RNA, 61 nt, hsa
gugggcaccggccccaagugcagagucaaggcagggagaggccggcuggagccaggccccc

SEQ ID NO: 721105 - RNA, 61 nt, hsa
augagucaggggcaccauggaccucacgugccagggagacuugaauguggcugucacucuu

SEQ ID NO: 721106 - RNA, 61 nt, hsa
cuggcuucuccuuuggaagugaggcauugcacagggagacguacguaucagcggccccuug

SEQ ID NO: 721107 - RNA, 61 nt, hsa
gagauggacacacugguguggauuaaccugccagggagacagagcucacaauaaaaauggc

SEQ ID NO: 721108 - RNA, 61 nt, hsa
aaccucaucuuguacuaaaggaggacacacucagggagaagaccucugugggcagggcuug

SEQ ID NO: 721109 - RNA, 61 nt, hsa
guaugggcaaagcuuuugugaucacacaccacagggagaaucugcauguggggacacugug

SEQ ID NO: 721110 - RNA, 61 nt, hsa
ggaccucacaggcaggacggcgacacuaaugcagggagagggagucuggccccagcuuuuc

SEQ ID NO: 721111 - RNA, 61 nt, hsa
ugcugccaggugacccgaggugcacucgccccagggagauggaguagacagccuggccugg

SEQ ID NO: 721112 - RNA, 61 nt, hsa
ggcagcccccagaaggaccacugcuggaucccagggagaaccugcuggcguuggcugugau

SEQ ID NO: 721113 - RNA, 61 nt, hsa
acccucccccuggagcugaugucugugacuacagggagauuagcacuucgucuagugaaac

SEQ ID NO: 721114 - RNA, 61 nt, hsa
agcugcagcuggagccugacccucccuggaacagggagaggcuggcccgugucacugccuc

SEQ ID NO: 721115 - RNA, 64 nt, hsa; identical to SEQ ID NO: 362110

SEQ ID NO: 721116 - RNA, 64 nt, hsa; identical to SEQ ID NO: 362111

SEQ ID NO: 721117 - RNA, 64 nt, hsa; identical to SEQ ID NO: 362112

SEQ ID NO: 721118 - RNA, 64 nt, hsa; identical to SEQ ID NO: 362113

SEQ ID NO: 721119 - RNA, 64 nt, hsa; identical to SEQ ID NO: 362114

SEQ ID NO: 721120 - RNA, 64 nt, hsa; identical to SEQ ID NO: 362115

SEQ ID NO: 721121 - RNA, 64 nt, hsa; identical to SEQ ID NO: 362116

SEQ ID NO: 721122 - RNA, 64 nt, hsa; identical to SEQ ID NO: 362117

SEQ ID NO: 721123 - RNA, 64 nt, hsa; identical to SEQ ID NO: 362118

SEQ ID NO: 721124 - RNA, 64 nt, hsa; identical to SEQ ID NO: 362119

SEQ ID NO: 721125 - RNA, 64 nt, hsa; identical to SEQ ID NO: 362120

SEQ ID NO: 721126 - RNA, 64 nt, hsa; identical to SEQ ID NO: 362121

SEQ ID NO: 721127 - RNA, 64 nt, hsa; identical to SEQ ID NO: 362122

SEQ ID NO: 721128 - RNA, 64 nt, hsa; identical to SEQ ID NO: 362123

SEQ ID NO: 721129 - RNA, 64 nt, hsa; identical to SEQ ID NO: 362124

SEQ ID NO: 721130 - RNA, 64 nt, hsa; identical to SEQ ID NO: 362125

SEQ ID NO: 721131 - RNA, 64 nt, hsa; identical to SEQ ID NO: 362126

SEQ ID NO: 721132 - RNA, 64 nt, hsa; identical to SEQ ID NO: 362127

SEQ ID NO: 721133 - RNA, 64 nt, hsa; identical to SEQ ID NO: 362128

SEQ ID NO: 721134 - RNA, 64 nt, hsa; identical to SEQ ID NO: 362129

SEQ ID NO: 721135 - RNA, 64 nt, hsa; identical to SEQ ID NO: 362130

SEQ ID NO: 721136 - RNA, 64 nt, hsa; identical to SEQ ID NO: 362131

SEQ ID NO: 721137 - RNA, 64 nt, hsa; identical to SEQ ID NO: 362132

SEQ ID NO: 721138 - RNA, 64 nt, hsa; identical to SEQ ID NO: 362133

SEQ ID NO: 721139 - RNA, 64 nt, hsa; identical to SEQ ID NO: 362134

SEQ ID NO: 721140 - RNA, 64 nt, hsa; identical to SEQ ID NO: 362135

SEQ ID NO: 721141 - RNA, 64 nt, hsa; identical to SEQ ID NO: 362136

SEQ ID NO: 721142 - RNA, 64 nt, hsa; identical to SEQ ID NO: 362137

SEQ ID NO: 721143 - RNA, 64 nt, hsa; identical to SEQ ID NO: 362138

SEQ ID NO: 721144 - RNA, 64 nt, hsa; identical to SEQ ID NO: 362139

SEQ ID NO: 721145 - RNA, 64 nt, hsa; identical to SEQ ID NO: 362140

SEQ ID NO: 721146 - RNA, 64 nt, hsa; identical to SEQ ID NO: 362141

SEQ ID NO: 721147 - RNA, 64 nt, hsa; identical to SEQ ID NO: 362142

SEQ ID NO: 721148 - RNA, 64 nt, hsa; identical to SEQ ID NO: 362143

SEQ ID NO: 721149 - RNA, 64 nt, hsa; identical to SEQ ID NO: 362144

SEQ ID NO: 721150 - RNA, 64 nt, hsa; identical to SEQ ID NO: 362145

SEQ ID NO: 721151 - RNA, 64 nt, hsa; identical to SEQ ID NO: 362146

SEQ ID NO: 721152 - RNA, 64 nt, hsa; identical to SEQ ID NO: 362147

SEQ ID NO: 721153 - RNA, 64 nt, hsa; identical to SEQ ID NO: 362148

SEQ ID NO: 721154 - RNA, 64 nt, hsa; identical to SEQ ID NO: 362149

SEQ ID NO: 721155 - RNA, 64 nt, hsa; identical to SEQ ID NO: 362150

SEQ ID NO: 721156 - RNA, 64 nt, hsa; identical to SEQ ID NO: 362151

SEQ ID NO: 721157 - RNA, 64 nt, hsa; identical to SEQ ID NO: 362152

SEQ ID NO: 721158 - RNA, 64 nt, hsa; identical to SEQ ID NO: 362153

SEQ ID NO: 721159 - RNA, 64 nt, hsa; identical to SEQ ID NO: 362154

SEQ ID NO: 721160 - RNA, 64 nt, hsa; identical to SEQ ID NO: 362155

SEQ ID NO: 721161 - RNA, 64 nt, hsa; identical to SEQ ID NO: 362156

SEQ ID NO: 721162 - RNA, 64 nt, hsa; identical to SEQ ID NO: 362157

SEQ ID NO: 721163 - RNA, 64 nt, hsa; identical to SEQ ID NO: 362158

SEQ ID NO: 721164 - RNA, 64 nt, hsa; identical to SEQ ID NO: 362159

SEQ ID NO: 721165 - RNA, 64 nt, hsa; identical to SEQ ID NO: 362160

SEQ ID NO: 721166 - RNA, 64 nt, hsa; identical to SEQ ID NO: 362161

SEQ ID NO: 721167 - RNA, 64 nt, hsa; identical to SEQ ID NO: 362162

SEQ ID NO: 721168 - RNA, 64 nt, hsa; identical to SEQ ID NO: 362163

SEQ ID NO: 721169 - RNA, 64 nt, hsa; identical to SEQ ID NO: 362164

SEQ ID NO: 721170 - RNA, 64 nt, hsa; identical to SEQ ID NO: 362165

SEQ ID NO: 721171 - RNA, 64 nt, hsa; identical to SEQ ID NO: 362166

SEQ ID NO: 721172 - RNA, 64 nt, hsa; identical to SEQ ID NO: 362167

SEQ ID NO: 721173 - RNA, 64 nt, hsa; identical to SEQ ID NO: 362168

SEQ ID NO: 721174 - RNA, 64 nt, hsa; identical to SEQ ID NO: 362169

SEQ ID NO: 721175 - RNA, 64 nt, hsa; identical to SEQ ID NO: 362170

SEQ ID NO: 721176 - RNA, 64 nt, hsa; identical to SEQ ID NO: 220617

SEQ ID NO: 721177 - RNA, 64 nt, hsa; identical to SEQ ID NO: 220618

SEQ ID NO: 721178 - RNA, 64 nt, hsa; identical to SEQ ID NO: 220619

SEQ ID NO: 721179 - RNA, 64 nt, hsa; identical to SEQ ID NO: 220620

SEQ ID NO: 721180 - RNA, 64 nt, hsa; identical to SEQ ID NO: 220621

SEQ ID NO: 721181 - RNA, 64 nt, hsa; identical to SEQ ID NO: 220622

SEQ ID NO: 721182 - RNA, 64 nt, hsa; identical to SEQ ID NO: 220623

SEQ ID NO: 721183 - RNA, 64 nt, hsa; identical to SEQ ID NO: 220624

SEQ ID NO: 721184 - RNA, 64 nt, hsa; identical to SEQ ID NO: 220625

SEQ ID NO: 721185 - RNA, 64 nt, hsa; identical to SEQ ID NO: 220626

SEQ ID NO: 721186 - RNA, 64 nt, hsa; identical to SEQ ID NO: 220627

SEQ ID NO: 721187 - RNA, 64 nt, hsa; identical to SEQ ID NO: 220628

SEQ ID NO: 721188 - RNA, 64 nt, hsa; identical to SEQ ID NO: 220629

SEQ ID NO: 721189 - RNA, 64 nt, hsa; identical to SEQ ID NO: 220630

SEQ ID NO: 721190 - RNA, 64 nt, hsa; identical to SEQ ID NO: 220631

SEQ ID NO: 721191 - RNA, 64 nt, hsa; identical to SEQ ID NO: 220632

SEQ ID NO: 721192 - RNA, 64 nt, hsa; identical to SEQ ID NO: 220633

SEQ ID NO: 721193 - RNA, 64 nt, hsa; identical to SEQ ID NO: 220634

SEQ ID NO: 721194 - RNA, 64 nt, hsa; identical to SEQ ID NO: 220635

SEQ ID NO: 721195 - RNA, 64 nt, hsa; identical to SEQ ID NO: 220636

SEQ ID NO: 721196 - RNA, 64 nt, hsa
agaggccugaagggacugccuacugcagcucguugccaaucacauagcuuucuauuuguuaagu

SEQ ID NO: 721197 - RNA, 64 nt, hsa
uauuuuaugcugcaagaaccaggacacacaauucgccaaucaucccaccauauaaccuucgauu

SEQ ID NO: 721198 - RNA, 64 nt, hsa
ccaucaguuguccuuacuuagaggagacagagaggccaaucaggucccagagcuugaaugcuaa

SEQ ID NO: 721199 - RNA, 64 nt, hsa
cauuuuuuuauacaaccaaccaguuucuuuucuagccaaucaucucugaagaguugcuguuucu

SEQ ID NO: 721200 - RNA, 64 nt, hsa
gccaaucagggccuugaggaggauguauccuccagccaaucagggccuggggaaucuguuggcg

SEQ ID NO: 721201 - RNA, 64 nt, hsa
ucuggccaaucaaggcuugcuggagugucucccagccaaucagggccuugaggaggauguaucc

SEQ ID NO: 721202 - RNA, 64 nt, hsa
uccgcccagccgcuaggccagggaccaucuucuggccaaucaaggcuugcuggagugucuccca

SEQ ID NO: 721203 - RNA, 64 nt, hsa
ucgggccugggccguuaucuccccacaacccccagccaaucaggacuuuccagacuuggcccug

SEQ ID NO: 721204 - RNA, 64 nt, hsa
aggugcugcuggccccuggugauccagcuucucugccaaucaugaccuguuccuuccugaaguc

SEQ ID NO: 721205 - RNA, 64 nt, hsa
gcgcugcggucgggcggagcuucuguuucucccagccaaucaugugacucaaggaaaacuuccg

SEQ ID NO: 721206 - RNA, 64 nt, hsa
ucaugcugcagcccaggggcgucugcugugccccgccaaucacgagacugggggaccggccggg

SEQ ID NO: 721207 - RNA, 64 nt, hsa
aauagcauacaaacucaauagcaaucaugacugagccaaucacuguuucucagaaaaacaaaac

SEQ ID NO: 721208 - RNA, 64 nt, hsa
uggagggcuggguuuggccugcaggcuguagcuugccaaucagugacuuaaauuguugauuuuu

SEQ ID NO: 721209 - RNA, 64 nt, hsa
uuuuugaaagucauacaacacagcuaaccauuaugccaaucaccaugcuuauuuugggaaacuc

SEQ ID NO: 721210 - RNA, 64 nt, hsa
acagauucacuggcugggucuccagucucaaauugccaaucauuugcaaagugaggaaggaucu

SEQ ID NO: 721211 - RNA, 64 nt, hsa
aggcucggccgcagagccggggcccagcgaaucacgcagagaaaucuuacagaaaacaggggug

SEQ ID NO: 721212 - RNA, 64 nt, hsa
gaauggugagggugggagucaggagacaagacagcgcagagagggcugguuagccggaaaaggc

SEQ ID NO: 721213 - RNA, 64 nt, hsa
uuuuccacccugggccccaaugccguccuuuccccgcagagacuggucuuggaaacccucagca

SEQ ID NO: 721214 - RNA, 64 nt, hsa
aagaccgagaaauuuaaagaaucggacagauggacgcagagaaccagagggcaaugugggaccu

SEQ ID NO: 721215 - RNA, 64 nt, hsa
aaggcuggagagugagggaggaggcucugcuggccgcagagaacacagggaugggagggucccu

SEQ ID NO: 721216 - RNA, 64 nt, hsa
cagugcagaggggccguggccccaugugauggugcgcagagaggaaccucuugggauucagcac

SEQ ID NO: 721217 - RNA, 64 nt, hsa
uccagcucucuuggcagggccuuuauuuaaagagcgcagagauuccuaugucucccuagugccc

SEQ ID NO: 721218 - RNA, 64 nt, hsa
gggcagugugggacccucaguucuaggacugguccgcagagaaagcacccaggagcagagcgcu

SEQ ID NO: 721219 - RNA, 64 nt, hsa
gccagacuaacugggcucaaggggugcuggaaggcgcagagauuggagugcccugcggaguugc

SEQ ID NO: 721220 - RNA, 64 nt, hsa
cucgagagcccgcgcuagagucggggaggaucugcgcagagaccgcagcaucacccaaaucggc

SEQ ID NO: 721221 - RNA, 64 nt, hsa
cuuccgagcacacauaaaagcacaaagacagagacgcagagagagagagagagccacggagagg

SEQ ID NO: 721222 - RNA, 64 nt, hsa
cucuuggucuucccaggcuggggcugaccuuccucgcagagaggccaggugcagguugggaaug

SEQ ID NO: 721223 - RNA, 64 nt, hsa
aggagggacagagaagcaagggggcugcugaaaucgcagagacuuuugcagcaucagaucugag

SEQ ID NO: 721224 - RNA, 64 nt, hsa
cuaccucgaguggcgaguccagacaccaucaccacgcagagaggggaggugggaggacaguuag

SEQ ID NO: 721225 - RNA, 64 nt, hsa
ucacaucuaaacaaaguuuagguaaaugaauuaucgcagagaaaaaccacaugagaaaauuuuu

SEQ ID NO: 721226 - RNA, 64 nt, hsa
uauccucccuuugguaccuuaauuugacuguccucgcagagaaugugaacauguguguguguug

SEQ ID NO: 721227 - RNA, 64 nt, hsa
gccucugggagccacugggccaggggccccgggucgcagagagcacguucccguuauuuauucc

SEQ ID NO: 721228 - RNA, 64 nt, hsa
ugagaggcugaacacccaaaacgccauugccuuccgcagagaccagagaucucuguacuucaag

SEQ ID NO: 721229 - RNA, 64 nt, hsa
agcuuuucccuguccugacaccaggcaagaaaagcgcagagaaaucggugucugacgauuuugg

SEQ ID NO: 721230 - RNA, 64 nt, hsa
cuaaaagugugugaaaccuacagcauauucuucacgcagagauuuucaucuauuauacuuuauc

SEQ ID NO: 721231 - RNA, 64 nt, hsa
caaucuauucauaauaaucuucaaguucaggagccgcagagacgcacaacuuuacacuuaucau

SEQ ID NO: 721232 - RNA, 64 nt, hsa
gagggaccaggcuggggucgcugcguugcugugccgcagagauccacucuguccguggagugga

SEQ ID NO: 721233 - RNA, 64 nt, hsa
guacauuugguugugcuuguggggaaaauaaaaacgcagagauccuuauauauuuauguuaaag

SEQ ID NO: 721234 - RNA, 64 nt, hsa
uaggccuuguugaaggcuucaucaggaaaugugacgcagagauugugcugcugugcuucauauu

SEQ ID NO: 721235 - RNA, 64 nt, hsa
acaagccagugcaugcauuaauacuuaguuagaccgcagagagcuggcauucacucaaaugcua

SEQ ID NO: 721236 - RNA, 64 nt, hsa
cuguaugcucagaaaacauugauuugagcauagacgcagagacugaaaaaaaaauuuacuuuga

SEQ ID NO: 721237 - RNA, 64 nt, hsa
gagagcgagcccccaaugcccggccaggcuaagccgcagagacccucucagcccccaccucagg

SEQ ID NO: 721238 - RNA, 64 nt, hsa
uacuccagcucccaacuuuuguggacugagcggccgcagagacugggucgccuuggauucccuc

SEQ ID NO: 721239 - RNA, 64 nt, hsa
uccaccccauugaugcggugacggggcggaaaggcgcagagaagcugagggcggucucugaucu

SEQ ID NO: 721240 - RNA, 64 nt, hsa
ggcguggaccgagggucccagccugcaggcuccccgcagagagcacaggaagaggcaggggcgg

SEQ ID NO: 721241 - RNA, 64 nt, hsa
aagauaagcugaguguucccaccaggaagucacgcgcagagaggagagucuuacggagggcugg

SEQ ID NO: 721242 - RNA, 64 nt, hsa
aauucuggcacuuggcugucauucggcuggccugcgcagagauuggcugugggccucaguuucc

SEQ ID NO: 721243 - RNA, 64 nt, hsa
ccaccuuggagggucugaccaucuucaccuguuccgcagagaaauguugcucuccauuauuccc

SEQ ID NO: 721244 - RNA, 64 nt, hsa
cugcagccagaggccgcacgcugcacugucgcgacgcagagaggcuucugugcaggcugggauc

SEQ ID NO: 721245 - RNA, 64 nt, hsa
gagucccgggaccauggccuccugccacacaacacgcagagaggacucaagacucccgcuggcc

SEQ ID NO: 721246 - RNA, 64 nt, hsa
aagucacgccuuggcccugacauccccacaugcccgcagagauccucuuugagugucugucuuu

SEQ ID NO: 721247 - RNA, 64 nt, hsa
gcucagucagcccucggggacgagaaaccacaagcgcagagacgcugaggcccaggcaggugaa

SEQ ID NO: 721248 - RNA, 64 nt, hsa
uaggugcugccuggcccuccccacaaugccagaccgcagagaggcucauccuguagggcaccca

SEQ ID NO: 721249 - RNA, 64 nt, hsa
ggggacugccaccuccccuugccagcugcugagccgcagagaagugacgguuccuacacaggac

SEQ ID NO: 721250 - RNA, 64 nt, hsa
uaacugcaccucacccccgcacgugugcaugacucgcagagaauauuccagcaauuguguaccc

SEQ ID NO: 721251 - RNA, 64 nt, hsa
uaucguuaagcaaauguacaauaugcucaggcaccgcagagagcugggcacgggcccaugugag

SEQ ID NO: 721252 - RNA, 64 nt, hsa
aagaacaaaaaaagagaaacccccaagccuggaacgcagagaggucuuuacugcugggauccac

SEQ ID NO: 721253 - RNA, 64 nt, hsa
ugauuguccacauuucaugauaaaaugagagcuccgcagagaauguuagccuuucuguuguaaa

SEQ ID NO: 721254 - RNA, 64 nt, hsa
ccugggugggggccggaaugagaccacaugagagcgcagagagguggguggucaggcccugaug

SEQ ID NO: 721255 - RNA, 64 nt, hsa
cagggcccgcgcggcccccgacacgccccuggggcgcagagacaccggguuggcuuggggcgcg

SEQ ID NO: 721256 - RNA, 64 nt, hsa
aacauuuuugucuauggugaacugcuguaaaugacgcagagaaaugccuaaaaaggacaggugg

SEQ ID NO: 721257 - RNA, 64 nt, hsa
gccgagagcaaggcacaaccucgaguucuuggggcgcagagaacuuaggagagaagcacggagg

SEQ ID NO: 721258 - RNA, 64 nt, hsa
cauaggaacgcugcauagaccauggaggccuuugcgcagagagcagagaggaugacuugcggcc

SEQ ID NO: 721259 - RNA, 64 nt, hsa
cacuccaccgcgaucugccugcgggggaucucagcgcagagaaguugagaggacccaugaagga

SEQ ID NO: 721260 - RNA, 64 nt, hsa
cgagaaucgucagcuguaaguaggagcuacacagcgcagagaaaauggaaccacccauccguga

SEQ ID NO: 721261 - RNA, 64 nt, hsa
augggauuccucccugcgaugcgugucuuucccacgcagagaagcccagucucuucucuggauc

SEQ ID NO: 721262 - RNA, 64 nt, hsa
cuggagggccccgugguuccuggagaaagcaggacgcagagaagaacaaaugaggcucacccac

SEQ ID NO: 721263 - RNA, 64 nt, hsa
ggugagcucugagggcaagcccugggcccagccacgcagagacccuggcugcccuggcucuugu

SEQ ID NO: 721264 - RNA, 64 nt, hsa
gcgcugucagugugaaacggugcuugccaacaaucgcagagaagcugaagaaugguuggcuguu

SEQ ID NO: 721265 - RNA, 64 nt, hsa
agacucccucauuuuaccaucaaggaaucucaagcgcagagagggagagaauucuccacaaauu

SEQ ID NO: 721266 - RNA, 64 nt, hsa
gcguuccuccgaaucccgucggcuucucgacccacgcagagaagccccgggcuuggcggcucua

SEQ ID NO: 721267 - RNA, 64 nt, hsa
accguccggcucggguccggacagccaguaaccucgcagagagugacggugucuccuugcaucc

SEQ ID NO: 721268 - RNA, 64 nt, hsa
acauguacaacuuuggucauaugagaagcaggugcgcagagaauuccuugaaagaucugagguu

SEQ ID NO: 721269 - RNA, 64 nt, hsa
cauuucacagauggggagcucagcccucgaaggccgcagagacgccucccaggcccgucugcca

SEQ ID NO: 721270 - RNA, 59 nt, hsa
acgaccaugacgagcucuagcuggaugggcgcagagaaccucaagaaggcaugaagcca

SEQ ID NO: 721271 - RNA, 64 nt, hsa
gucaugcuguuuugugugcucucuugcuaaagaccgcagagaccauaccuguugucaaagaggg

SEQ ID NO: 721272 - RNA, 64 nt, hsa
ccgaggagucugagccgggggcgcgggcgccuuccgcagagaccugcgcccacaggugcugucu

SEQ ID NO: 721273 - RNA, 64 nt, hsa
gcacagggaccgggaccgggaccgugagcgggagcgcagagagcggagccgggagcgagacaag

SEQ ID NO: 721274 - RNA, 64 nt, hsa
gcugggccccuccaggagucacagaugaggcccccgcagagacuggugaguggugacccuguca

SEQ ID NO: 721275 - RNA, 64 nt, hsa
cccugcaccccccucgucagaaguacaugaggggcgcagagaugagcacacagcuuugggcacg

SEQ ID NO: 721276 - RNA, 64 nt, hsa
gggugucauagccaucacgagcaugucacagugccgcagagauuuuguuuaugggcaguuucuc

SEQ ID NO: 721277 - RNA, 57 nt, hsa
gccacauccggggcuucuagggccucgcgcagagacucguccccaccgcccgcccgg

SEQ ID NO: 721278 - RNA, 64 nt, hsa
cucagggucugaggaggcugugacgcccuaugaccgcagagaucuagacagucguaacaguccc

SEQ ID NO: 721279 - RNA, 64 nt, hsa
cuguuggggcugauucggagagggcgccccgccgcgcagagaccagagcuccucagugccaguu

SEQ ID NO: 721280 - RNA, 64 nt, hsa
gcguuugcugcgcacagacacucagcaggggccucgcagagaugcgugcauccagcagccccuu

SEQ ID NO: 721281 - RNA, 64 nt, hsa
cguguaacacccuuccucugaucgcaccgccccucgcagagaguguaucaucuguuuuauuuuu

SEQ ID NO: 721282 - RNA, 64 nt, hsa
gcuguauuuaagacucgcguauccaguguuuugucgcagagaguuuucgcucuuaaauccuggg

SEQ ID NO: 721283 - RNA, 64 nt, hsa
uaaggggauuucuaaagcaggcaaucccuguagccgcagagaauaaacgccuucccaaaauggc

SEQ ID NO: 721284 - RNA, 64 nt, hsa
auuaacggugcuaaccccgucugcuccucccucccgcagagacuggggccuggacuggacauga

SEQ ID NO: 721285 - RNA, 64 nt, hsa
aaaggcuguccggagggcagaccaggugccuugccgcagagaaaacaccaaagucuccuguucg

SEQ ID NO: 721286 - RNA, 64 nt, hsa
gugggaagugggagggucccagccccaccaaguacgcagagacccccuugucguccuggacacc

SEQ ID NO: 721287 - RNA, 64 nt, hsa
gcugcuguggagugagguguauugguguugcagccgcagagaaaugccccaguguuauuuauuc

SEQ ID NO: 721288 - RNA, 64 nt, hsa
agaguguugcaguguauauuguaacaaccuaaaacgcagagaaguuuaauuuaauacuguuuuu

SEQ ID NO: 721289 - RNA, 64 nt, hsa
cggugguuccgcuccguggacuggaaagcuguuccgcagagaaaacugaagguacaacauguau

SEQ ID NO: 721290 - RNA, 64 nt, hsa; identical to SEQ ID NO: 189518

SEQ ID NO: 721291 - RNA, 64 nt, hsa; identical to SEQ ID NO: 189519

SEQ ID NO: 721292 - RNA, 64 nt, hsa; identical to SEQ ID NO: 189520

SEQ ID NO: 721293 - RNA, 64 nt, hsa; identical to SEQ ID NO: 189521

SEQ ID NO: 721294 - RNA, 64 nt, hsa; identical to SEQ ID NO: 189522

SEQ ID NO: 721295 - RNA, 64 nt, hsa; identical to SEQ ID NO: 189523

SEQ ID NO: 721296 - RNA, 64 nt, hsa; identical to SEQ ID NO: 189524

SEQ ID NO: 721297 - RNA, 64 nt, hsa; identical to SEQ ID NO: 189525

SEQ ID NO: 721298 - RNA, 64 nt, hsa; identical to SEQ ID NO: 189526

SEQ ID NO: 721299 - RNA, 64 nt, hsa; identical to SEQ ID NO: 189527

SEQ ID NO: 721300 - RNA, 64 nt, hsa; identical to SEQ ID NO: 189528

SEQ ID NO: 721301 - RNA, 64 nt, hsa; identical to SEQ ID NO: 189529

SEQ ID NO: 721302 - RNA, 64 nt, hsa; identical to SEQ ID NO: 189530

SEQ ID NO: 721303 - RNA, 64 nt, hsa; identical to SEQ ID NO: 720482

SEQ ID NO: 721304 - RNA, 64 nt, hsa; identical to SEQ ID NO: 720483

SEQ ID NO: 721305 - RNA, 64 nt, hsa; identical to SEQ ID NO: 310839

SEQ ID NO: 721306 - RNA, 64 nt, hsa; identical to SEQ ID NO: 310840

SEQ ID NO: 721307 - RNA, 64 nt, hsa; identical to SEQ ID NO: 310841

SEQ ID NO: 721308 - RNA, 64 nt, hsa; identical to SEQ ID NO: 310842

SEQ ID NO: 721309 - RNA, 64 nt, hsa; identical to SEQ ID NO: 310843

SEQ ID NO: 721310 - RNA, 64 nt, hsa; identical to SEQ ID NO: 310844

SEQ ID NO: 721311 - RNA, 64 nt, hsa; identical to SEQ ID NO: 310845

SEQ ID NO: 721312 - RNA, 64 nt, hsa; identical to SEQ ID NO: 310846

SEQ ID NO: 721313 - RNA, 64 nt, hsa; identical to SEQ ID NO: 310847

SEQ ID NO: 721314 - RNA, 64 nt, hsa; identical to SEQ ID NO: 310848

SEQ ID NO: 721315 - RNA, 64 nt, hsa; identical to SEQ ID NO: 310849

SEQ ID NO: 721316 - RNA, 64 nt, hsa; identical to SEQ ID NO: 310850

SEQ ID NO: 721317 - RNA, 64 nt, hsa; identical to SEQ ID NO: 310851

SEQ ID NO: 721318 - RNA, 64 nt, hsa; identical to SEQ ID NO: 310852

SEQ ID NO: 721319 - RNA, 64 nt, hsa; identical to SEQ ID NO: 310853

SEQ ID NO: 721320 - RNA, 64 nt, hsa; identical to SEQ ID NO: 310854

SEQ ID NO: 721321 - RNA, 64 nt, hsa; identical to SEQ ID NO: 310855

SEQ ID NO: 721322 - RNA, 64 nt, hsa; identical to SEQ ID NO: 310856

SEQ ID NO: 721323 - RNA, 64 nt, hsa; identical to SEQ ID NO: 310857

SEQ ID NO: 721324 - RNA, 64 nt, hsa; identical to SEQ ID NO: 310858

SEQ ID NO: 721325 - RNA, 64 nt, hsa; identical to SEQ ID NO: 310859

SEQ ID NO: 721326 - RNA, 64 nt, hsa; identical to SEQ ID NO: 310860

SEQ ID NO: 721327 - RNA, 64 nt, hsa; identical to SEQ ID NO: 97063

SEQ ID NO: 721328 - RNA, 64 nt, hsa; identical to SEQ ID NO: 97064

SEQ ID NO: 721329 - RNA, 64 nt, hsa; identical to SEQ ID NO: 97065

SEQ ID NO: 721330 - RNA, 64 nt, hsa; identical to SEQ ID NO: 97066

SEQ ID NO: 721331 - RNA, 64 nt, hsa; identical to SEQ ID NO: 97067

SEQ ID NO: 721332 - RNA, 64 nt, hsa; identical to SEQ ID NO: 97068

SEQ ID NO: 721333 - RNA, 64 nt, hsa; identical to SEQ ID NO: 97069

SEQ ID NO: 721334 - RNA, 64 nt, hsa; identical to SEQ ID NO: 97070

SEQ ID NO: 721335 - RNA, 64 nt, hsa; identical to SEQ ID NO: 97071

SEQ ID NO: 721336 - RNA, 64 nt, hsa; identical to SEQ ID NO: 97072

SEQ ID NO: 721337 - RNA, 64 nt, hsa; identical to SEQ ID NO: 97073

SEQ ID NO: 721338 - RNA, 64 nt, hsa; identical to SEQ ID NO: 97074

SEQ ID NO: 721339 - RNA, 64 nt, hsa; identical to SEQ ID NO: 97075

SEQ ID NO: 721340 - RNA, 64 nt, hsa; identical to SEQ ID NO: 97076

SEQ ID NO: 721341 - RNA, 64 nt, hsa; identical to SEQ ID NO: 97077

SEQ ID NO: 721342 - RNA, 64 nt, hsa; identical to SEQ ID NO: 97078

SEQ ID NO: 721343 - RNA, 64 nt, hsa; identical to SEQ ID NO: 97079

SEQ ID NO: 721344 - RNA, 64 nt, hsa; identical to SEQ ID NO: 97080

SEQ ID NO: 721345 - RNA, 64 nt, hsa; identical to SEQ ID NO: 97081

SEQ ID NO: 721346 - RNA, 64 nt, hsa; identical to SEQ ID NO: 97082

SEQ ID NO: 721347 - RNA, 64 nt, hsa; identical to SEQ ID NO: 97083

SEQ ID NO: 721348 - RNA, 64 nt, hsa; identical to SEQ ID NO: 97084

SEQ ID NO: 721349 - RNA, 64 nt, hsa; identical to SEQ ID NO: 97085

SEQ ID NO: 721350 - RNA, 64 nt, hsa; identical to SEQ ID NO: 97086

SEQ ID NO: 721351 - RNA, 64 nt, hsa; identical to SEQ ID NO: 97087

SEQ ID NO: 721352 - RNA, 64 nt, hsa
uuccuugcuuuucuuuuuuaaaggggucuguucugcaguggagaagacauucuggugaccagac

SEQ ID NO: 721353 - RNA, 64 nt, hsa
cuugcuuuugccucugcccaaccagguugcaguagcaguggauguuagccugcaaacaacauua

SEQ ID NO: 721354 - RNA, 64 nt, hsa
cuacggccuauucucagaggauuauguaaccccugcaguggaaacugagccagcuaacuuaaaa

SEQ ID NO: 721355 - RNA, 64 nt, hsa
gggugcucuuucucugugccugcuccuuaugagugcaguggaaggaagccacacacuggucagu

SEQ ID NO: 721356 - RNA, 64 nt, hsa
ggcgcuuccuuccaggaacagucccucaggagaggcaguggaccagaagagauggcgaaacgug

SEQ ID NO: 721357 - RNA, 64 nt, hsa
aagcguucucccugccugagaugguguggccacagcaguggaaggcugcacacaggcacauucc

SEQ ID NO: 721358 - RNA, 64 nt, hsa
ucugaagcucuuggaugucauuugaucggaauaugcaguggaauaggugacucacugaaaugcc

SEQ ID NO: 721359 - RNA, 64 nt, hsa
cccaccucuugguggaggaaguugggccaacacugcaguggagauaaccaccuuugcgauaaug

SEQ ID NO: 721360 - RNA, 64 nt, hsa
cgugcagucgcggugacggggggagggccgcccggcaguggacucgcugauccugggccgcagc

SEQ ID NO: 721361 - RNA, 64 nt, hsa
gaaccaaacucacuguccccacuguggcaugagggcaguggagcaccauguuugagggcgaagg

SEQ ID NO: 721362 - RNA, 64 nt, hsa
uuccuccccaaccugcaauaaauccgcuucuccugcaguggaugagugugggugccaguccucc

SEQ ID NO: 721363 - RNA, 64 nt, hsa
auggcugggccuuuccagcccaacccacugucuugcaguggacggagagccuuggcgagggcag

SEQ ID NO: 721364 - RNA, 64 nt, hsa
acagugagacccugucucaaaaaaaaaaaaaaaggcaguggaaauagagaaguaacuuaaaggu

SEQ ID NO: 721365 - RNA, 64 nt, hsa
gcucuaaacagaucgcaucccuuggaauuagaaagcaguggagaccgggcgcagugacucacac

SEQ ID NO: 721366 - RNA, 64 nt, hsa
accugccuggugcauugcugugugaauccaggaggcaguggacaucguaggcagccacggcccc

SEQ ID NO: 721367 - RNA, 64 nt, hsa
ccaucccagucccucgccgucccucccaggucgggcaguggaggcugcugugaaaacucuggua

SEQ ID NO: 721368 - RNA, 64 nt, hsa
uggucagcgcaggccacggcccgagggggcgcccgcaguggacaggacccgcguggguugggaa

SEQ ID NO: 721369 - RNA, 64 nt, hsa
caguggacaggacccgcguggguugggaaggaaagcaguggaacuggccggaccccgccuggag

SEQ ID NO: 721370 - RNA, 64 nt, hsa
uucagcgguggaccaagcacugguguuggcuucugcaguggaccaagcaccaguggcuucagcg

SEQ ID NO: 721371 - RNA, 64 nt, hsa
uuuggugguggaccgagcaccagugcuggcuuuggcaguggagccgccagucuuggugccugug

SEQ ID NO: 721372 - RNA, 64 nt, hsa
ggaggccagguguccccagaccucuaacccuugccccuagcagccucuucuuuguggagccucu

SEQ ID NO: 721373 - RNA, 64 nt, hsa
ccagacuucccauuuuacuuucugcaagcuguuucccuagcagcucccucuaggggagagguga

SEQ ID NO: 721374 - RNA, 64 nt, hsa
cacugaaauccuuaagguugaggaggcuuuauuucccuagcacuggugaagggcuucaacuguc

SEQ ID NO: 721375 - RNA, 64 nt, hsa
cucuucuuugagaagccagacugaucucugagcucccuagcacuguccucaaagaccaucugua

SEQ ID NO: 721376 - RNA, 64 nt, hsa
cuggaucaaaacugcuuugggauggaaccucgagcccuagcagugaagaagauuccauuucuug

SEQ ID NO: 721377 - RNA, 64 nt, hsa
agaggugacccucggacccgcugccguucgcgaacccuagcagaggacucagccaccgccgggg

SEQ ID NO: 721378 - RNA, 64 nt, hsa
caccacguccuugaguggaguucccugcugaagccccuagcacacacugcaugccuuaacaagu

SEQ ID NO: 721379 - RNA, 64 nt, hsa
cagucuccaaaccuggugccugugcuccuggccccccuagcaucaugcuaucccaggaguauca

SEQ ID NO: 721380 - RNA, 64 nt, hsa
gccucauaauagauguggugacucucccgguagacccuagcaaggguccuccaugguggugagg

SEQ ID NO: 721381 - RNA, 64 nt, hsa
gaagggcaggagaguaccugggaaucauuacgaucccuagcagcucauccugcccuuugaauac

SEQ ID NO: 721382 - RNA, 64 nt, hsa
guccagcucagguagcucuaggagcaccauccugcccuagcagagcccaggccuugcccucaug

SEQ ID NO: 721383 - RNA, 64 nt, hsa
ccuuuccccacuauuucugccugccccauuguaccccuagcacugagacuugugccuggaagga

SEQ ID NO: 721384 - RNA, 64 nt, hsa
gagaaaaauuuucauugacucccauuguggaauucccuagcaauuuauuuagacuuaauuuuuu

SEQ ID NO: 721385 - RNA, 64 nt, hsa
guuggacuccaagcuguaacuuccuagaguugcacccuagcaaccuagccagaaaagcaagugg

SEQ ID NO: 721386 - RNA, 64 nt, hsa
agcacuguuuuggggcccucggucucucugaagacccuagcagaacugauaccuaccuguaucu

SEQ ID NO: 721387 - RNA, 64 nt, hsa
ucagagaaaugauuuucauuauugaaacuguucucccuagcaggccauuuucccuuuuuccugg

SEQ ID NO: 721388 - RNA, 64 nt, hsa
uuuuaaauuuauuucaaaaagggaaacuauuguccccuagcaaggcaugauguuaaccagaaua

SEQ ID NO: 721389 - RNA, 64 nt, hsa
uucccagaccuggggucccuuggcuuuucgaccacccuagcacuggcccuaggaggggcugagu

SEQ ID NO: 721390 - RNA, 64 nt, hsa
aauagaggcagagacuggggauauaccuuuguuucccuagcauuuuuauuuauuuauuuuuauu

SEQ ID NO: 721391 - RNA, 64 nt, hsa
auucucccuuguugcaacucuguguaccaagaaccccuagcaucagccucauuccuaagccaau

SEQ ID NO: 721392 - RNA, 64 nt, hsa
uuauaccuguugaacaacucuccauuucccuggccccuagcaaccacccuucuacccuguuucu

SEQ ID NO: 721393 - RNA, 64 nt, hsa
gggggcucccacaccacauuucccuucugcacugcccuagcagagguucucuccccugccgcug

SEQ ID NO: 721394 - RNA, 64 nt, hsa
caccugaagcacuuggaucuguucagagcugacccccuagcaacguaguugacacagcuccagg

SEQ ID NO: 721395 - RNA, 64 nt, hsa
cuagggagauggcuuucugcuuuggaucacuguucccuagcaugggucuugggucuauuggcau

SEQ ID NO: 721396 - RNA, 64 nt, hsa
auauuccaaaccugaaauccaaaacacuucuggucccuagcauuuuggauaagggauacucagc

SEQ ID NO: 721397 - RNA, 64 nt, hsa
gauucccaacaagaauuuggauggaaaaccugaucccuagcaagaagucugcucuguaucaccu

SEQ ID NO: 721398 - RNA, 64 nt, hsa
guauugcuaugcccucccauaaaaacacauugaucccuagcaagauuauugcauuccagauuuu

SEQ ID NO: 721399 - RNA, 64 nt, hsa
ugggugcugggcugcagaggccggucaguggagccccuagcacgugugaacucaggcuuuucau

SEQ ID NO: 721400 - RNA, 64 nt, hsa
gggcuuugaaaggccuuccaaacagcuccgucgccccuagcaacuccaccauugggcacugcca

SEQ ID NO: 721401 - RNA, 64 nt, hsa
acuagggugacccucauccuguucugucuacucacccuagcagcccugcccagacucuucagcc

SEQ ID NO: 721402 - RNA, 64 nt, hsa
augaagggaggagcuccaggaggcgagggaagagcccuagcagggcggccaucacaaccacuca

SEQ ID NO: 721403 - RNA, 64 nt, hsa
aacuaauuauacaaacuugaaaggguucaccuugcccuagcaaaacuaggauugggacaccuuu

SEQ ID NO: 721404 - RNA, 64 nt, hsa
auauuacaguggcugggcuguuuuuuucaguagccccuagcauuggcugggauuccuguuccug

SEQ ID NO: 721405 - RNA, 64 nt, hsa
gccagucaucacuggacacgucuccucgcagcugcccuagcaaggggagacauugugguagcua

SEQ ID NO: 721406 - RNA, 64 nt, hsa
gggcauagcgcccgccaugacacgcugcccgugccccuagcaggagcccuggugcuacccccug

SEQ ID NO: 721407 - RNA, 64 nt, hsa
uaauauccauguucaauguuuuaaaggaauaaaucccuagcaggucuuagaauuagaaacuuug

SEQ ID NO: 721408 - RNA, 64 nt, hsa
gagauaguggaaaacuguucuuauaucuucagaucccuagcagaaaugacuguuuauuucaaac

SEQ ID NO: 721409 - RNA, 64 nt, hsa
cagacuggugggguggcagauguuagccuaagaccccuagcagugccuguugcuuugugagugg

SEQ ID NO: 721410 - RNA, 50 nt, hsa
cuugggcucugggcuccugacccuagcaguguaccugucuugccagcacu

SEQ ID NO: 721411 - RNA, 64 nt, hsa
gcuccuccaggccucugcgcugcccggccugauacccuagcagguuggguauucagaggugccu

SEQ ID NO: 721412 - RNA, 64 nt, hsa
aguagagagcccccacaaaguuauuuaaaagaugcccuagcagcaauccaccaguuuuucuaag

SEQ ID NO: 721413 - RNA, 64 nt, hsa
aagaacuauguuaauuuuuuugcacauuaaaaugcccuagcaguaucuaauuaaaaaccauggu

SEQ ID NO: 721414 - RNA, 64 nt, hsa
aaaacagacaagguucugaguccugugguauguccccuagcaaauguaacuaggaacaugcacu

SEQ ID NO: 721415 - RNA, 64 nt, hsa
ugaagggccacugguccccaacaaugugaggggucccuagcagcccacccugcugcuggugcac

SEQ ID NO: 721416 - RNA, 64 nt, hsa
gcccccacuguccacuguagggucauccgcaaagcccuagcagaaugugcucacuccauuuccu

SEQ ID NO: 721417 - RNA, 64 nt, hsa
uuaguuauaaaaauauauagcgacauccucgaggcccuagcauuucuccuuggauaggggacca

SEQ ID NO: 721418 - RNA, 64 nt, hsa
ucucaccagaccaugugggaggauuuaggugaaucccuagcagauugcuucccagggcucccug

SEQ ID NO: 721419 - RNA, 64 nt, hsa
aacuucauuacuuuccuuaggcccucugccccuccccuagcauauggcucuuucuccuauugaa

SEQ ID NO: 721420 - RNA, 64 nt, hsa
ucaaccaugagguaaaagagccaaguucaaagaacccuagcacaaauuugcuuugggauuuucu

SEQ ID NO: 721421 - RNA, 64 nt, hsa
uauauuuuuuguugucguuuuaacaucuccacgucccuagcauaaaaagaaaaagaaaaaaauu

SEQ ID NO: 721422 - RNA, 64 nt, hsa
uucauuugucauucaaagcggaauaacaaguugucccuagcaaaaccgcugagcgcuuuauaau

SEQ ID NO: 721423 - RNA, 64 nt, hsa
uuugucccugaugucuuggggaagguguagaacacccuagcaguuccuauuguauauacuuggg

SEQ ID NO: 721424 - RNA, 64 nt, hsa
aaggaauuuggagauagccaaggaacaggauuuccccuagcaagcuaccuucuguucaaaucau

SEQ ID NO: 721425 - RNA, 64 nt, hsa
ugauuuggugagaggaaucguugcugcccccuuccccuagcaccauauaugagucucaaguuuu

SEQ ID NO: 721426 - RNA, 64 nt, hsa
cgguauuuuucuguuaaaauguuaaccguccuuccccuagcaaauuuaaaaacagaaagaaaau

SEQ ID NO: 721427 - RNA, 64 nt, hsa
uuuugucuauuucauauuuguccccuagagccagcccuagcaaaugugugaguugggaguaguu

SEQ ID NO: 721428 - RNA, 64 nt, hsa
aaacugcaugaaaaaucaugggccagagccucggcccuagcauugcacuuggccucaugcugga

SEQ ID NO: 721429 - RNA, 64 nt, hsa
caccuauuuucugugcacaugggagugcuccacucccuagcagagcagagggaagucucugcca

SEQ ID NO: 721430 - RNA, 64 nt, hsa
auuugauuuaaaaacauauauuaauagauguuuucccuagcagacuuuuggagcaaaaauauua

SEQ ID NO: 721431 - RNA, 64 nt, hsa
gauuguguuuguuggcacacccaccuuuucuguucccuagcaucugggauaugcaaugcuucua

SEQ ID NO: 721432 - RNA, 64 nt, hsa
cagugcaucacaucugcacacucucuucuccauucccuagcaggaacuucuagcucauuuaaca

SEQ ID NO: 721433 - RNA, 64 nt, hsa
uggguacggguaccuuguauguuuacuuuuauaucccuagcacaaagcaagugccuggcacaua

SEQ ID NO: 721434 - RNA, 64 nt, hsa
uggcaguccauaugccucccuaugcagugaagggcccuagcaguguuaacaaauugcugagauc

SEQ ID NO: 721435 - RNA, 64 nt, hsa
cgucuccuagccaaucagaacuggcuguggaccacccuagcacggccaccucucagggccacug

SEQ ID NO: 721436 - RNA, 64 nt, hsa
uggugguaguuugcuagugcuucuaaaaguugcucccuagcacugagagguguggguagguaaa

SEQ ID NO: 721437 - RNA, 64 nt, hsa
ugugugagauaacuuccuucacaucucccauggucccuagcaaaaugcuaggccuguaguaguc

SEQ ID NO: 721438 - RNA, 64 nt, hsa
uuuugaugucuagccccucccauuuccaaccccucccuagcaucccaggugcccugacccagga

SEQ ID NO: 721439 - RNA, 64 nt, hsa
cccaauaauacagaacaagacaugaugggcaauacccuagcauauugggauuaagagcuuucua

SEQ ID NO: 721440 - RNA, 64 nt, hsa
ccaagagcagcagccgcagccuccucgugauccucccuagcauaaauuucccaaacaguccaca

SEQ ID NO: 721441 - RNA, 63 nt, hsa
cccugcuuggaccucgauaacgggggaggggugcccuagcaucagaaggguucauggcccuuu

SEQ ID NO: 721442 - RNA, 64 nt, hsa
uagaaaaaugcacauuuuuccacacucagcuuuccccuagcauggacaagauuuucagccauuu

SEQ ID NO: 721443 - RNA, 64 nt, hsa
gacacaaaggacagaauuccuuucccaguuguuacccuagcaaggcuagggagggcaugaacac

SEQ ID NO: 721444 - RNA, 64 nt, hsa
auguggauggggugucugcgugugcaaacggguucccuagcaaaguauuuguggggguccaaug

SEQ ID NO: 721445 - RNA, 64 nt, hsa
agcuauguguuaaacagaggugauggcagcccuucccuagcacacugguggaagagaccccuua

SEQ ID NO: 721446 - RNA, 64 nt, hsa
cuuucaggcaaaauccaauuuacauuuuucccuucccuagcaauuacuuuuuuccagcuucaac

SEQ ID NO: 721447 - RNA, 64 nt, hsa
caaacagauaugauuguguuugagggaaauaugucccuagcaggaaaagaauucaaagagguuc

SEQ ID NO: 721448 - RNA, 64 nt, hsa
ccccucuguuccucuguuccucucuucuccugcccccuagcaaccacugguguuuucugucccu

SEQ ID NO: 721449 - RNA, 64 nt, hsa
agcaugaaugcaaugguguagaguugugugaaaccccuagcauagagacagacagcgaagagau

SEQ ID NO: 721450 - RNA, 64 nt, hsa
ugaagaguccgugguugcccuagaaccuaacacccccuagcaaaacucacagagcuuuccguuu

SEQ ID NO: 721451 - RNA, 64 nt, hsa
gaggcagucauguuagcaaaugacacguuaauaucccuagcagaggcuguguucaccuucccug

SEQ ID NO: 721452 - RNA, 64 nt, hsa
aagccccccaaucugugguauuuuauuauggcagcccuagcaagcuaauacagugguuugagag

SEQ ID NO: 721453 - RNA, 64 nt, hsa
ccgcugccucguagagugaccucggacagagccccccuagcaauacagggaggcucccggggcc

SEQ ID NO: 721454 - RNA, 64 nt, hsa
ggagagcuagagucccagcaaagggugcagcugacccuagcacuggcugugacaugcugcuugg

SEQ ID NO: 721455 - RNA, 64 nt, hsa
gggagggacccgagccuggcuuuugaccuaagaacccuagcaggagaauacagucuccauccug

SEQ ID NO: 721456 - RNA, 64 nt, hsa
auaucaauuucuuaaagaacacaaaauguuuccucccuagcaaaacuauuuaagagccaauuaa

SEQ ID NO: 721457 - RNA, 64 nt, hsa
gcagcugaggccucucuccacuggccgccagccucccuagcacaaggggaccauucagcaauga

SEQ ID NO: 721458 - RNA, 64 nt, hsa
aaaaguguaaugaggaaaaugcuucauuaguuuccccuagcagacuuuuacuucucuuacacug

SEQ ID NO: 721459 - RNA, 64 nt, hsa
caugcauuuguccuucucccacccccuuacuacacccuagcagaucagcugaguguacuuuauu

SEQ ID NO: 721460 - RNA, 64 nt, hsa
uuggggugcuuucuugagcccccaguucucuguccccuagcacuagacucagcuguauuguuuu

SEQ ID NO: 721461 - RNA, 64 nt, hsa
uucgggcuccucccucccaccacuccccaacuuccccuagcaguugcagggaagauaggacgag

SEQ ID NO: 721462 - RNA, 64 nt, hsa
gaaacaugacacugaccuuggagagacacagcgucccuagcagugaacuauuucuacacagugg

SEQ ID NO: 721463 - RNA, 64 nt, hsa
uuggcaggaccaccuccgccuacuucuccaccaucccuagcaugucagcccguucccagaucaa

SEQ ID NO: 721464 - RNA, 64 nt, hsa
ggacugaaaacacuaucacaacacuaugagaagccccuagcacugguuaacgcuuuccuagccu

SEQ ID NO: 721465 - RNA, 64 nt, hsa
uucagcgaaagccugucuccucacccacccccagcccuagcauaggaaaagcuuccuugaugug

SEQ ID NO: 721466 - RNA, 64 nt, hsa
caaguagcauuuauaauagaggaaguauuguuaucccuagcaugaguguaauggugauaugaaa

SEQ ID NO: 721467 - RNA, 64 nt, hsa
ccaauuguuuacuguuagaaagugggaauggggucccuagcagacuugccuggaaggagccuau

SEQ ID NO: 721468 - RNA, 64 nt, hsa
gccuugagaagcaagaacaugguuccggacccagcccuagcagccuucuccccaaccaggaugu

SEQ ID NO: 721469 - RNA, 64 nt, hsa
guaaccccuuuccugcuuuuuccugccucuguuucccuagcaaguguggaugaaucaaaugacu

SEQ ID NO: 721470 - RNA, 64 nt, hsa
gccucucuagcagucaacuccauuuguaauaaagcccuagcacucugagaugugugugauuaaa

SEQ ID NO: 721471 - RNA, 64 nt, hsa
caguguuuccucagcucauccgcccucuguugcucccuagcauuccaggagccaucuuggacuc

SEQ ID NO: 721472 - RNA, 64 nt, hsa
ugaggucagaccaccuaggcuuccaccuggugagcccuagcagggcugagacccccagggcggc

SEQ ID NO: 721473 - RNA, 64 nt, hsa
ccuucccguuauucaaccagucucuugguugcaucccuagcacuucuacuacaagugagauggu

SEQ ID NO: 721474 - RNA, 64 nt, hsa
caagugaccagaugcccuacucagcuuccaucaccccuagcaauauguauuaaagucugaagug

SEQ ID NO: 721475 - RNA, 64 nt, hsa
gaaaaaaacaauauuaaaccgcccaagcagugugcccuagcagaggaaaaugcaacaucucgca

SEQ ID NO: 721476 - RNA, 64 nt, hsa
ccugguugaaucuggcaauucuuuuugccaagaucccuagcagaagauuuagccauguccuucc

SEQ ID NO: 721477 - RNA, 64 nt, hsa
auaccuacauugacccaagaaauauuuacgcaaucccuagcagaacauuguuucugaggaggca

SEQ ID NO: 721478 - RNA, 64 nt, hsa
aaaaaaucucaaagcuauuugaguucucgucugucccuagcagucuuucuucagcucacuuggc

SEQ ID NO: 721479 - RNA, 64 nt, hsa
auacacaugcuugcaaaaacauuagucgugaaaucccuagcaacaagucacuggauuuuucucu

SEQ ID NO: 721480 - RNA, 64 nt, hsa
cccgugcaggagccacauggguccugugcaggaccccuagcaguggugggcugagcccaggucu

SEQ ID NO: 721481 - RNA, 64 nt, hsa
ccaauaaggcacagcccaguuagcagcuuagccccccuagcaaaccccaaggcacaaagugggc

SEQ ID NO: 721482 - RNA, 64 nt, hsa
aggacucuuggaagcaggccauccuggccagacacccuagcaggaaggggcucaccugucaccc

SEQ ID NO: 721483 - RNA, 64 nt, hsa
cuccaaagaacagcuggacggagcugagaggagacccuagcaucuccauguccaucccccagac

SEQ ID NO: 721484 - RNA, 64 nt, hsa
aaggaaggagaaagugguuacuagccaggcauaccccuagcauaagucugggcagcucuauggg

SEQ ID NO: 721485 - RNA, 64 nt, hsa
cggacucggccugccuuugcccucggccuacuugcccuagcaugaggcucugagagccaccugc

SEQ ID NO: 721486 - RNA, 64 nt, hsa
agucugggcugggcaugguggcucacgccuguaacccuagcacuuuaggaaaucgaggcgagug

SEQ ID NO: 721487 - RNA, 64 nt, hsa
gugaucagggcagagcugggacuccagcucauggcccuagcagccaguacagugcccugucugu

SEQ ID NO: 721488 - RNA, 64 nt, hsa
gccccgcagaggcccgccugaagccagcccggcgcccuagcagaugcacgugucugucgaaucg

SEQ ID NO: 721489 - RNA, 64 nt, hsa
gcgggcccuggggcgaggccaucucugccugccucccuagcaggcgccagcgguggaggcugag

SEQ ID NO: 721490 - RNA, 64 nt, hsa
aaauggaaacaagacuauaaaugauaagcccugucccuagcaccaccucuccuguguguggaau

SEQ ID NO: 721491 - RNA, 64 nt, hsa
gcccuguggacacuggcugggaaggcaggucuuccccuagcacauggggaccccggccucgagg

SEQ ID NO: 721492 - RNA, 64 nt, hsa
ccccucaccuggccaccugccagggcaccugcaacccuagcaauaccaugcucgcuggagaggc

SEQ ID NO: 721493 - RNA, 64 nt, hsa
agucucugaggggcuaccaggaaagcgccuccaacccuagcaaaagugcaagauggggagugag

SEQ ID NO: 721494 - RNA, 64 nt, hsa
ucagccaagaacaggccuggcccaaggugccacccccuagcaccuugucaggcugucccuugcu

SEQ ID NO: 721495 - RNA, 64 nt, hsa
gaaauaaaaaagccuuagguaaauaagucauucucccuagcagagccacuugggucuccugcau

SEQ ID NO: 721496 - RNA, 64 nt, hsa
uucccucucuuccgucucuaggucuguucuucuucccuagcauccuccuccccacaucuccuuu

SEQ ID NO: 721497 - RNA, 64 nt, hsa
cuggcauuuggcauguccaugacauuggagacuccccuagcagggugccugacguguggggaac

SEQ ID NO: 721498 - RNA, 64 nt, hsa
cgauaggccugacgcagcccccagcccagggccgcccuagcaacuuccuguacauaugacugua

SEQ ID NO: 721499 - RNA, 64 nt, hsa
gucucaucaucagcaaccaugacugaugacugggcccuagcagguggcagguauaacauggcca

SEQ ID NO: 721500 - RNA, 64 nt, hsa
gaccccacucggagggugcccucugcucaggccucccuagcaccucccccuaaccaaauucucc

SEQ ID NO: 721501 - RNA, 64 nt, hsa
uccccagcuacuguuuuuggggccaagauggcugcccuagcagcaaucacugccaagggcaaga

SEQ ID NO: 721502 - RNA, 64 nt, hsa
ugugugccugggucuaacaugugguccccuuugucccuagcaccuuuaaggggaggggaagaau

SEQ ID NO: 721503 - RNA, 64 nt, hsa
cccagcuguucuguccuaggggagggggacauagcccuagcaggagcucccagccccucuuggc

SEQ ID NO: 721504 - RNA, 64 nt, hsa
uaauuauauaacuguucuuacugauuuuauugcccccuagcaauaagcccuuuccuuugaauac

SEQ ID NO: 721505 - RNA, 64 nt, hsa
gagacuuccauuuuuaguuccuuuacacucaccacccuagcaagugcccugcacagaguaauaa

SEQ ID NO: 721506 - RNA, 64 nt, hsa
gguggcucggccucagcugccuggguuguggccgcccuagcauccuguaugcccacagcuacug

SEQ ID NO: 721507 - RNA, 64 nt, hsa
gaaaugguugacauuacacaugguauuugucaugcccuagcauggacugucucauacugcucug

SEQ ID NO: 721508 - RNA, 64 nt, hsa
ggaccacauuagacugggcagagauucgcccaaccccuagcacuccggcucugggcuuucggcc

SEQ ID NO: 721509 - RNA, 64 nt, hsa
gguccaauccuaggacagccuuguuccucagcaccccuagcaugaacuugugggaugguggggu

SEQ ID NO: 721510 - RNA, 64 nt, hsa
guccauccuguacaucucaagcaagggguuccuccccuagcaccugggcuuggcagaagggcca

SEQ ID NO: 721511 - RNA, 64 nt, hsa
gggacuguggcuucuccgucacuccauucucagccccuagcagagcgucuggcacacuagauua

SEQ ID NO: 721512 - RNA, 64 nt, hsa
cucagaucucuauuucauuuuguggcuuaccauucccuagcacacuggccuugccaucuugugg

SEQ ID NO: 721513 - RNA, 64 nt, hsa
aaagcaagcaccugggugugcuccaggcuuccugcccuagcaguuugccucugcacgugcacac

SEQ ID NO: 721514 - RNA, 64 nt, hsa
cccggucagcccggcuggagcccgcccuccccuccccuagcagccaggucacugccuguggcug

SEQ ID NO: 721515 - RNA, 64 nt, hsa
ggggacacgaugagcaccaggccccaccuuuguccccuagcaaauucaggguacagcuccaccu

SEQ ID NO: 721516 - RNA, 64 nt, hsa
agugccugcggccccucacagggcugaggccagccccuagcagcuggauguggcagaggcaggc

SEQ ID NO: 721517 - RNA, 64 nt, hsa
ccacaaacagaugcauaguauggguuuuggaagucccuagcaagcuguuauugguaagauuagg

SEQ ID NO: 721518 - RNA, 64 nt, hsa
gguauaagaccagguggccugcuccuuuucugggcccuagcacagguggguaacccccacccaa

SEQ ID NO: 721519 - RNA, 64 nt, hsa
aaauuuaaaaaauaacacaauuucuugccuguaacccuagcacuuugggaggccgaggcaggug

SEQ ID NO: 721520 - RNA, 64 nt, hsa
uugccuuauaaaacuguuaggguaggucugucuacccuagcaaaagaaacacagaaauuuaaau

SEQ ID NO: 721521 - RNA, 64 nt, hsa
aacaagagcuccccguuuccucccuccucccugucccuagcaaccaccaguggacuuccuguuu

SEQ ID NO: 721522 - RNA, 64 nt, hsa
cacccuccacgccacccccuacuacucacucucacccuagcaaggagcuucgugcuaauaagag

SEQ ID NO: 721523 - RNA, 64 nt, hsa
gcuaugccccuuggaguaaauacggcucuguguucccuagcagcugcgggaggguuuggccgau

SEQ ID NO: 721524 - RNA, 64 nt, hsa
agcacugggcuuccacaggccccuggccuccuugcccuagcacacugggacuggccccacucuc

SEQ ID NO: 721525 - RNA, 64 nt, hsa
guucagggcugggcgcgguggcucaugccuguaacccuagcacuuugggaggcugaggcgggca

SEQ ID NO: 721526 - RNA, 64 nt, hsa
ugagcugauccuugacuccucuucaucuuagccccccuagcagcauuccaucccagccagagca

SEQ ID NO: 721527 - RNA, 64 nt, hsa
gucacaccaaaggcaaaaagccuggcuaccuccccccuagcacgugagucccuacuccccuccc

SEQ ID NO: 721528 - RNA, 64 nt, hsa
gcuaugccccuuggaguaaauacagcucuguguucccuagcagcugccggaggauuuggcugau

SEQ ID NO: 721529 - RNA, 64 nt, hsa
cccuugucugagacugaaccuccugagaaggggccccuagcagcggucagagguccugucugga

SEQ ID NO: 721530 - RNA, 64 nt, hsa; identical to SEQ ID NO: 334558

SEQ ID NO: 721531 - RNA, 64 nt, hsa; identical to SEQ ID NO: 334559

SEQ ID NO: 721532 - RNA, 64 nt, hsa; identical to SEQ ID NO: 334560

SEQ ID NO: 721533 - RNA, 64 nt, hsa; identical to SEQ ID NO: 334561

SEQ ID NO: 721534 - RNA, 64 nt, hsa; identical to SEQ ID NO: 334562

SEQ ID NO: 721535 - RNA, 64 nt, hsa; identical to SEQ ID NO: 334563

SEQ ID NO: 721536 - RNA, 64 nt, hsa; identical to SEQ ID NO: 334564

SEQ ID NO: 721537 - RNA, 64 nt, hsa; identical to SEQ ID NO: 334565

SEQ ID NO: 721538 - RNA, 64 nt, hsa; identical to SEQ ID NO: 334566

SEQ ID NO: 721539 - RNA, 64 nt, hsa; identical to SEQ ID NO: 334567

SEQ ID NO: 721540 - RNA, 64 nt, hsa; identical to SEQ ID NO: 334568

SEQ ID NO: 721541 - RNA, 64 nt, hsa; identical to SEQ ID NO: 334569

SEQ ID NO: 721542 - RNA, 64 nt, hsa; identical to SEQ ID NO: 334570

SEQ ID NO: 721543 - RNA, 64 nt, hsa; identical to SEQ ID NO: 334571

SEQ ID NO: 721544 - RNA, 64 nt, hsa; identical to SEQ ID NO: 334572

SEQ ID NO: 721545 - RNA, 64 nt, hsa; identical to SEQ ID NO: 334573

SEQ ID NO: 721546 - RNA, 64 nt, hsa; identical to SEQ ID NO: 334574

SEQ ID NO: 721547 - RNA, 64 nt, hsa; identical to SEQ ID NO: 334575

SEQ ID NO: 721548 - RNA, 64 nt, hsa; identical to SEQ ID NO: 334576

SEQ ID NO: 721549 - RNA, 64 nt, hsa; identical to SEQ ID NO: 334577

SEQ ID NO: 721550 - RNA, 64 nt, hsa; identical to SEQ ID NO: 334578

SEQ ID NO: 721551 - RNA, 64 nt, hsa; identical to SEQ ID NO: 334579

SEQ ID NO: 721552 - RNA, 64 nt, hsa; identical to SEQ ID NO: 334580

SEQ ID NO: 721553 - RNA, 64 nt, hsa; identical to SEQ ID NO: 334581

SEQ ID NO: 721554 - RNA, 64 nt, hsa
acuuuaugcagcagucagguacauaguuaggugaacccaaaagaaaaacucuugaaaacaagag

SEQ ID NO: 721555 - RNA, 64 nt, hsa
uuccuucuaacgaguuguagaaaucugaguaaccacccaaaaaagcaauagaauguuucuguca

SEQ ID NO: 721556 - RNA, 64 nt, hsa
aauacuaauguaacagcagaugaaaauugauaaaacccaaaagagagucaucuaaauuuguagu

SEQ ID NO: 721557 - RNA, 64 nt, hsa
aaauacauuaucagugauugaaacguuuacauguacccaaaaaccauaaucaucucuuggaaga

SEQ ID NO: 721558 - RNA, 64 nt, hsa
aauccauacacauacauaccuaggucauccuaucacccaaaagagggacaaacaucugacuugg

SEQ ID NO: 721559 - RNA, 64 nt, hsa
aagcaauaaguuuauguuaguagagcuguuuucaacccaaaaauaagaaaaaauagcucuaaau

SEQ ID NO: 721560 - RNA, 64 nt, hsa
ugaacuaccccacaacacgccuaaaacucaaaacacccaaaaauaucuccuccaauguccugaa

SEQ ID NO: 721561 - RNA, 64 nt, hsa
ccaaaaauaucuccuccaauguccugaaacaugaacccaaaaagagacccacaauaaacucgug

SEQ ID NO: 721562 - RNA, 64 nt, hsa
caaaggggagaucccuuuucuuaaaaaaggcucaacccaaaagaaaccauuucuuaaaaaauuu

SEQ ID NO: 721563 - RNA, 64 nt, hsa
aagagaaagccugugaaauaggcagggccagaucacccaaaacuccucaggacugggaucuggc

SEQ ID NO: 721564 - RNA, 64 nt, hsa
gaaaucaaauuuaucaguuuuuuucccccuaauuacccaaaagaucuuuugcaaacuauguuac

SEQ ID NO: 721565 - RNA, 64 nt, hsa
augcuucugccucuuuaagacaaagaagaaugucacccaaaauugucauuuuuuucuuaauguu

SEQ ID NO: 721566 - RNA, 64 nt, hsa; identical to SEQ ID NO: 603786

SEQ ID NO: 721567 - RNA, 64 nt, hsa; identical to SEQ ID NO: 603787

SEQ ID NO: 721568 - RNA, 64 nt, hsa; identical to SEQ ID NO: 603788

SEQ ID NO: 721569 - RNA, 64 nt, hsa; identical to SEQ ID NO: 603789

SEQ ID NO: 721570 - RNA, 64 nt, hsa
auccuaggcaaggcaaaaaugcacuuccacugaaacgaagcauuucugaccgcuuuuucuuggu

SEQ ID NO: 721571 - RNA, 64 nt, hsa
ucauaacccugaauguggggcucugguggcugucacgaagcagaguuggcacauaacauggaac

SEQ ID NO: 721572 - RNA, 64 nt, hsa
caaaugcagucuugguucuaaguucacugugaccacgaagcagcugacugugcaucacgcaguc

SEQ ID NO: 721573 - RNA, 64 nt, hsa
accuccaaggaccggccuuugcaccuccauggaaacgaagcaccaucauucccguugaacguca

SEQ ID NO: 721574 - RNA, 64 nt, hsa
acccgggaagggaaguccgcagccgacgcccgcuacgaagcagccugcaacaggcuggccaaca

SEQ ID NO: 721575 - RNA, 64 nt, hsa
ggcagggagcuggggacauuuuaaucaucaauaaacgaagcacuuuauucuguacagauuuggg

SEQ ID NO: 721576 - RNA, 64 nt, hsa
uacauagccccacucagcugcuucggaaagcgugacgaagcaguaguccucaguguguguguaa

SEQ ID NO: 721577 - RNA, 64 nt, hsa
gcuguggcccugcugugaucauaccuugagcacgacgaagcaaccuuguuucugaggaagcuug

SEQ ID NO: 721578 - RNA, 64 nt, hsa
ucacacacaaugcuuuuuuugguuaaauguugauacgaagcaauguuuuggaauuacuuuaauu

SEQ ID NO: 721579 - RNA, 64 nt, hsa
ugauuugcuuuuuaugccuguucugaauggcagcacgaagcaggccuguuacuuguaugucgcu

SEQ ID NO: 721580 - RNA, 64 nt, hsa
ugaacccccccuuguuccaaaugaagacggcaucacgaagcagcuccaaaaggaaaagcuuggg

SEQ ID NO: 721581 - RNA, 64 nt, hsa
uccucauuucucaugggcaacagaggccaaagaaacgaagcaagacaaacagcaaacaggcauu

SEQ ID NO: 721582 - RNA, 64 nt, hsa
cagaaggccaagauccuugcuuugggggugccucacgaagcaucccuguagacauuuggcccca

SEQ ID NO: 721583 - RNA, 64 nt, hsa
agaagaaaggcauugcacagagugaacuuaauggacgaagcaacaaauaugucaagaacaggac

SEQ ID NO: 721584 - RNA, 64 nt, hsa
augcaaauccaauuaggcggccaaguagguggagacgaagcaccuuccuuuccccaucucuguc

SEQ ID NO: 721585 - RNA, 64 nt, hsa
ccuaaaauaaccucaccccaaauacaauaaagggacgaagcacuuauagauaccacagacacau

SEQ ID NO: 721586 - RNA, 64 nt, hsa
cugaugcauuucauuaaaaaaaaaaccaugaauuacgaagcaccuuaguaagcaccuucuaaug

SEQ ID NO: 721587 - RNA, 64 nt, hsa
caagaaagcuguggcucaacacaugagaagaagcacgaagcaguuaggcuguacaucagacaga

SEQ ID NO: 721588 - RNA, 64 nt, hsa
gggaaacgugauucucagugugauuccaauuauuacgaagcacuaaucaguaacgcuacaauga

SEQ ID NO: 721589 - RNA, 64 nt, hsa
accaagguguauaguaaccuauuuaucacauuuuacgaagcaauuuuaaucuuaaacacaucca

SEQ ID NO: 721590 - RNA, 64 nt, hsa
cacuaacucgaucuucugggaguucucuggcuucacgaagcauguuuacggagaaaacuacaac

SEQ ID NO: 721591 - RNA, 64 nt, hsa
gaggccuggaaucuuuuaucauuaaacaccuaguacgaagcauuugcaggaaccuacugugcag

SEQ ID NO: 721592 - RNA, 64 nt, hsa
augccuugcaggauggacaggaugacagacagggacgaagcagagaccucuacagacccaaguc

SEQ ID NO: 721593 - RNA, 64 nt, hsa
uuagaagggaaauaauguaucaccucuuuccagaacgaagcaaaguugcuggcuuaguagagcc

SEQ ID NO: 721594 - RNA, 64 nt, hsa
ugaauaaagaaaaaccauaauugcuuguggugaaacgaagcagucuucauguuaaguagcaaug

SEQ ID NO: 721595 - RNA, 64 nt, hsa
cuucccccaacucuugaacgaugaugauauucagacgaagcauugauguuauggaagaaagaaa

SEQ ID NO: 721596 - RNA, 64 nt, hsa
gccucaguacugguguagugugucagcucuguuuacgaagcaauacuguccaguuuucuugcug

SEQ ID NO: 721597 - RNA, 64 nt, hsa
cuccucuaccuuuaugguauuuugguguucacuuacgaagcauacaacuagaaccauauccaag

SEQ ID NO: 721598 - RNA, 64 nt, hsa
cucaguagggccugccccuucaagggcagcaagaacgaagcaggauguugucacucccgucuga

SEQ ID NO: 721599 - RNA, 64 nt, hsa
ccaucuucauucauaggucugcgcuggggccgggacgaagcacuugguaacaggcacaucuucc

SEQ ID NO: 721600 - RNA, 64 nt, hsa
ucguuuuggaagacgagagaaaguugagaagaacacgaagcacagacccugaugugauaaaaca

SEQ ID NO: 721601 - RNA, 64 nt, hsa
auccgugugaaguuugucaaugaccucgggguggacgaagcagggauugaucaagacgguguuu

SEQ ID NO: 721602 - RNA, 64 nt, hsa
uuucuuccuucucucauaaacguacucaaaacacacgaagcauaauauguaaaaaguaagcagu

SEQ ID NO: 721603 - RNA, 64 nt, hsa
cauuuaauuguaccauucagaauggacuguuuguacgaagcauguauaaugcaguuaucuucuu

SEQ ID NO: 721604 - RNA, 64 nt, hsa
ugcugccuccauugaugucucuagaccugcagauacgaagcaaaccugggauugcuucuuccag

SEQ ID NO: 721605 - RNA, 64 nt, hsa
gcugggcugagggaagucagagccccagggcgccacgaagcagccacugggauaccccaccccg

SEQ ID NO: 721606 - RNA, 64 nt, hsa
caugcaucaucagaugacaaggacaacccucaugacgaagcaacaugaauuagggggccucuug

SEQ ID NO: 721607 - RNA, 64 nt, hsa
auuuauugauauuuaguccagaacaccaguucuaacgaagcaugcgugucucuucaucuacagg

SEQ ID NO: 721608 - RNA, 64 nt, hsa
agcucccuucugaagcagagaagccuccauggucacgaagcagcguugugcugugugucccucg

SEQ ID NO: 721609 - RNA, 64 nt, hsa
acuguccgucuuuaaacagaaagucaaaggagccacgaagcaagcggccguccgggcguccgcc

SEQ ID NO: 721610 - RNA, 64 nt, hsa
ccguuacgaggcugugguccggggcaagccaaguacgaagcagcagccaucgcgggcugcauca

SEQ ID NO: 721611 - RNA, 64 nt, hsa
cacacgcacacagccugguuuuguccucaugcacacgaagcagccccugcucccaucugucccu

SEQ ID NO: 721612 - RNA, 64 nt, hsa
acuccuucacgucaggcucagguuccaugggaggacgaagcaguggacgcauugugggcuuuag

SEQ ID NO: 721613 - RNA, 64 nt, hsa
ccucagucuccuccguggcuagugugucuaguucacgaagcaauuaacugggucuuacuaucau

SEQ ID NO: 721614 - RNA, 64 nt, hsa
acgcucaaugccccacgugccuucuccaggaggaacgaagcaggguuugaggguuggguggaug

SEQ ID NO: 721615 - RNA, 64 nt, hsa
auuuggagggaagaaguaauggcgcuagugugggacgaagcacagaucccagcacuuuucccag

SEQ ID NO: 721616 - RNA, 64 nt, hsa
cauaggcucaaaauaaaaggauggaggaagaucuacgaagcaaauggaaaacaaacaaaaaaag

SEQ ID NO: 721617 - RNA, 64 nt, hsa
gaacucagagggugccucaggggaaagaaaacucacgaagcagaggcugggcgugguggcucuc

SEQ ID NO: 721618 - RNA, 64 nt, hsa
uuuguacuguaugccuucagcauugccuaggaacacgaagcacgaucaguccaucccagaggga

SEQ ID NO: 721619 - RNA, 64 nt, hsa
cuccacuggcagacggcagacaaggggagaagagacgaagcagcuggacaucggagacuacagu

SEQ ID NO: 721620 - RNA, 64 nt, hsa
ucagauguuucgaguaaacuugaaaaggguaggcacgaagcaauuuguugcugcuugucacccc

SEQ ID NO: 721621 - RNA, 64 nt, hsa
ccugccugucagccguggucagaauaaguuuuacacgaagcaggugaaagauuuaguucuuuuc

SEQ ID NO: 721622 - RNA, 64 nt, hsa
ggggggcgguaggggucuugaugaaaccucuugaacgaagcacaguuugucccaucuuuguuca

SEQ ID NO: 721623 - RNA, 64 nt, hsa
cugcugcagaugaaagaagaagcaacaauggccaacgaagcacuggugauuucugaggggcugg

SEQ ID NO: 721624 - RNA, 64 nt, hsa
ccuggccacaggaguccccuacuggcugcagaggacgaagcaggaagcaugccguggaucccac

SEQ ID NO: 721625 - RNA, 64 nt, hsa; identical to SEQ ID NO: 383060

SEQ ID NO: 721626 - RNA, 64 nt, hsa; identical to SEQ ID NO: 383061

SEQ ID NO: 721627 - RNA, 64 nt, hsa; identical to SEQ ID NO: 383062

SEQ ID NO: 721628 - RNA, 64 nt, hsa; identical to SEQ ID NO: 383063

SEQ ID NO: 721629 - RNA, 64 nt, hsa; identical to SEQ ID NO: 383064

SEQ ID NO: 721630 - RNA, 64 nt, hsa; identical to SEQ ID NO: 383065

SEQ ID NO: 721631 - RNA, 64 nt, hsa; identical to SEQ ID NO: 383066

SEQ ID NO: 721632 - RNA, 64 nt, hsa; identical to SEQ ID NO: 383067

SEQ ID NO: 721633 - RNA, 64 nt, hsa; identical to SEQ ID NO: 383068

SEQ ID NO: 721634 - RNA, 64 nt, hsa; identical to SEQ ID NO: 383069

SEQ ID NO: 721635 - RNA, 64 nt, hsa; identical to SEQ ID NO: 383070

SEQ ID NO: 721636 - RNA, 64 nt, hsa; identical to SEQ ID NO: 383071

SEQ ID NO: 721637 - RNA, 64 nt, hsa; identical to SEQ ID NO: 383072

SEQ ID NO: 721638 - RNA, 64 nt, hsa; identical to SEQ ID NO: 383073

SEQ ID NO: 721639 - RNA, 64 nt, hsa; identical to SEQ ID NO: 383074

SEQ ID NO: 721640 - RNA, 64 nt, hsa; identical to SEQ ID NO: 383075

SEQ ID NO: 721641 - RNA, 64 nt, hsa; identical to SEQ ID NO: 383076

SEQ ID NO: 721642 - RNA, 64 nt, hsa; identical to SEQ ID NO: 383077

SEQ ID NO: 721643 - RNA, 64 nt, hsa; identical to SEQ ID NO: 383078

SEQ ID NO: 721644 - RNA, 51 nt, hsa; identical to SEQ ID NO: 111105

SEQ ID NO: 721645 - RNA, 64 nt, hsa; identical to SEQ ID NO: 383080

SEQ ID NO: 721646 - RNA, 64 nt, hsa; identical to SEQ ID NO: 383081

SEQ ID NO: 721647 - RNA, 64 nt, hsa; identical to SEQ ID NO: 383082

SEQ ID NO: 721648 - RNA, 64 nt, hsa; identical to SEQ ID NO: 383083

SEQ ID NO: 721649 - RNA, 64 nt, hsa; identical to SEQ ID NO: 383084

SEQ ID NO: 721650 - RNA, 64 nt, hsa; identical to SEQ ID NO: 383085

SEQ ID NO: 721651 - RNA, 64 nt, hsa; identical to SEQ ID NO: 383086

SEQ ID NO: 721652 - RNA, 64 nt, hsa; identical to SEQ ID NO: 383087

SEQ ID NO: 721653 - RNA, 64 nt, hsa; identical to SEQ ID NO: 383088

SEQ ID NO: 721654 - RNA, 64 nt, hsa; identical to SEQ ID NO: 383089

SEQ ID NO: 721655 - RNA, 64 nt, hsa; identical to SEQ ID NO: 383090

SEQ ID NO: 721656 - RNA, 64 nt, hsa; identical to SEQ ID NO: 383091

SEQ ID NO: 721657 - RNA, 64 nt, hsa; identical to SEQ ID NO: 383092

SEQ ID NO: 721658 - RNA, 64 nt, hsa; identical to SEQ ID NO: 383093

SEQ ID NO: 721659 - RNA, 64 nt, hsa; identical to SEQ ID NO: 383094

SEQ ID NO: 721660 - RNA, 64 nt, hsa; identical to SEQ ID NO: 383095

SEQ ID NO: 721661 - RNA, 64 nt, hsa
agacagucgugccauucacaaagucagaaaauacagcaggaagagacagcuuuuagaggggcag

SEQ ID NO: 721662 - RNA, 64 nt, hsa
aaagugauggaaugacuucugcaacuguagucccagcaggaacugugaagaccagcugcccugc

SEQ ID NO: 721663 - RNA, 64 nt, hsa
auuuuaagcugaaggcauuugaggaaauugcagaagcaggaaggugacucugaccuucugccug

SEQ ID NO: 721664 - RNA, 64 nt, hsa
acugcucuagauuaguagaugcaucuaagcaggcagcaggaacuuuaaauuuuuuaaguucaug

SEQ ID NO: 721665 - RNA, 64 nt, hsa
guuagcacaaaaugacuauauacuccuuuuaagaagcaggaaagcagguuuccugagugauaug

SEQ ID NO: 721666 - RNA, 64 nt, hsa
uggcaugacuccaugaauuugucuccagaacggcagcaggaaagucuuuuuuguuuccccuauu

SEQ ID NO: 721667 - RNA, 64 nt, hsa
cccggcagcagggcagccaugggaacucaggaaaagcaggaacccuuuccaaaagcccagagau

SEQ ID NO: 721668 - RNA, 64 nt, hsa
gcggggggugaggcuuagcccagaaggagaacugagcaggaaaccaaggcucuucucugucccc

SEQ ID NO: 721669 - RNA, 64 nt, hsa
uuuaugcuaagugaccacaguauacaaaguaauaagcaggaaauuugauauggguuaaauuaug

SEQ ID NO: 721670 - RNA, 64 nt, hsa
ugaccuagagguuuuugugguaugcauuggauauagcaggaaagaaagcacauuuccaaacagc

SEQ ID NO: 721671 - RNA, 64 nt, hsa
gcaacggcucagugacagcaagagcaggaagagcagcaggaaggcaccgcuguccaccuugggc

SEQ ID NO: 721672 - RNA, 64 nt, hsa
uccccacuggccgcaacggcucagugacagcaagagcaggaagagcagcaggaaggcaccgcug

SEQ ID NO: 721673 - RNA, 64 nt, hsa
uaacaaauuaagggaagauauuuugacacaagaaagcaggaacguggagaaauuggagcaggaa

SEQ ID NO: 721674 - RNA, 64 nt, hsa
uugacacaagaaagcaggaacguggagaaauuggagcaggaaaagaaauuaucaaagcaauaga

SEQ ID NO: 721675 - RNA, 64 nt, hsa
caugugcuggucucuguguguuuguguguuccucagcaggaaugagugucuuuguguaucaccu

SEQ ID NO: 721676 - RNA, 64 nt, hsa
agaaauguugaaaagcuccuuggguucuccugacagcaggaaccacuggccuggcaccaccugg

SEQ ID NO: 721677 - RNA, 64 nt, hsa
uuaguugagaaagaagagaagaagaaaaucaaccagcaggaaaguacagaugcagccgugcagg

SEQ ID NO: 721678 - RNA, 64 nt, hsa
uucuucgaucccaagguuuccaagauaaaaccagagcaggaaagaugaugcaagcgacaggaaa

SEQ ID NO: 721679 - RNA, 64 nt, hsa
ggaaaccagggucucaugguuuaaaagacuuugaagcaggaauguugcauuugacgccuuuaaa

SEQ ID NO: 721680 - RNA, 64 nt, hsa
acuauauaauguaugcuuauuggaauucugccacagcaggaagcuugagucaaaauguguuucc

SEQ ID NO: 721681 - RNA, 64 nt, hsa
uugcuaacaaagcacuuuuggacaaugcuaucccagcaggaaaaaaaaggauaauauaacuguu

SEQ ID NO: 721682 - RNA, 64 nt, hsa
gaguauuugaucccuagauaagaacaugcaaaucagcaggaacuggucauacaggguaagcacc

SEQ ID NO: 721683 - RNA, 64 nt, hsa
gcucuagaaaagucccaaaagcagcagaaggugaagcaggaagcacuugguuuucuccuuccug

SEQ ID NO: 721684 - RNA, 64 nt, hsa
aggaaucucucucagguuuuuucugaccuaaaccagcaggaagucguccugggcuguaagcacc

SEQ ID NO: 721685 - RNA, 64 nt, hsa
agggaugagagaaaggaggugguauggaagacucagcaggaacaagguaggcuucaaagagccu

SEQ ID NO: 721686 - RNA, 64 nt, hsa
agugagggccccugcugggcccagccaccaggacagcaggaaccagggccuacuccucuuaugg

SEQ ID NO: 721687 - RNA, 64 nt, hsa
uugauuaucuuuaagucucucuaccauggagaagagcaggaagggauacacucuccagugcauu

SEQ ID NO: 721688 - RNA, 64 nt, hsa
gauuguauugauaaccacugggguuccgcauugaagcaggaacaaauugccucuuuuucuggcc

SEQ ID NO: 721689 - RNA, 64 nt, hsa
cugauuaacccauguaaauaggcacuuaaauagaagcaggaaagggagacaaagacuggcuucu

SEQ ID NO: 721690 - RNA, 64 nt, hsa
guggcuucauucuagauguagcuugugcagauguagcaggaaaauaggaaaaccuaccaucuca

SEQ ID NO: 721691 - RNA, 64 nt, hsa
caagaaaaugagggcuugagucgccugaaccaagagcaggaagagguugcuggagcaagaggag

SEQ ID NO: 721692 - RNA, 64 nt, hsa
gaagaaaaugagggcuugagucgccugaacgaagagcaggaagagguugcugagauuguuggaa

SEQ ID NO: 721693 - RNA, 64 nt, hsa
gaagaaaaugagggcuugagucaccugaaccaagagcaggaagagguugcucagguuguuggag

SEQ ID NO: 721694 - RNA, 64 nt, hsa
uuugcaacaaaaagcugacccagaggccauacagagcaggaauaucccauugcccccuccucca

SEQ ID NO: 721695 - RNA, 64 nt, hsa
cuucuguugucuaacguauggcaggcagacugggagcaggaaaacagagggccccaaagcccaa

SEQ ID NO: 721696 - RNA, 64 nt, hsa
aaggcaagcuaacgcuaacuucccaggugacaguagcaggaacaaggaaggguaauguuuccau

SEQ ID NO: 721697 - RNA, 64 nt, hsa
uucauucagaaaguugccacuucugaaugaguagagcaggaaaaguaaacuuuacugaaacaua

SEQ ID NO: 721698 - RNA, 64 nt, hsa
uuaugguggugacaugcaugaggugggcugguagagcaggaagcucugugaugucagagcaucu

SEQ ID NO: 721699 - RNA, 64 nt, hsa
gaugaguaggucagucuaggaagaaagagaaaguagcaggaaaggaagugggaagggccagcca

SEQ ID NO: 721700 - RNA, 64 nt, hsa
accgugaugccacguaacuuacccuauggacaaaagcaggaaugacuaacacauccuaggaggg

SEQ ID NO: 721701 - RNA, 64 nt, hsa
cagggaccucaccugucggaccuauagcuugcugagcaggaaccuugcacuucacacuucuuga

SEQ ID NO: 721702 - RNA, 64 nt, hsa
uuaaugcugcuuuugagcuucaagguaauaggacagcaggaaccuaaaauaucugccaucaucu

SEQ ID NO: 721703 - RNA, 64 nt, hsa
ucagugacaccaucuuggaauaccuuugggaagcagcaggaaaugugcauguggguagagauca

SEQ ID NO: 721704 - RNA, 65 nt, hsa; identical to SEQ ID NO: 306964

SEQ ID NO: 721705 - RNA, 65 nt, hsa; identical to SEQ ID NO: 306965

SEQ ID NO: 721706 - RNA, 65 nt, hsa; identical to SEQ ID NO: 306966

SEQ ID NO: 721707 - RNA, 65 nt, hsa; identical to SEQ ID NO: 306967

SEQ ID NO: 721708 - RNA, 65 nt, hsa; identical to SEQ ID NO: 306968

SEQ ID NO: 721709 - RNA, 65 nt, hsa; identical to SEQ ID NO: 306969

SEQ ID NO: 721710 - RNA, 65 nt, hsa; identical to SEQ ID NO: 306970

SEQ ID NO: 721711 - RNA, 65 nt, hsa; identical to SEQ ID NO: 306971

SEQ ID NO: 721712 - RNA, 65 nt, hsa; identical to SEQ ID NO: 306972

SEQ ID NO: 721713 - RNA, 65 nt, hsa; identical to SEQ ID NO: 306973

SEQ ID NO: 721714 - RNA, 65 nt, hsa; identical to SEQ ID NO: 306974

SEQ ID NO: 721715 - RNA, 65 nt, hsa; identical to SEQ ID NO: 306975

SEQ ID NO: 721716 - RNA, 65 nt, hsa; identical to SEQ ID NO: 306976

SEQ ID NO: 721717 - RNA, 65 nt, hsa; identical to SEQ ID NO: 306977

SEQ ID NO: 721718 - RNA, 65 nt, hsa; identical to SEQ ID NO: 306978

SEQ ID NO: 721719 - RNA, 65 nt, hsa; identical to SEQ ID NO: 306979

SEQ ID NO: 721720 - RNA, 65 nt, hsa; identical to SEQ ID NO: 306980

SEQ ID NO: 721721 - RNA, 65 nt, hsa; identical to SEQ ID NO: 306981

SEQ ID NO: 721722 - RNA, 65 nt, hsa; identical to SEQ ID NO: 306982

SEQ ID NO: 721723 - RNA, 65 nt, hsa; identical to SEQ ID NO: 306983

SEQ ID NO: 721724 - RNA, 64 nt, hsa; identical to SEQ ID NO: 259863

SEQ ID NO: 721725 - RNA, 64 nt, hsa; identical to SEQ ID NO: 259864

SEQ ID NO: 721726 - RNA, 64 nt, hsa; identical to SEQ ID NO: 259865

SEQ ID NO: 721727 - RNA, 64 nt, hsa; identical to SEQ ID NO: 259866

SEQ ID NO: 721728 - RNA, 64 nt, hsa; identical to SEQ ID NO: 259867

SEQ ID NO: 721729 - RNA, 64 nt, hsa; identical to SEQ ID NO: 259868

SEQ ID NO: 721730 - RNA, 64 nt, hsa; identical to SEQ ID NO: 259869

SEQ ID NO: 721731 - RNA, 64 nt, hsa; identical to SEQ ID NO: 259870

SEQ ID NO: 721732 - RNA, 64 nt, hsa; identical to SEQ ID NO: 259871

SEQ ID NO: 721733 - RNA, 64 nt, hsa; identical to SEQ ID NO: 259872

SEQ ID NO: 721734 - RNA, 64 nt, hsa; identical to SEQ ID NO: 259873

SEQ ID NO: 721735 - RNA, 64 nt, hsa; identical to SEQ ID NO: 259874

SEQ ID NO: 721736 - RNA, 64 nt, hsa; identical to SEQ ID NO: 259875

SEQ ID NO: 721737 - RNA, 64 nt, hsa; identical to SEQ ID NO: 259876

SEQ ID NO: 721738 - RNA, 64 nt, hsa; identical to SEQ ID NO: 259877

SEQ ID NO: 721739 - RNA, 64 nt, hsa; identical to SEQ ID NO: 259878

SEQ ID NO: 721740 - RNA, 64 nt, hsa; identical to SEQ ID NO: 259879

SEQ ID NO: 721741 - RNA, 64 nt, hsa; identical to SEQ ID NO: 259880

SEQ ID NO: 721742 - RNA, 64 nt, hsa; identical to SEQ ID NO: 259881

SEQ ID NO: 721743 - RNA, 64 nt, hsa; identical to SEQ ID NO: 259882

SEQ ID NO: 721744 - RNA, 64 nt, hsa; identical to SEQ ID NO: 259883

SEQ ID NO: 721745 - RNA, 64 nt, hsa; identical to SEQ ID NO: 259884

SEQ ID NO: 721746 - RNA, 64 nt, hsa; identical to SEQ ID NO: 259885

SEQ ID NO: 721747 - RNA, 64 nt, hsa; identical to SEQ ID NO: 259886

SEQ ID NO: 721748 - RNA, 64 nt, hsa; identical to SEQ ID NO: 259887

SEQ ID NO: 721749 - RNA, 64 nt, hsa; identical to SEQ ID NO: 259888

SEQ ID NO: 721750 - RNA, 64 nt, hsa; identical to SEQ ID NO: 259889

SEQ ID NO: 721751 - RNA, 64 nt, hsa; identical to SEQ ID NO: 259890

SEQ ID NO: 721752 - RNA, 64 nt, hsa; identical to SEQ ID NO: 259891

SEQ ID NO: 721753 - RNA, 64 nt, hsa; identical to SEQ ID NO: 259892

SEQ ID NO: 721754 - RNA, 64 nt, hsa; identical to SEQ ID NO: 211358

SEQ ID NO: 721755 - RNA, 64 nt, hsa; identical to SEQ ID NO: 211359

SEQ ID NO: 721756 - RNA, 64 nt, hsa; identical to SEQ ID NO: 211360

SEQ ID NO: 721757 - RNA, 64 nt, hsa; identical to SEQ ID NO: 211361

SEQ ID NO: 721758 - RNA, 64 nt, hsa; identical to SEQ ID NO: 211362

SEQ ID NO: 721759 - RNA, 64 nt, hsa; identical to SEQ ID NO: 211363

SEQ ID NO: 721760 - RNA, 64 nt, hsa; identical to SEQ ID NO: 211364

SEQ ID NO: 721761 - RNA, 64 nt, hsa; identical to SEQ ID NO: 211365

SEQ ID NO: 721762 - RNA, 64 nt, hsa; identical to SEQ ID NO: 211366

SEQ ID NO: 721763 - RNA, 64 nt, hsa; identical to SEQ ID NO: 211367

SEQ ID NO: 721764 - RNA, 64 nt, hsa; identical to SEQ ID NO: 211368

SEQ ID NO: 721765 - RNA, 64 nt, hsa; identical to SEQ ID NO: 211369

SEQ ID NO: 721766 - RNA, 64 nt, hsa; identical to SEQ ID NO: 211370

SEQ ID NO: 721767 - RNA, 64 nt, hsa; identical to SEQ ID NO: 211371

SEQ ID NO: 721768 - RNA, 64 nt, hsa; identical to SEQ ID NO: 211372

SEQ ID NO: 721769 - RNA, 64 nt, hsa; identical to SEQ ID NO: 211373

SEQ ID NO: 721770 - RNA, 64 nt, hsa; identical to SEQ ID NO: 211374

SEQ ID NO: 721771 - RNA, 64 nt, hsa; identical to SEQ ID NO: 211375

SEQ ID NO: 721772 - RNA, 50 nt, hsa; identical to SEQ ID NO: 178066

SEQ ID NO: 721773 - RNA, 64 nt, hsa; identical to SEQ ID NO: 211377

SEQ ID NO: 721774 - RNA, 64 nt, hsa; identical to SEQ ID NO: 211378

SEQ ID NO: 721775 - RNA, 64 nt, hsa; identical to SEQ ID NO: 211379

SEQ ID NO: 721776 - RNA, 64 nt, hsa; identical to SEQ ID NO: 211380

SEQ ID NO: 721777 - RNA, 64 nt, hsa; identical to SEQ ID NO: 211381

SEQ ID NO: 721778 - RNA, 64 nt, hsa; identical to SEQ ID NO: 211382

SEQ ID NO: 721779 - RNA, 64 nt, hsa; identical to SEQ ID NO: 211383

SEQ ID NO: 721780 - RNA, 64 nt, hsa; identical to SEQ ID NO: 211384

SEQ ID NO: 721781 - RNA, 64 nt, hsa; identical to SEQ ID NO: 211385

SEQ ID NO: 721782 - RNA, 64 nt, hsa; identical to SEQ ID NO: 211386

SEQ ID NO: 721783 - RNA, 64 nt, hsa; identical to SEQ ID NO: 211387

SEQ ID NO: 721784 - RNA, 64 nt, hsa; identical to SEQ ID NO: 211388

SEQ ID NO: 721785 - RNA, 64 nt, hsa; identical to SEQ ID NO: 211389

SEQ ID NO: 721786 - RNA, 64 nt, hsa; identical to SEQ ID NO: 211390

SEQ ID NO: 721787 - RNA, 64 nt, hsa; identical to SEQ ID NO: 211391

SEQ ID NO: 721788 - RNA, 64 nt, hsa; identical to SEQ ID NO: 211392

SEQ ID NO: 721789 - RNA, 64 nt, hsa; identical to SEQ ID NO: 211393

SEQ ID NO: 721790 - RNA, 64 nt, hsa; identical to SEQ ID NO: 211394

SEQ ID NO: 721791 - RNA, 64 nt, hsa; identical to SEQ ID NO: 211395

SEQ ID NO: 721792 - RNA, 64 nt, hsa; identical to SEQ ID NO: 211396

SEQ ID NO: 721793 - RNA, 64 nt, hsa; identical to SEQ ID NO: 211397

SEQ ID NO: 721794 - RNA, 64 nt, hsa; identical to SEQ ID NO: 211398

SEQ ID NO: 721795 - RNA, 64 nt, hsa; identical to SEQ ID NO: 211399

SEQ ID NO: 721796 - RNA, 64 nt, hsa; identical to SEQ ID NO: 211400

SEQ ID NO: 721797 - RNA, 64 nt, hsa; identical to SEQ ID NO: 211401

SEQ ID NO: 721798 - RNA, 64 nt, hsa; identical to SEQ ID NO: 211402

SEQ ID NO: 721799 - RNA, 64 nt, hsa; identical to SEQ ID NO: 211403

SEQ ID NO: 721800 - RNA, 64 nt, hsa; identical to SEQ ID NO: 211404

SEQ ID NO: 721801 - RNA, 64 nt, hsa; identical to SEQ ID NO: 211405

SEQ ID NO: 721802 - RNA, 64 nt, hsa; identical to SEQ ID NO: 211406

SEQ ID NO: 721803 - RNA, 64 nt, hsa; identical to SEQ ID NO: 211407

SEQ ID NO: 721804 - RNA, 64 nt, hsa; identical to SEQ ID NO: 211408

SEQ ID NO: 721805 - RNA, 64 nt, hsa; identical to SEQ ID NO: 211409

SEQ ID NO: 721806 - RNA, 64 nt, hsa; identical to SEQ ID NO: 211410

SEQ ID NO: 721807 - RNA, 64 nt, hsa; identical to SEQ ID NO: 211411

SEQ ID NO: 721808 - RNA, 64 nt, hsa; identical to SEQ ID NO: 211412

SEQ ID NO: 721809 - RNA, 64 nt, hsa; identical to SEQ ID NO: 211413

SEQ ID NO: 721810 - RNA, 64 nt, hsa; identical to SEQ ID NO: 211414

SEQ ID NO: 721811 - RNA, 64 nt, hsa; identical to SEQ ID NO: 211415

SEQ ID NO: 721812 - RNA, 64 nt, hsa; identical to SEQ ID NO: 211416

SEQ ID NO: 721813 - RNA, 64 nt, hsa; identical to SEQ ID NO: 211417

SEQ ID NO: 721814 - RNA, 64 nt, hsa; identical to SEQ ID NO: 211418

SEQ ID NO: 721815 - RNA, 64 nt, hsa; identical to SEQ ID NO: 211419

SEQ ID NO: 721816 - RNA, 64 nt, hsa; identical to SEQ ID NO: 211420

SEQ ID NO: 721817 - RNA, 64 nt, hsa; identical to SEQ ID NO: 211421

SEQ ID NO: 721818 - RNA, 64 nt, hsa; identical to SEQ ID NO: 211422

SEQ ID NO: 721819 - RNA, 64 nt, hsa; identical to SEQ ID NO: 211423

SEQ ID NO: 721820 - RNA, 64 nt, hsa; identical to SEQ ID NO: 211424

SEQ ID NO: 721821 - RNA, 64 nt, hsa; identical to SEQ ID NO: 211425

SEQ ID NO: 721822 - RNA, 64 nt, hsa; identical to SEQ ID NO: 211426

SEQ ID NO: 721823 - RNA, 64 nt, hsa; identical to SEQ ID NO: 211427

SEQ ID NO: 721824 - RNA, 64 nt, hsa; identical to SEQ ID NO: 211428

SEQ ID NO: 721825 - RNA, 64 nt, hsa; identical to SEQ ID NO: 211429

SEQ ID NO: 721826 - RNA, 64 nt, hsa; identical to SEQ ID NO: 211430

SEQ ID NO: 721827 - RNA, 64 nt, hsa; identical to SEQ ID NO: 211424

SEQ ID NO: 721828 - RNA, 64 nt, hsa; identical to SEQ ID NO: 211423

SEQ ID NO: 721829 - RNA, 64 nt, hsa; identical to SEQ ID NO: 211433

SEQ ID NO: 721830 - RNA, 64 nt, hsa; identical to SEQ ID NO: 211434

SEQ ID NO: 721831 - RNA, 64 nt, hsa; identical to SEQ ID NO: 211435

SEQ ID NO: 721832 - RNA, 64 nt, hsa; identical to SEQ ID NO: 211436

SEQ ID NO: 721833 - RNA, 64 nt, hsa; identical to SEQ ID NO: 211437

SEQ ID NO: 721834 - RNA, 64 nt, hsa; identical to SEQ ID NO: 211438

SEQ ID NO: 721835 - RNA, 64 nt, hsa; identical to SEQ ID NO: 211439

SEQ ID NO: 721836 - RNA, 64 nt, hsa; identical to SEQ ID NO: 211440

SEQ ID NO: 721837 - RNA, 64 nt, hsa; identical to SEQ ID NO: 211441

SEQ ID NO: 721838 - RNA, 64 nt, hsa; identical to SEQ ID NO: 211442

SEQ ID NO: 721839 - RNA, 64 nt, hsa; identical to SEQ ID NO: 211443

SEQ ID NO: 721840 - RNA, 64 nt, hsa; identical to SEQ ID NO: 211444

SEQ ID NO: 721841 - RNA, 64 nt, hsa; identical to SEQ ID NO: 211445

SEQ ID NO: 721842 - RNA, 64 nt, hsa; identical to SEQ ID NO: 211446

SEQ ID NO: 721843 - RNA, 64 nt, hsa; identical to SEQ ID NO: 211447

SEQ ID NO: 721844 - RNA, 64 nt, hsa; identical to SEQ ID NO: 211448

SEQ ID NO: 721845 - RNA, 64 nt, hsa; identical to SEQ ID NO: 211449

SEQ ID NO: 721846 - RNA, 64 nt, hsa; identical to SEQ ID NO: 211450

SEQ ID NO: 721847 - RNA, 64 nt, hsa; identical to SEQ ID NO: 211451

SEQ ID NO: 721848 - RNA, 64 nt, hsa; identical to SEQ ID NO: 211452

SEQ ID NO: 721849 - RNA, 64 nt, hsa; identical to SEQ ID NO: 211453

SEQ ID NO: 721850 - RNA, 64 nt, hsa; identical to SEQ ID NO: 211454

SEQ ID NO: 721851 - RNA, 64 nt, hsa; identical to SEQ ID NO: 211455

SEQ ID NO: 721852 - RNA, 64 nt, hsa; identical to SEQ ID NO: 211456

SEQ ID NO: 721853 - RNA, 64 nt, hsa; identical to SEQ ID NO: 211457

SEQ ID NO: 721854 - RNA, 64 nt, hsa; identical to SEQ ID NO: 211458

SEQ ID NO: 721855 - RNA, 64 nt, hsa; identical to SEQ ID NO: 211459

SEQ ID NO: 721856 - RNA, 64 nt, hsa; identical to SEQ ID NO: 211460

SEQ ID NO: 721857 - RNA, 64 nt, hsa; identical to SEQ ID NO: 211461

SEQ ID NO: 721858 - RNA, 64 nt, hsa; identical to SEQ ID NO: 211462

SEQ ID NO: 721859 - RNA, 64 nt, hsa; identical to SEQ ID NO: 211463

SEQ ID NO: 721860 - RNA, 64 nt, hsa; identical to SEQ ID NO: 211464

SEQ ID NO: 721861 - RNA, 64 nt, hsa; identical to SEQ ID NO: 211465

SEQ ID NO: 721862 - RNA, 64 nt, hsa; identical to SEQ ID NO: 211466

SEQ ID NO: 721863 - RNA, 64 nt, hsa; identical to SEQ ID NO: 211467

SEQ ID NO: 721864 - RNA, 64 nt, hsa; identical to SEQ ID NO: 211468

SEQ ID NO: 721865 - RNA, 64 nt, hsa; identical to SEQ ID NO: 211469

SEQ ID NO: 721866 - RNA, 64 nt, hsa; identical to SEQ ID NO: 211470

SEQ ID NO: 721867 - RNA, 64 nt, hsa; identical to SEQ ID NO: 211471

SEQ ID NO: 721868 - RNA, 64 nt, hsa; identical to SEQ ID NO: 211472

SEQ ID NO: 721869 - RNA, 64 nt, hsa; identical to SEQ ID NO: 211473

SEQ ID NO: 721870 - RNA, 64 nt, hsa; identical to SEQ ID NO: 211474

SEQ ID NO: 721871 - RNA, 64 nt, hsa; identical to SEQ ID NO: 211475

SEQ ID NO: 721872 - RNA, 64 nt, hsa; identical to SEQ ID NO: 211476

SEQ ID NO: 721873 - RNA, 64 nt, hsa; identical to SEQ ID NO: 211477

SEQ ID NO: 721874 - RNA, 64 nt, hsa; identical to SEQ ID NO: 211478

SEQ ID NO: 721875 - RNA, 64 nt, hsa; identical to SEQ ID NO: 211479

SEQ ID NO: 721876 - RNA, 64 nt, hsa; identical to SEQ ID NO: 211480

SEQ ID NO: 721877 - RNA, 64 nt, hsa; identical to SEQ ID NO: 211481

SEQ ID NO: 721878 - RNA, 64 nt, hsa; identical to SEQ ID NO: 211482

SEQ ID NO: 721879 - RNA, 64 nt, hsa; identical to SEQ ID NO: 211483

SEQ ID NO: 721880 - RNA, 64 nt, hsa; identical to SEQ ID NO: 211484

SEQ ID NO: 721881 - RNA, 64 nt, hsa; identical to SEQ ID NO: 211485

SEQ ID NO: 721882 - RNA, 64 nt, hsa; identical to SEQ ID NO: 211486

SEQ ID NO: 721883 - RNA, 64 nt, hsa; identical to SEQ ID NO: 211487

SEQ ID NO: 721884 - RNA, 64 nt, hsa; identical to SEQ ID NO: 211488

SEQ ID NO: 721885 - RNA, 64 nt, hsa; identical to SEQ ID NO: 211489

SEQ ID NO: 721886 - RNA, 64 nt, hsa; identical to SEQ ID NO: 211490

SEQ ID NO: 721887 - RNA, 64 nt, hsa; identical to SEQ ID NO: 211491

SEQ ID NO: 721888 - RNA, 64 nt, hsa; identical to SEQ ID NO: 211492

SEQ ID NO: 721889 - RNA, 64 nt, hsa; identical to SEQ ID NO: 211493

SEQ ID NO: 721890 - RNA, 64 nt, hsa; identical to SEQ ID NO: 211494

SEQ ID NO: 721891 - RNA, 64 nt, hsa; identical to SEQ ID NO: 211495

SEQ ID NO: 721892 - RNA, 64 nt, hsa; identical to SEQ ID NO: 211496

SEQ ID NO: 721893 - RNA, 64 nt, hsa; identical to SEQ ID NO: 211497

SEQ ID NO: 721894 - RNA, 64 nt, hsa; identical to SEQ ID NO: 211498

SEQ ID NO: 721895 - RNA, 64 nt, hsa; identical to SEQ ID NO: 211499

SEQ ID NO: 721896 - RNA, 64 nt, hsa; identical to SEQ ID NO: 211500

SEQ ID NO: 721897 - RNA, 64 nt, hsa; identical to SEQ ID NO: 211501

SEQ ID NO: 721898 - RNA, 64 nt, hsa; identical to SEQ ID NO: 211502

SEQ ID NO: 721899 - RNA, 64 nt, hsa; identical to SEQ ID NO: 211503

SEQ ID NO: 721900 - RNA, 64 nt, hsa; identical to SEQ ID NO: 211504

SEQ ID NO: 721901 - RNA, 64 nt, hsa; identical to SEQ ID NO: 211505

SEQ ID NO: 721902 - RNA, 64 nt, hsa; identical to SEQ ID NO: 211506

SEQ ID NO: 721903 - RNA, 64 nt, hsa; identical to SEQ ID NO: 211507

SEQ ID NO: 721904 - RNA, 64 nt, hsa; identical to SEQ ID NO: 211508

SEQ ID NO: 721905 - RNA, 64 nt, hsa; identical to SEQ ID NO: 211509

SEQ ID NO: 721906 - RNA, 64 nt, hsa; identical to SEQ ID NO: 211510

SEQ ID NO: 721907 - RNA, 64 nt, hsa; identical to SEQ ID NO: 211511

SEQ ID NO: 721908 - RNA, 64 nt, hsa; identical to SEQ ID NO: 211512

SEQ ID NO: 721909 - RNA, 64 nt, hsa; identical to SEQ ID NO: 211513

SEQ ID NO: 721910 - RNA, 64 nt, hsa; identical to SEQ ID NO: 211514

SEQ ID NO: 721911 - RNA, 64 nt, hsa; identical to SEQ ID NO: 211515

SEQ ID NO: 721912 - RNA, 64 nt, hsa; identical to SEQ ID NO: 211516

SEQ ID NO: 721913 - RNA, 64 nt, hsa; identical to SEQ ID NO: 211517

SEQ ID NO: 721914 - RNA, 64 nt, hsa; identical to SEQ ID NO: 211518

SEQ ID NO: 721915 - RNA, 64 nt, hsa; identical to SEQ ID NO: 211519

SEQ ID NO: 721916 - RNA, 64 nt, hsa; identical to SEQ ID NO: 211520

SEQ ID NO: 721917 - RNA, 64 nt, hsa; identical to SEQ ID NO: 211521

SEQ ID NO: 721918 - RNA, 64 nt, hsa; identical to SEQ ID NO: 211522

SEQ ID NO: 721919 - RNA, 64 nt, hsa; identical to SEQ ID NO: 211523

SEQ ID NO: 721920 - RNA, 64 nt, hsa; identical to SEQ ID NO: 211524

SEQ ID NO: 721921 - RNA, 64 nt, hsa; identical to SEQ ID NO: 211525

SEQ ID NO: 721922 - RNA, 64 nt, hsa; identical to SEQ ID NO: 211526

SEQ ID NO: 721923 - RNA, 64 nt, hsa; identical to SEQ ID NO: 211527

SEQ ID NO: 721924 - RNA, 64 nt, hsa; identical to SEQ ID NO: 211528

SEQ ID NO: 721925 - RNA, 64 nt, hsa; identical to SEQ ID NO: 211529

SEQ ID NO: 721926 - RNA, 64 nt, hsa; identical to SEQ ID NO: 211530

SEQ ID NO: 721927 - RNA, 64 nt, hsa; identical to SEQ ID NO: 211531

SEQ ID NO: 721928 - RNA, 64 nt, hsa; identical to SEQ ID NO: 211532

SEQ ID NO: 721929 - RNA, 64 nt, hsa; identical to SEQ ID NO: 211533

SEQ ID NO: 721930 - RNA, 64 nt, hsa; identical to SEQ ID NO: 211534

SEQ ID NO: 721931 - RNA, 64 nt, hsa; identical to SEQ ID NO: 211535

SEQ ID NO: 721932 - RNA, 64 nt, hsa; identical to SEQ ID NO: 211536

SEQ ID NO: 721933 - RNA, 64 nt, hsa; identical to SEQ ID NO: 211537

SEQ ID NO: 721934 - RNA, 64 nt, hsa; identical to SEQ ID NO: 211538

SEQ ID NO: 721935 - RNA, 64 nt, hsa; identical to SEQ ID NO: 211539

SEQ ID NO: 721936 - RNA, 64 nt, hsa; identical to SEQ ID NO: 211540

SEQ ID NO: 721937 - RNA, 64 nt, hsa; identical to SEQ ID NO: 211541

SEQ ID NO: 721938 - RNA, 64 nt, hsa; identical to SEQ ID NO: 211542

SEQ ID NO: 721939 - RNA, 64 nt, hsa; identical to SEQ ID NO: 211543

SEQ ID NO: 721940 - RNA, 64 nt, hsa; identical to SEQ ID NO: 211544

SEQ ID NO: 721941 - RNA, 64 nt, hsa; identical to SEQ ID NO: 211545

SEQ ID NO: 721942 - RNA, 64 nt, hsa; identical to SEQ ID NO: 211546

SEQ ID NO: 721943 - RNA, 64 nt, hsa; identical to SEQ ID NO: 211547

SEQ ID NO: 721944 - RNA, 64 nt, hsa; identical to SEQ ID NO: 211548

SEQ ID NO: 721945 - RNA, 64 nt, hsa; identical to SEQ ID NO: 211549

SEQ ID NO: 721946 - RNA, 64 nt, hsa; identical to SEQ ID NO: 211550

SEQ ID NO: 721947 - RNA, 64 nt, hsa; identical to SEQ ID NO: 211551

SEQ ID NO: 721948 - RNA, 64 nt, hsa; identical to SEQ ID NO: 211552

SEQ ID NO: 721949 - RNA, 64 nt, hsa; identical to SEQ ID NO: 211553

SEQ ID NO: 721950 - RNA, 64 nt, hsa; identical to SEQ ID NO: 211554

SEQ ID NO: 721951 - RNA, 64 nt, hsa; identical to SEQ ID NO: 211555

SEQ ID NO: 721952 - RNA, 64 nt, hsa; identical to SEQ ID NO: 211556

SEQ ID NO: 721953 - RNA, 64 nt, hsa; identical to SEQ ID NO: 211557

SEQ ID NO: 721954 - RNA, 64 nt, hsa; identical to SEQ ID NO: 211558

SEQ ID NO: 721955 - RNA, 64 nt, hsa; identical to SEQ ID NO: 211559

SEQ ID NO: 721956 - RNA, 64 nt, hsa; identical to SEQ ID NO: 211560

SEQ ID NO: 721957 - RNA, 64 nt, hsa; identical to SEQ ID NO: 194965

SEQ ID NO: 721958 - RNA, 64 nt, hsa; identical to SEQ ID NO: 194966

SEQ ID NO: 721959 - RNA, 64 nt, hsa; identical to SEQ ID NO: 194967

SEQ ID NO: 721960 - RNA, 64 nt, hsa; identical to SEQ ID NO: 194968

SEQ ID NO: 721961 - RNA, 64 nt, hsa; identical to SEQ ID NO: 194969

SEQ ID NO: 721962 - RNA, 64 nt, hsa; identical to SEQ ID NO: 194970

SEQ ID NO: 721963 - RNA, 64 nt, hsa; identical to SEQ ID NO: 194971

SEQ ID NO: 721964 - RNA, 64 nt, hsa; identical to SEQ ID NO: 194972

SEQ ID NO: 721965 - RNA, 64 nt, hsa; identical to SEQ ID NO: 194973

SEQ ID NO: 721966 - RNA, 64 nt, hsa; identical to SEQ ID NO: 194974

SEQ ID NO: 721967 - RNA, 64 nt, hsa; identical to SEQ ID NO: 194975

SEQ ID NO: 721968 - RNA, 64 nt, hsa; identical to SEQ ID NO: 194976

SEQ ID NO: 721969 - RNA, 64 nt, hsa; identical to SEQ ID NO: 194977

SEQ ID NO: 721970 - RNA, 64 nt, hsa; identical to SEQ ID NO: 194978

SEQ ID NO: 721971 - RNA, 64 nt, hsa; identical to SEQ ID NO: 194979

SEQ ID NO: 721972 - RNA, 64 nt, hsa; identical to SEQ ID NO: 194980

SEQ ID NO: 721973 - RNA, 64 nt, hsa; identical to SEQ ID NO: 194981

SEQ ID NO: 721974 - RNA, 64 nt, hsa; identical to SEQ ID NO: 194982

SEQ ID NO: 721975 - RNA, 64 nt, hsa
agaacguaucauccuagcuuccucucuuaauaaaccuagaaaaacggguaguaaacuguggaua

SEQ ID NO: 721976 - RNA, 64 nt, hsa
ugugcaaggaucuuauuugugaugccuucccuccccuagaaagauuuugugcaauauauuaaau

SEQ ID NO: 721977 - RNA, 64 nt, hsa
ucuccugucccuaaagggguuaagagagagaucaccuagaaaucccucuggacacuuguggguu

SEQ ID NO: 721978 - RNA, 64 nt, hsa
cauuuauuuuuuaaacuuaaaagccuagaaauuuccuagaaagaaaauaggagacaucucagag

SEQ ID NO: 721979 - RNA, 64 nt, hsa
uacaucauaaucauuuauuuuuuaaacuuaaaagccuagaaauuuccuagaaagaaaauaggag

SEQ ID NO: 721980 - RNA, 64 nt, hsa
ucuccaaaacugaacugauugcuuguugagauuaccuagaaagcuuuuggaaaaaaauagagcu

SEQ ID NO: 721981 - RNA, 64 nt, hsa
cagauacacugaaucggaaucccuagggcuagagccuagaaaucucacuuuuuaaaaugcuucc

SEQ ID NO: 721982 - RNA, 64 nt, hsa
uagaagguagauaagaauuaaaaggguuuaauuuccuagaaagaaaauggaaaaauggucauuu

SEQ ID NO: 721983 - RNA, 64 nt, hsa
uccuucccuucccugugcagcauucaaaaucaccccuagaaaaagugaguguuuuaaugagacu

SEQ ID NO: 721984 - RNA, 64 nt, hsa
guugagaaagaacaaaaagggaauuuccagauguccuagaaauccuagcaacagauuucucugg

SEQ ID NO: 721985 - RNA, 64 nt, hsa
aaauagaacuguaaugggguuguauuuaugggcgccuagaaagaaaacacaaggacuugguagg

SEQ ID NO: 721986 - RNA, 64 nt, hsa
gggcaccaucacaauacagauaacauuagguuguccuagaaaggguguggagggaggaaggggg

SEQ ID NO: 721987 - RNA, 64 nt, hsa
uguuucucauauggucuaccaguuugcugaugucccuagaaaacaaugcaaaaccuuugaggua

SEQ ID NO: 721988 - RNA, 64 nt, hsa
ccuuuugauacaacuagguuauucauaauguauaccuagaaaagugaaauugaaaauaccaaaa

SEQ ID NO: 721989 - RNA, 64 nt, hsa
aaaagugcacauacgcaacuguguucucuguuuuccuagaaaaccaaaaucaaacugagauuuc

SEQ ID NO: 721990 - RNA, 64 nt, hsa
uaucugauauuaaacaucaucugcauuuuacuugccuagaaaauacacgguaacuuuucugccu

SEQ ID NO: 721991 - RNA, 64 nt, hsa
ugaauggcaggugucccauaucugguuauguuaaccuagaaagggcucacucuaccucuaggca

SEQ ID NO: 721992 - RNA, 64 nt, hsa
aaucuaaaacuguuaauuuaacccuuaacuugugccuagaaacuacagcacauauaaaauaugu

SEQ ID NO: 721993 - RNA, 64 nt, hsa
ugaccaaccuuagguaaaacaaaaauauuguaauccuagaaauuauccuccagcuuucucaccu

SEQ ID NO: 721994 - RNA, 64 nt, hsa
agagaugaacaacuuugccuucaaaaaugugcugccuagaaacagaccugcauucaaccaacug

SEQ ID NO: 721995 - RNA, 64 nt, hsa
cccuaaggagccugggaugauguuggucaaaugaccuagaaacaaggauucuaccugaacugaa

SEQ ID NO: 721996 - RNA, 64 nt, hsa
aagaaaagccucagcucauagugaacacagcagaccuagaaauguagcagcagccuacugagua

SEQ ID NO: 721997 - RNA, 64 nt, hsa
guggcagacauaucacaagaguccccagacucugccuagaaacaguguuugcccuuuggccagu

SEQ ID NO: 721998 - RNA, 64 nt, hsa
auagaggauacaaaauugucuaauuuucaugacaccuagaaaacguuuucccagagcugccuau

SEQ ID NO: 721999 - RNA, 64 nt, hsa
cucucaaaaaaaauguaucagaaaaguuugauuaccuagaaaguguguauagaaacugcaaaua

SEQ ID NO: 722000 - RNA, 64 nt, hsa
gauuguguggaaccaguauguagcaaauggaaagccuagaaauaucuuauuuucuaaguuuacc

SEQ ID NO: 722001 - RNA, 64 nt, hsa
ugggucuuuacuucugggaauuuguauguaacagccuagaaaauuaaaaggagguggaugcauc

SEQ ID NO: 722002 - RNA, 64 nt, hsa; identical to SEQ ID NO: 722000

SEQ ID NO: 722003 - RNA, 64 nt, hsa; identical to SEQ ID NO: 722001

SEQ ID NO: 722004 - RNA, 64 nt, hsa; identical to SEQ ID NO: 558207

SEQ ID NO: 722005 - RNA, 64 nt, hsa; identical to SEQ ID NO: 558208

SEQ ID NO: 722006 - RNA, 64 nt, hsa; identical to SEQ ID NO: 558209

SEQ ID NO: 722007 - RNA, 64 nt, hsa; identical to SEQ ID NO: 558210

SEQ ID NO: 722008 - RNA, 64 nt, hsa; identical to SEQ ID NO: 558211

SEQ ID NO: 722009 - RNA, 64 nt, hsa; identical to SEQ ID NO: 558212

SEQ ID NO: 722010 - RNA, 64 nt, hsa; identical to SEQ ID NO: 558213

SEQ ID NO: 722011 - RNA, 64 nt, hsa; identical to SEQ ID NO: 558214

SEQ ID NO: 722012 - RNA, 64 nt, hsa; identical to SEQ ID NO: 558215

SEQ ID NO: 722013 - RNA, 64 nt, hsa; identical to SEQ ID NO: 558216

SEQ ID NO: 722014 - RNA, 64 nt, hsa; identical to SEQ ID NO: 558217

SEQ ID NO: 722015 - RNA, 64 nt, hsa; identical to SEQ ID NO: 558218

SEQ ID NO: 722016 - RNA, 64 nt, hsa; identical to SEQ ID NO: 558219

SEQ ID NO: 722017 - RNA, 64 nt, hsa; identical to SEQ ID NO: 558220

SEQ ID NO: 722018 - RNA, 64 nt, hsa; identical to SEQ ID NO: 558221

SEQ ID NO: 722019 - RNA, 64 nt, hsa; identical to SEQ ID NO: 558222

SEQ ID NO: 722020 - RNA, 64 nt, hsa; identical to SEQ ID NO: 558223

SEQ ID NO: 722021 - RNA, 64 nt, hsa; identical to SEQ ID NO: 558224

SEQ ID NO: 722022 - RNA, 64 nt, hsa; identical to SEQ ID NO: 558225

SEQ ID NO: 722023 - RNA, 64 nt, hsa; identical to SEQ ID NO: 558226

SEQ ID NO: 722024 - RNA, 64 nt, hsa; identical to SEQ ID NO: 558227

SEQ ID NO: 722025 - RNA, 64 nt, hsa; identical to SEQ ID NO: 558228

SEQ ID NO: 722026 - RNA, 64 nt, hsa; identical to SEQ ID NO: 302224

SEQ ID NO: 722027 - RNA, 64 nt, hsa; identical to SEQ ID NO: 302225

SEQ ID NO: 722028 - RNA, 64 nt, hsa; identical to SEQ ID NO: 302226

SEQ ID NO: 722029 - RNA, 64 nt, hsa; identical to SEQ ID NO: 302227

SEQ ID NO: 722030 - RNA, 64 nt, hsa; identical to SEQ ID NO: 302228

SEQ ID NO: 722031 - RNA, 64 nt, hsa; identical to SEQ ID NO: 302229

SEQ ID NO: 722032 - RNA, 64 nt, hsa; identical to SEQ ID NO: 302230

SEQ ID NO: 722033 - RNA, 64 nt, hsa; identical to SEQ ID NO: 302231

SEQ ID NO: 722034 - RNA, 64 nt, hsa; identical to SEQ ID NO: 302232

SEQ ID NO: 722035 - RNA, 64 nt, hsa; identical to SEQ ID NO: 302233

SEQ ID NO: 722036 - RNA, 64 nt, hsa; identical to SEQ ID NO: 302234

SEQ ID NO: 722037 - RNA, 64 nt, hsa; identical to SEQ ID NO: 302235

SEQ ID NO: 722038 - RNA, 64 nt, hsa; identical to SEQ ID NO: 302236

SEQ ID NO: 722039 - RNA, 64 nt, hsa; identical to SEQ ID NO: 302237

SEQ ID NO: 722040 - RNA, 64 nt, hsa; identical to SEQ ID NO: 302238

SEQ ID NO: 722041 - RNA, 64 nt, hsa; identical to SEQ ID NO: 302239

SEQ ID NO: 722042 - RNA, 64 nt, hsa; identical to SEQ ID NO: 302240

SEQ ID NO: 722043 - RNA, 64 nt, hsa; identical to SEQ ID NO: 302241

SEQ ID NO: 722044 - RNA, 64 nt, hsa; identical to SEQ ID NO: 302242

SEQ ID NO: 722045 - RNA, 64 nt, hsa; identical to SEQ ID NO: 302243

SEQ ID NO: 722046 - RNA, 64 nt, hsa; identical to SEQ ID NO: 302244

SEQ ID NO: 722047 - RNA, 64 nt, hsa; identical to SEQ ID NO: 302245

SEQ ID NO: 722048 - RNA, 64 nt, hsa; identical to SEQ ID NO: 302246

SEQ ID NO: 722049 - RNA, 64 nt, hsa; identical to SEQ ID NO: 302247

SEQ ID NO: 722050 - RNA, 64 nt, hsa; identical to SEQ ID NO: 302248

SEQ ID NO: 722051 - RNA, 64 nt, hsa; identical to SEQ ID NO: 302249

SEQ ID NO: 722052 - RNA, 64 nt, hsa; identical to SEQ ID NO: 302250

SEQ ID NO: 722053 - RNA, 64 nt, hsa; identical to SEQ ID NO: 302251

SEQ ID NO: 722054 - RNA, 64 nt, hsa
auuuagcauuuaaguugggguauuuagagccuguaaucuaaaugcuggcucaaauuuauucccc

SEQ ID NO: 722055 - RNA, 64 nt, hsa
gcauaaucauaagcaccucaacacuugaauacauaaucuaaaaauuauauaguaaagcugguag

SEQ ID NO: 722056 - RNA, 64 nt, hsa
aguguuuuaaaaagguuuuuaaugaauagucuuaaaucuaaauuugugugaauaauccuuuuaa

SEQ ID NO: 722057 - RNA, 64 nt, hsa
uuuaaagcccaguggauauuucaauuaaaaaaaaaaucuaaagaugaauaguccuuggucauuc

SEQ ID NO: 722058 - RNA, 64 nt, hsa
agucauuaugagaguauugacuaaauauuuucacaaucuaaauauugucacaaucuaaauuucu

SEQ ID NO: 722059 - RNA, 64 nt, hsa
ugacuaaauauuuucacaaucuaaauauugucacaaucuaaauuucuguaguagagagagccgu

SEQ ID NO: 722060 - RNA, 64 nt, hsa
aaggaggaaacauuuaaauuauaaaggacugaauaaucuaaaaagcauauaaaaguuucacaca

SEQ ID NO: 722061 - RNA, 64 nt, hsa
aauacaacagaauagccacccaauuucugucugaaaucuaaauuggauggauuugaccaucauu

SEQ ID NO: 722062 - RNA, 64 nt, hsa
auaaaucaaucuaugcuguucuguccuucuugagaaucuaaaacauaccacaaaaauacauccc

SEQ ID NO: 722063 - RNA, 64 nt, hsa
uccaaauuuuaaguuucuaaauaaucuucgcugaaaucuaaaauauacuauaacaaccguguuu

SEQ ID NO: 722064 - RNA, 64 nt, hsa
auaaugucauauguuaaaaauaaagagauguagaaaucuaaaugaauuaucacuguguauacag

SEQ ID NO: 722065 - RNA, 64 nt, hsa
agccauggucaucuggugaugaagagaaaaguuuaaucuaaaugauaugugcauuuccucauuu

SEQ ID NO: 722066 - RNA, 64 nt, hsa
uuaaagaucuaaauacaaaggauauacagucuugaaucuaaaauaauuugcuaacuaacuauuu

SEQ ID NO: 722067 - RNA, 64 nt, hsa
cuauuuugauucuucagagagaacuacuaauaaaaaucuaaaagguaugucuuggugugauaac

SEQ ID NO: 722068 - RNA, 64 nt, hsa
uccaaaagaaaacagaaaacaauuccacgaggccaaucuaaagggaaaaaauccuacacuacuu

SEQ ID NO: 722069 - RNA, 64 nt, hsa
uuuuuuuaaucaauuguagagaauagucauuuuuaaucuaaauuagagaauugugauacaaugg

SEQ ID NO: 722070 - RNA, 64 nt, hsa
cuccuuccucccuuccuuuacaguuuaaaaaaaaaaucuaaaaauaguuaagcacugugucaaa

SEQ ID NO: 722071 - RNA, 64 nt, hsa
uguuaugauugccauuucaauaaaugacauuaaaaaucuaaaggauauuauuguuugaauuuuu

SEQ ID NO: 722072 - RNA, 64 nt, hsa
cacauccaccgaugcauuuguggcuagaaauuuuaaucuaaacuuuuuuuaaaaaaaaucauaa

SEQ ID NO: 722073 - RNA, 64 nt, hsa
ugucaaauaucuucccuauaucuaaacaaugcaaaaucuaaaugaauaaguggucagacuccuu

SEQ ID NO: 722074 - RNA, 64 nt, hsa
cuuuguauuuaaaaguuaaaaaggacaaaaaaaaaaucuaaagcauuuaaaaucuagugaaaua

SEQ ID NO: 722075 - RNA, 64 nt, hsa
uaagaauuuugagagggugaggaggguuguucagaaucuaaauuacagauagaugauuguuucu

SEQ ID NO: 722076 - RNA, 64 nt, hsa
uccaucccuuccucccauuggccucuccuugccaaaucuaaauaguuuauauagggauggcaga

SEQ ID NO: 722077 - RNA, 64 nt, hsa
cgggaagacggaucccaccucccuuucuuagcagaaucuaaauuacagccagaccucuggcugc

SEQ ID NO: 722078 - RNA, 64 nt, hsa
aaacaucgagaaacuaugggaaaaaaaauugcaaaaucuaaaauaaaaaaugcaaaaucuaaaa

SEQ ID NO: 722079 - RNA, 64 nt, hsa
aaaaaaauugcaaaaucuaaaauaaaaaaugcaaaaucuaaaauaaaaaauggaaaggaaacuu

SEQ ID NO: 722080 - RNA, 64 nt, hsa
aacuauccccuugaagcaaguucucuugaaaggaaaucuaaacagugcacccccauggcugcca

SEQ ID NO: 722081 - RNA, 64 nt, hsa
uauaauauuauuuaaaaugcugagaaaaugaaaaaaucuaaauggugaaauauauacuaaugcc

SEQ ID NO: 722082 - RNA, 64 nt, hsa
auggugauucugaagcuuacaucucccuuaaaaaaaucuaaagcagcucuuaugggcuucuaau

SEQ ID NO: 722083 - RNA, 64 nt, hsa
aaaauguguaaucuaaaauauaccagcgaauuuaaaucuaaaaaugcuccuacuuuaaguaccu

SEQ ID NO: 722084 - RNA, 64 nt, hsa
uuuuauccuaggugauuuuuaaaugaaaauguguaaucuaaaauauaccagcgaauuuaaaucu

SEQ ID NO: 722085 - RNA, 64 nt, hsa; identical to SEQ ID NO: 291437

SEQ ID NO: 722086 - RNA, 64 nt, hsa; identical to SEQ ID NO: 291438

SEQ ID NO: 722087 - RNA, 64 nt, hsa; identical to SEQ ID NO: 291439

SEQ ID NO: 722088 - RNA, 64 nt, hsa; identical to SEQ ID NO: 291440

SEQ ID NO: 722089 - RNA, 64 nt, hsa; identical to SEQ ID NO: 291441

SEQ ID NO: 722090 - RNA, 64 nt, hsa; identical to SEQ ID NO: 291442

SEQ ID NO: 722091 - RNA, 64 nt, hsa; identical to SEQ ID NO: 291443

SEQ ID NO: 722092 - RNA, 64 nt, hsa; identical to SEQ ID NO: 291444

SEQ ID NO: 722093 - RNA, 64 nt, hsa; identical to SEQ ID NO: 291445

SEQ ID NO: 722094 - RNA, 64 nt, hsa; identical to SEQ ID NO: 291446

SEQ ID NO: 722095 - RNA, 64 nt, hsa; identical to SEQ ID NO: 291447

SEQ ID NO: 722096 - RNA, 64 nt, hsa; identical to SEQ ID NO: 291448

SEQ ID NO: 722097 - RNA, 64 nt, hsa; identical to SEQ ID NO: 291449

SEQ ID NO: 722098 - RNA, 64 nt, hsa; identical to SEQ ID NO: 291450

SEQ ID NO: 722099 - RNA, 59 nt, hsa
gccacaaguucuuguuuagagaccagagcaggauuaauaauuuauuuuaacauuuuagu

SEQ ID NO: 722100 - RNA, 59 nt, hsa
uuaauuaauuaaaauuaacagaugugaugaggauuaaaugaaucaaaagacuuaauuug

SEQ ID NO: 722101 - RNA, 59 nt, hsa
aauguuuaaguaaacucugucucaguuuuaggauuaaaauacccaccgguggugugaug

SEQ ID NO: 722102 - RNA, 59 nt, hsa
uuuuuaacuggaugaaaaaucuucauguuaggauuaauuuucuuaaucaccuccacacu

SEQ ID NO: 722103 - RNA, 59 nt, hsa
cuccuaacaauggaauauggccugggaugaggauuaacuguucuuuauuuauaagugcu

SEQ ID NO: 722104 - RNA, 59 nt, hsa
accccauacuaccucacagauguguugugaggauuaauaaaauuaugucuaugguauuu

SEQ ID NO: 722105 - RNA, 59 nt, hsa
aauuuagaucaauauuuugaauaugugaaaggauuaauuuaaacuuuacaauuuacauc

SEQ ID NO: 722106 - RNA, 59 nt, hsa
uaauauauuaguacauucuagaauguaaaaggauuaaacuuuacaauuuagaucaauau

SEQ ID NO: 722107 - RNA, 59 nt, hsa
auuguuuuuaccacaugaugacgugacucaggauuaaauccugagcuacaguuucaaaa

SEQ ID NO: 722108 - RNA, 59 nt, hsa
uguuaaacaugguaagacugagguucugcaggauuaaagucagauuaaggguacagaaa

SEQ ID NO: 722109 - RNA, 59 nt, hsa
uuuugcuguuuaugaucuauuuguagauuaggauuaaaauggauuuaauccauuuuuaa

SEQ ID NO: 722110 - RNA, 59 nt, hsa
ugugcuuuuuugauuuugcugacuuuaaaaggauuaaucugggcagacauuauguaaaa

SEQ ID NO: 722111 - RNA, 59 nt, hsa
uaacuagcccuuuaaggauuaacuaguuaaggauuaauagcaaaagauauuaaauaugc

SEQ ID NO: 722112 - RNA, 59 nt, hsa
ggacuaguuaaggauuaacuagcccuuuaaggauuaacuaguuaaggauuaauagcaaa

SEQ ID NO: 722113 - RNA, 59 nt, hsa
gauaaugcacaaaaugaagggacuaguuaaggauuaacuagcccuuuaaggauuaacua

SEQ ID NO: 722114 - RNA, 64 nt, hsa; identical to SEQ ID NO: 238553

SEQ ID NO: 722115 - RNA, 64 nt, hsa; identical to SEQ ID NO: 238554

SEQ ID NO: 722116 - RNA, 64 nt, hsa; identical to SEQ ID NO: 238555

SEQ ID NO: 722117 - RNA, 64 nt, hsa; identical to SEQ ID NO: 238556

SEQ ID NO: 722118 - RNA, 61 nt, hsa; identical to SEQ ID NO: 238557

SEQ ID NO: 722119 - RNA, 64 nt, hsa; identical to SEQ ID NO: 238558

SEQ ID NO: 722120 - RNA, 64 nt, hsa; identical to SEQ ID NO: 238559

SEQ ID NO: 722121 - RNA, 64 nt, hsa; identical to SEQ ID NO: 238560

SEQ ID NO: 722122 - RNA, 64 nt, hsa; identical to SEQ ID NO: 238561

SEQ ID NO: 722123 - RNA, 64 nt, hsa; identical to SEQ ID NO: 238562

SEQ ID NO: 722124 - RNA, 64 nt, hsa; identical to SEQ ID NO: 238563

SEQ ID NO: 722125 - RNA, 64 nt, hsa; identical to SEQ ID NO: 238564

SEQ ID NO: 722126 - RNA, 64 nt, hsa; identical to SEQ ID NO: 238565

SEQ ID NO: 722127 - RNA, 64 nt, hsa; identical to SEQ ID NO: 238566

SEQ ID NO: 722128 - RNA, 64 nt, hsa; identical to SEQ ID NO: 238567

SEQ ID NO: 722129 - RNA, 64 nt, hsa; identical to SEQ ID NO: 238568

SEQ ID NO: 722130 - RNA, 64 nt, hsa; identical to SEQ ID NO: 238569

SEQ ID NO: 722131 - RNA, 64 nt, hsa; identical to SEQ ID NO: 238570

SEQ ID NO: 722132 - RNA, 64 nt, hsa; identical to SEQ ID NO: 238571

SEQ ID NO: 722133 - RNA, 64 nt, hsa; identical to SEQ ID NO: 238572

SEQ ID NO: 722134 - RNA, 64 nt, hsa; identical to SEQ ID NO: 238573

SEQ ID NO: 722135 - RNA, 64 nt, hsa; identical to SEQ ID NO: 238574

SEQ ID NO: 722136 - RNA, 64 nt, hsa; identical to SEQ ID NO: 238575

SEQ ID NO: 722137 - RNA, 64 nt, hsa; identical to SEQ ID NO: 238576

SEQ ID NO: 722138 - RNA, 64 nt, hsa; identical to SEQ ID NO: 238577

SEQ ID NO: 722139 - RNA, 64 nt, hsa; identical to SEQ ID NO: 238578

SEQ ID NO: 722140 - RNA, 64 nt, hsa; identical to SEQ ID NO: 238579

SEQ ID NO: 722141 - RNA, 64 nt, hsa; identical to SEQ ID NO: 238580

SEQ ID NO: 722142 - RNA, 64 nt, hsa; identical to SEQ ID NO: 238581

SEQ ID NO: 722143 - RNA, 64 nt, hsa; identical to SEQ ID NO: 238582

SEQ ID NO: 722144 - RNA, 64 nt, hsa; identical to SEQ ID NO: 238583

SEQ ID NO: 722145 - RNA, 64 nt, hsa; identical to SEQ ID NO: 238584

SEQ ID NO: 722146 - RNA, 64 nt, hsa; identical to SEQ ID NO: 238585

SEQ ID NO: 722147 - RNA, 64 nt, hsa; identical to SEQ ID NO: 238586

SEQ ID NO: 722148 - RNA, 64 nt, hsa; identical to SEQ ID NO: 238587

SEQ ID NO: 722149 - RNA, 64 nt, hsa; identical to SEQ ID NO: 238588

SEQ ID NO: 722150 - RNA, 64 nt, hsa; identical to SEQ ID NO: 238589

SEQ ID NO: 722151 - RNA, 64 nt, hsa; identical to SEQ ID NO: 238590

SEQ ID NO: 722152 - RNA, 64 nt, hsa; identical to SEQ ID NO: 238591

SEQ ID NO: 722153 - RNA, 64 nt, hsa; identical to SEQ ID NO: 238592

SEQ ID NO: 722154 - RNA, 64 nt, hsa; identical to SEQ ID NO: 238593

SEQ ID NO: 722155 - RNA, 51 nt, hsa; identical to SEQ ID NO: 238594

SEQ ID NO: 722156 - RNA, 64 nt, hsa; identical to SEQ ID NO: 238595

SEQ ID NO: 722157 - RNA, 64 nt, hsa; identical to SEQ ID NO: 238596

SEQ ID NO: 722158 - RNA, 64 nt, hsa; identical to SEQ ID NO: 238597

SEQ ID NO: 722159 - RNA, 64 nt, hsa; identical to SEQ ID NO: 238598

SEQ ID NO: 722160 - RNA, 64 nt, hsa; identical to SEQ ID NO: 238599

SEQ ID NO: 722161 - RNA, 64 nt, hsa; identical to SEQ ID NO: 238600

SEQ ID NO: 722162 - RNA, 64 nt, hsa; identical to SEQ ID NO: 238601

SEQ ID NO: 722163 - RNA, 64 nt, hsa; identical to SEQ ID NO: 238602

SEQ ID NO: 722164 - RNA, 64 nt, hsa; identical to SEQ ID NO: 238603

SEQ ID NO: 722165 - RNA, 64 nt, hsa; identical to SEQ ID NO: 238604

SEQ ID NO: 722166 - RNA, 64 nt, hsa; identical to SEQ ID NO: 238605

SEQ ID NO: 722167 - RNA, 64 nt, hsa; identical to SEQ ID NO: 238606

SEQ ID NO: 722168 - RNA, 64 nt, hsa; identical to SEQ ID NO: 238607

SEQ ID NO: 722169 - RNA, 64 nt, hsa; identical to SEQ ID NO: 238608

SEQ ID NO: 722170 - RNA, 64 nt, hsa; identical to SEQ ID NO: 238609

SEQ ID NO: 722171 - RNA, 64 nt, hsa; identical to SEQ ID NO: 238610

SEQ ID NO: 722172 - RNA, 64 nt, hsa; identical to SEQ ID NO: 238611

SEQ ID NO: 722173 - RNA, 64 nt, hsa; identical to SEQ ID NO: 238612

SEQ ID NO: 722174 - RNA, 64 nt, hsa; identical to SEQ ID NO: 238613

SEQ ID NO: 722175 - RNA, 64 nt, hsa; identical to SEQ ID NO: 238614

SEQ ID NO: 722176 - RNA, 64 nt, hsa; identical to SEQ ID NO: 238615

SEQ ID NO: 722177 - RNA, 64 nt, hsa; identical to SEQ ID NO: 238616

SEQ ID NO: 722178 - RNA, 64 nt, hsa; identical to SEQ ID NO: 238617

SEQ ID NO: 722179 - RNA, 64 nt, hsa; identical to SEQ ID NO: 238618

SEQ ID NO: 722180 - RNA, 64 nt, hsa; identical to SEQ ID NO: 238619

SEQ ID NO: 722181 - RNA, 64 nt, hsa; identical to SEQ ID NO: 238620

SEQ ID NO: 722182 - RNA, 64 nt, hsa; identical to SEQ ID NO: 238621

SEQ ID NO: 722183 - RNA, 64 nt, hsa; identical to SEQ ID NO: 238622

SEQ ID NO: 722184 - RNA, 64 nt, hsa; identical to SEQ ID NO: 238623

SEQ ID NO: 722185 - RNA, 64 nt, hsa; identical to SEQ ID NO: 238624

SEQ ID NO: 722186 - RNA, 64 nt, hsa; identical to SEQ ID NO: 238625

SEQ ID NO: 722187 - RNA, 64 nt, hsa; identical to SEQ ID NO: 238626

SEQ ID NO: 722188 - RNA, 64 nt, hsa; identical to SEQ ID NO: 238627

SEQ ID NO: 722189 - RNA, 64 nt, hsa; identical to SEQ ID NO: 238628

SEQ ID NO: 722190 - RNA, 64 nt, hsa; identical to SEQ ID NO: 238629

SEQ ID NO: 722191 - RNA, 64 nt, hsa; identical to SEQ ID NO: 493291

SEQ ID NO: 722192 - RNA, 64 nt, hsa; identical to SEQ ID NO: 493292

SEQ ID NO: 722193 - RNA, 64 nt, hsa; identical to SEQ ID NO: 493293

SEQ ID NO: 722194 - RNA, 64 nt, hsa; identical to SEQ ID NO: 493294

SEQ ID NO: 722195 - RNA, 64 nt, hsa; identical to SEQ ID NO: 493295

SEQ ID NO: 722196 - RNA, 64 nt, hsa; identical to SEQ ID NO: 493296

SEQ ID NO: 722197 - RNA, 64 nt, hsa; identical to SEQ ID NO: 493297

SEQ ID NO: 722198 - RNA, 64 nt, hsa; identical to SEQ ID NO: 493298

SEQ ID NO: 722199 - RNA, 64 nt, hsa; identical to SEQ ID NO: 493299

SEQ ID NO: 722200 - RNA, 64 nt, hsa; identical to SEQ ID NO: 493300

SEQ ID NO: 722201 - RNA, 64 nt, hsa; identical to SEQ ID NO: 493301

SEQ ID NO: 722202 - RNA, 64 nt, hsa; identical to SEQ ID NO: 493302

SEQ ID NO: 722203 - RNA, 64 nt, hsa; identical to SEQ ID NO: 493303

SEQ ID NO: 722204 - RNA, 64 nt, hsa; identical to SEQ ID NO: 493304

SEQ ID NO: 722205 - RNA, 64 nt, hsa; identical to SEQ ID NO: 493305

SEQ ID NO: 722206 - RNA, 64 nt, hsa; identical to SEQ ID NO: 493306

SEQ ID NO: 722207 - RNA, 64 nt, hsa; identical to SEQ ID NO: 493307

SEQ ID NO: 722208 - RNA, 64 nt, hsa; identical to SEQ ID NO: 493308

SEQ ID NO: 722209 - RNA, 64 nt, hsa; identical to SEQ ID NO: 493309

SEQ ID NO: 722210 - RNA, 64 nt, hsa; identical to SEQ ID NO: 493310

SEQ ID NO: 722211 - RNA, 64 nt, hsa; identical to SEQ ID NO: 493311

SEQ ID NO: 722212 - RNA, 64 nt, hsa; identical to SEQ ID NO: 493312

SEQ ID NO: 722213 - RNA, 64 nt, hsa; identical to SEQ ID NO: 493313

SEQ ID NO: 722214 - RNA, 64 nt, hsa; identical to SEQ ID NO: 493314

SEQ ID NO: 722215 - RNA, 64 nt, hsa; identical to SEQ ID NO: 493315

SEQ ID NO: 722216 - RNA, 64 nt, hsa; identical to SEQ ID NO: 493316

SEQ ID NO: 722217 - RNA, 64 nt, hsa; identical to SEQ ID NO: 493317

SEQ ID NO: 722218 - RNA, 64 nt, hsa; identical to SEQ ID NO: 493318

SEQ ID NO: 722219 - RNA, 64 nt, hsa; identical to SEQ ID NO: 493319

SEQ ID NO: 722220 - RNA, 64 nt, hsa; identical to SEQ ID NO: 493320

SEQ ID NO: 722221 - RNA, 64 nt, hsa; identical to SEQ ID NO: 493321

SEQ ID NO: 722222 - RNA, 64 nt, hsa; identical to SEQ ID NO: 493322

SEQ ID NO: 722223 - RNA, 64 nt, hsa; identical to SEQ ID NO: 493323

SEQ ID NO: 722224 - RNA, 64 nt, hsa; identical to SEQ ID NO: 493324

SEQ ID NO: 722225 - RNA, 64 nt, hsa; identical to SEQ ID NO: 493325

SEQ ID NO: 722226 - RNA, 64 nt, hsa; identical to SEQ ID NO: 493326

SEQ ID NO: 722227 - RNA, 64 nt, hsa; identical to SEQ ID NO: 493327

SEQ ID NO: 722228 - RNA, 64 nt, hsa; identical to SEQ ID NO: 493328

SEQ ID NO: 722229 - RNA, 64 nt, hsa; identical to SEQ ID NO: 493329

SEQ ID NO: 722230 - RNA, 64 nt, hsa; identical to SEQ ID NO: 493330

SEQ ID NO: 722231 - RNA, 64 nt, hsa; identical to SEQ ID NO: 493331

SEQ ID NO: 722232 - RNA, 64 nt, hsa; identical to SEQ ID NO: 493332

SEQ ID NO: 722233 - RNA, 64 nt, hsa; identical to SEQ ID NO: 493333

SEQ ID NO: 722234 - RNA, 64 nt, hsa; identical to SEQ ID NO: 493334

SEQ ID NO: 722235 - RNA, 64 nt, hsa; identical to SEQ ID NO: 493335

SEQ ID NO: 722236 - RNA, 64 nt, hsa; identical to SEQ ID NO: 493336

SEQ ID NO: 722237 - RNA, 64 nt, hsa; identical to SEQ ID NO: 493337

SEQ ID NO: 722238 - RNA, 64 nt, hsa; identical to SEQ ID NO: 493338

SEQ ID NO: 722239 - RNA, 64 nt, hsa; identical to SEQ ID NO: 493339

SEQ ID NO: 722240 - RNA, 64 nt, hsa; identical to SEQ ID NO: 493340

SEQ ID NO: 722241 - RNA, 64 nt, hsa; identical to SEQ ID NO: 493341

SEQ ID NO: 722242 - RNA, 64 nt, hsa; identical to SEQ ID NO: 128804

SEQ ID NO: 722243 - RNA, 64 nt, hsa; identical to SEQ ID NO: 128805

SEQ ID NO: 722244 - RNA, 64 nt, hsa; identical to SEQ ID NO: 128806

SEQ ID NO: 722245 - RNA, 64 nt, hsa; identical to SEQ ID NO: 128807

SEQ ID NO: 722246 - RNA, 64 nt, hsa; identical to SEQ ID NO: 128808

SEQ ID NO: 722247 - RNA, 64 nt, hsa; identical to SEQ ID NO: 128809

SEQ ID NO: 722248 - RNA, 64 nt, hsa; identical to SEQ ID NO: 128810

SEQ ID NO: 722249 - RNA, 64 nt, hsa; identical to SEQ ID NO: 128811

SEQ ID NO: 722250 - RNA, 64 nt, hsa; identical to SEQ ID NO: 128812

SEQ ID NO: 722251 - RNA, 64 nt, hsa; identical to SEQ ID NO: 128813

SEQ ID NO: 722252 - RNA, 64 nt, hsa; identical to SEQ ID NO: 128814

SEQ ID NO: 722253 - RNA, 64 nt, hsa; identical to SEQ ID NO: 128815

SEQ ID NO: 722254 - RNA, 64 nt, hsa; identical to SEQ ID NO: 128816

SEQ ID NO: 722255 - RNA, 64 nt, hsa; identical to SEQ ID NO: 128817

SEQ ID NO: 722256 - RNA, 64 nt, hsa; identical to SEQ ID NO: 128818

SEQ ID NO: 722257 - RNA, 64 nt, hsa; identical to SEQ ID NO: 128819

SEQ ID NO: 722258 - RNA, 64 nt, hsa; identical to SEQ ID NO: 128820

SEQ ID NO: 722259 - RNA, 64 nt, hsa; identical to SEQ ID NO: 128821

SEQ ID NO: 722260 - RNA, 64 nt, hsa; identical to SEQ ID NO: 128822

SEQ ID NO: 722261 - RNA, 64 nt, hsa; identical to SEQ ID NO: 128823

SEQ ID NO: 722262 - RNA, 64 nt, hsa; identical to SEQ ID NO: 128824

SEQ ID NO: 722263 - RNA, 64 nt, hsa; identical to SEQ ID NO: 128825

SEQ ID NO: 722264 - RNA, 64 nt, hsa; identical to SEQ ID NO: 128826

SEQ ID NO: 722265 - RNA, 64 nt, hsa; identical to SEQ ID NO: 128827

SEQ ID NO: 722266 - RNA, 64 nt, hsa; identical to SEQ ID NO: 287378

SEQ ID NO: 722267 - RNA, 64 nt, hsa; identical to SEQ ID NO: 287379

SEQ ID NO: 722268 - RNA, 64 nt, hsa; identical to SEQ ID NO: 287380

SEQ ID NO: 722269 - RNA, 64 nt, hsa; identical to SEQ ID NO: 287381

SEQ ID NO: 722270 - RNA, 64 nt, hsa; identical to SEQ ID NO: 287382

SEQ ID NO: 722271 - RNA, 64 nt, hsa; identical to SEQ ID NO: 287383

SEQ ID NO: 722272 - RNA, 64 nt, hsa; identical to SEQ ID NO: 287384

SEQ ID NO: 722273 - RNA, 64 nt, hsa; identical to SEQ ID NO: 287385

SEQ ID NO: 722274 - RNA, 64 nt, hsa; identical to SEQ ID NO: 287386

SEQ ID NO: 722275 - RNA, 64 nt, hsa; identical to SEQ ID NO: 287387

SEQ ID NO: 722276 - RNA, 64 nt, hsa
ccaguucauggaggcaaaaaacaaguuucuuguuauccugaaacuuucuaugcucaguggaaag

SEQ ID NO: 722277 - RNA, 64 nt, hsa
aucccugccuguguccaugucagacuuugagcugauccugaauaauaaagccuuuuaccuuauc

SEQ ID NO: 722278 - RNA, 64 nt, hsa
uguauuuccuuuuguuuaaugcuuugaguagauaauccugaauugaggucaugaggaggccccc

SEQ ID NO: 722279 - RNA, 64 nt, hsa
gguuucuucagcagggcuuaaaagagcagccuucauccugaaaauguauuuccuuuuguuuaau

SEQ ID NO: 722280 - RNA, 64 nt, hsa
agcugauguguaugggagccuaaacaaguguaguauccugaacuucucccauuaauugcuauuc

SEQ ID NO: 722281 - RNA, 64 nt, hsa
ugaauuauguauggcaaccugguuuagcacuggcauccugaacaguuaagagucacugggaaau

SEQ ID NO: 722282 - RNA, 57 nt, hsa
cccagucuucgaccugcugauccuuggauccugaaucugugcaaacaguaacgugug

SEQ ID NO: 722283 - RNA, 64 nt, hsa
uguuaccauuuuaacgcugccuaauuuugccaaaauccugaacuuucucccucaucggcccggc

SEQ ID NO: 722284 - RNA, 51 nt, hsa
cgcaucaagcugaugagugagauccugaacggcaucaaggugcugaagcug

SEQ ID NO: 722285 - RNA, 64 nt, hsa
acaguccuucuuugacaccacaccaucaggccgcauccugaacugcuucuccaaggacaucuau

SEQ ID NO: 722286 - RNA, 64 nt, hsa
cuggcgcccucuaguggagaagaauccucagagcauccugaagccccauucuccgacuuacaac

SEQ ID NO: 722287 - RNA, 64 nt, hsa
gcagcgcggcagagucauggggguuaaucccuauauccugaagaagaacaugauccucaugaca

SEQ ID NO: 722288 - RNA, 62 nt, hsa
gcccagccccuugugaguccuggccucugcugggcccugaaggagcugagagggagcucaac

SEQ ID NO: 722289 - RNA, 62 nt, hsa
augucugugcagugucagggcugcaccccauaggcccugaggcacacagcccagccccuugu

SEQ ID NO: 722290 - RNA, 62 nt, hsa
aaagcaaacaguccuccugaggcccugaggguggcccugacccccucagggcucauuccugg

SEQ ID NO: 722291 - RNA, 62 nt, hsa
auguuaucugcuaaagcaaacaguccuccugaggcccugaggguggcccugacccccucagg

SEQ ID NO: 722292 - RNA, 62 nt, hsa
ugcagccuguccugggcugguggcucccggagggcccugagcugagggcauugcuuacacgg

SEQ ID NO: 722293 - RNA, 62 nt, hsa
gagggcauugcuuacacggaugccuuccccugggcccugacauuggagccugggcauccuca

SEQ ID NO: 722294 - RNA, 62 nt, hsa
ggagguucauuuuccuuuaaacugauccagcuggcccugaaccaauuguuuuugacugagua

SEQ ID NO: 722295 - RNA, 62 nt, hsa
uccuguuuggccccuguucaccccagugcacuggcccugacuccaggcgugaguauggggaa

SEQ ID NO: 722296 - RNA, 62 nt, hsa
agaagcuggaucacucuuggucccauucccuaggcccugagcaagucaggcuccuggcucug

SEQ ID NO: 722297 - RNA, 62 nt, hsa
uggggacaacaggggcacaugacaucugccugggcccugaccaauaaacccucagacccagg

SEQ ID NO: 722298 - RNA, 62 nt, hsa
gagccaagcgcaucgggagcacaccagaaaccggcccugagcacgagaagagccuccgcccg

SEQ ID NO: 722299 - RNA, 62 nt, hsa
ucacaccgcacggcaggcacagaggcucgccaggcccugauccggucuguggggacgaggga

SEQ ID NO: 722300 - RNA, 62 nt, hsa
cagugguggagguggguguuugggaaaggcagggcccugaaauggccugucccuagggcucu

SEQ ID NO: 722301 - RNA, 62 nt, hsa
caggccucccaagcugauggacaugagaguagggcccugacaggccuuccuccucucaaacc

SEQ ID NO: 722302 - RNA, 62 nt, hsa
cgggcucggggccccaccgggguggagauggaggcccugaccucugcugcaguggccgcccu

SEQ ID NO: 722303 - RNA, 62 nt, hsa
accagccagcugaucccucugugccaccacguggcccugagccacauccaggugcagcugga

SEQ ID NO: 722304 - RNA, 62 nt, hsa
ggccucugcagaggggaccucagccugucacuggcccugaagacuggccccacuucuggucu

SEQ ID NO: 722305 - RNA, 62 nt, hsa
gaccagaacagggcagaguagguccccuccauggcccugaauccuccucugcuccagggcug

SEQ ID NO: 722306 - RNA, 62 nt, hsa
cugagaagaaguggcugccacacccaggggaaggcccugaggcggaggcugugcuccgccau

SEQ ID NO: 722307 - RNA, 62 nt, hsa
ugcucaccagcccugcagcccaccagacgucaggcccugacuccucuggcuuucccaggaga

SEQ ID NO: 722308 - RNA, 62 nt, hsa
cagcuggccuuccuggguuggaacgaggcaguggcccugagccccuucuccagggccaggua

SEQ ID NO: 722309 - RNA, 54 nt, hsa; identical to SEQ ID NO: 53521

SEQ ID NO: 722310 - RNA, 62 nt, hsa
ccuccaccugccccagugcccagaccaaccaaggcccugacagcccugccuucugcccucug

SEQ ID NO: 722311 - RNA, 62 nt, hsa
uucccuaccuggguggccugcuccccugccugggcccugacuucagcucccuguagugaagu

SEQ ID NO: 722312 - RNA, 62 nt, hsa
gaggagaaccggcagcugcuggcugaaguucaggcccugagccgggagaacagggagcuccu

SEQ ID NO: 722313 - RNA, 62 nt, hsa
ugcaggaacacgaaacagaugccaaccgagagggcccugagguacaggaaccggagaaacgu

SEQ ID NO: 722314 - RNA, 62 nt, hsa
ccccaaggggaguccuuggacaaggaggccugggcccugagauccuccacggucagcgccgg

SEQ ID NO: 722315 - RNA, 62 nt, hsa
cagcgggcuucuccaccuaccccagccaccaaggcccugacgcacugccuccugcaccuuca

SEQ ID NO: 722316 - RNA, 62 nt, hsa
ggggucaggacaugucggggucaugcguuucuggcccugacauaagcugucuggccucucug

SEQ ID NO: 722317 - RNA, 62 nt, hsa
gcauuguuccagcacggaggugaugugucacgggcccugacugagcuacagcgccaacgccu

SEQ ID NO: 722318 - RNA, 62 nt, hsa
uagagcccuuccgccagcgccucugggacaguggcccugagcccaccccuuccugggauggg

SEQ ID NO: 722319 - RNA, 62 nt, hsa
uguggcugggcccugccccacaaccggaugcaggcccugacuuccugugagugcaccaucug

SEQ ID NO: 722320 - RNA, 62 nt, hsa
ugcaacccagggcagggggcugagaccuuccaggcccugaggaaucccgggcgccggcaagg

SEQ ID NO: 722321 - RNA, 62 nt, hsa
cgcccgcgccccuccccaccggcgggcgccccggcccugaacccgcgccccacauuucuguc

SEQ ID NO: 722322 - RNA, 62 nt, hsa
cacuucugacuggugaucagggcccggcccacggcccugagcggcugcagccugcuuuggga

SEQ ID NO: 722323 - RNA, 62 nt, hsa
gggcucugcucugagaguagggcgggcuugaaggcccugauggguggaccaccagccugggc

SEQ ID NO: 722324 - RNA, 62 nt, hsa
acccaaagccucuuuuugccucccggaaucaaggcccugagggcagcaggaugguggccugg

SEQ ID NO: 722325 - RNA, 62 nt, hsa
ggcgcucuugaccccugauuccagugaggacuggcccugaggaguccuugcagaccugcugc

SEQ ID NO: 722326 - RNA, 62 nt, hsa
ccgcuaaaaugggcaagggagagcggguggagggcccugagguggcagcaggggucagggaa

SEQ ID NO: 722327 - RNA, 62 nt, hsa
gagguggaggcccggggagaggcaccugagguggcccugaagaugccccgccuuaguuuucc

SEQ ID NO: 722328 - RNA, 62 nt, hsa
ucaccugacuugaggugaauuuuggagugaagggcccugaggucagcucccaggucggucgu

SEQ ID NO: 722329 - RNA, 62 nt, hsa
gcucuccuuuggguguaugcagguguguggggggcccugaguggcaaguugcuuagcuaaca

SEQ ID NO: 722330 - RNA, 62 nt, hsa
ggcuuuauuuaccguggugguucagagucccaggcccugaccucuaaagacuuuucauaaca

SEQ ID NO: 722331 - RNA, 62 nt, hsa
gcacacccaccucuccgggggacuugacaaggggcccugaggccaagggaggucacuccucc

SEQ ID NO: 722332 - RNA, 64 nt, hsa; identical to SEQ ID NO: 189518

SEQ ID NO: 722333 - RNA, 64 nt, hsa; identical to SEQ ID NO: 189519

SEQ ID NO: 722334 - RNA, 64 nt, hsa; identical to SEQ ID NO: 189520

SEQ ID NO: 722335 - RNA, 64 nt, hsa; identical to SEQ ID NO: 189521

SEQ ID NO: 722336 - RNA, 64 nt, hsa; identical to SEQ ID NO: 189522

SEQ ID NO: 722337 - RNA, 64 nt, hsa; identical to SEQ ID NO: 189523

SEQ ID NO: 722338 - RNA, 64 nt, hsa; identical to SEQ ID NO: 189524

SEQ ID NO: 722339 - RNA, 64 nt, hsa; identical to SEQ ID NO: 189525

SEQ ID NO: 722340 - RNA, 64 nt, hsa; identical to SEQ ID NO: 189526

SEQ ID NO: 722341 - RNA, 64 nt, hsa; identical to SEQ ID NO: 189527

SEQ ID NO: 722342 - RNA, 64 nt, hsa; identical to SEQ ID NO: 189528

SEQ ID NO: 722343 - RNA, 64 nt, hsa; identical to SEQ ID NO: 189529

SEQ ID NO: 722344 - RNA, 64 nt, hsa; identical to SEQ ID NO: 189530

SEQ ID NO: 722345 - RNA, 64 nt, hsa; identical to SEQ ID NO: 720482

SEQ ID NO: 722346 - RNA, 64 nt, hsa; identical to SEQ ID NO: 720483

SEQ ID NO: 722347 - RNA, 64 nt, hsa; identical to SEQ ID NO: 328787

SEQ ID NO: 722348 - RNA, 64 nt, hsa; identical to SEQ ID NO: 328788

SEQ ID NO: 722349 - RNA, 64 nt, hsa; identical to SEQ ID NO: 328789

SEQ ID NO: 722350 - RNA, 64 nt, hsa; identical to SEQ ID NO: 328790

SEQ ID NO: 722351 - RNA, 64 nt, hsa; identical to SEQ ID NO: 328791

SEQ ID NO: 722352 - RNA, 64 nt, hsa; identical to SEQ ID NO: 328792

SEQ ID NO: 722353 - RNA, 64 nt, hsa; identical to SEQ ID NO: 328793

SEQ ID NO: 722354 - RNA, 64 nt, hsa; identical to SEQ ID NO: 328794

SEQ ID NO: 722355 - RNA, 64 nt, hsa; identical to SEQ ID NO: 328795

SEQ ID NO: 722356 - RNA, 64 nt, hsa; identical to SEQ ID NO: 328796

SEQ ID NO: 722357 - RNA, 64 nt, hsa; identical to SEQ ID NO: 328797

SEQ ID NO: 722358 - RNA, 64 nt, hsa; identical to SEQ ID NO: 328798

SEQ ID NO: 722359 - RNA, 64 nt, hsa; identical to SEQ ID NO: 328799

SEQ ID NO: 722360 - RNA, 64 nt, hsa; identical to SEQ ID NO: 328800

SEQ ID NO: 722361 - RNA, 64 nt, hsa; identical to SEQ ID NO: 328801

SEQ ID NO: 722362 - RNA, 64 nt, hsa; identical to SEQ ID NO: 328802

SEQ ID NO: 722363 - RNA, 64 nt, hsa; identical to SEQ ID NO: 328803

SEQ ID NO: 722364 - RNA, 64 nt, hsa; identical to SEQ ID NO: 328804

SEQ ID NO: 722365 - RNA, 64 nt, hsa
ucuaagaaauuuuucaguucacuagacuaaaauguuuuacaacaaaaagccuccaguuagccuc

SEQ ID NO: 722366 - RNA, 64 nt, hsa
caacccauaaucauuaaguacuuaacaaagaauauuuuacaagugauaguauuucaacaaugug

SEQ ID NO: 722367 - RNA, 64 nt, hsa
uacaauucugagugaucuuagaaaucauuucuguuuuuacaaacaaggaaacugagguccagaa

SEQ ID NO: 722368 - RNA, 64 nt, hsa
gcaagcucaauagacuucauaaguguucauagaauuuuacaauucugagugaucuuagaaauca

SEQ ID NO: 722369 - RNA, 64 nt, hsa
ggugcuuauucucaaagcaggaauugguggcagauuuuacaaaagauguauccuuccaauuugg

SEQ ID NO: 722370 - RNA, 64 nt, hsa
caugugcugugaccauuuauaauguuaguagaaauuuuacaauaggugcuuauucucaaagcag

SEQ ID NO: 722371 - RNA, 64 nt, hsa
uuuuacuucauuauuuuuaggaauaaauguaagauuuuacaaaucuuuuauuuccccacaagau

SEQ ID NO: 722372 - RNA, 64 nt, hsa
uaaaugugucauauuauauucuuuaaacuuacuguuuuacaaaauugagcucaucguaaauguc

SEQ ID NO: 722373 - RNA, 64 nt, hsa
uuaaagagaauuuacuucuaaaagccacaggugcuuuuacaaagcaaacugcauugaauuuaaa

SEQ ID NO: 722374 - RNA, 64 nt, hsa
uuguuuucauuuguauugcaaaaguuagaagucauuuuacaaauuaaaaaaacauuuuuuucuu

SEQ ID NO: 722375 - RNA, 64 nt, hsa
acgcuuugaaaccuuuagagggaagauccucauuuuuuacaauuuuguuccuuuucaucauaga

SEQ ID NO: 722376 - RNA, 64 nt, hsa
ccaaaaauaauuguccuuuuuucuuucuuucuuuuuuuacaauaaggcucuugaaaauugucau

SEQ ID NO: 722377 - RNA, 64 nt, hsa
auggaccuuuggggaagggggaguuuuuaguuuguuuuacaaauuuuuccugcaaaaguggaau

SEQ ID NO: 722378 - RNA, 64 nt, hsa
cagcaaguuucaccuuggguuuguauuuuaaauguuuuacaagaauuguccaugugcuucccua

SEQ ID NO: 722379 - RNA, 64 nt, hsa
ugaugacccccaaccaaguggcucccacacccuguuuuacaaaaaagaaaagaccaguccauga

SEQ ID NO: 722380 - RNA, 64 nt, hsa
gcaaaguucccuacuuccugugacuucagcucuguuuuacaauaaaaucuugaaaaugccuaua

SEQ ID NO: 722381 - RNA, 64 nt, hsa
guuuuguuuggcucagacauauaguuuuuuuuuuuuuuacaaaguuucaaaaacuuaaaaauca

SEQ ID NO: 722382 - RNA, 64 nt, hsa
gacccuggauggcuacuaagaggauagagaacaguuuuacaauagacauugcaaacucucaugu

SEQ ID NO: 722383 - RNA, 64 nt, hsa
aaaauccuaucgugaacaaccuauauuuucgccauuuuacaauggagaguugugacaaguacag

SEQ ID NO: 722384 - RNA, 64 nt, hsa
uaguuuuuaguccuguaaaugcaaacacagcauuuuuuacaacuuucuuuguucuugguacuua

SEQ ID NO: 722385 - RNA, 64 nt, hsa
aucugacauuuguauacauaaaaguuuacaugaauuuuacaacaaacuagugcaugauucacca

SEQ ID NO: 722386 - RNA, 64 nt, hsa
uuuuugcacaaaccaaaaguuuaauguuaauucuuuuuacaaaacuauuuacuguaguguauug

SEQ ID NO: 722387 - RNA, 64 nt, hsa
uccauucuauuuuuaacuuccauaucugccauauuuuuacaaaauuuguucuagugcauuucca

SEQ ID NO: 722388 - RNA, 64 nt, hsa
cugugugucuuuuuuuacuuaugccgucucauauuuuuacaaauaauuaucacaauguacuaua

SEQ ID NO: 722389 - RNA, 64 nt, hsa
ggaauaauuagaaacacacuuuugcacauauauuuuuuacaaacagaugaaaaaaguuaacauu

SEQ ID NO: 722390 - RNA, 64 nt, hsa
uuuagaauuuugugaaacagacuuguauauucuauuuuacaacuacaaaugccuccaaaguauu

SEQ ID NO: 722391 - RNA, 64 nt, hsa
gaauaugcaucuuaaaauggcaaguuuuccauauuuuuacaacucacuggugguuuuccgcauu

SEQ ID NO: 722392 - RNA, 64 nt, hsa
aggugcuuuagcuaucaguaguaccaaaggaucuuuuuacaaggcuuccugugguauugacucu

SEQ ID NO: 722393 - RNA, 64 nt, hsa
guuaugcuaagaggaaaucacugaggccauaucuuuuuacaaucugaaaaaaaaguaguaaaaa

SEQ ID NO: 722394 - RNA, 64 nt, hsa
uaaaugaaauguuuuguagcuagaauaaaaucauuuuuacaaguacagcauucuuggaaagaau

SEQ ID NO: 722395 - RNA, 64 nt, hsa
aaaaaaaaaagcccuauuucgcacuaacauuuuauuuuacaaguauuuuaaucuuauauuuugg

SEQ ID NO: 722396 - RNA, 64 nt, hsa
ucuggaugaaucuugaaacacauuuagcugccaguuuuacaaaccuuuaauauaucagugcucc

SEQ ID NO: 722397 - RNA, 64 nt, hsa
ccuuuucacaaagggaauugccuaacauguggacuuuuacaauaaaaaugcugcauucuaaucc

SEQ ID NO: 722398 - RNA, 64 nt, hsa
cuuuuaauugauuagaauucugccaauagguggauuuuacaaaaccacagacaaccucugaaag

SEQ ID NO: 722399 - RNA, 64 nt, hsa
auauacugcuuuaaaaaagaauaaaagaauauccuuuuacaaguggcuuuacauuuccuaaaau

SEQ ID NO: 722400 - RNA, 64 nt, hsa
aagccugcuuaaaaaauguaguugagccccauaauuuuacaaaugggcgaacuuuuaaacuucu

SEQ ID NO: 722401 - RNA, 64 nt, hsa
acuucuaacucuacuuggaucaaaaccucauacauuuuacaaagggguccugacaagucagcug

SEQ ID NO: 722402 - RNA, 64 nt, hsa
uuuuauguaacaaacagccccuccccaccuccaguuuuacaacaaucagaaagggcacugauuu

SEQ ID NO: 722403 - RNA, 64 nt, hsa
ucagaaagggcacugauuuauuugguauuuuucuuuuuacaaagcuaccuuuagucaaagguca

SEQ ID NO: 722404 - RNA, 64 nt, hsa
ugacucuuagaugcuauugaucuguagcaccauuuuuuacaaacgacuaaggaaaaaaccugcc

SEQ ID NO: 722405 - RNA, 64 nt, hsa
guguuuuauacaaaaauggaauugauaaaccauuuuuuacaaaauuaauuugucucaaaacugu

SEQ ID NO: 722406 - RNA, 64 nt, hsa
gauaacaagaaaugucuagacuaauauucaucaguuuuacaaacauaaugaaaauuaguugauu

SEQ ID NO: 722407 - RNA, 64 nt, hsa
aaaguauuuuaaaauacauuauccuuguaauguauuuuacaaggauaauguauuuuaaaauggg

SEQ ID NO: 722408 - RNA, 64 nt, hsa
aguggccucgaguacuugguaaguuacuuaaaauuuuuacaaaaauaucccacucaaugccaaa

SEQ ID NO: 722409 - RNA, 64 nt, hsa
accagacuguagcaucauaaaguuaauuuacaguuuuuacaacauugcuucuacauucuuacug

SEQ ID NO: 722410 - RNA, 64 nt, hsa
aucuuauaaaacccuugaaaauaaacagucucuuuuuuacaaagccuguguuagagcacagauu

SEQ ID NO: 722411 - RNA, 64 nt, hsa
uaacauuuacauugucaaccuuuauugacuuuguuuuuacaauaaaaaauauuuuacaacuuac

SEQ ID NO: 722412 - RNA, 62 nt, hsa
accuuuauugacuuuguuuuuacaauaaaaaauauuuuacaacuuacuuucuguucucugua

SEQ ID NO: 722413 - RNA, 64 nt, hsa
gugucuuuucauaagguuuuacaaugguuuauuuuuuuacaagguuuacgugucucaaagcaca

SEQ ID NO: 722414 - RNA, 64 nt, hsa
auugcacagaaucagugugugucuuuucauaagguuuuacaaugguuuauuuuuuuacaagguu

SEQ ID NO: 722415 - RNA, 64 nt, hsa
uuuccauauaggaaagccauuauuaguaguaaacuuuuacaaaucccauuuucaaauuacuuuu

SEQ ID NO: 722416 - RNA, 64 nt, hsa
uuuuugagguuuuuggaaguuacuauuuggccauuuuuacaaauggauuuugcauuaacaggaa

SEQ ID NO: 722417 - RNA, 64 nt, hsa
augaaaaucaguccauccuuguuauaaaaaauuuuuuuacaauuguaauuauauugauguucau

SEQ ID NO: 722418 - RNA, 64 nt, hsa
uuugucaaacauguacuccuuucauacggguggcuuuuacaaggcaacuuccgucauuuaaugu

SEQ ID NO: 722419 - RNA, 64 nt, hsa
cuugauugugugccauuuuauauaacagguccuguuuuacaaauaaauuuuguuuuacuaacau

SEQ ID NO: 722420 - RNA, 64 nt, hsa
uauacuuauuuuaaagaaaaucuuauauaguacauuuuacaaaaauuauaaaaaaugaauuagu

SEQ ID NO: 722421 - RNA, 64 nt, hsa
uuagauucauaauguuaggagcauuuaaucuguauuuuacaaguuaggaagcagaggaucagag

SEQ ID NO: 722422 - RNA, 64 nt, hsa
caauagacccucgagggcuuguguccauuuggccuuuuacaaguguaaugccaauuucauugau

SEQ ID NO: 722423 - RNA, 64 nt, hsa
cuggaaugcauuuauucuugaaauauuugugugauuuuacaaaaagcuuuuguaaucaguuauu

SEQ ID NO: 722424 - RNA, 64 nt, hsa
uggcaguugugaggaaaagccagucaaaugaccuuuuuacaaaagaaaugcaguggucacuuca

SEQ ID NO: 722425 - RNA, 64 nt, hsa
gcaaaauugccacauuuucuuauggcauuaaaaauuuuacaaaaacauaauuuuaauggcuaua

SEQ ID NO: 722426 - RNA, 64 nt, hsa
cggugucuuucuuuauaaaugcaaauggcuaccguuuuacaauaaaauuuugcaugugccauug

SEQ ID NO: 722427 - RNA, 64 nt, hsa
agcucccagcccacucaucgcagggcucaugauuuuuuacaaauuauguuuuaauuccaagugu

SEQ ID NO: 722428 - RNA, 64 nt, hsa
auuuugauagugccauuuauuguuaaagauuuauuuuuacaaaguaaauucaggguuuuagaug

SEQ ID NO: 722429 - RNA, 64 nt, hsa
aaaguaaauucaggguuuuagauguguacacagcuuuuacaaaucaauaaagaugauuguacaa

SEQ ID NO: 722430 - RNA, 64 nt, hsa
aagaucugaucagaauuuaacuaaaggguaguuguuuuacaaugaagacuaaaacugaacaaga

SEQ ID NO: 722431 - RNA, 64 nt, hsa
gauagaagauacuuuuaagacaacuuggccauuauuuuacaaugauguauccuuccuuugacaa

SEQ ID NO: 722432 - RNA, 64 nt, hsa
uuagugagaaccauaggcguuggaauuucucaccuuuuacaaugauagacuuuugcauugggac

SEQ ID NO: 722433 - RNA, 64 nt, hsa
gaacaaucucucuggaagugccucuucuuguggcuuuuacaacuucauuucuuucuggggucac

SEQ ID NO: 722434 - RNA, 64 nt, hsa
ccaacuucuauguuuaucuuuguuacuuucacuuuuuuacaaccuggccagaggcauuuuuuaa

SEQ ID NO: 722435 - RNA, 64 nt, hsa
aguagaucauggcagcaugaauuccaacucacuuuuuuacaacuccaacuucuauguuuaucuu

SEQ ID NO: 722436 - RNA, 64 nt, hsa
guuauugaaguguucuucucucaaguuaacaaaauuuuacaaauguuccugaaguguaucgauu

SEQ ID NO: 722437 - RNA, 64 nt, hsa
uauuauuuaucuucuuuuaguguagaaaauaauuuuuuacaaaaagucacuuuugggcugggcg

SEQ ID NO: 722438 - RNA, 64 nt, hsa
acauuguaaauuacauauuaaauauuuuaucugcuuuuacaagcgcaaggugcaaaaauauaua

SEQ ID NO: 722439 - RNA, 64 nt, hsa
cuugccagagaugaacacagaauguucuguuucauuuuacaagaacuauccugaguuucugugg

SEQ ID NO: 722440 - RNA, 64 nt, hsa
ugcagcuuagggaugguuccuggaaguggacacauuuuacaaaaacguuuuuuaaauacacgcc

SEQ ID NO: 722441 - RNA, 64 nt, hsa
ccaagauucauaugaagugauauuagauuguuccuuuuacaaaaguguuuagcuucaagacugg

SEQ ID NO: 722442 - RNA, 64 nt, hsa
uagaaauuagaagcuuucugauuucuagaugagguuuuacaauuguuucuuacagucaugugca

SEQ ID NO: 722443 - RNA, 64 nt, hsa
ucugcccucuucccuauaaaaucacacagcgugauuuuacaaggucccguggcaccuugcucag

SEQ ID NO: 722444 - RNA, 64 nt, hsa
uaaaagaagucaucucaaacucuuaguuuuuuuuuuuuacaacuauguaauuuauauuccauuu

SEQ ID NO: 722445 - RNA, 64 nt, hsa
auuaauuuuuuuuuuaaacaaugaagugaaaaaguuuuacaaucucuagguuuggcuaguucuc

SEQ ID NO: 722446 - RNA, 64 nt, hsa
gaagcagcuuguuucuaaacaaauaguguuauccuuuuacaauuaacugcacaucaauuuuaua

SEQ ID NO: 722447 - RNA, 64 nt, hsa
uauuuuguacuguuuauaagccuucaaacaguaguuuuacaaucaugcuauucuuacacuugcu

SEQ ID NO: 722448 - RNA, 64 nt, hsa
guaguuuaaaaauaggaccauguaugagacacuuuuuuacaaaaagugccguauauacauaugu

SEQ ID NO: 722449 - RNA, 64 nt, hsa
ugcuaaccauggcaagcaaacauuuacauuuguuuuuuacaauaaauuucuuuuaaaauauacu

SEQ ID NO: 722450 - RNA, 64 nt, hsa
gggaaacuacauuaucacaaaauuauacaaauuuuuuuacaaguauuuacauacuguaucugaa

SEQ ID NO: 722451 - RNA, 64 nt, hsa
aaaugggaaacaaggguuuaauuuaguucagccauuuuacaaggaaauaauaaaauacuaaaau

SEQ ID NO: 722452 - RNA, 64 nt, hsa
aaaggcaaauuucaagggaagaaauguaaaagaauuuuacaaaugcuuuccaagugaugaauau

SEQ ID NO: 722453 - RNA, 64 nt, hsa
gguuuuuacuauugaacccuuguacuuugccuuauuuuacaaauugaggauuaccaauuaaacu

SEQ ID NO: 722454 - RNA, 64 nt, hsa
ccacagauucuaccuuuuguguuuuguuuuuuuuuuuuacaauuguuuuaaagccauuucaugu

SEQ ID NO: 722455 - RNA, 64 nt, hsa
ugaucaguuuuugaaguccguauacaaggauauauuuuacaagugguuuucuuacauaggacuc

SEQ ID NO: 722456 - RNA, 64 nt, hsa
ggguggccuuuuuuuaccgauccccuuuuuuauuuuuuacaaccggaccuccacccccaacuuc

SEQ ID NO: 722457 - RNA, 64 nt, hsa
auaauuuuaguggaauuguuauugagaauaaaauuuuuacaaucauaacuggcuuuuuccaagu

SEQ ID NO: 722458 - RNA, 64 nt, hsa
uuguuuuucuuuuuuuucuuucuuuuuuuuuuuuuuuuacaauuuugaggucuucguguucaag

SEQ ID NO: 722459 - RNA, 64 nt, hsa
cacagggagagacaugggcgaaugagugagaaauuuuuacaaaauuacgaugucauuugggucu

SEQ ID NO: 722460 - RNA, 64 nt, hsa
gggacaggguugcuggguacagaagccagacuucuuuuacaaguaacucuaggcuggguguggu

SEQ ID NO: 722461 - RNA, 64 nt, hsa
cuacagcucucccccagcuaguaugaugauccuguuuuacaaaugcagaaaugaucuuaauauu

SEQ ID NO: 722462 - RNA, 64 nt, hsa
augaguucuuaaaauuuugucagagccuucuucauuuuacaauauuuuguuauuuuuauuuuac

SEQ ID NO: 722463 - RNA, 64 nt, hsa
acaauauuuuguuauuuuuauuuuaccuuuuucauuuuacaauauuucguuauuuuuauuuuac

SEQ ID NO: 722464 - RNA, 64 nt, hsa
acaauauuucguuauuuuuauuuuaccuuuuucauuuuacaaguugcaauauauuguuucguuc

SEQ ID NO: 722465 - RNA, 64 nt, hsa
aauuuuucuugaaagcuaaauuuucuuuguaaguuuuuacaaauuguuuaauaccuaguuguau

SEQ ID NO: 722466 - RNA, 64 nt, hsa
aagcuaaucuauaaauaccguuuuuccaaagguauuuuacaauauuucaacagcagaccuucug

SEQ ID NO: 722467 - RNA, 64 nt, hsa
caagauguaauuuuuacuuuaucucucacacguauuuuacaaaacgucaugagaaacauugucu

SEQ ID NO: 722468 - RNA, 64 nt, hsa
agaaaccuacuagcauucaaauaaucauucccuauuuuacaaugcaucaguucugucaagcuuc

SEQ ID NO: 722469 - RNA, 64 nt, hsa
uggaucucacuguugucuuuauaaaaauggcacauuuuacaaaguaguuuauucuuauuauacu

SEQ ID NO: 722470 - RNA, 64 nt, hsa
uuaacuguucuauucugauacuacgcguguuguuuuuuacaacagguauguuuuuguuucagaa

SEQ ID NO: 722471 - RNA, 64 nt, hsa
aauguguaucugaaaagcaaggaauuugcagccguuuuacaaauaucuguggaacauguaaaua

SEQ ID NO: 722472 - RNA, 64 nt, hsa
cagguuuguauauaaaaugaaaagcuauacuacuuuuuacaaaagggcaaacugggcugaugua

SEQ ID NO: 722473 - RNA, 64 nt, hsa
cuucuuugaguuguuuauggccucccuuaaggcauuuuacaaacccauaagccuacaauagaug

SEQ ID NO: 722474 - RNA, 64 nt, hsa
aacauuggaaauagaugauuagauuuuugugucauuuuacaauuaaaucuaaaaugcuuaaucc

SEQ ID NO: 722475 - RNA, 64 nt, hsa
uuggguuacaguauuuuuauucauauuuaaacauuuuuacaaaauaaauaaaguguuuuacaua

SEQ ID NO: 722476 - RNA, 64 nt, hsa
uaagacuuucuaugugguuugggcucccucuuauuuuuacaaguuucauuuuuaaaaguaggca

SEQ ID NO: 722477 - RNA, 64 nt, hsa
ggaggcagaaaguccuggaaaaguaaauuguuuauuuuacaauaagaaagugauuacauauuuu

SEQ ID NO: 722478 - RNA, 64 nt, hsa
auuuuacaauaagaaagugauuacauauuuuuuuuuuuacaaugguggaaaauuagaagucauu

SEQ ID NO: 722479 - RNA, 64 nt, hsa
gcaaguucugggaccuuuuggggcacauguaucauuuuacaaaugagcuuucaagaccauuuaa

SEQ ID NO: 722480 - RNA, 64 nt, hsa
aucaauaugguaucacaaugccuauuaagaggcuuuuuacaaauuacuuacuuaguaauaucug

SEQ ID NO: 722481 - RNA, 64 nt, hsa
aagccuaaaagugggcuugauucugcaguaaaucuuuuacaacugccucgaaacacagaaaccu

SEQ ID NO: 722482 - RNA, 64 nt, hsa
aaaaugcuuuuuauuucugcauauguugaauacuuuuuacaauuaaaaaaaaagaucuguuuug

SEQ ID NO: 722483 - RNA, 64 nt, hsa
gcauuugccaaaccaagccagcuggagcgccacagccgcauacauacagguaacggggaaggac

SEQ ID NO: 722484 - RNA, 64 nt, hsa
cuuccuugaaugucaguguguaaaccuggcuguagccgcauaugcagaauaacuguaauugugc

SEQ ID NO: 722485 - RNA, 64 nt, hsa
gaggggcagaguuaaacauuagccacaauggccccccgcgaagugagucauacuccccacaagu

SEQ ID NO: 722486 - RNA, 64 nt, hsa
gauggauggauggauggaugagcgagaacccgcgcccgcgaacaaagagcgaaccaaagcgaug

SEQ ID NO: 722487 - RNA, 64 nt, hsa
ccauuggaugaaguggugcccucuccucuggucccccgcgaaaagguaaauacacccaaaggga

SEQ ID NO: 722488 - RNA, 64 nt, hsa
cggcagcagagcuggcacaccgauucugggaagccccgcgaaugauggcuuuugaauuaaugag

SEQ ID NO: 722489 - RNA, 64 nt, hsa
aggauccuucugcuccgcucaggacccccggagccccgcgaaaacaucugccucccaggagggu

SEQ ID NO: 722490 - RNA, 64 nt, hsa
guuuugauggcagcaguaaucaugauagugugaacccgcgaaggccucaggauuaugguuaacc

SEQ ID NO: 722491 - RNA, 64 nt, hsa
agugccacaccucgaacugguuguagugggaagucccgcgaaacccggugcaucuggcacgugg

SEQ ID NO: 722492 - RNA, 64 nt, hsa
cauccccccaagcccuagagcucccuccacucuucccgcgaacaucacaccguuccccgaccaa

SEQ ID NO: 722493 - RNA, 64 nt, hsa
ugagcuggggcccacguggcaucgauccucccugcccgcgaagugacaguuuacaaaauuauuu

SEQ ID NO: 722494 - RNA, 64 nt, hsa
cgacaggggcgagggcugcuuccucgcggcagcccccgcgaagaaaucucgagagaacuggcau

SEQ ID NO: 722495 - RNA, 64 nt, hsa
cacuccccccgccucgacggcaccacuggccggccccgcgaaagacugcgcgugcguagagcac

SEQ ID NO: 722496 - RNA, 64 nt, hsa
ggcgaggccaccccccuccauccugggggaagcgcccgcgaaaaccguggagagaagccgccgc

SEQ ID NO: 722497 - RNA, 64 nt, hsa
cgccccccgccagcccgcccccgguuguccaccucccgcgaagcccaaucgcgaggccgcgagc

SEQ ID NO: 722498 - RNA, 64 nt, hsa
ggcgccccggacgccgcgauuuugccuuugguuccccgcgaaguccgaggccuggcucuggagc

SEQ ID NO: 722499 - RNA, 64 nt, hsa; identical to SEQ ID NO: 492612

SEQ ID NO: 722500 - RNA, 64 nt, hsa; identical to SEQ ID NO: 492613

SEQ ID NO: 722501 - RNA, 64 nt, hsa; identical to SEQ ID NO: 492614

SEQ ID NO: 722502 - RNA, 64 nt, hsa; identical to SEQ ID NO: 492615

SEQ ID NO: 722503 - RNA, 64 nt, hsa; identical to SEQ ID NO: 492616

SEQ ID NO: 722504 - RNA, 64 nt, hsa; identical to SEQ ID NO: 492617

SEQ ID NO: 722505 - RNA, 64 nt, hsa
gggcuuuguccuccaggaggugggggaaugugguaacauugaauacaguugaauaaaaucgcuu

SEQ ID NO: 722506 - RNA, 64 nt, hsa
ucucacaaugcauuguuaaguauguaaaagcaauaacauugauucucuguuguacuuuuuugua

SEQ ID NO: 722507 - RNA, 64 nt, hsa
ggugaggcacaaagaguuucuugaucauccagagaacauugacagacaauuaugaauaauaaag

SEQ ID NO: 722508 - RNA, 64 nt, hsa
aaacuaacaugacaagaaagcuauagaaaaaauaaacauugaacucaguucuucaagguuucau

SEQ ID NO: 722509 - RNA, 64 nt, hsa
gaaggauugcaaugcccgccagcacaguggcggcaacauugaagacguggacggaggaggggcc

SEQ ID NO: 722510 - RNA, 64 nt, hsa
uuacauugagcgugaccuugcaauguucaacauuaacauugaugaugacuacgucccgugucuc

SEQ ID NO: 722511 - RNA, 64 nt, hsa
auauauaaugaucacuucugaguuuaucaccaguaacauugauaccuauuuugggguauaaaca

SEQ ID NO: 722512 - RNA, 64 nt, hsa
guaaagacaccuuauuuaauauaaucgauucauuaacauugaagucaugaccaacaacacugua

SEQ ID NO: 722513 - RNA, 64 nt, hsa
ugaccuuuguggaacacaaauaaugaaggagcagaacauugacaagcuaagaugaaauucugac

SEQ ID NO: 722514 - RNA, 64 nt, hsa
uaaacacuguuauacaccuguuuuaugaaaacucaacauugaguaaaaaaaaacauauuuuuaa

SEQ ID NO: 722515 - RNA, 64 nt, hsa
acaaauuaaaucuucuggagggucgcuaucacaaaacauugacgauguauguauuauaauuuuu

SEQ ID NO: 722516 - RNA, 64 nt, hsa
uaacucaugauuuaugacauugaaaauaaagaggaacauugaccugcagacuaugguuuguaca

SEQ ID NO: 722517 - RNA, 64 nt, hsa
cauucaagguaguaggucucuuucaacugagugcaacauugagaauaaugauuugguucagggc

SEQ ID NO: 722518 - RNA, 64 nt, hsa
aaauacauuagaacuuaaugcagacauauaaaguaacauugagaaugacaacuaaaacauucca

SEQ ID NO: 722519 - RNA, 64 nt, hsa
auauuucuuccaaguuugauuucuguaucaggguaacauugagaacacacauauuucuguuuga

SEQ ID NO: 722520 - RNA, 64 nt, hsa
guugcaaauuuaagcauuauauauuaggagacuaaacauugaaaacuuucacugauuuuuaaau

SEQ ID NO: 722521 - RNA, 64 nt, hsa
aguaacguaccguauggucauuguucuauauauuaacauugaacacugcugcgauugcucaagg

SEQ ID NO: 722522 - RNA, 64 nt, hsa
uucaaauaaauggcaguuaacuggcuuuacaguaaacauugaagagaggaggauuuguuuauug

SEQ ID NO: 722523 - RNA, 64 nt, hsa
caagucccugauauccagaaccccauaggcaaguaacauugacuguaagaccucuguagggcaa

SEQ ID NO: 722524 - RNA, 64 nt, hsa
uggauguggacaucauugcuuaccaauuuuuaccaacauugaggcagggcucacucuccuaaau

SEQ ID NO: 722525 - RNA, 64 nt, hsa
uauuuauuugugcacuacaauucaaagcauuagaaacauugagaguucaagugcuguuucuuug

SEQ ID NO: 722526 - RNA, 64 nt, hsa
ccugcugcuugugguagaaaugcugccacagcccaacauugaggagcccucgaugacugcccuu

SEQ ID NO: 722527 - RNA, 64 nt, hsa; identical to SEQ ID NO: 47711

SEQ ID NO: 722528 - RNA, 64 nt, hsa; identical to SEQ ID NO: 47712

SEQ ID NO: 722529 - RNA, 51 nt, hsa; identical to SEQ ID NO: 47713

SEQ ID NO: 722530 - RNA, 64 nt, hsa; identical to SEQ ID NO: 47714

SEQ ID NO: 722531 - RNA, 64 nt, hsa; identical to SEQ ID NO: 47715

SEQ ID NO: 722532 - RNA, 64 nt, hsa; identical to SEQ ID NO: 47716

SEQ ID NO: 722533 - RNA, 64 nt, hsa; identical to SEQ ID NO: 47717

SEQ ID NO: 722534 - RNA, 64 nt, hsa; identical to SEQ ID NO: 47718

SEQ ID NO: 722535 - RNA, 64 nt, hsa; identical to SEQ ID NO: 47719

SEQ ID NO: 722536 - RNA, 64 nt, hsa; identical to SEQ ID NO: 47720

SEQ ID NO: 722537 - RNA, 64 nt, hsa; identical to SEQ ID NO: 47721

SEQ ID NO: 722538 - RNA, 64 nt, hsa; identical to SEQ ID NO: 47722

SEQ ID NO: 722539 - RNA, 64 nt, hsa; identical to SEQ ID NO: 47723

SEQ ID NO: 722540 - RNA, 59 nt, hsa; identical to SEQ ID NO: 47724

SEQ ID NO: 722541 - RNA, 64 nt, hsa; identical to SEQ ID NO: 47725

SEQ ID NO: 722542 - RNA, 64 nt, hsa; identical to SEQ ID NO: 47726

SEQ ID NO: 722543 - RNA, 64 nt, hsa; identical to SEQ ID NO: 47727

SEQ ID NO: 722544 - RNA, 64 nt, hsa; identical to SEQ ID NO: 47728

SEQ ID NO: 722545 - RNA, 64 nt, hsa; identical to SEQ ID NO: 47729

SEQ ID NO: 722546 - RNA, 64 nt, hsa; identical to SEQ ID NO: 47730

SEQ ID NO: 722547 - RNA, 64 nt, hsa; identical to SEQ ID NO: 47731

SEQ ID NO: 722548 - RNA, 64 nt, hsa; identical to SEQ ID NO: 47732

SEQ ID NO: 722549 - RNA, 64 nt, hsa; identical to SEQ ID NO: 47733

SEQ ID NO: 722550 - RNA, 64 nt, hsa; identical to SEQ ID NO: 47734

SEQ ID NO: 722551 - RNA, 64 nt, hsa; identical to SEQ ID NO: 47735

SEQ ID NO: 722552 - RNA, 64 nt, hsa; identical to SEQ ID NO: 47736

SEQ ID NO: 722553 - RNA, 64 nt, hsa; identical to SEQ ID NO: 47737

SEQ ID NO: 722554 - RNA, 64 nt, hsa; identical to SEQ ID NO: 47738

SEQ ID NO: 722555 - RNA, 64 nt, hsa; identical to SEQ ID NO: 47739

SEQ ID NO: 722556 - RNA, 64 nt, hsa; identical to SEQ ID NO: 47740

SEQ ID NO: 722557 - RNA, 64 nt, hsa; identical to SEQ ID NO: 47741

SEQ ID NO: 722558 - RNA, 64 nt, hsa; identical to SEQ ID NO: 47742

SEQ ID NO: 722559 - RNA, 64 nt, hsa; identical to SEQ ID NO: 47743

SEQ ID NO: 722560 - RNA, 64 nt, hsa; identical to SEQ ID NO: 47744

SEQ ID NO: 722561 - RNA, 64 nt, hsa; identical to SEQ ID NO: 47745

SEQ ID NO: 722562 - RNA, 64 nt, hsa; identical to SEQ ID NO: 47746

SEQ ID NO: 722563 - RNA, 64 nt, hsa; identical to SEQ ID NO: 47747

SEQ ID NO: 722564 - RNA, 64 nt, hsa; identical to SEQ ID NO: 47748

SEQ ID NO: 722565 - RNA, 64 nt, hsa; identical to SEQ ID NO: 47749

SEQ ID NO: 722566 - RNA, 64 nt, hsa; identical to SEQ ID NO: 47750

SEQ ID NO: 722567 - RNA, 64 nt, hsa; identical to SEQ ID NO: 47751

SEQ ID NO: 722568 - RNA, 64 nt, hsa; identical to SEQ ID NO: 47752

SEQ ID NO: 722569 - RNA, 64 nt, hsa; identical to SEQ ID NO: 47753

SEQ ID NO: 722570 - RNA, 64 nt, hsa; identical to SEQ ID NO: 47754

SEQ ID NO: 722571 - RNA, 64 nt, hsa; identical to SEQ ID NO: 47755

SEQ ID NO: 722572 - RNA, 64 nt, hsa; identical to SEQ ID NO: 47756

SEQ ID NO: 722573 - RNA, 64 nt, hsa; identical to SEQ ID NO: 47757

SEQ ID NO: 722574 - RNA, 64 nt, hsa; identical to SEQ ID NO: 47758

SEQ ID NO: 722575 - RNA, 64 nt, hsa; identical to SEQ ID NO: 47759

SEQ ID NO: 722576 - RNA, 64 nt, hsa; identical to SEQ ID NO: 47760

SEQ ID NO: 722577 - RNA, 64 nt, hsa; identical to SEQ ID NO: 47761

SEQ ID NO: 722578 - RNA, 64 nt, hsa; identical to SEQ ID NO: 47762

SEQ ID NO: 722579 - RNA, 64 nt, hsa; identical to SEQ ID NO: 47763

SEQ ID NO: 722580 - RNA, 64 nt, hsa; identical to SEQ ID NO: 47764

SEQ ID NO: 722581 - RNA, 64 nt, hsa; identical to SEQ ID NO: 47765

SEQ ID NO: 722582 - RNA, 64 nt, hsa; identical to SEQ ID NO: 47766

SEQ ID NO: 722583 - RNA, 64 nt, hsa; identical to SEQ ID NO: 47767

SEQ ID NO: 722584 - RNA, 64 nt, hsa; identical to SEQ ID NO: 47768

SEQ ID NO: 722585 - RNA, 64 nt, hsa; identical to SEQ ID NO: 47769

SEQ ID NO: 722586 - RNA, 64 nt, hsa; identical to SEQ ID NO: 47770

SEQ ID NO: 722587 - RNA, 59 nt, hsa; identical to SEQ ID NO: 47771

SEQ ID NO: 722588 - RNA, 64 nt, hsa; identical to SEQ ID NO: 47772

SEQ ID NO: 722589 - RNA, 62 nt, hsa
ggagggcuuccagcuauaauaucugccuccagggaggggaggggaugggaagcaccaccagc

SEQ ID NO: 722590 - RNA, 62 nt, hsa
gcuuccagcuauaauaucugccuccagggaggggaggggaugggaagcaccaccagccagcg

SEQ ID NO: 722591 - RNA, 62 nt, hsa
gagcagacgguauauuccagaggugggaggugggaggggaagggagaaauccaaaacaaagu

SEQ ID NO: 722592 - RNA, 62 nt, hsa
ucucagcucuugggaacccccuugcucccaggggaggggaaaccuuuuucauucaacauugu

SEQ ID NO: 722593 - RNA, 62 nt, hsa
uuuggugcgcccccugcugaggagcagccccaggaggggaccagaggggaugcugugucgcu

SEQ ID NO: 722594 - RNA, 62 nt, hsa
aucucuuguaccagcccaggcaauaguguugaggaggggagcaaggcugcuaaguggaagac

SEQ ID NO: 722595 - RNA, 62 nt, hsa
cgggcuggccugacacaaugguagcucugaagggaggggaagagagaggccugggugugacc

SEQ ID NO: 722596 - RNA, 62 nt, hsa
auuaacuuauugucuaggccagagcgggggugggaggggaaugccacagugaagggaguggc

SEQ ID NO: 722597 - RNA, 62 nt, hsa
agcuuuuaggaugugggaguaaaacuuuaaugggaggggagggcuggcugcuggaagaagga

SEQ ID NO: 722598 - RNA, 62 nt, hsa
augacugccauguacacugcagucaagggcagggaggggaggaaugacacaaauggcaggga

SEQ ID NO: 722599 - RNA, 62 nt, hsa
gguccaaggucuuuguccuagaaucagaguggggaggggacagccuggggcugcccagagac

SEQ ID NO: 722600 - RNA, 62 nt, hsa
gauggugguguugaugguggcggugguaggguggaggggagagaagaagaugcugaugauau

SEQ ID NO: 722601 - RNA, 62 nt, hsa
gauugcaacaaaggcagagggggcggggcgggggaggggagguaggacccgcuccggaaggc

SEQ ID NO: 722602 - RNA, 62 nt, hsa
cccagcuuucccaggggcacagcucuaggcugggaggggagaaccagccccucccccugccc

SEQ ID NO: 722603 - RNA, 62 nt, hsa
ggccccuaccaaccuuugccucugccuuggagggaggggaggucuguuaccacuggggaagg

SEQ ID NO: 722604 - RNA, 62 nt, hsa
gauaggaccgggggaccccagagggaggccuaggaggggacugcacccauacugcuucccua

SEQ ID NO: 722605 - RNA, 62 nt, hsa
uccaacaggacagcgccuucccccaugcgcugggaggggacccuccauuucucccccucacc

SEQ ID NO: 722606 - RNA, 62 nt, hsa
ccuccucccugccuggggagcccaguggccagggaggggagugguggagccagucgcuguaa

SEQ ID NO: 722607 - RNA, 62 nt, hsa
aggaggaaaggaugggggcugaagagcagaagggaggggagacagaggggauuaaagagggg

SEQ ID NO: 722608 - RNA, 62 nt, hsa
uucccuccauuaaaacaaccaagacaaagaaaggaggggaaaaaaagauaaaaagcaagcca

SEQ ID NO: 722609 - RNA, 62 nt, hsa
ccucccuucaaaaagacagcgccccuagucagggaggggauggcgguccuuugauaagaccc

SEQ ID NO: 722610 - RNA, 62 nt, hsa
accggccaggaauguuugcaugaccuaccucaggaggggaggcgaggaagaguaauauuuag

SEQ ID NO: 722611 - RNA, 62 nt, hsa
cucaauguagguacauuacacucuuguugcggggaggggauuuaccagaauacaguuuauuu

SEQ ID NO: 722612 - RNA, 62 nt, hsa
acgggcgccuucccgggggagugggaggagagggaggggagggauuuuuuauguucuucugu

SEQ ID NO: 722613 - RNA, 62 nt, hsa
uguguuuuuucuuuuuuuuuaaguucuuaugaggaggggaggguaaauaaaccacugugcgu

SEQ ID NO: 722614 - RNA, 62 nt, hsa
auucucugcuauauauaaaacggugcugugagggaggggaaaagcauuuuucaauauauuga

SEQ ID NO: 722615 - RNA, 62 nt, hsa
ugcuagacaaacauaaaggggcaggguuguggggaggggaacguuuuugguggugugugcag

SEQ ID NO: 722616 - RNA, 62 nt, hsa
ucaguagguccugggacuugacaaaguaugugggaggggaaggaaggacagaacuugacugg

SEQ ID NO: 722617 - RNA, 62 nt, hsa
cuggagguggcauccacacuggacagcagggaggaggggagugaggguaacauuuccauuuc

SEQ ID NO: 722618 - RNA, 62 nt, hsa
agcgcuucucaaugugugucacccggaaccugggaggggagggaacacugggguuuaggacc

SEQ ID NO: 722619 - RNA, 62 nt, hsa
ggucccucagcuggggggcagugcuguccaguggaggggagggcuuucacgcccacccaccc

SEQ ID NO: 722620 - RNA, 62 nt, hsa
ggcuccuggcaaggccugaccccaugguggggggaggggaggggaggggagggaaugaggca

SEQ ID NO: 722621 - RNA, 62 nt, hsa
cuggcaaggccugaccccaugguggggggaggggaggggaggggagggaaugaggcagcucu

SEQ ID NO: 722622 - RNA, 62 nt, hsa
aaggccugaccccaugguggggggaggggaggggaggggagggaaugaggcagcucuaggau

SEQ ID NO: 722623 - RNA, 62 nt, hsa
cauuuuggccuccccugccccccuuguuauggggaggggaccccgggugagggggcccuauu

SEQ ID NO: 722624 - RNA, 62 nt, hsa
ggauggaugggguuugggguggguaggccaugggaggggagaagccccuccuuggcaccccc

SEQ ID NO: 722625 - RNA, 62 nt, hsa
uccgcuccugcccagccugggggaaggagaaaggaggggagaaagcgggcucucacccccuc

SEQ ID NO: 722626 - RNA, 62 nt, hsa
ucaccgggcccugugugugucaccgaggugcgggaggggaggagcauuaaagcugaaagauc

SEQ ID NO: 722627 - RNA, 62 nt, hsa
aggcccagggaagaguguauuuggggagcaggggaggggaggguguugagaaagcugaacug

SEQ ID NO: 722628 - RNA, 62 nt, hsa
aaaguggaugcaauuuuucuuucuuuuguuggggaggggaaugggaggggaaaugggaauau

SEQ ID NO: 722629 - RNA, 62 nt, hsa
aauuuuucuuucuuuuguuggggaggggaaugggaggggaaaugggaauauaauauugucuc

SEQ ID NO: 722630 - RNA, 62 nt, hsa
uggggaguuggggaaaggaacgaacccuggcuggaggggauaggagggcuuuuaauuuauuu

SEQ ID NO: 722631 - RNA, 62 nt, hsa
ccccucaucuccagugacucagccuacacaagggaggggaacauuccauccccaguggaguc

SEQ ID NO: 722632 - RNA, 62 nt, hsa
caauucuaaacugcagugacugggaugggaggggaggggagcaguguugaugccaaaauacc

SEQ ID NO: 722633 - RNA, 62 nt, hsa
gcaugcaauucuaaacugcagugacugggaugggaggggaggggagcaguguugaugccaaa

SEQ ID NO: 722634 - RNA, 62 nt, hsa
ccaaaaagggggaauaugggagggcagaguggggaggggaguccaugggccuggggccccaa

SEQ ID NO: 722635 - RNA, 62 nt, hsa
ucaaaagggguucaaaccccaccucaguagguggaggggagcgccugccauugguuguauuu

SEQ ID NO: 722636 - RNA, 62 nt, hsa
cacguagggggcaggggcaggggcgggcggagggaggggaggggugaaauccauacuguaga

SEQ ID NO: 722637 - RNA, 62 nt, hsa
cccuggccacagccuucccucugcauugaccuggaggggagaggucagccuugaccuaauga

SEQ ID NO: 722638 - RNA, 62 nt, hsa
ggccaggggccaggaguggggagaguugugauggaggggagaggggucacacccacccccug

SEQ ID NO: 722639 - RNA, 62 nt, hsa
uacggguucuccagcuccuuuccaggcagagaggaggggagguccugaggggacugcugccc

SEQ ID NO: 722640 - RNA, 62 nt, hsa
guacugaggacagcgguggaggccgaggugguggaggggaugcaccccaguguccacuuuug

SEQ ID NO: 722641 - RNA, 62 nt, hsa
gcaguggcugauggggacacugagauaagaucggaggggagcugucaaugccagaagugguu

SEQ ID NO: 722642 - RNA, 62 nt, hsa
cggugguggggaggaggggugcgccauggccuggaggggaguguguguuggggugugugugu

SEQ ID NO: 722643 - RNA, 62 nt, hsa
ggccugagcuggacaggggagcuccuaguaggggaggggaggggaugcugggaucuagguga

SEQ ID NO: 722644 - RNA, 62 nt, hsa
gagcuggacaggggagcuccuaguaggggaggggaggggaugcugggaucuaggugacaugc

SEQ ID NO: 722645 - RNA, 62 nt, hsa
cacaugccugcgccugcugccugcugagaugaggaggggagcgucugggaacuugcgagucc

SEQ ID NO: 722646 - RNA, 62 nt, hsa
agggcugucccagccccggcaagccacaggaaggaggggagagacaggcagcccagcagugu

SEQ ID NO: 722647 - RNA, 62 nt, hsa
aagccccacggugggucagaaggcggaaggagggaggggaacgugugggcaagagacuuccu

SEQ ID NO: 722648 - RNA, 62 nt, hsa
ucucaucgaggugugguaaagccauuggaugaggaggggacugccauggaaaggagaguuug

SEQ ID NO: 722649 - RNA, 62 nt, hsa
uaagguguuguauaaauaauauucuuuuggggggaggggaacuauauugaauuuuauauuuc

SEQ ID NO: 722650 - RNA, 62 nt, hsa
cggagcuuuuuaaagaacugauguagaaugagggaggggaaaguuuaaaaucccagcugggc

SEQ ID NO: 722651 - RNA, 62 nt, hsa
ccagccagcccgugacagcuucccccuaaucaggaggggacagcugggggcgcaagcuggug

SEQ ID NO: 722652 - RNA, 62 nt, hsa
accugcagccaucugugaggcccgcggggaugggaggggaggaggguggccuguugguuucc

SEQ ID NO: 722653 - RNA, 62 nt, hsa
caggucugcggaggggaaguguccugagugaaggaggggacccccauccugggggaugcugg

SEQ ID NO: 722654 - RNA, 62 nt, hsa
aaaugagaaaggcccagaacgugcaggucugcggaggggaaguguccugagugaaggagggg

SEQ ID NO: 722655 - RNA, 62 nt, hsa
ugcccucgggcgucuggcagccugagguggguggaggggacaguguucuggauagaucuauu

SEQ ID NO: 722656 - RNA, 62 nt, hsa
gugaggugugcaagggugcacugaggguggugggaggggaucaccuggguuccaggccaucc

SEQ ID NO: 722657 - RNA, 62 nt, hsa
uauuccggcuuuuuauauggcaccuuucugagggaggggauuuuacagccgagggaccucca

SEQ ID NO: 722658 - RNA, 62 nt, hsa
gccuguuuuuacuuagaaagcaggcuugggcaggaggggaaauggauuugaaccaucucaga

SEQ ID NO: 722659 - RNA, 62 nt, hsa
gaacccagaggaucuaggcccuguuggggaggggaggggagcucaagguuuggguggggacu

SEQ ID NO: 722660 - RNA, 62 nt, hsa
auggagaacccagaggaucuaggcccuguuggggaggggaggggagcucaagguuugggugg

SEQ ID NO: 722661 - RNA, 62 nt, hsa
gggagagaguguggugggaagucuugagcggaggaggggaucugcccuucuccacuccucuc

SEQ ID NO: 722662 - RNA, 62 nt, hsa
cacucccucuccagcccccgauguggacccggggaggggaggcugaggcguuuggccccggc

SEQ ID NO: 722663 - RNA, 62 nt, hsa
gcacaacgcccggccugagcccccugccauagggaggggaggacccugagggcucagccagg

SEQ ID NO: 722664 - RNA, 62 nt, hsa
gaggcccaaaggcagaacagccagagggggcaggaggggaccaaaaaggaaaaugaggacgu

SEQ ID NO: 722665 - RNA, 62 nt, hsa
guuggucccuguccuugcugcccaggcagcguggaggggaaggguagggcagccagagaaag

SEQ ID NO: 722666 - RNA, 62 nt, hsa
gguaguaggugccagccuaggggagcuuccaaggaggggaaggcaaagcccuggccccugcc

SEQ ID NO: 722667 - RNA, 62 nt, hsa
aggauguggcuucucaugaagcucuggccagaggaggggaacuuauugggggagggggggug

SEQ ID NO: 722668 - RNA, 62 nt, hsa
agaggaggggaacuuauugggggaggggggguggaggggaggaaucuggaccucuaagucau

SEQ ID NO: 722669 - RNA, 62 nt, hsa
aaagcugagaucuaaauggggacaaggcagguggaggggaggccaguguacauguaaaugcc

SEQ ID NO: 722670 - RNA, 62 nt, hsa
gauuuucugccagaggggugggucagagcaguggaggggagacaucgcccaugugcuucugc

SEQ ID NO: 722671 - RNA, 62 nt, hsa
uccucauuugucucuaaguugaaggcuuuguuggaggggacagagcacaggaacagccuuga

SEQ ID NO: 722672 - RNA, 62 nt, hsa
gggcuggugcgcggagggggcgggggugggguggaggggagggggaagagguacaggcggug

SEQ ID NO: 722673 - RNA, 62 nt, hsa
uccuuugggguugagggagaugggagcuagggggaggggagggagaugucuuguugugggga

SEQ ID NO: 722674 - RNA, 62 nt, hsa
ucucaaaccaaaguuaacagggagaggaugggggaggggacaaauuagaauaggauagcauc

SEQ ID NO: 722675 - RNA, 62 nt, hsa
ggaaaagacaccugucaaaugucacagaucugggaggggacuuaagaccuaucaugccaaga

SEQ ID NO: 722676 - RNA, 62 nt, hsa
ggcgcuggacuugggcgaccugggaggcacagggaggggagagaugggcggccccgccccag

SEQ ID NO: 722677 - RNA, 62 nt, hsa
gggagugcggggaugcggaucagcugggaggaggaggggaggggaacuuccacccgagggga

SEQ ID NO: 722678 - RNA, 62 nt, hsa
ugcggggaugcggaucagcugggaggaggaggggaggggaacuuccacccgaggggaagaug

SEQ ID NO: 722679 - RNA, 62 nt, hsa
uguggggagggagcauuuuugguggucuugggggaggggaggggagggaagggcugguguug

SEQ ID NO: 722680 - RNA, 62 nt, hsa
ggagggagcauuuuugguggucuugggggaggggaggggagggaagggcugguguugauuuu

SEQ ID NO: 722681 - RNA, 62 nt, hsa
guuuuguguugguguuuccuauuuucugcacuggaggggaggggacuguugagguucugucu

SEQ ID NO: 722682 - RNA, 62 nt, hsa
guguugguguuuccuauuuucugcacuggaggggaggggacuguugagguucugucuuuuuu

SEQ ID NO: 722683 - RNA, 62 nt, hsa
cucugaccugaugguguugggguuuggguaggggaggggagcucggcugucagaacuccaug

SEQ ID NO: 722684 - RNA, 62 nt, hsa
ugucagaacuccauggauauguuucuuuggauggaggggagggccuuuguuaccuuuugcac

SEQ ID NO: 722685 - RNA, 62 nt, hsa
ggcaggggccugggccggcgagggggccggggggaggggacagagcugaggauuuccuggag

SEQ ID NO: 722686 - RNA, 62 nt, hsa
uccggagccucauguucucuucccaggccuuuggaggggaaauggggaaagcagaacugaag

SEQ ID NO: 722687 - RNA, 62 nt, hsa
uuuuuguguccucggcccuccacccuugguggggaggggacccaggaccauaggaagguccu

SEQ ID NO: 722688 - RNA, 62 nt, hsa
cuugcccaugccuggaccuugcuucuggccagggaggggaucaggcccccuuguccacucca

SEQ ID NO: 722689 - RNA, 62 nt, hsa
gaggcuggaaaguguccccugcauucuggaggggaggggagauaauaaggagggcugcuggg

SEQ ID NO: 722690 - RNA, 62 nt, hsa
acguagaggcuggaaaguguccccugcauucuggaggggaggggagauaauaaggagggcug

SEQ ID NO: 722691 - RNA, 62 nt, hsa
acugguguauuauuugggggagggagggauggggaggggagaaagggagauggguagcauca

SEQ ID NO: 722692 - RNA, 62 nt, hsa
ucaagcuguauaguuugcacacccaucccaguggaggggaaaggggauaaguguuucaaggc

SEQ ID NO: 722693 - RNA, 62 nt, hsa
cuuccaccgugggguugggggugggcaacagaggaggggagcaaguagggaaggggguggcc

SEQ ID NO: 722694 - RNA, 62 nt, hsa
acacuuuauauacgaauaaacgcagaagagggggaggggaagcuuuauuuauagaaaugaca

SEQ ID NO: 722695 - RNA, 62 nt, hsa
auucucugccccaggcuaauauuagggacuggggaggggaccaccagaggggagagggaagc

SEQ ID NO: 722696 - RNA, 62 nt, hsa
caggccucagcaucucacauccaccaccuccaggaggggagaccacugguaaguccuccucc

SEQ ID NO: 722697 - RNA, 62 nt, hsa
gcaggccaggagggccuccuuccugccacgagggaggggagucgggccccaggucgcccccg

SEQ ID NO: 722698 - RNA, 62 nt, hsa
guccagagggucuucagaagccccccugggagggaggggaggaugagcacgcccagcucccc

SEQ ID NO: 722699 - RNA, 62 nt, hsa
cuggcggagggagggaagaggagggagugacgggaggggaggaggucagcgaccuggggccg

SEQ ID NO: 722700 - RNA, 62 nt, hsa
gcacuucuaguggucucaccuggaggcaagagggaggggacagaggcccugccacgucccgc

SEQ ID NO: 722701 - RNA, 62 nt, hsa
cuggagguacugagacagggugcugaugggaaggaggggagccuuuggggggccacccgggg

SEQ ID NO: 722702 - RNA, 62 nt, hsa
ccuuccucccaaaaguaucgggggcuggggcaggaggggagugaggcaggugacagugaggu

SEQ ID NO: 722703 - RNA, 62 nt, hsa
uccucucuaaccuccuuuacccucaucugucuggaggggagcucugucuguccguguuauuu

SEQ ID NO: 722704 - RNA, 62 nt, hsa
ucugaugguggcuggggcuggggugagcucagggaggggaagaggagaauacaugcagaguc

SEQ ID NO: 722705 - RNA, 62 nt, hsa
gucaccugauauucuggccccaggggugggagggaggggagcuuggaaggcuaguccuguag

SEQ ID NO: 722706 - RNA, 62 nt, hsa
cugaggacgcgugacauggugggcaccggaaaggaggggacuucuccugcaccccaagaagu

SEQ ID NO: 722707 - RNA, 62 nt, hsa
uccccuggaccauccagggugcuagggggcagggaggggacacccccuccccgccuuuaccu

SEQ ID NO: 722708 - RNA, 62 nt, hsa
ucuuccucucccuugucgccuucacuucuacaggaggggaaggggccagggaggggauucuc

SEQ ID NO: 722709 - RNA, 62 nt, hsa
gccuucacuucuacaggaggggaaggggccagggaggggauucucccuuuaucaucaccuca

SEQ ID NO: 722710 - RNA, 62 nt, hsa
uugcccccagaggagcagucauugcccucugcggaggggaccaggguucagcagugacguag

SEQ ID NO: 722711 - RNA, 62 nt, hsa
aagagcuggcaaaaggagccucacacccccaaggaggggacggugccacuuccagacaagac

SEQ ID NO: 722712 - RNA, 62 nt, hsa
cugucacaacaauaagcagggaggggagauguggaggggacacaucugguugccuuggaggc

SEQ ID NO: 722713 - RNA, 62 nt, hsa
cccgucguaagaccugucacaacaauaagcagggaggggagauguggaggggacacaucugg

SEQ ID NO: 722714 - RNA, 62 nt, hsa
aguuccugacugugcaaggccaacagggcaggggaggggaagaccuggggaaggaagaauga

SEQ ID NO: 722715 - RNA, 62 nt, hsa
cgaggccuaggccccugccacccccaagacugggaggggacuucuuuuucuaaaacacaaaa

SEQ ID NO: 722716 - RNA, 62 nt, hsa
agcagaaacaaaaugaaaaaaaaaggggggugggaggggaagaaaaacucuauuuuuguaaa

SEQ ID NO: 722717 - RNA, 62 nt, hsa
ucauuucacacccccgaagggaggggaggccaggaggggagcugcuccugccagaagcuggu

SEQ ID NO: 722718 - RNA, 62 nt, hsa
ccacuccaucauuucauuucacacccccgaagggaggggaggccaggaggggagcugcuccu

SEQ ID NO: 722719 - RNA, 62 nt, hsa
ucccgaggcuacagcagacccccaugagagaaggaggggagcaggcccguggcaggaggagg

SEQ ID NO: 722720 - RNA, 62 nt, hsa
ugagggggccaggcgguggcuucucccugcgaggaggggagaauucuuggggcugagcuggg

SEQ ID NO: 722721 - RNA, 62 nt, hsa
gaaaggaaggaaggaaggaaaaggaggggagaggaggggaaggggaggcagaggaggaacau

SEQ ID NO: 722722 - RNA, 62 nt, hsa
gugcuccaaggaaaggaaggaaggaaggaaaaggaggggagaggaggggaaggggaggcaga

SEQ ID NO: 722723 - RNA, 62 nt, hsa
cuggaugcuuggguaacuggggcagggcagguggaggggagaccuccauucagguggagguc

SEQ ID NO: 722724 - RNA, 62 nt, hsa
uaagcaauuacuuuucauguugggguggggacggaggggaaagggaagccuggguuuuugua

SEQ ID NO: 722725 - RNA, 62 nt, hsa
gggaggcagguggacuccuggguccccgaggaggaggggacuggggucccggauucuugggu

SEQ ID NO: 722726 - RNA, 62 nt, hsa
ugccagggacuauucucaggcugaagaaggugggaggggagggcggaaccugaggagccacc

SEQ ID NO: 722727 - RNA, 62 nt, hsa
uucuacggagaugcaggcagugccacgagggaggaggggaccugcaaagcuagaaucuaggg

SEQ ID NO: 722728 - RNA, 62 nt, hsa
cacaucagaccuggggcaggugcgcaguguggggaggggauggggugcgucagggcccagca

SEQ ID NO: 722729 - RNA, 62 nt, hsa
ccaaggcucuagaggguguucagguacacugaggaggggacggcuccgucuucacauugugc

SEQ ID NO: 722730 - RNA, 62 nt, hsa
cugagaauccucggggcggucaggggaugucaggaggggaaggagccgcccucccuaucuug

SEQ ID NO: 722731 - RNA, 62 nt, hsa
aaaagcucucugguuguaaccuggagacauguggaggggaauggcgaugggauuauaggacu

SEQ ID NO: 722732 - RNA, 62 nt, hsa
uggggucccaggcagcgcugccugggggcuggggaggggaggcccagaggagggcuggccau

SEQ ID NO: 722733 - RNA, 62 nt, hsa
cgcgcugacacagugaugggcugcccagggcuggaggggacgcuguuccucccgccgccacu

SEQ ID NO: 722734 - RNA, 62 nt, hsa
cagaguuugggugcuggugguguggcuguaggggaggggagaccacacccaaggugggggcu

SEQ ID NO: 722735 - RNA, 62 nt, hsa
ccccaucuggggacgauauggggagggagaugggaggggaaaggggagaggguuuuucucac

SEQ ID NO: 722736 - RNA, 62 nt, hsa
cuggaauuagcuuggggccagggaagggacugggaggggagagaagagaaggagggaaggau

SEQ ID NO: 722737 - RNA, 62 nt, hsa
uauguggaaguguguguggcagcaggcagcggggaggggaggaacagggaagggggagcugg

SEQ ID NO: 722738 - RNA, 62 nt, hsa
ccacgggugucccugcccacucguguggcaagggaggggagggcaggagggcucggccugag

SEQ ID NO: 722739 - RNA, 62 nt, hsa
agauggggucucagagcgagagcugcggagggggaggggaagaagaaggccucacuuuugcu

SEQ ID NO: 722740 - RNA, 62 nt, hsa
ccuuuucccgaggcuggggcuggggguggcugggaggggaagggaagggagaggcaagcugg

SEQ ID NO: 722741 - RNA, 62 nt, hsa
ccccauccccagcuagcccaagcuccaggucaggaggggagggugcugggccugacauggcu

SEQ ID NO: 722742 - RNA, 62 nt, hsa
ucccccaaaucgucauggaaaggguggagaauggaggggaaccaggcguccuuggaggcagc

SEQ ID NO: 722743 - RNA, 62 nt, hsa
gcguuccugagggccaggucgggggcaggcauggaggggaggaaaggcgucccucuuggccc

SEQ ID NO: 722744 - RNA, 64 nt, hsa
cugcauuguguauuaaacaccagguaauaugugcaaaaccgagggcuccaguaacaccuucuaa

SEQ ID NO: 722745 - RNA, 64 nt, hsa
cucauucaucuagagguaaucuggcagucuugugaaaaccgaacacaacucagaaacuuggaau

SEQ ID NO: 722746 - RNA, 64 nt, hsa; identical to SEQ ID NO: 125657

SEQ ID NO: 722747 - RNA, 64 nt, hsa; identical to SEQ ID NO: 125658

SEQ ID NO: 722748 - RNA, 64 nt, hsa; identical to SEQ ID NO: 125659

SEQ ID NO: 722749 - RNA, 64 nt, hsa; identical to SEQ ID NO: 125660

SEQ ID NO: 722750 - RNA, 64 nt, hsa; identical to SEQ ID NO: 125661

SEQ ID NO: 722751 - RNA, 64 nt, hsa; identical to SEQ ID NO: 125662

SEQ ID NO: 722752 - RNA, 64 nt, hsa; identical to SEQ ID NO: 125663

SEQ ID NO: 722753 - RNA, 64 nt, hsa; identical to SEQ ID NO: 125664

SEQ ID NO: 722754 - RNA, 64 nt, hsa; identical to SEQ ID NO: 125665

SEQ ID NO: 722755 - RNA, 64 nt, hsa; identical to SEQ ID NO: 125666

SEQ ID NO: 722756 - RNA, 64 nt, hsa; identical to SEQ ID NO: 645301

SEQ ID NO: 722757 - RNA, 64 nt, hsa; identical to SEQ ID NO: 645302

SEQ ID NO: 722758 - RNA, 64 nt, hsa; identical to SEQ ID NO: 645303

SEQ ID NO: 722759 - RNA, 64 nt, hsa; identical to SEQ ID NO: 645304

SEQ ID NO: 722760 - RNA, 64 nt, hsa; identical to SEQ ID NO: 645305

SEQ ID NO: 722761 - RNA, 64 nt, hsa; identical to SEQ ID NO: 645306

SEQ ID NO: 722762 - RNA, 64 nt, hsa; identical to SEQ ID NO: 645307

SEQ ID NO: 722763 - RNA, 64 nt, hsa; identical to SEQ ID NO: 645308

SEQ ID NO: 722764 - RNA, 64 nt, hsa; identical to SEQ ID NO: 645309

SEQ ID NO: 722765 - RNA, 64 nt, hsa; identical to SEQ ID NO: 645310

SEQ ID NO: 722766 - RNA, 64 nt, hsa; identical to SEQ ID NO: 645311

SEQ ID NO: 722767 - RNA, 64 nt, hsa; identical to SEQ ID NO: 645312

SEQ ID NO: 722768 - RNA, 64 nt, hsa; identical to SEQ ID NO: 645313

SEQ ID NO: 722769 - RNA, 64 nt, hsa; identical to SEQ ID NO: 645314

SEQ ID NO: 722770 - RNA, 64 nt, hsa; identical to SEQ ID NO: 645315

SEQ ID NO: 722771 - RNA, 64 nt, hsa; identical to SEQ ID NO: 645316

SEQ ID NO: 722772 - RNA, 64 nt, hsa; identical to SEQ ID NO: 645317

SEQ ID NO: 722773 - RNA, 64 nt, hsa; identical to SEQ ID NO: 645318

SEQ ID NO: 722774 - RNA, 64 nt, hsa; identical to SEQ ID NO: 645319

SEQ ID NO: 722775 - RNA, 64 nt, hsa; identical to SEQ ID NO: 645320

SEQ ID NO: 722776 - RNA, 64 nt, hsa; identical to SEQ ID NO: 645321

SEQ ID NO: 722777 - RNA, 64 nt, hsa; identical to SEQ ID NO: 645322

SEQ ID NO: 722778 - RNA, 64 nt, hsa; identical to SEQ ID NO: 645323

SEQ ID NO: 722779 - RNA, 64 nt, hsa; identical to SEQ ID NO: 645324

SEQ ID NO: 722780 - RNA, 64 nt, hsa; identical to SEQ ID NO: 645325

SEQ ID NO: 722781 - RNA, 64 nt, hsa; identical to SEQ ID NO: 645326

SEQ ID NO: 722782 - RNA, 64 nt, hsa; identical to SEQ ID NO: 645327

SEQ ID NO: 722783 - RNA, 64 nt, hsa; identical to SEQ ID NO: 645328

SEQ ID NO: 722784 - RNA, 64 nt, hsa; identical to SEQ ID NO: 645329

SEQ ID NO: 722785 - RNA, 64 nt, hsa; identical to SEQ ID NO: 645330

SEQ ID NO: 722786 - RNA, 64 nt, hsa; identical to SEQ ID NO: 645331

SEQ ID NO: 722787 - RNA, 64 nt, hsa; identical to SEQ ID NO: 645332

SEQ ID NO: 722788 - RNA, 64 nt, hsa; identical to SEQ ID NO: 645333

SEQ ID NO: 722789 - RNA, 64 nt, hsa; identical to SEQ ID NO: 645334

SEQ ID NO: 722790 - RNA, 64 nt, hsa; identical to SEQ ID NO: 645335

SEQ ID NO: 722791 - RNA, 64 nt, hsa; identical to SEQ ID NO: 645336

SEQ ID NO: 722792 - RNA, 64 nt, hsa; identical to SEQ ID NO: 645337

SEQ ID NO: 722793 - RNA, 64 nt, hsa; identical to SEQ ID NO: 645338

SEQ ID NO: 722794 - RNA, 64 nt, hsa; identical to SEQ ID NO: 645339

SEQ ID NO: 722795 - RNA, 64 nt, hsa; identical to SEQ ID NO: 645340

SEQ ID NO: 722796 - RNA, 64 nt, hsa; identical to SEQ ID NO: 645341

SEQ ID NO: 722797 - RNA, 64 nt, hsa; identical to SEQ ID NO: 645342

SEQ ID NO: 722798 - RNA, 64 nt, hsa; identical to SEQ ID NO: 645343

SEQ ID NO: 722799 - RNA, 64 nt, hsa; identical to SEQ ID NO: 645344

SEQ ID NO: 722800 - RNA, 64 nt, hsa; identical to SEQ ID NO: 645345

SEQ ID NO: 722801 - RNA, 64 nt, hsa; identical to SEQ ID NO: 645346

SEQ ID NO: 722802 - RNA, 64 nt, hsa; identical to SEQ ID NO: 645347

SEQ ID NO: 722803 - RNA, 64 nt, hsa; identical to SEQ ID NO: 645348

SEQ ID NO: 722804 - RNA, 64 nt, hsa; identical to SEQ ID NO: 645349

SEQ ID NO: 722805 - RNA, 64 nt, hsa; identical to SEQ ID NO: 645350

SEQ ID NO: 722806 - RNA, 64 nt, hsa
ggacaaugacguugaaacgcagcauuuuugaaaagggagaaagacucggacaggugcuaucgaa

SEQ ID NO: 722807 - RNA, 64 nt, hsa
gcaccgccgccgucgucucccggccccucgcugggggagaaagcaucugcuccaaggagggagg

SEQ ID NO: 722808 - RNA, 64 nt, hsa
uccccugauauccaaccgugauuuuggaucacaugggagaaaaagucauccaguuuuucauguu

SEQ ID NO: 722809 - RNA, 64 nt, hsa
uguuuucugugucuagugccaauuagcuaaaucagggagaaagaaaugaucacaugacuuuuag

SEQ ID NO: 722810 - RNA, 64 nt, hsa
acugucuaaguuuauguugcauuuuuagucaaaagggagaaaucuuauuccuucuugaaaauuu

SEQ ID NO: 722811 - RNA, 64 nt, hsa
auguggggugaaaugggaguagggggguggacaggggagaaacgaaaaccacaaaaagaaaacc

SEQ ID NO: 722812 - RNA, 64 nt, hsa
uacaggguggugucagucaaggucuuucaggugggggagaaauugguuagggcucccacugcca

SEQ ID NO: 722813 - RNA, 64 nt, hsa
ugaaaagacaguugugugcauggaugugugcguggggagaaagaacguggguaagaugucccuu

SEQ ID NO: 722814 - RNA, 64 nt, hsa
cagucccacuccugucaccccacgcucugcacuggggagaaaacgggaggugcucgugcuggcc

SEQ ID NO: 722815 - RNA, 64 nt, hsa
uuucugccacaucucgcccuucuggaccugcacugggagaaauucaggacaggagugaacucaa

SEQ ID NO: 722816 - RNA, 64 nt, hsa
agcauuaaaguuccuaagacccagugacaguacugggagaaaccaaggcugaagagucagguug

SEQ ID NO: 722817 - RNA, 64 nt, hsa
gaccuaauguaauaauagaaaaauacucauaauagggagaaaccaagagaaguuuuguuuuugu

SEQ ID NO: 722818 - RNA, 64 nt, hsa
accugucuccuuucucagccacaaaauaaauguugggagaaaugauauauaccacuuucccaga

SEQ ID NO: 722819 - RNA, 64 nt, hsa
cuucuuggcagcuuaacauugacuucuugguuuggggagaaauaaauuuuguuucagaauuuug

SEQ ID NO: 722820 - RNA, 64 nt, hsa
uaggaauccuuugagaaugugauuccuuuugauggggagaaagggcaaauuauuuuaauauuuu

SEQ ID NO: 722821 - RNA, 64 nt, hsa
auuauuaaacuagucaaaaaugcuaaaauaauuugggagaaaauauuuuuuaaguaguguuaua

SEQ ID NO: 722822 - RNA, 64 nt, hsa
cuucuacacaucugccuaacuugggaaugaaugugggagaaaaucgcugcugcugagauggacu

SEQ ID NO: 722823 - RNA, 64 nt, hsa
auuacagccuuagaagaaagauugugaaaagcuggggagaaaaugcuuaaggacaugcuagggg

SEQ ID NO: 722824 - RNA, 64 nt, hsa
gguuacauugaaagaaaguuaauuuggaaaauuugggagaaaucuaaucaugccuauuaaggau

SEQ ID NO: 722825 - RNA, 64 nt, hsa
gucaaaaaugacuaaaaauauaacuagugacggagggagaaauccucccucugugggaggcacu

SEQ ID NO: 722826 - RNA, 64 nt, hsa
aauuuuuaugaaauacugcgugugauaagcaaacgggagaaauuuauaucagauucuuggcugc

SEQ ID NO: 722827 - RNA, 64 nt, hsa
uuucuuucccaagcuccuagccaacacuauccuugggagaaagaaauuugcagaaacugcuaag

SEQ ID NO: 722828 - RNA, 64 nt, hsa
gaaccuugcuguugcucugaggagauauaauucugggagaaagaaucuuuuauaagaacaguac

SEQ ID NO: 722829 - RNA, 64 nt, hsa
uaagucagcuagggauucuugcagucucagcugagggagaaagguagggcugugccuucuaaag

SEQ ID NO: 722830 - RNA, 64 nt, hsa
cuauguagagaauauucugcuagguggaaaaguugggagaaaggggaauaugcaucuuuauucu

SEQ ID NO: 722831 - RNA, 64 nt, hsa
ccugccuguccugugcccaccacgcagcagucaggggagaaaaugguggcuaucccuucugcuu

SEQ ID NO: 722832 - RNA, 64 nt, hsa
ccaucgaccagcaagcccagccccagggcgcuuagggagaaaugacccagccuccucagacccc

SEQ ID NO: 722833 - RNA, 64 nt, hsa
aagaggggaaaaugaguuuuuauggggcugaacggggagaaaaggucaucaucgauucuacuuu

SEQ ID NO: 722834 - RNA, 64 nt, hsa
cugcagaacguauugguccagcuugcucuucagugggagaaaacacuuguaaguugcuaaacga

SEQ ID NO: 722835 - RNA, 64 nt, hsa
auagagaaaccaaccugauacacacuuucaugaugggagaaaaaugugggagugaaaugguauu

SEQ ID NO: 722836 - RNA, 64 nt, hsa
auuaagugccauauauaauuaguucucagaagaagggagaaaugaucauaggacugggaauugu

SEQ ID NO: 722837 - RNA, 64 nt, hsa
uuggcaggaaaaaugcagcuuucaaaucauuggggggagaaaaaggaugucuuucaggauuauu

SEQ ID NO: 722838 - RNA, 64 nt, hsa
uugagaaucaaucaauaaagaaagauggaaggaagggagaaauuggaauguuuuaacugcagcc

SEQ ID NO: 722839 - RNA, 64 nt, hsa
aaaccagguaauugaaugaagaaaggucacuaaagggagaaaugacauguuuucuauuuucuuu

SEQ ID NO: 722840 - RNA, 64 nt, hsa
gccaucuuaaucacagaccucaggggcuccaacagggagaaaaaacaaucacuggucuugucua

SEQ ID NO: 722841 - RNA, 64 nt, hsa
aauauugaauccaaggaagagagcccaaggguaggggagaaaccccccacaacugaccccugcc

SEQ ID NO: 722842 - RNA, 64 nt, hsa
auuccagggccagcaaagccggcguucagaaggagggagaaaaccgugagaggauguguguggc

SEQ ID NO: 722843 - RNA, 64 nt, hsa
aaauacucaaccaaaagacagucgagaagccagggggagaaagaacucagggcacaaaauauug

SEQ ID NO: 722844 - RNA, 64 nt, hsa
gaucaaguugucauuuuagaacagagggaacuuugggagaaagcagcccaaguagguuauuugu

SEQ ID NO: 722845 - RNA, 64 nt, hsa
ucaucccucacucuucaugugagaagucacacaggggagaaacccuaugaauguaauaaaugug

SEQ ID NO: 722846 - RNA, 64 nt, hsa
acuggaauuugaaaagccaaacugugaaaccauugggagaaaauagaugauauugucuaugacg

SEQ ID NO: 722847 - RNA, 64 nt, hsa
uuucucuccugcagaaggaaagccacgcaaguuggggagaaaacccccaaggaugaaucugcca

SEQ ID NO: 722848 - RNA, 64 nt, hsa
ccauuuuuuuuaccccuuggaggaaauaagaugagggagaaaggagaaggggaggaaacuucuc

SEQ ID NO: 722849 - RNA, 64 nt, hsa
auuggauuucaaagacaugaaaggacucacacuagggagaaaaucuauaaauguaaauguggga

SEQ ID NO: 722850 - RNA, 64 nt, hsa
aguucuuaucuaagacaugaaagaacacguacuggggagaaacuguaugaauguaagcaguguu

SEQ ID NO: 722851 - RNA, 64 nt, hsa
ucagacaggcugggggccucacucuguuuuccaggggagaaaccugagucucagagcaggggag

SEQ ID NO: 722852 - RNA, 64 nt, hsa
auggaggucagagccacaagggaaaggggagagggggagaaaacuguacucuguccagacauga

SEQ ID NO: 722853 - RNA, 64 nt, hsa
cucccacaggccucucuuucuuucuagguugcuggggagaaauggguacccuaugaucccccuc

SEQ ID NO: 722854 - RNA, 64 nt, hsa
uucugauuguuagacuguaaugcuauuccucuaugggagaaaaaaauuaauauaaagaaaaaca

SEQ ID NO: 722855 - RNA, 64 nt, hsa
caccauuuacugaugaggaaacuaaggcuccuaggggagaaaucacuugcccacaguuccacag

SEQ ID NO: 722856 - RNA, 64 nt, hsa
auuuuaaaugguaggaauuuaaggugugacuucagggagaaacaaacuugcaaaaaaaaaaaau

SEQ ID NO: 722857 - RNA, 64 nt, hsa
cacuucaaaugacaaguucauauauagaauuuacgggagaaacuugagaccauuuacggggaga

SEQ ID NO: 722858 - RNA, 64 nt, hsa
uagaauuuacgggagaaacuugagaccauuuacggggagaaacuugauucugggaagauagcag

SEQ ID NO: 722859 - RNA, 64 nt, hsa
cuagggcuaguacuuaguuucacacccgggagcugggagaaaaaaccuguacaguugucuuucu

SEQ ID NO: 722860 - RNA, 64 nt, hsa
uuguaauuuuaaaacuuuaaaauaaauuggaaaagggagaaacugagcgguguauuuuuccuca

SEQ ID NO: 722861 - RNA, 64 nt, hsa
augaccugcagccaagcccagccccguggggaaggggagaaagugggggauggcuaagaaagcu

SEQ ID NO: 722862 - RNA, 64 nt, hsa
uuucuccccuuuugcuugagcaggguucccaggagggagaaagagaagacaagagccugaugcc

SEQ ID NO: 722863 - RNA, 64 nt, hsa; identical to SEQ ID NO: 83374

SEQ ID NO: 722864 - RNA, 64 nt, hsa; identical to SEQ ID NO: 83375

SEQ ID NO: 722865 - RNA, 64 nt, hsa; identical to SEQ ID NO: 83376

SEQ ID NO: 722866 - RNA, 64 nt, hsa; identical to SEQ ID NO: 83377

SEQ ID NO: 722867 - RNA, 64 nt, hsa; identical to SEQ ID NO: 83378

SEQ ID NO: 722868 - RNA, 64 nt, hsa; identical to SEQ ID NO: 83379

SEQ ID NO: 722869 - RNA, 64 nt, hsa; identical to SEQ ID NO: 211561

SEQ ID NO: 722870 - RNA, 64 nt, hsa; identical to SEQ ID NO: 211562

SEQ ID NO: 722871 - RNA, 64 nt, hsa
gcauuuguaucuugcaaguuuguauaaacccaauacaggaaauaaaaugaaugguuuguauaug

SEQ ID NO: 722872 - RNA, 64 nt, hsa
ucucucucucuuucucccaagccuuucucccuccacaggaaacagauuuuucagggccuuccau

SEQ ID NO: 722873 - RNA, 64 nt, hsa
accugagaggcagacagaucaaaccaaacaggaaacaggaaaugcauguuugaucuguugucac

SEQ ID NO: 722874 - RNA, 64 nt, hsa
auaagucaccugagaggcagacagaucaaaccaaacaggaaacaggaaaugcauguuugaucug

SEQ ID NO: 722875 - RNA, 64 nt, hsa
guuacauaauggaauuaggcauguggaacaccaaacaggaaagaacuaugucugaaauauaaaa

SEQ ID NO: 722876 - RNA, 64 nt, hsa
cauaugugugauuuuaaacgaauauucucagaccacaggaaacucuucaucccccuguuguuua

SEQ ID NO: 722877 - RNA, 64 nt, hsa
ggcaggauggagaacagugccuguuugggggaaaacaggaaaucuuguuaggcuugagugaggu

SEQ ID NO: 722878 - RNA, 64 nt, hsa
uagcucaucucacucacucugauucuccugugccacaggaaaagagggccuggaaagcgcagug

SEQ ID NO: 722879 - RNA, 62 nt, hsa
uugucuugaaaaaaaaaaaaacaaaaaaccacauacaggaaaaaagagagggauggagucaa

SEQ ID NO: 722880 - RNA, 64 nt, hsa
ggcaaaggggaucccugaaauaacauuagaacauacaggaaaaacgaggcaggcagaucacuuu

SEQ ID NO: 722881 - RNA, 64 nt, hsa
cagaucuugugagacuuacuaucacgagaauagcacaggaaagacuggcccccaugauucaauu

SEQ ID NO: 722882 - RNA, 64 nt, hsa
cagaucucaugagacuuacuaucaugagaauagcacaggaaagacuggccccccugauucgaug

SEQ ID NO: 722883 - RNA, 64 nt, hsa
cuuccagacauacgaaacacaaaccacaacugacacaggaaaccaacacccaaagcauggacua

SEQ ID NO: 722884 - RNA, 64 nt, hsa
aaccaacacccaaagcauggacuaaccccaacgcacaggaaaagguagcuuaccugacacaaga

SEQ ID NO: 722885 - RNA, 64 nt, hsa
ccuccucauucaacacagggcuggagguucuacaacaggaaaucaggccuacagcauccugugu

SEQ ID NO: 722886 - RNA, 64 nt, hsa
cugauucuucaaagucacccuaaaagaagaucugacaggaaagcuguauaaugagauagaaaaa

SEQ ID NO: 722887 - RNA, 64 nt, hsa
caucucauccugugggauucugcaaucauaaaacacaggaaaggggaauucugugauggcaaau

SEQ ID NO: 722888 - RNA, 64 nt, hsa
gauggauagaaaaaaagcacuuacauuggggcacacaggaaaucccagugucuagcaaugguuu

SEQ ID NO: 722889 - RNA, 64 nt, hsa
uuaauguugcccacauuaagcacuguggaucacgacaggaaaaagguuggagcagugcuuuuca

SEQ ID NO: 722890 - RNA, 64 nt, hsa
ggaccuccaaacuuauagcgcugaccaacgcacaacaggaaacugggaaucucauaggaagagc

SEQ ID NO: 722891 - RNA, 64 nt, hsa
uagcagauuauccauuucaauuuuuuuuuacuccacaggaaaauguaagcuacuuugucauaga

SEQ ID NO: 722892 - RNA, 64 nt, hsa
agaauucacuucuucuuguaaaaauaaguaauuuacaggaaaggcaaaaugcuaauacuaacau

SEQ ID NO: 722893 - RNA, 64 nt, hsa
ugacuuggaccuuuucaggaguggcgcggauguuacaggaaaugcugucggagagcgcgcauuc

SEQ ID NO: 722894 - RNA, 64 nt, hsa
agcuccccaaaugccuacuggauccuacagccauacaggaaaacagacggacacagcccuuucc

SEQ ID NO: 722895 - RNA, 64 nt, hsa
uugguucuuuuccuucugccuuuuugggaaagagacaggaaagauucacuugaaaacauaaaug

SEQ ID NO: 722896 - RNA, 64 nt, hsa
uauuuuuauuauuaaaaauguaacaauuuaacccacaggaaaaaaaauuacuuuguaugcuugu

SEQ ID NO: 722897 - RNA, 64 nt, hsa
gaggggggagcagguuuuaugaauguaacugugcacaggaaaugacugguaauggaaaaaaugu

SEQ ID NO: 722898 - RNA, 64 nt, hsa
auagccugaugucccacauugacccacugaccacacaggaaaagcagcgaaaccugcacccucu

SEQ ID NO: 722899 - RNA, 64 nt, hsa
acagagauuagggggacuuaaaauuaauauaggcacaggaaagagaaaagugugcgcuccauuc

SEQ ID NO: 722900 - RNA, 64 nt, hsa
ccuaauuuauaaauuaaacuuuagauauguauguacaggaaaaaauguaguauauaguaucgua

SEQ ID NO: 722901 - RNA, 64 nt, hsa
ggaaaaaauguaguauauaguaucguauauauguacaggaaaaaaacguacuaucugugguuuc

SEQ ID NO: 722902 - RNA, 64 nt, hsa
cagagaguucauacuaaaacauauuuuugcagauacaggaaaaauuuuuuaaaaauuuuaauca

SEQ ID NO: 722903 - RNA, 64 nt, hsa
ugugacaaaacuuuuaacuaaugcucacaccuucacaggaaagcauuuauacuugagaaauauu

SEQ ID NO: 722904 - RNA, 64 nt, hsa
auauauauagauauauagagauauagauauauauacaggaaacaccgcauccuugcacugcugc

SEQ ID NO: 722905 - RNA, 64 nt, hsa
cggaugugcuuugaaguuauguauauuacauauaacaggaaaaaauauuaaaauaaacagugcu

SEQ ID NO: 722906 - RNA, 64 nt, hsa
ccagggaggccuggccuggaggaggaguccacuaacaggaaacacuucucacccccucacacag

SEQ ID NO: 722907 - RNA, 64 nt, hsa
gggagccccuggagggaaauuccuuggcaggggaacaggaaauguggccgccucugccccacug

SEQ ID NO: 722908 - RNA, 64 nt, hsa; identical to SEQ ID NO: 97088

SEQ ID NO: 722909 - RNA, 64 nt, hsa; identical to SEQ ID NO: 97089

SEQ ID NO: 722910 - RNA, 64 nt, hsa; identical to SEQ ID NO: 97090

SEQ ID NO: 722911 - RNA, 52 nt, hsa; identical to SEQ ID NO: 97091

SEQ ID NO: 722912 - RNA, 64 nt, hsa; identical to SEQ ID NO: 97092

SEQ ID NO: 722913 - RNA, 64 nt, hsa; identical to SEQ ID NO: 97093

SEQ ID NO: 722914 - RNA, 64 nt, hsa; identical to SEQ ID NO: 97094

SEQ ID NO: 722915 - RNA, 64 nt, hsa; identical to SEQ ID NO: 97095

SEQ ID NO: 722916 - RNA, 64 nt, hsa; identical to SEQ ID NO: 97096

SEQ ID NO: 722917 - RNA, 64 nt, hsa; identical to SEQ ID NO: 97097

SEQ ID NO: 722918 - RNA, 64 nt, hsa; identical to SEQ ID NO: 97098

SEQ ID NO: 722919 - RNA, 64 nt, hsa; identical to SEQ ID NO: 97099

SEQ ID NO: 722920 - RNA, 64 nt, hsa; identical to SEQ ID NO: 97100

SEQ ID NO: 722921 - RNA, 64 nt, hsa; identical to SEQ ID NO: 97101

SEQ ID NO: 722922 - RNA, 64 nt, hsa; identical to SEQ ID NO: 97102

SEQ ID NO: 722923 - RNA, 64 nt, hsa; identical to SEQ ID NO: 97103

SEQ ID NO: 722924 - RNA, 64 nt, hsa; identical to SEQ ID NO: 97104

SEQ ID NO: 722925 - RNA, 64 nt, hsa; identical to SEQ ID NO: 97105

SEQ ID NO: 722926 - RNA, 64 nt, hsa; identical to SEQ ID NO: 97106

SEQ ID NO: 722927 - RNA, 64 nt, hsa; identical to SEQ ID NO: 97107

SEQ ID NO: 722928 - RNA, 64 nt, hsa; identical to SEQ ID NO: 97108

SEQ ID NO: 722929 - RNA, 64 nt, hsa; identical to SEQ ID NO: 97109

SEQ ID NO: 722930 - RNA, 64 nt, hsa; identical to SEQ ID NO: 97110

SEQ ID NO: 722931 - RNA, 64 nt, hsa; identical to SEQ ID NO: 97111

SEQ ID NO: 722932 - RNA, 64 nt, hsa; identical to SEQ ID NO: 97112

SEQ ID NO: 722933 - RNA, 64 nt, hsa; identical to SEQ ID NO: 97113

SEQ ID NO: 722934 - RNA, 64 nt, hsa; identical to SEQ ID NO: 97114

SEQ ID NO: 722935 - RNA, 64 nt, hsa; identical to SEQ ID NO: 97115

SEQ ID NO: 722936 - RNA, 64 nt, hsa; identical to SEQ ID NO: 97116

SEQ ID NO: 722937 - RNA, 64 nt, hsa; identical to SEQ ID NO: 97117

SEQ ID NO: 722938 - RNA, 64 nt, hsa; identical to SEQ ID NO: 97118

SEQ ID NO: 722939 - RNA, 64 nt, hsa; identical to SEQ ID NO: 97119

SEQ ID NO: 722940 - RNA, 64 nt, hsa; identical to SEQ ID NO: 97120

SEQ ID NO: 722941 - RNA, 64 nt, hsa; identical to SEQ ID NO: 97121

SEQ ID NO: 722942 - RNA, 64 nt, hsa; identical to SEQ ID NO: 97122

SEQ ID NO: 722943 - RNA, 64 nt, hsa; identical to SEQ ID NO: 97123

SEQ ID NO: 722944 - RNA, 64 nt, hsa; identical to SEQ ID NO: 97124

SEQ ID NO: 722945 - RNA, 64 nt, hsa; identical to SEQ ID NO: 97125

SEQ ID NO: 722946 - RNA, 64 nt, hsa; identical to SEQ ID NO: 97126

SEQ ID NO: 722947 - RNA, 64 nt, hsa; identical to SEQ ID NO: 97127

SEQ ID NO: 722948 - RNA, 64 nt, hsa; identical to SEQ ID NO: 97128

SEQ ID NO: 722949 - RNA, 64 nt, hsa; identical to SEQ ID NO: 97129

SEQ ID NO: 722950 - RNA, 64 nt, hsa; identical to SEQ ID NO: 97130

SEQ ID NO: 722951 - RNA, 64 nt, hsa; identical to SEQ ID NO: 97131

SEQ ID NO: 722952 - RNA, 64 nt, hsa; identical to SEQ ID NO: 97132

SEQ ID NO: 722953 - RNA, 64 nt, hsa; identical to SEQ ID NO: 97133

SEQ ID NO: 722954 - RNA, 64 nt, hsa; identical to SEQ ID NO: 82841

SEQ ID NO: 722955 - RNA, 64 nt, hsa; identical to SEQ ID NO: 82842

SEQ ID NO: 722956 - RNA, 64 nt, hsa; identical to SEQ ID NO: 82843

SEQ ID NO: 722957 - RNA, 64 nt, hsa; identical to SEQ ID NO: 82844

SEQ ID NO: 722958 - RNA, 64 nt, hsa; identical to SEQ ID NO: 82845

SEQ ID NO: 722959 - RNA, 64 nt, hsa; identical to SEQ ID NO: 82846

SEQ ID NO: 722960 - RNA, 64 nt, hsa; identical to SEQ ID NO: 82847

SEQ ID NO: 722961 - RNA, 64 nt, hsa; identical to SEQ ID NO: 82848

SEQ ID NO: 722962 - RNA, 64 nt, hsa; identical to SEQ ID NO: 82849

SEQ ID NO: 722963 - RNA, 64 nt, hsa; identical to SEQ ID NO: 82850

SEQ ID NO: 722964 - RNA, 64 nt, hsa; identical to SEQ ID NO: 664057

SEQ ID NO: 722965 - RNA, 64 nt, hsa; identical to SEQ ID NO: 664058

SEQ ID NO: 722966 - RNA, 64 nt, hsa; identical to SEQ ID NO: 664059

SEQ ID NO: 722967 - RNA, 64 nt, hsa; identical to SEQ ID NO: 664060

SEQ ID NO: 722968 - RNA, 64 nt, hsa; identical to SEQ ID NO: 664061

SEQ ID NO: 722969 - RNA, 64 nt, hsa; identical to SEQ ID NO: 664062

SEQ ID NO: 722970 - RNA, 64 nt, hsa; identical to SEQ ID NO: 664063

SEQ ID NO: 722971 - RNA, 64 nt, hsa; identical to SEQ ID NO: 664064

SEQ ID NO: 722972 - RNA, 64 nt, hsa; identical to SEQ ID NO: 664065

SEQ ID NO: 722973 - RNA, 64 nt, hsa; identical to SEQ ID NO: 664066

SEQ ID NO: 722974 - RNA, 64 nt, hsa; identical to SEQ ID NO: 664067

SEQ ID NO: 722975 - RNA, 64 nt, hsa; identical to SEQ ID NO: 664068

SEQ ID NO: 722976 - RNA, 64 nt, hsa; identical to SEQ ID NO: 664069

SEQ ID NO: 722977 - RNA, 64 nt, hsa; identical to SEQ ID NO: 664070

SEQ ID NO: 722978 - RNA, 64 nt, hsa; identical to SEQ ID NO: 664071

SEQ ID NO: 722979 - RNA, 64 nt, hsa; identical to SEQ ID NO: 664072

SEQ ID NO: 722980 - RNA, 64 nt, hsa; identical to SEQ ID NO: 664073

SEQ ID NO: 722981 - RNA, 64 nt, hsa; identical to SEQ ID NO: 664074

SEQ ID NO: 722982 - RNA, 64 nt, hsa; identical to SEQ ID NO: 664075

SEQ ID NO: 722983 - RNA, 64 nt, hsa; identical to SEQ ID NO: 664076

SEQ ID NO: 722984 - RNA, 64 nt, hsa; identical to SEQ ID NO: 664077

SEQ ID NO: 722985 - RNA, 58 nt, hsa; identical to SEQ ID NO: 664078

SEQ ID NO: 722986 - RNA, 64 nt, hsa; identical to SEQ ID NO: 664079

SEQ ID NO: 722987 - RNA, 64 nt, hsa; identical to SEQ ID NO: 246508

SEQ ID NO: 722988 - RNA, 64 nt, hsa; identical to SEQ ID NO: 246509

SEQ ID NO: 722989 - RNA, 64 nt, hsa; identical to SEQ ID NO: 246510

SEQ ID NO: 722990 - RNA, 64 nt, hsa; identical to SEQ ID NO: 246511

SEQ ID NO: 722991 - RNA, 64 nt, hsa; identical to SEQ ID NO: 246512

SEQ ID NO: 722992 - RNA, 64 nt, hsa; identical to SEQ ID NO: 246513

SEQ ID NO: 722993 - RNA, 64 nt, hsa; identical to SEQ ID NO: 246514

SEQ ID NO: 722994 - RNA, 64 nt, hsa; identical to SEQ ID NO: 246515

SEQ ID NO: 722995 - RNA, 64 nt, hsa; identical to SEQ ID NO: 246516

SEQ ID NO: 722996 - RNA, 64 nt, hsa; identical to SEQ ID NO: 246517

SEQ ID NO: 722997 - RNA, 64 nt, hsa; identical to SEQ ID NO: 246518

SEQ ID NO: 722998 - RNA, 64 nt, hsa; identical to SEQ ID NO: 246519

SEQ ID NO: 722999 - RNA, 64 nt, hsa; identical to SEQ ID NO: 246520

SEQ ID NO: 723000 - RNA, 64 nt, hsa; identical to SEQ ID NO: 246521

SEQ ID NO: 723001 - RNA, 64 nt, hsa; identical to SEQ ID NO: 246522

SEQ ID NO: 723002 - RNA, 64 nt, hsa; identical to SEQ ID NO: 246523

SEQ ID NO: 723003 - RNA, 64 nt, hsa; identical to SEQ ID NO: 246524

SEQ ID NO: 723004 - RNA, 64 nt, hsa; identical to SEQ ID NO: 246525

SEQ ID NO: 723005 - RNA, 64 nt, hsa; identical to SEQ ID NO: 80686

SEQ ID NO: 723006 - RNA, 64 nt, hsa; identical to SEQ ID NO: 80687

SEQ ID NO: 723007 - RNA, 64 nt, hsa; identical to SEQ ID NO: 80688

SEQ ID NO: 723008 - RNA, 64 nt, hsa; identical to SEQ ID NO: 80689

SEQ ID NO: 723009 - RNA, 64 nt, hsa; identical to SEQ ID NO: 80690

SEQ ID NO: 723010 - RNA, 64 nt, hsa; identical to SEQ ID NO: 80691

SEQ ID NO: 723011 - RNA, 64 nt, hsa; identical to SEQ ID NO: 80692

SEQ ID NO: 723012 - RNA, 64 nt, hsa; identical to SEQ ID NO: 80693

SEQ ID NO: 723013 - RNA, 64 nt, hsa; identical to SEQ ID NO: 80694

SEQ ID NO: 723014 - RNA, 50 nt, hsa; identical to SEQ ID NO: 80695

SEQ ID NO: 723015 - RNA, 64 nt, hsa; identical to SEQ ID NO: 80696

SEQ ID NO: 723016 - RNA, 64 nt, hsa; identical to SEQ ID NO: 80697

SEQ ID NO: 723017 - RNA, 64 nt, hsa; identical to SEQ ID NO: 80698

SEQ ID NO: 723018 - RNA, 64 nt, hsa; identical to SEQ ID NO: 80699

SEQ ID NO: 723019 - RNA, 64 nt, hsa; identical to SEQ ID NO: 80700

SEQ ID NO: 723020 - RNA, 64 nt, hsa; identical to SEQ ID NO: 80701

SEQ ID NO: 723021 - RNA, 64 nt, hsa; identical to SEQ ID NO: 80702

SEQ ID NO: 723022 - RNA, 64 nt, hsa; identical to SEQ ID NO: 80703

SEQ ID NO: 723023 - RNA, 64 nt, hsa; identical to SEQ ID NO: 80704

SEQ ID NO: 723024 - RNA, 64 nt, hsa; identical to SEQ ID NO: 80705

SEQ ID NO: 723025 - RNA, 64 nt, hsa; identical to SEQ ID NO: 80706

SEQ ID NO: 723026 - RNA, 64 nt, hsa; identical to SEQ ID NO: 80707

SEQ ID NO: 723027 - RNA, 64 nt, hsa; identical to SEQ ID NO: 80708

SEQ ID NO: 723028 - RNA, 64 nt, hsa; identical to SEQ ID NO: 80709

SEQ ID NO: 723029 - RNA, 64 nt, hsa; identical to SEQ ID NO: 80710

SEQ ID NO: 723030 - RNA, 64 nt, hsa; identical to SEQ ID NO: 80711

SEQ ID NO: 723031 - RNA, 64 nt, hsa; identical to SEQ ID NO: 80712

SEQ ID NO: 723032 - RNA, 64 nt, hsa; identical to SEQ ID NO: 80713

SEQ ID NO: 723033 - RNA, 64 nt, hsa; identical to SEQ ID NO: 80714

SEQ ID NO: 723034 - RNA, 64 nt, hsa; identical to SEQ ID NO: 80715

SEQ ID NO: 723035 - RNA, 53 nt, hsa; identical to SEQ ID NO: 80716

SEQ ID NO: 723036 - RNA, 64 nt, hsa; identical to SEQ ID NO: 80717

SEQ ID NO: 723037 - RNA, 64 nt, hsa; identical to SEQ ID NO: 80718

SEQ ID NO: 723038 - RNA, 64 nt, hsa; identical to SEQ ID NO: 80719

SEQ ID NO: 723039 - RNA, 64 nt, hsa; identical to SEQ ID NO: 80720

SEQ ID NO: 723040 - RNA, 64 nt, hsa; identical to SEQ ID NO: 80721

SEQ ID NO: 723041 - RNA, 64 nt, hsa; identical to SEQ ID NO: 80722

SEQ ID NO: 723042 - RNA, 64 nt, hsa; identical to SEQ ID NO: 80723

SEQ ID NO: 723043 - RNA, 64 nt, hsa; identical to SEQ ID NO: 80724

SEQ ID NO: 723044 - RNA, 64 nt, hsa; identical to SEQ ID NO: 80725

SEQ ID NO: 723045 - RNA, 64 nt, hsa; identical to SEQ ID NO: 80726

SEQ ID NO: 723046 - RNA, 52 nt, hsa; identical to SEQ ID NO: 80727

SEQ ID NO: 723047 - RNA, 64 nt, hsa; identical to SEQ ID NO: 80728

SEQ ID NO: 723048 - RNA, 64 nt, hsa; identical to SEQ ID NO: 80729

SEQ ID NO: 723049 - RNA, 64 nt, hsa; identical to SEQ ID NO: 80730

SEQ ID NO: 723050 - RNA, 64 nt, hsa; identical to SEQ ID NO: 80731

SEQ ID NO: 723051 - RNA, 64 nt, hsa; identical to SEQ ID NO: 80732

SEQ ID NO: 723052 - RNA, 64 nt, hsa; identical to SEQ ID NO: 80733

SEQ ID NO: 723053 - RNA, 64 nt, hsa; identical to SEQ ID NO: 80734

SEQ ID NO: 723054 - RNA, 64 nt, hsa; identical to SEQ ID NO: 80735

SEQ ID NO: 723055 - RNA, 64 nt, hsa; identical to SEQ ID NO: 80736

SEQ ID NO: 723056 - RNA, 64 nt, hsa; identical to SEQ ID NO: 80737

SEQ ID NO: 723057 - RNA, 64 nt, hsa; identical to SEQ ID NO: 80738

SEQ ID NO: 723058 - RNA, 64 nt, hsa; identical to SEQ ID NO: 80739

SEQ ID NO: 723059 - RNA, 64 nt, hsa; identical to SEQ ID NO: 80740

SEQ ID NO: 723060 - RNA, 64 nt, hsa; identical to SEQ ID NO: 80741

SEQ ID NO: 723061 - RNA, 64 nt, hsa; identical to SEQ ID NO: 80742

SEQ ID NO: 723062 - RNA, 64 nt, hsa; identical to SEQ ID NO: 80743

SEQ ID NO: 723063 - RNA, 64 nt, hsa; identical to SEQ ID NO: 80744

SEQ ID NO: 723064 - RNA, 64 nt, hsa; identical to SEQ ID NO: 80745

SEQ ID NO: 723065 - RNA, 64 nt, hsa; identical to SEQ ID NO: 80746

SEQ ID NO: 723066 - RNA, 64 nt, hsa; identical to SEQ ID NO: 80747

SEQ ID NO: 723067 - RNA, 64 nt, hsa; identical to SEQ ID NO: 80748

SEQ ID NO: 723068 - RNA, 64 nt, hsa; identical to SEQ ID NO: 80749

SEQ ID NO: 723069 - RNA, 64 nt, hsa; identical to SEQ ID NO: 80750

SEQ ID NO: 723070 - RNA, 64 nt, hsa; identical to SEQ ID NO: 80751

SEQ ID NO: 723071 - RNA, 64 nt, hsa; identical to SEQ ID NO: 80752

SEQ ID NO: 723072 - RNA, 64 nt, hsa; identical to SEQ ID NO: 80753

SEQ ID NO: 723073 - RNA, 64 nt, hsa; identical to SEQ ID NO: 80754

SEQ ID NO: 723074 - RNA, 64 nt, hsa; identical to SEQ ID NO: 80755

SEQ ID NO: 723075 - RNA, 64 nt, hsa; identical to SEQ ID NO: 80756

SEQ ID NO: 723076 - RNA, 64 nt, hsa; identical to SEQ ID NO: 80757

SEQ ID NO: 723077 - RNA, 64 nt, hsa; identical to SEQ ID NO: 80758

SEQ ID NO: 723078 - RNA, 64 nt, hsa; identical to SEQ ID NO: 80759

SEQ ID NO: 723079 - RNA, 64 nt, hsa; identical to SEQ ID NO: 80760

SEQ ID NO: 723080 - RNA, 64 nt, hsa; identical to SEQ ID NO: 80761

SEQ ID NO: 723081 - RNA, 64 nt, hsa; identical to SEQ ID NO: 80762

SEQ ID NO: 723082 - RNA, 64 nt, hsa; identical to SEQ ID NO: 80763

SEQ ID NO: 723083 - RNA, 64 nt, hsa; identical to SEQ ID NO: 80764

SEQ ID NO: 723084 - RNA, 64 nt, hsa; identical to SEQ ID NO: 80765

SEQ ID NO: 723085 - RNA, 64 nt, hsa; identical to SEQ ID NO: 80766

SEQ ID NO: 723086 - RNA, 64 nt, hsa; identical to SEQ ID NO: 80767

SEQ ID NO: 723087 - RNA, 64 nt, hsa; identical to SEQ ID NO: 80768

SEQ ID NO: 723088 - RNA, 64 nt, hsa; identical to SEQ ID NO: 80769

SEQ ID NO: 723089 - RNA, 64 nt, hsa; identical to SEQ ID NO: 80770

SEQ ID NO: 723090 - RNA, 64 nt, hsa; identical to SEQ ID NO: 80771

SEQ ID NO: 723091 - RNA, 64 nt, hsa; identical to SEQ ID NO: 80772

SEQ ID NO: 723092 - RNA, 64 nt, hsa; identical to SEQ ID NO: 80773

SEQ ID NO: 723093 - RNA, 64 nt, hsa; identical to SEQ ID NO: 80774

SEQ ID NO: 723094 - RNA, 59 nt, hsa; identical to SEQ ID NO: 80775

SEQ ID NO: 723095 - RNA, 64 nt, hsa; identical to SEQ ID NO: 80776

SEQ ID NO: 723096 - RNA, 64 nt, hsa; identical to SEQ ID NO: 80777

SEQ ID NO: 723097 - RNA, 64 nt, hsa; identical to SEQ ID NO: 80778

SEQ ID NO: 723098 - RNA, 64 nt, hsa; identical to SEQ ID NO: 80779

SEQ ID NO: 723099 - RNA, 64 nt, hsa; identical to SEQ ID NO: 80780

SEQ ID NO: 723100 - RNA, 64 nt, hsa; identical to SEQ ID NO: 80781

SEQ ID NO: 723101 - RNA, 64 nt, hsa; identical to SEQ ID NO: 80782

SEQ ID NO: 723102 - RNA, 64 nt, hsa; identical to SEQ ID NO: 80783

SEQ ID NO: 723103 - RNA, 64 nt, hsa; identical to SEQ ID NO: 80784

SEQ ID NO: 723104 - RNA, 64 nt, hsa; identical to SEQ ID NO: 80785

SEQ ID NO: 723105 - RNA, 64 nt, hsa; identical to SEQ ID NO: 80786

SEQ ID NO: 723106 - RNA, 64 nt, hsa; identical to SEQ ID NO: 80787

SEQ ID NO: 723107 - RNA, 64 nt, hsa; identical to SEQ ID NO: 80788

SEQ ID NO: 723108 - RNA, 64 nt, hsa; identical to SEQ ID NO: 80789

SEQ ID NO: 723109 - RNA, 64 nt, hsa; identical to SEQ ID NO: 80790

SEQ ID NO: 723110 - RNA, 64 nt, hsa; identical to SEQ ID NO: 80791

SEQ ID NO: 723111 - RNA, 64 nt, hsa; identical to SEQ ID NO: 80792

SEQ ID NO: 723112 - RNA, 64 nt, hsa; identical to SEQ ID NO: 80793

SEQ ID NO: 723113 - RNA, 64 nt, hsa; identical to SEQ ID NO: 80794

SEQ ID NO: 723114 - RNA, 64 nt, hsa; identical to SEQ ID NO: 80795

SEQ ID NO: 723115 - RNA, 64 nt, hsa; identical to SEQ ID NO: 80796

SEQ ID NO: 723116 - RNA, 64 nt, hsa; identical to SEQ ID NO: 80797

SEQ ID NO: 723117 - RNA, 64 nt, hsa; identical to SEQ ID NO: 80798

SEQ ID NO: 723118 - RNA, 64 nt, hsa; identical to SEQ ID NO: 80799

SEQ ID NO: 723119 - RNA, 64 nt, hsa; identical to SEQ ID NO: 80800

SEQ ID NO: 723120 - RNA, 64 nt, hsa; identical to SEQ ID NO: 80801

SEQ ID NO: 723121 - RNA, 64 nt, hsa; identical to SEQ ID NO: 80802

SEQ ID NO: 723122 - RNA, 64 nt, hsa; identical to SEQ ID NO: 80803

SEQ ID NO: 723123 - RNA, 64 nt, hsa; identical to SEQ ID NO: 80804

SEQ ID NO: 723124 - RNA, 64 nt, hsa; identical to SEQ ID NO: 80805

SEQ ID NO: 723125 - RNA, 64 nt, hsa; identical to SEQ ID NO: 80806

SEQ ID NO: 723126 - RNA, 64 nt, hsa; identical to SEQ ID NO: 80807

SEQ ID NO: 723127 - RNA, 64 nt, hsa; identical to SEQ ID NO: 80808

SEQ ID NO: 723128 - RNA, 64 nt, hsa; identical to SEQ ID NO: 80809

SEQ ID NO: 723129 - RNA, 64 nt, hsa; identical to SEQ ID NO: 80810

SEQ ID NO: 723130 - RNA, 64 nt, hsa; identical to SEQ ID NO: 80811

SEQ ID NO: 723131 - RNA, 64 nt, hsa; identical to SEQ ID NO: 80812

SEQ ID NO: 723132 - RNA, 64 nt, hsa; identical to SEQ ID NO: 80813

SEQ ID NO: 723133 - RNA, 64 nt, hsa; identical to SEQ ID NO: 80814

SEQ ID NO: 723134 - RNA, 64 nt, hsa; identical to SEQ ID NO: 80815

SEQ ID NO: 723135 - RNA, 64 nt, hsa; identical to SEQ ID NO: 80816

SEQ ID NO: 723136 - RNA, 64 nt, hsa; identical to SEQ ID NO: 80817

SEQ ID NO: 723137 - RNA, 64 nt, hsa; identical to SEQ ID NO: 80818

SEQ ID NO: 723138 - RNA, 64 nt, hsa; identical to SEQ ID NO: 80819

SEQ ID NO: 723139 - RNA, 64 nt, hsa; identical to SEQ ID NO: 80820

SEQ ID NO: 723140 - RNA, 64 nt, hsa; identical to SEQ ID NO: 80821

SEQ ID NO: 723141 - RNA, 64 nt, hsa; identical to SEQ ID NO: 80822

SEQ ID NO: 723142 - RNA, 64 nt, hsa; identical to SEQ ID NO: 80823

SEQ ID NO: 723143 - RNA, 64 nt, hsa; identical to SEQ ID NO: 80824

SEQ ID NO: 723144 - RNA, 64 nt, hsa; identical to SEQ ID NO: 80825

SEQ ID NO: 723145 - RNA, 64 nt, hsa; identical to SEQ ID NO: 80826

SEQ ID NO: 723146 - RNA, 64 nt, hsa; identical to SEQ ID NO: 80827

SEQ ID NO: 723147 - RNA, 64 nt, hsa; identical to SEQ ID NO: 80828

SEQ ID NO: 723148 - RNA, 64 nt, hsa; identical to SEQ ID NO: 80829

SEQ ID NO: 723149 - RNA, 64 nt, hsa; identical to SEQ ID NO: 80830

SEQ ID NO: 723150 - RNA, 64 nt, hsa; identical to SEQ ID NO: 80831

SEQ ID NO: 723151 - RNA, 64 nt, hsa; identical to SEQ ID NO: 80832

SEQ ID NO: 723152 - RNA, 64 nt, hsa; identical to SEQ ID NO: 80833

SEQ ID NO: 723153 - RNA, 64 nt, hsa; identical to SEQ ID NO: 80834

SEQ ID NO: 723154 - RNA, 64 nt, hsa; identical to SEQ ID NO: 80835

SEQ ID NO: 723155 - RNA, 64 nt, hsa; identical to SEQ ID NO: 80836

SEQ ID NO: 723156 - RNA, 64 nt, hsa; identical to SEQ ID NO: 80837

SEQ ID NO: 723157 - RNA, 64 nt, hsa; identical to SEQ ID NO: 80838

SEQ ID NO: 723158 - RNA, 64 nt, hsa; identical to SEQ ID NO: 80839

SEQ ID NO: 723159 - RNA, 64 nt, hsa; identical to SEQ ID NO: 80839

SEQ ID NO: 723160 - RNA, 64 nt, hsa; identical to SEQ ID NO: 80841

SEQ ID NO: 723161 - RNA, 64 nt, hsa; identical to SEQ ID NO: 80842

SEQ ID NO: 723162 - RNA, 64 nt, hsa; identical to SEQ ID NO: 80843

SEQ ID NO: 723163 - RNA, 64 nt, hsa; identical to SEQ ID NO: 80844

SEQ ID NO: 723164 - RNA, 64 nt, hsa; identical to SEQ ID NO: 80845

SEQ ID NO: 723165 - RNA, 64 nt, hsa; identical to SEQ ID NO: 80846

SEQ ID NO: 723166 - RNA, 64 nt, hsa; identical to SEQ ID NO: 80847

SEQ ID NO: 723167 - RNA, 64 nt, hsa; identical to SEQ ID NO: 80848

SEQ ID NO: 723168 - RNA, 64 nt, hsa; identical to SEQ ID NO: 80849

SEQ ID NO: 723169 - RNA, 64 nt, hsa; identical to SEQ ID NO: 80850

SEQ ID NO: 723170 - RNA, 64 nt, hsa; identical to SEQ ID NO: 80851

SEQ ID NO: 723171 - RNA, 64 nt, hsa; identical to SEQ ID NO: 80852

SEQ ID NO: 723172 - RNA, 64 nt, hsa; identical to SEQ ID NO: 80853

SEQ ID NO: 723173 - RNA, 64 nt, hsa; identical to SEQ ID NO: 80854

SEQ ID NO: 723174 - RNA, 64 nt, hsa; identical to SEQ ID NO: 80855

SEQ ID NO: 723175 - RNA, 64 nt, hsa; identical to SEQ ID NO: 80856

SEQ ID NO: 723176 - RNA, 64 nt, hsa; identical to SEQ ID NO: 576060

SEQ ID NO: 723177 - RNA, 64 nt, hsa; identical to SEQ ID NO: 576061

SEQ ID NO: 723178 - RNA, 64 nt, hsa; identical to SEQ ID NO: 576062

SEQ ID NO: 723179 - RNA, 64 nt, hsa; identical to SEQ ID NO: 576063

SEQ ID NO: 723180 - RNA, 64 nt, hsa; identical to SEQ ID NO: 576064

SEQ ID NO: 723181 - RNA, 64 nt, hsa; identical to SEQ ID NO: 576065

SEQ ID NO: 723182 - RNA, 64 nt, hsa; identical to SEQ ID NO: 576066

SEQ ID NO: 723183 - RNA, 64 nt, hsa; identical to SEQ ID NO: 576067

SEQ ID NO: 723184 - RNA, 64 nt, hsa; identical to SEQ ID NO: 576068

SEQ ID NO: 723185 - RNA, 64 nt, hsa; identical to SEQ ID NO: 576069

SEQ ID NO: 723186 - RNA, 64 nt, hsa; identical to SEQ ID NO: 576070

SEQ ID NO: 723187 - RNA, 64 nt, hsa; identical to SEQ ID NO: 576071

SEQ ID NO: 723188 - RNA, 64 nt, hsa; identical to SEQ ID NO: 576072

SEQ ID NO: 723189 - RNA, 64 nt, hsa; identical to SEQ ID NO: 576073

SEQ ID NO: 723190 - RNA, 64 nt, hsa; identical to SEQ ID NO: 576074

SEQ ID NO: 723191 - RNA, 64 nt, hsa; identical to SEQ ID NO: 576075

SEQ ID NO: 723192 - RNA, 64 nt, hsa; identical to SEQ ID NO: 89734

SEQ ID NO: 723193 - RNA, 64 nt, hsa; identical to SEQ ID NO: 89735

SEQ ID NO: 723194 - RNA, 64 nt, hsa; identical to SEQ ID NO: 324616

SEQ ID NO: 723195 - RNA, 64 nt, hsa; identical to SEQ ID NO: 324617

SEQ ID NO: 723196 - RNA, 64 nt, hsa; identical to SEQ ID NO: 71090

SEQ ID NO: 723197 - RNA, 64 nt, hsa; identical to SEQ ID NO: 71091

SEQ ID NO: 723198 - RNA, 64 nt, hsa; identical to SEQ ID NO: 71092

SEQ ID NO: 723199 - RNA, 64 nt, hsa; identical to SEQ ID NO: 71093

SEQ ID NO: 723200 - RNA, 64 nt, hsa; identical to SEQ ID NO: 71094

SEQ ID NO: 723201 - RNA, 64 nt, hsa; identical to SEQ ID NO: 71095

SEQ ID NO: 723202 - RNA, 64 nt, hsa; identical to SEQ ID NO: 71096

SEQ ID NO: 723203 - RNA, 64 nt, hsa; identical to SEQ ID NO: 71097

SEQ ID NO: 723204 - RNA, 64 nt, hsa; identical to SEQ ID NO: 71098

SEQ ID NO: 723205 - RNA, 64 nt, hsa; identical to SEQ ID NO: 71099

SEQ ID NO: 723206 - RNA, 64 nt, hsa; identical to SEQ ID NO: 71100

SEQ ID NO: 723207 - RNA, 64 nt, hsa; identical to SEQ ID NO: 71101

SEQ ID NO: 723208 - RNA, 64 nt, hsa; identical to SEQ ID NO: 71102

SEQ ID NO: 723209 - RNA, 64 nt, hsa; identical to SEQ ID NO: 71103

SEQ ID NO: 723210 - RNA, 64 nt, hsa; identical to SEQ ID NO: 71104

SEQ ID NO: 723211 - RNA, 64 nt, hsa; identical to SEQ ID NO: 71105

SEQ ID NO: 723212 - RNA, 64 nt, hsa; identical to SEQ ID NO: 71106

SEQ ID NO: 723213 - RNA, 64 nt, hsa; identical to SEQ ID NO: 71107

SEQ ID NO: 723214 - RNA, 64 nt, hsa; identical to SEQ ID NO: 71108

SEQ ID NO: 723215 - RNA, 64 nt, hsa; identical to SEQ ID NO: 71109

SEQ ID NO: 723216 - RNA, 64 nt, hsa; identical to SEQ ID NO: 71110

SEQ ID NO: 723217 - RNA, 64 nt, hsa; identical to SEQ ID NO: 71111

SEQ ID NO: 723218 - RNA, 64 nt, hsa; identical to SEQ ID NO: 71112

SEQ ID NO: 723219 - RNA, 64 nt, hsa; identical to SEQ ID NO: 71113

SEQ ID NO: 723220 - RNA, 64 nt, hsa; identical to SEQ ID NO: 71114

SEQ ID NO: 723221 - RNA, 64 nt, hsa; identical to SEQ ID NO: 71115

SEQ ID NO: 723222 - RNA, 64 nt, hsa; identical to SEQ ID NO: 71116

SEQ ID NO: 723223 - RNA, 64 nt, hsa; identical to SEQ ID NO: 71117

SEQ ID NO: 723224 - RNA, 64 nt, hsa; identical to SEQ ID NO: 71118

SEQ ID NO: 723225 - RNA, 64 nt, hsa; identical to SEQ ID NO: 71119

SEQ ID NO: 723226 - RNA, 64 nt, hsa; identical to SEQ ID NO: 581094

SEQ ID NO: 723227 - RNA, 64 nt, hsa; identical to SEQ ID NO: 581095

SEQ ID NO: 723228 - RNA, 64 nt, hsa; identical to SEQ ID NO: 581096

SEQ ID NO: 723229 - RNA, 64 nt, hsa; identical to SEQ ID NO: 581097

SEQ ID NO: 723230 - RNA, 64 nt, hsa; identical to SEQ ID NO: 581098

SEQ ID NO: 723231 - RNA, 64 nt, hsa; identical to SEQ ID NO: 581099

SEQ ID NO: 723232 - RNA, 64 nt, hsa; identical to SEQ ID NO: 581100

SEQ ID NO: 723233 - RNA, 64 nt, hsa; identical to SEQ ID NO: 581101

SEQ ID NO: 723234 - RNA, 64 nt, hsa; identical to SEQ ID NO: 581102

SEQ ID NO: 723235 - RNA, 64 nt, hsa; identical to SEQ ID NO: 581103

SEQ ID NO: 723236 - RNA, 64 nt, hsa; identical to SEQ ID NO: 581104

SEQ ID NO: 723237 - RNA, 64 nt, hsa; identical to SEQ ID NO: 581105

SEQ ID NO: 723238 - RNA, 64 nt, hsa; identical to SEQ ID NO: 538503

SEQ ID NO: 723239 - RNA, 64 nt, hsa; identical to SEQ ID NO: 538504

SEQ ID NO: 723240 - RNA, 64 nt, hsa; identical to SEQ ID NO: 538505

SEQ ID NO: 723241 - RNA, 64 nt, hsa; identical to SEQ ID NO: 538506

SEQ ID NO: 723242 - RNA, 64 nt, hsa; identical to SEQ ID NO: 538507

SEQ ID NO: 723243 - RNA, 64 nt, hsa; identical to SEQ ID NO: 538508

SEQ ID NO: 723244 - RNA, 64 nt, hsa; identical to SEQ ID NO: 538509

SEQ ID NO: 723245 - RNA, 64 nt, hsa; identical to SEQ ID NO: 538510

SEQ ID NO: 723246 - RNA, 64 nt, hsa; identical to SEQ ID NO: 538511

SEQ ID NO: 723247 - RNA, 64 nt, hsa; identical to SEQ ID NO: 538512

SEQ ID NO: 723248 - RNA, 64 nt, hsa; identical to SEQ ID NO: 538513

SEQ ID NO: 723249 - RNA, 64 nt, hsa; identical to SEQ ID NO: 538514

SEQ ID NO: 723250 - RNA, 64 nt, hsa; identical to SEQ ID NO: 538515

SEQ ID NO: 723251 - RNA, 64 nt, hsa; identical to SEQ ID NO: 538516

SEQ ID NO: 723252 - RNA, 64 nt, hsa; identical to SEQ ID NO: 538517

SEQ ID NO: 723253 - RNA, 64 nt, hsa; identical to SEQ ID NO: 538518

SEQ ID NO: 723254 - RNA, 64 nt, hsa; identical to SEQ ID NO: 538519

SEQ ID NO: 723255 - RNA, 64 nt, hsa; identical to SEQ ID NO: 538520

SEQ ID NO: 723256 - RNA, 64 nt, hsa; identical to SEQ ID NO: 538521

SEQ ID NO: 723257 - RNA, 64 nt, hsa; identical to SEQ ID NO: 538522

SEQ ID NO: 723258 - RNA, 64 nt, hsa; identical to SEQ ID NO: 538523

SEQ ID NO: 723259 - RNA, 64 nt, hsa; identical to SEQ ID NO: 538524

SEQ ID NO: 723260 - RNA, 64 nt, hsa; identical to SEQ ID NO: 538525

SEQ ID NO: 723261 - RNA, 64 nt, hsa; identical to SEQ ID NO: 538526

SEQ ID NO: 723262 - RNA, 64 nt, hsa; identical to SEQ ID NO: 538527

SEQ ID NO: 723263 - RNA, 64 nt, hsa; identical to SEQ ID NO: 538528

SEQ ID NO: 723264 - RNA, 64 nt, hsa; identical to SEQ ID NO: 223145

SEQ ID NO: 723265 - RNA, 64 nt, hsa; identical to SEQ ID NO: 223146

SEQ ID NO: 723266 - RNA, 64 nt, hsa; identical to SEQ ID NO: 223147

SEQ ID NO: 723267 - RNA, 64 nt, hsa; identical to SEQ ID NO: 223148

SEQ ID NO: 723268 - RNA, 64 nt, hsa; identical to SEQ ID NO: 223149

SEQ ID NO: 723269 - RNA, 64 nt, hsa; identical to SEQ ID NO: 223150

SEQ ID NO: 723270 - RNA, 64 nt, hsa; identical to SEQ ID NO: 223151

SEQ ID NO: 723271 - RNA, 64 nt, hsa; identical to SEQ ID NO: 223152

SEQ ID NO: 723272 - RNA, 64 nt, hsa; identical to SEQ ID NO: 223153

SEQ ID NO: 723273 - RNA, 64 nt, hsa; identical to SEQ ID NO: 223154

SEQ ID NO: 723274 - RNA, 64 nt, hsa; identical to SEQ ID NO: 223155

SEQ ID NO: 723275 - RNA, 64 nt, hsa; identical to SEQ ID NO: 223156

SEQ ID NO: 723276 - RNA, 64 nt, hsa; identical to SEQ ID NO: 223157

SEQ ID NO: 723277 - RNA, 64 nt, hsa; identical to SEQ ID NO: 223158

SEQ ID NO: 723278 - RNA, 64 nt, hsa; identical to SEQ ID NO: 223159

SEQ ID NO: 723279 - RNA, 64 nt, hsa; identical to SEQ ID NO: 223160

SEQ ID NO: 723280 - RNA, 64 nt, hsa; identical to SEQ ID NO: 223161

SEQ ID NO: 723281 - RNA, 64 nt, hsa; identical to SEQ ID NO: 223162

SEQ ID NO: 723282 - RNA, 64 nt, hsa; identical to SEQ ID NO: 223163

SEQ ID NO: 723283 - RNA, 64 nt, hsa; identical to SEQ ID NO: 223164

SEQ ID NO: 723284 - RNA, 64 nt, hsa; identical to SEQ ID NO: 223165

SEQ ID NO: 723285 - RNA, 64 nt, hsa; identical to SEQ ID NO: 223166

SEQ ID NO: 723286 - RNA, 64 nt, hsa; identical to SEQ ID NO: 223167

SEQ ID NO: 723287 - RNA, 64 nt, hsa; identical to SEQ ID NO: 223168

SEQ ID NO: 723288 - RNA, 64 nt, hsa; identical to SEQ ID NO: 223169

SEQ ID NO: 723289 - RNA, 64 nt, hsa; identical to SEQ ID NO: 223170

SEQ ID NO: 723290 - RNA, 64 nt, hsa; identical to SEQ ID NO: 223171

SEQ ID NO: 723291 - RNA, 64 nt, hsa; identical to SEQ ID NO: 223172

SEQ ID NO: 723292 - RNA, 64 nt, hsa; identical to SEQ ID NO: 223173

SEQ ID NO: 723293 - RNA, 64 nt, hsa; identical to SEQ ID NO: 223174

SEQ ID NO: 723294 - RNA, 64 nt, hsa; identical to SEQ ID NO: 223175

SEQ ID NO: 723295 - RNA, 64 nt, hsa; identical to SEQ ID NO: 223176

SEQ ID NO: 723296 - RNA, 64 nt, hsa; identical to SEQ ID NO: 223177

SEQ ID NO: 723297 - RNA, 64 nt, hsa; identical to SEQ ID NO: 223178

SEQ ID NO: 723298 - RNA, 64 nt, hsa; identical to SEQ ID NO: 223179

SEQ ID NO: 723299 - RNA, 64 nt, hsa; identical to SEQ ID NO: 223180

SEQ ID NO: 723300 - RNA, 64 nt, hsa; identical to SEQ ID NO: 223181

SEQ ID NO: 723301 - RNA, 64 nt, hsa; identical to SEQ ID NO: 223182

SEQ ID NO: 723302 - RNA, 64 nt, hsa; identical to SEQ ID NO: 223183

SEQ ID NO: 723303 - RNA, 64 nt, hsa; identical to SEQ ID NO: 223184

SEQ ID NO: 723304 - RNA, 64 nt, hsa; identical to SEQ ID NO: 223185

SEQ ID NO: 723305 - RNA, 64 nt, hsa; identical to SEQ ID NO: 223186

SEQ ID NO: 723306 - RNA, 64 nt, hsa; identical to SEQ ID NO: 223187

SEQ ID NO: 723307 - RNA, 64 nt, hsa; identical to SEQ ID NO: 223188

SEQ ID NO: 723308 - RNA, 64 nt, hsa; identical to SEQ ID NO: 223189

SEQ ID NO: 723309 - RNA, 64 nt, hsa; identical to SEQ ID NO: 223190

SEQ ID NO: 723310 - RNA, 64 nt, hsa; identical to SEQ ID NO: 223191

SEQ ID NO: 723311 - RNA, 64 nt, hsa; identical to SEQ ID NO: 223192

SEQ ID NO: 723312 - RNA, 64 nt, hsa; identical to SEQ ID NO: 223193

SEQ ID NO: 723313 - RNA, 64 nt, hsa; identical to SEQ ID NO: 223194

SEQ ID NO: 723314 - RNA, 64 nt, hsa; identical to SEQ ID NO: 223195

SEQ ID NO: 723315 - RNA, 57 nt, hsa; identical to SEQ ID NO: 223196

SEQ ID NO: 723316 - RNA, 64 nt, hsa; identical to SEQ ID NO: 223197

SEQ ID NO: 723317 - RNA, 54 nt, hsa; identical to SEQ ID NO: 223198

SEQ ID NO: 723318 - RNA, 64 nt, hsa; identical to SEQ ID NO: 361536

SEQ ID NO: 723319 - RNA, 64 nt, hsa; identical to SEQ ID NO: 361537

SEQ ID NO: 723320 - RNA, 64 nt, hsa; identical to SEQ ID NO: 361538

SEQ ID NO: 723321 - RNA, 64 nt, hsa; identical to SEQ ID NO: 361539

SEQ ID NO: 723322 - RNA, 64 nt, hsa; identical to SEQ ID NO: 361540

SEQ ID NO: 723323 - RNA, 64 nt, hsa; identical to SEQ ID NO: 361541

SEQ ID NO: 723324 - RNA, 64 nt, hsa; identical to SEQ ID NO: 361542

SEQ ID NO: 723325 - RNA, 64 nt, hsa; identical to SEQ ID NO: 361543

SEQ ID NO: 723326 - RNA, 64 nt, hsa; identical to SEQ ID NO: 361544

SEQ ID NO: 723327 - RNA, 64 nt, hsa; identical to SEQ ID NO: 361545

SEQ ID NO: 723328 - RNA, 64 nt, hsa; identical to SEQ ID NO: 361546

SEQ ID NO: 723329 - RNA, 64 nt, hsa; identical to SEQ ID NO: 361547

SEQ ID NO: 723330 - RNA, 64 nt, hsa; identical to SEQ ID NO: 361548

SEQ ID NO: 723331 - RNA, 64 nt, hsa; identical to SEQ ID NO: 361549

SEQ ID NO: 723332 - RNA, 64 nt, hsa; identical to SEQ ID NO: 361550

SEQ ID NO: 723333 - RNA, 64 nt, hsa; identical to SEQ ID NO: 361551

SEQ ID NO: 723334 - RNA, 64 nt, hsa; identical to SEQ ID NO: 361552

SEQ ID NO: 723335 - RNA, 64 nt, hsa; identical to SEQ ID NO: 361553

SEQ ID NO: 723336 - RNA, 64 nt, hsa; identical to SEQ ID NO: 361554

SEQ ID NO: 723337 - RNA, 64 nt, hsa; identical to SEQ ID NO: 361555

SEQ ID NO: 723338 - RNA, 64 nt, hsa; identical to SEQ ID NO: 361556

SEQ ID NO: 723339 - RNA, 64 nt, hsa
gccuuugugcuuugucaucccaugccagaaggcagaaggguaagagagggcaagagugagcaag

SEQ ID NO: 723340 - RNA, 64 nt, hsa
caucuguaaaaugggaagaguuauguuuauuuuugaaggguauuaggauaauuaaaaauaaugu

SEQ ID NO: 723341 - RNA, 64 nt, hsa
uccaucacaacaagaaauuucccaugccugcucagaaggguagccccuagcucucugugaaugu

SEQ ID NO: 723342 - RNA, 64 nt, hsa
uaggggaagccuggagccaaagaugacacaaggggaaggguacugaaaacaccauccauuuggg

SEQ ID NO: 723343 - RNA, 64 nt, hsa
auuuucuuuccucuggcugaucccagcccuaaaggaaggguagacccgugucuuuccagcccua

SEQ ID NO: 723344 - RNA, 64 nt, hsa
ggaaggguagacccgugucuuuccagcccuaaaggaaggguagacccgugucuuuccagcccua

SEQ ID NO: 723345 - RNA, 64 nt, hsa
uucucagguguuucuagacccccgacuccgcaagagugaggaugaugggagcuggucaugggag

SEQ ID NO: 723346 - RNA, 64 nt, hsa
uaucuuuaacugacuucuguccacucuggagagcagugaggaauuaaucuugcuuuugcuuguc

SEQ ID NO: 723347 - RNA, 64 nt, hsa
ccauuuucaagcuggaagaagugagcaguguuggagugaggaccuguaaggcaggcccauucag

SEQ ID NO: 723348 - RNA, 64 nt, hsa
gacauagucucugcccucauagaguugauugucuagugaggaagacaagcauuuuuaaaaaaua

SEQ ID NO: 723349 - RNA, 64 nt, hsa
ugcagccucugcccggccgccaccccgucugggaagugaggagcgucucugccuggcugcccau

SEQ ID NO: 723350 - RNA, 64 nt, hsa
gagcagccccucugccuggcugcccagucuggaaagugaggagcgucucugcccggccgccauc

SEQ ID NO: 723351 - RNA, 64 nt, hsa
gagcgucucugcccggccgccaucccaucuaggaagugaggagcgccucuucccacccgccauc

SEQ ID NO: 723352 - RNA, 64 nt, hsa
gagcgccucuucccacccgccaucccaucuaggaagugaggagcuucucugccuggccgcccau

SEQ ID NO: 723353 - RNA, 64 nt, hsa
gaggagcaacucugcccagccgccccgucugagaagugaggagacccuccgccuggcaaccgcc

SEQ ID NO: 723354 - RNA, 64 nt, hsa
gagccccucugcccagcagccgccccgucugagaagugaggagccccucugcccagcagccacc

SEQ ID NO: 723355 - RNA, 64 nt, hsa
gagccccucugcccagcagccacccugucugggaagugaggagcgucuccgcccggcagccacc

SEQ ID NO: 723356 - RNA, 64 nt, hsa
gaggggcgccucugcccagcugccccuacugggaagugaggagccccucugccccgccagccac

SEQ ID NO: 723357 - RNA, 64 nt, hsa
gaggggcgccucugcccggcugccccuacugggaagugaggagccccucugcccggccagccgc

SEQ ID NO: 723358 - RNA, 64 nt, hsa
uaggggcgccucugcccggccgccccuacugggaagugaggagccccucugcccggccaccacc

SEQ ID NO: 723359 - RNA, 64 nt, hsa
gccuccgccgacucccuccuuccgggccugcucuagugaggagugccuaagccaggacccagaa

SEQ ID NO: 723360 - RNA, 64 nt, hsa
aggcagggcagggacagccaccuuggaaggccgcagugaggagcugucuggaccaguggggcac

SEQ ID NO: 723361 - RNA, 64 nt, hsa
cgagcccaucagcaggucaacccuaugcugggaaagugaggauuugggauuucugugcuauaaa

SEQ ID NO: 723362 - RNA, 64 nt, hsa
uucuucaaguuagcuaaaaaugagaugcguaugaagugaggaggcuggauccaagucuugauug

SEQ ID NO: 723363 - RNA, 64 nt, hsa
cuucaaaacagaugcagacauguguguugguaguagugaggagauugguauuagcaucaagucu

SEQ ID NO: 723364 - RNA, 64 nt, hsa
gugcacaugucaaguacuuagcuaaaaucaacaaagugaggacugugaagauaacuuucaugua

SEQ ID NO: 723365 - RNA, 64 nt, hsa
gaaauagguuguuggguuuugagcaggcuguuauagugaggaauguucauuuuuaaauguuccu

SEQ ID NO: 723366 - RNA, 64 nt, hsa
ugaggggaccgagcccuguuacauggaugugaacagugaggaucagagguuuuaucagaacaca

SEQ ID NO: 723367 - RNA, 64 nt, hsa
ccuuaaugcuaaguguagauuauugagguuuguuagugaggaaaagaauaagaguucagaagcc

SEQ ID NO: 723368 - RNA, 64 nt, hsa
aagccuuuguuaucagauagcgaaaucagggccuagugaggagcacaggucgacuacauaaugg

SEQ ID NO: 723369 - RNA, 64 nt, hsa
ccugggcuuuacgagaccaugcaagacggggguuagugaggaaggaggauuuggggugggggug

SEQ ID NO: 723370 - RNA, 64 nt, hsa
aacccucuucauggaccagacucugcacccggugagugaggacagucccagcugagucccaucg

SEQ ID NO: 723371 - RNA, 64 nt, hsa
ggggacagacuuuuaaaaugcccuugugucucccagugaggagcccuaagcauugacuucucua

SEQ ID NO: 723372 - RNA, 64 nt, hsa
aguuaagcugaagaguuuacugaagcaaauuaauagugaggaagccuauuugaacuacuuaaac

SEQ ID NO: 723373 - RNA, 64 nt, hsa
aauggaguuuuagaggaaaagucaacaucuaacuagugaggaaaagugccuaauacaauuagaa

SEQ ID NO: 723374 - RNA, 64 nt, hsa
acuugaaggcaaaggaaacuaaggaaggagguucagugaggaaaauaagguuguccaugagauu

SEQ ID NO: 723375 - RNA, 64 nt, hsa
uauguaaggggugagacacaacagucugacuaugagugaggaaaauaucugggucuuuucguca

SEQ ID NO: 723376 - RNA, 64 nt, hsa
uucagcuuucuaaaaggcauauauuuuucaaagaagugaggaugcaguuucucacguugcaacc

SEQ ID NO: 723377 - RNA, 64 nt, hsa
guaacccggccccucuggcccuucccucaagcccagugaggagguggguggaggcaugcagggg

SEQ ID NO: 723378 - RNA, 64 nt, hsa
ugugggcagagaagggcaucugggacguggugccagugaggagcccaguuggcuggcacugggc

SEQ ID NO: 723379 - RNA, 64 nt, hsa
ccgaggcaguggugcuggcccaagugaaggccagagugaggacugaugcagcucuuuacggguc

SEQ ID NO: 723380 - RNA, 64 nt, hsa
acagaaagauuaaguuaccggcccaaggugacacagugaggagguggcagagcuaggauuugaa

SEQ ID NO: 723381 - RNA, 64 nt, hsa
ugcagccucugcccggccgccaccccgucuggaaagugaggagcgccucugcccggccgccauc

SEQ ID NO: 723382 - RNA, 64 nt, hsa
gagcgccucugcccggccgccaucccaucuaggaagugaggagcgccucuucccagccgccauc

SEQ ID NO: 723383 - RNA, 64 nt, hsa
gagcgccucuucccagccgccaucccaucuaggaagugaggagcgucucugcccggccgcccau

SEQ ID NO: 723384 - RNA, 64 nt, hsa
gaggagcgucucugucuggccaccccgucugagaagugaggagaccuccgcccggcagccgccc

SEQ ID NO: 723385 - RNA, 64 nt, hsa
ggagaccuccgcccggcagccgcccugucugagaagugaggagccccuccgcccggcagccacc

SEQ ID NO: 723386 - RNA, 64 nt, hsa
gagccccuccgcccggcagccaccccaucugggaagugaggagcgucuacgcccgggcagcugc

SEQ ID NO: 723387 - RNA, 64 nt, hsa
cccggccgccccugcccggccgccccuacugggaagugaggagccccucugccuggccaccacc

SEQ ID NO: 723388 - RNA, 64 nt, hsa
ggggaagaucugcagcuagcauaguuucaugcucagugaggaugauggucaccguguuuguugu

SEQ ID NO: 723389 - RNA, 64 nt, hsa
gcagcagccuccugaccaaugcccgcucuuggggagugaggauucugcacguggaugguacccu

SEQ ID NO: 723390 - RNA, 64 nt, hsa
aauauuggcaaaggcaucucaggaacaucaccuuagugaggaaacaaaauguucugcuagcuug

SEQ ID NO: 723391 - RNA, 64 nt, hsa
caagaaauuagaguccucagaagagaacuuaucuagugaggaugaagagcuucccugcuuccaa

SEQ ID NO: 723392 - RNA, 64 nt, hsa
ggacacagcccagagacagagaagcuuaugaggaagugaggagguggcgucacaagggugggga

SEQ ID NO: 723393 - RNA, 64 nt, hsa
gggcaggacggcaccugguaugcgggaggaacagagugaggagaggagggcagggcgugcaggg

SEQ ID NO: 723394 - RNA, 64 nt, hsa
gugaaucaggacugaaugugaaagggaaguauugagugaggacauucccaaaaccaaaggacaa

SEQ ID NO: 723395 - RNA, 64 nt, hsa
acugcccagcacauaaugaauaaauaagaaaaugagugaggaguuauuaacaucauuuggaaaa

SEQ ID NO: 723396 - RNA, 64 nt, hsa
caaacccugaagacaccccugccccccuccagagagugaggagggggccugagacuggaccugg

SEQ ID NO: 723397 - RNA, 64 nt, hsa
ugaccgccaggaugcuucugccauccagggguguagugaggacccacggggagccugggccccu

SEQ ID NO: 723398 - RNA, 64 nt, hsa
guguagugaggaggagcccagaggaccccaggggagugaggagggagaacuuggaagggugcag

SEQ ID NO: 723399 - RNA, 64 nt, hsa
agccacacgcaccagcucuauuugggggaaguguagugaggaggagcccagaggaccccagggg

SEQ ID NO: 723400 - RNA, 59 nt, hsa; identical to SEQ ID NO: 627537

SEQ ID NO: 723401 - RNA, 64 nt, hsa
ucuuccuccagcuccagccaccaccaggcugagcagugaggagagaaaguuucugccuggcccu

SEQ ID NO: 723402 - RNA, 64 nt, hsa
guaaacugccaguugcaaauuugauaggauaguuagugaggauuauuaaccucugagcagugau

SEQ ID NO: 723403 - RNA, 64 nt, hsa
gguuuaagugguguuagcuuugagggcaaggcaaagugaggaagggcuggugcagggaaagcaa

SEQ ID NO: 723404 - RNA, 64 nt, hsa
guucagugaggaaaaaacauucagacaaauguucagugaggaaaaaaaggggaaguuggggaua

SEQ ID NO: 723405 - RNA, 64 nt, hsa
acaaauguucagugugagugaggaaaacauguucagugaggaaaaaacauucagacaaauguuc

SEQ ID NO: 723406 - RNA, 64 nt, hsa
aagcagccacaguuucagacaaauguucagugugagugaggaaaacauguucagugaggaaaaa

SEQ ID NO: 723407 - RNA, 64 nt, hsa
gcucaaugaucuacauucugaaguugucugaaaaugucuucaugauuaaauucagccuaaacuu

SEQ ID NO: 723408 - RNA, 64 nt, hsa
acccugguuucaaugaaccuaaccucauucuuugugucuucaguguuggcuuguuuuagcugau

SEQ ID NO: 723409 - RNA, 64 nt, hsa
aguauuaauuuugaguuccauuuuauaauucugaugucuucauuagaaauacaaaaauacaauc

SEQ ID NO: 723410 - RNA, 64 nt, hsa
uguuacaaaaccaaguacuuaaucuuuuacaucaugucuucagcuauuuguauuuuaaccagua

SEQ ID NO: 723411 - RNA, 64 nt, hsa
gacuaacauuuaauuuguuuacaaaaauguuuauugucuucaguacaaaaaguuaaaaccauga

SEQ ID NO: 723412 - RNA, 64 nt, hsa
ggcuaauauauuuagacaggauuuccaaaaacuuugucuucaaauuuuaauuuucuuccuaaua

SEQ ID NO: 723413 - RNA, 64 nt, hsa
aaaaguuugaauagcuauuauuaaagaaaagccaugucuucaacaucugagucaccaagaagua

SEQ ID NO: 723414 - RNA, 64 nt, hsa
ucacuguaugccuguacuugggcugcacugagcuugucuucaggaaaccagagcguugcuuuau

SEQ ID NO: 723415 - RNA, 64 nt, hsa
uuuaaaaaaaaaaaaaaaggauccauuguaccguugucuucaucacugggaaaugauuauuaca

SEQ ID NO: 723416 - RNA, 64 nt, hsa
uccaggauacauaaauucaauggaucaauuuauuugucuucaaauggccuuaacuuggauuguc

SEQ ID NO: 723417 - RNA, 64 nt, hsa
ugugaagcauaagacacugaggcuaauacaacucugucuucauguguugacugccuggcacaua

SEQ ID NO: 723418 - RNA, 64 nt, hsa
ggaauuaagcaaaaguaguuuuugucuuuucuguugucuucaaauuuuaugccuuuuauuuuua

SEQ ID NO: 723419 - RNA, 64 nt, hsa
aaugcugacucaccuccucucggaggaggcguccugucuucacgggggggucccgguggccucc

SEQ ID NO: 723420 - RNA, 64 nt, hsa
gcaguguguucagauugccccuggggaucuucugugucuucagcgcccagcccugcguguuccu

SEQ ID NO: 723421 - RNA, 64 nt, hsa
cgugauuugaggaguuaaaaccaaaugcaauuuaugucuucauaaaauuuugauuagugaaacu

SEQ ID NO: 723422 - RNA, 64 nt, hsa
cugugccucagcuggacauuggaaccuuggagaaugucuucacagccccgacaucaacuccuuc

SEQ ID NO: 723423 - RNA, 64 nt, hsa
ccucacuugauuuuuuuaaccuucuuuuugcaaaugucuucagggaacugagcuaauacuuuuu

SEQ ID NO: 723424 - RNA, 64 nt, hsa
uugucugucacucacuacaugaauaagcaaauauugucuucaaaagaaugcacaagaaccacaa

SEQ ID NO: 723425 - RNA, 64 nt, hsa
gcaccuucaguuuauccucaaagccugcguuguuugucuucaucuaauccagcuuugauggaca

SEQ ID NO: 723426 - RNA, 64 nt, hsa
gcauuucaguagccaaagaggacaggaacaagucugucuucaugaggguauguccagauuaagu

SEQ ID NO: 723427 - RNA, 64 nt, hsa
gaaaucuguauaguacacugguuuguaaucauuaugucuucauugaaauccuugcuacuucucu

SEQ ID NO: 723428 - RNA, 64 nt, hsa
caugcauugguaacuugaaaauagaccagcuuaaugucuucaggauguaaaacucugaauacac

SEQ ID NO: 723429 - RNA, 64 nt, hsa
gcgguaucccuccacccaaguauggccaccuguuugucuucauauagaacaggggcuucugguc

SEQ ID NO: 723430 - RNA, 64 nt, hsa
ucugcagguucugggccuggcaaaggaguaucagugucuucaagcaccacuggucuaccugaua

SEQ ID NO: 723431 - RNA, 64 nt, hsa
aaacuucccaacagcagggcuuuggccaagcccuugucuucacaaauucgcaacacaacaauca

SEQ ID NO: 723432 - RNA, 64 nt, hsa
uggauucagaaaaauuaacuuucugaauuugaucugucuucagucuugugaaaaaguugaacaa

SEQ ID NO: 723433 - RNA, 64 nt, hsa
auuaaguaacauaauuuuuaaaauuuaaagaaugugucuucaacuaaaaacuuuauucuuuagc

SEQ ID NO: 723434 - RNA, 64 nt, hsa
ugauguugucaaguuucuagcuucauaaugauccugucuucaucauaucauauucacuuugaga

SEQ ID NO: 723435 - RNA, 64 nt, hsa
gaagucuuccccaaaaauauauguauauauuguaugucuucauccuugguagcggcuggcccau

SEQ ID NO: 723436 - RNA, 64 nt, hsa
aacggugugaaauagaagccaacuucuaguaugcugucuucaucucugcaauaaacuaaacgua

SEQ ID NO: 723437 - RNA, 64 nt, hsa
uuacagaagaggaguuuuauagucugaugguaaaugucuucauuuuaccuuuuuaauugaaaug

SEQ ID NO: 723438 - RNA, 64 nt, hsa
ggguccauaaacaauaucugccaacucaaccuguugucuucaaaugcuaaaaaaggagaaugga

SEQ ID NO: 723439 - RNA, 64 nt, hsa
gugaaagcucuguguucuuuugccuucaaucuguugucuucaaaacaaacaaacaaaaaaagcu

SEQ ID NO: 723440 - RNA, 64 nt, hsa
agaauucacuaacagacagaccaucuggaggagcugucuucaaaugcugugcuuacaccuuauc

SEQ ID NO: 723441 - RNA, 64 nt, hsa
agcuguccaguucaggccucuccucuuucccuggugucuucauuuuccuccgucucccugcugu

SEQ ID NO: 723442 - RNA, 64 nt, hsa
guuuccaggugucuucauuguaguggguauuaauugucuucagccucuugauauccauaccuuc

SEQ ID NO: 723443 - RNA, 64 nt, hsa
gcucacauugccucucaagagacagguuuccaggugucuucauuguaguggguauuaauugucu

SEQ ID NO: 723444 - RNA, 64 nt, hsa
guucuuacaccaguauuugguucaagacaccaaaugucuucagcccauggcugaagaacaacag

SEQ ID NO: 723445 - RNA, 64 nt, hsa
gaguuguaucaccuuuuuuguuugucuuuuauaaugucuucagucugagugugcaaagucaauu

SEQ ID NO: 723446 - RNA, 64 nt, hsa
ccaggccccaaugcaguuauuuuuagaugagcagugucuucauucgaaggggacacuaacugug

SEQ ID NO: 723447 - RNA, 64 nt, hsa
uaaugucuccuugugauauuugucauacuaugaaugucuucauuagucauuuaaaaugcacugu

SEQ ID NO: 723448 - RNA, 64 nt, hsa
uagcugccuugucccuggugagggcaagggucacugucuucacagaaaaaguuugcugacuugu

SEQ ID NO: 723449 - RNA, 64 nt, hsa
aaauauuuugaucagauggacucaugaucacagaugucuucacaugccuaugacuaauuuguac

SEQ ID NO: 723450 - RNA, 64 nt, hsa
uuccuugagcuaagcagaauaauggaauauaauaugucuucauaauauaacaacacuaauacac

SEQ ID NO: 723451 - RNA, 64 nt, hsa
ggaagagugaccuggcaucuuggaaaucauugugugucuucaggagaaugugcagugucuugua

SEQ ID NO: 723452 - RNA, 64 nt, hsa
cacguggcccacucccggcccaggcugcuuuccgugucuucaguucuguccaagccaucagcuc

SEQ ID NO: 723453 - RNA, 64 nt, hsa
guguguguguguguguguguauuuuuuuuuugguugucuucagcugacaguaugaaaaaugaaa

SEQ ID NO: 723454 - RNA, 64 nt, hsa
ggaagucuaugguuggucugaguaaguaacuuccugucuucaugaaaaaaguugacuuugaauc

SEQ ID NO: 723455 - RNA, 64 nt, hsa
ucucagaaaacaggccacgguguuucauacagaaugucuucauaucaucugaaaugguauggcu

SEQ ID NO: 723456 - RNA, 64 nt, hsa
auggcugaaguucauuuguuuacagggucgggaaugucuucaguucuugagagucaacaguaau

SEQ ID NO: 723457 - RNA, 64 nt, hsa
agacacacuguguuagguagaaaaaugcuacagaugucuucaucccuguauauguguccuucuu

SEQ ID NO: 723458 - RNA, 64 nt, hsa
cuuuguguuucaguuaggauaauuucuauugaucugucuucaaauucacugauguuuuuucucu

SEQ ID NO: 723459 - RNA, 64 nt, hsa
gggaaacauuuucagggaaaagacauguaucacaugucuucagaagcaagucagguuucaugua

SEQ ID NO: 723460 - RNA, 64 nt, hsa
agucgagcagcacccaccuccaaccucgggccagugucuucaggcuuuacuggggaccugcgag

SEQ ID NO: 723461 - RNA, 64 nt, hsa; identical to SEQ ID NO: 147594

SEQ ID NO: 723462 - RNA, 64 nt, hsa; identical to SEQ ID NO: 147595

SEQ ID NO: 723463 - RNA, 64 nt, hsa; identical to SEQ ID NO: 147767

SEQ ID NO: 723464 - RNA, 64 nt, hsa; identical to SEQ ID NO: 147768

SEQ ID NO: 723465 - RNA, 64 nt, hsa; identical to SEQ ID NO: 175075

SEQ ID NO: 723466 - RNA, 64 nt, hsa; identical to SEQ ID NO: 175076

SEQ ID NO: 723467 - RNA, 64 nt, hsa; identical to SEQ ID NO: 175077

SEQ ID NO: 723468 - RNA, 64 nt, hsa; identical to SEQ ID NO: 175078

SEQ ID NO: 723469 - RNA, 64 nt, hsa; identical to SEQ ID NO: 175079

SEQ ID NO: 723470 - RNA, 64 nt, hsa; identical to SEQ ID NO: 175080

SEQ ID NO: 723471 - RNA, 64 nt, hsa; identical to SEQ ID NO: 175081

SEQ ID NO: 723472 - RNA, 64 nt, hsa; identical to SEQ ID NO: 175082

SEQ ID NO: 723473 - RNA, 64 nt, hsa; identical to SEQ ID NO: 175083

SEQ ID NO: 723474 - RNA, 64 nt, hsa; identical to SEQ ID NO: 175084

SEQ ID NO: 723475 - RNA, 64 nt, hsa; identical to SEQ ID NO: 199877

SEQ ID NO: 723476 - RNA, 64 nt, hsa; identical to SEQ ID NO: 199878

SEQ ID NO: 723477 - RNA, 64 nt, hsa; identical to SEQ ID NO: 199879

SEQ ID NO: 723478 - RNA, 64 nt, hsa; identical to SEQ ID NO: 199880

SEQ ID NO: 723479 - RNA, 64 nt, hsa; identical to SEQ ID NO: 199881

SEQ ID NO: 723480 - RNA, 64 nt, hsa; identical to SEQ ID NO: 199882

SEQ ID NO: 723481 - RNA, 64 nt, hsa; identical to SEQ ID NO: 199883

SEQ ID NO: 723482 - RNA, 64 nt, hsa; identical to SEQ ID NO: 199884

SEQ ID NO: 723483 - RNA, 64 nt, hsa; identical to SEQ ID NO: 199885

SEQ ID NO: 723484 - RNA, 64 nt, hsa; identical to SEQ ID NO: 199886

SEQ ID NO: 723485 - RNA, 64 nt, hsa; identical to SEQ ID NO: 199887

SEQ ID NO: 723486 - RNA, 64 nt, hsa; identical to SEQ ID NO: 199888

SEQ ID NO: 723487 - RNA, 64 nt, hsa; identical to SEQ ID NO: 199889

SEQ ID NO: 723488 - RNA, 64 nt, hsa; identical to SEQ ID NO: 199890

SEQ ID NO: 723489 - RNA, 64 nt, hsa; identical to SEQ ID NO: 199891

SEQ ID NO: 723490 - RNA, 64 nt, hsa; identical to SEQ ID NO: 199892

SEQ ID NO: 723491 - RNA, 64 nt, hsa; identical to SEQ ID NO: 199893

SEQ ID NO: 723492 - RNA, 64 nt, hsa; identical to SEQ ID NO: 199894

SEQ ID NO: 723493 - RNA, 64 nt, hsa; identical to SEQ ID NO: 199895

SEQ ID NO: 723494 - RNA, 64 nt, hsa; identical to SEQ ID NO: 199896

SEQ ID NO: 723495 - RNA, 64 nt, hsa; identical to SEQ ID NO: 199897

SEQ ID NO: 723496 - RNA, 64 nt, hsa; identical to SEQ ID NO: 391203

SEQ ID NO: 723497 - RNA, 64 nt, hsa; identical to SEQ ID NO: 391204

SEQ ID NO: 723498 - RNA, 64 nt, hsa; identical to SEQ ID NO: 391205

SEQ ID NO: 723499 - RNA, 64 nt, hsa; identical to SEQ ID NO: 391206

SEQ ID NO: 723500 - RNA, 64 nt, hsa; identical to SEQ ID NO: 391207

SEQ ID NO: 723501 - RNA, 64 nt, hsa; identical to SEQ ID NO: 391208

SEQ ID NO: 723502 - RNA, 64 nt, hsa; identical to SEQ ID NO: 391209

SEQ ID NO: 723503 - RNA, 64 nt, hsa; identical to SEQ ID NO: 391210

SEQ ID NO: 723504 - RNA, 64 nt, hsa; identical to SEQ ID NO: 391211

SEQ ID NO: 723505 - RNA, 64 nt, hsa; identical to SEQ ID NO: 391212

SEQ ID NO: 723506 - RNA, 64 nt, hsa; identical to SEQ ID NO: 391213

SEQ ID NO: 723507 - RNA, 64 nt, hsa; identical to SEQ ID NO: 391214

SEQ ID NO: 723508 - RNA, 64 nt, hsa; identical to SEQ ID NO: 391215

SEQ ID NO: 723509 - RNA, 64 nt, hsa; identical to SEQ ID NO: 391216

SEQ ID NO: 723510 - RNA, 64 nt, hsa; identical to SEQ ID NO: 391217

SEQ ID NO: 723511 - RNA, 64 nt, hsa; identical to SEQ ID NO: 391218

SEQ ID NO: 723512 - RNA, 64 nt, hsa; identical to SEQ ID NO: 391219

SEQ ID NO: 723513 - RNA, 64 nt, hsa; identical to SEQ ID NO: 391220

SEQ ID NO: 723514 - RNA, 64 nt, hsa; identical to SEQ ID NO: 391221

SEQ ID NO: 723515 - RNA, 64 nt, hsa; identical to SEQ ID NO: 391222

SEQ ID NO: 723516 - RNA, 64 nt, hsa; identical to SEQ ID NO: 391223

SEQ ID NO: 723517 - RNA, 64 nt, hsa; identical to SEQ ID NO: 391224

SEQ ID NO: 723518 - RNA, 64 nt, hsa; identical to SEQ ID NO: 391225

SEQ ID NO: 723519 - RNA, 64 nt, hsa; identical to SEQ ID NO: 391226

SEQ ID NO: 723520 - RNA, 64 nt, hsa; identical to SEQ ID NO: 391227

SEQ ID NO: 723521 - RNA, 64 nt, hsa; identical to SEQ ID NO: 391228

SEQ ID NO: 723522 - RNA, 64 nt, hsa; identical to SEQ ID NO: 391229

SEQ ID NO: 723523 - RNA, 64 nt, hsa; identical to SEQ ID NO: 391230

SEQ ID NO: 723524 - RNA, 64 nt, hsa; identical to SEQ ID NO: 391231

SEQ ID NO: 723525 - RNA, 64 nt, hsa; identical to SEQ ID NO: 391232

SEQ ID NO: 723526 - RNA, 64 nt, hsa; identical to SEQ ID NO: 391233

SEQ ID NO: 723527 - RNA, 64 nt, hsa; identical to SEQ ID NO: 391234

SEQ ID NO: 723528 - RNA, 64 nt, hsa; identical to SEQ ID NO: 391235

SEQ ID NO: 723529 - RNA, 64 nt, hsa; identical to SEQ ID NO: 391236

SEQ ID NO: 723530 - RNA, 64 nt, hsa
auuuccuuccaguggaaagaaaggaggaagggagaauugagaaaauauauuagucuauuauuuu

SEQ ID NO: 723531 - RNA, 64 nt, hsa
uuuagaguucuaauacacucuaaauuaaagagaaaauugagaguaaaugacugucuuaucacuc

SEQ ID NO: 723532 - RNA, 64 nt, hsa
guuuauagauauguaaaauguggauuauguugcaaauugagauuaaaauuauuugggguuuugu

SEQ ID NO: 723533 - RNA, 64 nt, hsa
caaugugagacucuuaggaaacuaacuagaucucaauugagagcacauaacaauagaugauacc

SEQ ID NO: 723534 - RNA, 64 nt, hsa
ucugaauuuucaaagcauaaaaaugucaaagaaaaauugagauaaacauuuuguucaccauuaa

SEQ ID NO: 723535 - RNA, 64 nt, hsa
agaaauaugauaauauaaaaccaucaaauuuuauaauugagaugauacucuggaaaaacauguc

SEQ ID NO: 723536 - RNA, 64 nt, hsa
uccuaaccauucuuuaccguuucugaucacacagaauugagaaagaucucuuaggccacuaguu

SEQ ID NO: 723537 - RNA, 64 nt, hsa
gcaagcaguuuaaagauaagacuugagauuuuugaauugagaauuucaugggaauauucaguca

SEQ ID NO: 723538 - RNA, 64 nt, hsa
gggcacagcgugcuuaggcccaagcuuagaauucaauugagaaguucuguuguucauccuuacc

SEQ ID NO: 723539 - RNA, 64 nt, hsa
uaugaacuuuagucuaaagaauugagacuaccguaauugagacuacuguagugacaucugagaa

SEQ ID NO: 723540 - RNA, 64 nt, hsa
auaaguuggaugaccuaugaacuuuagucuaaagaauugagacuaccguaauugagacuacugu

SEQ ID NO: 723541 - RNA, 64 nt, hsa
gugacuauugagcccuggaaauguagcuuguccaaauugagaugugcugucaguauaaaauaca

SEQ ID NO: 723542 - RNA, 64 nt, hsa
caauggaaggaugcaggccaaccucuuugauuacaauugagauucaugugacuauugagcccug

SEQ ID NO: 723543 - RNA, 64 nt, hsa
gagcaaaauaauugagaaaaauaaauaacaagauaauugagaaaaaaauaaaauaaauucccaa

SEQ ID NO: 723544 - RNA, 64 nt, hsa
acuggccaaacuugagccaaucugagagcaaaauaauugagaaaaauaaauaacaagauaauug

SEQ ID NO: 723545 - RNA, 64 nt, hsa
aucggccugccaugggucaucagacugcuuccuaaauugagagaaacugagcaaucucucagcc

SEQ ID NO: 723546 - RNA, 64 nt, hsa
gggcugccaggugugcagggccaauccugacgguaauugagaaugagugagguuucguacaugc

SEQ ID NO: 723547 - RNA, 64 nt, hsa
uaugcucuuaacacacugugcauuguuuuucuaaaauugagaaauaucugaaauacagaauacg

SEQ ID NO: 723548 - RNA, 64 nt, hsa
gcugaacaugugguuagucuuuuauuuuaagaagaauugagaauugauagauuuggagaugagc

SEQ ID NO: 723549 - RNA, 64 nt, hsa
ccacaaaauaacauuuuauaaauccucaaaguaaaauugagaaaucuuuaaguuuuuuucaagu

SEQ ID NO: 723550 - RNA, 64 nt, hsa
gccuccaucccucuuacucauuuguagucuaggaaauugagauuuugauacaccuaaggucacg

SEQ ID NO: 723551 - RNA, 64 nt, hsa
cgcccccuggcuccaggcuaauuuuucuggaaugaauugagaagguggcgugcuggccugagcu

SEQ ID NO: 723552 - RNA, 64 nt, hsa
gagauuccugccccucuuuugucacagauuaggaaauugagaacuaggguuaaccuugacuaua

SEQ ID NO: 723553 - RNA, 64 nt, hsa
gcagccgggggccgguggccagagcgagggcaccagccacgaaggacggaggcgggcggggccc

SEQ ID NO: 723554 - RNA, 64 nt, hsa
aggccacgggccacgggaagaaccaagcggugccagccacgagacgucaccaagaaaacaugca

SEQ ID NO: 723555 - RNA, 64 nt, hsa
uuuugaggugcaauguuuaauuguuaaaaauaguagccacgacuuuaucaggcagccccaaacu

SEQ ID NO: 723556 - RNA, 64 nt, hsa
ugccaagggugcuggugcggauggacacuaaugcagccacgauuggagaauacuuugcuucaua

SEQ ID NO: 723557 - RNA, 64 nt, hsa
uggacccacagccuaagcugagugugaccccagaagccacgaugugcucuguauccagaacaca

SEQ ID NO: 723558 - RNA, 64 nt, hsa
agugagcuuggugcgguaggugcuggccucaaacagccacgaggugguagcucugagcccuccu

SEQ ID NO: 723559 - RNA, 64 nt, hsa
uuguuuuuuggugcuaauaugacauaugacaauaagccacgaggugcaguaaguacccgacuaa

SEQ ID NO: 723560 - RNA, 64 nt, hsa
ugucugcugggcuacaaaccaggagcaaccgugcagccacgaacacgcaugccucagccagccc

SEQ ID NO: 723561 - RNA, 64 nt, hsa
ggccuguggugccaucuccccaugguucauguggagccacgaacauccuuucccugcaguccau

SEQ ID NO: 723562 - RNA, 64 nt, hsa
agcccucgguaaguauguuuagaaauagaacauuagccacgagccauaggcauuucaggccaaa

SEQ ID NO: 723563 - RNA, 64 nt, hsa
cuuaauccuuaacaagacagcacuccagauaggcagccacgaccccaaaggugaggauaauguu

SEQ ID NO: 723564 - RNA, 64 nt, hsa
aggaugccagccccugccuggguugggggcacucagccacgaccagccccuuccuggguauuua

SEQ ID NO: 723565 - RNA, 64 nt, hsa
aguuauucuaugagaacacugcaucugcauucauagccacgaguuuguuauugcuacaggcuac

SEQ ID NO: 723566 - RNA, 64 nt, hsa
guucucagugauguauaugcaacauuuuguugaaagccacgauggacuuacaagcuuuaaugga

SEQ ID NO: 723567 - RNA, 64 nt, hsa
ccaugagcuuccuuuauuucuggcucacagaggcagccacgaggcacuacaccaaguauuauau

SEQ ID NO: 723568 - RNA, 64 nt, hsa
caauuaaauaacugagaccuaagucugggaacagagccacgaaucugccuuugagaugcuggca

SEQ ID NO: 723569 - RNA, 64 nt, hsa
aaagauuccagcacugagccgugggccggucaugagccacgauaaaaaaugccaguuuggcaaa

SEQ ID NO: 723570 - RNA, 64 nt, hsa
cugugccaccagggagugccuauacauccuguccagccacgacauugagcagcacgcccccuau

SEQ ID NO: 723571 - RNA, 64 nt, hsa
gcaauaccuccuccuguguuguauuacacauauuagccacgaguuuuugcagugaccagauaaa

SEQ ID NO: 723572 - RNA, 64 nt, hsa
guccaggguggagcgcgccagccucagccagagcagccacgacagccacagugugugcacucga

SEQ ID NO: 723573 - RNA, 64 nt, hsa
gaugagacaagagguagaggggagagguagagguagccacgagcugauaauuacagacaagaga

SEQ ID NO: 723574 - RNA, 64 nt, hsa
gcaggguggaccccaguuuggaagcugagcccccagccacgaacauggaucugaggaggggccc

SEQ ID NO: 723575 - RNA, 64 nt, hsa
agcagugguggcuggcgcgcuuucgcacuguggcagccacgagagucugugcacgucugugcug

SEQ ID NO: 723576 - RNA, 64 nt, hsa
ccagcccugcaggugggacuggcucucccuccccagccacgaguaugccacagggggcuuucaa

SEQ ID NO: 723577 - RNA, 64 nt, hsa
gauugcuugagcgagggaggucgaggcugcagugagccacgaucacaccacugcacuccagccu

SEQ ID NO: 723578 - RNA, 64 nt, hsa
caaggccuggagggcccaaugucgcugcaaacacagccacgaagaacaugcagccacugggccc

SEQ ID NO: 723579 - RNA, 63 nt, hsa
ccucugugauggcagugugagcuggacugugucagccacgacucgagcacucauucugcuccc

SEQ ID NO: 723580 - RNA, 64 nt, hsa
ccagcuaggaggaaauggagcaagaugaacaggcagccacgaggugggugggagcuggcagucu

SEQ ID NO: 723581 - RNA, 64 nt, hsa
ucauccuuggagagacugagcacucagcaccuucagccacgauuucaggaucgcuuccuuguga

SEQ ID NO: 723582 - RNA, 64 nt, hsa
gugaagccagcauguucaccacuggucguucagcagccacgacagcaccaugugagauggcgag

SEQ ID NO: 723583 - RNA, 64 nt, hsa
uuauacaccagugugugccugcagcagccuccacagccacgauggguuuguuucuguuuucuug

SEQ ID NO: 723584 - RNA, 64 nt, hsa
cacuuugcaccuccuauccccaggguccgccgagagccacgauuuuuuacagaaaaugagcaau

SEQ ID NO: 723585 - RNA, 64 nt, hsa
uguguaaauaauuugcacugaaacguggauacagagccacgaguuuggauguuguaaauaaaac

SEQ ID NO: 723586 - RNA, 64 nt, hsa
agccaaugauccccccucaggacaaaucuacuccagccacgaugagaagugggugagccagggu

SEQ ID NO: 723587 - RNA, 64 nt, hsa
cccagaguucuucgcuccacucacucaaaaucagagccacgaugacccaaaggauaagaaagaa

SEQ ID NO: 723588 - RNA, 64 nt, hsa
agaagaagcagcagaaggagcaggagcaagugagagccacgagccaaggugggcacuugauguc

SEQ ID NO: 723589 - RNA, 64 nt, hsa
cggagggggcugugcacauaccaguuacuuaagcagccacgagugucccccaugccuuggugcg

SEQ ID NO: 723590 - RNA, 64 nt, hsa
agugcugggaucacaggcaugagccacugugcccagccacgagcugcuuuuuauccaccuuccg

SEQ ID NO: 723591 - RNA, 64 nt, hsa
gaaugaaagagcggagacgguaguuuaguauuugagccacgaguuuaugugcacaaguguuuug

SEQ ID NO: 723592 - RNA, 64 nt, hsa
gggaacauuaaaacaguaacugacauccaguuaaagccacgaucgucagcaauucuccuuuuuu

SEQ ID NO: 723593 - RNA, 64 nt, hsa
agccacuguccgucuuuaaacagaaagucaaaggagccacgaagcaagcggccguccgggcguc

SEQ ID NO: 723594 - RNA, 64 nt, hsa
ugccagcuggaggugaaacugugcuuguauccccagccacgaagagcuggaccagcuucaagua

SEQ ID NO: 723595 - RNA, 64 nt, hsa
cugggguaugggaugagcauggagaagaggcaccagccacgauuccuuccuaagcaucuccugu

SEQ ID NO: 723596 - RNA, 64 nt, hsa
cagugcaauacgggagugacccagcuacugaaccagccacgaacagcccgccagaggccugaag

SEQ ID NO: 723597 - RNA, 64 nt, hsa
ggcagagacgcaguugucucugggcgcuugccagagccacgaaccccagaccuguuuguaucau

SEQ ID NO: 723598 - RNA, 64 nt, hsa
ggaaaccacagcauuaucacagcauuauugugacagccacgaacccauugcccacaaccccucc

SEQ ID NO: 723599 - RNA, 64 nt, hsa
ggcccccgcgcgcucuagugcccccgcacgcgggagccacgaaccucggggugggggugggcag

SEQ ID NO: 723600 - RNA, 64 nt, hsa
cuccagguaggcccguuuucacguggagcaugggagccacgacccuucuuaagacauguaucac

SEQ ID NO: 723601 - RNA, 64 nt, hsa
ggcagcaggccccgauaccgggaagagccgacacagccacgaaccagacaagcagacaaucagc

SEQ ID NO: 723602 - RNA, 64 nt, hsa
auuacacaucaagcgaugaaacuggaaaacuacaagccacgaaugaaugaauuaggaaagaaaa

SEQ ID NO: 723603 - RNA, 64 nt, hsa
aaaacacaagacccuccgcccgaguaaauucuucagccacgaagggauggaugugcaucugccc

SEQ ID NO: 723604 - RNA, 64 nt, hsa
ucaggggaggccagaggagagcugcugggccccgagccacgaacuugcugggugguucucuggg

SEQ ID NO: 723605 - RNA, 64 nt, hsa
gucucgguuauccaccccuaccucccagugucuaagccacgaauaaugguaugcuguugcugau

SEQ ID NO: 723606 - RNA, 64 nt, hsa
cuggcaggaugaaucgcaggauggcgcguacugaagccacgauguucauccaggccaaagcagg

SEQ ID NO: 723607 - RNA, 64 nt, hsa
uuaacguuuucauuaaaauuuuuuuuguaacuggagccacgacguaacaaauauggggaaaaaa

SEQ ID NO: 723608 - RNA, 64 nt, hsa
agguaaaugccugcacccauaauuuucuaguaauagccacgaccaauuuauuaacagucagggc

SEQ ID NO: 723609 - RNA, 64 nt, hsa
ggucagggccuacagcuguguuguccaguacaggagccacgagccaaauguggcauuugaauuu

SEQ ID NO: 723610 - RNA, 64 nt, hsa
gaaugauuggucauggggaagucucugcgccauaagccacgaucccagcgcaaaacccuuacuc

SEQ ID NO: 723611 - RNA, 64 nt, hsa
cacaucaauaaacaugacacucugaagugaaaguagccacgagaauugugcuacuuauacuggu

SEQ ID NO: 723612 - RNA, 64 nt, hsa
ggugcccacaggccgcccugcgggugaacaaagcagccacgaggugcaacaagguccucuguca

SEQ ID NO: 723613 - RNA, 64 nt, hsa
uguauuuucacuggagacgggguuucacuguguuagccacgauggucuccaucuccugaccucg

SEQ ID NO: 723614 - RNA, 64 nt, hsa
ggcagcaagggaccugcucaucauauuccaacccagccacgacugccauguaagguugugcagg

SEQ ID NO: 723615 - RNA, 64 nt, hsa
aaacugcgucucggaugucugucuuuugccucgaagccacgauggaucgcugguuuccucugca

SEQ ID NO: 723616 - RNA, 64 nt, hsa
gaaucagaguagaggacauggcugucuucuaaaaagccacgacaugaaaaugacaaucccuuuc

SEQ ID NO: 723617 - RNA, 64 nt, hsa
uccguccaccccugcaaagccaagacccuucugcagccacgaauguccacggagcccgccggca

SEQ ID NO: 723618 - RNA, 64 nt, hsa
ccaaaaaucagugucuagggacuaguugaucuggaugaguuauacaugauauuugacuuuucau

SEQ ID NO: 723619 - RNA, 64 nt, hsa
ccaaaaaucagugucuagggacugguugaucuagaugaguuauaaaugguauuugacuuuucau

SEQ ID NO: 723620 - RNA, 64 nt, hsa
agcgucccaaaucaauaagaagguagaaugaguuaugaguuauucauauucuguuggaagcuug

SEQ ID NO: 723621 - RNA, 64 nt, hsa
uggggggagcgucccaaaucaauaagaagguagaaugaguuaugaguuauucauauucuguugg

SEQ ID NO: 723622 - RNA, 64 nt, hsa
aauucagaccaaaccaggacuagcuuuuugugccaugaguuagccaugguccuggacccagcaa

SEQ ID NO: 723623 - RNA, 64 nt, hsa
uguacuggucuauagcuguauaguucauugcaccaugaguuauaguagccagaaguugggaaac

SEQ ID NO: 723624 - RNA, 64 nt, hsa
aaucacuucagaucucuaaaaaacaaagaauuacaugaguuaguacaugaaaaaauuaugggaa

SEQ ID NO: 723625 - RNA, 64 nt, hsa
aguaguaccuacaguauagugcuguuagaauuacaugaguuagauguggaggucagaguggaag

SEQ ID NO: 723626 - RNA, 64 nt, hsa; identical to SEQ ID NO: 161144

SEQ ID NO: 723627 - RNA, 64 nt, hsa; identical to SEQ ID NO: 161145

SEQ ID NO: 723628 - RNA, 64 nt, hsa; identical to SEQ ID NO: 161146

SEQ ID NO: 723629 - RNA, 64 nt, hsa; identical to SEQ ID NO: 161147

SEQ ID NO: 723630 - RNA, 64 nt, hsa; identical to SEQ ID NO: 161148

SEQ ID NO: 723631 - RNA, 64 nt, hsa; identical to SEQ ID NO: 119680

SEQ ID NO: 723632 - RNA, 64 nt, hsa; identical to SEQ ID NO: 119681

SEQ ID NO: 723633 - RNA, 64 nt, hsa; identical to SEQ ID NO: 119682

SEQ ID NO: 723634 - RNA, 64 nt, hsa; identical to SEQ ID NO: 119683

SEQ ID NO: 723635 - RNA, 64 nt, hsa; identical to SEQ ID NO: 119684

SEQ ID NO: 723636 - RNA, 64 nt, hsa; identical to SEQ ID NO: 119685

SEQ ID NO: 723637 - RNA, 64 nt, hsa; identical to SEQ ID NO: 119686

SEQ ID NO: 723638 - RNA, 64 nt, hsa; identical to SEQ ID NO: 119687

SEQ ID NO: 723639 - RNA, 64 nt, hsa; identical to SEQ ID NO: 119688

SEQ ID NO: 723640 - RNA, 64 nt, hsa; identical to SEQ ID NO: 119689

SEQ ID NO: 723641 - RNA, 64 nt, hsa; identical to SEQ ID NO: 119690

SEQ ID NO: 723642 - RNA, 64 nt, hsa; identical to SEQ ID NO: 119691

SEQ ID NO: 723643 - RNA, 64 nt, hsa; identical to SEQ ID NO: 119692

SEQ ID NO: 723644 - RNA, 64 nt, hsa; identical to SEQ ID NO: 119693

SEQ ID NO: 723645 - RNA, 64 nt, hsa; identical to SEQ ID NO: 119694

SEQ ID NO: 723646 - RNA, 64 nt, hsa; identical to SEQ ID NO: 119695

SEQ ID NO: 723647 - RNA, 64 nt, hsa; identical to SEQ ID NO: 119696

SEQ ID NO: 723648 - RNA, 64 nt, hsa; identical to SEQ ID NO: 119697

SEQ ID NO: 723649 - RNA, 64 nt, hsa; identical to SEQ ID NO: 119698

SEQ ID NO: 723650 - RNA, 64 nt, hsa; identical to SEQ ID NO: 119699

SEQ ID NO: 723651 - RNA, 64 nt, hsa; identical to SEQ ID NO: 119700

SEQ ID NO: 723652 - RNA, 64 nt, hsa; identical to SEQ ID NO: 119701

SEQ ID NO: 723653 - RNA, 64 nt, hsa; identical to SEQ ID NO: 119702

SEQ ID NO: 723654 - RNA, 64 nt, hsa; identical to SEQ ID NO: 119703

SEQ ID NO: 723655 - RNA, 64 nt, hsa; identical to SEQ ID NO: 119704

SEQ ID NO: 723656 - RNA, 64 nt, hsa; identical to SEQ ID NO: 119705

SEQ ID NO: 723657 - RNA, 64 nt, hsa; identical to SEQ ID NO: 119706

SEQ ID NO: 723658 - RNA, 64 nt, hsa; identical to SEQ ID NO: 119707

SEQ ID NO: 723659 - RNA, 64 nt, hsa; identical to SEQ ID NO: 119708

SEQ ID NO: 723660 - RNA, 64 nt, hsa; identical to SEQ ID NO: 119709

SEQ ID NO: 723661 - RNA, 64 nt, hsa; identical to SEQ ID NO: 119710

SEQ ID NO: 723662 - RNA, 64 nt, hsa; identical to SEQ ID NO: 119711

SEQ ID NO: 723663 - RNA, 64 nt, hsa; identical to SEQ ID NO: 119712

SEQ ID NO: 723664 - RNA, 64 nt, hsa; identical to SEQ ID NO: 119713

SEQ ID NO: 723665 - RNA, 64 nt, hsa; identical to SEQ ID NO: 119714

SEQ ID NO: 723666 - RNA, 64 nt, hsa; identical to SEQ ID NO: 119715

SEQ ID NO: 723667 - RNA, 64 nt, hsa; identical to SEQ ID NO: 119716

SEQ ID NO: 723668 - RNA, 64 nt, hsa; identical to SEQ ID NO: 260343

SEQ ID NO: 723669 - RNA, 64 nt, hsa; identical to SEQ ID NO: 260344

SEQ ID NO: 723670 - RNA, 64 nt, hsa; identical to SEQ ID NO: 260345

SEQ ID NO: 723671 - RNA, 64 nt, hsa; identical to SEQ ID NO: 260346

SEQ ID NO: 723672 - RNA, 64 nt, hsa; identical to SEQ ID NO: 260347

SEQ ID NO: 723673 - RNA, 64 nt, hsa; identical to SEQ ID NO: 260348

SEQ ID NO: 723674 - RNA, 64 nt, hsa; identical to SEQ ID NO: 260349

SEQ ID NO: 723675 - RNA, 64 nt, hsa; identical to SEQ ID NO: 260350

SEQ ID NO: 723676 - RNA, 57 nt, hsa; identical to SEQ ID NO: 260351

SEQ ID NO: 723677 - RNA, 64 nt, hsa; identical to SEQ ID NO: 260352

SEQ ID NO: 723678 - RNA, 64 nt, hsa; identical to SEQ ID NO: 260353

SEQ ID NO: 723679 - RNA, 64 nt, hsa; identical to SEQ ID NO: 260354

SEQ ID NO: 723680 - RNA, 64 nt, hsa; identical to SEQ ID NO: 260355

SEQ ID NO: 723681 - RNA, 64 nt, hsa; identical to SEQ ID NO: 260356

SEQ ID NO: 723682 - RNA, 64 nt, hsa; identical to SEQ ID NO: 260357

SEQ ID NO: 723683 - RNA, 64 nt, hsa; identical to SEQ ID NO: 260358

SEQ ID NO: 723684 - RNA, 64 nt, hsa; identical to SEQ ID NO: 260359

SEQ ID NO: 723685 - RNA, 64 nt, hsa; identical to SEQ ID NO: 260360

SEQ ID NO: 723686 - RNA, 64 nt, hsa; identical to SEQ ID NO: 260361

SEQ ID NO: 723687 - RNA, 64 nt, hsa; identical to SEQ ID NO: 260362

SEQ ID NO: 723688 - RNA, 64 nt, hsa; identical to SEQ ID NO: 260363

SEQ ID NO: 723689 - RNA, 64 nt, hsa; identical to SEQ ID NO: 260364

SEQ ID NO: 723690 - RNA, 64 nt, hsa; identical to SEQ ID NO: 260365

SEQ ID NO: 723691 - RNA, 64 nt, hsa; identical to SEQ ID NO: 260366

SEQ ID NO: 723692 - RNA, 64 nt, hsa; identical to SEQ ID NO: 260367

SEQ ID NO: 723693 - RNA, 64 nt, hsa; identical to SEQ ID NO: 260368

SEQ ID NO: 723694 - RNA, 64 nt, hsa; identical to SEQ ID NO: 260369

SEQ ID NO: 723695 - RNA, 64 nt, hsa; identical to SEQ ID NO: 260370

SEQ ID NO: 723696 - RNA, 64 nt, hsa; identical to SEQ ID NO: 260371

SEQ ID NO: 723697 - RNA, 64 nt, hsa; identical to SEQ ID NO: 260372

SEQ ID NO: 723698 - RNA, 64 nt, hsa; identical to SEQ ID NO: 260373

SEQ ID NO: 723699 - RNA, 64 nt, hsa; identical to SEQ ID NO: 260374

SEQ ID NO: 723700 - RNA, 64 nt, hsa; identical to SEQ ID NO: 260375

SEQ ID NO: 723701 - RNA, 64 nt, hsa; identical to SEQ ID NO: 260376

SEQ ID NO: 723702 - RNA, 64 nt, hsa; identical to SEQ ID NO: 260377

SEQ ID NO: 723703 - RNA, 64 nt, hsa; identical to SEQ ID NO: 260378

SEQ ID NO: 723704 - RNA, 64 nt, hsa; identical to SEQ ID NO: 260379

SEQ ID NO: 723705 - RNA, 64 nt, hsa; identical to SEQ ID NO: 260380

SEQ ID NO: 723706 - RNA, 64 nt, hsa; identical to SEQ ID NO: 260381

SEQ ID NO: 723707 - RNA, 64 nt, hsa; identical to SEQ ID NO: 260382

SEQ ID NO: 723708 - RNA, 64 nt, hsa; identical to SEQ ID NO: 260383

SEQ ID NO: 723709 - RNA, 64 nt, hsa; identical to SEQ ID NO: 260384

SEQ ID NO: 723710 - RNA, 64 nt, hsa; identical to SEQ ID NO: 260385

SEQ ID NO: 723711 - RNA, 64 nt, hsa; identical to SEQ ID NO: 260386

SEQ ID NO: 723712 - RNA, 64 nt, hsa; identical to SEQ ID NO: 260387

SEQ ID NO: 723713 - RNA, 64 nt, hsa; identical to SEQ ID NO: 260388

SEQ ID NO: 723714 - RNA, 64 nt, hsa; identical to SEQ ID NO: 260389

SEQ ID NO: 723715 - RNA, 64 nt, hsa; identical to SEQ ID NO: 260390

SEQ ID NO: 723716 - RNA, 64 nt, hsa; identical to SEQ ID NO: 260391

SEQ ID NO: 723717 - RNA, 64 nt, hsa; identical to SEQ ID NO: 260392

SEQ ID NO: 723718 - RNA, 64 nt, hsa; identical to SEQ ID NO: 260393

SEQ ID NO: 723719 - RNA, 64 nt, hsa; identical to SEQ ID NO: 260394

SEQ ID NO: 723720 - RNA, 64 nt, hsa; identical to SEQ ID NO: 260395

SEQ ID NO: 723721 - RNA, 64 nt, hsa; identical to SEQ ID NO: 260396

SEQ ID NO: 723722 - RNA, 64 nt, hsa; identical to SEQ ID NO: 260397

SEQ ID NO: 723723 - RNA, 64 nt, hsa; identical to SEQ ID NO: 260398

SEQ ID NO: 723724 - RNA, 64 nt, hsa; identical to SEQ ID NO: 260399

SEQ ID NO: 723725 - RNA, 64 nt, hsa; identical to SEQ ID NO: 260400

SEQ ID NO: 723726 - RNA, 64 nt, hsa; identical to SEQ ID NO: 260401

SEQ ID NO: 723727 - RNA, 64 nt, hsa; identical to SEQ ID NO: 260402

SEQ ID NO: 723728 - RNA, 64 nt, hsa; identical to SEQ ID NO: 260403

SEQ ID NO: 723729 - RNA, 64 nt, hsa; identical to SEQ ID NO: 260404

SEQ ID NO: 723730 - RNA, 64 nt, hsa; identical to SEQ ID NO: 260405

SEQ ID NO: 723731 - RNA, 64 nt, hsa; identical to SEQ ID NO: 260406

SEQ ID NO: 723732 - RNA, 64 nt, hsa; identical to SEQ ID NO: 260407

SEQ ID NO: 723733 - RNA, 64 nt, hsa; identical to SEQ ID NO: 260408

SEQ ID NO: 723734 - RNA, 64 nt, hsa; identical to SEQ ID NO: 260409

SEQ ID NO: 723735 - RNA, 64 nt, hsa; identical to SEQ ID NO: 260410

SEQ ID NO: 723736 - RNA, 64 nt, hsa; identical to SEQ ID NO: 260411

SEQ ID NO: 723737 - RNA, 64 nt, hsa; identical to SEQ ID NO: 260412

SEQ ID NO: 723738 - RNA, 64 nt, hsa; identical to SEQ ID NO: 260413

SEQ ID NO: 723739 - RNA, 64 nt, hsa; identical to SEQ ID NO: 260414

SEQ ID NO: 723740 - RNA, 64 nt, hsa; identical to SEQ ID NO: 260415

SEQ ID NO: 723741 - RNA, 64 nt, hsa; identical to SEQ ID NO: 260416

SEQ ID NO: 723742 - RNA, 64 nt, hsa; identical to SEQ ID NO: 260417

SEQ ID NO: 723743 - RNA, 64 nt, hsa; identical to SEQ ID NO: 260418

SEQ ID NO: 723744 - RNA, 64 nt, hsa; identical to SEQ ID NO: 260419

SEQ ID NO: 723745 - RNA, 64 nt, hsa; identical to SEQ ID NO: 260420

SEQ ID NO: 723746 - RNA, 64 nt, hsa; identical to SEQ ID NO: 260421

SEQ ID NO: 723747 - RNA, 64 nt, hsa; identical to SEQ ID NO: 260422

SEQ ID NO: 723748 - RNA, 64 nt, hsa; identical to SEQ ID NO: 260423

SEQ ID NO: 723749 - RNA, 64 nt, hsa; identical to SEQ ID NO: 260424

SEQ ID NO: 723750 - RNA, 64 nt, hsa; identical to SEQ ID NO: 260425

SEQ ID NO: 723751 - RNA, 64 nt, hsa; identical to SEQ ID NO: 260426

SEQ ID NO: 723752 - RNA, 64 nt, hsa; identical to SEQ ID NO: 260427

SEQ ID NO: 723753 - RNA, 64 nt, hsa; identical to SEQ ID NO: 260428

SEQ ID NO: 723754 - RNA, 64 nt, hsa; identical to SEQ ID NO: 260429

SEQ ID NO: 723755 - RNA, 64 nt, hsa; identical to SEQ ID NO: 260430

SEQ ID NO: 723756 - RNA, 64 nt, hsa; identical to SEQ ID NO: 260431

SEQ ID NO: 723757 - RNA, 64 nt, hsa; identical to SEQ ID NO: 260432

SEQ ID NO: 723758 - RNA, 64 nt, hsa; identical to SEQ ID NO: 260433

SEQ ID NO: 723759 - RNA, 64 nt, hsa; identical to SEQ ID NO: 260434

SEQ ID NO: 723760 - RNA, 64 nt, hsa; identical to SEQ ID NO: 260435

SEQ ID NO: 723761 - RNA, 64 nt, hsa; identical to SEQ ID NO: 260436

SEQ ID NO: 723762 - RNA, 64 nt, hsa; identical to SEQ ID NO: 260437

SEQ ID NO: 723763 - RNA, 64 nt, hsa; identical to SEQ ID NO: 260438

SEQ ID NO: 723764 - RNA, 64 nt, hsa; identical to SEQ ID NO: 260439

SEQ ID NO: 723765 - RNA, 64 nt, hsa; identical to SEQ ID NO: 260440

SEQ ID NO: 723766 - RNA, 64 nt, hsa; identical to SEQ ID NO: 260441

SEQ ID NO: 723767 - RNA, 64 nt, hsa; identical to SEQ ID NO: 260442

SEQ ID NO: 723768 - RNA, 64 nt, hsa; identical to SEQ ID NO: 260443

SEQ ID NO: 723769 - RNA, 64 nt, hsa; identical to SEQ ID NO: 260444

SEQ ID NO: 723770 - RNA, 64 nt, hsa; identical to SEQ ID NO: 260445

SEQ ID NO: 723771 - RNA, 64 nt, hsa; identical to SEQ ID NO: 260446

SEQ ID NO: 723772 - RNA, 64 nt, hsa; identical to SEQ ID NO: 260447

SEQ ID NO: 723773 - RNA, 64 nt, hsa; identical to SEQ ID NO: 260448

SEQ ID NO: 723774 - RNA, 64 nt, hsa; identical to SEQ ID NO: 260449

SEQ ID NO: 723775 - RNA, 64 nt, hsa; identical to SEQ ID NO: 260450

SEQ ID NO: 723776 - RNA, 64 nt, hsa; identical to SEQ ID NO: 260451

SEQ ID NO: 723777 - RNA, 64 nt, hsa; identical to SEQ ID NO: 260452

SEQ ID NO: 723778 - RNA, 64 nt, hsa; identical to SEQ ID NO: 260453

SEQ ID NO: 723779 - RNA, 64 nt, hsa; identical to SEQ ID NO: 260454

SEQ ID NO: 723780 - RNA, 64 nt, hsa; identical to SEQ ID NO: 260455

SEQ ID NO: 723781 - RNA, 64 nt, hsa; identical to SEQ ID NO: 260456

SEQ ID NO: 723782 - RNA, 64 nt, hsa; identical to SEQ ID NO: 260457

SEQ ID NO: 723783 - RNA, 64 nt, hsa; identical to SEQ ID NO: 260458

SEQ ID NO: 723784 - RNA, 64 nt, hsa; identical to SEQ ID NO: 260459

SEQ ID NO: 723785 - RNA, 64 nt, hsa; identical to SEQ ID NO: 260460

SEQ ID NO: 723786 - RNA, 64 nt, hsa; identical to SEQ ID NO: 260461

SEQ ID NO: 723787 - RNA, 64 nt, hsa; identical to SEQ ID NO: 260462

SEQ ID NO: 723788 - RNA, 64 nt, hsa; identical to SEQ ID NO: 260463

SEQ ID NO: 723789 - RNA, 64 nt, hsa; identical to SEQ ID NO: 260464

SEQ ID NO: 723790 - RNA, 64 nt, hsa; identical to SEQ ID NO: 260465

SEQ ID NO: 723791 - RNA, 64 nt, hsa; identical to SEQ ID NO: 260466

SEQ ID NO: 723792 - RNA, 64 nt, hsa; identical to SEQ ID NO: 260467

SEQ ID NO: 723793 - RNA, 64 nt, hsa; identical to SEQ ID NO: 260468

SEQ ID NO: 723794 - RNA, 64 nt, hsa; identical to SEQ ID NO: 260469

SEQ ID NO: 723795 - RNA, 56 nt, hsa; identical to SEQ ID NO: 260470

SEQ ID NO: 723796 - RNA, 64 nt, hsa; identical to SEQ ID NO: 260471

SEQ ID NO: 723797 - RNA, 64 nt, hsa; identical to SEQ ID NO: 260472

SEQ ID NO: 723798 - RNA, 64 nt, hsa; identical to SEQ ID NO: 260473

SEQ ID NO: 723799 - RNA, 64 nt, hsa; identical to SEQ ID NO: 260474

SEQ ID NO: 723800 - RNA, 64 nt, hsa; identical to SEQ ID NO: 260475

SEQ ID NO: 723801 - RNA, 64 nt, hsa; identical to SEQ ID NO: 260476

SEQ ID NO: 723802 - RNA, 64 nt, hsa; identical to SEQ ID NO: 260477

SEQ ID NO: 723803 - RNA, 64 nt, hsa; identical to SEQ ID NO: 260478

SEQ ID NO: 723804 - RNA, 64 nt, hsa; identical to SEQ ID NO: 260479

SEQ ID NO: 723805 - RNA, 64 nt, hsa; identical to SEQ ID NO: 260480

SEQ ID NO: 723806 - RNA, 64 nt, hsa; identical to SEQ ID NO: 260481

SEQ ID NO: 723807 - RNA, 64 nt, hsa; identical to SEQ ID NO: 260482

SEQ ID NO: 723808 - RNA, 64 nt, hsa; identical to SEQ ID NO: 260483

SEQ ID NO: 723809 - RNA, 64 nt, hsa; identical to SEQ ID NO: 260484

SEQ ID NO: 723810 - RNA, 64 nt, hsa; identical to SEQ ID NO: 260485

SEQ ID NO: 723811 - RNA, 64 nt, hsa; identical to SEQ ID NO: 260486

SEQ ID NO: 723812 - RNA, 64 nt, hsa; identical to SEQ ID NO: 260487

SEQ ID NO: 723813 - RNA, 64 nt, hsa; identical to SEQ ID NO: 260488

SEQ ID NO: 723814 - RNA, 64 nt, hsa; identical to SEQ ID NO: 260489

SEQ ID NO: 723815 - RNA, 64 nt, hsa; identical to SEQ ID NO: 260490

SEQ ID NO: 723816 - RNA, 64 nt, hsa; identical to SEQ ID NO: 260491

SEQ ID NO: 723817 - RNA, 64 nt, hsa; identical to SEQ ID NO: 260492

SEQ ID NO: 723818 - RNA, 64 nt, hsa; identical to SEQ ID NO: 260493

SEQ ID NO: 723819 - RNA, 64 nt, hsa; identical to SEQ ID NO: 260494

SEQ ID NO: 723820 - RNA, 64 nt, hsa; identical to SEQ ID NO: 260495

SEQ ID NO: 723821 - RNA, 64 nt, hsa; identical to SEQ ID NO: 260496

SEQ ID NO: 723822 - RNA, 64 nt, hsa; identical to SEQ ID NO: 260497

SEQ ID NO: 723823 - RNA, 64 nt, hsa; identical to SEQ ID NO: 260498

SEQ ID NO: 723824 - RNA, 64 nt, hsa; identical to SEQ ID NO: 260499

SEQ ID NO: 723825 - RNA, 64 nt, hsa; identical to SEQ ID NO: 260500

SEQ ID NO: 723826 - RNA, 64 nt, hsa; identical to SEQ ID NO: 260501

SEQ ID NO: 723827 - RNA, 64 nt, hsa; identical to SEQ ID NO: 260502

SEQ ID NO: 723828 - RNA, 64 nt, hsa; identical to SEQ ID NO: 260503

SEQ ID NO: 723829 - RNA, 64 nt, hsa; identical to SEQ ID NO: 260504

SEQ ID NO: 723830 - RNA, 64 nt, hsa; identical to SEQ ID NO: 260505

SEQ ID NO: 723831 - RNA, 64 nt, hsa; identical to SEQ ID NO: 260506

SEQ ID NO: 723832 - RNA, 64 nt, hsa; identical to SEQ ID NO: 260507

SEQ ID NO: 723833 - RNA, 64 nt, hsa; identical to SEQ ID NO: 260508

SEQ ID NO: 723834 - RNA, 64 nt, hsa; identical to SEQ ID NO: 260509

SEQ ID NO: 723835 - RNA, 64 nt, hsa; identical to SEQ ID NO: 260510

SEQ ID NO: 723836 - RNA, 64 nt, hsa; identical to SEQ ID NO: 260511

SEQ ID NO: 723837 - RNA, 64 nt, hsa; identical to SEQ ID NO: 260512

SEQ ID NO: 723838 - RNA, 64 nt, hsa; identical to SEQ ID NO: 260513

SEQ ID NO: 723839 - RNA, 64 nt, hsa; identical to SEQ ID NO: 260514

SEQ ID NO: 723840 - RNA, 64 nt, hsa; identical to SEQ ID NO: 260515

SEQ ID NO: 723841 - RNA, 64 nt, hsa; identical to SEQ ID NO: 260516

SEQ ID NO: 723842 - RNA, 64 nt, hsa; identical to SEQ ID NO: 260517

SEQ ID NO: 723843 - RNA, 64 nt, hsa; identical to SEQ ID NO: 260518

SEQ ID NO: 723844 - RNA, 64 nt, hsa; identical to SEQ ID NO: 260519

SEQ ID NO: 723845 - RNA, 64 nt, hsa; identical to SEQ ID NO: 260520

SEQ ID NO: 723846 - RNA, 64 nt, hsa; identical to SEQ ID NO: 260521

SEQ ID NO: 723847 - RNA, 64 nt, hsa; identical to SEQ ID NO: 260522

SEQ ID NO: 723848 - RNA, 64 nt, hsa; identical to SEQ ID NO: 260523

SEQ ID NO: 723849 - RNA, 64 nt, hsa; identical to SEQ ID NO: 260524

SEQ ID NO: 723850 - RNA, 64 nt, hsa; identical to SEQ ID NO: 260525

SEQ ID NO: 723851 - RNA, 64 nt, hsa; identical to SEQ ID NO: 260526

SEQ ID NO: 723852 - RNA, 64 nt, hsa; identical to SEQ ID NO: 260527

SEQ ID NO: 723853 - RNA, 64 nt, hsa; identical to SEQ ID NO: 260528

SEQ ID NO: 723854 - RNA, 64 nt, hsa; identical to SEQ ID NO: 260529

SEQ ID NO: 723855 - RNA, 64 nt, hsa; identical to SEQ ID NO: 260530

SEQ ID NO: 723856 - RNA, 64 nt, hsa; identical to SEQ ID NO: 260531

SEQ ID NO: 723857 - RNA, 64 nt, hsa; identical to SEQ ID NO: 260532

SEQ ID NO: 723858 - RNA, 64 nt, hsa; identical to SEQ ID NO: 260533

SEQ ID NO: 723859 - RNA, 64 nt, hsa; identical to SEQ ID NO: 260534

SEQ ID NO: 723860 - RNA, 64 nt, hsa; identical to SEQ ID NO: 260535

SEQ ID NO: 723861 - RNA, 64 nt, hsa; identical to SEQ ID NO: 260536

SEQ ID NO: 723862 - RNA, 64 nt, hsa; identical to SEQ ID NO: 260537

SEQ ID NO: 723863 - RNA, 64 nt, hsa; identical to SEQ ID NO: 260538

SEQ ID NO: 723864 - RNA, 64 nt, hsa; identical to SEQ ID NO: 260539

SEQ ID NO: 723865 - RNA, 64 nt, hsa; identical to SEQ ID NO: 260540

SEQ ID NO: 723866 - RNA, 64 nt, hsa; identical to SEQ ID NO: 260541

SEQ ID NO: 723867 - RNA, 64 nt, hsa; identical to SEQ ID NO: 260542

SEQ ID NO: 723868 - RNA, 64 nt, hsa
gggaaagcaacuucuugcuggaagaauaucucugccuucuuaccuuaaauuaaaaagagcacua

SEQ ID NO: 723869 - RNA, 64 nt, hsa
uuaguaugguuuugucucuaaugaauaaauaauuccuucuuauuaagaagaaguaagggagaaa

SEQ ID NO: 723870 - RNA, 64 nt, hsa
aaaacuugcagcuagaauugagggaagagagagaccuucuuauauuguuuuauauuguuugaua

SEQ ID NO: 723871 - RNA, 64 nt, hsa
uuauaguuuaauguuuuauauuuaagucuuuaauccuucuuaaguugauuuuuguaugcagagu

SEQ ID NO: 723872 - RNA, 64 nt, hsa
uucgauucuuuucucuuuuuuuucuucauuggcuccuucuuaguggauucucuucucuacugcc

SEQ ID NO: 723873 - RNA, 64 nt, hsa
ucugcuggcaccuucuguaccaugccuucagaaaccuucuuaucccccucaucucuggggcccc

SEQ ID NO: 723874 - RNA, 64 nt, hsa
ucuuccucacccuuugcauaccuuuaauauuuuuccuucuuaaauuggccacagcaggggucau

SEQ ID NO: 723875 - RNA, 64 nt, hsa
uaaacuccuuuccacaaaaguuuaagucuaaugaccuucuuagagaaguugagcaugccuggca

SEQ ID NO: 723876 - RNA, 64 nt, hsa
auggcacugacaucugccuuguaacugaugagaaccuucuuacugcaugauaacaaagcagcaa

SEQ ID NO: 723877 - RNA, 64 nt, hsa
aagucaaagacaggaagagaucagagugaaugugccuucuuaaccagagcuacagaauuuagug

SEQ ID NO: 723878 - RNA, 64 nt, hsa
acauucuauuaaaauuuagcccuaaaaugacaagccuucuuaaagccuuauuuuucaaaagcgc

SEQ ID NO: 723879 - RNA, 64 nt, hsa
uuuaaaauauuuuagauaauucuuaaacuaugaaccuucuuaacaucacugucuugccagauua

SEQ ID NO: 723880 - RNA, 64 nt, hsa
acgaccaugguggaauguuaaggugaaccccaccccuucuuacagauggggacccagagccugc

SEQ ID NO: 723881 - RNA, 64 nt, hsa
caucuuuagcucagguccauccuucucaagaucuccuucuuagccccccagccccuggugcugu

SEQ ID NO: 723882 - RNA, 64 nt, hsa
ggaacaagcccccagaaaagaaagggaagaacugccuucuuauacuacagaacaugcauuagug

SEQ ID NO: 723883 - RNA, 64 nt, hsa
gcacaaaugcuuauuuguuauccaaaaacaaccuccuucuuaucugugauaaaucuauagaaag

SEQ ID NO: 723884 - RNA, 64 nt, hsa
uuaaaggacuggccuuuccagaaaacgcuuuggaucugagcagaguagucaguuucucagacac

SEQ ID NO: 723885 - RNA, 64 nt, hsa
agagcugccccccaucaccacgccaucacaccccucugagcagaagcaaaucugaggcugaaga

SEQ ID NO: 723886 - RNA, 64 nt, hsa
ucacucuccccggucagcucugcaucagguguuuucugagcaaaccaaggggguuuauagucau

SEQ ID NO: 723887 - RNA, 64 nt, hsa
ccacagaguccuuucugcuggugaggacagcauuucugagcagggcuuuguucucuaugugcau

SEQ ID NO: 723888 - RNA, 64 nt, hsa
ucagaaacuuggaaucguuuuuuuuaaaaaugccucugagcaacccauauaagucacaaagucu

SEQ ID NO: 723889 - RNA, 64 nt, hsa
auaagcaagaugacugggaaaucucugccccuuuucugagcaguaugccucuucuuuuagaauu

SEQ ID NO: 723890 - RNA, 64 nt, hsa
agucagcacugaugccacccucucaguggucauuucugagcaucuuccugacuugaacaccuuc

SEQ ID NO: 723891 - RNA, 64 nt, hsa
gaacuucacggaacuuuauagcacuccgacauuuucugagcaagaggaagucaaaauuuauuua

SEQ ID NO: 723892 - RNA, 64 nt, hsa
caaaguaagaucaagccaguguuuugaucugggcucugagcacaagucaggaaacaccaacaua

SEQ ID NO: 723893 - RNA, 64 nt, hsa
auuguacucagugggccuuggggccuagcccagcucugagcagaggacuguggcauucacuguc

SEQ ID NO: 723894 - RNA, 64 nt, hsa
cucauggcguucccuccagaacuccccauuccccucugagcauauuucuaugcugcugcuucuu

SEQ ID NO: 723895 - RNA, 64 nt, hsa
aaaagaacacgacugaaaaaguucaucugaugccucugagcaugugauaaaguccuggguagac

SEQ ID NO: 723896 - RNA, 64 nt, hsa
cacugcccuuaccugacccucacagaaagagagcucugagcaggugagggggucugcgguggcu

SEQ ID NO: 723897 - RNA, 64 nt, hsa
ggcuggucauugacuucgggcuggaccguugcccucugagcagagaacagacccauuucuggga

SEQ ID NO: 723898 - RNA, 64 nt, hsa
acaggaguugaugaacccaucaugcugguuuuucucugagcacaaaguuuuaggcuguacacag

SEQ ID NO: 723899 - RNA, 64 nt, hsa
cuagcuuuagucuuucuguucccauuuuuauaaaucugagcauugauaauguucuaucuaaauu

SEQ ID NO: 723900 - RNA, 64 nt, hsa
ggcgugaguggccgugcccugggugugcugccugucugagcaagcuucccuagcuguggaaccc

SEQ ID NO: 723901 - RNA, 64 nt, hsa
ugaucccggacagccgaacccaagagcugguggcucugagcagacagagacaucuuggccuguc

SEQ ID NO: 723902 - RNA, 64 nt, hsa
ggggggaagcugggggcacauguggcccuugccuucugagcagcucccagugccagggcuuuga

SEQ ID NO: 723903 - RNA, 64 nt, hsa
uugcugguugguaucuguaaauguuuaauaaauaucugagcauguaucuaucaacgccaagaau

SEQ ID NO: 723904 - RNA, 64 nt, hsa
uggggugggggcaaggcaggacaaaacauacaagucugagcaaguacaucucuugcagguuuuc

SEQ ID NO: 723905 - RNA, 64 nt, hsa
ggugucagauaguguaugagaauuaaaugugucaucugagcaugcuacugaugauaaauuuguu

SEQ ID NO: 723906 - RNA, 64 nt, hsa
ucuucaucaaguuuugauaagaaauccuagguccucugagcaacgccugcuucuccauaucaca

SEQ ID NO: 723907 - RNA, 64 nt, hsa
agcaguccagccuccgucuucugguccacucugcucugagcagccugggaugcugaacucuuca

SEQ ID NO: 723908 - RNA, 64 nt, hsa
uuuaguuggagagauacaggaagccuccuaggguucugagcagaagaggggcaugagcugauuc

SEQ ID NO: 723909 - RNA, 64 nt, hsa
aguucuuccagcaaaaugcuuauuagaguuuuugucugagcacaguagccuggcccugcauauc

SEQ ID NO: 723910 - RNA, 64 nt, hsa
acacacacacacacacacacacacacacacacacucugagcacauuaucugugauucuuucauc

SEQ ID NO: 723911 - RNA, 64 nt, hsa; identical to SEQ ID NO: 190819

SEQ ID NO: 723912 - RNA, 64 nt, hsa; identical to SEQ ID NO: 190820

SEQ ID NO: 723913 - RNA, 64 nt, hsa; identical to SEQ ID NO: 190821

SEQ ID NO: 723914 - RNA, 64 nt, hsa; identical to SEQ ID NO: 190822

SEQ ID NO: 723915 - RNA, 64 nt, hsa; identical to SEQ ID NO: 190823

SEQ ID NO: 723916 - RNA, 64 nt, hsa; identical to SEQ ID NO: 190824

SEQ ID NO: 723917 - RNA, 64 nt, hsa; identical to SEQ ID NO: 190825

SEQ ID NO: 723918 - RNA, 64 nt, hsa; identical to SEQ ID NO: 190826

SEQ ID NO: 723919 - RNA, 64 nt, hsa; identical to SEQ ID NO: 190827

SEQ ID NO: 723920 - RNA, 64 nt, hsa; identical to SEQ ID NO: 190828

SEQ ID NO: 723921 - RNA, 64 nt, hsa; identical to SEQ ID NO: 190829

SEQ ID NO: 723922 - RNA, 64 nt, hsa; identical to SEQ ID NO: 190830

SEQ ID NO: 723923 - RNA, 64 nt, hsa; identical to SEQ ID NO: 190831

SEQ ID NO: 723924 - RNA, 64 nt, hsa; identical to SEQ ID NO: 190832

SEQ ID NO: 723925 - RNA, 64 nt, hsa
aaggcccugggguuccaacucacugugcgucuccuccacacagaccaguagguucuccuaugcu

SEQ ID NO: 723926 - RNA, 64 nt, hsa
cucagcaaacagaaccacagggcccaggaggcauuccacacaggcacugccccaggacaacaca

SEQ ID NO: 723927 - RNA, 64 nt, hsa
uuucuaauaauccacacauuucaugcucuaauaauccacacauuucaugcucauuuuuauuguu

SEQ ID NO: 723928 - RNA, 64 nt, hsa
auguucauuucacaagugcaugucuuucuaauaauccacacauuucaugcucuaauaauccaca

SEQ ID NO: 723929 - RNA, 64 nt, hsa
uggcauccuccggagagagagagaggaaggagauuccacacagggguggaguuucugacgaagg

SEQ ID NO: 723930 - RNA, 64 nt, hsa
ggcgccuggcacauuucagggagaaacuccaaaguccacacaaagauuuucuaaggaaugcaca

SEQ ID NO: 723931 - RNA, 64 nt, hsa
uucaacuugacccucccacccccugcuacucuccuccacacaccccuccguuccgcuagccuac

SEQ ID NO: 723932 - RNA, 64 nt, hsa
uugcugucgccacucaugucuccuccacaugcgguccacacaucaguaagggccuggagaugug

SEQ ID NO: 723933 - RNA, 64 nt, hsa
uggcagaggcaaauccacagaaggggggcugcccuccacacacacacgcccgucacccacaccu

SEQ ID NO: 723934 - RNA, 64 nt, hsa
gcagaaacuaacuccguaaugaauggaauucaauuccacacaugguuuguucaagcacacuuaa

SEQ ID NO: 723935 - RNA, 64 nt, hsa
uagaagcauccuuuuuaaagagaaguugccuugguccacacacuaagcagaaaaccaaguuauc

SEQ ID NO: 723936 - RNA, 64 nt, hsa
ucugccuuuauguaguaguugggcauauaauccuuccacacagccccugcagggaaaggcuaau

SEQ ID NO: 723937 - RNA, 64 nt, hsa
aaaggcuaaucuuacggauaauccacgugagauuuccacacaagagaaaagcacacgcauagug

SEQ ID NO: 723938 - RNA, 64 nt, hsa
ucacuuucuuagguaauucacugcagguuaagaauccacacaaccaaguucaugggaauuuugu

SEQ ID NO: 723939 - RNA, 64 nt, hsa
ucuuauccuacauuauuggaaaauaaaugagauguccacacaaauggauuauccacauaaucaa

SEQ ID NO: 723940 - RNA, 64 nt, hsa
gguuuuccagaguccaauccucaggacuuucccguccacacacaggccugguagucagguggcu

SEQ ID NO: 723941 - RNA, 64 nt, hsa
cagcugugauaucucagaugcugcugcuugacaauccacacaaaguauguuccagugucugugg

SEQ ID NO: 723942 - RNA, 64 nt, hsa
aauuuggucauuccuuaaagacaggguuucaauuuccacacaugaucucugcaaacaggcacug

SEQ ID NO: 723943 - RNA, 64 nt, hsa
aucuauuuuaggggcugucugcuuuucuagucuguccacacagggauuaccugucaucuugcau

SEQ ID NO: 723944 - RNA, 64 nt, hsa
gcuacaccacucucccagccugugaccaccgauguccacacacccccaaccacuuguccacaca

SEQ ID NO: 723945 - RNA, 64 nt, hsa
ugaccaccgauguccacacacccccaaccacuuguccacacagcuacccacguacgacaucguc

SEQ ID NO: 723946 - RNA, 64 nt, hsa
auguaaccacguggaaagcggccccugcugccccuccacacacacauacacacucacugaucua

SEQ ID NO: 723947 - RNA, 64 nt, hsa
gaaauuaaaagaacaacacccuagagagaagucauccacacacaauccacacacgcauagcaaa

SEQ ID NO: 723948 - RNA, 64 nt, hsa
aacaacacccuagagagaagucauccacacacaauccacacacgcauagcaaaccuccaaugca

SEQ ID NO: 723949 - RNA, 64 nt, hsa
ccuguccacacacucccuguccacacacucccuguccacacacucccuguccacaacugcagcc

SEQ ID NO: 723950 - RNA, 64 nt, hsa
aggccggccacgcucccuguccacacacucccuguccacacacucccuguccacacacucccug

SEQ ID NO: 723951 - RNA, 64 nt, hsa
acagcugccuaggaaaggccggccacgcucccuguccacacacucccuguccacacacucccug

SEQ ID NO: 723952 - RNA, 64 nt, hsa
cgacuuuugccacccuccugaggaagccccuagguccacacagugaugccaugggggacccuug

SEQ ID NO: 723953 - RNA, 64 nt, hsa
cacccucagaaggcuugucucaccuccaccggcauccacacaaaaccaaacaggagcaggcguc

SEQ ID NO: 723954 - RNA, 64 nt, hsa
cccaccuggagagaaacuuccagaccagccccucauaccacagccaagaggggccuuucucacc

SEQ ID NO: 723955 - RNA, 64 nt, hsa; identical to SEQ ID NO: 723954

SEQ ID NO: 723956 - RNA, 64 nt, hsa
gcacuguguaucuuauaugaauguuuuauuuuauauaccacaugcaaaaauguccauaugcacu

SEQ ID NO: 723957 - RNA, 64 nt, hsa
aacacacaccacacaucacacacagaacugaaucauaccacaugcugccuaugggacuucaguu

SEQ ID NO: 723958 - RNA, 64 nt, hsa
aaaaugccccucgugugaccauagauugagauuuauaccacauaccacacauagccacagaaac

SEQ ID NO: 723959 - RNA, 64 nt, hsa
cccucgugugaccauagauugagauuuauaccacauaccacacauagccacagaaacaucaucu

SEQ ID NO: 723960 - RNA, 64 nt, hsa
cucauuuuagaaagacauuuaaaauuuuuggaacauaccacauguagaaagguugaacugguuu

SEQ ID NO: 723961 - RNA, 64 nt, hsa
agcuauaaugcauauacaacuauaguguguacguauaccacauauacauauacuuguaugaaga

SEQ ID NO: 723962 - RNA, 64 nt, hsa; identical to SEQ ID NO: 215478

SEQ ID NO: 723963 - RNA, 64 nt, hsa; identical to SEQ ID NO: 215479

SEQ ID NO: 723964 - RNA, 64 nt, hsa; identical to SEQ ID NO: 215480

SEQ ID NO: 723965 - RNA, 64 nt, hsa; identical to SEQ ID NO: 215481

SEQ ID NO: 723966 - RNA, 64 nt, hsa; identical to SEQ ID NO: 215482

SEQ ID NO: 723967 - RNA, 64 nt, hsa; identical to SEQ ID NO: 215483

SEQ ID NO: 723968 - RNA, 64 nt, hsa; identical to SEQ ID NO: 215484

SEQ ID NO: 723969 - RNA, 64 nt, hsa; identical to SEQ ID NO: 215485

SEQ ID NO: 723970 - RNA, 64 nt, hsa; identical to SEQ ID NO: 308450

SEQ ID NO: 723971 - RNA, 64 nt, hsa; identical to SEQ ID NO: 308451

SEQ ID NO: 723972 - RNA, 64 nt, hsa; identical to SEQ ID NO: 308452

SEQ ID NO: 723973 - RNA, 64 nt, hsa; identical to SEQ ID NO: 308453

SEQ ID NO: 723974 - RNA, 64 nt, hsa; identical to SEQ ID NO: 308454

SEQ ID NO: 723975 - RNA, 64 nt, hsa; identical to SEQ ID NO: 308455

SEQ ID NO: 723976 - RNA, 64 nt, hsa; identical to SEQ ID NO: 308456

SEQ ID NO: 723977 - RNA, 64 nt, hsa; identical to SEQ ID NO: 308457

SEQ ID NO: 723978 - RNA, 64 nt, hsa; identical to SEQ ID NO: 308458

SEQ ID NO: 723979 - RNA, 64 nt, hsa; identical to SEQ ID NO: 308459

SEQ ID NO: 723980 - RNA, 64 nt, hsa; identical to SEQ ID NO: 308460

SEQ ID NO: 723981 - RNA, 64 nt, hsa; identical to SEQ ID NO: 308461

SEQ ID NO: 723982 - RNA, 64 nt, hsa; identical to SEQ ID NO: 308462

SEQ ID NO: 723983 - RNA, 64 nt, hsa; identical to SEQ ID NO: 308463

SEQ ID NO: 723984 - RNA, 64 nt, hsa; identical to SEQ ID NO: 308464

SEQ ID NO: 723985 - RNA, 64 nt, hsa; identical to SEQ ID NO: 308465

SEQ ID NO: 723986 - RNA, 64 nt, hsa; identical to SEQ ID NO: 308466

SEQ ID NO: 723987 - RNA, 64 nt, hsa; identical to SEQ ID NO: 244542

SEQ ID NO: 723988 - RNA, 64 nt, hsa; identical to SEQ ID NO: 244543

SEQ ID NO: 723989 - RNA, 64 nt, hsa; identical to SEQ ID NO: 244544

SEQ ID NO: 723990 - RNA, 64 nt, hsa; identical to SEQ ID NO: 244545

SEQ ID NO: 723991 - RNA, 64 nt, hsa; identical to SEQ ID NO: 244546

SEQ ID NO: 723992 - RNA, 64 nt, hsa; identical to SEQ ID NO: 244547

SEQ ID NO: 723993 - RNA, 64 nt, hsa; identical to SEQ ID NO: 244548

SEQ ID NO: 723994 - RNA, 64 nt, hsa; identical to SEQ ID NO: 244549

SEQ ID NO: 723995 - RNA, 64 nt, hsa; identical to SEQ ID NO: 244550

SEQ ID NO: 723996 - RNA, 64 nt, hsa; identical to SEQ ID NO: 244551

SEQ ID NO: 723997 - RNA, 64 nt, hsa; identical to SEQ ID NO: 244552

SEQ ID NO: 723998 - RNA, 64 nt, hsa; identical to SEQ ID NO: 244553

SEQ ID NO: 723999 - RNA, 64 nt, hsa; identical to SEQ ID NO: 244554

SEQ ID NO: 724000 - RNA, 64 nt, hsa; identical to SEQ ID NO: 244555

SEQ ID NO: 724001 - RNA, 64 nt, hsa; identical to SEQ ID NO: 244556

SEQ ID NO: 724002 - RNA, 64 nt, hsa; identical to SEQ ID NO: 244557

SEQ ID NO: 724003 - RNA, 64 nt, hsa; identical to SEQ ID NO: 244558

SEQ ID NO: 724004 - RNA, 64 nt, hsa; identical to SEQ ID NO: 244559

SEQ ID NO: 724005 - RNA, 64 nt, hsa; identical to SEQ ID NO: 244560

SEQ ID NO: 724006 - RNA, 64 nt, hsa; identical to SEQ ID NO: 244561

SEQ ID NO: 724007 - RNA, 64 nt, hsa; identical to SEQ ID NO: 244562

SEQ ID NO: 724008 - RNA, 64 nt, hsa; identical to SEQ ID NO: 244563

SEQ ID NO: 724009 - RNA, 64 nt, hsa; identical to SEQ ID NO: 244564

SEQ ID NO: 724010 - RNA, 64 nt, hsa; identical to SEQ ID NO: 244565

SEQ ID NO: 724011 - RNA, 64 nt, hsa; identical to SEQ ID NO: 244566

SEQ ID NO: 724012 - RNA, 64 nt, hsa; identical to SEQ ID NO: 244567

SEQ ID NO: 724013 - RNA, 64 nt, hsa; identical to SEQ ID NO: 244568

SEQ ID NO: 724014 - RNA, 64 nt, hsa; identical to SEQ ID NO: 244569

SEQ ID NO: 724015 - RNA, 64 nt, hsa; identical to SEQ ID NO: 244570

SEQ ID NO: 724016 - RNA, 64 nt, hsa; identical to SEQ ID NO: 279561

SEQ ID NO: 724017 - RNA, 64 nt, hsa; identical to SEQ ID NO: 279562

SEQ ID NO: 724018 - RNA, 64 nt, hsa; identical to SEQ ID NO: 279563

SEQ ID NO: 724019 - RNA, 64 nt, hsa; identical to SEQ ID NO: 279564

SEQ ID NO: 724020 - RNA, 64 nt, hsa; identical to SEQ ID NO: 279565

SEQ ID NO: 724021 - RNA, 64 nt, hsa; identical to SEQ ID NO: 279566

SEQ ID NO: 724022 - RNA, 64 nt, hsa; identical to SEQ ID NO: 279567

SEQ ID NO: 724023 - RNA, 64 nt, hsa; identical to SEQ ID NO: 279568

SEQ ID NO: 724024 - RNA, 64 nt, hsa; identical to SEQ ID NO: 279569

SEQ ID NO: 724025 - RNA, 64 nt, hsa; identical to SEQ ID NO: 279570

SEQ ID NO: 724026 - RNA, 64 nt, hsa; identical to SEQ ID NO: 279571

SEQ ID NO: 724027 - RNA, 64 nt, hsa; identical to SEQ ID NO: 279572

SEQ ID NO: 724028 - RNA, 64 nt, hsa; identical to SEQ ID NO: 279573

SEQ ID NO: 724029 - RNA, 61 nt, hsa; identical to SEQ ID NO: 279574

SEQ ID NO: 724030 - RNA, 64 nt, hsa; identical to SEQ ID NO: 279575

SEQ ID NO: 724031 - RNA, 64 nt, hsa; identical to SEQ ID NO: 279576

SEQ ID NO: 724032 - RNA, 64 nt, hsa; identical to SEQ ID NO: 279577

SEQ ID NO: 724033 - RNA, 64 nt, hsa; identical to SEQ ID NO: 279578

SEQ ID NO: 724034 - RNA, 64 nt, hsa; identical to SEQ ID NO: 279579

SEQ ID NO: 724035 - RNA, 63 nt, hsa; identical to SEQ ID NO: 279580

SEQ ID NO: 724036 - RNA, 64 nt, hsa; identical to SEQ ID NO: 279581

SEQ ID NO: 724037 - RNA, 64 nt, hsa; identical to SEQ ID NO: 279582

SEQ ID NO: 724038 - RNA, 64 nt, hsa; identical to SEQ ID NO: 279583

SEQ ID NO: 724039 - RNA, 64 nt, hsa; identical to SEQ ID NO: 279584

SEQ ID NO: 724040 - RNA, 64 nt, hsa; identical to SEQ ID NO: 279585

SEQ ID NO: 724041 - RNA, 64 nt, hsa; identical to SEQ ID NO: 279586

SEQ ID NO: 724042 - RNA, 64 nt, hsa; identical to SEQ ID NO: 279587

SEQ ID NO: 724043 - RNA, 64 nt, hsa; identical to SEQ ID NO: 279588

SEQ ID NO: 724044 - RNA, 64 nt, hsa; identical to SEQ ID NO: 279589

SEQ ID NO: 724045 - RNA, 64 nt, hsa; identical to SEQ ID NO: 279590

SEQ ID NO: 724046 - RNA, 64 nt, hsa
uguuucauuuaaguuuccuacacgcuaacuucguuugugcgauugaaauaaaauugcaguauau

SEQ ID NO: 724047 - RNA, 64 nt, hsa
agggaccauuucuccccgagucucuuacacuuuauugugcgauguccacguuuuugugacucuu

SEQ ID NO: 724048 - RNA, 64 nt, hsa
ccgugcuacuaaaguggcagguuucugguagaaauugugcgaguccaauuuggaguuuuaaguu

SEQ ID NO: 724049 - RNA, 64 nt, hsa
agcaucccagggucuccagccuacagaugagcuguugugcgauuucuuagccuccauaaucaca

SEQ ID NO: 724050 - RNA, 64 nt, hsa
ggaaaaccugacucugugugucugcaacugaauguugugcgaguaauuuauuaacugucuuucu

SEQ ID NO: 724051 - RNA, 64 nt, hsa
uccccaugugcuuuagugggcuuugguuuucuuuuugugcgagugugugugagaauggcugugu

SEQ ID NO: 724052 - RNA, 64 nt, hsa
ggugaccgggggccagcccaggagggcgggugguuugugcgaguucccuugccacgcggggccc

SEQ ID NO: 724053 - RNA, 64 nt, hsa
gaaucucaggaugaggaugaugcucuuaaugaaauugugcgauguauuugugagauggaugagg

SEQ ID NO: 724054 - RNA, 64 nt, hsa
gcuaagguguaacacuuaaagcaauuuucucccauugugcgaacauuuuauuuuuuaaaaaaaa

SEQ ID NO: 724055 - RNA, 64 nt, hsa
gaaacacuucauauucccugaacuuuucuggauguugugcgaaccuguuguauuuuuuuuuuuc

SEQ ID NO: 724056 - RNA, 64 nt, hsa
ucagcugauuacaauaacaaaaggcggaauugaauugugcgaugccaacggccuucucauuuac

SEQ ID NO: 724057 - RNA, 64 nt, hsa
accagaaacgccuugccuucagcugaaccaccguuugugcgagcuggauguccuuuucaguaga

SEQ ID NO: 724058 - RNA, 64 nt, hsa
gcuaagcccccuacugagaaacuuccuuugagaauugugcgacuucacaaaaugcaaggugaac

SEQ ID NO: 724059 - RNA, 64 nt, hsa
ggaacuaaauggggcuaaccacuucaggugcagcuugugcgaggguagaugguuccugcacaca

SEQ ID NO: 724060 - RNA, 64 nt, hsa
acucagcugcaauucugagggggguuugggaggcuugugcgaggucucaggccuguguggggag

SEQ ID NO: 724061 - RNA, 64 nt, hsa
uugaucacugaucgaguaaggaaugaccuuuagauugugcgacuuuuguuuuuguuuuuuuaaa

SEQ ID NO: 724062 - RNA, 64 nt, hsa
cucacuaauuuguaggaaaaagcaaguucgucuguugugcgaaugacugaaugggacagaguug

SEQ ID NO: 724063 - RNA, 64 nt, hsa
uccguuuuuuaagccugaagagcuuauuacuuauuugugcgaagugccuuaugcuaugagacca

SEQ ID NO: 724064 - RNA, 64 nt, hsa
uccgaagucuccuccguggaccacagguggaucuuugugcgaacaacuugcauuucggaagcca

SEQ ID NO: 724065 - RNA, 64 nt, hsa
cuucauauauuuucuuaagauuacaucaagcuaauugugcgagcucaauucacuuuguaagaaa

SEQ ID NO: 724066 - RNA, 64 nt, hsa
cucagucuuaaacuucaguaugaaaccaguuuccuugugcgaugauggccacuaaagcauagua

SEQ ID NO: 724067 - RNA, 64 nt, hsa
gaaucuucuccgugcagccccuuggggcgcgaccuugugcgaggcccucggggcccacccacag

SEQ ID NO: 724068 - RNA, 64 nt, hsa
ccuguggcccagcccgccccauucaccuguggauuugugcgagaugcagccucagaaggaacaa

SEQ ID NO: 724069 - RNA, 64 nt, hsa
uccuccgugccgugcgacccccaccccaugacuauugugcgauucgugagcgccgcccgagcgg

SEQ ID NO: 724070 - RNA, 64 nt, hsa
uucagugucacucuguacccucaacauauaucccuugugcgauaaaaaaaaaaaaaaaaaaaaa

SEQ ID NO: 724071 - RNA, 64 nt, hsa
cuucaguuugcuccgcugccuccuacccagagguuugugcgagccuguguugcaggguuguaua

SEQ ID NO: 724072 - RNA, 64 nt, hsa
ggacugggagcagaggccccucacucaacgacguuugugcgacauaguauuguauccaccuuag

SEQ ID NO: 724073 - RNA, 64 nt, hsa
gauuauaaugagcuggccaugcacuuugaccgccuugugcgaaaacaccaccuggggcgcgucc

SEQ ID NO: 724074 - RNA, 64 nt, hsa
cuguccauuuucuuuuaaaguuauaaacacguacuugugcgaauuauuuuuuuaaagugauuug

SEQ ID NO: 724075 - RNA, 64 nt, hsa; identical to SEQ ID NO: 72787

SEQ ID NO: 724076 - RNA, 64 nt, hsa; identical to SEQ ID NO: 72788

SEQ ID NO: 724077 - RNA, 64 nt, hsa; identical to SEQ ID NO: 72789

SEQ ID NO: 724078 - RNA, 64 nt, hsa; identical to SEQ ID NO: 72790

SEQ ID NO: 724079 - RNA, 64 nt, hsa; identical to SEQ ID NO: 72791

SEQ ID NO: 724080 - RNA, 64 nt, hsa; identical to SEQ ID NO: 72792

SEQ ID NO: 724081 - RNA, 64 nt, hsa; identical to SEQ ID NO: 72793

SEQ ID NO: 724082 - RNA, 64 nt, hsa; identical to SEQ ID NO: 72794

SEQ ID NO: 724083 - RNA, 64 nt, hsa; identical to SEQ ID NO: 72795

SEQ ID NO: 724084 - RNA, 64 nt, hsa; identical to SEQ ID NO: 72796

SEQ ID NO: 724085 - RNA, 64 nt, hsa; identical to SEQ ID NO: 72797

SEQ ID NO: 724086 - RNA, 64 nt, hsa; identical to SEQ ID NO: 72798

SEQ ID NO: 724087 - RNA, 64 nt, hsa; identical to SEQ ID NO: 72799

SEQ ID NO: 724088 - RNA, 64 nt, hsa; identical to SEQ ID NO: 72800

SEQ ID NO: 724089 - RNA, 64 nt, hsa; identical to SEQ ID NO: 72801

SEQ ID NO: 724090 - RNA, 64 nt, hsa; identical to SEQ ID NO: 72802

SEQ ID NO: 724091 - RNA, 64 nt, hsa; identical to SEQ ID NO: 72803

SEQ ID NO: 724092 - RNA, 64 nt, hsa; identical to SEQ ID NO: 72804

SEQ ID NO: 724093 - RNA, 64 nt, hsa; identical to SEQ ID NO: 72805

SEQ ID NO: 724094 - RNA, 64 nt, hsa; identical to SEQ ID NO: 72806

SEQ ID NO: 724095 - RNA, 64 nt, hsa; identical to SEQ ID NO: 72807

SEQ ID NO: 724096 - RNA, 64 nt, hsa; identical to SEQ ID NO: 72808

SEQ ID NO: 724097 - RNA, 64 nt, hsa; identical to SEQ ID NO: 72809

SEQ ID NO: 724098 - RNA, 64 nt, hsa; identical to SEQ ID NO: 72810

SEQ ID NO: 724099 - RNA, 64 nt, hsa; identical to SEQ ID NO: 72811

SEQ ID NO: 724100 - RNA, 64 nt, hsa; identical to SEQ ID NO: 72812

SEQ ID NO: 724101 - RNA, 64 nt, hsa; identical to SEQ ID NO: 72813

SEQ ID NO: 724102 - RNA, 64 nt, hsa; identical to SEQ ID NO: 72814

SEQ ID NO: 724103 - RNA, 64 nt, hsa; identical to SEQ ID NO: 72815

SEQ ID NO: 724104 - RNA, 64 nt, hsa; identical to SEQ ID NO: 72816

SEQ ID NO: 724105 - RNA, 64 nt, hsa; identical to SEQ ID NO: 72817

SEQ ID NO: 724106 - RNA, 64 nt, hsa; identical to SEQ ID NO: 72818

SEQ ID NO: 724107 - RNA, 64 nt, hsa; identical to SEQ ID NO: 72819

SEQ ID NO: 724108 - RNA, 64 nt, hsa; identical to SEQ ID NO: 72820

SEQ ID NO: 724109 - RNA, 64 nt, hsa; identical to SEQ ID NO: 72821

SEQ ID NO: 724110 - RNA, 64 nt, hsa; identical to SEQ ID NO: 72822

SEQ ID NO: 724111 - RNA, 64 nt, hsa; identical to SEQ ID NO: 72823

SEQ ID NO: 724112 - RNA, 64 nt, hsa; identical to SEQ ID NO: 72824

SEQ ID NO: 724113 - RNA, 64 nt, hsa; identical to SEQ ID NO: 72825

SEQ ID NO: 724114 - RNA, 64 nt, hsa; identical to SEQ ID NO: 72826

SEQ ID NO: 724115 - RNA, 64 nt, hsa; identical to SEQ ID NO: 72827

SEQ ID NO: 724116 - RNA, 64 nt, hsa; identical to SEQ ID NO: 72828

SEQ ID NO: 724117 - RNA, 64 nt, hsa; identical to SEQ ID NO: 72829

SEQ ID NO: 724118 - RNA, 64 nt, hsa; identical to SEQ ID NO: 72830

SEQ ID NO: 724119 - RNA, 64 nt, hsa; identical to SEQ ID NO: 72831

SEQ ID NO: 724120 - RNA, 64 nt, hsa; identical to SEQ ID NO: 72832

SEQ ID NO: 724121 - RNA, 64 nt, hsa; identical to SEQ ID NO: 72833

SEQ ID NO: 724122 - RNA, 64 nt, hsa; identical to SEQ ID NO: 72834

SEQ ID NO: 724123 - RNA, 64 nt, hsa; identical to SEQ ID NO: 72835

SEQ ID NO: 724124 - RNA, 64 nt, hsa; identical to SEQ ID NO: 72836

SEQ ID NO: 724125 - RNA, 64 nt, hsa; identical to SEQ ID NO: 72837

SEQ ID NO: 724126 - RNA, 64 nt, hsa; identical to SEQ ID NO: 72838

SEQ ID NO: 724127 - RNA, 64 nt, hsa; identical to SEQ ID NO: 72839

SEQ ID NO: 724128 - RNA, 64 nt, hsa; identical to SEQ ID NO: 72840

SEQ ID NO: 724129 - RNA, 64 nt, hsa; identical to SEQ ID NO: 72841

SEQ ID NO: 724130 - RNA, 64 nt, hsa; identical to SEQ ID NO: 101831

SEQ ID NO: 724131 - RNA, 64 nt, hsa; identical to SEQ ID NO: 101832

SEQ ID NO: 724132 - RNA, 64 nt, hsa; identical to SEQ ID NO: 101833

SEQ ID NO: 724133 - RNA, 64 nt, hsa; identical to SEQ ID NO: 101834

SEQ ID NO: 724134 - RNA, 61 nt, hsa; identical to SEQ ID NO: 101835

SEQ ID NO: 724135 - RNA, 64 nt, hsa; identical to SEQ ID NO: 101836

SEQ ID NO: 724136 - RNA, 64 nt, hsa; identical to SEQ ID NO: 101837

SEQ ID NO: 724137 - RNA, 64 nt, hsa; identical to SEQ ID NO: 101838

SEQ ID NO: 724138 - RNA, 64 nt, hsa; identical to SEQ ID NO: 101839

SEQ ID NO: 724139 - RNA, 64 nt, hsa; identical to SEQ ID NO: 101840

SEQ ID NO: 724140 - RNA, 64 nt, hsa; identical to SEQ ID NO: 101841

SEQ ID NO: 724141 - RNA, 64 nt, hsa; identical to SEQ ID NO: 101842

SEQ ID NO: 724142 - RNA, 64 nt, hsa; identical to SEQ ID NO: 101843

SEQ ID NO: 724143 - RNA, 64 nt, hsa; identical to SEQ ID NO: 101844

SEQ ID NO: 724144 - RNA, 64 nt, hsa; identical to SEQ ID NO: 101845

SEQ ID NO: 724145 - RNA, 64 nt, hsa; identical to SEQ ID NO: 101846

SEQ ID NO: 724146 - RNA, 64 nt, hsa; identical to SEQ ID NO: 101847

SEQ ID NO: 724147 - RNA, 64 nt, hsa; identical to SEQ ID NO: 101848

SEQ ID NO: 724148 - RNA, 64 nt, hsa; identical to SEQ ID NO: 101849

SEQ ID NO: 724149 - RNA, 64 nt, hsa; identical to SEQ ID NO: 101850

SEQ ID NO: 724150 - RNA, 64 nt, hsa; identical to SEQ ID NO: 101851

SEQ ID NO: 724151 - RNA, 64 nt, hsa; identical to SEQ ID NO: 101852

SEQ ID NO: 724152 - RNA, 64 nt, hsa; identical to SEQ ID NO: 101853

SEQ ID NO: 724153 - RNA, 64 nt, hsa; identical to SEQ ID NO: 101854

SEQ ID NO: 724154 - RNA, 64 nt, hsa; identical to SEQ ID NO: 125569

SEQ ID NO: 724155 - RNA, 64 nt, hsa; identical to SEQ ID NO: 125570

SEQ ID NO: 724156 - RNA, 64 nt, hsa; identical to SEQ ID NO: 125571

SEQ ID NO: 724157 - RNA, 64 nt, hsa; identical to SEQ ID NO: 125572

SEQ ID NO: 724158 - RNA, 64 nt, hsa; identical to SEQ ID NO: 125573

SEQ ID NO: 724159 - RNA, 64 nt, hsa; identical to SEQ ID NO: 125574

SEQ ID NO: 724160 - RNA, 64 nt, hsa; identical to SEQ ID NO: 125575

SEQ ID NO: 724161 - RNA, 64 nt, hsa; identical to SEQ ID NO: 125576

SEQ ID NO: 724162 - RNA, 64 nt, hsa; identical to SEQ ID NO: 125577

SEQ ID NO: 724163 - RNA, 64 nt, hsa; identical to SEQ ID NO: 125578

SEQ ID NO: 724164 - RNA, 64 nt, hsa; identical to SEQ ID NO: 125579

SEQ ID NO: 724165 - RNA, 64 nt, hsa; identical to SEQ ID NO: 125580

SEQ ID NO: 724166 - RNA, 64 nt, hsa; identical to SEQ ID NO: 125581

SEQ ID NO: 724167 - RNA, 64 nt, hsa; identical to SEQ ID NO: 125582

SEQ ID NO: 724168 - RNA, 64 nt, hsa; identical to SEQ ID NO: 125583

SEQ ID NO: 724169 - RNA, 64 nt, hsa; identical to SEQ ID NO: 125584

SEQ ID NO: 724170 - RNA, 64 nt, hsa; identical to SEQ ID NO: 125585

SEQ ID NO: 724171 - RNA, 64 nt, hsa; identical to SEQ ID NO: 125586

SEQ ID NO: 724172 - RNA, 64 nt, hsa; identical to SEQ ID NO: 125587

SEQ ID NO: 724173 - RNA, 64 nt, hsa; identical to SEQ ID NO: 125588

SEQ ID NO: 724174 - RNA, 64 nt, hsa; identical to SEQ ID NO: 125589

SEQ ID NO: 724175 - RNA, 64 nt, hsa; identical to SEQ ID NO: 125590

SEQ ID NO: 724176 - RNA, 64 nt, hsa; identical to SEQ ID NO: 125591

SEQ ID NO: 724177 - RNA, 64 nt, hsa; identical to SEQ ID NO: 125592

SEQ ID NO: 724178 - RNA, 64 nt, hsa; identical to SEQ ID NO: 125593

SEQ ID NO: 724179 - RNA, 64 nt, hsa; identical to SEQ ID NO: 125594

SEQ ID NO: 724180 - RNA, 64 nt, hsa; identical to SEQ ID NO: 125595

SEQ ID NO: 724181 - RNA, 64 nt, hsa; identical to SEQ ID NO: 125596

SEQ ID NO: 724182 - RNA, 64 nt, hsa; identical to SEQ ID NO: 125597

SEQ ID NO: 724183 - RNA, 64 nt, hsa; identical to SEQ ID NO: 125598

SEQ ID NO: 724184 - RNA, 64 nt, hsa; identical to SEQ ID NO: 125599

SEQ ID NO: 724185 - RNA, 64 nt, hsa; identical to SEQ ID NO: 125600

SEQ ID NO: 724186 - RNA, 64 nt, hsa; identical to SEQ ID NO: 125601

SEQ ID NO: 724187 - RNA, 64 nt, hsa; identical to SEQ ID NO: 125602

SEQ ID NO: 724188 - RNA, 64 nt, hsa; identical to SEQ ID NO: 125603

SEQ ID NO: 724189 - RNA, 64 nt, hsa; identical to SEQ ID NO: 125604

SEQ ID NO: 724190 - RNA, 64 nt, hsa; identical to SEQ ID NO: 125605

SEQ ID NO: 724191 - RNA, 64 nt, hsa; identical to SEQ ID NO: 125606

SEQ ID NO: 724192 - RNA, 64 nt, hsa; identical to SEQ ID NO: 125607

SEQ ID NO: 724193 - RNA, 64 nt, hsa; identical to SEQ ID NO: 125608

SEQ ID NO: 724194 - RNA, 64 nt, hsa; identical to SEQ ID NO: 125609

SEQ ID NO: 724195 - RNA, 64 nt, hsa; identical to SEQ ID NO: 125610

SEQ ID NO: 724196 - RNA, 64 nt, hsa; identical to SEQ ID NO: 125611

SEQ ID NO: 724197 - RNA, 64 nt, hsa; identical to SEQ ID NO: 125612

SEQ ID NO: 724198 - RNA, 64 nt, hsa; identical to SEQ ID NO: 125613

SEQ ID NO: 724199 - RNA, 64 nt, hsa; identical to SEQ ID NO: 125614

SEQ ID NO: 724200 - RNA, 64 nt, hsa; identical to SEQ ID NO: 125615

SEQ ID NO: 724201 - RNA, 64 nt, hsa; identical to SEQ ID NO: 125616

SEQ ID NO: 724202 - RNA, 64 nt, hsa; identical to SEQ ID NO: 125617

SEQ ID NO: 724203 - RNA, 64 nt, hsa; identical to SEQ ID NO: 125618

SEQ ID NO: 724204 - RNA, 64 nt, hsa; identical to SEQ ID NO: 125619

SEQ ID NO: 724205 - RNA, 64 nt, hsa; identical to SEQ ID NO: 125620

SEQ ID NO: 724206 - RNA, 64 nt, hsa; identical to SEQ ID NO: 125621

SEQ ID NO: 724207 - RNA, 64 nt, hsa; identical to SEQ ID NO: 125622

SEQ ID NO: 724208 - RNA, 64 nt, hsa; identical to SEQ ID NO: 125623

SEQ ID NO: 724209 - RNA, 64 nt, hsa; identical to SEQ ID NO: 125624

SEQ ID NO: 724210 - RNA, 64 nt, hsa; identical to SEQ ID NO: 125625

SEQ ID NO: 724211 - RNA, 64 nt, hsa; identical to SEQ ID NO: 125626

SEQ ID NO: 724212 - RNA, 64 nt, hsa; identical to SEQ ID NO: 125627

SEQ ID NO: 724213 - RNA, 64 nt, hsa; identical to SEQ ID NO: 125628

SEQ ID NO: 724214 - RNA, 64 nt, hsa; identical to SEQ ID NO: 125629

SEQ ID NO: 724215 - RNA, 64 nt, hsa; identical to SEQ ID NO: 125630

SEQ ID NO: 724216 - RNA, 64 nt, hsa; identical to SEQ ID NO: 125631

SEQ ID NO: 724217 - RNA, 64 nt, hsa; identical to SEQ ID NO: 125632

SEQ ID NO: 724218 - RNA, 64 nt, hsa; identical to SEQ ID NO: 125633

SEQ ID NO: 724219 - RNA, 64 nt, hsa; identical to SEQ ID NO: 125634

SEQ ID NO: 724220 - RNA, 64 nt, hsa; identical to SEQ ID NO: 125635

SEQ ID NO: 724221 - RNA, 64 nt, hsa; identical to SEQ ID NO: 125636

SEQ ID NO: 724222 - RNA, 64 nt, hsa; identical to SEQ ID NO: 125637

SEQ ID NO: 724223 - RNA, 64 nt, hsa; identical to SEQ ID NO: 125638

SEQ ID NO: 724224 - RNA, 64 nt, hsa; identical to SEQ ID NO: 125639

SEQ ID NO: 724225 - RNA, 64 nt, hsa; identical to SEQ ID NO: 125640

SEQ ID NO: 724226 - RNA, 64 nt, hsa; identical to SEQ ID NO: 125641

SEQ ID NO: 724227 - RNA, 64 nt, hsa; identical to SEQ ID NO: 125642

SEQ ID NO: 724228 - RNA, 64 nt, hsa; identical to SEQ ID NO: 259559

SEQ ID NO: 724229 - RNA, 64 nt, hsa; identical to SEQ ID NO: 259560

SEQ ID NO: 724230 - RNA, 64 nt, hsa; identical to SEQ ID NO: 259561

SEQ ID NO: 724231 - RNA, 64 nt, hsa; identical to SEQ ID NO: 259562

SEQ ID NO: 724232 - RNA, 64 nt, hsa; identical to SEQ ID NO: 259563

SEQ ID NO: 724233 - RNA, 64 nt, hsa; identical to SEQ ID NO: 259564

SEQ ID NO: 724234 - RNA, 64 nt, hsa; identical to SEQ ID NO: 259565

SEQ ID NO: 724235 - RNA, 64 nt, hsa; identical to SEQ ID NO: 259566

SEQ ID NO: 724236 - RNA, 64 nt, hsa; identical to SEQ ID NO: 259567

SEQ ID NO: 724237 - RNA, 64 nt, hsa; identical to SEQ ID NO: 259568

SEQ ID NO: 724238 - RNA, 64 nt, hsa; identical to SEQ ID NO: 259569

SEQ ID NO: 724239 - RNA, 64 nt, hsa; identical to SEQ ID NO: 259570

SEQ ID NO: 724240 - RNA, 64 nt, hsa; identical to SEQ ID NO: 259571

SEQ ID NO: 724241 - RNA, 64 nt, hsa; identical to SEQ ID NO: 259572

SEQ ID NO: 724242 - RNA, 64 nt, hsa; identical to SEQ ID NO: 259573

SEQ ID NO: 724243 - RNA, 64 nt, hsa; identical to SEQ ID NO: 259574

SEQ ID NO: 724244 - RNA, 64 nt, hsa; identical to SEQ ID NO: 259575

SEQ ID NO: 724245 - RNA, 64 nt, hsa; identical to SEQ ID NO: 259576

SEQ ID NO: 724246 - RNA, 64 nt, hsa; identical to SEQ ID NO: 259577

SEQ ID NO: 724247 - RNA, 64 nt, hsa; identical to SEQ ID NO: 259578

SEQ ID NO: 724248 - RNA, 64 nt, hsa; identical to SEQ ID NO: 259579

SEQ ID NO: 724249 - RNA, 64 nt, hsa; identical to SEQ ID NO: 259580

SEQ ID NO: 724250 - RNA, 64 nt, hsa; identical to SEQ ID NO: 376863

SEQ ID NO: 724251 - RNA, 64 nt, hsa; identical to SEQ ID NO: 376864

SEQ ID NO: 724252 - RNA, 64 nt, hsa; identical to SEQ ID NO: 376865

SEQ ID NO: 724253 - RNA, 64 nt, hsa; identical to SEQ ID NO: 376866

SEQ ID NO: 724254 - RNA, 64 nt, hsa; identical to SEQ ID NO: 376867

SEQ ID NO: 724255 - RNA, 64 nt, hsa; identical to SEQ ID NO: 376868

SEQ ID NO: 724256 - RNA, 64 nt, hsa; identical to SEQ ID NO: 376869

SEQ ID NO: 724257 - RNA, 64 nt, hsa; identical to SEQ ID NO: 376870

SEQ ID NO: 724258 - RNA, 64 nt, hsa; identical to SEQ ID NO: 376871

SEQ ID NO: 724259 - RNA, 64 nt, hsa; identical to SEQ ID NO: 376872

SEQ ID NO: 724260 - RNA, 64 nt, hsa; identical to SEQ ID NO: 376873

SEQ ID NO: 724261 - RNA, 64 nt, hsa; identical to SEQ ID NO: 376874

SEQ ID NO: 724262 - RNA, 64 nt, hsa; identical to SEQ ID NO: 376875

SEQ ID NO: 724263 - RNA, 64 nt, hsa; identical to SEQ ID NO: 376876

SEQ ID NO: 724264 - RNA, 64 nt, hsa; identical to SEQ ID NO: 376877

SEQ ID NO: 724265 - RNA, 64 nt, hsa; identical to SEQ ID NO: 376878

SEQ ID NO: 724266 - RNA, 64 nt, hsa; identical to SEQ ID NO: 376879

SEQ ID NO: 724267 - RNA, 64 nt, hsa; identical to SEQ ID NO: 376880

SEQ ID NO: 724268 - RNA, 64 nt, hsa; identical to SEQ ID NO: 376881

SEQ ID NO: 724269 - RNA, 64 nt, hsa
uguuccuccuccccucuccuagcagcccuaaugucugaccuagccuaucaagccuuaggcgcug

SEQ ID NO: 724270 - RNA, 64 nt, hsa
uuuccuacccuuuaaagguaacuucucccuucuccugaccuacuuccuccuagcaaccaacuuu

SEQ ID NO: 724271 - RNA, 64 nt, hsa
ucccuuuugcggaugggagggguaacuugcaccucugaccuaucacuuccacugcaccccgucu

SEQ ID NO: 724272 - RNA, 64 nt, hsa
ugcucaaugacucucuggugagcgaggacauucucugaccuacucgagggacuuaagaugcuac

SEQ ID NO: 724273 - RNA, 64 nt, hsa
gccugaccuaagccugguaguuaaaauucgaccccugaccuagcaacugauguuaucuauagau

SEQ ID NO: 724274 - RNA, 64 nt, hsa
aaggaaccagacccgaaaccaggccugggccggccugaccuaagccugguaguuaaaauucgac

SEQ ID NO: 724275 - RNA, 64 nt, hsa; identical to SEQ ID NO: 571770

SEQ ID NO: 724276 - RNA, 64 nt, hsa; identical to SEQ ID NO: 571771

SEQ ID NO: 724277 - RNA, 64 nt, hsa; identical to SEQ ID NO: 571772

SEQ ID NO: 724278 - RNA, 64 nt, hsa; identical to SEQ ID NO: 571773

SEQ ID NO: 724279 - RNA, 64 nt, hsa; identical to SEQ ID NO: 111305

SEQ ID NO: 724280 - RNA, 64 nt, hsa; identical to SEQ ID NO: 111306

SEQ ID NO: 724281 - RNA, 64 nt, hsa; identical to SEQ ID NO: 111307

SEQ ID NO: 724282 - RNA, 64 nt, hsa; identical to SEQ ID NO: 111308

SEQ ID NO: 724283 - RNA, 64 nt, hsa; identical to SEQ ID NO: 111309

SEQ ID NO: 724284 - RNA, 64 nt, hsa; identical to SEQ ID NO: 111310

SEQ ID NO: 724285 - RNA, 64 nt, hsa; identical to SEQ ID NO: 111311

SEQ ID NO: 724286 - RNA, 64 nt, hsa; identical to SEQ ID NO: 111312

SEQ ID NO: 724287 - RNA, 64 nt, hsa; identical to SEQ ID NO: 111313

SEQ ID NO: 724288 - RNA, 64 nt, hsa; identical to SEQ ID NO: 111314

SEQ ID NO: 724289 - RNA, 64 nt, hsa; identical to SEQ ID NO: 111315

SEQ ID NO: 724290 - RNA, 64 nt, hsa; identical to SEQ ID NO: 111316

SEQ ID NO: 724291 - RNA, 64 nt, hsa; identical to SEQ ID NO: 111317

SEQ ID NO: 724292 - RNA, 64 nt, hsa; identical to SEQ ID NO: 111318

SEQ ID NO: 724293 - RNA, 64 nt, hsa; identical to SEQ ID NO: 111319

SEQ ID NO: 724294 - RNA, 64 nt, hsa; identical to SEQ ID NO: 111320

SEQ ID NO: 724295 - RNA, 64 nt, hsa; identical to SEQ ID NO: 111321

SEQ ID NO: 724296 - RNA, 64 nt, hsa; identical to SEQ ID NO: 111322

SEQ ID NO: 724297 - RNA, 64 nt, hsa; identical to SEQ ID NO: 111323

SEQ ID NO: 724298 - RNA, 64 nt, hsa; identical to SEQ ID NO: 111324

SEQ ID NO: 724299 - RNA, 64 nt, hsa; identical to SEQ ID NO: 111325

SEQ ID NO: 724300 - RNA, 64 nt, hsa; identical to SEQ ID NO: 111326

SEQ ID NO: 724301 - RNA, 64 nt, hsa; identical to SEQ ID NO: 111327

SEQ ID NO: 724302 - RNA, 64 nt, hsa; identical to SEQ ID NO: 111328

SEQ ID NO: 724303 - RNA, 64 nt, hsa; identical to SEQ ID NO: 111329

SEQ ID NO: 724304 - RNA, 64 nt, hsa; identical to SEQ ID NO: 111330

SEQ ID NO: 724305 - RNA, 64 nt, hsa; identical to SEQ ID NO: 111331

SEQ ID NO: 724306 - RNA, 64 nt, hsa; identical to SEQ ID NO: 111332

SEQ ID NO: 724307 - RNA, 64 nt, hsa; identical to SEQ ID NO: 111333

SEQ ID NO: 724308 - RNA, 64 nt, hsa; identical to SEQ ID NO: 111334

SEQ ID NO: 724309 - RNA, 57 nt, hsa; identical to SEQ ID NO: 111335

SEQ ID NO: 724310 - RNA, 64 nt, hsa; identical to SEQ ID NO: 111336

SEQ ID NO: 724311 - RNA, 64 nt, hsa; identical to SEQ ID NO: 111337

SEQ ID NO: 724312 - RNA, 64 nt, hsa; identical to SEQ ID NO: 111338

SEQ ID NO: 724313 - RNA, 64 nt, hsa; identical to SEQ ID NO: 111339

SEQ ID NO: 724314 - RNA, 64 nt, hsa; identical to SEQ ID NO: 111340

SEQ ID NO: 724315 - RNA, 64 nt, hsa; identical to SEQ ID NO: 111341

SEQ ID NO: 724316 - RNA, 64 nt, hsa; identical to SEQ ID NO: 111342

SEQ ID NO: 724317 - RNA, 64 nt, hsa; identical to SEQ ID NO: 111343

SEQ ID NO: 724318 - RNA, 64 nt, hsa; identical to SEQ ID NO: 111344

SEQ ID NO: 724319 - RNA, 64 nt, hsa; identical to SEQ ID NO: 111345

SEQ ID NO: 724320 - RNA, 64 nt, hsa; identical to SEQ ID NO: 111346

SEQ ID NO: 724321 - RNA, 57 nt, hsa; identical to SEQ ID NO: 111347

SEQ ID NO: 724322 - RNA, 64 nt, hsa; identical to SEQ ID NO: 111348

SEQ ID NO: 724323 - RNA, 64 nt, hsa; identical to SEQ ID NO: 111349

SEQ ID NO: 724324 - RNA, 64 nt, hsa; identical to SEQ ID NO: 111350

SEQ ID NO: 724325 - RNA, 64 nt, hsa; identical to SEQ ID NO: 315746

SEQ ID NO: 724326 - RNA, 64 nt, hsa; identical to SEQ ID NO: 315747

SEQ ID NO: 724327 - RNA, 64 nt, hsa; identical to SEQ ID NO: 315748

SEQ ID NO: 724328 - RNA, 64 nt, hsa; identical to SEQ ID NO: 315749

SEQ ID NO: 724329 - RNA, 64 nt, hsa; identical to SEQ ID NO: 218107

SEQ ID NO: 724330 - RNA, 64 nt, hsa; identical to SEQ ID NO: 218108

SEQ ID NO: 724331 - RNA, 64 nt, hsa; identical to SEQ ID NO: 218109

SEQ ID NO: 724332 - RNA, 64 nt, hsa; identical to SEQ ID NO: 218110

SEQ ID NO: 724333 - RNA, 64 nt, hsa; identical to SEQ ID NO: 218111

SEQ ID NO: 724334 - RNA, 64 nt, hsa; identical to SEQ ID NO: 218112

SEQ ID NO: 724335 - RNA, 64 nt, hsa; identical to SEQ ID NO: 218113

SEQ ID NO: 724336 - RNA, 64 nt, hsa; identical to SEQ ID NO: 218114

SEQ ID NO: 724337 - RNA, 64 nt, hsa; identical to SEQ ID NO: 218115

SEQ ID NO: 724338 - RNA, 64 nt, hsa; identical to SEQ ID NO: 218116

SEQ ID NO: 724339 - RNA, 64 nt, hsa; identical to SEQ ID NO: 218117

SEQ ID NO: 724340 - RNA, 64 nt, hsa; identical to SEQ ID NO: 218118

SEQ ID NO: 724341 - RNA, 64 nt, hsa; identical to SEQ ID NO: 218119

SEQ ID NO: 724342 - RNA, 64 nt, hsa; identical to SEQ ID NO: 218120

SEQ ID NO: 724343 - RNA, 64 nt, hsa; identical to SEQ ID NO: 218121

SEQ ID NO: 724344 - RNA, 64 nt, hsa; identical to SEQ ID NO: 218122

SEQ ID NO: 724345 - RNA, 64 nt, hsa; identical to SEQ ID NO: 218123

SEQ ID NO: 724346 - RNA, 64 nt, hsa; identical to SEQ ID NO: 218124

SEQ ID NO: 724347 - RNA, 64 nt, hsa; identical to SEQ ID NO: 218125

SEQ ID NO: 724348 - RNA, 64 nt, hsa; identical to SEQ ID NO: 218126

SEQ ID NO: 724349 - RNA, 64 nt, hsa
uuuaaauguucuaacauaagaccuguucucucuagccauugauuuaccaggcuuucugaaagau

SEQ ID NO: 724350 - RNA, 64 nt, hsa
cugguaggaauaaagguagggguucagaaauggugccauugaagccacaaagccgguaaaugcc

SEQ ID NO: 724351 - RNA, 64 nt, hsa
cuuagccaguuggauaaauauuuggggucaccuagccauugaaagcagaaagcaguagugacac

SEQ ID NO: 724352 - RNA, 64 nt, hsa
gaaagcaguagugacacagcuuucccuucaaagagccauugagaaacauuucucaaacaggaaa

SEQ ID NO: 724353 - RNA, 64 nt, hsa
cuggcucuaucagaguuguuucaugcucaacaaugccauugaagugcacgguguguugccacga

SEQ ID NO: 724354 - RNA, 64 nt, hsa
accacaccuggccccaagcuugaauuuucauucugccauugacuuggcauuuaccuuggguaag

SEQ ID NO: 724355 - RNA, 64 nt, hsa; identical to SEQ ID NO: 309788

SEQ ID NO: 724356 - RNA, 64 nt, hsa; identical to SEQ ID NO: 309789

SEQ ID NO: 724357 - RNA, 64 nt, hsa; identical to SEQ ID NO: 309790

SEQ ID NO: 724358 - RNA, 64 nt, hsa; identical to SEQ ID NO: 309791

SEQ ID NO: 724359 - RNA, 64 nt, hsa; identical to SEQ ID NO: 309792

SEQ ID NO: 724360 - RNA, 64 nt, hsa; identical to SEQ ID NO: 309793

SEQ ID NO: 724361 - RNA, 64 nt, hsa; identical to SEQ ID NO: 309794

SEQ ID NO: 724362 - RNA, 64 nt, hsa; identical to SEQ ID NO: 309795

SEQ ID NO: 724363 - RNA, 64 nt, hsa; identical to SEQ ID NO: 309796

SEQ ID NO: 724364 - RNA, 64 nt, hsa; identical to SEQ ID NO: 309797

SEQ ID NO: 724365 - RNA, 64 nt, hsa; identical to SEQ ID NO: 309798

SEQ ID NO: 724366 - RNA, 64 nt, hsa; identical to SEQ ID NO: 309799

SEQ ID NO: 724367 - RNA, 64 nt, hsa; identical to SEQ ID NO: 309800

SEQ ID NO: 724368 - RNA, 64 nt, hsa; identical to SEQ ID NO: 309801

SEQ ID NO: 724369 - RNA, 64 nt, hsa; identical to SEQ ID NO: 309802

SEQ ID NO: 724370 - RNA, 64 nt, hsa; identical to SEQ ID NO: 309803

SEQ ID NO: 724371 - RNA, 64 nt, hsa; identical to SEQ ID NO: 309804

SEQ ID NO: 724372 - RNA, 64 nt, hsa; identical to SEQ ID NO: 309805

SEQ ID NO: 724373 - RNA, 64 nt, hsa; identical to SEQ ID NO: 309806

SEQ ID NO: 724374 - RNA, 64 nt, hsa; identical to SEQ ID NO: 309807

SEQ ID NO: 724375 - RNA, 64 nt, hsa; identical to SEQ ID NO: 309808

SEQ ID NO: 724376 - RNA, 64 nt, hsa; identical to SEQ ID NO: 309809

SEQ ID NO: 724377 - RNA, 64 nt, hsa; identical to SEQ ID NO: 309810

SEQ ID NO: 724378 - RNA, 64 nt, hsa; identical to SEQ ID NO: 309811

SEQ ID NO: 724379 - RNA, 64 nt, hsa; identical to SEQ ID NO: 309812

SEQ ID NO: 724380 - RNA, 64 nt, hsa; identical to SEQ ID NO: 309813

SEQ ID NO: 724381 - RNA, 64 nt, hsa; identical to SEQ ID NO: 309814

SEQ ID NO: 724382 - RNA, 64 nt, hsa; identical to SEQ ID NO: 309815

SEQ ID NO: 724383 - RNA, 64 nt, hsa; identical to SEQ ID NO: 309816

SEQ ID NO: 724384 - RNA, 64 nt, hsa; identical to SEQ ID NO: 309817

SEQ ID NO: 724385 - RNA, 64 nt, hsa; identical to SEQ ID NO: 309818

SEQ ID NO: 724386 - RNA, 64 nt, hsa; identical to SEQ ID NO: 309819

SEQ ID NO: 724387 - RNA, 64 nt, hsa; identical to SEQ ID NO: 309820

SEQ ID NO: 724388 - RNA, 64 nt, hsa; identical to SEQ ID NO: 309821

SEQ ID NO: 724389 - RNA, 64 nt, hsa; identical to SEQ ID NO: 309822

SEQ ID NO: 724390 - RNA, 64 nt, hsa; identical to SEQ ID NO: 309823

SEQ ID NO: 724391 - RNA, 64 nt, hsa; identical to SEQ ID NO: 309824

SEQ ID NO: 724392 - RNA, 64 nt, hsa; identical to SEQ ID NO: 309825

SEQ ID NO: 724393 - RNA, 64 nt, hsa; identical to SEQ ID NO: 309826

SEQ ID NO: 724394 - RNA, 64 nt, hsa; identical to SEQ ID NO: 309827

SEQ ID NO: 724395 - RNA, 64 nt, hsa; identical to SEQ ID NO: 309828

SEQ ID NO: 724396 - RNA, 64 nt, hsa; identical to SEQ ID NO: 309829

SEQ ID NO: 724397 - RNA, 64 nt, hsa; identical to SEQ ID NO: 309830

SEQ ID NO: 724398 - RNA, 64 nt, hsa; identical to SEQ ID NO: 309831

SEQ ID NO: 724399 - RNA, 64 nt, hsa; identical to SEQ ID NO: 309832

SEQ ID NO: 724400 - RNA, 64 nt, hsa; identical to SEQ ID NO: 309833

SEQ ID NO: 724401 - RNA, 64 nt, hsa; identical to SEQ ID NO: 309834

SEQ ID NO: 724402 - RNA, 64 nt, hsa; identical to SEQ ID NO: 309835

SEQ ID NO: 724403 - RNA, 64 nt, hsa; identical to SEQ ID NO: 309836

SEQ ID NO: 724404 - RNA, 64 nt, hsa; identical to SEQ ID NO: 309837

SEQ ID NO: 724405 - RNA, 64 nt, hsa; identical to SEQ ID NO: 309838

SEQ ID NO: 724406 - RNA, 64 nt, hsa; identical to SEQ ID NO: 309839

SEQ ID NO: 724407 - RNA, 64 nt, hsa; identical to SEQ ID NO: 309840

SEQ ID NO: 724408 - RNA, 64 nt, hsa; identical to SEQ ID NO: 309841

SEQ ID NO: 724409 - RNA, 64 nt, hsa; identical to SEQ ID NO: 309842

SEQ ID NO: 724410 - RNA, 64 nt, hsa; identical to SEQ ID NO: 309843

SEQ ID NO: 724411 - RNA, 64 nt, hsa; identical to SEQ ID NO: 309844

SEQ ID NO: 724412 - RNA, 64 nt, hsa; identical to SEQ ID NO: 309845

SEQ ID NO: 724413 - RNA, 64 nt, hsa; identical to SEQ ID NO: 309846

SEQ ID NO: 724414 - RNA, 64 nt, hsa; identical to SEQ ID NO: 309847

SEQ ID NO: 724415 - RNA, 64 nt, hsa; identical to SEQ ID NO: 309848

SEQ ID NO: 724416 - RNA, 64 nt, hsa; identical to SEQ ID NO: 309849

SEQ ID NO: 724417 - RNA, 64 nt, hsa; identical to SEQ ID NO: 309850

SEQ ID NO: 724418 - RNA, 64 nt, hsa; identical to SEQ ID NO: 309851

SEQ ID NO: 724419 - RNA, 64 nt, hsa; identical to SEQ ID NO: 309852

SEQ ID NO: 724420 - RNA, 64 nt, hsa; identical to SEQ ID NO: 309853

SEQ ID NO: 724421 - RNA, 64 nt, hsa; identical to SEQ ID NO: 309854

SEQ ID NO: 724422 - RNA, 64 nt, hsa; identical to SEQ ID NO: 309855

SEQ ID NO: 724423 - RNA, 64 nt, hsa; identical to SEQ ID NO: 309856

SEQ ID NO: 724424 - RNA, 64 nt, hsa; identical to SEQ ID NO: 309857

SEQ ID NO: 724425 - RNA, 64 nt, hsa; identical to SEQ ID NO: 309858

SEQ ID NO: 724426 - RNA, 64 nt, hsa; identical to SEQ ID NO: 309859

SEQ ID NO: 724427 - RNA, 64 nt, hsa; identical to SEQ ID NO: 309860

SEQ ID NO: 724428 - RNA, 64 nt, hsa; identical to SEQ ID NO: 309861

SEQ ID NO: 724429 - RNA, 64 nt, hsa; identical to SEQ ID NO: 309862

SEQ ID NO: 724430 - RNA, 64 nt, hsa; identical to SEQ ID NO: 309863

SEQ ID NO: 724431 - RNA, 64 nt, hsa; identical to SEQ ID NO: 309864

SEQ ID NO: 724432 - RNA, 64 nt, hsa; identical to SEQ ID NO: 309865

SEQ ID NO: 724433 - RNA, 64 nt, hsa; identical to SEQ ID NO: 309866

SEQ ID NO: 724434 - RNA, 64 nt, hsa; identical to SEQ ID NO: 309867

SEQ ID NO: 724435 - RNA, 64 nt, hsa; identical to SEQ ID NO: 309868

SEQ ID NO: 724436 - RNA, 64 nt, hsa; identical to SEQ ID NO: 309869

SEQ ID NO: 724437 - RNA, 64 nt, hsa; identical to SEQ ID NO: 309870

SEQ ID NO: 724438 - RNA, 64 nt, hsa; identical to SEQ ID NO: 309871

SEQ ID NO: 724439 - RNA, 64 nt, hsa; identical to SEQ ID NO: 309872

SEQ ID NO: 724440 - RNA, 64 nt, hsa; identical to SEQ ID NO: 309873

SEQ ID NO: 724441 - RNA, 64 nt, hsa; identical to SEQ ID NO: 309874

SEQ ID NO: 724442 - RNA, 64 nt, hsa; identical to SEQ ID NO: 309875

SEQ ID NO: 724443 - RNA, 64 nt, hsa; identical to SEQ ID NO: 309876

SEQ ID NO: 724444 - RNA, 64 nt, hsa; identical to SEQ ID NO: 309877

SEQ ID NO: 724445 - RNA, 64 nt, hsa; identical to SEQ ID NO: 309878

SEQ ID NO: 724446 - RNA, 64 nt, hsa; identical to SEQ ID NO: 309879

SEQ ID NO: 724447 - RNA, 64 nt, hsa; identical to SEQ ID NO: 309880

SEQ ID NO: 724448 - RNA, 64 nt, hsa; identical to SEQ ID NO: 309881

SEQ ID NO: 724449 - RNA, 64 nt, hsa; identical to SEQ ID NO: 309882

SEQ ID NO: 724450 - RNA, 64 nt, hsa; identical to SEQ ID NO: 309883

SEQ ID NO: 724451 - RNA, 64 nt, hsa; identical to SEQ ID NO: 309884

SEQ ID NO: 724452 - RNA, 64 nt, hsa; identical to SEQ ID NO: 309885

SEQ ID NO: 724453 - RNA, 64 nt, hsa; identical to SEQ ID NO: 309886

SEQ ID NO: 724454 - RNA, 64 nt, hsa; identical to SEQ ID NO: 309887

SEQ ID NO: 724455 - RNA, 64 nt, hsa; identical to SEQ ID NO: 309888

SEQ ID NO: 724456 - RNA, 64 nt, hsa; identical to SEQ ID NO: 309889

SEQ ID NO: 724457 - RNA, 64 nt, hsa; identical to SEQ ID NO: 309890

SEQ ID NO: 724458 - RNA, 64 nt, hsa; identical to SEQ ID NO: 309891

SEQ ID NO: 724459 - RNA, 64 nt, hsa; identical to SEQ ID NO: 309892

SEQ ID NO: 724460 - RNA, 64 nt, hsa; identical to SEQ ID NO: 309893

SEQ ID NO: 724461 - RNA, 64 nt, hsa; identical to SEQ ID NO: 309894

SEQ ID NO: 724462 - RNA, 64 nt, hsa; identical to SEQ ID NO: 309895

SEQ ID NO: 724463 - RNA, 64 nt, hsa; identical to SEQ ID NO: 309896

SEQ ID NO: 724464 - RNA, 64 nt, hsa; identical to SEQ ID NO: 309897

SEQ ID NO: 724465 - RNA, 64 nt, hsa; identical to SEQ ID NO: 309898

SEQ ID NO: 724466 - RNA, 64 nt, hsa; identical to SEQ ID NO: 309899

SEQ ID NO: 724467 - RNA, 64 nt, hsa; identical to SEQ ID NO: 309900

SEQ ID NO: 724468 - RNA, 64 nt, hsa; identical to SEQ ID NO: 309901

SEQ ID NO: 724469 - RNA, 64 nt, hsa; identical to SEQ ID NO: 309902

SEQ ID NO: 724470 - RNA, 64 nt, hsa; identical to SEQ ID NO: 309903

SEQ ID NO: 724471 - RNA, 64 nt, hsa; identical to SEQ ID NO: 309904

SEQ ID NO: 724472 - RNA, 64 nt, hsa; identical to SEQ ID NO: 309905

SEQ ID NO: 724473 - RNA, 64 nt, hsa; identical to SEQ ID NO: 309906

SEQ ID NO: 724474 - RNA, 64 nt, hsa; identical to SEQ ID NO: 309907

SEQ ID NO: 724475 - RNA, 64 nt, hsa; identical to SEQ ID NO: 309908

SEQ ID NO: 724476 - RNA, 64 nt, hsa; identical to SEQ ID NO: 309909

SEQ ID NO: 724477 - RNA, 64 nt, hsa; identical to SEQ ID NO: 309910

SEQ ID NO: 724478 - RNA, 64 nt, hsa; identical to SEQ ID NO: 309911

SEQ ID NO: 724479 - RNA, 64 nt, hsa; identical to SEQ ID NO: 309912

SEQ ID NO: 724480 - RNA, 64 nt, hsa; identical to SEQ ID NO: 309913

SEQ ID NO: 724481 - RNA, 64 nt, hsa; identical to SEQ ID NO: 309914

SEQ ID NO: 724482 - RNA, 64 nt, hsa; identical to SEQ ID NO: 90267

SEQ ID NO: 724483 - RNA, 64 nt, hsa; identical to SEQ ID NO: 90268

SEQ ID NO: 724484 - RNA, 64 nt, hsa; identical to SEQ ID NO: 90269

SEQ ID NO: 724485 - RNA, 64 nt, hsa; identical to SEQ ID NO: 90270

SEQ ID NO: 724486 - RNA, 64 nt, hsa; identical to SEQ ID NO: 90271

SEQ ID NO: 724487 - RNA, 64 nt, hsa; identical to SEQ ID NO: 90272

SEQ ID NO: 724488 - RNA, 64 nt, hsa; identical to SEQ ID NO: 90273

SEQ ID NO: 724489 - RNA, 64 nt, hsa; identical to SEQ ID NO: 90274

SEQ ID NO: 724490 - RNA, 64 nt, hsa; identical to SEQ ID NO: 90275

SEQ ID NO: 724491 - RNA, 64 nt, hsa; identical to SEQ ID NO: 90276

SEQ ID NO: 724492 - RNA, 64 nt, hsa; identical to SEQ ID NO: 90277

SEQ ID NO: 724493 - RNA, 64 nt, hsa; identical to SEQ ID NO: 90278

SEQ ID NO: 724494 - RNA, 64 nt, hsa; identical to SEQ ID NO: 90279

SEQ ID NO: 724495 - RNA, 64 nt, hsa; identical to SEQ ID NO: 90280

SEQ ID NO: 724496 - RNA, 64 nt, hsa; identical to SEQ ID NO: 90281

SEQ ID NO: 724497 - RNA, 64 nt, hsa; identical to SEQ ID NO: 90282

SEQ ID NO: 724498 - RNA, 64 nt, hsa; identical to SEQ ID NO: 90283

SEQ ID NO: 724499 - RNA, 64 nt, hsa; identical to SEQ ID NO: 90284

SEQ ID NO: 724500 - RNA, 64 nt, hsa; identical to SEQ ID NO: 90285

SEQ ID NO: 724501 - RNA, 64 nt, hsa; identical to SEQ ID NO: 90286

SEQ ID NO: 724502 - RNA, 64 nt, hsa; identical to SEQ ID NO: 90287

SEQ ID NO: 724503 - RNA, 64 nt, hsa; identical to SEQ ID NO: 318576

SEQ ID NO: 724504 - RNA, 64 nt, hsa; identical to SEQ ID NO: 318577

SEQ ID NO: 724505 - RNA, 64 nt, hsa; identical to SEQ ID NO: 318578

SEQ ID NO: 724506 - RNA, 64 nt, hsa; identical to SEQ ID NO: 318579

SEQ ID NO: 724507 - RNA, 64 nt, hsa; identical to SEQ ID NO: 318580

SEQ ID NO: 724508 - RNA, 64 nt, hsa; identical to SEQ ID NO: 318581

SEQ ID NO: 724509 - RNA, 64 nt, hsa; identical to SEQ ID NO: 318582

SEQ ID NO: 724510 - RNA, 64 nt, hsa; identical to SEQ ID NO: 318583

SEQ ID NO: 724511 - RNA, 64 nt, hsa; identical to SEQ ID NO: 318584

SEQ ID NO: 724512 - RNA, 64 nt, hsa; identical to SEQ ID NO: 318585

SEQ ID NO: 724513 - RNA, 64 nt, hsa; identical to SEQ ID NO: 318586

SEQ ID NO: 724514 - RNA, 64 nt, hsa; identical to SEQ ID NO: 318587

SEQ ID NO: 724515 - RNA, 64 nt, hsa; identical to SEQ ID NO: 318588

SEQ ID NO: 724516 - RNA, 64 nt, hsa; identical to SEQ ID NO: 318589

SEQ ID NO: 724517 - RNA, 64 nt, hsa; identical to SEQ ID NO: 318590

SEQ ID NO: 724518 - RNA, 64 nt, hsa; identical to SEQ ID NO: 318591

SEQ ID NO: 724519 - RNA, 64 nt, hsa; identical to SEQ ID NO: 318592

SEQ ID NO: 724520 - RNA, 64 nt, hsa; identical to SEQ ID NO: 318593

SEQ ID NO: 724521 - RNA, 64 nt, hsa; identical to SEQ ID NO: 133930

SEQ ID NO: 724522 - RNA, 64 nt, hsa; identical to SEQ ID NO: 133931

SEQ ID NO: 724523 - RNA, 64 nt, hsa; identical to SEQ ID NO: 133932

SEQ ID NO: 724524 - RNA, 64 nt, hsa; identical to SEQ ID NO: 133933

SEQ ID NO: 724525 - RNA, 64 nt, hsa; identical to SEQ ID NO: 133934

SEQ ID NO: 724526 - RNA, 64 nt, hsa; identical to SEQ ID NO: 133935

SEQ ID NO: 724527 - RNA, 64 nt, hsa; identical to SEQ ID NO: 133936

SEQ ID NO: 724528 - RNA, 64 nt, hsa; identical to SEQ ID NO: 133937

SEQ ID NO: 724529 - RNA, 64 nt, hsa; identical to SEQ ID NO: 133938

SEQ ID NO: 724530 - RNA, 64 nt, hsa; identical to SEQ ID NO: 133939

SEQ ID NO: 724531 - RNA, 64 nt, hsa; identical to SEQ ID NO: 133940

SEQ ID NO: 724532 - RNA, 64 nt, hsa; identical to SEQ ID NO: 133941

SEQ ID NO: 724533 - RNA, 64 nt, hsa; identical to SEQ ID NO: 133942

SEQ ID NO: 724534 - RNA, 64 nt, hsa; identical to SEQ ID NO: 133943

SEQ ID NO: 724535 - RNA, 64 nt, hsa; identical to SEQ ID NO: 133944

SEQ ID NO: 724536 - RNA, 64 nt, hsa; identical to SEQ ID NO: 133945

SEQ ID NO: 724537 - RNA, 64 nt, hsa; identical to SEQ ID NO: 133946

SEQ ID NO: 724538 - RNA, 64 nt, hsa; identical to SEQ ID NO: 133947

SEQ ID NO: 724539 - RNA, 64 nt, hsa; identical to SEQ ID NO: 133948

SEQ ID NO: 724540 - RNA, 64 nt, hsa; identical to SEQ ID NO: 133949

SEQ ID NO: 724541 - RNA, 64 nt, hsa; identical to SEQ ID NO: 133950

SEQ ID NO: 724542 - RNA, 64 nt, hsa; identical to SEQ ID NO: 133951

SEQ ID NO: 724543 - RNA, 64 nt, hsa; identical to SEQ ID NO: 133952

SEQ ID NO: 724544 - RNA, 64 nt, hsa; identical to SEQ ID NO: 133953

SEQ ID NO: 724545 - RNA, 64 nt, hsa; identical to SEQ ID NO: 133954

SEQ ID NO: 724546 - RNA, 64 nt, hsa; identical to SEQ ID NO: 133955

SEQ ID NO: 724547 - RNA, 64 nt, hsa; identical to SEQ ID NO: 133956

SEQ ID NO: 724548 - RNA, 64 nt, hsa; identical to SEQ ID NO: 133957

SEQ ID NO: 724549 - RNA, 64 nt, hsa; identical to SEQ ID NO: 133958

SEQ ID NO: 724550 - RNA, 64 nt, hsa; identical to SEQ ID NO: 133959

SEQ ID NO: 724551 - RNA, 64 nt, hsa; identical to SEQ ID NO: 133960

SEQ ID NO: 724552 - RNA, 64 nt, hsa; identical to SEQ ID NO: 133961

SEQ ID NO: 724553 - RNA, 64 nt, hsa; identical to SEQ ID NO: 133962

SEQ ID NO: 724554 - RNA, 64 nt, hsa; identical to SEQ ID NO: 133963

SEQ ID NO: 724555 - RNA, 64 nt, hsa; identical to SEQ ID NO: 133964

SEQ ID NO: 724556 - RNA, 64 nt, hsa; identical to SEQ ID NO: 133965

SEQ ID NO: 724557 - RNA, 64 nt, hsa; identical to SEQ ID NO: 133966

SEQ ID NO: 724558 - RNA, 64 nt, hsa; identical to SEQ ID NO: 119443

SEQ ID NO: 724559 - RNA, 64 nt, hsa; identical to SEQ ID NO: 119444

SEQ ID NO: 724560 - RNA, 64 nt, hsa; identical to SEQ ID NO: 119445

SEQ ID NO: 724561 - RNA, 64 nt, hsa; identical to SEQ ID NO: 119446

SEQ ID NO: 724562 - RNA, 64 nt, hsa; identical to SEQ ID NO: 119447

SEQ ID NO: 724563 - RNA, 64 nt, hsa; identical to SEQ ID NO: 119448

SEQ ID NO: 724564 - RNA, 64 nt, hsa; identical to SEQ ID NO: 119449

SEQ ID NO: 724565 - RNA, 64 nt, hsa; identical to SEQ ID NO: 119450

SEQ ID NO: 724566 - RNA, 64 nt, hsa; identical to SEQ ID NO: 119451

SEQ ID NO: 724567 - RNA, 64 nt, hsa; identical to SEQ ID NO: 119452

SEQ ID NO: 724568 - RNA, 64 nt, hsa; identical to SEQ ID NO: 119453

SEQ ID NO: 724569 - RNA, 64 nt, hsa; identical to SEQ ID NO: 119454

SEQ ID NO: 724570 - RNA, 64 nt, hsa; identical to SEQ ID NO: 119455

SEQ ID NO: 724571 - RNA, 64 nt, hsa; identical to SEQ ID NO: 119456

SEQ ID NO: 724572 - RNA, 64 nt, hsa; identical to SEQ ID NO: 119457

SEQ ID NO: 724573 - RNA, 64 nt, hsa; identical to SEQ ID NO: 119458

SEQ ID NO: 724574 - RNA, 64 nt, hsa; identical to SEQ ID NO: 119459

SEQ ID NO: 724575 - RNA, 64 nt, hsa; identical to SEQ ID NO: 119460

SEQ ID NO: 724576 - RNA, 51 nt, hsa; identical to SEQ ID NO: 119461

SEQ ID NO: 724577 - RNA, 64 nt, hsa; identical to SEQ ID NO: 119462

SEQ ID NO: 724578 - RNA, 64 nt, hsa; identical to SEQ ID NO: 119463

SEQ ID NO: 724579 - RNA, 64 nt, hsa; identical to SEQ ID NO: 119464

SEQ ID NO: 724580 - RNA, 64 nt, hsa; identical to SEQ ID NO: 119465

SEQ ID NO: 724581 - RNA, 64 nt, hsa; identical to SEQ ID NO: 119466

SEQ ID NO: 724582 - RNA, 64 nt, hsa; identical to SEQ ID NO: 119467

SEQ ID NO: 724583 - RNA, 64 nt, hsa; identical to SEQ ID NO: 119468

SEQ ID NO: 724584 - RNA, 64 nt, hsa; identical to SEQ ID NO: 119469

SEQ ID NO: 724585 - RNA, 64 nt, hsa; identical to SEQ ID NO: 119470

SEQ ID NO: 724586 - RNA, 64 nt, hsa; identical to SEQ ID NO: 119471

SEQ ID NO: 724587 - RNA, 64 nt, hsa; identical to SEQ ID NO: 119472

SEQ ID NO: 724588 - RNA, 64 nt, hsa; identical to SEQ ID NO: 119473

SEQ ID NO: 724589 - RNA, 64 nt, hsa; identical to SEQ ID NO: 119474

SEQ ID NO: 724590 - RNA, 64 nt, hsa; identical to SEQ ID NO: 119475

SEQ ID NO: 724591 - RNA, 64 nt, hsa; identical to SEQ ID NO: 119476

SEQ ID NO: 724592 - RNA, 64 nt, hsa; identical to SEQ ID NO: 119477

SEQ ID NO: 724593 - RNA, 64 nt, hsa; identical to SEQ ID NO: 119478

SEQ ID NO: 724594 - RNA, 64 nt, hsa; identical to SEQ ID NO: 119479

SEQ ID NO: 724595 - RNA, 64 nt, hsa; identical to SEQ ID NO: 119480

SEQ ID NO: 724596 - RNA, 64 nt, hsa; identical to SEQ ID NO: 119481

SEQ ID NO: 724597 - RNA, 62 nt, hsa
acacauuuacuggccuccucuaaugacuuuggggaaaagaugauucugggucuuucccuuga

SEQ ID NO: 724598 - RNA, 62 nt, hsa
aaacaaaaacaagcaaacaaacaaaaaacaauggaaaagaugaagcuggagagagaggaacc

SEQ ID NO: 724599 - RNA, 62 nt, hsa
gugggaagagagccuggaaaagaaccaggccuggaaaagaaccagaaggaggcugggcagaa

SEQ ID NO: 724600 - RNA, 62 nt, hsa
ucugucauuguucaaaggugggaagagagccuggaaaagaaccaggccuggaaaagaaccag

SEQ ID NO: 724601 - RNA, 62 nt, hsa
accugaucauuuucuuuaggaagagguuuuagggaaaagaaaauggggugggggugggggug

SEQ ID NO: 724602 - RNA, 62 nt, hsa
agucagccacagagacccuccuccuuucacgaggaaaagaccuuccccugaaccccuaaaaa

SEQ ID NO: 724603 - RNA, 62 nt, hsa
ccagcccucuugcaagaggagaggcacgguagggaaaagaacugcugggugggggccuguuu

SEQ ID NO: 724604 - RNA, 62 nt, hsa
guucuuugcagauuuggggcgaggggugauuuggaaaagaagaccuggguggaaagcgguuu

SEQ ID NO: 724605 - RNA, 62 nt, hsa
uauuuaauaugcuuauaaccuaguuaaagaaaggaaaagaaaacaaaaaacgaaugaaaaua

SEQ ID NO: 724606 - RNA, 62 nt, hsa
ucagaaucagaagauagucuuggaagcuguuuggaaaagacaguggagaugaggucaguugu

SEQ ID NO: 724607 - RNA, 62 nt, hsa
ucaguguaaagugugugauugaaggugauaagggaaaagauaaagaccagaaauucccuuuu

SEQ ID NO: 724608 - RNA, 62 nt, hsa
cuguggaugaacgaugaaugucaaugucagaaggaaaagagaauuuuggccaucaaaaucca

SEQ ID NO: 724609 - RNA, 62 nt, hsa
aacccagcagcugaaaagcuucaagagaucuaggaaaagacauuuucauguuaaugagaauu

SEQ ID NO: 724610 - RNA, 62 nt, hsa
uccuucauccuugugacauuucauuucaguaaggaaaagauaacaaagugcaauuaucagca

SEQ ID NO: 724611 - RNA, 62 nt, hsa
gaauccuccuucuagcugaaggugauugaaaaggaaaagagugagugaacagaaccauagcu

SEQ ID NO: 724612 - RNA, 62 nt, hsa
cuuugagguagaccaggauuucuaaucaaaagggaaaagaagauguugaagaauacaguuag

SEQ ID NO: 724613 - RNA, 62 nt, hsa
accuucuagaauuauaagucacaaagaguucuggaaaagaacuguuuacugcuugauaggaa

SEQ ID NO: 724614 - RNA, 62 nt, hsa
ugagggauaaauagaaagcagaaugaauuaauggaaaagaacucggcuguuaggccauucuc

SEQ ID NO: 724615 - RNA, 62 nt, hsa
uuaaguugcagcauaaauccaagggcccacugggaaaagauacugucggguuuuuccauuca

SEQ ID NO: 724616 - RNA, 62 nt, hsa
cauauuuuagagguguuaauaaaauccucaucggaaaagauccaaagugcaaggauuugauu

SEQ ID NO: 724617 - RNA, 62 nt, hsa
uauaaacauaauuuccuagacugaaaguuuuuggaaaagaugcagggucugagucaggccuu

SEQ ID NO: 724618 - RNA, 62 nt, hsa
cuuccuguaaugaaauccacucucuaugugugggaaaagaggcagggaggaaugaagagagc

SEQ ID NO: 724619 - RNA, 62 nt, hsa
uccugacugaaauagacaaaguaagagggaaaggaaaagagguaucaaguaaauacugaaac

SEQ ID NO: 724620 - RNA, 62 nt, hsa
uucaaauagaaaaacaacaaaacccaugaaauggaaaagagaguuccaaaaaagaagaccug

SEQ ID NO: 724621 - RNA, 62 nt, hsa
uuuaccaacuuuacucauuuucccauuuuagaggaaaagagguugccugcuuccuaucaaag

SEQ ID NO: 724622 - RNA, 62 nt, hsa
cuuccauccauuguuggcacccccuugcaaaaggaaaagaacagcaaaagucaggagcagua

SEQ ID NO: 724623 - RNA, 62 nt, hsa
gggaaaauaacaaccacccuuacugauaguugggaaaagaagauuggguuauuuugccauau

SEQ ID NO: 724624 - RNA, 62 nt, hsa
gacacaucaaacaggccuauacaaaagguuuaggaaaagaaaacaauggugagucccggccc

SEQ ID NO: 724625 - RNA, 62 nt, hsa
gguugcaguaccagccacagccagcagauagaggaaaagacacacauaaacucgcuucugag

SEQ ID NO: 724626 - RNA, 50 nt, hsa; identical to SEQ ID NO: 189214

SEQ ID NO: 724627 - RNA, 62 nt, hsa
uaaaauugaacuuugaugggggauucaguucuggaaaagaauuugguauuuuccagucugcu

SEQ ID NO: 724628 - RNA, 62 nt, hsa
caagaaagcaggaacguggagaaauuggagcaggaaaagaaauuaucaaagcaauagaaaua

SEQ ID NO: 724629 - RNA, 62 nt, hsa
augcuauuagcaauuuccauauacuauauuguggaaaagacugaagaauacaauucugagaa

SEQ ID NO: 724630 - RNA, 62 nt, hsa
cuguguuuugaauuuuuauuuucuaaugcaguggaaaagaaacagaucauccuaaaugagga

SEQ ID NO: 724631 - RNA, 62 nt, hsa
aaucccuucugucuuucuguucucacaaagauggaaaagauacaagagcuugccggaaauaa

SEQ ID NO: 724632 - RNA, 62 nt, hsa
ucagagaaaagcccuauacguguagugaauguggaaaagacuucagauugaauucacaucuu

SEQ ID NO: 724633 - RNA, 62 nt, hsa
accagacagaaagccuuugauugugauguaugggaaaagaacuccagucagagagcacaucu

SEQ ID NO: 724634 - RNA, 62 nt, hsa
caaagcgaauuuuaaaagaugcaauguagaggggaaaagagaugaugaaaauauuuaaaggc

SEQ ID NO: 724635 - RNA, 62 nt, hsa
uuugagguggaagagggcugcaaauccuugugggaaaagaaaucuaugauuccagguggcau

SEQ ID NO: 724636 - RNA, 62 nt, hsa
aagguagaauagggcugaagcaucugauaauaggaaaagaaaaggacaaaaguccucaacuu

SEQ ID NO: 724637 - RNA, 62 nt, hsa
acacuuaucagaaucuuccucaagcacuugcuggaaaagauaucagauuggaacuucuuguu

SEQ ID NO: 724638 - RNA, 62 nt, hsa
gaauggagagaggacucaacugggacccacguggaaaagaccgagcaggccacagaggcucg

SEQ ID NO: 724639 - RNA, 62 nt, hsa
ccacccaaagccuagccgcuguucuagggaacggaaaagaguucauggccaagcgucuaacc

SEQ ID NO: 724640 - RNA, 62 nt, hsa
uuuuucuuuuuuccuuuuuuuuuaaguggaggggaaaagaagagauaaacaaggaauauuuu

SEQ ID NO: 724641 - RNA, 62 nt, hsa
uuuuacaguuacauccagcuguuagauaugcaggaaaagauaguuugcuggcuagcucuauu

SEQ ID NO: 724642 - RNA, 62 nt, hsa
aagagcaugauuuuaaaaaaucaaucauaggaggaaaagaaauucgcuuuucaaguaggaag

SEQ ID NO: 724643 - RNA, 62 nt, hsa
uuaguauccaaagacuguuuauguugauguauggaaaagagcaugauuuuaaaaaaucaauc

SEQ ID NO: 724644 - RNA, 62 nt, hsa
ccauucccuguaggaguaaagauaaaaggauaggaaaagauucaaagcucuaauagagucac

SEQ ID NO: 724645 - RNA, 62 nt, hsa
ugaggugauaggcaaggaugaaagacaaagaaggaaaagaguaucaaaggcagaaaggagau

SEQ ID NO: 724646 - RNA, 62 nt, hsa
cuuucuuuacuccuuuggcuucaaaggauuuuggaaaagaaacaauaugcuuuacacucauu

SEQ ID NO: 724647 - RNA, 62 nt, hsa
gccaggauggggcacagcagcucagguuugggggaaaagacccgaauccagagugcagggga

SEQ ID NO: 724648 - RNA, 62 nt, hsa
agagggagcuucacugagacucagagggaaaaggaaaagagccucaaacauuuuuaggaggu

SEQ ID NO: 724649 - RNA, 62 nt, hsa
aaaacuugaaguuccucaggccuguaacuucuggaaaagaugauuauucaaaauaauguuuu

SEQ ID NO: 724650 - RNA, 62 nt, hsa
ccaacugugaaagcuggcuuuaauuuuuaggaggaaaagaaaagccugcauguguucuuuau

SEQ ID NO: 724651 - RNA, 62 nt, hsa
uguccuucaaaagaguuugaaaugucauuuugggaaaagagagccagucaagcuaguaggcu

SEQ ID NO: 724652 - RNA, 62 nt, hsa
gaaaugccagcuguuuaaucacaccuaccccuggaaaagagguaaaccuuuugaacaguuga

SEQ ID NO: 724653 - RNA, 62 nt, hsa
auuugguuuguggacugggcaugguggcuuauggaaaagaggugagccuuugugaagaacau

SEQ ID NO: 724654 - RNA, 62 nt, hsa
aagaacugguuuguuuaaagguuuaaauuguuggaaaagagcauuugccuucuuuaaugaau

SEQ ID NO: 724655 - RNA, 62 nt, hsa
uucuugagugauaccuauuacggaugaguucuggaaaagacccagcuaugauucauaaaaac

SEQ ID NO: 724656 - RNA, 62 nt, hsa
uucagaaaaacguggagugcuaggggcagccuggaaaagauggggaaccugcuagugaacua

SEQ ID NO: 724657 - RNA, 62 nt, hsa
ugaggugggucugaaauucauacaugaagucaggaaaagaaaagaaacuuaguucuaccuug

SEQ ID NO: 724658 - RNA, 62 nt, hsa
uucagcuaaaauaguacuucacaggaaauauaggaaaagaaacacuaguucaguuuuauucc

SEQ ID NO: 724659 - RNA, 62 nt, hsa
acaagaaaacucccugugggugcaaugagucuggaaaagaccauugagucuucuagaagaaa

SEQ ID NO: 724660 - RNA, 62 nt, hsa
guucuguucaucaaaugaugcuguuaagauagggaaaagacaagaaacaggacuggaagaag

SEQ ID NO: 724661 - RNA, 62 nt, hsa
gaaagugucuaugauauauagugaaaagugugggaaaagaauauagaaauaauauucacuuc

SEQ ID NO: 724662 - RNA, 62 nt, hsa
ccucuguuaauugugugucucaaauuuguucuggaaaagaaagggggaaagucuaugaacga

SEQ ID NO: 724663 - RNA, 62 nt, hsa
uguguuugguaaccccuauaaacuggggcagaggaaaagaaugaugguucaaggccauacuu

SEQ ID NO: 724664 - RNA, 62 nt, hsa
gaagguagauaacuuuuaggaccuugaugugaggaaaagauaaaauuuaaacaauaaauuug

SEQ ID NO: 724665 - RNA, 62 nt, hsa
aaaguuaaaaauguauaguaacugauugagggggaaaagaaugaucuuuauuaaugacaagg

SEQ ID NO: 724666 - RNA, 62 nt, hsa
ucucagucauccuggcagccaaaaaugugccaggaaaagaaagaauguggagcacgcguggc

SEQ ID NO: 724667 - RNA, 62 nt, hsa
gaacacgguuacagcugguucuguagaaagagggaaaagaugauugugacaauucagagcau

SEQ ID NO: 724668 - RNA, 62 nt, hsa
cacugugcaaagccccaguagucggauuccggggaaaagaacaaguaucuaguuuugaugac

SEQ ID NO: 724669 - RNA, 62 nt, hsa
ugaaauauauggucuaauguuuaagcagaauuggaaaagacuaagaucgguuaacaaauaac

SEQ ID NO: 724670 - RNA, 62 nt, hsa
uuacaaaugauugcuuuuaaaauuuuaagcuaggaaaagaaaucuauagaaaguguucuguu

SEQ ID NO: 724671 - RNA, 64 nt, hsa; identical to SEQ ID NO: 488598

SEQ ID NO: 724672 - RNA, 64 nt, hsa; identical to SEQ ID NO: 488599

SEQ ID NO: 724673 - RNA, 64 nt, hsa; identical to SEQ ID NO: 488600

SEQ ID NO: 724674 - RNA, 64 nt, hsa; identical to SEQ ID NO: 488601

SEQ ID NO: 724675 - RNA, 64 nt, hsa; identical to SEQ ID NO: 488602

SEQ ID NO: 724676 - RNA, 64 nt, hsa; identical to SEQ ID NO: 488603

SEQ ID NO: 724677 - RNA, 64 nt, hsa; identical to SEQ ID NO: 488604

SEQ ID NO: 724678 - RNA, 64 nt, hsa; identical to SEQ ID NO: 488605

SEQ ID NO: 724679 - RNA, 64 nt, hsa; identical to SEQ ID NO: 488606

SEQ ID NO: 724680 - RNA, 64 nt, hsa; identical to SEQ ID NO: 488607

SEQ ID NO: 724681 - RNA, 64 nt, hsa; identical to SEQ ID NO: 488608

SEQ ID NO: 724682 - RNA, 64 nt, hsa; identical to SEQ ID NO: 488609

SEQ ID NO: 724683 - RNA, 64 nt, hsa; identical to SEQ ID NO: 488610

SEQ ID NO: 724684 - RNA, 64 nt, hsa; identical to SEQ ID NO: 488611

SEQ ID NO: 724685 - RNA, 64 nt, hsa; identical to SEQ ID NO: 488612

SEQ ID NO: 724686 - RNA, 64 nt, hsa; identical to SEQ ID NO: 488613

SEQ ID NO: 724687 - RNA, 64 nt, hsa; identical to SEQ ID NO: 488614

SEQ ID NO: 724688 - RNA, 64 nt, hsa; identical to SEQ ID NO: 488615

SEQ ID NO: 724689 - RNA, 64 nt, hsa; identical to SEQ ID NO: 488616

SEQ ID NO: 724690 - RNA, 64 nt, hsa; identical to SEQ ID NO: 488617

SEQ ID NO: 724691 - RNA, 64 nt, hsa; identical to SEQ ID NO: 488618

SEQ ID NO: 724692 - RNA, 64 nt, hsa; identical to SEQ ID NO: 488619

SEQ ID NO: 724693 - RNA, 64 nt, hsa; identical to SEQ ID NO: 488620

SEQ ID NO: 724694 - RNA, 64 nt, hsa; identical to SEQ ID NO: 488621

SEQ ID NO: 724695 - RNA, 64 nt, hsa; identical to SEQ ID NO: 488622

SEQ ID NO: 724696 - RNA, 64 nt, hsa; identical to SEQ ID NO: 488623

SEQ ID NO: 724697 - RNA, 64 nt, hsa; identical to SEQ ID NO: 488624

SEQ ID NO: 724698 - RNA, 64 nt, hsa; identical to SEQ ID NO: 488625

SEQ ID NO: 724699 - RNA, 64 nt, hsa; identical to SEQ ID NO: 488626

SEQ ID NO: 724700 - RNA, 64 nt, hsa; identical to SEQ ID NO: 488627

SEQ ID NO: 724701 - RNA, 64 nt, hsa; identical to SEQ ID NO: 488628

SEQ ID NO: 724702 - RNA, 64 nt, hsa; identical to SEQ ID NO: 488629

SEQ ID NO: 724703 - RNA, 64 nt, hsa; identical to SEQ ID NO: 488630

SEQ ID NO: 724704 - RNA, 64 nt, hsa; identical to SEQ ID NO: 488631

SEQ ID NO: 724705 - RNA, 64 nt, hsa; identical to SEQ ID NO: 488632

SEQ ID NO: 724706 - RNA, 64 nt, hsa; identical to SEQ ID NO: 488633

SEQ ID NO: 724707 - RNA, 64 nt, hsa; identical to SEQ ID NO: 488634

SEQ ID NO: 724708 - RNA, 64 nt, hsa; identical to SEQ ID NO: 488635

SEQ ID NO: 724709 - RNA, 64 nt, hsa; identical to SEQ ID NO: 488636

SEQ ID NO: 724710 - RNA, 64 nt, hsa; identical to SEQ ID NO: 488637

SEQ ID NO: 724711 - RNA, 64 nt, hsa; identical to SEQ ID NO: 488638

SEQ ID NO: 724712 - RNA, 64 nt, hsa; identical to SEQ ID NO: 488639

SEQ ID NO: 724713 - RNA, 64 nt, hsa; identical to SEQ ID NO: 488640

SEQ ID NO: 724714 - RNA, 64 nt, hsa; identical to SEQ ID NO: 488641

SEQ ID NO: 724715 - RNA, 64 nt, hsa; identical to SEQ ID NO: 488642

SEQ ID NO: 724716 - RNA, 64 nt, hsa; identical to SEQ ID NO: 488643

SEQ ID NO: 724717 - RNA, 64 nt, hsa; identical to SEQ ID NO: 488644

SEQ ID NO: 724718 - RNA, 64 nt, hsa; identical to SEQ ID NO: 488645

SEQ ID NO: 724719 - RNA, 64 nt, hsa; identical to SEQ ID NO: 488646

SEQ ID NO: 724720 - RNA, 64 nt, hsa; identical to SEQ ID NO: 488647

SEQ ID NO: 724721 - RNA, 64 nt, hsa; identical to SEQ ID NO: 488648

SEQ ID NO: 724722 - RNA, 64 nt, hsa; identical to SEQ ID NO: 488649

SEQ ID NO: 724723 - RNA, 64 nt, hsa; identical to SEQ ID NO: 488650

SEQ ID NO: 724724 - RNA, 64 nt, hsa; identical to SEQ ID NO: 488651

SEQ ID NO: 724725 - RNA, 64 nt, hsa; identical to SEQ ID NO: 488652

SEQ ID NO: 724726 - RNA, 64 nt, hsa; identical to SEQ ID NO: 488653

SEQ ID NO: 724727 - RNA, 64 nt, hsa; identical to SEQ ID NO: 488654

SEQ ID NO: 724728 - RNA, 64 nt, hsa; identical to SEQ ID NO: 488655

SEQ ID NO: 724729 - RNA, 64 nt, hsa; identical to SEQ ID NO: 488656

SEQ ID NO: 724730 - RNA, 64 nt, hsa; identical to SEQ ID NO: 488657

SEQ ID NO: 724731 - RNA, 64 nt, hsa; identical to SEQ ID NO: 488658

SEQ ID NO: 724732 - RNA, 64 nt, hsa; identical to SEQ ID NO: 488659

SEQ ID NO: 724733 - RNA, 64 nt, hsa; identical to SEQ ID NO: 488660

SEQ ID NO: 724734 - RNA, 64 nt, hsa; identical to SEQ ID NO: 488661

SEQ ID NO: 724735 - RNA, 64 nt, hsa; identical to SEQ ID NO: 488662

SEQ ID NO: 724736 - RNA, 64 nt, hsa; identical to SEQ ID NO: 488663

SEQ ID NO: 724737 - RNA, 64 nt, hsa; identical to SEQ ID NO: 488664

SEQ ID NO: 724738 - RNA, 64 nt, hsa; identical to SEQ ID NO: 488665

SEQ ID NO: 724739 - RNA, 64 nt, hsa; identical to SEQ ID NO: 488666

SEQ ID NO: 724740 - RNA, 64 nt, hsa; identical to SEQ ID NO: 488667

SEQ ID NO: 724741 - RNA, 64 nt, hsa; identical to SEQ ID NO: 488668

SEQ ID NO: 724742 - RNA, 64 nt, hsa; identical to SEQ ID NO: 488669

SEQ ID NO: 724743 - RNA, 64 nt, hsa; identical to SEQ ID NO: 488670

SEQ ID NO: 724744 - RNA, 64 nt, hsa; identical to SEQ ID NO: 488671

SEQ ID NO: 724745 - RNA, 64 nt, hsa; identical to SEQ ID NO: 488672

SEQ ID NO: 724746 - RNA, 64 nt, hsa; identical to SEQ ID NO: 488673

SEQ ID NO: 724747 - RNA, 64 nt, hsa; identical to SEQ ID NO: 488674

SEQ ID NO: 724748 - RNA, 64 nt, hsa; identical to SEQ ID NO: 488675

SEQ ID NO: 724749 - RNA, 64 nt, hsa; identical to SEQ ID NO: 488676

SEQ ID NO: 724750 - RNA, 64 nt, hsa; identical to SEQ ID NO: 488677

SEQ ID NO: 724751 - RNA, 64 nt, hsa; identical to SEQ ID NO: 488678

SEQ ID NO: 724752 - RNA, 64 nt, hsa; identical to SEQ ID NO: 488679

SEQ ID NO: 724753 - RNA, 64 nt, hsa; identical to SEQ ID NO: 488680

SEQ ID NO: 724754 - RNA, 64 nt, hsa; identical to SEQ ID NO: 488681

SEQ ID NO: 724755 - RNA, 64 nt, hsa; identical to SEQ ID NO: 488682

SEQ ID NO: 724756 - RNA, 64 nt, hsa; identical to SEQ ID NO: 488683

SEQ ID NO: 724757 - RNA, 64 nt, hsa; identical to SEQ ID NO: 488684

SEQ ID NO: 724758 - RNA, 64 nt, hsa; identical to SEQ ID NO: 488685

SEQ ID NO: 724759 - RNA, 64 nt, hsa; identical to SEQ ID NO: 488686

SEQ ID NO: 724760 - RNA, 64 nt, hsa; identical to SEQ ID NO: 488687

SEQ ID NO: 724761 - RNA, 64 nt, hsa; identical to SEQ ID NO: 488688

SEQ ID NO: 724762 - RNA, 64 nt, hsa; identical to SEQ ID NO: 488689

SEQ ID NO: 724763 - RNA, 64 nt, hsa; identical to SEQ ID NO: 488690

SEQ ID NO: 724764 - RNA, 64 nt, hsa; identical to SEQ ID NO: 488691

SEQ ID NO: 724765 - RNA, 64 nt, hsa; identical to SEQ ID NO: 488692

SEQ ID NO: 724766 - RNA, 64 nt, hsa; identical to SEQ ID NO: 488693

SEQ ID NO: 724767 - RNA, 64 nt, hsa; identical to SEQ ID NO: 488694

SEQ ID NO: 724768 - RNA, 64 nt, hsa; identical to SEQ ID NO: 488695

SEQ ID NO: 724769 - RNA, 64 nt, hsa; identical to SEQ ID NO: 488696

SEQ ID NO: 724770 - RNA, 64 nt, hsa; identical to SEQ ID NO: 488697

SEQ ID NO: 724771 - RNA, 64 nt, hsa; identical to SEQ ID NO: 488698

SEQ ID NO: 724772 - RNA, 64 nt, hsa; identical to SEQ ID NO: 488699

SEQ ID NO: 724773 - RNA, 64 nt, hsa; identical to SEQ ID NO: 488700

SEQ ID NO: 724774 - RNA, 64 nt, hsa; identical to SEQ ID NO: 488701

SEQ ID NO: 724775 - RNA, 64 nt, hsa; identical to SEQ ID NO: 488702

SEQ ID NO: 724776 - RNA, 64 nt, hsa; identical to SEQ ID NO: 488703

SEQ ID NO: 724777 - RNA, 64 nt, hsa; identical to SEQ ID NO: 488704

SEQ ID NO: 724778 - RNA, 64 nt, hsa; identical to SEQ ID NO: 488705

SEQ ID NO: 724779 - RNA, 64 nt, hsa; identical to SEQ ID NO: 488706

SEQ ID NO: 724780 - RNA, 64 nt, hsa; identical to SEQ ID NO: 488707

SEQ ID NO: 724781 - RNA, 64 nt, hsa; identical to SEQ ID NO: 488708

SEQ ID NO: 724782 - RNA, 64 nt, hsa; identical to SEQ ID NO: 488709

SEQ ID NO: 724783 - RNA, 64 nt, hsa; identical to SEQ ID NO: 488710

SEQ ID NO: 724784 - RNA, 64 nt, hsa; identical to SEQ ID NO: 488711

SEQ ID NO: 724785 - RNA, 64 nt, hsa; identical to SEQ ID NO: 488712

SEQ ID NO: 724786 - RNA, 64 nt, hsa; identical to SEQ ID NO: 488713

SEQ ID NO: 724787 - RNA, 64 nt, hsa; identical to SEQ ID NO: 488714

SEQ ID NO: 724788 - RNA, 64 nt, hsa; identical to SEQ ID NO: 488715

SEQ ID NO: 724789 - RNA, 64 nt, hsa; identical to SEQ ID NO: 488716

SEQ ID NO: 724790 - RNA, 64 nt, hsa; identical to SEQ ID NO: 488717

SEQ ID NO: 724791 - RNA, 64 nt, hsa; identical to SEQ ID NO: 488718

SEQ ID NO: 724792 - RNA, 64 nt, hsa; identical to SEQ ID NO: 488719

SEQ ID NO: 724793 - RNA, 64 nt, hsa; identical to SEQ ID NO: 488720

SEQ ID NO: 724794 - RNA, 64 nt, hsa; identical to SEQ ID NO: 488721

SEQ ID NO: 724795 - RNA, 64 nt, hsa; identical to SEQ ID NO: 488722

SEQ ID NO: 724796 - RNA, 64 nt, hsa; identical to SEQ ID NO: 488723

SEQ ID NO: 724797 - RNA, 64 nt, hsa; identical to SEQ ID NO: 488724

SEQ ID NO: 724798 - RNA, 64 nt, hsa; identical to SEQ ID NO: 488725

SEQ ID NO: 724799 - RNA, 64 nt, hsa; identical to SEQ ID NO: 488726

SEQ ID NO: 724800 - RNA, 64 nt, hsa; identical to SEQ ID NO: 488727

SEQ ID NO: 724801 - RNA, 64 nt, hsa; identical to SEQ ID NO: 488728

SEQ ID NO: 724802 - RNA, 64 nt, hsa; identical to SEQ ID NO: 488729

SEQ ID NO: 724803 - RNA, 64 nt, hsa; identical to SEQ ID NO: 488730

SEQ ID NO: 724804 - RNA, 64 nt, hsa; identical to SEQ ID NO: 488731

SEQ ID NO: 724805 - RNA, 64 nt, hsa; identical to SEQ ID NO: 488732

SEQ ID NO: 724806 - RNA, 64 nt, hsa; identical to SEQ ID NO: 488733

SEQ ID NO: 724807 - RNA, 64 nt, hsa; identical to SEQ ID NO: 488734

SEQ ID NO: 724808 - RNA, 64 nt, hsa; identical to SEQ ID NO: 488735

SEQ ID NO: 724809 - RNA, 64 nt, hsa; identical to SEQ ID NO: 488736

SEQ ID NO: 724810 - RNA, 64 nt, hsa; identical to SEQ ID NO: 488737

SEQ ID NO: 724811 - RNA, 64 nt, hsa; identical to SEQ ID NO: 488738

SEQ ID NO: 724812 - RNA, 64 nt, hsa; identical to SEQ ID NO: 488739

SEQ ID NO: 724813 - RNA, 64 nt, hsa; identical to SEQ ID NO: 488740

SEQ ID NO: 724814 - RNA, 64 nt, hsa; identical to SEQ ID NO: 488741

SEQ ID NO: 724815 - RNA, 64 nt, hsa; identical to SEQ ID NO: 488742

SEQ ID NO: 724816 - RNA, 64 nt, hsa; identical to SEQ ID NO: 488743

SEQ ID NO: 724817 - RNA, 64 nt, hsa; identical to SEQ ID NO: 488744

SEQ ID NO: 724818 - RNA, 64 nt, hsa; identical to SEQ ID NO: 488745

SEQ ID NO: 724819 - RNA, 64 nt, hsa; identical to SEQ ID NO: 488746

SEQ ID NO: 724820 - RNA, 64 nt, hsa; identical to SEQ ID NO: 488747

SEQ ID NO: 724821 - RNA, 64 nt, hsa; identical to SEQ ID NO: 488748

SEQ ID NO: 724822 - RNA, 64 nt, hsa; identical to SEQ ID NO: 488749

SEQ ID NO: 724823 - RNA, 64 nt, hsa; identical to SEQ ID NO: 488750

SEQ ID NO: 724824 - RNA, 64 nt, hsa; identical to SEQ ID NO: 488751

SEQ ID NO: 724825 - RNA, 64 nt, hsa; identical to SEQ ID NO: 488752

SEQ ID NO: 724826 - RNA, 64 nt, hsa; identical to SEQ ID NO: 488753

SEQ ID NO: 724827 - RNA, 64 nt, hsa; identical to SEQ ID NO: 488754

SEQ ID NO: 724828 - RNA, 64 nt, hsa; identical to SEQ ID NO: 488755

SEQ ID NO: 724829 - RNA, 64 nt, hsa; identical to SEQ ID NO: 488756

SEQ ID NO: 724830 - RNA, 64 nt, hsa; identical to SEQ ID NO: 488757

SEQ ID NO: 724831 - RNA, 64 nt, hsa; identical to SEQ ID NO: 488758

SEQ ID NO: 724832 - RNA, 64 nt, hsa; identical to SEQ ID NO: 488759

SEQ ID NO: 724833 - RNA, 64 nt, hsa; identical to SEQ ID NO: 488760

SEQ ID NO: 724834 - RNA, 64 nt, hsa; identical to SEQ ID NO: 488761

SEQ ID NO: 724835 - RNA, 64 nt, hsa; identical to SEQ ID NO: 488762

SEQ ID NO: 724836 - RNA, 64 nt, hsa; identical to SEQ ID NO: 488763

SEQ ID NO: 724837 - RNA, 64 nt, hsa; identical to SEQ ID NO: 488764

SEQ ID NO: 724838 - RNA, 64 nt, hsa; identical to SEQ ID NO: 488765

SEQ ID NO: 724839 - RNA, 64 nt, hsa; identical to SEQ ID NO: 488766

SEQ ID NO: 724840 - RNA, 64 nt, hsa; identical to SEQ ID NO: 488767

SEQ ID NO: 724841 - RNA, 64 nt, hsa; identical to SEQ ID NO: 488768

SEQ ID NO: 724842 - RNA, 64 nt, hsa; identical to SEQ ID NO: 488769

SEQ ID NO: 724843 - RNA, 64 nt, hsa; identical to SEQ ID NO: 488770

SEQ ID NO: 724844 - RNA, 64 nt, hsa; identical to SEQ ID NO: 488771

SEQ ID NO: 724845 - RNA, 64 nt, hsa; identical to SEQ ID NO: 488772

SEQ ID NO: 724846 - RNA, 64 nt, hsa; identical to SEQ ID NO: 488773

SEQ ID NO: 724847 - RNA, 64 nt, hsa; identical to SEQ ID NO: 488774

SEQ ID NO: 724848 - RNA, 64 nt, hsa; identical to SEQ ID NO: 488775

SEQ ID NO: 724849 - RNA, 64 nt, hsa; identical to SEQ ID NO: 488776

SEQ ID NO: 724850 - RNA, 64 nt, hsa; identical to SEQ ID NO: 488777

SEQ ID NO: 724851 - RNA, 64 nt, hsa; identical to SEQ ID NO: 488778

SEQ ID NO: 724852 - RNA, 64 nt, hsa; identical to SEQ ID NO: 488779

SEQ ID NO: 724853 - RNA, 64 nt, hsa; identical to SEQ ID NO: 488780

SEQ ID NO: 724854 - RNA, 64 nt, hsa; identical to SEQ ID NO: 488781

SEQ ID NO: 724855 - RNA, 64 nt, hsa; identical to SEQ ID NO: 488782

SEQ ID NO: 724856 - RNA, 64 nt, hsa; identical to SEQ ID NO: 488783

SEQ ID NO: 724857 - RNA, 64 nt, hsa; identical to SEQ ID NO: 488784

SEQ ID NO: 724858 - RNA, 64 nt, hsa; identical to SEQ ID NO: 488785

SEQ ID NO: 724859 - RNA, 64 nt, hsa; identical to SEQ ID NO: 488786

SEQ ID NO: 724860 - RNA, 64 nt, hsa; identical to SEQ ID NO: 488787

SEQ ID NO: 724861 - RNA, 64 nt, hsa; identical to SEQ ID NO: 488788

SEQ ID NO: 724862 - RNA, 64 nt, hsa; identical to SEQ ID NO: 488789

SEQ ID NO: 724863 - RNA, 64 nt, hsa; identical to SEQ ID NO: 488790

SEQ ID NO: 724864 - RNA, 64 nt, hsa; identical to SEQ ID NO: 488791

SEQ ID NO: 724865 - RNA, 64 nt, hsa; identical to SEQ ID NO: 488792

SEQ ID NO: 724866 - RNA, 64 nt, hsa; identical to SEQ ID NO: 488793

SEQ ID NO: 724867 - RNA, 64 nt, hsa; identical to SEQ ID NO: 488794

SEQ ID NO: 724868 - RNA, 64 nt, hsa; identical to SEQ ID NO: 488795

SEQ ID NO: 724869 - RNA, 64 nt, hsa; identical to SEQ ID NO: 488796

SEQ ID NO: 724870 - RNA, 64 nt, hsa; identical to SEQ ID NO: 488797

SEQ ID NO: 724871 - RNA, 64 nt, hsa; identical to SEQ ID NO: 488798

SEQ ID NO: 724872 - RNA, 64 nt, hsa; identical to SEQ ID NO: 488799

SEQ ID NO: 724873 - RNA, 64 nt, hsa; identical to SEQ ID NO: 488800

SEQ ID NO: 724874 - RNA, 64 nt, hsa; identical to SEQ ID NO: 488801

SEQ ID NO: 724875 - RNA, 64 nt, hsa; identical to SEQ ID NO: 488802

SEQ ID NO: 724876 - RNA, 64 nt, hsa; identical to SEQ ID NO: 488803

SEQ ID NO: 724877 - RNA, 64 nt, hsa; identical to SEQ ID NO: 488804

SEQ ID NO: 724878 - RNA, 64 nt, hsa; identical to SEQ ID NO: 488805

SEQ ID NO: 724879 - RNA, 64 nt, hsa; identical to SEQ ID NO: 488806

SEQ ID NO: 724880 - RNA, 64 nt, hsa; identical to SEQ ID NO: 488807

SEQ ID NO: 724881 - RNA, 64 nt, hsa; identical to SEQ ID NO: 488808

SEQ ID NO: 724882 - RNA, 64 nt, hsa; identical to SEQ ID NO: 488809

SEQ ID NO: 724883 - RNA, 64 nt, hsa; identical to SEQ ID NO: 488810

SEQ ID NO: 724884 - RNA, 64 nt, hsa; identical to SEQ ID NO: 488811

SEQ ID NO: 724885 - RNA, 64 nt, hsa; identical to SEQ ID NO: 488812

SEQ ID NO: 724886 - RNA, 64 nt, hsa; identical to SEQ ID NO: 488813

SEQ ID NO: 724887 - RNA, 64 nt, hsa; identical to SEQ ID NO: 488814

SEQ ID NO: 724888 - RNA, 64 nt, hsa; identical to SEQ ID NO: 488815

SEQ ID NO: 724889 - RNA, 64 nt, hsa; identical to SEQ ID NO: 488816

SEQ ID NO: 724890 - RNA, 64 nt, hsa; identical to SEQ ID NO: 488817

SEQ ID NO: 724891 - RNA, 64 nt, hsa; identical to SEQ ID NO: 488818

SEQ ID NO: 724892 - RNA, 64 nt, hsa; identical to SEQ ID NO: 488819

SEQ ID NO: 724893 - RNA, 64 nt, hsa; identical to SEQ ID NO: 488820

SEQ ID NO: 724894 - RNA, 64 nt, hsa; identical to SEQ ID NO: 488821

SEQ ID NO: 724895 - RNA, 64 nt, hsa; identical to SEQ ID NO: 488822

SEQ ID NO: 724896 - RNA, 64 nt, hsa; identical to SEQ ID NO: 488823

SEQ ID NO: 724897 - RNA, 64 nt, hsa; identical to SEQ ID NO: 488824

SEQ ID NO: 724898 - RNA, 64 nt, hsa; identical to SEQ ID NO: 488825

SEQ ID NO: 724899 - RNA, 64 nt, hsa; identical to SEQ ID NO: 488826

SEQ ID NO: 724900 - RNA, 64 nt, hsa; identical to SEQ ID NO: 488827

SEQ ID NO: 724901 - RNA, 64 nt, hsa; identical to SEQ ID NO: 488828

SEQ ID NO: 724902 - RNA, 64 nt, hsa; identical to SEQ ID NO: 488829

SEQ ID NO: 724903 - RNA, 64 nt, hsa; identical to SEQ ID NO: 488830

SEQ ID NO: 724904 - RNA, 64 nt, hsa; identical to SEQ ID NO: 488831

SEQ ID NO: 724905 - RNA, 64 nt, hsa; identical to SEQ ID NO: 488832

SEQ ID NO: 724906 - RNA, 64 nt, hsa; identical to SEQ ID NO: 488833

SEQ ID NO: 724907 - RNA, 64 nt, hsa; identical to SEQ ID NO: 488834

SEQ ID NO: 724908 - RNA, 64 nt, hsa; identical to SEQ ID NO: 488835

SEQ ID NO: 724909 - RNA, 64 nt, hsa; identical to SEQ ID NO: 488836

SEQ ID NO: 724910 - RNA, 64 nt, hsa; identical to SEQ ID NO: 488837

SEQ ID NO: 724911 - RNA, 64 nt, hsa; identical to SEQ ID NO: 488838

SEQ ID NO: 724912 - RNA, 64 nt, hsa; identical to SEQ ID NO: 488839

SEQ ID NO: 724913 - RNA, 64 nt, hsa; identical to SEQ ID NO: 488840

SEQ ID NO: 724914 - RNA, 64 nt, hsa; identical to SEQ ID NO: 488841

SEQ ID NO: 724915 - RNA, 64 nt, hsa; identical to SEQ ID NO: 488842

SEQ ID NO: 724916 - RNA, 64 nt, hsa; identical to SEQ ID NO: 488843

SEQ ID NO: 724917 - RNA, 64 nt, hsa; identical to SEQ ID NO: 488844

SEQ ID NO: 724918 - RNA, 64 nt, hsa; identical to SEQ ID NO: 488845

SEQ ID NO: 724919 - RNA, 64 nt, hsa; identical to SEQ ID NO: 488846

SEQ ID NO: 724920 - RNA, 64 nt, hsa; identical to SEQ ID NO: 488847

SEQ ID NO: 724921 - RNA, 64 nt, hsa; identical to SEQ ID NO: 488848

SEQ ID NO: 724922 - RNA, 64 nt, hsa; identical to SEQ ID NO: 488849

SEQ ID NO: 724923 - RNA, 64 nt, hsa; identical to SEQ ID NO: 488850

SEQ ID NO: 724924 - RNA, 64 nt, hsa; identical to SEQ ID NO: 488851

SEQ ID NO: 724925 - RNA, 64 nt, hsa; identical to SEQ ID NO: 488852

SEQ ID NO: 724926 - RNA, 64 nt, hsa; identical to SEQ ID NO: 488853

SEQ ID NO: 724927 - RNA, 64 nt, hsa; identical to SEQ ID NO: 488854

SEQ ID NO: 724928 - RNA, 64 nt, hsa; identical to SEQ ID NO: 488855

SEQ ID NO: 724929 - RNA, 64 nt, hsa; identical to SEQ ID NO: 488856

SEQ ID NO: 724930 - RNA, 64 nt, hsa; identical to SEQ ID NO: 488857

SEQ ID NO: 724931 - RNA, 64 nt, hsa; identical to SEQ ID NO: 488858

SEQ ID NO: 724932 - RNA, 64 nt, hsa; identical to SEQ ID NO: 488859

SEQ ID NO: 724933 - RNA, 64 nt, hsa; identical to SEQ ID NO: 488860

SEQ ID NO: 724934 - RNA, 64 nt, hsa; identical to SEQ ID NO: 488861

SEQ ID NO: 724935 - RNA, 64 nt, hsa; identical to SEQ ID NO: 488862

SEQ ID NO: 724936 - RNA, 64 nt, hsa; identical to SEQ ID NO: 488863

SEQ ID NO: 724937 - RNA, 64 nt, hsa; identical to SEQ ID NO: 488864

SEQ ID NO: 724938 - RNA, 64 nt, hsa; identical to SEQ ID NO: 488865

SEQ ID NO: 724939 - RNA, 64 nt, hsa; identical to SEQ ID NO: 488866

SEQ ID NO: 724940 - RNA, 64 nt, hsa; identical to SEQ ID NO: 488867

SEQ ID NO: 724941 - RNA, 64 nt, hsa; identical to SEQ ID NO: 488868

SEQ ID NO: 724942 - RNA, 64 nt, hsa; identical to SEQ ID NO: 488869

SEQ ID NO: 724943 - RNA, 64 nt, hsa; identical to SEQ ID NO: 488870

SEQ ID NO: 724944 - RNA, 64 nt, hsa; identical to SEQ ID NO: 488871

SEQ ID NO: 724945 - RNA, 64 nt, hsa; identical to SEQ ID NO: 488872

SEQ ID NO: 724946 - RNA, 64 nt, hsa; identical to SEQ ID NO: 488873

SEQ ID NO: 724947 - RNA, 64 nt, hsa; identical to SEQ ID NO: 488874

SEQ ID NO: 724948 - RNA, 64 nt, hsa; identical to SEQ ID NO: 488875

SEQ ID NO: 724949 - RNA, 64 nt, hsa; identical to SEQ ID NO: 488876

SEQ ID NO: 724950 - RNA, 64 nt, hsa; identical to SEQ ID NO: 488877

SEQ ID NO: 724951 - RNA, 64 nt, hsa; identical to SEQ ID NO: 488878

SEQ ID NO: 724952 - RNA, 64 nt, hsa; identical to SEQ ID NO: 488879

SEQ ID NO: 724953 - RNA, 64 nt, hsa; identical to SEQ ID NO: 488880

SEQ ID NO: 724954 - RNA, 64 nt, hsa; identical to SEQ ID NO: 488881

SEQ ID NO: 724955 - RNA, 64 nt, hsa; identical to SEQ ID NO: 488882

SEQ ID NO: 724956 - RNA, 64 nt, hsa; identical to SEQ ID NO: 488883

SEQ ID NO: 724957 - RNA, 64 nt, hsa; identical to SEQ ID NO: 488884

SEQ ID NO: 724958 - RNA, 64 nt, hsa; identical to SEQ ID NO: 488885

SEQ ID NO: 724959 - RNA, 64 nt, hsa; identical to SEQ ID NO: 488886

SEQ ID NO: 724960 - RNA, 64 nt, hsa; identical to SEQ ID NO: 488887

SEQ ID NO: 724961 - RNA, 64 nt, hsa; identical to SEQ ID NO: 488888

SEQ ID NO: 724962 - RNA, 64 nt, hsa; identical to SEQ ID NO: 488889

SEQ ID NO: 724963 - RNA, 64 nt, hsa; identical to SEQ ID NO: 488890

SEQ ID NO: 724964 - RNA, 64 nt, hsa; identical to SEQ ID NO: 488891

SEQ ID NO: 724965 - RNA, 64 nt, hsa; identical to SEQ ID NO: 488892

SEQ ID NO: 724966 - RNA, 64 nt, hsa; identical to SEQ ID NO: 488893

SEQ ID NO: 724967 - RNA, 64 nt, hsa; identical to SEQ ID NO: 488894

SEQ ID NO: 724968 - RNA, 64 nt, hsa; identical to SEQ ID NO: 488895

SEQ ID NO: 724969 - RNA, 64 nt, hsa; identical to SEQ ID NO: 488896

SEQ ID NO: 724970 - RNA, 64 nt, hsa; identical to SEQ ID NO: 488897

SEQ ID NO: 724971 - RNA, 64 nt, hsa; identical to SEQ ID NO: 488898

SEQ ID NO: 724972 - RNA, 64 nt, hsa; identical to SEQ ID NO: 488899

SEQ ID NO: 724973 - RNA, 64 nt, hsa; identical to SEQ ID NO: 488900

SEQ ID NO: 724974 - RNA, 64 nt, hsa; identical to SEQ ID NO: 488901

SEQ ID NO: 724975 - RNA, 64 nt, hsa; identical to SEQ ID NO: 488902

SEQ ID NO: 724976 - RNA, 64 nt, hsa; identical to SEQ ID NO: 488903

SEQ ID NO: 724977 - RNA, 64 nt, hsa; identical to SEQ ID NO: 488904

SEQ ID NO: 724978 - RNA, 64 nt, hsa; identical to SEQ ID NO: 488905

SEQ ID NO: 724979 - RNA, 64 nt, hsa; identical to SEQ ID NO: 488906

SEQ ID NO: 724980 - RNA, 64 nt, hsa; identical to SEQ ID NO: 488907

SEQ ID NO: 724981 - RNA, 64 nt, hsa; identical to SEQ ID NO: 488908

SEQ ID NO: 724982 - RNA, 64 nt, hsa; identical to SEQ ID NO: 488909

SEQ ID NO: 724983 - RNA, 64 nt, hsa; identical to SEQ ID NO: 488910

SEQ ID NO: 724984 - RNA, 64 nt, hsa; identical to SEQ ID NO: 488911

SEQ ID NO: 724985 - RNA, 64 nt, hsa; identical to SEQ ID NO: 488912

SEQ ID NO: 724986 - RNA, 64 nt, hsa; identical to SEQ ID NO: 488913

SEQ ID NO: 724987 - RNA, 64 nt, hsa; identical to SEQ ID NO: 488914

SEQ ID NO: 724988 - RNA, 64 nt, hsa; identical to SEQ ID NO: 488915

SEQ ID NO: 724989 - RNA, 64 nt, hsa; identical to SEQ ID NO: 488916

SEQ ID NO: 724990 - RNA, 64 nt, hsa; identical to SEQ ID NO: 488917

SEQ ID NO: 724991 - RNA, 64 nt, hsa; identical to SEQ ID NO: 488918

SEQ ID NO: 724992 - RNA, 64 nt, hsa; identical to SEQ ID NO: 488919

SEQ ID NO: 724993 - RNA, 64 nt, hsa; identical to SEQ ID NO: 488920

SEQ ID NO: 724994 - RNA, 64 nt, hsa; identical to SEQ ID NO: 488921

SEQ ID NO: 724995 - RNA, 64 nt, hsa; identical to SEQ ID NO: 488922

SEQ ID NO: 724996 - RNA, 64 nt, hsa; identical to SEQ ID NO: 488923

SEQ ID NO: 724997 - RNA, 64 nt, hsa; identical to SEQ ID NO: 488924

SEQ ID NO: 724998 - RNA, 64 nt, hsa; identical to SEQ ID NO: 488925

SEQ ID NO: 724999 - RNA, 64 nt, hsa; identical to SEQ ID NO: 488926

SEQ ID NO: 725000 - RNA, 64 nt, hsa; identical to SEQ ID NO: 488927

SEQ ID NO: 725001 - RNA, 64 nt, hsa; identical to SEQ ID NO: 488928

SEQ ID NO: 725002 - RNA, 64 nt, hsa; identical to SEQ ID NO: 488929

SEQ ID NO: 725003 - RNA, 64 nt, hsa; identical to SEQ ID NO: 488930

SEQ ID NO: 725004 - RNA, 64 nt, hsa; identical to SEQ ID NO: 488931

SEQ ID NO: 725005 - RNA, 64 nt, hsa; identical to SEQ ID NO: 488932

SEQ ID NO: 725006 - RNA, 64 nt, hsa; identical to SEQ ID NO: 488933

SEQ ID NO: 725007 - RNA, 64 nt, hsa; identical to SEQ ID NO: 488934

SEQ ID NO: 725008 - RNA, 64 nt, hsa; identical to SEQ ID NO: 488935

SEQ ID NO: 725009 - RNA, 64 nt, hsa; identical to SEQ ID NO: 488936

SEQ ID NO: 725010 - RNA, 64 nt, hsa; identical to SEQ ID NO: 488937

SEQ ID NO: 725011 - RNA, 64 nt, hsa; identical to SEQ ID NO: 488938

SEQ ID NO: 725012 - RNA, 64 nt, hsa; identical to SEQ ID NO: 488939

SEQ ID NO: 725013 - RNA, 64 nt, hsa; identical to SEQ ID NO: 488940

SEQ ID NO: 725014 - RNA, 64 nt, hsa; identical to SEQ ID NO: 488941

SEQ ID NO: 725015 - RNA, 64 nt, hsa; identical to SEQ ID NO: 488942

SEQ ID NO: 725016 - RNA, 64 nt, hsa; identical to SEQ ID NO: 488943

SEQ ID NO: 725017 - RNA, 64 nt, hsa; identical to SEQ ID NO: 488944

SEQ ID NO: 725018 - RNA, 64 nt, hsa; identical to SEQ ID NO: 488945

SEQ ID NO: 725019 - RNA, 64 nt, hsa; identical to SEQ ID NO: 488946

SEQ ID NO: 725020 - RNA, 64 nt, hsa; identical to SEQ ID NO: 488947

SEQ ID NO: 725021 - RNA, 64 nt, hsa; identical to SEQ ID NO: 488948

SEQ ID NO: 725022 - RNA, 64 nt, hsa; identical to SEQ ID NO: 488949

SEQ ID NO: 725023 - RNA, 64 nt, hsa; identical to SEQ ID NO: 488950

SEQ ID NO: 725024 - RNA, 64 nt, hsa; identical to SEQ ID NO: 488951

SEQ ID NO: 725025 - RNA, 64 nt, hsa; identical to SEQ ID NO: 488952

SEQ ID NO: 725026 - RNA, 64 nt, hsa; identical to SEQ ID NO: 488953

SEQ ID NO: 725027 - RNA, 64 nt, hsa; identical to SEQ ID NO: 488954

SEQ ID NO: 725028 - RNA, 64 nt, hsa; identical to SEQ ID NO: 488955

SEQ ID NO: 725029 - RNA, 64 nt, hsa; identical to SEQ ID NO: 488956

SEQ ID NO: 725030 - RNA, 64 nt, hsa; identical to SEQ ID NO: 488957

SEQ ID NO: 725031 - RNA, 64 nt, hsa; identical to SEQ ID NO: 488958

SEQ ID NO: 725032 - RNA, 64 nt, hsa; identical to SEQ ID NO: 488959

SEQ ID NO: 725033 - RNA, 64 nt, hsa; identical to SEQ ID NO: 488960

SEQ ID NO: 725034 - RNA, 64 nt, hsa; identical to SEQ ID NO: 488961

SEQ ID NO: 725035 - RNA, 64 nt, hsa; identical to SEQ ID NO: 488962

SEQ ID NO: 725036 - RNA, 64 nt, hsa; identical to SEQ ID NO: 488963

SEQ ID NO: 725037 - RNA, 64 nt, hsa; identical to SEQ ID NO: 488964

SEQ ID NO: 725038 - RNA, 64 nt, hsa; identical to SEQ ID NO: 488965

SEQ ID NO: 725039 - RNA, 64 nt, hsa; identical to SEQ ID NO: 488966

SEQ ID NO: 725040 - RNA, 64 nt, hsa; identical to SEQ ID NO: 488967

SEQ ID NO: 725041 - RNA, 64 nt, hsa; identical to SEQ ID NO: 488968

SEQ ID NO: 725042 - RNA, 64 nt, hsa; identical to SEQ ID NO: 488969

SEQ ID NO: 725043 - RNA, 64 nt, hsa; identical to SEQ ID NO: 488970

SEQ ID NO: 725044 - RNA, 64 nt, hsa; identical to SEQ ID NO: 488971

SEQ ID NO: 725045 - RNA, 64 nt, hsa; identical to SEQ ID NO: 488972

SEQ ID NO: 725046 - RNA, 64 nt, hsa; identical to SEQ ID NO: 488973

SEQ ID NO: 725047 - RNA, 64 nt, hsa; identical to SEQ ID NO: 488974

SEQ ID NO: 725048 - RNA, 64 nt, hsa; identical to SEQ ID NO: 488975

SEQ ID NO: 725049 - RNA, 64 nt, hsa; identical to SEQ ID NO: 488976

SEQ ID NO: 725050 - RNA, 64 nt, hsa; identical to SEQ ID NO: 488977

SEQ ID NO: 725051 - RNA, 64 nt, hsa; identical to SEQ ID NO: 488978

SEQ ID NO: 725052 - RNA, 64 nt, hsa; identical to SEQ ID NO: 488979

SEQ ID NO: 725053 - RNA, 64 nt, hsa; identical to SEQ ID NO: 488980

SEQ ID NO: 725054 - RNA, 64 nt, hsa; identical to SEQ ID NO: 488981

SEQ ID NO: 725055 - RNA, 64 nt, hsa; identical to SEQ ID NO: 488982

SEQ ID NO: 725056 - RNA, 64 nt, hsa; identical to SEQ ID NO: 488983

SEQ ID NO: 725057 - RNA, 64 nt, hsa; identical to SEQ ID NO: 488984

SEQ ID NO: 725058 - RNA, 64 nt, hsa; identical to SEQ ID NO: 488985

SEQ ID NO: 725059 - RNA, 64 nt, hsa; identical to SEQ ID NO: 488986

SEQ ID NO: 725060 - RNA, 64 nt, hsa; identical to SEQ ID NO: 488987

SEQ ID NO: 725061 - RNA, 64 nt, hsa; identical to SEQ ID NO: 488988

SEQ ID NO: 725062 - RNA, 64 nt, hsa; identical to SEQ ID NO: 488989

SEQ ID NO: 725063 - RNA, 64 nt, hsa; identical to SEQ ID NO: 488990

SEQ ID NO: 725064 - RNA, 64 nt, hsa; identical to SEQ ID NO: 488991

SEQ ID NO: 725065 - RNA, 64 nt, hsa; identical to SEQ ID NO: 488992

SEQ ID NO: 725066 - RNA, 64 nt, hsa; identical to SEQ ID NO: 488993

SEQ ID NO: 725067 - RNA, 64 nt, hsa; identical to SEQ ID NO: 488994

SEQ ID NO: 725068 - RNA, 64 nt, hsa; identical to SEQ ID NO: 488995

SEQ ID NO: 725069 - RNA, 64 nt, hsa; identical to SEQ ID NO: 488996

SEQ ID NO: 725070 - RNA, 64 nt, hsa; identical to SEQ ID NO: 488997

SEQ ID NO: 725071 - RNA, 64 nt, hsa; identical to SEQ ID NO: 488998

SEQ ID NO: 725072 - RNA, 64 nt, hsa; identical to SEQ ID NO: 488999

SEQ ID NO: 725073 - RNA, 64 nt, hsa; identical to SEQ ID NO: 489000

SEQ ID NO: 725074 - RNA, 64 nt, hsa; identical to SEQ ID NO: 489001

SEQ ID NO: 725075 - RNA, 64 nt, hsa; identical to SEQ ID NO: 489002

SEQ ID NO: 725076 - RNA, 64 nt, hsa; identical to SEQ ID NO: 489003

SEQ ID NO: 725077 - RNA, 64 nt, hsa; identical to SEQ ID NO: 489004

SEQ ID NO: 725078 - RNA, 64 nt, hsa; identical to SEQ ID NO: 489005

SEQ ID NO: 725079 - RNA, 64 nt, hsa; identical to SEQ ID NO: 489006

SEQ ID NO: 725080 - RNA, 64 nt, hsa; identical to SEQ ID NO: 489007

SEQ ID NO: 725081 - RNA, 64 nt, hsa; identical to SEQ ID NO: 489008

SEQ ID NO: 725082 - RNA, 64 nt, hsa; identical to SEQ ID NO: 489009

SEQ ID NO: 725083 - RNA, 64 nt, hsa; identical to SEQ ID NO: 489010

SEQ ID NO: 725084 - RNA, 64 nt, hsa; identical to SEQ ID NO: 489011

SEQ ID NO: 725085 - RNA, 64 nt, hsa; identical to SEQ ID NO: 489012

SEQ ID NO: 725086 - RNA, 64 nt, hsa; identical to SEQ ID NO: 489013

SEQ ID NO: 725087 - RNA, 64 nt, hsa; identical to SEQ ID NO: 489014

SEQ ID NO: 725088 - RNA, 64 nt, hsa; identical to SEQ ID NO: 489015

SEQ ID NO: 725089 - RNA, 64 nt, hsa; identical to SEQ ID NO: 489016

SEQ ID NO: 725090 - RNA, 64 nt, hsa; identical to SEQ ID NO: 489017

SEQ ID NO: 725091 - RNA, 64 nt, hsa; identical to SEQ ID NO: 489018

SEQ ID NO: 725092 - RNA, 64 nt, hsa; identical to SEQ ID NO: 489019

SEQ ID NO: 725093 - RNA, 64 nt, hsa; identical to SEQ ID NO: 489020

SEQ ID NO: 725094 - RNA, 64 nt, hsa; identical to SEQ ID NO: 489021

SEQ ID NO: 725095 - RNA, 64 nt, hsa; identical to SEQ ID NO: 489022

SEQ ID NO: 725096 - RNA, 64 nt, hsa; identical to SEQ ID NO: 489023

SEQ ID NO: 725097 - RNA, 64 nt, hsa; identical to SEQ ID NO: 489024

SEQ ID NO: 725098 - RNA, 64 nt, hsa; identical to SEQ ID NO: 489025

SEQ ID NO: 725099 - RNA, 64 nt, hsa; identical to SEQ ID NO: 489026

SEQ ID NO: 725100 - RNA, 64 nt, hsa; identical to SEQ ID NO: 489027

SEQ ID NO: 725101 - RNA, 64 nt, hsa; identical to SEQ ID NO: 489028

SEQ ID NO: 725102 - RNA, 64 nt, hsa; identical to SEQ ID NO: 489029

SEQ ID NO: 725103 - RNA, 64 nt, hsa; identical to SEQ ID NO: 489030

SEQ ID NO: 725104 - RNA, 64 nt, hsa; identical to SEQ ID NO: 489031

SEQ ID NO: 725105 - RNA, 64 nt, hsa; identical to SEQ ID NO: 489032

SEQ ID NO: 725106 - RNA, 64 nt, hsa; identical to SEQ ID NO: 489033

SEQ ID NO: 725107 - RNA, 64 nt, hsa; identical to SEQ ID NO: 489034

SEQ ID NO: 725108 - RNA, 64 nt, hsa; identical to SEQ ID NO: 489035

SEQ ID NO: 725109 - RNA, 64 nt, hsa; identical to SEQ ID NO: 489036

SEQ ID NO: 725110 - RNA, 64 nt, hsa; identical to SEQ ID NO: 489037

SEQ ID NO: 725111 - RNA, 64 nt, hsa; identical to SEQ ID NO: 489038

SEQ ID NO: 725112 - RNA, 64 nt, hsa; identical to SEQ ID NO: 489039

SEQ ID NO: 725113 - RNA, 64 nt, hsa; identical to SEQ ID NO: 489040

SEQ ID NO: 725114 - RNA, 64 nt, hsa; identical to SEQ ID NO: 489041

SEQ ID NO: 725115 - RNA, 64 nt, hsa; identical to SEQ ID NO: 489042

SEQ ID NO: 725116 - RNA, 64 nt, hsa; identical to SEQ ID NO: 489043

SEQ ID NO: 725117 - RNA, 64 nt, hsa; identical to SEQ ID NO: 489044

SEQ ID NO: 725118 - RNA, 64 nt, hsa; identical to SEQ ID NO: 489045

SEQ ID NO: 725119 - RNA, 64 nt, hsa; identical to SEQ ID NO: 489046

SEQ ID NO: 725120 - RNA, 64 nt, hsa; identical to SEQ ID NO: 489047

SEQ ID NO: 725121 - RNA, 64 nt, hsa; identical to SEQ ID NO: 489048

SEQ ID NO: 725122 - RNA, 64 nt, hsa; identical to SEQ ID NO: 489049

SEQ ID NO: 725123 - RNA, 64 nt, hsa; identical to SEQ ID NO: 489050

SEQ ID NO: 725124 - RNA, 64 nt, hsa; identical to SEQ ID NO: 489051

SEQ ID NO: 725125 - RNA, 64 nt, hsa; identical to SEQ ID NO: 489052

SEQ ID NO: 725126 - RNA, 64 nt, hsa; identical to SEQ ID NO: 489053

SEQ ID NO: 725127 - RNA, 64 nt, hsa; identical to SEQ ID NO: 489054

SEQ ID NO: 725128 - RNA, 64 nt, hsa; identical to SEQ ID NO: 489055

SEQ ID NO: 725129 - RNA, 64 nt, hsa; identical to SEQ ID NO: 489056

SEQ ID NO: 725130 - RNA, 64 nt, hsa; identical to SEQ ID NO: 489057

SEQ ID NO: 725131 - RNA, 64 nt, hsa; identical to SEQ ID NO: 555644

SEQ ID NO: 725132 - RNA, 64 nt, hsa; identical to SEQ ID NO: 555645

SEQ ID NO: 725133 - RNA, 64 nt, hsa; identical to SEQ ID NO: 555646

SEQ ID NO: 725134 - RNA, 64 nt, hsa; identical to SEQ ID NO: 555647

SEQ ID NO: 725135 - RNA, 64 nt, hsa; identical to SEQ ID NO: 555648

SEQ ID NO: 725136 - RNA, 64 nt, hsa; identical to SEQ ID NO: 555649

SEQ ID NO: 725137 - RNA, 64 nt, hsa; identical to SEQ ID NO: 555650

SEQ ID NO: 725138 - RNA, 64 nt, hsa; identical to SEQ ID NO: 555651

SEQ ID NO: 725139 - RNA, 64 nt, hsa; identical to SEQ ID NO: 555652

SEQ ID NO: 725140 - RNA, 64 nt, hsa; identical to SEQ ID NO: 555653

SEQ ID NO: 725141 - RNA, 64 nt, hsa; identical to SEQ ID NO: 555654

SEQ ID NO: 725142 - RNA, 64 nt, hsa; identical to SEQ ID NO: 555655

SEQ ID NO: 725143 - RNA, 64 nt, hsa; identical to SEQ ID NO: 555656

SEQ ID NO: 725144 - RNA, 64 nt, hsa; identical to SEQ ID NO: 555657

SEQ ID NO: 725145 - RNA, 64 nt, hsa; identical to SEQ ID NO: 555658

SEQ ID NO: 725146 - RNA, 64 nt, hsa; identical to SEQ ID NO: 555659

SEQ ID NO: 725147 - RNA, 64 nt, hsa; identical to SEQ ID NO: 555660

SEQ ID NO: 725148 - RNA, 64 nt, hsa; identical to SEQ ID NO: 555661

SEQ ID NO: 725149 - RNA, 64 nt, hsa; identical to SEQ ID NO: 555662

SEQ ID NO: 725150 - RNA, 64 nt, hsa; identical to SEQ ID NO: 555663

SEQ ID NO: 725151 - RNA, 64 nt, hsa; identical to SEQ ID NO: 488598

SEQ ID NO: 725152 - RNA, 64 nt, hsa; identical to SEQ ID NO: 488599

SEQ ID NO: 725153 - RNA, 64 nt, hsa; identical to SEQ ID NO: 488600

SEQ ID NO: 725154 - RNA, 64 nt, hsa; identical to SEQ ID NO: 488601

SEQ ID NO: 725155 - RNA, 64 nt, hsa; identical to SEQ ID NO: 488602

SEQ ID NO: 725156 - RNA, 64 nt, hsa; identical to SEQ ID NO: 488603

SEQ ID NO: 725157 - RNA, 64 nt, hsa; identical to SEQ ID NO: 488604

SEQ ID NO: 725158 - RNA, 64 nt, hsa; identical to SEQ ID NO: 488605

SEQ ID NO: 725159 - RNA, 64 nt, hsa; identical to SEQ ID NO: 488606

SEQ ID NO: 725160 - RNA, 64 nt, hsa; identical to SEQ ID NO: 488607

SEQ ID NO: 725161 - RNA, 64 nt, hsa; identical to SEQ ID NO: 488608

SEQ ID NO: 725162 - RNA, 64 nt, hsa; identical to SEQ ID NO: 488609

SEQ ID NO: 725163 - RNA, 64 nt, hsa; identical to SEQ ID NO: 488610

SEQ ID NO: 725164 - RNA, 64 nt, hsa; identical to SEQ ID NO: 488611

SEQ ID NO: 725165 - RNA, 64 nt, hsa; identical to SEQ ID NO: 488612

SEQ ID NO: 725166 - RNA, 64 nt, hsa; identical to SEQ ID NO: 488613

SEQ ID NO: 725167 - RNA, 64 nt, hsa; identical to SEQ ID NO: 488614

SEQ ID NO: 725168 - RNA, 64 nt, hsa; identical to SEQ ID NO: 488615

SEQ ID NO: 725169 - RNA, 64 nt, hsa; identical to SEQ ID NO: 488616

SEQ ID NO: 725170 - RNA, 64 nt, hsa; identical to SEQ ID NO: 488617

SEQ ID NO: 725171 - RNA, 64 nt, hsa; identical to SEQ ID NO: 488618

SEQ ID NO: 725172 - RNA, 64 nt, hsa; identical to SEQ ID NO: 488619

SEQ ID NO: 725173 - RNA, 64 nt, hsa; identical to SEQ ID NO: 488620

SEQ ID NO: 725174 - RNA, 64 nt, hsa; identical to SEQ ID NO: 488621

SEQ ID NO: 725175 - RNA, 64 nt, hsa; identical to SEQ ID NO: 488622

SEQ ID NO: 725176 - RNA, 64 nt, hsa; identical to SEQ ID NO: 488623

SEQ ID NO: 725177 - RNA, 64 nt, hsa; identical to SEQ ID NO: 488624

SEQ ID NO: 725178 - RNA, 64 nt, hsa; identical to SEQ ID NO: 488625

SEQ ID NO: 725179 - RNA, 64 nt, hsa; identical to SEQ ID NO: 488626

SEQ ID NO: 725180 - RNA, 64 nt, hsa; identical to SEQ ID NO: 488627

SEQ ID NO: 725181 - RNA, 64 nt, hsa; identical to SEQ ID NO: 488628

SEQ ID NO: 725182 - RNA, 64 nt, hsa; identical to SEQ ID NO: 488629

SEQ ID NO: 725183 - RNA, 64 nt, hsa; identical to SEQ ID NO: 488630

SEQ ID NO: 725184 - RNA, 64 nt, hsa; identical to SEQ ID NO: 488631

SEQ ID NO: 725185 - RNA, 64 nt, hsa; identical to SEQ ID NO: 488632

SEQ ID NO: 725186 - RNA, 64 nt, hsa; identical to SEQ ID NO: 488633

SEQ ID NO: 725187 - RNA, 64 nt, hsa; identical to SEQ ID NO: 488634

SEQ ID NO: 725188 - RNA, 64 nt, hsa; identical to SEQ ID NO: 488635

SEQ ID NO: 725189 - RNA, 64 nt, hsa; identical to SEQ ID NO: 488636

SEQ ID NO: 725190 - RNA, 64 nt, hsa; identical to SEQ ID NO: 488637

SEQ ID NO: 725191 - RNA, 64 nt, hsa; identical to SEQ ID NO: 488638

SEQ ID NO: 725192 - RNA, 64 nt, hsa; identical to SEQ ID NO: 488639

SEQ ID NO: 725193 - RNA, 64 nt, hsa; identical to SEQ ID NO: 488640

SEQ ID NO: 725194 - RNA, 64 nt, hsa; identical to SEQ ID NO: 488641

SEQ ID NO: 725195 - RNA, 64 nt, hsa; identical to SEQ ID NO: 488642

SEQ ID NO: 725196 - RNA, 64 nt, hsa; identical to SEQ ID NO: 488643

SEQ ID NO: 725197 - RNA, 64 nt, hsa; identical to SEQ ID NO: 488644

SEQ ID NO: 725198 - RNA, 64 nt, hsa; identical to SEQ ID NO: 488645

SEQ ID NO: 725199 - RNA, 64 nt, hsa; identical to SEQ ID NO: 488646

SEQ ID NO: 725200 - RNA, 64 nt, hsa; identical to SEQ ID NO: 488647

SEQ ID NO: 725201 - RNA, 64 nt, hsa; identical to SEQ ID NO: 488648

SEQ ID NO: 725202 - RNA, 64 nt, hsa; identical to SEQ ID NO: 488649

SEQ ID NO: 725203 - RNA, 64 nt, hsa; identical to SEQ ID NO: 488650

SEQ ID NO: 725204 - RNA, 64 nt, hsa; identical to SEQ ID NO: 488651

SEQ ID NO: 725205 - RNA, 64 nt, hsa; identical to SEQ ID NO: 488652

SEQ ID NO: 725206 - RNA, 64 nt, hsa; identical to SEQ ID NO: 488653

SEQ ID NO: 725207 - RNA, 64 nt, hsa; identical to SEQ ID NO: 488654

SEQ ID NO: 725208 - RNA, 64 nt, hsa; identical to SEQ ID NO: 488655

SEQ ID NO: 725209 - RNA, 64 nt, hsa; identical to SEQ ID NO: 488656

SEQ ID NO: 725210 - RNA, 64 nt, hsa; identical to SEQ ID NO: 488657

SEQ ID NO: 725211 - RNA, 64 nt, hsa; identical to SEQ ID NO: 488658

SEQ ID NO: 725212 - RNA, 64 nt, hsa; identical to SEQ ID NO: 488659

SEQ ID NO: 725213 - RNA, 64 nt, hsa; identical to SEQ ID NO: 488660

SEQ ID NO: 725214 - RNA, 64 nt, hsa; identical to SEQ ID NO: 488661

SEQ ID NO: 725215 - RNA, 64 nt, hsa; identical to SEQ ID NO: 488662

SEQ ID NO: 725216 - RNA, 64 nt, hsa; identical to SEQ ID NO: 488663

SEQ ID NO: 725217 - RNA, 64 nt, hsa; identical to SEQ ID NO: 488664

SEQ ID NO: 725218 - RNA, 64 nt, hsa; identical to SEQ ID NO: 488665

SEQ ID NO: 725219 - RNA, 64 nt, hsa; identical to SEQ ID NO: 488666

SEQ ID NO: 725220 - RNA, 64 nt, hsa; identical to SEQ ID NO: 488667

SEQ ID NO: 725221 - RNA, 64 nt, hsa; identical to SEQ ID NO: 488668

SEQ ID NO: 725222 - RNA, 64 nt, hsa; identical to SEQ ID NO: 488669

SEQ ID NO: 725223 - RNA, 64 nt, hsa; identical to SEQ ID NO: 488670

SEQ ID NO: 725224 - RNA, 64 nt, hsa; identical to SEQ ID NO: 488671

SEQ ID NO: 725225 - RNA, 64 nt, hsa; identical to SEQ ID NO: 488672

SEQ ID NO: 725226 - RNA, 64 nt, hsa; identical to SEQ ID NO: 488673

SEQ ID NO: 725227 - RNA, 64 nt, hsa; identical to SEQ ID NO: 488674

SEQ ID NO: 725228 - RNA, 64 nt, hsa; identical to SEQ ID NO: 488675

SEQ ID NO: 725229 - RNA, 64 nt, hsa; identical to SEQ ID NO: 488676

SEQ ID NO: 725230 - RNA, 64 nt, hsa; identical to SEQ ID NO: 488677

SEQ ID NO: 725231 - RNA, 64 nt, hsa; identical to SEQ ID NO: 488678

SEQ ID NO: 725232 - RNA, 64 nt, hsa; identical to SEQ ID NO: 488679

SEQ ID NO: 725233 - RNA, 64 nt, hsa; identical to SEQ ID NO: 488680

SEQ ID NO: 725234 - RNA, 64 nt, hsa; identical to SEQ ID NO: 488681

SEQ ID NO: 725235 - RNA, 64 nt, hsa; identical to SEQ ID NO: 488682

SEQ ID NO: 725236 - RNA, 64 nt, hsa; identical to SEQ ID NO: 488683

SEQ ID NO: 725237 - RNA, 64 nt, hsa; identical to SEQ ID NO: 488684

SEQ ID NO: 725238 - RNA, 64 nt, hsa; identical to SEQ ID NO: 488685

SEQ ID NO: 725239 - RNA, 64 nt, hsa; identical to SEQ ID NO: 488686

SEQ ID NO: 725240 - RNA, 64 nt, hsa; identical to SEQ ID NO: 488687

SEQ ID NO: 725241 - RNA, 64 nt, hsa; identical to SEQ ID NO: 488688

SEQ ID NO: 725242 - RNA, 64 nt, hsa; identical to SEQ ID NO: 488689

SEQ ID NO: 725243 - RNA, 64 nt, hsa; identical to SEQ ID NO: 488690

SEQ ID NO: 725244 - RNA, 64 nt, hsa; identical to SEQ ID NO: 488691

SEQ ID NO: 725245 - RNA, 64 nt, hsa; identical to SEQ ID NO: 488692

SEQ ID NO: 725246 - RNA, 64 nt, hsa; identical to SEQ ID NO: 488693

SEQ ID NO: 725247 - RNA, 64 nt, hsa; identical to SEQ ID NO: 488694

SEQ ID NO: 725248 - RNA, 64 nt, hsa; identical to SEQ ID NO: 488695

SEQ ID NO: 725249 - RNA, 64 nt, hsa; identical to SEQ ID NO: 488696

SEQ ID NO: 725250 - RNA, 64 nt, hsa; identical to SEQ ID NO: 488697

SEQ ID NO: 725251 - RNA, 64 nt, hsa; identical to SEQ ID NO: 488698

SEQ ID NO: 725252 - RNA, 64 nt, hsa; identical to SEQ ID NO: 488699

SEQ ID NO: 725253 - RNA, 64 nt, hsa; identical to SEQ ID NO: 488700

SEQ ID NO: 725254 - RNA, 64 nt, hsa; identical to SEQ ID NO: 488701

SEQ ID NO: 725255 - RNA, 64 nt, hsa; identical to SEQ ID NO: 488702

SEQ ID NO: 725256 - RNA, 64 nt, hsa; identical to SEQ ID NO: 488703

SEQ ID NO: 725257 - RNA, 64 nt, hsa; identical to SEQ ID NO: 488704

SEQ ID NO: 725258 - RNA, 64 nt, hsa; identical to SEQ ID NO: 488705

SEQ ID NO: 725259 - RNA, 64 nt, hsa; identical to SEQ ID NO: 488706

SEQ ID NO: 725260 - RNA, 64 nt, hsa; identical to SEQ ID NO: 488707

SEQ ID NO: 725261 - RNA, 64 nt, hsa; identical to SEQ ID NO: 488708

SEQ ID NO: 725262 - RNA, 64 nt, hsa; identical to SEQ ID NO: 488709

SEQ ID NO: 725263 - RNA, 64 nt, hsa; identical to SEQ ID NO: 488710

SEQ ID NO: 725264 - RNA, 64 nt, hsa; identical to SEQ ID NO: 488711

SEQ ID NO: 725265 - RNA, 64 nt, hsa; identical to SEQ ID NO: 488712

SEQ ID NO: 725266 - RNA, 64 nt, hsa; identical to SEQ ID NO: 488713

SEQ ID NO: 725267 - RNA, 64 nt, hsa; identical to SEQ ID NO: 488714

SEQ ID NO: 725268 - RNA, 64 nt, hsa; identical to SEQ ID NO: 488715

SEQ ID NO: 725269 - RNA, 64 nt, hsa; identical to SEQ ID NO: 488716

SEQ ID NO: 725270 - RNA, 64 nt, hsa; identical to SEQ ID NO: 488717

SEQ ID NO: 725271 - RNA, 64 nt, hsa; identical to SEQ ID NO: 488718

SEQ ID NO: 725272 - RNA, 64 nt, hsa; identical to SEQ ID NO: 488719

SEQ ID NO: 725273 - RNA, 64 nt, hsa; identical to SEQ ID NO: 488720

SEQ ID NO: 725274 - RNA, 64 nt, hsa; identical to SEQ ID NO: 488721

SEQ ID NO: 725275 - RNA, 64 nt, hsa; identical to SEQ ID NO: 488722

SEQ ID NO: 725276 - RNA, 64 nt, hsa; identical to SEQ ID NO: 488723

SEQ ID NO: 725277 - RNA, 64 nt, hsa; identical to SEQ ID NO: 488724

SEQ ID NO: 725278 - RNA, 64 nt, hsa; identical to SEQ ID NO: 488725

SEQ ID NO: 725279 - RNA, 64 nt, hsa; identical to SEQ ID NO: 488726

SEQ ID NO: 725280 - RNA, 64 nt, hsa; identical to SEQ ID NO: 488727

SEQ ID NO: 725281 - RNA, 64 nt, hsa; identical to SEQ ID NO: 488728

SEQ ID NO: 725282 - RNA, 64 nt, hsa; identical to SEQ ID NO: 488729

SEQ ID NO: 725283 - RNA, 64 nt, hsa; identical to SEQ ID NO: 488730

SEQ ID NO: 725284 - RNA, 64 nt, hsa; identical to SEQ ID NO: 488731

SEQ ID NO: 725285 - RNA, 64 nt, hsa; identical to SEQ ID NO: 488732

SEQ ID NO: 725286 - RNA, 64 nt, hsa; identical to SEQ ID NO: 488733

SEQ ID NO: 725287 - RNA, 64 nt, hsa; identical to SEQ ID NO: 488734

SEQ ID NO: 725288 - RNA, 64 nt, hsa; identical to SEQ ID NO: 488735

SEQ ID NO: 725289 - RNA, 64 nt, hsa; identical to SEQ ID NO: 488736

SEQ ID NO: 725290 - RNA, 64 nt, hsa; identical to SEQ ID NO: 488737

SEQ ID NO: 725291 - RNA, 64 nt, hsa; identical to SEQ ID NO: 488738

SEQ ID NO: 725292 - RNA, 64 nt, hsa; identical to SEQ ID NO: 488739

SEQ ID NO: 725293 - RNA, 64 nt, hsa; identical to SEQ ID NO: 488740

SEQ ID NO: 725294 - RNA, 64 nt, hsa; identical to SEQ ID NO: 488741

SEQ ID NO: 725295 - RNA, 64 nt, hsa; identical to SEQ ID NO: 488742

SEQ ID NO: 725296 - RNA, 64 nt, hsa; identical to SEQ ID NO: 488743

SEQ ID NO: 725297 - RNA, 64 nt, hsa; identical to SEQ ID NO: 488744

SEQ ID NO: 725298 - RNA, 64 nt, hsa; identical to SEQ ID NO: 488745

SEQ ID NO: 725299 - RNA, 64 nt, hsa; identical to SEQ ID NO: 488746

SEQ ID NO: 725300 - RNA, 64 nt, hsa; identical to SEQ ID NO: 488747

SEQ ID NO: 725301 - RNA, 64 nt, hsa; identical to SEQ ID NO: 488748

SEQ ID NO: 725302 - RNA, 64 nt, hsa; identical to SEQ ID NO: 488749

SEQ ID NO: 725303 - RNA, 64 nt, hsa; identical to SEQ ID NO: 488750

SEQ ID NO: 725304 - RNA, 64 nt, hsa; identical to SEQ ID NO: 488751

SEQ ID NO: 725305 - RNA, 64 nt, hsa; identical to SEQ ID NO: 488752

SEQ ID NO: 725306 - RNA, 64 nt, hsa; identical to SEQ ID NO: 488753

SEQ ID NO: 725307 - RNA, 64 nt, hsa; identical to SEQ ID NO: 488754

SEQ ID NO: 725308 - RNA, 64 nt, hsa; identical to SEQ ID NO: 488755

SEQ ID NO: 725309 - RNA, 64 nt, hsa; identical to SEQ ID NO: 488756

SEQ ID NO: 725310 - RNA, 64 nt, hsa; identical to SEQ ID NO: 488757

SEQ ID NO: 725311 - RNA, 64 nt, hsa; identical to SEQ ID NO: 488758

SEQ ID NO: 725312 - RNA, 64 nt, hsa; identical to SEQ ID NO: 488759

SEQ ID NO: 725313 - RNA, 64 nt, hsa; identical to SEQ ID NO: 488760

SEQ ID NO: 725314 - RNA, 64 nt, hsa; identical to SEQ ID NO: 488761

SEQ ID NO: 725315 - RNA, 64 nt, hsa; identical to SEQ ID NO: 488762

SEQ ID NO: 725316 - RNA, 64 nt, hsa; identical to SEQ ID NO: 488763

SEQ ID NO: 725317 - RNA, 64 nt, hsa; identical to SEQ ID NO: 488764

SEQ ID NO: 725318 - RNA, 64 nt, hsa; identical to SEQ ID NO: 488765

SEQ ID NO: 725319 - RNA, 64 nt, hsa; identical to SEQ ID NO: 488766

SEQ ID NO: 725320 - RNA, 64 nt, hsa; identical to SEQ ID NO: 488767

SEQ ID NO: 725321 - RNA, 64 nt, hsa; identical to SEQ ID NO: 488768

SEQ ID NO: 725322 - RNA, 64 nt, hsa; identical to SEQ ID NO: 488769

SEQ ID NO: 725323 - RNA, 64 nt, hsa; identical to SEQ ID NO: 488770

SEQ ID NO: 725324 - RNA, 64 nt, hsa; identical to SEQ ID NO: 488771

SEQ ID NO: 725325 - RNA, 64 nt, hsa; identical to SEQ ID NO: 488772

SEQ ID NO: 725326 - RNA, 64 nt, hsa; identical to SEQ ID NO: 488773

SEQ ID NO: 725327 - RNA, 64 nt, hsa; identical to SEQ ID NO: 488774

SEQ ID NO: 725328 - RNA, 64 nt, hsa; identical to SEQ ID NO: 488775

SEQ ID NO: 725329 - RNA, 64 nt, hsa; identical to SEQ ID NO: 488776

SEQ ID NO: 725330 - RNA, 64 nt, hsa; identical to SEQ ID NO: 488777

SEQ ID NO: 725331 - RNA, 64 nt, hsa; identical to SEQ ID NO: 488778

SEQ ID NO: 725332 - RNA, 64 nt, hsa; identical to SEQ ID NO: 488779

SEQ ID NO: 725333 - RNA, 64 nt, hsa; identical to SEQ ID NO: 488780

SEQ ID NO: 725334 - RNA, 64 nt, hsa; identical to SEQ ID NO: 488781

SEQ ID NO: 725335 - RNA, 64 nt, hsa; identical to SEQ ID NO: 488782

SEQ ID NO: 725336 - RNA, 64 nt, hsa; identical to SEQ ID NO: 488783

SEQ ID NO: 725337 - RNA, 64 nt, hsa; identical to SEQ ID NO: 488784

SEQ ID NO: 725338 - RNA, 64 nt, hsa; identical to SEQ ID NO: 488785

SEQ ID NO: 725339 - RNA, 64 nt, hsa; identical to SEQ ID NO: 488786

SEQ ID NO: 725340 - RNA, 64 nt, hsa; identical to SEQ ID NO: 488787

SEQ ID NO: 725341 - RNA, 64 nt, hsa; identical to SEQ ID NO: 488788

SEQ ID NO: 725342 - RNA, 64 nt, hsa; identical to SEQ ID NO: 488789

SEQ ID NO: 725343 - RNA, 64 nt, hsa; identical to SEQ ID NO: 488790

SEQ ID NO: 725344 - RNA, 64 nt, hsa; identical to SEQ ID NO: 488791

SEQ ID NO: 725345 - RNA, 64 nt, hsa; identical to SEQ ID NO: 488792

SEQ ID NO: 725346 - RNA, 64 nt, hsa; identical to SEQ ID NO: 488793

SEQ ID NO: 725347 - RNA, 64 nt, hsa; identical to SEQ ID NO: 488794

SEQ ID NO: 725348 - RNA, 64 nt, hsa; identical to SEQ ID NO: 488795

SEQ ID NO: 725349 - RNA, 64 nt, hsa; identical to SEQ ID NO: 488796

SEQ ID NO: 725350 - RNA, 64 nt, hsa; identical to SEQ ID NO: 488797

SEQ ID NO: 725351 - RNA, 64 nt, hsa; identical to SEQ ID NO: 488798

SEQ ID NO: 725352 - RNA, 64 nt, hsa; identical to SEQ ID NO: 488799

SEQ ID NO: 725353 - RNA, 64 nt, hsa; identical to SEQ ID NO: 488800

SEQ ID NO: 725354 - RNA, 64 nt, hsa; identical to SEQ ID NO: 488801

SEQ ID NO: 725355 - RNA, 64 nt, hsa; identical to SEQ ID NO: 488802

SEQ ID NO: 725356 - RNA, 64 nt, hsa; identical to SEQ ID NO: 488803

SEQ ID NO: 725357 - RNA, 64 nt, hsa; identical to SEQ ID NO: 488804

SEQ ID NO: 725358 - RNA, 64 nt, hsa; identical to SEQ ID NO: 488805

SEQ ID NO: 725359 - RNA, 64 nt, hsa; identical to SEQ ID NO: 488806

SEQ ID NO: 725360 - RNA, 64 nt, hsa; identical to SEQ ID NO: 488807

SEQ ID NO: 725361 - RNA, 64 nt, hsa; identical to SEQ ID NO: 488808

SEQ ID NO: 725362 - RNA, 64 nt, hsa; identical to SEQ ID NO: 488809

SEQ ID NO: 725363 - RNA, 64 nt, hsa; identical to SEQ ID NO: 488810

SEQ ID NO: 725364 - RNA, 64 nt, hsa; identical to SEQ ID NO: 488811

SEQ ID NO: 725365 - RNA, 64 nt, hsa; identical to SEQ ID NO: 488812

SEQ ID NO: 725366 - RNA, 64 nt, hsa; identical to SEQ ID NO: 488813

SEQ ID NO: 725367 - RNA, 64 nt, hsa; identical to SEQ ID NO: 488814

SEQ ID NO: 725368 - RNA, 64 nt, hsa; identical to SEQ ID NO: 488815

SEQ ID NO: 725369 - RNA, 64 nt, hsa; identical to SEQ ID NO: 488816

SEQ ID NO: 725370 - RNA, 64 nt, hsa; identical to SEQ ID NO: 488817

SEQ ID NO: 725371 - RNA, 64 nt, hsa; identical to SEQ ID NO: 488818

SEQ ID NO: 725372 - RNA, 64 nt, hsa; identical to SEQ ID NO: 488819

SEQ ID NO: 725373 - RNA, 64 nt, hsa; identical to SEQ ID NO: 488820

SEQ ID NO: 725374 - RNA, 64 nt, hsa; identical to SEQ ID NO: 488821

SEQ ID NO: 725375 - RNA, 64 nt, hsa; identical to SEQ ID NO: 488822

SEQ ID NO: 725376 - RNA, 64 nt, hsa; identical to SEQ ID NO: 488823

SEQ ID NO: 725377 - RNA, 64 nt, hsa; identical to SEQ ID NO: 488824

SEQ ID NO: 725378 - RNA, 64 nt, hsa; identical to SEQ ID NO: 488825

SEQ ID NO: 725379 - RNA, 64 nt, hsa; identical to SEQ ID NO: 488826

SEQ ID NO: 725380 - RNA, 64 nt, hsa; identical to SEQ ID NO: 488827

SEQ ID NO: 725381 - RNA, 64 nt, hsa; identical to SEQ ID NO: 488828

SEQ ID NO: 725382 - RNA, 64 nt, hsa; identical to SEQ ID NO: 488829

SEQ ID NO: 725383 - RNA, 64 nt, hsa; identical to SEQ ID NO: 488830

SEQ ID NO: 725384 - RNA, 64 nt, hsa; identical to SEQ ID NO: 488831

SEQ ID NO: 725385 - RNA, 64 nt, hsa; identical to SEQ ID NO: 488832

SEQ ID NO: 725386 - RNA, 64 nt, hsa; identical to SEQ ID NO: 488833

SEQ ID NO: 725387 - RNA, 64 nt, hsa; identical to SEQ ID NO: 488834

SEQ ID NO: 725388 - RNA, 64 nt, hsa; identical to SEQ ID NO: 488835

SEQ ID NO: 725389 - RNA, 64 nt, hsa; identical to SEQ ID NO: 488836

SEQ ID NO: 725390 - RNA, 64 nt, hsa; identical to SEQ ID NO: 488837

SEQ ID NO: 725391 - RNA, 64 nt, hsa; identical to SEQ ID NO: 488838

SEQ ID NO: 725392 - RNA, 64 nt, hsa; identical to SEQ ID NO: 488839

SEQ ID NO: 725393 - RNA, 64 nt, hsa; identical to SEQ ID NO: 488840

SEQ ID NO: 725394 - RNA, 64 nt, hsa; identical to SEQ ID NO: 488841

SEQ ID NO: 725395 - RNA, 64 nt, hsa; identical to SEQ ID NO: 488842

SEQ ID NO: 725396 - RNA, 64 nt, hsa; identical to SEQ ID NO: 488843

SEQ ID NO: 725397 - RNA, 64 nt, hsa; identical to SEQ ID NO: 488844

SEQ ID NO: 725398 - RNA, 64 nt, hsa; identical to SEQ ID NO: 488845

SEQ ID NO: 725399 - RNA, 64 nt, hsa; identical to SEQ ID NO: 488846

SEQ ID NO: 725400 - RNA, 64 nt, hsa; identical to SEQ ID NO: 488847

SEQ ID NO: 725401 - RNA, 64 nt, hsa; identical to SEQ ID NO: 488848

SEQ ID NO: 725402 - RNA, 64 nt, hsa; identical to SEQ ID NO: 488849

SEQ ID NO: 725403 - RNA, 64 nt, hsa; identical to SEQ ID NO: 488850

SEQ ID NO: 725404 - RNA, 64 nt, hsa; identical to SEQ ID NO: 488851

SEQ ID NO: 725405 - RNA, 64 nt, hsa; identical to SEQ ID NO: 488852

SEQ ID NO: 725406 - RNA, 64 nt, hsa; identical to SEQ ID NO: 488853

SEQ ID NO: 725407 - RNA, 64 nt, hsa; identical to SEQ ID NO: 488854

SEQ ID NO: 725408 - RNA, 64 nt, hsa; identical to SEQ ID NO: 488855

SEQ ID NO: 725409 - RNA, 64 nt, hsa; identical to SEQ ID NO: 488856

SEQ ID NO: 725410 - RNA, 64 nt, hsa; identical to SEQ ID NO: 488857

SEQ ID NO: 725411 - RNA, 64 nt, hsa; identical to SEQ ID NO: 488858

SEQ ID NO: 725412 - RNA, 64 nt, hsa; identical to SEQ ID NO: 488859

SEQ ID NO: 725413 - RNA, 64 nt, hsa; identical to SEQ ID NO: 488860

SEQ ID NO: 725414 - RNA, 64 nt, hsa; identical to SEQ ID NO: 488861

SEQ ID NO: 725415 - RNA, 64 nt, hsa; identical to SEQ ID NO: 488862

SEQ ID NO: 725416 - RNA, 64 nt, hsa; identical to SEQ ID NO: 488863

SEQ ID NO: 725417 - RNA, 64 nt, hsa; identical to SEQ ID NO: 488864

SEQ ID NO: 725418 - RNA, 64 nt, hsa; identical to SEQ ID NO: 488865

SEQ ID NO: 725419 - RNA, 64 nt, hsa; identical to SEQ ID NO: 488866

SEQ ID NO: 725420 - RNA, 64 nt, hsa; identical to SEQ ID NO: 488867

SEQ ID NO: 725421 - RNA, 64 nt, hsa; identical to SEQ ID NO: 488868

SEQ ID NO: 725422 - RNA, 64 nt, hsa; identical to SEQ ID NO: 488869

SEQ ID NO: 725423 - RNA, 64 nt, hsa; identical to SEQ ID NO: 488870

SEQ ID NO: 725424 - RNA, 64 nt, hsa; identical to SEQ ID NO: 488871

SEQ ID NO: 725425 - RNA, 64 nt, hsa; identical to SEQ ID NO: 488872

SEQ ID NO: 725426 - RNA, 64 nt, hsa; identical to SEQ ID NO: 488873

SEQ ID NO: 725427 - RNA, 64 nt, hsa; identical to SEQ ID NO: 488874

SEQ ID NO: 725428 - RNA, 64 nt, hsa; identical to SEQ ID NO: 488875

SEQ ID NO: 725429 - RNA, 64 nt, hsa; identical to SEQ ID NO: 488876

SEQ ID NO: 725430 - RNA, 64 nt, hsa; identical to SEQ ID NO: 488877

SEQ ID NO: 725431 - RNA, 64 nt, hsa; identical to SEQ ID NO: 488878

SEQ ID NO: 725432 - RNA, 64 nt, hsa; identical to SEQ ID NO: 488879

SEQ ID NO: 725433 - RNA, 64 nt, hsa; identical to SEQ ID NO: 488880

SEQ ID NO: 725434 - RNA, 64 nt, hsa; identical to SEQ ID NO: 488881

SEQ ID NO: 725435 - RNA, 64 nt, hsa; identical to SEQ ID NO: 488882

SEQ ID NO: 725436 - RNA, 64 nt, hsa; identical to SEQ ID NO: 488883

SEQ ID NO: 725437 - RNA, 64 nt, hsa; identical to SEQ ID NO: 488884

SEQ ID NO: 725438 - RNA, 64 nt, hsa; identical to SEQ ID NO: 488885

SEQ ID NO: 725439 - RNA, 64 nt, hsa; identical to SEQ ID NO: 488886

SEQ ID NO: 725440 - RNA, 64 nt, hsa; identical to SEQ ID NO: 488887

SEQ ID NO: 725441 - RNA, 64 nt, hsa; identical to SEQ ID NO: 488888

SEQ ID NO: 725442 - RNA, 64 nt, hsa; identical to SEQ ID NO: 488889

SEQ ID NO: 725443 - RNA, 64 nt, hsa; identical to SEQ ID NO: 488890

SEQ ID NO: 725444 - RNA, 64 nt, hsa; identical to SEQ ID NO: 488891

SEQ ID NO: 725445 - RNA, 64 nt, hsa; identical to SEQ ID NO: 488892

SEQ ID NO: 725446 - RNA, 64 nt, hsa; identical to SEQ ID NO: 488893

SEQ ID NO: 725447 - RNA, 64 nt, hsa; identical to SEQ ID NO: 488894

SEQ ID NO: 725448 - RNA, 64 nt, hsa; identical to SEQ ID NO: 488895

SEQ ID NO: 725449 - RNA, 64 nt, hsa; identical to SEQ ID NO: 488896

SEQ ID NO: 725450 - RNA, 64 nt, hsa; identical to SEQ ID NO: 488897

SEQ ID NO: 725451 - RNA, 64 nt, hsa; identical to SEQ ID NO: 488898

SEQ ID NO: 725452 - RNA, 64 nt, hsa; identical to SEQ ID NO: 488899

SEQ ID NO: 725453 - RNA, 64 nt, hsa; identical to SEQ ID NO: 488900

SEQ ID NO: 725454 - RNA, 64 nt, hsa; identical to SEQ ID NO: 488901

SEQ ID NO: 725455 - RNA, 64 nt, hsa; identical to SEQ ID NO: 488902

SEQ ID NO: 725456 - RNA, 64 nt, hsa; identical to SEQ ID NO: 488903

SEQ ID NO: 725457 - RNA, 64 nt, hsa; identical to SEQ ID NO: 488904

SEQ ID NO: 725458 - RNA, 64 nt, hsa; identical to SEQ ID NO: 488905

SEQ ID NO: 725459 - RNA, 64 nt, hsa; identical to SEQ ID NO: 488906

SEQ ID NO: 725460 - RNA, 64 nt, hsa; identical to SEQ ID NO: 488907

SEQ ID NO: 725461 - RNA, 64 nt, hsa; identical to SEQ ID NO: 488908

SEQ ID NO: 725462 - RNA, 64 nt, hsa; identical to SEQ ID NO: 488909

SEQ ID NO: 725463 - RNA, 64 nt, hsa; identical to SEQ ID NO: 488910

SEQ ID NO: 725464 - RNA, 64 nt, hsa; identical to SEQ ID NO: 488911

SEQ ID NO: 725465 - RNA, 64 nt, hsa; identical to SEQ ID NO: 488912

SEQ ID NO: 725466 - RNA, 64 nt, hsa; identical to SEQ ID NO: 488913

SEQ ID NO: 725467 - RNA, 64 nt, hsa; identical to SEQ ID NO: 488914

SEQ ID NO: 725468 - RNA, 64 nt, hsa; identical to SEQ ID NO: 488915

SEQ ID NO: 725469 - RNA, 64 nt, hsa; identical to SEQ ID NO: 488916

SEQ ID NO: 725470 - RNA, 64 nt, hsa; identical to SEQ ID NO: 488917

SEQ ID NO: 725471 - RNA, 64 nt, hsa; identical to SEQ ID NO: 488918

SEQ ID NO: 725472 - RNA, 64 nt, hsa; identical to SEQ ID NO: 488919

SEQ ID NO: 725473 - RNA, 64 nt, hsa; identical to SEQ ID NO: 488920

SEQ ID NO: 725474 - RNA, 64 nt, hsa; identical to SEQ ID NO: 488921

SEQ ID NO: 725475 - RNA, 64 nt, hsa; identical to SEQ ID NO: 488922

SEQ ID NO: 725476 - RNA, 64 nt, hsa; identical to SEQ ID NO: 488923

SEQ ID NO: 725477 - RNA, 64 nt, hsa; identical to SEQ ID NO: 488924

SEQ ID NO: 725478 - RNA, 64 nt, hsa; identical to SEQ ID NO: 488925

SEQ ID NO: 725479 - RNA, 64 nt, hsa; identical to SEQ ID NO: 488926

SEQ ID NO: 725480 - RNA, 64 nt, hsa; identical to SEQ ID NO: 488927

SEQ ID NO: 725481 - RNA, 64 nt, hsa; identical to SEQ ID NO: 488928

SEQ ID NO: 725482 - RNA, 64 nt, hsa; identical to SEQ ID NO: 488929

SEQ ID NO: 725483 - RNA, 64 nt, hsa; identical to SEQ ID NO: 488930

SEQ ID NO: 725484 - RNA, 64 nt, hsa; identical to SEQ ID NO: 488931

SEQ ID NO: 725485 - RNA, 64 nt, hsa; identical to SEQ ID NO: 488932

SEQ ID NO: 725486 - RNA, 64 nt, hsa; identical to SEQ ID NO: 488933

SEQ ID NO: 725487 - RNA, 64 nt, hsa; identical to SEQ ID NO: 488934

SEQ ID NO: 725488 - RNA, 64 nt, hsa; identical to SEQ ID NO: 488935

SEQ ID NO: 725489 - RNA, 64 nt, hsa; identical to SEQ ID NO: 488936

SEQ ID NO: 725490 - RNA, 64 nt, hsa; identical to SEQ ID NO: 488937

SEQ ID NO: 725491 - RNA, 64 nt, hsa; identical to SEQ ID NO: 488938

SEQ ID NO: 725492 - RNA, 64 nt, hsa; identical to SEQ ID NO: 488939

SEQ ID NO: 725493 - RNA, 64 nt, hsa; identical to SEQ ID NO: 488940

SEQ ID NO: 725494 - RNA, 64 nt, hsa; identical to SEQ ID NO: 488941

SEQ ID NO: 725495 - RNA, 64 nt, hsa; identical to SEQ ID NO: 488942

SEQ ID NO: 725496 - RNA, 64 nt, hsa; identical to SEQ ID NO: 488943

SEQ ID NO: 725497 - RNA, 64 nt, hsa; identical to SEQ ID NO: 488944

SEQ ID NO: 725498 - RNA, 64 nt, hsa; identical to SEQ ID NO: 488945

SEQ ID NO: 725499 - RNA, 64 nt, hsa; identical to SEQ ID NO: 488946

SEQ ID NO: 725500 - RNA, 64 nt, hsa; identical to SEQ ID NO: 488947

SEQ ID NO: 725501 - RNA, 64 nt, hsa; identical to SEQ ID NO: 488948

SEQ ID NO: 725502 - RNA, 64 nt, hsa; identical to SEQ ID NO: 488949

SEQ ID NO: 725503 - RNA, 64 nt, hsa; identical to SEQ ID NO: 488950

SEQ ID NO: 725504 - RNA, 64 nt, hsa; identical to SEQ ID NO: 488951

SEQ ID NO: 725505 - RNA, 64 nt, hsa; identical to SEQ ID NO: 488952

SEQ ID NO: 725506 - RNA, 64 nt, hsa; identical to SEQ ID NO: 488953

SEQ ID NO: 725507 - RNA, 64 nt, hsa; identical to SEQ ID NO: 488954

SEQ ID NO: 725508 - RNA, 64 nt, hsa; identical to SEQ ID NO: 488955

SEQ ID NO: 725509 - RNA, 64 nt, hsa; identical to SEQ ID NO: 488956

SEQ ID NO: 725510 - RNA, 64 nt, hsa; identical to SEQ ID NO: 488957

SEQ ID NO: 725511 - RNA, 64 nt, hsa; identical to SEQ ID NO: 488958

SEQ ID NO: 725512 - RNA, 64 nt, hsa; identical to SEQ ID NO: 488959

SEQ ID NO: 725513 - RNA, 64 nt, hsa; identical to SEQ ID NO: 488960

SEQ ID NO: 725514 - RNA, 64 nt, hsa; identical to SEQ ID NO: 488961

SEQ ID NO: 725515 - RNA, 64 nt, hsa; identical to SEQ ID NO: 488962

SEQ ID NO: 725516 - RNA, 64 nt, hsa; identical to SEQ ID NO: 488963

SEQ ID NO: 725517 - RNA, 64 nt, hsa; identical to SEQ ID NO: 488964

SEQ ID NO: 725518 - RNA, 64 nt, hsa; identical to SEQ ID NO: 488965

SEQ ID NO: 725519 - RNA, 64 nt, hsa; identical to SEQ ID NO: 488966

SEQ ID NO: 725520 - RNA, 64 nt, hsa; identical to SEQ ID NO: 488967

SEQ ID NO: 725521 - RNA, 64 nt, hsa; identical to SEQ ID NO: 488968

SEQ ID NO: 725522 - RNA, 64 nt, hsa; identical to SEQ ID NO: 488969

SEQ ID NO: 725523 - RNA, 64 nt, hsa; identical to SEQ ID NO: 488970

SEQ ID NO: 725524 - RNA, 64 nt, hsa; identical to SEQ ID NO: 488971

SEQ ID NO: 725525 - RNA, 64 nt, hsa; identical to SEQ ID NO: 488972

SEQ ID NO: 725526 - RNA, 64 nt, hsa; identical to SEQ ID NO: 488973

SEQ ID NO: 725527 - RNA, 64 nt, hsa; identical to SEQ ID NO: 488974

SEQ ID NO: 725528 - RNA, 64 nt, hsa; identical to SEQ ID NO: 488975

SEQ ID NO: 725529 - RNA, 64 nt, hsa; identical to SEQ ID NO: 488976

SEQ ID NO: 725530 - RNA, 64 nt, hsa; identical to SEQ ID NO: 488977

SEQ ID NO: 725531 - RNA, 64 nt, hsa; identical to SEQ ID NO: 488978

SEQ ID NO: 725532 - RNA, 64 nt, hsa; identical to SEQ ID NO: 488979

SEQ ID NO: 725533 - RNA, 64 nt, hsa; identical to SEQ ID NO: 488980

SEQ ID NO: 725534 - RNA, 64 nt, hsa; identical to SEQ ID NO: 488981

SEQ ID NO: 725535 - RNA, 64 nt, hsa; identical to SEQ ID NO: 488982

SEQ ID NO: 725536 - RNA, 64 nt, hsa; identical to SEQ ID NO: 488983

SEQ ID NO: 725537 - RNA, 64 nt, hsa; identical to SEQ ID NO: 488984

SEQ ID NO: 725538 - RNA, 64 nt, hsa; identical to SEQ ID NO: 488985

SEQ ID NO: 725539 - RNA, 64 nt, hsa; identical to SEQ ID NO: 488986

SEQ ID NO: 725540 - RNA, 64 nt, hsa; identical to SEQ ID NO: 488987

SEQ ID NO: 725541 - RNA, 64 nt, hsa; identical to SEQ ID NO: 488988

SEQ ID NO: 725542 - RNA, 64 nt, hsa; identical to SEQ ID NO: 488989

SEQ ID NO: 725543 - RNA, 64 nt, hsa; identical to SEQ ID NO: 488990

SEQ ID NO: 725544 - RNA, 64 nt, hsa; identical to SEQ ID NO: 488991

SEQ ID NO: 725545 - RNA, 64 nt, hsa; identical to SEQ ID NO: 488992

SEQ ID NO: 725546 - RNA, 64 nt, hsa; identical to SEQ ID NO: 488993

SEQ ID NO: 725547 - RNA, 64 nt, hsa; identical to SEQ ID NO: 488994

SEQ ID NO: 725548 - RNA, 64 nt, hsa; identical to SEQ ID NO: 488995

SEQ ID NO: 725549 - RNA, 64 nt, hsa; identical to SEQ ID NO: 488996

SEQ ID NO: 725550 - RNA, 64 nt, hsa; identical to SEQ ID NO: 488997

SEQ ID NO: 725551 - RNA, 64 nt, hsa; identical to SEQ ID NO: 488998

SEQ ID NO: 725552 - RNA, 64 nt, hsa; identical to SEQ ID NO: 488999

SEQ ID NO: 725553 - RNA, 64 nt, hsa; identical to SEQ ID NO: 489000

SEQ ID NO: 725554 - RNA, 64 nt, hsa; identical to SEQ ID NO: 489001

SEQ ID NO: 725555 - RNA, 64 nt, hsa; identical to SEQ ID NO: 489002

SEQ ID NO: 725556 - RNA, 64 nt, hsa; identical to SEQ ID NO: 489003

SEQ ID NO: 725557 - RNA, 64 nt, hsa; identical to SEQ ID NO: 489004

SEQ ID NO: 725558 - RNA, 64 nt, hsa; identical to SEQ ID NO: 489005

SEQ ID NO: 725559 - RNA, 64 nt, hsa; identical to SEQ ID NO: 489006

SEQ ID NO: 725560 - RNA, 64 nt, hsa; identical to SEQ ID NO: 489007

SEQ ID NO: 725561 - RNA, 64 nt, hsa; identical to SEQ ID NO: 489008

SEQ ID NO: 725562 - RNA, 64 nt, hsa; identical to SEQ ID NO: 489009

SEQ ID NO: 725563 - RNA, 64 nt, hsa; identical to SEQ ID NO: 489010

SEQ ID NO: 725564 - RNA, 64 nt, hsa; identical to SEQ ID NO: 489011

SEQ ID NO: 725565 - RNA, 64 nt, hsa; identical to SEQ ID NO: 489012

SEQ ID NO: 725566 - RNA, 64 nt, hsa; identical to SEQ ID NO: 489013

SEQ ID NO: 725567 - RNA, 64 nt, hsa; identical to SEQ ID NO: 489014

SEQ ID NO: 725568 - RNA, 64 nt, hsa; identical to SEQ ID NO: 489015

SEQ ID NO: 725569 - RNA, 64 nt, hsa; identical to SEQ ID NO: 489016

SEQ ID NO: 725570 - RNA, 64 nt, hsa; identical to SEQ ID NO: 489017

SEQ ID NO: 725571 - RNA, 64 nt, hsa; identical to SEQ ID NO: 489018

SEQ ID NO: 725572 - RNA, 64 nt, hsa; identical to SEQ ID NO: 489019

SEQ ID NO: 725573 - RNA, 64 nt, hsa; identical to SEQ ID NO: 489020

SEQ ID NO: 725574 - RNA, 64 nt, hsa; identical to SEQ ID NO: 489021

SEQ ID NO: 725575 - RNA, 64 nt, hsa; identical to SEQ ID NO: 489022

SEQ ID NO: 725576 - RNA, 64 nt, hsa; identical to SEQ ID NO: 489023

SEQ ID NO: 725577 - RNA, 64 nt, hsa; identical to SEQ ID NO: 489024

SEQ ID NO: 725578 - RNA, 64 nt, hsa; identical to SEQ ID NO: 489025

SEQ ID NO: 725579 - RNA, 64 nt, hsa; identical to SEQ ID NO: 489026

SEQ ID NO: 725580 - RNA, 64 nt, hsa; identical to SEQ ID NO: 489027

SEQ ID NO: 725581 - RNA, 64 nt, hsa; identical to SEQ ID NO: 489028

SEQ ID NO: 725582 - RNA, 64 nt, hsa; identical to SEQ ID NO: 489029

SEQ ID NO: 725583 - RNA, 64 nt, hsa; identical to SEQ ID NO: 489030

SEQ ID NO: 725584 - RNA, 64 nt, hsa; identical to SEQ ID NO: 489031

SEQ ID NO: 725585 - RNA, 64 nt, hsa; identical to SEQ ID NO: 489032

SEQ ID NO: 725586 - RNA, 64 nt, hsa; identical to SEQ ID NO: 489033

SEQ ID NO: 725587 - RNA, 64 nt, hsa; identical to SEQ ID NO: 489034

SEQ ID NO: 725588 - RNA, 64 nt, hsa; identical to SEQ ID NO: 489035

SEQ ID NO: 725589 - RNA, 64 nt, hsa; identical to SEQ ID NO: 489036

SEQ ID NO: 725590 - RNA, 64 nt, hsa; identical to SEQ ID NO: 489037

SEQ ID NO: 725591 - RNA, 64 nt, hsa; identical to SEQ ID NO: 489038

SEQ ID NO: 725592 - RNA, 64 nt, hsa; identical to SEQ ID NO: 489039

SEQ ID NO: 725593 - RNA, 64 nt, hsa; identical to SEQ ID NO: 489040

SEQ ID NO: 725594 - RNA, 64 nt, hsa; identical to SEQ ID NO: 489041

SEQ ID NO: 725595 - RNA, 64 nt, hsa; identical to SEQ ID NO: 489042

SEQ ID NO: 725596 - RNA, 64 nt, hsa; identical to SEQ ID NO: 489043

SEQ ID NO: 725597 - RNA, 64 nt, hsa; identical to SEQ ID NO: 489044

SEQ ID NO: 725598 - RNA, 64 nt, hsa; identical to SEQ ID NO: 489045

SEQ ID NO: 725599 - RNA, 64 nt, hsa; identical to SEQ ID NO: 489046

SEQ ID NO: 725600 - RNA, 64 nt, hsa; identical to SEQ ID NO: 489047

SEQ ID NO: 725601 - RNA, 64 nt, hsa; identical to SEQ ID NO: 489048

SEQ ID NO: 725602 - RNA, 64 nt, hsa; identical to SEQ ID NO: 489049

SEQ ID NO: 725603 - RNA, 64 nt, hsa; identical to SEQ ID NO: 489050

SEQ ID NO: 725604 - RNA, 64 nt, hsa; identical to SEQ ID NO: 489051

SEQ ID NO: 725605 - RNA, 64 nt, hsa; identical to SEQ ID NO: 489052

SEQ ID NO: 725606 - RNA, 64 nt, hsa; identical to SEQ ID NO: 489053

SEQ ID NO: 725607 - RNA, 64 nt, hsa; identical to SEQ ID NO: 489054

SEQ ID NO: 725608 - RNA, 64 nt, hsa; identical to SEQ ID NO: 489055

SEQ ID NO: 725609 - RNA, 64 nt, hsa; identical to SEQ ID NO: 489056

SEQ ID NO: 725610 - RNA, 64 nt, hsa; identical to SEQ ID NO: 489057

SEQ ID NO: 725611 - RNA, 64 nt, hsa; identical to SEQ ID NO: 555644

SEQ ID NO: 725612 - RNA, 64 nt, hsa; identical to SEQ ID NO: 555645

SEQ ID NO: 725613 - RNA, 64 nt, hsa; identical to SEQ ID NO: 555646

SEQ ID NO: 725614 - RNA, 64 nt, hsa; identical to SEQ ID NO: 555647

SEQ ID NO: 725615 - RNA, 64 nt, hsa; identical to SEQ ID NO: 555648

SEQ ID NO: 725616 - RNA, 64 nt, hsa; identical to SEQ ID NO: 555649

SEQ ID NO: 725617 - RNA, 64 nt, hsa; identical to SEQ ID NO: 555650

SEQ ID NO: 725618 - RNA, 64 nt, hsa; identical to SEQ ID NO: 555651

SEQ ID NO: 725619 - RNA, 64 nt, hsa; identical to SEQ ID NO: 555652

SEQ ID NO: 725620 - RNA, 64 nt, hsa; identical to SEQ ID NO: 555653

SEQ ID NO: 725621 - RNA, 64 nt, hsa; identical to SEQ ID NO: 555654

SEQ ID NO: 725622 - RNA, 64 nt, hsa; identical to SEQ ID NO: 555655

SEQ ID NO: 725623 - RNA, 64 nt, hsa; identical to SEQ ID NO: 555656

SEQ ID NO: 725624 - RNA, 64 nt, hsa; identical to SEQ ID NO: 555657

SEQ ID NO: 725625 - RNA, 64 nt, hsa; identical to SEQ ID NO: 555658

SEQ ID NO: 725626 - RNA, 64 nt, hsa; identical to SEQ ID NO: 555659

SEQ ID NO: 725627 - RNA, 64 nt, hsa; identical to SEQ ID NO: 555660

SEQ ID NO: 725628 - RNA, 64 nt, hsa; identical to SEQ ID NO: 555661

SEQ ID NO: 725629 - RNA, 64 nt, hsa; identical to SEQ ID NO: 555662

SEQ ID NO: 725630 - RNA, 64 nt, hsa; identical to SEQ ID NO: 555663

SEQ ID NO: 725631 - RNA, 64 nt, hsa; identical to SEQ ID NO: 146945

SEQ ID NO: 725632 - RNA, 64 nt, hsa; identical to SEQ ID NO: 146946

SEQ ID NO: 725633 - RNA, 64 nt, hsa; identical to SEQ ID NO: 146947

SEQ ID NO: 725634 - RNA, 64 nt, hsa; identical to SEQ ID NO: 146948

SEQ ID NO: 725635 - RNA, 64 nt, hsa; identical to SEQ ID NO: 146949

SEQ ID NO: 725636 - RNA, 64 nt, hsa; identical to SEQ ID NO: 146950

SEQ ID NO: 725637 - RNA, 64 nt, hsa; identical to SEQ ID NO: 146951

SEQ ID NO: 725638 - RNA, 64 nt, hsa; identical to SEQ ID NO: 146952

SEQ ID NO: 725639 - RNA, 64 nt, hsa; identical to SEQ ID NO: 146953

SEQ ID NO: 725640 - RNA, 64 nt, hsa; identical to SEQ ID NO: 146954

SEQ ID NO: 725641 - RNA, 64 nt, hsa; identical to SEQ ID NO: 146955

SEQ ID NO: 725642 - RNA, 64 nt, hsa; identical to SEQ ID NO: 146956

SEQ ID NO: 725643 - RNA, 64 nt, hsa; identical to SEQ ID NO: 146957

SEQ ID NO: 725644 - RNA, 64 nt, hsa; identical to SEQ ID NO: 146958

SEQ ID NO: 725645 - RNA, 64 nt, hsa; identical to SEQ ID NO: 146959

SEQ ID NO: 725646 - RNA, 64 nt, hsa; identical to SEQ ID NO: 146960

SEQ ID NO: 725647 - RNA, 64 nt, hsa; identical to SEQ ID NO: 146961

SEQ ID NO: 725648 - RNA, 64 nt, hsa; identical to SEQ ID NO: 146962

SEQ ID NO: 725649 - RNA, 64 nt, hsa; identical to SEQ ID NO: 146963

SEQ ID NO: 725650 - RNA, 64 nt, hsa
caggaccagaguuaagcugauaccuuaggcacacagguuggacuuacauagaggaaagaaagca

SEQ ID NO: 725651 - RNA, 64 nt, hsa
uuuuuuuuuuucccagagucuugcucugucgcccagguuggagugcaguggcacgaucucggcu

SEQ ID NO: 725652 - RNA, 64 nt, hsa
ugugugccggcauccuugauggguucaaagagaaagguuggagaugauagugggugagaagcag

SEQ ID NO: 725653 - RNA, 64 nt, hsa
agugggugagaagcaggcuggugagacugggcugagguuggagaaggggcagccgggggcacug

SEQ ID NO: 725654 - RNA, 64 nt, hsa
gcagggccuguaaucccagcauuuuaggaggccaagguuggaggaucauuugagcccaggaauu

SEQ ID NO: 725655 - RNA, 64 nt, hsa
uuuuugucugagacagaaucucagucugucacccagguuggagugcaguggcgugaucucagcu

SEQ ID NO: 725656 - RNA, 64 nt, hsa; identical to SEQ ID NO: 220196

SEQ ID NO: 725657 - RNA, 64 nt, hsa; identical to SEQ ID NO: 220197

SEQ ID NO: 725658 - RNA, 64 nt, hsa; identical to SEQ ID NO: 220198

SEQ ID NO: 725659 - RNA, 64 nt, hsa; identical to SEQ ID NO: 220199

SEQ ID NO: 725660 - RNA, 64 nt, hsa; identical to SEQ ID NO: 220200

SEQ ID NO: 725661 - RNA, 64 nt, hsa; identical to SEQ ID NO: 220201

SEQ ID NO: 725662 - RNA, 61 nt, hsa; identical to SEQ ID NO: 220202

SEQ ID NO: 725663 - RNA, 64 nt, hsa; identical to SEQ ID NO: 220203

SEQ ID NO: 725664 - RNA, 64 nt, hsa; identical to SEQ ID NO: 220204

SEQ ID NO: 725665 - RNA, 64 nt, hsa; identical to SEQ ID NO: 220205

SEQ ID NO: 725666 - RNA, 64 nt, hsa; identical to SEQ ID NO: 220206

SEQ ID NO: 725667 - RNA, 64 nt, hsa; identical to SEQ ID NO: 220207

SEQ ID NO: 725668 - RNA, 64 nt, hsa; identical to SEQ ID NO: 220208

SEQ ID NO: 725669 - RNA, 64 nt, hsa; identical to SEQ ID NO: 220209

SEQ ID NO: 725670 - RNA, 64 nt, hsa; identical to SEQ ID NO: 220210

SEQ ID NO: 725671 - RNA, 64 nt, hsa; identical to SEQ ID NO: 220211

SEQ ID NO: 725672 - RNA, 64 nt, hsa; identical to SEQ ID NO: 220212

SEQ ID NO: 725673 - RNA, 64 nt, hsa; identical to SEQ ID NO: 220213

SEQ ID NO: 725674 - RNA, 64 nt, hsa; identical to SEQ ID NO: 220214

SEQ ID NO: 725675 - RNA, 64 nt, hsa; identical to SEQ ID NO: 220215

SEQ ID NO: 725676 - RNA, 64 nt, hsa; identical to SEQ ID NO: 220216

SEQ ID NO: 725677 - RNA, 64 nt, hsa; identical to SEQ ID NO: 220217

SEQ ID NO: 725678 - RNA, 64 nt, hsa
cuucugagguauuuucaugaucccaccauggucauaucuugaaguauggucuagaaaagucccu

SEQ ID NO: 725679 - RNA, 64 nt, hsa
cuacuauaaggcuuguuugaucccaaauggugcuuaucuugauugaacauucagaacaaggaua

SEQ ID NO: 725680 - RNA, 64 nt, hsa
auauauauuaccuuagugugcauuuucuauauaauaucuugauggacucuuuuauaaaauuauu

SEQ ID NO: 725681 - RNA, 64 nt, hsa
acuaggcgacucacauuugaggacuuuucucggguaucuugaggguuugugauccugaacccuu

SEQ ID NO: 725682 - RNA, 64 nt, hsa
auuucugaauugauguuuuuuuuaaugguauaacuaucuugauuuucacugaaauuauaugguu

SEQ ID NO: 725683 - RNA, 64 nt, hsa
caagcuucuauuaauguuauuucuaauaauacacuaucuugauuguacucuccagaaaauuuuu

SEQ ID NO: 725684 - RNA, 64 nt, hsa
agauaaagugaaaguuuauuucaggacugagaaauaucuugaagguuauuuauuagaugacuau

SEQ ID NO: 725685 - RNA, 64 nt, hsa
guccagcugaagacaaaucagaagauaaauuugcuaucuugacaauggacuuaguacccaugcu

SEQ ID NO: 725686 - RNA, 64 nt, hsa
aguuuuaaaggccauaaucaucuuuucugguuaauaucuugaguaauuuuaaaauguugacacc

SEQ ID NO: 725687 - RNA, 64 nt, hsa
auuagauuuauguuuuuaaaaucuguugucuccauaucuugauggcuuuugggagcauuucaca

SEQ ID NO: 725688 - RNA, 64 nt, hsa
ucuguccgaugucuacauucagguucugacuucauaucuugaaaaaggauuuccucccugucuu

SEQ ID NO: 725689 - RNA, 64 nt, hsa
uuuuuacuuuuuuccccuaacuuuagcaauguaguaucuugagccauuaauuuuuggguuuuuu

SEQ ID NO: 725690 - RNA, 64 nt, hsa
gcuaaagucuguuauacagaauugaaagccuucguaucuugaaccucccaacauuuuucuuaug

SEQ ID NO: 725691 - RNA, 64 nt, hsa
uucugacguguaaaggaccauaagguacaucauuuaucuugaacauuccgacguguaacucaca

SEQ ID NO: 725692 - RNA, 64 nt, hsa
agucuuccuuucaaggaccauaagguacaucaguuaucuugaacauucugacguguaaaggacc

SEQ ID NO: 725693 - RNA, 64 nt, hsa
ccuucagguauuaaacuugcugcauaucuugacauaucuugagauucugcaugucuuguaaaga

SEQ ID NO: 725694 - RNA, 64 nt, hsa
uuuauguuaaccuucagguauuaaacuugcugcauaucuugacauaucuugagauucugcaugu

SEQ ID NO: 725695 - RNA, 64 nt, hsa
agacucuuuuaaaaaaaaaaaaaccuaauguuuuuaucuugagucaauaugauuagguauuuug

SEQ ID NO: 725696 - RNA, 64 nt, hsa
caugaggccacauucagcugcuauuuaaacuuaauaucuugaaccuaaagaaugcugacuuuuc

SEQ ID NO: 725697 - RNA, 64 nt, hsa
auuaaauuguaaaauaaauggacuuauugaagcauaucuugauuuuuaagcuuaucuugauuuu

SEQ ID NO: 725698 - RNA, 64 nt, hsa
uggacuuauugaagcauaucuugauuuuuaagcuuaucuugauuuucaaacaugcauagcuauu

SEQ ID NO: 725699 - RNA, 64 nt, hsa; identical to SEQ ID NO: 220423

SEQ ID NO: 725700 - RNA, 64 nt, hsa; identical to SEQ ID NO: 220424

SEQ ID NO: 725701 - RNA, 64 nt, hsa
cucccuggggugggguugcuggaccuucaauccaucgcuacaguccagaaggcaauuggccacu

SEQ ID NO: 725702 - RNA, 64 nt, hsa
gcugaauaaaaacuuaagcugcaaauugauaacuucgcuacauaacaaggaaaauauaaauguu

SEQ ID NO: 725703 - RNA, 64 nt, hsa
ccugcggguccaggguggggggcugucacuuuauucgcuacacgccucuucucuccuauaagga

SEQ ID NO: 725704 - RNA, 64 nt, hsa
uguccucugagcugcaguuuccucaucugucacaucgcuacagacaagaccucccuggaacccu

SEQ ID NO: 725705 - RNA, 64 nt, hsa
aaguggugcgccgcagcgcgggcaugaacacugcucgcuacaagcuggccguggcagaugcugu

SEQ ID NO: 725706 - RNA, 64 nt, hsa
ugcccaggcuggagugcaguggcgugaucuccgcucgcuacaaccuccaccucccagcugccug

SEQ ID NO: 725707 - RNA, 64 nt, hsa
ugaaaaacguucuuauuuuaaagaaagguugugcucgcuacacugcuggugugugcauucugag

SEQ ID NO: 725708 - RNA, 64 nt, hsa
gcaauguuugguuaauguuuguauuacuuggaaaucgcuacagcuuggacuauuuuuuucuaaa

SEQ ID NO: 725709 - RNA, 64 nt, hsa
aaggugagagaggacacagaaggugccaacacugucgcuacaguaaggaccugaagugacuuug

SEQ ID NO: 725710 - RNA, 64 nt, hsa
cccagggcuggguguagguagccguuggaggccaucgcuacagggcaccuaucuguuaucgcug

SEQ ID NO: 725711 - RNA, 64 nt, hsa
uuacaacccuuacaggugggccuucaggccugguucgcuacaacaaugucuuccacaacucaaa

SEQ ID NO: 725712 - RNA, 64 nt, hsa
cacugccugggcaguggcacaaccaucccccaugucgcuacagaacaugggcccagagcaccuu

SEQ ID NO: 725713 - RNA, 64 nt, hsa
gcuuuuagaccaaaauaugaaagacuuacaggccucgcuacaagguagguaagguggggauuga

SEQ ID NO: 725714 - RNA, 64 nt, hsa
cugaugaaacugauuuggagcacccuuuucuuuaucgcuacauuuauuuaggggacaaacucca

SEQ ID NO: 725715 - RNA, 64 nt, hsa
ccugcuggccggacacccgacuccaguccaagucucgcuacauuuccgccacaucccucucugc

SEQ ID NO: 725716 - RNA, 64 nt, hsa
guuucagaacuucuguuucacaacaauuucucucucgcuacaaguauucuuucacucagcacug

SEQ ID NO: 725717 - RNA, 64 nt, hsa
cagugcucauuuugagauacccugcuaucgauggucgcuacaaaccaggaaauacucaaguuau

SEQ ID NO: 725718 - RNA, 64 nt, hsa
ugcuguuugcucaugguaaacagaaacagcaucuucgcuacaaccacugacaccagcuggcguc

SEQ ID NO: 725719 - RNA, 64 nt, hsa
uuagaucggaagccaguuucuacacacuugccucucgcuacagcguccuccucaccggccgaag

SEQ ID NO: 725720 - RNA, 64 nt, hsa
gucugauacucccuuugucuucccucucuacuccucgcuacaccugagccaggcucuugccaac

SEQ ID NO: 725721 - RNA, 64 nt, hsa
aaaaaaauuuaaacaaguguuaacuuuaaacaguucgcuacaaguaaaugauuauaaauacuac

SEQ ID NO: 725722 - RNA, 64 nt, hsa
uugaagcaguuuucauguaaucauugccaccucuucgcuacaugaacuacuauugauaccagca

SEQ ID NO: 725723 - RNA, 64 nt, hsa
uuuucucuuaacacauaggaaaaaaguucagacaucgcuacaauaaaugugcuuuauuugaucc

SEQ ID NO: 725724 - RNA, 64 nt, hsa
gugggcucagaccucauuucaggcaccagauuggucgcuacacccuggacaagugacugcccgu

SEQ ID NO: 725725 - RNA, 64 nt, hsa
caagaccagccugggcaauguaguaagacccccaucgcuacaaaaaauacaaaaguuagccagg

SEQ ID NO: 725726 - RNA, 64 nt, hsa
cccaggcugcuggccggacagucacccucuguucucgcuacaucccuugcccccuguccauuua

SEQ ID NO: 725727 - RNA, 64 nt, hsa
aaucgaagauugaggacuacuuuccagaauuugcucgcuacacuacuccugaggauggugugua

SEQ ID NO: 725728 - RNA, 64 nt, hsa
gggccagcucuuggcuaagaccaggaggcugcaagucuccuagaagcccucugagcuccagagg

SEQ ID NO: 725729 - RNA, 64 nt, hsa
ugcaauaugaaaccagccaacugcuuuuugugcggucuccuauaggaaguaucgcaauuguuuu

SEQ ID NO: 725730 - RNA, 64 nt, hsa
auauguuucaaaaagaauuagcauagaaauccuggucuccuagccaaaaaaaucaaaggauuuu

SEQ ID NO: 725731 - RNA, 64 nt, hsa
caugucuccauucuucucugucucugucuugcaugucuccuaccaugucacugucccugggcca

SEQ ID NO: 725732 - RNA, 64 nt, hsa
ugaauaggaauauucaagauuauaaagguaucaggucuccuaaaauugaucuauggauuuaaua

SEQ ID NO: 725733 - RNA, 64 nt, hsa
ugcuuaaaaugaugaaaccaacccucaaaaaacagucuccuaaccagccauccccuccuguggg

SEQ ID NO: 725734 - RNA, 64 nt, hsa
ggcuaauuguguacccuuugcagaaaugcuuuuggucuccuacccaaauacucacaagggucuu

SEQ ID NO: 725735 - RNA, 64 nt, hsa
aggcagucaccuucuuaggcccgggaaaaugccggucuccuacucuucauggccuuuguaccug

SEQ ID NO: 725736 - RNA, 64 nt, hsa
ugaacuccugggcuuaagugaucugccugccuuggucuccuaaagugcugggauuauaggugug

SEQ ID NO: 725737 - RNA, 64 nt, hsa
cccuuaaaucuagacuucucuuuauagguuucaggucuccuaugggugccugggaaguccuuga

SEQ ID NO: 725738 - RNA, 64 nt, hsa
ccuuucuccaggcucccuaccugcuugucuaccugucuccuacccaccuguaucucuuguuggg

SEQ ID NO: 725739 - RNA, 64 nt, hsa
auuuaaauuacaauuuuaucuguuuccugacauugucuccuauauauuucuauuauuaauugca

SEQ ID NO: 725740 - RNA, 64 nt, hsa
cuagacauuaucacagacugaauagaucuuaacugucuccuacauguguguuuucaaaugugua

SEQ ID NO: 725741 - RNA, 64 nt, hsa
uucccucccuuagcccaacccuccaaggccucaugucuccuaagcaugcugacugcauccgaaa

SEQ ID NO: 725742 - RNA, 64 nt, hsa
ggagcuggaaucugccuccggugugagggaaccugucuccuaccacuucggagccaugggggca

SEQ ID NO: 725743 - RNA, 64 nt, hsa
guaauuuuuacagaauugcuuguuugcuucaacugucuccuaccucugcucuuggaggagaugg

SEQ ID NO: 725744 - RNA, 64 nt, hsa
agaugcaacaagaugagcuaaucgaaaagcccaugucuccuaugcaguacgcacgaucuggucu

SEQ ID NO: 725745 - RNA, 64 nt, hsa
gugcaaccuccauaaauaugucgguggacggggcgucuccuaauaaaccugauaccaagaagac

SEQ ID NO: 725746 - RNA, 64 nt, hsa
ugagaaauaucacauugccccugauguuuugacagucuccuagugcuccugguagugccacuaa

SEQ ID NO: 725747 - RNA, 64 nt, hsa
agagaauaauguuacauguuuaauuguaauauuugucuccuaucauuuucuucccuuucaguca

SEQ ID NO: 725748 - RNA, 64 nt, hsa
cuauauccauucuuuauaucaauguauaguuuuagucuccuaaauugaucuguuauuuuccaaa

SEQ ID NO: 725749 - RNA, 64 nt, hsa
ugcaccaaguaugccuaccccuggccagucugaggucuccuagccauagaacugacuccuggaa

SEQ ID NO: 725750 - RNA, 64 nt, hsa
uuuuaagaaaaaacuuuuaaaaauauuucuuauagucuccuaacauuugucucuagccuuugcc

SEQ ID NO: 725751 - RNA, 64 nt, hsa
agaaauuuucugacacacugauggcaugugacuugucuccuaagucagugaggcaucacuuugu

SEQ ID NO: 725752 - RNA, 64 nt, hsa
augaggaaaauuacugaagaauaaguuuccauaagucuccuacauagcaguguuauuuauguac

SEQ ID NO: 725753 - RNA, 64 nt, hsa
aaacuauuuaacauucuuuuguuuauauuguuuugucuccuaaauuguuguaauugcauuauaa

SEQ ID NO: 725754 - RNA, 64 nt, hsa
cacacauacacgcucuauuaacuuugccuaauaagucuccuagguuacuaacuuacuuaccuaa

SEQ ID NO: 725755 - RNA, 64 nt, hsa
gugucaauuugcaucauuugcauauugauuucaagucuccuaauuuggaauggguaaaguacaa

SEQ ID NO: 725756 - RNA, 64 nt, hsa
uuccuuguaguucucaggaccuguucaagaaggugucuccuaggggcagccugaaugccucccu

SEQ ID NO: 725757 - RNA, 64 nt, hsa
gaacugccauuaucaguggaguagugggucccuggucuccuacaaauccugggacauuggaucc

SEQ ID NO: 725758 - RNA, 64 nt, hsa
gcauuaagucaguggcuuugcauagcuuucacaagucuccuagacacuccccacgggaaacuca

SEQ ID NO: 725759 - RNA, 64 nt, hsa
aucucuuuucccuuuauucaagcugucaauuuuugucuccuaaacaucuucuaguuauauucuc

SEQ ID NO: 725760 - RNA, 64 nt, hsa
cccacugaguguguacugguuccugcagguagcagucuccuauuaucuccuguuuagcaccaaa

SEQ ID NO: 725761 - RNA, 64 nt, hsa
ggaauguguccauugaaaagaaaauaggcgcuuugucuccuacaaucuuagagaaaguuuuaca

SEQ ID NO: 725762 - RNA, 64 nt, hsa
gaugcuguuucucguuaguggcaguagugccuccgucuccuagugauaaugcuccaagucuaug

SEQ ID NO: 725763 - RNA, 64 nt, hsa
aucugaaaccaaaucaagacacagaacaaggucugucuccuauagucacucaagaagucgaucg

SEQ ID NO: 725764 - RNA, 64 nt, hsa
uaggggguguggguucaucacaguguugccuuuugucuccuaaagauagggaucuacuuuugaa

SEQ ID NO: 725765 - RNA, 64 nt, hsa
gcccagggcacugccaggguucaaugggccagccgucuccuacuccaccuuggauuuuucucuc

SEQ ID NO: 725766 - RNA, 64 nt, hsa
ucuccuccuauuuaugaaaaccauaugauauuuugucuccuaccugcugcugcuauuauguaac

SEQ ID NO: 725767 - RNA, 64 nt, hsa
aguccucuguguaguuucagaccagaccugaauagucuccuaugcccuccaaaagucggguccu

SEQ ID NO: 725768 - RNA, 64 nt, hsa
uaauccaccacgguuaacuggaaaagcacuuucagucuccuauaacccucccaccagcugcugc

SEQ ID NO: 725769 - RNA, 64 nt, hsa
uuguucacauggcauaaaugaaaggaauuuuauagucuccuaaauggcguguacugcaagaccu

SEQ ID NO: 725770 - RNA, 64 nt, hsa
cuucuuuuacuuuuuauaaaguuuuuuuuccuuagucuccuacuuagagauauucuagaaaaug

SEQ ID NO: 725771 - RNA, 64 nt, hsa
ugcaguugcugucugcuucugaaucacugggggugucuccuaagaacugugccucggguuuuuc

SEQ ID NO: 725772 - RNA, 64 nt, hsa
cauaacuagagcacuucaaucuauuuaagccuuugucuccuaacugaaacauuauuucuaaaua

SEQ ID NO: 725773 - RNA, 64 nt, hsa
aaugcuuuaguaagaauaugaacaauuuccugaugucuccuauaaauugugauuguuuauucua

SEQ ID NO: 725774 - RNA, 64 nt, hsa
uaccagucucuucaaaaacuucucgaaccgcugugucuccuacguaaaaaaagagauguacaaa

SEQ ID NO: 725775 - RNA, 64 nt, hsa
uuuuaacagcaugugggugucagugucauuauuagucuccuaauaaguuccucugaagacugcu

SEQ ID NO: 725776 - RNA, 64 nt, hsa
cugagcaugucaagaaacugauaagaucaaaaaggucuccuaacucacuagaucagcgcacaag

SEQ ID NO: 725777 - RNA, 64 nt, hsa
cuaggguugagcaauuuuaagguugagacuccaagucuccuaaaauucuaggagagaaauaaag

SEQ ID NO: 725778 - RNA, 64 nt, hsa
aaaauuauuugguguggccaucuuaccugcuuaugucuccuacacaaagcuaaauauucuagca

SEQ ID NO: 725779 - RNA, 64 nt, hsa
accaugcuuuauguuaaacauuuuggggcucaaugucuccuacuauccaaaaugugcaucacag

SEQ ID NO: 725780 - RNA, 64 nt, hsa
cucuauuucugacucucauuuuuggucucugugugucuccuagucacuuucuuucucacucugu

SEQ ID NO: 725781 - RNA, 64 nt, hsa
aguccccagguccucagggccccagagcgggagggucuccuaccuggaagucccccugagcucc

SEQ ID NO: 725782 - RNA, 64 nt, hsa
aaacauauuagaaaccuugauucagugcucaguggucuccuaguaagaagucaccgacgguagc

SEQ ID NO: 725783 - RNA, 64 nt, hsa
aguuaaaaaugcauauaacguuagcaacacagcagucuccuaauuaaugacagcuugacuuaac

SEQ ID NO: 725784 - RNA, 64 nt, hsa
aaaauagcacugaacagggagucaggagacuauugucuccuaaacccaggacuagaguucccuc

SEQ ID NO: 725785 - RNA, 64 nt, hsa
acauucuggauuucagaguagagauuucuguguugucuccuagaaagcauuacauguaguuuau

SEQ ID NO: 725786 - RNA, 64 nt, hsa
uucagacucauggauuggucugaggggucugaacgucuccuagccaaucagaacuggcugugga

SEQ ID NO: 725787 - RNA, 64 nt, hsa
aauuuaauauacuuuauaaauaaguaucuaaaaugucuccuacuuuuuuccuauuucuuugcca

SEQ ID NO: 725788 - RNA, 64 nt, hsa
aaaacaaaucacuuucauuaauaaaggguuaaaagucuccuagucauucaacauagugucacaa

SEQ ID NO: 725789 - RNA, 64 nt, hsa
ucagccuuauccagguugguuuugcuguugaucggucuccuaggcuaaaugagaaugaaagcga

SEQ ID NO: 725790 - RNA, 64 nt, hsa
gcggguccuccagggcaaggggaacgggaaauaggucuccuaggugccugaagcgcugagcaac

SEQ ID NO: 725791 - RNA, 64 nt, hsa
uacaauaaauaaaauacuugaaauucucuuuugugucuccuaguagcuuccuacucaacuauuu

SEQ ID NO: 725792 - RNA, 64 nt, hsa
uuacuugucuaaaaguaaaaaaaaauaucagccugucuccuaggucaguccccuccuggaccca

SEQ ID NO: 725793 - RNA, 64 nt, hsa
ccgccgcugcuccccuccccagacaccucuccacgucuccuacccagggggucgcaucccuagc

SEQ ID NO: 725794 - RNA, 64 nt, hsa
acuucaguauuaaauuagauaucuucauagcaaugucuccuaaagguguuuuguaaaggauauc

SEQ ID NO: 725795 - RNA, 64 nt, hsa
guguuggaaacuguaaaaugauacuguagaaccugucuccuacuuugaaaacugaaugucaggg

SEQ ID NO: 725796 - RNA, 64 nt, hsa
auguagugccuuuacuauuucacuuucuacaaaagucuccuagggucuuugagucagcuuuaug

SEQ ID NO: 725797 - RNA, 64 nt, hsa
uccaaagaagauagcucucugacugcuuuggauagucuccuacgcaccauuuugucagguggga

SEQ ID NO: 725798 - RNA, 64 nt, hsa
cugaggacugcggcucccucccuccugcaugagggucuccuacugcuccuucuccccuugcaca

SEQ ID NO: 725799 - RNA, 64 nt, hsa
uucagcugaacacaagcaaaccuucucaggaggugucuccuacccucuuauuguuccucuuacg

SEQ ID NO: 725800 - RNA, 64 nt, hsa
ccaauaaagguucuggcacuucaaugccaggcaggucuccuaaaugaacagaaugaucugugug

SEQ ID NO: 725801 - RNA, 64 nt, hsa
uuuugagcgguuuuguaauuugacauuuaggagagucuccuauuuauucucauacuuuacauuc

SEQ ID NO: 725802 - RNA, 64 nt, hsa
ucuggcuugacuuuuaugggaaaaguuauuuuaugucuccuaagcauuagaguuuuucuauuac

SEQ ID NO: 725803 - RNA, 64 nt, hsa
ucccacgaggccagagguugccaggcugccugaggucuccuauucuacucugaaccauaaaccc

SEQ ID NO: 725804 - RNA, 64 nt, hsa
cugaaaugcugcauuuuaauuuuaaccaaaacaugucuccuauccugguuuuuguagccuuccu

SEQ ID NO: 725805 - RNA, 64 nt, hsa
uugucuucagaauaacuaucucccuuucugaucugucuccuacucuuuagauguucucagucaa

SEQ ID NO: 725806 - RNA, 64 nt, hsa
auggccccaaaggcugagggccccaaagccacuugucuccuaggauccaggccucugggcuucu

SEQ ID NO: 725807 - RNA, 64 nt, hsa
uuuguacaugucccuuggcaaaauucuuucuggugucuccuaacuucagagacagggacucuuu

SEQ ID NO: 725808 - RNA, 64 nt, hsa
gauagcauaggaaaauguucuggugauugucagggucuccuaauauuuaucucaauucuuuuau

SEQ ID NO: 725809 - RNA, 64 nt, hsa
aauacaggaugggcccaugaaggcaaaggugccugucuccuagggaagccuuaaugugguauuc

SEQ ID NO: 725810 - RNA, 64 nt, hsa
ugagcauaaaagucaauacauauuugaggaauaagucuccuaaaauuuuaagcuucacguaaua

SEQ ID NO: 725811 - RNA, 64 nt, hsa
uuauaguggcuucucuuuuucuaaacccuccuuagucuccuagaaaaccuuccugugggccagg

SEQ ID NO: 725812 - RNA, 64 nt, hsa
guacuguggagagcauaguccagccugggcauuugucuccuagcagccuacacuggcucugcug

SEQ ID NO: 725813 - RNA, 64 nt, hsa
ccaggcauguggcagggguuagagcaggacugaugucuccuaagcaccuguaaugugcgaggga

SEQ ID NO: 725814 - RNA, 63 nt, hsa
ucaaccuaggauuucucugaaggauccagaguugucuccuaugguccaugcagaauuuucugu

SEQ ID NO: 725815 - RNA, 64 nt, hsa
uaucauuuauaccagacauuaugaaguuauuaaagucuccuauacucuguacaccagaacugug

SEQ ID NO: 725816 - RNA, 64 nt, hsa
ugccaccuggcaaaggacccuugaguaagugaaggucuccuaaaacugggauuaagaaaccuug

SEQ ID NO: 725817 - RNA, 64 nt, hsa
cucucgaucacggggugggugcccccgacaccgggucuccuagcuugaguucccuagaagcgaa

SEQ ID NO: 725818 - RNA, 64 nt, hsa
cuagaggaauugagcaaaacagaagaaucaugaagucuccuaccuucuacagccuuguaguucu

SEQ ID NO: 725819 - RNA, 64 nt, hsa
ggugcugaaguacuguaaguagaauucaucaacggucuccuaauuuuugcaucuacaucugggg

SEQ ID NO: 725820 - RNA, 64 nt, hsa
gugacuaucugacuguugauggccacagaugauggucuccuaugguauaguucacucuguagaa

SEQ ID NO: 725821 - RNA, 64 nt, hsa
auuccaugggccaguaugccaguuugaauucucagucuccuagcaucuugugaguugcauauua

SEQ ID NO: 725822 - RNA, 64 nt, hsa
acugccacacgcgugcacauguggcucugugggugucuccuagagaggacguggccccugcugc

SEQ ID NO: 725823 - RNA, 64 nt, hsa
aauguugccagaggugguuguguuuugacaucuggucuccuagagaugagugcuugggauuucu

SEQ ID NO: 725824 - RNA, 64 nt, hsa
aacauacaagagacaugagauuccaguuguuuuugucuccuaaacccuagugauuuuuggauaa

SEQ ID NO: 725825 - RNA, 64 nt, hsa
ggauuuugagcuuuacaggugauagguaccuaaugucuccuacagaaacaccaucugauucaga

SEQ ID NO: 725826 - RNA, 64 nt, hsa
gccguucuuauugaccaauuccugacacuugauugucuccuaaugcuuuauccaucaccaccug

SEQ ID NO: 725827 - RNA, 64 nt, hsa
cuccuuaaugccuccaaggguccuugcaucccuagucuccuaaacuccagcucugauucgccau

SEQ ID NO: 725828 - RNA, 64 nt, hsa
acuuuuaauguggacuuuuacucauggaaaaauugucuccuaauuuggggagaugaaccaacca

SEQ ID NO: 725829 - RNA, 64 nt, hsa
gcguccucaguagguguuugggaauaugggaagggucuccuauuuauucaauagaguuuucuca

SEQ ID NO: 725830 - RNA, 64 nt, hsa
ggugagcgcugugagauggauguauuuguagccagucuccuauacccagcagagggauaaccca

SEQ ID NO: 725831 - RNA, 64 nt, hsa
ucuggagcagcauucauuuaucuucgucugccuugucuccuaccuaagugugugucgccacccg

SEQ ID NO: 725832 - RNA, 64 nt, hsa
ccgcauuuacggcugcauucuguaagugggcauggucuccuaauggaggaguguucauuguaua

SEQ ID NO: 725833 - RNA, 64 nt, hsa
agugggcccuguucaugcgaaauccacauccauggucuccuagaccugcuacccugguacuucc

SEQ ID NO: 725834 - RNA, 64 nt, hsa
uguucucuucuguccugucuuauacugcaacugugucuccuaggggacagauggccuucuuugu

SEQ ID NO: 725835 - RNA, 64 nt, hsa
ucccaacgaacccaccuauugccuuugucaccaggucuccuauggagagaugauuggcugugac

SEQ ID NO: 725836 - RNA, 64 nt, hsa
ucguauuauuucuccacgucuguuuuaguuuaaugucuccuaagcuuuucucucauagcguaga

SEQ ID NO: 725837 - RNA, 64 nt, hsa
aaaccugacggauuaacuaagcacacugggaugugucuccuacaguuggcuucucucuuugaug

SEQ ID NO: 725838 - RNA, 64 nt, hsa
aacuagcugucaguuucaaggauuacaaguuugagucuccuaguauucaacaucauucugaacc

SEQ ID NO: 725839 - RNA, 64 nt, hsa
uuuguuuagacagcacaagaaggggugagagugcgucuccuagccuuaaugugggaggguaguu

SEQ ID NO: 725840 - RNA, 64 nt, hsa
acaauuccaugugcaccuuuagguuaccuauauagucuccuaggaagaucaggaugaaagaccu

SEQ ID NO: 725841 - RNA, 64 nt, hsa
uuguaaaguaaaugaaagcuauugagaucuuuuugucuccuauaauaccagggaauuugagcuu

SEQ ID NO: 725842 - RNA, 64 nt, hsa
aaagguguaaauguuuucaucucuuaggcuugcugucuccuaaggucacccaagcagugguugg

SEQ ID NO: 725843 - RNA, 64 nt, hsa
agcccaggccacccuaucgcccccuacgcgccuugucuccuacuccugacuccuaccugcccug

SEQ ID NO: 725844 - RNA, 64 nt, hsa
uaagggcucaguaaauacuuguugaauaaacucagucuccuacauuagcauucuaaugguuuga

SEQ ID NO: 725845 - RNA, 64 nt, hsa
uggagauuucuggauccuucccugggagggagaggucuccuaacucgauuggacaggagccuuc

SEQ ID NO: 725846 - RNA, 64 nt, hsa
uauaagcccuuugucguuucugugccuauuuaaagucuccuaaagguguaauugacuaggaagg

SEQ ID NO: 725847 - RNA, 64 nt, hsa
uguuuuuuuuuuuuuugagacagagucuuccucugucuccuaagcuggagugcaguggcaucau

SEQ ID NO: 725848 - RNA, 64 nt, hsa
gagcaacaucuauagagaucuacuuuucuccuaugucuccuaggcuuuccaugauaauuaggua

SEQ ID NO: 725849 - RNA, 64 nt, hsa
uuuggugccaagaaaauaaaaaagcuauuaucaggucuccuaacuaccccaguuuguaaggaaa

SEQ ID NO: 725850 - RNA, 64 nt, hsa
ugguccuaagcauggaauccuaacuccugauuccgucuccuauuucuugcuuggcuacgccagu

SEQ ID NO: 725851 - RNA, 64 nt, hsa
ucggcuugcugccuguccugccuguccggaucuugucuccuaguccugaggagcggaggcugag

SEQ ID NO: 725852 - RNA, 64 nt, hsa
caaacuccugaccucaggcaaucugcccgccugggucuccuaaaguacugggauuacaggcgug

SEQ ID NO: 725853 - RNA, 64 nt, hsa
cccgucagcuguguaguggcaaagccgagaccgagucuccuaaguccccgucagugugguuuuc

SEQ ID NO: 725854 - RNA, 64 nt, hsa
agccauuuuauaguugaguaaacugagaucuuaagucuccuagucuacugaauuucauauggug

SEQ ID NO: 725855 - RNA, 64 nt, hsa
ucccuggcaaaauuuuccacucugaguaaaacaagucuccuaaguauuguguauguuuaaaacg

SEQ ID NO: 725856 - RNA, 64 nt, hsa
ggucccagccagggcagaggggccuccccaggaagucuccuacccucucagccaggcagagagc

SEQ ID NO: 725857 - RNA, 64 nt, hsa
guucacguggcccccgacuccucagccacaucaagucuccuagaccacuguggacucuaaacug

SEQ ID NO: 725858 - RNA, 61 nt, hsa
ucagcccgcuggacuuauaaugccaccuucugucuccuacgacuccaugagcagcgccagc

SEQ ID NO: 725859 - RNA, 64 nt, hsa
cuccuccuccucccuccucacucccuaggcccaagucuccuaggggcuugguccuaggguggga

SEQ ID NO: 725860 - RNA, 64 nt, hsa
cccugagugucugucccucuucagccaagcccaagucuccuagacccccagggagccagugaac

SEQ ID NO: 725861 - RNA, 64 nt, hsa
caaggucaccuauagaagcgagcuaccaaaagacgucuccuaagcauuuugguggccuagugac

SEQ ID NO: 725862 - RNA, 64 nt, hsa
aguuaaaggcaguccagagcuuuucagccaauuugucuccuacucuguguaaauauuuuucccu

SEQ ID NO: 725863 - RNA, 64 nt, hsa
uggccacuucuuggacaucuugacccagcgaguggucuccuacacgucaccugcaacacucgcu

SEQ ID NO: 725864 - RNA, 64 nt, hsa
ugagacaccuugaccaauaugcuuuggguggacggucuccuacauguucaguggaggccaccag

SEQ ID NO: 725865 - RNA, 61 nt, hsa
acuauugccacaaacacugagggacgcucaggucuccuaagaccucauccugcuggggacc

SEQ ID NO: 725866 - RNA, 64 nt, hsa
gcugcugaggggcaggaagcgggggagugggcucgucuccuaaauuuaagaucaccuccucagc

SEQ ID NO: 725867 - RNA, 64 nt, hsa
uuuaucccucuccacgcggggcagacucuggcgggucuccuagcguccgagagauggcuuauuu

SEQ ID NO: 725868 - RNA, 64 nt, hsa
gaugaugaagcuggagccagggcugccgguccgagucuccuaccucccccaacccugcccgccc

SEQ ID NO: 725869 - RNA, 64 nt, hsa
aacccucucccccaccucuucccugcccaaaucugucuccuagaaucuuaugugcugugaauaa

SEQ ID NO: 725870 - RNA, 64 nt, hsa
cuagggugugcugguuuguccuuuucauaccuuugucuccuaauugugcuacaauuggaagacc

SEQ ID NO: 725871 - RNA, 64 nt, hsa
ccagacucaagauauggucugggcgcugucuugugucuccuacccugaucccuggguucaacuc

SEQ ID NO: 725872 - RNA, 64 nt, hsa
guccuguuugucuuaauuuuuauugguuuccaaggucuccuaggaaggagagcagagcugugug

SEQ ID NO: 725873 - RNA, 64 nt, hsa
cuggcuggggacugucuuggguuuaaaacugcaagucuccuacccugggaucccauccaguucc

SEQ ID NO: 725874 - RNA, 64 nt, hsa
gcugcuaccagcugcucagugcaguggccacugugucuccuaaggugcucgcuucagucagcac

SEQ ID NO: 725875 - RNA, 64 nt, hsa
cucccaaguggcauagccccuuuuccgguauggggucuccuacacccacgcgcaccaccucucc

SEQ ID NO: 725876 - RNA, 64 nt, hsa
uccuccaagaucucagcuccuuaacauaucaguugucuccuagccuagaaaaccaguguuugga

SEQ ID NO: 725877 - RNA, 64 nt, hsa
augcugggaugaggacagaggaagaccugauggggucuccuauuccagggaauaagccaaauua

SEQ ID NO: 725878 - RNA, 64 nt, hsa
uguccuuaaacuaccuccuuagagcucugaaggggucuccuaguuccagauuuuaauuugggga

SEQ ID NO: 725879 - RNA, 64 nt, hsa
aucccaaaagggcucuguccugggagucuggugugucuccuacaugcaauuuccacggacccag

SEQ ID NO: 725880 - RNA, 64 nt, hsa
agcugcugucccugcccuguccuguccuugcacagucuccuaugucugagccccagugccuucu

SEQ ID NO: 725881 - RNA, 64 nt, hsa
ccugggcauugagacuguccugguuaggcugugugucuccuacauuaacagcuggggaggaggg

SEQ ID NO: 725882 - RNA, 64 nt, hsa
agaggccacaggaagauaggauggaacgugacuggucuccuaaccaaggugcacugagaagcaa

SEQ ID NO: 725883 - RNA, 64 nt, hsa
caggcuggcuccagaugcagggcagucauuggcugucuccuaggaaacccauauccuuacccuc

SEQ ID NO: 725884 - RNA, 64 nt, hsa
guccguggugucccccaaaggugccaccgugcgggucuccuagcucccugccagcuuccugucc

SEQ ID NO: 725885 - RNA, 64 nt, hsa
aacauuaaaaaauacucgaggcauaaauguaguugucuccuacucugcuucucuuacuauacuc

SEQ ID NO: 725886 - RNA, 64 nt, hsa
acaaugaagucuuuucuugcggacacucccuccugucuccuauuuucuguaaauaauuuucucc

SEQ ID NO: 725887 - RNA, 64 nt, hsa
gucacuucaugcugauuagaaugacaucucuuucgucuccuauuuuguuacccaacucuuccua

SEQ ID NO: 725888 - RNA, 64 nt, hsa
ucaccagauuucggcugcuggggccaggacaggcgucuccuagguugugccaaaccagccuaca

SEQ ID NO: 725889 - RNA, 64 nt, hsa
uccgcccugauuggaugaggaaagcuccaacccagucuccuaagcgacuggcccccuuuugaac

SEQ ID NO: 725890 - RNA, 64 nt, hsa
aaugacauccaggaagguaggagaaggcaucugagucuccuaacccaagauggaagagccagag

SEQ ID NO: 725891 - RNA, 64 nt, hsa
uaggcagaaacuagaagucuggacagucuccauggucuccuacuaucagaauaugugcccuuuu

SEQ ID NO: 725892 - RNA, 64 nt, hsa
ccuucccugagcugccuccugcuucucccucaaagucuccuacccuucucuuccucuuuuaagc

SEQ ID NO: 725893 - RNA, 64 nt, hsa
uuugacaauguuguaaguguuuaccaagccguuggucuccuaagggccuccugauggaagaaca

SEQ ID NO: 725894 - RNA, 64 nt, hsa
ugugcccuguccuggaugaacgccucuuuccgaggucuccuauuuucuuuuuaacuuuuuaaag

SEQ ID NO: 725895 - RNA, 64 nt, hsa
uuuucugucagucccccaguggccgcccuuacacgucuccuacuucaaugguaggggcgguuua

SEQ ID NO: 725896 - RNA, 64 nt, hsa
cugaugugaaacaacccuugcccaaccccacgaagucuccuauuuaaugugauggaagcacaac

SEQ ID NO: 725897 - RNA, 64 nt, hsa
gaaauguuugcugaacauuggagaaucucaacaugucuccuacugaggauauggacacuggugc

SEQ ID NO: 725898 - RNA, 64 nt, hsa
aacacuaagguuaggaucuucuaaguguauaacugucuccuaagcccaucacuguggcacacug

SEQ ID NO: 725899 - RNA, 64 nt, hsa
ucguaaacguuuugauguuaccuauuucuugugggucuccuauuaccagcuucuaaaugaaugu

SEQ ID NO: 725900 - RNA, 64 nt, hsa
gaucaauuauauucucauaucuguuagcuacacagucuccuauuaucucaauugcuuaugugca

SEQ ID NO: 725901 - RNA, 64 nt, hsa
ugccagccaucuggugggucagguccuuggcgccgucuccuaccugcacagccuggggaucgug

SEQ ID NO: 725902 - RNA, 64 nt, hsa; identical to SEQ ID NO: 111844

SEQ ID NO: 725903 - RNA, 64 nt, hsa; identical to SEQ ID NO: 111845

SEQ ID NO: 725904 - RNA, 62 nt, hsa; identical to SEQ ID NO: 111846

SEQ ID NO: 725905 - RNA, 64 nt, hsa; identical to SEQ ID NO: 111847

SEQ ID NO: 725906 - RNA, 64 nt, hsa; identical to SEQ ID NO: 111848

SEQ ID NO: 725907 - RNA, 64 nt, hsa; identical to SEQ ID NO: 111849

SEQ ID NO: 725908 - RNA, 64 nt, hsa; identical to SEQ ID NO: 111850

SEQ ID NO: 725909 - RNA, 64 nt, hsa; identical to SEQ ID NO: 111851

SEQ ID NO: 725910 - RNA, 64 nt, hsa; identical to SEQ ID NO: 111852

SEQ ID NO: 725911 - RNA, 64 nt, hsa; identical to SEQ ID NO: 111853

SEQ ID NO: 725912 - RNA, 64 nt, hsa; identical to SEQ ID NO: 111854

SEQ ID NO: 725913 - RNA, 64 nt, hsa; identical to SEQ ID NO: 111855

SEQ ID NO: 725914 - RNA, 64 nt, hsa; identical to SEQ ID NO: 111856

SEQ ID NO: 725915 - RNA, 64 nt, hsa; identical to SEQ ID NO: 111857

SEQ ID NO: 725916 - RNA, 64 nt, hsa; identical to SEQ ID NO: 111858

SEQ ID NO: 725917 - RNA, 64 nt, hsa; identical to SEQ ID NO: 111859

SEQ ID NO: 725918 - RNA, 64 nt, hsa; identical to SEQ ID NO: 449768

SEQ ID NO: 725919 - RNA, 64 nt, hsa; identical to SEQ ID NO: 449769

SEQ ID NO: 725920 - RNA, 64 nt, hsa; identical to SEQ ID NO: 449770

SEQ ID NO: 725921 - RNA, 64 nt, hsa; identical to SEQ ID NO: 449771

SEQ ID NO: 725922 - RNA, 64 nt, hsa; identical to SEQ ID NO: 449772

SEQ ID NO: 725923 - RNA, 64 nt, hsa; identical to SEQ ID NO: 449773

SEQ ID NO: 725924 - RNA, 64 nt, hsa; identical to SEQ ID NO: 449774

SEQ ID NO: 725925 - RNA, 64 nt, hsa; identical to SEQ ID NO: 449775

SEQ ID NO: 725926 - RNA, 64 nt, hsa; identical to SEQ ID NO: 449776

SEQ ID NO: 725927 - RNA, 64 nt, hsa; identical to SEQ ID NO: 449777

SEQ ID NO: 725928 - RNA, 64 nt, hsa; identical to SEQ ID NO: 449778

SEQ ID NO: 725929 - RNA, 64 nt, hsa; identical to SEQ ID NO: 449779

SEQ ID NO: 725930 - RNA, 64 nt, hsa; identical to SEQ ID NO: 449780

SEQ ID NO: 725931 - RNA, 64 nt, hsa; identical to SEQ ID NO: 449781

SEQ ID NO: 725932 - RNA, 64 nt, hsa; identical to SEQ ID NO: 449782

SEQ ID NO: 725933 - RNA, 64 nt, hsa; identical to SEQ ID NO: 449783

SEQ ID NO: 725934 - RNA, 64 nt, hsa; identical to SEQ ID NO: 449784

SEQ ID NO: 725935 - RNA, 64 nt, hsa; identical to SEQ ID NO: 449785

SEQ ID NO: 725936 - RNA, 64 nt, hsa; identical to SEQ ID NO: 449786

SEQ ID NO: 725937 - RNA, 64 nt, hsa; identical to SEQ ID NO: 449787

SEQ ID NO: 725938 - RNA, 64 nt, hsa; identical to SEQ ID NO: 449788

SEQ ID NO: 725939 - RNA, 64 nt, hsa; identical to SEQ ID NO: 449789

SEQ ID NO: 725940 - RNA, 64 nt, hsa; identical to SEQ ID NO: 449790

SEQ ID NO: 725941 - RNA, 64 nt, hsa; identical to SEQ ID NO: 449791

SEQ ID NO: 725942 - RNA, 64 nt, hsa; identical to SEQ ID NO: 449792

SEQ ID NO: 725943 - RNA, 64 nt, hsa; identical to SEQ ID NO: 449793

SEQ ID NO: 725944 - RNA, 64 nt, hsa; identical to SEQ ID NO: 449794

SEQ ID NO: 725945 - RNA, 64 nt, hsa; identical to SEQ ID NO: 449795

SEQ ID NO: 725946 - RNA, 64 nt, hsa; identical to SEQ ID NO: 449796

SEQ ID NO: 725947 - RNA, 64 nt, hsa; identical to SEQ ID NO: 449797

SEQ ID NO: 725948 - RNA, 64 nt, hsa; identical to SEQ ID NO: 449798

SEQ ID NO: 725949 - RNA, 64 nt, hsa; identical to SEQ ID NO: 449799

SEQ ID NO: 725950 - RNA, 64 nt, hsa; identical to SEQ ID NO: 449800

SEQ ID NO: 725951 - RNA, 64 nt, hsa; identical to SEQ ID NO: 449801

SEQ ID NO: 725952 - RNA, 64 nt, hsa; identical to SEQ ID NO: 449802

SEQ ID NO: 725953 - RNA, 64 nt, hsa; identical to SEQ ID NO: 449803

SEQ ID NO: 725954 - RNA, 64 nt, hsa; identical to SEQ ID NO: 449804

SEQ ID NO: 725955 - RNA, 64 nt, hsa; identical to SEQ ID NO: 449805

SEQ ID NO: 725956 - RNA, 64 nt, hsa; identical to SEQ ID NO: 449806

SEQ ID NO: 725957 - RNA, 64 nt, hsa; identical to SEQ ID NO: 449807

SEQ ID NO: 725958 - RNA, 64 nt, hsa; identical to SEQ ID NO: 449808

SEQ ID NO: 725959 - RNA, 64 nt, hsa; identical to SEQ ID NO: 449809

SEQ ID NO: 725960 - RNA, 64 nt, hsa; identical to SEQ ID NO: 449810

SEQ ID NO: 725961 - RNA, 64 nt, hsa; identical to SEQ ID NO: 449811

SEQ ID NO: 725962 - RNA, 64 nt, hsa; identical to SEQ ID NO: 449812

SEQ ID NO: 725963 - RNA, 64 nt, hsa; identical to SEQ ID NO: 449813

SEQ ID NO: 725964 - RNA, 64 nt, hsa; identical to SEQ ID NO: 449814

SEQ ID NO: 725965 - RNA, 64 nt, hsa; identical to SEQ ID NO: 449815

SEQ ID NO: 725966 - RNA, 64 nt, hsa; identical to SEQ ID NO: 449816

SEQ ID NO: 725967 - RNA, 64 nt, hsa; identical to SEQ ID NO: 449817

SEQ ID NO: 725968 - RNA, 64 nt, hsa; identical to SEQ ID NO: 449818

SEQ ID NO: 725969 - RNA, 64 nt, hsa; identical to SEQ ID NO: 449819

SEQ ID NO: 725970 - RNA, 64 nt, hsa; identical to SEQ ID NO: 449820

SEQ ID NO: 725971 - RNA, 64 nt, hsa; identical to SEQ ID NO: 449821

SEQ ID NO: 725972 - RNA, 64 nt, hsa; identical to SEQ ID NO: 449822

SEQ ID NO: 725973 - RNA, 64 nt, hsa; identical to SEQ ID NO: 449823

SEQ ID NO: 725974 - RNA, 64 nt, hsa; identical to SEQ ID NO: 449824

SEQ ID NO: 725975 - RNA, 64 nt, hsa; identical to SEQ ID NO: 449825

SEQ ID NO: 725976 - RNA, 64 nt, hsa; identical to SEQ ID NO: 449826

SEQ ID NO: 725977 - RNA, 64 nt, hsa; identical to SEQ ID NO: 449827

SEQ ID NO: 725978 - RNA, 64 nt, hsa; identical to SEQ ID NO: 449828

SEQ ID NO: 725979 - RNA, 64 nt, hsa; identical to SEQ ID NO: 449829

SEQ ID NO: 725980 - RNA, 64 nt, hsa; identical to SEQ ID NO: 449830

SEQ ID NO: 725981 - RNA, 64 nt, hsa; identical to SEQ ID NO: 449831

SEQ ID NO: 725982 - RNA, 64 nt, hsa; identical to SEQ ID NO: 449832

SEQ ID NO: 725983 - RNA, 64 nt, hsa; identical to SEQ ID NO: 449833

SEQ ID NO: 725984 - RNA, 64 nt, hsa; identical to SEQ ID NO: 449834

SEQ ID NO: 725985 - RNA, 64 nt, hsa; identical to SEQ ID NO: 449835

SEQ ID NO: 725986 - RNA, 64 nt, hsa; identical to SEQ ID NO: 449836

SEQ ID NO: 725987 - RNA, 64 nt, hsa; identical to SEQ ID NO: 449837

SEQ ID NO: 725988 - RNA, 64 nt, hsa; identical to SEQ ID NO: 449838

SEQ ID NO: 725989 - RNA, 64 nt, hsa; identical to SEQ ID NO: 449839

SEQ ID NO: 725990 - RNA, 64 nt, hsa; identical to SEQ ID NO: 449840

SEQ ID NO: 725991 - RNA, 64 nt, hsa; identical to SEQ ID NO: 449841

SEQ ID NO: 725992 - RNA, 64 nt, hsa; identical to SEQ ID NO: 449842

SEQ ID NO: 725993 - RNA, 64 nt, hsa; identical to SEQ ID NO: 449843

SEQ ID NO: 725994 - RNA, 64 nt, hsa; identical to SEQ ID NO: 449844

SEQ ID NO: 725995 - RNA, 64 nt, hsa; identical to SEQ ID NO: 449845

SEQ ID NO: 725996 - RNA, 64 nt, hsa; identical to SEQ ID NO: 449846

SEQ ID NO: 725997 - RNA, 64 nt, hsa; identical to SEQ ID NO: 449847

SEQ ID NO: 725998 - RNA, 64 nt, hsa; identical to SEQ ID NO: 449848

SEQ ID NO: 725999 - RNA, 64 nt, hsa; identical to SEQ ID NO: 449849

SEQ ID NO: 726000 - RNA, 64 nt, hsa; identical to SEQ ID NO: 449850

SEQ ID NO: 726001 - RNA, 64 nt, hsa; identical to SEQ ID NO: 449851

SEQ ID NO: 726002 - RNA, 64 nt, hsa; identical to SEQ ID NO: 449852

SEQ ID NO: 726003 - RNA, 64 nt, hsa; identical to SEQ ID NO: 449853

SEQ ID NO: 726004 - RNA, 64 nt, hsa; identical to SEQ ID NO: 449854

SEQ ID NO: 726005 - RNA, 64 nt, hsa; identical to SEQ ID NO: 449855

SEQ ID NO: 726006 - RNA, 64 nt, hsa; identical to SEQ ID NO: 449856

SEQ ID NO: 726007 - RNA, 64 nt, hsa; identical to SEQ ID NO: 449857

SEQ ID NO: 726008 - RNA, 64 nt, hsa; identical to SEQ ID NO: 449858

SEQ ID NO: 726009 - RNA, 64 nt, hsa; identical to SEQ ID NO: 449859

SEQ ID NO: 726010 - RNA, 64 nt, hsa; identical to SEQ ID NO: 449860

SEQ ID NO: 726011 - RNA, 64 nt, hsa; identical to SEQ ID NO: 449861

SEQ ID NO: 726012 - RNA, 64 nt, hsa; identical to SEQ ID NO: 449862

SEQ ID NO: 726013 - RNA, 64 nt, hsa; identical to SEQ ID NO: 449863

SEQ ID NO: 726014 - RNA, 64 nt, hsa; identical to SEQ ID NO: 449864

SEQ ID NO: 726015 - RNA, 64 nt, hsa; identical to SEQ ID NO: 449865

SEQ ID NO: 726016 - RNA, 64 nt, hsa; identical to SEQ ID NO: 449866

SEQ ID NO: 726017 - RNA, 64 nt, hsa; identical to SEQ ID NO: 449867

SEQ ID NO: 726018 - RNA, 64 nt, hsa; identical to SEQ ID NO: 449868

SEQ ID NO: 726019 - RNA, 64 nt, hsa; identical to SEQ ID NO: 449869

SEQ ID NO: 726020 - RNA, 64 nt, hsa; identical to SEQ ID NO: 449870

SEQ ID NO: 726021 - RNA, 64 nt, hsa; identical to SEQ ID NO: 449871

SEQ ID NO: 726022 - RNA, 64 nt, hsa; identical to SEQ ID NO: 449872

SEQ ID NO: 726023 - RNA, 64 nt, hsa; identical to SEQ ID NO: 449873

SEQ ID NO: 726024 - RNA, 64 nt, hsa; identical to SEQ ID NO: 449874

SEQ ID NO: 726025 - RNA, 64 nt, hsa
aucacacgcagccccuccccgccacagagacacaccauuacauacacagacacacacagaaaga

SEQ ID NO: 726026 - RNA, 64 nt, hsa
aucgcagauacgcccuuccggccacagaaacacaccauuacacacacauacacagaaagacaca

SEQ ID NO: 726027 - RNA, 64 nt, hsa
aucacacacacacccuccccgccacagagacacaccauuacauacacagacacgcaaucgcaga

SEQ ID NO: 726028 - RNA, 64 nt, hsa
aaaucacacacacacccuccccgccacagagacaccauuacauacacagacacacacagaaaga

SEQ ID NO: 726029 - RNA, 64 nt, hsa
aaaucacacacacccccuccccaccacagagacaccauuacauacacagacacacacagaaaga

SEQ ID NO: 726030 - RNA, 64 nt, hsa
auauaauccgaccacagugggaggugugauuuacccauuacacaaugagaaaccagaggagccg

SEQ ID NO: 726031 - RNA, 64 nt, hsa
ucuaaaaucuaaguauuuuagucuagaauuuucuccauuacaucauccuaagagauaaugcucu

SEQ ID NO: 726032 - RNA, 64 nt, hsa; identical to SEQ ID NO: 173405

SEQ ID NO: 726033 - RNA, 64 nt, hsa; identical to SEQ ID NO: 173406

SEQ ID NO: 726034 - RNA, 64 nt, hsa; identical to SEQ ID NO: 173407

SEQ ID NO: 726035 - RNA, 64 nt, hsa; identical to SEQ ID NO: 173408

SEQ ID NO: 726036 - RNA, 64 nt, hsa; identical to SEQ ID NO: 173409

SEQ ID NO: 726037 - RNA, 64 nt, hsa; identical to SEQ ID NO: 173410

SEQ ID NO: 726038 - RNA, 64 nt, hsa
uugugggggagggcaaggcucuccucccagccagggacgccaggacauagcugcuccuggucag

SEQ ID NO: 726039 - RNA, 64 nt, hsa
acugauguggacucaguaugauaacugagaugggggacgccagacaugugaggacgcuguccuc

SEQ ID NO: 726040 - RNA, 64 nt, hsa
cugauccuggaaccccucccucugcgccgcagcuggacgccaccuccgacggacacagccagcc

SEQ ID NO: 726041 - RNA, 64 nt, hsa
ugcagguggaguacaugucauucagcgcacacgcggacgccaagggcaucaugcagcugguggg

SEQ ID NO: 726042 - RNA, 64 nt, hsa
gggagagguggggccccugcugggguagagcuggggacgccacgugccauucccaugggccagu

SEQ ID NO: 726043 - RNA, 64 nt, hsa
gcuccgcguccuaggaccgccggcgccuccccacggacgccaggcaggccaggccgcucuccgg

SEQ ID NO: 726044 - RNA, 64 nt, hsa
ugugaccuggaucugaggucucugauagaaaucuggacgccaccggguccaggccuggccucag

SEQ ID NO: 726045 - RNA, 64 nt, hsa
gacuacaauccauagugaaacuguaaacaguaauggacgccaaauuauagguagcugauuuugc

SEQ ID NO: 726046 - RNA, 64 nt, hsa
caagaguugauuacaaccuccaugcuucauaagcggacgccacguuaggguuggacgugggcac

SEQ ID NO: 726047 - RNA, 64 nt, hsa
gccccgacuccagccagcgccucccuccaccccaggacgccacucauuucaucucauuuaaggg

SEQ ID NO: 726048 - RNA, 64 nt, hsa
agugauggccaagcugcaucagccgcacucuccuggacgccauauagcuuuaagaucgggggag

SEQ ID NO: 726049 - RNA, 64 nt, hsa
gggcugaccccagcuuccaggggacugucacuguggacgccaaaauggcauaacugagauaagg

SEQ ID NO: 726050 - RNA, 64 nt, hsa
ucuagucccuguguucugcacauccccacgguggggacgccaccaagccucagacucuuaccau

SEQ ID NO: 726051 - RNA, 64 nt, hsa
gcuucccacuaggacauccaggcaggucgggcggggacgccacacaccucagggccguccgcug

SEQ ID NO: 726052 - RNA, 64 nt, hsa
ugcuuuuguuucaacugcaggcaggggagcaaaaggacgccaugugagcauuaggaaaaaaaau

SEQ ID NO: 726053 - RNA, 56 nt, hsa
ugagagaggagaaugaauaaggcacgggacgccaugggcacugcagggacagucag

SEQ ID NO: 726054 - RNA, 64 nt, hsa
caagacugucuccuuuuggccaauaucauaagauggacgccauaauccugaggccuccuagagg

SEQ ID NO: 726055 - RNA, 64 nt, hsa
cccgcucccaggcgccccauguccucacaggccaggacgccauggcaggauggagaggacuugg

SEQ ID NO: 726056 - RNA, 64 nt, hsa
cucacugacaucuuugaauaacugccacuucuaaggacgccauucagagcagagcauuagcaga

SEQ ID NO: 726057 - RNA, 64 nt, hsa
agccucgcuccucgcuccucgcuccucgccccuaggacgccaagggggaaaggagagggcggaa

SEQ ID NO: 726058 - RNA, 64 nt, hsa
ccugucaccccaccccaggccacccucucccagaggacgccaucucccuuacuguugcugggag

SEQ ID NO: 726059 - RNA, 64 nt, hsa
gccacaccaggucgcagcaaauggcuucagccugggacgccaguguuuuaugcucuuaguucag

SEQ ID NO: 726060 - RNA, 64 nt, hsa
ccugccccgcuacagaagccagacugggucccgcggacgccagcaggggcagccccagccuagg

SEQ ID NO: 726061 - RNA, 64 nt, hsa
uaaaggaauaauaaaugcauaauaugaggucaguggacgccauuuucuguuauaaucauuuuug

SEQ ID NO: 726062 - RNA, 64 nt, hsa
caacaucucagcaccuggugccgaaggaggacuuggacgccauaguggcccgggaccgagaccu

SEQ ID NO: 726063 - RNA, 64 nt, hsa
agggcaagacagcucacagagaccucuuuuauaaggacgccaguuccauucaagagggcacugc

SEQ ID NO: 726064 - RNA, 64 nt, hsa
uccuuugugcccacccguucuggccacccugccuggacgccagcuguucuucucagccugagcc

SEQ ID NO: 726065 - RNA, 64 nt, hsa
agugaaaccaggggcucugcaggucacuugggacggacgccaccagacuugucuccaaaaauca

SEQ ID NO: 726066 - RNA, 64 nt, hsa
agcaaaagguggcaacccauggaggcagaaagaaggacgccagccugacccuuaucugaaacgu

SEQ ID NO: 726067 - RNA, 64 nt, hsa
aagaaaucccuaccuauguaaauguuugaauggaggacgccaguaaaaaaacaaaaacaaaaac

SEQ ID NO: 726068 - RNA, 64 nt, hsa
gccggggaaggccaggguggaagggcggcuugagggacgccaggagaagacugaaugccaggcu

SEQ ID NO: 726069 - RNA, 64 nt, hsa
cuucgccucccuccaggacuccaccccggcucccggacgccagcugggcgucagaccccaccgg

SEQ ID NO: 726070 - RNA, 64 nt, hsa
auguguuuccuugaugcaggagguguucuucccuggacgccaugguguucccugcacuugggug

SEQ ID NO: 726071 - RNA, 64 nt, hsa
cugguaaacauuccuccagccuccccuccccuggggacgccaaggaggugggccacacccagga

SEQ ID NO: 726072 - RNA, 64 nt, hsa
gcugauaacaccaccacugggacgugccauguugggacgccacucccugugggaaggcaccauc

SEQ ID NO: 726073 - RNA, 64 nt, hsa
gauaaauuuguuguauucaaaaacuugaaaugcaggacgccauuaagugucuguuuauauuuuu

SEQ ID NO: 726074 - RNA, 64 nt, hsa
gcacagacuaugaaaagcugaguuagugcgcccgggacgccaggcaagcagcuuuuacaguuug

SEQ ID NO: 726075 - RNA, 64 nt, hsa
cccagugggcuccuaagggggcaggcgugugaguggacgccauccgaagacagcacuugaccuc

SEQ ID NO: 726076 - RNA, 64 nt, hsa
ccagggcucccuguccagaauucgguucuccucaggacgccaacucccagagcuaaggaccaag

SEQ ID NO: 726077 - RNA, 64 nt, hsa
augggcccaccaauugggcuucccccugcucgagggacgccaauaggcaugccgccuccgggaa

SEQ ID NO: 726078 - RNA, 64 nt, hsa
gggagcgaacguggaugaaaaccacagggauuccggacgccagaccccauuuuauacuucacuu

SEQ ID NO: 726079 - RNA, 64 nt, hsa
ucccaguggcugcugcccaggcccagaccuucuaggacgccacccagcaaaagguuguuccuaa

SEQ ID NO: 726080 - RNA, 64 nt, hsa
augccaggagggcucgagcuggacacuccuggcuggacgccaggccagugccgccuacguggag

SEQ ID NO: 726081 - RNA, 64 nt, hsa
ggggugagacagcaggaaggggcccugcacgccgggacgccaccuccgccagccgccuccaccc

SEQ ID NO: 726082 - RNA, 64 nt, hsa
cacucaccuggguguccuggagcugggaacugagggacgccacguccuuggccagcuuaauggc

SEQ ID NO: 726083 - RNA, 64 nt, hsa
uuagcuguacugugugauauuuuucauuauuuuaggacgccaacaugagaccuguaauaaaaua

SEQ ID NO: 726084 - RNA, 64 nt, hsa
gccgggggcuucugcccagggcuccccuggaccaggacgccagguagggcagggaaccucagua

SEQ ID NO: 726085 - RNA, 64 nt, hsa
gggaauacacuugcauguacagagccuggggccuggacgccacggccucucaucuuaggaccua

SEQ ID NO: 726086 - RNA, 64 nt, hsa
cugccugggugucgggccaccagaaggcucugccggacgccaagaagacggucucugggcucuu

SEQ ID NO: 726087 - RNA, 64 nt, hsa
uucaauuccagaaagaccuuacucuucucucugaggacgccaaaauacaaauuugacccaagaa

SEQ ID NO: 726088 - RNA, 64 nt, hsa
agcugcagcagcugugccgccgcggguccaccgaggacgccaaucaaucaacccaacaccacaa

SEQ ID NO: 726089 - RNA, 64 nt, hsa
acaaaagguaaagacgcaacguuuccaacucucgggacgccaaggccgcaggacuggagggcca

SEQ ID NO: 726090 - RNA, 64 nt, hsa
ugacugacgcuguccgacgaaggcggccacggacggacgccagcacacgaagucacgugcaagu

SEQ ID NO: 726091 - RNA, 64 nt, hsa
gccagggagacuugaauguggcugucacucuuccggacgccaagggcugcaggaggcugcuuuu

SEQ ID NO: 726092 - RNA, 64 nt, hsa
uuucuuuaaggucccccgaccaauccccagccuaggacgccaacuucucccaccccuuggcccc

SEQ ID NO: 726093 - RNA, 64 nt, hsa
ucugugcagggcucucacuggcggugcccaggacggacgccagauggcugcgcgcuuugucagc

SEQ ID NO: 726094 - RNA, 64 nt, hsa
cgcgccagccaggcugugggcagggcggggccagggacgccaaagagagguugcagucagaacc

SEQ ID NO: 726095 - RNA, 64 nt, hsa
aacuucguggaagccaggguccccugcagcugagggacgccaagcagacacaccugcccucccc

SEQ ID NO: 726096 - RNA, 64 nt, hsa
gcagcuggcucugcucugagaaacucuggcaaguggacgccauucucuugcccuuaggauucac

SEQ ID NO: 726097 - RNA, 64 nt, hsa
uuggcgggucacugaggugcauucugggcuccagggacgccacugcggggcaaaggcgccguua

SEQ ID NO: 726098 - RNA, 64 nt, hsa
ucgcuauaggcauaggcccggcauggcugucgcuggacgccagcugugcacacccagccacacc

SEQ ID NO: 726099 - RNA, 64 nt, hsa
aaggaaacccuguggaggcugcccuuugaccuuuggacgccaccuguaaucacucuggauggug

SEQ ID NO: 726100 - RNA, 64 nt, hsa
ggucugugggggccgugcucucagggcgugugcgggacgccaccugugcacaccugcucagagc

SEQ ID NO: 726101 - RNA, 64 nt, hsa
ccccggucaccuuccuccgcacggaagaggggccggacgccaccuuccccaggaccauuccccu

SEQ ID NO: 726102 - RNA, 64 nt, hsa
gaaugccgagcagcacuuccagucuccacccacaggacgccaguagcacccucuaaguugugag

SEQ ID NO: 726103 - RNA, 64 nt, hsa
cccucuuccaucacggagguaaaguugaggccguggacgccaccagccugaugaaauaaagauu

SEQ ID NO: 726104 - RNA, 64 nt, hsa
ccuggggagacuugaaaggccccugucccagccuggacgccacgcacugccgcacgucacuggc

SEQ ID NO: 726105 - RNA, 64 nt, hsa
gggugguagaggcuggaaggaagccacaucaggaggacgccacuccggcccuucacccuugcca

SEQ ID NO: 726106 - RNA, 64 nt, hsa
cacaacucgggcgggggugugacaccucucccccacccccgacuccgugguuuccguaucguca

SEQ ID NO: 726107 - RNA, 64 nt, hsa
uuucccucuccccuagaaaagggggggccgucucacccccgagcccccuuggagacaccccccc

SEQ ID NO: 726108 - RNA, 64 nt, hsa
acucagcggccccaucggaacugagaauugcaaaacccccgacuuuagcuauaguuaaguugcc

SEQ ID NO: 726109 - RNA, 64 nt, hsa
augcagagaugugcccccacccccacccucgaccacccccgaugggauggcuuggggggcucca

SEQ ID NO: 726110 - RNA, 64 nt, hsa; identical to SEQ ID NO: 618953

SEQ ID NO: 726111 - RNA, 64 nt, hsa; identical to SEQ ID NO: 618954

SEQ ID NO: 726112 - RNA, 64 nt, hsa; identical to SEQ ID NO: 140704

SEQ ID NO: 726113 - RNA, 64 nt, hsa; identical to SEQ ID NO: 140705

SEQ ID NO: 726114 - RNA, 64 nt, hsa; identical to SEQ ID NO: 140706

SEQ ID NO: 726115 - RNA, 64 nt, hsa; identical to SEQ ID NO: 140707

SEQ ID NO: 726116 - RNA, 64 nt, hsa; identical to SEQ ID NO: 140708

SEQ ID NO: 726117 - RNA, 64 nt, hsa; identical to SEQ ID NO: 140709

SEQ ID NO: 726118 - RNA, 64 nt, hsa; identical to SEQ ID NO: 140710

SEQ ID NO: 726119 - RNA, 64 nt, hsa; identical to SEQ ID NO: 140711

SEQ ID NO: 726120 - RNA, 64 nt, hsa; identical to SEQ ID NO: 140712

SEQ ID NO: 726121 - RNA, 64 nt, hsa; identical to SEQ ID NO: 140713

SEQ ID NO: 726122 - RNA, 64 nt, hsa; identical to SEQ ID NO: 140714

SEQ ID NO: 726123 - RNA, 64 nt, hsa; identical to SEQ ID NO: 140715

SEQ ID NO: 726124 - RNA, 64 nt, hsa; identical to SEQ ID NO: 140716

SEQ ID NO: 726125 - RNA, 64 nt, hsa; identical to SEQ ID NO: 140717

SEQ ID NO: 726126 - RNA, 64 nt, hsa; identical to SEQ ID NO: 140718

SEQ ID NO: 726127 - RNA, 64 nt, hsa; identical to SEQ ID NO: 140719

SEQ ID NO: 726128 - RNA, 64 nt, hsa; identical to SEQ ID NO: 140720

SEQ ID NO: 726129 - RNA, 64 nt, hsa; identical to SEQ ID NO: 140721

SEQ ID NO: 726130 - RNA, 64 nt, hsa; identical to SEQ ID NO: 140722

SEQ ID NO: 726131 - RNA, 64 nt, hsa; identical to SEQ ID NO: 140723

SEQ ID NO: 726132 - RNA, 64 nt, hsa; identical to SEQ ID NO: 210736

SEQ ID NO: 726133 - RNA, 64 nt, hsa; identical to SEQ ID NO: 210737

SEQ ID NO: 726134 - RNA, 64 nt, hsa; identical to SEQ ID NO: 210738

SEQ ID NO: 726135 - RNA, 64 nt, hsa; identical to SEQ ID NO: 210739

SEQ ID NO: 726136 - RNA, 64 nt, hsa; identical to SEQ ID NO: 210740

SEQ ID NO: 726137 - RNA, 64 nt, hsa; identical to SEQ ID NO: 210741

SEQ ID NO: 726138 - RNA, 64 nt, hsa; identical to SEQ ID NO: 210742

SEQ ID NO: 726139 - RNA, 64 nt, hsa; identical to SEQ ID NO: 210743

SEQ ID NO: 726140 - RNA, 64 nt, hsa; identical to SEQ ID NO: 210744

SEQ ID NO: 726141 - RNA, 64 nt, hsa; identical to SEQ ID NO: 210745

SEQ ID NO: 726142 - RNA, 64 nt, hsa; identical to SEQ ID NO: 210746

SEQ ID NO: 726143 - RNA, 64 nt, hsa; identical to SEQ ID NO: 210747

SEQ ID NO: 726144 - RNA, 64 nt, hsa; identical to SEQ ID NO: 210748

SEQ ID NO: 726145 - RNA, 64 nt, hsa; identical to SEQ ID NO: 210749

SEQ ID NO: 726146 - RNA, 64 nt, hsa; identical to SEQ ID NO: 210750

SEQ ID NO: 726147 - RNA, 64 nt, hsa; identical to SEQ ID NO: 210751

SEQ ID NO: 726148 - RNA, 64 nt, hsa; identical to SEQ ID NO: 210752

SEQ ID NO: 726149 - RNA, 64 nt, hsa; identical to SEQ ID NO: 210753

SEQ ID NO: 726150 - RNA, 64 nt, hsa; identical to SEQ ID NO: 210754

SEQ ID NO: 726151 - RNA, 64 nt, hsa; identical to SEQ ID NO: 210755

SEQ ID NO: 726152 - RNA, 64 nt, hsa; identical to SEQ ID NO: 210756

SEQ ID NO: 726153 - RNA, 64 nt, hsa; identical to SEQ ID NO: 210757

SEQ ID NO: 726154 - RNA, 64 nt, hsa; identical to SEQ ID NO: 210758

SEQ ID NO: 726155 - RNA, 64 nt, hsa; identical to SEQ ID NO: 210759

SEQ ID NO: 726156 - RNA, 64 nt, hsa; identical to SEQ ID NO: 210760

SEQ ID NO: 726157 - RNA, 64 nt, hsa; identical to SEQ ID NO: 210761

SEQ ID NO: 726158 - RNA, 64 nt, hsa; identical to SEQ ID NO: 210762

SEQ ID NO: 726159 - RNA, 64 nt, hsa; identical to SEQ ID NO: 210763

SEQ ID NO: 726160 - RNA, 64 nt, hsa; identical to SEQ ID NO: 210764

SEQ ID NO: 726161 - RNA, 64 nt, hsa; identical to SEQ ID NO: 210765

SEQ ID NO: 726162 - RNA, 64 nt, hsa; identical to SEQ ID NO: 210766

SEQ ID NO: 726163 - RNA, 64 nt, hsa; identical to SEQ ID NO: 210767

SEQ ID NO: 726164 - RNA, 64 nt, hsa; identical to SEQ ID NO: 236246

SEQ ID NO: 726165 - RNA, 64 nt, hsa; identical to SEQ ID NO: 236247

SEQ ID NO: 726166 - RNA, 64 nt, hsa; identical to SEQ ID NO: 236248

SEQ ID NO: 726167 - RNA, 64 nt, hsa; identical to SEQ ID NO: 236249

SEQ ID NO: 726168 - RNA, 64 nt, hsa; identical to SEQ ID NO: 236250

SEQ ID NO: 726169 - RNA, 64 nt, hsa; identical to SEQ ID NO: 236251

SEQ ID NO: 726170 - RNA, 64 nt, hsa; identical to SEQ ID NO: 236252

SEQ ID NO: 726171 - RNA, 64 nt, hsa; identical to SEQ ID NO: 236253

SEQ ID NO: 726172 - RNA, 64 nt, hsa; identical to SEQ ID NO: 236254

SEQ ID NO: 726173 - RNA, 64 nt, hsa; identical to SEQ ID NO: 236255

SEQ ID NO: 726174 - RNA, 64 nt, hsa; identical to SEQ ID NO: 236256

SEQ ID NO: 726175 - RNA, 64 nt, hsa; identical to SEQ ID NO: 236257

SEQ ID NO: 726176 - RNA, 64 nt, hsa; identical to SEQ ID NO: 236258

SEQ ID NO: 726177 - RNA, 64 nt, hsa; identical to SEQ ID NO: 236259

SEQ ID NO: 726178 - RNA, 64 nt, hsa; identical to SEQ ID NO: 236260

SEQ ID NO: 726179 - RNA, 64 nt, hsa; identical to SEQ ID NO: 236261

SEQ ID NO: 726180 - RNA, 64 nt, hsa; identical to SEQ ID NO: 60331

SEQ ID NO: 726181 - RNA, 64 nt, hsa; identical to SEQ ID NO: 60332

SEQ ID NO: 726182 - RNA, 64 nt, hsa; identical to SEQ ID NO: 60333

SEQ ID NO: 726183 - RNA, 64 nt, hsa; identical to SEQ ID NO: 60334

SEQ ID NO: 726184 - RNA, 64 nt, hsa; identical to SEQ ID NO: 60335

SEQ ID NO: 726185 - RNA, 64 nt, hsa; identical to SEQ ID NO: 60336

SEQ ID NO: 726186 - RNA, 64 nt, hsa; identical to SEQ ID NO: 60337

SEQ ID NO: 726187 - RNA, 64 nt, hsa; identical to SEQ ID NO: 60338

SEQ ID NO: 726188 - RNA, 64 nt, hsa; identical to SEQ ID NO: 60339

SEQ ID NO: 726189 - RNA, 64 nt, hsa; identical to SEQ ID NO: 60340

SEQ ID NO: 726190 - RNA, 64 nt, hsa
auuuggauuauuuuugaaaaaaguaaaauaacaauacccuuacgaauuuuuuggugcauagcau

SEQ ID NO: 726191 - RNA, 64 nt, hsa
ccauucaguaugcaaaacuuaaaauacauaacuuuacccuuaaauauuuuuucuuucucugacu

SEQ ID NO: 726192 - RNA, 64 nt, hsa
cuuaaggagguucaagcagagugagaaguuaaaauacccuuaaggucuuuaagggaggaagugu

SEQ ID NO: 726193 - RNA, 64 nt, hsa
aggacggagguucaagcagagugagaaguuaaaauacccuuaaggagguucaagcagagugaga

SEQ ID NO: 726194 - RNA, 64 nt, hsa; identical to SEQ ID NO: 132800

SEQ ID NO: 726195 - RNA, 64 nt, hsa; identical to SEQ ID NO: 132801

SEQ ID NO: 726196 - RNA, 64 nt, hsa; identical to SEQ ID NO: 132802

SEQ ID NO: 726197 - RNA, 64 nt, hsa; identical to SEQ ID NO: 132803

SEQ ID NO: 726198 - RNA, 64 nt, hsa; identical to SEQ ID NO: 132804

SEQ ID NO: 726199 - RNA, 64 nt, hsa; identical to SEQ ID NO: 132805

SEQ ID NO: 726200 - RNA, 64 nt, hsa; identical to SEQ ID NO: 132806

SEQ ID NO: 726201 - RNA, 64 nt, hsa; identical to SEQ ID NO: 132807

SEQ ID NO: 726202 - RNA, 64 nt, hsa; identical to SEQ ID NO: 132808

SEQ ID NO: 726203 - RNA, 64 nt, hsa; identical to SEQ ID NO: 132809

SEQ ID NO: 726204 - RNA, 64 nt, hsa; identical to SEQ ID NO: 132810

SEQ ID NO: 726205 - RNA, 64 nt, hsa; identical to SEQ ID NO: 132811

SEQ ID NO: 726206 - RNA, 64 nt, hsa; identical to SEQ ID NO: 132812

SEQ ID NO: 726207 - RNA, 64 nt, hsa; identical to SEQ ID NO: 132813

SEQ ID NO: 726208 - RNA, 64 nt, hsa; identical to SEQ ID NO: 132814

SEQ ID NO: 726209 - RNA, 64 nt, hsa; identical to SEQ ID NO: 132815

SEQ ID NO: 726210 - RNA, 64 nt, hsa; identical to SEQ ID NO: 132816

SEQ ID NO: 726211 - RNA, 64 nt, hsa; identical to SEQ ID NO: 132817

SEQ ID NO: 726212 - RNA, 64 nt, hsa; identical to SEQ ID NO: 132818

SEQ ID NO: 726213 - RNA, 64 nt, hsa; identical to SEQ ID NO: 132819

SEQ ID NO: 726214 - RNA, 64 nt, hsa; identical to SEQ ID NO: 132820

SEQ ID NO: 726215 - RNA, 64 nt, hsa; identical to SEQ ID NO: 132821

SEQ ID NO: 726216 - RNA, 64 nt, hsa; identical to SEQ ID NO: 132822

SEQ ID NO: 726217 - RNA, 64 nt, hsa; identical to SEQ ID NO: 132823

SEQ ID NO: 726218 - RNA, 64 nt, hsa; identical to SEQ ID NO: 132824

SEQ ID NO: 726219 - RNA, 64 nt, hsa; identical to SEQ ID NO: 132825

SEQ ID NO: 726220 - RNA, 64 nt, hsa; identical to SEQ ID NO: 132826

SEQ ID NO: 726221 - RNA, 64 nt, hsa; identical to SEQ ID NO: 132827

SEQ ID NO: 726222 - RNA, 64 nt, hsa; identical to SEQ ID NO: 132828

SEQ ID NO: 726223 - RNA, 64 nt, hsa; identical to SEQ ID NO: 132829

SEQ ID NO: 726224 - RNA, 64 nt, hsa; identical to SEQ ID NO: 132830

SEQ ID NO: 726225 - RNA, 64 nt, hsa; identical to SEQ ID NO: 132831

SEQ ID NO: 726226 - RNA, 64 nt, hsa; identical to SEQ ID NO: 132832

SEQ ID NO: 726227 - RNA, 64 nt, hsa; identical to SEQ ID NO: 132833

SEQ ID NO: 726228 - RNA, 64 nt, hsa; identical to SEQ ID NO: 132834

SEQ ID NO: 726229 - RNA, 64 nt, hsa; identical to SEQ ID NO: 132835

SEQ ID NO: 726230 - RNA, 64 nt, hsa; identical to SEQ ID NO: 132836

SEQ ID NO: 726231 - RNA, 64 nt, hsa; identical to SEQ ID NO: 132837

SEQ ID NO: 726232 - RNA, 64 nt, hsa; identical to SEQ ID NO: 132838

SEQ ID NO: 726233 - RNA, 64 nt, hsa; identical to SEQ ID NO: 132839

SEQ ID NO: 726234 - RNA, 64 nt, hsa; identical to SEQ ID NO: 132840

SEQ ID NO: 726235 - RNA, 64 nt, hsa; identical to SEQ ID NO: 132841

SEQ ID NO: 726236 - RNA, 64 nt, hsa; identical to SEQ ID NO: 132842

SEQ ID NO: 726237 - RNA, 64 nt, hsa; identical to SEQ ID NO: 132843

SEQ ID NO: 726238 - RNA, 64 nt, hsa; identical to SEQ ID NO: 132844

SEQ ID NO: 726239 - RNA, 58 nt, hsa; identical to SEQ ID NO: 132845

SEQ ID NO: 726240 - RNA, 64 nt, hsa; identical to SEQ ID NO: 132846

SEQ ID NO: 726241 - RNA, 64 nt, hsa; identical to SEQ ID NO: 132847

SEQ ID NO: 726242 - RNA, 64 nt, hsa; identical to SEQ ID NO: 132848

SEQ ID NO: 726243 - RNA, 64 nt, hsa; identical to SEQ ID NO: 132849

SEQ ID NO: 726244 - RNA, 64 nt, hsa; identical to SEQ ID NO: 132850

SEQ ID NO: 726245 - RNA, 64 nt, hsa; identical to SEQ ID NO: 132851

SEQ ID NO: 726246 - RNA, 64 nt, hsa; identical to SEQ ID NO: 132852

SEQ ID NO: 726247 - RNA, 64 nt, hsa; identical to SEQ ID NO: 132853

SEQ ID NO: 726248 - RNA, 64 nt, hsa; identical to SEQ ID NO: 132854

SEQ ID NO: 726249 - RNA, 64 nt, hsa; identical to SEQ ID NO: 132855

SEQ ID NO: 726250 - RNA, 64 nt, hsa; identical to SEQ ID NO: 132856

SEQ ID NO: 726251 - RNA, 64 nt, hsa; identical to SEQ ID NO: 132857

SEQ ID NO: 726252 - RNA, 64 nt, hsa; identical to SEQ ID NO: 132858

SEQ ID NO: 726253 - RNA, 64 nt, hsa; identical to SEQ ID NO: 132859

SEQ ID NO: 726254 - RNA, 64 nt, hsa; identical to SEQ ID NO: 132860

SEQ ID NO: 726255 - RNA, 64 nt, hsa; identical to SEQ ID NO: 132861

SEQ ID NO: 726256 - RNA, 64 nt, hsa; identical to SEQ ID NO: 132862

SEQ ID NO: 726257 - RNA, 64 nt, hsa; identical to SEQ ID NO: 132863

SEQ ID NO: 726258 - RNA, 64 nt, hsa; identical to SEQ ID NO: 132864

SEQ ID NO: 726259 - RNA, 64 nt, hsa; identical to SEQ ID NO: 132865

SEQ ID NO: 726260 - RNA, 64 nt, hsa; identical to SEQ ID NO: 132866

SEQ ID NO: 726261 - RNA, 64 nt, hsa; identical to SEQ ID NO: 132867

SEQ ID NO: 726262 - RNA, 64 nt, hsa; identical to SEQ ID NO: 132868

SEQ ID NO: 726263 - RNA, 64 nt, hsa; identical to SEQ ID NO: 132869

SEQ ID NO: 726264 - RNA, 64 nt, hsa; identical to SEQ ID NO: 132870

SEQ ID NO: 726265 - RNA, 64 nt, hsa; identical to SEQ ID NO: 132871

SEQ ID NO: 726266 - RNA, 64 nt, hsa; identical to SEQ ID NO: 132872

SEQ ID NO: 726267 - RNA, 64 nt, hsa; identical to SEQ ID NO: 132873

SEQ ID NO: 726268 - RNA, 64 nt, hsa; identical to SEQ ID NO: 132874

SEQ ID NO: 726269 - RNA, 64 nt, hsa; identical to SEQ ID NO: 132875

SEQ ID NO: 726270 - RNA, 64 nt, hsa; identical to SEQ ID NO: 132876

SEQ ID NO: 726271 - RNA, 64 nt, hsa; identical to SEQ ID NO: 132877

SEQ ID NO: 726272 - RNA, 64 nt, hsa; identical to SEQ ID NO: 132878

SEQ ID NO: 726273 - RNA, 64 nt, hsa; identical to SEQ ID NO: 132879

SEQ ID NO: 726274 - RNA, 64 nt, hsa; identical to SEQ ID NO: 132880

SEQ ID NO: 726275 - RNA, 64 nt, hsa; identical to SEQ ID NO: 132881

SEQ ID NO: 726276 - RNA, 64 nt, hsa; identical to SEQ ID NO: 132882

SEQ ID NO: 726277 - RNA, 64 nt, hsa; identical to SEQ ID NO: 132883

SEQ ID NO: 726278 - RNA, 64 nt, hsa; identical to SEQ ID NO: 132884

SEQ ID NO: 726279 - RNA, 64 nt, hsa; identical to SEQ ID NO: 132885

SEQ ID NO: 726280 - RNA, 64 nt, hsa; identical to SEQ ID NO: 132886

SEQ ID NO: 726281 - RNA, 64 nt, hsa; identical to SEQ ID NO: 132887

SEQ ID NO: 726282 - RNA, 64 nt, hsa; identical to SEQ ID NO: 132888

SEQ ID NO: 726283 - RNA, 64 nt, hsa; identical to SEQ ID NO: 132889

SEQ ID NO: 726284 - RNA, 63 nt, hsa
ucugaaguuugagacgagggauuauuucaggguggggcccaaugugaucuaaugcccagcugg

SEQ ID NO: 726285 - RNA, 63 nt, hsa
cauguuccagggcaggucuggguuuccaagggaggggcccaggcuacauccuugguuucccca

SEQ ID NO: 726286 - RNA, 63 nt, hsa
gaaggcaaaggccaguuuccccguuaucaugaaggggcccacucaggacaggaacaaggacaa

SEQ ID NO: 726287 - RNA, 63 nt, hsa
ccuuucuccaccacagccaaggccuggagacugggggcccagcagagccugcucccacccucc

SEQ ID NO: 726288 - RNA, 63 nt, hsa
ucccugcugccuccucaguggggcagugggcaaggggcccaggggcagccgaagcacgggguc

SEQ ID NO: 726289 - RNA, 63 nt, hsa
acguuguacacauaugcugcaggaaggggguggggggcccaauaaggccuuugggaaaggaca

SEQ ID NO: 726290 - RNA, 63 nt, hsa
gaagucagggucaacucccaggccucagaugcaggggcccagaacaccugcucucaccugagc

SEQ ID NO: 726291 - RNA, 63 nt, hsa
ggaacaccugcucucaccugaaccccaggugaaggggcccagaacaccugcucucaccugagc

SEQ ID NO: 726292 - RNA, 63 nt, hsa
aaggguccucuuuuccuggcagcugcuguggguggggcccagacaccagccuagccuggcucu

SEQ ID NO: 726293 - RNA, 54 nt, hsa
ucacugagagggucccaugacggcggggcccaggcagccuccgggcgugugaag

SEQ ID NO: 726294 - RNA, 63 nt, hsa
cucugauaaauccaagcccgcccaggcccacggggggcccacgggaccccccgggacuccccg

SEQ ID NO: 726295 - RNA, 63 nt, hsa
cagggacagacauggcgagcacagugcaggcccggggcccacgggcaacauggaacccuggga

SEQ ID NO: 726296 - RNA, 63 nt, hsa
ccacaugcuccaaccucccacugcucccugucaggggcccaggcugccaucacuggaggcugc

SEQ ID NO: 726297 - RNA, 63 nt, hsa
uuuucagucguacgcauagacgccccaggauggggggcccacuguggcggaagggggucccug

SEQ ID NO: 726298 - RNA, 63 nt, hsa
guggggccugggaggguuccccuggccuuaaaaggggcccaagccccaucucauccuggcacg

SEQ ID NO: 726299 - RNA, 63 nt, hsa
cugccccuaggaugcugcagcagagugagcaagggggcccaaaucgaccauaaaggguguagg

SEQ ID NO: 726300 - RNA, 63 nt, hsa
aucaucucacuccuuugccugcacugccaggguggggcccaccaagauuccugaucaugacgg

SEQ ID NO: 726301 - RNA, 63 nt, hsa
acuugcaagcaacaucugcucuguuccucagguggggcccagagcccuuccccgagacugcug

SEQ ID NO: 726302 - RNA, 63 nt, hsa
ucaggaaguguggcgaccagaaagcguagacccggggcccagggucugcccgccccugcagcc

SEQ ID NO: 726303 - RNA, 63 nt, hsa
ccaccaaacugccaggggcugccguccacccguggggcccaggggcuggggccacagccuugc

SEQ ID NO: 726304 - RNA, 63 nt, hsa
acagguugacuguguacccccaaccaaggagcuggggcccaaggccaguccugccccagagac

SEQ ID NO: 726305 - RNA, 63 nt, hsa
cccagcccagccccaccacagaucccagagauaggggcccagucuccaugggggcaaggagca

SEQ ID NO: 726306 - RNA, 63 nt, hsa
gaaaugagcacaaagacacgaagucaugggccuggggcccagggccaggguggggcccaggcc

SEQ ID NO: 726307 - RNA, 63 nt, hsa
cgaagucaugggccuggggcccagggccaggguggggcccaggccacuggcuccagagcccug

SEQ ID NO: 726308 - RNA, 63 nt, hsa
caguuggcccaggccccuggcagugcucccggaggggcccaggaaggccugggcagagacccu

SEQ ID NO: 726309 - RNA, 63 nt, hsa
gacaggggacugugucugcagugccggcuacugggggcccagcugcaacgccuccugcccagc

SEQ ID NO: 726310 - RNA, 63 nt, hsa
ggccuuucaccggguugcugguuucuuuucuguggggcccagacuucuguaaagcacacagau

SEQ ID NO: 726311 - RNA, 63 nt, hsa
ugcugcggguggugcuuccaggcagagugggugggggcccaccgggcaccgcccuuucuuccu

SEQ ID NO: 726312 - RNA, 63 nt, hsa
agguuauguuuaccaacuggggcggggguggggggggcccagggagcagggcuuaggggcuag

SEQ ID NO: 726313 - RNA, 63 nt, hsa
gagagagagagaaagagagagagagagagagaaggggcccaagagagacagcacaggcagccc

SEQ ID NO: 726314 - RNA, 63 nt, hsa
ggccaaggucucaugggggcuagggccaaguugggggcccaggaggcggggagggaggaggag

SEQ ID NO: 726315 - RNA, 63 nt, hsa
augcuguacucaccuccaucacccuccaacuuuggggcccaugucuuccuugggccaaggucu

SEQ ID NO: 726316 - RNA, 63 nt, hsa
ugccgucccgucauggggcagggaauccauagcggggcccacaggcagggguaugagugcguc

SEQ ID NO: 726317 - RNA, 63 nt, hsa
uaacugaguguggcgggaagggugggcccuggaggggcccaugugggcugaaggaugggggcu

SEQ ID NO: 726318 - RNA, 63 nt, hsa
uccaaggaggggcacgugcaccugauucuccuuggggcccagaggaagcugaugucauggcug

SEQ ID NO: 726319 - RNA, 63 nt, hsa
agaacccugcugcccuuucuaggcagccuccuuggggcccaagcucugcucccuggaucugcc

SEQ ID NO: 726320 - RNA, 63 nt, hsa
gguaguugcuuuucucucuccugaugcuagguuggggcccacccugcucccuguuccugcuag

SEQ ID NO: 726321 - RNA, 63 nt, hsa
cccuaaaggggacuggcugcugugaucuucuaaggggcccagggccaacccuguaggcuuccc

SEQ ID NO: 726322 - RNA, 64 nt, hsa; identical to SEQ ID NO: 311016

SEQ ID NO: 726323 - RNA, 64 nt, hsa; identical to SEQ ID NO: 311017

SEQ ID NO: 726324 - RNA, 64 nt, hsa; identical to SEQ ID NO: 311018

SEQ ID NO: 726325 - RNA, 64 nt, hsa; identical to SEQ ID NO: 311019

SEQ ID NO: 726326 - RNA, 64 nt, hsa; identical to SEQ ID NO: 311020

SEQ ID NO: 726327 - RNA, 64 nt, hsa; identical to SEQ ID NO: 311021

SEQ ID NO: 726328 - RNA, 64 nt, hsa; identical to SEQ ID NO: 311022

SEQ ID NO: 726329 - RNA, 64 nt, hsa; identical to SEQ ID NO: 311023

SEQ ID NO: 726330 - RNA, 64 nt, hsa; identical to SEQ ID NO: 311024

SEQ ID NO: 726331 - RNA, 64 nt, hsa; identical to SEQ ID NO: 311025

SEQ ID NO: 726332 - RNA, 64 nt, hsa; identical to SEQ ID NO: 311026

SEQ ID NO: 726333 - RNA, 64 nt, hsa; identical to SEQ ID NO: 311027

SEQ ID NO: 726334 - RNA, 64 nt, hsa; identical to SEQ ID NO: 311028

SEQ ID NO: 726335 - RNA, 64 nt, hsa; identical to SEQ ID NO: 311029

SEQ ID NO: 726336 - RNA, 64 nt, hsa; identical to SEQ ID NO: 311030

SEQ ID NO: 726337 - RNA, 64 nt, hsa; identical to SEQ ID NO: 311031

SEQ ID NO: 726338 - RNA, 64 nt, hsa; identical to SEQ ID NO: 311032

SEQ ID NO: 726339 - RNA, 64 nt, hsa; identical to SEQ ID NO: 311033

SEQ ID NO: 726340 - RNA, 64 nt, hsa; identical to SEQ ID NO: 311034

SEQ ID NO: 726341 - RNA, 64 nt, hsa; identical to SEQ ID NO: 695788

SEQ ID NO: 726342 - RNA, 64 nt, hsa; identical to SEQ ID NO: 695789

SEQ ID NO: 726343 - RNA, 64 nt, hsa; identical to SEQ ID NO: 695790

SEQ ID NO: 726344 - RNA, 64 nt, hsa; identical to SEQ ID NO: 695791

SEQ ID NO: 726345 - RNA, 64 nt, hsa; identical to SEQ ID NO: 695792

SEQ ID NO: 726346 - RNA, 64 nt, hsa; identical to SEQ ID NO: 695793

SEQ ID NO: 726347 - RNA, 64 nt, hsa; identical to SEQ ID NO: 695794

SEQ ID NO: 726348 - RNA, 64 nt, hsa; identical to SEQ ID NO: 695795

SEQ ID NO: 726349 - RNA, 64 nt, hsa; identical to SEQ ID NO: 695796

SEQ ID NO: 726350 - RNA, 64 nt, hsa; identical to SEQ ID NO: 695797

SEQ ID NO: 726351 - RNA, 64 nt, hsa
cgugcucuguggcuuuccccuauuucucuuaauacuuagggaagaaucugacaggaagaagcgc

SEQ ID NO: 726352 - RNA, 64 nt, hsa
ugagggugggaacaugugagggaggguaaaggggcuuagggaaaagggggcauaccaggugggg

SEQ ID NO: 726353 - RNA, 64 nt, hsa
gcuuuaaguaccuuaaagcuucuccugugaacuucuuagggaaauguuagguucagaacuaaag

SEQ ID NO: 726354 - RNA, 64 nt, hsa
uaaaaagcaaguguaguauuccauuacuauguggcuuagggauuuauuuguuuuuuaaaaucaa

SEQ ID NO: 726355 - RNA, 64 nt, hsa
gcuucuguugagauaaucuucauuagguauauaucuuagggauacagccuuuucuuuaucuuau

SEQ ID NO: 726356 - RNA, 64 nt, hsa
uuucuuauuucuguguuacugaggacccuaaucacuuagggauguaauuuuauaguauaaacuu

SEQ ID NO: 726357 - RNA, 64 nt, hsa
acauuaggagcucugcuuggaaaacaguucacuacuuagggauuuuuguuuccuaaaacuuuua

SEQ ID NO: 726358 - RNA, 64 nt, hsa
ggcuugaacauaaaugaaaauauccuguuauuuucuuagggauacuugguuaguaaauuauaau

SEQ ID NO: 726359 - RNA, 64 nt, hsa
cuguuuugaggugucaaauacaaauaaaucugggcuuagggaaggagagaccuuauuccaaagc

SEQ ID NO: 726360 - RNA, 64 nt, hsa
ccuuacucuaagcuaaaucuaggugagguuuccccuuagggagcccagcuauuuacaaaguaca

SEQ ID NO: 726361 - RNA, 64 nt, hsa
cuccuggauuuagacucauggaauaugagaaaggcuuagggaaaauucaagucauggggagauu

SEQ ID NO: 726362 - RNA, 64 nt, hsa
cuugcacauggauugauuaaaagcaaauaccugucuuagggaauucugacaauuuaucuuccau

SEQ ID NO: 726363 - RNA, 64 nt, hsa
guacauuaacugagugaugcgcaacuuccucucucuuagggaauuagaccaucagaggccuuga

SEQ ID NO: 726364 - RNA, 64 nt, hsa
uaauaccaugugaacaccagucuauuuugguaugcuuagggaguaccucuaaagacagauuaau

SEQ ID NO: 726365 - RNA, 64 nt, hsa; identical to SEQ ID NO: 38255

SEQ ID NO: 726366 - RNA, 64 nt, hsa; identical to SEQ ID NO: 38256

SEQ ID NO: 726367 - RNA, 64 nt, hsa; identical to SEQ ID NO: 38257

SEQ ID NO: 726368 - RNA, 64 nt, hsa; identical to SEQ ID NO: 38258

SEQ ID NO: 726369 - RNA, 64 nt, hsa; identical to SEQ ID NO: 38259

SEQ ID NO: 726370 - RNA, 64 nt, hsa; identical to SEQ ID NO: 38260

SEQ ID NO: 726371 - RNA, 64 nt, hsa; identical to SEQ ID NO: 38261

SEQ ID NO: 726372 - RNA, 64 nt, hsa; identical to SEQ ID NO: 38262

SEQ ID NO: 726373 - RNA, 64 nt, hsa; identical to SEQ ID NO: 38263

SEQ ID NO: 726374 - RNA, 64 nt, hsa; identical to SEQ ID NO: 38264

SEQ ID NO: 726375 - RNA, 64 nt, hsa; identical to SEQ ID NO: 38265

SEQ ID NO: 726376 - RNA, 64 nt, hsa; identical to SEQ ID NO: 38266

SEQ ID NO: 726377 - RNA, 64 nt, hsa; identical to SEQ ID NO: 38267

SEQ ID NO: 726378 - RNA, 64 nt, hsa; identical to SEQ ID NO: 38268

SEQ ID NO: 726379 - RNA, 64 nt, hsa; identical to SEQ ID NO: 38269

SEQ ID NO: 726380 - RNA, 64 nt, hsa; identical to SEQ ID NO: 38270

SEQ ID NO: 726381 - RNA, 64 nt, hsa; identical to SEQ ID NO: 38271

SEQ ID NO: 726382 - RNA, 64 nt, hsa; identical to SEQ ID NO: 38272

SEQ ID NO: 726383 - RNA, 64 nt, hsa; identical to SEQ ID NO: 38273

SEQ ID NO: 726384 - RNA, 64 nt, hsa; identical to SEQ ID NO: 38274

SEQ ID NO: 726385 - RNA, 64 nt, hsa; identical to SEQ ID NO: 38275

SEQ ID NO: 726386 - RNA, 64 nt, hsa; identical to SEQ ID NO: 38276

SEQ ID NO: 726387 - RNA, 64 nt, hsa; identical to SEQ ID NO: 38277

SEQ ID NO: 726388 - RNA, 64 nt, hsa; identical to SEQ ID NO: 38278

SEQ ID NO: 726389 - RNA, 64 nt, hsa; identical to SEQ ID NO: 38279

SEQ ID NO: 726390 - RNA, 64 nt, hsa; identical to SEQ ID NO: 38280

SEQ ID NO: 726391 - RNA, 64 nt, hsa; identical to SEQ ID NO: 38281

SEQ ID NO: 726392 - RNA, 64 nt, hsa; identical to SEQ ID NO: 38282

SEQ ID NO: 726393 - RNA, 64 nt, hsa; identical to SEQ ID NO: 38283

SEQ ID NO: 726394 - RNA, 64 nt, hsa; identical to SEQ ID NO: 38284

SEQ ID NO: 726395 - RNA, 62 nt, hsa; identical to SEQ ID NO: 38285

SEQ ID NO: 726396 - RNA, 64 nt, hsa; identical to SEQ ID NO: 38286

SEQ ID NO: 726397 - RNA, 64 nt, hsa; identical to SEQ ID NO: 38287

SEQ ID NO: 726398 - RNA, 64 nt, hsa; identical to SEQ ID NO: 38288

SEQ ID NO: 726399 - RNA, 64 nt, hsa; identical to SEQ ID NO: 38289

SEQ ID NO: 726400 - RNA, 64 nt, hsa; identical to SEQ ID NO: 38290

SEQ ID NO: 726401 - RNA, 64 nt, hsa; identical to SEQ ID NO: 38291

SEQ ID NO: 726402 - RNA, 64 nt, hsa; identical to SEQ ID NO: 38292

SEQ ID NO: 726403 - RNA, 64 nt, hsa; identical to SEQ ID NO: 38293

SEQ ID NO: 726404 - RNA, 64 nt, hsa; identical to SEQ ID NO: 38294

SEQ ID NO: 726405 - RNA, 64 nt, hsa; identical to SEQ ID NO: 38295

SEQ ID NO: 726406 - RNA, 64 nt, hsa; identical to SEQ ID NO: 38296

SEQ ID NO: 726407 - RNA, 64 nt, hsa; identical to SEQ ID NO: 38297

SEQ ID NO: 726408 - RNA, 64 nt, hsa; identical to SEQ ID NO: 38298

SEQ ID NO: 726409 - RNA, 64 nt, hsa; identical to SEQ ID NO: 38299

SEQ ID NO: 726410 - RNA, 64 nt, hsa; identical to SEQ ID NO: 38300

SEQ ID NO: 726411 - RNA, 64 nt, hsa; identical to SEQ ID NO: 38301

SEQ ID NO: 726412 - RNA, 64 nt, hsa; identical to SEQ ID NO: 38302

SEQ ID NO: 726413 - RNA, 64 nt, hsa; identical to SEQ ID NO: 38303

SEQ ID NO: 726414 - RNA, 64 nt, hsa; identical to SEQ ID NO: 38304

SEQ ID NO: 726415 - RNA, 64 nt, hsa; identical to SEQ ID NO: 38305

SEQ ID NO: 726416 - RNA, 64 nt, hsa; identical to SEQ ID NO: 38306

SEQ ID NO: 726417 - RNA, 64 nt, hsa; identical to SEQ ID NO: 38307

SEQ ID NO: 726418 - RNA, 64 nt, hsa; identical to SEQ ID NO: 38308

SEQ ID NO: 726419 - RNA, 64 nt, hsa; identical to SEQ ID NO: 38309

SEQ ID NO: 726420 - RNA, 64 nt, hsa; identical to SEQ ID NO: 38310

SEQ ID NO: 726421 - RNA, 64 nt, hsa; identical to SEQ ID NO: 38311

SEQ ID NO: 726422 - RNA, 64 nt, hsa; identical to SEQ ID NO: 38312

SEQ ID NO: 726423 - RNA, 64 nt, hsa; identical to SEQ ID NO: 38313

SEQ ID NO: 726424 - RNA, 64 nt, hsa; identical to SEQ ID NO: 38314

SEQ ID NO: 726425 - RNA, 64 nt, hsa; identical to SEQ ID NO: 38315

SEQ ID NO: 726426 - RNA, 64 nt, hsa; identical to SEQ ID NO: 38316

SEQ ID NO: 726427 - RNA, 64 nt, hsa; identical to SEQ ID NO: 38317

SEQ ID NO: 726428 - RNA, 64 nt, hsa; identical to SEQ ID NO: 38318

SEQ ID NO: 726429 - RNA, 64 nt, hsa
agugucccaccuccuucaccaccccacuuggcuccuuugccaucuugaugcugagguuuccugu

SEQ ID NO: 726430 - RNA, 64 nt, hsa
uuugugguaaaagaaaggaaagggcuucugauggcuuugccacaagcuuaccuguggguuucag

SEQ ID NO: 726431 - RNA, 64 nt, hsa
guggguccauagacuuuuuaaugaagauuucugacuuugccacuguaaaugccuuuaaugagca

SEQ ID NO: 726432 - RNA, 64 nt, hsa
aagcuagaaccaggaugcuuccuuauuggaaaggcuuugccaguccuuaagguacaaugaguga

SEQ ID NO: 726433 - RNA, 64 nt, hsa
caacuaauuccacuaggcaugggaaugucaccuccuuugccacuguaccccaucaagcuuacuc

SEQ ID NO: 726434 - RNA, 64 nt, hsa
ccuuaugaggcuuagcccuugucuuacugccagccuuugccacaggcaggugagaaaggcaggg

SEQ ID NO: 726435 - RNA, 64 nt, hsa
agcacagccuuccugaaaugcccucaccccaugccuuugccauugugugcucucagauuucuuc

SEQ ID NO: 726436 - RNA, 64 nt, hsa
cggcuggggacaauggccacuuacuaccugugcacuuugccacucgggacaccuggaugguuuc

SEQ ID NO: 726437 - RNA, 64 nt, hsa
uuuaucacuguuuaaagcuuugaauaucugcaaucuuugccaagguacuuuuuuauuuaaaaaa

SEQ ID NO: 726438 - RNA, 64 nt, hsa
agauaucuaugaaaaccaguggcuuccaucaaaccuuugccaacucagguucacagcagcuuug

SEQ ID NO: 726439 - RNA, 64 nt, hsa
uuuccaugugcauuaaauacuuugccagcacugccuuugccagcauccuaaaucuggaguuuua

SEQ ID NO: 726440 - RNA, 64 nt, hsa
caaaauagaauagcauuuccaugugcauuaaauacuuugccagcacugccuuugccagcauccu

SEQ ID NO: 726441 - RNA, 64 nt, hsa
uauuuucccaaacacuacaaaaaaacuuuuaaaacuuugccauuucaucuguuuacacucuuug

SEQ ID NO: 726442 - RNA, 64 nt, hsa
cuuuuaaaacuuugccauuucaucuguuuacacucuuugccacugauuagcaguauuuaaaucu

SEQ ID NO: 726443 - RNA, 64 nt, hsa
cacuauuuggggggauguaaauuuugcccacagacuuugccacccaggugaggugcuguguuca

SEQ ID NO: 726444 - RNA, 64 nt, hsa
uugacacucuugggccacucugauuggcagccugcuuugccaaagagaacugugugagguuuug

SEQ ID NO: 726445 - RNA, 64 nt, hsa
ccucauccccacaaucuggcuuagugccacccaccuuugccacaaagcuaggaugguucuguga

SEQ ID NO: 726446 - RNA, 64 nt, hsa
caguugccgucuaggauugggccucccauaauugcuuugccaaaauaccagagccuucaagugc

SEQ ID NO: 726447 - RNA, 64 nt, hsa
guagauguugcacaccagccuuacagcugggagccuuugccaugguacuuagguagggugugug

SEQ ID NO: 726448 - RNA, 64 nt, hsa
uauuacacaugggcauauucugauguuucucauccuuugccagaagacuaccuuacauccaucg

SEQ ID NO: 726449 - RNA, 64 nt, hsa
aauuaaaaaagaaagaaauuugaaaaaacuuucucuuugccauuucuucuucuucuuuuuuaac

SEQ ID NO: 726450 - RNA, 64 nt, hsa
uuugcccaaaucuucuucagauucagcauuuguucuuugccagucucauuuucaucuucuucca

SEQ ID NO: 726451 - RNA, 64 nt, hsa
aaauauauuuaguguuuugccagaaucucucuugcuuugccauuaagcagaagaacuaguuucc

SEQ ID NO: 726452 - RNA, 64 nt, hsa
ucaucagggccugugaauacccaggugccuguaucuuugccaagaccgugaucaagguagcuua

SEQ ID NO: 726453 - RNA, 64 nt, hsa
uguucuuuucccguaucaauucauuccuucaucucuuugccaaguuguuuuccuuucagggccu

SEQ ID NO: 726454 - RNA, 64 nt, hsa
gguuaugauuuugaaggcuguggguucagggagucuuugccaauccuguuggcccuaaacuauc

SEQ ID NO: 726455 - RNA, 64 nt, hsa
ggaguacuucagggguggccucuggccccagagccuuugccacagugcucccaccagcccccac

SEQ ID NO: 726456 - RNA, 64 nt, hsa
auuccccugagagaauucccucacucacggcucccuuugccagagucaguucaaucaggucuga

SEQ ID NO: 726457 - RNA, 64 nt, hsa
ucaaagaagccugguggcaauaaggaucuucccacuuugccacuggaugacuuuggauggguca

SEQ ID NO: 726458 - RNA, 64 nt, hsa
cccaaacccacccauaccagcuagaaucacuugacuuugccacauccauugacugacccccucc

SEQ ID NO: 726459 - RNA, 64 nt, hsa
accuuuuuuuucacauuuuacauaaauaauaaugcuuugccagcaguacgugguagccacaauu

SEQ ID NO: 726460 - RNA, 64 nt, hsa
aauucagagaaaucaucugauguuucuauagucacuuugccagcucaaaagaaaacaauacccu

SEQ ID NO: 726461 - RNA, 64 nt, hsa
acacccuucucagauggccacgauguaggcuccacuuugccaacuucccgagaacaaacaggcc

SEQ ID NO: 726462 - RNA, 64 nt, hsa
gugucaccugcuguggcaaaauggguuuagaaaucuuugccaggucauggcccacuggauucug

SEQ ID NO: 726463 - RNA, 64 nt, hsa
cugugagugacaugggccucuggagaaugcaagucuuugccauggcacggcuccguuucuuaaa

SEQ ID NO: 726464 - RNA, 64 nt, hsa
uuaaaaacagaaaacaaagaaaagcuuguauauacuuugccacuggaaaggacaaauacauuuc

SEQ ID NO: 726465 - RNA, 64 nt, hsa
augcugugugcuagccagggccagcugguaccuucuuugccaugagcauucaagggacggcuaa

SEQ ID NO: 726466 - RNA, 64 nt, hsa
uugcagugguuguguuuugcauaaaaugucuagucuuugccacagauagugagcuacccacuaa

SEQ ID NO: 726467 - RNA, 64 nt, hsa
caauuugugaguauuaaugucaguacuaccagcacuuugccaaaacugucagagggacccguuu

SEQ ID NO: 726468 - RNA, 64 nt, hsa
ugagugguuccuucaagcugggugucuuuccagccuuugccagucuagccccagcagggcaccg

SEQ ID NO: 726469 - RNA, 64 nt, hsa
cucugucuccccauguccucuggaacagcugggcaugggucauggccauucaugacccuuaagu

SEQ ID NO: 726470 - RNA, 64 nt, hsa
caggcaccagagcagggacugagaaaccccaaggaugggucaucuaagugcuguccauaugaac

SEQ ID NO: 726471 - RNA, 64 nt, hsa
caguuuagagcaaacugucacuaaacuuggauaaaugggucagaaaguacagauuuaauaaagu

SEQ ID NO: 726472 - RNA, 64 nt, hsa
auaagacauugccaucucuauuuaacucauccauaugggucaaucaacugauuagaaaaucaaa

SEQ ID NO: 726473 - RNA, 64 nt, hsa
gcuacaggccucucacaaccuucagcaugccagcaugggucaggccucuucacagggccaagaa

SEQ ID NO: 726474 - RNA, 64 nt, hsa
ggcuuucugcacugaaaguggaagcagaaggcuaaugggucacauuguguaaaggucucuggug

SEQ ID NO: 726475 - RNA, 64 nt, hsa
ggaggugacggagcaucguggcacggcagucucaaugggucagaaacccaggccagcugggcuc

SEQ ID NO: 726476 - RNA, 64 nt, hsa
cauugcucaaaucguuaggguugcuucuauaaaaaugggucaguagcccuuccuguucucucca

SEQ ID NO: 726477 - RNA, 64 nt, hsa
gugcuggacuucuaauauauagaacugugagauaaugggucacauuggcuggaugugguggcuc

SEQ ID NO: 726478 - RNA, 64 nt, hsa
agugagacuccaucauaaauaaauaaauaaauaaaugggucacauuaagccuuuaaguuugugg

SEQ ID NO: 726479 - RNA, 64 nt, hsa; identical to SEQ ID NO: 56583

SEQ ID NO: 726480 - RNA, 64 nt, hsa; identical to SEQ ID NO: 56584

SEQ ID NO: 726481 - RNA, 64 nt, hsa; identical to SEQ ID NO: 56585

SEQ ID NO: 726482 - RNA, 64 nt, hsa; identical to SEQ ID NO: 56586

SEQ ID NO: 726483 - RNA, 64 nt, hsa; identical to SEQ ID NO: 56587

SEQ ID NO: 726484 - RNA, 64 nt, hsa; identical to SEQ ID NO: 56588

SEQ ID NO: 726485 - RNA, 64 nt, hsa; identical to SEQ ID NO: 56589

SEQ ID NO: 726486 - RNA, 64 nt, hsa; identical to SEQ ID NO: 56590

SEQ ID NO: 726487 - RNA, 64 nt, hsa; identical to SEQ ID NO: 56591

SEQ ID NO: 726488 - RNA, 64 nt, hsa; identical to SEQ ID NO: 56592

SEQ ID NO: 726489 - RNA, 64 nt, hsa; identical to SEQ ID NO: 56593

SEQ ID NO: 726490 - RNA, 64 nt, hsa; identical to SEQ ID NO: 56594

SEQ ID NO: 726491 - RNA, 64 nt, hsa; identical to SEQ ID NO: 56595

SEQ ID NO: 726492 - RNA, 64 nt, hsa; identical to SEQ ID NO: 56596

SEQ ID NO: 726493 - RNA, 64 nt, hsa; identical to SEQ ID NO: 56597

SEQ ID NO: 726494 - RNA, 64 nt, hsa; identical to SEQ ID NO: 56598

SEQ ID NO: 726495 - RNA, 64 nt, hsa; identical to SEQ ID NO: 296072

SEQ ID NO: 726496 - RNA, 64 nt, hsa; identical to SEQ ID NO: 296072

SEQ ID NO: 726497 - RNA, 64 nt, hsa; identical to SEQ ID NO: 296074

SEQ ID NO: 726498 - RNA, 64 nt, hsa; identical to SEQ ID NO: 296075

SEQ ID NO: 726499 - RNA, 64 nt, hsa; identical to SEQ ID NO: 296076

SEQ ID NO: 726500 - RNA, 64 nt, hsa; identical to SEQ ID NO: 296077

SEQ ID NO: 726501 - RNA, 64 nt, hsa; identical to SEQ ID NO: 291116

SEQ ID NO: 726502 - RNA, 64 nt, hsa; identical to SEQ ID NO: 291117

SEQ ID NO: 726503 - RNA, 64 nt, hsa; identical to SEQ ID NO: 291118

SEQ ID NO: 726504 - RNA, 64 nt, hsa; identical to SEQ ID NO: 291119

SEQ ID NO: 726505 - RNA, 62 nt, hsa; identical to SEQ ID NO: 291120

SEQ ID NO: 726506 - RNA, 64 nt, hsa; identical to SEQ ID NO: 291121

SEQ ID NO: 726507 - RNA, 64 nt, hsa; identical to SEQ ID NO: 291122

SEQ ID NO: 726508 - RNA, 64 nt, hsa; identical to SEQ ID NO: 291123

SEQ ID NO: 726509 - RNA, 64 nt, hsa; identical to SEQ ID NO: 291124

SEQ ID NO: 726510 - RNA, 64 nt, hsa; identical to SEQ ID NO: 291125

SEQ ID NO: 726511 - RNA, 64 nt, hsa; identical to SEQ ID NO: 291126

SEQ ID NO: 726512 - RNA, 64 nt, hsa; identical to SEQ ID NO: 291127

SEQ ID NO: 726513 - RNA, 64 nt, hsa; identical to SEQ ID NO: 291128

SEQ ID NO: 726514 - RNA, 64 nt, hsa; identical to SEQ ID NO: 291129

SEQ ID NO: 726515 - RNA, 64 nt, hsa; identical to SEQ ID NO: 291130

SEQ ID NO: 726516 - RNA, 64 nt, hsa; identical to SEQ ID NO: 291131

SEQ ID NO: 726517 - RNA, 64 nt, hsa; identical to SEQ ID NO: 291132

SEQ ID NO: 726518 - RNA, 64 nt, hsa; identical to SEQ ID NO: 291133

SEQ ID NO: 726519 - RNA, 64 nt, hsa; identical to SEQ ID NO: 291134

SEQ ID NO: 726520 - RNA, 64 nt, hsa; identical to SEQ ID NO: 291135

SEQ ID NO: 726521 - RNA, 64 nt, hsa; identical to SEQ ID NO: 291136

SEQ ID NO: 726522 - RNA, 64 nt, hsa; identical to SEQ ID NO: 291137

SEQ ID NO: 726523 - RNA, 64 nt, hsa; identical to SEQ ID NO: 291138

SEQ ID NO: 726524 - RNA, 64 nt, hsa; identical to SEQ ID NO: 291139

SEQ ID NO: 726525 - RNA, 64 nt, hsa; identical to SEQ ID NO: 291140

SEQ ID NO: 726526 - RNA, 64 nt, hsa; identical to SEQ ID NO: 291141

SEQ ID NO: 726527 - RNA, 64 nt, hsa; identical to SEQ ID NO: 291142

SEQ ID NO: 726528 - RNA, 64 nt, hsa; identical to SEQ ID NO: 291143

SEQ ID NO: 726529 - RNA, 64 nt, hsa; identical to SEQ ID NO: 291144

SEQ ID NO: 726530 - RNA, 64 nt, hsa; identical to SEQ ID NO: 291145

SEQ ID NO: 726531 - RNA, 64 nt, hsa; identical to SEQ ID NO: 291146

SEQ ID NO: 726532 - RNA, 64 nt, hsa; identical to SEQ ID NO: 291147

SEQ ID NO: 726533 - RNA, 64 nt, hsa; identical to SEQ ID NO: 291148

SEQ ID NO: 726534 - RNA, 64 nt, hsa; identical to SEQ ID NO: 291149

SEQ ID NO: 726535 - RNA, 64 nt, hsa
ccccauuuagauacacuacuguauuagugagaauacuugguacaguaacuugaaagcacuugcu

SEQ ID NO: 726536 - RNA, 64 nt, hsa
uaugcaguuaaaucuguaucaguggacuuuuaaaacuugguacuacuacuaaaucuacuauauc

SEQ ID NO: 726537 - RNA, 64 nt, hsa
aggcauacucagccagaaaucugaguuuugugagacuugguaauacagagauggacaaucguac

SEQ ID NO: 726538 - RNA, 64 nt, hsa
ggaaaauguuaucagugaauaggugguguacuuuacuugguauaauuuaaaguugcacaguaag

SEQ ID NO: 726539 - RNA, 64 nt, hsa
gaacagugaaguggcuugauugcuuaaacuauugacuugguaagucuacuguauauaacaucua

SEQ ID NO: 726540 - RNA, 64 nt, hsa; identical to SEQ ID NO: 726539

SEQ ID NO: 726541 - RNA, 64 nt, hsa
uuaaauguuuuuaucuuacucuuucuguacagauauaucaaaucacaugaaauauuuaaaguuu

SEQ ID NO: 726542 - RNA, 64 nt, hsa
auuaauauucugggucugaucugucagagaauaaauaucaaaucuaaauuuaauguagagauac

SEQ ID NO: 726543 - RNA, 64 nt, hsa
agaaaauggugggauuuuuuuuuaucaugauuaaauaucaaaaaauugcccuaugaaaacuuua

SEQ ID NO: 726544 - RNA, 64 nt, hsa
gaaauauccuaagguaacuuggaagcuguguaguauaucaaauuaauuugcuaccuaauaacau

SEQ ID NO: 726545 - RNA, 64 nt, hsa
guggucuuuuuaaaaaauuguaacccucuagaaaauaucaaagaaaugaaccagacgugguuua

SEQ ID NO: 726546 - RNA, 64 nt, hsa
aacugaaucauuuuuuaacuuaaaaagcuggaaaauaucaaaugcuguuuuuuuuuuuucauug

SEQ ID NO: 726547 - RNA, 64 nt, hsa
agaauacuuuaugauuuagaccaauauucuagaaauaucaaaugucaguaucuugaaaucaucu

SEQ ID NO: 726548 - RNA, 64 nt, hsa
auuaagguauuuuaguaugcaauuuacugccauaauaucaaaggucaguaacaguguucuuucu

SEQ ID NO: 726549 - RNA, 64 nt, hsa
uagugaacaggccuguuuuaaauaucuuaguaugauaucaaaagaauaaucaauuuaguuaccu

SEQ ID NO: 726550 - RNA, 64 nt, hsa
gaggcauuucuguuguuaucucugaaacauuuuuauaucaaaaaucagauugcugguaggugug

SEQ ID NO: 726551 - RNA, 64 nt, hsa
uugugaaaaaaauauuaaagugauuugcucucaaauaucaaauuuucuucucucuuuuauauua

SEQ ID NO: 726552 - RNA, 64 nt, hsa
guggaaauaaaaacuaagguaacuucucagaaagauaucaaaucucagaaagaaugucaaauca

SEQ ID NO: 726553 - RNA, 64 nt, hsa
guaaauaaccucagcugggaugaggagugacagaauaucaaaauaauuuguggcuguggauuuu

SEQ ID NO: 726554 - RNA, 64 nt, hsa
gaggugguauugugggguaauugcuuaaauuuacauaucaaaguaaaaaaguagugccuguauu

SEQ ID NO: 726555 - RNA, 64 nt, hsa
uuauuggccauaauugcuacucuucauacacaguauaucaaagagcuugauaauuuaguuguca

SEQ ID NO: 726556 - RNA, 64 nt, hsa
aacacagcaguuuuccuugcuuuuuauaugcagaauaucaaagucauuucuaauuuaguuguca

SEQ ID NO: 726557 - RNA, 64 nt, hsa
ggcuguagauguuggaggcuagggaggcuaguaaauaucaaaaggaaaagggagugggaauugc

SEQ ID NO: 726558 - RNA, 64 nt, hsa
aaggaaaagggagugggaauugcuaucauguaaaauaucaaaguuaaaauacuaaggugcauuu

SEQ ID NO: 726559 - RNA, 64 nt, hsa
acuuaguaaguaauaucaaagcauuuuauaaaugauaucaaagaagagucaacauugauccagu

SEQ ID NO: 726560 - RNA, 64 nt, hsa
accuuguuugaguuaucagggaacuuaguaaguaauaucaaagcauuuuauaaaugauaucaaa

SEQ ID NO: 726561 - RNA, 64 nt, hsa
uuaaucuuccucuagcaggcaugcaguccaaggaauaucaaaauucugguuguauugggaacca

SEQ ID NO: 726562 - RNA, 64 nt, hsa
uuaauuuuccucuagcaggcaugcaguccaaggaauaucaaaauucugauuguaugggaaccaa

SEQ ID NO: 726563 - RNA, 64 nt, hsa; identical to SEQ ID NO: 723868

SEQ ID NO: 726564 - RNA, 64 nt, hsa; identical to SEQ ID NO: 723869

SEQ ID NO: 726565 - RNA, 64 nt, hsa; identical to SEQ ID NO: 723870

SEQ ID NO: 726566 - RNA, 64 nt, hsa; identical to SEQ ID NO: 723871

SEQ ID NO: 726567 - RNA, 64 nt, hsa; identical to SEQ ID NO: 723872

SEQ ID NO: 726568 - RNA, 64 nt, hsa; identical to SEQ ID NO: 723873

SEQ ID NO: 726569 - RNA, 64 nt, hsa; identical to SEQ ID NO: 723874

SEQ ID NO: 726570 - RNA, 64 nt, hsa; identical to SEQ ID NO: 723875

SEQ ID NO: 726571 - RNA, 64 nt, hsa; identical to SEQ ID NO: 723876

SEQ ID NO: 726572 - RNA, 64 nt, hsa; identical to SEQ ID NO: 723877

SEQ ID NO: 726573 - RNA, 64 nt, hsa; identical to SEQ ID NO: 723878

SEQ ID NO: 726574 - RNA, 64 nt, hsa; identical to SEQ ID NO: 723879

SEQ ID NO: 726575 - RNA, 64 nt, hsa; identical to SEQ ID NO: 723880

SEQ ID NO: 726576 - RNA, 64 nt, hsa; identical to SEQ ID NO: 723881

SEQ ID NO: 726577 - RNA, 64 nt, hsa; identical to SEQ ID NO: 723882

SEQ ID NO: 726578 - RNA, 64 nt, hsa; identical to SEQ ID NO: 723883

SEQ ID NO: 726579 - RNA, 64 nt, hsa; identical to SEQ ID NO: 582838

SEQ ID NO: 726580 - RNA, 64 nt, hsa; identical to SEQ ID NO: 582839

SEQ ID NO: 726581 - RNA, 64 nt, hsa; identical to SEQ ID NO: 582840

SEQ ID NO: 726582 - RNA, 64 nt, hsa; identical to SEQ ID NO: 582841

SEQ ID NO: 726583 - RNA, 64 nt, hsa; identical to SEQ ID NO: 582842

SEQ ID NO: 726584 - RNA, 64 nt, hsa; identical to SEQ ID NO: 582843

SEQ ID NO: 726585 - RNA, 64 nt, hsa; identical to SEQ ID NO: 582844

SEQ ID NO: 726586 - RNA, 64 nt, hsa; identical to SEQ ID NO: 582845

SEQ ID NO: 726587 - RNA, 64 nt, hsa; identical to SEQ ID NO: 582846

SEQ ID NO: 726588 - RNA, 64 nt, hsa; identical to SEQ ID NO: 582847

SEQ ID NO: 726589 - RNA, 64 nt, hsa; identical to SEQ ID NO: 582848

SEQ ID NO: 726590 - RNA, 64 nt, hsa; identical to SEQ ID NO: 582849

SEQ ID NO: 726591 - RNA, 64 nt, hsa; identical to SEQ ID NO: 582850

SEQ ID NO: 726592 - RNA, 64 nt, hsa; identical to SEQ ID NO: 582851

SEQ ID NO: 726593 - RNA, 64 nt, hsa; identical to SEQ ID NO: 582852

SEQ ID NO: 726594 - RNA, 64 nt, hsa; identical to SEQ ID NO: 362209

SEQ ID NO: 726595 - RNA, 64 nt, hsa; identical to SEQ ID NO: 362210

SEQ ID NO: 726596 - RNA, 64 nt, hsa; identical to SEQ ID NO: 362211

SEQ ID NO: 726597 - RNA, 64 nt, hsa; identical to SEQ ID NO: 362212

SEQ ID NO: 726598 - RNA, 64 nt, hsa; identical to SEQ ID NO: 362213

SEQ ID NO: 726599 - RNA, 64 nt, hsa; identical to SEQ ID NO: 362214

SEQ ID NO: 726600 - RNA, 64 nt, hsa; identical to SEQ ID NO: 362215

SEQ ID NO: 726601 - RNA, 64 nt, hsa; identical to SEQ ID NO: 362216

SEQ ID NO: 726602 - RNA, 64 nt, hsa; identical to SEQ ID NO: 362217

SEQ ID NO: 726603 - RNA, 64 nt, hsa; identical to SEQ ID NO: 362218

SEQ ID NO: 726604 - RNA, 64 nt, hsa; identical to SEQ ID NO: 235742

SEQ ID NO: 726605 - RNA, 64 nt, hsa; identical to SEQ ID NO: 235743

SEQ ID NO: 726606 - RNA, 64 nt, hsa; identical to SEQ ID NO: 235744

SEQ ID NO: 726607 - RNA, 64 nt, hsa; identical to SEQ ID NO: 235745

SEQ ID NO: 726608 - RNA, 64 nt, hsa; identical to SEQ ID NO: 160193

SEQ ID NO: 726609 - RNA, 64 nt, hsa; identical to SEQ ID NO: 160194

SEQ ID NO: 726610 - RNA, 64 nt, hsa; identical to SEQ ID NO: 160195

SEQ ID NO: 726611 - RNA, 64 nt, hsa; identical to SEQ ID NO: 160196

SEQ ID NO: 726612 - RNA, 64 nt, hsa; identical to SEQ ID NO: 160197

SEQ ID NO: 726613 - RNA, 64 nt, hsa; identical to SEQ ID NO: 160198

SEQ ID NO: 726614 - RNA, 59 nt, hsa; identical to SEQ ID NO: 160199

SEQ ID NO: 726615 - RNA, 64 nt, hsa; identical to SEQ ID NO: 160200

SEQ ID NO: 726616 - RNA, 64 nt, hsa; identical to SEQ ID NO: 160201

SEQ ID NO: 726617 - RNA, 64 nt, hsa; identical to SEQ ID NO: 160202

SEQ ID NO: 726618 - RNA, 64 nt, hsa; identical to SEQ ID NO: 160203

SEQ ID NO: 726619 - RNA, 64 nt, hsa; identical to SEQ ID NO: 160204

SEQ ID NO: 726620 - RNA, 64 nt, hsa; identical to SEQ ID NO: 160205

SEQ ID NO: 726621 - RNA, 64 nt, hsa; identical to SEQ ID NO: 160206

SEQ ID NO: 726622 - RNA, 64 nt, hsa; identical to SEQ ID NO: 160207

SEQ ID NO: 726623 - RNA, 64 nt, hsa; identical to SEQ ID NO: 160208

SEQ ID NO: 726624 - RNA, 64 nt, hsa; identical to SEQ ID NO: 160209

SEQ ID NO: 726625 - RNA, 64 nt, hsa; identical to SEQ ID NO: 160210

SEQ ID NO: 726626 - RNA, 64 nt, hsa; identical to SEQ ID NO: 160211

SEQ ID NO: 726627 - RNA, 64 nt, hsa; identical to SEQ ID NO: 160212

SEQ ID NO: 726628 - RNA, 64 nt, hsa; identical to SEQ ID NO: 160213

SEQ ID NO: 726629 - RNA, 64 nt, hsa; identical to SEQ ID NO: 160214

SEQ ID NO: 726630 - RNA, 64 nt, hsa; identical to SEQ ID NO: 160215

SEQ ID NO: 726631 - RNA, 64 nt, hsa; identical to SEQ ID NO: 160216

SEQ ID NO: 726632 - RNA, 64 nt, hsa; identical to SEQ ID NO: 160217

SEQ ID NO: 726633 - RNA, 64 nt, hsa; identical to SEQ ID NO: 160218

SEQ ID NO: 726634 - RNA, 64 nt, hsa; identical to SEQ ID NO: 160219

SEQ ID NO: 726635 - RNA, 64 nt, hsa; identical to SEQ ID NO: 160220

SEQ ID NO: 726636 - RNA, 64 nt, hsa; identical to SEQ ID NO: 160221

SEQ ID NO: 726637 - RNA, 64 nt, hsa; identical to SEQ ID NO: 160222

SEQ ID NO: 726638 - RNA, 64 nt, hsa; identical to SEQ ID NO: 160223

SEQ ID NO: 726639 - RNA, 64 nt, hsa; identical to SEQ ID NO: 160224

SEQ ID NO: 726640 - RNA, 64 nt, hsa; identical to SEQ ID NO: 160225

SEQ ID NO: 726641 - RNA, 64 nt, hsa; identical to SEQ ID NO: 160226

SEQ ID NO: 726642 - RNA, 64 nt, hsa; identical to SEQ ID NO: 160227

SEQ ID NO: 726643 - RNA, 64 nt, hsa; identical to SEQ ID NO: 160228

SEQ ID NO: 726644 - RNA, 64 nt, hsa; identical to SEQ ID NO: 160229

SEQ ID NO: 726645 - RNA, 64 nt, hsa; identical to SEQ ID NO: 160230

SEQ ID NO: 726646 - RNA, 64 nt, hsa; identical to SEQ ID NO: 160231

SEQ ID NO: 726647 - RNA, 64 nt, hsa; identical to SEQ ID NO: 160232

SEQ ID NO: 726648 - RNA, 64 nt, hsa; identical to SEQ ID NO: 160233

SEQ ID NO: 726649 - RNA, 64 nt, hsa; identical to SEQ ID NO: 160234

SEQ ID NO: 726650 - RNA, 64 nt, hsa; identical to SEQ ID NO: 160235

SEQ ID NO: 726651 - RNA, 64 nt, hsa; identical to SEQ ID NO: 160236

SEQ ID NO: 726652 - RNA, 64 nt, hsa
uccccauguucauagcugccuuucuuaccauuuugguuugaagggcagucuucucuggcuuguu

SEQ ID NO: 726653 - RNA, 64 nt, hsa
uggcuucugcuaagugagaugggaaccacuggaggguuugaacagaggagugccuugauugauu

SEQ ID NO: 726654 - RNA, 64 nt, hsa
ucuuuccaauaaaaaugagcccuauguagcacuagguuugaauucuaaaauucaaaacaggcau

SEQ ID NO: 726655 - RNA, 64 nt, hsa
cauuuuuguccauuuguguuucagaaucagcacagguuugaagauuagacuguuagucaucugu

SEQ ID NO: 726656 - RNA, 64 nt, hsa
cugugaggcagcucuggaacgugaagagcuguuugguuugaaccgugaacaaaacuguguuuug

SEQ ID NO: 726657 - RNA, 64 nt, hsa
aauugcuuaggagaaaccauugucucugacugcagguuugaauaaguugaagaccagagaaaag

SEQ ID NO: 726658 - RNA, 64 nt, hsa
ucauugucaucaauaucuacagaagcucuuugacgguuugaauacuauggcucaagguuuucau

SEQ ID NO: 726659 - RNA, 64 nt, hsa
auuuucugauguggagauauguuauuaaugaagugguuugaaaauuuguuauauuaaaagugca

SEQ ID NO: 726660 - RNA, 64 nt, hsa
gguugggugggaggaggaagaaagggaagaauuagguuugaauugcuuuuuuaaaaaaaaagaa

SEQ ID NO: 726661 - RNA, 64 nt, hsa
gguugggugggaggaggaagaaagggaagaauuagguuugaauugcuuuuuaaaaaaaaaagaa

SEQ ID NO: 726662 - RNA, 64 nt, hsa
aaugguauuuucacuuuucuuuguaacauugaaugguuugaaguacucaaaaucuguuacgcua

SEQ ID NO: 726663 - RNA, 64 nt, hsa
ccucuguugcuuuaguauuuauuacaauaaaaaggguuugaaauauagcuguucuuuaugcaua

SEQ ID NO: 726664 - RNA, 64 nt, hsa
cuaguugcauuaguacugucuuucuguggaguuugguuugaagacuggcucagcaaguggaggu

SEQ ID NO: 726665 - RNA, 64 nt, hsa
ugaaugccggggagaaaccuguccaauuuuagcagguuugaagggaggaucuucuucaguugua

SEQ ID NO: 726666 - RNA, 64 nt, hsa
cacacacuggggauagauaagcuaccugguaaaggguuugaacauuuacaaaaugucacacuuu

SEQ ID NO: 726667 - RNA, 64 nt, hsa
ugucacacuuuuucuuaaaagaaaaauauuuugggguuugaauaaaauggaccaccauuucuca

SEQ ID NO: 726668 - RNA, 64 nt, hsa
caagcuauucuccugccucagccuucugaguagcugcgacuaugggcgugugccaccaugccca

SEQ ID NO: 726669 - RNA, 64 nt, hsa
ucacauguacaaaucacuucuaggccucaguuucugcgacuaugaaaauuacuagauugcacua

SEQ ID NO: 726670 - RNA, 64 nt, hsa
uacaaagauucucuauguaucaaauguaacuuacugcgacuaaacuuaauuuaauauuuacucu

SEQ ID NO: 726671 - RNA, 64 nt, hsa
auaaccuguaccuauaaaucgugcaauaaccauaugcgacuauuuugccauggagaaaucugac

SEQ ID NO: 726672 - RNA, 64 nt, hsa
acagaaugguaacuaagggugcugugcccaacccugcgacuagcaaggcucgcagcaagagcac

SEQ ID NO: 726673 - RNA, 64 nt, hsa
agcaauuauuuauuuuaaaugugcaguuacuugaugcgacuaaaaaguagaauaaaugcaagag

SEQ ID NO: 726674 - RNA, 64 nt, hsa
gcgccagcuccggggcgaguucagcacugcggggugcgacuagggcugcgcugccagggucacu

SEQ ID NO: 726675 - RNA, 64 nt, hsa
cccacacgcccucucugggcccaccaccugcaucugcgacuagagagcacccggcccacguugg

SEQ ID NO: 726676 - RNA, 64 nt, hsa
uuuucuguuauuaauauauaauuaugcaaaugaaugcgacuauguugacaauguguauauguaa

SEQ ID NO: 726677 - RNA, 64 nt, hsa
acccuuguggggccuggacaugacgcacgcuggcugcgacuaggagcagggcugccucuucucc

SEQ ID NO: 726678 - RNA, 64 nt, hsa
uggcuguaucagccgaaccaggagaggccugggcugcgacuaaggagaaagaaaucggggguuu

SEQ ID NO: 726679 - RNA, 64 nt, hsa; identical to SEQ ID NO: 664045

SEQ ID NO: 726680 - RNA, 64 nt, hsa; identical to SEQ ID NO: 664046

SEQ ID NO: 726681 - RNA, 64 nt, hsa; identical to SEQ ID NO: 664047

SEQ ID NO: 726682 - RNA, 64 nt, hsa; identical to SEQ ID NO: 664048

SEQ ID NO: 726683 - RNA, 64 nt, hsa; identical to SEQ ID NO: 664049

SEQ ID NO: 726684 - RNA, 64 nt, hsa; identical to SEQ ID NO: 664050

SEQ ID NO: 726685 - RNA, 64 nt, hsa; identical to SEQ ID NO: 664051

SEQ ID NO: 726686 - RNA, 64 nt, hsa; identical to SEQ ID NO: 664052

SEQ ID NO: 726687 - RNA, 64 nt, hsa; identical to SEQ ID NO: 111305

SEQ ID NO: 726688 - RNA, 64 nt, hsa; identical to SEQ ID NO: 111306

SEQ ID NO: 726689 - RNA, 64 nt, hsa; identical to SEQ ID NO: 111307

SEQ ID NO: 726690 - RNA, 64 nt, hsa; identical to SEQ ID NO: 111308

SEQ ID NO: 726691 - RNA, 64 nt, hsa; identical to SEQ ID NO: 111309

SEQ ID NO: 726692 - RNA, 64 nt, hsa; identical to SEQ ID NO: 111310

SEQ ID NO: 726693 - RNA, 64 nt, hsa; identical to SEQ ID NO: 111311

SEQ ID NO: 726694 - RNA, 64 nt, hsa; identical to SEQ ID NO: 111312

SEQ ID NO: 726695 - RNA, 64 nt, hsa; identical to SEQ ID NO: 111313

SEQ ID NO: 726696 - RNA, 64 nt, hsa; identical to SEQ ID NO: 111314

SEQ ID NO: 726697 - RNA, 64 nt, hsa; identical to SEQ ID NO: 111315

SEQ ID NO: 726698 - RNA, 64 nt, hsa; identical to SEQ ID NO: 111316

SEQ ID NO: 726699 - RNA, 64 nt, hsa; identical to SEQ ID NO: 111317

SEQ ID NO: 726700 - RNA, 64 nt, hsa; identical to SEQ ID NO: 111318

SEQ ID NO: 726701 - RNA, 64 nt, hsa; identical to SEQ ID NO: 111319

SEQ ID NO: 726702 - RNA, 64 nt, hsa; identical to SEQ ID NO: 111320

SEQ ID NO: 726703 - RNA, 64 nt, hsa; identical to SEQ ID NO: 111321

SEQ ID NO: 726704 - RNA, 64 nt, hsa; identical to SEQ ID NO: 111322

SEQ ID NO: 726705 - RNA, 64 nt, hsa; identical to SEQ ID NO: 111323

SEQ ID NO: 726706 - RNA, 64 nt, hsa; identical to SEQ ID NO: 111324

SEQ ID NO: 726707 - RNA, 64 nt, hsa; identical to SEQ ID NO: 111325

SEQ ID NO: 726708 - RNA, 64 nt, hsa; identical to SEQ ID NO: 111326

SEQ ID NO: 726709 - RNA, 64 nt, hsa; identical to SEQ ID NO: 111327

SEQ ID NO: 726710 - RNA, 64 nt, hsa; identical to SEQ ID NO: 111328

SEQ ID NO: 726711 - RNA, 64 nt, hsa; identical to SEQ ID NO: 111329

SEQ ID NO: 726712 - RNA, 64 nt, hsa; identical to SEQ ID NO: 111330

SEQ ID NO: 726713 - RNA, 64 nt, hsa; identical to SEQ ID NO: 111331

SEQ ID NO: 726714 - RNA, 64 nt, hsa; identical to SEQ ID NO: 111332

SEQ ID NO: 726715 - RNA, 64 nt, hsa; identical to SEQ ID NO: 111333

SEQ ID NO: 726716 - RNA, 64 nt, hsa; identical to SEQ ID NO: 111334

SEQ ID NO: 726717 - RNA, 57 nt, hsa; identical to SEQ ID NO: 111335

SEQ ID NO: 726718 - RNA, 64 nt, hsa; identical to SEQ ID NO: 111336

SEQ ID NO: 726719 - RNA, 64 nt, hsa; identical to SEQ ID NO: 111337

SEQ ID NO: 726720 - RNA, 64 nt, hsa; identical to SEQ ID NO: 111338

SEQ ID NO: 726721 - RNA, 64 nt, hsa; identical to SEQ ID NO: 111339

SEQ ID NO: 726722 - RNA, 64 nt, hsa; identical to SEQ ID NO: 111340

SEQ ID NO: 726723 - RNA, 64 nt, hsa; identical to SEQ ID NO: 111341

SEQ ID NO: 726724 - RNA, 64 nt, hsa; identical to SEQ ID NO: 111342

SEQ ID NO: 726725 - RNA, 64 nt, hsa; identical to SEQ ID NO: 111343

SEQ ID NO: 726726 - RNA, 64 nt, hsa; identical to SEQ ID NO: 111344

SEQ ID NO: 726727 - RNA, 64 nt, hsa; identical to SEQ ID NO: 111345

SEQ ID NO: 726728 - RNA, 64 nt, hsa; identical to SEQ ID NO: 111346

SEQ ID NO: 726729 - RNA, 57 nt, hsa; identical to SEQ ID NO: 111347

SEQ ID NO: 726730 - RNA, 64 nt, hsa; identical to SEQ ID NO: 111348

SEQ ID NO: 726731 - RNA, 64 nt, hsa; identical to SEQ ID NO: 111349

SEQ ID NO: 726732 - RNA, 64 nt, hsa; identical to SEQ ID NO: 111350

SEQ ID NO: 726733 - RNA, 64 nt, hsa; identical to SEQ ID NO: 101831

SEQ ID NO: 726734 - RNA, 64 nt, hsa; identical to SEQ ID NO: 101832

SEQ ID NO: 726735 - RNA, 64 nt, hsa; identical to SEQ ID NO: 101833

SEQ ID NO: 726736 - RNA, 64 nt, hsa; identical to SEQ ID NO: 101834

SEQ ID NO: 726737 - RNA, 61 nt, hsa; identical to SEQ ID NO: 101835

SEQ ID NO: 726738 - RNA, 64 nt, hsa; identical to SEQ ID NO: 101836

SEQ ID NO: 726739 - RNA, 64 nt, hsa; identical to SEQ ID NO: 101837

SEQ ID NO: 726740 - RNA, 64 nt, hsa; identical to SEQ ID NO: 101838

SEQ ID NO: 726741 - RNA, 64 nt, hsa; identical to SEQ ID NO: 101839

SEQ ID NO: 726742 - RNA, 64 nt, hsa; identical to SEQ ID NO: 101840

SEQ ID NO: 726743 - RNA, 64 nt, hsa; identical to SEQ ID NO: 101841

SEQ ID NO: 726744 - RNA, 64 nt, hsa; identical to SEQ ID NO: 101842

SEQ ID NO: 726745 - RNA, 64 nt, hsa; identical to SEQ ID NO: 101843

SEQ ID NO: 726746 - RNA, 64 nt, hsa; identical to SEQ ID NO: 101844

SEQ ID NO: 726747 - RNA, 64 nt, hsa; identical to SEQ ID NO: 101845

SEQ ID NO: 726748 - RNA, 64 nt, hsa; identical to SEQ ID NO: 101846

SEQ ID NO: 726749 - RNA, 64 nt, hsa; identical to SEQ ID NO: 101847

SEQ ID NO: 726750 - RNA, 64 nt, hsa; identical to SEQ ID NO: 101848

SEQ ID NO: 726751 - RNA, 64 nt, hsa; identical to SEQ ID NO: 101849

SEQ ID NO: 726752 - RNA, 64 nt, hsa; identical to SEQ ID NO: 101850

SEQ ID NO: 726753 - RNA, 64 nt, hsa; identical to SEQ ID NO: 101851

SEQ ID NO: 726754 - RNA, 64 nt, hsa; identical to SEQ ID NO: 101852

SEQ ID NO: 726755 - RNA, 64 nt, hsa; identical to SEQ ID NO: 101853

SEQ ID NO: 726756 - RNA, 64 nt, hsa; identical to SEQ ID NO: 101854

SEQ ID NO: 726757 - RNA, 64 nt, hsa; identical to SEQ ID NO: 199943

SEQ ID NO: 726758 - RNA, 64 nt, hsa; identical to SEQ ID NO: 199944

SEQ ID NO: 726759 - RNA, 64 nt, hsa; identical to SEQ ID NO: 199945

SEQ ID NO: 726760 - RNA, 64 nt, hsa; identical to SEQ ID NO: 199946

SEQ ID NO: 726761 - RNA, 64 nt, hsa
uguauaauaauucaaaauuauguuaauagugcagaguuuauauguaaugcuagacauuuuucau

SEQ ID NO: 726762 - RNA, 64 nt, hsa
uuuaauuuugaaaaggcuuauuucauccuggacgaguuuauaauagguggggaaauucaggaaa

SEQ ID NO: 726763 - RNA, 64 nt, hsa
aagacagugagaguuagagguauuacaaguugcuaguuuauaaugucuuacuaaugcagaaaca

SEQ ID NO: 726764 - RNA, 64 nt, hsa
gaaagagaauauucaggcuuuauuucugguaugaaguuuauauuuuuuaaaaaaauccuauauu

SEQ ID NO: 726765 - RNA, 64 nt, hsa
gaguuuaucagacaucucuaauuuggccauguccaguuuauacaguuuacaaaauauagcagau

SEQ ID NO: 726766 - RNA, 64 nt, hsa
uuuauuaguuacuuguaaauuacuguggcuguguaguuuauaaaugucugugcacuauauuaau

SEQ ID NO: 726767 - RNA, 64 nt, hsa
aaaaguuucaggaaaaaacgaguuuguuggaguuaguuuauacuuucacauaucaccacaaaga

SEQ ID NO: 726768 - RNA, 64 nt, hsa
cuagcagaaaguaucugaagauauucaggaauaaaguuuauacuuaaaauagcuuauguuaaag

SEQ ID NO: 726769 - RNA, 64 nt, hsa
auuaguaaauuauaaaacucauguguacuacuuaaguuuauaucuuaugcuaguuuauaagaac

SEQ ID NO: 726770 - RNA, 64 nt, hsa
cucauguguacuacuuaaguuuauaucuuaugcuaguuuauaagaacaauuaaaaggacuuaga

SEQ ID NO: 726771 - RNA, 64 nt, hsa
aguuuuauaauucucuggcaguuccuuaugauagaguuuauaaaacaguccuguguaaacugcu

SEQ ID NO: 726772 - RNA, 64 nt, hsa
uguuuuguuuaguuacaggacaauaaugaaauggaguuuauauuuguuauuucuauuuuguuau

SEQ ID NO: 726773 - RNA, 64 nt, hsa
uauaccuaaauaaaacuggaaaaaaauuucuggaaguuuauaucuaaaaauguuaauagugcgu

SEQ ID NO: 726774 - RNA, 64 nt, hsa
aauccaccccagcuaaaggcaaacccuucaaucaaguuuauacagcaaacccuccauuguccau

SEQ ID NO: 726775 - RNA, 64 nt, hsa
guagaauaaauaauggaaagcaacuugauauacaaguuuauacuaaaauuucaacugugugaag

SEQ ID NO: 726776 - RNA, 64 nt, hsa
uacacagaaaacaguaguuucaguaguguaaaagaguuuauacaggccuuaaauaucagacuuu

SEQ ID NO: 726777 - RNA, 64 nt, hsa
ucuauauauugacaagaguuuauauauugacaagaguuuauauauuugucaaaacuccucaaau

SEQ ID NO: 726778 - RNA, 64 nt, hsa
uuuggggugguggaauacucuauauauugacaagaguuuauauauugacaagaguuuauauauu

SEQ ID NO: 726779 - RNA, 64 nt, hsa
auugggacuaguuuauaggagaacguaucaauacaguuuauaaagccaagaauugcuaugauuu

SEQ ID NO: 726780 - RNA, 64 nt, hsa
aacucagugaaggcccaugaaggaaauugggacuaguuuauaggagaacguaucaauacaguuu

SEQ ID NO: 726781 - RNA, 64 nt, hsa
uuucuuuugcagaauguaaaagguaaugauaauuaguuuauauaaguguacuggcuguaaauga

SEQ ID NO: 726782 - RNA, 64 nt, hsa
aucaaaaauuguuaaaaucauuguguuaucuaguaguuuauaauuaucggcuuauauuucccca

SEQ ID NO: 726783 - RNA, 64 nt, hsa
gaaaguucuggugggccggcaggauugccgcacaaguuuauaugauggucguauauauaucccu

SEQ ID NO: 726784 - RNA, 64 nt, hsa
caguuuucauucuuucaaggguagacuaaaauauaguuuauaaaucggcaguacgguauuauga

SEQ ID NO: 726785 - RNA, 64 nt, hsa
auauuaagcuuagggauuuuugaauuuuuacgucaguuuauauuuuaauucuuacuguacuugg

SEQ ID NO: 726786 - RNA, 64 nt, hsa
gaacuuugaaguuauagaaaaucagagagggguaaguuuauagggcauuuuguucugaugguuc

SEQ ID NO: 726787 - RNA, 64 nt, hsa
aguuauguagguauccuaaugagugaaugguacuaguuuauauaaaaggagaauucauugagcu

SEQ ID NO: 726788 - RNA, 64 nt, hsa
ucccuuauaaacaauuguugaaccuaaccauuauaguuuauaaguuuuaagacauuuaugggau

SEQ ID NO: 726789 - RNA, 64 nt, hsa
uauuuuucaaaggacuaguaaucuaauagccuauaguuuauauuauuauuuuguauuauuugca

SEQ ID NO: 726790 - RNA, 64 nt, hsa
ucuuugcaaggcaggugauuaacuuaaauaucucaguuuauacagugguuuaaaagacuuuugu

SEQ ID NO: 726791 - RNA, 64 nt, hsa
cugaacuauguccauauuuuacagcuuagauaauaguuuauauggaaacuauuauacaucugcu

SEQ ID NO: 726792 - RNA, 64 nt, hsa
uugaauacugaaagagauuuuuugaguugcaaaaaguuuauaaaugcaaagcaaaaagaaaaca

SEQ ID NO: 726793 - RNA, 64 nt, hsa
aucccaggcuuaaaaucuuguguuucagaaagacaguuuauaccaugacugcuuaauuaucccc

SEQ ID NO: 726794 - RNA, 64 nt, hsa
cucaggauuguuccacuuuagagauucuauguaaaguuuauauaacuauacuugucaaauagca

SEQ ID NO: 726795 - RNA, 64 nt, hsa; identical to SEQ ID NO: 173300

SEQ ID NO: 726796 - RNA, 64 nt, hsa; identical to SEQ ID NO: 173301

SEQ ID NO: 726797 - RNA, 64 nt, hsa; identical to SEQ ID NO: 173302

SEQ ID NO: 726798 - RNA, 64 nt, hsa; identical to SEQ ID NO: 173303

SEQ ID NO: 726799 - RNA, 64 nt, hsa; identical to SEQ ID NO: 173304

SEQ ID NO: 726800 - RNA, 64 nt, hsa; identical to SEQ ID NO: 173305

SEQ ID NO: 726801 - RNA, 64 nt, hsa; identical to SEQ ID NO: 173306

SEQ ID NO: 726802 - RNA, 64 nt, hsa; identical to SEQ ID NO: 173307

SEQ ID NO: 726803 - RNA, 64 nt, hsa; identical to SEQ ID NO: 570311

SEQ ID NO: 726804 - RNA, 64 nt, hsa; identical to SEQ ID NO: 570312

SEQ ID NO: 726805 - RNA, 64 nt, hsa; identical to SEQ ID NO: 570313

SEQ ID NO: 726806 - RNA, 64 nt, hsa; identical to SEQ ID NO: 570314

SEQ ID NO: 726807 - RNA, 56 nt, hsa; identical to SEQ ID NO: 570315

SEQ ID NO: 726808 - RNA, 64 nt, hsa; identical to SEQ ID NO: 570316

SEQ ID NO: 726809 - RNA, 64 nt, hsa; identical to SEQ ID NO: 570317

SEQ ID NO: 726810 - RNA, 64 nt, hsa; identical to SEQ ID NO: 570318

SEQ ID NO: 726811 - RNA, 64 nt, hsa; identical to SEQ ID NO: 570319

SEQ ID NO: 726812 - RNA, 64 nt, hsa; identical to SEQ ID NO: 570320

SEQ ID NO: 726813 - RNA, 64 nt, hsa; identical to SEQ ID NO: 570321

SEQ ID NO: 726814 - RNA, 64 nt, hsa; identical to SEQ ID NO: 570322

SEQ ID NO: 726815 - RNA, 64 nt, hsa; identical to SEQ ID NO: 570323

SEQ ID NO: 726816 - RNA, 64 nt, hsa; identical to SEQ ID NO: 570324

SEQ ID NO: 726817 - RNA, 61 nt, hsa
augaacuccauugcuuaagaaacacauaaacaccauuuagucacugaacauagcuauaugu

SEQ ID NO: 726818 - RNA, 61 nt, hsa
ggaaugaauuuaacuguccuuggguuacacuaccauuuauuggaacaagccccagaggcag

SEQ ID NO: 726819 - RNA, 61 nt, hsa
ccuacugcaaaccaccccuccauauuuccguaccauuuacaauucaguuucugugacaucu

SEQ ID NO: 726820 - RNA, 61 nt, hsa
auucagugaaaagauuuuauuuauggaauuaaccauuuaauaaagaaauauuuaccuaaua

SEQ ID NO: 726821 - RNA, 61 nt, hsa
aaaguaaccugucuuugaugaugcuucucuuaccauuuaguuuuuguauauuacccugggg

SEQ ID NO: 726822 - RNA, 61 nt, hsa
ucaguuuugccgacugcuuuucaucugagucaccauuuacuccaagcauguauuccagacu

SEQ ID NO: 726823 - RNA, 61 nt, hsa
aagagacuuguuucaucuccggaaaugcaaaaccauuuauagcaugaagcccuacaugauc

SEQ ID NO: 726824 - RNA, 61 nt, hsa
ucaguguaucauuuaguauuuguaucacuguaccauuuaguguuguauaucacucagucau

SEQ ID NO: 726825 - RNA, 61 nt, hsa
gauuaucagcucggugacuuuucuuucugccaccauuuaggugaugguguuugauucagag

SEQ ID NO: 726826 - RNA, 61 nt, hsa
ccuuccaaaaauauugauggugauuugugcuaccauuuacucguuuauuuaauaaagacau

SEQ ID NO: 726827 - RNA, 61 nt, hsa
uacccaggguggccuuuagcacaguaucaguaccauuuauuugucugccgcuuuuaaaaaa

SEQ ID NO: 726828 - RNA, 61 nt, hsa
augggaauugcaguuagagagaguaaggaauaccauuuagucaucuauccguucuucacuu

SEQ ID NO: 726829 - RNA, 61 nt, hsa
aaaucucacuuggcuggaaacaucaaucuuaaccauuuauucagaaccauuaaaccaauga

SEQ ID NO: 726830 - RNA, 61 nt, hsa
aauauugcaugcauauugacuaauuggaauaaccauuuacucaauuauggacagcuuauug

SEQ ID NO: 726831 - RNA, 61 nt, hsa
aacauguuucuuuuugaaagggagagaauugaccauuuauuguugugauguuuaaguuaua

SEQ ID NO: 726832 - RNA, 61 nt, hsa
ccagggauuuucccauuauguucccuuuuauaccauuuaggugugaguuccuuagcuucug

SEQ ID NO: 726833 - RNA, 61 nt, hsa
uaaucuuauucacaguuguuauuguuuacagaccauuuaauuaauauuuccucuguuuauu

SEQ ID NO: 726834 - RNA, 61 nt, hsa
auguguuuccccaaagggaagccagucauugaccauuuaaaaagucuccugcuaaguaugg

SEQ ID NO: 726835 - RNA, 61 nt, hsa
uaauacaaaaguuuugagcucuuccaaguauaccauuuauauacaaacaaauagguuuauu

SEQ ID NO: 726836 - RNA, 61 nt, hsa
ucagggucuaccuaacugagccuagauauggaccauuuauggaugacaacaauuuuuuuuu

SEQ ID NO: 726837 - RNA, 61 nt, hsa
uggccaggccuugugccguggcuggguggacaccauuuacaaugcccaggugagugcagag

SEQ ID NO: 726838 - RNA, 61 nt, hsa
caguuuaguaucuuuugaauuuuauuucuguaccauuuaaaaaaaauaauuaacacuauuu

SEQ ID NO: 726839 - RNA, 61 nt, hsa
uaccugacuaaaaaugaaguaauacccuuaaaccauuuauaauuucuaguauuucucugaa

SEQ ID NO: 726840 - RNA, 61 nt, hsa
auucaauuuaaaaaaucacguuagccuccaaaccauuuaauucaaaugaacccaucaacug

SEQ ID NO: 726841 - RNA, 61 nt, hsa
uugcaggacuauccuguaauuguagacacccaccauuuaaauuuauuuaacaguuaucuug

SEQ ID NO: 726842 - RNA, 61 nt, hsa
guuuggauuguaucaaguggcaugugcugugaccauuuauaauguuaguagaaauuuuaca

SEQ ID NO: 726843 - RNA, 61 nt, hsa
cacuuuaaguucguauuuuuuaauuuauauuaccauuuauagauucauuuuggaaccauuu

SEQ ID NO: 726844 - RNA, 61 nt, hsa
caaaaucaaaaugguacauccauaaucagccaccauuuaacccuuccuuguucuaaaacaa

SEQ ID NO: 726845 - RNA, 61 nt, hsa
aagaaccuccccuuuccccucccacaauaagaccauuuaagugugugcuaaacaacuacgg

SEQ ID NO: 726846 - RNA, 61 nt, hsa
cuucugcauauggcuagccaguaaucccagcaccauuuauuaaauggggacuucuuucccc

SEQ ID NO: 726847 - RNA, 61 nt, hsa
ccccagauauuuguguggaagaggaggaaucaccauuuacaagguggacaaaugcuaauau

SEQ ID NO: 726848 - RNA, 61 nt, hsa
ugguauagaaaacaacgcugcauauacagguaccauuuaggaaauaccgaugccuuugugg

SEQ ID NO: 726849 - RNA, 61 nt, hsa
uuguguuuuagaaaaauuauuauuugcuaaaaccauuuaagucuuuguauauguguaaaug

SEQ ID NO: 726850 - RNA, 61 nt, hsa
ugaagacaaauagggauacauuucaauguaaaccauuuaugaauuggaagugauguuggcu

SEQ ID NO: 726851 - RNA, 61 nt, hsa
cgugaaauugaaaaacugaagcuggacaaggaccauuuagagaagguuuuacaaauuggau

SEQ ID NO: 726852 - RNA, 61 nt, hsa
uggauucacuuuuuacuuauguuaaaauuauaccauuuaacuggcucuuuugucauugugc

SEQ ID NO: 726853 - RNA, 61 nt, hsa
uuuuguucugcaggcuugcagaguucuucucaccauuuaaacugaaggacccuauauuaua

SEQ ID NO: 726854 - RNA, 61 nt, hsa
acuuuuuucucacuguugcaucuucuguaggaccauuuaagucugggccacuuaauggcug

SEQ ID NO: 726855 - RNA, 61 nt, hsa
aaccccuggaagagacucuuuaagaccucaaaccauuuagaaugggcaauguauuuuacgc

SEQ ID NO: 726856 - RNA, 61 nt, hsa
cauuaugagguauacaacuaguauuuaagauaccauuuaauaugccccguaaaugucuuca

SEQ ID NO: 726857 - RNA, 61 nt, hsa
ucuuuagagcauuugcuucacacacaguucaaccauuuaaccagaaauuaaaauaucaccc

SEQ ID NO: 726858 - RNA, 61 nt, hsa
gagcaaugcugggauugcaacuguagggaacaccauuuaugcagugggaggauucgauggc

SEQ ID NO: 726859 - RNA, 61 nt, hsa
uagaccaauuacugcacucuuaaacagcaccaccauuuaauuucauguauaucuaacuucg

SEQ ID NO: 726860 - RNA, 61 nt, hsa
gcagggcuuuuuaguaucaaaucacuacuagaccauuuaauuuguuaaauuaucucuagga

SEQ ID NO: 726861 - RNA, 61 nt, hsa
uagagggaagucuucucaaguuucaagcaagaccauuuacuuaaugugaaguuuuggaaag

SEQ ID NO: 726862 - RNA, 61 nt, hsa
gguuuauauuuaacucuugcuucauagguguaccauuuaaagaguguuauuuaaugcuaag

SEQ ID NO: 726863 - RNA, 61 nt, hsa
gucaauaacgaaaccuaauuguaaaacagucaccauuuacuaccaauaacuuuuaguuaau

SEQ ID NO: 726864 - RNA, 61 nt, hsa
uaaagucauuauauuaauuaaaagaaaaaacaccauuuaauauguucugaaaacauuacuc

SEQ ID NO: 726865 - RNA, 61 nt, hsa
uguacaaaaacuaauucuuuugguaaaaugaaccauuuacaguucgguuuuggacucugag

SEQ ID NO: 726866 - RNA, 61 nt, hsa
caguacuuuuuucucauguaucuuucucuagaccauuuauauacgggugaaaugaaagcuu

SEQ ID NO: 726867 - RNA, 61 nt, hsa
augaagucuugugaauuuguaauagaucaguaccauuuauugguuuggggaccaucuuaau

SEQ ID NO: 726868 - RNA, 61 nt, hsa
auguuauuuggcgagacaucaaauaaaguuaaccauuuaaaaauuauuuucauauacuguu

SEQ ID NO: 726869 - RNA, 61 nt, hsa
ucuguggucgcccgcccccccccaaaaaaauaccauuuaugguucucuccgcaaguauaaa

SEQ ID NO: 726870 - RNA, 61 nt, hsa
gagcauggauguauaaggcagguuuuauacaaccauuuagauucaacauuaaugguagagu

SEQ ID NO: 726871 - RNA, 61 nt, hsa
aaaugagcuugcaauguguuaaagaagauuaaccauuuaaaggcauguguuccauagccaa

SEQ ID NO: 726872 - RNA, 61 nt, hsa
ccauuuugaaauugccuauacagucuuagugaccauuuaaaccggacgaacuagguguuua

SEQ ID NO: 726873 - RNA, 61 nt, hsa
uuucuacauauggcuagccaguuuucccagcaccauuuauuaaauagggaauccuuucccc

SEQ ID NO: 726874 - RNA, 61 nt, hsa
gugaucuuacaaguuagauguuacuauaccuaccauuuauucagcuggauugcugaacaca

SEQ ID NO: 726875 - RNA, 61 nt, hsa
aaaaucauuguuaaauugauugaggaaaacaaccauuuaaaaaaaaucuauguugaauccu

SEQ ID NO: 726876 - RNA, 61 nt, hsa
gagucuccaccuuuggacacaacacuuacucaccauuuacucuuuaucacucugcaacaaa

SEQ ID NO: 726877 - RNA, 61 nt, hsa
uuaaauauuaaaauaucuauuuauuauuaaaaccauuuauaaggcuuuuucauaaauguau

SEQ ID NO: 726878 - RNA, 61 nt, hsa
gaguaacauaaaauaaaaguacauuuuauaaaccauuuacuauggcuuuguaacaauugca

SEQ ID NO: 726879 - RNA, 61 nt, hsa
uuacuacuaggaaaccuuccucauaugaauaaccauuuauauguguuuugcuuaaaguauu

SEQ ID NO: 726880 - RNA, 61 nt, hsa
guuauuccaguaaaaggaaauaguuuucucaaccauuuaaaaauauucuucugaacucauc

SEQ ID NO: 726881 - RNA, 61 nt, hsa
cuuuaucacaauaugauucuuacaucuuuauaccauuuacaauuguguuuuagaucuacag

SEQ ID NO: 726882 - RNA, 61 nt, hsa
uauagccggauuaacgguuauaaaguuuuguaccauuuauuuuaugacauuuuacaaugua

SEQ ID NO: 726883 - RNA, 61 nt, hsa
ucaauuaguacaguagcuuaaauaaauucaaaccauuuaauucauaauuagaacaauagcu

SEQ ID NO: 726884 - RNA, 61 nt, hsa
aucaauauugauagaagucacacuaguauauaccauuuaauacauuuacacuuucuuauuu

SEQ ID NO: 726885 - RNA, 61 nt, hsa
caguucuuggccuaugauaaguuccaaaaauaccauuuaucuacuauuugaaaaaagaaga

SEQ ID NO: 726886 - RNA, 61 nt, hsa
guccacuggacaguugggaaaacaccugaccaccauuuaaggacucuaagccagaauggaa

SEQ ID NO: 726887 - RNA, 61 nt, hsa
cuugagcuguaggacaaaccuugggcauuuaaccauuuacugucuggcuuugcccuuaaaa

SEQ ID NO: 726888 - RNA, 61 nt, hsa
gggaaaaaugaggaaaaaaaauagauucugaaccauuuauuguugaauaaguagagaaaau

SEQ ID NO: 726889 - RNA, 61 nt, hsa
gcauuguuuuaugaauuuuacauuuuuccucaccauuuagcaauuuucugaaugguaauaa

SEQ ID NO: 726890 - RNA, 61 nt, hsa
uauuuucugaguguugagaagaaugaguuaaaccauuuaaacacauuugaaacauacaaaa

SEQ ID NO: 726891 - RNA, 61 nt, hsa
uccuaaaucaaggaaaggaaaucauccccagaccauuuaugcugagcuuuggaauacuauu

SEQ ID NO: 726892 - RNA, 61 nt, hsa
uauggugcucacuuuaggaucagcaguguugaccauuuaugcugcauagcuguauuauagc

SEQ ID NO: 726893 - RNA, 61 nt, hsa
cuucucuauucuauucuacuuccuccauuucaccauuuauacaaagucauucaaaaaggcu

SEQ ID NO: 726894 - RNA, 61 nt, hsa
uguggggaggggggcugguuuacaauauuaaaccauuuaaaguauuuuauucuacaaaugg

SEQ ID NO: 726895 - RNA, 61 nt, hsa
gcugacaaucaguuaaacacaccggagaagaaccauuuacaugcaccuuauauuucugugu

SEQ ID NO: 726896 - RNA, 61 nt, hsa
gaagcagaggcacuuaaaacauguaccaggaaccauuuaacaaagaauauaaaaugucaca

SEQ ID NO: 726897 - RNA, 61 nt, hsa
ugcccacacuuaaugucaaucuauaauuuuaaccauuuauccaagauucuacuaaguguaa

SEQ ID NO: 726898 - RNA, 61 nt, hsa
caaguuugggucugugcugcuguuacuguuaaccauuuaaguggggcaaaaccuugcuaau

SEQ ID NO: 726899 - RNA, 61 nt, hsa
aaauauaugcuuuucuagaauuugauguuugaccauuuaugacuuaauuaccagagagcca

SEQ ID NO: 726900 - RNA, 61 nt, hsa
cauucucucguuuccccuuuagcucccuuucaccauuuauucagcuacaucaucccucuau

SEQ ID NO: 726901 - RNA, 61 nt, hsa
uuuuuuaucguuuuuguauuuucaugaaaauaccauuuaguaagaauaccacaucaaauaa

SEQ ID NO: 726902 - RNA, 61 nt, hsa
ugauuuguaaauuuacuuauguuaaaaauaaaccauuuauuuucagcuuugaauuuuauuu

SEQ ID NO: 726903 - RNA, 61 nt, hsa
cgaaugcaaagcuacuggcuucacagagacaaccauuuaugauuugcuguucuguaagagu

SEQ ID NO: 726904 - RNA, 61 nt, hsa
auugcaggugauuugauaauuaagcacccauaccauuuauaacuucugaauuuaaaaaguu

SEQ ID NO: 726905 - RNA, 61 nt, hsa
agcugaucucauuuccuuccaugguuuccuuaccauuuauaugcaaaugacugucagauuc

SEQ ID NO: 726906 - RNA, 61 nt, hsa
aaaauacugaggcugauuuagucagggcaaaaccauuuacuuuacauauucguuuucaaua

SEQ ID NO: 726907 - RNA, 61 nt, hsa
ucuaauccuacauaaugaaaaagaaaaacagaccauuuaaaaacucagacaagauuauauu

SEQ ID NO: 726908 - RNA, 61 nt, hsa
uuagcacgcaaaagccaaaaucuaaagaucaaccauuuauccugaacaacaccauuugaga

SEQ ID NO: 726909 - RNA, 61 nt, hsa
cucucccagcucucgaauccuaacugcagccaccauuuauucagcaccuguuaugcaccag

SEQ ID NO: 726910 - RNA, 61 nt, hsa
auuguauucagcuagccccuuaaagguaaugaccauuuauaaauuauuccuucaguuggcu

SEQ ID NO: 726911 - RNA, 61 nt, hsa
auguuaauaccuauaaaauauauagccaggaaccauuuaucaucaagaaaaguguaagaaa

SEQ ID NO: 726912 - RNA, 61 nt, hsa
gggugaguucucuccucaaagaagacuucaaaccauuuaacugguuucuuaagagccguca

SEQ ID NO: 726913 - RNA, 61 nt, hsa
ccugaauuccaaaauauuauggauaaacauuaccauuuauaugcuacaaauuagucugauu

SEQ ID NO: 726914 - RNA, 61 nt, hsa
cacuagauacaguaaauuuuuagaaaaaaauaccauuuacaguauuauugugaaccauuua

SEQ ID NO: 726915 - RNA, 61 nt, hsa
gaaaaaaauaccauuuacaguauuauugugaaccauuuaacccuuuugauccaaggccccg

SEQ ID NO: 726916 - RNA, 61 nt, hsa
cuaguccacauauaaggguaggguugggauuaccauuuacugaccacaucugugaggugcc

SEQ ID NO: 726917 - RNA, 61 nt, hsa
auacaaccaugauuugcaacuguaacaggagaccauuuauuauaagcguaccuguuuguga

SEQ ID NO: 726918 - RNA, 61 nt, hsa
agauaaagagagaauauuguaugggccaucaaccauuuacuuuucccugaauguuagaaac

SEQ ID NO: 726919 - RNA, 61 nt, hsa
cauagaauugcagucauuuggugcucugcuaaccauuuauauaaaacuuaaaaacaagaga

SEQ ID NO: 726920 - RNA, 61 nt, hsa
ggucagucaaguugguaaugccuguccauuaaccauuuaugcauacuaauaaaauuauaag

SEQ ID NO: 726921 - RNA, 61 nt, hsa
uuauuggcuaacugcaugacaugcccauucuaccauuuaaaaaaaaaucuuaaagccugua

SEQ ID NO: 726922 - RNA, 61 nt, hsa
gguaaaaauauauaccuucgggucgcaguucaccauuuauaugugguauuaaaaauuaaug

SEQ ID NO: 726923 - RNA, 61 nt, hsa
aggucuuaggaauugaauuaauaauaaagcuaccauuuaucaagcauuuaccaugugcuaa

SEQ ID NO: 726924 - RNA, 61 nt, hsa
aucaugucagaacugcuuaaaauuaaccuuuaccauuuaaugucaucuaccugaaaacagu

SEQ ID NO: 726925 - RNA, 61 nt, hsa
uuuuguuuguuuaguuauaacagaguaacauaccauuuaauuacaauuuuuagccagaaaa

SEQ ID NO: 726926 - RNA, 61 nt, hsa
cuuauuaauaaaacuuuggaaauugcuuuaaaccauuuaaaggaaauuucuagauauagaa

SEQ ID NO: 726927 - RNA, 61 nt, hsa
uggguuaaucaagucucgguaaguccuuuaaaccauuuaggauuuuuaaaacaucaaaauu

SEQ ID NO: 726928 - RNA, 61 nt, hsa
auauacacggaugacuuaacugcauuuuuagaccauuuaucugggauuaugguuuugugau

SEQ ID NO: 726929 - RNA, 61 nt, hsa
uuuuaaacuuuuuuaugaauuccuaaacauuaccauuuauguggcagaaguucuguucccu

SEQ ID NO: 726930 - RNA, 61 nt, hsa
auaaaaguuaacauuaggcuguggugcaguaaccauuuaaugucgaggcucuauuucggaa

SEQ ID NO: 726931 - RNA, 56 nt, hsa; identical to SEQ ID NO: 277656

SEQ ID NO: 726932 - RNA, 61 nt, hsa
auaauuuucacucauuuauugucuucuggaaaccauuuaacuuuuacuguuuuuuauuuuu

SEQ ID NO: 726933 - RNA, 61 nt, hsa
caaaaugaacacugcuugucuucuuccauugaccauuuaguguugaguacuguauguguuu

SEQ ID NO: 726934 - RNA, 61 nt, hsa
aaugcuauuuuucaaugcauuuggacugcugaccauuuaaaagcagccuaugauugcuucu

SEQ ID NO: 726935 - RNA, 61 nt, hsa
uguauuaaucuguuugugcaaacauaauaccaccauuuaaaaauguuagggagaugaguug

SEQ ID NO: 726936 - RNA, 61 nt, hsa
gagaauccccgugcucacaguagcuuccuagaccauuuacuuugcccauauuaaaaagcca

SEQ ID NO: 726937 - RNA, 61 nt, hsa
gauuaugcuuaacagugagagcugaaaugagaccauuuacuuuguuuaaaaugcuguacug

SEQ ID NO: 726938 - RNA, 61 nt, hsa
uacacaaaagugcacacugugugcucccuuuaccauuuacuaucucccuccagccccaacg

SEQ ID NO: 726939 - RNA, 61 nt, hsa
ucguccauuuuauuaggauuacccaaauauaaccauuuaaagaaagaaugcauuccagaac

SEQ ID NO: 726940 - RNA, 61 nt, hsa
cuagcacugcucuuuuugauguuguagugacaccauuuacauugaauuaaugcuugguagc

SEQ ID NO: 726941 - RNA, 61 nt, hsa
gaaaaacuguuugguaagcacauguauaucuaccauuuagauucagcaguuguuaauguuu

SEQ ID NO: 726942 - RNA, 61 nt, hsa
cuauuuuugguucaauacuacuacuguugucaccauuuaugauucugaauuuuaaaguugg

SEQ ID NO: 726943 - RNA, 61 nt, hsa
ucugaauauguuacugagcuugcuugugguaaccauuuauaauaucagaaaguauauguac

SEQ ID NO: 726944 - RNA, 61 nt, hsa
ccauauucagcauuugauuuccaugggccccaccauuuauguguagaauuugaaaugguug

SEQ ID NO: 726945 - RNA, 61 nt, hsa
uuauuccccacuacucuugucucuaucagauaccauuuaugagacauucuugcuauaacua

SEQ ID NO: 726946 - RNA, 61 nt, hsa
uuauuguaaaguaugcaaaauauauauucauaccauuuauuaaaucagaauguuuauacaa

SEQ ID NO: 726947 - RNA, 61 nt, hsa
ucucucaguucuacacugauacacuugaaggaccauuuacuguuuuuuucuguagcaccag

SEQ ID NO: 726948 - RNA, 61 nt, hsa
cagcaggaaggcaccgcuguccaccuugggcaccauuuauccuccuuucaucguccccggg

SEQ ID NO: 726949 - RNA, 61 nt, hsa
acacuaaacuuugguauuuugauuccuuuuaaccauuuaagacuacuuuucuuauagguag

SEQ ID NO: 726950 - RNA, 61 nt, hsa
uggcagcugaccaaucccccaucccaaauugaccauuuagauguaccaacucaccuuaaau

SEQ ID NO: 726951 - RNA, 61 nt, hsa
ucauauguacacuagccagugguuguggacaaccauuuacuugguguaaagaacuuaauuu

SEQ ID NO: 726952 - RNA, 61 nt, hsa
ucuaauuugaaaggcaguuaagaaauagauaaccauuuauuuuagaacacucaacaacuau

SEQ ID NO: 726953 - RNA, 61 nt, hsa
augcacugugggguuuuuuccuguaugggaaaccauuuaugccaagcuuuuccccauuucc

SEQ ID NO: 726954 - RNA, 61 nt, hsa
aucagcaacuuuugaaaacuucacacuuguuaccauuuagaaguuuccuggaaaauauaug

SEQ ID NO: 726955 - RNA, 61 nt, hsa
gauaucaggaaugucucaugauaucacguuuaccauuuacaccaucugcaaccauaugcua

SEQ ID NO: 726956 - RNA, 61 nt, hsa
ccuuacccagaaaugaaaauacucaauauggaccauuuaggaauuauaagcagcaacugug

SEQ ID NO: 726957 - RNA, 61 nt, hsa
uagauguccguacaaguagcgcauauauuuaaccauuuaguuuggggcucuauauuacuug

SEQ ID NO: 726958 - RNA, 61 nt, hsa
acccauuggauuugcugcugguaacaguuccaccauuuagguuccagcaccaagcaaacua

SEQ ID NO: 726959 - RNA, 61 nt, hsa
agacgcgucagauggcagauuuggaaaguuaaccauuuaaaagaacauuuuucucuccaac

SEQ ID NO: 726960 - RNA, 61 nt, hsa
aaagcuugggacaguuauuggagauuaaucuaccauuuauugaaugcauacucugugcaag

SEQ ID NO: 726961 - RNA, 61 nt, hsa
uguuagaguucauguaaucacauucucuagaaccauuuaguuuguguuaacuaugaaccaa

SEQ ID NO: 726962 - RNA, 61 nt, hsa
aacaguauuaauagcgacauugguaacagcuaccauuuauagaguuuuaaugggaguagga

SEQ ID NO: 726963 - RNA, 61 nt, hsa
aaauguacauucuaauuaauucacuuauaaaaccauuuacauauuguguauauguuuuuau

SEQ ID NO: 726964 - RNA, 61 nt, hsa
uauuuuucaaauuauuuaauagauguaugguaccauuuaaaagugguuguaucugaauuua

SEQ ID NO: 726965 - RNA, 61 nt, hsa
aagcaugauaaaggggcaguucacaauuuucaccauuuaaacacaaauuugcugcacagaa

SEQ ID NO: 726966 - RNA, 61 nt, hsa
ugaaaagcaaaaaauacuauuaaccuauauaaccauuuaaaauuuaaaaaauuauguucca

SEQ ID NO: 726967 - RNA, 61 nt, hsa
uccaagagccaucuccuuaugauguauuugaaccauuuagagaaauucacuucauuguacc

SEQ ID NO: 726968 - RNA, 61 nt, hsa
ggugguguucuguugguuacaagaaaguuauaccauuuaaagcuggcaccagagacccgau

SEQ ID NO: 726969 - RNA, 61 nt, hsa
gcuaggucagaagcugcuuuuucacacugaaaccauuuaaguauguacaaauaaguuaaua

SEQ ID NO: 726970 - RNA, 61 nt, hsa
uaugagcaggaagagggaaggcuguuugagaaccauuuacuuagcagaaccacauauuuua

SEQ ID NO: 726971 - RNA, 61 nt, hsa
ucuaaucaucuauguguguaugauggaugugaccauuuauaugucauguguugaaauuaaa

SEQ ID NO: 726972 - RNA, 61 nt, hsa
ggaaguaauguuaccuauccuugauaccaugaccauuuauuagauguuuugcuauauaaau

SEQ ID NO: 726973 - RNA, 61 nt, hsa
augccaagugaauauaagagcuuguacugaaaccauuuauuucuuucuauuuugcuauuug

SEQ ID NO: 726974 - RNA, 61 nt, hsa
uuuuauucaaaggaauuguaaaccuuaaaccaccauuuauuuccaugugaaaaaguguuau

SEQ ID NO: 726975 - RNA, 61 nt, hsa
agauuaagcaagugaaauucugcugcccuccaccauuuauuuuuacagugcuuuguaauuu

SEQ ID NO: 726976 - RNA, 61 nt, hsa
ggcugcuaccuaacuuuuagucccuuccaaaaccauuuaguaggguucuauuacauaaaca

SEQ ID NO: 726977 - RNA, 61 nt, hsa
agauuacacaaaaauuauuuccagaaaggcuaccauuuaucaucauuauauuucaagccuc

SEQ ID NO: 726978 - RNA, 61 nt, hsa
cuuguucuguucucuggaacuaaacagaacaaccauuuaccccuccuuuucaaacuagaga

SEQ ID NO: 726979 - RNA, 61 nt, hsa
gagcagugccuaguaucuggagagcagcacuaccauuuauucuuucauuuauaguugggaa

SEQ ID NO: 726980 - RNA, 61 nt, hsa
guuagaaaugaauuuuuuagaccuuaguaaaaccauuuaaccauaaaauggacaacugaga

SEQ ID NO: 726981 - RNA, 61 nt, hsa
uuuggaacuuuaauaagaucuagucuguuacaccauuuagaacuuuccugagccauuauca

SEQ ID NO: 726982 - RNA, 61 nt, hsa
ugucauuuuauuuuagucauuauugaauuauaccauuuacucuguuuucuuauagucuuaa

SEQ ID NO: 726983 - RNA, 61 nt, hsa
gcuggaccugcaagauguggcuugaauuuuaaccauuuauuacauaaucucuagugaucau

SEQ ID NO: 726984 - RNA, 61 nt, hsa
aauacgacacccaguauuuucuuuaaguuucaccauuuacgcuacaugugauuuuuuuaau

SEQ ID NO: 726985 - RNA, 61 nt, hsa
aaaagugaacaauccugugauaaguuggaguaccauuuaguaauacagcaacauuguguca

SEQ ID NO: 726986 - RNA, 61 nt, hsa
ugucacuugugcuuuaaaauuagucuguaucaccauuuauuacaguuauaauuuuggaguu

SEQ ID NO: 726987 - RNA, 61 nt, hsa
uuucaugugucaugaaauacuguuuucuccaaccauuuaauaauguaaauacuugcuagcu

SEQ ID NO: 726988 - RNA, 61 nt, hsa
cuucccuugaucugcuuauuuuuauuccaucaccauuuacccuuuuuuuuuuuuuaaauuu

SEQ ID NO: 726989 - RNA, 61 nt, hsa
acguaagugugugagugcagugcagaugagcaccauuuaguuauaugugcuaggcaaaucu

SEQ ID NO: 726990 - RNA, 61 nt, hsa
ccaagcgaggucucaggugcaaagcaaaaggaccauuuaaaguaaaauagcuuggauucaa

SEQ ID NO: 726991 - RNA, 61 nt, hsa
cagcuuaaaucauggguccagccuaaaaaccaccauuuaacuuacacugaucaauuucaac

SEQ ID NO: 726992 - RNA, 61 nt, hsa
uuucagaacaaaagauauucauugcacauuaaccauuuagaggucauuuaaauaacaaaau

SEQ ID NO: 726993 - RNA, 61 nt, hsa
auuccaccuaucuuaaugugaauuaaaaaccaccauuuauaauaauaauagcgccauauuc

SEQ ID NO: 726994 - RNA, 61 nt, hsa
uuaaauucuuaauauuagucauccuaaguauaccauuuauguauccuuuauaaggaaugug

SEQ ID NO: 726995 - RNA, 61 nt, hsa
cagaacaaagauuggaaaaagcuggccgagaaccauuuauacauagaggaagggcuuaugg

SEQ ID NO: 726996 - RNA, 61 nt, hsa
aguauuguuguaaaacuucaugaaacaaaagaccauuuaaauagugaauuauuaaaaaucu

SEQ ID NO: 726997 - RNA, 61 nt, hsa
aaggaucagacaauaaaaugaguuagugcaaaccauuuaguaaaaauaacuaucagcagag

SEQ ID NO: 726998 - RNA, 61 nt, hsa
ucucagaacauuuagccugcaguugggcaaaaccauuuaacacaaagccuauuuuauaaug

SEQ ID NO: 726999 - RNA, 61 nt, hsa
ucugugguagcuuuuaggcugcuccuaacccaccauuuauugccuucugagagguggguga

SEQ ID NO: 727000 - RNA, 61 nt, hsa
agcauuacaaaauccuaguuuauacuagacuaccauuuaaaaaucauguuuuuauauaaau

SEQ ID NO: 727001 - RNA, 61 nt, hsa
uccuucaacauccucacccccaccccugggcaccauuuaggacaagacuuccuuauuuauc

SEQ ID NO: 727002 - RNA, 61 nt, hsa
gccauuuagaugauuaguuaauuuguuuuucaccauuuagcaaaaauguauacuaccuuaa

SEQ ID NO: 727003 - RNA, 61 nt, hsa
cuucuguauuuuaaaauguaauauacuuuguaccauuuauaaaaauugugugaugaaugaa

SEQ ID NO: 727004 - RNA, 61 nt, hsa
auuuccauaaaccaaguuaaaguauggcccgaccauuuaagaaaacaaccaucugagacac

SEQ ID NO: 727005 - RNA, 61 nt, hsa
gguaaacaaaaaacuaaaacuuauacaagauaccauuuacacugaacauagaauucccuag

SEQ ID NO: 727006 - RNA, 61 nt, hsa
ccagaucgugaggcuggggagcauucuagguaccauuuauuaucuacugcguuucggucag

SEQ ID NO: 727007 - RNA, 61 nt, hsa
ccucccacaacacaugggaauucugagagauaccauuuaaguugagauuucaguggggaca

SEQ ID NO: 727008 - RNA, 61 nt, hsa
ucacaaaaaguagaaacucuaagagaccauuaccauuuauucacagauguauaggggaugu

SEQ ID NO: 727009 - RNA, 61 nt, hsa
uuauuaucaaaagaauaauuaaaaucauguaaccauuuaaaugucacuguuaacacuuuuc

SEQ ID NO: 727010 - RNA, 61 nt, hsa
acccaaaaguauaagauacauuuuuugguaaaccauuuaaaauacaaaauccuauuuugga

SEQ ID NO: 727011 - RNA, 61 nt, hsa
uuauugaauaguaauuaaacuuuaacugaugaccauuuauauucuaguagccaucuucacu

SEQ ID NO: 727012 - RNA, 61 nt, hsa
ugaaacaggacugaagcccuuuuuaccuagaaccauuuaaaagccugagcaaggaccacca

SEQ ID NO: 727013 - RNA, 61 nt, hsa
ugaaaggagaaaaagcacaaguucccuaguuaccauuuaauaugagggugcaagagccaca

SEQ ID NO: 727014 - RNA, 61 nt, hsa
ccagcuuucuuuucuacuagcaaaugacccuaccauuuauuucugccuuuuucuuccguuc

SEQ ID NO: 727015 - RNA, 61 nt, hsa
ugucagggccucugccaaggaaauaauauggaccauuuaccuggcaggcagucugcucucu

SEQ ID NO: 727016 - RNA, 61 nt, hsa
gguuuuuuuguuuuuacuuucuaucuucauaaccauuuaaagcgauuuagcuugaaauuaa

SEQ ID NO: 727017 - RNA, 61 nt, hsa
accacuuuugacuagguaagucuuucuaaaaaccauuuaaagcuaacugggucuuagcauc

SEQ ID NO: 727018 - RNA, 61 nt, hsa
uggaaaccagaaaugcaacaguuacuaaaacaccauuuaauaguuauaacgucguuacuug

SEQ ID NO: 727019 - RNA, 61 nt, hsa
uguagaauaaauuaaaaggauaaucuaaaucaccauuuagauuaagcuugacuugcaaacu

SEQ ID NO: 727020 - RNA, 61 nt, hsa
aauauucaaagaaagaaccacagauguguuaaccauuuaagcagaucaucugccaaacauu

SEQ ID NO: 727021 - RNA, 61 nt, hsa
gaaauaacauuuuaaaaucuauuuuauacuuaccauuuauuauucuguuauuuuagucucc

SEQ ID NO: 727022 - RNA, 61 nt, hsa
acugaugggaauauacagauuuaggugcuaaaccauuuauuuuccacggaugagucacaau

SEQ ID NO: 727023 - RNA, 61 nt, hsa
ugacuucagcaaaagcacggggcuguaaauuaccauuuacuagauuagccaaauagucuga

SEQ ID NO: 727024 - RNA, 61 nt, hsa
uuauuauguggguauuuauaugaccuuuguaaccauuuaaaaauguaaaaacgaccugacu

SEQ ID NO: 727025 - RNA, 61 nt, hsa
cugagaagucagccucuuggcuccucaggccaccauuuaggccugacugggguaagaaaug

SEQ ID NO: 727026 - RNA, 61 nt, hsa
uggaagcccagucuugaguucuugucuuguuaccauuuaaaauugacauuuaauuuucaaa

SEQ ID NO: 727027 - RNA, 61 nt, hsa
uuuaauccuuucuuuagaaugcuguuuaaacaccauuuacccuacuuaucccucaaugcac

SEQ ID NO: 727028 - RNA, 61 nt, hsa
uucucuuuguuuuaaagagagaauuuuguaaaccauuuauugaauguucugaucuuucauu

SEQ ID NO: 727029 - RNA, 61 nt, hsa
aacagucaauagggcuacugcuggcccaaagaccauuuagguccaccuccucuuuuuugcu

SEQ ID NO: 727030 - RNA, 61 nt, hsa
gagccucgggaaaagguagaggagucacguuaccauuuacauguuuuaaagaaagaagugu

SEQ ID NO: 727031 - RNA, 61 nt, hsa
gagauucagcuuaauuugcuucaauucagcaaccauuuauugagcaucuauuaugugccag

SEQ ID NO: 727032 - RNA, 61 nt, hsa
uccacccaugcaaauagcuacuggcccagcuaccauuuaccauuugccuacagaauuucau

SEQ ID NO: 727033 - RNA, 61 nt, hsa
uuugucauuaucaagagagauggcaguauugaccauuuaguuuaguuaaaaaaaaaaaaaa

SEQ ID NO: 727034 - RNA, 61 nt, hsa
aguauggaugucacucaacuaagaucaaaucaccauuuaaggggauggcauucuuuauacc

SEQ ID NO: 727035 - RNA, 61 nt, hsa
cuccaaggcagaaauuguaucuuuauagcuaaccauuuaguaaauaaauacauuacauuuu

SEQ ID NO: 727036 - RNA, 61 nt, hsa
guugacuaccuuuugauaagcaaaauuugaaaccauuuaaagaccacuguauuuuaacuca

SEQ ID NO: 727037 - RNA, 61 nt, hsa
gacacaagccaccgccccugagugcucauguaccauuuagcuuguguuuuaaaaaucuacu

SEQ ID NO: 727038 - RNA, 61 nt, hsa
uuaggugaggaagcaaaagcaucuaugugagaccauuuagcacacugcuugugaaaggaaa

SEQ ID NO: 727039 - RNA, 61 nt, hsa
aguuacauuaucagccagcccagccuugcccaccauuuaagaaauaucacagagccacuag

SEQ ID NO: 727040 - RNA, 61 nt, hsa
ucuauuuuccuauggaguuguuucuauuaugaccauuuaauuuuguuuuuauuuaauagua

SEQ ID NO: 727041 - RNA, 61 nt, hsa
agugacuucagugguauccuuuuuuccuaagaccauuuauaauuauuaguggcaacagagu

SEQ ID NO: 727042 - RNA, 61 nt, hsa
caaacaaaaaugcccugguggcaaagcuaucaccauuuaaugucuucucucagucuugcac

SEQ ID NO: 727043 - RNA, 61 nt, hsa
augcuuuuuuuuuuaaagacugaauguguucaccauuuagccuguagauuuauuuccauuu

SEQ ID NO: 727044 - RNA, 61 nt, hsa
guuaggagugguuacaacugagcuuuuaguaaccauuuaaccguauguaaacuugguuucu

SEQ ID NO: 727045 - RNA, 61 nt, hsa
cagguggcaauguaacucauuuuuuugucccaccauuuaucuucucugcccaagcccuguc

SEQ ID NO: 727046 - RNA, 61 nt, hsa
uuuagcuguuaaauguacuaugccaucauccaccauuuaguaaaauguagcuggcccagga

SEQ ID NO: 727047 - RNA, 61 nt, hsa
uaucuuuuuuuauuauucugaucaugauaugaccauuuaaccucagaauucauaauuccug

SEQ ID NO: 727048 - RNA, 61 nt, hsa
aaauucagucuuaaguagggugaauuggaucaccauuuacacaagagauggcuuuuuccuu

SEQ ID NO: 727049 - RNA, 61 nt, hsa
uuauucugauuuuuaaaaaugcaguuaauguaccauuuauuugcuugaugaagggagcucu

SEQ ID NO: 727050 - RNA, 61 nt, hsa
cacaguuaauuguugcgcucuaauacaacugaccauuuaaaauugaacaaguuuauuguuu

SEQ ID NO: 727051 - RNA, 61 nt, hsa
augucaauguauuuuuggcacugcgauuuuaaccauuuauuaaauaaaaauuuuguuaaag

SEQ ID NO: 727052 - RNA, 61 nt, hsa
agaggucgcuugggaauuuuauugacacaguaccauuuaauggggaggacaaaauggggca

SEQ ID NO: 727053 - RNA, 61 nt, hsa
ucauauguacaccagcuaguggcugugaacaaccauuuaguugguguaaaaaacuuuauuu

SEQ ID NO: 727054 - RNA, 61 nt, hsa
ucauuuuacuuuaacuauauaaugucuguuaaccauuuaagaugccaucugaaggggauuc

SEQ ID NO: 727055 - RNA, 61 nt, hsa
auuacucauuugauuucccccacccccgccaaccauuuaaaaaaguuugccggcuaggugc

SEQ ID NO: 727056 - RNA, 52 nt, hsa; identical to SEQ ID NO: 277781

SEQ ID NO: 727057 - RNA, 61 nt, hsa
uuaaaaaagugugccuugcuguauuucuuauaccauuuauuaaaaagcugcuuucacggua

SEQ ID NO: 727058 - RNA, 61 nt, hsa
aauuaguagcuuaccacagauacuguuuccuaccauuuauaaaauuuacuuuuuauugaaa

SEQ ID NO: 727059 - RNA, 61 nt, hsa
ugacuggagaccccagugugggggaggucuuaccauuuaauauagaaaugauaucaauaac

SEQ ID NO: 727060 - RNA, 61 nt, hsa
aauagaagaguguguugggcagguaguuuguaccauuuaugaagguuuguuccuuuguuaa

SEQ ID NO: 727061 - RNA, 61 nt, hsa
caacuuuuuaaaauccagacccaguguuaaaaccauuuauuccuuuuuucauaagaauaau

SEQ ID NO: 727062 - RNA, 61 nt, hsa
aaauauauauuuaaaagauuuaugaauacaaaccauuuaugguuuaugauuucuaaaaaga

SEQ ID NO: 727063 - RNA, 61 nt, hsa
aggaagaaaacaggugaaagaagaaguaaaaaccauuuaguauuaguauuagaaugaaguc

SEQ ID NO: 727064 - RNA, 61 nt, hsa
augacaauuugcacagcccaguggcuuaaacaccauuuauaccacagguccagaugaaucc

SEQ ID NO: 727065 - RNA, 61 nt, hsa
uaacacauaaaauuaguuucuaugaguguauaccauuuaaagaauuuuuuuuucaguaaaa

SEQ ID NO: 727066 - RNA, 61 nt, hsa
agauuuuuuuuuauuucaagaaaauuuugcuaccauuuaaguaagagaaggugagaaggau

SEQ ID NO: 727067 - RNA, 61 nt, hsa
aauguaauaaauuuuauuguauaaauauaucaccauuuacaugaggggaaacacuagccag

SEQ ID NO: 727068 - RNA, 61 nt, hsa
cuccuuucaguucguugguagagcccucagaaccauuuaagagacucuuuauuuuucucuu

SEQ ID NO: 727069 - RNA, 61 nt, hsa
gggauuacuuuugcagaaucauaauuuagcaaccauuuaucauggaugaaagagaucugua

SEQ ID NO: 727070 - RNA, 61 nt, hsa
uugugcagcaauagauuuuuaacuuuaacugaccauuuaaguuuuuuaauaaguuuuuuac

SEQ ID NO: 727071 - RNA, 61 nt, hsa
acaaguauugcaguaaucaucacuuacagguaccauuuauuucaaaacaacuuuuuuaguc

SEQ ID NO: 727072 - RNA, 61 nt, hsa
uuugagaagccaaauggaauuuuuaauggaaaccauuuaucagauuaaucucuugcucucc

SEQ ID NO: 727073 - RNA, 61 nt, hsa
aaacgauuuuuuguguccuuaaaauggcaugaccauuuauuugccccuuucuccauccugu

SEQ ID NO: 727074 - RNA, 61 nt, hsa
gucaauaaugaaacccaauuguaaaacagucaccauuuacuaccaguaacuuuuaguuaau

SEQ ID NO: 727075 - RNA, 61 nt, hsa
ccugacucugacaagaaagcauaagucucucaccauuuagugugauuuuagcuguggguuu

SEQ ID NO: 727076 - RNA, 61 nt, hsa
ccuguuaguuuucagucuccuuuucuuucucaccauuuaucacuucccucacugcccuacc

SEQ ID NO: 727077 - RNA, 61 nt, hsa
uuaagcuauaaauguguuaacauguauauauaccauuuauuauguucuacuuuagugauau

SEQ ID NO: 727078 - RNA, 61 nt, hsa
acguauguucauuauuuguacauaaaauaaaaccauuuaaaaaguaaugcugauauuuauu

SEQ ID NO: 727079 - RNA, 61 nt, hsa
gggaaacugggagacuuuaggaucuuaaaaaaccauuuaauaaaaaaaaaucuuugaaggg

SEQ ID NO: 727080 - RNA, 61 nt, hsa
aaaggaaacaguuuaaugguggaaaugaacuaccauuuauaacuucuguuuuuuuauugag

SEQ ID NO: 727081 - RNA, 61 nt, hsa
gcuauuaaaugucacaauccuuuaauuagaaaccauuuauuggccggacgcgguggcucac

SEQ ID NO: 727082 - RNA, 61 nt, hsa
cuccgucucaaaaaaaaaaaaaaaaaaagaaaccauuuauuuuaaaaaugauuagauugcu

SEQ ID NO: 727083 - RNA, 61 nt, hsa
ggagaauuuagguuuuuauuaguaccauaguaccauuuauacaaauuagaaaauguuauuu

SEQ ID NO: 727084 - RNA, 61 nt, hsa
aaagaaagaaauauuauugauucuauagaaaaccauuuaccaacugaaaggacacgaaguc

SEQ ID NO: 727085 - RNA, 61 nt, hsa
gauuuucuuaacucagauuuuaagccaaauaaccauuuaacacuaguauuuguuaaauggg

SEQ ID NO: 727086 - RNA, 61 nt, hsa
uaucaugccuaagggagacauuuaugauuaaaccauuuaugcuacauauaacuggggaaaa

SEQ ID NO: 727087 - RNA, 61 nt, hsa
uaagugguucucaucucuaauuaacugugaaaccauuuaauccaaacauguaagcacacac

SEQ ID NO: 727088 - RNA, 61 nt, hsa
agcuccacucggguggaguggaaguggccagaccauuuagacggacaggguccucacccua

SEQ ID NO: 727089 - RNA, 61 nt, hsa
gucagguacaaauacacuauagagucaaaauaccauuuacaaagaaaaucaaaagcauuuc

SEQ ID NO: 727090 - RNA, 61 nt, hsa
uguuagaauagugcuauauaucagguaugugaccauuuauuucagaaggcugaacauaaga

SEQ ID NO: 727091 - RNA, 61 nt, hsa
ugcaagaaacucuuuuauuaaacuuggaacaaccauuuaaaugaaggauuuugugagauag

SEQ ID NO: 727092 - RNA, 61 nt, hsa
uuguccauaucacaccaccaaaggcuuuuggaccauuuagcaucaugagccuaauggcuca

SEQ ID NO: 727093 - RNA, 61 nt, hsa
gaagaggaacugggccuguugcccuuucuguaccauuuauuugcucccaauguuuaugaua

SEQ ID NO: 727094 - RNA, 61 nt, hsa
auauaauuuugguugucaaauuccuaaugcaaccauuuagucuaaacuuagucauuuauuu

SEQ ID NO: 727095 - RNA, 61 nt, hsa
aaaacgaagggaaaagggaccacugaauugcaccauuuaagaugcugcuugaacaaauggg

SEQ ID NO: 727096 - RNA, 61 nt, hsa
ggaauaacucuguggcauuauugcauuauauaccauuuaucuguauuaacuuuggaaugua

SEQ ID NO: 727097 - RNA, 61 nt, hsa
uccucccuucuuucuuaaaguaauaaaauuuaccauuuaguucaagcuggcaauguggaca

SEQ ID NO: 727098 - RNA, 61 nt, hsa
uauccuuuuuuucuuuccugauuauccuaacaccauuuauucaauaaccuuguccauuuuc

SEQ ID NO: 727099 - RNA, 61 nt, hsa
uguggaagugaccacugggaugucaucauucaccauuuauccaggauggccgcucaccagg

SEQ ID NO: 727100 - RNA, 61 nt, hsa
ccacacuccauggagacucaguucuccuaggaccauuuauucaaaaggacugcccucucuu

SEQ ID NO: 727101 - RNA, 61 nt, hsa
aaggagagguagaugcauauuuuuguguggaaccauuuaucuuaaaacauugaggugcagu

SEQ ID NO: 727102 - RNA, 61 nt, hsa
gggugacauuuuuacucccuuuuuggggcuaaccauuuaugcuuuuguacaucaaccgugc

SEQ ID NO: 727103 - RNA, 61 nt, hsa
auacuaugaauguaaggauaugaguguuguuaccauuuagcccauugguugccaucuuuaa

SEQ ID NO: 727104 - RNA, 61 nt, hsa
ugucuaugcaugcacacccacaagccuauacaccauuuauauaccuacacgcacgcaagag

SEQ ID NO: 727105 - RNA, 61 nt, hsa
aaagaauauguugauuuaaaagccuuccaacaccauuuaaacaugguuuaucuucagcaaa

SEQ ID NO: 727106 - RNA, 61 nt, hsa
accacuuaaaguggaaucuaggcacuuuaucaccauuuagauccuauuaccuuuucucauc

SEQ ID NO: 727107 - RNA, 61 nt, hsa
ccagucuuccuucacuauuuuuuuuuccuucaccauuuaucauuucauagucauuuauguu

SEQ ID NO: 727108 - RNA, 61 nt, hsa
ugaucuguuuuucaccacuucacugaaagacaccauuuaucuacccaagggcagaaaguag

SEQ ID NO: 727109 - RNA, 61 nt, hsa
gaauuuuaaaaaagauggauuugacacacucaccauuuaaucauuuccagcaaaauauaug

SEQ ID NO: 727110 - RNA, 61 nt, hsa
ucaccuucucggcaacuaagcagucccugagaccauuuaacaugcaacccgaagguuaugg

SEQ ID NO: 727111 - RNA, 61 nt, hsa
cuggaaaccguuauuugcaaacauugcuguuaccauuuagaaauaugugcacuaucagcug

SEQ ID NO: 727112 - RNA, 61 nt, hsa
auuuagcaccugccagaugccagaaauuuauaccauuuaaaacucaguaagucuuuuaaau

SEQ ID NO: 727113 - RNA, 61 nt, hsa
ugagaaaucguugcugcacccuucccccagcaccauuuaugagucucaaguuuuauuauug

SEQ ID NO: 727114 - RNA, 61 nt, hsa
ccauucugugugugucggggggacagagggaaccauuuaagaaaagauaccaaaguagaag

SEQ ID NO: 727115 - RNA, 61 nt, hsa
uguauuuuccuugcaaauauuggaguuauaaaccauuuacuuuguguucuacugaguaaga

SEQ ID NO: 727116 - RNA, 61 nt, hsa
ccagcauucuaaaggaggguuugugauugucaccauuuacugaugaggaaacuaaggcucc

SEQ ID NO: 727117 - RNA, 61 nt, hsa
gcaccaugauagguugcacgcugccuguaccaccauuuacuuaauguuuucuuuaaauggc

SEQ ID NO: 727118 - RNA, 61 nt, hsa
aaaaauuuccaaguuguuagaguuuuuaauaaccauuuaauucaugaaaauaucauuaauc

SEQ ID NO: 727119 - RNA, 61 nt, hsa
ucauauauagaauuuacgggagaaacuugagaccauuuacggggagaaacuugauucuggg

SEQ ID NO: 727120 - RNA, 61 nt, hsa
aauuagcacagcugauguaaaauucuaaauuaccauuuacuuccagauagagcagaggaga

SEQ ID NO: 727121 - RNA, 61 nt, hsa
ggaaaugugauuaauuuaaucaugcagauaaaccauuuaaaugucagucucccaguuuuuc

SEQ ID NO: 727122 - RNA, 61 nt, hsa
uuguucugugucacucggcccuggguagucuaccauuuacuucaccccaaguccugcugcc

SEQ ID NO: 727123 - RNA, 61 nt, hsa
ugcacauugcuuuagaucacauucgugauuuaccauuuaauuaacugguaaccucaaaauu

SEQ ID NO: 727124 - RNA, 61 nt, hsa
gguggucucauccauuccuuugcuuuuucauaccauuuauuuguuaaugauucccacauuu

SEQ ID NO: 727125 - RNA, 61 nt, hsa
cccugccauuuuagugucuugguguaguguaaccauuuagugguugguggcaacaauuuua

SEQ ID NO: 727126 - RNA, 61 nt, hsa
ucagcaaauaccuaugucaacaguauaaguuaccauuuacucuauaaucugcagugaugca

SEQ ID NO: 727127 - RNA, 61 nt, hsa
uugugguaacuguagucaucuuaaauuucaaaccauuuaccaucugaaaguuuugauuuga

SEQ ID NO: 727128 - RNA, 61 nt, hsa
cuauguuauaguccagucuacuucuuuaaaaaccauuuaaacugcuagauaguauuagaau

SEQ ID NO: 727129 - RNA, 61 nt, hsa
auuauauuuuauuuaucuuuguagccuaaagaccauuuaaucuugaaggaacacaaagauc

SEQ ID NO: 727130 - RNA, 61 nt, hsa
guuggccauauuacugccacacaugagaagcaccauuuaugcagauuuucuucagaauauu

SEQ ID NO: 727131 - RNA, 61 nt, hsa
ucauaccuuaauuuuuuuuuuuuuuuuuuuuaccauuuaugauuuauucuccuauguguca

SEQ ID NO: 727132 - RNA, 61 nt, hsa
gaacuuauuaaauggaaacugaaacuacugcaccauuuaaaaacaggcagcucauaagagc

SEQ ID NO: 727133 - RNA, 61 nt, hsa
acauguaucauuuuacaaaugagcuuucaagaccauuuaaggaaacagaugcuucauuugc

SEQ ID NO: 727134 - RNA, 61 nt, hsa
agagaacauguugcuauaauguuccccagaaaccauuuauuaauugguaugaacaugagac

SEQ ID NO: 727135 - RNA, 61 nt, hsa
ccauuccagcaaauuccccgugucuguggucaccauuuaggugaucauacaggacaggcug

SEQ ID NO: 727136 - RNA, 61 nt, hsa
acuguauuguuacagcugaaagacaguaaagaccauuuaguccucaccuucuguuuuagag

SEQ ID NO: 727137 - RNA, 61 nt, hsa
ggccauacucagggguccaggaagaauuuguaccauuuaauggguugggagucuuggccaa

SEQ ID NO: 727138 - RNA, 61 nt, hsa
acaacaaugaauaaauaaggagaacuuggaaaccauuuauguagugaugugggauaaccuu

SEQ ID NO: 727139 - RNA, 61 nt, hsa
guaagaaauaaacaaugaaagcgaugaggggaccauuuacauaaaacacagagcuuagaca

SEQ ID NO: 727140 - RNA, 61 nt, hsa
aagugcugcagggcuuuaaaauucucuuccaaccauuuaucuugaaggaaaaauucaauag

SEQ ID NO: 727141 - RNA, 61 nt, hsa
uuauggagacaaagugaaaacauaaaaugugaccauuuaacuuauggcuaagaaauggacu

SEQ ID NO: 727142 - RNA, 61 nt, hsa
aagaaccuccccuuucccuucccccaauaagaccauuuaaguguguguuaaacaacuacag

SEQ ID NO: 727143 - RNA, 61 nt, hsa
uugcuuguugauuggaaagaguguuuuauucaccauuuaaacguuugcaaaguggcgugcc

SEQ ID NO: 727144 - RNA, 61 nt, hsa
acauauagaauuaauacaaaacaguuuaacaaccauuuaacugcaguguaagaaaauugga

SEQ ID NO: 727145 - RNA, 65 nt, hsa; identical to SEQ ID NO: 277870

SEQ ID NO: 727146 - RNA, 65 nt, hsa; identical to SEQ ID NO: 277871

SEQ ID NO: 727147 - RNA, 65 nt, hsa; identical to SEQ ID NO: 277872

SEQ ID NO: 727148 - RNA, 65 nt, hsa; identical to SEQ ID NO: 277873

SEQ ID NO: 727149 - RNA, 65 nt, hsa; identical to SEQ ID NO: 277874

SEQ ID NO: 727150 - RNA, 65 nt, hsa; identical to SEQ ID NO: 277875

SEQ ID NO: 727151 - RNA, 65 nt, hsa; identical to SEQ ID NO: 277876

SEQ ID NO: 727152 - RNA, 65 nt, hsa; identical to SEQ ID NO: 277877

SEQ ID NO: 727153 - RNA, 65 nt, hsa; identical to SEQ ID NO: 277878

SEQ ID NO: 727154 - RNA, 65 nt, hsa; identical to SEQ ID NO: 277879

SEQ ID NO: 727155 - RNA, 65 nt, hsa; identical to SEQ ID NO: 277880

SEQ ID NO: 727156 - RNA, 65 nt, hsa; identical to SEQ ID NO: 277881

SEQ ID NO: 727157 - RNA, 65 nt, hsa; identical to SEQ ID NO: 277882

SEQ ID NO: 727158 - RNA, 65 nt, hsa; identical to SEQ ID NO: 277883

SEQ ID NO: 727159 - RNA, 65 nt, hsa; identical to SEQ ID NO: 277884

SEQ ID NO: 727160 - RNA, 65 nt, hsa; identical to SEQ ID NO: 277885

SEQ ID NO: 727161 - RNA, 65 nt, hsa; identical to SEQ ID NO: 277886

SEQ ID NO: 727162 - RNA, 65 nt, hsa; identical to SEQ ID NO: 277887

SEQ ID NO: 727163 - RNA, 65 nt, hsa; identical to SEQ ID NO: 277888

SEQ ID NO: 727164 - RNA, 65 nt, hsa; identical to SEQ ID NO: 277889

SEQ ID NO: 727165 - RNA, 65 nt, hsa; identical to SEQ ID NO: 277890

SEQ ID NO: 727166 - RNA, 65 nt, hsa; identical to SEQ ID NO: 277891

SEQ ID NO: 727167 - RNA, 65 nt, hsa; identical to SEQ ID NO: 277892

SEQ ID NO: 727168 - RNA, 65 nt, hsa; identical to SEQ ID NO: 277893

SEQ ID NO: 727169 - RNA, 65 nt, hsa; identical to SEQ ID NO: 277894

SEQ ID NO: 727170 - RNA, 65 nt, hsa; identical to SEQ ID NO: 277895

SEQ ID NO: 727171 - RNA, 65 nt, hsa; identical to SEQ ID NO: 277896

SEQ ID NO: 727172 - RNA, 65 nt, hsa; identical to SEQ ID NO: 277897

SEQ ID NO: 727173 - RNA, 65 nt, hsa; identical to SEQ ID NO: 277898

SEQ ID NO: 727174 - RNA, 65 nt, hsa; identical to SEQ ID NO: 277899

SEQ ID NO: 727175 - RNA, 65 nt, hsa; identical to SEQ ID NO: 277900

SEQ ID NO: 727176 - RNA, 65 nt, hsa; identical to SEQ ID NO: 277901

SEQ ID NO: 727177 - RNA, 65 nt, hsa; identical to SEQ ID NO: 277902

SEQ ID NO: 727178 - RNA, 65 nt, hsa; identical to SEQ ID NO: 277903

SEQ ID NO: 727179 - RNA, 65 nt, hsa; identical to SEQ ID NO: 277904

SEQ ID NO: 727180 - RNA, 65 nt, hsa; identical to SEQ ID NO: 277905

SEQ ID NO: 727181 - RNA, 65 nt, hsa; identical to SEQ ID NO: 277906

SEQ ID NO: 727182 - RNA, 65 nt, hsa; identical to SEQ ID NO: 277907

SEQ ID NO: 727183 - RNA, 65 nt, hsa; identical to SEQ ID NO: 277908

SEQ ID NO: 727184 - RNA, 65 nt, hsa; identical to SEQ ID NO: 277909

SEQ ID NO: 727185 - RNA, 65 nt, hsa; identical to SEQ ID NO: 277910

SEQ ID NO: 727186 - RNA, 65 nt, hsa; identical to SEQ ID NO: 277911

SEQ ID NO: 727187 - RNA, 65 nt, hsa; identical to SEQ ID NO: 277912

SEQ ID NO: 727188 - RNA, 65 nt, hsa; identical to SEQ ID NO: 277913

SEQ ID NO: 727189 - RNA, 65 nt, hsa; identical to SEQ ID NO: 277914

SEQ ID NO: 727190 - RNA, 65 nt, hsa; identical to SEQ ID NO: 277915

SEQ ID NO: 727191 - RNA, 65 nt, hsa; identical to SEQ ID NO: 277916

SEQ ID NO: 727192 - RNA, 65 nt, hsa; identical to SEQ ID NO: 277917

SEQ ID NO: 727193 - RNA, 65 nt, hsa; identical to SEQ ID NO: 277918

SEQ ID NO: 727194 - RNA, 65 nt, hsa; identical to SEQ ID NO: 277919

SEQ ID NO: 727195 - RNA, 65 nt, hsa; identical to SEQ ID NO: 277920

SEQ ID NO: 727196 - RNA, 65 nt, hsa; identical to SEQ ID NO: 277921

SEQ ID NO: 727197 - RNA, 65 nt, hsa; identical to SEQ ID NO: 277922

SEQ ID NO: 727198 - RNA, 65 nt, hsa; identical to SEQ ID NO: 277923

SEQ ID NO: 727199 - RNA, 65 nt, hsa; identical to SEQ ID NO: 277924

SEQ ID NO: 727200 - RNA, 65 nt, hsa; identical to SEQ ID NO: 277925

SEQ ID NO: 727201 - RNA, 65 nt, hsa; identical to SEQ ID NO: 277926

SEQ ID NO: 727202 - RNA, 65 nt, hsa; identical to SEQ ID NO: 277927

SEQ ID NO: 727203 - RNA, 65 nt, hsa; identical to SEQ ID NO: 277928

SEQ ID NO: 727204 - RNA, 65 nt, hsa; identical to SEQ ID NO: 277929

SEQ ID NO: 727205 - RNA, 65 nt, hsa; identical to SEQ ID NO: 277930

SEQ ID NO: 727206 - RNA, 65 nt, hsa; identical to SEQ ID NO: 277931

SEQ ID NO: 727207 - RNA, 65 nt, hsa; identical to SEQ ID NO: 277932

SEQ ID NO: 727208 - RNA, 65 nt, hsa; identical to SEQ ID NO: 277933

SEQ ID NO: 727209 - RNA, 65 nt, hsa; identical to SEQ ID NO: 277934

SEQ ID NO: 727210 - RNA, 65 nt, hsa; identical to SEQ ID NO: 277935

SEQ ID NO: 727211 - RNA, 65 nt, hsa; identical to SEQ ID NO: 277936

SEQ ID NO: 727212 - RNA, 65 nt, hsa; identical to SEQ ID NO: 277937

SEQ ID NO: 727213 - RNA, 65 nt, hsa; identical to SEQ ID NO: 277938

SEQ ID NO: 727214 - RNA, 65 nt, hsa; identical to SEQ ID NO: 277939

SEQ ID NO: 727215 - RNA, 65 nt, hsa; identical to SEQ ID NO: 277940

SEQ ID NO: 727216 - RNA, 65 nt, hsa; identical to SEQ ID NO: 277941

SEQ ID NO: 727217 - RNA, 65 nt, hsa; identical to SEQ ID NO: 277942

SEQ ID NO: 727218 - RNA, 65 nt, hsa; identical to SEQ ID NO: 277943

SEQ ID NO: 727219 - RNA, 65 nt, hsa; identical to SEQ ID NO: 277944

SEQ ID NO: 727220 - RNA, 65 nt, hsa; identical to SEQ ID NO: 277945

SEQ ID NO: 727221 - RNA, 65 nt, hsa; identical to SEQ ID NO: 277946

SEQ ID NO: 727222 - RNA, 65 nt, hsa; identical to SEQ ID NO: 277947

SEQ ID NO: 727223 - RNA, 65 nt, hsa; identical to SEQ ID NO: 277948

SEQ ID NO: 727224 - RNA, 65 nt, hsa; identical to SEQ ID NO: 277949

SEQ ID NO: 727225 - RNA, 65 nt, hsa; identical to SEQ ID NO: 277950

SEQ ID NO: 727226 - RNA, 65 nt, hsa; identical to SEQ ID NO: 277951

SEQ ID NO: 727227 - RNA, 65 nt, hsa; identical to SEQ ID NO: 277952

SEQ ID NO: 727228 - RNA, 65 nt, hsa; identical to SEQ ID NO: 277953

SEQ ID NO: 727229 - RNA, 65 nt, hsa; identical to SEQ ID NO: 277954

SEQ ID NO: 727230 - RNA, 65 nt, hsa; identical to SEQ ID NO: 277955

SEQ ID NO: 727231 - RNA, 65 nt, hsa; identical to SEQ ID NO: 277956

SEQ ID NO: 727232 - RNA, 65 nt, hsa; identical to SEQ ID NO: 277957

SEQ ID NO: 727233 - RNA, 65 nt, hsa; identical to SEQ ID NO: 277958

SEQ ID NO: 727234 - RNA, 65 nt, hsa; identical to SEQ ID NO: 277959

SEQ ID NO: 727235 - RNA, 65 nt, hsa; identical to SEQ ID NO: 277960

SEQ ID NO: 727236 - RNA, 65 nt, hsa; identical to SEQ ID NO: 277961

SEQ ID NO: 727237 - RNA, 65 nt, hsa; identical to SEQ ID NO: 277962

SEQ ID NO: 727238 - RNA, 65 nt, hsa; identical to SEQ ID NO: 277963

SEQ ID NO: 727239 - RNA, 65 nt, hsa; identical to SEQ ID NO: 277964

SEQ ID NO: 727240 - RNA, 65 nt, hsa; identical to SEQ ID NO: 277965

SEQ ID NO: 727241 - RNA, 65 nt, hsa; identical to SEQ ID NO: 277966

SEQ ID NO: 727242 - RNA, 65 nt, hsa; identical to SEQ ID NO: 277967

SEQ ID NO: 727243 - RNA, 65 nt, hsa; identical to SEQ ID NO: 277968

SEQ ID NO: 727244 - RNA, 65 nt, hsa; identical to SEQ ID NO: 277969

SEQ ID NO: 727245 - RNA, 65 nt, hsa; identical to SEQ ID NO: 277970

SEQ ID NO: 727246 - RNA, 65 nt, hsa; identical to SEQ ID NO: 277971

SEQ ID NO: 727247 - RNA, 65 nt, hsa; identical to SEQ ID NO: 277972

SEQ ID NO: 727248 - RNA, 65 nt, hsa; identical to SEQ ID NO: 277973

SEQ ID NO: 727249 - RNA, 65 nt, hsa; identical to SEQ ID NO: 277974

SEQ ID NO: 727250 - RNA, 65 nt, hsa; identical to SEQ ID NO: 277975

SEQ ID NO: 727251 - RNA, 65 nt, hsa; identical to SEQ ID NO: 277976

SEQ ID NO: 727252 - RNA, 65 nt, hsa; identical to SEQ ID NO: 277977

SEQ ID NO: 727253 - RNA, 65 nt, hsa; identical to SEQ ID NO: 277978

SEQ ID NO: 727254 - RNA, 65 nt, hsa; identical to SEQ ID NO: 277979

SEQ ID NO: 727255 - RNA, 65 nt, hsa; identical to SEQ ID NO: 277980

SEQ ID NO: 727256 - RNA, 65 nt, hsa; identical to SEQ ID NO: 277981

SEQ ID NO: 727257 - RNA, 65 nt, hsa; identical to SEQ ID NO: 277982

SEQ ID NO: 727258 - RNA, 65 nt, hsa; identical to SEQ ID NO: 277983

SEQ ID NO: 727259 - RNA, 56 nt, hsa; identical to SEQ ID NO: 277656

SEQ ID NO: 727260 - RNA, 65 nt, hsa; identical to SEQ ID NO: 277985

SEQ ID NO: 727261 - RNA, 65 nt, hsa; identical to SEQ ID NO: 277986

SEQ ID NO: 727262 - RNA, 65 nt, hsa; identical to SEQ ID NO: 277987

SEQ ID NO: 727263 - RNA, 65 nt, hsa; identical to SEQ ID NO: 277988

SEQ ID NO: 727264 - RNA, 65 nt, hsa; identical to SEQ ID NO: 277989

SEQ ID NO: 727265 - RNA, 65 nt, hsa; identical to SEQ ID NO: 277990

SEQ ID NO: 727266 - RNA, 65 nt, hsa; identical to SEQ ID NO: 277991

SEQ ID NO: 727267 - RNA, 65 nt, hsa; identical to SEQ ID NO: 277992

SEQ ID NO: 727268 - RNA, 65 nt, hsa; identical to SEQ ID NO: 277993

SEQ ID NO: 727269 - RNA, 65 nt, hsa; identical to SEQ ID NO: 277994

SEQ ID NO: 727270 - RNA, 65 nt, hsa; identical to SEQ ID NO: 277995

SEQ ID NO: 727271 - RNA, 65 nt, hsa; identical to SEQ ID NO: 277996

SEQ ID NO: 727272 - RNA, 65 nt, hsa; identical to SEQ ID NO: 277997

SEQ ID NO: 727273 - RNA, 65 nt, hsa; identical to SEQ ID NO: 277998

SEQ ID NO: 727274 - RNA, 65 nt, hsa; identical to SEQ ID NO: 277999

SEQ ID NO: 727275 - RNA, 65 nt, hsa; identical to SEQ ID NO: 278000

SEQ ID NO: 727276 - RNA, 65 nt, hsa; identical to SEQ ID NO: 278001

SEQ ID NO: 727277 - RNA, 65 nt, hsa; identical to SEQ ID NO: 278002

SEQ ID NO: 727278 - RNA, 65 nt, hsa; identical to SEQ ID NO: 278003

SEQ ID NO: 727279 - RNA, 65 nt, hsa; identical to SEQ ID NO: 278004

SEQ ID NO: 727280 - RNA, 65 nt, hsa; identical to SEQ ID NO: 278005

SEQ ID NO: 727281 - RNA, 65 nt, hsa; identical to SEQ ID NO: 278006

SEQ ID NO: 727282 - RNA, 65 nt, hsa; identical to SEQ ID NO: 278007

SEQ ID NO: 727283 - RNA, 65 nt, hsa; identical to SEQ ID NO: 278008

SEQ ID NO: 727284 - RNA, 65 nt, hsa; identical to SEQ ID NO: 278009

SEQ ID NO: 727285 - RNA, 65 nt, hsa; identical to SEQ ID NO: 278010

SEQ ID NO: 727286 - RNA, 65 nt, hsa; identical to SEQ ID NO: 278011

SEQ ID NO: 727287 - RNA, 65 nt, hsa; identical to SEQ ID NO: 278012

SEQ ID NO: 727288 - RNA, 65 nt, hsa; identical to SEQ ID NO: 278013

SEQ ID NO: 727289 - RNA, 65 nt, hsa; identical to SEQ ID NO: 278014

SEQ ID NO: 727290 - RNA, 65 nt, hsa; identical to SEQ ID NO: 278015

SEQ ID NO: 727291 - RNA, 65 nt, hsa; identical to SEQ ID NO: 278016

SEQ ID NO: 727292 - RNA, 65 nt, hsa; identical to SEQ ID NO: 278017

SEQ ID NO: 727293 - RNA, 65 nt, hsa; identical to SEQ ID NO: 278018

SEQ ID NO: 727294 - RNA, 65 nt, hsa; identical to SEQ ID NO: 278019

SEQ ID NO: 727295 - RNA, 65 nt, hsa; identical to SEQ ID NO: 278020

SEQ ID NO: 727296 - RNA, 65 nt, hsa; identical to SEQ ID NO: 278021

SEQ ID NO: 727297 - RNA, 65 nt, hsa; identical to SEQ ID NO: 278022

SEQ ID NO: 727298 - RNA, 65 nt, hsa; identical to SEQ ID NO: 278023

SEQ ID NO: 727299 - RNA, 65 nt, hsa; identical to SEQ ID NO: 278024

SEQ ID NO: 727300 - RNA, 65 nt, hsa; identical to SEQ ID NO: 278025

SEQ ID NO: 727301 - RNA, 65 nt, hsa; identical to SEQ ID NO: 278026

SEQ ID NO: 727302 - RNA, 65 nt, hsa; identical to SEQ ID NO: 278027

SEQ ID NO: 727303 - RNA, 65 nt, hsa; identical to SEQ ID NO: 278028

SEQ ID NO: 727304 - RNA, 65 nt, hsa; identical to SEQ ID NO: 278029

SEQ ID NO: 727305 - RNA, 65 nt, hsa; identical to SEQ ID NO: 278030

SEQ ID NO: 727306 - RNA, 65 nt, hsa; identical to SEQ ID NO: 278031

SEQ ID NO: 727307 - RNA, 65 nt, hsa; identical to SEQ ID NO: 278032

SEQ ID NO: 727308 - RNA, 65 nt, hsa; identical to SEQ ID NO: 278033

SEQ ID NO: 727309 - RNA, 65 nt, hsa; identical to SEQ ID NO: 278034

SEQ ID NO: 727310 - RNA, 65 nt, hsa; identical to SEQ ID NO: 278035

SEQ ID NO: 727311 - RNA, 65 nt, hsa; identical to SEQ ID NO: 278036

SEQ ID NO: 727312 - RNA, 65 nt, hsa; identical to SEQ ID NO: 278037

SEQ ID NO: 727313 - RNA, 65 nt, hsa; identical to SEQ ID NO: 278038

SEQ ID NO: 727314 - RNA, 65 nt, hsa; identical to SEQ ID NO: 278039

SEQ ID NO: 727315 - RNA, 65 nt, hsa; identical to SEQ ID NO: 278040

SEQ ID NO: 727316 - RNA, 65 nt, hsa; identical to SEQ ID NO: 278041

SEQ ID NO: 727317 - RNA, 65 nt, hsa; identical to SEQ ID NO: 278042

SEQ ID NO: 727318 - RNA, 65 nt, hsa; identical to SEQ ID NO: 278043

SEQ ID NO: 727319 - RNA, 65 nt, hsa; identical to SEQ ID NO: 278044

SEQ ID NO: 727320 - RNA, 65 nt, hsa; identical to SEQ ID NO: 278045

SEQ ID NO: 727321 - RNA, 65 nt, hsa; identical to SEQ ID NO: 278046

SEQ ID NO: 727322 - RNA, 65 nt, hsa; identical to SEQ ID NO: 278047

SEQ ID NO: 727323 - RNA, 65 nt, hsa; identical to SEQ ID NO: 278048

SEQ ID NO: 727324 - RNA, 65 nt, hsa; identical to SEQ ID NO: 278049

SEQ ID NO: 727325 - RNA, 65 nt, hsa; identical to SEQ ID NO: 278050

SEQ ID NO: 727326 - RNA, 65 nt, hsa; identical to SEQ ID NO: 278051

SEQ ID NO: 727327 - RNA, 65 nt, hsa; identical to SEQ ID NO: 278052

SEQ ID NO: 727328 - RNA, 65 nt, hsa; identical to SEQ ID NO: 278053

SEQ ID NO: 727329 - RNA, 65 nt, hsa; identical to SEQ ID NO: 278054

SEQ ID NO: 727330 - RNA, 65 nt, hsa; identical to SEQ ID NO: 278055

SEQ ID NO: 727331 - RNA, 65 nt, hsa; identical to SEQ ID NO: 278056

SEQ ID NO: 727332 - RNA, 65 nt, hsa; identical to SEQ ID NO: 278057

SEQ ID NO: 727333 - RNA, 65 nt, hsa; identical to SEQ ID NO: 278058

SEQ ID NO: 727334 - RNA, 65 nt, hsa; identical to SEQ ID NO: 278059

SEQ ID NO: 727335 - RNA, 65 nt, hsa; identical to SEQ ID NO: 278060

SEQ ID NO: 727336 - RNA, 65 nt, hsa; identical to SEQ ID NO: 278061

SEQ ID NO: 727337 - RNA, 65 nt, hsa; identical to SEQ ID NO: 278062

SEQ ID NO: 727338 - RNA, 65 nt, hsa; identical to SEQ ID NO: 278063

SEQ ID NO: 727339 - RNA, 65 nt, hsa; identical to SEQ ID NO: 278064

SEQ ID NO: 727340 - RNA, 65 nt, hsa; identical to SEQ ID NO: 278065

SEQ ID NO: 727341 - RNA, 65 nt, hsa; identical to SEQ ID NO: 278066

SEQ ID NO: 727342 - RNA, 65 nt, hsa; identical to SEQ ID NO: 278067

SEQ ID NO: 727343 - RNA, 65 nt, hsa; identical to SEQ ID NO: 278068

SEQ ID NO: 727344 - RNA, 65 nt, hsa; identical to SEQ ID NO: 278069

SEQ ID NO: 727345 - RNA, 65 nt, hsa; identical to SEQ ID NO: 278070

SEQ ID NO: 727346 - RNA, 65 nt, hsa; identical to SEQ ID NO: 278071

SEQ ID NO: 727347 - RNA, 65 nt, hsa; identical to SEQ ID NO: 278072

SEQ ID NO: 727348 - RNA, 65 nt, hsa; identical to SEQ ID NO: 278073

SEQ ID NO: 727349 - RNA, 65 nt, hsa; identical to SEQ ID NO: 278074

SEQ ID NO: 727350 - RNA, 65 nt, hsa; identical to SEQ ID NO: 278075

SEQ ID NO: 727351 - RNA, 65 nt, hsa; identical to SEQ ID NO: 278076

SEQ ID NO: 727352 - RNA, 65 nt, hsa; identical to SEQ ID NO: 278077

SEQ ID NO: 727353 - RNA, 65 nt, hsa; identical to SEQ ID NO: 278078

SEQ ID NO: 727354 - RNA, 65 nt, hsa; identical to SEQ ID NO: 278079

SEQ ID NO: 727355 - RNA, 65 nt, hsa; identical to SEQ ID NO: 278080

SEQ ID NO: 727356 - RNA, 65 nt, hsa; identical to SEQ ID NO: 278081

SEQ ID NO: 727357 - RNA, 65 nt, hsa; identical to SEQ ID NO: 278082

SEQ ID NO: 727358 - RNA, 65 nt, hsa; identical to SEQ ID NO: 278083

SEQ ID NO: 727359 - RNA, 65 nt, hsa; identical to SEQ ID NO: 278084

SEQ ID NO: 727360 - RNA, 65 nt, hsa; identical to SEQ ID NO: 278085

SEQ ID NO: 727361 - RNA, 65 nt, hsa; identical to SEQ ID NO: 278086

SEQ ID NO: 727362 - RNA, 65 nt, hsa; identical to SEQ ID NO: 278087

SEQ ID NO: 727363 - RNA, 65 nt, hsa; identical to SEQ ID NO: 278088

SEQ ID NO: 727364 - RNA, 65 nt, hsa; identical to SEQ ID NO: 278089

SEQ ID NO: 727365 - RNA, 65 nt, hsa; identical to SEQ ID NO: 278090

SEQ ID NO: 727366 - RNA, 65 nt, hsa; identical to SEQ ID NO: 278091

SEQ ID NO: 727367 - RNA, 65 nt, hsa; identical to SEQ ID NO: 278092

SEQ ID NO: 727368 - RNA, 65 nt, hsa; identical to SEQ ID NO: 278093

SEQ ID NO: 727369 - RNA, 65 nt, hsa; identical to SEQ ID NO: 278094

SEQ ID NO: 727370 - RNA, 65 nt, hsa; identical to SEQ ID NO: 278095

SEQ ID NO: 727371 - RNA, 65 nt, hsa; identical to SEQ ID NO: 278096

SEQ ID NO: 727372 - RNA, 65 nt, hsa; identical to SEQ ID NO: 278097

SEQ ID NO: 727373 - RNA, 65 nt, hsa; identical to SEQ ID NO: 278098

SEQ ID NO: 727374 - RNA, 65 nt, hsa; identical to SEQ ID NO: 278099

SEQ ID NO: 727375 - RNA, 65 nt, hsa; identical to SEQ ID NO: 278100

SEQ ID NO: 727376 - RNA, 65 nt, hsa; identical to SEQ ID NO: 278101

SEQ ID NO: 727377 - RNA, 65 nt, hsa; identical to SEQ ID NO: 278102

SEQ ID NO: 727378 - RNA, 65 nt, hsa; identical to SEQ ID NO: 278103

SEQ ID NO: 727379 - RNA, 65 nt, hsa; identical to SEQ ID NO: 278104

SEQ ID NO: 727380 - RNA, 65 nt, hsa; identical to SEQ ID NO: 278105

SEQ ID NO: 727381 - RNA, 65 nt, hsa; identical to SEQ ID NO: 278106

SEQ ID NO: 727382 - RNA, 65 nt, hsa; identical to SEQ ID NO: 278107

SEQ ID NO: 727383 - RNA, 65 nt, hsa; identical to SEQ ID NO: 278108

SEQ ID NO: 727384 - RNA, 52 nt, hsa; identical to SEQ ID NO: 277781

SEQ ID NO: 727385 - RNA, 65 nt, hsa; identical to SEQ ID NO: 278110

SEQ ID NO: 727386 - RNA, 65 nt, hsa; identical to SEQ ID NO: 278111

SEQ ID NO: 727387 - RNA, 65 nt, hsa; identical to SEQ ID NO: 278112

SEQ ID NO: 727388 - RNA, 65 nt, hsa; identical to SEQ ID NO: 278113

SEQ ID NO: 727389 - RNA, 65 nt, hsa; identical to SEQ ID NO: 278114

SEQ ID NO: 727390 - RNA, 65 nt, hsa; identical to SEQ ID NO: 278115

SEQ ID NO: 727391 - RNA, 65 nt, hsa; identical to SEQ ID NO: 278116

SEQ ID NO: 727392 - RNA, 65 nt, hsa; identical to SEQ ID NO: 278117

SEQ ID NO: 727393 - RNA, 65 nt, hsa; identical to SEQ ID NO: 278118

SEQ ID NO: 727394 - RNA, 65 nt, hsa; identical to SEQ ID NO: 278119

SEQ ID NO: 727395 - RNA, 65 nt, hsa; identical to SEQ ID NO: 278120

SEQ ID NO: 727396 - RNA, 65 nt, hsa; identical to SEQ ID NO: 278121

SEQ ID NO: 727397 - RNA, 65 nt, hsa; identical to SEQ ID NO: 278122

SEQ ID NO: 727398 - RNA, 65 nt, hsa; identical to SEQ ID NO: 278123

SEQ ID NO: 727399 - RNA, 65 nt, hsa; identical to SEQ ID NO: 278124

SEQ ID NO: 727400 - RNA, 65 nt, hsa; identical to SEQ ID NO: 278125

SEQ ID NO: 727401 - RNA, 65 nt, hsa; identical to SEQ ID NO: 278126

SEQ ID NO: 727402 - RNA, 65 nt, hsa; identical to SEQ ID NO: 278127

SEQ ID NO: 727403 - RNA, 65 nt, hsa; identical to SEQ ID NO: 278128

SEQ ID NO: 727404 - RNA, 65 nt, hsa; identical to SEQ ID NO: 278129

SEQ ID NO: 727405 - RNA, 65 nt, hsa; identical to SEQ ID NO: 278130

SEQ ID NO: 727406 - RNA, 65 nt, hsa; identical to SEQ ID NO: 278131

SEQ ID NO: 727407 - RNA, 65 nt, hsa; identical to SEQ ID NO: 278132

SEQ ID NO: 727408 - RNA, 65 nt, hsa; identical to SEQ ID NO: 278133

SEQ ID NO: 727409 - RNA, 65 nt, hsa; identical to SEQ ID NO: 278134

SEQ ID NO: 727410 - RNA, 65 nt, hsa; identical to SEQ ID NO: 278135

SEQ ID NO: 727411 - RNA, 65 nt, hsa; identical to SEQ ID NO: 278136

SEQ ID NO: 727412 - RNA, 65 nt, hsa; identical to SEQ ID NO: 278137

SEQ ID NO: 727413 - RNA, 65 nt, hsa; identical to SEQ ID NO: 278138

SEQ ID NO: 727414 - RNA, 65 nt, hsa; identical to SEQ ID NO: 278139

SEQ ID NO: 727415 - RNA, 65 nt, hsa; identical to SEQ ID NO: 278140

SEQ ID NO: 727416 - RNA, 65 nt, hsa; identical to SEQ ID NO: 278141

SEQ ID NO: 727417 - RNA, 65 nt, hsa; identical to SEQ ID NO: 278142

SEQ ID NO: 727418 - RNA, 65 nt, hsa; identical to SEQ ID NO: 278143

SEQ ID NO: 727419 - RNA, 65 nt, hsa; identical to SEQ ID NO: 278144

SEQ ID NO: 727420 - RNA, 65 nt, hsa; identical to SEQ ID NO: 278145

SEQ ID NO: 727421 - RNA, 65 nt, hsa; identical to SEQ ID NO: 278146

SEQ ID NO: 727422 - RNA, 65 nt, hsa; identical to SEQ ID NO: 278147

SEQ ID NO: 727423 - RNA, 65 nt, hsa; identical to SEQ ID NO: 278148

SEQ ID NO: 727424 - RNA, 65 nt, hsa; identical to SEQ ID NO: 278149

SEQ ID NO: 727425 - RNA, 65 nt, hsa; identical to SEQ ID NO: 278150

SEQ ID NO: 727426 - RNA, 65 nt, hsa; identical to SEQ ID NO: 278151

SEQ ID NO: 727427 - RNA, 65 nt, hsa; identical to SEQ ID NO: 278152

SEQ ID NO: 727428 - RNA, 65 nt, hsa; identical to SEQ ID NO: 278153

SEQ ID NO: 727429 - RNA, 65 nt, hsa; identical to SEQ ID NO: 278154

SEQ ID NO: 727430 - RNA, 65 nt, hsa; identical to SEQ ID NO: 278155

SEQ ID NO: 727431 - RNA, 65 nt, hsa; identical to SEQ ID NO: 278156

SEQ ID NO: 727432 - RNA, 65 nt, hsa; identical to SEQ ID NO: 278157

SEQ ID NO: 727433 - RNA, 65 nt, hsa; identical to SEQ ID NO: 278158

SEQ ID NO: 727434 - RNA, 65 nt, hsa; identical to SEQ ID NO: 278159

SEQ ID NO: 727435 - RNA, 65 nt, hsa; identical to SEQ ID NO: 278160

SEQ ID NO: 727436 - RNA, 65 nt, hsa; identical to SEQ ID NO: 278161

SEQ ID NO: 727437 - RNA, 65 nt, hsa; identical to SEQ ID NO: 278162

SEQ ID NO: 727438 - RNA, 65 nt, hsa; identical to SEQ ID NO: 278163

SEQ ID NO: 727439 - RNA, 65 nt, hsa; identical to SEQ ID NO: 278164

SEQ ID NO: 727440 - RNA, 65 nt, hsa; identical to SEQ ID NO: 278165

SEQ ID NO: 727441 - RNA, 65 nt, hsa; identical to SEQ ID NO: 278166

SEQ ID NO: 727442 - RNA, 65 nt, hsa; identical to SEQ ID NO: 278167

SEQ ID NO: 727443 - RNA, 65 nt, hsa; identical to SEQ ID NO: 278168

SEQ ID NO: 727444 - RNA, 65 nt, hsa; identical to SEQ ID NO: 278169

SEQ ID NO: 727445 - RNA, 65 nt, hsa; identical to SEQ ID NO: 278170

SEQ ID NO: 727446 - RNA, 65 nt, hsa; identical to SEQ ID NO: 278171

SEQ ID NO: 727447 - RNA, 65 nt, hsa; identical to SEQ ID NO: 278172

SEQ ID NO: 727448 - RNA, 65 nt, hsa; identical to SEQ ID NO: 278173

SEQ ID NO: 727449 - RNA, 65 nt, hsa; identical to SEQ ID NO: 278174

SEQ ID NO: 727450 - RNA, 65 nt, hsa; identical to SEQ ID NO: 278175

SEQ ID NO: 727451 - RNA, 65 nt, hsa; identical to SEQ ID NO: 278176

SEQ ID NO: 727452 - RNA, 65 nt, hsa; identical to SEQ ID NO: 278177

SEQ ID NO: 727453 - RNA, 65 nt, hsa; identical to SEQ ID NO: 278178

SEQ ID NO: 727454 - RNA, 65 nt, hsa; identical to SEQ ID NO: 278179

SEQ ID NO: 727455 - RNA, 65 nt, hsa; identical to SEQ ID NO: 278180

SEQ ID NO: 727456 - RNA, 65 nt, hsa; identical to SEQ ID NO: 278181

SEQ ID NO: 727457 - RNA, 65 nt, hsa; identical to SEQ ID NO: 278182

SEQ ID NO: 727458 - RNA, 65 nt, hsa; identical to SEQ ID NO: 278183

SEQ ID NO: 727459 - RNA, 65 nt, hsa; identical to SEQ ID NO: 278184

SEQ ID NO: 727460 - RNA, 65 nt, hsa; identical to SEQ ID NO: 278185

SEQ ID NO: 727461 - RNA, 65 nt, hsa; identical to SEQ ID NO: 278186

SEQ ID NO: 727462 - RNA, 65 nt, hsa; identical to SEQ ID NO: 278187

SEQ ID NO: 727463 - RNA, 65 nt, hsa; identical to SEQ ID NO: 278188

SEQ ID NO: 727464 - RNA, 65 nt, hsa; identical to SEQ ID NO: 278189

SEQ ID NO: 727465 - RNA, 65 nt, hsa; identical to SEQ ID NO: 278190

SEQ ID NO: 727466 - RNA, 65 nt, hsa; identical to SEQ ID NO: 278191

SEQ ID NO: 727467 - RNA, 65 nt, hsa; identical to SEQ ID NO: 278192

SEQ ID NO: 727468 - RNA, 65 nt, hsa; identical to SEQ ID NO: 278193

SEQ ID NO: 727469 - RNA, 65 nt, hsa; identical to SEQ ID NO: 278194

SEQ ID NO: 727470 - RNA, 65 nt, hsa; identical to SEQ ID NO: 278195

SEQ ID NO: 727471 - RNA, 65 nt, hsa; identical to SEQ ID NO: 278196

SEQ ID NO: 727472 - RNA, 65 nt, hsa; identical to SEQ ID NO: 278197

SEQ ID NO: 727473 - RNA, 63 nt, hsa
ccuagaugacugccugugcagagacacaguuugcaccauuagccuuaccugcccugcccugau

SEQ ID NO: 727474 - RNA, 63 nt, hsa
ggauguuuccaccuccuucuccaaccucuaccccaccauuaguguauuuuacuauaaaaacag

SEQ ID NO: 727475 - RNA, 63 nt, hsa
ccgggaggcggagguugcagugagcugagaucgcaccauuacacuccagccugggcaacagag

SEQ ID NO: 727476 - RNA, 63 nt, hsa
ccuucaaguccuuuccaccucucacccauugcccaccauuaauaagcuuagcuucucuugcca

SEQ ID NO: 727477 - RNA, 63 nt, hsa
ugucacuccucugcucagaaaccuucaaugguucaccauuaccaguggaaugaagucaauucu

SEQ ID NO: 727478 - RNA, 63 nt, hsa
aacuuccucccucuaugcccaccccugacacuucaccauuaaucuuaacacagaacaugaggu

SEQ ID NO: 727479 - RNA, 63 nt, hsa
uauggcuguauuugcuguugauucagacuuucacaccauuaauggggaaaagcguggccacaa

SEQ ID NO: 727480 - RNA, 63 nt, hsa
gaaugccacuuuggcugaacuacaaguguaggccaccauuauaauuuauaaauacagcauacu

SEQ ID NO: 727481 - RNA, 63 nt, hsa
uucuauuguuuauauuguuaaaaugagcuugugcaccauuagguccugcuggguguucucagu

SEQ ID NO: 727482 - RNA, 63 nt, hsa
augucaaagaaaaauugagauaaacauuuuguucaccauuaaauguuugcaucugcagucuau

SEQ ID NO: 727483 - RNA, 63 nt, hsa
gggauugacuuuauuuuuuuauagugcuuaauucaccauuaugagaaaugcuuccagucacaa

SEQ ID NO: 727484 - RNA, 63 nt, hsa
cuggugucauugacuaaccacauccacaaagcacaccauuaauccacuaugaucaaguugggg

SEQ ID NO: 727485 - RNA, 63 nt, hsa
caucugcgggcagagaaggucuaguuuguccaacaccauuaugauaucaggacugguuacuug

SEQ ID NO: 727486 - RNA, 63 nt, hsa
uuagucugcccaccuuucuaggcugggcuuggccaccauuaaacacggggugggggugagggc

SEQ ID NO: 727487 - RNA, 63 nt, hsa
ugaaugaauggccuucccuucucaggcuauucccaccauuagucugcccaccuuucuaggcug

SEQ ID NO: 727488 - RNA, 63 nt, hsa
aaagacccuucgguguccaucuacaguaaaccccaccauuaccuucuaguuggcauaaaaaca

SEQ ID NO: 727489 - RNA, 63 nt, hsa
ugucucuagaagagaaugaaggauugaagaauucaccauuagaggacauuuagcgugaugaaa

SEQ ID NO: 727490 - RNA, 63 nt, hsa
caucauauagaccucugcccuucagaguagccucaccauuaguggcagcaucauguaacugag

SEQ ID NO: 727491 - RNA, 63 nt, hsa
ugggcuugcuauucugucccuagguguuuuguucaccauuauaaugaauuuagugagcauagg

SEQ ID NO: 727492 - RNA, 63 nt, hsa
gcugcuaauaugcuacuuaaccaucuauuaaugcaccauuaaaggcuuagcauuuaaguagca

SEQ ID NO: 727493 - RNA, 63 nt, hsa
uuagaaaccagaaugcuuuguuuuuaccagauucaccauuagagguugauggggcaacugcag

SEQ ID NO: 727494 - RNA, 63 nt, hsa
gcaaaauuacacaagaaaacaguauugcaaugacaccauuacauaaggaacauugaacuguua

SEQ ID NO: 727495 - RNA, 63 nt, hsa
aauuaauugcuggagacuacaauuccuggcaaacaccauuauuccagaugcaccaugcuaccc

SEQ ID NO: 727496 - RNA, 63 nt, hsa
uagguauuaauagauauguaaagaaagaaaucacaccauuaauaaugguaagauugguuuaug

SEQ ID NO: 727497 - RNA, 63 nt, hsa
ccuuucaaacauccccaaagucauggccauacucaccauuagccaguuucuaacaucuguuuc

SEQ ID NO: 727498 - RNA, 63 nt, hsa
aaaaaaaauuguaucucauuacuuauacugggacaccauuaccaaaauaauaaaaaucacuuu

SEQ ID NO: 727499 - RNA, 63 nt, hsa
aauuauuucaguuggguuuuucuuuuuuuuugccaccauuauaaauugccacaauuacuuuua

SEQ ID NO: 727500 - RNA, 63 nt, hsa
gguaaacacucgauaaucuggauaacugacuagcaccauuaugaucaccaguauuguggcugg

SEQ ID NO: 727501 - RNA, 63 nt, hsa
uaucuacucacucauacagccagcccaccagcccaccauuaacucacugaacaaugagacaau

SEQ ID NO: 727502 - RNA, 63 nt, hsa
auaguagcgaggaggauuuucuguuuuggaaaacaccauuagaaccagaccagcuuuguuuug

SEQ ID NO: 727503 - RNA, 63 nt, hsa
gucuuuagcucacauacauuccacggugggggacaccauuaguccagacaccgcuguggagau

SEQ ID NO: 727504 - RNA, 63 nt, hsa
gaagggauauuuaaacuugcuacuguuguucaacaccauuaauggucagugugaaccauuaca

SEQ ID NO: 727505 - RNA, 63 nt, hsa
acaaaacacuccaaguuucagcaguuuuagcgccaccauuaacccacuuugcuugucucauga

SEQ ID NO: 727506 - RNA, 63 nt, hsa
gaauagaaggugaguucuggaagugcaaagaagcaccauuaagugcaucuucuagaaguugua

SEQ ID NO: 727507 - RNA, 63 nt, hsa
aacacuauuagauaauaagugcuuauuguuuaacaccauuaauuuugaguauaauuuguuaca

SEQ ID NO: 727508 - RNA, 63 nt, hsa
uuucucucuauaaguuucugucauugaacagaucaccauuaaaaagaauauuagaauccagca

SEQ ID NO: 727509 - RNA, 63 nt, hsa
ggcacaaccaugaauaaaaauacaauucucuugcaccauuaaauaguguguuaagugcuacgg

SEQ ID NO: 727510 - RNA, 63 nt, hsa
aguaaaacaaagaaguuuaaagacuggcagguacaccauuaucacauaagugcugucaguaua

SEQ ID NO: 727511 - RNA, 63 nt, hsa
uaagucaaaaaauuaauacaccaaggauaucggcaccauuacacaaaaugccauuaagugaag

SEQ ID NO: 727512 - RNA, 63 nt, hsa
acaaggggaagugguguuuaccuacuuguucaucaccauuauugaaagccguacugaucaguu

SEQ ID NO: 727513 - RNA, 63 nt, hsa
auacaaagagcggagaauucugccuuguuuguucaccauuauuaguuuggcgauuugauggua

SEQ ID NO: 727514 - RNA, 63 nt, hsa
uagucaggaaaaacauucaggaauagauuuauacaccauuauuguuuuauuuuuaaauuuuca

SEQ ID NO: 727515 - RNA, 63 nt, hsa
cacauuacaauaauauaccauaggaggcacaagcaccauuauuaagccacuuugcuuacaccu

SEQ ID NO: 727516 - RNA, 63 nt, hsa
aacaguuugcuauaagaaacauaccagauuagccaccauuagcaucuauaucuacuuuguguu

SEQ ID NO: 727517 - RNA, 63 nt, hsa
uuuuguauuuuauuugggcaucuggaauugacacaccauuacauucuguuugcaggauuuuuu

SEQ ID NO: 727518 - RNA, 63 nt, hsa
gucacuugauuugcuagcugguggcagaauuggcaccauuacccaggucugacugaccaccag

SEQ ID NO: 727519 - RNA, 63 nt, hsa
auuuuaacaguaggaauuuaauguuaauuuuugcaccauuaauuuagcaaaggccaucuacaa

SEQ ID NO: 727520 - RNA, 63 nt, hsa
auaauggcucguguuuauguugaagauaaauagcaccauuauugggggaaguuauucaaaagc

SEQ ID NO: 727521 - RNA, 63 nt, hsa
ccaagaguauacuccaccgagaaccaccagccacaccauuauaccagaaggcggaucccccaa

SEQ ID NO: 727522 - RNA, 63 nt, hsa
guuccugccuaucuggaguuuaaaugcguaauacaccauuaauuuccacgcugcaguuuuuau

SEQ ID NO: 727523 - RNA, 63 nt, hsa
uuaaaauuucacucuggcauaugauuuaucuaucaccauuacuuuuuuuuaagucacaauuuc

SEQ ID NO: 727524 - RNA, 63 nt, hsa
uuaaccacaaaauacagcaagugcaccuauauucaccauuaacuuauaucccaaguccauuuu

SEQ ID NO: 727525 - RNA, 63 nt, hsa
ugaauaaaauaauuguaaugagugcuaaaugggcaccauuauucgaaucagauaccuuuuaua

SEQ ID NO: 727526 - RNA, 63 nt, hsa
auaacuuuaccaacauuggaaaacagccaacuacaccauuaguaauauauuugauuacauuuu

SEQ ID NO: 727527 - RNA, 63 nt, hsa
cagaauagaaccacugguuaaacauauuuuauucaccauuaagugaucuuuaucaauauucug

SEQ ID NO: 727528 - RNA, 63 nt, hsa
agaucuggaauggucgccaugauugaaaccacgcaccauuacaucaucauuacauuaauuaca

SEQ ID NO: 727529 - RNA, 63 nt, hsa
ucuuacucauuugcuagguuguaaauuugauuucaccauuaagaaaagguaaauuggauauaa

SEQ ID NO: 727530 - RNA, 63 nt, hsa
uuggcagacugguguuguucaucgcaguguggacaccauuacccacccccguuccccugaggu

SEQ ID NO: 727531 - RNA, 63 nt, hsa
aaugaccugugguuuaacccuuuugaucacuaccaccauuaucagcaccagacugagcagcua

SEQ ID NO: 727532 - RNA, 63 nt, hsa
uuagaucgggucucggaagggaaguagccaucacaccauuaaaaagccuguggaccuuuuucu

SEQ ID NO: 727533 - RNA, 63 nt, hsa
cacugagucugcccugggcucugauaaaaccuucaccauuaacuugcugugugaccuugggca

SEQ ID NO: 727534 - RNA, 63 nt, hsa
aagcaaagaccauuugauaaaagccugaguugucaccauuaugucuuaagcuguuagucuuaa

SEQ ID NO: 727535 - RNA, 63 nt, hsa
cgaagggaaggugcuguacaguucauuccuuugcaccauuagccaaucugucuuuuauggauu

SEQ ID NO: 727536 - RNA, 63 nt, hsa
ccucaaagacuugaucggagaauacucuuguuucaccauuauguugguacaguauaguaccau

SEQ ID NO: 727537 - RNA, 63 nt, hsa
ccaucaccuuaaccaagugacaaaguccuagcacaccauuaaugguaggauaacugacauuaa

SEQ ID NO: 727538 - RNA, 63 nt, hsa
ggugaauggcuuuguauagaaccucuuugucuacaccauuaugugcgcugauaagcguucaug

SEQ ID NO: 727539 - RNA, 63 nt, hsa
acugcuuguguaucagacuuacguuacugucaucaccauuaaaagaauugcagcuuugugccc

SEQ ID NO: 727540 - RNA, 63 nt, hsa
ucucuacucccucuugucaguguagacacaggucaccauuaugcugguguauguuuaucaaag

SEQ ID NO: 727541 - RNA, 63 nt, hsa
uaauaauaauaaaaugaaagaaacaaucaccaccaccauuauuaaacuguaacuugucuagua

SEQ ID NO: 727542 - RNA, 63 nt, hsa
uuccccuacccccaaggaugccaggaagacguccaccauuagccauguggcaaccuuuacuuc

SEQ ID NO: 727543 - RNA, 63 nt, hsa
ucauguccuuuuaugcuguagagacuuuucuuucaccauuacuuucugauaucuaguacacag

SEQ ID NO: 727544 - RNA, 63 nt, hsa
accugggaauaacauuagcaggcugauguccugcaccauuauguuuacuaaucacauguucug

SEQ ID NO: 727545 - RNA, 63 nt, hsa
agaagauggagacucuuaggcaagaauguuuuucaccauuauucucucacaaugauuuuaugu

SEQ ID NO: 727546 - RNA, 63 nt, hsa
ucucauaggacuaucuccaccacccccaguuagcaccauuaacuccuccugagcucugauaac

SEQ ID NO: 727547 - RNA, 63 nt, hsa
ucucacgggacuauuuccaccacccccaguuagcaccauuaacuccuccugagcucugauaag

SEQ ID NO: 727548 - RNA, 63 nt, hsa
ccagccuggcagcccagcguuuugggcugaaaccaccauuacuuuggcuguuucaucucuaag

SEQ ID NO: 727549 - RNA, 63 nt, hsa
uuuugcauucuauugcuaguauugauucagguacaccauuaagauacaacauucuagaagucu

SEQ ID NO: 727550 - RNA, 63 nt, hsa
uuaguguacauuuauguuccuuuauuuaggaaacaccauuauaaaaacacuuauaguaaaugg

SEQ ID NO: 727551 - RNA, 63 nt, hsa
agcaggaaagaucaaaaacgcauacccuaacaucaccauuaaaaggaugagagaagcaagagc

SEQ ID NO: 727552 - RNA, 63 nt, hsa
cccagcaccuuaccccaggacuuggucuucaaccaccauuaccccucuaacuuugcacaaaua

SEQ ID NO: 727553 - RNA, 63 nt, hsa
acaagagaacugucucauagucauggaaugcaucaccauuaagacaaaagcaauguguucaug

SEQ ID NO: 727554 - RNA, 63 nt, hsa
gugcgacagaaugcaguuagaaucaguucauaucaccauuaaaaucauccauucagaaaccaa

SEQ ID NO: 727555 - RNA, 63 nt, hsa
gcugaagaaauccaaggauacagucucagaggacaccauuaggcuaauagagaaacagguacu

SEQ ID NO: 727556 - RNA, 63 nt, hsa
cuaccuucccuccuggaaccacacuacuugaaucaccauuacuuugccucgcuggcagaguug

SEQ ID NO: 727557 - RNA, 63 nt, hsa
acugaauuagauuuucccauuucuaauaguuggcaccauuauaagcuauaagguucagaauca

SEQ ID NO: 727558 - RNA, 63 nt, hsa
ucaggaaagcuuucacacugguauuugugaucucaccauuaugacauccaucccccuagcuca

SEQ ID NO: 727559 - RNA, 63 nt, hsa
gcacacacacagaaaccacgagguaguuuaaaucaccauuaaaaaucaacgcuuucucugauu

SEQ ID NO: 727560 - RNA, 63 nt, hsa
aaucacacgcagccccuccccgccacagagacacaccauuacauacacagacacacacagaaa

SEQ ID NO: 727561 - RNA, 63 nt, hsa
aaucgcagauacgcccuuccggccacagaaacacaccauuacacacacauacacagaaagaca

SEQ ID NO: 727562 - RNA, 63 nt, hsa
aaucacacacacacccuccccgccacagagacacaccauuacauacacagacacgcaaucgca

SEQ ID NO: 727563 - RNA, 63 nt, hsa
aaaaucacacacacacccuccccgccacagagacaccauuacauacacagacacacacagaaa

SEQ ID NO: 727564 - RNA, 63 nt, hsa
caaaucacacacacccccuccccaccacagagacaccauuacauacacagacacacacagaaa

SEQ ID NO: 727565 - RNA, 63 nt, hsa
gugaaaaucagaucuauuuuguuugccauuagucaccauuaguuauauaaauuuuauuguuuu

SEQ ID NO: 727566 - RNA, 63 nt, hsa
cccuagcagacuuuuacuucucuuacacugcuacaccauuacuuucuugagacauuuguaagu

SEQ ID NO: 727567 - RNA, 59 nt, hsa
accugaacccuauauuuuaacauagaggucaccauuauccauuuaauggucuuauaacu

SEQ ID NO: 727568 - RNA, 63 nt, hsa
gcuuuuugaggcucgccaggucccuuuuguuuucaccauuaaaauuccaaacccaaagccuuu

SEQ ID NO: 727569 - RNA, 63 nt, hsa
cuugaacagauauuuguacaccagcguuuauaacaccauuauuuacaguagccaaaagguaga

SEQ ID NO: 727570 - RNA, 63 nt, hsa
ccuuuaaauuguaaauuaaggauuacucaagcucaccauuauucaagauugggacucgcuucc

SEQ ID NO: 727571 - RNA, 63 nt, hsa
uacuucaauuuguuaccacaacuugcugaaauacaccauuauuauuuguuguaugcaauacug

SEQ ID NO: 727572 - RNA, 63 nt, hsa
uaugauuguuauuauuuguccaaucaagcaaagcaccauuauuucuaacauauaaaagaccag

SEQ ID NO: 727573 - RNA, 63 nt, hsa
aauguggacaugaagauugggguguaacaccuacaccauuaucuuggaaagaaacaaccguug

SEQ ID NO: 727574 - RNA, 63 nt, hsa
gcccagcuacuccuuuaccugugagaagaucuucaccauuaggaagaucucuagacccccaga

SEQ ID NO: 727575 - RNA, 63 nt, hsa
ggccgugauacauuuuuuaauucauuuguuuuccaccauuauauuuuuauacuuuucaguuag

SEQ ID NO: 727576 - RNA, 63 nt, hsa
ucuuuuccugaaacuuuuuaugaauggcuauggcaccauuaaugcugcugaauaucuuuaaac

SEQ ID NO: 727577 - RNA, 63 nt, hsa
ugucuucucuacauggcauaaagcggcaaagcccaccauuaggugaggcggucccgaguugag

SEQ ID NO: 727578 - RNA, 63 nt, hsa
gugaggaugaugaaguagauacagucuucaggacaccauuagaugggcuuucccaauaggcca

SEQ ID NO: 727579 - RNA, 63 nt, hsa
uuaugauaugguacaguucuuuguacagaaaggcaccauuauguuagaauaaauuuccagaac

SEQ ID NO: 727580 - RNA, 63 nt, hsa
auauuuguggaaucagauaaaacuaaaagauuucaccauuacagcccugccucauaacuaaau

SEQ ID NO: 727581 - RNA, 63 nt, hsa
agccagccacauuucccugugucuggcuagagccaccauuagacucagacagaaugcuucagg

SEQ ID NO: 727582 - RNA, 63 nt, hsa
auccaaaucaacacaaugcacucugcaguuagacaccauuauuuuuucuuaccuaauauacug

SEQ ID NO: 727583 - RNA, 63 nt, hsa
aggcugguugggaccucuacagcuucauucuuucaccauuaaauaguggccuuuuucaguauu

SEQ ID NO: 727584 - RNA, 63 nt, hsa
uucuacucaaacacuaaucccccauucucuaaucaccauuauuaaucauaucaagucaauuag

SEQ ID NO: 727585 - RNA, 63 nt, hsa
uugaacugauaguuacuguugugaccugaaguucaccauuaaaagggauuacccaagcaaaau

SEQ ID NO: 727586 - RNA, 63 nt, hsa
gucuugcauggacauuugugauucucauuuucucaccauuaaauuaccuuggaggguagggcu

SEQ ID NO: 727587 - RNA, 63 nt, hsa
auugccuggcauuugguaguauaguaugauucucaccauuauuugucauggaggcagacauac

SEQ ID NO: 727588 - RNA, 63 nt, hsa
aggggaagaaaaagcuauuguuuacaauuauaucaccauuaaggcaacugcuacacccugcuu

SEQ ID NO: 727589 - RNA, 63 nt, hsa
aacuccuaugcaucccuuagaacccugcucagacaccauuacuuuugugaacgcuucugccac

SEQ ID NO: 727590 - RNA, 63 nt, hsa
agucagaaaacacaccuggaauacgaugcagcccaccauuaacucauucauguaguuuauuca

SEQ ID NO: 727591 - RNA, 63 nt, hsa
gaauuaggagcauaguuuuuuccauuuaaacgucaccauuacuuaaaagaugauugauuauug

SEQ ID NO: 727592 - RNA, 63 nt, hsa
gaaucaggaaacuuuaguuauuuauaguauaaucaccauuaucuguuuaaaggauccauuuag

SEQ ID NO: 727593 - RNA, 63 nt, hsa
ucacauugaauaguggaacauuuucauaugauacaccauuauguuuaagauauauuuccaaga

SEQ ID NO: 727594 - RNA, 63 nt, hsa
auuuucugccacagguaacaugauuguuugacacaccauuauauuuaauucuaguuucucuca

SEQ ID NO: 727595 - RNA, 63 nt, hsa
uuuucuauauggauugaccacagucuuaucuuccaccauuaagcuguauaacaauaaaauguu

SEQ ID NO: 727596 - RNA, 63 nt, hsa
uagcaggggauguucucugauuuauuccacuggcaccauuagugaauauuuaguuguuuucau

SEQ ID NO: 727597 - RNA, 63 nt, hsa
gaccuuuucuuugcauuuguuuugaaugucuaacaccauuagcuuuugugaucugguuaagaa

SEQ ID NO: 727598 - RNA, 63 nt, hsa
cuaccugacaguauuugacaguguccuuuccagcaccauuauuugggucuuucaggguggcca

SEQ ID NO: 727599 - RNA, 63 nt, hsa
ccugcagggaguggccaacucuccaccuuccagcaccauuaucagagggugggaaaaggcaca

SEQ ID NO: 727600 - RNA, 63 nt, hsa
gaagaaguuucagugaacuuucaaaaccauaaacaccauuaucuaacuucaugaaccagaaug

SEQ ID NO: 727601 - RNA, 63 nt, hsa
ucauuuucccccauagaagagaaaaaagagcaccaccauuauuaccaccuccccaacccuaca

SEQ ID NO: 727602 - RNA, 63 nt, hsa
auccaccaugcuaaugacacuugccuuuuuuuccaccauuaaggcuuuaagaacauguggaau

SEQ ID NO: 727603 - RNA, 63 nt, hsa
ucugguuuuggaaaauuuccagauaagacaugucaccauuaauucucaacgacugcucuauuu

SEQ ID NO: 727604 - RNA, 63 nt, hsa
uuuugacuagauuagacaaacaguuaauagauccaccauuaggaaucaauauauuaugucaua

SEQ ID NO: 727605 - RNA, 63 nt, hsa
auauguauccauuagucugacagaucgccugaacaccauuaagagguguggcguuuuugcuuu

SEQ ID NO: 727606 - RNA, 63 nt, hsa
gccuucccugaaucaaaauaaucuuucauucgucaccauuauacuaaugaacaauagauuuca

SEQ ID NO: 727607 - RNA, 63 nt, hsa
guuuuggccauggauaaagugaagaggccuacucaccauuaucccugcagcgugacaccuuuu

SEQ ID NO: 727608 - RNA, 63 nt, hsa
ugauccugccagauucccagaggauucucacgccaccauuaccucacucagugugaccuggag

SEQ ID NO: 727609 - RNA, 63 nt, hsa
aauagccuaggaagugcccucgagcacugaagucaccauuaggucacuuaagaaguaagcaac

SEQ ID NO: 727610 - RNA, 63 nt, hsa
cuguuugauauucuuacaaaagauguuuauguccaccauuaucucaucagggcugugcugaau

SEQ ID NO: 727611 - RNA, 63 nt, hsa
aaaacagaagguauuaaaaaaacaagagauucccaccauuauuuagguucaccugcaaaacaa

SEQ ID NO: 727612 - RNA, 63 nt, hsa
auguggugacugaagccagaggugauguacuuucaccauuagcuuaauuuuaacuuaaaauua

SEQ ID NO: 727613 - RNA, 63 nt, hsa
ugagagguuuugcuagggccuauuauuuuuaaccaccauuaauuaguugggguggaguuuacu

SEQ ID NO: 727614 - RNA, 63 nt, hsa
gcucaaagguacugacacaguugauuuuauucacaccauuagggguaugcaagaugucccugu

SEQ ID NO: 727615 - RNA, 63 nt, hsa
gacuaggagacuauaaacaguagucuauuggaacaccauuagcaugacuuuuaagcacaguaa

SEQ ID NO: 727616 - RNA, 63 nt, hsa
aagcugucugauagagaacuuucaggcagaucccaccauuagccuguaaacaaaagguguggc

SEQ ID NO: 727617 - RNA, 63 nt, hsa
gaaguuuccagaaagaagagaggacacaucucccaccauuaccagagggucaaaggagaacaa

SEQ ID NO: 727618 - RNA, 61 nt, hsa
ugaaaagggcaaggcccugauguauagguugcaccauuacucagacuucuaaagagacuau

SEQ ID NO: 727619 - RNA, 63 nt, hsa
guccaacggacaagaaaaaagcaaagucaacgacaccauuaucuugucaagaucagaugguuu

SEQ ID NO: 727620 - RNA, 63 nt, hsa
acugugucgucuccgugccagauguggcaagaucaccauuagcaaauggaaauuacauuugaa

SEQ ID NO: 727621 - RNA, 63 nt, hsa
aaguugucugauagagaacuuucaggcagaucccaccauuagccuguaaacaaaaaguuuggc

SEQ ID NO: 727622 - RNA, 63 nt, hsa
aaaauacaucuacuaggcuguuagccaaagcaucaccauuacaaguccaugaauguuaaaaug

SEQ ID NO: 727623 - RNA, 63 nt, hsa
aagcucuccgauagagaacuuucaggcagaucccaccauuagccuguaaacaaaagguuuggc

SEQ ID NO: 727624 - RNA, 63 nt, hsa
auugaaaacauguuugaacccuuauuuuaauugcaccauuaaaacauuugacuuaaauuguuu

SEQ ID NO: 727625 - RNA, 63 nt, hsa
augacaaauuuuguguugacuugaaaggaaucacaccauuauuccuuagaaguaauuacaugu

SEQ ID NO: 727626 - RNA, 63 nt, hsa
uaucugcggguccuguccuuuucucaagaccuucaccauuacuggcauuuuccugucuucucu

SEQ ID NO: 727627 - RNA, 63 nt, hsa
ucacaaaaaugcccuagaaauauagauuuuaaucaccauuacauaaugacaaaccuuguuaaa

SEQ ID NO: 727628 - RNA, 63 nt, hsa
gaaaauccacugggaaauguaaaaaucuucacucaccauuaugauauuuaucuugaaagaaau

SEQ ID NO: 727629 - RNA, 63 nt, hsa
aacucuuuaucuuguaaaaugaaacucuauaaccaccauuaaaaaaacaacucauucccacau

SEQ ID NO: 727630 - RNA, 63 nt, hsa
acucugugcccuguuugguuguugacaaugaagcaccauuaugugacucuucauauaacccuu

SEQ ID NO: 727631 - RNA, 63 nt, hsa
uagaaaggcuuuuuaacuucugcagaacuuagucaccauuaggcaggguguuugacugaagaa

SEQ ID NO: 727632 - RNA, 63 nt, hsa
ggaauggggaggggguuuggcaaucucacuaaccaccauuaaacugaggagagaacaaguguu

SEQ ID NO: 727633 - RNA, 63 nt, hsa
acugaaucguuucauguaagaauccaaaguggacaccauuaacaggucuuugaaauaugcaug

SEQ ID NO: 727634 - RNA, 63 nt, hsa
uaaacguugcugucaaaagauuuaccaggucuacaccauuaugcuuauuauuuuuuuaauuau

SEQ ID NO: 727635 - RNA, 63 nt, hsa
cucugcacugcagcacagugaaugauaugcacucaccauuagcuucgacacagggacugaggg

SEQ ID NO: 727636 - RNA, 63 nt, hsa
augcccugccuguugagccccauucuacauccccaccauuaaccaggccccacccacaaggua

SEQ ID NO: 727637 - RNA, 63 nt, hsa
ugauuuggucauaaguaaggacuauauuuaugucaccauuauuagauauauguacuuuuguaa

SEQ ID NO: 727638 - RNA, 63 nt, hsa
aaacaaauggaaucucugauggcaaaagagaaucaccauuaaagauugacccauuugaagauc

SEQ ID NO: 727639 - RNA, 63 nt, hsa
gucagcaaauguaaaaauuuaauuucugaaaagcaccauuagcccauuucccccaaauuaaac

SEQ ID NO: 727640 - RNA, 63 nt, hsa
ugcacaauggucuuccuccaccccucugggaaucaccauuaggcaggccucaguagggcaaaa

SEQ ID NO: 727641 - RNA, 63 nt, hsa
ggaaagaggaggaaguccuaagcagagaaguagcaccauuauccccauuuaacagaagggaaa

SEQ ID NO: 727642 - RNA, 63 nt, hsa
caggauggggacaggaucaccugcccgggacaccaccauuaucauucuccucuagugacgcag

SEQ ID NO: 727643 - RNA, 63 nt, hsa
augaguaaaagaccgcuuuuaaaauggggaaggcaccauuaagccaaaaugaaucugaaaaaa

SEQ ID NO: 727644 - RNA, 63 nt, hsa
ccauaaaaauucccaguaugcauguuuuaugcucaccauuaugaauuggggucuucaaagaga

SEQ ID NO: 727645 - RNA, 63 nt, hsa
guagguggggguggggaggcccaaaugauggaucaccauuauauuuugaaagaagccaucaag

SEQ ID NO: 727646 - RNA, 63 nt, hsa
auaagguuuacgagcuaugagaauuggugcuaucaccauuagcuauuugcuguaaugucaaga

SEQ ID NO: 727647 - RNA, 63 nt, hsa
gcuaccgcgccuggccaugaugauauuauuaaacaccauuauucacauuucaaauaauaacaa

SEQ ID NO: 727648 - RNA, 63 nt, hsa
ucuaaauauugauuucugccuuccuugcuaaugcaccauuagaagauauuagucuuggggcag

SEQ ID NO: 727649 - RNA, 63 nt, hsa
aguaauaaugugauucucuauggcuucuagcuucaccauuaagcugcaguuaagggucuguca

SEQ ID NO: 727650 - RNA, 63 nt, hsa
uucugggcauuuuuuggccaguuuuuaauguaacaccauuagacacucaccagauguuuacaa

SEQ ID NO: 727651 - RNA, 63 nt, hsa
guuucauauuuaaguguauuuaaagaaaauaaacaccauuauucaagccauauaauuuuaugu

SEQ ID NO: 727652 - RNA, 63 nt, hsa
caaaaaaaaauaauauuuucaccauccagacgucaccauuauaaauucuuaguucagggcugg

SEQ ID NO: 727653 - RNA, 63 nt, hsa
auuauauucuaauaauuaugcauuauacuaagacaccauuaagaacaguugaggcacuacacu

SEQ ID NO: 727654 - RNA, 64 nt, hsa
gcucuguuuccuaauucaggaccccacucaucuagcccuccaagagccuccgccaaauuguagc

SEQ ID NO: 727655 - RNA, 64 nt, hsa
gagucaacaguccccugauccccuaccucugccugcccuccagccccaucaccagcuucuugcu

SEQ ID NO: 727656 - RNA, 64 nt, hsa
ggcacaucaguuaaugccagugaggucagcuucugcccuccagcaauacaugugcagggguugc

SEQ ID NO: 727657 - RNA, 64 nt, hsa
uuccccaucaugggcaaggaagggaauucccacagcccuccaguguacugaggguacuggccua

SEQ ID NO: 727658 - RNA, 64 nt, hsa
caguauuaccaccagacugacuccaggacucacugcccuccagaaaacagaggugacaaaugug

SEQ ID NO: 727659 - RNA, 55 nt, hsa; identical to SEQ ID NO: 540628

SEQ ID NO: 727660 - RNA, 64 nt, hsa
caagggugaauccuucccacacuccuccaugguugcccuccagggucuagcccagccuauuugu

SEQ ID NO: 727661 - RNA, 64 nt, hsa
uacccuggcgggccacccugccagccagcagcuggcccuccaccaucuucacauuccaagacug

SEQ ID NO: 727662 - RNA, 64 nt, hsa
ccaccuccuugcucuccccagccugccaagcccagcccuccagagccagcccuccuggguaccg

SEQ ID NO: 727663 - RNA, 64 nt, hsa
gagacuuuaugcccuccagagcuccaagauauaagcccuccaagggaucagaagcuccaaguuc

SEQ ID NO: 727664 - RNA, 64 nt, hsa
ccauccucucucaggaagcuucuagagacuuuaugcccuccagagcuccaagauauaagcccuc

SEQ ID NO: 727665 - RNA, 64 nt, hsa
guccacugcguuccugggaagggcugcgaggccugcccuccaaaccugacuggggaugggcggc

SEQ ID NO: 727666 - RNA, 64 nt, hsa
acgagcaggcgaacgccacccucaaucaguacccgcccuccaucaaugguggucgugugauuga

SEQ ID NO: 727667 - RNA, 64 nt, hsa
accagacacagcuguuguucggggcuguggaacugcccuccaagcugcuggucuacuugucggu

SEQ ID NO: 727668 - RNA, 64 nt, hsa
aagcagguccagaacuaagugggaguggaggcaggcccuccacagaagcucugcagcaggggcu

SEQ ID NO: 727669 - RNA, 64 nt, hsa
uccccguuacucaaauccuuggcacuacuacaaugcccuccauucuucagggcugagaauugac

SEQ ID NO: 727670 - RNA, 64 nt, hsa
guguuucaggagaggacugugcuggaucaugcuugcccuccacagggaauacagcauccuuaca

SEQ ID NO: 727671 - RNA, 64 nt, hsa
ugucuguggccuucuggggcaccgauucuaccaggcccuccagcugcguggucuccgcagacca

SEQ ID NO: 727672 - RNA, 64 nt, hsa
uuuccagcccuccggagagugggcuuggcccuaggcccuccagcucagccagaaaaagcccaga

SEQ ID NO: 727673 - RNA, 64 nt, hsa
gggcggggugggauuuuugcauaagcacuuugcugcccuccaguggcugcuugaggaaacgcag

SEQ ID NO: 727674 - RNA, 64 nt, hsa
caggcggcugggaucucaggcagggugugcgucagcccuccaacccccagaggggcgccugugg

SEQ ID NO: 727675 - RNA, 64 nt, hsa
gcuuccgccugccucccagcgaguacgucaucgugcccuccaccuacgagccccaccaggaggg

SEQ ID NO: 727676 - RNA, 64 nt, hsa
cugccgguggcacucagcaccuccuugugcuagagcccuccaucaccuucacgcugucccacca

SEQ ID NO: 727677 - RNA, 64 nt, hsa
uaucgacaaucugucagccgacgcagggcuggaggcccuccauuucccuccccuuuuaauuuau

SEQ ID NO: 727678 - RNA, 64 nt, hsa
aagcugcagcucugcucaacugcgucuucucucagcccuccacacacacucacccccacuccca

SEQ ID NO: 727679 - RNA, 64 nt, hsa
gcucuggggccagaauggcuguccuugucguagagcccuccacauuuucuuuuucuuuuuugag

SEQ ID NO: 727680 - RNA, 64 nt, hsa
gaacuacaagugugagccaccgcgccuggcccaagcccuccacauuuucaauccaggagccuug

SEQ ID NO: 727681 - RNA, 64 nt, hsa
ggcagauaaaccccaugaggggucaggcugaugugcccuccagcaguaucugagaagcugcuac

SEQ ID NO: 727682 - RNA, 64 nt, hsa
ggcccuccacuggccccagggcuggagcugcccugcccuccauaggcaacuggugcagggacug

SEQ ID NO: 727683 - RNA, 64 nt, hsa
ugcacuagcugacugugcuggcuggcucuggcuggcccuccacuggccccagggcuggagcugc

SEQ ID NO: 727684 - RNA, 64 nt, hsa
caagccguaccuggugaacugcguccgcaucccugcccuccagucccuccugcuuuuuagccgg

SEQ ID NO: 727685 - RNA, 64 nt, hsa
ccaggagcccugcccaccuccgugcagcugaccugcccuccagcccaggacuaggggcaggacu

SEQ ID NO: 727686 - RNA, 64 nt, hsa
accaggggaccucgggacugcgcgugaggccccggcccuccaaauccaaauccagacgcaggcc

SEQ ID NO: 727687 - RNA, 64 nt, hsa
gggcauggacugacugccaggcugcgugcgcccugcccuccacccagccuccuggacucggccu

SEQ ID NO: 727688 - RNA, 64 nt, hsa
cugguccccaucccugucucucccuuucacccuugcccuccaguccucuaccucuggccugccc

SEQ ID NO: 727689 - RNA, 64 nt, hsa
agguagagccugugcagccugggcugcugucauugcccuccaguaagggcucaggguuuugcuu

SEQ ID NO: 727690 - RNA, 64 nt, hsa
aggcaucuccacagccccggguccucugucuaacgcccuccauuucacgcccuccaucucacag

SEQ ID NO: 727691 - RNA, 64 nt, hsa
ccccggguccucugucuaacgcccuccauuucacgcccuccaucucacagucaagauaaaggcc

SEQ ID NO: 727692 - RNA, 63 nt, hsa
ggcaaagacuuacugguugguguucuugauaagggaagugagacaaaggagaagaaauuacuc

SEQ ID NO: 727693 - RNA, 63 nt, hsa
uguccagcugcuccaucgauauacucauagaauggaagugagcaaaggaaaauuuuaagccag

SEQ ID NO: 727694 - RNA, 63 nt, hsa
aaaugcuuaaauauauaauacauuuuuuuccauggaagugagggaauauuucaguuuccugaa

SEQ ID NO: 727695 - RNA, 63 nt, hsa
gagcacaauggugggcccucucuagacacauacggaagugauggccucaguagaagagacgca

SEQ ID NO: 727696 - RNA, 63 nt, hsa
agugcagccucugcccggccgccaccccgucugggaagugaggagcgucucugccuggcugcc

SEQ ID NO: 727697 - RNA, 63 nt, hsa
aggagcgucucugcccggccgccaucccaucuaggaagugaggagcgccucuucccacccgcc

SEQ ID NO: 727698 - RNA, 63 nt, hsa
aggagcgccucuucccacccgccaucccaucuaggaagugaggagcuucucugccuggccgcc

SEQ ID NO: 727699 - RNA, 63 nt, hsa
aggagccccucugcccagcagccacccugucugggaagugaggagcgucuccgcccggcagcc

SEQ ID NO: 727700 - RNA, 63 nt, hsa
gugaggggcgccucugcccagcugccccuacugggaagugaggagccccucugccccgccagc

SEQ ID NO: 727701 - RNA, 63 nt, hsa
gcgaggggcgccucugcccggcugccccuacugggaagugaggagccccucugcccggccagc

SEQ ID NO: 727702 - RNA, 63 nt, hsa
guuaggggcgccucugcccggccgccccuacugggaagugaggagccccucugcccggccacc

SEQ ID NO: 727703 - RNA, 63 nt, hsa
gaggacaugcaccaaggcuugccagagccaacaggaagugagcccagagcauggcacaugagc

SEQ ID NO: 727704 - RNA, 63 nt, hsa
guaucuguuuuuaauuuucauucuucacuuaggggaagugaaaucgcucagagaugagauccu

SEQ ID NO: 727705 - RNA, 63 nt, hsa
cuauuaaaacuacuguucauuuugggggcugggggaagugagccuguuuggaugauggaugcc

SEQ ID NO: 727706 - RNA, 63 nt, hsa
aauguagugccuuuaaaggaaaaaugaacacagggaagugacuuugcuacaaauaauguugcu

SEQ ID NO: 727707 - RNA, 63 nt, hsa
ugcagaaguuggguagagagguuaagaagaggaggaagugagacggggaagggaggagcaccu

SEQ ID NO: 727708 - RNA, 63 nt, hsa
cuucccagagcaagcaggcugcauuuuagcuauggaagugaccugcugugacacugugcucuc

SEQ ID NO: 727709 - RNA, 63 nt, hsa
ugccaccaaggcucgguccagcccaguaccgcuggaagugaauaaacuccggagggucggacg

SEQ ID NO: 727710 - RNA, 63 nt, hsa
ccacauagggagggcuuagagcucacagccuugggaagugagacuagaagaggggagcagaaa

SEQ ID NO: 727711 - RNA, 63 nt, hsa
aggagcgccucugcccggccgccaucccaucuaggaagugaggagcgccucuucccagccgcc

SEQ ID NO: 727712 - RNA, 63 nt, hsa
aggagcgccucuucccagccgccaucccaucuaggaagugaggagcgucucugcccggccgcc

SEQ ID NO: 727713 - RNA, 63 nt, hsa
aggagccccuccgcccggcagccaccccaucugggaagugaggagcgucuacgcccgggcagc

SEQ ID NO: 727714 - RNA, 63 nt, hsa
ugcccggccgccccugcccggccgccccuacugggaagugaggagccccucugccuggccacc

SEQ ID NO: 727715 - RNA, 63 nt, hsa
gggagcuguuccuggacagccuucuacugccugggaagugauggaacaggaacucagggugcc

SEQ ID NO: 727716 - RNA, 63 nt, hsa
ugccucucagaaacgcggccagaagacaagcagggaagugaaaggucccaggcacacacccug

SEQ ID NO: 727717 - RNA, 63 nt, hsa
aaagauguagcucuggcccagugggaaaaauuaggaagugauuauaaaucgagaggaguuaua

SEQ ID NO: 727718 - RNA, 63 nt, hsa
ucugaguaagaaacagaauccucuggaacuugaggaagugaacauuucggugacuuccgcauc

SEQ ID NO: 727719 - RNA, 64 nt, hsa; identical to SEQ ID NO: 727654

SEQ ID NO: 727720 - RNA, 64 nt, hsa; identical to SEQ ID NO: 727655

SEQ ID NO: 727721 - RNA, 64 nt, hsa; identical to SEQ ID NO: 727656

SEQ ID NO: 727722 - RNA, 64 nt, hsa; identical to SEQ ID NO: 727657

SEQ ID NO: 727723 - RNA, 64 nt, hsa; identical to SEQ ID NO: 727658

SEQ ID NO: 727724 - RNA, 55 nt, hsa; identical to SEQ ID NO: 540628

SEQ ID NO: 727725 - RNA, 64 nt, hsa; identical to SEQ ID NO: 727660

SEQ ID NO: 727726 - RNA, 64 nt, hsa; identical to SEQ ID NO: 727661

SEQ ID NO: 727727 - RNA, 64 nt, hsa; identical to SEQ ID NO: 727662

SEQ ID NO: 727728 - RNA, 64 nt, hsa; identical to SEQ ID NO: 727663

SEQ ID NO: 727729 - RNA, 64 nt, hsa; identical to SEQ ID NO: 727664

SEQ ID NO: 727730 - RNA, 64 nt, hsa; identical to SEQ ID NO: 727665

SEQ ID NO: 727731 - RNA, 64 nt, hsa; identical to SEQ ID NO: 727666

SEQ ID NO: 727732 - RNA, 64 nt, hsa; identical to SEQ ID NO: 727667

SEQ ID NO: 727733 - RNA, 64 nt, hsa; identical to SEQ ID NO: 727668

SEQ ID NO: 727734 - RNA, 64 nt, hsa; identical to SEQ ID NO: 727669

SEQ ID NO: 727735 - RNA, 64 nt, hsa; identical to SEQ ID NO: 727670

SEQ ID NO: 727736 - RNA, 64 nt, hsa; identical to SEQ ID NO: 727671

SEQ ID NO: 727737 - RNA, 64 nt, hsa; identical to SEQ ID NO: 727672

SEQ ID NO: 727738 - RNA, 64 nt, hsa; identical to SEQ ID NO: 727673

SEQ ID NO: 727739 - RNA, 64 nt, hsa; identical to SEQ ID NO: 727674

SEQ ID NO: 727740 - RNA, 64 nt, hsa; identical to SEQ ID NO: 727675

SEQ ID NO: 727741 - RNA, 64 nt, hsa; identical to SEQ ID NO: 727676

SEQ ID NO: 727742 - RNA, 64 nt, hsa; identical to SEQ ID NO: 727677

SEQ ID NO: 727743 - RNA, 64 nt, hsa; identical to SEQ ID NO: 727678

SEQ ID NO: 727744 - RNA, 64 nt, hsa; identical to SEQ ID NO: 727679

SEQ ID NO: 727745 - RNA, 64 nt, hsa; identical to SEQ ID NO: 727680

SEQ ID NO: 727746 - RNA, 64 nt, hsa; identical to SEQ ID NO: 727681

SEQ ID NO: 727747 - RNA, 64 nt, hsa; identical to SEQ ID NO: 727682

SEQ ID NO: 727748 - RNA, 64 nt, hsa; identical to SEQ ID NO: 727683

SEQ ID NO: 727749 - RNA, 64 nt, hsa; identical to SEQ ID NO: 727684

SEQ ID NO: 727750 - RNA, 64 nt, hsa; identical to SEQ ID NO: 727685

SEQ ID NO: 727751 - RNA, 64 nt, hsa; identical to SEQ ID NO: 727686

SEQ ID NO: 727752 - RNA, 64 nt, hsa; identical to SEQ ID NO: 727687

SEQ ID NO: 727753 - RNA, 64 nt, hsa; identical to SEQ ID NO: 727688

SEQ ID NO: 727754 - RNA, 64 nt, hsa; identical to SEQ ID NO: 727689

SEQ ID NO: 727755 - RNA, 64 nt, hsa; identical to SEQ ID NO: 727690

SEQ ID NO: 727756 - RNA, 64 nt, hsa; identical to SEQ ID NO: 727691

SEQ ID NO: 727757 - RNA, 63 nt, hsa; identical to SEQ ID NO: 727692

SEQ ID NO: 727758 - RNA, 63 nt, hsa; identical to SEQ ID NO: 727693

SEQ ID NO: 727759 - RNA, 63 nt, hsa; identical to SEQ ID NO: 727694

SEQ ID NO: 727760 - RNA, 63 nt, hsa; identical to SEQ ID NO: 727695

SEQ ID NO: 727761 - RNA, 63 nt, hsa; identical to SEQ ID NO: 727696

SEQ ID NO: 727762 - RNA, 63 nt, hsa; identical to SEQ ID NO: 727697

SEQ ID NO: 727763 - RNA, 63 nt, hsa; identical to SEQ ID NO: 727698

SEQ ID NO: 727764 - RNA, 63 nt, hsa; identical to SEQ ID NO: 727699

SEQ ID NO: 727765 - RNA, 63 nt, hsa; identical to SEQ ID NO: 727700

SEQ ID NO: 727766 - RNA, 63 nt, hsa; identical to SEQ ID NO: 727701

SEQ ID NO: 727767 - RNA, 63 nt, hsa; identical to SEQ ID NO: 727702

SEQ ID NO: 727768 - RNA, 63 nt, hsa; identical to SEQ ID NO: 727703

SEQ ID NO: 727769 - RNA, 63 nt, hsa; identical to SEQ ID NO: 727704

SEQ ID NO: 727770 - RNA, 63 nt, hsa; identical to SEQ ID NO: 727705

SEQ ID NO: 727771 - RNA, 63 nt, hsa; identical to SEQ ID NO: 727706

SEQ ID NO: 727772 - RNA, 63 nt, hsa; identical to SEQ ID NO: 727707

SEQ ID NO: 727773 - RNA, 63 nt, hsa; identical to SEQ ID NO: 727708

SEQ ID NO: 727774 - RNA, 63 nt, hsa; identical to SEQ ID NO: 727709

SEQ ID NO: 727775 - RNA, 63 nt, hsa; identical to SEQ ID NO: 727710

SEQ ID NO: 727776 - RNA, 63 nt, hsa; identical to SEQ ID NO: 727711

SEQ ID NO: 727777 - RNA, 63 nt, hsa; identical to SEQ ID NO: 727712

SEQ ID NO: 727778 - RNA, 63 nt, hsa; identical to SEQ ID NO: 727713

SEQ ID NO: 727779 - RNA, 63 nt, hsa; identical to SEQ ID NO: 727714

SEQ ID NO: 727780 - RNA, 63 nt, hsa; identical to SEQ ID NO: 727715

SEQ ID NO: 727781 - RNA, 63 nt, hsa; identical to SEQ ID NO: 727716

SEQ ID NO: 727782 - RNA, 63 nt, hsa; identical to SEQ ID NO: 727717

SEQ ID NO: 727783 - RNA, 63 nt, hsa; identical to SEQ ID NO: 727718

SEQ ID NO: 727784 - RNA, 61 nt, hsa; identical to SEQ ID NO: 470455

SEQ ID NO: 727785 - RNA, 61 nt, hsa; identical to SEQ ID NO: 470456

SEQ ID NO: 727786 - RNA, 61 nt, hsa; identical to SEQ ID NO: 470457

SEQ ID NO: 727787 - RNA, 61 nt, hsa; identical to SEQ ID NO: 470458

SEQ ID NO: 727788 - RNA, 61 nt, hsa; identical to SEQ ID NO: 470459

SEQ ID NO: 727789 - RNA, 61 nt, hsa; identical to SEQ ID NO: 470460

SEQ ID NO: 727790 - RNA, 61 nt, hsa; identical to SEQ ID NO: 470461

SEQ ID NO: 727791 - RNA, 61 nt, hsa; identical to SEQ ID NO: 470462

SEQ ID NO: 727792 - RNA, 61 nt, hsa; identical to SEQ ID NO: 470463

SEQ ID NO: 727793 - RNA, 61 nt, hsa; identical to SEQ ID NO: 470464

SEQ ID NO: 727794 - RNA, 61 nt, hsa; identical to SEQ ID NO: 470465

SEQ ID NO: 727795 - RNA, 61 nt, hsa; identical to SEQ ID NO: 470466

SEQ ID NO: 727796 - RNA, 61 nt, hsa; identical to SEQ ID NO: 470467

SEQ ID NO: 727797 - RNA, 61 nt, hsa; identical to SEQ ID NO: 470468

SEQ ID NO: 727798 - RNA, 61 nt, hsa; identical to SEQ ID NO: 470469

SEQ ID NO: 727799 - RNA, 61 nt, hsa; identical to SEQ ID NO: 470470

SEQ ID NO: 727800 - RNA, 61 nt, hsa; identical to SEQ ID NO: 470471

SEQ ID NO: 727801 - RNA, 61 nt, hsa; identical to SEQ ID NO: 470472

SEQ ID NO: 727802 - RNA, 61 nt, hsa; identical to SEQ ID NO: 470473

SEQ ID NO: 727803 - RNA, 61 nt, hsa; identical to SEQ ID NO: 470474

SEQ ID NO: 727804 - RNA, 61 nt, hsa; identical to SEQ ID NO: 470475

SEQ ID NO: 727805 - RNA, 61 nt, hsa; identical to SEQ ID NO: 470476

SEQ ID NO: 727806 - RNA, 61 nt, hsa; identical to SEQ ID NO: 470477

SEQ ID NO: 727807 - RNA, 61 nt, hsa; identical to SEQ ID NO: 470478

SEQ ID NO: 727808 - RNA, 61 nt, hsa; identical to SEQ ID NO: 470479

SEQ ID NO: 727809 - RNA, 61 nt, hsa; identical to SEQ ID NO: 470480

SEQ ID NO: 727810 - RNA, 61 nt, hsa; identical to SEQ ID NO: 470481

SEQ ID NO: 727811 - RNA, 61 nt, hsa; identical to SEQ ID NO: 470482

SEQ ID NO: 727812 - RNA, 61 nt, hsa; identical to SEQ ID NO: 470483

SEQ ID NO: 727813 - RNA, 61 nt, hsa; identical to SEQ ID NO: 470484

SEQ ID NO: 727814 - RNA, 62 nt, hsa
aauccugcuuucucaaguacuauucuaacauugcgcuuuauaagggaugauauuucuaccac

SEQ ID NO: 727815 - RNA, 62 nt, hsa
uaaagcccaggaacuucuagaauaacccagaugcgcuuuaauuuuuuuuaauauguuuugau

SEQ ID NO: 727816 - RNA, 62 nt, hsa
ccuuaauauaucuauggcagacauuuaagaaugcgcuuuaucuagcucaugguaacuuugca

SEQ ID NO: 727817 - RNA, 62 nt, hsa
acgguaguuaggaugcucaguugcuaaacacugcgcuuuauuuucuuaaccaguuguggugu

SEQ ID NO: 727818 - RNA, 62 nt, hsa
caugggauaaaaauaaucgauguauguuacgggcgcuuuaaccaucagcugccucucgaaug

SEQ ID NO: 727819 - RNA, 62 nt, hsa
gguucaccuggguggcuggagccgccggcgcugcgcuuuauuucggagcgcaaugccaucua

SEQ ID NO: 727820 - RNA, 62 nt, hsa
uguuucccuuaaugauacaagucucuguaccagcgcuuuauguuaauuaccaaaacucuccu

SEQ ID NO: 727821 - RNA, 62 nt, hsa
agaaguggcagaacacuggauuuguguguguggcgcuuuagggugcuggacuguauggcuga

SEQ ID NO: 727822 - RNA, 62 nt, hsa
ucccuccccuugcacuugugaaaacacuuugagcgcuuuaagagauuagccugagaaauaau

SEQ ID NO: 727823 - RNA, 62 nt, hsa
aagugacuguuuggcuuauaaacacauugaaugcgcuuuauugcccaugggauauguggugu

SEQ ID NO: 727824 - RNA, 62 nt, hsa
gaauaacaaguugucccuagcaaaaccgcugagcgcuuuauaauuuugugguguauuuuugu

SEQ ID NO: 727825 - RNA, 62 nt, hsa
cucaguuuuauaaggugauacuuuuuaaauaagcgcuuuaaugaaaaugguuagacugaaaa

SEQ ID NO: 727826 - RNA, 62 nt, hsa
uacauugucaugugacuggaucacauggggaagcgcuuuauacagacaucaguuccauggug

SEQ ID NO: 727827 - RNA, 62 nt, hsa
ucucaccucacaggcacaucaggcugcagaaugcgcuuuagaaagcauuguuuuaguccagg

SEQ ID NO: 727828 - RNA, 62 nt, hsa
cauugcaugagucaagucggccacagacuugagcgcuuuauuauuaguuaaucuuuugcagg

SEQ ID NO: 727829 - RNA, 62 nt, hsa
aauuuuuaaacuucuaagugaaaguagucugagcgcuuuauaaaauucauauuauugugugu

SEQ ID NO: 727830 - RNA, 62 nt, hsa
accccagcacacacacucccugccacuguucugcgcuuuaauugugggagaagagaggagag

SEQ ID NO: 727831 - RNA, 62 nt, hsa
ucaugaugacaacacugccucgcguuucaauagcgcuuuauacuuuuuuaaguguuuucuau

SEQ ID NO: 727832 - RNA, 62 nt, hsa
uuuugcuauuguaaauauuagugguuuacaaugcgcuuuagacauauuucuuuaaaaugcaa

SEQ ID NO: 727833 - RNA, 62 nt, hsa
uguagcuaucuucaccugcgccaauugugagggcgcuuuagcauuugagugauucaauaguu

SEQ ID NO: 727834 - RNA, 62 nt, hsa
gggccgaggugggcuucaguaaguccccggcggcgcuuuaguuugagcgcauggcaagucac

SEQ ID NO: 727835 - RNA, 62 nt, hsa
aaagauugaacuuaaaugccccccucccaacagcgcuuuaaaagcgaccucucuugagguag

SEQ ID NO: 727836 - RNA, 62 nt, hsa
uugccgccaucucuuaguuuucuuuuucacaagcgcuuuauuuuuuuaauagacaaaucaca

SEQ ID NO: 727837 - RNA, 62 nt, hsa
ccuuggauuuaauuuaaagucuucaacacuaugcgcuuuaucauauuauucacagaugcauu

SEQ ID NO: 727838 - RNA, 62 nt, hsa
ccaauccaacuugaagucaauugaauauuaaggcgcuuuacuuccgugugcuuucaguuuuu

SEQ ID NO: 727839 - RNA, 62 nt, hsa
ucugccucagaaagcucugcgcuuuccagaaagcgcuuuacccugcaggguuuugcuaaccu

SEQ ID NO: 727840 - RNA, 62 nt, hsa
cuugagaaccuucacccuuucacuuaaaggaggcgcuuuauagcuucucuuuggcauaucca

SEQ ID NO: 727841 - RNA, 62 nt, hsa
uucauucucccccucucucccuccugugucuugcgcuuuauguuuucuuccguuugauaauu

SEQ ID NO: 727842 - RNA, 62 nt, hsa
uccuagagaagccaugugauucccagagccaggcgcuuuacaccuaaaguaguuugacuuuc

SEQ ID NO: 727843 - RNA, 62 nt, hsa
gcuuguguguguagcuucuuguagcuuagaaagcgcuuuaugcccaugaugucauuucaggc

SEQ ID NO: 727844 - RNA, 63 nt, hsa; identical to SEQ ID NO: 58102

SEQ ID NO: 727845 - RNA, 63 nt, hsa; identical to SEQ ID NO: 58103

SEQ ID NO: 727846 - RNA, 63 nt, hsa; identical to SEQ ID NO: 58104

SEQ ID NO: 727847 - RNA, 63 nt, hsa; identical to SEQ ID NO: 58105

SEQ ID NO: 727848 - RNA, 63 nt, hsa; identical to SEQ ID NO: 58106

SEQ ID NO: 727849 - RNA, 63 nt, hsa; identical to SEQ ID NO: 58107

SEQ ID NO: 727850 - RNA, 63 nt, hsa; identical to SEQ ID NO: 58108

SEQ ID NO: 727851 - RNA, 63 nt, hsa; identical to SEQ ID NO: 58109

SEQ ID NO: 727852 - RNA, 63 nt, hsa; identical to SEQ ID NO: 58110

SEQ ID NO: 727853 - RNA, 63 nt, hsa; identical to SEQ ID NO: 58111

SEQ ID NO: 727854 - RNA, 63 nt, hsa; identical to SEQ ID NO: 58112

SEQ ID NO: 727855 - RNA, 63 nt, hsa; identical to SEQ ID NO: 58113

SEQ ID NO: 727856 - RNA, 63 nt, hsa; identical to SEQ ID NO: 58114

SEQ ID NO: 727857 - RNA, 63 nt, hsa; identical to SEQ ID NO: 58115

SEQ ID NO: 727858 - RNA, 63 nt, hsa; identical to SEQ ID NO: 58116

SEQ ID NO: 727859 - RNA, 63 nt, hsa; identical to SEQ ID NO: 58117

SEQ ID NO: 727860 - RNA, 63 nt, hsa; identical to SEQ ID NO: 58118

SEQ ID NO: 727861 - RNA, 63 nt, hsa; identical to SEQ ID NO: 58119

SEQ ID NO: 727862 - RNA, 63 nt, hsa; identical to SEQ ID NO: 58120

SEQ ID NO: 727863 - RNA, 63 nt, hsa; identical to SEQ ID NO: 58121

SEQ ID NO: 727864 - RNA, 63 nt, hsa; identical to SEQ ID NO: 58122

SEQ ID NO: 727865 - RNA, 63 nt, hsa; identical to SEQ ID NO: 58123

SEQ ID NO: 727866 - RNA, 63 nt, hsa; identical to SEQ ID NO: 58124

SEQ ID NO: 727867 - RNA, 63 nt, hsa; identical to SEQ ID NO: 58125

SEQ ID NO: 727868 - RNA, 63 nt, hsa; identical to SEQ ID NO: 58126

SEQ ID NO: 727869 - RNA, 63 nt, hsa; identical to SEQ ID NO: 58127

SEQ ID NO: 727870 - RNA, 63 nt, hsa; identical to SEQ ID NO: 58128

SEQ ID NO: 727871 - RNA, 63 nt, hsa; identical to SEQ ID NO: 58129

SEQ ID NO: 727872 - RNA, 63 nt, hsa; identical to SEQ ID NO: 58130

SEQ ID NO: 727873 - RNA, 63 nt, hsa; identical to SEQ ID NO: 58131

SEQ ID NO: 727874 - RNA, 64 nt, hsa; identical to SEQ ID NO: 657704

SEQ ID NO: 727875 - RNA, 64 nt, hsa; identical to SEQ ID NO: 657705

SEQ ID NO: 727876 - RNA, 64 nt, hsa; identical to SEQ ID NO: 657706

SEQ ID NO: 727877 - RNA, 64 nt, hsa; identical to SEQ ID NO: 657707

SEQ ID NO: 727878 - RNA, 64 nt, hsa; identical to SEQ ID NO: 657708

SEQ ID NO: 727879 - RNA, 64 nt, hsa; identical to SEQ ID NO: 657709

SEQ ID NO: 727880 - RNA, 64 nt, hsa; identical to SEQ ID NO: 657710

SEQ ID NO: 727881 - RNA, 64 nt, hsa; identical to SEQ ID NO: 657711

SEQ ID NO: 727882 - RNA, 64 nt, hsa; identical to SEQ ID NO: 657712

SEQ ID NO: 727883 - RNA, 64 nt, hsa; identical to SEQ ID NO: 657713

SEQ ID NO: 727884 - RNA, 64 nt, hsa; identical to SEQ ID NO: 657714

SEQ ID NO: 727885 - RNA, 64 nt, hsa; identical to SEQ ID NO: 657715

SEQ ID NO: 727886 - RNA, 64 nt, hsa; identical to SEQ ID NO: 657716

SEQ ID NO: 727887 - RNA, 64 nt, hsa; identical to SEQ ID NO: 657717

SEQ ID NO: 727888 - RNA, 64 nt, hsa; identical to SEQ ID NO: 657718

SEQ ID NO: 727889 - RNA, 64 nt, hsa; identical to SEQ ID NO: 657719

SEQ ID NO: 727890 - RNA, 64 nt, hsa; identical to SEQ ID NO: 657720

SEQ ID NO: 727891 - RNA, 64 nt, hsa; identical to SEQ ID NO: 657721

SEQ ID NO: 727892 - RNA, 64 nt, hsa; identical to SEQ ID NO: 657722

SEQ ID NO: 727893 - RNA, 64 nt, hsa; identical to SEQ ID NO: 657723

SEQ ID NO: 727894 - RNA, 64 nt, hsa; identical to SEQ ID NO: 657724

SEQ ID NO: 727895 - RNA, 64 nt, hsa; identical to SEQ ID NO: 657725

SEQ ID NO: 727896 - RNA, 64 nt, hsa; identical to SEQ ID NO: 657726

SEQ ID NO: 727897 - RNA, 64 nt, hsa; identical to SEQ ID NO: 657727

SEQ ID NO: 727898 - RNA, 64 nt, hsa; identical to SEQ ID NO: 657728

SEQ ID NO: 727899 - RNA, 64 nt, hsa; identical to SEQ ID NO: 657729

SEQ ID NO: 727900 - RNA, 64 nt, hsa; identical to SEQ ID NO: 657730

SEQ ID NO: 727901 - RNA, 64 nt, hsa; identical to SEQ ID NO: 657731

SEQ ID NO: 727902 - RNA, 64 nt, hsa; identical to SEQ ID NO: 657732

SEQ ID NO: 727903 - RNA, 64 nt, hsa; identical to SEQ ID NO: 657733

SEQ ID NO: 727904 - RNA, 63 nt, hsa
ucggccccgccaccugcccagcgugcccuggcucuccagaaccuucuaucccacagucaggcc

SEQ ID NO: 727905 - RNA, 63 nt, hsa
agaaagucuuaagcaaaauacucccaggucucacuccagaacauaaaaauggugugugaucaa

SEQ ID NO: 727906 - RNA, 63 nt, hsa
aaacccaguguccaucuuuccacccucccugaucuccagaaccuucgacugacccccuugucu

SEQ ID NO: 727907 - RNA, 63 nt, hsa
gaccugcacgggacuuguggaugggccuggacucuccagaaacuacuugggcagagcaaagga

SEQ ID NO: 727908 - RNA, 63 nt, hsa
caacagaccaggaggggcccccaccugauggaccuccagaaaaacggaucacagccacuaugg

SEQ ID NO: 727909 - RNA, 63 nt, hsa
uggggagggagugggccuggaucugggaccucccuccagaauuuccuccagaugggggcagug

SEQ ID NO: 727910 - RNA, 63 nt, hsa
cuuccuggugcccaccaggcacuacggcuuccucuccagaauguggcuuugccugagcacaga

SEQ ID NO: 727911 - RNA, 63 nt, hsa
auugaauaacuagaacacaagccacuguuucagcuccagaaaaaagaaagggcuuuaacguuu

SEQ ID NO: 727912 - RNA, 63 nt, hsa
acagggauuccuccuuucccccccaaauauuaacuccagaaacuaggccugacuggggacacc

SEQ ID NO: 727913 - RNA, 63 nt, hsa
agcacacaauuucaagccauuuucagaucagaacuccagaaguguugacaagaugccuauucg

SEQ ID NO: 727914 - RNA, 63 nt, hsa
gaggauccuucaguucuggccauuccagggacccuccagaaacacaguguuucaagagacccu

SEQ ID NO: 727915 - RNA, 63 nt, hsa
ggguccccaucaucccagcugcucccaaauaaacuccagaagaggaaucugugggccugugag

SEQ ID NO: 727916 - RNA, 63 nt, hsa
aaaucaccuauucacugcuuaugcagucggaagcuccagaagaacaaagagcccaauuaccag

SEQ ID NO: 727917 - RNA, 63 nt, hsa
acucugucguugccuugaucuugaacuuccagccuccagaacuaugagaaauaaaauucuguu

SEQ ID NO: 727918 - RNA, 63 nt, hsa
aguugcaguauuucaaagucccuauccaggucacuccagaaaaggguauugaaacguugaaau

SEQ ID NO: 727919 - RNA, 63 nt, hsa
ugcugcauuuaggccaggucuccaauugcuuuccuccagaaaguguguucccgucuagugagg

SEQ ID NO: 727920 - RNA, 63 nt, hsa
cccaaacuccuggccuucugugguuucccuuugcuccagaaacacagaugugucuaaagacuu

SEQ ID NO: 727921 - RNA, 63 nt, hsa
gaaacguacacuaucauugcuaaacuaacaguccuccagaaauuuaauaagauguuuuugauu

SEQ ID NO: 727922 - RNA, 63 nt, hsa
uuaagugaccuccuucaucacauccugcaguaucuccagaagcagcacuaggguuugaguuuc

SEQ ID NO: 727923 - RNA, 63 nt, hsa
ccacguguauuguccgggcucagaaugggaggacuccagaagaugagagaaaccucuuuaucc

SEQ ID NO: 727924 - RNA, 63 nt, hsa
uuagccuuaccaccuuuuaaaaaauuuguuauucuccagaaacaguaaauaggugaguagggg

SEQ ID NO: 727925 - RNA, 63 nt, hsa
cucagucagugauuuuuugaugcuucucuuauccuccagaauagagaccuaaggacacgugga

SEQ ID NO: 727926 - RNA, 63 nt, hsa
cccuguccccagucagagauaacauccaacuaacuccagaagcggaagaggauauauuuaaca

SEQ ID NO: 727927 - RNA, 63 nt, hsa
ggauggagcgggucuccugauucuacaccaucucuccagaacucucuggccuugguggcccca

SEQ ID NO: 727928 - RNA, 63 nt, hsa
cuccccccggggagaggacacuggccccucgcacuccagaaaagccaugccagcugggcucgu

SEQ ID NO: 727929 - RNA, 63 nt, hsa
cuguaacuuaucuagaaagaaaagacccugagacuccagaaucugcuguugccauagccccau

SEQ ID NO: 727930 - RNA, 63 nt, hsa
ccuauccaguuuuccugguucccucacagguuucuccagaaaguacucccucaguaaagcauu

SEQ ID NO: 727931 - RNA, 63 nt, hsa
gcuuuugccacugacucggccguguccugacaccuccagaacgcaggugcuggcgcccguucu

SEQ ID NO: 727932 - RNA, 63 nt, hsa
ccugcuucacuugcagauaaguuuauuauaauucuccagaaaugugcaggaugugcauuagca

SEQ ID NO: 727933 - RNA, 63 nt, hsa
guugcccugagagugucccaggggauucagagucuccagaaagauauggcugggccaacucug

SEQ ID NO: 727934 - RNA, 63 nt, hsa
gaacagugcucugccucuaacucccuccucacacuccagaauuacccuuccucaucugugccu

SEQ ID NO: 727935 - RNA, 63 nt, hsa
aggggaagcugcuaggggaaggacuggccguggcuccagaaugugcugccuuuuuaaguuuug

SEQ ID NO: 727936 - RNA, 63 nt, hsa
cgcacuuuccugaagccucuuauuaacucccaucuccagaagcaccucaacaaugucaguggc

SEQ ID NO: 727937 - RNA, 63 nt, hsa
uuggaaucagcaggccucugugcucccucugcccuccagaacucagugacucuugaacaugga

SEQ ID NO: 727938 - RNA, 63 nt, hsa
cuccaugagucaagcccccuccccacaccuggacuccagaauucacccucuccccugcagucu

SEQ ID NO: 727939 - RNA, 63 nt, hsa
ggacgggggguggggaaggaaggaacaugaucccuccagaagucucccacccuggggccaacu

SEQ ID NO: 727940 - RNA, 63 nt, hsa
aguccuggcuucaggcaauucuccugccuuugccuccagaagcacugggaucacaggugucag

SEQ ID NO: 727941 - RNA, 63 nt, hsa
gcauuuuccuacaccccuuuccuggacugcucucuccagaaacagcacagcucauggagggug

SEQ ID NO: 727942 - RNA, 63 nt, hsa
cuuuccuagauccacacuuucaaagagaaaccccuccagaacucccacccugacagcccaaca

SEQ ID NO: 727943 - RNA, 63 nt, hsa
accuaacaacaucacuuuuguugaacauuccaacuccagaaugauccccaaucacccuaaucu

SEQ ID NO: 727944 - RNA, 63 nt, hsa
gucagucuuuguaauuauuuacacuuuaacuuucuccagaacucagacaugauuucaacaugg

SEQ ID NO: 727945 - RNA, 63 nt, hsa
guaucuuuggagaaggagaaagaaaggaaagaacuccagaaucccaucacuguucuuuaaagc

SEQ ID NO: 727946 - RNA, 63 nt, hsa
uauuuuuuuaagcaacaucaugaauuuuaucuacuccagaagucucuacaauagaaaaaaaag

SEQ ID NO: 727947 - RNA, 63 nt, hsa
aauggagagaagaccucuuccugaaucacuggacuccagaaaugugcaugcagaucagcuguu

SEQ ID NO: 727948 - RNA, 63 nt, hsa
auuaccaccagacugacuccaggacucacugcccuccagaaaacagaggugacaaaugugagg

SEQ ID NO: 727949 - RNA, 63 nt, hsa
gagcugcuggugaacuccaucucauucucgccccuccagaagaagcaguugucccccaaauac

SEQ ID NO: 727950 - RNA, 63 nt, hsa
cuuuucccuaaucauucccuuuucuccccacuccuccagaaggcauaacccuucucuccacac

SEQ ID NO: 727951 - RNA, 63 nt, hsa
cuucucauaguguacacccaccugccucucuggcuccagaagcugccagagugcacugggggg

SEQ ID NO: 727952 - RNA, 63 nt, hsa; identical to SEQ ID NO: 240602

SEQ ID NO: 727953 - RNA, 63 nt, hsa
aaaauagaagaccuugcaagaagcagagucauucuccagaaggaacuugggagaugauggugc

SEQ ID NO: 727954 - RNA, 63 nt, hsa
ggaauuguacugugcuacaauuaucucuagaaucuccagaaagguggagggcuguucgcccuu

SEQ ID NO: 727955 - RNA, 55 nt, hsa; identical to SEQ ID NO: 240605

SEQ ID NO: 727956 - RNA, 63 nt, hsa
guuaucuucauaugauaugcugaacaccaaaaucuccagaaaugcauuuuauguaguucuaaa

SEQ ID NO: 727957 - RNA, 63 nt, hsa
auguucucaugcccucaaucuguaaauuuuugucuccagaaaaacccucccaggcaucccaua

SEQ ID NO: 727958 - RNA, 63 nt, hsa
cagggaggacugggcacuauuuggcaggauguacuccagaauauaaucaaagaauuuucugua

SEQ ID NO: 727959 - RNA, 63 nt, hsa
aaaggaguacccagggccugguacccaggcccacuccagaauggccucuggacucaccuugag

SEQ ID NO: 727960 - RNA, 63 nt, hsa
cccaaccccaucucagagcucagaggguacaagcuccagaacaguaaccaagugggaaaauaa

SEQ ID NO: 727961 - RNA, 63 nt, hsa
agaaguguuugauggugccagagaggggcugcucuccagaaagcuaaaauuuaauuucuuuuu

SEQ ID NO: 727962 - RNA, 63 nt, hsa
aggggcucaggaaaacgggaccggccaggccaccuccagaaacggccauucagcaagacaaca

SEQ ID NO: 727963 - RNA, 63 nt, hsa
caagucuauaauauaauuaugaucaugaauagacuccagaauccacaaagagaagagggcuug

SEQ ID NO: 727964 - RNA, 63 nt, hsa
gccuucccuacccugacgccucccagucaucaucuccagaacucccagcggggcucccugagc

SEQ ID NO: 727965 - RNA, 63 nt, hsa
auauuagauuucugacuugcaaauauguuuguacuccagaagaauuagaggaaaagcagauac

SEQ ID NO: 727966 - RNA, 63 nt, hsa
gcugggauuacaagugugagccaccacaccuggcuccagaaauuuuauuuuauuuuuuugagg

SEQ ID NO: 727967 - RNA, 63 nt, hsa
acuauguguguuguuuccauagcucuucacuuccuccagaagccuccuuacauuaaaaagccu

SEQ ID NO: 727968 - RNA, 63 nt, hsa
uguaguaauuucuauuugcacugugccuuucaacuccagaaacauucugaagauguacuugga

SEQ ID NO: 727969 - RNA, 63 nt, hsa
uuaaucuagauaauaaaagcuuuuuggggcaaccuccagaacugugaaaaauaaauuuguuau

SEQ ID NO: 727970 - RNA, 63 nt, hsa
cgcuaaccgcccuucugcguuccauaaagguggcuccagaaagggcauccucuaccccaagcc

SEQ ID NO: 727971 - RNA, 63 nt, hsa
caucauacuggaaagcaaacaccuuuccuccagcuccagaauuccuugucucugaaugacucu

SEQ ID NO: 727972 - RNA, 63 nt, hsa
gccuccucuucaacugaccagccuccaugcugccuccagaauggucuuucuaaugugugaauc

SEQ ID NO: 727973 - RNA, 63 nt, hsa
aaaccugacaaagagacuguaauauuguaguugcuccagaaugucaagggcagcuuacggaga

SEQ ID NO: 727974 - RNA, 63 nt, hsa
aguguggucagucugccugcugcugugcgguagcuccagaaccaccucguuccugguuuuguu

SEQ ID NO: 727975 - RNA, 63 nt, hsa
uuuguaagaacaaucauaaaaggacuuguuagucuccagaacaucugcuaaaaugcaaguaua

SEQ ID NO: 727976 - RNA, 63 nt, hsa
augaguuuaugggaaugccuuuucccucuggcacuccagaacaaaccucuauauguugcugaa

SEQ ID NO: 727977 - RNA, 63 nt, hsa
aaauaccauauaugauccucgaaaugauaauaucuccagaauauuguuuucacccaaauuuga

SEQ ID NO: 727978 - RNA, 63 nt, hsa
accuauuuuugaggaccuugaaaaucuuaaucucuccagaagggauacugcauugguucuucu

SEQ ID NO: 727979 - RNA, 63 nt, hsa
uuugccuauauucucccuacaagaauauuuuugcuccagaaagacauguucuuuucucaaauu

SEQ ID NO: 727980 - RNA, 63 nt, hsa
cauuugguuacccucgggauggccauccacugucuccagaaagagaccacuuagagggucucu

SEQ ID NO: 727981 - RNA, 63 nt, hsa
uuaaaccuucaggaacaccaguuaggaaaauagcuccagaaaauauagauauauuuuauuuuu

SEQ ID NO: 727982 - RNA, 63 nt, hsa
gauauaaaggaagaauauuuccuuuauguguuucuccagaauggugccuguuucucucugugu

SEQ ID NO: 727983 - RNA, 63 nt, hsa
agaagccacaccauuugcaccauccacgccuugcuccagaaggccuggccgccuucucccugg

SEQ ID NO: 727984 - RNA, 63 nt, hsa
gucagaucucaggcuugucccccugucagcugccuccagaagggaagguagccagugccugag

SEQ ID NO: 727985 - RNA, 63 nt, hsa
ccucgccuagcacucugccuugccagagauuggcuccagaauuugugccagacuuacagaaaa

SEQ ID NO: 727986 - RNA, 63 nt, hsa
uaauugugaaggagucagggcuaacaccuggaucuccagaaaccuagcccagcagguuaaucu

SEQ ID NO: 727987 - RNA, 63 nt, hsa
agcuccacucucugguuucuaauaaacagggaucuccagaacacuggugguggacacagcuuu

SEQ ID NO: 727988 - RNA, 63 nt, hsa
ccaaugagggcgaaugacauuacagcuugaccucuccagaacacuaauauccuaaaauacaga

SEQ ID NO: 727989 - RNA, 57 nt, hsa; identical to SEQ ID NO: 240639

SEQ ID NO: 727990 - RNA, 63 nt, hsa
uucacuuucaauuauauccagcaauaaguuguucuccagaaaagaaagcuuggaaacuuaccc

SEQ ID NO: 727991 - RNA, 63 nt, hsa
uugcuuucaaaaggacugcuuaccauggaagugcuccagaagaaucauuugaaacaucuuuug

SEQ ID NO: 727992 - RNA, 63 nt, hsa
guuuuaguauauauagcccaaaaugguaacugucuccagaacagcaaccacauugaauucuug

SEQ ID NO: 727993 - RNA, 63 nt, hsa
auagccaucuacaauaguaacugcccacaggcucuccagaaaacuacuacaauggccaaguac

SEQ ID NO: 727994 - RNA, 63 nt, hsa
cagagagugaacagcaccucuccauugcuacaucuccagaauauuguucgguuauguucaugu

SEQ ID NO: 727995 - RNA, 63 nt, hsa
ggaaauaaagcccuguucuggaucccccauccccuccagaauaagagcauguucugcauguau

SEQ ID NO: 727996 - RNA, 63 nt, hsa
auaugcagugguucuuacagaucaguuaauuaacuccagaaagcaaauguuagacuacacauu

SEQ ID NO: 727997 - RNA, 63 nt, hsa
uucugaugggggagggcggucuucccacuuccucuccagaacuccagaaagagcagugugcuu

SEQ ID NO: 727998 - RNA, 63 nt, hsa
ggggagggcggucuucccacuuccucuccagaacuccagaaagagcagugugcuuaugcuuca

SEQ ID NO: 727999 - RNA, 63 nt, hsa
aaaacuucucuucugagccucuuuaacagcuuucuccagaaccagugucugaaccacccugga

SEQ ID NO: 728000 - RNA, 63 nt, hsa
uaguaauaaggagaggguugggggugggcagggcuccagaaagucagcagugugccugggcac

SEQ ID NO: 728001 - RNA, 63 nt, hsa
aaauguguauauuuaauguuuuauuguuagcuucuccagaaaauugaugcaaauucugguaau

SEQ ID NO: 728002 - RNA, 63 nt, hsa
gcugcucucaggcacccccuucuucauugcucucuccagaaaggguugcuagccuuaacuuca

SEQ ID NO: 728003 - RNA, 63 nt, hsa
uuauguuucugccuucggcgagagaacagcaagcuccagaaaguggcugcgccuucagccccg

SEQ ID NO: 728004 - RNA, 63 nt, hsa
agcacaguagugcgggccugggcccugcuccaccuccagaaguggcuggauguacccugccug

SEQ ID NO: 728005 - RNA, 63 nt, hsa
ccugcgacccucacuggccuggccuugugggggcuccagaaaagaggcuaggagaggccagag

SEQ ID NO: 728006 - RNA, 63 nt, hsa
caaggcacagcccuuguugggagggagaacccucuccagaaacccugccaccauggugucuug

SEQ ID NO: 728007 - RNA, 63 nt, hsa
cugagcugccccuggcuuccuuuaaggaggcugcuccagaaggaaccuggguggggagggcga

SEQ ID NO: 728008 - RNA, 63 nt, hsa
ucuguaccccaaagagaguucucaugaaauauucuccagaauguauucauuaucaagaaaaug

SEQ ID NO: 728009 - RNA, 63 nt, hsa
auucucuugaugccaccuucagauccuuuuauucuccagaauaauucuuaacagugguucaaa

SEQ ID NO: 728010 - RNA, 63 nt, hsa
ugagcccgucucccggacagguugaggaagcugcuccagaagcgccucggaaggggagcucuc

SEQ ID NO: 728011 - RNA, 63 nt, hsa
gaaaauucuggaacuugaaaaaguaguaagggccuccagaauugacuuagcccuaguaauaaa

SEQ ID NO: 728012 - RNA, 63 nt, hsa
uuaaauuuuuuaauuaccuguuguaggguguuccuccagaagcaaagagcaaaauuuuacugu

SEQ ID NO: 728013 - RNA, 63 nt, hsa
aaacuucagucuggacuucuuuuugccagagaacuccagaaaccagucaggcucucagucagc

SEQ ID NO: 728014 - RNA, 63 nt, hsa
auagcuucccuucccucccccuucacccacucccuccagaacauuuaguguagaugaaaaugu

SEQ ID NO: 728015 - RNA, 63 nt, hsa
agaaaaacacaaacaaaaacagacucccacugucuccagaagucguggccuuccagaacaguc

SEQ ID NO: 728016 - RNA, 63 nt, hsa
ccagugucauuugcuccuccuguuccugugccacuccagaaccucagcagaucugagccaccg

SEQ ID NO: 728017 - RNA, 63 nt, hsa
aucugaauguuccagcagccuaacugugcucugcuccagaaacauguguguggcuucccuacc

SEQ ID NO: 728018 - RNA, 63 nt, hsa
ucacuuuaguuaugcuaaaguggagguuucagccuccagaagacagcagagccuucuaggguc

SEQ ID NO: 728019 - RNA, 63 nt, hsa
uauuuacaguauugagcuuugcauuuaugauuucuccagaaauuuaccacaaaagcaaaauuu

SEQ ID NO: 728020 - RNA, 63 nt, hsa
agcguuggucucuguuuggaaucacugugaggucuccagaaggaccuggccgccagccccuuc

SEQ ID NO: 728021 - RNA, 63 nt, hsa
uugucccucacugccccaguaagcuggaggcugcuccagaacucagcaguguuggaggggccu

SEQ ID NO: 728022 - RNA, 63 nt, hsa
auuccuacuggagcuuaguuccaaugcauuuggcuccagaaagaccccagugccuuuugacaa

SEQ ID NO: 728023 - RNA, 63 nt, hsa
gggacccucuuccucuagcacaguaaagcuggccuccagaaacacggguaucuccgcguggug

SEQ ID NO: 728024 - RNA, 63 nt, hsa
uauuucaccaagccaauaccagccgccauccuucuccagaauucuuguaaauaaaauaaaucc

SEQ ID NO: 728025 - RNA, 56 nt, hsa; identical to SEQ ID NO: 240675

SEQ ID NO: 728026 - RNA, 63 nt, hsa
agggcuuugaucauucaaaaguaacuaaaguagcuccagaaugccaaguauucguguaaauua

SEQ ID NO: 728027 - RNA, 63 nt, hsa
ucaagcugaaaauaauaguucuacugcccgugucuccagaauguagagcccaucaauauuuuu

SEQ ID NO: 728028 - RNA, 63 nt, hsa
uaugacaacacauacacacuugccucuccccaucuccagaagaggggagcagaguccgagcuu

SEQ ID NO: 728029 - RNA, 63 nt, hsa
gagcacagaccccagagucuugugguucucuaacuccagaaaggacaauguccccuauucagg

SEQ ID NO: 728030 - RNA, 63 nt, hsa
uuuauauccaaaauuuguguuuuaaauuucauacuccagaacuuucauguuuaugaguauuag

SEQ ID NO: 728031 - RNA, 63 nt, hsa
uguuaaugucaauaugaugagauuuuagccuuucuccagaacuaaggcauuaaagaaaauagc

SEQ ID NO: 728032 - RNA, 63 nt, hsa
uguggucaccugaggaugugguucagguggggucuccagaaggcugcuugcccccagagagcc

SEQ ID NO: 728033 - RNA, 63 nt, hsa
gacccuuaagugccacccuucuuggaagacccccuccagaagcauacuggaagccaccucugg

SEQ ID NO: 728034 - RNA, 63 nt, hsa
acaguaagagauaguguugaaccagcaucaagucuccagaaacauggcagagcagacaggccg

SEQ ID NO: 728035 - RNA, 63 nt, hsa
aacugacccuuccuucauccucaaccugcuguccuccagaaagcaccaaggaaaaagcagaga

SEQ ID NO: 728036 - RNA, 63 nt, hsa
aucagcuuauauuuuuuaucuugaugacuccugcuccagaaucgcuagacuaagaauuaggug

SEQ ID NO: 728037 - RNA, 63 nt, hsa
uacacuggaagcuuugauucacccuccacaguacuccagaaaggacuguccuauaaguuguac

SEQ ID NO: 728038 - RNA, 63 nt, hsa
ccagauuuguuuccuuuuggccuccugcaaagucuccagaagaaaauuugccaaucuuuccua

SEQ ID NO: 728039 - RNA, 63 nt, hsa
agauguuuacuacaaaagcaugccaaaccuaggcuccagaaaccacguccaucagcugcauac

SEQ ID NO: 728040 - RNA, 63 nt, hsa
acuagcauugcacauauagucugcuuucuguuccuccagaauuugaguccuguuaauguagua

SEQ ID NO: 728041 - RNA, 63 nt, hsa
cauucuucaacagugccuugcauguaacaagcacuccagaaauguuuguugaaugaaugaaug

SEQ ID NO: 728042 - RNA, 63 nt, hsa
auggcuggagagcugaucagccaggcacagaaucuccagaacaaccuagagagugaaugcuaa

SEQ ID NO: 728043 - RNA, 63 nt, hsa
aucuccuggcaccuugaucuuggauuuuacagccuccagaacugugagaaaauaaauuucugu

SEQ ID NO: 728044 - RNA, 63 nt, hsa
uaaugguacuuaguauuuugaucaaacuuuagucuccagaacuaaacaagucccuaaguuucc

SEQ ID NO: 728045 - RNA, 63 nt, hsa
caggaaguacuggagaaaauggacguguuaugacuccagaauuucccaaagcagugcaugcug

SEQ ID NO: 728046 - RNA, 63 nt, hsa
aauguuaccuuuuggcuugagaaugucuuucagcuccagaauuauuguuacucauauuuuaau

SEQ ID NO: 728047 - RNA, 52 nt, hsa; identical to SEQ ID NO: 240697

SEQ ID NO: 728048 - RNA, 63 nt, hsa
uauaguaauuuuguuguuguugggugcugguagcuccagaauuuugugaccacuauugugggu

SEQ ID NO: 728049 - RNA, 63 nt, hsa
ccaaccucacagccucguagagcuucacagcuacuccagaaaauaggguuaugugugucauuc

SEQ ID NO: 728050 - RNA, 63 nt, hsa
cauccaaagauguccagauguccaugugcuagucuccagaacuuguaacuguguuguuaugug

SEQ ID NO: 728051 - RNA, 63 nt, hsa
uuauuucuaauaauacacuaucuugauuguacucuccagaaaauuuuucugucagugaaaaua

SEQ ID NO: 728052 - RNA, 63 nt, hsa
ucaaaagcuucagugaguuacaucucauucaaucuccagaagauugggauuaucgucuucuaa

SEQ ID NO: 728053 - RNA, 63 nt, hsa
ccagcucauggaauuuuuucaucuuauacugagcuccagaaaggacguaacuuagcauggauc

SEQ ID NO: 728054 - RNA, 63 nt, hsa
uuuauuuuccugucuucuuucuccugugguuugcuccagaauuaagguuuguuuuccauccau

SEQ ID NO: 728055 - RNA, 63 nt, hsa
cucccuuuugacacaguuguuucagaaagagcucuccagaagccaauauugagauguaauuca

SEQ ID NO: 728056 - RNA, 63 nt, hsa
agaagaaaaaaaaucuuucagauaagagguguucuccagaauggaggaacuacuuggcaugua

SEQ ID NO: 728057 - RNA, 63 nt, hsa
acuuaacuguaugugcaacagcaaugaaauuaacuccagaagccuuccaccugcgucacccag

SEQ ID NO: 728058 - RNA, 63 nt, hsa
ucaagcugcucaucuguuaguaagugauguucacuccagaacacauucaugaugagaacuuuc

SEQ ID NO: 728059 - RNA, 63 nt, hsa
agaagaaaaaaaaucuuucagauaagagguguucuccagaauggaagaacgacuuggcaugua

SEQ ID NO: 728060 - RNA, 63 nt, hsa
ucacacugcugugcagccaucaccaccauucaucuccagaauuuguucucagucccaaacuga

SEQ ID NO: 728061 - RNA, 63 nt, hsa
ucuauucauaaauguucuauacaguggacagcccuccagaaugguacuucagugccuagugua

SEQ ID NO: 728062 - RNA, 63 nt, hsa
aaauaaggaagagggcugagcugagcuucgguucuccagaauguaagaaaacaaaaucuaaaa

SEQ ID NO: 728063 - RNA, 63 nt, hsa
cgaccaccagcaccauccucuccucccagcagccuccagaaccaugcccaggucuccugccuc

SEQ ID NO: 728064 - RNA, 63 nt, hsa
ugaccucaucaugguucuaguucucauacagaacuccagaauuuuuaaagaacucuauaauug

SEQ ID NO: 728065 - RNA, 63 nt, hsa
uuacugaaucugucuacccuucauucaugagaacuccagaaugaguguugaccacugaagcau

SEQ ID NO: 728066 - RNA, 63 nt, hsa
ccacacuaagguaaguucagacuagauugaacacuccagaauuuuuuacuacagacuguuuuu

SEQ ID NO: 728067 - RNA, 63 nt, hsa
auccccauggagagacagcauugcuccccagcccuccagaaaccuugagcagauccagggauc

SEQ ID NO: 728068 - RNA, 63 nt, hsa
cauugccgggguaggguggugucuucaccacagcuccagaaggcacuggugggauguggaguc

SEQ ID NO: 728069 - RNA, 63 nt, hsa
gaaagaaucaaauuucuugcccggucacuggcacuccagaagacagcgugccggaaccggcag

SEQ ID NO: 728070 - RNA, 63 nt, hsa
acuuucauagucccaaagauaggcagagaacaucuccagaaaugugugugugugugugugugu

SEQ ID NO: 728071 - RNA, 63 nt, hsa
gaagagccacagucuccagacucauggcguucccuccagaacuccccauuccccucugagcau

SEQ ID NO: 728072 - RNA, 63 nt, hsa
gaaaagccagaggguucaccuagucagacgaaacuccagaacagugcuuguggagggccugac

SEQ ID NO: 728073 - RNA, 63 nt, hsa
auaauuuucuucaaugaguuaauaaacagaaaucuccagaaccucugaaacacauucuugaag

SEQ ID NO: 728074 - RNA, 63 nt, hsa
cuauauuacagaaugauguaauaccugguaauucuccagaagauagacuucagacccuuaaug

SEQ ID NO: 728075 - RNA, 63 nt, hsa
uuaauuguaaagccaagcuuaucaguugacucucuccagaauaaauaaucaucuguguggcau

SEQ ID NO: 728076 - RNA, 63 nt, hsa
cuguugcagcuuccucugcccuggcuggaaagacuccagaauccaguguggugcuguggaagg

SEQ ID NO: 728077 - RNA, 63 nt, hsa
cucugugaggagcugugggaaguguggguuugucuccagaacagaagagaaugauggauauuc

SEQ ID NO: 728078 - RNA, 63 nt, hsa
gucccugaggguggagggaagcugaggauagagcuccagaaacagcacuagggucccaggaga

SEQ ID NO: 728079 - RNA, 63 nt, hsa
aggggggaaagagaccagccuuggucccuaagccuccagaaacgucuucuuaauccccaccuu

SEQ ID NO: 728080 - RNA, 63 nt, hsa
gcauauuucugugcuguggaugacauggccuuacuccagaaucccaggcccuccacugugacu

SEQ ID NO: 728081 - RNA, 63 nt, hsa
gugcuggcaaccacuaagaauucaaacuggggccuccagaacucacuggggccuacagcuuug

SEQ ID NO: 728082 - RNA, 63 nt, hsa
ucagccuuaaauacaaaaauaaaacugaaacugcuccagaaagcagcuuucuccaaaaauguc

SEQ ID NO: 728083 - RNA, 63 nt, hsa
gaagcccaaaagcucuuaaggagaauuguauuucuccagaagcugcagcaagagguacagcuc

SEQ ID NO: 728084 - RNA, 63 nt, hsa
auuauucaauuucaugaauaacucuuguuugcacuccagaaaacaacauacauguuuaaauac

SEQ ID NO: 728085 - RNA, 63 nt, hsa
aucuuuuagaauuuuuuuggagguguuuguuuucuccagaauaaagguauuacuuuagaauag

SEQ ID NO: 728086 - RNA, 63 nt, hsa
guggcuguguagcauccucagugcaaaacccagcuccagaauuuucaccugguaacgaauuuc

SEQ ID NO: 728087 - RNA, 63 nt, hsa
aaaaugcagcuguuguuagacaacuguugaaaacuccagaaauacaucacccaagguggcagu

SEQ ID NO: 728088 - RNA, 63 nt, hsa
acccaggccuugacauuguuauucaaauggccccuccagaaaguuuaaugauuuccauuugua

SEQ ID NO: 728089 - RNA, 63 nt, hsa
gugaaaccuuggcacaggacugaggauccucuccuccagaaaagcccccucgaggaaauaaau

SEQ ID NO: 728090 - RNA, 63 nt, hsa
aggugucuacugaaaagggaaccugcuucuuuacuccagaacgcuguucuuuaaagaccaaga

SEQ ID NO: 728091 - RNA, 55 nt, hsa; identical to SEQ ID NO: 240741

SEQ ID NO: 728092 - RNA, 63 nt, hsa
caaauacuugacucccacucuugccacuccuagcuccagaagggcucagggccuuccccacag

SEQ ID NO: 728093 - RNA, 63 nt, hsa
uuaagaugcuaggaugaggcaggcccaguccuccuccagaaaauaagacaggccacaggaggg

SEQ ID NO: 728094 - RNA, 63 nt, hsa
agacucugauuagcugccuccccuucucccugccuccagaauguucugggauaacauuuggag

SEQ ID NO: 728095 - RNA, 63 nt, hsa
agagggggagcaaacaggaaauuccacagcugccuccagaaacauuaaccaccccucucuagu

SEQ ID NO: 728096 - RNA, 63 nt, hsa
gccagcuccucagccugcucccugggaggcaggcuccagaagcaccccgacggggggccuuau

SEQ ID NO: 728097 - RNA, 63 nt, hsa
gugcuacaggaguacaucugcccugccacaugacuccagaagucucugaccccauuuguuuuu

SEQ ID NO: 728098 - RNA, 63 nt, hsa
uuggcuaaggugcuguuccuguuccugcaaggucuccagaaccccuuuggaaauggugaagga

SEQ ID NO: 728099 - RNA, 63 nt, hsa
gucucaaauaauuauuucacagaggauagcaagcuccagaagguucuauuaccuuuaaaaaag

SEQ ID NO: 728100 - RNA, 63 nt, hsa
gagcgagagcagagcaaacugcgcagcaggcaccuccagaaagguaaugguggcagaacccac

SEQ ID NO: 728101 - RNA, 63 nt, hsa
uuuuacuuccgguuucuucauauugaggggcaacuccagaaguggaguuuucugugagaauaa

SEQ ID NO: 728102 - RNA, 63 nt, hsa
cuaaagcaaaauuuccagggguagggacugggacuccagaaccauuaauaaaacaaaacaaaa

SEQ ID NO: 728103 - RNA, 63 nt, hsa
cuucuagcugaaaaacgaguauuccccaauggacuccagaagaaacuugauucaucgcugcaa

SEQ ID NO: 728104 - RNA, 63 nt, hsa
ccagggcaaggacagacuaaaagagcauaucuucuccagaaguccuagaaacaucucaucauu

SEQ ID NO: 728105 - RNA, 63 nt, hsa
aaugugggagaaaaucgcugcugcugagauggacuccagaagaagaaacuguuucuccaggcg

SEQ ID NO: 728106 - RNA, 63 nt, hsa
aaguggcaaauauuuuaaaauauuugaaaaacacuccagaaucuaguacgcuuuauuuuuaga

SEQ ID NO: 728107 - RNA, 63 nt, hsa
ccccguguggcccaccccaggcacggcucauuccuccagaauuauagaagcucagccuggccu

SEQ ID NO: 728108 - RNA, 63 nt, hsa
gagccaccauuuuuuauaauuucuaauaaccaacuccagaacuaggagcugaucaacucuuug

SEQ ID NO: 728109 - RNA, 63 nt, hsa
gauguuggcaccuuugaauucuacauccuguuucuccagaaugagaauuuguguacaaagaua

SEQ ID NO: 728110 - RNA, 63 nt, hsa
auaccuuauaacacugagccacuucuccccacccuccagaagggguccacguugaauucugaa

SEQ ID NO: 728111 - RNA, 63 nt, hsa
cauugcauugugggaaucacaaagcaaauaguacuccagaaagacaaauaucagaagcuuccu

SEQ ID NO: 728112 - RNA, 63 nt, hsa
uuuagacuguuagacaaaagugcucacgugcagcuccagaauauggaaacagagcaaaagaac

SEQ ID NO: 728113 - RNA, 63 nt, hsa
ccgccuuccccaaagcagaggggcugucugugucuccagaaaggggacaucgggggggagggg

SEQ ID NO: 728114 - RNA, 63 nt, hsa
gaguuugggcugcaagugcucacagcucuuguucuccagaaacuggagaauugcccucaggag

SEQ ID NO: 728115 - RNA, 63 nt, hsa
uuucuacccaugcaacggaagaaaaacccauuacuccagaagaguauaucuaaguaacuaaaa

SEQ ID NO: 728116 - RNA, 63 nt, hsa
ccuugaugaagaaguugauaugccuuuucccaacuccagaaagugacaagcucacagaccuuu

SEQ ID NO: 728117 - RNA, 63 nt, hsa
uugugucgguuaaaaauucgaaggcuuaugggucuccagaaacucugccagccagccucagug

SEQ ID NO: 728118 - RNA, 63 nt, hsa
ucccaaauaacuauuuucuuaucugcaguauuccuccagaagagcuaaccagggcagggcugg

SEQ ID NO: 728119 - RNA, 63 nt, hsa
cccuuccaacgcaucacccgccucaaacugcugcuccagaacauucugaagagaacacagccu

SEQ ID NO: 728120 - RNA, 63 nt, hsa
ggcuaagguauaaaucaacacacugcuuccuuccuccagaaggucuuacugugaaggaaaaaa

SEQ ID NO: 728121 - RNA, 63 nt, hsa
acuuggcuacacauagacucuagucaguuuugucuccagaaccuuaggcuuuuguauuuuuua

SEQ ID NO: 728122 - RNA, 63 nt, hsa
ccugcggugauauucuaucugcaguauuuguaccuccagaauggcagaucccucagcaggaac

SEQ ID NO: 728123 - RNA, 63 nt, hsa
aauaucaaguauaaugauguaguaaaaagauuucuccagaaaacacuuugagauacuuaaaga

SEQ ID NO: 728124 - RNA, 63 nt, hsa
uaguucuguucuguggguuugugcuuccucuuucuccagaagccuucuggcugauuguuccga

SEQ ID NO: 728125 - RNA, 63 nt, hsa
ucaaaccagcccaacccgagcuuuuggacagcucuccagaagcaugaacugcaguggagauga

SEQ ID NO: 728126 - RNA, 63 nt, hsa
gauucaucugugaccuccaggcagcagucucugcuccagaaucucuggacggagcugcuggca

SEQ ID NO: 728127 - RNA, 63 nt, hsa
uuucuuuucuauagagaaauguauaguuugacucuccagaauguacuauccaucuugaugaga

SEQ ID NO: 728128 - RNA, 63 nt, hsa
gcccucaccagaacccaacccuuggacuucagccuccagaacugugagaaauacauaccugcu

SEQ ID NO: 728129 - RNA, 63 nt, hsa
gaucaggguggggacaaggacuggacccuccuucuccagaaggccuucagcucuugccuugcc

SEQ ID NO: 728130 - RNA, 63 nt, hsa
aauauaaauucuacagaaaauaguguucuuuuucuccagaaaaaugcuugugagaaucauuaa

SEQ ID NO: 728131 - RNA, 63 nt, hsa
cucuccaaccaccacacuccccgccguacaguucuccagaaucccaggcgaugacaagucuga

SEQ ID NO: 728132 - RNA, 63 nt, hsa
ucccaggggccggccuccucugccugguaaugacuccagaacaacaacugggaagaaacuuga

SEQ ID NO: 728133 - RNA, 63 nt, hsa
aaggaagcauggcccugacuucagaauuccagacuccagaacuggaagaauaaaugucuguug

SEQ ID NO: 728134 - RNA, 63 nt, hsa
ugcauugaauugaauaugaauuucucuaacucucuccagaaaauggauggagauaacuugucu

SEQ ID NO: 728135 - RNA, 63 nt, hsa
ugagauucuuuagccacuuuggggagccugucucuccagaagccuuucuuaguggugcccaca

SEQ ID NO: 728136 - RNA, 63 nt, hsa
uaaaaugcacggcuaaacuauucagaguuaacacuccagaauuguuaaauuacaaguacuaug

SEQ ID NO: 728137 - RNA, 63 nt, hsa
ugagcgccugcagaucccgcaggcuucguuugccuccagaaccuucccgucugauuguuccuc

SEQ ID NO: 728138 - RNA, 63 nt, hsa
accuuucuaaaaguuuucaucgccuugguaaagcuccagaaauggacaaugcuagugacugca

SEQ ID NO: 728139 - RNA, 63 nt, hsa
aucggcuucucagauggcuuccucacuucaugccuccagaaagcauauugcccggugaugaaa

SEQ ID NO: 728140 - RNA, 63 nt, hsa
cucugggccaaagcccauggguagcuuggcugccuccagaagagaugcagagagcuguggggc

SEQ ID NO: 728141 - RNA, 63 nt, hsa
auagggauccuggugggaggagagagggcacaucuccagaaaaaugaaaagcaauacaacuuu

SEQ ID NO: 728142 - RNA, 63 nt, hsa
ucauccucgccucucaggcuuuagauacgaaaucuccagaauggaaggggguggggauuuucu

SEQ ID NO: 728143 - RNA, 63 nt, hsa
ucccaugggauuccccggcugugacacucuacccuccagaaccugacgacugggccaugugac

SEQ ID NO: 728144 - RNA, 63 nt, hsa
uuuuucuugaagaggcagcucaaaugucaccuucuccagaagcugcucuccacuugcuuuagg

SEQ ID NO: 728145 - RNA, 63 nt, hsa
uccagcaggccccagucucgcaucagcgccggccuccagaacuuagcaauuuccgccugguga

SEQ ID NO: 728146 - RNA, 63 nt, hsa
aggagaggagggggaggucauuuaucugagucucuccagaaguuuuuaaggcuacauuuugga

SEQ ID NO: 728147 - RNA, 63 nt, hsa
gcuuuucuuuggcgauucagugucacaaaauaacuccagaaagaagcacuuagcgugcuguuc

SEQ ID NO: 728148 - RNA, 63 nt, hsa
acuuuaaacuuuuauuaccacaguugcugccuccuccagaauuuuugaauuuuaauaaaaggc

SEQ ID NO: 728149 - RNA, 63 nt, hsa
cauugcgagaguagcuauuuugaaagaauaauucuccagaaguuaacaucuaauaucuaguau

SEQ ID NO: 728150 - RNA, 63 nt, hsa
aaaucaccagcaccuugaucuuugacuucuaaucuccagaauagugagaaauaaauuucuguu

SEQ ID NO: 728151 - RNA, 63 nt, hsa
uucuuugccaccagccugucacuccaguggcagcuccagaaacggaggcuguugcuuuuaucc

SEQ ID NO: 728152 - RNA, 63 nt, hsa
uacugcuucugucccugcuggcagccucugucccuccagaacggcuaaccagagcacacuguc

SEQ ID NO: 728153 - RNA, 57 nt, hsa; identical to SEQ ID NO: 240803

SEQ ID NO: 728154 - RNA, 63 nt, hsa
uaauccuugcuuugguuuggaacugccuucgggcuccagaacuuaaauugcuugguccguggc

SEQ ID NO: 728155 - RNA, 63 nt, hsa
gugggcugggccgcuggagccuccgccugcuuccuccagaagacacgaaucaugacucacgau

SEQ ID NO: 728156 - RNA, 63 nt, hsa
cugcuaagcaguuuauaguucuucuccauguuucuccagaauuaaucaguguuaguccucugu

SEQ ID NO: 728157 - RNA, 63 nt, hsa
cagugguguggggaaacguuccccuggaucauacuccagaauucugcucucagcaauugcagu

SEQ ID NO: 728158 - RNA, 63 nt, hsa; identical to SEQ ID NO: 240808

SEQ ID NO: 728159 - RNA, 63 nt, hsa
uucuuggaccuccucccccgccccaauuccaagcuccagaaacucccaacucgucugccgucc

SEQ ID NO: 728160 - RNA, 63 nt, hsa
ccaccgauuucagcguguccacaucacagcucccuccagaagcugcaagagcuucuuagcagu

SEQ ID NO: 728161 - RNA, 63 nt, hsa
gcaguuuccuugcaacacuuucagcuccccaugcuccagaauacccacccaagaaaauaauag

SEQ ID NO: 728162 - RNA, 63 nt, hsa
ugcucuaauuggcugguugguuuggauuuguaacuccagaaacauucuauagugugccagagc

SEQ ID NO: 728163 - RNA, 53 nt, hsa; identical to SEQ ID NO: 240813

SEQ ID NO: 728164 - RNA, 63 nt, hsa
uaguuguucguugguuauacaaguucuuggucccuccagaaccaccccggcccccugcccguu

SEQ ID NO: 728165 - RNA, 63 nt, hsa
agucugucuucaacuauuuuauccaaaauaaaccuccagaagaaaguaguuuucauuuacuua

SEQ ID NO: 728166 - RNA, 63 nt, hsa
gagaccuaucgucuuggaacuugccauucuuuccuccagaacaaaauguuaacuuucuaacac

SEQ ID NO: 728167 - RNA, 63 nt, hsa
acagacagguuuucacauaaaugcagcccauuucuccagaacccauuugaggggugggggggu

SEQ ID NO: 728168 - RNA, 63 nt, hsa; identical to SEQ ID NO: 240818

SEQ ID NO: 728169 - RNA, 63 nt, hsa
aggcugcuugguacugaguauacuuaaauauaacuccagaauccagggacuugguguuaaaac

SEQ ID NO: 728170 - RNA, 63 nt, hsa
acgccucaacauauacuugugcucuuccuuugccuccagaagaaguuuuuccuugauugugcu

SEQ ID NO: 728171 - RNA, 63 nt, hsa
cugccuccaccacaggcauccugcaaaugcagacuccagaauccccagcaucagcgggaacca

SEQ ID NO: 728172 - RNA, 63 nt, hsa
gucugcuggcaccuugaucuuggaccucccagccuccagaacugugagaaauaaauguguuuu

SEQ ID NO: 728173 - RNA, 63 nt, hsa
auacaacauacuuaaugcagggcuacacugaaccuccagaaucauuuuguuugcuuugacccu

SEQ ID NO: 728174 - RNA, 63 nt, hsa
ucuuucacauggcuacugggaauauaaauuucgcuccagaaaggccguagcaguuugacgaua

SEQ ID NO: 728175 - RNA, 63 nt, hsa
cucuuaugagucauuuuuuucaaaagaugaaaacuccagaaacgcacaggaacgaaauaccuc

SEQ ID NO: 728176 - RNA, 63 nt, hsa
uauugguaaucuuuucugugaauauuagguuuccuccagaaauaguccguuauuugggaaagu

SEQ ID NO: 728177 - RNA, 63 nt, hsa
ccuggguugucucaaauccuguccacaaggcaacuccagaagaaagaagcccuuuacauuucc

SEQ ID NO: 728178 - RNA, 63 nt, hsa
aaguugcaggcacaacaguuuaagaaugcauuccuccagaagaguaucuggucagguugaccc

SEQ ID NO: 728179 - RNA, 52 nt, hsa; identical to SEQ ID NO: 240829

SEQ ID NO: 728180 - RNA, 63 nt, hsa
uaugaggcucugauuuccuaucccaguuuagggcuccagaaaagccauucucccaaacuaaug

SEQ ID NO: 728181 - RNA, 63 nt, hsa
cuuucacaggcagccagugcccugagccagggucuccagaaagccccacccaggccaggcaug

SEQ ID NO: 728182 - RNA, 63 nt, hsa
ugcauaugaugccagccucacgcauuuguauaucuccagaaauucagguaugccucaccaauu

SEQ ID NO: 728183 - RNA, 63 nt, hsa
uucugugguuucuuaggugaccuuagagcaagacuccagaaugaaauuccuaaagcuuuuagg

SEQ ID NO: 728184 - RNA, 63 nt, hsa
gucauuggucaauaggggaggguagauuagcugcuccagaauucaauaaaguguaauauuucu

SEQ ID NO: 728185 - RNA, 63 nt, hsa
uguuuuucaauuguugacauuucagaggggacccuccagaagcccagccggcuucccccaagg

SEQ ID NO: 728186 - RNA, 63 nt, hsa
ggaggugguguucuauaccuaaaggaugaccugcuccagaaacagcaccagcacagcauguau

SEQ ID NO: 728187 - RNA, 63 nt, hsa
uucacacaugacuaccuuugagcuaaugacugucuccagaaaauaacugugccccaagaagug

SEQ ID NO: 728188 - RNA, 63 nt, hsa
auaugccagguagacaccagcccaaguacccuccuccagaagucugugacuaccuugucacua

SEQ ID NO: 728189 - RNA, 63 nt, hsa
cugaaaauguuuuguuagcuuuuccuucuuucucuccagaagaaacauggauagaugauagcu

SEQ ID NO: 728190 - RNA, 63 nt, hsa
cugcucuaauuucuuuugcccauauaugaguaucuccagaaugucuacaaauaguuuuuguag

SEQ ID NO: 728191 - RNA, 63 nt, hsa
guuugaggccaccaaaagaucaacagacaaaugcuccagaaaucuaugcugacugugacacaa

SEQ ID NO: 728192 - RNA, 63 nt, hsa
ccaucucgggcacaggcccaccccgccccaccccuccagaacacggcucacgcuuaccucaac

SEQ ID NO: 728193 - RNA, 63 nt, hsa
cuauaaaguuaaacauacacuuuuacuuuaggacuccagaauuccacuucuaguuauuuauuc

SEQ ID NO: 728194 - RNA, 63 nt, hsa
accagaauucuucuguaauucugcccaugacuccuccagaauuuuaguagauacagggugggu

SEQ ID NO: 728195 - RNA, 63 nt, hsa
guuuuauccaugaggaagauuuuuaacaaaagccuccagaagauuuccccucaguuuccauug

SEQ ID NO: 728196 - RNA, 63 nt, hsa
aagauauggugaaggcagaacugcucacaccagcuccagaagcacguccucugacuucacugc

SEQ ID NO: 728197 - RNA, 63 nt, hsa
gagcagcccgccuagaacccagucuaaugagaacuccagaaagcuggagcagcccaccuagag

SEQ ID NO: 728198 - RNA, 63 nt, hsa
gcucuccucugggcccugccuucagccuccucacuccagaaacguguguuucccugaugcggg

SEQ ID NO: 728199 - RNA, 63 nt, hsa
cuaagucacagggaucugcugcagccacagcuccuccagaaagggacagccacggccaagugg

SEQ ID NO: 728200 - RNA, 63 nt, hsa
aaaggcagaugacggggaguuaggcauggggagcuccagaaggucaccagagagcuuucagcu

SEQ ID NO: 728201 - RNA, 63 nt, hsa
uuugggggcggggggguggggaauucagccacacuccagaaagccaggagucgacaguuuugg

SEQ ID NO: 728202 - RNA, 63 nt, hsa
gacucccugacaaaagugaagaauuaacuucuccuccagaacaagugcaauucagaaggcagc

SEQ ID NO: 728203 - RNA, 63 nt, hsa
cuucccaccugagcaugcugacccccuuccuaccuccagaauaaagaaucucaaccuggaggg

SEQ ID NO: 728204 - RNA, 63 nt, hsa
agccagcagcugugguacuccagacaaaaggaucuccagaaagccgccuguccuuccagcaug

SEQ ID NO: 728205 - RNA, 63 nt, hsa
ccaagcucccugccccaaauaacuucaguccugcuccagaauuuggaaauccuaguuuccucu

SEQ ID NO: 728206 - RNA, 63 nt, hsa
cagaguuccuucucacccagacacacuagugcucuccagaaucucugcccaggaggcagggga

SEQ ID NO: 728207 - RNA, 63 nt, hsa
agucacugcugcaagguggccucugccuggggccuccagaagcugcuccuuuacccucuuggu

SEQ ID NO: 728208 - RNA, 63 nt, hsa
gccggaagggagcccccugcuccucccaacaaacuccagaacagcagaaagcgggugcuguag

SEQ ID NO: 728209 - RNA, 63 nt, hsa
aagaccaagacaccuggggauugcgucuggggccuccagaacucugcuguggacugcaucagg

SEQ ID NO: 728210 - RNA, 63 nt, hsa
uggccuggaguauuuauauggugcuuaaugaaucuccagaaugccagccagaagccugauugg

SEQ ID NO: 728211 - RNA, 63 nt, hsa
uucagaauaauuauugcauaguagaauuuauuacuccagaacagaaagaccuuacuucauuuc

SEQ ID NO: 728212 - RNA, 63 nt, hsa
uccucuucaucucagcauucuccaucacuuccccuccagaaaaacggauggaaggaagcccuc

SEQ ID NO: 728213 - RNA, 63 nt, hsa
ccaaggagcuucagggcaguccuucuggcacugcuccagaauuccuccuucuuggugugucug

SEQ ID NO: 728214 - RNA, 63 nt, hsa
cuagauacuguguuaugugcaacuguagaaacccuccagaaauuuccacugcuguucuucacu

SEQ ID NO: 728215 - RNA, 50 nt, hsa; identical to SEQ ID NO: 240865

SEQ ID NO: 728216 - RNA, 63 nt, hsa
accacacagacucugggccuccccgcaaaauggcuccagaauuagaguaauuaugagauggug

SEQ ID NO: 728217 - RNA, 63 nt, hsa
aaauggcaacauggaauauuguccuccaugccccuccagaaggaccuaggagaguaggugagc

SEQ ID NO: 728218 - RNA, 63 nt, hsa
aaggcgucgaggaauuggaaagauuugcacacccuccagaaaggagagacgcaaucuccccuc

SEQ ID NO: 728219 - RNA, 63 nt, hsa
aaugcuuauuaugaguuuaagaagcaguucuuccuccagaaagaagggggcgauagcaugcag

SEQ ID NO: 728220 - RNA, 63 nt, hsa
ccgcagcccuggggccaguaggaagcggacccgcuccagaaguccccacgagaagaagaagaa

SEQ ID NO: 728221 - RNA, 63 nt, hsa
gacuguguugacugacgagccgagggguggccgcuccagaagggugcccagucaggccgcacc

SEQ ID NO: 728222 - RNA, 63 nt, hsa
caucauucauucucaagaccucugaaggguuggcuccagaacuuagaccuuugcuuaugcaaa

SEQ ID NO: 728223 - RNA, 63 nt, hsa
agcagauacaugucagugcagagguucucugcccuccagaagcccucgucugggaauucgaga

SEQ ID NO: 728224 - RNA, 63 nt, hsa
cccaaucccaaauuuuguuuugguucuaacuaccuccagaauguguucaauaaaaugcuuuua

SEQ ID NO: 728225 - RNA, 63 nt, hsa
ccaccaccgacucucccaacccagacucucccacuccagaauguagaagccugucucuguacc

SEQ ID NO: 728226 - RNA, 63 nt, hsa
auggacagagaagaaaaugaccaggagugucaucuccagaauuauuggggucacauauguccc

SEQ ID NO: 728227 - RNA, 63 nt, hsa
ucuucccaacuucuuacaccauugcuuuccauucuccagaacucuuuuuuccuuuuuacaaac

SEQ ID NO: 728228 - RNA, 63 nt, hsa
aaaaggggcugggacacucugaacuccugcacucuccagaagugacuggucaugaagcucaug

SEQ ID NO: 728229 - RNA, 63 nt, hsa
acucucuauuauugggcauaaagguggcuucugcuccagaacucuauccacuguauuuccaca

SEQ ID NO: 728230 - RNA, 63 nt, hsa
acgugucucagacugcauguaccauuugcauggcuccagaaaugucuaaaugcugaaaaaaca

SEQ ID NO: 728231 - RNA, 63 nt, hsa
cugggagacuucucuguacauuucugccauguacuccagaacucauccugucaaucacucugu

SEQ ID NO: 728232 - RNA, 63 nt, hsa
agugccuucugugaguuuaaaugugcuggugcccuccagaaaagccucggccucagcuccguu

SEQ ID NO: 728233 - RNA, 63 nt, hsa
gggauguaucagggaugaucagcugaugagaggcuccagaaggauuucuagaucgcuucaagc

SEQ ID NO: 728234 - RNA, 63 nt, hsa
uuuaagcuagcuuuaccuaagccacuucucagccuccagaauacucucucugggguugugagu

SEQ ID NO: 728235 - RNA, 63 nt, hsa
uacaggggcacauuuucugugguuaaaaaugaucuccagaauaaguguaaacugcaguuuucc

SEQ ID NO: 728236 - RNA, 63 nt, hsa
aauguagcugcgucauaaggagacuucugucuucuccagaaggcaauaccaaccugaaaguuc

SEQ ID NO: 728237 - RNA, 63 nt, hsa
aagcugauagcuccuccauguugguaaaauccucuccagaaucuuggaacaccuggcauguga

SEQ ID NO: 728238 - RNA, 63 nt, hsa
agcagugguuacccagacuuacagaauuauguccuccagaaaccagcaagaacacuuggaaug

SEQ ID NO: 728239 - RNA, 63 nt, hsa
ugugaucauuguugaacuucagcuccagugucucuccagaauaagacauuggcauucaaaugu

SEQ ID NO: 728240 - RNA, 63 nt, hsa
uggagccugucucaggaaggccagcugcagguccuccagaaaaucaaagaagggaagaaacuc

SEQ ID NO: 728241 - RNA, 63 nt, hsa
auaguuauccccaggccuggcacgucaaagaggcuccagaaauguuugcugagugagugauga

SEQ ID NO: 728242 - RNA, 63 nt, hsa
uagcaaacuguacauuccuucuuccucccccugcuccagaaggugccgguacugaagaugcuc

SEQ ID NO: 728243 - RNA, 63 nt, hsa
auacucucuuugccagaugaaguuacuugcuaacuccagaaauuccugcagacauccuacucg

SEQ ID NO: 728244 - RNA, 63 nt, hsa
gcccuggcucugcacauaaguguuagccagcagcuccagaaaaaucccgauucccgggaucug

SEQ ID NO: 728245 - RNA, 63 nt, hsa
gagaaauagagaaauauaaaaguguguucuuaacuccagaaccacucuuuuugcauaaauacc

SEQ ID NO: 728246 - RNA, 63 nt, hsa
guuuacugaacuccagaccaugcauguaguccacuccagaaaucaugcucgcuucccuuggca

SEQ ID NO: 728247 - RNA, 61 nt, hsa
cccaguaaaagauaugauauuuuccauagauaccuccagaauuuuuuucagcaaauggaau

SEQ ID NO: 728248 - RNA, 63 nt, hsa
aggaacgguguuauggacugaauguucauguuccuccagaauucauaugcugaagccucuguc

SEQ ID NO: 728249 - RNA, 63 nt, hsa
gucugcuggcaccuugaucuugaacuucccagccuccagaacugugagaaagaaaucucuaug

SEQ ID NO: 728250 - RNA, 63 nt, hsa
gugggaccuuguaaaaugcucccugucagagcucuccagaauaugcuuguuggagauccuuca

SEQ ID NO: 728251 - RNA, 63 nt, hsa
acggugagggcugacucugaacugucucucagucuccagaaaguguucaagccuguuguguuc

SEQ ID NO: 728252 - RNA, 63 nt, hsa
aaaggaauuagagggucagaaacacccagguuccuccagaaagcuccuuggagcccaacaacu

SEQ ID NO: 728253 - RNA, 63 nt, hsa
agaaagaugugagauaacuuacucaagauuccccuccagaaaaauacguauguuuaaaaaccc

SEQ ID NO: 728254 - RNA, 63 nt, hsa
guuuuaugauauggguuagggauucuccauggacuccagaaacccuaaaauacaauuuugagg

SEQ ID NO: 728255 - RNA, 63 nt, hsa
ugcugcauuuaucccaagaaaaacagcuuuaaucuccagaagaaaaccaaaauaccaugggau

SEQ ID NO: 728256 - RNA, 63 nt, hsa
gagugacaaaucuuuaaaguauuuacaauaucacuccagaaaagaaaacaaaucaaauaaaua

SEQ ID NO: 728257 - RNA, 63 nt, hsa
aagcuucgaaagauaucccaaaaauuucagugacuccagaagaaaugagccuccaccaccaag

SEQ ID NO: 728258 - RNA, 63 nt, hsa
gaccuaaucagcuuacaguuugaaaaccuagcucuccagaacaugagaugagccagccgagcc

SEQ ID NO: 728259 - RNA, 63 nt, hsa
uccucuacccaaagcucugucccccugcucccacuccagaagaacugcggcacgcgcuucggg

SEQ ID NO: 728260 - RNA, 63 nt, hsa
ugaccucaucucccgagcaauggcgccugcucccuccagaauggaacucaagcugguuuuaag

SEQ ID NO: 728261 - RNA, 63 nt, hsa
gcccucuuucucccagugauuacaucuaaggaccuccagaagcaugggaacaucugggugugc

SEQ ID NO: 728262 - RNA, 63 nt, hsa
ccgcaccccgccccaugccccaguccuuuccuacuccagaaaugcuccccacccccccaaaga

SEQ ID NO: 728263 - RNA, 63 nt, hsa
accuuccaaggugucugguugcccugccucuggcuccagaacagaaagggagccucacgcugg

SEQ ID NO: 728264 - RNA, 63 nt, hsa
caccaacuccuauuucccuaccaaccaaggagccuccagaaggaaaggaggaagaaauguuuu

SEQ ID NO: 728265 - RNA, 63 nt, hsa
ccucaaccccagggauucccaggaagcagaacucuccagaagaaggguuuugaucauuccagc

SEQ ID NO: 728266 - RNA, 63 nt, hsa
gcccugccucaacaggguccauugccuccucgccuccagaacuuggagcagggaagugggcac

SEQ ID NO: 728267 - RNA, 63 nt, hsa
ggaaagauauagcauagugguucucagcacagucuccagaacagaagcaucuguaguaccugg

SEQ ID NO: 728268 - RNA, 63 nt, hsa
agacauugaccccucccuccaugugguaaaccacuccagaauggccaccaggcuucccagagu

SEQ ID NO: 728269 - RNA, 63 nt, hsa
uuguguuacaucuauaaagagcaaaauaacacacuccagaacuuggcaguuguagcauuaguu

SEQ ID NO: 728270 - RNA, 63 nt, hsa
agcucauguuugugauccucuaucuggacagcucuccagaauccuguguugccccuguucugc

SEQ ID NO: 728271 - RNA, 63 nt, hsa
gaaugugccaugcaugaagcaaaggauuccaggcuccagaaaaaaugaaugaacucaccuuga

SEQ ID NO: 728272 - RNA, 63 nt, hsa
agcugggcaggacaaguaggacaucccuggagccuccagaagggacuggccucugcccacacc

SEQ ID NO: 728273 - RNA, 63 nt, hsa
gagggagugugcgaaucaagccugaccaagaggcuccagaauaaaguaugauuuguguucaau

SEQ ID NO: 728274 - RNA, 63 nt, hsa
gaagaagacacagaagccuuugauauugccacccuccagaauccugaugguaucaauggauuu

SEQ ID NO: 728275 - RNA, 63 nt, hsa
gcccagcguggggcccuagccggcguccccugccuccagaacgcggugcgugagguucccggc

SEQ ID NO: 728276 - RNA, 63 nt, hsa
accuggcagcuuuucuugccgucccuccccugccuccagaaucacagcccuucuccccaaggg

SEQ ID NO: 728277 - RNA, 63 nt, hsa
gugccggugacaagcugucugucaggggagaggcuccagaaccuggguucguccccagugaga

SEQ ID NO: 728278 - RNA, 63 nt, hsa
acacggcgucaaaaccaagcugccggccacugucuccagaacgcaaggcuccaggcccgugug

SEQ ID NO: 728279 - RNA, 63 nt, hsa
ucugcugagacugagcaccuuacagauauuuuucuccagaagauggugcuggguaauaaaauc

SEQ ID NO: 728280 - RNA, 63 nt, hsa
auccccuuuccuccccaccuuccccagacucagcuccagaauaccuucuucgcugcuagagaa

SEQ ID NO: 728281 - RNA, 63 nt, hsa
auuauucgcuccaagaaagaugcuaagucugagcuccagaagagacugugcuggguguggcuu

SEQ ID NO: 728282 - RNA, 63 nt, hsa
aggugccgccuuggccgggcccccacgugucuucuccagaaugugucugucuuugccuggugu

SEQ ID NO: 728283 - RNA, 63 nt, hsa
gcgacacacacacacuuauggcaccagccuggacuccagaaaaaggguguccagguauugugu

SEQ ID NO: 728284 - RNA, 63 nt, hsa
agcuggagcucgaucaugccugcgugacaaagccuccagaaaaauccuugaaagacaggacau

SEQ ID NO: 728285 - RNA, 63 nt, hsa
ugcggccacagcacuagagucacccccccaggccuccagaaccuuacuggcacuguggcacug

SEQ ID NO: 728286 - RNA, 63 nt, hsa
ugaucuguacuaucuagugucuaaaacacuauucuccagaaaaaucaaucauuuucuagcccu

SEQ ID NO: 728287 - RNA, 63 nt, hsa
acaaugaauguaguuaacugguuccugcucacacuccagaauuaaauucuauugaaaaaggaa

SEQ ID NO: 728288 - RNA, 63 nt, hsa
ugcagaucacagugcuggaagcaggaacccaggcuccagaagguguugccaggggcccagaug

SEQ ID NO: 728289 - RNA, 63 nt, hsa
aaagaugaacaucggaauaacaaacauuguccucuccagaaaguccuuucuuucuccauacug

SEQ ID NO: 728290 - RNA, 63 nt, hsa
cucaggauuuagaaagucuguaagccauccaugcuccagaaagcaccgaucuguuguaguugc

SEQ ID NO: 728291 - RNA, 63 nt, hsa
cguggaggcgugugcaggcuuggaagaagaacucuccagaacauggaacuuaacccucuuuug

SEQ ID NO: 728292 - RNA, 63 nt, hsa
cugaggccagagggaggagagaauugcucauggcuccagaacugguggcaaguuucucuggac

SEQ ID NO: 728293 - RNA, 63 nt, hsa
ucuggauacagccuuuuggguaaacacugggaacuccagaaguuguggggagaguggggaauc

SEQ ID NO: 728294 - RNA, 63 nt, hsa
cccccuucaccccuccuugcccgccuacccucccuccagaauagccccucacccuucuucccc

SEQ ID NO: 728295 - RNA, 63 nt, hsa
ggguaacuggggggccaccaugaccccuucucucuccagaaacagcugcuucuccccccaucc

SEQ ID NO: 728296 - RNA, 63 nt, hsa
ccuucuucauccuuccuuacgaucaaucacagucuccagaagaucagcucaauugcugugcag

SEQ ID NO: 728297 - RNA, 63 nt, hsa
gcaagggggaccgaugcugugcagcucacaccacuccagaaccugacaaggcaccagcaggac

SEQ ID NO: 728298 - RNA, 63 nt, hsa
cuccuggucgugccccgucucuuuugguccuggcuccagaaaacccgcgccccacauaccugc

SEQ ID NO: 728299 - RNA, 63 nt, hsa
uguggacacuuuugacagcuuggcagauuuuaacuccagaagcacuuuaugaaaugguacacu

SEQ ID NO: 728300 - RNA, 63 nt, hsa
uuguuccaaguuugucaaugagguuuauggagccuccagaacagaugccaucuuccugaaugu

SEQ ID NO: 728301 - RNA, 63 nt, hsa
uguuccugccccacaggaauagaauggagggagcuccagaaacuuuccaucccaaaggcaguc

SEQ ID NO: 728302 - RNA, 63 nt, hsa
gcaaaccucacaggguccccacacaacagugcccuccagaagcagccccucggaggcagagga

SEQ ID NO: 728303 - RNA, 63 nt, hsa
acucaugguuuuaaauauagaccaucaucgaaacuccagaaauuuauccacuguggaugauga

SEQ ID NO: 728304 - RNA, 63 nt, hsa
cccacacccacccccaccccacccccacccagccuccagaagcuggaaccauuucucccgcag

SEQ ID NO: 728305 - RNA, 63 nt, hsa
aaagcagcucuccccucagagugcaagccccugcuccagaagauagcuucaccccaaucccag

SEQ ID NO: 728306 - RNA, 63 nt, hsa
gagauggggaggagauauggagugagucaccugcuccagaagaugccagcuucucucuccagg

SEQ ID NO: 728307 - RNA, 63 nt, hsa
ucugcccuucacuuagcaccugccucagccccacuccagaauagccaagagaacccaaaccaa

SEQ ID NO: 728308 - RNA, 63 nt, hsa
ugagcccauugaaacugaucuugagcuccuggccuccagaauugcaggagaauaaauuugugu

SEQ ID NO: 728309 - RNA, 63 nt, hsa
aggugucuacugaaaagggaaccugcuucuuuacuccagaacucuguucuuuaaagaccaaga

SEQ ID NO: 728310 - RNA, 63 nt, hsa
gaaggaaaaugaagagagccaguauuuccccuucuccagaagcagguacucagcuuucuggga

SEQ ID NO: 728311 - RNA, 63 nt, hsa
aaucccccgcugcagggacacccacgcccuucucuccagaagccgggcaggcagaauccggcc

SEQ ID NO: 728312 - RNA, 63 nt, hsa
gagggagaggaggggguuggggaggacccaccucuccagaauggcgacuguccccauccgccu

SEQ ID NO: 728313 - RNA, 63 nt, hsa
caucuaaguuagagcuggcaccagaacugagaccuccagaaaucuauuccaguauuuuuucca

SEQ ID NO: 728314 - RNA, 63 nt, hsa
cuguccugcuuugccuuuugucacuagaauguucuccagaaaccccaguuucugucaucuuaa

SEQ ID NO: 728315 - RNA, 63 nt, hsa
auucucagaaaauccaaccauaucuuagaguaucuccagaaacuggcuuagaggagcuccaaa

SEQ ID NO: 728316 - RNA, 57 nt, hsa; identical to SEQ ID NO: 240966

SEQ ID NO: 728317 - RNA, 63 nt, hsa
gugauacuccaacaccguccaguuguggcagcucuccagaaguaauagcagcugacaacuuuc

SEQ ID NO: 728318 - RNA, 63 nt, hsa
gcaagggcucagcugggaucugcgcccggccugcuccagaacgcagcccacucgccaccggug

SEQ ID NO: 728319 - RNA, 63 nt, hsa
ggguuugcuggggaacuggcgccaucgccgggacuccagaaccgcagaagccuccccagcuca

SEQ ID NO: 728320 - RNA, 63 nt, hsa
cccugcccucuccucacaggucuguugcagggacuccagaaaccauucugggagccguggaug

SEQ ID NO: 728321 - RNA, 63 nt, hsa
gguucaugaugcauaaagcgcuaggcccuagaacuccagaaacagcacagcuggggcggggac

SEQ ID NO: 728322 - RNA, 63 nt, hsa
ccacagccacaccucaccgcccaguccagcugucuccagaaggggacaggcaguccgcggucu

SEQ ID NO: 728323 - RNA, 63 nt, hsa
uuggccaccaguucuucggccagcaccucugcccuccagaaccugcagccuggaggggugagg

SEQ ID NO: 728324 - RNA, 63 nt, hsa
cagcccggagcccagcccccugccccggcccugcuccagaacccagcccagaucggaggacaa

SEQ ID NO: 728325 - RNA, 63 nt, hsa
uagaacccaauccaauuuggagccccagcccaacuccagaacccaacccuucucuagaaucca

SEQ ID NO: 728326 - RNA, 63 nt, hsa
cggcugggucugcguccuuuccugugccuuucccuccagaaugcggccucagaccuagaagcu

SEQ ID NO: 728327 - RNA, 63 nt, hsa
ugucccagcuagcaccugagagcugggccuccucuccagaaucauguggaggggccagaggcc

SEQ ID NO: 728328 - RNA, 63 nt, hsa
auuuucucggaggugauaggcuuccacacaggucuccagaagcccugcauugaauauccaucc

SEQ ID NO: 728329 - RNA, 63 nt, hsa
uguuccagcaucuucccuggauggcuggaggaacuccagaaaauauccaucuucuuuuugugg

SEQ ID NO: 728330 - RNA, 63 nt, hsa
ccagcuccacugcccaggcccccaagagggcagcuccagaagcugcccagggcuccgggaccc

SEQ ID NO: 728331 - RNA, 63 nt, hsa
cccuuaggggcugaggaagcugcccucgaaacccuccagaagacaucuguccugcagaggccc

SEQ ID NO: 728332 - RNA, 63 nt, hsa
uccuuauccaaaucaauaaagagagaauccucccuccagaaggguuucuaaaaacagcccuca

SEQ ID NO: 728333 - RNA, 63 nt, hsa
ucuaggacagauuuuacguggagaguugaacuacuccagaaacuaaagaguaauguuucuaga

SEQ ID NO: 728334 - RNA, 63 nt, hsa
gugagaccuccuggaacacuggcaucucugagccuccagaagggguucugggccuaguugucc

SEQ ID NO: 728335 - RNA, 63 nt, hsa
ccccgccuggcacucagccuugccagagauuggcuccagaauuuuugccaggcuuacagaaca

SEQ ID NO: 728336 - RNA, 63 nt, hsa
gagagggucucucuccuagcugcuacccaggaccuccagaaggagcccuuggaccucugggag

SEQ ID NO: 728337 - RNA, 63 nt, hsa
uacuaagugcuuaguaaauguuagauaaguauucuccagaauugauguaaauuauuuuuaaac

SEQ ID NO: 728338 - RNA, 63 nt, hsa
guuauauaaauuccacauuuuuaugcaacuaaucuccagaacauuuuuccucuuaccaagaag

SEQ ID NO: 728339 - RNA, 63 nt, hsa
ggaguggcacaggugacccaggcguccuuucagcuccagaauguugcaagucuaggagagugu

SEQ ID NO: 728340 - RNA, 63 nt, hsa
cgcugggcuucacggcugccaggagccucuccccuccagaagacuugccugcuagggaccucg

SEQ ID NO: 728341 - RNA, 63 nt, hsa
agagugaggcucuguccaauacauggcucugcccuccagaacuucaggcucucagugacccuu

SEQ ID NO: 728342 - RNA, 63 nt, hsa
acccugucuccaccuugauauugcacuuccaggcuccagaacugugaggcaauaaauuucucu

SEQ ID NO: 728343 - RNA, 63 nt, hsa
auggucacagggccguccuguuccuccccgggacuccagaauuucucuccucaaaggaaagaa

SEQ ID NO: 728344 - RNA, 63 nt, hsa
ucucgggcugccagcgaugggcaggcgagaccccuccagaaucugcaggcgccucugguucuc

SEQ ID NO: 728345 - RNA, 63 nt, hsa
gcggacgggggucccgagguggaaaccauugcccuccagaacaaccgugagaaccaggcauuc

SEQ ID NO: 728346 - RNA, 63 nt, hsa
aacuucuaggcucaagcaucuaccugccucagccuccagaagugcugggauuacaaaugugag

SEQ ID NO: 728347 - RNA, 63 nt, hsa
agucaaacucucauuuaggugacagccuggugacuccagaauggagccagucaugcuaaaugc

SEQ ID NO: 728348 - RNA, 63 nt, hsa
gccgggugucuuuagggaucaguuuuuccaagacuccagaaggugccagguucuccccuugag

SEQ ID NO: 728349 - RNA, 63 nt, hsa
agguaacugagagcagaugguccuccauuucaacuccagaaguggggcucugggagggauguu

SEQ ID NO: 728350 - RNA, 63 nt, hsa
cuccagaauccacaaagccgugccuuucucuggcuccagaauaugcauaaucagcgcccugga

SEQ ID NO: 728351 - RNA, 63 nt, hsa
acccccuccagcuccaguuuccaaguuccugcacuccagaauccacaaagccgugccuuucuc

SEQ ID NO: 728352 - RNA, 63 nt, hsa
acaggaaaccaggcagaggaggcacagggugcucuccagaacgagaagccagcuccuggaguu

SEQ ID NO: 728353 - RNA, 63 nt, hsa
gagaauuagagaauuuauuugugucagaaaauacuccagaacaaccaccccauauuaugauua

SEQ ID NO: 728354 - RNA, 63 nt, hsa
agaucucauacucaacagaaggagacucagagacuccagaaggcacaggagcugcccccagug

SEQ ID NO: 728355 - RNA, 63 nt, hsa
ccucaacacuugagggcccagaaagucugaucucuccagaaugaucagcccagaggaaugcug

SEQ ID NO: 728356 - RNA, 62 nt, hsa
guaaauuaggaggcucaacaauaaaacauuaugcuccagaaauuaugugagaugugcuauau

SEQ ID NO: 728357 - RNA, 63 nt, hsa
aucuguaagcaccuugaucuuggacuucucagccuccagaauugugagaaauaaauuucuguu

SEQ ID NO: 728358 - RNA, 63 nt, hsa
gagacaagcauggugcugcugcuucugcugcuucuccagaaaaucccugggacaccuuuguuc

SEQ ID NO: 728359 - RNA, 63 nt, hsa
cuuugcaggcguccaauccuagaaaccaauggucuccagaacucucacacaaguguuuuucug

SEQ ID NO: 728360 - RNA, 63 nt, hsa
ugacuggcauccugcuuuccagugccugccagccuccagaagagccaggugccugacuaguac

SEQ ID NO: 728361 - RNA, 63 nt, hsa
guuguuaguuuugaagaguggaggagcuaggggcuccagaaagaaucuuacacauguguugaa

SEQ ID NO: 728362 - RNA, 63 nt, hsa
cuuaucccuugaauuuucaauauuguggaaucacuccagaagauccuuucaugugaaguuuuu

SEQ ID NO: 728363 - RNA, 63 nt, hsa
gcccaacauacgcacugggcauuggguaagggacuccagaagcagcagcuagaaagagaaaaa

SEQ ID NO: 728364 - RNA, 63 nt, hsa
uucuggccccaacccuugacucaacggggacaacuccagaaggucauuccagauccagagauc

SEQ ID NO: 728365 - RNA, 63 nt, hsa
ccugugugccccuggcuuucugggucugugccucuccagaaucuugucuuacccuccggugug

SEQ ID NO: 728366 - RNA, 63 nt, hsa
gguggggggaccccaaagccauucugggaagggcuccagaagaagguccagccuaggcccccu

SEQ ID NO: 728367 - RNA, 63 nt, hsa
acaagucuugcuaaaugugauacuguugacauccuccagaauggccagaagugcaauuaaccu

SEQ ID NO: 728368 - RNA, 63 nt, hsa
accuacugauguuuugauguugaacuucccagccuccagaacucugggaaaauaaaguccucu

SEQ ID NO: 728369 - RNA, 63 nt, hsa
cuggcuagaguccucacucccaguccaaauguccuccagaagccucuggcuagaggccagccc

SEQ ID NO: 728370 - RNA, 63 nt, hsa
uggaaacauuuaauuuauaccccucuccucugucuccagaagcuucuagcucuggggucuggc

SEQ ID NO: 728371 - RNA, 63 nt, hsa
ucuccuggauucaaacaauucuccugccucagccuccagaauagcugggauuacaggcguaca

SEQ ID NO: 728372 - RNA, 63 nt, hsa
auaccaugggaaggagccaucuccacucuccuucuccagaacccccuugaagggccuuuggga

SEQ ID NO: 728373 - RNA, 63 nt, hsa
aaguguucaguaaauauuugcugcuugaaucugcuccagaauuaacaagaaagccaucucuuc

SEQ ID NO: 728374 - RNA, 63 nt, hsa
aucuccuaccccacauccugucuuagccgcagucuccagaacccaugaugaacugugaucugc

SEQ ID NO: 728375 - RNA, 63 nt, hsa; identical to SEQ ID NO: 241025

SEQ ID NO: 728376 - RNA, 63 nt, hsa
ucuauaacagaagugacauguguacugauuuuucuccagaaauauggaugcuguuguauucag

SEQ ID NO: 728377 - RNA, 63 nt, hsa
ccuaggccuuuucaugcuucauuucuuccacuucuccagaaaauggaagcuaugaagcaacau

SEQ ID NO: 728378 - RNA, 63 nt, hsa
uuccuccacacaggucgccgugagucaagcugccuccagaaccucagagcuucccuggugggc

SEQ ID NO: 728379 - RNA, 63 nt, hsa
ugaccgggcuguucuguagacucaggaccguggcuccagaacuccugugccaggcgggaggga

SEQ ID NO: 728380 - RNA, 63 nt, hsa
uccggccggagaggccucccgcggacgccgucucuccagaacuccgcuuccaagagggagccu

SEQ ID NO: 728381 - RNA, 63 nt, hsa
cuauccugggagaucuaccugaaggagaacuaccuccagaaccgacaguuccagcaaaagcag

SEQ ID NO: 728382 - RNA, 63 nt, hsa
cgcaucccacucuaugcgaaccacaagacccuccuccagaaggcagccgcugaguucggggcu

SEQ ID NO: 728383 - RNA, 63 nt, hsa
gggugcagggggcugugggcauccagcgucauccuccagaaccucacaucugaacugggggca

SEQ ID NO: 728384 - RNA, 63 nt, hsa
agauugcuuugugaagcucuugguagagacacgcuccagaagggauaacaaaaucaaauagua

SEQ ID NO: 728385 - RNA, 63 nt, hsa
aagcacagcccugcuugaauucaaacuuuuggccuccagaacugugagucaguaccuguuguu

SEQ ID NO: 728386 - RNA, 63 nt, hsa
agacaggcuggauuccaguguugggacagccaucuccagaaaccugacuuaagagaguaagau

SEQ ID NO: 728387 - RNA, 63 nt, hsa
gcugguucccggaaugaaucagcugcugacugucuccagaagggcuggaaaggaugcugccag

SEQ ID NO: 728388 - RNA, 63 nt, hsa
guggaaacaaagcaggaccagcaggcacagcaccuccagaacagugccccggaugaccagagg

SEQ ID NO: 728389 - RNA, 63 nt, hsa
cugccuucuggcugacaauccuggaaaucuguucuccagaauccaggccaaaaaguucacagu

SEQ ID NO: 728390 - RNA, 63 nt, hsa
ccauagggagcuggcuggggguuuccgugggagcuccagaacuuuccccagcugagugaagag

SEQ ID NO: 728391 - RNA, 63 nt, hsa
auaggacaauuugcugaggucugagaggacucccuccagaaaaucccugaucucuuaaaauuu

SEQ ID NO: 728392 - RNA, 63 nt, hsa
gcugcagccuacugaggaggcagaggccaccuccuccagaaagcccucggccugggccgccgc

SEQ ID NO: 728393 - RNA, 63 nt, hsa
acugccuuucuuccccucaagucaacuuuugugcuccagaaaauuuucuauucuguaagucug

SEQ ID NO: 728394 - RNA, 63 nt, hsa
aagauccugcggcuggggccgucugccuacacgcuccagaagggccagcgcagagcugggaug

SEQ ID NO: 728395 - RNA, 63 nt, hsa
ccgugacugcugccucaucgauaccccauuuagcuccagaaagcaaagaaaacucgaguaaca

SEQ ID NO: 728396 - RNA, 63 nt, hsa
caccgaggcucccgugacuuugaacucccuacucuccagaauccaggggcuauagcgaugggg

SEQ ID NO: 728397 - RNA, 63 nt, hsa
ucuccucugcagcucagggacuggcacacuggccuccagaagggcagcuccacagggcagggc

SEQ ID NO: 728398 - RNA, 63 nt, hsa
gugccucccauuuccccucaccuguacccacaccuccagaaugcccugcccugcgaguguguc

SEQ ID NO: 728399 - RNA, 63 nt, hsa
uaaacuggcuuacuauagacuucguaaaaauggcuccagaagaguaacaaacugaaaucuuug

SEQ ID NO: 728400 - RNA, 63 nt, hsa
ucugucuggggacgaaggguuggacgggaugaccuccagaagucccuucaauuucuaguaccu

SEQ ID NO: 728401 - RNA, 63 nt, hsa
uuagccuccagguccagacuacuacucuauguucuccagaagggugcuaagucaccuacugaa

SEQ ID NO: 728402 - RNA, 63 nt, hsa
gccuaugaggcaucuggccccugguagccagcucuccagaauuacuuguagguaauuccucuc

SEQ ID NO: 728403 - RNA, 60 nt, hsa; identical to SEQ ID NO: 241053

SEQ ID NO: 728404 - RNA, 63 nt, hsa
caaggccagagacuucaagucuaucugaaaagucuccagaagucuaaccccagauaaauagcc

SEQ ID NO: 728405 - RNA, 63 nt, hsa
cuauuuuccaacugaagucagggacauugccagcuccagaaaacauccauaacauaguaaaga

SEQ ID NO: 728406 - RNA, 63 nt, hsa
auaaagaaucauuagaaauuaugaguggaaauucuccagaaagauaguauuauagagucuuuu

SEQ ID NO: 728407 - RNA, 63 nt, hsa
guuuuuuuaaaaaagaggacuugcaucagcugccuccagaacaauuuuaagaaaauaacaaag

SEQ ID NO: 728408 - RNA, 63 nt, hsa
cugcucuccuguauuauccuccacaauaaaauucuccagaaaauaagucccagugucugcugu

SEQ ID NO: 728409 - RNA, 63 nt, hsa
gagaaggguaguuugaggugugacaccaguuugcuccagaaaguuuaaggggucuguuucuca

SEQ ID NO: 728410 - RNA, 63 nt, hsa
ucaguccuagcaagaagcgagaauucugagauccuccagaaagucgagcagcacccaccucca

SEQ ID NO: 728411 - RNA, 63 nt, hsa
gaagggaaggggggucagaagagagggugaguccuccagaacucuuccuccaaggacagaagg

SEQ ID NO: 728412 - RNA, 63 nt, hsa
aaaaggucaagauuucuaucacuuccccgucuucuccagaacuugugucuccagaggaguacg

SEQ ID NO: 728413 - RNA, 65 nt, hsa
ccaggaagcacacugggugcagauaaucaggacauuccagagauccccaauuuaagagggucauu

SEQ ID NO: 728414 - RNA, 65 nt, hsa
ucuugcgcucagcacacucuagggaauaauuccacuccagagauggggcugcuucaaggucuuuu

SEQ ID NO: 728415 - RNA, 65 nt, hsa
augagagcaaaccguaguccccuggagacagcgacuccagagaaccucuugggagacagaagagg

SEQ ID NO: 728416 - RNA, 65 nt, hsa
agguggguggacccaagcuugucugcugccugaguuccagagagggaggacccugggguggaggg

SEQ ID NO: 728417 - RNA, 65 nt, hsa
gcgggcugcccugugggcuggugcuucaggaggaauccagagaaguguucagaugccccccuugg

SEQ ID NO: 728418 - RNA, 65 nt, hsa
cagcuucugcgaucagauuaucaucaccaccacccuccagagaauuuuuacgcaagaagagccaa

SEQ ID NO: 728419 - RNA, 65 nt, hsa
gauguugugaggcgugagugagaugauuaaagcguuccagagagugcgcucuuggaugauagccg

SEQ ID NO: 728420 - RNA, 65 nt, hsa
acgacuaccuguugggaaggacaaagggaugaggcuccagagagaguuggcugccacagccucug

SEQ ID NO: 728421 - RNA, 65 nt, hsa
gaagacaagguguuucugccaaacggggaccuccauccagagaaaaggaagaaggugcagggugg

SEQ ID NO: 728422 - RNA, 65 nt, hsa
gugggauuagagucaggccagaaagagaacauucauccagagaucccagaguuggggaucuggcu

SEQ ID NO: 728423 - RNA, 65 nt, hsa
aaguucuccguuaguuccuguauuagucaagguuuuccagagaaacagaaucaauauauauuggg

SEQ ID NO: 728424 - RNA, 65 nt, hsa
uuaaauauuguacacuuugccuuuuugaguaacauuccagagauagguauuuuuuguaggcuguu

SEQ ID NO: 728425 - RNA, 65 nt, hsa
acucaaggacaaggggggacaguuuugccuacagcuccagagacacagagaacaaaggggugacc

SEQ ID NO: 728426 - RNA, 65 nt, hsa
ugccagcuggcaaaugagggcuggacucucuucccuccagagaccaccccgcuccuugcugcagc

SEQ ID NO: 728427 - RNA, 65 nt, hsa
caagguaucccagccuggacaggcauggaccugucuccagagagaggagccugaaguucgugggg

SEQ ID NO: 728428 - RNA, 65 nt, hsa
gagaagcggcgauaccauagaguccagaucuugccuccagagauuugcuuuaccuuccugauuuu

SEQ ID NO: 728429 - RNA, 65 nt, hsa
gggggaagccagugauccagccccaccaaggggccuccagagaccccaggaacaauaagugucuc

SEQ ID NO: 728430 - RNA, 65 nt, hsa
ccagcucagucccacagccccuugcuucuaagggauccagagaccugcuccagauccucuuuccc

SEQ ID NO: 728431 - RNA, 65 nt, hsa
guuguggucuauuuagggacaaagaagguauaaaguccagagaugagaaaacugggucagcccuc

SEQ ID NO: 728432 - RNA, 65 nt, hsa
gugauuagggugaggcacaaagaguuucuugaucauccagagaacauugacagacaauuaugaau

SEQ ID NO: 728433 - RNA, 65 nt, hsa
guguguuuuguucugaucaagggguagggaaccuuuccagagaagucccauuaguaagaaaugac

SEQ ID NO: 728434 - RNA, 65 nt, hsa
cauuagauaugauuuaaccauaagcagcagcacgauccagagauccauugccaucagugaucuca

SEQ ID NO: 728435 - RNA, 65 nt, hsa
caguaauuucagccuuauaauuagcaaaaacaucuuccagagaauaaagucuucuguggcuuuag

SEQ ID NO: 728436 - RNA, 65 nt, hsa
ugcaauuaauuuuauuaacugauuucuggucuaucuccagagauaaaauaccauuccuucacaac

SEQ ID NO: 728437 - RNA, 65 nt, hsa
ccgagccacaccuuuggaaguaaugauuuggccauuccagagauucuggggcuaaaguuuguuuu

SEQ ID NO: 728438 - RNA, 65 nt, hsa
agccccucacuuuacagaugaggaaauggaggugguccagagagggucugggauucccaagguca

SEQ ID NO: 728439 - RNA, 65 nt, hsa
gugacuggaggggcaggagaugguccaaguguccauccagagaugagacucuuagaaucaaagug

SEQ ID NO: 728440 - RNA, 65 nt, hsa
gcuggggcauucuuuacaccuacaaaaaguuauuuuccagagaauguagcuguuuccaggguugc

SEQ ID NO: 728441 - RNA, 65 nt, hsa
uaaggagcaccaaagcugaggcuggcucagagaucuccagagaagcugcagccugcccuggcccu

SEQ ID NO: 728442 - RNA, 65 nt, hsa
aaggugucuucuuugacuuaaugucuuuaaaaguauccagagauacuacaauauuaacauaagaa

SEQ ID NO: 728443 - RNA, 65 nt, hsa
aaaaccagaaauggaaauaaggaauucaggggaguuccagagacuuacaaaaugaacucauuuua

SEQ ID NO: 728444 - RNA, 65 nt, hsa
cacuuaaccuaauuuaugcuuucgacuguucuguuuccagagaggaaagccuuuacaaauuacuc

SEQ ID NO: 728445 - RNA, 65 nt, hsa
cuauguacuacucuacccccugccuuagagcaccuuccagagaagcuauuccaggucucaacaua

SEQ ID NO: 728446 - RNA, 65 nt, hsa
caguacaagucaggucaggcuucaugccugcauccuccagagaccacaggagccaaagcgagccu

SEQ ID NO: 728447 - RNA, 65 nt, hsa
ggacccaugucuccugggacagaggccaucucucuuccagagagaggcagcauuggcccacagga

SEQ ID NO: 728448 - RNA, 65 nt, hsa
uuuucccugccaucucaaagaggagcaauguaucuuccagagaagauuuuauuugugguuuauua

SEQ ID NO: 728449 - RNA, 65 nt, hsa
gggguuuugaugcccucacuaguguugaagccuguuccagagagaggugggacugcaaggagagg

SEQ ID NO: 728450 - RNA, 65 nt, hsa
ccccaagguaguaaacccugccccuguuacugugcuccagagaccuccuaagggaagggacaguu

SEQ ID NO: 728451 - RNA, 65 nt, hsa
uaucaguuugaccacgggccuuuugcuacauucuauccagagagcaggccugccagccccucucc

SEQ ID NO: 728452 - RNA, 65 nt, hsa
acauuuuaagccuuuuguuuuuaaauuucuuuucuuccagagauuguuuaaaaauaaauauugac

SEQ ID NO: 728453 - RNA, 56 nt, hsa
uaaagcaggcagagcuuugauaacucuccagagaaccuuuagaauaucuuuucaag

SEQ ID NO: 728454 - RNA, 65 nt, hsa
accuguugaagugauauucauuguugcuguacagauccagagagccuuuuguccccaccucucug

SEQ ID NO: 728455 - RNA, 65 nt, hsa
auuuuauuuuugaaggaaaaauugcuuauacuaaguccagagacaugcaggugagcccuuuuguc

SEQ ID NO: 728456 - RNA, 65 nt, hsa
acucucucuuccuucuccuuuucuuuccuucccucuccagagauguugguuucuacagcaacccu

SEQ ID NO: 728457 - RNA, 65 nt, hsa
ugaaacacauacagacucaacagcaaucaugcaguuccagagacacaugaaccugacacaaucuc

SEQ ID NO: 728458 - RNA, 65 nt, hsa
gggggcagccagugacccagccccaccaaugggccuccagagaccccaggaacaauaaaaugucu

SEQ ID NO: 728459 - RNA, 65 nt, hsa
agaguuugcuccaagugggaaagggucccaagcaguccagagaagaugucuguguggcuuucccu

SEQ ID NO: 728460 - RNA, 65 nt, hsa
ucuuuccaggggaaggaggugcucagggguggguauccagagagccauacuucugagggaagacu

SEQ ID NO: 728461 - RNA, 65 nt, hsa
cuguaucucuuguucucuccuauuugaguuucacuuccagagaacuuguucuucagcaagaaugu

SEQ ID NO: 728462 - RNA, 65 nt, hsa
ugaaaauaaugucuacaguccacagcuucagcauuuccagagaccacaugugagcuucuuuuagg

SEQ ID NO: 728463 - RNA, 65 nt, hsa
guugaugaggccucuuggaccucugcucugaggcuuccagagaguccucuggauggcaccagagg

SEQ ID NO: 728464 - RNA, 65 nt, hsa
cugaggggccagguccaccaggccuacagucaaacuccagagaugcccaagacccccgcuuccau

SEQ ID NO: 728465 - RNA, 65 nt, hsa
caucaauaguuuauauugcuuuaccugugcuggcuuccagagauggaaacaaacccaggugucuc

SEQ ID NO: 728466 - RNA, 65 nt, hsa
acacugcaccuuaucccaggaaccugcccuagaccuccagagaccauauuuucucucccuccauu

SEQ ID NO: 728467 - RNA, 65 nt, hsa
cccccucucuccucccuuccuucccuccccgcaucuccagagagagccucucagcagcagggggg

SEQ ID NO: 728468 - RNA, 65 nt, hsa
gauccugguuucaaugacgguuggaaauagaaauuuccagagaagagaguauuggguagauauuu

SEQ ID NO: 728469 - RNA, 65 nt, hsa
aauagugauaauaacaucagauuuuaauauaacauuccagagaauuguggaaaauacugcauaua

SEQ ID NO: 728470 - RNA, 65 nt, hsa
cacaccuagaauguaaguuaaacaaaauaccggcuuccagagaccccuuuucuccagccauauua

SEQ ID NO: 728471 - RNA, 65 nt, hsa
gauuuauagccagccaucuaucaccucuagaagguuccagagacagugaaacugcaagaugcucu

SEQ ID NO: 728472 - RNA, 65 nt, hsa
uuuaaaucacuugagguaugaaguuuauccuguuuuccagagauaaacauaaguugaucuuccca

SEQ ID NO: 728473 - RNA, 65 nt, hsa
gugcaccugccucccacugacccagacccacuuccuccagagaggccucucuccgccugagcuau

SEQ ID NO: 728474 - RNA, 65 nt, hsa
gggagagucuaguucacugcccucccucagcugacuccagagauggagguagaaggaauugccuu

SEQ ID NO: 728475 - RNA, 65 nt, hsa
cugauggcauucacuucacacagucgucuauguuauccagagauuuuuauuucauuuuacauuuu

SEQ ID NO: 728476 - RNA, 65 nt, hsa
gauuguuuaacaguauguguggugaugucauuaucuccagagaggcuucaagaaauccuuuggaa

SEQ ID NO: 728477 - RNA, 65 nt, hsa
ugaaauuucccaaaauaauuauggcuucugucaucuccagagauaaucuggcuugguuuacccca

SEQ ID NO: 728478 - RNA, 65 nt, hsa
cauuucuuuacugcugccauuuuccucaccaguauuccagagauggucauagcucauuacucuac

SEQ ID NO: 728479 - RNA, 65 nt, hsa
aaauuuguaacaugagucagugggacuggugugcuuccagagagugucuucgaggguaucaucau

SEQ ID NO: 728480 - RNA, 65 nt, hsa
gagauaaaccaaguuuuuggaaaugguccuguuacuccagagaaaauugagcagcucagguaaga

SEQ ID NO: 728481 - RNA, 65 nt, hsa
gcagguucaucggguacugggacccagcagugugauccagagagcagugggagacgcuggcagca

SEQ ID NO: 728482 - RNA, 65 nt, hsa
gagcccaccagccagcccuggcccaccccccagccuccagagaagccccgcacgggcugucuggg

SEQ ID NO: 728483 - RNA, 65 nt, hsa
agaauccuggcugccaugugguugaugccagccccuccagagaaaagguccugcagacgguauua

SEQ ID NO: 728484 - RNA, 65 nt, hsa
guacaauauguguccaugagaauguaggaaugggcuccagagagaagacauuuauauuaugaaau

SEQ ID NO: 728485 - RNA, 65 nt, hsa
aagaagaaugaauuaagggagcaauuuuuauuacuuccagagauccucuucuuucacuggaauua

SEQ ID NO: 728486 - RNA, 65 nt, hsa
uugccuucuugcauucugggucccagccuccuguauccagagaugcaguggcucuccauugccac

SEQ ID NO: 728487 - RNA, 65 nt, hsa
ugccuguauuggucccuucugaccacucuccugccuccagagaaagcucugcuucacccuggaag

SEQ ID NO: 728488 - RNA, 65 nt, hsa
cccacaaaaugcagcccaccacccagucccccaauuccagagagaaacacaucacuagauugacg

SEQ ID NO: 728489 - RNA, 65 nt, hsa
aaucaugauggcaggaaggcccacagucgccguauuccagagaugcgacauuagcauaaacacau

SEQ ID NO: 728490 - RNA, 65 nt, hsa
gcaaggagagggagggcccacaggucagaaaaagcuccagagaccucacagcauuguagggcggg

SEQ ID NO: 728491 - RNA, 65 nt, hsa
augacccuccccuagucacucauccauccccuggcuccagagauggucacaugacccaggccugg

SEQ ID NO: 728492 - RNA, 65 nt, hsa
uccacccagcccacuaacugaggagcuaguguuaauccagagaaccccccgcaaugugcuuccga

SEQ ID NO: 728493 - RNA, 65 nt, hsa
accaaauaaaccuucggagaacgucacuaagcuuuuccagagagaagacccuagaugaaguugga

SEQ ID NO: 728494 - RNA, 65 nt, hsa
cuguuaacugaagccugcuccuucuuguucugcccuccagagauuugcucaaaugaucaauaagc

SEQ ID NO: 728495 - RNA, 65 nt, hsa
gucggaccacuggccaggggaccuuugauugucuuuccagagaugcugcucucugcagggcacca

SEQ ID NO: 728496 - RNA, 65 nt, hsa
agcaguuaggcaccuuaacuggagaccagaaaccuuccagagaacacagggcugcaucccgagca

SEQ ID NO: 728497 - RNA, 65 nt, hsa
auuaaaggcagaaaaacuggaaaaccuacugcagguccagagacuucuguuuuacaacugggaaa

SEQ ID NO: 728498 - RNA, 65 nt, hsa
uagcugcuugcugaggucuuuuaguugguaauaacuccagagaagcagccuguguauauuccuaa

SEQ ID NO: 728499 - RNA, 65 nt, hsa
aaaacugaagccuaagagagaaacuguccuaguuguccagagauaaaaaucauauagaccaauug

SEQ ID NO: 728500 - RNA, 65 nt, hsa
cucaugaaaauccugaguuaauuuggaaugauaauuccagagauaaaguguccacaacaguuagg

SEQ ID NO: 728501 - RNA, 65 nt, hsa
guuugacacccuccuuagagggcugcucuuuuuuuuccagagauaauccuagccauccucuccac

SEQ ID NO: 728502 - RNA, 65 nt, hsa
aggugcaagauggaaaggauuguaggugcaagcuguccagagaaaagaguccuuguuccagcccu

SEQ ID NO: 728503 - RNA, 65 nt, hsa
ccaacuucacccaugcaugagagacucuccuccuuuccagagagaaucggaucgcaccacgugug

SEQ ID NO: 728504 - RNA, 65 nt, hsa
aggugguacaggggauuggaaacaugcuccgcgccuccagagaaaaguugcucccgagguccaug

SEQ ID NO: 728505 - RNA, 65 nt, hsa
ggcgggaggaucgcuugaaccugggaggcggagguuccagagagccaagaucgcaccacugcacu

SEQ ID NO: 728506 - RNA, 65 nt, hsa
ccuucgauuccauuuuaccuccucuucugaucacuuccagagaugagcuguuucuggauaauggc

SEQ ID NO: 728507 - RNA, 65 nt, hsa
accagcaaaucugcaaaccaagcacuuuguuaaucuccagagagagcaaauacagcaaucuagag

SEQ ID NO: 728508 - RNA, 65 nt, hsa
ugcuccaggccgaggcugggcuacccucagggagauccagagacucaugcccauggccauccaug

SEQ ID NO: 728509 - RNA, 65 nt, hsa
ugguagaaagaagaugaaugagcaaaaccaaauauuccagagacugggacuaaguguaccagaga

SEQ ID NO: 728510 - RNA, 65 nt, hsa
gacaccggucugcagggaguuggggacuaagggcuuccagagaguggcuggaagagacuccaggc

SEQ ID NO: 728511 - RNA, 65 nt, hsa
cacccucuugcugcucgcccugcucccugcuucgguccagagaacuggcagauacuggugggaag

SEQ ID NO: 728512 - RNA, 65 nt, hsa
auaugcaucuacuuggcaaggucauagacaauuccuccagagacacugagccagucuuugaacug

SEQ ID NO: 728513 - RNA, 65 nt, hsa
agccaaccccaccucuaugcccugagcccugguaguccagagaccccaacucugcccuggcuucu

SEQ ID NO: 728514 - RNA, 65 nt, hsa
gccuuggguuuuaucuuucccuuaccccuggcaccuccagagaacugggaccugaaauagucccu

SEQ ID NO: 728515 - RNA, 65 nt, hsa
cuucaaugucaucuuugccacuucccucuucuuuguccagagagccagcccacagccaaugcuua

SEQ ID NO: 728516 - RNA, 65 nt, hsa
uucaaaggcaaaguucauuucuuccauuaacugcuuccagagaugucauguaaaaaaguuagugu

SEQ ID NO: 728517 - RNA, 65 nt, hsa
acugaagucucugcuguaauccuuauauaucuuucuccagagaacauaauauugucaaauagaua

SEQ ID NO: 728518 - RNA, 65 nt, hsa
ugcagcucauccucacuuggcauugaagaauuccuuccagagauaaacucuaugagauauguggg

SEQ ID NO: 728519 - RNA, 65 nt, hsa
uaaaaauguuaggauaacagaaugauuuuagauuuuccagagaauauuauaaagugcuuuaggua

SEQ ID NO: 728520 - RNA, 65 nt, hsa
uuaaauguauuuuuuguauauuuagaaauaaggaguccagagacuacgcuuaacuuucuaugcau

SEQ ID NO: 728521 - RNA, 65 nt, hsa
ggaagaugaaaugugcaguuuugaaauguuggguuuccagagagagucaugcuggaggagaagga

SEQ ID NO: 728522 - RNA, 65 nt, hsa
cgagaggcuccccaugcaacacuggaaaugacuguuccagagagcgggcagaccuggcagagcgc

SEQ ID NO: 728523 - RNA, 65 nt, hsa
uaccauucccauuuucucagccucuucucacugccuccagagaggugggugccuggguugagaga

SEQ ID NO: 728524 - RNA, 65 nt, hsa
gccucaucugaccccacccugggccacugcccugcuccagagaguggaccuugacucuuccacac

SEQ ID NO: 728525 - RNA, 65 nt, hsa
ucucccccuuacaaggcguggcucauggccugcauuccagagaccaacaugauagcuuuuaauuc

SEQ ID NO: 728526 - RNA, 65 nt, hsa
uguuccaauuuuaacuuuuacuguagcccuuugauuccagagagggagcuuugcuggcaaaagca

SEQ ID NO: 728527 - RNA, 65 nt, hsa
cagucuuacuccaaagacuauugcagggaggaacuuccagagaggaaauccaaugacaaugguac

SEQ ID NO: 728528 - RNA, 65 nt, hsa
ugagaucagauguggccaagggaaggagcucugguuccagagaauuugcacaaaguucccucugu

SEQ ID NO: 728529 - RNA, 65 nt, hsa
cgaaguugcugcuccggcauucaguaccugcuucuuccagagaaauaaaguuaguuucuauuuua

SEQ ID NO: 728530 - RNA, 65 nt, hsa
ccagcccucccuggcugugagcagccuccacuguguccagagacaugggccucccacuccuguuc

SEQ ID NO: 728531 - RNA, 65 nt, hsa
uauuuucuucuguggcaacuaaguggauaauuacauccagagaaaaaguuucuaaaguuacuacu

SEQ ID NO: 728532 - RNA, 65 nt, hsa
ugaucaaagugauacaaucaauuucaaaacaaucuuccagagaccacuugaagguucauaguuuu

SEQ ID NO: 728533 - RNA, 65 nt, hsa
aaugcuaaauguguaauaauguaacaugauuucccuccagagaaagcacaauuuaaaacaauccu

SEQ ID NO: 728534 - RNA, 55 nt, hsa
aacccaccuugaagguauaacuggauccagagagggaaggacugacaagaaggaa

SEQ ID NO: 728535 - RNA, 65 nt, hsa
acagggcucuuugaauguaugucaaacucaguuacuccagagaaaaaacugccuuucccuucaaa

SEQ ID NO: 728536 - RNA, 65 nt, hsa
agaaaauauauauauucaagaugcugaaaauccuuuccagagaaaauuuguuucuuuuuaaaauu

SEQ ID NO: 728537 - RNA, 65 nt, hsa
aauauuccgccggcauuuagaagacucuuggccucuccagagacgccccuuuccucguccgcucu

SEQ ID NO: 728538 - RNA, 65 nt, hsa
ggaugggcagccugcaguguggccggcgacugccauccagagaaaaggcaccuugugccacaggg

SEQ ID NO: 728539 - RNA, 65 nt, hsa
acgugagcgccagcgaaaagaaacuguaucagucauccagagaccguuuauugcccaacacguua

SEQ ID NO: 728540 - RNA, 65 nt, hsa
uaaccuuucuuuauuauuaaagguuuucuauuuucuccagagaacuauaugaauguugcauagua

SEQ ID NO: 728541 - RNA, 65 nt, hsa
ggaagagcagcccuaggcuuccacguacugcagccuccagagaguaucugaggcacaugucagca

SEQ ID NO: 728542 - RNA, 65 nt, hsa
ggcuuuaaacaacagaaauuuauucucuuaacaguuccagagacuaaauguccagacucacaaug

SEQ ID NO: 728543 - RNA, 65 nt, hsa
gccuaagcgucaggcuuguuuucaugcugugccacuccagagacuucugccaccuggccgccaca

SEQ ID NO: 728544 - RNA, 65 nt, hsa
cacaaauguaaaauaaguauuuccauaacucauaauccagagauaauugccauucugauuuugau

SEQ ID NO: 728545 - RNA, 65 nt, hsa
gccauauuuugauguauaggacaagucaacugagauccagagaauccuggaugugaaugcuaaac

SEQ ID NO: 728546 - RNA, 65 nt, hsa
gagcugguuuaauacucugagaaugagcagggagauccagagaaugaaucccugaccgcaucacc

SEQ ID NO: 728547 - RNA, 65 nt, hsa
aguagacacuuggucucaugaagccacugcugggcuccagagagaagggaaaacuaagagguuuu

SEQ ID NO: 728548 - RNA, 59 nt, hsa
agaggggagggaagcauuaaagagcuaacuccagagaucuauaaagcauauccuuuacc

SEQ ID NO: 728549 - RNA, 65 nt, hsa
caccaaagaagauggaaccagacuggaauucugucuccagagagaaacccagcuguuugggucaa

SEQ ID NO: 728550 - RNA, 65 nt, hsa
auggggauagaaaaguagguaagacucagccuuuguccagagaagcucaggguauagcugaauag

SEQ ID NO: 728551 - RNA, 65 nt, hsa
ugcaccuccagcuucuuucugaagcaugacccaucuccagagaugggauuugagaaaucagugag

SEQ ID NO: 728552 - RNA, 65 nt, hsa
ugcagaaacuuggaugucacugccugacauucacuuccagagaggaccuaucccaaauguggaau

SEQ ID NO: 728553 - RNA, 65 nt, hsa
gagcaucagugaggcuucagccuccucgucuccacuccagagaggagguggcuaugucuucuuaa

SEQ ID NO: 728554 - RNA, 65 nt, hsa
uuuugaggucauuagcaaacaugaacucacagggauccagagaugguaaaauucaaaacagccug

SEQ ID NO: 728555 - RNA, 65 nt, hsa
cauguggcccaccagcagccuuuccaaaggggaacuccagagacauuucauaaugcaaacagcac

SEQ ID NO: 728556 - RNA, 65 nt, hsa
ucccauagucuagagggaugcccauuccaugguccuccagagaauaguuuugacuuaacaugucu

SEQ ID NO: 728557 - RNA, 65 nt, hsa
guauuuauagcacguuacaguuguugcagauaauuuccagagacuguuuauaugcaccacuguuu

SEQ ID NO: 728558 - RNA, 65 nt, hsa
uguggagugauccugccgcccccucccugggcucguccagagaucucaaacuccgaugccccugg

SEQ ID NO: 728559 - RNA, 65 nt, hsa
ucuguagcacugcuuuuuugaggccaguagcaacauccagagaucauucuuccauacuuuacucc

SEQ ID NO: 728560 - RNA, 65 nt, hsa
agcuuuuccuacgaucugcauuauguaaucacagguccagagagcuuuauggaagcgggagagga

SEQ ID NO: 728561 - RNA, 65 nt, hsa
aaggcaguugcccaaaccauucugugggggaugcauccagagaaaauugcuucuuuaaggagcca

SEQ ID NO: 728562 - RNA, 65 nt, hsa
aagggugaauuugaagaauuucagaaccacugguauccagagaaagccugcagcucuccacagga

SEQ ID NO: 728563 - RNA, 65 nt, hsa
ucucucucaacaccacaguucucaacccugagccuuccagagagagcuauugaugauacaagagg

SEQ ID NO: 728564 - RNA, 61 nt, hsa
ggaaauaccaacacauuuagugcugaagguuuccagagaaagcaaauaagugugcuuagca

SEQ ID NO: 728565 - RNA, 65 nt, hsa
cucuaaguuucuugcagucuuuuucucagcuuaguuccagagagaaaaaagcuaauuuuccuaag

SEQ ID NO: 728566 - RNA, 65 nt, hsa
aauccuaggguaagguggaucaacugaacugucacuccagagauuuuagaaauuugaguaaagaa

SEQ ID NO: 728567 - RNA, 65 nt, hsa
uaaugucuuacuaauguggaacaguccauauuagcuccagagagugucaaacccagagaaaugug

SEQ ID NO: 728568 - RNA, 65 nt, hsa
auuacacaguuccagaguauguggaccccccaaaguccagagauugcccuaggggaucuuuagau

SEQ ID NO: 728569 - RNA, 65 nt, hsa
ucugauuaaagagaucuguucuggguguugaccacuccagagaaguuucgagggguccucaccug

SEQ ID NO: 728570 - RNA, 65 nt, hsa
caccagccgccauggccaagccugauuguuccagcuccagagacuaaggaaggggcagggguggg

SEQ ID NO: 728571 - RNA, 65 nt, hsa
cuaugugcaaauauagaagcacggguccacagaguuccagagaaugaaugcugacgacuaagcac

SEQ ID NO: 728572 - RNA, 65 nt, hsa
cugaccugugcucccuccccaaucaucuuuccuguuccagagagguggggcugaggugucuccau

SEQ ID NO: 728573 - RNA, 65 nt, hsa
agaggcaacaaguauuacaguugcuuguauauucuuccagagaucucugucuauacaagcaaaaa

SEQ ID NO: 728574 - RNA, 65 nt, hsa
cauuauauauucuaguuagaucagcucugguagguuccagagaacagucaauguuggaaggauga

SEQ ID NO: 728575 - RNA, 65 nt, hsa
aaaagacagacuagcuacaucaaacagaaucuauuuccagagagucuugcugcugauauuuuuuc

SEQ ID NO: 728576 - RNA, 65 nt, hsa
aguacaguuugagacccacuggcuagaacauauccuccagagacuuggcuuaauuggucugggua

SEQ ID NO: 728577 - RNA, 65 nt, hsa
ucuaaauuuguccagagcuuucuuuuuccuagaaauccagagagcaaagucagagccuggcaccu

SEQ ID NO: 728578 - RNA, 65 nt, hsa
agugguucuucagaaucaccuagaugccuccacccuccagagauccugaguccaggagucugaag

SEQ ID NO: 728579 - RNA, 65 nt, hsa
uagaaaagcaagacaagccagagaucucccacaccuccagagaugugcaaacagcugggaggaaa

SEQ ID NO: 728580 - RNA, 65 nt, hsa
cuugggauuuucuguuaguuugucuuguuuugcuuuccagagaucuugcucauacaaugaaucac

SEQ ID NO: 728581 - RNA, 65 nt, hsa
ggacaacuaacccgagcuggaccaacacaauucucuccagagacuuuugauuuuacuuuuaugua

SEQ ID NO: 728582 - RNA, 65 nt, hsa
ggagccuuuauaagacacugauacuugggacccacuccagagauucugaaugaauuggucugggg

SEQ ID NO: 728583 - RNA, 65 nt, hsa
cugaccuguguucccuccccgaucaucuuuccuguuccagagagguggggcuggaugucuccauc

SEQ ID NO: 728584 - RNA, 65 nt, hsa
cugaccuguguuuccuccccagucaucuuucuuguuccagagagguggggcuggaugucuccauc

SEQ ID NO: 728585 - RNA, 65 nt, hsa
cuggcaaauccuccuacccaaaaaggggucaauuguccagagaccuagacuggauacgaacuagc

SEQ ID NO: 728586 - RNA, 65 nt, hsa
gaaugcaacugugggcauuucuugucuuauuucuuuccagagaacgugguuuucauuuauuuuuc

SEQ ID NO: 728587 - RNA, 65 nt, hsa
ccuguccccaguguuuccagguaaugacuuggcacuccagagaaaguuucaugcuguugcgugug

SEQ ID NO: 728588 - RNA, 65 nt, hsa
gaauuuacuacagcaugugauuucagguuaaugacuccagagaguaagaucagauucguccacaa

SEQ ID NO: 728589 - RNA, 65 nt, hsa
gcuaagaucauugaucuuuaccaugagaagaccauuccagagaaagugauagaaucuuccccaaa

SEQ ID NO: 728590 - RNA, 65 nt, hsa
uauuuguaguccuaugaacagucuccucguguaucuccagagacugcaugugcaaaguaaaaugc

SEQ ID NO: 728591 - RNA, 65 nt, hsa
ggggaugugagaaaugucucuucuguucauugcucuccagagaaugcuauggacaagaaucaaau

SEQ ID NO: 728592 - RNA, 65 nt, hsa
cucagggagccaguucaaggucuggcugucaaguguccagagagccaugguguuggccccugagg

SEQ ID NO: 728593 - RNA, 65 nt, hsa
ggcacccugaggucaggggauccuaaggguguccuuccagagacgguguuuccagggggaggacc

SEQ ID NO: 728594 - RNA, 65 nt, hsa
ucaguggcgcgaguccaggaaggucauggggcaacuccagagagaagcauccccuggcccggugg

SEQ ID NO: 728595 - RNA, 65 nt, hsa
accuuaguggccagagacugacuucaagguuuuauuccagagacuccagagacuuaagcuaagua

SEQ ID NO: 728596 - RNA, 65 nt, hsa
gccagagacugacuucaagguuuuauuccagagacuccagagacuuaagcuaaguauuuuuucau

SEQ ID NO: 728597 - RNA, 65 nt, hsa
cuauauguguaucuuccuaggcaaaagcuguaauuuccagagagaccauuaggaacagguaguau

SEQ ID NO: 728598 - RNA, 65 nt, hsa
acgcgggaaaggcaaggccuggcuuacuuagagcuuccagagagcauagcugcuuccaucucuua

SEQ ID NO: 728599 - RNA, 65 nt, hsa
ugccagcaaugacaucucaggggccagaggaacuguccagagagcaacucugagaucuaaggaug

SEQ ID NO: 728600 - RNA, 65 nt, hsa
ugaaagaaugucucggucacaucaggcccgcuagguccagagagcgagcccccaaugcccggcca

SEQ ID NO: 728601 - RNA, 65 nt, hsa
uuccucaccgagcaugcuucccuaggaucccgucuuccagagaaccugugggcugacugcccucc

SEQ ID NO: 728602 - RNA, 65 nt, hsa
auuacaguuuccaaaugcauucugggauugccuauuccagagaggguacagaaaaagcacacaga

SEQ ID NO: 728603 - RNA, 65 nt, hsa
gcuguuacuuggccauuucuucccaucuccaaaaauccagagacauuacgagagcuauucauuca

SEQ ID NO: 728604 - RNA, 65 nt, hsa
auuguuagucccaacucuggccaaagauacuuuuuuccagagacagaggccaggaggcagugagg

SEQ ID NO: 728605 - RNA, 65 nt, hsa
uggagggcaucuguacuccugugcaaaaugcccaguccagagacaaaaccucagacuuugugcac

SEQ ID NO: 728606 - RNA, 65 nt, hsa
cccucagcagggccggagaccuagaugucauuguuuccagagaaggagaaaauggacagucuaga

SEQ ID NO: 728607 - RNA, 65 nt, hsa
gaaucgugguaauauuggcuguuaaauuggccugcuccagagacuggcucaaaaaagaaagaagc

SEQ ID NO: 728608 - RNA, 65 nt, hsa
guugcccagcccagggggaaagggagcaagaguuguccagagaagacaguggcaaaaugaagaaa

SEQ ID NO: 728609 - RNA, 65 nt, hsa
aggccuuccacccugaccuugcaucuccagacuguuccagagaaggugcggggccagcugcuaug

SEQ ID NO: 728610 - RNA, 65 nt, hsa
gcacuuugggaggccgaggcaggcggaucacaagguccagagaucgagaccauccuggccaacau

SEQ ID NO: 728611 - RNA, 65 nt, hsa
uucgguacuuggauaaaucauuucugcauuguuguuccagagaauuugcugagaaaucaaagcca

SEQ ID NO: 728612 - RNA, 65 nt, hsa
acuuucagaaugagcaaaacaccaucaacguuaauuccagagauggaacauuuuuuuuccuagug

SEQ ID NO: 728613 - RNA, 65 nt, hsa
agaguaggugguggugacgugagggcugugaaggauccagagacaagacuuagauguuucguuca

SEQ ID NO: 728614 - RNA, 65 nt, hsa
ugauccaaauucugaccuauauucuuuuccuucccuccagagaacuucuuuuaaugcuucuuuca

SEQ ID NO: 728615 - RNA, 65 nt, hsa
gacagaggggcuguuaggacagcaaagcagcaguguccagagaccccucaauccccaaagguccg

SEQ ID NO: 728616 - RNA, 65 nt, hsa
gggagcauuauagauuaaugcagaagauuuagguuuccagagaagcauacauaaccuagcuucuu

SEQ ID NO: 728617 - RNA, 65 nt, hsa
caggcagcaacgcaagucaggcugaacauucagucuccagagacagcuguguggagcaaaucaga

SEQ ID NO: 728618 - RNA, 65 nt, hsa
cuucaaacccugcauuugaaccgaccaacauuaaguccagagaguaaacuugaauggaauaacga

SEQ ID NO: 728619 - RNA, 65 nt, hsa
ucaaagauugaacacugcguaggagagggagaugauccagagacauguggcagcaggcauggcuu

SEQ ID NO: 728620 - RNA, 65 nt, hsa
aggcagccuauugguguuauguuuauguaacauaguccagagaacugacaugcaggucaaaaguc

SEQ ID NO: 728621 - RNA, 65 nt, hsa
aaauccaaggaaacaugcagcucuucaacaugacauccagagaugacuauuacuuuucuguuuag

SEQ ID NO: 728622 - RNA, 65 nt, hsa
uuggugucuuaauggcaugucagauaauuuguuuuuccagagaagagagcucaaagaggaauugg

SEQ ID NO: 728623 - RNA, 65 nt, hsa
uagaggacaaaaucaugaaaacagagucccugucuuccagagaucauccggggcuuuaauauuaa

SEQ ID NO: 728624 - RNA, 65 nt, hsa
uuuuguaggugggaauccagccucuguuagauauguccagagauggaaacucacuccccuacaaa

SEQ ID NO: 728625 - RNA, 65 nt, hsa
cauuccuguugaugggaaaagcccccaguuaauacuccagagacagggaaaggucagcccguuuc

SEQ ID NO: 728626 - RNA, 65 nt, hsa
uggaggacaggagucgacgugaguuccugggagucuccagagauggggccuggaggccuggagga

SEQ ID NO: 728627 - RNA, 65 nt, hsa
uugguauuuggccaaggccugcaucgggaauaaaguccagagaauuucuuucugcaggaugccgc

SEQ ID NO: 728628 - RNA, 65 nt, hsa
guuuuaguccaaugguucaguucuuugaaacugacuccagagauggcucuguucauuaauagauu

SEQ ID NO: 728629 - RNA, 65 nt, hsa
caccucaagacccccauuugucccagacuaaaggauccagagagcagcucccuuucucaggagcu

SEQ ID NO: 728630 - RNA, 65 nt, hsa
gucugcuuuuugcuuuuaauguuaacuaaugaaguuccagagaugggccuuagaaauguguuuua

SEQ ID NO: 728631 - RNA, 65 nt, hsa
gauuugauguucuaaucauuaauacacuuaaguuuuccagagaacuaaauaguaauaguuucaua

SEQ ID NO: 728632 - RNA, 65 nt, hsa
ggcugaggccuaagcccucccugaugggcagucaguccagagaugcuggcccucgcccagucuau

SEQ ID NO: 728633 - RNA, 65 nt, hsa
aucacccaggagaaauaauacaaacaccaccacuguccagagagaguaaagaagcagaaagagaa

SEQ ID NO: 728634 - RNA, 65 nt, hsa
gaaggugggccccguguguuuacagcauuuccagguccagagagguuggcagacaagugccauuu

SEQ ID NO: 728635 - RNA, 65 nt, hsa
ggggguccugauucugggcuggacacgguuguggauccagagaagaggccuagucuccaauaaau

SEQ ID NO: 728636 - RNA, 65 nt, hsa
aucuuauuauauuuacucauggcucaaugggggccuccagagacccucucaggcugcugagcuag

SEQ ID NO: 728637 - RNA, 65 nt, hsa
cugcccguugacuaacuaugcucugugguuuuguuuccagagaacucagauugcacagagcuaga

SEQ ID NO: 728638 - RNA, 65 nt, hsa
ucuuauguauuuuaacaguuggguucuguggaguguccagagaccuuggguuagguauauccauc

SEQ ID NO: 728639 - RNA, 65 nt, hsa
gacaacuuguugguaguuaggcacccaugaaugucuccagagacauccugagaggcaagauuccu

SEQ ID NO: 728640 - RNA, 65 nt, hsa
uggaacaguguuaaauuucuaugauguuggagccauccagagacuacuggaauugucgagacuuu

SEQ ID NO: 728641 - RNA, 65 nt, hsa
agaaggggggccuugggccgcugcagucacaucuguccagagaaauuccuuuugggacuggaggc

SEQ ID NO: 728642 - RNA, 65 nt, hsa
augauaaauaugccugacuaaagccacuacagaaauccagagauuggcuguuaaaauuuguuuug

SEQ ID NO: 728643 - RNA, 65 nt, hsa
gucccuccauggcacucuggguccucuccucacucuccagagacccucacauguccuuuugaaca

SEQ ID NO: 728644 - RNA, 65 nt, hsa
ccccuggagcucauuucugaaucgcacucuccauuuccagagacuaaaggauguccuuugaaaug

SEQ ID NO: 728645 - RNA, 65 nt, hsa
aauguuucccaaauuguuuuucuagaauacuaauuuccagagagacauucacaaguauuuacaga

SEQ ID NO: 728646 - RNA, 65 nt, hsa
cuuuuggccaaaagaauaucugaccaucacagagauccagagaacagaaacaagagccccuaagu

SEQ ID NO: 728647 - RNA, 65 nt, hsa
acccugcauggcugagcugcccacagcaggccagguccagagagaccgaggagggagagucuccc

SEQ ID NO: 728648 - RNA, 65 nt, hsa
acgacuuuuggggagacucacccccaccaacaccguccagagaggccugagggagggauuccaug

SEQ ID NO: 728649 - RNA, 65 nt, hsa
ggccauuggcacccacccaaguauuaugggaaaccuccagagaggggagggacucagauuuauau

SEQ ID NO: 728650 - RNA, 65 nt, hsa
ucuagguugaccugucugugauuuucaaacugugguccagagaauaggggaagacugggccagac

SEQ ID NO: 728651 - RNA, 65 nt, hsa
agaacucaucagagugcggauugccaagacccuucuccagagauuaugggguuggggguggaggu

SEQ ID NO: 728652 - RNA, 65 nt, hsa
gggagggggaagaggaccccugauguuuugcugcuuccagagauauuagaaacugacucacuuga

SEQ ID NO: 728653 - RNA, 65 nt, hsa
cacaaccagcuucuccaggucauaugugccuuaccuccagagagucuuuuuuuuuuuuuuucuga

SEQ ID NO: 728654 - RNA, 65 nt, hsa
ggugcugggucauuacuucugagccccagccccaauccagagaagcgcuguugcccgcccuccac

SEQ ID NO: 728655 - RNA, 65 nt, hsa
aucacuccaguggugaagggugcagcucugguucuuccagagagacugcccccuucccuccagcg

SEQ ID NO: 728656 - RNA, 65 nt, hsa
cccgugcuccuccuccuccuccucagggcugggucuccagagaguggggccuugguccugagaau

SEQ ID NO: 728657 - RNA, 65 nt, hsa
gagcuuaagaguggcauuaucuucucgccuuaauuuccagagauuauuucuguacugagaauccu

SEQ ID NO: 728658 - RNA, 65 nt, hsa
gccagugggggacuuucucacagcuuacauagccauccagagauccacagcuacgucacugaauu

SEQ ID NO: 728659 - RNA, 65 nt, hsa
uauuuuuguuacugacaguuaacaguggugugacauccagagagcagcugggcugcucccgcccc

SEQ ID NO: 728660 - RNA, 65 nt, hsa
gcugcaauuguccaggcgaugacaauggugauggcuccagagaacacaccagcuauuuaugagcc

SEQ ID NO: 728661 - RNA, 65 nt, hsa
ggggcugagagguuucuacacucgaggagcagggguccagagaggcaggcuggggaggcaaggga

SEQ ID NO: 728662 - RNA, 65 nt, hsa
guagaagaaauaaucagguaaguuaaaaguucauuuccagagaagguaaaccccacuuaccaucu

SEQ ID NO: 728663 - RNA, 65 nt, hsa
cuuccuccccagcccccgggcucgggaguuaugcauccagagaccugcccuucuaccuuccucgc

SEQ ID NO: 728664 - RNA, 65 nt, hsa
uaccaaauaauggcuaauguuacaaaaaguuauacuccagagacccaaagcuugacauuuaccua

SEQ ID NO: 728665 - RNA, 60 nt, hsa
uggagcggcugauauccugaaucuugccccuccagagacaggaaagaauuugccuucucc

SEQ ID NO: 728666 - RNA, 65 nt, hsa
gaaacagaaaaggcugccagcuguuuuaccagggauccagagacauagaggaaguaggggguggu

SEQ ID NO: 728667 - RNA, 65 nt, hsa
auuuuguuuguuuuaaaucuuuguaaaguuauuauuccagagaguauacugguaucuuacagcuu

SEQ ID NO: 728668 - RNA, 65 nt, hsa
gaucauaaauaauauguuuccuaaagaaaugccuuuccagagacuguauagcuuauaccaauuau

SEQ ID NO: 728669 - RNA, 65 nt, hsa
ccagaccccaccugaucugcaucuuuguuugcaucuccagagacaccugaggccccagagcuuga

SEQ ID NO: 728670 - RNA, 65 nt, hsa
ggcaaagacuccuguccccagccugaccuccagccuccagagaccgagcagcuguggggccugcu

SEQ ID NO: 728671 - RNA, 65 nt, hsa
uuuauacuucaguaugguuucaacgcaguuauguuuccagagaacaucuagaaguggcuggaaac

SEQ ID NO: 728672 - RNA, 65 nt, hsa
gagacaugaguucuggaaggagcaaggccaccagguccagagaaccuggcaugcaauggacaugg

SEQ ID NO: 728673 - RNA, 65 nt, hsa
agcucuucugcucccccaucaggacuggugcugcuuccagagacuuccuugggguugcaaccugg

SEQ ID NO: 728674 - RNA, 65 nt, hsa
cagcaccaguggaaacacaugaacuucgaugcagguccagagaccauggacacucccacgaggcu

SEQ ID NO: 728675 - RNA, 65 nt, hsa
agugccguuguuaugugaaacucuuccauucagauuccagagagguucucaugcuccccccccuc

SEQ ID NO: 728676 - RNA, 65 nt, hsa
uccucgccuggacucagggcaggugccguggguucuccagagaccccagcaacuggcccaggaug

SEQ ID NO: 728677 - RNA, 65 nt, hsa
cugggacacuuuuauguuaaugcucuggacuugccuccagagacugcuccagaguuggugacaca

SEQ ID NO: 728678 - RNA, 65 nt, hsa
ucucuuuuguuuauaaaaaacacuaaacauucaauuccagagaaccaaaaaucccaccuucccac

SEQ ID NO: 728679 - RNA, 65 nt, hsa
aggcuaccuuccaucacuguuguacagaaaagaaauccagagaaucaaauggacuggccuugggg

SEQ ID NO: 728680 - RNA, 65 nt, hsa
cccaucuuucccuucuuccuccucuccuucacaaauccagagaaccuuggggugguugugccagc

SEQ ID NO: 728681 - RNA, 65 nt, hsa
agggccaggcgcaccaggagaggcguuucuggggcuccagagaagugccacgggaggcagaaguc

SEQ ID NO: 728682 - RNA, 65 nt, hsa
cugcggcugugagagcagcaggacccugggccaguuccagagaccugggggugugucugggggug

SEQ ID NO: 728683 - RNA, 65 nt, hsa
gucagaccauggcgugguauuuauugugcagcagauccagagacagaggcagccugucuuuucag

SEQ ID NO: 728684 - RNA, 65 nt, hsa
aucauuuggauggaguaauuuaaaaugaauuaaauuccagagaacaauggaagcauugccuggca

SEQ ID NO: 728685 - RNA, 65 nt, hsa
ccucacuuugcugccccaccaucuugcugacaacuuccagagaagccaugguuuuuuguauuggu

SEQ ID NO: 728686 - RNA, 65 nt, hsa
uggcagauuguauuggccagcaggaaagcaagcucuccagagaaugcccccaguuaaauaccucc

SEQ ID NO: 728687 - RNA, 65 nt, hsa
aggagggcaggggcauugggaaugggugggugcccuccagagaggggcugcuaccucccagcagg

SEQ ID NO: 728688 - RNA, 65 nt, hsa
auuauccauuacaguuuaacucuuucauuuaaagguccagagaggcaagugaauugucuaaguuc

SEQ ID NO: 728689 - RNA, 65 nt, hsa
cucggggcagggauacaaaguuagugaggucuauguccagagaagcugagauauggcauauaaua

SEQ ID NO: 728690 - RNA, 65 nt, hsa
auuuuauaaaugccuauuuuaacaucauuuaugguuccagagaugcauacacuuuuuucugacaa

SEQ ID NO: 728691 - RNA, 65 nt, hsa
ggccgaaugaucaaggggacccauaggaaaucuuguccagagacaagacuucgggaaggugucug

SEQ ID NO: 728692 - RNA, 65 nt, hsa
uccacuaaaacuccaucuuagugaauuuuaaauuauccagagaugucaaacugccaaauaaaaau

SEQ ID NO: 728693 - RNA, 65 nt, hsa
uucuggaaagugcagaauucuuuugguucuuugguuccagagagagagaagaugcuugugccagg

SEQ ID NO: 728694 - RNA, 65 nt, hsa
augggcucaggggacucagcccuggacagagagccuccagagagugaacagucuuccagaucugg

SEQ ID NO: 728695 - RNA, 65 nt, hsa
cugguuuuuaaaagauaaacaguuuagcccaucucuccagagagcaaacauaggaauaugacuca

SEQ ID NO: 728696 - RNA, 65 nt, hsa
ccagcugaggacaacggaacccccuuucccugcccuccagagacugauccuagccaggcaccuua

SEQ ID NO: 728697 - RNA, 65 nt, hsa
aggccagcagccucaucccugccauucagggcuguuccagagauucgauccucuuaaggcauuau

SEQ ID NO: 728698 - RNA, 65 nt, hsa
gaaagauacgguugucuagaggugagaccaaaggauccagagacuuggggaccagaggugacagu

SEQ ID NO: 728699 - RNA, 65 nt, hsa
guuggcagagagaagcugguggaguccuguggcuuuccagagaagccaggagccaaaagcugggg

SEQ ID NO: 728700 - RNA, 65 nt, hsa
gguaugauuguagcuuccucagaaaucccuuggccuccagagauuaaacauggugcaauggcacc

SEQ ID NO: 728701 - RNA, 65 nt, hsa
ucuuaguugauuauuaaaaaaggaaaaauaugguuuccagagaaaaggccaauaccuaagcauuu

SEQ ID NO: 728702 - RNA, 65 nt, hsa
uguuucucugcagcugggguccaccuucccaagccuccagagaguucucccuccacgauugugaa

SEQ ID NO: 728703 - RNA, 65 nt, hsa
ugagcuuccuccagcugugagaauaaguccuaaucuccagagaaaugguggggggaggaggaggc

SEQ ID NO: 728704 - RNA, 65 nt, hsa
gaguaaauuuaaucuccaggauuuagaagugucuuuccagagaagcauaaugagaaagucagacu

SEQ ID NO: 728705 - RNA, 65 nt, hsa
acccacuccugagugggugggugggugggacucaguccagagaccuaacauucagaauauagcau

SEQ ID NO: 728706 - RNA, 65 nt, hsa
aaaaaugaacaaacuacaaaacaucagugaagagcuccagagaaauauuucucuacaacugauga

SEQ ID NO: 728707 - RNA, 65 nt, hsa
cagaugcugcugugcugcagacagauacaugcuaguccagagagccgccccugagauggcuguga

SEQ ID NO: 728708 - RNA, 65 nt, hsa
uaguuggcuaguacuuugaugcucccuugaugggguccagagagccucccugcagccaccagacu

SEQ ID NO: 728709 - RNA, 65 nt, hsa
agccccagcuucuuacccacccaggaaacccuugguccagagaggacaggcuuucuggaggaauc

SEQ ID NO: 728710 - RNA, 65 nt, hsa
guugacacaaccccuucccccaauuuuuguggaucuccagagaggcccuucuuuggauucaccaa

SEQ ID NO: 728711 - RNA, 65 nt, hsa
acauuucaguacccgcuggcagcuccucccacucauccagagacggccggugggcaggcggggag

SEQ ID NO: 728712 - RNA, 52 nt, hsa
aggcagcagaaacugaauagguuccagagacuuuuggcccaggaggaauauu

SEQ ID NO: 728713 - RNA, 65 nt, hsa
ccaucuuguuuguuuuccuaccuuaugcugaguaguccagagaguuaaaaaaauucucugcaugu

SEQ ID NO: 728714 - RNA, 65 nt, hsa
ucuaguagccaauuaacuacucugggguggcagguuccagagaaugcaguagaccuuuugccacu

SEQ ID NO: 728715 - RNA, 65 nt, hsa
ugugaacuugugaauguaauugaucuuuccuuccuuccagagaaagauuuaagggacacuguuaa

SEQ ID NO: 728716 - RNA, 57 nt, hsa
aagaggaagaggaggaguaauggugucuccagagacuuuacaucgguuccugucuuc

SEQ ID NO: 728717 - RNA, 65 nt, hsa
ggaccaguuccuucauuuucaggugggacucuugauccagagaggacaaagcuccucagugagcu

SEQ ID NO: 728718 - RNA, 65 nt, hsa
uaccuaccacaugggaaccguuuguccacacucauuccagagaaaaccgaguccucucaguugca

SEQ ID NO: 728719 - RNA, 65 nt, hsa
aauuauaaauguaagcuuauuuccuuagaucauuauccagagacugccagaagguggguaggaug

SEQ ID NO: 728720 - RNA, 65 nt, hsa
auaaaaaggauuaugggaggggaacauuagggaaauccagagaaggcaaaauugaaaaaaagauu

SEQ ID NO: 728721 - RNA, 65 nt, hsa
gaggaggacugagcccagaauucacuagguucgaauccagagagcaguguggaaaaaaaaaaaca

SEQ ID NO: 728722 - RNA, 65 nt, hsa
guccaguggccuagcugguaccacaucuauucccauccagagacauucucuggcaaguguucuca

SEQ ID NO: 728723 - RNA, 65 nt, hsa
ugggcauuugauggcaauaggccaaaauuauuguguccagagaguacacuuuuucaaaaugcuca

SEQ ID NO: 728724 - RNA, 65 nt, hsa
gucucggguuaagggaagugacaauuuuauuccauuccagagaauggacaaacucuuaacuuuua

SEQ ID NO: 728725 - RNA, 65 nt, hsa
gugugcuggucuaaauuaauccaucgcagugauccuccagagacagcgcucugcucauguccgua

SEQ ID NO: 728726 - RNA, 65 nt, hsa
accgagaaugaggagcccucccugccccaccguccuccagagaaugcgccccuccugguucccug

SEQ ID NO: 728727 - RNA, 65 nt, hsa
gagaagggccucagaggacaccugcaguacagcuauccagagagacugggcuucaagguacagcc

SEQ ID NO: 728728 - RNA, 65 nt, hsa
acucucaauacaauauauuuugaccuuaccauuauuccagagauucaguauuaaaaaaaaaaaaa

SEQ ID NO: 728729 - RNA, 65 nt, hsa
cagaggggaguugugugccaaugauggcaugacaauccagagaucauaacuucuuugcaagaaaa

SEQ ID NO: 728730 - RNA, 65 nt, hsa
auaucauuugguagaaagaaaaccaacuguggucauccagagaagcucaaaaacucuuguacuca

SEQ ID NO: 728731 - RNA, 65 nt, hsa
cacaaaaguccacugaugcaaauuggacuggcgaguccagagaggaaacuguggaauggaaaaag

SEQ ID NO: 728732 - RNA, 65 nt, hsa
accuuggaaaccuggcuuugcucuggacaaaggguuccagagagaagcuagaagucccccuugaa

SEQ ID NO: 728733 - RNA, 65 nt, hsa
gauuuuuuuguacaaugauuaauaaauggaacuuauccagagaaaccacgcaaauggccugccca

SEQ ID NO: 728734 - RNA, 65 nt, hsa
ggauguccagagacuaggccucuccccuuuaccccuccagagaaggggcuucccugucccggagg

SEQ ID NO: 728735 - RNA, 65 nt, hsa
gagugaauggcccuuccuuaguagccugggggauguccagagacuaggccucuccccuuuacccc

SEQ ID NO: 728736 - RNA, 65 nt, hsa
gguucuucaaauauuucauguuuacauuaaaaauuuccagagaagcauaaaaguauucacuuucc

SEQ ID NO: 728737 - RNA, 65 nt, hsa
uuaggucuucucuugaggcucuuagaaaagcguuuuccagagagauuucuauuuuugaacaaugg

SEQ ID NO: 728738 - RNA, 65 nt, hsa
aacaguagagagggaacauccuaagacagaggaacuccagagaugagugucuggagcgcuucagu

SEQ ID NO: 728739 - RNA, 65 nt, hsa
aguuucaucaggaccaaaaaaccucacugggccuuuccagagaacugcagaccucacugucaggg

SEQ ID NO: 728740 - RNA, 65 nt, hsa
ccaugcaauuuuguuuacuagaauugauuacacucuccagagaucucuccauugugcaaauuuuu

SEQ ID NO: 728741 - RNA, 65 nt, hsa
gguuauuuuuauauugaauggcaagaaugagaacuuccagagaugaaaacucuucaagaacaagg

SEQ ID NO: 728742 - RNA, 65 nt, hsa
uguaaauuagcagaugacuuuuuuccauuguuuucuccagagagaaugugcuauauuuuuguaua

SEQ ID NO: 728743 - RNA, 65 nt, hsa
gugguuuggagcaacgguguugucagugugcgaacuccagagaagcgcccacaucugaaggaccu

SEQ ID NO: 728744 - RNA, 65 nt, hsa
cuuuguucaaguaucagaagaaauaaacccacagcuccagagaaggugaccauucucagaacucc

SEQ ID NO: 728745 - RNA, 65 nt, hsa
gccagauuuuaccuaccaagaaaaaaagauauuuuuccagagaguuagguauaucauaauuuucc

SEQ ID NO: 728746 - RNA, 65 nt, hsa
uuacuagacucaugacuuggaggccaaaccuuaaauccagagauagcagccucgauagggaccuu

SEQ ID NO: 728747 - RNA, 65 nt, hsa
ccgucacuauucaucaaugaagauuaacacugagauccagagaggcuggaugacuugcucaaguu

SEQ ID NO: 728748 - RNA, 65 nt, hsa
uacugggccucuccuagacugcaggcugcagccaguccagagagaauagagccugcccaggccuu

SEQ ID NO: 728749 - RNA, 65 nt, hsa
agagguuuuuguacauuuuugagaucauucauguguccagagaucuuggaaaauauuuuuucacc

SEQ ID NO: 728750 - RNA, 65 nt, hsa
ugcaucauuuuaauuaugagucugacaaaaccuucuccagagaaucaagcaagaccuggauguga

SEQ ID NO: 728751 - RNA, 65 nt, hsa
ugguucuuggagggaaaagauucuuuauuccaauuuccagagagaagagaaaacucacccaggaa

SEQ ID NO: 728752 - RNA, 65 nt, hsa
gaauuaauuauguuuggaugcagcagcugaauauauccagagaaaauaaacuuaagauuacuggc

SEQ ID NO: 728753 - RNA, 65 nt, hsa
agaaaugcuugcuuuauagcugcuccacccucaucuccagagauuuugugucuaugguugugggu

SEQ ID NO: 728754 - RNA, 65 nt, hsa
cuucagggggcuccuuccggggcuccggccuguuuuccagagagaguggcaguagccccaugggg

SEQ ID NO: 728755 - RNA, 65 nt, hsa
ccccucuaacuggacagccucuucugucccaagucuccagagagaaaucaggccugaugaggggg

SEQ ID NO: 728756 - RNA, 65 nt, hsa
acguucaugucauuuuagaggauuauaugguugucuccagagaaauuaacuuacauuaucaaaaa

SEQ ID NO: 728757 - RNA, 65 nt, hsa
cccuugggggaucccgggugaggaguguugccccauccagagaaugaaugaguuccuuuaagugc

SEQ ID NO: 728758 - RNA, 65 nt, hsa
cagccugcgccacuguguucuucucuuaagaggcuuccagagaaaacggcacaccaaucaauaaa

SEQ ID NO: 728759 - RNA, 65 nt, hsa
uuaguuauaccuuauaccauuauguugugggcaauuccagagaauucaguaccugcuuggucagg

SEQ ID NO: 728760 - RNA, 65 nt, hsa
uuucccaccucucaccccuauuuccuauaaggauauccagagaagccaaacuguucuguggguuu

SEQ ID NO: 728761 - RNA, 65 nt, hsa
gagaguuggccugauuugggauuauggcagaaaaguccagagaugccaguccuggaguagaagag

SEQ ID NO: 728762 - RNA, 65 nt, hsa
auucccaccuuucacauauaguucaacaacauuaauccagagagaauuuuauguuuuaugauaug

SEQ ID NO: 728763 - RNA, 57 nt, hsa
uccagguuuugcuucauuaauucaccauccagagaccaaauaauuaaaagaaaaaca

SEQ ID NO: 728764 - RNA, 65 nt, hsa
uuauuaaagugguuugaauaaaguagaucaaaacuuccagagaucuuaauggcuauauaggaaga

SEQ ID NO: 728765 - RNA, 65 nt, hsa
acuaaggugcuaggaauucguaaucauccccauccuccagagaaacccagggaggaagacuguaa

SEQ ID NO: 728766 - RNA, 65 nt, hsa
aggacagcacaggaugcccuccaaggaugagcugguccagagauacaacaggaugaauaccaucc

SEQ ID NO: 728767 - RNA, 65 nt, hsa
gccugccccuacccuggacuugccucugcacacccuccagagacaacagguaaaacagggccaca

SEQ ID NO: 728768 - RNA, 65 nt, hsa
ggcaggaucuaaaacagcagcgaccucggccccuauccagagaggugcagcaagagagccauuuc

SEQ ID NO: 728769 - RNA, 65 nt, hsa
aacaguccuugcccuggggccgguucuuacccagguccagagaaaccaacgcgggaugucagacu

SEQ ID NO: 728770 - RNA, 65 nt, hsa
ggcauucuuuucugguacauggugagaguucaggcuccagagacucaaaacggaaugguuuuccu

SEQ ID NO: 728771 - RNA, 65 nt, hsa
ccucuuccaggagagcacccuuacuuggcccggcuuccagagacccucgaaaucuccgagaagau

SEQ ID NO: 728772 - RNA, 65 nt, hsa
aucagcauucucacuccuaccugguaauuuaagauuccagagaguggcuccucccggugcccaag

SEQ ID NO: 728773 - RNA, 65 nt, hsa
uccugggccuuucaaccuugcgggcugugcugaguuccagagagcugccggaauuccagguuuga

SEQ ID NO: 728774 - RNA, 65 nt, hsa
cuccugcccuuggggcugucuuccuucuccugaaauccagagacuuucuugcucaucccuucucc

SEQ ID NO: 728775 - RNA, 65 nt, hsa
aagguuucccuccggggaaugccucccuggaauguuccagagacggaacauucucuagagacaac

SEQ ID NO: 728776 - RNA, 65 nt, hsa
gguucccauuucccagguucuccagagagcgggcauccagagaggaguccugggagagcgggcgg

SEQ ID NO: 728777 - RNA, 65 nt, hsa
cuccacugagccucugguucccauuucccagguucuccagagagcgggcauccagagaggagucc

SEQ ID NO: 728778 - RNA, 65 nt, hsa
acacucccuaucugguuggaagagaguaaccaguuuccagagagccagagagugagagagagaaa

SEQ ID NO: 728779 - RNA, 62 nt, hsa
caggaagacaccuuuggugaaagacuuuaaguuccagagaaucagaauuucucuuaccgauu

SEQ ID NO: 728780 - RNA, 61 nt, hsa
agccgacccagguaauuuaaaauauucuucauccagagauagaggugguucuuccucuuac

SEQ ID NO: 728781 - RNA, 65 nt, hsa
caucagcugacccagguaauuuaaaauauucuucauccagagauagaggugguucuuccucuuac

SEQ ID NO: 728782 - RNA, 65 nt, hsa
gagcuggacagagcagagaacuacagggccaaggguccagagaagugauaacuuggcccagggcc

SEQ ID NO: 728783 - RNA, 65 nt, hsa
guaacagcccuaaugaugacuggaaacugagagguuccagagaaaucaguguugcaguaaacugc

SEQ ID NO: 728784 - RNA, 65 nt, hsa
ugauuaaccugacuuuauagggacugaaguccaccuccagagacaaguccaaguucuugauccac

SEQ ID NO: 728785 - RNA, 65 nt, hsa
agaugaagcacguucugccggggaggcccucaccuuccagagaggacagacacagauuuccugcu

SEQ ID NO: 728786 - RNA, 65 nt, hsa
ucuccaucuaucggaccccaguuuccaucacuaucuccagagauguagcuauuaugcgcccgucu

SEQ ID NO: 728787 - RNA, 65 nt, hsa
aaacgugcacacgcgucucauuugaccccuuugcuuccagagaugaauguggcacucccuccuuc

SEQ ID NO: 728788 - RNA, 65 nt, hsa
ugcuaagaauagauggaagacagcaggauaaacauuccagagaaaaucauguuuauucccugcug

SEQ ID NO: 728789 - RNA, 65 nt, hsa
ugguacuucccagggcuaccggcaguccucuguaguccagagaggugagauuagaucuucuuggu

SEQ ID NO: 728790 - RNA, 65 nt, hsa
guuucucugugcuauuuuuuggaauucuuucagauuccagagauaucuuacgucuuugauucaau

SEQ ID NO: 728791 - RNA, 65 nt, hsa
cgauuccccaaccacagcaaaggcaacacucuuccuccagagaucaccaagccccucuuaccucc

SEQ ID NO: 728792 - RNA, 65 nt, hsa
auaccucacccugccacuccaccauguaugaucauuccagagaucuuugugacuagaguuagugu

SEQ ID NO: 728793 - RNA, 65 nt, hsa
gaagccacauauaaaaaggcauugagggcucacuguccagagaauugcuuuuguaaaugcuccac

SEQ ID NO: 728794 - RNA, 65 nt, hsa
cuguucauuccaaaucuguuaagcauuuccaaacauccagagaaugguuucacuguugagggugc

SEQ ID NO: 728795 - RNA, 65 nt, hsa
aacuauagaagaguugccuccugucucucgaaucuuccagagauaucacuuaauuguuaacagcu

SEQ ID NO: 728796 - RNA, 65 nt, hsa
ccguguggccccuucacuucugaccacacuuccuguccagagagagaagugccccugcugccucc

SEQ ID NO: 728797 - RNA, 65 nt, hsa
gaguguggugacuuccuggaaggaggaugcagacuuccagagagcccccccaacggacgugcuga

SEQ ID NO: 728798 - RNA, 65 nt, hsa
ucuuccccaggaagcggggucuuggccuggaaccuuccagagaggaggcgggagcaauuuuagcc

SEQ ID NO: 728799 - RNA, 65 nt, hsa
agccguggggucccucaggccugggcggugcagcuuccagagagcgagcgcccuuuagcggccug

SEQ ID NO: 728800 - RNA, 65 nt, hsa
cugaugaaacgccacugggagugaggaagccagacuccagagacacggagaagaucaaacuggag

SEQ ID NO: 728801 - RNA, 65 nt, hsa
uccucuuagcucagcugagcauggagacagcaguuuccagagaguggagagagcagggcuaaaua

SEQ ID NO: 728802 - RNA, 65 nt, hsa
cauuguccauuagugaaugaauuccugugacauccuccagagauggccccuccucaccugggacg

SEQ ID NO: 728803 - RNA, 65 nt, hsa
ugcccagcuggccgcacacggacauuccaaagaccuccagagaccaccccacccccacauuccuu

SEQ ID NO: 728804 - RNA, 65 nt, hsa
ggaaccugggaugagaaacgacagguggaagguuguccagagacaccuacagcguggaugcuguu

SEQ ID NO: 728805 - RNA, 65 nt, hsa
aauuauaaaacaagaaaucagcaagccugcuuaccuccagagacacaccguuccacuuacaguau

SEQ ID NO: 728806 - RNA, 65 nt, hsa
uuacucggacaaagaccccaaaguggggcaacaacuccagagaggcugugggaaucuucagaacc

SEQ ID NO: 728807 - RNA, 65 nt, hsa
uggggcacggccccuacccgagaacaggaggguccuccagagaaugugccaugaucagggauaug

SEQ ID NO: 728808 - RNA, 65 nt, hsa
gaucuggccaacgggccuuuuuacaggaacugagguccagagaggacauggacacccccagcucu

SEQ ID NO: 728809 - RNA, 65 nt, hsa
uccaaaguaacgaccuuuguaagugaagaugcucuuccagagaccaccuucccagcucuugccag

SEQ ID NO: 728810 - RNA, 65 nt, hsa
ggaaauaacauucauugacauuucugugguuugaauccagagagauacuucuuauagaaaaacaa

SEQ ID NO: 728811 - RNA, 65 nt, hsa
aauuuagggauacagcaggggcuguugggcugugcuccagagaaaaggagcagcuacuccuuuua

SEQ ID NO: 728812 - RNA, 65 nt, hsa
auugcuuuaugaauuaacagucuguucuuccagaguccagagacauuguuaauaaagacaaugaa

SEQ ID NO: 728813 - RNA, 65 nt, hsa
ccugccucccuucccucagaccucucccucauaauuccagagaagggcauuucugucuuuuuaag

SEQ ID NO: 728814 - RNA, 65 nt, hsa
uucacuucuauacuuuguaugcggccuuccacacuuccagagaaugucagugugcaaugugucug

SEQ ID NO: 728815 - RNA, 65 nt, hsa
aaccaagucaacuuuucaccuccugaguuuauuuuuccagagauuccagggccagcaaagccggc

SEQ ID NO: 728816 - RNA, 65 nt, hsa
auuuuucacuacuuaaggaauaaauccaagagcuuuccagagacuggcugcugcagcccugggaa

SEQ ID NO: 728817 - RNA, 65 nt, hsa
ugauugcuucagacuuagaggugaauaaauugagguccagagaggucacagucacgaagcucaug

SEQ ID NO: 728818 - RNA, 65 nt, hsa
caccuccgcuuccccccugcuuccccaggucucuauccagagagaguccccagguacaacaaaug

SEQ ID NO: 728819 - RNA, 65 nt, hsa
gccaggugagcugguucagaccccuccagggguacuccagagaccucacguguggagccaggccu

SEQ ID NO: 728820 - RNA, 65 nt, hsa
aucgggaaaauuacauaaucccucugauuccacuauccagagauagccauuauuauuaauauuug

SEQ ID NO: 728821 - RNA, 65 nt, hsa
cauccuaucccuugacauacuuaaucauauaucucuccagagaacucaccugacaaaugucucug

SEQ ID NO: 728822 - RNA, 65 nt, hsa
cuuuucuguggaugccgauuucuguaaacucugcauccagagauucauuuucuagauacaauaaa

SEQ ID NO: 728823 - RNA, 65 nt, hsa
cccccacaucccuagacagggauggaauguaaauauccagagaauuugggucuaguauaguacau

SEQ ID NO: 728824 - RNA, 65 nt, hsa
uuucuuccuuguuguuugcuuuggucuguguucaauccagagagcuuaaauugucauuauuuugg

SEQ ID NO: 728825 - RNA, 65 nt, hsa
uucagcgugaauuaauuuuuaaucaguuugcuuucuccagagaaauuuuaaaauaauagaagaaa

SEQ ID NO: 728826 - RNA, 65 nt, hsa
ugcagcugggguucccugcuuuuugguagcaaggguccagagaugagguguuuuuuucggggagc

SEQ ID NO: 728827 - RNA, 65 nt, hsa
aggaguaaauaaaagccuaaaauauauuuuaaccauccagagaugguguugaauccuucaacaaa

SEQ ID NO: 728828 - RNA, 65 nt, hsa
uucugacaguauacaaacaacaaaauuaucuauuuuccagagauucuugauaaaacucuguaaug

SEQ ID NO: 728829 - RNA, 65 nt, hsa
auggggacauugggaaccugucaagaagugcuuuauccagagaagcaaauuuugcacgauuggac

SEQ ID NO: 728830 - RNA, 65 nt, hsa
ccacggccgggcccccuggcgacaacuuccaucauuccagagaaaagccacuuuaaaaacagcug

SEQ ID NO: 728831 - RNA, 65 nt, hsa
auuccuuguaauuaagucacaggcaggacccaguuuccagagagcaggcggggccgcccaguggg

SEQ ID NO: 728832 - RNA, 65 nt, hsa
ucuucucccgucugcccugcggguugcccgccuccuccagagacuugcccaagggcccaucacca

SEQ ID NO: 728833 - RNA, 65 nt, hsa
accagggaauuaauucccccagucaaccaauggcauccagagagggcauggaggcuccauacaac

SEQ ID NO: 728834 - RNA, 65 nt, hsa
acaccacaccuggcaaauuugauuuuuuuuuuuuuuccagagacggggucucgcaacauugccca

SEQ ID NO: 728835 - RNA, 65 nt, hsa
agagacgccagccucagacuuuuucccacugaggguccagagagcggggccacgugucacccacg

SEQ ID NO: 728836 - RNA, 65 nt, hsa
cuugcuagggcuucccccuucuccccaucccggucuccagagacccagcuucugagagacagggu

SEQ ID NO: 728837 - RNA, 65 nt, hsa
ggaaaaauagaccaugaacuauacacaaaagugaauccagagauuaaaaacagaaauauggaaaa

SEQ ID NO: 728838 - RNA, 65 nt, hsa
ugcucccauucacgucaauaccaagaaccauguucuccagagaauaaauuuaauuuaugacagcu

SEQ ID NO: 728839 - RNA, 65 nt, hsa
cugcauggggagcccggggagcugaguaguggggauccagagaggacccccgcccccagagacuu

SEQ ID NO: 728840 - RNA, 65 nt, hsa
gugggagguaggcuguggggugggcuggaguccucuccagagaggcucaacaaggaaaaaugcca

SEQ ID NO: 728841 - RNA, 65 nt, hsa
cugaccuuagcguucuggacucugccccaaucggguccagagaccacaccacuaaccauccccaa

SEQ ID NO: 728842 - RNA, 65 nt, hsa
guccuuccugagaagacagcccucugccuuggagcuccagagagagggagcccuguauucuuggc

SEQ ID NO: 728843 - RNA, 65 nt, hsa
ucugacuuuagaguauacaccugacccaguugugguccagagaaucugaguugugcugucagcuu

SEQ ID NO: 728844 - RNA, 65 nt, hsa
ccaugagggugggagccggccugggcagcuccaacuccagagaaggguacagcugaccccggcug

SEQ ID NO: 728845 - RNA, 65 nt, hsa
gccgugggcaaacccugaagacaccccugccccccuccagagagugaggagggggccugagacug

SEQ ID NO: 728846 - RNA, 65 nt, hsa
cauagcaggaauggcaggaagggacaaaagccuguuccagagacccugggaggaccccaggcagg

SEQ ID NO: 728847 - RNA, 65 nt, hsa
ggccgggggccacgggcugcaugcugggcgggcccuccagagaaggacacaaacguguuucguaa

SEQ ID NO: 728848 - RNA, 65 nt, hsa
cuuuaguugggaggagccucagugggccccagcuguccagagaagggggauucuggaacugggaa

SEQ ID NO: 728849 - RNA, 65 nt, hsa
gcuggguuugucccccacccuggggggggccaggcuccagagagggggcaccuccccacacaccc

SEQ ID NO: 728850 - RNA, 65 nt, hsa
auaguuuugagaugucugucccuccucccuggagcuccagagacccaccccucuccagguuaucc

SEQ ID NO: 728851 - RNA, 65 nt, hsa
cggggcgggcgggccgccagagcagcuuuuuacaauccagagacagaaaacaaaaucuagaugca

SEQ ID NO: 728852 - RNA, 65 nt, hsa
ccccaccacacuccccgccuguccugccucucugcuccagagagaggaugcagaggggugcugcu

SEQ ID NO: 728853 - RNA, 65 nt, hsa
aagcugaaaugcaggaagugguggcaaagguuuauuccagagaagccaggaagccggucaucacc

SEQ ID NO: 728854 - RNA, 65 nt, hsa
aauagaauuuauauuacauaaagucuuuauauuuuuccagagaaaauuaaauguuaugaugaaug

SEQ ID NO: 728855 - RNA, 65 nt, hsa
caagagucacuggccccugcuccagcuucuggguauccagagagcacugcacuuccccaaaacgg

SEQ ID NO: 728856 - RNA, 65 nt, hsa
guuucuagagacccagcuuuauucaccugacuguuuccagagacccagcuaaagucaccugccug

SEQ ID NO: 728857 - RNA, 65 nt, hsa
gagcagcuccuuggacagacuguuucucaguuauuuccagagacccagcuacaguucccuggcug

SEQ ID NO: 728858 - RNA, 65 nt, hsa
cugagccacacuguuaagucugcucauuggggaacuccagagacaacuuaggaugagggcagaaa

SEQ ID NO: 728859 - RNA, 65 nt, hsa
ugaugauuauugcagaacauuguaucacauuuuaguccagagauagaauaaaguugaauaaccuu

SEQ ID NO: 728860 - RNA, 65 nt, hsa
uucuuuugggggccuuccccuuuuacuccuuuucuuccagagaucaagagcuucucuugcaucuu

SEQ ID NO: 728861 - RNA, 65 nt, hsa
augguuugccuguccagacuugcucucaagccucauccagagaaggagcugcagaugagggagcc

SEQ ID NO: 728862 - RNA, 65 nt, hsa
ggagaaaagugagccaucugcuggucaggaaguccuccagagaggcagcuuuucccacaauggug

SEQ ID NO: 728863 - RNA, 59 nt, hsa
gugcuggugagcaggcauagcagaggcccuccagagagacugcccugcacgccaugccu

SEQ ID NO: 728864 - RNA, 65 nt, hsa
cuucuguuauugcuugagcauuuggaacucgagcuuccagagaaauuugagguccucgcuuguuc

SEQ ID NO: 728865 - RNA, 65 nt, hsa
uaaaguaacaauaaaagcaguuuuuagaguugaguuccagagagggcagggcaauggcagugaca

SEQ ID NO: 728866 - RNA, 65 nt, hsa
uauguguuguccaguuuuccagaccaggacugaaauccagagagggucaggaauuuggccccaug

SEQ ID NO: 728867 - RNA, 65 nt, hsa
gacccccucgccuuccccaccuccccaccgagaacuccagagacccagauguuggacaccaggaa

SEQ ID NO: 728868 - RNA, 65 nt, hsa
gacuuuaaaguuguuuacagaaauuuaaacucaauuccagagauugaaguuguccaaacagcuca

SEQ ID NO: 728869 - RNA, 65 nt, hsa
aggcaguuuucuuuguucucagacuaauggaugguuccagagaaggaaaugaaaggugcugggug

SEQ ID NO: 728870 - RNA, 65 nt, hsa
gacuuuaaucugacuguagcucauaagacccucauuccagagagggugcugccccauacccggaa

SEQ ID NO: 728871 - RNA, 65 nt, hsa
cccacacuuuaggggguugguaucucgugcucuucuccagagauuacaaaaauguagcuucucag

SEQ ID NO: 728872 - RNA, 65 nt, hsa
acucaacggggacaacuccagaaggucauuccagauccagagauccccaucgaacugaaggauca

SEQ ID NO: 728873 - RNA, 65 nt, hsa
uugagagaacaguguugcugcuggcagagaugcauuccagagaugcacuccgcucuggaacucac

SEQ ID NO: 728874 - RNA, 65 nt, hsa
gaguagacccuguguacacagauugugagugaaguuccagagaugugucagcccuuaucaggcau

SEQ ID NO: 728875 - RNA, 65 nt, hsa
aauguaauguaauuauaagcgauuccccucaacaauccagagaaaguaguucuuuaaauaagaga

SEQ ID NO: 728876 - RNA, 65 nt, hsa
cuggauuucugacagggcuuggagggaccaggguuuccagagaugcucaccuugucucugcagcc

SEQ ID NO: 728877 - RNA, 65 nt, hsa
uuggccgguucuugaccugguggauguggcugcaguccagagaaaggaaagauugagguggcaga

SEQ ID NO: 728878 - RNA, 65 nt, hsa
aaaggcccuguaaagcccucagagagaagagagacuccagagaaggcucccuaagaccuugagag

SEQ ID NO: 728879 - RNA, 65 nt, hsa
cgccccuggccccaaaacagagagcaagacaguuguccagagaauuuagauaugaguuaagagcu

SEQ ID NO: 728880 - RNA, 65 nt, hsa
aagccaucggagcugcuagaguucugucuggacuuuccagagaccaguauucccuuuugcugccu

SEQ ID NO: 728881 - RNA, 65 nt, hsa
cuuaucucagaaacagguuuuaaaaugaagugcuuuccagagaaccaucauauaaauaaagauua

SEQ ID NO: 728882 - RNA, 65 nt, hsa
uaaggucugugcugggccaagagcagcuuugaagcuccagagaaccaccccgucagguuccuugu

SEQ ID NO: 728883 - RNA, 65 nt, hsa
acccuugugccaccugggccagcaaagaggagggguccagagaacagcugaaauacugucacuag

SEQ ID NO: 728884 - RNA, 65 nt, hsa
agcagagagcccacgugcaggaguucuuugcuuccuccagagacuuuuucucuucucugcagccu

SEQ ID NO: 728885 - RNA, 65 nt, hsa
ccugccucagcucccugcccagccagccuccugucuccagagaaguucuccauuaaaaaauaauu

SEQ ID NO: 728886 - RNA, 65 nt, hsa
aucccguacaccagugggaagagggugagggcugauccagagacccugagccuacagcaaggcug

SEQ ID NO: 728887 - RNA, 65 nt, hsa
aucugugccuucucuauggccuugcuaccugggauuccagagaguugauggggugcagauagggg

SEQ ID NO: 728888 - RNA, 65 nt, hsa
uugugaacucaaccacaaucuccucgagacauucauccagagaccauguggcacuugauugaaac

SEQ ID NO: 728889 - RNA, 65 nt, hsa
aaagaggaauguuaccauccccagcugcccuuauuuccagagaaccagacguuuguuucccaguu

SEQ ID NO: 728890 - RNA, 65 nt, hsa
auugaaagaccugcuggagcucacaaggcgggaguuccagagagaggacauagcucugaauuacc

SEQ ID NO: 728891 - RNA, 65 nt, hsa
agaccugccgaggccacacuccuggaguaucugcauccagagaucugcacguuuguaaagcuaag

SEQ ID NO: 728892 - RNA, 65 nt, hsa
uggggauggcucgguccaagcccaacacugcccgcuccagagagccucagcccugccucccuuuc

SEQ ID NO: 728893 - RNA, 65 nt, hsa
auuuucuucaacaaccauaucgcuaaacuaauauauccagagauuuugcacaauucguguugaac

SEQ ID NO: 728894 - RNA, 65 nt, hsa
gugucccacauguuggauuccguccccaccacacuuccagagaccggagaacugugcagggccua

SEQ ID NO: 728895 - RNA, 65 nt, hsa
gcguuuuuggugggcuuacuuggugcagugugcuguccagagagaccugcugacccagucuggga

SEQ ID NO: 728896 - RNA, 65 nt, hsa
guuguggcuuuuaugcuuucaaagaauuucuucaguccagagaauuccuccuggcagcccugugu

SEQ ID NO: 728897 - RNA, 65 nt, hsa
gagggauccagggcaucugugaacuggcugcuucuuccagagagaucucuuggcagagugagggc

SEQ ID NO: 728898 - RNA, 65 nt, hsa
auguucuacucucaauacuaccacagacugauuuuuccagagaggagaacugacaggguuuggcu

SEQ ID NO: 728899 - RNA, 65 nt, hsa
ccacucuguacagaggcuguuugggcagccuugccuccagagagcagauuccagcuucggaagcc

SEQ ID NO: 728900 - RNA, 65 nt, hsa
ggugagugaccaccugggugccaguuacagguguuuccagagaccauagaaauguguuuuccuga

SEQ ID NO: 728901 - RNA, 65 nt, hsa
cuuaaacuguuuucuuuugggcuuggggugggacuuccagagauagggauggguugggggcgggg

SEQ ID NO: 728902 - RNA, 65 nt, hsa
ggcagccccuucugcccaccccauccuucuuccucuccagagaugccaggggggcguguaugcuc

SEQ ID NO: 728903 - RNA, 65 nt, hsa
caacguggacaucuccuuggggcuggucaguugcauccagagaugccucccucagggguaaggag

SEQ ID NO: 728904 - RNA, 65 nt, hsa
acugcccuccucaaagccauuuccacucagcucuuuccagagaauucucaguuuuaugagacggg

SEQ ID NO: 728905 - RNA, 65 nt, hsa
aacagagcuacgccagcaggcgccaagcacccaacuccagagauggaagccugguggccuuccuu

SEQ ID NO: 728906 - RNA, 65 nt, hsa
ucucaauaaauguuaagagcguaaguguaaggggguccagagaccaaaaguuuuagagcuacagg

SEQ ID NO: 728907 - RNA, 65 nt, hsa
aaaaucccaguggaggguggaaggaaccguuugccuccagagauggccccagggagaacacaggg

SEQ ID NO: 728908 - RNA, 65 nt, hsa
augaaggagaaccugguggcauugccccagagcucuccagagaugagccuccccuauccccaccc

SEQ ID NO: 728909 - RNA, 65 nt, hsa
ugcuuauguauaaguaaaggggcaggugcuugggcuccagagagacccuagguacugccuucuaa

SEQ ID NO: 728910 - RNA, 65 nt, hsa
aacuacugggcucaagacauccuccugcuucagccuccagagaguugggaccauaggugcacacc

SEQ ID NO: 728911 - RNA, 65 nt, hsa
auauaucugaagcagcaaccccacugaugcagacauccagagaguccuaugaaaagacaaggcca

SEQ ID NO: 728912 - RNA, 65 nt, hsa
gaagugugacaagugugggcuccugaaaggaauguuccagagaaaccagcuaaaucaugacaccu

SEQ ID NO: 728913 - RNA, 65 nt, hsa
gaaauuuagggguagaaaauguuuuccccuaauuuuccagagaagccuauuuuuauauuuuuaaa

SEQ ID NO: 728914 - RNA, 65 nt, hsa
ugaagcacucuuggaguuguggguccugcccagaguccagagagcagccucagcugagcacaggu

SEQ ID NO: 728915 - RNA, 65 nt, hsa
caggccacagccccuggcacugcagguggccucccuccagagacucgaguccccaugauucccuc

SEQ ID NO: 728916 - RNA, 65 nt, hsa
cauaagacccagcaguugugcuccuggacauucauuccagagaaaugaaaaccuauauuguacuu

SEQ ID NO: 728917 - RNA, 65 nt, hsa
gucaaugagauuuugcccagcacauggagcuguaauccagagagaaggaaacguagaaauuuauu

SEQ ID NO: 728918 - RNA, 65 nt, hsa
aagggagggcuggcucccaguuagcccugggacccuccagagaggguuucuacucugcucccuag

SEQ ID NO: 728919 - RNA, 65 nt, hsa
gucgagugauauggcuuguagggugaggcgugggauccagagagaagcaccccaccacacacacc

SEQ ID NO: 728920 - RNA, 65 nt, hsa
gggcagggggguggcuggggcugggccaucaccauuccagagacaaggccaguguauaugcaaac

SEQ ID NO: 728921 - RNA, 65 nt, hsa
cagggugcuccagcgcuggggaguggugagggccuuccagagauccucguacucuuucucccguc

SEQ ID NO: 728922 - RNA, 65 nt, hsa
ucaguauauucacaauguuguguccacuguuuaauuccagagaauuuuuaucacccaaauaagaa

SEQ ID NO: 728923 - RNA, 65 nt, hsa
gaaaaccaaagacgcuuggcagaacccuguuccuuuccagagacagagcuguguaccuugucuaa

SEQ ID NO: 728924 - RNA, 65 nt, hsa
gaagugugacaagugugggcuccugaaaggaauguuccagagaaaccagcuaaaucauggcaccu

SEQ ID NO: 728925 - RNA, 65 nt, hsa
uuguucagggaaaucagcaugauagaugcugugccuccagagaguucucuggagauuacuaccca

SEQ ID NO: 728926 - RNA, 65 nt, hsa
guuucugguugggaagcguaaaagccagggagagauccagagaguuuucaaguuuuugcagaugu

SEQ ID NO: 728927 - RNA, 65 nt, hsa
aaacuuaugaugaaaauuuacaauaaccugaaagauccagagauguaugagagcauuuuguaacu

SEQ ID NO: 728928 - RNA, 64 nt, hsa
acgccgccaguccauucuuaaggaacugccgacuaggacugaugaugcauuuuagcuuugagcu

SEQ ID NO: 728929 - RNA, 64 nt, hsa
ucagcuuauggcuucugucuaagcaccugaacagaggacugaaaccuccacugcaggcugguuu

SEQ ID NO: 728930 - RNA, 64 nt, hsa
acagaggcucucggugccgaagauugccugccagaggacugaccacagccuggcuggcagcugc

SEQ ID NO: 728931 - RNA, 64 nt, hsa
agccuggcuggcagcugcucuguggaggaccuccaggacugagacugggcucuguuuuccaagg

SEQ ID NO: 728932 - RNA, 64 nt, hsa
ggcuggaauaaggcagcaucacggaaauucuguaaggacugacacagagagcucaugcugacug

SEQ ID NO: 728933 - RNA, 64 nt, hsa
cuuccugaacauauucugcaccucgucagccuucaggacugaucugccauuuucaccucuaaau

SEQ ID NO: 728934 - RNA, 64 nt, hsa
auggugcuugaugagggaagguagacucuucccuaggacugacgaguuacggcugccagaugcc

SEQ ID NO: 728935 - RNA, 64 nt, hsa
aaaaugcacaaagcccugggagaugacaagcacaaggacugacucaagcugugucuuucagacc

SEQ ID NO: 728936 - RNA, 64 nt, hsa
uguagagaggcguuagugggcagguggccacagcaggacugaggacaggcccccauuauccuag

SEQ ID NO: 728937 - RNA, 64 nt, hsa
cacccagaccugaaugcuucugagagcaaagggaaggacugacgagagauguauauuuaauuuu

SEQ ID NO: 728938 - RNA, 64 nt, hsa
gccccaccccgccacuucccucgggcccuuaugaaggacugaggcuccagggugagaaggcuca

SEQ ID NO: 728939 - RNA, 64 nt, hsa
agguucugggugcccgcaggggcugggggaugcuaggacugagacccuggguggugcagcgccu

SEQ ID NO: 728940 - RNA, 64 nt, hsa
cauaccacuucagacuuuagccuguuuaguuuuaaggacugaaaaugguagguuugggcagaag

SEQ ID NO: 728941 - RNA, 64 nt, hsa
uucacugucuacagugugcuuuuguauauggaucaggacugagcaaaguaauuacauguaucag

SEQ ID NO: 728942 - RNA, 64 nt, hsa
ggauuuagcuuauaagaacaaagcacaauuauucaggacugaacugcuuugaggugccuuggaa

SEQ ID NO: 728943 - RNA, 64 nt, hsa
ccugcccccucccaggagcccagccccucuggccaggacugaggaggaguggagggaagcaggg

SEQ ID NO: 728944 - RNA, 64 nt, hsa
agaccucagccaggucuucuggagaugacauuugaggacugauggccaaagagcaugggggacu

SEQ ID NO: 728945 - RNA, 64 nt, hsa
cagagugagauucugcauggaggaaaaaugacuaaggacugagcccccuacccaacuaccccca

SEQ ID NO: 728946 - RNA, 64 nt, hsa
gagauacaaguucagggacucagcaaugcacuuuaggacugagcuaggaggcaaauaucugaag

SEQ ID NO: 728947 - RNA, 64 nt, hsa
uuuuccaaagcagguuugggcaaaauuaauccacaggacugaaagguauacaucugugaguuuu

SEQ ID NO: 728948 - RNA, 64 nt, hsa
caauuauugucugaagcuaaaauggguuauuuauaggacugauggaaaugauuucaucucugcc

SEQ ID NO: 728949 - RNA, 64 nt, hsa
ucuuacgauacagggccauuuuuuuaaaacucucaggacugaacagaagagaaaaauuauuaau

SEQ ID NO: 728950 - RNA, 64 nt, hsa
accagcuguaucugaaagagaaaagacaugaaauauaaaccaaccuccucauuucuguugagua

SEQ ID NO: 728951 - RNA, 64 nt, hsa
uacaauagaaacgcuuuuaauaaagucuuucagaauaaaccaaguuuuuguaaauuuucaauuc

SEQ ID NO: 728952 - RNA, 64 nt, hsa
cauccacuaccccguuuucucuucuugcugcaaaauaaaccacucuguccauuuuuaacucuaa

SEQ ID NO: 728953 - RNA, 64 nt, hsa
guggaagcaugugcaggagacauaucauccaaacauaaaccauuaaaauguuugugguuugcuu

SEQ ID NO: 728954 - RNA, 64 nt, hsa
cucugaagaaguucaaaaaaaauuauaugaagagauaaaccaaguuuuuggaaaugguccuguu

SEQ ID NO: 728955 - RNA, 64 nt, hsa
aaccauuuaaaaaaaaucuauguugaauccuuuuauaaaccaguaucacuuuguaauauaaaca

SEQ ID NO: 728956 - RNA, 64 nt, hsa
auuccaaaugaccaguuccaguuggaaccaauuuauaaaccaauuccuguuggaauuuggguga

SEQ ID NO: 728957 - RNA, 64 nt, hsa
ucaucuguugacaauuugccauagcagugcuaggauaaaccaaucaucuuaacuuggcuaacau

SEQ ID NO: 728958 - RNA, 64 nt, hsa
uugaucccuggcucagaggauagcgguuuccaucauaaaccaagaugaugaguucagccuuuau

SEQ ID NO: 728959 - RNA, 64 nt, hsa
cuguucccugggucagaggauagcgguuuccaucauaaaccaagaugaugaguucagccuuuau

SEQ ID NO: 728960 - RNA, 60 nt, hsa
auaacauccauaguguuuagagagaaaaaaauaaaccaauaaccuaccuacugacaagua

SEQ ID NO: 728961 - RNA, 64 nt, hsa
aucucuagggauguuuaacauuuauaauugcaaaauaaaccaacuauaaaaaaagaaacuaaga

SEQ ID NO: 728962 - RNA, 64 nt, hsa
ucucaauacuguaugaauaaugaaacuuacuaucauaaaccauguuucauguggccuguuaggg

SEQ ID NO: 728963 - RNA, 64 nt, hsa
accauagaaauguuuuucaaaauggcaacaauggauaaaccaaggauuuuguguuuaacaaucc

SEQ ID NO: 728964 - RNA, 64 nt, hsa
cgcgcgcacacacacaugcuuuacaaguuuuauuauaaaccaagaauuuuggacuugcaaagag

SEQ ID NO: 728965 - RNA, 64 nt, hsa
uuccuuuguccaaaaugauucuaaauagaaucuaauaaaccaauguagcauuauuuuuuucuaa

SEQ ID NO: 728966 - RNA, 64 nt, hsa; identical to SEQ ID NO: 69124

SEQ ID NO: 728967 - RNA, 64 nt, hsa; identical to SEQ ID NO: 69125

SEQ ID NO: 728968 - RNA, 64 nt, hsa; identical to SEQ ID NO: 69126

SEQ ID NO: 728969 - RNA, 64 nt, hsa; identical to SEQ ID NO: 69127

SEQ ID NO: 728970 - RNA, 64 nt, hsa; identical to SEQ ID NO: 69128

SEQ ID NO: 728971 - RNA, 64 nt, hsa; identical to SEQ ID NO: 69129

SEQ ID NO: 728972 - RNA, 64 nt, hsa
aaauguacagcaagccuauguaguucaauuaauauauaaggaaaaggaaggucuuucuucauga

SEQ ID NO: 728973 - RNA, 64 nt, hsa
ugaauuucuucauuugcucuugcaucuacauugcuauaaggauauaaaaugugguuucuauauu

SEQ ID NO: 728974 - RNA, 64 nt, hsa
aucauauccacaguuauguaaggcagugauauacuauaaggauaaacaaagucaaguccauaaa

SEQ ID NO: 728975 - RNA, 64 nt, hsa
ugugaauucuauuauggguagccuuuuuaccaauuauaaggaaaauuuacagcagugaacauga

SEQ ID NO: 728976 - RNA, 64 nt, hsa
gcugggauaugauggguuagaagcaaggagaaaauauaaggacuuuuugauggaauuaaaugug

SEQ ID NO: 728977 - RNA, 64 nt, hsa
aagguaaccaauccagugaauagaugugcccuuuuauaaggaaacuucugauguuuauuaaaaa

SEQ ID NO: 728978 - RNA, 64 nt, hsa
aaggauguauuauugagaaguaaguugaagggcuuauaaggaaaaauguuuuauaacugaguaa

SEQ ID NO: 728979 - RNA, 64 nt, hsa
aauaaaguauucaaaauauuaacauuuucauaaauauaaggauguauuauugagaaguaaguug

SEQ ID NO: 728980 - RNA, 64 nt, hsa
uaugaaggaggcuuuucuucucagcuaacaggcauauaaggaaaaccaucuagagaguuuucuu

SEQ ID NO: 728981 - RNA, 64 nt, hsa
aauacaaaggaucaccacaauccucuauugaacauauaaggauccucagauuuaaauaaguacu

SEQ ID NO: 728982 - RNA, 64 nt, hsa; identical to SEQ ID NO: 494653

SEQ ID NO: 728983 - RNA, 64 nt, hsa; identical to SEQ ID NO: 494654

SEQ ID NO: 728984 - RNA, 64 nt, hsa; identical to SEQ ID NO: 494655

SEQ ID NO: 728985 - RNA, 64 nt, hsa; identical to SEQ ID NO: 494656

SEQ ID NO: 728986 - RNA, 64 nt, hsa; identical to SEQ ID NO: 494657

SEQ ID NO: 728987 - RNA, 64 nt, hsa; identical to SEQ ID NO: 494658

SEQ ID NO: 728988 - RNA, 64 nt, hsa; identical to SEQ ID NO: 494659

SEQ ID NO: 728989 - RNA, 64 nt, hsa; identical to SEQ ID NO: 494660

SEQ ID NO: 728990 - RNA, 64 nt, hsa; identical to SEQ ID NO: 494661

SEQ ID NO: 728991 - RNA, 64 nt, hsa; identical to SEQ ID NO: 494662

SEQ ID NO: 728992 - RNA, 64 nt, hsa; identical to SEQ ID NO: 494663

SEQ ID NO: 728993 - RNA, 64 nt, hsa; identical to SEQ ID NO: 494664

SEQ ID NO: 728994 - RNA, 64 nt, hsa; identical to SEQ ID NO: 494665

SEQ ID NO: 728995 - RNA, 64 nt, hsa; identical to SEQ ID NO: 494666

SEQ ID NO: 728996 - RNA, 64 nt, hsa; identical to SEQ ID NO: 494667

SEQ ID NO: 728997 - RNA, 64 nt, hsa; identical to SEQ ID NO: 494668

SEQ ID NO: 728998 - RNA, 64 nt, hsa; identical to SEQ ID NO: 494669

SEQ ID NO: 728999 - RNA, 64 nt, hsa; identical to SEQ ID NO: 494670

SEQ ID NO: 729000 - RNA, 64 nt, hsa; identical to SEQ ID NO: 494671

SEQ ID NO: 729001 - RNA, 64 nt, hsa; identical to SEQ ID NO: 494672

SEQ ID NO: 729002 - RNA, 64 nt, hsa; identical to SEQ ID NO: 494673

SEQ ID NO: 729003 - RNA, 64 nt, hsa; identical to SEQ ID NO: 494674

SEQ ID NO: 729004 - RNA, 64 nt, hsa; identical to SEQ ID NO: 494675

SEQ ID NO: 729005 - RNA, 64 nt, hsa; identical to SEQ ID NO: 494676

SEQ ID NO: 729006 - RNA, 64 nt, hsa; identical to SEQ ID NO: 494677

SEQ ID NO: 729007 - RNA, 64 nt, hsa; identical to SEQ ID NO: 494678

SEQ ID NO: 729008 - RNA, 64 nt, hsa; identical to SEQ ID NO: 494679

SEQ ID NO: 729009 - RNA, 64 nt, hsa; identical to SEQ ID NO: 494680

SEQ ID NO: 729010 - RNA, 64 nt, hsa; identical to SEQ ID NO: 494681

SEQ ID NO: 729011 - RNA, 64 nt, hsa; identical to SEQ ID NO: 494682

SEQ ID NO: 729012 - RNA, 64 nt, hsa; identical to SEQ ID NO: 494683

SEQ ID NO: 729013 - RNA, 64 nt, hsa; identical to SEQ ID NO: 494684

SEQ ID NO: 729014 - RNA, 64 nt, hsa; identical to SEQ ID NO: 494685

SEQ ID NO: 729015 - RNA, 64 nt, hsa; identical to SEQ ID NO: 494686

SEQ ID NO: 729016 - RNA, 64 nt, hsa; identical to SEQ ID NO: 494687

SEQ ID NO: 729017 - RNA, 64 nt, hsa; identical to SEQ ID NO: 494688

SEQ ID NO: 729018 - RNA, 64 nt, hsa; identical to SEQ ID NO: 494689

SEQ ID NO: 729019 - RNA, 64 nt, hsa; identical to SEQ ID NO: 494690

SEQ ID NO: 729020 - RNA, 64 nt, hsa; identical to SEQ ID NO: 494691

SEQ ID NO: 729021 - RNA, 64 nt, hsa; identical to SEQ ID NO: 494692

SEQ ID NO: 729022 - RNA, 64 nt, hsa; identical to SEQ ID NO: 494693

SEQ ID NO: 729023 - RNA, 64 nt, hsa; identical to SEQ ID NO: 494694

SEQ ID NO: 729024 - RNA, 64 nt, hsa; identical to SEQ ID NO: 494695

SEQ ID NO: 729025 - RNA, 64 nt, hsa
agaguuaauuguuuucuuuguucuuuuuuugaagucauuacacaggacuucacuccagaguuac

SEQ ID NO: 729026 - RNA, 64 nt, hsa
ccccuaggaccugugcagacaguagucuguugaaucauuacaucaaggagcugccccugucagg

SEQ ID NO: 729027 - RNA, 64 nt, hsa
caaaugugacuaagucauuacaaaugugacugagucauuacaguggacccucugggugcauuga

SEQ ID NO: 729028 - RNA, 64 nt, hsa
ugguuaugacaaagucauuacaaaugugacuaagucauuacaaaugugacugagucauuacagu

SEQ ID NO: 729029 - RNA, 64 nt, hsa
gaauaguggaaaagguaucuugguuaugacaaagucauuacaaaugugacuaagucauuacaaa

SEQ ID NO: 729030 - RNA, 64 nt, hsa
uaggcaaaauacuuuucaggccuuuuuaaaaaauucauuacagcaaacagcuggggaaggacau

SEQ ID NO: 729031 - RNA, 64 nt, hsa
ccaccaaccagacccuuggaaaggaauacuaaaaucauuacaagguauggauuuuaaauggaug

SEQ ID NO: 729032 - RNA, 64 nt, hsa
uaggagaauucagaaaagaaugggugauuaaaguucauuacagcugaauaaaugugucuaaaac

SEQ ID NO: 729033 - RNA, 64 nt, hsa
ucaauuugaguugguucucucaaugaucuauugaucauuacacccuaacucuccuuccuuggcu

SEQ ID NO: 729034 - RNA, 64 nt, hsa
aaugacuuuguuuuauccacaguuaagccuuuucucauuacauauuuauguauuucacugucau

SEQ ID NO: 729035 - RNA, 64 nt, hsa
uuggauccuagcaugacuauacauugugacauggucauuacauauggauuagaccaacuggaga

SEQ ID NO: 729036 - RNA, 64 nt, hsa
acuguuuauugugaagcauuuaccuuucaaaaaaucauuacauuucuauuucuugguggagcag

SEQ ID NO: 729037 - RNA, 64 nt, hsa
aucuguuuuuuuuuuuaauguugcacuuguaguuucauuacaaaagaucagaucaugaaaggca

SEQ ID NO: 729038 - RNA, 64 nt, hsa
gugcacuuacaguucagaccguucuccuguaaguucauuacaaacacgggcggaaggcacucag

SEQ ID NO: 729039 - RNA, 64 nt, hsa
ugacagcaggaagaaaacaauuuuuuaaaaauucucauuacauagacgcacaagaauaugucac

SEQ ID NO: 729040 - RNA, 64 nt, hsa; identical to SEQ ID NO: 468216

SEQ ID NO: 729041 - RNA, 64 nt, hsa; identical to SEQ ID NO: 468217

SEQ ID NO: 729042 - RNA, 64 nt, hsa; identical to SEQ ID NO: 468218

SEQ ID NO: 729043 - RNA, 64 nt, hsa; identical to SEQ ID NO: 468219

SEQ ID NO: 729044 - RNA, 64 nt, hsa; identical to SEQ ID NO: 468220

SEQ ID NO: 729045 - RNA, 64 nt, hsa; identical to SEQ ID NO: 468221

SEQ ID NO: 729046 - RNA, 64 nt, hsa; identical to SEQ ID NO: 468222

SEQ ID NO: 729047 - RNA, 64 nt, hsa; identical to SEQ ID NO: 468223

SEQ ID NO: 729048 - RNA, 64 nt, hsa; identical to SEQ ID NO: 468224

SEQ ID NO: 729049 - RNA, 64 nt, hsa; identical to SEQ ID NO: 468225

SEQ ID NO: 729050 - RNA, 64 nt, hsa; identical to SEQ ID NO: 468226

SEQ ID NO: 729051 - RNA, 64 nt, hsa; identical to SEQ ID NO: 468227

SEQ ID NO: 729052 - RNA, 64 nt, hsa; identical to SEQ ID NO: 468228

SEQ ID NO: 729053 - RNA, 64 nt, hsa; identical to SEQ ID NO: 468229

SEQ ID NO: 729054 - RNA, 64 nt, hsa; identical to SEQ ID NO: 468230

SEQ ID NO: 729055 - RNA, 64 nt, hsa; identical to SEQ ID NO: 468231

SEQ ID NO: 729056 - RNA, 64 nt, hsa; identical to SEQ ID NO: 468232

SEQ ID NO: 729057 - RNA, 64 nt, hsa; identical to SEQ ID NO: 468233

SEQ ID NO: 729058 - RNA, 64 nt, hsa; identical to SEQ ID NO: 468234

SEQ ID NO: 729059 - RNA, 64 nt, hsa; identical to SEQ ID NO: 468235

SEQ ID NO: 729060 - RNA, 64 nt, hsa; identical to SEQ ID NO: 468236

SEQ ID NO: 729061 - RNA, 64 nt, hsa; identical to SEQ ID NO: 468237

SEQ ID NO: 729062 - RNA, 64 nt, hsa; identical to SEQ ID NO: 468238

SEQ ID NO: 729063 - RNA, 64 nt, hsa; identical to SEQ ID NO: 468239

SEQ ID NO: 729064 - RNA, 64 nt, hsa; identical to SEQ ID NO: 468240

SEQ ID NO: 729065 - RNA, 64 nt, hsa; identical to SEQ ID NO: 468241

SEQ ID NO: 729066 - RNA, 64 nt, hsa; identical to SEQ ID NO: 468242

SEQ ID NO: 729067 - RNA, 64 nt, hsa; identical to SEQ ID NO: 468243

SEQ ID NO: 729068 - RNA, 64 nt, hsa; identical to SEQ ID NO: 468244

SEQ ID NO: 729069 - RNA, 64 nt, hsa; identical to SEQ ID NO: 468245

SEQ ID NO: 729070 - RNA, 64 nt, hsa; identical to SEQ ID NO: 468246

SEQ ID NO: 729071 - RNA, 64 nt, hsa; identical to SEQ ID NO: 468246

SEQ ID NO: 729072 - RNA, 64 nt, hsa; identical to SEQ ID NO: 468245

SEQ ID NO: 729073 - RNA, 64 nt, hsa; identical to SEQ ID NO: 468249

SEQ ID NO: 729074 - RNA, 64 nt, hsa; identical to SEQ ID NO: 468250

SEQ ID NO: 729075 - RNA, 64 nt, hsa; identical to SEQ ID NO: 468251

SEQ ID NO: 729076 - RNA, 64 nt, hsa; identical to SEQ ID NO: 468252

SEQ ID NO: 729077 - RNA, 64 nt, hsa; identical to SEQ ID NO: 468253

SEQ ID NO: 729078 - RNA, 64 nt, hsa; identical to SEQ ID NO: 468254

SEQ ID NO: 729079 - RNA, 64 nt, hsa; identical to SEQ ID NO: 468255

SEQ ID NO: 729080 - RNA, 64 nt, hsa; identical to SEQ ID NO: 468256

SEQ ID NO: 729081 - RNA, 64 nt, hsa; identical to SEQ ID NO: 468257

SEQ ID NO: 729082 - RNA, 64 nt, hsa; identical to SEQ ID NO: 468258

SEQ ID NO: 729083 - RNA, 64 nt, hsa; identical to SEQ ID NO: 468259

SEQ ID NO: 729084 - RNA, 64 nt, hsa; identical to SEQ ID NO: 468260

SEQ ID NO: 729085 - RNA, 64 nt, hsa; identical to SEQ ID NO: 468261

SEQ ID NO: 729086 - RNA, 64 nt, hsa; identical to SEQ ID NO: 468262

SEQ ID NO: 729087 - RNA, 64 nt, hsa; identical to SEQ ID NO: 468263

SEQ ID NO: 729088 - RNA, 64 nt, hsa; identical to SEQ ID NO: 468264

SEQ ID NO: 729089 - RNA, 64 nt, hsa; identical to SEQ ID NO: 468265

SEQ ID NO: 729090 - RNA, 64 nt, hsa; identical to SEQ ID NO: 468266

SEQ ID NO: 729091 - RNA, 64 nt, hsa; identical to SEQ ID NO: 468267

SEQ ID NO: 729092 - RNA, 64 nt, hsa; identical to SEQ ID NO: 468268

SEQ ID NO: 729093 - RNA, 64 nt, hsa; identical to SEQ ID NO: 468269

SEQ ID NO: 729094 - RNA, 64 nt, hsa; identical to SEQ ID NO: 468270

SEQ ID NO: 729095 - RNA, 64 nt, hsa; identical to SEQ ID NO: 468271

SEQ ID NO: 729096 - RNA, 64 nt, hsa; identical to SEQ ID NO: 468272

SEQ ID NO: 729097 - RNA, 64 nt, hsa; identical to SEQ ID NO: 468273

SEQ ID NO: 729098 - RNA, 64 nt, hsa; identical to SEQ ID NO: 468274

SEQ ID NO: 729099 - RNA, 64 nt, hsa; identical to SEQ ID NO: 468275

SEQ ID NO: 729100 - RNA, 64 nt, hsa; identical to SEQ ID NO: 468276

SEQ ID NO: 729101 - RNA, 64 nt, hsa; identical to SEQ ID NO: 468277

SEQ ID NO: 729102 - RNA, 64 nt, hsa; identical to SEQ ID NO: 468278

SEQ ID NO: 729103 - RNA, 64 nt, hsa; identical to SEQ ID NO: 468279

SEQ ID NO: 729104 - RNA, 64 nt, hsa; identical to SEQ ID NO: 468280

SEQ ID NO: 729105 - RNA, 64 nt, hsa; identical to SEQ ID NO: 468281

SEQ ID NO: 729106 - RNA, 64 nt, hsa; identical to SEQ ID NO: 468282

SEQ ID NO: 729107 - RNA, 64 nt, hsa; identical to SEQ ID NO: 468283

SEQ ID NO: 729108 - RNA, 64 nt, hsa; identical to SEQ ID NO: 468284

SEQ ID NO: 729109 - RNA, 64 nt, hsa; identical to SEQ ID NO: 468285

SEQ ID NO: 729110 - RNA, 64 nt, hsa; identical to SEQ ID NO: 468286

SEQ ID NO: 729111 - RNA, 64 nt, hsa; identical to SEQ ID NO: 468287

SEQ ID NO: 729112 - RNA, 64 nt, hsa; identical to SEQ ID NO: 468288

SEQ ID NO: 729113 - RNA, 64 nt, hsa; identical to SEQ ID NO: 468289

SEQ ID NO: 729114 - RNA, 64 nt, hsa; identical to SEQ ID NO: 468290

SEQ ID NO: 729115 - RNA, 64 nt, hsa; identical to SEQ ID NO: 468291

SEQ ID NO: 729116 - RNA, 64 nt, hsa; identical to SEQ ID NO: 468292

SEQ ID NO: 729117 - RNA, 64 nt, hsa; identical to SEQ ID NO: 468293

SEQ ID NO: 729118 - RNA, 64 nt, hsa; identical to SEQ ID NO: 468294

SEQ ID NO: 729119 - RNA, 64 nt, hsa; identical to SEQ ID NO: 468293

SEQ ID NO: 729120 - RNA, 64 nt, hsa; identical to SEQ ID NO: 468294

SEQ ID NO: 729121 - RNA, 64 nt, hsa
cucggccucccaaagugcugggauuacaggccucagcuaccacgccuggccaauccaggucuua

SEQ ID NO: 729122 - RNA, 64 nt, hsa
cucuucuggaaaagagaggcuuuucuucaucgagagcuaccagaggagauauuaucuguccucu

SEQ ID NO: 729123 - RNA, 64 nt, hsa
cagggaagagcagugcuguccaugauguaauggaagcuaccaggggaggcagugucuggaugau

SEQ ID NO: 729124 - RNA, 64 nt, hsa
uuucaauaucacucuugaguaaagauuaaaauaaagcuaccauuuuacauuucuauuucauaau

SEQ ID NO: 729125 - RNA, 64 nt, hsa
gucugauuacgaaaaguacucuauguuacaguaaagcuaccacucuggcugcuagacagcuugg

SEQ ID NO: 729126 - RNA, 64 nt, hsa
gacccaguagaaagaaaaacauccugggaaauccagcuaccagggcccucccaguggaggcauc

SEQ ID NO: 729127 - RNA, 64 nt, hsa
gacccaguagaaagaaaaacauccugggaaauccagcuaccauggcccucccaguggaggcauc

SEQ ID NO: 729128 - RNA, 50 nt, hsa
aguacuguguguuacaguaaagcuaccacucuggcugcuagauagcuugg

SEQ ID NO: 729129 - RNA, 64 nt, hsa
acccaguagaaagaaacagcauccugggaaauccagcuaccauggcccucccaguggaggcauc

SEQ ID NO: 729130 - RNA, 50 nt, hsa
aguacuguguguuacaguaaagcuaccacucuggcugcuagacagcuugg

SEQ ID NO: 729131 - RNA, 64 nt, hsa
cacggcuucaccucccuaugugaacuguagacucagaucccaauaaagugcuguugcagcuaug

SEQ ID NO: 729132 - RNA, 64 nt, hsa
cccacagggaauggccuuggccuggcccagcccaagaucccagcguuaucuaacuccuggaggg

SEQ ID NO: 729133 - RNA, 64 nt, hsa
aaugcuagucaguaugcaccaccacaggaaaguuagaucccauuagcacuugaaacuacagcuu

SEQ ID NO: 729134 - RNA, 64 nt, hsa
cccacuucuuccuuaaaagguuccacuggagggcagaucccaaaggacaguaucaccguaaacc

SEQ ID NO: 729135 - RNA, 64 nt, hsa
cucaccuccguguucuuggggagugcguggugucagaucccauccugcuccucuccagaguuuc

SEQ ID NO: 729136 - RNA, 64 nt, hsa
cucaccuccguguucucggggagugcguggugucagaucccauccugcucaucuccagcauuuc

SEQ ID NO: 729137 - RNA, 64 nt, hsa
cucaccucuguguucucggggagugcguggugucagaucccauccugcuccucuccagcauuuc

SEQ ID NO: 729138 - RNA, 64 nt, hsa
cucaccuccguguucucggggagugcguggugucagaucccauccugcuccucuccagaguuuc

SEQ ID NO: 729139 - RNA, 64 nt, hsa
ccugcauaauagcuauuggaggcuccucagugaaagaucccaaaaggauuuugguggaaaacua

SEQ ID NO: 729140 - RNA, 64 nt, hsa
caagacuuugaagguguagggaagaggaaaucggagaucccagaagcuucuccacugcccuaug

SEQ ID NO: 729141 - RNA, 64 nt, hsa
cacugggucaugcgauccccacccuucagccacuagaucccagaucccccuguaaccauaacug

SEQ ID NO: 729142 - RNA, 64 nt, hsa
gauccaaccacaggaucccuacucuuuggccacgagaucccaguacccagauccuggauccuag

SEQ ID NO: 729143 - RNA, 63 nt, hsa
cgugccuaggaaaaggggacagagggcaaggagagaagugagagcuacaauuccagcauugga

SEQ ID NO: 729144 - RNA, 63 nt, hsa
gcccagauagacuaacaacccuuuagugcuccaagaagugagaauuuccgaaaaagaucugcc

SEQ ID NO: 729145 - RNA, 63 nt, hsa
gugagccaccgcacccggcuggccaaucuuaucagaagugagcuaccaaaacuuccacagaug

SEQ ID NO: 729146 - RNA, 63 nt, hsa
aagcauuccucaagaucacuuuuaaaaaagguuagaagugaagcaaauacauucagcuuacug

SEQ ID NO: 729147 - RNA, 63 nt, hsa
gugaggagcaacucugcccagccgccccgucugagaagugaggagacccuccgccuggcaacc

SEQ ID NO: 729148 - RNA, 63 nt, hsa
aggagccccucugcccagcagccgccccgucugagaagugaggagccccucugcccagcagcc

SEQ ID NO: 729149 - RNA, 63 nt, hsa
ggccuguuucuguaacuuucucccccucuacugagaagugaccuggaagugagaaguucuuug

SEQ ID NO: 729150 - RNA, 63 nt, hsa
gacggguguuuuauuuggucuaauacccugaaaagaagugaugacuuguugcuuuucaaaaca

SEQ ID NO: 729151 - RNA, 63 nt, hsa
uaauaauaaaaauauaaaaaggugauguucaacagaagugaagacaaaacaauaugcaucagg

SEQ ID NO: 729152 - RNA, 63 nt, hsa
auguucuuucacaucacuggaaucugcaauucaagaagugacaagggagaauucuugcuuuac

SEQ ID NO: 729153 - RNA, 63 nt, hsa
acagagacgggagcucugaguguccacgggugaagaagugaguguccacgggugaagaaguga

SEQ ID NO: 729154 - RNA, 63 nt, hsa
uccacgggugaagaagugaguguccacgggugaagaagugaguauguuucaccuggacauuaa

SEQ ID NO: 729155 - RNA, 63 nt, hsa
cauauaaggaaaaccaucuagagaguuuucuuuagaagugacucccauuagccugguguggug

SEQ ID NO: 729156 - RNA, 63 nt, hsa
agcgagacccugugucuaaguaaagaaaaagccagaagugacucccacugcuucuguugaucg

SEQ ID NO: 729157 - RNA, 63 nt, hsa
aaccuccaucggccuuaguuuuugcauccaaaaagaagugauugggcuggucuuggaagguuu

SEQ ID NO: 729158 - RNA, 63 nt, hsa
ggacagccuggacauuuugagcagcgcgagaguagaagugaauacccccaggaacuccaauug

SEQ ID NO: 729159 - RNA, 63 nt, hsa
uaccuacuauuggcccuaaauagcagaaagaagagaagugaccgagagaaccucagauucuuc

SEQ ID NO: 729160 - RNA, 63 nt, hsa
uauucugaugaaucucaaaguaaggcugguaagagaagugaguggugugacucuuacuccuua

SEQ ID NO: 729161 - RNA, 63 nt, hsa
cugcuaucauaaggggucagggacauuccggggagaagugaccacuaaggugaggauuagaga

SEQ ID NO: 729162 - RNA, 63 nt, hsa
agugaccacuaaggugaggauuagagagugaguagaagugagccagacaaaaaaagcagaaaa

SEQ ID NO: 729163 - RNA, 63 nt, hsa
ccacugaguggccacuguccuuccuaaaugucaagaagugaaguaugucacccuuucagggaa

SEQ ID NO: 729164 - RNA, 63 nt, hsa
acaugcugacagaaaacucccauggcucuaggaagaagugacacuaagccaacaccuuucuuu

SEQ ID NO: 729165 - RNA, 63 nt, hsa; identical to SEQ ID NO: 421856

SEQ ID NO: 729166 - RNA, 63 nt, hsa
uagauacaaagucugugucuaaauauuauuuaaagaagugauuuuucauucucuuggauucuu

SEQ ID NO: 729167 - RNA, 63 nt, hsa
gugaggagcgucucugucuggccaccccgucugagaagugaggagaccuccgcccggcagccg

SEQ ID NO: 729168 - RNA, 63 nt, hsa
gaggagaccuccgcccggcagccgcccugucugagaagugaggagccccuccgcccggcagcc

SEQ ID NO: 729169 - RNA, 63 nt, hsa
gcauuuuuagugaagcaagaaaggaguuugccaagaagugaucuguuuuaaaggucauauuug

SEQ ID NO: 729170 - RNA, 63 nt, hsa
cacgguuuaacacagcagaguacagaagggugaagaagugagcagaggcuuaugaagauauuc

SEQ ID NO: 729171 - RNA, 63 nt, hsa
aauuucuuguucauaagauuaugaaaccacaugagaagugauaaaauguuuguuaaagcuaga

SEQ ID NO: 729172 - RNA, 63 nt, hsa
uaauucauccuagcaaauucuaccuuauuuuacagaagugaaagugagguaucagaaguguua

SEQ ID NO: 729173 - RNA, 63 nt, hsa
aagcuaauaaagaaaagagguuuauacugcaaaagaagugaaacuauauguauucacaguuga

SEQ ID NO: 729174 - RNA, 63 nt, hsa
cccucguaacaacagucucccugggugggucccagaagugaucuuugugucgcucgggucgga

SEQ ID NO: 729175 - RNA, 63 nt, hsa
gugccugcccucagcucucacacaugacuggagagaagugagaagacucccagaaucugccuu

SEQ ID NO: 729176 - RNA, 63 nt, hsa
uccauaagccugaugaguugaaauugcaguuugagaagugaauuaaccuuacaucccuuuguu

SEQ ID NO: 729177 - RNA, 63 nt, hsa
uguuguuauaguucauuguuuugccuacucagcagaagugaugacucuuaaaaauuggcuuug

SEQ ID NO: 729178 - RNA, 63 nt, hsa
guggcuagauggaguauuaagguggagcagaaaagaagugagaacaucuugauuccccuuucu

SEQ ID NO: 729179 - RNA, 63 nt, hsa
ggccagggauugccuucuaaauuaugauaaaacagaagugaagaguuucagagcaucagauug

SEQ ID NO: 729180 - RNA, 63 nt, hsa
guuucuguuuuucccaguaugcauguuuaaaauagaagugacaagaaucacauccgguugugu

SEQ ID NO: 729181 - RNA, 63 nt, hsa
uucaggagaccauaggaccccugacccaugagaagaagugauugguuucgauuauagacauca

SEQ ID NO: 729182 - RNA, 63 nt, hsa
augcucaagagggagguuuccuccugagugaagagaagugauucucccuugacucuggcuccu

SEQ ID NO: 729183 - RNA, 64 nt, hsa
gauggguaaauguguacauccuauuccuuccucuuuaucucacaauuuuugucuccacuaagca

SEQ ID NO: 729184 - RNA, 64 nt, hsa
uaaauauauauuuuuaacauauauuguacuugaauuaucucauguuggcacuucuaaguuuuac

SEQ ID NO: 729185 - RNA, 64 nt, hsa
auaugguacccagacacugggcuaggcugcaacuuuaucucauuuaauacucccagcugucaug

SEQ ID NO: 729186 - RNA, 64 nt, hsa
aacuguucagucauucugguuuucaagcagugcuuuaucucauguccuugaauauaguugugua

SEQ ID NO: 729187 - RNA, 64 nt, hsa
uaugagccaggcaucauacuaaacuucaccuacauuaucucacuuaguccuuuaucauccuuaa

SEQ ID NO: 729188 - RNA, 64 nt, hsa
uuaucauccuuaaaacaauucugugacauacauauuaucucauuuuacacaaagggaagucggg

SEQ ID NO: 729189 - RNA, 64 nt, hsa
uauauauaaauauauacagauacauaucuguguauuaucucaaggaauguacaaacuuuaguuu

SEQ ID NO: 729190 - RNA, 64 nt, hsa
aaguguauuuguguauauguguguauacauauguuuaucucacacacauuaugagcuugaauuc

SEQ ID NO: 729191 - RNA, 64 nt, hsa
aaauuuuacuuuucaugcuucuguacuuacauuuuuaucucaaccuuaauuuuucuuucuuuuu

SEQ ID NO: 729192 - RNA, 64 nt, hsa
acccuaauuuuucauucagucauaauaccaauaguuaucucaugcaccucugagugccuucuuc

SEQ ID NO: 729193 - RNA, 64 nt, hsa; identical to SEQ ID NO: 79919

SEQ ID NO: 729194 - RNA, 64 nt, hsa; identical to SEQ ID NO: 79920

SEQ ID NO: 729195 - RNA, 64 nt, hsa; identical to SEQ ID NO: 79921

SEQ ID NO: 729196 - RNA, 64 nt, hsa; identical to SEQ ID NO: 79922

SEQ ID NO: 729197 - RNA, 64 nt, hsa; identical to SEQ ID NO: 79923

SEQ ID NO: 729198 - RNA, 64 nt, hsa; identical to SEQ ID NO: 79924

SEQ ID NO: 729199 - RNA, 64 nt, hsa; identical to SEQ ID NO: 79925

SEQ ID NO: 729200 - RNA, 64 nt, hsa; identical to SEQ ID NO: 79926

SEQ ID NO: 729201 - RNA, 64 nt, hsa; identical to SEQ ID NO: 79927

SEQ ID NO: 729202 - RNA, 64 nt, hsa; identical to SEQ ID NO: 79928

SEQ ID NO: 729203 - RNA, 64 nt, hsa; identical to SEQ ID NO: 79929

SEQ ID NO: 729204 - RNA, 64 nt, hsa; identical to SEQ ID NO: 79930

SEQ ID NO: 729205 - RNA, 64 nt, hsa; identical to SEQ ID NO: 79931

SEQ ID NO: 729206 - RNA, 64 nt, hsa; identical to SEQ ID NO: 79932

SEQ ID NO: 729207 - RNA, 64 nt, hsa; identical to SEQ ID NO: 79933

SEQ ID NO: 729208 - RNA, 64 nt, hsa; identical to SEQ ID NO: 79934

SEQ ID NO: 729209 - RNA, 64 nt, hsa; identical to SEQ ID NO: 79935

SEQ ID NO: 729210 - RNA, 64 nt, hsa; identical to SEQ ID NO: 79936

SEQ ID NO: 729211 - RNA, 64 nt, hsa; identical to SEQ ID NO: 79937

SEQ ID NO: 729212 - RNA, 64 nt, hsa; identical to SEQ ID NO: 79938

SEQ ID NO: 729213 - RNA, 64 nt, hsa; identical to SEQ ID NO: 79939

SEQ ID NO: 729214 - RNA, 64 nt, hsa; identical to SEQ ID NO: 334387

SEQ ID NO: 729215 - RNA, 64 nt, hsa; identical to SEQ ID NO: 334388

SEQ ID NO: 729216 - RNA, 64 nt, hsa; identical to SEQ ID NO: 334389

SEQ ID NO: 729217 - RNA, 64 nt, hsa; identical to SEQ ID NO: 334390

SEQ ID NO: 729218 - RNA, 64 nt, hsa; identical to SEQ ID NO: 334391

SEQ ID NO: 729219 - RNA, 64 nt, hsa; identical to SEQ ID NO: 334392

SEQ ID NO: 729220 - RNA, 64 nt, hsa; identical to SEQ ID NO: 334393

SEQ ID NO: 729221 - RNA, 64 nt, hsa; identical to SEQ ID NO: 334394

SEQ ID NO: 729222 - RNA, 64 nt, hsa; identical to SEQ ID NO: 334395

SEQ ID NO: 729223 - RNA, 64 nt, hsa; identical to SEQ ID NO: 334396

SEQ ID NO: 729224 - RNA, 64 nt, hsa; identical to SEQ ID NO: 334397

SEQ ID NO: 729225 - RNA, 64 nt, hsa; identical to SEQ ID NO: 334398

SEQ ID NO: 729226 - RNA, 64 nt, hsa; identical to SEQ ID NO: 356005

SEQ ID NO: 729227 - RNA, 64 nt, hsa; identical to SEQ ID NO: 356006

SEQ ID NO: 729228 - RNA, 64 nt, hsa; identical to SEQ ID NO: 356007

SEQ ID NO: 729229 - RNA, 64 nt, hsa; identical to SEQ ID NO: 356008

SEQ ID NO: 729230 - RNA, 64 nt, hsa; identical to SEQ ID NO: 356009

SEQ ID NO: 729231 - RNA, 64 nt, hsa; identical to SEQ ID NO: 356010

SEQ ID NO: 729232 - RNA, 64 nt, hsa; identical to SEQ ID NO: 356011

SEQ ID NO: 729233 - RNA, 64 nt, hsa; identical to SEQ ID NO: 356012

SEQ ID NO: 729234 - RNA, 64 nt, hsa; identical to SEQ ID NO: 356013

SEQ ID NO: 729235 - RNA, 64 nt, hsa; identical to SEQ ID NO: 356014

SEQ ID NO: 729236 - RNA, 52 nt, hsa; identical to SEQ ID NO: 356015

SEQ ID NO: 729237 - RNA, 64 nt, hsa; identical to SEQ ID NO: 356016

SEQ ID NO: 729238 - RNA, 64 nt, hsa; identical to SEQ ID NO: 356017

SEQ ID NO: 729239 - RNA, 64 nt, hsa; identical to SEQ ID NO: 356018

SEQ ID NO: 729240 - RNA, 64 nt, hsa; identical to SEQ ID NO: 356019

SEQ ID NO: 729241 - RNA, 64 nt, hsa; identical to SEQ ID NO: 356020

SEQ ID NO: 729242 - RNA, 64 nt, hsa; identical to SEQ ID NO: 356021

SEQ ID NO: 729243 - RNA, 64 nt, hsa; identical to SEQ ID NO: 356022

SEQ ID NO: 729244 - RNA, 64 nt, hsa; identical to SEQ ID NO: 356023

SEQ ID NO: 729245 - RNA, 64 nt, hsa; identical to SEQ ID NO: 356024

SEQ ID NO: 729246 - RNA, 64 nt, hsa; identical to SEQ ID NO: 356025

SEQ ID NO: 729247 - RNA, 64 nt, hsa; identical to SEQ ID NO: 356026

SEQ ID NO: 729248 - RNA, 64 nt, hsa; identical to SEQ ID NO: 356027

SEQ ID NO: 729249 - RNA, 64 nt, hsa; identical to SEQ ID NO: 356028

SEQ ID NO: 729250 - RNA, 64 nt, hsa; identical to SEQ ID NO: 356029

SEQ ID NO: 729251 - RNA, 64 nt, hsa; identical to SEQ ID NO: 356030

SEQ ID NO: 729252 - RNA, 64 nt, hsa; identical to SEQ ID NO: 356031

SEQ ID NO: 729253 - RNA, 64 nt, hsa; identical to SEQ ID NO: 356032

SEQ ID NO: 729254 - RNA, 64 nt, hsa; identical to SEQ ID NO: 356033

SEQ ID NO: 729255 - RNA, 64 nt, hsa; identical to SEQ ID NO: 356034

SEQ ID NO: 729256 - RNA, 64 nt, hsa; identical to SEQ ID NO: 356035

SEQ ID NO: 729257 - RNA, 64 nt, hsa; identical to SEQ ID NO: 356036

SEQ ID NO: 729258 - RNA, 64 nt, hsa; identical to SEQ ID NO: 356037

SEQ ID NO: 729259 - RNA, 64 nt, hsa; identical to SEQ ID NO: 356038

SEQ ID NO: 729260 - RNA, 64 nt, hsa; identical to SEQ ID NO: 356039

SEQ ID NO: 729261 - RNA, 64 nt, hsa; identical to SEQ ID NO: 356040

SEQ ID NO: 729262 - RNA, 64 nt, hsa; identical to SEQ ID NO: 356041

SEQ ID NO: 729263 - RNA, 64 nt, hsa; identical to SEQ ID NO: 356042

SEQ ID NO: 729264 - RNA, 64 nt, hsa; identical to SEQ ID NO: 356043

SEQ ID NO: 729265 - RNA, 64 nt, hsa; identical to SEQ ID NO: 356044

SEQ ID NO: 729266 - RNA, 64 nt, hsa; identical to SEQ ID NO: 356045

SEQ ID NO: 729267 - RNA, 64 nt, hsa; identical to SEQ ID NO: 356046

SEQ ID NO: 729268 - RNA, 64 nt, hsa; identical to SEQ ID NO: 356047

SEQ ID NO: 729269 - RNA, 64 nt, hsa; identical to SEQ ID NO: 356048

SEQ ID NO: 729270 - RNA, 64 nt, hsa; identical to SEQ ID NO: 356049

SEQ ID NO: 729271 - RNA, 64 nt, hsa; identical to SEQ ID NO: 356050

SEQ ID NO: 729272 - RNA, 64 nt, hsa; identical to SEQ ID NO: 356051

SEQ ID NO: 729273 - RNA, 64 nt, hsa; identical to SEQ ID NO: 356052

SEQ ID NO: 729274 - RNA, 64 nt, hsa; identical to SEQ ID NO: 356053

SEQ ID NO: 729275 - RNA, 64 nt, hsa; identical to SEQ ID NO: 356054

SEQ ID NO: 729276 - RNA, 64 nt, hsa; identical to SEQ ID NO: 356055

SEQ ID NO: 729277 - RNA, 64 nt, hsa; identical to SEQ ID NO: 356056

SEQ ID NO: 729278 - RNA, 64 nt, hsa; identical to SEQ ID NO: 356057

SEQ ID NO: 729279 - RNA, 64 nt, hsa; identical to SEQ ID NO: 356058

SEQ ID NO: 729280 - RNA, 64 nt, hsa; identical to SEQ ID NO: 356059

SEQ ID NO: 729281 - RNA, 64 nt, hsa; identical to SEQ ID NO: 356060

SEQ ID NO: 729282 - RNA, 64 nt, hsa; identical to SEQ ID NO: 356061

SEQ ID NO: 729283 - RNA, 64 nt, hsa; identical to SEQ ID NO: 356062

SEQ ID NO: 729284 - RNA, 64 nt, hsa; identical to SEQ ID NO: 356063

SEQ ID NO: 729285 - RNA, 62 nt, hsa
aucuagaugggauucuuauaaaaauucaaccucagacauaaacaccccauuucuguaaaccc

SEQ ID NO: 729286 - RNA, 62 nt, hsa
uuuuucauuacguggguuuugaaaucuagccccagacauacuguguugagagauacuuagag

SEQ ID NO: 729287 - RNA, 62 nt, hsa
uugaacuuuguguguguguguuuagaauauaacagacauaagaaaaaauuaccuaaaugaag

SEQ ID NO: 729288 - RNA, 62 nt, hsa
ucucuugucuaguacgcacauaugcacacaggcagacauaccucccaucaugacaugguccc

SEQ ID NO: 729289 - RNA, 62 nt, hsa
uggaacuaugaacuucauccauuugcacuguucagacauauauauguauguauguaaaaauu

SEQ ID NO: 729290 - RNA, 62 nt, hsa
cuugugauauuuucuggccuggcuuucccucucagacauagcucuuuggagaacuagguguu

SEQ ID NO: 729291 - RNA, 62 nt, hsa
agcccuucauccuuccucccucagcagccaggcagacauaacaacaaaacuacuaaaaggag

SEQ ID NO: 729292 - RNA, 62 nt, hsa
agccaaagucuuucugaagaaucugugcuggacagacauaauucccuuucucauugucucca

SEQ ID NO: 729293 - RNA, 62 nt, hsa
auucccugaacugauguaaaucuucauagugucagacauacugaccaaaaccacaaucuaga

SEQ ID NO: 729294 - RNA, 62 nt, hsa
auuuaaauagguccugagacuguugauagccccagacauacccacagcauuauauguaacau

SEQ ID NO: 729295 - RNA, 62 nt, hsa
ccuggagcaggagccccgccacagccuucggacagacauaugggauauucccaagccgaccu

SEQ ID NO: 729296 - RNA, 62 nt, hsa
ucuugggugaugugagucaugugacagaaguacagacauaacuccaaugugagaaauguccu

SEQ ID NO: 729297 - RNA, 62 nt, hsa
agggacgaugugcuguauuucagugccuaucccagacauacggggugguaacugaguuugug

SEQ ID NO: 729298 - RNA, 62 nt, hsa
gaaaaggcucaccuggccacuguuuaggcacccagacauaauuuauggacgaaaugccuaaa

SEQ ID NO: 729299 - RNA, 62 nt, hsa
auguguugguuacuagaguaguagguuaacuacagacauacuguuuuguuuguacauauuua

SEQ ID NO: 729300 - RNA, 62 nt, hsa
uuugaaugaaacuauaguuccauuuggaagcccagacauaggaugggucagugggcauggcu

SEQ ID NO: 729301 - RNA, 62 nt, hsa
cccacaaccagaggaaucuauaguuuaagcuccagacauacaaacauaaggcacauuguguc

SEQ ID NO: 729302 - RNA, 62 nt, hsa
ggacuaggguacaaugaaggccaagagcaucucagacauagaguuaaaacucaaaccucuua

SEQ ID NO: 729303 - RNA, 62 nt, hsa
cucaaggccagcuuauagucauauauaucacccagacauaaaggaaaagacacauuuuuuag

SEQ ID NO: 729304 - RNA, 62 nt, hsa
caccagaggucacucuccacauccccgccucccagacauauaccaggagcaauuucaaaacc

SEQ ID NO: 729305 - RNA, 62 nt, hsa
agggacagaagaauaaguaacacucccaaacacagacauacuuuuguagaaguggaccaacu

SEQ ID NO: 729306 - RNA, 62 nt, hsa
aauugaaauuauuagaagaauucagcagguuacagacauacuuaaacugggauuaaaaccuc

SEQ ID NO: 729307 - RNA, 62 nt, hsa
aguauuguaaaauaaacaugagaacaaauaaucagacauauacuuuaauguuaaaggugcuc

SEQ ID NO: 729308 - RNA, 62 nt, hsa
cucccccaacccaacgcuuuuuuggaucagcucagacauauuucaguauaaaacaguuggaa

SEQ ID NO: 729309 - RNA, 62 nt, hsa
uucaauggagagacuuaagacacauuugaaaacagacauaucaaguucuaugugaugauuuu

SEQ ID NO: 729310 - RNA, 62 nt, hsa
guacaaauacaugaacacagccugucugugcucagacauagagaaguacuaccugacuugag

SEQ ID NO: 729311 - RNA, 62 nt, hsa
auauuugucaaccuucuccuuauaaauaaguucagacauacauuuaauaacauagggugacu

SEQ ID NO: 729312 - RNA, 62 nt, hsa
caguguuagaugugcacaaggaaaguuauuuucagacauauuugaaugacugcuguacugca

SEQ ID NO: 729313 - RNA, 62 nt, hsa
agaagacaguauggcagcuuuccucaaaacuucagacauagaauuaacacaugauccugcaa

SEQ ID NO: 729314 - RNA, 62 nt, hsa
aaaguucuugagagaaggagaggaagauacagcagacauaggacugagccaaggaagagucu

SEQ ID NO: 729315 - RNA, 62 nt, hsa
cagcucacaaggcccucuuuguuuccugcucccagacauaagcccaaggggccccugcaccc

SEQ ID NO: 729316 - RNA, 62 nt, hsa
acgucugggcagaaaaccuguuuuguuuggcucagacauauaguuuuuuuuuuuuuuacaaa

SEQ ID NO: 729317 - RNA, 62 nt, hsa
gaaaaaugacuuuucaguuaugucuuugguaucagacauacgaaaggucucuuuguaguucg

SEQ ID NO: 729318 - RNA, 62 nt, hsa
gacauaauuauuuaacccagaauacuuucuggcagacauacagaaagcucugugugaucaau

SEQ ID NO: 729319 - RNA, 62 nt, hsa
aaaauucuguauaaccagguccuaacagugaucagacauauuacagggaaauagcuuguagg

SEQ ID NO: 729320 - RNA, 62 nt, hsa
aauaaaaauauuaaauagaagguaaaacaaaucagacauacacacauuagauagauaaauuu

SEQ ID NO: 729321 - RNA, 62 nt, hsa
aggaugggaugugguggggcagggaucugguacagacauaggcgcuuccuuccaggaacagu

SEQ ID NO: 729322 - RNA, 62 nt, hsa
uuaacaacauguauuugguuucccucaacuuacagacauacagcuauuuaaaacuauggcaa

SEQ ID NO: 729323 - RNA, 62 nt, hsa
aaaauaauauauauauauauaguacaaugguccagacauaauaagagguguaaaaacuauca

SEQ ID NO: 729324 - RNA, 62 nt, hsa
uaaaacacuaagcugaauuagucauguccauucagacauaaccugaacuacugaaaagauca

SEQ ID NO: 729325 - RNA, 62 nt, hsa
acuauccauucccuauacacccuguucuuucccagacauacacuuggcacacuuuauuguua

SEQ ID NO: 729326 - RNA, 62 nt, hsa
aggggaacgauguucuuuucuuucuucaugaucagacauaaacuuagcaucuuaauggaaga

SEQ ID NO: 729327 - RNA, 62 nt, hsa
ccauaugccuuggggaggacaaaacuucuugucagacauaaagccauguuuccucuuuaugc

SEQ ID NO: 729328 - RNA, 62 nt, hsa
augauaguucugcugauguuuuguuuauugggcagacauaucuucauuaagaguuuuuggaa

SEQ ID NO: 729329 - RNA, 62 nt, hsa
accgugcauggggcagcaaacacguggggccgcagacauagccugaugguuaauaaaugugc

SEQ ID NO: 729330 - RNA, 62 nt, hsa
auauuuuaaugaacuuugauugguuacuuuuccagacauacagauuuaauuuggaauaugaa

SEQ ID NO: 729331 - RNA, 62 nt, hsa
acaaacuacuuucacauugaacagcugugagacagacauauugagaugccugcccuuguuag

SEQ ID NO: 729332 - RNA, 62 nt, hsa
aucuuagaaagaaauuguagaaaaaacccaugcagacauaacauuuauaccaaugaggcaaa

SEQ ID NO: 729333 - RNA, 62 nt, hsa
gacuccuaauuuucauugauuaaaacuccuuucagacauauaaguuuaauaaauaacuuuuu

SEQ ID NO: 729334 - RNA, 62 nt, hsa
ucuuuaugucacuaguuauaguuaaguucauucagacauaauuauauaaaaacuacguggau

SEQ ID NO: 729335 - RNA, 62 nt, hsa
guuccuuuuacccuguucuguucaucuaaaugcagacauauuuaaaucauauucaacuaguu

SEQ ID NO: 729336 - RNA, 62 nt, hsa
ggaaaacacugacugacuccuuggguuucccccagacauacuuucagagcgcuagcugugug

SEQ ID NO: 729337 - RNA, 62 nt, hsa
agaguagaauuugaucagaaucacagaaucaucagacauaggaacugagcacaggcuuuuuc

SEQ ID NO: 729338 - RNA, 62 nt, hsa
ugagaaaguucuaauucuucaugguggggugucagacauaacugaucuggagcuuuuggaca

SEQ ID NO: 729339 - RNA, 62 nt, hsa
uggcaucagucaacaguguaugucaugcaguacagacauagcaagccuuguccugacuaugu

SEQ ID NO: 729340 - RNA, 62 nt, hsa
ccugugucacucacuuagccuuggcauuugugcagacauaccauuuucaguucugcugucac

SEQ ID NO: 729341 - RNA, 62 nt, hsa
uaguugaugcuuguaagguaggggagcuuauucagacauaguagauaguuucucuaaugcug

SEQ ID NO: 729342 - RNA, 62 nt, hsa
uuuuuguacccaugcugaaacucauaacaacacagacauaaaaauagcugugagguuuugcu

SEQ ID NO: 729343 - RNA, 62 nt, hsa
uccugucuccaagaauguuuugcuagagcuaacagacauagacugcaaaagaauaauuugga

SEQ ID NO: 729344 - RNA, 62 nt, hsa
ccaauuuauaaauaaucugucugcugguacgacagacauaaaucucuacucugagaguuuuu

SEQ ID NO: 729345 - RNA, 62 nt, hsa
uauuucagaaagacuuuacccaauucaguugucagacauaaugauuuauuugaaggcuuguu

SEQ ID NO: 729346 - RNA, 62 nt, hsa
ucagcuuccuuggagaagccaccccagguuuccagacauagauguugaauuguuuguggggg

SEQ ID NO: 729347 - RNA, 62 nt, hsa
cuuuuuuuagucuuaaaauaaugacuccuauucagacauaucauuuuucuuuuuuguaaauc

SEQ ID NO: 729348 - RNA, 62 nt, hsa
ggaauucaaaauggcuggccuaccuuggcuaccagacauauugggguuuuuguaguugaaug

SEQ ID NO: 729349 - RNA, 62 nt, hsa
aucaaccauauaaaucaaguaccuauugggaacagacauaacauucaauuuuucauuuaugc

SEQ ID NO: 729350 - RNA, 62 nt, hsa
gccccacggugguccaugacugcggaacugcccagacauaagcaggagccuccgaggaaucc

SEQ ID NO: 729351 - RNA, 62 nt, hsa
ugcuuuuuucccccugaaccauuuggauguuacagacauacuuaucaccgugaaaauacuuc

SEQ ID NO: 729352 - RNA, 62 nt, hsa
aaagagaauguacuguauauguguauguuauacagacauauacacauacauacauugaccca

SEQ ID NO: 729353 - RNA, 62 nt, hsa
uucuuggguuuaaaauacauuagaacuuaaugcagacauauaaaguaacauugagaaugaca

SEQ ID NO: 729354 - RNA, 62 nt, hsa
gucaaacuuuacaucagggauccaacauaacucagacauagcccagguagccuguuucuaac

SEQ ID NO: 729355 - RNA, 62 nt, hsa
uguguauguaaauuagaaaauacauaccuauccagacauaaaugcuaaguaacauuuuuuuc

SEQ ID NO: 729356 - RNA, 62 nt, hsa
cauacuuuguuauauauguuagugguauguaucagacauauuuucaggauggugcgucagga

SEQ ID NO: 729357 - RNA, 62 nt, hsa
gucaguuugaggcaucacaaauuuaaggcacccagacauaagggucaacaggguuagcuauc

SEQ ID NO: 729358 - RNA, 62 nt, hsa
caugugugcgugugcacacacgcaaguaugcacagacauacacuaaacacgaacauacagug

SEQ ID NO: 729359 - RNA, 62 nt, hsa
augaaaaauccgcugaggagcauaccccaaaccagacauaugcuuaggauucaugcugagau

SEQ ID NO: 729360 - RNA, 62 nt, hsa
acucucgucuccuuccccucgccauagaguuccagacauauuuuccgaucaagcuuuuauuu

SEQ ID NO: 729361 - RNA, 62 nt, hsa
uuuacauauuguaauucauuuuuaagagaguacagacauacacuuuuugaguaggcaauaug

SEQ ID NO: 729362 - RNA, 62 nt, hsa
ggaccauuagcccacagaugcauguauucucucagacauaccgguguagaugcuauauuucu

SEQ ID NO: 729363 - RNA, 62 nt, hsa
ugacauuuuuaauuuacaaccuuucuggggcucagacauaaaguuaccuauccaagguugca

SEQ ID NO: 729364 - RNA, 62 nt, hsa
ucauuugguguacaucauagaguguacuuacacagacauagaugauaucguuuacuacacac

SEQ ID NO: 729365 - RNA, 62 nt, hsa
ccuggagcuaucuguggucuuagggaaggauccagacauacacggcuuugggguacaagcug

SEQ ID NO: 729366 - RNA, 62 nt, hsa
ggagacaggcauauucaugggucaucaaaauccagacauacagucaacacugagaaucagca

SEQ ID NO: 729367 - RNA, 62 nt, hsa
auguuuggaaagguucuaaggggaccuacagacagacauacauagacauuucaaaauuaaua

SEQ ID NO: 729368 - RNA, 62 nt, hsa
uguguaugguauagacuguugcuccuaggcuacagacauauacagcauguuacugaauacug

SEQ ID NO: 729369 - RNA, 62 nt, hsa
gcacccccgcuagagcugugaaaaauucucuccagacauagucagaugucuccuggggccau

SEQ ID NO: 729370 - RNA, 62 nt, hsa
aaauaaaagggccauaaugguuuguucucuuucagacauaauuuaguaggggacaagaaguc

SEQ ID NO: 729371 - RNA, 62 nt, hsa
ugucagcauuuuuguugccauuuauuuaguaccagacauagugcuggucucacagcuuaaua

SEQ ID NO: 729372 - RNA, 62 nt, hsa
uuguuagcuggaaccuauucacuuccgagauucagacauagccaugcugguggccuucugaa

SEQ ID NO: 729373 - RNA, 62 nt, hsa
ccuguaguuuccaguuaagugcagauuccuuacagacauauagaacagcgcauucuucugua

SEQ ID NO: 729374 - RNA, 62 nt, hsa
cauugcugucauucauuuugcuaagguauaagcagacauaagcauacauaauugaauauauu

SEQ ID NO: 729375 - RNA, 62 nt, hsa
gaaguuacacagcaauuuagcaauguuguuaacagacauacagaauugugugugugugugug

SEQ ID NO: 729376 - RNA, 62 nt, hsa
uuguuuuuaaacauucaaaagcaauuaaugaucagacauaggagaaacccugaauagaaaca

SEQ ID NO: 729377 - RNA, 62 nt, hsa
ucagucaggaugacaucacucccaauguuaugcagacauacagacgguuggcauacguuaua

SEQ ID NO: 729378 - RNA, 62 nt, hsa
uggaauggguccuguuauuuaugcuugcugcacagacauauuagaagaaaaaaaaaagcuuu

SEQ ID NO: 729379 - RNA, 62 nt, hsa
auggcuauacuuggaaguucuccuuguuggcacagacauagaaaugcuuuaaccccaaaccu

SEQ ID NO: 729380 - RNA, 62 nt, hsa
agucaaauuauuuuuuguauuaguuuuugaugcagacauaaaaauagcaaucauuuuaaauu

SEQ ID NO: 729381 - RNA, 62 nt, hsa
cuuuauguaacuuuuagccaguugcucugccacagacauagacaaagagagauaagauuuca

SEQ ID NO: 729382 - RNA, 62 nt, hsa
uuauuuucauucaauuuuuuuuuuuucucagacagacauaguaguaucaacuagcauuggaa

SEQ ID NO: 729383 - RNA, 62 nt, hsa
ucuuacacgaggaagugaaguaaauuuuaguucagacauaaaauuucacuuauuaggaauau

SEQ ID NO: 729384 - RNA, 62 nt, hsa
uggacacuuguugagagagcaccggaucaucucagacauaucggugcccugcaagguaagcc

SEQ ID NO: 729385 - RNA, 62 nt, hsa
ccuggacuguuucuuuaauuucaaaagcccugcagacauaguaccuggucagaacuaugccu

SEQ ID NO: 729386 - RNA, 62 nt, hsa
ggaaggagaaauuaauugagauuuucaggacacagacauaugaugugaaugccuacaaagcc

SEQ ID NO: 729387 - RNA, 62 nt, hsa
cuaaaacuggaccauaauuucaguaaaaccuucagacauagacugaagcagcucaagaccaa

SEQ ID NO: 729388 - RNA, 62 nt, hsa
uauaacccauaaucaagaacaugagcgaaaagcagacauaaaucgauauggaugguuugugg

SEQ ID NO: 729389 - RNA, 62 nt, hsa
aagaaaaauucaugauuucuuccugaagccuacagacauaaaauaacagugugaagaauuac

SEQ ID NO: 729390 - RNA, 62 nt, hsa
ccuguaaaugaucaggaaaggccuuguggcaccagacauaagacccccugaaaguaucaucc

SEQ ID NO: 729391 - RNA, 62 nt, hsa
guaaacuuccagaucuuuuuucuaugcguaaucagacauacauauauacugcaguguaucuc

SEQ ID NO: 729392 - RNA, 62 nt, hsa
uggucauggccuccacagcaggucccuguggacagacauaucugcauauuuaucaauaaagc

SEQ ID NO: 729393 - RNA, 62 nt, hsa
gaagcgaagcaagaggaaccucucgccaugaucagacauacagcugccuaccuaaugaggac

SEQ ID NO: 729394 - RNA, 62 nt, hsa
guuuaugugggcauaaaauucuaaccaaaccccagacauagggagucauuuggagaaagccu

SEQ ID NO: 729395 - RNA, 62 nt, hsa
ggggaggagguuguuguuugggcuguucucuacagacauagucagggcaaaaagcauacgca

SEQ ID NO: 729396 - RNA, 62 nt, hsa
aaaauauaauguaccuagauuguaggagaugacagacauaagguauuucaaaauaaaucuca

SEQ ID NO: 729397 - RNA, 62 nt, hsa
uugcugucugcaagggagccccuagccccuggcagacauagcugcuucagugccccuuuucu

SEQ ID NO: 729398 - RNA, 62 nt, hsa
auuuaaauuacacacugagagcauguccuaugcagacauagauuuuucuguucauuuauuuu

SEQ ID NO: 729399 - RNA, 62 nt, hsa
gaggcagggcaaaugacaugcacugacccuuccagacauacgaaacacaaaccacaacugac

SEQ ID NO: 729400 - RNA, 62 nt, hsa
ugaccuguaaaaaguacucaagggcuuuauuacagacauacccucccuuugaaaagggacau

SEQ ID NO: 729401 - RNA, 62 nt, hsa
aagcaaguuuuaccucucuguacauguuuuugcagacauacuugaaaagcucacuuaaaucu

SEQ ID NO: 729402 - RNA, 62 nt, hsa
ucggaucuacuguagagcaccccugcuugguacagacauacucaggggcuaccgugucuuca

SEQ ID NO: 729403 - RNA, 62 nt, hsa
ggaagaaaggccaaccugauccugaggggacccagacauauccuuugcacugucccuagagg

SEQ ID NO: 729404 - RNA, 62 nt, hsa
cauaacuccauaaguaagaaauuucuaguucacagacauacaauagcauugauucaccuugu

SEQ ID NO: 729405 - RNA, 62 nt, hsa
ugugugugugcguguguguaaauguguacacacagacauaaaguacuugcccuaguuugugg

SEQ ID NO: 729406 - RNA, 62 nt, hsa
acucacugggagugaaaaugacuucuucacaacagacauauuucugcuucuguguuuuugug

SEQ ID NO: 729407 - RNA, 62 nt, hsa
gccccugcucuucccgagagcugcccccaaaucagacauaccucuguggcucuccucugguu

SEQ ID NO: 729408 - RNA, 62 nt, hsa
aaaauuaauaaugauugugagaauuauaaauacagacauaaaaagaggaguacaacauacug

SEQ ID NO: 729409 - RNA, 62 nt, hsa
uucaucuccacugauaaccgguuuccuugaugcagacauaguuuagcuuucuuugacugcag

SEQ ID NO: 729410 - RNA, 62 nt, hsa
gcugucuuagugcaaaaaacauacuuacauuucagacauauccaaagggaauacucacauuu

SEQ ID NO: 729411 - RNA, 62 nt, hsa
aucucucaagccaaaggagaagacaguaagaacagacauaagggacauuuuaguuugggcua

SEQ ID NO: 729412 - RNA, 62 nt, hsa
gucaugugcaagacaaugcuaagaacagaauacagacauaaauaagucacggcccaugaccu

SEQ ID NO: 729413 - RNA, 62 nt, hsa
cuugagcucucccaauuauuguaauauaaggacagacauaauaguauucuguacccauagua

SEQ ID NO: 729414 - RNA, 62 nt, hsa
ugguauguaaacuuguaaaaauagagauuugacagacauagcaaucuagucaauguguaagg

SEQ ID NO: 729415 - RNA, 62 nt, hsa
aguaugauucucaccauuauuugucauggaggcagacauacaccagaaaugggggagaaaca

SEQ ID NO: 729416 - RNA, 62 nt, hsa
ucuugauaacauuaacauuaauuuuauuuuuucagacauacuguaauuuaaaaauuaaugug

SEQ ID NO: 729417 - RNA, 62 nt, hsa
ccauucacuuagccuaucagaaaagucauuggcagacauauauguccuugaaccuuuuuuau

SEQ ID NO: 729418 - RNA, 62 nt, hsa
guaaaccagaaaacaauuguggggaucaaggacagacauagcacuuagacaggacuuucaug

SEQ ID NO: 729419 - RNA, 62 nt, hsa
aaccaggauuaaaauucauauauacugcagggcagacauacauaugauagcuugugcugauu

SEQ ID NO: 729420 - RNA, 62 nt, hsa
agaaaagagagcucaggcccaaguggaguuugcagacauaggcuguggcuaugguggccugu

SEQ ID NO: 729421 - RNA, 62 nt, hsa
uugagugugaguuuggaggccuuuuuaacaugcagacauacccauauuuaaaugaaaugggg

SEQ ID NO: 729422 - RNA, 62 nt, hsa
gagggaaguccuagggugguuucaguuucucccagacauaccuaaauuuuuacaucaauccu

SEQ ID NO: 729423 - RNA, 62 nt, hsa
cuauacaucauuuuugcccucugccuguuuuccagacauacagguucuguggaauaagauac

SEQ ID NO: 729424 - RNA, 62 nt, hsa
uaaaaugaucauuaggacauaacagacuaggccagacauagcaucuuguggcuuugcaacca

SEQ ID NO: 729425 - RNA, 62 nt, hsa
ucuuauuguaauagaugagcauauuuuuuuaccagacauaaaugggguaauaaucuaugccu

SEQ ID NO: 729426 - RNA, 62 nt, hsa
uugcuguugacauauuuaauguuuuaaauguacagacauauuuaacuggugcacuuuguaaa

SEQ ID NO: 729427 - RNA, 62 nt, hsa
caacucugguuuauuaucuuaaucuucaacuucagacauauauuuguguguuuauaugcuca

SEQ ID NO: 729428 - RNA, 62 nt, hsa
ucacggcacucccaaaagcacacaagcacauacagacauaugcauccccacacacgccuaug

SEQ ID NO: 729429 - RNA, 62 nt, hsa
aggaaaggguaggaagggugggaagggagaagcagacauagucauuuaugauuugaaaguug

SEQ ID NO: 729430 - RNA, 62 nt, hsa
agaaugggaugcauguauaucagcaaaguauucagacauaguauuacaagcuauuggaacuc

SEQ ID NO: 729431 - RNA, 62 nt, hsa
aaguaguuuuuuuuucaauuacauguugcuuccagacauacuucucugcaacuuguugagca

SEQ ID NO: 729432 - RNA, 62 nt, hsa
agguuccugaauaauuccugcagggcuggugacagacauaacagcucugguuuuauaauauc

SEQ ID NO: 729433 - RNA, 62 nt, hsa
guauuuauguauuaaccugaccauacuggaaucagacauaaauacuuauuuaugccuaaaaa

SEQ ID NO: 729434 - RNA, 62 nt, hsa
cuuuaaaacacgcacacaaacacacaaauaaacagacauaagaugucaucacgaaacugccc

SEQ ID NO: 729435 - RNA, 62 nt, hsa
gaacucugguugggguacuacgaucacagacacagacauacuuuuccuaaaguugaagcauu

SEQ ID NO: 729436 - RNA, 62 nt, hsa
cucuucagaucucuaacuucaccauauuaccacagacauacuaaccagcagaaaugccuuac

SEQ ID NO: 729437 - RNA, 62 nt, hsa
agugaaauaaauaaaguccugaccccagugcacagacauagaggcacagauugcagucagac

SEQ ID NO: 729438 - RNA, 62 nt, hsa
ugcugugccugauguugggagagcccugcucccagacauaaauagagcaaccaguacuaacc

SEQ ID NO: 729439 - RNA, 62 nt, hsa
gcggugcacuuucgcucuugggggcugcaccccagacauagcuggcaccagagcagggugcu

SEQ ID NO: 729440 - RNA, 62 nt, hsa
uacuaaugauacuuacaaguuucuagcucucacagacauauagaauaaggguuuuugcauaa

SEQ ID NO: 729441 - RNA, 62 nt, hsa
ccaucuuguauacacauauauacccacauguacagacauacauuuaugcacauucacgcugu

SEQ ID NO: 729442 - RNA, 62 nt, hsa
aaauacaaggagggggcuauuaacacccaguacagacauauccacaaggucguaaaugcaug

SEQ ID NO: 729443 - RNA, 62 nt, hsa
cucuccgaauccuccugaaggcauuuccucuacagacauaguguuacaggaagugaaaugca

SEQ ID NO: 729444 - RNA, 62 nt, hsa
ugcugacagcauggucuucccucccugcauuucagacauaccaguuacugaaagcaaaucag

SEQ ID NO: 729445 - RNA, 62 nt, hsa
aacagggacugcauuugcuccucucugcccgucagacauaagcucucacagcgcuaaggaag

SEQ ID NO: 729446 - RNA, 62 nt, hsa
aagugggacagcuaaugaagcucuaauuauugcagacauauuuuugagauguaaaaaaaaaa

SEQ ID NO: 729447 - RNA, 62 nt, hsa
accucagcgggcaggaggucccaccauguggacagacauagcccaaggaggcaccacagguc

SEQ ID NO: 729448 - RNA, 62 nt, hsa
gacaucuggcuugccacaaaggucuguucgaccagacauauccuagcuaagggauguccaaa

SEQ ID NO: 729449 - RNA, 62 nt, hsa
ggcuccucucaagggcauucugggcuuguaaacagacauaggaagccucuguuuacccugaa

SEQ ID NO: 729450 - RNA, 62 nt, hsa
agaaaccauaaaauuguuuuuauuuuucaggccagacauagcuuccuaaugaaagaaaaugg

SEQ ID NO: 729451 - RNA, 62 nt, hsa
uguuugugaagaggcaggacuggccagagugacagacauacggugauccaggaggcucaaag

SEQ ID NO: 729452 - RNA, 62 nt, hsa
uaugucuauauauauauauagacacacacacacagacauauauuuccuucuuuaagguaauc

SEQ ID NO: 729453 - RNA, 62 nt, hsa
ccuccuuugggcccagcggccggcgaggccgccagacauacacacguuaccagacgcuggag

SEQ ID NO: 729454 - RNA, 62 nt, hsa
uaguuauugaugugcaucuguuaaacugaugacagacauaacucaucauuccccagaaaccu

SEQ ID NO: 729455 - RNA, 62 nt, hsa
auuucuaaaaucccaaguguaggaaaaauaugcagacauacagauauauaggccaacuauua

SEQ ID NO: 729456 - RNA, 62 nt, hsa
aguagauaaaaacaaauuuuaaguuuaguuuucagacauagaauuucacuuuuggaggggac

SEQ ID NO: 729457 - RNA, 62 nt, hsa
gugaauagaacaaauucugacuugcagaaaugcagacauacagucaggaaagaacaaacuuc

SEQ ID NO: 729458 - RNA, 62 nt, hsa
ccuaggagccuucagucugggagaaacagagccagacauagacaguuccagcaucacagaac

SEQ ID NO: 729459 - RNA, 62 nt, hsa
ggcaaagccuucaacaaguccucaauucuuaccagacauaagauaauucuggcugggugcgg

SEQ ID NO: 729460 - RNA, 62 nt, hsa
ggcaaagccuuuaagaagcccucaauucuuaacagacauaagauaauuuauacuggagagaa

SEQ ID NO: 729461 - RNA, 62 nt, hsa
agcaaaguguucacuaagaguguuuaucuugccagacauaagaagaugaaugguagagcaac

SEQ ID NO: 729462 - RNA, 62 nt, hsa
gacucuuccucagcagccuggcaggcaggaaacagacauaggaccccagcccagaucugaau

SEQ ID NO: 729463 - RNA, 62 nt, hsa
aauagauuaccagaaaaaugaaaagaaaaaaacagacauacaaaauaaaagccccaguuuuu

SEQ ID NO: 729464 - RNA, 62 nt, hsa
ggccacaaagcaacugcuggguuagcuuuccacagacauaaauauaguccaucugcaaucac

SEQ ID NO: 729465 - RNA, 62 nt, hsa
ucuguaucuauguauguauauauaugcauaugcagacauauguauauggucuggucagcaua

SEQ ID NO: 729466 - RNA, 62 nt, hsa
acggagaaacacaaacaccacccaggaacacgcagacauaugcccauagcaucccacaggcc

SEQ ID NO: 729467 - RNA, 62 nt, hsa
ucuaacaaagaacagccuguaaaaucgagcugcagacauagacaagcaagcuggaagcuucc

SEQ ID NO: 729468 - RNA, 62 nt, hsa
ggcaaagccuuuaauaaauucucaauuccuaacagacauaagauaauucauacuagagagaa

SEQ ID NO: 729469 - RNA, 62 nt, hsa
uuacggacugagaagugucccugcaaaauucacagacauaaauaaauaaauacguauuuuca

SEQ ID NO: 729470 - RNA, 62 nt, hsa
ucccagcagguaugggcaguugcuugaggcuccagacauacucaccucuaccucgaccacau

SEQ ID NO: 729471 - RNA, 62 nt, hsa
ugccgcgcacucacggagcugcguagucuccucagacauagucaaagcuuugccgagaaaag

SEQ ID NO: 729472 - RNA, 62 nt, hsa
cuaaacucagaggcagugacagcagucagggacagacauacauuucucauaccuuccccaca

SEQ ID NO: 729473 - RNA, 62 nt, hsa
agagguuauauaaaaauacugcaaauagaccgcagacauaaauaucuaccaaaugcuaucuu

SEQ ID NO: 729474 - RNA, 62 nt, hsa
gagcgagccccucggcucuggaggcaaucaagcagacauagaagagccaagaguccaggagg

SEQ ID NO: 729475 - RNA, 62 nt, hsa
uuccuuagcgucuuguuugaccugcuugcuuccagacauaaccugcaugaaucaguuuuggg

SEQ ID NO: 729476 - RNA, 62 nt, hsa
cguuuugggaaaccaaggucaggaggccguugcagacauaaaucucggcgacucggccccgu

SEQ ID NO: 729477 - RNA, 62 nt, hsa
aucugagacagagucaucauuuucauuaucagcagacauaagcaaggcagaugugucuuccu

SEQ ID NO: 729478 - RNA, 62 nt, hsa
agagaugggugugcaagauaaaauuaaaaagccagacauacuuucuaucaagcuguauccuu

SEQ ID NO: 729479 - RNA, 62 nt, hsa
gcaggguugggcugaaucaaaugggagcccuccagacauaaggaggccagaggcugcaagga

SEQ ID NO: 729480 - RNA, 62 nt, hsa
ggguucaggccuggcguagcacccacaaguggcagacauaucacaagaguccccagacucug

SEQ ID NO: 729481 - RNA, 62 nt, hsa
uauauauauauguguauacacacacacauagacagacauauauauauauauuuauuuuuuuu

SEQ ID NO: 729482 - RNA, 62 nt, hsa
uuggggacccaguauguccucuccucuagacccagacauacaguuauaaccgucuguccuag

SEQ ID NO: 729483 - RNA, 62 nt, hsa
ugggggcuuggagcagaagacacccuuguagacagacauaagaggggcagaaggcuugacca

SEQ ID NO: 729484 - RNA, 62 nt, hsa
cagauacacacacuuguguauauauguacauacagacauacugaagggauuaguacaauuuc

SEQ ID NO: 729485 - RNA, 62 nt, hsa
ccucaccuucccugccuuggugcugccagcagcagacauagacgggugcagaagcggggagc

SEQ ID NO: 729486 - RNA, 62 nt, hsa
cucugauuuccggggcagccuuucagaugcggcagacauacaacaccuguacuuuagaguuu

SEQ ID NO: 729487 - RNA, 62 nt, hsa
uuaaaacaauuuuaaaaucuuaaaauggccaucagacauagagagcuuugugugauucaugu

SEQ ID NO: 729488 - RNA, 62 nt, hsa
uaagucuuagugaccaaacgugaccuugaaagcagacauagcaugacagaccuuccuagagu

SEQ ID NO: 729489 - RNA, 62 nt, hsa
aucuugaagucauuaugcuaagugaaauaaaccagacauaaaaggacaaauacuaugauucc

SEQ ID NO: 729490 - RNA, 62 nt, hsa
auuuguuucauuucaaauaggauuugaaaccucagacauacagaaaugcuuaugauauuccc

SEQ ID NO: 729491 - RNA, 62 nt, hsa
uaucauuguaacuaaaaaagcugacauugacccagacauauuguacucuuucuaaaaauaau

SEQ ID NO: 729492 - RNA, 62 nt, hsa
cggggacauucuacugugcuaaaaagccacugcagacauagcaauaaaaacaugucauuuuc

SEQ ID NO: 729493 - RNA, 62 nt, hsa
cacaggaacagagaaaugguugaugucagacccagacauagaauguuggagcaaaagcuccc

SEQ ID NO: 729494 - RNA, 62 nt, hsa
cguagauacagagaaguggucgauuccagacccagacauagaauguuugaacaaagacuccc

SEQ ID NO: 729495 - RNA, 62 nt, hsa
ccauacacaccuaaaagaugagagaauucauccagacauauuacagccaguuuggggccccu

SEQ ID NO: 729496 - RNA, 62 nt, hsa
auauugacauugaauggaucaauacacacacacagacauauauauauauaugcacacauaua

SEQ ID NO: 729497 - RNA, 62 nt, hsa
ucaucuaaauuuuucagguaucaagugcucaacagacauaugauagucaaggcucuuagucu

SEQ ID NO: 729498 - RNA, 62 nt, hsa
uucauaucauaaauuuuucuggaaagcuauuucagacauagauuucauaguauuuuucugag

SEQ ID NO: 729499 - RNA, 65 nt, hsa
cugccucagccucuggaguagcugagacuacaggcgcccaccaccaugcccggcuaauuuuguuu

SEQ ID NO: 729500 - RNA, 65 nt, hsa
ucuugcccugugguuugacucuccuuagaaccaccgcccaccagaaacauaaaggauuaaaauca

SEQ ID NO: 729501 - RNA, 65 nt, hsa
gccccuccccucucacacugaccuccccccuuacggcccaccaggguauguaaauaucucuuuuc

SEQ ID NO: 729502 - RNA, 65 nt, hsa
gacagagcugcugccuucccggccucacgcacccugcccaccagccccucggaagcaugugacaa

SEQ ID NO: 729503 - RNA, 65 nt, hsa
gcaaguuguucuugaacaccugaggccuuccuggugcccaccaggcacuacggcuuccucuccag

SEQ ID NO: 729504 - RNA, 65 nt, hsa
ccugaccccacuggaccaaaaggggcagcacuggugcccaccauacacacaggugucucauguga

SEQ ID NO: 729505 - RNA, 65 nt, hsa
accggcugccucugagauagcccuggguacccugagcccaccagggacaccucgcccuucagccc

SEQ ID NO: 729506 - RNA, 65 nt, hsa
guacccugagcccaccagggacaccucgcccuucagcccaccacccuggcaggcuuccauccccg

SEQ ID NO: 729507 - RNA, 65 nt, hsa
cuccccgugggaagccuccgcccugagguccgcuggcccaccaccccugggugcucaguuucuac

SEQ ID NO: 729508 - RNA, 65 nt, hsa
uccuugaugagcaugccagcuaugugguagggccagcccaccaugggggccaagaccugcacagg

SEQ ID NO: 729509 - RNA, 65 nt, hsa
gaauuauggcuguaaauaacacuauaguuuaauaagcccaccauucugaguuuauuaaacauuuu

SEQ ID NO: 729510 - RNA, 65 nt, hsa
uguauauuacccuggggcagugaagcccuaggugugcccaccaguaugaguugccauuaagaccu

SEQ ID NO: 729511 - RNA, 65 nt, hsa
gagcccagggccucaaugagccugguccaugaagugcccaccacaucgcagcacuuuuaccacgu

SEQ ID NO: 729512 - RNA, 65 nt, hsa
cccacccccacuggcuuuggugcuguccacacagugcccaccagaaggcagagggaacuccaggg

SEQ ID NO: 729513 - RNA, 65 nt, hsa
acucuggaguuucuuaugugcccugguggacacuugcccaccauccugugaguaaaagugaaaua

SEQ ID NO: 729514 - RNA, 65 nt, hsa
agaggccuucaaguccuuuccaccucucacccauugcccaccauuaauaagcuuagcuucucuug

SEQ ID NO: 729515 - RNA, 65 nt, hsa
caagaccuggcacuccuccaagcuuggcacagugagcccaccagcucagaugguugaucuuacca

SEQ ID NO: 729516 - RNA, 65 nt, hsa
uuagcaaagagaccagcugacugucucucggcccagcccaccacgccgaguagcuuguguggaug

SEQ ID NO: 729517 - RNA, 65 nt, hsa
gaagccuuguugaagcugugagcaggagaagcggugcccaccagcuuccaggucucccugaccug

SEQ ID NO: 729518 - RNA, 65 nt, hsa
ucugcaggaaucccggcuccagagcaggaaauucagcccaccagccaccucauccccaacccccu

SEQ ID NO: 729519 - RNA, 55 nt, hsa
ccacccuggccaagaucugaccugggcccaccaagguggacgcugggccccgcca

SEQ ID NO: 729520 - RNA, 65 nt, hsa
gagaccucucucagcaccacugccucaucugccacgcccaccagugagcugcugccccugggucc

SEQ ID NO: 729521 - RNA, 65 nt, hsa
ccuccagccccgggccggaccuccugcuggcucucgcccaccaaccaaguguuacaagccccaga

SEQ ID NO: 729522 - RNA, 65 nt, hsa
uccgucugcucaccugccacagagcccacacccaugcccaccaguguuggucuuugccucaaagc

SEQ ID NO: 729523 - RNA, 65 nt, hsa
ccuccccuaccucaaaccccagcugggcccgcuuagcccaccaggcaugaggccaagggcuccac

SEQ ID NO: 729524 - RNA, 65 nt, hsa
gggaagccccuccugccagucccuguccccuuucagcccaccagucccucucugcugccggugau

SEQ ID NO: 729525 - RNA, 65 nt, hsa
uggcagcuauuuccugagccuaguaccccaauuaagcccaccauugguuagcacacucagcgcug

SEQ ID NO: 729526 - RNA, 65 nt, hsa
uagagaagugagaguauuuauuuuuggcauguuuggcccaccacacagacucuguguguguaugu

SEQ ID NO: 729527 - RNA, 65 nt, hsa
uucacguguaagaugagaauggcugauggcugagagcccaccaaccuuccccaccccguaucagu

SEQ ID NO: 729528 - RNA, 65 nt, hsa
gguuacugccuucucccuugaaauccuugcugcgugcccaccaggauuuccugugagggcccagg

SEQ ID NO: 729529 - RNA, 65 nt, hsa
caggcagucuggccugugccagcacggucuccugugcccaccagccccacaggugcugugcuuug

SEQ ID NO: 729530 - RNA, 65 nt, hsa
gagagugaguggccacagguagaaccgcggccgaagcccaccacuggccaugcucaccgcccugc

SEQ ID NO: 729531 - RNA, 65 nt, hsa
ucagacucuccugguuguguaacugaagauguucugcccaccagcaccagaggucacucuccaca

SEQ ID NO: 729532 - RNA, 65 nt, hsa
ugccccaacugcaggaaugcugacaaugcugccaugcccaccaucggguguaggugaaaggcauc

SEQ ID NO: 729533 - RNA, 65 nt, hsa
uuaagaaguaauuuuccaaccuuuggaagucaugagcccaccauuguucauuugugcaccaauua

SEQ ID NO: 729534 - RNA, 65 nt, hsa
cacauacuccagauugaccuuauaaauaaaagaaugcccaccagauugaaauccuagaaauacag

SEQ ID NO: 729535 - RNA, 65 nt, hsa
cugccucagccucccgaguagcugggacuacaggcgcccaccaccacgcccggcuaauuuuuugu

SEQ ID NO: 729536 - RNA, 65 nt, hsa
cagccucagccucccgaguagcugggauuaugggcgcccaccaccaugcccagcuaauuuuugua

SEQ ID NO: 729537 - RNA, 65 nt, hsa
gccaguggggggcaggggugcgccuccucugcccugcccaccagccugugauuugauggggucuu

SEQ ID NO: 729538 - RNA, 65 nt, hsa
gcccaaccccgcagccugggcuucgaaggcgacccgcccaccauccugcccuucccagaaccuga

SEQ ID NO: 729539 - RNA, 65 nt, hsa
ccauaaguaguuuugagaggguggauggguuacuugcccaccagaaacagcccuagucccaacuc

SEQ ID NO: 729540 - RNA, 65 nt, hsa
aaaaucaaaacuucuuuaagcugguaaagugaggggcccaccagcagugaucuccugaugccuua

SEQ ID NO: 729541 - RNA, 65 nt, hsa
cauggcuucauuuagagaccacaguaacaacagcagcccaccaaucagagaagcugguuguuauu

SEQ ID NO: 729542 - RNA, 65 nt, hsa
accuccccagcaagcaaccugaaaucucagcagaugcccaccauuucucuagaucgccuagucuc

SEQ ID NO: 729543 - RNA, 65 nt, hsa
ccggcugcuagcccacggugaagcccggcgggguugcccaccaguugcgaaagcccccuuuccuc

SEQ ID NO: 729544 - RNA, 65 nt, hsa
uuucuugagcaccuucugugcccagcauaugcuaggcccaccagcuaaguguguguggggggucu

SEQ ID NO: 729545 - RNA, 65 nt, hsa
uugggggagggcccgaaauaucuauguuuuaccaagcccaccacaugauucugauguacucuaaa

SEQ ID NO: 729546 - RNA, 65 nt, hsa
cugggggugucccagggacucugucagugccuucagcccaccagcaggagcuuggaguuugggga

SEQ ID NO: 729547 - RNA, 65 nt, hsa
agccucggccaggccugcucugcucagcgcccaccgcccaccaccccuccugcuuccccgagccu

SEQ ID NO: 729548 - RNA, 65 nt, hsa
ccuccccgccuccucccacugggacucccagcagagcccaccagccagcccuggcccacccccca

SEQ ID NO: 729549 - RNA, 65 nt, hsa
gggaaagugggagguggugcuggugcucucuccaggcccaccaugcugggagaggcggccagagc

SEQ ID NO: 729550 - RNA, 65 nt, hsa
aacaagaccucuuuucuuuagauggugccaccuaugcccaccacaacagagauuuuacauggaaa

SEQ ID NO: 729551 - RNA, 65 nt, hsa
acaggaaacuuauucuauuccuguuuucucuuucugcccaccacauccaaucucucaaaacgguc

SEQ ID NO: 729552 - RNA, 65 nt, hsa
ugggcauggccguugccucucugccagccgcuggugcccaccagcuggcucugcagcacauugcc

SEQ ID NO: 729553 - RNA, 65 nt, hsa
gcucccaggcccagcaccgagcagaacagaccagagcccaccacaccacaaagagcagcaccuga

SEQ ID NO: 729554 - RNA, 65 nt, hsa
guaaauaucuacucacucauacagccagcccaccagcccaccauuaacucacugaacaaugagac

SEQ ID NO: 729555 - RNA, 65 nt, hsa
caggcagaguaaauaucuacucacucauacagccagcccaccagcccaccauuaacucacugaac

SEQ ID NO: 729556 - RNA, 65 nt, hsa
aguucccugggaggcugacagggucaagccacccugcccaccacccucccacuuccccuccccuu

SEQ ID NO: 729557 - RNA, 65 nt, hsa
cugccucagccucccgaguagccgggacuacaggcgcccaccaccgugcccggcuaauuuaguug

SEQ ID NO: 729558 - RNA, 65 nt, hsa
agcuggcuaguguaacacugacuaugaguaggugggcccaccacuugaguugaggugauuucaug

SEQ ID NO: 729559 - RNA, 65 nt, hsa
cuccugccaagccaaaugugcuuccugcagcucacgcccaccagcuacugaagggacccaaggca

SEQ ID NO: 729560 - RNA, 65 nt, hsa
uauuauuacaguuccacaucaaggccgagugcaccgcccaccacugccacggccuuugaccaucu

SEQ ID NO: 729561 - RNA, 65 nt, hsa
guguugcaguaccccccauucacccacaaaaugcagcccaccacccagucccccaauuccagaga

SEQ ID NO: 729562 - RNA, 65 nt, hsa
ccuuaaggacuuagcuggccacagugagcugaugugcccaccaccgugucaugagagaauggguu

SEQ ID NO: 729563 - RNA, 65 nt, hsa
ggauguuuggaacccuuuagcuuuguuuuggaauggcccaccauucucacuggaaaacagugguc

SEQ ID NO: 729564 - RNA, 65 nt, hsa
ccccuccccaccucacuuggggcccccagcagguugcccaccaagcugaaaggcagugauuuaga

SEQ ID NO: 729565 - RNA, 65 nt, hsa
caggcagucagagcuggaaguguauggagagcccagcccaccagguccugccuuuugcggugaua

SEQ ID NO: 729566 - RNA, 65 nt, hsa
cugccucagccucccgaguagcugggaccacaggggcccaccaccgcgcccggcuaauuuuuugu

SEQ ID NO: 729567 - RNA, 65 nt, hsa
cuagccaggcauuccaaacaauuucuuauacugcugcccaccaaagcagcuugccaacagucaaa

SEQ ID NO: 729568 - RNA, 65 nt, hsa
cuaccucagccucccgaguagcugggacuacaggcgcccaccaccaugcccggcuaauuuuuguu

SEQ ID NO: 729569 - RNA, 65 nt, hsa
auccccucccccuggggugugcugugucccaccuggcccaccagaggcucacgacgauggcaccu

SEQ ID NO: 729570 - RNA, 61 nt, hsa
cagggacagaaaggggauaguggaguuaugggcccaccaggcaagccugggccuucugguc

SEQ ID NO: 729571 - RNA, 65 nt, hsa
aggauggagcaccucugggacaacuaagagccaaggcccaccaaggaguuuuccacccgucucuc

SEQ ID NO: 729572 - RNA, 65 nt, hsa
cacuggcccucccacuucccucuuugacuuacaaagcccaccaggaagauccaggauaaucucuc

SEQ ID NO: 729573 - RNA, 65 nt, hsa
ugcuccuuagccuggaagaugcagggaaccuccacgcccaccaccaugagcuggaguggggauga

SEQ ID NO: 729574 - RNA, 65 nt, hsa
ccaacuaugauuauuaacgauguccaacccgucuggcccaccaggguccuuuugacacugcucua

SEQ ID NO: 729575 - RNA, 65 nt, hsa
uccugccccuuucaggccuacagccacauccccaagcccaccaggugucaggauagucacaguga

SEQ ID NO: 729576 - RNA, 61 nt, hsa
aaacagauccuaagccauagacaggcuaauugcccaccacucccaggaauauugaaauagc

SEQ ID NO: 729577 - RNA, 65 nt, hsa
aggggaggaccugcccagguaugccuuccagugaugcccaccagagaauacauucucuauuaguu

SEQ ID NO: 729578 - RNA, 65 nt, hsa
ggacugucauguuauccagaagggcugguacauccgcccaccaugucccccugcugggucaggag

SEQ ID NO: 729579 - RNA, 65 nt, hsa
ggccuuuccuaugggcaaggcccagugcucuuccugcccaccagggaccauggagcaguggcacc

SEQ ID NO: 729580 - RNA, 65 nt, hsa
caagucccagccacccaagcauacuuaccaguacugcccaccaccacccacugcccaccucuaag

SEQ ID NO: 729581 - RNA, 65 nt, hsa
auauaaaaaauaauuuccauguaaguuaccagaaagcccaccagcaacauaauuuuaaagccuuu

SEQ ID NO: 729582 - RNA, 65 nt, hsa
gugccucagccuccugaguagcugggacuacaggcgcccaccaccacacauggcuaauuuuugua

SEQ ID NO: 729583 - RNA, 65 nt, hsa
ugccuguggagcagugcccaucccagcccguuucugcccaccaguuguucucaggaaccuuaccc

SEQ ID NO: 729584 - RNA, 65 nt, hsa
uauacaaagccuuggucccgugaaaacacucgugugcccaccagcggccuugaagaggcaggucu

SEQ ID NO: 729585 - RNA, 65 nt, hsa
gagcaucacaggauguuccagugucccuggucucugcccaccagaugccagcacucccaccauuc

SEQ ID NO: 729586 - RNA, 65 nt, hsa
ugguccucuaggcaggcagggugcuccuggugucugcccaccacuguccccuugcugauggcaug

SEQ ID NO: 729587 - RNA, 65 nt, hsa
uguggcuggccaugggcacugggcucgccuugcacgcccaccaggagggccaggggcauacgcag

SEQ ID NO: 729588 - RNA, 65 nt, hsa
uaugugcacaaccaccaugugucuucuaggugcuggcccaccaccacacaucacaggcugauuuc

SEQ ID NO: 729589 - RNA, 65 nt, hsa
ggagcauuuguaagcacauggugaaaucagccccugcccaccaaaauaaucuuuauguuaccaag

SEQ ID NO: 729590 - RNA, 65 nt, hsa
uugccucagccucaugaauagcugggauuacaggugcccaccaccaugccuggcuaguuuuugua

SEQ ID NO: 729591 - RNA, 65 nt, hsa
gcuaauugucaacuuuauuaaggauuacuuugucugcccaccaccuaguguaaaauaaaaucaag

SEQ ID NO: 729592 - RNA, 65 nt, hsa
cugccucagccucaugaauagcugggauuacaggugcccaccaccaugccuggcugguuuuugua

SEQ ID NO: 729593 - RNA, 65 nt, hsa
uucuggcuaucgucccccuucucacugaccugaccgcccaccaccuccuucccccucaucacaug

SEQ ID NO: 729594 - RNA, 65 nt, hsa
uuaauauauucuuguuggcuaacuaaauuguguaugcccaccacaaagaagguacuauuuuuugu

SEQ ID NO: 729595 - RNA, 65 nt, hsa
cugcaucagccucccgaguagcuggcauuacaggcgcccaccaccacgcucggcuaaauuuuuuu

SEQ ID NO: 729596 - RNA, 65 nt, hsa
ggugcuaggcugggagcugcccugagagcugggaugcccaccaaggcccacagaacugucuccag

SEQ ID NO: 729597 - RNA, 65 nt, hsa
aguagggugugacuugaaaguaucgugaccauguggcccaccagcagccuuuccaaaggggaacu

SEQ ID NO: 729598 - RNA, 50 nt, hsa
cugucaccucccuggugugagcccaccagcgcgcaccgucgccacggauc

SEQ ID NO: 729599 - RNA, 65 nt, hsa
aaauggaaugaugacuuugaaaaccacuggcuuacgcccaccauuuccgagguccuguccacggc

SEQ ID NO: 729600 - RNA, 65 nt, hsa
gagccuuaagcucccaaguagcugggauuacgggcgcccaccaccacgcccagcuaauuuuuuuu

SEQ ID NO: 729601 - RNA, 65 nt, hsa
gugccucagccucccaaguagcugggguuacaggcgcccaccaccacacucggcuaauuuugugu

SEQ ID NO: 729602 - RNA, 65 nt, hsa
gccuuugcauuuauuuauacagugccuugcucggcgcccaccacccccucaagccccagcagccc

SEQ ID NO: 729603 - RNA, 65 nt, hsa
gagguugggcuggcuggacugagcccaggccuguugcccaccaagucuccauagguucuagucug

SEQ ID NO: 729604 - RNA, 65 nt, hsa
gagggcagggggccuacggugcuauugcuuuaggggcccaccacgggcaggggccugcucccagc

SEQ ID NO: 729605 - RNA, 65 nt, hsa
agggacaaagagggcaaaugagaucaccuccugcagcccaccacuccagcaccugugccgagguc

SEQ ID NO: 729606 - RNA, 65 nt, hsa
aacacguuuacaggaaaguguucuccuggguuugugcccaccauggugcgaauccugacccaagg

SEQ ID NO: 729607 - RNA, 65 nt, hsa
ugucuugggcuguaggcuagaaugcccgggcuggugcccaccaggggcuggggagaaggaggggu

SEQ ID NO: 729608 - RNA, 64 nt, hsa
ucucuuuccucgccacauagggugcagggccugggcccaccacgacgccugaagucacagcucc

SEQ ID NO: 729609 - RNA, 65 nt, hsa
ggguggcuucuuugaggagaagggcgccaucuucugcccaccaugcuaugacgugcgcuaugcac

SEQ ID NO: 729610 - RNA, 65 nt, hsa
aggggucagcaaacuacugccugugggccaaauuugcccaccaccuguaucuguaaauaagguuu

SEQ ID NO: 729611 - RNA, 65 nt, hsa
gacuccucuuugugcagagaccagcccaccccugugcccaccaugacccucuuccucaugcugaa

SEQ ID NO: 729612 - RNA, 65 nt, hsa
uugcuccgcucccaccgcccccaccccuuccccaggcccaccaucaccaccgccucuggccgcca

SEQ ID NO: 729613 - RNA, 65 nt, hsa
ccagccacaggcuucuuguccaccucuucuccccugcccaccagcugcucagcgcauaagaccuu

SEQ ID NO: 729614 - RNA, 65 nt, hsa
uaccaaaacacagacaaaccaaagguaaccagcuagcccaccacugaaaggaaagaucugagaca

SEQ ID NO: 729615 - RNA, 65 nt, hsa
cgaggacuccacuucuggggacgccugguucguucgcccaccaggccuaggcuacgcuccaugcu

SEQ ID NO: 729616 - RNA, 65 nt, hsa
cugccucagccugcugaguaguugggauuacaggcgcccaccaccaugcccagcuaauuuuugug

SEQ ID NO: 729617 - RNA, 65 nt, hsa
gaagacagggaaaggaaggcagcaggaggccacaagcccaccaggucuucaugucaagagaggga

SEQ ID NO: 729618 - RNA, 65 nt, hsa
cacacuuacugcuacucuguacccccagcccuacugcccaccagguuuccucucuuguccccuag

SEQ ID NO: 729619 - RNA, 65 nt, hsa
uugugaguuuaguuucucuccuaaaaugaauguaugcccaccagagcagacaucuuccacgugga

SEQ ID NO: 729620 - RNA, 65 nt, hsa
caguuccuguaauuuugugacacgcucucugccaagcccaccaaguauuuccuuuauagcuaaaa

SEQ ID NO: 729621 - RNA, 65 nt, hsa
cgccuaagaggaacacagcagcuguuccuggcugugcccaccacccuucccagaacccucggacg

SEQ ID NO: 729622 - RNA, 65 nt, hsa
uucuuaaaacacaaaguuuuuaccaacuuuucaaagcccaccaauccacauuuucuccaggaaau

SEQ ID NO: 729623 - RNA, 65 nt, hsa
ucaaggccaguucugcagugacaggcccaggggcugcccaccaggugugcugggcagacuucagc

SEQ ID NO: 729624 - RNA, 65 nt, hsa
uaaaugugaauguaugagcugggggagucaacccagcccaccaugccuuggcugaugauaccaga

SEQ ID NO: 729625 - RNA, 65 nt, hsa
gccucuccuggggccacuguugggggugggagugagcccaccacagaggccacaggcaggccccc

SEQ ID NO: 729626 - RNA, 65 nt, hsa
ggcggagggcaggggaacgggauccuucucccgcugcccaccaacaccaacacacacacaccucu

SEQ ID NO: 729627 - RNA, 65 nt, hsa
cuggcucccgagcucagacacagcccccaggagccgcccaccacggcugugggaacuuccaggcc

SEQ ID NO: 729628 - RNA, 64 nt, hsa
cucagucaagacggaaguaaaggcucaggaaacagcccaccacagaggcagaugccaaaccaaa

SEQ ID NO: 729629 - RNA, 65 nt, hsa
aggaaagccagcagccccagacugcccaaaaacuugcccaccagaccaagggcagugccccaagg

SEQ ID NO: 729630 - RNA, 65 nt, hsa
aucuguauauacacauaacugaaaaccaaguuuaagcccaccaaugcacugcugaugcaugccau

SEQ ID NO: 729631 - RNA, 65 nt, hsa
gcuccgcguguugguggcuguggccauggcucugugcccaccagcaucucccuccugagaugccg

SEQ ID NO: 729632 - RNA, 65 nt, hsa
uguggucccccaccagcucccccucccauagggcugcccaccaagcccugcccccagcccaagag

SEQ ID NO: 729633 - RNA, 65 nt, hsa
agcccuggccaccacaccggccugugccccuugaagcccaccaaagcggcccucacuugugguca

SEQ ID NO: 729634 - RNA, 65 nt, hsa
ugcaggauuugucccacucuguuuucucccucucagcccaccacccacagcucccuucucaucuc

SEQ ID NO: 729635 - RNA, 65 nt, hsa
gcuggugagacaaccucugauccugaggaccggccgcccaccaaggguugggcccccggggccag

SEQ ID NO: 729636 - RNA, 65 nt, hsa
ugcagggguguccuuguccacucgcaccccucgccgcccaccagggccaugcucugugacuuggg

SEQ ID NO: 729637 - RNA, 65 nt, hsa
auggccuggcagcucuccagcagggcagaguguuugcccaccagcugcuagcccuaggaaggcca

SEQ ID NO: 729638 - RNA, 65 nt, hsa
cccucucugaugucccagugcucaccagcccugcagcccaccagacgucaggcccugacuccucu

SEQ ID NO: 729639 - RNA, 65 nt, hsa
uagccggcuuugccauccgggcauguggccacacugcccaccaccgacgauguggguauggaacc

SEQ ID NO: 729640 - RNA, 65 nt, hsa
guccuugaacccaacagucccuuaugagcgucacugcccaccaaaggucaaugucaagagaggaa

SEQ ID NO: 729641 - RNA, 65 nt, hsa
ccacugugccuuuaacaagguuguaaauauuuuaugcccaccagagauguggucauaagaucuga

SEQ ID NO: 729642 - RNA, 65 nt, hsa
cgucagcuguaacccucacccacagccccugcugggcccaccaccuguccgucccuguccccuuu

SEQ ID NO: 729643 - RNA, 65 nt, hsa
cuuccauggcuucugaguacaaggccagccccccggcccaccagcuuucggaaugccugcuuacc

SEQ ID NO: 729644 - RNA, 65 nt, hsa
ggaaacaaaggcuuagcaaacaauuuuuguucaaugcccaccaagacauauagaauugggaacug

SEQ ID NO: 729645 - RNA, 57 nt, hsa
gcagugccggccaguucugagcccugcgcccaccaaucgaauuguagagcugcuugu

SEQ ID NO: 729646 - RNA, 65 nt, hsa
uacagaauauaaacaacaguagugccugugguuuagcccaccaaucuugaugacuaaaaguagcu

SEQ ID NO: 729647 - RNA, 65 nt, hsa
ccccagccugcccacuacauccagccuguggcuuugcccaccaggacuuuugagcuggggcugac

SEQ ID NO: 729648 - RNA, 65 nt, hsa
ccgcugaccucuggccacaggaagccagguccaccgcccaccacccuuucaggccauguuucuac

SEQ ID NO: 729649 - RNA, 61 nt, hsa
ccaucgaugaccgaaagugaccaagaccaaggcccaccaaggcagcagacuguuaaucaga

SEQ ID NO: 729650 - RNA, 65 nt, hsa
cagagcaauaggaggaaaaggaaagcguuuuuguagcccaccaucuacagcuuuacuguaaaacc

SEQ ID NO: 729651 - RNA, 65 nt, hsa
uggggcaguggucagaccccacacgcccucucugggcccaccaccugcaucugcgacuagagagc

SEQ ID NO: 729652 - RNA, 65 nt, hsa
ucaucucacuccuuugccugcacugccaggguggggcccaccaagauuccugaucaugacgggaa

SEQ ID NO: 729653 - RNA, 65 nt, hsa
cccagaggguuuccaugggguaggaggaugggcucgcccaccagugacuuuuucuaagagcuccc

SEQ ID NO: 729654 - RNA, 65 nt, hsa
caauaccuuaacaaaugcacucugagcuggagggagcccaccauuugcacccaccuacccacccu

SEQ ID NO: 729655 - RNA, 65 nt, hsa
ugcuuccugcuccuuggagcuggcucccggaccuugcccaccauccaugcaguggcucccagggc

SEQ ID NO: 729656 - RNA, 65 nt, hsa
gcuaugcacccccaccauuccuacacaucuugccagcccaccagcagccccacucacagcugcug

SEQ ID NO: 729657 - RNA, 65 nt, hsa
caggcugggagcagccuagggagagcccccaucaugcccaccacccacucuggcacuggcuucau

SEQ ID NO: 729658 - RNA, 65 nt, hsa
cuggcugccaggcucgccaggagcccacuggaaacgcccaccacgggggcuccuuguuacacaug

SEQ ID NO: 729659 - RNA, 65 nt, hsa
cacccaccuccgcauccacccccguccgccauccugcccaccaccaggucgguucccgaggccug

SEQ ID NO: 729660 - RNA, 65 nt, hsa
ccauugccccucccauccaugcugggacccuccuggcccaccaaggcccaggcaccacugugaau

SEQ ID NO: 729661 - RNA, 65 nt, hsa
cugccucagccuccugaguagcuggcauuauaggugcccaccaccaugccuggcugauuuuugua

SEQ ID NO: 729662 - RNA, 57 nt, hsa
gugugcugguguccaagugaggccggcgcccaccaugcuccugggcgcccacgcggc

SEQ ID NO: 729663 - RNA, 65 nt, hsa
gucucgacacguaccacguacguggaaacacaagagcccaccacuugaauuucuaagaccauuuc

SEQ ID NO: 729664 - RNA, 65 nt, hsa
gagaaagaccaucaaucaggggccauaguacaggagcccaccagcaggauuuuugaauaauccua

SEQ ID NO: 729665 - RNA, 65 nt, hsa
gggaagagggcucacaagacacauuugucccccgggcccaccacaucauccucacguguucggua

SEQ ID NO: 729666 - RNA, 65 nt, hsa
auggucuuugcaaaaaggaacaaaacaacacaaaagcccaccaggcugcugcuuuguggaaagac

SEQ ID NO: 729667 - RNA, 65 nt, hsa
ccaagucagccucccugcgacugcccaggcacacugcccaccaccccacccccgaaacaaugcca

SEQ ID NO: 729668 - RNA, 65 nt, hsa
caguaaggagaaacagagaggggcaaaguugcucugcccaccagaacugaagaggaggggcugcc

SEQ ID NO: 729669 - RNA, 65 nt, hsa
cccgaguagucccaggaguagcugggacuacaggugcccaccaccacacccagcuaauuuuuuug

SEQ ID NO: 729670 - RNA, 65 nt, hsa
cugagugagacaaauacagaaaugacccauucccugcccaccagaaacucagaggugauugggga

SEQ ID NO: 729671 - RNA, 65 nt, hsa
agaaaaacauaaaggaaaaaacuccaauccccugagcccaccacuguucaggaccccugcuuuug

SEQ ID NO: 729672 - RNA, 65 nt, hsa
gcuucagauggcuuugauuucggcaagcuggaauggcccaccagcccaucccagaucuuccuuua

SEQ ID NO: 729673 - RNA, 65 nt, hsa
cuuccugugaaccaaaguucucaggccaaggucucgcccaccaaagccagaaagugcaagcaccc

SEQ ID NO: 729674 - RNA, 65 nt, hsa
acccagccuccucagaccccgccugccuguccugugcccaccacgcagcagucaggggagaaaau

SEQ ID NO: 729675 - RNA, 65 nt, hsa
cuccccuuucugccuggucagccccguggccucuggcccaccaagcucccugucacccagccaug

SEQ ID NO: 729676 - RNA, 63 nt, hsa
aguaccguaacguggagugaggggcugcccugggcccaccacugcccaagaguucuugcuguu

SEQ ID NO: 729677 - RNA, 65 nt, hsa
cagccucagccucccgaauagcugggauuacacgugcccaccaccaugcccagcuaauuuuugua

SEQ ID NO: 729678 - RNA, 65 nt, hsa
cuccagccucugccgcugccaugcuuugaguccacgcccaccagccuugcucucuucaauaaacc

SEQ ID NO: 729679 - RNA, 65 nt, hsa
cugccucagccucuugaguagcugggauuacaggcgcccaccaccacagccugcuaauuuuugua

SEQ ID NO: 729680 - RNA, 65 nt, hsa
agcacaucuggcucacuccccacuccgucucuggagcccaccagggaaggcccucauccccugcc

SEQ ID NO: 729681 - RNA, 65 nt, hsa
gccaccacucaggggcucuggaggggucagcuggagcccaccaagcugucacugcugcacucacu

SEQ ID NO: 729682 - RNA, 65 nt, hsa
aucccucucuaccucccaaggugauaugggcagcugcccaccacuccagagguagcagcauccuu

SEQ ID NO: 729683 - RNA, 65 nt, hsa
caucugccucauaggccacucuuuccuuucccucugcccaccaaguccucauaucugcagagaac

SEQ ID NO: 729684 - RNA, 65 nt, hsa
cccagugucuucucuacauggcauaaagcggcaaagcccaccauuaggugaggcggucccgaguu

SEQ ID NO: 729685 - RNA, 65 nt, hsa
ccugccucagccucucaaguagcgggauuacaggcgcccaccaccaaaaauuagcccagcuaauu

SEQ ID NO: 729686 - RNA, 65 nt, hsa
ucucccuggacgaccggccucgaggcaacccuggggcccaccagccccugccaugcucucacccu

SEQ ID NO: 729687 - RNA, 65 nt, hsa
cugccucagcuucccgaguagcugggacuacaggcgcccaccacgacgccuggcucauuuuuuug

SEQ ID NO: 729688 - RNA, 65 nt, hsa
cugccucagccucccaaguagcugggauuacaggugcccaccaccaccccuggcuaaauuuguau

SEQ ID NO: 729689 - RNA, 65 nt, hsa
gccuguccccagaggcugaggagaggggguacugugcccaccacacaugauuaggccucagaccc

SEQ ID NO: 729690 - RNA, 65 nt, hsa
uucucgacuggaggaccacacucaagccgacuuaugcccaccaucccaccucuggauaauuuugc

SEQ ID NO: 729691 - RNA, 65 nt, hsa
aggcugccgaggccagggccuguggaggugccagggcccaccaugucgggguaugguuguaggcc

SEQ ID NO: 729692 - RNA, 65 nt, hsa
gugcugcauacccaccgcccagcuucucccugagggcccaccagccugugcuguacaccccguua

SEQ ID NO: 729693 - RNA, 65 nt, hsa
gugcugcauacccaccgcccagcuucucccugagggcccaccagccugugcugcauacccaccgc

SEQ ID NO: 729694 - RNA, 65 nt, hsa
cuuggggccgaacagccccugcccugccucugagggcccaccagccugugcugcauacccaccgc

SEQ ID NO: 729695 - RNA, 65 nt, hsa
cucucucagccuccuggguagcugggauuacaggugcccaccaacaugccuggcuaauuuuugua

SEQ ID NO: 729696 - RNA, 65 nt, hsa
cugccucagcauccuaauuaguugggauuacaggcgcccaccaccaugcccggcuaauuuuugug

SEQ ID NO: 729697 - RNA, 65 nt, hsa
ugucccccaggcuggagugcaguggcgcgaucuuggcccaccacgcccgccuaauuuuuuguauu

SEQ ID NO: 729698 - RNA, 65 nt, hsa
aggggccagcugggaaaugcuaaggagcugagggugcccaccaagcccaccuuccagaaacuugg

SEQ ID NO: 729699 - RNA, 65 nt, hsa
gaggcagcauaaaggacucaaggaccacagccucugcccaccagcauguuccuugaagcccaucg

SEQ ID NO: 729700 - RNA, 65 nt, hsa
cuugcugucccggugucaccugcuuccaucucccagcccaccagcccucugcccaccucacaugc

SEQ ID NO: 729701 - RNA, 65 nt, hsa
aucccuccaggccagaacugacuggagcaggcauggcccaccaggcuucaggaguaggggaagcc

SEQ ID NO: 729702 - RNA, 65 nt, hsa
acccccuggcccacccuggggucugagccugcugggcccaccacauggaaucacuagcuuggguu

SEQ ID NO: 729703 - RNA, 65 nt, hsa
cgccccacuucucccagccuggugcuguccucucggcccaccaucggccagguccagcgcuuccu

SEQ ID NO: 729704 - RNA, 65 nt, hsa
uggccagaggagggaggggcacagugaagaagggagcccaccaccucuccgaagaggaaagccac

SEQ ID NO: 729705 - RNA, 65 nt, hsa
auaaugaaaucguucacauucccucauaugcacaagcccaccaaccccuucacaccccccuucac

SEQ ID NO: 729706 - RNA, 65 nt, hsa
uccaccucagcgggccagcagcccagggaaccccugcccaccaggauugcuggaagugugacgga

SEQ ID NO: 729707 - RNA, 65 nt, hsa
gggugcccagcccccuuuccucaccugauacccaagcccaccacuuuuauuuucuggugaggugg

SEQ ID NO: 729708 - RNA, 65 nt, hsa
cugccucagccucccgaguagcugggacuauaggcgcccaccacgacgcccggcuaauuuuuugu

SEQ ID NO: 729709 - RNA, 65 nt, hsa
cugucucagccuccuagauaacugggauuacaggugcccaccaccaugcccggcuaauuuuugua

SEQ ID NO: 729710 - RNA, 65 nt, hsa
gcaguguggggcaggcaccccacuggcugcagcuagcccaccauaggcacagcacaucccaccac

SEQ ID NO: 729711 - RNA, 65 nt, hsa
ugcucagccuguuucucucugcccucuagagcaaggcccaccagguccauccaggaggcucuccu

SEQ ID NO: 729712 - RNA, 65 nt, hsa
uguaaccugaacuucugugugguggcaguacuguggcccaccaguguaaucucccuggauuaagg

SEQ ID NO: 729713 - RNA, 65 nt, hsa
cccuccuuggggcguuuaggacugggcgucuccaagcccaccauggcccagauggacgugcaaag

SEQ ID NO: 729714 - RNA, 63 nt, hsa
gggacggagacacugacugaggcgaugggagcugcccaccagagugccucugagcagcucaca

SEQ ID NO: 729715 - RNA, 65 nt, hsa
aacagcacacagggucagggucacuucuagaaauagcccaccaaggcuauucagauuggacugug

SEQ ID NO: 729716 - RNA, 65 nt, hsa
uguuaaugaguuacauuaucagccagcccagccuugcccaccauuuaagaaauaucacagagcca

SEQ ID NO: 729717 - RNA, 65 nt, hsa
gugacagucagaaaacacaccuggaauacgaugcagcccaccauuaacucauucauguaguuuau

SEQ ID NO: 729718 - RNA, 65 nt, hsa
ccuaugaaucucuaaggcucuggaaccaucugcccgcccaccaugcccuugggaccugguucucu

SEQ ID NO: 729719 - RNA, 65 nt, hsa
aaucggcccacagcucccaccccacccccuucagugcccaccaacaucccauugcccugguuaua

SEQ ID NO: 729720 - RNA, 65 nt, hsa
aaaaaccauguuuagcuugcagcuguacaaaaacugcccaccagccagaugugacccucaggcca

SEQ ID NO: 729721 - RNA, 65 nt, hsa
cagagcaacuuccagcaaggcuggucugggucucugcccaccaggcggggagguguucaaagaca

SEQ ID NO: 729722 - RNA, 65 nt, hsa
cccaacuucccuacuggcugcuccccuugggucccgcccaccagcggacucggcccccaaggcuc

SEQ ID NO: 729723 - RNA, 65 nt, hsa
auggacucuccucggguggguccagcaggggcccugcccaccagaacacaguccgugcugugcug

SEQ ID NO: 729724 - RNA, 65 nt, hsa
cuuguuuguugaauuugugaacaguauagaucucagcccaccaaugccaagacaaaauuauuuuu

SEQ ID NO: 729725 - RNA, 65 nt, hsa
ugggucaggaaauuacugcccacuugucaaguucagcccaccaucuguuugaagauuauaugaag

SEQ ID NO: 729726 - RNA, 65 nt, hsa
cugccucagccucccaaguagcugggauuacaggugcccaccaccaugccuggcuuaauuuuuug

SEQ ID NO: 729727 - RNA, 65 nt, hsa
cuucgccagcacccuuuccccaucauggggcagaugcccaccagcccucacuaucuacugcuuga

SEQ ID NO: 729728 - RNA, 65 nt, hsa
cauggcccugccacaucccguguaacauaaguggugcccaccauguuugcacuuuuaauaacucu

SEQ ID NO: 729729 - RNA, 65 nt, hsa
cauuuguguggaccaaucuacucggggaauuccaggcccaccaggacacgugccaauggccccau

SEQ ID NO: 729730 - RNA, 65 nt, hsa
gccacgugaggguccagccuccagggacaggcacugcccaccaacggcaaauccaaaguucuuuc

SEQ ID NO: 729731 - RNA, 65 nt, hsa
acccccucccucaaggaauggccuugcccaggaaugcccaccacacauacccucuucuuuuuuuc

SEQ ID NO: 729732 - RNA, 65 nt, hsa
uguccaacaauucuaaccaacaaaggaccuagacagcccaccaagucacuugguucccacuccca

SEQ ID NO: 729733 - RNA, 65 nt, hsa
ugcuuuaugagcccauuagcacuuugguucaaggggcccaccaagucuuggacgggaaggcgcua

SEQ ID NO: 729734 - RNA, 65 nt, hsa
cgaagcaucugccucccaccccucggcccccucaagcccaccaucugcuucugagugucgcacua

SEQ ID NO: 729735 - RNA, 65 nt, hsa
ugaaggagaaagaggccgcugcugccgccgccgccgcccaccagcaggcccugcgggaggagagc

SEQ ID NO: 729736 - RNA, 65 nt, hsa
agcccugcugcuuccuaacuuauugccugggcagugcccaccaugcaccccugauguucgccguc

SEQ ID NO: 729737 - RNA, 65 nt, hsa
guccuggggccagcaaugugguuccugugcacugagcccaccagccacagugcccauguccccuc

SEQ ID NO: 729738 - RNA, 65 nt, hsa
uauggcuccuccaccugguaugagaccacccaugggcccaccaauugggcuucccccugcucgag

SEQ ID NO: 729739 - RNA, 65 nt, hsa
aaggugggugccccagaguagauuccaccccugcugcccaccaauggagaaucccaauguugaau

SEQ ID NO: 729740 - RNA, 65 nt, hsa
cacauggcccuuugcuugagggcuccccacucccugcccaccaauacccaggugaggaacagacc

SEQ ID NO: 729741 - RNA, 65 nt, hsa
ccugugucucuggcuacagcaagaccagcccaggagcccaccagcaccugccucucagcuacuug

SEQ ID NO: 729742 - RNA, 65 nt, hsa
gggcagaggccaggaggggaccuggugugucaccugcccaccaccuggcucaucccucaggccca

SEQ ID NO: 729743 - RNA, 65 nt, hsa
cgccaggaugcacagaccgaccgacagaccucagugcccaccacgggcuguggcggagcucccgc

SEQ ID NO: 729744 - RNA, 65 nt, hsa
cugggggccucgggaggcuaggccccuccucaaaggcccaccagcccggcgcucaugcugagccc

SEQ ID NO: 729745 - RNA, 65 nt, hsa
ggcugcacaggccagggcucgggcaugugguggccgcccaccaggggccuucacgucugcccuuu

SEQ ID NO: 729746 - RNA, 65 nt, hsa
agcauguggacgcccuccguccugcagucuugccagcccaccacagccacuguagaccacaggca

SEQ ID NO: 729747 - RNA, 61 nt, hsa
ucauccucuccacaaaguagacccucuccgagcccaccagccacagaauauuauguaaaga

SEQ ID NO: 729748 - RNA, 65 nt, hsa
cuacuugcccuagcaugaggcucugagagccaccugcccaccaaucuggugaggauaaugguggc

SEQ ID NO: 729749 - RNA, 65 nt, hsa
gacugucccuguuguaacugcccaaggcauguuuugcccaccagaucauggcccacguggaggcc

SEQ ID NO: 729750 - RNA, 65 nt, hsa
guaccucugagucccagggaccugggcaggcccaagcccaccacgagcaucauccaguccucagc

SEQ ID NO: 729751 - RNA, 65 nt, hsa
ucacaaucauguagcagaauggcacccagaccacugcccaccagugacggacaugcacguggcag

SEQ ID NO: 729752 - RNA, 65 nt, hsa
acgggacugacagccucccagaggcccguggaggagcccaccagccccuucuucuugugaaggaa

SEQ ID NO: 729753 - RNA, 65 nt, hsa
ggacagacgugggcuucagaagcucgcuggccugggcccaccagcauuuucuuuuaugaacauga

SEQ ID NO: 729754 - RNA, 65 nt, hsa
gccuggugaggccacuuggccucuugguuggccaggcccaccaggaagucaccaggacaguccac

SEQ ID NO: 729755 - RNA, 65 nt, hsa
gccagugcaauucugaggcuaggggaauaggagaagcccaccagcugccccugccacccacgggg

SEQ ID NO: 729756 - RNA, 65 nt, hsa
uaugauuuccuauauuccaaauuccauuaaggucagcccaccauguaauuuucucaucagaaaug

SEQ ID NO: 729757 - RNA, 65 nt, hsa
cacucuccacuucccaguuugcaaauguggcuuucgcccaccaagugaaagcggacugagagcag

SEQ ID NO: 729758 - RNA, 65 nt, hsa
guuuggcgagcacgaacuagaccaagcgaagggcagcccaccaccguauaucaaaccucacuucc

SEQ ID NO: 729759 - RNA, 65 nt, hsa
ccacccagagcuuccugccuagucccacugggcuggcccaccaggccucugacccaggcugcucu

SEQ ID NO: 729760 - RNA, 65 nt, hsa
cccccucucccuuuccuuccuuccuuccuuucucugcccaccaccccgcucagucucucucucuc

SEQ ID NO: 729761 - RNA, 65 nt, hsa
ggagaggaccgccggccucagcuacuagcccaccagcccaccagggagaaaagaagccaugagag

SEQ ID NO: 729762 - RNA, 65 nt, hsa
uccccgggggagaggaccgccggccucagcuacuagcccaccagcccaccagggagaaaagaagc

SEQ ID NO: 729763 - RNA, 65 nt, hsa
ccagcccuacccagaguauuucugagccaugaggggcccaccagauugguucugaauuggauuca

SEQ ID NO: 729764 - RNA, 65 nt, hsa
ugaccucaagaccagccacaccaagucugugcacugcccaccacccccuucaaccccuccuacac

SEQ ID NO: 729765 - RNA, 65 nt, hsa
ggagcucagaugugggcaggaauucccaaaccugagcccaccaaggacucacaagugguccagaa

SEQ ID NO: 729766 - RNA, 65 nt, hsa
caagugaugcuuuugagcuuacacacaauucacaggcccaccagugacaauuuacugugaguuaa

SEQ ID NO: 729767 - RNA, 65 nt, hsa
ccuugugggaagaaguuugcaccucggcccuggcugcccaccaucagugccccgcagucagcagc

SEQ ID NO: 729768 - RNA, 65 nt, hsa
aaauuccuccuuccccccaucucugaguggaggaagcccaccaaucugcccuuugcagugugcag

SEQ ID NO: 729769 - RNA, 65 nt, hsa
uugccucagccucccgaguagcugggauuacaggugcccaccaccgcgcccagcuaauuuuuuaa

SEQ ID NO: 729770 - RNA, 65 nt, hsa
ucagaacagaagccauguaucucccccacaccagggcccaccauggagcuuguguucucagaauc

SEQ ID NO: 729771 - RNA, 65 nt, hsa
uccaggucccaugccaagaaccagugauucuaguggcccaccaccucccucuccugccacccuua

SEQ ID NO: 729772 - RNA, 65 nt, hsa
ggagaaagugagccuggggaagaaggggguuugaagcccaccaagaccgaaacuggagaagggcu

SEQ ID NO: 729773 - RNA, 65 nt, hsa
gaggaggagcgcuacccaccuccagggagcacccugcccaccaagaagcacugggugaccagcug

SEQ ID NO: 729774 - RNA, 65 nt, hsa
ccccuggagugugucagagcccaggggagaaugcagcccaccaggagcaccuggacccccugccc

SEQ ID NO: 729775 - RNA, 63 nt, hsa
uggagaagcgugucagauagcggcgugacccgggcccaccaggccacggccgccugcuguaca

SEQ ID NO: 729776 - RNA, 65 nt, hsa
ggccaagagcgagcgagaggcgcugccccagccaggcccaccaccucucacagucagugcacgca

SEQ ID NO: 729777 - RNA, 65 nt, hsa
gaggggcggcugcugccuggugacggcacccggaggcccaccaggacgcgccaccggugaaugug

SEQ ID NO: 729778 - RNA, 65 nt, hsa
ccuggagcugaugacgggggaggcccguccgccuggcccaccaacccgcccaccuugacugcccc

SEQ ID NO: 729779 - RNA, 65 nt, hsa
ucccuccacgcagcggccggagccagacuagccccgcccaccaacgagucccggcuucgaguagu

SEQ ID NO: 729780 - RNA, 65 nt, hsa
ccuuugggcugcccuggcccccacucucccgggccgcccaccacaggcucuuaauggggccgggu

SEQ ID NO: 729781 - RNA, 65 nt, hsa
gucuuuaagucuauuguuuaacuguaccauccagagcccaccagaagcuauugaucauuaaaauu

SEQ ID NO: 729782 - RNA, 65 nt, hsa
gcccucaagaaguugugcccuuccccgccugcgaugcccaccauggccuauuuucuuggugucau

SEQ ID NO: 729783 - RNA, 65 nt, hsa
gacccucugcaagggggacaggcaggccccuccaggcccaccagccugguucccgcggcccauuu

SEQ ID NO: 729784 - RNA, 65 nt, hsa
gcacauggcuggcacugagcaguaccagugugcuugcccaccacagcgauccacggagcugaagc

SEQ ID NO: 729785 - RNA, 65 nt, hsa
cuccuagaacugagcugccucuaccacagccuccugcccaccagcuggccucaccuccugaaggc

SEQ ID NO: 729786 - RNA, 65 nt, hsa
cagaccagcacaucccuuuugagacaccgccuucugcccaccacucacggacacauuucugccua

SEQ ID NO: 729787 - RNA, 65 nt, hsa
gugccucuccuggucguggaaggugcuacuccagugcccaccagccuuguccuaauaaaauuaag

SEQ ID NO: 729788 - RNA, 65 nt, hsa
agugccucuccuggcccugaaggugccacuccagugcccaccagccuuguccuaauaaaauuaag

SEQ ID NO: 729789 - RNA, 65 nt, hsa
agugccucuccuggcccugaaggugccacuccagugcccaccagccuugucuuaauaaaauuaag

SEQ ID NO: 729790 - RNA, 65 nt, hsa
gugccucuccuggcccuggaaguugccacuccagugcccaccagccuuguccuaauaaaauuaag

SEQ ID NO: 729791 - RNA, 65 nt, hsa
ccuuuccuggaccccccagcuggccucugaagcuggcccaccagagcugccauuugucuccagcc

SEQ ID NO: 729792 - RNA, 65 nt, hsa
ccacacggccuuggcuauugcuuccuucaggcucugcccaccaaggugcccucuccccggggacc

SEQ ID NO: 729793 - RNA, 65 nt, hsa
acugagggcuuggcugccugccaccgccaucuggagcccaccacagcucuucucccuguucucug

SEQ ID NO: 729794 - RNA, 65 nt, hsa
cguggcugugcccucaguugcccccagggcugggugcccaccaugccccuuccucuuucuccucc

SEQ ID NO: 729795 - RNA, 65 nt, hsa
ucccugccccuggcaagugcucccaucgccccggugcccaccaugagcucccagcaccugacucc

SEQ ID NO: 729796 - RNA, 65 nt, hsa
ggucucccccuacauauuaauaccagucaccaggagcccaccaccucccucuaggaugcccccuc

SEQ ID NO: 729797 - RNA, 65 nt, hsa
cagggacacguggggugugcugcugcugcuccccagcccaccagugccuggccagccugcccccu

SEQ ID NO: 729798 - RNA, 65 nt, hsa
guggcgccugcugcgucagagcucaaggaaucugugcccaccaccagcuccugguccguaggagg

SEQ ID NO: 729799 - RNA, 65 nt, hsa
uucaggagccagcccucuuccauccgcccggcucugcccaccaccacugccaggcugaacagggg

SEQ ID NO: 729800 - RNA, 65 nt, hsa
cugccucagccucccgaguagcugggacuacaggugcccaccaccacgccuggcuaguuuuuugu

SEQ ID NO: 729801 - RNA, 65 nt, hsa
cugccucagccuccugaguagcugggacuacaggcgcccaccaccacgcccggcuaauuuuuugu

SEQ ID NO: 729802 - RNA, 65 nt, hsa
auuaccacugaaacacuucgagcuauuuagcuaaagcccaccaaaccaaaacaaaauacugauuu

SEQ ID NO: 729803 - RNA, 65 nt, hsa
ugaaaccccaugggcccguucugauugaaggugaagcccaccagauuauuuuucaaagucuuagg

SEQ ID NO: 729804 - RNA, 65 nt, hsa
ccaccgguggggagggucguccgguaucccccagugcccaccaccaccaaccagaaucacuucuc

SEQ ID NO: 729805 - RNA, 65 nt, hsa
caguggccuuagagggagccugcccugcccccaccgcccaccaccuccuccccuucauuccugcu

SEQ ID NO: 729806 - RNA, 65 nt, hsa
ccgggugggcaggggccugaggguggcucgggccagcccaccagccaauggaccccuccucaggc

SEQ ID NO: 729807 - RNA, 65 nt, hsa
accuaaccccuagccgucaucuccacacucaccaggcccaccaggggagggggcuggccuggggg

SEQ ID NO: 729808 - RNA, 65 nt, hsa
ccuucagaggaccuaagacccaccuaugacucagggcccaccacaccccacccccccccaacugg

SEQ ID NO: 729809 - RNA, 65 nt, hsa
cccaccaggcccagagccugguuggccauucucaugcccaccagcuucuggcuuugggaugucuc

SEQ ID NO: 729810 - RNA, 65 nt, hsa
uagucguacacggagacuggcagcgccgacguccugcccaccacgcacucccggagagcacggaa

SEQ ID NO: 729811 - RNA, 65 nt, hsa
cugccucagccucccaaguagcugggauaacaggcgcccaccaccgcacccugcuaauuuuuugu

SEQ ID NO: 729812 - RNA, 65 nt, hsa
ccaacaacaaaaguguuuuccccccacccccacucgcccaccagggugaugccacuuuugccucc

SEQ ID NO: 729813 - RNA, 65 nt, hsa
gaccugagcuauucucacucggaccuggggaaacggcccaccaaggacagcuacacgcugacgga

SEQ ID NO: 729814 - RNA, 60 nt, hsa
gccgucgguuccuuaacugaggccguggcugcccaccacgaccccucacaccuccugcug

SEQ ID NO: 729815 - RNA, 65 nt, hsa
uacaacugaagacaacuaacccuuuccccaacagagcccaccagcagugguggagaugucggucc

SEQ ID NO: 729816 - RNA, 55 nt, hsa
gggcccacggcucccacuaaggccugcccaccaccgcccgccugggcagccauga

SEQ ID NO: 729817 - RNA, 65 nt, hsa
caacccugccuggaucucccugcuucaccccuguggcccaccaggugggccaugaaaggagagga

SEQ ID NO: 729818 - RNA, 65 nt, hsa
cugccucagccucccgaguagcugggccuaaaggugcccaccacuauacccggcuaauuuuugua

SEQ ID NO: 729819 - RNA, 65 nt, hsa
gacgcacccuccaggaugcucgcugggauucccacgcccaccacugucccccaccccauggcugg

SEQ ID NO: 729820 - RNA, 65 nt, hsa
gagcuggguccccccaaaacuugggcuggcccagggcccaccagcagcugauguugccuccucuc

SEQ ID NO: 729821 - RNA, 65 nt, hsa
gaaaccagcacuccaugaagauaaacucugggcccgcccaccagcaggaccugucgaccugaggu

SEQ ID NO: 729822 - RNA, 65 nt, hsa
uccagcccuuaaaucccccagcuuccaaacuugaggcccaccaucuccaccaucugguaauaaac

SEQ ID NO: 729823 - RNA, 65 nt, hsa
cugccucagccuuccaaguagcugggauuacaagugcccaccaccaugcccagcuaauuuuuaua

SEQ ID NO: 729824 - RNA, 65 nt, hsa
uggguauucaccacccugggaccccccccccccccgcccaccagaccuguucugaccucaugagu

SEQ ID NO: 729825 - RNA, 65 nt, hsa
ccucaacccgcccugcagccucggccuccgccccggcccaccaccucgcuacugcuggaaccgcg

SEQ ID NO: 729826 - RNA, 65 nt, hsa
gcugcuccugaaguuguagagagcaagcugaagcugcccaccaucaagaugcccucccuuggcau

SEQ ID NO: 729827 - RNA, 65 nt, hsa
ugaacuugcaaacaggcugauaccuuugugaaguugcccaccaaaacacagaaggaaaaaaacau

SEQ ID NO: 729828 - RNA, 65 nt, hsa
accgacugcuggaacccagccagugggagggccuggcccaccagaguccugcucccucacuccuc

SEQ ID NO: 729829 - RNA, 65 nt, hsa
ccgaggggguggggacugagccgcccgccucugccgcccaccaccaucucaggaaaggcuguugu

SEQ ID NO: 729830 - RNA, 65 nt, hsa
agccauaccucaaagauauuguggauuggguugcagcccaccacaauaaagcaaauauugcuaua

SEQ ID NO: 729831 - RNA, 65 nt, hsa
cugccucagccucccgaguagcugggauuacaggcgcccaccaccaugcccggcuaguuuuuuug

SEQ ID NO: 729832 - RNA, 65 nt, hsa
cccuugccugguuccauauggcuccuuccagcccugcccaccaagugcagcucccacuuuccauc

SEQ ID NO: 729833 - RNA, 65 nt, hsa
ggcuccagccauugcggugguuucuagauagccaggcccaccaagagauauugccccuugaugag

SEQ ID NO: 729834 - RNA, 65 nt, hsa
augccucauccucccaaguaggugggauuacaggugcccaccaccaagcccugcaaauuuuuuug

SEQ ID NO: 729835 - RNA, 65 nt, hsa
cugcggggaggcucuuuuucucccuggccuccagugcccaccaggaggaucugcgcacggugcac

SEQ ID NO: 729836 - RNA, 65 nt, hsa
cagugcccaccaggaggaucugcgcacggugcacagcccaccagagcacuacagccuuuuauuga

SEQ ID NO: 729837 - RNA, 65 nt, hsa
gaagccagcacaggguuaaaguaacuccuggcauugcccaccagggggcuggugcaccugcugac

SEQ ID NO: 729838 - RNA, 65 nt, hsa
caggucuaggccgugugguacccagaagugucccagcccaccacaccguuuaccucccucgcccu

SEQ ID NO: 729839 - RNA, 65 nt, hsa
gguuucccuuacagggcccccucccccgggaaugcgcccaccaaggcccuagacucaucuuggcc

SEQ ID NO: 729840 - RNA, 65 nt, hsa
gagucccaggaaacagugcuuuccgaugagacucagcccaccauuucuccucaccugggccuucu

SEQ ID NO: 729841 - RNA, 65 nt, hsa
gcagacagcccagagccugccgcuacccucggccugcccaccaccaagcaagcagcaagcaagau

SEQ ID NO: 729842 - RNA, 65 nt, hsa
cugccucagccucccaaguagcugggauuacaggugcccaccaucaugcccagcuaauuuuuugu

SEQ ID NO: 729843 - RNA, 65 nt, hsa
ggguccacgccugugccuguccuggccuccacugugcccaccacugcccucccccuugccagugu

SEQ ID NO: 729844 - RNA, 53 nt, hsa
uggagcacugcuggaagugaguggcccaccagagccucccucagccacgccuc

SEQ ID NO: 729845 - RNA, 65 nt, hsa
aaacaggugccaucuuggccaccucggccagggcagcccaccaugcuaaaaggaccccaaauggu

SEQ ID NO: 729846 - RNA, 65 nt, hsa
cauuauuuuuaggauguguauuucauuuauuuauggcccaccagucucccccaaauuaguacaga

SEQ ID NO: 729847 - RNA, 65 nt, hsa
cugccgcagccuccagaguagcugggauaacaggugcccaccaccacaccccacuaauuuuugua

SEQ ID NO: 729848 - RNA, 65 nt, hsa
ccuguaugugccacauggaaaaacaggacaccagagcccaccagacagugccggccagcagagaa

SEQ ID NO: 729849 - RNA, 65 nt, hsa
augaauuuagggguuacgauuauagcaauuuaagggcccaccagaagcaggccucgaggagucaa

SEQ ID NO: 729850 - RNA, 65 nt, hsa
gguccccuguugauuauaugugcggccuuccagcugcccaccaucacagcuacagcucgcucccc

SEQ ID NO: 729851 - RNA, 65 nt, hsa
gucugaagggggcguggccacaccuccuagaccacgcccaccacuuagaccacgcccaccuccug

SEQ ID NO: 729852 - RNA, 65 nt, hsa
agggcaggaguguuuauggcagagugaaguucugugcccaccacaagaggcugugagauguucug

SEQ ID NO: 729853 - RNA, 65 nt, hsa
ucucccagucucccugccccccaugccccagaccggcccaccagggacuagccgcugucgcacag

SEQ ID NO: 729854 - RNA, 65 nt, hsa
aggcagccucugggggguggccaggccgggaaaaagcccaccauuuggcaucccugggccuuggg

SEQ ID NO: 729855 - RNA, 65 nt, hsa
agccgggaugccugcaucccacccccggccccagggcccaccacauaaaaucugggagcccagag

SEQ ID NO: 729856 - RNA, 57 nt, hsa
gacggcggcugccagagugagugcccggcccaccagggacugcagcugcaccagcag

SEQ ID NO: 729857 - RNA, 65 nt, hsa
caguuuaucucuuaucuaccuaugaccugcgagcugcccaccacccccaguuguugcgccuuucc

SEQ ID NO: 729858 - RNA, 65 nt, hsa
cugcccccacuccagggcagccaugaugugcuugggcccaccagggccuuccgggcugcucucuu

SEQ ID NO: 729859 - RNA, 65 nt, hsa
ucauccuggccccaccagggccuugggcaaguccugcccaccauaggccucugcuaccugccagu

SEQ ID NO: 729860 - RNA, 59 nt, hsa
cagccgagaacaacagcuagcaccaagaagcccaccacuagggggagacaugcuguagg

SEQ ID NO: 729861 - RNA, 65 nt, hsa
gcagauuaguuagaauucacugccagguuucuucugcccaccaaaaugauccagucuggaauaac

SEQ ID NO: 729862 - RNA, 65 nt, hsa
ugucucgagcuggacagugaggcaaggccaggagugcccaccagcuugccccgcuccuccaccau

SEQ ID NO: 729863 - RNA, 65 nt, hsa
gucccccaaagucccuucugucuggccuauccugugcccaccaccuguggcuucauccagcccuc

SEQ ID NO: 729864 - RNA, 65 nt, hsa
cacuauaaggcugagggcugccagcagccccgucugcccaccauucccggccguggaccauaguc

SEQ ID NO: 729865 - RNA, 65 nt, hsa
ggagccaaucucagcccuccacgccaaggagccuugcccaccagccaaucaauguucgucucugc

SEQ ID NO: 729866 - RNA, 65 nt, hsa
aggauguggcuaugucuuuuaggaagccacucuuagcccaccagagucugcccuuuggcccaaaa

SEQ ID NO: 729867 - RNA, 65 nt, hsa
gcaggugagcaaccaguuggcuaggggagcagggggcccaccagagcuguggagaggggacccua

SEQ ID NO: 729868 - RNA, 65 nt, hsa
gcagcacacauauuuucuugucaacuuuuccccaagcccaccaacuuggauucagauugcgacau

SEQ ID NO: 729869 - RNA, 65 nt, hsa
aggcugaugcugauuuggccagagaugaccucaaggcccaccaaauagagcacaacuucccauug

SEQ ID NO: 729870 - RNA, 65 nt, hsa
ugggcgucaucugguccugguaagaggagugcguggcccaccaggccccccugucacccaugaca

SEQ ID NO: 729871 - RNA, 64 nt, hsa; identical to SEQ ID NO: 729131

SEQ ID NO: 729872 - RNA, 64 nt, hsa; identical to SEQ ID NO: 729132

SEQ ID NO: 729873 - RNA, 64 nt, hsa; identical to SEQ ID NO: 729133

SEQ ID NO: 729874 - RNA, 64 nt, hsa; identical to SEQ ID NO: 729134

SEQ ID NO: 729875 - RNA, 64 nt, hsa; identical to SEQ ID NO: 729135

SEQ ID NO: 729876 - RNA, 64 nt, hsa; identical to SEQ ID NO: 729136

SEQ ID NO: 729877 - RNA, 64 nt, hsa; identical to SEQ ID NO: 729137

SEQ ID NO: 729878 - RNA, 64 nt, hsa; identical to SEQ ID NO: 729138

SEQ ID NO: 729879 - RNA, 64 nt, hsa; identical to SEQ ID NO: 729139

SEQ ID NO: 729880 - RNA, 64 nt, hsa; identical to SEQ ID NO: 729140

SEQ ID NO: 729881 - RNA, 64 nt, hsa; identical to SEQ ID NO: 729141

SEQ ID NO: 729882 - RNA, 64 nt, hsa; identical to SEQ ID NO: 729142

SEQ ID NO: 729883 - RNA, 62 nt, hsa
ccuccugggccaccuggggcaccuuaccaccggagccgaaucuggucccugggggaccccca

SEQ ID NO: 729884 - RNA, 62 nt, hsa
uuguaccuaacauuuuauccucuuagaucuaagagccgaagcuauagaacuuuguuagacua

SEQ ID NO: 729885 - RNA, 62 nt, hsa
cuguguggaaaggaggcccacgggcacuaggggagccgaauucuacaaucccgcuggggcgg

SEQ ID NO: 729886 - RNA, 62 nt, hsa
aacuuuuguacuucucugguauggagaguuuggagccgaaugauuugcauuuuuuacauguc

SEQ ID NO: 729887 - RNA, 62 nt, hsa
cccugggcccaucucucccugcgcaccaggcugagccgaagcugcgggggcaggccgggccu

SEQ ID NO: 729888 - RNA, 62 nt, hsa
ggaaccagugggucacuguggcagcuucaucugagccgaagguguggguccucuguggcugu

SEQ ID NO: 729889 - RNA, 62 nt, hsa
guccgagguagcugcucuccccacugagagcugagccgaaauauaagaauaauauauuugug

SEQ ID NO: 729890 - RNA, 62 nt, hsa
gcaaauagcaauugacuugaaaauaagaaguggagccgaagguggauacaagaaauccagga

SEQ ID NO: 729891 - RNA, 62 nt, hsa
ggaaaagggagaaaggcagugggaaaagaggugagccgaagaucaauucgacagacagaugg

SEQ ID NO: 729892 - RNA, 62 nt, hsa
caauaguaacaguaugcaaaagcagcauucaggagccgaaagauagucugaagucauucaga

SEQ ID NO: 729893 - RNA, 62 nt, hsa
cuuugcagcagugcuuccaagcuuuuuuuggugagccgaaugggcauggcugcgcuggaucc

SEQ ID NO: 729894 - RNA, 62 nt, hsa
ugaaaaagugaagccucagaguuacccucuuugagccgaaccuaaaauaaaaguaaacaaga

SEQ ID NO: 729895 - RNA, 62 nt, hsa
gcuaagccugcaguuuacucgggggguucagggagccgaaaggcuuaaauaguuuaaguagg

SEQ ID NO: 729896 - RNA, 62 nt, hsa
guguucauagaaacauggaauucucugauuuugagccgaacaugaguuuuuagacuguaucu

SEQ ID NO: 729897 - RNA, 62 nt, hsa
aaaauguccugccaguuuaaggguacauuguagagccgaacuuugaguuacugugcaagauu

SEQ ID NO: 729898 - RNA, 62 nt, hsa
guaggggaagaggguggcuggacuuaagguaggagccgaaagugggcaugggagcccauccc

SEQ ID NO: 729899 - RNA, 62 nt, hsa
cauccaguccacugacaagaggguuuccccgagagccgaaguggacugaagcuacaguuuuu

SEQ ID NO: 729900 - RNA, 62 nt, hsa
cgugggcucccgggucgcaagccgggagggucgagccgaagucuccggcgggccgcaagagg

SEQ ID NO: 729901 - RNA, 62 nt, hsa
gaggacgacguuucuuuucucaugaaacacaagagccgaaaacgccgguaaguugccaaagc

SEQ ID NO: 729902 - RNA, 62 nt, hsa
auugcuugaaccuggaaggcagagguugcagugagccgaaauggcgccacuguacuccaacc

SEQ ID NO: 729903 - RNA, 62 nt, hsa
caaaaacagccuccaauaccacaaccugaaaagagccgaaaugguuauuuuacagcauacaa

SEQ ID NO: 729904 - RNA, 62 nt, hsa
augcugugaacccuggaggcagagcuugcagugagccgaauaugcgccacugcacuccagcc

SEQ ID NO: 729905 - RNA, 62 nt, hsa
aaucuagacgaauggagaugcaggagcugcgggagccgaauucgguccugaaaaacacuaau

SEQ ID NO: 729906 - RNA, 62 nt, hsa
uaaccaagacauggaaauaaaugugaaagcuggagccgaagagucaaagagcuaaaaaauua

SEQ ID NO: 729907 - RNA, 62 nt, hsa
cauccccccugccaccgggcgaucccugcugugagccgaagcucucccugccccgcccuggc

SEQ ID NO: 729908 - RNA, 62 nt, hsa
auucaggggcauuuuggugcuguuaaaagcaagagccgaauuuagaaguucccuuaaaaaga

SEQ ID NO: 729909 - RNA, 62 nt, hsa
auugcuugaaccuaggaggcugagauugcagugagccgaaaucacgccacuacacuccagcc

SEQ ID NO: 729910 - RNA, 62 nt, hsa
cacuucaggagcccuacugaagggaacagccugagccgaacauguuauuuaaccugaguaua

SEQ ID NO: 729911 - RNA, 62 nt, hsa
aggugggggaggggcgacaguagugagcgccugagccgaacaauccucgaacuaaaagccuu

SEQ ID NO: 729912 - RNA, 62 nt, hsa
uuuggaaaaacuuuagaggaugauuuaaucaagagccgaaauuauuacccuucucaaagucc

SEQ ID NO: 729913 - RNA, 62 nt, hsa
uuggagcgcgcucugcgauuggagcagggccggagccgaacgccuggaacgcucuccguccg

SEQ ID NO: 729914 - RNA, 62 nt, hsa
uuacuucaguacaaugccaccaguaguacgaugagccgaagcuuuacauugugagaguagca

SEQ ID NO: 729915 - RNA, 62 nt, hsa
ggccugggaccagcugggugucagccacggaugagccgaauagccagucagcauguugcugc

SEQ ID NO: 729916 - RNA, 62 nt, hsa
gggggagugggucagagguacuggagggugcugagccgaagggacggugggagggggguuau

SEQ ID NO: 729917 - RNA, 62 nt, hsa
aaccucuacuguaaacuuucugguccgagaacgagccgaacacagcgcgacgcagggacuag

SEQ ID NO: 729918 - RNA, 62 nt, hsa
ggcucccccugcacauuugcacacgauccggagagccgaaggccgcgugcuuccugucacau

SEQ ID NO: 729919 - RNA, 62 nt, hsa
agucuacuaugggcagggccccccaccaagcugagccgaauggagacagcugagcugaggcc

SEQ ID NO: 729920 - RNA, 62 nt, hsa
gccgggcaggguguggggccaugccuccucaggagccgaagcccaggggccggccaguggcc

SEQ ID NO: 729921 - RNA, 62 nt, hsa
ucucccucuuuccacggucucccucugaugccgagccgaagcuggacuguacugcugccauc

SEQ ID NO: 729922 - RNA, 62 nt, hsa
guaauacaguuucuacgucuauuuaaggcuaggagccgaaugugccccauugucaguggguc

SEQ ID NO: 729923 - RNA, 62 nt, hsa
cucacuccuugcccccuccccacgacacccaugagccgaaaggaugucacuaaggauggcug

SEQ ID NO: 729924 - RNA, 62 nt, hsa
ccccagacugggacacaggcggaagccuaggagagccgaaucaguguuugugaagaggcagg

SEQ ID NO: 729925 - RNA, 62 nt, hsa
aguaggucuacagucccauauguuggcagcuggagccgaagagcaccacucccuguaggugg

SEQ ID NO: 729926 - RNA, 62 nt, hsa
ggcgccggcgcugccuggcgggggccgcggaggagccgaaagggcguugggauccaggggaa

SEQ ID NO: 729927 - RNA, 62 nt, hsa
ccucccaugccguuccacuccucccugccucugagccgaacaugauaauaaaagcuauuauu

SEQ ID NO: 729928 - RNA, 62 nt, hsa
agagaacccuugugcuacgccaggcaguuaccgagccgaagggagaugaugggccuucgccc

SEQ ID NO: 729929 - RNA, 62 nt, hsa
accgcuuguacccaggagguggagguugcagugagccgaaguugcaccauugcacuccaccc

SEQ ID NO: 729930 - RNA, 64 nt, hsa; identical to SEQ ID NO: 687063

SEQ ID NO: 729931 - RNA, 64 nt, hsa; identical to SEQ ID NO: 687064

SEQ ID NO: 729932 - RNA, 64 nt, hsa; identical to SEQ ID NO: 687065

SEQ ID NO: 729933 - RNA, 64 nt, hsa; identical to SEQ ID NO: 687066

SEQ ID NO: 729934 - RNA, 64 nt, hsa; identical to SEQ ID NO: 687067

SEQ ID NO: 729935 - RNA, 64 nt, hsa; identical to SEQ ID NO: 687068

SEQ ID NO: 729936 - RNA, 64 nt, hsa; identical to SEQ ID NO: 687069

SEQ ID NO: 729937 - RNA, 64 nt, hsa; identical to SEQ ID NO: 687070

SEQ ID NO: 729938 - RNA, 64 nt, hsa; identical to SEQ ID NO: 687071

SEQ ID NO: 729939 - RNA, 64 nt, hsa; identical to SEQ ID NO: 687072

SEQ ID NO: 729940 - RNA, 64 nt, hsa; identical to SEQ ID NO: 687073

SEQ ID NO: 729941 - RNA, 64 nt, hsa; identical to SEQ ID NO: 687074

SEQ ID NO: 729942 - RNA, 64 nt, hsa; identical to SEQ ID NO: 687075

SEQ ID NO: 729943 - RNA, 64 nt, hsa; identical to SEQ ID NO: 687076

SEQ ID NO: 729944 - RNA, 64 nt, hsa; identical to SEQ ID NO: 687077

SEQ ID NO: 729945 - RNA, 64 nt, hsa; identical to SEQ ID NO: 687078

SEQ ID NO: 729946 - RNA, 64 nt, hsa; identical to SEQ ID NO: 687079

SEQ ID NO: 729947 - RNA, 64 nt, hsa; identical to SEQ ID NO: 687080

SEQ ID NO: 729948 - RNA, 64 nt, hsa; identical to SEQ ID NO: 687081

SEQ ID NO: 729949 - RNA, 64 nt, hsa; identical to SEQ ID NO: 687082

SEQ ID NO: 729950 - RNA, 64 nt, hsa; identical to SEQ ID NO: 687083

SEQ ID NO: 729951 - RNA, 64 nt, hsa; identical to SEQ ID NO: 574358

SEQ ID NO: 729952 - RNA, 64 nt, hsa; identical to SEQ ID NO: 574359

SEQ ID NO: 729953 - RNA, 64 nt, hsa; identical to SEQ ID NO: 574360

SEQ ID NO: 729954 - RNA, 64 nt, hsa; identical to SEQ ID NO: 574361

SEQ ID NO: 729955 - RNA, 64 nt, hsa; identical to SEQ ID NO: 334399

SEQ ID NO: 729956 - RNA, 57 nt, hsa; identical to SEQ ID NO: 334400

SEQ ID NO: 729957 - RNA, 64 nt, hsa; identical to SEQ ID NO: 334401

SEQ ID NO: 729958 - RNA, 64 nt, hsa; identical to SEQ ID NO: 334402

SEQ ID NO: 729959 - RNA, 64 nt, hsa; identical to SEQ ID NO: 334403

SEQ ID NO: 729960 - RNA, 64 nt, hsa; identical to SEQ ID NO: 334404

SEQ ID NO: 729961 - RNA, 64 nt, hsa; identical to SEQ ID NO: 334405

SEQ ID NO: 729962 - RNA, 64 nt, hsa; identical to SEQ ID NO: 334406

SEQ ID NO: 729963 - RNA, 64 nt, hsa; identical to SEQ ID NO: 334407

SEQ ID NO: 729964 - RNA, 64 nt, hsa; identical to SEQ ID NO: 334408

SEQ ID NO: 729965 - RNA, 64 nt, hsa; identical to SEQ ID NO: 334409

SEQ ID NO: 729966 - RNA, 64 nt, hsa; identical to SEQ ID NO: 334410

SEQ ID NO: 729967 - RNA, 64 nt, hsa; identical to SEQ ID NO: 334411

SEQ ID NO: 729968 - RNA, 64 nt, hsa; identical to SEQ ID NO: 334412

SEQ ID NO: 729969 - RNA, 64 nt, hsa; identical to SEQ ID NO: 334413

SEQ ID NO: 729970 - RNA, 64 nt, hsa; identical to SEQ ID NO: 334414

SEQ ID NO: 729971 - RNA, 64 nt, hsa; identical to SEQ ID NO: 334415

SEQ ID NO: 729972 - RNA, 64 nt, hsa; identical to SEQ ID NO: 334416

SEQ ID NO: 729973 - RNA, 64 nt, hsa; identical to SEQ ID NO: 334417

SEQ ID NO: 729974 - RNA, 64 nt, hsa; identical to SEQ ID NO: 334418

SEQ ID NO: 729975 - RNA, 64 nt, hsa; identical to SEQ ID NO: 334419

SEQ ID NO: 729976 - RNA, 64 nt, hsa; identical to SEQ ID NO: 334420

SEQ ID NO: 729977 - RNA, 64 nt, hsa; identical to SEQ ID NO: 334421

SEQ ID NO: 729978 - RNA, 64 nt, hsa; identical to SEQ ID NO: 334422

SEQ ID NO: 729979 - RNA, 64 nt, hsa; identical to SEQ ID NO: 334423

SEQ ID NO: 729980 - RNA, 64 nt, hsa; identical to SEQ ID NO: 334424

SEQ ID NO: 729981 - RNA, 64 nt, hsa; identical to SEQ ID NO: 334425

SEQ ID NO: 729982 - RNA, 64 nt, hsa
auaguuuccacuuuaaagggaagaagggacuuuaacauccuaugaauuugaaacauccuaugaa

SEQ ID NO: 729983 - RNA, 64 nt, hsa
ggaagaagggacuuuaacauccuaugaauuugaaacauccuaugaauuugaaaguuuccuaagu

SEQ ID NO: 729984 - RNA, 64 nt, hsa
uuuaaaacucagauuuaaaacaagggguuacuuuacauccuacuaagaaguuuaaguaaguaag

SEQ ID NO: 729985 - RNA, 64 nt, hsa
gacugacuuuuuccauuuuuuaaauguucaugucacauccuaauagaaagaaauuacuucuagu

SEQ ID NO: 729986 - RNA, 64 nt, hsa
gccuuuauugauuuuacuuuuaugagucauuguagacaucuauaaauauaaaagggccuguacc

SEQ ID NO: 729987 - RNA, 64 nt, hsa
auugagaaacuauauacuucucagagaaauaucugacaucuauugucauuccauugcuauuuuu

SEQ ID NO: 729988 - RNA, 64 nt, hsa
uguauguuugcauauuauagcucucuuuaagacagacaucuaaaaagauuuugguuauucuggg

SEQ ID NO: 729989 - RNA, 64 nt, hsa
uggucuuagaauccaugucagauuggugcuuccagacaucuauucccaguccaucagagugaaa

SEQ ID NO: 729990 - RNA, 64 nt, hsa
uacugaauuaaaggauuaaauuaggugacauggugacaucuaucccuuuauuuugacacuaaaa

SEQ ID NO: 729991 - RNA, 64 nt, hsa
uagguaguaauuuguucaaaagcgguuuuagccagacaucuaguugcaguguucaagaggauua

SEQ ID NO: 729992 - RNA, 64 nt, hsa
ucgcuggaaggucuuugacggcaccaucuggaaggacaucuacaaucaggagugguggaaccuc

SEQ ID NO: 729993 - RNA, 64 nt, hsa
agccucgggccacauggguccacugcaccagugugacaucuacaacuccaagauugccgggaag

SEQ ID NO: 729994 - RNA, 64 nt, hsa
gugcuaaucucacauuuagccaugauagaugaugguucuagaguguacuuccauuuguaagucc

SEQ ID NO: 729995 - RNA, 64 nt, hsa
uauuuuagcaaauauuauauuucaugacaauggaguucuagaaagcagcaucuguuuuuuguug

SEQ ID NO: 729996 - RNA, 64 nt, hsa
ucguauguaugaggaguuagggauggggagucaaguucuagaaaguuuugucugaaaaccuuug

SEQ ID NO: 729997 - RNA, 64 nt, hsa
agcuauacugcaaaaguauaauguuuuuggaacuguucuagagcauaccaugaaaagcaguuug

SEQ ID NO: 729998 - RNA, 64 nt, hsa
aauugauagacccaaaaaauauaauuuaaucaaaguucuagaguuuuuguuuguuuguuugaga

SEQ ID NO: 729999 - RNA, 64 nt, hsa
cauuacaggcaugagccaccaugccuggcccaaaguucuagaauuuuuuaaagguauucauggu

SEQ ID NO: 730000 - RNA, 64 nt, hsa
cugugucucauucaccaugaugcuuccugaggguguucuagaagcccguuccccaguggcugua

SEQ ID NO: 730001 - RNA, 64 nt, hsa
ucuuuuugucacuguuaauuucugggcugcugagguucuagaauagaagggcugccaaaugagg

SEQ ID NO: 730002 - RNA, 64 nt, hsa
uggggcagucugcagauguuugaaguaguuuaguguucuagaaagagcuauuacuguggauagu

SEQ ID NO: 730003 - RNA, 64 nt, hsa
cuugucuuacaccgugcugccauuaaaggcagcuguucuagaguuucagucaccuaaguacacc

SEQ ID NO: 730004 - RNA, 64 nt, hsa
auuuuuuuaaagggggaggggaaggcuuuaauguguucuagaucaauuuauaccuuccguauga

SEQ ID NO: 730005 - RNA, 64 nt, hsa
ccauagaaagaugggguuguuuuccaaaguuuaaguucuagaucacaauaucuuagcuuuuagc

SEQ ID NO: 730006 - RNA, 64 nt, hsa
uucuguaaaggcacuuugugguuuuuccaaagauguucuagaucuauuugguugcucuauaguc

SEQ ID NO: 730007 - RNA, 64 nt, hsa
ucuguguacauuccuuucauaggguagaguucuaguucuagaaguucuuauuuuguuuuuguug

SEQ ID NO: 730008 - RNA, 64 nt, hsa
agucacagcugucuaggccucggugcuggccuggguucuagaucucugggaaccagugccugag

SEQ ID NO: 730009 - RNA, 64 nt, hsa
cauuccauaaaucaguggugagugacuggccuggguucuagaccucugggaaccagcaccugag

SEQ ID NO: 730010 - RNA, 64 nt, hsa
gaauucuggaucacccaagaggaaaagacuggcaguucuagauuccucuauauggggagaccug

SEQ ID NO: 730011 - RNA, 64 nt, hsa
uucucaacucagccaacugaguagcaaaucauuuguucuagaccaccuaaggagggaagguuau

SEQ ID NO: 730012 - RNA, 64 nt, hsa
ccugcaccccagcauuccagcucugcccccgcggguucuagacgccccucccaagcguuccugg

SEQ ID NO: 730013 - RNA, 64 nt, hsa
cccucggccuccgaggcuccccgccuccacucuaguucuagaugagugggaggcgugccccccu

SEQ ID NO: 730014 - RNA, 64 nt, hsa
ggauucuuuccccagaggcucccaaucagcuuuuguucuagacuuccccaucccgaagccauca

SEQ ID NO: 730015 - RNA, 64 nt, hsa
ucuguguuucuggagugauucuagagggagacuuguucuagagaggaccagguuugaugccugu

SEQ ID NO: 730016 - RNA, 64 nt, hsa
uagcaaaacaucuuuuccugauggcuggcaggcaguucuagaagccacagugcccaccugcucu

SEQ ID NO: 730017 - RNA, 64 nt, hsa
gaggccaagauggguggaucaccugaggucaggaguucuagaucagccuggccaacauggugaa

SEQ ID NO: 730018 - RNA, 64 nt, hsa
gaaaauuuucaaugagcuuuuucuaacuucucaaguucuagagaaagaauuaaccaacugauga

SEQ ID NO: 730019 - RNA, 64 nt, hsa
uccaagcagacaggauuccgucaguugugauagaguucuagauuggcaaugcaguuacauuguu

SEQ ID NO: 730020 - RNA, 64 nt, hsa
aaugcaguuacauuguuucuucuuugaaaauaaaguucuagacauauaaaacaggauaccacua

SEQ ID NO: 730021 - RNA, 61 nt, hsa
gguggcagcguggagggcucggcguggauggcagccucaggacacacaccccugccucaag

SEQ ID NO: 730022 - RNA, 61 nt, hsa
aggaagccucggccucccugagcucugaccccagccucacccgaaaggccagccuggggcu

SEQ ID NO: 730023 - RNA, 61 nt, hsa
ugaggucccgggcuuagugugagcaucuugccagccucaggcuugagggagggcugggcua

SEQ ID NO: 730024 - RNA, 61 nt, hsa
gacaaagguaaaucagccagccaggcacccacagccucagcuccugugcaguuccugggca

SEQ ID NO: 730025 - RNA, 61 nt, hsa
aggguccccucugggagaaacagcuucaccccagccucagggcccugggccaucacugcag

SEQ ID NO: 730026 - RNA, 61 nt, hsa
cacuacggccauucuccucuugggcgcuccucagccucacugugaccuuucugccagagcu

SEQ ID NO: 730027 - RNA, 61 nt, hsa
uuuggaccuaacaucucgcacgugacucccucagccucagagccuugggaugcagagcagc

SEQ ID NO: 730028 - RNA, 52 nt, hsa
gcaaccgcgacuucagcugaggcagccucacagccugccaucuggugccucc

SEQ ID NO: 730029 - RNA, 61 nt, hsa
ggaagcccucuuuccccaaauccuacucccucagccucaggcaguggugcucccaucuucc

SEQ ID NO: 730030 - RNA, 61 nt, hsa
aaaaagaacucaaccaauuuggcaccccaugcagccucaaaauguuucaaaugccuaccgc

SEQ ID NO: 730031 - RNA, 61 nt, hsa
ccaagcuucaaggaagugcuugggggacccccagccucauccucuuaguugggucucuugu

SEQ ID NO: 730032 - RNA, 61 nt, hsa
ucuugacccugcauauccaggaaggaacugccagccucagaggaggcagcaccgagggugc

SEQ ID NO: 730033 - RNA, 61 nt, hsa
ugcucagcagccagucucagagaccagcacucagccucauucagcauggguccuugaugcc

SEQ ID NO: 730034 - RNA, 61 nt, hsa
ccccagcuggagcuggcugagagcaguccugcagccucauuccuuaguucccggagcuggc

SEQ ID NO: 730035 - RNA, 61 nt, hsa
ucucuguuccccagcccaccuggcucacacacagccucauggguagggucagcaaaccaga

SEQ ID NO: 730036 - RNA, 61 nt, hsa
gaggcugcccccucacccagaagucugagcccagccucaggaggggccaagaaccaggggg

SEQ ID NO: 730037 - RNA, 61 nt, hsa
auuucaggcuggaaaacuaucaguaugaucucagccucaguucucuugucuguaaaaugga

SEQ ID NO: 730038 - RNA, 61 nt, hsa
gacuacuuaccacaucaaaucugggcccaaacagccucaguuaacugcauaauucaggaac

SEQ ID NO: 730039 - RNA, 61 nt, hsa
gaugucucuacuugcucuaugagccuuuugccagccucagaauaggcgagguaaccuugaa

SEQ ID NO: 730040 - RNA, 61 nt, hsa
ggaucucuguggggcucuucaccaauuuuuccagccucauuuauaguaaacaaauuguucu

SEQ ID NO: 730041 - RNA, 61 nt, hsa
gagauggaaucuuagaucgucccccaugugccagccucauucgaauucuacucuuugguua

SEQ ID NO: 730042 - RNA, 52 nt, hsa
uuagcauggaagaggagugaggcagccucacugugugcccucagggauacga

SEQ ID NO: 730043 - RNA, 59 nt, hsa
caagacagcuggugccuuaagaauuggcccagccucagauccugucuuuagcaaccagc

SEQ ID NO: 730044 - RNA, 61 nt, hsa
ucuguauuucugugugguuguagcaaggacucagccucauguagcacgaauaggggugugg

SEQ ID NO: 730045 - RNA, 61 nt, hsa
ccgccucccgguucaagccauucuucugccucagccucagcgaguagcugagacuaccggc

SEQ ID NO: 730046 - RNA, 61 nt, hsa
cugugccagaagcaacagaggugccaggccucagccucacccacagcagccccaucgccaa

SEQ ID NO: 730047 - RNA, 61 nt, hsa
accaaagaaaugaagcuggcaagcuacuuuucagccucaagcuuuacacagcuguccuuac

SEQ ID NO: 730048 - RNA, 61 nt, hsa
acucccaccacaggcauaagcuaucaccuagcagccucaaaacgggucaguauuaagguuu

SEQ ID NO: 730049 - RNA, 61 nt, hsa
uguagcuccuccugacaaacgucugggaaaacagccucaccccacucuccucucucuuccc

SEQ ID NO: 730050 - RNA, 61 nt, hsa
uaaaccagaaggaagcccucucagaucaccccagccucacuccauuucccacuuccacccc

SEQ ID NO: 730051 - RNA, 61 nt, hsa
gacuuugucccuucuaauuauuaucucuuuccagccucauucagcuauucuuacugacaua

SEQ ID NO: 730052 - RNA, 61 nt, hsa
uuucuaaauauaauaaaaacuuaccuggcaucagccucauaccuaaaacuccugacucuua

SEQ ID NO: 730053 - RNA, 61 nt, hsa
cacacacuggcacagggaggcuacaacuaagcagccucagaucuguaaaguugauuggugc

SEQ ID NO: 730054 - RNA, 61 nt, hsa
cuggcgaugagccauuuauugugucucacaccagccucauuuccaacuccgacuuccuacu

SEQ ID NO: 730055 - RNA, 61 nt, hsa
acuuuauccugcuauaacuuuauccucuucccagccucaucccuguuuuucuguuagggca

SEQ ID NO: 730056 - RNA, 61 nt, hsa
gucugcaaacaggucccugccuuuuuagaagcagccucauggucucaugcuuaaucuuguc

SEQ ID NO: 730057 - RNA, 61 nt, hsa
ucgaggcagggaaaagccaucuauucuucugcagccucaggagcgagacuucaaggacuca

SEQ ID NO: 730058 - RNA, 61 nt, hsa
agagccccuucugcaucuuauucacagcuugcagccucagccccuuugaugaggcccucag

SEQ ID NO: 730059 - RNA, 61 nt, hsa
ccuuguugcucuaacaguccagauguacacccagccucagggggaaggcagcucucuccag

SEQ ID NO: 730060 - RNA, 61 nt, hsa
cucccuugugauuucugagggucaccacugccagccucaggcaacauagagagccuccugu

SEQ ID NO: 730061 - RNA, 61 nt, hsa
ccagagaggggcagguagaccugcauagcagcagccucagcagcugucuugguaaaggaga

SEQ ID NO: 730062 - RNA, 61 nt, hsa
ggccugucuguccuccucccuaauucagacccagccucaagaggaaagggaguaaaauaaa

SEQ ID NO: 730063 - RNA, 61 nt, hsa
caucagaaccuggcagccccaaaacuggggucagccucagggcaggagucccacuccucca

SEQ ID NO: 730064 - RNA, 61 nt, hsa
ucuguggcguuguguuauugguagacacccucagccucaucauuugacuaccuauguacua

SEQ ID NO: 730065 - RNA, 61 nt, hsa
aguuuauugucaauugcuucucaagucuaaccagccucagcagugugcauagaccauuucc

SEQ ID NO: 730066 - RNA, 61 nt, hsa
ccuuggguucagcccaucugggcucaaauuccagccucaccacucacaagcugugugacuu

SEQ ID NO: 730067 - RNA, 61 nt, hsa
gggcuauaggagccucccacuuucaccagagcagccucacugugcccugauucacacacug

SEQ ID NO: 730068 - RNA, 61 nt, hsa
aguaacucccacuccuaaucaagagucucuccagccucacagaugcuggccucuuggcacc

SEQ ID NO: 730069 - RNA, 61 nt, hsa
cuaugccuaguggagccacagugccucccugcagccucaacaccacccugcuguccagucc

SEQ ID NO: 730070 - RNA, 61 nt, hsa
cagccucaggauggggaauagccaagaauggcagccucagcgcagaggcaaggucagaaag

SEQ ID NO: 730071 - RNA, 61 nt, hsa
agccacuuagugcuuuguccuggacuccacucagccucaggauggggaauagccaagaaug

SEQ ID NO: 730072 - RNA, 50 nt, hsa
agcgcuaccugcggaaauaacagccucagccggggccaccagcacugcug

SEQ ID NO: 730073 - RNA, 61 nt, hsa
ugucuaccaacuccucauagugagccagaagcagccucauaacccugaauguggggcucug

SEQ ID NO: 730074 - RNA, 61 nt, hsa
ggaaucuuuagcgcucaauaggaccaggauccagccucacuucuaggguaugggaaaucca

SEQ ID NO: 730075 - RNA, 61 nt, hsa
uuguuuaugcaacucuaucuuaagaacugcccagccucagcugaaaacccgaaucugagaa

SEQ ID NO: 730076 - RNA, 61 nt, hsa
ggagaaggcauuccaggguugaaucuugucccagccucagccugggacaccuagguggaga

SEQ ID NO: 730077 - RNA, 61 nt, hsa
ugccgucagccgaacuuuguuauggagggagcagccucacacaagcagaaacacuccugug

SEQ ID NO: 730078 - RNA, 61 nt, hsa
ccuguggcuagaggaacaccagcacaaacgacagccucaagucuccuucgagcuuuguaaa

SEQ ID NO: 730079 - RNA, 61 nt, hsa
ccuuaaaaagggcuucuuggaacuuuaccagcagccucagcuuuacaaaugccuugguaug

SEQ ID NO: 730080 - RNA, 61 nt, hsa
ucuuuuuuuuuuuuuuuuguaucugcacuugcagccucagcuuucacacuucagcccuuaa

SEQ ID NO: 730081 - RNA, 61 nt, hsa
ccagaggguggggcuggcagaacaccaucuccagccucagcuuugaccugucucauuuccc

SEQ ID NO: 730082 - RNA, 61 nt, hsa
uuccauggcccuggauggucuggcccaccuccagccucagcuagcauuacccuucugacac

SEQ ID NO: 730083 - RNA, 61 nt, hsa
uggccaagauuuccuucuguaucacuccaagcagccucagcagaagaagcagccaugccca

SEQ ID NO: 730084 - RNA, 61 nt, hsa
uccggccugcugucaagucccccagcagaaccagccucaaaaacgcccucaagaacaugau

SEQ ID NO: 730085 - RNA, 61 nt, hsa
gcaaccacacagggauauuucugcuaugcaccagccucacuccaccuuccuuccaucaaaa

SEQ ID NO: 730086 - RNA, 61 nt, hsa
uucccaggugggcccacucacaugguauugccagccucacuggucagccucgccucccagc

SEQ ID NO: 730087 - RNA, 61 nt, hsa
uauuacuuccccucugauaggacauuguagccagccucagcacucagugaguucaucaggg

SEQ ID NO: 730088 - RNA, 61 nt, hsa
agcugucucaucaccaaauagguagucaaggcagccucaucuccccaggugaggggcgggu

SEQ ID NO: 730089 - RNA, 61 nt, hsa
ccauaaccaccccugggaaacacaucauucccagccucaggcccugcuggaauuggggcug

SEQ ID NO: 730090 - RNA, 61 nt, hsa
ucccuaggaggacccaccaguggagcacaugcagccucaguggagaugcuuggugugggga

SEQ ID NO: 730091 - RNA, 61 nt, hsa
uuaacccccaaguaaucauuaacccccagaccagccucagaacugaaggagauuguugacc

SEQ ID NO: 730092 - RNA, 61 nt, hsa
guugacugugagcaaagugucuuccgauuagcagccucagggaugcccugguggccucucc

SEQ ID NO: 730093 - RNA, 61 nt, hsa
cucagucuucagauagacaguaagaagaaagcagccucauugauccgcagauguaggggcc

SEQ ID NO: 730094 - RNA, 61 nt, hsa
guguaguccauagcccagccagaugagcuugcagccucauaggaggucagcaccuugcaaa

SEQ ID NO: 730095 - RNA, 61 nt, hsa
uccuuuaaccagcacagccaguuaaaagaugcagccucacugcuucaacgcagauuuuaau

SEQ ID NO: 730096 - RNA, 61 nt, hsa
aaccucugccuccuggguucaagugauucuccagccucagccucccgaguagcugggauua

SEQ ID NO: 730097 - RNA, 61 nt, hsa
ugcaacucuguguaccaagaaccccuagcaucagccucauuccuaagccaauaacgccugu

SEQ ID NO: 730098 - RNA, 61 nt, hsa
aucuucuggugcccacggccauuggcauugccagccucauuccaugccacuaugagucaac

SEQ ID NO: 730099 - RNA, 61 nt, hsa
caaaccuguuaguuuuacuucugcauugaaccagccucagaagcuacuuacugcuuuaugu

SEQ ID NO: 730100 - RNA, 61 nt, hsa
ugcugggauugcaggcaugagccaccgugcccagccucaaaaauauuuuuuaaaagaaaag

SEQ ID NO: 730101 - RNA, 61 nt, hsa
caugacccccaagcagauauaacaagcugugcagccucaguaggcugcuugcccucuccag

SEQ ID NO: 730102 - RNA, 61 nt, hsa
uuuuuuguguggaacagcucaccuugucagacagccucagggcaucucugagacacagggg

SEQ ID NO: 730103 - RNA, 61 nt, hsa
caaccccaucucccacucagaaaucaccucccagccucaggaagaguagaaauuggguggu

SEQ ID NO: 730104 - RNA, 61 nt, hsa
ccccucaggagggauugcaggccccagguggcagccucagagaggaggcgcaggcaggccc

SEQ ID NO: 730105 - RNA, 61 nt, hsa
uuuugcuuuucagugucuucucagaaacaaccagccucaaagguaauuaaacucucauuua

SEQ ID NO: 730106 - RNA, 61 nt, hsa
ggcagggccgccuucagaggcugcagggccucagccucaggaugcauuuaauguauccugg

SEQ ID NO: 730107 - RNA, 61 nt, hsa
gauccuuugagguaaaaaaacauaaugucuucagccucauaauaaaggaaaguuaauuaaa

SEQ ID NO: 730108 - RNA, 61 nt, hsa
ccagccuucuuccaucccaggacaccacacccagccucaguccuccccucacagccucuga

SEQ ID NO: 730109 - RNA, 61 nt, hsa
gccguuggaccuucaccuccuagagauaaaccagccucagcuggcgcagcggggcccuucu

SEQ ID NO: 730110 - RNA, 61 nt, hsa
ugagggucaccggcaggugggcugguggcugcagccucagagcccucccagguugcugcug

SEQ ID NO: 730111 - RNA, 61 nt, hsa
gcacagcccugcaccccgccccugggguuggcagccucaguuggccccuggcagaggaaca

SEQ ID NO: 730112 - RNA, 61 nt, hsa
uuucuucaugguggggggccauuuggaaugacagccucacuuccuucugauggcuacaucu

SEQ ID NO: 730113 - RNA, 61 nt, hsa
agguuuauuucugugaguuuuguaugaaaaucagccucauuauuuauaguugaauuuuugc

SEQ ID NO: 730114 - RNA, 61 nt, hsa
cucucucccuccuaccaccugccaguuuccccagccucagccccagccccagccccagugg

SEQ ID NO: 730115 - RNA, 61 nt, hsa
ugcugggauuacagggaugagccaccgcgcccagccucaucucuuuguucuaaagauggaa

SEQ ID NO: 730116 - RNA, 61 nt, hsa
ucuugucuggaagaguucugcaggaaauggccagccucaaacgacaauucacggaacuguu

SEQ ID NO: 730117 - RNA, 61 nt, hsa
caucugaaaggcccaaaccagggggaagcaccagccucagugcagcccccuccugacccca

SEQ ID NO: 730118 - RNA, 61 nt, hsa
ggccauacccaugugucgccucucacucuggcagccucagaggccccuugcugcuggcucc

SEQ ID NO: 730119 - RNA, 61 nt, hsa
uugucugugaguuacgggcaaccagccucuucagccucacacccauuccccugagagcaag

SEQ ID NO: 730120 - RNA, 61 nt, hsa
uuugaguucuggguauccucccuuucuguaacagccucaaauaaagguguaccuuccaugu

SEQ ID NO: 730121 - RNA, 61 nt, hsa
aaauccgcaagcugggugugcuuugagugugcagccucacaaacauggccuuuucucucuc

SEQ ID NO: 730122 - RNA, 61 nt, hsa
uugcuaaauagauuauaauacacaaggaaagcagccucaaagaauuaccccucccaaaaug

SEQ ID NO: 730123 - RNA, 61 nt, hsa
uguuacauaugaacauucauuuuuaaaugcucagccucaagugcaggcauuuuugaguggc

SEQ ID NO: 730124 - RNA, 61 nt, hsa
uaaugccauaagucuagauugccucaugaagcagccucauuugaauugcuuucauagcuuu

SEQ ID NO: 730125 - RNA, 61 nt, hsa
auggaacaagagaaguacuaucuuuguguugcagccucaaccaacaacaauguguuguaaa

SEQ ID NO: 730126 - RNA, 61 nt, hsa
gacugaaaauucauugcaauuagggaacgcacagccucacaaaaagugguugugauugcaa

SEQ ID NO: 730127 - RNA, 61 nt, hsa
cuggcacugucauuuguaaaugccauugucacagccucauuuguaagcagcacugccucuc

SEQ ID NO: 730128 - RNA, 61 nt, hsa
ucucgagacgcacaugcacgccugggcguggcagccucacagggaacacgggacagacgcc

SEQ ID NO: 730129 - RNA, 61 nt, hsa
uguuuacugugcugcugcacugguccuaugccagccucacccauguggggaccacggaagg

SEQ ID NO: 730130 - RNA, 61 nt, hsa
aguaaaaaagguaggaaaucccuaaaacuuccagccucacauagcacgguucucaccuguc

SEQ ID NO: 730131 - RNA, 61 nt, hsa
aagaugguggaagacauaggcuaaauuucuccagccucacaauggucuucacuuggucuga

SEQ ID NO: 730132 - RNA, 61 nt, hsa
agaagauuccuggauggagaccccauugguucagccucaagucuggcccgucuucgaaaaa

SEQ ID NO: 730133 - RNA, 61 nt, hsa
ccuggccagaagcaggagugugaggaggagacagccucagcggacaagcagcuggugcucc

SEQ ID NO: 730134 - RNA, 61 nt, hsa
gaauucuagcaaccuuuguuaggaaaaagcacagccucagauggaggcagccuaaacugug

SEQ ID NO: 730135 - RNA, 61 nt, hsa
uucagcuguuucaccaucagucaaugaauaacagccucauugaugucaaaaacuucaauau

SEQ ID NO: 730136 - RNA, 61 nt, hsa
cauguuggccaggcuggucuugaacuccuggcagccucaagugauccacccaccucggucu

SEQ ID NO: 730137 - RNA, 61 nt, hsa
gccagagggguuggccaguuggagccugggucagccucagcagccuauccccauguccucu

SEQ ID NO: 730138 - RNA, 61 nt, hsa
auuuagugcacaguggccccaucauagccugcagccucaucauuucccaucuggaccuggu

SEQ ID NO: 730139 - RNA, 61 nt, hsa
ucaaagcuaauuuuuuacuaaaguuuuuauacagccucaaauuguuuuauuaaaaaaaaga

SEQ ID NO: 730140 - RNA, 61 nt, hsa
uccacgcagguggcuuguagaaaccuuugggcagccucaugucugcuaaaacagccaucuu

SEQ ID NO: 730141 - RNA, 61 nt, hsa
gaaagguaauuuuaagcuaacaaccagugcacagccucagguuuuaaauuacaaccacagu

SEQ ID NO: 730142 - RNA, 61 nt, hsa
gacccagcccuauuuuacgucauucuaaauucagccucauauaaugaaaauacauuaugaa

SEQ ID NO: 730143 - RNA, 61 nt, hsa
uggagugcaguggcacaaugacgacucacugcagccucaaccuccuggggccaagugaucc

SEQ ID NO: 730144 - RNA, 61 nt, hsa
ugggaccuuuguaggaagagacacaguccugcagccucauauggcucaauaaaacagaaag

SEQ ID NO: 730145 - RNA, 61 nt, hsa
agcgcuuucagcuggaccacucaggccuggacagccucaucuccaugaggcuggugcuucg

SEQ ID NO: 730146 - RNA, 61 nt, hsa
uggccucuucuugcuuugaccuggcagauaucagccucaacauugaguaugcaccucucug

SEQ ID NO: 730147 - RNA, 61 nt, hsa
ucccaguccagacgggugcugccggcucagccagccucacgcugcuaggaaauggcucccu

SEQ ID NO: 730148 - RNA, 61 nt, hsa
aaccuccuacccaugucugagguagcaagugcagccucacgacagauaccaggcaauccag

SEQ ID NO: 730149 - RNA, 61 nt, hsa
aguagggaacauggcagagaguggugcuucccagccucacaaugugggaauuugacauagg

SEQ ID NO: 730150 - RNA, 61 nt, hsa
aggccauucuccuucucuuccauggagaauccagccucacaaaaggauucuuucaacuucu

SEQ ID NO: 730151 - RNA, 61 nt, hsa
agagauggaggagccccaguggcugacaggccagccucacucaggcacguaccugcugacc

SEQ ID NO: 730152 - RNA, 61 nt, hsa
acauacaaggacagugggucauggguaguaccagccucaaauucccacaggcucauacuca

SEQ ID NO: 730153 - RNA, 61 nt, hsa
acaugcaugcacaugaaaacaugcacaaccacagccucaaucuuguauuuaguuuggggaa

SEQ ID NO: 730154 - RNA, 61 nt, hsa
ugacagcccagugucggccuggccgggugggcagccucaggucuugagaggauaagacucu

SEQ ID NO: 730155 - RNA, 61 nt, hsa
cgcagcagugacuacaauaguugcaccagggcagccucagcccuugcagccaguaagaaau

SEQ ID NO: 730156 - RNA, 61 nt, hsa
cuggcaacugugagucccugcuucccgacaccagccucauggaauaugcaacaacuccugu

SEQ ID NO: 730157 - RNA, 61 nt, hsa
cuguggaccagagugcuugaggcaucucaggcagccucagcccaagcuucuaccugccuuu

SEQ ID NO: 730158 - RNA, 61 nt, hsa
cuggagcagaauaagucuaaaggcagagccccagccucagagacaaauaggcuucaucaug

SEQ ID NO: 730159 - RNA, 61 nt, hsa
cauuuaaguuggcuugaaucucaucagcaggcagccucaugcaaccaugagggauaguaug

SEQ ID NO: 730160 - RNA, 61 nt, hsa
acccucccacagcacauccuacccggaagaccagccucagaggguccuucuggaaccagcu

SEQ ID NO: 730161 - RNA, 61 nt, hsa
ucacuguauacucuugcugagaauguggaugcagccucacagaucuuugcaacacuccaac

SEQ ID NO: 730162 - RNA, 61 nt, hsa
aaguauuuccagcaggaaguaaugucuuccucagccucaaccagggaccaaccggcugcuu

SEQ ID NO: 730163 - RNA, 61 nt, hsa
guaccguaaagaauauaucuuaucuggagcucagccucaaucaugucuuaacaaaaugaca

SEQ ID NO: 730164 - RNA, 61 nt, hsa
cccuuauggugcccugugcagggugccaccacagccucauuuuacagacagcccccugagg

SEQ ID NO: 730165 - RNA, 61 nt, hsa
gacuggaugugccgugggcagugccuuccuccagccucacaaccuuucugcuggggcugaa

SEQ ID NO: 730166 - RNA, 61 nt, hsa
cccuccuggcuucagcauccugcagguagagcagccucauuccuucacaagauggaaggca

SEQ ID NO: 730167 - RNA, 61 nt, hsa
acuauuaaggguguuagucuuggagaagacacagccucaccuucucacuugcuguggguga

SEQ ID NO: 730168 - RNA, 60 nt, hsa
gagauuuagauucacugugaaugaaaagcacagccucagaauaaaagaugauuucucaaa

SEQ ID NO: 730169 - RNA, 61 nt, hsa
uuuuaacuugggggugaaagauuuaagaacucagccucacuagaucaacggaccaaauaaa

SEQ ID NO: 730170 - RNA, 61 nt, hsa
aguacaggucugguacaaucacaguucauugcagccucaaccuccuggguuuaagcagucc

SEQ ID NO: 730171 - RNA, 61 nt, hsa
cacaaaaggaacaaaagcgaaacacacaaaccagccucaacuuacacuugguuacucaaaa

SEQ ID NO: 730172 - RNA, 61 nt, hsa
ucagguucuuagugucacuuaccuagauuuacagccucacuugaaugugucacuacucaca

SEQ ID NO: 730173 - RNA, 61 nt, hsa
caccauguugcccaggcuggucucaaacccccagccucaacugauccucgcaucucagccu

SEQ ID NO: 730174 - RNA, 61 nt, hsa
caccugcuggguucaagcaauucuccugccucagccucaugaguagcugugacuacaggca

SEQ ID NO: 730175 - RNA, 61 nt, hsa
cagaagcugcauuucagcugaaucuguguuucagccucaguugguugcaccguuagccccu

SEQ ID NO: 730176 - RNA, 61 nt, hsa
ucacagaagcgaaggcuugaugcugucucagcagccucagcugugggggggaagcgcgugu

SEQ ID NO: 730177 - RNA, 61 nt, hsa
gccgugagccaaguaaaccucuuuaauuacccagccucaggugcuccgggaacgccuuccg

SEQ ID NO: 730178 - RNA, 61 nt, hsa
cgaagauguuguacuccaccgccugcaccaacagccucaguguuacuucccaggauuugcu

SEQ ID NO: 730179 - RNA, 61 nt, hsa
uuuguaauauuuguccacuaagcuggagaagcagccucauacaguugauuuuguguaugug

SEQ ID NO: 730180 - RNA, 61 nt, hsa
gcuugggcaauucagggcagaacuccuguaucagccucauggacacccagaauugguaucu

SEQ ID NO: 730181 - RNA, 61 nt, hsa
acagcccaaccucuggcagaccagggguuaccagccucacagcugcagcugccuucaagcc

SEQ ID NO: 730182 - RNA, 61 nt, hsa
ugccccagcagacacaggcugccagucccuccagccucaccuccccgcccugggcagcagg

SEQ ID NO: 730183 - RNA, 61 nt, hsa
uagguaugugcaguucccggccccugccacccagccucaugcaagucauccccgacaugac

SEQ ID NO: 730184 - RNA, 61 nt, hsa
gaacgggaccuaggggacagcagcaccacuccagccucagagacugcacacccccuugccu

SEQ ID NO: 730185 - RNA, 61 nt, hsa
cugugauuuuuuuuaaaugugcaguacacaucagccucacugagcuaauaaagggaaacga

SEQ ID NO: 730186 - RNA, 61 nt, hsa
uuggcagucgaggagucagaacucggauucccagccucacucccucuguguguguugacca

SEQ ID NO: 730187 - RNA, 61 nt, hsa
aauauucuuuuuuuuuucuagaaacugggggcagccucaaaaucauguuaaagagggaguu

SEQ ID NO: 730188 - RNA, 61 nt, hsa
gugaccggagagaaagaggagcccucccgcucagccucagaagcagacucugaagccggag

SEQ ID NO: 730189 - RNA, 61 nt, hsa
cugccucccggguucaagcaauuucuugccucagccucaugaauagcugggauuacaggug

SEQ ID NO: 730190 - RNA, 61 nt, hsa
aaucaaaaguauuuuauaaaaggagaaagaacagccucauuuuagauguaguccuguugga

SEQ ID NO: 730191 - RNA, 61 nt, hsa
aaccuccgccucccggguucaagcgauucuccagccucagcuuccugaguagaugggauua

SEQ ID NO: 730192 - RNA, 61 nt, hsa
cugccucccggguucaagcaauucccugccucagccucaugaauagcugggauuacaggug

SEQ ID NO: 730193 - RNA, 61 nt, hsa
cucccugucuccaacuccaguaagcccuccucagccucaccuuacgaauccaaagaacugg

SEQ ID NO: 730194 - RNA, 61 nt, hsa
uagaguacaauauugcaaucacagcucacugcagccucaaacuccugggcucaagugaucc

SEQ ID NO: 730195 - RNA, 61 nt, hsa
uagcggguuggggguggugguggggugcuggcagccucaggagcgaucgcuccccuggaga

SEQ ID NO: 730196 - RNA, 61 nt, hsa
guggggcucauaaaacaugaaucaagcaauccagccucaugggaaguccuggcacaguuuu

SEQ ID NO: 730197 - RNA, 61 nt, hsa
uggagugcgcuggcuugaucuuggcucacugcagccucaauguccccaggcucagauuguc

SEQ ID NO: 730198 - RNA, 61 nt, hsa
aacguggucaacucacaccugccucuuccugcagccucacuucuaccugcccccaucauaa

SEQ ID NO: 730199 - RNA, 61 nt, hsa
cccauguacagacacgguccccacacccucccagccucaggcccaggcagacaugggcgag

SEQ ID NO: 730200 - RNA, 61 nt, hsa
aauggggcugugugcaugcaggcccauguuucagccucagcccacgccaggugaaaggauc

SEQ ID NO: 730201 - RNA, 61 nt, hsa
uuugagugugccaggguaaaggcuuccaguucagccucaguuauuuuagacaaucucgcca

SEQ ID NO: 730202 - RNA, 61 nt, hsa
ucccuugaguucaggugcccugaacucaguacagccucaucuucucauccaccaccuucuc

SEQ ID NO: 730203 - RNA, 61 nt, hsa
acggccuccugaacguccguccucaggagcacagccucacggacagugccaaacccugugg

SEQ ID NO: 730204 - RNA, 61 nt, hsa
agacauugucucugucggccaggcuggagugcagccucaaccuccuggguccaagugaucc

SEQ ID NO: 730205 - RNA, 61 nt, hsa
cagcgccccuccucccugagggagcauggcacagccucacacuugaaagacgguguuuggu

SEQ ID NO: 730206 - RNA, 61 nt, hsa
ccgugccaggacucagcaguggccuggacaacagccucagcuuccucuacccaucuucuuu

SEQ ID NO: 730207 - RNA, 61 nt, hsa
aucuuacucccagcaccaaaagguaauugaccagccucaacacaauuuuggacaaagcuag

SEQ ID NO: 730208 - RNA, 61 nt, hsa
aguuuuuagcccuugagaggacauacuuuuccagccucauggguauggcacucuuaauuaa

SEQ ID NO: 730209 - RNA, 61 nt, hsa
gaaagugggguccuucggggcgaugcucccucagccucagaggagcucuacccugcucccu

SEQ ID NO: 730210 - RNA, 61 nt, hsa
ggccaaggaacacccccuaguccugacacugcagccucaagcagguacgcuguacauuuuu

SEQ ID NO: 730211 - RNA, 61 nt, hsa
ccacgggcucuccugggcuuauggccggucacagccucagugugacuccacaguggccccu

SEQ ID NO: 730212 - RNA, 61 nt, hsa
agucucugcccuauacgccgccuucacuccacagccucaccccucccacccccauacuggu

SEQ ID NO: 730213 - RNA, 61 nt, hsa
guaauuaccgagcaaggucugagcucuucuucagccucaguucccucauugguuaaaaggg

SEQ ID NO: 730214 - RNA, 61 nt, hsa
auggguguccacagcacuggcccccucuccccagccucagcugcuguccgccugaucuguc

SEQ ID NO: 730215 - RNA, 61 nt, hsa
aaccaaaauuagauucaacuauucauauuaucagccucauuuuauggaaaagggaugccac

SEQ ID NO: 730216 - RNA, 61 nt, hsa
agccaggugcccaggacagaagccccagccccagccucaucuacaccccaggagcccuggc

SEQ ID NO: 730217 - RNA, 61 nt, hsa
cagcccaugcccuggagggcauuccccuggccagccucagccccuugucuacuuguucucc

SEQ ID NO: 730218 - RNA, 50 nt, hsa; identical to SEQ ID NO: 110858

SEQ ID NO: 730219 - RNA, 61 nt, hsa
uucaggccaaaaccagggaagauucuagcuucagccucauguccauuuccagucugucagc

SEQ ID NO: 730220 - RNA, 61 nt, hsa
uaugccuucaucagcgugaccccugugccugcagccucauagguguuaaucuguaauuuua

SEQ ID NO: 730221 - RNA, 61 nt, hsa
ggagugcaguggugcagucuguagcucacugcagccucaaacuccuaggcucaggcgaucc

SEQ ID NO: 730222 - RNA, 61 nt, hsa
gaagauccuuggcugccgcuuucucuccccacagccucaaggccacccuaccgucauauau

SEQ ID NO: 730223 - RNA, 61 nt, hsa
ccuagggaagaagcaagaaacuucggggcugcagccucaggaugaggcagaaggaagggua

SEQ ID NO: 730224 - RNA, 61 nt, hsa
agauggucucucuucucaaguaggaacaccccagccucagacagacacagcaggaaggggc

SEQ ID NO: 730225 - RNA, 61 nt, hsa
caacagcccacuguuaggagguaguagaccccagccucaaggcucugaccuucuucaugug

SEQ ID NO: 730226 - RNA, 61 nt, hsa
caccauguuacucaggcuggucucaaacucccagccucaagcgaugcucccaccuccaccu

SEQ ID NO: 730227 - RNA, 61 nt, hsa
uugcucacccaagggggcugcuuaacacaaacagccucagacccgagguuuagauuucuga

SEQ ID NO: 730228 - RNA, 61 nt, hsa
gaucucgaacucccgaccucaggugauccgccagccucagccucccaaagugcugggauua

SEQ ID NO: 730229 - RNA, 61 nt, hsa
aaccuccgccuccuggguucaagcgauucuccagccucagccuccugaguagcuggaauua

SEQ ID NO: 730230 - RNA, 61 nt, hsa
cucucauccucccgccgcccgucaggccggccagccucacaucagucucuccgccccgggg

SEQ ID NO: 730231 - RNA, 61 nt, hsa
cagccaaaguccccccaccccuucagagaagcagccucaaauuccagaaguggaggcucca

SEQ ID NO: 730232 - RNA, 61 nt, hsa
gccaccaaccgaaccgugaauguagggcccccagccucaccucugccccaggaccaacaac

SEQ ID NO: 730233 - RNA, 61 nt, hsa
agccuguugcuguacuuuucugcuuauuuuacagccucaaauauuucucauuaucuuguca

SEQ ID NO: 730234 - RNA, 61 nt, hsa
cagccccucaggaacccucauccuucaaagacagccucauuucggacuaaacucauuagag

SEQ ID NO: 730235 - RNA, 61 nt, hsa
uuucuuucucaccauagaucggcgggugcugcagccucacuguguucuguguacgugacaa

SEQ ID NO: 730236 - RNA, 61 nt, hsa
uguguaauugugacacaauuacagcugauugcagccucaaccuucccagcucaagugaucc

SEQ ID NO: 730237 - RNA, 61 nt, hsa
auuuugcuugcucauauuucuggccaauguacagccucauauuuuucagaguaauacagau

SEQ ID NO: 730238 - RNA, 61 nt, hsa
gugacucuuguuacagaucauggcggugcgucagccucacaggagacauagcaggucucag

SEQ ID NO: 730239 - RNA, 61 nt, hsa
gauggaaaaguguagggacugagaagggcugcagccucagcaguguacagaguccccggcg

SEQ ID NO: 730240 - RNA, 61 nt, hsa
acagcucucagccuaagagcgcagcacugaacagccucaucauuccacuuuucaugggaaa

SEQ ID NO: 730241 - RNA, 61 nt, hsa
gcugcucacugcucacacgcugccuccucagcagccucacugcaucuuucucuucccaugc

SEQ ID NO: 730242 - RNA, 61 nt, hsa
acagccugagccuucagcccucacagaugcccagccucauagcugaaguugccugaaugau

SEQ ID NO: 730243 - RNA, 61 nt, hsa
aaaaaguguuagugcuuccaggcggcacugacagccucaguaacaauaaaaacaaugguag

SEQ ID NO: 730244 - RNA, 61 nt, hsa
aggguggugaugguaguuucuacccauaccucagccucaggcgaguggcuuauagccucca

SEQ ID NO: 730245 - RNA, 61 nt, hsa
uucagcuuggguacacacacagaggagaccucagccucacaccagaaauauuauuuuuuua

SEQ ID NO: 730246 - RNA, 61 nt, hsa
uuccaugaaugaccccucagucuggccuccccagccucaagguccacucaggcacaagagc

SEQ ID NO: 730247 - RNA, 61 nt, hsa
caugccgugugccuuuaguuagcacagcgggcagccucagugaaacucuuagguuaagcag

SEQ ID NO: 730248 - RNA, 61 nt, hsa
augacaugauuaaaugaugaauuuauuuugucagccucagcaacaaacauuuccuaaaugg

SEQ ID NO: 730249 - RNA, 61 nt, hsa
guauaguuacgaugccagauuagauuuauagcagccucaaguuguauuaaaugauauuuug

SEQ ID NO: 730250 - RNA, 61 nt, hsa
ggucagauaaaugaagaucaaacuccagcuccagccucauuugcuugagacuuugugugua

SEQ ID NO: 730251 - RNA, 61 nt, hsa
ggucauucuugucacaaaagugccacuaaaacagccucaggagaauaaaugacuugcuuuu

SEQ ID NO: 730252 - RNA, 61 nt, hsa
ugcuuuuacaguggacagccucuucucguuucagccucaguauuauguagggaccuuaugc

SEQ ID NO: 730253 - RNA, 61 nt, hsa
ccuacuuguaauuaacuugaguuguaguccacagccucaggacaaaugucguugagguuac

SEQ ID NO: 730254 - RNA, 61 nt, hsa
ccaguggcagucucagguuaagaaggaaaugcagccucaguaacuuccuuuucaaagcagu

SEQ ID NO: 730255 - RNA, 61 nt, hsa
uccacacacacaucucacgccccuggucucacagccucacaccuuguccuuccaccccugc

SEQ ID NO: 730256 - RNA, 61 nt, hsa
gcaaacagcgcaauuccaagcucgagagcuucagccucaggaaagaacuuccccuucccug

SEQ ID NO: 730257 - RNA, 61 nt, hsa
auaucacuuugcucuuaccauuccuuuugaucagccucaauucagccucauuguguaguau

SEQ ID NO: 730258 - RNA, 61 nt, hsa
cucuuaccauuccuuuugaucagccucaauucagccucauuguguaguauguuuuuucuuu

SEQ ID NO: 730259 - RNA, 61 nt, hsa
agaugugugcuccuggagggaaaaagaaauacagccucaacagauuaaaaaacaaaaguca

SEQ ID NO: 730260 - RNA, 61 nt, hsa
acaaaacugugucuuaucugccaggaaagaccagccucacuccugggaacugucuggcagg

SEQ ID NO: 730261 - RNA, 61 nt, hsa
agaggcggaacugcuguguccucauguggcgcagccucaaacuggcauccaggcacugggc

SEQ ID NO: 730262 - RNA, 61 nt, hsa
agauuuuauuauguuaguuuaaaaggucaaucagccucaugacuuuauaguuaugucuugu

SEQ ID NO: 730263 - RNA, 61 nt, hsa
aggcuuaugggucuccagaaacucugccagccagccucaguggagaagcuuccucuaccac

SEQ ID NO: 730264 - RNA, 61 nt, hsa
caaggucccuugaaucccaaaagugccuccccagccucagcccccaccuccagccacacac

SEQ ID NO: 730265 - RNA, 61 nt, hsa
cuccugaugaugaagacugaagguguagacucagccucacucuguacaagugggugugcuc

SEQ ID NO: 730266 - RNA, 61 nt, hsa
ccuaaguaagaacauaauguaaaauugucagcagccucauggggaggaaaaaggaagaguc

SEQ ID NO: 730267 - RNA, 61 nt, hsa
guccucacuggugcuccaggggaagaaacgacagccucacuucuguauggacugcugaugu

SEQ ID NO: 730268 - RNA, 61 nt, hsa
gaaacguugggguuucuuccuccagugacagcagccucaguagcuuuccugggcuccaggc

SEQ ID NO: 730269 - RNA, 61 nt, hsa
cuccaugcucaccagcagccgcccaggcccgcagccucacccggcucccucuccucacccu

SEQ ID NO: 730270 - RNA, 61 nt, hsa
aggaauaaagcugugagcaaacagaggaggccagccucaccucauuccaacaccugccaua

SEQ ID NO: 730271 - RNA, 61 nt, hsa
cagggugugaugaggugggagcccucagugccagccucaucacugugugacccugggucug

SEQ ID NO: 730272 - RNA, 61 nt, hsa
ucauccccuuauaaaugugcuuugccugccucagccucauggucagagcaguggagacugg

SEQ ID NO: 730273 - RNA, 61 nt, hsa
gcuguaauugaacgggucgagaugccgaccucagccucacaggccaaagcaucagcaccag

SEQ ID NO: 730274 - RNA, 61 nt, hsa
cggcacaucuaacaucuacacuucucuagcucagccucacaggccaaagcaucagcaccag

SEQ ID NO: 730275 - RNA, 61 nt, hsa
augggcucgugagcacacucagugcccagcccagccucaaggugagccccgggcccaggcu

SEQ ID NO: 730276 - RNA, 61 nt, hsa
cugaaccuccuccuccagccucaccuuccuccagccucaccacuccucccuggaccugcag

SEQ ID NO: 730277 - RNA, 61 nt, hsa; identical to SEQ ID NO: 110868

SEQ ID NO: 730278 - RNA, 61 nt, hsa
agucaggcuagcugugcugguauuggaauagcagccucacacuggcgucuggacuguucug

SEQ ID NO: 730279 - RNA, 61 nt, hsa
ugcgaaguccagaguccaggguggagcgcgccagccucagccagagcagccacgacagcca

SEQ ID NO: 730280 - RNA, 61 nt, hsa
caggggagggugcgugggggcgguguggcugcagccucagucccugccccuccagcccaca

SEQ ID NO: 730281 - RNA, 54 nt, hsa
gugaagaccaagcagcgugaccuucagccucaagcaggaagaacaaaaaaucaa

SEQ ID NO: 730282 - RNA, 61 nt, hsa
gaucuggagucucugaacucuuaauaggaugcagccucacauacauaaugucacccauuuu

SEQ ID NO: 730283 - RNA, 61 nt, hsa
gugcugggagaugaucagaaaucucagggcacagccucaggucuaccuggacacucaucca

SEQ ID NO: 730284 - RNA, 61 nt, hsa
uugguuucacuaagggccaugugguucccugcagccucaugccuggccccuugacacaucc

SEQ ID NO: 730285 - RNA, 61 nt, hsa
ugugacucccuucaggcaguccuuuaguccccagccucaccuuugcucucaaugucaugca

SEQ ID NO: 730286 - RNA, 54 nt, hsa
ucaaggcccuuccccagugagcggcagccucaggggccucaggggagcccccac

SEQ ID NO: 730287 - RNA, 61 nt, hsa
uuuuguuaaaaaaaaaaaaaaaaaaaggaaacagccucacuuuuuugugcucccucagaau

SEQ ID NO: 730288 - RNA, 61 nt, hsa
gagcuacaggggcacuuaacccaccacagcacagccucaucaaaaugcagcuggcaacuuc

SEQ ID NO: 730289 - RNA, 61 nt, hsa
cauacuucuuuuuuuuccucugaugugaauccagccucagacugagugaacuguaauaauu

SEQ ID NO: 730290 - RNA, 61 nt, hsa
gugcuagucccagaggaugcugcggagggggcagccucagcucucuuuucagagaagauca

SEQ ID NO: 730291 - RNA, 61 nt, hsa
gaaggaucaccugagccuaggaguucaagaccagccucagcaacagcaggagccccacccc

SEQ ID NO: 730292 - RNA, 61 nt, hsa
cuacuguccaugcggccucacugggggccaucagccucaccagcaaagcagagaugagagc

SEQ ID NO: 730293 - RNA, 61 nt, hsa
ugcagugagccaagaucgcgccacugcacuccagccucagcaauagagugagacugucuca

SEQ ID NO: 730294 - RNA, 61 nt, hsa
uagagugcaguggcaugaucagggcuuacugcagccucacccucgauuuccugggcucaag

SEQ ID NO: 730295 - RNA, 61 nt, hsa
aagaaaacgaaaacaguuuaaaucucuaccacagccucacaagcaaaugcuaaggggaaca

SEQ ID NO: 730296 - RNA, 61 nt, hsa
aggccucacauucguggggcucccugaauggcagccucagcacagcguaggcccuuaauaa

SEQ ID NO: 730297 - RNA, 61 nt, hsa
aaggagaggaguagaugagauggaauuuuuccagccucauccuggccugcccucuagacuc

SEQ ID NO: 730298 - RNA, 61 nt, hsa
ggugggcgcauagguacaagugcugcuuugucagccucacucccugcagcucucagcuccc

SEQ ID NO: 730299 - RNA, 61 nt, hsa
ccacagaggccucccagggcucucggccagucagccucagaaugagaguuacaccacuggc

SEQ ID NO: 730300 - RNA, 61 nt, hsa
uggagugcaguggcaugaucauggcucacugcagccucaaccuccagggcuuaagcaaucc

SEQ ID NO: 730301 - RNA, 61 nt, hsa
uuuuaaaaaggaaggguagacucacuuagcucagccucacccaugcuaagggcacaugcac

SEQ ID NO: 730302 - RNA, 61 nt, hsa
uggagugcaguggcaugaucauagcucacugcagccucauacuccugggcucaagcaaucc

SEQ ID NO: 730303 - RNA, 61 nt, hsa
ugauggaggugacaucaggcagaggagagugcagccucacagugacuuucucagaggugac

SEQ ID NO: 730304 - RNA, 61 nt, hsa
cgucacucuuggaggacuccugugacguggucagccucauucauccuugcccuucucaggg

SEQ ID NO: 730305 - RNA, 61 nt, hsa
ugccuuugcugggccuucugugcaggacgcucagccucagggcucagaaggugccaguccg

SEQ ID NO: 730306 - RNA, 61 nt, hsa
gguggauugcuugagcucgggaguuugagaccagccucaucaacacagugaaacuccaucu

SEQ ID NO: 730307 - RNA, 61 nt, hsa
aaccagugcaugcaccugguuggaagaugcucagccucacaaaagcuccaagcccuuuggg

SEQ ID NO: 730308 - RNA, 56 nt, hsa
aacgagacgacgaagauuaauuaaggcagccucauagucaaucccaguugcuuuuc

SEQ ID NO: 730309 - RNA, 61 nt, hsa
auuuuaaauuagcuuuucuaaaaaaaaaauccagccucauaaaguagauuagaaaacuaga

SEQ ID NO: 730310 - RNA, 61 nt, hsa
guaugcaugcauuuucaagcaaguaauaaagcagccucauuuaauucuggauaaugcuggg

SEQ ID NO: 730311 - RNA, 61 nt, hsa
caaaacucuuuauggcauuuuacaaugcacacagccucaugcaaguuuagacaaguggauu

SEQ ID NO: 730312 - RNA, 61 nt, hsa
uggagccguuccaucccggagcuuggaggggcagccucaggugugugccugggcaccgcuc

SEQ ID NO: 730313 - RNA, 61 nt, hsa
cgagggacguguguuccccagcugaucgugucagccucaugccccaggccucaucuuucau

SEQ ID NO: 730314 - RNA, 61 nt, hsa
cgaggggcguguguuccccagcugaucaugucagccucaugccccaggccucgucuuucau

SEQ ID NO: 730315 - RNA, 61 nt, hsa
gggccuuuggguggggagggcccgggccggacagccucagcuccguccccugccccacaag

SEQ ID NO: 730316 - RNA, 61 nt, hsa
auccccugguggcuucagcaguccuuaucaccagccucacaaucccacaggcccaccccca

SEQ ID NO: 730317 - RNA, 61 nt, hsa
uguguggggaggauccaucccccacccacugcagccucacaccgaguccaccuuggacaug

SEQ ID NO: 730318 - RNA, 61 nt, hsa
gagggccaucagaaggaagccaaagaguucacagccucagcaccaacaacucaacaugguc

SEQ ID NO: 730319 - RNA, 61 nt, hsa
uuauguuuccuaaaggaaauuguuuauucuacagccucaguagguagacacaaacauaaag

SEQ ID NO: 730320 - RNA, 61 nt, hsa
ugguauaaucuccauuucaaaaccaaggaagcagccucagaguggucgagugacacaccuc

SEQ ID NO: 730321 - RNA, 61 nt, hsa
cugugcuaagccugccacgggcguauccuugcagccucacaacagugggaggucuguaucc

SEQ ID NO: 730322 - RNA, 61 nt, hsa
guaugcugcacaagcguguacacccccugggcagccucaaaaccccgcuuacagcagcaac

SEQ ID NO: 730323 - RNA, 61 nt, hsa
ggggccccucccugccucggcucugccgccccagccucaguuccugcuucuggucuucucc

SEQ ID NO: 730324 - RNA, 61 nt, hsa
gggcuugcccacccaccccgaccccagcccccagccucagccccgguccgggggcagccag

SEQ ID NO: 730325 - RNA, 61 nt, hsa
agccugcccugcgguccugucaccuggaggccagccucacaugcccaaaucuccagucucc

SEQ ID NO: 730326 - RNA, 61 nt, hsa
uggggugcccgcugccuguccuccgugaaaccagccucagaucagggcccugccacccagg

SEQ ID NO: 730327 - RNA, 61 nt, hsa
gcgugaccuuggcucacugcaaccuccaggccagccucagccucccuaguagcugggacua

SEQ ID NO: 730328 - RNA, 61 nt, hsa
ugauaagcaagaaagauuucaucucccaccccagccucaaguaggaguuuuauauacugug

SEQ ID NO: 730329 - RNA, 61 nt, hsa
acauguugccugagcugguuaaccacaucggcagccucagcuaccacaacauacugacuaa

SEQ ID NO: 730330 - RNA, 61 nt, hsa
aucucuugauaaaggagagguuaaagcaaaccagccucagcggaccacucuucucuccaag

SEQ ID NO: 730331 - RNA, 61 nt, hsa
uuccaguauggccccaccauguuugucccuccagccucagccaagcaacauggggugaacc

SEQ ID NO: 730332 - RNA, 61 nt, hsa
agugagcagccuggagcccuggagaccccaccagccucaccagcgcuugaagccugaaccc

SEQ ID NO: 730333 - RNA, 61 nt, hsa
cacccugccagcagcuuccggccaguccccacagccucaucagcucucuucaccguuuuuu

SEQ ID NO: 730334 - RNA, 61 nt, hsa
ggccucucugggcccuacagccucacuuccccagccucaccuugcuguccucugacacugc

SEQ ID NO: 730335 - RNA, 61 nt, hsa
guuggaggcacuagggccucucugggcccuacagccucacuuccccagccucaccuugcug

SEQ ID NO: 730336 - RNA, 61 nt, hsa
cuggcagguggccaggcaggcgggggcugcucagccucauccugagagaccugcccucucu

SEQ ID NO: 730337 - RNA, 61 nt, hsa
gaguacuuucauacucuucuaaguccucuuccagccucacuuugaguccuccuugggguug

SEQ ID NO: 730338 - RNA, 61 nt, hsa
gcuuacccacugccugcccagacuuucuauccagccucacugagcugcccacuacuggaag

SEQ ID NO: 730339 - RNA, 61 nt, hsa
ugaacugguuuuggucccucuaaugauccuccagccucaucuaaugccccccaaagacuga

SEQ ID NO: 730340 - RNA, 60 nt, hsa
agaaauccgggcagcagugacacuggccuccagccucaaucuguuccguagcucagagcc

SEQ ID NO: 730341 - RNA, 61 nt, hsa
ggcuuucugaguccuguuggccaccaagugucagccucagcacucccgggacuauugccaa

SEQ ID NO: 730342 - RNA, 61 nt, hsa
uuauuuuuuacuuuaaaugccugccaaggagcagccucaagcccagagaagacugaggcua

SEQ ID NO: 730343 - RNA, 61 nt, hsa
agcaagccuccuuugugcuauguggagcucacagccucacaugugaacacccgugucuggg

SEQ ID NO: 730344 - RNA, 61 nt, hsa
cuguagcacaggcaaugccagugccaugcugcagccucagaaaccaggccucucacuccag

SEQ ID NO: 730345 - RNA, 61 nt, hsa
caccugccggcaguagcccccacgcuggccccagccucagaccccacccagcaccuuccca

SEQ ID NO: 730346 - RNA, 59 nt, hsa
acgucucuuucuauucaauaaacagaugcugcagccucauggcccucaccucuuuggac

SEQ ID NO: 730347 - RNA, 61 nt, hsa
augacguguuuggcuguuggcucaccgagaccagccucaucucggggaaccugcaccgcau

SEQ ID NO: 730348 - RNA, 61 nt, hsa
ucucauugcugcuguugaguucagcuuuuaccagccucaguguggaggcuccaucccagca

SEQ ID NO: 730349 - RNA, 61 nt, hsa
aaagagauuuugaaaaccaauuguauuuaaccagccucaaauugugcaaccaugauguaua

SEQ ID NO: 730350 - RNA, 61 nt, hsa
gccaggaggcuguuccaggaguccugcccagcagccucaguggccaagcccagacacucac

SEQ ID NO: 730351 - RNA, 61 nt, hsa
augauauugcaaaagugauacuuagauuuuacagccucaguagucugcccaguguccacau

SEQ ID NO: 730352 - RNA, 61 nt, hsa
gcagcuaacacgcccgggguggccacagcgccagccucagacuggagggcaagggguuccc

SEQ ID NO: 730353 - RNA, 61 nt, hsa
uuuucuccugcaggguacugggccaggcccucagccucagagagccugcagaagggcuugg

SEQ ID NO: 730354 - RNA, 61 nt, hsa
gacgcgacgcgaugccucccggccaccgccccagccucaccccaucccacgacccccgcaa

SEQ ID NO: 730355 - RNA, 61 nt, hsa
cuaguauguucugacaucuggcuucccuucucagccucauguccaccugccugccagccag

SEQ ID NO: 730356 - RNA, 61 nt, hsa
cuacaccacacacaacagccaacagcuacaacagccucacuuggucugccaggcccccacc

SEQ ID NO: 730357 - RNA, 61 nt, hsa
aagugaaugggucucaaagacuuggugaccccagccucaucuucuaggccuuuuccaccca

SEQ ID NO: 730358 - RNA, 61 nt, hsa
aggccacuucucaagcagcuuuuggcaccuucagccucagaguggaaucuuuuaaagacag

SEQ ID NO: 730359 - RNA, 61 nt, hsa
cuggugguugccucccguccugggcaggcugcagccucaugccaugucucucucccacuac

SEQ ID NO: 730360 - RNA, 61 nt, hsa
cagcguucgcccuuuagcggggaggucauuacagccucauggccucuaccaaggccccaga

SEQ ID NO: 730361 - RNA, 61 nt, hsa
acuucgcuucagccuccggaccauuccggagcagccucacauaccucacugucucgucugu

SEQ ID NO: 730362 - RNA, 61 nt, hsa
aaccuccgccuccuggguucaagcgauucuccagccucagccucccgaguagcugggauua

SEQ ID NO: 730363 - RNA, 61 nt, hsa
cacuaguucuuaacauuguaaaaaguuugaccagccucagaaggcuuucucuguguaaaga

SEQ ID NO: 730364 - RNA, 61 nt, hsa
aaacugggccgauguggugugacauccccaccagccucagaugagacgggccaggacgccc

SEQ ID NO: 730365 - RNA, 61 nt, hsa
augaacaagucuguaaagcucagacauuugucagccucaacagcaccacccauucaagcau

SEQ ID NO: 730366 - RNA, 61 nt, hsa
caauuuguaaagccacauuugcauaugaugccagccucacgcauuuguauaucuccagaaa

SEQ ID NO: 730367 - RNA, 61 nt, hsa
gcuaccccuccuggccacccaguacucccuccagccucagcuggcugaaccucgccgcucc

SEQ ID NO: 730368 - RNA, 61 nt, hsa
aaaaagaacuagcagagggccugggcucuuccagccucagugugccucucuggccgcccac

SEQ ID NO: 730369 - RNA, 61 nt, hsa
ucuaauucuggcaggaccucaccaaaagauccagccucauaccuacaucagacaaaauauc

SEQ ID NO: 730370 - RNA, 61 nt, hsa
cugaaggcgagggguggaggaggccccagcacagccucaucuccauguguacacgugugua

SEQ ID NO: 730371 - RNA, 61 nt, hsa
cgcaguuggggcugaggcuggggcuggcugccagccucaguucugggagcgcuggggucgc

SEQ ID NO: 730372 - RNA, 61 nt, hsa
ccugaggggagacagagcaaccccuggaccccagccucaaauccaggacccugccaggcac

SEQ ID NO: 730373 - RNA, 61 nt, hsa
cuuuccuaggcacauucguccacuaagggaacagccucagaaacugguacagcaaugggug

SEQ ID NO: 730374 - RNA, 61 nt, hsa
gggagauucaggaucccccugugccagagcacagccucaccggaugcugcuucccacacug

SEQ ID NO: 730375 - RNA, 61 nt, hsa
aaccuccgucuccuggguucaagugauucuccagccucagccucccgaauagcugggauua

SEQ ID NO: 730376 - RNA, 61 nt, hsa
guugggaagccuuccgucugcggugggcaggcagccucacccugggcccacagaccggccu

SEQ ID NO: 730377 - RNA, 61 nt, hsa
ugucauuguuccuuccccagaagcuaagagccagccucagagccuacccaggagcugugaa

SEQ ID NO: 730378 - RNA, 61 nt, hsa
caggaucagguuagggcgagcgcuaccucuccagccucagcucucaguugcagcccugcug

SEQ ID NO: 730379 - RNA, 61 nt, hsa
ggcauguuauggggaggggaggggguucuuccagccucaggucccagcugucucacguugu

SEQ ID NO: 730380 - RNA, 61 nt, hsa
ucccagccacuuucccuccuggcacugccaccagccucaccgccugcgggcagggggaggc

SEQ ID NO: 730381 - RNA, 61 nt, hsa
uccucucagcuccgccccauacccgucacuacagccucaccucccaccccugucacuacgg

SEQ ID NO: 730382 - RNA, 61 nt, hsa
acuacggccucaccucccaccccugucacuacagccucaccuccuacagccuuaaguccca

SEQ ID NO: 730383 - RNA, 61 nt, hsa
cccacgugguugucccgggaaagcugccccacagccucagcaucuucagcacuuaccgauc

SEQ ID NO: 730384 - RNA, 61 nt, hsa
gacguccugugugccaagugguuuauaugcccagccucauuuaauccucagaaugacucca

SEQ ID NO: 730385 - RNA, 61 nt, hsa
uggccaggcccaaggacccagccaucaaaaccagccucaaaucugguugugauggagaagu

SEQ ID NO: 730386 - RNA, 61 nt, hsa
uagccgggccucaccccaccccuacccgccacagccucagggugugcaggggagccugcug

SEQ ID NO: 730387 - RNA, 61 nt, hsa
gugugaccuuaggaagucucugccccucucucagccucagugucccgagggccccgaagca

SEQ ID NO: 730388 - RNA, 61 nt, hsa
ugcacaccagccugggugacagugugagacccagccucaaaaaaaaaaaaaaaaaagugau

SEQ ID NO: 730389 - RNA, 61 nt, hsa
ggucucaaacuccugggcucaagcgaacugucagccucagccucccagugugcugggauua

SEQ ID NO: 730390 - RNA, 61 nt, hsa
acugcaccugggcagcuccucccugugcccccagccucagcccaacuucuuacccgaaagc

SEQ ID NO: 730391 - RNA, 61 nt, hsa
aagaguccccuuggguacaccccucugcccacagccucagcauuucuuggagcagcaaagg

SEQ ID NO: 730392 - RNA, 61 nt, hsa
gucuuggaccccacgagagagaaucguuccucagccucauggugaacucgcgcccuccagc

SEQ ID NO: 730393 - RNA, 61 nt, hsa
uucccgcacccagcaugcagcucugccuccgcagccucagugcgcuuuccugcgcgcacug

SEQ ID NO: 730394 - RNA, 61 nt, hsa
cguuccgguuauguuguguaagucaacucuucagccucauucacuguccuggcuuuuauuu

SEQ ID NO: 730395 - RNA, 61 nt, hsa
cagauauauacaaaugaaauuagaagaaacacagccucaugggacagaaauuugagggagg

SEQ ID NO: 730396 - RNA, 61 nt, hsa
gaagccuguguucuucaagagcagguguucucagccucacaugcccugccgugcuggacuc

SEQ ID NO: 730397 - RNA, 61 nt, hsa
agcgugagggugugucuucccuggauagcagcagccucagccucugccuguccagcgccaa

SEQ ID NO: 730398 - RNA, 61 nt, hsa
agagaugguuugaaggcccagucuucucucccagccucaguuggagccaaagcuuuguccu

SEQ ID NO: 730399 - RNA, 61 nt, hsa
agcccggccagggccuggugugaggcugggccagccucagcucagccucccccugcugcuc

SEQ ID NO: 730400 - RNA, 61 nt, hsa
ugcuggaauuacuggcgugagccaccaugcccagccucaaauauguuuuuaaaaaauauca

SEQ ID NO: 730401 - RNA, 61 nt, hsa
gcccagcagguaugggcaucugggaaaccuccagccucaaguguguuaguaacaugaaaaa

SEQ ID NO: 730402 - RNA, 61 nt, hsa
acuccuggcaacaucaggccaacguccaccccagccucacauugccagauguuggcagaag

SEQ ID NO: 730403 - RNA, 61 nt, hsa
uccgcgcccauuggugacccuuccaggcagacagccucagcaacgccccugguggacagga

SEQ ID NO: 730404 - RNA, 61 nt, hsa
gaacuccugggcuuaaaugacucuucugccucagccucaccaaaguguugggauuacuggu

SEQ ID NO: 730405 - RNA, 61 nt, hsa
gaggaccugagggugcucaaagggccaggcucagccucaagcaguguuuucauugccaaca

SEQ ID NO: 730406 - RNA, 61 nt, hsa
ucacauuguuccuccagaccgcagguucccccagccucagguugcuggagcugucacauga

SEQ ID NO: 730407 - RNA, 61 nt, hsa
cuugacugugucccagccagcaccaggccagcagccucaucccugccauucagggcuguuc

SEQ ID NO: 730408 - RNA, 61 nt, hsa
gguuugaccucugcccacauggccauggagucagccucagcccugucuguacugcucgucc

SEQ ID NO: 730409 - RNA, 61 nt, hsa
caaagaacaaucacuaaaaccacacucaccccagccucauugugccaagccuucugugaga

SEQ ID NO: 730410 - RNA, 61 nt, hsa
agggccuggcucacaugccccuccuuagaggcagccucaagaugaaccagggaaucaaacu

SEQ ID NO: 730411 - RNA, 61 nt, hsa
agcaggacuggggagagauccaggacugagccagccucaggccagggcgggaaagcaggcu

SEQ ID NO: 730412 - RNA, 61 nt, hsa
gccugcuucccaccucccugcccaggccggccagccucacccuugcgaaccgugagcagga

SEQ ID NO: 730413 - RNA, 61 nt, hsa
ucaguaucaaggcugccuggagaaaggauggcagccucagggcuuccuuauguccuccacc

SEQ ID NO: 730414 - RNA, 61 nt, hsa
cacagugcuccuccauaucaccagucauacacagccucauuauuaaggucuuauuuaauuu

SEQ ID NO: 730415 - RNA, 61 nt, hsa
ugcuacucucucccucuccaucccaucuuugcagccucauagggugggauacagcagcuuu

SEQ ID NO: 730416 - RNA, 61 nt, hsa
gaucuugaacuccugggcucaagcaaucugccagccucagccucucaaagugcugggauua

SEQ ID NO: 730417 - RNA, 61 nt, hsa
uagagugcaguggugcaaucucagcucacugcagccucaacugccccagguuuaagcaauc

SEQ ID NO: 730418 - RNA, 61 nt, hsa
augugugugucuacgugcagcucacuaccaacagccucaugugcacuugaccugacagugc

SEQ ID NO: 730419 - RNA, 61 nt, hsa
gaauaaggaacaagcauuauuccuuugccaacagccucacucuaagaggcuuuuuugcuga

SEQ ID NO: 730420 - RNA, 61 nt, hsa
ccggcagacccacccacccccuggggcugcucagccucaggcacggacagggcacaugaua

SEQ ID NO: 730421 - RNA, 61 nt, hsa
ucucucuuugcucucuuucucccuccccuaccagccucauucuuccuccgguagccucucc

SEQ ID NO: 730422 - RNA, 61 nt, hsa
guagccucucccaccuaaccucugcaucccccagccucauguccugccccaucccuauccu

SEQ ID NO: 730423 - RNA, 61 nt, hsa
aagacacuacgggaacaguuugccucccucccagccucaaccacaauucuuccaugcuggg

SEQ ID NO: 730424 - RNA, 61 nt, hsa
ugcuaugcaccacuugaaggagcucuaucaccagccucaaacccgaaagacugaggcauuu

SEQ ID NO: 730425 - RNA, 61 nt, hsa
aggacggcagggucauccugagccgccaaggcagccucagucagagcacccugaaguuuuu

SEQ ID NO: 730426 - RNA, 61 nt, hsa
ggaaagaaguucaguggucccauuguuaacucagccucaaaucucaacugucaggcccuac

SEQ ID NO: 730427 - RNA, 61 nt, hsa
accuggagauccugaacugucaagccacuggcagccucaugccaccacauuugccagaaau

SEQ ID NO: 730428 - RNA, 61 nt, hsa
gaaagugaugucagaauagcuuccaauaaagcagccucauucugaggccugagugauccac

SEQ ID NO: 730429 - RNA, 61 nt, hsa
gaaccuuggccugggccguaucuccggcucccagccucagcgcggcccucccgaguuaagg

SEQ ID NO: 730430 - RNA, 61 nt, hsa
cccagccaguccugagccucccgccaaaucccagccucacuaggugggacccccuucccag

SEQ ID NO: 730431 - RNA, 61 nt, hsa
uggagugcaguggugugaucacagcucacugcagccucaaccucugaaggcccagaugauc

SEQ ID NO: 730432 - RNA, 61 nt, hsa
aaaaugccauuuagcaauaaauaacacuugucagccucagagcauuuaaggaaacuagaca

SEQ ID NO: 730433 - RNA, 61 nt, hsa
ggucucaaacuccuaggcuuaagcaguccuccagccucagccuucucaaagugcuaggaug

SEQ ID NO: 730434 - RNA, 61 nt, hsa
uggagugcaguggcauaaucauaccucauugcagccucagacuccuggguucaagcaaucc

SEQ ID NO: 730435 - RNA, 61 nt, hsa
uggagugcagugacgacaucacagcucacugcagccucaaccuggguucaagugauccucu

SEQ ID NO: 730436 - RNA, 61 nt, hsa
aauuuuguauaaauauauagaaacacacacacagccucagacuuacaaacugauuauacuc

SEQ ID NO: 730437 - RNA, 61 nt, hsa
cccucuauccuaucauagauaacauucuccacagccucacuucauuccaccuauucucuga

SEQ ID NO: 730438 - RNA, 61 nt, hsa
uuacgcccuuccccuugaccuuguccugccccagccucacggacagccugcgcagggggcu

SEQ ID NO: 730439 - RNA, 61 nt, hsa
gcccaggaccccugaccccggccgcugcugccagccucagaaaggcacccaggugugcagg

SEQ ID NO: 730440 - RNA, 61 nt, hsa
gugaauaaaauucuuauugucuaaauugagacagccucagauauuugcagauauuuacuuu

SEQ ID NO: 730441 - RNA, 61 nt, hsa
gccccacucuguucccaagcaguucaugauacagccucaccuuuuggccccaucucugguu

SEQ ID NO: 730442 - RNA, 61 nt, hsa
auaguugggacaucagcugacuaauagaccucagccucaaaaggcuuggaaagaaaaaaca

SEQ ID NO: 730443 - RNA, 61 nt, hsa
uccuggcucugcaaaccccagacuuugcacacagccucaggcuccacacagaaaugugaac

SEQ ID NO: 730444 - RNA, 61 nt, hsa
gagagacccaaggaggaaaaacagacaaaaacagccucacagaagaauaugacagcugucc

SEQ ID NO: 730445 - RNA, 61 nt, hsa
ucaguucugccaucuuguuuucaaagggcuccagccucacucagucccuaauuaugggacu

SEQ ID NO: 730446 - RNA, 61 nt, hsa
augcuggccucaugggcuugggggccuacagcagccucaccuucagcuucaugccucuucc

SEQ ID NO: 730447 - RNA, 61 nt, hsa
ggcagguaugacaacucauccaguggaaacacagccucacacugcccuuccgccccccaca

SEQ ID NO: 730448 - RNA, 61 nt, hsa
uagagugcaauggugcaaucacagcucacugcagccucaaccuccuggguucaagcaaucc

SEQ ID NO: 730449 - RNA, 61 nt, hsa
ugcugagugcugaagcagugcgcaacacccucagccucaugcauuccugcggcauguauga

SEQ ID NO: 730450 - RNA, 61 nt, hsa
cagagcgcgcugugugugugugugugugugucagccucagagcgcgcgcugugugugugug

SEQ ID NO: 730451 - RNA, 61 nt, hsa
caucaucccuuccauugccacacccuagauccagccucaggaacuaacaaguuuugagaaa

SEQ ID NO: 730452 - RNA, 61 nt, hsa
uucgcauccugcagaagaguccuggugguggcagccucaccgcggcacacguucuagcuca

SEQ ID NO: 730453 - RNA, 61 nt, hsa
cagcaaagcugagacaaaauuggagaagcugcagccucacgcaccaucccccucuuuccac

SEQ ID NO: 730454 - RNA, 55 nt, hsa; identical to SEQ ID NO: 110882

SEQ ID NO: 730455 - RNA, 61 nt, hsa
cccguuccaagugcacugcccggccaagccccagccucagccugcgccugagcugcaugcg

SEQ ID NO: 730456 - RNA, 61 nt, hsa
ugguguguauucucaugugguuugcacagcccagccucacagcacuauuguaaacccugcu

SEQ ID NO: 730457 - RNA, 61 nt, hsa
uaaugaaaaaaaguaaaacuucguucuuuaucagccucaugccugaaucaaauuuuuaauu

SEQ ID NO: 730458 - RNA, 61 nt, hsa
uguggagggggcugcagggcugaccagcaggcagccucaucuggucgggggcgggggcggc

SEQ ID NO: 730459 - RNA, 61 nt, hsa
ccccgccuggagcccaggccaguguuguuuccagccucaggccacgggcuggacgggccug

SEQ ID NO: 730460 - RNA, 61 nt, hsa
uuuggagccgggucuagagggaacccucuaucagccucaggaaaacaagaccucugugcac

SEQ ID NO: 730461 - RNA, 61 nt, hsa
ccuguuugcauggagaaaugggcuggccccacagccucacaggagcaguuugugggcuggu

SEQ ID NO: 730462 - RNA, 61 nt, hsa
cagacucucugucgccaggcuucuccugccucagccucacgaguagcugggacuacaggca

SEQ ID NO: 730463 - RNA, 61 nt, hsa
ccuccccuaccagcucagccccgagcugccgcagccucaggcagaacggaggucaccuucu

SEQ ID NO: 730464 - RNA, 61 nt, hsa
augagaugcuuuuucuuaaugugauuuuguucagccucacuguuuuuaccuuaauuucaac

SEQ ID NO: 730465 - RNA, 61 nt, hsa
agugugggcugugcccuagccacaccacagccagccucagggagccacggcccgucuaguc

SEQ ID NO: 730466 - RNA, 61 nt, hsa
gugaacugucaucaccuggcaaccccagccccagccucagcccugcccccuuucccuccuu

SEQ ID NO: 730467 - RNA, 61 nt, hsa
cuagggccuuuuuucaauaacuugaaaaucacagccucaucauuagcaacuuuauauacac

SEQ ID NO: 730468 - RNA, 61 nt, hsa
aaccuccaccuccuggguucaagcgcuucuccagccucagccuccugaguagcugggauua

SEQ ID NO: 730469 - RNA, 61 nt, hsa
cccucaucuagucuugaccucuccagcaucccagccucagaagccuucuugcugcccacaa

SEQ ID NO: 730470 - RNA, 61 nt, hsa
gcuaagauuaaaauccgucucccauuuguuacagccucaccugcaccaggauagaaagcac

SEQ ID NO: 730471 - RNA, 61 nt, hsa
guuuguccugagccugcacuguccucgccugcagccucagaggggcaggcauccccgcaca

SEQ ID NO: 730472 - RNA, 61 nt, hsa
ggaauuagugcuggauuugaagcuacgcacucagccucaagaacucccuggaauaucccug

SEQ ID NO: 730473 - RNA, 61 nt, hsa
gaagccacaguacucaucugcagagggcuuacagccucagcaaggaccuuguggcuuugua

SEQ ID NO: 730474 - RNA, 61 nt, hsa
ucucucagccagcuguuuaagccugcggcgccagccucacggagggccgugugacacucuc

SEQ ID NO: 730475 - RNA, 61 nt, hsa
gauauagccaaugcuguuguagucguuuccucagccucaucucacugugcuguggucuguc

SEQ ID NO: 730476 - RNA, 61 nt, hsa
caucccccgcgugcucugagcaggcgccugccagccucaccugccgcucaggccucagagg

SEQ ID NO: 730477 - RNA, 61 nt, hsa
ugcugggauuacaggcgugagacacugcgcccagccucaucccugugaauuucuuauugua

SEQ ID NO: 730478 - RNA, 61 nt, hsa
guggaaaugccucuucuugguuuaaugagaccagccucagcugacucacagagcugcagag

SEQ ID NO: 730479 - RNA, 61 nt, hsa
cggcugcuucggaagcagacaucuggggacacagccucaguacccagucuuuucccuaguu

SEQ ID NO: 730480 - RNA, 61 nt, hsa
gcuggcugugaggccaccuuugucccaggcccagccucaaggcaaggagggcgcuucacug

SEQ ID NO: 730481 - RNA, 61 nt, hsa
uggagaacaguggcaccaucauagcucacugcagccucaaacuccugggcucaagcgaucc

SEQ ID NO: 730482 - RNA, 61 nt, hsa
uuuucacauugaaaaucagucagauuugcuucagccucaaagaggguguuuauguaaaacu

SEQ ID NO: 730483 - RNA, 61 nt, hsa
gcucauucugggcccuugcugccaaggagcccagccucaccuagcaggaaaggagaugaag

SEQ ID NO: 730484 - RNA, 61 nt, hsa
ugccgaggaagccgagugcccgccgccgcgccagccucagcccgcgcagaaugugcucgcu

SEQ ID NO: 730485 - RNA, 61 nt, hsa
cuuuccugcuucucugaaagcacaggucacccagccucagaaucacaccucccggcugcug

SEQ ID NO: 730486 - RNA, 61 nt, hsa
gaccucucaacacaguaugccaaguggauuccagccucauggccuagcaaaagaacagacu

SEQ ID NO: 730487 - RNA, 61 nt, hsa
uauuccuaggcaaagagccucauggcuaaggcagccucaaagccagccccuccucccaccu

SEQ ID NO: 730488 - RNA, 61 nt, hsa
aaccucugccucccagguucaagugcuucuccagccucagccucccaaguagcugagacua

SEQ ID NO: 730489 - RNA, 61 nt, hsa
gaccgggccccucucuagggaccccucgccccagccucauuccccauucugugucccaugu

SEQ ID NO: 730490 - RNA, 61 nt, hsa
uaaagaaaacuaaauccuucuguguccccggcagccucagugcagcaacagaagccaaggg

SEQ ID NO: 730491 - RNA, 61 nt, hsa
gaacccauuaccuucucccucauuucaggagcagccucagaacaaagugagacaguccagc

SEQ ID NO: 730492 - RNA, 61 nt, hsa
gagucaggaacccagacaaggaaucccauuccagccucaccccaaccaugaccuuggcaag

SEQ ID NO: 730493 - RNA, 61 nt, hsa
uaucauccauuguuuuucaagcacgugacaccagccucaaaguaaaugacaugaccagugg

SEQ ID NO: 730494 - RNA, 61 nt, hsa
cuccacauuccaaacagaguccugguuuccucagccucacccugcauagcuugcacaacau

SEQ ID NO: 730495 - RNA, 61 nt, hsa
aacacagucacuguugguuccuucugauccacagccucaucaguauuuggacuuuuuaaag

SEQ ID NO: 730496 - RNA, 61 nt, hsa
uuacuagaccaucuccauuuuuagcacuuggcagccucaugauccuuuuauaaaugugaga

SEQ ID NO: 730497 - RNA, 61 nt, hsa
cucagaaauaagccugagagaccaucuuuagcagccucagcacugccaggccugcccugaa

SEQ ID NO: 730498 - RNA, 61 nt, hsa
gagagaccaggagccaccucaaucagcaggacagccucacugccccucuugcagagucccc

SEQ ID NO: 730499 - RNA, 61 nt, hsa
acgugcauagaggucugggaggaccaggaaacagccucaguggccagaggaucaccagugc

SEQ ID NO: 730500 - RNA, 61 nt, hsa
guggccuuggcccagaaggagccagaggcagcagccucagccccagggacugggggcgauu

SEQ ID NO: 730501 - RNA, 61 nt, hsa
caagaaagccugaugaaguccagccgugcuccagccucacuuucccugcuuggaagcgugg

SEQ ID NO: 730502 - RNA, 61 nt, hsa
ugccacuuucaaagugguccccuggggagcucagccucauccugaugaugcugccaaggcg

SEQ ID NO: 730503 - RNA, 61 nt, hsa
caagcuggcccagccuggagcuggcgcugugcagccucaccccgggcaggggcggcccucg

SEQ ID NO: 730504 - RNA, 61 nt, hsa
cagggucuugcucugucucccaggcucacugcagccucaacguuuugagcugaagugaucc

SEQ ID NO: 730505 - RNA, 61 nt, hsa
gagcaucgccaggcugcugugggggcgggagcagccucagugucaagggcccgcccacuga

SEQ ID NO: 730506 - RNA, 61 nt, hsa
cccugcccccaggccccggcauugccaucagcagccucagcgucuccccggccaugugugc

SEQ ID NO: 730507 - RNA, 61 nt, hsa
ggggcggcugaugccagggcggcccgcggggcagccucacggaagggcccggugggacgug

SEQ ID NO: 730508 - RNA, 61 nt, hsa
gucccucaugucucuagauuuucucgucacccagccucaaaaauauaugugucugcaaccc

SEQ ID NO: 730509 - RNA, 61 nt, hsa
ccucuccgggaucaguccuaggacacaggcucagccucagguugaugggggaugaugugcu

SEQ ID NO: 730510 - RNA, 61 nt, hsa
ggccaggagcgcuggguucugcagcagggcucagccucaggggcguuaagacccuggauga

SEQ ID NO: 730511 - RNA, 61 nt, hsa
guggaggugcuccccacaguccgggccaggacagccucaggggagagugaaggccugcagg

SEQ ID NO: 730512 - RNA, 61 nt, hsa
ucacuuaggggccacuuccuaaguugcuguccagccucagugacccccuagugcuuccugg

SEQ ID NO: 730513 - RNA, 61 nt, hsa
gggugguccgggcacacugggccugccucuccagccucaggaugcucuuguuuauucuggg

SEQ ID NO: 730514 - RNA, 61 nt, hsa
uggaaugcagugguaugaucacggcucacugcagccucaaccuccugggcuaagugauccu

SEQ ID NO: 730515 - RNA, 61 nt, hsa
acccugccccuggugcccugagacagacacacagccucacgcccccaggaaugcaaguggu

SEQ ID NO: 730516 - RNA, 61 nt, hsa
gguucucauugguccagacgaggaagguauccagccucaagucaucauuguggccaggaag

SEQ ID NO: 730517 - RNA, 61 nt, hsa
caggggugggcgacacaggcagcuucuucggcagccucacggcagcaaccccagccuuccc

SEQ ID NO: 730518 - RNA, 61 nt, hsa
gcuggggugcaguggcgcgaucccagcacugcagccucaaccuccugggcucaagccaucc

SEQ ID NO: 730519 - RNA, 61 nt, hsa
gcgucccuguccuugaaggaccuccuucccccagccucaucaccgugcucuucucagcgcc

SEQ ID NO: 730520 - RNA, 61 nt, hsa
gcuccccaccagcacgcugaccugugaaccccagccucaccaucacccccagcacugccag

SEQ ID NO: 730521 - RNA, 61 nt, hsa
uaagaccaacugcguuggacaccauaagccacagccucacaggaagugggggugaggagcc

SEQ ID NO: 730522 - RNA, 61 nt, hsa
cuuuuucacaugggccacaguuucaguacuucagccucagugggguuccugauguuuaucu

SEQ ID NO: 730523 - RNA, 61 nt, hsa
accugaggcccuucucuccagccccuggaugcagccucacaguccuuaccagcagagcacc

SEQ ID NO: 730524 - RNA, 61 nt, hsa
caauccaguggacuucgcaguccacuucugacagccucagugacccuggcuccuugugcca

SEQ ID NO: 730525 - RNA, 61 nt, hsa
agagggggcugcggacacagcaggcccccuacagccucagguucugccugagcccagccua

SEQ ID NO: 730526 - RNA, 61 nt, hsa
aaauaugacucuuuuguaauuaacucauguacagccucauccuguauaguuuaaugaugaa

SEQ ID NO: 730527 - RNA, 61 nt, hsa
ccccccauagggggcagugucuuguuccugccagccucagugucuugcuucugccagcucc

SEQ ID NO: 730528 - RNA, 61 nt, hsa; identical to SEQ ID NO: 110891

SEQ ID NO: 730529 - RNA, 61 nt, hsa
ccuucucccagugcguuugacuuugucaggucagccucacuugucccuuucacaguuggcc

SEQ ID NO: 730530 - RNA, 61 nt, hsa
aggugaaacuuagauaucauggacuguuguccagccucaaugcuucauuuuccccuugcau

SEQ ID NO: 730531 - RNA, 61 nt, hsa
ggguugagaaggcuuugcugccaccuggugucagccucagucacuuucucugaaugcuucu

SEQ ID NO: 730532 - RNA, 61 nt, hsa
uacccuaguucugcccuuguuuguggaguuacagccucaagguuguagcaugugugcuggc

SEQ ID NO: 730533 - RNA, 61 nt, hsa
gaggacagccccccacuguucuccucaucuccagccucaguaguuggggguagaaggagcu

SEQ ID NO: 730534 - RNA, 61 nt, hsa
ucuagcagccuggacuccgcaguggcugugucagccucacccuucgugugcacccgcaugg

SEQ ID NO: 730535 - RNA, 61 nt, hsa
gcgcacgcgcgagugugcuguauggcccaggcagccucaaggcccucggagcuggcugugc

SEQ ID NO: 730536 - RNA, 61 nt, hsa
gaaggacugggagagacacaaagaccagagccagccucagggacaagagauuccaguuuua

SEQ ID NO: 730537 - RNA, 61 nt, hsa
cugccuccagcauccaguggcugcuggcauacagccucauccccacgucccaaccccucuc

SEQ ID NO: 730538 - RNA, 61 nt, hsa
aagcgaggucagacauccaccagaaucaacucagccucaggcauccaaagccacaccacag

SEQ ID NO: 730539 - RNA, 61 nt, hsa
caaccuggaguuggaggcauugcaggcuguccagccucauccccugccugauauccaguca

SEQ ID NO: 730540 - RNA, 61 nt, hsa
ugcugcggggcuggcugcaguguaccguggacagccucagggggcugucggccaagagccu

SEQ ID NO: 730541 - RNA, 61 nt, hsa
ccaauggguuugccaagcccuuugcuguucgcagccucacauucccccggugccucuccca

SEQ ID NO: 730542 - RNA, 61 nt, hsa
guguggggugggggggaccugcuuuggagaucagccucaccuucucccaucccagaagcgg

SEQ ID NO: 730543 - RNA, 61 nt, hsa
gccuuuaaagaacauaagaauucccauugcccagccucagugcauuuggcaaaugcuuacu

SEQ ID NO: 730544 - RNA, 61 nt, hsa
aauauucagacuauucuuaaaaugggacaaucagccucaugaaaaauugauguaaaucaga

SEQ ID NO: 730545 - RNA, 61 nt, hsa
uauuuugccaagguuaaggaugcaccugugacagccucaggagguccugacaacaggugcc

SEQ ID NO: 730546 - RNA, 61 nt, hsa
ggcggaucaccugaggucaggaguucgagaccagccucaacauggagaaaccccgucucua

SEQ ID NO: 730547 - RNA, 61 nt, hsa
aggauggcuaaaugcuccugggagucaggcgcagccucacaccagcugccuccuccacuca

SEQ ID NO: 730548 - RNA, 61 nt, hsa
gggcguuuucccggcaggcccccgggguccucagccucagcaacccagggagaggacagaa

SEQ ID NO: 730549 - RNA, 61 nt, hsa
gcccucggaucagggccgggaugggaggggucagccucagggagcagcugccuugggggac

SEQ ID NO: 730550 - RNA, 61 nt, hsa
cacucaguaacaaguauugggacguagagcacagccucacucagcucugaaagguaauaca

SEQ ID NO: 730551 - RNA, 61 nt, hsa
gcaguuaugagggaggaagucaacugcuguucagccucagaauaaaggugccguucacugg

SEQ ID NO: 730552 - RNA, 61 nt, hsa
gaucucccaacuugaacuauaauccaccagccagccucagccuugagcuuuggaaccacau

SEQ ID NO: 730553 - RNA, 61 nt, hsa
agccaaguuugagcucuuaaaaguugaugaacagccucauuuccccagcuucccugauuuc

SEQ ID NO: 730554 - RNA, 61 nt, hsa
uuccugguaggggugugugcgugacguacugcagccucaaccuccugggcucaagugaucc

SEQ ID NO: 730555 - RNA, 61 nt, hsa
uagcagucagcuugaggaggaugaaggaaggcagccucagacaggaauuaaggcaaugccc

SEQ ID NO: 730556 - RNA, 61 nt, hsa
auuuauuuguuauuaaauugaucugacuucucagccucauuuggacuaaaaaaagaaagca

SEQ ID NO: 730557 - RNA, 61 nt, hsa
ucccacucuguccaccaagugggggguagcacagccucacagcaaccgcccugaccuuggg

SEQ ID NO: 730558 - RNA, 61 nt, hsa
auuaccuuuacuccccucccucucccaucaccagccucaaggccugaggggugcaggggcu

SEQ ID NO: 730559 - RNA, 61 nt, hsa
aucagcaccgauucccgaaagcuuuccaccucagccucagaguccagcugcccggacucca

SEQ ID NO: 730560 - RNA, 61 nt, hsa
aauuuggcaguuuguuagguuagacaacugacagccucauuucauuccuacaaguugguuu

SEQ ID NO: 730561 - RNA, 61 nt, hsa
ggagcacuggaggaggagugggcucucugugcagccucacagggcuuugccacggagccac

SEQ ID NO: 730562 - RNA, 61 nt, hsa
uccaugucccggagaggggucccucaacagucagccucaccugucagaccgggguucuccc

SEQ ID NO: 730563 - RNA, 61 nt, hsa
gagaugccacuucucacucaccacuaccagccagccucagaaggccccagagagacccugc

SEQ ID NO: 730564 - RNA, 61 nt, hsa
ccuggccauuuugacccugaguggacagucacagccucagcucaugucuggcugugacaca

SEQ ID NO: 730565 - RNA, 61 nt, hsa
acuggggcucagagccggggugggguggcugcagccucaggacugggagcccccagccugu

SEQ ID NO: 730566 - RNA, 61 nt, hsa
ccuacccccuccaaggggcagguuuccaguccagccucagagaucaggcucugggaccccu

SEQ ID NO: 730567 - RNA, 61 nt, hsa
ccgaguccuugucccuaccuccagcuuccuccagccucaaaccgccucuggaucuagcugu

SEQ ID NO: 730568 - RNA, 61 nt, hsa
cagcgccagggcccaggccauguggccugcccagccucaaugucacuugguggcggggugg

SEQ ID NO: 730569 - RNA, 61 nt, hsa
caccggaagacucacuuugucugcccugcgccagccucaccucacccugcaguucccguuu

SEQ ID NO: 730570 - RNA, 61 nt, hsa
gucacggcccagacugggcaccuucgcgucucagccucagggagccccacagccccaagcu

SEQ ID NO: 730571 - RNA, 61 nt, hsa
gccaccuuguacaaagccggcugcccagccccagccucaccaccgcaucccaccuccugcc

SEQ ID NO: 730572 - RNA, 61 nt, hsa
accuccgcccagccuguaauguuuauauaagcagccucaaggaccaagaaccaucugcgaa

SEQ ID NO: 730573 - RNA, 61 nt, hsa
gcugugugccggccuucuugcugcauguacucagccucaggagagcuugcugcacccaggc

SEQ ID NO: 730574 - RNA, 61 nt, hsa
gucaccaaggcuucagccccaagggcaucuccagccucaggccggcagguccuauguccuu

SEQ ID NO: 730575 - RNA, 61 nt, hsa
agugcaguggugccaucaccacggcucacugcagccucagcguccugggcucaaaugaucc

SEQ ID NO: 730576 - RNA, 61 nt, hsa
agugcccaugucccuuccagcucaccuugagcagccucagaucaucucugucacucuggaa

SEQ ID NO: 730577 - RNA, 61 nt, hsa
uggauggacacaugggccaggggcucugaagcagccucacucuuaacuucguguucacacu

SEQ ID NO: 730578 - RNA, 61 nt, hsa
cgcugccuagcaucugcuuggccaauuaguucagccucagaccauggcacuuugagggggu

SEQ ID NO: 730579 - RNA, 61 nt, hsa
guaauccacagacaacucuauuuguguucuucagccucagccugaaggcuuuuuuuuggcu

SEQ ID NO: 730580 - RNA, 61 nt, hsa
gccuggggagauggaggaaagugauaucccccagccucaagucuuauuuccucaacguugc

SEQ ID NO: 730581 - RNA, 61 nt, hsa
cccagcccuaaacccugccccaggaagcccacagccucaccugcugcugccccucuagguc

SEQ ID NO: 730582 - RNA, 61 nt, hsa
gguuucagcaugguauugaguugacacuucucagccucaauucauaacuauaugaacuuua

SEQ ID NO: 730583 - RNA, 61 nt, hsa
cguacaucauuauuaauauaaaaauaacaggcagccucaagaaugugcugagauuucucug

SEQ ID NO: 730584 - RNA, 61 nt, hsa
acacgccccucuacugcuauguggcuucaaccagccucacagccacacgggggaagcagag

SEQ ID NO: 730585 - RNA, 61 nt, hsa
gccccaucugccccacagucuccggccucuccagccucagcccccugcuucagucccuucc

SEQ ID NO: 730586 - RNA, 61 nt, hsa
cagcagccauugcacgugcaucagcucccaucagccucauuccguggcaggugaugugucc

SEQ ID NO: 730587 - RNA, 61 nt, hsa
aaaugccuuaauuucacucuccucccuucuccagccucaggggaggaucuggaggauccac

SEQ ID NO: 730588 - RNA, 61 nt, hsa
gggggcuggaggagcccaggccaggacucugcagccucagagacaucagcccuuggggguc

SEQ ID NO: 730589 - RNA, 61 nt, hsa
uuuccuaggauaaaaauaaacaaaugacuuacagccucauccucccuaacuccauuugaac

SEQ ID NO: 730590 - RNA, 61 nt, hsa
aggaccgccaccucuucccagugcuugcgaccagccucauucuauuuaacuuugcucucag

SEQ ID NO: 730591 - RNA, 61 nt, hsa
ugagcaccaccagggcuccaggagccucauccagccucagagaucucccuucucaucuccc

SEQ ID NO: 730592 - RNA, 61 nt, hsa
gccacguacagccagcgggucagcccagaggcagccucagcuccagggcuaaggacucucg

SEQ ID NO: 730593 - RNA, 61 nt, hsa
ugcaccaucacuguggcuggcaggcaucggacagccucauccagacccccugcccugucuu

SEQ ID NO: 730594 - RNA, 61 nt, hsa
gcucccucagucuggcacccacugcuacacucagccucaugagccacuucagaccagccag

SEQ ID NO: 730595 - RNA, 61 nt, hsa
agguaggauacguacaccucuugccucagagcagccucaucccaggcagugggucuucccu

SEQ ID NO: 730596 - RNA, 61 nt, hsa
gagcgaugauggacuugagcgccguguucuucagccucagcuggaaggggaaaagucaggg

SEQ ID NO: 730597 - RNA, 61 nt, hsa
cagccuuccucaggccccugucucuggcccccagccucagugccucuuggcccagggccag

SEQ ID NO: 730598 - RNA, 61 nt, hsa
gggagcgagaaaccccagcugagcugcguuccagccucagcugagucuuuuuggucugcac

SEQ ID NO: 730599 - RNA, 61 nt, hsa
agcccacgcccccccaagagcccucgauggacagccucacccaccccaccugggcccagcc

SEQ ID NO: 730600 - RNA, 61 nt, hsa
cccaggcuggaggcccugccucgcugcuugccagccucaccugcuggggcuggaggccaug

SEQ ID NO: 730601 - RNA, 61 nt, hsa
cacacagaggaggaagacagcagccuggcagcagccucaccgaagagaggaaccaccacac

SEQ ID NO: 730602 - RNA, 61 nt, hsa
acuuucugcgugguggaaaccauugcauauucagccucauuucaagaguguuuccuucuca

SEQ ID NO: 730603 - RNA, 61 nt, hsa
cugaagcaggaaggcagagcaucaucuuguucagccucagcugggaacauguguacugggu

SEQ ID NO: 730604 - RNA, 61 nt, hsa
cuuucacccuaaacgacacuuccuccccagccagccucacucugucuccggcccgcagcag

SEQ ID NO: 730605 - RNA, 61 nt, hsa
aaaugauggggaaaggaguccuuaguccuuucagccucagaggucacaguggguggcaggu

SEQ ID NO: 730606 - RNA, 61 nt, hsa
agccuggcuguggaguuuccacggcgacacacagccucaguggugcaagauuuaaaauuac

SEQ ID NO: 730607 - RNA, 61 nt, hsa
cuauuuuugugacccacauagguggcccauucagccucaaggggaaauccaggguaggaag

SEQ ID NO: 730608 - RNA, 61 nt, hsa
uuuuaugagggccacgggucuguguucgacucagccucagggacgacucugaccucuuggc

SEQ ID NO: 730609 - RNA, 61 nt, hsa
ucacuugcccacaccgagggcgaccccgucacagccucaagucacucccaagcccccuccu

SEQ ID NO: 730610 - RNA, 61 nt, hsa
gaaucgccuaccugugccugcguguaaaccacagccucagaccagcuauggggagaggaca

SEQ ID NO: 730611 - RNA, 61 nt, hsa
ccccucccggcgccugcccacccuccacccacagccucacggguccaggacuuggcguguu

SEQ ID NO: 730612 - RNA, 61 nt, hsa
caccuccaccuuccgggcucaagcgauucuccagccucagccuccugaguagcuaggacug

SEQ ID NO: 730613 - RNA, 61 nt, hsa
auguugggcaacaacucagccagccugauggcagccucagaggcuuacucuaacccauccc

SEQ ID NO: 730614 - RNA, 61 nt, hsa
gccccuguucuucacacugccccccaugccucagccucauacagaugugccaucauggggg

SEQ ID NO: 730615 - RNA, 61 nt, hsa
caauguaagcaaugugggaaagccgucagaucagccucaagacuucaaaugcauggaagca

SEQ ID NO: 730616 - RNA, 61 nt, hsa
accaggggaggugggguuuggugagagacgccagccucagacuuuuucccacugagggucc

SEQ ID NO: 730617 - RNA, 61 nt, hsa
ggcugcuggagaagucuccucccguucggaccagccucagggcugcacguuaccucaggaa

SEQ ID NO: 730618 - RNA, 61 nt, hsa
agccgcagccaaacccggcugccucccaccccagccucaaaaccucuuccugacgaccccc

SEQ ID NO: 730619 - RNA, 61 nt, hsa
cucccugcuucccuggaagcuucaggaagcucagccucagccuucaggccugagcaagugc

SEQ ID NO: 730620 - RNA, 61 nt, hsa
gguggaucaccugaggucaggaguucaagaccagccucaacauggagaaaccccaucucua

SEQ ID NO: 730621 - RNA, 61 nt, hsa
uggaaguggugggugcccaggacggugccuccagccucaacagugggcauggacaggguua

SEQ ID NO: 730622 - RNA, 61 nt, hsa
ccccuucccaguccauaaaaaccccggaccccagccucauacugggcaacuuauuuggauc

SEQ ID NO: 730623 - RNA, 61 nt, hsa
caccaugcgggccucagguggcagagaggcccagccucacaggccuguggccccacacacc

SEQ ID NO: 730624 - RNA, 61 nt, hsa
ccuucccuaaucaccucuccugccccuagcucagccucauccccaacuccaugccugucuc

SEQ ID NO: 730625 - RNA, 54 nt, hsa
agaagacccaggcaguguaggcgacagccucaugggccacuguggcccgauguc

SEQ ID NO: 730626 - RNA, 61 nt, hsa
acaaggcuucucuguccgcccuucacaccuccagccucacguucacuuaggcacaucacac

SEQ ID NO: 730627 - RNA, 61 nt, hsa
gaccccacuccaggaccuaggcccagccccucagccucaucuggagccccugaagaccagu

SEQ ID NO: 730628 - RNA, 61 nt, hsa
acgaugagcugugagcaccgcgcaccugccacagccucagaggcccgcacaaugaccggag

SEQ ID NO: 730629 - RNA, 61 nt, hsa
ugcugggauuacaggcaugaaccauggugcccagccucauuuuugaaauggaauagagaac

SEQ ID NO: 730630 - RNA, 61 nt, hsa
cggccauuugcugcccuccccaccccugccccagccucaggacugcaggagccauccgccc

SEQ ID NO: 730631 - RNA, 61 nt, hsa
gugaaugugggaaagucuuuagauacaacuccagccucauuaaacaucggagaauucacac

SEQ ID NO: 730632 - RNA, 61 nt, hsa
gcagcggcgcccagcucccugguggccgcggcagccucaguggcagcagcugccgguggug

SEQ ID NO: 730633 - RNA, 61 nt, hsa
gccccauucaccuguggauuugugcgagaugcagccucagaaggaacaaggcccccagagg

SEQ ID NO: 730634 - RNA, 61 nt, hsa
ugaagugcgguggugcaaucauggcucacugcagccucaaauuccugggcucaagcgaucc

SEQ ID NO: 730635 - RNA, 61 nt, hsa
uggcuaccaggaaacucggagacaaucuuuucagccucagcauuucuggcuggauuuccac

SEQ ID NO: 730636 - RNA, 61 nt, hsa
ggccacacacagcaagaaagauacaucugaccagccucaacgucaacguauuuccccucuc

SEQ ID NO: 730637 - RNA, 61 nt, hsa
auggucuugaucuccugaccuugugauccaccagccucagccucccaaagugcugggauua

SEQ ID NO: 730638 - RNA, 61 nt, hsa
ccuuugggguauuccccuagugugcccaagucagccucauauucugggcggacagcuuguc

SEQ ID NO: 730639 - RNA, 61 nt, hsa
cccccagcccucccuccuggcgggucuccuccagccucacuucgcugccacuucgccgcug

SEQ ID NO: 730640 - RNA, 61 nt, hsa
caggcggaugaggucccuacucccgagcccccagccucacccacugcagggccaggcucuc

SEQ ID NO: 730641 - RNA, 61 nt, hsa
ugccucccggguucaagugauucuccugccucagccucacgaguagcuggaauuacaggca

SEQ ID NO: 730642 - RNA, 61 nt, hsa
cuuacuuccagcuugcacaucagaauuuuuccagccucauuugucaguuucaaaucugcuu

SEQ ID NO: 730643 - RNA, 61 nt, hsa
cugcuccaggaugaaaccaagagggggaugucagccucacccacaccgugugccuuacucc

SEQ ID NO: 730644 - RNA, 61 nt, hsa
ccacuccacacacucccugccagcuuuguugcagccucagcugguggugucuccguccuua

SEQ ID NO: 730645 - RNA, 61 nt, hsa
caaagcuucuguggcuucguggucacugcuccagccucagccagggcagggagggggacuc

SEQ ID NO: 730646 - RNA, 61 nt, hsa
gguacuuucucuuccugguaauccucuggcccagccucauggcagaauagagguauuuuua

SEQ ID NO: 730647 - RNA, 61 nt, hsa
gaaaccaaaaagagacugaucauccaggccucagccucauccuccccaggaccccugucca

SEQ ID NO: 730648 - RNA, 61 nt, hsa
cccucugucccuacugauuccuccuugggugcagccucagaguggccugaggcccagaggg

SEQ ID NO: 730649 - RNA, 61 nt, hsa
ccgcgccgcggaagggggcuccgagggggcgcagccucaaacccugccuuuccuuuacuuu

SEQ ID NO: 730650 - RNA, 61 nt, hsa
ccccggcucagaucuuugcaaaucaguacgacagccucagagcagagcaaggguuguuugg

SEQ ID NO: 730651 - RNA, 61 nt, hsa
accccccucauuaucuaccaugacugucucucagccucacgggcccucagcacuuuguguu

SEQ ID NO: 730652 - RNA, 61 nt, hsa
ucccuguccccaccuccagucccucccucaccagccucaccccuguggugggcuuuuuaag

SEQ ID NO: 730653 - RNA, 61 nt, hsa
uggagugcaguggcaugaucauaacucacugcagccucaaacuucuggccucaagugaucc

SEQ ID NO: 730654 - RNA, 61 nt, hsa
cuccacagacccagccuccggcugugacccccagccucacaccugccucugguucccgccu

SEQ ID NO: 730655 - RNA, 61 nt, hsa
aaacgaucuaaagguaggcagacccuggacccagccucagauccaggcaggagcacgaggu

SEQ ID NO: 730656 - RNA, 61 nt, hsa
ggaggguauucugggccuucugcccaggcagcagccucauggguguggcuucuguggcuuu

SEQ ID NO: 730657 - RNA, 61 nt, hsa
gggcacgggguaggggguucucguagggucccagccucaaugguucccgcccuggaccucc

SEQ ID NO: 730658 - RNA, 61 nt, hsa
uacugaagugacuuaugguugcuccccuagacagccucagaauggggcuguucucuaggaa

SEQ ID NO: 730659 - RNA, 61 nt, hsa
gugugucuguaaaaugugugaaaccaaacugcagccucaacaccauggacacacgucauca

SEQ ID NO: 730660 - RNA, 61 nt, hsa
cagggauccaagaaugugccaagagucccgccagccucagccaggugggccuguauauagg

SEQ ID NO: 730661 - RNA, 61 nt, hsa
ucagauuugaccaggccucuggcugccugggcagccucauugccaaugggcugaaagguuc

SEQ ID NO: 730662 - RNA, 61 nt, hsa
caaacgcagugcccuguucugccgguguguacagccucagcgcaccaggagacccuagagu

SEQ ID NO: 730663 - RNA, 61 nt, hsa
cuccuuguccccucccacccgccucaugacccagccucacagacccucucaggccucugac

SEQ ID NO: 730664 - RNA, 61 nt, hsa
guauguuucuuucugccccguugaagaggugcagccucaggcugagaaacacugauagacc

SEQ ID NO: 730665 - RNA, 61 nt, hsa
ucacugccccacauucucccaguggcucuaccagccucacccaucaaaccagugaauuucu

SEQ ID NO: 730666 - RNA, 61 nt, hsa
cugagucucuaucauagcugaacccugaggacagccucauagcucauguaucagggacuuu

SEQ ID NO: 730667 - RNA, 61 nt, hsa
gacugccaggcagaaaggacagggcccaggucagccucagucugcugugccuccagacugc

SEQ ID NO: 730668 - RNA, 61 nt, hsa
uuucccuuuguucuugaacacuuuugcccugcagccucaguuuugaauucuuuuagcaacu

SEQ ID NO: 730669 - RNA, 61 nt, hsa
ggcuggggccggggcugagggugcccuuuuccagccucagccuacuccgcucacugaacuc

SEQ ID NO: 730670 - RNA, 61 nt, hsa
aucaaguugaggggcuuccggcucccuucuacagccucagaaaccagacucguucuucugg

SEQ ID NO: 730671 - RNA, 61 nt, hsa
agagaaucguacgucgacuuucgauuuuucacagccucagccuaggaaaaaugguucaugg

SEQ ID NO: 730672 - RNA, 61 nt, hsa
caggacaccacaugggagggggcucaggccucagccucaagaucuucagcuguggccucuc

SEQ ID NO: 730673 - RNA, 61 nt, hsa
aacgaggaccuggacucagagccagacagggcagccucagacccuucucuggggcuccugg

SEQ ID NO: 730674 - RNA, 61 nt, hsa
uugcuucacccgcugcagagcacacgcaacccagccucagcaucacagccgcagcucuguu

SEQ ID NO: 730675 - RNA, 61 nt, hsa
aguuccucaucacaaaagaacaaagauaaaccagccucaaucccggcugcugcauuuaggu

SEQ ID NO: 730676 - RNA, 61 nt, hsa
caauaaucaacauuuaccagacauccaaugacagccucaggggaaagcacccuugucuggg

SEQ ID NO: 730677 - RNA, 61 nt, hsa
cggucaccucggccgggcccggggcugaggucagccucacugccugcuuauugccucuuuc

SEQ ID NO: 730678 - RNA, 53 nt, hsa
gaauguucuucuuugaguaaaggcagccucaccucgggcagucccugcagguc

SEQ ID NO: 730679 - RNA, 61 nt, hsa
gccuugucuuccaguuccuuucucccauucccagccucauuucuuaaaugacuaggaauuu

SEQ ID NO: 730680 - RNA, 61 nt, hsa
uugccaccagcaugcgggauucccucauugacagccucaccugagucaccuuccaaguugu

SEQ ID NO: 730681 - RNA, 61 nt, hsa
agggguagcccuguccagguaaaguuguuuucagccucaugucuacuguuaggugagggag

SEQ ID NO: 730682 - RNA, 61 nt, hsa
accugggugucugggcucaagcuuucccgcccagccucacuuccuuugcccuuccuccugc

SEQ ID NO: 730683 - RNA, 61 nt, hsa
gacucuugacaccggucucugcugaggcucccagccucaguuucccccacagcagcacggg

SEQ ID NO: 730684 - RNA, 61 nt, hsa
gccuugagaggacccugcaggcagucagcaccagccucagcaacugugcagagaccuacag

SEQ ID NO: 730685 - RNA, 61 nt, hsa
ucucuagccagugcuuaggcccaauaucugacagccucaggugggcugggaccuaggaagc

SEQ ID NO: 730686 - RNA, 61 nt, hsa
uucuagagaacuaaacuggcuuaacgagucacagccucagcugugcugggacgacccuugu

SEQ ID NO: 730687 - RNA, 61 nt, hsa
aaaguaccaggagcuagcuuuuaaccuugcccagccucaguuucuuuucuuagaagaagcu

SEQ ID NO: 730688 - RNA, 54 nt, hsa
gguggggaggugggauuuagugcacagccucacguggggcuuggacacaggcug

SEQ ID NO: 730689 - RNA, 61 nt, hsa
uccguccuggcagggcaggcagagcucagcacagccucaccccugcaggcgguauccagag

SEQ ID NO: 730690 - RNA, 61 nt, hsa
uacugauucaaaugcuaaucucuuccagaaacagccucacagacacacccagacaucuggu

SEQ ID NO: 730691 - RNA, 61 nt, hsa
acucuagaugacaagagcaccucaaaggcagcagccucaaggagcagccauggccccagac

SEQ ID NO: 730692 - RNA, 61 nt, hsa
uggagugcaguggcacaaucacaguucacugcagccucaaccucuccagauucaagugauc

SEQ ID NO: 730693 - RNA, 61 nt, hsa
cuuccccuaaaagaggccgugauauuugcagcagccucaaauugcucuuaagggguuuagg

SEQ ID NO: 730694 - RNA, 61 nt, hsa
ccccacucugcccguccaccuucccuggcuccagccucauucucucuuuaguuuaacuaug

SEQ ID NO: 730695 - RNA, 61 nt, hsa
cccugccaguccuuggaccucccagcccacccagccucagcacagcucaacacagaaggag

SEQ ID NO: 730696 - RNA, 61 nt, hsa
ucuguuaacugaagauauuccaacucaaaaccagccucaugcucugauuagauaaucuuuu

SEQ ID NO: 730697 - RNA, 61 nt, hsa
cugagugcacuggcaggaucacagcucacggcagccucaaccucccuggcucaagcgaucc

SEQ ID NO: 730698 - RNA, 61 nt, hsa
caccuccccauacagagagaggcuucccucccagccucaguuuacccguaaaugcacuagc

SEQ ID NO: 730699 - RNA, 61 nt, hsa
cccugccaguccuuggaccucccagcccacccagccucagcacagcucagcacagaaggag

SEQ ID NO: 730700 - RNA, 61 nt, hsa
gccgccuagccaagacugcagggauggcccgcagccucaucggggccaaggacacacgccu

SEQ ID NO: 730701 - RNA, 61 nt, hsa
ccaccucucgccccucaucuugguaauuagccagccucagauacuucugugggcccugaag

SEQ ID NO: 730702 - RNA, 61 nt, hsa
ccuugcagugaagccaccaugggugaccguccagccucacccgguggccugcacagugagg

SEQ ID NO: 730703 - RNA, 61 nt, hsa
aggccucccggaacaaaagcggaagaggggccagccucaucccacugccagcugacccuca

SEQ ID NO: 730704 - RNA, 61 nt, hsa
uauuuuuguuggagccacucuguuccuggcucagccucaaaugcaguauuuuuguuguguu

SEQ ID NO: 730705 - RNA, 61 nt, hsa
uucaucuccucugugggaggacacaucucugcagccucaagaguuaggcagagacucaagu

SEQ ID NO: 730706 - RNA, 61 nt, hsa
acuccaugccacccccaccagcuggaggacccagccucacaguguguccuuugugccagac

SEQ ID NO: 730707 - RNA, 61 nt, hsa
uucaaguuaacaggaucagacaccagucaagcagccucaggucaucuugcgacuccacuga

SEQ ID NO: 730708 - RNA, 61 nt, hsa
gccucaaaaauucaccaagcagaaugccucucagccucauguguugguccucugcuccucc

SEQ ID NO: 730709 - RNA, 61 nt, hsa
ggggcccgcagaggugcccuuacugaggugacagccucacagggucugguaccagggguug

SEQ ID NO: 730710 - RNA, 61 nt, hsa
gggcagucccucagaaucccagaggcagucccagccucagaacccaggauaggaaaugggu

SEQ ID NO: 730711 - RNA, 61 nt, hsa
cccuagccugaggcuccacuggaagaucucgcagccucaguguaugggaaacccuuucccc

SEQ ID NO: 730712 - RNA, 61 nt, hsa
uuggggcugcugggguuggaauguggaacugcagccucagcccaucuggcagagucccagg

SEQ ID NO: 730713 - RNA, 61 nt, hsa
gccugcagggggcgcugcaucccgcgcgcugcagccucaugugacccgaucggacagugcc

SEQ ID NO: 730714 - RNA, 61 nt, hsa
acgccccauggaggcuccgagaccaucugcccagccucacugaggcucaggacacggccac

SEQ ID NO: 730715 - RNA, 61 nt, hsa
uaggggccccaaguucaacucaaccccucaacagccucagcuuugcagccccugagaaggc

SEQ ID NO: 730716 - RNA, 61 nt, hsa
ucuguuucagcaaaucucagucccugacuaacagccucagcacauccgacaccucccagcg

SEQ ID NO: 730717 - RNA, 61 nt, hsa
ugugcccccggccaggcccugaggaaaugcucagccucaguggagauggggagguuagaga

SEQ ID NO: 730718 - RNA, 61 nt, hsa
cuguugggcccaguggccccugcuauccccacagccucauuccugcagaagguuugugacg

SEQ ID NO: 730719 - RNA, 61 nt, hsa
agacaccagaccagguccagggccuccuccacagccucagcuggggcucucagcaccaaag

SEQ ID NO: 730720 - RNA, 61 nt, hsa
aauccuacuccuaugaccccgaagaugaggccagccucagccucuauggcaaggcccugcu

SEQ ID NO: 730721 - RNA, 61 nt, hsa
ucuugcugcucucagagccagaaaaugcugacagccucaugcugguggacuucgaguacag

SEQ ID NO: 730722 - RNA, 61 nt, hsa
cagggccugagggagccccuggcuuuccccucagccucaggaaagguggucaggaaaacuc

SEQ ID NO: 730723 - RNA, 61 nt, hsa
uggagugcagugacguggucauagcucacugcagccucaaccuccugggcucaagugaccc

SEQ ID NO: 730724 - RNA, 61 nt, hsa
ggugaguuggggggcagggguugucuugggccagccucaguuuuugucaggccaugaaucc

SEQ ID NO: 730725 - RNA, 61 nt, hsa
ugcugggauuauaggcgugagccacugugcccagccucacagcugcaucuuaaccuuaccu

SEQ ID NO: 730726 - RNA, 61 nt, hsa
ucuaccucccagaucggaucuguugcaaacucagccucaauaagccuugucguugacuuua

SEQ ID NO: 730727 - RNA, 61 nt, hsa
aagaaaggagggacccggaacuugggccaaucagccucaccuugucccaguccacuccuaa

SEQ ID NO: 730728 - RNA, 61 nt, hsa
aaccuccaccucccggauucaagugauucuccagccucagccuccugaguagcugggauua

SEQ ID NO: 730729 - RNA, 61 nt, hsa
gaguuguggguccugcccagaguccagagagcagccucagcugagcacagguccgaggggg

SEQ ID NO: 730730 - RNA, 61 nt, hsa
uugucaaccuucuacacagccaaugacuuaacagccucauuagaaguuacagaaacuaaag

SEQ ID NO: 730731 - RNA, 61 nt, hsa
caugagaucagggccugcccccuggggaucacagccucaccccugccccugugggacucau

SEQ ID NO: 730732 - RNA, 61 nt, hsa
accuggggacucacguagcuggagagcauuacagccucauccacuuaccuggagcugcucu

SEQ ID NO: 730733 - RNA, 61 nt, hsa
aggacccuggaaggacagcaaggcagcuccccagccucacucuucacuccugauugaggcc

SEQ ID NO: 730734 - RNA, 61 nt, hsa
ugaaggauuuagacggggaugaagugcccuccagccucagagcuagccacaaagcccccag

SEQ ID NO: 730735 - RNA, 61 nt, hsa
cuuuguagugcuuucggcccaguucuggccucagccucaaagugcaccgacuaguugcuug

SEQ ID NO: 730736 - RNA, 61 nt, hsa
gagccaggucaggcuucggaggccacaagcucagccucaggcccaggcacugauuguggca

SEQ ID NO: 730737 - RNA, 61 nt, hsa
cgugagagaaucugccuguggccuugcccgccagccucagugccacuugacauuccuuguc

SEQ ID NO: 730738 - RNA, 61 nt, hsa
ucuuaccaauuuccccaacuauguugcacaucagccucauuuucccccuuuauuggaaugc

SEQ ID NO: 730739 - RNA, 62 nt, hsa
agguggcagcguggagggcucggcguggauggcagccucaggacacacaccccugccucaag

SEQ ID NO: 730740 - RNA, 62 nt, hsa
gaggaagccucggccucccugagcucugaccccagccucacccgaaaggccagccuggggcu

SEQ ID NO: 730741 - RNA, 62 nt, hsa
cugaggucccgggcuuagugugagcaucuugccagccucaggcuugagggagggcugggcua

SEQ ID NO: 730742 - RNA, 62 nt, hsa
agacaaagguaaaucagccagccaggcacccacagccucagcuccugugcaguuccugggca

SEQ ID NO: 730743 - RNA, 62 nt, hsa
gaggguccccucugggagaaacagcuucaccccagccucagggcccugggccaucacugcag

SEQ ID NO: 730744 - RNA, 62 nt, hsa
gcacuacggccauucuccucuugggcgcuccucagccucacugugaccuuucugccagagcu

SEQ ID NO: 730745 - RNA, 62 nt, hsa
guuuggaccuaacaucucgcacgugacucccucagccucagagccuugggaugcagagcagc

SEQ ID NO: 730746 - RNA, 52 nt, hsa; identical to SEQ ID NO: 730028

SEQ ID NO: 730747 - RNA, 62 nt, hsa
uggaagcccucuuuccccaaauccuacucccucagccucaggcaguggugcucccaucuucc

SEQ ID NO: 730748 - RNA, 62 nt, hsa
gaaaaagaacucaaccaauuuggcaccccaugcagccucaaaauguuucaaaugccuaccgc

SEQ ID NO: 730749 - RNA, 62 nt, hsa
cccaagcuucaaggaagugcuugggggacccccagccucauccucuuaguugggucucuugu

SEQ ID NO: 730750 - RNA, 62 nt, hsa
cucuugacccugcauauccaggaaggaacugccagccucagaggaggcagcaccgagggugc

SEQ ID NO: 730751 - RNA, 62 nt, hsa
cugcucagcagccagucucagagaccagcacucagccucauucagcauggguccuugaugcc

SEQ ID NO: 730752 - RNA, 62 nt, hsa
gccccagcuggagcuggcugagagcaguccugcagccucauuccuuaguucccggagcuggc

SEQ ID NO: 730753 - RNA, 62 nt, hsa
gucucuguuccccagcccaccuggcucacacacagccucauggguagggucagcaaaccaga

SEQ ID NO: 730754 - RNA, 62 nt, hsa
cgaggcugcccccucacccagaagucugagcccagccucaggaggggccaagaaccaggggg

SEQ ID NO: 730755 - RNA, 62 nt, hsa
aauuucaggcuggaaaacuaucaguaugaucucagccucaguucucuugucuguaaaaugga

SEQ ID NO: 730756 - RNA, 62 nt, hsa
ugacuacuuaccacaucaaaucugggcccaaacagccucaguuaacugcauaauucaggaac

SEQ ID NO: 730757 - RNA, 62 nt, hsa
ugaugucucuacuugcucuaugagccuuuugccagccucagaauaggcgagguaaccuugaa

SEQ ID NO: 730758 - RNA, 62 nt, hsa
cggaucucuguggggcucuucaccaauuuuuccagccucauuuauaguaaacaaauuguucu

SEQ ID NO: 730759 - RNA, 62 nt, hsa
ugagauggaaucuuagaucgucccccaugugccagccucauucgaauucuacucuuugguua

SEQ ID NO: 730760 - RNA, 52 nt, hsa; identical to SEQ ID NO: 730042

SEQ ID NO: 730761 - RNA, 59 nt, hsa; identical to SEQ ID NO: 730043

SEQ ID NO: 730762 - RNA, 62 nt, hsa
gucuguauuucugugugguuguagcaaggacucagccucauguagcacgaauaggggugugg

SEQ ID NO: 730763 - RNA, 62 nt, hsa
uccgccucccgguucaagccauucuucugccucagccucagcgaguagcugagacuaccggc

SEQ ID NO: 730764 - RNA, 62 nt, hsa
ccugugccagaagcaacagaggugccaggccucagccucacccacagcagccccaucgccaa

SEQ ID NO: 730765 - RNA, 62 nt, hsa
aaccaaagaaaugaagcuggcaagcuacuuuucagccucaagcuuuacacagcuguccuuac

SEQ ID NO: 730766 - RNA, 62 nt, hsa
cacucccaccacaggcauaagcuaucaccuagcagccucaaaacgggucaguauuaagguuu

SEQ ID NO: 730767 - RNA, 62 nt, hsa
cuguagcuccuccugacaaacgucugggaaaacagccucaccccacucuccucucucuuccc

SEQ ID NO: 730768 - RNA, 62 nt, hsa
cuaaaccagaaggaagcccucucagaucaccccagccucacuccauuucccacuuccacccc

SEQ ID NO: 730769 - RNA, 62 nt, hsa
ggacuuugucccuucuaauuauuaucucuuuccagccucauucagcuauucuuacugacaua

SEQ ID NO: 730770 - RNA, 62 nt, hsa
uuuucuaaauauaauaaaaacuuaccuggcaucagccucauaccuaaaacuccugacucuua

SEQ ID NO: 730771 - RNA, 62 nt, hsa
acacacacuggcacagggaggcuacaacuaagcagccucagaucuguaaaguugauuggugc

SEQ ID NO: 730772 - RNA, 62 nt, hsa
ccuggcgaugagccauuuauugugucucacaccagccucauuuccaacuccgacuuccuacu

SEQ ID NO: 730773 - RNA, 62 nt, hsa
aacuuuauccugcuauaacuuuauccucuucccagccucaucccuguuuuucuguuagggca

SEQ ID NO: 730774 - RNA, 62 nt, hsa
ugucugcaaacaggucccugccuuuuuagaagcagccucauggucucaugcuuaaucuuguc

SEQ ID NO: 730775 - RNA, 62 nt, hsa
cucgaggcagggaaaagccaucuauucuucugcagccucaggagcgagacuucaaggacuca

SEQ ID NO: 730776 - RNA, 62 nt, hsa
aagagccccuucugcaucuuauucacagcuugcagccucagccccuuugaugaggcccucag

SEQ ID NO: 730777 - RNA, 62 nt, hsa
uccuuguugcucuaacaguccagauguacacccagccucagggggaaggcagcucucuccag

SEQ ID NO: 730778 - RNA, 62 nt, hsa
gcucccuugugauuucugagggucaccacugccagccucaggcaacauagagagccuccugu

SEQ ID NO: 730779 - RNA, 62 nt, hsa
gccagagaggggcagguagaccugcauagcagcagccucagcagcugucuugguaaaggaga

SEQ ID NO: 730780 - RNA, 62 nt, hsa
uggccugucuguccuccucccuaauucagacccagccucaagaggaaagggaguaaaauaaa

SEQ ID NO: 730781 - RNA, 62 nt, hsa
ccaucagaaccuggcagccccaaaacuggggucagccucagggcaggagucccacuccucca

SEQ ID NO: 730782 - RNA, 62 nt, hsa
cucuguggcguuguguuauugguagacacccucagccucaucauuugacuaccuauguacua

SEQ ID NO: 730783 - RNA, 62 nt, hsa
gaguuuauugucaauugcuucucaagucuaaccagccucagcagugugcauagaccauuucc

SEQ ID NO: 730784 - RNA, 62 nt, hsa
gccuuggguucagcccaucugggcucaaauuccagccucaccacucacaagcugugugacuu

SEQ ID NO: 730785 - RNA, 62 nt, hsa
ggggcuauaggagccucccacuuucaccagagcagccucacugugcccugauucacacacug

SEQ ID NO: 730786 - RNA, 62 nt, hsa
aaguaacucccacuccuaaucaagagucucuccagccucacagaugcuggccucuuggcacc

SEQ ID NO: 730787 - RNA, 62 nt, hsa
ucuaugccuaguggagccacagugccucccugcagccucaacaccacccugcuguccagucc

SEQ ID NO: 730788 - RNA, 62 nt, hsa
ucagccucaggauggggaauagccaagaauggcagccucagcgcagaggcaaggucagaaag

SEQ ID NO: 730789 - RNA, 62 nt, hsa
cagccacuuagugcuuuguccuggacuccacucagccucaggauggggaauagccaagaaug

SEQ ID NO: 730790 - RNA, 50 nt, hsa; identical to SEQ ID NO: 730072

SEQ ID NO: 730791 - RNA, 62 nt, hsa
cugucuaccaacuccucauagugagccagaagcagccucauaacccugaauguggggcucug

SEQ ID NO: 730792 - RNA, 62 nt, hsa
uggaaucuuuagcgcucaauaggaccaggauccagccucacuucuaggguaugggaaaucca

SEQ ID NO: 730793 - RNA, 62 nt, hsa
guuguuuaugcaacucuaucuuaagaacugcccagccucagcugaaaacccgaaucugagaa

SEQ ID NO: 730794 - RNA, 62 nt, hsa
uggagaaggcauuccaggguugaaucuugucccagccucagccugggacaccuagguggaga

SEQ ID NO: 730795 - RNA, 62 nt, hsa
uugccgucagccgaacuuuguuauggagggagcagccucacacaagcagaaacacuccugug

SEQ ID NO: 730796 - RNA, 62 nt, hsa
cccuguggcuagaggaacaccagcacaaacgacagccucaagucuccuucgagcuuuguaaa

SEQ ID NO: 730797 - RNA, 62 nt, hsa
gccuuaaaaagggcuucuuggaacuuuaccagcagccucagcuuuacaaaugccuugguaug

SEQ ID NO: 730798 - RNA, 62 nt, hsa
aucuuuuuuuuuuuuuuuuguaucugcacuugcagccucagcuuucacacuucagcccuuaa

SEQ ID NO: 730799 - RNA, 62 nt, hsa
gccagaggguggggcuggcagaacaccaucuccagccucagcuuugaccugucucauuuccc

SEQ ID NO: 730800 - RNA, 62 nt, hsa
uuuccauggcccuggauggucuggcccaccuccagccucagcuagcauuacccuucugacac

SEQ ID NO: 730801 - RNA, 62 nt, hsa
cuggccaagauuuccuucuguaucacuccaagcagccucagcagaagaagcagccaugccca

SEQ ID NO: 730802 - RNA, 62 nt, hsa
cuccggccugcugucaagucccccagcagaaccagccucaaaaacgcccucaagaacaugau

SEQ ID NO: 730803 - RNA, 62 nt, hsa
ugcaaccacacagggauauuucugcuaugcaccagccucacuccaccuuccuuccaucaaaa

SEQ ID NO: 730804 - RNA, 62 nt, hsa
cuucccaggugggcccacucacaugguauugccagccucacuggucagccucgccucccagc

SEQ ID NO: 730805 - RNA, 62 nt, hsa
guauuacuuccccucugauaggacauuguagccagccucagcacucagugaguucaucaggg

SEQ ID NO: 730806 - RNA, 62 nt, hsa
aagcugucucaucaccaaauagguagucaaggcagccucaucuccccaggugaggggcgggu

SEQ ID NO: 730807 - RNA, 62 nt, hsa
accauaaccaccccugggaaacacaucauucccagccucaggcccugcuggaauuggggcug

SEQ ID NO: 730808 - RNA, 62 nt, hsa
aucccuaggaggacccaccaguggagcacaugcagccucaguggagaugcuuggugugggga

SEQ ID NO: 730809 - RNA, 62 nt, hsa
cuuaacccccaaguaaucauuaacccccagaccagccucagaacugaaggagauuguugacc

SEQ ID NO: 730810 - RNA, 62 nt, hsa
uguugacugugagcaaagugucuuccgauuagcagccucagggaugcccugguggccucucc

SEQ ID NO: 730811 - RNA, 62 nt, hsa
ccucagucuucagauagacaguaagaagaaagcagccucauugauccgcagauguaggggcc

SEQ ID NO: 730812 - RNA, 62 nt, hsa
uguguaguccauagcccagccagaugagcuugcagccucauaggaggucagcaccuugcaaa

SEQ ID NO: 730813 - RNA, 62 nt, hsa
guccuuuaaccagcacagccaguuaaaagaugcagccucacugcuucaacgcagauuuuaau

SEQ ID NO: 730814 - RNA, 62 nt, hsa
caaccucugccuccuggguucaagugauucuccagccucagccucccgaguagcugggauua

SEQ ID NO: 730815 - RNA, 62 nt, hsa
uugcaacucuguguaccaagaaccccuagcaucagccucauuccuaagccaauaacgccugu

SEQ ID NO: 730816 - RNA, 62 nt, hsa
caucuucuggugcccacggccauuggcauugccagccucauuccaugccacuaugagucaac

SEQ ID NO: 730817 - RNA, 62 nt, hsa
gcaaaccuguuaguuuuacuucugcauugaaccagccucagaagcuacuuacugcuuuaugu

SEQ ID NO: 730818 - RNA, 62 nt, hsa
gugcugggauugcaggcaugagccaccgugcccagccucaaaaauauuuuuuaaaagaaaag

SEQ ID NO: 730819 - RNA, 62 nt, hsa
ccaugacccccaagcagauauaacaagcugugcagccucaguaggcugcuugcccucuccag

SEQ ID NO: 730820 - RNA, 62 nt, hsa
guuuuuuguguggaacagcucaccuugucagacagccucagggcaucucugagacacagggg

SEQ ID NO: 730821 - RNA, 62 nt, hsa
ccaaccccaucucccacucagaaaucaccucccagccucaggaagaguagaaauuggguggu

SEQ ID NO: 730822 - RNA, 62 nt, hsa
accccucaggagggauugcaggccccagguggcagccucagagaggaggcgcaggcaggccc

SEQ ID NO: 730823 - RNA, 62 nt, hsa
cuuuugcuuuucagugucuucucagaaacaaccagccucaaagguaauuaaacucucauuua

SEQ ID NO: 730824 - RNA, 62 nt, hsa
uggcagggccgccuucagaggcugcagggccucagccucaggaugcauuuaauguauccugg

SEQ ID NO: 730825 - RNA, 62 nt, hsa
ggauccuuugagguaaaaaaacauaaugucuucagccucauaauaaaggaaaguuaauuaaa

SEQ ID NO: 730826 - RNA, 62 nt, hsa
gccagccuucuuccaucccaggacaccacacccagccucaguccuccccucacagccucuga

SEQ ID NO: 730827 - RNA, 62 nt, hsa
ugccguuggaccuucaccuccuagagauaaaccagccucagcuggcgcagcggggcccuucu

SEQ ID NO: 730828 - RNA, 62 nt, hsa
gugagggucaccggcaggugggcugguggcugcagccucagagcccucccagguugcugcug

SEQ ID NO: 730829 - RNA, 62 nt, hsa
cgcacagcccugcaccccgccccugggguuggcagccucaguuggccccuggcagaggaaca

SEQ ID NO: 730830 - RNA, 62 nt, hsa
guuucuucaugguggggggccauuuggaaugacagccucacuuccuucugauggcuacaucu

SEQ ID NO: 730831 - RNA, 62 nt, hsa
aagguuuauuucugugaguuuuguaugaaaaucagccucauuauuuauaguugaauuuuugc

SEQ ID NO: 730832 - RNA, 62 nt, hsa
ccucucucccuccuaccaccugccaguuuccccagccucagccccagccccagccccagugg

SEQ ID NO: 730833 - RNA, 62 nt, hsa
gugcugggauuacagggaugagccaccgcgcccagccucaucucuuuguucuaaagauggaa

SEQ ID NO: 730834 - RNA, 62 nt, hsa
uucuugucuggaagaguucugcaggaaauggccagccucaaacgacaauucacggaacuguu

SEQ ID NO: 730835 - RNA, 62 nt, hsa
ucaucugaaaggcccaaaccagggggaagcaccagccucagugcagcccccuccugacccca

SEQ ID NO: 730836 - RNA, 62 nt, hsa
gggccauacccaugugucgccucucacucuggcagccucagaggccccuugcugcuggcucc

SEQ ID NO: 730837 - RNA, 62 nt, hsa
uuugucugugaguuacgggcaaccagccucuucagccucacacccauuccccugagagcaag

SEQ ID NO: 730838 - RNA, 62 nt, hsa
guuugaguucuggguauccucccuuucuguaacagccucaaauaaagguguaccuuccaugu

SEQ ID NO: 730839 - RNA, 62 nt, hsa
gaaauccgcaagcugggugugcuuugagugugcagccucacaaacauggccuuuucucucuc

SEQ ID NO: 730840 - RNA, 62 nt, hsa
guugcuaaauagauuauaauacacaaggaaagcagccucaaagaauuaccccucccaaaaug

SEQ ID NO: 730841 - RNA, 62 nt, hsa
uuguuacauaugaacauucauuuuuaaaugcucagccucaagugcaggcauuuuugaguggc

SEQ ID NO: 730842 - RNA, 62 nt, hsa
auaaugccauaagucuagauugccucaugaagcagccucauuugaauugcuuucauagcuuu

SEQ ID NO: 730843 - RNA, 62 nt, hsa
gauggaacaagagaaguacuaucuuuguguugcagccucaaccaacaacaauguguuguaaa

SEQ ID NO: 730844 - RNA, 62 nt, hsa
agacugaaaauucauugcaauuagggaacgcacagccucacaaaaagugguugugauugcaa

SEQ ID NO: 730845 - RNA, 62 nt, hsa
acuggcacugucauuuguaaaugccauugucacagccucauuuguaagcagcacugccucuc

SEQ ID NO: 730846 - RNA, 62 nt, hsa
gucucgagacgcacaugcacgccugggcguggcagccucacagggaacacgggacagacgcc

SEQ ID NO: 730847 - RNA, 62 nt, hsa
guguuuacugugcugcugcacugguccuaugccagccucacccauguggggaccacggaagg

SEQ ID NO: 730848 - RNA, 62 nt, hsa
uaguaaaaaagguaggaaaucccuaaaacuuccagccucacauagcacgguucucaccuguc

SEQ ID NO: 730849 - RNA, 62 nt, hsa
aaagaugguggaagacauaggcuaaauuucuccagccucacaauggucuucacuuggucuga

SEQ ID NO: 730850 - RNA, 62 nt, hsa
uagaagauuccuggauggagaccccauugguucagccucaagucuggcccgucuucgaaaaa

SEQ ID NO: 730851 - RNA, 62 nt, hsa
cccuggccagaagcaggagugugaggaggagacagccucagcggacaagcagcuggugcucc

SEQ ID NO: 730852 - RNA, 62 nt, hsa
ugaauucuagcaaccuuuguuaggaaaaagcacagccucagauggaggcagccuaaacugug

SEQ ID NO: 730853 - RNA, 62 nt, hsa
uuucagcuguuucaccaucagucaaugaauaacagccucauugaugucaaaaacuucaauau

SEQ ID NO: 730854 - RNA, 62 nt, hsa
ccauguuggccaggcuggucuugaacuccuggcagccucaagugauccacccaccucggucu

SEQ ID NO: 730855 - RNA, 62 nt, hsa
ugccagagggguuggccaguuggagccugggucagccucagcagccuauccccauguccucu

SEQ ID NO: 730856 - RNA, 62 nt, hsa
cauuuagugcacaguggccccaucauagccugcagccucaucauuucccaucuggaccuggu

SEQ ID NO: 730857 - RNA, 62 nt, hsa
cucaaagcuaauuuuuuacuaaaguuuuuauacagccucaaauuguuuuauuaaaaaaaaga

SEQ ID NO: 730858 - RNA, 62 nt, hsa
guccacgcagguggcuuguagaaaccuuugggcagccucaugucugcuaaaacagccaucuu

SEQ ID NO: 730859 - RNA, 62 nt, hsa
ggaaagguaauuuuaagcuaacaaccagugcacagccucagguuuuaaauuacaaccacagu

SEQ ID NO: 730860 - RNA, 62 nt, hsa
ugacccagcccuauuuuacgucauucuaaauucagccucauauaaugaaaauacauuaugaa

SEQ ID NO: 730861 - RNA, 62 nt, hsa
cuggagugcaguggcacaaugacgacucacugcagccucaaccuccuggggccaagugaucc

SEQ ID NO: 730862 - RNA, 62 nt, hsa
augggaccuuuguaggaagagacacaguccugcagccucauauggcucaauaaaacagaaag

SEQ ID NO: 730863 - RNA, 62 nt, hsa
cagcgcuuucagcuggaccacucaggccuggacagccucaucuccaugaggcuggugcuucg

SEQ ID NO: 730864 - RNA, 62 nt, hsa
uuggccucuucuugcuuugaccuggcagauaucagccucaacauugaguaugcaccucucug

SEQ ID NO: 730865 - RNA, 62 nt, hsa
aucccaguccagacgggugcugccggcucagccagccucacgcugcuaggaaauggcucccu

SEQ ID NO: 730866 - RNA, 62 nt, hsa
aaaccuccuacccaugucugagguagcaagugcagccucacgacagauaccaggcaauccag

SEQ ID NO: 730867 - RNA, 62 nt, hsa
aaguagggaacauggcagagaguggugcuucccagccucacaaugugggaauuugacauagg

SEQ ID NO: 730868 - RNA, 62 nt, hsa
uaggccauucuccuucucuuccauggagaauccagccucacaaaaggauucuuucaacuucu

SEQ ID NO: 730869 - RNA, 62 nt, hsa
cagagauggaggagccccaguggcugacaggccagccucacucaggcacguaccugcugacc

SEQ ID NO: 730870 - RNA, 62 nt, hsa
gacauacaaggacagugggucauggguaguaccagccucaaauucccacaggcucauacuca

SEQ ID NO: 730871 - RNA, 62 nt, hsa
uacaugcaugcacaugaaaacaugcacaaccacagccucaaucuuguauuuaguuuggggaa

SEQ ID NO: 730872 - RNA, 62 nt, hsa
augacagcccagugucggccuggccgggugggcagccucaggucuugagaggauaagacucu

SEQ ID NO: 730873 - RNA, 62 nt, hsa
ccgcagcagugacuacaauaguugcaccagggcagccucagcccuugcagccaguaagaaau

SEQ ID NO: 730874 - RNA, 62 nt, hsa
ccuggcaacugugagucccugcuucccgacaccagccucauggaauaugcaacaacuccugu

SEQ ID NO: 730875 - RNA, 62 nt, hsa
ucuguggaccagagugcuugaggcaucucaggcagccucagcccaagcuucuaccugccuuu

SEQ ID NO: 730876 - RNA, 62 nt, hsa
acuggagcagaauaagucuaaaggcagagccccagccucagagacaaauaggcuucaucaug

SEQ ID NO: 730877 - RNA, 62 nt, hsa
ucauuuaaguuggcuugaaucucaucagcaggcagccucaugcaaccaugagggauaguaug

SEQ ID NO: 730878 - RNA, 62 nt, hsa
aacccucccacagcacauccuacccggaagaccagccucagaggguccuucuggaaccagcu

SEQ ID NO: 730879 - RNA, 62 nt, hsa
aucacuguauacucuugcugagaauguggaugcagccucacagaucuuugcaacacuccaac

SEQ ID NO: 730880 - RNA, 62 nt, hsa
caaguauuuccagcaggaaguaaugucuuccucagccucaaccagggaccaaccggcugcuu

SEQ ID NO: 730881 - RNA, 62 nt, hsa
uguaccguaaagaauauaucuuaucuggagcucagccucaaucaugucuuaacaaaaugaca

SEQ ID NO: 730882 - RNA, 62 nt, hsa
gcccuuauggugcccugugcagggugccaccacagccucauuuuacagacagcccccugagg

SEQ ID NO: 730883 - RNA, 62 nt, hsa
ggacuggaugugccgugggcagugccuuccuccagccucacaaccuuucugcuggggcugaa

SEQ ID NO: 730884 - RNA, 62 nt, hsa
gcccuccuggcuucagcauccugcagguagagcagccucauuccuucacaagauggaaggca

SEQ ID NO: 730885 - RNA, 62 nt, hsa
gacuauuaaggguguuagucuuggagaagacacagccucaccuucucacuugcuguggguga

SEQ ID NO: 730886 - RNA, 60 nt, hsa; identical to SEQ ID NO: 730168

SEQ ID NO: 730887 - RNA, 62 nt, hsa
uuuuuaacuugggggugaaagauuuaagaacucagccucacuagaucaacggaccaaauaaa

SEQ ID NO: 730888 - RNA, 62 nt, hsa
gaguacaggucugguacaaucacaguucauugcagccucaaccuccuggguuuaagcagucc

SEQ ID NO: 730889 - RNA, 62 nt, hsa
acacaaaaggaacaaaagcgaaacacacaaaccagccucaacuuacacuugguuacucaaaa

SEQ ID NO: 730890 - RNA, 62 nt, hsa
uucagguucuuagugucacuuaccuagauuuacagccucacuugaaugugucacuacucaca

SEQ ID NO: 730891 - RNA, 62 nt, hsa
ucaccauguugcccaggcuggucucaaacccccagccucaacugauccucgcaucucagccu

SEQ ID NO: 730892 - RNA, 62 nt, hsa
ccaccugcuggguucaagcaauucuccugccucagccucaugaguagcugugacuacaggca

SEQ ID NO: 730893 - RNA, 62 nt, hsa
gcagaagcugcauuucagcugaaucuguguuucagccucaguugguugcaccguuagccccu

SEQ ID NO: 730894 - RNA, 62 nt, hsa
gucacagaagcgaaggcuugaugcugucucagcagccucagcugugggggggaagcgcgugu

SEQ ID NO: 730895 - RNA, 62 nt, hsa
agccgugagccaaguaaaccucuuuaauuacccagccucaggugcuccgggaacgccuuccg

SEQ ID NO: 730896 - RNA, 62 nt, hsa
ucgaagauguuguacuccaccgccugcaccaacagccucaguguuacuucccaggauuugcu

SEQ ID NO: 730897 - RNA, 62 nt, hsa
uuuuguaauauuuguccacuaagcuggagaagcagccucauacaguugauuuuguguaugug

SEQ ID NO: 730898 - RNA, 62 nt, hsa
agcuugggcaauucagggcagaacuccuguaucagccucauggacacccagaauugguaucu

SEQ ID NO: 730899 - RNA, 62 nt, hsa
gacagcccaaccucuggcagaccagggguuaccagccucacagcugcagcugccuucaagcc

SEQ ID NO: 730900 - RNA, 62 nt, hsa
cugccccagcagacacaggcugccagucccuccagccucaccuccccgcccugggcagcagg

SEQ ID NO: 730901 - RNA, 62 nt, hsa
cuagguaugugcaguucccggccccugccacccagccucaugcaagucauccccgacaugac

SEQ ID NO: 730902 - RNA, 62 nt, hsa
agaacgggaccuaggggacagcagcaccacuccagccucagagacugcacacccccuugccu

SEQ ID NO: 730903 - RNA, 62 nt, hsa
ccugugauuuuuuuuaaaugugcaguacacaucagccucacugagcuaauaaagggaaacga

SEQ ID NO: 730904 - RNA, 62 nt, hsa
auuggcagucgaggagucagaacucggauucccagccucacucccucuguguguguugacca

SEQ ID NO: 730905 - RNA, 62 nt, hsa
uaauauucuuuuuuuuuucuagaaacugggggcagccucaaaaucauguuaaagagggaguu

SEQ ID NO: 730906 - RNA, 62 nt, hsa
ggugaccggagagaaagaggagcccucccgcucagccucagaagcagacucugaagccggag

SEQ ID NO: 730907 - RNA, 62 nt, hsa
ucugccucccggguucaagcaauuucuugccucagccucaugaauagcugggauuacaggug

SEQ ID NO: 730908 - RNA, 62 nt, hsa
gaaucaaaaguauuuuauaaaaggagaaagaacagccucauuuuagauguaguccuguugga

SEQ ID NO: 730909 - RNA, 62 nt, hsa
caaccuccgccucccggguucaagcgauucuccagccucagcuuccugaguagaugggauua

SEQ ID NO: 730910 - RNA, 62 nt, hsa
ucugccucccggguucaagcaauucccugccucagccucaugaauagcugggauuacaggug

SEQ ID NO: 730911 - RNA, 62 nt, hsa
ucucccugucuccaacuccaguaagcccuccucagccucaccuuacgaauccaaagaacugg

SEQ ID NO: 730912 - RNA, 62 nt, hsa
cuagaguacaauauugcaaucacagcucacugcagccucaaacuccugggcucaagugaucc

SEQ ID NO: 730913 - RNA, 62 nt, hsa
cuagcggguuggggguggugguggggugcuggcagccucaggagcgaucgcuccccuggaga

SEQ ID NO: 730914 - RNA, 62 nt, hsa
uguggggcucauaaaacaugaaucaagcaauccagccucaugggaaguccuggcacaguuuu

SEQ ID NO: 730915 - RNA, 62 nt, hsa
cuggagugcgcuggcuugaucuuggcucacugcagccucaauguccccaggcucagauuguc

SEQ ID NO: 730916 - RNA, 62 nt, hsa
gaacguggucaacucacaccugccucuuccugcagccucacuucuaccugcccccaucauaa

SEQ ID NO: 730917 - RNA, 62 nt, hsa
ucccauguacagacacgguccccacacccucccagccucaggcccaggcagacaugggcgag

SEQ ID NO: 730918 - RNA, 62 nt, hsa
aaauggggcugugugcaugcaggcccauguuucagccucagcccacgccaggugaaaggauc

SEQ ID NO: 730919 - RNA, 62 nt, hsa
uuuugagugugccaggguaaaggcuuccaguucagccucaguuauuuuagacaaucucgcca

SEQ ID NO: 730920 - RNA, 62 nt, hsa
cucccuugaguucaggugcccugaacucaguacagccucaucuucucauccaccaccuucuc

SEQ ID NO: 730921 - RNA, 62 nt, hsa
cacggccuccugaacguccguccucaggagcacagccucacggacagugccaaacccugugg

SEQ ID NO: 730922 - RNA, 62 nt, hsa
aagacauugucucugucggccaggcuggagugcagccucaaccuccuggguccaagugaucc

SEQ ID NO: 730923 - RNA, 62 nt, hsa
ccagcgccccuccucccugagggagcauggcacagccucacacuugaaagacgguguuuggu

SEQ ID NO: 730924 - RNA, 62 nt, hsa
cccgugccaggacucagcaguggccuggacaacagccucagcuuccucuacccaucuucuuu

SEQ ID NO: 730925 - RNA, 62 nt, hsa
aaucuuacucccagcaccaaaagguaauugaccagccucaacacaauuuuggacaaagcuag

SEQ ID NO: 730926 - RNA, 62 nt, hsa
caguuuuuagcccuugagaggacauacuuuuccagccucauggguauggcacucuuaauuaa

SEQ ID NO: 730927 - RNA, 62 nt, hsa
ggaaagugggguccuucggggcgaugcucccucagccucagaggagcucuacccugcucccu

SEQ ID NO: 730928 - RNA, 62 nt, hsa
gggccaaggaacacccccuaguccugacacugcagccucaagcagguacgcuguacauuuuu

SEQ ID NO: 730929 - RNA, 62 nt, hsa
gccacgggcucuccugggcuuauggccggucacagccucagugugacuccacaguggccccu

SEQ ID NO: 730930 - RNA, 62 nt, hsa
uagucucugcccuauacgccgccuucacuccacagccucaccccucccacccccauacuggu

SEQ ID NO: 730931 - RNA, 62 nt, hsa
uguaauuaccgagcaaggucugagcucuucuucagccucaguucccucauugguuaaaaggg

SEQ ID NO: 730932 - RNA, 62 nt, hsa
cauggguguccacagcacuggcccccucuccccagccucagcugcuguccgccugaucuguc

SEQ ID NO: 730933 - RNA, 62 nt, hsa
gaaccaaaauuagauucaacuauucauauuaucagccucauuuuauggaaaagggaugccac

SEQ ID NO: 730934 - RNA, 62 nt, hsa
cagccaggugcccaggacagaagccccagccccagccucaucuacaccccaggagcccuggc

SEQ ID NO: 730935 - RNA, 62 nt, hsa
ucagcccaugcccuggagggcauuccccuggccagccucagccccuugucuacuuguucucc

SEQ ID NO: 730936 - RNA, 50 nt, hsa; identical to SEQ ID NO: 110858

SEQ ID NO: 730937 - RNA, 62 nt, hsa
uuucaggccaaaaccagggaagauucuagcuucagccucauguccauuuccagucugucagc

SEQ ID NO: 730938 - RNA, 62 nt, hsa
uuaugccuucaucagcgugaccccugugccugcagccucauagguguuaaucuguaauuuua

SEQ ID NO: 730939 - RNA, 62 nt, hsa
uggagugcaguggugcagucuguagcucacugcagccucaaacuccuaggcucaggcgaucc

SEQ ID NO: 730940 - RNA, 62 nt, hsa
ggaagauccuuggcugccgcuuucucuccccacagccucaaggccacccuaccgucauauau

SEQ ID NO: 730941 - RNA, 62 nt, hsa
cccuagggaagaagcaagaaacuucggggcugcagccucaggaugaggcagaaggaagggua

SEQ ID NO: 730942 - RNA, 62 nt, hsa
gagauggucucucuucucaaguaggaacaccccagccucagacagacacagcaggaaggggc

SEQ ID NO: 730943 - RNA, 62 nt, hsa
ccaacagcccacuguuaggagguaguagaccccagccucaaggcucugaccuucuucaugug

SEQ ID NO: 730944 - RNA, 62 nt, hsa
ucaccauguuacucaggcuggucucaaacucccagccucaagcgaugcucccaccuccaccu

SEQ ID NO: 730945 - RNA, 62 nt, hsa
auugcucacccaagggggcugcuuaacacaaacagccucagacccgagguuuagauuucuga

SEQ ID NO: 730946 - RNA, 62 nt, hsa
ugaucucgaacucccgaccucaggugauccgccagccucagccucccaaagugcugggauua

SEQ ID NO: 730947 - RNA, 62 nt, hsa
caaccuccgccuccuggguucaagcgauucuccagccucagccuccugaguagcuggaauua

SEQ ID NO: 730948 - RNA, 62 nt, hsa
ccucucauccucccgccgcccgucaggccggccagccucacaucagucucuccgccccgggg

SEQ ID NO: 730949 - RNA, 62 nt, hsa
ccagccaaaguccccccaccccuucagagaagcagccucaaauuccagaaguggaggcucca

SEQ ID NO: 730950 - RNA, 62 nt, hsa
ugccaccaaccgaaccgugaauguagggcccccagccucaccucugccccaggaccaacaac

SEQ ID NO: 730951 - RNA, 62 nt, hsa
cagccuguugcuguacuuuucugcuuauuuuacagccucaaauauuucucauuaucuuguca

SEQ ID NO: 730952 - RNA, 62 nt, hsa
ccagccccucaggaacccucauccuucaaagacagccucauuucggacuaaacucauuagag

SEQ ID NO: 730953 - RNA, 62 nt, hsa
uuuucuuucucaccauagaucggcgggugcugcagccucacuguguucuguguacgugacaa

SEQ ID NO: 730954 - RNA, 62 nt, hsa
uuguguaauugugacacaauuacagcugauugcagccucaaccuucccagcucaagugaucc

SEQ ID NO: 730955 - RNA, 62 nt, hsa
aauuuugcuugcucauauuucuggccaauguacagccucauauuuuucagaguaauacagau

SEQ ID NO: 730956 - RNA, 62 nt, hsa
ugugacucuuguuacagaucauggcggugcgucagccucacaggagacauagcaggucucag

SEQ ID NO: 730957 - RNA, 62 nt, hsa
agauggaaaaguguagggacugagaagggcugcagccucagcaguguacagaguccccggcg

SEQ ID NO: 730958 - RNA, 62 nt, hsa
uacagcucucagccuaagagcgcagcacugaacagccucaucauuccacuuuucaugggaaa

SEQ ID NO: 730959 - RNA, 62 nt, hsa
agcugcucacugcucacacgcugccuccucagcagccucacugcaucuuucucuucccaugc

SEQ ID NO: 730960 - RNA, 62 nt, hsa
aacagccugagccuucagcccucacagaugcccagccucauagcugaaguugccugaaugau

SEQ ID NO: 730961 - RNA, 62 nt, hsa
gaaaaaguguuagugcuuccaggcggcacugacagccucaguaacaauaaaaacaaugguag

SEQ ID NO: 730962 - RNA, 62 nt, hsa
gaggguggugaugguaguuucuacccauaccucagccucaggcgaguggcuuauagccucca

SEQ ID NO: 730963 - RNA, 62 nt, hsa
cuucagcuuggguacacacacagaggagaccucagccucacaccagaaauauuauuuuuuua

SEQ ID NO: 730964 - RNA, 62 nt, hsa
cuuccaugaaugaccccucagucuggccuccccagccucaagguccacucaggcacaagagc

SEQ ID NO: 730965 - RNA, 62 nt, hsa
acaugccgugugccuuuaguuagcacagcgggcagccucagugaaacucuuagguuaagcag

SEQ ID NO: 730966 - RNA, 62 nt, hsa
aaugacaugauuaaaugaugaauuuauuuugucagccucagcaacaaacauuuccuaaaugg

SEQ ID NO: 730967 - RNA, 62 nt, hsa
uguauaguuacgaugccagauuagauuuauagcagccucaaguuguauuaaaugauauuuug

SEQ ID NO: 730968 - RNA, 62 nt, hsa
gggucagauaaaugaagaucaaacuccagcuccagccucauuugcuugagacuuugugugua

SEQ ID NO: 730969 - RNA, 62 nt, hsa
gggucauucuugucacaaaagugccacuaaaacagccucaggagaauaaaugacuugcuuuu

SEQ ID NO: 730970 - RNA, 62 nt, hsa
uugcuuuuacaguggacagccucuucucguuucagccucaguauuauguagggaccuuaugc

SEQ ID NO: 730971 - RNA, 62 nt, hsa
accuacuuguaauuaacuugaguuguaguccacagccucaggacaaaugucguugagguuac

SEQ ID NO: 730972 - RNA, 62 nt, hsa
cccaguggcagucucagguuaagaaggaaaugcagccucaguaacuuccuuuucaaagcagu

SEQ ID NO: 730973 - RNA, 62 nt, hsa
guccacacacacaucucacgccccuggucucacagccucacaccuuguccuuccaccccugc

SEQ ID NO: 730974 - RNA, 62 nt, hsa
ugcaaacagcgcaauuccaagcucgagagcuucagccucaggaaagaacuuccccuucccug

SEQ ID NO: 730975 - RNA, 62 nt, hsa
cauaucacuuugcucuuaccauuccuuuugaucagccucaauucagccucauuguguaguau

SEQ ID NO: 730976 - RNA, 62 nt, hsa
gcucuuaccauuccuuuugaucagccucaauucagccucauuguguaguauguuuuuucuuu

SEQ ID NO: 730977 - RNA, 62 nt, hsa
gagaugugugcuccuggagggaaaaagaaauacagccucaacagauuaaaaaacaaaaguca

SEQ ID NO: 730978 - RNA, 62 nt, hsa
aacaaaacugugucuuaucugccaggaaagaccagccucacuccugggaacugucuggcagg

SEQ ID NO: 730979 - RNA, 62 nt, hsa
gagaggcggaacugcuguguccucauguggcgcagccucaaacuggcauccaggcacugggc

SEQ ID NO: 730980 - RNA, 62 nt, hsa
uagauuuuauuauguuaguuuaaaaggucaaucagccucaugacuuuauaguuaugucuugu

SEQ ID NO: 730981 - RNA, 62 nt, hsa
aaggcuuaugggucuccagaaacucugccagccagccucaguggagaagcuuccucuaccac

SEQ ID NO: 730982 - RNA, 62 nt, hsa
ucaaggucccuugaaucccaaaagugccuccccagccucagcccccaccuccagccacacac

SEQ ID NO: 730983 - RNA, 61 nt, hsa; identical to SEQ ID NO: 730265

SEQ ID NO: 730984 - RNA, 62 nt, hsa
uccuaaguaagaacauaauguaaaauugucagcagccucauggggaggaaaaaggaagaguc

SEQ ID NO: 730985 - RNA, 62 nt, hsa
uguccucacuggugcuccaggggaagaaacgacagccucacuucuguauggacugcugaugu

SEQ ID NO: 730986 - RNA, 62 nt, hsa
ggaaacguugggguuucuuccuccagugacagcagccucaguagcuuuccugggcuccaggc

SEQ ID NO: 730987 - RNA, 62 nt, hsa
gcuccaugcucaccagcagccgcccaggcccgcagccucacccggcucccucuccucacccu

SEQ ID NO: 730988 - RNA, 62 nt, hsa
gaggaauaaagcugugagcaaacagaggaggccagccucaccucauuccaacaccugccaua

SEQ ID NO: 730989 - RNA, 62 nt, hsa
gcagggugugaugaggugggagcccucagugccagccucaucacugugugacccugggucug

SEQ ID NO: 730990 - RNA, 62 nt, hsa
cucauccccuuauaaaugugcuuugccugccucagccucauggucagagcaguggagacugg

SEQ ID NO: 730991 - RNA, 62 nt, hsa
ugcuguaauugaacgggucgagaugccgaccucagccucacaggccaaagcaucagcaccag

SEQ ID NO: 730992 - RNA, 62 nt, hsa
ccggcacaucuaacaucuacacuucucuagcucagccucacaggccaaagcaucagcaccag

SEQ ID NO: 730993 - RNA, 62 nt, hsa
caugggcucgugagcacacucagugcccagcccagccucaaggugagccccgggcccaggcu

SEQ ID NO: 730994 - RNA, 62 nt, hsa
ccugaaccuccuccuccagccucaccuuccuccagccucaccacuccucccuggaccugcag

SEQ ID NO: 730995 - RNA, 61 nt, hsa; identical to SEQ ID NO: 110868

SEQ ID NO: 730996 - RNA, 62 nt, hsa
aagucaggcuagcugugcugguauuggaauagcagccucacacuggcgucuggacuguucug

SEQ ID NO: 730997 - RNA, 62 nt, hsa
cugcgaaguccagaguccaggguggagcgcgccagccucagccagagcagccacgacagcca

SEQ ID NO: 730998 - RNA, 62 nt, hsa
ccaggggagggugcgugggggcgguguggcugcagccucagucccugccccuccagcccaca

SEQ ID NO: 730999 - RNA, 54 nt, hsa; identical to SEQ ID NO: 730281

SEQ ID NO: 731000 - RNA, 62 nt, hsa
ggaucuggagucucugaacucuuaauaggaugcagccucacauacauaaugucacccauuuu

SEQ ID NO: 731001 - RNA, 62 nt, hsa
agugcugggagaugaucagaaaucucagggcacagccucaggucuaccuggacacucaucca

SEQ ID NO: 731002 - RNA, 62 nt, hsa
uuugguuucacuaagggccaugugguucccugcagccucaugccuggccccuugacacaucc

SEQ ID NO: 731003 - RNA, 62 nt, hsa
gugugacucccuucaggcaguccuuuaguccccagccucaccuuugcucucaaugucaugca

SEQ ID NO: 731004 - RNA, 54 nt, hsa; identical to SEQ ID NO: 730286

SEQ ID NO: 731005 - RNA, 62 nt, hsa
guuuuguuaaaaaaaaaaaaaaaaaaaggaaacagccucacuuuuuugugcucccucagaau

SEQ ID NO: 731006 - RNA, 62 nt, hsa
ggagcuacaggggcacuuaacccaccacagcacagccucaucaaaaugcagcuggcaacuuc

SEQ ID NO: 731007 - RNA, 62 nt, hsa
ccauacuucuuuuuuuuccucugaugugaauccagccucagacugagugaacuguaauaauu

SEQ ID NO: 731008 - RNA, 62 nt, hsa
agugcuagucccagaggaugcugcggagggggcagccucagcucucuuuucagagaagauca

SEQ ID NO: 731009 - RNA, 62 nt, hsa
ggaaggaucaccugagccuaggaguucaagaccagccucagcaacagcaggagccccacccc

SEQ ID NO: 731010 - RNA, 62 nt, hsa
ccuacuguccaugcggccucacugggggccaucagccucaccagcaaagcagagaugagagc

SEQ ID NO: 731011 - RNA, 62 nt, hsa
uugcagugagccaagaucgcgccacugcacuccagccucagcaauagagugagacugucuca

SEQ ID NO: 731012 - RNA, 62 nt, hsa
cuagagugcaguggcaugaucagggcuuacugcagccucacccucgauuuccugggcucaag

SEQ ID NO: 731013 - RNA, 62 nt, hsa
aaagaaaacgaaaacaguuuaaaucucuaccacagccucacaagcaaaugcuaaggggaaca

SEQ ID NO: 731014 - RNA, 62 nt, hsa
caggccucacauucguggggcucccugaauggcagccucagcacagcguaggcccuuaauaa

SEQ ID NO: 731015 - RNA, 62 nt, hsa
aaaggagaggaguagaugagauggaauuuuuccagccucauccuggccugcccucuagacuc

SEQ ID NO: 731016 - RNA, 62 nt, hsa
aggugggcgcauagguacaagugcugcuuugucagccucacucccugcagcucucagcuccc

SEQ ID NO: 731017 - RNA, 62 nt, hsa
gccacagaggccucccagggcucucggccagucagccucagaaugagaguuacaccacuggc

SEQ ID NO: 731018 - RNA, 62 nt, hsa
cuggagugcaguggcaugaucauggcucacugcagccucaaccuccagggcuuaagcaaucc

SEQ ID NO: 731019 - RNA, 62 nt, hsa
cuuuuaaaaaggaaggguagacucacuuagcucagccucacccaugcuaagggcacaugcac

SEQ ID NO: 731020 - RNA, 62 nt, hsa
cuggagugcaguggcaugaucauagcucacugcagccucauacuccugggcucaagcaaucc

SEQ ID NO: 731021 - RNA, 62 nt, hsa
augauggaggugacaucaggcagaggagagugcagccucacagugacuuucucagaggugac

SEQ ID NO: 731022 - RNA, 62 nt, hsa
ccgucacucuuggaggacuccugugacguggucagccucauucauccuugcccuucucaggg

SEQ ID NO: 731023 - RNA, 62 nt, hsa
uugccuuugcugggccuucugugcaggacgcucagccucagggcucagaaggugccaguccg

SEQ ID NO: 731024 - RNA, 62 nt, hsa
agguggauugcuugagcucgggaguuugagaccagccucaucaacacagugaaacuccaucu

SEQ ID NO: 731025 - RNA, 62 nt, hsa
aaaccagugcaugcaccugguuggaagaugcucagccucacaaaagcuccaagcccuuuggg

SEQ ID NO: 731026 - RNA, 56 nt, hsa; identical to SEQ ID NO: 730308

SEQ ID NO: 731027 - RNA, 62 nt, hsa
uauuuuaaauuagcuuuucuaaaaaaaaaauccagccucauaaaguagauuagaaaacuaga

SEQ ID NO: 731028 - RNA, 62 nt, hsa
uguaugcaugcauuuucaagcaaguaauaaagcagccucauuuaauucuggauaaugcuggg

SEQ ID NO: 731029 - RNA, 62 nt, hsa
ccaaaacucuuuauggcauuuuacaaugcacacagccucaugcaaguuuagacaaguggauu

SEQ ID NO: 731030 - RNA, 62 nt, hsa
cuggagccguuccaucccggagcuuggaggggcagccucaggugugugccugggcaccgcuc

SEQ ID NO: 731031 - RNA, 62 nt, hsa
ucgagggacguguguuccccagcugaucgugucagccucaugccccaggccucaucuuucau

SEQ ID NO: 731032 - RNA, 62 nt, hsa
ucgaggggcguguguuccccagcugaucaugucagccucaugccccaggccucgucuuucau

SEQ ID NO: 731033 - RNA, 62 nt, hsa
agggccuuuggguggggagggcccgggccggacagccucagcuccguccccugccccacaag

SEQ ID NO: 731034 - RNA, 62 nt, hsa
cauccccugguggcuucagcaguccuuaucaccagccucacaaucccacaggcccaccccca

SEQ ID NO: 731035 - RNA, 62 nt, hsa
auguguggggaggauccaucccccacccacugcagccucacaccgaguccaccuuggacaug

SEQ ID NO: 731036 - RNA, 62 nt, hsa
agagggccaucagaaggaagccaaagaguucacagccucagcaccaacaacucaacaugguc

SEQ ID NO: 731037 - RNA, 62 nt, hsa
uuuauguuuccuaaaggaaauuguuuauucuacagccucaguagguagacacaaacauaaag

SEQ ID NO: 731038 - RNA, 62 nt, hsa
gugguauaaucuccauuucaaaaccaaggaagcagccucagaguggucgagugacacaccuc

SEQ ID NO: 731039 - RNA, 62 nt, hsa
gcugugcuaagccugccacgggcguauccuugcagccucacaacagugggaggucuguaucc

SEQ ID NO: 731040 - RNA, 62 nt, hsa
cguaugcugcacaagcguguacacccccugggcagccucaaaaccccgcuuacagcagcaac

SEQ ID NO: 731041 - RNA, 62 nt, hsa
aggggccccucccugccucggcucugccgccccagccucaguuccugcuucuggucuucucc

SEQ ID NO: 731042 - RNA, 62 nt, hsa
ggggcuugcccacccaccccgaccccagcccccagccucagccccgguccgggggcagccag

SEQ ID NO: 731043 - RNA, 62 nt, hsa
cagccugcccugcgguccugucaccuggaggccagccucacaugcccaaaucuccagucucc

SEQ ID NO: 731044 - RNA, 62 nt, hsa
guggggugcccgcugccuguccuccgugaaaccagccucagaucagggcccugccacccagg

SEQ ID NO: 731045 - RNA, 62 nt, hsa
ggcgugaccuuggcucacugcaaccuccaggccagccucagccucccuaguagcugggacua

SEQ ID NO: 731046 - RNA, 62 nt, hsa
uugauaagcaagaaagauuucaucucccaccccagccucaaguaggaguuuuauauacugug

SEQ ID NO: 731047 - RNA, 62 nt, hsa
cacauguugccugagcugguuaaccacaucggcagccucagcuaccacaacauacugacuaa

SEQ ID NO: 731048 - RNA, 62 nt, hsa
caucucuugauaaaggagagguuaaagcaaaccagccucagcggaccacucuucucuccaag

SEQ ID NO: 731049 - RNA, 62 nt, hsa
cuuccaguauggccccaccauguuugucccuccagccucagccaagcaacauggggugaacc

SEQ ID NO: 731050 - RNA, 62 nt, hsa
cagugagcagccuggagcccuggagaccccaccagccucaccagcgcuugaagccugaaccc

SEQ ID NO: 731051 - RNA, 62 nt, hsa
ccacccugccagcagcuuccggccaguccccacagccucaucagcucucuucaccguuuuuu

SEQ ID NO: 731052 - RNA, 62 nt, hsa
gggccucucugggcccuacagccucacuuccccagccucaccuugcuguccucugacacugc

SEQ ID NO: 731053 - RNA, 62 nt, hsa
uguuggaggcacuagggccucucugggcccuacagccucacuuccccagccucaccuugcug

SEQ ID NO: 731054 - RNA, 62 nt, hsa
ccuggcagguggccaggcaggcgggggcugcucagccucauccugagagaccugcccucucu

SEQ ID NO: 731055 - RNA, 62 nt, hsa
agaguacuuucauacucuucuaaguccucuuccagccucacuuugaguccuccuugggguug

SEQ ID NO: 731056 - RNA, 62 nt, hsa
ugcuuacccacugccugcccagacuuucuauccagccucacugagcugcccacuacuggaag

SEQ ID NO: 731057 - RNA, 62 nt, hsa
augaacugguuuuggucccucuaaugauccuccagccucaucuaaugccccccaaagacuga

SEQ ID NO: 731058 - RNA, 60 nt, hsa; identical to SEQ ID NO: 730340

SEQ ID NO: 731059 - RNA, 62 nt, hsa
uggcuuucugaguccuguuggccaccaagugucagccucagcacucccgggacuauugccaa

SEQ ID NO: 731060 - RNA, 62 nt, hsa
uuuauuuuuuacuuuaaaugccugccaaggagcagccucaagcccagagaagacugaggcua

SEQ ID NO: 731061 - RNA, 62 nt, hsa
cagcaagccuccuuugugcuauguggagcucacagccucacaugugaacacccgugucuggg

SEQ ID NO: 731062 - RNA, 62 nt, hsa
ucuguagcacaggcaaugccagugccaugcugcagccucagaaaccaggccucucacuccag

SEQ ID NO: 731063 - RNA, 62 nt, hsa
acaccugccggcaguagcccccacgcuggccccagccucagaccccacccagcaccuuccca

SEQ ID NO: 731064 - RNA, 60 nt, hsa
gacgucucuuucuauucaauaaacagaugcugcagccucauggcccucaccucuuuggac

SEQ ID NO: 731065 - RNA, 62 nt, hsa
uaugacguguuuggcuguuggcucaccgagaccagccucaucucggggaaccugcaccgcau

SEQ ID NO: 731066 - RNA, 62 nt, hsa
cucucauugcugcuguugaguucagcuuuuaccagccucaguguggaggcuccaucccagca

SEQ ID NO: 731067 - RNA, 62 nt, hsa
caaagagauuuugaaaaccaauuguauuuaaccagccucaaauugugcaaccaugauguaua

SEQ ID NO: 731068 - RNA, 62 nt, hsa
ggccaggaggcuguuccaggaguccugcccagcagccucaguggccaagcccagacacucac

SEQ ID NO: 731069 - RNA, 62 nt, hsa
uaugauauugcaaaagugauacuuagauuuuacagccucaguagucugcccaguguccacau

SEQ ID NO: 731070 - RNA, 62 nt, hsa
ggcagcuaacacgcccgggguggccacagcgccagccucagacuggagggcaagggguuccc

SEQ ID NO: 731071 - RNA, 62 nt, hsa
uuuuucuccugcaggguacugggccaggcccucagccucagagagccugcagaagggcuugg

SEQ ID NO: 731072 - RNA, 62 nt, hsa
cgacgcgacgcgaugccucccggccaccgccccagccucaccccaucccacgacccccgcaa

SEQ ID NO: 731073 - RNA, 62 nt, hsa
ccuaguauguucugacaucuggcuucccuucucagccucauguccaccugccugccagccag

SEQ ID NO: 731074 - RNA, 62 nt, hsa
acuacaccacacacaacagccaacagcuacaacagccucacuuggucugccaggcccccacc

SEQ ID NO: 731075 - RNA, 62 nt, hsa
caagugaaugggucucaaagacuuggugaccccagccucaucuucuaggccuuuuccaccca

SEQ ID NO: 731076 - RNA, 62 nt, hsa
aaggccacuucucaagcagcuuuuggcaccuucagccucagaguggaaucuuuuaaagacag

SEQ ID NO: 731077 - RNA, 62 nt, hsa
gcuggugguugccucccguccugggcaggcugcagccucaugccaugucucucucccacuac

SEQ ID NO: 731078 - RNA, 62 nt, hsa
acagcguucgcccuuuagcggggaggucauuacagccucauggccucuaccaaggccccaga

SEQ ID NO: 731079 - RNA, 62 nt, hsa
cacuucgcuucagccuccggaccauuccggagcagccucacauaccucacugucucgucugu

SEQ ID NO: 731080 - RNA, 62 nt, hsa
caaccuccgccuccuggguucaagcgauucuccagccucagccucccgaguagcugggauua

SEQ ID NO: 731081 - RNA, 62 nt, hsa
ucacuaguucuuaacauuguaaaaaguuugaccagccucagaaggcuuucucuguguaaaga

SEQ ID NO: 731082 - RNA, 62 nt, hsa
aaaacugggccgauguggugugacauccccaccagccucagaugagacgggccaggacgccc

SEQ ID NO: 731083 - RNA, 62 nt, hsa
caugaacaagucuguaaagcucagacauuugucagccucaacagcaccacccauucaagcau

SEQ ID NO: 731084 - RNA, 62 nt, hsa
ccaauuuguaaagccacauuugcauaugaugccagccucacgcauuuguauaucuccagaaa

SEQ ID NO: 731085 - RNA, 62 nt, hsa
ggcuaccccuccuggccacccaguacucccuccagccucagcuggcugaaccucgccgcucc

SEQ ID NO: 731086 - RNA, 62 nt, hsa
gaaaaagaacuagcagagggccugggcucuuccagccucagugugccucucuggccgcccac

SEQ ID NO: 731087 - RNA, 62 nt, hsa
aucuaauucuggcaggaccucaccaaaagauccagccucauaccuacaucagacaaaauauc

SEQ ID NO: 731088 - RNA, 62 nt, hsa
gcugaaggcgagggguggaggaggccccagcacagccucaucuccauguguacacgugugua

SEQ ID NO: 731089 - RNA, 62 nt, hsa
ucgcaguuggggcugaggcuggggcuggcugccagccucaguucugggagcgcuggggucgc

SEQ ID NO: 731090 - RNA, 62 nt, hsa
uccugaggggagacagagcaaccccuggaccccagccucaaauccaggacccugccaggcac

SEQ ID NO: 731091 - RNA, 62 nt, hsa
ccuuuccuaggcacauucguccacuaagggaacagccucagaaacugguacagcaaugggug

SEQ ID NO: 731092 - RNA, 62 nt, hsa
ggggagauucaggaucccccugugccagagcacagccucaccggaugcugcuucccacacug

SEQ ID NO: 731093 - RNA, 62 nt, hsa
uaaccuccgucuccuggguucaagugauucuccagccucagccucccgaauagcugggauua

SEQ ID NO: 731094 - RNA, 62 nt, hsa
gguugggaagccuuccgucugcggugggcaggcagccucacccugggcccacagaccggccu

SEQ ID NO: 731095 - RNA, 62 nt, hsa
cugucauuguuccuuccccagaagcuaagagccagccucagagccuacccaggagcugugaa

SEQ ID NO: 731096 - RNA, 62 nt, hsa
gcaggaucagguuagggcgagcgcuaccucuccagccucagcucucaguugcagcccugcug

SEQ ID NO: 731097 - RNA, 62 nt, hsa
gggcauguuauggggaggggaggggguucuuccagccucaggucccagcugucucacguugu

SEQ ID NO: 731098 - RNA, 62 nt, hsa
cucccagccacuuucccuccuggcacugccaccagccucaccgccugcgggcagggggaggc

SEQ ID NO: 731099 - RNA, 62 nt, hsa
uuccucucagcuccgccccauacccgucacuacagccucaccucccaccccugucacuacgg

SEQ ID NO: 731100 - RNA, 62 nt, hsa
cacuacggccucaccucccaccccugucacuacagccucaccuccuacagccuuaaguccca

SEQ ID NO: 731101 - RNA, 62 nt, hsa
ucccacgugguugucccgggaaagcugccccacagccucagcaucuucagcacuuaccgauc

SEQ ID NO: 731102 - RNA, 62 nt, hsa
ggacguccugugugccaagugguuuauaugcccagccucauuuaauccucagaaugacucca

SEQ ID NO: 731103 - RNA, 62 nt, hsa
cuggccaggcccaaggacccagccaucaaaaccagccucaaaucugguugugauggagaagu

SEQ ID NO: 731104 - RNA, 62 nt, hsa
cuagccgggccucaccccaccccuacccgccacagccucagggugugcaggggagccugcug

SEQ ID NO: 731105 - RNA, 62 nt, hsa
ugugugaccuuaggaagucucugccccucucucagccucagugucccgagggccccgaagca

SEQ ID NO: 731106 - RNA, 62 nt, hsa
cugcacaccagccugggugacagugugagacccagccucaaaaaaaaaaaaaaaaaagugau

SEQ ID NO: 731107 - RNA, 62 nt, hsa
uggucucaaacuccugggcucaagcgaacugucagccucagccucccagugugcugggauua

SEQ ID NO: 731108 - RNA, 62 nt, hsa
aacugcaccugggcagcuccucccugugcccccagccucagcccaacuucuuacccgaaagc

SEQ ID NO: 731109 - RNA, 62 nt, hsa
caagaguccccuuggguacaccccucugcccacagccucagcauuucuuggagcagcaaagg

SEQ ID NO: 731110 - RNA, 62 nt, hsa
agucuuggaccccacgagagagaaucguuccucagccucauggugaacucgcgcccuccagc

SEQ ID NO: 731111 - RNA, 62 nt, hsa
cuucccgcacccagcaugcagcucugccuccgcagccucagugcgcuuuccugcgcgcacug

SEQ ID NO: 731112 - RNA, 62 nt, hsa
ucguuccgguuauguuguguaagucaacucuucagccucauucacuguccuggcuuuuauuu

SEQ ID NO: 731113 - RNA, 62 nt, hsa
ucagauauauacaaaugaaauuagaagaaacacagccucaugggacagaaauuugagggagg

SEQ ID NO: 731114 - RNA, 62 nt, hsa
agaagccuguguucuucaagagcagguguucucagccucacaugcccugccgugcuggacuc

SEQ ID NO: 731115 - RNA, 62 nt, hsa
cagcgugagggugugucuucccuggauagcagcagccucagccucugccuguccagcgccaa

SEQ ID NO: 731116 - RNA, 62 nt, hsa
cagagaugguuugaaggcccagucuucucucccagccucaguuggagccaaagcuuuguccu

SEQ ID NO: 731117 - RNA, 62 nt, hsa
uagcccggccagggccuggugugaggcugggccagccucagcucagccucccccugcugcuc

SEQ ID NO: 731118 - RNA, 62 nt, hsa
gugcuggaauuacuggcgugagccaccaugcccagccucaaauauguuuuuaaaaaauauca

SEQ ID NO: 731119 - RNA, 62 nt, hsa
agcccagcagguaugggcaucugggaaaccuccagccucaaguguguuaguaacaugaaaaa

SEQ ID NO: 731120 - RNA, 62 nt, hsa
uacuccuggcaacaucaggccaacguccaccccagccucacauugccagauguuggcagaag

SEQ ID NO: 731121 - RNA, 62 nt, hsa
uuccgcgcccauuggugacccuuccaggcagacagccucagcaacgccccugguggacagga

SEQ ID NO: 731122 - RNA, 62 nt, hsa
cgaacuccugggcuuaaaugacucuucugccucagccucaccaaaguguugggauuacuggu

SEQ ID NO: 731123 - RNA, 62 nt, hsa
ggaggaccugagggugcucaaagggccaggcucagccucaagcaguguuuucauugccaaca

SEQ ID NO: 731124 - RNA, 62 nt, hsa
cucacauuguuccuccagaccgcagguucccccagccucagguugcuggagcugucacauga

SEQ ID NO: 731125 - RNA, 62 nt, hsa
ccuugacugugucccagccagcaccaggccagcagccucaucccugccauucagggcuguuc

SEQ ID NO: 731126 - RNA, 62 nt, hsa
ggguuugaccucugcccacauggccauggagucagccucagcccugucuguacugcucgucc

SEQ ID NO: 731127 - RNA, 62 nt, hsa
acaaagaacaaucacuaaaaccacacucaccccagccucauugugccaagccuucugugaga

SEQ ID NO: 731128 - RNA, 62 nt, hsa
aagggccuggcucacaugccccuccuuagaggcagccucaagaugaaccagggaaucaaacu

SEQ ID NO: 731129 - RNA, 62 nt, hsa
aagcaggacuggggagagauccaggacugagccagccucaggccagggcgggaaagcaggcu

SEQ ID NO: 731130 - RNA, 62 nt, hsa
agccugcuucccaccucccugcccaggccggccagccucacccuugcgaaccgugagcagga

SEQ ID NO: 731131 - RNA, 62 nt, hsa
uucaguaucaaggcugccuggagaaaggauggcagccucagggcuuccuuauguccuccacc

SEQ ID NO: 731132 - RNA, 62 nt, hsa
gcacagugcuccuccauaucaccagucauacacagccucauuauuaaggucuuauuuaauuu

SEQ ID NO: 731133 - RNA, 62 nt, hsa
uugcuacucucucccucuccaucccaucuuugcagccucauagggugggauacagcagcuuu

SEQ ID NO: 731134 - RNA, 62 nt, hsa
ugaucuugaacuccugggcucaagcaaucugccagccucagccucucaaagugcugggauua

SEQ ID NO: 731135 - RNA, 62 nt, hsa
cuagagugcaguggugcaaucucagcucacugcagccucaacugccccagguuuaagcaauc

SEQ ID NO: 731136 - RNA, 62 nt, hsa
uaugugugugucuacgugcagcucacuaccaacagccucaugugcacuugaccugacagugc

SEQ ID NO: 731137 - RNA, 62 nt, hsa
agaauaaggaacaagcauuauuccuuugccaacagccucacucuaagaggcuuuuuugcuga

SEQ ID NO: 731138 - RNA, 62 nt, hsa
cccggcagacccacccacccccuggggcugcucagccucaggcacggacagggcacaugaua

SEQ ID NO: 731139 - RNA, 62 nt, hsa
cucucucuuugcucucuuucucccuccccuaccagccucauucuuccuccgguagccucucc

SEQ ID NO: 731140 - RNA, 62 nt, hsa
gguagccucucccaccuaaccucugcaucccccagccucauguccugccccaucccuauccu

SEQ ID NO: 731141 - RNA, 62 nt, hsa
caagacacuacgggaacaguuugccucccucccagccucaaccacaauucuuccaugcuggg

SEQ ID NO: 731142 - RNA, 62 nt, hsa
cugcuaugcaccacuugaaggagcucuaucaccagccucaaacccgaaagacugaggcauuu

SEQ ID NO: 731143 - RNA, 62 nt, hsa
caggacggcagggucauccugagccgccaaggcagccucagucagagcacccugaaguuuuu

SEQ ID NO: 731144 - RNA, 62 nt, hsa
uggaaagaaguucaguggucccauuguuaacucagccucaaaucucaacugucaggcccuac

SEQ ID NO: 731145 - RNA, 62 nt, hsa
caccuggagauccugaacugucaagccacuggcagccucaugccaccacauuugccagaaau

SEQ ID NO: 731146 - RNA, 62 nt, hsa
ggaaagugaugucagaauagcuuccaauaaagcagccucauucugaggccugagugauccac

SEQ ID NO: 731147 - RNA, 62 nt, hsa
cgaaccuuggccugggccguaucuccggcucccagccucagcgcggcccucccgaguuaagg

SEQ ID NO: 731148 - RNA, 62 nt, hsa
ccccagccaguccugagccucccgccaaaucccagccucacuaggugggacccccuucccag

SEQ ID NO: 731149 - RNA, 62 nt, hsa
cuggagugcaguggugugaucacagcucacugcagccucaaccucugaaggcccagaugauc

SEQ ID NO: 731150 - RNA, 62 nt, hsa
caaaaugccauuuagcaauaaauaacacuugucagccucagagcauuuaaggaaacuagaca

SEQ ID NO: 731151 - RNA, 62 nt, hsa
uggucucaaacuccuaggcuuaagcaguccuccagccucagccuucucaaagugcuaggaug

SEQ ID NO: 731152 - RNA, 62 nt, hsa
cuggagugcaguggcauaaucauaccucauugcagccucagacuccuggguucaagcaaucc

SEQ ID NO: 731153 - RNA, 62 nt, hsa
guggagugcagugacgacaucacagcucacugcagccucaaccuggguucaagugauccucu

SEQ ID NO: 731154 - RNA, 62 nt, hsa
caauuuuguauaaauauauagaaacacacacacagccucagacuuacaaacugauuauacuc

SEQ ID NO: 731155 - RNA, 62 nt, hsa
gcccucuauccuaucauagauaacauucuccacagccucacuucauuccaccuauucucuga

SEQ ID NO: 731156 - RNA, 62 nt, hsa
cuuacgcccuuccccuugaccuuguccugccccagccucacggacagccugcgcagggggcu

SEQ ID NO: 731157 - RNA, 62 nt, hsa
agcccaggaccccugaccccggccgcugcugccagccucagaaaggcacccaggugugcagg

SEQ ID NO: 731158 - RNA, 62 nt, hsa
ugugaauaaaauucuuauugucuaaauugagacagccucagauauuugcagauauuuacuuu

SEQ ID NO: 731159 - RNA, 62 nt, hsa
ggccccacucuguucccaagcaguucaugauacagccucaccuuuuggccccaucucugguu

SEQ ID NO: 731160 - RNA, 62 nt, hsa
aauaguugggacaucagcugacuaauagaccucagccucaaaaggcuuggaaagaaaaaaca

SEQ ID NO: 731161 - RNA, 62 nt, hsa
uuccuggcucugcaaaccccagacuuugcacacagccucaggcuccacacagaaaugugaac

SEQ ID NO: 731162 - RNA, 62 nt, hsa
ugagagacccaaggaggaaaaacagacaaaaacagccucacagaagaauaugacagcugucc

SEQ ID NO: 731163 - RNA, 62 nt, hsa
uucaguucugccaucuuguuuucaaagggcuccagccucacucagucccuaauuaugggacu

SEQ ID NO: 731164 - RNA, 62 nt, hsa
caugcuggccucaugggcuugggggccuacagcagccucaccuucagcuucaugccucuucc

SEQ ID NO: 731165 - RNA, 62 nt, hsa
uggcagguaugacaacucauccaguggaaacacagccucacacugcccuuccgccccccaca

SEQ ID NO: 731166 - RNA, 62 nt, hsa
cuagagugcaauggugcaaucacagcucacugcagccucaaccuccuggguucaagcaaucc

SEQ ID NO: 731167 - RNA, 62 nt, hsa
gugcugagugcugaagcagugcgcaacacccucagccucaugcauuccugcggcauguauga

SEQ ID NO: 731168 - RNA, 62 nt, hsa
ucagagcgcgcugugugugugugugugugugucagccucagagcgcgcgcugugugugugug

SEQ ID NO: 731169 - RNA, 62 nt, hsa
ccaucaucccuuccauugccacacccuagauccagccucaggaacuaacaaguuuugagaaa

SEQ ID NO: 731170 - RNA, 62 nt, hsa
cuucgcauccugcagaagaguccuggugguggcagccucaccgcggcacacguucuagcuca

SEQ ID NO: 731171 - RNA, 62 nt, hsa
ccagcaaagcugagacaaaauuggagaagcugcagccucacgcaccaucccccucuuuccac

SEQ ID NO: 731172 - RNA, 55 nt, hsa; identical to SEQ ID NO: 110882

SEQ ID NO: 731173 - RNA, 62 nt, hsa
ccccguuccaagugcacugcccggccaagccccagccucagccugcgccugagcugcaugcg

SEQ ID NO: 731174 - RNA, 62 nt, hsa
cugguguguauucucaugugguuugcacagcccagccucacagcacuauuguaaacccugcu

SEQ ID NO: 731175 - RNA, 62 nt, hsa
uuaaugaaaaaaaguaaaacuucguucuuuaucagccucaugccugaaucaaauuuuuaauu

SEQ ID NO: 731176 - RNA, 62 nt, hsa
cuguggagggggcugcagggcugaccagcaggcagccucaucuggucgggggcgggggcggc

SEQ ID NO: 731177 - RNA, 62 nt, hsa
gccccgccuggagcccaggccaguguuguuuccagccucaggccacgggcuggacgggccug

SEQ ID NO: 731178 - RNA, 62 nt, hsa
auuuggagccgggucuagagggaacccucuaucagccucaggaaaacaagaccucugugcac

SEQ ID NO: 731179 - RNA, 62 nt, hsa
accuguuugcauggagaaaugggcuggccccacagccucacaggagcaguuugugggcuggu

SEQ ID NO: 731180 - RNA, 62 nt, hsa
gcagacucucugucgccaggcuucuccugccucagccucacgaguagcugggacuacaggca

SEQ ID NO: 731181 - RNA, 62 nt, hsa
uccuccccuaccagcucagccccgagcugccgcagccucaggcagaacggaggucaccuucu

SEQ ID NO: 731182 - RNA, 62 nt, hsa
caugagaugcuuuuucuuaaugugauuuuguucagccucacuguuuuuaccuuaauuucaac

SEQ ID NO: 731183 - RNA, 62 nt, hsa
aagugugggcugugcccuagccacaccacagccagccucagggagccacggcccgucuaguc

SEQ ID NO: 731184 - RNA, 62 nt, hsa
cgugaacugucaucaccuggcaaccccagccccagccucagcccugcccccuuucccuccuu

SEQ ID NO: 731185 - RNA, 62 nt, hsa
ucuagggccuuuuuucaauaacuugaaaaucacagccucaucauuagcaacuuuauauacac

SEQ ID NO: 731186 - RNA, 62 nt, hsa
caaccuccaccuccuggguucaagcgcuucuccagccucagccuccugaguagcugggauua

SEQ ID NO: 731187 - RNA, 62 nt, hsa
ucccucaucuagucuugaccucuccagcaucccagccucagaagccuucuugcugcccacaa

SEQ ID NO: 731188 - RNA, 62 nt, hsa
ugcuaagauuaaaauccgucucccauuuguuacagccucaccugcaccaggauagaaagcac

SEQ ID NO: 731189 - RNA, 62 nt, hsa
gguuuguccugagccugcacuguccucgccugcagccucagaggggcaggcauccccgcaca

SEQ ID NO: 731190 - RNA, 62 nt, hsa
aggaauuagugcuggauuugaagcuacgcacucagccucaagaacucccuggaauaucccug

SEQ ID NO: 731191 - RNA, 62 nt, hsa
agaagccacaguacucaucugcagagggcuuacagccucagcaaggaccuuguggcuuugua

SEQ ID NO: 731192 - RNA, 62 nt, hsa
uucucucagccagcuguuuaagccugcggcgccagccucacggagggccgugugacacucuc

SEQ ID NO: 731193 - RNA, 62 nt, hsa
ugauauagccaaugcuguuguagucguuuccucagccucaucucacugugcuguggucuguc

SEQ ID NO: 731194 - RNA, 62 nt, hsa
ucaucccccgcgugcucugagcaggcgccugccagccucaccugccgcucaggccucagagg

SEQ ID NO: 731195 - RNA, 62 nt, hsa
gugcugggauuacaggcgugagacacugcgcccagccucaucccugugaauuucuuauugua

SEQ ID NO: 731196 - RNA, 62 nt, hsa
gguggaaaugccucuucuugguuuaaugagaccagccucagcugacucacagagcugcagag

SEQ ID NO: 731197 - RNA, 62 nt, hsa
gcggcugcuucggaagcagacaucuggggacacagccucaguacccagucuuuucccuaguu

SEQ ID NO: 731198 - RNA, 62 nt, hsa
ggcuggcugugaggccaccuuugucccaggcccagccucaaggcaaggagggcgcuucacug

SEQ ID NO: 731199 - RNA, 62 nt, hsa
cuggagaacaguggcaccaucauagcucacugcagccucaaacuccugggcucaagcgaucc

SEQ ID NO: 731200 - RNA, 62 nt, hsa
auuuucacauugaaaaucagucagauuugcuucagccucaaagaggguguuuauguaaaacu

SEQ ID NO: 731201 - RNA, 62 nt, hsa
ugcucauucugggcccuugcugccaaggagcccagccucaccuagcaggaaaggagaugaag

SEQ ID NO: 731202 - RNA, 62 nt, hsa
cugccgaggaagccgagugcccgccgccgcgccagccucagcccgcgcagaaugugcucgcu

SEQ ID NO: 731203 - RNA, 62 nt, hsa
ccuuuccugcuucucugaaagcacaggucacccagccucagaaucacaccucccggcugcug

SEQ ID NO: 731204 - RNA, 62 nt, hsa
agaccucucaacacaguaugccaaguggauuccagccucauggccuagcaaaagaacagacu

SEQ ID NO: 731205 - RNA, 62 nt, hsa
cuauuccuaggcaaagagccucauggcuaaggcagccucaaagccagccccuccucccaccu

SEQ ID NO: 731206 - RNA, 62 nt, hsa
caaccucugccucccagguucaagugcuucuccagccucagccucccaaguagcugagacua

SEQ ID NO: 731207 - RNA, 62 nt, hsa
ggaccgggccccucucuagggaccccucgccccagccucauuccccauucugugucccaugu

SEQ ID NO: 731208 - RNA, 62 nt, hsa
guaaagaaaacuaaauccuucuguguccccggcagccucagugcagcaacagaagccaaggg

SEQ ID NO: 731209 - RNA, 62 nt, hsa
ggaacccauuaccuucucccucauuucaggagcagccucagaacaaagugagacaguccagc

SEQ ID NO: 731210 - RNA, 62 nt, hsa
ggagucaggaacccagacaaggaaucccauuccagccucaccccaaccaugaccuuggcaag

SEQ ID NO: 731211 - RNA, 62 nt, hsa
auaucauccauuguuuuucaagcacgugacaccagccucaaaguaaaugacaugaccagugg

SEQ ID NO: 731212 - RNA, 62 nt, hsa
ucuccacauuccaaacagaguccugguuuccucagccucacccugcauagcuugcacaacau

SEQ ID NO: 731213 - RNA, 62 nt, hsa
aaacacagucacuguugguuccuucugauccacagccucaucaguauuuggacuuuuuaaag

SEQ ID NO: 731214 - RNA, 62 nt, hsa
guuacuagaccaucuccauuuuuagcacuuggcagccucaugauccuuuuauaaaugugaga

SEQ ID NO: 731215 - RNA, 62 nt, hsa
ccucagaaauaagccugagagaccaucuuuagcagccucagcacugccaggccugcccugaa

SEQ ID NO: 731216 - RNA, 62 nt, hsa
agagagaccaggagccaccucaaucagcaggacagccucacugccccucuugcagagucccc

SEQ ID NO: 731217 - RNA, 62 nt, hsa
cacgugcauagaggucugggaggaccaggaaacagccucaguggccagaggaucaccagugc

SEQ ID NO: 731218 - RNA, 62 nt, hsa
gguggccuuggcccagaaggagccagaggcagcagccucagccccagggacugggggcgauu

SEQ ID NO: 731219 - RNA, 62 nt, hsa
acaagaaagccugaugaaguccagccgugcuccagccucacuuucccugcuuggaagcgugg

SEQ ID NO: 731220 - RNA, 62 nt, hsa
uugccacuuucaaagugguccccuggggagcucagccucauccugaugaugcugccaaggcg

SEQ ID NO: 731221 - RNA, 62 nt, hsa
ccaagcuggcccagccuggagcuggcgcugugcagccucaccccgggcaggggcggcccucg

SEQ ID NO: 731222 - RNA, 62 nt, hsa
gcagggucuugcucugucucccaggcucacugcagccucaacguuuugagcugaagugaucc

SEQ ID NO: 731223 - RNA, 62 nt, hsa
ugagcaucgccaggcugcugugggggcgggagcagccucagugucaagggcccgcccacuga

SEQ ID NO: 731224 - RNA, 62 nt, hsa
ucccugcccccaggccccggcauugccaucagcagccucagcgucuccccggccaugugugc

SEQ ID NO: 731225 - RNA, 62 nt, hsa
uggggcggcugaugccagggcggcccgcggggcagccucacggaagggcccggugggacgug

SEQ ID NO: 731226 - RNA, 62 nt, hsa
ugucccucaugucucuagauuuucucgucacccagccucaaaaauauaugugucugcaaccc

SEQ ID NO: 731227 - RNA, 62 nt, hsa
gccucuccgggaucaguccuaggacacaggcucagccucagguugaugggggaugaugugcu

SEQ ID NO: 731228 - RNA, 62 nt, hsa
aggccaggagcgcuggguucugcagcagggcucagccucaggggcguuaagacccuggauga

SEQ ID NO: 731229 - RNA, 62 nt, hsa
gguggaggugcuccccacaguccgggccaggacagccucaggggagagugaaggccugcagg

SEQ ID NO: 731230 - RNA, 62 nt, hsa
gucacuuaggggccacuuccuaaguugcuguccagccucagugacccccuagugcuuccugg

SEQ ID NO: 731231 - RNA, 62 nt, hsa
agggugguccgggcacacugggccugccucuccagccucaggaugcucuuguuuauucuggg

SEQ ID NO: 731232 - RNA, 62 nt, hsa
cuggaaugcagugguaugaucacggcucacugcagccucaaccuccugggcuaagugauccu

SEQ ID NO: 731233 - RNA, 62 nt, hsa
cacccugccccuggugcccugagacagacacacagccucacgcccccaggaaugcaaguggu

SEQ ID NO: 731234 - RNA, 62 nt, hsa
ugguucucauugguccagacgaggaagguauccagccucaagucaucauuguggccaggaag

SEQ ID NO: 731235 - RNA, 62 nt, hsa
ccaggggugggcgacacaggcagcuucuucggcagccucacggcagcaaccccagccuuccc

SEQ ID NO: 731236 - RNA, 62 nt, hsa
ggcuggggugcaguggcgcgaucccagcacugcagccucaaccuccugggcucaagccaucc

SEQ ID NO: 731237 - RNA, 62 nt, hsa
cgcgucccuguccuugaaggaccuccuucccccagccucaucaccgugcucuucucagcgcc

SEQ ID NO: 731238 - RNA, 62 nt, hsa
ugcuccccaccagcacgcugaccugugaaccccagccucaccaucacccccagcacugccag

SEQ ID NO: 731239 - RNA, 62 nt, hsa
cuaagaccaacugcguuggacaccauaagccacagccucacaggaagugggggugaggagcc

SEQ ID NO: 731240 - RNA, 62 nt, hsa
ucuuuuucacaugggccacaguuucaguacuucagccucagugggguuccugauguuuaucu

SEQ ID NO: 731241 - RNA, 62 nt, hsa
gaccugaggcccuucucuccagccccuggaugcagccucacaguccuuaccagcagagcacc

SEQ ID NO: 731242 - RNA, 62 nt, hsa
ccaauccaguggacuucgcaguccacuucugacagccucagugacccuggcuccuugugcca

SEQ ID NO: 731243 - RNA, 62 nt, hsa
cagagggggcugcggacacagcaggcccccuacagccucagguucugccugagcccagccua

SEQ ID NO: 731244 - RNA, 62 nt, hsa
uaaauaugacucuuuuguaauuaacucauguacagccucauccuguauaguuuaaugaugaa

SEQ ID NO: 731245 - RNA, 62 nt, hsa
accccccauagggggcagugucuuguuccugccagccucagugucuugcuucugccagcucc

SEQ ID NO: 731246 - RNA, 61 nt, hsa; identical to SEQ ID NO: 110891

SEQ ID NO: 731247 - RNA, 62 nt, hsa
cccuucucccagugcguuugacuuugucaggucagccucacuugucccuuucacaguuggcc

SEQ ID NO: 731248 - RNA, 62 nt, hsa
aaggugaaacuuagauaucauggacuguuguccagccucaaugcuucauuuuccccuugcau

SEQ ID NO: 731249 - RNA, 62 nt, hsa
aggguugagaaggcuuugcugccaccuggugucagccucagucacuuucucugaaugcuucu

SEQ ID NO: 731250 - RNA, 62 nt, hsa
uuacccuaguucugcccuuguuuguggaguuacagccucaagguuguagcaugugugcuggc

SEQ ID NO: 731251 - RNA, 62 nt, hsa
ggaggacagccccccacuguucuccucaucuccagccucaguaguuggggguagaaggagcu

SEQ ID NO: 731252 - RNA, 62 nt, hsa
cucuagcagccuggacuccgcaguggcugugucagccucacccuucgugugcacccgcaugg

SEQ ID NO: 731253 - RNA, 62 nt, hsa
cgcgcacgcgcgagugugcuguauggcccaggcagccucaaggcccucggagcuggcugugc

SEQ ID NO: 731254 - RNA, 62 nt, hsa
ggaaggacugggagagacacaaagaccagagccagccucagggacaagagauuccaguuuua

SEQ ID NO: 731255 - RNA, 62 nt, hsa
gcugccuccagcauccaguggcugcuggcauacagccucauccccacgucccaaccccucuc

SEQ ID NO: 731256 - RNA, 62 nt, hsa
uaagcgaggucagacauccaccagaaucaacucagccucaggcauccaaagccacaccacag

SEQ ID NO: 731257 - RNA, 62 nt, hsa
gcaaccuggaguuggaggcauugcaggcuguccagccucauccccugccugauauccaguca

SEQ ID NO: 731258 - RNA, 62 nt, hsa
cugcugcggggcuggcugcaguguaccguggacagccucagggggcugucggccaagagccu

SEQ ID NO: 731259 - RNA, 62 nt, hsa
accaauggguuugccaagcccuuugcuguucgcagccucacauucccccggugccucuccca

SEQ ID NO: 731260 - RNA, 62 nt, hsa
aguguggggugggggggaccugcuuuggagaucagccucaccuucucccaucccagaagcgg

SEQ ID NO: 731261 - RNA, 62 nt, hsa
ggccuuuaaagaacauaagaauucccauugcccagccucagugcauuuggcaaaugcuuacu

SEQ ID NO: 731262 - RNA, 62 nt, hsa
uaauauucagacuauucuuaaaaugggacaaucagccucaugaaaaauugauguaaaucaga

SEQ ID NO: 731263 - RNA, 62 nt, hsa
uuauuuugccaagguuaaggaugcaccugugacagccucaggagguccugacaacaggugcc

SEQ ID NO: 731264 - RNA, 62 nt, hsa
gggcggaucaccugaggucaggaguucgagaccagccucaacauggagaaaccccgucucua

SEQ ID NO: 731265 - RNA, 62 nt, hsa
aaggauggcuaaaugcuccugggagucaggcgcagccucacaccagcugccuccuccacuca

SEQ ID NO: 731266 - RNA, 62 nt, hsa
ugggcguuuucccggcaggcccccgggguccucagccucagcaacccagggagaggacagaa

SEQ ID NO: 731267 - RNA, 62 nt, hsa
ugcccucggaucagggccgggaugggaggggucagccucagggagcagcugccuugggggac

SEQ ID NO: 731268 - RNA, 62 nt, hsa
ccacucaguaacaaguauugggacguagagcacagccucacucagcucugaaagguaauaca

SEQ ID NO: 731269 - RNA, 62 nt, hsa
agcaguuaugagggaggaagucaacugcuguucagccucagaauaaaggugccguucacugg

SEQ ID NO: 731270 - RNA, 62 nt, hsa
agaucucccaacuugaacuauaauccaccagccagccucagccuugagcuuuggaaccacau

SEQ ID NO: 731271 - RNA, 62 nt, hsa
cagccaaguuugagcucuuaaaaguugaugaacagccucauuuccccagcuucccugauuuc

SEQ ID NO: 731272 - RNA, 62 nt, hsa
auuccugguaggggugugugcgugacguacugcagccucaaccuccugggcucaagugaucc

SEQ ID NO: 731273 - RNA, 62 nt, hsa
auagcagucagcuugaggaggaugaaggaaggcagccucagacaggaauuaaggcaaugccc

SEQ ID NO: 731274 - RNA, 62 nt, hsa
uauuuauuuguuauuaaauugaucugacuucucagccucauuuggacuaaaaaaagaaagca

SEQ ID NO: 731275 - RNA, 62 nt, hsa
uucccacucuguccaccaagugggggguagcacagccucacagcaaccgcccugaccuuggg

SEQ ID NO: 731276 - RNA, 62 nt, hsa
uauuaccuuuacuccccucccucucccaucaccagccucaaggccugaggggugcaggggcu

SEQ ID NO: 731277 - RNA, 62 nt, hsa
gaucagcaccgauucccgaaagcuuuccaccucagccucagaguccagcugcccggacucca

SEQ ID NO: 731278 - RNA, 62 nt, hsa
uaauuuggcaguuuguuagguuagacaacugacagccucauuucauuccuacaaguugguuu

SEQ ID NO: 731279 - RNA, 62 nt, hsa
aggagcacuggaggaggagugggcucucugugcagccucacagggcuuugccacggagccac

SEQ ID NO: 731280 - RNA, 62 nt, hsa
auccaugucccggagaggggucccucaacagucagccucaccugucagaccgggguucuccc

SEQ ID NO: 731281 - RNA, 62 nt, hsa
ggagaugccacuucucacucaccacuaccagccagccucagaaggccccagagagacccugc

SEQ ID NO: 731282 - RNA, 62 nt, hsa
accuggccauuuugacccugaguggacagucacagccucagcucaugucuggcugugacaca

SEQ ID NO: 731283 - RNA, 62 nt, hsa
cacuggggcucagagccggggugggguggcugcagccucaggacugggagcccccagccugu

SEQ ID NO: 731284 - RNA, 62 nt, hsa
cccuacccccuccaaggggcagguuuccaguccagccucagagaucaggcucugggaccccu

SEQ ID NO: 731285 - RNA, 62 nt, hsa
gccgaguccuugucccuaccuccagcuuccuccagccucaaaccgccucuggaucuagcugu

SEQ ID NO: 731286 - RNA, 62 nt, hsa
ccagcgccagggcccaggccauguggccugcccagccucaaugucacuugguggcggggugg

SEQ ID NO: 731287 - RNA, 62 nt, hsa
gcaccggaagacucacuuugucugcccugcgccagccucaccucacccugcaguucccguuu

SEQ ID NO: 731288 - RNA, 62 nt, hsa
agucacggcccagacugggcaccuucgcgucucagccucagggagccccacagccccaagcu

SEQ ID NO: 731289 - RNA, 62 nt, hsa
ugccaccuuguacaaagccggcugcccagccccagccucaccaccgcaucccaccuccugcc

SEQ ID NO: 731290 - RNA, 62 nt, hsa
caccuccgcccagccuguaauguuuauauaagcagccucaaggaccaagaaccaucugcgaa

SEQ ID NO: 731291 - RNA, 62 nt, hsa
ggcugugugccggccuucuugcugcauguacucagccucaggagagcuugcugcacccaggc

SEQ ID NO: 731292 - RNA, 62 nt, hsa
agucaccaaggcuucagccccaagggcaucuccagccucaggccggcagguccuauguccuu

SEQ ID NO: 731293 - RNA, 62 nt, hsa
gagugcaguggugccaucaccacggcucacugcagccucagcguccugggcucaaaugaucc

SEQ ID NO: 731294 - RNA, 62 nt, hsa
cagugcccaugucccuuccagcucaccuugagcagccucagaucaucucugucacucuggaa

SEQ ID NO: 731295 - RNA, 62 nt, hsa
cuggauggacacaugggccaggggcucugaagcagccucacucuuaacuucguguucacacu

SEQ ID NO: 731296 - RNA, 62 nt, hsa
ccgcugccuagcaucugcuuggccaauuaguucagccucagaccauggcacuuugagggggu

SEQ ID NO: 731297 - RNA, 62 nt, hsa
uguaauccacagacaacucuauuuguguucuucagccucagccugaaggcuuuuuuuuggcu

SEQ ID NO: 731298 - RNA, 62 nt, hsa
ggccuggggagauggaggaaagugauaucccccagccucaagucuuauuuccucaacguugc

SEQ ID NO: 731299 - RNA, 62 nt, hsa
ucccagcccuaaacccugccccaggaagcccacagccucaccugcugcugccccucuagguc

SEQ ID NO: 731300 - RNA, 62 nt, hsa
ugguuucagcaugguauugaguugacacuucucagccucaauucauaacuauaugaacuuua

SEQ ID NO: 731301 - RNA, 62 nt, hsa
acguacaucauuauuaauauaaaaauaacaggcagccucaagaaugugcugagauuucucug

SEQ ID NO: 731302 - RNA, 62 nt, hsa
cacacgccccucuacugcuauguggcuucaaccagccucacagccacacgggggaagcagag

SEQ ID NO: 731303 - RNA, 62 nt, hsa
cgccccaucugccccacagucuccggccucuccagccucagcccccugcuucagucccuucc

SEQ ID NO: 731304 - RNA, 62 nt, hsa
acagcagccauugcacgugcaucagcucccaucagccucauuccguggcaggugaugugucc

SEQ ID NO: 731305 - RNA, 62 nt, hsa
gaaaugccuuaauuucacucuccucccuucuccagccucaggggaggaucuggaggauccac

SEQ ID NO: 731306 - RNA, 62 nt, hsa
agggggcuggaggagcccaggccaggacucugcagccucagagacaucagcccuuggggguc

SEQ ID NO: 731307 - RNA, 62 nt, hsa
auuuccuaggauaaaaauaaacaaaugacuuacagccucauccucccuaacuccauuugaac

SEQ ID NO: 731308 - RNA, 62 nt, hsa
gaggaccgccaccucuucccagugcuugcgaccagccucauucuauuuaacuuugcucucag

SEQ ID NO: 731309 - RNA, 62 nt, hsa
gugagcaccaccagggcuccaggagccucauccagccucagagaucucccuucucaucuccc

SEQ ID NO: 731310 - RNA, 62 nt, hsa
ggccacguacagccagcgggucagcccagaggcagccucagcuccagggcuaaggacucucg

SEQ ID NO: 731311 - RNA, 62 nt, hsa
augcaccaucacuguggcuggcaggcaucggacagccucauccagacccccugcccugucuu

SEQ ID NO: 731312 - RNA, 62 nt, hsa
agcucccucagucuggcacccacugcuacacucagccucaugagccacuucagaccagccag

SEQ ID NO: 731313 - RNA, 62 nt, hsa
cagguaggauacguacaccucuugccucagagcagccucaucccaggcagugggucuucccu

SEQ ID NO: 731314 - RNA, 62 nt, hsa
agagcgaugauggacuugagcgccguguucuucagccucagcuggaaggggaaaagucaggg

SEQ ID NO: 731315 - RNA, 62 nt, hsa
acagccuuccucaggccccugucucuggcccccagccucagugccucuuggcccagggccag

SEQ ID NO: 731316 - RNA, 62 nt, hsa
ugggagcgagaaaccccagcugagcugcguuccagccucagcugagucuuuuuggucugcac

SEQ ID NO: 731317 - RNA, 62 nt, hsa
gagcccacgcccccccaagagcccucgauggacagccucacccaccccaccugggcccagcc

SEQ ID NO: 731318 - RNA, 62 nt, hsa
gcccaggcuggaggcccugccucgcugcuugccagccucaccugcuggggcuggaggccaug

SEQ ID NO: 731319 - RNA, 62 nt, hsa
ccacacagaggaggaagacagcagccuggcagcagccucaccgaagagaggaaccaccacac

SEQ ID NO: 731320 - RNA, 62 nt, hsa
uacuuucugcgugguggaaaccauugcauauucagccucauuucaagaguguuuccuucuca

SEQ ID NO: 731321 - RNA, 62 nt, hsa
acugaagcaggaaggcagagcaucaucuuguucagccucagcugggaacauguguacugggu

SEQ ID NO: 731322 - RNA, 62 nt, hsa
acuuucacccuaaacgacacuuccuccccagccagccucacucugucuccggcccgcagcag

SEQ ID NO: 731323 - RNA, 62 nt, hsa
gaaaugauggggaaaggaguccuuaguccuuucagccucagaggucacaguggguggcaggu

SEQ ID NO: 731324 - RNA, 62 nt, hsa
cagccuggcuguggaguuuccacggcgacacacagccucaguggugcaagauuuaaaauuac

SEQ ID NO: 731325 - RNA, 62 nt, hsa
gcuauuuuugugacccacauagguggcccauucagccucaaggggaaauccaggguaggaag

SEQ ID NO: 731326 - RNA, 62 nt, hsa
auuuuaugagggccacgggucuguguucgacucagccucagggacgacucugaccucuuggc

SEQ ID NO: 731327 - RNA, 62 nt, hsa
cucacuugcccacaccgagggcgaccccgucacagccucaagucacucccaagcccccuccu

SEQ ID NO: 731328 - RNA, 62 nt, hsa
agaaucgccuaccugugccugcguguaaaccacagccucagaccagcuauggggagaggaca

SEQ ID NO: 731329 - RNA, 62 nt, hsa
gccccucccggcgccugcccacccuccacccacagccucacggguccaggacuuggcguguu

SEQ ID NO: 731330 - RNA, 62 nt, hsa
gcaccuccaccuuccgggcucaagcgauucuccagccucagccuccugaguagcuaggacug

SEQ ID NO: 731331 - RNA, 62 nt, hsa
aauguugggcaacaacucagccagccugauggcagccucagaggcuuacucuaacccauccc

SEQ ID NO: 731332 - RNA, 62 nt, hsa
ugccccuguucuucacacugccccccaugccucagccucauacagaugugccaucauggggg

SEQ ID NO: 731333 - RNA, 62 nt, hsa
ucaauguaagcaaugugggaaagccgucagaucagccucaagacuucaaaugcauggaagca

SEQ ID NO: 731334 - RNA, 62 nt, hsa
caccaggggaggugggguuuggugagagacgccagccucagacuuuuucccacugagggucc

SEQ ID NO: 731335 - RNA, 62 nt, hsa
gggcugcuggagaagucuccucccguucggaccagccucagggcugcacguuaccucaggaa

SEQ ID NO: 731336 - RNA, 62 nt, hsa
cagccgcagccaaacccggcugccucccaccccagccucaaaaccucuuccugacgaccccc

SEQ ID NO: 731337 - RNA, 62 nt, hsa
acucccugcuucccuggaagcuucaggaagcucagccucagccuucaggccugagcaagugc

SEQ ID NO: 731338 - RNA, 62 nt, hsa
ggguggaucaccugaggucaggaguucaagaccagccucaacauggagaaaccccaucucua

SEQ ID NO: 731339 - RNA, 62 nt, hsa
uuggaaguggugggugcccaggacggugccuccagccucaacagugggcauggacaggguua

SEQ ID NO: 731340 - RNA, 62 nt, hsa
uccccuucccaguccauaaaaaccccggaccccagccucauacugggcaacuuauuuggauc

SEQ ID NO: 731341 - RNA, 62 nt, hsa
ccaccaugcgggccucagguggcagagaggcccagccucacaggccuguggccccacacacc

SEQ ID NO: 731342 - RNA, 62 nt, hsa
cccuucccuaaucaccucuccugccccuagcucagccucauccccaacuccaugccugucuc

SEQ ID NO: 731343 - RNA, 54 nt, hsa; identical to SEQ ID NO: 730625

SEQ ID NO: 731344 - RNA, 62 nt, hsa
gacaaggcuucucuguccgcccuucacaccuccagccucacguucacuuaggcacaucacac

SEQ ID NO: 731345 - RNA, 62 nt, hsa
ugaccccacuccaggaccuaggcccagccccucagccucaucuggagccccugaagaccagu

SEQ ID NO: 731346 - RNA, 62 nt, hsa
cacgaugagcugugagcaccgcgcaccugccacagccucagaggcccgcacaaugaccggag

SEQ ID NO: 731347 - RNA, 62 nt, hsa
gugcugggauuacaggcaugaaccauggugcccagccucauuuuugaaauggaauagagaac

SEQ ID NO: 731348 - RNA, 62 nt, hsa
ccggccauuugcugcccuccccaccccugccccagccucaggacugcaggagccauccgccc

SEQ ID NO: 731349 - RNA, 62 nt, hsa
agugaaugugggaaagucuuuagauacaacuccagccucauuaaacaucggagaauucacac

SEQ ID NO: 731350 - RNA, 62 nt, hsa
ggcagcggcgcccagcucccugguggccgcggcagccucaguggcagcagcugccgguggug

SEQ ID NO: 731351 - RNA, 62 nt, hsa
cgccccauucaccuguggauuugugcgagaugcagccucagaaggaacaaggcccccagagg

SEQ ID NO: 731352 - RNA, 62 nt, hsa
cugaagugcgguggugcaaucauggcucacugcagccucaaauuccugggcucaagcgaucc

SEQ ID NO: 731353 - RNA, 62 nt, hsa
cuggcuaccaggaaacucggagacaaucuuuucagccucagcauuucuggcuggauuuccac

SEQ ID NO: 731354 - RNA, 62 nt, hsa
cggccacacacagcaagaaagauacaucugaccagccucaacgucaacguauuuccccucuc

SEQ ID NO: 731355 - RNA, 62 nt, hsa
gauggucuugaucuccugaccuugugauccaccagccucagccucccaaagugcugggauua

SEQ ID NO: 731356 - RNA, 62 nt, hsa
gccuuugggguauuccccuagugugcccaagucagccucauauucugggcggacagcuuguc

SEQ ID NO: 731357 - RNA, 62 nt, hsa
ucccccagcccucccuccuggcgggucuccuccagccucacuucgcugccacuucgccgcug

SEQ ID NO: 731358 - RNA, 62 nt, hsa
ucaggcggaugaggucccuacucccgagcccccagccucacccacugcagggccaggcucuc

SEQ ID NO: 731359 - RNA, 62 nt, hsa
cugccucccggguucaagugauucuccugccucagccucacgaguagcuggaauuacaggca

SEQ ID NO: 731360 - RNA, 62 nt, hsa
ccuuacuuccagcuugcacaucagaauuuuuccagccucauuugucaguuucaaaucugcuu

SEQ ID NO: 731361 - RNA, 62 nt, hsa
ccugcuccaggaugaaaccaagagggggaugucagccucacccacaccgugugccuuacucc

SEQ ID NO: 731362 - RNA, 62 nt, hsa
cccacuccacacacucccugccagcuuuguugcagccucagcugguggugucuccguccuua

SEQ ID NO: 731363 - RNA, 62 nt, hsa
ucaaagcuucuguggcuucguggucacugcuccagccucagccagggcagggagggggacuc

SEQ ID NO: 731364 - RNA, 62 nt, hsa
ugguacuuucucuuccugguaauccucuggcccagccucauggcagaauagagguauuuuua

SEQ ID NO: 731365 - RNA, 62 nt, hsa
ugaaaccaaaaagagacugaucauccaggccucagccucauccuccccaggaccccugucca

SEQ ID NO: 731366 - RNA, 62 nt, hsa
acccucugucccuacugauuccuccuugggugcagccucagaguggccugaggcccagaggg

SEQ ID NO: 731367 - RNA, 62 nt, hsa
accgcgccgcggaagggggcuccgagggggcgcagccucaaacccugccuuuccuuuacuuu

SEQ ID NO: 731368 - RNA, 62 nt, hsa
cccccggcucagaucuuugcaaaucaguacgacagccucagagcagagcaaggguuguuugg

SEQ ID NO: 731369 - RNA, 62 nt, hsa
caccccccucauuaucuaccaugacugucucucagccucacgggcccucagcacuuuguguu

SEQ ID NO: 731370 - RNA, 62 nt, hsa
gucccuguccccaccuccagucccucccucaccagccucaccccuguggugggcuuuuuaag

SEQ ID NO: 731371 - RNA, 62 nt, hsa
cuggagugcaguggcaugaucauaacucacugcagccucaaacuucuggccucaagugaucc

SEQ ID NO: 731372 - RNA, 62 nt, hsa
ucuccacagacccagccuccggcugugacccccagccucacaccugccucugguucccgccu

SEQ ID NO: 731373 - RNA, 62 nt, hsa
aaaacgaucuaaagguaggcagacccuggacccagccucagauccaggcaggagcacgaggu

SEQ ID NO: 731374 - RNA, 62 nt, hsa
aggaggguauucugggccuucugcccaggcagcagccucauggguguggcuucuguggcuuu

SEQ ID NO: 731375 - RNA, 62 nt, hsa
agggcacgggguaggggguucucguagggucccagccucaaugguucccgcccuggaccucc

SEQ ID NO: 731376 - RNA, 62 nt, hsa
cuacugaagugacuuaugguugcuccccuagacagccucagaauggggcuguucucuaggaa

SEQ ID NO: 731377 - RNA, 62 nt, hsa
cgugugucuguaaaaugugugaaaccaaacugcagccucaacaccauggacacacgucauca

SEQ ID NO: 731378 - RNA, 62 nt, hsa
gcagggauccaagaaugugccaagagucccgccagccucagccaggugggccuguauauagg

SEQ ID NO: 731379 - RNA, 62 nt, hsa
cucagauuugaccaggccucuggcugccugggcagccucauugccaaugggcugaaagguuc

SEQ ID NO: 731380 - RNA, 62 nt, hsa
ccaaacgcagugcccuguucugccgguguguacagccucagcgcaccaggagacccuagagu

SEQ ID NO: 731381 - RNA, 62 nt, hsa
gcuccuuguccccucccacccgccucaugacccagccucacagacccucucaggccucugac

SEQ ID NO: 731382 - RNA, 62 nt, hsa
aguauguuucuuucugccccguugaagaggugcagccucaggcugagaaacacugauagacc

SEQ ID NO: 731383 - RNA, 62 nt, hsa
cucacugccccacauucucccaguggcucuaccagccucacccaucaaaccagugaauuucu

SEQ ID NO: 731384 - RNA, 62 nt, hsa
gcugagucucuaucauagcugaacccugaggacagccucauagcucauguaucagggacuuu

SEQ ID NO: 731385 - RNA, 62 nt, hsa
ugacugccaggcagaaaggacagggcccaggucagccucagucugcugugccuccagacugc

SEQ ID NO: 731386 - RNA, 62 nt, hsa
uuuucccuuuguucuugaacacuuuugcccugcagccucaguuuugaauucuuuuagcaacu

SEQ ID NO: 731387 - RNA, 62 nt, hsa
gggcuggggccggggcugagggugcccuuuuccagccucagccuacuccgcucacugaacuc

SEQ ID NO: 731388 - RNA, 62 nt, hsa
gaucaaguugaggggcuuccggcucccuucuacagccucagaaaccagacucguucuucugg

SEQ ID NO: 731389 - RNA, 62 nt, hsa
aagagaaucguacgucgacuuucgauuuuucacagccucagccuaggaaaaaugguucaugg

SEQ ID NO: 731390 - RNA, 62 nt, hsa
ccaggacaccacaugggagggggcucaggccucagccucaagaucuucagcuguggccucuc

SEQ ID NO: 731391 - RNA, 62 nt, hsa
gaacgaggaccuggacucagagccagacagggcagccucagacccuucucuggggcuccugg

SEQ ID NO: 731392 - RNA, 62 nt, hsa
guugcuucacccgcugcagagcacacgcaacccagccucagcaucacagccgcagcucuguu

SEQ ID NO: 731393 - RNA, 62 nt, hsa
uaguuccucaucacaaaagaacaaagauaaaccagccucaaucccggcugcugcauuuaggu

SEQ ID NO: 731394 - RNA, 62 nt, hsa
gcaauaaucaacauuuaccagacauccaaugacagccucaggggaaagcacccuugucuggg

SEQ ID NO: 731395 - RNA, 62 nt, hsa
ccggucaccucggccgggcccggggcugaggucagccucacugccugcuuauugccucuuuc

SEQ ID NO: 731396 - RNA, 53 nt, hsa; identical to SEQ ID NO: 730678

SEQ ID NO: 731397 - RNA, 62 nt, hsa
ggccuugucuuccaguuccuuucucccauucccagccucauuucuuaaaugacuaggaauuu

SEQ ID NO: 731398 - RNA, 62 nt, hsa
auugccaccagcaugcgggauucccucauugacagccucaccugagucaccuuccaaguugu

SEQ ID NO: 731399 - RNA, 62 nt, hsa
uagggguagcccuguccagguaaaguuguuuucagccucaugucuacuguuaggugagggag

SEQ ID NO: 731400 - RNA, 62 nt, hsa
caccugggugucugggcucaagcuuucccgcccagccucacuuccuuugcccuuccuccugc

SEQ ID NO: 731401 - RNA, 62 nt, hsa
agacucuugacaccggucucugcugaggcucccagccucaguuucccccacagcagcacggg

SEQ ID NO: 731402 - RNA, 62 nt, hsa
ggccuugagaggacccugcaggcagucagcaccagccucagcaacugugcagagaccuacag

SEQ ID NO: 731403 - RNA, 62 nt, hsa
aucucuagccagugcuuaggcccaauaucugacagccucaggugggcugggaccuaggaagc

SEQ ID NO: 731404 - RNA, 62 nt, hsa
auucuagagaacuaaacuggcuuaacgagucacagccucagcugugcugggacgacccuugu

SEQ ID NO: 731405 - RNA, 62 nt, hsa
aaaaguaccaggagcuagcuuuuaaccuugcccagccucaguuucuuuucuuagaagaagcu

SEQ ID NO: 731406 - RNA, 54 nt, hsa; identical to SEQ ID NO: 730688

SEQ ID NO: 731407 - RNA, 62 nt, hsa
cuccguccuggcagggcaggcagagcucagcacagccucaccccugcaggcgguauccagag

SEQ ID NO: 731408 - RNA, 62 nt, hsa
cuacugauucaaaugcuaaucucuuccagaaacagccucacagacacacccagacaucuggu

SEQ ID NO: 731409 - RNA, 62 nt, hsa
aacucuagaugacaagagcaccucaaaggcagcagccucaaggagcagccauggccccagac

SEQ ID NO: 731410 - RNA, 62 nt, hsa
cuggagugcaguggcacaaucacaguucacugcagccucaaccucuccagauucaagugauc

SEQ ID NO: 731411 - RNA, 62 nt, hsa
ucuuccccuaaaagaggccgugauauuugcagcagccucaaauugcucuuaagggguuuagg

SEQ ID NO: 731412 - RNA, 62 nt, hsa
uccccacucugcccguccaccuucccuggcuccagccucauucucucuuuaguuuaacuaug

SEQ ID NO: 731413 - RNA, 62 nt, hsa
ucccugccaguccuuggaccucccagcccacccagccucagcacagcucaacacagaaggag

SEQ ID NO: 731414 - RNA, 62 nt, hsa
uucuguuaacugaagauauuccaacucaaaaccagccucaugcucugauuagauaaucuuuu

SEQ ID NO: 731415 - RNA, 62 nt, hsa
gcugagugcacuggcaggaucacagcucacggcagccucaaccucccuggcucaagcgaucc

SEQ ID NO: 731416 - RNA, 62 nt, hsa
ccaccuccccauacagagagaggcuucccucccagccucaguuuacccguaaaugcacuagc

SEQ ID NO: 731417 - RNA, 62 nt, hsa
ucccugccaguccuuggaccucccagcccacccagccucagcacagcucagcacagaaggag

SEQ ID NO: 731418 - RNA, 62 nt, hsa
agccgccuagccaagacugcagggauggcccgcagccucaucggggccaaggacacacgccu

SEQ ID NO: 731419 - RNA, 62 nt, hsa
cccaccucucgccccucaucuugguaauuagccagccucagauacuucugugggcccugaag

SEQ ID NO: 731420 - RNA, 62 nt, hsa
uccuugcagugaagccaccaugggugaccguccagccucacccgguggccugcacagugagg

SEQ ID NO: 731421 - RNA, 62 nt, hsa
gaggccucccggaacaaaagcggaagaggggccagccucaucccacugccagcugacccuca

SEQ ID NO: 731422 - RNA, 62 nt, hsa
uuauuuuuguuggagccacucuguuccuggcucagccucaaaugcaguauuuuuguuguguu

SEQ ID NO: 731423 - RNA, 62 nt, hsa
uuucaucuccucugugggaggacacaucucugcagccucaagaguuaggcagagacucaagu

SEQ ID NO: 731424 - RNA, 62 nt, hsa
cacuccaugccacccccaccagcuggaggacccagccucacaguguguccuuugugccagac

SEQ ID NO: 731425 - RNA, 62 nt, hsa
cuucaaguuaacaggaucagacaccagucaagcagccucaggucaucuugcgacuccacuga

SEQ ID NO: 731426 - RNA, 62 nt, hsa
ugccucaaaaauucaccaagcagaaugccucucagccucauguguugguccucugcuccucc

SEQ ID NO: 731427 - RNA, 62 nt, hsa
cggggcccgcagaggugcccuuacugaggugacagccucacagggucugguaccagggguug

SEQ ID NO: 731428 - RNA, 62 nt, hsa
agggcagucccucagaaucccagaggcagucccagccucagaacccaggauaggaaaugggu

SEQ ID NO: 731429 - RNA, 62 nt, hsa
acccuagccugaggcuccacuggaagaucucgcagccucaguguaugggaaacccuuucccc

SEQ ID NO: 731430 - RNA, 62 nt, hsa
cuuggggcugcugggguuggaauguggaacugcagccucagcccaucuggcagagucccagg

SEQ ID NO: 731431 - RNA, 62 nt, hsa
cgccugcagggggcgcugcaucccgcgcgcugcagccucaugugacccgaucggacagugcc

SEQ ID NO: 731432 - RNA, 62 nt, hsa
uacgccccauggaggcuccgagaccaucugcccagccucacugaggcucaggacacggccac

SEQ ID NO: 731433 - RNA, 62 nt, hsa
cuaggggccccaaguucaacucaaccccucaacagccucagcuuugcagccccugagaaggc

SEQ ID NO: 731434 - RNA, 62 nt, hsa
uucuguuucagcaaaucucagucccugacuaacagccucagcacauccgacaccucccagcg

SEQ ID NO: 731435 - RNA, 62 nt, hsa
cugugcccccggccaggcccugaggaaaugcucagccucaguggagauggggagguuagaga

SEQ ID NO: 731436 - RNA, 62 nt, hsa
ucuguugggcccaguggccccugcuauccccacagccucauuccugcagaagguuugugacg

SEQ ID NO: 731437 - RNA, 62 nt, hsa
cagacaccagaccagguccagggccuccuccacagccucagcuggggcucucagcaccaaag

SEQ ID NO: 731438 - RNA, 62 nt, hsa
gaauccuacuccuaugaccccgaagaugaggccagccucagccucuauggcaaggcccugcu

SEQ ID NO: 731439 - RNA, 62 nt, hsa
aucuugcugcucucagagccagaaaaugcugacagccucaugcugguggacuucgaguacag

SEQ ID NO: 731440 - RNA, 62 nt, hsa
gcagggccugagggagccccuggcuuuccccucagccucaggaaagguggucaggaaaacuc

SEQ ID NO: 731441 - RNA, 62 nt, hsa
cuggagugcagugacguggucauagcucacugcagccucaaccuccugggcucaagugaccc

SEQ ID NO: 731442 - RNA, 62 nt, hsa
uggugaguuggggggcagggguugucuugggccagccucaguuuuugucaggccaugaaucc

SEQ ID NO: 731443 - RNA, 62 nt, hsa
gugcugggauuauaggcgugagccacugugcccagccucacagcugcaucuuaaccuuaccu

SEQ ID NO: 731444 - RNA, 62 nt, hsa
uucuaccucccagaucggaucuguugcaaacucagccucaauaagccuugucguugacuuua

SEQ ID NO: 731445 - RNA, 62 nt, hsa
gaagaaaggagggacccggaacuugggccaaucagccucaccuugucccaguccacuccuaa

SEQ ID NO: 731446 - RNA, 62 nt, hsa
caaccuccaccucccggauucaagugauucuccagccucagccuccugaguagcugggauua

SEQ ID NO: 731447 - RNA, 62 nt, hsa
ggaguuguggguccugcccagaguccagagagcagccucagcugagcacagguccgaggggg

SEQ ID NO: 731448 - RNA, 62 nt, hsa
auugucaaccuucuacacagccaaugacuuaacagccucauuagaaguuacagaaacuaaag

SEQ ID NO: 731449 - RNA, 62 nt, hsa
acaugagaucagggccugcccccuggggaucacagccucaccccugccccugugggacucau

SEQ ID NO: 731450 - RNA, 62 nt, hsa
caccuggggacucacguagcuggagagcauuacagccucauccacuuaccuggagcugcucu

SEQ ID NO: 731451 - RNA, 62 nt, hsa
gaggacccuggaaggacagcaaggcagcuccccagccucacucuucacuccugauugaggcc

SEQ ID NO: 731452 - RNA, 62 nt, hsa
cugaaggauuuagacggggaugaagugcccuccagccucagagcuagccacaaagcccccag

SEQ ID NO: 731453 - RNA, 62 nt, hsa
ccuuuguagugcuuucggcccaguucuggccucagccucaaagugcaccgacuaguugcuug

SEQ ID NO: 731454 - RNA, 62 nt, hsa
cgagccaggucaggcuucggaggccacaagcucagccucaggcccaggcacugauuguggca

SEQ ID NO: 731455 - RNA, 62 nt, hsa
acgugagagaaucugccuguggccuugcccgccagccucagugccacuugacauuccuuguc

SEQ ID NO: 731456 - RNA, 62 nt, hsa
uucuuaccaauuuccccaacuauguugcacaucagccucauuuucccccuuuauuggaaugc

SEQ ID NO: 731457 - RNA, 64 nt, hsa
cgagguggcagcguggagggcucggcguggauggcagccucaggacacacaccccugccucaag

SEQ ID NO: 731458 - RNA, 64 nt, hsa
aagaggaagccucggccucccugagcucugaccccagccucacccgaaaggccagccuggggcu

SEQ ID NO: 731459 - RNA, 64 nt, hsa
ugcugaggucccgggcuuagugugagcaucuugccagccucaggcuugagggagggcugggcua

SEQ ID NO: 731460 - RNA, 64 nt, hsa; identical to SEQ ID NO: 110836

SEQ ID NO: 731461 - RNA, 64 nt, hsa; identical to SEQ ID NO: 110837

SEQ ID NO: 731462 - RNA, 64 nt, hsa
cugcacuacggccauucuccucuugggcgcuccucagccucacugugaccuuucugccagagcu

SEQ ID NO: 731463 - RNA, 64 nt, hsa
ugguuuggaccuaacaucucgcacgugacucccucagccucagagccuugggaugcagagcagc

SEQ ID NO: 731464 - RNA, 52 nt, hsa; identical to SEQ ID NO: 730028

SEQ ID NO: 731465 - RNA, 64 nt, hsa
aguggaagcccucuuuccccaaauccuacucccucagccucaggcaguggugcucccaucuucc

SEQ ID NO: 731466 - RNA, 64 nt, hsa
cagaaaaagaacucaaccaauuuggcaccccaugcagccucaaaauguuucaaaugccuaccgc

SEQ ID NO: 731467 - RNA, 64 nt, hsa
uacccaagcuucaaggaagugcuugggggacccccagccucauccucuuaguugggucucuugu

SEQ ID NO: 731468 - RNA, 64 nt, hsa
cgcucuugacccugcauauccaggaaggaacugccagccucagaggaggcagcaccgagggugc

SEQ ID NO: 731469 - RNA, 64 nt, hsa
gccugcucagcagccagucucagagaccagcacucagccucauucagcauggguccuugaugcc

SEQ ID NO: 731470 - RNA, 64 nt, hsa
cggccccagcuggagcuggcugagagcaguccugcagccucauuccuuaguucccggagcuggc

SEQ ID NO: 731471 - RNA, 64 nt, hsa
uggucucuguuccccagcccaccuggcucacacacagccucauggguagggucagcaaaccaga

SEQ ID NO: 731472 - RNA, 64 nt, hsa
gccgaggcugcccccucacccagaagucugagcccagccucaggaggggccaagaaccaggggg

SEQ ID NO: 731473 - RNA, 64 nt, hsa
ugaauuucaggcuggaaaacuaucaguaugaucucagccucaguucucuugucuguaaaaugga

SEQ ID NO: 731474 - RNA, 64 nt, hsa
ucugacuacuuaccacaucaaaucugggcccaaacagccucaguuaacugcauaauucaggaac

SEQ ID NO: 731475 - RNA, 64 nt, hsa
agugaugucucuacuugcucuaugagccuuuugccagccucagaauaggcgagguaaccuugaa

SEQ ID NO: 731476 - RNA, 64 nt, hsa
uccggaucucuguggggcucuucaccaauuuuuccagccucauuuauaguaaacaaauuguucu

SEQ ID NO: 731477 - RNA, 64 nt, hsa
ggugagauggaaucuuagaucgucccccaugugccagccucauucgaauucuacucuuugguua

SEQ ID NO: 731478 - RNA, 52 nt, hsa; identical to SEQ ID NO: 730042

SEQ ID NO: 731479 - RNA, 59 nt, hsa; identical to SEQ ID NO: 730043

SEQ ID NO: 731480 - RNA, 64 nt, hsa
uugucuguauuucugugugguuguagcaaggacucagccucauguagcacgaauaggggugugg

SEQ ID NO: 731481 - RNA, 64 nt, hsa
ccuccgccucccgguucaagccauucuucugccucagccucagcgaguagcugagacuaccggc

SEQ ID NO: 731482 - RNA, 64 nt, hsa
acccugugccagaagcaacagaggugccaggccucagccucacccacagcagccccaucgccaa

SEQ ID NO: 731483 - RNA, 64 nt, hsa
gaaaccaaagaaaugaagcuggcaagcuacuuuucagccucaagcuuuacacagcuguccuuac

SEQ ID NO: 731484 - RNA, 64 nt, hsa
accacucccaccacaggcauaagcuaucaccuagcagccucaaaacgggucaguauuaagguuu

SEQ ID NO: 731485 - RNA, 64 nt, hsa
cucuguagcuccuccugacaaacgucugggaaaacagccucaccccacucuccucucucuuccc

SEQ ID NO: 731486 - RNA, 64 nt, hsa
aucuaaaccagaaggaagcccucucagaucaccccagccucacuccauuucccacuuccacccc

SEQ ID NO: 731487 - RNA, 64 nt, hsa
ugggacuuugucccuucuaauuauuaucucuuuccagccucauucagcuauucuuacugacaua

SEQ ID NO: 731488 - RNA, 64 nt, hsa
uuuuuucuaaauauaauaaaaacuuaccuggcaucagccucauaccuaaaacuccugacucuua

SEQ ID NO: 731489 - RNA, 64 nt, hsa
acacacacacuggcacagggaggcuacaacuaagcagccucagaucuguaaaguugauuggugc

SEQ ID NO: 731490 - RNA, 64 nt, hsa
uuccuggcgaugagccauuuauugugucucacaccagccucauuuccaacuccgacuuccuacu

SEQ ID NO: 731491 - RNA, 64 nt, hsa
auaacuuuauccugcuauaacuuuauccucuucccagccucaucccuguuuuucuguuagggca

SEQ ID NO: 731492 - RNA, 64 nt, hsa
cuugucugcaaacaggucccugccuuuuuagaagcagccucauggucucaugcuuaaucuuguc

SEQ ID NO: 731493 - RNA, 64 nt, hsa; identical to SEQ ID NO: 110838

SEQ ID NO: 731494 - RNA, 64 nt, hsa; identical to SEQ ID NO: 110839

SEQ ID NO: 731495 - RNA, 64 nt, hsa
gguccuuguugcucuaacaguccagauguacacccagccucagggggaaggcagcucucuccag

SEQ ID NO: 731496 - RNA, 64 nt, hsa
ccgcucccuugugauuucugagggucaccacugccagccucaggcaacauagagagccuccugu

SEQ ID NO: 731497 - RNA, 64 nt, hsa
aggccagagaggggcagguagaccugcauagcagcagccucagcagcugucuugguaaaggaga

SEQ ID NO: 731498 - RNA, 64 nt, hsa
uguggccugucuguccuccucccuaauucagacccagccucaagaggaaagggaguaaaauaaa

SEQ ID NO: 731499 - RNA, 64 nt, hsa
ucccaucagaaccuggcagccccaaaacuggggucagccucagggcaggagucccacuccucca

SEQ ID NO: 731500 - RNA, 64 nt, hsa
agcucuguggcguuguguuauugguagacacccucagccucaucauuugacuaccuauguacua

SEQ ID NO: 731501 - RNA, 64 nt, hsa
uagaguuuauugucaauugcuucucaagucuaaccagccucagcagugugcauagaccauuucc

SEQ ID NO: 731502 - RNA, 64 nt, hsa
cugccuuggguucagcccaucugggcucaaauuccagccucaccacucacaagcugugugacuu

SEQ ID NO: 731503 - RNA, 64 nt, hsa
auggggcuauaggagccucccacuuucaccagagcagccucacugugcccugauucacacacug

SEQ ID NO: 731504 - RNA, 64 nt, hsa
agaaguaacucccacuccuaaucaagagucucuccagccucacagaugcuggccucuuggcacc

SEQ ID NO: 731505 - RNA, 64 nt, hsa
guucuaugccuaguggagccacagugccucccugcagccucaacaccacccugcuguccagucc

SEQ ID NO: 731506 - RNA, 64 nt, hsa; identical to SEQ ID NO: 110840

SEQ ID NO: 731507 - RNA, 64 nt, hsa; identical to SEQ ID NO: 110841

SEQ ID NO: 731508 - RNA, 50 nt, hsa; identical to SEQ ID NO: 730072

SEQ ID NO: 731509 - RNA, 64 nt, hsa
aucugucuaccaacuccucauagugagccagaagcagccucauaacccugaauguggggcucug

SEQ ID NO: 731510 - RNA, 64 nt, hsa
gguggaaucuuuagcgcucaauaggaccaggauccagccucacuucuaggguaugggaaaucca

SEQ ID NO: 731511 - RNA, 64 nt, hsa; identical to SEQ ID NO: 110842

SEQ ID NO: 731512 - RNA, 64 nt, hsa; identical to SEQ ID NO: 110843

SEQ ID NO: 731513 - RNA, 64 nt, hsa
uguugccgucagccgaacuuuguuauggagggagcagccucacacaagcagaaacacuccugug

SEQ ID NO: 731514 - RNA, 64 nt, hsa
gccccuguggcuagaggaacaccagcacaaacgacagccucaagucuccuucgagcuuuguaaa

SEQ ID NO: 731515 - RNA, 64 nt, hsa
cagccuuaaaaagggcuucuuggaacuuuaccagcagccucagcuuuacaaaugccuugguaug

SEQ ID NO: 731516 - RNA, 64 nt, hsa
uaaucuuuuuuuuuuuuuuuuguaucugcacuugcagccucagcuuucacacuucagcccuuaa

SEQ ID NO: 731517 - RNA, 64 nt, hsa
ucgccagaggguggggcuggcagaacaccaucuccagccucagcuuugaccugucucauuuccc

SEQ ID NO: 731518 - RNA, 64 nt, hsa
aguuuccauggcccuggauggucuggcccaccuccagccucagcuagcauuacccuucugacac

SEQ ID NO: 731519 - RNA, 64 nt, hsa
uucuggccaagauuuccuucuguaucacuccaagcagccucagcagaagaagcagccaugccca

SEQ ID NO: 731520 - RNA, 64 nt, hsa
agcuccggccugcugucaagucccccagcagaaccagccucaaaaacgcccucaagaacaugau

SEQ ID NO: 731521 - RNA, 64 nt, hsa
ucugcaaccacacagggauauuucugcuaugcaccagccucacuccaccuuccuuccaucaaaa

SEQ ID NO: 731522 - RNA, 64 nt, hsa
accuucccaggugggcccacucacaugguauugccagccucacuggucagccucgccucccagc

SEQ ID NO: 731523 - RNA, 64 nt, hsa
ugguauuacuuccccucugauaggacauuguagccagccucagcacucagugaguucaucaggg

SEQ ID NO: 731524 - RNA, 64 nt, hsa
ccaagcugucucaucaccaaauagguagucaaggcagccucaucuccccaggugaggggcgggu

SEQ ID NO: 731525 - RNA, 64 nt, hsa
gaaccauaaccaccccugggaaacacaucauucccagccucaggcccugcuggaauuggggcug

SEQ ID NO: 731526 - RNA, 64 nt, hsa
ucaucccuaggaggacccaccaguggagcacaugcagccucaguggagaugcuuggugugggga

SEQ ID NO: 731527 - RNA, 64 nt, hsa
uccuuaacccccaaguaaucauuaacccccagaccagccucagaacugaaggagauuguugacc

SEQ ID NO: 731528 - RNA, 64 nt, hsa
cauguugacugugagcaaagugucuuccgauuagcagccucagggaugcccugguggccucucc

SEQ ID NO: 731529 - RNA, 64 nt, hsa; identical to SEQ ID NO: 110844

SEQ ID NO: 731530 - RNA, 64 nt, hsa; identical to SEQ ID NO: 110845

SEQ ID NO: 731531 - RNA, 64 nt, hsa
caguccuuuaaccagcacagccaguuaaaagaugcagccucacugcuucaacgcagauuuuaau

SEQ ID NO: 731532 - RNA, 64 nt, hsa
ugcaaccucugccuccuggguucaagugauucuccagccucagccucccgaguagcugggauua

SEQ ID NO: 731533 - RNA, 64 nt, hsa; identical to SEQ ID NO: 110846

SEQ ID NO: 731534 - RNA, 64 nt, hsa; identical to SEQ ID NO: 110847

SEQ ID NO: 731535 - RNA, 64 nt, hsa
uagcaaaccuguuaguuuuacuucugcauugaaccagccucagaagcuacuuacugcuuuaugu

SEQ ID NO: 731536 - RNA, 64 nt, hsa
aagugcugggauugcaggcaugagccaccgugcccagccucaaaaauauuuuuuaaaagaaaag

SEQ ID NO: 731537 - RNA, 64 nt, hsa
auccaugacccccaagcagauauaacaagcugugcagccucaguaggcugcuugcccucuccag

SEQ ID NO: 731538 - RNA, 64 nt, hsa
uuguuuuuuguguggaacagcucaccuugucagacagccucagggcaucucugagacacagggg

SEQ ID NO: 731539 - RNA, 64 nt, hsa
caccaaccccaucucccacucagaaaucaccucccagccucaggaagaguagaaauuggguggu

SEQ ID NO: 731540 - RNA, 64 nt, hsa
ugaccccucaggagggauugcaggccccagguggcagccucagagaggaggcgcaggcaggccc

SEQ ID NO: 731541 - RNA, 64 nt, hsa
cccuuuugcuuuucagugucuucucagaaacaaccagccucaaagguaauuaaacucucauuua

SEQ ID NO: 731542 - RNA, 64 nt, hsa
gcuggcagggccgccuucagaggcugcagggccucagccucaggaugcauuuaauguauccugg

SEQ ID NO: 731543 - RNA, 64 nt, hsa
uuggauccuuugagguaaaaaaacauaaugucuucagccucauaauaaaggaaaguuaauuaaa

SEQ ID NO: 731544 - RNA, 64 nt, hsa
aagccagccuucuuccaucccaggacaccacacccagccucaguccuccccucacagccucuga

SEQ ID NO: 731545 - RNA, 64 nt, hsa
ccugccguuggaccuucaccuccuagagauaaaccagccucagcuggcgcagcggggcccuucu

SEQ ID NO: 731546 - RNA, 64 nt, hsa
gugugagggucaccggcaggugggcugguggcugcagccucagagcccucccagguugcugcug

SEQ ID NO: 731547 - RNA, 64 nt, hsa
cccgcacagcccugcaccccgccccugggguuggcagccucaguuggccccuggcagaggaaca

SEQ ID NO: 731548 - RNA, 64 nt, hsa
ggguuucuucaugguggggggccauuuggaaugacagccucacuuccuucugauggcuacaucu

SEQ ID NO: 731549 - RNA, 64 nt, hsa
auaagguuuauuucugugaguuuuguaugaaaaucagccucauuauuuauaguugaauuuuugc

SEQ ID NO: 731550 - RNA, 64 nt, hsa
uuccucucucccuccuaccaccugccaguuuccccagccucagccccagccccagccccagugg

SEQ ID NO: 731551 - RNA, 64 nt, hsa
aagugcugggauuacagggaugagccaccgcgcccagccucaucucuuuguucuaaagauggaa

SEQ ID NO: 731552 - RNA, 64 nt, hsa
acuucuugucuggaagaguucugcaggaaauggccagccucaaacgacaauucacggaacuguu

SEQ ID NO: 731553 - RNA, 64 nt, hsa; identical to SEQ ID NO: 110848

SEQ ID NO: 731554 - RNA, 64 nt, hsa; identical to SEQ ID NO: 110849

SEQ ID NO: 731555 - RNA, 64 nt, hsa
uguuugucugugaguuacgggcaaccagccucuucagccucacacccauuccccugagagcaag

SEQ ID NO: 731556 - RNA, 64 nt, hsa
agguuugaguucuggguauccucccuuucuguaacagccucaaauaaagguguaccuuccaugu

SEQ ID NO: 731557 - RNA, 64 nt, hsa
uagaaauccgcaagcugggugugcuuugagugugcagccucacaaacauggccuuuucucucuc

SEQ ID NO: 731558 - RNA, 64 nt, hsa
auguugcuaaauagauuauaauacacaaggaaagcagccucaaagaauuaccccucccaaaaug

SEQ ID NO: 731559 - RNA, 64 nt, hsa
uuuuguuacauaugaacauucauuuuuaaaugcucagccucaagugcaggcauuuuugaguggc

SEQ ID NO: 731560 - RNA, 64 nt, hsa
aaauaaugccauaagucuagauugccucaugaagcagccucauuugaauugcuuucauagcuuu

SEQ ID NO: 731561 - RNA, 64 nt, hsa
gugauggaacaagagaaguacuaucuuuguguugcagccucaaccaacaacaauguguuguaaa

SEQ ID NO: 731562 - RNA, 64 nt, hsa
aaagacugaaaauucauugcaauuagggaacgcacagccucacaaaaagugguugugauugcaa

SEQ ID NO: 731563 - RNA, 64 nt, hsa
uaacuggcacugucauuuguaaaugccauugucacagccucauuuguaagcagcacugccucuc

SEQ ID NO: 731564 - RNA, 64 nt, hsa
aggucucgagacgcacaugcacgccugggcguggcagccucacagggaacacgggacagacgcc

SEQ ID NO: 731565 - RNA, 64 nt, hsa
agguguuuacugugcugcugcacugguccuaugccagccucacccauguggggaccacggaagg

SEQ ID NO: 731566 - RNA, 64 nt, hsa
ucuaguaaaaaagguaggaaaucccuaaaacuuccagccucacauagcacgguucucaccuguc

SEQ ID NO: 731567 - RNA, 64 nt, hsa; identical to SEQ ID NO: 110850

SEQ ID NO: 731568 - RNA, 64 nt, hsa; identical to SEQ ID NO: 110851

SEQ ID NO: 731569 - RNA, 64 nt, hsa
ggcccuggccagaagcaggagugugaggaggagacagccucagcggacaagcagcuggugcucc

SEQ ID NO: 731570 - RNA, 64 nt, hsa
ugugaauucuagcaaccuuuguuaggaaaaagcacagccucagauggaggcagccuaaacugug

SEQ ID NO: 731571 - RNA, 64 nt, hsa
cauuucagcuguuucaccaucagucaaugaauaacagccucauugaugucaaaaacuucaauau

SEQ ID NO: 731572 - RNA, 64 nt, hsa
caccauguuggccaggcuggucuugaacuccuggcagccucaagugauccacccaccucggucu

SEQ ID NO: 731573 - RNA, 64 nt, hsa
ugugccagagggguuggccaguuggagccugggucagccucagcagccuauccccauguccucu

SEQ ID NO: 731574 - RNA, 64 nt, hsa
agcauuuagugcacaguggccccaucauagccugcagccucaucauuucccaucuggaccuggu

SEQ ID NO: 731575 - RNA, 64 nt, hsa
cucucaaagcuaauuuuuuacuaaaguuuuuauacagccucaaauuguuuuauuaaaaaaaaga

SEQ ID NO: 731576 - RNA, 64 nt, hsa
aaguccacgcagguggcuuguagaaaccuuugggcagccucaugucugcuaaaacagccaucuu

SEQ ID NO: 731577 - RNA, 64 nt, hsa
aaggaaagguaauuuuaagcuaacaaccagugcacagccucagguuuuaaauuacaaccacagu

SEQ ID NO: 731578 - RNA, 64 nt, hsa
caugacccagcccuauuuuacgucauucuaaauucagccucauauaaugaaaauacauuaugaa

SEQ ID NO: 731579 - RNA, 64 nt, hsa
ggcuggagugcaguggcacaaugacgacucacugcagccucaaccuccuggggccaagugaucc

SEQ ID NO: 731580 - RNA, 64 nt, hsa
ggaugggaccuuuguaggaagagacacaguccugcagccucauauggcucaauaaaacagaaag

SEQ ID NO: 731581 - RNA, 64 nt, hsa; identical to SEQ ID NO: 110852

SEQ ID NO: 731582 - RNA, 64 nt, hsa; identical to SEQ ID NO: 110853

SEQ ID NO: 731583 - RNA, 64 nt, hsa
ugaucccaguccagacgggugcugccggcucagccagccucacgcugcuaggaaauggcucccu

SEQ ID NO: 731584 - RNA, 64 nt, hsa
ggaaaccuccuacccaugucugagguagcaagugcagccucacgacagauaccaggcaauccag

SEQ ID NO: 731585 - RNA, 64 nt, hsa
auaaguagggaacauggcagagaguggugcuucccagccucacaaugugggaauuugacauagg

SEQ ID NO: 731586 - RNA, 64 nt, hsa
cuuaggccauucuccuucucuuccauggagaauccagccucacaaaaggauucuuucaacuucu

SEQ ID NO: 731587 - RNA, 64 nt, hsa
gccagagauggaggagccccaguggcugacaggccagccucacucaggcacguaccugcugacc

SEQ ID NO: 731588 - RNA, 64 nt, hsa
gagacauacaaggacagugggucauggguaguaccagccucaaauucccacaggcucauacuca

SEQ ID NO: 731589 - RNA, 64 nt, hsa
aauacaugcaugcacaugaaaacaugcacaaccacagccucaaucuuguauuuaguuuggggaa

SEQ ID NO: 731590 - RNA, 64 nt, hsa
ggaugacagcccagugucggccuggccgggugggcagccucaggucuugagaggauaagacucu

SEQ ID NO: 731591 - RNA, 64 nt, hsa
agccgcagcagugacuacaauaguugcaccagggcagccucagcccuugcagccaguaagaaau

SEQ ID NO: 731592 - RNA, 64 nt, hsa
aaccuggcaacugugagucccugcuucccgacaccagccucauggaauaugcaacaacuccugu

SEQ ID NO: 731593 - RNA, 64 nt, hsa
ucucuguggaccagagugcuugaggcaucucaggcagccucagcccaagcuucuaccugccuuu

SEQ ID NO: 731594 - RNA, 64 nt, hsa
ugacuggagcagaauaagucuaaaggcagagccccagccucagagacaaauaggcuucaucaug

SEQ ID NO: 731595 - RNA, 64 nt, hsa
cuucauuuaaguuggcuugaaucucaucagcaggcagccucaugcaaccaugagggauaguaug

SEQ ID NO: 731596 - RNA, 64 nt, hsa
agaacccucccacagcacauccuacccggaagaccagccucagaggguccuucuggaaccagcu

SEQ ID NO: 731597 - RNA, 64 nt, hsa
gcaucacuguauacucuugcugagaauguggaugcagccucacagaucuuugcaacacuccaac

SEQ ID NO: 731598 - RNA, 64 nt, hsa
cccaaguauuuccagcaggaaguaaugucuuccucagccucaaccagggaccaaccggcugcuu

SEQ ID NO: 731599 - RNA, 64 nt, hsa
uguguaccguaaagaauauaucuuaucuggagcucagccucaaucaugucuuaacaaaaugaca

SEQ ID NO: 731600 - RNA, 64 nt, hsa
uggcccuuauggugcccugugcagggugccaccacagccucauuuuacagacagcccccugagg

SEQ ID NO: 731601 - RNA, 64 nt, hsa
ugggacuggaugugccgugggcagugccuuccuccagccucacaaccuuucugcuggggcugaa

SEQ ID NO: 731602 - RNA, 64 nt, hsa
uggcccuccuggcuucagcauccugcagguagagcagccucauuccuucacaagauggaaggca

SEQ ID NO: 731603 - RNA, 64 nt, hsa
gggacuauuaaggguguuagucuuggagaagacacagccucaccuucucacuugcuguggguga

SEQ ID NO: 731604 - RNA, 60 nt, hsa; identical to SEQ ID NO: 730168

SEQ ID NO: 731605 - RNA, 64 nt, hsa
aauuuuuaacuugggggugaaagauuuaagaacucagccucacuagaucaacggaccaaauaaa

SEQ ID NO: 731606 - RNA, 64 nt, hsa
cagaguacaggucugguacaaucacaguucauugcagccucaaccuccuggguuuaagcagucc

SEQ ID NO: 731607 - RNA, 64 nt, hsa
ucacacaaaaggaacaaaagcgaaacacacaaaccagccucaacuuacacuugguuacucaaaa

SEQ ID NO: 731608 - RNA, 64 nt, hsa
ucuucagguucuuagugucacuuaccuagauuuacagccucacuugaaugugucacuacucaca

SEQ ID NO: 731609 - RNA, 64 nt, hsa
ucucaccauguugcccaggcuggucucaaacccccagccucaacugauccucgcaucucagccu

SEQ ID NO: 731610 - RNA, 64 nt, hsa
cuccaccugcuggguucaagcaauucuccugccucagccucaugaguagcugugacuacaggca

SEQ ID NO: 731611 - RNA, 64 nt, hsa
cugcagaagcugcauuucagcugaaucuguguuucagccucaguugguugcaccguuagccccu

SEQ ID NO: 731612 - RNA, 64 nt, hsa
acgucacagaagcgaaggcuugaugcugucucagcagccucagcugugggggggaagcgcgugu

SEQ ID NO: 731613 - RNA, 64 nt, hsa; identical to SEQ ID NO: 110854

SEQ ID NO: 731614 - RNA, 64 nt, hsa; identical to SEQ ID NO: 110855

SEQ ID NO: 731615 - RNA, 64 nt, hsa
auuuuuguaauauuuguccacuaagcuggagaagcagccucauacaguugauuuuguguaugug

SEQ ID NO: 731616 - RNA, 64 nt, hsa
ccagcuugggcaauucagggcagaacuccuguaucagccucauggacacccagaauugguaucu

SEQ ID NO: 731617 - RNA, 64 nt, hsa
uggacagcccaaccucuggcagaccagggguuaccagccucacagcugcagcugccuucaagcc

SEQ ID NO: 731618 - RNA, 64 nt, hsa
cccugccccagcagacacaggcugccagucccuccagccucaccuccccgcccugggcagcagg

SEQ ID NO: 731619 - RNA, 64 nt, hsa
cacuagguaugugcaguucccggccccugccacccagccucaugcaagucauccccgacaugac

SEQ ID NO: 731620 - RNA, 64 nt, hsa
gaagaacgggaccuaggggacagcagcaccacuccagccucagagacugcacacccccuugccu

SEQ ID NO: 731621 - RNA, 64 nt, hsa
uuccugugauuuuuuuuaaaugugcaguacacaucagccucacugagcuaauaaagggaaacga

SEQ ID NO: 731622 - RNA, 64 nt, hsa
acauuggcagucgaggagucagaacucggauucccagccucacucccucuguguguguugacca

SEQ ID NO: 731623 - RNA, 64 nt, hsa
uauaauauucuuuuuuuuuucuagaaacugggggcagccucaaaaucauguuaaagagggaguu

SEQ ID NO: 731624 - RNA, 64 nt, hsa
cuggugaccggagagaaagaggagcccucccgcucagccucagaagcagacucugaagccggag

SEQ ID NO: 731625 - RNA, 64 nt, hsa
ccucugccucccggguucaagcaauuucuugccucagccucaugaauagcugggauuacaggug

SEQ ID NO: 731626 - RNA, 64 nt, hsa
aggaaucaaaaguauuuuauaaaaggagaaagaacagccucauuuuagauguaguccuguugga

SEQ ID NO: 731627 - RNA, 64 nt, hsa
ugcaaccuccgccucccggguucaagcgauucuccagccucagcuuccugaguagaugggauua

SEQ ID NO: 731628 - RNA, 64 nt, hsa
ccucugccucccggguucaagcaauucccugccucagccucaugaauagcugggauuacaggug

SEQ ID NO: 731629 - RNA, 64 nt, hsa
gcucucccugucuccaacuccaguaagcccuccucagccucaccuuacgaauccaaagaacugg

SEQ ID NO: 731630 - RNA, 64 nt, hsa
gacuagaguacaauauugcaaucacagcucacugcagccucaaacuccugggcucaagugaucc

SEQ ID NO: 731631 - RNA, 64 nt, hsa
cacuagcggguuggggguggugguggggugcuggcagccucaggagcgaucgcuccccuggaga

SEQ ID NO: 731632 - RNA, 64 nt, hsa
auuguggggcucauaaaacaugaaucaagcaauccagccucaugggaaguccuggcacaguuuu

SEQ ID NO: 731633 - RNA, 64 nt, hsa
ggcuggagugcgcuggcuugaucuuggcucacugcagccucaauguccccaggcucagauuguc

SEQ ID NO: 731634 - RNA, 64 nt, hsa
aggaacguggucaacucacaccugccucuuccugcagccucacuucuaccugcccccaucauaa

SEQ ID NO: 731635 - RNA, 64 nt, hsa
guucccauguacagacacgguccccacacccucccagccucaggcccaggcagacaugggcgag

SEQ ID NO: 731636 - RNA, 64 nt, hsa
uaaaauggggcugugugcaugcaggcccauguuucagccucagcccacgccaggugaaaggauc

SEQ ID NO: 731637 - RNA, 64 nt, hsa
auuuuugagugugccaggguaaaggcuuccaguucagccucaguuauuuuagacaaucucgcca

SEQ ID NO: 731638 - RNA, 64 nt, hsa
gucucccuugaguucaggugcccugaacucaguacagccucaucuucucauccaccaccuucuc

SEQ ID NO: 731639 - RNA, 64 nt, hsa
uccacggccuccugaacguccguccucaggagcacagccucacggacagugccaaacccugugg

SEQ ID NO: 731640 - RNA, 64 nt, hsa
ccaagacauugucucugucggccaggcuggagugcagccucaaccuccuggguccaagugaucc

SEQ ID NO: 731641 - RNA, 64 nt, hsa
acccagcgccccuccucccugagggagcauggcacagccucacacuugaaagacgguguuuggu

SEQ ID NO: 731642 - RNA, 64 nt, hsa
accccgugccaggacucagcaguggccuggacaacagccucagcuuccucuacccaucuucuuu

SEQ ID NO: 731643 - RNA, 64 nt, hsa
uuaaucuuacucccagcaccaaaagguaauugaccagccucaacacaauuuuggacaaagcuag

SEQ ID NO: 731644 - RNA, 64 nt, hsa
cucaguuuuuagcccuugagaggacauacuuuuccagccucauggguauggcacucuuaauuaa

SEQ ID NO: 731645 - RNA, 64 nt, hsa
aaggaaagugggguccuucggggcgaugcucccucagccucagaggagcucuacccugcucccu

SEQ ID NO: 731646 - RNA, 64 nt, hsa
cugggccaaggaacacccccuaguccugacacugcagccucaagcagguacgcuguacauuuuu

SEQ ID NO: 731647 - RNA, 64 nt, hsa
cugccacgggcucuccugggcuuauggccggucacagccucagugugacuccacaguggccccu

SEQ ID NO: 731648 - RNA, 64 nt, hsa
cuuagucucugcccuauacgccgccuucacuccacagccucaccccucccacccccauacuggu

SEQ ID NO: 731649 - RNA, 64 nt, hsa; identical to SEQ ID NO: 110856

SEQ ID NO: 731650 - RNA, 64 nt, hsa; identical to SEQ ID NO: 110857

SEQ ID NO: 731651 - RNA, 64 nt, hsa
cugaaccaaaauuagauucaacuauucauauuaucagccucauuuuauggaaaagggaugccac

SEQ ID NO: 731652 - RNA, 64 nt, hsa
ugcagccaggugcccaggacagaagccccagccccagccucaucuacaccccaggagcccuggc

SEQ ID NO: 731653 - RNA, 64 nt, hsa
ucucagcccaugcccuggagggcauuccccuggccagccucagccccuugucuacuuguucucc

SEQ ID NO: 731654 - RNA, 50 nt, hsa; identical to SEQ ID NO: 110858

SEQ ID NO: 731655 - RNA, 64 nt, hsa; identical to SEQ ID NO: 110859

SEQ ID NO: 731656 - RNA, 64 nt, hsa; identical to SEQ ID NO: 110860

SEQ ID NO: 731657 - RNA, 64 nt, hsa; identical to SEQ ID NO: 110861

SEQ ID NO: 731658 - RNA, 64 nt, hsa
ugggaagauccuuggcugccgcuuucucuccccacagccucaaggccacccuaccgucauauau

SEQ ID NO: 731659 - RNA, 64 nt, hsa
gacccuagggaagaagcaagaaacuucggggcugcagccucaggaugaggcagaaggaagggua

SEQ ID NO: 731660 - RNA, 64 nt, hsa
gggagauggucucucuucucaaguaggaacaccccagccucagacagacacagcaggaaggggc

SEQ ID NO: 731661 - RNA, 64 nt, hsa
ucccaacagcccacuguuaggagguaguagaccccagccucaaggcucugaccuucuucaugug

SEQ ID NO: 731662 - RNA, 64 nt, hsa
uuucaccauguuacucaggcuggucucaaacucccagccucaagcgaugcucccaccuccaccu

SEQ ID NO: 731663 - RNA, 64 nt, hsa
uaauugcucacccaagggggcugcuuaacacaaacagccucagacccgagguuuagauuucuga

SEQ ID NO: 731664 - RNA, 64 nt, hsa
gcugaucucgaacucccgaccucaggugauccgccagccucagccucccaaagugcugggauua

SEQ ID NO: 731665 - RNA, 64 nt, hsa
ugcaaccuccgccuccuggguucaagcgauucuccagccucagccuccugaguagcuggaauua

SEQ ID NO: 731666 - RNA, 64 nt, hsa; identical to SEQ ID NO: 110862

SEQ ID NO: 731667 - RNA, 64 nt, hsa; identical to SEQ ID NO: 110863

SEQ ID NO: 731668 - RNA, 64 nt, hsa; identical to SEQ ID NO: 110864

SEQ ID NO: 731669 - RNA, 64 nt, hsa
accagccuguugcuguacuuuucugcuuauuuuacagccucaaauauuucucauuaucuuguca

SEQ ID NO: 731670 - RNA, 64 nt, hsa
acccagccccucaggaacccucauccuucaaagacagccucauuucggacuaaacucauuagag

SEQ ID NO: 731671 - RNA, 64 nt, hsa
uauuuucuuucucaccauagaucggcgggugcugcagccucacuguguucuguguacgugacaa

SEQ ID NO: 731672 - RNA, 64 nt, hsa
uguuguguaauugugacacaauuacagcugauugcagccucaaccuucccagcucaagugaucc

SEQ ID NO: 731673 - RNA, 64 nt, hsa
cuaauuuugcuugcucauauuucuggccaauguacagccucauauuuuucagaguaauacagau

SEQ ID NO: 731674 - RNA, 64 nt, hsa
uaugugacucuuguuacagaucauggcggugcgucagccucacaggagacauagcaggucucag

SEQ ID NO: 731675 - RNA, 64 nt, hsa
uuagauggaaaaguguagggacugagaagggcugcagccucagcaguguacagaguccccggcg

SEQ ID NO: 731676 - RNA, 64 nt, hsa
cuuacagcucucagccuaagagcgcagcacugaacagccucaucauuccacuuuucaugggaaa

SEQ ID NO: 731677 - RNA, 64 nt, hsa
gaagcugcucacugcucacacgcugccuccucagcagccucacugcaucuuucucuucccaugc

SEQ ID NO: 731678 - RNA, 64 nt, hsa
agaacagccugagccuucagcccucacagaugcccagccucauagcugaaguugccugaaugau

SEQ ID NO: 731679 - RNA, 64 nt, hsa
gggaaaaaguguuagugcuuccaggcggcacugacagccucaguaacaauaaaaacaaugguag

SEQ ID NO: 731680 - RNA, 64 nt, hsa
cugaggguggugaugguaguuucuacccauaccucagccucaggcgaguggcuuauagccucca

SEQ ID NO: 731681 - RNA, 64 nt, hsa
cccuucagcuuggguacacacacagaggagaccucagccucacaccagaaauauuauuuuuuua

SEQ ID NO: 731682 - RNA, 64 nt, hsa
cccuuccaugaaugaccccucagucuggccuccccagccucaagguccacucaggcacaagagc

SEQ ID NO: 731683 - RNA, 64 nt, hsa
gaacaugccgugugccuuuaguuagcacagcgggcagccucagugaaacucuuagguuaagcag

SEQ ID NO: 731684 - RNA, 64 nt, hsa
uaaaugacaugauuaaaugaugaauuuauuuugucagccucagcaacaaacauuuccuaaaugg

SEQ ID NO: 731685 - RNA, 64 nt, hsa
uauguauaguuacgaugccagauuagauuuauagcagccucaaguuguauuaaaugauauuuug

SEQ ID NO: 731686 - RNA, 64 nt, hsa
uugggucagauaaaugaagaucaaacuccagcuccagccucauuugcuugagacuuugugugua

SEQ ID NO: 731687 - RNA, 64 nt, hsa
gagggucauucuugucacaaaagugccacuaaaacagccucaggagaauaaaugacuugcuuuu

SEQ ID NO: 731688 - RNA, 64 nt, hsa
ccuugcuuuuacaguggacagccucuucucguuucagccucaguauuauguagggaccuuaugc

SEQ ID NO: 731689 - RNA, 64 nt, hsa
ugaccuacuuguaauuaacuugaguuguaguccacagccucaggacaaaugucguugagguuac

SEQ ID NO: 731690 - RNA, 64 nt, hsa
uacccaguggcagucucagguuaagaaggaaaugcagccucaguaacuuccuuuucaaagcagu

SEQ ID NO: 731691 - RNA, 64 nt, hsa
uuguccacacacacaucucacgccccuggucucacagccucacaccuuguccuuccaccccugc

SEQ ID NO: 731692 - RNA, 64 nt, hsa
guugcaaacagcgcaauuccaagcucgagagcuucagccucaggaaagaacuuccccuucccug

SEQ ID NO: 731693 - RNA, 64 nt, hsa; identical to SEQ ID NO: 110865

SEQ ID NO: 731694 - RNA, 64 nt, hsa; identical to SEQ ID NO: 110866

SEQ ID NO: 731695 - RNA, 64 nt, hsa
cagagaugugugcuccuggagggaaaaagaaauacagccucaacagauuaaaaaacaaaaguca

SEQ ID NO: 731696 - RNA, 64 nt, hsa
ccaacaaaacugugucuuaucugccaggaaagaccagccucacuccugggaacugucuggcagg

SEQ ID NO: 731697 - RNA, 64 nt, hsa
aagagaggcggaacugcuguguccucauguggcgcagccucaaacuggcauccaggcacugggc

SEQ ID NO: 731698 - RNA, 64 nt, hsa
uauagauuuuauuauguuaguuuaaaaggucaaucagccucaugacuuuauaguuaugucuugu

SEQ ID NO: 731699 - RNA, 64 nt, hsa
cgaaggcuuaugggucuccagaaacucugccagccagccucaguggagaagcuuccucuaccac

SEQ ID NO: 731700 - RNA, 64 nt, hsa
agucaaggucccuugaaucccaaaagugccuccccagccucagcccccaccuccagccacacac

SEQ ID NO: 731701 - RNA, 61 nt, hsa; identical to SEQ ID NO: 730265

SEQ ID NO: 731702 - RNA, 64 nt, hsa
gauccuaaguaagaacauaauguaaaauugucagcagccucauggggaggaaaaaggaagaguc

SEQ ID NO: 731703 - RNA, 64 nt, hsa
ccuguccucacuggugcuccaggggaagaaacgacagccucacuucuguauggacugcugaugu

SEQ ID NO: 731704 - RNA, 64 nt, hsa
cuggaaacguugggguuucuuccuccagugacagcagccucaguagcuuuccugggcuccaggc

SEQ ID NO: 731705 - RNA, 64 nt, hsa
cggcuccaugcucaccagcagccgcccaggcccgcagccucacccggcucccucuccucacccu

SEQ ID NO: 731706 - RNA, 64 nt, hsa
uagaggaauaaagcugugagcaaacagaggaggccagccucaccucauuccaacaccugccaua

SEQ ID NO: 731707 - RNA, 64 nt, hsa
cugcagggugugaugaggugggagcccucagugccagccucaucacugugugacccugggucug

SEQ ID NO: 731708 - RNA, 64 nt, hsa
ugcucauccccuuauaaaugugcuuugccugccucagccucauggucagagcaguggagacugg

SEQ ID NO: 731709 - RNA, 64 nt, hsa
guugcuguaauugaacgggucgagaugccgaccucagccucacaggccaaagcaucagcaccag

SEQ ID NO: 731710 - RNA, 64 nt, hsa
caccggcacaucuaacaucuacacuucucuagcucagccucacaggccaaagcaucagcaccag

SEQ ID NO: 731711 - RNA, 64 nt, hsa
uucaugggcucgugagcacacucagugcccagcccagccucaaggugagccccgggcccaggcu

SEQ ID NO: 731712 - RNA, 64 nt, hsa; identical to SEQ ID NO: 110867

SEQ ID NO: 731713 - RNA, 61 nt, hsa; identical to SEQ ID NO: 110868

SEQ ID NO: 731714 - RNA, 64 nt, hsa
gaaagucaggcuagcugugcugguauuggaauagcagccucacacuggcgucuggacuguucug

SEQ ID NO: 731715 - RNA, 64 nt, hsa
accugcgaaguccagaguccaggguggagcgcgccagccucagccagagcagccacgacagcca

SEQ ID NO: 731716 - RNA, 64 nt, hsa
cuccaggggagggugcgugggggcgguguggcugcagccucagucccugccccuccagcccaca

SEQ ID NO: 731717 - RNA, 54 nt, hsa; identical to SEQ ID NO: 730281

SEQ ID NO: 731718 - RNA, 64 nt, hsa
auggaucuggagucucugaacucuuaauaggaugcagccucacauacauaaugucacccauuuu

SEQ ID NO: 731719 - RNA, 64 nt, hsa
acagugcugggagaugaucagaaaucucagggcacagccucaggucuaccuggacacucaucca

SEQ ID NO: 731720 - RNA, 64 nt, hsa
cauuugguuucacuaagggccaugugguucccugcagccucaugccuggccccuugacacaucc

SEQ ID NO: 731721 - RNA, 64 nt, hsa
uugugugacucccuucaggcaguccuuuaguccccagccucaccuuugcucucaaugucaugca

SEQ ID NO: 731722 - RNA, 54 nt, hsa; identical to SEQ ID NO: 730286

SEQ ID NO: 731723 - RNA, 64 nt, hsa
uaguuuuguuaaaaaaaaaaaaaaaaaaaggaaacagccucacuuuuuugugcucccucagaau

SEQ ID NO: 731724 - RNA, 64 nt, hsa
ggggagcuacaggggcacuuaacccaccacagcacagccucaucaaaaugcagcuggcaacuuc

SEQ ID NO: 731725 - RNA, 64 nt, hsa
aaccauacuucuuuuuuuuccucugaugugaauccagccucagacugagugaacuguaauaauu

SEQ ID NO: 731726 - RNA, 64 nt, hsa
cuagugcuagucccagaggaugcugcggagggggcagccucagcucucuuuucagagaagauca

SEQ ID NO: 731727 - RNA, 64 nt, hsa
gcggaaggaucaccugagccuaggaguucaagaccagccucagcaacagcaggagccccacccc

SEQ ID NO: 731728 - RNA, 64 nt, hsa
cgccuacuguccaugcggccucacugggggccaucagccucaccagcaaagcagagaugagagc

SEQ ID NO: 731729 - RNA, 64 nt, hsa
gguugcagugagccaagaucgcgccacugcacuccagccucagcaauagagugagacugucuca

SEQ ID NO: 731730 - RNA, 64 nt, hsa
ggcuagagugcaguggcaugaucagggcuuacugcagccucacccucgauuuccugggcucaag

SEQ ID NO: 731731 - RNA, 64 nt, hsa
gaaaagaaaacgaaaacaguuuaaaucucuaccacagccucacaagcaaaugcuaaggggaaca

SEQ ID NO: 731732 - RNA, 64 nt, hsa
gccaggccucacauucguggggcucccugaauggcagccucagcacagcguaggcccuuaauaa

SEQ ID NO: 731733 - RNA, 64 nt, hsa
ugaaaggagaggaguagaugagauggaauuuuuccagccucauccuggccugcccucuagacuc

SEQ ID NO: 731734 - RNA, 64 nt, hsa
agaggugggcgcauagguacaagugcugcuuugucagccucacucccugcagcucucagcuccc

SEQ ID NO: 731735 - RNA, 64 nt, hsa
uugccacagaggccucccagggcucucggccagucagccucagaaugagaguuacaccacuggc

SEQ ID NO: 731736 - RNA, 64 nt, hsa; identical to SEQ ID NO: 110869

SEQ ID NO: 731737 - RNA, 64 nt, hsa; identical to SEQ ID NO: 110870

SEQ ID NO: 731738 - RNA, 64 nt, hsa
ggcuggagugcaguggcaugaucauagcucacugcagccucauacuccugggcucaagcaaucc

SEQ ID NO: 731739 - RNA, 64 nt, hsa
ggaugauggaggugacaucaggcagaggagagugcagccucacagugacuuucucagaggugac

SEQ ID NO: 731740 - RNA, 64 nt, hsa
ccccgucacucuuggaggacuccugugacguggucagccucauucauccuugcccuucucaggg

SEQ ID NO: 731741 - RNA, 64 nt, hsa
cuuugccuuugcugggccuucugugcaggacgcucagccucagggcucagaaggugccaguccg

SEQ ID NO: 731742 - RNA, 64 nt, hsa
gcagguggauugcuugagcucgggaguuugagaccagccucaucaacacagugaaacuccaucu

SEQ ID NO: 731743 - RNA, 64 nt, hsa
gcaaaccagugcaugcaccugguuggaagaugcucagccucacaaaagcuccaagcccuuuggg

SEQ ID NO: 731744 - RNA, 56 nt, hsa; identical to SEQ ID NO: 730308

SEQ ID NO: 731745 - RNA, 64 nt, hsa
aauauuuuaaauuagcuuuucuaaaaaaaaaauccagccucauaaaguagauuagaaaacuaga

SEQ ID NO: 731746 - RNA, 64 nt, hsa
cuuguaugcaugcauuuucaagcaaguaauaaagcagccucauuuaauucuggauaaugcuggg

SEQ ID NO: 731747 - RNA, 64 nt, hsa
acccaaaacucuuuauggcauuuuacaaugcacacagccucaugcaaguuuagacaaguggauu

SEQ ID NO: 731748 - RNA, 64 nt, hsa
ugcuggagccguuccaucccggagcuuggaggggcagccucaggugugugccugggcaccgcuc

SEQ ID NO: 731749 - RNA, 64 nt, hsa
ucucgagggacguguguuccccagcugaucgugucagccucaugccccaggccucaucuuucau

SEQ ID NO: 731750 - RNA, 64 nt, hsa
ucucgaggggcguguguuccccagcugaucaugucagccucaugccccaggccucgucuuucau

SEQ ID NO: 731751 - RNA, 64 nt, hsa
cuagggccuuuggguggggagggcccgggccggacagccucagcuccguccccugccccacaag

SEQ ID NO: 731752 - RNA, 64 nt, hsa
uucauccccugguggcuucagcaguccuuaucaccagccucacaaucccacaggcccaccccca

SEQ ID NO: 731753 - RNA, 64 nt, hsa
agauguguggggaggauccaucccccacccacugcagccucacaccgaguccaccuuggacaug

SEQ ID NO: 731754 - RNA, 64 nt, hsa; identical to SEQ ID NO: 110871

SEQ ID NO: 731755 - RNA, 64 nt, hsa; identical to SEQ ID NO: 110872

SEQ ID NO: 731756 - RNA, 64 nt, hsa
gcgugguauaaucuccauuucaaaaccaaggaagcagccucagaguggucgagugacacaccuc

SEQ ID NO: 731757 - RNA, 64 nt, hsa
cagcugugcuaagccugccacgggcguauccuugcagccucacaacagugggaggucuguaucc

SEQ ID NO: 731758 - RNA, 64 nt, hsa
gccguaugcugcacaagcguguacacccccugggcagccucaaaaccccgcuuacagcagcaac

SEQ ID NO: 731759 - RNA, 64 nt, hsa
gcaggggccccucccugccucggcucugccgccccagccucaguuccugcuucuggucuucucc

SEQ ID NO: 731760 - RNA, 64 nt, hsa
agggggcuugcccacccaccccgaccccagcccccagccucagccccgguccgggggcagccag

SEQ ID NO: 731761 - RNA, 64 nt, hsa
gccagccugcccugcgguccugucaccuggaggccagccucacaugcccaaaucuccagucucc

SEQ ID NO: 731762 - RNA, 64 nt, hsa
caguggggugcccgcugccuguccuccgugaaaccagccucagaucagggcccugccacccagg

SEQ ID NO: 731763 - RNA, 64 nt, hsa
guggcgugaccuuggcucacugcaaccuccaggccagccucagccucccuaguagcugggacua

SEQ ID NO: 731764 - RNA, 64 nt, hsa
auuugauaagcaagaaagauuucaucucccaccccagccucaaguaggaguuuuauauacugug

SEQ ID NO: 731765 - RNA, 64 nt, hsa
uacacauguugccugagcugguuaaccacaucggcagccucagcuaccacaacauacugacuaa

SEQ ID NO: 731766 - RNA, 64 nt, hsa
aucaucucuugauaaaggagagguuaaagcaaaccagccucagcggaccacucuucucuccaag

SEQ ID NO: 731767 - RNA, 64 nt, hsa
gccuuccaguauggccccaccauguuugucccuccagccucagccaagcaacauggggugaacc

SEQ ID NO: 731768 - RNA, 64 nt, hsa
cccagugagcagccuggagcccuggagaccccaccagccucaccagcgcuugaagccugaaccc

SEQ ID NO: 731769 - RNA, 64 nt, hsa
cuccacccugccagcagcuuccggccaguccccacagccucaucagcucucuucaccguuuuuu

SEQ ID NO: 731770 - RNA, 64 nt, hsa; identical to SEQ ID NO: 110873

SEQ ID NO: 731771 - RNA, 64 nt, hsa; identical to SEQ ID NO: 110874

SEQ ID NO: 731772 - RNA, 64 nt, hsa
ucccuggcagguggccaggcaggcgggggcugcucagccucauccugagagaccugcccucucu

SEQ ID NO: 731773 - RNA, 64 nt, hsa
uuagaguacuuucauacucuucuaaguccucuuccagccucacuuugaguccuccuugggguug

SEQ ID NO: 731774 - RNA, 64 nt, hsa
auugcuuacccacugccugcccagacuuucuauccagccucacugagcugcccacuacuggaag

SEQ ID NO: 731775 - RNA, 64 nt, hsa
cuaugaacugguuuuggucccucuaaugauccuccagccucaucuaaugccccccaaagacuga

SEQ ID NO: 731776 - RNA, 60 nt, hsa; identical to SEQ ID NO: 730340

SEQ ID NO: 731777 - RNA, 64 nt, hsa
gguggcuuucugaguccuguuggccaccaagugucagccucagcacucccgggacuauugccaa

SEQ ID NO: 731778 - RNA, 64 nt, hsa
auuuuauuuuuuacuuuaaaugccugccaaggagcagccucaagcccagagaagacugaggcua

SEQ ID NO: 731779 - RNA, 64 nt, hsa
gucagcaagccuccuuugugcuauguggagcucacagccucacaugugaacacccgugucuggg

SEQ ID NO: 731780 - RNA, 64 nt, hsa
caucuguagcacaggcaaugccagugccaugcugcagccucagaaaccaggccucucacuccag

SEQ ID NO: 731781 - RNA, 64 nt, hsa
ugacaccugccggcaguagcccccacgcuggccccagccucagaccccacccagcaccuuccca

SEQ ID NO: 731782 - RNA, 62 nt, hsa
gggacgucucuuucuauucaauaaacagaugcugcagccucauggcccucaccucuuuggac

SEQ ID NO: 731783 - RNA, 64 nt, hsa
ccuaugacguguuuggcuguuggcucaccgagaccagccucaucucggggaaccugcaccgcau

SEQ ID NO: 731784 - RNA, 64 nt, hsa
cacucucauugcugcuguugaguucagcuuuuaccagccucaguguggaggcuccaucccagca

SEQ ID NO: 731785 - RNA, 64 nt, hsa
uucaaagagauuuugaaaaccaauuguauuuaaccagccucaaauugugcaaccaugauguaua

SEQ ID NO: 731786 - RNA, 64 nt, hsa
caggccaggaggcuguuccaggaguccugcccagcagccucaguggccaagcccagacacucac

SEQ ID NO: 731787 - RNA, 64 nt, hsa
auuaugauauugcaaaagugauacuuagauuuuacagccucaguagucugcccaguguccacau

SEQ ID NO: 731788 - RNA, 64 nt, hsa
cuggcagcuaacacgcccgggguggccacagcgccagccucagacuggagggcaagggguuccc

SEQ ID NO: 731789 - RNA, 64 nt, hsa
gguuuuucuccugcaggguacugggccaggcccucagccucagagagccugcagaagggcuugg

SEQ ID NO: 731790 - RNA, 64 nt, hsa
accgacgcgacgcgaugccucccggccaccgccccagccucaccccaucccacgacccccgcaa

SEQ ID NO: 731791 - RNA, 64 nt, hsa
agccuaguauguucugacaucuggcuucccuucucagccucauguccaccugccugccagccag

SEQ ID NO: 731792 - RNA, 64 nt, hsa
acacuacaccacacacaacagccaacagcuacaacagccucacuuggucugccaggcccccacc

SEQ ID NO: 731793 - RNA, 64 nt, hsa
uccaagugaaugggucucaaagacuuggugaccccagccucaucuucuaggccuuuuccaccca

SEQ ID NO: 731794 - RNA, 64 nt, hsa
caaaggccacuucucaagcagcuuuuggcaccuucagccucagaguggaaucuuuuaaagacag

SEQ ID NO: 731795 - RNA, 64 nt, hsa
aggcuggugguugccucccguccugggcaggcugcagccucaugccaugucucucucccacuac

SEQ ID NO: 731796 - RNA, 64 nt, hsa
ggacagcguucgcccuuuagcggggaggucauuacagccucauggccucuaccaaggccccaga

SEQ ID NO: 731797 - RNA, 64 nt, hsa
cacacuucgcuucagccuccggaccauuccggagcagccucacauaccucacugucucgucugu

SEQ ID NO: 731798 - RNA, 64 nt, hsa
ugcaaccuccgccuccuggguucaagcgauucuccagccucagccucccgaguagcugggauua

SEQ ID NO: 731799 - RNA, 64 nt, hsa
auucacuaguucuuaacauuguaaaaaguuugaccagccucagaaggcuuucucuguguaaaga

SEQ ID NO: 731800 - RNA, 64 nt, hsa
ccaaaacugggccgauguggugugacauccccaccagccucagaugagacgggccaggacgccc

SEQ ID NO: 731801 - RNA, 64 nt, hsa
aacaugaacaagucuguaaagcucagacauuugucagccucaacagcaccacccauucaagcau

SEQ ID NO: 731802 - RNA, 64 nt, hsa
aaccaauuuguaaagccacauuugcauaugaugccagccucacgcauuuguauaucuccagaaa

SEQ ID NO: 731803 - RNA, 64 nt, hsa
cuggcuaccccuccuggccacccaguacucccuccagccucagcuggcugaaccucgccgcucc

SEQ ID NO: 731804 - RNA, 64 nt, hsa
gagaaaaagaacuagcagagggccugggcucuuccagccucagugugccucucuggccgcccac

SEQ ID NO: 731805 - RNA, 64 nt, hsa
ucaucuaauucuggcaggaccucaccaaaagauccagccucauaccuacaucagacaaaauauc

SEQ ID NO: 731806 - RNA, 64 nt, hsa
aggcugaaggcgagggguggaggaggccccagcacagccucaucuccauguguacacgugugua

SEQ ID NO: 731807 - RNA, 64 nt, hsa
ccucgcaguuggggcugaggcuggggcuggcugccagccucaguucugggagcgcuggggucgc

SEQ ID NO: 731808 - RNA, 64 nt, hsa
cuuccugaggggagacagagcaaccccuggaccccagccucaaauccaggacccugccaggcac

SEQ ID NO: 731809 - RNA, 64 nt, hsa
auccuuuccuaggcacauucguccacuaagggaacagccucagaaacugguacagcaaugggug

SEQ ID NO: 731810 - RNA, 64 nt, hsa
auggggagauucaggaucccccugugccagagcacagccucaccggaugcugcuucccacacug

SEQ ID NO: 731811 - RNA, 64 nt, hsa
uguaaccuccgucuccuggguucaagugauucuccagccucagccucccgaauagcugggauua

SEQ ID NO: 731812 - RNA, 64 nt, hsa
aggguugggaagccuuccgucugcggugggcaggcagccucacccugggcccacagaccggccu

SEQ ID NO: 731813 - RNA, 64 nt, hsa
agcugucauuguuccuuccccagaagcuaagagccagccucagagccuacccaggagcugugaa

SEQ ID NO: 731814 - RNA, 64 nt, hsa
cugcaggaucagguuagggcgagcgcuaccucuccagccucagcucucaguugcagcccugcug

SEQ ID NO: 731815 - RNA, 64 nt, hsa
gugggcauguuauggggaggggaggggguucuuccagccucaggucccagcugucucacguugu

SEQ ID NO: 731816 - RNA, 64 nt, hsa
gucucccagccacuuucccuccuggcacugccaccagccucaccgccugcgggcagggggaggc

SEQ ID NO: 731817 - RNA, 64 nt, hsa; identical to SEQ ID NO: 110875

SEQ ID NO: 731818 - RNA, 64 nt, hsa; identical to SEQ ID NO: 110876

SEQ ID NO: 731819 - RNA, 64 nt, hsa
ucucccacgugguugucccgggaaagcugccccacagccucagcaucuucagcacuuaccgauc

SEQ ID NO: 731820 - RNA, 64 nt, hsa
gaggacguccugugugccaagugguuuauaugcccagccucauuuaauccucagaaugacucca

SEQ ID NO: 731821 - RNA, 64 nt, hsa
gacuggccaggcccaaggacccagccaucaaaaccagccucaaaucugguugugauggagaagu

SEQ ID NO: 731822 - RNA, 64 nt, hsa
ggcuagccgggccucaccccaccccuacccgccacagccucagggugugcaggggagccugcug

SEQ ID NO: 731823 - RNA, 64 nt, hsa
gcugugugaccuuaggaagucucugccccucucucagccucagugucccgagggccccgaagca

SEQ ID NO: 731824 - RNA, 64 nt, hsa
cacugcacaccagccugggugacagugugagacccagccucaaaaaaaaaaaaaaaaaagugau

SEQ ID NO: 731825 - RNA, 64 nt, hsa
gguggucucaaacuccugggcucaagcgaacugucagccucagccucccagugugcugggauua

SEQ ID NO: 731826 - RNA, 64 nt, hsa
guaacugcaccugggcagcuccucccugugcccccagccucagcccaacuucuuacccgaaagc

SEQ ID NO: 731827 - RNA, 64 nt, hsa
agcaagaguccccuuggguacaccccucugcccacagccucagcauuucuuggagcagcaaagg

SEQ ID NO: 731828 - RNA, 64 nt, hsa
cuagucuuggaccccacgagagagaaucguuccucagccucauggugaacucgcgcccuccagc

SEQ ID NO: 731829 - RNA, 64 nt, hsa
cucuucccgcacccagcaugcagcucugccuccgcagccucagugcgcuuuccugcgcgcacug

SEQ ID NO: 731830 - RNA, 64 nt, hsa
ugucguuccgguuauguuguguaagucaacucuucagccucauucacuguccuggcuuuuauuu

SEQ ID NO: 731831 - RNA, 64 nt, hsa
aaucagauauauacaaaugaaauuagaagaaacacagccucaugggacagaaauuugagggagg

SEQ ID NO: 731832 - RNA, 64 nt, hsa
ucagaagccuguguucuucaagagcagguguucucagccucacaugcccugccgugcuggacuc

SEQ ID NO: 731833 - RNA, 64 nt, hsa
cgcagcgugagggugugucuucccuggauagcagcagccucagccucugccuguccagcgccaa

SEQ ID NO: 731834 - RNA, 64 nt, hsa
uucagagaugguuugaaggcccagucuucucucccagccucaguuggagccaaagcuuuguccu

SEQ ID NO: 731835 - RNA, 64 nt, hsa
uguagcccggccagggccuggugugaggcugggccagccucagcucagccucccccugcugcuc

SEQ ID NO: 731836 - RNA, 64 nt, hsa
aagugcuggaauuacuggcgugagccaccaugcccagccucaaauauguuuuuaaaaaauauca

SEQ ID NO: 731837 - RNA, 64 nt, hsa
ucagcccagcagguaugggcaucugggaaaccuccagccucaaguguguuaguaacaugaaaaa

SEQ ID NO: 731838 - RNA, 64 nt, hsa
ccuacuccuggcaacaucaggccaacguccaccccagccucacauugccagauguuggcagaag

SEQ ID NO: 731839 - RNA, 64 nt, hsa
cuuuccgcgcccauuggugacccuuccaggcagacagccucagcaacgccccugguggacagga

SEQ ID NO: 731840 - RNA, 64 nt, hsa
cucgaacuccugggcuuaaaugacucuucugccucagccucaccaaaguguugggauuacuggu

SEQ ID NO: 731841 - RNA, 64 nt, hsa
guggaggaccugagggugcucaaagggccaggcucagccucaagcaguguuuucauugccaaca

SEQ ID NO: 731842 - RNA, 64 nt, hsa
aacucacauuguuccuccagaccgcagguucccccagccucagguugcuggagcugucacauga

SEQ ID NO: 731843 - RNA, 64 nt, hsa
cuccuugacugugucccagccagcaccaggccagcagccucaucccugccauucagggcuguuc

SEQ ID NO: 731844 - RNA, 64 nt, hsa
auggguuugaccucugcccacauggccauggagucagccucagcccugucuguacugcucgucc

SEQ ID NO: 731845 - RNA, 64 nt, hsa
caacaaagaacaaucacuaaaaccacacucaccccagccucauugugccaagccuucugugaga

SEQ ID NO: 731846 - RNA, 64 nt, hsa
ggaagggccuggcucacaugccccuccuuagaggcagccucaagaugaaccagggaaucaaacu

SEQ ID NO: 731847 - RNA, 64 nt, hsa
gaaagcaggacuggggagagauccaggacugagccagccucaggccagggcgggaaagcaggcu

SEQ ID NO: 731848 - RNA, 64 nt, hsa
gcagccugcuucccaccucccugcccaggccggccagccucacccuugcgaaccgugagcagga

SEQ ID NO: 731849 - RNA, 64 nt, hsa
ccuucaguaucaaggcugccuggagaaaggauggcagccucagggcuuccuuauguccuccacc

SEQ ID NO: 731850 - RNA, 64 nt, hsa
cagcacagugcuccuccauaucaccagucauacacagccucauuauuaaggucuuauuuaauuu

SEQ ID NO: 731851 - RNA, 64 nt, hsa
acuugcuacucucucccucuccaucccaucuuugcagccucauagggugggauacagcagcuuu

SEQ ID NO: 731852 - RNA, 64 nt, hsa; identical to SEQ ID NO: 110877

SEQ ID NO: 731853 - RNA, 64 nt, hsa; identical to SEQ ID NO: 110878

SEQ ID NO: 731854 - RNA, 64 nt, hsa
ucuaugugugugucuacgugcagcucacuaccaacagccucaugugcacuugaccugacagugc

SEQ ID NO: 731855 - RNA, 64 nt, hsa
uuagaauaaggaacaagcauuauuccuuugccaacagccucacucuaagaggcuuuuuugcuga

SEQ ID NO: 731856 - RNA, 64 nt, hsa
cucccggcagacccacccacccccuggggcugcucagccucaggcacggacagggcacaugaua

SEQ ID NO: 731857 - RNA, 64 nt, hsa; identical to SEQ ID NO: 110879

SEQ ID NO: 731858 - RNA, 64 nt, hsa; identical to SEQ ID NO: 110880

SEQ ID NO: 731859 - RNA, 64 nt, hsa
uacaagacacuacgggaacaguuugccucccucccagccucaaccacaauucuuccaugcuggg

SEQ ID NO: 731860 - RNA, 64 nt, hsa
uacugcuaugcaccacuugaaggagcucuaucaccagccucaaacccgaaagacugaggcauuu

SEQ ID NO: 731861 - RNA, 64 nt, hsa
accaggacggcagggucauccugagccgccaaggcagccucagucagagcacccugaaguuuuu

SEQ ID NO: 731862 - RNA, 64 nt, hsa
auuggaaagaaguucaguggucccauuguuaacucagccucaaaucucaacugucaggcccuac

SEQ ID NO: 731863 - RNA, 64 nt, hsa
cgcaccuggagauccugaacugucaagccacuggcagccucaugccaccacauuugccagaaau

SEQ ID NO: 731864 - RNA, 64 nt, hsa
cuggaaagugaugucagaauagcuuccaauaaagcagccucauucugaggccugagugauccac

SEQ ID NO: 731865 - RNA, 64 nt, hsa
aacgaaccuuggccugggccguaucuccggcucccagccucagcgcggcccucccgaguuaagg

SEQ ID NO: 731866 - RNA, 64 nt, hsa
cuccccagccaguccugagccucccgccaaaucccagccucacuaggugggacccccuucccag

SEQ ID NO: 731867 - RNA, 64 nt, hsa
ggcuggagugcaguggugugaucacagcucacugcagccucaaccucugaaggcccagaugauc

SEQ ID NO: 731868 - RNA, 64 nt, hsa
gccaaaaugccauuuagcaauaaauaacacuugucagccucagagcauuuaaggaaacuagaca

SEQ ID NO: 731869 - RNA, 64 nt, hsa
gcuggucucaaacuccuaggcuuaagcaguccuccagccucagccuucucaaagugcuaggaug

SEQ ID NO: 731870 - RNA, 64 nt, hsa
ggcuggagugcaguggcauaaucauaccucauugcagccucagacuccuggguucaagcaaucc

SEQ ID NO: 731871 - RNA, 64 nt, hsa
agguggagugcagugacgacaucacagcucacugcagccucaaccuggguucaagugauccucu

SEQ ID NO: 731872 - RNA, 64 nt, hsa
aucaauuuuguauaaauauauagaaacacacacacagccucagacuuacaaacugauuauacuc

SEQ ID NO: 731873 - RNA, 64 nt, hsa
augcccucuauccuaucauagauaacauucuccacagccucacuucauuccaccuauucucuga

SEQ ID NO: 731874 - RNA, 64 nt, hsa
gccuuacgcccuuccccuugaccuuguccugccccagccucacggacagccugcgcagggggcu

SEQ ID NO: 731875 - RNA, 64 nt, hsa
ggagcccaggaccccugaccccggccgcugcugccagccucagaaaggcacccaggugugcagg

SEQ ID NO: 731876 - RNA, 64 nt, hsa
caugugaauaaaauucuuauugucuaaauugagacagccucagauauuugcagauauuuacuuu

SEQ ID NO: 731877 - RNA, 64 nt, hsa
auggccccacucuguucccaagcaguucaugauacagccucaccuuuuggccccaucucugguu

SEQ ID NO: 731878 - RNA, 64 nt, hsa
uaaauaguugggacaucagcugacuaauagaccucagccucaaaaggcuuggaaagaaaaaaca

SEQ ID NO: 731879 - RNA, 64 nt, hsa
uauuccuggcucugcaaaccccagacuuugcacacagccucaggcuccacacagaaaugugaac

SEQ ID NO: 731880 - RNA, 64 nt, hsa
gcugagagacccaaggaggaaaaacagacaaaaacagccucacagaagaauaugacagcugucc

SEQ ID NO: 731881 - RNA, 64 nt, hsa
ucuucaguucugccaucuuguuuucaaagggcuccagccucacucagucccuaauuaugggacu

SEQ ID NO: 731882 - RNA, 64 nt, hsa
ggcaugcuggccucaugggcuugggggccuacagcagccucaccuucagcuucaugccucuucc

SEQ ID NO: 731883 - RNA, 64 nt, hsa
uguggcagguaugacaacucauccaguggaaacacagccucacacugcccuuccgccccccaca

SEQ ID NO: 731884 - RNA, 64 nt, hsa
ggcuagagugcaauggugcaaucacagcucacugcagccucaaccuccuggguucaagcaaucc

SEQ ID NO: 731885 - RNA, 64 nt, hsa
gugugcugagugcugaagcagugcgcaacacccucagccucaugcauuccugcggcauguauga

SEQ ID NO: 731886 - RNA, 64 nt, hsa
ccucagagcgcgcugugugugugugugugugugucagccucagagcgcgcgcugugugugugug

SEQ ID NO: 731887 - RNA, 64 nt, hsa
ccccaucaucccuuccauugccacacccuagauccagccucaggaacuaacaaguuuugagaaa

SEQ ID NO: 731888 - RNA, 64 nt, hsa
cccuucgcauccugcagaagaguccuggugguggcagccucaccgcggcacacguucuagcuca

SEQ ID NO: 731889 - RNA, 64 nt, hsa; identical to SEQ ID NO: 110881

SEQ ID NO: 731890 - RNA, 55 nt, hsa; identical to SEQ ID NO: 110882

SEQ ID NO: 731891 - RNA, 64 nt, hsa
gaccccguuccaagugcacugcccggccaagccccagccucagccugcgccugagcugcaugcg

SEQ ID NO: 731892 - RNA, 64 nt, hsa
aacugguguguauucucaugugguuugcacagcccagccucacagcacuauuguaaacccugcu

SEQ ID NO: 731893 - RNA, 64 nt, hsa
uuuuaaugaaaaaaaguaaaacuucguucuuuaucagccucaugccugaaucaaauuuuuaauu

SEQ ID NO: 731894 - RNA, 64 nt, hsa
ugcuguggagggggcugcagggcugaccagcaggcagccucaucuggucgggggcgggggcggc

SEQ ID NO: 731895 - RNA, 64 nt, hsa
cugccccgccuggagcccaggccaguguuguuuccagccucaggccacgggcuggacgggccug

SEQ ID NO: 731896 - RNA, 64 nt, hsa; identical to SEQ ID NO: 110883

SEQ ID NO: 731897 - RNA, 64 nt, hsa; identical to SEQ ID NO: 110884

SEQ ID NO: 731898 - RNA, 64 nt, hsa
aggcagacucucugucgccaggcuucuccugccucagccucacgaguagcugggacuacaggca

SEQ ID NO: 731899 - RNA, 64 nt, hsa
guuccuccccuaccagcucagccccgagcugccgcagccucaggcagaacggaggucaccuucu

SEQ ID NO: 731900 - RNA, 64 nt, hsa
cucaugagaugcuuuuucuuaaugugauuuuguucagccucacuguuuuuaccuuaauuucaac

SEQ ID NO: 731901 - RNA, 64 nt, hsa
ggaagugugggcugugcccuagccacaccacagccagccucagggagccacggcccgucuaguc

SEQ ID NO: 731902 - RNA, 64 nt, hsa
cacgugaacugucaucaccuggcaaccccagccccagccucagcccugcccccuuucccuccuu

SEQ ID NO: 731903 - RNA, 64 nt, hsa
ucucuagggccuuuuuucaauaacuugaaaaucacagccucaucauuagcaacuuuauauacac

SEQ ID NO: 731904 - RNA, 64 nt, hsa
ugcaaccuccaccuccuggguucaagcgcuucuccagccucagccuccugaguagcugggauua

SEQ ID NO: 731905 - RNA, 64 nt, hsa
caucccucaucuagucuugaccucuccagcaucccagccucagaagccuucuugcugcccacaa

SEQ ID NO: 731906 - RNA, 64 nt, hsa
acugcuaagauuaaaauccgucucccauuuguuacagccucaccugcaccaggauagaaagcac

SEQ ID NO: 731907 - RNA, 64 nt, hsa
cggguuuguccugagccugcacuguccucgccugcagccucagaggggcaggcauccccgcaca

SEQ ID NO: 731908 - RNA, 64 nt, hsa
ugaggaauuagugcuggauuugaagcuacgcacucagccucaagaacucccuggaauaucccug

SEQ ID NO: 731909 - RNA, 64 nt, hsa
guagaagccacaguacucaucugcagagggcuuacagccucagcaaggaccuuguggcuuugua

SEQ ID NO: 731910 - RNA, 64 nt, hsa
gcuucucucagccagcuguuuaagccugcggcgccagccucacggagggccgugugacacucuc

SEQ ID NO: 731911 - RNA, 64 nt, hsa
ccugauauagccaaugcuguuguagucguuuccucagccucaucucacugugcuguggucuguc

SEQ ID NO: 731912 - RNA, 62 nt, hsa; identical to SEQ ID NO: 731194

SEQ ID NO: 731913 - RNA, 64 nt, hsa
aagugcugggauuacaggcgugagacacugcgcccagccucaucccugugaauuucuuauugua

SEQ ID NO: 731914 - RNA, 64 nt, hsa
aggguggaaaugccucuucuugguuuaaugagaccagccucagcugacucacagagcugcagag

SEQ ID NO: 731915 - RNA, 64 nt, hsa
acgcggcugcuucggaagcagacaucuggggacacagccucaguacccagucuuuucccuaguu

SEQ ID NO: 731916 - RNA, 64 nt, hsa
ugggcuggcugugaggccaccuuugucccaggcccagccucaaggcaaggagggcgcuucacug

SEQ ID NO: 731917 - RNA, 64 nt, hsa
ggcuggagaacaguggcaccaucauagcucacugcagccucaaacuccugggcucaagcgaucc

SEQ ID NO: 731918 - RNA, 64 nt, hsa
uuauuuucacauugaaaaucagucagauuugcuucagccucaaagaggguguuuauguaaaacu

SEQ ID NO: 731919 - RNA, 64 nt, hsa
ccugcucauucugggcccuugcugccaaggagcccagccucaccuagcaggaaaggagaugaag

SEQ ID NO: 731920 - RNA, 64 nt, hsa
gccugccgaggaagccgagugcccgccgccgcgccagccucagcccgcgcagaaugugcucgcu

SEQ ID NO: 731921 - RNA, 64 nt, hsa; identical to SEQ ID NO: 110885

SEQ ID NO: 731922 - RNA, 64 nt, hsa; identical to SEQ ID NO: 110886

SEQ ID NO: 731923 - RNA, 64 nt, hsa
agcuauuccuaggcaaagagccucauggcuaaggcagccucaaagccagccccuccucccaccu

SEQ ID NO: 731924 - RNA, 64 nt, hsa
ugcaaccucugccucccagguucaagugcuucuccagccucagccucccaaguagcugagacua

SEQ ID NO: 731925 - RNA, 64 nt, hsa
ggggaccgggccccucucuagggaccccucgccccagccucauuccccauucugugucccaugu

SEQ ID NO: 731926 - RNA, 64 nt, hsa
uuguaaagaaaacuaaauccuucuguguccccggcagccucagugcagcaacagaagccaaggg

SEQ ID NO: 731927 - RNA, 64 nt, hsa
guggaacccauuaccuucucccucauuucaggagcagccucagaacaaagugagacaguccagc

SEQ ID NO: 731928 - RNA, 64 nt, hsa
ugggagucaggaacccagacaaggaaucccauuccagccucaccccaaccaugaccuuggcaag

SEQ ID NO: 731929 - RNA, 64 nt, hsa
ucauaucauccauuguuuuucaagcacgugacaccagccucaaaguaaaugacaugaccagugg

SEQ ID NO: 731930 - RNA, 64 nt, hsa
ucucuccacauuccaaacagaguccugguuuccucagccucacccugcauagcuugcacaacau

SEQ ID NO: 731931 - RNA, 64 nt, hsa
gcaaacacagucacuguugguuccuucugauccacagccucaucaguauuuggacuuuuuaaag

SEQ ID NO: 731932 - RNA, 64 nt, hsa
uaguuacuagaccaucuccauuuuuagcacuuggcagccucaugauccuuuuauaaaugugaga

SEQ ID NO: 731933 - RNA, 64 nt, hsa
ggccucagaaauaagccugagagaccaucuuuagcagccucagcacugccaggccugcccugaa

SEQ ID NO: 731934 - RNA, 64 nt, hsa
guagagagaccaggagccaccucaaucagcaggacagccucacugccccucuugcagagucccc

SEQ ID NO: 731935 - RNA, 64 nt, hsa
cacacgugcauagaggucugggaggaccaggaaacagccucaguggccagaggaucaccagugc

SEQ ID NO: 731936 - RNA, 64 nt, hsa
ccgguggccuuggcccagaaggagccagaggcagcagccucagccccagggacugggggcgauu

SEQ ID NO: 731937 - RNA, 64 nt, hsa
ucacaagaaagccugaugaaguccagccgugcuccagccucacuuucccugcuuggaagcgugg

SEQ ID NO: 731938 - RNA, 64 nt, hsa
cguugccacuuucaaagugguccccuggggagcucagccucauccugaugaugcugccaaggcg

SEQ ID NO: 731939 - RNA, 64 nt, hsa
ggccaagcuggcccagccuggagcuggcgcugugcagccucaccccgggcaggggcggcccucg

SEQ ID NO: 731940 - RNA, 64 nt, hsa
aggcagggucuugcucugucucccaggcucacugcagccucaacguuuugagcugaagugaucc

SEQ ID NO: 731941 - RNA, 64 nt, hsa
ugugagcaucgccaggcugcugugggggcgggagcagccucagugucaagggcccgcccacuga

SEQ ID NO: 731942 - RNA, 64 nt, hsa; identical to SEQ ID NO: 110887

SEQ ID NO: 731943 - RNA, 64 nt, hsa; identical to SEQ ID NO: 110888

SEQ ID NO: 731944 - RNA, 64 nt, hsa
uaugucccucaugucucuagauuuucucgucacccagccucaaaaauauaugugucugcaaccc

SEQ ID NO: 731945 - RNA, 64 nt, hsa
uggccucuccgggaucaguccuaggacacaggcucagccucagguugaugggggaugaugugcu

SEQ ID NO: 731946 - RNA, 64 nt, hsa; identical to SEQ ID NO: 110889

SEQ ID NO: 731947 - RNA, 64 nt, hsa; identical to SEQ ID NO: 110890

SEQ ID NO: 731948 - RNA, 64 nt, hsa
gagucacuuaggggccacuuccuaaguugcuguccagccucagugacccccuagugcuuccugg

SEQ ID NO: 731949 - RNA, 64 nt, hsa
gcagggugguccgggcacacugggccugccucuccagccucaggaugcucuuguuuauucuggg

SEQ ID NO: 731950 - RNA, 64 nt, hsa
gucuggaaugcagugguaugaucacggcucacugcagccucaaccuccugggcuaagugauccu

SEQ ID NO: 731951 - RNA, 64 nt, hsa
cacacccugccccuggugcccugagacagacacacagccucacgcccccaggaaugcaaguggu

SEQ ID NO: 731952 - RNA, 64 nt, hsa
uuugguucucauugguccagacgaggaagguauccagccucaagucaucauuguggccaggaag

SEQ ID NO: 731953 - RNA, 64 nt, hsa
gcccaggggugggcgacacaggcagcuucuucggcagccucacggcagcaaccccagccuuccc

SEQ ID NO: 731954 - RNA, 64 nt, hsa
caggcuggggugcaguggcgcgaucccagcacugcagccucaaccuccugggcucaagccaucc

SEQ ID NO: 731955 - RNA, 64 nt, hsa
cucgcgucccuguccuugaaggaccuccuucccccagccucaucaccgugcucuucucagcgcc

SEQ ID NO: 731956 - RNA, 64 nt, hsa
acugcuccccaccagcacgcugaccugugaaccccagccucaccaucacccccagcacugccag

SEQ ID NO: 731957 - RNA, 64 nt, hsa
gccuaagaccaacugcguuggacaccauaagccacagccucacaggaagugggggugaggagcc

SEQ ID NO: 731958 - RNA, 64 nt, hsa
ccucuuuuucacaugggccacaguuucaguacuucagccucagugggguuccugauguuuaucu

SEQ ID NO: 731959 - RNA, 64 nt, hsa
uugaccugaggcccuucucuccagccccuggaugcagccucacaguccuuaccagcagagcacc

SEQ ID NO: 731960 - RNA, 64 nt, hsa
ucccaauccaguggacuucgcaguccacuucugacagccucagugacccuggcuccuugugcca

SEQ ID NO: 731961 - RNA, 64 nt, hsa
ugcagagggggcugcggacacagcaggcccccuacagccucagguucugccugagcccagccua

SEQ ID NO: 731962 - RNA, 64 nt, hsa
uguaaauaugacucuuuuguaauuaacucauguacagccucauccuguauaguuuaaugaugaa

SEQ ID NO: 731963 - RNA, 64 nt, hsa
uuaccccccauagggggcagugucuuguuccugccagccucagugucuugcuucugccagcucc

SEQ ID NO: 731964 - RNA, 61 nt, hsa; identical to SEQ ID NO: 110891

SEQ ID NO: 731965 - RNA, 64 nt, hsa; identical to SEQ ID NO: 110892

SEQ ID NO: 731966 - RNA, 64 nt, hsa; identical to SEQ ID NO: 110893

SEQ ID NO: 731967 - RNA, 64 nt, hsa
agaggguugagaaggcuuugcugccaccuggugucagccucagucacuuucucugaaugcuucu

SEQ ID NO: 731968 - RNA, 64 nt, hsa
cauuacccuaguucugcccuuguuuguggaguuacagccucaagguuguagcaugugugcuggc

SEQ ID NO: 731969 - RNA, 64 nt, hsa
cuggaggacagccccccacuguucuccucaucuccagccucaguaguuggggguagaaggagcu

SEQ ID NO: 731970 - RNA, 64 nt, hsa
accucuagcagccuggacuccgcaguggcugugucagccucacccuucgugugcacccgcaugg

SEQ ID NO: 731971 - RNA, 64 nt, hsa
cgcgcgcacgcgcgagugugcuguauggcccaggcagccucaaggcccucggagcuggcugugc

SEQ ID NO: 731972 - RNA, 64 nt, hsa
agggaaggacugggagagacacaaagaccagagccagccucagggacaagagauuccaguuuua

SEQ ID NO: 731973 - RNA, 64 nt, hsa
cagcugccuccagcauccaguggcugcuggcauacagccucauccccacgucccaaccccucuc

SEQ ID NO: 731974 - RNA, 64 nt, hsa
guuaagcgaggucagacauccaccagaaucaacucagccucaggcauccaaagccacaccacag

SEQ ID NO: 731975 - RNA, 64 nt, hsa
ccgcaaccuggaguuggaggcauugcaggcuguccagccucauccccugccugauauccaguca

SEQ ID NO: 731976 - RNA, 64 nt, hsa
gccugcugcggggcuggcugcaguguaccguggacagccucagggggcugucggccaagagccu

SEQ ID NO: 731977 - RNA, 64 nt, hsa
ggaccaauggguuugccaagcccuuugcuguucgcagccucacauucccccggugccucuccca

SEQ ID NO: 731978 - RNA, 64 nt, hsa
agaguguggggugggggggaccugcuuuggagaucagccucaccuucucccaucccagaagcgg

SEQ ID NO: 731979 - RNA, 64 nt, hsa
cuggccuuuaaagaacauaagaauucccauugcccagccucagugcauuuggcaaaugcuuacu

SEQ ID NO: 731980 - RNA, 64 nt, hsa
uauaauauucagacuauucuuaaaaugggacaaucagccucaugaaaaauugauguaaaucaga

SEQ ID NO: 731981 - RNA, 64 nt, hsa
guuuauuuugccaagguuaaggaugcaccugugacagccucaggagguccugacaacaggugcc

SEQ ID NO: 731982 - RNA, 64 nt, hsa
acgggcggaucaccugaggucaggaguucgagaccagccucaacauggagaaaccccgucucua

SEQ ID NO: 731983 - RNA, 64 nt, hsa
aaaaggauggcuaaaugcuccugggagucaggcgcagccucacaccagcugccuccuccacuca

SEQ ID NO: 731984 - RNA, 64 nt, hsa
agugggcguuuucccggcaggcccccgggguccucagccucagcaacccagggagaggacagaa

SEQ ID NO: 731985 - RNA, 64 nt, hsa
gaugcccucggaucagggccgggaugggaggggucagccucagggagcagcugccuugggggac

SEQ ID NO: 731986 - RNA, 64 nt, hsa
guccacucaguaacaaguauugggacguagagcacagccucacucagcucugaaagguaauaca

SEQ ID NO: 731987 - RNA, 64 nt, hsa
ggagcaguuaugagggaggaagucaacugcuguucagccucagaauaaaggugccguucacugg

SEQ ID NO: 731988 - RNA, 64 nt, hsa
gcagaucucccaacuugaacuauaauccaccagccagccucagccuugagcuuuggaaccacau

SEQ ID NO: 731989 - RNA, 64 nt, hsa
cacagccaaguuugagcucuuaaaaguugaugaacagccucauuuccccagcuucccugauuuc

SEQ ID NO: 731990 - RNA, 64 nt, hsa
uaauuccugguaggggugugugcgugacguacugcagccucaaccuccugggcucaagugaucc

SEQ ID NO: 731991 - RNA, 64 nt, hsa
ugauagcagucagcuugaggaggaugaaggaaggcagccucagacaggaauuaaggcaaugccc

SEQ ID NO: 731992 - RNA, 64 nt, hsa
uguauuuauuuguuauuaaauugaucugacuucucagccucauuuggacuaaaaaaagaaagca

SEQ ID NO: 731993 - RNA, 64 nt, hsa
gauucccacucuguccaccaagugggggguagcacagccucacagcaaccgcccugaccuuggg

SEQ ID NO: 731994 - RNA, 64 nt, hsa
uuuauuaccuuuacuccccucccucucccaucaccagccucaaggccugaggggugcaggggcu

SEQ ID NO: 731995 - RNA, 64 nt, hsa
uggaucagcaccgauucccgaaagcuuuccaccucagccucagaguccagcugcccggacucca

SEQ ID NO: 731996 - RNA, 64 nt, hsa
ccuaauuuggcaguuuguuagguuagacaacugacagccucauuucauuccuacaaguugguuu

SEQ ID NO: 731997 - RNA, 64 nt, hsa; identical to SEQ ID NO: 110894

SEQ ID NO: 731998 - RNA, 64 nt, hsa; identical to SEQ ID NO: 110895

SEQ ID NO: 731999 - RNA, 64 nt, hsa
gaggagaugccacuucucacucaccacuaccagccagccucagaaggccccagagagacccugc

SEQ ID NO: 732000 - RNA, 64 nt, hsa
ccaccuggccauuuugacccugaguggacagucacagccucagcucaugucuggcugugacaca

SEQ ID NO: 732001 - RNA, 64 nt, hsa
gccacuggggcucagagccggggugggguggcugcagccucaggacugggagcccccagccugu

SEQ ID NO: 732002 - RNA, 64 nt, hsa; identical to SEQ ID NO: 110896

SEQ ID NO: 732003 - RNA, 64 nt, hsa; identical to SEQ ID NO: 110897

SEQ ID NO: 732004 - RNA, 64 nt, hsa
ggccagcgccagggcccaggccauguggccugcccagccucaaugucacuugguggcggggugg

SEQ ID NO: 732005 - RNA, 64 nt, hsa
cugcaccggaagacucacuuugucugcccugcgccagccucaccucacccugcaguucccguuu

SEQ ID NO: 732006 - RNA, 64 nt, hsa; identical to SEQ ID NO: 110898

SEQ ID NO: 732007 - RNA, 64 nt, hsa; identical to SEQ ID NO: 110899

SEQ ID NO: 732008 - RNA, 64 nt, hsa
uccaccuccgcccagccuguaauguuuauauaagcagccucaaggaccaagaaccaucugcgaa

SEQ ID NO: 732009 - RNA, 64 nt, hsa
ggggcugugugccggccuucuugcugcauguacucagccucaggagagcuugcugcacccaggc

SEQ ID NO: 732010 - RNA, 64 nt, hsa
ggagucaccaaggcuucagccccaagggcaucuccagccucaggccggcagguccuauguccuu

SEQ ID NO: 732011 - RNA, 64 nt, hsa
uggagugcaguggugccaucaccacggcucacugcagccucagcguccugggcucaaaugaucc

SEQ ID NO: 732012 - RNA, 64 nt, hsa
accagugcccaugucccuuccagcucaccuugagcagccucagaucaucucugucacucuggaa

SEQ ID NO: 732013 - RNA, 64 nt, hsa
gucuggauggacacaugggccaggggcucugaagcagccucacucuuaacuucguguucacacu

SEQ ID NO: 732014 - RNA, 64 nt, hsa
cgccgcugccuagcaucugcuuggccaauuaguucagccucagaccauggcacuuugagggggu

SEQ ID NO: 732015 - RNA, 64 nt, hsa
cauguaauccacagacaacucuauuuguguucuucagccucagccugaaggcuuuuuuuuggcu

SEQ ID NO: 732016 - RNA, 64 nt, hsa
agggccuggggagauggaggaaagugauaucccccagccucaagucuuauuuccucaacguugc

SEQ ID NO: 732017 - RNA, 64 nt, hsa
cuucccagcccuaaacccugccccaggaagcccacagccucaccugcugcugccccucuagguc

SEQ ID NO: 732018 - RNA, 64 nt, hsa
gcugguuucagcaugguauugaguugacacuucucagccucaauucauaacuauaugaacuuua

SEQ ID NO: 732019 - RNA, 64 nt, hsa
cuacguacaucauuauuaauauaaaaauaacaggcagccucaagaaugugcugagauuucucug

SEQ ID NO: 732020 - RNA, 64 nt, hsa
cacacacgccccucuacugcuauguggcuucaaccagccucacagccacacgggggaagcagag

SEQ ID NO: 732021 - RNA, 64 nt, hsa
gccgccccaucugccccacagucuccggccucuccagccucagcccccugcuucagucccuucc

SEQ ID NO: 732022 - RNA, 64 nt, hsa
gcacagcagccauugcacgugcaucagcucccaucagccucauuccguggcaggugaugugucc

SEQ ID NO: 732023 - RNA, 64 nt, hsa
gggaaaugccuuaauuucacucuccucccuucuccagccucaggggaggaucuggaggauccac

SEQ ID NO: 732024 - RNA, 64 nt, hsa
guagggggcuggaggagcccaggccaggacucugcagccucagagacaucagcccuuggggguc

SEQ ID NO: 732025 - RNA, 64 nt, hsa
gcauuuccuaggauaaaaauaaacaaaugacuuacagccucauccucccuaacuccauuugaac

SEQ ID NO: 732026 - RNA, 64 nt, hsa
ccgaggaccgccaccucuucccagugcuugcgaccagccucauucuauuuaacuuugcucucag

SEQ ID NO: 732027 - RNA, 64 nt, hsa
ccgugagcaccaccagggcuccaggagccucauccagccucagagaucucccuucucaucuccc

SEQ ID NO: 732028 - RNA, 64 nt, hsa
cuggccacguacagccagcgggucagcccagaggcagccucagcuccagggcuaaggacucucg

SEQ ID NO: 732029 - RNA, 64 nt, hsa
ccaugcaccaucacuguggcuggcaggcaucggacagccucauccagacccccugcccugucuu

SEQ ID NO: 732030 - RNA, 64 nt, hsa
ccagcucccucagucuggcacccacugcuacacucagccucaugagccacuucagaccagccag

SEQ ID NO: 732031 - RNA, 64 nt, hsa
gccagguaggauacguacaccucuugccucagagcagccucaucccaggcagugggucuucccu

SEQ ID NO: 732032 - RNA, 64 nt, hsa; identical to SEQ ID NO: 110900

SEQ ID NO: 732033 - RNA, 64 nt, hsa; identical to SEQ ID NO: 110901

SEQ ID NO: 732034 - RNA, 64 nt, hsa
aaugggagcgagaaaccccagcugagcugcguuccagccucagcugagucuuuuuggucugcac

SEQ ID NO: 732035 - RNA, 64 nt, hsa
cagagcccacgcccccccaagagcccucgauggacagccucacccaccccaccugggcccagcc

SEQ ID NO: 732036 - RNA, 64 nt, hsa
gcgcccaggcuggaggcccugccucgcugcuugccagccucaccugcuggggcuggaggccaug

SEQ ID NO: 732037 - RNA, 64 nt, hsa
ggccacacagaggaggaagacagcagccuggcagcagccucaccgaagagaggaaccaccacac

SEQ ID NO: 732038 - RNA, 64 nt, hsa
gauacuuucugcgugguggaaaccauugcauauucagccucauuucaagaguguuuccuucuca

SEQ ID NO: 732039 - RNA, 64 nt, hsa
agacugaagcaggaaggcagagcaucaucuuguucagccucagcugggaacauguguacugggu

SEQ ID NO: 732040 - RNA, 64 nt, hsa
ucacuuucacccuaaacgacacuuccuccccagccagccucacucugucuccggcccgcagcag

SEQ ID NO: 732041 - RNA, 64 nt, hsa
cugaaaugauggggaaaggaguccuuaguccuuucagccucagaggucacaguggguggcaggu

SEQ ID NO: 732042 - RNA, 64 nt, hsa
ggcagccuggcuguggaguuuccacggcgacacacagccucaguggugcaagauuuaaaauuac

SEQ ID NO: 732043 - RNA, 64 nt, hsa
gggcuauuuuugugacccacauagguggcccauucagccucaaggggaaauccaggguaggaag

SEQ ID NO: 732044 - RNA, 64 nt, hsa; identical to SEQ ID NO: 110902

SEQ ID NO: 732045 - RNA, 64 nt, hsa; identical to SEQ ID NO: 110903

SEQ ID NO: 732046 - RNA, 64 nt, hsa
ucagaaucgccuaccugugccugcguguaaaccacagccucagaccagcuauggggagaggaca

SEQ ID NO: 732047 - RNA, 64 nt, hsa
cggccccucccggcgccugcccacccuccacccacagccucacggguccaggacuuggcguguu

SEQ ID NO: 732048 - RNA, 64 nt, hsa
cugcaccuccaccuuccgggcucaagcgauucuccagccucagccuccugaguagcuaggacug

SEQ ID NO: 732049 - RNA, 64 nt, hsa
acaauguugggcaacaacucagccagccugauggcagccucagaggcuuacucuaacccauccc

SEQ ID NO: 732050 - RNA, 64 nt, hsa
ccugccccuguucuucacacugccccccaugccucagccucauacagaugugccaucauggggg

SEQ ID NO: 732051 - RNA, 64 nt, hsa
uaucaauguaagcaaugugggaaagccgucagaucagccucaagacuucaaaugcauggaagca

SEQ ID NO: 732052 - RNA, 64 nt, hsa
cccaccaggggaggugggguuuggugagagacgccagccucagacuuuuucccacugagggucc

SEQ ID NO: 732053 - RNA, 64 nt, hsa
cugggcugcuggagaagucuccucccguucggaccagccucagggcugcacguuaccucaggaa

SEQ ID NO: 732054 - RNA, 64 nt, hsa
agcagccgcagccaaacccggcugccucccaccccagccucaaaaccucuuccugacgaccccc

SEQ ID NO: 732055 - RNA, 64 nt, hsa
agacucccugcuucccuggaagcuucaggaagcucagccucagccuucaggccugagcaagugc

SEQ ID NO: 732056 - RNA, 64 nt, hsa
guggguggaucaccugaggucaggaguucaagaccagccucaacauggagaaaccccaucucua

SEQ ID NO: 732057 - RNA, 64 nt, hsa
acuuggaaguggugggugcccaggacggugccuccagccucaacagugggcauggacaggguua

SEQ ID NO: 732058 - RNA, 64 nt, hsa
cuuccccuucccaguccauaaaaaccccggaccccagccucauacugggcaacuuauuuggauc

SEQ ID NO: 732059 - RNA, 64 nt, hsa
ccccaccaugcgggccucagguggcagagaggcccagccucacaggccuguggccccacacacc

SEQ ID NO: 732060 - RNA, 64 nt, hsa
uccccuucccuaaucaccucuccugccccuagcucagccucauccccaacuccaugccugucuc

SEQ ID NO: 732061 - RNA, 54 nt, hsa; identical to SEQ ID NO: 730625

SEQ ID NO: 732062 - RNA, 64 nt, hsa
gggacaaggcuucucuguccgcccuucacaccuccagccucacguucacuuaggcacaucacac

SEQ ID NO: 732063 - RNA, 64 nt, hsa
gcugaccccacuccaggaccuaggcccagccccucagccucaucuggagccccugaagaccagu

SEQ ID NO: 732064 - RNA, 64 nt, hsa
accacgaugagcugugagcaccgcgcaccugccacagccucagaggcccgcacaaugaccggag

SEQ ID NO: 732065 - RNA, 64 nt, hsa
aagugcugggauuacaggcaugaaccauggugcccagccucauuuuugaaauggaauagagaac

SEQ ID NO: 732066 - RNA, 64 nt, hsa
ccccggccauuugcugcccuccccaccccugccccagccucaggacugcaggagccauccgccc

SEQ ID NO: 732067 - RNA, 64 nt, hsa
gcagugaaugugggaaagucuuuagauacaacuccagccucauuaaacaucggagaauucacac

SEQ ID NO: 732068 - RNA, 64 nt, hsa
guggcagcggcgcccagcucccugguggccgcggcagccucaguggcagcagcugccgguggug

SEQ ID NO: 732069 - RNA, 64 nt, hsa
cccgccccauucaccuguggauuugugcgagaugcagccucagaaggaacaaggcccccagagg

SEQ ID NO: 732070 - RNA, 64 nt, hsa; identical to SEQ ID NO: 110904

SEQ ID NO: 732071 - RNA, 64 nt, hsa; identical to SEQ ID NO: 110905

SEQ ID NO: 732072 - RNA, 64 nt, hsa; identical to SEQ ID NO: 110906

SEQ ID NO: 732073 - RNA, 64 nt, hsa
aggauggucuugaucuccugaccuugugauccaccagccucagccucccaaagugcugggauua

SEQ ID NO: 732074 - RNA, 64 nt, hsa
aggccuuugggguauuccccuagugugcccaagucagccucauauucugggcggacagcuuguc

SEQ ID NO: 732075 - RNA, 64 nt, hsa
ucucccccagcccucccuccuggcgggucuccuccagccucacuucgcugccacuucgccgcug

SEQ ID NO: 732076 - RNA, 64 nt, hsa
ggucaggcggaugaggucccuacucccgagcccccagccucacccacugcagggccaggcucuc

SEQ ID NO: 732077 - RNA, 64 nt, hsa
cucugccucccggguucaagugauucuccugccucagccucacgaguagcuggaauuacaggca

SEQ ID NO: 732078 - RNA, 64 nt, hsa
aaccuuacuuccagcuugcacaucagaauuuuuccagccucauuugucaguuucaaaucugcuu

SEQ ID NO: 732079 - RNA, 64 nt, hsa
ucccugcuccaggaugaaaccaagagggggaugucagccucacccacaccgugugccuuacucc

SEQ ID NO: 732080 - RNA, 64 nt, hsa
gacccacuccacacacucccugccagcuuuguugcagccucagcugguggugucuccguccuua

SEQ ID NO: 732081 - RNA, 64 nt, hsa
ccucaaagcuucuguggcuucguggucacugcuccagccucagccagggcagggagggggacuc

SEQ ID NO: 732082 - RNA, 64 nt, hsa
agugguacuuucucuuccugguaauccucuggcccagccucauggcagaauagagguauuuuua

SEQ ID NO: 732083 - RNA, 64 nt, hsa
caugaaaccaaaaagagacugaucauccaggccucagccucauccuccccaggaccccugucca

SEQ ID NO: 732084 - RNA, 64 nt, hsa
ugacccucugucccuacugauuccuccuugggugcagccucagaguggccugaggcccagaggg

SEQ ID NO: 732085 - RNA, 64 nt, hsa
acaccgcgccgcggaagggggcuccgagggggcgcagccucaaacccugccuuuccuuuacuuu

SEQ ID NO: 732086 - RNA, 64 nt, hsa
cacccccggcucagaucuuugcaaaucaguacgacagccucagagcagagcaaggguuguuugg

SEQ ID NO: 732087 - RNA, 64 nt, hsa
ugcaccccccucauuaucuaccaugacugucucucagccucacgggcccucagcacuuuguguu

SEQ ID NO: 732088 - RNA, 64 nt, hsa
gagucccuguccccaccuccagucccucccucaccagccucaccccuguggugggcuuuuuaag

SEQ ID NO: 732089 - RNA, 64 nt, hsa
ggcuggagugcaguggcaugaucauaacucacugcagccucaaacuucuggccucaagugaucc

SEQ ID NO: 732090 - RNA, 64 nt, hsa
ccucuccacagacccagccuccggcugugacccccagccucacaccugccucugguucccgccu

SEQ ID NO: 732091 - RNA, 64 nt, hsa
auaaaacgaucuaaagguaggcagacccuggacccagccucagauccaggcaggagcacgaggu

SEQ ID NO: 732092 - RNA, 64 nt, hsa
uuaggaggguauucugggccuucugcccaggcagcagccucauggguguggcuucuguggcuuu

SEQ ID NO: 732093 - RNA, 64 nt, hsa
gaagggcacgggguaggggguucucguagggucccagccucaaugguucccgcccuggaccucc

SEQ ID NO: 732094 - RNA, 64 nt, hsa
uacuacugaagugacuuaugguugcuccccuagacagccucagaauggggcuguucucuaggaa

SEQ ID NO: 732095 - RNA, 64 nt, hsa
cucgugugucuguaaaaugugugaaaccaaacugcagccucaacaccauggacacacgucauca

SEQ ID NO: 732096 - RNA, 64 nt, hsa
gagcagggauccaagaaugugccaagagucccgccagccucagccaggugggccuguauauagg

SEQ ID NO: 732097 - RNA, 64 nt, hsa
accucagauuugaccaggccucuggcugccugggcagccucauugccaaugggcugaaagguuc

SEQ ID NO: 732098 - RNA, 64 nt, hsa
uuccaaacgcagugcccuguucugccgguguguacagccucagcgcaccaggagacccuagagu

SEQ ID NO: 732099 - RNA, 64 nt, hsa
augcuccuuguccccucccacccgccucaugacccagccucacagacccucucaggccucugac

SEQ ID NO: 732100 - RNA, 64 nt, hsa
ccaguauguuucuuucugccccguugaagaggugcagccucaggcugagaaacacugauagacc

SEQ ID NO: 732101 - RNA, 64 nt, hsa
cccucacugccccacauucucccaguggcucuaccagccucacccaucaaaccagugaauuucu

SEQ ID NO: 732102 - RNA, 64 nt, hsa
cagcugagucucuaucauagcugaacccugaggacagccucauagcucauguaucagggacuuu

SEQ ID NO: 732103 - RNA, 64 nt, hsa
ugugacugccaggcagaaaggacagggcccaggucagccucagucugcugugccuccagacugc

SEQ ID NO: 732104 - RNA, 64 nt, hsa
guuuuucccuuuguucuugaacacuuuugcccugcagccucaguuuugaauucuuuuagcaacu

SEQ ID NO: 732105 - RNA, 64 nt, hsa
aagggcuggggccggggcugagggugcccuuuuccagccucagccuacuccgcucacugaacuc

SEQ ID NO: 732106 - RNA, 64 nt, hsa
gugaucaaguugaggggcuuccggcucccuucuacagccucagaaaccagacucguucuucugg

SEQ ID NO: 732107 - RNA, 64 nt, hsa
aaaagagaaucguacgucgacuuucgauuuuucacagccucagccuaggaaaaaugguucaugg

SEQ ID NO: 732108 - RNA, 64 nt, hsa; identical to SEQ ID NO: 110907

SEQ ID NO: 732109 - RNA, 64 nt, hsa; identical to SEQ ID NO: 110908

SEQ ID NO: 732110 - RNA, 64 nt, hsa
ugguugcuucacccgcugcagagcacacgcaacccagccucagcaucacagccgcagcucuguu

SEQ ID NO: 732111 - RNA, 64 nt, hsa
uuuaguuccucaucacaaaagaacaaagauaaaccagccucaaucccggcugcugcauuuaggu

SEQ ID NO: 732112 - RNA, 64 nt, hsa
uagcaauaaucaacauuuaccagacauccaaugacagccucaggggaaagcacccuugucuggg

SEQ ID NO: 732113 - RNA, 64 nt, hsa
gcccggucaccucggccgggcccggggcugaggucagccucacugccugcuuauugccucuuuc

SEQ ID NO: 732114 - RNA, 53 nt, hsa; identical to SEQ ID NO: 730678

SEQ ID NO: 732115 - RNA, 64 nt, hsa
ugggccuugucuuccaguuccuuucucccauucccagccucauuucuuaaaugacuaggaauuu

SEQ ID NO: 732116 - RNA, 64 nt, hsa
ccauugccaccagcaugcgggauucccucauugacagccucaccugagucaccuuccaaguugu

SEQ ID NO: 732117 - RNA, 64 nt, hsa
uguagggguagcccuguccagguaaaguuguuuucagccucaugucuacuguuaggugagggag

SEQ ID NO: 732118 - RNA, 64 nt, hsa
uucaccugggugucugggcucaagcuuucccgcccagccucacuuccuuugcccuuccuccugc

SEQ ID NO: 732119 - RNA, 64 nt, hsa; identical to SEQ ID NO: 110909

SEQ ID NO: 732120 - RNA, 64 nt, hsa; identical to SEQ ID NO: 110910

SEQ ID NO: 732121 - RNA, 64 nt, hsa
ugaucucuagccagugcuuaggcccaauaucugacagccucaggugggcugggaccuaggaagc

SEQ ID NO: 732122 - RNA, 64 nt, hsa
cuauucuagagaacuaaacuggcuuaacgagucacagccucagcugugcugggacgacccuugu

SEQ ID NO: 732123 - RNA, 64 nt, hsa
gcaaaaguaccaggagcuagcuuuuaaccuugcccagccucaguuucuuuucuuagaagaagcu

SEQ ID NO: 732124 - RNA, 54 nt, hsa; identical to SEQ ID NO: 730688

SEQ ID NO: 732125 - RNA, 64 nt, hsa
cccuccguccuggcagggcaggcagagcucagcacagccucaccccugcaggcgguauccagag

SEQ ID NO: 732126 - RNA, 64 nt, hsa
gucuacugauucaaaugcuaaucucuuccagaaacagccucacagacacacccagacaucuggu

SEQ ID NO: 732127 - RNA, 64 nt, hsa
caaacucuagaugacaagagcaccucaaaggcagcagccucaaggagcagccauggccccagac

SEQ ID NO: 732128 - RNA, 64 nt, hsa
ggcuggagugcaguggcacaaucacaguucacugcagccucaaccucuccagauucaagugauc

SEQ ID NO: 732129 - RNA, 64 nt, hsa
uaucuuccccuaaaagaggccgugauauuugcagcagccucaaauugcucuuaagggguuuagg

SEQ ID NO: 732130 - RNA, 64 nt, hsa
gcuccccacucugcccguccaccuucccuggcuccagccucauucucucuuuaguuuaacuaug

SEQ ID NO: 732131 - RNA, 64 nt, hsa
ccucccugccaguccuuggaccucccagcccacccagccucagcacagcucaacacagaaggag

SEQ ID NO: 732132 - RNA, 64 nt, hsa
aauucuguuaacugaagauauuccaacucaaaaccagccucaugcucugauuagauaaucuuuu

SEQ ID NO: 732133 - RNA, 64 nt, hsa
aggcugagugcacuggcaggaucacagcucacggcagccucaaccucccuggcucaagcgaucc

SEQ ID NO: 732134 - RNA, 64 nt, hsa
gaccaccuccccauacagagagaggcuucccucccagccucaguuuacccguaaaugcacuagc

SEQ ID NO: 732135 - RNA, 64 nt, hsa
ccucccugccaguccuuggaccucccagcccacccagccucagcacagcucagcacagaaggag

SEQ ID NO: 732136 - RNA, 64 nt, hsa
ucagccgccuagccaagacugcagggauggcccgcagccucaucggggccaaggacacacgccu

SEQ ID NO: 732137 - RNA, 64 nt, hsa
ggcccaccucucgccccucaucuugguaauuagccagccucagauacuucugugggcccugaag

SEQ ID NO: 732138 - RNA, 64 nt, hsa
gcuccuugcagugaagccaccaugggugaccguccagccucacccgguggccugcacagugagg

SEQ ID NO: 732139 - RNA, 64 nt, hsa
gggaggccucccggaacaaaagcggaagaggggccagccucaucccacugccagcugacccuca

SEQ ID NO: 732140 - RNA, 64 nt, hsa
ucuuauuuuuguuggagccacucuguuccuggcucagccucaaaugcaguauuuuuguuguguu

SEQ ID NO: 732141 - RNA, 64 nt, hsa
gguuucaucuccucugugggaggacacaucucugcagccucaagaguuaggcagagacucaagu

SEQ ID NO: 732142 - RNA, 64 nt, hsa
cccacuccaugccacccccaccagcuggaggacccagccucacaguguguccuuugugccagac

SEQ ID NO: 732143 - RNA, 64 nt, hsa
ggcuucaaguuaacaggaucagacaccagucaagcagccucaggucaucuugcgacuccacuga

SEQ ID NO: 732144 - RNA, 64 nt, hsa
ucugccucaaaaauucaccaagcagaaugccucucagccucauguguugguccucugcuccucc

SEQ ID NO: 732145 - RNA, 64 nt, hsa
cccggggcccgcagaggugcccuuacugaggugacagccucacagggucugguaccagggguug

SEQ ID NO: 732146 - RNA, 64 nt, hsa; identical to SEQ ID NO: 110911

SEQ ID NO: 732147 - RNA, 64 nt, hsa; identical to SEQ ID NO: 110912

SEQ ID NO: 732148 - RNA, 64 nt, hsa
ggcuuggggcugcugggguuggaauguggaacugcagccucagcccaucuggcagagucccagg

SEQ ID NO: 732149 - RNA, 64 nt, hsa
ugcgccugcagggggcgcugcaucccgcgcgcugcagccucaugugacccgaucggacagugcc

SEQ ID NO: 732150 - RNA, 64 nt, hsa
gcuacgccccauggaggcuccgagaccaucugcccagccucacugaggcucaggacacggccac

SEQ ID NO: 732151 - RNA, 64 nt, hsa
cacuaggggccccaaguucaacucaaccccucaacagccucagcuuugcagccccugagaaggc

SEQ ID NO: 732152 - RNA, 64 nt, hsa
cuuucuguuucagcaaaucucagucccugacuaacagccucagcacauccgacaccucccagcg

SEQ ID NO: 732153 - RNA, 64 nt, hsa; identical to SEQ ID NO: 110913

SEQ ID NO: 732154 - RNA, 64 nt, hsa; identical to SEQ ID NO: 110914

SEQ ID NO: 732155 - RNA, 64 nt, hsa
gacagacaccagaccagguccagggccuccuccacagccucagcuggggcucucagcaccaaag

SEQ ID NO: 732156 - RNA, 64 nt, hsa; identical to SEQ ID NO: 110915

SEQ ID NO: 732157 - RNA, 64 nt, hsa; identical to SEQ ID NO: 110916

SEQ ID NO: 732158 - RNA, 64 nt, hsa
aggcagggccugagggagccccuggcuuuccccucagccucaggaaagguggucaggaaaacuc

SEQ ID NO: 732159 - RNA, 64 nt, hsa
ggcuggagugcagugacguggucauagcucacugcagccucaaccuccugggcucaagugaccc

SEQ ID NO: 732160 - RNA, 64 nt, hsa
ccuggugaguuggggggcagggguugucuugggccagccucaguuuuugucaggccaugaaucc

SEQ ID NO: 732161 - RNA, 64 nt, hsa
aagugcugggauuauaggcgugagccacugugcccagccucacagcugcaucuuaaccuuaccu

SEQ ID NO: 732162 - RNA, 64 nt, hsa
guuucuaccucccagaucggaucuguugcaaacucagccucaauaagccuugucguugacuuua

SEQ ID NO: 732163 - RNA, 64 nt, hsa
uugaagaaaggagggacccggaacuugggccaaucagccucaccuugucccaguccacuccuaa

SEQ ID NO: 732164 - RNA, 64 nt, hsa
ugcaaccuccaccucccggauucaagugauucuccagccucagccuccugaguagcugggauua

SEQ ID NO: 732165 - RNA, 64 nt, hsa
uuggaguuguggguccugcccagaguccagagagcagccucagcugagcacagguccgaggggg

SEQ ID NO: 732166 - RNA, 64 nt, hsa
auauugucaaccuucuacacagccaaugacuuaacagccucauuagaaguuacagaaacuaaag

SEQ ID NO: 732167 - RNA, 64 nt, hsa
ggacaugagaucagggccugcccccuggggaucacagccucaccccugccccugugggacucau

SEQ ID NO: 732168 - RNA, 64 nt, hsa
accaccuggggacucacguagcuggagagcauuacagccucauccacuuaccuggagcugcucu

SEQ ID NO: 732169 - RNA, 64 nt, hsa
uggaggacccuggaaggacagcaaggcagcuccccagccucacucuucacuccugauugaggcc

SEQ ID NO: 732170 - RNA, 64 nt, hsa
ugcugaaggauuuagacggggaugaagugcccuccagccucagagcuagccacaaagcccccag

SEQ ID NO: 732171 - RNA, 64 nt, hsa
ugccuuuguagugcuuucggcccaguucuggccucagccucaaagugcaccgacuaguugcuug

SEQ ID NO: 732172 - RNA, 64 nt, hsa
uccgagccaggucaggcuucggaggccacaagcucagccucaggcccaggcacugauuguggca

SEQ ID NO: 732173 - RNA, 64 nt, hsa
ccacgugagagaaucugccuguggccuugcccgccagccucagugccacuugacauuccuuguc

SEQ ID NO: 732174 - RNA, 64 nt, hsa
gcuucuuaccaauuuccccaacuauguugcacaucagccucauuuucccccuuuauuggaaugc

SEQ ID NO: 732175 - RNA, 63 nt, hsa
gucagaggucaaaauuuaugaaaaacaaaaugcuguaugaauggaaaucauuuugcaauugag

SEQ ID NO: 732176 - RNA, 63 nt, hsa
acaacacccugaccucuuucucuccuccuugauuguaugaauaacccugagaucaccucuuag

SEQ ID NO: 732177 - RNA, 63 nt, hsa
ugugugcauguguguguguguucaugugugcccuguaugaauguggcuggcucccauaucccc

SEQ ID NO: 732178 - RNA, 63 nt, hsa
uuuggaaaugcccauugccgacuugaauuuuuuuguaugaagucccuccugauuuugugugug

SEQ ID NO: 732179 - RNA, 63 nt, hsa
ucuugauucuuggucuauaauugcagauguuauuguaugaauguaccauaauauauuugagca

SEQ ID NO: 732180 - RNA, 63 nt, hsa
ccuguaacaaaucucauuuuuguuaccaagaacuguaugaaagaaguaaauccaccccgauuc

SEQ ID NO: 732181 - RNA, 63 nt, hsa
uguauaaacacuaacauuuuccccuucuguaguuguaugaaaaaacaaauauuguuagcauag

SEQ ID NO: 732182 - RNA, 63 nt, hsa
uauuuugcauuuguuuuuucaauguguuuacauuguaugaauugagcuuuuugcccacagauu

SEQ ID NO: 732183 - RNA, 63 nt, hsa
cuaggcccgaaaugacuagcaaauaucauuuucuguaugaauuguggaacaucacaauaaaau

SEQ ID NO: 732184 - RNA, 63 nt, hsa
gauuuucacugggguuugagucacagcaagcuguguaugaacuuguguuuuguggugacacau

SEQ ID NO: 732185 - RNA, 63 nt, hsa
uucaccuauauuuuguguacuuuguuacuugcauguaugaauuuuguuauguaaaauauaguu

SEQ ID NO: 732186 - RNA, 63 nt, hsa
caauuuuauuuuuuucugcaagaaaaaguguaauguaugaaauaaaccaaagucacuuguuug

SEQ ID NO: 732187 - RNA, 63 nt, hsa
uucagauagguucagcccacccacccccaugauuguaugaaguuuuaaaaaaaacuacagcag

SEQ ID NO: 732188 - RNA, 63 nt, hsa
auuuugacaugauuccuuuuuccuuuuaaacaauguaugaaagauguauuuuaaaucuaaaua

SEQ ID NO: 732189 - RNA, 63 nt, hsa
guugagucuuccuugcccccacucagucaucuuuguaugaaucccaugauuuggggguuuuuu

SEQ ID NO: 732190 - RNA, 63 nt, hsa
aaaacaacugcagaggcuggaacugccacaggcuguaugaaaggccacuuuggaaaggguuug

SEQ ID NO: 732191 - RNA, 63 nt, hsa
uuaacaguucaaucucaauaagaccucgcauuauguaugaauguuauucacugacuagauuua

SEQ ID NO: 732192 - RNA, 63 nt, hsa
cuuucuagagugaugagagucaagaagaggggauguaugaacggccaaauucccaugugagag

SEQ ID NO: 732193 - RNA, 63 nt, hsa
ccaguguccugccaggcucuguacuguccuuuguguaugaagaaaaugcuguuagcccucucu

SEQ ID NO: 732194 - RNA, 63 nt, hsa
guagguagcauccuuugaugcuucuuugaaacuuguaugaauuuggguaugaacagauugccu

SEQ ID NO: 732195 - RNA, 63 nt, hsa
ucaugaguagaaauuucaacaacucuuuuugaauguaugaagaguagcaguccccuuuggaug

SEQ ID NO: 732196 - RNA, 63 nt, hsa
guuuucagugaucagaagcagcaguuauuugaguguaugaauggaaugaugaucacugugcua

SEQ ID NO: 732197 - RNA, 63 nt, hsa
gguugugccggugccaugcuccucccugugucuuguaugaaaggggccacugugugucuuccu

SEQ ID NO: 732198 - RNA, 63 nt, hsa
uguccugugcuuggauagucagucaauuauuuguguaugaaacaauguacaaaucaauguuuu

SEQ ID NO: 732199 - RNA, 63 nt, hsa
cagaugugggagcgacaucaaugaaaucuguacuguaugaaagcuacacaaaaaugggcagac

SEQ ID NO: 732200 - RNA, 63 nt, hsa
aaguaaaagcuaucaucagcaucaucuuagacuuguaugaaauaaccacuccguuucuauucu

SEQ ID NO: 732201 - RNA, 63 nt, hsa
ugucauuauauauuuuuaaaaauguguuucucuuguaugaauuggaaauaaguauaaggaaac

SEQ ID NO: 732202 - RNA, 63 nt, hsa
cucuugauuugucuggguuaaaaccauuccuuuuguaugaaauguuuugacuuaggaaucauu

SEQ ID NO: 732203 - RNA, 63 nt, hsa
uguuaaaagaaaucucuacauaaaucguauuuguguaugaaaaccuucuauuuugggcuaguu

SEQ ID NO: 732204 - RNA, 63 nt, hsa
aauauuuuccauuuccguuauuaugcuaauuguuguaugaaauaagugcaauuauacuucucu

SEQ ID NO: 732205 - RNA, 63 nt, hsa
auaucuauuugagagcagaugccauuuuguacauguaugaaauugguuuuccagaggccuguu

SEQ ID NO: 732206 - RNA, 63 nt, hsa
gaaaaagggggcaauaaaaggguauguaaaauauguaugaagaaaagguguacaaaaauuugc

SEQ ID NO: 732207 - RNA, 63 nt, hsa
uauaucuucagcuuuggguaggaggaaucuugguguaugaaaucauugcaaauuuacuucauc

SEQ ID NO: 732208 - RNA, 63 nt, hsa
cuuggggaaagugcaaaggacaaacaucucaauuguaugaagggagaaaggagaauugaaaga

SEQ ID NO: 732209 - RNA, 63 nt, hsa
caacaguauugaaauguaauauguauguguucauguaugaaaauuuuuacuccacacaggugu

SEQ ID NO: 732210 - RNA, 63 nt, hsa
acugcuuuuuuugguuacaguguaugauggauguguaugaaaaaaauguaucuuugggaaaac

SEQ ID NO: 732211 - RNA, 63 nt, hsa
cuacgcugauuugaucuuuacaaauuauaugaguguaugaauuugucacauguaucaccccca

SEQ ID NO: 732212 - RNA, 63 nt, hsa
acucuccauaccccguguacucaaauucucuacuguaugaauuaugcuuuaaguagaauucag

SEQ ID NO: 732213 - RNA, 63 nt, hsa
aaagcagacauuuuccucacacccaccugcugcuguaugaauagcuguguaucuguuuuucca

SEQ ID NO: 732214 - RNA, 63 nt, hsa
caaugcuugguuuggggaguguguggggugggcuguaugaaguagcauuuugggggugggugg

SEQ ID NO: 732215 - RNA, 63 nt, hsa
ucuacuugcuggaaaaucauuguaagucuguuguguaugaaauuuuaggaaaagucuuauaua

SEQ ID NO: 732216 - RNA, 63 nt, hsa
gacaagaugacucaaaggagacuucaagaacaguguaugaaacacuggaagaggucaccuagg

SEQ ID NO: 732217 - RNA, 63 nt, hsa
auucugugccauuuacaguuucuaauacuauacuguaugaaauauguauaaauauaugaugcu

SEQ ID NO: 732218 - RNA, 63 nt, hsa
aacauuuggccuuuuacuauguuauuuuuauuuuguaugaauacauuauccuccuuauuuauu

SEQ ID NO: 732219 - RNA, 63 nt, hsa
agacuacagcaugacguaguauuaugauugcauuguaugaaagagcaagugacuuucuaagua

SEQ ID NO: 732220 - RNA, 63 nt, hsa
cagucaaauuggcaccuacuggcucugacuuuuuguaugaagcaugccucaguuuccucauuu

SEQ ID NO: 732221 - RNA, 63 nt, hsa
gaugcugucaaugcccgagugacacaugagagcuguaugaauugagagaaaaggcaacaagua

SEQ ID NO: 732222 - RNA, 63 nt, hsa
aggucauuuaggaaaaaacuucuguccaagcuuuguaugaauuaaauucauaaguauaccaaa

SEQ ID NO: 732223 - RNA, 56 nt, hsa
ugaucagccagccuaacugaagaugauguaugaaggaguuggaguuguugaaacca

SEQ ID NO: 732224 - RNA, 63 nt, hsa
auuacaguuaagaaggagaaacuucuauaagacuguaugaacaaggugauaucuucauagugg

SEQ ID NO: 732225 - RNA, 63 nt, hsa
ccgguuugccccgggauauuauagaaaauuauuuguaugaauaaugaaaauaaaacacaccuc

SEQ ID NO: 732226 - RNA, 63 nt, hsa
ccgauugcaggacacaagcacaguuuuaagaguuguaugaacauggagaggacuuuugguuuu

SEQ ID NO: 732227 - RNA, 63 nt, hsa
cuggagaggaaaugacugcugaaauaaggcgauuguaugaauauuuaaaaugccuggaacacu

SEQ ID NO: 732228 - RNA, 63 nt, hsa
agguagaccuaaauucaauaugacugguuuccuuguaugaaaaggagaggacacagagacaga

SEQ ID NO: 732229 - RNA, 63 nt, hsa
uugacauuguagagcuucuggcacuuggagacuuguaugaaagauggcugugccucugccugu

SEQ ID NO: 732230 - RNA, 63 nt, hsa
aguaaguaacugagagcauaaaauaaaccugacuguaugaagucaauuuaagugaugagaaca

SEQ ID NO: 732231 - RNA, 63 nt, hsa
ggugaagggauguuguuucuuaaauaccuaccauguaugaagcuauacacagcauauaccgaa

SEQ ID NO: 732232 - RNA, 63 nt, hsa
ucaacguuuguuccuguguguacaauuguacuuuguaugaacagcuuuaucauuuuuauaggc

SEQ ID NO: 732233 - RNA, 63 nt, hsa
uauuauucaaaaaaauguacuggugugauaucuuguaugaaugaucauuuaaauacaguacau

SEQ ID NO: 732234 - RNA, 63 nt, hsa
auauuauagugcauuuuagccuaauucauuaucuguaugaaguuauaaaaguagcuguagaug

SEQ ID NO: 732235 - RNA, 63 nt, hsa
cuucccuucuucccuauugaaccuugauuaaaauguaugaauacaauacuuggauuuuuuuuu

SEQ ID NO: 732236 - RNA, 63 nt, hsa
cacuuacauccaaggcacugucacuacggugauuguaugaaguuugaaugcugcaaguuauga

SEQ ID NO: 732237 - RNA, 63 nt, hsa
cucguuuaagaggcagcuagaaucuuuaccauauguaugaauuuguauaauuucauuuuugga

SEQ ID NO: 732238 - RNA, 63 nt, hsa
cugaaagagauugcuaauaaaaucaaauaaaacuguaugaacucuaauggagaaaaaucuaau

SEQ ID NO: 732239 - RNA, 63 nt, hsa
ugucagcgggugacguguguucuuuugaguccuuguaugaauaaaaggcuggaaaccuacagc

SEQ ID NO: 732240 - RNA, 63 nt, hsa
gaauuuaauuuuuaaaagacuuugauguguuuuuguaugaaguacuuuuaacguauguauuuc

SEQ ID NO: 732241 - RNA, 63 nt, hsa
aaagaauaaaauauuuuggacaaugccgauaaauguaugaaguuaguauccacaucauaaauu

SEQ ID NO: 732242 - RNA, 63 nt, hsa
acugugaaauaauaaggccgauuuucauauaaauguaugaaaaucaaccauguuuucucucac

SEQ ID NO: 732243 - RNA, 63 nt, hsa
uguauauguaauaagguuuauuucugugaguuuuguaugaaaaucagccucauuauuuauagu

SEQ ID NO: 732244 - RNA, 63 nt, hsa
ucuguauuaaugcuugaauauuacuggauaaauuguaugaagaucuucugcagaaucagcaug

SEQ ID NO: 732245 - RNA, 63 nt, hsa
uaaauuagaaaaugaaaaaugugugaauaacauuguaugaaauaaaccuggucuuguguuuuu

SEQ ID NO: 732246 - RNA, 63 nt, hsa
ucauagacauuuuacugagaaaugaccugcauuuguaugaagugaacugagcgucacacccug

SEQ ID NO: 732247 - RNA, 63 nt, hsa
uggaggcagggcaaacguuuauaagggcuguuauguaugaaaugugccucugacccaaaucca

SEQ ID NO: 732248 - RNA, 63 nt, hsa
ccuuugucacaguguugucgugaagaucagauauguaugaaugcagucaaauaaacuaaaaac

SEQ ID NO: 732249 - RNA, 63 nt, hsa
gccuucauucuguugcaauuaaguuuuaguacuuguaugaaaggugugaauuagaaagucaca

SEQ ID NO: 732250 - RNA, 63 nt, hsa
aauuacaguguaguguuuauucuaaggaagauauguaugaauguauauacaaagacucagcua

SEQ ID NO: 732251 - RNA, 63 nt, hsa
gucauguugugggaucuuuagaaaacuucauacuguaugaauaagaaaauaaaauauuugaaa

SEQ ID NO: 732252 - RNA, 63 nt, hsa
auguguuuacguaucugacaaguuguacauuuguguaugaacugacauaaaaugugaaagccu

SEQ ID NO: 732253 - RNA, 63 nt, hsa
uuccuccuuagaagaacagaccuaacuagcgaauguaugaaugaaaaugcaucuauuucagag

SEQ ID NO: 732254 - RNA, 63 nt, hsa
ccaggugugcacuguucacugcagcccauuugcuguaugaacugugguuguugugugcccaau

SEQ ID NO: 732255 - RNA, 63 nt, hsa
ucccaauaauuaucucuuucccuggaaucaacuuguaugaaaccuugucaaaauguacuccac

SEQ ID NO: 732256 - RNA, 63 nt, hsa
uuguacaguaauauguuuaauguucauuuucucuguaugaaugugauugguaacuaggauaug

SEQ ID NO: 732257 - RNA, 63 nt, hsa
uuuuguguuuaauuuguguuuuuuuuuuccagcuguaugaaaugggcuuucugaaguuuaaau

SEQ ID NO: 732258 - RNA, 63 nt, hsa
uuuguauuuuuauuaucagauggggcaacauauuguaugaagcauauguagcacuucacagca

SEQ ID NO: 732259 - RNA, 63 nt, hsa
uuuuucucuaagguucuuuuuuuuuauucaaacuguaugaaauggcaaagugaggcucugggg

SEQ ID NO: 732260 - RNA, 63 nt, hsa
acagaaauggcuauuaaaaauguuuuaaccucauguaugaacugaauuuaaaaaaccacuaaa

SEQ ID NO: 732261 - RNA, 63 nt, hsa
cacuggcaaugacccacuccccuuggaaaugcauguaugaacuacccuaugaaauguaagcug

SEQ ID NO: 732262 - RNA, 63 nt, hsa
guauucaaauaagaucaggaagccaauuuucuauguaugaauaugcuuuaaccuaggauuuca

SEQ ID NO: 732263 - RNA, 63 nt, hsa
aaaugugaaugugcugcguuuuguuuucuuuacuguaugaaaacaggaaaauaaaagagaaau

SEQ ID NO: 732264 - RNA, 63 nt, hsa
uauagcaaagaauauaaauuugcuguugauuuuuguaugaauuuuuucacaaaaagauccuga

SEQ ID NO: 732265 - RNA, 63 nt, hsa
uucuauaauagagcucuaaaaacaugccaccaguguaugaauaagggaaagauuaauuuuggc

SEQ ID NO: 732266 - RNA, 63 nt, hsa
ucagcaggguguguguguguguguguguguguguguaugaaugguauauuuauuacauuauuu

SEQ ID NO: 732267 - RNA, 63 nt, hsa
ucuggaaacaauacauuguaaauaguuuuucauuguaugaaguaguguucacauuaaaaagau

SEQ ID NO: 732268 - RNA, 63 nt, hsa
acaugauguuugacuguaaucucaucacggauauguaugaauuuuuacagguucguuuuugaa

SEQ ID NO: 732269 - RNA, 63 nt, hsa
cuguguuaacuuagugacauuuaaugcccaauauguaugaauagaucuaagccauuuaauuuu

SEQ ID NO: 732270 - RNA, 63 nt, hsa
guccacccccauaaaacuguaagacaagccuccuguaugaagccagaagcacaagugccuuca

SEQ ID NO: 732271 - RNA, 63 nt, hsa
auuuguuaugggaguagaauauauauugaauuuuguaugaagaacuauuuguuuaaauuauau

SEQ ID NO: 732272 - RNA, 63 nt, hsa
aaaagguauaaacaccaaaaaaaaaauuaacauuguaugaagauggaaaauaagaagaugcac

SEQ ID NO: 732273 - RNA, 63 nt, hsa
ucacuuagcaaacacauguugacuuuuaacugauguaugaauauuaauacucuaaaaauagaa

SEQ ID NO: 732274 - RNA, 63 nt, hsa
ugugcuuuuggucccuggaaacaaauccgccuauguaugaagcuaguugauuuccaguugcac

SEQ ID NO: 732275 - RNA, 63 nt, hsa
gcaccucucugcuuaaucuuuucuaaaaucgccuguaugaaaaauaccucgcuggauggaaaa

SEQ ID NO: 732276 - RNA, 63 nt, hsa
uauaaaacccuaacagcggugauaucauuagacuguaugaaucaguuuuauuaccuaguguac

SEQ ID NO: 732277 - RNA, 63 nt, hsa
ccacaaggcauagccuccaaguauacucucaaauguaugaagcaacuggggugggcagaagac

SEQ ID NO: 732278 - RNA, 63 nt, hsa
gauuauaccccauuggaggcuuuuaauuuuauuuguaugaauuuuccaggauuucauuaaaaa

SEQ ID NO: 732279 - RNA, 63 nt, hsa
gauuguccaguuaucauacauuugacuuucaaauguaugaaccagcauguaccccauggauuu

SEQ ID NO: 732280 - RNA, 63 nt, hsa
aauuuggaaagguuauuuacauggcagaauacauguaugaauauuaaaguaauaugaaugaaa

SEQ ID NO: 732281 - RNA, 63 nt, hsa
uuuuaguagguuuuguuuaaccucugugcaguuuguaugaaugaauugcuauacauuuauaag

SEQ ID NO: 732282 - RNA, 63 nt, hsa
gugauucuguguggccuuuuuggggcuggaaaauguaugaauucuucaacugucuuacaagag

SEQ ID NO: 732283 - RNA, 63 nt, hsa
cgaaauuuuacuacgugugauuuaacugcuauuuguaugaaguuguauuggauuacauuaagu

SEQ ID NO: 732284 - RNA, 63 nt, hsa
uguauauugauugagacuaucuaaacucauaccuguaugaauuaagcuguaaggccuguagcu

SEQ ID NO: 732285 - RNA, 63 nt, hsa
aacagaucuuuucauucacgugcuuucugggucuguaugaacauaaguaagacacaagguacu

SEQ ID NO: 732286 - RNA, 63 nt, hsa
uagagucacuguauaagggucuaugaguagcuguguaugaauaaauauuaccugucuaccuca

SEQ ID NO: 732287 - RNA, 63 nt, hsa
uaaaggacagaagugcaauuuagcuuaaauggguguaugaauggucuagaaacauuucuauuu

SEQ ID NO: 732288 - RNA, 63 nt, hsa
uauguauguaaaacuguuuccugaacaauaagauguaugaacggagcagaaauaaauacuuuu

SEQ ID NO: 732289 - RNA, 63 nt, hsa
uucacaaguucaaucuguuuuucauguaaauuuuguaugaaaaaucaaugucaaguaccaaaa

SEQ ID NO: 732290 - RNA, 63 nt, hsa
uuguguggcagugauuggucuguuuguggagaauguaugaaagcuauuaauauucuagaauag

SEQ ID NO: 732291 - RNA, 63 nt, hsa
uaucguucucaauucuauagacuuucaagccuauguaugaauaugaagggguuuuuuuuuuuu

SEQ ID NO: 732292 - RNA, 63 nt, hsa
gagaaacucuauuuugaugucaauauagauuacuguaugaaguagcuuugugucuguuaccug

SEQ ID NO: 732293 - RNA, 63 nt, hsa
aaauauauauguauguguauauauauacauguauguaugaaauauauauaugugcgugugugu

SEQ ID NO: 732294 - RNA, 63 nt, hsa
uuugcuucgcgagcccugguguggacuguggucuguaugaaucguguguaacuguggugaggg

SEQ ID NO: 732295 - RNA, 63 nt, hsa
uugguuaaaaucauguuugugacuguaaccauuuguaugaauuauuuuaaagaaauaaaaauc

SEQ ID NO: 732296 - RNA, 63 nt, hsa
caauucuacauguauuguugugguuuuauucauuguaugaaaauuccugugauuuuuuuuaaa

SEQ ID NO: 732297 - RNA, 63 nt, hsa
aaauuuuguucucugagccaaaguuuaacucauuguaugaauucuuuuucaugguaguucauu

SEQ ID NO: 732298 - RNA, 63 nt, hsa
ugugaaauccagcaacugaauuguggucacgauuguaugaaaguucaagaacauaugucaguu

SEQ ID NO: 732299 - RNA, 63 nt, hsa
uuccagucuugcugguaauuuuguacaguauaguguaugaauugcugugcugcaaagccaaac

SEQ ID NO: 732300 - RNA, 63 nt, hsa
agcagcuccaugcucgcuacgucuugaaccuuuuguaugaaaccaagaaacaucugguacagc

SEQ ID NO: 732301 - RNA, 63 nt, hsa
agggaaaauuauuccauguaaacauuucaacucuguaugaaaauguuaaauauuguaagaaag

SEQ ID NO: 732302 - RNA, 63 nt, hsa
uagauuaguuuuguuggggaagaauuauuauguuguaugaacaaccccacugaagcauuauac

SEQ ID NO: 732303 - RNA, 63 nt, hsa
aauugcauuguguuacagagcuagaaaauuuuauguaugaaaaacgauaauagccuuacacug

SEQ ID NO: 732304 - RNA, 63 nt, hsa
ucuuaucccaaaauucuagaaaguaauaaauucuguaugaauaagcauaaaaaauaaauaaau

SEQ ID NO: 732305 - RNA, 63 nt, hsa
uuuuuuaauucuaauguucaaaucacugcgugcuguaugaaucuagaaagccuuaauuuacua

SEQ ID NO: 732306 - RNA, 63 nt, hsa
aguguuuuuuuaaccauuguuaaucagcuuuuguguaugaaagacacaguaaaauuucuuucu

SEQ ID NO: 732307 - RNA, 63 nt, hsa
cuguucaaguuaaucuagaaauuuauucaauucuguaugaacaccuggaagcaaaaucauagu

SEQ ID NO: 732308 - RNA, 63 nt, hsa
aggugagaauaagaaauagccaacuaguuaaaauguaugaaaagaaaacuuuccccugcugua

SEQ ID NO: 732309 - RNA, 63 nt, hsa
aauaauuuacagguucuuaggcuccauccuguuuguaugaaauuauaaucuguggauuggccu

SEQ ID NO: 732310 - RNA, 63 nt, hsa
cuuuggcuuucagaaagauacagugauaauguguguaugaaucagucacaaugaauuuuacuu

SEQ ID NO: 732311 - RNA, 63 nt, hsa
uuagccagugggggcuuaugguugugugaaccauguaugaaaauccagugggccccaaccaag

SEQ ID NO: 732312 - RNA, 63 nt, hsa
gugacaagugacaaaaucuauuuagguucucuguguaugaauccugauuuuaacugcuaggau

SEQ ID NO: 732313 - RNA, 63 nt, hsa
uaagaaguauuuuacccacuggugguuuguguguguaugaagguaaauauuuauauauuuuua

SEQ ID NO: 732314 - RNA, 63 nt, hsa
aggguugaggagacuguuggggggcauuuauaauguaugaaaguuaaggaagggggugaggau

SEQ ID NO: 732315 - RNA, 63 nt, hsa
uaaaaauguuuuuuaguucuagcuacuaaaaccuguaugaacucaaauggauaggcaucuugu

SEQ ID NO: 732316 - RNA, 63 nt, hsa
auauaucuguauuuuacuacuguuaaguuucuuuguaugaacuguguuguuaguacucagaua

SEQ ID NO: 732317 - RNA, 63 nt, hsa
acaccauaugccucauuuuaucauagccuauuguguaugaaagauguuuguacaaugaauuga

SEQ ID NO: 732318 - RNA, 63 nt, hsa
gcugagaaauuguuuugcaaauggaucuauuuuuguaugaaaaaaaaaauuuuuuuaaagaaa

SEQ ID NO: 732319 - RNA, 63 nt, hsa
agguuuugucccauuuguugcccuugaauuauuuguaugaauuauauguuccagugaaaaugg

SEQ ID NO: 732320 - RNA, 63 nt, hsa
uuccacccucgugauuguauagggcucuucuccuguaugaacucugagaucagugagcucuga

SEQ ID NO: 732321 - RNA, 63 nt, hsa
aauaccaauacuuaggauuuuggucuugguguuuguaugaaauucugaggccuugauuuaaau

SEQ ID NO: 732322 - RNA, 63 nt, hsa
uaguuaggcuucugagcuugcaaucauauugaauguaugaagagcgaaaucaaauucuuauuu

SEQ ID NO: 732323 - RNA, 63 nt, hsa
ugagguauauaugauuuuuaacuguauuagggguguaugaaccaguuuaaaaacgagguuuua

SEQ ID NO: 732324 - RNA, 63 nt, hsa
cauguaccaagguuuugcuauaaaaguuuugucuguaugaauaauguggcuuuaguaaauaau

SEQ ID NO: 732325 - RNA, 63 nt, hsa
agauuuguggguuuugugccuuauaaauggaaauguaugaacacaauauaugcucauguagaa

SEQ ID NO: 732326 - RNA, 63 nt, hsa
ccugagaaaccaaacacagcuaaugcuaugggguguaugaauaugucaaguuuaggucauuua

SEQ ID NO: 732327 - RNA, 63 nt, hsa
uguuugauauuaugaacaggaaacauaauuuaauguaugaauagaugugaauuugggauuuca

SEQ ID NO: 732328 - RNA, 63 nt, hsa
ugcuuauugucucauuuuguagucuuuuaaaguuguaugaacccuuaauuugaagaacuaacu

SEQ ID NO: 732329 - RNA, 63 nt, hsa
acuuggucugcuucaaggaggucgaccuucuaauguaugaagaaugggaugcauuugaucuca

SEQ ID NO: 732330 - RNA, 63 nt, hsa
uuuugaaaggacuauuauccucuaaaauguauguguaugaagauccuggcuugcagcucggga

SEQ ID NO: 732331 - RNA, 63 nt, hsa
ucauggggacuccacuccugccuggguuuacucuguaugaagaggccacugguauccugccau

SEQ ID NO: 732332 - RNA, 63 nt, hsa
aacaguagaaccuguguaaccucaaggagauauuguaugaaucucacuagccgcagcuuauaa

SEQ ID NO: 732333 - RNA, 63 nt, hsa
gggcugccuccaagaggaaccucugauuuauuuuguaugaaauauaugugaaaggauaugaau

SEQ ID NO: 732334 - RNA, 63 nt, hsa
ucuguacaaauauuagcacuaaauguuuaaauauguaugaaugccagaaauuugucaguucau

SEQ ID NO: 732335 - RNA, 63 nt, hsa
cauauaauuuauauaugaaagcuuacgcuauauuguaugaauuauuugcaucuuucaguggcc

SEQ ID NO: 732336 - RNA, 63 nt, hsa
aaucuacuacuuuaaauguaacaucaacucaguuguaugaaucuggaguguaauauuuauauu

SEQ ID NO: 732337 - RNA, 63 nt, hsa
uuaucccaaguacuccauauaucugucugugguuguaugaaaugaaaaaaggggcagagugca

SEQ ID NO: 732338 - RNA, 63 nt, hsa
uguauauugcacaacaguccucaaauacacugauguaugaaacuauucauacaucaagcagca

SEQ ID NO: 732339 - RNA, 63 nt, hsa
uauuguaacaaauucaauauccuagucuucauuuguaugaaugguuuguauuguacauaguuu

SEQ ID NO: 732340 - RNA, 63 nt, hsa
gcuaaacguggaagaagggaaguuuucuaguauuguaugaaaauguuuaaauauuuucaagga

SEQ ID NO: 732341 - RNA, 63 nt, hsa
cauaaugcaguacauuucaaaauuuuuagauuauguaugaacuuagauuuuuaaacauguuuu

SEQ ID NO: 732342 - RNA, 63 nt, hsa
ugguggaccuguaauauccacauugugaagcuguguaugaaauucaacuauaauaugaauaaa

SEQ ID NO: 732343 - RNA, 63 nt, hsa
agcauuaagagauguaaaugauaaaggaauuauuguaugaaauauuacaaagcguagacuaug

SEQ ID NO: 732344 - RNA, 63 nt, hsa
cucauaaaauaggauuugaaggaugaaauuaauuguaugaagcaaugugauuauaugaagaga

SEQ ID NO: 732345 - RNA, 63 nt, hsa
gcuuaaggcuguaacucuucuaucggggcuaauuguaugaauaggugucaguauguugaagau

SEQ ID NO: 732346 - RNA, 63 nt, hsa
acaauugaaaaaaacuauuggaauaauagcacuuguaugaaauucaguuuuggaacuaaacag

SEQ ID NO: 732347 - RNA, 63 nt, hsa
uuguauacugucuuuuaauccuucauuguuucauguaugaaguuuuuaaucacccccuaaccc

SEQ ID NO: 732348 - RNA, 63 nt, hsa
gauguaauguacauagaugacauuaagaaaauuuguaugaaauaauuuagucaucaugaaaua

SEQ ID NO: 732349 - RNA, 63 nt, hsa
uaaaguauauauauacauauauauauauauauauguaugaaacccgcauggaauuaucuguau

SEQ ID NO: 732350 - RNA, 63 nt, hsa
uauauauauguaugaaacccgcauggaauuaucuguaugaaaucaaggugcgcuguggaaaca

SEQ ID NO: 732351 - RNA, 63 nt, hsa
uggcuagugcuuacauuugcucaaaaagcauguuguaugaagcugacugccaccaugcuaaag

SEQ ID NO: 732352 - RNA, 63 nt, hsa
gagugauagcuacuguagaaaggaaauagacuuuguaugaacucuuuaaguugaaaaguaaaa

SEQ ID NO: 732353 - RNA, 63 nt, hsa
gcugauuuaaaguugugcaggaaacaucuucuguguaugaagcaaaugucgauguuuugaaaa

SEQ ID NO: 732354 - RNA, 63 nt, hsa
aaaauacugcaggaugcuuagugcucaguguuauguaugaacuuguggacuuuacaaugcagg

SEQ ID NO: 732355 - RNA, 63 nt, hsa
ccccuucccccuuuuuugucccccaacuugagauguaugaaggcuuuuggucucccugggagu

SEQ ID NO: 732356 - RNA, 63 nt, hsa
cauugucuuauuuuauuucuguaaaauauuagcuguaugaauaugauuuaauuaacaagaaaa

SEQ ID NO: 732357 - RNA, 63 nt, hsa
ugaaaacaggcauguggaaacacaaaaaugauguguaugaaaagcaccugaugaaaauauuug

SEQ ID NO: 732358 - RNA, 63 nt, hsa
gccggacgcugugucaccccucauucuggccgcuguaugaagcagccucgggcaggggucuca

SEQ ID NO: 732359 - RNA, 63 nt, hsa
ccuaccggaauauaauuaaagggagaaauacacuguaugaaguauauguugauacuaugacau

SEQ ID NO: 732360 - RNA, 63 nt, hsa
gauucuuguagcuacuacauuccagacuggaaauguaugaaugauaaucaacauaaugcugau

SEQ ID NO: 732361 - RNA, 63 nt, hsa
agcagaaguuuucagggcauuaaauauauguuguguaugaaguaucucaaacuggaacauaaa

SEQ ID NO: 732362 - RNA, 63 nt, hsa
aacaugaugcuucuugcauauuauccagauuauuguaugaaguugugucuauaauuauuacca

SEQ ID NO: 732363 - RNA, 63 nt, hsa
uauuucuguucaugucuucuacuuuucuacuccuguaugaauaaaauauugauuugauuacag

SEQ ID NO: 732364 - RNA, 63 nt, hsa
gggaccccccuaauguaauggauuucucaauacuguaugaauaaugaaacuuacuaucauaaa

SEQ ID NO: 732365 - RNA, 63 nt, hsa
ccuauaacuuuugguaucuacuucuacauccaauguaugaauuaagcuguaagauaauguugc

SEQ ID NO: 732366 - RNA, 63 nt, hsa
cugcuaggauccuacauaggauuucuauagaaauguaugaaauucuguggucacugcauguca

SEQ ID NO: 732367 - RNA, 63 nt, hsa
auuuuugaaccugcauuucuuucuuauguguaguguaugaagaaagacuagaauguagcuuua

SEQ ID NO: 732368 - RNA, 63 nt, hsa
aaaaauguuguauaauaguguaauacuuuucuuuguaugaaaauguccucuucuucaaaggua

SEQ ID NO: 732369 - RNA, 63 nt, hsa
ucaaucuacuuaucaucuugggucuuugaguauuguaugaaagauccuucgugcacaccacac

SEQ ID NO: 732370 - RNA, 63 nt, hsa
aagaaauaugaguaauucuacauguaguagagguguaugaagaucauauaacaauuaaacaua

SEQ ID NO: 732371 - RNA, 63 nt, hsa
uuuugauguguuaaguugaagaaagguaacucguguaugaaccccgagccauuucccuguugu

SEQ ID NO: 732372 - RNA, 63 nt, hsa
uccaaaaguggguucuaaaugccuggcugcaucuguaugaaaucaaggcacacuccaggaaga

SEQ ID NO: 732373 - RNA, 63 nt, hsa
augauaugauugacugaugcgcaguccagagcauguaugaauaaucucauaaaacaguaucac

SEQ ID NO: 732374 - RNA, 63 nt, hsa
uuguugguuuuuugauuuuagcauauuauuuccuguaugaaauauguuuuauauaaucuccua

SEQ ID NO: 732375 - RNA, 63 nt, hsa
uaaauuuauuguguauggaucaaaagugaauaauguaugaaugagagcuguaagaaggauuuu

SEQ ID NO: 732376 - RNA, 63 nt, hsa
aauuagaaaaagccaggaaugaguuacaaacaguguaugaagcauucguccagcagcaccagg

SEQ ID NO: 732377 - RNA, 63 nt, hsa
accaagcgccuccacgggaggcgagggaggcucuguaugaaacagaagagcagggacauaaag

SEQ ID NO: 732378 - RNA, 63 nt, hsa
uggaccccgauuggugagggcucugcauaugccuguaugaaggagauacaggugugugugcac

SEQ ID NO: 732379 - RNA, 63 nt, hsa
uuuguguuuauuuuuauaugauugaaugaguucuguaugaaacugagauguugucuauagcua

SEQ ID NO: 732380 - RNA, 63 nt, hsa
uuuguuucuuuuuauuaccaaguacuauuucauuguaugaauauaucacaguuuauccauucu

SEQ ID NO: 732381 - RNA, 63 nt, hsa
agaaugaaaaaugaaagaugauuugcaaugggauguaugaauacagcagcaagaaaaaaaaau

SEQ ID NO: 732382 - RNA, 63 nt, hsa
acagagcuucucugggaugcugggauucuugccuguaugaaugcaucaaguauucauuuauug

SEQ ID NO: 732383 - RNA, 63 nt, hsa
ucucuuuguuuuuaaacaaaagauauuauuuuguguaugaaucuaaaucaagcccaucuguca

SEQ ID NO: 732384 - RNA, 63 nt, hsa
auauuaccaccucucuuuguaauuuacuuuacuuguaugaauuuaacaucucuagcauguauc

SEQ ID NO: 732385 - RNA, 63 nt, hsa
aacagggaagggcuggggugugaaaaagaagauuguaugaaaaccauugguaauuuuuauuuu

SEQ ID NO: 732386 - RNA, 63 nt, hsa
ugaagggcuauagccaaaguauuuuuacuagccuguaugaaaucacuaguccuuauuuuuaaa

SEQ ID NO: 732387 - RNA, 63 nt, hsa
gcccccuggaucuuggacacuuacagauugagcuguaugaauucagcgggucucacuccagag

SEQ ID NO: 732388 - RNA, 63 nt, hsa
auuuagaagcugcuuuuccuaagacuucuaguauguaugaauucuuugaaaauuauauuacuu

SEQ ID NO: 732389 - RNA, 63 nt, hsa
auagugauguucuuuugcaaggcauagaacauuuguaugaaaagacauuuaguaugcuuugaa

SEQ ID NO: 732390 - RNA, 63 nt, hsa
caccgacacugagcaguggaaaggggcuauauguguaugaauagaccacauugaaggagcaca

SEQ ID NO: 732391 - RNA, 63 nt, hsa
cacuucuguguuauaauggaagguuuuuugugauguaugaaacuuguguuuuuuauauauaaa

SEQ ID NO: 732392 - RNA, 63 nt, hsa
uuacugaauccuggugugaaagcauaucagauauguaugaacugcuacugcuguacuuccgau

SEQ ID NO: 732393 - RNA, 63 nt, hsa
caacuuuuuauuuaaaaaagcucugcacugccauguaugaaagucucuuuaugauguuuguuu

SEQ ID NO: 732394 - RNA, 63 nt, hsa
ccaaauggaccuucugggacaagcugagcaagcuguaugaacgccacguuugugaagagcuga

SEQ ID NO: 732395 - RNA, 63 nt, hsa
guguaaaaagucacagcuaaaugaucucacuccuguaugaauaagcaagugcuuuuuuagugu

SEQ ID NO: 732396 - RNA, 63 nt, hsa
uuuauguaaucucuggugcugcuuuccagucacuguaugaagugucuccccaacacuagcaaa

SEQ ID NO: 732397 - RNA, 63 nt, hsa
auuuauuuaucucauuaacuuaaaacagcuauguguaugaaauaggucacaacagaacuugaa

SEQ ID NO: 732398 - RNA, 63 nt, hsa
uucacauguguggguccaacacuuacuaccugguguaugaaauuggaccugaacuguuggauu

SEQ ID NO: 732399 - RNA, 63 nt, hsa
agcuguugguugaaaucauaauuaaugcguuacuguaugaaccacaaaacagcacuauuuauu

SEQ ID NO: 732400 - RNA, 63 nt, hsa
guuacuucuucaucaguuuuuccuuuugaaagguguaugaauucauuacauuuuuauucuaau

SEQ ID NO: 732401 - RNA, 63 nt, hsa
caucauuaaauguguacugugaagagauuaauauguaugaagggcuuuaccaaaguccacuaa

SEQ ID NO: 732402 - RNA, 63 nt, hsa
aaauuguacguaauguauuuaaaucaacgcaaauguaugaauaacaaauacaguucugaccuu

SEQ ID NO: 732403 - RNA, 63 nt, hsa
aagcagguaaauugucgggggagagaguuagcauguaugaauguaaggaugagggaagcgaag

SEQ ID NO: 732404 - RNA, 63 nt, hsa
uuuugacacagcaacuuccuguagugagcacuuuguaugaaucguggacuuccuguucucaag

SEQ ID NO: 732405 - RNA, 63 nt, hsa
aaauaauauaaucuuaguucaguaacuauuauguguaugaagauguugcacauuaagucucag

SEQ ID NO: 732406 - RNA, 63 nt, hsa
cuuuaguagauauuaccaguuuuccuaagugauuguaugaauuuaugcuccuaccggcaaugu

SEQ ID NO: 732407 - RNA, 63 nt, hsa
cagcauucauugacacauagcucuaaugacauauguaugaaaaaccauacacuggaugaccua

SEQ ID NO: 732408 - RNA, 63 nt, hsa
aacuugcccugagacuccagaacuaaauccuuauguaugaaauuaccuacaaugaauguuaug

SEQ ID NO: 732409 - RNA, 63 nt, hsa
cuagagaaauaagaucuuuuuugucaguuuguuuguaugaaacuaaagccuuuauuuguuaau

SEQ ID NO: 732410 - RNA, 63 nt, hsa
caauuuucgaagucaguaaaaaaacacaaaaacuguaugaaugacuuuguaaauuuuguucua

SEQ ID NO: 732411 - RNA, 63 nt, hsa
aggaauaucuacagcagugaugcuugaaauuuuuguaugaauuauuuugucguccuacccuuu

SEQ ID NO: 732412 - RNA, 63 nt, hsa
aaaugugacucucccagagaagaagccgcuggcuguaugaaacuugacggcgcuuuuguaagg

SEQ ID NO: 732413 - RNA, 63 nt, hsa
cugguuggaagaauauaguauugcagcaaauccuguaugaaagagagaugugggcuuccuuuu

SEQ ID NO: 732414 - RNA, 63 nt, hsa
ggagagggagggaugcugauugauauuucacauuguaugaaauaccauguuugaaacucauag

SEQ ID NO: 732415 - RNA, 63 nt, hsa
acacuccagcauaucgggugaguuuuagggauguguaugaauauuuaaaucuuuuaauuucag

SEQ ID NO: 732416 - RNA, 63 nt, hsa
cuccagcagguaggggcacagugaauguguguauguaugaaggccacaucaacuuuauguagc

SEQ ID NO: 732417 - RNA, 63 nt, hsa
uguugcagagcccuuacuuaaauccuucacugguguaugaauacuuugucauaaugcugcuuu

SEQ ID NO: 732418 - RNA, 63 nt, hsa
gugcuauaguaaauuacaaagaaauagguagauuguaugaacauacccacaaaugccuaugau

SEQ ID NO: 732419 - RNA, 63 nt, hsa
ugaaauuauauguguguggugugugaauaaauauguaugaauauauggucuguguuuucuuuu

SEQ ID NO: 732420 - RNA, 63 nt, hsa
cccucaaggguguguauauuguauaggggcaacuguaugaaaaauuggggaggagggggccgg

SEQ ID NO: 732421 - RNA, 63 nt, hsa
auucacucauguguuccagauguauucuaauuguguaugaaauguauguacacauaagugugu

SEQ ID NO: 732422 - RNA, 63 nt, hsa
uggguucaaauucugaaacugucacuuauuaccuguaugaacaugggcaaauuaucuaaucuc

SEQ ID NO: 732423 - RNA, 63 nt, hsa
gugccauucuccccagacuuuuuuuguacuuaauguaugaaagauccaaacuaauauugcugu

SEQ ID NO: 732424 - RNA, 63 nt, hsa
aaauuguaaacuuaaaauauauauaaaauuuauuguaugaaaauuaagccucaauaaacguga

SEQ ID NO: 732425 - RNA, 63 nt, hsa
uucugaaaaauuguaaaucugaucauaucaacauguaugaacuuaaaauauggagaauguuau

SEQ ID NO: 732426 - RNA, 63 nt, hsa
acuguagcaguguguucugggcaguaucuguaauguaugaaauagagucuggaauagguuauc

SEQ ID NO: 732427 - RNA, 63 nt, hsa
auaguguguacguauaccacauauacauauacuuguaugaagauauguguaaaauguuuuuac

SEQ ID NO: 732428 - RNA, 63 nt, hsa
ugguuuauuuuauuucccaccuuugugugaguguguaugaaagagaagaaaaugcaauuuuua

SEQ ID NO: 732429 - RNA, 63 nt, hsa
cugccuuauuguuuguuuuuauuuauggcagaauguaugaaauccguuuuguaguuucaaauu

SEQ ID NO: 732430 - RNA, 63 nt, hsa
ucuucucugucgcccugaagggucacuguauucuguaugaaugcauggcaugauacaacuaau

SEQ ID NO: 732431 - RNA, 63 nt, hsa
gguucaucauggugacagcaugaaaggaaugaguguaugaaaaggugaaggugggagcaccuu

SEQ ID NO: 732432 - RNA, 63 nt, hsa
ccucgauggaugcgagugcggcggucuucagaauguaugaaggaugaccccaucacucucuuu

SEQ ID NO: 732433 - RNA, 63 nt, hsa
gaucucuauuuuaaaacuagcuuuuuaagcagcuguaugaaauaaaugcugagugagccccag

SEQ ID NO: 732434 - RNA, 63 nt, hsa
caaugugaauucuuacgaauguacaacacaaacuguaugaagccaugaaggaaacagaggggc

SEQ ID NO: 732435 - RNA, 63 nt, hsa
ugccauggccugaauguuggcuuaacugaauauuguaugaaaagacaugccuccauaugugcc

SEQ ID NO: 732436 - RNA, 63 nt, hsa
aagcaaauccuuucaagaauggcaugggcauucuguaugaaccuuuccagaugguguucagug

SEQ ID NO: 732437 - RNA, 61 nt, hsa
accucuucccaggacauuaaaauaaggaaacuguaugaaugucugugggcagguacaugug

SEQ ID NO: 732438 - RNA, 63 nt, hsa
guuguuugguuuucaaggcacugauaauggauauguaugaaguccaugcugucuguuaaauaa

SEQ ID NO: 732439 - RNA, 63 nt, hsa
ucccaggauuccauccugaaauuuauuuuucuuuguaugaauauguguaaaugauuuaaaaau

SEQ ID NO: 732440 - RNA, 63 nt, hsa
auggagagaaagggauuuuuuacugcaucccucuguaugaauaugaaaucagagaccagggca

SEQ ID NO: 732441 - RNA, 63 nt, hsa
uaagagacauucuucauccaccaauguuguacauguaugaaaaugguguacuguauacuuuaa

SEQ ID NO: 732442 - RNA, 63 nt, hsa
aaaguaaauaucuuuuucauauguccauuagaauguaugaaaaaaaucauuuuaacuaaaagc

SEQ ID NO: 732443 - RNA, 63 nt, hsa
auggucucaugaguuucaaaauaauaauuuuuguguaugaacaaagcuguuguuuuuaccaug

SEQ ID NO: 732444 - RNA, 63 nt, hsa
aauuaaugaucucuuuggaagagagcccagauuuguaugaaaacuuguuuuuccucucaauug

SEQ ID NO: 732445 - RNA, 63 nt, hsa
agucugucuuuccuuagccgucugagugagcuguguaugaacaagucccaggaguuccaagag

SEQ ID NO: 732446 - RNA, 63 nt, hsa
uuccccuaacgucucaacaggcgcucacugaaguguaugaauauuuuuuaaaaagguuuuugc

SEQ ID NO: 732447 - RNA, 63 nt, hsa
ccucaaagcguugucauguggauugagaugauauguaugaaucacauaaaagagugccuggca

SEQ ID NO: 732448 - RNA, 63 nt, hsa
gaguugaaaauugccuccaaauuaccggaagaguguaugaagauugaaugugauguauucacg

SEQ ID NO: 732449 - RNA, 63 nt, hsa
acagauaagggcuuuauuguacaauaaaagauauguaugaaugcaucaguagcugaaaauugc

SEQ ID NO: 732450 - RNA, 63 nt, hsa
aaauuguuaaacauuuagacaaacauauauguauguaugaauguacauaaauauuuuuaacuc

SEQ ID NO: 732451 - RNA, 63 nt, hsa
ggaaauggcaagucuuuaggauaggcaagacccuguaugaauaguaccaaagcauuaccgcau

SEQ ID NO: 732452 - RNA, 63 nt, hsa
uuuaaaucauaacuauuugcuuuguacguuucauguaugaaugacaauaguuugaugauuucc

SEQ ID NO: 732453 - RNA, 63 nt, hsa
agauuguauagagagacuaucuuguguugugccuguaugaauuuuuaaaaguuguugacugga

SEQ ID NO: 732454 - RNA, 63 nt, hsa
uuaaauaggaaaauuguuauuaaauaaagaauuuguaugaaccuuugccaauguuuuugacac

SEQ ID NO: 732455 - RNA, 63 nt, hsa
uuauacuuuuuucuguauuguaauagguaguuuuguaugaaaucuuuucuccucucccguugu

SEQ ID NO: 732456 - RNA, 63 nt, hsa
auucacuuacggagaauguaagguuaccuuugauguaugaaguagcaguauuuuccaguuuuu

SEQ ID NO: 732457 - RNA, 63 nt, hsa
ccuguccagcagggagcuugaauuuaaguuccauguaugaagucauuggcucuaucugcauuu

SEQ ID NO: 732458 - RNA, 63 nt, hsa
uauauucuaaacacaaugaaauagggaauauaauguaugaacuuuuugcauuggcuugaagca

SEQ ID NO: 732459 - RNA, 63 nt, hsa
agaagaauaucacuuauuuuuagacuuguaaaauguaugaacuggugagcggacaucuguuaa

SEQ ID NO: 732460 - RNA, 63 nt, hsa
gcccaaaggggcagaacaagaaagccacgggauuguaugaaaucaaacaugaguuuguggugu

SEQ ID NO: 732461 - RNA, 63 nt, hsa
augaaacagaaagaucuguccaaggacacagcuuguaugaaaggguugaauuugggcuccauc

SEQ ID NO: 732462 - RNA, 63 nt, hsa
ggggcauagaauaaaauauuaaauauuggcagauguaugaaaagaagugugaguuaaaaauau

SEQ ID NO: 732463 - RNA, 63 nt, hsa
aaguguggugucuuuuauauuugaauuaguaacuguaugaagucauagauaauaguacauguc

SEQ ID NO: 732464 - RNA, 63 nt, hsa
gacuuuuuaauuguaaaagauuaguugaaaaacuguaugaaugugaagaucacaugcuuaguc

SEQ ID NO: 732465 - RNA, 63 nt, hsa
uuuuccaguaugaauguuaauguugucaguguauguaugaauaugaaagugcuuuguuuuguu

SEQ ID NO: 732466 - RNA, 63 nt, hsa
uuagugcuuuugcaaguucaauuuguuaguuccuguaugaaagauugugggggaaaaauaaac

SEQ ID NO: 732467 - RNA, 63 nt, hsa
guuuuaacgugcucaacuuuaauuuuuuucaauuguaugaaggccuuaaaaaagcuacauuaa

SEQ ID NO: 732468 - RNA, 63 nt, hsa
guagcaacuguuugauuucuuucuggauacagcuguaugaacacuuuucuauuuuauacugaa

SEQ ID NO: 732469 - RNA, 63 nt, hsa
aaugcaaugaggaaaucugacagggaaauuaucuguaugaacuaaaaguaagggaaccccggg

SEQ ID NO: 732470 - RNA, 63 nt, hsa
gauuccuuuggauggcuucauuugcccccagacuguaugaaaacaucuccgaauuagcauuuc

SEQ ID NO: 732471 - RNA, 63 nt, hsa
uuacccaucugcagaacuaaggaaagcaauuuauguaugaaagaaauucuugaauucgucauu

SEQ ID NO: 732472 - RNA, 63 nt, hsa
aucuggguacagacaguaaagcccuuugauugcuguaugaauuccacacuauauaaacaauaa

SEQ ID NO: 732473 - RNA, 63 nt, hsa
agaaaaguugggaaaagaguacaaugaccuuuuuguaugaaaauuacuuauuaacaggccagg

SEQ ID NO: 732474 - RNA, 63 nt, hsa
ggaccacuucucauauuagauuacuaagucauuuguaugaauauguguggcagugaagagaac

SEQ ID NO: 732475 - RNA, 63 nt, hsa
gugaggagugagugagacaggacaugaaagguguguaugaacugugauaacuguugcccuugu

SEQ ID NO: 732476 - RNA, 63 nt, hsa
ugucuuuauuguuguuaaaaaguuuuuauugaauguaugaaaauuaucaaauuguauucauca

SEQ ID NO: 732477 - RNA, 63 nt, hsa
acagugugucagauggucuuuauauauuuuuucuguaugaaggaauagccuugccuacugaag

SEQ ID NO: 732478 - RNA, 63 nt, hsa
cggggagaagaggauacugaaacauuugugaaauguaugaaugcacuucuguaaccagauacu

SEQ ID NO: 732479 - RNA, 63 nt, hsa
uauccuauuucugggggaggauguacguggccauguaugaagccaaauauuaggcuuaaaaac

SEQ ID NO: 732480 - RNA, 63 nt, hsa
gauuuuuaugugucuuugacagcuagugucuaguguaugaaaguggaaaaggacauuucugua

SEQ ID NO: 732481 - RNA, 63 nt, hsa
uuauuugugcauauuuuuuaacaaugcccaaucuguaugaauaauguaaacuucgauuuuuuu

SEQ ID NO: 732482 - RNA, 63 nt, hsa
aaauuagcagacaauccauuccuacuguauuucuguaugaauguguuugugaauguaugugua

SEQ ID NO: 732483 - RNA, 63 nt, hsa
cggggucaguauccuguuuguuauuguuaaauuuguaugaaccuuagaaaaguuauuaaagug

SEQ ID NO: 732484 - RNA, 63 nt, hsa
ugaaagcugagaacuccugacuguaacauauucuguaugaacuuuaucuaaagaaaaauaaau

SEQ ID NO: 732485 - RNA, 63 nt, hsa
auuaugcauacccaguauguauacuuauuaaucuguaugaagauguacauucuaaaauauaau

SEQ ID NO: 732486 - RNA, 63 nt, hsa
aauuuauugacugaaaugaauuuuaaaugcauguguaugaacuuguuuuucuuaaucuuuaag

SEQ ID NO: 732487 - RNA, 63 nt, hsa
caucuauuauguaucaguuuuaaaaauuagaauuguaugaaauuaagaguuucagaguucaua

SEQ ID NO: 732488 - RNA, 63 nt, hsa
uguuugcaaauugagcagugcugcaacauguacuguaugaaggccauaaaauagagcuaguca

SEQ ID NO: 732489 - RNA, 63 nt, hsa
auaauucccuugaaauccauccaaguuguugcauguaugaauaguuucuuccuuuuuuucuuu

SEQ ID NO: 732490 - RNA, 63 nt, hsa
uccaucucuguaauuuugucauuucaagaauguuguaugaauggaaucauacagaauguaauc

SEQ ID NO: 732491 - RNA, 63 nt, hsa
aggagaaggauugggaacagaauggaaaaacaguguaugaaagucauguuacaggccgagugc

SEQ ID NO: 732492 - RNA, 63 nt, hsa
aaauucgaagaguuagucaccaagagagccauauguaugaaagcguaucugugaaagguagga

SEQ ID NO: 732493 - RNA, 63 nt, hsa
uuuguuccuucuuauuucugaagaguuuuccauuguaugaauauaccacaauuuguuuccucc

SEQ ID NO: 732494 - RNA, 63 nt, hsa
aaaagguguuuuacuguuuuccauuaacgcuguuguaugaacaauauuuggugacauguuguc

SEQ ID NO: 732495 - RNA, 63 nt, hsa
uauuuuuguaaaguuuccgugcguggcacucgcuguaugaaaggagagagcaaagggugucug

SEQ ID NO: 732496 - RNA, 63 nt, hsa
ggguccuugugacuucaacggacucuuccaaauuguaugaauguaucaauguauuagauaaac

SEQ ID NO: 732497 - RNA, 63 nt, hsa
agcacuaaggggagggcgcauacccgagacgauuguaugaagaaaauauggaggaacuguuac

SEQ ID NO: 732498 - RNA, 63 nt, hsa
gggcgcuguuuuuaacgugcccguuuguacugauguaugaacuugucaauaaacacaauuguu

SEQ ID NO: 732499 - RNA, 63 nt, hsa
gaauuuaagugacccauuaaaaucuagcacaccuguaugaaaaaucaguguagaagaauaccu

SEQ ID NO: 732500 - RNA, 63 nt, hsa
cauuacauagggacuguacagagccugugaagauguaugaaugguaucuuuuauaauccacaa

SEQ ID NO: 732501 - RNA, 63 nt, hsa
acuggguaagauucauggaacuuagaaaaaagcuguaugaacugcuuuaccaaauaucacuac

SEQ ID NO: 732502 - RNA, 63 nt, hsa
uagucccauuugggugguuucagcugcacuaucuguaugaaauggugucaccaaaacccuuuu

SEQ ID NO: 732503 - RNA, 63 nt, hsa
gcuguuguaaacaacguguauagugccuaaaauuguaugaaaauccuuuuaaccauuuuaacc

SEQ ID NO: 732504 - RNA, 63 nt, hsa
cacaagcuaguuuucuuaguuuuaaaauccuguuguaugaauggcauuuguauauuaaaacac

SEQ ID NO: 732505 - RNA, 63 nt, hsa
uuaauagcagaggaagacuccuuuuuucaucacuguaugaauuuuuuauaauguuuuuuuaaa

SEQ ID NO: 732506 - RNA, 63 nt, hsa
uaauuuuaaaaugguuucuauaaaggguuuuauuguaugaaauagaacuuuauauuuuugcau

SEQ ID NO: 732507 - RNA, 63 nt, hsa
gauuguugcugcacauaguugccuuuguaucucuguaugaaauaaaaggucauuuguucaugu

SEQ ID NO: 732508 - RNA, 63 nt, hsa
cuuugcaaagacaguguguccaguuaccacugguguaugaaaugauuaauaccugaccucaca

SEQ ID NO: 732509 - RNA, 63 nt, hsa; identical to SEQ ID NO: 732496

SEQ ID NO: 732510 - RNA, 63 nt, hsa
ggguccuuguaacuucaacugacucuuccaaauuguaugaauuuaucaauguauuacacaaau

SEQ ID NO: 732511 - RNA, 63 nt, hsa
uucggugucuugaauauauuuuuuuaaauuauguguaugaacaauucuaguuucauuuguuca

SEQ ID NO: 732512 - RNA, 63 nt, hsa
gaugcuggaauuacuccuguagguauaaaccucuguaugaagagaagauuucucccaggaaau

SEQ ID NO: 732513 - RNA, 63 nt, hsa
ugcugacauacuaaaaaaaauaaaaccuaguauuguaugaaggauagcuauucuuuacagcau

SEQ ID NO: 732514 - RNA, 63 nt, hsa
uguauauauaaaaaucuugagaugguagaaacauguaugaauguacuaaguaguauuccacug

SEQ ID NO: 732515 - RNA, 63 nt, hsa
uugaccuaguuagaugugguguuuauucaaguuuguaugaaaucauguuugacaauacuguaa

SEQ ID NO: 732516 - RNA, 63 nt, hsa
acuguuuuaaaagaauuagugugaguguguuuuuguaugaaugagcccauucaugguaagucu

SEQ ID NO: 732517 - RNA, 63 nt, hsa
gcucccagcuccacuggcccauggggccuccauuguaugaagucagcauaggcugcccaccua

SEQ ID NO: 732518 - RNA, 63 nt, hsa
acacagugcauugcccuuuguuggggguaugcauguaugaacacacaugcuugucggaacgcu

SEQ ID NO: 732519 - RNA, 63 nt, hsa
guuugcaaacccgaaaauaaaagacguucauuauguaugaaaaguaacugauuuguauucugu

SEQ ID NO: 732520 - RNA, 63 nt, hsa
ccacaggacuuaccccuguauguacaggauuuuuguaugaaaguuuuguuugauucugagacu

SEQ ID NO: 732521 - RNA, 63 nt, hsa
gcaggucacaacuuacccuuguguguuuagauguguaugaaauaccuguauacguuagugaaa

SEQ ID NO: 732522 - RNA, 63 nt, hsa
ccaccuuugccuccuaccagugaaccucaucuuuguaugaaagacagcaaccuccuggguaaa

SEQ ID NO: 732523 - RNA, 63 nt, hsa
aguauucaguuagcagacagaaguguaguaugcuguaugaauauuuuauauuaaaauaugaag

SEQ ID NO: 732524 - RNA, 63 nt, hsa
ccaacauccugaaaguuaaagaaaaaaaucuaauguaugaaugugacucaccaauuuuuauca

SEQ ID NO: 732525 - RNA, 63 nt, hsa
uacaagaaccccuuuuaucccuggaagaggcuguguaugaaaccaaugcccaggguuugaagg

SEQ ID NO: 732526 - RNA, 63 nt, hsa
cagaaaugcacuugugccagguauugucccugcuguaugaaaagcuucuuggcaaugaauucu

SEQ ID NO: 732527 - RNA, 63 nt, hsa
uauacuugaacaguuccaacuguacauacauacuguaugaagcuuguccucugacuagguuuc

SEQ ID NO: 732528 - RNA, 63 nt, hsa
caaauaaacaugcagucucagugugcucucgcauguaugaauaucuaguccuuucugugguuc

SEQ ID NO: 732529 - RNA, 63 nt, hsa
aauggaugaauguagacacaaaacagcaacacuuguaugaagauguaaagugcugaacauauu

SEQ ID NO: 732530 - RNA, 63 nt, hsa
cacggggaagguuuuggaguagaaccagggguguguaugaaggggggugacaaggucccccug

SEQ ID NO: 732531 - RNA, 63 nt, hsa
ugacaaaguaauguaauuuuuaccuuauuuaucuguaugaaauuccaguaguuaauuugaaca

SEQ ID NO: 732532 - RNA, 63 nt, hsa
ccccuaaaaaugguaaaucugaucauaucuacauguaugaacuuaacauggaaaauguuaagg

SEQ ID NO: 732533 - RNA, 63 nt, hsa
uaauacugaagagaggggucugcagaaaggauguguaugaagcuuagauaauaauggcuguuu

SEQ ID NO: 732534 - RNA, 63 nt, hsa
uagagguuaugugcaacugaucuguccaguuuguguaugaaauggauuugauaaaguuuuugc

SEQ ID NO: 732535 - RNA, 63 nt, hsa
aaacccaccacaccaccacaaaauggccuuuaguguaugaaaugcacauggaggggauguagu

SEQ ID NO: 732536 - RNA, 63 nt, hsa
aggugagacucuguuucuguuauuuuuaauugcuguaugaaaugugaucagauuauuuuacua

SEQ ID NO: 732537 - RNA, 63 nt, hsa
ucccuuaaaaaaaaaugacacuuggaagaaaaauguaugaaauucagaaauuccgaucaaaga

SEQ ID NO: 732538 - RNA, 63 nt, hsa
uguacuccagcauagcuuggucuuauuucuuacuguaugaaagcuuaacagcaaugugauuua

SEQ ID NO: 732539 - RNA, 63 nt, hsa
ugaguaucacagcguccaacucaguagcuccaguguaugaaaaugucuccagggcuaaaggcu

SEQ ID NO: 732540 - RNA, 63 nt, hsa
agaaacacauucuuauuaauucuucaccuguuauguaugaaggaaucauuccagugcuagaaa

SEQ ID NO: 732541 - RNA, 63 nt, hsa
gcucauaauaaugaaaaaaauagaauuauauuuuguaugaauuguuucuaacaaaccuugauc

SEQ ID NO: 732542 - RNA, 63 nt, hsa
auuuacaagcaaaagaugacaugacgugacaccuguaugaaaaugugaugauugaacucccug

SEQ ID NO: 732543 - RNA, 63 nt, hsa
cugucagguguuaugcacuccauccaucauaacuguaugaaacacauuucauauguaaauaaa

SEQ ID NO: 732544 - RNA, 63 nt, hsa
ugcaaacacauuucauugugagguuuuacccucuguaugaaugaagagaacgcuggaaggcug

SEQ ID NO: 732545 - RNA, 63 nt, hsa
uucgacgggcgccucguggcuuggaaccuccucuguaugaauaaacaguuuucacgucugucc

SEQ ID NO: 732546 - RNA, 63 nt, hsa
gggaagcagaaauccaagcaccaccaaacacaguguaugaaggggggcggucaucauuucacu

SEQ ID NO: 732547 - RNA, 63 nt, hsa
uuccugcauauauauguaugaagggcauguauauguaugaaugagcaaacauauuugaaaguu

SEQ ID NO: 732548 - RNA, 63 nt, hsa
uguaugaaugaacauacauuuccugcauauauauguaugaagggcauguauauguaugaauga

SEQ ID NO: 732549 - RNA, 63 nt, hsa
uuaagaguauaaauagaagggagaguguauauguguaugaaugaacauacauuuccugcauau

SEQ ID NO: 732550 - RNA, 63 nt, hsa
guaaauaaggcuuucuggggaucacagaacuuuuguaugaauaaaagccuuauaaaaccagcu

SEQ ID NO: 732551 - RNA, 63 nt, hsa
cugugggggucccggcaccuggcgugaguuucauguaugaaaacauaaaauugaaaaaaaaaa

SEQ ID NO: 732552 - RNA, 63 nt, hsa
gugggaugcauuuagggggcgggcuugguauguuguaugaauccacucucuguuccuuuugga

SEQ ID NO: 732553 - RNA, 63 nt, hsa
acaaauacauaagagacucacacugaaaaaaguuguaugaauauaaaaauguacuaaaaccuu

SEQ ID NO: 732554 - RNA, 63 nt, hsa
cuugugccucucucuuucucucucuuucuuaauuguaugaaaacacaaagcacaggucaggau

SEQ ID NO: 732555 - RNA, 63 nt, hsa
cacuuguuaucugaaagugugugaaagaaacaauguaugaaaauuuacauuugaucauccggc

SEQ ID NO: 732556 - RNA, 63 nt, hsa
uuaacaucagaaaaauguauacuggggaaaaguuguaugaagguggugaacaugggagacuuu

SEQ ID NO: 732557 - RNA, 63 nt, hsa
ggaaucuccugcaaacuccuacaggagaaaaguuguaugaauguggaaacuuuagaaauugaa

SEQ ID NO: 732558 - RNA, 63 nt, hsa
aacuuuuauaugaugcauuuauucuaaugugauuguaugaacaagugaauaaaaaaccuugga

SEQ ID NO: 732559 - RNA, 63 nt, hsa
aaaaaugauuauaaaauucaugugaaauagaaguguaugaauugcugcgacaauuuugaaaag

SEQ ID NO: 732560 - RNA, 63 nt, hsa
guuaucugaauuccauugaagaaaaccuauuuuuguaugaauaugaccaguuucaagcagagc

SEQ ID NO: 732561 - RNA, 63 nt, hsa
cuucuucuaccuuuauuuauucucagcucugaauguaugaaccugcucaaucaccucaucuua

SEQ ID NO: 732562 - RNA, 63 nt, hsa
ucacuccauccagccucuugacaagcaccgcucuguaugaauuuuacuaguccggguaccuca

SEQ ID NO: 732563 - RNA, 63 nt, hsa
ucaugcaacauaauuugaaauuuguccaugguauguaugaacaguccauuuuaaaauuacuga

SEQ ID NO: 732564 - RNA, 63 nt, hsa
aaauggacaccauccaugaagcagcuggcacaguguaugaagaucugagguauaagcucuugc

SEQ ID NO: 732565 - RNA, 63 nt, hsa
ugauauuacauccacaguaccacaguauuuauguguaugaauuaaggauuaaaagauaaugug

SEQ ID NO: 732566 - RNA, 63 nt, hsa
cccgagcaaccucuccaguuauccucauaugcauguaugaauacugucauuuuucugugcgug

SEQ ID NO: 732567 - RNA, 63 nt, hsa
uuuuagucggauuuuguuuuggaauuuugcuuuuguaugaacacucagcagaaaaguacuuac

SEQ ID NO: 732568 - RNA, 63 nt, hsa
ccaaacacaucagaaaucucacuggagagaaacuguaugaauguagagaaucugggaauaccu

SEQ ID NO: 732569 - RNA, 63 nt, hsa
uaagacaugaaagaacacguacuggggagaaacuguaugaauguaagcaguguucuaaagccu

SEQ ID NO: 732570 - RNA, 63 nt, hsa
uuaaguguaagaaaauuauagagugaguuuguguguaugaauuuguaccuguuuuccgaagaa

SEQ ID NO: 732571 - RNA, 63 nt, hsa
auuugguuaaaaaauaaaauaaaauaauaauaauguaugaagcucuguuuuuuaaacuccuua

SEQ ID NO: 732572 - RNA, 63 nt, hsa
acccucugcacccucaagaaacccccagugccuuguaugaagcccaccccacauggcccacag

SEQ ID NO: 732573 - RNA, 63 nt, hsa
uaauuuuuccuggcuaagaucaugucugaauuauguaugaaaauuauucuauguuuuuauaau

SEQ ID NO: 732574 - RNA, 63 nt, hsa
uuuuauauauaauauauuaaaaaaucaaaagucuguaugaaaauaucagauugcaccccccuc

SEQ ID NO: 732575 - RNA, 63 nt, hsa
uuuuuuuuuaguccccaguagaaaaauacucucuguaugaagaacauucaaaagugugcucaa

SEQ ID NO: 732576 - RNA, 63 nt, hsa
cagacauagucaaagcuuugccgagaaaagaaauguaugaacuauauuugacaacauaaaauc

SEQ ID NO: 732577 - RNA, 63 nt, hsa
uuuuauaguuguauuuuugaccugccuuuuauauguaugaauauuucauaguuuugcauauca

SEQ ID NO: 732578 - RNA, 63 nt, hsa
agccuuugccagucuagccccagcagggcaccguguaugaaugcaguuuggugcuguuuuaga

SEQ ID NO: 732579 - RNA, 63 nt, hsa
aauuguauugucaacaugggucauuuaaaguccuguaugaaccauaaccugcugugguaccuu

SEQ ID NO: 732580 - RNA, 63 nt, hsa
aaauuuugaaaaguaauauuuauuaaauuuuuuuguaugaaaacauggaacaguguggccucu

SEQ ID NO: 732581 - RNA, 63 nt, hsa
aaggguuauguggggcgugggcucuccauaguguguaugaaaagcuuguugacucuagcggcu

SEQ ID NO: 732582 - RNA, 63 nt, hsa
uauuaguugauaaauuaacaguaauaacaagauuguaugaaccgcauggugcuugcaguuuua

SEQ ID NO: 732583 - RNA, 63 nt, hsa
cuaugucuucaacuuucagaccccccauuuauuuguaugaaggcuucaguugccuuaauaaag

SEQ ID NO: 732584 - RNA, 63 nt, hsa
uacuaauugguucuuucuauuuucagagguuauuguaugaaauugucuauugauaguacuuuu

SEQ ID NO: 732585 - RNA, 63 nt, hsa
ugucuagcuaaugugggcagccaccacccacuguguaugaacaagucugaagcaaguuggccu

SEQ ID NO: 732586 - RNA, 63 nt, hsa
ccuugggacuguuaugaacagaaaaugaugcaauguaugaaaaacugcuuugaggagaaaaac

SEQ ID NO: 732587 - RNA, 63 nt, hsa
aauguaugugaugacuguauaaggaggccuguguguaugaauuuauagggaguagaaccgucu

SEQ ID NO: 732588 - RNA, 63 nt, hsa
ggaccuccagcuuccacaaacaccaucuucagcuguaugaaagggacgguuguggugaaguuu

SEQ ID NO: 732589 - RNA, 63 nt, hsa
uauuuauaguuugcauuuuaaauauaaaaauuauguaugaaauauuuauuucagcauuaugug

SEQ ID NO: 732590 - RNA, 63 nt, hsa
uuugguauuuuguggucauguaaaacuucuuuuuguaugaaaauugugagaaauuuaaaucag

SEQ ID NO: 732591 - RNA, 63 nt, hsa
aaaagacacuugguaauagacuucagugaacucuguaugaaugcaguagugugugugcaaaau

SEQ ID NO: 732592 - RNA, 63 nt, hsa
caggugguguucugguaaaauuguuagaauagcuguaugaaggaaaccagugggaggaaauga

SEQ ID NO: 732593 - RNA, 63 nt, hsa
auuuuuucaacuguaucaguagcacaguauuuuuguaugaaaagugggagacuucugaacagu

SEQ ID NO: 732594 - RNA, 63 nt, hsa
uuaaauggucguggccaauuaugucauagaaacuguaugaacaaccagauuuacauagcagag

SEQ ID NO: 732595 - RNA, 63 nt, hsa
ucuuacuuaaacuuggucuucuuucaaauuguuuguaugaagaugcuguacccacuugaacag

SEQ ID NO: 732596 - RNA, 63 nt, hsa
ccgguucucggguccuugaaaguauauacagcuuguaugaaggcuucucugggacagugugcu

SEQ ID NO: 732597 - RNA, 63 nt, hsa
agucuuuaagccauuccagucaugaugaggugauguaugaauacaugcauacauucaaagcac

SEQ ID NO: 732598 - RNA, 63 nt, hsa
gggggguuggguuccugaaugcaccauaaucgcuguaugaaauauuaaaaagucuaaagugaa

SEQ ID NO: 732599 - RNA, 63 nt, hsa
aaauuguggcuggcuucccuuucugucugcuauuguaugaagaauacugauguuuaccuguau

SEQ ID NO: 732600 - RNA, 63 nt, hsa
auaccaauacuuuagaaguuuggucgugucguuuguaugaaaaucugaggcuuugguuuaaau

SEQ ID NO: 732601 - RNA, 63 nt, hsa
ugguuaacacuaagcuuaaguagacuauacaguuguaugaauuuguaaaaguauaugaacacc

SEQ ID NO: 732602 - RNA, 63 nt, hsa
accaaguaagacaucucaaauacaguaguauaauguaugaauuuuguaaguauaagaaauuuu

SEQ ID NO: 732603 - RNA, 63 nt, hsa
uucauuccuuucuauggcugaauaaaauuccauuguaugaauauaccacaauuuguuucaccu

SEQ ID NO: 732604 - RNA, 63 nt, hsa
ucuuacuuaaacuuggucuucuuucaaguuguuuguaugaagaugcuguacccacuugaacag

SEQ ID NO: 732605 - RNA, 63 nt, hsa
aauguccaauuuuaccuuuuacacaaugugagauguaugaaaaucaacucauuuuauucucgg

SEQ ID NO: 732606 - RNA, 63 nt, hsa
acuaauuuaaauguaauaaaggccaaaggccucuguaugaaauuggauuuaaacuuucuuauu

SEQ ID NO: 732607 - RNA, 63 nt, hsa
aaauucaaaccauauccacacacaacaacuaauuguaugaaacuuuuauauccuaauuuaaaa

SEQ ID NO: 732608 - RNA, 63 nt, hsa
acaggagcaucacuaugccugugugaaaguauauguaugaaaguuuaccuaggguugauuccu

SEQ ID NO: 732609 - RNA, 63 nt, hsa
uuguagaggcucaguacuuuuccaaugcacuguuguaugaaugcauuaaaaauuguaaaguac

SEQ ID NO: 732610 - RNA, 63 nt, hsa
aggccaaaucuaugcugugguucuuaugagacuuguaugaagaugcccugauuuguacagauu

SEQ ID NO: 732611 - RNA, 63 nt, hsa
guguaggugcugaaugcuguaaggaguuuagguuguaugaauucuacaacccuauaauaaauu

SEQ ID NO: 732612 - RNA, 63 nt, hsa
ggauuaagggcagccacagugguuucuacuguauguaugaaccgaauggaggaauguuuucaa

SEQ ID NO: 732613 - RNA, 63 nt, hsa
guguuuaugugucucagcuuucuccaaggaauauguaugaaauaacuuaaacugauuuuuucu

SEQ ID NO: 732614 - RNA, 63 nt, hsa
uuaguaggaguucugcaguauagaacaauuacuuguaugaaauuauaccuuugaauuuuagaa

SEQ ID NO: 732615 - RNA, 63 nt, hsa
gaaaaugaacacccuugugauagaauuaccagcuguaugaaacaaauugucccaugcaaauua

SEQ ID NO: 732616 - RNA, 64 nt, hsa
ggucagaggucaaaauuuaugaaaaacaaaaugcuguaugaauggaaaucauuuugcaauugag

SEQ ID NO: 732617 - RNA, 64 nt, hsa
uacaacacccugaccucuuucucuccuccuugauuguaugaauaacccugagaucaccucuuag

SEQ ID NO: 732618 - RNA, 64 nt, hsa
gugugugcauguguguguguguucaugugugcccuguaugaauguggcuggcucccauaucccc

SEQ ID NO: 732619 - RNA, 64 nt, hsa
uuuuggaaaugcccauugccgacuugaauuuuuuuguaugaagucccuccugauuuugugugug

SEQ ID NO: 732620 - RNA, 64 nt, hsa
uucuugauucuuggucuauaauugcagauguuauuguaugaauguaccauaauauauuugagca

SEQ ID NO: 732621 - RNA, 64 nt, hsa; identical to SEQ ID NO: 337391

SEQ ID NO: 732622 - RNA, 64 nt, hsa; identical to SEQ ID NO: 337392

SEQ ID NO: 732623 - RNA, 64 nt, hsa
uuauuuugcauuuguuuuuucaauguguuuacauuguaugaauugagcuuuuugcccacagauu

SEQ ID NO: 732624 - RNA, 64 nt, hsa
ccuaggcccgaaaugacuagcaaauaucauuuucuguaugaauuguggaacaucacaauaaaau

SEQ ID NO: 732625 - RNA, 64 nt, hsa
ugauuuucacugggguuugagucacagcaagcuguguaugaacuuguguuuuguggugacacau

SEQ ID NO: 732626 - RNA, 64 nt, hsa
uuucaccuauauuuuguguacuuuguuacuugcauguaugaauuuuguuauguaaaauauaguu

SEQ ID NO: 732627 - RNA, 64 nt, hsa
acaauuuuauuuuuuucugcaagaaaaaguguaauguaugaaauaaaccaaagucacuuguuug

SEQ ID NO: 732628 - RNA, 64 nt, hsa
cuucagauagguucagcccacccacccccaugauuguaugaaguuuuaaaaaaaacuacagcag

SEQ ID NO: 732629 - RNA, 64 nt, hsa
cauuuugacaugauuccuuuuuccuuuuaaacaauguaugaaagauguauuuuaaaucuaaaua

SEQ ID NO: 732630 - RNA, 64 nt, hsa
gguugagucuuccuugcccccacucagucaucuuuguaugaaucccaugauuuggggguuuuuu

SEQ ID NO: 732631 - RNA, 64 nt, hsa
aaaaacaacugcagaggcuggaacugccacaggcuguaugaaaggccacuuuggaaaggguuug

SEQ ID NO: 732632 - RNA, 64 nt, hsa
uuuaacaguucaaucucaauaagaccucgcauuauguaugaauguuauucacugacuagauuua

SEQ ID NO: 732633 - RNA, 64 nt, hsa
ccuuucuagagugaugagagucaagaagaggggauguaugaacggccaaauucccaugugagag

SEQ ID NO: 732634 - RNA, 64 nt, hsa
uccaguguccugccaggcucuguacuguccuuuguguaugaagaaaaugcuguuagcccucucu

SEQ ID NO: 732635 - RNA, 64 nt, hsa
uguagguagcauccuuugaugcuucuuugaaacuuguaugaauuuggguaugaacagauugccu

SEQ ID NO: 732636 - RNA, 64 nt, hsa
uucaugaguagaaauuucaacaacucuuuuugaauguaugaagaguagcaguccccuuuggaug

SEQ ID NO: 732637 - RNA, 64 nt, hsa
aguuuucagugaucagaagcagcaguuauuugaguguaugaauggaaugaugaucacugugcua

SEQ ID NO: 732638 - RNA, 64 nt, hsa
agguugugccggugccaugcuccucccugugucuuguaugaaaggggccacugugugucuuccu

SEQ ID NO: 732639 - RNA, 64 nt, hsa
cuguccugugcuuggauagucagucaauuauuuguguaugaaacaauguacaaaucaauguuuu

SEQ ID NO: 732640 - RNA, 64 nt, hsa
ucagaugugggagcgacaucaaugaaaucuguacuguaugaaagcuacacaaaaaugggcagac

SEQ ID NO: 732641 - RNA, 64 nt, hsa
aaaguaaaagcuaucaucagcaucaucuuagacuuguaugaaauaaccacuccguuucuauucu

SEQ ID NO: 732642 - RNA, 64 nt, hsa
augucauuauauauuuuuaaaaauguguuucucuuguaugaauuggaaauaaguauaaggaaac

SEQ ID NO: 732643 - RNA, 64 nt, hsa
ccucuugauuugucuggguuaaaaccauuccuuuuguaugaaauguuuugacuuaggaaucauu

SEQ ID NO: 732644 - RNA, 64 nt, hsa
auguuaaaagaaaucucuacauaaaucguauuuguguaugaaaaccuucuauuuugggcuaguu

SEQ ID NO: 732645 - RNA, 64 nt, hsa
aaauauuuuccauuuccguuauuaugcuaauuguuguaugaaauaagugcaauuauacuucucu

SEQ ID NO: 732646 - RNA, 64 nt, hsa
uauaucuauuugagagcagaugccauuuuguacauguaugaaauugguuuuccagaggccuguu

SEQ ID NO: 732647 - RNA, 64 nt, hsa
ugaaaaagggggcaauaaaaggguauguaaaauauguaugaagaaaagguguacaaaaauuugc

SEQ ID NO: 732648 - RNA, 64 nt, hsa
auauaucuucagcuuuggguaggaggaaucuugguguaugaaaucauugcaaauuuacuucauc

SEQ ID NO: 732649 - RNA, 64 nt, hsa
ucuuggggaaagugcaaaggacaaacaucucaauuguaugaagggagaaaggagaauugaaaga

SEQ ID NO: 732650 - RNA, 64 nt, hsa
ucaacaguauugaaauguaauauguauguguucauguaugaaaauuuuuacuccacacaggugu

SEQ ID NO: 732651 - RNA, 64 nt, hsa
cacugcuuuuuuugguuacaguguaugauggauguguaugaaaaaaauguaucuuugggaaaac

SEQ ID NO: 732652 - RNA, 64 nt, hsa
acuacgcugauuugaucuuuacaaauuauaugaguguaugaauuugucacauguaucaccccca

SEQ ID NO: 732653 - RNA, 64 nt, hsa
uacucuccauaccccguguacucaaauucucuacuguaugaauuaugcuuuaaguagaauucag

SEQ ID NO: 732654 - RNA, 64 nt, hsa
caaagcagacauuuuccucacacccaccugcugcuguaugaauagcuguguaucuguuuuucca

SEQ ID NO: 732655 - RNA, 64 nt, hsa
gcaaugcuugguuuggggaguguguggggugggcuguaugaaguagcauuuugggggugggugg

SEQ ID NO: 732656 - RNA, 64 nt, hsa
cucuacuugcuggaaaaucauuguaagucuguuguguaugaaauuuuaggaaaagucuuauaua

SEQ ID NO: 732657 - RNA, 64 nt, hsa
ugacaagaugacucaaaggagacuucaagaacaguguaugaaacacuggaagaggucaccuagg

SEQ ID NO: 732658 - RNA, 64 nt, hsa
uauucugugccauuuacaguuucuaauacuauacuguaugaaauauguauaaauauaugaugcu

SEQ ID NO: 732659 - RNA, 64 nt, hsa
aaacauuuggccuuuuacuauguuauuuuuauuuuguaugaauacauuauccuccuuauuuauu

SEQ ID NO: 732660 - RNA, 64 nt, hsa
aagacuacagcaugacguaguauuaugauugcauuguaugaaagagcaagugacuuucuaagua

SEQ ID NO: 732661 - RNA, 64 nt, hsa
gcagucaaauuggcaccuacuggcucugacuuuuuguaugaagcaugccucaguuuccucauuu

SEQ ID NO: 732662 - RNA, 64 nt, hsa
ggaugcugucaaugcccgagugacacaugagagcuguaugaauugagagaaaaggcaacaagua

SEQ ID NO: 732663 - RNA, 64 nt, hsa
uaggucauuuaggaaaaaacuucuguccaagcuuuguaugaauuaaauucauaaguauaccaaa

SEQ ID NO: 732664 - RNA, 56 nt, hsa; identical to SEQ ID NO: 732223

SEQ ID NO: 732665 - RNA, 64 nt, hsa
aauuacaguuaagaaggagaaacuucuauaagacuguaugaacaaggugauaucuucauagugg

SEQ ID NO: 732666 - RNA, 64 nt, hsa
uccgguuugccccgggauauuauagaaaauuauuuguaugaauaaugaaaauaaaacacaccuc

SEQ ID NO: 732667 - RNA, 64 nt, hsa
accgauugcaggacacaagcacaguuuuaagaguuguaugaacauggagaggacuuuugguuuu

SEQ ID NO: 732668 - RNA, 64 nt, hsa
acuggagaggaaaugacugcugaaauaaggcgauuguaugaauauuuaaaaugccuggaacacu

SEQ ID NO: 732669 - RNA, 64 nt, hsa
aagguagaccuaaauucaauaugacugguuuccuuguaugaaaaggagaggacacagagacaga

SEQ ID NO: 732670 - RNA, 64 nt, hsa
cuugacauuguagagcuucuggcacuuggagacuuguaugaaagauggcugugccucugccugu

SEQ ID NO: 732671 - RNA, 64 nt, hsa
uaguaaguaacugagagcauaaaauaaaccugacuguaugaagucaauuuaagugaugagaaca

SEQ ID NO: 732672 - RNA, 64 nt, hsa
gggugaagggauguuguuucuuaaauaccuaccauguaugaagcuauacacagcauauaccgaa

SEQ ID NO: 732673 - RNA, 64 nt, hsa
uucaacguuuguuccuguguguacaauuguacuuuguaugaacagcuuuaucauuuuuauaggc

SEQ ID NO: 732674 - RNA, 64 nt, hsa
auauuauucaaaaaaauguacuggugugauaucuuguaugaaugaucauuuaaauacaguacau

SEQ ID NO: 732675 - RNA, 64 nt, hsa
aauauuauagugcauuuuagccuaauucauuaucuguaugaaguuauaaaaguagcuguagaug

SEQ ID NO: 732676 - RNA, 64 nt, hsa
ucuucccuucuucccuauugaaccuugauuaaaauguaugaauacaauacuuggauuuuuuuuu

SEQ ID NO: 732677 - RNA, 64 nt, hsa
ccacuuacauccaaggcacugucacuacggugauuguaugaaguuugaaugcugcaaguuauga

SEQ ID NO: 732678 - RNA, 64 nt, hsa
ucucguuuaagaggcagcuagaaucuuuaccauauguaugaauuuguauaauuucauuuuugga

SEQ ID NO: 732679 - RNA, 63 nt, hsa; identical to SEQ ID NO: 732238

SEQ ID NO: 732680 - RNA, 64 nt, hsa
gugucagcgggugacguguguucuuuugaguccuuguaugaauaaaaggcuggaaaccuacagc

SEQ ID NO: 732681 - RNA, 64 nt, hsa
agaauuuaauuuuuaaaagacuuugauguguuuuuguaugaaguacuuuuaacguauguauuuc

SEQ ID NO: 732682 - RNA, 64 nt, hsa
uaaagaauaaaauauuuuggacaaugccgauaaauguaugaaguuaguauccacaucauaaauu

SEQ ID NO: 732683 - RNA, 64 nt, hsa; identical to SEQ ID NO: 337393

SEQ ID NO: 732684 - RNA, 64 nt, hsa; identical to SEQ ID NO: 337394

SEQ ID NO: 732685 - RNA, 64 nt, hsa
aucuguauuaaugcuugaauauuacuggauaaauuguaugaagaucuucugcagaaucagcaug

SEQ ID NO: 732686 - RNA, 64 nt, hsa
auaaauuagaaaaugaaaaaugugugaauaacauuguaugaaauaaaccuggucuuguguuuuu

SEQ ID NO: 732687 - RNA, 64 nt, hsa
uucauagacauuuuacugagaaaugaccugcauuuguaugaagugaacugagcgucacacccug

SEQ ID NO: 732688 - RNA, 64 nt, hsa
guggaggcagggcaaacguuuauaagggcuguuauguaugaaaugugccucugacccaaaucca

SEQ ID NO: 732689 - RNA, 64 nt, hsa
cccuuugucacaguguugucgugaagaucagauauguaugaaugcagucaaauaaacuaaaaac

SEQ ID NO: 732690 - RNA, 64 nt, hsa; identical to SEQ ID NO: 337395

SEQ ID NO: 732691 - RNA, 64 nt, hsa; identical to SEQ ID NO: 337396

SEQ ID NO: 732692 - RNA, 64 nt, hsa
cgucauguugugggaucuuuagaaaacuucauacuguaugaauaagaaaauaaaauauuugaaa

SEQ ID NO: 732693 - RNA, 64 nt, hsa
aauguguuuacguaucugacaaguuguacauuuguguaugaacugacauaaaaugugaaagccu

SEQ ID NO: 732694 - RNA, 64 nt, hsa
uuuccuccuuagaagaacagaccuaacuagcgaauguaugaaugaaaaugcaucuauuucagag

SEQ ID NO: 732695 - RNA, 64 nt, hsa
accaggugugcacuguucacugcagcccauuugcuguaugaacugugguuguugugugcccaau

SEQ ID NO: 732696 - RNA, 64 nt, hsa
cucccaauaauuaucucuuucccuggaaucaacuuguaugaaaccuugucaaaauguacuccac

SEQ ID NO: 732697 - RNA, 64 nt, hsa
uuuguacaguaauauguuuaauguucauuuucucuguaugaaugugauugguaacuaggauaug

SEQ ID NO: 732698 - RNA, 64 nt, hsa
auuuuguguuuaauuuguguuuuuuuuuuccagcuguaugaaaugggcuuucugaaguuuaaau

SEQ ID NO: 732699 - RNA, 64 nt, hsa
cuuuguauuuuuauuaucagauggggcaacauauuguaugaagcauauguagcacuucacagca

SEQ ID NO: 732700 - RNA, 64 nt, hsa
cuuuuucucuaagguucuuuuuuuuuauucaaacuguaugaaauggcaaagugaggcucugggg

SEQ ID NO: 732701 - RNA, 64 nt, hsa
gacagaaauggcuauuaaaaauguuuuaaccucauguaugaacugaauuuaaaaaaccacuaaa

SEQ ID NO: 732702 - RNA, 64 nt, hsa
acacuggcaaugacccacuccccuuggaaaugcauguaugaacuacccuaugaaauguaagcug

SEQ ID NO: 732703 - RNA, 64 nt, hsa
aguauucaaauaagaucaggaagccaauuuucuauguaugaauaugcuuuaaccuaggauuuca

SEQ ID NO: 732704 - RNA, 64 nt, hsa
aaaaugugaaugugcugcguuuuguuuucuuuacuguaugaaaacaggaaaauaaaagagaaau

SEQ ID NO: 732705 - RNA, 64 nt, hsa
uuauagcaaagaauauaaauuugcuguugauuuuuguaugaauuuuuucacaaaaagauccuga

SEQ ID NO: 732706 - RNA, 64 nt, hsa
uuucuauaauagagcucuaaaaacaugccaccaguguaugaauaagggaaagauuaauuuuggc

SEQ ID NO: 732707 - RNA, 64 nt, hsa
uucagcaggguguguguguguguguguguguguguguaugaaugguauauuuauuacauuauuu

SEQ ID NO: 732708 - RNA, 64 nt, hsa
aucuggaaacaauacauuguaaauaguuuuucauuguaugaaguaguguucacauuaaaaagau

SEQ ID NO: 732709 - RNA, 64 nt, hsa
aacaugauguuugacuguaaucucaucacggauauguaugaauuuuuacagguucguuuuugaa

SEQ ID NO: 732710 - RNA, 64 nt, hsa
acuguguuaacuuagugacauuuaaugcccaauauguaugaauagaucuaagccauuuaauuuu

SEQ ID NO: 732711 - RNA, 64 nt, hsa
gguccacccccauaaaacuguaagacaagccuccuguaugaagccagaagcacaagugccuuca

SEQ ID NO: 732712 - RNA, 64 nt, hsa
gauuuguuaugggaguagaauauauauugaauuuuguaugaagaacuauuuguuuaaauuauau

SEQ ID NO: 732713 - RNA, 64 nt, hsa
uaaaagguauaaacaccaaaaaaaaaauuaacauuguaugaagauggaaaauaagaagaugcac

SEQ ID NO: 732714 - RNA, 64 nt, hsa
aucacuuagcaaacacauguugacuuuuaacugauguaugaauauuaauacucuaaaaauagaa

SEQ ID NO: 732715 - RNA, 64 nt, hsa
cugugcuuuuggucccuggaaacaaauccgccuauguaugaagcuaguugauuuccaguugcac

SEQ ID NO: 732716 - RNA, 64 nt, hsa
ugcaccucucugcuuaaucuuuucuaaaaucgccuguaugaaaaauaccucgcuggauggaaaa

SEQ ID NO: 732717 - RNA, 64 nt, hsa
uuauaaaacccuaacagcggugauaucauuagacuguaugaaucaguuuuauuaccuaguguac

SEQ ID NO: 732718 - RNA, 64 nt, hsa
uccacaaggcauagccuccaaguauacucucaaauguaugaagcaacuggggugggcagaagac

SEQ ID NO: 732719 - RNA, 64 nt, hsa
ggauuauaccccauuggaggcuuuuaauuuuauuuguaugaauuuuccaggauuucauuaaaaa

SEQ ID NO: 732720 - RNA, 64 nt, hsa
ugauuguccaguuaucauacauuugacuuucaaauguaugaaccagcauguaccccauggauuu

SEQ ID NO: 732721 - RNA, 64 nt, hsa
uaauuuggaaagguuauuuacauggcagaauacauguaugaauauuaaaguaauaugaaugaaa

SEQ ID NO: 732722 - RNA, 64 nt, hsa
uuuuuaguagguuuuguuuaaccucugugcaguuuguaugaaugaauugcuauacauuuauaag

SEQ ID NO: 732723 - RNA, 64 nt, hsa
ugugauucuguguggccuuuuuggggcuggaaaauguaugaauucuucaacugucuuacaagag

SEQ ID NO: 732724 - RNA, 64 nt, hsa
acgaaauuuuacuacgugugauuuaacugcuauuuguaugaaguuguauuggauuacauuaagu

SEQ ID NO: 732725 - RNA, 64 nt, hsa
cuguauauugauugagacuaucuaaacucauaccuguaugaauuaagcuguaaggccuguagcu

SEQ ID NO: 732726 - RNA, 64 nt, hsa
aaacagaucuuuucauucacgugcuuucugggucuguaugaacauaaguaagacacaagguacu

SEQ ID NO: 732727 - RNA, 64 nt, hsa
cuagagucacuguauaagggucuaugaguagcuguguaugaauaaauauuaccugucuaccuca

SEQ ID NO: 732728 - RNA, 64 nt, hsa
cuaaaggacagaagugcaauuuagcuuaaauggguguaugaauggucuagaaacauuucuauuu

SEQ ID NO: 732729 - RNA, 64 nt, hsa
auauguauguaaaacuguuuccugaacaauaagauguaugaacggagcagaaauaaauacuuuu

SEQ ID NO: 732730 - RNA, 64 nt, hsa
uuucacaaguucaaucuguuuuucauguaaauuuuguaugaaaaaucaaugucaaguaccaaaa

SEQ ID NO: 732731 - RNA, 64 nt, hsa; identical to SEQ ID NO: 337397

SEQ ID NO: 732732 - RNA, 64 nt, hsa; identical to SEQ ID NO: 337398

SEQ ID NO: 732733 - RNA, 64 nt, hsa
agagaaacucuauuuugaugucaauauagauuacuguaugaaguagcuuugugucuguuaccug

SEQ ID NO: 732734 - RNA, 64 nt, hsa
gaaauauauauguauguguauauauauacauguauguaugaaauauauauaugugcgugugugu

SEQ ID NO: 732735 - RNA, 64 nt, hsa
uuuugcuucgcgagcccugguguggacuguggucuguaugaaucguguguaacuguggugaggg

SEQ ID NO: 732736 - RNA, 64 nt, hsa
uuugguuaaaaucauguuugugacuguaaccauuuguaugaauuauuuuaaagaaauaaaaauc

SEQ ID NO: 732737 - RNA, 64 nt, hsa
ccaauucuacauguauuguugugguuuuauucauuguaugaaaauuccugugauuuuuuuuaaa

SEQ ID NO: 732738 - RNA, 64 nt, hsa
gaaauuuuguucucugagccaaaguuuaacucauuguaugaauucuuuuucaugguaguucauu

SEQ ID NO: 732739 - RNA, 64 nt, hsa
gugugaaauccagcaacugaauuguggucacgauuguaugaaaguucaagaacauaugucaguu

SEQ ID NO: 732740 - RNA, 64 nt, hsa
auuccagucuugcugguaauuuuguacaguauaguguaugaauugcugugcugcaaagccaaac

SEQ ID NO: 732741 - RNA, 64 nt, hsa
uagcagcuccaugcucgcuacgucuugaaccuuuuguaugaaaccaagaaacaucugguacagc

SEQ ID NO: 732742 - RNA, 64 nt, hsa
uagggaaaauuauuccauguaaacauuucaacucuguaugaaaauguuaaauauuguaagaaag

SEQ ID NO: 732743 - RNA, 64 nt, hsa
uuagauuaguuuuguuggggaagaauuauuauguuguaugaacaaccccacugaagcauuauac

SEQ ID NO: 732744 - RNA, 64 nt, hsa
aaauugcauuguguuacagagcuagaaaauuuuauguaugaaaaacgauaauagccuuacacug

SEQ ID NO: 732745 - RNA, 64 nt, hsa
uucuuaucccaaaauucuagaaaguaauaaauucuguaugaauaagcauaaaaaauaaauaaau

SEQ ID NO: 732746 - RNA, 64 nt, hsa
guuuuuuaauucuaauguucaaaucacugcgugcuguaugaaucuagaaagccuuaauuuacua

SEQ ID NO: 732747 - RNA, 64 nt, hsa
uaguguuuuuuuaaccauuguuaaucagcuuuuguguaugaaagacacaguaaaauuucuuucu

SEQ ID NO: 732748 - RNA, 64 nt, hsa
gcuguucaaguuaaucuagaaauuuauucaauucuguaugaacaccuggaagcaaaaucauagu

SEQ ID NO: 732749 - RNA, 64 nt, hsa
aaggugagaauaagaaauagccaacuaguuaaaauguaugaaaagaaaacuuuccccugcugua

SEQ ID NO: 732750 - RNA, 64 nt, hsa
uaauaauuuacagguucuuaggcuccauccuguuuguaugaaauuauaaucuguggauuggccu

SEQ ID NO: 732751 - RNA, 64 nt, hsa
ucuuuggcuuucagaaagauacagugauaauguguguaugaaucagucacaaugaauuuuacuu

SEQ ID NO: 732752 - RNA, 64 nt, hsa
auuagccagugggggcuuaugguugugugaaccauguaugaaaauccagugggccccaaccaag

SEQ ID NO: 732753 - RNA, 64 nt, hsa
agugacaagugacaaaaucuauuuagguucucuguguaugaauccugauuuuaacugcuaggau

SEQ ID NO: 732754 - RNA, 64 nt, hsa
cuaagaaguauuuuacccacuggugguuuguguguguaugaagguaaauauuuauauauuuuua

SEQ ID NO: 732755 - RNA, 64 nt, hsa
caggguugaggagacuguuggggggcauuuauaauguaugaaaguuaaggaagggggugaggau

SEQ ID NO: 732756 - RNA, 64 nt, hsa
uuaaaaauguuuuuuaguucuagcuacuaaaaccuguaugaacucaaauggauaggcaucuugu

SEQ ID NO: 732757 - RNA, 64 nt, hsa
uauauaucuguauuuuacuacuguuaaguuucuuuguaugaacuguguuguuaguacucagaua

SEQ ID NO: 732758 - RNA, 64 nt, hsa
uacaccauaugccucauuuuaucauagccuauuguguaugaaagauguuuguacaaugaauuga

SEQ ID NO: 732759 - RNA, 64 nt, hsa
ggcugagaaauuguuuugcaaauggaucuauuuuuguaugaaaaaaaaaauuuuuuuaaagaaa

SEQ ID NO: 732760 - RNA, 64 nt, hsa; identical to SEQ ID NO: 337399

SEQ ID NO: 732761 - RNA, 64 nt, hsa; identical to SEQ ID NO: 337400

SEQ ID NO: 732762 - RNA, 64 nt, hsa
caauaccaauacuuaggauuuuggucuugguguuuguaugaaauucugaggccuugauuuaaau

SEQ ID NO: 732763 - RNA, 64 nt, hsa
uuaguuaggcuucugagcuugcaaucauauugaauguaugaagagcgaaaucaaauucuuauuu

SEQ ID NO: 732764 - RNA, 64 nt, hsa
uugagguauauaugauuuuuaacuguauuagggguguaugaaccaguuuaaaaacgagguuuua

SEQ ID NO: 732765 - RNA, 64 nt, hsa
ucauguaccaagguuuugcuauaaaaguuuugucuguaugaauaauguggcuuuaguaaauaau

SEQ ID NO: 732766 - RNA, 64 nt, hsa
gagauuuguggguuuugugccuuauaaauggaaauguaugaacacaauauaugcucauguagaa

SEQ ID NO: 732767 - RNA, 64 nt, hsa
gccugagaaaccaaacacagcuaaugcuaugggguguaugaauaugucaaguuuaggucauuua

SEQ ID NO: 732768 - RNA, 64 nt, hsa
auguuugauauuaugaacaggaaacauaauuuaauguaugaauagaugugaauuugggauuuca

SEQ ID NO: 732769 - RNA, 64 nt, hsa
gugcuuauugucucauuuuguagucuuuuaaaguuguaugaacccuuaauuugaagaacuaacu

SEQ ID NO: 732770 - RNA, 64 nt, hsa
uacuuggucugcuucaaggaggucgaccuucuaauguaugaagaaugggaugcauuugaucuca

SEQ ID NO: 732771 - RNA, 64 nt, hsa
cuuuugaaaggacuauuauccucuaaaauguauguguaugaagauccuggcuugcagcucggga

SEQ ID NO: 732772 - RNA, 64 nt, hsa
cucauggggacuccacuccugccuggguuuacucuguaugaagaggccacugguauccugccau

SEQ ID NO: 732773 - RNA, 64 nt, hsa
aaacaguagaaccuguguaaccucaaggagauauuguaugaaucucacuagccgcagcuuauaa

SEQ ID NO: 732774 - RNA, 64 nt, hsa
agggcugccuccaagaggaaccucugauuuauuuuguaugaaauauaugugaaaggauaugaau

SEQ ID NO: 732775 - RNA, 64 nt, hsa
uucuguacaaauauuagcacuaaauguuuaaauauguaugaaugccagaaauuugucaguucau

SEQ ID NO: 732776 - RNA, 64 nt, hsa
acauauaauuuauauaugaaagcuuacgcuauauuguaugaauuauuugcaucuuucaguggcc

SEQ ID NO: 732777 - RNA, 64 nt, hsa
aaaucuacuacuuuaaauguaacaucaacucaguuguaugaaucuggaguguaauauuuauauu

SEQ ID NO: 732778 - RNA, 64 nt, hsa
auuaucccaaguacuccauauaucugucugugguuguaugaaaugaaaaaaggggcagagugca

SEQ ID NO: 732779 - RNA, 64 nt, hsa
cuguauauugcacaacaguccucaaauacacugauguaugaaacuauucauacaucaagcagca

SEQ ID NO: 732780 - RNA, 64 nt, hsa
auauuguaacaaauucaauauccuagucuucauuuguaugaaugguuuguauuguacauaguuu

SEQ ID NO: 732781 - RNA, 64 nt, hsa
agcuaaacguggaagaagggaaguuuucuaguauuguaugaaaauguuuaaauauuuucaagga

SEQ ID NO: 732782 - RNA, 64 nt, hsa
ucauaaugcaguacauuucaaaauuuuuagauuauguaugaacuuagauuuuuaaacauguuuu

SEQ ID NO: 732783 - RNA, 64 nt, hsa
cugguggaccuguaauauccacauugugaagcuguguaugaaauucaacuauaauaugaauaaa

SEQ ID NO: 732784 - RNA, 64 nt, hsa
uagcauuaagagauguaaaugauaaaggaauuauuguaugaaauauuacaaagcguagacuaug

SEQ ID NO: 732785 - RNA, 64 nt, hsa
ucucauaaaauaggauuugaaggaugaaauuaauuguaugaagcaaugugauuauaugaagaga

SEQ ID NO: 732786 - RNA, 64 nt, hsa
agcuuaaggcuguaacucuucuaucggggcuaauuguaugaauaggugucaguauguugaagau

SEQ ID NO: 732787 - RNA, 64 nt, hsa
gacaauugaaaaaaacuauuggaauaauagcacuuguaugaaauucaguuuuggaacuaaacag

SEQ ID NO: 732788 - RNA, 64 nt, hsa
auuguauacugucuuuuaauccuucauuguuucauguaugaaguuuuuaaucacccccuaaccc

SEQ ID NO: 732789 - RNA, 64 nt, hsa
ggauguaauguacauagaugacauuaagaaaauuuguaugaaauaauuuagucaucaugaaaua

SEQ ID NO: 732790 - RNA, 64 nt, hsa; identical to SEQ ID NO: 337401

SEQ ID NO: 732791 - RNA, 64 nt, hsa; identical to SEQ ID NO: 337402

SEQ ID NO: 732792 - RNA, 64 nt, hsa
cuggcuagugcuuacauuugcucaaaaagcauguuguaugaagcugacugccaccaugcuaaag

SEQ ID NO: 732793 - RNA, 64 nt, hsa
ggagugauagcuacuguagaaaggaaauagacuuuguaugaacucuuuaaguugaaaaguaaaa

SEQ ID NO: 732794 - RNA, 64 nt, hsa
ggcugauuuaaaguugugcaggaaacaucuucuguguaugaagcaaaugucgauguuuugaaaa

SEQ ID NO: 732795 - RNA, 64 nt, hsa
uaaaauacugcaggaugcuuagugcucaguguuauguaugaacuuguggacuuuacaaugcagg

SEQ ID NO: 732796 - RNA, 64 nt, hsa
cccccuucccccuuuuuugucccccaacuugagauguaugaaggcuuuuggucucccugggagu

SEQ ID NO: 732797 - RNA, 64 nt, hsa
acauugucuuauuuuauuucuguaaaauauuagcuguaugaauaugauuuaauuaacaagaaaa

SEQ ID NO: 732798 - RNA, 64 nt, hsa
cugaaaacaggcauguggaaacacaaaaaugauguguaugaaaagcaccugaugaaaauauuug

SEQ ID NO: 732799 - RNA, 64 nt, hsa
ggccggacgcugugucaccccucauucuggccgcuguaugaagcagccucgggcaggggucuca

SEQ ID NO: 732800 - RNA, 64 nt, hsa
uccuaccggaauauaauuaaagggagaaauacacuguaugaaguauauguugauacuaugacau

SEQ ID NO: 732801 - RNA, 64 nt, hsa
ugauucuuguagcuacuacauuccagacuggaaauguaugaaugauaaucaacauaaugcugau

SEQ ID NO: 732802 - RNA, 64 nt, hsa
aagcagaaguuuucagggcauuaaauauauguuguguaugaaguaucucaaacuggaacauaaa

SEQ ID NO: 732803 - RNA, 64 nt, hsa
caacaugaugcuucuugcauauuauccagauuauuguaugaaguugugucuauaauuauuacca

SEQ ID NO: 732804 - RNA, 64 nt, hsa
uuauuucuguucaugucuucuacuuuucuacuccuguaugaauaaaauauugauuugauuacag

SEQ ID NO: 732805 - RNA, 64 nt, hsa
ugggaccccccuaauguaauggauuucucaauacuguaugaauaaugaaacuuacuaucauaaa

SEQ ID NO: 732806 - RNA, 64 nt, hsa
gccuauaacuuuugguaucuacuucuacauccaauguaugaauuaagcuguaagauaauguugc

SEQ ID NO: 732807 - RNA, 64 nt, hsa
gcugcuaggauccuacauaggauuucuauagaaauguaugaaauucuguggucacugcauguca

SEQ ID NO: 732808 - RNA, 64 nt, hsa
uauuuuugaaccugcauuucuuucuuauguguaguguaugaagaaagacuagaauguagcuuua

SEQ ID NO: 732809 - RNA, 64 nt, hsa
uaaaaauguuguauaauaguguaauacuuuucuuuguaugaaaauguccucuucuucaaaggua

SEQ ID NO: 732810 - RNA, 64 nt, hsa
aucaaucuacuuaucaucuugggucuuugaguauuguaugaaagauccuucgugcacaccacac

SEQ ID NO: 732811 - RNA, 64 nt, hsa
aaagaaauaugaguaauucuacauguaguagagguguaugaagaucauauaacaauuaaacaua

SEQ ID NO: 732812 - RNA, 64 nt, hsa
auuuugauguguuaaguugaagaaagguaacucguguaugaaccccgagccauuucccuguugu

SEQ ID NO: 732813 - RNA, 64 nt, hsa
uuccaaaaguggguucuaaaugccuggcugcaucuguaugaaaucaaggcacacuccaggaaga

SEQ ID NO: 732814 - RNA, 64 nt, hsa; identical to SEQ ID NO: 337403

SEQ ID NO: 732815 - RNA, 64 nt, hsa; identical to SEQ ID NO: 337404

SEQ ID NO: 732816 - RNA, 64 nt, hsa
guaaauuuauuguguauggaucaaaagugaauaauguaugaaugagagcuguaagaaggauuuu

SEQ ID NO: 732817 - RNA, 64 nt, hsa
aaauuagaaaaagccaggaaugaguuacaaacaguguaugaagcauucguccagcagcaccagg

SEQ ID NO: 732818 - RNA, 64 nt, hsa
aaccaagcgccuccacgggaggcgagggaggcucuguaugaaacagaagagcagggacauaaag

SEQ ID NO: 732819 - RNA, 64 nt, hsa
guggaccccgauuggugagggcucugcauaugccuguaugaaggagauacaggugugugugcac

SEQ ID NO: 732820 - RNA, 64 nt, hsa
auuuguguuuauuuuuauaugauugaaugaguucuguaugaaacugagauguugucuauagcua

SEQ ID NO: 732821 - RNA, 64 nt, hsa
guuuguuucuuuuuauuaccaaguacuauuucauuguaugaauauaucacaguuuauccauucu

SEQ ID NO: 732822 - RNA, 64 nt, hsa
cagaaugaaaaaugaaagaugauuugcaaugggauguaugaauacagcagcaagaaaaaaaaau

SEQ ID NO: 732823 - RNA, 64 nt, hsa
gacagagcuucucugggaugcugggauucuugccuguaugaaugcaucaaguauucauuuauug

SEQ ID NO: 732824 - RNA, 64 nt, hsa
aucucuuuguuuuuaaacaaaagauauuauuuuguguaugaaucuaaaucaagcccaucuguca

SEQ ID NO: 732825 - RNA, 64 nt, hsa
aauauuaccaccucucuuuguaauuuacuuuacuuguaugaauuuaacaucucuagcauguauc

SEQ ID NO: 732826 - RNA, 64 nt, hsa
uaacagggaagggcuggggugugaaaaagaagauuguaugaaaaccauugguaauuuuuauuuu

SEQ ID NO: 732827 - RNA, 64 nt, hsa
gugaagggcuauagccaaaguauuuuuacuagccuguaugaaaucacuaguccuuauuuuuaaa

SEQ ID NO: 732828 - RNA, 64 nt, hsa
ugcccccuggaucuuggacacuuacagauugagcuguaugaauucagcgggucucacuccagag

SEQ ID NO: 732829 - RNA, 64 nt, hsa
cauuuagaagcugcuuuuccuaagacuucuaguauguaugaauucuuugaaaauuauauuacuu

SEQ ID NO: 732830 - RNA, 64 nt, hsa
aauagugauguucuuuugcaaggcauagaacauuuguaugaaaagacauuuaguaugcuuugaa

SEQ ID NO: 732831 - RNA, 64 nt, hsa
ucaccgacacugagcaguggaaaggggcuauauguguaugaauagaccacauugaaggagcaca

SEQ ID NO: 732832 - RNA, 64 nt, hsa
ucacuucuguguuauaauggaagguuuuuugugauguaugaaacuuguguuuuuuauauauaaa

SEQ ID NO: 732833 - RNA, 64 nt, hsa
uuuacugaauccuggugugaaagcauaucagauauguaugaacugcuacugcuguacuuccgau

SEQ ID NO: 732834 - RNA, 64 nt, hsa
gcaacuuuuuauuuaaaaaagcucugcacugccauguaugaaagucucuuuaugauguuuguuu

SEQ ID NO: 732835 - RNA, 64 nt, hsa
accaaauggaccuucugggacaagcugagcaagcuguaugaacgccacguuugugaagagcuga

SEQ ID NO: 732836 - RNA, 64 nt, hsa
aguguaaaaagucacagcuaaaugaucucacuccuguaugaauaagcaagugcuuuuuuagugu

SEQ ID NO: 732837 - RNA, 64 nt, hsa
uuuuauguaaucucuggugcugcuuuccagucacuguaugaagugucuccccaacacuagcaaa

SEQ ID NO: 732838 - RNA, 64 nt, hsa
gauuuauuuaucucauuaacuuaaaacagcuauguguaugaaauaggucacaacagaacuugaa

SEQ ID NO: 732839 - RNA, 64 nt, hsa
guucacauguguggguccaacacuuacuaccugguguaugaaauuggaccugaacuguuggauu

SEQ ID NO: 732840 - RNA, 64 nt, hsa
aagcuguugguugaaaucauaauuaaugcguuacuguaugaaccacaaaacagcacuauuuauu

SEQ ID NO: 732841 - RNA, 64 nt, hsa
uguuacuucuucaucaguuuuuccuuuugaaagguguaugaauucauuacauuuuuauucuaau

SEQ ID NO: 732842 - RNA, 64 nt, hsa
ccaucauuaaauguguacugugaagagauuaauauguaugaagggcuuuaccaaaguccacuaa

SEQ ID NO: 732843 - RNA, 64 nt, hsa
gaaauuguacguaauguauuuaaaucaacgcaaauguaugaauaacaaauacaguucugaccuu

SEQ ID NO: 732844 - RNA, 64 nt, hsa
aaagcagguaaauugucgggggagagaguuagcauguaugaauguaaggaugagggaagcgaag

SEQ ID NO: 732845 - RNA, 64 nt, hsa
auuuugacacagcaacuuccuguagugagcacuuuguaugaaucguggacuuccuguucucaag

SEQ ID NO: 732846 - RNA, 64 nt, hsa
gaaauaauauaaucuuaguucaguaacuauuauguguaugaagauguugcacauuaagucucag

SEQ ID NO: 732847 - RNA, 64 nt, hsa
gcuuuaguagauauuaccaguuuuccuaagugauuguaugaauuuaugcuccuaccggcaaugu

SEQ ID NO: 732848 - RNA, 64 nt, hsa
ucagcauucauugacacauagcucuaaugacauauguaugaaaaaccauacacuggaugaccua

SEQ ID NO: 732849 - RNA, 64 nt, hsa
uaacuugcccugagacuccagaacuaaauccuuauguaugaaauuaccuacaaugaauguuaug

SEQ ID NO: 732850 - RNA, 64 nt, hsa
ucuagagaaauaagaucuuuuuugucaguuuguuuguaugaaacuaaagccuuuauuuguuaau

SEQ ID NO: 732851 - RNA, 64 nt, hsa
ccaauuuucgaagucaguaaaaaaacacaaaaacuguaugaaugacuuuguaaauuuuguucua

SEQ ID NO: 732852 - RNA, 64 nt, hsa
gaggaauaucuacagcagugaugcuugaaauuuuuguaugaauuauuuugucguccuacccuuu

SEQ ID NO: 732853 - RNA, 64 nt, hsa
aaaaugugacucucccagagaagaagccgcuggcuguaugaaacuugacggcgcuuuuguaagg

SEQ ID NO: 732854 - RNA, 64 nt, hsa
acugguuggaagaauauaguauugcagcaaauccuguaugaaagagagaugugggcuuccuuuu

SEQ ID NO: 732855 - RNA, 64 nt, hsa
gggagagggagggaugcugauugauauuucacauuguaugaaauaccauguuugaaacucauag

SEQ ID NO: 732856 - RNA, 64 nt, hsa
uacacuccagcauaucgggugaguuuuagggauguguaugaauauuuaaaucuuuuaauuucag

SEQ ID NO: 732857 - RNA, 64 nt, hsa
acuccagcagguaggggcacagugaauguguguauguaugaaggccacaucaacuuuauguagc

SEQ ID NO: 732858 - RNA, 64 nt, hsa
auguugcagagcccuuacuuaaauccuucacugguguaugaauacuuugucauaaugcugcuuu

SEQ ID NO: 732859 - RNA, 64 nt, hsa
agugcuauaguaaauuacaaagaaauagguagauuguaugaacauacccacaaaugccuaugau

SEQ ID NO: 732860 - RNA, 64 nt, hsa
augaaauuauauguguguggugugugaauaaauauguaugaauauauggucuguguuuucuuuu

SEQ ID NO: 732861 - RNA, 64 nt, hsa
gcccucaaggguguguauauuguauaggggcaacuguaugaaaaauuggggaggagggggccgg

SEQ ID NO: 732862 - RNA, 64 nt, hsa
uauucacucauguguuccagauguauucuaauuguguaugaaauguauguacacauaagugugu

SEQ ID NO: 732863 - RNA, 64 nt, hsa
cuggguucaaauucugaaacugucacuuauuaccuguaugaacaugggcaaauuaucuaaucuc

SEQ ID NO: 732864 - RNA, 64 nt, hsa
cgugccauucuccccagacuuuuuuuguacuuaauguaugaaagauccaaacuaauauugcugu

SEQ ID NO: 732865 - RNA, 64 nt, hsa
caaauuguaaacuuaaaauauauauaaaauuuauuguaugaaaauuaagccucaauaaacguga

SEQ ID NO: 732866 - RNA, 64 nt, hsa
uuucugaaaaauuguaaaucugaucauaucaacauguaugaacuuaaaauauggagaauguuau

SEQ ID NO: 732867 - RNA, 64 nt, hsa
aacuguagcaguguguucugggcaguaucuguaauguaugaaauagagucuggaauagguuauc

SEQ ID NO: 732868 - RNA, 64 nt, hsa
uauaguguguacguauaccacauauacauauacuuguaugaagauauguguaaaauguuuuuac

SEQ ID NO: 732869 - RNA, 64 nt, hsa
uugguuuauuuuauuucccaccuuugugugaguguguaugaaagagaagaaaaugcaauuuuua

SEQ ID NO: 732870 - RNA, 64 nt, hsa
ccugccuuauuguuuguuuuuauuuauggcagaauguaugaaauccguuuuguaguuucaaauu

SEQ ID NO: 732871 - RNA, 64 nt, hsa
cucuucucugucgcccugaagggucacuguauucuguaugaaugcauggcaugauacaacuaau

SEQ ID NO: 732872 - RNA, 64 nt, hsa
ugguucaucauggugacagcaugaaaggaaugaguguaugaaaaggugaaggugggagcaccuu

SEQ ID NO: 732873 - RNA, 64 nt, hsa
gccucgauggaugcgagugcggcggucuucagaauguaugaaggaugaccccaucacucucuuu

SEQ ID NO: 732874 - RNA, 64 nt, hsa
ugaucucuauuuuaaaacuagcuuuuuaagcagcuguaugaaauaaaugcugagugagccccag

SEQ ID NO: 732875 - RNA, 64 nt, hsa
ucaaugugaauucuuacgaauguacaacacaaacuguaugaagccaugaaggaaacagaggggc

SEQ ID NO: 732876 - RNA, 64 nt, hsa
uugccauggccugaauguuggcuuaacugaauauuguaugaaaagacaugccuccauaugugcc

SEQ ID NO: 732877 - RNA, 64 nt, hsa
aaagcaaauccuuucaagaauggcaugggcauucuguaugaaccuuuccagaugguguucagug

SEQ ID NO: 732878 - RNA, 61 nt, hsa; identical to SEQ ID NO: 732437

SEQ ID NO: 732879 - RNA, 64 nt, hsa
aguuguuugguuuucaaggcacugauaauggauauguaugaaguccaugcugucuguuaaauaa

SEQ ID NO: 732880 - RNA, 64 nt, hsa
gucccaggauuccauccugaaauuuauuuuucuuuguaugaauauguguaaaugauuuaaaaau

SEQ ID NO: 732881 - RNA, 64 nt, hsa
aauggagagaaagggauuuuuuacugcaucccucuguaugaauaugaaaucagagaccagggca

SEQ ID NO: 732882 - RNA, 64 nt, hsa
cuaagagacauucuucauccaccaauguuguacauguaugaaaaugguguacuguauacuuuaa

SEQ ID NO: 732883 - RNA, 64 nt, hsa
aaaaguaaauaucuuuuucauauguccauuagaauguaugaaaaaaaucauuuuaacuaaaagc

SEQ ID NO: 732884 - RNA, 64 nt, hsa
gauggucucaugaguuucaaaauaauaauuuuuguguaugaacaaagcuguuguuuuuaccaug

SEQ ID NO: 732885 - RNA, 64 nt, hsa
gaauuaaugaucucuuuggaagagagcccagauuuguaugaaaacuuguuuuuccucucaauug

SEQ ID NO: 732886 - RNA, 64 nt, hsa
gagucugucuuuccuuagccgucugagugagcuguguaugaacaagucccaggaguuccaagag

SEQ ID NO: 732887 - RNA, 64 nt, hsa
guuccccuaacgucucaacaggcgcucacugaaguguaugaauauuuuuuaaaaagguuuuugc

SEQ ID NO: 732888 - RNA, 64 nt, hsa
accucaaagcguugucauguggauugagaugauauguaugaaucacauaaaagagugccuggca

SEQ ID NO: 732889 - RNA, 64 nt, hsa
agaguugaaaauugccuccaaauuaccggaagaguguaugaagauugaaugugauguauucacg

SEQ ID NO: 732890 - RNA, 64 nt, hsa
cacagauaagggcuuuauuguacaauaaaagauauguaugaaugcaucaguagcugaaaauugc

SEQ ID NO: 732891 - RNA, 64 nt, hsa
uaaauuguuaaacauuuagacaaacauauauguauguaugaauguacauaaauauuuuuaacuc

SEQ ID NO: 732892 - RNA, 64 nt, hsa
gggaaauggcaagucuuuaggauaggcaagacccuguaugaauaguaccaaagcauuaccgcau

SEQ ID NO: 732893 - RNA, 64 nt, hsa
cuuuaaaucauaacuauuugcuuuguacguuucauguaugaaugacaauaguuugaugauuucc

SEQ ID NO: 732894 - RNA, 64 nt, hsa
uagauuguauagagagacuaucuuguguugugccuguaugaauuuuuaaaaguuguugacugga

SEQ ID NO: 732895 - RNA, 64 nt, hsa
guuaaauaggaaaauuguuauuaaauaaagaauuuguaugaaccuuugccaauguuuuugacac

SEQ ID NO: 732896 - RNA, 64 nt, hsa
uuuauacuuuuuucuguauuguaauagguaguuuuguaugaaaucuuuucuccucucccguugu

SEQ ID NO: 732897 - RNA, 64 nt, hsa
cauucacuuacggagaauguaagguuaccuuugauguaugaaguagcaguauuuuccaguuuuu

SEQ ID NO: 732898 - RNA, 64 nt, hsa
gccuguccagcagggagcuugaauuuaaguuccauguaugaagucauuggcucuaucugcauuu

SEQ ID NO: 732899 - RNA, 64 nt, hsa
auauauucuaaacacaaugaaauagggaauauaauguaugaacuuuuugcauuggcuugaagca

SEQ ID NO: 732900 - RNA, 64 nt, hsa
uagaagaauaucacuuauuuuuagacuuguaaaauguaugaacuggugagcggacaucuguuaa

SEQ ID NO: 732901 - RNA, 64 nt, hsa
agcccaaaggggcagaacaagaaagccacgggauuguaugaaaucaaacaugaguuuguggugu

SEQ ID NO: 732902 - RNA, 64 nt, hsa
uaugaaacagaaagaucuguccaaggacacagcuuguaugaaaggguugaauuugggcuccauc

SEQ ID NO: 732903 - RNA, 64 nt, hsa
aggggcauagaauaaaauauuaaauauuggcagauguaugaaaagaagugugaguuaaaaauau

SEQ ID NO: 732904 - RNA, 64 nt, hsa
gaaguguggugucuuuuauauuugaauuaguaacuguaugaagucauagauaauaguacauguc

SEQ ID NO: 732905 - RNA, 64 nt, hsa
ugacuuuuuaauuguaaaagauuaguugaaaaacuguaugaaugugaagaucacaugcuuaguc

SEQ ID NO: 732906 - RNA, 64 nt, hsa
guuuuccaguaugaauguuaauguugucaguguauguaugaauaugaaagugcuuuguuuuguu

SEQ ID NO: 732907 - RNA, 64 nt, hsa
uuuagugcuuuugcaaguucaauuuguuaguuccuguaugaaagauugugggggaaaaauaaac

SEQ ID NO: 732908 - RNA, 64 nt, hsa
gguuuuaacgugcucaacuuuaauuuuuuucaauuguaugaaggccuuaaaaaagcuacauuaa

SEQ ID NO: 732909 - RNA, 64 nt, hsa
uguagcaacuguuugauuucuuucuggauacagcuguaugaacacuuuucuauuuuauacugaa

SEQ ID NO: 732910 - RNA, 64 nt, hsa
aaaugcaaugaggaaaucugacagggaaauuaucuguaugaacuaaaaguaagggaaccccggg

SEQ ID NO: 732911 - RNA, 64 nt, hsa
cgauuccuuuggauggcuucauuugcccccagacuguaugaaaacaucuccgaauuagcauuuc

SEQ ID NO: 732912 - RNA, 64 nt, hsa
auuacccaucugcagaacuaaggaaagcaauuuauguaugaaagaaauucuugaauucgucauu

SEQ ID NO: 732913 - RNA, 64 nt, hsa
caucuggguacagacaguaaagcccuuugauugcuguaugaauuccacacuauauaaacaauaa

SEQ ID NO: 732914 - RNA, 64 nt, hsa
cagaaaaguugggaaaagaguacaaugaccuuuuuguaugaaaauuacuuauuaacaggccagg

SEQ ID NO: 732915 - RNA, 64 nt, hsa
aggaccacuucucauauuagauuacuaagucauuuguaugaauauguguggcagugaagagaac

SEQ ID NO: 732916 - RNA, 64 nt, hsa
ugugaggagugagugagacaggacaugaaagguguguaugaacugugauaacuguugcccuugu

SEQ ID NO: 732917 - RNA, 64 nt, hsa
augucuuuauuguuguuaaaaaguuuuuauugaauguaugaaaauuaucaaauuguauucauca

SEQ ID NO: 732918 - RNA, 64 nt, hsa
aacagugugucagauggucuuuauauauuuuuucuguaugaaggaauagccuugccuacugaag

SEQ ID NO: 732919 - RNA, 64 nt, hsa
ucggggagaagaggauacugaaacauuugugaaauguaugaaugcacuucuguaaccagauacu

SEQ ID NO: 732920 - RNA, 64 nt, hsa
uuauccuauuucugggggaggauguacguggccauguaugaagccaaauauuaggcuuaaaaac

SEQ ID NO: 732921 - RNA, 64 nt, hsa
agauuuuuaugugucuuugacagcuagugucuaguguaugaaaguggaaaaggacauuucugua

SEQ ID NO: 732922 - RNA, 64 nt, hsa
guuauuugugcauauuuuuuaacaaugcccaaucuguaugaauaauguaaacuucgauuuuuuu

SEQ ID NO: 732923 - RNA, 64 nt, hsa
aaaauuagcagacaauccauuccuacuguauuucuguaugaauguguuugugaauguaugugua

SEQ ID NO: 732924 - RNA, 64 nt, hsa
ucggggucaguauccuguuuguuauuguuaaauuuguaugaaccuuagaaaaguuauuaaagug

SEQ ID NO: 732925 - RNA, 64 nt, hsa
gugaaagcugagaacuccugacuguaacauauucuguaugaacuuuaucuaaagaaaaauaaau

SEQ ID NO: 732926 - RNA, 64 nt, hsa
gauuaugcauacccaguauguauacuuauuaaucuguaugaagauguacauucuaaaauauaau

SEQ ID NO: 732927 - RNA, 64 nt, hsa
aaauuuauugacugaaaugaauuuuaaaugcauguguaugaacuuguuuuucuuaaucuuuaag

SEQ ID NO: 732928 - RNA, 64 nt, hsa
acaucuauuauguaucaguuuuaaaaauuagaauuguaugaaauuaagaguuucagaguucaua

SEQ ID NO: 732929 - RNA, 64 nt, hsa
cuguuugcaaauugagcagugcugcaacauguacuguaugaaggccauaaaauagagcuaguca

SEQ ID NO: 732930 - RNA, 64 nt, hsa; identical to SEQ ID NO: 337405

SEQ ID NO: 732931 - RNA, 64 nt, hsa; identical to SEQ ID NO: 337406

SEQ ID NO: 732932 - RNA, 64 nt, hsa
caggagaaggauugggaacagaauggaaaaacaguguaugaaagucauguuacaggccgagugc

SEQ ID NO: 732933 - RNA, 64 nt, hsa
caaauucgaagaguuagucaccaagagagccauauguaugaaagcguaucugugaaagguagga

SEQ ID NO: 732934 - RNA, 64 nt, hsa
guuuguuccuucuuauuucugaagaguuuuccauuguaugaauauaccacaauuuguuuccucc

SEQ ID NO: 732935 - RNA, 64 nt, hsa
uaaaagguguuuuacuguuuuccauuaacgcuguuguaugaacaauauuuggugacauguuguc

SEQ ID NO: 732936 - RNA, 64 nt, hsa
cuauuuuuguaaaguuuccgugcguggcacucgcuguaugaaaggagagagcaaagggugucug

SEQ ID NO: 732937 - RNA, 64 nt, hsa
cggguccuugugacuucaacggacucuuccaaauuguaugaauguaucaauguauuagauaaac

SEQ ID NO: 732938 - RNA, 64 nt, hsa
aagcacuaaggggagggcgcauacccgagacgauuguaugaagaaaauauggaggaacuguuac

SEQ ID NO: 732939 - RNA, 64 nt, hsa
ggggcgcuguuuuuaacgugcccguuuguacugauguaugaacuugucaauaaacacaauuguu

SEQ ID NO: 732940 - RNA, 64 nt, hsa
ugaauuuaagugacccauuaaaaucuagcacaccuguaugaaaaaucaguguagaagaauaccu

SEQ ID NO: 732941 - RNA, 64 nt, hsa
ccauuacauagggacuguacagagccugugaagauguaugaaugguaucuuuuauaauccacaa

SEQ ID NO: 732942 - RNA, 64 nt, hsa
cacuggguaagauucauggaacuuagaaaaaagcuguaugaacugcuuuaccaaauaucacuac

SEQ ID NO: 732943 - RNA, 64 nt, hsa
auagucccauuugggugguuucagcugcacuaucuguaugaaauggugucaccaaaacccuuuu

SEQ ID NO: 732944 - RNA, 64 nt, hsa
ugcuguuguaaacaacguguauagugccuaaaauuguaugaaaauccuuuuaaccauuuuaacc

SEQ ID NO: 732945 - RNA, 64 nt, hsa
ccacaagcuaguuuucuuaguuuuaaaauccuguuguaugaauggcauuuguauauuaaaacac

SEQ ID NO: 732946 - RNA, 64 nt, hsa
auuaauagcagaggaagacuccuuuuuucaucacuguaugaauuuuuuauaauguuuuuuuaaa

SEQ ID NO: 732947 - RNA, 64 nt, hsa
uuaauuuuaaaaugguuucuauaaaggguuuuauuguaugaaauagaacuuuauauuuuugcau

SEQ ID NO: 732948 - RNA, 64 nt, hsa
agauuguugcugcacauaguugccuuuguaucucuguaugaaauaaaaggucauuuguucaugu

SEQ ID NO: 732949 - RNA, 64 nt, hsa
acuuugcaaagacaguguguccaguuaccacugguguaugaaaugauuaauaccugaccucaca

SEQ ID NO: 732950 - RNA, 64 nt, hsa; identical to SEQ ID NO: 732937

SEQ ID NO: 732951 - RNA, 64 nt, hsa
uggguccuuguaacuucaacugacucuuccaaauuguaugaauuuaucaauguauuacacaaau

SEQ ID NO: 732952 - RNA, 64 nt, hsa
uuucggugucuugaauauauuuuuuuaaauuauguguaugaacaauucuaguuucauuuguuca

SEQ ID NO: 732953 - RNA, 64 nt, hsa
ugaugcuggaauuacuccuguagguauaaaccucuguaugaagagaagauuucucccaggaaau

SEQ ID NO: 732954 - RNA, 64 nt, hsa
augcugacauacuaaaaaaaauaaaaccuaguauuguaugaaggauagcuauucuuuacagcau

SEQ ID NO: 732955 - RNA, 64 nt, hsa
cuguauauauaaaaaucuugagaugguagaaacauguaugaauguacuaaguaguauuccacug

SEQ ID NO: 732956 - RNA, 64 nt, hsa
uuugaccuaguuagaugugguguuuauucaaguuuguaugaaaucauguuugacaauacuguaa

SEQ ID NO: 732957 - RNA, 64 nt, hsa
uacuguuuuaaaagaauuagugugaguguguuuuuguaugaaugagcccauucaugguaagucu

SEQ ID NO: 732958 - RNA, 64 nt, hsa
ggcucccagcuccacuggcccauggggccuccauuguaugaagucagcauaggcugcccaccua

SEQ ID NO: 732959 - RNA, 64 nt, hsa
uacacagugcauugcccuuuguuggggguaugcauguaugaacacacaugcuugucggaacgcu

SEQ ID NO: 732960 - RNA, 64 nt, hsa
uguuugcaaacccgaaaauaaaagacguucauuauguaugaaaaguaacugauuuguauucugu

SEQ ID NO: 732961 - RNA, 64 nt, hsa
cccacaggacuuaccccuguauguacaggauuuuuguaugaaaguuuuguuugauucugagacu

SEQ ID NO: 732962 - RNA, 64 nt, hsa
agcaggucacaacuuacccuuguguguuuagauguguaugaaauaccuguauacguuagugaaa

SEQ ID NO: 732963 - RNA, 64 nt, hsa
cccaccuuugccuccuaccagugaaccucaucuuuguaugaaagacagcaaccuccuggguaaa

SEQ ID NO: 732964 - RNA, 64 nt, hsa
caguauucaguuagcagacagaaguguaguaugcuguaugaauauuuuauauuaaaauaugaag

SEQ ID NO: 732965 - RNA, 64 nt, hsa
accaacauccugaaaguuaaagaaaaaaaucuaauguaugaaugugacucaccaauuuuuauca

SEQ ID NO: 732966 - RNA, 64 nt, hsa
guacaagaaccccuuuuaucccuggaagaggcuguguaugaaaccaaugcccaggguuugaagg

SEQ ID NO: 732967 - RNA, 64 nt, hsa
ccagaaaugcacuugugccagguauugucccugcuguaugaaaagcuucuuggcaaugaauucu

SEQ ID NO: 732968 - RNA, 64 nt, hsa
cuauacuugaacaguuccaacuguacauacauacuguaugaagcuuguccucugacuagguuuc

SEQ ID NO: 732969 - RNA, 64 nt, hsa
ccaaauaaacaugcagucucagugugcucucgcauguaugaauaucuaguccuuucugugguuc

SEQ ID NO: 732970 - RNA, 64 nt, hsa
caauggaugaauguagacacaaaacagcaacacuuguaugaagauguaaagugcugaacauauu

SEQ ID NO: 732971 - RNA, 64 nt, hsa
gcacggggaagguuuuggaguagaaccagggguguguaugaaggggggugacaaggucccccug

SEQ ID NO: 732972 - RNA, 64 nt, hsa
uugacaaaguaauguaauuuuuaccuuauuuaucuguaugaaauuccaguaguuaauuugaaca

SEQ ID NO: 732973 - RNA, 64 nt, hsa; identical to SEQ ID NO: 337407

SEQ ID NO: 732974 - RNA, 64 nt, hsa; identical to SEQ ID NO: 337408

SEQ ID NO: 732975 - RNA, 64 nt, hsa
guagagguuaugugcaacugaucuguccaguuuguguaugaaauggauuugauaaaguuuuugc

SEQ ID NO: 732976 - RNA, 64 nt, hsa
aaaacccaccacaccaccacaaaauggccuuuaguguaugaaaugcacauggaggggauguagu

SEQ ID NO: 732977 - RNA, 64 nt, hsa; identical to SEQ ID NO: 337409

SEQ ID NO: 732978 - RNA, 64 nt, hsa; identical to SEQ ID NO: 337410

SEQ ID NO: 732979 - RNA, 64 nt, hsa
uuguacuccagcauagcuuggucuuauuucuuacuguaugaaagcuuaacagcaaugugauuua

SEQ ID NO: 732980 - RNA, 64 nt, hsa
augaguaucacagcguccaacucaguagcuccaguguaugaaaaugucuccagggcuaaaggcu

SEQ ID NO: 732981 - RNA, 64 nt, hsa
gagaaacacauucuuauuaauucuucaccuguuauguaugaaggaaucauuccagugcuagaaa

SEQ ID NO: 732982 - RNA, 64 nt, hsa; identical to SEQ ID NO: 337411

SEQ ID NO: 732983 - RNA, 64 nt, hsa; identical to SEQ ID NO: 337412

SEQ ID NO: 732984 - RNA, 64 nt, hsa
gcugucagguguuaugcacuccauccaucauaacuguaugaaacacauuucauauguaaauaaa

SEQ ID NO: 732985 - RNA, 64 nt, hsa
cugcaaacacauuucauugugagguuuuacccucuguaugaaugaagagaacgcuggaaggcug

SEQ ID NO: 732986 - RNA, 64 nt, hsa
uuucgacgggcgccucguggcuuggaaccuccucuguaugaauaaacaguuuucacgucugucc

SEQ ID NO: 732987 - RNA, 64 nt, hsa
ggggaagcagaaauccaagcaccaccaaacacaguguaugaaggggggcggucaucauuucacu

SEQ ID NO: 732988 - RNA, 64 nt, hsa; identical to SEQ ID NO: 337413

SEQ ID NO: 732989 - RNA, 64 nt, hsa; identical to SEQ ID NO: 337414

SEQ ID NO: 732990 - RNA, 64 nt, hsa; identical to SEQ ID NO: 337415

SEQ ID NO: 732991 - RNA, 64 nt, hsa
uguaaauaaggcuuucuggggaucacagaacuuuuguaugaauaaaagccuuauaaaaccagcu

SEQ ID NO: 732992 - RNA, 64 nt, hsa
gcugugggggucccggcaccuggcgugaguuucauguaugaaaacauaaaauugaaaaaaaaaa

SEQ ID NO: 732993 - RNA, 64 nt, hsa
agugggaugcauuuagggggcgggcuugguauguuguaugaauccacucucuguuccuuuugga

SEQ ID NO: 732994 - RNA, 64 nt, hsa
uacaaauacauaagagacucacacugaaaaaaguuguaugaauauaaaaauguacuaaaaccuu

SEQ ID NO: 732995 - RNA, 64 nt, hsa
ccuugugccucucucuuucucucucuuucuuaauuguaugaaaacacaaagcacaggucaggau

SEQ ID NO: 732996 - RNA, 64 nt, hsa
acacuuguuaucugaaagugugugaaagaaacaauguaugaaaauuuacauuugaucauccggc

SEQ ID NO: 732997 - RNA, 64 nt, hsa; identical to SEQ ID NO: 337416

SEQ ID NO: 732998 - RNA, 64 nt, hsa; identical to SEQ ID NO: 337417

SEQ ID NO: 732999 - RNA, 64 nt, hsa
gaacuuuuauaugaugcauuuauucuaaugugauuguaugaacaagugaauaaaaaaccuugga

SEQ ID NO: 733000 - RNA, 64 nt, hsa
caaaaaugauuauaaaauucaugugaaauagaaguguaugaauugcugcgacaauuuugaaaag

SEQ ID NO: 733001 - RNA, 64 nt, hsa
aguuaucugaauuccauugaagaaaaccuauuuuuguaugaauaugaccaguuucaagcagagc

SEQ ID NO: 733002 - RNA, 64 nt, hsa
gcuucuucuaccuuuauuuauucucagcucugaauguaugaaccugcucaaucaccucaucuua

SEQ ID NO: 733003 - RNA, 64 nt, hsa
cucacuccauccagccucuugacaagcaccgcucuguaugaauuuuacuaguccggguaccuca

SEQ ID NO: 733004 - RNA, 64 nt, hsa
uucaugcaacauaauuugaaauuuguccaugguauguaugaacaguccauuuuaaaauuacuga

SEQ ID NO: 733005 - RNA, 64 nt, hsa
caaauggacaccauccaugaagcagcuggcacaguguaugaagaucugagguauaagcucuugc

SEQ ID NO: 733006 - RNA, 64 nt, hsa
cugauauuacauccacaguaccacaguauuuauguguaugaauuaaggauuaaaagauaaugug

SEQ ID NO: 733007 - RNA, 64 nt, hsa
ccccgagcaaccucuccaguuauccucauaugcauguaugaauacugucauuuuucugugcgug

SEQ ID NO: 733008 - RNA, 64 nt, hsa
auuuuagucggauuuuguuuuggaauuuugcuuuuguaugaacacucagcagaaaaguacuuac

SEQ ID NO: 733009 - RNA, 64 nt, hsa
accaaacacaucagaaaucucacuggagagaaacuguaugaauguagagaaucugggaauaccu

SEQ ID NO: 733010 - RNA, 64 nt, hsa
cuaagacaugaaagaacacguacuggggagaaacuguaugaauguaagcaguguucuaaagccu

SEQ ID NO: 733011 - RNA, 64 nt, hsa
cuuaaguguaagaaaauuauagagugaguuuguguguaugaauuuguaccuguuuuccgaagaa

SEQ ID NO: 733012 - RNA, 64 nt, hsa
aauuugguuaaaaaauaaaauaaaauaauaauaauguaugaagcucuguuuuuuaaacuccuua

SEQ ID NO: 733013 - RNA, 64 nt, hsa
uacccucugcacccucaagaaacccccagugccuuguaugaagcccaccccacauggcccacag

SEQ ID NO: 733014 - RNA, 64 nt, hsa
uuaauuuuuccuggcuaagaucaugucugaauuauguaugaaaauuauucuauguuuuuauaau

SEQ ID NO: 733015 - RNA, 64 nt, hsa
guuuuauauauaauauauuaaaaaaucaaaagucuguaugaaaauaucagauugcaccccccuc

SEQ ID NO: 733016 - RNA, 64 nt, hsa
auuuuuuuuuaguccccaguagaaaaauacucucuguaugaagaacauucaaaagugugcucaa

SEQ ID NO: 733017 - RNA, 64 nt, hsa
ucagacauagucaaagcuuugccgagaaaagaaauguaugaacuauauuugacaacauaaaauc

SEQ ID NO: 733018 - RNA, 64 nt, hsa
uuuuuauaguuguauuuuugaccugccuuuuauauguaugaauauuucauaguuuugcauauca

SEQ ID NO: 733019 - RNA, 64 nt, hsa
cagccuuugccagucuagccccagcagggcaccguguaugaaugcaguuuggugcuguuuuaga

SEQ ID NO: 733020 - RNA, 64 nt, hsa
aaauuguauugucaacaugggucauuuaaaguccuguaugaaccauaaccugcugugguaccuu

SEQ ID NO: 733021 - RNA, 64 nt, hsa
uaaauuuugaaaaguaauauuuauuaaauuuuuuuguaugaaaacauggaacaguguggccucu

SEQ ID NO: 733022 - RNA, 64 nt, hsa
caaggguuauguggggcgugggcucuccauaguguguaugaaaagcuuguugacucuagcggcu

SEQ ID NO: 733023 - RNA, 64 nt, hsa
guauuaguugauaaauuaacaguaauaacaagauuguaugaaccgcauggugcuugcaguuuua

SEQ ID NO: 733024 - RNA, 64 nt, hsa
ucuaugucuucaacuuucagaccccccauuuauuuguaugaaggcuucaguugccuuaauaaag

SEQ ID NO: 733025 - RNA, 64 nt, hsa
auacuaauugguucuuucuauuuucagagguuauuguaugaaauugucuauugauaguacuuuu

SEQ ID NO: 733026 - RNA, 64 nt, hsa
uugucuagcuaaugugggcagccaccacccacuguguaugaacaagucugaagcaaguuggccu

SEQ ID NO: 733027 - RNA, 64 nt, hsa
uccuugggacuguuaugaacagaaaaugaugcaauguaugaaaaacugcuuugaggagaaaaac

SEQ ID NO: 733028 - RNA, 64 nt, hsa
aaauguaugugaugacuguauaaggaggccuguguguaugaauuuauagggaguagaaccgucu

SEQ ID NO: 733029 - RNA, 64 nt, hsa
gggaccuccagcuuccacaaacaccaucuucagcuguaugaaagggacgguuguggugaaguuu

SEQ ID NO: 733030 - RNA, 64 nt, hsa
auauuuauaguuugcauuuuaaauauaaaaauuauguaugaaauauuuauuucagcauuaugug

SEQ ID NO: 733031 - RNA, 64 nt, hsa
auuugguauuuuguggucauguaaaacuucuuuuuguaugaaaauugugagaaauuuaaaucag

SEQ ID NO: 733032 - RNA, 64 nt, hsa
uaaaagacacuugguaauagacuucagugaacucuguaugaaugcaguagugugugugcaaaau

SEQ ID NO: 733033 - RNA, 64 nt, hsa
ucaggugguguucugguaaaauuguuagaauagcuguaugaaggaaaccagugggaggaaauga

SEQ ID NO: 733034 - RNA, 64 nt, hsa
aauuuuuucaacuguaucaguagcacaguauuuuuguaugaaaagugggagacuucugaacagu

SEQ ID NO: 733035 - RNA, 64 nt, hsa
guuaaauggucguggccaauuaugucauagaaacuguaugaacaaccagauuuacauagcagag

SEQ ID NO: 733036 - RNA, 64 nt, hsa
uucuuacuuaaacuuggucuucuuucaaauuguuuguaugaagaugcuguacccacuugaacag

SEQ ID NO: 733037 - RNA, 64 nt, hsa
gccgguucucggguccuugaaaguauauacagcuuguaugaaggcuucucugggacagugugcu

SEQ ID NO: 733038 - RNA, 64 nt, hsa
uagucuuuaagccauuccagucaugaugaggugauguaugaauacaugcauacauucaaagcac

SEQ ID NO: 733039 - RNA, 64 nt, hsa
ugggggguuggguuccugaaugcaccauaaucgcuguaugaaauauuaaaaagucuaaagugaa

SEQ ID NO: 733040 - RNA, 64 nt, hsa
uaaauuguggcuggcuucccuuucugucugcuauuguaugaagaauacugauguuuaccuguau

SEQ ID NO: 733041 - RNA, 64 nt, hsa
aauaccaauacuuuagaaguuuggucgugucguuuguaugaaaaucugaggcuuugguuuaaau

SEQ ID NO: 733042 - RNA, 64 nt, hsa
uugguuaacacuaagcuuaaguagacuauacaguuguaugaauuuguaaaaguauaugaacacc

SEQ ID NO: 733043 - RNA, 64 nt, hsa
uaccaaguaagacaucucaaauacaguaguauaauguaugaauuuuguaaguauaagaaauuuu

SEQ ID NO: 733044 - RNA, 64 nt, hsa
uuucauuccuuucuauggcugaauaaaauuccauuguaugaauauaccacaauuuguuucaccu

SEQ ID NO: 733045 - RNA, 64 nt, hsa
uucuuacuuaaacuuggucuucuuucaaguuguuuguaugaagaugcuguacccacuugaacag

SEQ ID NO: 733046 - RNA, 64 nt, hsa
aaauguccaauuuuaccuuuuacacaaugugagauguaugaaaaucaacucauuuuauucucgg

SEQ ID NO: 733047 - RNA, 64 nt, hsa
cacuaauuuaaauguaauaaaggccaaaggccucuguaugaaauuggauuuaaacuuucuuauu

SEQ ID NO: 733048 - RNA, 64 nt, hsa
uaaauucaaaccauauccacacacaacaacuaauuguaugaaacuuuuauauccuaauuuaaaa

SEQ ID NO: 733049 - RNA, 64 nt, hsa
cacaggagcaucacuaugccugugugaaaguauauguaugaaaguuuaccuaggguugauuccu

SEQ ID NO: 733050 - RNA, 64 nt, hsa
uuuguagaggcucaguacuuuuccaaugcacuguuguaugaaugcauuaaaaauuguaaaguac

SEQ ID NO: 733051 - RNA, 64 nt, hsa
caggccaaaucuaugcugugguucuuaugagacuuguaugaagaugcccugauuuguacagauu

SEQ ID NO: 733052 - RNA, 64 nt, hsa
uguguaggugcugaaugcuguaaggaguuuagguuguaugaauucuacaacccuauaauaaauu

SEQ ID NO: 733053 - RNA, 64 nt, hsa
uggauuaagggcagccacagugguuucuacuguauguaugaaccgaauggaggaauguuuucaa

SEQ ID NO: 733054 - RNA, 64 nt, hsa
uguguuuaugugucucagcuuucuccaaggaauauguaugaaauaacuuaaacugauuuuuucu

SEQ ID NO: 733055 - RNA, 64 nt, hsa
cuuaguaggaguucugcaguauagaacaauuacuuguaugaaauuauaccuuugaauuuuagaa

SEQ ID NO: 733056 - RNA, 64 nt, hsa
agaaaaugaacacccuugugauagaauuaccagcuguaugaaacaaauugucccaugcaaauua

SEQ ID NO: 733057 - RNA, 64 nt, hsa; identical to SEQ ID NO: 377795

SEQ ID NO: 733058 - RNA, 64 nt, hsa; identical to SEQ ID NO: 377796

SEQ ID NO: 733059 - RNA, 64 nt, hsa; identical to SEQ ID NO: 377797

SEQ ID NO: 733060 - RNA, 64 nt, hsa; identical to SEQ ID NO: 377798

SEQ ID NO: 733061 - RNA, 64 nt, hsa; identical to SEQ ID NO: 377799

SEQ ID NO: 733062 - RNA, 64 nt, hsa; identical to SEQ ID NO: 377800

SEQ ID NO: 733063 - RNA, 64 nt, hsa; identical to SEQ ID NO: 377801

SEQ ID NO: 733064 - RNA, 62 nt, hsa; identical to SEQ ID NO: 377802

SEQ ID NO: 733065 - RNA, 64 nt, hsa; identical to SEQ ID NO: 377803

SEQ ID NO: 733066 - RNA, 64 nt, hsa; identical to SEQ ID NO: 377804

SEQ ID NO: 733067 - RNA, 64 nt, hsa; identical to SEQ ID NO: 377805

SEQ ID NO: 733068 - RNA, 64 nt, hsa; identical to SEQ ID NO: 377806

SEQ ID NO: 733069 - RNA, 64 nt, hsa; identical to SEQ ID NO: 377807

SEQ ID NO: 733070 - RNA, 64 nt, hsa; identical to SEQ ID NO: 377808

SEQ ID NO: 733071 - RNA, 64 nt, hsa; identical to SEQ ID NO: 377809

SEQ ID NO: 733072 - RNA, 64 nt, hsa; identical to SEQ ID NO: 377810

SEQ ID NO: 733073 - RNA, 64 nt, hsa; identical to SEQ ID NO: 377811

SEQ ID NO: 733074 - RNA, 64 nt, hsa; identical to SEQ ID NO: 377812

SEQ ID NO: 733075 - RNA, 64 nt, hsa; identical to SEQ ID NO: 377813

SEQ ID NO: 733076 - RNA, 64 nt, hsa; identical to SEQ ID NO: 377814

SEQ ID NO: 733077 - RNA, 64 nt, hsa; identical to SEQ ID NO: 377815

SEQ ID NO: 733078 - RNA, 64 nt, hsa; identical to SEQ ID NO: 377816

SEQ ID NO: 733079 - RNA, 64 nt, hsa; identical to SEQ ID NO: 377817

SEQ ID NO: 733080 - RNA, 64 nt, hsa; identical to SEQ ID NO: 377818

SEQ ID NO: 733081 - RNA, 64 nt, hsa; identical to SEQ ID NO: 377819

SEQ ID NO: 733082 - RNA, 64 nt, hsa; identical to SEQ ID NO: 377820

SEQ ID NO: 733083 - RNA, 64 nt, hsa; identical to SEQ ID NO: 491300

SEQ ID NO: 733084 - RNA, 64 nt, hsa; identical to SEQ ID NO: 491301

SEQ ID NO: 733085 - RNA, 64 nt, hsa; identical to SEQ ID NO: 491302

SEQ ID NO: 733086 - RNA, 64 nt, hsa; identical to SEQ ID NO: 491303

SEQ ID NO: 733087 - RNA, 64 nt, hsa; identical to SEQ ID NO: 491304

SEQ ID NO: 733088 - RNA, 64 nt, hsa; identical to SEQ ID NO: 491305

SEQ ID NO: 733089 - RNA, 64 nt, hsa; identical to SEQ ID NO: 491306

SEQ ID NO: 733090 - RNA, 64 nt, hsa; identical to SEQ ID NO: 491307

SEQ ID NO: 733091 - RNA, 64 nt, hsa; identical to SEQ ID NO: 491308

SEQ ID NO: 733092 - RNA, 64 nt, hsa; identical to SEQ ID NO: 491309

SEQ ID NO: 733093 - RNA, 64 nt, hsa; identical to SEQ ID NO: 491310

SEQ ID NO: 733094 - RNA, 64 nt, hsa; identical to SEQ ID NO: 491311

SEQ ID NO: 733095 - RNA, 64 nt, hsa; identical to SEQ ID NO: 491312

SEQ ID NO: 733096 - RNA, 64 nt, hsa; identical to SEQ ID NO: 491313

SEQ ID NO: 733097 - RNA, 64 nt, hsa; identical to SEQ ID NO: 491314

SEQ ID NO: 733098 - RNA, 64 nt, hsa; identical to SEQ ID NO: 491315

SEQ ID NO: 733099 - RNA, 64 nt, hsa; identical to SEQ ID NO: 491316

SEQ ID NO: 733100 - RNA, 64 nt, hsa; identical to SEQ ID NO: 491317

SEQ ID NO: 733101 - RNA, 64 nt, hsa; identical to SEQ ID NO: 491318

SEQ ID NO: 733102 - RNA, 64 nt, hsa; identical to SEQ ID NO: 491319

SEQ ID NO: 733103 - RNA, 64 nt, hsa; identical to SEQ ID NO: 491320

SEQ ID NO: 733104 - RNA, 64 nt, hsa; identical to SEQ ID NO: 491321

SEQ ID NO: 733105 - RNA, 64 nt, hsa; identical to SEQ ID NO: 491322

SEQ ID NO: 733106 - RNA, 64 nt, hsa; identical to SEQ ID NO: 491323

SEQ ID NO: 733107 - RNA, 64 nt, hsa; identical to SEQ ID NO: 491324

SEQ ID NO: 733108 - RNA, 64 nt, hsa; identical to SEQ ID NO: 491325

SEQ ID NO: 733109 - RNA, 64 nt, hsa; identical to SEQ ID NO: 491326

SEQ ID NO: 733110 - RNA, 64 nt, hsa; identical to SEQ ID NO: 491327

SEQ ID NO: 733111 - RNA, 64 nt, hsa; identical to SEQ ID NO: 491328

SEQ ID NO: 733112 - RNA, 64 nt, hsa; identical to SEQ ID NO: 491329

SEQ ID NO: 733113 - RNA, 64 nt, hsa; identical to SEQ ID NO: 491330

SEQ ID NO: 733114 - RNA, 64 nt, hsa; identical to SEQ ID NO: 491331

SEQ ID NO: 733115 - RNA, 64 nt, hsa; identical to SEQ ID NO: 491332

SEQ ID NO: 733116 - RNA, 64 nt, hsa; identical to SEQ ID NO: 491333

SEQ ID NO: 733117 - RNA, 64 nt, hsa; identical to SEQ ID NO: 491334

SEQ ID NO: 733118 - RNA, 64 nt, hsa; identical to SEQ ID NO: 491335

SEQ ID NO: 733119 - RNA, 64 nt, hsa; identical to SEQ ID NO: 491336

SEQ ID NO: 733120 - RNA, 64 nt, hsa; identical to SEQ ID NO: 491337

SEQ ID NO: 733121 - RNA, 64 nt, hsa; identical to SEQ ID NO: 491338

SEQ ID NO: 733122 - RNA, 64 nt, hsa; identical to SEQ ID NO: 491339

SEQ ID NO: 733123 - RNA, 64 nt, hsa; identical to SEQ ID NO: 491340

SEQ ID NO: 733124 - RNA, 64 nt, hsa; identical to SEQ ID NO: 491341

SEQ ID NO: 733125 - RNA, 64 nt, hsa; identical to SEQ ID NO: 491342

SEQ ID NO: 733126 - RNA, 64 nt, hsa; identical to SEQ ID NO: 491343

SEQ ID NO: 733127 - RNA, 64 nt, hsa; identical to SEQ ID NO: 491344

SEQ ID NO: 733128 - RNA, 64 nt, hsa; identical to SEQ ID NO: 491345

SEQ ID NO: 733129 - RNA, 64 nt, hsa; identical to SEQ ID NO: 491346

SEQ ID NO: 733130 - RNA, 64 nt, hsa; identical to SEQ ID NO: 491347

SEQ ID NO: 733131 - RNA, 64 nt, hsa; identical to SEQ ID NO: 377795

SEQ ID NO: 733132 - RNA, 64 nt, hsa; identical to SEQ ID NO: 377796

SEQ ID NO: 733133 - RNA, 64 nt, hsa; identical to SEQ ID NO: 377797

SEQ ID NO: 733134 - RNA, 64 nt, hsa; identical to SEQ ID NO: 377798

SEQ ID NO: 733135 - RNA, 64 nt, hsa; identical to SEQ ID NO: 377799

SEQ ID NO: 733136 - RNA, 64 nt, hsa; identical to SEQ ID NO: 377800

SEQ ID NO: 733137 - RNA, 64 nt, hsa; identical to SEQ ID NO: 377801

SEQ ID NO: 733138 - RNA, 62 nt, hsa; identical to SEQ ID NO: 377802

SEQ ID NO: 733139 - RNA, 64 nt, hsa; identical to SEQ ID NO: 377803

SEQ ID NO: 733140 - RNA, 64 nt, hsa; identical to SEQ ID NO: 377804

SEQ ID NO: 733141 - RNA, 64 nt, hsa; identical to SEQ ID NO: 377805

SEQ ID NO: 733142 - RNA, 64 nt, hsa; identical to SEQ ID NO: 377806

SEQ ID NO: 733143 - RNA, 64 nt, hsa; identical to SEQ ID NO: 377807

SEQ ID NO: 733144 - RNA, 64 nt, hsa; identical to SEQ ID NO: 377808

SEQ ID NO: 733145 - RNA, 64 nt, hsa; identical to SEQ ID NO: 377809

SEQ ID NO: 733146 - RNA, 64 nt, hsa; identical to SEQ ID NO: 377810

SEQ ID NO: 733147 - RNA, 64 nt, hsa; identical to SEQ ID NO: 377811

SEQ ID NO: 733148 - RNA, 64 nt, hsa; identical to SEQ ID NO: 377812

SEQ ID NO: 733149 - RNA, 64 nt, hsa; identical to SEQ ID NO: 377813

SEQ ID NO: 733150 - RNA, 64 nt, hsa; identical to SEQ ID NO: 377814

SEQ ID NO: 733151 - RNA, 64 nt, hsa; identical to SEQ ID NO: 377815

SEQ ID NO: 733152 - RNA, 64 nt, hsa; identical to SEQ ID NO: 377816

SEQ ID NO: 733153 - RNA, 64 nt, hsa; identical to SEQ ID NO: 377817

SEQ ID NO: 733154 - RNA, 64 nt, hsa; identical to SEQ ID NO: 377818

SEQ ID NO: 733155 - RNA, 64 nt, hsa; identical to SEQ ID NO: 377819

SEQ ID NO: 733156 - RNA, 64 nt, hsa; identical to SEQ ID NO: 377820

SEQ ID NO: 733157 - RNA, 64 nt, hsa; identical to SEQ ID NO: 491300

SEQ ID NO: 733158 - RNA, 64 nt, hsa; identical to SEQ ID NO: 491301

SEQ ID NO: 733159 - RNA, 64 nt, hsa; identical to SEQ ID NO: 491302

SEQ ID NO: 733160 - RNA, 64 nt, hsa; identical to SEQ ID NO: 491303

SEQ ID NO: 733161 - RNA, 64 nt, hsa; identical to SEQ ID NO: 491304

SEQ ID NO: 733162 - RNA, 64 nt, hsa; identical to SEQ ID NO: 491305

SEQ ID NO: 733163 - RNA, 64 nt, hsa; identical to SEQ ID NO: 491306

SEQ ID NO: 733164 - RNA, 64 nt, hsa; identical to SEQ ID NO: 491307

SEQ ID NO: 733165 - RNA, 64 nt, hsa; identical to SEQ ID NO: 491308

SEQ ID NO: 733166 - RNA, 64 nt, hsa; identical to SEQ ID NO: 491309

SEQ ID NO: 733167 - RNA, 64 nt, hsa; identical to SEQ ID NO: 491310

SEQ ID NO: 733168 - RNA, 64 nt, hsa; identical to SEQ ID NO: 491311

SEQ ID NO: 733169 - RNA, 64 nt, hsa; identical to SEQ ID NO: 491312

SEQ ID NO: 733170 - RNA, 64 nt, hsa; identical to SEQ ID NO: 491313

SEQ ID NO: 733171 - RNA, 64 nt, hsa; identical to SEQ ID NO: 491314

SEQ ID NO: 733172 - RNA, 64 nt, hsa; identical to SEQ ID NO: 491315

SEQ ID NO: 733173 - RNA, 64 nt, hsa; identical to SEQ ID NO: 491316

SEQ ID NO: 733174 - RNA, 64 nt, hsa; identical to SEQ ID NO: 491317

SEQ ID NO: 733175 - RNA, 64 nt, hsa; identical to SEQ ID NO: 491318

SEQ ID NO: 733176 - RNA, 64 nt, hsa; identical to SEQ ID NO: 491319

SEQ ID NO: 733177 - RNA, 64 nt, hsa; identical to SEQ ID NO: 491320

SEQ ID NO: 733178 - RNA, 64 nt, hsa; identical to SEQ ID NO: 491321

SEQ ID NO: 733179 - RNA, 64 nt, hsa; identical to SEQ ID NO: 491322

SEQ ID NO: 733180 - RNA, 64 nt, hsa; identical to SEQ ID NO: 491323

SEQ ID NO: 733181 - RNA, 64 nt, hsa; identical to SEQ ID NO: 491324

SEQ ID NO: 733182 - RNA, 64 nt, hsa; identical to SEQ ID NO: 491325

SEQ ID NO: 733183 - RNA, 64 nt, hsa; identical to SEQ ID NO: 491326

SEQ ID NO: 733184 - RNA, 64 nt, hsa; identical to SEQ ID NO: 491327

SEQ ID NO: 733185 - RNA, 64 nt, hsa; identical to SEQ ID NO: 491328

SEQ ID NO: 733186 - RNA, 64 nt, hsa; identical to SEQ ID NO: 491329

SEQ ID NO: 733187 - RNA, 64 nt, hsa; identical to SEQ ID NO: 491330

SEQ ID NO: 733188 - RNA, 64 nt, hsa; identical to SEQ ID NO: 491331

SEQ ID NO: 733189 - RNA, 64 nt, hsa; identical to SEQ ID NO: 491332

SEQ ID NO: 733190 - RNA, 64 nt, hsa; identical to SEQ ID NO: 491333

SEQ ID NO: 733191 - RNA, 64 nt, hsa; identical to SEQ ID NO: 491334

SEQ ID NO: 733192 - RNA, 64 nt, hsa; identical to SEQ ID NO: 491335

SEQ ID NO: 733193 - RNA, 64 nt, hsa; identical to SEQ ID NO: 491336

SEQ ID NO: 733194 - RNA, 64 nt, hsa; identical to SEQ ID NO: 491337

SEQ ID NO: 733195 - RNA, 64 nt, hsa; identical to SEQ ID NO: 491338

SEQ ID NO: 733196 - RNA, 64 nt, hsa; identical to SEQ ID NO: 491339

SEQ ID NO: 733197 - RNA, 64 nt, hsa; identical to SEQ ID NO: 491340

SEQ ID NO: 733198 - RNA, 64 nt, hsa; identical to SEQ ID NO: 491341

SEQ ID NO: 733199 - RNA, 64 nt, hsa; identical to SEQ ID NO: 491342

SEQ ID NO: 733200 - RNA, 64 nt, hsa; identical to SEQ ID NO: 491343

SEQ ID NO: 733201 - RNA, 64 nt, hsa; identical to SEQ ID NO: 491344

SEQ ID NO: 733202 - RNA, 64 nt, hsa; identical to SEQ ID NO: 491345

SEQ ID NO: 733203 - RNA, 64 nt, hsa; identical to SEQ ID NO: 491346

SEQ ID NO: 733204 - RNA, 64 nt, hsa; identical to SEQ ID NO: 491347

SEQ ID NO: 733205 - RNA, 64 nt, hsa; identical to SEQ ID NO: 244198

SEQ ID NO: 733206 - RNA, 64 nt, hsa; identical to SEQ ID NO: 244199

SEQ ID NO: 733207 - RNA, 64 nt, hsa; identical to SEQ ID NO: 244200

SEQ ID NO: 733208 - RNA, 64 nt, hsa; identical to SEQ ID NO: 244201

SEQ ID NO: 733209 - RNA, 64 nt, hsa; identical to SEQ ID NO: 244202

SEQ ID NO: 733210 - RNA, 64 nt, hsa; identical to SEQ ID NO: 244203

SEQ ID NO: 733211 - RNA, 64 nt, hsa; identical to SEQ ID NO: 244204

SEQ ID NO: 733212 - RNA, 64 nt, hsa; identical to SEQ ID NO: 244205

SEQ ID NO: 733213 - RNA, 64 nt, hsa; identical to SEQ ID NO: 244206

SEQ ID NO: 733214 - RNA, 64 nt, hsa; identical to SEQ ID NO: 244207

SEQ ID NO: 733215 - RNA, 64 nt, hsa; identical to SEQ ID NO: 244208

SEQ ID NO: 733216 - RNA, 64 nt, hsa; identical to SEQ ID NO: 244209

SEQ ID NO: 733217 - RNA, 64 nt, hsa; identical to SEQ ID NO: 244210

SEQ ID NO: 733218 - RNA, 64 nt, hsa; identical to SEQ ID NO: 244211

SEQ ID NO: 733219 - RNA, 64 nt, hsa; identical to SEQ ID NO: 244212

SEQ ID NO: 733220 - RNA, 64 nt, hsa; identical to SEQ ID NO: 244213

SEQ ID NO: 733221 - RNA, 64 nt, hsa; identical to SEQ ID NO: 244214

SEQ ID NO: 733222 - RNA, 64 nt, hsa; identical to SEQ ID NO: 244215

SEQ ID NO: 733223 - RNA, 64 nt, hsa; identical to SEQ ID NO: 244216

SEQ ID NO: 733224 - RNA, 64 nt, hsa; identical to SEQ ID NO: 244217

SEQ ID NO: 733225 - RNA, 64 nt, hsa; identical to SEQ ID NO: 244218

SEQ ID NO: 733226 - RNA, 64 nt, hsa; identical to SEQ ID NO: 244219

SEQ ID NO: 733227 - RNA, 64 nt, hsa; identical to SEQ ID NO: 244220

SEQ ID NO: 733228 - RNA, 64 nt, hsa; identical to SEQ ID NO: 244221

SEQ ID NO: 733229 - RNA, 64 nt, hsa; identical to SEQ ID NO: 244222

SEQ ID NO: 733230 - RNA, 64 nt, hsa; identical to SEQ ID NO: 244223

SEQ ID NO: 733231 - RNA, 64 nt, hsa; identical to SEQ ID NO: 244224

SEQ ID NO: 733232 - RNA, 64 nt, hsa; identical to SEQ ID NO: 244225

SEQ ID NO: 733233 - RNA, 64 nt, hsa; identical to SEQ ID NO: 244226

SEQ ID NO: 733234 - RNA, 64 nt, hsa; identical to SEQ ID NO: 244227

SEQ ID NO: 733235 - RNA, 64 nt, hsa; identical to SEQ ID NO: 244228

SEQ ID NO: 733236 - RNA, 64 nt, hsa; identical to SEQ ID NO: 244229

SEQ ID NO: 733237 - RNA, 64 nt, hsa; identical to SEQ ID NO: 244230

SEQ ID NO: 733238 - RNA, 64 nt, hsa; identical to SEQ ID NO: 244231

SEQ ID NO: 733239 - RNA, 64 nt, hsa; identical to SEQ ID NO: 244232

SEQ ID NO: 733240 - RNA, 64 nt, hsa; identical to SEQ ID NO: 244233

SEQ ID NO: 733241 - RNA, 64 nt, hsa; identical to SEQ ID NO: 244234

SEQ ID NO: 733242 - RNA, 64 nt, hsa; identical to SEQ ID NO: 244235

SEQ ID NO: 733243 - RNA, 64 nt, hsa; identical to SEQ ID NO: 244236

SEQ ID NO: 733244 - RNA, 64 nt, hsa; identical to SEQ ID NO: 244237

SEQ ID NO: 733245 - RNA, 64 nt, hsa; identical to SEQ ID NO: 244238

SEQ ID NO: 733246 - RNA, 64 nt, hsa; identical to SEQ ID NO: 244239

SEQ ID NO: 733247 - RNA, 64 nt, hsa; identical to SEQ ID NO: 244240

SEQ ID NO: 733248 - RNA, 64 nt, hsa; identical to SEQ ID NO: 244241

SEQ ID NO: 733249 - RNA, 64 nt, hsa; identical to SEQ ID NO: 244242

SEQ ID NO: 733250 - RNA, 64 nt, hsa; identical to SEQ ID NO: 244243

SEQ ID NO: 733251 - RNA, 64 nt, hsa; identical to SEQ ID NO: 244244

SEQ ID NO: 733252 - RNA, 64 nt, hsa; identical to SEQ ID NO: 244245

SEQ ID NO: 733253 - RNA, 64 nt, hsa; identical to SEQ ID NO: 244246

SEQ ID NO: 733254 - RNA, 64 nt, hsa; identical to SEQ ID NO: 244247

SEQ ID NO: 733255 - RNA, 64 nt, hsa; identical to SEQ ID NO: 244248

SEQ ID NO: 733256 - RNA, 64 nt, hsa; identical to SEQ ID NO: 244249

SEQ ID NO: 733257 - RNA, 64 nt, hsa; identical to SEQ ID NO: 244250

SEQ ID NO: 733258 - RNA, 64 nt, hsa; identical to SEQ ID NO: 244251

SEQ ID NO: 733259 - RNA, 64 nt, hsa; identical to SEQ ID NO: 244252

SEQ ID NO: 733260 - RNA, 64 nt, hsa; identical to SEQ ID NO: 244253

SEQ ID NO: 733261 - RNA, 64 nt, hsa; identical to SEQ ID NO: 244254

SEQ ID NO: 733262 - RNA, 64 nt, hsa; identical to SEQ ID NO: 244255

SEQ ID NO: 733263 - RNA, 64 nt, hsa; identical to SEQ ID NO: 244256

SEQ ID NO: 733264 - RNA, 64 nt, hsa; identical to SEQ ID NO: 244257

SEQ ID NO: 733265 - RNA, 64 nt, hsa; identical to SEQ ID NO: 244258

SEQ ID NO: 733266 - RNA, 64 nt, hsa; identical to SEQ ID NO: 244259

SEQ ID NO: 733267 - RNA, 64 nt, hsa; identical to SEQ ID NO: 244260

SEQ ID NO: 733268 - RNA, 64 nt, hsa; identical to SEQ ID NO: 244261

SEQ ID NO: 733269 - RNA, 64 nt, hsa; identical to SEQ ID NO: 244262

SEQ ID NO: 733270 - RNA, 64 nt, hsa; identical to SEQ ID NO: 244263

SEQ ID NO: 733271 - RNA, 59 nt, hsa
agagcuagaaccuggagaacuagaaccuggagggcuagaacuggagaggcuagaaccaa

SEQ ID NO: 733272 - RNA, 59 nt, hsa
agggcuggaaucuggagagcuagaaccuggagggcuagaaccuggagggcuagaaucug

SEQ ID NO: 733273 - RNA, 59 nt, hsa
agagcuagaaccuggagggcuagaaccuggagggcuagaaucuggagagcuagaaccug

SEQ ID NO: 733274 - RNA, 59 nt, hsa
agggcuagaaucuggagagcuagaaccuggagggcuagaaucuggagagcuagaaccug

SEQ ID NO: 733275 - RNA, 59 nt, hsa
agggcuagaaucuggagagcuagaaccuggagggcuagaaccuggagagcuagaaccua

SEQ ID NO: 733276 - RNA, 59 nt, hsa
agggcuggaaucuggagagcuagaaccuggagggcuagaaccuggagggcuagaaccua

SEQ ID NO: 733277 - RNA, 59 nt, hsa
agagcuagaaccuggagggcuagaaccuggagggcuagaaccuagaagggcuagaaccu

SEQ ID NO: 733278 - RNA, 59 nt, hsa; identical to SEQ ID NO: 733276

SEQ ID NO: 733279 - RNA, 59 nt, hsa; identical to SEQ ID NO: 733277

SEQ ID NO: 733280 - RNA, 59 nt, hsa
gggcuagaaccuagaagggcuagaaccuggagggcuagaaccuggcagguuagaaccua

SEQ ID NO: 733281 - RNA, 59 nt, hsa
agggcuagaaccuggagagccagaaccuggagggcuagaaccuggaagggcuagaaccu

SEQ ID NO: 733282 - RNA, 59 nt, hsa
caagcuagaaccuggagggaaugaaccuggagggcuagaaccuggagaaugagaaaaau

SEQ ID NO: 733283 - RNA, 64 nt, hsa
cccaaacuuuuagaguaaaaagccaaauuuaaauuauaagaaagaagggaaaaaagagaaaaac

SEQ ID NO: 733284 - RNA, 64 nt, hsa
uguuuuaacuucuaaagaaaauauguuucagcauuauaagaaaggcagaaugcagaacaccuac

SEQ ID NO: 733285 - RNA, 64 nt, hsa
cagcuuaaaauugguaauugaauggaagcaaaauuauaagaagaggaaauuaaagucuuccauu

SEQ ID NO: 733286 - RNA, 64 nt, hsa
uugucauauaaaccugauguugagcugaguuccuuauaagaauuaaucuuaauuuuguauuuuu

SEQ ID NO: 733287 - RNA, 64 nt, hsa
uccuuguuuuaagauuguaauucagaaaacauaauauaagaaucauagugccauagaugguucu

SEQ ID NO: 733288 - RNA, 64 nt, hsa
caaauguuuugguuauucaugaucacuugggcaguauaagaaaauguagcuucugaauauuggc

SEQ ID NO: 733289 - RNA, 64 nt, hsa
aaacaauguuuggaugcaacgcagaauaaaagaauauaagaaauagcuuuuuguugcauuaaug

SEQ ID NO: 733290 - RNA, 64 nt, hsa
aaaaaguuguauuuucuaauuuuuauuaccaauauauaagaauguaauuuauuuuuacauaauu

SEQ ID NO: 733291 - RNA, 64 nt, hsa
gauguuuuagaauuuuuuuuauaaaaaccuucacuauaagaacagaaaaccaaacaccgcaugu

SEQ ID NO: 733292 - RNA, 64 nt, hsa
ugccagucauguaaauugauucugcugagggucuuauaagaauugagauauaacaaugguaaaa

SEQ ID NO: 733293 - RNA, 64 nt, hsa
caauggcaaaaguccuuguuguagaugagaagcauauaagaaaugguugccaaucuuuguuuug

SEQ ID NO: 733294 - RNA, 64 nt, hsa
uuauuauggaaauguugucuuuuauacuuaguuauauaagaaaaaagggaguuaugcaauuaau

SEQ ID NO: 733295 - RNA, 64 nt, hsa
aaagggaaggauguguuuuuuucucucacuauaguauaagaaucuauuuuggagaaaaaaagaa

SEQ ID NO: 733296 - RNA, 64 nt, hsa
auaccuuuaacugcaaagaaaaggcaguuucaaauauaagaaauuuauuucagguaaggguaau

SEQ ID NO: 733297 - RNA, 64 nt, hsa
uccaugggauuguaaauauaaacauuaacuuuccuauaagaauauuuuggcuuuguaaucuaua

SEQ ID NO: 733298 - RNA, 64 nt, hsa
caguuuuccaagaacaaaucuugcacaagcaaaguauaagaauuauccuaaaaauaggggguuu

SEQ ID NO: 733299 - RNA, 64 nt, hsa
agacaauaaucugaauaagacaauaugugaugaauauaagaaagggcaaaaaauucauuugaac

SEQ ID NO: 733300 - RNA, 64 nt, hsa
uaggacagguacaauuuuggauaaauagcacauuuauaagaaccgcaaugaaaacugacuugaa

SEQ ID NO: 733301 - RNA, 64 nt, hsa
cauuucacccaggcaggccauuuucuuuugugauuauaagaaagaguaguuguugauuaaauuu

SEQ ID NO: 733302 - RNA, 64 nt, hsa
aguauaacuccugcaguuccuauagcagauaagauauaagaaagugccuccuagugcuccuccg

SEQ ID NO: 733303 - RNA, 64 nt, hsa
acugagaucagggaucccaaauucaugggacuuauauaagaaggacaauuaaugcugauuuggg

SEQ ID NO: 733304 - RNA, 64 nt, hsa
caguuguaaauuuguaaagauuaccuugccacuuuauaagaaaguguauuuaacuaaaaaguca

SEQ ID NO: 733305 - RNA, 64 nt, hsa
agcacaaaauaguacuuuguggaucauuucaagauauaagaaauuuuggaaauuccaccauaaa

SEQ ID NO: 733306 - RNA, 50 nt, hsa
aaacucauaauguaauuuaauauaagaaaagguuuccaugucaugcucua

SEQ ID NO: 733307 - RNA, 64 nt, hsa
aggguggagccuucaugaguggaauuacugccuuuauaagaagaagccaaagagccagcuagcu

SEQ ID NO: 733308 - RNA, 64 nt, hsa
aagacucauacuacaaauaauuuaauugauggcauauaagaauaugcaguuugaaaaagccaaa

SEQ ID NO: 733309 - RNA, 64 nt, hsa
guaacucauagcugcugugcaaauugguagaccuuauaagaaggcacuuguuuguaagccagag

SEQ ID NO: 733310 - RNA, 64 nt, hsa
auaguagagcugcaccuaaagaggaaauuggguuuauaagaaaauggaggcaaagaacuuaagu

SEQ ID NO: 733311 - RNA, 64 nt, hsa
uaaauguaucuuuauuagugacuucuaguccaaauauaagaaacugucauguuuugugggaaaa

SEQ ID NO: 733312 - RNA, 64 nt, hsa
cuuguaguguuaguuaaaacauauguuucaaaaauauaagaaaaguucaaaaacuaauuaauuu

SEQ ID NO: 733313 - RNA, 64 nt, hsa
ugaaauuaacugcccuagauauaguuacucaagguauaagaagccuuguguucuguauuuuucu

SEQ ID NO: 733314 - RNA, 64 nt, hsa
augggaguggcugcuucuccuuggcuaagcccaugcagacuauuguguccaggacuggaauaaa

SEQ ID NO: 733315 - RNA, 64 nt, hsa
aaaaacuacuuauaauuaaucacuagccuacucagcagacuaaaaugaugucaacagucuauau

SEQ ID NO: 733316 - RNA, 64 nt, hsa
aaaauuguauacugagaaaaauccuaugaauguggcagacuauaaaagccuuuggugggaagau

SEQ ID NO: 733317 - RNA, 64 nt, hsa
uaagauaucugcaaagaagaguaauuucaugaaugcagacuacaugguuguuuauuuagugauc

SEQ ID NO: 733318 - RNA, 64 nt, hsa; identical to SEQ ID NO: 592524

SEQ ID NO: 733319 - RNA, 64 nt, hsa; identical to SEQ ID NO: 592525

SEQ ID NO: 733320 - RNA, 64 nt, hsa; identical to SEQ ID NO: 592526

SEQ ID NO: 733321 - RNA, 64 nt, hsa; identical to SEQ ID NO: 592527

SEQ ID NO: 733322 - RNA, 64 nt, hsa; identical to SEQ ID NO: 592528

SEQ ID NO: 733323 - RNA, 64 nt, hsa; identical to SEQ ID NO: 592529

SEQ ID NO: 733324 - RNA, 64 nt, hsa; identical to SEQ ID NO: 592530

SEQ ID NO: 733325 - RNA, 64 nt, hsa; identical to SEQ ID NO: 592531

SEQ ID NO: 733326 - RNA, 64 nt, hsa; identical to SEQ ID NO: 592532

SEQ ID NO: 733327 - RNA, 64 nt, hsa; identical to SEQ ID NO: 592533

SEQ ID NO: 733328 - RNA, 64 nt, hsa; identical to SEQ ID NO: 592534

SEQ ID NO: 733329 - RNA, 64 nt, hsa; identical to SEQ ID NO: 592535

SEQ ID NO: 733330 - RNA, 64 nt, hsa; identical to SEQ ID NO: 592536

SEQ ID NO: 733331 - RNA, 64 nt, hsa; identical to SEQ ID NO: 592537

SEQ ID NO: 733332 - RNA, 64 nt, hsa; identical to SEQ ID NO: 592538

SEQ ID NO: 733333 - RNA, 64 nt, hsa; identical to SEQ ID NO: 592539

SEQ ID NO: 733334 - RNA, 64 nt, hsa; identical to SEQ ID NO: 592540

SEQ ID NO: 733335 - RNA, 64 nt, hsa; identical to SEQ ID NO: 592541

SEQ ID NO: 733336 - RNA, 64 nt, hsa; identical to SEQ ID NO: 592542

SEQ ID NO: 733337 - RNA, 64 nt, hsa; identical to SEQ ID NO: 592543

SEQ ID NO: 733338 - RNA, 64 nt, hsa; identical to SEQ ID NO: 592544

SEQ ID NO: 733339 - RNA, 64 nt, hsa; identical to SEQ ID NO: 592545

SEQ ID NO: 733340 - RNA, 64 nt, hsa; identical to SEQ ID NO: 592546

SEQ ID NO: 733341 - RNA, 64 nt, hsa; identical to SEQ ID NO: 592547

SEQ ID NO: 733342 - RNA, 64 nt, hsa; identical to SEQ ID NO: 592548

SEQ ID NO: 733343 - RNA, 64 nt, hsa; identical to SEQ ID NO: 592549

SEQ ID NO: 733344 - RNA, 64 nt, hsa; identical to SEQ ID NO: 592550

SEQ ID NO: 733345 - RNA, 64 nt, hsa; identical to SEQ ID NO: 592551

SEQ ID NO: 733346 - RNA, 64 nt, hsa; identical to SEQ ID NO: 592552

SEQ ID NO: 733347 - RNA, 64 nt, hsa; identical to SEQ ID NO: 592553

SEQ ID NO: 733348 - RNA, 64 nt, hsa; identical to SEQ ID NO: 592554

SEQ ID NO: 733349 - RNA, 64 nt, hsa; identical to SEQ ID NO: 592555

SEQ ID NO: 733350 - RNA, 64 nt, hsa; identical to SEQ ID NO: 592556

SEQ ID NO: 733351 - RNA, 64 nt, hsa; identical to SEQ ID NO: 592557

SEQ ID NO: 733352 - RNA, 64 nt, hsa; identical to SEQ ID NO: 592558

SEQ ID NO: 733353 - RNA, 64 nt, hsa; identical to SEQ ID NO: 592559

SEQ ID NO: 733354 - RNA, 64 nt, hsa; identical to SEQ ID NO: 592560

SEQ ID NO: 733355 - RNA, 64 nt, hsa; identical to SEQ ID NO: 592561

SEQ ID NO: 733356 - RNA, 64 nt, hsa; identical to SEQ ID NO: 592562

SEQ ID NO: 733357 - RNA, 64 nt, hsa; identical to SEQ ID NO: 592563

SEQ ID NO: 733358 - RNA, 64 nt, hsa; identical to SEQ ID NO: 592564

SEQ ID NO: 733359 - RNA, 64 nt, hsa; identical to SEQ ID NO: 592565

SEQ ID NO: 733360 - RNA, 64 nt, hsa; identical to SEQ ID NO: 592566

SEQ ID NO: 733361 - RNA, 64 nt, hsa; identical to SEQ ID NO: 592567

SEQ ID NO: 733362 - RNA, 64 nt, hsa; identical to SEQ ID NO: 592568

SEQ ID NO: 733363 - RNA, 64 nt, hsa; identical to SEQ ID NO: 592569

SEQ ID NO: 733364 - RNA, 64 nt, hsa; identical to SEQ ID NO: 592570

SEQ ID NO: 733365 - RNA, 64 nt, hsa; identical to SEQ ID NO: 592571

SEQ ID NO: 733366 - RNA, 64 nt, hsa; identical to SEQ ID NO: 592572

SEQ ID NO: 733367 - RNA, 64 nt, hsa; identical to SEQ ID NO: 592573

SEQ ID NO: 733368 - RNA, 64 nt, hsa; identical to SEQ ID NO: 592574

SEQ ID NO: 733369 - RNA, 64 nt, hsa; identical to SEQ ID NO: 592575

SEQ ID NO: 733370 - RNA, 64 nt, hsa; identical to SEQ ID NO: 592576

SEQ ID NO: 733371 - RNA, 64 nt, hsa; identical to SEQ ID NO: 592577

SEQ ID NO: 733372 - RNA, 64 nt, hsa; identical to SEQ ID NO: 592578

SEQ ID NO: 733373 - RNA, 64 nt, hsa; identical to SEQ ID NO: 592579

SEQ ID NO: 733374 - RNA, 64 nt, hsa; identical to SEQ ID NO: 592580

SEQ ID NO: 733375 - RNA, 64 nt, hsa; identical to SEQ ID NO: 592581

SEQ ID NO: 733376 - RNA, 64 nt, hsa; identical to SEQ ID NO: 592582

SEQ ID NO: 733377 - RNA, 64 nt, hsa; identical to SEQ ID NO: 592583

SEQ ID NO: 733378 - RNA, 64 nt, hsa; identical to SEQ ID NO: 592584

SEQ ID NO: 733379 - RNA, 64 nt, hsa; identical to SEQ ID NO: 592585

SEQ ID NO: 733380 - RNA, 64 nt, hsa; identical to SEQ ID NO: 592586

SEQ ID NO: 733381 - RNA, 64 nt, hsa; identical to SEQ ID NO: 592587

SEQ ID NO: 733382 - RNA, 64 nt, hsa; identical to SEQ ID NO: 592588

SEQ ID NO: 733383 - RNA, 64 nt, hsa; identical to SEQ ID NO: 592589

SEQ ID NO: 733384 - RNA, 64 nt, hsa; identical to SEQ ID NO: 592590

SEQ ID NO: 733385 - RNA, 64 nt, hsa; identical to SEQ ID NO: 592591

SEQ ID NO: 733386 - RNA, 64 nt, hsa; identical to SEQ ID NO: 592592

SEQ ID NO: 733387 - RNA, 64 nt, hsa; identical to SEQ ID NO: 592593

SEQ ID NO: 733388 - RNA, 62 nt, hsa; identical to SEQ ID NO: 592594

SEQ ID NO: 733389 - RNA, 64 nt, hsa; identical to SEQ ID NO: 592595

SEQ ID NO: 733390 - RNA, 64 nt, hsa; identical to SEQ ID NO: 592596

SEQ ID NO: 733391 - RNA, 64 nt, hsa; identical to SEQ ID NO: 592597

SEQ ID NO: 733392 - RNA, 64 nt, hsa; identical to SEQ ID NO: 592598

SEQ ID NO: 733393 - RNA, 64 nt, hsa; identical to SEQ ID NO: 592599

SEQ ID NO: 733394 - RNA, 64 nt, hsa; identical to SEQ ID NO: 592600

SEQ ID NO: 733395 - RNA, 64 nt, hsa; identical to SEQ ID NO: 592601

SEQ ID NO: 733396 - RNA, 64 nt, hsa; identical to SEQ ID NO: 592602

SEQ ID NO: 733397 - RNA, 64 nt, hsa; identical to SEQ ID NO: 592603

SEQ ID NO: 733398 - RNA, 64 nt, hsa; identical to SEQ ID NO: 592604

SEQ ID NO: 733399 - RNA, 64 nt, hsa; identical to SEQ ID NO: 592605

SEQ ID NO: 733400 - RNA, 64 nt, hsa; identical to SEQ ID NO: 592606

SEQ ID NO: 733401 - RNA, 64 nt, hsa; identical to SEQ ID NO: 592607

SEQ ID NO: 733402 - RNA, 64 nt, hsa; identical to SEQ ID NO: 592608

SEQ ID NO: 733403 - RNA, 64 nt, hsa; identical to SEQ ID NO: 592609

SEQ ID NO: 733404 - RNA, 64 nt, hsa; identical to SEQ ID NO: 592610

SEQ ID NO: 733405 - RNA, 64 nt, hsa; identical to SEQ ID NO: 592611

SEQ ID NO: 733406 - RNA, 64 nt, hsa; identical to SEQ ID NO: 592612

SEQ ID NO: 733407 - RNA, 64 nt, hsa; identical to SEQ ID NO: 592613

SEQ ID NO: 733408 - RNA, 64 nt, hsa; identical to SEQ ID NO: 592614

SEQ ID NO: 733409 - RNA, 64 nt, hsa; identical to SEQ ID NO: 592615

SEQ ID NO: 733410 - RNA, 64 nt, hsa; identical to SEQ ID NO: 592616

SEQ ID NO: 733411 - RNA, 64 nt, hsa; identical to SEQ ID NO: 592617

SEQ ID NO: 733412 - RNA, 64 nt, hsa; identical to SEQ ID NO: 592618

SEQ ID NO: 733413 - RNA, 64 nt, hsa; identical to SEQ ID NO: 592619

SEQ ID NO: 733414 - RNA, 64 nt, hsa; identical to SEQ ID NO: 592620

SEQ ID NO: 733415 - RNA, 64 nt, hsa; identical to SEQ ID NO: 592621

SEQ ID NO: 733416 - RNA, 64 nt, hsa; identical to SEQ ID NO: 592622

SEQ ID NO: 733417 - RNA, 64 nt, hsa; identical to SEQ ID NO: 592623

SEQ ID NO: 733418 - RNA, 64 nt, hsa; identical to SEQ ID NO: 592624

SEQ ID NO: 733419 - RNA, 64 nt, hsa; identical to SEQ ID NO: 592625

SEQ ID NO: 733420 - RNA, 64 nt, hsa; identical to SEQ ID NO: 592626

SEQ ID NO: 733421 - RNA, 64 nt, hsa; identical to SEQ ID NO: 592627

SEQ ID NO: 733422 - RNA, 64 nt, hsa; identical to SEQ ID NO: 592628

SEQ ID NO: 733423 - RNA, 64 nt, hsa; identical to SEQ ID NO: 592629

SEQ ID NO: 733424 - RNA, 64 nt, hsa; identical to SEQ ID NO: 592630

SEQ ID NO: 733425 - RNA, 64 nt, hsa; identical to SEQ ID NO: 592631

SEQ ID NO: 733426 - RNA, 64 nt, hsa; identical to SEQ ID NO: 592632

SEQ ID NO: 733427 - RNA, 64 nt, hsa; identical to SEQ ID NO: 592633

SEQ ID NO: 733428 - RNA, 64 nt, hsa; identical to SEQ ID NO: 592634

SEQ ID NO: 733429 - RNA, 64 nt, hsa; identical to SEQ ID NO: 592635

SEQ ID NO: 733430 - RNA, 64 nt, hsa; identical to SEQ ID NO: 617984

SEQ ID NO: 733431 - RNA, 64 nt, hsa; identical to SEQ ID NO: 617985

SEQ ID NO: 733432 - RNA, 64 nt, hsa; identical to SEQ ID NO: 617986

SEQ ID NO: 733433 - RNA, 64 nt, hsa; identical to SEQ ID NO: 617987

SEQ ID NO: 733434 - RNA, 64 nt, hsa; identical to SEQ ID NO: 617988

SEQ ID NO: 733435 - RNA, 64 nt, hsa; identical to SEQ ID NO: 617989

SEQ ID NO: 733436 - RNA, 64 nt, hsa; identical to SEQ ID NO: 617990

SEQ ID NO: 733437 - RNA, 64 nt, hsa; identical to SEQ ID NO: 617991

SEQ ID NO: 733438 - RNA, 64 nt, hsa; identical to SEQ ID NO: 617992

SEQ ID NO: 733439 - RNA, 64 nt, hsa; identical to SEQ ID NO: 617993

SEQ ID NO: 733440 - RNA, 64 nt, hsa; identical to SEQ ID NO: 617994

SEQ ID NO: 733441 - RNA, 64 nt, hsa; identical to SEQ ID NO: 617995

SEQ ID NO: 733442 - RNA, 64 nt, hsa; identical to SEQ ID NO: 617996

SEQ ID NO: 733443 - RNA, 64 nt, hsa; identical to SEQ ID NO: 617997

SEQ ID NO: 733444 - RNA, 64 nt, hsa; identical to SEQ ID NO: 617998

SEQ ID NO: 733445 - RNA, 64 nt, hsa; identical to SEQ ID NO: 617999

SEQ ID NO: 733446 - RNA, 64 nt, hsa; identical to SEQ ID NO: 618000

SEQ ID NO: 733447 - RNA, 64 nt, hsa; identical to SEQ ID NO: 618001

SEQ ID NO: 733448 - RNA, 64 nt, hsa; identical to SEQ ID NO: 618002

SEQ ID NO: 733449 - RNA, 64 nt, hsa; identical to SEQ ID NO: 618003

SEQ ID NO: 733450 - RNA, 64 nt, hsa; identical to SEQ ID NO: 618004

SEQ ID NO: 733451 - RNA, 64 nt, hsa; identical to SEQ ID NO: 618005

SEQ ID NO: 733452 - RNA, 64 nt, hsa; identical to SEQ ID NO: 618006

SEQ ID NO: 733453 - RNA, 64 nt, hsa; identical to SEQ ID NO: 618007

SEQ ID NO: 733454 - RNA, 64 nt, hsa; identical to SEQ ID NO: 618008

SEQ ID NO: 733455 - RNA, 64 nt, hsa; identical to SEQ ID NO: 618009

SEQ ID NO: 733456 - RNA, 64 nt, hsa; identical to SEQ ID NO: 618010

SEQ ID NO: 733457 - RNA, 64 nt, hsa; identical to SEQ ID NO: 618011

SEQ ID NO: 733458 - RNA, 64 nt, hsa; identical to SEQ ID NO: 618012

SEQ ID NO: 733459 - RNA, 64 nt, hsa; identical to SEQ ID NO: 618013

SEQ ID NO: 733460 - RNA, 64 nt, hsa; identical to SEQ ID NO: 618014

SEQ ID NO: 733461 - RNA, 64 nt, hsa; identical to SEQ ID NO: 618015

SEQ ID NO: 733462 - RNA, 64 nt, hsa; identical to SEQ ID NO: 618016

SEQ ID NO: 733463 - RNA, 64 nt, hsa; identical to SEQ ID NO: 618017

SEQ ID NO: 733464 - RNA, 64 nt, hsa; identical to SEQ ID NO: 618018

SEQ ID NO: 733465 - RNA, 64 nt, hsa; identical to SEQ ID NO: 618019

SEQ ID NO: 733466 - RNA, 64 nt, hsa; identical to SEQ ID NO: 618020

SEQ ID NO: 733467 - RNA, 64 nt, hsa; identical to SEQ ID NO: 618021

SEQ ID NO: 733468 - RNA, 64 nt, hsa; identical to SEQ ID NO: 618022

SEQ ID NO: 733469 - RNA, 64 nt, hsa; identical to SEQ ID NO: 618023

SEQ ID NO: 733470 - RNA, 64 nt, hsa; identical to SEQ ID NO: 618024

SEQ ID NO: 733471 - RNA, 64 nt, hsa; identical to SEQ ID NO: 618025

SEQ ID NO: 733472 - RNA, 64 nt, hsa; identical to SEQ ID NO: 618026

SEQ ID NO: 733473 - RNA, 64 nt, hsa; identical to SEQ ID NO: 618027

SEQ ID NO: 733474 - RNA, 64 nt, hsa; identical to SEQ ID NO: 618028

SEQ ID NO: 733475 - RNA, 64 nt, hsa; identical to SEQ ID NO: 618029

SEQ ID NO: 733476 - RNA, 64 nt, hsa; identical to SEQ ID NO: 618030

SEQ ID NO: 733477 - RNA, 64 nt, hsa; identical to SEQ ID NO: 618031

SEQ ID NO: 733478 - RNA, 64 nt, hsa; identical to SEQ ID NO: 618032

SEQ ID NO: 733479 - RNA, 64 nt, hsa; identical to SEQ ID NO: 618033

SEQ ID NO: 733480 - RNA, 64 nt, hsa; identical to SEQ ID NO: 618034

SEQ ID NO: 733481 - RNA, 64 nt, hsa; identical to SEQ ID NO: 618035

SEQ ID NO: 733482 - RNA, 64 nt, hsa; identical to SEQ ID NO: 618036

SEQ ID NO: 733483 - RNA, 64 nt, hsa; identical to SEQ ID NO: 618037

SEQ ID NO: 733484 - RNA, 64 nt, hsa; identical to SEQ ID NO: 618038

SEQ ID NO: 733485 - RNA, 64 nt, hsa; identical to SEQ ID NO: 618039

SEQ ID NO: 733486 - RNA, 64 nt, hsa; identical to SEQ ID NO: 618040

SEQ ID NO: 733487 - RNA, 64 nt, hsa; identical to SEQ ID NO: 618041

SEQ ID NO: 733488 - RNA, 64 nt, hsa; identical to SEQ ID NO: 618042

SEQ ID NO: 733489 - RNA, 64 nt, hsa; identical to SEQ ID NO: 618043

SEQ ID NO: 733490 - RNA, 64 nt, hsa; identical to SEQ ID NO: 618044

SEQ ID NO: 733491 - RNA, 64 nt, hsa; identical to SEQ ID NO: 618045

SEQ ID NO: 733492 - RNA, 64 nt, hsa; identical to SEQ ID NO: 618046

SEQ ID NO: 733493 - RNA, 64 nt, hsa; identical to SEQ ID NO: 618047

SEQ ID NO: 733494 - RNA, 64 nt, hsa; identical to SEQ ID NO: 618048

SEQ ID NO: 733495 - RNA, 64 nt, hsa; identical to SEQ ID NO: 618049

SEQ ID NO: 733496 - RNA, 64 nt, hsa; identical to SEQ ID NO: 618050

SEQ ID NO: 733497 - RNA, 64 nt, hsa; identical to SEQ ID NO: 618051

SEQ ID NO: 733498 - RNA, 64 nt, hsa; identical to SEQ ID NO: 618052

SEQ ID NO: 733499 - RNA, 64 nt, hsa; identical to SEQ ID NO: 618053

SEQ ID NO: 733500 - RNA, 64 nt, hsa; identical to SEQ ID NO: 618054

SEQ ID NO: 733501 - RNA, 64 nt, hsa; identical to SEQ ID NO: 618055

SEQ ID NO: 733502 - RNA, 64 nt, hsa; identical to SEQ ID NO: 618056

SEQ ID NO: 733503 - RNA, 64 nt, hsa; identical to SEQ ID NO: 618057

SEQ ID NO: 733504 - RNA, 64 nt, hsa; identical to SEQ ID NO: 618058

SEQ ID NO: 733505 - RNA, 64 nt, hsa; identical to SEQ ID NO: 618059

SEQ ID NO: 733506 - RNA, 64 nt, hsa; identical to SEQ ID NO: 618060

SEQ ID NO: 733507 - RNA, 64 nt, hsa; identical to SEQ ID NO: 618061

SEQ ID NO: 733508 - RNA, 64 nt, hsa; identical to SEQ ID NO: 618062

SEQ ID NO: 733509 - RNA, 64 nt, hsa; identical to SEQ ID NO: 618063

SEQ ID NO: 733510 - RNA, 64 nt, hsa; identical to SEQ ID NO: 618064

SEQ ID NO: 733511 - RNA, 64 nt, hsa; identical to SEQ ID NO: 618065

SEQ ID NO: 733512 - RNA, 64 nt, hsa; identical to SEQ ID NO: 618066

SEQ ID NO: 733513 - RNA, 64 nt, hsa; identical to SEQ ID NO: 618067

SEQ ID NO: 733514 - RNA, 64 nt, hsa; identical to SEQ ID NO: 618068

SEQ ID NO: 733515 - RNA, 64 nt, hsa; identical to SEQ ID NO: 618069

SEQ ID NO: 733516 - RNA, 64 nt, hsa; identical to SEQ ID NO: 618070

SEQ ID NO: 733517 - RNA, 64 nt, hsa; identical to SEQ ID NO: 618071

SEQ ID NO: 733518 - RNA, 64 nt, hsa; identical to SEQ ID NO: 618072

SEQ ID NO: 733519 - RNA, 64 nt, hsa; identical to SEQ ID NO: 618073

SEQ ID NO: 733520 - RNA, 64 nt, hsa; identical to SEQ ID NO: 618074

SEQ ID NO: 733521 - RNA, 64 nt, hsa; identical to SEQ ID NO: 618075

SEQ ID NO: 733522 - RNA, 64 nt, hsa; identical to SEQ ID NO: 618076

SEQ ID NO: 733523 - RNA, 64 nt, hsa; identical to SEQ ID NO: 213308

SEQ ID NO: 733524 - RNA, 64 nt, hsa; identical to SEQ ID NO: 213309

SEQ ID NO: 733525 - RNA, 64 nt, hsa; identical to SEQ ID NO: 213310

SEQ ID NO: 733526 - RNA, 64 nt, hsa; identical to SEQ ID NO: 213311

SEQ ID NO: 733527 - RNA, 64 nt, hsa; identical to SEQ ID NO: 213312

SEQ ID NO: 733528 - RNA, 64 nt, hsa; identical to SEQ ID NO: 213313

SEQ ID NO: 733529 - RNA, 64 nt, hsa; identical to SEQ ID NO: 213314

SEQ ID NO: 733530 - RNA, 64 nt, hsa; identical to SEQ ID NO: 213315

SEQ ID NO: 733531 - RNA, 64 nt, hsa; identical to SEQ ID NO: 213316

SEQ ID NO: 733532 - RNA, 64 nt, hsa; identical to SEQ ID NO: 213317

SEQ ID NO: 733533 - RNA, 64 nt, hsa; identical to SEQ ID NO: 213318

SEQ ID NO: 733534 - RNA, 64 nt, hsa; identical to SEQ ID NO: 213319

SEQ ID NO: 733535 - RNA, 64 nt, hsa; identical to SEQ ID NO: 213320

SEQ ID NO: 733536 - RNA, 64 nt, hsa; identical to SEQ ID NO: 213321

SEQ ID NO: 733537 - RNA, 64 nt, hsa; identical to SEQ ID NO: 213322

SEQ ID NO: 733538 - RNA, 64 nt, hsa; identical to SEQ ID NO: 213323

SEQ ID NO: 733539 - RNA, 64 nt, hsa; identical to SEQ ID NO: 213324

SEQ ID NO: 733540 - RNA, 64 nt, hsa; identical to SEQ ID NO: 213325

SEQ ID NO: 733541 - RNA, 64 nt, hsa; identical to SEQ ID NO: 213326

SEQ ID NO: 733542 - RNA, 64 nt, hsa; identical to SEQ ID NO: 213327

SEQ ID NO: 733543 - RNA, 64 nt, hsa; identical to SEQ ID NO: 213328

SEQ ID NO: 733544 - RNA, 64 nt, hsa; identical to SEQ ID NO: 213329

SEQ ID NO: 733545 - RNA, 64 nt, hsa; identical to SEQ ID NO: 213330

SEQ ID NO: 733546 - RNA, 64 nt, hsa; identical to SEQ ID NO: 213331

SEQ ID NO: 733547 - RNA, 64 nt, hsa; identical to SEQ ID NO: 213332

SEQ ID NO: 733548 - RNA, 64 nt, hsa; identical to SEQ ID NO: 213333

SEQ ID NO: 733549 - RNA, 64 nt, hsa; identical to SEQ ID NO: 213334

SEQ ID NO: 733550 - RNA, 64 nt, hsa; identical to SEQ ID NO: 213335

SEQ ID NO: 733551 - RNA, 64 nt, hsa; identical to SEQ ID NO: 213336

SEQ ID NO: 733552 - RNA, 64 nt, hsa; identical to SEQ ID NO: 213337

SEQ ID NO: 733553 - RNA, 64 nt, hsa; identical to SEQ ID NO: 213338

SEQ ID NO: 733554 - RNA, 60 nt, hsa
uguuuuguucaaucuggaagaaugacuguaucagucaauggggauuuuaacagacugccu

SEQ ID NO: 733555 - RNA, 60 nt, hsa
uuucuguagggaugagaauuccucuuuuaaucagucaagggagaugcuucaaagcuggag

SEQ ID NO: 733556 - RNA, 60 nt, hsa
ugcuaggaacagccuucccuccguuuccccucagucaaacuugagccagccucuggaucg

SEQ ID NO: 733557 - RNA, 60 nt, hsa
uaaacauucuucagugaaaauaauuuuauuucagucaaacauuuaugaggaaaugagauc

SEQ ID NO: 733558 - RNA, 60 nt, hsa
cacaugaauguaaugaauguggaaaagcuuucagucaaaccucaugccuuauucagcauc

SEQ ID NO: 733559 - RNA, 60 nt, hsa
uccauugcugcaaugaaugugaaaaagccaucagucaaagaaacuaccuuguuuaguauc

SEQ ID NO: 733560 - RNA, 60 nt, hsa
guucccuaaggaacagcauuucucugcuccucagucaacccccguagccuagagcagugu

SEQ ID NO: 733561 - RNA, 60 nt, hsa
ugugguaggcauuuggcauauuuuguggacucagucaagcaaccacagucuguuaaucau

SEQ ID NO: 733562 - RNA, 60 nt, hsa
aacccuaaauugaaagacaaaacuaugguuucagucaacauauucaugaauuagggagcu

SEQ ID NO: 733563 - RNA, 60 nt, hsa
aggggaugcucuacaucaagggaugcaccuucagucaaacugucaaaaagcccagaauuc

SEQ ID NO: 733564 - RNA, 64 nt, hsa
auaugaguuaaauuuaaaaguuucaauuuauugcucaguguaccuguuaacauuauauuuaaca

SEQ ID NO: 733565 - RNA, 64 nt, hsa
aauaaaaaaaguugguaaaacaugguuuuauaccucaguguauaagaugugcaagacaaauaug

SEQ ID NO: 733566 - RNA, 64 nt, hsa
aaaagaccaaggaugcaguugaauggaaaauuacucaguguauagaaaggaaaaaaaccagaaa

SEQ ID NO: 733567 - RNA, 64 nt, hsa
accagccccccaaaaaaccucucaguaguuucuuucaguguacaaaaugaugagcauuuuucua

SEQ ID NO: 733568 - RNA, 64 nt, hsa
uugugcacugauuugaccauugugaaauccuuucucaguguaacugcauuucuaauaaaaauuu

SEQ ID NO: 733569 - RNA, 64 nt, hsa
uucuaaaaugauguagccugacaagacauuuuuuucaguguauaaaacuagguaguauugugca

SEQ ID NO: 733570 - RNA, 64 nt, hsa
uuggaagagaacgcgcuugauggauagagcgccuucaguguacuguuucuuauuaacuuuacuu

SEQ ID NO: 733571 - RNA, 64 nt, hsa
uuauuucaaaaaauccuacaaauauugucagcuuucaguguagugagauuauuccuguagguua

SEQ ID NO: 733572 - RNA, 64 nt, hsa
agcugagcucuucugcuaaaguucaaaguucacaucaguguagccagagugaagcaucuuuguu

SEQ ID NO: 733573 - RNA, 64 nt, hsa
aucaugaaaagguuuauauucacuauucuuuauuucaguguagcacuuuuagagccaaaaaaac

SEQ ID NO: 733574 - RNA, 64 nt, hsa
uuucugcguauauaugaaaacugaaugauauuucucaguguauuuccuugcauuugaaugguuc

SEQ ID NO: 733575 - RNA, 64 nt, hsa
ugaaucuuauuauuuaaaucacuucaguuagcuuucaguguauguuuaauaauauacauuuaau

SEQ ID NO: 733576 - RNA, 64 nt, hsa
gaaaucagagaauucacacuagugagaaaccguaucaguguaaaaaauguagaaaauccuuuau

SEQ ID NO: 733577 - RNA, 64 nt, hsa
gacaucagagaauucacaaaggagagaaacccuaucaguguaaagaaugugggaagguuuuuaa

SEQ ID NO: 733578 - RNA, 56 nt, hsa
accucuucugcuucaguugaggugacacgucucagccuuagcccugugcccccuga

SEQ ID NO: 733579 - RNA, 64 nt, hsa
ucuggagggcuccugagccucugcguaaggcugaacgucucacugacugagcuagucuucuugu

SEQ ID NO: 733580 - RNA, 64 nt, hsa
gcuugaauaaaaaccagagaagguuuuucccaggacgucucauguuuggcccuuuagaauuggg

SEQ ID NO: 733581 - RNA, 64 nt, hsa
acaaggagcuugccaggcuucauguagccgacacacgucucaggauuuuaaguccacauuggcc

SEQ ID NO: 733582 - RNA, 64 nt, hsa
cuucuaccaaaaugcuuuaaguucuauggaaagaacgucucauacugacauaaaugaagaaaau

SEQ ID NO: 733583 - RNA, 64 nt, hsa
gcuaagucacuacacuacaucguuauuuucuauuacgucucauucuucccuuucuaaauggaac

SEQ ID NO: 733584 - RNA, 64 nt, hsa
aaacaaauauagacaaauauuuugauucuagagaacgucucagaugugcuuauaaagcuuccaa

SEQ ID NO: 733585 - RNA, 64 nt, hsa
cucugggugucucaggggccugcccucaucaucaacgucucagcccuucaguuuggucugcucc

SEQ ID NO: 733586 - RNA, 64 nt, hsa
cuacaagcacuugaaaaugauauuuuuauuuuuaacgucucaacaaucugauaucggaugucgu

SEQ ID NO: 733587 - RNA, 64 nt, hsa
ugcucucaggaagcccagggaaggcugugcagggacgucucaucucccaugugugaugcugaca

SEQ ID NO: 733588 - RNA, 64 nt, hsa
aaaguuuucuccucuuaaauguuauuuugcuuuuacgucucaacuguguauguaaaaaaaauga

SEQ ID NO: 733589 - RNA, 64 nt, hsa
aaagacaaaaaaggaaaucuggauucugaggaccacgucucacccagggugacaucaggaaugg

SEQ ID NO: 733590 - RNA, 64 nt, hsa
acacacaucucaugcuguacaccugaggcugcucacgucucacgcccaguguuggugcacauuu

SEQ ID NO: 733591 - RNA, 64 nt, hsa
gcuuuauuugcuuaaauaccuucauuuguauaguacgucucacuugaaauugcuuuguauacau

SEQ ID NO: 733592 - RNA, 64 nt, hsa
uucuaauaauuuucaucaauaggaaaaaagaaauacgucucauucuucaauacuuuaaaauggc

SEQ ID NO: 733593 - RNA, 64 nt, hsa
aguucgguucucucccacagccagagcugguggaacgucucauugcuguagauaucagcccagu

SEQ ID NO: 733594 - RNA, 64 nt, hsa
uucuaugguguagaaucuuucuuucugauaaggaacgucucaggcuuagaaauauaugaaauug

SEQ ID NO: 733595 - RNA, 64 nt, hsa
cauauuuugaguucuuaaauacuaccaacccugaacgucucaggacaaauaauucaaaaaagag

SEQ ID NO: 733596 - RNA, 64 nt, hsa
aacagggagaggccacggggcccaaaaacgcaacacgucucaaggcaaacccgagggaggaacu

SEQ ID NO: 733597 - RNA, 64 nt, hsa
cuaagucacuacacuacaucguuuauuuucuauuacgucucauucuucccuuucuaaauggaac

SEQ ID NO: 733598 - RNA, 64 nt, hsa
cacuuuaaaguuugagaaagaauaguguggaagcacgucucaaauuuagacuuguucccccucu

SEQ ID NO: 733599 - RNA, 64 nt, hsa
auuuuaaaccuccaaaaugaucaccuuugacuccacgucucacaaucaucucucucaaguucga

SEQ ID NO: 733600 - RNA, 64 nt, hsa
aaugcuuguugaaucaggggcaaacggaguacagacgucucaagacugaaacggccccauugcc

SEQ ID NO: 733601 - RNA, 64 nt, hsa
gagauuuuuuagaucuuccuucccacauugcuagacgucucacucaaagacauuuguugggagu

SEQ ID NO: 733602 - RNA, 64 nt, hsa
uguaugccaucauggggcaccugaaaagaaaaacacgucucaccacugugguugauucaaaaga

SEQ ID NO: 733603 - RNA, 64 nt, hsa
uggguccauuuuucugacugugaaguaaggagagacgucucaguacccagggccucuucagcuc

SEQ ID NO: 733604 - RNA, 64 nt, hsa
cuggacgggauguuuccaagcucuuguuccccuaacgucucaacaggcgcucacugaaguguau

SEQ ID NO: 733605 - RNA, 64 nt, hsa
cccaagguuguuuuagaggauuggauagacuugcacgucucagguuuuugccaugcagaaucaa

SEQ ID NO: 733606 - RNA, 64 nt, hsa
agccugucaccgauggcugacugaugaaauggacacgucucaucugacccacucuuccuuccac

SEQ ID NO: 733607 - RNA, 64 nt, hsa
uacucaagcagaucucaucucaugacaggcagccacgucucaacauggguaaggggugggggug

SEQ ID NO: 733608 - RNA, 64 nt, hsa
ggcugcuuauucacucuggggauucgccauggacacgucucaacugcgcaagcugcugcccaug

SEQ ID NO: 733609 - RNA, 64 nt, hsa
uagcacuuacuuaaucuuuucaguuuuccaguuuacgucucaggaaugaaguguagucuauggu

SEQ ID NO: 733610 - RNA, 64 nt, hsa
uggagucuuaggcaucucugguacaguggggugcacgucucagguggaggaagauuuacggcuc

SEQ ID NO: 733611 - RNA, 64 nt, hsa
cguccugagacggcugcggacacuggcuccuuccacgucucaccaggcagacagucugccuagg

SEQ ID NO: 733612 - RNA, 64 nt, hsa
gauuuuauuuagcaagcccagaccuuccggucuaacgucucacaccacgacggacuccccuucc

SEQ ID NO: 733613 - RNA, 64 nt, hsa
gauuucuaggccugauauccaacagaaagcauagacgucucagguuauucguuacucuaaggua

SEQ ID NO: 733614 - RNA, 64 nt, hsa
caugccucaggcuucugcagcccagggcacuagaacgucucacacucagagccggcuggcccgg

SEQ ID NO: 733615 - RNA, 64 nt, hsa
accaggggccuucacgucugcccuuugugaacggacgucucagggcugcugugccccuugggug

SEQ ID NO: 733616 - RNA, 64 nt, hsa
ucuuguuuauucugggcucagacccuccucuuguacgucucaucacagcugguagagacccagg

SEQ ID NO: 733617 - RNA, 64 nt, hsa
caaaugcuguuucccaacaccccaaagucugcacacgucucaugaaugcaucacauuucuguca

SEQ ID NO: 733618 - RNA, 64 nt, hsa
caaggauuacauucuagagcuaaaagugaaggaaacgucucaagugacuuugguccacacugag

SEQ ID NO: 733619 - RNA, 64 nt, hsa
ccugacggacauggacgcccugagcugugaguccacgucucaugugcacgccccggccagcuaa

SEQ ID NO: 733620 - RNA, 64 nt, hsa
uuuauucuuuggguccuuccaucccacugggaaaacgucucagguggccucugaaacaccacuc

SEQ ID NO: 733621 - RNA, 64 nt, hsa
gagugcaucacccucugggaaccuccguguguucacgucucaugaagcucuccaaauccagucc

SEQ ID NO: 733622 - RNA, 64 nt, hsa
aaaaaaaucaauuuaaaggggagaaaacuucagcacgucucaacagaagaccaccaaauggcca

SEQ ID NO: 733623 - RNA, 64 nt, hsa
cuggaucugcuuguugcauuuccagcugugcagcacgucucagagauucuugaagaaugaagac

SEQ ID NO: 733624 - RNA, 64 nt, hsa
auucaugaccaguagcagcccagcuaugccugccacgucucauggccccuguguaagccagacc

SEQ ID NO: 733625 - RNA, 64 nt, hsa
ggcgcauggcggcgcaccugcugcaggagcggccacgucucagcuucauuauaccauggccugc

SEQ ID NO: 733626 - RNA, 64 nt, hsa
gccccgggaguggccuuggcucccuggagagcccacgucucagccacaguucuccacucgccuc

SEQ ID NO: 733627 - RNA, 64 nt, hsa; identical to SEQ ID NO: 145321

SEQ ID NO: 733628 - RNA, 64 nt, hsa; identical to SEQ ID NO: 145322

SEQ ID NO: 733629 - RNA, 64 nt, hsa; identical to SEQ ID NO: 145323

SEQ ID NO: 733630 - RNA, 64 nt, hsa; identical to SEQ ID NO: 145324

SEQ ID NO: 733631 - RNA, 64 nt, hsa; identical to SEQ ID NO: 145325

SEQ ID NO: 733632 - RNA, 64 nt, hsa; identical to SEQ ID NO: 145326

SEQ ID NO: 733633 - RNA, 64 nt, hsa; identical to SEQ ID NO: 145327

SEQ ID NO: 733634 - RNA, 64 nt, hsa; identical to SEQ ID NO: 145328

SEQ ID NO: 733635 - RNA, 64 nt, hsa; identical to SEQ ID NO: 145329

SEQ ID NO: 733636 - RNA, 64 nt, hsa; identical to SEQ ID NO: 145330

SEQ ID NO: 733637 - RNA, 62 nt, hsa; identical to SEQ ID NO: 145331

SEQ ID NO: 733638 - RNA, 64 nt, hsa; identical to SEQ ID NO: 145332

SEQ ID NO: 733639 - RNA, 64 nt, hsa; identical to SEQ ID NO: 145333

SEQ ID NO: 733640 - RNA, 64 nt, hsa; identical to SEQ ID NO: 145334

SEQ ID NO: 733641 - RNA, 64 nt, hsa; identical to SEQ ID NO: 145335

SEQ ID NO: 733642 - RNA, 64 nt, hsa; identical to SEQ ID NO: 145336

SEQ ID NO: 733643 - RNA, 64 nt, hsa; identical to SEQ ID NO: 145337

SEQ ID NO: 733644 - RNA, 64 nt, hsa; identical to SEQ ID NO: 145338

SEQ ID NO: 733645 - RNA, 64 nt, hsa; identical to SEQ ID NO: 145339

SEQ ID NO: 733646 - RNA, 64 nt, hsa; identical to SEQ ID NO: 145340

SEQ ID NO: 733647 - RNA, 64 nt, hsa; identical to SEQ ID NO: 145341

SEQ ID NO: 733648 - RNA, 64 nt, hsa; identical to SEQ ID NO: 145342

SEQ ID NO: 733649 - RNA, 64 nt, hsa; identical to SEQ ID NO: 145343

SEQ ID NO: 733650 - RNA, 64 nt, hsa; identical to SEQ ID NO: 145344

SEQ ID NO: 733651 - RNA, 64 nt, hsa; identical to SEQ ID NO: 145345

SEQ ID NO: 733652 - RNA, 64 nt, hsa; identical to SEQ ID NO: 145346

SEQ ID NO: 733653 - RNA, 64 nt, hsa; identical to SEQ ID NO: 145347

SEQ ID NO: 733654 - RNA, 64 nt, hsa; identical to SEQ ID NO: 145348

SEQ ID NO: 733655 - RNA, 64 nt, hsa; identical to SEQ ID NO: 145349

SEQ ID NO: 733656 - RNA, 64 nt, hsa; identical to SEQ ID NO: 145350

SEQ ID NO: 733657 - RNA, 64 nt, hsa; identical to SEQ ID NO: 145351

SEQ ID NO: 733658 - RNA, 64 nt, hsa; identical to SEQ ID NO: 145352

SEQ ID NO: 733659 - RNA, 64 nt, hsa; identical to SEQ ID NO: 145353

SEQ ID NO: 733660 - RNA, 64 nt, hsa; identical to SEQ ID NO: 145354

SEQ ID NO: 733661 - RNA, 64 nt, hsa; identical to SEQ ID NO: 145355

SEQ ID NO: 733662 - RNA, 64 nt, hsa; identical to SEQ ID NO: 145356

SEQ ID NO: 733663 - RNA, 64 nt, hsa; identical to SEQ ID NO: 145357

SEQ ID NO: 733664 - RNA, 64 nt, hsa; identical to SEQ ID NO: 145358

SEQ ID NO: 733665 - RNA, 64 nt, hsa
aucaguguguuuagacuuuucaaguaucuaacucauuuccaaacauguaccauguuuuauaaac

SEQ ID NO: 733666 - RNA, 64 nt, hsa
augaauacuuuuguauugcugcuugcaaauaugcauuuccaaacuugaaauauaggugugaaca

SEQ ID NO: 733667 - RNA, 64 nt, hsa
guugaagagaucuucucuggucagacuuggaagaauuuccaaaacugaaguuagccccaagacu

SEQ ID NO: 733668 - RNA, 64 nt, hsa
ugcaacacuguucucuucuucucuacuaaauucuauuuccaaaauugguaauagagccagaagg

SEQ ID NO: 733669 - RNA, 64 nt, hsa
ucauaaugcuuaaagccauauggaguuggaaauuauuuccaaagcauauuuauuccauuguuuu

SEQ ID NO: 733670 - RNA, 64 nt, hsa
auuuauuuuccuccauucauguacuuuuccuuauauuuccaaaacuguuacugagaauggguca

SEQ ID NO: 733671 - RNA, 64 nt, hsa
gguuuuucuuuucuauugcauagucaggcugcaaauuuccaaacuuuuaugcuuugcuucccuu

SEQ ID NO: 733672 - RNA, 64 nt, hsa
ugugauugaacacuuuaguaaugcaaaauaacucauuuccaacuacugcugcagcauuuuggua

SEQ ID NO: 733673 - RNA, 64 nt, hsa
ucaugugacauauuucccuuucccauuguugcugauuuccaaaucgcugucagcaauuuuuucc

SEQ ID NO: 733674 - RNA, 64 nt, hsa
ugacaugcugggaaucuucaccccaccagggcaaauuuccaaauagcucauuuuauucuagguc

SEQ ID NO: 733675 - RNA, 64 nt, hsa
cuguuacagacaagcuuauuuccaaagccaccucauuuccaaacaucucacucaggaagggagg

SEQ ID NO: 733676 - RNA, 64 nt, hsa
agucuuuguggaaaccacuguuacagacaagcuuauuuccaaagccaccucauuuccaaacauc

SEQ ID NO: 733677 - RNA, 64 nt, hsa
gugagauauauucaguauuguagauacuacacuaauuuccaacauaagaggcaggaagaguuuu

SEQ ID NO: 733678 - RNA, 64 nt, hsa
uccucugugucccggcauggaagccaguauaagcauuuccaaaugagggaaaaguccuuggcuc

SEQ ID NO: 733679 - RNA, 64 nt, hsa
gggaucccagcccacaagugaucagcagaguugcauuuccaaagaaaaaggcuaugagaugagc

SEQ ID NO: 733680 - RNA, 64 nt, hsa
uuuuuaacaaaaugaaaugauguguuaaguuuuuauuuccaaaguguuuaguuuauuggcugau

SEQ ID NO: 733681 - RNA, 64 nt, hsa
acaaagugagcauuucuuuuuaaauuuucuugacauuuccaagcuuauuaugaauaauauugca

SEQ ID NO: 733682 - RNA, 64 nt, hsa
uauaacuugugguuucugaacucauuauuguuguauuuccaaaaaaguaauaccuuuuaauuag

SEQ ID NO: 733683 - RNA, 64 nt, hsa
uauuguucagaagauuuuuacaaauuaaaaacugauuuccaaauauguucaacauuuacuucua

SEQ ID NO: 733684 - RNA, 64 nt, hsa
ugguaugcauuggauauagcaggaaagaaagcacauuuccaaacagcagggaguaagcuuacau

SEQ ID NO: 733685 - RNA, 64 nt, hsa
uuaacuaaaaccccuaggucauuuguagauauauauuuccaaauauucuaaaaaagauacugua

SEQ ID NO: 733686 - RNA, 64 nt, hsa
ggugugaaguccacuuauguagacaaaacuuauaauuuccaaacuguugucuaguauacaguga

SEQ ID NO: 733687 - RNA, 64 nt, hsa
auaucacauaguacauauauuauuuccuuaguuuauuuccaaacugguauuuuaaauagacacu

SEQ ID NO: 733688 - RNA, 64 nt, hsa
cuuggaagggcaaaaaucauccccuauuuuacuuauuuccaagaaaugcauuuucuuagcauca

SEQ ID NO: 733689 - RNA, 64 nt, hsa
aaggaaaccuuuucuuguaucuggauucaaauuuauuuccaauguuucaagcgggaaacaugac

SEQ ID NO: 733690 - RNA, 64 nt, hsa
agaugcuguagacaucuguccuacacuugagaugauuuccaagccucucuggcacuuugaguua

SEQ ID NO: 733691 - RNA, 64 nt, hsa
uagaccagaucuaauccgaagauuaaucuuuaggauuuccaauuuccaagccugaugggaucuc

SEQ ID NO: 733692 - RNA, 64 nt, hsa
gaucuaauccgaagauuaaucuuuaggauuuccaauuuccaagccugaugggaucucccagcug

SEQ ID NO: 733693 - RNA, 64 nt, hsa
acaacaugucacaauuuagugaggagcuacauguauuuccaagaauuccagcauagauuauaau

SEQ ID NO: 733694 - RNA, 64 nt, hsa
uucuagucuagaggucuguugguugaaggcagacauuuccaaguuuguugaaauaauacgaagc

SEQ ID NO: 733695 - RNA, 64 nt, hsa
uccuaccugcgcagucuaaacauagcuguggaucauuuccaacuuucaacuucacuccgggcca

SEQ ID NO: 733696 - RNA, 64 nt, hsa
gcgaggcugguuuccugugcagcagguggaguucauuuccaacccagagguccgugcacagaac

SEQ ID NO: 733697 - RNA, 64 nt, hsa
auuaguagucacuuguuuucauuaucauaauugaauuuccaagaacaacuugauaucauucagc

SEQ ID NO: 733698 - RNA, 64 nt, hsa
gcaauuaagugggaacauuuuuaauuuaaaaaaaauuuccaaauauuuguggguccgacaguaa

SEQ ID NO: 733699 - RNA, 64 nt, hsa
cacaaaagucaguauuuuaucuuaaaguggcuugauuuccaauagcugaacuugggcagaaaac

SEQ ID NO: 733700 - RNA, 64 nt, hsa
cacaucccagcagccgguucuggguagcagaucaauuuccaacuggaaaauaacuauauaaugu

SEQ ID NO: 733701 - RNA, 64 nt, hsa
gaugagauuacuuaaugauuuccaauuaaguuguauuuccaaauaucaugauuuccauuuuaau

SEQ ID NO: 733702 - RNA, 64 nt, hsa
cccacuguaaaaagguugaugagauuacuuaaugauuuccaauuaaguuguauuuccaaauauc

SEQ ID NO: 733703 - RNA, 64 nt, hsa
ccccaagcuauccuguuucagauaauaucaauuuauuuccaauccaucagacuaaaaucuaaga

SEQ ID NO: 733704 - RNA, 64 nt, hsa
uaguguauaacaucaaguucuguguaaugaggcuauuuccaagucuccaaagauggucacugua

SEQ ID NO: 733705 - RNA, 64 nt, hsa
aucuuaguaaacccaauuuccagucuuagucuguauuuccaauauuucuaauuccugagccacg

SEQ ID NO: 733706 - RNA, 64 nt, hsa
gcuuaccuguuaugugacagugauuuaccuguccauuuccaacccaaaagccugucagaaagca

SEQ ID NO: 733707 - RNA, 64 nt, hsa
gcaugagggcuaucaggccaaaauucauuauuguauuuccaauacaguuugucuugaaugucug

SEQ ID NO: 733708 - RNA, 64 nt, hsa
uuacuauuauguggaauuuaacuuuucagagaaaauuuccaaaguccucuaccuuauuuggcuu

SEQ ID NO: 733709 - RNA, 64 nt, hsa
uaaguuuauuuccaacauuagcucuaauuaguucauuuccaaucccagaacacauggagggaau

SEQ ID NO: 733710 - RNA, 64 nt, hsa
cccaaaucaugcagccuauccaauaaguaaguuuauuuccaacauuagcucuaauuaguucauu

SEQ ID NO: 733711 - RNA, 64 nt, hsa
uuuggagcaaaaaccuugcagugguaaauaaaaaauuuccaacagggucagcugccugguguuu

SEQ ID NO: 733712 - RNA, 64 nt, hsa
uagucuuugcaucagcuuaccuuguaccagaaacauuuccaauuuacuaucaaauuauaguaac

SEQ ID NO: 733713 - RNA, 64 nt, hsa
auuaacuaucaaauaaauaaauaaaagcaaucugauuuccaacgugguacuaccuggugaguuu

SEQ ID NO: 733714 - RNA, 64 nt, hsa
aggaaggugguuuugagaacuauguguuuggucuauuuccaaaaaccugagggggagaaaauac

SEQ ID NO: 733715 - RNA, 64 nt, hsa
uuaacauaacuucuaccaaggaaaaauaaguaaaauuuccaacccuugcauggccagucacuua

SEQ ID NO: 733716 - RNA, 64 nt, hsa
guguguaaugauaccacaugugguuuuaauuugcauuuccaauggcuaaugauguugaguaucu

SEQ ID NO: 733717 - RNA, 64 nt, hsa; identical to SEQ ID NO: 111411

SEQ ID NO: 733718 - RNA, 64 nt, hsa; identical to SEQ ID NO: 111412

SEQ ID NO: 733719 - RNA, 64 nt, hsa; identical to SEQ ID NO: 111413

SEQ ID NO: 733720 - RNA, 64 nt, hsa; identical to SEQ ID NO: 111414

SEQ ID NO: 733721 - RNA, 64 nt, hsa; identical to SEQ ID NO: 111415

SEQ ID NO: 733722 - RNA, 64 nt, hsa; identical to SEQ ID NO: 111416

SEQ ID NO: 733723 - RNA, 64 nt, hsa; identical to SEQ ID NO: 111417

SEQ ID NO: 733724 - RNA, 64 nt, hsa; identical to SEQ ID NO: 111418

SEQ ID NO: 733725 - RNA, 64 nt, hsa; identical to SEQ ID NO: 111419

SEQ ID NO: 733726 - RNA, 64 nt, hsa; identical to SEQ ID NO: 111420

SEQ ID NO: 733727 - RNA, 64 nt, hsa; identical to SEQ ID NO: 111421

SEQ ID NO: 733728 - RNA, 64 nt, hsa; identical to SEQ ID NO: 111422

SEQ ID NO: 733729 - RNA, 64 nt, hsa; identical to SEQ ID NO: 111423

SEQ ID NO: 733730 - RNA, 64 nt, hsa; identical to SEQ ID NO: 111424

SEQ ID NO: 733731 - RNA, 64 nt, hsa; identical to SEQ ID NO: 111425

SEQ ID NO: 733732 - RNA, 64 nt, hsa; identical to SEQ ID NO: 111426

SEQ ID NO: 733733 - RNA, 64 nt, hsa; identical to SEQ ID NO: 111427

SEQ ID NO: 733734 - RNA, 64 nt, hsa; identical to SEQ ID NO: 111428

SEQ ID NO: 733735 - RNA, 64 nt, hsa; identical to SEQ ID NO: 111429

SEQ ID NO: 733736 - RNA, 64 nt, hsa; identical to SEQ ID NO: 111430

SEQ ID NO: 733737 - RNA, 64 nt, hsa; identical to SEQ ID NO: 111431

SEQ ID NO: 733738 - RNA, 64 nt, hsa; identical to SEQ ID NO: 111432

SEQ ID NO: 733739 - RNA, 64 nt, hsa; identical to SEQ ID NO: 111433

SEQ ID NO: 733740 - RNA, 64 nt, hsa; identical to SEQ ID NO: 111434

SEQ ID NO: 733741 - RNA, 58 nt, hsa; identical to SEQ ID NO: 111435

SEQ ID NO: 733742 - RNA, 64 nt, hsa; identical to SEQ ID NO: 111436

SEQ ID NO: 733743 - RNA, 64 nt, hsa; identical to SEQ ID NO: 111437

SEQ ID NO: 733744 - RNA, 64 nt, hsa; identical to SEQ ID NO: 111438

SEQ ID NO: 733745 - RNA, 64 nt, hsa; identical to SEQ ID NO: 111439

SEQ ID NO: 733746 - RNA, 64 nt, hsa; identical to SEQ ID NO: 111440

SEQ ID NO: 733747 - RNA, 64 nt, hsa; identical to SEQ ID NO: 111441

SEQ ID NO: 733748 - RNA, 64 nt, hsa; identical to SEQ ID NO: 111442

SEQ ID NO: 733749 - RNA, 64 nt, hsa; identical to SEQ ID NO: 111443

SEQ ID NO: 733750 - RNA, 64 nt, hsa; identical to SEQ ID NO: 111444

SEQ ID NO: 733751 - RNA, 64 nt, hsa; identical to SEQ ID NO: 111445

SEQ ID NO: 733752 - RNA, 64 nt, hsa; identical to SEQ ID NO: 111446

SEQ ID NO: 733753 - RNA, 64 nt, hsa; identical to SEQ ID NO: 111447

SEQ ID NO: 733754 - RNA, 64 nt, hsa; identical to SEQ ID NO: 111448

SEQ ID NO: 733755 - RNA, 64 nt, hsa; identical to SEQ ID NO: 111449

SEQ ID NO: 733756 - RNA, 64 nt, hsa; identical to SEQ ID NO: 111450

SEQ ID NO: 733757 - RNA, 64 nt, hsa; identical to SEQ ID NO: 111451

SEQ ID NO: 733758 - RNA, 64 nt, hsa; identical to SEQ ID NO: 111452

SEQ ID NO: 733759 - RNA, 64 nt, hsa; identical to SEQ ID NO: 111453

SEQ ID NO: 733760 - RNA, 64 nt, hsa; identical to SEQ ID NO: 111454

SEQ ID NO: 733761 - RNA, 64 nt, hsa; identical to SEQ ID NO: 111455

SEQ ID NO: 733762 - RNA, 64 nt, hsa; identical to SEQ ID NO: 111456

SEQ ID NO: 733763 - RNA, 64 nt, hsa; identical to SEQ ID NO: 111457

SEQ ID NO: 733764 - RNA, 64 nt, hsa; identical to SEQ ID NO: 111458

SEQ ID NO: 733765 - RNA, 64 nt, hsa; identical to SEQ ID NO: 111459

SEQ ID NO: 733766 - RNA, 52 nt, hsa; identical to SEQ ID NO: 111460

SEQ ID NO: 733767 - RNA, 64 nt, hsa; identical to SEQ ID NO: 111461

SEQ ID NO: 733768 - RNA, 64 nt, hsa; identical to SEQ ID NO: 111462

SEQ ID NO: 733769 - RNA, 64 nt, hsa; identical to SEQ ID NO: 111463

SEQ ID NO: 733770 - RNA, 64 nt, hsa; identical to SEQ ID NO: 111464

SEQ ID NO: 733771 - RNA, 64 nt, hsa; identical to SEQ ID NO: 111465

SEQ ID NO: 733772 - RNA, 64 nt, hsa; identical to SEQ ID NO: 111466

SEQ ID NO: 733773 - RNA, 64 nt, hsa; identical to SEQ ID NO: 111467

SEQ ID NO: 733774 - RNA, 64 nt, hsa; identical to SEQ ID NO: 390817

SEQ ID NO: 733775 - RNA, 64 nt, hsa; identical to SEQ ID NO: 390818

SEQ ID NO: 733776 - RNA, 64 nt, hsa; identical to SEQ ID NO: 215540

SEQ ID NO: 733777 - RNA, 64 nt, hsa; identical to SEQ ID NO: 215541

SEQ ID NO: 733778 - RNA, 64 nt, hsa; identical to SEQ ID NO: 215542

SEQ ID NO: 733779 - RNA, 64 nt, hsa; identical to SEQ ID NO: 215543

SEQ ID NO: 733780 - RNA, 64 nt, hsa; identical to SEQ ID NO: 215544

SEQ ID NO: 733781 - RNA, 64 nt, hsa; identical to SEQ ID NO: 215545

SEQ ID NO: 733782 - RNA, 64 nt, hsa; identical to SEQ ID NO: 215546

SEQ ID NO: 733783 - RNA, 64 nt, hsa; identical to SEQ ID NO: 215547

SEQ ID NO: 733784 - RNA, 64 nt, hsa; identical to SEQ ID NO: 215548

SEQ ID NO: 733785 - RNA, 64 nt, hsa; identical to SEQ ID NO: 215549

SEQ ID NO: 733786 - RNA, 64 nt, hsa; identical to SEQ ID NO: 215550

SEQ ID NO: 733787 - RNA, 64 nt, hsa; identical to SEQ ID NO: 215551

SEQ ID NO: 733788 - RNA, 64 nt, hsa; identical to SEQ ID NO: 215552

SEQ ID NO: 733789 - RNA, 64 nt, hsa; identical to SEQ ID NO: 215553

SEQ ID NO: 733790 - RNA, 64 nt, hsa; identical to SEQ ID NO: 215554

SEQ ID NO: 733791 - RNA, 64 nt, hsa; identical to SEQ ID NO: 215555

SEQ ID NO: 733792 - RNA, 64 nt, hsa; identical to SEQ ID NO: 215556

SEQ ID NO: 733793 - RNA, 64 nt, hsa; identical to SEQ ID NO: 215557

SEQ ID NO: 733794 - RNA, 64 nt, hsa; identical to SEQ ID NO: 215558

SEQ ID NO: 733795 - RNA, 64 nt, hsa; identical to SEQ ID NO: 215559

SEQ ID NO: 733796 - RNA, 64 nt, hsa; identical to SEQ ID NO: 215560

SEQ ID NO: 733797 - RNA, 64 nt, hsa; identical to SEQ ID NO: 215561

SEQ ID NO: 733798 - RNA, 64 nt, hsa; identical to SEQ ID NO: 215562

SEQ ID NO: 733799 - RNA, 64 nt, hsa; identical to SEQ ID NO: 215563

SEQ ID NO: 733800 - RNA, 64 nt, hsa; identical to SEQ ID NO: 215564

SEQ ID NO: 733801 - RNA, 64 nt, hsa; identical to SEQ ID NO: 215565

SEQ ID NO: 733802 - RNA, 64 nt, hsa; identical to SEQ ID NO: 215566

SEQ ID NO: 733803 - RNA, 64 nt, hsa; identical to SEQ ID NO: 215567

SEQ ID NO: 733804 - RNA, 64 nt, hsa; identical to SEQ ID NO: 215568

SEQ ID NO: 733805 - RNA, 64 nt, hsa
caccagcacuuuaaacucuuuguguggguaugcguggguguauguuugggaagaaaaacaaagg

SEQ ID NO: 733806 - RNA, 64 nt, hsa
accuguucucuagcugugaucuuaccacuucaaauggguguaauuugaauaaauuuuguauggu

SEQ ID NO: 733807 - RNA, 64 nt, hsa
cauauuguacuuggguguaggacucuaguguucuuggguguauugcaugggcugcauuaucuac

SEQ ID NO: 733808 - RNA, 64 nt, hsa
ccacuugcagagggcugcuuuaucauauuguacuuggguguaggacucuaguguucuugggugu

SEQ ID NO: 733809 - RNA, 64 nt, hsa
gaauaccugagaagacacacuuggagaaaccuuuuggguguaaugaaugugggaaaaccuuuca

SEQ ID NO: 733810 - RNA, 64 nt, hsa
uucaccacagaacucauauaagacagaaacccuauggguguaaugaauguggaaaaucauucug

SEQ ID NO: 733811 - RNA, 64 nt, hsa; identical to SEQ ID NO: 585216

SEQ ID NO: 733812 - RNA, 64 nt, hsa; identical to SEQ ID NO: 585217

SEQ ID NO: 733813 - RNA, 64 nt, hsa; identical to SEQ ID NO: 585218

SEQ ID NO: 733814 - RNA, 64 nt, hsa; identical to SEQ ID NO: 585219

SEQ ID NO: 733815 - RNA, 64 nt, hsa; identical to SEQ ID NO: 585220

SEQ ID NO: 733816 - RNA, 64 nt, hsa; identical to SEQ ID NO: 585221

SEQ ID NO: 733817 - RNA, 64 nt, hsa; identical to SEQ ID NO: 585222

SEQ ID NO: 733818 - RNA, 64 nt, hsa; identical to SEQ ID NO: 585223

SEQ ID NO: 733819 - RNA, 64 nt, hsa; identical to SEQ ID NO: 585224

SEQ ID NO: 733820 - RNA, 64 nt, hsa; identical to SEQ ID NO: 585225

SEQ ID NO: 733821 - RNA, 64 nt, hsa; identical to SEQ ID NO: 585226

SEQ ID NO: 733822 - RNA, 64 nt, hsa; identical to SEQ ID NO: 585227

SEQ ID NO: 733823 - RNA, 64 nt, hsa; identical to SEQ ID NO: 585228

SEQ ID NO: 733824 - RNA, 64 nt, hsa; identical to SEQ ID NO: 585229

SEQ ID NO: 733825 - RNA, 64 nt, hsa; identical to SEQ ID NO: 585230

SEQ ID NO: 733826 - RNA, 64 nt, hsa; identical to SEQ ID NO: 585231

SEQ ID NO: 733827 - RNA, 64 nt, hsa; identical to SEQ ID NO: 585232

SEQ ID NO: 733828 - RNA, 64 nt, hsa; identical to SEQ ID NO: 585233

SEQ ID NO: 733829 - RNA, 64 nt, hsa; identical to SEQ ID NO: 585234

SEQ ID NO: 733830 - RNA, 64 nt, hsa; identical to SEQ ID NO: 585235

SEQ ID NO: 733831 - RNA, 64 nt, hsa; identical to SEQ ID NO: 585236

SEQ ID NO: 733832 - RNA, 64 nt, hsa; identical to SEQ ID NO: 585237

SEQ ID NO: 733833 - RNA, 64 nt, hsa; identical to SEQ ID NO: 585238

SEQ ID NO: 733834 - RNA, 64 nt, hsa; identical to SEQ ID NO: 585239

SEQ ID NO: 733835 - RNA, 64 nt, hsa; identical to SEQ ID NO: 585240

SEQ ID NO: 733836 - RNA, 64 nt, hsa; identical to SEQ ID NO: 585241

SEQ ID NO: 733837 - RNA, 64 nt, hsa; identical to SEQ ID NO: 585242

SEQ ID NO: 733838 - RNA, 64 nt, hsa; identical to SEQ ID NO: 585243

SEQ ID NO: 733839 - RNA, 64 nt, hsa; identical to SEQ ID NO: 585244

SEQ ID NO: 733840 - RNA, 64 nt, hsa; identical to SEQ ID NO: 585245

SEQ ID NO: 733841 - RNA, 64 nt, hsa; identical to SEQ ID NO: 585246

SEQ ID NO: 733842 - RNA, 64 nt, hsa; identical to SEQ ID NO: 585247

SEQ ID NO: 733843 - RNA, 64 nt, hsa; identical to SEQ ID NO: 585248

SEQ ID NO: 733844 - RNA, 64 nt, hsa; identical to SEQ ID NO: 585249

SEQ ID NO: 733845 - RNA, 64 nt, hsa; identical to SEQ ID NO: 585250

SEQ ID NO: 733846 - RNA, 64 nt, hsa; identical to SEQ ID NO: 585251

SEQ ID NO: 733847 - RNA, 64 nt, hsa; identical to SEQ ID NO: 585252

SEQ ID NO: 733848 - RNA, 64 nt, hsa; identical to SEQ ID NO: 585253

SEQ ID NO: 733849 - RNA, 64 nt, hsa; identical to SEQ ID NO: 585254

SEQ ID NO: 733850 - RNA, 64 nt, hsa; identical to SEQ ID NO: 585255

SEQ ID NO: 733851 - RNA, 64 nt, hsa; identical to SEQ ID NO: 585256

SEQ ID NO: 733852 - RNA, 64 nt, hsa; identical to SEQ ID NO: 585257

SEQ ID NO: 733853 - RNA, 64 nt, hsa; identical to SEQ ID NO: 585258

SEQ ID NO: 733854 - RNA, 64 nt, hsa; identical to SEQ ID NO: 585259

SEQ ID NO: 733855 - RNA, 64 nt, hsa; identical to SEQ ID NO: 585260

SEQ ID NO: 733856 - RNA, 64 nt, hsa; identical to SEQ ID NO: 585261

SEQ ID NO: 733857 - RNA, 64 nt, hsa; identical to SEQ ID NO: 585262

SEQ ID NO: 733858 - RNA, 64 nt, hsa; identical to SEQ ID NO: 585263

SEQ ID NO: 733859 - RNA, 63 nt, hsa
accacacccuccauuuccucauguugcugaccaggugcccauaugauuucuacacuucccaag

SEQ ID NO: 733860 - RNA, 63 nt, hsa
cauccucccagcacgcucuggggaggcggcucuggugcccauccucccagcaugcucuagaga

SEQ ID NO: 733861 - RNA, 63 nt, hsa
ccgucucccagcaugcucuagagaggcggcucuggugcccauccucccagcacgcucugggga

SEQ ID NO: 733862 - RNA, 63 nt, hsa
gcucacagggacgugguaugggcccugggugcaggugcccacauucugcuaaugagagcuuug

SEQ ID NO: 733863 - RNA, 63 nt, hsa
ucuucccuuguuccccagaaguagagggcucugggugcccauuucuugggggcuuuccagucu

SEQ ID NO: 733864 - RNA, 63 nt, hsa
acgcccccacucucccuccacacuuccaggguuggugcccacgaguuagaggcacgcccuccc

SEQ ID NO: 733865 - RNA, 63 nt, hsa
ggaugucaccucaccggccuggggaaggcggggggugcccaagcccagcccugugcccccgcu

SEQ ID NO: 733866 - RNA, 63 nt, hsa
cacccagaccacacacugacggccggcuccggcggugcccaccccucaggcuggcccggcacc

SEQ ID NO: 733867 - RNA, 63 nt, hsa
gguugucagguugcuguggauguaaggauaggaggugcccagugcuccgcucaaggaaggcug

SEQ ID NO: 733868 - RNA, 63 nt, hsa
agccacccccucuggccugcuggcaaugccacaggugcccaagaagauggaggaucccugugc

SEQ ID NO: 733869 - RNA, 63 nt, hsa
aagccaucccacagcuggaagguaggggaugggggugcccacacugagugaggaagggaaugg

SEQ ID NO: 733870 - RNA, 63 nt, hsa
agucacccuguggcaaaugccaggacagcugcaggugcccauuagcaacgccugccuucuggg

SEQ ID NO: 733871 - RNA, 63 nt, hsa
aaggugagggaugccauaccuugagaccaagccggugcccaccuaagggcuaaggccucuugc

SEQ ID NO: 733872 - RNA, 63 nt, hsa
ccccgggaaacugaggaacuaaagaaagcugaaggugcccaccugggccaccagaaggugaca

SEQ ID NO: 733873 - RNA, 63 nt, hsa
ccugccucagccucccgaguagcugggccuaaaggugcccaccacuauacccggcuaauuuuu

SEQ ID NO: 733874 - RNA, 63 nt, hsa
agcuccagguggggaccacgucuuccugagguuggugcccacuggcugggacccuuugcagug

SEQ ID NO: 733875 - RNA, 63 nt, hsa
ugggacagggugaggcucccagacgcuccucgaggugcccagcucuccagggagcuucuggcc

SEQ ID NO: 733876 - RNA, 63 nt, hsa
ccuuggcaucggagugucagggcccgaggucaaggugcccaagggaccugaagugaagcuccc

SEQ ID NO: 733877 - RNA, 63 nt, hsa
ccuagagacccgggaaggggcugugucgguaguggugcccacccuggauguggcagcaccgac

SEQ ID NO: 733878 - RNA, 63 nt, hsa
gcucuucucccccaaacccacgcguguucugaaggugcccaggagcggcgaugcacucgcacu

SEQ ID NO: 733879 - RNA, 63 nt, hsa
caugccucauccucccaaguaggugggauuacaggugcccaccaccaagcccugcaaauuuuu

SEQ ID NO: 733880 - RNA, 63 nt, hsa
ggacagcucacgaggcuuggaccugcuguggagggugcccagcagggggcugagcucugaggg

SEQ ID NO: 733881 - RNA, 63 nt, hsa
ggacgguucacaaggcuuggaccugccauggagggugcccagcagacguggugugagagggac

SEQ ID NO: 733882 - RNA, 63 nt, hsa
agauggcucaugaggcuuggaccugccguggagggugcccagcagacgugguaugagagggau

SEQ ID NO: 733883 - RNA, 63 nt, hsa
aggaacggcucacgagacuuggaccugguggagggugcccagcagacguggugugagagggac

SEQ ID NO: 733884 - RNA, 63 nt, hsa
ggacggcucacgaggcuuggaccugcuguggagggugcccagcagacguggugugagaggaac

SEQ ID NO: 733885 - RNA, 63 nt, hsa
augccuccugcacacagccgucugagcagggcaggugcccaacaccccccaccggaggacacg

SEQ ID NO: 733886 - RNA, 63 nt, hsa
uccaggggugugaccugggacgggugggccugaggugcccagcucagggcagccagguggcuc

SEQ ID NO: 733887 - RNA, 63 nt, hsa
cuugggguucagaggggacucuuccaggagaggggugcccagcggagguaaagaugauagagg

SEQ ID NO: 733888 - RNA, 64 nt, hsa; identical to SEQ ID NO: 199907

SEQ ID NO: 733889 - RNA, 64 nt, hsa; identical to SEQ ID NO: 199908

SEQ ID NO: 733890 - RNA, 64 nt, hsa; identical to SEQ ID NO: 199909

SEQ ID NO: 733891 - RNA, 64 nt, hsa; identical to SEQ ID NO: 199910

SEQ ID NO: 733892 - RNA, 64 nt, hsa; identical to SEQ ID NO: 199911

SEQ ID NO: 733893 - RNA, 64 nt, hsa; identical to SEQ ID NO: 199912

SEQ ID NO: 733894 - RNA, 64 nt, hsa; identical to SEQ ID NO: 199913

SEQ ID NO: 733895 - RNA, 64 nt, hsa; identical to SEQ ID NO: 199914

SEQ ID NO: 733896 - RNA, 64 nt, hsa; identical to SEQ ID NO: 199915

SEQ ID NO: 733897 - RNA, 64 nt, hsa; identical to SEQ ID NO: 199916

SEQ ID NO: 733898 - RNA, 64 nt, hsa; identical to SEQ ID NO: 199917

SEQ ID NO: 733899 - RNA, 64 nt, hsa; identical to SEQ ID NO: 199918

SEQ ID NO: 733900 - RNA, 64 nt, hsa; identical to SEQ ID NO: 199919

SEQ ID NO: 733901 - RNA, 64 nt, hsa; identical to SEQ ID NO: 199920

SEQ ID NO: 733902 - RNA, 64 nt, hsa; identical to SEQ ID NO: 199921

SEQ ID NO: 733903 - RNA, 64 nt, hsa; identical to SEQ ID NO: 199922

SEQ ID NO: 733904 - RNA, 64 nt, hsa; identical to SEQ ID NO: 199923

SEQ ID NO: 733905 - RNA, 64 nt, hsa; identical to SEQ ID NO: 199924

SEQ ID NO: 733906 - RNA, 64 nt, hsa; identical to SEQ ID NO: 199925

SEQ ID NO: 733907 - RNA, 64 nt, hsa; identical to SEQ ID NO: 199926

SEQ ID NO: 733908 - RNA, 64 nt, hsa; identical to SEQ ID NO: 199927

SEQ ID NO: 733909 - RNA, 64 nt, hsa; identical to SEQ ID NO: 199928

SEQ ID NO: 733910 - RNA, 64 nt, hsa; identical to SEQ ID NO: 199929

SEQ ID NO: 733911 - RNA, 64 nt, hsa; identical to SEQ ID NO: 199930

SEQ ID NO: 733912 - RNA, 64 nt, hsa; identical to SEQ ID NO: 199931

SEQ ID NO: 733913 - RNA, 64 nt, hsa; identical to SEQ ID NO: 199932

SEQ ID NO: 733914 - RNA, 64 nt, hsa; identical to SEQ ID NO: 199933

SEQ ID NO: 733915 - RNA, 64 nt, hsa; identical to SEQ ID NO: 199934

SEQ ID NO: 733916 - RNA, 64 nt, hsa; identical to SEQ ID NO: 199935

SEQ ID NO: 733917 - RNA, 64 nt, hsa; identical to SEQ ID NO: 199936

SEQ ID NO: 733918 - RNA, 64 nt, hsa; identical to SEQ ID NO: 199937

SEQ ID NO: 733919 - RNA, 64 nt, hsa; identical to SEQ ID NO: 199938

SEQ ID NO: 733920 - RNA, 64 nt, hsa; identical to SEQ ID NO: 199939

SEQ ID NO: 733921 - RNA, 64 nt, hsa; identical to SEQ ID NO: 199940

SEQ ID NO: 733922 - RNA, 64 nt, hsa; identical to SEQ ID NO: 199941

SEQ ID NO: 733923 - RNA, 64 nt, hsa; identical to SEQ ID NO: 199942

SEQ ID NO: 733924 - RNA, 64 nt, hsa
gacuguguguguguggaggggugacuguccguggaggggugacuguguccgugguguguauuau

SEQ ID NO: 733925 - RNA, 64 nt, hsa
ccugugugaguguugacugacuguguguguguggaggggugacuguccguggaggggugacugu

SEQ ID NO: 733926 - RNA, 64 nt, hsa
uagcagugacaauggcagucuuggcuuuaaagugaggggugacccuuuagugagcuuagcacag

SEQ ID NO: 733927 - RNA, 64 nt, hsa
caaggagcuucuuaaguuaaaucacuagaaauuuaggggugaucugggccuucauaugugugag

SEQ ID NO: 733928 - RNA, 64 nt, hsa
aacagagcaucugacaaaaggucccaguuuggccaggggugagggagagagcaccagacaggcu

SEQ ID NO: 733929 - RNA, 64 nt, hsa
uggcuacaggccucuuguggagaguuucacgggcaggggugauuccaacuucugccuguggaga

SEQ ID NO: 733930 - RNA, 64 nt, hsa
acccucaaugcaugauugguauucucaacagcaaaggggugaaaaaucuagagacagaggaggc

SEQ ID NO: 733931 - RNA, 64 nt, hsa
ggggugaaaaaucuagagacagaggaggccuggcaggggugauaaaaauggagauugaaaugaa

SEQ ID NO: 733932 - RNA, 64 nt, hsa
ggggugacaccaggagagagggacagguucugucaggggugacaccaggagagagggacagguu

SEQ ID NO: 733933 - RNA, 64 nt, hsa
accugcaaaccaggagagagggacagguucugucaggggugacaccaggacacagggacagguu

SEQ ID NO: 733934 - RNA, 64 nt, hsa; identical to SEQ ID NO: 71989

SEQ ID NO: 733935 - RNA, 64 nt, hsa; identical to SEQ ID NO: 71990

SEQ ID NO: 733936 - RNA, 64 nt, hsa; identical to SEQ ID NO: 71991

SEQ ID NO: 733937 - RNA, 64 nt, hsa; identical to SEQ ID NO: 71992

SEQ ID NO: 733938 - RNA, 64 nt, hsa; identical to SEQ ID NO: 71993

SEQ ID NO: 733939 - RNA, 64 nt, hsa; identical to SEQ ID NO: 71994

SEQ ID NO: 733940 - RNA, 64 nt, hsa; identical to SEQ ID NO: 71995

SEQ ID NO: 733941 - RNA, 64 nt, hsa; identical to SEQ ID NO: 71996

SEQ ID NO: 733942 - RNA, 64 nt, hsa; identical to SEQ ID NO: 71997

SEQ ID NO: 733943 - RNA, 64 nt, hsa; identical to SEQ ID NO: 71998

SEQ ID NO: 733944 - RNA, 64 nt, hsa; identical to SEQ ID NO: 71999

SEQ ID NO: 733945 - RNA, 64 nt, hsa; identical to SEQ ID NO: 72000

SEQ ID NO: 733946 - RNA, 64 nt, hsa; identical to SEQ ID NO: 72001

SEQ ID NO: 733947 - RNA, 64 nt, hsa; identical to SEQ ID NO: 72002

SEQ ID NO: 733948 - RNA, 64 nt, hsa; identical to SEQ ID NO: 72003

SEQ ID NO: 733949 - RNA, 64 nt, hsa; identical to SEQ ID NO: 72004

SEQ ID NO: 733950 - RNA, 64 nt, hsa; identical to SEQ ID NO: 72005

SEQ ID NO: 733951 - RNA, 64 nt, hsa; identical to SEQ ID NO: 72006

SEQ ID NO: 733952 - RNA, 64 nt, hsa; identical to SEQ ID NO: 72007

SEQ ID NO: 733953 - RNA, 64 nt, hsa; identical to SEQ ID NO: 72008

SEQ ID NO: 733954 - RNA, 64 nt, hsa; identical to SEQ ID NO: 72009

SEQ ID NO: 733955 - RNA, 64 nt, hsa; identical to SEQ ID NO: 72010

SEQ ID NO: 733956 - RNA, 64 nt, hsa; identical to SEQ ID NO: 72011

SEQ ID NO: 733957 - RNA, 64 nt, hsa; identical to SEQ ID NO: 72012

SEQ ID NO: 733958 - RNA, 64 nt, hsa; identical to SEQ ID NO: 72013

SEQ ID NO: 733959 - RNA, 64 nt, hsa; identical to SEQ ID NO: 72014

SEQ ID NO: 733960 - RNA, 64 nt, hsa; identical to SEQ ID NO: 72015

SEQ ID NO: 733961 - RNA, 64 nt, hsa; identical to SEQ ID NO: 72016

SEQ ID NO: 733962 - RNA, 64 nt, hsa; identical to SEQ ID NO: 72017

SEQ ID NO: 733963 - RNA, 64 nt, hsa; identical to SEQ ID NO: 72018

SEQ ID NO: 733964 - RNA, 64 nt, hsa; identical to SEQ ID NO: 72019

SEQ ID NO: 733965 - RNA, 64 nt, hsa; identical to SEQ ID NO: 72020

SEQ ID NO: 733966 - RNA, 64 nt, hsa; identical to SEQ ID NO: 72021

SEQ ID NO: 733967 - RNA, 64 nt, hsa; identical to SEQ ID NO: 72022

SEQ ID NO: 733968 - RNA, 64 nt, hsa; identical to SEQ ID NO: 72023

SEQ ID NO: 733969 - RNA, 64 nt, hsa; identical to SEQ ID NO: 276902

SEQ ID NO: 733970 - RNA, 64 nt, hsa; identical to SEQ ID NO: 276903

SEQ ID NO: 733971 - RNA, 64 nt, hsa; identical to SEQ ID NO: 276904

SEQ ID NO: 733972 - RNA, 64 nt, hsa; identical to SEQ ID NO: 276905

SEQ ID NO: 733973 - RNA, 64 nt, hsa; identical to SEQ ID NO: 276906

SEQ ID NO: 733974 - RNA, 64 nt, hsa; identical to SEQ ID NO: 276907

SEQ ID NO: 733975 - RNA, 64 nt, hsa; identical to SEQ ID NO: 276908

SEQ ID NO: 733976 - RNA, 64 nt, hsa; identical to SEQ ID NO: 276909

SEQ ID NO: 733977 - RNA, 64 nt, hsa; identical to SEQ ID NO: 276910

SEQ ID NO: 733978 - RNA, 64 nt, hsa; identical to SEQ ID NO: 276911

SEQ ID NO: 733979 - RNA, 64 nt, hsa; identical to SEQ ID NO: 276912

SEQ ID NO: 733980 - RNA, 64 nt, hsa; identical to SEQ ID NO: 276913

SEQ ID NO: 733981 - RNA, 64 nt, hsa; identical to SEQ ID NO: 276914

SEQ ID NO: 733982 - RNA, 64 nt, hsa; identical to SEQ ID NO: 276915

SEQ ID NO: 733983 - RNA, 64 nt, hsa; identical to SEQ ID NO: 276916

SEQ ID NO: 733984 - RNA, 64 nt, hsa; identical to SEQ ID NO: 276917

SEQ ID NO: 733985 - RNA, 64 nt, hsa; identical to SEQ ID NO: 276918

SEQ ID NO: 733986 - RNA, 64 nt, hsa; identical to SEQ ID NO: 276919

SEQ ID NO: 733987 - RNA, 64 nt, hsa; identical to SEQ ID NO: 276920

SEQ ID NO: 733988 - RNA, 64 nt, hsa; identical to SEQ ID NO: 276921

SEQ ID NO: 733989 - RNA, 64 nt, hsa; identical to SEQ ID NO: 276922

SEQ ID NO: 733990 - RNA, 64 nt, hsa; identical to SEQ ID NO: 276923

SEQ ID NO: 733991 - RNA, 64 nt, hsa; identical to SEQ ID NO: 276924

SEQ ID NO: 733992 - RNA, 64 nt, hsa; identical to SEQ ID NO: 276925

SEQ ID NO: 733993 - RNA, 64 nt, hsa; identical to SEQ ID NO: 276926

SEQ ID NO: 733994 - RNA, 64 nt, hsa; identical to SEQ ID NO: 276927

SEQ ID NO: 733995 - RNA, 64 nt, hsa; identical to SEQ ID NO: 276928

SEQ ID NO: 733996 - RNA, 64 nt, hsa; identical to SEQ ID NO: 276929

SEQ ID NO: 733997 - RNA, 64 nt, hsa; identical to SEQ ID NO: 276930

SEQ ID NO: 733998 - RNA, 64 nt, hsa; identical to SEQ ID NO: 276931

SEQ ID NO: 733999 - RNA, 64 nt, hsa; identical to SEQ ID NO: 276932

SEQ ID NO: 734000 - RNA, 64 nt, hsa; identical to SEQ ID NO: 276933

SEQ ID NO: 734001 - RNA, 64 nt, hsa; identical to SEQ ID NO: 276934

SEQ ID NO: 734002 - RNA, 64 nt, hsa; identical to SEQ ID NO: 276935

SEQ ID NO: 734003 - RNA, 64 nt, hsa; identical to SEQ ID NO: 276936

SEQ ID NO: 734004 - RNA, 64 nt, hsa; identical to SEQ ID NO: 276937

SEQ ID NO: 734005 - RNA, 64 nt, hsa; identical to SEQ ID NO: 276938

SEQ ID NO: 734006 - RNA, 64 nt, hsa; identical to SEQ ID NO: 276939

SEQ ID NO: 734007 - RNA, 64 nt, hsa; identical to SEQ ID NO: 276940

SEQ ID NO: 734008 - RNA, 64 nt, hsa; identical to SEQ ID NO: 276941

SEQ ID NO: 734009 - RNA, 56 nt, hsa; identical to SEQ ID NO: 276942

SEQ ID NO: 734010 - RNA, 64 nt, hsa; identical to SEQ ID NO: 276943

SEQ ID NO: 734011 - RNA, 64 nt, hsa; identical to SEQ ID NO: 276944

SEQ ID NO: 734012 - RNA, 64 nt, hsa; identical to SEQ ID NO: 276945

SEQ ID NO: 734013 - RNA, 64 nt, hsa; identical to SEQ ID NO: 276946

SEQ ID NO: 734014 - RNA, 64 nt, hsa; identical to SEQ ID NO: 276947

SEQ ID NO: 734015 - RNA, 64 nt, hsa; identical to SEQ ID NO: 276948

SEQ ID NO: 734016 - RNA, 64 nt, hsa; identical to SEQ ID NO: 276949

SEQ ID NO: 734017 - RNA, 64 nt, hsa; identical to SEQ ID NO: 276950

SEQ ID NO: 734018 - RNA, 64 nt, hsa; identical to SEQ ID NO: 276951

SEQ ID NO: 734019 - RNA, 64 nt, hsa; identical to SEQ ID NO: 276952

SEQ ID NO: 734020 - RNA, 64 nt, hsa; identical to SEQ ID NO: 276953

SEQ ID NO: 734021 - RNA, 64 nt, hsa; identical to SEQ ID NO: 276954

SEQ ID NO: 734022 - RNA, 64 nt, hsa; identical to SEQ ID NO: 276955

SEQ ID NO: 734023 - RNA, 64 nt, hsa; identical to SEQ ID NO: 276956

SEQ ID NO: 734024 - RNA, 64 nt, hsa; identical to SEQ ID NO: 276957

SEQ ID NO: 734025 - RNA, 64 nt, hsa; identical to SEQ ID NO: 276958

SEQ ID NO: 734026 - RNA, 64 nt, hsa; identical to SEQ ID NO: 276959

SEQ ID NO: 734027 - RNA, 64 nt, hsa; identical to SEQ ID NO: 276960

SEQ ID NO: 734028 - RNA, 57 nt, hsa; identical to SEQ ID NO: 276961

SEQ ID NO: 734029 - RNA, 64 nt, hsa; identical to SEQ ID NO: 276962

SEQ ID NO: 734030 - RNA, 64 nt, hsa; identical to SEQ ID NO: 276963

SEQ ID NO: 734031 - RNA, 64 nt, hsa; identical to SEQ ID NO: 276964

SEQ ID NO: 734032 - RNA, 64 nt, hsa; identical to SEQ ID NO: 276965

SEQ ID NO: 734033 - RNA, 64 nt, hsa; identical to SEQ ID NO: 276966

SEQ ID NO: 734034 - RNA, 64 nt, hsa; identical to SEQ ID NO: 276967

SEQ ID NO: 734035 - RNA, 64 nt, hsa; identical to SEQ ID NO: 276968

SEQ ID NO: 734036 - RNA, 64 nt, hsa; identical to SEQ ID NO: 276969

SEQ ID NO: 734037 - RNA, 64 nt, hsa; identical to SEQ ID NO: 276970

SEQ ID NO: 734038 - RNA, 64 nt, hsa; identical to SEQ ID NO: 276971

SEQ ID NO: 734039 - RNA, 64 nt, hsa; identical to SEQ ID NO: 276972

SEQ ID NO: 734040 - RNA, 64 nt, hsa; identical to SEQ ID NO: 276973

SEQ ID NO: 734041 - RNA, 64 nt, hsa; identical to SEQ ID NO: 276974

SEQ ID NO: 734042 - RNA, 64 nt, hsa; identical to SEQ ID NO: 276975

SEQ ID NO: 734043 - RNA, 64 nt, hsa; identical to SEQ ID NO: 276976

SEQ ID NO: 734044 - RNA, 64 nt, hsa; identical to SEQ ID NO: 276977

SEQ ID NO: 734045 - RNA, 64 nt, hsa; identical to SEQ ID NO: 276978

SEQ ID NO: 734046 - RNA, 64 nt, hsa; identical to SEQ ID NO: 276979

SEQ ID NO: 734047 - RNA, 64 nt, hsa; identical to SEQ ID NO: 276980

SEQ ID NO: 734048 - RNA, 64 nt, hsa; identical to SEQ ID NO: 276981

SEQ ID NO: 734049 - RNA, 64 nt, hsa; identical to SEQ ID NO: 276982

SEQ ID NO: 734050 - RNA, 64 nt, hsa; identical to SEQ ID NO: 276983

SEQ ID NO: 734051 - RNA, 64 nt, hsa; identical to SEQ ID NO: 276984

SEQ ID NO: 734052 - RNA, 64 nt, hsa; identical to SEQ ID NO: 276985

SEQ ID NO: 734053 - RNA, 64 nt, hsa; identical to SEQ ID NO: 276986

SEQ ID NO: 734054 - RNA, 64 nt, hsa; identical to SEQ ID NO: 276987

SEQ ID NO: 734055 - RNA, 64 nt, hsa; identical to SEQ ID NO: 276988

SEQ ID NO: 734056 - RNA, 63 nt, hsa
aauuuuuuuuccccauugauguuuagaaaguuugagacugaaacaggaaaggccauaaaauau

SEQ ID NO: 734057 - RNA, 63 nt, hsa
gagcauggauuacccaguagcuacuuuuuaauagagacugacuagguuuacaacuucugggag

SEQ ID NO: 734058 - RNA, 63 nt, hsa
uccugauccuuuucccucauuccugaacugcaggagacugagccccuuugggcuuuggugacc

SEQ ID NO: 734059 - RNA, 63 nt, hsa
cauauggcggguaccguaauccuagcuacucgggagacugacgggagaaucgcuugaacccag

SEQ ID NO: 734060 - RNA, 63 nt, hsa
gcagguuaaguaucuuccauguuaauguguuaagagacugaaaauaccagccaucagaaacug

SEQ ID NO: 734061 - RNA, 63 nt, hsa
auauuuuaggguggguuaggaguauccuuucuggagacugagaaagggguguauuuaauucca

SEQ ID NO: 734062 - RNA, 63 nt, hsa
cuauggauuuuauaaugaaagaaaaaggcauuggagacugaaggcagaaaugguugugacagu

SEQ ID NO: 734063 - RNA, 63 nt, hsa
aauaguacuuacaaaugacuccuaagggacugugagacugagagggcucacgccucuguguuc

SEQ ID NO: 734064 - RNA, 53 nt, hsa; identical to SEQ ID NO: 615283

SEQ ID NO: 734065 - RNA, 63 nt, hsa
auuagauuggaucucccaaguuuuaauugaaaggagacugaacgaaaaccuuucugcuuucug

SEQ ID NO: 734066 - RNA, 63 nt, hsa
uaacagcuugauccagggcgugaaagguuaguugagacugaaguguucacuuccauagaagaa

SEQ ID NO: 734067 - RNA, 63 nt, hsa
uucugugagaccaauuuugugcuaaugagcauugagacugaugcuuuguaagucacaccacaa

SEQ ID NO: 734068 - RNA, 63 nt, hsa
cuggccuccacaccaaacguucccuugcagauggagacugaaucugagggcagcagacuuuua

SEQ ID NO: 734069 - RNA, 63 nt, hsa
auuaaauuuagacaauuaaaacauuucuaaagugagacugaaaauaauauagaaaaucucauu

SEQ ID NO: 734070 - RNA, 63 nt, hsa
gggcaucaacauggccaacagcauugccaaccugagacugaaggccaaggaauauaguuuaca

SEQ ID NO: 734071 - RNA, 63 nt, hsa
ugguggcagaugccuguaacuccagcuacucgggagacugaaggacaagaaucacuugaaccu

SEQ ID NO: 734072 - RNA, 63 nt, hsa
aggagcacaaaugagccuuuaaaaaccaauucugagacugaacuuuuuuauagccuauuucuu

SEQ ID NO: 734073 - RNA, 63 nt, hsa
aauguggaacuugaugccacccccugcaauggagagacugauuuaggagcauugugucccuuc

SEQ ID NO: 734074 - RNA, 63 nt, hsa
uacauuaaaaaucaguuaagaguuuacaggaaagagacugagauugguaaucugaaaaggacc

SEQ ID NO: 734075 - RNA, 63 nt, hsa
gugucuuuuucuuuucauaaaguaacaacagacgagacugagguuaaacaucagaaaaaaacc

SEQ ID NO: 734076 - RNA, 63 nt, hsa
gagcucuuaacgcaaagaccaugcacaucaucagagacugagaugggagaggccugagacgga

SEQ ID NO: 734077 - RNA, 63 nt, hsa
aacacccacauggacacaaggaauguugcugcagagacugaaugacaugcaacaggugaaggu

SEQ ID NO: 734078 - RNA, 63 nt, hsa
acugaggagucugcaauuuggaauauggagagagagacugauuugcugaauuuccuucuaaau

SEQ ID NO: 734079 - RNA, 63 nt, hsa
gguuggugugucauggugccucaucauucuggggagacugaaaauaccuucaucacugaccug

SEQ ID NO: 734080 - RNA, 63 nt, hsa
ucacuggcuggggcagaggggcagccgcuaggagagacugaaagcagcagcuaggacugagga

SEQ ID NO: 734081 - RNA, 63 nt, hsa
gaauccuugucucaggcucugcuucuaaggaaagagacugaagagggacaacuuuuuccuaug

SEQ ID NO: 734082 - RNA, 63 nt, hsa
aaaaauuagccgggcgugguccuagcuacucgggagacugaaguggaaggcuugcuugagccc

SEQ ID NO: 734083 - RNA, 63 nt, hsa
caguggcucacgccuguaaucucggcacuuugggagacugaggugggagcaucacuugagacc

SEQ ID NO: 734084 - RNA, 63 nt, hsa
augguggcacgcacuguagucccagcuacucaggagacugaggcuagaagauccuuugaaccu

SEQ ID NO: 734085 - RNA, 63 nt, hsa
gguaccaggcaccaugcuagguauuggggaagagagacugaagucacaaccccugacugcucc

SEQ ID NO: 734086 - RNA, 63 nt, hsa
auacuauggaguaccauguggcaacggaagaaugagacugaacugugugaacuaacaugcaaa

SEQ ID NO: 734087 - RNA, 63 nt, hsa
uuccagaggacccagaccuucguucauucuaaagagacugauagaauuaaaaacaaagugccu

SEQ ID NO: 734088 - RNA, 63 nt, hsa
uaaagcauugucuguuccagaguggccuuugaagagacugaauaaucacuucgucauaauguu

SEQ ID NO: 734089 - RNA, 63 nt, hsa
uucugaggcugccauacugccacuguccagguggagacugagcaaaggaaguccugggcugug

SEQ ID NO: 734090 - RNA, 63 nt, hsa
ucuaggacuagaaaaacuugggucucuuaccgcgagacugagaggcagaagucagcccgaaug

SEQ ID NO: 734091 - RNA, 63 nt, hsa
ugaguggagucaccccacucccaguugcuggcagagacugagacuaaagcaucacuuaauaaa

SEQ ID NO: 734092 - RNA, 63 nt, hsa
ugguggugcaccccuaaaaucccagcuacuugagagacugaggcaggagaaucgcuugaaccc

SEQ ID NO: 734093 - RNA, 63 nt, hsa
agcucauuauccagucugugccaacugaaguaggagacugacugugagugcuggcuaaaagcc

SEQ ID NO: 734094 - RNA, 63 nt, hsa
ggaucugauaaacucauuuacucucagguguaagagacugaugagaccuuagaagcgaauucc

SEQ ID NO: 734095 - RNA, 63 nt, hsa
gcuuugcuuaugggugcucgcugggguccgguggagacugaccacccugcuugagccaaagac

SEQ ID NO: 734096 - RNA, 63 nt, hsa
ggagcuaagcucaggagcccgaagggagagacugagacugacucccuuaucucuucauauucu

SEQ ID NO: 734097 - RNA, 63 nt, hsa
uccccuggagcuaagcucaggagcccgaagggagagacugagacugacucccuuaucucuuca

SEQ ID NO: 734098 - RNA, 63 nt, hsa
agaguaagacaugcucugcugucucuuccucuggagacugaacuuggguugguugugaugagc

SEQ ID NO: 734099 - RNA, 63 nt, hsa
ugguggcgggcaccuguaaucccagcuacuugggagacugaggcaggagaaucgcuugaaccu

SEQ ID NO: 734100 - RNA, 63 nt, hsa
ugauggcacgugucuguaaucccagcuacucuggagacugaggugggagaaucgcuugagacu

SEQ ID NO: 734101 - RNA, 63 nt, hsa
gacagccccuaccuaccccugcccacuccucuggagacugagccuugcccgugcauauuuagg

SEQ ID NO: 734102 - RNA, 63 nt, hsa
cgaugagggauggagguagcugcaggcucagaagagacugagcuugcacagaucagaccgaga

SEQ ID NO: 734103 - RNA, 63 nt, hsa
aaagaugcagucaccauagauguccacguagcagagacugacuuaggaucugagauaaagcau

SEQ ID NO: 734104 - RNA, 63 nt, hsa
guuguacaaauuucugauugcccuaaauguagagagacugauggggaaaguaugauggguuug

SEQ ID NO: 734105 - RNA, 63 nt, hsa
agcggcucuccugagaggugcugcaggcaaagugagacugacaccucacugaggaagggagac

SEQ ID NO: 734106 - RNA, 63 nt, hsa
ugaugaaccuaucgggugaaaacgaccacucaagagacugacuucgccauucaagacaaggaa

SEQ ID NO: 734107 - RNA, 63 nt, hsa
guggcuccugauagcguuuggaagaacgcgggggagacugaagagcaacugggaacucggauc

SEQ ID NO: 734108 - RNA, 63 nt, hsa
aggggguggaauuauuacucuauacauucaacagagacugaauagauaugaaagcugauuuuu

SEQ ID NO: 734109 - RNA, 63 nt, hsa
gccaaccaaggcaggcagaacccucuuaaauaugagacugauguauagguucucucuaugguc

SEQ ID NO: 734110 - RNA, 63 nt, hsa
aacuggugaaacuagccuggaauaaugccaccagagacugaguggaaaucgccccuuuugaag

SEQ ID NO: 734111 - RNA, 63 nt, hsa
cagggggauaacuaccagaaagguauaccuguugagacugauucagaggagcaacccuauuua

SEQ ID NO: 734112 - RNA, 63 nt, hsa
uuagcuguuuagaagggauggcuugaaaggaaggagacugaaaaacacucugagagcauacac

SEQ ID NO: 734113 - RNA, 63 nt, hsa
cccaaaauuuauuaaaaagcuauauuuuccugagagacugauacauacacucauacauauaug

SEQ ID NO: 734114 - RNA, 63 nt, hsa
auaugaagagugcugucguuggggugaaaccaugagacugacagaucugccugaaaugggggg

SEQ ID NO: 734115 - RNA, 63 nt, hsa
ucauguaugcccacgagggugauaguaauucgugagacugaaguugcuuagaguacuucuuug

SEQ ID NO: 734116 - RNA, 63 nt, hsa
ccaccuagacuguuuucugagcccuccggaccugagacugaguuuugucuuuuuccuuuagcc

SEQ ID NO: 734117 - RNA, 63 nt, hsa
gccugaaugccucccucaaaggaccugcaggcagagacugaaaauugcagacagaggggcacg

SEQ ID NO: 734118 - RNA, 63 nt, hsa
caacaaguuacuuuuaggauccuuuuggggcuggagacugagucuugaaccacagaagggaau

SEQ ID NO: 734119 - RNA, 63 nt, hsa
cccccugggagagugcucaaccuacaguggagggagacugacccauucacauuuuaacauagg

SEQ ID NO: 734120 - RNA, 63 nt, hsa
agacuuguugagaaauacgaccccacagacugcgagacugaaccgccgcuacaagccaaagau

SEQ ID NO: 734121 - RNA, 63 nt, hsa
aagacaugcuuacuuuuuaauuuuuauuuuuuugagacugagucucucucuguugcccaggcu

SEQ ID NO: 734122 - RNA, 63 nt, hsa
ggacgauuuucuaaccccagggagaacucgccagagacugagagcagagaccacuuauccuca

SEQ ID NO: 734123 - RNA, 63 nt, hsa
ugguagugcaugccuguagucccagcuacuuuggagacugaggugggaguaccccuugagccu

SEQ ID NO: 734124 - RNA, 63 nt, hsa
cucccucacucuccaugcuggcagagcaggagggagacugaaguaagagauggcagagggaga

SEQ ID NO: 734125 - RNA, 63 nt, hsa
cugcccuugccaucuuuuaggaugggcccccaggagacugaggucuuccugggcccucauugc

SEQ ID NO: 734126 - RNA, 63 nt, hsa
gacuucuggguacuggaauuaauaccagugggugagacugagggugagugaguuaguacauau

SEQ ID NO: 734127 - RNA, 63 nt, hsa
cugggcuuuguuagucagagcaggggaucagaggagacugaagcagaaacccugcacacgggc

SEQ ID NO: 734128 - RNA, 63 nt, hsa
ugggacguacguggaggcugcuggaccuggucagagacugaugugccuuagcggcaaugguua

SEQ ID NO: 734129 - RNA, 63 nt, hsa
uaaccuuucaaucaaaacucaguaucauaaguagagacugaaaacuugccguuauugauuguu

SEQ ID NO: 734130 - RNA, 63 nt, hsa
uugggaaggcaaagcuuuuguggagucaggggggagacugagaaaaaaugaauuaacccugug

SEQ ID NO: 734131 - RNA, 63 nt, hsa
gagcuguaccaggaacuugcauaucuagagacagagacugagucacuggcccaucucuuugcu

SEQ ID NO: 734132 - RNA, 63 nt, hsa
cagccacugcagcagacagaccaggaacacaaugagacugacauuucaaaaaaacaaaacugg

SEQ ID NO: 734133 - RNA, 63 nt, hsa
cucgccaccacaccuggcuaauuuuuuuuuuuugagacugagucucgcacugucacccagggu

SEQ ID NO: 734134 - RNA, 63 nt, hsa
cagaaacaaaacaucgaacaaaacccuauuuaagagacugaucacacacguauacacaacauu

SEQ ID NO: 734135 - RNA, 63 nt, hsa
agguaucauuugaaaaauaccauaauggcauuugagacugaauuucuaaaaauugaaugccaa

SEQ ID NO: 734136 - RNA, 63 nt, hsa
gcugcagagggaugagugaccaccauccaggcugagacugaaaggagcagaggcuggaacuac

SEQ ID NO: 734137 - RNA, 63 nt, hsa
ggggcaggcugaggaguugcccuuugccccccagagacugacucucagagccagagaugggau

SEQ ID NO: 734138 - RNA, 63 nt, hsa
ggucucagcauguugacugggauuggaaauaaugagacugagcccucggcuugggcugcacuc

SEQ ID NO: 734139 - RNA, 63 nt, hsa
uggcuugucgggggugggaggggaaggugggcagagacugauguauaauggacagguguuccu

SEQ ID NO: 734140 - RNA, 63 nt, hsa
uguugaaauauaguugaaaguaaaaaaauaauugagacugaaagaaacuaagauuuaucugca

SEQ ID NO: 734141 - RNA, 63 nt, hsa
ucauuucauuauguuucuuccaaggaaacaggagagacugaauuaauaauucucucuuuccuc

SEQ ID NO: 734142 - RNA, 63 nt, hsa
uucugcccugccccaccagggcccugcauguuggagacugagcugggugcacuggccaugccc

SEQ ID NO: 734143 - RNA, 63 nt, hsa
ccuguuuucuguuucaaacaugauaguugauaugagacugaaaccccuggguuguggagggaa

SEQ ID NO: 734144 - RNA, 63 nt, hsa
ucacuuccucuuagaucauaauuccaucuucaagagacugauuuccagaauaguaaucuuuuu

SEQ ID NO: 734145 - RNA, 63 nt, hsa
auuguuuuuaugauucuaaucaagcuguauguagagacugaaugugaagucaagucugagcac

SEQ ID NO: 734146 - RNA, 63 nt, hsa
caggguuggggccuggacaggguuuccucugcugagacugagacaagcagggcuugaugcugg

SEQ ID NO: 734147 - RNA, 63 nt, hsa
uuaugucaauguccaaacaaaguccaaugccaugagacugaagucuuuguggaaaccacuguu

SEQ ID NO: 734148 - RNA, 63 nt, hsa
cuuuccaacuuccuuuuuuuuuuuuuuuuuuuugagacugagucucacuccaucagccaggcu

SEQ ID NO: 734149 - RNA, 63 nt, hsa
guccuugcucucagggagcccccacuuuaaugggagacugauaaacugguaauuagacuguga

SEQ ID NO: 734150 - RNA, 63 nt, hsa
ccuauccuuaauaaauccuccacucucuggaaggagacugaggggcuuuguaaaacauuaguc

SEQ ID NO: 734151 - RNA, 63 nt, hsa
ggacauggcaggauguucuggcacagcagacuggagacugaggcagggccugugaguggacag

SEQ ID NO: 734152 - RNA, 63 nt, hsa
ccacauucccacaggccuugagcagaauuuucugagacugaagggaaaucccccuuucuuucu

SEQ ID NO: 734153 - RNA, 63 nt, hsa
uuauauauugccaagaauuaaaugauaaacuuagagacugauuagacugaaaaugccuaaucg

SEQ ID NO: 734154 - RNA, 63 nt, hsa
uccaggcuuucccacuucccacccugccccucagagacugaaauuacggguaccugaagaugg

SEQ ID NO: 734155 - RNA, 63 nt, hsa
uucuugccuaaugauguuaucuaggcaccauuggagacugaaaaaaaaaaaucccugcucugu

SEQ ID NO: 734156 - RNA, 63 nt, hsa
ucuguucaagucccacuuuaaauuaugucuuaggagacugaaaguggaaucuucugagcauuc

SEQ ID NO: 734157 - RNA, 63 nt, hsa
cucagccacagagaacucccuccuacaaagggggagacugaaacccgaguuaaggaggggccu

SEQ ID NO: 734158 - RNA, 62 nt, hsa; identical to SEQ ID NO: 615292

SEQ ID NO: 734159 - RNA, 63 nt, hsa
guuuuucacuuggaggauggugaacccuacugugagacugauuauuaugcccucuuugguacu

SEQ ID NO: 734160 - RNA, 63 nt, hsa
ucaguuauuauauucauuuagcauuaagucaaggagacugagaaugacucaagggacgucaua

SEQ ID NO: 734161 - RNA, 63 nt, hsa
guggugagcgggcaggaaccuggcgccgccaccgagacugagccuccugcagacgggcgaagc

SEQ ID NO: 734162 - RNA, 63 nt, hsa
ucaaaccaacacuuuuaaaaaaauaauucagaugagacugagccauaucugcaguaagagaaa

SEQ ID NO: 734163 - RNA, 63 nt, hsa
auacccucauaucuguccugaugugauaugucugagacugaaugcgggagguucaaugugaag

SEQ ID NO: 734164 - RNA, 63 nt, hsa
uuccugcagcugacagauagacucagauuuugugagacugaaauguucacugaagacacuuga

SEQ ID NO: 734165 - RNA, 63 nt, hsa
auguagacauacacuucagaagcuccuaaaacagagacugaaaggccaccuuuaggauuucuu

SEQ ID NO: 734166 - RNA, 51 nt, hsa
gcuuuguggaaaacauaugaggagacugacacugaagaagcuuaaaaucac

SEQ ID NO: 734167 - RNA, 63 nt, hsa
cuguccuuccaugcaaaggcuuccugaaauagggagacugacugaguagcucauucuugugac

SEQ ID NO: 734168 - RNA, 63 nt, hsa
cauuuccuuuuaacucaguucaauuuuuguagugagacugagcaguuuuaaauccuuugcgug

SEQ ID NO: 734169 - RNA, 63 nt, hsa
uuauaacucaggaucugaggucucaagcuaggagagacugagaauuuuaaucaguuugggcau

SEQ ID NO: 734170 - RNA, 63 nt, hsa
uguuacauuagguuccaauucgcaauaguagcagagacugacaugcuuuuauugaccugcuaa

SEQ ID NO: 734171 - RNA, 63 nt, hsa
uugcuaauugaaaaucauauccugaaucauacugagacugaucaacuuugguagcuuuuuugu

SEQ ID NO: 734172 - RNA, 63 nt, hsa
acuguccccaguguagagggcuuugcugucccugagacugaggcagguuccuuuuccagguca

SEQ ID NO: 734173 - RNA, 63 nt, hsa
caagcaggagauguugggucuggagcaagaucugagacugagaugucccccaagggugacagg

SEQ ID NO: 734174 - RNA, 52 nt, hsa
uugcagaaucaggacuuuaguagagacugaguaccaggccacgggcugcaga

SEQ ID NO: 734175 - RNA, 63 nt, hsa
gugauaugaaugcaguuuguauggaagaccuuugagacugaguagaugaauuauugaauguga

SEQ ID NO: 734176 - RNA, 63 nt, hsa
cagugaaggugagcuggagcugguuggacuaaugagacugaggaagcagcuuuuccuacgauc

SEQ ID NO: 734177 - RNA, 63 nt, hsa
acaaaagcauuaguaguuuguuuguuuguuuuugagacugagucucacuuuaucacccagacu

SEQ ID NO: 734178 - RNA, 63 nt, hsa
ugucucuaaguaaguaaaaucuaaugcguauaggagacugauagcuaaaaaugaauggaacau

SEQ ID NO: 734179 - RNA, 63 nt, hsa
gcaggcagccuguugcaggcaggggaaggagaagagacugaggggcugugaccucuccugagg

SEQ ID NO: 734180 - RNA, 63 nt, hsa
ugguagcugaaugugcucagaugugagcagucagagacugacagccaugcuuuccuauacuug

SEQ ID NO: 734181 - RNA, 63 nt, hsa
uuuuguaaguuauguuuuacaugccccguuuuugagacugaucucgaugcagguggaucuccu

SEQ ID NO: 734182 - RNA, 63 nt, hsa
ggccacauuaaaguugcaaauaacacuuuuuuugagacugaaauaaaggugaaauauuggaag

SEQ ID NO: 734183 - RNA, 63 nt, hsa
auauuuuuuaaaauuauuuaaccccugggggcagagacugaggagggaggaugauaagggauc

SEQ ID NO: 734184 - RNA, 63 nt, hsa
gacaucuugacuugagccugaagacuauguacagagacugaccucacagacugaccauuccau

SEQ ID NO: 734185 - RNA, 63 nt, hsa
uuucuaccucuuuaggaagacaccuauuccacagagacugauuuauagggggcagcacuuuau

SEQ ID NO: 734186 - RNA, 63 nt, hsa
agauauuaccacacaacaucaaguggccuugaagagacugagauaacgaauucuugaguuugu

SEQ ID NO: 734187 - RNA, 63 nt, hsa
agcagcaugaauaguuuauacugugguuuuucagagacugaaugccaagagaacucgguaaau

SEQ ID NO: 734188 - RNA, 63 nt, hsa
aauacugauuggccuauaauaaguuccuauagggagacugaggcuugcagaauuaagguucag

SEQ ID NO: 734189 - RNA, 63 nt, hsa
gaaccauccauggacugugauucugaggcugcugagacugaacauguucacauugacagaaaa

SEQ ID NO: 734190 - RNA, 63 nt, hsa
guccauaacgaagagugagacuauuuggaaacagagacugaucaucuuugggggaagcccugc

SEQ ID NO: 734191 - RNA, 63 nt, hsa
gacaaguaguagaagaaaaugaaugcugcugcugagacugaagaccaguauuucagaacuuug

SEQ ID NO: 734192 - RNA, 63 nt, hsa
acggaagcgcaggcagcucccacgacacacggagagacugacugauacgagauuuggaaagcu

SEQ ID NO: 734193 - RNA, 63 nt, hsa
cucccagucccacuaccagcacccccgaucccugagacugagggguuuacgggcugugaaugg

SEQ ID NO: 734194 - RNA, 63 nt, hsa
caugcccucaacucuugcuuggcagggguaccagagacugaaagacacggcacaaaucucaau

SEQ ID NO: 734195 - RNA, 63 nt, hsa
cuaaagcauuuuugcuauuuucgucaugccuuugagacugagucuuacuccgucccccagcgu

SEQ ID NO: 734196 - RNA, 63 nt, hsa
ccaguaggaagcauggacucuccugagugagaagagacugaaauaggagcaagcagaacccug

SEQ ID NO: 734197 - RNA, 63 nt, hsa
cagccucguuggggaggcuuguccagggugauagagacugauuucagacaaaccuauuuauua

SEQ ID NO: 734198 - RNA, 63 nt, hsa
ggaaguagaaacaguagggccucuguaaaauuggagacugauagguugaucagaaacucaccc

SEQ ID NO: 734199 - RNA, 63 nt, hsa
cuccuucucagcucacuucaauaacuauuuucugagacugaaguuuuuuagacaagaauaaga

SEQ ID NO: 734200 - RNA, 63 nt, hsa
ucaaaccuguagaugacauaaaaugacagcaaagagacugagagacuguugaucaaagcacag

SEQ ID NO: 734201 - RNA, 63 nt, hsa
ugacagcuaggaugugcauucuccagccaucaagagacugagucaaguuguuccuuaagucag

SEQ ID NO: 734202 - RNA, 63 nt, hsa
ugcucagaaaacauugauuugagcauagacgcagagacugaaaaaaaaauuuacuuugaucuc

SEQ ID NO: 734203 - RNA, 63 nt, hsa
acuuucccucgggaugaaggugaacaugggggugagacugaagccugaggaauuaaaggucau

SEQ ID NO: 734204 - RNA, 63 nt, hsa
uaagguaaugucaugauucauccucucuucagugagacugagccugauguguuaacaaauagg

SEQ ID NO: 734205 - RNA, 63 nt, hsa
agcccaguccagcgacaccuugguuuggccugugagacugagaagagagccagccacgccaug

SEQ ID NO: 734206 - RNA, 63 nt, hsa
ggccacuggcugcuggggacuggggacugggcagagacugagccaggcaggaaggcagcagcc

SEQ ID NO: 734207 - RNA, 63 nt, hsa
cucugccucacccgcuucagcccagggccccuggagacugauccccucugaguccucugcccc

SEQ ID NO: 734208 - RNA, 63 nt, hsa
auuuuuauauauuuaaauacaccuuaguggccagagacugacuucaagguuuuauuccagaga

SEQ ID NO: 734209 - RNA, 63 nt, hsa
gggaagaagcaugaagcuuuguguggguuggaagagacugaagauauggguuauaaaauguua

SEQ ID NO: 734210 - RNA, 63 nt, hsa
uuuaugucccacccaaaaauuggauuccuuuuggagacugaucuguuggucucaggcauuuca

SEQ ID NO: 734211 - RNA, 63 nt, hsa
aaaauguucuucauccaggccugccguggagaugagacugaucgugggguugaccaacaagau

SEQ ID NO: 734212 - RNA, 63 nt, hsa
gaggcaggcaauggaauauaauggaauauucuugagacugaucacaaaaaaaaaaaccuuuuu

SEQ ID NO: 734213 - RNA, 63 nt, hsa
auauuuuauuaguauuuuggaaauagcauaucugagacugaagagaaauugacaauucacuua

SEQ ID NO: 734214 - RNA, 63 nt, hsa
cugggcuggaagucaaagccgucgguuacagaggagacugacagaggaauuccagaauguaag

SEQ ID NO: 734215 - RNA, 63 nt, hsa
cuaccauuuuuaauuuaugguucaacuguuugugagacugaauucuugcaaugcauaagauau

SEQ ID NO: 734216 - RNA, 63 nt, hsa
uguagcggggcaggggguguccaacuucccugugagacugauuaucaauaauaaugugucucc

SEQ ID NO: 734217 - RNA, 63 nt, hsa
uuccaucaacaagggaguuuaaauacuauaugugagacugacaaaaaccuuaauguaauuuac

SEQ ID NO: 734218 - RNA, 63 nt, hsa
acagaccccucaguccucccgccucgcucucuugagacugagggguccgcagaagucgccacc

SEQ ID NO: 734219 - RNA, 63 nt, hsa
ggcaguuguauuuuuuuuuuuuuuuuuuuuuuugagacugaaucucacuccaucguccaggcu

SEQ ID NO: 734220 - RNA, 63 nt, hsa
ggccucggauaggaagcugccugccagcaagaggagacugaugugccccgggugcaccccacc

SEQ ID NO: 734221 - RNA, 63 nt, hsa
cacagauauccuauauagauuguauacagaacugagacugauuuuguaccgauuagaaugauu

SEQ ID NO: 734222 - RNA, 63 nt, hsa
cagaacucagcugugacucuugcagaaucaacagagacugaagugggcuuuuguguuauaauu

SEQ ID NO: 734223 - RNA, 63 nt, hsa
uuuagaauguauuaaaaauuuuaccuugccauagagacugaauuagucacagcucucagugau

SEQ ID NO: 734224 - RNA, 63 nt, hsa
aguuuaaaauaaggagauccagaauaaaaagaagagacugaucucuucaauuauugucaucug

SEQ ID NO: 734225 - RNA, 63 nt, hsa
cuauccugaaucuaacagugacuucauaacuaggagacugaauuagacccuuaagguauagug

SEQ ID NO: 734226 - RNA, 63 nt, hsa
auugagcugaguuugaaaguccugauucagagagagacugaggguugacaaauaaacuguauc

SEQ ID NO: 734227 - RNA, 63 nt, hsa
ucaaaugcaaccucacaaccuuggcugagucuugagacugaaagauuuagccauaauguaaac

SEQ ID NO: 734228 - RNA, 63 nt, hsa
ggccaagccgcagagguccgcgagguccgcgaugagacugaggggugaguggagccaggggug

SEQ ID NO: 734229 - RNA, 63 nt, hsa
cuuuauuuuuuuaauuauuauuaguauuauuuugagacugagucuugcucuaucacccaggcu

SEQ ID NO: 734230 - RNA, 63 nt, hsa
gacuccuuggagaacaauauucauuugguuguggagacugauuugcugggagaaaucuguccu

SEQ ID NO: 734231 - RNA, 63 nt, hsa
ugccauacuaaugaugagcauuuagcacaauuugagacugaaauuuaguacacuauguucuag

SEQ ID NO: 734232 - RNA, 63 nt, hsa
uauaauucauuaaagcuguggucuuuccauguggagacugauagaaaauaauuuugucccaag

SEQ ID NO: 734233 - RNA, 63 nt, hsa
cuucuccaauacagcaaaccuaauugcacaacagagacugaaauguguuuccugaauaccagu

SEQ ID NO: 734234 - RNA, 63 nt, hsa
augccugcagggauuucaccaccucaggguggagagacugaaugcuugugagggaauuaggau

SEQ ID NO: 734235 - RNA, 63 nt, hsa
gggaguguuaacuguuaacucuugccguaucaggagacugaaaguucauacuaauuuacaaac

SEQ ID NO: 734236 - RNA, 63 nt, hsa
aaggcagaggaauuuggcugcuucuacggccaugagacugaucccuggccacugaaaagcuuu

SEQ ID NO: 734237 - RNA, 63 nt, hsa
caacuccacaucaacuccacaugcgcccagcucgagacugaugaguggaaucagcuuccaggu

SEQ ID NO: 734238 - RNA, 63 nt, hsa
aucagacacccucuccuuaaaaacuggcccguggagacugagaucacugacucugacucaucc

SEQ ID NO: 734239 - RNA, 63 nt, hsa
cugagaaguuaacccuuaaacaguuuucuggaagagacugaauuucuggguccuugcagcugu

SEQ ID NO: 734240 - RNA, 63 nt, hsa
ucugggcugggcaggcccucugguucccaggcugagacugacggguuuucucaggaugauguc

SEQ ID NO: 734241 - RNA, 63 nt, hsa
cuguccagcacgggggccgcuggugcuugcugugagacugagcugggcucugaguguaaacua

SEQ ID NO: 734242 - RNA, 63 nt, hsa
cuguuauaaauggagcuucagcccucugggucagagacugacaacccuccuucuucuuccuaa

SEQ ID NO: 734243 - RNA, 63 nt, hsa
cugccgccuaagcuuuacuggaauucagguuuugagacugagaugcguguucguauuuuucca

SEQ ID NO: 734244 - RNA, 63 nt, hsa
uugucauaucuguuuucaagcauuguacaauuugagacugaguaauuuaacaauaaguaaaaa

SEQ ID NO: 734245 - RNA, 63 nt, hsa
uauugcugguuugggggaggggacuggaaagcugagacugaaaaucaagagggaagaggugag

SEQ ID NO: 734246 - RNA, 63 nt, hsa
aaaauucagagaauauaaauuacuucuugugaagagacugaaacuuuguuuuuauuuuaauau

SEQ ID NO: 734247 - RNA, 63 nt, hsa
auuugaagagcuaaagagucugcagcaggauuggagacugacuugugacugcgggcugggggg

SEQ ID NO: 734248 - RNA, 63 nt, hsa
aaaguggcauuaugucuguugcucacagaugcagagacugacaauugugucuccacagcagag

SEQ ID NO: 734249 - RNA, 63 nt, hsa
gacagcguggcagcggagacuguggaggcaguggagacugacuucuuccugcugacagcugga

SEQ ID NO: 734250 - RNA, 63 nt, hsa
auagccccggccccccgcgcucgcccagcaggagagacugagcagccgccagcugggagcacu

SEQ ID NO: 734251 - RNA, 63 nt, hsa
gcaagaaggagcuggcaaggaccggcgcugcuggagacugacccagcccucuggcugaggaca

SEQ ID NO: 734252 - RNA, 63 nt, hsa
cucgggaugccacucugugcccaggacgguucugagacugaacacugagggcaggagcaaggg

SEQ ID NO: 734253 - RNA, 63 nt, hsa
uagcacaccugagacagauuuaagccucccuaagagacugaagagaggaacaggugucagaua

SEQ ID NO: 734254 - RNA, 63 nt, hsa
gaauuggaaugcugaagacuaacgaagaaacuagagacugauaucgagcauucugcccaccuc

SEQ ID NO: 734255 - RNA, 63 nt, hsa
aauaaacaaaauuaaaaagaaaaaaaaauaccugagacugaguaacuuauaaagaaaagaggu

SEQ ID NO: 734256 - RNA, 63 nt, hsa
gcuggccuugaaaugauucccccacuuccuggagagacugagcggaguugggagccuuuuuag

SEQ ID NO: 734257 - RNA, 63 nt, hsa
uccauauuaaguuuagauuuucaguuaauuuuugagacugaguaguauucuuggauacaggcu

SEQ ID NO: 734258 - RNA, 63 nt, hsa
cccacacccauugagucauucacaggcaggagggagacugaucauuccucuggguuaucugca

SEQ ID NO: 734259 - RNA, 63 nt, hsa
uaaaagauacuuaggcacuuuuuuuuuuuuuuugagacugaguuucgcucuugucauccuggc

SEQ ID NO: 734260 - RNA, 63 nt, hsa
ucccagaacaaagaacuugggagaacaguacgggagacugagcagaaaggauggguuugcuga

SEQ ID NO: 734261 - RNA, 63 nt, hsa
aauacuuuuuaauuuuuuuaacuuaaaauucaagagacugaaucacuuuucucauugauuaaa

SEQ ID NO: 734262 - RNA, 63 nt, hsa
uaauacaaaauguacauaaaacguuaguccuuugagacugacaugauuaaugaucaguguggu

SEQ ID NO: 734263 - RNA, 63 nt, hsa
agccagaggagcacaggcgggcaggucacugcagagacugauggaaguuagagagguggagga

SEQ ID NO: 734264 - RNA, 63 nt, hsa
ucccugcccaccagaaacucagaggugauuggggagacugacacaggaaaaugaacuuaauca

SEQ ID NO: 734265 - RNA, 63 nt, hsa
cucacagccccagggagcagaagacagaaugaagagacugagcaucuaaaaugggcagccucc

SEQ ID NO: 734266 - RNA, 63 nt, hsa
aauacccagcugcuucuggcuaagagugcagcagagacugaggcauagccagcuucaaaagcg

SEQ ID NO: 734267 - RNA, 63 nt, hsa
cgccaucgucaaagagaaacuuugaaggagcaggagacugaaaucgauauuaauuccugcaaa

SEQ ID NO: 734268 - RNA, 63 nt, hsa
cacagccuugcccacaaacccugccucugaggggagacugaggaagggcagagccagaagcaa

SEQ ID NO: 734269 - RNA, 63 nt, hsa
accaguacucuguaaagcaucaucauccuuggagagacugagcacucagcaccuucagccacg

SEQ ID NO: 734270 - RNA, 63 nt, hsa
cuucccagcaauuauaagcacaccagauucagggagacugaccaccaagggauaguguaaaag

SEQ ID NO: 734271 - RNA, 63 nt, hsa
ucccagagcugaugcuauuguacuugcacauuggagacugaaaggaaagaagggacuaaaugc

SEQ ID NO: 734272 - RNA, 63 nt, hsa
acuauaacuugcccaaauuuuuuuuuuuuuuuugagacugagucucacucugucgccugggcu

SEQ ID NO: 734273 - RNA, 63 nt, hsa
agcacaucaggccugguucaccucuggggucacgagacugagucuacaggagcuuugggccug

SEQ ID NO: 734274 - RNA, 63 nt, hsa
cuggcuuguuugaccaaagagcccucuuuccacgagacugaagucuggggaggaggcuacagu

SEQ ID NO: 734275 - RNA, 63 nt, hsa
caggguacccugacugucccucuguagacuguugagacugaguuccuguugggacagucaguu

SEQ ID NO: 734276 - RNA, 63 nt, hsa
aguacaggcucccuaagagaggauggagagggagagacugaauuguuaguaggucuaaacauc

SEQ ID NO: 734277 - RNA, 63 nt, hsa
gaacuuaaaauauaucuaaauuuuauaaaauuugagacugagcucuuagugaaguauauucug

SEQ ID NO: 734278 - RNA, 63 nt, hsa
gguaaaugggcgaaauccaggccaggagccucagagacugaagcagaacagaguaagacucau

SEQ ID NO: 734279 - RNA, 63 nt, hsa
caaccucgucaucauccccacuuuaaaccccaggagacugaaacucaaacaacccugggcaag

SEQ ID NO: 734280 - RNA, 63 nt, hsa
gaaaagguuugagaggaauuauaucuaaguugugagacugaguucuauauucuggugaguuaa

SEQ ID NO: 734281 - RNA, 63 nt, hsa
acugcuuucccaugcuucuuucggguuguaggggagacugacugccugcucaaggacacuccc

SEQ ID NO: 734282 - RNA, 63 nt, hsa
uucucacugcuaucuggggagugauuaccccgggagacugaacugcaggguucaagccuucca

SEQ ID NO: 734283 - RNA, 63 nt, hsa
aggcucggaggacccuggaaaacagacgggucugagacugaaauuguuuuaccagcucccagg

SEQ ID NO: 734284 - RNA, 63 nt, hsa
gaucagaacaggaauccacauugccagugacaugagacugaacagccaaauggaggcuaugug

SEQ ID NO: 734285 - RNA, 63 nt, hsa
uuaaucaccucuggcgggggccucgugcaaggggagacugacaccaagaacagccaguagguu

SEQ ID NO: 734286 - RNA, 63 nt, hsa
gggucacuagagacccuucugggucagaggagagagacugaauuggacuaaacccguccucug

SEQ ID NO: 734287 - RNA, 63 nt, hsa
gaggacaacggaacccccuuucccugcccuccagagacugauccuagccaggcaccuuaggag

SEQ ID NO: 734288 - RNA, 63 nt, hsa
ccccaggccccuuuccucugcagcuucucaagugagacugaccugucucacccagcagccacu

SEQ ID NO: 734289 - RNA, 63 nt, hsa
caacuccagcaacuucuucuccaucccucuaaugagacugaccauauugugcuucacaguaga

SEQ ID NO: 734290 - RNA, 63 nt, hsa
aggcugguguaaggagcggggcuugggaucggugagacugauacagacuugaccuuucagggc

SEQ ID NO: 734291 - RNA, 63 nt, hsa
cuaauaaaauauggaauuccauauuagggcaaugagacugaaacuacugguguuuuucugccu

SEQ ID NO: 734292 - RNA, 63 nt, hsa
uuguauguuuuggaaggcaaagucuuggcuuuugagacugaaguuaagugggcacagguggcc

SEQ ID NO: 734293 - RNA, 63 nt, hsa
auuuguuuugcuggagaaacaucagguuuguaggagacugaguuguuagcaggugugcuuagc

SEQ ID NO: 734294 - RNA, 63 nt, hsa
ucuuggccugagcuaugccuguugaggcaucuggagacugagaaagaaucaaaggcagagaag

SEQ ID NO: 734295 - RNA, 63 nt, hsa
gcagcugcaagccucgcaaggguggaguggggggagacugaggaccaguaguaccugcagggu

SEQ ID NO: 734296 - RNA, 63 nt, hsa
cucugaaauauccuccaaaaggagagugcaucugagacugauauuuaaacuaagaaaaauguu

SEQ ID NO: 734297 - RNA, 63 nt, hsa
aaaggcucuaguuagggugucauugucauuugagagacugacacacuccuagcagcugguaaa

SEQ ID NO: 734298 - RNA, 63 nt, hsa
auuaccuguucucccacugcuaaugacauacccgagacugaguaauuuauaaauaaaagagau

SEQ ID NO: 734299 - RNA, 63 nt, hsa
ucagacaagccagcaugucaaacacagguuagagagacugagcuuccagauugcauagccauu

SEQ ID NO: 734300 - RNA, 63 nt, hsa
uuggagaaugaaaccugcuccaacagagaucaugagacugaaauuggucagaauuguguccag

SEQ ID NO: 734301 - RNA, 63 nt, hsa
augcacagaucaacccacaucugcauggguugugagacugagcauagugagagcaguggugga

SEQ ID NO: 734302 - RNA, 63 nt, hsa
guauauccacauuuucauggaaugguacugugggagacugagcaaacacucuuuuggcaacuu

SEQ ID NO: 734303 - RNA, 63 nt, hsa
ucuacuuuucucuuuacgcaagauaauuauuuagagacugauuacagucuuucucagauuuuu

SEQ ID NO: 734304 - RNA, 63 nt, hsa
ugggaggccgaggugggagaaucacaaggucaggagacugagaccauccuggcuaacaccaug

SEQ ID NO: 734305 - RNA, 63 nt, hsa
uaacuuuggugcccaggccaaguagaaugagaugagacugaguuuggccucuggcucgguuuc

SEQ ID NO: 734306 - RNA, 63 nt, hsa
ucauccuguuuucucugugaccugauuucagaagagacugauccaaaaauuauaacggcaggg

SEQ ID NO: 734307 - RNA, 63 nt, hsa
agacagacgaggcagagacaaaacacugagaaagagacugaaauggaguaauaaaugaaagcc

SEQ ID NO: 734308 - RNA, 63 nt, hsa
cuaguuaguguuuugccucaccuaauaggcugggagacugaagacucagcccggguggggcug

SEQ ID NO: 734309 - RNA, 63 nt, hsa
ugguggugcacaccuguaaucccagcuacuugggagacugagacaugagaaucgcuugagccu

SEQ ID NO: 734310 - RNA, 63 nt, hsa
guugagugaaauggccuuccuguucagcuguuagagacugaagauuguuagggcaccuuagaa

SEQ ID NO: 734311 - RNA, 63 nt, hsa
ccaaacuuuucagaugaacuauuguuuaguacagagacugagcaaauacuacaaaauucaacu

SEQ ID NO: 734312 - RNA, 63 nt, hsa
aaacaaggacugcagccuaaauuccaaauaccagagacugaaauuuucagccuugcuaaggga

SEQ ID NO: 734313 - RNA, 63 nt, hsa
gggcuuucuccuucuguggccccggaggaaggagagacugaggcaaggcaaagugauaguaca

SEQ ID NO: 734314 - RNA, 63 nt, hsa
uuugaggacgacugugacagccugacuugggaggagacugaggagacccugcugcuuugggag

SEQ ID NO: 734315 - RNA, 63 nt, hsa
uguccggacccuuccauaguacaccuuagcgcugagacugagccagcuugggggucagguagg

SEQ ID NO: 734316 - RNA, 63 nt, hsa
caugguggcacaugccuacucccagcucccaaggagacugagaugggaggaucccuggagccc

SEQ ID NO: 734317 - RNA, 63 nt, hsa
uuuguuuguuuguuuuauuucaccaggcugcaugagacugaccuuccggcauucuuacuaaua

SEQ ID NO: 734318 - RNA, 63 nt, hsa
cuucgagccagaaaggggcaugagggcucuugcgagacugaagugcuaucuucucuggacuag

SEQ ID NO: 734319 - RNA, 63 nt, hsa
caagcccugucuuaaggcccagggggagguuaggagacugauagcaugugauggcucaggcug

SEQ ID NO: 734320 - RNA, 63 nt, hsa
uggggcugucccagccguaagucaggcucgagggagacugauccccugaccaauucaccugau

SEQ ID NO: 734321 - RNA, 63 nt, hsa
gcucugggucauuugggaguggcucugcuaguagagacugauggagagagccagguggaaugc

SEQ ID NO: 734322 - RNA, 63 nt, hsa
acuguggcagagaaaguccuccacucagaggcagagacugaguuaagucauagguggccuuag

SEQ ID NO: 734323 - RNA, 63 nt, hsa
agcacagaggcuccccggacucggagggggccagagacugagcucuggucaccuguucauucc

SEQ ID NO: 734324 - RNA, 63 nt, hsa
gacaaggccagagggugcgauugaaugaguauugagacugaggagaaugauagagagugaagc

SEQ ID NO: 734325 - RNA, 63 nt, hsa
acaaacggggccagcucuuaaaauaagaaagcugagacugaggaggugaaacugaaaauaaaa

SEQ ID NO: 734326 - RNA, 63 nt, hsa
ugguggcucacgcuugugaucccagcacuuugggagacugaggcggaucaccugaggucagga

SEQ ID NO: 734327 - RNA, 63 nt, hsa
cuugauuuaucaugagagaagaggagagagagagagacugagcgcuaggaguguguguaugug

SEQ ID NO: 734328 - RNA, 63 nt, hsa
aaucucuuuguaccuacaguugaagcuaauguugagacugagacuuacgaaacugugaauccc

SEQ ID NO: 734329 - RNA, 63 nt, hsa
uaauaacaaagacuuaaauggcuuuucucccuagagacugaaacuaguauucauuguguucag

SEQ ID NO: 734330 - RNA, 63 nt, hsa
agagacagaaacagagagagacagagacagagagagacugagggagagacucugaggacaugg

SEQ ID NO: 734331 - RNA, 63 nt, hsa
gaggauggaaaggggcagaguaaucuagcaaaggagacugaggccagugaaguaggaagaaag

SEQ ID NO: 734332 - RNA, 63 nt, hsa
aucuuauuacaaagugauuuucuacauuaaaaagagacugaaauaaauuguauaguuacuuaa

SEQ ID NO: 734333 - RNA, 63 nt, hsa
uauuuuauuuuauuuuauuuauuuauuuauuuugagacugagucuugcucugucgcccaggcu

SEQ ID NO: 734334 - RNA, 63 nt, hsa
cacccauuucauugcucgcugcgaaagagacgugagacugacauaugccauuaucucuuuucc

SEQ ID NO: 734335 - RNA, 63 nt, hsa
cuucugccuuaccguguuucccacagcaacacagagacugauucaaagaacaauggucucuuu

SEQ ID NO: 734336 - RNA, 63 nt, hsa
gggagugggggcugcuagaggggauuaguuccggagacugagacuguuggcuccaccuccaag

SEQ ID NO: 734337 - RNA, 63 nt, hsa
gacucuauccugggccuacuaaacuucuguuuggagacugacccuuguguauaaagacgggag

SEQ ID NO: 734338 - RNA, 63 nt, hsa
cacaaaauguagcgggauuuuuaaggaaucagagagacugaaaaaaaaaaaaaaauuaaugau

SEQ ID NO: 734339 - RNA, 63 nt, hsa
uuguguauugucaauacuuaauugggggugggagagacugagcuacacuacugcuaaacuauu

SEQ ID NO: 734340 - RNA, 63 nt, hsa
ccccucccuagaggugcccauuccauacccugggagacugaggagagcauuggcugaagccca

SEQ ID NO: 734341 - RNA, 63 nt, hsa
gguggggagacuugacuuccucgggcucuucaggagacugagacagagaagacaagugaaagc

SEQ ID NO: 734342 - RNA, 63 nt, hsa
gcaggagaauguacaacagugucacuuguuaacgagacugauauucaacaggcuucuaagaau

SEQ ID NO: 734343 - RNA, 63 nt, hsa
gaugggaacguaacacuuauuuuuauauaaaaagagacugaguaaacaaacauuauagaaaaa

SEQ ID NO: 734344 - RNA, 63 nt, hsa
caacgcaugcgguauaguggagugggaagaguugagacugaaaguuaagagaaggguuuucaa

SEQ ID NO: 734345 - RNA, 63 nt, hsa
ccgccaugacaucuucaccuugcagcuugugcugagacugacccaagugcagcuagcacuggg

SEQ ID NO: 734346 - RNA, 63 nt, hsa
uuugggggcuugggagucccuuuguccucaucugagacugaaauguggggauccaggauggcc

SEQ ID NO: 734347 - RNA, 63 nt, hsa
ccaaggcugagugucccaguuuuaucugcuccugagacugagcccagauccccaaaucuaauc

SEQ ID NO: 734348 - RNA, 63 nt, hsa
uguagucuuuguuuuuuucuuuuuuuuuuuuuugagacugagucucauucuaucacccaggcu

SEQ ID NO: 734349 - RNA, 63 nt, hsa
guucagcucuugcaacguuuacuggacaugggagagacugaccucaugcuggcggcucugcgu

SEQ ID NO: 734350 - RNA, 63 nt, hsa
ccguccucgagccaggcgggaggagggaguggagagacugacuggccgugaugggaaugacag

SEQ ID NO: 734351 - RNA, 63 nt, hsa
ccaaugggacugugcaagcacccaagcagaagggagacugagugccucagccucucacccccu

SEQ ID NO: 734352 - RNA, 63 nt, hsa
aagagggucugugagcccccagaaauugugugugagacugaguauguguucuuuuuuccagga

SEQ ID NO: 734353 - RNA, 63 nt, hsa
aucucaucagggcugugcugaauauuugauaaugagacugaucauuccgcuuuuucuuucuua

SEQ ID NO: 734354 - RNA, 63 nt, hsa
guuucucauuuuuauaccagucuagggacaaaggagacugaacaucuuugcagcaggauaggc

SEQ ID NO: 734355 - RNA, 63 nt, hsa
uacuuuuuauuuccuuucauucacuagucauuugagacugacagcuuugcagguagcaguagu

SEQ ID NO: 734356 - RNA, 63 nt, hsa
uucugaauaaauauaaugugucuauaaaauaaugagacugauucuggugucuuuagucauuaa

SEQ ID NO: 734357 - RNA, 63 nt, hsa
ucuucugcccucauuucaugugacagccauugugagacugaugcacaaacugucacuugguua

SEQ ID NO: 734358 - RNA, 63 nt, hsa
caagccagggaugaagaaagacucugagauguggagacugauggccaggcaagugggaccagg

SEQ ID NO: 734359 - RNA, 63 nt, hsa
uauggcguauaucuugguucaucuucaaaaucagagacugagcuuugaaacuagugguuuuua

SEQ ID NO: 734360 - RNA, 63 nt, hsa
agccagugcucccuccuuucauguacuuggccugagacugaccucucccuagguccaaaugcc

SEQ ID NO: 734361 - RNA, 63 nt, hsa
uccucuggaaaugcccacagggcuugccgcguggagacugaucuguuccauccguuagcgcga

SEQ ID NO: 734362 - RNA, 63 nt, hsa
ggccucaugggaauuugaccuugacuagaaauagagacugagagugagcaaccagcuggaagg

SEQ ID NO: 734363 - RNA, 63 nt, hsa
aaucagcgcuggcaauuuuugacagucucuacggagacugaauaagaaaaaagaaaagaaaag

SEQ ID NO: 734364 - RNA, 63 nt, hsa
guauuuuugaaagcacuuucaccucuggcccaggagacugacccaaagugaaggacauugccg

SEQ ID NO: 734365 - RNA, 63 nt, hsa
acaccaaauggacaggccuggcauguacccacagagacugagaguuggugcuggugguugugg

SEQ ID NO: 734366 - RNA, 63 nt, hsa
ccgucugguuuccaucccaccacuccaaggacugagacugaccuccucuggugacacuggccu

SEQ ID NO: 734367 - RNA, 63 nt, hsa
uggggcaggauucucugcagcccauucccaagggagacugaccaucaugcccucucucgggag

SEQ ID NO: 734368 - RNA, 63 nt, hsa
gcagccccaccccgagcgcacacugugauggaggagacugagcucccuggggcgggcagcuga

SEQ ID NO: 734369 - RNA, 63 nt, hsa
cacucuugcuguggugcuacguggaagugaauggagacugaucucaaaucugaacugcagcuu

SEQ ID NO: 734370 - RNA, 63 nt, hsa
aucuucuucggaggaucacccgggaagacgacagagacugaagauuggucacuguaaagcagu

SEQ ID NO: 734371 - RNA, 63 nt, hsa
acugaacuagagcuugcagugaaguguucugcugagacugagcaccuuacagauauuuuucuc

SEQ ID NO: 734372 - RNA, 63 nt, hsa
ugguggcgcaugccuguaaucccagcuacuugggagacugaggcaagagaaucacuugaaccc

SEQ ID NO: 734373 - RNA, 63 nt, hsa
gcucauggguggacuaacaccugguuugguacagagacugagaaguuuuucauucugguguca

SEQ ID NO: 734374 - RNA, 63 nt, hsa
agggaguguggagagcuccuggugucgaggacugagacugagaggggagcccccuccaucugg

SEQ ID NO: 734375 - RNA, 63 nt, hsa
agugacagugacacccacacccacaguaaagaggagacugaaugagacuggccuggcugcauc

SEQ ID NO: 734376 - RNA, 63 nt, hsa
uugugaaggucucucugccugucggcuggggcagagacugaaauacugccaccuaccuuuggc

SEQ ID NO: 734377 - RNA, 63 nt, hsa
guuuuagacgaggccacagcugccaucgaccuggagacugacaaccucauccaggcuaccauc

SEQ ID NO: 734378 - RNA, 63 nt, hsa
uaaucauuagguuuuagauuuccuuuagcagcagagacugacuugcuguauagagggaaguca

SEQ ID NO: 734379 - RNA, 63 nt, hsa
guguuggugggugccuguaauccagcuacuugggagacugaggcaggagaauugcuugaaccc

SEQ ID NO: 734380 - RNA, 63 nt, hsa
agagacacaccuggcccucagggggcugagcuggagacugagcuggggcuggccgggacguga

SEQ ID NO: 734381 - RNA, 63 nt, hsa
auaucuaucuaucuauacagcggaaccacaagagagacugaggaaggccuggaggcaggggca

SEQ ID NO: 734382 - RNA, 63 nt, hsa
acaagucagccccuucuaccugccuccacccaggagacugaugcacaagaucuguuugugaaa

SEQ ID NO: 734383 - RNA, 63 nt, hsa
ggucacagcgugacugaaagcugauuucucugugagacugaaaucccagaacauuguuugcca

SEQ ID NO: 734384 - RNA, 63 nt, hsa
gcccuuuguggggucaggacacagagugggagggagacugaugcaggccuaccagucccuggc

SEQ ID NO: 734385 - RNA, 63 nt, hsa
aggcgacccucauggggaaggucacugacucuggagacugaagccccagugugcgcagcucga

SEQ ID NO: 734386 - RNA, 63 nt, hsa
cgaacuacaguugaauaccugaucaaauuguuagagacugaaagcuuucagaugaacagaauu

SEQ ID NO: 734387 - RNA, 63 nt, hsa
gcugggcuacccccccuccugcugccuaauaaagagacugagcccugaugcugagcaugcugc

SEQ ID NO: 734388 - RNA, 63 nt, hsa
aagcaucacugaacuugcccagccgggacacuggagacugaagaaguuccccggagcaggacu

SEQ ID NO: 734389 - RNA, 63 nt, hsa
cagaacaccuuuccuuucucacccagaacuuaagagacugauuuuuuguuucaucugcauuug

SEQ ID NO: 734390 - RNA, 63 nt, hsa
ucauucagauagaaaagugaucauguccaaugggagacugaagugugcagguucuucuauguu

SEQ ID NO: 734391 - RNA, 63 nt, hsa
ugguguugcugaaaggggaggcugagccagugcgagacugaacuugugcagccuuagccaaga

SEQ ID NO: 734392 - RNA, 63 nt, hsa
ucugagcagccugcguggccgucuggaguccgugagacugaaaggacccgugcaucuuacugu

SEQ ID NO: 734393 - RNA, 63 nt, hsa
ccugccauuuccacccuccagucauuucucuaugagacugaagcaggaaggcagagcaucauc

SEQ ID NO: 734394 - RNA, 63 nt, hsa
gcuacucaggacacugacguaggaggguugcuugagacugagaguuggaggcugcgaugagcc

SEQ ID NO: 734395 - RNA, 63 nt, hsa
gcggugggacagggacacuuugccuggaaaguggagacugagaugacguggaucauaaugagu

SEQ ID NO: 734396 - RNA, 63 nt, hsa
caaagcaguauguacaggcugagacacagcccagagacugaacggcaaucuuuccacacugug

SEQ ID NO: 734397 - RNA, 63 nt, hsa
ggcgcagccgcggcgggcgaggccaauggaaaggagacugaggggagucccggcagugagccc

SEQ ID NO: 734398 - RNA, 63 nt, hsa
aacccacgaggaccaucgggggcagagucguuggagacugaagaggaagaggaggaggagaag

SEQ ID NO: 734399 - RNA, 63 nt, hsa
ggaggguccagacuguccacucggggguggagugagacugacugcaagccccacccuccuuga

SEQ ID NO: 734400 - RNA, 63 nt, hsa
cucagggagggucauccuccauguuuugaagaagagacugagguucagagaggauaagaggcg

SEQ ID NO: 734401 - RNA, 63 nt, hsa
ugguggcuggcgccuguaaucccagcuacucaggagacugaggcagaaggaucgcuugaaccu

SEQ ID NO: 734402 - RNA, 63 nt, hsa
agauucuuuuguuuguuuguucguuuguuuuuugagacugaguuucacucuuucgcccaggcu

SEQ ID NO: 734403 - RNA, 63 nt, hsa
uguguauuuuuugugugccugggcuggagaugagagacugagucauaacugauuuaaaaguuu

SEQ ID NO: 734404 - RNA, 63 nt, hsa
cgguggcucacgcuugcaaucccagugcuuugggagacugaggcaggaggaucacuuaaggcc

SEQ ID NO: 734405 - RNA, 63 nt, hsa
cguuggggacaugagauuuuauuuuuugugagugagacugagggaucguagauuuuuacaauc

SEQ ID NO: 734406 - RNA, 63 nt, hsa
augcagcuccaagccauuguauggcccaugugggagacugaugggacauggagaaugacagua

SEQ ID NO: 734407 - RNA, 63 nt, hsa
ugugaggggacagcagcccuuggugcaaagccagagacugauccuggcucugacggcugaaga

SEQ ID NO: 734408 - RNA, 63 nt, hsa
auuucuuuuucuuuuucuuuuuuuuuuuuuuuugagacugagucucgcucugccgcccaggcu

SEQ ID NO: 734409 - RNA, 63 nt, hsa
cccaguccugccuuccaccccccaaccaggccugagacugaucaaacaauaaacacguuuccc

SEQ ID NO: 734410 - RNA, 63 nt, hsa
auucccucuaugucaagaguaaauagaggcacagagacugaugagaaacguucauaacaugaa

SEQ ID NO: 734411 - RNA, 63 nt, hsa
agagagggccacauaucgugugccagaggcugagagacugagagggaugacaggcuuagggga

SEQ ID NO: 734412 - RNA, 63 nt, hsa
ccuguacuguaaagacuaaaaggcguuugcucugagacugacaaggcggaaacuuccaugugu

SEQ ID NO: 734413 - RNA, 63 nt, hsa
cccaaucccucaccccccacaccucagccacuggagacugaugauccaaccacaggaucccua

SEQ ID NO: 734414 - RNA, 63 nt, hsa
ucucuguggcaaccgcagguggcucugaggugagagacugaagaagcagagccuguaucaugg

SEQ ID NO: 734415 - RNA, 63 nt, hsa
gacccaacugugccguuuguccccucucuuauggagacugaauaaaccaccucuggcccaugu

SEQ ID NO: 734416 - RNA, 63 nt, hsa
uuucuguuuuuuaaaugaucaugaaaccaaaaagagacugaucauccaggccucagccucauc

SEQ ID NO: 734417 - RNA, 63 nt, hsa
agagaccggccguacaccuucugcaucucacuggagacugaacacuagucccuugcggucacg

SEQ ID NO: 734418 - RNA, 63 nt, hsa
ccccaucuaccugagucugauucuuuagcagcagagacugaggggugcagagugugagcuggg

SEQ ID NO: 734419 - RNA, 60 nt, hsa
agcccucgaagccacaaugagauuuuuguagagacugaagcaguuguuucuguuuacaug

SEQ ID NO: 734420 - RNA, 63 nt, hsa
aaaauuauuuguuguugaagcagucauaaaacugagacugagacagaauauugaauucagaaa

SEQ ID NO: 734421 - RNA, 63 nt, hsa
cagugaagguugugaacuuuauagugaauagaugagacugacaacgucugaacccacucauca

SEQ ID NO: 734422 - RNA, 63 nt, hsa
uuauuacaaaguaaaggaugguuuuauaaaauugagacugaugaaacaucaauacuagagccc

SEQ ID NO: 734423 - RNA, 63 nt, hsa
ugggaggccgagacgggcggaucacgaggucaggagacugagaccauccuggcuaacacggug

SEQ ID NO: 734424 - RNA, 63 nt, hsa
ugagggcucacgaccccugcagcaaagaagcccgagacugauuccuuuagaauuaacagcccu

SEQ ID NO: 734425 - RNA, 63 nt, hsa
acuaacgguagaaaaguuauugccuaggagugugagacugauguugcuggacagaaagugauc

SEQ ID NO: 734426 - RNA, 63 nt, hsa
ucugguuugggagagaccaucgacuuggccagugagacugagaauggauuccgaguagugaug

SEQ ID NO: 734427 - RNA, 63 nt, hsa
gggcaggggccaccagccuccccuucuuguggugagacugaauuuugggcucagacaccagca

SEQ ID NO: 734428 - RNA, 63 nt, hsa
uugcaaagcccuccccugucccaggacaaagcugagacugacgggugauguugcucauaggcu

SEQ ID NO: 734429 - RNA, 63 nt, hsa
gucacgugauccaaacuuuuuuucaguaauauggagacugagcugcaugguaguuggggauca

SEQ ID NO: 734430 - RNA, 63 nt, hsa
ucuaaacacaccaggacucccauccaucgccuugagacugaccguaaaccacagacgcucucc

SEQ ID NO: 734431 - RNA, 63 nt, hsa
ggaacccuguucuacugcaaaacacuggaaaaagagacugaaaaaaagcaauguacuguacau

SEQ ID NO: 734432 - RNA, 63 nt, hsa
cacuugccccuaaguccuucagacauguugagagagacugagacaggagucuuccggagucag

SEQ ID NO: 734433 - RNA, 63 nt, hsa
ggaccuccuuagcccugucugcuaggcgcuggggagacugauaacuuggggaggcaagagacu

SEQ ID NO: 734434 - RNA, 63 nt, hsa
ggaaacuguugugggcgcugcuuccaggauaaggagacugaggcuuagagagaggaggcagcc

SEQ ID NO: 734435 - RNA, 63 nt, hsa
uuacagucccuuuuggcccucacauccaauaaagagacugauaccacuggaguggcuggcuuu

SEQ ID NO: 734436 - RNA, 63 nt, hsa
ucuaguuaaauagcacaguuuggaaacuugucugagacugacuuuaucaauaaucuaaccgac

SEQ ID NO: 734437 - RNA, 63 nt, hsa
cagccugcucuggagccugcagaugagauccgggagacugacacgaagccagcagaggucaga

SEQ ID NO: 734438 - RNA, 63 nt, hsa
agaagucuugggaccagaaaauggcaaugauaggagacugacauagaagaagaaugcuucccu

SEQ ID NO: 734439 - RNA, 63 nt, hsa
uuuaagucuuugaucgaaggaaaauagaucuaugagacugaaaaaccuauuugcuugauuacc

SEQ ID NO: 734440 - RNA, 63 nt, hsa
cuguggcucacgccugcaaucccagcacuuugggagacugaggcgggcggaucaugaggucag

SEQ ID NO: 734441 - RNA, 63 nt, hsa
ccauaaauuuccaggaucagacuaacggcuaaagagacugaugcaucaacaccaggcagagaa

SEQ ID NO: 734442 - RNA, 63 nt, hsa
uucaggaaaauuacauccucccauggaggaugagagacugaggcucagggagggcaaggaaua

SEQ ID NO: 734443 - RNA, 63 nt, hsa
ggaguggaggcagccugcagaggaagggugcgggagacugagccggcaguggcuugcuuggag

SEQ ID NO: 734444 - RNA, 63 nt, hsa
accaccaccaugccuccaccugacuuuggcuuggagacugauccucucuguguaaauucugcc

SEQ ID NO: 734445 - RNA, 63 nt, hsa
uuaacuccaagaacuugggauaagagugugagagagacugauggggucgcucuuugggggaaa

SEQ ID NO: 734446 - RNA, 63 nt, hsa
acacaccuguaucccagagagcaaagugaugaggagacugagcguccccagccccaccuggcg

SEQ ID NO: 734447 - RNA, 63 nt, hsa
uggaauuuguaaauuuacauuuuuuuuaaagaagagacugauguguagauagaaaacccuuuu

SEQ ID NO: 734448 - RNA, 63 nt, hsa
gaagugugaggaaaugcagauguacgugacaaugagacugaccuuucucaggaauauuuggag

SEQ ID NO: 734449 - RNA, 63 nt, hsa
ugguggcucaugccuguaaucccagcacuuugggagacugagaugggaggaucgcuugagacc

SEQ ID NO: 734450 - RNA, 63 nt, hsa
cugcaaucauuguacagggggaaauggguaugagagacugaggcuugagugaacugaaggcaa

SEQ ID NO: 734451 - RNA, 63 nt, hsa
gccuauggaaaggguguggcuuggaacauuugggagacugagcuugauucuaaaggggacaga

SEQ ID NO: 734452 - RNA, 63 nt, hsa
uguuuaauauauaguuuaaaguaacaaauaaucgagacugaaagaauguuaagauuuaucugc

SEQ ID NO: 734453 - RNA, 63 nt, hsa; identical to SEQ ID NO: 734452

SEQ ID NO: 734454 - RNA, 63 nt, hsa
gaaaauggacugaaguuucuggagcccuugucugagacugaaccuccugagaaggggccccua

SEQ ID NO: 734455 - RNA, 63 nt, hsa
cacaaagcaggaggccacauaaagacagaggcagagacugaagugaugcugccccaagcccag

SEQ ID NO: 734456 - RNA, 64 nt, hsa
gagccagcuggcgugucgggaaggauccaggaucugcaaacacaacugcucaggccuucucacg

SEQ ID NO: 734457 - RNA, 64 nt, hsa
guuuucucuuuggugguuucuaaagugccuuaucugcaaacaacuucuuuucuccuucaggaac

SEQ ID NO: 734458 - RNA, 64 nt, hsa
uggccuccauucucuugggggagucuuggcacuuugcaaacauccuggccaccaugggcaccag

SEQ ID NO: 734459 - RNA, 64 nt, hsa
ccagcccccauacugacagacggacagacagacaugcaaacaccagacugaagcacauguaaua

SEQ ID NO: 734460 - RNA, 64 nt, hsa
ugggcaauauccuucacuuuacuacaguuacuuuugcaaacagacagaaaggauacacuucuaa

SEQ ID NO: 734461 - RNA, 64 nt, hsa
augaacugaauaaagcuucuguuguagcaugccaugcaaacacauuauuguguuugugguugau

SEQ ID NO: 734462 - RNA, 64 nt, hsa
aauuacagcaguuucaaaacucuaccauggauaaugcaaacaaaccgaagcuacaugccaauga

SEQ ID NO: 734463 - RNA, 64 nt, hsa
gugucugugagaggcagcuaucugcacucuaaacugcaaacagaaaucagguguuuuaagacug

SEQ ID NO: 734464 - RNA, 64 nt, hsa; identical to SEQ ID NO: 55124

SEQ ID NO: 734465 - RNA, 64 nt, hsa; identical to SEQ ID NO: 55125

SEQ ID NO: 734466 - RNA, 64 nt, hsa; identical to SEQ ID NO: 55126

SEQ ID NO: 734467 - RNA, 64 nt, hsa; identical to SEQ ID NO: 55127

SEQ ID NO: 734468 - RNA, 64 nt, hsa
aacagccuaauuuugagugucugugucuuagaccugcaaacagcuaauaggaaauucuauuaau

SEQ ID NO: 734469 - RNA, 64 nt, hsa
aguguugcagggagguguuaagaagagaacucugugcaaacagugauggaaggcuguugucuug

SEQ ID NO: 734470 - RNA, 64 nt, hsa
ugaaucacugcaggcuguguucuugcaucuugucugcaaacaggucccugccuuuuuagaagca

SEQ ID NO: 734471 - RNA, 64 nt, hsa
uugguuuuaaaaccaauacaccauacuuucuuucugcaaacagccaucuuuauacuuagggaag

SEQ ID NO: 734472 - RNA, 64 nt, hsa
gguacugugugguggauacaugacaauauccauuugcaaacacaagaacuauacacauggccag

SEQ ID NO: 734473 - RNA, 64 nt, hsa; identical to SEQ ID NO: 55128

SEQ ID NO: 734474 - RNA, 64 nt, hsa; identical to SEQ ID NO: 55129

SEQ ID NO: 734475 - RNA, 64 nt, hsa
ugccucaguuccucucaaaagcacuaaaucuaagugcaaacaaguauucauuuucauacaggaa

SEQ ID NO: 734476 - RNA, 64 nt, hsa
caggucagcuguuacuuucuuucagauguuuauuugcaaacaaccauuuuuuguucuguguccc

SEQ ID NO: 734477 - RNA, 64 nt, hsa
guugcggaaagguaaccacaaaguuaugaugaacugcaaacauccaaaggaugugagaguuuuu

SEQ ID NO: 734478 - RNA, 64 nt, hsa
ucuucaauaaaaucuuucuauauagccauuucagugcaaacaaguaaaaucaaaaaagaccauc

SEQ ID NO: 734479 - RNA, 64 nt, hsa
gcaaaaccaagagcuguucuucccagaagagcccugcaaacacauugguucgugcuucccuuua

SEQ ID NO: 734480 - RNA, 64 nt, hsa
gugaguguucagaaauuagaucuacaagaaguuuugcaaacagacccucagggccaggcaaugu

SEQ ID NO: 734481 - RNA, 64 nt, hsa
auguggcaacauucugucagccucuuucauagugugcaaacauuuuaucauucuaaauggugac

SEQ ID NO: 734482 - RNA, 64 nt, hsa
cugcuuuuggugcucucaccuuaucuggaagaucugcaaacauuaccuaaauaggcuggcaaga

SEQ ID NO: 734483 - RNA, 64 nt, hsa
ccuuugaccaucucuuaggucuaaugauauuuuaugcaaacaguucuuggaccccugaauucaa

SEQ ID NO: 734484 - RNA, 64 nt, hsa
guuuguuuaacugugaguggcugcacaggcacugugcaaacaaugaaaagccccuucacuucug

SEQ ID NO: 734485 - RNA, 64 nt, hsa; identical to SEQ ID NO: 55130

SEQ ID NO: 734486 - RNA, 64 nt, hsa; identical to SEQ ID NO: 55131

SEQ ID NO: 734487 - RNA, 64 nt, hsa
gaggccaaacguuuugaacuaauaaaagcauaaaugcaaacacacaaagguauaauuuuaugaa

SEQ ID NO: 734488 - RNA, 64 nt, hsa
uaaguaauuaucauugguugcuuuucaauauaauugcaaacaaauuaaaaacacaguuaaacua

SEQ ID NO: 734489 - RNA, 64 nt, hsa
cccaaccagguugcaguagcaguggauguuagccugcaaacaacauuaggggauucuucuuuug

SEQ ID NO: 734490 - RNA, 64 nt, hsa
uggcuucuugugcaauaauaugauguuuuaagugugcaaacaaguuagagcuggcagcugaaug

SEQ ID NO: 734491 - RNA, 64 nt, hsa; identical to SEQ ID NO: 55132

SEQ ID NO: 734492 - RNA, 64 nt, hsa; identical to SEQ ID NO: 55133

SEQ ID NO: 734493 - RNA, 64 nt, hsa; identical to SEQ ID NO: 55134

SEQ ID NO: 734494 - RNA, 64 nt, hsa; identical to SEQ ID NO: 55135

SEQ ID NO: 734495 - RNA, 64 nt, hsa
auguuccaagcacuuuaggcagacaccagcuguuugcaaacaaugugcuaauaugcaaaugaug

SEQ ID NO: 734496 - RNA, 64 nt, hsa
auagaauaaaagcuauaaaguauauauuaggaucugcaaacaaugaagaauuauguaauauauu

SEQ ID NO: 734497 - RNA, 64 nt, hsa
gauaggggagggauuaagcuaagaacuuacagaaugcaaacacgagcacacucucuucgaaccc

SEQ ID NO: 734498 - RNA, 64 nt, hsa
uuauuggggccuuuuauucuuucccaaagugcuuugcaaacauuaaguuuuagccacuagcugc

SEQ ID NO: 734499 - RNA, 64 nt, hsa
uuacagugaccccaucuaaauaaaauacugcuuuugcaaacagaacacuguaauaggguaguuc

SEQ ID NO: 734500 - RNA, 64 nt, hsa
uucaccauggcaauauguauuucccuuaaaacacugcaaacaaauauacuaggagugugcccuu

SEQ ID NO: 734501 - RNA, 64 nt, hsa
cagccucuaggcuagcggcugcauucguggucugugcaaacacuucgugguucuauauaucagc

SEQ ID NO: 734502 - RNA, 64 nt, hsa
auccagagcuauagguacagugugaucucagcuuugcaaacacauuuucuacauagauaguacu

SEQ ID NO: 734503 - RNA, 64 nt, hsa
aacuccuuuugucuauaaccaggcccuggcaaagugcaaacaggaugcaacugcaguggcacaa

SEQ ID NO: 734504 - RNA, 64 nt, hsa
caaugggguuuucuagauauacagucaugucgucugcaaacagggacaauuugacuuccucuuu

SEQ ID NO: 734505 - RNA, 64 nt, hsa
caaguuuaguucuuuuuguagaucauauuaaaauugcaaacaaaaucaucuuuaaugggccagc

SEQ ID NO: 734506 - RNA, 64 nt, hsa
ucuucucggagucucauauuuugugggacuccugugcaaacauauguuauuaaaauuuuuuucc

SEQ ID NO: 734507 - RNA, 64 nt, hsa
ccuucuuggagucucauauuucguggaacuccugugcaaacauauauuauuaaauuuuuuuucc

SEQ ID NO: 734508 - RNA, 64 nt, hsa
ugugccaaaaagaaaaaaagcuagagacccuuuuugcaaacauuuggugaccacacauuugagg

SEQ ID NO: 734509 - RNA, 64 nt, hsa
ccucugugcugugugugacgugaccggacuuuucugcaaacaccaacauguugggaaacuuggc

SEQ ID NO: 734510 - RNA, 64 nt, hsa
cuguuuuccugcacacuaaauagcuagcaaucuaugcaaacaccuuucccauaaagaaaccaaa

SEQ ID NO: 734511 - RNA, 64 nt, hsa
aaaguacagaaaaaagccacaugugggacucaaaugcaaacagacuuucccuagaggugaaaua

SEQ ID NO: 734512 - RNA, 64 nt, hsa
uucuuaacuauuuggauuaaagcuuugugguucaugcaaacaaugugcagaugauagcaccucc

SEQ ID NO: 734513 - RNA, 64 nt, hsa
cuguugguucaaacuauguuaguuuacaguuuguugcaaacauuguaaaauacagcgacaugua

SEQ ID NO: 734514 - RNA, 64 nt, hsa
uggaucaaaucaaucugcaguugauguccccaaaugcaaacacaggcacacacaugcacacacc

SEQ ID NO: 734515 - RNA, 64 nt, hsa
uaucuguugcauacuuaguuuuuaguccuguaaaugcaaacacagcauuuuuuacaacuuucuu

SEQ ID NO: 734516 - RNA, 64 nt, hsa
uauagcuggaccuaaguucucagaagcguagaugugcaaacaagcgauugaguugggcuuuagg

SEQ ID NO: 734517 - RNA, 64 nt, hsa
gccaucauguaaauuaccaguaaaguguaacauaugcaaacauaacaaaaucacuuccauagug

SEQ ID NO: 734518 - RNA, 64 nt, hsa
agcauggauuaacucauccugcugcugagggcagugcaaacaggugcuuauuagagguagugac

SEQ ID NO: 734519 - RNA, 64 nt, hsa
cacacauacagcuacggauauaaugaaaauuaucugcaaacaccuaaauuaaagagaaaaaaaa

SEQ ID NO: 734520 - RNA, 64 nt, hsa
cuggccuucggagccagccagcacuuugggcaaaugcaaacaacaaugagugcuugagauaaaa

SEQ ID NO: 734521 - RNA, 64 nt, hsa
ccaccucaucauagaugggaacuuuuguuuucagugcaaacaauguuggagcuguaauaguaag

SEQ ID NO: 734522 - RNA, 64 nt, hsa
agcaaagauguacugggcaguaacuaaacacacaugcaaacaugugaauggugguuuauuccuc

SEQ ID NO: 734523 - RNA, 64 nt, hsa
uuuucuuugacaaaaauguguacuguguaagccuugcaaacaaaaaacaacaaaaaagaagcag

SEQ ID NO: 734524 - RNA, 64 nt, hsa
ugaugagcuauccauaugaugguucugcagccauugcaaacauuuuuaaagacaauuuaaugcc

SEQ ID NO: 734525 - RNA, 64 nt, hsa
uuaauaaauuccauguuauguauaaggaguuaauugcaaacaugcaauugagaaacuggauaga

SEQ ID NO: 734526 - RNA, 64 nt, hsa
gcccugaacacacaccuucccuuugcccaggcggugcaaacaauccacuucuucaagcuccaac

SEQ ID NO: 734527 - RNA, 64 nt, hsa
augcuagugaguccaagugguggaaaauauagacugcaaacaagugcuuguugccccacacggc

SEQ ID NO: 734528 - RNA, 64 nt, hsa
guguuauaaaaugacugugcuuguucguaacagaugcaaacaagaaagaagaacugggaagucu

SEQ ID NO: 734529 - RNA, 64 nt, hsa
ggaaauguauaaacuaaaguaagcugauuggcuuugcaaacauguucauuuguuuuucagacag

SEQ ID NO: 734530 - RNA, 64 nt, hsa
aauuucagucaugucuucaugcuuucagccucucugcaaacauuuauuuugugugcuagauacu

SEQ ID NO: 734531 - RNA, 64 nt, hsa
auuauugguauuaaugugcuuuuuuuguauaaagugcaaacauuucgucccaaagucuaaguac

SEQ ID NO: 734532 - RNA, 64 nt, hsa
auucacggaaagcaaguugaugaccagaaaucagugcaaacacaucuucuguuaaacccauugg

SEQ ID NO: 734533 - RNA, 64 nt, hsa
auauauauuuuguuucuuuaaauuucaaauguuuugcaaacaucacugaguuaggugggggugg

SEQ ID NO: 734534 - RNA, 64 nt, hsa
uuacaauauuauuuuuuuaaccaauguauuuguuugcaaacauuugccauguugaagagugugu

SEQ ID NO: 734535 - RNA, 64 nt, hsa
auauguagagcaauaaugcaaaagcuguucuauaugcaaacaugaugucuuuauuauucaggag

SEQ ID NO: 734536 - RNA, 64 nt, hsa
ugcccagccugugcgugucaaccccaccgacugcugcaaacaguguccaggugagagagguggc

SEQ ID NO: 734537 - RNA, 64 nt, hsa
guguuuguucagcguauucauucacucacucguuugcaaacauaaugggcaguggucauuuacu

SEQ ID NO: 734538 - RNA, 64 nt, hsa
uuuuguuuguuuguuuguuuucuuaggcgggaacugcaaacagacucuuuucugagacuauuua

SEQ ID NO: 734539 - RNA, 64 nt, hsa
cucauuacugaccucucaaaguuauaaggaucucugcaaacaggaucuaagcuuaggaauaaua

SEQ ID NO: 734540 - RNA, 64 nt, hsa
cugguuccccccagacacgaguaacauggcaucuugcaaacaucagccuccacucucccagcuu

SEQ ID NO: 734541 - RNA, 64 nt, hsa
uuaaaacugaagauuuccucuggaagcuaccacaugcaaacauacaagcagucucaccucaggc

SEQ ID NO: 734542 - RNA, 64 nt, hsa
auuuuugucucagaagugaaaaucuuggagacccugcaaacagaacagggucauguuugcaggg

SEQ ID NO: 734543 - RNA, 64 nt, hsa
ugggacucauucacauuucaagauccaaaugcugugcaaacaguguaagcuuagauuuucugua

SEQ ID NO: 734544 - RNA, 64 nt, hsa
agaugcugcacaaaguuaccuucuguuucaucauugcaaacaaaaaucauugaaaauacuaugc

SEQ ID NO: 734545 - RNA, 64 nt, hsa
uauaauuugucacuacuuauaaaaaacauucuguugcaaacagugguguugcauugaauugaac

SEQ ID NO: 734546 - RNA, 64 nt, hsa
auauuuuuagugugaaaaacauuaauauauuauaugcaaacauuuaaauauaguacaauguuuu

SEQ ID NO: 734547 - RNA, 64 nt, hsa
uugacuuuaucuuuaggcuuuuguauguuucagaugcaaacauauuaaaguuucauauauuuac

SEQ ID NO: 734548 - RNA, 64 nt, hsa
acaagauaaaaaggauagugaaucauucuuuacaugcaaacauuuuccaguuacuuaacugauc

SEQ ID NO: 734549 - RNA, 64 nt, hsa
uauaccaccagacugcaaugccaguuuccucuacugcaaacaguguucugugacaaaaaaaaaa

SEQ ID NO: 734550 - RNA, 64 nt, hsa
caguuccugcacaaaaaguguccagagggcuguuugcaaacacuagugcacuuuguagcuuuuc

SEQ ID NO: 734551 - RNA, 64 nt, hsa
cuguaacuaguuguaagugcuuaggaagaaacuuugcaaacauuuaaugaggauacacuguuca

SEQ ID NO: 734552 - RNA, 64 nt, hsa
cucugaugccugcugucucaguguuugguuauuaugcaaacaaguaauguuugaaauauauaau

SEQ ID NO: 734553 - RNA, 64 nt, hsa
cugacgagagauguauauuuaauuuuuuaacugcugcaaacauuguacauccaaauuaaaggaa

SEQ ID NO: 734554 - RNA, 64 nt, hsa
ucuuccuucacucacccagcaggucaguuuucugugcaaacaaaccuguuuaggauucuuccaa

SEQ ID NO: 734555 - RNA, 64 nt, hsa
ccauuugcauucuuucuguuugguauuaaaaguuugcaaacaaaaauacauugcaugagccauu

SEQ ID NO: 734556 - RNA, 64 nt, hsa
caucuuacucacauccagauuuauuuuccuacagugcaaacacaccagaugaaacuuuaaaaug

SEQ ID NO: 734557 - RNA, 64 nt, hsa
gaacuaucacuuuauaagaaucauuuucuaguaaugcaaacaaauuauuuuuuacaaaaaaaca

SEQ ID NO: 734558 - RNA, 64 nt, hsa
ccugcuauaaaguuaaagucacacauuucuauuuugcaaacacugugauuacucuuugcuuugu

SEQ ID NO: 734559 - RNA, 64 nt, hsa
ugacuuuagcugugugaauauauaauagucaaacugcaaacauuuugcaucccuuuugugaccu

SEQ ID NO: 734560 - RNA, 64 nt, hsa
caucuccagguaggaaaaaaugaaagcuauuucaugcaaacauuaucuaauuuagcuuaaaagu

SEQ ID NO: 734561 - RNA, 64 nt, hsa
cauagauugcucagcuugacacugaagcauauuaugcaaacaagcuuuguuuuaauauaaagca

SEQ ID NO: 734562 - RNA, 64 nt, hsa; identical to SEQ ID NO: 55136

SEQ ID NO: 734563 - RNA, 64 nt, hsa; identical to SEQ ID NO: 55137

SEQ ID NO: 734564 - RNA, 64 nt, hsa
ucauaugcuuuuuuuaaugaagugcuugaucacuugcaaacauauauacauguagauguacaua

SEQ ID NO: 734565 - RNA, 64 nt, hsa
uaaaaauauaacauaaucuauucaucuauuuauaugcaaacauaaaaauguaaauauugaaaca

SEQ ID NO: 734566 - RNA, 64 nt, hsa
cugaaaacuucuuguauuuccugauguaaaauugugcaaacaccuacaauaaagccaucuacuu

SEQ ID NO: 734567 - RNA, 64 nt, hsa
acucaaaagcuaaaacugaacaaauuugauguuaugcaaacaucuugcauuuuuaguaguugau

SEQ ID NO: 734568 - RNA, 64 nt, hsa
gaaacuauucaguuuuuguaguaaaggcgucacaugcaaacaaacaaaaugaaugaaacaguca

SEQ ID NO: 734569 - RNA, 64 nt, hsa
cacacuuuuccacauuccagugaugugugagcuaugcaaacaaaauccaagauucugcugguga

SEQ ID NO: 734570 - RNA, 64 nt, hsa; identical to SEQ ID NO: 55138

SEQ ID NO: 734571 - RNA, 64 nt, hsa; identical to SEQ ID NO: 55139

SEQ ID NO: 734572 - RNA, 64 nt, hsa
auccaucagcauaaugacuguguguucugagaaaugcaaacaacuuuaugaaaguguggucauc

SEQ ID NO: 734573 - RNA, 64 nt, hsa
acuaauuucaguuguacugugaaugcuaaauauuugcaaacaaguacaucuugaaaguaaaggu

SEQ ID NO: 734574 - RNA, 64 nt, hsa
ucugggaauaauaaaauugcaaccaguuugguaaugcaaacagcagaauagaaugaaaucucag

SEQ ID NO: 734575 - RNA, 64 nt, hsa
aaguacuaccuggagauuucaaauucacuuggccugcaaacaacagaguuauccguaucuucca

SEQ ID NO: 734576 - RNA, 64 nt, hsa
uauauguuuucucuguccuaauuuaaaaguacauugcaaacaucaugaaacuugaucccugaaa

SEQ ID NO: 734577 - RNA, 64 nt, hsa
cuuuccaaaggggaacuccagagacauuucauaaugcaaacagcacuguugcuuuaagaacaag

SEQ ID NO: 734578 - RNA, 64 nt, hsa
uauaauauagguguuuuguagauucuugugucacugcaaacaauaugaacuccuuuuucguauu

SEQ ID NO: 734579 - RNA, 64 nt, hsa
agggccccagagcuccugccugagcuggaccuuaugcaaacauuucugugccugcuggguaggg

SEQ ID NO: 734580 - RNA, 64 nt, hsa
gaucuuggcuuaauuuaauguauuaaucuguuugugcaaacauaauaccaccauuuaaaaaugu

SEQ ID NO: 734581 - RNA, 64 nt, hsa
caaauuagugaaccaaaaauagaaauuagauuugugcaaacauggagaaaucuacugaauuggc

SEQ ID NO: 734582 - RNA, 64 nt, hsa
cauaaacauauacauacacaaacacaaucccacaugcaaacacacacagccacauauauacaug

SEQ ID NO: 734583 - RNA, 64 nt, hsa
uaaccugaacuaauuuguucuuauuuuuugccacugcaaacauauaucuacagagagaaaaauu

SEQ ID NO: 734584 - RNA, 64 nt, hsa
uccuucaggugaucacacacaguggacgaguaugugcaaacauggacauaauaguucacuuaca

SEQ ID NO: 734585 - RNA, 64 nt, hsa
aggguugauguuacacuauuuaaggagucaucaaugcaaacagucacauuagguaugucaucau

SEQ ID NO: 734586 - RNA, 64 nt, hsa
uauuauguucaaguuauuucaggauugccauaugugcaaacaaaucaugcaaugcagccaagga

SEQ ID NO: 734587 - RNA, 64 nt, hsa
agccagaggacccaaauugccgcccuggcugugcugcaaacaagcugugagaucuugaauagug

SEQ ID NO: 734588 - RNA, 64 nt, hsa
caugucuacacaugacuacacaaaugcaaaccuuugcaaacacauuaugcuuuugcacacacac

SEQ ID NO: 734589 - RNA, 64 nt, hsa
ucagcaccuguuccgcacguaauuggcaugugucugcaaacauccuuauucccaacuuaaagug

SEQ ID NO: 734590 - RNA, 64 nt, hsa
aaaaagaggccuuauuucuuaacugugcugggauugcaaacacuuuuuaaaaaauuguuugcuu

SEQ ID NO: 734591 - RNA, 64 nt, hsa
aaucugaucuuuguuuuguauuuuugugcuaaugugcaaacauguacagaagaaauagaauaca

SEQ ID NO: 734592 - RNA, 64 nt, hsa
uaauuauuuuuagcaaaauguugccuuugucuugugcaaacauguagaauaugcucuuuaauuu

SEQ ID NO: 734593 - RNA, 64 nt, hsa
uagugcuaacaugaagaccuuuuucugcacuauaugcaaacaggguaacuaacuaaaacaaagc

SEQ ID NO: 734594 - RNA, 64 nt, hsa
aaauuaucaaauaaaaccagugaagaucugaagaugcaaacauuucaacuaugaagauuuacau

SEQ ID NO: 734595 - RNA, 64 nt, hsa
gacaagccagagaucucccacaccuccagagaugugcaaacagcugggaggaaaagccugggag

SEQ ID NO: 734596 - RNA, 64 nt, hsa
ggcacucuucaaauuuuuauuuuaaaaauuauaaugcaaacaucuggccaucaccuuaaccaag

SEQ ID NO: 734597 - RNA, 64 nt, hsa
auuuuaugcugaguuuuaaaaaugaaauacuuuaugcaaacaggcaaaauugguaccaaaggga

SEQ ID NO: 734598 - RNA, 64 nt, hsa
uaccaccguggguacauuguugggcaggagugugugcaaacacaggucugugugugcaaucuca

SEQ ID NO: 734599 - RNA, 64 nt, hsa
uaacagaacaggagguaucaaacuagcugcuaugugcaaacagcguccauuuuuucauauuaga

SEQ ID NO: 734600 - RNA, 64 nt, hsa
auuugauuuacaaaaacgcuaacuuuguuugaaaugcaaacagguuugaaaauauguauuaagu

SEQ ID NO: 734601 - RNA, 64 nt, hsa
ugacucaaaguagaucguuauuuugaucaaacugugcaaacaguaguaccacguguagcauuuu

SEQ ID NO: 734602 - RNA, 64 nt, hsa
uuguauguaugggagugaggaguuucagggccauugcaaacauagcugugcccuugaagagaau

SEQ ID NO: 734603 - RNA, 64 nt, hsa; identical to SEQ ID NO: 55140

SEQ ID NO: 734604 - RNA, 64 nt, hsa; identical to SEQ ID NO: 55141

SEQ ID NO: 734605 - RNA, 64 nt, hsa
acauucaaauggaaggaaccaccugaauuauaucugcaaacaaaauggaaauaguuguugaaua

SEQ ID NO: 734606 - RNA, 64 nt, hsa
uguucuguuucuucuuuuaagcucuaugcaaucaugcaaacauagugaucauagcgucaacaug

SEQ ID NO: 734607 - RNA, 64 nt, hsa
aaacuuaaauucuagccggucauuuucuuaaaacugcaaacauuucucucgaguguggacuggc

SEQ ID NO: 734608 - RNA, 64 nt, hsa
gacggcucaccgagagcauaucuaaaaaacacucugcaaacauuuggucacaugcaaguuagug

SEQ ID NO: 734609 - RNA, 64 nt, hsa
cucccuucacugauacugaaaucaugguaucugcugcaaacaugaguagauccaugauggauua

SEQ ID NO: 734610 - RNA, 64 nt, hsa
accggcagagcucuacaggccugcagccccuaagugcaaacacagcauggguccagaagacgug

SEQ ID NO: 734611 - RNA, 64 nt, hsa
gaaaggaagggcugguccugccccuuugagggggugcaaacaugacugggaccuaagagccaga

SEQ ID NO: 734612 - RNA, 64 nt, hsa
uggagaaacuaggagacugggacaagcaaaaggcugcaaacaacccagaagcccauccucagaa

SEQ ID NO: 734613 - RNA, 64 nt, hsa; identical to SEQ ID NO: 55142

SEQ ID NO: 734614 - RNA, 64 nt, hsa; identical to SEQ ID NO: 55143

SEQ ID NO: 734615 - RNA, 64 nt, hsa
acgaaagugauacggagguuaggaugcuacuugcugcaaacaagcccuacuuuggccaacaucc

SEQ ID NO: 734616 - RNA, 64 nt, hsa
guuaaauguauauuuugguuguauuauaauaaaaugcaaacaugacuguucuaugauuauaaaa

SEQ ID NO: 734617 - RNA, 64 nt, hsa
uugucacggucacuagcugaucccucaggucugcugcaaacacagcauggaggacacagaugac

SEQ ID NO: 734618 - RNA, 64 nt, hsa
agagagguaguagguaggugcaguguguggaagcugcaaacaaguaggccuuuuauucauugau

SEQ ID NO: 734619 - RNA, 64 nt, hsa
acuaguuggcauccuuuugaacuuuugucuccuuugcaaacagugguccuaaaauacgaggucu

SEQ ID NO: 734620 - RNA, 64 nt, hsa
aguuuggggucagugguauaaaggggguauauguugcaaacaaauguuuuaguaacaguuggcu

SEQ ID NO: 734621 - RNA, 64 nt, hsa
cuccagugacaccucccagagaaguuccuauauaugcaaacagauuugcaguaccaaccuaugc

SEQ ID NO: 734622 - RNA, 64 nt, hsa
uucugauaacuuguuccuuuuccugacuccuccuugcaaacaaaaugauaguugacacuuuauc

SEQ ID NO: 734623 - RNA, 64 nt, hsa
uuuuuuuuuuuuuucuguaaaucuuucuucccauugcaaacaaguagugaucaguuuauacuuu

SEQ ID NO: 734624 - RNA, 64 nt, hsa
gaugcguuuugcacuacucuuuccauuuauaugcugcaaacaacuacagucuuugaaauaugga

SEQ ID NO: 734625 - RNA, 64 nt, hsa
cgugaaauuuuuuuuccugaauuggacauguguuugcaaacacuugucuugaagauuaugcugu

SEQ ID NO: 734626 - RNA, 64 nt, hsa
acaugccacuguacauucagauauuauuuaaauuugcaaacacauuguucuauauguaagggua

SEQ ID NO: 734627 - RNA, 64 nt, hsa
gaagaaacagggcuggaugauuuugcagguccaaugcaaacaucacagaccccacccaugcaua

SEQ ID NO: 734628 - RNA, 64 nt, hsa
aauuuaaaucugauuaauccauuuuaacaaacaaugcaaacaucuucagugcagaaggaagagu

SEQ ID NO: 734629 - RNA, 64 nt, hsa
aagaaaugucuuuugcccguuuugauuacgugcaugcaaacagcgauuugcaaagaccguauga

SEQ ID NO: 734630 - RNA, 64 nt, hsa
auccuuccauaugugugauuugucuucuuccagcugcaaacagcuaaagggauggucugguguu

SEQ ID NO: 734631 - RNA, 64 nt, hsa
caccaaacaaaauuuucuauuacaguuguguacuugcaaacauuuugcuauacaguacuucaua

SEQ ID NO: 734632 - RNA, 64 nt, hsa
uaaccaguccuuauuucugcauuucuuugguugaugcaaacaaaaaacuauuauauuuaagaac

SEQ ID NO: 734633 - RNA, 64 nt, hsa
uaucaauucuugagaguuaaugugaucaugauauugcaaacaacuauaaauggucucuaggccu

SEQ ID NO: 734634 - RNA, 64 nt, hsa
uuuaauaugcacagcaucuuagaaaaguuuaaccugcaaacacuuuuaaaacauaaugccuacu

SEQ ID NO: 734635 - RNA, 64 nt, hsa
uugccaagauugagaaauagccucuucacugguaugcaaacagauuugauuuugcauccuauca

SEQ ID NO: 734636 - RNA, 64 nt, hsa
ucucuguuccaguauacaucuuuccuucuuauucugcaaacauuagaccacuugauauucuuua

SEQ ID NO: 734637 - RNA, 64 nt, hsa; identical to SEQ ID NO: 55144

SEQ ID NO: 734638 - RNA, 64 nt, hsa; identical to SEQ ID NO: 55145

SEQ ID NO: 734639 - RNA, 64 nt, hsa
aacugaaagcauuuuaauggacuauuuauuaaagugcaaacaaacucagcaauccuuauguaga

SEQ ID NO: 734640 - RNA, 64 nt, hsa
uaaggauuucagauuauagucuaugugagauaugugcaaacauguacauauuuccccuagaagc

SEQ ID NO: 734641 - RNA, 64 nt, hsa
uuuagucuaaaaagcugucugguuguauaaacggugcaaacaaugucgccacagcacccacgcg

SEQ ID NO: 734642 - RNA, 62 nt, hsa
gugaaagauugaacuagaauaaugaaaguuuguuugcaaacauuuugguccucucagcguuc

SEQ ID NO: 734643 - RNA, 64 nt, hsa
aauuggcuauaaucacaauuuaauaauuuaucaaugcaaacaguacauuaaaaacuguagcaca

SEQ ID NO: 734644 - RNA, 64 nt, hsa
cuuugaccccaaggccuggagggcccaaugucgcugcaaacacagccacgaagaacaugcagcc

SEQ ID NO: 734645 - RNA, 64 nt, hsa
caguauugcuuauugugacuuuggcaugcauuuuugcaaacaaugcuguaagauuuauacuacu

SEQ ID NO: 734646 - RNA, 64 nt, hsa
gggcuauguacaaccuggcacgauccagaaagggugcaaacaaaaugccuacauccaggcacac

SEQ ID NO: 734647 - RNA, 64 nt, hsa
gacaauguagcagaauaccaggcagacagaaccuugcaaacaccuuaacuucuaaccaaagacu

SEQ ID NO: 734648 - RNA, 64 nt, hsa
agaggaacggaaaugggacgucuuccuuaacaucugcaaacaaggaggcgcugggauaucaaac

SEQ ID NO: 734649 - RNA, 64 nt, hsa
uccaggcugugugacugcagggccacaugcugccugcaaacagggcaagaccacggaggcacag

SEQ ID NO: 734650 - RNA, 64 nt, hsa
guguacuguauagacaguuuguaaauguuauuucugcaaacaaacaccuucuuauuauauauau

SEQ ID NO: 734651 - RNA, 64 nt, hsa
uuuugcacgugcucuucuguucucaaaugcuaaaugcaaacacuguguauuuauuaguuaggug

SEQ ID NO: 734652 - RNA, 64 nt, hsa
ucauuuaaucaucuuugagagacaaaaugaccucugcaaacagaaucuuggauauuucuucuga

SEQ ID NO: 734653 - RNA, 64 nt, hsa
gucauacuagagauugguugugccuugucacaacugcaaacaauaccugaguggaguauucaaa

SEQ ID NO: 734654 - RNA, 64 nt, hsa
uagaacaguuuuuaggcagccuuuacuaaaguuaugcaaacacacaguuccccauuuacuacau

SEQ ID NO: 734655 - RNA, 64 nt, hsa
cugcccugggacauuucacuguaccaguauuaacugcaaacagcaauaauugucauuacagcaa

SEQ ID NO: 734656 - RNA, 64 nt, hsa
gcucauuccagccauuccaaucucuucuucuuuaugcaaacacuuuucccccacaacaagccuu

SEQ ID NO: 734657 - RNA, 58 nt, hsa
uuguagaaaaggaugauuaaaugaucucugcaaacaaggugcuuuuuccagaauaacc

SEQ ID NO: 734658 - RNA, 64 nt, hsa
uaucaccuuauuuugauuaaaucuuuuccaauuuugcaaacacuacaguauacugcaacacaaa

SEQ ID NO: 734659 - RNA, 64 nt, hsa
uuuuauaucagcaaaauaauucaauuuugcagguugcaaacaaauauaaaaccuguuucuguuu

SEQ ID NO: 734660 - RNA, 64 nt, hsa
uuugcucugauuaacuaguauucaaucaccaacuugcaaacagaauucauaacacuuggcacuu

SEQ ID NO: 734661 - RNA, 64 nt, hsa
ggaccuaagugccuaccuacucgcuaaucgcaggugcaaacacacaaggaguuuggugggcuua

SEQ ID NO: 734662 - RNA, 64 nt, hsa
acagaaaaucuucuuauccucuuugauauuuuauugcaaacacucagucuuuuaugauuuuuua

SEQ ID NO: 734663 - RNA, 64 nt, hsa
cuggugcuuaugcgguggugacggguguagacguugcaaacaaaucuugggaagcgaggagggc

SEQ ID NO: 734664 - RNA, 64 nt, hsa
ugggaaucuggcuuuuagcgaauguggcgucuucugcaaacaauagcaauugggcuggcuuagg

SEQ ID NO: 734665 - RNA, 64 nt, hsa
uuaaagauuuuauuuaaacuauuaagaaucaacaugcaaacagccuacuucuucaugaacaauu

SEQ ID NO: 734666 - RNA, 64 nt, hsa
caguauccuaaggaagccuucuuauuuaucuuccugcaaacaaggguuaccugaaaagaaaaaa

SEQ ID NO: 734667 - RNA, 64 nt, hsa
auaugaaugaaucagguuuuuuuuuuuuuuuuucugcaaacacuguguauagugagacuuguuc

SEQ ID NO: 734668 - RNA, 64 nt, hsa
uuacaauuagaacuccugaccccagauucaacuuugcaaacaacaggggaaaaaaauggggaaa

SEQ ID NO: 734669 - RNA, 64 nt, hsa
caucagagucaaaagcacuggcaaaggguaccccugcaaacaacuguggugggggcuggcagca

SEQ ID NO: 734670 - RNA, 64 nt, hsa
gcucccaccagggcccgguggguccuggguuuucugcaaacauggaggaccacuuucugauagg

SEQ ID NO: 734671 - RNA, 64 nt, hsa
acacaugguggaagagagaagaggcguguagguuugcaaacaaaguuaagaaauaggaaacuga

SEQ ID NO: 734672 - RNA, 64 nt, hsa
guacagacagacacaugauaagccaaacuguuccugcaaacauagcuaugcuucaugaggcuua

SEQ ID NO: 734673 - RNA, 64 nt, hsa
cacacacacacacacacacacuacagaagaggauugcaaacacauggcuccaucuucugcacac

SEQ ID NO: 734674 - RNA, 64 nt, hsa
guuuuggggaaauguggagaagagugcccugcuuugcaaacaucaaccuggcaaaaaugcaaca

SEQ ID NO: 734675 - RNA, 64 nt, hsa
cacuaaauuuauugcuuucacuacuuuugaauuuugcaaacaugaaauuaaguuuuauaauuag

SEQ ID NO: 734676 - RNA, 64 nt, hsa
gaaaggcuucauuuucuucucuuuuuuuuuaaccugcaaacaugcugauaaaauuucuccacau

SEQ ID NO: 734677 - RNA, 64 nt, hsa
aacagugccuuuccuugcccuguucucaauaacaugcaaacaaacaagccacgggaaauaugua

SEQ ID NO: 734678 - RNA, 64 nt, hsa
aguuccucuaguuguuguuuuuuuuucccaaacaugcaaacacugaggauugagcugugugggg

SEQ ID NO: 734679 - RNA, 64 nt, hsa
guucugguucacaugccuuguagcuaagucuuucugcaaacaaccucccuuccccccgucgagu

SEQ ID NO: 734680 - RNA, 64 nt, hsa
aaauauacuauugcacuaagguugugguucugauugcaaacaaacagugaacacugucugaauu

SEQ ID NO: 734681 - RNA, 64 nt, hsa; identical to SEQ ID NO: 734500

SEQ ID NO: 734682 - RNA, 64 nt, hsa
cuuuaagaaaaagaauucuaaaauaucuuacuuuugcaaacauuaugaaaauauacugccacau

SEQ ID NO: 734683 - RNA, 64 nt, hsa
aacucccauuaacauaauauaagcaucagaaaauugcaaacacuagaauuaauuuuacacucua

SEQ ID NO: 734684 - RNA, 55 nt, hsa
agcagccccgggaaaccugaggacaugcaaacaaccagucauguuccaacuucaa

SEQ ID NO: 734685 - RNA, 64 nt, hsa
gacuuaauuuucaagcacuugauuaacacaacacugcaaacagaagggagaaagugucagugac

SEQ ID NO: 734686 - RNA, 64 nt, hsa
gugaggagcgacacacacaccuguaggcauccugugcaaacacuuugucauuaucaagagagau

SEQ ID NO: 734687 - RNA, 64 nt, hsa
aucuccaacaagaucaggaaccucuccaccacacugcaaacaauagccaccaaauuaugucgug

SEQ ID NO: 734688 - RNA, 64 nt, hsa
ccucggccuuacugacaaggacaccaaccuagggugcaaacagauggacuaugguucaaggaca

SEQ ID NO: 734689 - RNA, 64 nt, hsa
acuggaagucaugucuucuaauugguugacauuuugcaaacaaauaaauuguaaucaaaagagc

SEQ ID NO: 734690 - RNA, 64 nt, hsa
aaccgaauuggguuuagucaaucacugcacugcaugcaaacaagaaacgugucacacuugugac

SEQ ID NO: 734691 - RNA, 64 nt, hsa
agagguguuucacuugcugagauuuccuguacauugcaaacaaauacagaaugcaaacccucaa

SEQ ID NO: 734692 - RNA, 64 nt, hsa
acugucuuaaagauuaugcuagcuuuagaacacaugcaaacagcugcagcucugugauuaaaau

SEQ ID NO: 734693 - RNA, 64 nt, hsa
aaaaaaaguuugcccagauugcuuaauuaaaaauugcaaacaaaaucucauuugaagucagcac

SEQ ID NO: 734694 - RNA, 64 nt, hsa
ugugauuuguagucagguaucuuuuguauuugauugcaaacauuuggauuuuaguuuucucaug

SEQ ID NO: 734695 - RNA, 64 nt, hsa
aaagcaaagaaggccaagaaaguucuaguagugcugcaaacacuaacccagcaguugccccacc

SEQ ID NO: 734696 - RNA, 64 nt, hsa
gucuggcuguguugcccugacuggaguucaguggugcaaacacagcucucuccacaaccucuug

SEQ ID NO: 734697 - RNA, 64 nt, hsa
gacuccacaggaccaaaccauagaacaauuucacugcaaacaugcaugauucuccaagacaaaa

SEQ ID NO: 734698 - RNA, 64 nt, hsa
ugaauuucaguguuagauucauagugauaagaacugcaaacagcaauuugauucuguacuuuua

SEQ ID NO: 734699 - RNA, 64 nt, hsa
ugugggcacaaaagaaggggcaccagagucccugugcaaacaccuagacucacuucauggauuc

SEQ ID NO: 734700 - RNA, 64 nt, hsa; identical to SEQ ID NO: 55146

SEQ ID NO: 734701 - RNA, 64 nt, hsa; identical to SEQ ID NO: 55147

SEQ ID NO: 734702 - RNA, 64 nt, hsa
ucaacuugcacaucuaguuaaaguccaagguaacugcaaacaguggaacauggcuuagguuuug

SEQ ID NO: 734703 - RNA, 64 nt, hsa
aggucccccuggauucaaauuaagugcaauauuuugcaaacagcucuucuuagggaaaucuccu

SEQ ID NO: 734704 - RNA, 64 nt, hsa
aaaaguguuuuguuuuuuaauucucuguuccuuuugcaaacaauuuuaaugaugguguuaaagc

SEQ ID NO: 734705 - RNA, 64 nt, hsa
agguuccagugauagaguuauaauuuugcuccuuugcaaacaaaugguaucuaauuaauaacua

SEQ ID NO: 734706 - RNA, 64 nt, hsa
agcuuccucaagauaaauuucuaguuuauuaagaugcaaacagcucucauagauggcuacuacg

SEQ ID NO: 734707 - RNA, 64 nt, hsa
uuuguauacugcaaguucccaggcaacucgaauuugcaaacacagccauggauacacuauuuac

SEQ ID NO: 734708 - RNA, 64 nt, hsa
gaaggcuuuuuuaacucauccguuugccaaucauugcaaacaacugaaauguggaugugauugc

SEQ ID NO: 734709 - RNA, 64 nt, hsa
gauuuaaaauuuucaaaaugaaauuccauauaugugcaaacagauaugggcaccacgaaauaca

SEQ ID NO: 734710 - RNA, 64 nt, hsa
uugcucagugcugucugaagaugcaguugcuguuugcaaacaacaggaacaccaguuaaacuaa

SEQ ID NO: 734711 - RNA, 64 nt, hsa
cuuguguucagccuuuuuguaacuuuuuugaaagugcaaacaauucuuuggauuauuaaauaag

SEQ ID NO: 734712 - RNA, 64 nt, hsa
acuucuguucaauuccuaauauuccacuccgcagugcaaacaaucucuuccuuuaaaaaggaau

SEQ ID NO: 734713 - RNA, 64 nt, hsa
gcuauuuccaaucacauugguacuguuugguauuugcaaacaaaaauguaguuaauguaauuuu

SEQ ID NO: 734714 - RNA, 64 nt, hsa; identical to SEQ ID NO: 55148

SEQ ID NO: 734715 - RNA, 64 nt, hsa; identical to SEQ ID NO: 55149

SEQ ID NO: 734716 - RNA, 64 nt, hsa
guauaugcacauuuaaaaaauaucauauaguaaaugcaaacaugccaaguauuuuauaaagauu

SEQ ID NO: 734717 - RNA, 64 nt, hsa
acuccauucugaggugucacaagcaaugaagcuaugcaaacaauaggagggugugacaggggaa

SEQ ID NO: 734718 - RNA, 62 nt, hsa
auccucuugguauuauaugaguaggaagugauugcaaacaggcuggauuuggacaaaaagca

SEQ ID NO: 734719 - RNA, 64 nt, hsa
aauugucaauuaaauauucaguuuuaugucuccaugcaaacauucaaagugcuuccaucagaac

SEQ ID NO: 734720 - RNA, 64 nt, hsa
caugauccaggcacauuugaaauuugguaggcauugcaaacacauuugaauauuguguauuuca

SEQ ID NO: 734721 - RNA, 64 nt, hsa
ugcugauaacaauucugggcacggugaagcccaaugcaaacagaauugcuuuagauuuccaaag

SEQ ID NO: 734722 - RNA, 64 nt, hsa
acauugcaguaauguuaaggacagguauacuuuuugcaaacaaaugcauaaaugcaaauguaaa

SEQ ID NO: 734723 - RNA, 64 nt, hsa
caugcacaguacaauaauguacucacauauaacaugcaaacagguuguuuucuacuuugccccu

SEQ ID NO: 734724 - RNA, 64 nt, hsa
aaccccuccacucuuucuuucaauaaaacgcaguugcaaacaccugauuucugaagcgguucug

SEQ ID NO: 734725 - RNA, 64 nt, hsa; identical to SEQ ID NO: 55150

SEQ ID NO: 734726 - RNA, 64 nt, hsa; identical to SEQ ID NO: 55151

SEQ ID NO: 734727 - RNA, 64 nt, hsa
uuuaaugugagcuuaagauguaaauaaauaauuuugcaaacaugccuuuuguuuucuauauacc

SEQ ID NO: 734728 - RNA, 64 nt, hsa
aaaguuuggacaguagauggacuucucagaacuuugcaaacauaaucauuguucucacccucuu

SEQ ID NO: 734729 - RNA, 64 nt, hsa
acuaugggaguguauuauaaaaucaauaauaauaugcaaacaguugugccuguguauuugaacu

SEQ ID NO: 734730 - RNA, 64 nt, hsa
gugugcauuuauuagcuauuacucaacuuuacaaugcaaacaucuuauuucucaucuuuaaaca

SEQ ID NO: 734731 - RNA, 64 nt, hsa
cucccaaaguaggugagcuauagugaagaauaggugcaaacaaacaagcuuacuuccauugcaa

SEQ ID NO: 734732 - RNA, 64 nt, hsa
ucaaagagaugaggaaauaagacuuuuagcgguuugcaaacaaaaugaugggaaaguggaacaa

SEQ ID NO: 734733 - RNA, 64 nt, hsa
gugcauuugauuccagccuugguaauggagaguuugcaaacacacagcggcccacagcuucacg

SEQ ID NO: 734734 - RNA, 64 nt, hsa
gucugaauuuuugggagcaggcaauaucugaaggugcaaacaggcccuacggcuguucccugca

SEQ ID NO: 734735 - RNA, 64 nt, hsa
aaugugacuacauguucuccagauuagccacacaugcaaacaucaguguccuucuagcuuuagc

SEQ ID NO: 734736 - RNA, 64 nt, hsa
gauggacuuccugccagugacagagcaugucuauugcaaacaauucucucaguuacguucagca

SEQ ID NO: 734737 - RNA, 64 nt, hsa
ucuucgaccugcugauccuuggauccugaaucugugcaaacaguaacgugugcgcacgcgcagc

SEQ ID NO: 734738 - RNA, 64 nt, hsa
auuacacacaugcacacacauaugcacacacaugugcaaacauagccacuuuuuugucaagagu

SEQ ID NO: 734739 - RNA, 64 nt, hsa
ggaauaacagauuugccggcaaucacugaaagagugcaaacaucggguccuugugacuucaacg

SEQ ID NO: 734740 - RNA, 64 nt, hsa
cauagcagaugcugcugcugauuaagagaauagaugcaaacaaggcaugcauuuggccaaaaua

SEQ ID NO: 734741 - RNA, 64 nt, hsa
gucucuacucaguuuauaaagcaguuccacaccaugcaaacaaaacucuaacagcaaagguuau

SEQ ID NO: 734742 - RNA, 64 nt, hsa
uggggagagaaaucuuaagucauaaugaauaaagugcaaacagaagugcauccugauuauuuuc

SEQ ID NO: 734743 - RNA, 64 nt, hsa
ugcgacaccucaagguguucucuguagcucaaucugcaaacaugccaggccucagggauccucu

SEQ ID NO: 734744 - RNA, 64 nt, hsa
uccccucucagccgucucaggacuacuguuggauugcaaacagcaucucugacccagucuucgg

SEQ ID NO: 734745 - RNA, 64 nt, hsa
auccugcauguacaauaacugcugccuggcaaacugcaaacaagcagcaucacucaaguuugaa

SEQ ID NO: 734746 - RNA, 64 nt, hsa
auacauuuucuucuggccuaaaugaauauuuaugugcaaacauaggcaacuguuaaaggcugga

SEQ ID NO: 734747 - RNA, 52 nt, hsa
aacgcaacagaaugaucuaaacugcaaacauuuucacacccaccaugcugcu

SEQ ID NO: 734748 - RNA, 64 nt, hsa
ggggaacacgcugcccgcacugcccagagagcagugcaaacaccacaacacgagcguguuucuu

SEQ ID NO: 734749 - RNA, 64 nt, hsa
ggucacccaugcaucuuccacuggaacguuucacugcaaacacaccuuggagaaguggcaucag

SEQ ID NO: 734750 - RNA, 64 nt, hsa
guuuucguuuauuuuaaaacugaauccuuaaacuugcaaacacgccuacuguaagcaugcuugg

SEQ ID NO: 734751 - RNA, 64 nt, hsa
ccuugagggcugugccaauccuagugaaccaaaaugcaaacaacucacacaagugaaaagcucc

SEQ ID NO: 734752 - RNA, 64 nt, hsa
uauaugguaaacaagcacacacaauuuuauccaaugcaaacaaauguagagcaucaguuacaaa

SEQ ID NO: 734753 - RNA, 64 nt, hsa
agucuucagaagaccucgcuuuaaaacaaauuugugcaaacacugcuagagucauuuugaagcu

SEQ ID NO: 734754 - RNA, 64 nt, hsa
ugaaagucagaaggcugucaaacucaaauaucuuugcaaacaguuugaauacugugaauucauu

SEQ ID NO: 734755 - RNA, 64 nt, hsa
uaaagacaggguuucaauuuccacacaugaucucugcaaacaggcacuggguuuucaguguccu

SEQ ID NO: 734756 - RNA, 58 nt, hsa
ggacauucuuacugugcuaaaaagccacugcaaacauagcaauaaaaaccugucauuu

SEQ ID NO: 734757 - RNA, 54 nt, hsa
ugcagugugcccaucaguaaacucugcaaacaaauugcacagguggauuuucuu

SEQ ID NO: 734758 - RNA, 64 nt, hsa
agaaagcuuauuuauuagcgauauaaccuugcuuugcaaacagaaugcaagcguuaacuuuggu

SEQ ID NO: 734759 - RNA, 64 nt, hsa
gaagcaggaccaggccuaggaucuccccagcagaugcaaacaaguguccuccccugaauugugu

SEQ ID NO: 734760 - RNA, 64 nt, hsa
ugcacuuuuaauuuuauauaugacagcauuuaaaugcaaacacuaccaugaauuuaauguauaa

SEQ ID NO: 734761 - RNA, 64 nt, hsa
cgaguagugguuugagugggcaggaagggccauuugcaaacacugcuguguucuagacaaacaa

SEQ ID NO: 734762 - RNA, 64 nt, hsa
gucagccuggauuucuggucuuugguuauuucugugcaaacaaaaggugugccuggcagccauu

SEQ ID NO: 734763 - RNA, 64 nt, hsa
auuuuuaaaucauaccaaaaauaguaagaaaauaugcaaacacucugugaucaaacuuaaaagu

SEQ ID NO: 734764 - RNA, 64 nt, hsa
ucucuuucucauauacauggacucucuguuggccugcaaacacauuuacuucuccucuuaugag

SEQ ID NO: 734765 - RNA, 64 nt, hsa
acaaaacagcaaacuucagguaacuauuuuggauugcaaacaggauaaauuaaauguucaaaca

SEQ ID NO: 734766 - RNA, 64 nt, hsa
acguggaggaaugcucccccauccuccccuucccugcaaacaugggguuggcugggcccagaag

SEQ ID NO: 734767 - RNA, 64 nt, hsa
uuuagagauacuguuguuacuucugcauguucauugcaaacagaagguuccuugagcacccgga

SEQ ID NO: 734768 - RNA, 64 nt, hsa
aagacaaaagaaacuuaccaauugauguuuuacgugcaaacaaccugaaucuuuuuuuuauaua

SEQ ID NO: 734769 - RNA, 64 nt, hsa
uauguguguguauauauauguauuugauucuaccugcaaacaaauuuuuauuggugaggacuau

SEQ ID NO: 734770 - RNA, 64 nt, hsa
ugucuguuccagcuguugugacugcugccauuuuugcaaacaucugcccaauccugggugauca

SEQ ID NO: 734771 - RNA, 64 nt, hsa
ccaggaggggccgcagggcguguaugagcaguuuugcaaacagaacacaaccacaaugauggua

SEQ ID NO: 734772 - RNA, 64 nt, hsa
ccuuccacacuguguaugugaacagcuugggcccugcaaacacaaccaucuacacacaucuaca

SEQ ID NO: 734773 - RNA, 64 nt, hsa
ggcugacccuucuuugggucucaguuucuuucucugcaaacaaguugccaucugguuugccuuc

SEQ ID NO: 734774 - RNA, 64 nt, hsa
ugaaacauuucucuacuucaagaccaccucucccugcaaacaccacacacacauggcaugcaug

SEQ ID NO: 734775 - RNA, 64 nt, hsa
aaguacuguuuguagaggggggcaaagccccaacugcaaacaaagugaaugcccauuaauaggg

SEQ ID NO: 734776 - RNA, 64 nt, hsa
ggaaauagaaagccaggaguggcuguccccaguaugcaaacacaccacggucugcccugcaaaa

SEQ ID NO: 734777 - RNA, 64 nt, hsa
aagggagacuuuccuccgauguuuauuuagcuguugcaaacaucuucacccuaauagucccucc

SEQ ID NO: 734778 - RNA, 64 nt, hsa
caucaguccucugucaguuucccagccagcagauugcaaacauccuagauagccaugcagcuac

SEQ ID NO: 734779 - RNA, 64 nt, hsa
auacuuacaagaauaugauuuuuuuguuuguucaugcaaacagauccuuuacccaauauauauu

SEQ ID NO: 734780 - RNA, 64 nt, hsa
uaaaucgaccuuuaagaauuccugggguggacuuugcaaacacauucuacaaccugaugguuuu

SEQ ID NO: 734781 - RNA, 64 nt, hsa; identical to SEQ ID NO: 55152

SEQ ID NO: 734782 - RNA, 64 nt, hsa; identical to SEQ ID NO: 55153

SEQ ID NO: 734783 - RNA, 63 nt, hsa
agaaaagauuauucaauaaaguuuccugccuuucugcaaacauauuuuugauucuggccuggu

SEQ ID NO: 734784 - RNA, 64 nt, hsa
gguuugccuuaaaggcuuuuaauuuuguuuuguuugcaaacauguuuuaaauuaaauucgggua

SEQ ID NO: 734785 - RNA, 64 nt, hsa
uuugugcuuuucagcuugacacagguuuggaguaugcaaacagcuauaauuuugcaaaaaagga

SEQ ID NO: 734786 - RNA, 64 nt, hsa
cacacacaagcacuugcacauacauacaaacacaugcaaacauaccuacacacacacacacucu

SEQ ID NO: 734787 - RNA, 64 nt, hsa
uaaaaaugauuauauacauuuuccuuaaaacacuugcaaacauuuuauucaguugucuuuagcu

SEQ ID NO: 734788 - RNA, 64 nt, hsa
ucauucuaccacauguuaacccucuagcugauaaugcaaacacuaacugggggauuuuauuuau

SEQ ID NO: 734789 - RNA, 64 nt, hsa
cguuaaacucuauuuuaugguuuugauuucagauugcaaacauguaaaaccugcauagcagcga

SEQ ID NO: 734790 - RNA, 64 nt, hsa
aauuuaauaaauucauaaaaaagacucauaucuuugcaaacaaaagaagggcagauacugggcu

SEQ ID NO: 734791 - RNA, 64 nt, hsa
auacuugaauucuggcugaugguguaaacagcucugcaaacaaucccuuucauaccacaaagcc

SEQ ID NO: 734792 - RNA, 64 nt, hsa
ugcaagcugacagcagagcucaguccccacuuccugcaaacaauggccugcacccuaucccuug

SEQ ID NO: 734793 - RNA, 64 nt, hsa
uugcuacuguaggaguauuuuuaggagcagaaacugcaaacacauuucauugugagguuuuacc

SEQ ID NO: 734794 - RNA, 64 nt, hsa
cugucacccaggcuggaaugacgaagugaaguagugcaaacauagcucacugcagcuuugaccu

SEQ ID NO: 734795 - RNA, 64 nt, hsa
gauggaugguuagaaauguuaaaaacaaagcaaaugcaaacaucucugcuucugcuccucuacu

SEQ ID NO: 734796 - RNA, 64 nt, hsa
ugggauggcaccuauauuggcugauaauugaggaugcaaacauuccauucauuagugugaucga

SEQ ID NO: 734797 - RNA, 64 nt, hsa
uuaauaggaaaaaaagaguaaagcucagugugaaugcaaacauccacaaaauaugaucuucguu

SEQ ID NO: 734798 - RNA, 64 nt, hsa
cacacacuggagagaaaccuaugaauguaaggaaugcaaacaagcauucaauuauuuuucuucc

SEQ ID NO: 734799 - RNA, 64 nt, hsa
agguaagauaauucauauuggaacaaacuacaagugcaaacaauguggcaaaacuuaauuuaug

SEQ ID NO: 734800 - RNA, 64 nt, hsa
augguauuuaacugaguuaacucugucagauugcugcaaacauuucuaaauacuugcucuuggu

SEQ ID NO: 734801 - RNA, 64 nt, hsa
gucaccccuuuuuaagcacccugauucuaccaaaugcaaacacaucugggucugcgauuaugca

SEQ ID NO: 734802 - RNA, 64 nt, hsa
ucuucuccuuauucaccggggaggcugugucuugugcaaacaagucauagaaacuugaugggag

SEQ ID NO: 734803 - RNA, 64 nt, hsa
cccuggggucgugguuugacauuugucugccuggugcaaacaaggaauccuugccuuuaaggug

SEQ ID NO: 734804 - RNA, 64 nt, hsa
uucugccauguaacuggaggaugugcuaugaguuugcaaacagcuggacugucaggcugcuuuu

SEQ ID NO: 734805 - RNA, 64 nt, hsa
gguuuuauugcuguuguuaaccacccaugaggggugcaaacagauaaugcuguuaacauuuuca

SEQ ID NO: 734806 - RNA, 64 nt, hsa
ugaaagaaaucacauaggagauaagccucaugaaugcaaacacaugguaaagccuuaagauguu

SEQ ID NO: 734807 - RNA, 64 nt, hsa
aauauuuauuuuuugagcauguuuccugucugccugcaaacacaugcagacauuuaguuuugau

SEQ ID NO: 734808 - RNA, 64 nt, hsa
uugauuugaaauauguaagaauugaugauguauuugcaaacauuaaugugaaauaaauugaauu

SEQ ID NO: 734809 - RNA, 64 nt, hsa
uuuuuuuuaaggucuauggguuuuguuuuuuacaugcaaacauuguaaauuauacagaagauac

SEQ ID NO: 734810 - RNA, 64 nt, hsa
aaguaaugugugaauauauuuuccuuauaaaagaugcaaacauuacaaaaaggcaaauguaccc

SEQ ID NO: 734811 - RNA, 64 nt, hsa
cuuuaagaucacgccacuggacugucuaugaacuugcaaacaggcugauaccuuugugaaguug

SEQ ID NO: 734812 - RNA, 64 nt, hsa
aaucagaccacauuugaagaaacuccaccuauuuugcaaacaaacuuauucuacugaaauuauc

SEQ ID NO: 734813 - RNA, 64 nt, hsa
cccacccucccuguccccuguuggccaaccugccugcaaacauggagggcauuuggccacagau

SEQ ID NO: 734814 - RNA, 64 nt, hsa
auuugcugaaagagagcacaaaaaugggagaaaaugcaaacaugagcagaaaauauuuucccac

SEQ ID NO: 734815 - RNA, 64 nt, hsa
gugacacccccagaccucuggaggagacaauggaugcaaacagcccacacaggaaagacaaagc

SEQ ID NO: 734816 - RNA, 64 nt, hsa
ccagacaugacaacacacacacuggaaugaaaugugcaaacaugggggugacaccacagagaga

SEQ ID NO: 734817 - RNA, 64 nt, hsa
gaacucacaacccccucucugaccugggggacaaugcaaacaggucacagugcauucccauauu

SEQ ID NO: 734818 - RNA, 64 nt, hsa
augggccuucagauuauuuccaguuuuuugccacugcaaacaauaaacauccuuguacauacua

SEQ ID NO: 734819 - RNA, 64 nt, hsa
gucaucuuuuagaguaaacuauucuauaaacauaugcaaacagcccuaaauaaaucuaaagucu

SEQ ID NO: 734820 - RNA, 64 nt, hsa; identical to SEQ ID NO: 55154

SEQ ID NO: 734821 - RNA, 64 nt, hsa; identical to SEQ ID NO: 55155

SEQ ID NO: 734822 - RNA, 64 nt, hsa
uuuguagcgguuauuuuuguaugaucuaguaacuugcaaacagaccaaauggaugagaggcggg

SEQ ID NO: 734823 - RNA, 64 nt, hsa
ugaguccacacuccccuggagccuggcuggccucugcaaacaaacauaauuuuggggaccuucc

SEQ ID NO: 734824 - RNA, 64 nt, hsa
cuuuguuacagcugggaaagaacaguucugugaaugcaaacaccuccugaguuuugcaauugag

SEQ ID NO: 734825 - RNA, 64 nt, hsa
cccugcuuucuuccuuucucuuuuuauuuuauugugcaaacauuucucaaauauggaaaagaaa

SEQ ID NO: 734826 - RNA, 64 nt, hsa
caggccuguuacacucuccccaaccuccuuggacugcaaacaaucuaggacaccuccaccaaac

SEQ ID NO: 734827 - RNA, 64 nt, hsa
gguuccauuuuuauuucauuuuuauuuuuguuaaugcaaacaggacuuaaaugaacuuugaucu

SEQ ID NO: 734828 - RNA, 64 nt, hsa
uuggcaauguccugagugcaaagugugccagaacugcaaacaaucgggagaagauagcaagaug

SEQ ID NO: 734829 - RNA, 64 nt, hsa
ugauugcuaucuuauuuuuguuauccgagaccuuugcaaacauuggcaaauagcaucaauuacc

SEQ ID NO: 734830 - RNA, 64 nt, hsa
cacacaacuacuuucaugaauuuuuuaaucccauugcaaacauuauuccaagaguaucccagua

SEQ ID NO: 734831 - RNA, 64 nt, hsa
auucucagggcaucugccgagacccugcacaguuugcaaacagcuuuuaccugauuucaccgaa

SEQ ID NO: 734832 - RNA, 64 nt, hsa
uuagaauaaguuuguugcagaacgugacccugcgugcaaacauguaccguggccugguauauga

SEQ ID NO: 734833 - RNA, 64 nt, hsa
gcugacugggucugguccuuaccaacauagacggugcaaacacucuuaacaguguuguuuuugu

SEQ ID NO: 734834 - RNA, 64 nt, hsa
ccccuuggccucugccuccuuggccccacauuucugcaaacauaaauauuuacggauagauugc

SEQ ID NO: 734835 - RNA, 64 nt, hsa
cuugucaguaauuugagaccacuucaaagcccucugcaaacaccccaaaggcagaaucugcuau

SEQ ID NO: 734836 - RNA, 64 nt, hsa
ccugggacuucggguacccacccgcuguucuccaugcaaacaaagcgccagggaaaugacccac

SEQ ID NO: 734837 - RNA, 64 nt, hsa
gauuacaggcgugagccaucgcuuuugacccaaaugcaaacauuuuauuagggggauaaagagg

SEQ ID NO: 734838 - RNA, 64 nt, hsa
ugagcagcagaauaaaagaucuucuuccaagaaaugcaaacagaccguucaccaccaucuccag

SEQ ID NO: 734839 - RNA, 64 nt, hsa; identical to SEQ ID NO: 734838

SEQ ID NO: 734840 - RNA, 64 nt, hsa
ugagccucagaauaaaagaucuucuuccaagaaaugcaaacaggcuguucaccaccaucuccag

SEQ ID NO: 734841 - RNA, 64 nt, hsa
uugucuguucccuaagaaaauauauuuucauuccugcaaacacagugcucagccuucaguuccc

SEQ ID NO: 734842 - RNA, 64 nt, hsa
caauauaggaggcaauaaucuuuuaacaguguuuugcaaacaaacaaaaagagaaaaaucccag

SEQ ID NO: 734843 - RNA, 64 nt, hsa
ccccucuaucagucacugacaguuaacaaaccuuugcaaacauuccccaguuguuuguuccucu

SEQ ID NO: 734844 - RNA, 64 nt, hsa
gggaaucaaugcuguuucacucaaaaguguugcaugcaaacacuucucuuuauucugcauuuau

SEQ ID NO: 734845 - RNA, 64 nt, hsa
aauguugaaauaauagauuaguuggguuuucacaugcaaacauucaaaaugaauacaaaauuaa

SEQ ID NO: 734846 - RNA, 64 nt, hsa
cucucugguguaaucgucuaaaggcaaacauuccugcaaacagguuuuucucagcuucaggcag

SEQ ID NO: 734847 - RNA, 64 nt, hsa
uuuuauaucagcaaaauaacucaauuuugcagauugcaaacaaauauaaaagcuguuucuguuu

SEQ ID NO: 734848 - RNA, 64 nt, hsa
ucaaaggaaagcauaagcaaauuuuccuuuacaaugcaaacaugccacugguggcagcacaugg

SEQ ID NO: 734849 - RNA, 64 nt, hsa
uacuuacucuccgaaaggcaucuaucugugcuauugcaaacacuccuugagauuuuaggggaau

SEQ ID NO: 734850 - RNA, 64 nt, hsa
uggcccaacaauucccagauucugaagcuuggaaugcaaacacaggcuucaugggcuguggccu

SEQ ID NO: 734851 - RNA, 64 nt, hsa
gauacuggcagggcuauguuuguuuaugaugcucugcaaacauuucauauuggccaauaaacag

SEQ ID NO: 734852 - RNA, 64 nt, hsa
ugguuuucuugggggaaaauaccacaaucaccgaugcaaacauuggaagauuauugagagcccu

SEQ ID NO: 734853 - RNA, 64 nt, hsa
agguguaaggaagguaaguuuuuucauagugguaugcaaacauaucauugaaauauuacauaga

SEQ ID NO: 734854 - RNA, 64 nt, hsa
uaaaaaaauaauaaaacuacagacaaaaacaaagugcaaacaacugagacagcaaaugaaugag

SEQ ID NO: 734855 - RNA, 64 nt, hsa
augcaucugucuaacgcaugccucguguucguuuugcaaacaugccugugguggagggugguca

SEQ ID NO: 734856 - RNA, 64 nt, hsa
auuuuacuucuuuuacuuguuuaacuugguuagaugcaaacacguuggaugaguuugaaaggac

SEQ ID NO: 734857 - RNA, 64 nt, hsa; identical to SEQ ID NO: 98025

SEQ ID NO: 734858 - RNA, 64 nt, hsa; identical to SEQ ID NO: 98026

SEQ ID NO: 734859 - RNA, 64 nt, hsa; identical to SEQ ID NO: 98027

SEQ ID NO: 734860 - RNA, 64 nt, hsa; identical to SEQ ID NO: 98028

SEQ ID NO: 734861 - RNA, 64 nt, hsa; identical to SEQ ID NO: 98029

SEQ ID NO: 734862 - RNA, 64 nt, hsa; identical to SEQ ID NO: 98030

SEQ ID NO: 734863 - RNA, 64 nt, hsa; identical to SEQ ID NO: 98031

SEQ ID NO: 734864 - RNA, 64 nt, hsa; identical to SEQ ID NO: 98032

SEQ ID NO: 734865 - RNA, 64 nt, hsa; identical to SEQ ID NO: 98033

SEQ ID NO: 734866 - RNA, 64 nt, hsa; identical to SEQ ID NO: 98034

SEQ ID NO: 734867 - RNA, 64 nt, hsa; identical to SEQ ID NO: 98035

SEQ ID NO: 734868 - RNA, 64 nt, hsa; identical to SEQ ID NO: 98036

SEQ ID NO: 734869 - RNA, 64 nt, hsa; identical to SEQ ID NO: 98037

SEQ ID NO: 734870 - RNA, 64 nt, hsa; identical to SEQ ID NO: 98038

SEQ ID NO: 734871 - RNA, 64 nt, hsa; identical to SEQ ID NO: 98039

SEQ ID NO: 734872 - RNA, 64 nt, hsa; identical to SEQ ID NO: 98040

SEQ ID NO: 734873 - RNA, 64 nt, hsa; identical to SEQ ID NO: 98041

SEQ ID NO: 734874 - RNA, 64 nt, hsa; identical to SEQ ID NO: 98042

SEQ ID NO: 734875 - RNA, 64 nt, hsa; identical to SEQ ID NO: 98043

SEQ ID NO: 734876 - RNA, 64 nt, hsa; identical to SEQ ID NO: 98044

SEQ ID NO: 734877 - RNA, 64 nt, hsa; identical to SEQ ID NO: 98045

SEQ ID NO: 734878 - RNA, 64 nt, hsa; identical to SEQ ID NO: 98046

SEQ ID NO: 734879 - RNA, 64 nt, hsa; identical to SEQ ID NO: 98047

SEQ ID NO: 734880 - RNA, 64 nt, hsa; identical to SEQ ID NO: 98048

SEQ ID NO: 734881 - RNA, 64 nt, hsa; identical to SEQ ID NO: 98049

SEQ ID NO: 734882 - RNA, 64 nt, hsa; identical to SEQ ID NO: 98050

SEQ ID NO: 734883 - RNA, 64 nt, hsa; identical to SEQ ID NO: 98051

SEQ ID NO: 734884 - RNA, 64 nt, hsa; identical to SEQ ID NO: 98052

SEQ ID NO: 734885 - RNA, 64 nt, hsa; identical to SEQ ID NO: 98053

SEQ ID NO: 734886 - RNA, 64 nt, hsa; identical to SEQ ID NO: 98054

SEQ ID NO: 734887 - RNA, 63 nt, hsa
gaaaacaacuguuacaguuuuauugcucugaguaacugacaaagcagaaacuauucaguuuuu

SEQ ID NO: 734888 - RNA, 63 nt, hsa
gggcuguggugaauggaugaacguacaucguaaaacugacaaaauauuuuaaaaauauauaaa

SEQ ID NO: 734889 - RNA, 63 nt, hsa
uaagaaggaaaagaagaagagaugacaaaccauaacugacaagagaggcgucugcugucucau

SEQ ID NO: 734890 - RNA, 63 nt, hsa
uagauguauuacuuggaaaguucugcuuugacaaacugacaaagucuaaaugagcacauguau

SEQ ID NO: 734891 - RNA, 63 nt, hsa
aucauuauguuuuauuacuuuccaauuaccuguaacugacagaccaaauuaauuggcuuugug

SEQ ID NO: 734892 - RNA, 63 nt, hsa
uccaguuuaguuucuucuggacuuuccuuacuuaacugacaguuaccuuuuaaaauuugcaca

SEQ ID NO: 734893 - RNA, 63 nt, hsa
uuaaaguacaagccaaaugauuuucauugguggaacugacacaaaaaaaguaacuuaaaaaca

SEQ ID NO: 734894 - RNA, 63 nt, hsa
gcgggucugggcgucugcaccuggggccuagggaacugacacgugggaagcgcagugagccgg

SEQ ID NO: 734895 - RNA, 63 nt, hsa
aaaaugguuuaaauaccccacagcaaauagaguaacugacaaaccaccaaaaacugaaacccc

SEQ ID NO: 734896 - RNA, 63 nt, hsa
gugcagaccccaaccucccugacuuccuucaguaacugacaguguagcauuguucuugauuag

SEQ ID NO: 734897 - RNA, 63 nt, hsa
uuuacccaaaaucacacagcucagaagcagcagaacugacauugggacccagguccauuggag

SEQ ID NO: 734898 - RNA, 64 nt, hsa; identical to SEQ ID NO: 264315

SEQ ID NO: 734899 - RNA, 64 nt, hsa; identical to SEQ ID NO: 264316

SEQ ID NO: 734900 - RNA, 64 nt, hsa; identical to SEQ ID NO: 264317

SEQ ID NO: 734901 - RNA, 64 nt, hsa; identical to SEQ ID NO: 264318

SEQ ID NO: 734902 - RNA, 64 nt, hsa; identical to SEQ ID NO: 264319

SEQ ID NO: 734903 - RNA, 64 nt, hsa; identical to SEQ ID NO: 264320

SEQ ID NO: 734904 - RNA, 64 nt, hsa; identical to SEQ ID NO: 264321

SEQ ID NO: 734905 - RNA, 64 nt, hsa; identical to SEQ ID NO: 264322

SEQ ID NO: 734906 - RNA, 60 nt, hsa
gccaaacagcccugagaaaagcuggggaaacagucugagcuggaguccgagagugguugg

SEQ ID NO: 734907 - RNA, 60 nt, hsa
ucacuuaggcaaagcauuauucauucccaucagucugaagcccgaaggacuguuuuguau

SEQ ID NO: 734908 - RNA, 60 nt, hsa
aucuccuggccgagagcagccacugccacucagucugacagcuugcgacugcaucuguau

SEQ ID NO: 734909 - RNA, 60 nt, hsa
cagcuuuggcuucugguguggucaauauuucagucugacauagguuuuguuuguagugaa

SEQ ID NO: 734910 - RNA, 60 nt, hsa
uccucugccugcuaacaagcccacguggaccagucugaaugucuuuccuuuacaccuaug

SEQ ID NO: 734911 - RNA, 60 nt, hsa
caucuaaaaacucuucaaacuccacuuguucagucugaaaugcagcucccuguccaagug

SEQ ID NO: 734912 - RNA, 60 nt, hsa
ugcgcugggacggcccaucuuggcaagguucagucugaauggcauggagaccgggagaua

SEQ ID NO: 734913 - RNA, 60 nt, hsa
uguuuuuccguggauuuggcgagaccagagcagucugaaggauuccccaccuccaauccc

SEQ ID NO: 734914 - RNA, 60 nt, hsa
ggggacccagacugccuucaucucugauggcagucugaucacuguggccacugugcgagc

SEQ ID NO: 734915 - RNA, 60 nt, hsa
ccugguuuccuagccguuccccuucugccccagucugagccagugagggguagcuuuuua

SEQ ID NO: 734916 - RNA, 60 nt, hsa
cuccauucuccagucugaacaguucagcuacagucugacucuggacaggggguuucuguu

SEQ ID NO: 734917 - RNA, 60 nt, hsa
aggggugcgcccacagccugcuccauucuccagucugaacaguucagcuacagucugacu

SEQ ID NO: 734918 - RNA, 60 nt, hsa
uuuuuuggcacuaggucauuaaguagcacacagucugaaugcccuuuucuggaguggcca

SEQ ID NO: 734919 - RNA, 60 nt, hsa
ucgcacugacuguggcgcacuggggaauaacagucugagcuagcaccacccucagccagg

SEQ ID NO: 734920 - RNA, 60 nt, hsa
ccagcuagaaggagggucagggauuuuuuacagucugagaaugagugugugugagugagg

SEQ ID NO: 734921 - RNA, 60 nt, hsa
gaaaacgcccucuccugacuuguauuguggcagucugaacgcccccagaaaauugugcca

SEQ ID NO: 734922 - RNA, 60 nt, hsa
uagagacucaggaaagacaguggcauaaugcagucugaguccaaaggccagguaaccuug

SEQ ID NO: 734923 - RNA, 60 nt, hsa
ggaacaaaguaaaguaggguaagggaaugccagucugaggaguuagaaguuaccguuuua

SEQ ID NO: 734924 - RNA, 64 nt, hsa; identical to SEQ ID NO: 81719

SEQ ID NO: 734925 - RNA, 64 nt, hsa; identical to SEQ ID NO: 81720

SEQ ID NO: 734926 - RNA, 64 nt, hsa; identical to SEQ ID NO: 81721

SEQ ID NO: 734927 - RNA, 64 nt, hsa; identical to SEQ ID NO: 81722

SEQ ID NO: 734928 - RNA, 64 nt, hsa; identical to SEQ ID NO: 81723

SEQ ID NO: 734929 - RNA, 64 nt, hsa; identical to SEQ ID NO: 81724

SEQ ID NO: 734930 - RNA, 64 nt, hsa; identical to SEQ ID NO: 81725

SEQ ID NO: 734931 - RNA, 64 nt, hsa; identical to SEQ ID NO: 81726

SEQ ID NO: 734932 - RNA, 64 nt, hsa; identical to SEQ ID NO: 81727

SEQ ID NO: 734933 - RNA, 64 nt, hsa; identical to SEQ ID NO: 81728

SEQ ID NO: 734934 - RNA, 64 nt, hsa; identical to SEQ ID NO: 81729

SEQ ID NO: 734935 - RNA, 64 nt, hsa; identical to SEQ ID NO: 81730

SEQ ID NO: 734936 - RNA, 64 nt, hsa; identical to SEQ ID NO: 81731

SEQ ID NO: 734937 - RNA, 64 nt, hsa; identical to SEQ ID NO: 81732

SEQ ID NO: 734938 - RNA, 64 nt, hsa; identical to SEQ ID NO: 81733

SEQ ID NO: 734939 - RNA, 64 nt, hsa; identical to SEQ ID NO: 81734

SEQ ID NO: 734940 - RNA, 64 nt, hsa; identical to SEQ ID NO: 522646

SEQ ID NO: 734941 - RNA, 64 nt, hsa; identical to SEQ ID NO: 522647

SEQ ID NO: 734942 - RNA, 64 nt, hsa; identical to SEQ ID NO: 522648

SEQ ID NO: 734943 - RNA, 64 nt, hsa; identical to SEQ ID NO: 522649

SEQ ID NO: 734944 - RNA, 64 nt, hsa; identical to SEQ ID NO: 522650

SEQ ID NO: 734945 - RNA, 64 nt, hsa; identical to SEQ ID NO: 522651

SEQ ID NO: 734946 - RNA, 64 nt, hsa; identical to SEQ ID NO: 522652

SEQ ID NO: 734947 - RNA, 64 nt, hsa; identical to SEQ ID NO: 522653

SEQ ID NO: 734948 - RNA, 64 nt, hsa; identical to SEQ ID NO: 522654

SEQ ID NO: 734949 - RNA, 64 nt, hsa; identical to SEQ ID NO: 522655

SEQ ID NO: 734950 - RNA, 64 nt, hsa; identical to SEQ ID NO: 522656

SEQ ID NO: 734951 - RNA, 64 nt, hsa; identical to SEQ ID NO: 522657

SEQ ID NO: 734952 - RNA, 64 nt, hsa; identical to SEQ ID NO: 522658

SEQ ID NO: 734953 - RNA, 64 nt, hsa; identical to SEQ ID NO: 522659

SEQ ID NO: 734954 - RNA, 64 nt, hsa; identical to SEQ ID NO: 522660

SEQ ID NO: 734955 - RNA, 64 nt, hsa; identical to SEQ ID NO: 522661

SEQ ID NO: 734956 - RNA, 64 nt, hsa; identical to SEQ ID NO: 113667

SEQ ID NO: 734957 - RNA, 64 nt, hsa; identical to SEQ ID NO: 113668

SEQ ID NO: 734958 - RNA, 64 nt, hsa; identical to SEQ ID NO: 113669

SEQ ID NO: 734959 - RNA, 64 nt, hsa; identical to SEQ ID NO: 113670

SEQ ID NO: 734960 - RNA, 64 nt, hsa; identical to SEQ ID NO: 113671

SEQ ID NO: 734961 - RNA, 64 nt, hsa; identical to SEQ ID NO: 113672

SEQ ID NO: 734962 - RNA, 64 nt, hsa; identical to SEQ ID NO: 113673

SEQ ID NO: 734963 - RNA, 64 nt, hsa; identical to SEQ ID NO: 113674

SEQ ID NO: 734964 - RNA, 64 nt, hsa; identical to SEQ ID NO: 113675

SEQ ID NO: 734965 - RNA, 64 nt, hsa; identical to SEQ ID NO: 113676

SEQ ID NO: 734966 - RNA, 64 nt, hsa; identical to SEQ ID NO: 113677

SEQ ID NO: 734967 - RNA, 64 nt, hsa; identical to SEQ ID NO: 113678

SEQ ID NO: 734968 - RNA, 64 nt, hsa; identical to SEQ ID NO: 113679

SEQ ID NO: 734969 - RNA, 64 nt, hsa; identical to SEQ ID NO: 113680

SEQ ID NO: 734970 - RNA, 64 nt, hsa; identical to SEQ ID NO: 113681

SEQ ID NO: 734971 - RNA, 64 nt, hsa; identical to SEQ ID NO: 113682

SEQ ID NO: 734972 - RNA, 64 nt, hsa; identical to SEQ ID NO: 113683

SEQ ID NO: 734973 - RNA, 64 nt, hsa; identical to SEQ ID NO: 113684

SEQ ID NO: 734974 - RNA, 64 nt, hsa; identical to SEQ ID NO: 113685

SEQ ID NO: 734975 - RNA, 64 nt, hsa; identical to SEQ ID NO: 113686

SEQ ID NO: 734976 - RNA, 64 nt, hsa; identical to SEQ ID NO: 113687

SEQ ID NO: 734977 - RNA, 64 nt, hsa; identical to SEQ ID NO: 113688

SEQ ID NO: 734978 - RNA, 64 nt, hsa; identical to SEQ ID NO: 113689

SEQ ID NO: 734979 - RNA, 62 nt, hsa; identical to SEQ ID NO: 113690

SEQ ID NO: 734980 - RNA, 64 nt, hsa; identical to SEQ ID NO: 113691

SEQ ID NO: 734981 - RNA, 59 nt, hsa; identical to SEQ ID NO: 113692

SEQ ID NO: 734982 - RNA, 64 nt, hsa; identical to SEQ ID NO: 113693

SEQ ID NO: 734983 - RNA, 64 nt, hsa; identical to SEQ ID NO: 113694

SEQ ID NO: 734984 - RNA, 64 nt, hsa; identical to SEQ ID NO: 113695

SEQ ID NO: 734985 - RNA, 64 nt, hsa; identical to SEQ ID NO: 113696

SEQ ID NO: 734986 - RNA, 64 nt, hsa; identical to SEQ ID NO: 113697

SEQ ID NO: 734987 - RNA, 64 nt, hsa; identical to SEQ ID NO: 113698

SEQ ID NO: 734988 - RNA, 64 nt, hsa; identical to SEQ ID NO: 113699

SEQ ID NO: 734989 - RNA, 64 nt, hsa; identical to SEQ ID NO: 113700

SEQ ID NO: 734990 - RNA, 64 nt, hsa; identical to SEQ ID NO: 113701

SEQ ID NO: 734991 - RNA, 64 nt, hsa; identical to SEQ ID NO: 113702

SEQ ID NO: 734992 - RNA, 64 nt, hsa; identical to SEQ ID NO: 113703

SEQ ID NO: 734993 - RNA, 64 nt, hsa; identical to SEQ ID NO: 113704

SEQ ID NO: 734994 - RNA, 64 nt, hsa; identical to SEQ ID NO: 113705

SEQ ID NO: 734995 - RNA, 64 nt, hsa; identical to SEQ ID NO: 113706

SEQ ID NO: 734996 - RNA, 64 nt, hsa; identical to SEQ ID NO: 113707

SEQ ID NO: 734997 - RNA, 64 nt, hsa; identical to SEQ ID NO: 113708

SEQ ID NO: 734998 - RNA, 64 nt, hsa; identical to SEQ ID NO: 113709

SEQ ID NO: 734999 - RNA, 64 nt, hsa; identical to SEQ ID NO: 113710

SEQ ID NO: 735000 - RNA, 64 nt, hsa; identical to SEQ ID NO: 113711

SEQ ID NO: 735001 - RNA, 64 nt, hsa; identical to SEQ ID NO: 113712

SEQ ID NO: 735002 - RNA, 64 nt, hsa; identical to SEQ ID NO: 113713

SEQ ID NO: 735003 - RNA, 64 nt, hsa; identical to SEQ ID NO: 113714

SEQ ID NO: 735004 - RNA, 64 nt, hsa; identical to SEQ ID NO: 113715

SEQ ID NO: 735005 - RNA, 64 nt, hsa; identical to SEQ ID NO: 113716

SEQ ID NO: 735006 - RNA, 64 nt, hsa; identical to SEQ ID NO: 113717

SEQ ID NO: 735007 - RNA, 64 nt, hsa; identical to SEQ ID NO: 113718

SEQ ID NO: 735008 - RNA, 64 nt, hsa; identical to SEQ ID NO: 113719

SEQ ID NO: 735009 - RNA, 64 nt, hsa; identical to SEQ ID NO: 113720

SEQ ID NO: 735010 - RNA, 64 nt, hsa; identical to SEQ ID NO: 113721

SEQ ID NO: 735011 - RNA, 64 nt, hsa; identical to SEQ ID NO: 113722

SEQ ID NO: 735012 - RNA, 64 nt, hsa; identical to SEQ ID NO: 113723

SEQ ID NO: 735013 - RNA, 64 nt, hsa; identical to SEQ ID NO: 113724

SEQ ID NO: 735014 - RNA, 64 nt, hsa; identical to SEQ ID NO: 113725

SEQ ID NO: 735015 - RNA, 64 nt, hsa; identical to SEQ ID NO: 113726

SEQ ID NO: 735016 - RNA, 64 nt, hsa; identical to SEQ ID NO: 113727

SEQ ID NO: 735017 - RNA, 64 nt, hsa; identical to SEQ ID NO: 113728

SEQ ID NO: 735018 - RNA, 64 nt, hsa; identical to SEQ ID NO: 113729

SEQ ID NO: 735019 - RNA, 64 nt, hsa; identical to SEQ ID NO: 113730

SEQ ID NO: 735020 - RNA, 64 nt, hsa; identical to SEQ ID NO: 113731

SEQ ID NO: 735021 - RNA, 64 nt, hsa; identical to SEQ ID NO: 113732

SEQ ID NO: 735022 - RNA, 64 nt, hsa; identical to SEQ ID NO: 113733

SEQ ID NO: 735023 - RNA, 64 nt, hsa; identical to SEQ ID NO: 113734

SEQ ID NO: 735024 - RNA, 64 nt, hsa; identical to SEQ ID NO: 113735

SEQ ID NO: 735025 - RNA, 64 nt, hsa; identical to SEQ ID NO: 113736

SEQ ID NO: 735026 - RNA, 64 nt, hsa; identical to SEQ ID NO: 113737

SEQ ID NO: 735027 - RNA, 64 nt, hsa; identical to SEQ ID NO: 113738

SEQ ID NO: 735028 - RNA, 64 nt, hsa; identical to SEQ ID NO: 113739

SEQ ID NO: 735029 - RNA, 64 nt, hsa; identical to SEQ ID NO: 113740

SEQ ID NO: 735030 - RNA, 64 nt, hsa; identical to SEQ ID NO: 113741

SEQ ID NO: 735031 - RNA, 64 nt, hsa; identical to SEQ ID NO: 113742

SEQ ID NO: 735032 - RNA, 64 nt, hsa; identical to SEQ ID NO: 113743

SEQ ID NO: 735033 - RNA, 64 nt, hsa; identical to SEQ ID NO: 113744

SEQ ID NO: 735034 - RNA, 64 nt, hsa; identical to SEQ ID NO: 113745

SEQ ID NO: 735035 - RNA, 64 nt, hsa; identical to SEQ ID NO: 113746

SEQ ID NO: 735036 - RNA, 64 nt, hsa; identical to SEQ ID NO: 113747

SEQ ID NO: 735037 - RNA, 64 nt, hsa; identical to SEQ ID NO: 113748

SEQ ID NO: 735038 - RNA, 64 nt, hsa; identical to SEQ ID NO: 113749

SEQ ID NO: 735039 - RNA, 64 nt, hsa; identical to SEQ ID NO: 113750

SEQ ID NO: 735040 - RNA, 64 nt, hsa; identical to SEQ ID NO: 113751

SEQ ID NO: 735041 - RNA, 64 nt, hsa; identical to SEQ ID NO: 113752

SEQ ID NO: 735042 - RNA, 64 nt, hsa; identical to SEQ ID NO: 113753

SEQ ID NO: 735043 - RNA, 64 nt, hsa; identical to SEQ ID NO: 113754

SEQ ID NO: 735044 - RNA, 64 nt, hsa; identical to SEQ ID NO: 113755

SEQ ID NO: 735045 - RNA, 64 nt, hsa; identical to SEQ ID NO: 113756

SEQ ID NO: 735046 - RNA, 64 nt, hsa; identical to SEQ ID NO: 113757

SEQ ID NO: 735047 - RNA, 64 nt, hsa; identical to SEQ ID NO: 113758

SEQ ID NO: 735048 - RNA, 64 nt, hsa; identical to SEQ ID NO: 113759

SEQ ID NO: 735049 - RNA, 64 nt, hsa; identical to SEQ ID NO: 113760

SEQ ID NO: 735050 - RNA, 64 nt, hsa; identical to SEQ ID NO: 113761

SEQ ID NO: 735051 - RNA, 64 nt, hsa; identical to SEQ ID NO: 113762

SEQ ID NO: 735052 - RNA, 64 nt, hsa; identical to SEQ ID NO: 113763

SEQ ID NO: 735053 - RNA, 64 nt, hsa; identical to SEQ ID NO: 113764

SEQ ID NO: 735054 - RNA, 61 nt, hsa; identical to SEQ ID NO: 113765

SEQ ID NO: 735055 - RNA, 64 nt, hsa; identical to SEQ ID NO: 113766

SEQ ID NO: 735056 - RNA, 64 nt, hsa; identical to SEQ ID NO: 113767

SEQ ID NO: 735057 - RNA, 64 nt, hsa; identical to SEQ ID NO: 113768

SEQ ID NO: 735058 - RNA, 64 nt, hsa; identical to SEQ ID NO: 113769

SEQ ID NO: 735059 - RNA, 64 nt, hsa; identical to SEQ ID NO: 113770

SEQ ID NO: 735060 - RNA, 64 nt, hsa; identical to SEQ ID NO: 113771

SEQ ID NO: 735061 - RNA, 64 nt, hsa; identical to SEQ ID NO: 113772

SEQ ID NO: 735062 - RNA, 64 nt, hsa; identical to SEQ ID NO: 113773

SEQ ID NO: 735063 - RNA, 64 nt, hsa; identical to SEQ ID NO: 113774

SEQ ID NO: 735064 - RNA, 64 nt, hsa; identical to SEQ ID NO: 113775

SEQ ID NO: 735065 - RNA, 64 nt, hsa; identical to SEQ ID NO: 113776

SEQ ID NO: 735066 - RNA, 64 nt, hsa; identical to SEQ ID NO: 113777

SEQ ID NO: 735067 - RNA, 64 nt, hsa; identical to SEQ ID NO: 113778

SEQ ID NO: 735068 - RNA, 64 nt, hsa; identical to SEQ ID NO: 113779

SEQ ID NO: 735069 - RNA, 64 nt, hsa; identical to SEQ ID NO: 113780

SEQ ID NO: 735070 - RNA, 64 nt, hsa; identical to SEQ ID NO: 113781

SEQ ID NO: 735071 - RNA, 64 nt, hsa; identical to SEQ ID NO: 113782

SEQ ID NO: 735072 - RNA, 64 nt, hsa; identical to SEQ ID NO: 113783

SEQ ID NO: 735073 - RNA, 64 nt, hsa; identical to SEQ ID NO: 113784

SEQ ID NO: 735074 - RNA, 64 nt, hsa; identical to SEQ ID NO: 113785

SEQ ID NO: 735075 - RNA, 64 nt, hsa; identical to SEQ ID NO: 113786

SEQ ID NO: 735076 - RNA, 64 nt, hsa; identical to SEQ ID NO: 113787

SEQ ID NO: 735077 - RNA, 64 nt, hsa; identical to SEQ ID NO: 113788

SEQ ID NO: 735078 - RNA, 64 nt, hsa; identical to SEQ ID NO: 113789

SEQ ID NO: 735079 - RNA, 64 nt, hsa; identical to SEQ ID NO: 113790

SEQ ID NO: 735080 - RNA, 64 nt, hsa; identical to SEQ ID NO: 113791

SEQ ID NO: 735081 - RNA, 64 nt, hsa; identical to SEQ ID NO: 113792

SEQ ID NO: 735082 - RNA, 64 nt, hsa; identical to SEQ ID NO: 113793

SEQ ID NO: 735083 - RNA, 64 nt, hsa; identical to SEQ ID NO: 113794

SEQ ID NO: 735084 - RNA, 64 nt, hsa; identical to SEQ ID NO: 113795

SEQ ID NO: 735085 - RNA, 64 nt, hsa; identical to SEQ ID NO: 113796

SEQ ID NO: 735086 - RNA, 64 nt, hsa; identical to SEQ ID NO: 113797

SEQ ID NO: 735087 - RNA, 64 nt, hsa; identical to SEQ ID NO: 113798

SEQ ID NO: 735088 - RNA, 64 nt, hsa; identical to SEQ ID NO: 113799

SEQ ID NO: 735089 - RNA, 64 nt, hsa; identical to SEQ ID NO: 113800

SEQ ID NO: 735090 - RNA, 64 nt, hsa; identical to SEQ ID NO: 113801

SEQ ID NO: 735091 - RNA, 64 nt, hsa; identical to SEQ ID NO: 113802

SEQ ID NO: 735092 - RNA, 64 nt, hsa; identical to SEQ ID NO: 113803

SEQ ID NO: 735093 - RNA, 64 nt, hsa; identical to SEQ ID NO: 113804

SEQ ID NO: 735094 - RNA, 64 nt, hsa; identical to SEQ ID NO: 113805

SEQ ID NO: 735095 - RNA, 64 nt, hsa; identical to SEQ ID NO: 113806

SEQ ID NO: 735096 - RNA, 64 nt, hsa; identical to SEQ ID NO: 113807

SEQ ID NO: 735097 - RNA, 64 nt, hsa; identical to SEQ ID NO: 113808

SEQ ID NO: 735098 - RNA, 64 nt, hsa; identical to SEQ ID NO: 113809

SEQ ID NO: 735099 - RNA, 64 nt, hsa; identical to SEQ ID NO: 113810

SEQ ID NO: 735100 - RNA, 64 nt, hsa; identical to SEQ ID NO: 113811

SEQ ID NO: 735101 - RNA, 64 nt, hsa
gucauaccacuagucucuguccuauaccccaugaaauguaaauacuguaucauaaguagaagaa

SEQ ID NO: 735102 - RNA, 64 nt, hsa
uuuuguuuucuaaaaaugcauuuugagauaguuuaauguaaaucugacaggagcauucugaagc

SEQ ID NO: 735103 - RNA, 64 nt, hsa
uuccacgcuucccucaguucaccaaaguuaccaaaauguaaaauaaaauaagacuggcucaggu

SEQ ID NO: 735104 - RNA, 64 nt, hsa
caaaaucuuuccaaauguucugguaucuuugaaaaauguaaauaguuuauuuauagagaacccu

SEQ ID NO: 735105 - RNA, 64 nt, hsa
uaaacugaaauaugucaugugaaauuauuuuaaaaauguaaaaacaaaacuuucugcuaacaaa

SEQ ID NO: 735106 - RNA, 64 nt, hsa
augcauuaggcuuuggaaauuuaauguuaguugaaauguaaaaugugaaaacuuuagaucauuu

SEQ ID NO: 735107 - RNA, 64 nt, hsa
guuugggacagcaccugguauagaauaaauaauaaauguaaacuauuauuuuugguuaucaugu

SEQ ID NO: 735108 - RNA, 64 nt, hsa
uuuuuuuuuuuuuaaugaaggcucauuuacuugaaauguaaaaacuuucacugaauacaaauag

SEQ ID NO: 735109 - RNA, 64 nt, hsa
aaaguuuguuuucuaaaauguaaauauuugccacaauguaaagcaaaucuuagcuauauuuuaa

SEQ ID NO: 735110 - RNA, 64 nt, hsa
auuauguugacuaaauacaaaguuuguuuucuaaaauguaaauauuugccacaauguaaagcaa

SEQ ID NO: 735111 - RNA, 64 nt, hsa
augacacagaacuuuguacuuuucagcucuuaaaaauguaaauguuacauguauauuacuuggc

SEQ ID NO: 735112 - RNA, 64 nt, hsa
gggaaggaagaaaaaacggcuuucauuaccaaauaauguaaaaccucaaaagcaagggcuucaa

SEQ ID NO: 735113 - RNA, 64 nt, hsa
uuuaaagaaauauguuguuucuugucuguaauguaauguaaaggguggaaaggccucaagcuca

SEQ ID NO: 735114 - RNA, 64 nt, hsa
ggccaacuccaauauaggguggguaaggccuuauaauguaaagagcauauaauguaaagggcuu

SEQ ID NO: 735115 - RNA, 64 nt, hsa
ggguggguaaggccuuauaauguaaagagcauauaauguaaagggcuuuagagugagacagacc

SEQ ID NO: 735116 - RNA, 64 nt, hsa
gggcuaacuucgggaucccugcacuuuauguaagaauguaaaccuggagucucauuuaagaaug

SEQ ID NO: 735117 - RNA, 64 nt, hsa
aauguacauuuagagguuaaaagaaacagugagaaauguaaacauucaaaaugauaauugaauc

SEQ ID NO: 735118 - RNA, 64 nt, hsa
uaugaauaccgcagggcagccuucuuaaaugacaaauguaaaaaaaaaaaaaaaaaagacucua

SEQ ID NO: 735119 - RNA, 64 nt, hsa
cagaauguaugguaggaauguauucucuuguaggaauguaaaucuguauuaaaaggggguccaa

SEQ ID NO: 735120 - RNA, 64 nt, hsa
auugaaaaauauaaagguauccaaacucugucuuaauguaaauguaacuauuuuuccuucaagu

SEQ ID NO: 735121 - RNA, 64 nt, hsa
cucacaccuucuguuccccuccuggccugugcagaauguaaacagcagacucauacucaauggg

SEQ ID NO: 735122 - RNA, 64 nt, hsa
gagauuuuuaugccugugacuuccuuggaaaucaaauguaaaguuuaauugaaagaauguaaag

SEQ ID NO: 735123 - RNA, 64 nt, hsa
uccuuggaaaucaaauguaaaguuuaauugaaagaauguaaagcaaccaaaaagaaaaaaaaaa

SEQ ID NO: 735124 - RNA, 64 nt, hsa
aacuuagcuaaguuuuguuuuguuuuucagcguuaauguaaaggggcagcagugccaaaauaua

SEQ ID NO: 735125 - RNA, 64 nt, hsa
ucuaugcuuguaacugucuucuagcagugagccaaauguaaaauagugaauaaagucauuauua

SEQ ID NO: 735126 - RNA, 64 nt, hsa
uaaauguguaaaagaaaaaugcagagguuauuaaaauguaaagaaguaacaaucuuuggauuug

SEQ ID NO: 735127 - RNA, 64 nt, hsa
accaaauaaagccauuuauucuguuuucugggauaauguaaacaugccucugccuuuuccuuca

SEQ ID NO: 735128 - RNA, 64 nt, hsa
aagacuaaguuauuuacauguccauuguaaaugcaauguaaaugagaguucugauaaaauauuu

SEQ ID NO: 735129 - RNA, 64 nt, hsa
ugggaucagggaaugggagaagaugggagcuaagaauguaaagucagaaacuugcacuguuuua

SEQ ID NO: 735130 - RNA, 63 nt, hsa
auaagaaaauucauacuugagagaaauccuacaaauguaaagaauguggcaaaccuuuggaug

SEQ ID NO: 735131 - RNA, 64 nt, hsa
cagaagaaaauuauuacuggagauaaacccugcaaauguaaagaguguaacaaaaccuuuaaac

SEQ ID NO: 735132 - RNA, 64 nt, hsa
auauaagaauucauccuagauauaaaaccauagaaauguaaaagaugugacaaaaccuuuaagc

SEQ ID NO: 735133 - RNA, 64 nt, hsa
acuuuaauacagcucaguaaauggcuucuucuagaauguaaaguuauguauuuaaaguuguauc

SEQ ID NO: 735134 - RNA, 64 nt, hsa
accgcacguagcauuuacauuagguauuacaaguaauguaaagaugauuuaaguauacaggagg

SEQ ID NO: 735135 - RNA, 64 nt, hsa
caaauuuauguagcuauguggaaugauaugucauaauguaaaauuagauaaauucuuuuuucuu

SEQ ID NO: 735136 - RNA, 64 nt, hsa
auauaauguacauaaauguuacauuuguaaagaaaauguaaaaauguaacuauagcauaugaau

SEQ ID NO: 735137 - RNA, 64 nt, hsa
gaauuuuguaucuccuuugauaaaaaguguguauaauguaaaguaguuuugcauauucuugugc

SEQ ID NO: 735138 - RNA, 64 nt, hsa
uugguuuuauaauguuugucaccagauuuuuauuaauguaaaaaaaaucaauuuuuaaaaaaua

SEQ ID NO: 735139 - RNA, 64 nt, hsa
uaaugguaggaauguuaauguaaauaguggugguaauguaaaaucauuucauuuaucauucaug

SEQ ID NO: 735140 - RNA, 64 nt, hsa
uuuuauuuuggagacggcuaaugguaggaauguuaauguaaauaguggugguaauguaaaauca

SEQ ID NO: 735141 - RNA, 64 nt, hsa
gugagaaaagaauagaagugaaauuugcauaaugaauguaaaagggaaauaaaagucuuuugaa

SEQ ID NO: 735142 - RNA, 64 nt, hsa
gaacuauuguucucugaaugacaguuguaagagaaauguaaauuuuuuagaacucuuugcuguu

SEQ ID NO: 735143 - RNA, 64 nt, hsa
aaaauaagcaaagaccacacauuuuuuacuacaaaauguaaaggauaaauguaaauccugcaua

SEQ ID NO: 735144 - RNA, 64 nt, hsa
accacacauuuuuuacuacaaaauguaaaggauaaauguaaauccugcauaacuaaaaucacaa

SEQ ID NO: 735145 - RNA, 64 nt, hsa
ccagugaagagccuaugugcauuuuguaguagauaauguaaaauuugucaucuuuuucuuuucu

SEQ ID NO: 735146 - RNA, 64 nt, hsa
aauaauaugaaagaccuaguuaaaaauucuaaccaauguaaaaugaccauuuuucuguugcauu

SEQ ID NO: 735147 - RNA, 64 nt, hsa
aaagccagccuguuuucagaguaugauguccuuuaauguaaacucaaauaucaauauuuuaaau

SEQ ID NO: 735148 - RNA, 64 nt, hsa
ucaaaaauagaaaaaaaaaaaaaaagaaaaaaagaauguaaaauuuuaaaaauacaguuuaaca

SEQ ID NO: 735149 - RNA, 64 nt, hsa
guuuauuuucucuuaaacaauuuuuaaaauucagaauguaaaaauuggguaaauuuacuacuga

SEQ ID NO: 735150 - RNA, 64 nt, hsa
uguaguuacagaguaauuacauggugauuuuugcaauguaaaauaaaguguuucugauuauuuu

SEQ ID NO: 735151 - RNA, 64 nt, hsa
cuaaagaaaagaaucagaaaucaaucuuucuacuaauguaaauuugagauuauuuuuaaaaaug

SEQ ID NO: 735152 - RNA, 64 nt, hsa
ucuaaaaaccuaugaguauuuaauucauagaaaaaauguaaaaggucuuuuuaaaaaucaugaa

SEQ ID NO: 735153 - RNA, 64 nt, hsa
ugaauuuucuuuuaaaaacagucacugaguuaauaauguaaauaaguguguggccuucuuuaaa

SEQ ID NO: 735154 - RNA, 64 nt, hsa
uauauauauuaaguuuaauuuuuucaguuuuuuuaauguaaaagcaagugaaauuuuaauaaac

SEQ ID NO: 735155 - RNA, 64 nt, hsa
gccggaacugccuugggaccacaguuacagaaaaaauguaaacucagagugauccuuguguaua

SEQ ID NO: 735156 - RNA, 64 nt, hsa
caacuagacaaagaaaaaauuguuguuuuaauggaauguaaaccugaaauuggugugucugcaa

SEQ ID NO: 735157 - RNA, 64 nt, hsa
agaaaggcuaauauggaaccaaacucuuguaaguaauguaaauagaaagguggguggauaaagu

SEQ ID NO: 735158 - RNA, 64 nt, hsa
cucuggacuuuauuuugcuaaccauaacugagcaaauguaaauuacugcuauauuaauguuuua

SEQ ID NO: 735159 - RNA, 64 nt, hsa
ccuucccucaucagugaaaaaaucuaauguuucaaauguaaauuguucauagaaaaggaacaua

SEQ ID NO: 735160 - RNA, 64 nt, hsa
ucagaggaucuaacauagaagcugaugacgcauuaauguaaaaauggaacuuauuuuugucaaa

SEQ ID NO: 735161 - RNA, 64 nt, hsa
cuuugagugacaugcuaacagcaauuucauaguaaauguaaauaaggucagaggaucuaacaua

SEQ ID NO: 735162 - RNA, 64 nt, hsa
gccacauucuuacacuguccagcuuguaaugguuaauguaaaacuuaccagaugaaccuugugu

SEQ ID NO: 735163 - RNA, 64 nt, hsa
uaaaucaugaauugaacauguaaaauuccaguaaaauguaaaaacggaauaugcaucgcucuua

SEQ ID NO: 735164 - RNA, 64 nt, hsa
acagaaacacauaguauuugcacuuuguacuuuaaauguaaauucacuuuguagaaaugagcua

SEQ ID NO: 735165 - RNA, 64 nt, hsa
agucacagugccugggaggggcccauccuuccaaaauguaaauccagucgcggugugaccgagc

SEQ ID NO: 735166 - RNA, 64 nt, hsa
uaauaaguagccuauuuuuuaaaugucuuuuuaaaauguaaauauuuggaugaaguuuuucuuu

SEQ ID NO: 735167 - RNA, 64 nt, hsa
augauacaguaagguguaauuacagaauuuacgaaauguaaauggccucuacagaguuuuaugg

SEQ ID NO: 735168 - RNA, 64 nt, hsa
gagaaucgagaaauuugauagagguaacuuguuuaauguaaaucuaauaguacuuguaauuucu

SEQ ID NO: 735169 - RNA, 64 nt, hsa
cagaucuuauuuuuuuauuuugagugccacuauuaauguaaaaaggggggggcucuacagcagu

SEQ ID NO: 735170 - RNA, 64 nt, hsa
uuuuuuuuaacuguagaucaugcaugugauuguaaauguaaauuuguacaauguuguuauggua

SEQ ID NO: 735171 - RNA, 64 nt, hsa
acacgagguauuuuauacuggugagaaaccuuacaauguaaagaauguggcacagcuuuuaacu

SEQ ID NO: 735172 - RNA, 64 nt, hsa
uguaagaguauuuauacuggaaagaaacccuacaaauguaaaaaacguggcaaugccuuuaacu

SEQ ID NO: 735173 - RNA, 64 nt, hsa
aaucaaauaacuagacauauaucagaaacuuuaaaauguaaaaguuguacacuuucaacauuuu

SEQ ID NO: 735174 - RNA, 64 nt, hsa
ugugcuccucuuuuggauuuacagaaaugugucaaauguaaaucuuucaaagccauuuaaaaau

SEQ ID NO: 735175 - RNA, 64 nt, hsa
aaucuauaucuguuagaaauaauguagccaaaagaauguaaauuugaggauuuuuuugccaaua

SEQ ID NO: 735176 - RNA, 64 nt, hsa
aaauauaugaaccaaagugauuugaguuuguaaaaauguaaaauaguaugaacaaaauuugcac

SEQ ID NO: 735177 - RNA, 64 nt, hsa
guggagaaccugacagaggacuaagaaguuaucuaauguaaaagaccucaggcaccaccuucgc

SEQ ID NO: 735178 - RNA, 64 nt, hsa
aaaauacauaccagauuuuaaagauguaccaaaaaauguaaacuaucucaauuuuuauauuggu

SEQ ID NO: 735179 - RNA, 64 nt, hsa
cauuugacuuuuauuuuuguauuuaauugacaugaauguaaaggggacagcucaggguuguuuu

SEQ ID NO: 735180 - RNA, 64 nt, hsa
uuuguauuuucccugccgaagugaauuguuggagaauguaaaccgccuccacguggcggcagac

SEQ ID NO: 735181 - RNA, 64 nt, hsa
aauguagaaauucuucaugaacauaacucugcugaauguaaaagaaaauuuuuuuucaaaaaug

SEQ ID NO: 735182 - RNA, 64 nt, hsa
uuuucucuucuacauugacacacagaaaugugucaauguaaagccaaaaccaucuucuguguuu

SEQ ID NO: 735183 - RNA, 64 nt, hsa
gcugagugauggccaaguuuuuucucuggacaggaauguaaaugucuuacuggaaaugacaagu

SEQ ID NO: 735184 - RNA, 64 nt, hsa
uucaaacugauacauauacacauauuuuuuugauaauguaaauacagugaccauguuaaccuac

SEQ ID NO: 735185 - RNA, 64 nt, hsa
ggagaaaaagauaugcuuauacacuguugguggaaauguaaauuaaauuaguucagccauugug

SEQ ID NO: 735186 - RNA, 64 nt, hsa
auacaaaaauuaacucaagauggauuaaagacuuaauguaaaacccaaaacaguaaaaauccug

SEQ ID NO: 735187 - RNA, 64 nt, hsa
ugggcauuuuucucucuguucccucucuuuugaaaauguaaaauaaaaccaaaaauagacaacu

SEQ ID NO: 735188 - RNA, 64 nt, hsa
uuugaacuuccaaguaugucuagucaccuuuuaaaauguaaacauuuucagaaaaaugaggauu

SEQ ID NO: 735189 - RNA, 64 nt, hsa
uuggcugagucuugagacugaaagauuuagccauaauguaaacugccucaaauuggacuuuggg

SEQ ID NO: 735190 - RNA, 64 nt, hsa
uuuacacaauguuucucuguaaauauugccauuaaauguaaauaacuuuaauaaaacguuuaua

SEQ ID NO: 735191 - RNA, 64 nt, hsa
auauauuagagaacugugauuuaaaaguacuguuaauguaaaaaauaaagcaaguguaauuaau

SEQ ID NO: 735192 - RNA, 64 nt, hsa
cacuguaugguuuuaauauauuaguacauucuagaauguaaaaggauuaaacuuuacaauuuag

SEQ ID NO: 735193 - RNA, 64 nt, hsa
guaguauaauuuguggagaaauguaaauuguaauaauguaaaugggggcuucaauauauauaua

SEQ ID NO: 735194 - RNA, 64 nt, hsa
uuaaaauauuugggaguaguauaauuuguggagaaauguaaauuguaauaauguaaaugggggc

SEQ ID NO: 735195 - RNA, 64 nt, hsa
uugacaucuggcucauuaaaaaauuuagcaauagaauguaaauuguauaaaaaguuugugaaua

SEQ ID NO: 735196 - RNA, 64 nt, hsa
uaauaaugaguguguaaacugcauacguuaaauaaauguaaauacuaauguacugcugccuucu

SEQ ID NO: 735197 - RNA, 64 nt, hsa
ucuuguuuauuguugaugccaucuuagaggaaaaaauguaaagguaaguaauuaagcauaugac

SEQ ID NO: 735198 - RNA, 64 nt, hsa
uucauacuacuguuaacuuuuuuaaaaaagaagcaauguaaagaccguaaugcacuaagcuuuu

SEQ ID NO: 735199 - RNA, 64 nt, hsa
gauuaaaaguugugcaugggcuuauacaauuucaaauguaaaaacagccuauuuauauauguug

SEQ ID NO: 735200 - RNA, 64 nt, hsa
aaaguuaaacuacugcaguugguggaaguucugcaauguaaauagaacacuaauuaaaaaacaa

SEQ ID NO: 735201 - RNA, 64 nt, hsa
aaaaaaagagguagcuuuuagauugcaaacuggaaauguaaaacucaugaaauuuaagcaauau

SEQ ID NO: 735202 - RNA, 64 nt, hsa
guaacuuugugggaacacugauucauauuuagaaaauguaaaugucuguagcacuuucuugcag

SEQ ID NO: 735203 - RNA, 64 nt, hsa
gaacaucuauacauauggugaucuaaauguacaaaauguaaaauguauaagucaucucacuuuu

SEQ ID NO: 735204 - RNA, 64 nt, hsa
uauaaaaaguuuauuuugcuauugugaaaaacuaaauguaaaggaaaucaccuacuuucaugca

SEQ ID NO: 735205 - RNA, 64 nt, hsa
cuugggauuguuuuguggguuuuuguuuguuuuaaauguaaauugagaaucuuuuauaagaaau

SEQ ID NO: 735206 - RNA, 64 nt, hsa
guaauauuguguauacaaaacccaaaucucucaaaauguaaauuauguauaccugccaagauac

SEQ ID NO: 735207 - RNA, 64 nt, hsa
agguggccugcugaggcugccccauauuuuagaaaauguaaaaauggugguuuggccauuaauu

SEQ ID NO: 735208 - RNA, 64 nt, hsa
aaaaaauuugguucucaagugaacaaacauauaaaauguaaacaaucccuacaauccagauaaa

SEQ ID NO: 735209 - RNA, 64 nt, hsa
uguugauaggugaccacuguugguauuuacauuaaauguaaagaaauguguacugaucucauug

SEQ ID NO: 735210 - RNA, 64 nt, hsa
acaaaagucugagauggggaguuucagauaaccgaauguaaauccuuuaucagauuuuaacuug

SEQ ID NO: 735211 - RNA, 64 nt, hsa
gcuuugggguuuuuuuuuucuuuuuuuuuuuuuuaauguaaacuaaccuccugcaugacagagg

SEQ ID NO: 735212 - RNA, 64 nt, hsa
aacaugccccauacuuuguauuggagaguacaauaauguaaauccuaaaagcaccacuauuuua

SEQ ID NO: 735213 - RNA, 64 nt, hsa
ccaaccuaauguuacaacuacuuugagguggccaaauguaaacuaaaagccuuaauuaaagugg

SEQ ID NO: 735214 - RNA, 64 nt, hsa
gaaugguggucagacugaugacagauccuagaccaauguaaagaauguguaucuguauauaaau

SEQ ID NO: 735215 - RNA, 64 nt, hsa
gggguggcaauagcauugugccauuuugucauagaauguaaaaauugguuaacuuuacaaaugu

SEQ ID NO: 735216 - RNA, 64 nt, hsa
aaucuucucauuuuauugaaaacuaagagcagaaaauguaaaaugcucaugaagguuuugaaug

SEQ ID NO: 735217 - RNA, 64 nt, hsa
uugaccauaaaaagucauugcuguucuuguuucuaauguaaauaguguccauuaguaaaaguga

SEQ ID NO: 735218 - RNA, 64 nt, hsa
accuuuagacucugaaaguaauauuuugacuaagaauguaaauauuuccaaacuaaauuacucg

SEQ ID NO: 735219 - RNA, 64 nt, hsa
acaaaacauuuaagugccagacuuaauauuaaagaauguaaagguccaaguaaaaugagguaug

SEQ ID NO: 735220 - RNA, 64 nt, hsa
gaaaaaagaugacaauuuaaaagucagccuaaagaauguaaagguaucuauauacaaaaggcua

SEQ ID NO: 735221 - RNA, 64 nt, hsa
cagagauauuuagaauauuugacaaugguuugagaauguaaaacaaaaaggaacuaguuagagu

SEQ ID NO: 735222 - RNA, 64 nt, hsa
uauuauuuacaaagauucaaaugcuuuuaugacuaauguaaaaugaaaagaggcuuacauuuua

SEQ ID NO: 735223 - RNA, 64 nt, hsa
cuaauuuugauaucucauuuucggcauuuuuuaaaauguaaaaggaaaaccucuuguguucaca

SEQ ID NO: 735224 - RNA, 64 nt, hsa
aaaauggcauacaucuuuuguacaaagaacuugaaauguaaauacuguguuugugcuguaagag

SEQ ID NO: 735225 - RNA, 64 nt, hsa
guuuaguuuguuuuuuuucaaacaacccucuaaaaauguaaaaaccauguuuagcuugcagcug

SEQ ID NO: 735226 - RNA, 64 nt, hsa
uuuccagugugccaacuccaaagucaacauuaaaaauguaaauggaccuguguaaauaucacag

SEQ ID NO: 735227 - RNA, 64 nt, hsa
uccuuuaauaaguaaagaaaauaauauguuuaaaaauguaaauguuuuacaaauuugaaacuuu

SEQ ID NO: 735228 - RNA, 64 nt, hsa
gaauuaaauuuguauagagcagaguuuuaaaaugaauguaaauagcacuaaacguuuucuuucu

SEQ ID NO: 735229 - RNA, 64 nt, hsa
cuguacuaagugucaacagcccuuacaaacauuaaauguaaaugguuucaaauggucagcguug

SEQ ID NO: 735230 - RNA, 64 nt, hsa
uuuuuaauacauauccaauaaugccuuccaucugaauguaaaauaaguacccaugauuucuauu

SEQ ID NO: 735231 - RNA, 64 nt, hsa
uaggcaguucagagcauaaguuaacugugaaaaaaauguaaagguuuuauuuaggacauuugca

SEQ ID NO: 735232 - RNA, 64 nt, hsa
gcauauuuuuuaacaaugcccaaucuguaugaauaauguaaacuucgauuuuuuuuuaaaaaaa

SEQ ID NO: 735233 - RNA, 64 nt, hsa
uaaaaaaauuagauuuuagcuggagcuuuugacuaauguaaaguaaaugccaaacuaccgacuu

SEQ ID NO: 735234 - RNA, 64 nt, hsa
cuuauagcuuuuaaaagaccuuuuaaagacauuaaauguaaacuuaaaaauguuuagaucuugu

SEQ ID NO: 735235 - RNA, 64 nt, hsa
aauuuguauuuauguguauauaaaauguacaaugaauguaaauaugacuuucuggaaaguuuag

SEQ ID NO: 735236 - RNA, 64 nt, hsa
uuauacaugguugguugucucuucuugaaacuguaauguaaaucuaggguccagucauauccua

SEQ ID NO: 735237 - RNA, 64 nt, hsa
ccacauagcuuuugcacugcaguuacuauuuacuaauguaaacguaggguuuguaaaagucaca

SEQ ID NO: 735238 - RNA, 64 nt, hsa
ucuaaaaccaaagcugauuuuuagaaaauuugaaaauguaaaucagcccuauccauacuauagu

SEQ ID NO: 735239 - RNA, 64 nt, hsa
ugaauuuuaccaauuuaugaauucuuguaagcggaauguaaaacggaaauacugaaagacuuuu

SEQ ID NO: 735240 - RNA, 64 nt, hsa; identical to SEQ ID NO: 735239

SEQ ID NO: 735241 - RNA, 64 nt, hsa; identical to SEQ ID NO: 735238

SEQ ID NO: 735242 - RNA, 64 nt, hsa
ggguugggggaagauauuacuuugagaaaacagaaauguaaaggauuuuugaccuuauauaugu

SEQ ID NO: 735243 - RNA, 64 nt, hsa
caugaaauugucuuaaaaaagcaagagacugcaaaauguaaacaguaaucuucugucccuuuaa

SEQ ID NO: 735244 - RNA, 64 nt, hsa
cuaaaauaaagcaucuauuagugucugauuuaggaauguaaaaugauucuguauuaauguaaau

SEQ ID NO: 735245 - RNA, 64 nt, hsa
ugucugauuuaggaauguaaaaugauucuguauuaauguaaauaagauuaucuauugcaaaaag

SEQ ID NO: 735246 - RNA, 64 nt, hsa
auuauuucaagcuagucauugagguauaugacaaaauguaaauaacaaaaaacugaaaucuacc

SEQ ID NO: 735247 - RNA, 64 nt, hsa
ggagcucauggugccgcuggggacuuuuuagagaaauguaaagagaauagcuauucagugucua

SEQ ID NO: 735248 - RNA, 51 nt, hsa
auacuagagaaaaacuuuaaaaauguaaaacauggagcagauuuuuuacuu

SEQ ID NO: 735249 - RNA, 64 nt, hsa
uaauaucagcauuuuucauggaaguuuaaugccaaauguaaaacacaugaaaauuuuuaaaaau

SEQ ID NO: 735250 - RNA, 64 nt, hsa
uuacuaaccuugaaauguaagagaucugguuuugaauguaaaaguugcaacacacaaacggaag

SEQ ID NO: 735251 - RNA, 64 nt, hsa
uaugccuuauuacagacuuguugacuauaggcuuaauguaaaaaggaaucuugccagauguagc

SEQ ID NO: 735252 - RNA, 64 nt, hsa
ucugccucggccauucaaaagucuaauaacaaaaaauguaaaccuaauuuggcaguuuguuagg

SEQ ID NO: 735253 - RNA, 64 nt, hsa
acuaaaauuagaaauguccccucacugcagaucaaauguaaagcuuccaguuaaggagcuaaau

SEQ ID NO: 735254 - RNA, 64 nt, hsa
cuaaacugggauuuauaaaccagcugugauuaacaauguaaaguauuaauuauugaacuuugaa

SEQ ID NO: 735255 - RNA, 64 nt, hsa
uaguugacuguauuauuugauuucggauugaaugaauguaaauagaaauuaaaugcaaauuuga

SEQ ID NO: 735256 - RNA, 64 nt, hsa
aagagauguuaagcaagugguuguuuuagauccaaauguaaaggcagguuugggaagguguuua

SEQ ID NO: 735257 - RNA, 64 nt, hsa
uaaaguuuaucagauauuuucauauuuaaagccaaauguaaauagaggucuguaaagaaaaaua

SEQ ID NO: 735258 - RNA, 64 nt, hsa
gagauaagggaaggggagacuguaaaaacagaaaaauguaaaugcugccuuuaugguauaaaac

SEQ ID NO: 735259 - RNA, 64 nt, hsa
uccguuagaaauaaaagcagcaucaaugcauaagaauguaaauaaacauguuuguugaaguacu

SEQ ID NO: 735260 - RNA, 64 nt, hsa
acauucagauuuaauuacuguaaguaaaauuuaaaauguaaauacaucaguucauguucuguau

SEQ ID NO: 735261 - RNA, 64 nt, hsa
acucaugguguggcuaaucuacauuuaucaauaaaauguaaauuaucugaaaggacagaauaua

SEQ ID NO: 735262 - RNA, 64 nt, hsa
gaaaaauuuguagcggauggcaguguugaaggcaaauguaaacauaaggguaauggucugucau

SEQ ID NO: 735263 - RNA, 64 nt, hsa
uuuucccuauugacugucagaaaauccacugggaaauguaaaaaucuucacucaccauuaugau

SEQ ID NO: 735264 - RNA, 64 nt, hsa
acaguuggaggaauccauggaaaauagacgagaaaauguaaauaaggcuuucuggggaucacag

SEQ ID NO: 735265 - RNA, 64 nt, hsa
cuacaugcugucauugaacagagauguggggagaaauguaaacaaucagcucacaggcaucaau

SEQ ID NO: 735266 - RNA, 64 nt, hsa
caugcaagaacacacaauggagagaaacccuaugaauguaaagaaugcagaaaagcauucagcu

SEQ ID NO: 735267 - RNA, 64 nt, hsa
cagaccugacaagauucuuugaauacagauaaugaauguaaacaauuaacuguuuauaauaacu

SEQ ID NO: 735268 - RNA, 64 nt, hsa
acaacugauaccagccgcugcaaaaucaugccaaaauguaaagaccaucgagacuaggaagaaa

SEQ ID NO: 735269 - RNA, 64 nt, hsa
agcaucaaauucucacauaacaauauuagcuuuaaauguaaaugggcuaaaugcuccaauuaaa

SEQ ID NO: 735270 - RNA, 64 nt, hsa
gaccacauaguuggaaguaaagcacuccucagcaaauguaaaggaacaaaaauuauaacaaacu

SEQ ID NO: 735271 - RNA, 64 nt, hsa
ugagauaaaacaacacaaugcauguugccuuuuuaauguaaauacccguagguaucauuaauag

SEQ ID NO: 735272 - RNA, 64 nt, hsa
uuguuuuuaaauguuagauggcacuauguauauuaauguaaaacaauguuaauuuacucaaguu

SEQ ID NO: 735273 - RNA, 64 nt, hsa
caucuuuuauuccauacugcaaagaaauuuugcaaauguaaagaauaugacaaggucuucaaac

SEQ ID NO: 735274 - RNA, 64 nt, hsa
agagaaaagcaaauacuuauacacugcuggugggaauguaaauuaauucagccauuguggaaag

SEQ ID NO: 735275 - RNA, 64 nt, hsa
augugaagaaagugcacgcugaauagaaacuauaaauguaaauaucgaaaguuuuucaauuuua

SEQ ID NO: 735276 - RNA, 64 nt, hsa
caugaacgaauucauacuggagagaaacccuaugaauguaaagaauguggaaaacccuucaguu

SEQ ID NO: 735277 - RNA, 64 nt, hsa
caugaaagaacccacacuggagagaaaccuuaugaauguaaacagugugguaaagccuucagua

SEQ ID NO: 735278 - RNA, 64 nt, hsa
caugaaaggaugcacacugcaaagaaacaguaugaauguaaaaaaugugggaaaacauacauua

SEQ ID NO: 735279 - RNA, 64 nt, hsa
caugagaggaaucacacugcacagaaacacuaugaauguaaacugugugggaaaacuuacuugu

SEQ ID NO: 735280 - RNA, 64 nt, hsa
caugaaagaacucacacuggagaaaaacccuaugaauguaaaaaaugugggaaaguguucguau

SEQ ID NO: 735281 - RNA, 64 nt, hsa
caugaaaggaaucacacuguacagaaacgcuaugaauguaaacaauguggaaaaaccuacauau

SEQ ID NO: 735282 - RNA, 64 nt, hsa
auagaaauaauucucauuggagauaaacccuaugaauguaaacacauaguaaagccuuaauuuu

SEQ ID NO: 735283 - RNA, 64 nt, hsa
caugaauaaacuuacacuggacagaaacccuauaaauguaaaugugggaaagccuuucauaauu

SEQ ID NO: 735284 - RNA, 64 nt, hsa
aaauaaaaaaaaagaaaaagaaauaaacucuaugaauguaaaccauguggugaaggcuuaagug

SEQ ID NO: 735285 - RNA, 64 nt, hsa
caugagacaacucauaugggagagaagccauaugaauguaaauaaugugggaaagcauuugguu

SEQ ID NO: 735286 - RNA, 64 nt, hsa
caugaaaggacucacacuagggagaaaaucuauaaauguaaaugugggaaagccuuuagugauc

SEQ ID NO: 735287 - RNA, 64 nt, hsa
uaaccccccaaaaaaucacacaaauauauuuuaaaauguaaauauuuuaucgcuucuguuuucu

SEQ ID NO: 735288 - RNA, 64 nt, hsa
uuuaaugcauagccucuucagaaugcaauuuuaaaauguaaaggcucuuuuauaaccccccaaa

SEQ ID NO: 735289 - RNA, 64 nt, hsa
uaagauaguuagguauuaaacacuucagaauaucaauguaaaauuggaaaauaaggaacugggg

SEQ ID NO: 735290 - RNA, 64 nt, hsa
guaucacaucuagcucccuuacuuguccacagauaauguaaacaaaggagggaaaaacuuauua

SEQ ID NO: 735291 - RNA, 64 nt, hsa
aaacauauaauuugcuuaauuacgugaauaaugaaauguaaaauccggguccauaagccuuuau

SEQ ID NO: 735292 - RNA, 64 nt, hsa
uggaagugcgguugagcucucugccacuuucuucaauguaaaaaguaggcaucaaagauacgac

SEQ ID NO: 735293 - RNA, 64 nt, hsa
aagcuuugaaaauaaaggacuucacaaaaacgguaauguaaaugugcuuccaaguuggggggaa

SEQ ID NO: 735294 - RNA, 64 nt, hsa
aagcacaggccauuuuucacuuugguauuaauaaaauguaaaaaaaaaaaacuggcugaauggc

SEQ ID NO: 735295 - RNA, 64 nt, hsa
accaccagcccauccugaggaaagccuccuauggaauguaaagugcaaucauuucuucagauau

SEQ ID NO: 735296 - RNA, 64 nt, hsa
uucaaaccauuuaccaucugaaaguuuugauuugaauguaaaacaggaaauuggaauuccuuug

SEQ ID NO: 735297 - RNA, 64 nt, hsa
ucauuuucaucuguuuuuugaagaaaaauggaaaaauguaaaaggcagccccuccccaggcuuu

SEQ ID NO: 735298 - RNA, 64 nt, hsa
uuuguguaaauacuagucuuuuuggaaaaaaaauaauguaaagauguuuuguauaaacucugaa

SEQ ID NO: 735299 - RNA, 64 nt, hsa
uuuucuccaggugcuuauauugaucuggaauuguaauguaaaaagcaaugcaaacuuaggcgag

SEQ ID NO: 735300 - RNA, 64 nt, hsa
ugucccaauuuguauugauucucuuuaaauauaaaauguaaauaaaauauuccaauaaaaguuu

SEQ ID NO: 735301 - RNA, 64 nt, hsa
gugauuggcuaaacaaucucgcauuaaaaauucaaauguaaauugaauucacaugaaaaaucau

SEQ ID NO: 735302 - RNA, 64 nt, hsa
uguuuucgucacaugcugaguaaaagugccuuacaauguaaaaauuguacaguacuuauguucc

SEQ ID NO: 735303 - RNA, 64 nt, hsa
agacuuaugaaggcauuaggauagauagcucaggaauguaaagguucagaaaaggucuguuuuc

SEQ ID NO: 735304 - RNA, 64 nt, hsa
ucuuugccaagcugccuagcauacaucaguauguaauguaaaagacauaugagcaagaaaaaag

SEQ ID NO: 735305 - RNA, 64 nt, hsa
guaagugaaaaaaaaucacauucauuuguuuaaaaauguaaagcuauuuuguagaggcucagua

SEQ ID NO: 735306 - RNA, 64 nt, hsa
cuugcuuuuauguccacuuuuugagugguacuuaaauguaaaguaacaaccugaauugagucau

SEQ ID NO: 735307 - RNA, 64 nt, hsa
gugaccaagguccucaaauuggaauuugaacaacaauguaaaaccuguucugucacaaauguuc

SEQ ID NO: 735308 - RNA, 64 nt, hsa
cuucauuuccccucccccaauccaugaaagccuaaauguaaaauauaucuuuucauucaucuua

SEQ ID NO: 735309 - RNA, 64 nt, hsa; identical to SEQ ID NO: 354755

SEQ ID NO: 735310 - RNA, 64 nt, hsa; identical to SEQ ID NO: 354756

SEQ ID NO: 735311 - RNA, 64 nt, hsa; identical to SEQ ID NO: 354757

SEQ ID NO: 735312 - RNA, 64 nt, hsa; identical to SEQ ID NO: 354758

SEQ ID NO: 735313 - RNA, 64 nt, hsa; identical to SEQ ID NO: 354759

SEQ ID NO: 735314 - RNA, 64 nt, hsa; identical to SEQ ID NO: 354760

SEQ ID NO: 735315 - RNA, 64 nt, hsa; identical to SEQ ID NO: 354761

SEQ ID NO: 735316 - RNA, 64 nt, hsa; identical to SEQ ID NO: 354762

SEQ ID NO: 735317 - RNA, 64 nt, hsa; identical to SEQ ID NO: 354763

SEQ ID NO: 735318 - RNA, 64 nt, hsa; identical to SEQ ID NO: 354764

SEQ ID NO: 735319 - RNA, 64 nt, hsa; identical to SEQ ID NO: 354765

SEQ ID NO: 735320 - RNA, 64 nt, hsa; identical to SEQ ID NO: 354766

SEQ ID NO: 735321 - RNA, 64 nt, hsa; identical to SEQ ID NO: 354767

SEQ ID NO: 735322 - RNA, 64 nt, hsa; identical to SEQ ID NO: 354768

SEQ ID NO: 735323 - RNA, 64 nt, hsa; identical to SEQ ID NO: 354769

SEQ ID NO: 735324 - RNA, 64 nt, hsa; identical to SEQ ID NO: 354770

SEQ ID NO: 735325 - RNA, 64 nt, hsa; identical to SEQ ID NO: 354771

SEQ ID NO: 735326 - RNA, 64 nt, hsa; identical to SEQ ID NO: 354772

SEQ ID NO: 735327 - RNA, 64 nt, hsa; identical to SEQ ID NO: 354773

SEQ ID NO: 735328 - RNA, 64 nt, hsa; identical to SEQ ID NO: 354774

SEQ ID NO: 735329 - RNA, 64 nt, hsa; identical to SEQ ID NO: 354775

SEQ ID NO: 735330 - RNA, 64 nt, hsa; identical to SEQ ID NO: 354776

SEQ ID NO: 735331 - RNA, 64 nt, hsa; identical to SEQ ID NO: 354777

SEQ ID NO: 735332 - RNA, 64 nt, hsa; identical to SEQ ID NO: 354778

SEQ ID NO: 735333 - RNA, 64 nt, hsa; identical to SEQ ID NO: 354779

SEQ ID NO: 735334 - RNA, 64 nt, hsa; identical to SEQ ID NO: 354780

SEQ ID NO: 735335 - RNA, 64 nt, hsa; identical to SEQ ID NO: 354781

SEQ ID NO: 735336 - RNA, 64 nt, hsa; identical to SEQ ID NO: 354782

SEQ ID NO: 735337 - RNA, 64 nt, hsa; identical to SEQ ID NO: 354783

SEQ ID NO: 735338 - RNA, 64 nt, hsa; identical to SEQ ID NO: 354784

SEQ ID NO: 735339 - RNA, 64 nt, hsa; identical to SEQ ID NO: 354785

SEQ ID NO: 735340 - RNA, 64 nt, hsa; identical to SEQ ID NO: 354786

SEQ ID NO: 735341 - RNA, 64 nt, hsa; identical to SEQ ID NO: 354787

SEQ ID NO: 735342 - RNA, 64 nt, hsa; identical to SEQ ID NO: 354788

SEQ ID NO: 735343 - RNA, 64 nt, hsa; identical to SEQ ID NO: 354789

SEQ ID NO: 735344 - RNA, 64 nt, hsa; identical to SEQ ID NO: 354790

SEQ ID NO: 735345 - RNA, 64 nt, hsa; identical to SEQ ID NO: 354791

SEQ ID NO: 735346 - RNA, 64 nt, hsa; identical to SEQ ID NO: 354792

SEQ ID NO: 735347 - RNA, 64 nt, hsa
cuaacccgagucucacccacagaauucauauaaauucauauaugccuucucucuggcugccucu

SEQ ID NO: 735348 - RNA, 64 nt, hsa
guaaguagaucuaacccgagucucacccacagaauucauauaaauucauauaugccuucucucu

SEQ ID NO: 735349 - RNA, 64 nt, hsa
uacugaaccagcuaaaaauuuugcugauguauuuuucauauacuucucuccugacacgcaaucc

SEQ ID NO: 735350 - RNA, 64 nt, hsa
uuuuacagacacaauaccuucaugaauuucaaaauucauauaaaauuugaucuuaugcaauaca

SEQ ID NO: 735351 - RNA, 64 nt, hsa
cuuccauauuuaucuguucaaaggagcaagaacuuucauauaggaauagaaacaugcuggccga

SEQ ID NO: 735352 - RNA, 64 nt, hsa
gauugacccugauuuuaauugugaaauuauaugauucauauauuuuaugaaucagaauaaccuu

SEQ ID NO: 735353 - RNA, 64 nt, hsa
uuugguuuaaaagaacuauaucuauauguauauuuucauauauaugacagaacaagaauaugua

SEQ ID NO: 735354 - RNA, 64 nt, hsa
uguaauuuuauguaucccaucuccuuugugugaauucauauauuauagcaaaauacaagagaca

SEQ ID NO: 735355 - RNA, 64 nt, hsa
auggaauacauuuuguuggagguaauuuaugugauucauauaccacugcuacaguguuagcuga

SEQ ID NO: 735356 - RNA, 64 nt, hsa
auguuugaaaaaacguuguauccuuauuuuguaauucauauaguaagaguauucuaaacagcac

SEQ ID NO: 735357 - RNA, 64 nt, hsa
acaauuucauuguuguaauuguucccuuucuguuuucauauagugaauaaccuuuaaaggguug

SEQ ID NO: 735358 - RNA, 64 nt, hsa
aagaaauuuugcauuaaaaauaguguaccaaugcuucauauacguuaguuauuugcuauuaugu

SEQ ID NO: 735359 - RNA, 64 nt, hsa
ugcaugauuuucuagauacacagucuaugcauuauucauauacauuuauuuuagccuaaagugg

SEQ ID NO: 735360 - RNA, 64 nt, hsa
auuugaauauucuugaacaccaccacugaagaguuucauauacaccaaauaaugucucaucucu

SEQ ID NO: 735361 - RNA, 64 nt, hsa
auauaacaugcuucgugccaucaugauccuugccuucauauaacaaacaugcuucgucagaggu

SEQ ID NO: 735362 - RNA, 64 nt, hsa
ucauauaacaugcuucgugcucauggucauugccuucauauaacaugcuucgugccaucaugau

SEQ ID NO: 735363 - RNA, 64 nt, hsa
uauuuugguggcagcugccaucauggucauugccuucauauaacaugcuucgugcucaugguca

SEQ ID NO: 735364 - RNA, 64 nt, hsa
gaaaaauaaugggcaaaaauuuuuguugcaacuuuucauauauauuuuccccuuaccaauuguu

SEQ ID NO: 735365 - RNA, 64 nt, hsa
caaggugcguucuagaugucauccuaaaaaacacuucauauauaauuaaucacuauuuuguaua

SEQ ID NO: 735366 - RNA, 64 nt, hsa
uguuuguagguuagaaacagcugaguaucguaguuucauauaugguuccagcuaauacaugcaa

SEQ ID NO: 735367 - RNA, 64 nt, hsa
ucucuaaggcucuaucaguucugacauucuaggcuucauauacauuaaguugagccauauguaa

SEQ ID NO: 735368 - RNA, 64 nt, hsa
uguaguauucaacugacuucauaauauuuuuauauucauauacuguuaaugcacauuugguuau

SEQ ID NO: 735369 - RNA, 64 nt, hsa
uagaaaucauccauauguuuauacauauauuuacuucauauauuuuuaagucuguguaguauuc

SEQ ID NO: 735370 - RNA, 64 nt, hsa
ggcuaguuuaaauauguuucuaaccacagagaauuucauauauauauacauauauauauacaca

SEQ ID NO: 735371 - RNA, 64 nt, hsa
augggacugagaaaagcuuggaaagaaucuugguuucauauaaauucuuguuguuaggccuuac

SEQ ID NO: 735372 - RNA, 64 nt, hsa
ucaucuuuguguacagagguuuaauaaauuaguuuucauauacauaaucuaagacuuugaauac

SEQ ID NO: 735373 - RNA, 64 nt, hsa
uuaguaauacuuuuacuuuuuuguaacuucauccuucauauaugcuugcuauacagguauguuc

SEQ ID NO: 735374 - RNA, 64 nt, hsa
acaaugguuaaggcagaauaaugacuaaaauauguucauauauuaugauguggaaauaauugau

SEQ ID NO: 735375 - RNA, 64 nt, hsa
uauggcauuucuaauuguaaguagagacaaaauauucauauagucagauauauguugucugcuu

SEQ ID NO: 735376 - RNA, 64 nt, hsa
ggcuucauauauguaacgugagguauuaauguaauucauauauuaaagcaaaaauuguucacag

SEQ ID NO: 735377 - RNA, 64 nt, hsa
agguuguaagcaaacuaaguuaguguaauuuggcuucauauauguaacgugagguauuaaugua

SEQ ID NO: 735378 - RNA, 64 nt, hsa
cacauauaauuagacuuuauaauauauauacuuuuucauauauaauuagaucuuucuuuguaau

SEQ ID NO: 735379 - RNA, 64 nt, hsa
ccucauuuauuugauaauucacuaauguuuuauauucauauauuaggaaagugaacuuagcaag

SEQ ID NO: 735380 - RNA, 64 nt, hsa
auauaagugaaaucauacacucucguguauauacuucauauaagugaauauauacucucgugag

SEQ ID NO: 735381 - RNA, 64 nt, hsa
uuauuggccuugccucuucuagagcuucuagaacuucauauaagugaaaucauacacucucgug

SEQ ID NO: 735382 - RNA, 64 nt, hsa
uaaguauauugauuaccaccaugguauugguuccuucauauaccuugcuuggauuuaaaacuuu

SEQ ID NO: 735383 - RNA, 64 nt, hsa
aguuacuccugguuaugcagcuucucuugucuucuucauauauaugauaucauuuauuuuucgc

SEQ ID NO: 735384 - RNA, 64 nt, hsa
ugugucacuucugacaugagccuguaaacauauauucauauauguaccugcacauguacccacc

SEQ ID NO: 735385 - RNA, 64 nt, hsa
gucuuauuccuuuaguauggacuuaaaguacuuauucauauaccuuguaacuaaaaauuagaac

SEQ ID NO: 735386 - RNA, 64 nt, hsa
uuuuuauuucuguggcuuuuucuauucuggauauuucauauaaguggaauuacacaauauaugu

SEQ ID NO: 735387 - RNA, 64 nt, hsa
gagacucaagacuaaacaugaaauucauuuaugcuucauauacaccuuauauacauagccuaaa

SEQ ID NO: 735388 - RNA, 64 nt, hsa
uuucucucucuguagauuugcuuauucuggucauuucauauaaauggaauucuacaauauucgg

SEQ ID NO: 735389 - RNA, 64 nt, hsa
aguguaaguuauaugugaaaugagucuuugguauuucauauaggaauuauuuuuuuuuucauuu

SEQ ID NO: 735390 - RNA, 64 nt, hsa; identical to SEQ ID NO: 542419

SEQ ID NO: 735391 - RNA, 64 nt, hsa; identical to SEQ ID NO: 542420

SEQ ID NO: 735392 - RNA, 64 nt, hsa; identical to SEQ ID NO: 542421

SEQ ID NO: 735393 - RNA, 64 nt, hsa; identical to SEQ ID NO: 542422

SEQ ID NO: 735394 - RNA, 64 nt, hsa; identical to SEQ ID NO: 542423

SEQ ID NO: 735395 - RNA, 64 nt, hsa; identical to SEQ ID NO: 542424

SEQ ID NO: 735396 - RNA, 64 nt, hsa; identical to SEQ ID NO: 542425

SEQ ID NO: 735397 - RNA, 64 nt, hsa; identical to SEQ ID NO: 542426

SEQ ID NO: 735398 - RNA, 64 nt, hsa; identical to SEQ ID NO: 478477

SEQ ID NO: 735399 - RNA, 64 nt, hsa; identical to SEQ ID NO: 478478

SEQ ID NO: 735400 - RNA, 64 nt, hsa; identical to SEQ ID NO: 478479

SEQ ID NO: 735401 - RNA, 64 nt, hsa; identical to SEQ ID NO: 478480

SEQ ID NO: 735402 - RNA, 64 nt, hsa; identical to SEQ ID NO: 478481

SEQ ID NO: 735403 - RNA, 64 nt, hsa; identical to SEQ ID NO: 478482

SEQ ID NO: 735404 - RNA, 64 nt, hsa; identical to SEQ ID NO: 478483

SEQ ID NO: 735405 - RNA, 64 nt, hsa; identical to SEQ ID NO: 478484

SEQ ID NO: 735406 - RNA, 64 nt, hsa; identical to SEQ ID NO: 478485

SEQ ID NO: 735407 - RNA, 64 nt, hsa; identical to SEQ ID NO: 478486

SEQ ID NO: 735408 - RNA, 64 nt, hsa; identical to SEQ ID NO: 478487

SEQ ID NO: 735409 - RNA, 64 nt, hsa; identical to SEQ ID NO: 478488

SEQ ID NO: 735410 - RNA, 64 nt, hsa; identical to SEQ ID NO: 478489

SEQ ID NO: 735411 - RNA, 64 nt, hsa; identical to SEQ ID NO: 478490

SEQ ID NO: 735412 - RNA, 64 nt, hsa; identical to SEQ ID NO: 478491

SEQ ID NO: 735413 - RNA, 64 nt, hsa; identical to SEQ ID NO: 478492

SEQ ID NO: 735414 - RNA, 64 nt, hsa; identical to SEQ ID NO: 478493

SEQ ID NO: 735415 - RNA, 64 nt, hsa; identical to SEQ ID NO: 478494

SEQ ID NO: 735416 - RNA, 64 nt, hsa; identical to SEQ ID NO: 478495

SEQ ID NO: 735417 - RNA, 64 nt, hsa; identical to SEQ ID NO: 478496

SEQ ID NO: 735418 - RNA, 64 nt, hsa; identical to SEQ ID NO: 478497

SEQ ID NO: 735419 - RNA, 64 nt, hsa; identical to SEQ ID NO: 478498

SEQ ID NO: 735420 - RNA, 64 nt, hsa; identical to SEQ ID NO: 478499

SEQ ID NO: 735421 - RNA, 64 nt, hsa; identical to SEQ ID NO: 478500

SEQ ID NO: 735422 - RNA, 64 nt, hsa; identical to SEQ ID NO: 478501

SEQ ID NO: 735423 - RNA, 64 nt, hsa; identical to SEQ ID NO: 478502

SEQ ID NO: 735424 - RNA, 64 nt, hsa; identical to SEQ ID NO: 478503

SEQ ID NO: 735425 - RNA, 64 nt, hsa; identical to SEQ ID NO: 478504

SEQ ID NO: 735426 - RNA, 64 nt, hsa; identical to SEQ ID NO: 478505

SEQ ID NO: 735427 - RNA, 64 nt, hsa; identical to SEQ ID NO: 478506

SEQ ID NO: 735428 - RNA, 64 nt, hsa; identical to SEQ ID NO: 478507

SEQ ID NO: 735429 - RNA, 64 nt, hsa; identical to SEQ ID NO: 478508

SEQ ID NO: 735430 - RNA, 64 nt, hsa; identical to SEQ ID NO: 478509

SEQ ID NO: 735431 - RNA, 55 nt, hsa; identical to SEQ ID NO: 478510

SEQ ID NO: 735432 - RNA, 64 nt, hsa; identical to SEQ ID NO: 478511

SEQ ID NO: 735433 - RNA, 64 nt, hsa; identical to SEQ ID NO: 478512

SEQ ID NO: 735434 - RNA, 64 nt, hsa; identical to SEQ ID NO: 478513

SEQ ID NO: 735435 - RNA, 64 nt, hsa; identical to SEQ ID NO: 478514

SEQ ID NO: 735436 - RNA, 64 nt, hsa; identical to SEQ ID NO: 478515

SEQ ID NO: 735437 - RNA, 64 nt, hsa; identical to SEQ ID NO: 478516

SEQ ID NO: 735438 - RNA, 64 nt, hsa; identical to SEQ ID NO: 478517

SEQ ID NO: 735439 - RNA, 64 nt, hsa; identical to SEQ ID NO: 478518

SEQ ID NO: 735440 - RNA, 64 nt, hsa; identical to SEQ ID NO: 478519

SEQ ID NO: 735441 - RNA, 57 nt, hsa; identical to SEQ ID NO: 478520

SEQ ID NO: 735442 - RNA, 64 nt, hsa; identical to SEQ ID NO: 478521

SEQ ID NO: 735443 - RNA, 64 nt, hsa; identical to SEQ ID NO: 478522

SEQ ID NO: 735444 - RNA, 64 nt, hsa; identical to SEQ ID NO: 478523

SEQ ID NO: 735445 - RNA, 64 nt, hsa; identical to SEQ ID NO: 478524

SEQ ID NO: 735446 - RNA, 64 nt, hsa; identical to SEQ ID NO: 478525

SEQ ID NO: 735447 - RNA, 64 nt, hsa; identical to SEQ ID NO: 478526

SEQ ID NO: 735448 - RNA, 64 nt, hsa; identical to SEQ ID NO: 478527

SEQ ID NO: 735449 - RNA, 64 nt, hsa; identical to SEQ ID NO: 478528

SEQ ID NO: 735450 - RNA, 64 nt, hsa; identical to SEQ ID NO: 478529

SEQ ID NO: 735451 - RNA, 64 nt, hsa; identical to SEQ ID NO: 478530

SEQ ID NO: 735452 - RNA, 64 nt, hsa; identical to SEQ ID NO: 478531

SEQ ID NO: 735453 - RNA, 64 nt, hsa; identical to SEQ ID NO: 478532

SEQ ID NO: 735454 - RNA, 64 nt, hsa; identical to SEQ ID NO: 478533

SEQ ID NO: 735455 - RNA, 64 nt, hsa; identical to SEQ ID NO: 478534

SEQ ID NO: 735456 - RNA, 64 nt, hsa; identical to SEQ ID NO: 478535

SEQ ID NO: 735457 - RNA, 64 nt, hsa; identical to SEQ ID NO: 478536

SEQ ID NO: 735458 - RNA, 64 nt, hsa; identical to SEQ ID NO: 478537

SEQ ID NO: 735459 - RNA, 64 nt, hsa; identical to SEQ ID NO: 478538

SEQ ID NO: 735460 - RNA, 64 nt, hsa; identical to SEQ ID NO: 478539

SEQ ID NO: 735461 - RNA, 64 nt, hsa; identical to SEQ ID NO: 478540

SEQ ID NO: 735462 - RNA, 64 nt, hsa; identical to SEQ ID NO: 478541

SEQ ID NO: 735463 - RNA, 64 nt, hsa; identical to SEQ ID NO: 478542

SEQ ID NO: 735464 - RNA, 64 nt, hsa; identical to SEQ ID NO: 478543

SEQ ID NO: 735465 - RNA, 64 nt, hsa; identical to SEQ ID NO: 478544

SEQ ID NO: 735466 - RNA, 64 nt, hsa; identical to SEQ ID NO: 478545

SEQ ID NO: 735467 - RNA, 64 nt, hsa; identical to SEQ ID NO: 478546

SEQ ID NO: 735468 - RNA, 64 nt, hsa; identical to SEQ ID NO: 478547

SEQ ID NO: 735469 - RNA, 64 nt, hsa; identical to SEQ ID NO: 478548

SEQ ID NO: 735470 - RNA, 64 nt, hsa; identical to SEQ ID NO: 478549

SEQ ID NO: 735471 - RNA, 64 nt, hsa; identical to SEQ ID NO: 478550

SEQ ID NO: 735472 - RNA, 64 nt, hsa; identical to SEQ ID NO: 478551

SEQ ID NO: 735473 - RNA, 64 nt, hsa; identical to SEQ ID NO: 478552

SEQ ID NO: 735474 - RNA, 64 nt, hsa; identical to SEQ ID NO: 478553

SEQ ID NO: 735475 - RNA, 64 nt, hsa; identical to SEQ ID NO: 478554

SEQ ID NO: 735476 - RNA, 64 nt, hsa; identical to SEQ ID NO: 478555

SEQ ID NO: 735477 - RNA, 64 nt, hsa; identical to SEQ ID NO: 478556

SEQ ID NO: 735478 - RNA, 64 nt, hsa; identical to SEQ ID NO: 478557

SEQ ID NO: 735479 - RNA, 50 nt, hsa; identical to SEQ ID NO: 478558

SEQ ID NO: 735480 - RNA, 64 nt, hsa; identical to SEQ ID NO: 478559

SEQ ID NO: 735481 - RNA, 64 nt, hsa; identical to SEQ ID NO: 478560

SEQ ID NO: 735482 - RNA, 64 nt, hsa; identical to SEQ ID NO: 478561

SEQ ID NO: 735483 - RNA, 64 nt, hsa; identical to SEQ ID NO: 478562

SEQ ID NO: 735484 - RNA, 64 nt, hsa; identical to SEQ ID NO: 478563

SEQ ID NO: 735485 - RNA, 64 nt, hsa; identical to SEQ ID NO: 478564

SEQ ID NO: 735486 - RNA, 64 nt, hsa; identical to SEQ ID NO: 478565

SEQ ID NO: 735487 - RNA, 64 nt, hsa; identical to SEQ ID NO: 478566

SEQ ID NO: 735488 - RNA, 64 nt, hsa; identical to SEQ ID NO: 478567

SEQ ID NO: 735489 - RNA, 64 nt, hsa; identical to SEQ ID NO: 478568

SEQ ID NO: 735490 - RNA, 64 nt, hsa; identical to SEQ ID NO: 478569

SEQ ID NO: 735491 - RNA, 64 nt, hsa; identical to SEQ ID NO: 478570

SEQ ID NO: 735492 - RNA, 64 nt, hsa; identical to SEQ ID NO: 478571

SEQ ID NO: 735493 - RNA, 64 nt, hsa; identical to SEQ ID NO: 478572

SEQ ID NO: 735494 - RNA, 64 nt, hsa; identical to SEQ ID NO: 478573

SEQ ID NO: 735495 - RNA, 64 nt, hsa; identical to SEQ ID NO: 478574

SEQ ID NO: 735496 - RNA, 64 nt, hsa; identical to SEQ ID NO: 478575

SEQ ID NO: 735497 - RNA, 64 nt, hsa; identical to SEQ ID NO: 478576

SEQ ID NO: 735498 - RNA, 64 nt, hsa; identical to SEQ ID NO: 478577

SEQ ID NO: 735499 - RNA, 64 nt, hsa; identical to SEQ ID NO: 478578

SEQ ID NO: 735500 - RNA, 64 nt, hsa; identical to SEQ ID NO: 478579

SEQ ID NO: 735501 - RNA, 64 nt, hsa; identical to SEQ ID NO: 478580

SEQ ID NO: 735502 - RNA, 64 nt, hsa; identical to SEQ ID NO: 478581

SEQ ID NO: 735503 - RNA, 64 nt, hsa; identical to SEQ ID NO: 478582

SEQ ID NO: 735504 - RNA, 64 nt, hsa; identical to SEQ ID NO: 478583

SEQ ID NO: 735505 - RNA, 64 nt, hsa; identical to SEQ ID NO: 478584

SEQ ID NO: 735506 - RNA, 64 nt, hsa; identical to SEQ ID NO: 478585

SEQ ID NO: 735507 - RNA, 64 nt, hsa; identical to SEQ ID NO: 478586

SEQ ID NO: 735508 - RNA, 64 nt, hsa; identical to SEQ ID NO: 478587

SEQ ID NO: 735509 - RNA, 64 nt, hsa; identical to SEQ ID NO: 478588

SEQ ID NO: 735510 - RNA, 64 nt, hsa; identical to SEQ ID NO: 478589

SEQ ID NO: 735511 - RNA, 64 nt, hsa; identical to SEQ ID NO: 478590

SEQ ID NO: 735512 - RNA, 64 nt, hsa; identical to SEQ ID NO: 478591

SEQ ID NO: 735513 - RNA, 64 nt, hsa; identical to SEQ ID NO: 478592

SEQ ID NO: 735514 - RNA, 64 nt, hsa; identical to SEQ ID NO: 245406

SEQ ID NO: 735515 - RNA, 64 nt, hsa; identical to SEQ ID NO: 245407

SEQ ID NO: 735516 - RNA, 64 nt, hsa; identical to SEQ ID NO: 245408

SEQ ID NO: 735517 - RNA, 64 nt, hsa; identical to SEQ ID NO: 245409

SEQ ID NO: 735518 - RNA, 64 nt, hsa; identical to SEQ ID NO: 245410

SEQ ID NO: 735519 - RNA, 64 nt, hsa; identical to SEQ ID NO: 245411

SEQ ID NO: 735520 - RNA, 64 nt, hsa; identical to SEQ ID NO: 532305

SEQ ID NO: 735521 - RNA, 64 nt, hsa; identical to SEQ ID NO: 532306

SEQ ID NO: 735522 - RNA, 64 nt, hsa; identical to SEQ ID NO: 532307

SEQ ID NO: 735523 - RNA, 64 nt, hsa; identical to SEQ ID NO: 532308

SEQ ID NO: 735524 - RNA, 64 nt, hsa; identical to SEQ ID NO: 532309

SEQ ID NO: 735525 - RNA, 57 nt, hsa; identical to SEQ ID NO: 83127

SEQ ID NO: 735526 - RNA, 64 nt, hsa; identical to SEQ ID NO: 532311

SEQ ID NO: 735527 - RNA, 64 nt, hsa; identical to SEQ ID NO: 532312

SEQ ID NO: 735528 - RNA, 64 nt, hsa; identical to SEQ ID NO: 532313

SEQ ID NO: 735529 - RNA, 64 nt, hsa; identical to SEQ ID NO: 532314

SEQ ID NO: 735530 - RNA, 64 nt, hsa; identical to SEQ ID NO: 532315

SEQ ID NO: 735531 - RNA, 64 nt, hsa; identical to SEQ ID NO: 532316

SEQ ID NO: 735532 - RNA, 64 nt, hsa; identical to SEQ ID NO: 532317

SEQ ID NO: 735533 - RNA, 64 nt, hsa; identical to SEQ ID NO: 532318

SEQ ID NO: 735534 - RNA, 59 nt, hsa; identical to SEQ ID NO: 83136

SEQ ID NO: 735535 - RNA, 64 nt, hsa; identical to SEQ ID NO: 532320

SEQ ID NO: 735536 - RNA, 64 nt, hsa; identical to SEQ ID NO: 532321

SEQ ID NO: 735537 - RNA, 64 nt, hsa; identical to SEQ ID NO: 532322

SEQ ID NO: 735538 - RNA, 64 nt, hsa; identical to SEQ ID NO: 532323

SEQ ID NO: 735539 - RNA, 64 nt, hsa; identical to SEQ ID NO: 532324

SEQ ID NO: 735540 - RNA, 64 nt, hsa; identical to SEQ ID NO: 532325

SEQ ID NO: 735541 - RNA, 64 nt, hsa; identical to SEQ ID NO: 532326

SEQ ID NO: 735542 - RNA, 64 nt, hsa; identical to SEQ ID NO: 532327

SEQ ID NO: 735543 - RNA, 64 nt, hsa; identical to SEQ ID NO: 532328

SEQ ID NO: 735544 - RNA, 64 nt, hsa; identical to SEQ ID NO: 532329

SEQ ID NO: 735545 - RNA, 64 nt, hsa; identical to SEQ ID NO: 532330

SEQ ID NO: 735546 - RNA, 64 nt, hsa; identical to SEQ ID NO: 532331

SEQ ID NO: 735547 - RNA, 64 nt, hsa; identical to SEQ ID NO: 532332

SEQ ID NO: 735548 - RNA, 64 nt, hsa; identical to SEQ ID NO: 532333

SEQ ID NO: 735549 - RNA, 64 nt, hsa; identical to SEQ ID NO: 532334

SEQ ID NO: 735550 - RNA, 64 nt, hsa; identical to SEQ ID NO: 532335

SEQ ID NO: 735551 - RNA, 64 nt, hsa; identical to SEQ ID NO: 532336

SEQ ID NO: 735552 - RNA, 64 nt, hsa; identical to SEQ ID NO: 532337

SEQ ID NO: 735553 - RNA, 64 nt, hsa; identical to SEQ ID NO: 532338

SEQ ID NO: 735554 - RNA, 64 nt, hsa; identical to SEQ ID NO: 539759

SEQ ID NO: 735555 - RNA, 64 nt, hsa; identical to SEQ ID NO: 539760

SEQ ID NO: 735556 - RNA, 64 nt, hsa; identical to SEQ ID NO: 539761

SEQ ID NO: 735557 - RNA, 64 nt, hsa; identical to SEQ ID NO: 539762

SEQ ID NO: 735558 - RNA, 64 nt, hsa; identical to SEQ ID NO: 539763

SEQ ID NO: 735559 - RNA, 64 nt, hsa; identical to SEQ ID NO: 539764

SEQ ID NO: 735560 - RNA, 64 nt, hsa; identical to SEQ ID NO: 539765

SEQ ID NO: 735561 - RNA, 64 nt, hsa; identical to SEQ ID NO: 539766

SEQ ID NO: 735562 - RNA, 64 nt, hsa; identical to SEQ ID NO: 539767

SEQ ID NO: 735563 - RNA, 64 nt, hsa; identical to SEQ ID NO: 539768

SEQ ID NO: 735564 - RNA, 64 nt, hsa; identical to SEQ ID NO: 539769

SEQ ID NO: 735565 - RNA, 64 nt, hsa; identical to SEQ ID NO: 539770

SEQ ID NO: 735566 - RNA, 64 nt, hsa; identical to SEQ ID NO: 539771

SEQ ID NO: 735567 - RNA, 64 nt, hsa; identical to SEQ ID NO: 539772

SEQ ID NO: 735568 - RNA, 64 nt, hsa; identical to SEQ ID NO: 539773

SEQ ID NO: 735569 - RNA, 64 nt, hsa; identical to SEQ ID NO: 539774

SEQ ID NO: 735570 - RNA, 64 nt, hsa; identical to SEQ ID NO: 539775

SEQ ID NO: 735571 - RNA, 64 nt, hsa; identical to SEQ ID NO: 539776

SEQ ID NO: 735572 - RNA, 64 nt, hsa; identical to SEQ ID NO: 539777

SEQ ID NO: 735573 - RNA, 64 nt, hsa; identical to SEQ ID NO: 539778

SEQ ID NO: 735574 - RNA, 64 nt, hsa; identical to SEQ ID NO: 539779

SEQ ID NO: 735575 - RNA, 64 nt, hsa; identical to SEQ ID NO: 539780

SEQ ID NO: 735576 - RNA, 64 nt, hsa; identical to SEQ ID NO: 539781

SEQ ID NO: 735577 - RNA, 64 nt, hsa; identical to SEQ ID NO: 539782

SEQ ID NO: 735578 - RNA, 64 nt, hsa; identical to SEQ ID NO: 539783

SEQ ID NO: 735579 - RNA, 64 nt, hsa; identical to SEQ ID NO: 539784

SEQ ID NO: 735580 - RNA, 64 nt, hsa; identical to SEQ ID NO: 539785

SEQ ID NO: 735581 - RNA, 64 nt, hsa; identical to SEQ ID NO: 539786

SEQ ID NO: 735582 - RNA, 64 nt, hsa; identical to SEQ ID NO: 539787

SEQ ID NO: 735583 - RNA, 64 nt, hsa; identical to SEQ ID NO: 539788

SEQ ID NO: 735584 - RNA, 64 nt, hsa; identical to SEQ ID NO: 156567

SEQ ID NO: 735585 - RNA, 64 nt, hsa; identical to SEQ ID NO: 156568

SEQ ID NO: 735586 - RNA, 64 nt, hsa; identical to SEQ ID NO: 156569

SEQ ID NO: 735587 - RNA, 64 nt, hsa; identical to SEQ ID NO: 156570

SEQ ID NO: 735588 - RNA, 64 nt, hsa; identical to SEQ ID NO: 156571

SEQ ID NO: 735589 - RNA, 64 nt, hsa; identical to SEQ ID NO: 156572

SEQ ID NO: 735590 - RNA, 64 nt, hsa; identical to SEQ ID NO: 156573

SEQ ID NO: 735591 - RNA, 64 nt, hsa; identical to SEQ ID NO: 156574

SEQ ID NO: 735592 - RNA, 64 nt, hsa; identical to SEQ ID NO: 156575

SEQ ID NO: 735593 - RNA, 64 nt, hsa; identical to SEQ ID NO: 156576

SEQ ID NO: 735594 - RNA, 64 nt, hsa; identical to SEQ ID NO: 156577

SEQ ID NO: 735595 - RNA, 64 nt, hsa; identical to SEQ ID NO: 156578

SEQ ID NO: 735596 - RNA, 64 nt, hsa; identical to SEQ ID NO: 156579

SEQ ID NO: 735597 - RNA, 64 nt, hsa; identical to SEQ ID NO: 156580

SEQ ID NO: 735598 - RNA, 64 nt, hsa; identical to SEQ ID NO: 156581

SEQ ID NO: 735599 - RNA, 64 nt, hsa; identical to SEQ ID NO: 156582

SEQ ID NO: 735600 - RNA, 64 nt, hsa; identical to SEQ ID NO: 156583

SEQ ID NO: 735601 - RNA, 64 nt, hsa; identical to SEQ ID NO: 156584

SEQ ID NO: 735602 - RNA, 64 nt, hsa; identical to SEQ ID NO: 156585

SEQ ID NO: 735603 - RNA, 64 nt, hsa; identical to SEQ ID NO: 156586

SEQ ID NO: 735604 - RNA, 64 nt, hsa; identical to SEQ ID NO: 156587

SEQ ID NO: 735605 - RNA, 64 nt, hsa; identical to SEQ ID NO: 156588

SEQ ID NO: 735606 - RNA, 64 nt, hsa; identical to SEQ ID NO: 156589

SEQ ID NO: 735607 - RNA, 64 nt, hsa; identical to SEQ ID NO: 156590

SEQ ID NO: 735608 - RNA, 64 nt, hsa; identical to SEQ ID NO: 156591

SEQ ID NO: 735609 - RNA, 64 nt, hsa; identical to SEQ ID NO: 156592

SEQ ID NO: 735610 - RNA, 64 nt, hsa; identical to SEQ ID NO: 156593

SEQ ID NO: 735611 - RNA, 64 nt, hsa; identical to SEQ ID NO: 156594

SEQ ID NO: 735612 - RNA, 64 nt, hsa; identical to SEQ ID NO: 156595

SEQ ID NO: 735613 - RNA, 64 nt, hsa; identical to SEQ ID NO: 156596

SEQ ID NO: 735614 - RNA, 64 nt, hsa; identical to SEQ ID NO: 156597

SEQ ID NO: 735615 - RNA, 64 nt, hsa; identical to SEQ ID NO: 156598

SEQ ID NO: 735616 - RNA, 64 nt, hsa; identical to SEQ ID NO: 156599

SEQ ID NO: 735617 - RNA, 64 nt, hsa; identical to SEQ ID NO: 156600

SEQ ID NO: 735618 - RNA, 64 nt, hsa; identical to SEQ ID NO: 156601

SEQ ID NO: 735619 - RNA, 64 nt, hsa; identical to SEQ ID NO: 156602

SEQ ID NO: 735620 - RNA, 64 nt, hsa; identical to SEQ ID NO: 156603

SEQ ID NO: 735621 - RNA, 64 nt, hsa; identical to SEQ ID NO: 156604

SEQ ID NO: 735622 - RNA, 64 nt, hsa; identical to SEQ ID NO: 156605

SEQ ID NO: 735623 - RNA, 64 nt, hsa; identical to SEQ ID NO: 156606

SEQ ID NO: 735624 - RNA, 64 nt, hsa; identical to SEQ ID NO: 156607

SEQ ID NO: 735625 - RNA, 64 nt, hsa; identical to SEQ ID NO: 129730

SEQ ID NO: 735626 - RNA, 64 nt, hsa; identical to SEQ ID NO: 129731

SEQ ID NO: 735627 - RNA, 64 nt, hsa; identical to SEQ ID NO: 129732

SEQ ID NO: 735628 - RNA, 64 nt, hsa; identical to SEQ ID NO: 129733

SEQ ID NO: 735629 - RNA, 64 nt, hsa; identical to SEQ ID NO: 129734

SEQ ID NO: 735630 - RNA, 64 nt, hsa; identical to SEQ ID NO: 129735

SEQ ID NO: 735631 - RNA, 64 nt, hsa; identical to SEQ ID NO: 129736

SEQ ID NO: 735632 - RNA, 64 nt, hsa; identical to SEQ ID NO: 129737

SEQ ID NO: 735633 - RNA, 64 nt, hsa; identical to SEQ ID NO: 129738

SEQ ID NO: 735634 - RNA, 64 nt, hsa; identical to SEQ ID NO: 129739

SEQ ID NO: 735635 - RNA, 64 nt, hsa; identical to SEQ ID NO: 129740

SEQ ID NO: 735636 - RNA, 64 nt, hsa; identical to SEQ ID NO: 129741

SEQ ID NO: 735637 - RNA, 64 nt, hsa; identical to SEQ ID NO: 129742

SEQ ID NO: 735638 - RNA, 64 nt, hsa; identical to SEQ ID NO: 129743

SEQ ID NO: 735639 - RNA, 64 nt, hsa; identical to SEQ ID NO: 129744

SEQ ID NO: 735640 - RNA, 64 nt, hsa; identical to SEQ ID NO: 129745

SEQ ID NO: 735641 - RNA, 64 nt, hsa; identical to SEQ ID NO: 129746

SEQ ID NO: 735642 - RNA, 64 nt, hsa; identical to SEQ ID NO: 129747

SEQ ID NO: 735643 - RNA, 64 nt, hsa; identical to SEQ ID NO: 129748

SEQ ID NO: 735644 - RNA, 64 nt, hsa
ggccgacauuuuuaaaaaaguuuuauuuugcacggcucuaaaccuccauguuauuuuccagugg

SEQ ID NO: 735645 - RNA, 64 nt, hsa
aaucgacuaccagcugaugaaauaccugcaaagugcucuaaaaauuaaauauuuugacuuuaag

SEQ ID NO: 735646 - RNA, 64 nt, hsa; identical to SEQ ID NO: 166123

SEQ ID NO: 735647 - RNA, 64 nt, hsa; identical to SEQ ID NO: 166124

SEQ ID NO: 735648 - RNA, 64 nt, hsa; identical to SEQ ID NO: 166125

SEQ ID NO: 735649 - RNA, 64 nt, hsa; identical to SEQ ID NO: 166126

SEQ ID NO: 735650 - RNA, 64 nt, hsa; identical to SEQ ID NO: 166127

SEQ ID NO: 735651 - RNA, 64 nt, hsa; identical to SEQ ID NO: 166128

SEQ ID NO: 735652 - RNA, 64 nt, hsa; identical to SEQ ID NO: 166129

SEQ ID NO: 735653 - RNA, 64 nt, hsa; identical to SEQ ID NO: 166130

SEQ ID NO: 735654 - RNA, 64 nt, hsa; identical to SEQ ID NO: 166131

SEQ ID NO: 735655 - RNA, 64 nt, hsa; identical to SEQ ID NO: 166132

SEQ ID NO: 735656 - RNA, 64 nt, hsa; identical to SEQ ID NO: 166133

SEQ ID NO: 735657 - RNA, 64 nt, hsa; identical to SEQ ID NO: 166134

SEQ ID NO: 735658 - RNA, 64 nt, hsa; identical to SEQ ID NO: 166135

SEQ ID NO: 735659 - RNA, 64 nt, hsa; identical to SEQ ID NO: 166136

SEQ ID NO: 735660 - RNA, 64 nt, hsa; identical to SEQ ID NO: 166137

SEQ ID NO: 735661 - RNA, 64 nt, hsa; identical to SEQ ID NO: 166138

SEQ ID NO: 735662 - RNA, 64 nt, hsa; identical to SEQ ID NO: 166139

SEQ ID NO: 735663 - RNA, 64 nt, hsa; identical to SEQ ID NO: 166140

SEQ ID NO: 735664 - RNA, 64 nt, hsa; identical to SEQ ID NO: 166141

SEQ ID NO: 735665 - RNA, 64 nt, hsa; identical to SEQ ID NO: 166142

SEQ ID NO: 735666 - RNA, 64 nt, hsa; identical to SEQ ID NO: 166143

SEQ ID NO: 735667 - RNA, 64 nt, hsa; identical to SEQ ID NO: 166144

SEQ ID NO: 735668 - RNA, 64 nt, hsa; identical to SEQ ID NO: 166145

SEQ ID NO: 735669 - RNA, 64 nt, hsa; identical to SEQ ID NO: 166146

SEQ ID NO: 735670 - RNA, 64 nt, hsa; identical to SEQ ID NO: 166147

SEQ ID NO: 735671 - RNA, 64 nt, hsa; identical to SEQ ID NO: 166148

SEQ ID NO: 735672 - RNA, 64 nt, hsa; identical to SEQ ID NO: 166149

SEQ ID NO: 735673 - RNA, 64 nt, hsa; identical to SEQ ID NO: 102210

SEQ ID NO: 735674 - RNA, 64 nt, hsa; identical to SEQ ID NO: 102211

SEQ ID NO: 735675 - RNA, 64 nt, hsa; identical to SEQ ID NO: 102212

SEQ ID NO: 735676 - RNA, 64 nt, hsa; identical to SEQ ID NO: 102213

SEQ ID NO: 735677 - RNA, 64 nt, hsa; identical to SEQ ID NO: 102214

SEQ ID NO: 735678 - RNA, 64 nt, hsa; identical to SEQ ID NO: 102215

SEQ ID NO: 735679 - RNA, 64 nt, hsa; identical to SEQ ID NO: 102216

SEQ ID NO: 735680 - RNA, 64 nt, hsa; identical to SEQ ID NO: 102217

SEQ ID NO: 735681 - RNA, 64 nt, hsa; identical to SEQ ID NO: 102218

SEQ ID NO: 735682 - RNA, 64 nt, hsa; identical to SEQ ID NO: 102219

SEQ ID NO: 735683 - RNA, 64 nt, hsa; identical to SEQ ID NO: 102220

SEQ ID NO: 735684 - RNA, 64 nt, hsa; identical to SEQ ID NO: 102221

SEQ ID NO: 735685 - RNA, 64 nt, hsa; identical to SEQ ID NO: 102222

SEQ ID NO: 735686 - RNA, 64 nt, hsa; identical to SEQ ID NO: 102223

SEQ ID NO: 735687 - RNA, 64 nt, hsa; identical to SEQ ID NO: 102224

SEQ ID NO: 735688 - RNA, 64 nt, hsa; identical to SEQ ID NO: 102225

SEQ ID NO: 735689 - RNA, 64 nt, hsa; identical to SEQ ID NO: 102226

SEQ ID NO: 735690 - RNA, 64 nt, hsa; identical to SEQ ID NO: 102227

SEQ ID NO: 735691 - RNA, 64 nt, hsa; identical to SEQ ID NO: 102228

SEQ ID NO: 735692 - RNA, 64 nt, hsa; identical to SEQ ID NO: 102229

SEQ ID NO: 735693 - RNA, 64 nt, hsa; identical to SEQ ID NO: 102230

SEQ ID NO: 735694 - RNA, 64 nt, hsa; identical to SEQ ID NO: 102231

SEQ ID NO: 735695 - RNA, 64 nt, hsa; identical to SEQ ID NO: 102232

SEQ ID NO: 735696 - RNA, 64 nt, hsa; identical to SEQ ID NO: 102233

SEQ ID NO: 735697 - RNA, 64 nt, hsa; identical to SEQ ID NO: 102234

SEQ ID NO: 735698 - RNA, 64 nt, hsa; identical to SEQ ID NO: 102235

SEQ ID NO: 735699 - RNA, 64 nt, hsa; identical to SEQ ID NO: 102236

SEQ ID NO: 735700 - RNA, 64 nt, hsa; identical to SEQ ID NO: 102237

SEQ ID NO: 735701 - RNA, 64 nt, hsa; identical to SEQ ID NO: 102238

SEQ ID NO: 735702 - RNA, 64 nt, hsa; identical to SEQ ID NO: 102239

SEQ ID NO: 735703 - RNA, 64 nt, hsa; identical to SEQ ID NO: 102240

SEQ ID NO: 735704 - RNA, 64 nt, hsa; identical to SEQ ID NO: 102241

SEQ ID NO: 735705 - RNA, 64 nt, hsa; identical to SEQ ID NO: 102242

SEQ ID NO: 735706 - RNA, 64 nt, hsa; identical to SEQ ID NO: 55156

SEQ ID NO: 735707 - RNA, 64 nt, hsa; identical to SEQ ID NO: 55157

SEQ ID NO: 735708 - RNA, 64 nt, hsa; identical to SEQ ID NO: 55157

SEQ ID NO: 735709 - RNA, 64 nt, hsa; identical to SEQ ID NO: 55159

SEQ ID NO: 735710 - RNA, 64 nt, hsa; identical to SEQ ID NO: 55160

SEQ ID NO: 735711 - RNA, 64 nt, hsa; identical to SEQ ID NO: 55161

SEQ ID NO: 735712 - RNA, 64 nt, hsa; identical to SEQ ID NO: 55162

SEQ ID NO: 735713 - RNA, 63 nt, hsa; identical to SEQ ID NO: 55163

SEQ ID NO: 735714 - RNA, 64 nt, hsa; identical to SEQ ID NO: 55164

SEQ ID NO: 735715 - RNA, 64 nt, hsa; identical to SEQ ID NO: 55165

SEQ ID NO: 735716 - RNA, 64 nt, hsa; identical to SEQ ID NO: 580105

SEQ ID NO: 735717 - RNA, 64 nt, hsa; identical to SEQ ID NO: 580106

SEQ ID NO: 735718 - RNA, 64 nt, hsa; identical to SEQ ID NO: 580107

SEQ ID NO: 735719 - RNA, 64 nt, hsa; identical to SEQ ID NO: 580108

SEQ ID NO: 735720 - RNA, 64 nt, hsa; identical to SEQ ID NO: 580109

SEQ ID NO: 735721 - RNA, 64 nt, hsa; identical to SEQ ID NO: 580110

SEQ ID NO: 735722 - RNA, 64 nt, hsa; identical to SEQ ID NO: 580111

SEQ ID NO: 735723 - RNA, 64 nt, hsa; identical to SEQ ID NO: 580112

SEQ ID NO: 735724 - RNA, 64 nt, hsa; identical to SEQ ID NO: 580113

SEQ ID NO: 735725 - RNA, 64 nt, hsa; identical to SEQ ID NO: 580114

SEQ ID NO: 735726 - RNA, 64 nt, hsa; identical to SEQ ID NO: 580115

SEQ ID NO: 735727 - RNA, 64 nt, hsa; identical to SEQ ID NO: 580116

SEQ ID NO: 735728 - RNA, 64 nt, hsa; identical to SEQ ID NO: 580117

SEQ ID NO: 735729 - RNA, 64 nt, hsa; identical to SEQ ID NO: 580118

SEQ ID NO: 735730 - RNA, 64 nt, hsa; identical to SEQ ID NO: 580119

SEQ ID NO: 735731 - RNA, 64 nt, hsa; identical to SEQ ID NO: 580120

SEQ ID NO: 735732 - RNA, 64 nt, hsa; identical to SEQ ID NO: 580121

SEQ ID NO: 735733 - RNA, 64 nt, hsa; identical to SEQ ID NO: 580122

SEQ ID NO: 735734 - RNA, 64 nt, hsa; identical to SEQ ID NO: 580123

SEQ ID NO: 735735 - RNA, 64 nt, hsa; identical to SEQ ID NO: 580124

SEQ ID NO: 735736 - RNA, 64 nt, hsa; identical to SEQ ID NO: 580125

SEQ ID NO: 735737 - RNA, 64 nt, hsa; identical to SEQ ID NO: 580126

SEQ ID NO: 735738 - RNA, 64 nt, hsa; identical to SEQ ID NO: 580127

SEQ ID NO: 735739 - RNA, 64 nt, hsa; identical to SEQ ID NO: 580128

SEQ ID NO: 735740 - RNA, 64 nt, hsa
ccuuuuccacccugggccccaaugccguccuuuccccgcagagacuggucuuggaaacccucag

SEQ ID NO: 735741 - RNA, 64 nt, hsa
acccuuaccgguggcucuuccugccugggacccucccgcagagucccacuagccagcggccuca

SEQ ID NO: 735742 - RNA, 64 nt, hsa
ccagagcagccaggcuggggccccucugucucaacccgcagacccuugacugaaugagagaggc

SEQ ID NO: 735743 - RNA, 64 nt, hsa
agcuggcauggucagguaacacuaguggcccagccccgcagacccacaagcccuacccgugcug

SEQ ID NO: 735744 - RNA, 64 nt, hsa
ugggacaugaggggcagcuagacuucacccccuucccgcagaccugccuccagagcaaggagaa

SEQ ID NO: 735745 - RNA, 64 nt, hsa
ggcaucaccugucaaaaauggaguuccacuucuccccgcagaccuaggucagacuuuuccuuuc

SEQ ID NO: 735746 - RNA, 64 nt, hsa
ggagaggcaguacgcauccuuacccaggggaggacccgcagauccuguagacuaucugccagca

SEQ ID NO: 735747 - RNA, 64 nt, hsa
aggguguugggauacugcagggccaggacugagccccgcagaccuccccagccccuagcccagg

SEQ ID NO: 735748 - RNA, 64 nt, hsa
agagaggcccgcccgcccaccgugggcagugccacccgcagaugacacgcgcucuccaccaccc

SEQ ID NO: 735749 - RNA, 64 nt, hsa
guggucacagcggagguguggagccgaggccuaccccgcagacaccuuggacauccuccuccca

SEQ ID NO: 735750 - RNA, 64 nt, hsa
gcgguagggcguggaaaggggcaggccagagcuacccgcagaguucucagaaucaugcugagag

SEQ ID NO: 735751 - RNA, 64 nt, hsa
guggggcccagacaccagccuagccuggcucugccccgcagacggucugugugcuguuugaaaa

SEQ ID NO: 735752 - RNA, 64 nt, hsa
gcagagcuggcugcuggacgcaccgugcucgcugcccgcagaagcggcacugugcuggcgggcu

SEQ ID NO: 735753 - RNA, 64 nt, hsa
cugagacucuguuuaucacuagccuucugucccucccgcagaagacuguuggauugaacaaaau

SEQ ID NO: 735754 - RNA, 64 nt, hsa
ugagucccuggcaguagccuuggggcagagggcacccgcagagucccagagaugaugugggcag

SEQ ID NO: 735755 - RNA, 64 nt, hsa
agacccguucagacacugcguugcgggcuccuuccccgcagaggccggggccucccugacuuug

SEQ ID NO: 735756 - RNA, 64 nt, hsa
gugccaguagccuaggugucucaggccccugggccccgcagauggccauuuccggugccugccc

SEQ ID NO: 735757 - RNA, 64 nt, hsa
ccagugugaaguuucuggcauagaguccuggcuucccgcagacgacuuucacacucugccaugu

SEQ ID NO: 735758 - RNA, 64 nt, hsa
aagcgcugagcugagggacgaggaagagcuggagcccgcagaagccguccacagcccugccuca

SEQ ID NO: 735759 - RNA, 64 nt, hsa
aaugcaccauguccugaaagauggcacccucccacccgcagagugcuuccugcaagcuggcguu

SEQ ID NO: 735760 - RNA, 64 nt, hsa
uuaaggagguagcucccagcacucaaccaaccuccccgcagagcucccuuccugacccuccgcu

SEQ ID NO: 735761 - RNA, 64 nt, hsa
gccucggagcccggcccgcccuccggcuacaauccccgcagagucuccggugcagacgcgcugc

SEQ ID NO: 735762 - RNA, 64 nt, hsa
aacggaauaguguggggugugugcagggcugcaucccgcagauggcuggaauauuaaaauucuu

SEQ ID NO: 735763 - RNA, 64 nt, hsa
gauccuggccugagaauugaggggagguggccagcccgcagagguggggugcuggggcugcaug

SEQ ID NO: 735764 - RNA, 64 nt, hsa
cccugggucgcagacgaggucggccucgucauuccccgcagaccgccgcgcgucccucuugugc

SEQ ID NO: 735765 - RNA, 64 nt, hsa
cuuuaucuuccgaggccaccguuuaacaggaguccccgcagauggguucugcccuguggaguau

SEQ ID NO: 735766 - RNA, 64 nt, hsa
guuguuuagcuuaccuuucugcuaggauuggcuucccgcagagggcagggcccauccuaagcag

SEQ ID NO: 735767 - RNA, 64 nt, hsa
augcgcuuguuggcgcgacuguggcucgagcuggcccgcagacacguggguuucaucacucuga

SEQ ID NO: 735768 - RNA, 64 nt, hsa
aagcauugcucaggguggggggcugggaccauggcccgcagaggcacugccacagcugugaggg

SEQ ID NO: 735769 - RNA, 64 nt, hsa
cccuggcaccaugcacggccagcaagaaucaaggcccgcagaugcuaagagggccuauugucag

SEQ ID NO: 735770 - RNA, 64 nt, hsa
auuacaagccuuuuuaagauaugaaauaugccuacccgcagagcuuggcacaaaguggagucaa

SEQ ID NO: 735771 - RNA, 64 nt, hsa
gcggcguggaccgagggucccagccugcaggcuccccgcagagagcacaggaagaggcaggggc

SEQ ID NO: 735772 - RNA, 64 nt, hsa
ccccaggugccccccucaccuugaugggugcguucccgcagaccaaagagagugugacucccuu

SEQ ID NO: 735773 - RNA, 64 nt, hsa
aaggccccaggaguggcaccuuagugugggucggcccgcagauggcacccaaggccgggaaggg

SEQ ID NO: 735774 - RNA, 64 nt, hsa
cacccaggguggggaggccacccuuccugcccuacccgcagaauggugcucuccuuugcccucc

SEQ ID NO: 735775 - RNA, 64 nt, hsa
uucagcagaaugacucuggaaccauccucuguuacccgcagauccugucccaugggcucuggcc

SEQ ID NO: 735776 - RNA, 64 nt, hsa
aagcagguggugguggaaauuccagcaggugggucccgcagaggcccugaggccucacuuuucg

SEQ ID NO: 735777 - RNA, 64 nt, hsa
ugagacuccccgcccgcccuccucugcccccucccccgcagacagacagacagacggacgggac

SEQ ID NO: 735778 - RNA, 64 nt, hsa
ugaagucacgccuuggcccugacauccccacaugcccgcagagauccucuuugagugucugucu

SEQ ID NO: 735779 - RNA, 64 nt, hsa
uccugcccauauauuauaccaguugcuucugcagcccgcagaugccagcgaugccaggaaacaa

SEQ ID NO: 735780 - RNA, 64 nt, hsa
ccuucuggccccucugaggauucccuagggcugccccgcagaggggcuuccccaagcucuguuu

SEQ ID NO: 735781 - RNA, 64 nt, hsa
ggaucaugucccauccaguccagugaauccacgacccgcagaccuguccccccgcaacagcuua

SEQ ID NO: 735782 - RNA, 64 nt, hsa
uggcaugccccccagcuacuguaugcccccgacccccgcagaggcagaaugaacccauagggag

SEQ ID NO: 735783 - RNA, 64 nt, hsa
cacgcacgaccccaagcccgcggaggcaccgaugcccgcagagcccgcaccccccggcccugcc

SEQ ID NO: 735784 - RNA, 64 nt, hsa
ccgacuuguggcucggacccagggaccuucagggcccgcagacccucccggcgccuugagaccc

SEQ ID NO: 735785 - RNA, 64 nt, hsa
gccucauuucauccuugcaacagcucugcagggccccgcagaugaggaaauccguaggcaggag

SEQ ID NO: 735786 - RNA, 64 nt, hsa
ggaaaaacuucaagaagaaaagaaucgucacgaccccgcagacuguccuccggauaaacagcau

SEQ ID NO: 735787 - RNA, 64 nt, hsa
aagcaaagaggcucuuuagaggcagcgggggaggcccgcagagcgcgccccuagccgguuccug

SEQ ID NO: 735788 - RNA, 64 nt, hsa
ucugucuugcugccggccuugauaccaccccucacccgcagagucacugcauucccucccagcc

SEQ ID NO: 735789 - RNA, 64 nt, hsa
acuuccaugcugagugaugcucagggaagugaugcccgcagaaggcgucugggccuaaggaucc

SEQ ID NO: 735790 - RNA, 61 nt, hsa; identical to SEQ ID NO: 481711

SEQ ID NO: 735791 - RNA, 64 nt, hsa
ugaaggucaggaggcaaguggaggauggacugggcccgcagaugcccugaccucugcccccagg

SEQ ID NO: 735792 - RNA, 64 nt, hsa
aggggcacacagacuguggcagagcugcgcccaucccgcagaggccccuguccaccuggagacc

SEQ ID NO: 735793 - RNA, 64 nt, hsa
cugggccucggcccuucccgcaccgccgccagcgcccgcagacacccuggcaucucaagaggga

SEQ ID NO: 735794 - RNA, 64 nt, hsa
ccccuccuaccccugggcagguguccagcgcagccccgcagagcuccaggguggccaaguggau

SEQ ID NO: 735795 - RNA, 64 nt, hsa
cggggugcagaucuccuggcguguccaccauggccccgcagaacgccagggaccgccugcugcc

SEQ ID NO: 735796 - RNA, 64 nt, hsa
uucucugagccgcggacaugcccucgcauugcuucccgcagagugcagagacaggaagcuggag

SEQ ID NO: 735797 - RNA, 64 nt, hsa
gcugaggauggagccgcccccagccgacuccaagcccgcagagggcagacgccacccuggacug

SEQ ID NO: 735798 - RNA, 64 nt, hsa
gggaggauuccagaacagcagcacugagcucccacccgcagagccucuggacggccuuggcaac

SEQ ID NO: 735799 - RNA, 64 nt, hsa
ccaaggacgccuaccccgaaaccggccccgacgccccgcagaggcccgccugaagccagcccgg

SEQ ID NO: 735800 - RNA, 61 nt, hsa; identical to SEQ ID NO: 481721

SEQ ID NO: 735801 - RNA, 64 nt, hsa
ccaaaccacucaggacaguacccguggcacugggcccgcagaagcaagggaugacuugguucuu

SEQ ID NO: 735802 - RNA, 64 nt, hsa
cagaggcccccgagguguguguaggaggcggaggcccgcagagcacagagcaggagaagggcuu

SEQ ID NO: 735803 - RNA, 64 nt, hsa
ccgaguuggggggaggggguguggcaacgugccccccgcagaggccacgcauguuugaccaaag

SEQ ID NO: 735804 - RNA, 64 nt, hsa
acugagucuuuuggaggcuccaagccucaaagugcccgcagagcccaccuugaggguuuugcua

SEQ ID NO: 735805 - RNA, 64 nt, hsa
cauaguguagauggacauuugccacaacacacugcccgcagaaauggacuuaccgugaagccaa

SEQ ID NO: 735806 - RNA, 64 nt, hsa
ggguggcgcuucucagccggcugucccagccagccccgcagagcgcccacggacaguguccacu

SEQ ID NO: 735807 - RNA, 64 nt, hsa
cuuuccaggagccccaggcccggaggaggcgaagcccgcagagcaaagguggaaacacgugccu

SEQ ID NO: 735808 - RNA, 64 nt, hsa
gagggccaaggacaauugggagggcagcaggcagcccgcagaugguggccauguggcacgcugc

SEQ ID NO: 735809 - RNA, 64 nt, hsa
ggccccuccuucugcugccuggccaagccccacacccgcagacccuccuucccauccucugaaa

SEQ ID NO: 735810 - RNA, 64 nt, hsa
acgguacccggccgccguucugcaaugcaucacucccgcagaggggggugcagaucaggcgccg

SEQ ID NO: 735811 - RNA, 64 nt, hsa
cacugaacagaacgucgcugauggagaaagggcucccgcagaaggaacggccuguaccgugcgc

SEQ ID NO: 735812 - RNA, 64 nt, hsa
uguguaugcgagcgcccgccucccagccccggugcccgcagaagacgcuuuuccccagcagguc

SEQ ID NO: 735813 - RNA, 64 nt, hsa
gggcccucgggaagccuuggacagaacccuccaccccgcagaccaggcgucguguguguguggg

SEQ ID NO: 735814 - RNA, 64 nt, hsa
guacgggggcgcggcagggguccccggccccucccccgcagaggucaaugccaacgaacaaacg

SEQ ID NO: 735815 - RNA, 64 nt, hsa
ccgcccccuccgccgccccuuccccagcccugcccccgcagacucccccugccgccaagacuuc

SEQ ID NO: 735816 - RNA, 64 nt, hsa
gcgguuucggggcucccccuuccucucccucccucccgcagaaggggguuuuaggggccugggc

SEQ ID NO: 735817 - RNA, 64 nt, hsa
gggcugggccccuccaggagucacagaugaggcccccgcagagacuggugaguggugacccugu

SEQ ID NO: 735818 - RNA, 64 nt, hsa
ggguccggaagggugaucaucgacccccaagggacccgcagacccuuaaaaaaaucacccacaa

SEQ ID NO: 735819 - RNA, 56 nt, hsa; identical to SEQ ID NO: 481740

SEQ ID NO: 735820 - RNA, 64 nt, hsa
guggaggucagaguggaagcaggugugagagggucccgcagaagaaaacauggcugccaaagug

SEQ ID NO: 735821 - RNA, 64 nt, hsa
uccgggagcugauggccccucucucccggcuccgcccgcagacucuggcuccuccgacuacacc

SEQ ID NO: 735822 - RNA, 64 nt, hsa
gcccauccccccucagauccagacaugccccucccccgcagacacaccccaaggcagcccaacc

SEQ ID NO: 735823 - RNA, 64 nt, hsa
ccuccacuccaccuccacccacuguccgccucugcccgcagagcccacgcccgacuagcaggca

SEQ ID NO: 735824 - RNA, 64 nt, hsa
ggugugaggggcuuggccugcgccccgccagcugcccgcagaggugcagccucgaggaaucuga

SEQ ID NO: 735825 - RNA, 64 nt, hsa
gacuaggcguggaccugcccauggugccugucagcccgcagagcccaucuacgcccaacacaga

SEQ ID NO: 735826 - RNA, 64 nt, hsa
cugggacaucugaggauugggauucuuuguucaccccgcagauaguuaaugaauggucugcccu

SEQ ID NO: 735827 - RNA, 64 nt, hsa
agauuaacggugcuaaccccgucugcuccucccucccgcagagacuggggccuggacuggacau

SEQ ID NO: 735828 - RNA, 64 nt, hsa
gccccguccucugcugcuggccucugggucgugccccgcagacugagcugcgcuuggggguccu

SEQ ID NO: 735829 - RNA, 60 nt, hsa; identical to SEQ ID NO: 481750

SEQ ID NO: 735830 - RNA, 64 nt, hsa
ccccacgccucggggcccccgccgccccuccggacccgcagagcuggggacauggcaugcccug

SEQ ID NO: 735831 - RNA, 64 nt, hsa
ggugagcuagcccuuagagaaggcugucccggggcccgcagaggugcccuuacugaggugacag

SEQ ID NO: 735832 - RNA, 64 nt, hsa
agcuaccugagccugacgcccgagcaguggaggucccgcagaagcuacagcugccaggucaugc

SEQ ID NO: 735833 - RNA, 64 nt, hsa
ugccccucuccaauagguguggccccuaccagaccccgcagacccgggcacuucucagcauggc

SEQ ID NO: 735834 - RNA, 64 nt, hsa
ggccuaaguauguggagcucugcuuuggcacugccccgcagaggccacgccuauuuauucuguu

SEQ ID NO: 735835 - RNA, 64 nt, hsa
ccuguccccaaauuggccucgguggcaggggagccccgcagagcuggacagcgacacgcagggg

SEQ ID NO: 735836 - RNA, 64 nt, hsa
auuccugaccauccucagaaucucaugccauuuucccgcagagcugagggauguggucagcagu

SEQ ID NO: 735837 - RNA, 57 nt, hsa
uggagaauaggaagggcauuccaggcagagggaaaccugugcagagaccaagaggug

SEQ ID NO: 735838 - RNA, 57 nt, hsa
ggccugccccagcuccuugcccagggagagggaaagaguuaacggugugggccacuc

SEQ ID NO: 735839 - RNA, 57 nt, hsa
gcugcacucgguccagaggccagcuaggagggaaaccgcagcuuccuggggcuugug

SEQ ID NO: 735840 - RNA, 57 nt, hsa
cugacccagucggagccugacaugguggagggaaagggagacaaguggggcugcacu

SEQ ID NO: 735841 - RNA, 57 nt, hsa
gugggggccucucuggaagcacauuuggagggaaagacaagagagccaugaggagag

SEQ ID NO: 735842 - RNA, 57 nt, hsa
ggagcccucccaccccacccccagauagagggaaauaaccaaaaaacuaccaaacaa

SEQ ID NO: 735843 - RNA, 57 nt, hsa
ugacggggaaacaaaauuauucucugagagggaaaggacauuugagggaaacaucaa

SEQ ID NO: 735844 - RNA, 57 nt, hsa
uuauucucugagagggaaaggacauuugagggaaacaucaaauuuccccauaaauaa

SEQ ID NO: 735845 - RNA, 57 nt, hsa
uugcugaaacacacaggccauuucauugagggaaaacauaauaucuugaagaauauu

SEQ ID NO: 735846 - RNA, 57 nt, hsa
uuuucaaaacgccauguccuaggggccgagggaaaugcuguuggugagaaucgaccu

SEQ ID NO: 735847 - RNA, 57 nt, hsa
ugauauucucagaggcaggggaaaauagagggaaaaauagagacuauugguauguuc

SEQ ID NO: 735848 - RNA, 57 nt, hsa
ccacuggacgggaaggagaacagaggagagggaaagagaagcccaaccucugugauc

SEQ ID NO: 735849 - RNA, 57 nt, hsa
cuguaauuucaguuuuugugucggggagagggaaaaacuauuugucuguaguugcuu

SEQ ID NO: 735850 - RNA, 57 nt, hsa
cuguaaugagaauagacuggaacaugugagggaaaaauauuuaaaaaaagauggcag

SEQ ID NO: 735851 - RNA, 57 nt, hsa
uucagaaaauuauuuuaaaagaugaaagagggaaauaggccauggacgguggcucac

SEQ ID NO: 735852 - RNA, 57 nt, hsa
gaugaaaagagaagguacccuaaggcugagggaaagaauccuaacaaggaaaggcag

SEQ ID NO: 735853 - RNA, 57 nt, hsa
uggaaguuuuccauucacuggggaaaggagggaaaagugcauuuauuuuuauacaga

SEQ ID NO: 735854 - RNA, 57 nt, hsa
guuuguuuauuugguuggcuuuuuggagagggaaauuuggaaacgggacauacacaa

SEQ ID NO: 735855 - RNA, 57 nt, hsa
acuuuggugcuacuacccccauuaccugagggaaacuggccagguccuugaucaugg

SEQ ID NO: 735856 - RNA, 57 nt, hsa
caacuuucagaaauucagggagcuggagagggaaaucuuuuuuuuucccccugagug

SEQ ID NO: 735857 - RNA, 57 nt, hsa
aaauuauuucagagaugugugcuccuggagggaaaaagaaauacagccucaacagau

SEQ ID NO: 735858 - RNA, 57 nt, hsa
gcaacgacccaagcacuuauuuuuuaagagggaaaggacuuuggucauguuuacauu

SEQ ID NO: 735859 - RNA, 57 nt, hsa
guggcauauacugcacauacugaaauagagggaaaucacugaauguaaagagguuuc

SEQ ID NO: 735860 - RNA, 57 nt, hsa
gagggggcuacagcagcaucaugcaaagagggaaagaugaagggauagaagaagaga

SEQ ID NO: 735861 - RNA, 57 nt, hsa
aaaacaauuaacguaagagcuacaaaggagggaaaaggaaccaagaaguagaaggag

SEQ ID NO: 735862 - RNA, 57 nt, hsa
ucccaguaacuucuaccugccagcccagagggaaauauggauuuucacaccuugccu

SEQ ID NO: 735863 - RNA, 57 nt, hsa
gggcucuggggaggcugugggccuggagagggaaaaggagggagggggugucugcac

SEQ ID NO: 735864 - RNA, 57 nt, hsa
accaacauucaaauucugccucaucuggagggaaaccaaaauugggagggggaagag

SEQ ID NO: 735865 - RNA, 57 nt, hsa
gacggggguggggggugguaguggugggagggaaaccaugucuugcuaaaccuguuu

SEQ ID NO: 735866 - RNA, 57 nt, hsa
guuguuugcuuaaaaaaaauuucaugugagggaaaaaaaaaaaaccuauuccagaau

SEQ ID NO: 735867 - RNA, 57 nt, hsa
guuuuaacgaguaauuggauaaacccugagggaaaacggagguagauucagcaccua

SEQ ID NO: 735868 - RNA, 57 nt, hsa
ucaauaaaaauucaaauaauuuguacugagggaaacaguuauacuacaaaucauguu

SEQ ID NO: 735869 - RNA, 57 nt, hsa
agguacaccuuaugaaucgcaucaauagagggaaauuuucagcuacaaucuuugcuc

SEQ ID NO: 735870 - RNA, 57 nt, hsa
cuggggagggaggcaggugggugguaagagggaaacucuggagagccugcacccagg

SEQ ID NO: 735871 - RNA, 57 nt, hsa
auuccaagugauggaacuccagggguggagggaaauuggcaguuccuggcaucucuu

SEQ ID NO: 735872 - RNA, 57 nt, hsa
auguuccuacagagggaaagaccuacagagggaaagacccucgggccgcuccccugc

SEQ ID NO: 735873 - RNA, 57 nt, hsa
uuccagaaucuucuggauguuccuacagagggaaagaccuacagagggaaagacccu

SEQ ID NO: 735874 - RNA, 57 nt, hsa
gcuucuuuagauggaauaaugggaaaggagggaaaugggaaauggauggaaauggga

SEQ ID NO: 735875 - RNA, 57 nt, hsa
aaugggaaauggauggaaaugggaaaggagggaaaauaauagcccagugagagcuga

SEQ ID NO: 735876 - RNA, 57 nt, hsa
aagauauauugauuaugcuguucuguugagggaaaggucauguauuuagaaauuuaa

SEQ ID NO: 735877 - RNA, 57 nt, hsa
uucagcucaccuuccaugauugcuuuugagggaaaagcuacaguggccacauuucag

SEQ ID NO: 735878 - RNA, 57 nt, hsa
uuuguaauugugagacauuuucuuggggagggaaaauuggaaugguucccuuuuuua

SEQ ID NO: 735879 - RNA, 57 nt, hsa
uuuuuguguuuaaaaaaaaauaggaaagagggaaacugcagcuuucauuacagauuc

SEQ ID NO: 735880 - RNA, 57 nt, hsa
agagagacagaggggaagagaggcagagagggaaagaggcagagaaggaaagagaca

SEQ ID NO: 735881 - RNA, 57 nt, hsa
ggcccaggugcauaaaugggggucagggagggaaaggaggagggagagagauggaga

SEQ ID NO: 735882 - RNA, 57 nt, hsa
cuccuuccucuacauuuuaaagggggagagggaaaaguaaccgggagacaaauugag

SEQ ID NO: 735883 - RNA, 57 nt, hsa
ccaauaugacuggaguccuuaucggaagagggaaauucagacacagaugcauaggga

SEQ ID NO: 735884 - RNA, 57 nt, hsa
gcuuucacagggugggaaacgaaauucgagggaaauuccccggaaauaugagggaaa

SEQ ID NO: 735885 - RNA, 57 nt, hsa
aauucgagggaaauuccccggaaauaugagggaaaucucugcauugcaccaccagag

SEQ ID NO: 735886 - RNA, 57 nt, hsa
uccucuucuuuuagcaguaaaauagcugagggaaaagggagggaaaaggaaguuaug

SEQ ID NO: 735887 - RNA, 57 nt, hsa
uagcaguaaaauagcugagggaaaagggagggaaaaggaaguuaugggaauaccugu

SEQ ID NO: 735888 - RNA, 64 nt, hsa; identical to SEQ ID NO: 283773

SEQ ID NO: 735889 - RNA, 64 nt, hsa; identical to SEQ ID NO: 283774

SEQ ID NO: 735890 - RNA, 64 nt, hsa; identical to SEQ ID NO: 283775

SEQ ID NO: 735891 - RNA, 64 nt, hsa; identical to SEQ ID NO: 283776

SEQ ID NO: 735892 - RNA, 64 nt, hsa; identical to SEQ ID NO: 283777

SEQ ID NO: 735893 - RNA, 64 nt, hsa; identical to SEQ ID NO: 283778

SEQ ID NO: 735894 - RNA, 64 nt, hsa; identical to SEQ ID NO: 283779

SEQ ID NO: 735895 - RNA, 64 nt, hsa; identical to SEQ ID NO: 283780

SEQ ID NO: 735896 - RNA, 64 nt, hsa; identical to SEQ ID NO: 283781

SEQ ID NO: 735897 - RNA, 64 nt, hsa; identical to SEQ ID NO: 283782

SEQ ID NO: 735898 - RNA, 64 nt, hsa; identical to SEQ ID NO: 283783

SEQ ID NO: 735899 - RNA, 64 nt, hsa; identical to SEQ ID NO: 283784

SEQ ID NO: 735900 - RNA, 64 nt, hsa; identical to SEQ ID NO: 283785

SEQ ID NO: 735901 - RNA, 64 nt, hsa; identical to SEQ ID NO: 283786

SEQ ID NO: 735902 - RNA, 64 nt, hsa; identical to SEQ ID NO: 283787

SEQ ID NO: 735903 - RNA, 64 nt, hsa; identical to SEQ ID NO: 283788

SEQ ID NO: 735904 - RNA, 64 nt, hsa; identical to SEQ ID NO: 283789

SEQ ID NO: 735905 - RNA, 64 nt, hsa; identical to SEQ ID NO: 283790

SEQ ID NO: 735906 - RNA, 64 nt, hsa; identical to SEQ ID NO: 283791

SEQ ID NO: 735907 - RNA, 64 nt, hsa; identical to SEQ ID NO: 283792

SEQ ID NO: 735908 - RNA, 64 nt, hsa; identical to SEQ ID NO: 283793

SEQ ID NO: 735909 - RNA, 64 nt, hsa; identical to SEQ ID NO: 283794

SEQ ID NO: 735910 - RNA, 64 nt, hsa; identical to SEQ ID NO: 283795

SEQ ID NO: 735911 - RNA, 64 nt, hsa; identical to SEQ ID NO: 283796

SEQ ID NO: 735912 - RNA, 64 nt, hsa; identical to SEQ ID NO: 283797

SEQ ID NO: 735913 - RNA, 64 nt, hsa; identical to SEQ ID NO: 283798

SEQ ID NO: 735914 - RNA, 64 nt, hsa; identical to SEQ ID NO: 283799

SEQ ID NO: 735915 - RNA, 64 nt, hsa; identical to SEQ ID NO: 283800

SEQ ID NO: 735916 - RNA, 64 nt, hsa; identical to SEQ ID NO: 283801

SEQ ID NO: 735917 - RNA, 64 nt, hsa; identical to SEQ ID NO: 283802

SEQ ID NO: 735918 - RNA, 64 nt, hsa; identical to SEQ ID NO: 283803

SEQ ID NO: 735919 - RNA, 64 nt, hsa; identical to SEQ ID NO: 283804

SEQ ID NO: 735920 - RNA, 64 nt, hsa; identical to SEQ ID NO: 283805

SEQ ID NO: 735921 - RNA, 64 nt, hsa; identical to SEQ ID NO: 283806

SEQ ID NO: 735922 - RNA, 64 nt, hsa; identical to SEQ ID NO: 283807

SEQ ID NO: 735923 - RNA, 64 nt, hsa; identical to SEQ ID NO: 283808

SEQ ID NO: 735924 - RNA, 64 nt, hsa; identical to SEQ ID NO: 334267

SEQ ID NO: 735925 - RNA, 64 nt, hsa; identical to SEQ ID NO: 334268

SEQ ID NO: 735926 - RNA, 64 nt, hsa; identical to SEQ ID NO: 334269

SEQ ID NO: 735927 - RNA, 64 nt, hsa; identical to SEQ ID NO: 334270

SEQ ID NO: 735928 - RNA, 64 nt, hsa; identical to SEQ ID NO: 334271

SEQ ID NO: 735929 - RNA, 64 nt, hsa; identical to SEQ ID NO: 334272

SEQ ID NO: 735930 - RNA, 64 nt, hsa; identical to SEQ ID NO: 334273

SEQ ID NO: 735931 - RNA, 64 nt, hsa; identical to SEQ ID NO: 334274

SEQ ID NO: 735932 - RNA, 64 nt, hsa; identical to SEQ ID NO: 334275

SEQ ID NO: 735933 - RNA, 64 nt, hsa; identical to SEQ ID NO: 334276

SEQ ID NO: 735934 - RNA, 64 nt, hsa; identical to SEQ ID NO: 553500

SEQ ID NO: 735935 - RNA, 64 nt, hsa; identical to SEQ ID NO: 553501

SEQ ID NO: 735936 - RNA, 64 nt, hsa; identical to SEQ ID NO: 553502

SEQ ID NO: 735937 - RNA, 64 nt, hsa; identical to SEQ ID NO: 553503

SEQ ID NO: 735938 - RNA, 64 nt, hsa; identical to SEQ ID NO: 553504

SEQ ID NO: 735939 - RNA, 64 nt, hsa; identical to SEQ ID NO: 553505

SEQ ID NO: 735940 - RNA, 64 nt, hsa; identical to SEQ ID NO: 553506

SEQ ID NO: 735941 - RNA, 64 nt, hsa; identical to SEQ ID NO: 553507

SEQ ID NO: 735942 - RNA, 64 nt, hsa; identical to SEQ ID NO: 553508

SEQ ID NO: 735943 - RNA, 64 nt, hsa; identical to SEQ ID NO: 553509

SEQ ID NO: 735944 - RNA, 64 nt, hsa; identical to SEQ ID NO: 553510

SEQ ID NO: 735945 - RNA, 64 nt, hsa; identical to SEQ ID NO: 553511

SEQ ID NO: 735946 - RNA, 64 nt, hsa; identical to SEQ ID NO: 553512

SEQ ID NO: 735947 - RNA, 64 nt, hsa; identical to SEQ ID NO: 553513

SEQ ID NO: 735948 - RNA, 64 nt, hsa; identical to SEQ ID NO: 553514

SEQ ID NO: 735949 - RNA, 64 nt, hsa; identical to SEQ ID NO: 553515

SEQ ID NO: 735950 - RNA, 64 nt, hsa; identical to SEQ ID NO: 553516

SEQ ID NO: 735951 - RNA, 64 nt, hsa; identical to SEQ ID NO: 553517

SEQ ID NO: 735952 - RNA, 64 nt, hsa; identical to SEQ ID NO: 553518

SEQ ID NO: 735953 - RNA, 64 nt, hsa; identical to SEQ ID NO: 553519

SEQ ID NO: 735954 - RNA, 64 nt, hsa; identical to SEQ ID NO: 553520

SEQ ID NO: 735955 - RNA, 64 nt, hsa; identical to SEQ ID NO: 553521

SEQ ID NO: 735956 - RNA, 64 nt, hsa; identical to SEQ ID NO: 553522

SEQ ID NO: 735957 - RNA, 64 nt, hsa; identical to SEQ ID NO: 553523

SEQ ID NO: 735958 - RNA, 64 nt, hsa; identical to SEQ ID NO: 553524

SEQ ID NO: 735959 - RNA, 64 nt, hsa; identical to SEQ ID NO: 553525

SEQ ID NO: 735960 - RNA, 64 nt, hsa; identical to SEQ ID NO: 553526

SEQ ID NO: 735961 - RNA, 64 nt, hsa; identical to SEQ ID NO: 553527

SEQ ID NO: 735962 - RNA, 64 nt, hsa; identical to SEQ ID NO: 553528

SEQ ID NO: 735963 - RNA, 64 nt, hsa; identical to SEQ ID NO: 553529

SEQ ID NO: 735964 - RNA, 64 nt, hsa; identical to SEQ ID NO: 553530

SEQ ID NO: 735965 - RNA, 64 nt, hsa; identical to SEQ ID NO: 553531

SEQ ID NO: 735966 - RNA, 64 nt, hsa; identical to SEQ ID NO: 553532

SEQ ID NO: 735967 - RNA, 64 nt, hsa; identical to SEQ ID NO: 553533

SEQ ID NO: 735968 - RNA, 64 nt, hsa; identical to SEQ ID NO: 553534

SEQ ID NO: 735969 - RNA, 64 nt, hsa; identical to SEQ ID NO: 553535

SEQ ID NO: 735970 - RNA, 64 nt, hsa; identical to SEQ ID NO: 553536

SEQ ID NO: 735971 - RNA, 64 nt, hsa; identical to SEQ ID NO: 553537

SEQ ID NO: 735972 - RNA, 64 nt, hsa; identical to SEQ ID NO: 553538

SEQ ID NO: 735973 - RNA, 64 nt, hsa; identical to SEQ ID NO: 553539

SEQ ID NO: 735974 - RNA, 64 nt, hsa; identical to SEQ ID NO: 553540

SEQ ID NO: 735975 - RNA, 64 nt, hsa; identical to SEQ ID NO: 553541

SEQ ID NO: 735976 - RNA, 62 nt, hsa
uaucgaacgugagaguggagcugcuuaguggaagauguaagugaggugggugucccaugugc

SEQ ID NO: 735977 - RNA, 62 nt, hsa
cuugaaccaagagcacaugaaugaacaggaaaagauguaaaaacauuuuuuucugagaugaa

SEQ ID NO: 735978 - RNA, 62 nt, hsa
uaugucauauaucaaaucaucucuuuaaccuaagauguaaguauuaagaauaucuaauuuuc

SEQ ID NO: 735979 - RNA, 62 nt, hsa
aucaaacauaaugaugaguaagaugaugaaugagauguaaaugugccaagaauauauuauau

SEQ ID NO: 735980 - RNA, 62 nt, hsa
ugaguucagccuuuaucccucgugguuccacuagauguaacuuaaaggaguuaacauuugag

SEQ ID NO: 735981 - RNA, 62 nt, hsa
ugaguucagccuuuaucccucgugguuccgcuagauguaacuuauaggaguuaacauuugag

SEQ ID NO: 735982 - RNA, 62 nt, hsa
uaaggcuucagccauaauauggaggagggagcagauguaagcucccaagagccugggggauc

SEQ ID NO: 735983 - RNA, 62 nt, hsa
agcuuguguagucagauuagccaguaaucucuagauguaauaguucccuuuguacuuuucca

SEQ ID NO: 735984 - RNA, 62 nt, hsa
agacguaaaaauaaaggcauuuggcugguccaagauguaauuaucaaucagucagcaccugu

SEQ ID NO: 735985 - RNA, 62 nt, hsa
agugucagaugagaauuuuaggggcuggaggaagauguaaaagaugaaaauguuuuccuuau

SEQ ID NO: 735986 - RNA, 62 nt, hsa
auuuuuucagauggacaaaauguauaugguacagauguaaaguuuucuauguaaaaaauucu

SEQ ID NO: 735987 - RNA, 62 nt, hsa
gguguggaagugaaacuuacccaaagaacuauagauguaaagauugaacuucuacaagaagu

SEQ ID NO: 735988 - RNA, 62 nt, hsa
uggauauguaaacaaugacuguaacguguuauagauguaaagacaaaauaaagguuaaagag

SEQ ID NO: 735989 - RNA, 62 nt, hsa
gcaaguuuuuuggugcuguaguauaugaugaaagauguaaagcugaauaaagcauuauuucu

SEQ ID NO: 735990 - RNA, 62 nt, hsa
agcaagacucccucucaaaagaaaaagaaaaaagauguaaaaaccauucuuaguuugugggc

SEQ ID NO: 735991 - RNA, 62 nt, hsa
gccacugugcccaggcagacccccuucuuuaaagauguaaaacccggccgggcgcgguggcu

SEQ ID NO: 735992 - RNA, 62 nt, hsa
gauucccuaaguaugcuacacagcaucauauuagauguaagauguaagacuugcaaaggaca

SEQ ID NO: 735993 - RNA, 62 nt, hsa
uaaguaugcuacacagcaucauauuagauguaagauguaagacuugcaaaggacagaaggaa

SEQ ID NO: 735994 - RNA, 62 nt, hsa
acagacugagucuccacaacaccaaaauauccagauguaaaccccaaacuuguacacaaaag

SEQ ID NO: 735995 - RNA, 62 nt, hsa
aaagcacagauuguuuaccuguuguggauuuuagauguaacaaauguuuauacaaauacaua

SEQ ID NO: 735996 - RNA, 62 nt, hsa
auuccucuucaaaaauugagcgcuauguugcaagauguaauuuuucuuuuccuuuuuuuuga

SEQ ID NO: 735997 - RNA, 62 nt, hsa
guuacaggugugagccacugcacccggccacaagauguaauuuuuacuuuaucucucacacg

SEQ ID NO: 735998 - RNA, 62 nt, hsa
acauagcaagagcccagcucuugggagcauugagauguaagcucaggguuacacaguuccaa

SEQ ID NO: 735999 - RNA, 62 nt, hsa
ucauguuuaacaaguauagccuugauuucaguagauguaauggaagccaaauuaaauugaua

SEQ ID NO: 736000 - RNA, 62 nt, hsa
auucuuaaaacauuuuaaaaaccacuguagaaagauguaaauagggacugugcaguauuucu

SEQ ID NO: 736001 - RNA, 62 nt, hsa
uuuguccagaacacauugaccaagcuccugaaagauguaaguuuacuacgcauagacuuuua

SEQ ID NO: 736002 - RNA, 62 nt, hsa
ucuuauuuaagaaaccuagaucaaguuuuuacagauguaaauaaaaguugaauaguuuaccu

SEQ ID NO: 736003 - RNA, 62 nt, hsa
aauaaugcacaguaaauaugugaauuuuuccuagauguaaaaaaaaaaaucuuucauauaaa

SEQ ID NO: 736004 - RNA, 64 nt, hsa; identical to SEQ ID NO: 169280

SEQ ID NO: 736005 - RNA, 64 nt, hsa; identical to SEQ ID NO: 169281

SEQ ID NO: 736006 - RNA, 64 nt, hsa; identical to SEQ ID NO: 169282

SEQ ID NO: 736007 - RNA, 64 nt, hsa; identical to SEQ ID NO: 169283

SEQ ID NO: 736008 - RNA, 64 nt, hsa; identical to SEQ ID NO: 169284

SEQ ID NO: 736009 - RNA, 64 nt, hsa; identical to SEQ ID NO: 169285

SEQ ID NO: 736010 - RNA, 64 nt, hsa; identical to SEQ ID NO: 169286

SEQ ID NO: 736011 - RNA, 64 nt, hsa; identical to SEQ ID NO: 169287

SEQ ID NO: 736012 - RNA, 64 nt, hsa; identical to SEQ ID NO: 169288

SEQ ID NO: 736013 - RNA, 64 nt, hsa; identical to SEQ ID NO: 169289

SEQ ID NO: 736014 - RNA, 64 nt, hsa; identical to SEQ ID NO: 169290

SEQ ID NO: 736015 - RNA, 64 nt, hsa; identical to SEQ ID NO: 169291

SEQ ID NO: 736016 - RNA, 64 nt, hsa; identical to SEQ ID NO: 169292

SEQ ID NO: 736017 - RNA, 64 nt, hsa; identical to SEQ ID NO: 169293

SEQ ID NO: 736018 - RNA, 64 nt, hsa; identical to SEQ ID NO: 169294

SEQ ID NO: 736019 - RNA, 64 nt, hsa; identical to SEQ ID NO: 169295

SEQ ID NO: 736020 - RNA, 64 nt, hsa; identical to SEQ ID NO: 169296

SEQ ID NO: 736021 - RNA, 64 nt, hsa; identical to SEQ ID NO: 169297

SEQ ID NO: 736022 - RNA, 64 nt, hsa; identical to SEQ ID NO: 169298

SEQ ID NO: 736023 - RNA, 64 nt, hsa; identical to SEQ ID NO: 169299

SEQ ID NO: 736024 - RNA, 64 nt, hsa; identical to SEQ ID NO: 169300

SEQ ID NO: 736025 - RNA, 64 nt, hsa; identical to SEQ ID NO: 169301

SEQ ID NO: 736026 - RNA, 64 nt, hsa; identical to SEQ ID NO: 169302

SEQ ID NO: 736027 - RNA, 64 nt, hsa; identical to SEQ ID NO: 169303

SEQ ID NO: 736028 - RNA, 64 nt, hsa; identical to SEQ ID NO: 169304

SEQ ID NO: 736029 - RNA, 64 nt, hsa; identical to SEQ ID NO: 169305

SEQ ID NO: 736030 - RNA, 64 nt, hsa; identical to SEQ ID NO: 169306

SEQ ID NO: 736031 - RNA, 64 nt, hsa; identical to SEQ ID NO: 169307

SEQ ID NO: 736032 - RNA, 64 nt, hsa; identical to SEQ ID NO: 243860

SEQ ID NO: 736033 - RNA, 64 nt, hsa; identical to SEQ ID NO: 243861

SEQ ID NO: 736034 - RNA, 64 nt, hsa; identical to SEQ ID NO: 243862

SEQ ID NO: 736035 - RNA, 64 nt, hsa; identical to SEQ ID NO: 243863

SEQ ID NO: 736036 - RNA, 64 nt, hsa; identical to SEQ ID NO: 243864

SEQ ID NO: 736037 - RNA, 64 nt, hsa; identical to SEQ ID NO: 243865

SEQ ID NO: 736038 - RNA, 64 nt, hsa; identical to SEQ ID NO: 243866

SEQ ID NO: 736039 - RNA, 64 nt, hsa; identical to SEQ ID NO: 243867

SEQ ID NO: 736040 - RNA, 64 nt, hsa; identical to SEQ ID NO: 243868

SEQ ID NO: 736041 - RNA, 64 nt, hsa; identical to SEQ ID NO: 243869

SEQ ID NO: 736042 - RNA, 64 nt, hsa; identical to SEQ ID NO: 243870

SEQ ID NO: 736043 - RNA, 64 nt, hsa; identical to SEQ ID NO: 243871

SEQ ID NO: 736044 - RNA, 64 nt, hsa; identical to SEQ ID NO: 243872

SEQ ID NO: 736045 - RNA, 64 nt, hsa; identical to SEQ ID NO: 243873

SEQ ID NO: 736046 - RNA, 64 nt, hsa; identical to SEQ ID NO: 243874

SEQ ID NO: 736047 - RNA, 64 nt, hsa; identical to SEQ ID NO: 243875

SEQ ID NO: 736048 - RNA, 64 nt, hsa; identical to SEQ ID NO: 243876

SEQ ID NO: 736049 - RNA, 64 nt, hsa; identical to SEQ ID NO: 243877

SEQ ID NO: 736050 - RNA, 64 nt, hsa; identical to SEQ ID NO: 243878

SEQ ID NO: 736051 - RNA, 64 nt, hsa; identical to SEQ ID NO: 243879

SEQ ID NO: 736052 - RNA, 64 nt, hsa; identical to SEQ ID NO: 243880

SEQ ID NO: 736053 - RNA, 64 nt, hsa; identical to SEQ ID NO: 243881

SEQ ID NO: 736054 - RNA, 64 nt, hsa; identical to SEQ ID NO: 243882

SEQ ID NO: 736055 - RNA, 64 nt, hsa; identical to SEQ ID NO: 243883

SEQ ID NO: 736056 - RNA, 64 nt, hsa; identical to SEQ ID NO: 243884

SEQ ID NO: 736057 - RNA, 64 nt, hsa; identical to SEQ ID NO: 243885

SEQ ID NO: 736058 - RNA, 64 nt, hsa; identical to SEQ ID NO: 243886

SEQ ID NO: 736059 - RNA, 64 nt, hsa; identical to SEQ ID NO: 243887

SEQ ID NO: 736060 - RNA, 64 nt, hsa; identical to SEQ ID NO: 243888

SEQ ID NO: 736061 - RNA, 64 nt, hsa; identical to SEQ ID NO: 243889

SEQ ID NO: 736062 - RNA, 51 nt, hsa; identical to SEQ ID NO: 243890

SEQ ID NO: 736063 - RNA, 64 nt, hsa; identical to SEQ ID NO: 243891

SEQ ID NO: 736064 - RNA, 64 nt, hsa; identical to SEQ ID NO: 243892

SEQ ID NO: 736065 - RNA, 64 nt, hsa; identical to SEQ ID NO: 243893

SEQ ID NO: 736066 - RNA, 64 nt, hsa; identical to SEQ ID NO: 243894

SEQ ID NO: 736067 - RNA, 64 nt, hsa; identical to SEQ ID NO: 243895

SEQ ID NO: 736068 - RNA, 64 nt, hsa; identical to SEQ ID NO: 243896

SEQ ID NO: 736069 - RNA, 64 nt, hsa; identical to SEQ ID NO: 243897

SEQ ID NO: 736070 - RNA, 64 nt, hsa; identical to SEQ ID NO: 243898

SEQ ID NO: 736071 - RNA, 64 nt, hsa; identical to SEQ ID NO: 243899

SEQ ID NO: 736072 - RNA, 64 nt, hsa; identical to SEQ ID NO: 243900

SEQ ID NO: 736073 - RNA, 64 nt, hsa; identical to SEQ ID NO: 243901

SEQ ID NO: 736074 - RNA, 63 nt, hsa; identical to SEQ ID NO: 243902

SEQ ID NO: 736075 - RNA, 64 nt, hsa; identical to SEQ ID NO: 243903

SEQ ID NO: 736076 - RNA, 64 nt, hsa; identical to SEQ ID NO: 243904

SEQ ID NO: 736077 - RNA, 64 nt, hsa; identical to SEQ ID NO: 243905

SEQ ID NO: 736078 - RNA, 64 nt, hsa; identical to SEQ ID NO: 243906

SEQ ID NO: 736079 - RNA, 64 nt, hsa; identical to SEQ ID NO: 243907

SEQ ID NO: 736080 - RNA, 64 nt, hsa; identical to SEQ ID NO: 243908

SEQ ID NO: 736081 - RNA, 64 nt, hsa; identical to SEQ ID NO: 243909

SEQ ID NO: 736082 - RNA, 64 nt, hsa; identical to SEQ ID NO: 243910

SEQ ID NO: 736083 - RNA, 64 nt, hsa; identical to SEQ ID NO: 243911

SEQ ID NO: 736084 - RNA, 64 nt, hsa; identical to SEQ ID NO: 243912

SEQ ID NO: 736085 - RNA, 64 nt, hsa; identical to SEQ ID NO: 243913

SEQ ID NO: 736086 - RNA, 64 nt, hsa; identical to SEQ ID NO: 243914

SEQ ID NO: 736087 - RNA, 64 nt, hsa; identical to SEQ ID NO: 243915

SEQ ID NO: 736088 - RNA, 64 nt, hsa; identical to SEQ ID NO: 243916

SEQ ID NO: 736089 - RNA, 64 nt, hsa; identical to SEQ ID NO: 243917

SEQ ID NO: 736090 - RNA, 64 nt, hsa; identical to SEQ ID NO: 243918

SEQ ID NO: 736091 - RNA, 64 nt, hsa; identical to SEQ ID NO: 243919

SEQ ID NO: 736092 - RNA, 64 nt, hsa; identical to SEQ ID NO: 243920

SEQ ID NO: 736093 - RNA, 64 nt, hsa; identical to SEQ ID NO: 243921

SEQ ID NO: 736094 - RNA, 64 nt, hsa; identical to SEQ ID NO: 243922

SEQ ID NO: 736095 - RNA, 64 nt, hsa; identical to SEQ ID NO: 243923

SEQ ID NO: 736096 - RNA, 64 nt, hsa; identical to SEQ ID NO: 243924

SEQ ID NO: 736097 - RNA, 64 nt, hsa; identical to SEQ ID NO: 243925

SEQ ID NO: 736098 - RNA, 64 nt, hsa; identical to SEQ ID NO: 243926

SEQ ID NO: 736099 - RNA, 64 nt, hsa; identical to SEQ ID NO: 243927

SEQ ID NO: 736100 - RNA, 64 nt, hsa; identical to SEQ ID NO: 243928

SEQ ID NO: 736101 - RNA, 64 nt, hsa; identical to SEQ ID NO: 243929

SEQ ID NO: 736102 - RNA, 64 nt, hsa; identical to SEQ ID NO: 243930

SEQ ID NO: 736103 - RNA, 64 nt, hsa; identical to SEQ ID NO: 243931

SEQ ID NO: 736104 - RNA, 64 nt, hsa; identical to SEQ ID NO: 243932

SEQ ID NO: 736105 - RNA, 64 nt, hsa; identical to SEQ ID NO: 243933

SEQ ID NO: 736106 - RNA, 64 nt, hsa; identical to SEQ ID NO: 243934

SEQ ID NO: 736107 - RNA, 64 nt, hsa; identical to SEQ ID NO: 243935

SEQ ID NO: 736108 - RNA, 64 nt, hsa; identical to SEQ ID NO: 243936

SEQ ID NO: 736109 - RNA, 64 nt, hsa; identical to SEQ ID NO: 243937

SEQ ID NO: 736110 - RNA, 64 nt, hsa; identical to SEQ ID NO: 243938

SEQ ID NO: 736111 - RNA, 64 nt, hsa; identical to SEQ ID NO: 243939

SEQ ID NO: 736112 - RNA, 64 nt, hsa; identical to SEQ ID NO: 243940

SEQ ID NO: 736113 - RNA, 64 nt, hsa; identical to SEQ ID NO: 243941

SEQ ID NO: 736114 - RNA, 64 nt, hsa; identical to SEQ ID NO: 243942

SEQ ID NO: 736115 - RNA, 64 nt, hsa; identical to SEQ ID NO: 243943

SEQ ID NO: 736116 - RNA, 64 nt, hsa; identical to SEQ ID NO: 243944

SEQ ID NO: 736117 - RNA, 64 nt, hsa; identical to SEQ ID NO: 243945

SEQ ID NO: 736118 - RNA, 64 nt, hsa; identical to SEQ ID NO: 243946

SEQ ID NO: 736119 - RNA, 64 nt, hsa; identical to SEQ ID NO: 243947

SEQ ID NO: 736120 - RNA, 64 nt, hsa; identical to SEQ ID NO: 243948

SEQ ID NO: 736121 - RNA, 64 nt, hsa; identical to SEQ ID NO: 632047

SEQ ID NO: 736122 - RNA, 64 nt, hsa; identical to SEQ ID NO: 632048

SEQ ID NO: 736123 - RNA, 64 nt, hsa; identical to SEQ ID NO: 632049

SEQ ID NO: 736124 - RNA, 64 nt, hsa; identical to SEQ ID NO: 632050

SEQ ID NO: 736125 - RNA, 64 nt, hsa; identical to SEQ ID NO: 632051

SEQ ID NO: 736126 - RNA, 64 nt, hsa; identical to SEQ ID NO: 632052

SEQ ID NO: 736127 - RNA, 64 nt, hsa; identical to SEQ ID NO: 632053

SEQ ID NO: 736128 - RNA, 64 nt, hsa; identical to SEQ ID NO: 632054

SEQ ID NO: 736129 - RNA, 64 nt, hsa; identical to SEQ ID NO: 632055

SEQ ID NO: 736130 - RNA, 64 nt, hsa; identical to SEQ ID NO: 632056

SEQ ID NO: 736131 - RNA, 64 nt, hsa; identical to SEQ ID NO: 632057

SEQ ID NO: 736132 - RNA, 64 nt, hsa; identical to SEQ ID NO: 632058

SEQ ID NO: 736133 - RNA, 64 nt, hsa; identical to SEQ ID NO: 632059

SEQ ID NO: 736134 - RNA, 64 nt, hsa; identical to SEQ ID NO: 632060

SEQ ID NO: 736135 - RNA, 64 nt, hsa; identical to SEQ ID NO: 632061

SEQ ID NO: 736136 - RNA, 64 nt, hsa; identical to SEQ ID NO: 632062

SEQ ID NO: 736137 - RNA, 64 nt, hsa; identical to SEQ ID NO: 632063

SEQ ID NO: 736138 - RNA, 64 nt, hsa; identical to SEQ ID NO: 632064

SEQ ID NO: 736139 - RNA, 64 nt, hsa; identical to SEQ ID NO: 632065

SEQ ID NO: 736140 - RNA, 64 nt, hsa; identical to SEQ ID NO: 632066

SEQ ID NO: 736141 - RNA, 64 nt, hsa; identical to SEQ ID NO: 632067

SEQ ID NO: 736142 - RNA, 64 nt, hsa; identical to SEQ ID NO: 632068

SEQ ID NO: 736143 - RNA, 64 nt, hsa; identical to SEQ ID NO: 632069

SEQ ID NO: 736144 - RNA, 64 nt, hsa; identical to SEQ ID NO: 632070

SEQ ID NO: 736145 - RNA, 64 nt, hsa; identical to SEQ ID NO: 632071

SEQ ID NO: 736146 - RNA, 64 nt, hsa; identical to SEQ ID NO: 632072

SEQ ID NO: 736147 - RNA, 64 nt, hsa; identical to SEQ ID NO: 632073

SEQ ID NO: 736148 - RNA, 64 nt, hsa; identical to SEQ ID NO: 632074

SEQ ID NO: 736149 - RNA, 64 nt, hsa; identical to SEQ ID NO: 632075

SEQ ID NO: 736150 - RNA, 64 nt, hsa; identical to SEQ ID NO: 87431

SEQ ID NO: 736151 - RNA, 64 nt, hsa; identical to SEQ ID NO: 87432

SEQ ID NO: 736152 - RNA, 64 nt, hsa; identical to SEQ ID NO: 87433

SEQ ID NO: 736153 - RNA, 64 nt, hsa; identical to SEQ ID NO: 87434

SEQ ID NO: 736154 - RNA, 64 nt, hsa; identical to SEQ ID NO: 87435

SEQ ID NO: 736155 - RNA, 64 nt, hsa; identical to SEQ ID NO: 87436

SEQ ID NO: 736156 - RNA, 64 nt, hsa; identical to SEQ ID NO: 87437

SEQ ID NO: 736157 - RNA, 64 nt, hsa; identical to SEQ ID NO: 87438

SEQ ID NO: 736158 - RNA, 64 nt, hsa; identical to SEQ ID NO: 87439

SEQ ID NO: 736159 - RNA, 64 nt, hsa; identical to SEQ ID NO: 87440

SEQ ID NO: 736160 - RNA, 64 nt, hsa; identical to SEQ ID NO: 87441

SEQ ID NO: 736161 - RNA, 64 nt, hsa; identical to SEQ ID NO: 87442

SEQ ID NO: 736162 - RNA, 64 nt, hsa; identical to SEQ ID NO: 87443

SEQ ID NO: 736163 - RNA, 64 nt, hsa; identical to SEQ ID NO: 87444

SEQ ID NO: 736164 - RNA, 64 nt, hsa; identical to SEQ ID NO: 87445

SEQ ID NO: 736165 - RNA, 64 nt, hsa; identical to SEQ ID NO: 87446

SEQ ID NO: 736166 - RNA, 64 nt, hsa; identical to SEQ ID NO: 87447

SEQ ID NO: 736167 - RNA, 64 nt, hsa; identical to SEQ ID NO: 87448

SEQ ID NO: 736168 - RNA, 64 nt, hsa; identical to SEQ ID NO: 87449

SEQ ID NO: 736169 - RNA, 64 nt, hsa; identical to SEQ ID NO: 87450

SEQ ID NO: 736170 - RNA, 64 nt, hsa; identical to SEQ ID NO: 87451

SEQ ID NO: 736171 - RNA, 64 nt, hsa; identical to SEQ ID NO: 87452

SEQ ID NO: 736172 - RNA, 64 nt, hsa; identical to SEQ ID NO: 87453

SEQ ID NO: 736173 - RNA, 64 nt, hsa; identical to SEQ ID NO: 87454

SEQ ID NO: 736174 - RNA, 64 nt, hsa; identical to SEQ ID NO: 87455

SEQ ID NO: 736175 - RNA, 64 nt, hsa; identical to SEQ ID NO: 87456

SEQ ID NO: 736176 - RNA, 64 nt, hsa; identical to SEQ ID NO: 87457

SEQ ID NO: 736177 - RNA, 64 nt, hsa; identical to SEQ ID NO: 87458

SEQ ID NO: 736178 - RNA, 64 nt, hsa; identical to SEQ ID NO: 87459

SEQ ID NO: 736179 - RNA, 64 nt, hsa; identical to SEQ ID NO: 87460

SEQ ID NO: 736180 - RNA, 64 nt, hsa; identical to SEQ ID NO: 87461

SEQ ID NO: 736181 - RNA, 64 nt, hsa; identical to SEQ ID NO: 87462

SEQ ID NO: 736182 - RNA, 64 nt, hsa; identical to SEQ ID NO: 87463

SEQ ID NO: 736183 - RNA, 64 nt, hsa; identical to SEQ ID NO: 87464

SEQ ID NO: 736184 - RNA, 64 nt, hsa; identical to SEQ ID NO: 87465

SEQ ID NO: 736185 - RNA, 64 nt, hsa; identical to SEQ ID NO: 87466

SEQ ID NO: 736186 - RNA, 64 nt, hsa; identical to SEQ ID NO: 87467

SEQ ID NO: 736187 - RNA, 64 nt, hsa; identical to SEQ ID NO: 87468

SEQ ID NO: 736188 - RNA, 64 nt, hsa; identical to SEQ ID NO: 87469

SEQ ID NO: 736189 - RNA, 64 nt, hsa; identical to SEQ ID NO: 87470

SEQ ID NO: 736190 - RNA, 64 nt, hsa; identical to SEQ ID NO: 87471

SEQ ID NO: 736191 - RNA, 64 nt, hsa; identical to SEQ ID NO: 87472

SEQ ID NO: 736192 - RNA, 64 nt, hsa; identical to SEQ ID NO: 87473

SEQ ID NO: 736193 - RNA, 64 nt, hsa; identical to SEQ ID NO: 87474

SEQ ID NO: 736194 - RNA, 64 nt, hsa; identical to SEQ ID NO: 87475

SEQ ID NO: 736195 - RNA, 64 nt, hsa; identical to SEQ ID NO: 87476

SEQ ID NO: 736196 - RNA, 64 nt, hsa; identical to SEQ ID NO: 87477

SEQ ID NO: 736197 - RNA, 64 nt, hsa; identical to SEQ ID NO: 87478

SEQ ID NO: 736198 - RNA, 64 nt, hsa; identical to SEQ ID NO: 87479

SEQ ID NO: 736199 - RNA, 64 nt, hsa; identical to SEQ ID NO: 355748

SEQ ID NO: 736200 - RNA, 64 nt, hsa; identical to SEQ ID NO: 355749

SEQ ID NO: 736201 - RNA, 64 nt, hsa; identical to SEQ ID NO: 355750

SEQ ID NO: 736202 - RNA, 64 nt, hsa; identical to SEQ ID NO: 355751

SEQ ID NO: 736203 - RNA, 64 nt, hsa; identical to SEQ ID NO: 355752

SEQ ID NO: 736204 - RNA, 64 nt, hsa; identical to SEQ ID NO: 355753

SEQ ID NO: 736205 - RNA, 64 nt, hsa; identical to SEQ ID NO: 355754

SEQ ID NO: 736206 - RNA, 64 nt, hsa; identical to SEQ ID NO: 355755

SEQ ID NO: 736207 - RNA, 64 nt, hsa; identical to SEQ ID NO: 355756

SEQ ID NO: 736208 - RNA, 64 nt, hsa; identical to SEQ ID NO: 355757

SEQ ID NO: 736209 - RNA, 64 nt, hsa; identical to SEQ ID NO: 355758

SEQ ID NO: 736210 - RNA, 64 nt, hsa; identical to SEQ ID NO: 355759

SEQ ID NO: 736211 - RNA, 64 nt, hsa; identical to SEQ ID NO: 355760

SEQ ID NO: 736212 - RNA, 64 nt, hsa; identical to SEQ ID NO: 355761

SEQ ID NO: 736213 - RNA, 64 nt, hsa; identical to SEQ ID NO: 355762

SEQ ID NO: 736214 - RNA, 64 nt, hsa; identical to SEQ ID NO: 355763

SEQ ID NO: 736215 - RNA, 64 nt, hsa; identical to SEQ ID NO: 355764

SEQ ID NO: 736216 - RNA, 64 nt, hsa; identical to SEQ ID NO: 355765

SEQ ID NO: 736217 - RNA, 64 nt, hsa; identical to SEQ ID NO: 355766

SEQ ID NO: 736218 - RNA, 64 nt, hsa; identical to SEQ ID NO: 355767

SEQ ID NO: 736219 - RNA, 64 nt, hsa; identical to SEQ ID NO: 355768

SEQ ID NO: 736220 - RNA, 64 nt, hsa; identical to SEQ ID NO: 355769

SEQ ID NO: 736221 - RNA, 64 nt, hsa; identical to SEQ ID NO: 355770

SEQ ID NO: 736222 - RNA, 64 nt, hsa; identical to SEQ ID NO: 355771

SEQ ID NO: 736223 - RNA, 64 nt, hsa; identical to SEQ ID NO: 355772

SEQ ID NO: 736224 - RNA, 64 nt, hsa; identical to SEQ ID NO: 355773

SEQ ID NO: 736225 - RNA, 64 nt, hsa; identical to SEQ ID NO: 355774

SEQ ID NO: 736226 - RNA, 64 nt, hsa; identical to SEQ ID NO: 355775

SEQ ID NO: 736227 - RNA, 64 nt, hsa; identical to SEQ ID NO: 355776

SEQ ID NO: 736228 - RNA, 64 nt, hsa; identical to SEQ ID NO: 355777

SEQ ID NO: 736229 - RNA, 64 nt, hsa; identical to SEQ ID NO: 355778

SEQ ID NO: 736230 - RNA, 64 nt, hsa; identical to SEQ ID NO: 355779

SEQ ID NO: 736231 - RNA, 64 nt, hsa; identical to SEQ ID NO: 355780

SEQ ID NO: 736232 - RNA, 62 nt, hsa; identical to SEQ ID NO: 355781

SEQ ID NO: 736233 - RNA, 64 nt, hsa; identical to SEQ ID NO: 355782

SEQ ID NO: 736234 - RNA, 64 nt, hsa; identical to SEQ ID NO: 355783

SEQ ID NO: 736235 - RNA, 64 nt, hsa; identical to SEQ ID NO: 355784

SEQ ID NO: 736236 - RNA, 64 nt, hsa; identical to SEQ ID NO: 326924

SEQ ID NO: 736237 - RNA, 64 nt, hsa; identical to SEQ ID NO: 326925

SEQ ID NO: 736238 - RNA, 64 nt, hsa; identical to SEQ ID NO: 326926

SEQ ID NO: 736239 - RNA, 64 nt, hsa; identical to SEQ ID NO: 326927

SEQ ID NO: 736240 - RNA, 64 nt, hsa; identical to SEQ ID NO: 326928

SEQ ID NO: 736241 - RNA, 64 nt, hsa; identical to SEQ ID NO: 326929

SEQ ID NO: 736242 - RNA, 64 nt, hsa; identical to SEQ ID NO: 326930

SEQ ID NO: 736243 - RNA, 64 nt, hsa; identical to SEQ ID NO: 326931

SEQ ID NO: 736244 - RNA, 64 nt, hsa; identical to SEQ ID NO: 326932

SEQ ID NO: 736245 - RNA, 64 nt, hsa; identical to SEQ ID NO: 326933

SEQ ID NO: 736246 - RNA, 64 nt, hsa; identical to SEQ ID NO: 326934

SEQ ID NO: 736247 - RNA, 64 nt, hsa; identical to SEQ ID NO: 326935

SEQ ID NO: 736248 - RNA, 64 nt, hsa; identical to SEQ ID NO: 326936

SEQ ID NO: 736249 - RNA, 64 nt, hsa; identical to SEQ ID NO: 326937

SEQ ID NO: 736250 - RNA, 64 nt, hsa; identical to SEQ ID NO: 326938

SEQ ID NO: 736251 - RNA, 64 nt, hsa; identical to SEQ ID NO: 326939

SEQ ID NO: 736252 - RNA, 64 nt, hsa; identical to SEQ ID NO: 326940

SEQ ID NO: 736253 - RNA, 56 nt, hsa; identical to SEQ ID NO: 326941

SEQ ID NO: 736254 - RNA, 64 nt, hsa; identical to SEQ ID NO: 326942

SEQ ID NO: 736255 - RNA, 64 nt, hsa; identical to SEQ ID NO: 326943

SEQ ID NO: 736256 - RNA, 64 nt, hsa; identical to SEQ ID NO: 326944

SEQ ID NO: 736257 - RNA, 64 nt, hsa; identical to SEQ ID NO: 326945

SEQ ID NO: 736258 - RNA, 64 nt, hsa; identical to SEQ ID NO: 326946

SEQ ID NO: 736259 - RNA, 64 nt, hsa; identical to SEQ ID NO: 326947

SEQ ID NO: 736260 - RNA, 64 nt, hsa; identical to SEQ ID NO: 326948

SEQ ID NO: 736261 - RNA, 64 nt, hsa; identical to SEQ ID NO: 326949

SEQ ID NO: 736262 - RNA, 64 nt, hsa; identical to SEQ ID NO: 326950

SEQ ID NO: 736263 - RNA, 64 nt, hsa; identical to SEQ ID NO: 326951

SEQ ID NO: 736264 - RNA, 64 nt, hsa; identical to SEQ ID NO: 326952

SEQ ID NO: 736265 - RNA, 64 nt, hsa; identical to SEQ ID NO: 326953

SEQ ID NO: 736266 - RNA, 64 nt, hsa; identical to SEQ ID NO: 326954

SEQ ID NO: 736267 - RNA, 64 nt, hsa; identical to SEQ ID NO: 326955

SEQ ID NO: 736268 - RNA, 64 nt, hsa; identical to SEQ ID NO: 144401

SEQ ID NO: 736269 - RNA, 64 nt, hsa; identical to SEQ ID NO: 144402

SEQ ID NO: 736270 - RNA, 64 nt, hsa; identical to SEQ ID NO: 144403

SEQ ID NO: 736271 - RNA, 64 nt, hsa; identical to SEQ ID NO: 144404

SEQ ID NO: 736272 - RNA, 64 nt, hsa; identical to SEQ ID NO: 144405

SEQ ID NO: 736273 - RNA, 64 nt, hsa; identical to SEQ ID NO: 144406

SEQ ID NO: 736274 - RNA, 64 nt, hsa; identical to SEQ ID NO: 144407

SEQ ID NO: 736275 - RNA, 64 nt, hsa; identical to SEQ ID NO: 144408

SEQ ID NO: 736276 - RNA, 64 nt, hsa; identical to SEQ ID NO: 144409

SEQ ID NO: 736277 - RNA, 64 nt, hsa; identical to SEQ ID NO: 144410

SEQ ID NO: 736278 - RNA, 64 nt, hsa; identical to SEQ ID NO: 144411

SEQ ID NO: 736279 - RNA, 64 nt, hsa; identical to SEQ ID NO: 144412

SEQ ID NO: 736280 - RNA, 64 nt, hsa; identical to SEQ ID NO: 144413

SEQ ID NO: 736281 - RNA, 64 nt, hsa; identical to SEQ ID NO: 144414

SEQ ID NO: 736282 - RNA, 64 nt, hsa; identical to SEQ ID NO: 144415

SEQ ID NO: 736283 - RNA, 64 nt, hsa; identical to SEQ ID NO: 545865

SEQ ID NO: 736284 - RNA, 64 nt, hsa; identical to SEQ ID NO: 545866

SEQ ID NO: 736285 - RNA, 64 nt, hsa; identical to SEQ ID NO: 545867

SEQ ID NO: 736286 - RNA, 64 nt, hsa; identical to SEQ ID NO: 545868

SEQ ID NO: 736287 - RNA, 64 nt, hsa; identical to SEQ ID NO: 545869

SEQ ID NO: 736288 - RNA, 64 nt, hsa; identical to SEQ ID NO: 545870

SEQ ID NO: 736289 - RNA, 64 nt, hsa; identical to SEQ ID NO: 545871

SEQ ID NO: 736290 - RNA, 64 nt, hsa; identical to SEQ ID NO: 545872

SEQ ID NO: 736291 - RNA, 64 nt, hsa; identical to SEQ ID NO: 545873

SEQ ID NO: 736292 - RNA, 64 nt, hsa; identical to SEQ ID NO: 545874

SEQ ID NO: 736293 - RNA, 64 nt, hsa; identical to SEQ ID NO: 545875

SEQ ID NO: 736294 - RNA, 64 nt, hsa; identical to SEQ ID NO: 545876

SEQ ID NO: 736295 - RNA, 64 nt, hsa; identical to SEQ ID NO: 545877

SEQ ID NO: 736296 - RNA, 64 nt, hsa; identical to SEQ ID NO: 545878

SEQ ID NO: 736297 - RNA, 64 nt, hsa; identical to SEQ ID NO: 545879

SEQ ID NO: 736298 - RNA, 64 nt, hsa
cccucucagagccucaagagggguagcucggcugccggaagagaggggugcccuaucccuggca

SEQ ID NO: 736299 - RNA, 64 nt, hsa
ccggcaacagucugaaaguacguggaggacgggaccggaagacgagagagggcuggacauccug

SEQ ID NO: 736300 - RNA, 64 nt, hsa
ggggucucugacacaacacaccaucccaaaguagccggaagagcuaaacacaggggguucuuaa

SEQ ID NO: 736301 - RNA, 64 nt, hsa
cccguguguaaccuguaagauguacugugugccuccggaagacaccaccuuucccuucagcauu

SEQ ID NO: 736302 - RNA, 64 nt, hsa
ucaacgacuucaucuguggcagggagagaggaggccggaagaacaaccccugaacaauggaggc

SEQ ID NO: 736303 - RNA, 64 nt, hsa
ggggagagacccagcggcacugaucgccuugugaccggaagagugaccuguuaaaagccacgca

SEQ ID NO: 736304 - RNA, 64 nt, hsa
accuaucuuccuucaugaagcaggugcucaggacccggaagaaucaucuaccucccagcuuugu

SEQ ID NO: 736305 - RNA, 64 nt, hsa
cucggaaacagaacccucccacagcacauccuacccggaagaccagccucagaggguccuucug

SEQ ID NO: 736306 - RNA, 64 nt, hsa
ucaguguagagggaaaaaagcauguauugggccaccggaagacaagcuaauaaauaggcuggaa

SEQ ID NO: 736307 - RNA, 64 nt, hsa
ccagggcagcugggugugcagggacugggggcucccggaagauuuuuuggaggaaguaacagcu

SEQ ID NO: 736308 - RNA, 64 nt, hsa
aaaaauagccccuuuccuugcagguagucacaguccggaagagaugauagaugcauagacaaaa

SEQ ID NO: 736309 - RNA, 64 nt, hsa
ucgcacagaccccuggcucugacccccucucaucccggaagaagaggaagaagcagaacagacu

SEQ ID NO: 736310 - RNA, 64 nt, hsa
gcgcgggggcugccagaagcgggaggggucacugccggaagagcagcugcccuccgaccccuca

SEQ ID NO: 736311 - RNA, 64 nt, hsa
cccucgggaaguuccgcguccucugugggggcugccggaagacacggccccaggagucaggccc

SEQ ID NO: 736312 - RNA, 64 nt, hsa
uggccccacuucuggucucugucccucugccuccccggaagaagaugaggaaucugaggauuau

SEQ ID NO: 736313 - RNA, 59 nt, hsa
gugacccaguacgacccugaagaggacugccggaagauggccaaggaauauggagacua

SEQ ID NO: 736314 - RNA, 64 nt, hsa
gaagaucguuccaccuucuacgcaauugacaaacccggaagaucagaugcaauugcucccauca

SEQ ID NO: 736315 - RNA, 64 nt, hsa
ccaggaguacaugugagacuaugggaggaaagcuccggaagaaggagaaacauugcaguggcua

SEQ ID NO: 736316 - RNA, 64 nt, hsa
ucuucuccagugauggauggauggacugauaacuccggaagaaugacucuccuguggccucaca

SEQ ID NO: 736317 - RNA, 64 nt, hsa
aagccuuauagaagcaguaagaggcuugaccacgccggaagaguccuggagcuaaagcuggaag

SEQ ID NO: 736318 - RNA, 64 nt, hsa
ugcuggggccaugccgagucgcggcccugcucagccggaagaggcucccggaccuggauguaca

SEQ ID NO: 736319 - RNA, 64 nt, hsa
gugucaguaacaucaggacauuggacacaccauuccggaagaacugcagcuucucaacaccagu

SEQ ID NO: 736320 - RNA, 64 nt, hsa
auggcugccagacacugcugcaacugaccagcugccggaagauucuggagccacuaacauuagu

SEQ ID NO: 736321 - RNA, 64 nt, hsa
gucuucuuucccgggcgucgccuccuguguggugccggaagagcgccagguucaguguuacccu

SEQ ID NO: 736322 - RNA, 64 nt, hsa
ggguuguuuugguuucggacgacccuugcucugaccggaagagaagucccuaucccacaccugc

SEQ ID NO: 736323 - RNA, 64 nt, hsa
agcgcggcagcccuggcggagggaugcaggugggccggaagaucccacgauuccgaucgacugc

SEQ ID NO: 736324 - RNA, 64 nt, hsa
cgggucuuggacuggggcagaauccccaguggaaccggaagagcuggacugaugagaaacauca

SEQ ID NO: 736325 - RNA, 64 nt, hsa
acuccuccaucuaaccagcaggcucccagaguccccggaagagccugcgcagcugaagcagagu

SEQ ID NO: 736326 - RNA, 64 nt, hsa
cuucggggaccagcccacagcacaccaagguggcccggaagaaccagaagugcagccccucuca

SEQ ID NO: 736327 - RNA, 64 nt, hsa
aacugcagcagaguugaaaauugccuccaaauuaccggaagaguguaugaagauugaaugugau

SEQ ID NO: 736328 - RNA, 51 nt, hsa
cgaaaucaaguggggcaugagccggaagaucuggcgaagcucaggcaaaaa

SEQ ID NO: 736329 - RNA, 64 nt, hsa
aagccugccucaccuccagcaccuguaggaacucccggaagagccggauccgcuccgacuccag

SEQ ID NO: 736330 - RNA, 64 nt, hsa
cuuugacuuacgacccauuuugcaagacuuaaagccggaagaacacauuuucagauuguuaaau

SEQ ID NO: 736331 - RNA, 64 nt, hsa
ugcugcugcugcuaucuuccaagagaacgggacuccggaagaagacgucuccacggagcccucg

SEQ ID NO: 736332 - RNA, 64 nt, hsa
guuggggccccgcggguagaugccggcaggccuuccggaagaaaaagagccauugguuuuugua

SEQ ID NO: 736333 - RNA, 64 nt, hsa
augauguguguaagggaagauuuuauuugcccuuccggaagaaaucaguaucuaugcaaaucuu

SEQ ID NO: 736334 - RNA, 64 nt, hsa
ggaucuagaaguuuuacuuuuauaaagaugguguccggaagauguugcuaauguauuuuacuuc

SEQ ID NO: 736335 - RNA, 64 nt, hsa
uguuuugagugucuuucuuugcagguuucuguagccggaagaucuccguuccgcucccagcggc

SEQ ID NO: 736336 - RNA, 64 nt, hsa
ccgauaguuucacacuauuccuauaccuccagguccggaagacagguaaaaaauucuauaaugu

SEQ ID NO: 736337 - RNA, 64 nt, hsa
ugugauuuuccugagucucccuucguuggaucugccggaagacuugucggggaaccuuuaguga

SEQ ID NO: 736338 - RNA, 64 nt, hsa
agggcugccugagcugguggcacccuccccugggccggaagacugggaauuccugcuaagugug

SEQ ID NO: 736339 - RNA, 64 nt, hsa
gcaagagaaagagaaagcgggcgguggaggggucccggaagagcugguccccgugguugagcug

SEQ ID NO: 736340 - RNA, 57 nt, hsa
cagugcccaaaauccacuaguccuaaaccggaagaggaugacaccggccauggguua

SEQ ID NO: 736341 - RNA, 64 nt, hsa
acugcccgugacuuuuucugaauggacuucauaaccggaagacuuaaccgguggccucaucacc

SEQ ID NO: 736342 - RNA, 64 nt, hsa
ggugcacacaaaugaguggguugcugugcugucuccggaagauucugucguugcccuuggccug

SEQ ID NO: 736343 - RNA, 64 nt, hsa
aucuuggauguuuuagauugaaacagccugauucccggaagaauccucuucauucauugcuagu

SEQ ID NO: 736344 - RNA, 64 nt, hsa
agugaagguggcuuccggcacacuccccgcugccccggaagagacauccuuugacccucucagc

SEQ ID NO: 736345 - RNA, 64 nt, hsa
gaaugccauugauuguuccaugcacugugcauacccggaagaaagaccuauaugaugcgguuug

SEQ ID NO: 736346 - RNA, 64 nt, hsa
accacagcaagaagaggaggcaugcuggccugcaccggaagacucacuuugucugcccugcgcc

SEQ ID NO: 736347 - RNA, 64 nt, hsa
acccccgcccagcgcacggcgaccucgcgccucaccggaagaccuugccucugugccgcggagg

SEQ ID NO: 736348 - RNA, 64 nt, hsa
agaagucagcauuuuugaagcccuccacaccguuccggaagagcuggcaaaaggagccucacac

SEQ ID NO: 736349 - RNA, 55 nt, hsa
ccgaggccacuacccccugacacugccggaagagcacagggacacagccagagcc

SEQ ID NO: 736350 - RNA, 64 nt, hsa
agcuagccacacccugacaccauguucaaggguaccggaagagaagggugucugcccccaaccu

SEQ ID NO: 736351 - RNA, 64 nt, hsa
augucauuaauguguugggaaaaaggccucugucccggaagagucaugggaggugaaaggggca

SEQ ID NO: 736352 - RNA, 64 nt, hsa
uucggaggggcggaugcagagcccagggcccccaccggaagauguguacagcuggucuuuacuc

SEQ ID NO: 736353 - RNA, 64 nt, hsa
gaagacuuggagcuucuuggaagacauggauuguccggaagacauggauugucuggaagaugug

SEQ ID NO: 736354 - RNA, 64 nt, hsa
acagggacaucuuaggcucugucagugagcagauccggaagaacuuugcucggacacacuggaa

SEQ ID NO: 736355 - RNA, 61 nt, hsa
ugcuggaggaacuugcugcugugccugcgucgcggcggauccgcggggacccugccgaggg

SEQ ID NO: 736356 - RNA, 61 nt, hsa
uugaccaggcugccuucuugagugaggugcugcggcggaccugccacguuccaggugaguu

SEQ ID NO: 736357 - RNA, 61 nt, hsa
agaaacucaagagccuccguaccuccccugggcggcggaggggcauugcacuuccgggaag

SEQ ID NO: 736358 - RNA, 61 nt, hsa
acuuucuuaaaggccuagucuaugggauggggcggcggagggaauuuuuugagaaauaaaa

SEQ ID NO: 736359 - RNA, 61 nt, hsa
accucgaccagugacaggccagcagcagagggcggcggaggaaggguuagggguucauucu

SEQ ID NO: 736360 - RNA, 61 nt, hsa
cugccgccgccucccgggucucaggccuccagcggcggaggcgcaggcgaccgggccuccc

SEQ ID NO: 736361 - RNA, 61 nt, hsa
aggcugaagcaggauaaucgcuugaacccgggcggcggagauugcagugagccgaggucau

SEQ ID NO: 736362 - RNA, 61 nt, hsa
cauugccguccugcagagauccaggcugcacgcggcggacugggcaggccgggcccgggca

SEQ ID NO: 736363 - RNA, 61 nt, hsa
gggcccagcgcggccagugcuccuccugcacgcggcggacucggaggcgcagcggcgccug

SEQ ID NO: 736364 - RNA, 52 nt, hsa
ccuuccggugguuucagugacggcggcggaacccaaagcugcccucuccgug

SEQ ID NO: 736365 - RNA, 61 nt, hsa
ccugagccgcuuguuaggucgccgcacccucgcggcggaugucucuuggucuguuucuccg

SEQ ID NO: 736366 - RNA, 61 nt, hsa
gccuucucugaaaacaaugcugagaaugagagcggcggagacaagccccccaucgauccca

SEQ ID NO: 736367 - RNA, 61 nt, hsa
aggcugaggcaggagaaucgccugaacccgggcggcggagguuguagugagccaagaucca

SEQ ID NO: 736368 - RNA, 61 nt, hsa
cacccccuggccugugccaggcucacgggcggcggcggaccccgaccuccaguugccuaca

SEQ ID NO: 736369 - RNA, 61 nt, hsa
caccuaauucgaugaaggcugccaacggggagcggcggaaagccuguaagccugcaagccu

SEQ ID NO: 736370 - RNA, 61 nt, hsa
agccacagcccaaacacaucaaacuugcuaagcggcggauacccccagcuucuaagguggg

SEQ ID NO: 736371 - RNA, 61 nt, hsa
ggcauccaaaauaaggcggggcacagugugggcggcggagucccugagccuugagcuccgc

SEQ ID NO: 736372 - RNA, 61 nt, hsa
gccugcgggaugagaccuuggcaggcgggcagcggcggaaacucagcucaagguucccggu

SEQ ID NO: 736373 - RNA, 61 nt, hsa
agccaggaggugggguguggacccggcccuggcggcggagucagggucccaagaucccacc

SEQ ID NO: 736374 - RNA, 61 nt, hsa
ccaggcagugggaagccaauggagggauuaagcggcggaagcuucuuagaagaggcagggg

SEQ ID NO: 736375 - RNA, 61 nt, hsa
guucccauaguccugggagagugucugcagggcggcggagggcagagcagggcaggggagg

SEQ ID NO: 736376 - RNA, 54 nt, hsa
ucaggagcuaccggagcugagcccgcggcggacugccccaggacugcgggaagg

SEQ ID NO: 736377 - RNA, 61 nt, hsa
gcccaguccccgauggcugcgcacacaggaggcggcggagcacaaggcaagugaguuugca

SEQ ID NO: 736378 - RNA, 61 nt, hsa
gacuugagguaggagaaucacuugaaccucagcggcggagguugcagugagucgagaucgc

SEQ ID NO: 736379 - RNA, 61 nt, hsa
gaaacuccguuccuacaaaacccucuuugaugcggcggagacgauggucagccuucagcug

SEQ ID NO: 736380 - RNA, 61 nt, hsa
gcggcggccgcgguccugccacacaagcugggcggcggaggccacgcagccgggccuucuu

SEQ ID NO: 736381 - RNA, 61 nt, hsa
agaagcuuauccgagagaaagaugaggagcugcggcggaugcaggagaugcuacacaaaau

SEQ ID NO: 736382 - RNA, 61 nt, hsa
accuguaaccccagcacuuugggaggcuaaggcggcggaucacuugaggucaggaguucaa

SEQ ID NO: 736383 - RNA, 61 nt, hsa
uauuuaacagggaggggaagagggggcgaucgcggcggagcuggccccgccgccugguacu

SEQ ID NO: 736384 - RNA, 56 nt, hsa
cggggcugucccaguauuaaaagguggcggcggaagagcuaagcaacguggcuuag

SEQ ID NO: 736385 - RNA, 61 nt, hsa
uggaacggugacggccaccccgggacugcaggcggcggaugucaggcccugucugggccag

SEQ ID NO: 736386 - RNA, 61 nt, hsa
ugucacgcuaucagcaguucaaggauuuccagcggcggauccugguggccaccaaucuguu

SEQ ID NO: 736387 - RNA, 61 nt, hsa
gccgggacccccaggagaccaggucuggcucgcggcggacguccccaggggucacccugca

SEQ ID NO: 736388 - RNA, 61 nt, hsa
ugucuuaaggcaggacgacuuggaaaaaaaggcggcggacaguuggccagagggauggaga

SEQ ID NO: 736389 - RNA, 61 nt, hsa
ggcccaaggcuccggaccacacuggcccccugcggcggaggccaacgcagggcaccaccac

SEQ ID NO: 736390 - RNA, 60 nt, hsa
cggaccacgcugaccuguagguccgggggcgcggcggagcugggaccuaccugccugagu

SEQ ID NO: 736391 - RNA, 61 nt, hsa
cccaggccguggugaggaggcggaggcaucggcggcggaggcucaggguggggagcaggcc

SEQ ID NO: 736392 - RNA, 61 nt, hsa
gacuaaaaaugcagaaauuuacccaggcacggcggcggacgcccaucaucccagcuacuug

SEQ ID NO: 736393 - RNA, 64 nt, hsa; identical to SEQ ID NO: 155629

SEQ ID NO: 736394 - RNA, 64 nt, hsa; identical to SEQ ID NO: 155630

SEQ ID NO: 736395 - RNA, 64 nt, hsa; identical to SEQ ID NO: 155631

SEQ ID NO: 736396 - RNA, 64 nt, hsa; identical to SEQ ID NO: 155632

SEQ ID NO: 736397 - RNA, 64 nt, hsa; identical to SEQ ID NO: 155633

SEQ ID NO: 736398 - RNA, 64 nt, hsa; identical to SEQ ID NO: 155634

SEQ ID NO: 736399 - RNA, 64 nt, hsa; identical to SEQ ID NO: 155635

SEQ ID NO: 736400 - RNA, 64 nt, hsa; identical to SEQ ID NO: 155636

SEQ ID NO: 736401 - RNA, 64 nt, hsa; identical to SEQ ID NO: 155637

SEQ ID NO: 736402 - RNA, 64 nt, hsa; identical to SEQ ID NO: 155638

SEQ ID NO: 736403 - RNA, 64 nt, hsa; identical to SEQ ID NO: 155639

SEQ ID NO: 736404 - RNA, 64 nt, hsa; identical to SEQ ID NO: 155640

SEQ ID NO: 736405 - RNA, 64 nt, hsa; identical to SEQ ID NO: 155641

SEQ ID NO: 736406 - RNA, 64 nt, hsa; identical to SEQ ID NO: 155642

SEQ ID NO: 736407 - RNA, 64 nt, hsa; identical to SEQ ID NO: 155643

SEQ ID NO: 736408 - RNA, 64 nt, hsa; identical to SEQ ID NO: 155644

SEQ ID NO: 736409 - RNA, 64 nt, hsa; identical to SEQ ID NO: 155645

SEQ ID NO: 736410 - RNA, 64 nt, hsa; identical to SEQ ID NO: 155646

SEQ ID NO: 736411 - RNA, 64 nt, hsa; identical to SEQ ID NO: 155647

SEQ ID NO: 736412 - RNA, 64 nt, hsa; identical to SEQ ID NO: 155648

SEQ ID NO: 736413 - RNA, 64 nt, hsa; identical to SEQ ID NO: 155649

SEQ ID NO: 736414 - RNA, 64 nt, hsa; identical to SEQ ID NO: 155650

SEQ ID NO: 736415 - RNA, 64 nt, hsa; identical to SEQ ID NO: 155651

SEQ ID NO: 736416 - RNA, 64 nt, hsa; identical to SEQ ID NO: 155652

SEQ ID NO: 736417 - RNA, 64 nt, hsa; identical to SEQ ID NO: 155653

SEQ ID NO: 736418 - RNA, 64 nt, hsa; identical to SEQ ID NO: 155654

SEQ ID NO: 736419 - RNA, 64 nt, hsa; identical to SEQ ID NO: 155655

SEQ ID NO: 736420 - RNA, 64 nt, hsa; identical to SEQ ID NO: 155656

SEQ ID NO: 736421 - RNA, 64 nt, hsa; identical to SEQ ID NO: 155657

SEQ ID NO: 736422 - RNA, 64 nt, hsa; identical to SEQ ID NO: 155658

SEQ ID NO: 736423 - RNA, 64 nt, hsa; identical to SEQ ID NO: 155659

SEQ ID NO: 736424 - RNA, 64 nt, hsa; identical to SEQ ID NO: 155660

SEQ ID NO: 736425 - RNA, 64 nt, hsa; identical to SEQ ID NO: 155661

SEQ ID NO: 736426 - RNA, 64 nt, hsa; identical to SEQ ID NO: 155662

SEQ ID NO: 736427 - RNA, 64 nt, hsa; identical to SEQ ID NO: 155663

SEQ ID NO: 736428 - RNA, 64 nt, hsa; identical to SEQ ID NO: 155664

SEQ ID NO: 736429 - RNA, 64 nt, hsa; identical to SEQ ID NO: 155665

SEQ ID NO: 736430 - RNA, 64 nt, hsa; identical to SEQ ID NO: 155666

SEQ ID NO: 736431 - RNA, 64 nt, hsa; identical to SEQ ID NO: 155667

SEQ ID NO: 736432 - RNA, 64 nt, hsa; identical to SEQ ID NO: 155668

SEQ ID NO: 736433 - RNA, 64 nt, hsa; identical to SEQ ID NO: 155669

SEQ ID NO: 736434 - RNA, 64 nt, hsa; identical to SEQ ID NO: 155670

SEQ ID NO: 736435 - RNA, 64 nt, hsa; identical to SEQ ID NO: 155671

SEQ ID NO: 736436 - RNA, 64 nt, hsa; identical to SEQ ID NO: 155672

SEQ ID NO: 736437 - RNA, 64 nt, hsa; identical to SEQ ID NO: 155673

SEQ ID NO: 736438 - RNA, 64 nt, hsa; identical to SEQ ID NO: 155674

SEQ ID NO: 736439 - RNA, 64 nt, hsa; identical to SEQ ID NO: 155675

SEQ ID NO: 736440 - RNA, 64 nt, hsa; identical to SEQ ID NO: 155676

SEQ ID NO: 736441 - RNA, 64 nt, hsa; identical to SEQ ID NO: 155677

SEQ ID NO: 736442 - RNA, 64 nt, hsa; identical to SEQ ID NO: 155678

SEQ ID NO: 736443 - RNA, 64 nt, hsa; identical to SEQ ID NO: 155679

SEQ ID NO: 736444 - RNA, 64 nt, hsa; identical to SEQ ID NO: 155680

SEQ ID NO: 736445 - RNA, 64 nt, hsa; identical to SEQ ID NO: 155681

SEQ ID NO: 736446 - RNA, 64 nt, hsa; identical to SEQ ID NO: 155682

SEQ ID NO: 736447 - RNA, 64 nt, hsa; identical to SEQ ID NO: 155683

SEQ ID NO: 736448 - RNA, 64 nt, hsa; identical to SEQ ID NO: 155684

SEQ ID NO: 736449 - RNA, 64 nt, hsa; identical to SEQ ID NO: 155685

SEQ ID NO: 736450 - RNA, 64 nt, hsa; identical to SEQ ID NO: 155686

SEQ ID NO: 736451 - RNA, 64 nt, hsa; identical to SEQ ID NO: 155687

SEQ ID NO: 736452 - RNA, 64 nt, hsa; identical to SEQ ID NO: 155688

SEQ ID NO: 736453 - RNA, 64 nt, hsa; identical to SEQ ID NO: 155689

SEQ ID NO: 736454 - RNA, 64 nt, hsa; identical to SEQ ID NO: 155690

SEQ ID NO: 736455 - RNA, 64 nt, hsa; identical to SEQ ID NO: 155691

SEQ ID NO: 736456 - RNA, 64 nt, hsa; identical to SEQ ID NO: 155692

SEQ ID NO: 736457 - RNA, 64 nt, hsa; identical to SEQ ID NO: 155693

SEQ ID NO: 736458 - RNA, 64 nt, hsa; identical to SEQ ID NO: 155694

SEQ ID NO: 736459 - RNA, 64 nt, hsa; identical to SEQ ID NO: 155695

SEQ ID NO: 736460 - RNA, 64 nt, hsa; identical to SEQ ID NO: 155696

SEQ ID NO: 736461 - RNA, 64 nt, hsa; identical to SEQ ID NO: 155697

SEQ ID NO: 736462 - RNA, 64 nt, hsa; identical to SEQ ID NO: 155698

SEQ ID NO: 736463 - RNA, 64 nt, hsa; identical to SEQ ID NO: 155699

SEQ ID NO: 736464 - RNA, 64 nt, hsa; identical to SEQ ID NO: 155700

SEQ ID NO: 736465 - RNA, 64 nt, hsa; identical to SEQ ID NO: 155701

SEQ ID NO: 736466 - RNA, 64 nt, hsa; identical to SEQ ID NO: 155702

SEQ ID NO: 736467 - RNA, 64 nt, hsa; identical to SEQ ID NO: 155703

SEQ ID NO: 736468 - RNA, 64 nt, hsa; identical to SEQ ID NO: 155704

SEQ ID NO: 736469 - RNA, 64 nt, hsa; identical to SEQ ID NO: 155705

SEQ ID NO: 736470 - RNA, 64 nt, hsa; identical to SEQ ID NO: 155706

SEQ ID NO: 736471 - RNA, 64 nt, hsa; identical to SEQ ID NO: 155707

SEQ ID NO: 736472 - RNA, 64 nt, hsa; identical to SEQ ID NO: 155708

SEQ ID NO: 736473 - RNA, 64 nt, hsa; identical to SEQ ID NO: 155709

SEQ ID NO: 736474 - RNA, 64 nt, hsa; identical to SEQ ID NO: 155710

SEQ ID NO: 736475 - RNA, 64 nt, hsa; identical to SEQ ID NO: 155711

SEQ ID NO: 736476 - RNA, 64 nt, hsa; identical to SEQ ID NO: 155712

SEQ ID NO: 736477 - RNA, 64 nt, hsa; identical to SEQ ID NO: 155713

SEQ ID NO: 736478 - RNA, 64 nt, hsa; identical to SEQ ID NO: 155714

SEQ ID NO: 736479 - RNA, 64 nt, hsa; identical to SEQ ID NO: 155715

SEQ ID NO: 736480 - RNA, 64 nt, hsa; identical to SEQ ID NO: 155716

SEQ ID NO: 736481 - RNA, 64 nt, hsa; identical to SEQ ID NO: 155717

SEQ ID NO: 736482 - RNA, 64 nt, hsa; identical to SEQ ID NO: 155718

SEQ ID NO: 736483 - RNA, 64 nt, hsa; identical to SEQ ID NO: 155719

SEQ ID NO: 736484 - RNA, 64 nt, hsa; identical to SEQ ID NO: 155720

SEQ ID NO: 736485 - RNA, 64 nt, hsa; identical to SEQ ID NO: 155721

SEQ ID NO: 736486 - RNA, 64 nt, hsa; identical to SEQ ID NO: 155722

SEQ ID NO: 736487 - RNA, 64 nt, hsa; identical to SEQ ID NO: 155723

SEQ ID NO: 736488 - RNA, 64 nt, hsa; identical to SEQ ID NO: 155724

SEQ ID NO: 736489 - RNA, 64 nt, hsa; identical to SEQ ID NO: 155725

SEQ ID NO: 736490 - RNA, 64 nt, hsa; identical to SEQ ID NO: 155726

SEQ ID NO: 736491 - RNA, 64 nt, hsa; identical to SEQ ID NO: 155727

SEQ ID NO: 736492 - RNA, 64 nt, hsa; identical to SEQ ID NO: 155728

SEQ ID NO: 736493 - RNA, 64 nt, hsa; identical to SEQ ID NO: 155729

SEQ ID NO: 736494 - RNA, 58 nt, hsa; identical to SEQ ID NO: 155730

SEQ ID NO: 736495 - RNA, 64 nt, hsa; identical to SEQ ID NO: 155731

SEQ ID NO: 736496 - RNA, 64 nt, hsa; identical to SEQ ID NO: 155732

SEQ ID NO: 736497 - RNA, 64 nt, hsa; identical to SEQ ID NO: 155733

SEQ ID NO: 736498 - RNA, 64 nt, hsa; identical to SEQ ID NO: 155734

SEQ ID NO: 736499 - RNA, 64 nt, hsa; identical to SEQ ID NO: 155735

SEQ ID NO: 736500 - RNA, 64 nt, hsa; identical to SEQ ID NO: 155736

SEQ ID NO: 736501 - RNA, 64 nt, hsa; identical to SEQ ID NO: 155737

SEQ ID NO: 736502 - RNA, 64 nt, hsa; identical to SEQ ID NO: 155738

SEQ ID NO: 736503 - RNA, 64 nt, hsa; identical to SEQ ID NO: 155739

SEQ ID NO: 736504 - RNA, 64 nt, hsa; identical to SEQ ID NO: 155740

SEQ ID NO: 736505 - RNA, 64 nt, hsa; identical to SEQ ID NO: 155741

SEQ ID NO: 736506 - RNA, 64 nt, hsa; identical to SEQ ID NO: 155742

SEQ ID NO: 736507 - RNA, 64 nt, hsa; identical to SEQ ID NO: 155743

SEQ ID NO: 736508 - RNA, 64 nt, hsa; identical to SEQ ID NO: 155744

SEQ ID NO: 736509 - RNA, 64 nt, hsa; identical to SEQ ID NO: 155745

SEQ ID NO: 736510 - RNA, 64 nt, hsa; identical to SEQ ID NO: 155746

SEQ ID NO: 736511 - RNA, 64 nt, hsa; identical to SEQ ID NO: 155747

SEQ ID NO: 736512 - RNA, 64 nt, hsa; identical to SEQ ID NO: 155748

SEQ ID NO: 736513 - RNA, 64 nt, hsa; identical to SEQ ID NO: 155749

SEQ ID NO: 736514 - RNA, 64 nt, hsa; identical to SEQ ID NO: 155750

SEQ ID NO: 736515 - RNA, 64 nt, hsa; identical to SEQ ID NO: 155751

SEQ ID NO: 736516 - RNA, 64 nt, hsa; identical to SEQ ID NO: 155752

SEQ ID NO: 736517 - RNA, 64 nt, hsa; identical to SEQ ID NO: 155753

SEQ ID NO: 736518 - RNA, 63 nt, hsa; identical to SEQ ID NO: 155754

SEQ ID NO: 736519 - RNA, 64 nt, hsa; identical to SEQ ID NO: 155755

SEQ ID NO: 736520 - RNA, 64 nt, hsa; identical to SEQ ID NO: 155756

SEQ ID NO: 736521 - RNA, 64 nt, hsa; identical to SEQ ID NO: 155757

SEQ ID NO: 736522 - RNA, 64 nt, hsa; identical to SEQ ID NO: 155758

SEQ ID NO: 736523 - RNA, 64 nt, hsa; identical to SEQ ID NO: 155759

SEQ ID NO: 736524 - RNA, 64 nt, hsa; identical to SEQ ID NO: 155760

SEQ ID NO: 736525 - RNA, 64 nt, hsa; identical to SEQ ID NO: 155761

SEQ ID NO: 736526 - RNA, 64 nt, hsa; identical to SEQ ID NO: 155762

SEQ ID NO: 736527 - RNA, 64 nt, hsa; identical to SEQ ID NO: 155763

SEQ ID NO: 736528 - RNA, 64 nt, hsa; identical to SEQ ID NO: 155764

SEQ ID NO: 736529 - RNA, 64 nt, hsa; identical to SEQ ID NO: 155765

SEQ ID NO: 736530 - RNA, 64 nt, hsa; identical to SEQ ID NO: 155766

SEQ ID NO: 736531 - RNA, 64 nt, hsa; identical to SEQ ID NO: 155767

SEQ ID NO: 736532 - RNA, 64 nt, hsa; identical to SEQ ID NO: 155768

SEQ ID NO: 736533 - RNA, 64 nt, hsa; identical to SEQ ID NO: 155769

SEQ ID NO: 736534 - RNA, 64 nt, hsa; identical to SEQ ID NO: 155770

SEQ ID NO: 736535 - RNA, 64 nt, hsa; identical to SEQ ID NO: 155771

SEQ ID NO: 736536 - RNA, 64 nt, hsa; identical to SEQ ID NO: 155772

SEQ ID NO: 736537 - RNA, 64 nt, hsa; identical to SEQ ID NO: 155773

SEQ ID NO: 736538 - RNA, 64 nt, hsa; identical to SEQ ID NO: 155774

SEQ ID NO: 736539 - RNA, 64 nt, hsa; identical to SEQ ID NO: 155775

SEQ ID NO: 736540 - RNA, 64 nt, hsa; identical to SEQ ID NO: 155776

SEQ ID NO: 736541 - RNA, 64 nt, hsa; identical to SEQ ID NO: 155777

SEQ ID NO: 736542 - RNA, 64 nt, hsa; identical to SEQ ID NO: 155778

SEQ ID NO: 736543 - RNA, 64 nt, hsa; identical to SEQ ID NO: 155779

SEQ ID NO: 736544 - RNA, 64 nt, hsa; identical to SEQ ID NO: 155780

SEQ ID NO: 736545 - RNA, 64 nt, hsa; identical to SEQ ID NO: 155781

SEQ ID NO: 736546 - RNA, 64 nt, hsa; identical to SEQ ID NO: 155782

SEQ ID NO: 736547 - RNA, 64 nt, hsa; identical to SEQ ID NO: 155783

SEQ ID NO: 736548 - RNA, 64 nt, hsa; identical to SEQ ID NO: 155784

SEQ ID NO: 736549 - RNA, 64 nt, hsa; identical to SEQ ID NO: 155785

SEQ ID NO: 736550 - RNA, 64 nt, hsa; identical to SEQ ID NO: 155786

SEQ ID NO: 736551 - RNA, 53 nt, hsa; identical to SEQ ID NO: 155787

SEQ ID NO: 736552 - RNA, 64 nt, hsa; identical to SEQ ID NO: 155788

SEQ ID NO: 736553 - RNA, 64 nt, hsa; identical to SEQ ID NO: 155789

SEQ ID NO: 736554 - RNA, 64 nt, hsa; identical to SEQ ID NO: 155790

SEQ ID NO: 736555 - RNA, 64 nt, hsa; identical to SEQ ID NO: 155791

SEQ ID NO: 736556 - RNA, 64 nt, hsa; identical to SEQ ID NO: 155792

SEQ ID NO: 736557 - RNA, 64 nt, hsa; identical to SEQ ID NO: 155793

SEQ ID NO: 736558 - RNA, 64 nt, hsa; identical to SEQ ID NO: 155794

SEQ ID NO: 736559 - RNA, 64 nt, hsa; identical to SEQ ID NO: 155795

SEQ ID NO: 736560 - RNA, 64 nt, hsa; identical to SEQ ID NO: 155796

SEQ ID NO: 736561 - RNA, 64 nt, hsa; identical to SEQ ID NO: 155797

SEQ ID NO: 736562 - RNA, 64 nt, hsa; identical to SEQ ID NO: 155798

SEQ ID NO: 736563 - RNA, 64 nt, hsa; identical to SEQ ID NO: 155799

SEQ ID NO: 736564 - RNA, 64 nt, hsa; identical to SEQ ID NO: 155800

SEQ ID NO: 736565 - RNA, 64 nt, hsa; identical to SEQ ID NO: 155801

SEQ ID NO: 736566 - RNA, 64 nt, hsa; identical to SEQ ID NO: 155802

SEQ ID NO: 736567 - RNA, 64 nt, hsa; identical to SEQ ID NO: 155803

SEQ ID NO: 736568 - RNA, 64 nt, hsa; identical to SEQ ID NO: 155804

SEQ ID NO: 736569 - RNA, 64 nt, hsa; identical to SEQ ID NO: 155805

SEQ ID NO: 736570 - RNA, 64 nt, hsa; identical to SEQ ID NO: 155806

SEQ ID NO: 736571 - RNA, 64 nt, hsa; identical to SEQ ID NO: 155807

SEQ ID NO: 736572 - RNA, 64 nt, hsa; identical to SEQ ID NO: 155808

SEQ ID NO: 736573 - RNA, 64 nt, hsa; identical to SEQ ID NO: 243402

SEQ ID NO: 736574 - RNA, 64 nt, hsa; identical to SEQ ID NO: 243403

SEQ ID NO: 736575 - RNA, 64 nt, hsa; identical to SEQ ID NO: 155629

SEQ ID NO: 736576 - RNA, 64 nt, hsa; identical to SEQ ID NO: 155630

SEQ ID NO: 736577 - RNA, 64 nt, hsa; identical to SEQ ID NO: 155631

SEQ ID NO: 736578 - RNA, 64 nt, hsa; identical to SEQ ID NO: 155632

SEQ ID NO: 736579 - RNA, 64 nt, hsa; identical to SEQ ID NO: 155633

SEQ ID NO: 736580 - RNA, 64 nt, hsa; identical to SEQ ID NO: 155634

SEQ ID NO: 736581 - RNA, 64 nt, hsa; identical to SEQ ID NO: 155635

SEQ ID NO: 736582 - RNA, 64 nt, hsa; identical to SEQ ID NO: 155636

SEQ ID NO: 736583 - RNA, 64 nt, hsa; identical to SEQ ID NO: 155637

SEQ ID NO: 736584 - RNA, 64 nt, hsa; identical to SEQ ID NO: 155638

SEQ ID NO: 736585 - RNA, 64 nt, hsa; identical to SEQ ID NO: 155639

SEQ ID NO: 736586 - RNA, 64 nt, hsa; identical to SEQ ID NO: 155640

SEQ ID NO: 736587 - RNA, 64 nt, hsa; identical to SEQ ID NO: 155641

SEQ ID NO: 736588 - RNA, 64 nt, hsa; identical to SEQ ID NO: 155642

SEQ ID NO: 736589 - RNA, 64 nt, hsa; identical to SEQ ID NO: 155643

SEQ ID NO: 736590 - RNA, 64 nt, hsa; identical to SEQ ID NO: 155644

SEQ ID NO: 736591 - RNA, 64 nt, hsa; identical to SEQ ID NO: 155645

SEQ ID NO: 736592 - RNA, 64 nt, hsa; identical to SEQ ID NO: 155646

SEQ ID NO: 736593 - RNA, 64 nt, hsa; identical to SEQ ID NO: 155647

SEQ ID NO: 736594 - RNA, 64 nt, hsa; identical to SEQ ID NO: 155648

SEQ ID NO: 736595 - RNA, 64 nt, hsa; identical to SEQ ID NO: 155649

SEQ ID NO: 736596 - RNA, 64 nt, hsa; identical to SEQ ID NO: 155650

SEQ ID NO: 736597 - RNA, 64 nt, hsa; identical to SEQ ID NO: 155651

SEQ ID NO: 736598 - RNA, 64 nt, hsa; identical to SEQ ID NO: 155652

SEQ ID NO: 736599 - RNA, 64 nt, hsa; identical to SEQ ID NO: 155653

SEQ ID NO: 736600 - RNA, 64 nt, hsa; identical to SEQ ID NO: 155654

SEQ ID NO: 736601 - RNA, 64 nt, hsa; identical to SEQ ID NO: 155655

SEQ ID NO: 736602 - RNA, 64 nt, hsa; identical to SEQ ID NO: 155656

SEQ ID NO: 736603 - RNA, 64 nt, hsa; identical to SEQ ID NO: 155657

SEQ ID NO: 736604 - RNA, 64 nt, hsa; identical to SEQ ID NO: 155658

SEQ ID NO: 736605 - RNA, 64 nt, hsa; identical to SEQ ID NO: 155659

SEQ ID NO: 736606 - RNA, 64 nt, hsa; identical to SEQ ID NO: 155660

SEQ ID NO: 736607 - RNA, 64 nt, hsa; identical to SEQ ID NO: 155661

SEQ ID NO: 736608 - RNA, 64 nt, hsa; identical to SEQ ID NO: 155662

SEQ ID NO: 736609 - RNA, 64 nt, hsa; identical to SEQ ID NO: 155663

SEQ ID NO: 736610 - RNA, 64 nt, hsa; identical to SEQ ID NO: 155664

SEQ ID NO: 736611 - RNA, 64 nt, hsa; identical to SEQ ID NO: 155665

SEQ ID NO: 736612 - RNA, 64 nt, hsa; identical to SEQ ID NO: 155666

SEQ ID NO: 736613 - RNA, 64 nt, hsa; identical to SEQ ID NO: 155667

SEQ ID NO: 736614 - RNA, 64 nt, hsa; identical to SEQ ID NO: 155668

SEQ ID NO: 736615 - RNA, 64 nt, hsa; identical to SEQ ID NO: 155669

SEQ ID NO: 736616 - RNA, 64 nt, hsa; identical to SEQ ID NO: 155670

SEQ ID NO: 736617 - RNA, 64 nt, hsa; identical to SEQ ID NO: 155671

SEQ ID NO: 736618 - RNA, 64 nt, hsa; identical to SEQ ID NO: 155672

SEQ ID NO: 736619 - RNA, 64 nt, hsa; identical to SEQ ID NO: 155673

SEQ ID NO: 736620 - RNA, 64 nt, hsa; identical to SEQ ID NO: 155674

SEQ ID NO: 736621 - RNA, 64 nt, hsa; identical to SEQ ID NO: 155675

SEQ ID NO: 736622 - RNA, 64 nt, hsa; identical to SEQ ID NO: 155676

SEQ ID NO: 736623 - RNA, 64 nt, hsa; identical to SEQ ID NO: 155677

SEQ ID NO: 736624 - RNA, 64 nt, hsa; identical to SEQ ID NO: 155678

SEQ ID NO: 736625 - RNA, 64 nt, hsa; identical to SEQ ID NO: 155679

SEQ ID NO: 736626 - RNA, 64 nt, hsa; identical to SEQ ID NO: 155680

SEQ ID NO: 736627 - RNA, 64 nt, hsa; identical to SEQ ID NO: 155681

SEQ ID NO: 736628 - RNA, 64 nt, hsa; identical to SEQ ID NO: 155682

SEQ ID NO: 736629 - RNA, 64 nt, hsa; identical to SEQ ID NO: 155683

SEQ ID NO: 736630 - RNA, 64 nt, hsa; identical to SEQ ID NO: 155684

SEQ ID NO: 736631 - RNA, 64 nt, hsa; identical to SEQ ID NO: 155685

SEQ ID NO: 736632 - RNA, 64 nt, hsa; identical to SEQ ID NO: 155686

SEQ ID NO: 736633 - RNA, 64 nt, hsa; identical to SEQ ID NO: 155687

SEQ ID NO: 736634 - RNA, 64 nt, hsa; identical to SEQ ID NO: 155688

SEQ ID NO: 736635 - RNA, 64 nt, hsa; identical to SEQ ID NO: 155689

SEQ ID NO: 736636 - RNA, 64 nt, hsa; identical to SEQ ID NO: 155690

SEQ ID NO: 736637 - RNA, 64 nt, hsa; identical to SEQ ID NO: 155691

SEQ ID NO: 736638 - RNA, 64 nt, hsa; identical to SEQ ID NO: 155692

SEQ ID NO: 736639 - RNA, 64 nt, hsa; identical to SEQ ID NO: 155693

SEQ ID NO: 736640 - RNA, 64 nt, hsa; identical to SEQ ID NO: 155694

SEQ ID NO: 736641 - RNA, 64 nt, hsa; identical to SEQ ID NO: 155695

SEQ ID NO: 736642 - RNA, 64 nt, hsa; identical to SEQ ID NO: 155696

SEQ ID NO: 736643 - RNA, 64 nt, hsa; identical to SEQ ID NO: 155697

SEQ ID NO: 736644 - RNA, 64 nt, hsa; identical to SEQ ID NO: 155698

SEQ ID NO: 736645 - RNA, 64 nt, hsa; identical to SEQ ID NO: 155699

SEQ ID NO: 736646 - RNA, 64 nt, hsa; identical to SEQ ID NO: 155700

SEQ ID NO: 736647 - RNA, 64 nt, hsa; identical to SEQ ID NO: 155701

SEQ ID NO: 736648 - RNA, 64 nt, hsa; identical to SEQ ID NO: 155702

SEQ ID NO: 736649 - RNA, 64 nt, hsa; identical to SEQ ID NO: 155703

SEQ ID NO: 736650 - RNA, 64 nt, hsa; identical to SEQ ID NO: 155704

SEQ ID NO: 736651 - RNA, 64 nt, hsa; identical to SEQ ID NO: 155705

SEQ ID NO: 736652 - RNA, 64 nt, hsa; identical to SEQ ID NO: 155706

SEQ ID NO: 736653 - RNA, 64 nt, hsa; identical to SEQ ID NO: 155707

SEQ ID NO: 736654 - RNA, 64 nt, hsa; identical to SEQ ID NO: 155708

SEQ ID NO: 736655 - RNA, 64 nt, hsa; identical to SEQ ID NO: 155709

SEQ ID NO: 736656 - RNA, 64 nt, hsa; identical to SEQ ID NO: 155710

SEQ ID NO: 736657 - RNA, 64 nt, hsa; identical to SEQ ID NO: 155711

SEQ ID NO: 736658 - RNA, 64 nt, hsa; identical to SEQ ID NO: 155712

SEQ ID NO: 736659 - RNA, 64 nt, hsa; identical to SEQ ID NO: 155713

SEQ ID NO: 736660 - RNA, 64 nt, hsa; identical to SEQ ID NO: 155714

SEQ ID NO: 736661 - RNA, 64 nt, hsa; identical to SEQ ID NO: 155715

SEQ ID NO: 736662 - RNA, 64 nt, hsa; identical to SEQ ID NO: 155716

SEQ ID NO: 736663 - RNA, 64 nt, hsa; identical to SEQ ID NO: 155717

SEQ ID NO: 736664 - RNA, 64 nt, hsa; identical to SEQ ID NO: 155718

SEQ ID NO: 736665 - RNA, 64 nt, hsa; identical to SEQ ID NO: 155719

SEQ ID NO: 736666 - RNA, 64 nt, hsa; identical to SEQ ID NO: 155720

SEQ ID NO: 736667 - RNA, 64 nt, hsa; identical to SEQ ID NO: 155721

SEQ ID NO: 736668 - RNA, 64 nt, hsa; identical to SEQ ID NO: 155722

SEQ ID NO: 736669 - RNA, 64 nt, hsa; identical to SEQ ID NO: 155723

SEQ ID NO: 736670 - RNA, 64 nt, hsa; identical to SEQ ID NO: 155724

SEQ ID NO: 736671 - RNA, 64 nt, hsa; identical to SEQ ID NO: 155725

SEQ ID NO: 736672 - RNA, 64 nt, hsa; identical to SEQ ID NO: 155726

SEQ ID NO: 736673 - RNA, 64 nt, hsa; identical to SEQ ID NO: 155727

SEQ ID NO: 736674 - RNA, 64 nt, hsa; identical to SEQ ID NO: 155728

SEQ ID NO: 736675 - RNA, 64 nt, hsa; identical to SEQ ID NO: 155729

SEQ ID NO: 736676 - RNA, 58 nt, hsa; identical to SEQ ID NO: 155730

SEQ ID NO: 736677 - RNA, 64 nt, hsa; identical to SEQ ID NO: 155731

SEQ ID NO: 736678 - RNA, 64 nt, hsa; identical to SEQ ID NO: 155732

SEQ ID NO: 736679 - RNA, 64 nt, hsa; identical to SEQ ID NO: 155733

SEQ ID NO: 736680 - RNA, 64 nt, hsa; identical to SEQ ID NO: 155734

SEQ ID NO: 736681 - RNA, 64 nt, hsa; identical to SEQ ID NO: 155735

SEQ ID NO: 736682 - RNA, 64 nt, hsa; identical to SEQ ID NO: 155736

SEQ ID NO: 736683 - RNA, 64 nt, hsa; identical to SEQ ID NO: 155737

SEQ ID NO: 736684 - RNA, 64 nt, hsa; identical to SEQ ID NO: 155738

SEQ ID NO: 736685 - RNA, 64 nt, hsa; identical to SEQ ID NO: 155739

SEQ ID NO: 736686 - RNA, 64 nt, hsa; identical to SEQ ID NO: 155740

SEQ ID NO: 736687 - RNA, 64 nt, hsa; identical to SEQ ID NO: 155741

SEQ ID NO: 736688 - RNA, 64 nt, hsa; identical to SEQ ID NO: 155742

SEQ ID NO: 736689 - RNA, 64 nt, hsa; identical to SEQ ID NO: 155743

SEQ ID NO: 736690 - RNA, 64 nt, hsa; identical to SEQ ID NO: 155744

SEQ ID NO: 736691 - RNA, 64 nt, hsa; identical to SEQ ID NO: 155745

SEQ ID NO: 736692 - RNA, 64 nt, hsa; identical to SEQ ID NO: 155746

SEQ ID NO: 736693 - RNA, 64 nt, hsa; identical to SEQ ID NO: 155747

SEQ ID NO: 736694 - RNA, 64 nt, hsa; identical to SEQ ID NO: 155748

SEQ ID NO: 736695 - RNA, 64 nt, hsa; identical to SEQ ID NO: 155749

SEQ ID NO: 736696 - RNA, 64 nt, hsa; identical to SEQ ID NO: 155750

SEQ ID NO: 736697 - RNA, 64 nt, hsa; identical to SEQ ID NO: 155751

SEQ ID NO: 736698 - RNA, 64 nt, hsa; identical to SEQ ID NO: 155752

SEQ ID NO: 736699 - RNA, 64 nt, hsa; identical to SEQ ID NO: 155753

SEQ ID NO: 736700 - RNA, 63 nt, hsa; identical to SEQ ID NO: 155754

SEQ ID NO: 736701 - RNA, 64 nt, hsa; identical to SEQ ID NO: 155755

SEQ ID NO: 736702 - RNA, 64 nt, hsa; identical to SEQ ID NO: 155756

SEQ ID NO: 736703 - RNA, 64 nt, hsa; identical to SEQ ID NO: 155757

SEQ ID NO: 736704 - RNA, 64 nt, hsa; identical to SEQ ID NO: 155758

SEQ ID NO: 736705 - RNA, 64 nt, hsa; identical to SEQ ID NO: 155759

SEQ ID NO: 736706 - RNA, 64 nt, hsa; identical to SEQ ID NO: 155760

SEQ ID NO: 736707 - RNA, 64 nt, hsa; identical to SEQ ID NO: 155761

SEQ ID NO: 736708 - RNA, 64 nt, hsa; identical to SEQ ID NO: 155762

SEQ ID NO: 736709 - RNA, 64 nt, hsa; identical to SEQ ID NO: 155763

SEQ ID NO: 736710 - RNA, 64 nt, hsa; identical to SEQ ID NO: 155764

SEQ ID NO: 736711 - RNA, 64 nt, hsa; identical to SEQ ID NO: 155765

SEQ ID NO: 736712 - RNA, 64 nt, hsa; identical to SEQ ID NO: 155766

SEQ ID NO: 736713 - RNA, 64 nt, hsa; identical to SEQ ID NO: 155767

SEQ ID NO: 736714 - RNA, 64 nt, hsa; identical to SEQ ID NO: 155768

SEQ ID NO: 736715 - RNA, 64 nt, hsa; identical to SEQ ID NO: 155769

SEQ ID NO: 736716 - RNA, 64 nt, hsa; identical to SEQ ID NO: 155770

SEQ ID NO: 736717 - RNA, 64 nt, hsa; identical to SEQ ID NO: 155771

SEQ ID NO: 736718 - RNA, 64 nt, hsa; identical to SEQ ID NO: 155772

SEQ ID NO: 736719 - RNA, 64 nt, hsa; identical to SEQ ID NO: 155773

SEQ ID NO: 736720 - RNA, 64 nt, hsa; identical to SEQ ID NO: 155774

SEQ ID NO: 736721 - RNA, 64 nt, hsa; identical to SEQ ID NO: 155775

SEQ ID NO: 736722 - RNA, 64 nt, hsa; identical to SEQ ID NO: 155776

SEQ ID NO: 736723 - RNA, 64 nt, hsa; identical to SEQ ID NO: 155777

SEQ ID NO: 736724 - RNA, 64 nt, hsa; identical to SEQ ID NO: 155778

SEQ ID NO: 736725 - RNA, 64 nt, hsa; identical to SEQ ID NO: 155779

SEQ ID NO: 736726 - RNA, 64 nt, hsa; identical to SEQ ID NO: 155780

SEQ ID NO: 736727 - RNA, 64 nt, hsa; identical to SEQ ID NO: 155781

SEQ ID NO: 736728 - RNA, 64 nt, hsa; identical to SEQ ID NO: 155782

SEQ ID NO: 736729 - RNA, 64 nt, hsa; identical to SEQ ID NO: 155783

SEQ ID NO: 736730 - RNA, 64 nt, hsa; identical to SEQ ID NO: 155784

SEQ ID NO: 736731 - RNA, 64 nt, hsa; identical to SEQ ID NO: 155785

SEQ ID NO: 736732 - RNA, 64 nt, hsa; identical to SEQ ID NO: 155786

SEQ ID NO: 736733 - RNA, 53 nt, hsa; identical to SEQ ID NO: 155787

SEQ ID NO: 736734 - RNA, 64 nt, hsa; identical to SEQ ID NO: 155788

SEQ ID NO: 736735 - RNA, 64 nt, hsa; identical to SEQ ID NO: 155789

SEQ ID NO: 736736 - RNA, 64 nt, hsa; identical to SEQ ID NO: 155790

SEQ ID NO: 736737 - RNA, 64 nt, hsa; identical to SEQ ID NO: 155791

SEQ ID NO: 736738 - RNA, 64 nt, hsa; identical to SEQ ID NO: 155792

SEQ ID NO: 736739 - RNA, 64 nt, hsa; identical to SEQ ID NO: 155793

SEQ ID NO: 736740 - RNA, 64 nt, hsa; identical to SEQ ID NO: 155794

SEQ ID NO: 736741 - RNA, 64 nt, hsa; identical to SEQ ID NO: 155795

SEQ ID NO: 736742 - RNA, 64 nt, hsa; identical to SEQ ID NO: 155796

SEQ ID NO: 736743 - RNA, 64 nt, hsa; identical to SEQ ID NO: 155797

SEQ ID NO: 736744 - RNA, 64 nt, hsa; identical to SEQ ID NO: 155798

SEQ ID NO: 736745 - RNA, 64 nt, hsa; identical to SEQ ID NO: 155799

SEQ ID NO: 736746 - RNA, 64 nt, hsa; identical to SEQ ID NO: 155800

SEQ ID NO: 736747 - RNA, 64 nt, hsa; identical to SEQ ID NO: 155801

SEQ ID NO: 736748 - RNA, 64 nt, hsa; identical to SEQ ID NO: 155802

SEQ ID NO: 736749 - RNA, 64 nt, hsa; identical to SEQ ID NO: 155803

SEQ ID NO: 736750 - RNA, 64 nt, hsa; identical to SEQ ID NO: 155804

SEQ ID NO: 736751 - RNA, 64 nt, hsa; identical to SEQ ID NO: 155805

SEQ ID NO: 736752 - RNA, 64 nt, hsa; identical to SEQ ID NO: 155806

SEQ ID NO: 736753 - RNA, 64 nt, hsa; identical to SEQ ID NO: 155807

SEQ ID NO: 736754 - RNA, 64 nt, hsa; identical to SEQ ID NO: 155808

SEQ ID NO: 736755 - RNA, 64 nt, hsa; identical to SEQ ID NO: 243402

SEQ ID NO: 736756 - RNA, 64 nt, hsa; identical to SEQ ID NO: 243403

SEQ ID NO: 736757 - RNA, 64 nt, hsa; identical to SEQ ID NO: 155629

SEQ ID NO: 736758 - RNA, 64 nt, hsa; identical to SEQ ID NO: 155630

SEQ ID NO: 736759 - RNA, 64 nt, hsa; identical to SEQ ID NO: 155631

SEQ ID NO: 736760 - RNA, 64 nt, hsa; identical to SEQ ID NO: 155632

SEQ ID NO: 736761 - RNA, 64 nt, hsa; identical to SEQ ID NO: 155633

SEQ ID NO: 736762 - RNA, 64 nt, hsa; identical to SEQ ID NO: 155634

SEQ ID NO: 736763 - RNA, 64 nt, hsa; identical to SEQ ID NO: 155635

SEQ ID NO: 736764 - RNA, 64 nt, hsa; identical to SEQ ID NO: 155636

SEQ ID NO: 736765 - RNA, 64 nt, hsa; identical to SEQ ID NO: 155637

SEQ ID NO: 736766 - RNA, 64 nt, hsa; identical to SEQ ID NO: 155638

SEQ ID NO: 736767 - RNA, 64 nt, hsa; identical to SEQ ID NO: 155639

SEQ ID NO: 736768 - RNA, 64 nt, hsa; identical to SEQ ID NO: 155640

SEQ ID NO: 736769 - RNA, 64 nt, hsa; identical to SEQ ID NO: 155641

SEQ ID NO: 736770 - RNA, 64 nt, hsa; identical to SEQ ID NO: 155642

SEQ ID NO: 736771 - RNA, 64 nt, hsa; identical to SEQ ID NO: 155643

SEQ ID NO: 736772 - RNA, 64 nt, hsa; identical to SEQ ID NO: 155644

SEQ ID NO: 736773 - RNA, 64 nt, hsa; identical to SEQ ID NO: 155645

SEQ ID NO: 736774 - RNA, 64 nt, hsa; identical to SEQ ID NO: 155646

SEQ ID NO: 736775 - RNA, 64 nt, hsa; identical to SEQ ID NO: 155647

SEQ ID NO: 736776 - RNA, 64 nt, hsa; identical to SEQ ID NO: 155648

SEQ ID NO: 736777 - RNA, 64 nt, hsa; identical to SEQ ID NO: 155649

SEQ ID NO: 736778 - RNA, 64 nt, hsa; identical to SEQ ID NO: 155650

SEQ ID NO: 736779 - RNA, 64 nt, hsa; identical to SEQ ID NO: 155651

SEQ ID NO: 736780 - RNA, 64 nt, hsa; identical to SEQ ID NO: 155652

SEQ ID NO: 736781 - RNA, 64 nt, hsa; identical to SEQ ID NO: 155653

SEQ ID NO: 736782 - RNA, 64 nt, hsa; identical to SEQ ID NO: 155654

SEQ ID NO: 736783 - RNA, 64 nt, hsa; identical to SEQ ID NO: 155655

SEQ ID NO: 736784 - RNA, 64 nt, hsa; identical to SEQ ID NO: 155656

SEQ ID NO: 736785 - RNA, 64 nt, hsa; identical to SEQ ID NO: 155657

SEQ ID NO: 736786 - RNA, 64 nt, hsa; identical to SEQ ID NO: 155658

SEQ ID NO: 736787 - RNA, 64 nt, hsa; identical to SEQ ID NO: 155659

SEQ ID NO: 736788 - RNA, 64 nt, hsa; identical to SEQ ID NO: 155660

SEQ ID NO: 736789 - RNA, 64 nt, hsa; identical to SEQ ID NO: 155661

SEQ ID NO: 736790 - RNA, 64 nt, hsa; identical to SEQ ID NO: 155662

SEQ ID NO: 736791 - RNA, 64 nt, hsa; identical to SEQ ID NO: 155663

SEQ ID NO: 736792 - RNA, 64 nt, hsa; identical to SEQ ID NO: 155664

SEQ ID NO: 736793 - RNA, 64 nt, hsa; identical to SEQ ID NO: 155665

SEQ ID NO: 736794 - RNA, 64 nt, hsa; identical to SEQ ID NO: 155666

SEQ ID NO: 736795 - RNA, 64 nt, hsa; identical to SEQ ID NO: 155667

SEQ ID NO: 736796 - RNA, 64 nt, hsa; identical to SEQ ID NO: 155668

SEQ ID NO: 736797 - RNA, 64 nt, hsa; identical to SEQ ID NO: 155669

SEQ ID NO: 736798 - RNA, 64 nt, hsa; identical to SEQ ID NO: 155670

SEQ ID NO: 736799 - RNA, 64 nt, hsa; identical to SEQ ID NO: 155671

SEQ ID NO: 736800 - RNA, 64 nt, hsa; identical to SEQ ID NO: 155672

SEQ ID NO: 736801 - RNA, 64 nt, hsa; identical to SEQ ID NO: 155673

SEQ ID NO: 736802 - RNA, 64 nt, hsa; identical to SEQ ID NO: 155674

SEQ ID NO: 736803 - RNA, 64 nt, hsa; identical to SEQ ID NO: 155675

SEQ ID NO: 736804 - RNA, 64 nt, hsa; identical to SEQ ID NO: 155676

SEQ ID NO: 736805 - RNA, 64 nt, hsa; identical to SEQ ID NO: 155677

SEQ ID NO: 736806 - RNA, 64 nt, hsa; identical to SEQ ID NO: 155678

SEQ ID NO: 736807 - RNA, 64 nt, hsa; identical to SEQ ID NO: 155679

SEQ ID NO: 736808 - RNA, 64 nt, hsa; identical to SEQ ID NO: 155680

SEQ ID NO: 736809 - RNA, 64 nt, hsa; identical to SEQ ID NO: 155681

SEQ ID NO: 736810 - RNA, 64 nt, hsa; identical to SEQ ID NO: 155682

SEQ ID NO: 736811 - RNA, 64 nt, hsa; identical to SEQ ID NO: 155683

SEQ ID NO: 736812 - RNA, 64 nt, hsa; identical to SEQ ID NO: 155684

SEQ ID NO: 736813 - RNA, 64 nt, hsa; identical to SEQ ID NO: 155685

SEQ ID NO: 736814 - RNA, 64 nt, hsa; identical to SEQ ID NO: 155686

SEQ ID NO: 736815 - RNA, 64 nt, hsa; identical to SEQ ID NO: 155687

SEQ ID NO: 736816 - RNA, 64 nt, hsa; identical to SEQ ID NO: 155688

SEQ ID NO: 736817 - RNA, 64 nt, hsa; identical to SEQ ID NO: 155689

SEQ ID NO: 736818 - RNA, 64 nt, hsa; identical to SEQ ID NO: 155690

SEQ ID NO: 736819 - RNA, 64 nt, hsa; identical to SEQ ID NO: 155691

SEQ ID NO: 736820 - RNA, 64 nt, hsa; identical to SEQ ID NO: 155692

SEQ ID NO: 736821 - RNA, 64 nt, hsa; identical to SEQ ID NO: 155693

SEQ ID NO: 736822 - RNA, 64 nt, hsa; identical to SEQ ID NO: 155694

SEQ ID NO: 736823 - RNA, 64 nt, hsa; identical to SEQ ID NO: 155695

SEQ ID NO: 736824 - RNA, 64 nt, hsa; identical to SEQ ID NO: 155696

SEQ ID NO: 736825 - RNA, 64 nt, hsa; identical to SEQ ID NO: 155697

SEQ ID NO: 736826 - RNA, 64 nt, hsa; identical to SEQ ID NO: 155698

SEQ ID NO: 736827 - RNA, 64 nt, hsa; identical to SEQ ID NO: 155699

SEQ ID NO: 736828 - RNA, 64 nt, hsa; identical to SEQ ID NO: 155700

SEQ ID NO: 736829 - RNA, 64 nt, hsa; identical to SEQ ID NO: 155701

SEQ ID NO: 736830 - RNA, 64 nt, hsa; identical to SEQ ID NO: 155702

SEQ ID NO: 736831 - RNA, 64 nt, hsa; identical to SEQ ID NO: 155703

SEQ ID NO: 736832 - RNA, 64 nt, hsa; identical to SEQ ID NO: 155704

SEQ ID NO: 736833 - RNA, 64 nt, hsa; identical to SEQ ID NO: 155705

SEQ ID NO: 736834 - RNA, 64 nt, hsa; identical to SEQ ID NO: 155706

SEQ ID NO: 736835 - RNA, 64 nt, hsa; identical to SEQ ID NO: 155707

SEQ ID NO: 736836 - RNA, 64 nt, hsa; identical to SEQ ID NO: 155708

SEQ ID NO: 736837 - RNA, 64 nt, hsa; identical to SEQ ID NO: 155709

SEQ ID NO: 736838 - RNA, 64 nt, hsa; identical to SEQ ID NO: 155710

SEQ ID NO: 736839 - RNA, 64 nt, hsa; identical to SEQ ID NO: 155711

SEQ ID NO: 736840 - RNA, 64 nt, hsa; identical to SEQ ID NO: 155712

SEQ ID NO: 736841 - RNA, 64 nt, hsa; identical to SEQ ID NO: 155713

SEQ ID NO: 736842 - RNA, 64 nt, hsa; identical to SEQ ID NO: 155714

SEQ ID NO: 736843 - RNA, 64 nt, hsa; identical to SEQ ID NO: 155715

SEQ ID NO: 736844 - RNA, 64 nt, hsa; identical to SEQ ID NO: 155716

SEQ ID NO: 736845 - RNA, 64 nt, hsa; identical to SEQ ID NO: 155717

SEQ ID NO: 736846 - RNA, 64 nt, hsa; identical to SEQ ID NO: 155718

SEQ ID NO: 736847 - RNA, 64 nt, hsa; identical to SEQ ID NO: 155719

SEQ ID NO: 736848 - RNA, 64 nt, hsa; identical to SEQ ID NO: 155720

SEQ ID NO: 736849 - RNA, 64 nt, hsa; identical to SEQ ID NO: 155721

SEQ ID NO: 736850 - RNA, 64 nt, hsa; identical to SEQ ID NO: 155722

SEQ ID NO: 736851 - RNA, 64 nt, hsa; identical to SEQ ID NO: 155723

SEQ ID NO: 736852 - RNA, 64 nt, hsa; identical to SEQ ID NO: 155724

SEQ ID NO: 736853 - RNA, 64 nt, hsa; identical to SEQ ID NO: 155725

SEQ ID NO: 736854 - RNA, 64 nt, hsa; identical to SEQ ID NO: 155726

SEQ ID NO: 736855 - RNA, 64 nt, hsa; identical to SEQ ID NO: 155727

SEQ ID NO: 736856 - RNA, 64 nt, hsa; identical to SEQ ID NO: 155728

SEQ ID NO: 736857 - RNA, 64 nt, hsa; identical to SEQ ID NO: 155729

SEQ ID NO: 736858 - RNA, 58 nt, hsa; identical to SEQ ID NO: 155730

SEQ ID NO: 736859 - RNA, 64 nt, hsa; identical to SEQ ID NO: 155731

SEQ ID NO: 736860 - RNA, 64 nt, hsa; identical to SEQ ID NO: 155732

SEQ ID NO: 736861 - RNA, 64 nt, hsa; identical to SEQ ID NO: 155733

SEQ ID NO: 736862 - RNA, 64 nt, hsa; identical to SEQ ID NO: 155734

SEQ ID NO: 736863 - RNA, 64 nt, hsa; identical to SEQ ID NO: 155735

SEQ ID NO: 736864 - RNA, 64 nt, hsa; identical to SEQ ID NO: 155736

SEQ ID NO: 736865 - RNA, 64 nt, hsa; identical to SEQ ID NO: 155737

SEQ ID NO: 736866 - RNA, 64 nt, hsa; identical to SEQ ID NO: 155738

SEQ ID NO: 736867 - RNA, 64 nt, hsa; identical to SEQ ID NO: 155739

SEQ ID NO: 736868 - RNA, 64 nt, hsa; identical to SEQ ID NO: 155740

SEQ ID NO: 736869 - RNA, 64 nt, hsa; identical to SEQ ID NO: 155741

SEQ ID NO: 736870 - RNA, 64 nt, hsa; identical to SEQ ID NO: 155742

SEQ ID NO: 736871 - RNA, 64 nt, hsa; identical to SEQ ID NO: 155743

SEQ ID NO: 736872 - RNA, 64 nt, hsa; identical to SEQ ID NO: 155744

SEQ ID NO: 736873 - RNA, 64 nt, hsa; identical to SEQ ID NO: 155745

SEQ ID NO: 736874 - RNA, 64 nt, hsa; identical to SEQ ID NO: 155746

SEQ ID NO: 736875 - RNA, 64 nt, hsa; identical to SEQ ID NO: 155747

SEQ ID NO: 736876 - RNA, 64 nt, hsa; identical to SEQ ID NO: 155748

SEQ ID NO: 736877 - RNA, 64 nt, hsa; identical to SEQ ID NO: 155749

SEQ ID NO: 736878 - RNA, 64 nt, hsa; identical to SEQ ID NO: 155750

SEQ ID NO: 736879 - RNA, 64 nt, hsa; identical to SEQ ID NO: 155751

SEQ ID NO: 736880 - RNA, 64 nt, hsa; identical to SEQ ID NO: 155752

SEQ ID NO: 736881 - RNA, 64 nt, hsa; identical to SEQ ID NO: 155753

SEQ ID NO: 736882 - RNA, 63 nt, hsa; identical to SEQ ID NO: 155754

SEQ ID NO: 736883 - RNA, 64 nt, hsa; identical to SEQ ID NO: 155755

SEQ ID NO: 736884 - RNA, 64 nt, hsa; identical to SEQ ID NO: 155756

SEQ ID NO: 736885 - RNA, 64 nt, hsa; identical to SEQ ID NO: 155757

SEQ ID NO: 736886 - RNA, 64 nt, hsa; identical to SEQ ID NO: 155758

SEQ ID NO: 736887 - RNA, 64 nt, hsa; identical to SEQ ID NO: 155759

SEQ ID NO: 736888 - RNA, 64 nt, hsa; identical to SEQ ID NO: 155760

SEQ ID NO: 736889 - RNA, 64 nt, hsa; identical to SEQ ID NO: 155761

SEQ ID NO: 736890 - RNA, 64 nt, hsa; identical to SEQ ID NO: 155762

SEQ ID NO: 736891 - RNA, 64 nt, hsa; identical to SEQ ID NO: 155763

SEQ ID NO: 736892 - RNA, 64 nt, hsa; identical to SEQ ID NO: 155764

SEQ ID NO: 736893 - RNA, 64 nt, hsa; identical to SEQ ID NO: 155765

SEQ ID NO: 736894 - RNA, 64 nt, hsa; identical to SEQ ID NO: 155766

SEQ ID NO: 736895 - RNA, 64 nt, hsa; identical to SEQ ID NO: 155767

SEQ ID NO: 736896 - RNA, 64 nt, hsa; identical to SEQ ID NO: 155768

SEQ ID NO: 736897 - RNA, 64 nt, hsa; identical to SEQ ID NO: 155769

SEQ ID NO: 736898 - RNA, 64 nt, hsa; identical to SEQ ID NO: 155770

SEQ ID NO: 736899 - RNA, 64 nt, hsa; identical to SEQ ID NO: 155771

SEQ ID NO: 736900 - RNA, 64 nt, hsa; identical to SEQ ID NO: 155772

SEQ ID NO: 736901 - RNA, 64 nt, hsa; identical to SEQ ID NO: 155773

SEQ ID NO: 736902 - RNA, 64 nt, hsa; identical to SEQ ID NO: 155774

SEQ ID NO: 736903 - RNA, 64 nt, hsa; identical to SEQ ID NO: 155775

SEQ ID NO: 736904 - RNA, 64 nt, hsa; identical to SEQ ID NO: 155776

SEQ ID NO: 736905 - RNA, 64 nt, hsa; identical to SEQ ID NO: 155777

SEQ ID NO: 736906 - RNA, 64 nt, hsa; identical to SEQ ID NO: 155778

SEQ ID NO: 736907 - RNA, 64 nt, hsa; identical to SEQ ID NO: 155779

SEQ ID NO: 736908 - RNA, 64 nt, hsa; identical to SEQ ID NO: 155780

SEQ ID NO: 736909 - RNA, 64 nt, hsa; identical to SEQ ID NO: 155781

SEQ ID NO: 736910 - RNA, 64 nt, hsa; identical to SEQ ID NO: 155782

SEQ ID NO: 736911 - RNA, 64 nt, hsa; identical to SEQ ID NO: 155783

SEQ ID NO: 736912 - RNA, 64 nt, hsa; identical to SEQ ID NO: 155784

SEQ ID NO: 736913 - RNA, 64 nt, hsa; identical to SEQ ID NO: 155785

SEQ ID NO: 736914 - RNA, 64 nt, hsa; identical to SEQ ID NO: 155786

SEQ ID NO: 736915 - RNA, 53 nt, hsa; identical to SEQ ID NO: 155787

SEQ ID NO: 736916 - RNA, 64 nt, hsa; identical to SEQ ID NO: 155788

SEQ ID NO: 736917 - RNA, 64 nt, hsa; identical to SEQ ID NO: 155789

SEQ ID NO: 736918 - RNA, 64 nt, hsa; identical to SEQ ID NO: 155790

SEQ ID NO: 736919 - RNA, 64 nt, hsa; identical to SEQ ID NO: 155791

SEQ ID NO: 736920 - RNA, 64 nt, hsa; identical to SEQ ID NO: 155792

SEQ ID NO: 736921 - RNA, 64 nt, hsa; identical to SEQ ID NO: 155793

SEQ ID NO: 736922 - RNA, 64 nt, hsa; identical to SEQ ID NO: 155794

SEQ ID NO: 736923 - RNA, 64 nt, hsa; identical to SEQ ID NO: 155795

SEQ ID NO: 736924 - RNA, 64 nt, hsa; identical to SEQ ID NO: 155796

SEQ ID NO: 736925 - RNA, 64 nt, hsa; identical to SEQ ID NO: 155797

SEQ ID NO: 736926 - RNA, 64 nt, hsa; identical to SEQ ID NO: 155798

SEQ ID NO: 736927 - RNA, 64 nt, hsa; identical to SEQ ID NO: 155799

SEQ ID NO: 736928 - RNA, 64 nt, hsa; identical to SEQ ID NO: 155800

SEQ ID NO: 736929 - RNA, 64 nt, hsa; identical to SEQ ID NO: 155801

SEQ ID NO: 736930 - RNA, 64 nt, hsa; identical to SEQ ID NO: 155802

SEQ ID NO: 736931 - RNA, 64 nt, hsa; identical to SEQ ID NO: 155803

SEQ ID NO: 736932 - RNA, 64 nt, hsa; identical to SEQ ID NO: 155804

SEQ ID NO: 736933 - RNA, 64 nt, hsa; identical to SEQ ID NO: 155805

SEQ ID NO: 736934 - RNA, 64 nt, hsa; identical to SEQ ID NO: 155806

SEQ ID NO: 736935 - RNA, 64 nt, hsa; identical to SEQ ID NO: 155807

SEQ ID NO: 736936 - RNA, 64 nt, hsa; identical to SEQ ID NO: 155808

SEQ ID NO: 736937 - RNA, 64 nt, hsa; identical to SEQ ID NO: 243402

SEQ ID NO: 736938 - RNA, 64 nt, hsa; identical to SEQ ID NO: 243403

SEQ ID NO: 736939 - RNA, 64 nt, hsa
acagucuugagggucaaaaaaaaauacuuaggaagcuagccauggaagcuucuugccucugacc

SEQ ID NO: 736940 - RNA, 64 nt, hsa
augaaaugggcaccuagucagaucuucucagcuugcuagccagaaaugacugugauucugcugg

SEQ ID NO: 736941 - RNA, 64 nt, hsa
guaagccugagguggaauccacccaguuuugucugcuagccauaugggacaucuaauuggaaaa

SEQ ID NO: 736942 - RNA, 64 nt, hsa
guagcuggcugacaaucuuugccaaaucuuccuugcuagccagaaguggaauuggcagcuucua

SEQ ID NO: 736943 - RNA, 64 nt, hsa
uaaacucuuugcuucugcuaagaagcagucuaaauauaaucaacguacagugagcucuuugaag

SEQ ID NO: 736944 - RNA, 64 nt, hsa
aaguuguauauucuugcaaugcauaaaaugacauuauaaucaacaaacuuaugguuuguuucaa

SEQ ID NO: 736945 - RNA, 64 nt, hsa
uuuauaacaggguuuuacagacacuaccauaauuuauaaucauuauuuuuuacuuuuggguuca

SEQ ID NO: 736946 - RNA, 64 nt, hsa
auauggacaaucauauuuacaaaauugauguuuuuauaaucaaauguauuuuuuuacuuaugua

SEQ ID NO: 736947 - RNA, 64 nt, hsa
gauaauauuaucaucauaauggcuggugaaaccauauaaucacagaaaaacauugccuucagca

SEQ ID NO: 736948 - RNA, 64 nt, hsa
guaugucuuuugggauguauuauaugccuagcuuuauaaucaguauaaauuuuaauuauuccag

SEQ ID NO: 736949 - RNA, 64 nt, hsa
guaaguggcuaauuauaaaucuacucuagagacauauaaucauacagauuauucauaaaauuuu

SEQ ID NO: 736950 - RNA, 64 nt, hsa
cucuaugugauuauuuuucuuaauuguuauuuuuuauaaucauuauuuuucugaaccauucuuc

SEQ ID NO: 736951 - RNA, 64 nt, hsa
uuuuucugagaguugggugaggguaaagcuuuucuauaaucaagcucaauacaccaaggaaacu

SEQ ID NO: 736952 - RNA, 64 nt, hsa
gguauccuuuccucaguguguauaugacagccaguauaaucaauacccuagguuaugcgucuau

SEQ ID NO: 736953 - RNA, 64 nt, hsa
uucuuaauguuggcaugucacauuuuucuguuacuauaaucagaaaauguauagucuguuauac

SEQ ID NO: 736954 - RNA, 64 nt, hsa
uucuaaauauauguuauuuaauaguuacauguauuauaaucauucuuucuaaauucuuugcuag

SEQ ID NO: 736955 - RNA, 64 nt, hsa
uuuauaucuggauauaauguucuuuuuaaacaaguauaaucauaucgucggagguuaagauuau

SEQ ID NO: 736956 - RNA, 64 nt, hsa
aauugauaagauguuagaaauuuggaccauuauuuauaaucaggguagcauuaaaauggagaaa

SEQ ID NO: 736957 - RNA, 64 nt, hsa
uaaauuuuaagguaccacugguauuuugggagauuauaaucaguuuguuuucaagauaauagaa

SEQ ID NO: 736958 - RNA, 64 nt, hsa
gcagaaucaguaauuccuuggcuuaaagcucuuauauaaucaauauuauuggugguaaauacca

SEQ ID NO: 736959 - RNA, 64 nt, hsa
uuugguuccuguauauuccauguauaaguguaaauauaaucagacagguuuaaaaguugugcau

SEQ ID NO: 736960 - RNA, 64 nt, hsa
accagguuagcaaaugaccuaucaaaaauuauucuauaaucacuacuaguuaggauauugauuu

SEQ ID NO: 736961 - RNA, 64 nt, hsa; identical to SEQ ID NO: 165157

SEQ ID NO: 736962 - RNA, 64 nt, hsa; identical to SEQ ID NO: 165158

SEQ ID NO: 736963 - RNA, 64 nt, hsa; identical to SEQ ID NO: 165159

SEQ ID NO: 736964 - RNA, 64 nt, hsa; identical to SEQ ID NO: 165160

SEQ ID NO: 736965 - RNA, 64 nt, hsa; identical to SEQ ID NO: 165161

SEQ ID NO: 736966 - RNA, 64 nt, hsa; identical to SEQ ID NO: 165162

SEQ ID NO: 736967 - RNA, 64 nt, hsa; identical to SEQ ID NO: 165163

SEQ ID NO: 736968 - RNA, 64 nt, hsa; identical to SEQ ID NO: 165164

SEQ ID NO: 736969 - RNA, 64 nt, hsa; identical to SEQ ID NO: 165165

SEQ ID NO: 736970 - RNA, 59 nt, hsa
ucaacaucaggauccacagcuuaaagaugggaauucagguaugaaagaaaacaggcaag

SEQ ID NO: 736971 - RNA, 59 nt, hsa
ggguugugguugguugguauagaauggugggaauucaaauuuuucuaaacucaugguaa

SEQ ID NO: 736972 - RNA, 59 nt, hsa
gcccugaggcugccccggugaauguuauuggaauucaucccucgugcacauccuguugu

SEQ ID NO: 736973 - RNA, 59 nt, hsa
ucgaaaaugggaaucugaaugucuagaguggaauucaggcuugagaauacaugagggag

SEQ ID NO: 736974 - RNA, 59 nt, hsa
uccagagcaaggagccauguuccucuaagggaauucaggaauucagacgugcuaguccc

SEQ ID NO: 736975 - RNA, 59 nt, hsa
aaggagccauguuccucuaagggaauucaggaauucagacgugcuagucccacaccagu

SEQ ID NO: 736976 - RNA, 59 nt, hsa
uugcacaguucuuuuuuuccauuggaaauggaauucauugccuuaggucuuuuuaaaua

SEQ ID NO: 736977 - RNA, 59 nt, hsa
aauuuauacaaauuaagacuaacuuucuuggaauucacuauucuggcaauaaauuuugg

SEQ ID NO: 736978 - RNA, 59 nt, hsa
aaaacugguugaacagcggaugaagauauggaauucaaagcucuaauggaccuuuuuga

SEQ ID NO: 736979 - RNA, 59 nt, hsa
uuagugucuucucaagcuuucuuuacugaggaauucagcuugugacacagauacauccc

SEQ ID NO: 736980 - RNA, 59 nt, hsa
aucaucuacccaucuauuuggaaagcacuggaauucagaugcaagagaacaauguuucu

SEQ ID NO: 736981 - RNA, 59 nt, hsa
uggugcugucuagggguccacggguggcaggaauucagaggcuggccuugugcccuggc

SEQ ID NO: 736982 - RNA, 59 nt, hsa
auauuucuaacauccuuaaauauacaaucggaauucaagcaucucccauugucccacaa

SEQ ID NO: 736983 - RNA, 59 nt, hsa
augaucuauuucagugugccucauugcuuggaauucagcggaauauugauuagaaagaa

SEQ ID NO: 736984 - RNA, 59 nt, hsa
uagaaaacacauuguacugugcuuuuucuggaauucaguauaauggcaucacugccugu

SEQ ID NO: 736985 - RNA, 59 nt, hsa
gaguucuucaggucuggaaaguaugaccuggaauucaaguuucucgacgaccccaccag

SEQ ID NO: 736986 - RNA, 59 nt, hsa
uuacuagauaaaaccagaaauggaaauaaggaauucaggggaguuccagagacuuacaa

SEQ ID NO: 736987 - RNA, 59 nt, hsa
ugugccuguggcagaaaagaggagacccuggaauucagcacccugggugccauucccag

SEQ ID NO: 736988 - RNA, 59 nt, hsa
caggauucaaaagccaaauaaccccuuauggaauucaacucaagguuugaagacuuccu

SEQ ID NO: 736989 - RNA, 59 nt, hsa
agcugaggcagguggaucaccugaggucaggaauucaagaccagccuggccaacauggu

SEQ ID NO: 736990 - RNA, 59 nt, hsa
aggaugggaucacccccuucgugccucauggaauucagucccaugcacuacacucugga

SEQ ID NO: 736991 - RNA, 59 nt, hsa
aaagauuuuuuaggcaauaacaguaauagggaauucacuuauugagaaugaaagugaag

SEQ ID NO: 736992 - RNA, 59 nt, hsa
aaauaaugacaauuauuugaauguaacaaggaauucaacugaaauccugauaaguuuua

SEQ ID NO: 736993 - RNA, 59 nt, hsa
guaguaacugcuacuguauuuagugggguggaauucagaagaaauuugaagaccagauc

SEQ ID NO: 736994 - RNA, 59 nt, hsa
acagagugugggaacugcuggggaucuagggaauucagugggaccaaugaaagcauggc

SEQ ID NO: 736995 - RNA, 59 nt, hsa
gugcaaauuugccagcuuggagauagaaaggaauucaacaauauaucaaauacuuuccu

SEQ ID NO: 736996 - RNA, 59 nt, hsa
guuuugauacuuggaauuuugagguucagggaauucagagaauuugguagcacagugua

SEQ ID NO: 736997 - RNA, 59 nt, hsa
augagucaucaucugguccuuugugaaauggaauucaugguauuuucuguaacguuuuc

SEQ ID NO: 736998 - RNA, 59 nt, hsa
uccagaacuaccaugagaugguuuagacgggaauucaugcaaaugaggggucaaaaaug

SEQ ID NO: 736999 - RNA, 59 nt, hsa
agaaaacugaaauuucaguugucaguuguggaauucaguuuuucaauuguggaaauuuc

SEQ ID NO: 737000 - RNA, 59 nt, hsa
ugugacauuauuucaaggauaugugccagggaauucaggaaccaccucaccaaccccau

SEQ ID NO: 737001 - RNA, 59 nt, hsa
ggcugaggugggcggaucacuugagcucaggaauucaaggucagccugggcaacauggc

SEQ ID NO: 737002 - RNA, 59 nt, hsa
ggcuguggucacgugcucccagaagaccuggaauucaaaagaaauggagcuauucuuuu

SEQ ID NO: 737003 - RNA, 59 nt, hsa
cuuccuauaacugugaaaggaggauuucuggaauucagaagagagcuauugaguuugcu

SEQ ID NO: 737004 - RNA, 59 nt, hsa
acuuuggcucagcagauugcuugaacccaggaauucaaguccaaucugggcaacauggg

SEQ ID NO: 737005 - RNA, 59 nt, hsa
uacuugcauacuuaugagaauuucacauuggaauucauaaugguaaaacaacauacauc

SEQ ID NO: 737006 - RNA, 59 nt, hsa
gcuauuuuuauuuguuugugcauuuggggggaauucaucucucuuuaauauaaaguugg

SEQ ID NO: 737007 - RNA, 59 nt, hsa
agaggacccuuucacuuuuucuuuuuuacggaauucaucaucagagaagaaaauaacaa

SEQ ID NO: 737008 - RNA, 59 nt, hsa
ccucagggcauggucucaucuccgcaucaggaauucaccuggagguugaaaagagaaaa

SEQ ID NO: 737009 - RNA, 59 nt, hsa
gaaucuucuuaaauugaaauuuuugguaaggaauucauuucacagguaguguuucagac

SEQ ID NO: 737010 - RNA, 59 nt, hsa
aauaaacaucuuuugauugcuuggauuuaggaauucaauuuuuguuucagugaccaaug

SEQ ID NO: 737011 - RNA, 59 nt, hsa
aaaggaccaaccugccuuacacaucucaaggaauucagcuguugaaaucauuugaacua

SEQ ID NO: 737012 - RNA, 59 nt, hsa
ccaaagagccgcgucccggcaaguccggcggaauucaccaguguuccugaagcugcugu

SEQ ID NO: 737013 - RNA, 59 nt, hsa
ccgagugcaaugcuaaacacuuccaggugggaauucaucuauuucacuuaacacaaacg

SEQ ID NO: 737014 - RNA, 59 nt, hsa
guacuccacuggucugucuuuggauaauaggaauucaauuuggcaaaacaaaauguaau

SEQ ID NO: 737015 - RNA, 59 nt, hsa
agcucuucuuugcacaaagcuuuauaaagggaauucaaaggaagcccuuuagaauuaga

SEQ ID NO: 737016 - RNA, 59 nt, hsa
aucaaaugacauuuugacauuggacauauggaauucauaguaugagccacauuuuguug

SEQ ID NO: 737017 - RNA, 59 nt, hsa
uuuaucaugcuacagagagugaauacacuggaauucagacaccgacucugagcugcuag

SEQ ID NO: 737018 - RNA, 59 nt, hsa
ggguugagaccaggaagucagggaagaucggaauucagggcgacggucuaggugucgag

SEQ ID NO: 737019 - RNA, 59 nt, hsa
guauuauuuuagauuuauuacauagauuuggaauucacuuuuuucaugaccuagaaaaa

SEQ ID NO: 737020 - RNA, 59 nt, hsa
ccagacucucugaaaacugcaaauggaaaggaauucaaaagaauuuagauuaaaaguua

SEQ ID NO: 737021 - RNA, 59 nt, hsa
cucugguccccaggccccuccaguucaucggaauucagccaugaaacugacucaucagu

SEQ ID NO: 737022 - RNA, 59 nt, hsa
uugacuauacuuugcacauguuuucuuuaggaauucacucacacauuuaaaccaguuag

SEQ ID NO: 737023 - RNA, 59 nt, hsa
gugccauggauuaucuuuuccauguugauggaauucauucuguuggaauccuuuggcca

SEQ ID NO: 737024 - RNA, 59 nt, hsa
uagagauuaggcugaaaaaaauaaguaauggaauucaccuuugcaucuuuugugucuuu

SEQ ID NO: 737025 - RNA, 59 nt, hsa
cagauucccuauguaaagcaguuuaaaauggaauucaauguucagugcucagguaugua

SEQ ID NO: 737026 - RNA, 57 nt, hsa
acauuuuuauuaguggauagcguuguuggaauucaaaaaacagacaauauugccaua

SEQ ID NO: 737027 - RNA, 59 nt, hsa
ucuggaaaagaacuguuuacugcuugauaggaauucaucuuuugaggcuucuguuccuc

SEQ ID NO: 737028 - RNA, 59 nt, hsa
ggaccuggcaguugcaacacaguaagucaggaauucaagcgugaacccauauugauaag

SEQ ID NO: 737029 - RNA, 59 nt, hsa
uuuacaucgcacuuucaguuccuccauuuggaauucaaaaaggggagggauccugaaga

SEQ ID NO: 737030 - RNA, 59 nt, hsa
gaggauaugaaaaaauacuuccgaaaccaggaauucaauguauguuuguuuuauacugu

SEQ ID NO: 737031 - RNA, 59 nt, hsa
cagaaguaauaagagaaacaguuacguguggaauucaacaucuuugguuggaacgcauu

SEQ ID NO: 737032 - RNA, 59 nt, hsa
uuuucagcaacacuuaucccacauccuauggaauucagguucuagaacagugucaucca

SEQ ID NO: 737033 - RNA, 59 nt, hsa
acugugcuacugaugauacaucacccuggggaauucaacccugcagaugucaacugaag

SEQ ID NO: 737034 - RNA, 59 nt, hsa
ggaaggugagcaaagggagcagaaacaagggaauucaagacccagaauguaggugccac

SEQ ID NO: 737035 - RNA, 59 nt, hsa
cuauguuuuaaugacagaacuuggcuaauggaauucacagagguguugcagcguaucac

SEQ ID NO: 737036 - RNA, 59 nt, hsa
aagaguguggaaauaaagagaacugagauggaauucaagagagaagugucuccuccucg

SEQ ID NO: 737037 - RNA, 59 nt, hsa
accccgaagaaugaaaaguacacacccauggaauucaaggugggagccuucuuuuuuuu

SEQ ID NO: 737038 - RNA, 59 nt, hsa
guaacauuaacugcaaugauguucuuccuggaauucaugaaaauauaauuaaaacacau

SEQ ID NO: 737039 - RNA, 59 nt, hsa
agggggugugauggaugcaaagggaaugaggaauucagcacugcauucucuuugcaccc

SEQ ID NO: 737040 - RNA, 59 nt, hsa
uugauuuggcuuuacuuacuaggaagccuggaauucauuauuuuuuuccuuuuaugugc

SEQ ID NO: 737041 - RNA, 59 nt, hsa
uggcugggcagagccugugugaaaauacuggaauucaaagauaaggcaacaaaaugguu

SEQ ID NO: 737042 - RNA, 59 nt, hsa
cagguuuuugaugaauauaaugaauguauggaauucaauugaauuugcauggucuucgg

SEQ ID NO: 737043 - RNA, 59 nt, hsa
ccuguaaucaugguaucauuacaaugaaaggaauucacaaacuacugccagaggaaguu

SEQ ID NO: 737044 - RNA, 59 nt, hsa
auuucaucugaguguggagucccuggaauggaauucaguaacauuuggaguguguauuc

SEQ ID NO: 737045 - RNA, 59 nt, hsa
aucauauaguaaguagcagaguugggauuggaauucaggcaugacucaaaccuggaugu

SEQ ID NO: 737046 - RNA, 59 nt, hsa
ggccaagguggguagaucaucugaggucaggaauucaagaccagccuggccaacauggu

SEQ ID NO: 737047 - RNA, 59 nt, hsa
uuauagucaucuguuaugcugugaaauuuggaauucaguauuaucauuuugaagucugu

SEQ ID NO: 737048 - RNA, 59 nt, hsa
aucauuccuguccauuccacuuguaaaugggaauucaugaaauuaaauauuacuuuaaa

SEQ ID NO: 737049 - RNA, 59 nt, hsa
acucugagguccuuacccaccaaauggauggaauucagcugcucaaucacugccuuucu

SEQ ID NO: 737050 - RNA, 59 nt, hsa
ggcagaggagggaggaucacuugaacccaggaauucaaggcugcaguaagcuacgauca

SEQ ID NO: 737051 - RNA, 59 nt, hsa
aacucauguguucagcucaagacuccacaggaauucaacccccagaaagacauaaacuu

SEQ ID NO: 737052 - RNA, 59 nt, hsa
guguaguacuauauuaagugcacuugaguggaauucaacauuugacuaauaaaaugagu

SEQ ID NO: 737053 - RNA, 59 nt, hsa
gcuuuuagggcagccaauauuuuauuauuggaauucagacacuguucuuaccguguuug

SEQ ID NO: 737054 - RNA, 59 nt, hsa
guaucaacauuuggguugguauucagaugggaauucaaauaugaauccucucuggagag

SEQ ID NO: 737055 - RNA, 59 nt, hsa
ccuaaguaucaaguauagaaaaucuucauggaauucacaaaguaauuuggaaauuaggu

SEQ ID NO: 737056 - RNA, 59 nt, hsa
augggacuuuuaaaagaagggcuauuuaaggaauucacuugguaguacuuugcuuuagc

SEQ ID NO: 737057 - RNA, 59 nt, hsa
uuuaugucuuugagagagauacaggucuuggaauucacuuuuuaaauguuacguuccaa

SEQ ID NO: 737058 - RNA, 59 nt, hsa
uaguaauuuguauguaaugucaaauaaaaggaauucaaaucugaguaaauaacagccuc

SEQ ID NO: 737059 - RNA, 59 nt, hsa
uaugaucuuagggaacuuugauacaaaugggaauucacucacuggaaucguggcuccca

SEQ ID NO: 737060 - RNA, 59 nt, hsa
aaagucauuuugaaauuaaccuccuaaaaggaauucauauuuuaaaggaaaaaaauaca

SEQ ID NO: 737061 - RNA, 59 nt, hsa
aacuggcaaugcuguagaagucagccguaggaauucaaaauggcuggccuaccuuggcu

SEQ ID NO: 737062 - RNA, 59 nt, hsa
cacuuaagucagagccuuccuccccaucuggaauucacagcuguucccuggcagcacac

SEQ ID NO: 737063 - RNA, 59 nt, hsa
ugcuccuuaugugaauuucaaacacguauggaauucauuccgcauggacucugggauca

SEQ ID NO: 737064 - RNA, 59 nt, hsa
acaucaaacaauugaucaugugcuguaaaggaauucaaugaauaaauguuauuuuuaag

SEQ ID NO: 737065 - RNA, 59 nt, hsa
ucucuucuauacucugugcugaaacggauggaauucauggcuuauggaaaucaaauccc

SEQ ID NO: 737066 - RNA, 59 nt, hsa
auauauauauauaaaggaaucuuggauugggaauucaguacuuugcuuuaaaaaaauuu

SEQ ID NO: 737067 - RNA, 59 nt, hsa
acuggcucccaggggaauagaggaaaccaggaauucauuucaaaaucaucaaagucuaa

SEQ ID NO: 737068 - RNA, 59 nt, hsa
ucugaucucaccauuucaccaugcaucuuggaauucaguaagugcauauccuaacuugc

SEQ ID NO: 737069 - RNA, 59 nt, hsa
guuguuguuguuguuguuguauuuuagaaggaauucagcucugauguuuuuaaagaaaa

SEQ ID NO: 737070 - RNA, 59 nt, hsa
uugcuaaacugcccucucaaauguugcuaggaauucauacugcgaaaagcaaugaauaa

SEQ ID NO: 737071 - RNA, 59 nt, hsa
ccaccaugccuggccccaauuuaaaauguggaauucaguugguguccaagacuuaucuu

SEQ ID NO: 737072 - RNA, 59 nt, hsa
agccuuaauucagucaagacucccuuuggggaauucauuuuauuaaaaauuggugucug

SEQ ID NO: 737073 - RNA, 59 nt, hsa
uaauuuguuuuaaugauuuugcuacauuuggaauucaauaaaaaaugugaacaauaaua

SEQ ID NO: 737074 - RNA, 59 nt, hsa
aggcccuguugacgggcugucuuggcucuggaauucaugcauccuggccuugccaaggu

SEQ ID NO: 737075 - RNA, 59 nt, hsa
uccaauugacugcccucuuacuguuuugaggaauucagaaguggagauuucaguucagc

SEQ ID NO: 737076 - RNA, 59 nt, hsa
auuaguuuauacaccacuuuugccgcuggggaauucaaguugaaaugucccucaaucau

SEQ ID NO: 737077 - RNA, 59 nt, hsa
auuuacuucuguuacagaccuaguuacugggaauucauuacuugccauggacuaccuuu

SEQ ID NO: 737078 - RNA, 59 nt, hsa
uguuuugaaagaagaaacucccaggaauuggaauucagcaccuguuccgcacguaauug

SEQ ID NO: 737079 - RNA, 59 nt, hsa
cacagcaggcagggcacccaggccuuauaggaauucacccuggaccaugcccuaaaaua

SEQ ID NO: 737080 - RNA, 59 nt, hsa
aacaaaucuuugaaaagcaaucuuggaaaggaauucauuaacuaaaugggguaaaaggu

SEQ ID NO: 737081 - RNA, 59 nt, hsa
auuuagcagaaacuaacuccguaaugaauggaauucaauuccacacaugguuuguucaa

SEQ ID NO: 737082 - RNA, 59 nt, hsa
auucauugggaaaucacggggacagaggaggaauucacgggaucagagcacugagaaac

SEQ ID NO: 737083 - RNA, 59 nt, hsa
ggguugcuacuguccacauaggcauuuccggaauucacuuuuuugcuacaaccuccagu

SEQ ID NO: 737084 - RNA, 59 nt, hsa
gaguuucagaaacagaauuuuuguacuagggaauucauuggugagaguguucuuuuaac

SEQ ID NO: 737085 - RNA, 59 nt, hsa
gcuuucuggggagguguguguuugugaaaggaauucaaguguugcaggacagaugagcu

SEQ ID NO: 737086 - RNA, 59 nt, hsa
ggcugagguggguagauuacuugagcccaggaauucaagaccagccugggcaacauggu

SEQ ID NO: 737087 - RNA, 59 nt, hsa
aagucauaaaauauuuugaaauuuagagaggaauucaugauuaaagauuccuaaaaaua

SEQ ID NO: 737088 - RNA, 59 nt, hsa
uuguuauugguuaagaaaaaaggauaugaggaauucauuuuaucaauguagcugugaag

SEQ ID NO: 737089 - RNA, 59 nt, hsa
ucguauuucucauaggcuaugccaugugcggaauucaaguuaccaauguaacacuggcc

SEQ ID NO: 737090 - RNA, 59 nt, hsa
gcgaaugacaguagcauuaugaguaguguggaauucagguaguaaauaugaaacuaggg

SEQ ID NO: 737091 - RNA, 59 nt, hsa
acuugagaaucacuuguuaguucuugguaggaauucaguugggcaaugauaacuuuuau

SEQ ID NO: 737092 - RNA, 59 nt, hsa
aauauggguuggccuauauuaaacaacaaggaauucauuucagagaaaagcccuauacg

SEQ ID NO: 737093 - RNA, 59 nt, hsa
gggggagguauaugaugagcagacuucucggaauucauaauaaauuuucuaaaagccua

SEQ ID NO: 737094 - RNA, 59 nt, hsa
gaagaauguaucacucuuauucaagcaaaggaauucagacuuaaaugccuaccucugug

SEQ ID NO: 737095 - RNA, 59 nt, hsa
guuaccugcaauuauucuuaacacuacauggaauucacuggguaauugugggucauuua

SEQ ID NO: 737096 - RNA, 59 nt, hsa
uaaaaagucuugagaucccaccauucugaggaauucaauaugaucacuuuuuccuucuu

SEQ ID NO: 737097 - RNA, 59 nt, hsa
caaacaagcauccuuuacuaacaagagcaggaauucagaggcacaagaaaaagcauugg

SEQ ID NO: 737098 - RNA, 59 nt, hsa
cagacauugccgagugacuuucuaacauaggaauucacuguguuuucauuugaugucgu

SEQ ID NO: 737099 - RNA, 59 nt, hsa
cagugcagagcacaaugcuguguaacauaggaauucacuguguuuucauuugaugucgu

SEQ ID NO: 737100 - RNA, 59 nt, hsa
guucuuuggccgaagacgugggucugcguggaauucaggccgaggcgagccggcagagc

SEQ ID NO: 737101 - RNA, 59 nt, hsa
caccaggcucagcgcaagaggaagcagagggaauucacaggacccccugagaagagcca

SEQ ID NO: 737102 - RNA, 59 nt, hsa
ggcugaggugggagaauugcuugggcccaggaauucaaggcuagagugagccgugauca

SEQ ID NO: 737103 - RNA, 59 nt, hsa
aguuaacaauggcugcaagcuggauacauggaauucagcacacuuuucucccucuuacu

SEQ ID NO: 737104 - RNA, 59 nt, hsa
uuuugcuguucuagaaaaucauaaagaaaggaauucauauggggaaguucggaaaacug

SEQ ID NO: 737105 - RNA, 59 nt, hsa
acccagaaugggaaggaaagaaggccaagggaauucagauucugaccagccagguaagg

SEQ ID NO: 737106 - RNA, 59 nt, hsa
gcgggguuguugggggggccucuguuuccggaauucaccgcccagucgccagggggcgc

SEQ ID NO: 737107 - RNA, 59 nt, hsa
auugggcagcuccccuggaagaagcugauggaauucauauaucugucucucuccugcaa

SEQ ID NO: 737108 - RNA, 59 nt, hsa
cauugacaccucuuuucugcacaaauacuggaauucaaugucaagagaaaaugaccucu

SEQ ID NO: 737109 - RNA, 59 nt, hsa
uuuuuuaauguaaucauuugcauugguuaggaauucagaauuccgccggcucuauuacu

SEQ ID NO: 737110 - RNA, 59 nt, hsa
gaggccgcuuucugcccaguggcguugggggaauucagccuucauuuauaaucagugag

SEQ ID NO: 737111 - RNA, 59 nt, hsa
auucagucuguuuggugucugcacagacuggaauucaaucugucaaauuuguuuuauuc

SEQ ID NO: 737112 - RNA, 56 nt, hsa
ucguuuuugaugcucgaugaaugcugggaauucagaggaaugucuucacuuauacu

SEQ ID NO: 737113 - RNA, 59 nt, hsa
gagcagagcugugaagaacuaucagauuuggaauucaaugacacucgaguucuggucca

SEQ ID NO: 737114 - RNA, 59 nt, hsa
uagugaguccuacgguauuucaguaaaaaggaauucauggcauaaauguggacagauuu

SEQ ID NO: 737115 - RNA, 59 nt, hsa
ucuuuauacucacuuaaaccaacugggauggaauucagaauaccuaagcugcuucuuua

SEQ ID NO: 737116 - RNA, 59 nt, hsa
cacccacagagagagagcugcaagagcauggaauucauguguuuaaagauaauccuuuc

SEQ ID NO: 737117 - RNA, 59 nt, hsa
agacuugaaauaacacuucagaguaagagggaauucagcuaauuuguuuuuaaaauuga

SEQ ID NO: 737118 - RNA, 59 nt, hsa
agaaucugaacaccucuucuuuccacugaggaauucagggaaguguuuucaccauggau

SEQ ID NO: 737119 - RNA, 59 nt, hsa
acuaaagaagauaacuaagcaaacaaguuggaauucaccaagauuggguagaacuggua

SEQ ID NO: 737120 - RNA, 59 nt, hsa
uuuccccagauuagucauacaguucauuuggaauucagguacauuaagcuuuagugaag

SEQ ID NO: 737121 - RNA, 59 nt, hsa
caauuaaauagaaauagguuuucuugaugggaauucaauagcuuguaaugucuuaugaa

SEQ ID NO: 737122 - RNA, 59 nt, hsa
acuugacuggggauggcgcaugcaugggaggaauucaucuucagucuaccagcccccgc

SEQ ID NO: 737123 - RNA, 59 nt, hsa
ugccugugaccugccgccuaagcuuuacuggaauucagguuuugagacugagaugcgug

SEQ ID NO: 737124 - RNA, 59 nt, hsa
acacauguaaauccuugaagacacauccuggaauucauaccccacaaggacagugugua

SEQ ID NO: 737125 - RNA, 59 nt, hsa
cuccauguguauuuugcccacuuuuuuugggaauucaagggaaaguguuucuuggguuu

SEQ ID NO: 737126 - RNA, 59 nt, hsa
ugaaaguaggaaguuggagcucuugcaauggaauucaagaacagacucuggagugucca

SEQ ID NO: 737127 - RNA, 59 nt, hsa
ugucucagcuguccccagggaaauuaaguggaauucaacuaagaucuguuaauaagaug

SEQ ID NO: 737128 - RNA, 59 nt, hsa
auuacaaacccauucauuacauaguauaaggaauucacaguauauugacuauauagugu

SEQ ID NO: 737129 - RNA, 59 nt, hsa
gcuugggguguuugaaugucuauagcaaaggaauucauaaugggaaaucuuuuucauuu

SEQ ID NO: 737130 - RNA, 59 nt, hsa
aaucuguuuuuugaucaguauauggcuuuggaauucaaucaugucugauaugguaguau

SEQ ID NO: 737131 - RNA, 59 nt, hsa
uggguuucuguguuauugaggauuuguuuggaauucaaauuacaguuauguacuggaug

SEQ ID NO: 737132 - RNA, 59 nt, hsa
gcggcuccggcggaugucaggaaugcuccggaauucauaccuaguggcuguguagaggc

SEQ ID NO: 737133 - RNA, 59 nt, hsa
uguuuggaggauuucagaguuaaccucauggaauucaggauuuuuuagcaaguuugcuu

SEQ ID NO: 737134 - RNA, 59 nt, hsa
agaaacaaggaugguguggugaccauugaggaauucauugagucuugucaaaagguaca

SEQ ID NO: 737135 - RNA, 59 nt, hsa
aaugaucacuguaaacuggcucugucucaggaauucacccaggcagccuggagucagcc

SEQ ID NO: 737136 - RNA, 59 nt, hsa
ggccgaggcagguggaucauuugagcucaggaauucaagaccagccuggguaauauggc

SEQ ID NO: 737137 - RNA, 59 nt, hsa
ucccuuggacuaauuuuuaagucucgauuggaauucagugaguagguucauaaugugca

SEQ ID NO: 737138 - RNA, 59 nt, hsa
gaggugaacaagacaaggaaugccaucagggaauucaccuuuuauuaggaaaauauaaa

SEQ ID NO: 737139 - RNA, 59 nt, hsa
auguacauaccuccuugcacaaauggaggggaauucauuuucaucacugggaguguccu

SEQ ID NO: 737140 - RNA, 59 nt, hsa
ugggaacuuuuuugggggcggggggguggggaauucagccacacuccagaaagccagga

SEQ ID NO: 737141 - RNA, 59 nt, hsa
uaugccaauaaaaaugucucagcaacaguggaauucaccuugguguuucucucuguaau

SEQ ID NO: 737142 - RNA, 59 nt, hsa
cacggaaaguguugaaccugggacccugaggaauucaccaggaguaaauggcuuucaug

SEQ ID NO: 737143 - RNA, 59 nt, hsa
aaaaaaaaaaaauuuacuugcaaguacuaggaauucagaugaucagcucuuaaaagaaa

SEQ ID NO: 737144 - RNA, 59 nt, hsa
agguguguuuucuagaaaaguucccuaauggaauucaugaguuugggggucucagucac

SEQ ID NO: 737145 - RNA, 59 nt, hsa
ccauuuccugacaucugcauguaccucguggaauucagccagcuucauguugcaaauca

SEQ ID NO: 737146 - RNA, 59 nt, hsa
cccucuuuggaacagauauuuagcucuguggaauucagugacaaaaugggaggaggaaa

SEQ ID NO: 737147 - RNA, 59 nt, hsa
aucugcagcgggaucuccaaccagccgcuggaauucacguuccagaaaagagagcugcc

SEQ ID NO: 737148 - RNA, 59 nt, hsa
cuccccccacacccaacaaaauacaguuuggaauucacugaaacaguaccagcaaguca

SEQ ID NO: 737149 - RNA, 59 nt, hsa
ggcugccucaggaaaauuccuagauccuaggaauucagugagacccugggaaggaccag

SEQ ID NO: 737150 - RNA, 59 nt, hsa
ucuguuaacuuucuuuguguguuccugauggaauucaccauagccuuacagcuuuucuc

SEQ ID NO: 737151 - RNA, 59 nt, hsa
gcucccuaagguccuugacuuucuccccaggaauucacuuaaaaagggacugagcauug

SEQ ID NO: 737152 - RNA, 59 nt, hsa
ccuuggggaugggacccaagucugaacguggaauucaccuguguuucguguauaugccu

SEQ ID NO: 737153 - RNA, 59 nt, hsa
ucauuacauagugauagcuggacacacaaggaauucacaacuccccaaagaaaauacau

SEQ ID NO: 737154 - RNA, 59 nt, hsa
uaacucaauaacuuucuauaaaagccaauggaauucaaauaggagcuaggagacaacaa

SEQ ID NO: 737155 - RNA, 59 nt, hsa
cucuuaaacccagucagaagcucaucauuggaauucaguauuuucuuaaagaaaggaug

SEQ ID NO: 737156 - RNA, 59 nt, hsa
ugcuauuaggugaggguuucuugcugucuggaauucaguuuuuccaucugccacaugga

SEQ ID NO: 737157 - RNA, 59 nt, hsa
cauuaaguaguuaauaauaauuccaacaaggaauucagaguaauguaaaagacuaaaua

SEQ ID NO: 737158 - RNA, 59 nt, hsa
ccaacaaaaauaacaaugcuguugacaguggaauucaccuuacaauagaaaugaacaag

SEQ ID NO: 737159 - RNA, 59 nt, hsa
cugugggagcucguuuuauucuuuaauuuggaauucaguaauuuuucuucuuuauugac

SEQ ID NO: 737160 - RNA, 59 nt, hsa
uuuuaccacuuugggguugcuuuuuucccggaauucaucagaacuuugaauuuuuuuuu

SEQ ID NO: 737161 - RNA, 59 nt, hsa
uucuuuaguuuauucuuacuagaugcagaggaauucaucuacugucuguuauuaacugu

SEQ ID NO: 737162 - RNA, 59 nt, hsa
cuuuuaaacucacuuuaaaauuuuggcaaggaauucaugcauaacugagacuuggaggc

SEQ ID NO: 737163 - RNA, 59 nt, hsa
guucaaauccuagaucguuacagcuucagggaauucauauuuuguuauguguaggauac

SEQ ID NO: 737164 - RNA, 59 nt, hsa
gugggaaggggagugaggcccuaaagauaggaauucacugauagcugaaauagauacaa

SEQ ID NO: 737165 - RNA, 59 nt, hsa
agaguuaaagugaaaauuggaauuucauuggaauucauguauugguuucaguaccaagu

SEQ ID NO: 737166 - RNA, 59 nt, hsa
cagcaaagugccagccaauuuguccuggaggaauucauagccucauggggcaaaaguaa

SEQ ID NO: 737167 - RNA, 51 nt, hsa
caagaucuguaucaagauaaaggaauucaaauagcauauauaugaccaugu

SEQ ID NO: 737168 - RNA, 59 nt, hsa
cuacuaaagaugcagaaauugaugaucuuggaauucaucauaacauggaaucuacagua

SEQ ID NO: 737169 - RNA, 59 nt, hsa
aauaauuuuuuuuaaaacauuaaggaauuggaauucagaaagguuacccccuuccucug

SEQ ID NO: 737170 - RNA, 59 nt, hsa
ccaacagaaaagaaacauuuguuugcauaggaauucaugaaggcgacccaaccuggaaa

SEQ ID NO: 737171 - RNA, 59 nt, hsa
gacacuucagcugagauugaauuuacaaaggaauucagugucaguuccuuuacagagga

SEQ ID NO: 737172 - RNA, 59 nt, hsa
cgagagcugaucaaguucuuuguuccuggggaauucacuucucuuccucccucauggaa

SEQ ID NO: 737173 - RNA, 59 nt, hsa
ccauauggccaccuggacauugggacuugggaauucacucucaacugggccauccaugu

SEQ ID NO: 737174 - RNA, 59 nt, hsa
acgaggggcagggaaggacaggacccucaggaauucagugccuucaacaacgugagaga

SEQ ID NO: 737175 - RNA, 59 nt, hsa
ggcugaggcagguggcucacuugaggucaggaauucaagaccagccuggccaacauggu

SEQ ID NO: 737176 - RNA, 59 nt, hsa
gccacacucugaauacauuuuaugucucaggaauucacauuccagguucaggaauuuua

SEQ ID NO: 737177 - RNA, 59 nt, hsa
cccuccaccuacgagccccaccaggagggggaauucauccuccgggucuucucugaaaa

SEQ ID NO: 737178 - RNA, 59 nt, hsa
gaggucgaggcagguagaucacgaggucaggaauucaagaccagccuggccaacaugug

SEQ ID NO: 737179 - RNA, 59 nt, hsa
uuauaaaaacaguuuacauuaaacaucuuggaauucaacaauagugaucucacucaaau

SEQ ID NO: 737180 - RNA, 59 nt, hsa
cucuucccuucccacccucuugucuucagggaauucagaggauugcucuccaaggccau

SEQ ID NO: 737181 - RNA, 59 nt, hsa
augcauaucgaguuugcccuuagguggugggaauucaaacacacaaagacccacuaauu

SEQ ID NO: 737182 - RNA, 59 nt, hsa
caaugggcuuugcugcuuaugagcacagaggaauucaguccccaggcagcccugccucu

SEQ ID NO: 737183 - RNA, 59 nt, hsa
cacaagggcaccugcagcuaauggaggcuggaauucagcuuguguucugcucacuaagc

SEQ ID NO: 737184 - RNA, 59 nt, hsa
ccagcaaagccauauucggcuaggaauuuggaauucacaaccuuuauuaaccccuggca

SEQ ID NO: 737185 - RNA, 59 nt, hsa
acaguggcugcucugcugacuaucuuuuaggaauucaggaagcaaaucacauagugaca

SEQ ID NO: 737186 - RNA, 59 nt, hsa
gccugaggucggcggacugccugaggucaggaauucaagaccagccuggccaacauggc

SEQ ID NO: 737187 - RNA, 59 nt, hsa
cccagcaucucuuaaaacuuuguagucuuggaauucaugacagaggcaaaugacuccug

SEQ ID NO: 737188 - RNA, 59 nt, hsa
cuuguuggauaguaguaccacugagauagggaauucaagguuuggggcaaggguaauug

SEQ ID NO: 737189 - RNA, 59 nt, hsa
gaugggaugcacucucagaccaagcagcaggaauucaaagcugcuugcuguaacugugu

SEQ ID NO: 737190 - RNA, 59 nt, hsa
ugagcacuuugcaagagagaugggcccaaggaauucagaagagcuugcaggcaagccag

SEQ ID NO: 737191 - RNA, 59 nt, hsa
cuacugcuaaauauuggauuacugacaaaggaauucaguuuuguggaaucugguguuug

SEQ ID NO: 737192 - RNA, 59 nt, hsa
caaagaacaaaaccaguaacaaacacaaaggaauucagggucgcuuugcuugcucucug

SEQ ID NO: 737193 - RNA, 59 nt, hsa
gggcuugcuccugcaaccaguaucuccuuggaauucauccaaagcccccauggacgcau

SEQ ID NO: 737194 - RNA, 59 nt, hsa
aaaccucaugacaguauugagggaacaugggaauucauacugagaugcaaucucucaac

SEQ ID NO: 737195 - RNA, 59 nt, hsa
gguugccuucaucaguuacagcaugagacggaauucaucauuccuuccgaaaccccuga

SEQ ID NO: 737196 - RNA, 59 nt, hsa
cuaauugugcuguguucgugucuugcacuggaauucaacauucccuucuccuuuuguac

SEQ ID NO: 737197 - RNA, 59 nt, hsa
aacucaaacguucaguucaagucuccacaggaauucaaccccagaaagacauaaacuug

SEQ ID NO: 737198 - RNA, 59 nt, hsa
cagaucgggagacaggauguugacauauaggaauucagcuccacaaagcuucaggccug

SEQ ID NO: 737199 - RNA, 59 nt, hsa
cuguuuaauuuacagaaaaggaaauggugggaauucagugucuuuagauacugaagaca

SEQ ID NO: 737200 - RNA, 59 nt, hsa
acaaaggggugggaagccaggagugagaaggaauucagggagagcaaaggagccagugc

SEQ ID NO: 737201 - RNA, 59 nt, hsa
ggucucuacuguggcaaaugccaacuguuggaauucacuuuauuguagaaaaacccaaa

SEQ ID NO: 737202 - RNA, 59 nt, hsa
cuuucccagcaaccccccauuucuguuugggaauucauaugaucugccagagccucucc

SEQ ID NO: 737203 - RNA, 59 nt, hsa
ggcugagacaggcggaucaccugaggccaggaauucaagaccagccuggccaacauggu

SEQ ID NO: 737204 - RNA, 59 nt, hsa
caacaucuacacugcugcucuucaccauuggaauucacugugguauuuauaguauuggc

SEQ ID NO: 737205 - RNA, 59 nt, hsa
uauggacaaacacugaaauuacauuuuagggaauucauccucuaagaauuauguuuuug

SEQ ID NO: 737206 - RNA, 59 nt, hsa
auuaaaagaaauauacaguuugacuuuuuggaauucagcaguuuuauccuggccuugua

SEQ ID NO: 737207 - RNA, 59 nt, hsa
ggaugcaucuggggagagcaaagcacuaaggaauucagcaucagccugcagagggcuga

SEQ ID NO: 737208 - RNA, 59 nt, hsa
ccuuuuguccaaacucccuuccuuccaaaggaauucauugacaaucuccuaauaaauug

SEQ ID NO: 737209 - RNA, 59 nt, hsa
uccccuggggguuucaccugggcccuggaggaauucagcucagcuucuuccuaggucca

SEQ ID NO: 737210 - RNA, 59 nt, hsa
cucugaggggucucuaauaauccccacuuggaauucagcaccgcaaggaaauuaugggu

SEQ ID NO: 737211 - RNA, 59 nt, hsa
uuaaccaauuaccuuuucccggauuccagggaauucauacugugaaaucaaaaccaugu

SEQ ID NO: 737212 - RNA, 59 nt, hsa
uuaaaccccauaaaccaacuaagccuuauggaauucacagucacaaaaucgaaguuaau

SEQ ID NO: 737213 - RNA, 59 nt, hsa
ggauuagcaaaggguagcaggagcuucagggaauucaggaaaugccagcauuggaauuu

SEQ ID NO: 737214 - RNA, 59 nt, hsa
uauaucaugaccaaguggaauuuaucccaggaauucaagguugguucaacaucuaaaaa

SEQ ID NO: 737215 - RNA, 59 nt, hsa
uugaaguucuagccacagcaguuagguuaggaauucaagguuuguucaacaucuaaaaa

SEQ ID NO: 737216 - RNA, 59 nt, hsa
gcaauugcuaguugucuugaggagcaugaggaauucaggagcagaaggucaggauagca

SEQ ID NO: 737217 - RNA, 59 nt, hsa
uaauaaaaaaaaaugggagauuguuuucaggaauucagggaugaaaagaaagaauaauu

SEQ ID NO: 737218 - RNA, 59 nt, hsa
ccccagauaacucaguaaacaguggagcuggaauucaaacauguacggucugacuucuu

SEQ ID NO: 737219 - RNA, 59 nt, hsa
cuuuacagcucucaucuaacuucuuuuauggaauucaugaagcaagugguaugugacaa

SEQ ID NO: 737220 - RNA, 59 nt, hsa
acuguuccucaauccuuacuaaacauaagggaauucauaauagagaaacccuacaaaug

SEQ ID NO: 737221 - RNA, 59 nt, hsa
cgccaccuugguccuagugucuauucccuggaauucacccucucauguuucccuacuaa

SEQ ID NO: 737222 - RNA, 59 nt, hsa
ggugcaggcaggcagauggcuugagcccaggaauucaagaccaguccgagcaacauagc

SEQ ID NO: 737223 - RNA, 59 nt, hsa
ugcugcggacggagcgcggaaacugcguaggaauucaguggugguggguuuuuuuaagg

SEQ ID NO: 737224 - RNA, 59 nt, hsa
guuuauucucuaacaauuucuacagaucaggaauucaagaacagcuuaucucuguaguu

SEQ ID NO: 737225 - RNA, 59 nt, hsa
gcauuaugaagaaugaagcuaaggaaaagggaauucauuaaacauaucauccuuggaga

SEQ ID NO: 737226 - RNA, 59 nt, hsa
gcaguuacuuaaacuuuguucaacaucagggaauucagauuggagaaaaacccugcaaa

SEQ ID NO: 737227 - RNA, 59 nt, hsa
aaacugucccaaagugcugcuuccuaauaggaauucauuaaccuaaaacaagauguuac

SEQ ID NO: 737228 - RNA, 59 nt, hsa
acauugugacgcccagguugcaacaggauggaauucagggacggacccagccuggcuaa

SEQ ID NO: 737229 - RNA, 59 nt, hsa
aaauugacccccaaauacauccugcggaaggaauucaggaauaucuguucccagccccu

SEQ ID NO: 737230 - RNA, 59 nt, hsa
uugucaugccaugagucuuuucucuucauggaauucagcuauuuaucauaacucuugcu

SEQ ID NO: 737231 - RNA, 59 nt, hsa
gccuguagcuggcuggcugauuucauuuuggaauucauuugccauccacagccuuacac

SEQ ID NO: 737232 - RNA, 59 nt, hsa
uccauaagaagucguuuuuagggagaacgggaauucagacaagcugcauuucagaaaug

SEQ ID NO: 737233 - RNA, 59 nt, hsa
aaaaauguuguguagugcaugcucuguguggaauucagaggaaaacccagauucaguga

SEQ ID NO: 737234 - RNA, 59 nt, hsa
ucagaucccacagggccuccucuuuagcaggaauucacaacaguuuggaugcccuaaac

SEQ ID NO: 737235 - RNA, 59 nt, hsa
uuuaaauuucuuacuacuguuagaucccaggaauucauuaauaaucauccuuggcuuuc

SEQ ID NO: 737236 - RNA, 59 nt, hsa
ugagugucacuugauaggcuaugcauauuggaauucaaagaaacccauacucuagucgu

SEQ ID NO: 737237 - RNA, 59 nt, hsa
cacuccccucugagauuggccuucggugaggaauucagggcuuuccccauaucuucucu

SEQ ID NO: 737238 - RNA, 59 nt, hsa
auaucaucuugaguauagcaauaucaaaaggaauucaguaguuacugcuguuuaggaau

SEQ ID NO: 737239 - RNA, 59 nt, hsa
gguucaugugggauucugggagcuuucugggaauucaguuggagucaagucaggaugcu

SEQ ID NO: 737240 - RNA, 59 nt, hsa
uuuuguucacugauacaaaaaaaaaaaaaggaauucaugaugcuguacagaauuuuauu

SEQ ID NO: 737241 - RNA, 59 nt, hsa
cccucaaucuggggucuagaguugugcaaggaauucagcuccaguaaggccuggauugc

SEQ ID NO: 737242 - RNA, 59 nt, hsa
uuuuuaauuguucuuuuuuauuugauuuuggaauucaggugcacucuauucaagugcaa

SEQ ID NO: 737243 - RNA, 59 nt, hsa
uuuguagaccauagaccauuaaaaaauacggaauucaaaaguuacaaaaaggguauucu

SEQ ID NO: 737244 - RNA, 59 nt, hsa
gccacccacugcugccccaagcucacucaggaauucacacccgccugguuucuugaagu

SEQ ID NO: 737245 - RNA, 59 nt, hsa
aaaugccagacuucuaaaauaaauguuuuggaauucaauggguaaauaaaugcugcuuu

SEQ ID NO: 737246 - RNA, 59 nt, hsa
gcauauuuguuucgcucuuacucaguuugggaauucaaauuguccugcagagguucauu

SEQ ID NO: 737247 - RNA, 59 nt, hsa
uaaaaucuagauaauucuacauauucugaggaauucaugcuccuguggcucuugcuuau

SEQ ID NO: 737248 - RNA, 59 nt, hsa
cuuagguuugcucaauucuuauuuaccgaggaauucaaggccgguucucggguccuuga

SEQ ID NO: 737249 - RNA, 59 nt, hsa
ugggcccagcgagcgaacccugaggaccuggaauucauccgcagcacgguccucaagga

SEQ ID NO: 737250 - RNA, 59 nt, hsa
uucaguucugcucuaucuuacugcuauggggaauucacuucuucaaagcaggaccuauu

SEQ ID NO: 737251 - RNA, 59 nt, hsa
ccaaauauauucucuuugguguacaaaauggaauucauucuggucucucuauuaccacu

SEQ ID NO: 737252 - RNA, 59 nt, hsa
aaucauuaaggaacccauuacugccauuuggaauucaaauaaccuaaccaaccuccacc

SEQ ID NO: 737253 - RNA, 59 nt, hsa
uuaagagaggucuggaaaguguccaacaaggaauucacaccucugccuccuuugcaaca

SEQ ID NO: 737254 - RNA, 59 nt, hsa
acauaugccuguuacagauaacuacauuaggaauucauucuuagcuucuucaucuuugu

SEQ ID NO: 737255 - RNA, 59 nt, hsa
auggugucggaauuguuguauuuuccuuaggaauucaguggaacuuaucuucauuaaau

SEQ ID NO: 737256 - RNA, 59 nt, hsa
ucuuccaaaaagcagcuuccauuaaaaugggaauucaguaugcacauacugaaugcaua

SEQ ID NO: 737257 - RNA, 59 nt, hsa
aacccuccuuuuucucagaucaucugggaggaauucaccccagaggaagggaaaggcua

SEQ ID NO: 737258 - RNA, 63 nt, hsa
uuuucccccaugcuguucucaugauagugagugaguucucacgagaucugaugguuuuacaag

SEQ ID NO: 737259 - RNA, 63 nt, hsa
augcuauuuuuauuugaaccuuuggaacuugggaguucucauuguaacccuaacaugugagaa

SEQ ID NO: 737260 - RNA, 63 nt, hsa
ccucuaccccuuuccauuuuggauucucggcugaguucucacagaagcauuuuccccaugugg

SEQ ID NO: 737261 - RNA, 63 nt, hsa
agugcccuggcauucuggcagagaauccucaccaguucucaccaaccuuccccccaggcaagg

SEQ ID NO: 737262 - RNA, 63 nt, hsa
ugauggucuucuauccacccuacuugguaacaaaguucucagauguuaggucauguuucauuu

SEQ ID NO: 737263 - RNA, 63 nt, hsa
gcacaccuuuauucagaacuuuaguauuaaaucaguucucaauuucauuuuuuauguauuguu

SEQ ID NO: 737264 - RNA, 63 nt, hsa
uuucaaucugaagauguaagacuuccugaaacaaguucucaagaagucuuuacauuauauuua

SEQ ID NO: 737265 - RNA, 63 nt, hsa
gacuucguauuaucaugggaguacuguaaguucaguucucagggaaugcuaaauuagaguaau

SEQ ID NO: 737266 - RNA, 63 nt, hsa
gggucauagagcuaccguauuuucuaggacaagaguucucagucacugugcaauaugcccccu

SEQ ID NO: 737267 - RNA, 63 nt, hsa
agucaccccaaauggagacacucgcagaccugcaguucucagaccgaaggugcugccuucauc

SEQ ID NO: 737268 - RNA, 63 nt, hsa
cuucaauuuauauuugugauaugaagacuauccaguucucaguuugaauuggaacaucauguu

SEQ ID NO: 737269 - RNA, 63 nt, hsa
uuucacuggugcacacugaaauuuuacuugaacaguucucauaauaaagcacuugucuuuugc

SEQ ID NO: 737270 - RNA, 63 nt, hsa
guuggcaacaucccuaaaaacucagucucuucuaguucucagagaaggguuucaucuucuaag

SEQ ID NO: 737271 - RNA, 63 nt, hsa
aaccuuggcugugggccgauaaugcauauguccaguucucacuuaaauuaugcaaugauauuu

SEQ ID NO: 737272 - RNA, 63 nt, hsa
uugccagucccgguguucaaugucaucaauggcaguucucaugcugucaccaagcuggccaug

SEQ ID NO: 737273 - RNA, 63 nt, hsa
aggagagcagcaggagaggcgcacagaaggcccaguucucagggguuuuuauucuugcugcag

SEQ ID NO: 737274 - RNA, 63 nt, hsa
cucuucaagacaaaacagauugcgucgcugacaaguucucaagaagaacuuaugaguaagcag

SEQ ID NO: 737275 - RNA, 63 nt, hsa
gagcuggguggccuguuucugcagcccuugggcaguucucacuccuaggagagccaaccucgg

SEQ ID NO: 737276 - RNA, 63 nt, hsa
agcgagauucuuucuaaauguuauucaagauugaguucucacuaguguuuuuuuaauccuaaa

SEQ ID NO: 737277 - RNA, 63 nt, hsa
caucuccauugagaugauuaagugaaccaaacuaguucucagaauucuacagagaaggaggga

SEQ ID NO: 737278 - RNA, 63 nt, hsa
cuucugugagauggcuggcuggugauaggacuaaguucucauuguucaaauagagcuguucaa

SEQ ID NO: 737279 - RNA, 63 nt, hsa
uuuuguugcguguuuccauuuuaaagugaguugaguucucaaauuggaaagaaagauuccuug

SEQ ID NO: 737280 - RNA, 63 nt, hsa
ggcuauuuuauuuauuucaaaugcaguuguauuaguucucauuauugaacugucugugcacug

SEQ ID NO: 737281 - RNA, 63 nt, hsa
augauuuauugcuaugccccagauccuuaauguaguucucauccuccgcaugcccucagccac

SEQ ID NO: 737282 - RNA, 63 nt, hsa
ggaacuaaauggagcccugacugcaccaaauaaaguucucauuuugcugcuuguuccaaauaa

SEQ ID NO: 737283 - RNA, 63 nt, hsa
ucaguaguuuaguacaauaaucucuauuugagaaguucucagaauaacuaccuccucacuugg

SEQ ID NO: 737284 - RNA, 63 nt, hsa
aggugaauucccgacucuuuugguuugaaugacaguucucauuccuucuauggcugcaaguau

SEQ ID NO: 737285 - RNA, 63 nt, hsa
uuuuuuuuuuuuuuuuuuuuugagcucaaagagaguucucauuuucccuauucaaacuaauac

SEQ ID NO: 737286 - RNA, 63 nt, hsa
ugccggacaaagcaaguugaagagaugaguaacaguucucacugaugacccacuucugcaggc

SEQ ID NO: 737287 - RNA, 63 nt, hsa
cagagcuaggccagaucaaugcuacaaucaugaaguucucauugcaugcaauuguguaggauu

SEQ ID NO: 737288 - RNA, 63 nt, hsa
aacugcauugguuuuccaugaccuuaaggcaguaguucucaacuggggggcaauuuugcacug

SEQ ID NO: 737289 - RNA, 63 nt, hsa
aaaaauuguuuacuuuguuggacaaaccaaaucaguucucaaaaaaugaccggugcuuauaaa

SEQ ID NO: 737290 - RNA, 63 nt, hsa
ugagacuuggccugugaccaucauggcaguuggaguucucauauagaggugaccaguuugcca

SEQ ID NO: 737291 - RNA, 63 nt, hsa
uuauuuaaaaacaaaaccaaaugauaucuaaguaguucucagcaauaauaauaaugacgauaa

SEQ ID NO: 737292 - RNA, 63 nt, hsa
acacauuauaaaguucagauguuucaucaaugcaguucucacgaaaguauuuacuuuuuaaaa

SEQ ID NO: 737293 - RNA, 63 nt, hsa
gagauggggaguuuuuuugaaaaccagaauuacaguucucauuucacuacuuaccaguuguau

SEQ ID NO: 737294 - RNA, 63 nt, hsa
guauugcguaccaagugauacaacucgaaaugcaguucucaucuuccuguuuugagaaaugau

SEQ ID NO: 737295 - RNA, 63 nt, hsa
gacagcccaaagacaaauauugggcaggaaaucaguucucacugagcccgguuuccauguaaa

SEQ ID NO: 737296 - RNA, 63 nt, hsa
agaagguugagaugcaaagagucuaccuuuccaaguucucacugcuggaaagagcuagaagca

SEQ ID NO: 737297 - RNA, 63 nt, hsa
cucacaaaacccuacuuaggucaucagggcaggaguucucacucccauuuuacagaugagaau

SEQ ID NO: 737298 - RNA, 63 nt, hsa
agcugggcuggcugggaugccucuggcuggugaaguucucacauaggcugauuuaaauccagc

SEQ ID NO: 737299 - RNA, 63 nt, hsa
ugauaauuucugucccacugugucucauuauagaguucucagccauuggaccucuucuaaagg

SEQ ID NO: 737300 - RNA, 63 nt, hsa
uccccuucauuggcugcccaggccacuggccccaguucucagugucccuuggguccaggcucc

SEQ ID NO: 737301 - RNA, 63 nt, hsa
gugcuuuucccaguuugguguuagguggccuuaaguucucaguaaugacacuuaucaaauagg

SEQ ID NO: 737302 - RNA, 63 nt, hsa
uauaaacagauccccugcugaacagauacacagaguucucagaccccacccccacccucaggu

SEQ ID NO: 737303 - RNA, 63 nt, hsa
gaaagucauauuuuauuuguggcauuuuuauauaguucucauccacaugcuaaauggaaagac

SEQ ID NO: 737304 - RNA, 63 nt, hsa
uacguagugaucugcuuuuacuuuguaauuuguaguucucaaaagacuuuuuuuuaaaaaaau

SEQ ID NO: 737305 - RNA, 63 nt, hsa
uagcuaaucucuacaaacccucuguaggccaguaguucucaaaguguggucucuggaagagca

SEQ ID NO: 737306 - RNA, 63 nt, hsa
gcaccguguggcuccgccuccuggcccccagccaguucucagaaacguggcuggggcccagca

SEQ ID NO: 737307 - RNA, 63 nt, hsa
uccauaaacguuaugcugaauaguuguugaaacaguucucauuuuguaguauuuaauaaucug

SEQ ID NO: 737308 - RNA, 63 nt, hsa
guuuccccuauguuguuaucauaauagagagggaguucucacaagaucugcugguuuuaaaga

SEQ ID NO: 737309 - RNA, 63 nt, hsa
cguguugacagcaaagaaacagagugcuaauuuaguucucagcucuucugacuuaagugugca

SEQ ID NO: 737310 - RNA, 63 nt, hsa
agcaacuuuccuuuccuggagcuucuuccuuguaguucucaggaccuguucaagaaggugucu

SEQ ID NO: 737311 - RNA, 63 nt, hsa
cuuuuuggaaggaaaggaaggggaagacacccuaguucucaguguuugggacucuuaugcaga

SEQ ID NO: 737312 - RNA, 63 nt, hsa
aaugagaaauguaguuucucaguugcacuaucaaguucucaauggcuacgugugacuagugcu

SEQ ID NO: 737313 - RNA, 63 nt, hsa
agaauauguauucauauaaucugccuacuuuugaguucucauauuaacauuuagauaacauau

SEQ ID NO: 737314 - RNA, 63 nt, hsa
gcguggaaaggggcaggccagagcuacccgcagaguucucagaaucaugcugagagagcugga

SEQ ID NO: 737315 - RNA, 63 nt, hsa
augccuguguuuucuucuaagaacuauacuuuuaguucucacaauggucuuugauccauuucg

SEQ ID NO: 737316 - RNA, 63 nt, hsa
cucugcugguagcagugccuauagcuggaccuaaguucucagaagcguagaugugcaaacaag

SEQ ID NO: 737317 - RNA, 63 nt, hsa
aauguuucgguuuagacucuccacuguuaccuaaguucucaagcugccuaugguuuuucugug

SEQ ID NO: 737318 - RNA, 63 nt, hsa
cuucaggcggggacccauugccucgcagaagaaaguucucacuuauaaaccucuguacacaca

SEQ ID NO: 737319 - RNA, 63 nt, hsa
uauuucuauguucuguaaaguauuugacuuacuaguucucaauaaaauuuuauuaggacuaua

SEQ ID NO: 737320 - RNA, 63 nt, hsa
uuucuuuuauuauaaacaaggggauuauucuuuaguucucagagguagggacaaaaccacauc

SEQ ID NO: 737321 - RNA, 63 nt, hsa
ucuuauugcuguacauugcguuuuuaaccugcaaguucucaguuucuucaccaucacuccauc

SEQ ID NO: 737322 - RNA, 63 nt, hsa
cuucucugccaucccuuugcaccugagaggggaaguucucagcugagcugaagcuggauuauu

SEQ ID NO: 737323 - RNA, 63 nt, hsa
ugccuacagaaccuugagguugacuccugcuucaguucucagcuguuuaccacagcccuccag

SEQ ID NO: 737324 - RNA, 63 nt, hsa
agagugguuaacagauacaagugucaguuucuuaguucucauuuaagcacuaguggaauuuuu

SEQ ID NO: 737325 - RNA, 63 nt, hsa
ucucucuucuguaacuuccaaagcaucccucucaguucucaugcucagcugaugguuauguuu

SEQ ID NO: 737326 - RNA, 63 nt, hsa
gccucagugacuguguugcuaaacccaguggucaguucucaguucucagccaucagcagcauu

SEQ ID NO: 737327 - RNA, 63 nt, hsa
ugacuguguugcuaaacccaguggucaguucucaguucucagccaucagcagcauuugcucgc

SEQ ID NO: 737328 - RNA, 63 nt, hsa
uuuugcccacguguuugcgcuguuuuucucuggaguucucaagaguuggugacuuggaaggcc

SEQ ID NO: 737329 - RNA, 63 nt, hsa
uuuucuccaugcacugugaacuucuguggcuucaguucucaugcugccucuuccaaaagggga

SEQ ID NO: 737330 - RNA, 63 nt, hsa
auagagcccuuggcauuuuauuaucacauucuuaguucucagguugggacuucaauuacugcu

SEQ ID NO: 737331 - RNA, 63 nt, hsa
uggcuuccauaugccacucuguaccccaaagagaguucucaugaaauauucuccagaauguau

SEQ ID NO: 737332 - RNA, 63 nt, hsa
auuucuucuaguaaaauaaaauauuguuagauuaguucucauuaaauuuauuauaugcuaaag

SEQ ID NO: 737333 - RNA, 63 nt, hsa
ccugccuuaauuauuuaucuuuaguuccuuauuaguucucaagaaacaaaugcuagcuucaua

SEQ ID NO: 737334 - RNA, 63 nt, hsa
guacggacuuccuuuaggaucucaggcuucugcaguucucaugacuccuacuuuucauccuag

SEQ ID NO: 737335 - RNA, 63 nt, hsa
uaugcucuagagaaaagucuaccccugcuaaggaguucucaucccucugucagggucaguaag

SEQ ID NO: 737336 - RNA, 63 nt, hsa
gaagccagauccacccuaucccuguacagaguaaguucucaauuauuggccugcuaauagcug

SEQ ID NO: 737337 - RNA, 63 nt, hsa
cuuccacagggccuguguaagaauggguucuggaguucucauggucuuuaggaaauauugagu

SEQ ID NO: 737338 - RNA, 63 nt, hsa
gcuuuuaaguggugcuguuucccauagggcauuaguucucagauuuuggaaugugaaauaauc

SEQ ID NO: 737339 - RNA, 63 nt, hsa
uuauuagugaaaacaaaacuaaagggaaguucaaguucucauguaaugccacauauauacuug

SEQ ID NO: 737340 - RNA, 63 nt, hsa
aggacagauagaccacccucaucaaugaaaggaaguucucaaacacauccuuuggaacuuacu

SEQ ID NO: 737341 - RNA, 63 nt, hsa
guggaguuugacauuguauguaucuauuuauuaaguucucaaugugaaaaaugugucuguaag

SEQ ID NO: 737342 - RNA, 63 nt, hsa
acuguauccagguucccucccagaggagccaccaguucucauggguggcacucagucucucuu

SEQ ID NO: 737343 - RNA, 63 nt, hsa
gguagcugggggaguggcauggggcaggggcccaguucucagcagcagacacucuguacaguu

SEQ ID NO: 737344 - RNA, 63 nt, hsa
uuagacaugaacaugacauguucagcuaggcagaguucucauagauaauuuucaaauauuuuc

SEQ ID NO: 737345 - RNA, 63 nt, hsa
aguuugaccucauuuguaaaauauuuaugagaaaguucucauuuaaaaugagaucguuguuua

SEQ ID NO: 737346 - RNA, 63 nt, hsa
gcucacugcaaccucugccucccggguucaagcaguucucaugucucaacaucccagguagcu

SEQ ID NO: 737347 - RNA, 63 nt, hsa
acuugaacuggacaucaggggaagcugcuugagaguucucaauuacuuucuuaaacaguguuu

SEQ ID NO: 737348 - RNA, 63 nt, hsa
cuauaaacaugagauaagggaaaaugaauccagaguucucauauuaauagguagugaaacaau

SEQ ID NO: 737349 - RNA, 63 nt, hsa
uugccuaggaaagcaagucauauggccauugauaguucucauguaauuaguuuugcucaccac

SEQ ID NO: 737350 - RNA, 63 nt, hsa
ggugggcggcuggagaccaugcagagcgccgugaguucucagggcuccugccuucuguccugg

SEQ ID NO: 737351 - RNA, 63 nt, hsa
aaagcccgcuagaagguuugggaacgaggggaaaguucucagaacuguuggcugcuccccacc

SEQ ID NO: 737352 - RNA, 63 nt, hsa
gauuagaaacaaacaaaacucuuaaguccuaaaaguucucaauguagaggcauaaaccugugc

SEQ ID NO: 737353 - RNA, 63 nt, hsa
guggaggcuggaugugcauuagccuggauccucaguucucaaauguguguggcagccaggaug

SEQ ID NO: 737354 - RNA, 63 nt, hsa
aauuuugacccaaggcacagcagugaaauuuauaguucucaauuuaguugucauuauugacag

SEQ ID NO: 737355 - RNA, 63 nt, hsa
acuugaagcaagaggccaagugaggggcugcccaguucucacaccagaaaccacacauucacu

SEQ ID NO: 737356 - RNA, 63 nt, hsa
ucuuagauuuuuaaaaaagaauuaaaaugugggaguucucagaaagaaauaaacacaugagaa

SEQ ID NO: 737357 - RNA, 63 nt, hsa
gaaggguagaauuuugaaaccuugauuuucuagaguucucauuuauucaggauaccuauucuu

SEQ ID NO: 737358 - RNA, 63 nt, hsa
uaugacguugggucccucugaaguuuaauucugaguucucauuaaaagaaauuugcuuucauu

SEQ ID NO: 737359 - RNA, 63 nt, hsa
uucuaguauagugaacuacauacugaauauccaaguucucagcaccuacuuuugucaaaucuu

SEQ ID NO: 737360 - RNA, 63 nt, hsa
uaugcauaccagcaauuauuacuguguucgcacaguucucacuuaacuggugcuaugugaaga

SEQ ID NO: 737361 - RNA, 63 nt, hsa
cugagugaacacccccagcugggugguccaccaaguucucauaaacagagucccucccauucc

SEQ ID NO: 737362 - RNA, 63 nt, hsa
aggguaguguuuguuuuugaacgauaauuuagaaguucucauagaaagcguauaacauagguc

SEQ ID NO: 737363 - RNA, 63 nt, hsa
uuugccggccauuuggaaagugaaaugccacuuaguucucaauugaugacaguguuugaauca

SEQ ID NO: 737364 - RNA, 63 nt, hsa
aaguucuuaaagaaccagcuucuuagaauguucaguucucaaugugcugcugcuuucccuucu

SEQ ID NO: 737365 - RNA, 63 nt, hsa
caaagugccugccucugaccucaucaugguucuaguucucauacagaacuccagaauuuuuaa

SEQ ID NO: 737366 - RNA, 63 nt, hsa
cccagugaaagccaaguuggacugaauuucuggaguucucaucagugcacauuccauaguucu

SEQ ID NO: 737367 - RNA, 63 nt, hsa
cauugucccagcugggaaggggacauucccacuaguucucauucauucuugcuuuuaugaaaa

SEQ ID NO: 737368 - RNA, 63 nt, hsa
uuuauuaaauauaaugaauaugagaaaacucuuaguucucaucagauacuaaguuuuaagaau

SEQ ID NO: 737369 - RNA, 63 nt, hsa
acucugcguucuccuagaucugagcaagcugucaguucucacccccaccguguauauacauga

SEQ ID NO: 737370 - RNA, 63 nt, hsa
uaucuuguuaccugcuuucucucucaacaccacaguucucaacccugagccuuccagagagag

SEQ ID NO: 737371 - RNA, 63 nt, hsa
uugggacagcugggaacuuaacuugaaauaggaaguucucacugaauccuggaggcuggaaca

SEQ ID NO: 737372 - RNA, 63 nt, hsa
uguuaccauggaaaaggauauucacaguaguacaguucucaauauuuuuaauuagaugucaua

SEQ ID NO: 737373 - RNA, 63 nt, hsa
uuuuuggauauaugcauguugucauuuuggacuaguucucaugcuacugcaaagaucuauugc

SEQ ID NO: 737374 - RNA, 63 nt, hsa
cugaauggaaauaaauagauguaaauaaaauugaguucucauuuaacuguuauauuucauuuu

SEQ ID NO: 737375 - RNA, 63 nt, hsa
gguaguaagcaugguuucuugcagaaaacacaaaguucucagcuaacacauuaaacuucucac

SEQ ID NO: 737376 - RNA, 63 nt, hsa
ggagacuaagacuguauaaacaucuucauugucaguucucaaaaugacugaaauuguuuucau

SEQ ID NO: 737377 - RNA, 63 nt, hsa
auggauuugacagggugcaugucacagagagacaguucucagucagcacuuccuguccccugc

SEQ ID NO: 737378 - RNA, 63 nt, hsa
uccaggacagagcccucaaagcaacucccaacgaguucucaggauucaggcucuggcuucaac

SEQ ID NO: 737379 - RNA, 63 nt, hsa
ucugugugcugcugucuuccgguaaacggaccaaguucucacuucccauccuccuccccaguc

SEQ ID NO: 737380 - RNA, 63 nt, hsa
ugaagaaaguacuuuucuggcauagcuaccgugaguucucagcaggaacuucccagcgaugau

SEQ ID NO: 737381 - RNA, 63 nt, hsa
uuaagaguuuguguguaaacaggcucaucucugaguucucaggacccuugcccccacccccau

SEQ ID NO: 737382 - RNA, 63 nt, hsa
aagacuuugcauuuccuaguauuucuguuugucaguucucaauuuccuguguuugcaauguug

SEQ ID NO: 737383 - RNA, 63 nt, hsa
ugaaaacuccagaaauacaucacccaagguggcaguucucaguauuuggcagaacaauugcaa

SEQ ID NO: 737384 - RNA, 63 nt, hsa
uagcagugcauugguauaagcaauuauuucaucaguucucagauuaacaagcauuucugcucu

SEQ ID NO: 737385 - RNA, 63 nt, hsa
gagaaugaaguguuucaaguaagcgagucugcaaguucucagaagcagacagauauccaaucu

SEQ ID NO: 737386 - RNA, 63 nt, hsa
gauauauuuuccuuuaucacuuuaguauucugcaguucucagcuuggugaggcuccaaaagag

SEQ ID NO: 737387 - RNA, 63 nt, hsa
cuaacaugguaaaauguuagguggagcauauacaguucucauuauacucuuauuuuaaauuua

SEQ ID NO: 737388 - RNA, 63 nt, hsa
cuauuuuaagucaggggcuuuacuagccgauuuaguucucacaauaaccauguggagaagcug

SEQ ID NO: 737389 - RNA, 63 nt, hsa
uuaagaaaggaaucuagccaaugagguccaagaaguucucacccauugaauuuuuaaauggcu

SEQ ID NO: 737390 - RNA, 63 nt, hsa
ccuuaauucuccuuuauuccccugccacccaguaguucucauguaggaccucugaaggcagag

SEQ ID NO: 737391 - RNA, 63 nt, hsa
ugagggacccacaggagaggugggcagagcuggaguucucauccagggcugcuuguccccaga

SEQ ID NO: 737392 - RNA, 63 nt, hsa
cuuucgucuaagucucaguauugaggccucuccaguucucaugcacccugaucuuaggguuag

SEQ ID NO: 737393 - RNA, 63 nt, hsa
ucauuuuaguuuggucacgcauuugccuguucaaguucucauuugaacuucaccauugugcua

SEQ ID NO: 737394 - RNA, 63 nt, hsa
gaauaucccaucauccuauuucauguauaguugaguucucaaauuuguaaguuuuuauacauc

SEQ ID NO: 737395 - RNA, 63 nt, hsa
cagguugugcuagaaaguagggcugcuucugugaguucucagccuaggcuguggccacuaaga

SEQ ID NO: 737396 - RNA, 63 nt, hsa
uucgagacaggcagaaucaguagcuggagagagaguucucacauuuaauauccugccuuuuac

SEQ ID NO: 737397 - RNA, 63 nt, hsa
agacauagcuaggaaagcgaaugauaagggaaaaguucucagggaauugaaguguuguugcua

SEQ ID NO: 737398 - RNA, 63 nt, hsa
aguuaggaggugcagacacuugcucuccuauguaguucucagaugcguaaagcagaacagccu

SEQ ID NO: 737399 - RNA, 63 nt, hsa
uuuuuugcuaagagccagaggcaggucuucuggaguucucaggggggcccugugacccccucu

SEQ ID NO: 737400 - RNA, 63 nt, hsa
acaaaugugaagaauguggcauaucuuuuaaccaguucucacaacuugcuauacauaagauga

SEQ ID NO: 737401 - RNA, 63 nt, hsa
aaucaaugccaaauaaguacagucaucuucucuaguucucauaagacuaucuccccgccaccu

SEQ ID NO: 737402 - RNA, 63 nt, hsa
uugguuguuugcuguuuuuuguuuuuuaaggugaguucucacuauguuucucagacuggucuc

SEQ ID NO: 737403 - RNA, 63 nt, hsa
aguugggcuuucuuucuggguuugggccauuucaguucucauguguguacuauucuaucauua

SEQ ID NO: 737404 - RNA, 63 nt, hsa
gguuuacuauguuuaaaacuaaacugcugcaaaaguucucaauguucuuuuccaacacaucua

SEQ ID NO: 737405 - RNA, 63 nt, hsa
ucugacccacccagccccugugguagccccagcaguucucagggugcugaccucucucuccca

SEQ ID NO: 737406 - RNA, 63 nt, hsa
aacuacauguaaagugaacuguuuccuguauaaaguucucaucuuaaugaaccuaugagagug

SEQ ID NO: 737407 - RNA, 54 nt, hsa
cgcccccgcucuucuucugagccuaguucucacgaggacccuuucuugcccaca

SEQ ID NO: 737408 - RNA, 63 nt, hsa
uugaacugaacaugcaacauuuaucauacauucaguucucauucacacuccuuaagauuuggu

SEQ ID NO: 737409 - RNA, 63 nt, hsa
ugacaaauaaucauuuucaucuuggcagcaaaaaguucucagugaccuauuuugugguguuuc

SEQ ID NO: 737410 - RNA, 63 nt, hsa
ccuguccgauuuuuccauggguuccaguuucagaguucucauuauuacucaaaguaaaagcgg

SEQ ID NO: 737411 - RNA, 63 nt, hsa
uguccguguuacauaaucaagugcaauauacucaguucucaugcaggugacauucuaccauga

SEQ ID NO: 737412 - RNA, 63 nt, hsa
gagaacuggacagaacugaaacacagcaacaccaguucucaaggacaaggugugugauggggg

SEQ ID NO: 737413 - RNA, 63 nt, hsa
ugaguccaccaaaggauaaugccaacuuauauaaguucucaaaucaugccuuccgcuuagucu

SEQ ID NO: 737414 - RNA, 63 nt, hsa
cagcaacuuuuaccaauaccuuuguauacucucaguucucauucaguauaaauaaaauuuuaa

SEQ ID NO: 737415 - RNA, 63 nt, hsa
gaaguagaauauaauguauacuaagggauuucaaguucucagaauuuuugaguaguugcuuac

SEQ ID NO: 737416 - RNA, 63 nt, hsa
acaauacauauaucuacacauacagaaagaagcaguucucacaauguugcuaguuuuuugcuu

SEQ ID NO: 737417 - RNA, 63 nt, hsa
agauucacacagccacccuuggagcugguuucuaguucucacauuuagucaacaucuagaaag

SEQ ID NO: 737418 - RNA, 63 nt, hsa
uuucuauagaaaaaaaaaauuguugaaagguccaguucucaguaccaugugaguuaaugauac

SEQ ID NO: 737419 - RNA, 63 nt, hsa
uaguuuuucaaauaggaaagcaauaauggcaguaguucucaaaugggcuaggccuuuuuuaua

SEQ ID NO: 737420 - RNA, 63 nt, hsa
cauucuuuccauaacaaucuaaucaaaacugggaguucucaagugaaugcaaaaggagcaggc

SEQ ID NO: 737421 - RNA, 63 nt, hsa
uggaaacgugcaagagaaggcagagccuuugacaguucucaaaagugguuucauacuuuuuac

SEQ ID NO: 737422 - RNA, 63 nt, hsa
uuuaugaagauaguuuauuauagucuguacuucaguucucaucuuguaaauaaugcuuaacau

SEQ ID NO: 737423 - RNA, 63 nt, hsa
accagccaguagucacagaacugcuguuuacacaguucucaggaggcugugguuucuuagaau

SEQ ID NO: 737424 - RNA, 63 nt, hsa
gguuacccccacacugcuguucucaugauacugaguucucacaaguccuguuuguuuuauaag

SEQ ID NO: 737425 - RNA, 63 nt, hsa
ggggcaguuucucaaaagcagaaacaugccgccaguucucaaguuuuccuccuaacuccauuu

SEQ ID NO: 737426 - RNA, 63 nt, hsa
ugccagccuuggcugucaaaaggaggcaggagcaguucucaacacaccaagccuuauucccac

SEQ ID NO: 737427 - RNA, 63 nt, hsa
uggguacaaaccucacuguucagaugggcuguaaguucucacuucaaagcuauggaauggauu

SEQ ID NO: 737428 - RNA, 63 nt, hsa
guguacccugagcaggggcagcuggccacucccaguucucaccaagucaccucccuccuugua

SEQ ID NO: 737429 - RNA, 63 nt, hsa
cauacuaaagaggcgaggcaaugacuguuggccaguucucaccggggaaaaacccacuguuag

SEQ ID NO: 737430 - RNA, 63 nt, hsa
ucucagcaauugcaguuaaguaaguuacacuacaguucucacaagagccugugaggggauguc

SEQ ID NO: 737431 - RNA, 63 nt, hsa
uucuauuauuaaacuacaggcuguagauuucuuaguucucacagaacuucuaucauuuuaaac

SEQ ID NO: 737432 - RNA, 63 nt, hsa
aaguuuaggcagcaagggaaaggaauaugggucaguucucaaaugucaauguagauaagaguc

SEQ ID NO: 737433 - RNA, 63 nt, hsa
ccagcucccugaggugucccacauacuauugugaguucucagagcaugaacuguccucagaag

SEQ ID NO: 737434 - RNA, 63 nt, hsa
gcaaccucugcggcagccgacugcaugaaccaaaguucucaccuaaugguaucaucacgcagu

SEQ ID NO: 737435 - RNA, 63 nt, hsa
guuugccuuagauaccuaaauacacauauauucaguucucagauguugaagcugucaccagca

SEQ ID NO: 737436 - RNA, 63 nt, hsa
aaguuguuggccuuguguguguguuuuuuuuuaaguucucaucauuauuacauagacugugau

SEQ ID NO: 737437 - RNA, 63 nt, hsa
uaaugauaaugagaacaccuuugcccugaagucaguucucacaguauagaagagaacuuaaag

SEQ ID NO: 737438 - RNA, 63 nt, hsa
aaaaaugaaaaaaaaaucaaagauuuuuuuaacaguucucagacuuaacuguugccuugaauu

SEQ ID NO: 737439 - RNA, 63 nt, hsa
ccaagucuuuaauuugccaagaugaagaaaaugaguucucaaggagggaaugcuuugcuugag

SEQ ID NO: 737440 - RNA, 63 nt, hsa
uagguuuauuuuggaagggacuguggccaggguaguucucagguugugcuagagcagcacuuu

SEQ ID NO: 737441 - RNA, 63 nt, hsa
ggcagugcaaugcuuguagaaguaggaggaaacaguucucacugggaagaagcaagggcaaga

SEQ ID NO: 737442 - RNA, 63 nt, hsa
uuuucauuggcuuagggcagauuuucaugcaaaaguucucauaugaguuagaggagaaaaagc

SEQ ID NO: 737443 - RNA, 63 nt, hsa
uuacguaguggaaacauuuugcauuguuuacauaguucucauggaacauggaaauuuuugaaa

SEQ ID NO: 737444 - RNA, 63 nt, hsa
uuucgugcgacugcuuuuucuucaaaggaguucaguucucaccauggagugaguggccuuuag

SEQ ID NO: 737445 - RNA, 63 nt, hsa
gugaugguacaauguaaauggggacuucuguaaaguucucaguuucgguccaugugguuuauc

SEQ ID NO: 737446 - RNA, 63 nt, hsa
aauggccuggugccauccuuuugguaaugagugaguucucacuguauuagauccuguugaaaa

SEQ ID NO: 737447 - RNA, 63 nt, hsa
agaguaggcaaacaaauuuugccuucaugguacaguucucaguuuuucuuauaggagaaauau

SEQ ID NO: 737448 - RNA, 63 nt, hsa
auaauguauguguaauauacauaaucauaauacaguucucagaugcagggaagaaguuuggca

SEQ ID NO: 737449 - RNA, 63 nt, hsa
cugaguacuaauugauuccuccauccuugaaucaguucucauaaugcuuuuuaaauaagaaaa

SEQ ID NO: 737450 - RNA, 63 nt, hsa
acuggggugagggaggcauuguucuuuaguuggaguucucauucuuauucuccaguacugacu

SEQ ID NO: 737451 - RNA, 63 nt, hsa
cauccacacaccugccaacccugggaagcauccaguucucaaaucguuuuugcuauggauuua

SEQ ID NO: 737452 - RNA, 63 nt, hsa
gucauauuuuuguaguucuaguuuucauucuguaguucucaccccuuuguucauauuuuuaaa

SEQ ID NO: 737453 - RNA, 63 nt, hsa
uugggggcgguucccccaugcuguucuugugauaguucucacgagaucugaugauuuuauaag

SEQ ID NO: 737454 - RNA, 63 nt, hsa
gccucaguucuguacuuguaaaguggagacagcaguucucauccuccauccuuuuagcccaug

SEQ ID NO: 737455 - RNA, 63 nt, hsa
uaugacuuugugccauccccauaguaaugagugaguucucacucugguuguuuaugcaagagc

SEQ ID NO: 737456 - RNA, 63 nt, hsa
cuaaccauugagccaaugcauuggugucuccucaguucucagggaguguggguggcggcuccg

SEQ ID NO: 737457 - RNA, 63 nt, hsa
cuucugaggcagaggcuggagcaguucuuuuucaguucucauccucuccaucccaauccagua

SEQ ID NO: 737458 - RNA, 63 nt, hsa
aaguauugucaagggaagcuuccugugaaccaaaguucucaggccaaggucucgcccaccaaa

SEQ ID NO: 737459 - RNA, 63 nt, hsa
gggcggaggaaggaucguuauacgucuucagaaaguucucauugccccagcugccuaguacua

SEQ ID NO: 737460 - RNA, 63 nt, hsa
aacacgugguuuuuaaagccauuagguaaaaaaaguucucaauaaaggcauuacaauuuuuua

SEQ ID NO: 737461 - RNA, 63 nt, hsa
cccuuuccuaaugagccuccucaauaagagagaaguucucauugugggaaucugacauaguuc

SEQ ID NO: 737462 - RNA, 63 nt, hsa
gggagacucgcagaugcacacccacaaguauucaguucucaaacucuagacgaguguuggcaa

SEQ ID NO: 737463 - RNA, 63 nt, hsa
guaauacagccugguuuuuaaguacucacuaaaaguucucaaauauuggguugggcacggcuu

SEQ ID NO: 737464 - RNA, 63 nt, hsa
auggcaggaugugaacuuccccaucgcaaaugcaguucucagcccacugcaguggauacaagg

SEQ ID NO: 737465 - RNA, 63 nt, hsa
gcaggaucucagccauaaagugccaguuugcuuaguucucacugucuccuggucugugcugcc

SEQ ID NO: 737466 - RNA, 63 nt, hsa
cacucugauuuuuaaaauuaugcaguauuuuccaguucucagagaggucaugguugugcccag

SEQ ID NO: 737467 - RNA, 63 nt, hsa
uuucucuuggccccuuguacaccccaggagagaaguucucaaucccagcaguucuuuguaguc

SEQ ID NO: 737468 - RNA, 63 nt, hsa
uugccuuaguuuuggaaguaaauucuaguuuguaguucucauuuguaaugaacacauuaacga

SEQ ID NO: 737469 - RNA, 63 nt, hsa
uauuuugaaauagcuagaagagaggauuuugaaaguucucaacacaaagaaaugacacauauu

SEQ ID NO: 737470 - RNA, 63 nt, hsa
aguauauuagcagcaugcaauaauuacaucauaaguucucaagcagaggcagucuauugcaag

SEQ ID NO: 737471 - RNA, 63 nt, hsa
agaggauuugaaccauaauccuuggaaaacuuaaguucucauucaccccaguuuuuccuccag

SEQ ID NO: 737472 - RNA, 63 nt, hsa
gcccucgagaagaguuauugcucuagaaaguugaguucucauuuuuuuaaccuguuauagauu

SEQ ID NO: 737473 - RNA, 63 nt, hsa
cugcaaauggcauaaaaauuaaaguccuagcugaguucucaaugguaaaggcaucagaugucu

SEQ ID NO: 737474 - RNA, 63 nt, hsa
aaucaagcucaccaugcagggcagucacccggcaguucucaaacuuuagcaugugaagaguca

SEQ ID NO: 737475 - RNA, 63 nt, hsa
cucgugcugauagauggccacacucuuuagaguaguucucauaaguucuagaacugguagcuc

SEQ ID NO: 737476 - RNA, 63 nt, hsa
uucccuccccucccccucugccuuuuguacgccaguucucagaaauaaagaucuuuuguccgu

SEQ ID NO: 737477 - RNA, 63 nt, hsa
uuuaaucuucuuaaaauguaucuuguccuacauaguucucagaauacauaugggguauaguua

SEQ ID NO: 737478 - RNA, 63 nt, hsa
cugaagaauauuugaugugaugauucacuuuucaguucucaaauuaaaagaaaacuguuagau

SEQ ID NO: 737479 - RNA, 63 nt, hsa
uacaauuauguccauauaaaauucuagcccagaaguucucaucugggguagauuuuggccuuc

SEQ ID NO: 737480 - RNA, 63 nt, hsa
ucuggguucuacuuuauuuuuuaaaaucuuuacaguucucaccauuucacguaccuuaaucca

SEQ ID NO: 737481 - RNA, 63 nt, hsa
ugugauggaugugcauucucacuugggucuugaaguucucauuccuacaucucaagcuagcca

SEQ ID NO: 737482 - RNA, 63 nt, hsa
aagagaaaccaaaugagcugauuacugacuauaaguucucagccuuuauggaccuaaucuuau

SEQ ID NO: 737483 - RNA, 63 nt, hsa
ccuaguaauaggucauauuccccuaguaauaugaguucucaaagccuacauucaggaucuccc

SEQ ID NO: 737484 - RNA, 52 nt, hsa
accaagcaaaagacauauaaacaguucucaugagaacuugguaguaagcuaa

SEQ ID NO: 737485 - RNA, 63 nt, hsa
aguguaggaaauaaaagugaugauauuuaaaauaguucucaguugaagcagagaaaugccacu

SEQ ID NO: 737486 - RNA, 63 nt, hsa
uacugcacugcccaagguguguguagcacaaacaguucucauuacaaaggaccaauucagaac

SEQ ID NO: 737487 - RNA, 63 nt, hsa
uuucucccuauaaagaguuauaaaugaugguuuaguucucaggcagcuacaaaugccuauuua

SEQ ID NO: 737488 - RNA, 63 nt, hsa
uuguugaggagaggcugcucaaucgacaccccgaguucucaugacugggaagauaguuuucuu

SEQ ID NO: 737489 - RNA, 63 nt, hsa
gaaaucugcuugugugcuuauaagaauuuacugaguucucacuucccuuacagucauacaugg

SEQ ID NO: 737490 - RNA, 63 nt, hsa
aaccagaguggugccucuguccgagaacuuguaaguucucaacuugggaaagacagaggugcu

SEQ ID NO: 737491 - RNA, 63 nt, hsa
caaacccuugucagugacaguauuuugguucuuaguucucacuguucccucugcuccuggagc

SEQ ID NO: 737492 - RNA, 63 nt, hsa
gauaucuauaacuauagggauacaaaucacuacaguucucagauuuacagcuuuuuuuuguca

SEQ ID NO: 737493 - RNA, 63 nt, hsa
acauggaacagcagguaguuguuauguagagcuaguucucaaagcugcccugccuguuuuagg

SEQ ID NO: 737494 - RNA, 63 nt, hsa
gaagauuuaggaugccuccuucuaagaacuggaaguucucauuccccauuaugaacugagcua

SEQ ID NO: 737495 - RNA, 63 nt, hsa
gaggauuuaggaugccuccuucuaagaaccagaaguucucauuccccauuaugaacugagcua

SEQ ID NO: 737496 - RNA, 63 nt, hsa
cuaaccauccugcccauuauagcuacacucaggaguucucaucugacaagucaguuguccuga

SEQ ID NO: 737497 - RNA, 63 nt, hsa
uggccacuauuaaguggguuugccccaucacuuaguucucaggcagagacaucuuugggccug

SEQ ID NO: 737498 - RNA, 63 nt, hsa
caugugaauagauauuaagugccauauauaauuaguucucagaagaagggagaaaugaucaua

SEQ ID NO: 737499 - RNA, 63 nt, hsa
uugguuuguugacaauaacaguacaucuuuucaaguucucagcuauuucuucuaccucucccu

SEQ ID NO: 737500 - RNA, 63 nt, hsa
cagcucuggagcuccaccaacucucggccugccaguucucaagcgagcuaaucuugucauuaa

SEQ ID NO: 737501 - RNA, 63 nt, hsa
ccguguguucggacggcacuggcuccuuuccgaaguucucaguaacugagcccagaguaacug

SEQ ID NO: 737502 - RNA, 63 nt, hsa
ugcuuuugcuucucuccucugaagugugaguugaguucucauuuagguuuguaacauggcuau

SEQ ID NO: 737503 - RNA, 63 nt, hsa
cuucguccacgaauccacaccaccuuucccaucaguucucaccggaaauaugcugccaaaaag

SEQ ID NO: 737504 - RNA, 63 nt, hsa
aaacugauucuaugcaggugaaggaugcacuaaaguucucacuuuagugagaacuuuucuagc

SEQ ID NO: 737505 - RNA, 63 nt, hsa
ugacaggcaucaccaagucuucaaggaggacugaguucucaggggagaacugggaauggggcc

SEQ ID NO: 737506 - RNA, 63 nt, hsa
ucacagacaaacugggauccagcacaguccagcaguucucaaaaugagguccucaggccacag

SEQ ID NO: 737507 - RNA, 63 nt, hsa
cugccauagaauacucagucuuguggucaagagaguucucaagugacaaccauugggguuucu

SEQ ID NO: 737508 - RNA, 63 nt, hsa
ggugguuacccucaugcuguucuugugauggugaguucucaugagaucugauggguguuuuuu

SEQ ID NO: 737509 - RNA, 63 nt, hsa
uuucaaucucagugaaauggcucuuugcuuucgaguucucacgcaacguacugggcaaaugac

SEQ ID NO: 737510 - RNA, 63 nt, hsa
ggcccauucuucaucauuuguaaguucaacaaaaguucucacauggagucccaccucuucaga

SEQ ID NO: 737511 - RNA, 63 nt, hsa
aauuguauagcaugugacucuuuuggcuuucagaguucucaaaaauauuauuuuguugcaugu

SEQ ID NO: 737512 - RNA, 63 nt, hsa
guuuccccuacgauguucuccugauagugggugaguucucacaagaucugaugguuuuauaaa

SEQ ID NO: 737513 - RNA, 63 nt, hsa
ucuuuauuuuuaugcauuuagaauauuuuaaauaguucucagauauuaagaaguuguaugagu

SEQ ID NO: 737514 - RNA, 63 nt, hsa
uauuugacuuuuuuauuuuauguuaauguuuucaguucucacuuugaggcacauuuacaucaa

SEQ ID NO: 737515 - RNA, 63 nt, hsa
ggaacaguggggcugggaccgggugggagaaagaguucucagugguuccuuucuauacaguuu

SEQ ID NO: 737516 - RNA, 63 nt, hsa
cuucccacaaguccauucugccuucaaaguguaaguucucaugucauuauggauuuggaguuu

SEQ ID NO: 737517 - RNA, 63 nt, hsa
gcucaguucauuuaaaaaagauaucuauuugaaaguucucagaguuguacauauguuucacag

SEQ ID NO: 737518 - RNA, 63 nt, hsa
ugccccaacaaacucauggcguugaaaccacacaguucucauuacuguuauuuauuagcugua

SEQ ID NO: 737519 - RNA, 63 nt, hsa
uuuuuagacaugaaagaauugccuuaguugaacaguucucagauuguaguuugcaauccccug

SEQ ID NO: 737520 - RNA, 63 nt, hsa
ccugcaccagaggucucauauguuaccccagggaguucucagaggauuggguuggccucuaac

SEQ ID NO: 737521 - RNA, 63 nt, hsa
agggauuccuauugacacugcucgggugcacccaguucucacaugugcagucaugccguucuc

SEQ ID NO: 737522 - RNA, 63 nt, hsa
aggcgggcgccaggcccgcugugggugggcaccaguucucagcaccgcucacugcugccgggc

SEQ ID NO: 737523 - RNA, 63 nt, hsa
gcuaauaugauuacagcgaagacuuuccugauaaguucucaaacucgaugugugacuguuugg

SEQ ID NO: 737524 - RNA, 63 nt, hsa
ccucugcccaucccccucaagggcugcaggcccaguucucaugcugcccuugggugggcaucu

SEQ ID NO: 737525 - RNA, 63 nt, hsa
uucugcugcuugguguucuucuggaggagcgugaguucucagcggagcgcuucucggcacuuc

SEQ ID NO: 737526 - RNA, 63 nt, hsa
gauucucuagcuguuagguagaccuaaauaaaaaguucucaauagauuccucuuuugaguaaa

SEQ ID NO: 737527 - RNA, 63 nt, hsa
cuucccuuccaguucgaauuuggaaacucccaaaguucucaaugguuuguugugaguuccaug

SEQ ID NO: 737528 - RNA, 63 nt, hsa
guaaugguaaaugcuuuuaaucaagcaggaaaaaguucucaugauuaugccaacuauaauagu

SEQ ID NO: 737529 - RNA, 63 nt, hsa
cauguuucugguggacuaaauuguguaucugggaguucucacuuucuagccaggccugaugag

SEQ ID NO: 737530 - RNA, 63 nt, hsa
uaaucuggggagcaaauuccagcucugaaauggaguucucacaccguaucuagggacagaggc

SEQ ID NO: 737531 - RNA, 63 nt, hsa
ccccaaaucuuuuaaaugaagccagugacucccaguucucaacacauggccccagucaagaca

SEQ ID NO: 737532 - RNA, 63 nt, hsa
cacugugcugaccaucgcccaccgccucaacacaguucucaacugcgaucacguccugguuau

SEQ ID NO: 737533 - RNA, 63 nt, hsa
ucucacaucauagaggaccccuccuccucucccaguucucaacuucuccaugccuggaaucca

SEQ ID NO: 737534 - RNA, 63 nt, hsa
gccucagcugugggggccucaggcaggucccucaguucucacgccuuccuguccaguggaaug

SEQ ID NO: 737535 - RNA, 63 nt, hsa
ucugauaucugaggccaguaacuauuaauaucuaguucucagagcauuuggaaagguuaucuu

SEQ ID NO: 737536 - RNA, 63 nt, hsa
ccgagccacaggcaauaaaaggauaucagcuguaguucucagcuacaucaugguguauagaug

SEQ ID NO: 737537 - RNA, 52 nt, hsa
cucaucaggcccucgacugaaaaguucucaguggggccagacuggcuccugg

SEQ ID NO: 737538 - RNA, 63 nt, hsa
ggacacugaaccuuguugaugccagcuguacugaguucucauccacagaggccaggcauggcc

SEQ ID NO: 737539 - RNA, 63 nt, hsa
ccagaagaauaguuucucuggcucacaggcccaaguucucaaugaaaucguuuuuuaacuuuc

SEQ ID NO: 737540 - RNA, 63 nt, hsa
uaaacuugguaaaagauaaucuaaaaauuccauaguucucaguuauuaaaauuuuucuuguuc

SEQ ID NO: 737541 - RNA, 63 nt, hsa
ccguacacacacacucgggcacuucaggaggucaguucucaccccuuccucgauggggcuuua

SEQ ID NO: 737542 - RNA, 63 nt, hsa
cccuucccagucucauuagaggaagcuuuccaaaguucucaguuaucaagaccucauccagcu

SEQ ID NO: 737543 - RNA, 63 nt, hsa; identical to SEQ ID NO: 737535

SEQ ID NO: 737544 - RNA, 63 nt, hsa
acuggcaaacaugaaaaaucggcuuaccauuaaaguucucaaugcaaccauaaagcugacucu

SEQ ID NO: 737545 - RNA, 63 nt, hsa
ucagggccuugccucugcggccuccacuuggaaaguucucaguucccuccaggcuucuagaag

SEQ ID NO: 737546 - RNA, 63 nt, hsa
guucaucccuugaccaccucuggaccacuaacaaguucucagacuuugcauugcuugugaugg

SEQ ID NO: 737547 - RNA, 63 nt, hsa
gcgugcacagagggagucggugagcauuuccuuaguucucagacucuccuccgccucuaccaa

SEQ ID NO: 737548 - RNA, 63 nt, hsa; identical to SEQ ID NO: 737535

SEQ ID NO: 737549 - RNA, 63 nt, hsa
cccuucuccaccagauauuugcuuccuaagaauaguucucauuggaggcugaggucgaagcag

SEQ ID NO: 737550 - RNA, 63 nt, hsa
aaacuuacagcuuaacccauuuucaagcaaaacaguucucagaaaugucaugauugccggggu

SEQ ID NO: 737551 - RNA, 63 nt, hsa
aguccuucucagauuagcuggaaauggggacagaguucucauuuaucccagauauauacauug

SEQ ID NO: 737552 - RNA, 63 nt, hsa
uuuuagucaucccagcuuuuuagucuuaaccacaguucucacucucuuaaaugguaccucaaa

SEQ ID NO: 737553 - RNA, 63 nt, hsa
guggcugaaacugagcuuuuuugugugggcuccaguucucacuguucugcaaugcucauggca

SEQ ID NO: 737554 - RNA, 63 nt, hsa
augcggaggcgaggugagugauuccaucauuucaguucucaccugcaguuuuggugaagcagg

SEQ ID NO: 737555 - RNA, 63 nt, hsa
cguagugugggagaggagagagcugaugacugcaguucucaaagguccucagugaaguuauuu

SEQ ID NO: 737556 - RNA, 63 nt, hsa
uuuaaaagaaaggagagaacauuuuagaacaauaguucucaaaguguguuccccggacaagca

SEQ ID NO: 737557 - RNA, 63 nt, hsa
gcacaggcugacaccaaaguggcacaacugcacaguucucagauuucuuugcacagauugauu

SEQ ID NO: 737558 - RNA, 63 nt, hsa
auaauccaguauugcugauuuuaaaggcagagaaguucucaaaguuaauucaccuauguuauu

SEQ ID NO: 737559 - RNA, 63 nt, hsa
acaucuaaaaaucaaauaagcuaauauacagucaguucucauuauucacaguaauuauguucu

SEQ ID NO: 737560 - RNA, 63 nt, hsa
ggaauauacuuuucuuaaaaaaaaggaacaguuaguucucaucuagaaugaaaguuccauaua

SEQ ID NO: 737561 - RNA, 63 nt, hsa
ugaccuggagugacagcugagucacccuggguaaguucucagaguggucaggauggcuugacc

SEQ ID NO: 737562 - RNA, 63 nt, hsa
uuucgcuuuucaguaaaaacagucaaguuacugaguucucacauaaagagcucuucucacaca

SEQ ID NO: 737563 - RNA, 63 nt, hsa
uguaauauuguuuuguggauaauugaaauaaaaaguucucauugaaugcaccuauuaaucguu

SEQ ID NO: 737564 - RNA, 63 nt, hsa
gaugcagagacaauguugaaauccccuaaacacaguucucaguggcaaaaccuaggaaggcuc

SEQ ID NO: 737565 - RNA, 63 nt, hsa
caccuugggggcuggcuuaggggaggcuguuggaguucucacugacuuaguggcauauuuauu

SEQ ID NO: 737566 - RNA, 63 nt, hsa
cauuuccucuccaacuuucuuccuuggaggccaaguucucacccuguccaacuauucgcagga

SEQ ID NO: 737567 - RNA, 63 nt, hsa
augcuaauuuucauuucuagaauggucacuggcaguucucacuuuuaacuauaagaagucacg

SEQ ID NO: 737568 - RNA, 63 nt, hsa
caaugucuuugagaaugcagucauuugcacgugaguucucaucuuuguuuucugaaacagacg

SEQ ID NO: 737569 - RNA, 63 nt, hsa
ccggaguccacucccagugcuugcaagauuccaaguucucaccucuuaaagaaaacccacccc

SEQ ID NO: 737570 - RNA, 63 nt, hsa
gugguguggaggcuguugauguuucuggugucaaguucucagaaguugcugccaccaacucuu

SEQ ID NO: 737571 - RNA, 63 nt, hsa
cccggggacccccgcgggccccagaagcagcccaguucucagagagcccuuggaaggggucuc

SEQ ID NO: 737572 - RNA, 63 nt, hsa
aaauauaaagaaugugacaaagcuuuuuaaggaaguucucaacccuuauuacacauaauucau

SEQ ID NO: 737573 - RNA, 63 nt, hsa
gaagaauguggcaaaaccuauaaaccuauaacaaguucucaauuccuuuuuuuuugagaugga

SEQ ID NO: 737574 - RNA, 63 nt, hsa
acagaugugaagaauguggcaaaggcuuuaauuaguucucaucccuuacuaaacauaagagaa

SEQ ID NO: 737575 - RNA, 63 nt, hsa
ugaaaugugaugaauguggcauagccucuucccaguucucaacucuuacuaaacaugagaaca

SEQ ID NO: 737576 - RNA, 63 nt, hsa
uacaaauaugaagaaugugacaaggccuuuaaaaguucucaacccuuauuacacauaauuuau

SEQ ID NO: 737577 - RNA, 63 nt, hsa
ugacaaggaccaaugcuucuuuaucuggugcucaguucucagucagacgugcagcauggcugc

SEQ ID NO: 737578 - RNA, 63 nt, hsa
acuuaauaaauguaugagucuuaaauaccucuuaguucucauuaaauuuaggaaaauucacac

SEQ ID NO: 737579 - RNA, 63 nt, hsa
gcucccucuggggacggcuggcucacugucuccaguucucaauggccaacgaaggugcuugga

SEQ ID NO: 737580 - RNA, 63 nt, hsa
gggauacagaguuguccauuaccaaagccuggaaguucucaucaccuccagguggacugcuug

SEQ ID NO: 737581 - RNA, 63 nt, hsa
cacaaagugcuuccuuuuaaaugaaaaggugaaaguucucaacuuaaaaaagaaaagaaaaaa

SEQ ID NO: 737582 - RNA, 63 nt, hsa
cccccucucauaacuucuccccaucccaggaggaguucucaggccugggguggggccccgggu

SEQ ID NO: 737583 - RNA, 63 nt, hsa
ugucaacguuguccucaugacaaccagacuuccaguucucaggaacuucucauugugggccag

SEQ ID NO: 737584 - RNA, 63 nt, hsa
acaaaugugaaaaacguggcaaagcuuuucauuaguucucaacccuuacugaacauaagggaa

SEQ ID NO: 737585 - RNA, 63 nt, hsa
gcagauuucucccuugcuguucucaugauagugaguucucaugagagcugaugguuuuaaggu

SEQ ID NO: 737586 - RNA, 63 nt, hsa
auguguucacaaggguuacuccucaaaacccccaguucucacucauguccccaacucaaggcu

SEQ ID NO: 737587 - RNA, 63 nt, hsa
cccuccccccccacccccccccacugcuccuggaguucucaucggauuccccaagggcacugc

SEQ ID NO: 737588 - RNA, 63 nt, hsa
cagugaauguaaggaucccuucagucaccacucaguucucacucauugcagaaggauucauac

SEQ ID NO: 737589 - RNA, 63 nt, hsa
aguagagaugggguuucacccuguuagccaggaaguucucaaucuccugaccucgugaucugc

SEQ ID NO: 737590 - RNA, 63 nt, hsa
uauuucuuuuguuccaaguuuguauuuccucagaguucucacauauggaaaggauacacacuu

SEQ ID NO: 737591 - RNA, 63 nt, hsa
guagcucggcaccaacuaagaaaaaaagcacaaaguucucagagcucucgaggaaagugguug

SEQ ID NO: 737592 - RNA, 63 nt, hsa
aauuuuagugaaacuugacucaacuauacacaaaguucucauccuaaaugaacuauuucaguc

SEQ ID NO: 737593 - RNA, 63 nt, hsa
uugggaucuuguuuagagaauccacuuucuggaaguucucagcauaauuaguguugagagugg

SEQ ID NO: 737594 - RNA, 63 nt, hsa
auuuauuaacagucagggccuauccuugccuguaguucucagucacuggaugcacaaaaucac

SEQ ID NO: 737595 - RNA, 63 nt, hsa
agagcuucuggcaccagaacccugucuuccuccaguucucaacacgguguugcucuucaguca

SEQ ID NO: 737596 - RNA, 63 nt, hsa
gcugguuucccuuacacauagcagagcucacucaguucucacaguagccaaaugaagcaguua

SEQ ID NO: 737597 - RNA, 63 nt, hsa
cgcuuauucuccucccuguuaucugcuagaucuaguucucaaucacugcucccccguguguau

SEQ ID NO: 737598 - RNA, 63 nt, hsa
cuugugauagugaguucucauaagaucucagugaguucucaugagaucugguuuuuugaaagu

SEQ ID NO: 737599 - RNA, 63 nt, hsa
gcggacuucccccuugcuguucuugugauagugaguucucauaagaucucagugaguucucau

SEQ ID NO: 737600 - RNA, 63 nt, hsa
cugaaaggcuuuucaaccacaaaacucaucuggaguucucaaagaccuggggcugcugugaag

SEQ ID NO: 737601 - RNA, 63 nt, hsa
acccauuuguuuuuuacaugggguuguagaucgaguucucaaaggugaaaccagaugaucauu

SEQ ID NO: 737602 - RNA, 63 nt, hsa
gcuaccuccgugcuguucucgugauagcgagugaguucucacgagaucugaugguuuuauaag

SEQ ID NO: 737603 - RNA, 63 nt, hsa
uuucauuuuauuucucauaauuugaacagagacaguucucauacaugaucagaugcuuuuuuu

SEQ ID NO: 737604 - RNA, 63 nt, hsa
gugacaauuuucuuggaacuccuuuuuauuguuaguucucacuuguuuccauauuuagugaau

SEQ ID NO: 737605 - RNA, 63 nt, hsa
aauuuuuuuaacagggucuuccucucucgcccaaguucucaugccucagccucccaaauagcu

SEQ ID NO: 737606 - RNA, 63 nt, hsa
ugggcugaaguuaauuguucaucuugccccuuuaguucucaugcacagaauuccuccauagca

SEQ ID NO: 737607 - RNA, 63 nt, hsa
ggggcagcagauaggagagcacugagcccggauaguucucagccuggcaaguggcucugaagc

SEQ ID NO: 737608 - RNA, 63 nt, hsa
guucucacaccugugcgcagguuugcacacucaaguucucaugggcaggcucaggucuguccc

SEQ ID NO: 737609 - RNA, 63 nt, hsa
auuggggagugggggguucgagggacuuaguggaguucucaucccuucaaugcccccucccuu

SEQ ID NO: 737610 - RNA, 63 nt, hsa
gcccgcgugccugcccaugccagcacuuccuuaaguucucacaucacacucaaaccagugaca

SEQ ID NO: 737611 - RNA, 63 nt, hsa
uugaugagaaauggaagaugagaacucccuaagaguucucauaauaaaucaucucaucacaaa

SEQ ID NO: 737612 - RNA, 63 nt, hsa
gcgagaacacgaucuucuuccacaucuccagcaaguucucaagcucagagacggugagucucc

SEQ ID NO: 737613 - RNA, 63 nt, hsa
ugcucuuggcuuggucucuacccucacuaccucaguucucaauaacuuagugaaucacugccc

SEQ ID NO: 737614 - RNA, 63 nt, hsa
guggaagaauuucgugccauguggaaacuuuuuaguucucacuacaauguucacauugaugau

SEQ ID NO: 737615 - RNA, 63 nt, hsa
ugagaaauacuucuucaaguuaugaugcuugaaaguucucaauaaaguucacgguuucauuac

SEQ ID NO: 737616 - RNA, 63 nt, hsa
gaggggccuugcaaggaggggccuuugagccucaguucucauguauugggggguggggguggg

SEQ ID NO: 737617 - RNA, 63 nt, hsa
uacauuuguuuugugugucacauggggucaguaaguucucaauaaaaauuguuaagaaaugcc

SEQ ID NO: 737618 - RNA, 63 nt, hsa
gaucacaagucagcacuaccuccucccuucuugaguucucaacugagugagcaucauggaggg

SEQ ID NO: 737619 - RNA, 63 nt, hsa
auagccauauccaaaucuuuucccccucccaagaguucucagugucuacauguagacuauucc

SEQ ID NO: 737620 - RNA, 63 nt, hsa
gacuggacuguuuuuguuuuuuugguuacaauuaguucucaucucccugucgucgucauuguu

SEQ ID NO: 737621 - RNA, 63 nt, hsa
auuaccuaagcugccaugcauuuuuuuuuuuacaguucucaaggaagagcacagaacaauuuc

SEQ ID NO: 737622 - RNA, 63 nt, hsa
auucuucacucuguguuugaagagagcagucacaguucucaguaguggggagcauguugggug

SEQ ID NO: 737623 - RNA, 63 nt, hsa
cagggcaccccagccccacacucacauguacgaaguucucaccccagcuccuuuguguggcac

SEQ ID NO: 737624 - RNA, 63 nt, hsa
gccuaaauauauauguacagugccuggcauauaaguucucaauaaaugguagauauuaauuuu

SEQ ID NO: 737625 - RNA, 63 nt, hsa
aguacuggagcacguggucagggucaaugcaagaguucucauuuccuacccaucccugcauga

SEQ ID NO: 737626 - RNA, 63 nt, hsa
ccaaauccggaagucaaaguucucauggucagaaguucucauggugcacgaguccucagcacu

SEQ ID NO: 737627 - RNA, 63 nt, hsa
caccugggcagaucccccaaauccggaagucaaaguucucauggucagaaguucucauggugc

SEQ ID NO: 737628 - RNA, 63 nt, hsa
cuuucaucagccccagcccccacacuccaccaaaguucucaugcacuaugcacucagaaaaau

SEQ ID NO: 737629 - RNA, 64 nt, hsa
guuuucccccaugcuguucucaugauagugagugaguucucacgagaucugaugguuuuacaag

SEQ ID NO: 737630 - RNA, 64 nt, hsa
aaugcuauuuuuauuugaaccuuuggaacuugggaguucucauuguaacccuaacaugugagaa

SEQ ID NO: 737631 - RNA, 64 nt, hsa
accucuaccccuuuccauuuuggauucucggcugaguucucacagaagcauuuuccccaugugg

SEQ ID NO: 737632 - RNA, 64 nt, hsa
cagugcccuggcauucuggcagagaauccucaccaguucucaccaaccuuccccccaggcaagg

SEQ ID NO: 737633 - RNA, 64 nt, hsa
cugauggucuucuauccacccuacuugguaacaaaguucucagauguuaggucauguuucauuu

SEQ ID NO: 737634 - RNA, 64 nt, hsa
ugcacaccuuuauucagaacuuuaguauuaaaucaguucucaauuucauuuuuuauguauuguu

SEQ ID NO: 737635 - RNA, 64 nt, hsa
cuuucaaucugaagauguaagacuuccugaaacaaguucucaagaagucuuuacauuauauuua

SEQ ID NO: 737636 - RNA, 64 nt, hsa
agacuucguauuaucaugggaguacuguaaguucaguucucagggaaugcuaaauuagaguaau

SEQ ID NO: 737637 - RNA, 64 nt, hsa
cgggucauagagcuaccguauuuucuaggacaagaguucucagucacugugcaauaugcccccu

SEQ ID NO: 737638 - RNA, 64 nt, hsa
cagucaccccaaauggagacacucgcagaccugcaguucucagaccgaaggugcugccuucauc

SEQ ID NO: 737639 - RNA, 64 nt, hsa
acuucaauuuauauuugugauaugaagacuauccaguucucaguuugaauuggaacaucauguu

SEQ ID NO: 737640 - RNA, 64 nt, hsa
cuuucacuggugcacacugaaauuuuacuugaacaguucucauaauaaagcacuugucuuuugc

SEQ ID NO: 737641 - RNA, 64 nt, hsa
aguuggcaacaucccuaaaaacucagucucuucuaguucucagagaaggguuucaucuucuaag

SEQ ID NO: 737642 - RNA, 64 nt, hsa
uaaccuuggcugugggccgauaaugcauauguccaguucucacuuaaauuaugcaaugauauuu

SEQ ID NO: 737643 - RNA, 64 nt, hsa
cuugccagucccgguguucaaugucaucaauggcaguucucaugcugucaccaagcuggccaug

SEQ ID NO: 737644 - RNA, 64 nt, hsa
caggagagcagcaggagaggcgcacagaaggcccaguucucagggguuuuuauucuugcugcag

SEQ ID NO: 737645 - RNA, 64 nt, hsa
gcucuucaagacaaaacagauugcgucgcugacaaguucucaagaagaacuuaugaguaagcag

SEQ ID NO: 737646 - RNA, 64 nt, hsa
agagcuggguggccuguuucugcagcccuugggcaguucucacuccuaggagagccaaccucgg

SEQ ID NO: 737647 - RNA, 64 nt, hsa
uagcgagauucuuucuaaauguuauucaagauugaguucucacuaguguuuuuuuaauccuaaa

SEQ ID NO: 737648 - RNA, 64 nt, hsa
ccaucuccauugagaugauuaagugaaccaaacuaguucucagaauucuacagagaaggaggga

SEQ ID NO: 737649 - RNA, 64 nt, hsa
acuucugugagauggcuggcuggugauaggacuaaguucucauuguucaaauagagcuguucaa

SEQ ID NO: 737650 - RNA, 64 nt, hsa
uuuuuguugcguguuuccauuuuaaagugaguugaguucucaaauuggaaagaaagauuccuug

SEQ ID NO: 737651 - RNA, 64 nt, hsa
aggcuauuuuauuuauuucaaaugcaguuguauuaguucucauuauugaacugucugugcacug

SEQ ID NO: 737652 - RNA, 64 nt, hsa
aaugauuuauugcuaugccccagauccuuaauguaguucucauccuccgcaugcccucagccac

SEQ ID NO: 737653 - RNA, 64 nt, hsa
gggaacuaaauggagcccugacugcaccaaauaaaguucucauuuugcugcuuguuccaaauaa

SEQ ID NO: 737654 - RNA, 64 nt, hsa
cucaguaguuuaguacaauaaucucuauuugagaaguucucagaauaacuaccuccucacuugg

SEQ ID NO: 737655 - RNA, 64 nt, hsa
caggugaauucccgacucuuuugguuugaaugacaguucucauuccuucuauggcugcaaguau

SEQ ID NO: 737656 - RNA, 64 nt, hsa
uuuuuuuuuuuuuuuuuuuuuugagcucaaagagaguucucauuuucccuauucaaacuaauac

SEQ ID NO: 737657 - RNA, 64 nt, hsa
cugccggacaaagcaaguugaagagaugaguaacaguucucacugaugacccacuucugcaggc

SEQ ID NO: 737658 - RNA, 64 nt, hsa
ccagagcuaggccagaucaaugcuacaaucaugaaguucucauugcaugcaauuguguaggauu

SEQ ID NO: 737659 - RNA, 64 nt, hsa
caacugcauugguuuuccaugaccuuaaggcaguaguucucaacuggggggcaauuuugcacug

SEQ ID NO: 737660 - RNA, 64 nt, hsa
aaaaaauuguuuacuuuguuggacaaaccaaaucaguucucaaaaaaugaccggugcuuauaaa

SEQ ID NO: 737661 - RNA, 64 nt, hsa
cugagacuuggccugugaccaucauggcaguuggaguucucauauagaggugaccaguuugcca

SEQ ID NO: 737662 - RNA, 64 nt, hsa
cuuauuuaaaaacaaaaccaaaugauaucuaaguaguucucagcaauaauaauaaugacgauaa

SEQ ID NO: 737663 - RNA, 64 nt, hsa
aacacauuauaaaguucagauguuucaucaaugcaguucucacgaaaguauuuacuuuuuaaaa

SEQ ID NO: 737664 - RNA, 64 nt, hsa
ggagauggggaguuuuuuugaaaaccagaauuacaguucucauuucacuacuuaccaguuguau

SEQ ID NO: 737665 - RNA, 64 nt, hsa
aguauugcguaccaagugauacaacucgaaaugcaguucucaucuuccuguuuugagaaaugau

SEQ ID NO: 737666 - RNA, 64 nt, hsa
agacagcccaaagacaaauauugggcaggaaaucaguucucacugagcccgguuuccauguaaa

SEQ ID NO: 737667 - RNA, 64 nt, hsa
gagaagguugagaugcaaagagucuaccuuuccaaguucucacugcuggaaagagcuagaagca

SEQ ID NO: 737668 - RNA, 64 nt, hsa
ucucacaaaacccuacuuaggucaucagggcaggaguucucacucccauuuuacagaugagaau

SEQ ID NO: 737669 - RNA, 64 nt, hsa
aagcugggcuggcugggaugccucuggcuggugaaguucucacauaggcugauuuaaauccagc

SEQ ID NO: 737670 - RNA, 64 nt, hsa
augauaauuucugucccacugugucucauuauagaguucucagccauuggaccucuucuaaagg

SEQ ID NO: 737671 - RNA, 64 nt, hsa
cuccccuucauuggcugcccaggccacuggccccaguucucagugucccuuggguccaggcucc

SEQ ID NO: 737672 - RNA, 64 nt, hsa
ugugcuuuucccaguuugguguuagguggccuuaaguucucaguaaugacacuuaucaaauagg

SEQ ID NO: 737673 - RNA, 64 nt, hsa
auauaaacagauccccugcugaacagauacacagaguucucagaccccacccccacccucaggu

SEQ ID NO: 737674 - RNA, 64 nt, hsa
ugaaagucauauuuuauuuguggcauuuuuauauaguucucauccacaugcuaaauggaaagac

SEQ ID NO: 737675 - RNA, 64 nt, hsa
cuacguagugaucugcuuuuacuuuguaauuuguaguucucaaaagacuuuuuuuuaaaaaaau

SEQ ID NO: 737676 - RNA, 64 nt, hsa
cuagcuaaucucuacaaacccucuguaggccaguaguucucaaaguguggucucuggaagagca

SEQ ID NO: 737677 - RNA, 64 nt, hsa
cgcaccguguggcuccgccuccuggcccccagccaguucucagaaacguggcuggggcccagca

SEQ ID NO: 737678 - RNA, 64 nt, hsa
guccauaaacguuaugcugaauaguuguugaaacaguucucauuuuguaguauuuaauaaucug

SEQ ID NO: 737679 - RNA, 64 nt, hsa
gguuuccccuauguuguuaucauaauagagagggaguucucacaagaucugcugguuuuaaaga

SEQ ID NO: 737680 - RNA, 64 nt, hsa
ucguguugacagcaaagaaacagagugcuaauuuaguucucagcucuucugacuuaagugugca

SEQ ID NO: 737681 - RNA, 64 nt, hsa
aagcaacuuuccuuuccuggagcuucuuccuuguaguucucaggaccuguucaagaaggugucu

SEQ ID NO: 737682 - RNA, 64 nt, hsa
ccuuuuuggaaggaaaggaaggggaagacacccuaguucucaguguuugggacucuuaugcaga

SEQ ID NO: 737683 - RNA, 64 nt, hsa
aaaugagaaauguaguuucucaguugcacuaucaaguucucaauggcuacgugugacuagugcu

SEQ ID NO: 737684 - RNA, 64 nt, hsa
aagaauauguauucauauaaucugccuacuuuugaguucucauauuaacauuuagauaacauau

SEQ ID NO: 737685 - RNA, 64 nt, hsa
ggcguggaaaggggcaggccagagcuacccgcagaguucucagaaucaugcugagagagcugga

SEQ ID NO: 737686 - RNA, 64 nt, hsa
aaugccuguguuuucuucuaagaacuauacuuuuaguucucacaauggucuuugauccauuucg

SEQ ID NO: 737687 - RNA, 64 nt, hsa
ccucugcugguagcagugccuauagcuggaccuaaguucucagaagcguagaugugcaaacaag

SEQ ID NO: 737688 - RNA, 64 nt, hsa
caauguuucgguuuagacucuccacuguuaccuaaguucucaagcugccuaugguuuuucugug

SEQ ID NO: 737689 - RNA, 64 nt, hsa
acuucaggcggggacccauugccucgcagaagaaaguucucacuuauaaaccucuguacacaca

SEQ ID NO: 737690 - RNA, 64 nt, hsa
guauuucuauguucuguaaaguauuugacuuacuaguucucaauaaaauuuuauuaggacuaua

SEQ ID NO: 737691 - RNA, 64 nt, hsa
uuuucuuuuauuauaaacaaggggauuauucuuuaguucucagagguagggacaaaaccacauc

SEQ ID NO: 737692 - RNA, 64 nt, hsa
uucuuauugcuguacauugcguuuuuaaccugcaaguucucaguuucuucaccaucacuccauc

SEQ ID NO: 737693 - RNA, 64 nt, hsa
acuucucugccaucccuuugcaccugagaggggaaguucucagcugagcugaagcuggauuauu

SEQ ID NO: 737694 - RNA, 64 nt, hsa
cugccuacagaaccuugagguugacuccugcuucaguucucagcuguuuaccacagcccuccag

SEQ ID NO: 737695 - RNA, 64 nt, hsa
uagagugguuaacagauacaagugucaguuucuuaguucucauuuaagcacuaguggaauuuuu

SEQ ID NO: 737696 - RNA, 64 nt, hsa
uucucucuucuguaacuuccaaagcaucccucucaguucucaugcucagcugaugguuauguuu

SEQ ID NO: 737697 - RNA, 64 nt, hsa; identical to SEQ ID NO: 338022

SEQ ID NO: 737698 - RNA, 64 nt, hsa; identical to SEQ ID NO: 338023

SEQ ID NO: 737699 - RNA, 64 nt, hsa
uuuuugcccacguguuugcgcuguuuuucucuggaguucucaagaguuggugacuuggaaggcc

SEQ ID NO: 737700 - RNA, 64 nt, hsa
auuuucuccaugcacugugaacuucuguggcuucaguucucaugcugccucuuccaaaagggga

SEQ ID NO: 737701 - RNA, 64 nt, hsa
gauagagcccuuggcauuuuauuaucacauucuuaguucucagguugggacuucaauuacugcu

SEQ ID NO: 737702 - RNA, 64 nt, hsa
auggcuuccauaugccacucuguaccccaaagagaguucucaugaaauauucuccagaauguau

SEQ ID NO: 737703 - RNA, 64 nt, hsa
uauuucuucuaguaaaauaaaauauuguuagauuaguucucauuaaauuuauuauaugcuaaag

SEQ ID NO: 737704 - RNA, 64 nt, hsa
accugccuuaauuauuuaucuuuaguuccuuauuaguucucaagaaacaaaugcuagcuucaua

SEQ ID NO: 737705 - RNA, 64 nt, hsa
gguacggacuuccuuuaggaucucaggcuucugcaguucucaugacuccuacuuuucauccuag

SEQ ID NO: 737706 - RNA, 64 nt, hsa
cuaugcucuagagaaaagucuaccccugcuaaggaguucucaucccucugucagggucaguaag

SEQ ID NO: 737707 - RNA, 64 nt, hsa
ugaagccagauccacccuaucccuguacagaguaaguucucaauuauuggccugcuaauagcug

SEQ ID NO: 737708 - RNA, 64 nt, hsa
ucuuccacagggccuguguaagaauggguucuggaguucucauggucuuuaggaaauauugagu

SEQ ID NO: 737709 - RNA, 64 nt, hsa
ugcuuuuaaguggugcuguuucccauagggcauuaguucucagauuuuggaaugugaaauaauc

SEQ ID NO: 737710 - RNA, 64 nt, hsa
auuauuagugaaaacaaaacuaaagggaaguucaaguucucauguaaugccacauauauacuug

SEQ ID NO: 737711 - RNA, 64 nt, hsa
aaggacagauagaccacccucaucaaugaaaggaaguucucaaacacauccuuuggaacuuacu

SEQ ID NO: 737712 - RNA, 64 nt, hsa
uguggaguuugacauuguauguaucuauuuauuaaguucucaaugugaaaaaugugucuguaag

SEQ ID NO: 737713 - RNA, 64 nt, hsa
cacuguauccagguucccucccagaggagccaccaguucucauggguggcacucagucucucuu

SEQ ID NO: 737714 - RNA, 64 nt, hsa
agguagcugggggaguggcauggggcaggggcccaguucucagcagcagacacucuguacaguu

SEQ ID NO: 737715 - RNA, 64 nt, hsa
uuuagacaugaacaugacauguucagcuaggcagaguucucauagauaauuuucaaauauuuuc

SEQ ID NO: 737716 - RNA, 64 nt, hsa
uaguuugaccucauuuguaaaauauuuaugagaaaguucucauuuaaaaugagaucguuguuua

SEQ ID NO: 737717 - RNA, 64 nt, hsa
ggcucacugcaaccucugccucccggguucaagcaguucucaugucucaacaucccagguagcu

SEQ ID NO: 737718 - RNA, 64 nt, hsa
cacuugaacuggacaucaggggaagcugcuugagaguucucaauuacuuucuuaaacaguguuu

SEQ ID NO: 737719 - RNA, 64 nt, hsa
acuauaaacaugagauaagggaaaaugaauccagaguucucauauuaauagguagugaaacaau

SEQ ID NO: 737720 - RNA, 64 nt, hsa
auugccuaggaaagcaagucauauggccauugauaguucucauguaauuaguuuugcucaccac

SEQ ID NO: 737721 - RNA, 64 nt, hsa
gggugggcggcuggagaccaugcagagcgccgugaguucucagggcuccugccuucuguccugg

SEQ ID NO: 737722 - RNA, 64 nt, hsa
gaaagcccgcuagaagguuugggaacgaggggaaaguucucagaacuguuggcugcuccccacc

SEQ ID NO: 737723 - RNA, 64 nt, hsa; identical to SEQ ID NO: 338024

SEQ ID NO: 737724 - RNA, 64 nt, hsa; identical to SEQ ID NO: 338025

SEQ ID NO: 737725 - RNA, 64 nt, hsa
aaauuuugacccaaggcacagcagugaaauuuauaguucucaauuuaguugucauuauugacag

SEQ ID NO: 737726 - RNA, 64 nt, hsa
gacuugaagcaagaggccaagugaggggcugcccaguucucacaccagaaaccacacauucacu

SEQ ID NO: 737727 - RNA, 64 nt, hsa
aucuuagauuuuuaaaaaagaauuaaaaugugggaguucucagaaagaaauaaacacaugagaa

SEQ ID NO: 737728 - RNA, 64 nt, hsa
ggaaggguagaauuuugaaaccuugauuuucuagaguucucauuuauucaggauaccuauucuu

SEQ ID NO: 737729 - RNA, 64 nt, hsa
guaugacguugggucccucugaaguuuaauucugaguucucauuaaaagaaauuugcuuucauu

SEQ ID NO: 737730 - RNA, 64 nt, hsa
uuucuaguauagugaacuacauacugaauauccaaguucucagcaccuacuuuugucaaaucuu

SEQ ID NO: 737731 - RNA, 64 nt, hsa
auaugcauaccagcaauuauuacuguguucgcacaguucucacuuaacuggugcuaugugaaga

SEQ ID NO: 737732 - RNA, 64 nt, hsa
ccugagugaacacccccagcugggugguccaccaaguucucauaaacagagucccucccauucc

SEQ ID NO: 737733 - RNA, 64 nt, hsa
aaggguaguguuuguuuuugaacgauaauuuagaaguucucauagaaagcguauaacauagguc

SEQ ID NO: 737734 - RNA, 64 nt, hsa
auuugccggccauuuggaaagugaaaugccacuuaguucucaauugaugacaguguuugaauca

SEQ ID NO: 737735 - RNA, 64 nt, hsa
uaaguucuuaaagaaccagcuucuuagaauguucaguucucaaugugcugcugcuuucccuucu

SEQ ID NO: 737736 - RNA, 64 nt, hsa
gcaaagugccugccucugaccucaucaugguucuaguucucauacagaacuccagaauuuuuaa

SEQ ID NO: 737737 - RNA, 64 nt, hsa
ccccagugaaagccaaguuggacugaauuucuggaguucucaucagugcacauuccauaguucu

SEQ ID NO: 737738 - RNA, 64 nt, hsa
ccauugucccagcugggaaggggacauucccacuaguucucauucauucuugcuuuuaugaaaa

SEQ ID NO: 737739 - RNA, 64 nt, hsa
auuuauuaaauauaaugaauaugagaaaacucuuaguucucaucagauacuaaguuuuaagaau

SEQ ID NO: 737740 - RNA, 64 nt, hsa
cacucugcguucuccuagaucugagcaagcugucaguucucacccccaccguguauauacauga

SEQ ID NO: 737741 - RNA, 64 nt, hsa
guaucuuguuaccugcuuucucucucaacaccacaguucucaacccugagccuuccagagagag

SEQ ID NO: 737742 - RNA, 64 nt, hsa
cuugggacagcugggaacuuaacuugaaauaggaaguucucacugaauccuggaggcuggaaca

SEQ ID NO: 737743 - RNA, 64 nt, hsa
guguuaccauggaaaaggauauucacaguaguacaguucucaauauuuuuaauuagaugucaua

SEQ ID NO: 737744 - RNA, 64 nt, hsa
uuuuuuggauauaugcauguugucauuuuggacuaguucucaugcuacugcaaagaucuauugc

SEQ ID NO: 737745 - RNA, 64 nt, hsa
acugaauggaaauaaauagauguaaauaaaauugaguucucauuuaacuguuauauuucauuuu

SEQ ID NO: 737746 - RNA, 64 nt, hsa
ggguaguaagcaugguuucuugcagaaaacacaaaguucucagcuaacacauuaaacuucucac

SEQ ID NO: 737747 - RNA, 64 nt, hsa
aggagacuaagacuguauaaacaucuucauugucaguucucaaaaugacugaaauuguuuucau

SEQ ID NO: 737748 - RNA, 64 nt, hsa
uauggauuugacagggugcaugucacagagagacaguucucagucagcacuuccuguccccugc

SEQ ID NO: 737749 - RNA, 64 nt, hsa
cuccaggacagagcccucaaagcaacucccaacgaguucucaggauucaggcucuggcuucaac

SEQ ID NO: 737750 - RNA, 64 nt, hsa
aucugugugcugcugucuuccgguaaacggaccaaguucucacuucccauccuccuccccaguc

SEQ ID NO: 737751 - RNA, 64 nt, hsa
gugaagaaaguacuuuucuggcauagcuaccgugaguucucagcaggaacuucccagcgaugau

SEQ ID NO: 737752 - RNA, 64 nt, hsa
cuuaagaguuuguguguaaacaggcucaucucugaguucucaggacccuugcccccacccccau

SEQ ID NO: 737753 - RNA, 64 nt, hsa
caagacuuugcauuuccuaguauuucuguuugucaguucucaauuuccuguguuugcaauguug

SEQ ID NO: 737754 - RNA, 64 nt, hsa
uugaaaacuccagaaauacaucacccaagguggcaguucucaguauuuggcagaacaauugcaa

SEQ ID NO: 737755 - RNA, 64 nt, hsa
uuagcagugcauugguauaagcaauuauuucaucaguucucagauuaacaagcauuucugcucu

SEQ ID NO: 737756 - RNA, 64 nt, hsa
ggagaaugaaguguuucaaguaagcgagucugcaaguucucagaagcagacagauauccaaucu

SEQ ID NO: 737757 - RNA, 64 nt, hsa
ugauauauuuuccuuuaucacuuuaguauucugcaguucucagcuuggugaggcuccaaaagag

SEQ ID NO: 737758 - RNA, 64 nt, hsa
acuaacaugguaaaauguuagguggagcauauacaguucucauuauacucuuauuuuaaauuua

SEQ ID NO: 737759 - RNA, 64 nt, hsa
ucuauuuuaagucaggggcuuuacuagccgauuuaguucucacaauaaccauguggagaagcug

SEQ ID NO: 737760 - RNA, 64 nt, hsa
uuuaagaaaggaaucuagccaaugagguccaagaaguucucacccauugaauuuuuaaauggcu

SEQ ID NO: 737761 - RNA, 64 nt, hsa
uccuuaauucuccuuuauuccccugccacccaguaguucucauguaggaccucugaaggcagag

SEQ ID NO: 737762 - RNA, 64 nt, hsa
uugagggacccacaggagaggugggcagagcuggaguucucauccagggcugcuuguccccaga

SEQ ID NO: 737763 - RNA, 64 nt, hsa
ccuuucgucuaagucucaguauugaggccucuccaguucucaugcacccugaucuuaggguuag

SEQ ID NO: 737764 - RNA, 64 nt, hsa
uucauuuuaguuuggucacgcauuugccuguucaaguucucauuugaacuucaccauugugcua

SEQ ID NO: 737765 - RNA, 64 nt, hsa
ugaauaucccaucauccuauuucauguauaguugaguucucaaauuuguaaguuuuuauacauc

SEQ ID NO: 737766 - RNA, 64 nt, hsa
ccagguugugcuagaaaguagggcugcuucugugaguucucagccuaggcuguggccacuaaga

SEQ ID NO: 737767 - RNA, 64 nt, hsa
auucgagacaggcagaaucaguagcuggagagagaguucucacauuuaauauccugccuuuuac

SEQ ID NO: 737768 - RNA, 64 nt, hsa
aagacauagcuaggaaagcgaaugauaagggaaaaguucucagggaauugaaguguuguugcua

SEQ ID NO: 737769 - RNA, 64 nt, hsa
caguuaggaggugcagacacuugcucuccuauguaguucucagaugcguaaagcagaacagccu

SEQ ID NO: 737770 - RNA, 64 nt, hsa
guuuuuugcuaagagccagaggcaggucuucuggaguucucaggggggcccugugacccccucu

SEQ ID NO: 737771 - RNA, 64 nt, hsa
uacaaaugugaagaauguggcauaucuuuuaaccaguucucacaacuugcuauacauaagauga

SEQ ID NO: 737772 - RNA, 64 nt, hsa
aaaucaaugccaaauaaguacagucaucuucucuaguucucauaagacuaucuccccgccaccu

SEQ ID NO: 737773 - RNA, 64 nt, hsa
uuugguuguuugcuguuuuuuguuuuuuaaggugaguucucacuauguuucucagacuggucuc

SEQ ID NO: 737774 - RNA, 64 nt, hsa
uaguugggcuuucuuucuggguuugggccauuucaguucucauguguguacuauucuaucauua

SEQ ID NO: 737775 - RNA, 64 nt, hsa
agguuuacuauguuuaaaacuaaacugcugcaaaaguucucaauguucuuuuccaacacaucua

SEQ ID NO: 737776 - RNA, 64 nt, hsa
cucugacccacccagccccugugguagccccagcaguucucagggugcugaccucucucuccca

SEQ ID NO: 737777 - RNA, 64 nt, hsa
aaacuacauguaaagugaacuguuuccuguauaaaguucucaucuuaaugaaccuaugagagug

SEQ ID NO: 737778 - RNA, 54 nt, hsa; identical to SEQ ID NO: 737407

SEQ ID NO: 737779 - RNA, 64 nt, hsa
auugaacugaacaugcaacauuuaucauacauucaguucucauucacacuccuuaagauuuggu

SEQ ID NO: 737780 - RNA, 64 nt, hsa
gugacaaauaaucauuuucaucuuggcagcaaaaaguucucagugaccuauuuugugguguuuc

SEQ ID NO: 737781 - RNA, 64 nt, hsa; identical to SEQ ID NO: 338026

SEQ ID NO: 737782 - RNA, 64 nt, hsa; identical to SEQ ID NO: 338027

SEQ ID NO: 737783 - RNA, 64 nt, hsa
ggagaacuggacagaacugaaacacagcaacaccaguucucaaggacaaggugugugauggggg

SEQ ID NO: 737784 - RNA, 64 nt, hsa
uugaguccaccaaaggauaaugccaacuuauauaaguucucaaaucaugccuuccgcuuagucu

SEQ ID NO: 737785 - RNA, 64 nt, hsa
acagcaacuuuuaccaauaccuuuguauacucucaguucucauucaguauaaauaaaauuuuaa

SEQ ID NO: 737786 - RNA, 64 nt, hsa
ugaaguagaauauaauguauacuaagggauuucaaguucucagaauuuuugaguaguugcuuac

SEQ ID NO: 737787 - RNA, 64 nt, hsa
uacaauacauauaucuacacauacagaaagaagcaguucucacaauguugcuaguuuuuugcuu

SEQ ID NO: 737788 - RNA, 64 nt, hsa
aagauucacacagccacccuuggagcugguuucuaguucucacauuuagucaacaucuagaaag

SEQ ID NO: 737789 - RNA, 64 nt, hsa
cuuucuauagaaaaaaaaaauuguugaaagguccaguucucaguaccaugugaguuaaugauac

SEQ ID NO: 737790 - RNA, 64 nt, hsa
auaguuuuucaaauaggaaagcaauaauggcaguaguucucaaaugggcuaggccuuuuuuaua

SEQ ID NO: 737791 - RNA, 64 nt, hsa
ccauucuuuccauaacaaucuaaucaaaacugggaguucucaagugaaugcaaaaggagcaggc

SEQ ID NO: 737792 - RNA, 64 nt, hsa
guggaaacgugcaagagaaggcagagccuuugacaguucucaaaagugguuucauacuuuuuac

SEQ ID NO: 737793 - RNA, 64 nt, hsa
auuuaugaagauaguuuauuauagucuguacuucaguucucaucuuguaaauaaugcuuaacau

SEQ ID NO: 737794 - RNA, 64 nt, hsa
gaccagccaguagucacagaacugcuguuuacacaguucucaggaggcugugguuucuuagaau

SEQ ID NO: 737795 - RNA, 64 nt, hsa
ugguuacccccacacugcuguucucaugauacugaguucucacaaguccuguuuguuuuauaag

SEQ ID NO: 737796 - RNA, 64 nt, hsa
aggggcaguuucucaaaagcagaaacaugccgccaguucucaaguuuuccuccuaacuccauuu

SEQ ID NO: 737797 - RNA, 64 nt, hsa
uugccagccuuggcugucaaaaggaggcaggagcaguucucaacacaccaagccuuauucccac

SEQ ID NO: 737798 - RNA, 64 nt, hsa
cuggguacaaaccucacuguucagaugggcuguaaguucucacuucaaagcuauggaauggauu

SEQ ID NO: 737799 - RNA, 64 nt, hsa
gguguacccugagcaggggcagcuggccacucccaguucucaccaagucaccucccuccuugua

SEQ ID NO: 737800 - RNA, 64 nt, hsa
acauacuaaagaggcgaggcaaugacuguuggccaguucucaccggggaaaaacccacuguuag

SEQ ID NO: 737801 - RNA, 64 nt, hsa
cucucagcaauugcaguuaaguaaguuacacuacaguucucacaagagccugugaggggauguc

SEQ ID NO: 737802 - RNA, 64 nt, hsa
uuucuauuauuaaacuacaggcuguagauuucuuaguucucacagaacuucuaucauuuuaaac

SEQ ID NO: 737803 - RNA, 64 nt, hsa
caaguuuaggcagcaagggaaaggaauaugggucaguucucaaaugucaauguagauaagaguc

SEQ ID NO: 737804 - RNA, 64 nt, hsa
accagcucccugaggugucccacauacuauugugaguucucagagcaugaacuguccucagaag

SEQ ID NO: 737805 - RNA, 64 nt, hsa
ugcaaccucugcggcagccgacugcaugaaccaaaguucucaccuaaugguaucaucacgcagu

SEQ ID NO: 737806 - RNA, 64 nt, hsa
gguuugccuuagauaccuaaauacacauauauucaguucucagauguugaagcugucaccagca

SEQ ID NO: 737807 - RNA, 64 nt, hsa
uaaguuguuggccuuguguguguguuuuuuuuuaaguucucaucauuauuacauagacugugau

SEQ ID NO: 737808 - RNA, 64 nt, hsa
auaaugauaaugagaacaccuuugcccugaagucaguucucacaguauagaagagaacuuaaag

SEQ ID NO: 737809 - RNA, 64 nt, hsa
uaaaaaugaaaaaaaaaucaaagauuuuuuuaacaguucucagacuuaacuguugccuugaauu

SEQ ID NO: 737810 - RNA, 64 nt, hsa
uccaagucuuuaauuugccaagaugaagaaaaugaguucucaaggagggaaugcuuugcuugag

SEQ ID NO: 737811 - RNA, 64 nt, hsa
guagguuuauuuuggaagggacuguggccaggguaguucucagguugugcuagagcagcacuuu

SEQ ID NO: 737812 - RNA, 64 nt, hsa
uggcagugcaaugcuuguagaaguaggaggaaacaguucucacugggaagaagcaagggcaaga

SEQ ID NO: 737813 - RNA, 64 nt, hsa
uuuuucauuggcuuagggcagauuuucaugcaaaaguucucauaugaguuagaggagaaaaagc

SEQ ID NO: 737814 - RNA, 64 nt, hsa
guuacguaguggaaacauuuugcauuguuuacauaguucucauggaacauggaaauuuuugaaa

SEQ ID NO: 737815 - RNA, 64 nt, hsa
auuucgugcgacugcuuuuucuucaaaggaguucaguucucaccauggagugaguggccuuuag

SEQ ID NO: 737816 - RNA, 64 nt, hsa
cgugaugguacaauguaaauggggacuucuguaaaguucucaguuucgguccaugugguuuauc

SEQ ID NO: 737817 - RNA, 64 nt, hsa
gaauggccuggugccauccuuuugguaaugagugaguucucacuguauuagauccuguugaaaa

SEQ ID NO: 737818 - RNA, 64 nt, hsa; identical to SEQ ID NO: 338028

SEQ ID NO: 737819 - RNA, 64 nt, hsa; identical to SEQ ID NO: 338029

SEQ ID NO: 737820 - RNA, 64 nt, hsa
gcugaguacuaauugauuccuccauccuugaaucaguucucauaaugcuuuuuaaauaagaaaa

SEQ ID NO: 737821 - RNA, 64 nt, hsa
uacuggggugagggaggcauuguucuuuaguuggaguucucauucuuauucuccaguacugacu

SEQ ID NO: 737822 - RNA, 64 nt, hsa
ccauccacacaccugccaacccugggaagcauccaguucucaaaucguuuuugcuauggauuua

SEQ ID NO: 737823 - RNA, 64 nt, hsa
agucauauuuuuguaguucuaguuuucauucuguaguucucaccccuuuguucauauuuuuaaa

SEQ ID NO: 737824 - RNA, 64 nt, hsa
cuugggggcgguucccccaugcuguucuugugauaguucucacgagaucugaugauuuuauaag

SEQ ID NO: 737825 - RNA, 64 nt, hsa
agccucaguucuguacuuguaaaguggagacagcaguucucauccuccauccuuuuagcccaug

SEQ ID NO: 737826 - RNA, 64 nt, hsa
guaugacuuugugccauccccauaguaaugagugaguucucacucugguuguuuaugcaagagc

SEQ ID NO: 737827 - RNA, 64 nt, hsa
ccuaaccauugagccaaugcauuggugucuccucaguucucagggaguguggguggcggcuccg

SEQ ID NO: 737828 - RNA, 64 nt, hsa
ucuucugaggcagaggcuggagcaguucuuuuucaguucucauccucuccaucccaauccagua

SEQ ID NO: 737829 - RNA, 64 nt, hsa
caaguauugucaagggaagcuuccugugaaccaaaguucucaggccaaggucucgcccaccaaa

SEQ ID NO: 737830 - RNA, 64 nt, hsa
ugggcggaggaaggaucguuauacgucuucagaaaguucucauugccccagcugccuaguacua

SEQ ID NO: 737831 - RNA, 64 nt, hsa
aaacacgugguuuuuaaagccauuagguaaaaaaaguucucaauaaaggcauuacaauuuuuua

SEQ ID NO: 737832 - RNA, 64 nt, hsa
acccuuuccuaaugagccuccucaauaagagagaaguucucauugugggaaucugacauaguuc

SEQ ID NO: 737833 - RNA, 64 nt, hsa
agggagacucgcagaugcacacccacaaguauucaguucucaaacucuagacgaguguuggcaa

SEQ ID NO: 737834 - RNA, 64 nt, hsa
aguaauacagccugguuuuuaaguacucacuaaaaguucucaaauauuggguugggcacggcuu

SEQ ID NO: 737835 - RNA, 64 nt, hsa
aauggcaggaugugaacuuccccaucgcaaaugcaguucucagcccacugcaguggauacaagg

SEQ ID NO: 737836 - RNA, 64 nt, hsa
ggcaggaucucagccauaaagugccaguuugcuuaguucucacugucuccuggucugugcugcc

SEQ ID NO: 737837 - RNA, 64 nt, hsa
acacucugauuuuuaaaauuaugcaguauuuuccaguucucagagaggucaugguugugcccag

SEQ ID NO: 737838 - RNA, 64 nt, hsa
cuuucucuuggccccuuguacaccccaggagagaaguucucaaucccagcaguucuuuguaguc

SEQ ID NO: 737839 - RNA, 64 nt, hsa
uuugccuuaguuuuggaaguaaauucuaguuuguaguucucauuuguaaugaacacauuaacga

SEQ ID NO: 737840 - RNA, 64 nt, hsa
auauuuugaaauagcuagaagagaggauuuugaaaguucucaacacaaagaaaugacacauauu

SEQ ID NO: 737841 - RNA, 64 nt, hsa
uaguauauuagcagcaugcaauaauuacaucauaaguucucaagcagaggcagucuauugcaag

SEQ ID NO: 737842 - RNA, 64 nt, hsa; identical to SEQ ID NO: 338030

SEQ ID NO: 737843 - RNA, 64 nt, hsa; identical to SEQ ID NO: 338031

SEQ ID NO: 737844 - RNA, 64 nt, hsa; identical to SEQ ID NO: 338032

SEQ ID NO: 737845 - RNA, 64 nt, hsa; identical to SEQ ID NO: 338033

SEQ ID NO: 737846 - RNA, 64 nt, hsa
ccucgugcugauagauggccacacucuuuagaguaguucucauaaguucuagaacugguagcuc

SEQ ID NO: 737847 - RNA, 64 nt, hsa
cuucccuccccucccccucugccuuuuguacgccaguucucagaaauaaagaucuuuuguccgu

SEQ ID NO: 737848 - RNA, 64 nt, hsa
guuuaaucuucuuaaaauguaucuuguccuacauaguucucagaauacauaugggguauaguua

SEQ ID NO: 737849 - RNA, 64 nt, hsa
ccugaagaauauuugaugugaugauucacuuuucaguucucaaauuaaaagaaaacuguuagau

SEQ ID NO: 737850 - RNA, 64 nt, hsa
uuacaauuauguccauauaaaauucuagcccagaaguucucaucugggguagauuuuggccuuc

SEQ ID NO: 737851 - RNA, 64 nt, hsa
cucuggguucuacuuuauuuuuuaaaaucuuuacaguucucaccauuucacguaccuuaaucca

SEQ ID NO: 737852 - RNA, 64 nt, hsa
gugugauggaugugcauucucacuugggucuugaaguucucauuccuacaucucaagcuagcca

SEQ ID NO: 737853 - RNA, 64 nt, hsa
aaagagaaaccaaaugagcugauuacugacuauaaguucucagccuuuauggaccuaaucuuau

SEQ ID NO: 737854 - RNA, 64 nt, hsa
cccuaguaauaggucauauuccccuaguaauaugaguucucaaagccuacauucaggaucuccc

SEQ ID NO: 737855 - RNA, 52 nt, hsa; identical to SEQ ID NO: 737484

SEQ ID NO: 737856 - RNA, 64 nt, hsa
caguguaggaaauaaaagugaugauauuuaaaauaguucucaguugaagcagagaaaugccacu

SEQ ID NO: 737857 - RNA, 64 nt, hsa
cuacugcacugcccaagguguguguagcacaaacaguucucauuacaaaggaccaauucagaac

SEQ ID NO: 737858 - RNA, 64 nt, hsa
auuucucccuauaaagaguuauaaaugaugguuuaguucucaggcagcuacaaaugccuauuua

SEQ ID NO: 737859 - RNA, 64 nt, hsa
auuguugaggagaggcugcucaaucgacaccccgaguucucaugacugggaagauaguuuucuu

SEQ ID NO: 737860 - RNA, 64 nt, hsa
ugaaaucugcuugugugcuuauaagaauuuacugaguucucacuucccuuacagucauacaugg

SEQ ID NO: 737861 - RNA, 64 nt, hsa
aaaccagaguggugccucuguccgagaacuuguaaguucucaacuugggaaagacagaggugcu

SEQ ID NO: 737862 - RNA, 64 nt, hsa
ccaaacccuugucagugacaguauuuugguucuuaguucucacuguucccucugcuccuggagc

SEQ ID NO: 737863 - RNA, 64 nt, hsa; identical to SEQ ID NO: 338034

SEQ ID NO: 737864 - RNA, 64 nt, hsa; identical to SEQ ID NO: 338035

SEQ ID NO: 737865 - RNA, 64 nt, hsa
agaagauuuaggaugccuccuucuaagaacuggaaguucucauuccccauuaugaacugagcua

SEQ ID NO: 737866 - RNA, 64 nt, hsa
agaggauuuaggaugccuccuucuaagaaccagaaguucucauuccccauuaugaacugagcua

SEQ ID NO: 737867 - RNA, 64 nt, hsa
gcuaaccauccugcccauuauagcuacacucaggaguucucaucugacaagucaguuguccuga

SEQ ID NO: 737868 - RNA, 64 nt, hsa
cuggccacuauuaaguggguuugccccaucacuuaguucucaggcagagacaucuuugggccug

SEQ ID NO: 737869 - RNA, 64 nt, hsa
acaugugaauagauauuaagugccauauauaauuaguucucagaagaagggagaaaugaucaua

SEQ ID NO: 737870 - RNA, 64 nt, hsa
auugguuuguugacaauaacaguacaucuuuucaaguucucagcuauuucuucuaccucucccu

SEQ ID NO: 737871 - RNA, 64 nt, hsa; identical to SEQ ID NO: 338036

SEQ ID NO: 737872 - RNA, 64 nt, hsa; identical to SEQ ID NO: 338037

SEQ ID NO: 737873 - RNA, 64 nt, hsa
uugcuuuugcuucucuccucugaagugugaguugaguucucauuuagguuuguaacauggcuau

SEQ ID NO: 737874 - RNA, 64 nt, hsa
acuucguccacgaauccacaccaccuuucccaucaguucucaccggaaauaugcugccaaaaag

SEQ ID NO: 737875 - RNA, 64 nt, hsa
caaacugauucuaugcaggugaaggaugcacuaaaguucucacuuuagugagaacuuuucuagc

SEQ ID NO: 737876 - RNA, 64 nt, hsa
uugacaggcaucaccaagucuucaaggaggacugaguucucaggggagaacugggaauggggcc

SEQ ID NO: 737877 - RNA, 64 nt, hsa
gucacagacaaacugggauccagcacaguccagcaguucucaaaaugagguccucaggccacag

SEQ ID NO: 737878 - RNA, 64 nt, hsa
ucugccauagaauacucagucuuguggucaagagaguucucaagugacaaccauugggguuucu

SEQ ID NO: 737879 - RNA, 64 nt, hsa
uggugguuacccucaugcuguucuugugauggugaguucucaugagaucugauggguguuuuuu

SEQ ID NO: 737880 - RNA, 64 nt, hsa
uuuucaaucucagugaaauggcucuuugcuuucgaguucucacgcaacguacugggcaaaugac

SEQ ID NO: 737881 - RNA, 64 nt, hsa
uggcccauucuucaucauuuguaaguucaacaaaaguucucacauggagucccaccucuucaga

SEQ ID NO: 737882 - RNA, 64 nt, hsa
aaauuguauagcaugugacucuuuuggcuuucagaguucucaaaaauauuauuuuguugcaugu

SEQ ID NO: 737883 - RNA, 64 nt, hsa
gguuuccccuacgauguucuccugauagugggugaguucucacaagaucugaugguuuuauaaa

SEQ ID NO: 737884 - RNA, 64 nt, hsa
aucuuuauuuuuaugcauuuagaauauuuuaaauaguucucagauauuaagaaguuguaugagu

SEQ ID NO: 737885 - RNA, 64 nt, hsa
uuauuugacuuuuuuauuuuauguuaauguuuucaguucucacuuugaggcacauuuacaucaa

SEQ ID NO: 737886 - RNA, 64 nt, hsa
gggaacaguggggcugggaccgggugggagaaagaguucucagugguuccuuucuauacaguuu

SEQ ID NO: 737887 - RNA, 64 nt, hsa
ucuucccacaaguccauucugccuucaaaguguaaguucucaugucauuauggauuuggaguuu

SEQ ID NO: 737888 - RNA, 64 nt, hsa
ggcucaguucauuuaaaaaagauaucuauuugaaaguucucagaguuguacauauguuucacag

SEQ ID NO: 737889 - RNA, 64 nt, hsa
augccccaacaaacucauggcguugaaaccacacaguucucauuacuguuauuuauuagcugua

SEQ ID NO: 737890 - RNA, 64 nt, hsa
uuuuuuagacaugaaagaauugccuuaguugaacaguucucagauuguaguuugcaauccccug

SEQ ID NO: 737891 - RNA, 64 nt, hsa
cccugcaccagaggucucauauguuaccccagggaguucucagaggauuggguuggccucuaac

SEQ ID NO: 737892 - RNA, 64 nt, hsa
aagggauuccuauugacacugcucgggugcacccaguucucacaugugcagucaugccguucuc

SEQ ID NO: 737893 - RNA, 64 nt, hsa
caggcgggcgccaggcccgcugugggugggcaccaguucucagcaccgcucacugcugccgggc

SEQ ID NO: 737894 - RNA, 64 nt, hsa
cgcuaauaugauuacagcgaagacuuuccugauaaguucucaaacucgaugugugacuguuugg

SEQ ID NO: 737895 - RNA, 64 nt, hsa
gccucugcccaucccccucaagggcugcaggcccaguucucaugcugcccuugggugggcaucu

SEQ ID NO: 737896 - RNA, 64 nt, hsa
uuucugcugcuugguguucuucuggaggagcgugaguucucagcggagcgcuucucggcacuuc

SEQ ID NO: 737897 - RNA, 64 nt, hsa
agauucucuagcuguuagguagaccuaaauaaaaaguucucaauagauuccucuuuugaguaaa

SEQ ID NO: 737898 - RNA, 64 nt, hsa
ucuucccuuccaguucgaauuuggaaacucccaaaguucucaaugguuuguugugaguuccaug

SEQ ID NO: 737899 - RNA, 64 nt, hsa
gguaaugguaaaugcuuuuaaucaagcaggaaaaaguucucaugauuaugccaacuauaauagu

SEQ ID NO: 737900 - RNA, 64 nt, hsa
ccauguuucugguggacuaaauuguguaucugggaguucucacuuucuagccaggccugaugag

SEQ ID NO: 737901 - RNA, 64 nt, hsa
uuaaucuggggagcaaauuccagcucugaaauggaguucucacaccguaucuagggacagaggc

SEQ ID NO: 737902 - RNA, 64 nt, hsa
uccccaaaucuuuuaaaugaagccagugacucccaguucucaacacauggccccagucaagaca

SEQ ID NO: 737903 - RNA, 64 nt, hsa
gcacugugcugaccaucgcccaccgccucaacacaguucucaacugcgaucacguccugguuau

SEQ ID NO: 737904 - RNA, 64 nt, hsa
gucucacaucauagaggaccccuccuccucucccaguucucaacuucuccaugccuggaaucca

SEQ ID NO: 737905 - RNA, 64 nt, hsa
cgccucagcugugggggccucaggcaggucccucaguucucacgccuuccuguccaguggaaug

SEQ ID NO: 737906 - RNA, 64 nt, hsa
uucugauaucugaggccaguaacuauuaauaucuaguucucagagcauuuggaaagguuaucuu

SEQ ID NO: 737907 - RNA, 64 nt, hsa
uccgagccacaggcaauaaaaggauaucagcuguaguucucagcuacaucaugguguauagaug

SEQ ID NO: 737908 - RNA, 52 nt, hsa; identical to SEQ ID NO: 737537

SEQ ID NO: 737909 - RNA, 64 nt, hsa
gggacacugaaccuuguugaugccagcuguacugaguucucauccacagaggccaggcauggcc

SEQ ID NO: 737910 - RNA, 64 nt, hsa
cccagaagaauaguuucucuggcucacaggcccaaguucucaaugaaaucguuuuuuaacuuuc

SEQ ID NO: 737911 - RNA, 64 nt, hsa
uuaaacuugguaaaagauaaucuaaaaauuccauaguucucaguuauuaaaauuuuucuuguuc

SEQ ID NO: 737912 - RNA, 64 nt, hsa
cccguacacacacacucgggcacuucaggaggucaguucucaccccuuccucgauggggcuuua

SEQ ID NO: 737913 - RNA, 64 nt, hsa
gcccuucccagucucauuagaggaagcuuuccaaaguucucaguuaucaagaccucauccagcu

SEQ ID NO: 737914 - RNA, 64 nt, hsa; identical to SEQ ID NO: 737906

SEQ ID NO: 737915 - RNA, 64 nt, hsa
uacuggcaaacaugaaaaaucggcuuaccauuaaaguucucaaugcaaccauaaagcugacucu

SEQ ID NO: 737916 - RNA, 64 nt, hsa
cucagggccuugccucugcggccuccacuuggaaaguucucaguucccuccaggcuucuagaag

SEQ ID NO: 737917 - RNA, 64 nt, hsa
uguucaucccuugaccaccucuggaccacuaacaaguucucagacuuugcauugcuugugaugg

SEQ ID NO: 737918 - RNA, 64 nt, hsa
agcgugcacagagggagucggugagcauuuccuuaguucucagacucuccuccgccucuaccaa

SEQ ID NO: 737919 - RNA, 64 nt, hsa; identical to SEQ ID NO: 737906

SEQ ID NO: 737920 - RNA, 64 nt, hsa
ccccuucuccaccagauauuugcuuccuaagaauaguucucauuggaggcugaggucgaagcag

SEQ ID NO: 737921 - RNA, 64 nt, hsa
aaaacuuacagcuuaacccauuuucaagcaaaacaguucucagaaaugucaugauugccggggu

SEQ ID NO: 737922 - RNA, 64 nt, hsa
uaguccuucucagauuagcuggaaauggggacagaguucucauuuaucccagauauauacauug

SEQ ID NO: 737923 - RNA, 64 nt, hsa
auuuuagucaucccagcuuuuuagucuuaaccacaguucucacucucuuaaaugguaccucaaa

SEQ ID NO: 737924 - RNA, 64 nt, hsa
gguggcugaaacugagcuuuuuugugugggcuccaguucucacuguucugcaaugcucauggca

SEQ ID NO: 737925 - RNA, 64 nt, hsa
gaugcggaggcgaggugagugauuccaucauuucaguucucaccugcaguuuuggugaagcagg

SEQ ID NO: 737926 - RNA, 64 nt, hsa
gcguagugugggagaggagagagcugaugacugcaguucucaaagguccucagugaaguuauuu

SEQ ID NO: 737927 - RNA, 64 nt, hsa; identical to SEQ ID NO: 338038

SEQ ID NO: 737928 - RNA, 64 nt, hsa; identical to SEQ ID NO: 338039

SEQ ID NO: 737929 - RNA, 64 nt, hsa
aauaauccaguauugcugauuuuaaaggcagagaaguucucaaaguuaauucaccuauguuauu

SEQ ID NO: 737930 - RNA, 64 nt, hsa
aacaucuaaaaaucaaauaagcuaauauacagucaguucucauuauucacaguaauuauguucu

SEQ ID NO: 737931 - RNA, 64 nt, hsa
uggaauauacuuuucuuaaaaaaaaggaacaguuaguucucaucuagaaugaaaguuccauaua

SEQ ID NO: 737932 - RNA, 64 nt, hsa
gugaccuggagugacagcugagucacccuggguaaguucucagaguggucaggauggcuugacc

SEQ ID NO: 737933 - RNA, 64 nt, hsa
auuucgcuuuucaguaaaaacagucaaguuacugaguucucacauaaagagcucuucucacaca

SEQ ID NO: 737934 - RNA, 64 nt, hsa
uuguaauauuguuuuguggauaauugaaauaaaaaguucucauugaaugcaccuauuaaucguu

SEQ ID NO: 737935 - RNA, 64 nt, hsa
ggaugcagagacaauguugaaauccccuaaacacaguucucaguggcaaaaccuaggaaggcuc

SEQ ID NO: 737936 - RNA, 64 nt, hsa
acaccuugggggcuggcuuaggggaggcuguuggaguucucacugacuuaguggcauauuuauu

SEQ ID NO: 737937 - RNA, 64 nt, hsa
gcauuuccucuccaacuuucuuccuuggaggccaaguucucacccuguccaacuauucgcagga

SEQ ID NO: 737938 - RNA, 64 nt, hsa; identical to SEQ ID NO: 338040

SEQ ID NO: 737939 - RNA, 64 nt, hsa; identical to SEQ ID NO: 338041

SEQ ID NO: 737940 - RNA, 64 nt, hsa
gccggaguccacucccagugcuugcaagauuccaaguucucaccucuuaaagaaaacccacccc

SEQ ID NO: 737941 - RNA, 64 nt, hsa
cgugguguggaggcuguugauguuucuggugucaaguucucagaaguugcugccaccaacucuu

SEQ ID NO: 737942 - RNA, 64 nt, hsa
gcccggggacccccgcgggccccagaagcagcccaguucucagagagcccuuggaaggggucuc

SEQ ID NO: 737943 - RNA, 64 nt, hsa; identical to SEQ ID NO: 338042

SEQ ID NO: 737944 - RNA, 64 nt, hsa; identical to SEQ ID NO: 338043

SEQ ID NO: 737945 - RNA, 64 nt, hsa
uacagaugugaagaauguggcaaaggcuuuaauuaguucucaucccuuacuaaacauaagagaa

SEQ ID NO: 737946 - RNA, 64 nt, hsa; identical to SEQ ID NO: 338044

SEQ ID NO: 737947 - RNA, 64 nt, hsa; identical to SEQ ID NO: 338045

SEQ ID NO: 737948 - RNA, 64 nt, hsa
cugacaaggaccaaugcuucuuuaucuggugcucaguucucagucagacgugcagcauggcugc

SEQ ID NO: 737949 - RNA, 64 nt, hsa
aacuuaauaaauguaugagucuuaaauaccucuuaguucucauuaaauuuaggaaaauucacac

SEQ ID NO: 737950 - RNA, 64 nt, hsa
agcucccucuggggacggcuggcucacugucuccaguucucaauggccaacgaaggugcuugga

SEQ ID NO: 737951 - RNA, 64 nt, hsa
agggauacagaguuguccauuaccaaagccuggaaguucucaucaccuccagguggacugcuug

SEQ ID NO: 737952 - RNA, 64 nt, hsa
ccacaaagugcuuccuuuuaaaugaaaaggugaaaguucucaacuuaaaaaagaaaagaaaaaa

SEQ ID NO: 737953 - RNA, 64 nt, hsa
ucccccucucauaacuucuccccaucccaggaggaguucucaggccugggguggggccccgggu

SEQ ID NO: 737954 - RNA, 64 nt, hsa
cugucaacguuguccucaugacaaccagacuuccaguucucaggaacuucucauugugggccag

SEQ ID NO: 737955 - RNA, 64 nt, hsa
uacaaaugugaaaaacguggcaaagcuuuucauuaguucucaacccuuacugaacauaagggaa

SEQ ID NO: 737956 - RNA, 64 nt, hsa
ggcagauuucucccuugcuguucucaugauagugaguucucaugagagcugaugguuuuaaggu

SEQ ID NO: 737957 - RNA, 64 nt, hsa
cauguguucacaaggguuacuccucaaaacccccaguucucacucauguccccaacucaaggcu

SEQ ID NO: 737958 - RNA, 64 nt, hsa
ucccuccccccccacccccccccacugcuccuggaguucucaucggauuccccaagggcacugc

SEQ ID NO: 737959 - RNA, 64 nt, hsa
acagugaauguaaggaucccuucagucaccacucaguucucacucauugcagaaggauucauac

SEQ ID NO: 737960 - RNA, 64 nt, hsa
uaguagagaugggguuucacccuguuagccaggaaguucucaaucuccugaccucgugaucugc

SEQ ID NO: 737961 - RNA, 64 nt, hsa
cuauuucuuuuguuccaaguuuguauuuccucagaguucucacauauggaaaggauacacacuu

SEQ ID NO: 737962 - RNA, 64 nt, hsa
gguagcucggcaccaacuaagaaaaaaagcacaaaguucucagagcucucgaggaaagugguug

SEQ ID NO: 737963 - RNA, 64 nt, hsa
aaauuuuagugaaacuugacucaacuauacacaaaguucucauccuaaaugaacuauuucaguc

SEQ ID NO: 737964 - RNA, 64 nt, hsa; identical to SEQ ID NO: 338046

SEQ ID NO: 737965 - RNA, 64 nt, hsa; identical to SEQ ID NO: 338047

SEQ ID NO: 737966 - RNA, 64 nt, hsa
aagagcuucuggcaccagaacccugucuuccuccaguucucaacacgguguugcucuucaguca

SEQ ID NO: 737967 - RNA, 64 nt, hsa
ugcugguuucccuuacacauagcagagcucacucaguucucacaguagccaaaugaagcaguua

SEQ ID NO: 737968 - RNA, 64 nt, hsa
ccgcuuauucuccucccuguuaucugcuagaucuaguucucaaucacugcucccccguguguau

SEQ ID NO: 737969 - RNA, 64 nt, hsa; identical to SEQ ID NO: 338048

SEQ ID NO: 737970 - RNA, 64 nt, hsa; identical to SEQ ID NO: 338049

SEQ ID NO: 737971 - RNA, 64 nt, hsa
acugaaaggcuuuucaaccacaaaacucaucuggaguucucaaagaccuggggcugcugugaag

SEQ ID NO: 737972 - RNA, 64 nt, hsa
uacccauuuguuuuuuacaugggguuguagaucgaguucucaaaggugaaaccagaugaucauu

SEQ ID NO: 737973 - RNA, 64 nt, hsa
ggcuaccuccgugcuguucucgugauagcgagugaguucucacgagaucugaugguuuuauaag

SEQ ID NO: 737974 - RNA, 64 nt, hsa
uuuucauuuuauuucucauaauuugaacagagacaguucucauacaugaucagaugcuuuuuuu

SEQ ID NO: 737975 - RNA, 64 nt, hsa
cgugacaauuuucuuggaacuccuuuuuauuguuaguucucacuuguuuccauauuuagugaau

SEQ ID NO: 737976 - RNA, 64 nt, hsa
uaauuuuuuuaacagggucuuccucucucgcccaaguucucaugccucagccucccaaauagcu

SEQ ID NO: 737977 - RNA, 64 nt, hsa
cugggcugaaguuaauuguucaucuugccccuuuaguucucaugcacagaauuccuccauagca

SEQ ID NO: 737978 - RNA, 64 nt, hsa
aggggcagcagauaggagagcacugagcccggauaguucucagccuggcaaguggcucugaagc

SEQ ID NO: 737979 - RNA, 64 nt, hsa
uguucucacaccugugcgcagguuugcacacucaaguucucaugggcaggcucaggucuguccc

SEQ ID NO: 737980 - RNA, 64 nt, hsa
cauuggggagugggggguucgagggacuuaguggaguucucaucccuucaaugcccccucccuu

SEQ ID NO: 737981 - RNA, 64 nt, hsa
cgcccgcgugccugcccaugccagcacuuccuuaaguucucacaucacacucaaaccagugaca

SEQ ID NO: 737982 - RNA, 64 nt, hsa
auugaugagaaauggaagaugagaacucccuaagaguucucauaauaaaucaucucaucacaaa

SEQ ID NO: 737983 - RNA, 64 nt, hsa
ggcgagaacacgaucuucuuccacaucuccagcaaguucucaagcucagagacggugagucucc

SEQ ID NO: 737984 - RNA, 64 nt, hsa
cugcucuuggcuuggucucuacccucacuaccucaguucucaauaacuuagugaaucacugccc

SEQ ID NO: 737985 - RNA, 64 nt, hsa
cguggaagaauuucgugccauguggaaacuuuuuaguucucacuacaauguucacauugaugau

SEQ ID NO: 737986 - RNA, 64 nt, hsa
uugagaaauacuucuucaaguuaugaugcuugaaaguucucaauaaaguucacgguuucauuac

SEQ ID NO: 737987 - RNA, 64 nt, hsa
agaggggccuugcaaggaggggccuuugagccucaguucucauguauugggggguggggguggg

SEQ ID NO: 737988 - RNA, 64 nt, hsa
guacauuuguuuugugugucacauggggucaguaaguucucaauaaaaauuguuaagaaaugcc

SEQ ID NO: 737989 - RNA, 64 nt, hsa
agaucacaagucagcacuaccuccucccuucuugaguucucaacugagugagcaucauggaggg

SEQ ID NO: 737990 - RNA, 64 nt, hsa
uauagccauauccaaaucuuuucccccucccaagaguucucagugucuacauguagacuauucc

SEQ ID NO: 737991 - RNA, 64 nt, hsa
cgacuggacuguuuuuguuuuuuugguuacaauuaguucucaucucccugucgucgucauuguu

SEQ ID NO: 737992 - RNA, 64 nt, hsa
aauuaccuaagcugccaugcauuuuuuuuuuuacaguucucaaggaagagcacagaacaauuuc

SEQ ID NO: 737993 - RNA, 64 nt, hsa
cauucuucacucuguguuugaagagagcagucacaguucucaguaguggggagcauguugggug

SEQ ID NO: 737994 - RNA, 64 nt, hsa
ucagggcaccccagccccacacucacauguacgaaguucucaccccagcuccuuuguguggcac

SEQ ID NO: 737995 - RNA, 64 nt, hsa
ugccuaaauauauauguacagugccuggcauauaaguucucaauaaaugguagauauuaauuuu

SEQ ID NO: 737996 - RNA, 64 nt, hsa
aaguacuggagcacguggucagggucaaugcaagaguucucauuuccuacccaucccugcauga

SEQ ID NO: 737997 - RNA, 64 nt, hsa; identical to SEQ ID NO: 338050

SEQ ID NO: 737998 - RNA, 64 nt, hsa; identical to SEQ ID NO: 338051

SEQ ID NO: 737999 - RNA, 64 nt, hsa
gcuuucaucagccccagcccccacacuccaccaaaguucucaugcacuaugcacucagaaaaau

SEQ ID NO: 738000 - RNA, 64 nt, hsa; identical to SEQ ID NO: 314992

SEQ ID NO: 738001 - RNA, 64 nt, hsa; identical to SEQ ID NO: 314993

SEQ ID NO: 738002 - RNA, 64 nt, hsa; identical to SEQ ID NO: 314994

SEQ ID NO: 738003 - RNA, 64 nt, hsa; identical to SEQ ID NO: 314995

SEQ ID NO: 738004 - RNA, 64 nt, hsa; identical to SEQ ID NO: 314996

SEQ ID NO: 738005 - RNA, 64 nt, hsa; identical to SEQ ID NO: 314997

SEQ ID NO: 738006 - RNA, 64 nt, hsa; identical to SEQ ID NO: 314998

SEQ ID NO: 738007 - RNA, 64 nt, hsa; identical to SEQ ID NO: 314999

SEQ ID NO: 738008 - RNA, 64 nt, hsa; identical to SEQ ID NO: 315000

SEQ ID NO: 738009 - RNA, 64 nt, hsa; identical to SEQ ID NO: 315001

SEQ ID NO: 738010 - RNA, 64 nt, hsa; identical to SEQ ID NO: 315002

SEQ ID NO: 738011 - RNA, 64 nt, hsa; identical to SEQ ID NO: 315003

SEQ ID NO: 738012 - RNA, 64 nt, hsa; identical to SEQ ID NO: 315004

SEQ ID NO: 738013 - RNA, 64 nt, hsa; identical to SEQ ID NO: 315005

SEQ ID NO: 738014 - RNA, 64 nt, hsa; identical to SEQ ID NO: 315006

SEQ ID NO: 738015 - RNA, 64 nt, hsa; identical to SEQ ID NO: 315007

SEQ ID NO: 738016 - RNA, 64 nt, hsa; identical to SEQ ID NO: 315008

SEQ ID NO: 738017 - RNA, 64 nt, hsa; identical to SEQ ID NO: 315009

SEQ ID NO: 738018 - RNA, 64 nt, hsa; identical to SEQ ID NO: 315010

SEQ ID NO: 738019 - RNA, 64 nt, hsa; identical to SEQ ID NO: 315011

SEQ ID NO: 738020 - RNA, 64 nt, hsa; identical to SEQ ID NO: 315012

SEQ ID NO: 738021 - RNA, 64 nt, hsa; identical to SEQ ID NO: 315013

SEQ ID NO: 738022 - RNA, 64 nt, hsa; identical to SEQ ID NO: 315014

SEQ ID NO: 738023 - RNA, 64 nt, hsa; identical to SEQ ID NO: 315015

SEQ ID NO: 738024 - RNA, 64 nt, hsa; identical to SEQ ID NO: 315016

SEQ ID NO: 738025 - RNA, 64 nt, hsa; identical to SEQ ID NO: 315017

SEQ ID NO: 738026 - RNA, 64 nt, hsa; identical to SEQ ID NO: 315018

SEQ ID NO: 738027 - RNA, 64 nt, hsa; identical to SEQ ID NO: 315019

SEQ ID NO: 738028 - RNA, 64 nt, hsa; identical to SEQ ID NO: 522269

SEQ ID NO: 738029 - RNA, 64 nt, hsa; identical to SEQ ID NO: 522270

SEQ ID NO: 738030 - RNA, 64 nt, hsa; identical to SEQ ID NO: 522271

SEQ ID NO: 738031 - RNA, 64 nt, hsa; identical to SEQ ID NO: 522272

SEQ ID NO: 738032 - RNA, 64 nt, hsa; identical to SEQ ID NO: 522273

SEQ ID NO: 738033 - RNA, 64 nt, hsa; identical to SEQ ID NO: 522274

SEQ ID NO: 738034 - RNA, 64 nt, hsa; identical to SEQ ID NO: 522275

SEQ ID NO: 738035 - RNA, 64 nt, hsa; identical to SEQ ID NO: 522276

SEQ ID NO: 738036 - RNA, 64 nt, hsa; identical to SEQ ID NO: 522277

SEQ ID NO: 738037 - RNA, 64 nt, hsa; identical to SEQ ID NO: 522278

SEQ ID NO: 738038 - RNA, 64 nt, hsa; identical to SEQ ID NO: 522279

SEQ ID NO: 738039 - RNA, 64 nt, hsa; identical to SEQ ID NO: 522280

SEQ ID NO: 738040 - RNA, 64 nt, hsa; identical to SEQ ID NO: 522281

SEQ ID NO: 738041 - RNA, 64 nt, hsa; identical to SEQ ID NO: 522282

SEQ ID NO: 738042 - RNA, 64 nt, hsa; identical to SEQ ID NO: 522283

SEQ ID NO: 738043 - RNA, 64 nt, hsa; identical to SEQ ID NO: 522284

SEQ ID NO: 738044 - RNA, 64 nt, hsa; identical to SEQ ID NO: 522285

SEQ ID NO: 738045 - RNA, 64 nt, hsa; identical to SEQ ID NO: 522286

SEQ ID NO: 738046 - RNA, 64 nt, hsa; identical to SEQ ID NO: 522287

SEQ ID NO: 738047 - RNA, 64 nt, hsa; identical to SEQ ID NO: 522288

SEQ ID NO: 738048 - RNA, 64 nt, hsa; identical to SEQ ID NO: 522289

SEQ ID NO: 738049 - RNA, 64 nt, hsa; identical to SEQ ID NO: 522290

SEQ ID NO: 738050 - RNA, 64 nt, hsa; identical to SEQ ID NO: 522291

SEQ ID NO: 738051 - RNA, 64 nt, hsa; identical to SEQ ID NO: 522292

SEQ ID NO: 738052 - RNA, 64 nt, hsa; identical to SEQ ID NO: 522293

SEQ ID NO: 738053 - RNA, 64 nt, hsa; identical to SEQ ID NO: 522294

SEQ ID NO: 738054 - RNA, 64 nt, hsa; identical to SEQ ID NO: 522295

SEQ ID NO: 738055 - RNA, 64 nt, hsa; identical to SEQ ID NO: 522296

SEQ ID NO: 738056 - RNA, 64 nt, hsa; identical to SEQ ID NO: 522297

SEQ ID NO: 738057 - RNA, 64 nt, hsa; identical to SEQ ID NO: 522298

SEQ ID NO: 738058 - RNA, 64 nt, hsa; identical to SEQ ID NO: 522299

SEQ ID NO: 738059 - RNA, 64 nt, hsa; identical to SEQ ID NO: 522300

SEQ ID NO: 738060 - RNA, 64 nt, hsa; identical to SEQ ID NO: 522301

SEQ ID NO: 738061 - RNA, 64 nt, hsa; identical to SEQ ID NO: 522302

SEQ ID NO: 738062 - RNA, 64 nt, hsa; identical to SEQ ID NO: 522303

SEQ ID NO: 738063 - RNA, 64 nt, hsa; identical to SEQ ID NO: 522304

SEQ ID NO: 738064 - RNA, 64 nt, hsa; identical to SEQ ID NO: 522305

SEQ ID NO: 738065 - RNA, 64 nt, hsa; identical to SEQ ID NO: 522306

SEQ ID NO: 738066 - RNA, 64 nt, hsa; identical to SEQ ID NO: 522307

SEQ ID NO: 738067 - RNA, 64 nt, hsa; identical to SEQ ID NO: 522308

SEQ ID NO: 738068 - RNA, 64 nt, hsa; identical to SEQ ID NO: 522309

SEQ ID NO: 738069 - RNA, 64 nt, hsa; identical to SEQ ID NO: 522310

SEQ ID NO: 738070 - RNA, 64 nt, hsa; identical to SEQ ID NO: 522311

SEQ ID NO: 738071 - RNA, 64 nt, hsa; identical to SEQ ID NO: 522312

SEQ ID NO: 738072 - RNA, 64 nt, hsa; identical to SEQ ID NO: 522313

SEQ ID NO: 738073 - RNA, 64 nt, hsa; identical to SEQ ID NO: 522314

SEQ ID NO: 738074 - RNA, 64 nt, hsa; identical to SEQ ID NO: 522315

SEQ ID NO: 738075 - RNA, 64 nt, hsa; identical to SEQ ID NO: 522316

SEQ ID NO: 738076 - RNA, 64 nt, hsa; identical to SEQ ID NO: 522317

SEQ ID NO: 738077 - RNA, 64 nt, hsa; identical to SEQ ID NO: 522318

SEQ ID NO: 738078 - RNA, 64 nt, hsa; identical to SEQ ID NO: 522319

SEQ ID NO: 738079 - RNA, 64 nt, hsa; identical to SEQ ID NO: 522320

SEQ ID NO: 738080 - RNA, 64 nt, hsa; identical to SEQ ID NO: 522321

SEQ ID NO: 738081 - RNA, 64 nt, hsa; identical to SEQ ID NO: 522322

SEQ ID NO: 738082 - RNA, 64 nt, hsa; identical to SEQ ID NO: 522323

SEQ ID NO: 738083 - RNA, 64 nt, hsa; identical to SEQ ID NO: 522324

SEQ ID NO: 738084 - RNA, 64 nt, hsa; identical to SEQ ID NO: 522325

SEQ ID NO: 738085 - RNA, 64 nt, hsa; identical to SEQ ID NO: 522326

SEQ ID NO: 738086 - RNA, 64 nt, hsa; identical to SEQ ID NO: 333348

SEQ ID NO: 738087 - RNA, 64 nt, hsa; identical to SEQ ID NO: 333349

SEQ ID NO: 738088 - RNA, 64 nt, hsa; identical to SEQ ID NO: 333350

SEQ ID NO: 738089 - RNA, 64 nt, hsa; identical to SEQ ID NO: 333351

SEQ ID NO: 738090 - RNA, 64 nt, hsa; identical to SEQ ID NO: 333352

SEQ ID NO: 738091 - RNA, 64 nt, hsa; identical to SEQ ID NO: 333353

SEQ ID NO: 738092 - RNA, 64 nt, hsa; identical to SEQ ID NO: 333354

SEQ ID NO: 738093 - RNA, 64 nt, hsa; identical to SEQ ID NO: 333355

SEQ ID NO: 738094 - RNA, 64 nt, hsa; identical to SEQ ID NO: 333356

SEQ ID NO: 738095 - RNA, 64 nt, hsa; identical to SEQ ID NO: 333357

SEQ ID NO: 738096 - RNA, 64 nt, hsa; identical to SEQ ID NO: 333358

SEQ ID NO: 738097 - RNA, 64 nt, hsa; identical to SEQ ID NO: 333359

SEQ ID NO: 738098 - RNA, 64 nt, hsa; identical to SEQ ID NO: 333360

SEQ ID NO: 738099 - RNA, 64 nt, hsa; identical to SEQ ID NO: 333361

SEQ ID NO: 738100 - RNA, 64 nt, hsa; identical to SEQ ID NO: 333362

SEQ ID NO: 738101 - RNA, 64 nt, hsa; identical to SEQ ID NO: 333363

SEQ ID NO: 738102 - RNA, 64 nt, hsa; identical to SEQ ID NO: 333364

SEQ ID NO: 738103 - RNA, 64 nt, hsa; identical to SEQ ID NO: 333365

SEQ ID NO: 738104 - RNA, 64 nt, hsa; identical to SEQ ID NO: 333366

SEQ ID NO: 738105 - RNA, 64 nt, hsa; identical to SEQ ID NO: 333367

SEQ ID NO: 738106 - RNA, 64 nt, hsa; identical to SEQ ID NO: 333368

SEQ ID NO: 738107 - RNA, 64 nt, hsa; identical to SEQ ID NO: 333369

SEQ ID NO: 738108 - RNA, 64 nt, hsa; identical to SEQ ID NO: 333370

SEQ ID NO: 738109 - RNA, 64 nt, hsa; identical to SEQ ID NO: 333371

SEQ ID NO: 738110 - RNA, 64 nt, hsa; identical to SEQ ID NO: 333372

SEQ ID NO: 738111 - RNA, 64 nt, hsa; identical to SEQ ID NO: 333373

SEQ ID NO: 738112 - RNA, 64 nt, hsa; identical to SEQ ID NO: 333374

SEQ ID NO: 738113 - RNA, 64 nt, hsa; identical to SEQ ID NO: 333375

SEQ ID NO: 738114 - RNA, 64 nt, hsa; identical to SEQ ID NO: 333376

SEQ ID NO: 738115 - RNA, 64 nt, hsa; identical to SEQ ID NO: 333377

SEQ ID NO: 738116 - RNA, 64 nt, hsa; identical to SEQ ID NO: 333378

SEQ ID NO: 738117 - RNA, 64 nt, hsa; identical to SEQ ID NO: 333379

SEQ ID NO: 738118 - RNA, 64 nt, hsa; identical to SEQ ID NO: 333380

SEQ ID NO: 738119 - RNA, 64 nt, hsa; identical to SEQ ID NO: 333381

SEQ ID NO: 738120 - RNA, 64 nt, hsa; identical to SEQ ID NO: 333382

SEQ ID NO: 738121 - RNA, 64 nt, hsa; identical to SEQ ID NO: 333383

SEQ ID NO: 738122 - RNA, 64 nt, hsa; identical to SEQ ID NO: 333384

SEQ ID NO: 738123 - RNA, 64 nt, hsa; identical to SEQ ID NO: 333385

SEQ ID NO: 738124 - RNA, 64 nt, hsa; identical to SEQ ID NO: 333386

SEQ ID NO: 738125 - RNA, 64 nt, hsa; identical to SEQ ID NO: 333387

SEQ ID NO: 738126 - RNA, 64 nt, hsa; identical to SEQ ID NO: 333388

SEQ ID NO: 738127 - RNA, 64 nt, hsa; identical to SEQ ID NO: 333389

SEQ ID NO: 738128 - RNA, 64 nt, hsa; identical to SEQ ID NO: 333390

SEQ ID NO: 738129 - RNA, 64 nt, hsa; identical to SEQ ID NO: 333391

SEQ ID NO: 738130 - RNA, 64 nt, hsa; identical to SEQ ID NO: 333392

SEQ ID NO: 738131 - RNA, 64 nt, hsa; identical to SEQ ID NO: 333393

SEQ ID NO: 738132 - RNA, 64 nt, hsa; identical to SEQ ID NO: 333394

SEQ ID NO: 738133 - RNA, 64 nt, hsa; identical to SEQ ID NO: 333395

SEQ ID NO: 738134 - RNA, 64 nt, hsa; identical to SEQ ID NO: 333396

SEQ ID NO: 738135 - RNA, 64 nt, hsa; identical to SEQ ID NO: 333397

SEQ ID NO: 738136 - RNA, 64 nt, hsa; identical to SEQ ID NO: 333398

SEQ ID NO: 738137 - RNA, 64 nt, hsa; identical to SEQ ID NO: 333399

SEQ ID NO: 738138 - RNA, 64 nt, hsa; identical to SEQ ID NO: 333400

SEQ ID NO: 738139 - RNA, 64 nt, hsa; identical to SEQ ID NO: 333401

SEQ ID NO: 738140 - RNA, 64 nt, hsa; identical to SEQ ID NO: 333402

SEQ ID NO: 738141 - RNA, 64 nt, hsa; identical to SEQ ID NO: 333403

SEQ ID NO: 738142 - RNA, 64 nt, hsa; identical to SEQ ID NO: 333404

SEQ ID NO: 738143 - RNA, 64 nt, hsa; identical to SEQ ID NO: 333405

SEQ ID NO: 738144 - RNA, 64 nt, hsa; identical to SEQ ID NO: 333406

SEQ ID NO: 738145 - RNA, 64 nt, hsa; identical to SEQ ID NO: 333407

SEQ ID NO: 738146 - RNA, 64 nt, hsa; identical to SEQ ID NO: 333408

SEQ ID NO: 738147 - RNA, 64 nt, hsa; identical to SEQ ID NO: 333409

SEQ ID NO: 738148 - RNA, 64 nt, hsa; identical to SEQ ID NO: 333410

SEQ ID NO: 738149 - RNA, 64 nt, hsa; identical to SEQ ID NO: 333411

SEQ ID NO: 738150 - RNA, 64 nt, hsa; identical to SEQ ID NO: 333412

SEQ ID NO: 738151 - RNA, 64 nt, hsa; identical to SEQ ID NO: 333413

SEQ ID NO: 738152 - RNA, 64 nt, hsa; identical to SEQ ID NO: 333414

SEQ ID NO: 738153 - RNA, 64 nt, hsa; identical to SEQ ID NO: 333415

SEQ ID NO: 738154 - RNA, 64 nt, hsa; identical to SEQ ID NO: 333416

SEQ ID NO: 738155 - RNA, 64 nt, hsa; identical to SEQ ID NO: 333417

SEQ ID NO: 738156 - RNA, 64 nt, hsa; identical to SEQ ID NO: 333418

SEQ ID NO: 738157 - RNA, 64 nt, hsa; identical to SEQ ID NO: 333419

SEQ ID NO: 738158 - RNA, 64 nt, hsa; identical to SEQ ID NO: 333420

SEQ ID NO: 738159 - RNA, 64 nt, hsa; identical to SEQ ID NO: 333421

SEQ ID NO: 738160 - RNA, 64 nt, hsa; identical to SEQ ID NO: 333422

SEQ ID NO: 738161 - RNA, 64 nt, hsa; identical to SEQ ID NO: 333423

SEQ ID NO: 738162 - RNA, 64 nt, hsa; identical to SEQ ID NO: 333424

SEQ ID NO: 738163 - RNA, 64 nt, hsa; identical to SEQ ID NO: 333425

SEQ ID NO: 738164 - RNA, 64 nt, hsa; identical to SEQ ID NO: 333426

SEQ ID NO: 738165 - RNA, 64 nt, hsa; identical to SEQ ID NO: 333427

SEQ ID NO: 738166 - RNA, 64 nt, hsa; identical to SEQ ID NO: 333428

SEQ ID NO: 738167 - RNA, 64 nt, hsa; identical to SEQ ID NO: 333429

SEQ ID NO: 738168 - RNA, 64 nt, hsa; identical to SEQ ID NO: 333430

SEQ ID NO: 738169 - RNA, 64 nt, hsa; identical to SEQ ID NO: 333431

SEQ ID NO: 738170 - RNA, 64 nt, hsa; identical to SEQ ID NO: 333432

SEQ ID NO: 738171 - RNA, 64 nt, hsa; identical to SEQ ID NO: 333433

SEQ ID NO: 738172 - RNA, 64 nt, hsa; identical to SEQ ID NO: 333434

SEQ ID NO: 738173 - RNA, 64 nt, hsa; identical to SEQ ID NO: 333435

SEQ ID NO: 738174 - RNA, 64 nt, hsa; identical to SEQ ID NO: 333436

SEQ ID NO: 738175 - RNA, 64 nt, hsa; identical to SEQ ID NO: 333437

SEQ ID NO: 738176 - RNA, 64 nt, hsa; identical to SEQ ID NO: 333438

SEQ ID NO: 738177 - RNA, 64 nt, hsa; identical to SEQ ID NO: 333439

SEQ ID NO: 738178 - RNA, 64 nt, hsa; identical to SEQ ID NO: 333440

SEQ ID NO: 738179 - RNA, 64 nt, hsa; identical to SEQ ID NO: 333441

SEQ ID NO: 738180 - RNA, 64 nt, hsa; identical to SEQ ID NO: 333442

SEQ ID NO: 738181 - RNA, 64 nt, hsa; identical to SEQ ID NO: 333443

SEQ ID NO: 738182 - RNA, 64 nt, hsa; identical to SEQ ID NO: 333444

SEQ ID NO: 738183 - RNA, 64 nt, hsa; identical to SEQ ID NO: 333445

SEQ ID NO: 738184 - RNA, 64 nt, hsa; identical to SEQ ID NO: 333446

SEQ ID NO: 738185 - RNA, 64 nt, hsa; identical to SEQ ID NO: 333447

SEQ ID NO: 738186 - RNA, 64 nt, hsa; identical to SEQ ID NO: 333448

SEQ ID NO: 738187 - RNA, 64 nt, hsa; identical to SEQ ID NO: 333449

SEQ ID NO: 738188 - RNA, 64 nt, hsa; identical to SEQ ID NO: 333450

SEQ ID NO: 738189 - RNA, 64 nt, hsa; identical to SEQ ID NO: 333451

SEQ ID NO: 738190 - RNA, 64 nt, hsa; identical to SEQ ID NO: 333452

SEQ ID NO: 738191 - RNA, 64 nt, hsa; identical to SEQ ID NO: 333453

SEQ ID NO: 738192 - RNA, 64 nt, hsa; identical to SEQ ID NO: 333454

SEQ ID NO: 738193 - RNA, 55 nt, hsa; identical to SEQ ID NO: 333455

SEQ ID NO: 738194 - RNA, 64 nt, hsa; identical to SEQ ID NO: 333456

SEQ ID NO: 738195 - RNA, 64 nt, hsa; identical to SEQ ID NO: 333457

SEQ ID NO: 738196 - RNA, 64 nt, hsa; identical to SEQ ID NO: 333458

SEQ ID NO: 738197 - RNA, 64 nt, hsa; identical to SEQ ID NO: 315524

SEQ ID NO: 738198 - RNA, 64 nt, hsa; identical to SEQ ID NO: 315525

SEQ ID NO: 738199 - RNA, 64 nt, hsa; identical to SEQ ID NO: 315526

SEQ ID NO: 738200 - RNA, 64 nt, hsa; identical to SEQ ID NO: 315527

SEQ ID NO: 738201 - RNA, 64 nt, hsa; identical to SEQ ID NO: 315528

SEQ ID NO: 738202 - RNA, 64 nt, hsa; identical to SEQ ID NO: 315529

SEQ ID NO: 738203 - RNA, 64 nt, hsa; identical to SEQ ID NO: 315530

SEQ ID NO: 738204 - RNA, 64 nt, hsa; identical to SEQ ID NO: 315531

SEQ ID NO: 738205 - RNA, 64 nt, hsa; identical to SEQ ID NO: 315532

SEQ ID NO: 738206 - RNA, 64 nt, hsa; identical to SEQ ID NO: 315533

SEQ ID NO: 738207 - RNA, 64 nt, hsa; identical to SEQ ID NO: 315534

SEQ ID NO: 738208 - RNA, 64 nt, hsa; identical to SEQ ID NO: 315535

SEQ ID NO: 738209 - RNA, 64 nt, hsa; identical to SEQ ID NO: 315536

SEQ ID NO: 738210 - RNA, 64 nt, hsa; identical to SEQ ID NO: 315537

SEQ ID NO: 738211 - RNA, 64 nt, hsa; identical to SEQ ID NO: 315538

SEQ ID NO: 738212 - RNA, 64 nt, hsa; identical to SEQ ID NO: 315539

SEQ ID NO: 738213 - RNA, 64 nt, hsa
cuacacagacugcagcaacgguugcaucugcauauccuaagaggaaaaaaugaccuucaagaga

SEQ ID NO: 738214 - RNA, 64 nt, hsa
ugaccuuuuguuacucaaaguaaaguacuaggaguccuaagaaauguucuguucuuguacauua

SEQ ID NO: 738215 - RNA, 64 nt, hsa
auuuuggugggcagggacugccuccucccggaauuccuaagauccgcccagcugccaccauuuu

SEQ ID NO: 738216 - RNA, 64 nt, hsa
aucccuggguaauggaugguaagaugauggagauuccuaagauugguggaguugggcaaugcau

SEQ ID NO: 738217 - RNA, 64 nt, hsa
cccauaucgauugccaaagagcaucuaccuuaccuccuaagaagaaaagccacuuucuuccaau

SEQ ID NO: 738218 - RNA, 64 nt, hsa
ucuucugcagccaccagugggagagacaagccaguccuaagagaaaaggugguggcagccacaa

SEQ ID NO: 738219 - RNA, 64 nt, hsa
cauucuugucccccaaaccuguaaguaggugaauuccuaagauaaguguguauuuucauuccag

SEQ ID NO: 738220 - RNA, 64 nt, hsa
augaccagcgugugacucauucugacauuucagauccuaagaauucuaagaacacuacuagaag

SEQ ID NO: 738221 - RNA, 64 nt, hsa
cagucuuuaugaugggauuaagguggacaagaucuccuaagaucugugaaugggauuaaggugg

SEQ ID NO: 738222 - RNA, 64 nt, hsa
aagaucugugaaugggauuaagguggacaagaucuccuaagaucugaaaagaaaccuuaauacg

SEQ ID NO: 738223 - RNA, 64 nt, hsa
ccacugaccuacugaauaucuagcauccuuagauuggcucaacuguuacuuuccuaaggagucc

SEQ ID NO: 738224 - RNA, 64 nt, hsa
uguauguaagugaaaagcaucaccaucuacccauuggcucaagcagaaaucuggaagucaucuu

SEQ ID NO: 738225 - RNA, 64 nt, hsa
gauuucgugugaaaugucccgauuguuaaaaaguuggcucaauuauuuuuaaaacauuuuguaa

SEQ ID NO: 738226 - RNA, 64 nt, hsa
ugguccacguccuauaucuuauuauauuuacucauggcucaaugggggccuccagagacccucu

SEQ ID NO: 738227 - RNA, 64 nt, hsa
cccucaccccugugugcuagugucugggaaguuucccugaaaggugggaggcgggugggugguc

SEQ ID NO: 738228 - RNA, 64 nt, hsa
ugggggaggguuucacuguuacaucaccaagaggcccugaaaagaggaaaaaaaaaaaaaaaga

SEQ ID NO: 738229 - RNA, 64 nt, hsa
guguccugaccagcuccaaaaauauacuucacugcccugaaaaacagacacagggagaguuggu

SEQ ID NO: 738230 - RNA, 64 nt, hsa
agccucccggaaccuccccuuuggcuaaccgagccccugaaaugcccaguacugccauuugaca

SEQ ID NO: 738231 - RNA, 64 nt, hsa
cugcagcugaggcuuggaaacguuucuuguguugcccugaaaaaucuuugagaccucagggagg

SEQ ID NO: 738232 - RNA, 64 nt, hsa
caggccagggggcugccaucuucuucacagacaucccugaaaggaagccccuuuggggcaggga

SEQ ID NO: 738233 - RNA, 64 nt, hsa
guugauauuaaagcgcaaaugaauucaaccucagcccugaaaauaacagaauucugaaguuucc

SEQ ID NO: 738234 - RNA, 64 nt, hsa
gugugaaaagcuacccugaaacccaguaauucuacccugaaagugacugccugcagaaagacca

SEQ ID NO: 738235 - RNA, 64 nt, hsa
uccccagggccauaguguagagugugaaaagcuacccugaaacccaguaauucuacccugaaag

SEQ ID NO: 738236 - RNA, 64 nt, hsa
cccagagugaaccguccuuucacacaucugggugcccugaaagggcccuuccccucccccacuc

SEQ ID NO: 738237 - RNA, 64 nt, hsa
caucagggaggguuaggaaaaccacaaacggagccccugaaagccucacguauuucacagagca

SEQ ID NO: 738238 - RNA, 64 nt, hsa
aacaugugccccugccaaggccggagacccacagcccugaaacgagaagugcccuuaaggauca

SEQ ID NO: 738239 - RNA, 64 nt, hsa
ccgccacccugucucaguaccuccccuccccgcccccugaaacaugugccccugccaaggccgg

SEQ ID NO: 738240 - RNA, 64 nt, hsa
aacuaaaaacuccuuaacuuacuguugcuuacaccccugaaagucuguuuuuaagcaaaugggu

SEQ ID NO: 738241 - RNA, 64 nt, hsa
uuuaacccuuuuaaaagagaccuauguugaaaaccccugaaaauucacugaagaaaaaucauua

SEQ ID NO: 738242 - RNA, 64 nt, hsa
uuucuuucuagaaacacauuugccuaucuucuuacccugaaacagaaaauaaauauugugcuuu

SEQ ID NO: 738243 - RNA, 64 nt, hsa
gaaggauuuuagaaaucauauaucucuucuaacccccugaaauccugaguuuaaguggcuugau

SEQ ID NO: 738244 - RNA, 64 nt, hsa
agcuuccugcucuuucuccuuuuugcuuucuuaccccugaaagagggaaggacaagucaccuca

SEQ ID NO: 738245 - RNA, 64 nt, hsa
guacuuuagugagagcugacuggcaagauaaaaacccugaaauucccagaaguuacagaugccu

SEQ ID NO: 738246 - RNA, 64 nt, hsa
gaaaaagaacacuuuugaacuauguaaugcuucacccugaaaggcaagcuaacgcuaacuuccc

SEQ ID NO: 738247 - RNA, 64 nt, hsa
uuggcuaaacacaaaugagagcuucccucaggcucccugaaacagcuaggcccaaaucacaagu

SEQ ID NO: 738248 - RNA, 64 nt, hsa
aggcccaaaucacaaguacaguccuuuccaacaccccugaaauucauagucaguagcagagaaa

SEQ ID NO: 738249 - RNA, 64 nt, hsa
agaauuauagaugggguucaagaaucccuaaguccccugaaauuauauaaggcauucuguauaa

SEQ ID NO: 738250 - RNA, 64 nt, hsa
agaagugaggagaaaccugcaugaaagcauucuucccugaaaaguuaggccucucagagucacc

SEQ ID NO: 738251 - RNA, 64 nt, hsa
acaccccgagcgagcaccccaaagugcacaaagcugaguaaaaagcugcccccuucaaacagaa

SEQ ID NO: 738252 - RNA, 64 nt, hsa
ccugaagguguaaaauuguaaauauuuuuaucuaugaguaaauguuaaguaguuguuuuaaaau

SEQ ID NO: 738253 - RNA, 64 nt, hsa
ugcauguauuuuguuuuucauguacugggcaauaugaguaaaaucugucccuuuuucccccuuu

SEQ ID NO: 738254 - RNA, 64 nt, hsa
cuuaaaaggacaugcccacugaauucagguccuuugaguaaaaaaaaaaucuucugcugcacau

SEQ ID NO: 738255 - RNA, 64 nt, hsa
gauuaaugguauaugcuccuuaugucacuguuuuugaguaaaauccauuuccuuucucuguuuc

SEQ ID NO: 738256 - RNA, 64 nt, hsa
cacacaguggagagguuaaucuagguugggaaacugaguaaaaguccagagcaggaaugagccu

SEQ ID NO: 738257 - RNA, 64 nt, hsa
gguaagaaguaauaaugaguaaaugguaaguacuugaguaaaucuaaagaaauauugauaguaa

SEQ ID NO: 738258 - RNA, 64 nt, hsa
ucagaaaguaaaucugagagguaagaaguaauaaugaguaaaugguaaguacuugaguaaaucu

SEQ ID NO: 738259 - RNA, 64 nt, hsa
agcuggucaucgucuuagcauacauauccuacacugaguaaaccguaacgggaugucaucagca

SEQ ID NO: 738260 - RNA, 64 nt, hsa
uuaaagcuauauaaacacaguuaacccuuguaaaugaguaaacaaauuuuuacauguaagauuc

SEQ ID NO: 738261 - RNA, 64 nt, hsa
aauuaagaaauacauaugcaaauucuuuugugauugaguaaaagcagcuuaaauuacuuuucuu

SEQ ID NO: 738262 - RNA, 64 nt, hsa
aaauuagcagauagucuuugcucuaaaugauaucugaguaaauagacuugaggaauccucuacc

SEQ ID NO: 738263 - RNA, 64 nt, hsa
gagguggugugcagaggaaagcugcauucacuauugaguaaaaacuuguagaaagcacauuaua

SEQ ID NO: 738264 - RNA, 64 nt, hsa
ggcccuggauaaugcuguagcauucagggucgauugaguaaaaaaaauguagagaugguuuccu

SEQ ID NO: 738265 - RNA, 64 nt, hsa
gcuggaauuacaggugugagccacugugcccagcugaguaaauuucuugauugcacagaaugua

SEQ ID NO: 738266 - RNA, 64 nt, hsa
aaugcccaaauccgaaugaccccaguuuuccuaaugaguaaaaugaucccagaugugccccaga

SEQ ID NO: 738267 - RNA, 64 nt, hsa
agcucaaggcuauuagguugaauauuugcuuucaugaguaaauguggaucuuuggggaauggcu

SEQ ID NO: 738268 - RNA, 64 nt, hsa
gaaugugugcaaaacacgucacaguccugguuucugaguaaaggcaggcuguuaucuuuagaau

SEQ ID NO: 738269 - RNA, 64 nt, hsa
uguaauccucaugugaguauuccuguuuaacacuugaguaaacugaggcacagagaacauaagu

SEQ ID NO: 738270 - RNA, 64 nt, hsa
cuucagguuaucuugaacugccugacuuaggccagcccuacagaagugcuguuuacucauugga

SEQ ID NO: 738271 - RNA, 64 nt, hsa
cuucaguuuaucuuggacugacugacucaugccagcccuacagaagugccuuuuacguauugga

SEQ ID NO: 738272 - RNA, 59 nt, hsa; identical to SEQ ID NO: 494003

SEQ ID NO: 738273 - RNA, 62 nt, hsa
ccccacaccagucaaggcuucucagcuggagaaccggggagcagcuggacacccagccaagg

SEQ ID NO: 738274 - RNA, 62 nt, hsa
cuguucauuuaccaaccugggggauugauacgaccggggaaaauguuccuaaaccaggaagc

SEQ ID NO: 738275 - RNA, 62 nt, hsa
acucgggaggcugaggcaggagaauugcuugaaccggggaggcagaaguugcagugagccga

SEQ ID NO: 738276 - RNA, 62 nt, hsa
aaauggggugggggugggggugguaaggggagaccggggagucaguuucagacaguucucua

SEQ ID NO: 738277 - RNA, 62 nt, hsa
ucagucuuuccugcucagccaggggggaugauaccggggacucuccagagccaugacuagau

SEQ ID NO: 738278 - RNA, 62 nt, hsa
acaccugaggcugaggcaggagaauugcuugaaccggggagacggagguugcagugagccga

SEQ ID NO: 738279 - RNA, 62 nt, hsa
uccugcggacaccagcuccucucuccgccgucaccggggaggccggggauccuugcagggcu

SEQ ID NO: 738280 - RNA, 62 nt, hsa
uagcauaguacaaucagaaccucguggagaccaccggggacaggcuugcggacgccggcugu

SEQ ID NO: 738281 - RNA, 62 nt, hsa
uuacagaaaaauaguguaaacauuauuuccuuaccggggaaugaggguuuuuucuuuuucuu

SEQ ID NO: 738282 - RNA, 62 nt, hsa
ugccauccucuccuauuuaucucugaggaucgaccggggacugggauagaggaagggugagc

SEQ ID NO: 738283 - RNA, 62 nt, hsa
gcagaagaagaagcgguaaugcgcccggagcgaccggggagcgagcgagugcgucaagaaag

SEQ ID NO: 738284 - RNA, 62 nt, hsa
gggggauacugaaccucuagacugaaguacuuaccggggagcacaguggacuaggggaugcc

SEQ ID NO: 738285 - RNA, 62 nt, hsa
gcuuccagcaggauugagucacccugacgaugaccggggagaagccgugugcucuucauuau

SEQ ID NO: 738286 - RNA, 62 nt, hsa
aaaaaaaaaaaggaaaaaaaauucaccgggcaaccggggaaguauuguggccuuggaguuug

SEQ ID NO: 738287 - RNA, 62 nt, hsa
cugcacucuugugccacagcugcccuggggaaaccggggaaccccaacugggaaaggaggcc

SEQ ID NO: 738288 - RNA, 62 nt, hsa
caggcagaagccggacaggggcccuuccccacaccggggagagcugcucggacaggcccccu

SEQ ID NO: 738289 - RNA, 62 nt, hsa
gugucugcuccacgucaggcacugugcuuugcaccggggagaaaauggugauggagggcaac

SEQ ID NO: 738290 - RNA, 62 nt, hsa
aagacaaagccuugucuauguggggggcggggaccggggaaagagggaggcugaaauguuua

SEQ ID NO: 738291 - RNA, 62 nt, hsa
ugaaguaacugaggcuuagaaagguuaauagcaccggggaacaauuucucugggugagaauu

SEQ ID NO: 738292 - RNA, 62 nt, hsa
ugccaugcccagagaaucagggcaggcuugccaccggggaacccagcccugggguaugagcu

SEQ ID NO: 738293 - RNA, 62 nt, hsa
cucccgagccucaaggcaaguccaggacucagaccggggaggcccgggccagcagcucccag

SEQ ID NO: 738294 - RNA, 62 nt, hsa
cauuucuguacuaacuguucucuuguuccgguaccggggagaaggaugaccccuccuuauuc

SEQ ID NO: 738295 - RNA, 62 nt, hsa
gccucaacuaacaaacccuucaggaagcauauaccggggaauguguagccuucaggaaaaaa

SEQ ID NO: 738296 - RNA, 62 nt, hsa
ucgcaugaaccacagaugcuggagaucaccagaccggggagagaagaggggcaccugggcug

SEQ ID NO: 738297 - RNA, 62 nt, hsa
acacaggugccaguucagcagugaccgucaagaccggggaagugcccuguggugaccaggag

SEQ ID NO: 738298 - RNA, 62 nt, hsa
ggaccagggagcccugacucccagaggcugccaccggggagaagcagcgguccuccauccag

SEQ ID NO: 738299 - RNA, 62 nt, hsa
gcugcccagcugucaaggucaggcaagugagcaccggggacugaggaucagggcgggacccc

SEQ ID NO: 738300 - RNA, 62 nt, hsa
cugggaauuccaccugagaacaagucccgcaaaccggggacggaaggacauuugacuuuuau

SEQ ID NO: 738301 - RNA, 62 nt, hsa
ccugccggcccacaggcccaucccggcggggcaccggggacucgcgggcuucugcugggucc

SEQ ID NO: 738302 - RNA, 62 nt, hsa
agaugggcuucauccaauggacugcauaaauaaccggggauucuguacaugcauugagcucu

SEQ ID NO: 738303 - RNA, 62 nt, hsa
agccagaaagguaugcaugugggugucuucacaccggggaggagggccucucaugggaaagc

SEQ ID NO: 738304 - RNA, 62 nt, hsa
ccugauguggagguacagggcagaucuucccuaccggggagggauggaugguuggauacagg

SEQ ID NO: 738305 - RNA, 62 nt, hsa
agaggcgaggcaaugacuguuggccaguucucaccggggaaaaacccacuguuaggauggca

SEQ ID NO: 738306 - RNA, 62 nt, hsa
ucugacaaggggagcugucaaucaaacaccaaaccggggagacaagaugauuggcagguauu

SEQ ID NO: 738307 - RNA, 62 nt, hsa
ccugccucaagccugaguggaagcaccugaggaccggggaucgggaccugaccuggggcugg

SEQ ID NO: 738308 - RNA, 62 nt, hsa
cucaucccuagcuccaaucccuuccccacgugaccggggauucugguugcaauaaaacaugc

SEQ ID NO: 738309 - RNA, 62 nt, hsa
ggaggcucccgaggggaaggggcggugcccacaccggggacaggccgcagcuccauuuucuu

SEQ ID NO: 738310 - RNA, 62 nt, hsa
gggugcgguggcacacaccuguaaucccagcuaccggggaggcugaggcaggagaaucgcua

SEQ ID NO: 738311 - RNA, 62 nt, hsa
acccaggaggcugaggcaggagaaucgcuugaaccggggagguggagguugcagugagcuga

SEQ ID NO: 738312 - RNA, 62 nt, hsa
cuucugcuuacuuuccacaugagaugcuuuguaccggggagcugugagcaggccucacgaug

SEQ ID NO: 738313 - RNA, 62 nt, hsa
uggguugccaaagcagccaggcuuaugcugaaaccggggaagucugacauaugcaggaaacu

SEQ ID NO: 738314 - RNA, 62 nt, hsa
uccgcugcguggaggugucggacgaucaggacaccggggacacucugggcagcguccuccgg

SEQ ID NO: 738315 - RNA, 62 nt, hsa
ugucucauccccagaacaugccgucuguccccaccggggagugggccuugauggccgggccu

SEQ ID NO: 738316 - RNA, 62 nt, hsa
cuccuugggccaccaaaggugguggccaugguaccggggacuugggagagugagacccagug

SEQ ID NO: 738317 - RNA, 62 nt, hsa
cccuuugaaaagugccuggggaccugaagagcaccggggaauuuguaaccccuauuuaagcc

SEQ ID NO: 738318 - RNA, 61 nt, hsa; identical to SEQ ID NO: 494049

SEQ ID NO: 738319 - RNA, 62 nt, hsa
caggacugccugggacucccuggcaacccagcaccggggaagccgucagcugcugugacaau

SEQ ID NO: 738320 - RNA, 62 nt, hsa
acuccggccccuggacccgggccggggcgcccaccggggaccgccuggccgggggcuccaag

SEQ ID NO: 738321 - RNA, 62 nt, hsa
aggguaucccaucuggggcaaacucacuguguaccggggaggaggcuacgugguccccuugg

SEQ ID NO: 738322 - RNA, 62 nt, hsa
gucucugucuuccaacccccaauaauauuuccaccggggaugcaucauuuuuacucccaaua

SEQ ID NO: 738323 - RNA, 55 nt, hsa; identical to SEQ ID NO: 494054

SEQ ID NO: 738324 - RNA, 62 nt, hsa
agguccugcaguacagucuuccccugaaugccaccggggacccagggggacuccaccccccu

SEQ ID NO: 738325 - RNA, 62 nt, hsa
acacugucucccuggaggggcucgagggcaugaccggggacugaccauucugugaaaggagc

SEQ ID NO: 738326 - RNA, 62 nt, hsa
uggagagugagggcucccugcucccucccuccaccggggaagggcaugggcuagaagaggag

SEQ ID NO: 738327 - RNA, 62 nt, hsa
ugaagcgcugcacccccaccaaccuuacccucaccggggaacccucacuagcaggacuggug

SEQ ID NO: 738328 - RNA, 62 nt, hsa
cuggugcccagcgagcugagcaccagugggugaccggggagaaacagggcagacuggguaag

SEQ ID NO: 738329 - RNA, 62 nt, hsa
agguccaggacugggaaggaccgggugagugcaccggggacccaggccaggugccccccgga

SEQ ID NO: 738330 - RNA, 62 nt, hsa
aagaaggcggauuaggggguggcccaaggggcaccggggagaggacccggacccaggacccu

SEQ ID NO: 738331 - RNA, 62 nt, hsa
cucaggcguggaagagaaucuucuccuuauucaccggggaggcugugucuugugcaaacaag

SEQ ID NO: 738332 - RNA, 58 nt, hsa; identical to SEQ ID NO: 494063

SEQ ID NO: 738333 - RNA, 62 nt, hsa
ggaagagccaccaucccugcccccguuuucccaccggggagucuguacagagauuuuucuac

SEQ ID NO: 738334 - RNA, 62 nt, hsa
ucuccugggcuguggucucaucucaacguucaaccggggaugggucggccucuaagcucaug

SEQ ID NO: 738335 - RNA, 62 nt, hsa
ggagagcuaggaaaaauaaacaaccuuaugccaccggggaaaaaaucacaauaaauauuuau

SEQ ID NO: 738336 - RNA, 62 nt, hsa
acucaggaggcugaggcaugagaaucgcuugaaccggggaggcagagguugcagugagccga

SEQ ID NO: 738337 - RNA, 62 nt, hsa
gugaaugugugugagcaugugugugugcauguaccggggaaugaaggugaacauacaccucu

SEQ ID NO: 738338 - RNA, 62 nt, hsa
aggcgguggggcaugggaggaaggaggcacagaccggggaaauaugacagccgucauuucca

SEQ ID NO: 738339 - RNA, 62 nt, hsa
cacugugguuugagaagaggcuggauccgcugaccggggagauggccuguguguacaagggc

SEQ ID NO: 738340 - RNA, 62 nt, hsa
accacccucccuucuagagagcacaucgccugaccggggagaaguggggccgugguucgagg

SEQ ID NO: 738341 - RNA, 62 nt, hsa
ccggcuccccgaggacccaggcuugacgauucaccggggaucuccugggcugggcucuccuu

SEQ ID NO: 738342 - RNA, 62 nt, hsa
auguagcuugugacacuuuuauuuuauuagucaccggggaacuuuucagugaugaaaauaca

SEQ ID NO: 738343 - RNA, 64 nt, hsa; identical to SEQ ID NO: 665165

SEQ ID NO: 738344 - RNA, 64 nt, hsa; identical to SEQ ID NO: 665166

SEQ ID NO: 738345 - RNA, 64 nt, hsa; identical to SEQ ID NO: 665167

SEQ ID NO: 738346 - RNA, 64 nt, hsa; identical to SEQ ID NO: 665168

SEQ ID NO: 738347 - RNA, 64 nt, hsa; identical to SEQ ID NO: 665169

SEQ ID NO: 738348 - RNA, 64 nt, hsa; identical to SEQ ID NO: 665170

SEQ ID NO: 738349 - RNA, 64 nt, hsa; identical to SEQ ID NO: 665171

SEQ ID NO: 738350 - RNA, 64 nt, hsa; identical to SEQ ID NO: 665172

SEQ ID NO: 738351 - RNA, 64 nt, hsa; identical to SEQ ID NO: 343074

SEQ ID NO: 738352 - RNA, 64 nt, hsa; identical to SEQ ID NO: 343075

SEQ ID NO: 738353 - RNA, 64 nt, hsa; identical to SEQ ID NO: 343076

SEQ ID NO: 738354 - RNA, 64 nt, hsa; identical to SEQ ID NO: 343077

SEQ ID NO: 738355 - RNA, 64 nt, hsa; identical to SEQ ID NO: 343078

SEQ ID NO: 738356 - RNA, 64 nt, hsa; identical to SEQ ID NO: 343079

SEQ ID NO: 738357 - RNA, 64 nt, hsa; identical to SEQ ID NO: 343080

SEQ ID NO: 738358 - RNA, 64 nt, hsa; identical to SEQ ID NO: 343081

SEQ ID NO: 738359 - RNA, 64 nt, hsa; identical to SEQ ID NO: 343082

SEQ ID NO: 738360 - RNA, 64 nt, hsa; identical to SEQ ID NO: 343083

SEQ ID NO: 738361 - RNA, 64 nt, hsa; identical to SEQ ID NO: 343084

SEQ ID NO: 738362 - RNA, 64 nt, hsa; identical to SEQ ID NO: 343085

SEQ ID NO: 738363 - RNA, 64 nt, hsa; identical to SEQ ID NO: 343086

SEQ ID NO: 738364 - RNA, 64 nt, hsa; identical to SEQ ID NO: 343087

SEQ ID NO: 738365 - RNA, 64 nt, hsa; identical to SEQ ID NO: 343088

SEQ ID NO: 738366 - RNA, 64 nt, hsa; identical to SEQ ID NO: 343089

SEQ ID NO: 738367 - RNA, 64 nt, hsa; identical to SEQ ID NO: 343090

SEQ ID NO: 738368 - RNA, 64 nt, hsa; identical to SEQ ID NO: 343091

SEQ ID NO: 738369 - RNA, 64 nt, hsa; identical to SEQ ID NO: 343092

SEQ ID NO: 738370 - RNA, 64 nt, hsa; identical to SEQ ID NO: 343093

SEQ ID NO: 738371 - RNA, 64 nt, hsa; identical to SEQ ID NO: 343094

SEQ ID NO: 738372 - RNA, 64 nt, hsa; identical to SEQ ID NO: 343095

SEQ ID NO: 738373 - RNA, 64 nt, hsa; identical to SEQ ID NO: 343096

SEQ ID NO: 738374 - RNA, 64 nt, hsa; identical to SEQ ID NO: 343097

SEQ ID NO: 738375 - RNA, 64 nt, hsa; identical to SEQ ID NO: 343098

SEQ ID NO: 738376 - RNA, 64 nt, hsa; identical to SEQ ID NO: 343099

SEQ ID NO: 738377 - RNA, 64 nt, hsa; identical to SEQ ID NO: 343100

SEQ ID NO: 738378 - RNA, 64 nt, hsa; identical to SEQ ID NO: 343101

SEQ ID NO: 738379 - RNA, 64 nt, hsa; identical to SEQ ID NO: 343102

SEQ ID NO: 738380 - RNA, 64 nt, hsa; identical to SEQ ID NO: 343103

SEQ ID NO: 738381 - RNA, 64 nt, hsa; identical to SEQ ID NO: 343104

SEQ ID NO: 738382 - RNA, 64 nt, hsa; identical to SEQ ID NO: 343105

SEQ ID NO: 738383 - RNA, 64 nt, hsa; identical to SEQ ID NO: 343106

SEQ ID NO: 738384 - RNA, 64 nt, hsa; identical to SEQ ID NO: 343107

SEQ ID NO: 738385 - RNA, 64 nt, hsa; identical to SEQ ID NO: 343108

SEQ ID NO: 738386 - RNA, 64 nt, hsa
ggagcgaagugcacaccucaccauccuucagucuaaggaagaagggcaagcccugggaccaaga

SEQ ID NO: 738387 - RNA, 64 nt, hsa
gaaugaccuuccucauuccaggaggcccuggaauaaggaagaggcuucuuucugagggagcuuu

SEQ ID NO: 738388 - RNA, 64 nt, hsa
cugcuggcaauggugauaauggauuaauuccucaaaggaagagcagaacaccugaaaaucagca

SEQ ID NO: 738389 - RNA, 64 nt, hsa
cugcuggcaauggugaugauggauuaauuccuccaaggaagagcagaacaccugaaagccagca

SEQ ID NO: 738390 - RNA, 64 nt, hsa
agaucgcgcaccuucaggucgcgcaccuucgcugaaggaagaugacgcagagcuuuaucugaaa

SEQ ID NO: 738391 - RNA, 64 nt, hsa
ucuccuugaaaaaaaaaucucuuggauguuuaggaaggaagacuuggccgugaugugguguccu

SEQ ID NO: 738392 - RNA, 64 nt, hsa
caaaaccacccaacccccacccugccucuauccuaaggaagaccaagcaggccuggacccagag

SEQ ID NO: 738393 - RNA, 64 nt, hsa
gggacaucuggaugcugggcauagauuucucaacaaggaagacuccccugccuccucaaggucu

SEQ ID NO: 738394 - RNA, 64 nt, hsa
gagcuugaagcauaaggaagacaaguuauucuguaaggaagauaaagcauucaaaaguacuaca

SEQ ID NO: 738395 - RNA, 64 nt, hsa
gacuucuuccuuacccuuuuggagcuugaagcauaaggaagacaaguuauucuguaaggaagau

SEQ ID NO: 738396 - RNA, 64 nt, hsa
guagcaaauauuuauugacaaauugaaaagcaggaaggaagaggguugugccaagguauugaug

SEQ ID NO: 738397 - RNA, 64 nt, hsa
uuuuuuaaagaaauuacaguguaguguuuauucuaaggaagauauguaugaauguauauacaaa

SEQ ID NO: 738398 - RNA, 64 nt, hsa
augauaaacuuuaagaccuuguauaccauauugaaaggaagaggcugacaauaagguuugacag

SEQ ID NO: 738399 - RNA, 64 nt, hsa
gucugucucuaaaggguuaaauguaucaauuggaaaggaagaaaaaaggccuugaauugacaaa

SEQ ID NO: 738400 - RNA, 64 nt, hsa
uuuguacauacacacuuagaaagaaaagacagaaaaggaagaggaaggaaggaaauauuuugag

SEQ ID NO: 738401 - RNA, 64 nt, hsa
gaaagcaacaccucaacucaucuuuuuauuuaauaaggaagaaauauauuacaaaaguauaaaa

SEQ ID NO: 738402 - RNA, 64 nt, hsa
ggacaaugcuuaguuauaagucuccgaguuggaaaaggaagaaagccagagcugucuaguuuca

SEQ ID NO: 738403 - RNA, 64 nt, hsa
ccauauugugaaaaacuuuaguggacaagggcagaaggaagagggaagaccuguuaggaagcua

SEQ ID NO: 738404 - RNA, 64 nt, hsa
gauuugcugagaguuugaauguggaguguaagagaaggaagaguuaaugaugacauuaagguuu

SEQ ID NO: 738405 - RNA, 64 nt, hsa
ccacaaaaucaauaaaagauguuuuugagaaaaaaaggaagaaaccaacucauucagaaggcuc

SEQ ID NO: 738406 - RNA, 64 nt, hsa
uuucugaucaccuuagaaauggcaguaagcccaaaaggaagaauuaugcugguaguaaauggga

SEQ ID NO: 738407 - RNA, 64 nt, hsa
aaacaguaaaaaugacucccauccauccucugacaaggaagaaggugaggccacauccgauucu

SEQ ID NO: 738408 - RNA, 64 nt, hsa
ccuaagugacuccgauuuucagcccugguagaauaaggaagacagcugaugccuccuuagcccc

SEQ ID NO: 738409 - RNA, 64 nt, hsa
aacaaacugagcagcuguuauuugggcaaaaucaaaggaagaaagagacuauggucuucuauuu

SEQ ID NO: 738410 - RNA, 64 nt, hsa
uuucccgccacuggguccaaggagccuuuguucaaaggaagaagugggccacggaagaacgggc

SEQ ID NO: 738411 - RNA, 64 nt, hsa
aggccucaagagccccuaauugucucaggguucaaaggaagacacugaccuuucccaucccggu

SEQ ID NO: 738412 - RNA, 64 nt, hsa
ugcuaaaacuaacccucuuuuuaagaggagauuuaaggaagacgucaaucaaaaugucaaauau

SEQ ID NO: 738413 - RNA, 64 nt, hsa
uaaaauauauaaauauccuuuuuacuucaugaggaaggaagaauuuuuugauaauuacugaguu

SEQ ID NO: 738414 - RNA, 64 nt, hsa
auuuucaaauauuuaauucuaaauuccagauuuuaaggaagauuuuucaagaaacugcaaguuu

SEQ ID NO: 738415 - RNA, 64 nt, hsa
aaugaugcucuugaugaaagaaaaagacagaaggaaggaagaagaaaaagacugcaagcuuucc

SEQ ID NO: 738416 - RNA, 64 nt, hsa
uucaaauugugauuucauugauuuuacuaacuggaaggaagaagaguaaaauuggcauauuuag

SEQ ID NO: 738417 - RNA, 64 nt, hsa
ggagaaauuggggggaaauagaagaguacggagaaaggaagagaccagaguucuuuaaagcuca

SEQ ID NO: 738418 - RNA, 64 nt, hsa
guuucugcccuagacauuugccaaggaggaaccuaaggaagauauugacgucucuauucugccc

SEQ ID NO: 738419 - RNA, 64 nt, hsa
caagauuugguggguccacacggucuucacaaagaaggaagaaaagaaggaguggaggaaggug

SEQ ID NO: 738420 - RNA, 64 nt, hsa
gcuauugauuuuuacuucaaugggcucuuccaacaaggaagaagcuugcugguagcacuugcua

SEQ ID NO: 738421 - RNA, 64 nt, hsa
ucuccuagucaauauccaccccauccaauuuaucaaggaagaaaugguucagaaaauauuuuca

SEQ ID NO: 738422 - RNA, 64 nt, hsa
auuugacuuaccaccagagcauagaaaagcaugcaaggaagaccagaugggcuuagcauuggga

SEQ ID NO: 738423 - RNA, 64 nt, hsa
gaguagugaaucucucagccaaggagggaaagaaaaggaagaacucuugacuauuuagauucua

SEQ ID NO: 738424 - RNA, 64 nt, hsa
cuacaggugucuucuggggggcagaaccaauuggaaggaagaaagggaccccucuccaguccug

SEQ ID NO: 738425 - RNA, 64 nt, hsa
ggagaagccuggggaggagggggaggaagacaagaaggaagaggaggaggagaaggaagacgag

SEQ ID NO: 738426 - RNA, 64 nt, hsa
gggggaggaagacaagaaggaagaggaggaggagaaggaagacgaggagcuggacugggccuug

SEQ ID NO: 738427 - RNA, 64 nt, hsa
cuuauuuugcuacugagucacacaagggaaguggaaggaagaacaguuaauuuaagaaugaaac

SEQ ID NO: 738428 - RNA, 64 nt, hsa
gaaauaauacaaauuggcuuucaagugagacccaaaggaagaacuggauaaaaucuuccaaauc

SEQ ID NO: 738429 - RNA, 64 nt, hsa
aaggagggucccuccaaaguugaacacuuggugaaaggaagaugccccgacuucuuuggccagu

SEQ ID NO: 738430 - RNA, 64 nt, hsa
uccccgguuuuguuuuuguaaaaugcucuggaggaaggaagaaacguggcagaucccugacauc

SEQ ID NO: 738431 - RNA, 64 nt, hsa
uagucucagcacaggaauugaggugggucaggugaaggaagaguguauguuccuauuuuuauuc

SEQ ID NO: 738432 - RNA, 64 nt, hsa
caguuauaaaauggggcuugauuuguuuagacugaaggaagacguuuucccaaaauauacuaca

SEQ ID NO: 738433 - RNA, 64 nt, hsa
cuuucacaguaccaucugaauaccucuuugaaagaaggaagacuuuacguaguguagauuuguu

SEQ ID NO: 738434 - RNA, 64 nt, hsa
cccucccccucuggucuccucuuuguuuuguuuuaaggaagaaaaaucaguugcgcguucugaa

SEQ ID NO: 738435 - RNA, 64 nt, hsa
gauaggugggaggacuaacuuccagggugccaagaaggaagaaaagccccagguucucuuuucu

SEQ ID NO: 738436 - RNA, 64 nt, hsa
guagcccccacccuccugccaagcugccucugggaaggaagaaacaggagcuaggcagaagccu

SEQ ID NO: 738437 - RNA, 64 nt, hsa
auugugauuauugaaguucaugaaucuugcugucaaggaagaaagguaagaaagcugauagcuc

SEQ ID NO: 738438 - RNA, 64 nt, hsa
agagaaauacagccauuuuguuuuuaaugcagaaaaggaagauguucuguagcaagggggaaua

SEQ ID NO: 738439 - RNA, 64 nt, hsa
ugaugaugaugaagaugaugaugaggaugaagauaaggaagauacguuaccauugucaaagaaa

SEQ ID NO: 738440 - RNA, 64 nt, hsa
augauauuauggauccaauaaguaaauucauggaaaggaagaaauguauguuggaaaaaaaugg

SEQ ID NO: 738441 - RNA, 64 nt, hsa
aggugacccggaugcugacaucugcugcugcagaaaggaagacuuuucauuguaauuucgcuua

SEQ ID NO: 738442 - RNA, 64 nt, hsa
auucaaaauagucacuugagcucacaaaaaaagcaaggaagaauucucauguccuuugucuucc

SEQ ID NO: 738443 - RNA, 64 nt, hsa
acgcaggcaggggcgucaagggguuucucugcccaaggaagacagaacauggagaaccgucagg

SEQ ID NO: 738444 - RNA, 64 nt, hsa
ccaggcugugccagugugucccggacgcaucacuaaggaagagagaguuuauuuagucaacugg

SEQ ID NO: 738445 - RNA, 64 nt, hsa
gacaccugaugaccuguuagaugauggugaaauaaaggaagauacuaguuuugcugaaaaugac

SEQ ID NO: 738446 - RNA, 64 nt, hsa
acaaaguccaaaagucacuuuugaaugugaacaaaaggaagaaaaucaaggaaagaaugagucu

SEQ ID NO: 738447 - RNA, 64 nt, hsa
uaguucccaccaguugccuuccccucagggauggaaggaagaggguuucuugggcugguugagg

SEQ ID NO: 738448 - RNA, 64 nt, hsa
uuaacccuuucagacccagucuguuggagccaugaaggaagagggaaagagggcugccauuccu

SEQ ID NO: 738449 - RNA, 64 nt, hsa
cuuguuccugcauauuuuuuaaaauauugaauccaaggaagagagcccaaggguaggggagaaa

SEQ ID NO: 738450 - RNA, 64 nt, hsa
aacuucuccaccaagcauuugguuuauuuagaaaaaggaagaaaaacaaaaaacaaaaaacuaa

SEQ ID NO: 738451 - RNA, 64 nt, hsa
gcucaauuaaagauguuugaauccaaaggaagucaaggaagaaaaagcauggaaaggaagagaa

SEQ ID NO: 738452 - RNA, 64 nt, hsa
aauccaaaggaagucaaggaagaaaaagcauggaaaggaagagaacugauuccuacugaaaauu

SEQ ID NO: 738453 - RNA, 64 nt, hsa
gcacauauggagggcuggcuauaaagggcaccacaaggaagaagccaaacagauccagaaugug

SEQ ID NO: 738454 - RNA, 64 nt, hsa
uauuauugucauuaguauuagugaauucacguaaaaggaagaucuguagacauaauaaauguag

SEQ ID NO: 738455 - RNA, 64 nt, hsa
uaauucuuggagggggaaauaagggaauaaggccaaggaagauguauagcuuuagcuuuagccu

SEQ ID NO: 738456 - RNA, 64 nt, hsa
gaauccacauaccuuguguauugaaccccaggaaaaggaagaggucgaaccaacccugcggaag

SEQ ID NO: 738457 - RNA, 64 nt, hsa
cccuguucagagcagccggaguuugcuggaccacaaggaagaagagaagagacuugcagugaac

SEQ ID NO: 738458 - RNA, 64 nt, hsa
uccuuuuggggacacccaaaacacugcuugugagaaggaagauggaagguaaguucugucguuc

SEQ ID NO: 738459 - RNA, 64 nt, hsa
ucauauguucuaaaaugacuagcaaugguuuaaaaaggaagaagaguggaagugaagaaggugg

SEQ ID NO: 738460 - RNA, 63 nt, hsa
guuuuucuaccucuuuaacaguuaauauuuuuuaaaggaagaaauggaauguaccuucagggg

SEQ ID NO: 738461 - RNA, 64 nt, hsa
ggaaugaauccuaagaggcagggaucuuaaggacaaggaagagaagagagagagggagggaucu

SEQ ID NO: 738462 - RNA, 64 nt, hsa
aaaugaauuuuucauagaauuuacaguauauucaaaggaagaaagauaaaauuauuggucauca

SEQ ID NO: 738463 - RNA, 64 nt, hsa
ccagaauuuucuuuggaaauuguugagaaaaaccaaggaagauaaaacaaguugcauuuuuaag

SEQ ID NO: 738464 - RNA, 64 nt, hsa
gcaaaaguuuccauggaagcuguucagaaaaaucaaggaagaaaaaagcaaguuguucaauuuu

SEQ ID NO: 738465 - RNA, 64 nt, hsa
uucucacccagcaccuggggagaucggugcuaccaaggaagagagcacacagauaagacagagg

SEQ ID NO: 738466 - RNA, 64 nt, hsa
acuguuggacaaaaccauaacuuugucauuuuacaaggaagaaccucuuaagaaguccucagaa

SEQ ID NO: 738467 - RNA, 64 nt, hsa
uaagcugccaugcauuuuuuuuuuuacaguucucaaggaagagcacagaacaauuucucauuuc

SEQ ID NO: 738468 - RNA, 64 nt, hsa
uccucuccucuaaucuguguacacaucuccaagcaaggaagaaaaaacaaacucugcucagacg

SEQ ID NO: 738469 - RNA, 64 nt, hsa; identical to SEQ ID NO: 655163

SEQ ID NO: 738470 - RNA, 64 nt, hsa; identical to SEQ ID NO: 655164

SEQ ID NO: 738471 - RNA, 64 nt, hsa; identical to SEQ ID NO: 115778

SEQ ID NO: 738472 - RNA, 64 nt, hsa; identical to SEQ ID NO: 115779

SEQ ID NO: 738473 - RNA, 64 nt, hsa; identical to SEQ ID NO: 115780

SEQ ID NO: 738474 - RNA, 64 nt, hsa; identical to SEQ ID NO: 115781

SEQ ID NO: 738475 - RNA, 64 nt, hsa; identical to SEQ ID NO: 115782

SEQ ID NO: 738476 - RNA, 64 nt, hsa; identical to SEQ ID NO: 115783

SEQ ID NO: 738477 - RNA, 64 nt, hsa; identical to SEQ ID NO: 115784

SEQ ID NO: 738478 - RNA, 64 nt, hsa; identical to SEQ ID NO: 115785

SEQ ID NO: 738479 - RNA, 64 nt, hsa; identical to SEQ ID NO: 115786

SEQ ID NO: 738480 - RNA, 64 nt, hsa; identical to SEQ ID NO: 115787

SEQ ID NO: 738481 - RNA, 64 nt, hsa; identical to SEQ ID NO: 115788

SEQ ID NO: 738482 - RNA, 64 nt, hsa; identical to SEQ ID NO: 115789

SEQ ID NO: 738483 - RNA, 64 nt, hsa; identical to SEQ ID NO: 115790

SEQ ID NO: 738484 - RNA, 64 nt, hsa; identical to SEQ ID NO: 115791

SEQ ID NO: 738485 - RNA, 64 nt, hsa; identical to SEQ ID NO: 115792

SEQ ID NO: 738486 - RNA, 64 nt, hsa; identical to SEQ ID NO: 115793

SEQ ID NO: 738487 - RNA, 64 nt, hsa; identical to SEQ ID NO: 115794

SEQ ID NO: 738488 - RNA, 64 nt, hsa; identical to SEQ ID NO: 115795

SEQ ID NO: 738489 - RNA, 64 nt, hsa; identical to SEQ ID NO: 115796

SEQ ID NO: 738490 - RNA, 64 nt, hsa; identical to SEQ ID NO: 115797

SEQ ID NO: 738491 - RNA, 62 nt, hsa
aagggaaaaaagagaaaaacucaagucuauuacuuguagaguccaauucuuagcaauggaau

SEQ ID NO: 738492 - RNA, 62 nt, hsa
cccacucacuuugcucuaauucuuucuaguaucuuguagaucuaaugggucugggauaaaaa

SEQ ID NO: 738493 - RNA, 62 nt, hsa
caugcaaagcugauaacacaguugucuuuggacuuguagaccucuuggauuccaggugugau

SEQ ID NO: 738494 - RNA, 62 nt, hsa
ucugauuccuuuuucuaauccaugaaggccaucuuguagauuacauuuaucauuaaugcaag

SEQ ID NO: 738495 - RNA, 62 nt, hsa
aguguaaucuuguagaaaaagaguuguauaaucuuguagaauuucucauucugugguacaac

SEQ ID NO: 738496 - RNA, 62 nt, hsa
gaauggaauaaaaacaauaugaguaguguaaucuuguagaaaaagaguuguauaaucuugua

SEQ ID NO: 738497 - RNA, 64 nt, hsa
auuaaauaguugaugcaauuuuuaacguuaauugauauaaaaaaaaaaacaacaaaauuaggcu

SEQ ID NO: 738498 - RNA, 64 nt, hsa
ccaaguuagucaaguaugucucaacacuagcaugauauaaaaagggacacugcagcugaaugaa

SEQ ID NO: 738499 - RNA, 64 nt, hsa
aauaaagaauauugacaugaguauaccaguuuauauauaaaaauguuuuuaaacuugacaauca

SEQ ID NO: 738500 - RNA, 64 nt, hsa
cuaguucauuauaaaaaauaucuaggcauuguggauauaaaacuguuggguauucuacaacuuc

SEQ ID NO: 738501 - RNA, 64 nt, hsa
aaucuuaauuuggauuuaaggaagaaaucaauaaauauaaaauauaagcacauauuuauuauau

SEQ ID NO: 738502 - RNA, 64 nt, hsa
uuaaugagguauuuaccacugaagaaauaugauaauauaaaaccaucaaauuuuauaauugaga

SEQ ID NO: 738503 - RNA, 64 nt, hsa
ccaaagaguugaaaucuuaaaucuauuuaaaaggauauaaaagcuuuggauauguauuuuuagu

SEQ ID NO: 738504 - RNA, 64 nt, hsa
ugaucuuaaaccuaugauucaguaacuucuuaccauauaaaaacgauaauugcuuuauuuggaa

SEQ ID NO: 738505 - RNA, 64 nt, hsa
agaccauuaauggucuucuccaaaauauuuugagauauaaaaguaggaaacagguauaauuuua

SEQ ID NO: 738506 - RNA, 64 nt, hsa
ucugaaggcuuguuuuuaguccucauuguacaaaauauaaaauaaucauauugcuaugaauacc

SEQ ID NO: 738507 - RNA, 64 nt, hsa
auuuucuggguuuuaucauuuugccuaaaauaggauauaaaagggacaaaaaauaaguagacug

SEQ ID NO: 738508 - RNA, 64 nt, hsa
ucuccagagauguugguuucuacagcaacccuagauauaaaauuguggcuuuaaaaaugcauga

SEQ ID NO: 738509 - RNA, 64 nt, hsa
aaaaaacuuuuuucauuguggucuuaacacuuuuauauaaaaaugaaaauggaaaaaaaguccc

SEQ ID NO: 738510 - RNA, 64 nt, hsa
acauugaguuuaauucagcaacaacaaaaaauacauauaaaacuagaaagggacuuuuuuuccu

SEQ ID NO: 738511 - RNA, 64 nt, hsa
uuuaagucauuuuaacuuuuuuuucugccuuacgauauaaaaauauuuaucuuagaauuugaga

SEQ ID NO: 738512 - RNA, 64 nt, hsa
uuccagacuuucuaaaacauucugcuuaaaaaccauauaaaauauaauuccaaagucucugcug

SEQ ID NO: 738513 - RNA, 64 nt, hsa
accaguagaauuuaaauugguugguugauuguuuauauaaaacacacuaaaauuauauuuuaaa

SEQ ID NO: 738514 - RNA, 64 nt, hsa
aauuguacagcuguuguaauaaugaccuauuucuauauaaaauaaaauuguauggcuuaugugu

SEQ ID NO: 738515 - RNA, 64 nt, hsa
auuuuguaucugagauaccaguuccuuuucccaaauauaaaaguauaaaaguuuucuuguguuu

SEQ ID NO: 738516 - RNA, 64 nt, hsa
uccccauucgauaauauaguaacucagaauuuucauauaaaauugaauucuacucauuagagua

SEQ ID NO: 738517 - RNA, 64 nt, hsa
gugccaaaaaucucuauuuuaaaugaaaauauuuauauaaaaauacauuuauucugcuuaacac

SEQ ID NO: 738518 - RNA, 64 nt, hsa
uugugggggaaugccuaauaaauacauugacuauauauaaaaugaauauauacauacacaugua

SEQ ID NO: 738519 - RNA, 64 nt, hsa
uagcaauaaaaucuaauuuuuaaaaaguauauaaauauaaaauguauaaaugauggauagauuu

SEQ ID NO: 738520 - RNA, 64 nt, hsa
guaacuaguacuaauuauaaauauaaaauacacaauauaaaauaugaaacucaauaauaaacag

SEQ ID NO: 738521 - RNA, 64 nt, hsa
uccaugucauauguguaacuaguacuaauuauaaauauaaaauacacaauauaaaauaugaaac

SEQ ID NO: 738522 - RNA, 64 nt, hsa
aauuaaguuggacuaacauucacguaucaaacuaauauaaaaagaaauaaaaccaagaggugau

SEQ ID NO: 738523 - RNA, 64 nt, hsa
uacuuauaacuguuauuaaauaccaaaucaaauaauauaaaagcuguaacauuuccuuuaaaac

SEQ ID NO: 738524 - RNA, 64 nt, hsa
uaaagagaggcccaagcauagcugguuaugugaaauauaaaaugggguguuguucucccuuuaa

SEQ ID NO: 738525 - RNA, 64 nt, hsa
caucaauuuguaauuuaggguacuuacaaggcacauauaaaauaauuucccaugcuggaaauuc

SEQ ID NO: 738526 - RNA, 64 nt, hsa
gaacauaaaaagcacacauagucuugacaaauguauauaaaauucucuguuggaauuugccuac

SEQ ID NO: 738527 - RNA, 64 nt, hsa
aaaaguuuacuaucugaaaauauuugaauguugaauauaaaaaaauguuuuauauagaacauaa

SEQ ID NO: 738528 - RNA, 64 nt, hsa
ugguaaagauugccuucuguauaauguuuggauuauauaaaauugcaaaaaugauaacagcccg

SEQ ID NO: 738529 - RNA, 64 nt, hsa
cacucauagcauuucuauauuugaaaguagcccaauauaaaacuuuugauucuaaaauuaaacc

SEQ ID NO: 738530 - RNA, 64 nt, hsa
auuucaauuuuuaucaauucauaaauuaaaaacaauauaaaaauuccagagggguguguguaua

SEQ ID NO: 738531 - RNA, 64 nt, hsa
uagagagguaagcauuaguggcacagcugagaaaauauaaaagguaguucugucucuauccugu

SEQ ID NO: 738532 - RNA, 64 nt, hsa
cugccaugggccagccuagcccuugucccuuuuaauauaaaagauauauauauauauauauaua

SEQ ID NO: 738533 - RNA, 64 nt, hsa
uuuuaauauaaaagauauauauauauauauauauauauaaaauaucuauauucuauacacaccc

SEQ ID NO: 738534 - RNA, 64 nt, hsa
caagaauacagcuguagggucauugcuuuaaauuauauaaaauguaucugucuauaaagaagau

SEQ ID NO: 738535 - RNA, 64 nt, hsa
uaaauuauauaaaauguaucugucuauaaagaagauauaaaauugugacuuuauucuacuguaa

SEQ ID NO: 738536 - RNA, 64 nt, hsa
acuuauauagcaauuguuuaaaguuaucaauuguauauaaaaucacaguagccugcuaaaucau

SEQ ID NO: 738537 - RNA, 64 nt, hsa
ugcaaauuauucagccuccaaaugcaaaugaaugauauaaaaauaaguagggaacauggcagag

SEQ ID NO: 738538 - RNA, 64 nt, hsa
uugacucucucaucugucuaaagaguacuggacgauauaaaaauauauauuuuuuaaacaaugu

SEQ ID NO: 738539 - RNA, 64 nt, hsa
uacuaucaguuuugauauaacuauauauauauaaauauaaaauuauauauaaaggguuauuuga

SEQ ID NO: 738540 - RNA, 64 nt, hsa
cacugcugagcuguauuuaaaauuuugguacaauauauaaaauggagaagagcuugauauucag

SEQ ID NO: 738541 - RNA, 64 nt, hsa
guauaaaauauuauuuuaaacagcgaaauuaauaauauaaaaugccaaaugguugaaaaaauag

SEQ ID NO: 738542 - RNA, 64 nt, hsa
aauuuucccaaauuguaauaacugugauacaugcauauaaaaaaauccuuaaugucaacacacu

SEQ ID NO: 738543 - RNA, 64 nt, hsa
uaaguugaacugcucugcauuaauuacagauuuaauauaaaaugaacugauuauauauuggaau

SEQ ID NO: 738544 - RNA, 64 nt, hsa
aaauauauauaaaccuaaaaaagauauauuaaaaauauaaaacugcguuaaaggcucgauuuug

SEQ ID NO: 738545 - RNA, 64 nt, hsa
uauggcagaguuguaaauauauaaauauauauauauauaaaauaaauauauauaaaccuaaaaa

SEQ ID NO: 738546 - RNA, 64 nt, hsa
agauaugaaagaugaauauaagaauucauccuagauauaaaaccauagaaauguaaaagaugug

SEQ ID NO: 738547 - RNA, 64 nt, hsa
augauauccuuuauauucgagaaaaguuauagaaauauaaaaaauauagaaaagucauaucucc

SEQ ID NO: 738548 - RNA, 64 nt, hsa
auguugccuuuagcuucuugaagauuuagaaguuauauaaaaaauuaauuuaaaagcaaaccaa

SEQ ID NO: 738549 - RNA, 64 nt, hsa
guuugguuucagugguccagcuuuauuuacaggcauauaaaaugaaauugugagauguuuugca

SEQ ID NO: 738550 - RNA, 64 nt, hsa
gaggcauucacuagaggugaaaacuugucagaauauauaaaagcuuagauuguagcuguucuaa

SEQ ID NO: 738551 - RNA, 64 nt, hsa
uaguuccaaaaccaaaaaaagugccuguggauguauauaaaauuaagaugauaagaaagugcuc

SEQ ID NO: 738552 - RNA, 64 nt, hsa
ccugcuccuuauugccauacccacgaacuguuaaauauaaaaaaauucaaaguauuugacaucu

SEQ ID NO: 738553 - RNA, 64 nt, hsa
ucacaguaaguucuauuagugaugauagaaccagauauaaaauuguucagugauggagaaaaga

SEQ ID NO: 738554 - RNA, 64 nt, hsa
augccaaacauguuggcaucaauuuuauacagggauauaaaaaaguauauguggauaaauuuuu

SEQ ID NO: 738555 - RNA, 64 nt, hsa
guauauguggauaaauuuuuuguaaucuuuagggauauaaaaaaguguauguggauaaauuuuu

SEQ ID NO: 738556 - RNA, 64 nt, hsa
guguuuacuguacuauuucaaagcuucuaaauaaauauaaaauauauauauuauauuauauaau

SEQ ID NO: 738557 - RNA, 64 nt, hsa
auuuuacauaguuuugugacuuaauuacacaugaauauaaaaucuauaauucuauaugaauaua

SEQ ID NO: 738558 - RNA, 64 nt, hsa
guguuuuacguuuuuuauccugcugaaaaaguauauauaaaauaucuaacauuacaggauagag

SEQ ID NO: 738559 - RNA, 64 nt, hsa
uccuccccacccacccauguuuuuaaacuaauuuauauaaaaucuggaggcuguuacagcuaac

SEQ ID NO: 738560 - RNA, 64 nt, hsa
uuuaaauuauaaaggacugaauaaucuaaaaagcauauaaaaguuucacacagcauaaaagaua

SEQ ID NO: 738561 - RNA, 64 nt, hsa
gacagagcaagaccaccaucuccaaaaauuauauauauaaaaauaauuaauauuauagaagaga

SEQ ID NO: 738562 - RNA, 64 nt, hsa
agagaauauacacaacucagagaugcaauggauaauauaaaaagaguaccugagauguauuuuu

SEQ ID NO: 738563 - RNA, 64 nt, hsa
aguaaaugcccuacauggugugaugcugcauuauauauaaaacugugugcauauauuaaauuuu

SEQ ID NO: 738564 - RNA, 64 nt, hsa
uaaguuuguuaaaguauuuuuuauaaacagcuuaauauaaaacauuauagauuuaguguuuggc

SEQ ID NO: 738565 - RNA, 64 nt, hsa
cugugucuuguuauaguaguacauuaugaaucacauauaaaaucuuacaauacagaacaacugu

SEQ ID NO: 738566 - RNA, 64 nt, hsa
ggaaaauucauuuucuuugcauuauuccaguaauauauaaaaacugugucuuguuauaguagua

SEQ ID NO: 738567 - RNA, 64 nt, hsa
aucauauuccggggaucaucacaucaguccaaggauauaaaaaaauggaagauuaaaaacucaa

SEQ ID NO: 738568 - RNA, 64 nt, hsa
aaaauuucuauuucuuuugcuuaaggaauaguucauauaaaaauaugcuaaagauaggauaaaa

SEQ ID NO: 738569 - RNA, 64 nt, hsa
uagucuugcuuauuuuguugcgaaggccaguggaauauaaaaaucaauggcauuaaugaggagc

SEQ ID NO: 738570 - RNA, 64 nt, hsa
agauugaaaagacuaaugagaagauaacaugacaauauaaaaagacagaaacucaaaaaguaua

SEQ ID NO: 738571 - RNA, 64 nt, hsa
agaaguuuuguuuuugaaauguguauuucuaauuauauaaaauauuaagaaucuuuuaaaaaaa

SEQ ID NO: 738572 - RNA, 64 nt, hsa
auaaaaauauguacauuacauuuugcuuauuuucauauaaaagguaagacagaguuugcaaagc

SEQ ID NO: 738573 - RNA, 64 nt, hsa
auaaaucugggucugcaucucuuauuaaauaaaaauauaaaaauauguacauuacauuuugcuu

SEQ ID NO: 738574 - RNA, 64 nt, hsa
agcaguuaauaguaugaucuuuaaaguuuugacaauauaaaauaaacuugguaacuguuuuaca

SEQ ID NO: 738575 - RNA, 64 nt, hsa
acaauauaaaauaaacuugguaacuguuuuacaaauauaaaaguauaauaaauaugcagcccag

SEQ ID NO: 738576 - RNA, 64 nt, hsa
guugaaaaauaucuuugcaucauagaacagaaauauauaaaaauauauguugaauguuaacagg

SEQ ID NO: 738577 - RNA, 64 nt, hsa
uaaaugaacugauuuuuauuaacugcuuuugcccauauaaaaugcugauauuuacuggaaaccu

SEQ ID NO: 738578 - RNA, 64 nt, hsa
ucuuguaaaguccauuuauguuaaucaaaguugaauauaaaaauccaccauugccuguuagcca

SEQ ID NO: 738579 - RNA, 64 nt, hsa
cgguguuuuuauuuuuuuuuucuuauggaaaaaaauauaaaagaucacauauacugauuuuaaa

SEQ ID NO: 738580 - RNA, 64 nt, hsa
aaguucuccauauugccuuaugucccaaagccaaauauaaaaauauaaaugaugcuuuguauaa

SEQ ID NO: 738581 - RNA, 64 nt, hsa
gauuuuagaaggaacuuugcucucuacugucacuauauaaaaccaauuauguuauguuauuaga

SEQ ID NO: 738582 - RNA, 64 nt, hsa
gucauuguggauguuaccuuuuucagauccaagcauauaaaaagccuguauauuuuuuaaaaac

SEQ ID NO: 738583 - RNA, 64 nt, hsa
aaauuucaauguuaagugucugcuuuaugggcauauauaaaaguagacacauuucauuuguuaa

SEQ ID NO: 738584 - RNA, 64 nt, hsa
ucagaguucacugauugauuuaaaugucaaucucauauaaaacacccucacagaaacaccuaga

SEQ ID NO: 738585 - RNA, 64 nt, hsa
aaccauaccauuaacuugaacagggauaauuuuaauauaaaaacuguuaacugauaaugguauu

SEQ ID NO: 738586 - RNA, 64 nt, hsa
uuuauuucuuuuacuuuuuuuaguaaguuaauguauauaaaaauggcuucggacaaaauaucuc

SEQ ID NO: 738587 - RNA, 64 nt, hsa
aaaguuugaaaagcaauauuguauauuuuuaucuauauaaaauaacuaaaauguaucuaagaau

SEQ ID NO: 738588 - RNA, 64 nt, hsa
aaccagccugggcaaaacccugucucuacuaaaaauauaaaaauuagccaggcaugauggcaca

SEQ ID NO: 738589 - RNA, 64 nt, hsa
uggccaacauggcaaaaccccgucucuaugaaaaauauaaaaauuagcugggcaugguggcagg

SEQ ID NO: 738590 - RNA, 64 nt, hsa
gauaaaaugcaucuuguuacuacaaauguuauauauauaaaaucaaguugagcuuugccuugau

SEQ ID NO: 738591 - RNA, 64 nt, hsa
gauaauuuugaaaagaaauagaaauuaagcuacuauauaaaacaauuguuuacguguacuuuua

SEQ ID NO: 738592 - RNA, 64 nt, hsa
augucuagcaucaaaugaguauuguaaaagacuaauauaaaaugguuuauaagacugauguaua

SEQ ID NO: 738593 - RNA, 64 nt, hsa
aaauaaaauuuuaacccaaaugaauaacuaagaaauauaaaacaagcacaaaaucuuagggaag

SEQ ID NO: 738594 - RNA, 64 nt, hsa
cugguuauaaaccuugcuaaugaaaauacaauacauauaaaaauguauagccauguuauuuucu

SEQ ID NO: 738595 - RNA, 64 nt, hsa
aaaugcuacuuaaaacuuugguuguuuuccuguaauauaaaagaaaaaguuaauuuaucaauug

SEQ ID NO: 738596 - RNA, 64 nt, hsa
uuacgugaccggcaaauaaaucucauagcaguuaauauaaaacaucuuuggaggaugggagaga

SEQ ID NO: 738597 - RNA, 64 nt, hsa
cgcugcccccugagaaaacacuugaauugacgcaauauaaaacaaaaugugaaaaccaaagugg

SEQ ID NO: 738598 - RNA, 64 nt, hsa
uugauucuauguugucuggaaaaaauauggaauuauauaaaaagggaugcuuuuauauauuuuu

SEQ ID NO: 738599 - RNA, 64 nt, hsa
uaaagcaaugaagcaauggaguauuaucucacaaauauaaaaccacuauaagacaaacauuuga

SEQ ID NO: 738600 - RNA, 64 nt, hsa
guuuuccaugucuucucuggucaccuuggauuauauauaaaaauacaggaaauagauaaacaug

SEQ ID NO: 738601 - RNA, 64 nt, hsa
cuuagauagaaauuggucuuaauuuauauaaucaauauaaaauacuaaugcaauucuacagcau

SEQ ID NO: 738602 - RNA, 64 nt, hsa
auuuaaaaacaaaaaaacacaaaaaaauaguaaaauauaaaaacaaauuaauguuuuauagacc

SEQ ID NO: 738603 - RNA, 64 nt, hsa
aaacuuaaauauuauggaaaaaaaacauugcaaaauauaaaauaaauaaaaaaaggaaaggaaa

SEQ ID NO: 738604 - RNA, 64 nt, hsa
cauuuccuugccugacaguauuuuugaauuauuuauauaaaauaucuaucuuuucaucaugucu

SEQ ID NO: 738605 - RNA, 64 nt, hsa
uuaaaaaaauuugcuuaguaaagguuauuuugugauauaaaaugggauuuauaaaaauauuaga

SEQ ID NO: 738606 - RNA, 64 nt, hsa
guuugaguucagccucuucauuuacuccauuuacauauaaaagaucuugaaaagguaguuguua

SEQ ID NO: 738607 - RNA, 64 nt, hsa
cucuagguaauugauuuaaguauaaaauccaaucauauaaaaacuuuaaugaauuaggauaaca

SEQ ID NO: 738608 - RNA, 64 nt, hsa
cuucugcaacaucuuaagauccacaaaugaagggauauaaaaauaaugucauagguaagaaaca

SEQ ID NO: 738609 - RNA, 64 nt, hsa
augugcugccugcaagcuucuuuuuucucauuaaauauaaaauauuuuguaaugcugcacagaa

SEQ ID NO: 738610 - RNA, 64 nt, hsa
caguugagcucccaagaccaggacccacuggggcauauaaaaaagucaaaaaucaaaaucaaac

SEQ ID NO: 738611 - RNA, 64 nt, hsa
caguugagcucccaagaccaggacccacuggggcauauaaaaucucugcuguauccuuucggcu

SEQ ID NO: 738612 - RNA, 64 nt, hsa
uuuauugaauaccagggucauaucuuagaauuguauauaaaacaacauguaacccauucaugaa

SEQ ID NO: 738613 - RNA, 64 nt, hsa
gggaaauugauuuuuaaggagcgauucuuuuccuauauaaaagcuauugaggcuuagcuuuauu

SEQ ID NO: 738614 - RNA, 64 nt, hsa
uguacaugaauauauauauauucauguaucuuguauauaaaauauaggcauauaccucauauau

SEQ ID NO: 738615 - RNA, 64 nt, hsa
ucauguagcguaucacauaacuuuuuugcaaaaaauauaaaaagaaauaaacuucaauguauuu

SEQ ID NO: 738616 - RNA, 64 nt, hsa
acugugcuagugacuggaggcccugcuacugcaaauauaaaacauaaaguuuguuuaaaaaaau

SEQ ID NO: 738617 - RNA, 64 nt, hsa
uuaaaaaugugcauuuuauauaaagaugcauuuuauauaaaaaugcacaccuuuaaucucuaua

SEQ ID NO: 738618 - RNA, 64 nt, hsa
uuuaaucucuauauggcagcauauacauauauauauauaaaaugcacacuuuuaaucucuauau

SEQ ID NO: 738619 - RNA, 64 nt, hsa
uuauauacuguuaaaauuugagguacuguaguuuauauaaaagucggauguuaagauauuauau

SEQ ID NO: 738620 - RNA, 64 nt, hsa
uuugcagucauuaacaugacaaauuaaguaauaaauauaaaagugauuguccauaaauuaucau

SEQ ID NO: 738621 - RNA, 64 nt, hsa
accagccugggcaauguagcaagaccccaucucuauauaaaauauaaaaauguuggcugugcac

SEQ ID NO: 738622 - RNA, 64 nt, hsa
ugggcaauguagcaagaccccaucucuauauaaaauauaaaaauguuggcugugcacgguagcu

SEQ ID NO: 738623 - RNA, 64 nt, hsa
auguuucaaaacucagaugcauaaaacguaagguauauaaaaauacaucuaugcuugcguuuga

SEQ ID NO: 738624 - RNA, 64 nt, hsa
cuggguauggaaauaacccugugaugauguguuaauauaaaauguugggagggaauauucccaa

SEQ ID NO: 738625 - RNA, 64 nt, hsa
uaugagcuccaagacacuuacugaucuacugugaauauaaaauguuauuagccuuaucaaauaa

SEQ ID NO: 738626 - RNA, 64 nt, hsa
cacgugugcauacacacauacccuauaccccacuauauaaaagucauauuauuauaaauuuccu

SEQ ID NO: 738627 - RNA, 64 nt, hsa
cagggcaggaguauucuggaaucuuuuuacuuagauauaaaauaaaccucgaauauuaaaaagu

SEQ ID NO: 738628 - RNA, 64 nt, hsa
uagagcuuuauauauuaaagagagguauuggugcauauaaaaacaguaauauuauuguuaugcu

SEQ ID NO: 738629 - RNA, 64 nt, hsa
uugaaaaauauaaguaauuuggcauauugacccuauauaaaaaagugggcauuuuguaacauuc

SEQ ID NO: 738630 - RNA, 64 nt, hsa
augguaaaaugagugaucucaaauccacugacagauauaaaauaggcuuagagaggaaaagcug

SEQ ID NO: 738631 - RNA, 64 nt, hsa
gacuccauuucaaaaaaaaaaaaaaaauccacucauauaaaaggugagcucagcucacuggucc

SEQ ID NO: 738632 - RNA, 64 nt, hsa
aauuauauauaucuugccucccugauggaaaacuauauaaaauuguagacuuaaaagguuugug

SEQ ID NO: 738633 - RNA, 64 nt, hsa
uuagagacuaagcccucuuaaaaccuuuaguuaaauauaaaaagaaauuauauauaucuugccu

SEQ ID NO: 738634 - RNA, 64 nt, hsa
auugucuguguacccagaguuuacaauuauguccauauaaaauucuagcccagaaguucucauc

SEQ ID NO: 738635 - RNA, 64 nt, hsa
aaguuauauguggauaacuguaugccuaaguaguauauaaaagcugugcccuagcguaaacagu

SEQ ID NO: 738636 - RNA, 64 nt, hsa
caauaguuugccccuuuuggaaugaucucugaauauauaaaacacacacacaaagagcaauagu

SEQ ID NO: 738637 - RNA, 64 nt, hsa
caauaguuugccccuuuuggaacgaccccugaauauauaaaacacacacacaccccgcgcacuc

SEQ ID NO: 738638 - RNA, 64 nt, hsa
aaauagaugaugguaugauucuauuauauauuuuauauaaaauccauccaaauuaaguuuuggg

SEQ ID NO: 738639 - RNA, 64 nt, hsa
aggaauggaaucuucuccaguaugaaauuaccagauauaaaauaauguaaugaugcugaggaua

SEQ ID NO: 738640 - RNA, 64 nt, hsa
guggaaaacaguguacuuuuuaaaaaauugcugaauauaaaaucuuugaaaauuuucuuuaugu

SEQ ID NO: 738641 - RNA, 64 nt, hsa
uaggcuccaguguuauacuuuuuuuuauauauauauauaaaaauaaacuuuacguagugaaauc

SEQ ID NO: 738642 - RNA, 64 nt, hsa
auauauacagaauaauacacacaguugugugugcauauaaaauacauauuuacgccaggcgugg

SEQ ID NO: 738643 - RNA, 64 nt, hsa
auuugacuacauuaguauuagugacaucagguggauauaaaagaaaacccuuggaaagagaacu

SEQ ID NO: 738644 - RNA, 64 nt, hsa
acauggaauuucauugaaaauaguuuaauuuuuuauauaaaagguuuuguauauaauguguguc

SEQ ID NO: 738645 - RNA, 64 nt, hsa
caauagaauuauucuggauaauucuauaucuagaauauaaaaucuggucuuauagcuagacaug

SEQ ID NO: 738646 - RNA, 64 nt, hsa
ugguuugguugguuucagucauuuguuuggggagauauaaaaggcucaggagagcaggcuuuug

SEQ ID NO: 738647 - RNA, 64 nt, hsa
auauuuuguuaaucuaugccauuaguaguauuauauauaaaauauaguuccccgucccccuuuu

SEQ ID NO: 738648 - RNA, 64 nt, hsa
uuuggaagaacauacaguauucagaaacuaaccuauauaaaauguaaacaauauauugauugca

SEQ ID NO: 738649 - RNA, 64 nt, hsa
uacuugcuuuaauucuuaagcauaaguaaacaugauauaaaaauauaugcugaauuacuuguga

SEQ ID NO: 738650 - RNA, 64 nt, hsa
gauaaagauuuuaaaugguauuacguauaaauuaauauaaaaugauuaccucugguguugacag

SEQ ID NO: 738651 - RNA, 64 nt, hsa
aucauaguauaaaucuaugauauauuuauaucauauauaaaagucugaguucucuuucuuaguc

SEQ ID NO: 738652 - RNA, 64 nt, hsa
guauaugauuauaaugcuauuuuaaaaaauauauauauaaaauauuuuuuucuuuuuaaaauag

SEQ ID NO: 738653 - RNA, 64 nt, hsa
aggagcucaacuaaaaguggcauagagaauacacauauaaaaacaauauauuugucauaugcuc

SEQ ID NO: 738654 - RNA, 64 nt, hsa
auuuacuuuucugaucucuuugagaaauagagaaauauaaaaguguguucuuaacuccagaacc

SEQ ID NO: 738655 - RNA, 64 nt, hsa
gacaaauucugacuguuggggaacuuacucugcaauauaaaaauaucuucaugcucugguaggg

SEQ ID NO: 738656 - RNA, 64 nt, hsa
guugcucucagaaaaaaaaaaaaagcauauauauauauaaaauaaaauuuaggccaugggaacu

SEQ ID NO: 738657 - RNA, 64 nt, hsa
gaaaauucaugaacuauucucucauaucccugaaauauaaaaguaaguggccacuauuccuaag

SEQ ID NO: 738658 - RNA, 64 nt, hsa
gauauuugggauccucuuuucuauguauguauauauauaaaaaacuaugaaucacucacacuca

SEQ ID NO: 738659 - RNA, 64 nt, hsa
uuuuuaauaguuugaaaugaugauaauccuaauuauauaaaaauauauauauaaacacacauau

SEQ ID NO: 738660 - RNA, 64 nt, hsa
uucugcagagaggaagauauguuuuugcugcuuuauauaaaaaugguuuuuuuaaguuauuuua

SEQ ID NO: 738661 - RNA, 64 nt, hsa
uuuauauuuggaaauauauauuuaagaauuauauauauaaaaauauauauguauaagaguuaug

SEQ ID NO: 738662 - RNA, 64 nt, hsa
auauauguauaagaguuauguauuugaaaaaaauauauaaaagaauauacaucacaauauaaua

SEQ ID NO: 738663 - RNA, 64 nt, hsa
caccugugcccacuuugaccauuggugaggauagauauaaaaucacuucuuccaacgaagccua

SEQ ID NO: 738664 - RNA, 64 nt, hsa
aaugguguaaaauuacauucagcuccuucuugucauauaaaaggaauuuggagggugucgcuua

SEQ ID NO: 738665 - RNA, 64 nt, hsa
uccaugagaauuauuacuuuaaaaacaaaacaaaauauaaaaaacuguguuugaguaaacugau

SEQ ID NO: 738666 - RNA, 64 nt, hsa
aguucaauaauaacuaaggcugugauuuuuuucaauauaaaaggcacagcuguuggccaaagug

SEQ ID NO: 738667 - RNA, 64 nt, hsa
aauuuaaauaaaagugaaccauauuuaucugguuauauaaaacuaaaaauggggguguuuauau

SEQ ID NO: 738668 - RNA, 64 nt, hsa
aucugguuauauaaaacuaaaaauggggguguuuauauaaaacuaaaaacuaagaaugauguaa

SEQ ID NO: 738669 - RNA, 64 nt, hsa
auacaaguuucugaauauuuuaaaucuuaacaucauauaaaaagcagcagaggugagaacucag

SEQ ID NO: 738670 - RNA, 64 nt, hsa
uuccccgaauucuauuuuuguccuugcagacagaauauaaaaacuccugggcuuaaggccuaag

SEQ ID NO: 738671 - RNA, 64 nt, hsa
aacugagaccucagaguauguaggaguaaauaguauauaaaauagcucugguggcucaugccug

SEQ ID NO: 738672 - RNA, 64 nt, hsa
aucugcuccccaaaaacuauugaaauaaaauaaaauauaaaaagaaagagaaagaaaagaaaau

SEQ ID NO: 738673 - RNA, 64 nt, hsa
agaguagauauuugauauaccacucugauaacucauauaaaaauaucaucauaaaaagcuuaau

SEQ ID NO: 738674 - RNA, 64 nt, hsa
aggaauaccucuuuauacgucuacauauuuuaguauauaaaaauagauaaugcucuuggacaca

SEQ ID NO: 738675 - RNA, 64 nt, hsa
uagguuuuaaaucaguggguaucauaaaagccauauauaaaagauccuuucuuauaguaagacu

SEQ ID NO: 738676 - RNA, 64 nt, hsa
guuuauguuuauuguauuuuauaugaucuacaacauauaaaauuguguauuuuucuuugguugu

SEQ ID NO: 738677 - RNA, 64 nt, hsa
aauuccuaggauaugugaucgugaaucagaucacauauaaaaagucuggauugucaguaguauu

SEQ ID NO: 738678 - RNA, 64 nt, hsa
gauuauucauucuaucucagaguuaccggcaagcauauaaaaugcuacuuggauaauaucuaca

SEQ ID NO: 738679 - RNA, 64 nt, hsa
acuguauauuaauugagguuacagaaaguucuuuauauaaaacuuauuuaaauuuuucauauuu

SEQ ID NO: 738680 - RNA, 64 nt, hsa
guucucguuuuucuacagauauaaguaaauuuauauauaaaaauaccaaaaagaggcugggcgu

SEQ ID NO: 738681 - RNA, 64 nt, hsa
acuuugugaguauucuauguaaaaauauauauguauauaaaauauauauugcauaggacagacu

SEQ ID NO: 738682 - RNA, 64 nt, hsa
cuauauuuguaacuuugcauguucuuguuuuguuauauaaaaaaauuguaaauguuuaauaucu

SEQ ID NO: 738683 - RNA, 64 nt, hsa
caagauaauucacucuacucagccggcguggcaaauauaaaacuuacagagcguggcugugcuc

SEQ ID NO: 738684 - RNA, 64 nt, hsa
guauaaacauuaaaugucuuauauagcagcaaaaauauaaaauaguuguccauauuuucacagg

SEQ ID NO: 738685 - RNA, 64 nt, hsa
agagaaauggcaaguuuugauaugaguauacaauauauaaaaauauauauagugcuauauauau

SEQ ID NO: 738686 - RNA, 64 nt, hsa
cugccuuuugccacucuuaaaaauugugcccaaaauauaaaaguguggaacuuuagaacuugga

SEQ ID NO: 738687 - RNA, 64 nt, hsa
ucuuaagauaucuggaggcaugcucugaaauccuauauaaaagaguuuaaacugaacuuuaagg

SEQ ID NO: 738688 - RNA, 64 nt, hsa
auuauaggauuuuuuucuuuuuuaguaaaaaccuauauaaaaaccaaaauuauaggauuuuuuc

SEQ ID NO: 738689 - RNA, 64 nt, hsa
cggggguaauagagccacuggugaguaaaaaccuauauaaaaaccaaaauuauaggauuuuuuc

SEQ ID NO: 738690 - RNA, 64 nt, hsa
aauuuauauauauauauaugagauauauaaauauauauaaaauagcuauuuugcuuaaauuucu

SEQ ID NO: 738691 - RNA, 64 nt, hsa
ucuuucuacuccaggacugguuuuguuuuuauauauauaaaaaaaaaaagugaaaacaccaaug

SEQ ID NO: 738692 - RNA, 64 nt, hsa
ucuccuuucuucucucuguauauuuuguuauuuuauauaaaauaggagauaaaagucacauuga

SEQ ID NO: 738693 - RNA, 64 nt, hsa
aaaaagagagagaaaagaaaagaaaucacaauguauauaaaacaguacuuauguuuuaaaauua

SEQ ID NO: 738694 - RNA, 64 nt, hsa
gaauuauuaagcauaugugcuuucgcagcugauaauauaaaaggaaaucccacagucuagauau

SEQ ID NO: 738695 - RNA, 64 nt, hsa
uaaaaaacguacucuuauuaucuggaacauagaaauauaaaagguaacaucuaaagcuuagaau

SEQ ID NO: 738696 - RNA, 64 nt, hsa
auuauccaguagaaaauguuaggauaugugugcuauauaaaaaaaaaaaaagacuuguuaaguu

SEQ ID NO: 738697 - RNA, 64 nt, hsa
uauaacugauugaugaaagggcauauuuaggucaauauaaaauaauagcaaguauuuacugaga

SEQ ID NO: 738698 - RNA, 64 nt, hsa
accuuaauguuuauuuaucauccaaguguucuugauauaaaaucaguauacagaaaauuuuaag

SEQ ID NO: 738699 - RNA, 64 nt, hsa
uaacuuugcuacccuggauucugaugcaauuucaauauaaaaaguuguuccuuucauaguuuuu

SEQ ID NO: 738700 - RNA, 64 nt, hsa
ucuaaggucuaucaagucaaucauuucucacuguguacauaaugcuuaauuucuaaagauaaua

SEQ ID NO: 738701 - RNA, 64 nt, hsa
uaaaaaaaaaaguuacagaaauacuauaacauauguacauaaauugcauaaagcauaaguauac

SEQ ID NO: 738702 - RNA, 64 nt, hsa
caggacuuaaaaugacauucaguauauaaaauauguacauaauauuggaugacuaacuaucaaa

SEQ ID NO: 738703 - RNA, 64 nt, hsa
gccaaaacagauccacaguaguuguugaguucaaguacauaaaguacauaacaagcgaacgucu

SEQ ID NO: 738704 - RNA, 64 nt, hsa
gauccacaguaguuguugaguucaaguacauaaaguacauaacaagcgaacgucuaguacaauu

SEQ ID NO: 738705 - RNA, 64 nt, hsa
cuuggugagucagggugccuguaggaaguggcuuguacauaaucccagcucugcaaagcucucu

SEQ ID NO: 738706 - RNA, 64 nt, hsa
uucauuccugggauccuaucauuugaacagcauuguacauaacuuggggguaugugugcaggau

SEQ ID NO: 738707 - RNA, 64 nt, hsa
aucauugccuagaagucaauauucaauaaaucuuguacauaacuauuucgauggcaaauguuaa

SEQ ID NO: 738708 - RNA, 64 nt, hsa
cggagacucaccuucccgagcuaacuuaacuacuguacauaauaauauguauuaaacugguauc

SEQ ID NO: 738709 - RNA, 64 nt, hsa
uuaaaauagucaagacaacacugaccuugcacuuguacauaacuauacaguaguguccagaaug

SEQ ID NO: 738710 - RNA, 64 nt, hsa
acaguaguguccagaauguucagacauucggaguguacauaaaacagaaaaaaucuucauguau

SEQ ID NO: 738711 - RNA, 64 nt, hsa
ugaccuuuuuuccuguucacaagcugagccauauguacauaaucuagauuuuguuuucauaguu

SEQ ID NO: 738712 - RNA, 64 nt, hsa
ggugaaagcuacugaaauaagcugugauuguacuguacauaaaacauaugaggaaucugcaagg

SEQ ID NO: 738713 - RNA, 64 nt, hsa
cacagcauaaacugaggguguggguucuggcuuuguacauaacucauuuucucccuugcuuuuu

SEQ ID NO: 738714 - RNA, 64 nt, hsa
accauaaaugaaacacuugagcacacuuuaaaaaguacauaaacccaugaguccauauguguaa

SEQ ID NO: 738715 - RNA, 64 nt, hsa; identical to SEQ ID NO: 218381

SEQ ID NO: 738716 - RNA, 64 nt, hsa; identical to SEQ ID NO: 218382

SEQ ID NO: 738717 - RNA, 64 nt, hsa; identical to SEQ ID NO: 218383

SEQ ID NO: 738718 - RNA, 64 nt, hsa; identical to SEQ ID NO: 218384

SEQ ID NO: 738719 - RNA, 64 nt, hsa; identical to SEQ ID NO: 218385

SEQ ID NO: 738720 - RNA, 64 nt, hsa; identical to SEQ ID NO: 218386

SEQ ID NO: 738721 - RNA, 64 nt, hsa; identical to SEQ ID NO: 218387

SEQ ID NO: 738722 - RNA, 64 nt, hsa; identical to SEQ ID NO: 218388

SEQ ID NO: 738723 - RNA, 64 nt, hsa; identical to SEQ ID NO: 218389

SEQ ID NO: 738724 - RNA, 64 nt, hsa; identical to SEQ ID NO: 218390

SEQ ID NO: 738725 - RNA, 64 nt, hsa; identical to SEQ ID NO: 218391

SEQ ID NO: 738726 - RNA, 64 nt, hsa; identical to SEQ ID NO: 218392

SEQ ID NO: 738727 - RNA, 64 nt, hsa; identical to SEQ ID NO: 218393

SEQ ID NO: 738728 - RNA, 64 nt, hsa; identical to SEQ ID NO: 218394

SEQ ID NO: 738729 - RNA, 64 nt, hsa; identical to SEQ ID NO: 218395

SEQ ID NO: 738730 - RNA, 64 nt, hsa; identical to SEQ ID NO: 218396

SEQ ID NO: 738731 - RNA, 64 nt, hsa; identical to SEQ ID NO: 218397

SEQ ID NO: 738732 - RNA, 64 nt, hsa; identical to SEQ ID NO: 218398

SEQ ID NO: 738733 - RNA, 64 nt, hsa; identical to SEQ ID NO: 218399

SEQ ID NO: 738734 - RNA, 64 nt, hsa; identical to SEQ ID NO: 218400

SEQ ID NO: 738735 - RNA, 64 nt, hsa; identical to SEQ ID NO: 218401

SEQ ID NO: 738736 - RNA, 64 nt, hsa; identical to SEQ ID NO: 218402

SEQ ID NO: 738737 - RNA, 64 nt, hsa; identical to SEQ ID NO: 218403

SEQ ID NO: 738738 - RNA, 64 nt, hsa; identical to SEQ ID NO: 218404

SEQ ID NO: 738739 - RNA, 64 nt, hsa; identical to SEQ ID NO: 218405

SEQ ID NO: 738740 - RNA, 64 nt, hsa; identical to SEQ ID NO: 218406

SEQ ID NO: 738741 - RNA, 64 nt, hsa; identical to SEQ ID NO: 218407

SEQ ID NO: 738742 - RNA, 64 nt, hsa; identical to SEQ ID NO: 218408

SEQ ID NO: 738743 - RNA, 64 nt, hsa; identical to SEQ ID NO: 218409

SEQ ID NO: 738744 - RNA, 64 nt, hsa; identical to SEQ ID NO: 218410

SEQ ID NO: 738745 - RNA, 64 nt, hsa; identical to SEQ ID NO: 218411

SEQ ID NO: 738746 - RNA, 64 nt, hsa; identical to SEQ ID NO: 218412

SEQ ID NO: 738747 - RNA, 64 nt, hsa; identical to SEQ ID NO: 218413

SEQ ID NO: 738748 - RNA, 64 nt, hsa; identical to SEQ ID NO: 218414

SEQ ID NO: 738749 - RNA, 64 nt, hsa; identical to SEQ ID NO: 218415

SEQ ID NO: 738750 - RNA, 64 nt, hsa; identical to SEQ ID NO: 218416

SEQ ID NO: 738751 - RNA, 64 nt, hsa
ucagggcucugcauuccgugccagggacgccucagccccuuaacauggaugugccacaugacag

SEQ ID NO: 738752 - RNA, 64 nt, hsa
uguucguuuuugaggggaaccauuccuuuauguugccccuuacugaugcccaacuaauguguuu

SEQ ID NO: 738753 - RNA, 64 nt, hsa
agcuaaaccagaaaggugauuccaggaggaguuagccaaacaacaacaaaaacaaaaaaugugc

SEQ ID NO: 738754 - RNA, 64 nt, hsa
ggagaggaaaagguguaggccugccuuaccgagagccaaacagagcccagggagacuccgcugu

SEQ ID NO: 738755 - RNA, 64 nt, hsa
cauauaauauucucacguacuucuuucagcaaacgccaaacaguaguaauucuuguaacuaccu

SEQ ID NO: 738756 - RNA, 64 nt, hsa
ugcaggcugcggccuugcccggacacuugguaaugccaaacaaguacguguggcuacucauugg

SEQ ID NO: 738757 - RNA, 64 nt, hsa
agaugccauuuuauauguggacguauuuauacuggccaaacauauuuuuucuuuugucccuuuu

SEQ ID NO: 738758 - RNA, 64 nt, hsa
cggcccccgucuuguaaaaaggggaggagaauuagccaaacacuguaagcuuuuaagaaaaaca

SEQ ID NO: 738759 - RNA, 64 nt, hsa
gugccgccuucuuguccuccuccucauugucgcugccaaacaggaggcaccggccacaggccca

SEQ ID NO: 738760 - RNA, 64 nt, hsa
uacaauaagaaagagauaaaauggaaugcuuuaugccaaacauguuuauuuuuaucacacagcu

SEQ ID NO: 738761 - RNA, 64 nt, hsa
uauucaaaucagcaucuagaggcugaaugacaaugccaaacacuccaccucugaucagaaccau

SEQ ID NO: 738762 - RNA, 64 nt, hsa
cuggaagacacucagcucucuaagcaggggcucggccaaacaugggaguuaagugcugcuuguc

SEQ ID NO: 738763 - RNA, 64 nt, hsa
ugugaucuccacaccaaagucagggagccuggaagccaaacaaaggcccagcagccuucugaca

SEQ ID NO: 738764 - RNA, 64 nt, hsa
ugccugcuccaagaaaagggcuugcgaaaggaaagccaaacacuguuucuaacucaggggugau

SEQ ID NO: 738765 - RNA, 64 nt, hsa; identical to SEQ ID NO: 201947

SEQ ID NO: 738766 - RNA, 64 nt, hsa; identical to SEQ ID NO: 201948

SEQ ID NO: 738767 - RNA, 64 nt, hsa; identical to SEQ ID NO: 201949

SEQ ID NO: 738768 - RNA, 64 nt, hsa; identical to SEQ ID NO: 201950

SEQ ID NO: 738769 - RNA, 64 nt, hsa; identical to SEQ ID NO: 201951

SEQ ID NO: 738770 - RNA, 64 nt, hsa; identical to SEQ ID NO: 201952

SEQ ID NO: 738771 - RNA, 64 nt, hsa; identical to SEQ ID NO: 201953

SEQ ID NO: 738772 - RNA, 64 nt, hsa; identical to SEQ ID NO: 201954

SEQ ID NO: 738773 - RNA, 64 nt, hsa; identical to SEQ ID NO: 201955

SEQ ID NO: 738774 - RNA, 64 nt, hsa; identical to SEQ ID NO: 201956

SEQ ID NO: 738775 - RNA, 64 nt, hsa; identical to SEQ ID NO: 201957

SEQ ID NO: 738776 - RNA, 64 nt, hsa; identical to SEQ ID NO: 201958

SEQ ID NO: 738777 - RNA, 64 nt, hsa; identical to SEQ ID NO: 201959

SEQ ID NO: 738778 - RNA, 64 nt, hsa; identical to SEQ ID NO: 201960

SEQ ID NO: 738779 - RNA, 64 nt, hsa; identical to SEQ ID NO: 201961

SEQ ID NO: 738780 - RNA, 64 nt, hsa; identical to SEQ ID NO: 201962

SEQ ID NO: 738781 - RNA, 64 nt, hsa; identical to SEQ ID NO: 201963

SEQ ID NO: 738782 - RNA, 64 nt, hsa; identical to SEQ ID NO: 201964

SEQ ID NO: 738783 - RNA, 64 nt, hsa; identical to SEQ ID NO: 201965

SEQ ID NO: 738784 - RNA, 64 nt, hsa; identical to SEQ ID NO: 201966

SEQ ID NO: 738785 - RNA, 64 nt, hsa; identical to SEQ ID NO: 201967

SEQ ID NO: 738786 - RNA, 64 nt, hsa; identical to SEQ ID NO: 201968

SEQ ID NO: 738787 - RNA, 64 nt, hsa; identical to SEQ ID NO: 201969

SEQ ID NO: 738788 - RNA, 64 nt, hsa; identical to SEQ ID NO: 201970

SEQ ID NO: 738789 - RNA, 64 nt, hsa; identical to SEQ ID NO: 201971

SEQ ID NO: 738790 - RNA, 64 nt, hsa; identical to SEQ ID NO: 201972

SEQ ID NO: 738791 - RNA, 64 nt, hsa; identical to SEQ ID NO: 361150

SEQ ID NO: 738792 - RNA, 64 nt, hsa; identical to SEQ ID NO: 361151

SEQ ID NO: 738793 - RNA, 64 nt, hsa; identical to SEQ ID NO: 361152

SEQ ID NO: 738794 - RNA, 64 nt, hsa; identical to SEQ ID NO: 361153

SEQ ID NO: 738795 - RNA, 64 nt, hsa; identical to SEQ ID NO: 361154

SEQ ID NO: 738796 - RNA, 64 nt, hsa; identical to SEQ ID NO: 361155

SEQ ID NO: 738797 - RNA, 64 nt, hsa; identical to SEQ ID NO: 361156

SEQ ID NO: 738798 - RNA, 64 nt, hsa; identical to SEQ ID NO: 361157

SEQ ID NO: 738799 - RNA, 64 nt, hsa; identical to SEQ ID NO: 361158

SEQ ID NO: 738800 - RNA, 64 nt, hsa; identical to SEQ ID NO: 361159

SEQ ID NO: 738801 - RNA, 64 nt, hsa; identical to SEQ ID NO: 361160

SEQ ID NO: 738802 - RNA, 64 nt, hsa; identical to SEQ ID NO: 361161

SEQ ID NO: 738803 - RNA, 64 nt, hsa; identical to SEQ ID NO: 361162

SEQ ID NO: 738804 - RNA, 64 nt, hsa; identical to SEQ ID NO: 361163

SEQ ID NO: 738805 - RNA, 64 nt, hsa; identical to SEQ ID NO: 361164

SEQ ID NO: 738806 - RNA, 64 nt, hsa; identical to SEQ ID NO: 361165

SEQ ID NO: 738807 - RNA, 64 nt, hsa; identical to SEQ ID NO: 361166

SEQ ID NO: 738808 - RNA, 64 nt, hsa; identical to SEQ ID NO: 361167

SEQ ID NO: 738809 - RNA, 64 nt, hsa; identical to SEQ ID NO: 361168

SEQ ID NO: 738810 - RNA, 64 nt, hsa; identical to SEQ ID NO: 361169

SEQ ID NO: 738811 - RNA, 64 nt, hsa; identical to SEQ ID NO: 361170

SEQ ID NO: 738812 - RNA, 64 nt, hsa; identical to SEQ ID NO: 361171

SEQ ID NO: 738813 - RNA, 61 nt, hsa
gggagaccacauguggugcacagggaagaaacggcuuuagacagcagucugcgggccccac

SEQ ID NO: 738814 - RNA, 61 nt, hsa
acuccucaugugccauuuuguccucagagggcggcuuuacuuuuuugguaaaggaacaagc

SEQ ID NO: 738815 - RNA, 64 nt, hsa; identical to SEQ ID NO: 98055

SEQ ID NO: 738816 - RNA, 64 nt, hsa; identical to SEQ ID NO: 98056

SEQ ID NO: 738817 - RNA, 64 nt, hsa; identical to SEQ ID NO: 98057

SEQ ID NO: 738818 - RNA, 64 nt, hsa; identical to SEQ ID NO: 98058

SEQ ID NO: 738819 - RNA, 64 nt, hsa; identical to SEQ ID NO: 98059

SEQ ID NO: 738820 - RNA, 64 nt, hsa; identical to SEQ ID NO: 98060

SEQ ID NO: 738821 - RNA, 64 nt, hsa; identical to SEQ ID NO: 98061

SEQ ID NO: 738822 - RNA, 64 nt, hsa; identical to SEQ ID NO: 98062

SEQ ID NO: 738823 - RNA, 64 nt, hsa; identical to SEQ ID NO: 98063

SEQ ID NO: 738824 - RNA, 64 nt, hsa; identical to SEQ ID NO: 98064

SEQ ID NO: 738825 - RNA, 64 nt, hsa; identical to SEQ ID NO: 98065

SEQ ID NO: 738826 - RNA, 64 nt, hsa; identical to SEQ ID NO: 98066

SEQ ID NO: 738827 - RNA, 64 nt, hsa; identical to SEQ ID NO: 98067

SEQ ID NO: 738828 - RNA, 64 nt, hsa; identical to SEQ ID NO: 98068

SEQ ID NO: 738829 - RNA, 64 nt, hsa; identical to SEQ ID NO: 98069

SEQ ID NO: 738830 - RNA, 64 nt, hsa; identical to SEQ ID NO: 98070

SEQ ID NO: 738831 - RNA, 64 nt, hsa; identical to SEQ ID NO: 98071

SEQ ID NO: 738832 - RNA, 64 nt, hsa; identical to SEQ ID NO: 98072

SEQ ID NO: 738833 - RNA, 64 nt, hsa; identical to SEQ ID NO: 98073

SEQ ID NO: 738834 - RNA, 64 nt, hsa; identical to SEQ ID NO: 98074

SEQ ID NO: 738835 - RNA, 64 nt, hsa; identical to SEQ ID NO: 98075

SEQ ID NO: 738836 - RNA, 64 nt, hsa; identical to SEQ ID NO: 98076

SEQ ID NO: 738837 - RNA, 64 nt, hsa; identical to SEQ ID NO: 98077

SEQ ID NO: 738838 - RNA, 64 nt, hsa; identical to SEQ ID NO: 98078

SEQ ID NO: 738839 - RNA, 64 nt, hsa; identical to SEQ ID NO: 98079

SEQ ID NO: 738840 - RNA, 64 nt, hsa; identical to SEQ ID NO: 98080

SEQ ID NO: 738841 - RNA, 64 nt, hsa; identical to SEQ ID NO: 98081

SEQ ID NO: 738842 - RNA, 64 nt, hsa; identical to SEQ ID NO: 98082

SEQ ID NO: 738843 - RNA, 64 nt, hsa; identical to SEQ ID NO: 98083

SEQ ID NO: 738844 - RNA, 64 nt, hsa; identical to SEQ ID NO: 98084

SEQ ID NO: 738845 - RNA, 64 nt, hsa; identical to SEQ ID NO: 98085

SEQ ID NO: 738846 - RNA, 64 nt, hsa; identical to SEQ ID NO: 98086

SEQ ID NO: 738847 - RNA, 64 nt, hsa; identical to SEQ ID NO: 98087

SEQ ID NO: 738848 - RNA, 64 nt, hsa; identical to SEQ ID NO: 98088

SEQ ID NO: 738849 - RNA, 64 nt, hsa; identical to SEQ ID NO: 98089

SEQ ID NO: 738850 - RNA, 64 nt, hsa; identical to SEQ ID NO: 98090

SEQ ID NO: 738851 - RNA, 64 nt, hsa; identical to SEQ ID NO: 98091

SEQ ID NO: 738852 - RNA, 64 nt, hsa; identical to SEQ ID NO: 98092

SEQ ID NO: 738853 - RNA, 64 nt, hsa; identical to SEQ ID NO: 98093

SEQ ID NO: 738854 - RNA, 64 nt, hsa; identical to SEQ ID NO: 98094

SEQ ID NO: 738855 - RNA, 64 nt, hsa; identical to SEQ ID NO: 98095

SEQ ID NO: 738856 - RNA, 64 nt, hsa; identical to SEQ ID NO: 98096

SEQ ID NO: 738857 - RNA, 64 nt, hsa; identical to SEQ ID NO: 98097

SEQ ID NO: 738858 - RNA, 64 nt, hsa; identical to SEQ ID NO: 98098

SEQ ID NO: 738859 - RNA, 64 nt, hsa; identical to SEQ ID NO: 98099

SEQ ID NO: 738860 - RNA, 64 nt, hsa; identical to SEQ ID NO: 98100

SEQ ID NO: 738861 - RNA, 64 nt, hsa; identical to SEQ ID NO: 98101

SEQ ID NO: 738862 - RNA, 64 nt, hsa; identical to SEQ ID NO: 98102

SEQ ID NO: 738863 - RNA, 64 nt, hsa; identical to SEQ ID NO: 98103

SEQ ID NO: 738864 - RNA, 64 nt, hsa; identical to SEQ ID NO: 98104

SEQ ID NO: 738865 - RNA, 64 nt, hsa; identical to SEQ ID NO: 98105

SEQ ID NO: 738866 - RNA, 64 nt, hsa; identical to SEQ ID NO: 98106

SEQ ID NO: 738867 - RNA, 64 nt, hsa; identical to SEQ ID NO: 98107

SEQ ID NO: 738868 - RNA, 64 nt, hsa; identical to SEQ ID NO: 98108

SEQ ID NO: 738869 - RNA, 64 nt, hsa; identical to SEQ ID NO: 98109

SEQ ID NO: 738870 - RNA, 64 nt, hsa; identical to SEQ ID NO: 98110

SEQ ID NO: 738871 - RNA, 64 nt, hsa; identical to SEQ ID NO: 98111

SEQ ID NO: 738872 - RNA, 64 nt, hsa; identical to SEQ ID NO: 98112

SEQ ID NO: 738873 - RNA, 64 nt, hsa; identical to SEQ ID NO: 98113

SEQ ID NO: 738874 - RNA, 64 nt, hsa; identical to SEQ ID NO: 98114

SEQ ID NO: 738875 - RNA, 64 nt, hsa; identical to SEQ ID NO: 98115

SEQ ID NO: 738876 - RNA, 64 nt, hsa; identical to SEQ ID NO: 98116

SEQ ID NO: 738877 - RNA, 64 nt, hsa; identical to SEQ ID NO: 98117

SEQ ID NO: 738878 - RNA, 64 nt, hsa; identical to SEQ ID NO: 98118

SEQ ID NO: 738879 - RNA, 64 nt, hsa; identical to SEQ ID NO: 98119

SEQ ID NO: 738880 - RNA, 64 nt, hsa; identical to SEQ ID NO: 98120

SEQ ID NO: 738881 - RNA, 64 nt, hsa; identical to SEQ ID NO: 98121

SEQ ID NO: 738882 - RNA, 64 nt, hsa; identical to SEQ ID NO: 98122

SEQ ID NO: 738883 - RNA, 64 nt, hsa; identical to SEQ ID NO: 98123

SEQ ID NO: 738884 - RNA, 64 nt, hsa; identical to SEQ ID NO: 98124

SEQ ID NO: 738885 - RNA, 64 nt, hsa; identical to SEQ ID NO: 98125

SEQ ID NO: 738886 - RNA, 64 nt, hsa; identical to SEQ ID NO: 98126

SEQ ID NO: 738887 - RNA, 64 nt, hsa; identical to SEQ ID NO: 98127

SEQ ID NO: 738888 - RNA, 64 nt, hsa; identical to SEQ ID NO: 98128

SEQ ID NO: 738889 - RNA, 64 nt, hsa; identical to SEQ ID NO: 98129

SEQ ID NO: 738890 - RNA, 64 nt, hsa; identical to SEQ ID NO: 98130

SEQ ID NO: 738891 - RNA, 64 nt, hsa; identical to SEQ ID NO: 98131

SEQ ID NO: 738892 - RNA, 64 nt, hsa; identical to SEQ ID NO: 98132

SEQ ID NO: 738893 - RNA, 64 nt, hsa; identical to SEQ ID NO: 98133

SEQ ID NO: 738894 - RNA, 64 nt, hsa; identical to SEQ ID NO: 98134

SEQ ID NO: 738895 - RNA, 64 nt, hsa; identical to SEQ ID NO: 98135

SEQ ID NO: 738896 - RNA, 64 nt, hsa; identical to SEQ ID NO: 98136

SEQ ID NO: 738897 - RNA, 64 nt, hsa; identical to SEQ ID NO: 98137

SEQ ID NO: 738898 - RNA, 64 nt, hsa; identical to SEQ ID NO: 98138

SEQ ID NO: 738899 - RNA, 64 nt, hsa; identical to SEQ ID NO: 98139

SEQ ID NO: 738900 - RNA, 64 nt, hsa; identical to SEQ ID NO: 98140

SEQ ID NO: 738901 - RNA, 64 nt, hsa; identical to SEQ ID NO: 98141

SEQ ID NO: 738902 - RNA, 64 nt, hsa; identical to SEQ ID NO: 98142

SEQ ID NO: 738903 - RNA, 64 nt, hsa; identical to SEQ ID NO: 98143

SEQ ID NO: 738904 - RNA, 64 nt, hsa; identical to SEQ ID NO: 98144

SEQ ID NO: 738905 - RNA, 64 nt, hsa; identical to SEQ ID NO: 98145

SEQ ID NO: 738906 - RNA, 64 nt, hsa; identical to SEQ ID NO: 98146

SEQ ID NO: 738907 - RNA, 64 nt, hsa; identical to SEQ ID NO: 98147

SEQ ID NO: 738908 - RNA, 64 nt, hsa; identical to SEQ ID NO: 98148

SEQ ID NO: 738909 - RNA, 64 nt, hsa; identical to SEQ ID NO: 98149

SEQ ID NO: 738910 - RNA, 64 nt, hsa; identical to SEQ ID NO: 98150

SEQ ID NO: 738911 - RNA, 64 nt, hsa; identical to SEQ ID NO: 98151

SEQ ID NO: 738912 - RNA, 64 nt, hsa; identical to SEQ ID NO: 98152

SEQ ID NO: 738913 - RNA, 64 nt, hsa; identical to SEQ ID NO: 98153

SEQ ID NO: 738914 - RNA, 64 nt, hsa; identical to SEQ ID NO: 98154

SEQ ID NO: 738915 - RNA, 64 nt, hsa; identical to SEQ ID NO: 98155

SEQ ID NO: 738916 - RNA, 64 nt, hsa; identical to SEQ ID NO: 98156

SEQ ID NO: 738917 - RNA, 64 nt, hsa; identical to SEQ ID NO: 98157

SEQ ID NO: 738918 - RNA, 64 nt, hsa; identical to SEQ ID NO: 98158

SEQ ID NO: 738919 - RNA, 64 nt, hsa; identical to SEQ ID NO: 98159

SEQ ID NO: 738920 - RNA, 64 nt, hsa; identical to SEQ ID NO: 98160

SEQ ID NO: 738921 - RNA, 64 nt, hsa; identical to SEQ ID NO: 98161

SEQ ID NO: 738922 - RNA, 64 nt, hsa; identical to SEQ ID NO: 98162

SEQ ID NO: 738923 - RNA, 64 nt, hsa; identical to SEQ ID NO: 98163

SEQ ID NO: 738924 - RNA, 64 nt, hsa; identical to SEQ ID NO: 98164

SEQ ID NO: 738925 - RNA, 64 nt, hsa; identical to SEQ ID NO: 98165

SEQ ID NO: 738926 - RNA, 64 nt, hsa; identical to SEQ ID NO: 98166

SEQ ID NO: 738927 - RNA, 64 nt, hsa; identical to SEQ ID NO: 98167

SEQ ID NO: 738928 - RNA, 64 nt, hsa; identical to SEQ ID NO: 98168

SEQ ID NO: 738929 - RNA, 64 nt, hsa; identical to SEQ ID NO: 98169

SEQ ID NO: 738930 - RNA, 64 nt, hsa; identical to SEQ ID NO: 98170

SEQ ID NO: 738931 - RNA, 64 nt, hsa; identical to SEQ ID NO: 98171

SEQ ID NO: 738932 - RNA, 64 nt, hsa; identical to SEQ ID NO: 98172

SEQ ID NO: 738933 - RNA, 64 nt, hsa; identical to SEQ ID NO: 98173

SEQ ID NO: 738934 - RNA, 64 nt, hsa; identical to SEQ ID NO: 98174

SEQ ID NO: 738935 - RNA, 64 nt, hsa; identical to SEQ ID NO: 98175

SEQ ID NO: 738936 - RNA, 64 nt, hsa; identical to SEQ ID NO: 98176

SEQ ID NO: 738937 - RNA, 64 nt, hsa; identical to SEQ ID NO: 98177

SEQ ID NO: 738938 - RNA, 64 nt, hsa; identical to SEQ ID NO: 98178

SEQ ID NO: 738939 - RNA, 64 nt, hsa; identical to SEQ ID NO: 98179

SEQ ID NO: 738940 - RNA, 64 nt, hsa; identical to SEQ ID NO: 98180

SEQ ID NO: 738941 - RNA, 64 nt, hsa; identical to SEQ ID NO: 98181

SEQ ID NO: 738942 - RNA, 64 nt, hsa; identical to SEQ ID NO: 98182

SEQ ID NO: 738943 - RNA, 64 nt, hsa; identical to SEQ ID NO: 98183

SEQ ID NO: 738944 - RNA, 64 nt, hsa; identical to SEQ ID NO: 98184

SEQ ID NO: 738945 - RNA, 64 nt, hsa; identical to SEQ ID NO: 98185

SEQ ID NO: 738946 - RNA, 64 nt, hsa; identical to SEQ ID NO: 98186

SEQ ID NO: 738947 - RNA, 64 nt, hsa; identical to SEQ ID NO: 98187

SEQ ID NO: 738948 - RNA, 64 nt, hsa; identical to SEQ ID NO: 98188

SEQ ID NO: 738949 - RNA, 64 nt, hsa; identical to SEQ ID NO: 98189

SEQ ID NO: 738950 - RNA, 64 nt, hsa; identical to SEQ ID NO: 98190

SEQ ID NO: 738951 - RNA, 64 nt, hsa; identical to SEQ ID NO: 98191

SEQ ID NO: 738952 - RNA, 64 nt, hsa; identical to SEQ ID NO: 98192

SEQ ID NO: 738953 - RNA, 64 nt, hsa; identical to SEQ ID NO: 98193

SEQ ID NO: 738954 - RNA, 64 nt, hsa; identical to SEQ ID NO: 98194

SEQ ID NO: 738955 - RNA, 64 nt, hsa; identical to SEQ ID NO: 98195

SEQ ID NO: 738956 - RNA, 64 nt, hsa; identical to SEQ ID NO: 98196

SEQ ID NO: 738957 - RNA, 64 nt, hsa; identical to SEQ ID NO: 98197

SEQ ID NO: 738958 - RNA, 64 nt, hsa; identical to SEQ ID NO: 98198

SEQ ID NO: 738959 - RNA, 64 nt, hsa; identical to SEQ ID NO: 98199

SEQ ID NO: 738960 - RNA, 64 nt, hsa
gcuccuggaaggugaaaaguagucauuuguucuaaaucuauacauauuacuuguaucuagugca

SEQ ID NO: 738961 - RNA, 64 nt, hsa
ucuuaaauguauauguuggucacuaauugcacaaaaucuauaauuugccagggcuuuagagauu

SEQ ID NO: 738962 - RNA, 64 nt, hsa
ucgcauuucguuuucucugucucacugagacaacaaucuauacuguuuuggcaaguuugcauuu

SEQ ID NO: 738963 - RNA, 64 nt, hsa
aagcagaaauaguaaaauucaguagguuuaaaacaaucuauaaauguauuuuauuuccaagaaa

SEQ ID NO: 738964 - RNA, 64 nt, hsa
agcuucuauauauuguauguauauauuuuuuaaaaaucuauauuuugggaaaaaaacauacaca

SEQ ID NO: 738965 - RNA, 64 nt, hsa
ggcaagcccccaaacugcuguggggacauuuuauaaucuauaugcugcacccacuuaaucuacu

SEQ ID NO: 738966 - RNA, 64 nt, hsa
aagugaauguucaacaacaaugaugagcaauagaaaucuauauaugagaaacguuuggauaaua

SEQ ID NO: 738967 - RNA, 64 nt, hsa
agagcucccuccgaagagaaaauuuuuauacuaaaaucuauaauuuaauucaagagaaugcuuu

SEQ ID NO: 738968 - RNA, 64 nt, hsa
uuuuacauucccaccagcagugcacaaggauugcaaucuauauacauccucaccaacauuguuc

SEQ ID NO: 738969 - RNA, 64 nt, hsa
uuggauagcagcuaucuuguuggaugugagguggaaucuauagugucuuucauuuuuauuuugu

SEQ ID NO: 738970 - RNA, 64 nt, hsa
uauuuccuguaagaaauguuuuuaguuaaucuauaaucuauagaaauaaugcuuaucacuggcu

SEQ ID NO: 738971 - RNA, 64 nt, hsa
aucccuuuauuuccuguaagaaauguuuuuaguuaaucuauaaucuauagaaauaaugcuuauc

SEQ ID NO: 738972 - RNA, 64 nt, hsa
cucuugcauuucacuugaguggagguuuauaguuaaucuauaacuacauauugaauagggcuag

SEQ ID NO: 738973 - RNA, 64 nt, hsa
auagaaagcaagauguacuauaacauagaauugcaaucuauaauauuuguguguucacuaaacu

SEQ ID NO: 738974 - RNA, 58 nt, hsa; identical to SEQ ID NO: 244172

SEQ ID NO: 738975 - RNA, 64 nt, hsa; identical to SEQ ID NO: 244173

SEQ ID NO: 738976 - RNA, 64 nt, hsa; identical to SEQ ID NO: 244174

SEQ ID NO: 738977 - RNA, 64 nt, hsa; identical to SEQ ID NO: 244175

SEQ ID NO: 738978 - RNA, 64 nt, hsa; identical to SEQ ID NO: 244176

SEQ ID NO: 738979 - RNA, 64 nt, hsa; identical to SEQ ID NO: 244177

SEQ ID NO: 738980 - RNA, 64 nt, hsa; identical to SEQ ID NO: 244178

SEQ ID NO: 738981 - RNA, 64 nt, hsa; identical to SEQ ID NO: 244179

SEQ ID NO: 738982 - RNA, 64 nt, hsa; identical to SEQ ID NO: 244180

SEQ ID NO: 738983 - RNA, 64 nt, hsa; identical to SEQ ID NO: 244181

SEQ ID NO: 738984 - RNA, 64 nt, hsa; identical to SEQ ID NO: 244182

SEQ ID NO: 738985 - RNA, 64 nt, hsa; identical to SEQ ID NO: 244183

SEQ ID NO: 738986 - RNA, 64 nt, hsa; identical to SEQ ID NO: 244184

SEQ ID NO: 738987 - RNA, 64 nt, hsa; identical to SEQ ID NO: 244185

SEQ ID NO: 738988 - RNA, 64 nt, hsa; identical to SEQ ID NO: 244186

SEQ ID NO: 738989 - RNA, 64 nt, hsa; identical to SEQ ID NO: 244187

SEQ ID NO: 738990 - RNA, 64 nt, hsa; identical to SEQ ID NO: 244188

SEQ ID NO: 738991 - RNA, 64 nt, hsa; identical to SEQ ID NO: 244189

SEQ ID NO: 738992 - RNA, 64 nt, hsa; identical to SEQ ID NO: 244190

SEQ ID NO: 738993 - RNA, 64 nt, hsa; identical to SEQ ID NO: 244191

SEQ ID NO: 738994 - RNA, 64 nt, hsa; identical to SEQ ID NO: 244192

SEQ ID NO: 738995 - RNA, 64 nt, hsa; identical to SEQ ID NO: 244193

SEQ ID NO: 738996 - RNA, 64 nt, hsa; identical to SEQ ID NO: 244194

SEQ ID NO: 738997 - RNA, 64 nt, hsa; identical to SEQ ID NO: 244195

SEQ ID NO: 738998 - RNA, 63 nt, hsa
guguucucaacugaguaacuuuuaaguggaaaccaaguuuagauuuggggagugguaaaggaa

SEQ ID NO: 738999 - RNA, 63 nt, hsa
uacugcccaaguuaaauauugauagccuaaagacaaguuuauguaguacuuaauguacaugau

SEQ ID NO: 739000 - RNA, 63 nt, hsa
aaaugaauaagcuaucaauauauaauuuaaguacaaguuuaggcugggcgugguggcucacgc

SEQ ID NO: 739001 - RNA, 63 nt, hsa
ucucaaaaaaagaaagaaagaaaaaagaaaguacaaguuuauaaaguauuauagugaaaaauu

SEQ ID NO: 739002 - RNA, 63 nt, hsa
caaggaaaugaauauauuguuagaccagguaagcaaguuuauuuuuguuaaagagcacuuggu

SEQ ID NO: 739003 - RNA, 63 nt, hsa
guccuuuuaauuuuugcuuagaauagaauggaacaaguuuaaauuucaaggaaauaugaaggc

SEQ ID NO: 739004 - RNA, 63 nt, hsa
auaggucuuaaacaugaugaauuuuuucuauuacaaguuuauuuaaaacugcuuucucaaguc

SEQ ID NO: 739005 - RNA, 63 nt, hsa
uuauugccaaaaaguuuuuuuuaaucugucuuucaaguuuacagaaaagaaagcaguaaaugc

SEQ ID NO: 739006 - RNA, 63 nt, hsa
aauaaggucuuuuuuaaauauacaaauuuuacucaaguuuaaauuguauaaaacugcuuagaa

SEQ ID NO: 739007 - RNA, 63 nt, hsa
uaauccauuguuuaaauuuacaacuuaacuuuccaaguuuauauccuagucaaacaaaauuua

SEQ ID NO: 739008 - RNA, 63 nt, hsa
auuguaucuuauuauaaaauggacacaaauuuucaaguuuacacuucauauagcauugauaau

SEQ ID NO: 739009 - RNA, 63 nt, hsa
gaggguggggggauuuguagcauaacuguagcucaaguuuaaaagccauguauaaccaagugu

SEQ ID NO: 739010 - RNA, 63 nt, hsa
aucaaacagccaaacaccuggaaguauuagauacaaguuuaaaauaucuuuuauagguuuuau

SEQ ID NO: 739011 - RNA, 63 nt, hsa
auuuaaugauauguuagugccucuguuauaugucaaguuuaaagcagggcacauuguugcagc

SEQ ID NO: 739012 - RNA, 63 nt, hsa
gcacucccuggagagaggacccagugacuuguccaaguuuacacacgacacuaaucuccccug

SEQ ID NO: 739013 - RNA, 63 nt, hsa
ggcaagcagggcccaucuuacauccucucucuccaaguuuaucucauccuuuauuuuuaauca

SEQ ID NO: 739014 - RNA, 63 nt, hsa
ccuguuuuagucaguugggaggaagggaaaaaucaaguuuaauucccuuuaucuggguuaauu

SEQ ID NO: 739015 - RNA, 63 nt, hsa
acuuauacucuugagaaugaauucaguuucaaucaaguuuacauuauguugcuuaaaaaaaua

SEQ ID NO: 739016 - RNA, 63 nt, hsa
ugguuuucaauaccaccaagaggaaaauauugacaaguuuaaaggcugugucauugggccaug

SEQ ID NO: 739017 - RNA, 63 nt, hsa
ggaauuaacaauugccagggaaaccagccaacccaaguuuauuauaucauuaaccuuaucaua

SEQ ID NO: 739018 - RNA, 64 nt, hsa; identical to SEQ ID NO: 126433

SEQ ID NO: 739019 - RNA, 64 nt, hsa; identical to SEQ ID NO: 126434

SEQ ID NO: 739020 - RNA, 64 nt, hsa; identical to SEQ ID NO: 126435

SEQ ID NO: 739021 - RNA, 64 nt, hsa; identical to SEQ ID NO: 126436

SEQ ID NO: 739022 - RNA, 64 nt, hsa; identical to SEQ ID NO: 126437

SEQ ID NO: 739023 - RNA, 64 nt, hsa; identical to SEQ ID NO: 126438

SEQ ID NO: 739024 - RNA, 64 nt, hsa; identical to SEQ ID NO: 126439

SEQ ID NO: 739025 - RNA, 64 nt, hsa; identical to SEQ ID NO: 126440

SEQ ID NO: 739026 - RNA, 64 nt, hsa; identical to SEQ ID NO: 126441

SEQ ID NO: 739027 - RNA, 64 nt, hsa; identical to SEQ ID NO: 126442

SEQ ID NO: 739028 - RNA, 64 nt, hsa; identical to SEQ ID NO: 126443

SEQ ID NO: 739029 - RNA, 64 nt, hsa; identical to SEQ ID NO: 126444

SEQ ID NO: 739030 - RNA, 64 nt, hsa; identical to SEQ ID NO: 126445

SEQ ID NO: 739031 - RNA, 64 nt, hsa; identical to SEQ ID NO: 126446

SEQ ID NO: 739032 - RNA, 64 nt, hsa; identical to SEQ ID NO: 126447

SEQ ID NO: 739033 - RNA, 64 nt, hsa; identical to SEQ ID NO: 126448

SEQ ID NO: 739034 - RNA, 64 nt, hsa; identical to SEQ ID NO: 126449

SEQ ID NO: 739035 - RNA, 64 nt, hsa; identical to SEQ ID NO: 126450

SEQ ID NO: 739036 - RNA, 64 nt, hsa; identical to SEQ ID NO: 126451

SEQ ID NO: 739037 - RNA, 64 nt, hsa; identical to SEQ ID NO: 126452

SEQ ID NO: 739038 - RNA, 64 nt, hsa; identical to SEQ ID NO: 126453

SEQ ID NO: 739039 - RNA, 64 nt, hsa; identical to SEQ ID NO: 126454

SEQ ID NO: 739040 - RNA, 64 nt, hsa; identical to SEQ ID NO: 126455

SEQ ID NO: 739041 - RNA, 64 nt, hsa; identical to SEQ ID NO: 126456

SEQ ID NO: 739042 - RNA, 64 nt, hsa; identical to SEQ ID NO: 126457

SEQ ID NO: 739043 - RNA, 64 nt, hsa; identical to SEQ ID NO: 126458

SEQ ID NO: 739044 - RNA, 64 nt, hsa
cgggacaucacagggugggccucggccccucccacacccaaagcugagccugcagggaagcccc

SEQ ID NO: 739045 - RNA, 64 nt, hsa
uucuuggggcccagugcaugguggccagaggugucacccaaaccggcaggugcgauuuuguuaa

SEQ ID NO: 739046 - RNA, 64 nt, hsa
uugaagucacauacuuaauauucuuccuaaaaaccacccaaacacuagaugugugugugcacac

SEQ ID NO: 739047 - RNA, 64 nt, hsa
ucagauaauaaauaagagaccaaaaguaggcuaucacccaaagcaaacauccuuaacugacccu

SEQ ID NO: 739048 - RNA, 64 nt, hsa
ucccaaaccaaacuaacagugcugguuuguccgacacccaaagcccacuucacacauuuauaag

SEQ ID NO: 739049 - RNA, 64 nt, hsa
ccuuucucuuaccacuaguugcuuacaaaaauagcacccaaacacauggcacuuggaagaaaaa

SEQ ID NO: 739050 - RNA, 64 nt, hsa; identical to SEQ ID NO: 68551

SEQ ID NO: 739051 - RNA, 64 nt, hsa; identical to SEQ ID NO: 68552

SEQ ID NO: 739052 - RNA, 64 nt, hsa; identical to SEQ ID NO: 68553

SEQ ID NO: 739053 - RNA, 64 nt, hsa; identical to SEQ ID NO: 68554

SEQ ID NO: 739054 - RNA, 64 nt, hsa; identical to SEQ ID NO: 68555

SEQ ID NO: 739055 - RNA, 64 nt, hsa; identical to SEQ ID NO: 68556

SEQ ID NO: 739056 - RNA, 64 nt, hsa; identical to SEQ ID NO: 68557

SEQ ID NO: 739057 - RNA, 64 nt, hsa; identical to SEQ ID NO: 68558

SEQ ID NO: 739058 - RNA, 64 nt, hsa; identical to SEQ ID NO: 560313

SEQ ID NO: 739059 - RNA, 64 nt, hsa; identical to SEQ ID NO: 560314

SEQ ID NO: 739060 - RNA, 64 nt, hsa; identical to SEQ ID NO: 560315

SEQ ID NO: 739061 - RNA, 64 nt, hsa; identical to SEQ ID NO: 560316

SEQ ID NO: 739062 - RNA, 64 nt, hsa; identical to SEQ ID NO: 560317

SEQ ID NO: 739063 - RNA, 64 nt, hsa; identical to SEQ ID NO: 560318

SEQ ID NO: 739064 - RNA, 64 nt, hsa; identical to SEQ ID NO: 560319

SEQ ID NO: 739065 - RNA, 64 nt, hsa; identical to SEQ ID NO: 560320

SEQ ID NO: 739066 - RNA, 64 nt, hsa; identical to SEQ ID NO: 560321

SEQ ID NO: 739067 - RNA, 62 nt, hsa; identical to SEQ ID NO: 560322

SEQ ID NO: 739068 - RNA, 64 nt, hsa; identical to SEQ ID NO: 560323

SEQ ID NO: 739069 - RNA, 64 nt, hsa; identical to SEQ ID NO: 560324

SEQ ID NO: 739070 - RNA, 64 nt, hsa; identical to SEQ ID NO: 560325

SEQ ID NO: 739071 - RNA, 64 nt, hsa; identical to SEQ ID NO: 560326

SEQ ID NO: 739072 - RNA, 64 nt, hsa; identical to SEQ ID NO: 560327

SEQ ID NO: 739073 - RNA, 64 nt, hsa; identical to SEQ ID NO: 560328

SEQ ID NO: 739074 - RNA, 64 nt, hsa; identical to SEQ ID NO: 560329

SEQ ID NO: 739075 - RNA, 64 nt, hsa; identical to SEQ ID NO: 560330

SEQ ID NO: 739076 - RNA, 64 nt, hsa; identical to SEQ ID NO: 420761

SEQ ID NO: 739077 - RNA, 64 nt, hsa; identical to SEQ ID NO: 420762

SEQ ID NO: 739078 - RNA, 64 nt, hsa; identical to SEQ ID NO: 420763

SEQ ID NO: 739079 - RNA, 64 nt, hsa; identical to SEQ ID NO: 420764

SEQ ID NO: 739080 - RNA, 64 nt, hsa; identical to SEQ ID NO: 420765

SEQ ID NO: 739081 - RNA, 64 nt, hsa; identical to SEQ ID NO: 420766

SEQ ID NO: 739082 - RNA, 64 nt, hsa; identical to SEQ ID NO: 420767

SEQ ID NO: 739083 - RNA, 64 nt, hsa; identical to SEQ ID NO: 420768

SEQ ID NO: 739084 - RNA, 64 nt, hsa; identical to SEQ ID NO: 244684

SEQ ID NO: 739085 - RNA, 64 nt, hsa; identical to SEQ ID NO: 244685

SEQ ID NO: 739086 - RNA, 64 nt, hsa
uugauuuauuauuagcaugucauuuguacauaaacuaguagaaaauagcaguuuuaaaaguuuu

SEQ ID NO: 739087 - RNA, 64 nt, hsa
agucaauuuuaacuaaaaacuaagauaauguuuccuaguagaguugcuugaagauuagacuaga

SEQ ID NO: 739088 - RNA, 64 nt, hsa
cagcugacagacgugggcucugcaugccgccagccuaguagaaaguucucguucauuggcaaca

SEQ ID NO: 739089 - RNA, 64 nt, hsa
ugggaguggcuuuccauuuugggcagaaugcugacuaguagacuaacauaaaagauauaaaagg

SEQ ID NO: 739090 - RNA, 64 nt, hsa
aucagugcauuugaaaauucaagccagcauauuccuaguagauggaagcaaaauuaaguugucu

SEQ ID NO: 739091 - RNA, 64 nt, hsa
aaucucauuaaacaaauauucuccaugggccugucuaguagauuaauggaucugguuggccguu

SEQ ID NO: 739092 - RNA, 64 nt, hsa
uucuuuguuuuuacagaucauauuaaggaaugcugaugaacaauuuugcuaucgacuacuaaau

SEQ ID NO: 739093 - RNA, 64 nt, hsa
cuuaccgccuccuuuuuccuuuaaucuuauuuuugaugaacacauauauaggagaacaucuauc

SEQ ID NO: 739094 - RNA, 64 nt, hsa
aacauuuuuuuguauagguauaccaugauuuguugaugaacaaauuuaccuguugaugaacauu

SEQ ID NO: 739095 - RNA, 64 nt, hsa
uaccaugauuuguugaugaacaaauuuaccuguugaugaacauuuacguuguuaccaagauuuu

SEQ ID NO: 739096 - RNA, 64 nt, hsa
uuuggcaaacauacauaauguuacaucauacuaugaugaacauccauguacuuuucacucaauu

SEQ ID NO: 739097 - RNA, 64 nt, hsa
uuugugucuggcagaugaguaugucaaggauugagaugaacacauaagucuuggaaauuaaaua

SEQ ID NO: 739098 - RNA, 64 nt, hsa; identical to SEQ ID NO: 484977

SEQ ID NO: 739099 - RNA, 64 nt, hsa; identical to SEQ ID NO: 484978

SEQ ID NO: 739100 - RNA, 64 nt, hsa; identical to SEQ ID NO: 484979

SEQ ID NO: 739101 - RNA, 64 nt, hsa; identical to SEQ ID NO: 484980

SEQ ID NO: 739102 - RNA, 64 nt, hsa; identical to SEQ ID NO: 484981

SEQ ID NO: 739103 - RNA, 64 nt, hsa; identical to SEQ ID NO: 484982

SEQ ID NO: 739104 - RNA, 62 nt, hsa
acacucucaaaugauucacauguucagccaaaguugagaaccaucgagccuguggaaguucu

SEQ ID NO: 739105 - RNA, 62 nt, hsa
uauucacacucagggucaugcacuugcacaauguugagaaugaguaccacucucaccauugg

SEQ ID NO: 739106 - RNA, 62 nt, hsa
agaacaguaucuugguuaauugcuacugaaagguugagaaaggaaugguuugauauuuacca

SEQ ID NO: 739107 - RNA, 62 nt, hsa
uccugcugccaguucuuuccucuuuaggcgugguugagaaaaagcagaaacuuuacauaaag

SEQ ID NO: 739108 - RNA, 62 nt, hsa
acacggggugaaaccugggucagcaucccuagguugagaagggaugcauuuuucugcuacua

SEQ ID NO: 739109 - RNA, 62 nt, hsa
ugagagauugguaacacugagcaaauaaauauguugagaaugaugacagcaagauuucucca

SEQ ID NO: 739110 - RNA, 62 nt, hsa
guuaucaaaagugacuuugaccucauaaaagaguugagaacaucucucgugucacauacugc

SEQ ID NO: 739111 - RNA, 62 nt, hsa
agaacaaggaaagcucuccaaccaugucuggcguugagaagccaagagucucugucaacucu

SEQ ID NO: 739112 - RNA, 62 nt, hsa
ccacaauccaagugauucugauacacacuaaaguugagaaucacugcacuagaucacuuugu

SEQ ID NO: 739113 - RNA, 62 nt, hsa
auuuuccaacccaaaauaucauuaguccugagguugagaaacccuguccuagccuaacugug

SEQ ID NO: 739114 - RNA, 62 nt, hsa
uuuuuuugcaauaacaaggugaaaucaauauuguugagaagauucuuccaucugguaauguu

SEQ ID NO: 739115 - RNA, 62 nt, hsa
auauuguugagaagauucuuccaucugguaauguugagaagacuucauuugguaggaguccc

SEQ ID NO: 739116 - RNA, 62 nt, hsa
gaaugggaacucuaggucccaaggccugaaggguugagaacagacagcuguaacuuugaauu

SEQ ID NO: 739117 - RNA, 62 nt, hsa
ugccugucuucuugagacucguugagaucuuuguugagaaccacuacuaucauucacuagcu

SEQ ID NO: 739118 - RNA, 62 nt, hsa
auuggaaaauucuaaaauuuguccuugucuagguugagaacuuuuacacacacuaagauaaa

SEQ ID NO: 739119 - RNA, 62 nt, hsa
aaaaucuaaaacugcgaagaauacuaaauguaguugagaaauaauugauggcgagaguuugc

SEQ ID NO: 739120 - RNA, 62 nt, hsa
cuggcugcagauccuuagcauaggcagcaaauguugagaaagucuaucuguaguauuacaua

SEQ ID NO: 739121 - RNA, 62 nt, hsa
ugucguuaacuuguacaacauugccaucugcuguugagaauugguagguacugcuucugaga

SEQ ID NO: 739122 - RNA, 62 nt, hsa
aggugaaugagggaccagcccugcccugggcuguugagaagagaucaguccacccagaguua

SEQ ID NO: 739123 - RNA, 62 nt, hsa
ggggguagggggguggauuaggagauugaaggguugagaagaaagagaaauuguccaaagag

SEQ ID NO: 739124 - RNA, 62 nt, hsa
guggguauuaauguuuccauguucccaacuauguugagaaguggaaaaaaacccagguucua

SEQ ID NO: 739125 - RNA, 62 nt, hsa
uaaaccuucauauucuguauaguugcuaaaguguugagaaccuuuuuaauuguaaaaugaga

SEQ ID NO: 739126 - RNA, 64 nt, hsa; identical to SEQ ID NO: 484977

SEQ ID NO: 739127 - RNA, 64 nt, hsa; identical to SEQ ID NO: 484978

SEQ ID NO: 739128 - RNA, 64 nt, hsa; identical to SEQ ID NO: 484979

SEQ ID NO: 739129 - RNA, 64 nt, hsa; identical to SEQ ID NO: 484980

SEQ ID NO: 739130 - RNA, 64 nt, hsa; identical to SEQ ID NO: 484981

SEQ ID NO: 739131 - RNA, 64 nt, hsa; identical to SEQ ID NO: 484982

SEQ ID NO: 739132 - RNA, 62 nt, hsa; identical to SEQ ID NO: 739104

SEQ ID NO: 739133 - RNA, 62 nt, hsa; identical to SEQ ID NO: 739105

SEQ ID NO: 739134 - RNA, 62 nt, hsa; identical to SEQ ID NO: 739106

SEQ ID NO: 739135 - RNA, 62 nt, hsa; identical to SEQ ID NO: 739107

SEQ ID NO: 739136 - RNA, 62 nt, hsa; identical to SEQ ID NO: 739108

SEQ ID NO: 739137 - RNA, 62 nt, hsa; identical to SEQ ID NO: 739109

SEQ ID NO: 739138 - RNA, 62 nt, hsa; identical to SEQ ID NO: 739110

SEQ ID NO: 739139 - RNA, 62 nt, hsa; identical to SEQ ID NO: 739111

SEQ ID NO: 739140 - RNA, 62 nt, hsa; identical to SEQ ID NO: 739112

SEQ ID NO: 739141 - RNA, 62 nt, hsa; identical to SEQ ID NO: 739113

SEQ ID NO: 739142 - RNA, 62 nt, hsa; identical to SEQ ID NO: 739114

SEQ ID NO: 739143 - RNA, 62 nt, hsa; identical to SEQ ID NO: 739115

SEQ ID NO: 739144 - RNA, 62 nt, hsa; identical to SEQ ID NO: 739116

SEQ ID NO: 739145 - RNA, 62 nt, hsa; identical to SEQ ID NO: 739117

SEQ ID NO: 739146 - RNA, 62 nt, hsa; identical to SEQ ID NO: 739118

SEQ ID NO: 739147 - RNA, 62 nt, hsa; identical to SEQ ID NO: 739119

SEQ ID NO: 739148 - RNA, 62 nt, hsa; identical to SEQ ID NO: 739120

SEQ ID NO: 739149 - RNA, 62 nt, hsa; identical to SEQ ID NO: 739121

SEQ ID NO: 739150 - RNA, 62 nt, hsa; identical to SEQ ID NO: 739122

SEQ ID NO: 739151 - RNA, 62 nt, hsa; identical to SEQ ID NO: 739123

SEQ ID NO: 739152 - RNA, 62 nt, hsa; identical to SEQ ID NO: 739124

SEQ ID NO: 739153 - RNA, 62 nt, hsa; identical to SEQ ID NO: 739125

SEQ ID NO: 739154 - RNA, 55 nt, hsa; identical to SEQ ID NO: 194635

SEQ ID NO: 739155 - RNA, 64 nt, hsa; identical to SEQ ID NO: 417042

SEQ ID NO: 739156 - RNA, 64 nt, hsa; identical to SEQ ID NO: 417043

SEQ ID NO: 739157 - RNA, 64 nt, hsa; identical to SEQ ID NO: 417044

SEQ ID NO: 739158 - RNA, 64 nt, hsa; identical to SEQ ID NO: 417045

SEQ ID NO: 739159 - RNA, 64 nt, hsa; identical to SEQ ID NO: 417046

SEQ ID NO: 739160 - RNA, 64 nt, hsa; identical to SEQ ID NO: 417047

SEQ ID NO: 739161 - RNA, 64 nt, hsa; identical to SEQ ID NO: 417048

SEQ ID NO: 739162 - RNA, 64 nt, hsa; identical to SEQ ID NO: 417049

SEQ ID NO: 739163 - RNA, 64 nt, hsa; identical to SEQ ID NO: 417050

SEQ ID NO: 739164 - RNA, 64 nt, hsa; identical to SEQ ID NO: 417051

SEQ ID NO: 739165 - RNA, 64 nt, hsa; identical to SEQ ID NO: 417052

SEQ ID NO: 739166 - RNA, 64 nt, hsa; identical to SEQ ID NO: 417053

SEQ ID NO: 739167 - RNA, 64 nt, hsa; identical to SEQ ID NO: 417054

SEQ ID NO: 739168 - RNA, 64 nt, hsa; identical to SEQ ID NO: 417055

SEQ ID NO: 739169 - RNA, 64 nt, hsa; identical to SEQ ID NO: 417056

SEQ ID NO: 739170 - RNA, 64 nt, hsa; identical to SEQ ID NO: 417057

SEQ ID NO: 739171 - RNA, 64 nt, hsa; identical to SEQ ID NO: 417058

SEQ ID NO: 739172 - RNA, 64 nt, hsa; identical to SEQ ID NO: 417059

SEQ ID NO: 739173 - RNA, 64 nt, hsa; identical to SEQ ID NO: 417060

SEQ ID NO: 739174 - RNA, 64 nt, hsa; identical to SEQ ID NO: 417061

SEQ ID NO: 739175 - RNA, 64 nt, hsa; identical to SEQ ID NO: 417062

SEQ ID NO: 739176 - RNA, 64 nt, hsa; identical to SEQ ID NO: 417063

SEQ ID NO: 739177 - RNA, 64 nt, hsa; identical to SEQ ID NO: 417064

SEQ ID NO: 739178 - RNA, 64 nt, hsa; identical to SEQ ID NO: 417065

SEQ ID NO: 739179 - RNA, 64 nt, hsa; identical to SEQ ID NO: 417066

SEQ ID NO: 739180 - RNA, 64 nt, hsa; identical to SEQ ID NO: 417067

SEQ ID NO: 739181 - RNA, 64 nt, hsa; identical to SEQ ID NO: 417068

SEQ ID NO: 739182 - RNA, 64 nt, hsa; identical to SEQ ID NO: 417069

SEQ ID NO: 739183 - RNA, 64 nt, hsa; identical to SEQ ID NO: 417070

SEQ ID NO: 739184 - RNA, 64 nt, hsa; identical to SEQ ID NO: 417071

SEQ ID NO: 739185 - RNA, 64 nt, hsa; identical to SEQ ID NO: 417072

SEQ ID NO: 739186 - RNA, 64 nt, hsa; identical to SEQ ID NO: 417073

SEQ ID NO: 739187 - RNA, 64 nt, hsa; identical to SEQ ID NO: 417074

SEQ ID NO: 739188 - RNA, 64 nt, hsa; identical to SEQ ID NO: 417075

SEQ ID NO: 739189 - RNA, 64 nt, hsa; identical to SEQ ID NO: 417076

SEQ ID NO: 739190 - RNA, 64 nt, hsa; identical to SEQ ID NO: 417077

SEQ ID NO: 739191 - RNA, 64 nt, hsa; identical to SEQ ID NO: 417078

SEQ ID NO: 739192 - RNA, 64 nt, hsa; identical to SEQ ID NO: 417079

SEQ ID NO: 739193 - RNA, 64 nt, hsa; identical to SEQ ID NO: 417080

SEQ ID NO: 739194 - RNA, 64 nt, hsa; identical to SEQ ID NO: 417081

SEQ ID NO: 739195 - RNA, 64 nt, hsa; identical to SEQ ID NO: 124124

SEQ ID NO: 739196 - RNA, 64 nt, hsa; identical to SEQ ID NO: 124125

SEQ ID NO: 739197 - RNA, 64 nt, hsa; identical to SEQ ID NO: 124126

SEQ ID NO: 739198 - RNA, 64 nt, hsa; identical to SEQ ID NO: 124127

SEQ ID NO: 739199 - RNA, 64 nt, hsa; identical to SEQ ID NO: 124128

SEQ ID NO: 739200 - RNA, 64 nt, hsa; identical to SEQ ID NO: 124129

SEQ ID NO: 739201 - RNA, 64 nt, hsa; identical to SEQ ID NO: 124130

SEQ ID NO: 739202 - RNA, 64 nt, hsa; identical to SEQ ID NO: 124131

SEQ ID NO: 739203 - RNA, 64 nt, hsa; identical to SEQ ID NO: 124132

SEQ ID NO: 739204 - RNA, 64 nt, hsa; identical to SEQ ID NO: 124133

SEQ ID NO: 739205 - RNA, 64 nt, hsa; identical to SEQ ID NO: 124134

SEQ ID NO: 739206 - RNA, 64 nt, hsa; identical to SEQ ID NO: 124135

SEQ ID NO: 739207 - RNA, 64 nt, hsa; identical to SEQ ID NO: 124136

SEQ ID NO: 739208 - RNA, 64 nt, hsa; identical to SEQ ID NO: 124137

SEQ ID NO: 739209 - RNA, 64 nt, hsa; identical to SEQ ID NO: 124138

SEQ ID NO: 739210 - RNA, 64 nt, hsa; identical to SEQ ID NO: 124139

SEQ ID NO: 739211 - RNA, 64 nt, hsa; identical to SEQ ID NO: 124140

SEQ ID NO: 739212 - RNA, 64 nt, hsa; identical to SEQ ID NO: 124141

SEQ ID NO: 739213 - RNA, 64 nt, hsa; identical to SEQ ID NO: 124142

SEQ ID NO: 739214 - RNA, 64 nt, hsa; identical to SEQ ID NO: 124143

SEQ ID NO: 739215 - RNA, 64 nt, hsa; identical to SEQ ID NO: 124144

SEQ ID NO: 739216 - RNA, 61 nt, hsa; identical to SEQ ID NO: 124145

SEQ ID NO: 739217 - RNA, 64 nt, hsa; identical to SEQ ID NO: 124146

SEQ ID NO: 739218 - RNA, 64 nt, hsa; identical to SEQ ID NO: 124147

SEQ ID NO: 739219 - RNA, 64 nt, hsa
gucgauguaauuaacugauggcccaaaaacuaccucaagagaccuggcccuguuaagacggcuu

SEQ ID NO: 739220 - RNA, 64 nt, hsa
cugagaaguugggcugagaguauggggaaaagaaucaagagaccugacugccgccaacucacua

SEQ ID NO: 739221 - RNA, 64 nt, hsa
augaagguuuuuugcuuuuugacauacgaaaaugucaagagaaaggccaaagauuuguacuuuu

SEQ ID NO: 739222 - RNA, 64 nt, hsa
uaugauacuguaauaauauuuuuaaaaauuuacaucaagagaggcagucauucacgaugguuuu

SEQ ID NO: 739223 - RNA, 64 nt, hsa
gaucucagcucacugcaaccucugccuccugggcucaagagaccagcccaccuccgccuccaag

SEQ ID NO: 739224 - RNA, 64 nt, hsa
ccauauuucuuaggcuggccuuuaacuucugagcucaagagaugcacuccccucagccucccaa

SEQ ID NO: 739225 - RNA, 64 nt, hsa
guagccuuauccugguuuuacagaugugaaacuuucaagagauuuacugacuuuccuagaauag

SEQ ID NO: 739226 - RNA, 64 nt, hsa
auuccauguaagcauuaaacaguguauguagguuucaagagauugugaugauucuuaaauuuua

SEQ ID NO: 739227 - RNA, 64 nt, hsa
cuggaaauacuuuuuaauuuuuuuaacuuaaaauucaagagacugaaucacuuuucucauugau

SEQ ID NO: 739228 - RNA, 64 nt, hsa
aauauaugcugugccuguacuuauauacagucuuucaagagagauacaaacaaggcagaaacau

SEQ ID NO: 739229 - RNA, 64 nt, hsa
cacuuuggggagcugaggcgggcggaucacgaggucaagagaucgagaccauccuggccaacau

SEQ ID NO: 739230 - RNA, 64 nt, hsa
caauauuaaaaaacaauuugcaagaaaauguguuucaagagagcaaccuaagcuaagucacucu

SEQ ID NO: 739231 - RNA, 64 nt, hsa
augccuauaaguagcaggccuuugugccucagugucaagagaaaucaagagaugcuaaaagcuu

SEQ ID NO: 739232 - RNA, 64 nt, hsa
guagcaggccuuugugccucagugucaagagaaaucaagagaugcuaaaagcuuuacaauggaa

SEQ ID NO: 739233 - RNA, 64 nt, hsa
cuccugauccucaaccuccaugccuaaggcugguucaagagaccacauaauaucugccuuuuau

SEQ ID NO: 739234 - RNA, 64 nt, hsa
gucaugugaaaaauauugauuacucacacauagaucaagagagacacggcuccugccuucaugg

SEQ ID NO: 739235 - RNA, 64 nt, hsa
ucugucuggugagcucugcuuuuucagugcaccaucaagagaugcagccccguggacaugaaga

SEQ ID NO: 739236 - RNA, 64 nt, hsa
aaaaaaucaccuuguguguuguagcucauuuguuucaagagagaaucaacagaucauauucagu

SEQ ID NO: 739237 - RNA, 64 nt, hsa; identical to SEQ ID NO: 363444

SEQ ID NO: 739238 - RNA, 64 nt, hsa; identical to SEQ ID NO: 363445

SEQ ID NO: 739239 - RNA, 64 nt, hsa; identical to SEQ ID NO: 363446

SEQ ID NO: 739240 - RNA, 64 nt, hsa; identical to SEQ ID NO: 363447

SEQ ID NO: 739241 - RNA, 64 nt, hsa; identical to SEQ ID NO: 363448

SEQ ID NO: 739242 - RNA, 64 nt, hsa; identical to SEQ ID NO: 363449

SEQ ID NO: 739243 - RNA, 64 nt, hsa; identical to SEQ ID NO: 363450

SEQ ID NO: 739244 - RNA, 64 nt, hsa; identical to SEQ ID NO: 363451

SEQ ID NO: 739245 - RNA, 64 nt, hsa; identical to SEQ ID NO: 363452

SEQ ID NO: 739246 - RNA, 64 nt, hsa; identical to SEQ ID NO: 363453

SEQ ID NO: 739247 - RNA, 64 nt, hsa; identical to SEQ ID NO: 363454

SEQ ID NO: 739248 - RNA, 64 nt, hsa; identical to SEQ ID NO: 363455

SEQ ID NO: 739249 - RNA, 64 nt, hsa; identical to SEQ ID NO: 363456

SEQ ID NO: 739250 - RNA, 64 nt, hsa; identical to SEQ ID NO: 363457

SEQ ID NO: 739251 - RNA, 64 nt, hsa; identical to SEQ ID NO: 363458

SEQ ID NO: 739252 - RNA, 64 nt, hsa; identical to SEQ ID NO: 363459

SEQ ID NO: 739253 - RNA, 64 nt, hsa; identical to SEQ ID NO: 363460

SEQ ID NO: 739254 - RNA, 64 nt, hsa; identical to SEQ ID NO: 363461

SEQ ID NO: 739255 - RNA, 64 nt, hsa; identical to SEQ ID NO: 363462

SEQ ID NO: 739256 - RNA, 64 nt, hsa; identical to SEQ ID NO: 363463

SEQ ID NO: 739257 - RNA, 64 nt, hsa; identical to SEQ ID NO: 363464

SEQ ID NO: 739258 - RNA, 64 nt, hsa; identical to SEQ ID NO: 363465

SEQ ID NO: 739259 - RNA, 64 nt, hsa; identical to SEQ ID NO: 363466

SEQ ID NO: 739260 - RNA, 64 nt, hsa; identical to SEQ ID NO: 363467

SEQ ID NO: 739261 - RNA, 64 nt, hsa; identical to SEQ ID NO: 363468

SEQ ID NO: 739262 - RNA, 64 nt, hsa; identical to SEQ ID NO: 363469

SEQ ID NO: 739263 - RNA, 64 nt, hsa; identical to SEQ ID NO: 363470

SEQ ID NO: 739264 - RNA, 64 nt, hsa; identical to SEQ ID NO: 363471

SEQ ID NO: 739265 - RNA, 64 nt, hsa; identical to SEQ ID NO: 363472

SEQ ID NO: 739266 - RNA, 64 nt, hsa; identical to SEQ ID NO: 363473

SEQ ID NO: 739267 - RNA, 56 nt, hsa; identical to SEQ ID NO: 363474

SEQ ID NO: 739268 - RNA, 64 nt, hsa; identical to SEQ ID NO: 363475

SEQ ID NO: 739269 - RNA, 64 nt, hsa; identical to SEQ ID NO: 363476

SEQ ID NO: 739270 - RNA, 64 nt, hsa; identical to SEQ ID NO: 363477

SEQ ID NO: 739271 - RNA, 64 nt, hsa; identical to SEQ ID NO: 363478

SEQ ID NO: 739272 - RNA, 64 nt, hsa; identical to SEQ ID NO: 363479

SEQ ID NO: 739273 - RNA, 64 nt, hsa; identical to SEQ ID NO: 363480

SEQ ID NO: 739274 - RNA, 64 nt, hsa; identical to SEQ ID NO: 363481

SEQ ID NO: 739275 - RNA, 64 nt, hsa; identical to SEQ ID NO: 363482

SEQ ID NO: 739276 - RNA, 64 nt, hsa; identical to SEQ ID NO: 363483

SEQ ID NO: 739277 - RNA, 64 nt, hsa; identical to SEQ ID NO: 363484

SEQ ID NO: 739278 - RNA, 64 nt, hsa; identical to SEQ ID NO: 363485

SEQ ID NO: 739279 - RNA, 64 nt, hsa; identical to SEQ ID NO: 363486

SEQ ID NO: 739280 - RNA, 64 nt, hsa; identical to SEQ ID NO: 363487

SEQ ID NO: 739281 - RNA, 64 nt, hsa; identical to SEQ ID NO: 363488

SEQ ID NO: 739282 - RNA, 64 nt, hsa; identical to SEQ ID NO: 363489

SEQ ID NO: 739283 - RNA, 64 nt, hsa; identical to SEQ ID NO: 363490

SEQ ID NO: 739284 - RNA, 64 nt, hsa; identical to SEQ ID NO: 363491

SEQ ID NO: 739285 - RNA, 64 nt, hsa; identical to SEQ ID NO: 363492

SEQ ID NO: 739286 - RNA, 64 nt, hsa; identical to SEQ ID NO: 363493

SEQ ID NO: 739287 - RNA, 64 nt, hsa; identical to SEQ ID NO: 363494

SEQ ID NO: 739288 - RNA, 64 nt, hsa; identical to SEQ ID NO: 363495

SEQ ID NO: 739289 - RNA, 64 nt, hsa; identical to SEQ ID NO: 363496

SEQ ID NO: 739290 - RNA, 64 nt, hsa; identical to SEQ ID NO: 363497

SEQ ID NO: 739291 - RNA, 64 nt, hsa; identical to SEQ ID NO: 363498

SEQ ID NO: 739292 - RNA, 64 nt, hsa; identical to SEQ ID NO: 363499

SEQ ID NO: 739293 - RNA, 64 nt, hsa; identical to SEQ ID NO: 363500

SEQ ID NO: 739294 - RNA, 64 nt, hsa; identical to SEQ ID NO: 363501

SEQ ID NO: 739295 - RNA, 64 nt, hsa; identical to SEQ ID NO: 363502

SEQ ID NO: 739296 - RNA, 64 nt, hsa; identical to SEQ ID NO: 363503

SEQ ID NO: 739297 - RNA, 64 nt, hsa; identical to SEQ ID NO: 363504

SEQ ID NO: 739298 - RNA, 64 nt, hsa; identical to SEQ ID NO: 363505

SEQ ID NO: 739299 - RNA, 64 nt, hsa; identical to SEQ ID NO: 363506

SEQ ID NO: 739300 - RNA, 64 nt, hsa; identical to SEQ ID NO: 363507

SEQ ID NO: 739301 - RNA, 64 nt, hsa; identical to SEQ ID NO: 363508

SEQ ID NO: 739302 - RNA, 64 nt, hsa; identical to SEQ ID NO: 363509

SEQ ID NO: 739303 - RNA, 64 nt, hsa; identical to SEQ ID NO: 363510

SEQ ID NO: 739304 - RNA, 63 nt, hsa; identical to SEQ ID NO: 363511

SEQ ID NO: 739305 - RNA, 64 nt, hsa; identical to SEQ ID NO: 363512

SEQ ID NO: 739306 - RNA, 64 nt, hsa; identical to SEQ ID NO: 363513

SEQ ID NO: 739307 - RNA, 64 nt, hsa; identical to SEQ ID NO: 363514

SEQ ID NO: 739308 - RNA, 64 nt, hsa; identical to SEQ ID NO: 363515

SEQ ID NO: 739309 - RNA, 64 nt, hsa; identical to SEQ ID NO: 363516

SEQ ID NO: 739310 - RNA, 64 nt, hsa; identical to SEQ ID NO: 363517

SEQ ID NO: 739311 - RNA, 64 nt, hsa; identical to SEQ ID NO: 363518

SEQ ID NO: 739312 - RNA, 64 nt, hsa; identical to SEQ ID NO: 363519

SEQ ID NO: 739313 - RNA, 64 nt, hsa; identical to SEQ ID NO: 272964

SEQ ID NO: 739314 - RNA, 64 nt, hsa; identical to SEQ ID NO: 272965

SEQ ID NO: 739315 - RNA, 64 nt, hsa; identical to SEQ ID NO: 272966

SEQ ID NO: 739316 - RNA, 64 nt, hsa; identical to SEQ ID NO: 272967

SEQ ID NO: 739317 - RNA, 64 nt, hsa; identical to SEQ ID NO: 272968

SEQ ID NO: 739318 - RNA, 64 nt, hsa; identical to SEQ ID NO: 272969

SEQ ID NO: 739319 - RNA, 64 nt, hsa; identical to SEQ ID NO: 272970

SEQ ID NO: 739320 - RNA, 64 nt, hsa; identical to SEQ ID NO: 272971

SEQ ID NO: 739321 - RNA, 64 nt, hsa; identical to SEQ ID NO: 272972

SEQ ID NO: 739322 - RNA, 64 nt, hsa; identical to SEQ ID NO: 272973

SEQ ID NO: 739323 - RNA, 64 nt, hsa; identical to SEQ ID NO: 272974

SEQ ID NO: 739324 - RNA, 64 nt, hsa; identical to SEQ ID NO: 272975

SEQ ID NO: 739325 - RNA, 64 nt, hsa; identical to SEQ ID NO: 272976

SEQ ID NO: 739326 - RNA, 64 nt, hsa; identical to SEQ ID NO: 272977

SEQ ID NO: 739327 - RNA, 64 nt, hsa; identical to SEQ ID NO: 272978

SEQ ID NO: 739328 - RNA, 64 nt, hsa; identical to SEQ ID NO: 272979

SEQ ID NO: 739329 - RNA, 64 nt, hsa; identical to SEQ ID NO: 272980

SEQ ID NO: 739330 - RNA, 64 nt, hsa; identical to SEQ ID NO: 272981

SEQ ID NO: 739331 - RNA, 64 nt, hsa; identical to SEQ ID NO: 272982

SEQ ID NO: 739332 - RNA, 64 nt, hsa; identical to SEQ ID NO: 272983

SEQ ID NO: 739333 - RNA, 64 nt, hsa; identical to SEQ ID NO: 272984

SEQ ID NO: 739334 - RNA, 64 nt, hsa; identical to SEQ ID NO: 272985

SEQ ID NO: 739335 - RNA, 64 nt, hsa; identical to SEQ ID NO: 272986

SEQ ID NO: 739336 - RNA, 64 nt, hsa; identical to SEQ ID NO: 272987

SEQ ID NO: 739337 - RNA, 64 nt, hsa; identical to SEQ ID NO: 272988

SEQ ID NO: 739338 - RNA, 64 nt, hsa; identical to SEQ ID NO: 272989

SEQ ID NO: 739339 - RNA, 64 nt, hsa; identical to SEQ ID NO: 272990

SEQ ID NO: 739340 - RNA, 64 nt, hsa; identical to SEQ ID NO: 272991

SEQ ID NO: 739341 - RNA, 64 nt, hsa; identical to SEQ ID NO: 272992

SEQ ID NO: 739342 - RNA, 64 nt, hsa; identical to SEQ ID NO: 272993

SEQ ID NO: 739343 - RNA, 64 nt, hsa; identical to SEQ ID NO: 272994

SEQ ID NO: 739344 - RNA, 64 nt, hsa; identical to SEQ ID NO: 272995

SEQ ID NO: 739345 - RNA, 64 nt, hsa; identical to SEQ ID NO: 272996

SEQ ID NO: 739346 - RNA, 64 nt, hsa; identical to SEQ ID NO: 272997

SEQ ID NO: 739347 - RNA, 64 nt, hsa; identical to SEQ ID NO: 272998

SEQ ID NO: 739348 - RNA, 64 nt, hsa; identical to SEQ ID NO: 272999

SEQ ID NO: 739349 - RNA, 64 nt, hsa; identical to SEQ ID NO: 273000

SEQ ID NO: 739350 - RNA, 64 nt, hsa; identical to SEQ ID NO: 273001

SEQ ID NO: 739351 - RNA, 64 nt, hsa; identical to SEQ ID NO: 581471

SEQ ID NO: 739352 - RNA, 64 nt, hsa; identical to SEQ ID NO: 581472

SEQ ID NO: 739353 - RNA, 64 nt, hsa; identical to SEQ ID NO: 581473

SEQ ID NO: 739354 - RNA, 64 nt, hsa; identical to SEQ ID NO: 581474

SEQ ID NO: 739355 - RNA, 64 nt, hsa; identical to SEQ ID NO: 581475

SEQ ID NO: 739356 - RNA, 64 nt, hsa; identical to SEQ ID NO: 581476

SEQ ID NO: 739357 - RNA, 64 nt, hsa; identical to SEQ ID NO: 581477

SEQ ID NO: 739358 - RNA, 64 nt, hsa; identical to SEQ ID NO: 581478

SEQ ID NO: 739359 - RNA, 64 nt, hsa; identical to SEQ ID NO: 581479

SEQ ID NO: 739360 - RNA, 64 nt, hsa; identical to SEQ ID NO: 581480

SEQ ID NO: 739361 - RNA, 64 nt, hsa; identical to SEQ ID NO: 581481

SEQ ID NO: 739362 - RNA, 64 nt, hsa; identical to SEQ ID NO: 581482

SEQ ID NO: 739363 - RNA, 64 nt, hsa; identical to SEQ ID NO: 581483

SEQ ID NO: 739364 - RNA, 64 nt, hsa; identical to SEQ ID NO: 581484

SEQ ID NO: 739365 - RNA, 64 nt, hsa; identical to SEQ ID NO: 581485

SEQ ID NO: 739366 - RNA, 64 nt, hsa; identical to SEQ ID NO: 581486

SEQ ID NO: 739367 - RNA, 64 nt, hsa; identical to SEQ ID NO: 581487

SEQ ID NO: 739368 - RNA, 64 nt, hsa; identical to SEQ ID NO: 581488

SEQ ID NO: 739369 - RNA, 64 nt, hsa; identical to SEQ ID NO: 581489

SEQ ID NO: 739370 - RNA, 64 nt, hsa; identical to SEQ ID NO: 581490

SEQ ID NO: 739371 - RNA, 64 nt, hsa; identical to SEQ ID NO: 581491

SEQ ID NO: 739372 - RNA, 64 nt, hsa; identical to SEQ ID NO: 581492

SEQ ID NO: 739373 - RNA, 64 nt, hsa; identical to SEQ ID NO: 581493

SEQ ID NO: 739374 - RNA, 64 nt, hsa; identical to SEQ ID NO: 581494

SEQ ID NO: 739375 - RNA, 64 nt, hsa; identical to SEQ ID NO: 581495

SEQ ID NO: 739376 - RNA, 64 nt, hsa; identical to SEQ ID NO: 581496

SEQ ID NO: 739377 - RNA, 64 nt, hsa; identical to SEQ ID NO: 581497

SEQ ID NO: 739378 - RNA, 64 nt, hsa; identical to SEQ ID NO: 581498

SEQ ID NO: 739379 - RNA, 64 nt, hsa; identical to SEQ ID NO: 581499

SEQ ID NO: 739380 - RNA, 64 nt, hsa; identical to SEQ ID NO: 581500

SEQ ID NO: 739381 - RNA, 64 nt, hsa; identical to SEQ ID NO: 581501

SEQ ID NO: 739382 - RNA, 64 nt, hsa; identical to SEQ ID NO: 581502

SEQ ID NO: 739383 - RNA, 64 nt, hsa; identical to SEQ ID NO: 581503

SEQ ID NO: 739384 - RNA, 64 nt, hsa; identical to SEQ ID NO: 581504

SEQ ID NO: 739385 - RNA, 64 nt, hsa; identical to SEQ ID NO: 581505

SEQ ID NO: 739386 - RNA, 64 nt, hsa; identical to SEQ ID NO: 581506

SEQ ID NO: 739387 - RNA, 64 nt, hsa; identical to SEQ ID NO: 581507

SEQ ID NO: 739388 - RNA, 64 nt, hsa; identical to SEQ ID NO: 581508

SEQ ID NO: 739389 - RNA, 64 nt, hsa; identical to SEQ ID NO: 581509

SEQ ID NO: 739390 - RNA, 64 nt, hsa; identical to SEQ ID NO: 581510

SEQ ID NO: 739391 - RNA, 64 nt, hsa; identical to SEQ ID NO: 581511

SEQ ID NO: 739392 - RNA, 64 nt, hsa; identical to SEQ ID NO: 581512

SEQ ID NO: 739393 - RNA, 64 nt, hsa; identical to SEQ ID NO: 581513

SEQ ID NO: 739394 - RNA, 64 nt, hsa; identical to SEQ ID NO: 581514

SEQ ID NO: 739395 - RNA, 64 nt, hsa; identical to SEQ ID NO: 581515

SEQ ID NO: 739396 - RNA, 64 nt, hsa; identical to SEQ ID NO: 581516

SEQ ID NO: 739397 - RNA, 64 nt, hsa; identical to SEQ ID NO: 581517

SEQ ID NO: 739398 - RNA, 64 nt, hsa; identical to SEQ ID NO: 581518

SEQ ID NO: 739399 - RNA, 64 nt, hsa; identical to SEQ ID NO: 581519

SEQ ID NO: 739400 - RNA, 64 nt, hsa; identical to SEQ ID NO: 581520

SEQ ID NO: 739401 - RNA, 64 nt, hsa; identical to SEQ ID NO: 581521

SEQ ID NO: 739402 - RNA, 64 nt, hsa; identical to SEQ ID NO: 581522

SEQ ID NO: 739403 - RNA, 64 nt, hsa; identical to SEQ ID NO: 581523

SEQ ID NO: 739404 - RNA, 64 nt, hsa; identical to SEQ ID NO: 581524

SEQ ID NO: 739405 - RNA, 64 nt, hsa; identical to SEQ ID NO: 581525

SEQ ID NO: 739406 - RNA, 64 nt, hsa; identical to SEQ ID NO: 581526

SEQ ID NO: 739407 - RNA, 64 nt, hsa; identical to SEQ ID NO: 581527

SEQ ID NO: 739408 - RNA, 64 nt, hsa; identical to SEQ ID NO: 581528

SEQ ID NO: 739409 - RNA, 64 nt, hsa; identical to SEQ ID NO: 581529

SEQ ID NO: 739410 - RNA, 64 nt, hsa; identical to SEQ ID NO: 581530

SEQ ID NO: 739411 - RNA, 64 nt, hsa; identical to SEQ ID NO: 581531

SEQ ID NO: 739412 - RNA, 64 nt, hsa; identical to SEQ ID NO: 581532

SEQ ID NO: 739413 - RNA, 64 nt, hsa; identical to SEQ ID NO: 581533

SEQ ID NO: 739414 - RNA, 64 nt, hsa; identical to SEQ ID NO: 581534

SEQ ID NO: 739415 - RNA, 64 nt, hsa; identical to SEQ ID NO: 581535

SEQ ID NO: 739416 - RNA, 64 nt, hsa; identical to SEQ ID NO: 581536

SEQ ID NO: 739417 - RNA, 64 nt, hsa; identical to SEQ ID NO: 581537

SEQ ID NO: 739418 - RNA, 64 nt, hsa; identical to SEQ ID NO: 581538

SEQ ID NO: 739419 - RNA, 64 nt, hsa
cuuucugcccuccuucccaucccacaugcugagccgccacaaagaccaaagaagugauggcuuu

SEQ ID NO: 739420 - RNA, 64 nt, hsa
aucuggggugucuguaaugucaccccuccagcagcgccacaaggacugagguuggguaggugug

SEQ ID NO: 739421 - RNA, 64 nt, hsa
cccacuggagacuuugaguucuccuacauucauccgccacaaaucuuaauguguugaaagaaug

SEQ ID NO: 739422 - RNA, 64 nt, hsa
gaauagaacucguagcucgugacugcacgguuuacgccacaaaagugcucuugacauccgugac

SEQ ID NO: 739423 - RNA, 64 nt, hsa
guuuaaaaaaauaaaaaggaaaggaagcguucaccgccacaaaucauaaaauggacaugacugu

SEQ ID NO: 739424 - RNA, 64 nt, hsa
ggcaaaauaagauuuaguuguguuuucucagagccgccacaagauugaacaaaauguuuucugu

SEQ ID NO: 739425 - RNA, 64 nt, hsa
cuugcugugcgucuuccaaacuaaagccugcaagcgccacaauucuaagugccgccuuccauuu

SEQ ID NO: 739426 - RNA, 64 nt, hsa
auugcucugucccaggacacuugcgugccagagacgccacaacuucaugucccugucucuugca

SEQ ID NO: 739427 - RNA, 64 nt, hsa
gaacgccuuugaaauggcuuugcuaaaaugcucccgccacaaaguuguaggaaaugggaagagg

SEQ ID NO: 739428 - RNA, 64 nt, hsa
caaaauuauuaauccucuugagagaaacgugaaacgccacaaaaauagagaaaauucaggucug

SEQ ID NO: 739429 - RNA, 64 nt, hsa
cauuuucccccucacccuaacucucuuauucugccgccacaaugcaagcauaguuugauguuuu

SEQ ID NO: 739430 - RNA, 64 nt, hsa
gucaccgaagguccuacagggccacaacugcccccgccacaacccaccccgcuuucguaguuuu

SEQ ID NO: 739431 - RNA, 64 nt, hsa
cuggccacggagggcuccugccucucuucuucagcgccacaaaauuacauggaggccagcuggu

SEQ ID NO: 739432 - RNA, 64 nt, hsa
guaaaaaugauacugaagaggaaaguaauaaauccgccacaacagacaaugaaauaaguaggac

SEQ ID NO: 739433 - RNA, 64 nt, hsa
uuccaguacuaacaaagggaauaaaaauaccucacgccacaauccagcauauugauguuuuaag

SEQ ID NO: 739434 - RNA, 64 nt, hsa
gaucucugacuucuuauuaccuccgauuggaacgcgccacaaaucauccugcuuucuuuauccu

SEQ ID NO: 739435 - RNA, 64 nt, hsa
gcuuuucuucuaacuuuucccucuagccucuccucgccacaauuugcugcuuacugcugguguu

SEQ ID NO: 739436 - RNA, 64 nt, hsa
acuuguguaaacagcagcagucacguuccucggccgccacaaccaacaccaaagcaggaaaacc

SEQ ID NO: 739437 - RNA, 64 nt, hsa
gaggggagcuugguggcccccguggcugcaagcucgccacaacauggcucuuugugagccugug

SEQ ID NO: 739438 - RNA, 64 nt, hsa
ccgagguaggaaaggccagccccagacauccuaucgccacaaugccaugucgcaauaggaagca

SEQ ID NO: 739439 - RNA, 64 nt, hsa
agauuugggggugcuaauccaggacagcauuacacgccacaacuccaguguucccuucuggcug

SEQ ID NO: 739440 - RNA, 64 nt, hsa
gguuaccuuugcugcuaaagauccaaucuucuaacgccacaacagcauagcaaauccuaggaua

SEQ ID NO: 739441 - RNA, 64 nt, hsa; identical to SEQ ID NO: 739439

SEQ ID NO: 739442 - RNA, 64 nt, hsa
gugggagacagagcuggaccugcagggguggucccgccacaacccugcguguggacccuggcag

SEQ ID NO: 739443 - RNA, 64 nt, hsa
caagggcgcugucccgcccaaccccgccuuuaaacgccacaaauaaagagcauuguuaccgcca

SEQ ID NO: 739444 - RNA, 64 nt, hsa
acucggggccaccuccacuccaugugcccagccccgccacaaccucuccuccagcacauuccag

SEQ ID NO: 739445 - RNA, 64 nt, hsa
acacgcauccgcaucggccucccugcccacaaagcgccacaacggugaccagccggagcagccg

SEQ ID NO: 739446 - RNA, 64 nt, hsa
cauugacuuuuaguaaauuucuagcguuaugcaucgccacaauccaguuuuagaauauuuccau

SEQ ID NO: 739447 - RNA, 64 nt, hsa
aucaggaaggcuagaguuacccagagcaucaggccgccacaagugccugcuuuuaggagaccga

SEQ ID NO: 739448 - RNA, 64 nt, hsa
ccagggcucacgugggaaccccccucccacccaccgccacaauaaagaucgcccccaccuccac

SEQ ID NO: 739449 - RNA, 64 nt, hsa
caggccaacauucagauucaggaaauacagagaacgccacaaagauacuccuugagaagagcaa

SEQ ID NO: 739450 - RNA, 64 nt, hsa
gugagucuucaucuuagggcaucgcuccuccucacgccacaaaucuggugccucucucuugcuu

SEQ ID NO: 739451 - RNA, 64 nt, hsa
cccgcgacccacccgcggaguggggggcccccuccgccacaaggaagcacaaccagcucgcccu

SEQ ID NO: 739452 - RNA, 64 nt, hsa
ggcuuuucccaucagcgugcauucaccagcccaucgccacaaacucuaucggagaacaugaauc

SEQ ID NO: 739453 - RNA, 64 nt, hsa
cagacagaaccaucugaggcucaccuuuggguuuugugacaagaaggggacguguuggguuuuu

SEQ ID NO: 739454 - RNA, 64 nt, hsa
ggauccuuguaccugguuuggguuuucccuuccuugugacaauuauaauccagaugccucuucu

SEQ ID NO: 739455 - RNA, 64 nt, hsa
gcgaaagucaaguaucugaggccacuugcaacauugugacaaagaagauggaagauagcagccu

SEQ ID NO: 739456 - RNA, 64 nt, hsa
uuaaagcugacuuuucuugccagaaaguuuuccuugugacaagaaauuugcaagcuuuucaauc

SEQ ID NO: 739457 - RNA, 64 nt, hsa
uuauuuauuaccuuuccauuuguucgccugaugaugugacaaugcauggucuuugugcaugcug

SEQ ID NO: 739458 - RNA, 64 nt, hsa
auguacuucuggcaauucuaucuguauuuaaagaugugacaaucuugacaccaauuuuaagaau

SEQ ID NO: 739459 - RNA, 64 nt, hsa
uugauuucccucauuguguaaacauugacagguaugugacaaaugggaaaaaaaauccaaauaa

SEQ ID NO: 739460 - RNA, 64 nt, hsa
cauccuagauauaaaaccauagaaauguaaaagaugugacaaaaccuuuaagccauacuccagg

SEQ ID NO: 739461 - RNA, 64 nt, hsa
auucacacugaagagaaacugcaaacguggaaagugugacaaagcuugcaaccacacucaaucu

SEQ ID NO: 739462 - RNA, 64 nt, hsa
uacaaagaucuuuaaaguuauuuuuaggcacauuugugacaaacaacuacuugauauugaaauc

SEQ ID NO: 739463 - RNA, 64 nt, hsa
auaaaaugacggaccuguuaggaaaaugcuguugugugacaauggagagccugcccaaggacug

SEQ ID NO: 739464 - RNA, 64 nt, hsa
cugccaggccucgagcauccaagcaugauuuugcugugacaaaucuaaaaucaaccaggcuacu

SEQ ID NO: 739465 - RNA, 64 nt, hsa
ccaggccccaagcaucugagcaugaugauuuugcugugacaauucuaagaucaaccagguuacu

SEQ ID NO: 739466 - RNA, 64 nt, hsa
uuuuuuaaugauuaaaaaaaucaaaauaauauucugugacaaugacaggugaaauuuauaugug

SEQ ID NO: 739467 - RNA, 64 nt, hsa
uaauauucugugacaaugacaggugaaauuuauaugugacaagugaaaauuauaugaaauuuaa

SEQ ID NO: 739468 - RNA, 64 nt, hsa
aaauauugaaaggagguauaguucauuucaucucugugacaaauuuauagcaaggcacugaauu

SEQ ID NO: 739469 - RNA, 64 nt, hsa
aauacacaaacaaaaaaagugacaguuacuuuuuugugacaagagcaauauuggguaugaacug

SEQ ID NO: 739470 - RNA, 64 nt, hsa
auuuguacuuuaagucaaaugcuuauaugaaauaugugacaacaaauagagaagacuggcucug

SEQ ID NO: 739471 - RNA, 64 nt, hsa
cggaaaaugagaaugaggguaauccuggagaaauugugacaacaauuugaaaauugugguugca

SEQ ID NO: 739472 - RNA, 64 nt, hsa
guaaacgacuuuaaaaaauaaaugauuauugcuuugugacaauugacagaauaugucugauguu

SEQ ID NO: 739473 - RNA, 64 nt, hsa
caguguuugcuauucagacugucuaaauacagcaugugacaagcugaagaagccaaaucuauca

SEQ ID NO: 739474 - RNA, 64 nt, hsa
ucauaccauagagaaauccuacaaauaugaagaaugugacaaagcuuuuaaccacuucucaacc

SEQ ID NO: 739475 - RNA, 64 nt, hsa
ucauacaggagagaaacccuacaaaugugaagaaugugacaaagccuuuaaccaguccucaauu

SEQ ID NO: 739476 - RNA, 64 nt, hsa
ucauaugaaugagaaauccuagaaaugugaagaaugugacaaagccuuuaaauggcugucacac

SEQ ID NO: 739477 - RNA, 64 nt, hsa
auucauacaugagagacucuacaaaccugaaagaugugacaaugcuuuuggcaacaccucagac

SEQ ID NO: 739478 - RNA, 64 nt, hsa
ucaugcuggagagaaacacuacaaacgugaagaaugugacaaaggcuucaaccgguccucaaac

SEQ ID NO: 739479 - RNA, 64 nt, hsa
ccugcagggcauuguguccuggggugacgucccuugugacaacaccaccaagccuggugucuau

SEQ ID NO: 739480 - RNA, 64 nt, hsa
uugugccaacaucagcauuaucucggacacaucuugugacaagagcuacccagggcgccugaca

SEQ ID NO: 739481 - RNA, 64 nt, hsa
ucauacugcagagaaaucuuacaaaugugaagacugugacaaaguugucagucacaaaucacag

SEQ ID NO: 739482 - RNA, 64 nt, hsa
ucauacugcagagaaacuuuacaaauaggaagaaugugacaaaguuuucgguugcaaaucaaac

SEQ ID NO: 739483 - RNA, 64 nt, hsa
ucacacuggagaaaagccauagaaauguaagguuugugacaaggcuuucgggaaugauucacac

SEQ ID NO: 739484 - RNA, 64 nt, hsa
ucauacugcauagaaaucuuacaaacgugaacaaugugacaaaguuuucauucacaaauccagc

SEQ ID NO: 739485 - RNA, 64 nt, hsa
ucacauugaagagaaaccauacagagguaagguuugugacaagguuuuugcauauaaugcauau

SEQ ID NO: 739486 - RNA, 64 nt, hsa
ucauacuggagagaaaccuuacaaaugggaggaaugugacaaaaguuuucaguuguaaaucaaa

SEQ ID NO: 739487 - RNA, 64 nt, hsa
acuacccuuccaugccccagaccucugucuugcaugugacaauugacaaucuggacuaccccaa

SEQ ID NO: 739488 - RNA, 64 nt, hsa
aaagcaaaacaaaauggaaaguaggggagguggaugugacaacaacuuccaaauuggcucuuug

SEQ ID NO: 739489 - RNA, 64 nt, hsa; identical to SEQ ID NO: 634929

SEQ ID NO: 739490 - RNA, 64 nt, hsa; identical to SEQ ID NO: 634930

SEQ ID NO: 739491 - RNA, 64 nt, hsa; identical to SEQ ID NO: 634931

SEQ ID NO: 739492 - RNA, 64 nt, hsa; identical to SEQ ID NO: 634932

SEQ ID NO: 739493 - RNA, 64 nt, hsa; identical to SEQ ID NO: 634933

SEQ ID NO: 739494 - RNA, 64 nt, hsa; identical to SEQ ID NO: 634934

SEQ ID NO: 739495 - RNA, 64 nt, hsa; identical to SEQ ID NO: 634935

SEQ ID NO: 739496 - RNA, 64 nt, hsa; identical to SEQ ID NO: 634936

SEQ ID NO: 739497 - RNA, 64 nt, hsa; identical to SEQ ID NO: 634937

SEQ ID NO: 739498 - RNA, 64 nt, hsa; identical to SEQ ID NO: 634938

SEQ ID NO: 739499 - RNA, 64 nt, hsa; identical to SEQ ID NO: 634939

SEQ ID NO: 739500 - RNA, 64 nt, hsa; identical to SEQ ID NO: 634940

SEQ ID NO: 739501 - RNA, 64 nt, hsa; identical to SEQ ID NO: 520126

SEQ ID NO: 739502 - RNA, 64 nt, hsa; identical to SEQ ID NO: 520127

SEQ ID NO: 739503 - RNA, 64 nt, hsa; identical to SEQ ID NO: 520128

SEQ ID NO: 739504 - RNA, 64 nt, hsa; identical to SEQ ID NO: 520129

SEQ ID NO: 739505 - RNA, 64 nt, hsa; identical to SEQ ID NO: 520130

SEQ ID NO: 739506 - RNA, 64 nt, hsa; identical to SEQ ID NO: 520131

SEQ ID NO: 739507 - RNA, 64 nt, hsa
acugcuuauaauaauccaggaguugcauuauagccaguaguaaaaauaauaauaauaauaauaa

SEQ ID NO: 739508 - RNA, 64 nt, hsa
gacaauauuggauguacaauuccucaggagacuacaguaguauauucuauuccuuaccaguaau

SEQ ID NO: 739509 - RNA, 64 nt, hsa
acaugaugcugauuucuuaaaaccuacauauaagcaguaguacuuuuucucuauuauaaaguau

SEQ ID NO: 739510 - RNA, 64 nt, hsa
cauuucuuuuuucuaucagauauucauugucaugcaguaguaguaaaaacaucaaagaugcagc

SEQ ID NO: 739511 - RNA, 64 nt, hsa
agugaaucaaugccauuuguaacucaacugguaacaguaguaaucauacaaaauaaaaaccugc

SEQ ID NO: 739512 - RNA, 64 nt, hsa
uuauuauaaucaucccucuauuauucuuaaaugccaguaguauuuagagauguguaccugcuua

SEQ ID NO: 739513 - RNA, 64 nt, hsa
gucaguauuaauguguagcccuaccaaaaauagccaguaguaucugaaaaugaaaaauaaauga

SEQ ID NO: 739514 - RNA, 64 nt, hsa
uuuguuucugauaaaaugaagacuuuaaaucagucaguaguacuuuaccuuucaaggcauuagu

SEQ ID NO: 739515 - RNA, 64 nt, hsa
ugcccccugccccagggcucuucagaaagcaucugcaugugaacaccaucaugccuuuauaaag

SEQ ID NO: 739516 - RNA, 64 nt, hsa
uucugugccuuaagcagagucaggagaccccaaggcaugugagcaucugcccagcaaccugugg

SEQ ID NO: 739517 - RNA, 64 nt, hsa
uauguaaacauaauguuuauuuuaucucacaaaugcaugugaaauguauaauuacaucuuagga

SEQ ID NO: 739518 - RNA, 64 nt, hsa
gcuauuaccaacauuuuccugugcauuaaccucugcaugugaaaacuuuuaacaguuacugaac

SEQ ID NO: 739519 - RNA, 64 nt, hsa
cuaacaugagacguggcaugugagaugagacuuggcaugugagacauagggucacuagagaccc

SEQ ID NO: 739520 - RNA, 64 nt, hsa
ucuacagggcaucugacaccuaacaugagacguggcaugugagaugagacuuggcaugugagac

SEQ ID NO: 739521 - RNA, 64 nt, hsa
ugguaaaauccucuccagaaucuuggaacaccuggcaugugacccuagugacgucacagaccug

SEQ ID NO: 739522 - RNA, 64 nt, hsa
auaggcaucugguguuucagcauacauaacugaagcaugugaaacaguaucauccucguuagua

SEQ ID NO: 739523 - RNA, 64 nt, hsa
gcacaguuuugaaguucuagccacucgagcucaugcaugugaaacgugugcuuuacgaaggugg

SEQ ID NO: 739524 - RNA, 64 nt, hsa
cugcuggugacgugcaggugaaggacaggaaggggcaugugagcguaaauagaggugaccagag

SEQ ID NO: 739525 - RNA, 64 nt, hsa
aagcuaaaaaaaagcaaggguuugucauagagggaaccucuaaauaauuucagggguaggggag

SEQ ID NO: 739526 - RNA, 64 nt, hsa
uguuugacaauugaauuuguuuucugugaauucuaaccucuaaaggcaugcuuagaggucaagg

SEQ ID NO: 739527 - RNA, 64 nt, hsa
cgacuaaccucuaacaagagauuuauggucaguuaaccucuaaauaugaacuuuccacucuaac

SEQ ID NO: 739528 - RNA, 64 nt, hsa
aaacuucagcuuaaccagucagaaacuaccgacuaaccucuaacaagagauuuauggucaguua

SEQ ID NO: 739529 - RNA, 64 nt, hsa; identical to SEQ ID NO: 134242

SEQ ID NO: 739530 - RNA, 64 nt, hsa; identical to SEQ ID NO: 134243

SEQ ID NO: 739531 - RNA, 64 nt, hsa; identical to SEQ ID NO: 134244

SEQ ID NO: 739532 - RNA, 64 nt, hsa; identical to SEQ ID NO: 134245

SEQ ID NO: 739533 - RNA, 52 nt, hsa; identical to SEQ ID NO: 134246

SEQ ID NO: 739534 - RNA, 64 nt, hsa; identical to SEQ ID NO: 134247

SEQ ID NO: 739535 - RNA, 64 nt, hsa; identical to SEQ ID NO: 134248

SEQ ID NO: 739536 - RNA, 64 nt, hsa; identical to SEQ ID NO: 134249

SEQ ID NO: 739537 - RNA, 64 nt, hsa; identical to SEQ ID NO: 134250

SEQ ID NO: 739538 - RNA, 64 nt, hsa; identical to SEQ ID NO: 134251

SEQ ID NO: 739539 - RNA, 64 nt, hsa; identical to SEQ ID NO: 134252

SEQ ID NO: 739540 - RNA, 64 nt, hsa; identical to SEQ ID NO: 134253

SEQ ID NO: 739541 - RNA, 64 nt, hsa; identical to SEQ ID NO: 134254

SEQ ID NO: 739542 - RNA, 64 nt, hsa; identical to SEQ ID NO: 134255

SEQ ID NO: 739543 - RNA, 64 nt, hsa; identical to SEQ ID NO: 134256

SEQ ID NO: 739544 - RNA, 64 nt, hsa; identical to SEQ ID NO: 134257

SEQ ID NO: 739545 - RNA, 64 nt, hsa; identical to SEQ ID NO: 134258

SEQ ID NO: 739546 - RNA, 64 nt, hsa; identical to SEQ ID NO: 134259

SEQ ID NO: 739547 - RNA, 64 nt, hsa; identical to SEQ ID NO: 134260

SEQ ID NO: 739548 - RNA, 64 nt, hsa; identical to SEQ ID NO: 134261

SEQ ID NO: 739549 - RNA, 64 nt, hsa; identical to SEQ ID NO: 134262

SEQ ID NO: 739550 - RNA, 64 nt, hsa; identical to SEQ ID NO: 134263

SEQ ID NO: 739551 - RNA, 64 nt, hsa; identical to SEQ ID NO: 134264

SEQ ID NO: 739552 - RNA, 64 nt, hsa; identical to SEQ ID NO: 134265

SEQ ID NO: 739553 - RNA, 64 nt, hsa; identical to SEQ ID NO: 134266

SEQ ID NO: 739554 - RNA, 64 nt, hsa; identical to SEQ ID NO: 134267

SEQ ID NO: 739555 - RNA, 64 nt, hsa; identical to SEQ ID NO: 134268

SEQ ID NO: 739556 - RNA, 64 nt, hsa; identical to SEQ ID NO: 134269

SEQ ID NO: 739557 - RNA, 64 nt, hsa
auuugaguagaaccacugaugaugauuuuauaaauugugugaagcgaauuucccauuuggcaau

SEQ ID NO: 739558 - RNA, 64 nt, hsa
cucccugccagcugcccuauguagcuccuaacuguugugugauuuggacggcuuuuugcauauu

SEQ ID NO: 739559 - RNA, 64 nt, hsa
aaucaagauaacuuuauucaaagagcagcccgcuuugugugacuaaaaugaaacaagacaguug

SEQ ID NO: 739560 - RNA, 64 nt, hsa
cuuugugugacuaaaaugaaacaagacaguugaauugugugacuugaagauuaccaaugauuuu

SEQ ID NO: 739561 - RNA, 64 nt, hsa
uccuacccugguggauuuuauuccuagauuuggguugugugaaucagauuugggcaucuguuuu

SEQ ID NO: 739562 - RNA, 64 nt, hsa
auauucugaauaauugccauucagaaugcuauuuuugugugaaaucaaaauaucauugggccau

SEQ ID NO: 739563 - RNA, 64 nt, hsa
uccugccuuccagccccaccccucugucccuagauugugugacucccuucaggcaguccuuuag

SEQ ID NO: 739564 - RNA, 64 nt, hsa
gcggcuucggacucagaauuccaugcccuuugcauugugugacaucgcaguccccuuccccgcu

SEQ ID NO: 739565 - RNA, 64 nt, hsa
ugauaaguguaucugugugagugugugcaacuacuugugugagggcaugguagcuaacgugugu

SEQ ID NO: 739566 - RNA, 64 nt, hsa
uuaauuuugugugugcacuaacauucccugguuuuugugugaucauuccgaguguugcugcaag

SEQ ID NO: 739567 - RNA, 64 nt, hsa
ugugaagcuaaaugguggcuaaaaggaacacuuuuugugugauuauuauaaacuuugcauugua

SEQ ID NO: 739568 - RNA, 64 nt, hsa
agaucuaaauaaaccacguauuuuccagucuucguugugugaagcuaaaugguggcuaaaagga

SEQ ID NO: 739569 - RNA, 64 nt, hsa
aggauuguuaccaaauggugucaguauggaccaauugugugaccaugagaaggaugcuuauuuu

SEQ ID NO: 739570 - RNA, 64 nt, hsa
uuguaaugcaguuuucuucauaaugugucagugauugugugaccaaggcagcaucuagcagaaa

SEQ ID NO: 739571 - RNA, 64 nt, hsa
uugcauugagcaguggggacuuaauauauuuuacuugugugauugcaucuaugcagacgccagu

SEQ ID NO: 739572 - RNA, 64 nt, hsa
gugucacaaauguaggucuguauuacuuguaugcuugugugacuuacuguuaguccagcucuaa

SEQ ID NO: 739573 - RNA, 64 nt, hsa
gauuuaaaguuuguaucuaaauaaugccuaugaguugugugaagcucuuggcuuuuuuccaacg

SEQ ID NO: 739574 - RNA, 64 nt, hsa
cauucauaaauucaagcacuaccacuggucaguuuugugugauagaauaaaaauauguuaccug

SEQ ID NO: 739575 - RNA, 64 nt, hsa
cauuauguaauuugguuucauuuuauucuaccuguugugugaguuuaguauauuuaauuuacuu

SEQ ID NO: 739576 - RNA, 64 nt, hsa
gggcuggacgcaggucccaggacgugcugcucccuugugugagugaccacggccccaagcccag

SEQ ID NO: 739577 - RNA, 64 nt, hsa
gggcuggacgcaggucccaggacaugcugcucccuugugugagugaccgcggccccgagccugg

SEQ ID NO: 739578 - RNA, 64 nt, hsa
uugggcuuccauucuaguucuuuuaccaagauuuuugugugaccauguugacuucauuuggauu

SEQ ID NO: 739579 - RNA, 64 nt, hsa
auaaugccaaagucagcauuuguccuggguucccuugugugaucuguuuggacuauguuuucuu

SEQ ID NO: 739580 - RNA, 64 nt, hsa
uuuuaguuuucaaaucaauuucuaauucuggugauugugugauguaaagaggugcuaugauggu

SEQ ID NO: 739581 - RNA, 64 nt, hsa
gacugggugggaugugaauggaauguuagaaauguugugugaauugaaguucuguauucauuau

SEQ ID NO: 739582 - RNA, 56 nt, hsa; identical to SEQ ID NO: 86279

SEQ ID NO: 739583 - RNA, 63 nt, hsa
cuauuuuuguuuguuuauacaaauaucugauuugcaagaaaaagugcaugggagggguuuuag

SEQ ID NO: 739584 - RNA, 63 nt, hsa
uguggguguggccgaggugauggcaagaaaggugcaagaaagugagcagucugccugugagug

SEQ ID NO: 739585 - RNA, 63 nt, hsa
uauuggaggaauguggguguggccgaggugauggcaagaaaggugcaagaaagugagcagucu

SEQ ID NO: 739586 - RNA, 63 nt, hsa
guuuucuagauugucacaugcuuugugacuaaugcaagaaagcaaguccuguguuguauuugu

SEQ ID NO: 739587 - RNA, 63 nt, hsa
ucucuaauuccaauaugucuuuugcuuccagaagcaagaaaaguuucuucucuccccuccuuc

SEQ ID NO: 739588 - RNA, 63 nt, hsa
aaaaaucauugccauaagaaaaaguauaaauuagcaagaaaggagagugacuugauuugcuuu

SEQ ID NO: 739589 - RNA, 63 nt, hsa
cgaugaaguaaacgccuuagugcuucagacccagcaagaaauuauugguaauauuuaugucua

SEQ ID NO: 739590 - RNA, 63 nt, hsa
guauacaggauaaacuacauacacugaucccuugcaagaaauuugaucucaguuauaaucuaa

SEQ ID NO: 739591 - RNA, 63 nt, hsa
ccuaaaauucuagccauuugucacacaaccacagcaagaaacguguucuauaucuagagugug

SEQ ID NO: 739592 - RNA, 63 nt, hsa
uuacuucacuauaauuacaaggacaaauuauuagcaagaaauaagaauaguauuagaagaauu

SEQ ID NO: 739593 - RNA, 63 nt, hsa
guacugcauugcaccaugagcaagaacugcucugcaagaaaaauaucugucccuguggucuga

SEQ ID NO: 739594 - RNA, 63 nt, hsa
aaucucaaaucacacugaacccuaaaugucauugcaagaaauaaaaauuuaagaauuaaauug

SEQ ID NO: 739595 - RNA, 63 nt, hsa
acuuuuauuauauuguuuacaaauauauuucaugcaagaaacagaaaaaaaaaaaaacccuuu

SEQ ID NO: 739596 - RNA, 63 nt, hsa
uaaacuauaggauagauagaaugguuauuuuaugcaagaaauauuguaccgcaagggugguuu

SEQ ID NO: 739597 - RNA, 63 nt, hsa
aagcaugaagauuccugggguggggggaaagcagcaagaaaagguagagaggaaccagauugg

SEQ ID NO: 739598 - RNA, 63 nt, hsa
gauauuggaaacaguaugcaugaagacaugaaggcaagaaacagcaaaacaaauacugaagca

SEQ ID NO: 739599 - RNA, 64 nt, hsa
gauggggguuuaaaugauuugcucaaagucauuuagggguaauaaauacuuggcuuggaaauuu

SEQ ID NO: 739600 - RNA, 64 nt, hsa
agcacaugaccuugggauuacauuuuuauggggcagggguaagcaaguuuuuaaaucauuugug

SEQ ID NO: 739601 - RNA, 64 nt, hsa
ugggcucuccuauuggaaucuaguuggggguuggagggguaaggaacacagggugauaggggag

SEQ ID NO: 739602 - RNA, 64 nt, hsa
acaggcacacaauuucagucccagccaaagcagaagggguaaugacauggacuuggcgggggga

SEQ ID NO: 739603 - RNA, 64 nt, hsa
caggacagggaaagaaaggguaugagacacggcuagggguaaacucuuaguccaaaacccaagc

SEQ ID NO: 739604 - RNA, 64 nt, hsa
caggcuuuaguggaagcccuuguuuacagaagagagggguaaaccuaugaaaacaggggaagcc

SEQ ID NO: 739605 - RNA, 64 nt, hsa; identical to SEQ ID NO: 140348

SEQ ID NO: 739606 - RNA, 64 nt, hsa; identical to SEQ ID NO: 140349

SEQ ID NO: 739607 - RNA, 64 nt, hsa; identical to SEQ ID NO: 94750

SEQ ID NO: 739608 - RNA, 64 nt, hsa; identical to SEQ ID NO: 94751

SEQ ID NO: 739609 - RNA, 64 nt, hsa; identical to SEQ ID NO: 94752

SEQ ID NO: 739610 - RNA, 64 nt, hsa; identical to SEQ ID NO: 94753

SEQ ID NO: 739611 - RNA, 64 nt, hsa; identical to SEQ ID NO: 94754

SEQ ID NO: 739612 - RNA, 64 nt, hsa; identical to SEQ ID NO: 94755

SEQ ID NO: 739613 - RNA, 64 nt, hsa; identical to SEQ ID NO: 94756

SEQ ID NO: 739614 - RNA, 64 nt, hsa; identical to SEQ ID NO: 94757

SEQ ID NO: 739615 - RNA, 64 nt, hsa; identical to SEQ ID NO: 94758

SEQ ID NO: 739616 - RNA, 64 nt, hsa; identical to SEQ ID NO: 94759

SEQ ID NO: 739617 - RNA, 64 nt, hsa; identical to SEQ ID NO: 94760

SEQ ID NO: 739618 - RNA, 64 nt, hsa; identical to SEQ ID NO: 94761

SEQ ID NO: 739619 - RNA, 64 nt, hsa; identical to SEQ ID NO: 94762

SEQ ID NO: 739620 - RNA, 64 nt, hsa; identical to SEQ ID NO: 94763

SEQ ID NO: 739621 - RNA, 64 nt, hsa; identical to SEQ ID NO: 94764

SEQ ID NO: 739622 - RNA, 64 nt, hsa; identical to SEQ ID NO: 94765

SEQ ID NO: 739623 - RNA, 64 nt, hsa; identical to SEQ ID NO: 94766

SEQ ID NO: 739624 - RNA, 64 nt, hsa; identical to SEQ ID NO: 94767

SEQ ID NO: 739625 - RNA, 64 nt, hsa; identical to SEQ ID NO: 94768

SEQ ID NO: 739626 - RNA, 64 nt, hsa; identical to SEQ ID NO: 94769

SEQ ID NO: 739627 - RNA, 64 nt, hsa; identical to SEQ ID NO: 94770

SEQ ID NO: 739628 - RNA, 64 nt, hsa; identical to SEQ ID NO: 94771

SEQ ID NO: 739629 - RNA, 64 nt, hsa; identical to SEQ ID NO: 94772

SEQ ID NO: 739630 - RNA, 64 nt, hsa; identical to SEQ ID NO: 94773

SEQ ID NO: 739631 - RNA, 64 nt, hsa; identical to SEQ ID NO: 94774

SEQ ID NO: 739632 - RNA, 64 nt, hsa; identical to SEQ ID NO: 94775

SEQ ID NO: 739633 - RNA, 64 nt, hsa; identical to SEQ ID NO: 94776

SEQ ID NO: 739634 - RNA, 64 nt, hsa; identical to SEQ ID NO: 94777

SEQ ID NO: 739635 - RNA, 64 nt, hsa; identical to SEQ ID NO: 94778

SEQ ID NO: 739636 - RNA, 64 nt, hsa; identical to SEQ ID NO: 94779

SEQ ID NO: 739637 - RNA, 64 nt, hsa; identical to SEQ ID NO: 94780

SEQ ID NO: 739638 - RNA, 64 nt, hsa; identical to SEQ ID NO: 94781

SEQ ID NO: 739639 - RNA, 64 nt, hsa; identical to SEQ ID NO: 94782

SEQ ID NO: 739640 - RNA, 64 nt, hsa; identical to SEQ ID NO: 94783

SEQ ID NO: 739641 - RNA, 64 nt, hsa; identical to SEQ ID NO: 94784

SEQ ID NO: 739642 - RNA, 64 nt, hsa; identical to SEQ ID NO: 94785

SEQ ID NO: 739643 - RNA, 64 nt, hsa; identical to SEQ ID NO: 94786

SEQ ID NO: 739644 - RNA, 64 nt, hsa; identical to SEQ ID NO: 94787

SEQ ID NO: 739645 - RNA, 64 nt, hsa; identical to SEQ ID NO: 94788

SEQ ID NO: 739646 - RNA, 64 nt, hsa; identical to SEQ ID NO: 94789

SEQ ID NO: 739647 - RNA, 64 nt, hsa; identical to SEQ ID NO: 94790

SEQ ID NO: 739648 - RNA, 64 nt, hsa; identical to SEQ ID NO: 94791

SEQ ID NO: 739649 - RNA, 64 nt, hsa; identical to SEQ ID NO: 94792

SEQ ID NO: 739650 - RNA, 64 nt, hsa; identical to SEQ ID NO: 94793

SEQ ID NO: 739651 - RNA, 64 nt, hsa; identical to SEQ ID NO: 94794

SEQ ID NO: 739652 - RNA, 64 nt, hsa; identical to SEQ ID NO: 94795

SEQ ID NO: 739653 - RNA, 64 nt, hsa; identical to SEQ ID NO: 94796

SEQ ID NO: 739654 - RNA, 64 nt, hsa; identical to SEQ ID NO: 94797

SEQ ID NO: 739655 - RNA, 64 nt, hsa; identical to SEQ ID NO: 94798

SEQ ID NO: 739656 - RNA, 64 nt, hsa; identical to SEQ ID NO: 94799

SEQ ID NO: 739657 - RNA, 64 nt, hsa; identical to SEQ ID NO: 94800

SEQ ID NO: 739658 - RNA, 64 nt, hsa; identical to SEQ ID NO: 94801

SEQ ID NO: 739659 - RNA, 64 nt, hsa; identical to SEQ ID NO: 94802

SEQ ID NO: 739660 - RNA, 64 nt, hsa; identical to SEQ ID NO: 94803

SEQ ID NO: 739661 - RNA, 64 nt, hsa; identical to SEQ ID NO: 94804

SEQ ID NO: 739662 - RNA, 64 nt, hsa; identical to SEQ ID NO: 94805

SEQ ID NO: 739663 - RNA, 64 nt, hsa; identical to SEQ ID NO: 94806

SEQ ID NO: 739664 - RNA, 64 nt, hsa; identical to SEQ ID NO: 94807

SEQ ID NO: 739665 - RNA, 64 nt, hsa; identical to SEQ ID NO: 94808

SEQ ID NO: 739666 - RNA, 64 nt, hsa; identical to SEQ ID NO: 94809

SEQ ID NO: 739667 - RNA, 64 nt, hsa; identical to SEQ ID NO: 94810

SEQ ID NO: 739668 - RNA, 64 nt, hsa; identical to SEQ ID NO: 94811

SEQ ID NO: 739669 - RNA, 64 nt, hsa; identical to SEQ ID NO: 94812

SEQ ID NO: 739670 - RNA, 64 nt, hsa; identical to SEQ ID NO: 94813

SEQ ID NO: 739671 - RNA, 64 nt, hsa; identical to SEQ ID NO: 94814

SEQ ID NO: 739672 - RNA, 64 nt, hsa; identical to SEQ ID NO: 94815

SEQ ID NO: 739673 - RNA, 64 nt, hsa; identical to SEQ ID NO: 94816

SEQ ID NO: 739674 - RNA, 64 nt, hsa; identical to SEQ ID NO: 94817

SEQ ID NO: 739675 - RNA, 64 nt, hsa; identical to SEQ ID NO: 94818

SEQ ID NO: 739676 - RNA, 64 nt, hsa; identical to SEQ ID NO: 94819

SEQ ID NO: 739677 - RNA, 64 nt, hsa; identical to SEQ ID NO: 94820

SEQ ID NO: 739678 - RNA, 64 nt, hsa; identical to SEQ ID NO: 94821

SEQ ID NO: 739679 - RNA, 64 nt, hsa; identical to SEQ ID NO: 94822

SEQ ID NO: 739680 - RNA, 64 nt, hsa; identical to SEQ ID NO: 94823

SEQ ID NO: 739681 - RNA, 64 nt, hsa; identical to SEQ ID NO: 94824

SEQ ID NO: 739682 - RNA, 64 nt, hsa; identical to SEQ ID NO: 94825

SEQ ID NO: 739683 - RNA, 64 nt, hsa; identical to SEQ ID NO: 94826

SEQ ID NO: 739684 - RNA, 64 nt, hsa; identical to SEQ ID NO: 94827

SEQ ID NO: 739685 - RNA, 64 nt, hsa; identical to SEQ ID NO: 94828

SEQ ID NO: 739686 - RNA, 64 nt, hsa; identical to SEQ ID NO: 94829

SEQ ID NO: 739687 - RNA, 64 nt, hsa; identical to SEQ ID NO: 94830

SEQ ID NO: 739688 - RNA, 64 nt, hsa; identical to SEQ ID NO: 94831

SEQ ID NO: 739689 - RNA, 64 nt, hsa; identical to SEQ ID NO: 94832

SEQ ID NO: 739690 - RNA, 64 nt, hsa; identical to SEQ ID NO: 94833

SEQ ID NO: 739691 - RNA, 64 nt, hsa; identical to SEQ ID NO: 94834

SEQ ID NO: 739692 - RNA, 64 nt, hsa; identical to SEQ ID NO: 94835

SEQ ID NO: 739693 - RNA, 64 nt, hsa; identical to SEQ ID NO: 109251

SEQ ID NO: 739694 - RNA, 64 nt, hsa; identical to SEQ ID NO: 109252

SEQ ID NO: 739695 - RNA, 64 nt, hsa; identical to SEQ ID NO: 109253

SEQ ID NO: 739696 - RNA, 64 nt, hsa; identical to SEQ ID NO: 109254

SEQ ID NO: 739697 - RNA, 64 nt, hsa; identical to SEQ ID NO: 109255

SEQ ID NO: 739698 - RNA, 64 nt, hsa; identical to SEQ ID NO: 109256

SEQ ID NO: 739699 - RNA, 64 nt, hsa; identical to SEQ ID NO: 488598

SEQ ID NO: 739700 - RNA, 64 nt, hsa; identical to SEQ ID NO: 488599

SEQ ID NO: 739701 - RNA, 64 nt, hsa; identical to SEQ ID NO: 488600

SEQ ID NO: 739702 - RNA, 64 nt, hsa; identical to SEQ ID NO: 488601

SEQ ID NO: 739703 - RNA, 64 nt, hsa; identical to SEQ ID NO: 488602

SEQ ID NO: 739704 - RNA, 64 nt, hsa; identical to SEQ ID NO: 488603

SEQ ID NO: 739705 - RNA, 64 nt, hsa; identical to SEQ ID NO: 488604

SEQ ID NO: 739706 - RNA, 64 nt, hsa; identical to SEQ ID NO: 488605

SEQ ID NO: 739707 - RNA, 64 nt, hsa; identical to SEQ ID NO: 488606

SEQ ID NO: 739708 - RNA, 64 nt, hsa; identical to SEQ ID NO: 488607

SEQ ID NO: 739709 - RNA, 64 nt, hsa; identical to SEQ ID NO: 488608

SEQ ID NO: 739710 - RNA, 64 nt, hsa; identical to SEQ ID NO: 488609

SEQ ID NO: 739711 - RNA, 64 nt, hsa; identical to SEQ ID NO: 488610

SEQ ID NO: 739712 - RNA, 64 nt, hsa; identical to SEQ ID NO: 488611

SEQ ID NO: 739713 - RNA, 64 nt, hsa; identical to SEQ ID NO: 488612

SEQ ID NO: 739714 - RNA, 64 nt, hsa; identical to SEQ ID NO: 488613

SEQ ID NO: 739715 - RNA, 64 nt, hsa; identical to SEQ ID NO: 488614

SEQ ID NO: 739716 - RNA, 64 nt, hsa; identical to SEQ ID NO: 488615

SEQ ID NO: 739717 - RNA, 64 nt, hsa; identical to SEQ ID NO: 488616

SEQ ID NO: 739718 - RNA, 64 nt, hsa; identical to SEQ ID NO: 488617

SEQ ID NO: 739719 - RNA, 64 nt, hsa; identical to SEQ ID NO: 488618

SEQ ID NO: 739720 - RNA, 64 nt, hsa; identical to SEQ ID NO: 488619

SEQ ID NO: 739721 - RNA, 64 nt, hsa; identical to SEQ ID NO: 488620

SEQ ID NO: 739722 - RNA, 64 nt, hsa; identical to SEQ ID NO: 488621

SEQ ID NO: 739723 - RNA, 64 nt, hsa; identical to SEQ ID NO: 488622

SEQ ID NO: 739724 - RNA, 64 nt, hsa; identical to SEQ ID NO: 488623

SEQ ID NO: 739725 - RNA, 64 nt, hsa; identical to SEQ ID NO: 488624

SEQ ID NO: 739726 - RNA, 64 nt, hsa; identical to SEQ ID NO: 488625

SEQ ID NO: 739727 - RNA, 64 nt, hsa; identical to SEQ ID NO: 488626

SEQ ID NO: 739728 - RNA, 64 nt, hsa; identical to SEQ ID NO: 488627

SEQ ID NO: 739729 - RNA, 64 nt, hsa; identical to SEQ ID NO: 488628

SEQ ID NO: 739730 - RNA, 64 nt, hsa; identical to SEQ ID NO: 488629

SEQ ID NO: 739731 - RNA, 64 nt, hsa; identical to SEQ ID NO: 488630

SEQ ID NO: 739732 - RNA, 64 nt, hsa; identical to SEQ ID NO: 488631

SEQ ID NO: 739733 - RNA, 64 nt, hsa; identical to SEQ ID NO: 488632

SEQ ID NO: 739734 - RNA, 64 nt, hsa; identical to SEQ ID NO: 488633

SEQ ID NO: 739735 - RNA, 64 nt, hsa; identical to SEQ ID NO: 488634

SEQ ID NO: 739736 - RNA, 64 nt, hsa; identical to SEQ ID NO: 488635

SEQ ID NO: 739737 - RNA, 64 nt, hsa; identical to SEQ ID NO: 488636

SEQ ID NO: 739738 - RNA, 64 nt, hsa; identical to SEQ ID NO: 488637

SEQ ID NO: 739739 - RNA, 64 nt, hsa; identical to SEQ ID NO: 488638

SEQ ID NO: 739740 - RNA, 64 nt, hsa; identical to SEQ ID NO: 488639

SEQ ID NO: 739741 - RNA, 64 nt, hsa; identical to SEQ ID NO: 488640

SEQ ID NO: 739742 - RNA, 64 nt, hsa; identical to SEQ ID NO: 488641

SEQ ID NO: 739743 - RNA, 64 nt, hsa; identical to SEQ ID NO: 488642

SEQ ID NO: 739744 - RNA, 64 nt, hsa; identical to SEQ ID NO: 488643

SEQ ID NO: 739745 - RNA, 64 nt, hsa; identical to SEQ ID NO: 488644

SEQ ID NO: 739746 - RNA, 64 nt, hsa; identical to SEQ ID NO: 488645

SEQ ID NO: 739747 - RNA, 64 nt, hsa; identical to SEQ ID NO: 488646

SEQ ID NO: 739748 - RNA, 64 nt, hsa; identical to SEQ ID NO: 488647

SEQ ID NO: 739749 - RNA, 64 nt, hsa; identical to SEQ ID NO: 488648

SEQ ID NO: 739750 - RNA, 64 nt, hsa; identical to SEQ ID NO: 488649

SEQ ID NO: 739751 - RNA, 64 nt, hsa; identical to SEQ ID NO: 488650

SEQ ID NO: 739752 - RNA, 64 nt, hsa; identical to SEQ ID NO: 488651

SEQ ID NO: 739753 - RNA, 64 nt, hsa; identical to SEQ ID NO: 488652

SEQ ID NO: 739754 - RNA, 64 nt, hsa; identical to SEQ ID NO: 488653

SEQ ID NO: 739755 - RNA, 64 nt, hsa; identical to SEQ ID NO: 488654

SEQ ID NO: 739756 - RNA, 64 nt, hsa; identical to SEQ ID NO: 488655

SEQ ID NO: 739757 - RNA, 64 nt, hsa; identical to SEQ ID NO: 488656

SEQ ID NO: 739758 - RNA, 64 nt, hsa; identical to SEQ ID NO: 488657

SEQ ID NO: 739759 - RNA, 64 nt, hsa; identical to SEQ ID NO: 488658

SEQ ID NO: 739760 - RNA, 64 nt, hsa; identical to SEQ ID NO: 488659

SEQ ID NO: 739761 - RNA, 64 nt, hsa; identical to SEQ ID NO: 488660

SEQ ID NO: 739762 - RNA, 64 nt, hsa; identical to SEQ ID NO: 488661

SEQ ID NO: 739763 - RNA, 64 nt, hsa; identical to SEQ ID NO: 488662

SEQ ID NO: 739764 - RNA, 64 nt, hsa; identical to SEQ ID NO: 488663

SEQ ID NO: 739765 - RNA, 64 nt, hsa; identical to SEQ ID NO: 488664

SEQ ID NO: 739766 - RNA, 64 nt, hsa; identical to SEQ ID NO: 488665

SEQ ID NO: 739767 - RNA, 64 nt, hsa; identical to SEQ ID NO: 488666

SEQ ID NO: 739768 - RNA, 64 nt, hsa; identical to SEQ ID NO: 488667

SEQ ID NO: 739769 - RNA, 64 nt, hsa; identical to SEQ ID NO: 488668

SEQ ID NO: 739770 - RNA, 64 nt, hsa; identical to SEQ ID NO: 488669

SEQ ID NO: 739771 - RNA, 64 nt, hsa; identical to SEQ ID NO: 488670

SEQ ID NO: 739772 - RNA, 64 nt, hsa; identical to SEQ ID NO: 488671

SEQ ID NO: 739773 - RNA, 64 nt, hsa; identical to SEQ ID NO: 488672

SEQ ID NO: 739774 - RNA, 64 nt, hsa; identical to SEQ ID NO: 488673

SEQ ID NO: 739775 - RNA, 64 nt, hsa; identical to SEQ ID NO: 488674

SEQ ID NO: 739776 - RNA, 64 nt, hsa; identical to SEQ ID NO: 488675

SEQ ID NO: 739777 - RNA, 64 nt, hsa; identical to SEQ ID NO: 488676

SEQ ID NO: 739778 - RNA, 64 nt, hsa; identical to SEQ ID NO: 488677

SEQ ID NO: 739779 - RNA, 64 nt, hsa; identical to SEQ ID NO: 488678

SEQ ID NO: 739780 - RNA, 64 nt, hsa; identical to SEQ ID NO: 488679

SEQ ID NO: 739781 - RNA, 64 nt, hsa; identical to SEQ ID NO: 488680

SEQ ID NO: 739782 - RNA, 64 nt, hsa; identical to SEQ ID NO: 488681

SEQ ID NO: 739783 - RNA, 64 nt, hsa; identical to SEQ ID NO: 488682

SEQ ID NO: 739784 - RNA, 64 nt, hsa; identical to SEQ ID NO: 488683

SEQ ID NO: 739785 - RNA, 64 nt, hsa; identical to SEQ ID NO: 488684

SEQ ID NO: 739786 - RNA, 64 nt, hsa; identical to SEQ ID NO: 488685

SEQ ID NO: 739787 - RNA, 64 nt, hsa; identical to SEQ ID NO: 488686

SEQ ID NO: 739788 - RNA, 64 nt, hsa; identical to SEQ ID NO: 488687

SEQ ID NO: 739789 - RNA, 64 nt, hsa; identical to SEQ ID NO: 488688

SEQ ID NO: 739790 - RNA, 64 nt, hsa; identical to SEQ ID NO: 488689

SEQ ID NO: 739791 - RNA, 64 nt, hsa; identical to SEQ ID NO: 488690

SEQ ID NO: 739792 - RNA, 64 nt, hsa; identical to SEQ ID NO: 488691

SEQ ID NO: 739793 - RNA, 64 nt, hsa; identical to SEQ ID NO: 488692

SEQ ID NO: 739794 - RNA, 64 nt, hsa; identical to SEQ ID NO: 488693

SEQ ID NO: 739795 - RNA, 64 nt, hsa; identical to SEQ ID NO: 488694

SEQ ID NO: 739796 - RNA, 64 nt, hsa; identical to SEQ ID NO: 488695

SEQ ID NO: 739797 - RNA, 64 nt, hsa; identical to SEQ ID NO: 488696

SEQ ID NO: 739798 - RNA, 64 nt, hsa; identical to SEQ ID NO: 488697

SEQ ID NO: 739799 - RNA, 64 nt, hsa; identical to SEQ ID NO: 488698

SEQ ID NO: 739800 - RNA, 64 nt, hsa; identical to SEQ ID NO: 488699

SEQ ID NO: 739801 - RNA, 64 nt, hsa; identical to SEQ ID NO: 488700

SEQ ID NO: 739802 - RNA, 64 nt, hsa; identical to SEQ ID NO: 488701

SEQ ID NO: 739803 - RNA, 64 nt, hsa; identical to SEQ ID NO: 488702

SEQ ID NO: 739804 - RNA, 64 nt, hsa; identical to SEQ ID NO: 488703

SEQ ID NO: 739805 - RNA, 64 nt, hsa; identical to SEQ ID NO: 488704

SEQ ID NO: 739806 - RNA, 64 nt, hsa; identical to SEQ ID NO: 488705

SEQ ID NO: 739807 - RNA, 64 nt, hsa; identical to SEQ ID NO: 488706

SEQ ID NO: 739808 - RNA, 64 nt, hsa; identical to SEQ ID NO: 488707

SEQ ID NO: 739809 - RNA, 64 nt, hsa; identical to SEQ ID NO: 488708

SEQ ID NO: 739810 - RNA, 64 nt, hsa; identical to SEQ ID NO: 488709

SEQ ID NO: 739811 - RNA, 64 nt, hsa; identical to SEQ ID NO: 488710

SEQ ID NO: 739812 - RNA, 64 nt, hsa; identical to SEQ ID NO: 488711

SEQ ID NO: 739813 - RNA, 64 nt, hsa; identical to SEQ ID NO: 488712

SEQ ID NO: 739814 - RNA, 64 nt, hsa; identical to SEQ ID NO: 488713

SEQ ID NO: 739815 - RNA, 64 nt, hsa; identical to SEQ ID NO: 488714

SEQ ID NO: 739816 - RNA, 64 nt, hsa; identical to SEQ ID NO: 488715

SEQ ID NO: 739817 - RNA, 64 nt, hsa; identical to SEQ ID NO: 488716

SEQ ID NO: 739818 - RNA, 64 nt, hsa; identical to SEQ ID NO: 488717

SEQ ID NO: 739819 - RNA, 64 nt, hsa; identical to SEQ ID NO: 488718

SEQ ID NO: 739820 - RNA, 64 nt, hsa; identical to SEQ ID NO: 488719

SEQ ID NO: 739821 - RNA, 64 nt, hsa; identical to SEQ ID NO: 488720

SEQ ID NO: 739822 - RNA, 64 nt, hsa; identical to SEQ ID NO: 488721

SEQ ID NO: 739823 - RNA, 64 nt, hsa; identical to SEQ ID NO: 488722

SEQ ID NO: 739824 - RNA, 64 nt, hsa; identical to SEQ ID NO: 488723

SEQ ID NO: 739825 - RNA, 64 nt, hsa; identical to SEQ ID NO: 488724

SEQ ID NO: 739826 - RNA, 64 nt, hsa; identical to SEQ ID NO: 488725

SEQ ID NO: 739827 - RNA, 64 nt, hsa; identical to SEQ ID NO: 488726

SEQ ID NO: 739828 - RNA, 64 nt, hsa; identical to SEQ ID NO: 488727

SEQ ID NO: 739829 - RNA, 64 nt, hsa; identical to SEQ ID NO: 488728

SEQ ID NO: 739830 - RNA, 64 nt, hsa; identical to SEQ ID NO: 488729

SEQ ID NO: 739831 - RNA, 64 nt, hsa; identical to SEQ ID NO: 488730

SEQ ID NO: 739832 - RNA, 64 nt, hsa; identical to SEQ ID NO: 488731

SEQ ID NO: 739833 - RNA, 64 nt, hsa; identical to SEQ ID NO: 488732

SEQ ID NO: 739834 - RNA, 64 nt, hsa; identical to SEQ ID NO: 488733

SEQ ID NO: 739835 - RNA, 64 nt, hsa; identical to SEQ ID NO: 488734

SEQ ID NO: 739836 - RNA, 64 nt, hsa; identical to SEQ ID NO: 488735

SEQ ID NO: 739837 - RNA, 64 nt, hsa; identical to SEQ ID NO: 488736

SEQ ID NO: 739838 - RNA, 64 nt, hsa; identical to SEQ ID NO: 488737

SEQ ID NO: 739839 - RNA, 64 nt, hsa; identical to SEQ ID NO: 488738

SEQ ID NO: 739840 - RNA, 64 nt, hsa; identical to SEQ ID NO: 488739

SEQ ID NO: 739841 - RNA, 64 nt, hsa; identical to SEQ ID NO: 488740

SEQ ID NO: 739842 - RNA, 64 nt, hsa; identical to SEQ ID NO: 488741

SEQ ID NO: 739843 - RNA, 64 nt, hsa; identical to SEQ ID NO: 488742

SEQ ID NO: 739844 - RNA, 64 nt, hsa; identical to SEQ ID NO: 488743

SEQ ID NO: 739845 - RNA, 64 nt, hsa; identical to SEQ ID NO: 488744

SEQ ID NO: 739846 - RNA, 64 nt, hsa; identical to SEQ ID NO: 488745

SEQ ID NO: 739847 - RNA, 64 nt, hsa; identical to SEQ ID NO: 488746

SEQ ID NO: 739848 - RNA, 64 nt, hsa; identical to SEQ ID NO: 488747

SEQ ID NO: 739849 - RNA, 64 nt, hsa; identical to SEQ ID NO: 488748

SEQ ID NO: 739850 - RNA, 64 nt, hsa; identical to SEQ ID NO: 488749

SEQ ID NO: 739851 - RNA, 64 nt, hsa; identical to SEQ ID NO: 488750

SEQ ID NO: 739852 - RNA, 64 nt, hsa; identical to SEQ ID NO: 488751

SEQ ID NO: 739853 - RNA, 64 nt, hsa; identical to SEQ ID NO: 488752

SEQ ID NO: 739854 - RNA, 64 nt, hsa; identical to SEQ ID NO: 488753

SEQ ID NO: 739855 - RNA, 64 nt, hsa; identical to SEQ ID NO: 488754

SEQ ID NO: 739856 - RNA, 64 nt, hsa; identical to SEQ ID NO: 488755

SEQ ID NO: 739857 - RNA, 64 nt, hsa; identical to SEQ ID NO: 488756

SEQ ID NO: 739858 - RNA, 64 nt, hsa; identical to SEQ ID NO: 488757

SEQ ID NO: 739859 - RNA, 64 nt, hsa; identical to SEQ ID NO: 488758

SEQ ID NO: 739860 - RNA, 64 nt, hsa; identical to SEQ ID NO: 488759

SEQ ID NO: 739861 - RNA, 64 nt, hsa; identical to SEQ ID NO: 488760

SEQ ID NO: 739862 - RNA, 64 nt, hsa; identical to SEQ ID NO: 488761

SEQ ID NO: 739863 - RNA, 64 nt, hsa; identical to SEQ ID NO: 488762

SEQ ID NO: 739864 - RNA, 64 nt, hsa; identical to SEQ ID NO: 488763

SEQ ID NO: 739865 - RNA, 64 nt, hsa; identical to SEQ ID NO: 488764

SEQ ID NO: 739866 - RNA, 64 nt, hsa; identical to SEQ ID NO: 488765

SEQ ID NO: 739867 - RNA, 64 nt, hsa; identical to SEQ ID NO: 488766

SEQ ID NO: 739868 - RNA, 64 nt, hsa; identical to SEQ ID NO: 488767

SEQ ID NO: 739869 - RNA, 64 nt, hsa; identical to SEQ ID NO: 488768

SEQ ID NO: 739870 - RNA, 64 nt, hsa; identical to SEQ ID NO: 488769

SEQ ID NO: 739871 - RNA, 64 nt, hsa; identical to SEQ ID NO: 488770

SEQ ID NO: 739872 - RNA, 64 nt, hsa; identical to SEQ ID NO: 488771

SEQ ID NO: 739873 - RNA, 64 nt, hsa; identical to SEQ ID NO: 488772

SEQ ID NO: 739874 - RNA, 64 nt, hsa; identical to SEQ ID NO: 488773

SEQ ID NO: 739875 - RNA, 64 nt, hsa; identical to SEQ ID NO: 488774

SEQ ID NO: 739876 - RNA, 64 nt, hsa; identical to SEQ ID NO: 488775

SEQ ID NO: 739877 - RNA, 64 nt, hsa; identical to SEQ ID NO: 488776

SEQ ID NO: 739878 - RNA, 64 nt, hsa; identical to SEQ ID NO: 488777

SEQ ID NO: 739879 - RNA, 64 nt, hsa; identical to SEQ ID NO: 488778

SEQ ID NO: 739880 - RNA, 64 nt, hsa; identical to SEQ ID NO: 488779

SEQ ID NO: 739881 - RNA, 64 nt, hsa; identical to SEQ ID NO: 488780

SEQ ID NO: 739882 - RNA, 64 nt, hsa; identical to SEQ ID NO: 488781

SEQ ID NO: 739883 - RNA, 64 nt, hsa; identical to SEQ ID NO: 488782

SEQ ID NO: 739884 - RNA, 64 nt, hsa; identical to SEQ ID NO: 488783

SEQ ID NO: 739885 - RNA, 64 nt, hsa; identical to SEQ ID NO: 488784

SEQ ID NO: 739886 - RNA, 64 nt, hsa; identical to SEQ ID NO: 488785

SEQ ID NO: 739887 - RNA, 64 nt, hsa; identical to SEQ ID NO: 488786

SEQ ID NO: 739888 - RNA, 64 nt, hsa; identical to SEQ ID NO: 488787

SEQ ID NO: 739889 - RNA, 64 nt, hsa; identical to SEQ ID NO: 488788

SEQ ID NO: 739890 - RNA, 64 nt, hsa; identical to SEQ ID NO: 488789

SEQ ID NO: 739891 - RNA, 64 nt, hsa; identical to SEQ ID NO: 488790

SEQ ID NO: 739892 - RNA, 64 nt, hsa; identical to SEQ ID NO: 488791

SEQ ID NO: 739893 - RNA, 64 nt, hsa; identical to SEQ ID NO: 488792

SEQ ID NO: 739894 - RNA, 64 nt, hsa; identical to SEQ ID NO: 488793

SEQ ID NO: 739895 - RNA, 64 nt, hsa; identical to SEQ ID NO: 488794

SEQ ID NO: 739896 - RNA, 64 nt, hsa; identical to SEQ ID NO: 488795

SEQ ID NO: 739897 - RNA, 64 nt, hsa; identical to SEQ ID NO: 488796

SEQ ID NO: 739898 - RNA, 64 nt, hsa; identical to SEQ ID NO: 488797

SEQ ID NO: 739899 - RNA, 64 nt, hsa; identical to SEQ ID NO: 488798

SEQ ID NO: 739900 - RNA, 64 nt, hsa; identical to SEQ ID NO: 488799

SEQ ID NO: 739901 - RNA, 64 nt, hsa; identical to SEQ ID NO: 488800

SEQ ID NO: 739902 - RNA, 64 nt, hsa; identical to SEQ ID NO: 488801

SEQ ID NO: 739903 - RNA, 64 nt, hsa; identical to SEQ ID NO: 488802

SEQ ID NO: 739904 - RNA, 64 nt, hsa; identical to SEQ ID NO: 488803

SEQ ID NO: 739905 - RNA, 64 nt, hsa; identical to SEQ ID NO: 488804

SEQ ID NO: 739906 - RNA, 64 nt, hsa; identical to SEQ ID NO: 488805

SEQ ID NO: 739907 - RNA, 64 nt, hsa; identical to SEQ ID NO: 488806

SEQ ID NO: 739908 - RNA, 64 nt, hsa; identical to SEQ ID NO: 488807

SEQ ID NO: 739909 - RNA, 64 nt, hsa; identical to SEQ ID NO: 488808

SEQ ID NO: 739910 - RNA, 64 nt, hsa; identical to SEQ ID NO: 488809

SEQ ID NO: 739911 - RNA, 64 nt, hsa; identical to SEQ ID NO: 488810

SEQ ID NO: 739912 - RNA, 64 nt, hsa; identical to SEQ ID NO: 488811

SEQ ID NO: 739913 - RNA, 64 nt, hsa; identical to SEQ ID NO: 488812

SEQ ID NO: 739914 - RNA, 64 nt, hsa; identical to SEQ ID NO: 488813

SEQ ID NO: 739915 - RNA, 64 nt, hsa; identical to SEQ ID NO: 488814

SEQ ID NO: 739916 - RNA, 64 nt, hsa; identical to SEQ ID NO: 488815

SEQ ID NO: 739917 - RNA, 64 nt, hsa; identical to SEQ ID NO: 488816

SEQ ID NO: 739918 - RNA, 64 nt, hsa; identical to SEQ ID NO: 488817

SEQ ID NO: 739919 - RNA, 64 nt, hsa; identical to SEQ ID NO: 488818

SEQ ID NO: 739920 - RNA, 64 nt, hsa; identical to SEQ ID NO: 488819

SEQ ID NO: 739921 - RNA, 64 nt, hsa; identical to SEQ ID NO: 488820

SEQ ID NO: 739922 - RNA, 64 nt, hsa; identical to SEQ ID NO: 488821

SEQ ID NO: 739923 - RNA, 64 nt, hsa; identical to SEQ ID NO: 488822

SEQ ID NO: 739924 - RNA, 64 nt, hsa; identical to SEQ ID NO: 488823

SEQ ID NO: 739925 - RNA, 64 nt, hsa; identical to SEQ ID NO: 488824

SEQ ID NO: 739926 - RNA, 64 nt, hsa; identical to SEQ ID NO: 488825

SEQ ID NO: 739927 - RNA, 64 nt, hsa; identical to SEQ ID NO: 488826

SEQ ID NO: 739928 - RNA, 64 nt, hsa; identical to SEQ ID NO: 488827

SEQ ID NO: 739929 - RNA, 64 nt, hsa; identical to SEQ ID NO: 488828

SEQ ID NO: 739930 - RNA, 64 nt, hsa; identical to SEQ ID NO: 488829

SEQ ID NO: 739931 - RNA, 64 nt, hsa; identical to SEQ ID NO: 488830

SEQ ID NO: 739932 - RNA, 64 nt, hsa; identical to SEQ ID NO: 488831

SEQ ID NO: 739933 - RNA, 64 nt, hsa; identical to SEQ ID NO: 488832

SEQ ID NO: 739934 - RNA, 64 nt, hsa; identical to SEQ ID NO: 488833

SEQ ID NO: 739935 - RNA, 64 nt, hsa; identical to SEQ ID NO: 488834

SEQ ID NO: 739936 - RNA, 64 nt, hsa; identical to SEQ ID NO: 488835

SEQ ID NO: 739937 - RNA, 64 nt, hsa; identical to SEQ ID NO: 488836

SEQ ID NO: 739938 - RNA, 64 nt, hsa; identical to SEQ ID NO: 488837

SEQ ID NO: 739939 - RNA, 64 nt, hsa; identical to SEQ ID NO: 488838

SEQ ID NO: 739940 - RNA, 64 nt, hsa; identical to SEQ ID NO: 488839

SEQ ID NO: 739941 - RNA, 64 nt, hsa; identical to SEQ ID NO: 488840

SEQ ID NO: 739942 - RNA, 64 nt, hsa; identical to SEQ ID NO: 488841

SEQ ID NO: 739943 - RNA, 64 nt, hsa; identical to SEQ ID NO: 488842

SEQ ID NO: 739944 - RNA, 64 nt, hsa; identical to SEQ ID NO: 488843

SEQ ID NO: 739945 - RNA, 64 nt, hsa; identical to SEQ ID NO: 488844

SEQ ID NO: 739946 - RNA, 64 nt, hsa; identical to SEQ ID NO: 488845

SEQ ID NO: 739947 - RNA, 64 nt, hsa; identical to SEQ ID NO: 488846

SEQ ID NO: 739948 - RNA, 64 nt, hsa; identical to SEQ ID NO: 488847

SEQ ID NO: 739949 - RNA, 64 nt, hsa; identical to SEQ ID NO: 488848

SEQ ID NO: 739950 - RNA, 64 nt, hsa; identical to SEQ ID NO: 488849

SEQ ID NO: 739951 - RNA, 64 nt, hsa; identical to SEQ ID NO: 488850

SEQ ID NO: 739952 - RNA, 64 nt, hsa; identical to SEQ ID NO: 488851

SEQ ID NO: 739953 - RNA, 64 nt, hsa; identical to SEQ ID NO: 488852

SEQ ID NO: 739954 - RNA, 64 nt, hsa; identical to SEQ ID NO: 488853

SEQ ID NO: 739955 - RNA, 64 nt, hsa; identical to SEQ ID NO: 488854

SEQ ID NO: 739956 - RNA, 64 nt, hsa; identical to SEQ ID NO: 488855

SEQ ID NO: 739957 - RNA, 64 nt, hsa; identical to SEQ ID NO: 488856

SEQ ID NO: 739958 - RNA, 64 nt, hsa; identical to SEQ ID NO: 488857

SEQ ID NO: 739959 - RNA, 64 nt, hsa; identical to SEQ ID NO: 488858

SEQ ID NO: 739960 - RNA, 64 nt, hsa; identical to SEQ ID NO: 488859

SEQ ID NO: 739961 - RNA, 64 nt, hsa; identical to SEQ ID NO: 488860

SEQ ID NO: 739962 - RNA, 64 nt, hsa; identical to SEQ ID NO: 488861

SEQ ID NO: 739963 - RNA, 64 nt, hsa; identical to SEQ ID NO: 488862

SEQ ID NO: 739964 - RNA, 64 nt, hsa; identical to SEQ ID NO: 488863

SEQ ID NO: 739965 - RNA, 64 nt, hsa; identical to SEQ ID NO: 488864

SEQ ID NO: 739966 - RNA, 64 nt, hsa; identical to SEQ ID NO: 488865

SEQ ID NO: 739967 - RNA, 64 nt, hsa; identical to SEQ ID NO: 488866

SEQ ID NO: 739968 - RNA, 64 nt, hsa; identical to SEQ ID NO: 488867

SEQ ID NO: 739969 - RNA, 64 nt, hsa; identical to SEQ ID NO: 488868

SEQ ID NO: 739970 - RNA, 64 nt, hsa; identical to SEQ ID NO: 488869

SEQ ID NO: 739971 - RNA, 64 nt, hsa; identical to SEQ ID NO: 488870

SEQ ID NO: 739972 - RNA, 64 nt, hsa; identical to SEQ ID NO: 488871

SEQ ID NO: 739973 - RNA, 64 nt, hsa; identical to SEQ ID NO: 488872

SEQ ID NO: 739974 - RNA, 64 nt, hsa; identical to SEQ ID NO: 488873

SEQ ID NO: 739975 - RNA, 64 nt, hsa; identical to SEQ ID NO: 488874

SEQ ID NO: 739976 - RNA, 64 nt, hsa; identical to SEQ ID NO: 488875

SEQ ID NO: 739977 - RNA, 64 nt, hsa; identical to SEQ ID NO: 488876

SEQ ID NO: 739978 - RNA, 64 nt, hsa; identical to SEQ ID NO: 488877

SEQ ID NO: 739979 - RNA, 64 nt, hsa; identical to SEQ ID NO: 488878

SEQ ID NO: 739980 - RNA, 64 nt, hsa; identical to SEQ ID NO: 488879

SEQ ID NO: 739981 - RNA, 64 nt, hsa; identical to SEQ ID NO: 488880

SEQ ID NO: 739982 - RNA, 64 nt, hsa; identical to SEQ ID NO: 488881

SEQ ID NO: 739983 - RNA, 64 nt, hsa; identical to SEQ ID NO: 488882

SEQ ID NO: 739984 - RNA, 64 nt, hsa; identical to SEQ ID NO: 488883

SEQ ID NO: 739985 - RNA, 64 nt, hsa; identical to SEQ ID NO: 488884

SEQ ID NO: 739986 - RNA, 64 nt, hsa; identical to SEQ ID NO: 488885

SEQ ID NO: 739987 - RNA, 64 nt, hsa; identical to SEQ ID NO: 488886

SEQ ID NO: 739988 - RNA, 64 nt, hsa; identical to SEQ ID NO: 488887

SEQ ID NO: 739989 - RNA, 64 nt, hsa; identical to SEQ ID NO: 488888

SEQ ID NO: 739990 - RNA, 64 nt, hsa; identical to SEQ ID NO: 488889

SEQ ID NO: 739991 - RNA, 64 nt, hsa; identical to SEQ ID NO: 488890

SEQ ID NO: 739992 - RNA, 64 nt, hsa; identical to SEQ ID NO: 488891

SEQ ID NO: 739993 - RNA, 64 nt, hsa; identical to SEQ ID NO: 488892

SEQ ID NO: 739994 - RNA, 64 nt, hsa; identical to SEQ ID NO: 488893

SEQ ID NO: 739995 - RNA, 64 nt, hsa; identical to SEQ ID NO: 488894

SEQ ID NO: 739996 - RNA, 64 nt, hsa; identical to SEQ ID NO: 488895

SEQ ID NO: 739997 - RNA, 64 nt, hsa; identical to SEQ ID NO: 488896

SEQ ID NO: 739998 - RNA, 64 nt, hsa; identical to SEQ ID NO: 488897

SEQ ID NO: 739999 - RNA, 64 nt, hsa; identical to SEQ ID NO: 488898

SEQ ID NO: 740000 - RNA, 64 nt, hsa; identical to SEQ ID NO: 488899

SEQ ID NO: 740001 - RNA, 64 nt, hsa; identical to SEQ ID NO: 488900

SEQ ID NO: 740002 - RNA, 64 nt, hsa; identical to SEQ ID NO: 488901

SEQ ID NO: 740003 - RNA, 64 nt, hsa; identical to SEQ ID NO: 488902

SEQ ID NO: 740004 - RNA, 64 nt, hsa; identical to SEQ ID NO: 488903

SEQ ID NO: 740005 - RNA, 64 nt, hsa; identical to SEQ ID NO: 488904

SEQ ID NO: 740006 - RNA, 64 nt, hsa; identical to SEQ ID NO: 488905

SEQ ID NO: 740007 - RNA, 64 nt, hsa; identical to SEQ ID NO: 488906

SEQ ID NO: 740008 - RNA, 64 nt, hsa; identical to SEQ ID NO: 488907

SEQ ID NO: 740009 - RNA, 64 nt, hsa; identical to SEQ ID NO: 488908

SEQ ID NO: 740010 - RNA, 64 nt, hsa; identical to SEQ ID NO: 488909

SEQ ID NO: 740011 - RNA, 64 nt, hsa; identical to SEQ ID NO: 488910

SEQ ID NO: 740012 - RNA, 64 nt, hsa; identical to SEQ ID NO: 488911

SEQ ID NO: 740013 - RNA, 64 nt, hsa; identical to SEQ ID NO: 488912

SEQ ID NO: 740014 - RNA, 64 nt, hsa; identical to SEQ ID NO: 488913

SEQ ID NO: 740015 - RNA, 64 nt, hsa; identical to SEQ ID NO: 488914

SEQ ID NO: 740016 - RNA, 64 nt, hsa; identical to SEQ ID NO: 488915

SEQ ID NO: 740017 - RNA, 64 nt, hsa; identical to SEQ ID NO: 488916

SEQ ID NO: 740018 - RNA, 64 nt, hsa; identical to SEQ ID NO: 488917

SEQ ID NO: 740019 - RNA, 64 nt, hsa; identical to SEQ ID NO: 488918

SEQ ID NO: 740020 - RNA, 64 nt, hsa; identical to SEQ ID NO: 488919

SEQ ID NO: 740021 - RNA, 64 nt, hsa; identical to SEQ ID NO: 488920

SEQ ID NO: 740022 - RNA, 64 nt, hsa; identical to SEQ ID NO: 488921

SEQ ID NO: 740023 - RNA, 64 nt, hsa; identical to SEQ ID NO: 488922

SEQ ID NO: 740024 - RNA, 64 nt, hsa; identical to SEQ ID NO: 488923

SEQ ID NO: 740025 - RNA, 64 nt, hsa; identical to SEQ ID NO: 488924

SEQ ID NO: 740026 - RNA, 64 nt, hsa; identical to SEQ ID NO: 488925

SEQ ID NO: 740027 - RNA, 64 nt, hsa; identical to SEQ ID NO: 488926

SEQ ID NO: 740028 - RNA, 64 nt, hsa; identical to SEQ ID NO: 488927

SEQ ID NO: 740029 - RNA, 64 nt, hsa; identical to SEQ ID NO: 488928

SEQ ID NO: 740030 - RNA, 64 nt, hsa; identical to SEQ ID NO: 488929

SEQ ID NO: 740031 - RNA, 64 nt, hsa; identical to SEQ ID NO: 488930

SEQ ID NO: 740032 - RNA, 64 nt, hsa; identical to SEQ ID NO: 488931

SEQ ID NO: 740033 - RNA, 64 nt, hsa; identical to SEQ ID NO: 488932

SEQ ID NO: 740034 - RNA, 64 nt, hsa; identical to SEQ ID NO: 488933

SEQ ID NO: 740035 - RNA, 64 nt, hsa; identical to SEQ ID NO: 488934

SEQ ID NO: 740036 - RNA, 64 nt, hsa; identical to SEQ ID NO: 488935

SEQ ID NO: 740037 - RNA, 64 nt, hsa; identical to SEQ ID NO: 488936

SEQ ID NO: 740038 - RNA, 64 nt, hsa; identical to SEQ ID NO: 488937

SEQ ID NO: 740039 - RNA, 64 nt, hsa; identical to SEQ ID NO: 488938

SEQ ID NO: 740040 - RNA, 64 nt, hsa; identical to SEQ ID NO: 488939

SEQ ID NO: 740041 - RNA, 64 nt, hsa; identical to SEQ ID NO: 488940

SEQ ID NO: 740042 - RNA, 64 nt, hsa; identical to SEQ ID NO: 488941

SEQ ID NO: 740043 - RNA, 64 nt, hsa; identical to SEQ ID NO: 488942

SEQ ID NO: 740044 - RNA, 64 nt, hsa; identical to SEQ ID NO: 488943

SEQ ID NO: 740045 - RNA, 64 nt, hsa; identical to SEQ ID NO: 488944

SEQ ID NO: 740046 - RNA, 64 nt, hsa; identical to SEQ ID NO: 488945

SEQ ID NO: 740047 - RNA, 64 nt, hsa; identical to SEQ ID NO: 488946

SEQ ID NO: 740048 - RNA, 64 nt, hsa; identical to SEQ ID NO: 488947

SEQ ID NO: 740049 - RNA, 64 nt, hsa; identical to SEQ ID NO: 488948

SEQ ID NO: 740050 - RNA, 64 nt, hsa; identical to SEQ ID NO: 488949

SEQ ID NO: 740051 - RNA, 64 nt, hsa; identical to SEQ ID NO: 488950

SEQ ID NO: 740052 - RNA, 64 nt, hsa; identical to SEQ ID NO: 488951

SEQ ID NO: 740053 - RNA, 64 nt, hsa; identical to SEQ ID NO: 488952

SEQ ID NO: 740054 - RNA, 64 nt, hsa; identical to SEQ ID NO: 488953

SEQ ID NO: 740055 - RNA, 64 nt, hsa; identical to SEQ ID NO: 488954

SEQ ID NO: 740056 - RNA, 64 nt, hsa; identical to SEQ ID NO: 488955

SEQ ID NO: 740057 - RNA, 64 nt, hsa; identical to SEQ ID NO: 488956

SEQ ID NO: 740058 - RNA, 64 nt, hsa; identical to SEQ ID NO: 488957

SEQ ID NO: 740059 - RNA, 64 nt, hsa; identical to SEQ ID NO: 488958

SEQ ID NO: 740060 - RNA, 64 nt, hsa; identical to SEQ ID NO: 488959

SEQ ID NO: 740061 - RNA, 64 nt, hsa; identical to SEQ ID NO: 488960

SEQ ID NO: 740062 - RNA, 64 nt, hsa; identical to SEQ ID NO: 488961

SEQ ID NO: 740063 - RNA, 64 nt, hsa; identical to SEQ ID NO: 488962

SEQ ID NO: 740064 - RNA, 64 nt, hsa; identical to SEQ ID NO: 488963

SEQ ID NO: 740065 - RNA, 64 nt, hsa; identical to SEQ ID NO: 488964

SEQ ID NO: 740066 - RNA, 64 nt, hsa; identical to SEQ ID NO: 488965

SEQ ID NO: 740067 - RNA, 64 nt, hsa; identical to SEQ ID NO: 488966

SEQ ID NO: 740068 - RNA, 64 nt, hsa; identical to SEQ ID NO: 488967

SEQ ID NO: 740069 - RNA, 64 nt, hsa; identical to SEQ ID NO: 488968

SEQ ID NO: 740070 - RNA, 64 nt, hsa; identical to SEQ ID NO: 488969

SEQ ID NO: 740071 - RNA, 64 nt, hsa; identical to SEQ ID NO: 488970

SEQ ID NO: 740072 - RNA, 64 nt, hsa; identical to SEQ ID NO: 488971

SEQ ID NO: 740073 - RNA, 64 nt, hsa; identical to SEQ ID NO: 488972

SEQ ID NO: 740074 - RNA, 64 nt, hsa; identical to SEQ ID NO: 488973

SEQ ID NO: 740075 - RNA, 64 nt, hsa; identical to SEQ ID NO: 488974

SEQ ID NO: 740076 - RNA, 64 nt, hsa; identical to SEQ ID NO: 488975

SEQ ID NO: 740077 - RNA, 64 nt, hsa; identical to SEQ ID NO: 488976

SEQ ID NO: 740078 - RNA, 64 nt, hsa; identical to SEQ ID NO: 488977

SEQ ID NO: 740079 - RNA, 64 nt, hsa; identical to SEQ ID NO: 488978

SEQ ID NO: 740080 - RNA, 64 nt, hsa; identical to SEQ ID NO: 488979

SEQ ID NO: 740081 - RNA, 64 nt, hsa; identical to SEQ ID NO: 488980

SEQ ID NO: 740082 - RNA, 64 nt, hsa; identical to SEQ ID NO: 488981

SEQ ID NO: 740083 - RNA, 64 nt, hsa; identical to SEQ ID NO: 488982

SEQ ID NO: 740084 - RNA, 64 nt, hsa; identical to SEQ ID NO: 488983

SEQ ID NO: 740085 - RNA, 64 nt, hsa; identical to SEQ ID NO: 488984

SEQ ID NO: 740086 - RNA, 64 nt, hsa; identical to SEQ ID NO: 488985

SEQ ID NO: 740087 - RNA, 64 nt, hsa; identical to SEQ ID NO: 488986

SEQ ID NO: 740088 - RNA, 64 nt, hsa; identical to SEQ ID NO: 488987

SEQ ID NO: 740089 - RNA, 64 nt, hsa; identical to SEQ ID NO: 488988

SEQ ID NO: 740090 - RNA, 64 nt, hsa; identical to SEQ ID NO: 488989

SEQ ID NO: 740091 - RNA, 64 nt, hsa; identical to SEQ ID NO: 488990

SEQ ID NO: 740092 - RNA, 64 nt, hsa; identical to SEQ ID NO: 488991

SEQ ID NO: 740093 - RNA, 64 nt, hsa; identical to SEQ ID NO: 488992

SEQ ID NO: 740094 - RNA, 64 nt, hsa; identical to SEQ ID NO: 488993

SEQ ID NO: 740095 - RNA, 64 nt, hsa; identical to SEQ ID NO: 488994

SEQ ID NO: 740096 - RNA, 64 nt, hsa; identical to SEQ ID NO: 488995

SEQ ID NO: 740097 - RNA, 64 nt, hsa; identical to SEQ ID NO: 488996

SEQ ID NO: 740098 - RNA, 64 nt, hsa; identical to SEQ ID NO: 488997

SEQ ID NO: 740099 - RNA, 64 nt, hsa; identical to SEQ ID NO: 488998

SEQ ID NO: 740100 - RNA, 64 nt, hsa; identical to SEQ ID NO: 488999

SEQ ID NO: 740101 - RNA, 64 nt, hsa; identical to SEQ ID NO: 489000

SEQ ID NO: 740102 - RNA, 64 nt, hsa; identical to SEQ ID NO: 489001

SEQ ID NO: 740103 - RNA, 64 nt, hsa; identical to SEQ ID NO: 489002

SEQ ID NO: 740104 - RNA, 64 nt, hsa; identical to SEQ ID NO: 489003

SEQ ID NO: 740105 - RNA, 64 nt, hsa; identical to SEQ ID NO: 489004

SEQ ID NO: 740106 - RNA, 64 nt, hsa; identical to SEQ ID NO: 489005

SEQ ID NO: 740107 - RNA, 64 nt, hsa; identical to SEQ ID NO: 489006

SEQ ID NO: 740108 - RNA, 64 nt, hsa; identical to SEQ ID NO: 489007

SEQ ID NO: 740109 - RNA, 64 nt, hsa; identical to SEQ ID NO: 489008

SEQ ID NO: 740110 - RNA, 64 nt, hsa; identical to SEQ ID NO: 489009

SEQ ID NO: 740111 - RNA, 64 nt, hsa; identical to SEQ ID NO: 489010

SEQ ID NO: 740112 - RNA, 64 nt, hsa; identical to SEQ ID NO: 489011

SEQ ID NO: 740113 - RNA, 64 nt, hsa; identical to SEQ ID NO: 489012

SEQ ID NO: 740114 - RNA, 64 nt, hsa; identical to SEQ ID NO: 489013

SEQ ID NO: 740115 - RNA, 64 nt, hsa; identical to SEQ ID NO: 489014

SEQ ID NO: 740116 - RNA, 64 nt, hsa; identical to SEQ ID NO: 489015

SEQ ID NO: 740117 - RNA, 64 nt, hsa; identical to SEQ ID NO: 489016

SEQ ID NO: 740118 - RNA, 64 nt, hsa; identical to SEQ ID NO: 489017

SEQ ID NO: 740119 - RNA, 64 nt, hsa; identical to SEQ ID NO: 489018

SEQ ID NO: 740120 - RNA, 64 nt, hsa; identical to SEQ ID NO: 489019

SEQ ID NO: 740121 - RNA, 64 nt, hsa; identical to SEQ ID NO: 489020

SEQ ID NO: 740122 - RNA, 64 nt, hsa; identical to SEQ ID NO: 489021

SEQ ID NO: 740123 - RNA, 64 nt, hsa; identical to SEQ ID NO: 489022

SEQ ID NO: 740124 - RNA, 64 nt, hsa; identical to SEQ ID NO: 489023

SEQ ID NO: 740125 - RNA, 64 nt, hsa; identical to SEQ ID NO: 489024

SEQ ID NO: 740126 - RNA, 64 nt, hsa; identical to SEQ ID NO: 489025

SEQ ID NO: 740127 - RNA, 64 nt, hsa; identical to SEQ ID NO: 489026

SEQ ID NO: 740128 - RNA, 64 nt, hsa; identical to SEQ ID NO: 489027

SEQ ID NO: 740129 - RNA, 64 nt, hsa; identical to SEQ ID NO: 489028

SEQ ID NO: 740130 - RNA, 64 nt, hsa; identical to SEQ ID NO: 489029

SEQ ID NO: 740131 - RNA, 64 nt, hsa; identical to SEQ ID NO: 489030

SEQ ID NO: 740132 - RNA, 64 nt, hsa; identical to SEQ ID NO: 489031

SEQ ID NO: 740133 - RNA, 64 nt, hsa; identical to SEQ ID NO: 489032

SEQ ID NO: 740134 - RNA, 64 nt, hsa; identical to SEQ ID NO: 489033

SEQ ID NO: 740135 - RNA, 64 nt, hsa; identical to SEQ ID NO: 489034

SEQ ID NO: 740136 - RNA, 64 nt, hsa; identical to SEQ ID NO: 489035

SEQ ID NO: 740137 - RNA, 64 nt, hsa; identical to SEQ ID NO: 489036

SEQ ID NO: 740138 - RNA, 64 nt, hsa; identical to SEQ ID NO: 489037

SEQ ID NO: 740139 - RNA, 64 nt, hsa; identical to SEQ ID NO: 489038

SEQ ID NO: 740140 - RNA, 64 nt, hsa; identical to SEQ ID NO: 489039

SEQ ID NO: 740141 - RNA, 64 nt, hsa; identical to SEQ ID NO: 489040

SEQ ID NO: 740142 - RNA, 64 nt, hsa; identical to SEQ ID NO: 489041

SEQ ID NO: 740143 - RNA, 64 nt, hsa; identical to SEQ ID NO: 489042

SEQ ID NO: 740144 - RNA, 64 nt, hsa; identical to SEQ ID NO: 489043

SEQ ID NO: 740145 - RNA, 64 nt, hsa; identical to SEQ ID NO: 489044

SEQ ID NO: 740146 - RNA, 64 nt, hsa; identical to SEQ ID NO: 489045

SEQ ID NO: 740147 - RNA, 64 nt, hsa; identical to SEQ ID NO: 489046

SEQ ID NO: 740148 - RNA, 64 nt, hsa; identical to SEQ ID NO: 489047

SEQ ID NO: 740149 - RNA, 64 nt, hsa; identical to SEQ ID NO: 489048

SEQ ID NO: 740150 - RNA, 64 nt, hsa; identical to SEQ ID NO: 489049

SEQ ID NO: 740151 - RNA, 64 nt, hsa; identical to SEQ ID NO: 489050

SEQ ID NO: 740152 - RNA, 64 nt, hsa; identical to SEQ ID NO: 489051

SEQ ID NO: 740153 - RNA, 64 nt, hsa; identical to SEQ ID NO: 489052

SEQ ID NO: 740154 - RNA, 64 nt, hsa; identical to SEQ ID NO: 489053

SEQ ID NO: 740155 - RNA, 64 nt, hsa; identical to SEQ ID NO: 489054

SEQ ID NO: 740156 - RNA, 64 nt, hsa; identical to SEQ ID NO: 489055

SEQ ID NO: 740157 - RNA, 64 nt, hsa; identical to SEQ ID NO: 489056

SEQ ID NO: 740158 - RNA, 64 nt, hsa; identical to SEQ ID NO: 489057

SEQ ID NO: 740159 - RNA, 63 nt, hsa
cuaugaaugccuucuuaaaaucauguuuuuaaaugcauaaaauauauaggauuacaaaggaau

SEQ ID NO: 740160 - RNA, 63 nt, hsa
cacauauuuuuauauuauguuaaaguaaagaaaugcauaaaagacaagcacuuuggaagaauu

SEQ ID NO: 740161 - RNA, 63 nt, hsa
ugggcuaauuuguauguuuccauagcuacuauaugcauaaacaacaguaccugaaggauuauu

SEQ ID NO: 740162 - RNA, 63 nt, hsa
aauggucacaaggucuuuacuuaugcacauuugugcauaaauuuccacccaauuuccaagaca

SEQ ID NO: 740163 - RNA, 63 nt, hsa
agcaaaacucccuuuuuucucuugccuuuuuuaugcauaaauggaggucaauuugauuguccu

SEQ ID NO: 740164 - RNA, 63 nt, hsa
accagaagacuuugaaguuguauauucuugcaaugcauaaaaugacauuauaaucaacaaacu

SEQ ID NO: 740165 - RNA, 64 nt, hsa
acuggaauggauuucucaaugcgggaccagauuaugacuagaguuuuuaugccagaaggaauca

SEQ ID NO: 740166 - RNA, 64 nt, hsa
acaagucccuaaguuuccuuauuuuaauuuacugugacuagauuugaagcaaauaaauacucca

SEQ ID NO: 740167 - RNA, 64 nt, hsa
uuucucagguucuuaacagccugugcaaacucccugacuagauggucugucacuccuaucauua

SEQ ID NO: 740168 - RNA, 64 nt, hsa
cuaagcauguggcauaaauuuggagaaaauaauaugacuagaaaaauuaguguuauauugggug

SEQ ID NO: 740169 - RNA, 64 nt, hsa
gcuccccuuuucuuguuugaaaacaguuauuuggugacuagaaaggcaagggaggcauagccgg

SEQ ID NO: 740170 - RNA, 64 nt, hsa
cacacuucuuuuggucugaagguaacccccaucaugacuagacgagaaccgucuuuacccgggc

SEQ ID NO: 740171 - RNA, 62 nt, hsa
gugacuagagggugguggagguaaggccuuccagagcccauggcuucaggagagggucucuc

SEQ ID NO: 740172 - RNA, 62 nt, hsa
gaagcuuuaacaugguucaggcccuuggugugagagcccagggggaggacagcuugucugcu

SEQ ID NO: 740173 - RNA, 62 nt, hsa
cacaucaguguuuccgucugcucaccugccacagagcccacacccaugcccaccaguguugg

SEQ ID NO: 740174 - RNA, 62 nt, hsa
ugggaagacacauucccuucccuguuccccagagagcccaccuccgcccugggcaggagccc

SEQ ID NO: 740175 - RNA, 62 nt, hsa
cgucugugcugccugguuugcauccggcucacagagcccagacugcuggaacagccaaggac

SEQ ID NO: 740176 - RNA, 62 nt, hsa
ucucccagacaggagccaggguugagcaauggagagcccagcccccacgucuuacagucgcc

SEQ ID NO: 740177 - RNA, 62 nt, hsa
uuguuuugaacuuccuuucccacuugguagaaagagcccagaagcagcccuggcccuguaag

SEQ ID NO: 740178 - RNA, 62 nt, hsa
cagccuuauuucugccggggccuccccaccggagagcccagggggccggccggguuccuggu

SEQ ID NO: 740179 - RNA, 62 nt, hsa
auuuuauauaaaaaguguuucugugauucuucagagcccaggagucagugcuggugguugga

SEQ ID NO: 740180 - RNA, 62 nt, hsa
gcucccaggcccagcaccgagcagaacagaccagagcccaccacaccacaaagagcagcacc

SEQ ID NO: 740181 - RNA, 62 nt, hsa
aucauugaaguggagcccggcacaggggucauagagcccagugaggucggggauuuugaguu

SEQ ID NO: 740182 - RNA, 62 nt, hsa
cagccagcucccagccacauggcgcaugaaggagagcccagucucccuccaggaaaggccug

SEQ ID NO: 740183 - RNA, 62 nt, hsa
ccugaccagaggggagguggauggcacuuuccagagcccagguucuuauggcauuucccagg

SEQ ID NO: 740184 - RNA, 62 nt, hsa
ugugcccacugcccgugcagccuccuucagccagagcccagagcauagacaggaguguagga

SEQ ID NO: 740185 - RNA, 62 nt, hsa
aaguguuccguacccacugcugaugguuucccagagcccacacugaguugaagaaccuauug

SEQ ID NO: 740186 - RNA, 62 nt, hsa
ugacucccauuugcucucagugaccccagggcagagcccagagaaguguuccguacccacug

SEQ ID NO: 740187 - RNA, 62 nt, hsa
cagauagcaaaugugucugguuagaucucagcagagcccauucugcaagaccuggcugagcc

SEQ ID NO: 740188 - RNA, 62 nt, hsa
auuaacaccuucuggagccagcucaucagcucagagcccagggucaggaguucguucaguaa

SEQ ID NO: 740189 - RNA, 62 nt, hsa
ccuggauguccuucgaaggaaccaggacccucagagcccagcauccaucucugucaucaucu

SEQ ID NO: 740190 - RNA, 62 nt, hsa
ccugcuccuacccaugcuacaggccaggaaccagagcccaucaucucagaggccccuggaug

SEQ ID NO: 740191 - RNA, 62 nt, hsa
uuuguuccuguuaaauguauagcauuguaaugagagcccaucaaauccugagugucaguuug

SEQ ID NO: 740192 - RNA, 62 nt, hsa
guuaccuugaccacgcuguacaguaacauccaagagcccauucuacagugggugguuuuggu

SEQ ID NO: 740193 - RNA, 62 nt, hsa
uugcugcggcugcaauggaggcaaggggcugcagagcccaggugcacugugugaugauggga

SEQ ID NO: 740194 - RNA, 62 nt, hsa
ccuaucagugccccccagaguagagagcaauaagagcccagcccagugcagucccggcugug

SEQ ID NO: 740195 - RNA, 62 nt, hsa
uuguauauacccugcaccagcagugaccgggcagagcccaacccccuccacgggggucccag

SEQ ID NO: 740196 - RNA, 62 nt, hsa
accucccugcacauggcacuacccagacugccagagcccaggcuggccucaucugcaccaug

SEQ ID NO: 740197 - RNA, 62 nt, hsa
cuuuggagaaaccaaccagauacaucugcuggagagcccaggugggcacagagaagggugga

SEQ ID NO: 740198 - RNA, 62 nt, hsa
ccuugaagggcaaggagggaaacaguguuaccagagcccaguaagaacugcugucaugaagg

SEQ ID NO: 740199 - RNA, 62 nt, hsa
aucaaaauguuaacacaaagcuaagauucaucagagcccacccuauucuaaggaaccacaau

SEQ ID NO: 740200 - RNA, 62 nt, hsa
aacucugguaaagcauccuguggagggagaggagagcccagucauuugcuuagaugguguuu

SEQ ID NO: 740201 - RNA, 62 nt, hsa
gucucacucucaggacuauucuguaagaguccagagcccaccuccucaguuccuguggauag

SEQ ID NO: 740202 - RNA, 62 nt, hsa
agccuaaacagggcacauagaucucucccacuagagcccagagggaugagaggagagagcaa

SEQ ID NO: 740203 - RNA, 62 nt, hsa
guugaggcccuaacaaauuucaggcccagccaagagcccaugaauggaggcugcaggaggcu

SEQ ID NO: 740204 - RNA, 62 nt, hsa
ggccuugaaguagcagccuuggcugacuuuccagagcccagucccaagccuggcaccaagcc

SEQ ID NO: 740205 - RNA, 62 nt, hsa
gcuagugcuaagagggaaggcccagguuugagagagcccagaggggcagagcccagagccuu

SEQ ID NO: 740206 - RNA, 62 nt, hsa
gaaggcccagguuugagagagcccagaggggcagagcccagagccuuguuuggcccugaucu

SEQ ID NO: 740207 - RNA, 62 nt, hsa
auccccaucggcccuguccccuggagugugucagagcccaggggagaaugcagcccaccagg

SEQ ID NO: 740208 - RNA, 62 nt, hsa
guugaucuacccgugccugggccccuccccucagagcccaugguaacgaaccccuagaaagg

SEQ ID NO: 740209 - RNA, 62 nt, hsa
gucccagaagcagucccugacccccagcuuucagagcccagccaccagcuuggggcuggaug

SEQ ID NO: 740210 - RNA, 62 nt, hsa
uacacagaagugauaaaggaauccaaaguugaagagcccaggaaacgggaaacuguauccau

SEQ ID NO: 740211 - RNA, 62 nt, hsa
ugcaaccagucuggggccauucagccagggacagagcccacagagcccauacaccugucucc

SEQ ID NO: 740212 - RNA, 62 nt, hsa
ucuggggccauucagccagggacagagcccacagagcccauacaccugucucccaccagcgg

SEQ ID NO: 740213 - RNA, 64 nt, hsa
gguauuaccucugugcucagugccaggcaaaacacuagcucaaaggagagucaaggaaaccgcu

SEQ ID NO: 740214 - RNA, 64 nt, hsa
augucagguuuuugguuuuauuauuauuucagaacuagcucagcccaucucuaauuauaaaaca

SEQ ID NO: 740215 - RNA, 64 nt, hsa
agggauuguaaauacaccgaugggcacucuguaucuagcucaagguuuguaaacacaccaauca

SEQ ID NO: 740216 - RNA, 64 nt, hsa
aagguuuguaaacacaccaaucagcacccugugucuagcucaguguuugugaaugcaccaaucc

SEQ ID NO: 740217 - RNA, 64 nt, hsa
gcuaaucuaguggggauguggagaaccuuugugucuagcucagggaucguaaacgcaccaauca

SEQ ID NO: 740218 - RNA, 64 nt, hsa; identical to SEQ ID NO: 178899

SEQ ID NO: 740219 - RNA, 64 nt, hsa; identical to SEQ ID NO: 178900

SEQ ID NO: 740220 - RNA, 64 nt, hsa; identical to SEQ ID NO: 178901

SEQ ID NO: 740221 - RNA, 64 nt, hsa; identical to SEQ ID NO: 178902

SEQ ID NO: 740222 - RNA, 64 nt, hsa; identical to SEQ ID NO: 178903

SEQ ID NO: 740223 - RNA, 64 nt, hsa; identical to SEQ ID NO: 178904

SEQ ID NO: 740224 - RNA, 64 nt, hsa; identical to SEQ ID NO: 178905

SEQ ID NO: 740225 - RNA, 64 nt, hsa; identical to SEQ ID NO: 178906

SEQ ID NO: 740226 - RNA, 64 nt, hsa; identical to SEQ ID NO: 178907

SEQ ID NO: 740227 - RNA, 64 nt, hsa; identical to SEQ ID NO: 178908

SEQ ID NO: 740228 - RNA, 64 nt, hsa; identical to SEQ ID NO: 178909

SEQ ID NO: 740229 - RNA, 64 nt, hsa; identical to SEQ ID NO: 178910

SEQ ID NO: 740230 - RNA, 64 nt, hsa; identical to SEQ ID NO: 178911

SEQ ID NO: 740231 - RNA, 64 nt, hsa; identical to SEQ ID NO: 178912

SEQ ID NO: 740232 - RNA, 64 nt, hsa; identical to SEQ ID NO: 178913

SEQ ID NO: 740233 - RNA, 64 nt, hsa; identical to SEQ ID NO: 178914

SEQ ID NO: 740234 - RNA, 64 nt, hsa; identical to SEQ ID NO: 178915

SEQ ID NO: 740235 - RNA, 64 nt, hsa; identical to SEQ ID NO: 178916

SEQ ID NO: 740236 - RNA, 64 nt, hsa; identical to SEQ ID NO: 178917

SEQ ID NO: 740237 - RNA, 64 nt, hsa; identical to SEQ ID NO: 178918

SEQ ID NO: 740238 - RNA, 64 nt, hsa; identical to SEQ ID NO: 178919

SEQ ID NO: 740239 - RNA, 64 nt, hsa; identical to SEQ ID NO: 178920

SEQ ID NO: 740240 - RNA, 64 nt, hsa; identical to SEQ ID NO: 178921

SEQ ID NO: 740241 - RNA, 64 nt, hsa; identical to SEQ ID NO: 178922

SEQ ID NO: 740242 - RNA, 64 nt, hsa; identical to SEQ ID NO: 178923

SEQ ID NO: 740243 - RNA, 64 nt, hsa; identical to SEQ ID NO: 178924

SEQ ID NO: 740244 - RNA, 58 nt, hsa; identical to SEQ ID NO: 178925

SEQ ID NO: 740245 - RNA, 64 nt, hsa; identical to SEQ ID NO: 178926

SEQ ID NO: 740246 - RNA, 64 nt, hsa; identical to SEQ ID NO: 178927

SEQ ID NO: 740247 - RNA, 64 nt, hsa; identical to SEQ ID NO: 178928

SEQ ID NO: 740248 - RNA, 64 nt, hsa; identical to SEQ ID NO: 178929

SEQ ID NO: 740249 - RNA, 64 nt, hsa; identical to SEQ ID NO: 178930

SEQ ID NO: 740250 - RNA, 64 nt, hsa; identical to SEQ ID NO: 178931

SEQ ID NO: 740251 - RNA, 64 nt, hsa; identical to SEQ ID NO: 178932

SEQ ID NO: 740252 - RNA, 64 nt, hsa; identical to SEQ ID NO: 178933

SEQ ID NO: 740253 - RNA, 64 nt, hsa; identical to SEQ ID NO: 178934

SEQ ID NO: 740254 - RNA, 64 nt, hsa; identical to SEQ ID NO: 178935

SEQ ID NO: 740255 - RNA, 64 nt, hsa; identical to SEQ ID NO: 178936

SEQ ID NO: 740256 - RNA, 64 nt, hsa; identical to SEQ ID NO: 178937

SEQ ID NO: 740257 - RNA, 64 nt, hsa; identical to SEQ ID NO: 178938

SEQ ID NO: 740258 - RNA, 64 nt, hsa; identical to SEQ ID NO: 178939

SEQ ID NO: 740259 - RNA, 64 nt, hsa; identical to SEQ ID NO: 178940

SEQ ID NO: 740260 - RNA, 64 nt, hsa; identical to SEQ ID NO: 178941

SEQ ID NO: 740261 - RNA, 64 nt, hsa; identical to SEQ ID NO: 178942

SEQ ID NO: 740262 - RNA, 64 nt, hsa; identical to SEQ ID NO: 178943

SEQ ID NO: 740263 - RNA, 64 nt, hsa; identical to SEQ ID NO: 178944

SEQ ID NO: 740264 - RNA, 60 nt, hsa; identical to SEQ ID NO: 178945

SEQ ID NO: 740265 - RNA, 64 nt, hsa; identical to SEQ ID NO: 178946

SEQ ID NO: 740266 - RNA, 64 nt, hsa; identical to SEQ ID NO: 178947

SEQ ID NO: 740267 - RNA, 64 nt, hsa; identical to SEQ ID NO: 178948

SEQ ID NO: 740268 - RNA, 64 nt, hsa; identical to SEQ ID NO: 178949

SEQ ID NO: 740269 - RNA, 64 nt, hsa; identical to SEQ ID NO: 178950

SEQ ID NO: 740270 - RNA, 64 nt, hsa; identical to SEQ ID NO: 178951

SEQ ID NO: 740271 - RNA, 64 nt, hsa; identical to SEQ ID NO: 178952

SEQ ID NO: 740272 - RNA, 64 nt, hsa; identical to SEQ ID NO: 178953

SEQ ID NO: 740273 - RNA, 64 nt, hsa; identical to SEQ ID NO: 178954

SEQ ID NO: 740274 - RNA, 64 nt, hsa; identical to SEQ ID NO: 178955

SEQ ID NO: 740275 - RNA, 64 nt, hsa; identical to SEQ ID NO: 178956

SEQ ID NO: 740276 - RNA, 64 nt, hsa; identical to SEQ ID NO: 178957

SEQ ID NO: 740277 - RNA, 64 nt, hsa; identical to SEQ ID NO: 178958

SEQ ID NO: 740278 - RNA, 64 nt, hsa; identical to SEQ ID NO: 178959

SEQ ID NO: 740279 - RNA, 64 nt, hsa; identical to SEQ ID NO: 178960

SEQ ID NO: 740280 - RNA, 64 nt, hsa; identical to SEQ ID NO: 178961

SEQ ID NO: 740281 - RNA, 64 nt, hsa; identical to SEQ ID NO: 178962

SEQ ID NO: 740282 - RNA, 64 nt, hsa; identical to SEQ ID NO: 178963

SEQ ID NO: 740283 - RNA, 64 nt, hsa; identical to SEQ ID NO: 178964

SEQ ID NO: 740284 - RNA, 64 nt, hsa; identical to SEQ ID NO: 178965

SEQ ID NO: 740285 - RNA, 64 nt, hsa; identical to SEQ ID NO: 178966

SEQ ID NO: 740286 - RNA, 64 nt, hsa; identical to SEQ ID NO: 178967

SEQ ID NO: 740287 - RNA, 64 nt, hsa; identical to SEQ ID NO: 178968

SEQ ID NO: 740288 - RNA, 64 nt, hsa; identical to SEQ ID NO: 178969

SEQ ID NO: 740289 - RNA, 64 nt, hsa; identical to SEQ ID NO: 178970

SEQ ID NO: 740290 - RNA, 64 nt, hsa; identical to SEQ ID NO: 178971

SEQ ID NO: 740291 - RNA, 64 nt, hsa; identical to SEQ ID NO: 178972

SEQ ID NO: 740292 - RNA, 64 nt, hsa; identical to SEQ ID NO: 178973

SEQ ID NO: 740293 - RNA, 64 nt, hsa; identical to SEQ ID NO: 178974

SEQ ID NO: 740294 - RNA, 64 nt, hsa; identical to SEQ ID NO: 178975

SEQ ID NO: 740295 - RNA, 64 nt, hsa; identical to SEQ ID NO: 178976

SEQ ID NO: 740296 - RNA, 64 nt, hsa; identical to SEQ ID NO: 178977

SEQ ID NO: 740297 - RNA, 64 nt, hsa; identical to SEQ ID NO: 178978

SEQ ID NO: 740298 - RNA, 64 nt, hsa; identical to SEQ ID NO: 178979

SEQ ID NO: 740299 - RNA, 64 nt, hsa; identical to SEQ ID NO: 178980

SEQ ID NO: 740300 - RNA, 64 nt, hsa; identical to SEQ ID NO: 178981

SEQ ID NO: 740301 - RNA, 64 nt, hsa; identical to SEQ ID NO: 178982

SEQ ID NO: 740302 - RNA, 64 nt, hsa; identical to SEQ ID NO: 178983

SEQ ID NO: 740303 - RNA, 64 nt, hsa; identical to SEQ ID NO: 178984

SEQ ID NO: 740304 - RNA, 64 nt, hsa; identical to SEQ ID NO: 178985

SEQ ID NO: 740305 - RNA, 64 nt, hsa; identical to SEQ ID NO: 178986

SEQ ID NO: 740306 - RNA, 64 nt, hsa; identical to SEQ ID NO: 178987

SEQ ID NO: 740307 - RNA, 64 nt, hsa; identical to SEQ ID NO: 178988

SEQ ID NO: 740308 - RNA, 64 nt, hsa; identical to SEQ ID NO: 178989

SEQ ID NO: 740309 - RNA, 64 nt, hsa; identical to SEQ ID NO: 178990

SEQ ID NO: 740310 - RNA, 64 nt, hsa; identical to SEQ ID NO: 178991

SEQ ID NO: 740311 - RNA, 64 nt, hsa
ugcagaggaguuugggagguguaaacagcccaugcacguggaggaggagcuggcuuucagcccc

SEQ ID NO: 740312 - RNA, 64 nt, hsa
cuagugccucugcuuggggaggagaaccucuguccacguggaggcuaggaggucucaggugcug

SEQ ID NO: 740313 - RNA, 64 nt, hsa
cccugggaggccggcagccaggccacagaauccacacguggaccauugugggucccugggaggc

SEQ ID NO: 740314 - RNA, 64 nt, hsa
cccugggaggccggcagccaggccacggaauccacacguggaccauugugggucccuugggagg

SEQ ID NO: 740315 - RNA, 64 nt, hsa
acagaagaggagacacagacacagagcaggaggacacguggagacagaggcagacuggagugau

SEQ ID NO: 740316 - RNA, 64 nt, hsa
gaagagcucugacucuccaggggugcugggacaucacguggaauuggaucccaggcucucuugg

SEQ ID NO: 740317 - RNA, 64 nt, hsa
caaauguguucauguauuguauaucauaugaauuguauaucaauuacuaaugggaauuucuaca

SEQ ID NO: 740318 - RNA, 64 nt, hsa
gaaggugcugggcauucaaauguguucauguauuguauaucauaugaauuguauaucaauuacu

SEQ ID NO: 740319 - RNA, 64 nt, hsa
gggguaguuuggcugccauucucacugacaaaauguauaucagcccccaccuccaccccccaau

SEQ ID NO: 740320 - RNA, 64 nt, hsa
aacaguugguuuuaguguguuguauaacuuugcuguauaucaaacuaauuuugacaaguuuuca

SEQ ID NO: 740321 - RNA, 64 nt, hsa
uaaaagcaguacuccuagggaaauggccucugaaguauaucaguuucaucucuuaccaagacug

SEQ ID NO: 740322 - RNA, 64 nt, hsa
gcaugccuucuuuauuccagcuccuauguucuguguauaucauuaacauuuucccaaauaaaca

SEQ ID NO: 740323 - RNA, 64 nt, hsa
guauuuuaagcuuuacuuagauauucaaaaccugguauaucaagucucuguuaguacuauuggc

SEQ ID NO: 740324 - RNA, 64 nt, hsa
ugagcauaggaaaauuuuggaaugaggcagaaaaguauaucaagacauacuuccugguuuugga

SEQ ID NO: 740325 - RNA, 64 nt, hsa
gccagcuacagaguugagcuggccauguuucacaguauaucaagcauuauagagaaagacagaa

SEQ ID NO: 740326 - RNA, 64 nt, hsa; identical to SEQ ID NO: 23251

SEQ ID NO: 740327 - RNA, 64 nt, hsa; identical to SEQ ID NO: 23252

SEQ ID NO: 740328 - RNA, 64 nt, hsa; identical to SEQ ID NO: 23253

SEQ ID NO: 740329 - RNA, 64 nt, hsa; identical to SEQ ID NO: 23254

SEQ ID NO: 740330 - RNA, 64 nt, hsa; identical to SEQ ID NO: 23255

SEQ ID NO: 740331 - RNA, 64 nt, hsa; identical to SEQ ID NO: 23256

SEQ ID NO: 740332 - RNA, 64 nt, hsa; identical to SEQ ID NO: 23257

SEQ ID NO: 740333 - RNA, 64 nt, hsa; identical to SEQ ID NO: 23258

SEQ ID NO: 740334 - RNA, 64 nt, hsa; identical to SEQ ID NO: 23259

SEQ ID NO: 740335 - RNA, 64 nt, hsa; identical to SEQ ID NO: 23260

SEQ ID NO: 740336 - RNA, 64 nt, hsa; identical to SEQ ID NO: 23261

SEQ ID NO: 740337 - RNA, 64 nt, hsa; identical to SEQ ID NO: 23262

SEQ ID NO: 740338 - RNA, 64 nt, hsa; identical to SEQ ID NO: 23263

SEQ ID NO: 740339 - RNA, 64 nt, hsa; identical to SEQ ID NO: 23264

SEQ ID NO: 740340 - RNA, 64 nt, hsa; identical to SEQ ID NO: 23265

SEQ ID NO: 740341 - RNA, 64 nt, hsa; identical to SEQ ID NO: 23266

SEQ ID NO: 740342 - RNA, 64 nt, hsa; identical to SEQ ID NO: 23267

SEQ ID NO: 740343 - RNA, 64 nt, hsa; identical to SEQ ID NO: 23268

SEQ ID NO: 740344 - RNA, 64 nt, hsa; identical to SEQ ID NO: 23269

SEQ ID NO: 740345 - RNA, 64 nt, hsa; identical to SEQ ID NO: 23270

SEQ ID NO: 740346 - RNA, 64 nt, hsa; identical to SEQ ID NO: 23271

SEQ ID NO: 740347 - RNA, 64 nt, hsa; identical to SEQ ID NO: 23272

SEQ ID NO: 740348 - RNA, 64 nt, hsa; identical to SEQ ID NO: 23273

SEQ ID NO: 740349 - RNA, 64 nt, hsa; identical to SEQ ID NO: 23274

SEQ ID NO: 740350 - RNA, 64 nt, hsa; identical to SEQ ID NO: 23275

SEQ ID NO: 740351 - RNA, 64 nt, hsa; identical to SEQ ID NO: 23276

SEQ ID NO: 740352 - RNA, 64 nt, hsa; identical to SEQ ID NO: 23277

SEQ ID NO: 740353 - RNA, 64 nt, hsa; identical to SEQ ID NO: 23278

SEQ ID NO: 740354 - RNA, 64 nt, hsa; identical to SEQ ID NO: 23279

SEQ ID NO: 740355 - RNA, 64 nt, hsa; identical to SEQ ID NO: 23280

SEQ ID NO: 740356 - RNA, 64 nt, hsa; identical to SEQ ID NO: 23281

SEQ ID NO: 740357 - RNA, 64 nt, hsa; identical to SEQ ID NO: 23282

SEQ ID NO: 740358 - RNA, 64 nt, hsa; identical to SEQ ID NO: 23283

SEQ ID NO: 740359 - RNA, 64 nt, hsa; identical to SEQ ID NO: 23284

SEQ ID NO: 740360 - RNA, 64 nt, hsa; identical to SEQ ID NO: 23285

SEQ ID NO: 740361 - RNA, 64 nt, hsa; identical to SEQ ID NO: 23286

SEQ ID NO: 740362 - RNA, 64 nt, hsa; identical to SEQ ID NO: 23287

SEQ ID NO: 740363 - RNA, 64 nt, hsa; identical to SEQ ID NO: 23288

SEQ ID NO: 740364 - RNA, 64 nt, hsa; identical to SEQ ID NO: 23289

SEQ ID NO: 740365 - RNA, 64 nt, hsa; identical to SEQ ID NO: 23290

SEQ ID NO: 740366 - RNA, 64 nt, hsa; identical to SEQ ID NO: 23291

SEQ ID NO: 740367 - RNA, 64 nt, hsa; identical to SEQ ID NO: 23292

SEQ ID NO: 740368 - RNA, 64 nt, hsa; identical to SEQ ID NO: 23293

SEQ ID NO: 740369 - RNA, 64 nt, hsa; identical to SEQ ID NO: 23294

SEQ ID NO: 740370 - RNA, 64 nt, hsa; identical to SEQ ID NO: 23295

SEQ ID NO: 740371 - RNA, 64 nt, hsa; identical to SEQ ID NO: 23296

SEQ ID NO: 740372 - RNA, 64 nt, hsa; identical to SEQ ID NO: 23297

SEQ ID NO: 740373 - RNA, 64 nt, hsa; identical to SEQ ID NO: 23298

SEQ ID NO: 740374 - RNA, 64 nt, hsa; identical to SEQ ID NO: 23299

SEQ ID NO: 740375 - RNA, 64 nt, hsa; identical to SEQ ID NO: 23300

SEQ ID NO: 740376 - RNA, 64 nt, hsa; identical to SEQ ID NO: 23301

SEQ ID NO: 740377 - RNA, 64 nt, hsa; identical to SEQ ID NO: 23302

SEQ ID NO: 740378 - RNA, 64 nt, hsa; identical to SEQ ID NO: 23303

SEQ ID NO: 740379 - RNA, 64 nt, hsa; identical to SEQ ID NO: 23304

SEQ ID NO: 740380 - RNA, 64 nt, hsa; identical to SEQ ID NO: 23305

SEQ ID NO: 740381 - RNA, 64 nt, hsa; identical to SEQ ID NO: 23306

SEQ ID NO: 740382 - RNA, 64 nt, hsa; identical to SEQ ID NO: 23307

SEQ ID NO: 740383 - RNA, 64 nt, hsa; identical to SEQ ID NO: 23308

SEQ ID NO: 740384 - RNA, 64 nt, hsa; identical to SEQ ID NO: 23309

SEQ ID NO: 740385 - RNA, 64 nt, hsa; identical to SEQ ID NO: 23310

SEQ ID NO: 740386 - RNA, 64 nt, hsa; identical to SEQ ID NO: 23311

SEQ ID NO: 740387 - RNA, 64 nt, hsa; identical to SEQ ID NO: 23312

SEQ ID NO: 740388 - RNA, 64 nt, hsa; identical to SEQ ID NO: 23313

SEQ ID NO: 740389 - RNA, 64 nt, hsa; identical to SEQ ID NO: 23314

SEQ ID NO: 740390 - RNA, 64 nt, hsa; identical to SEQ ID NO: 23315

SEQ ID NO: 740391 - RNA, 64 nt, hsa; identical to SEQ ID NO: 23316

SEQ ID NO: 740392 - RNA, 64 nt, hsa; identical to SEQ ID NO: 23317

SEQ ID NO: 740393 - RNA, 64 nt, hsa; identical to SEQ ID NO: 23318

SEQ ID NO: 740394 - RNA, 64 nt, hsa; identical to SEQ ID NO: 23319

SEQ ID NO: 740395 - RNA, 64 nt, hsa; identical to SEQ ID NO: 23320

SEQ ID NO: 740396 - RNA, 64 nt, hsa; identical to SEQ ID NO: 23321

SEQ ID NO: 740397 - RNA, 64 nt, hsa; identical to SEQ ID NO: 23322

SEQ ID NO: 740398 - RNA, 64 nt, hsa; identical to SEQ ID NO: 23323

SEQ ID NO: 740399 - RNA, 64 nt, hsa; identical to SEQ ID NO: 23324

SEQ ID NO: 740400 - RNA, 64 nt, hsa; identical to SEQ ID NO: 23325

SEQ ID NO: 740401 - RNA, 64 nt, hsa; identical to SEQ ID NO: 23326

SEQ ID NO: 740402 - RNA, 64 nt, hsa; identical to SEQ ID NO: 23327

SEQ ID NO: 740403 - RNA, 64 nt, hsa; identical to SEQ ID NO: 23328

SEQ ID NO: 740404 - RNA, 64 nt, hsa; identical to SEQ ID NO: 23329

SEQ ID NO: 740405 - RNA, 64 nt, hsa; identical to SEQ ID NO: 107827

SEQ ID NO: 740406 - RNA, 64 nt, hsa; identical to SEQ ID NO: 107828

SEQ ID NO: 740407 - RNA, 64 nt, hsa; identical to SEQ ID NO: 107829

SEQ ID NO: 740408 - RNA, 64 nt, hsa; identical to SEQ ID NO: 107830

SEQ ID NO: 740409 - RNA, 64 nt, hsa; identical to SEQ ID NO: 107831

SEQ ID NO: 740410 - RNA, 64 nt, hsa; identical to SEQ ID NO: 107832

SEQ ID NO: 740411 - RNA, 64 nt, hsa; identical to SEQ ID NO: 107833

SEQ ID NO: 740412 - RNA, 64 nt, hsa; identical to SEQ ID NO: 107834

SEQ ID NO: 740413 - RNA, 64 nt, hsa; identical to SEQ ID NO: 107835

SEQ ID NO: 740414 - RNA, 64 nt, hsa; identical to SEQ ID NO: 107836

SEQ ID NO: 740415 - RNA, 64 nt, hsa; identical to SEQ ID NO: 107837

SEQ ID NO: 740416 - RNA, 64 nt, hsa; identical to SEQ ID NO: 107838

SEQ ID NO: 740417 - RNA, 64 nt, hsa; identical to SEQ ID NO: 107839

SEQ ID NO: 740418 - RNA, 64 nt, hsa; identical to SEQ ID NO: 107840

SEQ ID NO: 740419 - RNA, 64 nt, hsa; identical to SEQ ID NO: 161784

SEQ ID NO: 740420 - RNA, 64 nt, hsa; identical to SEQ ID NO: 161785

SEQ ID NO: 740421 - RNA, 64 nt, hsa; identical to SEQ ID NO: 161786

SEQ ID NO: 740422 - RNA, 64 nt, hsa; identical to SEQ ID NO: 161787

SEQ ID NO: 740423 - RNA, 64 nt, hsa; identical to SEQ ID NO: 161788

SEQ ID NO: 740424 - RNA, 64 nt, hsa; identical to SEQ ID NO: 161789

SEQ ID NO: 740425 - RNA, 64 nt, hsa; identical to SEQ ID NO: 161790

SEQ ID NO: 740426 - RNA, 64 nt, hsa; identical to SEQ ID NO: 161791

SEQ ID NO: 740427 - RNA, 64 nt, hsa; identical to SEQ ID NO: 161792

SEQ ID NO: 740428 - RNA, 64 nt, hsa; identical to SEQ ID NO: 161793

SEQ ID NO: 740429 - RNA, 64 nt, hsa; identical to SEQ ID NO: 161794

SEQ ID NO: 740430 - RNA, 64 nt, hsa; identical to SEQ ID NO: 161795

SEQ ID NO: 740431 - RNA, 64 nt, hsa; identical to SEQ ID NO: 161796

SEQ ID NO: 740432 - RNA, 64 nt, hsa; identical to SEQ ID NO: 161797

SEQ ID NO: 740433 - RNA, 64 nt, hsa; identical to SEQ ID NO: 161798

SEQ ID NO: 740434 - RNA, 64 nt, hsa; identical to SEQ ID NO: 161799

SEQ ID NO: 740435 - RNA, 64 nt, hsa; identical to SEQ ID NO: 161800

SEQ ID NO: 740436 - RNA, 64 nt, hsa; identical to SEQ ID NO: 161801

SEQ ID NO: 740437 - RNA, 64 nt, hsa; identical to SEQ ID NO: 161802

SEQ ID NO: 740438 - RNA, 64 nt, hsa; identical to SEQ ID NO: 161803

SEQ ID NO: 740439 - RNA, 64 nt, hsa; identical to SEQ ID NO: 161804

SEQ ID NO: 740440 - RNA, 64 nt, hsa; identical to SEQ ID NO: 161805

SEQ ID NO: 740441 - RNA, 64 nt, hsa; identical to SEQ ID NO: 161806

SEQ ID NO: 740442 - RNA, 64 nt, hsa; identical to SEQ ID NO: 161807

SEQ ID NO: 740443 - RNA, 64 nt, hsa; identical to SEQ ID NO: 161808

SEQ ID NO: 740444 - RNA, 64 nt, hsa; identical to SEQ ID NO: 161809

SEQ ID NO: 740445 - RNA, 64 nt, hsa; identical to SEQ ID NO: 161810

SEQ ID NO: 740446 - RNA, 64 nt, hsa; identical to SEQ ID NO: 161811

SEQ ID NO: 740447 - RNA, 64 nt, hsa; identical to SEQ ID NO: 161812

SEQ ID NO: 740448 - RNA, 64 nt, hsa; identical to SEQ ID NO: 161813

SEQ ID NO: 740449 - RNA, 64 nt, hsa; identical to SEQ ID NO: 161814

SEQ ID NO: 740450 - RNA, 64 nt, hsa; identical to SEQ ID NO: 161815

SEQ ID NO: 740451 - RNA, 64 nt, hsa; identical to SEQ ID NO: 161816

SEQ ID NO: 740452 - RNA, 64 nt, hsa; identical to SEQ ID NO: 161817

SEQ ID NO: 740453 - RNA, 64 nt, hsa; identical to SEQ ID NO: 161818

SEQ ID NO: 740454 - RNA, 64 nt, hsa; identical to SEQ ID NO: 161819

SEQ ID NO: 740455 - RNA, 64 nt, hsa; identical to SEQ ID NO: 161820

SEQ ID NO: 740456 - RNA, 64 nt, hsa; identical to SEQ ID NO: 161821

SEQ ID NO: 740457 - RNA, 64 nt, hsa; identical to SEQ ID NO: 161822

SEQ ID NO: 740458 - RNA, 64 nt, hsa; identical to SEQ ID NO: 161823

SEQ ID NO: 740459 - RNA, 64 nt, hsa; identical to SEQ ID NO: 161824

SEQ ID NO: 740460 - RNA, 64 nt, hsa; identical to SEQ ID NO: 161825

SEQ ID NO: 740461 - RNA, 64 nt, hsa; identical to SEQ ID NO: 161826

SEQ ID NO: 740462 - RNA, 64 nt, hsa; identical to SEQ ID NO: 161827

SEQ ID NO: 740463 - RNA, 64 nt, hsa; identical to SEQ ID NO: 161828

SEQ ID NO: 740464 - RNA, 64 nt, hsa; identical to SEQ ID NO: 161829

SEQ ID NO: 740465 - RNA, 64 nt, hsa; identical to SEQ ID NO: 161830

SEQ ID NO: 740466 - RNA, 64 nt, hsa; identical to SEQ ID NO: 161831

SEQ ID NO: 740467 - RNA, 64 nt, hsa; identical to SEQ ID NO: 161832

SEQ ID NO: 740468 - RNA, 64 nt, hsa; identical to SEQ ID NO: 161833

SEQ ID NO: 740469 - RNA, 64 nt, hsa; identical to SEQ ID NO: 161834

SEQ ID NO: 740470 - RNA, 56 nt, hsa; identical to SEQ ID NO: 161835

SEQ ID NO: 740471 - RNA, 64 nt, hsa; identical to SEQ ID NO: 161836

SEQ ID NO: 740472 - RNA, 64 nt, hsa; identical to SEQ ID NO: 161837

SEQ ID NO: 740473 - RNA, 64 nt, hsa; identical to SEQ ID NO: 161838

SEQ ID NO: 740474 - RNA, 64 nt, hsa; identical to SEQ ID NO: 161839

SEQ ID NO: 740475 - RNA, 64 nt, hsa; identical to SEQ ID NO: 161840

SEQ ID NO: 740476 - RNA, 64 nt, hsa; identical to SEQ ID NO: 161841

SEQ ID NO: 740477 - RNA, 64 nt, hsa; identical to SEQ ID NO: 161842

SEQ ID NO: 740478 - RNA, 64 nt, hsa; identical to SEQ ID NO: 161843

SEQ ID NO: 740479 - RNA, 51 nt, hsa; identical to SEQ ID NO: 161844

SEQ ID NO: 740480 - RNA, 64 nt, hsa; identical to SEQ ID NO: 161845

SEQ ID NO: 740481 - RNA, 64 nt, hsa; identical to SEQ ID NO: 161846

SEQ ID NO: 740482 - RNA, 64 nt, hsa; identical to SEQ ID NO: 161847

SEQ ID NO: 740483 - RNA, 64 nt, hsa; identical to SEQ ID NO: 161848

SEQ ID NO: 740484 - RNA, 64 nt, hsa; identical to SEQ ID NO: 161849

SEQ ID NO: 740485 - RNA, 64 nt, hsa; identical to SEQ ID NO: 161850

SEQ ID NO: 740486 - RNA, 64 nt, hsa; identical to SEQ ID NO: 161851

SEQ ID NO: 740487 - RNA, 64 nt, hsa; identical to SEQ ID NO: 161852

SEQ ID NO: 740488 - RNA, 64 nt, hsa; identical to SEQ ID NO: 161853

SEQ ID NO: 740489 - RNA, 64 nt, hsa; identical to SEQ ID NO: 161854

SEQ ID NO: 740490 - RNA, 64 nt, hsa; identical to SEQ ID NO: 161855

SEQ ID NO: 740491 - RNA, 64 nt, hsa; identical to SEQ ID NO: 161856

SEQ ID NO: 740492 - RNA, 64 nt, hsa; identical to SEQ ID NO: 161857

SEQ ID NO: 740493 - RNA, 64 nt, hsa; identical to SEQ ID NO: 161858

SEQ ID NO: 740494 - RNA, 64 nt, hsa; identical to SEQ ID NO: 161859

SEQ ID NO: 740495 - RNA, 64 nt, hsa; identical to SEQ ID NO: 161860

SEQ ID NO: 740496 - RNA, 64 nt, hsa; identical to SEQ ID NO: 161861

SEQ ID NO: 740497 - RNA, 64 nt, hsa; identical to SEQ ID NO: 161862

SEQ ID NO: 740498 - RNA, 64 nt, hsa; identical to SEQ ID NO: 161863

SEQ ID NO: 740499 - RNA, 64 nt, hsa; identical to SEQ ID NO: 161864

SEQ ID NO: 740500 - RNA, 64 nt, hsa; identical to SEQ ID NO: 161865

SEQ ID NO: 740501 - RNA, 64 nt, hsa; identical to SEQ ID NO: 161866

SEQ ID NO: 740502 - RNA, 64 nt, hsa; identical to SEQ ID NO: 161867

SEQ ID NO: 740503 - RNA, 64 nt, hsa; identical to SEQ ID NO: 161868

SEQ ID NO: 740504 - RNA, 64 nt, hsa; identical to SEQ ID NO: 161869

SEQ ID NO: 740505 - RNA, 64 nt, hsa; identical to SEQ ID NO: 161870

SEQ ID NO: 740506 - RNA, 64 nt, hsa; identical to SEQ ID NO: 161871

SEQ ID NO: 740507 - RNA, 64 nt, hsa; identical to SEQ ID NO: 161872

SEQ ID NO: 740508 - RNA, 64 nt, hsa; identical to SEQ ID NO: 161873

SEQ ID NO: 740509 - RNA, 64 nt, hsa; identical to SEQ ID NO: 161874

SEQ ID NO: 740510 - RNA, 64 nt, hsa; identical to SEQ ID NO: 161875

SEQ ID NO: 740511 - RNA, 64 nt, hsa; identical to SEQ ID NO: 161876

SEQ ID NO: 740512 - RNA, 64 nt, hsa; identical to SEQ ID NO: 161877

SEQ ID NO: 740513 - RNA, 64 nt, hsa; identical to SEQ ID NO: 161878

SEQ ID NO: 740514 - RNA, 64 nt, hsa; identical to SEQ ID NO: 161879

SEQ ID NO: 740515 - RNA, 64 nt, hsa; identical to SEQ ID NO: 161880

SEQ ID NO: 740516 - RNA, 64 nt, hsa; identical to SEQ ID NO: 161881

SEQ ID NO: 740517 - RNA, 64 nt, hsa; identical to SEQ ID NO: 161882

SEQ ID NO: 740518 - RNA, 64 nt, hsa; identical to SEQ ID NO: 161883

SEQ ID NO: 740519 - RNA, 64 nt, hsa; identical to SEQ ID NO: 161884

SEQ ID NO: 740520 - RNA, 64 nt, hsa; identical to SEQ ID NO: 161885

SEQ ID NO: 740521 - RNA, 64 nt, hsa; identical to SEQ ID NO: 161886

SEQ ID NO: 740522 - RNA, 64 nt, hsa; identical to SEQ ID NO: 161887

SEQ ID NO: 740523 - RNA, 64 nt, hsa; identical to SEQ ID NO: 161888

SEQ ID NO: 740524 - RNA, 64 nt, hsa; identical to SEQ ID NO: 161889

SEQ ID NO: 740525 - RNA, 64 nt, hsa; identical to SEQ ID NO: 161890

SEQ ID NO: 740526 - RNA, 64 nt, hsa; identical to SEQ ID NO: 161891

SEQ ID NO: 740527 - RNA, 50 nt, hsa; identical to SEQ ID NO: 161892

SEQ ID NO: 740528 - RNA, 64 nt, hsa; identical to SEQ ID NO: 161893

SEQ ID NO: 740529 - RNA, 64 nt, hsa; identical to SEQ ID NO: 161894

SEQ ID NO: 740530 - RNA, 64 nt, hsa; identical to SEQ ID NO: 161895

SEQ ID NO: 740531 - RNA, 64 nt, hsa; identical to SEQ ID NO: 161896

SEQ ID NO: 740532 - RNA, 64 nt, hsa; identical to SEQ ID NO: 161897

SEQ ID NO: 740533 - RNA, 64 nt, hsa; identical to SEQ ID NO: 496488

SEQ ID NO: 740534 - RNA, 64 nt, hsa; identical to SEQ ID NO: 496489

SEQ ID NO: 740535 - RNA, 64 nt, hsa; identical to SEQ ID NO: 496490

SEQ ID NO: 740536 - RNA, 64 nt, hsa; identical to SEQ ID NO: 496491

SEQ ID NO: 740537 - RNA, 64 nt, hsa; identical to SEQ ID NO: 496492

SEQ ID NO: 740538 - RNA, 64 nt, hsa; identical to SEQ ID NO: 496493

SEQ ID NO: 740539 - RNA, 64 nt, hsa; identical to SEQ ID NO: 496494

SEQ ID NO: 740540 - RNA, 64 nt, hsa; identical to SEQ ID NO: 496495

SEQ ID NO: 740541 - RNA, 64 nt, hsa; identical to SEQ ID NO: 302562

SEQ ID NO: 740542 - RNA, 64 nt, hsa; identical to SEQ ID NO: 302563

SEQ ID NO: 740543 - RNA, 64 nt, hsa; identical to SEQ ID NO: 302564

SEQ ID NO: 740544 - RNA, 64 nt, hsa; identical to SEQ ID NO: 302565

SEQ ID NO: 740545 - RNA, 64 nt, hsa; identical to SEQ ID NO: 302566

SEQ ID NO: 740546 - RNA, 64 nt, hsa; identical to SEQ ID NO: 302567

SEQ ID NO: 740547 - RNA, 64 nt, hsa; identical to SEQ ID NO: 302568

SEQ ID NO: 740548 - RNA, 64 nt, hsa; identical to SEQ ID NO: 302569

SEQ ID NO: 740549 - RNA, 64 nt, hsa; identical to SEQ ID NO: 302570

SEQ ID NO: 740550 - RNA, 64 nt, hsa; identical to SEQ ID NO: 302571

SEQ ID NO: 740551 - RNA, 64 nt, hsa; identical to SEQ ID NO: 302572

SEQ ID NO: 740552 - RNA, 64 nt, hsa; identical to SEQ ID NO: 302573

SEQ ID NO: 740553 - RNA, 64 nt, hsa; identical to SEQ ID NO: 302574

SEQ ID NO: 740554 - RNA, 64 nt, hsa; identical to SEQ ID NO: 302575

SEQ ID NO: 740555 - RNA, 64 nt, hsa; identical to SEQ ID NO: 302576

SEQ ID NO: 740556 - RNA, 64 nt, hsa; identical to SEQ ID NO: 302577

SEQ ID NO: 740557 - RNA, 64 nt, hsa; identical to SEQ ID NO: 302578

SEQ ID NO: 740558 - RNA, 64 nt, hsa; identical to SEQ ID NO: 302579

SEQ ID NO: 740559 - RNA, 64 nt, hsa; identical to SEQ ID NO: 302580

SEQ ID NO: 740560 - RNA, 64 nt, hsa; identical to SEQ ID NO: 302581

SEQ ID NO: 740561 - RNA, 64 nt, hsa; identical to SEQ ID NO: 243769

SEQ ID NO: 740562 - RNA, 64 nt, hsa; identical to SEQ ID NO: 243770

SEQ ID NO: 740563 - RNA, 64 nt, hsa; identical to SEQ ID NO: 243771

SEQ ID NO: 740564 - RNA, 64 nt, hsa; identical to SEQ ID NO: 243772

SEQ ID NO: 740565 - RNA, 64 nt, hsa; identical to SEQ ID NO: 243773

SEQ ID NO: 740566 - RNA, 64 nt, hsa; identical to SEQ ID NO: 243774

SEQ ID NO: 740567 - RNA, 64 nt, hsa; identical to SEQ ID NO: 243775

SEQ ID NO: 740568 - RNA, 64 nt, hsa; identical to SEQ ID NO: 243776

SEQ ID NO: 740569 - RNA, 64 nt, hsa; identical to SEQ ID NO: 243777

SEQ ID NO: 740570 - RNA, 64 nt, hsa; identical to SEQ ID NO: 243778

SEQ ID NO: 740571 - RNA, 64 nt, hsa; identical to SEQ ID NO: 243779

SEQ ID NO: 740572 - RNA, 64 nt, hsa; identical to SEQ ID NO: 243780

SEQ ID NO: 740573 - RNA, 64 nt, hsa; identical to SEQ ID NO: 243781

SEQ ID NO: 740574 - RNA, 64 nt, hsa; identical to SEQ ID NO: 243782

SEQ ID NO: 740575 - RNA, 64 nt, hsa; identical to SEQ ID NO: 243783

SEQ ID NO: 740576 - RNA, 64 nt, hsa; identical to SEQ ID NO: 243784

SEQ ID NO: 740577 - RNA, 64 nt, hsa; identical to SEQ ID NO: 243785

SEQ ID NO: 740578 - RNA, 64 nt, hsa; identical to SEQ ID NO: 243786

SEQ ID NO: 740579 - RNA, 64 nt, hsa; identical to SEQ ID NO: 243787

SEQ ID NO: 740580 - RNA, 64 nt, hsa; identical to SEQ ID NO: 243788

SEQ ID NO: 740581 - RNA, 64 nt, hsa; identical to SEQ ID NO: 243789

SEQ ID NO: 740582 - RNA, 64 nt, hsa; identical to SEQ ID NO: 243790

SEQ ID NO: 740583 - RNA, 64 nt, hsa; identical to SEQ ID NO: 243791

SEQ ID NO: 740584 - RNA, 64 nt, hsa; identical to SEQ ID NO: 243792

SEQ ID NO: 740585 - RNA, 64 nt, hsa; identical to SEQ ID NO: 243793

SEQ ID NO: 740586 - RNA, 64 nt, hsa; identical to SEQ ID NO: 243794

SEQ ID NO: 740587 - RNA, 64 nt, hsa; identical to SEQ ID NO: 243795

SEQ ID NO: 740588 - RNA, 64 nt, hsa; identical to SEQ ID NO: 243796

SEQ ID NO: 740589 - RNA, 64 nt, hsa; identical to SEQ ID NO: 243797

SEQ ID NO: 740590 - RNA, 64 nt, hsa; identical to SEQ ID NO: 243798

SEQ ID NO: 740591 - RNA, 64 nt, hsa; identical to SEQ ID NO: 243799

SEQ ID NO: 740592 - RNA, 64 nt, hsa; identical to SEQ ID NO: 243800

SEQ ID NO: 740593 - RNA, 64 nt, hsa; identical to SEQ ID NO: 243801

SEQ ID NO: 740594 - RNA, 64 nt, hsa; identical to SEQ ID NO: 243802

SEQ ID NO: 740595 - RNA, 64 nt, hsa; identical to SEQ ID NO: 243803

SEQ ID NO: 740596 - RNA, 64 nt, hsa; identical to SEQ ID NO: 243804

SEQ ID NO: 740597 - RNA, 64 nt, hsa; identical to SEQ ID NO: 243805

SEQ ID NO: 740598 - RNA, 64 nt, hsa; identical to SEQ ID NO: 243806

SEQ ID NO: 740599 - RNA, 64 nt, hsa; identical to SEQ ID NO: 243807

SEQ ID NO: 740600 - RNA, 64 nt, hsa; identical to SEQ ID NO: 243808

SEQ ID NO: 740601 - RNA, 64 nt, hsa; identical to SEQ ID NO: 243809

SEQ ID NO: 740602 - RNA, 64 nt, hsa; identical to SEQ ID NO: 243810

SEQ ID NO: 740603 - RNA, 64 nt, hsa; identical to SEQ ID NO: 243811

SEQ ID NO: 740604 - RNA, 64 nt, hsa; identical to SEQ ID NO: 243812

SEQ ID NO: 740605 - RNA, 64 nt, hsa; identical to SEQ ID NO: 243813

SEQ ID NO: 740606 - RNA, 64 nt, hsa; identical to SEQ ID NO: 243814

SEQ ID NO: 740607 - RNA, 64 nt, hsa; identical to SEQ ID NO: 243815

SEQ ID NO: 740608 - RNA, 64 nt, hsa; identical to SEQ ID NO: 243816

SEQ ID NO: 740609 - RNA, 64 nt, hsa; identical to SEQ ID NO: 243817

SEQ ID NO: 740610 - RNA, 64 nt, hsa; identical to SEQ ID NO: 243818

SEQ ID NO: 740611 - RNA, 64 nt, hsa; identical to SEQ ID NO: 243819

SEQ ID NO: 740612 - RNA, 64 nt, hsa; identical to SEQ ID NO: 243820

SEQ ID NO: 740613 - RNA, 64 nt, hsa; identical to SEQ ID NO: 243821

SEQ ID NO: 740614 - RNA, 64 nt, hsa; identical to SEQ ID NO: 243822

SEQ ID NO: 740615 - RNA, 64 nt, hsa; identical to SEQ ID NO: 243823

SEQ ID NO: 740616 - RNA, 64 nt, hsa; identical to SEQ ID NO: 243824

SEQ ID NO: 740617 - RNA, 64 nt, hsa; identical to SEQ ID NO: 243825

SEQ ID NO: 740618 - RNA, 64 nt, hsa
ccuguagacuauuuuuacuaaggugcuuuauaauguguuuuaaagcauugcauuuacaaaacaa

SEQ ID NO: 740619 - RNA, 64 nt, hsa
ugauauaaauuuguguuugauaaauauccucucaguguuuuaucuuccauguuucaacaacuau

SEQ ID NO: 740620 - RNA, 64 nt, hsa
acaaccugcucucuguacugcuguuggacagucaguguuuuaauguuucuacaguuuugcuauu

SEQ ID NO: 740621 - RNA, 64 nt, hsa
gugugugagagugugcgcgcgcguguguguguguguguuuuaauggaguguugccuugaaugaa

SEQ ID NO: 740622 - RNA, 64 nt, hsa
auuuuguuuuccaccaggcagggaguagggcuuaguguuuuaaaacaccucugcuuucugaugu

SEQ ID NO: 740623 - RNA, 64 nt, hsa
gcacacacaaaauaaaucagugggauuugguaauguguuuuagaguaagaaauuucagguuguu

SEQ ID NO: 740624 - RNA, 64 nt, hsa
gugcagcauucaaaaucaccccuagaaaaagugaguguuuuaaugagacuuccuaggaagggau

SEQ ID NO: 740625 - RNA, 64 nt, hsa
guggcaauauauugacucaggaucucaaagcuggguguuuuagcauuacuguguaaagacuuga

SEQ ID NO: 740626 - RNA, 64 nt, hsa
ccacugcaccuggcccagaugauauaauuuaacuguguuuuagguaacauguuaaugagggaaa

SEQ ID NO: 740627 - RNA, 64 nt, hsa
caguguagcauuggaucaaaaaguuuaucacacaguguuuuaauaaaugguuuauucugcuuac

SEQ ID NO: 740628 - RNA, 64 nt, hsa
ugaacaacugaauguauaaaaaaauuauaaacugguguuuuaacuaguauugcaauaagcaaau

SEQ ID NO: 740629 - RNA, 64 nt, hsa
ugauguuugugaucucuaacucaaaaaauuugaaguguuuuaaguuguuucuggguaagggaga

SEQ ID NO: 740630 - RNA, 64 nt, hsa
uaaaguaucauguauuaaaauguuuagacagcauguguuuuaaagugauaaaugcaaaauguua

SEQ ID NO: 740631 - RNA, 64 nt, hsa
uaggggaaaaccuacuuuaaaguaugguaaauguguguuuuaaacuuccuaucaagugacauac

SEQ ID NO: 740632 - RNA, 64 nt, hsa
ccacaugacuuuuuccucuaaaaacuggauccuaguguuuuaauuaccugugugcagcuauuuu

SEQ ID NO: 740633 - RNA, 64 nt, hsa
gacauaacucauuuuucuaguuuuugacaauuguguguuuuagugucuagucugcagagagcug

SEQ ID NO: 740634 - RNA, 64 nt, hsa
gaagauaauuaaaggauguuaucauaggcuauauguguuuuacuuauucagacugauaaucaua

SEQ ID NO: 740635 - RNA, 64 nt, hsa
aggcaauuuagucauuaugauaauaaggaaaacaguguuuuagaugagagaucauuaaugcauu

SEQ ID NO: 740636 - RNA, 64 nt, hsa
ccaggucugcgucccuaaccccuuccccagcuugguguuuuaccccgaaacaggaaggaacagg

SEQ ID NO: 740637 - RNA, 64 nt, hsa
aggucgcagcaaauggcuucagccugggacgccaguguuuuaugcucuuaguucaguaaaauac

SEQ ID NO: 740638 - RNA, 64 nt, hsa
aaaguucuuauugcacugguuuauauguguauguguguuuuauuguguguuuuuuuaauuugua

SEQ ID NO: 740639 - RNA, 64 nt, hsa
uggagggggaaguuuaugaauauaauauagcucuguguuuuaaaccucagaaacagauuugagu

SEQ ID NO: 740640 - RNA, 64 nt, hsa
guugaaauuuaaaacguguuucuagguugaccuuguguuuuagaaauuugcacuuaauggaauu

SEQ ID NO: 740641 - RNA, 64 nt, hsa
guacuuugaucucuccacaucacuuauaacuuauguguuuuauuucuccaagugcgguguuccu

SEQ ID NO: 740642 - RNA, 64 nt, hsa
ugaccagaugcgucccaagauguugauuuuuacuguguuuuauaaaauagaguguaguuuacag

SEQ ID NO: 740643 - RNA, 64 nt, hsa
aacaagugaaagcauauggguuagauguugccauguguuuuagaugguuucuugcaagcaugcu

SEQ ID NO: 740644 - RNA, 64 nt, hsa
uuuucaauugcuaucuuuugaaaggcaccaguauguguuuuagauugauuucccuguuucaggg

SEQ ID NO: 740645 - RNA, 64 nt, hsa
gaguuaacaacuaguugagcagucagcuuccuaaguguuuuaggacauuuguucauuauauuuu

SEQ ID NO: 740646 - RNA, 64 nt, hsa
ugucaacaaguagaaccucaguuugcuaacugaaguguuuuauuaguauuuuacucuaguggug

SEQ ID NO: 740647 - RNA, 64 nt, hsa
ccagagaaugcaguagaccuuuugccacucaucuguguuuuacuugagacauguaaauaugaua

SEQ ID NO: 740648 - RNA, 64 nt, hsa
uucauccaauaauucaagccaagcaaguauauagguguuuuaauaguuuuuguuugcaguccuc

SEQ ID NO: 740649 - RNA, 64 nt, hsa
agucacugaaguggaaacuaagaaguggcaguuaguguuuuacccagcauuucugccuucucuc

SEQ ID NO: 740650 - RNA, 64 nt, hsa
uccauuacucuuuuuauuggcucuugcagguuuuguguuuuaucaucagugcuuuuagaaaugc

SEQ ID NO: 740651 - RNA, 64 nt, hsa
auauuucaccacgguaucauguacuucauggccaguguuuuaucucagcagggaacuacgccaa

SEQ ID NO: 740652 - RNA, 64 nt, hsa
aaaauuccaggugugccgcacccacuuucucgcaguguuuuaauauuguguggaguugucgaua

SEQ ID NO: 740653 - RNA, 64 nt, hsa
gcugggauuacaggcaugagccaccgcgcccaguguguuuuaagcaugaggcauccgcguggcu

SEQ ID NO: 740654 - RNA, 64 nt, hsa
cuuugcuauuuuucccuuuugggaaaacaaugaaguguuuuaaguccuggguggacugagagau

SEQ ID NO: 740655 - RNA, 64 nt, hsa
uuuaaucauguaauauauacaauuuaauguccuaguguuuuacuuaauaguguaucauguuuuc

SEQ ID NO: 740656 - RNA, 64 nt, hsa
gcucuggaaauucguuaauguauuugaugucuuaguguuuuagugacuagggagaccauuaacu

SEQ ID NO: 740657 - RNA, 64 nt, hsa
acaguggccuugcuucuuagacggucuucacuguguguuuuaaaacaacaacaacaacaacaac

SEQ ID NO: 740658 - RNA, 64 nt, hsa
aaaaaccugcaaagaugaugugagauuuuuucuuguguuuuaauuauuuucacauuuucucucu

SEQ ID NO: 740659 - RNA, 64 nt, hsa
acgugcauacacauucuuuucuuaaacuuuaccuguguuuuaacuaauauugugucaguguauu

SEQ ID NO: 740660 - RNA, 64 nt, hsa
uugcuaccaaguaggaaaaaaaauguacauggcaguguuuuaguuggcaauauaaucuuugaau

SEQ ID NO: 740661 - RNA, 64 nt, hsa
gaaagauagagauuguuuuuagagguugguuguuguguuuuaggauucuguccauuuucuuuua

SEQ ID NO: 740662 - RNA, 64 nt, hsa; identical to SEQ ID NO: 740658

SEQ ID NO: 740663 - RNA, 64 nt, hsa; identical to SEQ ID NO: 740659

SEQ ID NO: 740664 - RNA, 64 nt, hsa
aaaaaaauccuuuucaauccugagaaaauuaaagguguuuuacucacauggauauuucaacauu

SEQ ID NO: 740665 - RNA, 64 nt, hsa; identical to SEQ ID NO: 565539

SEQ ID NO: 740666 - RNA, 64 nt, hsa; identical to SEQ ID NO: 565540

SEQ ID NO: 740667 - RNA, 64 nt, hsa; identical to SEQ ID NO: 565541

SEQ ID NO: 740668 - RNA, 64 nt, hsa; identical to SEQ ID NO: 565542

SEQ ID NO: 740669 - RNA, 64 nt, hsa; identical to SEQ ID NO: 565543

SEQ ID NO: 740670 - RNA, 64 nt, hsa; identical to SEQ ID NO: 565544

SEQ ID NO: 740671 - RNA, 64 nt, hsa; identical to SEQ ID NO: 565545

SEQ ID NO: 740672 - RNA, 64 nt, hsa; identical to SEQ ID NO: 565546

SEQ ID NO: 740673 - RNA, 64 nt, hsa; identical to SEQ ID NO: 565547

SEQ ID NO: 740674 - RNA, 64 nt, hsa; identical to SEQ ID NO: 565548

SEQ ID NO: 740675 - RNA, 64 nt, hsa; identical to SEQ ID NO: 565549

SEQ ID NO: 740676 - RNA, 64 nt, hsa; identical to SEQ ID NO: 565550

SEQ ID NO: 740677 - RNA, 64 nt, hsa; identical to SEQ ID NO: 565551

SEQ ID NO: 740678 - RNA, 64 nt, hsa; identical to SEQ ID NO: 565552

SEQ ID NO: 740679 - RNA, 64 nt, hsa; identical to SEQ ID NO: 565553

SEQ ID NO: 740680 - RNA, 64 nt, hsa; identical to SEQ ID NO: 565554

SEQ ID NO: 740681 - RNA, 64 nt, hsa; identical to SEQ ID NO: 565555

SEQ ID NO: 740682 - RNA, 64 nt, hsa; identical to SEQ ID NO: 565556

SEQ ID NO: 740683 - RNA, 64 nt, hsa; identical to SEQ ID NO: 565557

SEQ ID NO: 740684 - RNA, 64 nt, hsa; identical to SEQ ID NO: 565558

SEQ ID NO: 740685 - RNA, 64 nt, hsa; identical to SEQ ID NO: 565559

SEQ ID NO: 740686 - RNA, 64 nt, hsa; identical to SEQ ID NO: 565560

SEQ ID NO: 740687 - RNA, 64 nt, hsa; identical to SEQ ID NO: 244630

SEQ ID NO: 740688 - RNA, 64 nt, hsa; identical to SEQ ID NO: 244631

SEQ ID NO: 740689 - RNA, 64 nt, hsa; identical to SEQ ID NO: 244632

SEQ ID NO: 740690 - RNA, 64 nt, hsa; identical to SEQ ID NO: 244633

SEQ ID NO: 740691 - RNA, 64 nt, hsa; identical to SEQ ID NO: 244634

SEQ ID NO: 740692 - RNA, 64 nt, hsa; identical to SEQ ID NO: 244635

SEQ ID NO: 740693 - RNA, 64 nt, hsa; identical to SEQ ID NO: 244636

SEQ ID NO: 740694 - RNA, 64 nt, hsa; identical to SEQ ID NO: 244637

SEQ ID NO: 740695 - RNA, 64 nt, hsa; identical to SEQ ID NO: 244638

SEQ ID NO: 740696 - RNA, 64 nt, hsa; identical to SEQ ID NO: 244639

SEQ ID NO: 740697 - RNA, 64 nt, hsa; identical to SEQ ID NO: 244640

SEQ ID NO: 740698 - RNA, 64 nt, hsa; identical to SEQ ID NO: 244641

SEQ ID NO: 740699 - RNA, 64 nt, hsa; identical to SEQ ID NO: 244642

SEQ ID NO: 740700 - RNA, 64 nt, hsa; identical to SEQ ID NO: 244643

SEQ ID NO: 740701 - RNA, 64 nt, hsa; identical to SEQ ID NO: 244644

SEQ ID NO: 740702 - RNA, 64 nt, hsa; identical to SEQ ID NO: 244645

SEQ ID NO: 740703 - RNA, 64 nt, hsa; identical to SEQ ID NO: 244646

SEQ ID NO: 740704 - RNA, 64 nt, hsa; identical to SEQ ID NO: 244647

SEQ ID NO: 740705 - RNA, 64 nt, hsa; identical to SEQ ID NO: 244648

SEQ ID NO: 740706 - RNA, 64 nt, hsa; identical to SEQ ID NO: 244649

SEQ ID NO: 740707 - RNA, 64 nt, hsa; identical to SEQ ID NO: 244650

SEQ ID NO: 740708 - RNA, 64 nt, hsa; identical to SEQ ID NO: 244651

SEQ ID NO: 740709 - RNA, 64 nt, hsa; identical to SEQ ID NO: 244652

SEQ ID NO: 740710 - RNA, 64 nt, hsa; identical to SEQ ID NO: 244653

SEQ ID NO: 740711 - RNA, 64 nt, hsa; identical to SEQ ID NO: 244654

SEQ ID NO: 740712 - RNA, 64 nt, hsa; identical to SEQ ID NO: 244655

SEQ ID NO: 740713 - RNA, 64 nt, hsa; identical to SEQ ID NO: 244656

SEQ ID NO: 740714 - RNA, 64 nt, hsa; identical to SEQ ID NO: 244657

SEQ ID NO: 740715 - RNA, 64 nt, hsa; identical to SEQ ID NO: 244658

SEQ ID NO: 740716 - RNA, 64 nt, hsa; identical to SEQ ID NO: 244659

SEQ ID NO: 740717 - RNA, 64 nt, hsa; identical to SEQ ID NO: 244660

SEQ ID NO: 740718 - RNA, 64 nt, hsa; identical to SEQ ID NO: 244661

SEQ ID NO: 740719 - RNA, 64 nt, hsa; identical to SEQ ID NO: 244662

SEQ ID NO: 740720 - RNA, 64 nt, hsa; identical to SEQ ID NO: 244663

SEQ ID NO: 740721 - RNA, 64 nt, hsa
aaagcugagauguuuuuucuugguucuggcugccaacugugaguuaaaacucaaggcuuguugu

SEQ ID NO: 740722 - RNA, 64 nt, hsa
agguuuaaagccuaccaguguaaccuaccaguacaacugugaauccuaggcaaggcaaaaaugc

SEQ ID NO: 740723 - RNA, 64 nt, hsa
cuugccgcaucacuuaaugugauccccauacugcaacugugaugcugaugaugcuaauggagau

SEQ ID NO: 740724 - RNA, 64 nt, hsa
uaacuggaauugagaugaaggccagugacaugacaacugugaccuaagaaaugggaagauuauc

SEQ ID NO: 740725 - RNA, 64 nt, hsa
caaggagguuacauguuuuccaacauauccuaaaaacugugauauaagcuaacauauaauuugc

SEQ ID NO: 740726 - RNA, 64 nt, hsa
acccuuuugugaagaucacagcauuuaucuaagaaacugugaggcuuucugguuuacauauauc

SEQ ID NO: 740727 - RNA, 64 nt, hsa
uugaguuaguuuauagugcuaauagauucuauauaacugugagaguuugguaguaaaccaguag

SEQ ID NO: 740728 - RNA, 64 nt, hsa
aaagcauuuagucagucccccaaacagucaugccaacugugaaggaaugucccacaaaacauuu

SEQ ID NO: 740729 - RNA, 64 nt, hsa
guuuuaugacuaauccuuaauaacuaugguaaauaacugugacugugggguuuuuaaucucuug

SEQ ID NO: 740730 - RNA, 64 nt, hsa
agcacaauauuaaguguuguacaauuacugugagaacugugaauauguguaacuuuuuuuuagu

SEQ ID NO: 740731 - RNA, 64 nt, hsa
gacuuaaaugaccuggauugaucagagagaauugaacugugaccuuuaagacuucuagacuaau

SEQ ID NO: 740732 - RNA, 64 nt, hsa
gauagagauucauuuagucaaagacaaaagcuuuaacugugagggcacagccuugaagugggag

SEQ ID NO: 740733 - RNA, 64 nt, hsa
cagaaggaaauuauuuagguuguaaugcacaggcaacugugagaaacuguugugccaaaaauag

SEQ ID NO: 740734 - RNA, 64 nt, hsa
caacagggggaagaaaauggagauuuaauccuaaaacugugacuuggggaggucagucauuuac

SEQ ID NO: 740735 - RNA, 64 nt, hsa
uggaaccuccugaucaguuugaaggacauugauaaacugugauuuuacaauaacauuaucaucu

SEQ ID NO: 740736 - RNA, 64 nt, hsa
aaugccuacauugagugcuuaaaaaaaaaaaaacaacugugaugaugugagcagaauggcaagu

SEQ ID NO: 740737 - RNA, 64 nt, hsa
uaaaggcuguaauuggagcagcuuuuggcugcguaacugugaacuauggccauauauaauuuuu

SEQ ID NO: 740738 - RNA, 64 nt, hsa
cucuguugagagcauuucagccagaggacuuuggaacugugaauauacuuccugaaggggaggg

SEQ ID NO: 740739 - RNA, 64 nt, hsa
gcacauuuugggaaguugcauuccuuugucuucaaacugugaagcauuuacagaaacgcaucca

SEQ ID NO: 740740 - RNA, 64 nt, hsa
gguagcacuugcuacccugaguucauccaggcccaacugugagcaaggagcacaagccacaagu

SEQ ID NO: 740741 - RNA, 64 nt, hsa
augccagccaucacucacugccaccugggccaucaacugugaauucucagcaccaguugccuuu

SEQ ID NO: 740742 - RNA, 64 nt, hsa
uggcaccugcuccauucugcccuacaugauggguaacugugaucuuucuucccuguuagauugu

SEQ ID NO: 740743 - RNA, 64 nt, hsa
uugucagacacccaguguccuccugcaaggacgcaacugugagcugaggugugagccuaggagc

SEQ ID NO: 740744 - RNA, 64 nt, hsa
caggaaucaaggauagggcuaagguuuucaccuuaacugugaaggcaggaggaauaggugacug

SEQ ID NO: 740745 - RNA, 64 nt, hsa
uggucuuuauaacuuuacugaacaagagggaagcaacugugaugggaagagauuaccuagccuu

SEQ ID NO: 740746 - RNA, 64 nt, hsa
uuucuuuugauguugcaacuuuuggguucuuuuaaacugugauagugaugguaacugaugccuu

SEQ ID NO: 740747 - RNA, 64 nt, hsa
auuugugaucgguaggcaguucagagcauaaguuaacugugaaaaaaauguaaagguuuuauuu

SEQ ID NO: 740748 - RNA, 64 nt, hsa
cgccaucagccuggaugggcauaaguagauaaauaacugugagcucgcacaaccgaaagggccu

SEQ ID NO: 740749 - RNA, 64 nt, hsa
ggcugggcugcugcgacacaggcagcgcuuuguaaacugugaagccauauacgugaaacugaag

SEQ ID NO: 740750 - RNA, 64 nt, hsa
caguacauuuuuguuuaauguugggccugagguuaacugugaccaugguccagcuugaguggcu

SEQ ID NO: 740751 - RNA, 64 nt, hsa
ugcaaauugugcuuucugauggacaagaccucauaacugugauuaauaucaauaaaaaggggau

SEQ ID NO: 740752 - RNA, 64 nt, hsa
agauugacauuauugaaggaaaggggaugaggacaacugugaacucacagugagcccuguggaa

SEQ ID NO: 740753 - RNA, 64 nt, hsa
aucaauuauucugaugcugggacaggugagaagaaacugugaaguauaugagccuuugaaaguu

SEQ ID NO: 740754 - RNA, 64 nt, hsa
cuagcauucaacagagaacucugucuuaagcuucaacugugaaaaugaugacgggcuuguagca

SEQ ID NO: 740755 - RNA, 64 nt, hsa
uugauucuuucaauccacaguauuguucuuguaaaacugugacauuccacagaguuacugccac

SEQ ID NO: 740756 - RNA, 64 nt, hsa
cuuuuaaaaaaauaauauaaaugaaugaaauauaaacugugagauaaauaucauuauagcaugu

SEQ ID NO: 740757 - RNA, 64 nt, hsa
ugaaucacaucauccacuuuaucccagaaacuagaacugugagaaaccagguuuagaagacagu

SEQ ID NO: 740758 - RNA, 64 nt, hsa
ugugaggaguuacuuuauguacguugcauauucaaacugugauguuuuauccuucaaaacaauc

SEQ ID NO: 740759 - RNA, 64 nt, hsa
cagcacaguacucaggcagugcaauacucagugcgguacucaguaacacagugcaguacucagu

SEQ ID NO: 740760 - RNA, 64 nt, hsa
caguaauacaguacaguacucaguaaggcaguaugguacucaguaaagcaaugcaaugcucagu

SEQ ID NO: 740761 - RNA, 64 nt, hsa
acacccguucccacgucagaggagggcaaggcuggguacucagcagccacucugagccggggcu

SEQ ID NO: 740762 - RNA, 64 nt, hsa
aaauccaccugucuccaucuuccuugccugccuggguacucaugccaagcagagacugggauua

SEQ ID NO: 740763 - RNA, 63 nt, hsa
ccacacuguacucugcacuggugugagggccccugccuggacugugggacccuccuggugcug

SEQ ID NO: 740764 - RNA, 63 nt, hsa
ccuccccaugugaacauggggaacuucgggcccugccuggaguccuugaccgcucucuguggg

SEQ ID NO: 740765 - RNA, 63 nt, hsa
gcaggaucugccauaaaggacaauaugaacugaugccuggacuaucaguaaccccacugcaca

SEQ ID NO: 740766 - RNA, 63 nt, hsa
gcacaggcacacgaugcucugggacauaacuggugccuggaaaucaccaugguccucauaucu

SEQ ID NO: 740767 - RNA, 63 nt, hsa
aaccuguguccgguauucgauacugcgacuuucugccuggaguguaugacugcacaugacucg

SEQ ID NO: 740768 - RNA, 63 nt, hsa
gugcugggagcuccacucugcuucucugacuucugccuggagacuuagggcaccagggguuuc

SEQ ID NO: 740769 - RNA, 63 nt, hsa
agccccuggacacacacacacagacacacacacugccuggaugcauguaugcacacacaugcg

SEQ ID NO: 740770 - RNA, 63 nt, hsa
aacauacacacgcacacccaugcgcagaugugcugccuggacacacacacacacacggauaug

SEQ ID NO: 740771 - RNA, 63 nt, hsa
augguauccggacacacacgugcacagauaugcugccuggacacacagauaaugcugccuuga

SEQ ID NO: 740772 - RNA, 63 nt, hsa
uaaugcugccuugacacacacaugcacggauauugccuggacacacacacacacacgugugca

SEQ ID NO: 740773 - RNA, 63 nt, hsa
gcugucuggacacgcacacacaugcagauaugcugccuggacacacacuuccagacacacgug

SEQ ID NO: 740774 - RNA, 63 nt, hsa
cuuccagacacacgugcacaggcgcagauaugcugccuggacacacgcagauaugcugucuag

SEQ ID NO: 740775 - RNA, 63 nt, hsa
gcuguccggacacacacacgcacgcagauaugcugccuggacacacacacagauaaugcugcc

SEQ ID NO: 740776 - RNA, 63 nt, hsa
augcugccucaacacucacacacgugcagauauugccuggacacacacaugugcacagauaug

SEQ ID NO: 740777 - RNA, 63 nt, hsa
cggacacacaugcacacacaggugcagauaugcugccuggacacacgcagacugacgugcuuu

SEQ ID NO: 740778 - RNA, 63 nt, hsa
gcuccucacaccacagccaggagagaccuuuucugccuggagagaaacuuucagaccagcccc

SEQ ID NO: 740779 - RNA, 63 nt, hsa
gccccacacaccacagccaggagaggccguuccugccuggagagaagcuuccagaccagcccu

SEQ ID NO: 740780 - RNA, 63 nt, hsa
cagaaccugcccugcaggcuguagggggcauggugccuggagcugaggggcauccgaacgcgu

SEQ ID NO: 740781 - RNA, 63 nt, hsa
ucaggggucaucuggcaaacagccccugggcugugccuggaucccccucuagcuccugcucac

SEQ ID NO: 740782 - RNA, 63 nt, hsa
ccuccaggagcaggccuggugcagcccacucugugccuggacaucccccgcaggccgccgcgu

SEQ ID NO: 740783 - RNA, 63 nt, hsa
ccauucccgcuccuggaacacuuccugcagcugugccuggaggcagucggccugcagugccag

SEQ ID NO: 740784 - RNA, 63 nt, hsa
acagagagggguccaaauggugaaugcucauccugccuggauucaaggaauuagcucagagau

SEQ ID NO: 740785 - RNA, 63 nt, hsa
ugaucuuagggauuuccaaaguaaccugcuuuuugccuggauaggguuaaaauagaccuuucu

SEQ ID NO: 740786 - RNA, 63 nt, hsa
gcaguggggggacucgacccccugacauggggcugccuggagcaggccgcgugacguggggcu

SEQ ID NO: 740787 - RNA, 63 nt, hsa
uaaaauaauggaaaauuuuaacaauuuguauagugccuggaucauuacuagugccauaacccu

SEQ ID NO: 740788 - RNA, 63 nt, hsa
ccuuuucuuuuuuuacgcauagcuccgucaagcugccuggaugagcgcccaugcagcaaggcu

SEQ ID NO: 740789 - RNA, 63 nt, hsa
ucccugugagaguucugcagagugcugggcaugugccuggaacuaccgaguaggagccauuuc

SEQ ID NO: 740790 - RNA, 63 nt, hsa
cuucgaucucacacacacagaaacauacauucgugccuggagacccugcaggccagaguccaa

SEQ ID NO: 740791 - RNA, 63 nt, hsa
agucagccaguugguugcugugguuacagccagugccuggaauuccuccuuagggcccuggga

SEQ ID NO: 740792 - RNA, 53 nt, hsa; identical to SEQ ID NO: 332978

SEQ ID NO: 740793 - RNA, 63 nt, hsa
aacugaauggcgucuguccugucauccauauggugccuggaaauauuuaccagucaaggucaa

SEQ ID NO: 740794 - RNA, 63 nt, hsa
gccuguccuccaggcuggggcagguucuuaguuugccuggaauuguucuguaccucuuuguag

SEQ ID NO: 740795 - RNA, 63 nt, hsa
cuccaaccaccacacacucccugcuguuuucccugccuggaacuuucccuccugccccaccaa

SEQ ID NO: 740796 - RNA, 63 nt, hsa
uggcucuaacauuacugccuucaguaucaaggcugccuggagaaaggauggcagccucagggc

SEQ ID NO: 740797 - RNA, 63 nt, hsa
acauucauucaacagcugaugcccuauaaccccugccuggauuucuuccuauuaggcuauaag

SEQ ID NO: 740798 - RNA, 63 nt, hsa
cagcccgacuggaucgccaucugcuacaacaacugccuggagauacucagaguguaguguugg

SEQ ID NO: 740799 - RNA, 63 nt, hsa
ccucccucuuugcaccuucuucucuucccucagugccuggagcugguacugggccccuggccc

SEQ ID NO: 740800 - RNA, 63 nt, hsa
cgagacaugaauacuauccauguaauaagcacuugccuggaauaaaauauaaaacugaaauaa

SEQ ID NO: 740801 - RNA, 63 nt, hsa
uugguuccuuggggggccaaagaaggcagggaaugccuggaggguaacuggggggccaccaug

SEQ ID NO: 740802 - RNA, 63 nt, hsa
aaaaaagaaagaaagaaaaggaaacccaagagcugccuggacacacggaaacccaacugagaa

SEQ ID NO: 740803 - RNA, 63 nt, hsa
gagccaagggaacccagaugacacccuugcccaugccuggaccuugcuucuggccagggaggg

SEQ ID NO: 740804 - RNA, 63 nt, hsa
cucugcagaucagaacaacggaggauagcuuugugccuggacccagagagugugggacucccc

SEQ ID NO: 740805 - RNA, 63 nt, hsa
cugacccucgucuuuguggcagcaaaaccaggaugccuggagcuguggccugagggccugcug

SEQ ID NO: 740806 - RNA, 63 nt, hsa
ccgaguagcagggauuaccggugugcaccaccaugccuggauaacuuuuuuuuuuauuucuau

SEQ ID NO: 740807 - RNA, 63 nt, hsa
uaccacccuaacguggacacccaggguaacauaugccuggacauccugaaggagaaguggucu

SEQ ID NO: 740808 - RNA, 63 nt, hsa
cacugcuaccuuaugugagcccucauugccucuugccuggauuauagccggggucuccuuccu

SEQ ID NO: 740809 - RNA, 63 nt, hsa
auacauuuucccacuuaugugccuuuguaccugugccuggaacccuccucuucuuuuucuuuu

SEQ ID NO: 740810 - RNA, 64 nt, hsa; identical to SEQ ID NO: 91745

SEQ ID NO: 740811 - RNA, 64 nt, hsa; identical to SEQ ID NO: 91746

SEQ ID NO: 740812 - RNA, 64 nt, hsa; identical to SEQ ID NO: 91747

SEQ ID NO: 740813 - RNA, 64 nt, hsa; identical to SEQ ID NO: 91748

SEQ ID NO: 740814 - RNA, 64 nt, hsa; identical to SEQ ID NO: 91749

SEQ ID NO: 740815 - RNA, 64 nt, hsa; identical to SEQ ID NO: 91750

SEQ ID NO: 740816 - RNA, 64 nt, hsa; identical to SEQ ID NO: 91751

SEQ ID NO: 740817 - RNA, 64 nt, hsa; identical to SEQ ID NO: 91752

SEQ ID NO: 740818 - RNA, 64 nt, hsa; identical to SEQ ID NO: 91753

SEQ ID NO: 740819 - RNA, 64 nt, hsa; identical to SEQ ID NO: 91754

SEQ ID NO: 740820 - RNA, 64 nt, hsa; identical to SEQ ID NO: 91755

SEQ ID NO: 740821 - RNA, 64 nt, hsa; identical to SEQ ID NO: 91756

SEQ ID NO: 740822 - RNA, 64 nt, hsa; identical to SEQ ID NO: 91757

SEQ ID NO: 740823 - RNA, 64 nt, hsa; identical to SEQ ID NO: 91758

SEQ ID NO: 740824 - RNA, 64 nt, hsa; identical to SEQ ID NO: 91759

SEQ ID NO: 740825 - RNA, 64 nt, hsa; identical to SEQ ID NO: 91760

SEQ ID NO: 740826 - RNA, 64 nt, hsa; identical to SEQ ID NO: 91761

SEQ ID NO: 740827 - RNA, 64 nt, hsa; identical to SEQ ID NO: 91762

SEQ ID NO: 740828 - RNA, 64 nt, hsa; identical to SEQ ID NO: 91763

SEQ ID NO: 740829 - RNA, 64 nt, hsa; identical to SEQ ID NO: 91764

SEQ ID NO: 740830 - RNA, 64 nt, hsa; identical to SEQ ID NO: 91765

SEQ ID NO: 740831 - RNA, 64 nt, hsa; identical to SEQ ID NO: 91766

SEQ ID NO: 740832 - RNA, 64 nt, hsa; identical to SEQ ID NO: 91767

SEQ ID NO: 740833 - RNA, 64 nt, hsa; identical to SEQ ID NO: 91768

SEQ ID NO: 740834 - RNA, 64 nt, hsa; identical to SEQ ID NO: 91769

SEQ ID NO: 740835 - RNA, 64 nt, hsa; identical to SEQ ID NO: 91770

SEQ ID NO: 740836 - RNA, 64 nt, hsa; identical to SEQ ID NO: 91771

SEQ ID NO: 740837 - RNA, 64 nt, hsa; identical to SEQ ID NO: 91772

SEQ ID NO: 740838 - RNA, 64 nt, hsa; identical to SEQ ID NO: 91773

SEQ ID NO: 740839 - RNA, 64 nt, hsa; identical to SEQ ID NO: 91774

SEQ ID NO: 740840 - RNA, 64 nt, hsa; identical to SEQ ID NO: 91775

SEQ ID NO: 740841 - RNA, 64 nt, hsa; identical to SEQ ID NO: 91776

SEQ ID NO: 740842 - RNA, 64 nt, hsa; identical to SEQ ID NO: 91777

SEQ ID NO: 740843 - RNA, 64 nt, hsa; identical to SEQ ID NO: 91778

SEQ ID NO: 740844 - RNA, 64 nt, hsa; identical to SEQ ID NO: 91779

SEQ ID NO: 740845 - RNA, 64 nt, hsa; identical to SEQ ID NO: 91780

SEQ ID NO: 740846 - RNA, 64 nt, hsa; identical to SEQ ID NO: 91781

SEQ ID NO: 740847 - RNA, 64 nt, hsa; identical to SEQ ID NO: 91782

SEQ ID NO: 740848 - RNA, 64 nt, hsa; identical to SEQ ID NO: 91783

SEQ ID NO: 740849 - RNA, 64 nt, hsa; identical to SEQ ID NO: 91784

SEQ ID NO: 740850 - RNA, 64 nt, hsa; identical to SEQ ID NO: 91785

SEQ ID NO: 740851 - RNA, 64 nt, hsa; identical to SEQ ID NO: 91786

SEQ ID NO: 740852 - RNA, 64 nt, hsa; identical to SEQ ID NO: 91787

SEQ ID NO: 740853 - RNA, 64 nt, hsa; identical to SEQ ID NO: 91788

SEQ ID NO: 740854 - RNA, 64 nt, hsa; identical to SEQ ID NO: 91789

SEQ ID NO: 740855 - RNA, 64 nt, hsa; identical to SEQ ID NO: 91790

SEQ ID NO: 740856 - RNA, 64 nt, hsa; identical to SEQ ID NO: 91791

SEQ ID NO: 740857 - RNA, 64 nt, hsa; identical to SEQ ID NO: 91792

SEQ ID NO: 740858 - RNA, 64 nt, hsa; identical to SEQ ID NO: 91793

SEQ ID NO: 740859 - RNA, 64 nt, hsa; identical to SEQ ID NO: 91794

SEQ ID NO: 740860 - RNA, 64 nt, hsa; identical to SEQ ID NO: 91795

SEQ ID NO: 740861 - RNA, 64 nt, hsa; identical to SEQ ID NO: 91796

SEQ ID NO: 740862 - RNA, 64 nt, hsa; identical to SEQ ID NO: 91797

SEQ ID NO: 740863 - RNA, 64 nt, hsa; identical to SEQ ID NO: 91798

SEQ ID NO: 740864 - RNA, 64 nt, hsa; identical to SEQ ID NO: 91799

SEQ ID NO: 740865 - RNA, 64 nt, hsa; identical to SEQ ID NO: 91800

SEQ ID NO: 740866 - RNA, 54 nt, hsa; identical to SEQ ID NO: 91801

SEQ ID NO: 740867 - RNA, 64 nt, hsa; identical to SEQ ID NO: 223610

SEQ ID NO: 740868 - RNA, 64 nt, hsa; identical to SEQ ID NO: 223611

SEQ ID NO: 740869 - RNA, 64 nt, hsa; identical to SEQ ID NO: 348706

SEQ ID NO: 740870 - RNA, 64 nt, hsa; identical to SEQ ID NO: 348707

SEQ ID NO: 740871 - RNA, 64 nt, hsa; identical to SEQ ID NO: 348708

SEQ ID NO: 740872 - RNA, 64 nt, hsa; identical to SEQ ID NO: 348709

SEQ ID NO: 740873 - RNA, 64 nt, hsa; identical to SEQ ID NO: 372098

SEQ ID NO: 740874 - RNA, 64 nt, hsa; identical to SEQ ID NO: 372099

SEQ ID NO: 740875 - RNA, 64 nt, hsa; identical to SEQ ID NO: 372100

SEQ ID NO: 740876 - RNA, 64 nt, hsa; identical to SEQ ID NO: 372101

SEQ ID NO: 740877 - RNA, 64 nt, hsa; identical to SEQ ID NO: 372102

SEQ ID NO: 740878 - RNA, 64 nt, hsa; identical to SEQ ID NO: 372103

SEQ ID NO: 740879 - RNA, 64 nt, hsa; identical to SEQ ID NO: 372104

SEQ ID NO: 740880 - RNA, 64 nt, hsa; identical to SEQ ID NO: 372105

SEQ ID NO: 740881 - RNA, 64 nt, hsa
ccaaaacaccccuuuccaguuacaauuagcaucgugauccaagcagaugccacauggaagagga

SEQ ID NO: 740882 - RNA, 64 nt, hsa
uuuguuuagacucccugagguuccguuuuacacaugauccaacguuaacuaccuuuuuuucugu

SEQ ID NO: 740883 - RNA, 64 nt, hsa
aggcauuaacaggcuuaauuaggccacaguacagugauccaaggcaggcaaggcagccaggaca

SEQ ID NO: 740884 - RNA, 64 nt, hsa
augacaaaucucugaaagagguuuuuaaaacuuuugauccaacugcuucaccauuuuguuagcu

SEQ ID NO: 740885 - RNA, 64 nt, hsa
uuuauuuuugaaauggccuuuguucauuguauugugauccaauaacacuuuguauuaaauuguu

SEQ ID NO: 740886 - RNA, 64 nt, hsa
ugaaucauuggcuucuagaaaucagaugcccagaugauccaagacuaguuuguuaucucaucug

SEQ ID NO: 740887 - RNA, 64 nt, hsa
gauaacuuuuuacucuucaaguuaggguaaauucugauccaauauucaauucauuuguguacuc

SEQ ID NO: 740888 - RNA, 64 nt, hsa
guuacaaaucgacaguuuuauucuuagacucaugugauccaagcuguauauaccauauauaaac

SEQ ID NO: 740889 - RNA, 63 nt, hsa
uuuaaagaaugguuccugaaaugaagucaguagaaauggcaugggauaagagcagagcucaca

SEQ ID NO: 740890 - RNA, 63 nt, hsa
uccacuuuuucagguaaacauuuuucauuuggcaaauggcauaauuauuugaaagugacagga

SEQ ID NO: 740891 - RNA, 63 nt, hsa
auacuagaaacacaaggaaaugcaaguuacgcuaaauggcaguaauacuacccaacugccuuu

SEQ ID NO: 740892 - RNA, 63 nt, hsa
aucagcauacacauuuuugacuguacacacuauaaauggcaucaaauuuggauauuuuucuua

SEQ ID NO: 740893 - RNA, 63 nt, hsa
uccuauuucauuagugaagacauaguucaccuaaaauggcauccugcucugaaucuagacuuu

SEQ ID NO: 740894 - RNA, 63 nt, hsa
aauggcauccugcucugaaucuagacuuuuuagaaauggcauauguuuuugaugauaugucaa

SEQ ID NO: 740895 - RNA, 63 nt, hsa
ucuuucuggcuaauuaaaaaagacaacuuuauaaaauggcacuuuaagcaagccauaguuagu

SEQ ID NO: 740896 - RNA, 63 nt, hsa
cccuagagcuuucccuguguugcuaagagcugaaaauggcaucuucgugaucaccacagugag

SEQ ID NO: 740897 - RNA, 63 nt, hsa
gccuuccuaguccuccaccuggcacaguauuugaaauggcaaaggaugugcuucauccucuaa

SEQ ID NO: 740898 - RNA, 63 nt, hsa
gauugagaauuuuauuugaaaagaaucugguuuaaauggcauugugguccgagguagcugcuc

SEQ ID NO: 740899 - RNA, 63 nt, hsa
gaugagagaggggacuaauuauuuuguuuaugaaaauggcaaguaaauuacuugaucuuuuug

SEQ ID NO: 740900 - RNA, 63 nt, hsa
ucuaagguucuuuuuuuuuauucaaacuguaugaaauggcaaagugaggcucugggguuagau

SEQ ID NO: 740901 - RNA, 63 nt, hsa
aggaugucuugaaacccgugcauuuaauuuuagaaauggcaaauuuguaagcgugucauuuaa

SEQ ID NO: 740902 - RNA, 63 nt, hsa
auuauaccaguguuguccaagguugcuagcaggaaauggcagagccaggaguuggaccuaggu

SEQ ID NO: 740903 - RNA, 63 nt, hsa
agcacuuugcgcauuguguaaguuggguaacaaaaauggcaaaagaaaugcagauuucccagu

SEQ ID NO: 740904 - RNA, 63 nt, hsa
auucccccuuggaauuugacaguuucuauggugaaauggcagaagguaacaacuauguugaaa

SEQ ID NO: 740905 - RNA, 63 nt, hsa
auauacaguuuuuucuucuuaguucugcauuagaaauggcaucuguuuuaggucucaaaauau

SEQ ID NO: 740906 - RNA, 63 nt, hsa
uccugcuccuccucucauguuuccucuuugacuaaauggcauuaccacuaccaaccauucauu

SEQ ID NO: 740907 - RNA, 63 nt, hsa
uuuagguggaauugaugucugggcaauuaaaauaaauggcauaagagcuuaaaaaccaaaguu

SEQ ID NO: 740908 - RNA, 63 nt, hsa
uaaaauucugacaguugccuuuuuuuucaucucaaauggcagcaugggacugaaacaugagaa

SEQ ID NO: 740909 - RNA, 63 nt, hsa
agagguaacuuaauuugggaauuuguuguguugaaauggcauuuaauuucaaccuaaauacug

SEQ ID NO: 740910 - RNA, 63 nt, hsa
aaugaaauuuuuuaguauguucaacucucauccaaauggcauaugacccuguuuacacagccu

SEQ ID NO: 740911 - RNA, 63 nt, hsa
cuugaagauguagcuuccaaauuugaauggauuaaauggcaccuguauaccaauuuguagaaa

SEQ ID NO: 740912 - RNA, 63 nt, hsa
gcugcaaaaccggcaaccuguaacugcccuuuuaaauggcaugacaaggugugcaguggcccc

SEQ ID NO: 740913 - RNA, 63 nt, hsa
cugugaaugcagaauguaaaauugguaacuaagaaauggcacaaacaccuuaagcaauauauu

SEQ ID NO: 740914 - RNA, 63 nt, hsa
acucaaauaaaaugccccacauuuuacuacaguaaauggcaguguuuuuaugacuuuuauacu

SEQ ID NO: 740915 - RNA, 63 nt, hsa
auguuucacuggaauugaugggaaaugguuucuaaauggcaucgaagcuggucuuuaaugagu

SEQ ID NO: 740916 - RNA, 63 nt, hsa
uauacccagauuuacagagaugacacaguauugaaauggcaggugggcucuguaaguuauuuu

SEQ ID NO: 740917 - RNA, 63 nt, hsa
aguaucaauggaaaaaugauaggcacuacaaugaaauggcaggaugccaauaugagauauuuc

SEQ ID NO: 740918 - RNA, 63 nt, hsa
agaaaauaacauacccuguauucaaaauuacugaaauggcaaucaaagaugaucauuuuuaug

SEQ ID NO: 740919 - RNA, 63 nt, hsa
cuggggaagggaaguuucaguaacaugacacuaaaauggcagagacguuaaaaaaaguuuuuc

SEQ ID NO: 740920 - RNA, 63 nt, hsa
guauccugggugaagccuguuugccucucuugaaaauggcaggugcucuuguuuuacccaugu

SEQ ID NO: 740921 - RNA, 63 nt, hsa
gaaaaguuauuuuucaaaggucuugcaguuaauaaauggcagagugagcauucaaguccaggu

SEQ ID NO: 740922 - RNA, 63 nt, hsa
gugaaaauguauaaaagaugcaucuguuguuucaaauggcacuaucuucuuuucaguacuaca

SEQ ID NO: 740923 - RNA, 63 nt, hsa
uuuuaaacacucugaccauagaaauguuuuucaaaauggcaacaauggauaaaccaaggauuu

SEQ ID NO: 740924 - RNA, 63 nt, hsa
gcaaaaucuauggccacacugagaagccuuugaaaauggcaaauacuuuucaucaccaauugc

SEQ ID NO: 740925 - RNA, 63 nt, hsa
gcaauaaucaacugaauugcaaaauuugggggaaaauggcacuauccguguacgaaucgaaua

SEQ ID NO: 740926 - RNA, 63 nt, hsa
uguccauuuacagcccucagcaaugugccuucuaaauggcaugacauauguagaugugcugca

SEQ ID NO: 740927 - RNA, 63 nt, hsa
cguaucucuaauuuauggucuauauaccaauuuaaauggcauguaaaccugccuguuucuucu

SEQ ID NO: 740928 - RNA, 63 nt, hsa
gagacauuuaagauugucagcaaacuugucccaaaauggcacaucaucauaauccauuuucuc

SEQ ID NO: 740929 - RNA, 63 nt, hsa
auuguuuuuauucuuacacgacuacaguacuucaaauggcacauagauaggcaggauauuaca

SEQ ID NO: 740930 - RNA, 63 nt, hsa
guuucagugucacagagacauucuuugauaaggaaauggcacaaacauaaagggaaaggcugc

SEQ ID NO: 740931 - RNA, 63 nt, hsa
gucaauauuaaagauagcugagaagcaccuuucaaauggcacagucccucuucaagaugucua

SEQ ID NO: 740932 - RNA, 63 nt, hsa
gcauuucccuaucuugcaguucuguuaacaugaaaauggcauuuuuccauaauagcuuuaaaa

SEQ ID NO: 740933 - RNA, 63 nt, hsa
gauugucuuagucucaaugagauguagcuacaaaaauggcaccucuuagcagugaugaggcuc

SEQ ID NO: 740934 - RNA, 63 nt, hsa
aauggcauaaauauggucgcacuaauggaagacaaauggcaaaucuugaaauagaauuggggc

SEQ ID NO: 740935 - RNA, 63 nt, hsa
caccuucagccacagccuuauaaaagggaagguaaauggcauaaauauggucgcacuaaugga

SEQ ID NO: 740936 - RNA, 63 nt, hsa
caaaugaagagaaaaagaaaaacagcauucuagaaauggcauuucuccuaauuaauuuuccac

SEQ ID NO: 740937 - RNA, 63 nt, hsa
cuggauaaccuaauuuuuuuuaaugcuuuaaaaaaauggcaaaaagacgucaggccacccuca

SEQ ID NO: 740938 - RNA, 63 nt, hsa
uagacauggauaggagugcguuuuaggcacagcaaauggcacauacaagggccagggagcaag

SEQ ID NO: 740939 - RNA, 63 nt, hsa
gccagggagcaagagagaggacagguccucaacaaauggcaugugacuuuguaaguguagaau

SEQ ID NO: 740940 - RNA, 63 nt, hsa
cugcggaucgagagaggggguagagucuucuucaaauggcaguuuuacuucaaauggcagauu

SEQ ID NO: 740941 - RNA, 63 nt, hsa
gguagagucuucuucaaauggcaguuuuacuucaaauggcagauuucacaagaguugguuauu

SEQ ID NO: 740942 - RNA, 63 nt, hsa
cacauuucuuacaaaaaagaguugaaugagguaaaauggcauuagauggcucuauauuuuuua

SEQ ID NO: 740943 - RNA, 63 nt, hsa
aguuucucuuaaucugauuaugugcacauaugaaaauggcacaucauauacauguaaaaucag

SEQ ID NO: 740944 - RNA, 63 nt, hsa
agagcaucuucauuuuaauuaacugcuuuauaaaaauggcaacuuuagguauagauaaccuaa

SEQ ID NO: 740945 - RNA, 63 nt, hsa
uaaaagccugaauuugaaauauuuuuaucagaaaaauggcauauugcugaagugucaaaauau

SEQ ID NO: 740946 - RNA, 63 nt, hsa
uccacaucauggcaguucauuuacucuugugccaaauggcaacaccacgucuaaagcaguuuc

SEQ ID NO: 740947 - RNA, 63 nt, hsa
cucccuagugaaaacuuggguaauauauguaagaaauggcaaauaaauaccuuaguuaaugac

SEQ ID NO: 740948 - RNA, 64 nt, hsa
uugggauuuuuuuuuuuuuaaaauacuuuagggacuguuguaauuucucauauggugcuggaaa

SEQ ID NO: 740949 - RNA, 64 nt, hsa
ggcuagcggaggacuacccuugcucacugacuuccuguuguaacacacuuuccuuacggagccu

SEQ ID NO: 740950 - RNA, 64 nt, hsa
uuuaguauguguaaauuguacaauaauuuuuuugcuguuguacucacugcuaauaguggauugu

SEQ ID NO: 740951 - RNA, 64 nt, hsa
ugggcucaaguacacauccugauuugguuucucccuguuguaauuugagauuucccaaauuaag

SEQ ID NO: 740952 - RNA, 64 nt, hsa
ccccuuucauauuauuuuuaaauuuuuuaauuaccuguuguaggguguuccuccagaagcaaag

SEQ ID NO: 740953 - RNA, 64 nt, hsa
cgguucuuucguagaacaauuuccauguuguuaacuguuguagacuuaauugaaucacauuuug

SEQ ID NO: 740954 - RNA, 64 nt, hsa
caaccagcaauguugagagcugaacuuaagauagcuguuguacuuuuugcuuuccaucuguuac

SEQ ID NO: 740955 - RNA, 64 nt, hsa
agcuagcauguuuucccucugauguauauagucacuguuguauaaacuaaucuuugcuuguuuu

SEQ ID NO: 740956 - RNA, 64 nt, hsa
acagaugacuucuguuguagacucacaaguuuaacuguuguauuauaacaguauuacaugucaa

SEQ ID NO: 740957 - RNA, 64 nt, hsa
ucaacuuuguuuccuguuuaacuacagaugacuucuguuguagacucacaaguuuaacuguugu

SEQ ID NO: 740958 - RNA, 64 nt, hsa
uuucaguuagacaaggcaacugaguucaagagaucuguuguacagcuuggugacuguaauuaac

SEQ ID NO: 740959 - RNA, 64 nt, hsa
auauaaaaaauuagccaggcauaguggcgcaugccuguuguagccccagcuacucaagaggcug

SEQ ID NO: 740960 - RNA, 64 nt, hsa
ggaggagaacuacguugaaaucaagauccuaugucuguuguauuuucucuuugccuggaguaaa

SEQ ID NO: 740961 - RNA, 64 nt, hsa
uccauggucuuggaaaagauugucccuucucuugcuguuguaaugcaucucugcuacagcaguc

SEQ ID NO: 740962 - RNA, 64 nt, hsa
gccuuucuucccauccuuaacuguucaaguaugucuguuguaaccaauaaguuuauugcuguga

SEQ ID NO: 740963 - RNA, 64 nt, hsa
cuuacuggguuuaauuaaaaaaaaagaaaaaacucuguuguaaaaacaguuuaacacaauacua

SEQ ID NO: 740964 - RNA, 64 nt, hsa
cuguccaacaaacacacacggguagauugcuggccuguuguaggugguagggacacagaugacc

SEQ ID NO: 740965 - RNA, 64 nt, hsa
guagaagagaaucaagaagaaaaauaaaaaucagcuguuguaaucaccuagcaaacuggcguaa

SEQ ID NO: 740966 - RNA, 64 nt, hsa
cacacacacacacacacacacacacucccuuacacuguuguacuuccgugggcccuccuuccag

SEQ ID NO: 740967 - RNA, 64 nt, hsa
cuguuuaguuuacucagguggccacauacagucucuguuguauauucuugguuuuguuuuaaua

SEQ ID NO: 740968 - RNA, 64 nt, hsa; identical to SEQ ID NO: 46370

SEQ ID NO: 740969 - RNA, 64 nt, hsa; identical to SEQ ID NO: 46371

SEQ ID NO: 740970 - RNA, 64 nt, hsa; identical to SEQ ID NO: 46372

SEQ ID NO: 740971 - RNA, 64 nt, hsa; identical to SEQ ID NO: 46373

SEQ ID NO: 740972 - RNA, 64 nt, hsa; identical to SEQ ID NO: 46374

SEQ ID NO: 740973 - RNA, 64 nt, hsa; identical to SEQ ID NO: 46375

SEQ ID NO: 740974 - RNA, 64 nt, hsa; identical to SEQ ID NO: 46376

SEQ ID NO: 740975 - RNA, 64 nt, hsa; identical to SEQ ID NO: 46377

SEQ ID NO: 740976 - RNA, 64 nt, hsa; identical to SEQ ID NO: 46378

SEQ ID NO: 740977 - RNA, 64 nt, hsa; identical to SEQ ID NO: 46379

SEQ ID NO: 740978 - RNA, 64 nt, hsa; identical to SEQ ID NO: 46380

SEQ ID NO: 740979 - RNA, 64 nt, hsa; identical to SEQ ID NO: 46381

SEQ ID NO: 740980 - RNA, 64 nt, hsa; identical to SEQ ID NO: 46382

SEQ ID NO: 740981 - RNA, 64 nt, hsa; identical to SEQ ID NO: 46383

SEQ ID NO: 740982 - RNA, 64 nt, hsa; identical to SEQ ID NO: 46384

SEQ ID NO: 740983 - RNA, 64 nt, hsa; identical to SEQ ID NO: 46385

SEQ ID NO: 740984 - RNA, 64 nt, hsa; identical to SEQ ID NO: 46386

SEQ ID NO: 740985 - RNA, 64 nt, hsa; identical to SEQ ID NO: 46387

SEQ ID NO: 740986 - RNA, 64 nt, hsa; identical to SEQ ID NO: 46388

SEQ ID NO: 740987 - RNA, 64 nt, hsa; identical to SEQ ID NO: 46389

SEQ ID NO: 740988 - RNA, 64 nt, hsa; identical to SEQ ID NO: 46390

SEQ ID NO: 740989 - RNA, 64 nt, hsa; identical to SEQ ID NO: 46391

SEQ ID NO: 740990 - RNA, 64 nt, hsa; identical to SEQ ID NO: 46392

SEQ ID NO: 740991 - RNA, 64 nt, hsa; identical to SEQ ID NO: 46393

SEQ ID NO: 740992 - RNA, 64 nt, hsa; identical to SEQ ID NO: 46394

SEQ ID NO: 740993 - RNA, 64 nt, hsa; identical to SEQ ID NO: 46395

SEQ ID NO: 740994 - RNA, 64 nt, hsa; identical to SEQ ID NO: 46396

SEQ ID NO: 740995 - RNA, 64 nt, hsa; identical to SEQ ID NO: 46397

SEQ ID NO: 740996 - RNA, 64 nt, hsa; identical to SEQ ID NO: 46398

SEQ ID NO: 740997 - RNA, 64 nt, hsa; identical to SEQ ID NO: 46399

SEQ ID NO: 740998 - RNA, 64 nt, hsa; identical to SEQ ID NO: 46400

SEQ ID NO: 740999 - RNA, 64 nt, hsa; identical to SEQ ID NO: 46401

SEQ ID NO: 741000 - RNA, 64 nt, hsa; identical to SEQ ID NO: 46402

SEQ ID NO: 741001 - RNA, 64 nt, hsa; identical to SEQ ID NO: 46403

SEQ ID NO: 741002 - RNA, 64 nt, hsa; identical to SEQ ID NO: 46404

SEQ ID NO: 741003 - RNA, 64 nt, hsa; identical to SEQ ID NO: 46405

SEQ ID NO: 741004 - RNA, 64 nt, hsa; identical to SEQ ID NO: 46406

SEQ ID NO: 741005 - RNA, 64 nt, hsa; identical to SEQ ID NO: 46407

SEQ ID NO: 741006 - RNA, 64 nt, hsa; identical to SEQ ID NO: 46408

SEQ ID NO: 741007 - RNA, 64 nt, hsa; identical to SEQ ID NO: 46409

SEQ ID NO: 741008 - RNA, 64 nt, hsa; identical to SEQ ID NO: 46410

SEQ ID NO: 741009 - RNA, 64 nt, hsa; identical to SEQ ID NO: 46411

SEQ ID NO: 741010 - RNA, 64 nt, hsa; identical to SEQ ID NO: 46412

SEQ ID NO: 741011 - RNA, 64 nt, hsa; identical to SEQ ID NO: 46413

SEQ ID NO: 741012 - RNA, 64 nt, hsa; identical to SEQ ID NO: 46414

SEQ ID NO: 741013 - RNA, 64 nt, hsa; identical to SEQ ID NO: 46415

SEQ ID NO: 741014 - RNA, 64 nt, hsa; identical to SEQ ID NO: 46416

SEQ ID NO: 741015 - RNA, 64 nt, hsa; identical to SEQ ID NO: 46417

SEQ ID NO: 741016 - RNA, 64 nt, hsa; identical to SEQ ID NO: 46418

SEQ ID NO: 741017 - RNA, 64 nt, hsa; identical to SEQ ID NO: 46419

SEQ ID NO: 741018 - RNA, 64 nt, hsa; identical to SEQ ID NO: 46420

SEQ ID NO: 741019 - RNA, 64 nt, hsa; identical to SEQ ID NO: 46421

SEQ ID NO: 741020 - RNA, 64 nt, hsa; identical to SEQ ID NO: 46422

SEQ ID NO: 741021 - RNA, 64 nt, hsa; identical to SEQ ID NO: 46423

SEQ ID NO: 741022 - RNA, 64 nt, hsa; identical to SEQ ID NO: 46424

SEQ ID NO: 741023 - RNA, 64 nt, hsa; identical to SEQ ID NO: 46425

SEQ ID NO: 741024 - RNA, 64 nt, hsa; identical to SEQ ID NO: 46426

SEQ ID NO: 741025 - RNA, 64 nt, hsa; identical to SEQ ID NO: 46427

SEQ ID NO: 741026 - RNA, 64 nt, hsa; identical to SEQ ID NO: 46428

SEQ ID NO: 741027 - RNA, 64 nt, hsa; identical to SEQ ID NO: 46429

SEQ ID NO: 741028 - RNA, 64 nt, hsa; identical to SEQ ID NO: 46430

SEQ ID NO: 741029 - RNA, 64 nt, hsa; identical to SEQ ID NO: 46431

SEQ ID NO: 741030 - RNA, 64 nt, hsa; identical to SEQ ID NO: 46432

SEQ ID NO: 741031 - RNA, 64 nt, hsa; identical to SEQ ID NO: 46433

SEQ ID NO: 741032 - RNA, 64 nt, hsa; identical to SEQ ID NO: 46434

SEQ ID NO: 741033 - RNA, 64 nt, hsa; identical to SEQ ID NO: 46435

SEQ ID NO: 741034 - RNA, 64 nt, hsa; identical to SEQ ID NO: 46436

SEQ ID NO: 741035 - RNA, 64 nt, hsa; identical to SEQ ID NO: 46437

SEQ ID NO: 741036 - RNA, 64 nt, hsa; identical to SEQ ID NO: 46438

SEQ ID NO: 741037 - RNA, 64 nt, hsa; identical to SEQ ID NO: 46439

SEQ ID NO: 741038 - RNA, 64 nt, hsa; identical to SEQ ID NO: 46440

SEQ ID NO: 741039 - RNA, 64 nt, hsa; identical to SEQ ID NO: 46441

SEQ ID NO: 741040 - RNA, 64 nt, hsa; identical to SEQ ID NO: 46442

SEQ ID NO: 741041 - RNA, 64 nt, hsa; identical to SEQ ID NO: 46443

SEQ ID NO: 741042 - RNA, 64 nt, hsa; identical to SEQ ID NO: 46444

SEQ ID NO: 741043 - RNA, 64 nt, hsa; identical to SEQ ID NO: 46445

SEQ ID NO: 741044 - RNA, 64 nt, hsa; identical to SEQ ID NO: 46446

SEQ ID NO: 741045 - RNA, 64 nt, hsa; identical to SEQ ID NO: 46447

SEQ ID NO: 741046 - RNA, 64 nt, hsa; identical to SEQ ID NO: 46448

SEQ ID NO: 741047 - RNA, 64 nt, hsa; identical to SEQ ID NO: 46449

SEQ ID NO: 741048 - RNA, 64 nt, hsa; identical to SEQ ID NO: 46450

SEQ ID NO: 741049 - RNA, 64 nt, hsa; identical to SEQ ID NO: 46451

SEQ ID NO: 741050 - RNA, 64 nt, hsa; identical to SEQ ID NO: 46452

SEQ ID NO: 741051 - RNA, 64 nt, hsa; identical to SEQ ID NO: 46453

SEQ ID NO: 741052 - RNA, 64 nt, hsa; identical to SEQ ID NO: 46454

SEQ ID NO: 741053 - RNA, 64 nt, hsa; identical to SEQ ID NO: 46455

SEQ ID NO: 741054 - RNA, 64 nt, hsa; identical to SEQ ID NO: 46456

SEQ ID NO: 741055 - RNA, 64 nt, hsa; identical to SEQ ID NO: 46457

SEQ ID NO: 741056 - RNA, 64 nt, hsa; identical to SEQ ID NO: 46458

SEQ ID NO: 741057 - RNA, 64 nt, hsa; identical to SEQ ID NO: 46459

SEQ ID NO: 741058 - RNA, 64 nt, hsa; identical to SEQ ID NO: 46460

SEQ ID NO: 741059 - RNA, 64 nt, hsa; identical to SEQ ID NO: 46461

SEQ ID NO: 741060 - RNA, 64 nt, hsa; identical to SEQ ID NO: 46462

SEQ ID NO: 741061 - RNA, 64 nt, hsa; identical to SEQ ID NO: 46463

SEQ ID NO: 741062 - RNA, 64 nt, hsa; identical to SEQ ID NO: 46464

SEQ ID NO: 741063 - RNA, 64 nt, hsa; identical to SEQ ID NO: 46465

SEQ ID NO: 741064 - RNA, 64 nt, hsa; identical to SEQ ID NO: 46466

SEQ ID NO: 741065 - RNA, 64 nt, hsa; identical to SEQ ID NO: 46467

SEQ ID NO: 741066 - RNA, 64 nt, hsa; identical to SEQ ID NO: 46468

SEQ ID NO: 741067 - RNA, 64 nt, hsa; identical to SEQ ID NO: 46469

SEQ ID NO: 741068 - RNA, 64 nt, hsa; identical to SEQ ID NO: 46470

SEQ ID NO: 741069 - RNA, 64 nt, hsa; identical to SEQ ID NO: 46471

SEQ ID NO: 741070 - RNA, 64 nt, hsa; identical to SEQ ID NO: 46472

SEQ ID NO: 741071 - RNA, 64 nt, hsa; identical to SEQ ID NO: 46473

SEQ ID NO: 741072 - RNA, 64 nt, hsa; identical to SEQ ID NO: 46474

SEQ ID NO: 741073 - RNA, 60 nt, hsa; identical to SEQ ID NO: 46475

SEQ ID NO: 741074 - RNA, 64 nt, hsa; identical to SEQ ID NO: 46476

SEQ ID NO: 741075 - RNA, 64 nt, hsa; identical to SEQ ID NO: 46477

SEQ ID NO: 741076 - RNA, 64 nt, hsa; identical to SEQ ID NO: 46478

SEQ ID NO: 741077 - RNA, 64 nt, hsa; identical to SEQ ID NO: 46479

SEQ ID NO: 741078 - RNA, 64 nt, hsa; identical to SEQ ID NO: 46480

SEQ ID NO: 741079 - RNA, 64 nt, hsa; identical to SEQ ID NO: 46481

SEQ ID NO: 741080 - RNA, 64 nt, hsa; identical to SEQ ID NO: 46482

SEQ ID NO: 741081 - RNA, 64 nt, hsa; identical to SEQ ID NO: 46483

SEQ ID NO: 741082 - RNA, 64 nt, hsa; identical to SEQ ID NO: 46484

SEQ ID NO: 741083 - RNA, 64 nt, hsa; identical to SEQ ID NO: 46485

SEQ ID NO: 741084 - RNA, 64 nt, hsa; identical to SEQ ID NO: 46486

SEQ ID NO: 741085 - RNA, 64 nt, hsa; identical to SEQ ID NO: 46487

SEQ ID NO: 741086 - RNA, 64 nt, hsa; identical to SEQ ID NO: 46488

SEQ ID NO: 741087 - RNA, 64 nt, hsa; identical to SEQ ID NO: 46489

SEQ ID NO: 741088 - RNA, 64 nt, hsa; identical to SEQ ID NO: 46490

SEQ ID NO: 741089 - RNA, 64 nt, hsa; identical to SEQ ID NO: 46491

SEQ ID NO: 741090 - RNA, 64 nt, hsa; identical to SEQ ID NO: 46492

SEQ ID NO: 741091 - RNA, 64 nt, hsa; identical to SEQ ID NO: 46493

SEQ ID NO: 741092 - RNA, 64 nt, hsa; identical to SEQ ID NO: 46494

SEQ ID NO: 741093 - RNA, 64 nt, hsa; identical to SEQ ID NO: 46495

SEQ ID NO: 741094 - RNA, 64 nt, hsa; identical to SEQ ID NO: 46496

SEQ ID NO: 741095 - RNA, 64 nt, hsa; identical to SEQ ID NO: 46497

SEQ ID NO: 741096 - RNA, 64 nt, hsa; identical to SEQ ID NO: 46498

SEQ ID NO: 741097 - RNA, 64 nt, hsa; identical to SEQ ID NO: 46499

SEQ ID NO: 741098 - RNA, 64 nt, hsa; identical to SEQ ID NO: 46500

SEQ ID NO: 741099 - RNA, 64 nt, hsa; identical to SEQ ID NO: 46501

SEQ ID NO: 741100 - RNA, 64 nt, hsa; identical to SEQ ID NO: 46502

SEQ ID NO: 741101 - RNA, 64 nt, hsa; identical to SEQ ID NO: 46503

SEQ ID NO: 741102 - RNA, 64 nt, hsa; identical to SEQ ID NO: 46504

SEQ ID NO: 741103 - RNA, 64 nt, hsa; identical to SEQ ID NO: 46505

SEQ ID NO: 741104 - RNA, 64 nt, hsa; identical to SEQ ID NO: 46506

SEQ ID NO: 741105 - RNA, 64 nt, hsa; identical to SEQ ID NO: 46507

SEQ ID NO: 741106 - RNA, 64 nt, hsa; identical to SEQ ID NO: 46508

SEQ ID NO: 741107 - RNA, 64 nt, hsa; identical to SEQ ID NO: 46509

SEQ ID NO: 741108 - RNA, 64 nt, hsa; identical to SEQ ID NO: 46510

SEQ ID NO: 741109 - RNA, 64 nt, hsa; identical to SEQ ID NO: 46511

SEQ ID NO: 741110 - RNA, 64 nt, hsa; identical to SEQ ID NO: 46512

SEQ ID NO: 741111 - RNA, 64 nt, hsa; identical to SEQ ID NO: 46513

SEQ ID NO: 741112 - RNA, 64 nt, hsa; identical to SEQ ID NO: 46514

SEQ ID NO: 741113 - RNA, 64 nt, hsa; identical to SEQ ID NO: 46515

SEQ ID NO: 741114 - RNA, 64 nt, hsa; identical to SEQ ID NO: 46516

SEQ ID NO: 741115 - RNA, 64 nt, hsa; identical to SEQ ID NO: 46517

SEQ ID NO: 741116 - RNA, 64 nt, hsa; identical to SEQ ID NO: 46518

SEQ ID NO: 741117 - RNA, 64 nt, hsa; identical to SEQ ID NO: 46519

SEQ ID NO: 741118 - RNA, 64 nt, hsa; identical to SEQ ID NO: 46520

SEQ ID NO: 741119 - RNA, 64 nt, hsa; identical to SEQ ID NO: 46521

SEQ ID NO: 741120 - RNA, 64 nt, hsa; identical to SEQ ID NO: 46522

SEQ ID NO: 741121 - RNA, 64 nt, hsa; identical to SEQ ID NO: 46523

SEQ ID NO: 741122 - RNA, 64 nt, hsa; identical to SEQ ID NO: 46524

SEQ ID NO: 741123 - RNA, 64 nt, hsa; identical to SEQ ID NO: 46525

SEQ ID NO: 741124 - RNA, 64 nt, hsa; identical to SEQ ID NO: 46526

SEQ ID NO: 741125 - RNA, 64 nt, hsa; identical to SEQ ID NO: 46527

SEQ ID NO: 741126 - RNA, 64 nt, hsa; identical to SEQ ID NO: 46528

SEQ ID NO: 741127 - RNA, 64 nt, hsa; identical to SEQ ID NO: 46529

SEQ ID NO: 741128 - RNA, 50 nt, hsa; identical to SEQ ID NO: 46530

SEQ ID NO: 741129 - RNA, 64 nt, hsa; identical to SEQ ID NO: 46531

SEQ ID NO: 741130 - RNA, 64 nt, hsa
guuuuguuuuaauaaaacagcauguuuucagguagagcuuaaacuaaaugauguguuuacuuag

SEQ ID NO: 741131 - RNA, 64 nt, hsa
gacuguagauaaggauagcagcaaacaaucauuggagcuuaaugaacauuuuuaaaaauaauua

SEQ ID NO: 741132 - RNA, 64 nt, hsa; identical to SEQ ID NO: 528631

SEQ ID NO: 741133 - RNA, 64 nt, hsa; identical to SEQ ID NO: 528632

SEQ ID NO: 741134 - RNA, 64 nt, hsa; identical to SEQ ID NO: 528633

SEQ ID NO: 741135 - RNA, 64 nt, hsa; identical to SEQ ID NO: 528634

SEQ ID NO: 741136 - RNA, 64 nt, hsa; identical to SEQ ID NO: 528635

SEQ ID NO: 741137 - RNA, 64 nt, hsa; identical to SEQ ID NO: 528636

SEQ ID NO: 741138 - RNA, 64 nt, hsa; identical to SEQ ID NO: 528637

SEQ ID NO: 741139 - RNA, 64 nt, hsa; identical to SEQ ID NO: 528638

SEQ ID NO: 741140 - RNA, 64 nt, hsa; identical to SEQ ID NO: 528639

SEQ ID NO: 741141 - RNA, 64 nt, hsa; identical to SEQ ID NO: 528640

SEQ ID NO: 741142 - RNA, 64 nt, hsa; identical to SEQ ID NO: 528641

SEQ ID NO: 741143 - RNA, 64 nt, hsa; identical to SEQ ID NO: 528642

SEQ ID NO: 741144 - RNA, 64 nt, hsa; identical to SEQ ID NO: 528643

SEQ ID NO: 741145 - RNA, 64 nt, hsa; identical to SEQ ID NO: 528644

SEQ ID NO: 741146 - RNA, 64 nt, hsa; identical to SEQ ID NO: 528645

SEQ ID NO: 741147 - RNA, 64 nt, hsa; identical to SEQ ID NO: 528646

SEQ ID NO: 741148 - RNA, 64 nt, hsa; identical to SEQ ID NO: 528647

SEQ ID NO: 741149 - RNA, 64 nt, hsa; identical to SEQ ID NO: 528648

SEQ ID NO: 741150 - RNA, 64 nt, hsa; identical to SEQ ID NO: 528649

SEQ ID NO: 741151 - RNA, 64 nt, hsa; identical to SEQ ID NO: 528650

SEQ ID NO: 741152 - RNA, 64 nt, hsa; identical to SEQ ID NO: 528651

SEQ ID NO: 741153 - RNA, 64 nt, hsa; identical to SEQ ID NO: 528652

SEQ ID NO: 741154 - RNA, 64 nt, hsa; identical to SEQ ID NO: 528653

SEQ ID NO: 741155 - RNA, 64 nt, hsa; identical to SEQ ID NO: 528654

SEQ ID NO: 741156 - RNA, 57 nt, hsa; identical to SEQ ID NO: 528655

SEQ ID NO: 741157 - RNA, 64 nt, hsa; identical to SEQ ID NO: 528656

SEQ ID NO: 741158 - RNA, 64 nt, hsa; identical to SEQ ID NO: 528657

SEQ ID NO: 741159 - RNA, 64 nt, hsa; identical to SEQ ID NO: 528658

SEQ ID NO: 741160 - RNA, 64 nt, hsa; identical to SEQ ID NO: 528659

SEQ ID NO: 741161 - RNA, 64 nt, hsa; identical to SEQ ID NO: 528660

SEQ ID NO: 741162 - RNA, 64 nt, hsa; identical to SEQ ID NO: 286991

SEQ ID NO: 741163 - RNA, 64 nt, hsa; identical to SEQ ID NO: 286992

SEQ ID NO: 741164 - RNA, 64 nt, hsa; identical to SEQ ID NO: 286993

SEQ ID NO: 741165 - RNA, 64 nt, hsa; identical to SEQ ID NO: 286994

SEQ ID NO: 741166 - RNA, 64 nt, hsa; identical to SEQ ID NO: 286995

SEQ ID NO: 741167 - RNA, 64 nt, hsa; identical to SEQ ID NO: 286996

SEQ ID NO: 741168 - RNA, 64 nt, hsa; identical to SEQ ID NO: 286997

SEQ ID NO: 741169 - RNA, 64 nt, hsa; identical to SEQ ID NO: 286998

SEQ ID NO: 741170 - RNA, 64 nt, hsa; identical to SEQ ID NO: 286999

SEQ ID NO: 741171 - RNA, 64 nt, hsa; identical to SEQ ID NO: 287000

SEQ ID NO: 741172 - RNA, 64 nt, hsa; identical to SEQ ID NO: 287001

SEQ ID NO: 741173 - RNA, 64 nt, hsa; identical to SEQ ID NO: 287002

SEQ ID NO: 741174 - RNA, 64 nt, hsa; identical to SEQ ID NO: 287003

SEQ ID NO: 741175 - RNA, 64 nt, hsa; identical to SEQ ID NO: 287004

SEQ ID NO: 741176 - RNA, 64 nt, hsa; identical to SEQ ID NO: 287005

SEQ ID NO: 741177 - RNA, 64 nt, hsa; identical to SEQ ID NO: 287006

SEQ ID NO: 741178 - RNA, 64 nt, hsa; identical to SEQ ID NO: 287007

SEQ ID NO: 741179 - RNA, 64 nt, hsa; identical to SEQ ID NO: 287008

SEQ ID NO: 741180 - RNA, 64 nt, hsa; identical to SEQ ID NO: 287009

SEQ ID NO: 741181 - RNA, 64 nt, hsa; identical to SEQ ID NO: 287010

SEQ ID NO: 741182 - RNA, 64 nt, hsa; identical to SEQ ID NO: 287011

SEQ ID NO: 741183 - RNA, 64 nt, hsa; identical to SEQ ID NO: 287012

SEQ ID NO: 741184 - RNA, 64 nt, hsa; identical to SEQ ID NO: 287013

SEQ ID NO: 741185 - RNA, 64 nt, hsa; identical to SEQ ID NO: 287014

SEQ ID NO: 741186 - RNA, 64 nt, hsa; identical to SEQ ID NO: 287015

SEQ ID NO: 741187 - RNA, 64 nt, hsa; identical to SEQ ID NO: 287016

SEQ ID NO: 741188 - RNA, 64 nt, hsa; identical to SEQ ID NO: 287017

SEQ ID NO: 741189 - RNA, 64 nt, hsa; identical to SEQ ID NO: 287018

SEQ ID NO: 741190 - RNA, 64 nt, hsa; identical to SEQ ID NO: 287019

SEQ ID NO: 741191 - RNA, 64 nt, hsa; identical to SEQ ID NO: 287020

SEQ ID NO: 741192 - RNA, 64 nt, hsa; identical to SEQ ID NO: 287021

SEQ ID NO: 741193 - RNA, 64 nt, hsa; identical to SEQ ID NO: 287022

SEQ ID NO: 741194 - RNA, 64 nt, hsa; identical to SEQ ID NO: 287023

SEQ ID NO: 741195 - RNA, 64 nt, hsa; identical to SEQ ID NO: 287024

SEQ ID NO: 741196 - RNA, 64 nt, hsa; identical to SEQ ID NO: 287025

SEQ ID NO: 741197 - RNA, 64 nt, hsa; identical to SEQ ID NO: 287026

SEQ ID NO: 741198 - RNA, 64 nt, hsa; identical to SEQ ID NO: 287027

SEQ ID NO: 741199 - RNA, 64 nt, hsa; identical to SEQ ID NO: 287028

SEQ ID NO: 741200 - RNA, 64 nt, hsa; identical to SEQ ID NO: 287029

SEQ ID NO: 741201 - RNA, 64 nt, hsa; identical to SEQ ID NO: 287030

SEQ ID NO: 741202 - RNA, 64 nt, hsa; identical to SEQ ID NO: 287031

SEQ ID NO: 741203 - RNA, 64 nt, hsa; identical to SEQ ID NO: 287032

SEQ ID NO: 741204 - RNA, 64 nt, hsa; identical to SEQ ID NO: 287033

SEQ ID NO: 741205 - RNA, 64 nt, hsa; identical to SEQ ID NO: 287034

SEQ ID NO: 741206 - RNA, 64 nt, hsa; identical to SEQ ID NO: 287035

SEQ ID NO: 741207 - RNA, 64 nt, hsa; identical to SEQ ID NO: 287036

SEQ ID NO: 741208 - RNA, 64 nt, hsa; identical to SEQ ID NO: 287037

SEQ ID NO: 741209 - RNA, 64 nt, hsa; identical to SEQ ID NO: 287038

SEQ ID NO: 741210 - RNA, 64 nt, hsa; identical to SEQ ID NO: 287039

SEQ ID NO: 741211 - RNA, 64 nt, hsa; identical to SEQ ID NO: 287040

SEQ ID NO: 741212 - RNA, 64 nt, hsa; identical to SEQ ID NO: 287041

SEQ ID NO: 741213 - RNA, 64 nt, hsa; identical to SEQ ID NO: 287042

SEQ ID NO: 741214 - RNA, 64 nt, hsa; identical to SEQ ID NO: 287043

SEQ ID NO: 741215 - RNA, 64 nt, hsa; identical to SEQ ID NO: 287044

SEQ ID NO: 741216 - RNA, 64 nt, hsa; identical to SEQ ID NO: 287045

SEQ ID NO: 741217 - RNA, 64 nt, hsa; identical to SEQ ID NO: 287046

SEQ ID NO: 741218 - RNA, 64 nt, hsa; identical to SEQ ID NO: 287047

SEQ ID NO: 741219 - RNA, 64 nt, hsa; identical to SEQ ID NO: 287048

SEQ ID NO: 741220 - RNA, 64 nt, hsa; identical to SEQ ID NO: 287049

SEQ ID NO: 741221 - RNA, 64 nt, hsa; identical to SEQ ID NO: 287050

SEQ ID NO: 741222 - RNA, 64 nt, hsa; identical to SEQ ID NO: 287051

SEQ ID NO: 741223 - RNA, 64 nt, hsa; identical to SEQ ID NO: 287052

SEQ ID NO: 741224 - RNA, 64 nt, hsa; identical to SEQ ID NO: 287053

SEQ ID NO: 741225 - RNA, 64 nt, hsa; identical to SEQ ID NO: 287054

SEQ ID NO: 741226 - RNA, 64 nt, hsa; identical to SEQ ID NO: 287055

SEQ ID NO: 741227 - RNA, 64 nt, hsa; identical to SEQ ID NO: 287056

SEQ ID NO: 741228 - RNA, 64 nt, hsa; identical to SEQ ID NO: 287057

SEQ ID NO: 741229 - RNA, 64 nt, hsa; identical to SEQ ID NO: 287058

SEQ ID NO: 741230 - RNA, 64 nt, hsa; identical to SEQ ID NO: 287059

SEQ ID NO: 741231 - RNA, 64 nt, hsa; identical to SEQ ID NO: 287060

SEQ ID NO: 741232 - RNA, 64 nt, hsa; identical to SEQ ID NO: 287061

SEQ ID NO: 741233 - RNA, 64 nt, hsa; identical to SEQ ID NO: 287062

SEQ ID NO: 741234 - RNA, 64 nt, hsa; identical to SEQ ID NO: 287063

SEQ ID NO: 741235 - RNA, 64 nt, hsa; identical to SEQ ID NO: 287064

SEQ ID NO: 741236 - RNA, 64 nt, hsa; identical to SEQ ID NO: 287065

SEQ ID NO: 741237 - RNA, 64 nt, hsa; identical to SEQ ID NO: 287066

SEQ ID NO: 741238 - RNA, 64 nt, hsa; identical to SEQ ID NO: 287067

SEQ ID NO: 741239 - RNA, 64 nt, hsa; identical to SEQ ID NO: 287068

SEQ ID NO: 741240 - RNA, 64 nt, hsa; identical to SEQ ID NO: 287069

SEQ ID NO: 741241 - RNA, 64 nt, hsa; identical to SEQ ID NO: 287070

SEQ ID NO: 741242 - RNA, 64 nt, hsa; identical to SEQ ID NO: 287071

SEQ ID NO: 741243 - RNA, 64 nt, hsa; identical to SEQ ID NO: 287072

SEQ ID NO: 741244 - RNA, 64 nt, hsa; identical to SEQ ID NO: 287073

SEQ ID NO: 741245 - RNA, 64 nt, hsa; identical to SEQ ID NO: 287074

SEQ ID NO: 741246 - RNA, 64 nt, hsa; identical to SEQ ID NO: 287075

SEQ ID NO: 741247 - RNA, 55 nt, hsa; identical to SEQ ID NO: 287076

SEQ ID NO: 741248 - RNA, 64 nt, hsa; identical to SEQ ID NO: 287077

SEQ ID NO: 741249 - RNA, 64 nt, hsa; identical to SEQ ID NO: 287078

SEQ ID NO: 741250 - RNA, 64 nt, hsa; identical to SEQ ID NO: 287079

SEQ ID NO: 741251 - RNA, 64 nt, hsa; identical to SEQ ID NO: 287080

SEQ ID NO: 741252 - RNA, 64 nt, hsa; identical to SEQ ID NO: 287081

SEQ ID NO: 741253 - RNA, 64 nt, hsa; identical to SEQ ID NO: 287082

SEQ ID NO: 741254 - RNA, 64 nt, hsa; identical to SEQ ID NO: 287083

SEQ ID NO: 741255 - RNA, 64 nt, hsa; identical to SEQ ID NO: 287084

SEQ ID NO: 741256 - RNA, 64 nt, hsa; identical to SEQ ID NO: 287085

SEQ ID NO: 741257 - RNA, 64 nt, hsa; identical to SEQ ID NO: 287086

SEQ ID NO: 741258 - RNA, 64 nt, hsa; identical to SEQ ID NO: 287087

SEQ ID NO: 741259 - RNA, 64 nt, hsa; identical to SEQ ID NO: 287088

SEQ ID NO: 741260 - RNA, 64 nt, hsa; identical to SEQ ID NO: 287089

SEQ ID NO: 741261 - RNA, 64 nt, hsa; identical to SEQ ID NO: 287090

SEQ ID NO: 741262 - RNA, 64 nt, hsa; identical to SEQ ID NO: 287091

SEQ ID NO: 741263 - RNA, 64 nt, hsa; identical to SEQ ID NO: 287092

SEQ ID NO: 741264 - RNA, 64 nt, hsa; identical to SEQ ID NO: 287093

SEQ ID NO: 741265 - RNA, 64 nt, hsa; identical to SEQ ID NO: 287094

SEQ ID NO: 741266 - RNA, 64 nt, hsa; identical to SEQ ID NO: 287095

SEQ ID NO: 741267 - RNA, 64 nt, hsa; identical to SEQ ID NO: 287096

SEQ ID NO: 741268 - RNA, 64 nt, hsa; identical to SEQ ID NO: 287097

SEQ ID NO: 741269 - RNA, 64 nt, hsa; identical to SEQ ID NO: 287098

SEQ ID NO: 741270 - RNA, 64 nt, hsa; identical to SEQ ID NO: 287099

SEQ ID NO: 741271 - RNA, 64 nt, hsa; identical to SEQ ID NO: 287100

SEQ ID NO: 741272 - RNA, 64 nt, hsa; identical to SEQ ID NO: 287101

SEQ ID NO: 741273 - RNA, 64 nt, hsa; identical to SEQ ID NO: 287102

SEQ ID NO: 741274 - RNA, 64 nt, hsa; identical to SEQ ID NO: 287103

SEQ ID NO: 741275 - RNA, 64 nt, hsa; identical to SEQ ID NO: 287104

SEQ ID NO: 741276 - RNA, 64 nt, hsa; identical to SEQ ID NO: 287105

SEQ ID NO: 741277 - RNA, 64 nt, hsa; identical to SEQ ID NO: 287106

SEQ ID NO: 741278 - RNA, 64 nt, hsa; identical to SEQ ID NO: 287107

SEQ ID NO: 741279 - RNA, 64 nt, hsa; identical to SEQ ID NO: 287108

SEQ ID NO: 741280 - RNA, 64 nt, hsa; identical to SEQ ID NO: 287109

SEQ ID NO: 741281 - RNA, 64 nt, hsa; identical to SEQ ID NO: 287110

SEQ ID NO: 741282 - RNA, 64 nt, hsa; identical to SEQ ID NO: 287111

SEQ ID NO: 741283 - RNA, 64 nt, hsa; identical to SEQ ID NO: 287112

SEQ ID NO: 741284 - RNA, 64 nt, hsa; identical to SEQ ID NO: 287113

SEQ ID NO: 741285 - RNA, 64 nt, hsa; identical to SEQ ID NO: 287114

SEQ ID NO: 741286 - RNA, 64 nt, hsa; identical to SEQ ID NO: 287115

SEQ ID NO: 741287 - RNA, 64 nt, hsa; identical to SEQ ID NO: 287116

SEQ ID NO: 741288 - RNA, 64 nt, hsa; identical to SEQ ID NO: 287117

SEQ ID NO: 741289 - RNA, 64 nt, hsa; identical to SEQ ID NO: 287118

SEQ ID NO: 741290 - RNA, 52 nt, hsa; identical to SEQ ID NO: 287119

SEQ ID NO: 741291 - RNA, 64 nt, hsa; identical to SEQ ID NO: 287120

SEQ ID NO: 741292 - RNA, 64 nt, hsa; identical to SEQ ID NO: 287121

SEQ ID NO: 741293 - RNA, 64 nt, hsa; identical to SEQ ID NO: 287122

SEQ ID NO: 741294 - RNA, 55 nt, hsa; identical to SEQ ID NO: 287123

SEQ ID NO: 741295 - RNA, 64 nt, hsa; identical to SEQ ID NO: 287124

SEQ ID NO: 741296 - RNA, 64 nt, hsa; identical to SEQ ID NO: 287125

SEQ ID NO: 741297 - RNA, 64 nt, hsa; identical to SEQ ID NO: 287126

SEQ ID NO: 741298 - RNA, 64 nt, hsa; identical to SEQ ID NO: 287127

SEQ ID NO: 741299 - RNA, 64 nt, hsa; identical to SEQ ID NO: 287128

SEQ ID NO: 741300 - RNA, 64 nt, hsa; identical to SEQ ID NO: 287129

SEQ ID NO: 741301 - RNA, 64 nt, hsa; identical to SEQ ID NO: 287130

SEQ ID NO: 741302 - RNA, 64 nt, hsa; identical to SEQ ID NO: 287131

SEQ ID NO: 741303 - RNA, 64 nt, hsa; identical to SEQ ID NO: 287132

SEQ ID NO: 741304 - RNA, 64 nt, hsa; identical to SEQ ID NO: 287133

SEQ ID NO: 741305 - RNA, 64 nt, hsa; identical to SEQ ID NO: 287134

SEQ ID NO: 741306 - RNA, 64 nt, hsa; identical to SEQ ID NO: 287135

SEQ ID NO: 741307 - RNA, 64 nt, hsa; identical to SEQ ID NO: 287136

SEQ ID NO: 741308 - RNA, 64 nt, hsa; identical to SEQ ID NO: 287137

SEQ ID NO: 741309 - RNA, 64 nt, hsa; identical to SEQ ID NO: 287138

SEQ ID NO: 741310 - RNA, 64 nt, hsa; identical to SEQ ID NO: 287139

SEQ ID NO: 741311 - RNA, 64 nt, hsa; identical to SEQ ID NO: 287140

SEQ ID NO: 741312 - RNA, 64 nt, hsa; identical to SEQ ID NO: 287141

SEQ ID NO: 741313 - RNA, 64 nt, hsa; identical to SEQ ID NO: 287142

SEQ ID NO: 741314 - RNA, 64 nt, hsa; identical to SEQ ID NO: 287143

SEQ ID NO: 741315 - RNA, 64 nt, hsa; identical to SEQ ID NO: 287144

SEQ ID NO: 741316 - RNA, 64 nt, hsa; identical to SEQ ID NO: 287145

SEQ ID NO: 741317 - RNA, 64 nt, hsa; identical to SEQ ID NO: 287146

SEQ ID NO: 741318 - RNA, 64 nt, hsa; identical to SEQ ID NO: 287147

SEQ ID NO: 741319 - RNA, 64 nt, hsa; identical to SEQ ID NO: 287148

SEQ ID NO: 741320 - RNA, 64 nt, hsa; identical to SEQ ID NO: 287149

SEQ ID NO: 741321 - RNA, 64 nt, hsa; identical to SEQ ID NO: 287150

SEQ ID NO: 741322 - RNA, 64 nt, hsa; identical to SEQ ID NO: 287151

SEQ ID NO: 741323 - RNA, 64 nt, hsa; identical to SEQ ID NO: 287152

SEQ ID NO: 741324 - RNA, 64 nt, hsa; identical to SEQ ID NO: 287153

SEQ ID NO: 741325 - RNA, 64 nt, hsa; identical to SEQ ID NO: 287154

SEQ ID NO: 741326 - RNA, 64 nt, hsa; identical to SEQ ID NO: 287155

SEQ ID NO: 741327 - RNA, 64 nt, hsa; identical to SEQ ID NO: 287156

SEQ ID NO: 741328 - RNA, 64 nt, hsa; identical to SEQ ID NO: 287157

SEQ ID NO: 741329 - RNA, 64 nt, hsa; identical to SEQ ID NO: 287158

SEQ ID NO: 741330 - RNA, 64 nt, hsa; identical to SEQ ID NO: 287159

SEQ ID NO: 741331 - RNA, 64 nt, hsa; identical to SEQ ID NO: 287160

SEQ ID NO: 741332 - RNA, 64 nt, hsa; identical to SEQ ID NO: 287161

SEQ ID NO: 741333 - RNA, 64 nt, hsa; identical to SEQ ID NO: 287162

SEQ ID NO: 741334 - RNA, 64 nt, hsa; identical to SEQ ID NO: 287163

SEQ ID NO: 741335 - RNA, 64 nt, hsa; identical to SEQ ID NO: 287164

SEQ ID NO: 741336 - RNA, 64 nt, hsa; identical to SEQ ID NO: 287165

SEQ ID NO: 741337 - RNA, 64 nt, hsa; identical to SEQ ID NO: 287166

SEQ ID NO: 741338 - RNA, 64 nt, hsa; identical to SEQ ID NO: 287167

SEQ ID NO: 741339 - RNA, 64 nt, hsa; identical to SEQ ID NO: 287168

SEQ ID NO: 741340 - RNA, 64 nt, hsa; identical to SEQ ID NO: 287169

SEQ ID NO: 741341 - RNA, 64 nt, hsa; identical to SEQ ID NO: 287170

SEQ ID NO: 741342 - RNA, 64 nt, hsa; identical to SEQ ID NO: 287171

SEQ ID NO: 741343 - RNA, 64 nt, hsa; identical to SEQ ID NO: 287172

SEQ ID NO: 741344 - RNA, 64 nt, hsa; identical to SEQ ID NO: 287173

SEQ ID NO: 741345 - RNA, 64 nt, hsa; identical to SEQ ID NO: 287174

SEQ ID NO: 741346 - RNA, 64 nt, hsa; identical to SEQ ID NO: 287175

SEQ ID NO: 741347 - RNA, 64 nt, hsa; identical to SEQ ID NO: 287176

SEQ ID NO: 741348 - RNA, 64 nt, hsa; identical to SEQ ID NO: 572073

SEQ ID NO: 741349 - RNA, 64 nt, hsa; identical to SEQ ID NO: 572074

SEQ ID NO: 741350 - RNA, 64 nt, hsa; identical to SEQ ID NO: 572075

SEQ ID NO: 741351 - RNA, 64 nt, hsa; identical to SEQ ID NO: 572076

SEQ ID NO: 741352 - RNA, 64 nt, hsa; identical to SEQ ID NO: 572077

SEQ ID NO: 741353 - RNA, 64 nt, hsa; identical to SEQ ID NO: 572078

SEQ ID NO: 741354 - RNA, 64 nt, hsa; identical to SEQ ID NO: 572079

SEQ ID NO: 741355 - RNA, 64 nt, hsa; identical to SEQ ID NO: 572080

SEQ ID NO: 741356 - RNA, 64 nt, hsa; identical to SEQ ID NO: 572081

SEQ ID NO: 741357 - RNA, 64 nt, hsa; identical to SEQ ID NO: 572082

SEQ ID NO: 741358 - RNA, 64 nt, hsa; identical to SEQ ID NO: 572083

SEQ ID NO: 741359 - RNA, 64 nt, hsa; identical to SEQ ID NO: 572084

SEQ ID NO: 741360 - RNA, 64 nt, hsa; identical to SEQ ID NO: 572085

SEQ ID NO: 741361 - RNA, 64 nt, hsa; identical to SEQ ID NO: 572086

SEQ ID NO: 741362 - RNA, 64 nt, hsa; identical to SEQ ID NO: 572087

SEQ ID NO: 741363 - RNA, 64 nt, hsa; identical to SEQ ID NO: 572088

SEQ ID NO: 741364 - RNA, 64 nt, hsa; identical to SEQ ID NO: 572089

SEQ ID NO: 741365 - RNA, 64 nt, hsa; identical to SEQ ID NO: 572090

SEQ ID NO: 741366 - RNA, 64 nt, hsa; identical to SEQ ID NO: 572091

SEQ ID NO: 741367 - RNA, 64 nt, hsa; identical to SEQ ID NO: 572092

SEQ ID NO: 741368 - RNA, 64 nt, hsa; identical to SEQ ID NO: 572093

SEQ ID NO: 741369 - RNA, 64 nt, hsa; identical to SEQ ID NO: 572094

SEQ ID NO: 741370 - RNA, 64 nt, hsa; identical to SEQ ID NO: 572095

SEQ ID NO: 741371 - RNA, 64 nt, hsa; identical to SEQ ID NO: 572096

SEQ ID NO: 741372 - RNA, 64 nt, hsa; identical to SEQ ID NO: 572097

SEQ ID NO: 741373 - RNA, 64 nt, hsa; identical to SEQ ID NO: 572098

SEQ ID NO: 741374 - RNA, 64 nt, hsa; identical to SEQ ID NO: 572099

SEQ ID NO: 741375 - RNA, 64 nt, hsa; identical to SEQ ID NO: 572100

SEQ ID NO: 741376 - RNA, 64 nt, hsa; identical to SEQ ID NO: 572101

SEQ ID NO: 741377 - RNA, 64 nt, hsa; identical to SEQ ID NO: 572102

SEQ ID NO: 741378 - RNA, 64 nt, hsa; identical to SEQ ID NO: 572103

SEQ ID NO: 741379 - RNA, 64 nt, hsa; identical to SEQ ID NO: 572104

SEQ ID NO: 741380 - RNA, 64 nt, hsa; identical to SEQ ID NO: 572105

SEQ ID NO: 741381 - RNA, 64 nt, hsa; identical to SEQ ID NO: 572106

SEQ ID NO: 741382 - RNA, 64 nt, hsa; identical to SEQ ID NO: 572107

SEQ ID NO: 741383 - RNA, 64 nt, hsa; identical to SEQ ID NO: 572108

SEQ ID NO: 741384 - RNA, 64 nt, hsa; identical to SEQ ID NO: 572109

SEQ ID NO: 741385 - RNA, 55 nt, hsa; identical to SEQ ID NO: 572110

SEQ ID NO: 741386 - RNA, 64 nt, hsa; identical to SEQ ID NO: 572111

SEQ ID NO: 741387 - RNA, 64 nt, hsa; identical to SEQ ID NO: 572112

SEQ ID NO: 741388 - RNA, 64 nt, hsa; identical to SEQ ID NO: 572113

SEQ ID NO: 741389 - RNA, 64 nt, hsa; identical to SEQ ID NO: 74140

SEQ ID NO: 741390 - RNA, 64 nt, hsa; identical to SEQ ID NO: 74141

SEQ ID NO: 741391 - RNA, 64 nt, hsa; identical to SEQ ID NO: 74142

SEQ ID NO: 741392 - RNA, 64 nt, hsa; identical to SEQ ID NO: 74143

SEQ ID NO: 741393 - RNA, 64 nt, hsa; identical to SEQ ID NO: 74144

SEQ ID NO: 741394 - RNA, 64 nt, hsa; identical to SEQ ID NO: 74145

SEQ ID NO: 741395 - RNA, 64 nt, hsa; identical to SEQ ID NO: 74146

SEQ ID NO: 741396 - RNA, 64 nt, hsa; identical to SEQ ID NO: 74147

SEQ ID NO: 741397 - RNA, 64 nt, hsa; identical to SEQ ID NO: 74148

SEQ ID NO: 741398 - RNA, 64 nt, hsa; identical to SEQ ID NO: 74149

SEQ ID NO: 741399 - RNA, 64 nt, hsa; identical to SEQ ID NO: 74150

SEQ ID NO: 741400 - RNA, 64 nt, hsa; identical to SEQ ID NO: 74151

SEQ ID NO: 741401 - RNA, 64 nt, hsa; identical to SEQ ID NO: 74152

SEQ ID NO: 741402 - RNA, 64 nt, hsa; identical to SEQ ID NO: 74153

SEQ ID NO: 741403 - RNA, 64 nt, hsa; identical to SEQ ID NO: 74154

SEQ ID NO: 741404 - RNA, 64 nt, hsa; identical to SEQ ID NO: 74155

SEQ ID NO: 741405 - RNA, 64 nt, hsa; identical to SEQ ID NO: 74156

SEQ ID NO: 741406 - RNA, 64 nt, hsa; identical to SEQ ID NO: 74157

SEQ ID NO: 741407 - RNA, 64 nt, hsa; identical to SEQ ID NO: 74158

SEQ ID NO: 741408 - RNA, 64 nt, hsa; identical to SEQ ID NO: 74159

SEQ ID NO: 741409 - RNA, 64 nt, hsa; identical to SEQ ID NO: 74160

SEQ ID NO: 741410 - RNA, 64 nt, hsa; identical to SEQ ID NO: 74161

SEQ ID NO: 741411 - RNA, 64 nt, hsa; identical to SEQ ID NO: 74162

SEQ ID NO: 741412 - RNA, 64 nt, hsa; identical to SEQ ID NO: 74163

SEQ ID NO: 741413 - RNA, 64 nt, hsa; identical to SEQ ID NO: 74164

SEQ ID NO: 741414 - RNA, 64 nt, hsa; identical to SEQ ID NO: 74165

SEQ ID NO: 741415 - RNA, 64 nt, hsa; identical to SEQ ID NO: 74166

SEQ ID NO: 741416 - RNA, 64 nt, hsa; identical to SEQ ID NO: 74167

SEQ ID NO: 741417 - RNA, 64 nt, hsa; identical to SEQ ID NO: 74168

SEQ ID NO: 741418 - RNA, 64 nt, hsa; identical to SEQ ID NO: 74169

SEQ ID NO: 741419 - RNA, 64 nt, hsa; identical to SEQ ID NO: 74170

SEQ ID NO: 741420 - RNA, 64 nt, hsa; identical to SEQ ID NO: 74171

SEQ ID NO: 741421 - RNA, 64 nt, hsa; identical to SEQ ID NO: 74172

SEQ ID NO: 741422 - RNA, 64 nt, hsa; identical to SEQ ID NO: 74173

SEQ ID NO: 741423 - RNA, 64 nt, hsa; identical to SEQ ID NO: 74174

SEQ ID NO: 741424 - RNA, 64 nt, hsa; identical to SEQ ID NO: 74175

SEQ ID NO: 741425 - RNA, 64 nt, hsa; identical to SEQ ID NO: 74176

SEQ ID NO: 741426 - RNA, 64 nt, hsa; identical to SEQ ID NO: 74177

SEQ ID NO: 741427 - RNA, 64 nt, hsa; identical to SEQ ID NO: 74178

SEQ ID NO: 741428 - RNA, 64 nt, hsa; identical to SEQ ID NO: 74179

SEQ ID NO: 741429 - RNA, 64 nt, hsa; identical to SEQ ID NO: 74180

SEQ ID NO: 741430 - RNA, 64 nt, hsa; identical to SEQ ID NO: 74181

SEQ ID NO: 741431 - RNA, 64 nt, hsa; identical to SEQ ID NO: 74182

SEQ ID NO: 741432 - RNA, 64 nt, hsa; identical to SEQ ID NO: 74183

SEQ ID NO: 741433 - RNA, 64 nt, hsa; identical to SEQ ID NO: 74184

SEQ ID NO: 741434 - RNA, 64 nt, hsa; identical to SEQ ID NO: 74185

SEQ ID NO: 741435 - RNA, 64 nt, hsa; identical to SEQ ID NO: 74186

SEQ ID NO: 741436 - RNA, 64 nt, hsa; identical to SEQ ID NO: 74187

SEQ ID NO: 741437 - RNA, 64 nt, hsa; identical to SEQ ID NO: 74188

SEQ ID NO: 741438 - RNA, 64 nt, hsa; identical to SEQ ID NO: 74189

SEQ ID NO: 741439 - RNA, 64 nt, hsa; identical to SEQ ID NO: 74190

SEQ ID NO: 741440 - RNA, 64 nt, hsa; identical to SEQ ID NO: 74191

SEQ ID NO: 741441 - RNA, 64 nt, hsa; identical to SEQ ID NO: 74192

SEQ ID NO: 741442 - RNA, 64 nt, hsa; identical to SEQ ID NO: 74193

SEQ ID NO: 741443 - RNA, 64 nt, hsa; identical to SEQ ID NO: 74194

SEQ ID NO: 741444 - RNA, 64 nt, hsa; identical to SEQ ID NO: 74195

SEQ ID NO: 741445 - RNA, 64 nt, hsa; identical to SEQ ID NO: 74196

SEQ ID NO: 741446 - RNA, 64 nt, hsa; identical to SEQ ID NO: 74197

SEQ ID NO: 741447 - RNA, 64 nt, hsa; identical to SEQ ID NO: 74198

SEQ ID NO: 741448 - RNA, 64 nt, hsa; identical to SEQ ID NO: 74199

SEQ ID NO: 741449 - RNA, 64 nt, hsa; identical to SEQ ID NO: 74200

SEQ ID NO: 741450 - RNA, 64 nt, hsa; identical to SEQ ID NO: 74201

SEQ ID NO: 741451 - RNA, 64 nt, hsa; identical to SEQ ID NO: 74202

SEQ ID NO: 741452 - RNA, 64 nt, hsa; identical to SEQ ID NO: 74203

SEQ ID NO: 741453 - RNA, 64 nt, hsa; identical to SEQ ID NO: 74204

SEQ ID NO: 741454 - RNA, 64 nt, hsa; identical to SEQ ID NO: 74205

SEQ ID NO: 741455 - RNA, 64 nt, hsa; identical to SEQ ID NO: 74206

SEQ ID NO: 741456 - RNA, 64 nt, hsa; identical to SEQ ID NO: 74207

SEQ ID NO: 741457 - RNA, 64 nt, hsa; identical to SEQ ID NO: 74208

SEQ ID NO: 741458 - RNA, 64 nt, hsa; identical to SEQ ID NO: 74209

SEQ ID NO: 741459 - RNA, 64 nt, hsa; identical to SEQ ID NO: 74210

SEQ ID NO: 741460 - RNA, 64 nt, hsa; identical to SEQ ID NO: 74211

SEQ ID NO: 741461 - RNA, 64 nt, hsa; identical to SEQ ID NO: 74212

SEQ ID NO: 741462 - RNA, 64 nt, hsa; identical to SEQ ID NO: 74213

SEQ ID NO: 741463 - RNA, 64 nt, hsa; identical to SEQ ID NO: 74214

SEQ ID NO: 741464 - RNA, 64 nt, hsa; identical to SEQ ID NO: 74215

SEQ ID NO: 741465 - RNA, 64 nt, hsa; identical to SEQ ID NO: 74216

SEQ ID NO: 741466 - RNA, 58 nt, hsa; identical to SEQ ID NO: 74217

SEQ ID NO: 741467 - RNA, 64 nt, hsa; identical to SEQ ID NO: 74218

SEQ ID NO: 741468 - RNA, 64 nt, hsa; identical to SEQ ID NO: 74219

SEQ ID NO: 741469 - RNA, 64 nt, hsa; identical to SEQ ID NO: 74220

SEQ ID NO: 741470 - RNA, 64 nt, hsa; identical to SEQ ID NO: 74221

SEQ ID NO: 741471 - RNA, 56 nt, hsa; identical to SEQ ID NO: 74222

SEQ ID NO: 741472 - RNA, 64 nt, hsa; identical to SEQ ID NO: 74223

SEQ ID NO: 741473 - RNA, 64 nt, hsa; identical to SEQ ID NO: 74224

SEQ ID NO: 741474 - RNA, 64 nt, hsa; identical to SEQ ID NO: 74225

SEQ ID NO: 741475 - RNA, 64 nt, hsa; identical to SEQ ID NO: 74226

SEQ ID NO: 741476 - RNA, 64 nt, hsa; identical to SEQ ID NO: 74227

SEQ ID NO: 741477 - RNA, 64 nt, hsa; identical to SEQ ID NO: 74228

SEQ ID NO: 741478 - RNA, 53 nt, hsa; identical to SEQ ID NO: 74229

SEQ ID NO: 741479 - RNA, 64 nt, hsa; identical to SEQ ID NO: 74230

SEQ ID NO: 741480 - RNA, 64 nt, hsa; identical to SEQ ID NO: 74231

SEQ ID NO: 741481 - RNA, 64 nt, hsa; identical to SEQ ID NO: 74232

SEQ ID NO: 741482 - RNA, 64 nt, hsa; identical to SEQ ID NO: 74233

SEQ ID NO: 741483 - RNA, 64 nt, hsa; identical to SEQ ID NO: 74234

SEQ ID NO: 741484 - RNA, 64 nt, hsa; identical to SEQ ID NO: 74235

SEQ ID NO: 741485 - RNA, 64 nt, hsa; identical to SEQ ID NO: 74236

SEQ ID NO: 741486 - RNA, 64 nt, hsa; identical to SEQ ID NO: 74237

SEQ ID NO: 741487 - RNA, 64 nt, hsa; identical to SEQ ID NO: 74238

SEQ ID NO: 741488 - RNA, 64 nt, hsa; identical to SEQ ID NO: 74239

SEQ ID NO: 741489 - RNA, 64 nt, hsa; identical to SEQ ID NO: 74240

SEQ ID NO: 741490 - RNA, 64 nt, hsa; identical to SEQ ID NO: 74241

SEQ ID NO: 741491 - RNA, 64 nt, hsa; identical to SEQ ID NO: 74242

SEQ ID NO: 741492 - RNA, 64 nt, hsa; identical to SEQ ID NO: 74243

SEQ ID NO: 741493 - RNA, 64 nt, hsa; identical to SEQ ID NO: 74244

SEQ ID NO: 741494 - RNA, 64 nt, hsa; identical to SEQ ID NO: 74245

SEQ ID NO: 741495 - RNA, 64 nt, hsa; identical to SEQ ID NO: 74246

SEQ ID NO: 741496 - RNA, 64 nt, hsa; identical to SEQ ID NO: 74247

SEQ ID NO: 741497 - RNA, 64 nt, hsa; identical to SEQ ID NO: 74248

SEQ ID NO: 741498 - RNA, 64 nt, hsa; identical to SEQ ID NO: 74249

SEQ ID NO: 741499 - RNA, 64 nt, hsa; identical to SEQ ID NO: 74250

SEQ ID NO: 741500 - RNA, 64 nt, hsa; identical to SEQ ID NO: 74251

SEQ ID NO: 741501 - RNA, 64 nt, hsa; identical to SEQ ID NO: 74252

SEQ ID NO: 741502 - RNA, 64 nt, hsa; identical to SEQ ID NO: 74253

SEQ ID NO: 741503 - RNA, 64 nt, hsa; identical to SEQ ID NO: 74254

SEQ ID NO: 741504 - RNA, 64 nt, hsa; identical to SEQ ID NO: 74255

SEQ ID NO: 741505 - RNA, 64 nt, hsa; identical to SEQ ID NO: 74256

SEQ ID NO: 741506 - RNA, 64 nt, hsa; identical to SEQ ID NO: 74257

SEQ ID NO: 741507 - RNA, 64 nt, hsa; identical to SEQ ID NO: 74258

SEQ ID NO: 741508 - RNA, 64 nt, hsa; identical to SEQ ID NO: 74259

SEQ ID NO: 741509 - RNA, 64 nt, hsa; identical to SEQ ID NO: 74260

SEQ ID NO: 741510 - RNA, 64 nt, hsa; identical to SEQ ID NO: 74261

SEQ ID NO: 741511 - RNA, 64 nt, hsa; identical to SEQ ID NO: 74262

SEQ ID NO: 741512 - RNA, 64 nt, hsa; identical to SEQ ID NO: 74263

SEQ ID NO: 741513 - RNA, 64 nt, hsa; identical to SEQ ID NO: 74264

SEQ ID NO: 741514 - RNA, 64 nt, hsa; identical to SEQ ID NO: 632047

SEQ ID NO: 741515 - RNA, 64 nt, hsa; identical to SEQ ID NO: 632048

SEQ ID NO: 741516 - RNA, 64 nt, hsa; identical to SEQ ID NO: 632049

SEQ ID NO: 741517 - RNA, 64 nt, hsa; identical to SEQ ID NO: 632050

SEQ ID NO: 741518 - RNA, 64 nt, hsa; identical to SEQ ID NO: 632051

SEQ ID NO: 741519 - RNA, 64 nt, hsa; identical to SEQ ID NO: 632052

SEQ ID NO: 741520 - RNA, 64 nt, hsa; identical to SEQ ID NO: 632053

SEQ ID NO: 741521 - RNA, 64 nt, hsa; identical to SEQ ID NO: 632054

SEQ ID NO: 741522 - RNA, 64 nt, hsa; identical to SEQ ID NO: 632055

SEQ ID NO: 741523 - RNA, 64 nt, hsa; identical to SEQ ID NO: 632056

SEQ ID NO: 741524 - RNA, 64 nt, hsa; identical to SEQ ID NO: 632057

SEQ ID NO: 741525 - RNA, 64 nt, hsa; identical to SEQ ID NO: 632058

SEQ ID NO: 741526 - RNA, 64 nt, hsa; identical to SEQ ID NO: 632059

SEQ ID NO: 741527 - RNA, 64 nt, hsa; identical to SEQ ID NO: 632060

SEQ ID NO: 741528 - RNA, 64 nt, hsa; identical to SEQ ID NO: 632061

SEQ ID NO: 741529 - RNA, 64 nt, hsa; identical to SEQ ID NO: 632062

SEQ ID NO: 741530 - RNA, 64 nt, hsa; identical to SEQ ID NO: 632063

SEQ ID NO: 741531 - RNA, 64 nt, hsa; identical to SEQ ID NO: 632064

SEQ ID NO: 741532 - RNA, 64 nt, hsa; identical to SEQ ID NO: 632065

SEQ ID NO: 741533 - RNA, 64 nt, hsa; identical to SEQ ID NO: 632066

SEQ ID NO: 741534 - RNA, 64 nt, hsa; identical to SEQ ID NO: 632067

SEQ ID NO: 741535 - RNA, 64 nt, hsa; identical to SEQ ID NO: 632068

SEQ ID NO: 741536 - RNA, 64 nt, hsa; identical to SEQ ID NO: 632069

SEQ ID NO: 741537 - RNA, 64 nt, hsa; identical to SEQ ID NO: 632070

SEQ ID NO: 741538 - RNA, 64 nt, hsa; identical to SEQ ID NO: 632071

SEQ ID NO: 741539 - RNA, 64 nt, hsa; identical to SEQ ID NO: 632072

SEQ ID NO: 741540 - RNA, 64 nt, hsa; identical to SEQ ID NO: 632073

SEQ ID NO: 741541 - RNA, 64 nt, hsa; identical to SEQ ID NO: 632074

SEQ ID NO: 741542 - RNA, 64 nt, hsa; identical to SEQ ID NO: 632075

SEQ ID NO: 741543 - RNA, 64 nt, hsa; identical to SEQ ID NO: 209887

SEQ ID NO: 741544 - RNA, 64 nt, hsa; identical to SEQ ID NO: 209888

SEQ ID NO: 741545 - RNA, 64 nt, hsa; identical to SEQ ID NO: 209889

SEQ ID NO: 741546 - RNA, 64 nt, hsa; identical to SEQ ID NO: 209890

SEQ ID NO: 741547 - RNA, 64 nt, hsa; identical to SEQ ID NO: 209891

SEQ ID NO: 741548 - RNA, 64 nt, hsa; identical to SEQ ID NO: 209892

SEQ ID NO: 741549 - RNA, 64 nt, hsa; identical to SEQ ID NO: 209893

SEQ ID NO: 741550 - RNA, 64 nt, hsa; identical to SEQ ID NO: 209894

SEQ ID NO: 741551 - RNA, 64 nt, hsa; identical to SEQ ID NO: 209895

SEQ ID NO: 741552 - RNA, 64 nt, hsa; identical to SEQ ID NO: 209896

SEQ ID NO: 741553 - RNA, 64 nt, hsa; identical to SEQ ID NO: 209897

SEQ ID NO: 741554 - RNA, 64 nt, hsa; identical to SEQ ID NO: 209898

SEQ ID NO: 741555 - RNA, 64 nt, hsa; identical to SEQ ID NO: 209899

SEQ ID NO: 741556 - RNA, 64 nt, hsa; identical to SEQ ID NO: 209900

SEQ ID NO: 741557 - RNA, 64 nt, hsa; identical to SEQ ID NO: 209901

SEQ ID NO: 741558 - RNA, 64 nt, hsa; identical to SEQ ID NO: 209902

SEQ ID NO: 741559 - RNA, 64 nt, hsa; identical to SEQ ID NO: 209903

SEQ ID NO: 741560 - RNA, 64 nt, hsa; identical to SEQ ID NO: 209904

SEQ ID NO: 741561 - RNA, 64 nt, hsa; identical to SEQ ID NO: 209905

SEQ ID NO: 741562 - RNA, 64 nt, hsa; identical to SEQ ID NO: 209906

SEQ ID NO: 741563 - RNA, 64 nt, hsa; identical to SEQ ID NO: 209907

SEQ ID NO: 741564 - RNA, 64 nt, hsa; identical to SEQ ID NO: 209908

SEQ ID NO: 741565 - RNA, 64 nt, hsa; identical to SEQ ID NO: 209909

SEQ ID NO: 741566 - RNA, 64 nt, hsa; identical to SEQ ID NO: 209910

SEQ ID NO: 741567 - RNA, 64 nt, hsa; identical to SEQ ID NO: 209911

SEQ ID NO: 741568 - RNA, 64 nt, hsa; identical to SEQ ID NO: 209912

SEQ ID NO: 741569 - RNA, 64 nt, hsa; identical to SEQ ID NO: 209913

SEQ ID NO: 741570 - RNA, 64 nt, hsa; identical to SEQ ID NO: 209914

SEQ ID NO: 741571 - RNA, 64 nt, hsa; identical to SEQ ID NO: 209915

SEQ ID NO: 741572 - RNA, 64 nt, hsa; identical to SEQ ID NO: 209916

SEQ ID NO: 741573 - RNA, 64 nt, hsa
gcuauguguucuuuuuguucauuucguucuuacuucccugaagcaagagacuauauggccuuca

SEQ ID NO: 741574 - RNA, 64 nt, hsa
guauuggccacacgcuggaagcugaaauugaugaucccugaagguugaacccacacacaccccu

SEQ ID NO: 741575 - RNA, 64 nt, hsa
aaugauuguuuuagccugcucgaacugauacaaaucccugaaaccaugauuggcauauguuaga

SEQ ID NO: 741576 - RNA, 64 nt, hsa
auuaauguuucuucauugauuauggaacuuuuguucccugaagcuaguuaacugugucuaaagu

SEQ ID NO: 741577 - RNA, 64 nt, hsa
ugaggacggggcugugucugccucagacugggaaucccugaagauggggccgugucucccucaa

SEQ ID NO: 741578 - RNA, 64 nt, hsa
ugaggacggggcugugucucccucagacuggggcucccugaagaaagggcugcuucucccucag

SEQ ID NO: 741579 - RNA, 64 nt, hsa
ugaagaaagggcugcuucucccucagacuggagcucccugaagauggggcugugucccccucag

SEQ ID NO: 741580 - RNA, 64 nt, hsa
aguaaauagacuugaggaauccucuaccacagugucccugaaaccacaugcaucauucaggaag

SEQ ID NO: 741581 - RNA, 64 nt, hsa
auucaggaagccuucacccugugacuauucagccucccugaauaugcuuucucuauagaaccac

SEQ ID NO: 741582 - RNA, 64 nt, hsa
agauuauuuuaagaugagacaagauuauugucaaucccugaaugucuggaguuaccucccaugg

SEQ ID NO: 741583 - RNA, 64 nt, hsa
ucuggugaccucuuccuaaacuugaagcccugccucccugaaggcuaauuaaggguugcagucc

SEQ ID NO: 741584 - RNA, 64 nt, hsa
gcacaucacugucaccucugaaucuccaucugcaucccugaaaaaugaagaaacagggcuggau

SEQ ID NO: 741585 - RNA, 64 nt, hsa
ugggacaagagcccucccugaaccccugcaacccucccugaaccccugcaaaugaaaccaaacg

SEQ ID NO: 741586 - RNA, 64 nt, hsa
cccucucccuuccccgguugugggacaagagcccucccugaaccccugcaacccucccugaacc

SEQ ID NO: 741587 - RNA, 64 nt, hsa
gcuugagcuggauagagguggggucucuucaccuucccugaauucagaacagacccugugccug

SEQ ID NO: 741588 - RNA, 64 nt, hsa
aguggugggugcucccccucccuaagcuccagggucccugaaucuucugaaaucucaaaugagu

SEQ ID NO: 741589 - RNA, 64 nt, hsa
ucucacaauuucucuaaucuuuacucauguuaugucccugaaugucuugguauagguuuaagug

SEQ ID NO: 741590 - RNA, 64 nt, hsa
ugaaauagaaacaagagaaugcaccuagguuaauucccugaauccuacuugaacauuguauaaa

SEQ ID NO: 741591 - RNA, 64 nt, hsa
ccagcauauacaaaaggggagguuuuagacaggcucccugaauguuaaccacagaggagucacu

SEQ ID NO: 741592 - RNA, 64 nt, hsa
uggggcucaaucccccuuucaccagaugccacccucccugaaccccccaccacuaccagcuccc

SEQ ID NO: 741593 - RNA, 64 nt, hsa
aagguggagcugggcaagauuuuggguuugcugcucccugaagcuggauucuuucauacgauac

SEQ ID NO: 741594 - RNA, 64 nt, hsa
guggcucuuacagcucucuggugccagcacgggaucccugaagugacucagccaggcagacaug

SEQ ID NO: 741595 - RNA, 64 nt, hsa
aggguuuaauaaaacugguuaaaaauugagucuuucccugaaguaagugcucuuuccagaugaa

SEQ ID NO: 741596 - RNA, 64 nt, hsa
cuucuguaaccagggcugucuucagaugucagggucccugaacugcugcgggcccagucaguga

SEQ ID NO: 741597 - RNA, 64 nt, hsa
ucuugauagcugauuaauuugcccucaauucugcucccugaacuucacacauaaaucuucccaa

SEQ ID NO: 741598 - RNA, 64 nt, hsa
ugugaaaucacacucuuccucugggcauccuggaucccugaauuauccccccccccaugaagua

SEQ ID NO: 741599 - RNA, 64 nt, hsa; identical to SEQ ID NO: 193898

SEQ ID NO: 741600 - RNA, 64 nt, hsa; identical to SEQ ID NO: 193899

SEQ ID NO: 741601 - RNA, 64 nt, hsa; identical to SEQ ID NO: 193900

SEQ ID NO: 741602 - RNA, 64 nt, hsa; identical to SEQ ID NO: 193901

SEQ ID NO: 741603 - RNA, 64 nt, hsa; identical to SEQ ID NO: 193902

SEQ ID NO: 741604 - RNA, 64 nt, hsa; identical to SEQ ID NO: 193903

SEQ ID NO: 741605 - RNA, 64 nt, hsa; identical to SEQ ID NO: 193904

SEQ ID NO: 741606 - RNA, 64 nt, hsa; identical to SEQ ID NO: 193905

SEQ ID NO: 741607 - RNA, 64 nt, hsa; identical to SEQ ID NO: 193906

SEQ ID NO: 741608 - RNA, 64 nt, hsa; identical to SEQ ID NO: 193907

SEQ ID NO: 741609 - RNA, 64 nt, hsa; identical to SEQ ID NO: 193908

SEQ ID NO: 741610 - RNA, 64 nt, hsa; identical to SEQ ID NO: 193909

SEQ ID NO: 741611 - RNA, 64 nt, hsa; identical to SEQ ID NO: 193910

SEQ ID NO: 741612 - RNA, 64 nt, hsa; identical to SEQ ID NO: 193911

SEQ ID NO: 741613 - RNA, 64 nt, hsa; identical to SEQ ID NO: 193912

SEQ ID NO: 741614 - RNA, 64 nt, hsa; identical to SEQ ID NO: 193913

SEQ ID NO: 741615 - RNA, 64 nt, hsa; identical to SEQ ID NO: 193914

SEQ ID NO: 741616 - RNA, 64 nt, hsa; identical to SEQ ID NO: 193915

SEQ ID NO: 741617 - RNA, 64 nt, hsa; identical to SEQ ID NO: 193916

SEQ ID NO: 741618 - RNA, 64 nt, hsa; identical to SEQ ID NO: 193917

SEQ ID NO: 741619 - RNA, 64 nt, hsa; identical to SEQ ID NO: 193918

SEQ ID NO: 741620 - RNA, 64 nt, hsa; identical to SEQ ID NO: 193919

SEQ ID NO: 741621 - RNA, 64 nt, hsa; identical to SEQ ID NO: 359890

SEQ ID NO: 741622 - RNA, 64 nt, hsa; identical to SEQ ID NO: 359891

SEQ ID NO: 741623 - RNA, 64 nt, hsa; identical to SEQ ID NO: 359892

SEQ ID NO: 741624 - RNA, 64 nt, hsa; identical to SEQ ID NO: 359893

SEQ ID NO: 741625 - RNA, 64 nt, hsa; identical to SEQ ID NO: 359894

SEQ ID NO: 741626 - RNA, 64 nt, hsa; identical to SEQ ID NO: 359895

SEQ ID NO: 741627 - RNA, 64 nt, hsa; identical to SEQ ID NO: 359896

SEQ ID NO: 741628 - RNA, 64 nt, hsa; identical to SEQ ID NO: 359897

SEQ ID NO: 741629 - RNA, 64 nt, hsa; identical to SEQ ID NO: 359898

SEQ ID NO: 741630 - RNA, 64 nt, hsa; identical to SEQ ID NO: 359899

SEQ ID NO: 741631 - RNA, 64 nt, hsa; identical to SEQ ID NO: 359900

SEQ ID NO: 741632 - RNA, 64 nt, hsa; identical to SEQ ID NO: 359901

SEQ ID NO: 741633 - RNA, 64 nt, hsa; identical to SEQ ID NO: 359902

SEQ ID NO: 741634 - RNA, 64 nt, hsa; identical to SEQ ID NO: 359903

SEQ ID NO: 741635 - RNA, 64 nt, hsa; identical to SEQ ID NO: 359904

SEQ ID NO: 741636 - RNA, 64 nt, hsa; identical to SEQ ID NO: 359905

SEQ ID NO: 741637 - RNA, 64 nt, hsa; identical to SEQ ID NO: 359906

SEQ ID NO: 741638 - RNA, 64 nt, hsa; identical to SEQ ID NO: 359907

SEQ ID NO: 741639 - RNA, 64 nt, hsa; identical to SEQ ID NO: 359908

SEQ ID NO: 741640 - RNA, 64 nt, hsa; identical to SEQ ID NO: 359909

SEQ ID NO: 741641 - RNA, 64 nt, hsa; identical to SEQ ID NO: 359910

SEQ ID NO: 741642 - RNA, 64 nt, hsa; identical to SEQ ID NO: 359911

SEQ ID NO: 741643 - RNA, 64 nt, hsa; identical to SEQ ID NO: 359912

SEQ ID NO: 741644 - RNA, 64 nt, hsa; identical to SEQ ID NO: 359913

SEQ ID NO: 741645 - RNA, 64 nt, hsa; identical to SEQ ID NO: 359914

SEQ ID NO: 741646 - RNA, 64 nt, hsa; identical to SEQ ID NO: 359915

SEQ ID NO: 741647 - RNA, 64 nt, hsa; identical to SEQ ID NO: 359916

SEQ ID NO: 741648 - RNA, 64 nt, hsa; identical to SEQ ID NO: 359917

SEQ ID NO: 741649 - RNA, 64 nt, hsa; identical to SEQ ID NO: 359918

SEQ ID NO: 741650 - RNA, 64 nt, hsa; identical to SEQ ID NO: 359919

SEQ ID NO: 741651 - RNA, 64 nt, hsa; identical to SEQ ID NO: 359920

SEQ ID NO: 741652 - RNA, 64 nt, hsa; identical to SEQ ID NO: 359921

SEQ ID NO: 741653 - RNA, 64 nt, hsa; identical to SEQ ID NO: 359922

SEQ ID NO: 741654 - RNA, 64 nt, hsa; identical to SEQ ID NO: 359923

SEQ ID NO: 741655 - RNA, 64 nt, hsa; identical to SEQ ID NO: 359924

SEQ ID NO: 741656 - RNA, 64 nt, hsa; identical to SEQ ID NO: 359925

SEQ ID NO: 741657 - RNA, 64 nt, hsa; identical to SEQ ID NO: 359926

SEQ ID NO: 741658 - RNA, 64 nt, hsa; identical to SEQ ID NO: 359927

SEQ ID NO: 741659 - RNA, 62 nt, hsa
ggaaacagaacucgaugcacugaccugcuccgccaggaaagugagcguguagcguccugagg

SEQ ID NO: 741660 - RNA, 62 nt, hsa
gguccggcccauccccaggcaccucacaggccccaggaaaggcccagccaccgaagccgccu

SEQ ID NO: 741661 - RNA, 62 nt, hsa
uguuuccgcucucaauagccccucuuguuuuaccaggaaagauccaguuaaaucacccacug

SEQ ID NO: 741662 - RNA, 62 nt, hsa
uuccugaccaacagccagcucuguccuuccccccaggaaacacauguucauuugugugauca

SEQ ID NO: 741663 - RNA, 62 nt, hsa
gcaaggaaccgguuuauaaaacaacagaacagccaggaaaauggugcuaggagagacagugg

SEQ ID NO: 741664 - RNA, 62 nt, hsa
ugcaccugacuuaugaaauggggauaauacucccaggaaauagcgcaggacaucacaaggac

SEQ ID NO: 741665 - RNA, 62 nt, hsa
caggggcauuugacauccccuccugguucucaccaggaaaacauccaaagcuuuggaggaaa

SEQ ID NO: 741666 - RNA, 62 nt, hsa
cugaagaccaccccagucuaccucggugcuggccaggaaaccuuucggcuaccucucccacc

SEQ ID NO: 741667 - RNA, 62 nt, hsa
aagaucaacaggucccccccacaugaggccacccaggaaaaaaggcaggggcaguggcaucc

SEQ ID NO: 741668 - RNA, 62 nt, hsa
gauucauugccacacucuuuucucccagggacccaggaaacuaggacuuuguguguuugcug

SEQ ID NO: 741669 - RNA, 62 nt, hsa
acuggaauggaaaaguguguuccuguucauagccaggaaacccagcucagcaaacucccuuu

SEQ ID NO: 741670 - RNA, 62 nt, hsa
aguauuaaaacauuggauuauccugagguguaccaggaaaggauuuuauaaugcuuagaaaa

SEQ ID NO: 741671 - RNA, 62 nt, hsa
uuccuugugugugucuuggagugcauuugacuccaggaaaagccauuuugguuuuccuuaac

SEQ ID NO: 741672 - RNA, 62 nt, hsa
acaugaagaaaacuuguauauucuaauguuugccaggaaaggcuagguucaguagaugagac

SEQ ID NO: 741673 - RNA, 62 nt, hsa
cuagaucauggcaaggccugacaacagcugagccaggaaagugcugcugaggcaagucgaca

SEQ ID NO: 741674 - RNA, 62 nt, hsa
ccgugaacugaagaaugguauccagucaucagccaggaaagauggggauucacuuacaugcc

SEQ ID NO: 741675 - RNA, 62 nt, hsa
gcauggguggauuuagccaaggaccuggcaacccaggaaacaugauguuuuaagcugcuaag

SEQ ID NO: 741676 - RNA, 62 nt, hsa
aaucugcgagguaguuucuuugguauucuugcccaggaaauggguugauucaucacagauuu

SEQ ID NO: 741677 - RNA, 62 nt, hsa
agcacuucgucuuacccauuuauguaggggccccaggaaaccuacacacagccagaaugagg

SEQ ID NO: 741678 - RNA, 62 nt, hsa
ccuaauuucuccucccuuccuuuucccugcuuccaggaaacuccacaucugccuuaaaacca

SEQ ID NO: 741679 - RNA, 62 nt, hsa
ggagagucuuuccucacgcuccagcacaguggccaggaaaagaaauacugaauuugccccag

SEQ ID NO: 741680 - RNA, 62 nt, hsa
auuuuuuccaagccaaggagaccauuggccauccaggaaauuucguacagcugaaauauagg

SEQ ID NO: 741681 - RNA, 62 nt, hsa
cugccuccauauauccugaacaucaaacuaucccaggaaaaccaucuagaguaguuuguuuc

SEQ ID NO: 741682 - RNA, 62 nt, hsa
caaauaguauaaacaacacuaaauuuacugugccaggaaaucuuccugaacuccuugaacuc

SEQ ID NO: 741683 - RNA, 62 nt, hsa
ccucugcugcuguccaugacuguccuuuugaaccaggaaaagucacagaguuuaaagagaag

SEQ ID NO: 741684 - RNA, 62 nt, hsa
caaucccaaggauggaggcugugcccagagccccaggaaaaugggagugagaagaugccugg

SEQ ID NO: 741685 - RNA, 62 nt, hsa
uagcuucuccuacagugauucaugucccagguccaggaaauccaauguuggugaaggcagcc

SEQ ID NO: 741686 - RNA, 62 nt, hsa
acgaaggguuuuuagccagggaaaacugagccccaggaaaaccuaaccacugggcaggcaga

SEQ ID NO: 741687 - RNA, 62 nt, hsa
uggccaugcuuaagccagcaauuggcugggguccaggaaacaaagcaaaagcacaauaugug

SEQ ID NO: 741688 - RNA, 62 nt, hsa
cccuucuccucugccugguuagacucgggcacccaggaaagccuggccagggcuccuuuggg

SEQ ID NO: 741689 - RNA, 62 nt, hsa
cguguccccagggacuucuaaagcuuggggcuccaggaaaucauccaguagaguuggagauu

SEQ ID NO: 741690 - RNA, 62 nt, hsa
agccagugucuuucugagguaaauaauuucugccaggaaacuucccagccccaccagcagcc

SEQ ID NO: 741691 - RNA, 62 nt, hsa
acgcaagccugaggacccuccccuaccaaggaccaggaaaagcagcagcugccugcucucca

SEQ ID NO: 741692 - RNA, 62 nt, hsa
gaagaugagucuauggcaucagguucuuaaacccaggaaagcaccuacagaccggcuccucc

SEQ ID NO: 741693 - RNA, 62 nt, hsa
acaguugacaaacugucauucaacaauuagcuccaggaaauaacaguuauuucaucauaaaa

SEQ ID NO: 741694 - RNA, 62 nt, hsa
ucccagcgccagauucaucaugucuguugugaccaggaaagcugcccccaucugcaggaagc

SEQ ID NO: 741695 - RNA, 62 nt, hsa
ggagacuggaggugguggggcuugaaaugagcccaggaaaccagagcagugagggcgggcgg

SEQ ID NO: 741696 - RNA, 62 nt, hsa
gcuagcuguagugugacacauuguaguguuugccaggaaaggagccagucaugccggaaaca

SEQ ID NO: 741697 - RNA, 62 nt, hsa
ccccucuggguggacaugcacccauccccaguccaggaaaccaucucccccaggaccuucug

SEQ ID NO: 741698 - RNA, 62 nt, hsa
aacaaguucccaggugaugcugugcugcuuguccaggaaacacaauuugagagucaugugaa

SEQ ID NO: 741699 - RNA, 62 nt, hsa
uauugaggaaucaucuagaacaauuaagccgaccaggaaaccucauuccuaccuacacugga

SEQ ID NO: 741700 - RNA, 52 nt, hsa
uggccgaagcagcuucauagaaccaggaaaccuuuuaaauagccaguuugaa

SEQ ID NO: 741701 - RNA, 62 nt, hsa
ugugaaaauuacaaaucugaagaacauaguguccaggaaagugguuuagcacgaagaggccc

SEQ ID NO: 741702 - RNA, 62 nt, hsa
agacagcuuacuuggcucaucguucagggaacccaggaaaaugggaggagaacgccgcgugg

SEQ ID NO: 741703 - RNA, 62 nt, hsa
cucucaaaaggaacuugggaaacuugugaaacccaggaaaaccuuuagucuuauaccucaac

SEQ ID NO: 741704 - RNA, 62 nt, hsa
cccuagagggcccuugucugagaaaccccaaaccaggaaaccccaccuacccaaccauccac

SEQ ID NO: 741705 - RNA, 62 nt, hsa
gcgauuuuggaggaaacaagaaucccaagggcccaggaaaaccccaucuugaugcaugaguu

SEQ ID NO: 741706 - RNA, 62 nt, hsa
ugggaaacuuacauguugagaucuacagagauccaggaaaccaaagcccugcugagcagagc

SEQ ID NO: 741707 - RNA, 62 nt, hsa
aguuuucaagggguauuacucaggcacuaaccccaggaaagaugacagcacauugccauaaa

SEQ ID NO: 741708 - RNA, 62 nt, hsa
cccaggcacccagaugauuccuauggcaccagccaggaaaaauggcagcucuuaaaggagaa

SEQ ID NO: 741709 - RNA, 62 nt, hsa
cgaccuuuggaaaacguuagcgguguaacaguccaggaaacuguuuuuuuuuguuguuguug

SEQ ID NO: 741710 - RNA, 62 nt, hsa
uguggggagcagggcugugacucuggcugagcccaggaaagcgacaagggugaacugggaga

SEQ ID NO: 741711 - RNA, 62 nt, hsa
ucugggaaauuagaaaaaguggggugaucuuuccaggaaaaacauguguaacaucugcuuau

SEQ ID NO: 741712 - RNA, 62 nt, hsa
gaacagccuuguccaggcagaacagucauaagccaggaaaugaaacaaaggaaaacaggugc

SEQ ID NO: 741713 - RNA, 62 nt, hsa
uuuauuucucucaucuguuacacaaagaaccaccaggaaagcaaaucaguuugguugguaac

SEQ ID NO: 741714 - RNA, 62 nt, hsa
auguagcuggcaagcugcaaaaggccugugauccaggaaagaugucccacagggaccacauc

SEQ ID NO: 741715 - RNA, 62 nt, hsa
cuuguuccugagaaggguggguaacagauauuccaggaaaaagaaugcacauugaauggaug

SEQ ID NO: 741716 - RNA, 62 nt, hsa
caaaagagaagcagucugggccagaugcccugccaggaaagggacauggacccacgugcuug

SEQ ID NO: 741717 - RNA, 62 nt, hsa
ucucuuccugaucuucccugcccauuggguacccaggaaacugcaagcauugccuguguucc

SEQ ID NO: 741718 - RNA, 62 nt, hsa
ucccucugaucauuuccaguugauugucauauccaggaaaaaauggaacagugcacucuucu

SEQ ID NO: 741719 - RNA, 62 nt, hsa
gucuuccuucauccuuaaaggucuuugugaccccaggaaaauauugacucugucuaacacac

SEQ ID NO: 741720 - RNA, 62 nt, hsa
agcaaacgcagugaguaucaaccugauuguugccaggaaauccuuaugaauuaaaacaaugc

SEQ ID NO: 741721 - RNA, 62 nt, hsa
agccugcgugggagaaccccaauucuagcacuccaggaaacugugggagaguguggggcagg

SEQ ID NO: 741722 - RNA, 62 nt, hsa
uuuuuuaaagauggauuuaaaccaagaugccuccaggaaagaggacgaaaugaguauauuca

SEQ ID NO: 741723 - RNA, 62 nt, hsa
gacuuucuaguucuagaaguuccgcugcaaggccaggaaagcuugagaaagguauuguggaa

SEQ ID NO: 741724 - RNA, 62 nt, hsa
agacaugugauagcaaaagaaacaaacaaaagccaggaaaacacucauuuucgccuugaaua

SEQ ID NO: 741725 - RNA, 62 nt, hsa
uugguugaacugaacauaucuugucuuagcacccaggaaacagaacuuuaagauauauacag

SEQ ID NO: 741726 - RNA, 62 nt, hsa
uuuuucaauuccagauuuuuaauuuuaaggcuccaggaaagaaaggagaguagaacauuuuu

SEQ ID NO: 741727 - RNA, 62 nt, hsa
aaucuaggcagugaacaagucuucauccuggcccaggaaauagccuauuaaaaaaugcuguc

SEQ ID NO: 741728 - RNA, 62 nt, hsa
ggaggaugacaagccgcugcccaccuccaagcccaggaaacaguacaagauggcuaaggaga

SEQ ID NO: 741729 - RNA, 62 nt, hsa
ccaaggaggagcggcgcauggaccagaugaugccaggaaagaccaaagcagaugcugcugac

SEQ ID NO: 741730 - RNA, 62 nt, hsa
aagcagccaugagaaggaaggauucaccaccuccaggaaaagguaaauuugccaauacaaau

SEQ ID NO: 741731 - RNA, 60 nt, hsa
uuacguggaagaaacgcuaaggguuugcucccaggaaaggagaggaagagcuauauauau

SEQ ID NO: 741732 - RNA, 62 nt, hsa
ccccaauuuucagguaguacuaagaguaugugccaggaaacucuugcuauugaauugagaug

SEQ ID NO: 741733 - RNA, 62 nt, hsa
aaacaugcugccaaccagcuuguccaacaacuccaggaaaacuguuuuucaaaacgccaugu

SEQ ID NO: 741734 - RNA, 62 nt, hsa
aagugcacaaauucuguaguuugccguaucauccaggaaaaccugagggaaaaaaauuauag

SEQ ID NO: 741735 - RNA, 62 nt, hsa
gaauucggagcuagaggacauggaaaauaaagccaggaaagucaaaaaaacgaaagagaagg

SEQ ID NO: 741736 - RNA, 62 nt, hsa
acugcagguugugcccuguggcugccugcaccccaggaaaggagggggcucaggccauccag

SEQ ID NO: 741737 - RNA, 62 nt, hsa
ugauugauuuuaggaggcccacaccaaacuccccaggaaaugacugccuuccuugggaccaa

SEQ ID NO: 741738 - RNA, 62 nt, hsa
aaguguuuuccggcugauaaggcuaacccuacccaggaaaggauugauaacuaaauaaauuu

SEQ ID NO: 741739 - RNA, 62 nt, hsa
cuaggccccaguucuuccuccuucccccuuucccaggaaaggccagcccaguccauggccuu

SEQ ID NO: 741740 - RNA, 62 nt, hsa
gagccacccacuugccauuugcuccuguccuuccaggaaaucacaauuuucaucagagccca

SEQ ID NO: 741741 - RNA, 62 nt, hsa
cauuaugcuguacuaucuacccauaaauaccuccaggaaacauuccccucuugguaauuugu

SEQ ID NO: 741742 - RNA, 62 nt, hsa
gugugaaagguuacuuaauuaaauuacaaccaccaggaaauugacugcuuuuuuuuuuuuuu

SEQ ID NO: 741743 - RNA, 62 nt, hsa
uuuggcaggacacagagagguaggugaacauuccaggaaagaagcagcuuagagaaaaugug

SEQ ID NO: 741744 - RNA, 62 nt, hsa
gcuuguauuuuaagacauucauuaaaaagaaaccaggaaacacuuuugaaauaacagcauaa

SEQ ID NO: 741745 - RNA, 62 nt, hsa
agaguuauugaaaugcauggguagaaauugaaccaggaaaaucaguaaagugauuguaaaaa

SEQ ID NO: 741746 - RNA, 62 nt, hsa
gcauuuugguccaaguugugcuuaucccauagccaggaaacucugcauucuaguacuuggga

SEQ ID NO: 741747 - RNA, 62 nt, hsa
uuuuuuaagauuuguucauaaaauggucugauccaggaaaaauaaaaugggaacauggacac

SEQ ID NO: 741748 - RNA, 62 nt, hsa
aauauuuagccccucuguucugugcuuacuggccaggaaaugguaccaauuuuucaguguug

SEQ ID NO: 741749 - RNA, 62 nt, hsa
uauuacaagcaauccccaaauuuuauggucuuccaggaaaaguuauuaccguuuaugauacu

SEQ ID NO: 741750 - RNA, 62 nt, hsa
uacuguuucuguugccuggacaguuacaguuuccaggaaacaucaggaaguaggaaacugua

SEQ ID NO: 741751 - RNA, 62 nt, hsa
gccuugugacuguucuuuaaggcugaagauauccaggaaagggggcuuggacacuggccaag

SEQ ID NO: 741752 - RNA, 62 nt, hsa
caaauuagaaugcuuauaaugagacccaaucuccaggaaaacaacacucacauaaguuuaau

SEQ ID NO: 741753 - RNA, 62 nt, hsa
cugccagaggaagaucuggcgucacauggcucccaggaaagugcugugcccuauccccacug

SEQ ID NO: 741754 - RNA, 62 nt, hsa
agugacuccaagaagaguuccggcagcuuuccccaggaaagggugaggggugacacucggcu

SEQ ID NO: 741755 - RNA, 62 nt, hsa
agaaaaaggucugaggcagaauccaagaucugccaggaaacacacaacaaaacaucugcugu

SEQ ID NO: 741756 - RNA, 62 nt, hsa
aggugcuuugagcaguucugaaaaaugcaguuccaggaaagcaacugcuuugguuccuaagg

SEQ ID NO: 741757 - RNA, 62 nt, hsa
ccugugccaaaguccugucaggcuggugggcaccaggaaaggccugcacccucuuccugcuc

SEQ ID NO: 741758 - RNA, 62 nt, hsa
acccaaaggagcugccgcacugacccagccccccaggaaacagugagacaagaaucaaguau

SEQ ID NO: 741759 - RNA, 62 nt, hsa
acauggcgcaugaaggagagcccagucucccuccaggaaaggccugaggauguaagucaggc

SEQ ID NO: 741760 - RNA, 62 nt, hsa
ggagcuaagcugggaugccacauaggcagaagccaggaaaaaugaccaaccacagaaccaag

SEQ ID NO: 741761 - RNA, 62 nt, hsa
aucuguuaccuguacgcuguauuaaaauagaaccaggaaaggcucaggauuucagacauuuc

SEQ ID NO: 741762 - RNA, 62 nt, hsa
gagcagucaaguguucaggccacacagucagcccaggaaaaagagaagcagggccaaaugga

SEQ ID NO: 741763 - RNA, 62 nt, hsa
cucaauaucuaucucagaggaaauaugguuacccaggaaagaaauggucugcuagagugaua

SEQ ID NO: 741764 - RNA, 62 nt, hsa
aaaaugccagggccaggcuguguauuucuuucccaggaaauuagcuuuccagccccuuuaua

SEQ ID NO: 741765 - RNA, 62 nt, hsa
ccgacccugccacagguuccuggaaagacucuccaggaaauggaagauacugauuuuuuuuu

SEQ ID NO: 741766 - RNA, 62 nt, hsa
caauugauauauaauaaccguucuaaccucuuccaggaaaauauuuuuagaacuacuagcuu

SEQ ID NO: 741767 - RNA, 62 nt, hsa
uuucaaaaugguauuuugaugccaucaaaugcccaggaaauugacuuugcagugucaccacu

SEQ ID NO: 741768 - RNA, 62 nt, hsa
aaauaaagaagcugccaccuaacaggagucacccaggaaagcaccgcacaggcuggcgcggg

SEQ ID NO: 741769 - RNA, 62 nt, hsa
cugaaugcaagcaguuuauaugggagaugauuccaggaaauaccgauaugagaauggggaaa

SEQ ID NO: 741770 - RNA, 62 nt, hsa
gcagcucagaauuauucuggaaagaaagccugccaggaaauaaauucaaauacaguaugagc

SEQ ID NO: 741771 - RNA, 62 nt, hsa
gcacacucuggagaccuugcuggcagugcuagccaggaaacagagugaccaagggacaagaa

SEQ ID NO: 741772 - RNA, 62 nt, hsa
uuagcuuguccuaaaucuugcuguccacccuuccaggaaagggacauuguaaaugaauaaaa

SEQ ID NO: 741773 - RNA, 62 nt, hsa
agucaacaaaaauugggcuaagucacuuuuccccaggaaagaauauuucccucuccugcauc

SEQ ID NO: 741774 - RNA, 62 nt, hsa
acagcaaagaugaugggcucugcacaccaacuccaggaaacucauucugggccagcucuaug

SEQ ID NO: 741775 - RNA, 62 nt, hsa
ugacugaauguugguaggugcuccauuacaauccaggaaagucuguguuacugauauuugug

SEQ ID NO: 741776 - RNA, 62 nt, hsa
caugcccagucagaaaucuguucuauucugcuccaggaaaaucggaaaccugugagucagag

SEQ ID NO: 741777 - RNA, 62 nt, hsa
agcccagcccagccugacguggauguggcugcccaggaaaagacuuaacugugaaaaaguac

SEQ ID NO: 741778 - RNA, 62 nt, hsa
agccggucucaaagauaacugcauccuucauuccaggaaagcccuagaauuagggcacauug

SEQ ID NO: 741779 - RNA, 62 nt, hsa
acccagaauacuugccgccugcuuuuuguccuccaggaaaccagaagcccggguaauuaggu

SEQ ID NO: 741780 - RNA, 62 nt, hsa
ugggcucagcacauuuuacuguuaguagagagccaggaaacguuuucuggguuggggauuuu

SEQ ID NO: 741781 - RNA, 62 nt, hsa
agaugccuuggccauggcacaagagaaaccagccaggaaaaaccagacagacuuucacacua

SEQ ID NO: 741782 - RNA, 62 nt, hsa
cuuaagagccaaaggaaggaagugguugagggccaggaaagagaaggaaugucaugccaggg

SEQ ID NO: 741783 - RNA, 62 nt, hsa
ccgcucccugccaccauccuccuuccugggcuccaggaaaguguuucugggaggucaggagg

SEQ ID NO: 741784 - RNA, 62 nt, hsa
ggauuaaagaggggaggagagagugcagagcuccaggaaaggguaucagagcugcagccagc

SEQ ID NO: 741785 - RNA, 62 nt, hsa
auucuccaacuccaaacaagcucuagagugcuccaggaaaaguuauauucaguauaugaaua

SEQ ID NO: 741786 - RNA, 62 nt, hsa
uuuuuaguguuuuuucagauauaaaucgggguccaggaaauccucaccagaaucuggcacug

SEQ ID NO: 741787 - RNA, 62 nt, hsa
cuggccuggaggaguucgggaaggaggauagaccaggaaauaaagggucaacagagcugugu

SEQ ID NO: 741788 - RNA, 62 nt, hsa
gauggggggcacaggagcugggagccccgucuccaggaaaaggagagggguuaagaugcacc

SEQ ID NO: 741789 - RNA, 62 nt, hsa
guaacaaaguaugcuuugccuguuuccacuuaccaggaaauuccuucagaacuagauuagca

SEQ ID NO: 741790 - RNA, 62 nt, hsa
ccacaggcaguuacuucugagggcaucuugguccaggaaaugugcacaaaauucgaccugau

SEQ ID NO: 741791 - RNA, 62 nt, hsa
ugaaauggagaauuucaggucuccacgucugcccaggaaagaacuucagcugacuccacggg

SEQ ID NO: 741792 - RNA, 62 nt, hsa
cccaucaacaaccguccugcuccccaccucccccaggaaauaaggggccugcuccucucccu

SEQ ID NO: 741793 - RNA, 62 nt, hsa
aaagacuaauggggagagggagggccgggaagccaggaaagcuugguguuuucucuggguac

SEQ ID NO: 741794 - RNA, 62 nt, hsa
acugaagaaacugccgcucugagacugcacauccaggaaaaaagacuaggacuugccacaca

SEQ ID NO: 741795 - RNA, 62 nt, hsa
cuugcaagugugcaugguucaaucccucacauccaggaaaugaauuuugcaauugggccaga

SEQ ID NO: 741796 - RNA, 62 nt, hsa
ggauuuuaguuuugugcuuaguuaaaucuuuuccaggaaaaagaacuuccccauacaaauaa

SEQ ID NO: 741797 - RNA, 62 nt, hsa
guuuugguuccuuuugcagagugaaaugccucccaggaaaaaaauacauauguauuuuuuug

SEQ ID NO: 741798 - RNA, 62 nt, hsa
uauguguugcuaaaacacaugcuaugagcacuccaggaaacacuauauuuuuuccaaaaaau

SEQ ID NO: 741799 - RNA, 62 nt, hsa
guaccaacacuugaaagauggguggauauuuuccaggaaacagauuuugggcaggacauucc

SEQ ID NO: 741800 - RNA, 62 nt, hsa
uaggauuuggaagacaggaacggcacaggcguccaggaaagcagcugcacucagacaaugcc

SEQ ID NO: 741801 - RNA, 62 nt, hsa
uuuguuuuguuuuuuacaagauauaacauaacccaggaaacagacccagcugagguuauucu

SEQ ID NO: 741802 - RNA, 62 nt, hsa
uaauaauacauuuauguugacaccucccuaauccaggaaacauucacaaacaaggacuccca

SEQ ID NO: 741803 - RNA, 62 nt, hsa
accuuugaacagaucccggugacauucuauuuccaggaaaauccggaaccugauuuuaguuc

SEQ ID NO: 741804 - RNA, 62 nt, hsa
cauuuuaugcugaucuucaguucauaauucuuccaggaaaacucagucuuccaacugcaaua

SEQ ID NO: 741805 - RNA, 62 nt, hsa
caauggagaucaugacacuacuguuaauaaggccaggaaaacugccauuucaaguucugaaa

SEQ ID NO: 741806 - RNA, 62 nt, hsa
ugcuggacuuggcucagugcuauaaauuguagccaggaaauaagaagagcuuacacagaguc

SEQ ID NO: 741807 - RNA, 62 nt, hsa
gcuggcaaacaccaggcugcggcuuggauuaaccaggaaagaaagcuuuucucacugaguug

SEQ ID NO: 741808 - RNA, 62 nt, hsa
guauuuuauuacugcauaauagauggugaaacccaggaaaauuaaguacuugugcauggccc

SEQ ID NO: 741809 - RNA, 62 nt, hsa
gggccagagaagauaauguucuuuaauguuguccaggaaacccuggcuugcuugccgagccu

SEQ ID NO: 741810 - RNA, 62 nt, hsa
ucucuuguagaagauggacucugaaaaacauuccaggaaaccauggcagcauggagagccuc

SEQ ID NO: 741811 - RNA, 62 nt, hsa
auauuuccuguucacuugugcaugggcuaaaaccaggaaaacuuccuugucuuauuacuuua

SEQ ID NO: 741812 - RNA, 62 nt, hsa
uuagcuggaguaggagucugggaguggagaccccaggaaacagcaugaggugagggugugag

SEQ ID NO: 741813 - RNA, 62 nt, hsa
gagcauggguccuuguucuuccuauuucaccuccaggaaagcaaaagugggagcagaaauuc

SEQ ID NO: 741814 - RNA, 62 nt, hsa
uccaacugccaaauucugcuucccucugaaccccaggaaauacuuucuggagaggcuugucu

SEQ ID NO: 741815 - RNA, 62 nt, hsa
cauuccacaaucuauggcuuccaccagcuagcccaggaaauacuugaaaucagcauuccaau

SEQ ID NO: 741816 - RNA, 62 nt, hsa
ggguggguaagaguccaugggggugcccagucccaggaaaggggacaaugaagggacaggcc

SEQ ID NO: 741817 - RNA, 62 nt, hsa
uuacuccccagcccagagagacgcugcuuuuaccaggaaagacuauugaaagauguuuuauu

SEQ ID NO: 741818 - RNA, 62 nt, hsa
aucuguauguaucaauacaggguuuuuccaagccaggaaacgcccuccuuggcuacuaggag

SEQ ID NO: 741819 - RNA, 62 nt, hsa
uauuuauuuaacuuacuuaucuggucaaagccccaggaaaccuaccaaagcuagaauuaaug

SEQ ID NO: 741820 - RNA, 62 nt, hsa
agcccuuggcucccucuugcucguuguucucaccaggaaaguacacgggccugaggcaggau

SEQ ID NO: 741821 - RNA, 62 nt, hsa
guguguguguguuuaauaugauuuagugacaaccaggaaaacuuacuugggauuauuagcac

SEQ ID NO: 741822 - RNA, 62 nt, hsa
gcauuggaggauggggguccugguaugucucaccaggaaauucuguuuauguucuugcagca

SEQ ID NO: 741823 - RNA, 62 nt, hsa
uguuuugaaaagaguaauuuaacuuuugggugccaggaaauggguuuucucaaaguccauug

SEQ ID NO: 741824 - RNA, 62 nt, hsa
uauuuuucuaauaaauaggaccauuauuacuaccaggaaagucuuauuuauuuugccugaaa

SEQ ID NO: 741825 - RNA, 62 nt, hsa
gcaacugaagaacugcagccaagaccuuaauuccaggaaagcacagaggacaaaguuaauuc

SEQ ID NO: 741826 - RNA, 60 nt, hsa
cugugugcaccaaggucugaaaaaugacuuccaggaaaggaagcaugguauauaacagga

SEQ ID NO: 741827 - RNA, 62 nt, hsa
agcaggagucagggggcuguacccugggggugccaggaaaugcucucugaccuaucaauaaa

SEQ ID NO: 741828 - RNA, 62 nt, hsa
ucccgcucuccugcuuaccuaggaggugagugccaggaaaauacaccaaaugcuucuaguau

SEQ ID NO: 741829 - RNA, 62 nt, hsa
accuagcacacugccuaguacauaguagaaguccaggaaauggaagccauuauuauguaaaa

SEQ ID NO: 741830 - RNA, 62 nt, hsa
uauugugacaacauuccaguacucugaaauagccaggaaacuucuuugaauggaauuugacu

SEQ ID NO: 741831 - RNA, 62 nt, hsa
cuaggaauucuugacguggggucucuggagcuccaggaaauucgggcacaucauauguccau

SEQ ID NO: 741832 - RNA, 62 nt, hsa
gcucuccaccagcacaucacuaugcaucuguuccaggaaagaagaaaagcgagcgaggaaga

SEQ ID NO: 741833 - RNA, 62 nt, hsa
aagaguugugucuuuuguggccagugacaaauccaggaaaugaauguugcugauagggauaa

SEQ ID NO: 741834 - RNA, 62 nt, hsa
uggagcugaucaaggucauguuucucacuguuccaggaaauugaucaacucuuccaauggga

SEQ ID NO: 741835 - RNA, 62 nt, hsa
guaauauaaaggacuaggaagcagucauacuuccaggaaaugcuuggauucauguggacauu

SEQ ID NO: 741836 - RNA, 62 nt, hsa
uuggccucuuugauacacuuuugcuugccuccccaggaaagaaggaauugcauccaagguau

SEQ ID NO: 741837 - RNA, 62 nt, hsa
cauuuguucaaaaguuagaacaucuggcugcaccaggaaaaaaaaaaaaaaaaaguccuguu

SEQ ID NO: 741838 - RNA, 62 nt, hsa
gcuuuccaccgaguacuguguuuauucucucuccaggaaagcagaucaaaagaaaguuagca

SEQ ID NO: 741839 - RNA, 62 nt, hsa
ugagagaugaagcaucauauugacaacuuacuccaggaaaaaagguguguguauaggugugu

SEQ ID NO: 741840 - RNA, 62 nt, hsa
gaaaacauaaauaucugccacauaaaagaaguccaggaaaauaacacguaauaagacuguuc

SEQ ID NO: 741841 - RNA, 62 nt, hsa
cuguccuuauaacgccuuauacgcauacacagccaggaaacguggagcauuguuucucacag

SEQ ID NO: 741842 - RNA, 62 nt, hsa
guggggugggguggggugggggcugucuguguccaggaaacuuaauucccuggugacuagag

SEQ ID NO: 741843 - RNA, 54 nt, hsa
cagguuugggaagcaauugaauuuccaggaaauauccauccaugaauuaugcca

SEQ ID NO: 741844 - RNA, 62 nt, hsa
aacuuucuggagaggugccaaacuugguguggccaggaaagggcaguccugagggagaagac

SEQ ID NO: 741845 - RNA, 62 nt, hsa
uccaaggaagggauguauuuguaguguuauugccaggaaaggagaguacuuugguuucugag

SEQ ID NO: 741846 - RNA, 62 nt, hsa
uaaaaagggaauuuaggauccaccaucgguggccaggaaaauagcagugacaauaaacaaag

SEQ ID NO: 741847 - RNA, 62 nt, hsa
uuggauaauaaaaauuguagcuuuuuauuaagccaggaaacaugaagcauaauuuguuuaaa

SEQ ID NO: 741848 - RNA, 62 nt, hsa
ccuugaaagaaucaacuucuaaccucaaccauccaggaaauugacaguggcugcaguauuga

SEQ ID NO: 741849 - RNA, 62 nt, hsa
aacuuuucaaagcccaccaauccacauuuucuccaggaaauuaaauauuuaaguaagugagu

SEQ ID NO: 741850 - RNA, 62 nt, hsa
uuucuguuccuccccgagaggcccucuggcccccaggaaaccuguugugcagagcucuuccc

SEQ ID NO: 741851 - RNA, 62 nt, hsa
uaauaugcuuuccagcuagaggggagaaaacaccaggaaagaggaacccugggucauaaaau

SEQ ID NO: 741852 - RNA, 62 nt, hsa
aauggauagaaacaaaauucucuaguacucauccaggaaaccauucuucaauguugcaugug

SEQ ID NO: 741853 - RNA, 62 nt, hsa
uaacauauuuacucuugucuaacuuaagagugccaggaaagcagaugcuuagauuuuguguc

SEQ ID NO: 741854 - RNA, 62 nt, hsa
aaagcuggagugugaggcaggaggcuggaaacccaggaaagcugauggugcaagguccaguc

SEQ ID NO: 741855 - RNA, 62 nt, hsa
gagagcuaugauguccuaggacugagaguaccccaggaaagaauacccuugaaagggucucc

SEQ ID NO: 741856 - RNA, 62 nt, hsa
acucgaggggagaagucgcgcccccagggaagccaggaaacucugacacagaacgcccaacg

SEQ ID NO: 741857 - RNA, 62 nt, hsa
gccgcugcaggaaacauuucugacaccgucgaccaggaaagccacacggagaggccacugug

SEQ ID NO: 741858 - RNA, 62 nt, hsa
uuuuuaaguaaaguuuguagcuccucccaugcccaggaaagcacagaacucaaguguggugg

SEQ ID NO: 741859 - RNA, 62 nt, hsa
gguuaaaagagccuuuuggacagaaaacugggccaggaaaaggcaucucagaccacaaauag

SEQ ID NO: 741860 - RNA, 62 nt, hsa
uggggaagucagcugaaacuugucuuguuuugccaggaaaggaaguaguugccuuuggucau

SEQ ID NO: 741861 - RNA, 62 nt, hsa
guucguaccagcaaguagacuaggaacugagcccaggaaagggggauguuuuccugguguuu

SEQ ID NO: 741862 - RNA, 62 nt, hsa
caugucacuaaacaagaaaucugacaauagugccaggaaacuaauuuccugauacauuaaaa

SEQ ID NO: 741863 - RNA, 62 nt, hsa
ucccgcgcccccaccccagaccccgagccaccccaggaaaagcacaaggacugccgccuucu

SEQ ID NO: 741864 - RNA, 62 nt, hsa
cccugaagcaguuguucaaacuuuguucaauaccaggaaauuuauauuggagaaaaacccua

SEQ ID NO: 741865 - RNA, 62 nt, hsa
cucauucacccaacaaaacugugucuuaucugccaggaaagaccagccucacuccugggaac

SEQ ID NO: 741866 - RNA, 62 nt, hsa
aaugggaugucaccuaccaaaauccaaauccuccaggaaaaacuacuacacuaaauggacca

SEQ ID NO: 741867 - RNA, 62 nt, hsa
uccauuucucuucuuugaccgugcuaggaauuccaggaaagugcauuccugcccuggugacc

SEQ ID NO: 741868 - RNA, 62 nt, hsa
ucuagaauugggcuuguacagaaggauaaaacccaggaaaauggauauuucuauucagauuu

SEQ ID NO: 741869 - RNA, 62 nt, hsa
cagaagccacauccgcacaauuuuccacuuaaccaggaaauauuucuccucuaaaugcauga

SEQ ID NO: 741870 - RNA, 62 nt, hsa
ucauauuacuaggacuuaauauaguggcauacccaggaaaugcuuaguaaguguucccuuca

SEQ ID NO: 741871 - RNA, 62 nt, hsa
agggucucuugcccaucucuccggccaccccgccaggaaacgacgagaaggccgaggaaucc

SEQ ID NO: 741872 - RNA, 62 nt, hsa; identical to SEQ ID NO: 741859

SEQ ID NO: 741873 - RNA, 62 nt, hsa
ggagggcauuuggaaggagcagugaagccaagccaggaaacaccaagauggcgagccagugu

SEQ ID NO: 741874 - RNA, 62 nt, hsa
cgacugguguuugaucacgaugggaaaaucauccaggaaacccccuacccccaccccagagg

SEQ ID NO: 741875 - RNA, 62 nt, hsa
gcgcugcaccaacauugggggccuggagcucuccaggaaagccaagcuggcggccaccgcag

SEQ ID NO: 741876 - RNA, 62 nt, hsa
ccugcucaguguggcuggagguugaaaugccaccaggaaaaugccacuucauaauugaaagg

SEQ ID NO: 741877 - RNA, 62 nt, hsa
cuccuguagggcaccucccugccccuagccucccaggaaauggugcucuccuggcccugccu

SEQ ID NO: 741878 - RNA, 62 nt, hsa
auacuggggaguaaacggcccaggccaggugcccaggaaaggacggcugagcauguggagcg

SEQ ID NO: 741879 - RNA, 62 nt, hsa
gcccucugcccucuugcugcuucuccacauugccaggaaaagcugcugacgccugcccuccu

SEQ ID NO: 741880 - RNA, 62 nt, hsa
cuagcugagagggccuggcccuggggugggcuccaggaaaacgcugguuaggccugggauug

SEQ ID NO: 741881 - RNA, 62 nt, hsa
cuugucauucuacuuucuauauuguuaucaguccaggaaacagguaaacagauguaauuaga

SEQ ID NO: 741882 - RNA, 62 nt, hsa
gggguguggaaaaggugauccuuuacccccacccaggaaaaccugcauugugcuagcaugga

SEQ ID NO: 741883 - RNA, 62 nt, hsa
cauaaugcuucccauugaagggaaguugagaaccaggaaagcugcuuucacgucauugccau

SEQ ID NO: 741884 - RNA, 62 nt, hsa
cuguacugguuuaaauaaguuuaccuuuuccuccaggaaauauaaugauuucugggaacaug

SEQ ID NO: 741885 - RNA, 62 nt, hsa
uacuuuauuuauuguucccuugaaaugacugaccaggaaaaagaucauccuuaaauuuugaa

SEQ ID NO: 741886 - RNA, 62 nt, hsa
gagauuuguuaaaacgguuaggacuguuuuguccaggaaagauaagaggaccaaacauauaa

SEQ ID NO: 741887 - RNA, 62 nt, hsa
ugacauauauaaauuaagcauaaaauauguaaccaggaaaagacuguuaacauuacauuuau

SEQ ID NO: 741888 - RNA, 62 nt, hsa
ucauagaauaacaacugcugggaauauccgugccaggaaaagaaaaauuucuggcaaauauu

SEQ ID NO: 741889 - RNA, 62 nt, hsa
auggaaaguggaagacauauaccaauuauauuccaggaaaaaauacuuuaauaguauuguua

SEQ ID NO: 741890 - RNA, 62 nt, hsa
gaccagaaaaaguuccaucuaaaauaucaugcccaggaaagcacaugggaucaaaaguaaaa

SEQ ID NO: 741891 - RNA, 62 nt, hsa
gaaggggauuuggagggaggcugucgucgcccccaggaaagacgggccugggggaggcggga

SEQ ID NO: 741892 - RNA, 62 nt, hsa
aaaaucccuugugauuggauguuuacuaucugccaggaaacugguacucaagauguugaagc

SEQ ID NO: 741893 - RNA, 62 nt, hsa
ccccuccccaggcuggagacccccccccaacuccaggaaagagcagucagaguccagugcuc

SEQ ID NO: 741894 - RNA, 62 nt, hsa
cggccuauuuccuugccaggccuguuuccccaccaggaaaugagauaggaggacuggaugag

SEQ ID NO: 741895 - RNA, 62 nt, hsa
agaguuuaaacaaaaaacccacaauugaacuuccaggaaagugugaagacccaaaacagcuu

SEQ ID NO: 741896 - RNA, 62 nt, hsa
gaaagauuuuuguaaaaagucaguauuuauuuccaggaaaagccugaccuugcuauuugaac

SEQ ID NO: 741897 - RNA, 62 nt, hsa
aaguacugcuaucucgcauucuucucagguugccaggaaauguuucucuaacccuuucaaaa

SEQ ID NO: 741898 - RNA, 62 nt, hsa
acacuuaaagcaacaaccaacuaguaacagcuccaggaaaggggaaugaaucaacucuuggu

SEQ ID NO: 741899 - RNA, 62 nt, hsa
ucuggcauccauaugaggaaaaaugcucagcuccaggaaagauggggaguccaaguggauua

SEQ ID NO: 741900 - RNA, 62 nt, hsa
uaguggaagaggagagcaugaagcaaagaauuccaggaaacccaagaggcugagaauucuuu

SEQ ID NO: 741901 - RNA, 62 nt, hsa
gccagcucugagucccaggcagcuggacaucuccaggaaaccaggccaucugggcaggaggc

SEQ ID NO: 741902 - RNA, 62 nt, hsa
aagaaguugcaguauggauaucuuucacccucccaggaaacucuuucaaaccuaaucuguac

SEQ ID NO: 741903 - RNA, 62 nt, hsa
ggcaggggucugcuucaggaaauggaagcuguccaggaaaugagcagagauucacaagacag

SEQ ID NO: 741904 - RNA, 62 nt, hsa
uguuagcgggcaggggagccauugugggguccccaggaaagggcaagggcucagccacaucu

SEQ ID NO: 741905 - RNA, 62 nt, hsa
ucaauuaaaaacuucccaggauuucuuuggacccaggaaacagccauguggguccuuucugu

SEQ ID NO: 741906 - RNA, 62 nt, hsa
cugucuguuauuuucuguacauugugguagguccaggaaauaugacauuuucccccuugaug

SEQ ID NO: 741907 - RNA, 62 nt, hsa
cuucucgcugcccuuccaagcccggcuuugggccaggaaaggcuuccccagguggcucuucu

SEQ ID NO: 741908 - RNA, 62 nt, hsa
cgcguguggagagagccgcacaccagcgccacccaggaaaggcggagcgguuaccaguguuu

SEQ ID NO: 741909 - RNA, 62 nt, hsa
cacaggacaggcuggugcaccuccaggcugugccaggaaacccgcugccuuugcgucaccac

SEQ ID NO: 741910 - RNA, 62 nt, hsa
uaaaaagaauuuacaugauagguuaacaaggaccaggaaagugaguuuccugaaggaguucu

SEQ ID NO: 741911 - RNA, 62 nt, hsa
ccaugaacucccaagccccggccucagccuaaccaggaaaggggcucggagggagaaaggcc

SEQ ID NO: 741912 - RNA, 62 nt, hsa
gagggauggaccccgaaaggagaaaaguacucccaggaaacagacgcgugaaaacugagccc

SEQ ID NO: 741913 - RNA, 62 nt, hsa
gauuuuuuaaagcuuuucuguucacccuccugccaggaaaaucccagaaagcuuaaugauac

SEQ ID NO: 741914 - RNA, 62 nt, hsa
uugaaaucucaggacucuucuggccguagguuccaggaaagcucguggaagcuuuggggcuc

SEQ ID NO: 741915 - RNA, 62 nt, hsa
agaaaucagggcacuugcauccauugccuuuuccaggaaagggaagaaaacacucaguugau

SEQ ID NO: 741916 - RNA, 62 nt, hsa
aggucacucugaggauugaaacuugaucuuguccaggaaagcuuuguaccaaacagugaagc

SEQ ID NO: 741917 - RNA, 62 nt, hsa
uccagggcaaagcugaagguuucuuggggaagccaggaaagccaguauuuccuaugugucag

SEQ ID NO: 741918 - RNA, 62 nt, hsa
uuuucaaaguaggauuuccuuuuucaacuguuccaggaaagaaucucuaagacuggguagcu

SEQ ID NO: 741919 - RNA, 62 nt, hsa
ugccuauaacgcugugaguguccaguccuuguccaggaaacucagaucccggccuggcuucc

SEQ ID NO: 741920 - RNA, 62 nt, hsa
ccaagggauggggcugucuuuacuuguggaaaccaggaaauugcuccucucagccaaccaag

SEQ ID NO: 741921 - RNA, 62 nt, hsa
cccacccucagcgucucugccccuaaggcagcccaggaaauaggaacugagacucugguacc

SEQ ID NO: 741922 - RNA, 62 nt, hsa
uuucagacuugacccuaauugaccauauaugaccaggaaacacuucugaguuuacagcuccg

SEQ ID NO: 741923 - RNA, 62 nt, hsa
ugaagaagacaagauuucuggacaagcucagcccaggaaacaaaggguaaacaaaaaacuaa

SEQ ID NO: 741924 - RNA, 62 nt, hsa
ggaggcuguccaccuugcuuggcucacugggaccaggaaagccugucuuugguuaggcucgu

SEQ ID NO: 741925 - RNA, 62 nt, hsa
ggaauaaaauuaauuaggcuaauaggcuuaacccaggaaauccuaaguuccuugaauaucca

SEQ ID NO: 741926 - RNA, 62 nt, hsa
aguggaaucuuuuaaagacaggaccccuauguccaggaaaggggaaaaggaacuuugccaau

SEQ ID NO: 741927 - RNA, 62 nt, hsa
ggggggcaggaggaaagcacaauguuucuuagccaggaaagacaaauaauccaacgcugcua

SEQ ID NO: 741928 - RNA, 62 nt, hsa
uaguuaaauuggauugagaaugccuuuuguuuccaggaaaauauugaucaccaugaaagaag

SEQ ID NO: 741929 - RNA, 62 nt, hsa
uucucucuuagaauuggaggauuugccauuguccaggaaagaaacuugcagcuuuaaccugc

SEQ ID NO: 741930 - RNA, 62 nt, hsa
ggacgguaccaagaguagcgcuuagcccuuacccaggaaauauccuucauggccacagaaau

SEQ ID NO: 741931 - RNA, 62 nt, hsa
guugcuucugcagcccgcagaugccagcgaugccaggaaacaaguugaaauccaggaaucuc

SEQ ID NO: 741932 - RNA, 62 nt, hsa
gacuugcuaguaaacagaagacuucaagccagccaggaaauuaaaguggcgacuaaaacagc

SEQ ID NO: 741933 - RNA, 62 nt, hsa
ggcaaaaauagacccagcuucugcaagguuuuccaggaaaaucugcuuggggcagcauuugu

SEQ ID NO: 741934 - RNA, 62 nt, hsa
agagagcccuauucaucgcugcccaggccuucccaggaaaaucauuuuuucugggcugaugu

SEQ ID NO: 741935 - RNA, 62 nt, hsa
gucauucuucucacugaguuuuuguuuaaaaaccaggaaauuucuacaaucauggagacaga

SEQ ID NO: 741936 - RNA, 62 nt, hsa
ucacuucugcccaccugccggcaacaccagugccaggaaaaggccaaaagaaugucuguuuc

SEQ ID NO: 741937 - RNA, 56 nt, hsa
cucagagaaacaccaacugaaaagagccaggaaaacccgggaauuuuccaaaaggu

SEQ ID NO: 741938 - RNA, 62 nt, hsa
caugugauuaagauccaggccgcugaaguuccccaggaaaugaucuuccacuugagcaaccu

SEQ ID NO: 741939 - RNA, 62 nt, hsa
gccccaaggauggcugggaguugcucaggcauccaggaaaaguggggaaugcugccaucugg

SEQ ID NO: 741940 - RNA, 62 nt, hsa
ggagcucucugcugagcagcccagcacaacccccaggaaacacaaaugggguccaggucacc

SEQ ID NO: 741941 - RNA, 62 nt, hsa
cuucuggcagcagaaauccaugaagcccgggcccaggaaaauuagaaguuuuccauuccuga

SEQ ID NO: 741942 - RNA, 62 nt, hsa
uauuccuuagccuuauagauuucuaguacugcccaggaaaucuaauuucaauacauuuaucc

SEQ ID NO: 741943 - RNA, 62 nt, hsa
uauuggacucuugaaggcaauccuuccucuggccaggaaauuuuuuaaaaaauaauacugug

SEQ ID NO: 741944 - RNA, 62 nt, hsa
aagccaagguugucaaagaacagccagugaggccaggaaagaaauuggucuugugguuuuca

SEQ ID NO: 741945 - RNA, 62 nt, hsa
ugaaguuagugcgggcuuugcugcucccuggcccaggaaagagggacuaccugacccucacc

SEQ ID NO: 741946 - RNA, 62 nt, hsa
uuuuuuuuuucccccuugaggauuguggaaaaccaggaaaagggagcuaugauuuuuuuuuc

SEQ ID NO: 741947 - RNA, 62 nt, hsa
ugagauacccugcuaucgauggucgcuacaaaccaggaaauacucaaguuauuauguguaua

SEQ ID NO: 741948 - RNA, 62 nt, hsa
cgccauggauuccucugggggcuggcgcaugcccaggaaagccugggccacacgggacacuc

SEQ ID NO: 741949 - RNA, 62 nt, hsa
cugagcaaacccagggaauagcccuccucuccccaggaaacuucucugaaaucuuagacuua

SEQ ID NO: 741950 - RNA, 62 nt, hsa
cggcgccuuuuucuuuuuagaugggaaggaggccaggaaagggucagcuuaaccauuuccua

SEQ ID NO: 741951 - RNA, 62 nt, hsa
aauacuaugcauagcaaggagaugcagagccgccaggaaaauucugaguuccagcacaauuu

SEQ ID NO: 741952 - RNA, 62 nt, hsa
gccucuuagcauguuugauuuaagaaaagccuccaggaaaucuugagagccugucuuggcau

SEQ ID NO: 741953 - RNA, 62 nt, hsa
ggaggcccgcggcgguggagccgagcggggagccaggaaagaagaguuggagugagaugaag

SEQ ID NO: 741954 - RNA, 62 nt, hsa
ccauaccccuuccuggaucuccagugccugggccaggaaagcccucuggguuccgggaagcc

SEQ ID NO: 741955 - RNA, 62 nt, hsa
gaggaaaacaagugaggacacugguuuuaccuccaggaaacaugaaaaauaauccaaaucca

SEQ ID NO: 741956 - RNA, 62 nt, hsa
uccauauaaauuguuuauucaaccaucagguuccaggaaaaagccuguuaguauuuucauug

SEQ ID NO: 741957 - RNA, 62 nt, hsa
guaggaaggugcugugggcuggucccacacauccaggaaagaggccaguagagaauucugcc

SEQ ID NO: 741958 - RNA, 62 nt, hsa
cgcgacaaggacgacauucuguucuacacccuccaggaaaugacagcagucagugccgccca

SEQ ID NO: 741959 - RNA, 62 nt, hsa
ccaggccuggggccccucccaguucccccgccccaggaaacacugcugaccuuugcaaaggc

SEQ ID NO: 741960 - RNA, 62 nt, hsa
agaguuacauuaugcuuggcaugaauaaggugccaggaaaacaguuuaaaauuauacaucag

SEQ ID NO: 741961 - RNA, 62 nt, hsa
ucuagaaucccuucaguuuuagcuaccaacggccaggaaaagcccucaucuucucuuucucu

SEQ ID NO: 741962 - RNA, 62 nt, hsa
caacggggccauggcaggaaagcugacccuacccaggaaaguaauagcuucuuuaaaagucu

SEQ ID NO: 741963 - RNA, 62 nt, hsa
ugaugauauccuauccucuccaagcuccuauuccaggaaaaaagauccaauguuuuuucuaa

SEQ ID NO: 741964 - RNA, 62 nt, hsa
ugcucuaacuggagcacauucacuuacgaacaccaggaaaccacagggcccuugucgccccu

SEQ ID NO: 741965 - RNA, 62 nt, hsa
cuuggauuuagggauagugucccucuccauguccaggaaacuuguaaccacccuuuucuaac

SEQ ID NO: 741966 - RNA, 62 nt, hsa
aggauugcgcacccugcacaaguacagauugaccaggaaaagacaagugucuucuguguguc

SEQ ID NO: 741967 - RNA, 62 nt, hsa
cauucucagcugucuuguuccaccaguauuuaccaggaaaacaaagaauguguuaagggaug

SEQ ID NO: 741968 - RNA, 62 nt, hsa
uagaccgaagccuugugcauaaggauuuuuucccaggaaaagauagacuuuauaaacagugg

SEQ ID NO: 741969 - RNA, 62 nt, hsa
gucccccguuugccuccacgagccugcuguuuccaggaaauuacauaacguucaguugggau

SEQ ID NO: 741970 - RNA, 62 nt, hsa
gccaagacaguggcagcaaaggaagacuuggcccaggaaaaaccuguggguugugcuaauuu

SEQ ID NO: 741971 - RNA, 62 nt, hsa
ucuuuuuuuccucugcccugaucaacuggggcccaggaaaagcaaugucucuucacgggccu

SEQ ID NO: 741972 - RNA, 62 nt, hsa
uggggcaugacccagugaagaugcagguuugaccaggaaagcagcgcuaguggaggguugga

SEQ ID NO: 741973 - RNA, 62 nt, hsa
acuucugauaauuuauugucuuuauuuuuaucccaggaaauaaaagguuaccuuguugaggc

SEQ ID NO: 741974 - RNA, 62 nt, hsa
gccugggcucacccuguguggcucauucccacccaggaaacugaagauaaaagauuugggaa

SEQ ID NO: 741975 - RNA, 62 nt, hsa
ucagccaugauaagaacagagugccugcauucccaggaaaauacgaaaaucccaugagauaa

SEQ ID NO: 741976 - RNA, 62 nt, hsa
aucaauuuguucuuagaaccugguugaaaauaccaggaaacuguuacagacgccauuuuuuu

SEQ ID NO: 741977 - RNA, 62 nt, hsa
gggaccucagggagccccagcuucuuacccacccaggaaacccuugguccagagaggacagg

SEQ ID NO: 741978 - RNA, 62 nt, hsa
agcccuaagggugguaggaacccaggagggacccaggaaacuaagauuugagauucagugcc

SEQ ID NO: 741979 - RNA, 62 nt, hsa
cuccucaggcuccuccuugcccccaccuugccccaggaaaggccaaaguccaggugacugcc

SEQ ID NO: 741980 - RNA, 62 nt, hsa
gccagcugugcacuuucuucucuuucccaaccccaggaaagguuuuccuuauuuugugugcu

SEQ ID NO: 741981 - RNA, 62 nt, hsa
gagacuuccugcugccuuuggacauaacuaagccaggaaacuuuaaaagccuucuagaaaua

SEQ ID NO: 741982 - RNA, 62 nt, hsa
aaggcuagagcugauggcacugucugcacuguccaggaaaaaaguaaaacuguacuguugcg

SEQ ID NO: 741983 - RNA, 62 nt, hsa
ggcgguggcuucacuccugagucugcaaaaucccaggaaacuugggucuugcugcccauccu

SEQ ID NO: 741984 - RNA, 62 nt, hsa
cuuuaaagagccaaguugcuucggggaaacagccaggaaaauggucaagauuauuuuuagag

SEQ ID NO: 741985 - RNA, 62 nt, hsa
cccacugcccccugagauguacacccugauugccaggaaaacagacugcuguguucaguaac

SEQ ID NO: 741986 - RNA, 62 nt, hsa
aaugggucugugacucaaaaauugagcccuggccaggaaaauguggagacaguucuucuccu

SEQ ID NO: 741987 - RNA, 62 nt, hsa
caauccauagauagccagcaguggauguuacuccaggaaaaugcaggauuaaaauuguccuu

SEQ ID NO: 741988 - RNA, 62 nt, hsa
auccaggacuacgaggcggccaaggcucuguuccaggaaauucuugaagaguauaaugaaag

SEQ ID NO: 741989 - RNA, 62 nt, hsa
gacacuuugucuaguguauucucuucacagugccaggaaagagugguuucugcguguguaua

SEQ ID NO: 741990 - RNA, 62 nt, hsa
gcuugauuuuggccuauuuuacauuauuugguccaggaaauuagguuauauuagguuuuuug

SEQ ID NO: 741991 - RNA, 62 nt, hsa
ggagucccuuacuuuacguguguaaauuccuaccaggaaagaauacauauccaauagauugg

SEQ ID NO: 741992 - RNA, 62 nt, hsa
cauuguaguucgcaugguucucuggaaacgcgccaggaaaagcuuccgugccagugauucgu

SEQ ID NO: 741993 - RNA, 62 nt, hsa
caaacagaacuauggaaaaaaaggaagaaauuccaggaaaaucugcacugugggcuuuuauu

SEQ ID NO: 741994 - RNA, 62 nt, hsa
ugauaauugucuccccuccauaggaauuucucccaggaaagaaauauauccccaucuccguu

SEQ ID NO: 741995 - RNA, 62 nt, hsa
gaucugggggaauaaaaagccaacaguaagccccaggaaaggguuuuuugagaccauaugua

SEQ ID NO: 741996 - RNA, 62 nt, hsa
uuguuucacccuacuucaaguacacuuccacaccaggaaaacagacccaaauuccauaaaca

SEQ ID NO: 741997 - RNA, 62 nt, hsa
uuuccccuuuguuuagggguaggcuuugaugaccaggaaaaaaaaaaagguauuucugcauu

SEQ ID NO: 741998 - RNA, 62 nt, hsa
ccuuccccccccccaccccgagauacgggguuccaggaaaggggagggguagcgggggaggg

SEQ ID NO: 741999 - RNA, 62 nt, hsa
aauguccauuuucauuuauaggccaaauccugccaggaaaguaaccagaucucuggauuuca

SEQ ID NO: 742000 - RNA, 62 nt, hsa
caauauuuaguaaagcuuuucuuuuuuaauuuccaggaaaaaauaaaaagaguaugagucuu

SEQ ID NO: 742001 - RNA, 62 nt, hsa
uuauaaagcuuguacagcugccucccggcaguccaggaaaacugcaaaaaaugggaaguaag

SEQ ID NO: 742002 - RNA, 62 nt, hsa
uucucccacugggucaccucaaggaucagaggccaggaaaaaaaaaaaaaagacucccugga

SEQ ID NO: 742003 - RNA, 62 nt, hsa
gagcuuuuuuagaaagucgaagugaauguuggccaggaaaauggaaaagccauuguauaaau

SEQ ID NO: 742004 - RNA, 62 nt, hsa
acgucuccacggagcccucgggaccugcugcaccaggaaagccacuccaccaguagugcugg

SEQ ID NO: 742005 - RNA, 62 nt, hsa
gccugcuguucccgcuuuccauauagcuuuggccaggaaagcaugcaauagacuugcucgga

SEQ ID NO: 742006 - RNA, 62 nt, hsa
guccuuugacuuaguacugacuugcacugaggccaggaaaagaagcacuggaaagcagcagg

SEQ ID NO: 742007 - RNA, 62 nt, hsa
gucagagaagacuggcgucagcagccaaaacaccaggaaacacauuucuguggccuuagcca

SEQ ID NO: 742008 - RNA, 62 nt, hsa
uuugcugccauccagccccagaucgcuuuacuccaggaaaugcacguuacacauuuucgcuu

SEQ ID NO: 742009 - RNA, 62 nt, hsa
ugcuaagaucagucacccaugugaauaagaagccaggaaaggaaagauggggaagcccagau

SEQ ID NO: 742010 - RNA, 62 nt, hsa
gagugugacugggaaggagaacuuauuccuuaccaggaaacuggaagcuaaaaauacagagg

SEQ ID NO: 742011 - RNA, 62 nt, hsa
ggccugcgucuuuuuucucuucccuucccagaccaggaaaggcuuggcugguguaugcacag

SEQ ID NO: 742012 - RNA, 62 nt, hsa
uuauuucuagaagcacauguguauuuauacccccaggaaacuagcuuuugccaguauuaugc

SEQ ID NO: 742013 - RNA, 62 nt, hsa
gagggaauuggguuuguggcaaagagcuugacccaggaaauagauggugccccccaaauugu

SEQ ID NO: 742014 - RNA, 62 nt, hsa
cagugguuugcccuuggcuaaaugaagcagagccaggaaaaacagacuacauauuuuucaug

SEQ ID NO: 742015 - RNA, 62 nt, hsa
cagggagguugaggcagcaggauugcuggagcccaggaaauugaggcugcagugagccauga

SEQ ID NO: 742016 - RNA, 62 nt, hsa
uaacacuguuuugauuuuugugggaaaauauuccaggaaacgcuaauucucuuuagacuccu

SEQ ID NO: 742017 - RNA, 62 nt, hsa
uuguuuuuaauuuuaaccauagugcacauauuccaggaaagugucuuuaaaaacaaaaacaa

SEQ ID NO: 742018 - RNA, 62 nt, hsa
ccagggcccaaaagucagaagggccccaccagccaggaaaguuguuucaaugcuguaaguag

SEQ ID NO: 742019 - RNA, 62 nt, hsa
uccacugagguuagaguccauuuacaaagcugccaggaaaccggccacuucuaguaaaccac

SEQ ID NO: 742020 - RNA, 62 nt, hsa
augaugcaauuaucuuacucagaggagauuugccaggaaauucucuccguuacaugcauuac

SEQ ID NO: 742021 - RNA, 62 nt, hsa
ucucuucagaucugaaauacuccaguuuagagccaggaaauuucacaggucacaccgauuuu

SEQ ID NO: 742022 - RNA, 62 nt, hsa
ccagggcacccauccaaggaaccuccgaacagccaggaaaagccaugaguugcaaccaaaac

SEQ ID NO: 742023 - RNA, 62 nt, hsa
uauggagucaccuguaaauugauucaagugagccaggaaagcagcaaaggaaagagaaaccu

SEQ ID NO: 742024 - RNA, 62 nt, hsa
gggaugggaaugacuuccucgagaccauacagccaggaaauagcggugaaucuagugaucuc

SEQ ID NO: 742025 - RNA, 62 nt, hsa
acgcccagcacagcagcaggacacaccaugugccaggaaaugaccucagcaagaaaccucag

SEQ ID NO: 742026 - RNA, 62 nt, hsa
auccccugcccugccgggcaccucgcucuaccccaggaaaaugugagcucguuuuccugcuc

SEQ ID NO: 742027 - RNA, 62 nt, hsa
auaaaagcuaugagacaaauaguccucuaguuccaggaaacacagucuuuuuuuaaaaaaaa

SEQ ID NO: 742028 - RNA, 62 nt, hsa
aaccaucaaaccuuuccuccugacuuaccaaaccaggaaaacagcaggagaggguggcucag

SEQ ID NO: 742029 - RNA, 62 nt, hsa
uccuuccuugagucauagaacguauccaucucccaggaaauguccuucucuggcgucugcuu

SEQ ID NO: 742030 - RNA, 62 nt, hsa
uaucaguggucguguaccuucuccaccugcccccaggaaaaagagucucccccuuaaauuuc

SEQ ID NO: 742031 - RNA, 62 nt, hsa
cagaugcuuagggggcauuugugcuccucuggccaggaaagggaacagaguccauccaagcu

SEQ ID NO: 742032 - RNA, 53 nt, hsa
gccuggaagggcacuucugagugccaggaaaggcagcuuuagugcagaccuag

SEQ ID NO: 742033 - RNA, 62 nt, hsa
auaagaccucuuucagcagaucacaucagaagccaggaaaugcauagcuaggagaugucaaa

SEQ ID NO: 742034 - RNA, 62 nt, hsa
cugaugauuuauuuaaagagccguugaugccuccaggaaacuuaaguauuuuauuaauauau

SEQ ID NO: 742035 - RNA, 62 nt, hsa
uucuuaacugcccaagugaaaagcaaccaaguccaggaaauuacaauagcuguuaaggaaag

SEQ ID NO: 742036 - RNA, 62 nt, hsa
cccaagcuuguggcaccaggcaucugauggugccaggaaagccacuggaauugucacacggc

SEQ ID NO: 742037 - RNA, 62 nt, hsa
aggagccacuuaagagauuauugugcuguuuuccaggaaagcugcagcuagaaaauggucuu

SEQ ID NO: 742038 - RNA, 62 nt, hsa
uuauuuuauguuaaaaugugugcuaaacuaucccaggaaaguauuuaauccaacauuguaaa

SEQ ID NO: 742039 - RNA, 62 nt, hsa
gccccacuucagggcugcugugagauggaauuccaggaaagaacuucaggugucuggacccu

SEQ ID NO: 742040 - RNA, 62 nt, hsa
agauuuuuccucuugccuuacacauggagguuccaggaaaccucuugcagaacuucacacgu

SEQ ID NO: 742041 - RNA, 62 nt, hsa
accccuaagcauggucccuugucaccaggcaaccaggaaacugcuacuuguggaccucacca

SEQ ID NO: 742042 - RNA, 62 nt, hsa
uugaggucggaaacccucuacugccccauaagccaggaaaagugaaaagagaacacaguucc

SEQ ID NO: 742043 - RNA, 62 nt, hsa
cccuccugcucuccaucuuauauguauucuaaccaggaaaaaugugauagcacauggguagc

SEQ ID NO: 742044 - RNA, 62 nt, hsa
ccugagcugccagugcuggguaucccccagccccaggaaauguggggucggccaggacccuc

SEQ ID NO: 742045 - RNA, 62 nt, hsa
gucauacacuuuaaaaaaaaaaaaaacuuuuuccaggaaaauauauugaaaucaugcugcug

SEQ ID NO: 742046 - RNA, 62 nt, hsa
cagccccuucucugggaugugguucuauucccccaggaaaaaggagccccagccuucugagg

SEQ ID NO: 742047 - RNA, 62 nt, hsa
uugugugugagacugaguauguguucuuuuuuccaggaaaggcuccagugguucuuacuuga

SEQ ID NO: 742048 - RNA, 62 nt, hsa
ucucccuguuuuagcacugaaagucucuugccccaggaaaccccaucagucccaggcagauu

SEQ ID NO: 742049 - RNA, 62 nt, hsa
uccccaaagugucagcaacuuugaggagggcaccaggaaacaaagaugccuccccagcccug

SEQ ID NO: 742050 - RNA, 62 nt, hsa
cuggcccacacgugcauagaggucugggaggaccaggaaacagccucaguggccagaggauc

SEQ ID NO: 742051 - RNA, 62 nt, hsa
guuucugaaauauuuuauggacuuauuucuccccaggaaaugauucuuacggaaaaaaauug

SEQ ID NO: 742052 - RNA, 62 nt, hsa
guauaaaccucuguaugaagagaagauuucucccaggaaaucuuuguacagcuuuaaguugu

SEQ ID NO: 742053 - RNA, 62 nt, hsa
aaagcugcaaguggauucuagugcugagucuuccaggaaaaaaucccguuuggccaccguga

SEQ ID NO: 742054 - RNA, 62 nt, hsa
gcagagauggccugccaagaguugcaggagacccaggaaagggaguugcugagggcaggucc

SEQ ID NO: 742055 - RNA, 62 nt, hsa
ccagagggaccucaggguguggcauuauagggccaggaaaagaaaaucgguguauccuaucu

SEQ ID NO: 742056 - RNA, 62 nt, hsa
acaugagaugagccagccgagccagacugugaccaggaaacagcucaucccagagaaggaga

SEQ ID NO: 742057 - RNA, 62 nt, hsa
auggaaauauuagcugccccgucugccauucaccaggaaaaauuucuauggcaauuuuguac

SEQ ID NO: 742058 - RNA, 62 nt, hsa
cugcagucacauggguguggccuccaagcuccccaggaaagcaguggcagccucugggguuu

SEQ ID NO: 742059 - RNA, 62 nt, hsa
agccauaucuuacacuuugguaaagcagaaaaccaggaaaauuuucuuaaaauauccacaau

SEQ ID NO: 742060 - RNA, 62 nt, hsa
ggccacaggcacaagggcugcagcugcuucuuccaggaaacugacacagggagcucagcggc

SEQ ID NO: 742061 - RNA, 62 nt, hsa
ccagaugcccugcuccaucacaaccuccuuccccaggaaaacccacuuuccaaaagcccaag

SEQ ID NO: 742062 - RNA, 62 nt, hsa
acuuuggucaguuaccugggaauucugggcugccaggaaacgauuugggccucugucaguuu

SEQ ID NO: 742063 - RNA, 54 nt, hsa
ccccacccgcucccaccuaggaggccaggaaagggggagcggggcgcccagggc

SEQ ID NO: 742064 - RNA, 62 nt, hsa
cuuguuccugacuccagaggaacgagagcauuccaggaaagagagauucccuggaaaauuga

SEQ ID NO: 742065 - RNA, 62 nt, hsa
gguggcuacuuuuggucugaaacccacuuggcccaggaaagagaaaagguuguauguuuugu

SEQ ID NO: 742066 - RNA, 50 nt, hsa
gggcccagauggaggaguaaccaggaaaaucacugccggcuagucccaag

SEQ ID NO: 742067 - RNA, 62 nt, hsa
uauuuauauguuguggggacugcauaacuagcccaggaaaugacucugguuuugaguggccu

SEQ ID NO: 742068 - RNA, 62 nt, hsa
gagggagggcuccagacacauguccaagaagcccaggaaaggcuccaggagcagccacauuc

SEQ ID NO: 742069 - RNA, 62 nt, hsa
cucccuugugguuucagcacagaaccugaaugccaggaaaaauuccugggccaagaagcuaa

SEQ ID NO: 742070 - RNA, 62 nt, hsa
cuuuuugugcauuguccucaugccuguauucuccaggaaacuuguccuucuggaaaucauau

SEQ ID NO: 742071 - RNA, 62 nt, hsa
ugacucagugaccagugccugugagcauggggccaggaaagucugguaauaaaugugacuca

SEQ ID NO: 742072 - RNA, 62 nt, hsa
aaugccacugcuugguuauugguccccuuugaccaggaaacccaagaggagacaccucaguc

SEQ ID NO: 742073 - RNA, 62 nt, hsa
uggagagaaagcuguaggauccauaaauucuaccaggaaaccagggucuuccuguuccuagc

SEQ ID NO: 742074 - RNA, 62 nt, hsa
acucugcucaugagacagaucugggcuccaagccaggaaaggugaacagaaaccacaagugu

SEQ ID NO: 742075 - RNA, 62 nt, hsa
ugaccaaaccacaugaaccagacuuuucccguccaggaaauagcauuucagauuugguuuuu

SEQ ID NO: 742076 - RNA, 62 nt, hsa
aacuccauuccaccugacccuguguguacaauccaggaaaaaaacaaaccccacucagaaac

SEQ ID NO: 742077 - RNA, 62 nt, hsa
gguaacaguugccgaaccaggccgccucacagccaggaaauuuggaaauccuagccaagggg

SEQ ID NO: 742078 - RNA, 61 nt, hsa
aagucaaggaagaacuuuagcuucuccaauaccaggaaaaaagaugcuuauuuuccagauc

SEQ ID NO: 742079 - RNA, 62 nt, hsa
ucaguucucugauccacuuccauuuaagcuccccaggaaaucccaugacaaacuggccucug

SEQ ID NO: 742080 - RNA, 62 nt, hsa
cggagggguguguggccagguacuaggaggcaccaggaaaucccgcgggguggcccaugcag

SEQ ID NO: 742081 - RNA, 62 nt, hsa
uuauucccgcugacugagucucugaggggcuaccaggaaagcgccuccaacccuagcaaaag

SEQ ID NO: 742082 - RNA, 62 nt, hsa
acccacuauuucuccucugcuucagaggaaacccaggaaaugcccuuacugccaggcugagu

SEQ ID NO: 742083 - RNA, 62 nt, hsa
ucacacugugaguccagcggcgcagggugguaccaggaaagaggauauucuaggcuuugcgu

SEQ ID NO: 742084 - RNA, 62 nt, hsa
guucuugggaagcagauuaaguagcagaaaguccaggaaagaaagaccagaaggaguaauga

SEQ ID NO: 742085 - RNA, 62 nt, hsa
guuggcagugcccagauucgucaagugaggguccaggaaagcucuugcccucuugcccagca

SEQ ID NO: 742086 - RNA, 62 nt, hsa
cagccacgcagaaagcucacgugccugcagggccaggaaagggaaaugaucguuucuuuugu

SEQ ID NO: 742087 - RNA, 62 nt, hsa
cccacagcccuucaccuucgcuaucaaacaucccaggaaaggguaagaauuuagggccaccg

SEQ ID NO: 742088 - RNA, 62 nt, hsa
uucugcucuaacauggcaugcccuuucucagcccaggaaacagcaugugguucagagaaaag

SEQ ID NO: 742089 - RNA, 62 nt, hsa
uggccaaccuagccaaggcugcagcauauagaccaggaaaucagguagcccagacuggugau

SEQ ID NO: 742090 - RNA, 62 nt, hsa
caguucacagaggucuuucagcucauuuaaucccaggaaagaggcaucaaagcuagaaugug

SEQ ID NO: 742091 - RNA, 62 nt, hsa
ggcaagaggugccugggaggaguggcccugauccaggaaaaugugaggggaaucuggaacgc

SEQ ID NO: 742092 - RNA, 62 nt, hsa
gcgauucuggauaaagccacugaaaauucgaaccaggaaauggaaccccaccacuguugguc

SEQ ID NO: 742093 - RNA, 62 nt, hsa
gggagucauuaaagccaagucauucauagcagccaggaaacaauaggaaccaaaagccucug

SEQ ID NO: 742094 - RNA, 62 nt, hsa
gaacccuccaauucaggaagugggaaaaggagccaggaaaugugcuucuacuuugccaguua

SEQ ID NO: 742095 - RNA, 62 nt, hsa
cccccaaccagagauguuaaagugagccugucccaggaaacaucuccacccaagacgucuuu

SEQ ID NO: 742096 - RNA, 62 nt, hsa
gaugucaucguccaucccaucuuccuuugcccccaggaaaggacgcauccaccgguagcggc

SEQ ID NO: 742097 - RNA, 62 nt, hsa
guguggaggacaaagcuucuuccugcguggcuccaggaaaagauguggcucacguagguggc

SEQ ID NO: 742098 - RNA, 62 nt, hsa
aaagagggagcacauugacuugggaauuuccuccaggaaacucagggcuguuuucucuuccc

SEQ ID NO: 742099 - RNA, 62 nt, hsa
ucaggaggggcucucagggacuccuggugacuccaggaaaaugcugccaucguuaaacauua

SEQ ID NO: 742100 - RNA, 62 nt, hsa
uugucaucguuccccaccccuucgacaugcugccaggaaacaagggaaggggccucccuccg

SEQ ID NO: 742101 - RNA, 62 nt, hsa
uuuauauuauuaggagcaaaaguaaaugaagcccaggaaaacaccuuugggaacaaacucuu

SEQ ID NO: 742102 - RNA, 62 nt, hsa
gguguucuaccagaaaaacgucucccaaucacccaggaaagcuguccacaguaguccccccu

SEQ ID NO: 742103 - RNA, 62 nt, hsa
cuuugcaggacuugcacacagggaggcuguagccaggaaacccucuucuucccuggucuggc

SEQ ID NO: 742104 - RNA, 62 nt, hsa
ggagcuuagccugagaggguucuuggccucccccaggaaagauuucaaaggcaagcgccagu

SEQ ID NO: 742105 - RNA, 62 nt, hsa
gggauuacagcuugaguucugucaccccauccccaggaaacuguagcuucuuaacuggugac

SEQ ID NO: 742106 - RNA, 62 nt, hsa
auauuucuaaguguaacuguccuuccucugugccaggaaacgggagggggcugauccucuga

SEQ ID NO: 742107 - RNA, 62 nt, hsa
uuccacuguacuucucaaaguugguuauuagaccaggaaaacuuaauguaauauuauuuuua

SEQ ID NO: 742108 - RNA, 62 nt, hsa
gagguggcuuccuaguuacaugaggaugugauccaggaaauccaguuuggaggcuugaugug

SEQ ID NO: 742109 - RNA, 62 nt, hsa
gacaaggaagguggaauguucuguuuuggccaccaggaaaugggguggggugggcauacaca

SEQ ID NO: 742110 - RNA, 62 nt, hsa
caaagcgccagucauuugcuccguuuucaaauccaggaaaugcagaagaggaaugugcaaca

SEQ ID NO: 742111 - RNA, 53 nt, hsa
uugaaguggaagaaagaugaaacccaggaaauauauucuucccucucuccugc

SEQ ID NO: 742112 - RNA, 62 nt, hsa
gaauguuugugucugugguugcagucuuucccccaggaaaaaaaaaaaaagaaauucgcaug

SEQ ID NO: 742113 - RNA, 62 nt, hsa
cuguggguggggagcuggggcaagaugaggcaccaggaaaggggugguagucagaggaggga

SEQ ID NO: 742114 - RNA, 62 nt, hsa
gagcuggcgggagggugggaggugggauuuagccaggaaaggggugagagugauuguguugu

SEQ ID NO: 742115 - RNA, 62 nt, hsa
cuucagugagaggauuggcugugagcuucagaccaggaaaugugucaucuugccaggcaccu

SEQ ID NO: 742116 - RNA, 62 nt, hsa
cuucaccucuuggcuguggaggaacuuaguugccaggaaauuuuuuuuuuuuuuuucagacg

SEQ ID NO: 742117 - RNA, 62 nt, hsa
uccugggcagauuggguagaaaggacauucuuccaggaaaguugacugcugacugauuggga

SEQ ID NO: 742118 - RNA, 62 nt, hsa
caacacgguguccugccacccagcgccuggcuccaggaaaacacgcuugccuuccuucccgg

SEQ ID NO: 742119 - RNA, 62 nt, hsa
ucuuuuuucaucucacaguaaagccuauuuccccaggaaaaaaauaaaugccuuugaaugaa

SEQ ID NO: 742120 - RNA, 62 nt, hsa
aacgaaugccaaaucagacuccaccuagagcaccaggaaacagcuuguacccugguagggaa

SEQ ID NO: 742121 - RNA, 62 nt, hsa
cacucagacugagacuugaguuauuacagaagccaggaaaaguguauuagaaacuguugucu

SEQ ID NO: 742122 - RNA, 62 nt, hsa
agaagugauaaaggaauccaaaguugaagagcccaggaaacgggaaacuguauccauaaugc

SEQ ID NO: 742123 - RNA, 62 nt, hsa
uccggccuaggugacagagggaaacuccaucuccaggaaaaaaaaaaaaaaacccaauuugg

SEQ ID NO: 742124 - RNA, 62 nt, hsa
agucuauaguacaaaaugcauaaaccauguccccaggaaauuugaaaggaagcaggugcuga

SEQ ID NO: 742125 - RNA, 62 nt, hsa
gugcgcccucgacucccgauuucauuugcuggccaggaaaaucgaaagggaaacacccucaa

SEQ ID NO: 742126 - RNA, 62 nt, hsa
agcagaaauguacaauuucuggucuguguuuuccaggaaauucauagagaagagaauagagu

SEQ ID NO: 742127 - RNA, 62 nt, hsa
gaccacccggcauucucugcccacuuugccuuccaggaaaugggcuuuucaggaagugaauu

SEQ ID NO: 742128 - RNA, 52 nt, hsa
guguaccauacaacaaauaacaccaggaaacucuggaaugaacaguaucaca

SEQ ID NO: 742129 - RNA, 62 nt, hsa
cuccucuuccuccggauccucuuuugaucugcccaggaaagggaugcauugacacucuccug

SEQ ID NO: 742130 - RNA, 62 nt, hsa
cagaggaggucccagauaccaaguggcgccucccaggaaaggcugggagaagagguggccug

SEQ ID NO: 742131 - RNA, 62 nt, hsa
gagcuaggggcccgccccgcggacugacagcaccaggaaaccaaaugaugucccugcccgcc

SEQ ID NO: 742132 - RNA, 62 nt, hsa
gucuuucgagguggguuuguaccuuccuuaagccaggaaagggauucauggcgucggaaaug

SEQ ID NO: 742133 - RNA, 62 nt, hsa
ccacgaggggacauccacccucugggguguggccaggaaaagacaagcucuucagcuugggg

SEQ ID NO: 742134 - RNA, 62 nt, hsa
cacuggaacauuccaguggacccuggaccauuccaggaaaacugggacauaggaucgucccg

SEQ ID NO: 742135 - RNA, 62 nt, hsa
cuggaaaacugggaaauggccagcugugugucccaggaaauuccuccccuuauucuuccuug

SEQ ID NO: 742136 - RNA, 62 nt, hsa
cugugauggggaugugcagggacagugggaucccaggaaacagaccuccauggugggagauc

SEQ ID NO: 742137 - RNA, 62 nt, hsa
agugcuccccuccugcuaaagaaccaguuaccccaggaaaauucgacuccuguuuuucuuua

SEQ ID NO: 742138 - RNA, 62 nt, hsa
aaccuaaaaguauuaaauuccuagaagaaaacccaggaaaugccauucuggacauaagugcu

SEQ ID NO: 742139 - RNA, 62 nt, hsa
cucaaacagaaaauaaugaagccuucuuccucccaggaaaggggacguucagcugagccgag

SEQ ID NO: 742140 - RNA, 62 nt, hsa
uuucaguaucugcuuuacugguucaguaaaagccaggaaacacaacuuugugguaaucugaa

SEQ ID NO: 742141 - RNA, 62 nt, hsa
uucauuuuguuaauuuuucccaguguuuacaaccaggaaauagcuugucaucuuugauacaa

SEQ ID NO: 742142 - RNA, 62 nt, hsa
caacguaccaauuuccccuuuuccccuggcuaccaggaaacucggagacaaucuuuucagcc

SEQ ID NO: 742143 - RNA, 62 nt, hsa
guagcugggauuacaggugugcgccaccacgcccaggaaauuauuguaguuuuaguagagac

SEQ ID NO: 742144 - RNA, 62 nt, hsa
aggugccacccaccuuggcccuaaaacagccaccaggaaagcagccggagagccggacagca

SEQ ID NO: 742145 - RNA, 62 nt, hsa
uacaaugugagagacugcagaagguaugaauaccaggaaacagauaacucagaagcaucugg

SEQ ID NO: 742146 - RNA, 62 nt, hsa
ccugugcccccaccugggugcccuaugcugacccaggaaaggccagaccugccccuccaaac

SEQ ID NO: 742147 - RNA, 62 nt, hsa
caaaauuuuuaaugaauacucacaccuuauugccaggaaagcauuuauacuugagaaaaauu

SEQ ID NO: 742148 - RNA, 62 nt, hsa
aaugugucuugcugucauuuauauuccuuuucccaggaaagaagcauuucugauacuuucug

SEQ ID NO: 742149 - RNA, 62 nt, hsa
cucccagacaccucaagcccuauucacaggcaccaggaaaccccacacaggaauucccaucc

SEQ ID NO: 742150 - RNA, 62 nt, hsa
aaucccaaauuugaaaauccaaucccaaguccccaggaaacccaaucaugagguccuugugc

SEQ ID NO: 742151 - RNA, 62 nt, hsa
ggcagcccggcuggccgccgccgcuccuccccccaggaaagccaagguggaggcugaggugg

SEQ ID NO: 742152 - RNA, 62 nt, hsa
uugcuagggguccugaaccaggcuacuucgaaccaggaaagccagauuccagccugagugcu

SEQ ID NO: 742153 - RNA, 62 nt, hsa
aagugaaugggccuguggcccacccggggucaccaggaaaggaucugaauaaagaggacccu

SEQ ID NO: 742154 - RNA, 62 nt, hsa
gagguuauguccuuuuccauuaaguacaugugccaggaaacaagagagagagaaaguaaagg

SEQ ID NO: 742155 - RNA, 52 nt, hsa
aggcggccggcgaggccugagcccaggaaagccccccucacugucccuggua

SEQ ID NO: 742156 - RNA, 62 nt, hsa
cuacauuucccaagaggcucugcuccaggaguccaggaaagacgaggcaccuuggccgcggg

SEQ ID NO: 742157 - RNA, 59 nt, hsa
gccggacuggccgggccugagacccaugcccaggaaaauaacagagcuggaugcugaga

SEQ ID NO: 742158 - RNA, 62 nt, hsa
aacaccagcucagcauggcagcagugcggaggccaggaaacccugaucgccaguuucuaacg

SEQ ID NO: 742159 - RNA, 62 nt, hsa
uccaaagagcugauucuaccaauccaauuucaccaggaaaauuccaucagggauuggaugac

SEQ ID NO: 742160 - RNA, 62 nt, hsa
cuggagaauccacauaccuuguguauugaaccccaggaaaaggaagaggucgaaccaacccu

SEQ ID NO: 742161 - RNA, 62 nt, hsa
aaucugcuuuuuuucuaaaaucugauuugcagccaggaaagaauuuucucacccaaggaaca

SEQ ID NO: 742162 - RNA, 62 nt, hsa
gguucauucucaggcugggguggacucagaugccaggaaagggacagccucccauugucagg

SEQ ID NO: 742163 - RNA, 62 nt, hsa
cucccuccagugaggagcugggaggagacaucccaggaaaagaauuugauacuccucuguga

SEQ ID NO: 742164 - RNA, 62 nt, hsa
ugucuccagugccuguuaagcugaggauacaaccaggaaaugcaacggugucagauuguguu

SEQ ID NO: 742165 - RNA, 62 nt, hsa
ucuuuucuucugcuacuuuggggaguugauggccaggaaagaagccagcacaggguuaaagu

SEQ ID NO: 742166 - RNA, 62 nt, hsa
cccagcccuaugguuuuuuuauuucauguaccccaggaaauacugugugguuucuaaaagcc

SEQ ID NO: 742167 - RNA, 62 nt, hsa
cgucggaggcaucauggaaagacugggacagcccaggaaacaaggggucugaggaugcauuc

SEQ ID NO: 742168 - RNA, 62 nt, hsa
agugccaccgugcggggccuggcucugcacacccaggaaaagucugcagacccccagcccuc

SEQ ID NO: 742169 - RNA, 62 nt, hsa
cccuguccaccaggauaagugacaccuaggacccaggaaauaaaugccgaugauuuguguga

SEQ ID NO: 742170 - RNA, 62 nt, hsa
agccuugacuccuugagacuguagauuucgauccaggaaacauuuauuuagcaccugccaga

SEQ ID NO: 742171 - RNA, 62 nt, hsa
uuuucucagucauccuggcagccaaaaaugugccaggaaaagaaagaauguggagcacgcgu

SEQ ID NO: 742172 - RNA, 62 nt, hsa
caacugggccccuuucaagaaauuuugcucuaccaggaaaacaguuacacauuuuaagagaa

SEQ ID NO: 742173 - RNA, 62 nt, hsa
aagauugcaaaaaugacugugcaaccugaaacccaggaaagcagucuccauagucaaucaga

SEQ ID NO: 742174 - RNA, 62 nt, hsa
agccauggcauaugacaaagaccaaugagggaccaggaaaaaaagugauguccccuuucccu

SEQ ID NO: 742175 - RNA, 62 nt, hsa
ccagggagacagacucugaaugggacugagucccaggaaacagugcuuuccgaugagacuca

SEQ ID NO: 742176 - RNA, 62 nt, hsa
ucaucuccagcuagccuugggaggccgucccaccaggaaaucucucuauuccguagccugag

SEQ ID NO: 742177 - RNA, 62 nt, hsa
cccaaggugagggcuuaggcagcuguagaaccccaggaaagaacggaauccaggcaaucugu

SEQ ID NO: 742178 - RNA, 62 nt, hsa
uuuggggaagaugcaaggaaguaaugagaagcccaggaaauuucuccaccuguguuuauggc

SEQ ID NO: 742179 - RNA, 62 nt, hsa
cagugcccaggaauuugaacauuuuccuuuacccaggaaaucuccggagccaacaccaccac

SEQ ID NO: 742180 - RNA, 62 nt, hsa
cagauauauuuuaguaacacauucccagcuccccaggaaagccagucucaucuaauuucuua

SEQ ID NO: 742181 - RNA, 62 nt, hsa
uuccucccuuccuuucacagccggucucucugccaggaaaugggggaaggaacuagaaccac

SEQ ID NO: 742182 - RNA, 62 nt, hsa
ucagcuggauccccacgugagcaacagcuggcccaggaaaggcugccugcagaggacaggug

SEQ ID NO: 742183 - RNA, 62 nt, hsa
ccacccaccccauugggagaaaaacccagacgccaggaaaagaagaaacaacaaaggcagga

SEQ ID NO: 742184 - RNA, 62 nt, hsa
uccacgggcaggagaagguggauauuucagcuccaggaaagagagcuaauucacucucucuu

SEQ ID NO: 742185 - RNA, 62 nt, hsa
aucaaauuccagaaugauuuuacggagauaucccaggaaaauuaaggcuucucuuaaacacu

SEQ ID NO: 742186 - RNA, 62 nt, hsa
uuucugccuccaggaugccacugccucugcuuccaggaaaggcaagggggagggugcuuauc

SEQ ID NO: 742187 - RNA, 62 nt, hsa
ggaagcccauccugaccagcugcuccgaggacccaggaaaggcaggauugaaaauguccagg

SEQ ID NO: 742188 - RNA, 62 nt, hsa
cgaggacccaggaaaggcaggauugaaaauguccaggaaaguggccaagaagcaguggccuu

SEQ ID NO: 742189 - RNA, 62 nt, hsa
aaauccgggcagagagguaaaacaccugaaugccaggaaacaggaagauuagacacuguggc

SEQ ID NO: 742190 - RNA, 62 nt, hsa
ggagacuggggcgugugccacauugccagccaccaggaaagcuuuucuuuuucuuuuuuuuu

SEQ ID NO: 742191 - RNA, 62 nt, hsa
aacugaucacuauauuacaucauuucagugggccaggaaaauagaugucuugcuguuuucag

SEQ ID NO: 742192 - RNA, 62 nt, hsa
acaaugccuccaauuccagcucggagucaaucccaggaaaauaugcgaaguucuccaaaccc

SEQ ID NO: 742193 - RNA, 62 nt, hsa
uacaccguuguuguuuuacaucuuuugggaagccaggaaagcguuuggaaaacguaucaccu

SEQ ID NO: 742194 - RNA, 62 nt, hsa
uauauuacaaaccaucacacuuagaaauacuuccaggaaaugcuuuuuugaagugugaauua

SEQ ID NO: 742195 - RNA, 62 nt, hsa
uggaagggggaccugagggccuccaccucgagccaggaaaugaggaccggccggacgaugcc

SEQ ID NO: 742196 - RNA, 62 nt, hsa
ugcugggcccagaggugacauuugacuuuuuuccaggaaaaauguaagugugaggaaacccu

SEQ ID NO: 742197 - RNA, 62 nt, hsa
uggcccguccugggaaggggggugucuagagcccaggaaacuucuucuuccguggcuuuugg

SEQ ID NO: 742198 - RNA, 62 nt, hsa
gaggaggcuugaaggaaccagcaaugagaaggccaggaaaagaaagagcugaaaauggagaa

SEQ ID NO: 742199 - RNA, 62 nt, hsa
caaaaaccuucagcucucagaggagauugggaccaggaaaaccugggaggaugggcagacuu

SEQ ID NO: 742200 - RNA, 62 nt, hsa
caggugccucgauucccugcccuugugaccucccaggaaacagaacugaucugggacacuau

SEQ ID NO: 742201 - RNA, 62 nt, hsa
cucccuccuccccaucaagcacaagagagggcccaggaaaaaagguuucacauaaguguaga

SEQ ID NO: 742202 - RNA, 62 nt, hsa
gauguacccugugccauucaaggagaugugguccaggaaagugagccucaugguuuucagag

SEQ ID NO: 742203 - RNA, 62 nt, hsa
cugccuguggucagggccaaguguucccuccuccaggaaagccuuuacccuccucaugcccu

SEQ ID NO: 742204 - RNA, 62 nt, hsa
uuaagggugcaggaggacagcagcuaacaaggccaggaaauacucacuucccuccacccuca

SEQ ID NO: 742205 - RNA, 62 nt, hsa
uaaaugccaagagggagaaaguugaauuaaacccaggaaaauaucagaagaacucuuuaaaa

SEQ ID NO: 742206 - RNA, 62 nt, hsa
gaacccuuggguagcuugauucugccuaccauccaggaaaacuugugcuggaauugcugaug

SEQ ID NO: 742207 - RNA, 62 nt, hsa
cugcccagaggggcuggggaaagggaugggagccaggaaagauuuaggggcaggagacagac

SEQ ID NO: 742208 - RNA, 62 nt, hsa
aagggaagucaggguucuagggguuauucgucccaggaaauagaagugaaauugucuuuauu

SEQ ID NO: 742209 - RNA, 62 nt, hsa
ggggaggugugcaggaaccagcaaugagaaggccaggaaaagaaagagcugaaaaugcagaa

SEQ ID NO: 742210 - RNA, 62 nt, hsa
agggaggcacguaggaacaagcaaugagaagaccaggaaaagaaagagcugaaaauggagaa

SEQ ID NO: 742211 - RNA, 62 nt, hsa
gggggagcuugcaggaaccagcaaugagaaggccaggaaaagaaagagcugaaaauggagaa

SEQ ID NO: 742212 - RNA, 62 nt, hsa
gacgcaucccaggaggugacgaggcaggggcuccaggaaaggaaucagagacaauucacaga

SEQ ID NO: 742213 - RNA, 62 nt, hsa
gggacugugucucauguuugugugaauguagaccaggaaagggggcugcaaaaauguugagu

SEQ ID NO: 742214 - RNA, 62 nt, hsa
cucuuggguauguagaacuguaugggaagaagccaggaaaaccucugaguguugaaggggca

SEQ ID NO: 742215 - RNA, 62 nt, hsa
cagggaagccuugaaaaccacggagguggaugccaggaaagggcccauguggcagaaggcaa

SEQ ID NO: 742216 - RNA, 62 nt, hsa
uuugugcagccugaaggaucaguguaguaaugccaggaaagugcuuuuuaccuaagacuucc

SEQ ID NO: 742217 - RNA, 62 nt, hsa
caugacaggucuauauuucuaccugggccaggccaggaaagagacuauuuaagaaaaaaaaa

SEQ ID NO: 742218 - RNA, 62 nt, hsa
uauuauaaguaugcugauggaaaucuauauugccaggaaaagcuauucauuaugcguuguga

SEQ ID NO: 742219 - RNA, 62 nt, hsa
caccagucaucagcuauucaguugguaagcuuccaggaaaaaggacaggcagaaagaguuug

SEQ ID NO: 742220 - RNA, 62 nt, hsa
cgaauacuagcaucaguggggaagaaaccuccccaggaaauuggaauuaaagugaaaaauca

SEQ ID NO: 742221 - RNA, 62 nt, hsa
ucacagacauuaccaaagaggagcuugugaauccaggaaaagcuccagggggcuagcugauc

SEQ ID NO: 742222 - RNA, 62 nt, hsa
caacaugccaaaaaugcucaugccaguuaaugccaggaaaaaaaucaccgacacacuacuag

SEQ ID NO: 742223 - RNA, 62 nt, hsa
cuguccaguuagcugugcccugcaccuucagcccaggaaagauuugaacagagcaaaggcuu

SEQ ID NO: 742224 - RNA, 62 nt, hsa
uuucccacaugaaccuccagcaaauagcaaguccaggaaaaacucuucucauucaaagagga

SEQ ID NO: 742225 - RNA, 62 nt, hsa
uucaugaaaugguccacauaguggggaaguagccaggaaaugagaaacuuccucccacccca

SEQ ID NO: 742226 - RNA, 62 nt, hsa
gaaggaaggggcuauccugggaccuccccagcccaggaaaaacuggaagccuucccccagca

SEQ ID NO: 742227 - RNA, 62 nt, hsa
caggccucaccccuccccugggacuuucccacccaggaaaggaggaccagucaggaugaggc

SEQ ID NO: 742228 - RNA, 62 nt, hsa
aaauucaauggccuucuacugcagggaauuuaccaggaaaucuacaaagcaaguuguguggg

SEQ ID NO: 742229 - RNA, 62 nt, hsa
ggauaugacagcuuaccagcuaagaguaccucccaggaaacagucugacuaauguggaaccu

SEQ ID NO: 742230 - RNA, 62 nt, hsa
aaggcaccaaaaggaaacaagcuggaaucgcuccaggaaaaacucugguuacaccuggaaga

SEQ ID NO: 742231 - RNA, 62 nt, hsa
acuccucuacuccaaauuucucauucuucaggccaggaaaccgagacacagagguaaaguaa

SEQ ID NO: 742232 - RNA, 62 nt, hsa
aggaggagguuuugaagaauaaagccucauauccaggaaaaagugaucaagugaaaaagcug

SEQ ID NO: 742233 - RNA, 62 nt, hsa
uugccuauuccaaagagcuaaaaaagucuaacccaggaaagcuuuugauauuuuguguuugu

SEQ ID NO: 742234 - RNA, 62 nt, hsa
gggccauguuuauuguggauugguaagaaucaccaggaaaccauuaagccccaauagcuaca

SEQ ID NO: 742235 - RNA, 62 nt, hsa
auacauuuaccaguguucuuguuuguguggugccaggaaauugauuuuggaaaaagugaaau

SEQ ID NO: 742236 - RNA, 62 nt, hsa
uguguuucccugugagcuagcagacacaaugaccaggaaaaaaccuaugaauuccauucuua

SEQ ID NO: 742237 - RNA, 62 nt, hsa
uguuaaaggccugggguuuaggaagcuaagucccaggaaaacauaccuacagacaggacaac

SEQ ID NO: 742238 - RNA, 62 nt, hsa
gcugcuaugggggauggcaccucucagcccucccaggaaacacacagagcucugggcccauc

SEQ ID NO: 742239 - RNA, 63 nt, hsa
cggaaacagaacucgaugcacugaccugcuccgccaggaaagugagcguguagcguccugagg

SEQ ID NO: 742240 - RNA, 63 nt, hsa
agguccggcccauccccaggcaccucacaggccccaggaaaggcccagccaccgaagccgccu

SEQ ID NO: 742241 - RNA, 63 nt, hsa
guguuuccgcucucaauagccccucuuguuuuaccaggaaagauccaguuaaaucacccacug

SEQ ID NO: 742242 - RNA, 63 nt, hsa
cuuccugaccaacagccagcucuguccuuccccccaggaaacacauguucauuugugugauca

SEQ ID NO: 742243 - RNA, 63 nt, hsa
ugcaaggaaccgguuuauaaaacaacagaacagccaggaaaauggugcuaggagagacagugg

SEQ ID NO: 742244 - RNA, 63 nt, hsa
augcaccugacuuaugaaauggggauaauacucccaggaaauagcgcaggacaucacaaggac

SEQ ID NO: 742245 - RNA, 63 nt, hsa
ucaggggcauuugacauccccuccugguucucaccaggaaaacauccaaagcuuuggaggaaa

SEQ ID NO: 742246 - RNA, 63 nt, hsa
ccugaagaccaccccagucuaccucggugcuggccaggaaaccuuucggcuaccucucccacc

SEQ ID NO: 742247 - RNA, 63 nt, hsa
uaagaucaacaggucccccccacaugaggccacccaggaaaaaaggcaggggcaguggcaucc

SEQ ID NO: 742248 - RNA, 63 nt, hsa
ggauucauugccacacucuuuucucccagggacccaggaaacuaggacuuuguguguuugcug

SEQ ID NO: 742249 - RNA, 63 nt, hsa
cacuggaauggaaaaguguguuccuguucauagccaggaaacccagcucagcaaacucccuuu

SEQ ID NO: 742250 - RNA, 63 nt, hsa
aaguauuaaaacauuggauuauccugagguguaccaggaaaggauuuuauaaugcuuagaaaa

SEQ ID NO: 742251 - RNA, 63 nt, hsa
auuccuugugugugucuuggagugcauuugacuccaggaaaagccauuuugguuuuccuuaac

SEQ ID NO: 742252 - RNA, 63 nt, hsa
aacaugaagaaaacuuguauauucuaauguuugccaggaaaggcuagguucaguagaugagac

SEQ ID NO: 742253 - RNA, 63 nt, hsa
ccuagaucauggcaaggccugacaacagcugagccaggaaagugcugcugaggcaagucgaca

SEQ ID NO: 742254 - RNA, 63 nt, hsa
gccgugaacugaagaaugguauccagucaucagccaggaaagauggggauucacuuacaugcc

SEQ ID NO: 742255 - RNA, 63 nt, hsa
ggcauggguggauuuagccaaggaccuggcaacccaggaaacaugauguuuuaagcugcuaag

SEQ ID NO: 742256 - RNA, 63 nt, hsa
aaaucugcgagguaguuucuuugguauucuugcccaggaaauggguugauucaucacagauuu

SEQ ID NO: 742257 - RNA, 63 nt, hsa
aagcacuucgucuuacccauuuauguaggggccccaggaaaccuacacacagccagaaugagg

SEQ ID NO: 742258 - RNA, 63 nt, hsa
uccuaauuucuccucccuuccuuuucccugcuuccaggaaacuccacaucugccuuaaaacca

SEQ ID NO: 742259 - RNA, 63 nt, hsa
uggagagucuuuccucacgcuccagcacaguggccaggaaaagaaauacugaauuugccccag

SEQ ID NO: 742260 - RNA, 63 nt, hsa
aauuuuuuccaagccaaggagaccauuggccauccaggaaauuucguacagcugaaauauagg

SEQ ID NO: 742261 - RNA, 63 nt, hsa
ucugccuccauauauccugaacaucaaacuaucccaggaaaaccaucuagaguaguuuguuuc

SEQ ID NO: 742262 - RNA, 63 nt, hsa
gcaaauaguauaaacaacacuaaauuuacugugccaggaaaucuuccugaacuccuugaacuc

SEQ ID NO: 742263 - RNA, 63 nt, hsa
uccucugcugcuguccaugacuguccuuuugaaccaggaaaagucacagaguuuaaagagaag

SEQ ID NO: 742264 - RNA, 63 nt, hsa
ccaaucccaaggauggaggcugugcccagagccccaggaaaaugggagugagaagaugccugg

SEQ ID NO: 742265 - RNA, 63 nt, hsa
auagcuucuccuacagugauucaugucccagguccaggaaauccaauguuggugaaggcagcc

SEQ ID NO: 742266 - RNA, 63 nt, hsa
cacgaaggguuuuuagccagggaaaacugagccccaggaaaaccuaaccacugggcaggcaga

SEQ ID NO: 742267 - RNA, 63 nt, hsa
auggccaugcuuaagccagcaauuggcugggguccaggaaacaaagcaaaagcacaauaugug

SEQ ID NO: 742268 - RNA, 63 nt, hsa
ucccuucuccucugccugguuagacucgggcacccaggaaagccuggccagggcuccuuuggg

SEQ ID NO: 742269 - RNA, 63 nt, hsa
ucguguccccagggacuucuaaagcuuggggcuccaggaaaucauccaguagaguuggagauu

SEQ ID NO: 742270 - RNA, 63 nt, hsa
aagccagugucuuucugagguaaauaauuucugccaggaaacuucccagccccaccagcagcc

SEQ ID NO: 742271 - RNA, 63 nt, hsa
cacgcaagccugaggacccuccccuaccaaggaccaggaaaagcagcagcugccugcucucca

SEQ ID NO: 742272 - RNA, 63 nt, hsa
agaagaugagucuauggcaucagguucuuaaacccaggaaagcaccuacagaccggcuccucc

SEQ ID NO: 742273 - RNA, 63 nt, hsa
aacaguugacaaacugucauucaacaauuagcuccaggaaauaacaguuauuucaucauaaaa

SEQ ID NO: 742274 - RNA, 63 nt, hsa
cucccagcgccagauucaucaugucuguugugaccaggaaagcugcccccaucugcaggaagc

SEQ ID NO: 742275 - RNA, 63 nt, hsa
uggagacuggaggugguggggcuugaaaugagcccaggaaaccagagcagugagggcgggcgg

SEQ ID NO: 742276 - RNA, 63 nt, hsa
ugcuagcuguagugugacacauuguaguguuugccaggaaaggagccagucaugccggaaaca

SEQ ID NO: 742277 - RNA, 63 nt, hsa
uccccucuggguggacaugcacccauccccaguccaggaaaccaucucccccaggaccuucug

SEQ ID NO: 742278 - RNA, 63 nt, hsa
uaacaaguucccaggugaugcugugcugcuuguccaggaaacacaauuugagagucaugugaa

SEQ ID NO: 742279 - RNA, 63 nt, hsa
auauugaggaaucaucuagaacaauuaagccgaccaggaaaccucauuccuaccuacacugga

SEQ ID NO: 742280 - RNA, 52 nt, hsa; identical to SEQ ID NO: 741700

SEQ ID NO: 742281 - RNA, 63 nt, hsa
uugugaaaauuacaaaucugaagaacauaguguccaggaaagugguuuagcacgaagaggccc

SEQ ID NO: 742282 - RNA, 63 nt, hsa
aagacagcuuacuuggcucaucguucagggaacccaggaaaaugggaggagaacgccgcgugg

SEQ ID NO: 742283 - RNA, 63 nt, hsa
ucucucaaaaggaacuugggaaacuugugaaacccaggaaaaccuuuagucuuauaccucaac

SEQ ID NO: 742284 - RNA, 63 nt, hsa
ucccuagagggcccuugucugagaaaccccaaaccaggaaaccccaccuacccaaccauccac

SEQ ID NO: 742285 - RNA, 63 nt, hsa
agcgauuuuggaggaaacaagaaucccaagggcccaggaaaaccccaucuugaugcaugaguu

SEQ ID NO: 742286 - RNA, 63 nt, hsa
uugggaaacuuacauguugagaucuacagagauccaggaaaccaaagcccugcugagcagagc

SEQ ID NO: 742287 - RNA, 63 nt, hsa
aaguuuucaagggguauuacucaggcacuaaccccaggaaagaugacagcacauugccauaaa

SEQ ID NO: 742288 - RNA, 63 nt, hsa
gcccaggcacccagaugauuccuauggcaccagccaggaaaaauggcagcucuuaaaggagaa

SEQ ID NO: 742289 - RNA, 63 nt, hsa
gcgaccuuuggaaaacguuagcgguguaacaguccaggaaacuguuuuuuuuuguuguuguug

SEQ ID NO: 742290 - RNA, 63 nt, hsa
cuguggggagcagggcugugacucuggcugagcccaggaaagcgacaagggugaacugggaga

SEQ ID NO: 742291 - RNA, 63 nt, hsa
uucugggaaauuagaaaaaguggggugaucuuuccaggaaaaacauguguaacaucugcuuau

SEQ ID NO: 742292 - RNA, 63 nt, hsa
ggaacagccuuguccaggcagaacagucauaagccaggaaaugaaacaaaggaaaacaggugc

SEQ ID NO: 742293 - RNA, 63 nt, hsa
cuuuauuucucucaucuguuacacaaagaaccaccaggaaagcaaaucaguuugguugguaac

SEQ ID NO: 742294 - RNA, 63 nt, hsa
cauguagcuggcaagcugcaaaaggccugugauccaggaaagaugucccacagggaccacauc

SEQ ID NO: 742295 - RNA, 63 nt, hsa
ucuuguuccugagaaggguggguaacagauauuccaggaaaaagaaugcacauugaauggaug

SEQ ID NO: 742296 - RNA, 63 nt, hsa
ccaaaagagaagcagucugggccagaugcccugccaggaaagggacauggacccacgugcuug

SEQ ID NO: 742297 - RNA, 63 nt, hsa
aucucuuccugaucuucccugcccauuggguacccaggaaacugcaagcauugccuguguucc

SEQ ID NO: 742298 - RNA, 63 nt, hsa
cucccucugaucauuuccaguugauugucauauccaggaaaaaauggaacagugcacucuucu

SEQ ID NO: 742299 - RNA, 63 nt, hsa
ugucuuccuucauccuuaaaggucuuugugaccccaggaaaauauugacucugucuaacacac

SEQ ID NO: 742300 - RNA, 63 nt, hsa
cagcaaacgcagugaguaucaaccugauuguugccaggaaauccuuaugaauuaaaacaaugc

SEQ ID NO: 742301 - RNA, 63 nt, hsa
gagccugcgugggagaaccccaauucuagcacuccaggaaacugugggagaguguggggcagg

SEQ ID NO: 742302 - RNA, 63 nt, hsa
uuuuuuuaaagauggauuuaaaccaagaugccuccaggaaagaggacgaaaugaguauauuca

SEQ ID NO: 742303 - RNA, 63 nt, hsa
ugacuuucuaguucuagaaguuccgcugcaaggccaggaaagcuugagaaagguauuguggaa

SEQ ID NO: 742304 - RNA, 63 nt, hsa
uagacaugugauagcaaaagaaacaaacaaaagccaggaaaacacucauuuucgccuugaaua

SEQ ID NO: 742305 - RNA, 63 nt, hsa
guugguugaacugaacauaucuugucuuagcacccaggaaacagaacuuuaagauauauacag

SEQ ID NO: 742306 - RNA, 63 nt, hsa
auuuuucaauuccagauuuuuaauuuuaaggcuccaggaaagaaaggagaguagaacauuuuu

SEQ ID NO: 742307 - RNA, 63 nt, hsa
aaaucuaggcagugaacaagucuucauccuggcccaggaaauagccuauuaaaaaaugcuguc

SEQ ID NO: 742308 - RNA, 63 nt, hsa
gggaggaugacaagccgcugcccaccuccaagcccaggaaacaguacaagauggcuaaggaga

SEQ ID NO: 742309 - RNA, 63 nt, hsa
gccaaggaggagcggcgcauggaccagaugaugccaggaaagaccaaagcagaugcugcugac

SEQ ID NO: 742310 - RNA, 63 nt, hsa
aaagcagccaugagaaggaaggauucaccaccuccaggaaaagguaaauuugccaauacaaau

SEQ ID NO: 742311 - RNA, 60 nt, hsa; identical to SEQ ID NO: 741731

SEQ ID NO: 742312 - RNA, 63 nt, hsa
gccccaauuuucagguaguacuaagaguaugugccaggaaacucuugcuauugaauugagaug

SEQ ID NO: 742313 - RNA, 63 nt, hsa
uaaacaugcugccaaccagcuuguccaacaacuccaggaaaacuguuuuucaaaacgccaugu

SEQ ID NO: 742314 - RNA, 63 nt, hsa
uaagugcacaaauucuguaguuugccguaucauccaggaaaaccugagggaaaaaaauuauag

SEQ ID NO: 742315 - RNA, 63 nt, hsa
ggaauucggagcuagaggacauggaaaauaaagccaggaaagucaaaaaaacgaaagagaagg

SEQ ID NO: 742316 - RNA, 63 nt, hsa
gacugcagguugugcccuguggcugccugcaccccaggaaaggagggggcucaggccauccag

SEQ ID NO: 742317 - RNA, 63 nt, hsa
gugauugauuuuaggaggcccacaccaaacuccccaggaaaugacugccuuccuugggaccaa

SEQ ID NO: 742318 - RNA, 63 nt, hsa
uaaguguuuuccggcugauaaggcuaacccuacccaggaaaggauugauaacuaaauaaauuu

SEQ ID NO: 742319 - RNA, 63 nt, hsa
gcuaggccccaguucuuccuccuucccccuuucccaggaaaggccagcccaguccauggccuu

SEQ ID NO: 742320 - RNA, 63 nt, hsa
ugagccacccacuugccauuugcuccuguccuuccaggaaaucacaauuuucaucagagccca

SEQ ID NO: 742321 - RNA, 63 nt, hsa
ccauuaugcuguacuaucuacccauaaauaccuccaggaaacauuccccucuugguaauuugu

SEQ ID NO: 742322 - RNA, 63 nt, hsa
agugugaaagguuacuuaauuaaauuacaaccaccaggaaauugacugcuuuuuuuuuuuuuu

SEQ ID NO: 742323 - RNA, 63 nt, hsa
guuuggcaggacacagagagguaggugaacauuccaggaaagaagcagcuuagagaaaaugug

SEQ ID NO: 742324 - RNA, 63 nt, hsa
ugcuuguauuuuaagacauucauuaaaaagaaaccaggaaacacuuuugaaauaacagcauaa

SEQ ID NO: 742325 - RNA, 63 nt, hsa
aagaguuauugaaaugcauggguagaaauugaaccaggaaaaucaguaaagugauuguaaaaa

SEQ ID NO: 742326 - RNA, 63 nt, hsa
ggcauuuugguccaaguugugcuuaucccauagccaggaaacucugcauucuaguacuuggga

SEQ ID NO: 742327 - RNA, 63 nt, hsa
uuuuuuuaagauuuguucauaaaauggucugauccaggaaaaauaaaaugggaacauggacac

SEQ ID NO: 742328 - RNA, 63 nt, hsa
aaauauuuagccccucuguucugugcuuacuggccaggaaaugguaccaauuuuucaguguug

SEQ ID NO: 742329 - RNA, 63 nt, hsa
auauuacaagcaauccccaaauuuuauggucuuccaggaaaaguuauuaccguuuaugauacu

SEQ ID NO: 742330 - RNA, 63 nt, hsa
uuacuguuucuguugccuggacaguuacaguuuccaggaaacaucaggaaguaggaaacugua

SEQ ID NO: 742331 - RNA, 63 nt, hsa
ggccuugugacuguucuuuaaggcugaagauauccaggaaagggggcuuggacacuggccaag

SEQ ID NO: 742332 - RNA, 63 nt, hsa
ccaaauuagaaugcuuauaaugagacccaaucuccaggaaaacaacacucacauaaguuuaau

SEQ ID NO: 742333 - RNA, 63 nt, hsa
acugccagaggaagaucuggcgucacauggcucccaggaaagugcugugcccuauccccacug

SEQ ID NO: 742334 - RNA, 63 nt, hsa
gagugacuccaagaagaguuccggcagcuuuccccaggaaagggugaggggugacacucggcu

SEQ ID NO: 742335 - RNA, 63 nt, hsa
aagaaaaaggucugaggcagaauccaagaucugccaggaaacacacaacaaaacaucugcugu

SEQ ID NO: 742336 - RNA, 63 nt, hsa
gaggugcuuugagcaguucugaaaaaugcaguuccaggaaagcaacugcuuugguuccuaagg

SEQ ID NO: 742337 - RNA, 63 nt, hsa
uccugugccaaaguccugucaggcuggugggcaccaggaaaggccugcacccucuuccugcuc

SEQ ID NO: 742338 - RNA, 63 nt, hsa
aacccaaaggagcugccgcacugacccagccccccaggaaacagugagacaagaaucaaguau

SEQ ID NO: 742339 - RNA, 63 nt, hsa
cacauggcgcaugaaggagagcccagucucccuccaggaaaggccugaggauguaagucaggc

SEQ ID NO: 742340 - RNA, 63 nt, hsa
aggagcuaagcugggaugccacauaggcagaagccaggaaaaaugaccaaccacagaaccaag

SEQ ID NO: 742341 - RNA, 63 nt, hsa
caucuguuaccuguacgcuguauuaaaauagaaccaggaaaggcucaggauuucagacauuuc

SEQ ID NO: 742342 - RNA, 63 nt, hsa
ugagcagucaaguguucaggccacacagucagcccaggaaaaagagaagcagggccaaaugga

SEQ ID NO: 742343 - RNA, 63 nt, hsa
acucaauaucuaucucagaggaaauaugguuacccaggaaagaaauggucugcuagagugaua

SEQ ID NO: 742344 - RNA, 63 nt, hsa
uaaaaugccagggccaggcuguguauuucuuucccaggaaauuagcuuuccagccccuuuaua

SEQ ID NO: 742345 - RNA, 63 nt, hsa
uccgacccugccacagguuccuggaaagacucuccaggaaauggaagauacugauuuuuuuuu

SEQ ID NO: 742346 - RNA, 63 nt, hsa
ucaauugauauauaauaaccguucuaaccucuuccaggaaaauauuuuuagaacuacuagcuu

SEQ ID NO: 742347 - RNA, 63 nt, hsa
auuucaaaaugguauuuugaugccaucaaaugcccaggaaauugacuuugcagugucaccacu

SEQ ID NO: 742348 - RNA, 63 nt, hsa
aaaauaaagaagcugccaccuaacaggagucacccaggaaagcaccgcacaggcuggcgcggg

SEQ ID NO: 742349 - RNA, 63 nt, hsa
ucugaaugcaagcaguuuauaugggagaugauuccaggaaauaccgauaugagaauggggaaa

SEQ ID NO: 742350 - RNA, 63 nt, hsa
ggcagcucagaauuauucuggaaagaaagccugccaggaaauaaauucaaauacaguaugagc

SEQ ID NO: 742351 - RNA, 63 nt, hsa
ggcacacucuggagaccuugcuggcagugcuagccaggaaacagagugaccaagggacaagaa

SEQ ID NO: 742352 - RNA, 63 nt, hsa
uuuagcuuguccuaaaucuugcuguccacccuuccaggaaagggacauuguaaaugaauaaaa

SEQ ID NO: 742353 - RNA, 63 nt, hsa
cagucaacaaaaauugggcuaagucacuuuuccccaggaaagaauauuucccucuccugcauc

SEQ ID NO: 742354 - RNA, 63 nt, hsa
gacagcaaagaugaugggcucugcacaccaacuccaggaaacucauucugggccagcucuaug

SEQ ID NO: 742355 - RNA, 63 nt, hsa
cugacugaauguugguaggugcuccauuacaauccaggaaagucuguguuacugauauuugug

SEQ ID NO: 742356 - RNA, 63 nt, hsa
gcaugcccagucagaaaucuguucuauucugcuccaggaaaaucggaaaccugugagucagag

SEQ ID NO: 742357 - RNA, 63 nt, hsa
cagcccagcccagccugacguggauguggcugcccaggaaaagacuuaacugugaaaaaguac

SEQ ID NO: 742358 - RNA, 63 nt, hsa
aagccggucucaaagauaacugcauccuucauuccaggaaagcccuagaauuagggcacauug

SEQ ID NO: 742359 - RNA, 63 nt, hsa
uacccagaauacuugccgccugcuuuuuguccuccaggaaaccagaagcccggguaauuaggu

SEQ ID NO: 742360 - RNA, 63 nt, hsa
uugggcucagcacauuuuacuguuaguagagagccaggaaacguuuucuggguuggggauuuu

SEQ ID NO: 742361 - RNA, 63 nt, hsa
gagaugccuuggccauggcacaagagaaaccagccaggaaaaaccagacagacuuucacacua

SEQ ID NO: 742362 - RNA, 63 nt, hsa
ucuuaagagccaaaggaaggaagugguugagggccaggaaagagaaggaaugucaugccaggg

SEQ ID NO: 742363 - RNA, 63 nt, hsa
uccgcucccugccaccauccuccuuccugggcuccaggaaaguguuucugggaggucaggagg

SEQ ID NO: 742364 - RNA, 63 nt, hsa
gggauuaaagaggggaggagagagugcagagcuccaggaaaggguaucagagcugcagccagc

SEQ ID NO: 742365 - RNA, 63 nt, hsa
uauucuccaacuccaaacaagcucuagagugcuccaggaaaaguuauauucaguauaugaaua

SEQ ID NO: 742366 - RNA, 63 nt, hsa
auuuuuaguguuuuuucagauauaaaucgggguccaggaaauccucaccagaaucuggcacug

SEQ ID NO: 742367 - RNA, 63 nt, hsa
gcuggccuggaggaguucgggaaggaggauagaccaggaaauaaagggucaacagagcugugu

SEQ ID NO: 742368 - RNA, 63 nt, hsa
ggauggggggcacaggagcugggagccccgucuccaggaaaaggagagggguuaagaugcacc

SEQ ID NO: 742369 - RNA, 63 nt, hsa
aguaacaaaguaugcuuugccuguuuccacuuaccaggaaauuccuucagaacuagauuagca

SEQ ID NO: 742370 - RNA, 63 nt, hsa
accacaggcaguuacuucugagggcaucuugguccaggaaaugugcacaaaauucgaccugau

SEQ ID NO: 742371 - RNA, 63 nt, hsa
gugaaauggagaauuucaggucuccacgucugcccaggaaagaacuucagcugacuccacggg

SEQ ID NO: 742372 - RNA, 63 nt, hsa
ccccaucaacaaccguccugcuccccaccucccccaggaaauaaggggccugcuccucucccu

SEQ ID NO: 742373 - RNA, 63 nt, hsa
caaagacuaauggggagagggagggccgggaagccaggaaagcuugguguuuucucuggguac

SEQ ID NO: 742374 - RNA, 63 nt, hsa
aacugaagaaacugccgcucugagacugcacauccaggaaaaaagacuaggacuugccacaca

SEQ ID NO: 742375 - RNA, 63 nt, hsa
gcuugcaagugugcaugguucaaucccucacauccaggaaaugaauuuugcaauugggccaga

SEQ ID NO: 742376 - RNA, 63 nt, hsa
uggauuuuaguuuugugcuuaguuaaaucuuuuccaggaaaaagaacuuccccauacaaauaa

SEQ ID NO: 742377 - RNA, 63 nt, hsa
aguuuugguuccuuuugcagagugaaaugccucccaggaaaaaaauacauauguauuuuuuug

SEQ ID NO: 742378 - RNA, 63 nt, hsa
cuauguguugcuaaaacacaugcuaugagcacuccaggaaacacuauauuuuuuccaaaaaau

SEQ ID NO: 742379 - RNA, 63 nt, hsa
uguaccaacacuugaaagauggguggauauuuuccaggaaacagauuuugggcaggacauucc

SEQ ID NO: 742380 - RNA, 63 nt, hsa
auaggauuuggaagacaggaacggcacaggcguccaggaaagcagcugcacucagacaaugcc

SEQ ID NO: 742381 - RNA, 63 nt, hsa
uuuuguuuuguuuuuuacaagauauaacauaacccaggaaacagacccagcugagguuauucu

SEQ ID NO: 742382 - RNA, 63 nt, hsa
uuaauaauacauuuauguugacaccucccuaauccaggaaacauucacaaacaaggacuccca

SEQ ID NO: 742383 - RNA, 63 nt, hsa
caccuuugaacagaucccggugacauucuauuuccaggaaaauccggaaccugauuuuaguuc

SEQ ID NO: 742384 - RNA, 63 nt, hsa
acauuuuaugcugaucuucaguucauaauucuuccaggaaaacucagucuuccaacugcaaua

SEQ ID NO: 742385 - RNA, 63 nt, hsa
gcaauggagaucaugacacuacuguuaauaaggccaggaaaacugccauuucaaguucugaaa

SEQ ID NO: 742386 - RNA, 63 nt, hsa
augcuggacuuggcucagugcuauaaauuguagccaggaaauaagaagagcuuacacagaguc

SEQ ID NO: 742387 - RNA, 63 nt, hsa
agcuggcaaacaccaggcugcggcuuggauuaaccaggaaagaaagcuuuucucacugaguug

SEQ ID NO: 742388 - RNA, 63 nt, hsa
gguauuuuauuacugcauaauagauggugaaacccaggaaaauuaaguacuugugcauggccc

SEQ ID NO: 742389 - RNA, 63 nt, hsa
ugggccagagaagauaauguucuuuaauguuguccaggaaacccuggcuugcuugccgagccu

SEQ ID NO: 742390 - RNA, 63 nt, hsa
gucucuuguagaagauggacucugaaaaacauuccaggaaaccauggcagcauggagagccuc

SEQ ID NO: 742391 - RNA, 63 nt, hsa
gauauuuccuguucacuugugcaugggcuaaaaccaggaaaacuuccuugucuuauuacuuua

SEQ ID NO: 742392 - RNA, 63 nt, hsa
auuagcuggaguaggagucugggaguggagaccccaggaaacagcaugaggugagggugugag

SEQ ID NO: 742393 - RNA, 63 nt, hsa
ugagcauggguccuuguucuuccuauuucaccuccaggaaagcaaaagugggagcagaaauuc

SEQ ID NO: 742394 - RNA, 63 nt, hsa
cuccaacugccaaauucugcuucccucugaaccccaggaaauacuuucuggagaggcuugucu

SEQ ID NO: 742395 - RNA, 63 nt, hsa
acauuccacaaucuauggcuuccaccagcuagcccaggaaauacuugaaaucagcauuccaau

SEQ ID NO: 742396 - RNA, 63 nt, hsa
aggguggguaagaguccaugggggugcccagucccaggaaaggggacaaugaagggacaggcc

SEQ ID NO: 742397 - RNA, 63 nt, hsa
uuuacuccccagcccagagagacgcugcuuuuaccaggaaagacuauugaaagauguuuuauu

SEQ ID NO: 742398 - RNA, 63 nt, hsa
aaucuguauguaucaauacaggguuuuuccaagccaggaaacgcccuccuuggcuacuaggag

SEQ ID NO: 742399 - RNA, 63 nt, hsa
uuauuuauuuaacuuacuuaucuggucaaagccccaggaaaccuaccaaagcuagaauuaaug

SEQ ID NO: 742400 - RNA, 63 nt, hsa
cagcccuuggcucccucuugcucguuguucucaccaggaaaguacacgggccugaggcaggau

SEQ ID NO: 742401 - RNA, 63 nt, hsa
uguguguguguguuuaauaugauuuagugacaaccaggaaaacuuacuugggauuauuagcac

SEQ ID NO: 742402 - RNA, 63 nt, hsa
ggcauuggaggauggggguccugguaugucucaccaggaaauucuguuuauguucuugcagca

SEQ ID NO: 742403 - RNA, 63 nt, hsa
auguuuugaaaagaguaauuuaacuuuugggugccaggaaauggguuuucucaaaguccauug

SEQ ID NO: 742404 - RNA, 63 nt, hsa
uuauuuuucuaauaaauaggaccauuauuacuaccaggaaagucuuauuuauuuugccugaaa

SEQ ID NO: 742405 - RNA, 63 nt, hsa
ugcaacugaagaacugcagccaagaccuuaauuccaggaaagcacagaggacaaaguuaauuc

SEQ ID NO: 742406 - RNA, 60 nt, hsa; identical to SEQ ID NO: 741826

SEQ ID NO: 742407 - RNA, 63 nt, hsa
uagcaggagucagggggcuguacccugggggugccaggaaaugcucucugaccuaucaauaaa

SEQ ID NO: 742408 - RNA, 63 nt, hsa
gucccgcucuccugcuuaccuaggaggugagugccaggaaaauacaccaaaugcuucuaguau

SEQ ID NO: 742409 - RNA, 63 nt, hsa
uaccuagcacacugccuaguacauaguagaaguccaggaaauggaagccauuauuauguaaaa

SEQ ID NO: 742410 - RNA, 63 nt, hsa
uuauugugacaacauuccaguacucugaaauagccaggaaacuucuuugaauggaauuugacu

SEQ ID NO: 742411 - RNA, 63 nt, hsa
acuaggaauucuugacguggggucucuggagcuccaggaaauucgggcacaucauauguccau

SEQ ID NO: 742412 - RNA, 63 nt, hsa
ggcucuccaccagcacaucacuaugcaucuguuccaggaaagaagaaaagcgagcgaggaaga

SEQ ID NO: 742413 - RNA, 63 nt, hsa
gaagaguugugucuuuuguggccagugacaaauccaggaaaugaauguugcugauagggauaa

SEQ ID NO: 742414 - RNA, 63 nt, hsa
auggagcugaucaaggucauguuucucacuguuccaggaaauugaucaacucuuccaauggga

SEQ ID NO: 742415 - RNA, 63 nt, hsa
gguaauauaaaggacuaggaagcagucauacuuccaggaaaugcuuggauucauguggacauu

SEQ ID NO: 742416 - RNA, 63 nt, hsa
auuggccucuuugauacacuuuugcuugccuccccaggaaagaaggaauugcauccaagguau

SEQ ID NO: 742417 - RNA, 63 nt, hsa
ucauuuguucaaaaguuagaacaucuggcugcaccaggaaaaaaaaaaaaaaaaaguccuguu

SEQ ID NO: 742418 - RNA, 63 nt, hsa
ugcuuuccaccgaguacuguguuuauucucucuccaggaaagcagaucaaaagaaaguuagca

SEQ ID NO: 742419 - RNA, 63 nt, hsa
cugagagaugaagcaucauauugacaacuuacuccaggaaaaaagguguguguauaggugugu

SEQ ID NO: 742420 - RNA, 63 nt, hsa
ugaaaacauaaauaucugccacauaaaagaaguccaggaaaauaacacguaauaagacuguuc

SEQ ID NO: 742421 - RNA, 63 nt, hsa
gcuguccuuauaacgccuuauacgcauacacagccaggaaacguggagcauuguuucucacag

SEQ ID NO: 742422 - RNA, 63 nt, hsa
gguggggugggguggggugggggcugucuguguccaggaaacuuaauucccuggugacuagag

SEQ ID NO: 742423 - RNA, 54 nt, hsa; identical to SEQ ID NO: 741843

SEQ ID NO: 742424 - RNA, 63 nt, hsa
caacuuucuggagaggugccaaacuugguguggccaggaaagggcaguccugagggagaagac

SEQ ID NO: 742425 - RNA, 63 nt, hsa
auccaaggaagggauguauuuguaguguuauugccaggaaaggagaguacuuugguuucugag

SEQ ID NO: 742426 - RNA, 63 nt, hsa
auaaaaagggaauuuaggauccaccaucgguggccaggaaaauagcagugacaauaaacaaag

SEQ ID NO: 742427 - RNA, 63 nt, hsa
uuuggauaauaaaaauuguagcuuuuuauuaagccaggaaacaugaagcauaauuuguuuaaa

SEQ ID NO: 742428 - RNA, 63 nt, hsa
gccuugaaagaaucaacuucuaaccucaaccauccaggaaauugacaguggcugcaguauuga

SEQ ID NO: 742429 - RNA, 63 nt, hsa
caacuuuucaaagcccaccaauccacauuuucuccaggaaauuaaauauuuaaguaagugagu

SEQ ID NO: 742430 - RNA, 63 nt, hsa
uuuucuguuccuccccgagaggcccucuggcccccaggaaaccuguugugcagagcucuuccc

SEQ ID NO: 742431 - RNA, 63 nt, hsa
auaauaugcuuuccagcuagaggggagaaaacaccaggaaagaggaacccugggucauaaaau

SEQ ID NO: 742432 - RNA, 63 nt, hsa
aaauggauagaaacaaaauucucuaguacucauccaggaaaccauucuucaauguugcaugug

SEQ ID NO: 742433 - RNA, 63 nt, hsa
cuaacauauuuacucuugucuaacuuaagagugccaggaaagcagaugcuuagauuuuguguc

SEQ ID NO: 742434 - RNA, 63 nt, hsa
aaaagcuggagugugaggcaggaggcuggaaacccaggaaagcugauggugcaagguccaguc

SEQ ID NO: 742435 - RNA, 63 nt, hsa
agagagcuaugauguccuaggacugagaguaccccaggaaagaauacccuugaaagggucucc

SEQ ID NO: 742436 - RNA, 63 nt, hsa
aacucgaggggagaagucgcgcccccagggaagccaggaaacucugacacagaacgcccaacg

SEQ ID NO: 742437 - RNA, 63 nt, hsa
ugccgcugcaggaaacauuucugacaccgucgaccaggaaagccacacggagaggccacugug

SEQ ID NO: 742438 - RNA, 63 nt, hsa
uuuuuuaaguaaaguuuguagcuccucccaugcccaggaaagcacagaacucaaguguggugg

SEQ ID NO: 742439 - RNA, 63 nt, hsa
agguuaaaagagccuuuuggacagaaaacugggccaggaaaaggcaucucagaccacaaauag

SEQ ID NO: 742440 - RNA, 63 nt, hsa
auggggaagucagcugaaacuugucuuguuuugccaggaaaggaaguaguugccuuuggucau

SEQ ID NO: 742441 - RNA, 63 nt, hsa
gguucguaccagcaaguagacuaggaacugagcccaggaaagggggauguuuuccugguguuu

SEQ ID NO: 742442 - RNA, 63 nt, hsa
ucaugucacuaaacaagaaaucugacaauagugccaggaaacuaauuuccugauacauuaaaa

SEQ ID NO: 742443 - RNA, 63 nt, hsa
cucccgcgcccccaccccagaccccgagccaccccaggaaaagcacaaggacugccgccuucu

SEQ ID NO: 742444 - RNA, 63 nt, hsa
acccugaagcaguuguucaaacuuuguucaauaccaggaaauuuauauuggagaaaaacccua

SEQ ID NO: 742445 - RNA, 63 nt, hsa
gcucauucacccaacaaaacugugucuuaucugccaggaaagaccagccucacuccugggaac

SEQ ID NO: 742446 - RNA, 63 nt, hsa
caaugggaugucaccuaccaaaauccaaauccuccaggaaaaacuacuacacuaaauggacca

SEQ ID NO: 742447 - RNA, 63 nt, hsa
uuccauuucucuucuuugaccgugcuaggaauuccaggaaagugcauuccugcccuggugacc

SEQ ID NO: 742448 - RNA, 63 nt, hsa
cucuagaauugggcuuguacagaaggauaaaacccaggaaaauggauauuucuauucagauuu

SEQ ID NO: 742449 - RNA, 63 nt, hsa
ccagaagccacauccgcacaauuuuccacuuaaccaggaaauauuucuccucuaaaugcauga

SEQ ID NO: 742450 - RNA, 63 nt, hsa
aucauauuacuaggacuuaauauaguggcauacccaggaaaugcuuaguaaguguucccuuca

SEQ ID NO: 742451 - RNA, 63 nt, hsa
gagggucucuugcccaucucuccggccaccccgccaggaaacgacgagaaggccgaggaaucc

SEQ ID NO: 742452 - RNA, 63 nt, hsa; identical to SEQ ID NO: 742439

SEQ ID NO: 742453 - RNA, 63 nt, hsa
uggagggcauuuggaaggagcagugaagccaagccaggaaacaccaagauggcgagccagugu

SEQ ID NO: 742454 - RNA, 63 nt, hsa
ucgacugguguuugaucacgaugggaaaaucauccaggaaacccccuacccccaccccagagg

SEQ ID NO: 742455 - RNA, 63 nt, hsa
ugcgcugcaccaacauugggggccuggagcucuccaggaaagccaagcuggcggccaccgcag

SEQ ID NO: 742456 - RNA, 63 nt, hsa
accugcucaguguggcuggagguugaaaugccaccaggaaaaugccacuucauaauugaaagg

SEQ ID NO: 742457 - RNA, 63 nt, hsa
ucuccuguagggcaccucccugccccuagccucccaggaaauggugcucuccuggcccugccu

SEQ ID NO: 742458 - RNA, 63 nt, hsa
gauacuggggaguaaacggcccaggccaggugcccaggaaaggacggcugagcauguggagcg

SEQ ID NO: 742459 - RNA, 63 nt, hsa
cgcccucugcccucuugcugcuucuccacauugccaggaaaagcugcugacgccugcccuccu

SEQ ID NO: 742460 - RNA, 63 nt, hsa
ucuagcugagagggccuggcccuggggugggcuccaggaaaacgcugguuaggccugggauug

SEQ ID NO: 742461 - RNA, 63 nt, hsa
acuugucauucuacuuucuauauuguuaucaguccaggaaacagguaaacagauguaauuaga

SEQ ID NO: 742462 - RNA, 63 nt, hsa
agggguguggaaaaggugauccuuuacccccacccaggaaaaccugcauugugcuagcaugga

SEQ ID NO: 742463 - RNA, 63 nt, hsa
ccauaaugcuucccauugaagggaaguugagaaccaggaaagcugcuuucacgucauugccau

SEQ ID NO: 742464 - RNA, 63 nt, hsa
ccuguacugguuuaaauaaguuuaccuuuuccuccaggaaauauaaugauuucugggaacaug

SEQ ID NO: 742465 - RNA, 63 nt, hsa
cuacuuuauuuauuguucccuugaaaugacugaccaggaaaaagaucauccuuaaauuuugaa

SEQ ID NO: 742466 - RNA, 63 nt, hsa
ugagauuuguuaaaacgguuaggacuguuuuguccaggaaagauaagaggaccaaacauauaa

SEQ ID NO: 742467 - RNA, 63 nt, hsa
gugacauauauaaauuaagcauaaaauauguaaccaggaaaagacuguuaacauuacauuuau

SEQ ID NO: 742468 - RNA, 63 nt, hsa
uucauagaauaacaacugcugggaauauccgugccaggaaaagaaaaauuucuggcaaauauu

SEQ ID NO: 742469 - RNA, 63 nt, hsa
gauggaaaguggaagacauauaccaauuauauuccaggaaaaaauacuuuaauaguauuguua

SEQ ID NO: 742470 - RNA, 63 nt, hsa
agaccagaaaaaguuccaucuaaaauaucaugcccaggaaagcacaugggaucaaaaguaaaa

SEQ ID NO: 742471 - RNA, 63 nt, hsa
ggaaggggauuuggagggaggcugucgucgcccccaggaaagacgggccugggggaggcggga

SEQ ID NO: 742472 - RNA, 63 nt, hsa
aaaaaucccuugugauuggauguuuacuaucugccaggaaacugguacucaagauguugaagc

SEQ ID NO: 742473 - RNA, 63 nt, hsa
cccccuccccaggcuggagacccccccccaacuccaggaaagagcagucagaguccagugcuc

SEQ ID NO: 742474 - RNA, 63 nt, hsa
ucggccuauuuccuugccaggccuguuuccccaccaggaaaugagauaggaggacuggaugag

SEQ ID NO: 742475 - RNA, 63 nt, hsa
aagaguuuaaacaaaaaacccacaauugaacuuccaggaaagugugaagacccaaaacagcuu

SEQ ID NO: 742476 - RNA, 63 nt, hsa
ugaaagauuuuuguaaaaagucaguauuuauuuccaggaaaagccugaccuugcuauuugaac

SEQ ID NO: 742477 - RNA, 63 nt, hsa
gaaguacugcuaucucgcauucuucucagguugccaggaaauguuucucuaacccuuucaaaa

SEQ ID NO: 742478 - RNA, 63 nt, hsa
uacacuuaaagcaacaaccaacuaguaacagcuccaggaaaggggaaugaaucaacucuuggu

SEQ ID NO: 742479 - RNA, 63 nt, hsa
gucuggcauccauaugaggaaaaaugcucagcuccaggaaagauggggaguccaaguggauua

SEQ ID NO: 742480 - RNA, 63 nt, hsa
auaguggaagaggagagcaugaagcaaagaauuccaggaaacccaagaggcugagaauucuuu

SEQ ID NO: 742481 - RNA, 63 nt, hsa
cgccagcucugagucccaggcagcuggacaucuccaggaaaccaggccaucugggcaggaggc

SEQ ID NO: 742482 - RNA, 63 nt, hsa
gaagaaguugcaguauggauaucuuucacccucccaggaaacucuuucaaaccuaaucuguac

SEQ ID NO: 742483 - RNA, 63 nt, hsa
gggcaggggucugcuucaggaaauggaagcuguccaggaaaugagcagagauucacaagacag

SEQ ID NO: 742484 - RNA, 63 nt, hsa
guguuagcgggcaggggagccauugugggguccccaggaaagggcaagggcucagccacaucu

SEQ ID NO: 742485 - RNA, 63 nt, hsa
gucaauuaaaaacuucccaggauuucuuuggacccaggaaacagccauguggguccuuucugu

SEQ ID NO: 742486 - RNA, 63 nt, hsa
acugucuguuauuuucuguacauugugguagguccaggaaauaugacauuuucccccuugaug

SEQ ID NO: 742487 - RNA, 63 nt, hsa
acuucucgcugcccuuccaagcccggcuuugggccaggaaaggcuuccccagguggcucuucu

SEQ ID NO: 742488 - RNA, 63 nt, hsa
acgcguguggagagagccgcacaccagcgccacccaggaaaggcggagcgguuaccaguguuu

SEQ ID NO: 742489 - RNA, 63 nt, hsa
acacaggacaggcuggugcaccuccaggcugugccaggaaacccgcugccuuugcgucaccac

SEQ ID NO: 742490 - RNA, 63 nt, hsa
auaaaaagaauuuacaugauagguuaacaaggaccaggaaagugaguuuccugaaggaguucu

SEQ ID NO: 742491 - RNA, 63 nt, hsa
gccaugaacucccaagccccggccucagccuaaccaggaaaggggcucggagggagaaaggcc

SEQ ID NO: 742492 - RNA, 63 nt, hsa
ggagggauggaccccgaaaggagaaaaguacucccaggaaacagacgcgugaaaacugagccc

SEQ ID NO: 742493 - RNA, 63 nt, hsa
ggauuuuuuaaagcuuuucuguucacccuccugccaggaaaaucccagaaagcuuaaugauac

SEQ ID NO: 742494 - RNA, 63 nt, hsa
uuugaaaucucaggacucuucuggccguagguuccaggaaagcucguggaagcuuuggggcuc

SEQ ID NO: 742495 - RNA, 63 nt, hsa
cagaaaucagggcacuugcauccauugccuuuuccaggaaagggaagaaaacacucaguugau

SEQ ID NO: 742496 - RNA, 63 nt, hsa
aaggucacucugaggauugaaacuugaucuuguccaggaaagcuuuguaccaaacagugaagc

SEQ ID NO: 742497 - RNA, 63 nt, hsa
cuccagggcaaagcugaagguuucuuggggaagccaggaaagccaguauuuccuaugugucag

SEQ ID NO: 742498 - RNA, 63 nt, hsa
uuuuucaaaguaggauuuccuuuuucaacuguuccaggaaagaaucucuaagacuggguagcu

SEQ ID NO: 742499 - RNA, 63 nt, hsa
augccuauaacgcugugaguguccaguccuuguccaggaaacucagaucccggccuggcuucc

SEQ ID NO: 742500 - RNA, 63 nt, hsa
cccaagggauggggcugucuuuacuuguggaaaccaggaaauugcuccucucagccaaccaag

SEQ ID NO: 742501 - RNA, 63 nt, hsa
ccccacccucagcgucucugccccuaaggcagcccaggaaauaggaacugagacucugguacc

SEQ ID NO: 742502 - RNA, 63 nt, hsa
auuucagacuugacccuaauugaccauauaugaccaggaaacacuucugaguuuacagcuccg

SEQ ID NO: 742503 - RNA, 63 nt, hsa
cugaagaagacaagauuucuggacaagcucagcccaggaaacaaaggguaaacaaaaaacuaa

SEQ ID NO: 742504 - RNA, 63 nt, hsa
aggaggcuguccaccuugcuuggcucacugggaccaggaaagccugucuuugguuaggcucgu

SEQ ID NO: 742505 - RNA, 63 nt, hsa
uggaauaaaauuaauuaggcuaauaggcuuaacccaggaaauccuaaguuccuugaauaucca

SEQ ID NO: 742506 - RNA, 63 nt, hsa
gaguggaaucuuuuaaagacaggaccccuauguccaggaaaggggaaaaggaacuuugccaau

SEQ ID NO: 742507 - RNA, 63 nt, hsa
uggggggcaggaggaaagcacaauguuucuuagccaggaaagacaaauaauccaacgcugcua

SEQ ID NO: 742508 - RNA, 63 nt, hsa
uuaguuaaauuggauugagaaugccuuuuguuuccaggaaaauauugaucaccaugaaagaag

SEQ ID NO: 742509 - RNA, 63 nt, hsa
uuucucucuuagaauuggaggauuugccauuguccaggaaagaaacuugcagcuuuaaccugc

SEQ ID NO: 742510 - RNA, 63 nt, hsa
gggacgguaccaagaguagcgcuuagcccuuacccaggaaauauccuucauggccacagaaau

SEQ ID NO: 742511 - RNA, 63 nt, hsa
aguugcuucugcagcccgcagaugccagcgaugccaggaaacaaguugaaauccaggaaucuc

SEQ ID NO: 742512 - RNA, 63 nt, hsa
ugacuugcuaguaaacagaagacuucaagccagccaggaaauuaaaguggcgacuaaaacagc

SEQ ID NO: 742513 - RNA, 63 nt, hsa
cggcaaaaauagacccagcuucugcaagguuuuccaggaaaaucugcuuggggcagcauuugu

SEQ ID NO: 742514 - RNA, 63 nt, hsa
uagagagcccuauucaucgcugcccaggccuucccaggaaaaucauuuuuucugggcugaugu

SEQ ID NO: 742515 - RNA, 63 nt, hsa
agucauucuucucacugaguuuuuguuuaaaaaccaggaaauuucuacaaucauggagacaga

SEQ ID NO: 742516 - RNA, 63 nt, hsa
cucacuucugcccaccugccggcaacaccagugccaggaaaaggccaaaagaaugucuguuuc

SEQ ID NO: 742517 - RNA, 56 nt, hsa; identical to SEQ ID NO: 741937

SEQ ID NO: 742518 - RNA, 63 nt, hsa
ccaugugauuaagauccaggccgcugaaguuccccaggaaaugaucuuccacuugagcaaccu

SEQ ID NO: 742519 - RNA, 63 nt, hsa
agccccaaggauggcugggaguugcucaggcauccaggaaaaguggggaaugcugccaucugg

SEQ ID NO: 742520 - RNA, 63 nt, hsa
aggagcucucugcugagcagcccagcacaacccccaggaaacacaaaugggguccaggucacc

SEQ ID NO: 742521 - RNA, 63 nt, hsa
ucuucuggcagcagaaauccaugaagcccgggcccaggaaaauuagaaguuuuccauuccuga

SEQ ID NO: 742522 - RNA, 63 nt, hsa
cuauuccuuagccuuauagauuucuaguacugcccaggaaaucuaauuucaauacauuuaucc

SEQ ID NO: 742523 - RNA, 63 nt, hsa
auauuggacucuugaaggcaauccuuccucuggccaggaaauuuuuuaaaaaauaauacugug

SEQ ID NO: 742524 - RNA, 63 nt, hsa
aaagccaagguugucaaagaacagccagugaggccaggaaagaaauuggucuugugguuuuca

SEQ ID NO: 742525 - RNA, 63 nt, hsa
augaaguuagugcgggcuuugcugcucccuggcccaggaaagagggacuaccugacccucacc

SEQ ID NO: 742526 - RNA, 63 nt, hsa
uuuuuuuuuuucccccuugaggauuguggaaaaccaggaaaagggagcuaugauuuuuuuuuc

SEQ ID NO: 742527 - RNA, 63 nt, hsa
uugagauacccugcuaucgauggucgcuacaaaccaggaaauacucaaguuauuauguguaua

SEQ ID NO: 742528 - RNA, 63 nt, hsa
gcgccauggauuccucugggggcuggcgcaugcccaggaaagccugggccacacgggacacuc

SEQ ID NO: 742529 - RNA, 63 nt, hsa
gcugagcaaacccagggaauagcccuccucuccccaggaaacuucucugaaaucuuagacuua

SEQ ID NO: 742530 - RNA, 63 nt, hsa
ccggcgccuuuuucuuuuuagaugggaaggaggccaggaaagggucagcuuaaccauuuccua

SEQ ID NO: 742531 - RNA, 63 nt, hsa
aaauacuaugcauagcaaggagaugcagagccgccaggaaaauucugaguuccagcacaauuu

SEQ ID NO: 742532 - RNA, 63 nt, hsa
ugccucuuagcauguuugauuuaagaaaagccuccaggaaaucuugagagccugucuuggcau

SEQ ID NO: 742533 - RNA, 63 nt, hsa
gggaggcccgcggcgguggagccgagcggggagccaggaaagaagaguuggagugagaugaag

SEQ ID NO: 742534 - RNA, 63 nt, hsa
uccauaccccuuccuggaucuccagugccugggccaggaaagcccucuggguuccgggaagcc

SEQ ID NO: 742535 - RNA, 63 nt, hsa
agaggaaaacaagugaggacacugguuuuaccuccaggaaacaugaaaaauaauccaaaucca

SEQ ID NO: 742536 - RNA, 63 nt, hsa
uuccauauaaauuguuuauucaaccaucagguuccaggaaaaagccuguuaguauuuucauug

SEQ ID NO: 742537 - RNA, 63 nt, hsa
gguaggaaggugcugugggcuggucccacacauccaggaaagaggccaguagagaauucugcc

SEQ ID NO: 742538 - RNA, 63 nt, hsa
ccgcgacaaggacgacauucuguucuacacccuccaggaaaugacagcagucagugccgccca

SEQ ID NO: 742539 - RNA, 63 nt, hsa
gccaggccuggggccccucccaguucccccgccccaggaaacacugcugaccuuugcaaaggc

SEQ ID NO: 742540 - RNA, 63 nt, hsa
uagaguuacauuaugcuuggcaugaauaaggugccaggaaaacaguuuaaaauuauacaucag

SEQ ID NO: 742541 - RNA, 63 nt, hsa
uucuagaaucccuucaguuuuagcuaccaacggccaggaaaagcccucaucuucucuuucucu

SEQ ID NO: 742542 - RNA, 63 nt, hsa
ucaacggggccauggcaggaaagcugacccuacccaggaaaguaauagcuucuuuaaaagucu

SEQ ID NO: 742543 - RNA, 63 nt, hsa
cugaugauauccuauccucuccaagcuccuauuccaggaaaaaagauccaauguuuuuucuaa

SEQ ID NO: 742544 - RNA, 63 nt, hsa
uugcucuaacuggagcacauucacuuacgaacaccaggaaaccacagggcccuugucgccccu

SEQ ID NO: 742545 - RNA, 63 nt, hsa
ccuuggauuuagggauagugucccucuccauguccaggaaacuuguaaccacccuuuucuaac

SEQ ID NO: 742546 - RNA, 63 nt, hsa
aaggauugcgcacccugcacaaguacagauugaccaggaaaagacaagugucuucuguguguc

SEQ ID NO: 742547 - RNA, 63 nt, hsa
acauucucagcugucuuguuccaccaguauuuaccaggaaaacaaagaauguguuaagggaug

SEQ ID NO: 742548 - RNA, 63 nt, hsa
guagaccgaagccuugugcauaaggauuuuuucccaggaaaagauagacuuuauaaacagugg

SEQ ID NO: 742549 - RNA, 63 nt, hsa
ugucccccguuugccuccacgagccugcuguuuccaggaaauuacauaacguucaguugggau

SEQ ID NO: 742550 - RNA, 63 nt, hsa
agccaagacaguggcagcaaaggaagacuuggcccaggaaaaaccuguggguugugcuaauuu

SEQ ID NO: 742551 - RNA, 63 nt, hsa
gucuuuuuuuccucugcccugaucaacuggggcccaggaaaagcaaugucucuucacgggccu

SEQ ID NO: 742552 - RNA, 63 nt, hsa
uuggggcaugacccagugaagaugcagguuugaccaggaaagcagcgcuaguggaggguugga

SEQ ID NO: 742553 - RNA, 63 nt, hsa
uacuucugauaauuuauugucuuuauuuuuaucccaggaaauaaaagguuaccuuguugaggc

SEQ ID NO: 742554 - RNA, 63 nt, hsa
agccugggcucacccuguguggcucauucccacccaggaaacugaagauaaaagauuugggaa

SEQ ID NO: 742555 - RNA, 63 nt, hsa
uucagccaugauaagaacagagugccugcauucccaggaaaauacgaaaaucccaugagauaa

SEQ ID NO: 742556 - RNA, 63 nt, hsa
aaucaauuuguucuuagaaccugguugaaaauaccaggaaacuguuacagacgccauuuuuuu

SEQ ID NO: 742557 - RNA, 63 nt, hsa
agggaccucagggagccccagcuucuuacccacccaggaaacccuugguccagagaggacagg

SEQ ID NO: 742558 - RNA, 63 nt, hsa
aagcccuaagggugguaggaacccaggagggacccaggaaacuaagauuugagauucagugcc

SEQ ID NO: 742559 - RNA, 63 nt, hsa
ucuccucaggcuccuccuugcccccaccuugccccaggaaaggccaaaguccaggugacugcc

SEQ ID NO: 742560 - RNA, 63 nt, hsa
agccagcugugcacuuucuucucuuucccaaccccaggaaagguuuuccuuauuuugugugcu

SEQ ID NO: 742561 - RNA, 63 nt, hsa
ugagacuuccugcugccuuuggacauaacuaagccaggaaacuuuaaaagccuucuagaaaua

SEQ ID NO: 742562 - RNA, 63 nt, hsa
caaggcuagagcugauggcacugucugcacuguccaggaaaaaaguaaaacuguacuguugcg

SEQ ID NO: 742563 - RNA, 63 nt, hsa
gggcgguggcuucacuccugagucugcaaaaucccaggaaacuugggucuugcugcccauccu

SEQ ID NO: 742564 - RNA, 63 nt, hsa
ucuuuaaagagccaaguugcuucggggaaacagccaggaaaauggucaagauuauuuuuagag

SEQ ID NO: 742565 - RNA, 63 nt, hsa
ucccacugcccccugagauguacacccugauugccaggaaaacagacugcuguguucaguaac

SEQ ID NO: 742566 - RNA, 63 nt, hsa
caaugggucugugacucaaaaauugagcccuggccaggaaaauguggagacaguucuucuccu

SEQ ID NO: 742567 - RNA, 63 nt, hsa
acaauccauagauagccagcaguggauguuacuccaggaaaaugcaggauuaaaauuguccuu

SEQ ID NO: 742568 - RNA, 63 nt, hsa
cauccaggacuacgaggcggccaaggcucuguuccaggaaauucuugaagaguauaaugaaag

SEQ ID NO: 742569 - RNA, 63 nt, hsa
agacacuuugucuaguguauucucuucacagugccaggaaagagugguuucugcguguguaua

SEQ ID NO: 742570 - RNA, 63 nt, hsa
ggcuugauuuuggccuauuuuacauuauuugguccaggaaauuagguuauauuagguuuuuug

SEQ ID NO: 742571 - RNA, 63 nt, hsa
aggagucccuuacuuuacguguguaaauuccuaccaggaaagaauacauauccaauagauugg

SEQ ID NO: 742572 - RNA, 63 nt, hsa
acauuguaguucgcaugguucucuggaaacgcgccaggaaaagcuuccgugccagugauucgu

SEQ ID NO: 742573 - RNA, 63 nt, hsa
ccaaacagaacuauggaaaaaaaggaagaaauuccaggaaaaucugcacugugggcuuuuauu

SEQ ID NO: 742574 - RNA, 63 nt, hsa
cugauaauugucuccccuccauaggaauuucucccaggaaagaaauauauccccaucuccguu

SEQ ID NO: 742575 - RNA, 63 nt, hsa
agaucugggggaauaaaaagccaacaguaagccccaggaaaggguuuuuugagaccauaugua

SEQ ID NO: 742576 - RNA, 63 nt, hsa
uuuguuucacccuacuucaaguacacuuccacaccaggaaaacagacccaaauuccauaaaca

SEQ ID NO: 742577 - RNA, 63 nt, hsa
cuuuccccuuuguuuagggguaggcuuugaugaccaggaaaaaaaaaaagguauuucugcauu

SEQ ID NO: 742578 - RNA, 63 nt, hsa
uccuuccccccccccaccccgagauacgggguuccaggaaaggggagggguagcgggggaggg

SEQ ID NO: 742579 - RNA, 63 nt, hsa
aaauguccauuuucauuuauaggccaaauccugccaggaaaguaaccagaucucuggauuuca

SEQ ID NO: 742580 - RNA, 63 nt, hsa
ucaauauuuaguaaagcuuuucuuuuuuaauuuccaggaaaaaauaaaaagaguaugagucuu

SEQ ID NO: 742581 - RNA, 63 nt, hsa
cuuauaaagcuuguacagcugccucccggcaguccaggaaaacugcaaaaaaugggaaguaag

SEQ ID NO: 742582 - RNA, 63 nt, hsa
uuucucccacugggucaccucaaggaucagaggccaggaaaaaaaaaaaaaagacucccugga

SEQ ID NO: 742583 - RNA, 63 nt, hsa
ugagcuuuuuuagaaagucgaagugaauguuggccaggaaaauggaaaagccauuguauaaau

SEQ ID NO: 742584 - RNA, 63 nt, hsa
gacgucuccacggagcccucgggaccugcugcaccaggaaagccacuccaccaguagugcugg

SEQ ID NO: 742585 - RNA, 63 nt, hsa
agccugcuguucccgcuuuccauauagcuuuggccaggaaagcaugcaauagacuugcucgga

SEQ ID NO: 742586 - RNA, 63 nt, hsa
aguccuuugacuuaguacugacuugcacugaggccaggaaaagaagcacuggaaagcagcagg

SEQ ID NO: 742587 - RNA, 63 nt, hsa
ugucagagaagacuggcgucagcagccaaaacaccaggaaacacauuucuguggccuuagcca

SEQ ID NO: 742588 - RNA, 63 nt, hsa
cuuugcugccauccagccccagaucgcuuuacuccaggaaaugcacguuacacauuuucgcuu

SEQ ID NO: 742589 - RNA, 63 nt, hsa
gugcuaagaucagucacccaugugaauaagaagccaggaaaggaaagauggggaagcccagau

SEQ ID NO: 742590 - RNA, 63 nt, hsa
cgagugugacugggaaggagaacuuauuccuuaccaggaaacuggaagcuaaaaauacagagg

SEQ ID NO: 742591 - RNA, 63 nt, hsa
uggccugcgucuuuuuucucuucccuucccagaccaggaaaggcuuggcugguguaugcacag

SEQ ID NO: 742592 - RNA, 63 nt, hsa
cuuauuucuagaagcacauguguauuuauacccccaggaaacuagcuuuugccaguauuaugc

SEQ ID NO: 742593 - RNA, 63 nt, hsa
ggagggaauuggguuuguggcaaagagcuugacccaggaaauagauggugccccccaaauugu

SEQ ID NO: 742594 - RNA, 63 nt, hsa
ucagugguuugcccuuggcuaaaugaagcagagccaggaaaaacagacuacauauuuuucaug

SEQ ID NO: 742595 - RNA, 63 nt, hsa
ucagggagguugaggcagcaggauugcuggagcccaggaaauugaggcugcagugagccauga

SEQ ID NO: 742596 - RNA, 63 nt, hsa
cuaacacuguuuugauuuuugugggaaaauauuccaggaaacgcuaauucucuuuagacuccu

SEQ ID NO: 742597 - RNA, 63 nt, hsa
uuuguuuuuaauuuuaaccauagugcacauauuccaggaaagugucuuuaaaaacaaaaacaa

SEQ ID NO: 742598 - RNA, 63 nt, hsa
cccagggcccaaaagucagaagggccccaccagccaggaaaguuguuucaaugcuguaaguag

SEQ ID NO: 742599 - RNA, 63 nt, hsa
uuccacugagguuagaguccauuuacaaagcugccaggaaaccggccacuucuaguaaaccac

SEQ ID NO: 742600 - RNA, 63 nt, hsa
caugaugcaauuaucuuacucagaggagauuugccaggaaauucucuccguuacaugcauuac

SEQ ID NO: 742601 - RNA, 63 nt, hsa
gucucuucagaucugaaauacuccaguuuagagccaggaaauuucacaggucacaccgauuuu

SEQ ID NO: 742602 - RNA, 63 nt, hsa
accagggcacccauccaaggaaccuccgaacagccaggaaaagccaugaguugcaaccaaaac

SEQ ID NO: 742603 - RNA, 63 nt, hsa
guauggagucaccuguaaauugauucaagugagccaggaaagcagcaaaggaaagagaaaccu

SEQ ID NO: 742604 - RNA, 63 nt, hsa
ggggaugggaaugacuuccucgagaccauacagccaggaaauagcggugaaucuagugaucuc

SEQ ID NO: 742605 - RNA, 63 nt, hsa
gacgcccagcacagcagcaggacacaccaugugccaggaaaugaccucagcaagaaaccucag

SEQ ID NO: 742606 - RNA, 63 nt, hsa
cauccccugcccugccgggcaccucgcucuaccccaggaaaaugugagcucguuuuccugcuc

SEQ ID NO: 742607 - RNA, 63 nt, hsa
aauaaaagcuaugagacaaauaguccucuaguuccaggaaacacagucuuuuuuuaaaaaaaa

SEQ ID NO: 742608 - RNA, 63 nt, hsa
gaaccaucaaaccuuuccuccugacuuaccaaaccaggaaaacagcaggagaggguggcucag

SEQ ID NO: 742609 - RNA, 63 nt, hsa
uuccuuccuugagucauagaacguauccaucucccaggaaauguccuucucuggcgucugcuu

SEQ ID NO: 742610 - RNA, 63 nt, hsa
cuaucaguggucguguaccuucuccaccugcccccaggaaaaagagucucccccuuaaauuuc

SEQ ID NO: 742611 - RNA, 63 nt, hsa
ucagaugcuuagggggcauuugugcuccucuggccaggaaagggaacagaguccauccaagcu

SEQ ID NO: 742612 - RNA, 53 nt, hsa; identical to SEQ ID NO: 742032

SEQ ID NO: 742613 - RNA, 63 nt, hsa
uauaagaccucuuucagcagaucacaucagaagccaggaaaugcauagcuaggagaugucaaa

SEQ ID NO: 742614 - RNA, 63 nt, hsa
ucugaugauuuauuuaaagagccguugaugccuccaggaaacuuaaguauuuuauuaauauau

SEQ ID NO: 742615 - RNA, 63 nt, hsa
cuucuuaacugcccaagugaaaagcaaccaaguccaggaaauuacaauagcuguuaaggaaag

SEQ ID NO: 742616 - RNA, 63 nt, hsa
acccaagcuuguggcaccaggcaucugauggugccaggaaagccacuggaauugucacacggc

SEQ ID NO: 742617 - RNA, 63 nt, hsa
caggagccacuuaagagauuauugugcuguuuuccaggaaagcugcagcuagaaaauggucuu

SEQ ID NO: 742618 - RNA, 63 nt, hsa
auuauuuuauguuaaaaugugugcuaaacuaucccaggaaaguauuuaauccaacauuguaaa

SEQ ID NO: 742619 - RNA, 63 nt, hsa
ugccccacuucagggcugcugugagauggaauuccaggaaagaacuucaggugucuggacccu

SEQ ID NO: 742620 - RNA, 63 nt, hsa
aagauuuuuccucuugccuuacacauggagguuccaggaaaccucuugcagaacuucacacgu

SEQ ID NO: 742621 - RNA, 63 nt, hsa
caccccuaagcauggucccuugucaccaggcaaccaggaaacugcuacuuguggaccucacca

SEQ ID NO: 742622 - RNA, 63 nt, hsa
uuugaggucggaaacccucuacugccccauaagccaggaaaagugaaaagagaacacaguucc

SEQ ID NO: 742623 - RNA, 63 nt, hsa
ccccuccugcucuccaucuuauauguauucuaaccaggaaaaaugugauagcacauggguagc

SEQ ID NO: 742624 - RNA, 63 nt, hsa
cccugagcugccagugcuggguaucccccagccccaggaaauguggggucggccaggacccuc

SEQ ID NO: 742625 - RNA, 63 nt, hsa
agucauacacuuuaaaaaaaaaaaaaacuuuuuccaggaaaauauauugaaaucaugcugcug

SEQ ID NO: 742626 - RNA, 63 nt, hsa
ucagccccuucucugggaugugguucuauucccccaggaaaaaggagccccagccuucugagg

SEQ ID NO: 742627 - RNA, 63 nt, hsa
auugugugugagacugaguauguguucuuuuuuccaggaaaggcuccagugguucuuacuuga

SEQ ID NO: 742628 - RNA, 63 nt, hsa
cucucccuguuuuagcacugaaagucucuugccccaggaaaccccaucagucccaggcagauu

SEQ ID NO: 742629 - RNA, 63 nt, hsa
guccccaaagugucagcaacuuugaggagggcaccaggaaacaaagaugccuccccagcccug

SEQ ID NO: 742630 - RNA, 63 nt, hsa
acuggcccacacgugcauagaggucugggaggaccaggaaacagccucaguggccagaggauc

SEQ ID NO: 742631 - RNA, 63 nt, hsa
gguuucugaaauauuuuauggacuuauuucuccccaggaaaugauucuuacggaaaaaaauug

SEQ ID NO: 742632 - RNA, 63 nt, hsa
gguauaaaccucuguaugaagagaagauuucucccaggaaaucuuuguacagcuuuaaguugu

SEQ ID NO: 742633 - RNA, 63 nt, hsa
caaagcugcaaguggauucuagugcugagucuuccaggaaaaaaucccguuuggccaccguga

SEQ ID NO: 742634 - RNA, 63 nt, hsa
agcagagauggccugccaagaguugcaggagacccaggaaagggaguugcugagggcaggucc

SEQ ID NO: 742635 - RNA, 63 nt, hsa
gccagagggaccucaggguguggcauuauagggccaggaaaagaaaaucgguguauccuaucu

SEQ ID NO: 742636 - RNA, 63 nt, hsa
aacaugagaugagccagccgagccagacugugaccaggaaacagcucaucccagagaaggaga

SEQ ID NO: 742637 - RNA, 63 nt, hsa
cauggaaauauuagcugccccgucugccauucaccaggaaaaauuucuauggcaauuuuguac

SEQ ID NO: 742638 - RNA, 63 nt, hsa
ccugcagucacauggguguggccuccaagcuccccaggaaagcaguggcagccucugggguuu

SEQ ID NO: 742639 - RNA, 63 nt, hsa
cagccauaucuuacacuuugguaaagcagaaaaccaggaaaauuuucuuaaaauauccacaau

SEQ ID NO: 742640 - RNA, 63 nt, hsa
uggccacaggcacaagggcugcagcugcuucuuccaggaaacugacacagggagcucagcggc

SEQ ID NO: 742641 - RNA, 63 nt, hsa
accagaugcccugcuccaucacaaccuccuuccccaggaaaacccacuuuccaaaagcccaag

SEQ ID NO: 742642 - RNA, 63 nt, hsa
gacuuuggucaguuaccugggaauucugggcugccaggaaacgauuugggccucugucaguuu

SEQ ID NO: 742643 - RNA, 54 nt, hsa; identical to SEQ ID NO: 742063

SEQ ID NO: 742644 - RNA, 63 nt, hsa
ucuuguuccugacuccagaggaacgagagcauuccaggaaagagagauucccuggaaaauuga

SEQ ID NO: 742645 - RNA, 63 nt, hsa
ugguggcuacuuuuggucugaaacccacuuggcccaggaaagagaaaagguuguauguuuugu

SEQ ID NO: 742646 - RNA, 50 nt, hsa; identical to SEQ ID NO: 742066

SEQ ID NO: 742647 - RNA, 63 nt, hsa
uuauuuauauguuguggggacugcauaacuagcccaggaaaugacucugguuuugaguggccu

SEQ ID NO: 742648 - RNA, 63 nt, hsa
ggagggagggcuccagacacauguccaagaagcccaggaaaggcuccaggagcagccacauuc

SEQ ID NO: 742649 - RNA, 63 nt, hsa
ccucccuugugguuucagcacagaaccugaaugccaggaaaaauuccugggccaagaagcuaa

SEQ ID NO: 742650 - RNA, 63 nt, hsa
ucuuuuugugcauuguccucaugccuguauucuccaggaaacuuguccuucuggaaaucauau

SEQ ID NO: 742651 - RNA, 63 nt, hsa
cugacucagugaccagugccugugagcauggggccaggaaagucugguaauaaaugugacuca

SEQ ID NO: 742652 - RNA, 63 nt, hsa
gaaugccacugcuugguuauugguccccuuugaccaggaaacccaagaggagacaccucaguc

SEQ ID NO: 742653 - RNA, 63 nt, hsa
auggagagaaagcuguaggauccauaaauucuaccaggaaaccagggucuuccuguuccuagc

SEQ ID NO: 742654 - RNA, 63 nt, hsa
uacucugcucaugagacagaucugggcuccaagccaggaaaggugaacagaaaccacaagugu

SEQ ID NO: 742655 - RNA, 63 nt, hsa
gugaccaaaccacaugaaccagacuuuucccguccaggaaauagcauuucagauuugguuuuu

SEQ ID NO: 742656 - RNA, 63 nt, hsa
gaacuccauuccaccugacccuguguguacaauccaggaaaaaaacaaaccccacucagaaac

SEQ ID NO: 742657 - RNA, 63 nt, hsa
cgguaacaguugccgaaccaggccgccucacagccaggaaauuuggaaauccuagccaagggg

SEQ ID NO: 742658 - RNA, 61 nt, hsa; identical to SEQ ID NO: 742078

SEQ ID NO: 742659 - RNA, 63 nt, hsa
aucaguucucugauccacuuccauuuaagcuccccaggaaaucccaugacaaacuggccucug

SEQ ID NO: 742660 - RNA, 63 nt, hsa
gcggagggguguguggccagguacuaggaggcaccaggaaaucccgcgggguggcccaugcag

SEQ ID NO: 742661 - RNA, 63 nt, hsa
cuuauucccgcugacugagucucugaggggcuaccaggaaagcgccuccaacccuagcaaaag

SEQ ID NO: 742662 - RNA, 63 nt, hsa
gacccacuauuucuccucugcuucagaggaaacccaggaaaugcccuuacugccaggcugagu

SEQ ID NO: 742663 - RNA, 63 nt, hsa
cucacacugugaguccagcggcgcagggugguaccaggaaagaggauauucuaggcuuugcgu

SEQ ID NO: 742664 - RNA, 63 nt, hsa
uguucuugggaagcagauuaaguagcagaaaguccaggaaagaaagaccagaaggaguaauga

SEQ ID NO: 742665 - RNA, 63 nt, hsa
gguuggcagugcccagauucgucaagugaggguccaggaaagcucuugcccucuugcccagca

SEQ ID NO: 742666 - RNA, 63 nt, hsa
ucagccacgcagaaagcucacgugccugcagggccaggaaagggaaaugaucguuucuuuugu

SEQ ID NO: 742667 - RNA, 63 nt, hsa
ccccacagcccuucaccuucgcuaucaaacaucccaggaaaggguaagaauuuagggccaccg

SEQ ID NO: 742668 - RNA, 63 nt, hsa
guucugcucuaacauggcaugcccuuucucagcccaggaaacagcaugugguucagagaaaag

SEQ ID NO: 742669 - RNA, 63 nt, hsa
uuggccaaccuagccaaggcugcagcauauagaccaggaaaucagguagcccagacuggugau

SEQ ID NO: 742670 - RNA, 63 nt, hsa
acaguucacagaggucuuucagcucauuuaaucccaggaaagaggcaucaaagcuagaaugug

SEQ ID NO: 742671 - RNA, 63 nt, hsa
gggcaagaggugccugggaggaguggcccugauccaggaaaaugugaggggaaucuggaacgc

SEQ ID NO: 742672 - RNA, 63 nt, hsa
ugcgauucuggauaaagccacugaaaauucgaaccaggaaauggaaccccaccacuguugguc

SEQ ID NO: 742673 - RNA, 63 nt, hsa
ugggagucauuaaagccaagucauucauagcagccaggaaacaauaggaaccaaaagccucug

SEQ ID NO: 742674 - RNA, 63 nt, hsa
ugaacccuccaauucaggaagugggaaaaggagccaggaaaugugcuucuacuuugccaguua

SEQ ID NO: 742675 - RNA, 63 nt, hsa
ucccccaaccagagauguuaaagugagccugucccaggaaacaucuccacccaagacgucuuu

SEQ ID NO: 742676 - RNA, 63 nt, hsa
ugaugucaucguccaucccaucuuccuuugcccccaggaaaggacgcauccaccgguagcggc

SEQ ID NO: 742677 - RNA, 63 nt, hsa
uguguggaggacaaagcuucuuccugcguggcuccaggaaaagauguggcucacguagguggc

SEQ ID NO: 742678 - RNA, 63 nt, hsa
uaaagagggagcacauugacuugggaauuuccuccaggaaacucagggcuguuuucucuuccc

SEQ ID NO: 742679 - RNA, 63 nt, hsa
cucaggaggggcucucagggacuccuggugacuccaggaaaaugcugccaucguuaaacauua

SEQ ID NO: 742680 - RNA, 63 nt, hsa
uuugucaucguuccccaccccuucgacaugcugccaggaaacaagggaaggggccucccuccg

SEQ ID NO: 742681 - RNA, 63 nt, hsa
uuuuauauuauuaggagcaaaaguaaaugaagcccaggaaaacaccuuugggaacaaacucuu

SEQ ID NO: 742682 - RNA, 63 nt, hsa
ugguguucuaccagaaaaacgucucccaaucacccaggaaagcuguccacaguaguccccccu

SEQ ID NO: 742683 - RNA, 63 nt, hsa
ccuuugcaggacuugcacacagggaggcuguagccaggaaacccucuucuucccuggucuggc

SEQ ID NO: 742684 - RNA, 63 nt, hsa
uggagcuuagccugagaggguucuuggccucccccaggaaagauuucaaaggcaagcgccagu

SEQ ID NO: 742685 - RNA, 63 nt, hsa
ugggauuacagcuugaguucugucaccccauccccaggaaacuguagcuucuuaacuggugac

SEQ ID NO: 742686 - RNA, 63 nt, hsa
uauauuucuaaguguaacuguccuuccucugugccaggaaacgggagggggcugauccucuga

SEQ ID NO: 742687 - RNA, 63 nt, hsa
cuuccacuguacuucucaaaguugguuauuagaccaggaaaacuuaauguaauauuauuuuua

SEQ ID NO: 742688 - RNA, 63 nt, hsa
ugagguggcuuccuaguuacaugaggaugugauccaggaaauccaguuuggaggcuugaugug

SEQ ID NO: 742689 - RNA, 63 nt, hsa
agacaaggaagguggaauguucuguuuuggccaccaggaaaugggguggggugggcauacaca

SEQ ID NO: 742690 - RNA, 63 nt, hsa
ucaaagcgccagucauuugcuccguuuucaaauccaggaaaugcagaagaggaaugugcaaca

SEQ ID NO: 742691 - RNA, 53 nt, hsa; identical to SEQ ID NO: 742111

SEQ ID NO: 742692 - RNA, 63 nt, hsa
ugaauguuugugucugugguugcagucuuucccccaggaaaaaaaaaaaaagaaauucgcaug

SEQ ID NO: 742693 - RNA, 63 nt, hsa
ccuguggguggggagcuggggcaagaugaggcaccaggaaaggggugguagucagaggaggga

SEQ ID NO: 742694 - RNA, 63 nt, hsa
ggagcuggcgggagggugggaggugggauuuagccaggaaaggggugagagugauuguguugu

SEQ ID NO: 742695 - RNA, 63 nt, hsa
acuucagugagaggauuggcugugagcuucagaccaggaaaugugucaucuugccaggcaccu

SEQ ID NO: 742696 - RNA, 63 nt, hsa
acuucaccucuuggcuguggaggaacuuaguugccaggaaauuuuuuuuuuuuuuuucagacg

SEQ ID NO: 742697 - RNA, 63 nt, hsa
cuccugggcagauuggguagaaaggacauucuuccaggaaaguugacugcugacugauuggga

SEQ ID NO: 742698 - RNA, 63 nt, hsa
ccaacacgguguccugccacccagcgccuggcuccaggaaaacacgcuugccuuccuucccgg

SEQ ID NO: 742699 - RNA, 63 nt, hsa
cucuuuuuucaucucacaguaaagccuauuuccccaggaaaaaaauaaaugccuuugaaugaa

SEQ ID NO: 742700 - RNA, 63 nt, hsa
gaacgaaugccaaaucagacuccaccuagagcaccaggaaacagcuuguacccugguagggaa

SEQ ID NO: 742701 - RNA, 63 nt, hsa
ucacucagacugagacuugaguuauuacagaagccaggaaaaguguauuagaaacuguugucu

SEQ ID NO: 742702 - RNA, 63 nt, hsa
cagaagugauaaaggaauccaaaguugaagagcccaggaaacgggaaacuguauccauaaugc

SEQ ID NO: 742703 - RNA, 63 nt, hsa
cuccggccuaggugacagagggaaacuccaucuccaggaaaaaaaaaaaaaaacccaauuugg

SEQ ID NO: 742704 - RNA, 63 nt, hsa
gagucuauaguacaaaaugcauaaaccauguccccaggaaauuugaaaggaagcaggugcuga

SEQ ID NO: 742705 - RNA, 63 nt, hsa
ggugcgcccucgacucccgauuucauuugcuggccaggaaaaucgaaagggaaacacccucaa

SEQ ID NO: 742706 - RNA, 63 nt, hsa
aagcagaaauguacaauuucuggucuguguuuuccaggaaauucauagagaagagaauagagu

SEQ ID NO: 742707 - RNA, 63 nt, hsa
agaccacccggcauucucugcccacuuugccuuccaggaaaugggcuuuucaggaagugaauu

SEQ ID NO: 742708 - RNA, 52 nt, hsa; identical to SEQ ID NO: 742128

SEQ ID NO: 742709 - RNA, 63 nt, hsa
gcuccucuuccuccggauccucuuuugaucugcccaggaaagggaugcauugacacucuccug

SEQ ID NO: 742710 - RNA, 63 nt, hsa
gcagaggaggucccagauaccaaguggcgccucccaggaaaggcugggagaagagguggccug

SEQ ID NO: 742711 - RNA, 63 nt, hsa
ggagcuaggggcccgccccgcggacugacagcaccaggaaaccaaaugaugucccugcccgcc

SEQ ID NO: 742712 - RNA, 63 nt, hsa
ugucuuucgagguggguuuguaccuuccuuaagccaggaaagggauucauggcgucggaaaug

SEQ ID NO: 742713 - RNA, 63 nt, hsa
cccacgaggggacauccacccucugggguguggccaggaaaagacaagcucuucagcuugggg

SEQ ID NO: 742714 - RNA, 63 nt, hsa
acacuggaacauuccaguggacccuggaccauuccaggaaaacugggacauaggaucgucccg

SEQ ID NO: 742715 - RNA, 63 nt, hsa
acuggaaaacugggaaauggccagcugugugucccaggaaauuccuccccuuauucuuccuug

SEQ ID NO: 742716 - RNA, 63 nt, hsa
gcugugauggggaugugcagggacagugggaucccaggaaacagaccuccauggugggagauc

SEQ ID NO: 742717 - RNA, 63 nt, hsa
cagugcuccccuccugcuaaagaaccaguuaccccaggaaaauucgacuccuguuuuucuuua

SEQ ID NO: 742718 - RNA, 63 nt, hsa
aaaccuaaaaguauuaaauuccuagaagaaaacccaggaaaugccauucuggacauaagugcu

SEQ ID NO: 742719 - RNA, 63 nt, hsa
ccucaaacagaaaauaaugaagccuucuuccucccaggaaaggggacguucagcugagccgag

SEQ ID NO: 742720 - RNA, 63 nt, hsa
uuuucaguaucugcuuuacugguucaguaaaagccaggaaacacaacuuugugguaaucugaa

SEQ ID NO: 742721 - RNA, 63 nt, hsa
uuucauuuuguuaauuuuucccaguguuuacaaccaggaaauagcuugucaucuuugauacaa

SEQ ID NO: 742722 - RNA, 63 nt, hsa
ccaacguaccaauuuccccuuuuccccuggcuaccaggaaacucggagacaaucuuuucagcc

SEQ ID NO: 742723 - RNA, 63 nt, hsa
aguagcugggauuacaggugugcgccaccacgcccaggaaauuauuguaguuuuaguagagac

SEQ ID NO: 742724 - RNA, 63 nt, hsa
caggugccacccaccuuggcccuaaaacagccaccaggaaagcagccggagagccggacagca

SEQ ID NO: 742725 - RNA, 63 nt, hsa
auacaaugugagagacugcagaagguaugaauaccaggaaacagauaacucagaagcaucugg

SEQ ID NO: 742726 - RNA, 63 nt, hsa
accugugcccccaccugggugcccuaugcugacccaggaaaggccagaccugccccuccaaac

SEQ ID NO: 742727 - RNA, 63 nt, hsa
gcaaaauuuuuaaugaauacucacaccuuauugccaggaaagcauuuauacuugagaaaaauu

SEQ ID NO: 742728 - RNA, 63 nt, hsa
aaaugugucuugcugucauuuauauuccuuuucccaggaaagaagcauuucugauacuuucug

SEQ ID NO: 742729 - RNA, 63 nt, hsa
gcucccagacaccucaagcccuauucacaggcaccaggaaaccccacacaggaauucccaucc

SEQ ID NO: 742730 - RNA, 63 nt, hsa
gaaucccaaauuugaaaauccaaucccaaguccccaggaaacccaaucaugagguccuugugc

SEQ ID NO: 742731 - RNA, 63 nt, hsa
aggcagcccggcuggccgccgccgcuccuccccccaggaaagccaagguggaggcugaggugg

SEQ ID NO: 742732 - RNA, 63 nt, hsa
cuugcuagggguccugaaccaggcuacuucgaaccaggaaagccagauuccagccugagugcu

SEQ ID NO: 742733 - RNA, 63 nt, hsa
aaagugaaugggccuguggcccacccggggucaccaggaaaggaucugaauaaagaggacccu

SEQ ID NO: 742734 - RNA, 63 nt, hsa
ugagguuauguccuuuuccauuaaguacaugugccaggaaacaagagagagagaaaguaaagg

SEQ ID NO: 742735 - RNA, 52 nt, hsa; identical to SEQ ID NO: 742155

SEQ ID NO: 742736 - RNA, 63 nt, hsa
acuacauuucccaagaggcucugcuccaggaguccaggaaagacgaggcaccuuggccgcggg

SEQ ID NO: 742737 - RNA, 59 nt, hsa; identical to SEQ ID NO: 742157

SEQ ID NO: 742738 - RNA, 63 nt, hsa
aaacaccagcucagcauggcagcagugcggaggccaggaaacccugaucgccaguuucuaacg

SEQ ID NO: 742739 - RNA, 63 nt, hsa
auccaaagagcugauucuaccaauccaauuucaccaggaaaauuccaucagggauuggaugac

SEQ ID NO: 742740 - RNA, 63 nt, hsa
ccuggagaauccacauaccuuguguauugaaccccaggaaaaggaagaggucgaaccaacccu

SEQ ID NO: 742741 - RNA, 63 nt, hsa
caaucugcuuuuuuucuaaaaucugauuugcagccaggaaagaauuuucucacccaaggaaca

SEQ ID NO: 742742 - RNA, 63 nt, hsa
ugguucauucucaggcugggguggacucagaugccaggaaagggacagccucccauugucagg

SEQ ID NO: 742743 - RNA, 63 nt, hsa
acucccuccagugaggagcugggaggagacaucccaggaaaagaauuugauacuccucuguga

SEQ ID NO: 742744 - RNA, 63 nt, hsa
cugucuccagugccuguuaagcugaggauacaaccaggaaaugcaacggugucagauuguguu

SEQ ID NO: 742745 - RNA, 63 nt, hsa
aucuuuucuucugcuacuuuggggaguugauggccaggaaagaagccagcacaggguuaaagu

SEQ ID NO: 742746 - RNA, 63 nt, hsa
ccccagcccuaugguuuuuuuauuucauguaccccaggaaauacugugugguuucuaaaagcc

SEQ ID NO: 742747 - RNA, 63 nt, hsa
ucgucggaggcaucauggaaagacugggacagcccaggaaacaaggggucugaggaugcauuc

SEQ ID NO: 742748 - RNA, 63 nt, hsa
aagugccaccgugcggggccuggcucugcacacccaggaaaagucugcagacccccagcccuc

SEQ ID NO: 742749 - RNA, 63 nt, hsa
gcccuguccaccaggauaagugacaccuaggacccaggaaauaaaugccgaugauuuguguga

SEQ ID NO: 742750 - RNA, 63 nt, hsa
uagccuugacuccuugagacuguagauuucgauccaggaaacauuuauuuagcaccugccaga

SEQ ID NO: 742751 - RNA, 63 nt, hsa
auuuucucagucauccuggcagccaaaaaugugccaggaaaagaaagaauguggagcacgcgu

SEQ ID NO: 742752 - RNA, 63 nt, hsa
gcaacugggccccuuucaagaaauuuugcucuaccaggaaaacaguuacacauuuuaagagaa

SEQ ID NO: 742753 - RNA, 63 nt, hsa
caagauugcaaaaaugacugugcaaccugaaacccaggaaagcagucuccauagucaaucaga

SEQ ID NO: 742754 - RNA, 63 nt, hsa
gagccauggcauaugacaaagaccaaugagggaccaggaaaaaaagugauguccccuuucccu

SEQ ID NO: 742755 - RNA, 63 nt, hsa
uccagggagacagacucugaaugggacugagucccaggaaacagugcuuuccgaugagacuca

SEQ ID NO: 742756 - RNA, 63 nt, hsa
cucaucuccagcuagccuugggaggccgucccaccaggaaaucucucuauuccguagccugag

SEQ ID NO: 742757 - RNA, 63 nt, hsa
ccccaaggugagggcuuaggcagcuguagaaccccaggaaagaacggaauccaggcaaucugu

SEQ ID NO: 742758 - RNA, 63 nt, hsa
guuuggggaagaugcaaggaaguaaugagaagcccaggaaauuucuccaccuguguuuauggc

SEQ ID NO: 742759 - RNA, 63 nt, hsa
ccagugcccaggaauuugaacauuuuccuuuacccaggaaaucuccggagccaacaccaccac

SEQ ID NO: 742760 - RNA, 63 nt, hsa
ucagauauauuuuaguaacacauucccagcuccccaggaaagccagucucaucuaauuucuua

SEQ ID NO: 742761 - RNA, 63 nt, hsa
cuuccucccuuccuuucacagccggucucucugccaggaaaugggggaaggaacuagaaccac

SEQ ID NO: 742762 - RNA, 63 nt, hsa
aucagcuggauccccacgugagcaacagcuggcccaggaaaggcugccugcagaggacaggug

SEQ ID NO: 742763 - RNA, 63 nt, hsa
accacccaccccauugggagaaaaacccagacgccaggaaaagaagaaacaacaaaggcagga

SEQ ID NO: 742764 - RNA, 63 nt, hsa
guccacgggcaggagaagguggauauuucagcuccaggaaagagagcuaauucacucucucuu

SEQ ID NO: 742765 - RNA, 63 nt, hsa
aaucaaauuccagaaugauuuuacggagauaucccaggaaaauuaaggcuucucuuaaacacu

SEQ ID NO: 742766 - RNA, 63 nt, hsa
auuucugccuccaggaugccacugccucugcuuccaggaaaggcaagggggagggugcuuauc

SEQ ID NO: 742767 - RNA, 63 nt, hsa
gggaagcccauccugaccagcugcuccgaggacccaggaaaggcaggauugaaaauguccagg

SEQ ID NO: 742768 - RNA, 63 nt, hsa
ccgaggacccaggaaaggcaggauugaaaauguccaggaaaguggccaagaagcaguggccuu

SEQ ID NO: 742769 - RNA, 62 nt, hsa; identical to SEQ ID NO: 742189

SEQ ID NO: 742770 - RNA, 63 nt, hsa
uggagacuggggcgugugccacauugccagccaccaggaaagcuuuucuuuuucuuuuuuuuu

SEQ ID NO: 742771 - RNA, 63 nt, hsa
uaacugaucacuauauuacaucauuucagugggccaggaaaauagaugucuugcuguuuucag

SEQ ID NO: 742772 - RNA, 63 nt, hsa
aacaaugccuccaauuccagcucggagucaaucccaggaaaauaugcgaaguucuccaaaccc

SEQ ID NO: 742773 - RNA, 63 nt, hsa
uuacaccguuguuguuuuacaucuuuugggaagccaggaaagcguuuggaaaacguaucaccu

SEQ ID NO: 742774 - RNA, 63 nt, hsa
auauauuacaaaccaucacacuuagaaauacuuccaggaaaugcuuuuuugaagugugaauua

SEQ ID NO: 742775 - RNA, 63 nt, hsa
guggaagggggaccugagggccuccaccucgagccaggaaaugaggaccggccggacgaugcc

SEQ ID NO: 742776 - RNA, 63 nt, hsa
cugcugggcccagaggugacauuugacuuuuuuccaggaaaaauguaagugugaggaaacccu

SEQ ID NO: 742777 - RNA, 63 nt, hsa
cuggcccguccugggaaggggggugucuagagcccaggaaacuucuucuuccguggcuuuugg

SEQ ID NO: 742778 - RNA, 63 nt, hsa
agaggaggcuugaaggaaccagcaaugagaaggccaggaaaagaaagagcugaaaauggagaa

SEQ ID NO: 742779 - RNA, 63 nt, hsa
gcaaaaaccuucagcucucagaggagauugggaccaggaaaaccugggaggaugggcagacuu

SEQ ID NO: 742780 - RNA, 63 nt, hsa
gcaggugccucgauucccugcccuugugaccucccaggaaacagaacugaucugggacacuau

SEQ ID NO: 742781 - RNA, 63 nt, hsa
gcucccuccuccccaucaagcacaagagagggcccaggaaaaaagguuucacauaaguguaga

SEQ ID NO: 742782 - RNA, 63 nt, hsa
ugauguacccugugccauucaaggagaugugguccaggaaagugagccucaugguuuucagag

SEQ ID NO: 742783 - RNA, 63 nt, hsa
ccugccuguggucagggccaaguguucccuccuccaggaaagccuuuacccuccucaugcccu

SEQ ID NO: 742784 - RNA, 63 nt, hsa
uuuaagggugcaggaggacagcagcuaacaaggccaggaaauacucacuucccuccacccuca

SEQ ID NO: 742785 - RNA, 63 nt, hsa
auaaaugccaagagggagaaaguugaauuaaacccaggaaaauaucagaagaacucuuuaaaa

SEQ ID NO: 742786 - RNA, 63 nt, hsa
ugaacccuuggguagcuugauucugccuaccauccaggaaaacuugugcuggaauugcugaug

SEQ ID NO: 742787 - RNA, 63 nt, hsa
ucugcccagaggggcuggggaaagggaugggagccaggaaagauuuaggggcaggagacagac

SEQ ID NO: 742788 - RNA, 63 nt, hsa
aaagggaagucaggguucuagggguuauucgucccaggaaauagaagugaaauugucuuuauu

SEQ ID NO: 742789 - RNA, 63 nt, hsa
aggggaggugugcaggaaccagcaaugagaaggccaggaaaagaaagagcugaaaaugcagaa

SEQ ID NO: 742790 - RNA, 63 nt, hsa
gagggaggcacguaggaacaagcaaugagaagaccaggaaaagaaagagcugaaaauggagaa

SEQ ID NO: 742791 - RNA, 63 nt, hsa
agggggagcuugcaggaaccagcaaugagaaggccaggaaaagaaagagcugaaaauggagaa

SEQ ID NO: 742792 - RNA, 63 nt, hsa
agacgcaucccaggaggugacgaggcaggggcuccaggaaaggaaucagagacaauucacaga

SEQ ID NO: 742793 - RNA, 63 nt, hsa
ugggacugugucucauguuugugugaauguagaccaggaaagggggcugcaaaaauguugagu

SEQ ID NO: 742794 - RNA, 63 nt, hsa
gcucuuggguauguagaacuguaugggaagaagccaggaaaaccucugaguguugaaggggca

SEQ ID NO: 742795 - RNA, 63 nt, hsa
ucagggaagccuugaaaaccacggagguggaugccaggaaagggcccauguggcagaaggcaa

SEQ ID NO: 742796 - RNA, 63 nt, hsa
cuuugugcagccugaaggaucaguguaguaaugccaggaaagugcuuuuuaccuaagacuucc

SEQ ID NO: 742797 - RNA, 63 nt, hsa
ucaugacaggucuauauuucuaccugggccaggccaggaaagagacuauuuaagaaaaaaaaa

SEQ ID NO: 742798 - RNA, 63 nt, hsa
auauuauaaguaugcugauggaaaucuauauugccaggaaaagcuauucauuaugcguuguga

SEQ ID NO: 742799 - RNA, 63 nt, hsa
gcaccagucaucagcuauucaguugguaagcuuccaggaaaaaggacaggcagaaagaguuug

SEQ ID NO: 742800 - RNA, 63 nt, hsa
acgaauacuagcaucaguggggaagaaaccuccccaggaaauuggaauuaaagugaaaaauca

SEQ ID NO: 742801 - RNA, 63 nt, hsa
cucacagacauuaccaaagaggagcuugugaauccaggaaaagcuccagggggcuagcugauc

SEQ ID NO: 742802 - RNA, 63 nt, hsa
ccaacaugccaaaaaugcucaugccaguuaaugccaggaaaaaaaucaccgacacacuacuag

SEQ ID NO: 742803 - RNA, 63 nt, hsa
gcuguccaguuagcugugcccugcaccuucagcccaggaaagauuugaacagagcaaaggcuu

SEQ ID NO: 742804 - RNA, 63 nt, hsa
uuuucccacaugaaccuccagcaaauagcaaguccaggaaaaacucuucucauucaaagagga

SEQ ID NO: 742805 - RNA, 63 nt, hsa
uuucaugaaaugguccacauaguggggaaguagccaggaaaugagaaacuuccucccacccca

SEQ ID NO: 742806 - RNA, 63 nt, hsa
ugaaggaaggggcuauccugggaccuccccagcccaggaaaaacuggaagccuucccccagca

SEQ ID NO: 742807 - RNA, 63 nt, hsa
ucaggccucaccccuccccugggacuuucccacccaggaaaggaggaccagucaggaugaggc

SEQ ID NO: 742808 - RNA, 63 nt, hsa
aaaauucaauggccuucuacugcagggaauuuaccaggaaaucuacaaagcaaguuguguggg

SEQ ID NO: 742809 - RNA, 63 nt, hsa
aggauaugacagcuuaccagcuaagaguaccucccaggaaacagucugacuaauguggaaccu

SEQ ID NO: 742810 - RNA, 63 nt, hsa
gaaggcaccaaaaggaaacaagcuggaaucgcuccaggaaaaacucugguuacaccuggaaga

SEQ ID NO: 742811 - RNA, 63 nt, hsa
uacuccucuacuccaaauuucucauucuucaggccaggaaaccgagacacagagguaaaguaa

SEQ ID NO: 742812 - RNA, 63 nt, hsa
uaggaggagguuuugaagaauaaagccucauauccaggaaaaagugaucaagugaaaaagcug

SEQ ID NO: 742813 - RNA, 63 nt, hsa
uuugccuauuccaaagagcuaaaaaagucuaacccaggaaagcuuuugauauuuuguguuugu

SEQ ID NO: 742814 - RNA, 63 nt, hsa
ugggccauguuuauuguggauugguaagaaucaccaggaaaccauuaagccccaauagcuaca

SEQ ID NO: 742815 - RNA, 63 nt, hsa
gauacauuuaccaguguucuuguuuguguggugccaggaaauugauuuuggaaaaagugaaau

SEQ ID NO: 742816 - RNA, 63 nt, hsa
guguguuucccugugagcuagcagacacaaugaccaggaaaaaaccuaugaauuccauucuua

SEQ ID NO: 742817 - RNA, 63 nt, hsa
auguuaaaggccugggguuuaggaagcuaagucccaggaaaacauaccuacagacaggacaac

SEQ ID NO: 742818 - RNA, 63 nt, hsa
ggcugcuaugggggauggcaccucucagcccucccaggaaacacacagagcucugggcccauc

SEQ ID NO: 742819 - RNA, 65 nt, hsa
ccugcauuaacccagaaauaccucgcuucuaucugugcacuuagcugggaacuuacccacuguaa

SEQ ID NO: 742820 - RNA, 65 nt, hsa
agcguccuggcuccaguuggaacacuuuccugagaugcacuuacuucucagcuucugcgaucaga

SEQ ID NO: 742821 - RNA, 65 nt, hsa
gcaagggcccaaaugcauaaguuucuuugcacuguugcacuuacuuaauacaaauaaauguuuuu

SEQ ID NO: 742822 - RNA, 65 nt, hsa
uacuacuguucaguuuuuuaaaaguuuugaaaugcugcacuuacauuuaaaaaaacaacaacaac

SEQ ID NO: 742823 - RNA, 65 nt, hsa
cucaccauuucccccugcucccccacagccgguucugcacuuaucaccgagucgccccuggaagc

SEQ ID NO: 742824 - RNA, 65 nt, hsa
cuugaccaagaaauuggguuucuuuucccucagccugcacuuacucuucuauuaagaccagaaaa

SEQ ID NO: 742825 - RNA, 65 nt, hsa
ucauccuucuucucuguguuuucugguuuaaaagcugcacuuauauuuuagccuuauuauuuucu

SEQ ID NO: 742826 - RNA, 65 nt, hsa
caaugaaaugaugucauaagcgaucacuuccuauaugcacuuauucucaagaagaacaucuuuau

SEQ ID NO: 742827 - RNA, 65 nt, hsa
uugaaaauuguuuuauuucaggcauguucccuuugugcacuuagguucauugugccucaguuccu

SEQ ID NO: 742828 - RNA, 65 nt, hsa
caucucuguaaaauaauuggaaugaaaauacuucuugcacuuaaacacugcacaugccguacuuu

SEQ ID NO: 742829 - RNA, 65 nt, hsa
cuuuucuuuagugggggaggguaagaaaagcaguuugcacuuaaaaagaaaaaaaaaaaacgggu

SEQ ID NO: 742830 - RNA, 65 nt, hsa
caaaagcauuuugcacaguguuuguuuuccugucuugcacuuacaaauaaggucuaugggaguag

SEQ ID NO: 742831 - RNA, 65 nt, hsa
caggaagacagucuuagcacugucacuuagcagauugcacuuaagucccuugugcuggccagaug

SEQ ID NO: 742832 - RNA, 65 nt, hsa
cucugaggggcuguccagucugcuagaaugcuaauugcacuuaggccucaugguucuaguaaacg

SEQ ID NO: 742833 - RNA, 65 nt, hsa
gacuuguuugagcucuugagcuuagaaguugauuuugcacuuauuuuuuuggggggugggaaugu

SEQ ID NO: 742834 - RNA, 65 nt, hsa
ugugaggcugacacgucugugugaugcaguguggcugcacuuaagggucuguuucucagcaucau

SEQ ID NO: 742835 - RNA, 65 nt, hsa
ugccaguauucuaagacauuugaguaauugcuguuugcacuuacugcauggucagaccacgucac

SEQ ID NO: 742836 - RNA, 65 nt, hsa
guuuuuacaugugauagucaguuguacaaagaaaaugcacuuaaaccuguuucuaaauuauauau

SEQ ID NO: 742837 - RNA, 65 nt, hsa
ggguucagccagucagugacugguggguuugaaucugcacuuauccccaccaccuggggaccccc

SEQ ID NO: 742838 - RNA, 65 nt, hsa
acaugacuaggaguguuaggggcagaaguuuugaaugcacuuaaccggaggagggcgcagggugg

SEQ ID NO: 742839 - RNA, 65 nt, hsa
cuaauuucauacuauuuagauuuucuuuuuuaucuugcacuuauuguccccuuuuuaguuuuuuu

SEQ ID NO: 742840 - RNA, 65 nt, hsa
ccguagcagcuuagauuaacguugauuucauuccaugcacuuagaguugcuuucaguaacauuuu

SEQ ID NO: 742841 - RNA, 65 nt, hsa
cccuccuugggcucuucccgcaaaucaacacuuucugcacuuaucuuuuggagcaaauugacaug

SEQ ID NO: 742842 - RNA, 65 nt, hsa
gagugcaggugacagcaggacuugcuaaagcacuuugcacuuaauggcuguugagggccacuuuu

SEQ ID NO: 742843 - RNA, 65 nt, hsa
ucauagauuuaaguaaacagauguauuuugcacagugcacuuaugucuauuuuaacaauccuccu

SEQ ID NO: 742844 - RNA, 65 nt, hsa
caaucacgucuuuuguuaugcuaguaucagucagaugcacuuagagugaagaaacacuguaauua

SEQ ID NO: 742845 - RNA, 65 nt, hsa
ggaaaacaguucuuguggccuucuauuaaauaguuugcacuuaagccuugccaguguucugagcu

SEQ ID NO: 742846 - RNA, 65 nt, hsa
uuucuuacugccaucauuauuuguuaaagauauuuugcacuuaauuuugugggaaaaauauugcu

SEQ ID NO: 742847 - RNA, 65 nt, hsa
cacacgguucuaauuaagugugaagguauagcuauugcacuuaugccaucuccaaaauuucuuaa

SEQ ID NO: 742848 - RNA, 65 nt, hsa
caccccacccaucacauggcuggcuggcugcugggugcacuuacccuccuuggcuugguuacuuc

SEQ ID NO: 742849 - RNA, 65 nt, hsa
ucugcacaggccucagcuuugaagaacggagucuuugcacuuacacacacucuuccuguucugcc

SEQ ID NO: 742850 - RNA, 65 nt, hsa
uguuugcagcggaucacuggacaucaaagauucauugcacuuaugaacaaggaaccuucuuuuca

SEQ ID NO: 742851 - RNA, 65 nt, hsa
aaagggagaauuuuagacuuaauuuuuaacucuauugcacuuaaagauuuuaguuagguuaccac

SEQ ID NO: 742852 - RNA, 65 nt, hsa
guuacaucuaaauuacaacccuuaauugccacgugugcacuuacuacucuccaguaugucuuauu

SEQ ID NO: 742853 - RNA, 65 nt, hsa
aauacaaauuuaguuuaaguguuugaacaacuauaugcacuuacgguuguguguuuaaaaugucu

SEQ ID NO: 742854 - RNA, 65 nt, hsa
acguaaaaagauauuucuaauuuacuguugcccauugcacuuacauaccaccaccaagaaagccu

SEQ ID NO: 742855 - RNA, 65 nt, hsa
uuguuuaaaauuuuugugcaauucauauauuaaauugcacuuacuugcauacgcucauauucuag

SEQ ID NO: 742856 - RNA, 65 nt, hsa
gggucauuguccccacaaugugccagucgacuauuugcacuuaccuuguccuauauauccguacg

SEQ ID NO: 742857 - RNA, 65 nt, hsa
gcugcagaggccagaggcccccagcccagggcuccugcacuuacuugcuuauuugacaacguuuc

SEQ ID NO: 742858 - RNA, 65 nt, hsa
aagucaagcaagacuuugugaauuugugacaaguuugcacuuacaaaaucauguaaauaugucac

SEQ ID NO: 742859 - RNA, 65 nt, hsa
gaaaaugccuuaaaaggaaugcauauggauaaaguugcacuuauaacacccuucaacaaaaucua

SEQ ID NO: 742860 - RNA, 65 nt, hsa
aauggagaguugugacaaguacagguuaucaaguuugcacuuaacuaugccaaaaaaaguuugaa

SEQ ID NO: 742861 - RNA, 65 nt, hsa
aggccugauggagugagaagaaaguccuugguguuugcacuuaaaugaaaaccuuuucagugaug

SEQ ID NO: 742862 - RNA, 65 nt, hsa
guuuauacacaacuuugcaaauuauuuauuacuugugcacuuaguaguuuuuacaaaacugcuuu

SEQ ID NO: 742863 - RNA, 65 nt, hsa
augaauuaguguucuagacucugcuuugcacagcuugcacuuacagugauuguacauauuguaca

SEQ ID NO: 742864 - RNA, 65 nt, hsa
uuaagucuuuuuuuuuuuugucuagguagucagucugcacuuaaauaucaaucauuuuccuuuuu

SEQ ID NO: 742865 - RNA, 65 nt, hsa
auuauaaucacaggagacucugccuucauuauccuugcacuuaacggaaguuacaucaggcaagu

SEQ ID NO: 742866 - RNA, 65 nt, hsa
guaugucuaccuggcagauacucagaaauguaguuugcacuuaagcuguaauuuuauuuguucuu

SEQ ID NO: 742867 - RNA, 65 nt, hsa
cccuaugaaguaaagaacugcacaugaagaaauacugcacuuacaaucccaccuuuccucaaaug

SEQ ID NO: 742868 - RNA, 65 nt, hsa
aaagagaucuguuauuuucagguagugccauaaucugcacuuagcauuggcuugcuucaguuguu

SEQ ID NO: 742869 - RNA, 65 nt, hsa
aagcauacaauuugagcaugcuguauucuaccacuugcacuuacucaucuucuagccuuaugacc

SEQ ID NO: 742870 - RNA, 65 nt, hsa
augagcgugacacucauuuuagugcuuuguuuccgugcacuuaaaaauaauugagaagaaaaacu

SEQ ID NO: 742871 - RNA, 65 nt, hsa
caucaggguaauuguauugagaacucaaauauacgugcacuuacaugugugguucguacucaagu

SEQ ID NO: 742872 - RNA, 65 nt, hsa
cucuuauaaauggagcacuuagaaauuuguuguucugcacuuaaccuagagagagaaaaaaugcu

SEQ ID NO: 742873 - RNA, 65 nt, hsa
auuacaauuaaaaccucauuuuuuuuuuccauuuuugcacuuaacagugaugaauacuuuuacgu

SEQ ID NO: 742874 - RNA, 65 nt, hsa
aauaauuucuuaauuuaaaaugauagcacuucucuugcacuuaagaauggcauccauaagauucu

SEQ ID NO: 742875 - RNA, 65 nt, hsa
ucugugauuccacuggcggaggauucuuggaagcuugcacuuaguuuccccugacuucaccccau

SEQ ID NO: 742876 - RNA, 65 nt, hsa
caaauuagaagcggauuuggaaaugcaaacuaacgugcacuuagauauccaagugggugagcuua

SEQ ID NO: 742877 - RNA, 65 nt, hsa
uauuuaauuaaaaaggcaaaaccugaaccaccuucugcacuuaaagaagucuaacaguacaaaua

SEQ ID NO: 742878 - RNA, 65 nt, hsa
uguauccagccuucacuccagcugguuaaaaauguugcacuuaucagcaacccuaccacuuucau

SEQ ID NO: 742879 - RNA, 65 nt, hsa
guuauucaagaaaaugaacaugcucuucaaaaagaugcacuuaguauuaaguugaaacuugaaca

SEQ ID NO: 742880 - RNA, 65 nt, hsa
uggcucuauaaauuaaguuugugcuuuccuugaaaugcacuuauucuuauuacaagcauuuuaua

SEQ ID NO: 742881 - RNA, 65 nt, hsa
guuuaaaauguaauuuaaaugaaagaaaauugaguugcacuuauugaccauuuuuuaauuuacuu

SEQ ID NO: 742882 - RNA, 65 nt, hsa
ggaggaggagcacaagauccucagcaacgaacaccugcacuuagaaaaaguggacagcuucugcc

SEQ ID NO: 742883 - RNA, 65 nt, hsa
guauuucauuaggaucuaaaguugucugaguuaaaugcacuuaugugacucauguguccucuuag

SEQ ID NO: 742884 - RNA, 65 nt, hsa
ugauuaaaauuuaaaaaaaaaacauuucacucaguugcacuuagucguaugucuugcaugcuuag

SEQ ID NO: 742885 - RNA, 65 nt, hsa
agaauuuuuccaggagggagaccuguugguuauugugcacuuaaaagaaccacccacaccucucu

SEQ ID NO: 742886 - RNA, 65 nt, hsa
ggcuuuaaacauauucagaacagaugcuugaaauaugcacuuagcacuuugguuccacaucuguc

SEQ ID NO: 742887 - RNA, 65 nt, hsa
aauuuuaaguguaacauaacuguguuuacuucccaugcacuuaauacccuuaugcgcuaauuuug

SEQ ID NO: 742888 - RNA, 65 nt, hsa
gcaacacagucugcugcuauauagugggggaagcgugcacuuauuucuaaacauggguuuuuaac

SEQ ID NO: 742889 - RNA, 65 nt, hsa
ugcuuucauugucuucaucuuccugccauacuuugugcacuuauugcucuccuucugagucagga

SEQ ID NO: 742890 - RNA, 65 nt, hsa
cuugcagccagucacuguguaaagccucucugaugugcacuuaagaguggguugcuuucucacaa

SEQ ID NO: 742891 - RNA, 65 nt, hsa
ggaaggcaucagucccuauguauuugcaguucaccugcacuuaaggcacucuguuauuuagacuc

SEQ ID NO: 742892 - RNA, 65 nt, hsa
agcagaaugaaaccacauuuuuugguuugauaauaugcacuuauugacucccacucauuguuaug

SEQ ID NO: 742893 - RNA, 65 nt, hsa
uguugcaauuuagcuugcuuucaagcuucaccccuugcacuuaacauaagcuauuuuuggcauug

SEQ ID NO: 742894 - RNA, 65 nt, hsa
auuuaauaauguauauucuuucaugcuuuuuucugugcacuuaccuaagugugaauauguaaagg

SEQ ID NO: 742895 - RNA, 65 nt, hsa
auuaguagguucuguuacaguuuuucuuuugaucgugcacuuauagucuucauuuaauuccucau

SEQ ID NO: 742896 - RNA, 65 nt, hsa
uuguauuuguggaaauugguauuaucucuguuuuaugcacuuacauuuaucccuuacauuuuguu

SEQ ID NO: 742897 - RNA, 65 nt, hsa
ccagagcuaauauauuuauugccuauggcuuguuuugcacuuaauaaaauaauuuguuuuugcaa

SEQ ID NO: 742898 - RNA, 65 nt, hsa
aaaacaccggcauaagaaauuugacauuucacagaugcacuuacauauuuugaccacaaggggga

SEQ ID NO: 742899 - RNA, 65 nt, hsa
uacauaugcaaucacucguuuaugcugucuagucaugcacuuaaagcaauuuucaaauguacuca

SEQ ID NO: 742900 - RNA, 65 nt, hsa
uacgcgugcaguucauuucuaguucuugauagaacugcacuuaauuuucaguaguagucuugacu

SEQ ID NO: 742901 - RNA, 65 nt, hsa
uaaccguuuauuuaacauauauuuuuauuuuugauugcacuuaaauuuuguauaauuuguguuuc

SEQ ID NO: 742902 - RNA, 65 nt, hsa
aggaauugauugcauaugcaagcccuggccacagcugcacuuacaggaugccucauagacgauga

SEQ ID NO: 742903 - RNA, 65 nt, hsa
gauacaauuauugaaugaagcguuuuacaauacauugcacuuaauccauuguuuaaauuuacaac

SEQ ID NO: 742904 - RNA, 65 nt, hsa
cuuaggaagugacuugaauguacaaagauacuugaugcacuuauuuuuuaaugugagacagcaag

SEQ ID NO: 742905 - RNA, 65 nt, hsa
uuuacuguguuauuuaaaugcuaagccaaaguaucugcacuuagguauaccucuuuaugccaaua

SEQ ID NO: 742906 - RNA, 65 nt, hsa
cacaaaaagacaaaugauuguaggauccauggaagugcacuuaggcuugcugugguggaggccau

SEQ ID NO: 742907 - RNA, 65 nt, hsa
ggguggagaguggcaggaagcaagcauguuugcugugcacuuaggaaaggcuggugagccagagg

SEQ ID NO: 742908 - RNA, 65 nt, hsa
aaagcuaaauuugucccuuuuuuauuguuauuaauugcacuuaacauuuuuaguuauacuggaua

SEQ ID NO: 742909 - RNA, 65 nt, hsa
aaaauuguguucuuaaaauauuguguaagaaucacugcacuuagcuguuggaauguuguuaaaug

SEQ ID NO: 742910 - RNA, 65 nt, hsa
auguaaaaauuggguaaauuuacuacugaggggagugcacuuauuuauuuaacuuacuuaucugg

SEQ ID NO: 742911 - RNA, 65 nt, hsa
gcaagaucuggggcugcagagaacagaagagcuggugcacuuaauccagcucugcccuugggggg

SEQ ID NO: 742912 - RNA, 65 nt, hsa
ggggccguggggucucaggggugccuggugaauucugcacuuacacguacucaagggagcgcgcc

SEQ ID NO: 742913 - RNA, 65 nt, hsa
cacacuuugcuuguauuuuaaaaggaggauauauuugcacuuauguauacuuuuacaguuugcca

SEQ ID NO: 742914 - RNA, 65 nt, hsa
cugauuaaauaauacauuuauaaucuacaacuguuugcacuuacagcuuuuuuuguaaauauaaa

SEQ ID NO: 742915 - RNA, 65 nt, hsa
acccccaugauguaaguuuaccuauguaacaaaccugcacuuauacccaugaacuuaaaaugaaa

SEQ ID NO: 742916 - RNA, 65 nt, hsa
gggcaaagccuaguagagaaccagugcaccucaggugcacuuacauaugguggggcugaggcaaa

SEQ ID NO: 742917 - RNA, 65 nt, hsa
ucaucaaacaaaaaauaaaucucgaagaaaaaaaaugcacuuacaugugcuuauuuggcuuuucu

SEQ ID NO: 742918 - RNA, 65 nt, hsa
auguggcacuucaaaaggcagcaccacugggcgccugcacuuauuugaaaauggaacuuugggag

SEQ ID NO: 742919 - RNA, 65 nt, hsa
ugcaauuuucucuuggugcuaccugauggaauuccugcacuuaaaguucuggcugacuaaacaag

SEQ ID NO: 742920 - RNA, 65 nt, hsa
ucugggagggcaaaaaaaaaaaaaaaguuuuuaugugcacuuaaauuuggggacaauuuuaugua

SEQ ID NO: 742921 - RNA, 65 nt, hsa
cggaaggcuucugacgcuuguggccagacugcaauugcacuuauguguuaugcuacuaauauuug

SEQ ID NO: 742922 - RNA, 54 nt, hsa; identical to SEQ ID NO: 190234

SEQ ID NO: 742923 - RNA, 65 nt, hsa
aaggucauagauucuugagcuguugugguuuuuagugcacuuaauauuagcuugcuuaaggcaua

SEQ ID NO: 742924 - RNA, 65 nt, hsa
cccacaugcacacagaacucugacacaggaucagcugcacuuaagaaaucaucccagcuaaguuc

SEQ ID NO: 742925 - RNA, 65 nt, hsa
aaagcuacauugacgagacacuuacugguuuaauuugcacuuauuaaccaucuauugaauacaca

SEQ ID NO: 742926 - RNA, 65 nt, hsa
uguaaacaagauauuuaaacuagaguaucuuauucugcacuuaugcauuaguuaaaaaaagauaa

SEQ ID NO: 742927 - RNA, 65 nt, hsa
gugucauagcuaugacauuuguuaaaaauaaacucugcacuuauuuugauuugaauuaauuuugg

SEQ ID NO: 742928 - RNA, 65 nt, hsa
gccgagggcaggaguggcucaacuuggucucgucuugcacuuagugcaaauaccaauaauuaaga

SEQ ID NO: 742929 - RNA, 65 nt, hsa
guguucacauggucaaaauuucaccacugaaacccugcacuuagcuagaaccucauuuuuaaaga

SEQ ID NO: 742930 - RNA, 65 nt, hsa
auuuuuuuuccuauuuuucuucuuuuugcuuuuuuugcacuuaucagaaauauuugaugugugca

SEQ ID NO: 742931 - RNA, 65 nt, hsa
acugauuuagaagagacucuuugcugaaauugaauugcacuuauacauguaaauugucaacaugu

SEQ ID NO: 742932 - RNA, 65 nt, hsa
caguuuuucauuuuaaaaaguccauaccuuauauaugcacuuaauuuguuggggcuuuacauacu

SEQ ID NO: 742933 - RNA, 65 nt, hsa
ucaauuccaccagggccagagcagcuccaccacugugcacuuagccaugauggcaacagaaacca

SEQ ID NO: 742934 - RNA, 65 nt, hsa
aauucuucaaccagaaaaaccuauuguucuaaaagugcacuuaagagaugggauuacaaguggac

SEQ ID NO: 742935 - RNA, 65 nt, hsa
uuugucaucauaaucuuuauggugggggcagacuuugcacuuacugcagugcaacacuugcacuu

SEQ ID NO: 742936 - RNA, 65 nt, hsa
aaugaauguucuuuucaaaaaauaaaguagaaaaaugcacuuacuaagaacaugaaaaaaaauga

SEQ ID NO: 742937 - RNA, 65 nt, hsa
ugauaaacuauaauuguagaaagggguaauuucugugcacuuacaacaagcugaguguucauguu

SEQ ID NO: 742938 - RNA, 65 nt, hsa
uaucauugaaaaaguccauagccaaaaccugacugugcacuuacuauaggacccugaccugccug

SEQ ID NO: 742939 - RNA, 65 nt, hsa
ucugauuuuuaaaccugguuuacagguauuacuucugcacuuaccaaauaaugccagauggaaau

SEQ ID NO: 742940 - RNA, 65 nt, hsa
acuugccuuaaaacuggagagaggaaucuaguauuugcacuuagcaaaauauuuaaaaacugaaa

SEQ ID NO: 742941 - RNA, 65 nt, hsa
uccuggaauacaguuuucaguguaauuaauucaacugcacuuaacacuaauguccguguugguau

SEQ ID NO: 742942 - RNA, 65 nt, hsa
aguauuuuggcauauuauucuccagguguuucuuaugcacuuauaaaaugauuugaacaaauaaa

SEQ ID NO: 742943 - RNA, 65 nt, hsa
ugugccucagccuagauguuuugucuucucuuuucugcacuuaauaccugacaguaugaccgauc

SEQ ID NO: 742944 - RNA, 65 nt, hsa
agcccauccccucccagaaauagagugacaaacucugcacuuaaguccccuguuucuguuuaacu

SEQ ID NO: 742945 - RNA, 65 nt, hsa
uugaggggaaggaggagccccucuuucucccaugcugcacuuacuccuuuugcuaauaaaagugu

SEQ ID NO: 742946 - RNA, 65 nt, hsa
ccccccaccgugguucuuuucacagcccucgacuuugcacuuaaaaagggauauuguaaaugaaa

SEQ ID NO: 742947 - RNA, 65 nt, hsa
uugguugacuuaauauauuugcuuuuuuucucaccugcacuuagaggaaauuugaacaaguugga

SEQ ID NO: 742948 - RNA, 65 nt, hsa
gccucauuuagagaggaaaaguaaccaucacugguugcacuuaugauuucaugugcggggaucau

SEQ ID NO: 742949 - RNA, 65 nt, hsa
uacugucaagguacuugcuugugucugaacucuagugcacuuaugauuuuguagaccaugugaaa

SEQ ID NO: 742950 - RNA, 65 nt, hsa
uuuuguuguuuuguuugcuuugggaucuuguuggaugcacuuagauauggaaaauggaagccaaa

SEQ ID NO: 742951 - RNA, 65 nt, hsa
cuugucucuaaauugauguucacccauuucaauauugcacuuauuaauggucuuuauuuuucuag

SEQ ID NO: 742952 - RNA, 65 nt, hsa
acuguuuuguaagaaucacuguuacauucuucuuuugcacuuaaaguugcauugccuacuguuau

SEQ ID NO: 742953 - RNA, 65 nt, hsa
guauaaugauguaaacauggaaaaacuuuaggaaaugcacuuauuaggcuguuuacauggguugc

SEQ ID NO: 742954 - RNA, 65 nt, hsa
cacucucuugaauuuaggaaucauugaaaacuccuugcacuuagauuuaauuuauauguuaguua

SEQ ID NO: 742955 - RNA, 65 nt, hsa
uaaauauuuuuaacauuacugaggugaauuauuuaugcacuuaggaagugcuaaauuuuaaaagc

SEQ ID NO: 742956 - RNA, 65 nt, hsa
gcuccucucaagccacauuuccucccagugcugggugcacuuaacaacugcguucuggcuaacac

SEQ ID NO: 742957 - RNA, 65 nt, hsa
ucuuacacuaaaaauccuugcauuuuaaagagagaugcacuuaagaauagagugaacugcucaua

SEQ ID NO: 742958 - RNA, 65 nt, hsa
cauuguugcugcauuaguguaauguggugugguuuugcacuuaaaagagguauucauaugcucua

SEQ ID NO: 742959 - RNA, 61 nt, hsa; identical to SEQ ID NO: 190271

SEQ ID NO: 742960 - RNA, 65 nt, hsa
acguguuucuagguugaccuuguguuuuagaaauuugcacuuaauggaauuugcauuucagagau

SEQ ID NO: 742961 - RNA, 65 nt, hsa
agaaaaaugucacuacugcaacauuaggaauguccugcacuuaauagaauuauuuuucaccgcua

SEQ ID NO: 742962 - RNA, 64 nt, hsa
cugaguuuucggagaccaagaaauuaaaauacaauugcacuuacuguuuacuuguaaauguuau

SEQ ID NO: 742963 - RNA, 65 nt, hsa
gucuacugcuuuguacgaauucuaaguauucuuguugcacuuaauuagccuguauauccucagaa

SEQ ID NO: 742964 - RNA, 65 nt, hsa
cagagccuauagccagaacucagaaaaaauucaaaugcacuuauguucucauucuauggccauug

SEQ ID NO: 742965 - RNA, 65 nt, hsa
cuaagaaauauuccaaaugucuuuuagaagauagaugcacuuaugcaguaaauuaucuugggaua

SEQ ID NO: 742966 - RNA, 65 nt, hsa
augggaguauuauaucccuguauagugaugcaaaaugcacuuauguguaaccaguggugauuugg

SEQ ID NO: 742967 - RNA, 65 nt, hsa
uauucaaaccuuuaaguuagcuuuccauaauucacugcacuuaaauaaguuuaaaucaaauacag

SEQ ID NO: 742968 - RNA, 65 nt, hsa
augcuaaaauuccugaaguucagcugcauacaguuugcacuuauggacuccuguuguugaaguuc

SEQ ID NO: 742969 - RNA, 65 nt, hsa
uuagagguauggagcagugcaacuuaaacucaaguugcacuuacauuuugaauuuuaaaaugaug

SEQ ID NO: 742970 - RNA, 65 nt, hsa
uuuuucauucugagcauguuugucccaaaaggugaugcacuuaagcugacagucccuucaguggu

SEQ ID NO: 742971 - RNA, 65 nt, hsa
uccaaaaacuugcugaaacacuugauauugcacagugcacuuauuuuguggccaaagcauggccu

SEQ ID NO: 742972 - RNA, 65 nt, hsa
uacaguaagcguuuuuuuucuuugaagauuuaugaugcacuuauucaauagcugucagccguucc

SEQ ID NO: 742973 - RNA, 65 nt, hsa
cuaaagucuacaccaauggaauuagaugagugcuaugcacuuaauuuuaaaauaaaacuaguuuu

SEQ ID NO: 742974 - RNA, 65 nt, hsa
gaggacaggagacuccaagcgcuaguauugcacgcugcacuuaauggacuggacucuugccaugg

SEQ ID NO: 742975 - RNA, 65 nt, hsa
agaacccauuugagggguggggggguguuaauuuaugcacuuauaagguguuuucuguguaacca

SEQ ID NO: 742976 - RNA, 65 nt, hsa
acuggcugcagcagaacacguugagggagucuuggugcacuuaggucacuguaagguucuagggc

SEQ ID NO: 742977 - RNA, 65 nt, hsa
acugcaagugacaaucagaggugacuaucuauauuugcacuuaaaaucaaaguaguucaacaugc

SEQ ID NO: 742978 - RNA, 65 nt, hsa
cuuuugacuccccuuauucccucuccaagaguaguugcacuuaacuuuuuuuuuuuuuuuuuagu

SEQ ID NO: 742979 - RNA, 65 nt, hsa
ggagguuaucagaauuaauaaaaguaucuguuaugugcacuuaagccgcagcugcuauagauagc

SEQ ID NO: 742980 - RNA, 65 nt, hsa
ucuacuuugaagucauaccaaugaaaaaauguauaugcacuuauaauuuuccuaauaaaguucug

SEQ ID NO: 742981 - RNA, 65 nt, hsa
uugugguguuguucugauuguuuugaacuggagcaugcacuuauuuucagaaacuuagagaguug

SEQ ID NO: 742982 - RNA, 65 nt, hsa
aucauaaauguacuucaccagugauuuuacugaaaugcacuuauauuagucuuuauguauuugcu

SEQ ID NO: 742983 - RNA, 65 nt, hsa
guggaaaggcaaguuggucuuauagaaagcacuacugcacuuaguagcuaugugauuuugagcaa

SEQ ID NO: 742984 - RNA, 65 nt, hsa
aaguuaagaagccaaagcuacuugaucaugcaaaaugcacuuauauauuuguuacacuguauugc

SEQ ID NO: 742985 - RNA, 65 nt, hsa
uuaugguuuaucuccagcaacauuucucuaguacuugcacuuauuaucuuuugucuaauuuaacc

SEQ ID NO: 742986 - RNA, 65 nt, hsa
uuuuuacucccaguagcaagggauucuaaguuaguugcacuuacaugauuauuguuauuuaaaac

SEQ ID NO: 742987 - RNA, 65 nt, hsa
cccgacuuacuugcuagucucuaugagguccuuauugcacuuauugggguugaagcucuucagag

SEQ ID NO: 742988 - RNA, 65 nt, hsa
cacucccuucuucccuguguggggcucaagccuggugcacuuaguauagaagagcuaacguacuc

SEQ ID NO: 742989 - RNA, 65 nt, hsa
uggggcagaagcucugccuaaaaugaagugaaagcugcacuuaacccuuugugauaaugaugaca

SEQ ID NO: 742990 - RNA, 65 nt, hsa
uggaacuucuuuauuucaaaacagaagugucuccuugcacuuagccuuggcagacccuugacucc

SEQ ID NO: 742991 - RNA, 65 nt, hsa
cugauccaggaggccggggccggguacugagagucugcacuuaacaagcucccaggccgagaagc

SEQ ID NO: 742992 - RNA, 65 nt, hsa
gaauguaugaaggaugaccccaucacucucuuuguugcacuuagcccucagguaagugcauaggc

SEQ ID NO: 742993 - RNA, 65 nt, hsa
caaacauuuaugcgguaggcucagaugucguaauuugcacuuagguaccaggugucaggaaacag

SEQ ID NO: 742994 - RNA, 65 nt, hsa
gauauauaaauagacuauauguucaauauuaucacugcacuuauaaaaaaagaaugauaugugag

SEQ ID NO: 742995 - RNA, 65 nt, hsa
aaaaaucacuugguaaggauuauaaacuuaauuacugcacuuaaaaugaaacauuacuuuuuuua

SEQ ID NO: 742996 - RNA, 65 nt, hsa
aaguucagcguuguaugucucucucuacacuguggugcacuuaacuuguggaauuuuuauacuaa

SEQ ID NO: 742997 - RNA, 65 nt, hsa
aaccagugaaaaugaaaggaaguuucaguauuagaugcacuuaaguuagccuccaccacccuuuc

SEQ ID NO: 742998 - RNA, 65 nt, hsa
aguuuuauauuugucgacgccaggucagucauuuuugcacuuaauuguauaugagauaacuagau

SEQ ID NO: 742999 - RNA, 65 nt, hsa
aaaauauaaaugaagauauuuuaccaugaagagauugcacuuauccuugagaacagucuaaauau

SEQ ID NO: 743000 - RNA, 65 nt, hsa
uaaauauaaaugaagauauuuuaccaugaagagauugcacuuauccuugagaacagucuaaugau

SEQ ID NO: 743001 - RNA, 65 nt, hsa
gguagucuccuuauaguugaagauaaaauguugagugcacuuauuuuagaauauccuagacauaa

SEQ ID NO: 743002 - RNA, 65 nt, hsa
uagccucgcuagucaagcugugaauguauauuguuugcacuuaauccuuaacuguauuaacguuc

SEQ ID NO: 743003 - RNA, 65 nt, hsa
uaacaggaaaagucaucccuauuuccuuguuuuacugcacuuaauauuauuugguugaauuuguu

SEQ ID NO: 743004 - RNA, 65 nt, hsa
ggcucccaagugccuaggccaugccuuacgacugcugcacuuaccauuugucauaugauggcacu

SEQ ID NO: 743005 - RNA, 65 nt, hsa
cuugaauguuuauacuuuuauucuauaauuugcccugcacuuauuuuacaaccuaguaauaaugu

SEQ ID NO: 743006 - RNA, 65 nt, hsa
gaggccaagaauauugcaaaauacaugaagcuucaugcacuuaaagaaguauuuuuagaauaaga

SEQ ID NO: 743007 - RNA, 65 nt, hsa
uauuuucucuauuuuccccuguucuuuuuguguuaugcacuuaauuuuaugacugccgggggggu

SEQ ID NO: 743008 - RNA, 65 nt, hsa
auggaggcuuggaugggaauaugcugauuuuguucugcacuuaaaggcuucuccuccuggagggc

SEQ ID NO: 743009 - RNA, 65 nt, hsa
ugauaauuauaacuuaauguuagagaugguaaagcugcacuuacuugaacagcccaaaagcauua

SEQ ID NO: 743010 - RNA, 65 nt, hsa
cagcagcuccccaccccagagccaaaugacaguagugcacuuaaaaaggaaaaucaggccuguug

SEQ ID NO: 743011 - RNA, 65 nt, hsa
uuuuggucauuugacaucagagauguuguaaguauugcacuuaauacgcaccuauuucucaauag

SEQ ID NO: 743012 - RNA, 65 nt, hsa
aaugagaaucaaauggaaacauaucauucuggaggugcacuuacucuucuacaauguggccggau

SEQ ID NO: 743013 - RNA, 65 nt, hsa
aauauuaaaacgacuccccaauuauuuugcagaauugcacuuaauauugaaauguacuguauagg

SEQ ID NO: 743014 - RNA, 65 nt, hsa
acagacgcugcaaucacagauuuuaaaaaauuguuugcacuuaaaaauaguugaaugcuggugga

SEQ ID NO: 743015 - RNA, 65 nt, hsa
auaaacugauuuuauuugggagaaacaaggaagggugcacuuaacuagcaaccuaagcaugauuu

SEQ ID NO: 743016 - RNA, 65 nt, hsa
ggcagcuuauuggacacauggauuuucuucagauuugcacuuacugcuagcucugcuuuuuaugc

SEQ ID NO: 743017 - RNA, 65 nt, hsa
cauccuauuguacucucuucugcuuuuuagaagccugcacuuaagcuuagauuugugaagggaga

SEQ ID NO: 743018 - RNA, 65 nt, hsa
guuccuaauggauucaauuacggacucuggauauuugcacuuauguacuugauacugaaugcaua

SEQ ID NO: 743019 - RNA, 65 nt, hsa
aacagugguacgauuucuagcccguggcuuuaaaaugcacuuaaaguccuguccuugccuuuuau

SEQ ID NO: 743020 - RNA, 65 nt, hsa
aaauuaucccagcuauuagauagaagggauguuacugcacuuauguguaaucagaucuuuauuua

SEQ ID NO: 743021 - RNA, 65 nt, hsa
uuguaaggugacuuuauugugugaacaucauggagugcacuuauacaaaccuagaugggacaccu

SEQ ID NO: 743022 - RNA, 65 nt, hsa
uuguuuguuuauuauaaacaaaaagcaugugaaagugcacuuaagauagaguuuuuauuaauuac

SEQ ID NO: 743023 - RNA, 65 nt, hsa
aacagugguacgauuucucgcccguggcuuuaaaaugcacuuaaaguccuguccuugccuuuuau

SEQ ID NO: 743024 - RNA, 65 nt, hsa
uuacuucaugcauggcuucuccuccaacuuccuccugcacuuaaaaagggccagguuccaaauua

SEQ ID NO: 743025 - RNA, 65 nt, hsa
ccaguccuuucugucauucugugugugugugugugugcacuuauguguauggguccauauguacg

SEQ ID NO: 743026 - RNA, 65 nt, hsa
acaugcauucaagaagcuaggggaaaaauaucucaugcacuuaaauaauggucuucaauuuaauu

SEQ ID NO: 743027 - RNA, 65 nt, hsa
aagccuuguaaauaaugacauggaagacccugugcugcacuuaaaauauugcugcuugauuauuu

SEQ ID NO: 743028 - RNA, 61 nt, hsa; identical to SEQ ID NO: 190340

SEQ ID NO: 743029 - RNA, 65 nt, hsa
uuacuuuauuacagagcuccuugguuuuuuacuucugcacuuaaauuuuuuuaaauaacaugaug

SEQ ID NO: 743030 - RNA, 65 nt, hsa
uuuuuuuuuuaauuuucaggucaaguuuuuuauacugcacuuauuugucaaaauaaagauucuca

SEQ ID NO: 743031 - RNA, 65 nt, hsa
acaguggcugaaauccagcauuuuuacauaggagaugcacuuagccucuaagccucguuuuacuc

SEQ ID NO: 743032 - RNA, 65 nt, hsa
uucuuuggauggaggggagggccuuuguuaccuuuugcacuuauucuuucugugggugcuuugac

SEQ ID NO: 743033 - RNA, 65 nt, hsa
guggaucccucugucuggggugggaugccuuacuuugcacuuaauuuaauaagggcauucucgga

SEQ ID NO: 743034 - RNA, 65 nt, hsa
aaggaaugucugacaggcuuaagcuuucguccccuugcacuuagacucgaaguuaguaaauccuu

SEQ ID NO: 743035 - RNA, 65 nt, hsa
gagugcagaucacgaaugcaccugcuuccaggcagugcacuuagagaaaggucacuggcccgggc

SEQ ID NO: 743036 - RNA, 65 nt, hsa
aagggauuguagguagauaacauccaaucacuguuugcacuuaucugaaaucuucccucuuggcu

SEQ ID NO: 743037 - RNA, 65 nt, hsa
caucauggcucuccacucagacugugccuggccccugcacuuacaacuuccugccgcucuguggc

SEQ ID NO: 743038 - RNA, 65 nt, hsa
acauugaaaaguaaauguuuuauuaguucauugccugcacuuacugaucggaagagagaaagaac

SEQ ID NO: 743039 - RNA, 65 nt, hsa
cauugggcuguuuucucaacaaauggaaugccauuugcacuuacacaagacuuuccccauacucu

SEQ ID NO: 743040 - RNA, 65 nt, hsa
gagcugggagcagcacaaggacccagccuuuguucugcacuuaauaaaugguuuugcuacugcua

SEQ ID NO: 743041 - RNA, 65 nt, hsa
cagugccgggaaggaacugccgggacucaccgagcugcacuuaacuguucucuuucuggcuauuu

SEQ ID NO: 743042 - RNA, 65 nt, hsa
agcugagccugaaucugacucuugaggguuggggcugcacuuauuuauugcggggagacagcucu

SEQ ID NO: 743043 - RNA, 65 nt, hsa
ggaaucaaacaguccugaauucaaauccuuguuuuugcacuuauugucuggagagcuuuggauaa

SEQ ID NO: 743044 - RNA, 65 nt, hsa
guguuuucacuggauuuuuaucucucucaacuuccugcacuuaacaauaugaaauagaaacuuuu

SEQ ID NO: 743045 - RNA, 65 nt, hsa
ucaagaagggggcucccugggaucuccagguguacugcacuuacccucaauccagccccggagaa

SEQ ID NO: 743046 - RNA, 65 nt, hsa
gaggguuucaguacaaaugcugcugucuauuucugugcacuuaacaauggaacccaaacagaaga

SEQ ID NO: 743047 - RNA, 65 nt, hsa
aucguguaaagagauuacacaugacuguaccauguugcacuuaaucaaauaguauguggggauuu

SEQ ID NO: 743048 - RNA, 65 nt, hsa
gaagaacagauaaucccuguauuucaagaccucugugcacuuauuuaugaaccugcccugcuccc

SEQ ID NO: 743049 - RNA, 65 nt, hsa
ggugccgacuggcugccugacuucaucaugcucccugcacuuaggcugcgugggacaagggcugu

SEQ ID NO: 743050 - RNA, 65 nt, hsa
cuaauuaacaaaauguucuuccuuuaguuugcuuuugcacuuaaaauauauauaauugacuuuuu

SEQ ID NO: 743051 - RNA, 65 nt, hsa
aguauaaguaugcguuacaggguuugauacuuuccugcacuuagguuuguccuauucuucauuua

SEQ ID NO: 743052 - RNA, 65 nt, hsa
aguuagcauaauuuuagaugccugugaaauaguacugcacuuacauaaagugagacauugugaaa

SEQ ID NO: 743053 - RNA, 65 nt, hsa
aucauaauacauguaguauuuugugucuggcgucuugcacuuagcaugguguucuugagguucau

SEQ ID NO: 743054 - RNA, 65 nt, hsa
guacauccuuaaacaaaguaguauguacaugaaauugcacuuaaccaaaacuauuguguaaaaca

SEQ ID NO: 743055 - RNA, 64 nt, hsa
uaugugaaaauauccuggaaauaaauacauguuucugcacuuagagccagggaccugccgcguu

SEQ ID NO: 743056 - RNA, 65 nt, hsa
gaagccccagcgagauuuuccggugaauacgggauugcacuuacucuuucaucacggaaacagac

SEQ ID NO: 743057 - RNA, 65 nt, hsa
agauaagcccccgcggggcggagauuucuaccuucugcacuuacuccccaucagaagaucgaguu

SEQ ID NO: 743058 - RNA, 65 nt, hsa
gagguuuauuucaccugaauauaauuccuaacugaugcacuuaguauaugucaguuuuuauaaau

SEQ ID NO: 743059 - RNA, 65 nt, hsa
gggaaucucuaacaugcucuguuuacaucgauaaaugcacuuaaggaaaacaaacaaauuaaagc

SEQ ID NO: 743060 - RNA, 65 nt, hsa
cuugacucauauguuuuaacaugauuuuaacaaacugcacuuauuaagaaauguguuugcccugu

SEQ ID NO: 743061 - RNA, 65 nt, hsa
aaucacugugacucuagaguggccagacucagagcugcacuuaguagggguuccucaaaggaagg

SEQ ID NO: 743062 - RNA, 65 nt, hsa
auaauucacccaugaaagagacccagugguuacugugcacuuaggaaaaccuucagccacaucuu

SEQ ID NO: 743063 - RNA, 65 nt, hsa
agaauucacccaugagagagacccagugguugcuaugcacuuaggaaaacuuucagccacaucuu

SEQ ID NO: 743064 - RNA, 65 nt, hsa
agaagacagccuacaugguccauugcuacucuugcugcacuuauguaaacaaucagaccacauuu

SEQ ID NO: 743065 - RNA, 58 nt, hsa; identical to SEQ ID NO: 190377

SEQ ID NO: 743066 - RNA, 65 nt, hsa
guguauacaaauacaguauuuuccaugguucugccugcacuuacuuuguaaugccacgguugaga

SEQ ID NO: 743067 - RNA, 65 nt, hsa
ggcuuuucccguugaugucuugaugcuccuaucugugcacuuaccguagguagggacacgugucc

SEQ ID NO: 743068 - RNA, 65 nt, hsa
aaagaaaugaaugugaaagaaagccaagcaucacuugcacuuaaaucauuaccacggaagauaua

SEQ ID NO: 743069 - RNA, 65 nt, hsa
uuuggggaguaccuguccaagacagggcucauuuuugcacuuaucucgaauuugaagagauugcu

SEQ ID NO: 743070 - RNA, 65 nt, hsa
cccugcaguaacuaucuauacaccuaccuccagugugcacuuagggggugagcgcgggugucgag

SEQ ID NO: 743071 - RNA, 65 nt, hsa
gaaggaagcacaugugcaccuuuccuuuacacuaaugcacuuaggauguuucugcaucaugucua

SEQ ID NO: 743072 - RNA, 65 nt, hsa
cggcucagcgaccuuuccucucaaaugcggaagcgugcacuuacaguucagaccguucuccugua

SEQ ID NO: 743073 - RNA, 65 nt, hsa
cuauauuuucuggauucuggagguugauaaccauaugcacuuaacauuauauucuauaaacauua

SEQ ID NO: 743074 - RNA, 65 nt, hsa
aauauguagaauguuaaaagcacagcaaacugcacugcacuuauaaagcaaaucuauuagaaaaa

SEQ ID NO: 743075 - RNA, 65 nt, hsa
uggacuucgguguccucggcucugaaggcgcucucugcacuuagaugcugucagcccucaacgua

SEQ ID NO: 743076 - RNA, 65 nt, hsa
cauugagggugaugacaagagacauccggggacugugcacuuacagucgguguggaaugucacuc

SEQ ID NO: 743077 - RNA, 65 nt, hsa
gagggagaccagcaguuaacggugagggagguaggugcacuuacccucuccucucuucuccuauc

SEQ ID NO: 743078 - RNA, 65 nt, hsa
cccagcuaacucugaccugggagcccucaggcaccugcacuuacaggccuugcucacagcugauu

SEQ ID NO: 743079 - RNA, 65 nt, hsa
uuaagacuuucugcugcacucacaggauccugagcugcacuuaccugugagagucuucaaacuuu

SEQ ID NO: 743080 - RNA, 65 nt, hsa
ugcuuaugugugugggcuugggacgagugcugguaugcacuuaggaccuucuugauagcucccug

SEQ ID NO: 743081 - RNA, 65 nt, hsa
gaaugcuggucagucugaaaaggugaagcuggcugugcacuuacccccaucuuucucccucgggg

SEQ ID NO: 743082 - RNA, 65 nt, hsa
aguccccuuucccugucccagccccaucuguggguugcacuuacaaacccccacccaccuucaga

SEQ ID NO: 743083 - RNA, 65 nt, hsa
uuuagaaaacuauugaaagaaaucacaggggaaacugcacuuagacugacagaauugaacaccaa

SEQ ID NO: 743084 - RNA, 65 nt, hsa
aaaaauguaugcaauuccugaguguagaaacuucuugcacuuauuuaaaauuuaggagagaacau

SEQ ID NO: 743085 - RNA, 65 nt, hsa
uaauuuuaaaagucuauuuuauuaugagcuuucuuugcacuuaaaaauuagcaugcugcuuuuug

SEQ ID NO: 743086 - RNA, 65 nt, hsa
gcugcccaugccgcucaggcuacccuuaucuccucugcacuuauguuaucaauaaagaggcaaau

SEQ ID NO: 743087 - RNA, 65 nt, hsa
aaaugccaguguguccuagaaccuagauaacgaagugcacuuacacuuauaaaauaacuugcauc

SEQ ID NO: 743088 - RNA, 62 nt, hsa; identical to SEQ ID NO: 253135

SEQ ID NO: 743089 - RNA, 62 nt, hsa; identical to SEQ ID NO: 253136

SEQ ID NO: 743090 - RNA, 62 nt, hsa; identical to SEQ ID NO: 253137

SEQ ID NO: 743091 - RNA, 62 nt, hsa; identical to SEQ ID NO: 253138

SEQ ID NO: 743092 - RNA, 62 nt, hsa; identical to SEQ ID NO: 253139

SEQ ID NO: 743093 - RNA, 62 nt, hsa; identical to SEQ ID NO: 253140

SEQ ID NO: 743094 - RNA, 62 nt, hsa; identical to SEQ ID NO: 253141

SEQ ID NO: 743095 - RNA, 62 nt, hsa; identical to SEQ ID NO: 253142

SEQ ID NO: 743096 - RNA, 62 nt, hsa; identical to SEQ ID NO: 253143

SEQ ID NO: 743097 - RNA, 62 nt, hsa; identical to SEQ ID NO: 253144

SEQ ID NO: 743098 - RNA, 62 nt, hsa; identical to SEQ ID NO: 253145

SEQ ID NO: 743099 - RNA, 58 nt, hsa; identical to SEQ ID NO: 102991

SEQ ID NO: 743100 - RNA, 62 nt, hsa; identical to SEQ ID NO: 253147

SEQ ID NO: 743101 - RNA, 62 nt, hsa; identical to SEQ ID NO: 253148

SEQ ID NO: 743102 - RNA, 62 nt, hsa; identical to SEQ ID NO: 253149

SEQ ID NO: 743103 - RNA, 62 nt, hsa; identical to SEQ ID NO: 253150

SEQ ID NO: 743104 - RNA, 62 nt, hsa; identical to SEQ ID NO: 253151

SEQ ID NO: 743105 - RNA, 62 nt, hsa; identical to SEQ ID NO: 253152

SEQ ID NO: 743106 - RNA, 62 nt, hsa; identical to SEQ ID NO: 253153

SEQ ID NO: 743107 - RNA, 62 nt, hsa; identical to SEQ ID NO: 253154

SEQ ID NO: 743108 - RNA, 62 nt, hsa; identical to SEQ ID NO: 253155

SEQ ID NO: 743109 - RNA, 62 nt, hsa; identical to SEQ ID NO: 253156

SEQ ID NO: 743110 - RNA, 62 nt, hsa; identical to SEQ ID NO: 253157

SEQ ID NO: 743111 - RNA, 62 nt, hsa; identical to SEQ ID NO: 253158

SEQ ID NO: 743112 - RNA, 62 nt, hsa; identical to SEQ ID NO: 253159

SEQ ID NO: 743113 - RNA, 62 nt, hsa; identical to SEQ ID NO: 253160

SEQ ID NO: 743114 - RNA, 62 nt, hsa; identical to SEQ ID NO: 253161

SEQ ID NO: 743115 - RNA, 62 nt, hsa; identical to SEQ ID NO: 253162

SEQ ID NO: 743116 - RNA, 62 nt, hsa; identical to SEQ ID NO: 253163

SEQ ID NO: 743117 - RNA, 62 nt, hsa; identical to SEQ ID NO: 253164

SEQ ID NO: 743118 - RNA, 62 nt, hsa; identical to SEQ ID NO: 253165

SEQ ID NO: 743119 - RNA, 62 nt, hsa; identical to SEQ ID NO: 253166

SEQ ID NO: 743120 - RNA, 62 nt, hsa; identical to SEQ ID NO: 253167

SEQ ID NO: 743121 - RNA, 62 nt, hsa; identical to SEQ ID NO: 253168

SEQ ID NO: 743122 - RNA, 53 nt, hsa; identical to SEQ ID NO: 103014

SEQ ID NO: 743123 - RNA, 62 nt, hsa; identical to SEQ ID NO: 253170

SEQ ID NO: 743124 - RNA, 62 nt, hsa; identical to SEQ ID NO: 253171

SEQ ID NO: 743125 - RNA, 62 nt, hsa; identical to SEQ ID NO: 253172

SEQ ID NO: 743126 - RNA, 62 nt, hsa; identical to SEQ ID NO: 253173

SEQ ID NO: 743127 - RNA, 62 nt, hsa; identical to SEQ ID NO: 253174

SEQ ID NO: 743128 - RNA, 62 nt, hsa; identical to SEQ ID NO: 253175

SEQ ID NO: 743129 - RNA, 62 nt, hsa; identical to SEQ ID NO: 253176

SEQ ID NO: 743130 - RNA, 62 nt, hsa; identical to SEQ ID NO: 253177

SEQ ID NO: 743131 - RNA, 62 nt, hsa; identical to SEQ ID NO: 253178

SEQ ID NO: 743132 - RNA, 62 nt, hsa; identical to SEQ ID NO: 253179

SEQ ID NO: 743133 - RNA, 62 nt, hsa; identical to SEQ ID NO: 253180

SEQ ID NO: 743134 - RNA, 62 nt, hsa; identical to SEQ ID NO: 253181

SEQ ID NO: 743135 - RNA, 62 nt, hsa; identical to SEQ ID NO: 253182

SEQ ID NO: 743136 - RNA, 62 nt, hsa; identical to SEQ ID NO: 253183

SEQ ID NO: 743137 - RNA, 62 nt, hsa; identical to SEQ ID NO: 253184

SEQ ID NO: 743138 - RNA, 62 nt, hsa; identical to SEQ ID NO: 253185

SEQ ID NO: 743139 - RNA, 62 nt, hsa; identical to SEQ ID NO: 253186

SEQ ID NO: 743140 - RNA, 62 nt, hsa; identical to SEQ ID NO: 253187

SEQ ID NO: 743141 - RNA, 62 nt, hsa; identical to SEQ ID NO: 253188

SEQ ID NO: 743142 - RNA, 62 nt, hsa; identical to SEQ ID NO: 253189

SEQ ID NO: 743143 - RNA, 62 nt, hsa; identical to SEQ ID NO: 253190

SEQ ID NO: 743144 - RNA, 62 nt, hsa; identical to SEQ ID NO: 253191

SEQ ID NO: 743145 - RNA, 62 nt, hsa; identical to SEQ ID NO: 253192

SEQ ID NO: 743146 - RNA, 62 nt, hsa; identical to SEQ ID NO: 253193

SEQ ID NO: 743147 - RNA, 62 nt, hsa; identical to SEQ ID NO: 253194

SEQ ID NO: 743148 - RNA, 62 nt, hsa; identical to SEQ ID NO: 253195

SEQ ID NO: 743149 - RNA, 62 nt, hsa; identical to SEQ ID NO: 253196

SEQ ID NO: 743150 - RNA, 62 nt, hsa; identical to SEQ ID NO: 253197

SEQ ID NO: 743151 - RNA, 62 nt, hsa; identical to SEQ ID NO: 253198

SEQ ID NO: 743152 - RNA, 62 nt, hsa; identical to SEQ ID NO: 253199

SEQ ID NO: 743153 - RNA, 62 nt, hsa; identical to SEQ ID NO: 253200

SEQ ID NO: 743154 - RNA, 62 nt, hsa; identical to SEQ ID NO: 253201

SEQ ID NO: 743155 - RNA, 62 nt, hsa; identical to SEQ ID NO: 253202

SEQ ID NO: 743156 - RNA, 62 nt, hsa; identical to SEQ ID NO: 253203

SEQ ID NO: 743157 - RNA, 62 nt, hsa; identical to SEQ ID NO: 253204

SEQ ID NO: 743158 - RNA, 62 nt, hsa; identical to SEQ ID NO: 253205

SEQ ID NO: 743159 - RNA, 62 nt, hsa; identical to SEQ ID NO: 253206

SEQ ID NO: 743160 - RNA, 62 nt, hsa; identical to SEQ ID NO: 253207

SEQ ID NO: 743161 - RNA, 62 nt, hsa; identical to SEQ ID NO: 253208

SEQ ID NO: 743162 - RNA, 62 nt, hsa; identical to SEQ ID NO: 253209

SEQ ID NO: 743163 - RNA, 62 nt, hsa; identical to SEQ ID NO: 253210

SEQ ID NO: 743164 - RNA, 62 nt, hsa; identical to SEQ ID NO: 253211

SEQ ID NO: 743165 - RNA, 62 nt, hsa; identical to SEQ ID NO: 253212

SEQ ID NO: 743166 - RNA, 62 nt, hsa; identical to SEQ ID NO: 253213

SEQ ID NO: 743167 - RNA, 62 nt, hsa; identical to SEQ ID NO: 253214

SEQ ID NO: 743168 - RNA, 62 nt, hsa; identical to SEQ ID NO: 253215

SEQ ID NO: 743169 - RNA, 62 nt, hsa; identical to SEQ ID NO: 253216

SEQ ID NO: 743170 - RNA, 62 nt, hsa; identical to SEQ ID NO: 253217

SEQ ID NO: 743171 - RNA, 62 nt, hsa; identical to SEQ ID NO: 253218

SEQ ID NO: 743172 - RNA, 62 nt, hsa; identical to SEQ ID NO: 253219

SEQ ID NO: 743173 - RNA, 62 nt, hsa; identical to SEQ ID NO: 253220

SEQ ID NO: 743174 - RNA, 62 nt, hsa; identical to SEQ ID NO: 253221

SEQ ID NO: 743175 - RNA, 62 nt, hsa; identical to SEQ ID NO: 253222

SEQ ID NO: 743176 - RNA, 62 nt, hsa; identical to SEQ ID NO: 253223

SEQ ID NO: 743177 - RNA, 62 nt, hsa; identical to SEQ ID NO: 253224

SEQ ID NO: 743178 - RNA, 62 nt, hsa; identical to SEQ ID NO: 253225

SEQ ID NO: 743179 - RNA, 62 nt, hsa; identical to SEQ ID NO: 253226

SEQ ID NO: 743180 - RNA, 62 nt, hsa; identical to SEQ ID NO: 253227

SEQ ID NO: 743181 - RNA, 62 nt, hsa; identical to SEQ ID NO: 253228

SEQ ID NO: 743182 - RNA, 62 nt, hsa; identical to SEQ ID NO: 253229

SEQ ID NO: 743183 - RNA, 62 nt, hsa; identical to SEQ ID NO: 253230

SEQ ID NO: 743184 - RNA, 62 nt, hsa; identical to SEQ ID NO: 253231

SEQ ID NO: 743185 - RNA, 62 nt, hsa; identical to SEQ ID NO: 253232

SEQ ID NO: 743186 - RNA, 62 nt, hsa; identical to SEQ ID NO: 253233

SEQ ID NO: 743187 - RNA, 62 nt, hsa; identical to SEQ ID NO: 253234

SEQ ID NO: 743188 - RNA, 62 nt, hsa; identical to SEQ ID NO: 253235

SEQ ID NO: 743189 - RNA, 62 nt, hsa; identical to SEQ ID NO: 253236

SEQ ID NO: 743190 - RNA, 62 nt, hsa; identical to SEQ ID NO: 253237

SEQ ID NO: 743191 - RNA, 62 nt, hsa; identical to SEQ ID NO: 253238

SEQ ID NO: 743192 - RNA, 62 nt, hsa; identical to SEQ ID NO: 253239

SEQ ID NO: 743193 - RNA, 62 nt, hsa; identical to SEQ ID NO: 253240

SEQ ID NO: 743194 - RNA, 62 nt, hsa; identical to SEQ ID NO: 253241

SEQ ID NO: 743195 - RNA, 62 nt, hsa; identical to SEQ ID NO: 253242

SEQ ID NO: 743196 - RNA, 62 nt, hsa; identical to SEQ ID NO: 253243

SEQ ID NO: 743197 - RNA, 62 nt, hsa; identical to SEQ ID NO: 253244

SEQ ID NO: 743198 - RNA, 62 nt, hsa; identical to SEQ ID NO: 253245

SEQ ID NO: 743199 - RNA, 62 nt, hsa; identical to SEQ ID NO: 253246

SEQ ID NO: 743200 - RNA, 62 nt, hsa; identical to SEQ ID NO: 253247

SEQ ID NO: 743201 - RNA, 62 nt, hsa; identical to SEQ ID NO: 253248

SEQ ID NO: 743202 - RNA, 62 nt, hsa; identical to SEQ ID NO: 253249

SEQ ID NO: 743203 - RNA, 62 nt, hsa; identical to SEQ ID NO: 253250

SEQ ID NO: 743204 - RNA, 62 nt, hsa; identical to SEQ ID NO: 253251

SEQ ID NO: 743205 - RNA, 62 nt, hsa; identical to SEQ ID NO: 253252

SEQ ID NO: 743206 - RNA, 60 nt, hsa; identical to SEQ ID NO: 103098

SEQ ID NO: 743207 - RNA, 62 nt, hsa; identical to SEQ ID NO: 253254

SEQ ID NO: 743208 - RNA, 62 nt, hsa; identical to SEQ ID NO: 253255

SEQ ID NO: 743209 - RNA, 62 nt, hsa; identical to SEQ ID NO: 253256

SEQ ID NO: 743210 - RNA, 62 nt, hsa; identical to SEQ ID NO: 253257

SEQ ID NO: 743211 - RNA, 62 nt, hsa; identical to SEQ ID NO: 253258

SEQ ID NO: 743212 - RNA, 62 nt, hsa; identical to SEQ ID NO: 253259

SEQ ID NO: 743213 - RNA, 62 nt, hsa; identical to SEQ ID NO: 253260

SEQ ID NO: 743214 - RNA, 62 nt, hsa; identical to SEQ ID NO: 253261

SEQ ID NO: 743215 - RNA, 62 nt, hsa; identical to SEQ ID NO: 253262

SEQ ID NO: 743216 - RNA, 62 nt, hsa; identical to SEQ ID NO: 253263

SEQ ID NO: 743217 - RNA, 62 nt, hsa; identical to SEQ ID NO: 253264

SEQ ID NO: 743218 - RNA, 62 nt, hsa; identical to SEQ ID NO: 253265

SEQ ID NO: 743219 - RNA, 62 nt, hsa; identical to SEQ ID NO: 253266

SEQ ID NO: 743220 - RNA, 62 nt, hsa; identical to SEQ ID NO: 253267

SEQ ID NO: 743221 - RNA, 62 nt, hsa; identical to SEQ ID NO: 253268

SEQ ID NO: 743222 - RNA, 62 nt, hsa; identical to SEQ ID NO: 253269

SEQ ID NO: 743223 - RNA, 62 nt, hsa; identical to SEQ ID NO: 253270

SEQ ID NO: 743224 - RNA, 62 nt, hsa; identical to SEQ ID NO: 253271

SEQ ID NO: 743225 - RNA, 62 nt, hsa; identical to SEQ ID NO: 253272

SEQ ID NO: 743226 - RNA, 62 nt, hsa; identical to SEQ ID NO: 253273

SEQ ID NO: 743227 - RNA, 62 nt, hsa; identical to SEQ ID NO: 253274

SEQ ID NO: 743228 - RNA, 62 nt, hsa; identical to SEQ ID NO: 253275

SEQ ID NO: 743229 - RNA, 62 nt, hsa; identical to SEQ ID NO: 253276

SEQ ID NO: 743230 - RNA, 62 nt, hsa; identical to SEQ ID NO: 253277

SEQ ID NO: 743231 - RNA, 62 nt, hsa; identical to SEQ ID NO: 253278

SEQ ID NO: 743232 - RNA, 62 nt, hsa; identical to SEQ ID NO: 253279

SEQ ID NO: 743233 - RNA, 62 nt, hsa; identical to SEQ ID NO: 253280

SEQ ID NO: 743234 - RNA, 62 nt, hsa; identical to SEQ ID NO: 253281

SEQ ID NO: 743235 - RNA, 62 nt, hsa; identical to SEQ ID NO: 253282

SEQ ID NO: 743236 - RNA, 62 nt, hsa; identical to SEQ ID NO: 253283

SEQ ID NO: 743237 - RNA, 62 nt, hsa; identical to SEQ ID NO: 253284

SEQ ID NO: 743238 - RNA, 62 nt, hsa; identical to SEQ ID NO: 253285

SEQ ID NO: 743239 - RNA, 62 nt, hsa; identical to SEQ ID NO: 253286

SEQ ID NO: 743240 - RNA, 62 nt, hsa; identical to SEQ ID NO: 253287

SEQ ID NO: 743241 - RNA, 62 nt, hsa; identical to SEQ ID NO: 253288

SEQ ID NO: 743242 - RNA, 62 nt, hsa; identical to SEQ ID NO: 253289

SEQ ID NO: 743243 - RNA, 62 nt, hsa; identical to SEQ ID NO: 253290

SEQ ID NO: 743244 - RNA, 62 nt, hsa; identical to SEQ ID NO: 253291

SEQ ID NO: 743245 - RNA, 62 nt, hsa; identical to SEQ ID NO: 253292

SEQ ID NO: 743246 - RNA, 62 nt, hsa; identical to SEQ ID NO: 253293

SEQ ID NO: 743247 - RNA, 62 nt, hsa; identical to SEQ ID NO: 253294

SEQ ID NO: 743248 - RNA, 62 nt, hsa; identical to SEQ ID NO: 253295

SEQ ID NO: 743249 - RNA, 62 nt, hsa; identical to SEQ ID NO: 253296

SEQ ID NO: 743250 - RNA, 62 nt, hsa; identical to SEQ ID NO: 253297

SEQ ID NO: 743251 - RNA, 62 nt, hsa; identical to SEQ ID NO: 253298

SEQ ID NO: 743252 - RNA, 62 nt, hsa; identical to SEQ ID NO: 253299

SEQ ID NO: 743253 - RNA, 62 nt, hsa; identical to SEQ ID NO: 253300

SEQ ID NO: 743254 - RNA, 62 nt, hsa; identical to SEQ ID NO: 253301

SEQ ID NO: 743255 - RNA, 62 nt, hsa; identical to SEQ ID NO: 253302

SEQ ID NO: 743256 - RNA, 62 nt, hsa; identical to SEQ ID NO: 253303

SEQ ID NO: 743257 - RNA, 62 nt, hsa; identical to SEQ ID NO: 253304

SEQ ID NO: 743258 - RNA, 62 nt, hsa; identical to SEQ ID NO: 253305

SEQ ID NO: 743259 - RNA, 62 nt, hsa; identical to SEQ ID NO: 253306

SEQ ID NO: 743260 - RNA, 62 nt, hsa; identical to SEQ ID NO: 253307

SEQ ID NO: 743261 - RNA, 62 nt, hsa; identical to SEQ ID NO: 253308

SEQ ID NO: 743262 - RNA, 62 nt, hsa; identical to SEQ ID NO: 253309

SEQ ID NO: 743263 - RNA, 62 nt, hsa; identical to SEQ ID NO: 253310

SEQ ID NO: 743264 - RNA, 62 nt, hsa; identical to SEQ ID NO: 253311

SEQ ID NO: 743265 - RNA, 62 nt, hsa; identical to SEQ ID NO: 253312

SEQ ID NO: 743266 - RNA, 62 nt, hsa; identical to SEQ ID NO: 253313

SEQ ID NO: 743267 - RNA, 62 nt, hsa; identical to SEQ ID NO: 253314

SEQ ID NO: 743268 - RNA, 62 nt, hsa; identical to SEQ ID NO: 253315

SEQ ID NO: 743269 - RNA, 62 nt, hsa; identical to SEQ ID NO: 253316

SEQ ID NO: 743270 - RNA, 62 nt, hsa; identical to SEQ ID NO: 253317

SEQ ID NO: 743271 - RNA, 62 nt, hsa; identical to SEQ ID NO: 253318

SEQ ID NO: 743272 - RNA, 62 nt, hsa; identical to SEQ ID NO: 253319

SEQ ID NO: 743273 - RNA, 62 nt, hsa; identical to SEQ ID NO: 253320

SEQ ID NO: 743274 - RNA, 62 nt, hsa; identical to SEQ ID NO: 253321

SEQ ID NO: 743275 - RNA, 62 nt, hsa; identical to SEQ ID NO: 253322

SEQ ID NO: 743276 - RNA, 62 nt, hsa; identical to SEQ ID NO: 253323

SEQ ID NO: 743277 - RNA, 62 nt, hsa; identical to SEQ ID NO: 253324

SEQ ID NO: 743278 - RNA, 62 nt, hsa; identical to SEQ ID NO: 253325

SEQ ID NO: 743279 - RNA, 62 nt, hsa; identical to SEQ ID NO: 253326

SEQ ID NO: 743280 - RNA, 62 nt, hsa; identical to SEQ ID NO: 253327

SEQ ID NO: 743281 - RNA, 62 nt, hsa; identical to SEQ ID NO: 253328

SEQ ID NO: 743282 - RNA, 62 nt, hsa; identical to SEQ ID NO: 253329

SEQ ID NO: 743283 - RNA, 62 nt, hsa; identical to SEQ ID NO: 253330

SEQ ID NO: 743284 - RNA, 62 nt, hsa; identical to SEQ ID NO: 253331

SEQ ID NO: 743285 - RNA, 62 nt, hsa; identical to SEQ ID NO: 253332

SEQ ID NO: 743286 - RNA, 62 nt, hsa; identical to SEQ ID NO: 253333

SEQ ID NO: 743287 - RNA, 62 nt, hsa; identical to SEQ ID NO: 253334

SEQ ID NO: 743288 - RNA, 62 nt, hsa; identical to SEQ ID NO: 253335

SEQ ID NO: 743289 - RNA, 62 nt, hsa; identical to SEQ ID NO: 253336

SEQ ID NO: 743290 - RNA, 62 nt, hsa; identical to SEQ ID NO: 253337

SEQ ID NO: 743291 - RNA, 62 nt, hsa; identical to SEQ ID NO: 253338

SEQ ID NO: 743292 - RNA, 62 nt, hsa; identical to SEQ ID NO: 253339

SEQ ID NO: 743293 - RNA, 62 nt, hsa; identical to SEQ ID NO: 253340

SEQ ID NO: 743294 - RNA, 62 nt, hsa; identical to SEQ ID NO: 253341

SEQ ID NO: 743295 - RNA, 62 nt, hsa; identical to SEQ ID NO: 253342

SEQ ID NO: 743296 - RNA, 62 nt, hsa; identical to SEQ ID NO: 253343

SEQ ID NO: 743297 - RNA, 62 nt, hsa; identical to SEQ ID NO: 253344

SEQ ID NO: 743298 - RNA, 62 nt, hsa; identical to SEQ ID NO: 253345

SEQ ID NO: 743299 - RNA, 62 nt, hsa; identical to SEQ ID NO: 253346

SEQ ID NO: 743300 - RNA, 62 nt, hsa; identical to SEQ ID NO: 253347

SEQ ID NO: 743301 - RNA, 62 nt, hsa; identical to SEQ ID NO: 253348

SEQ ID NO: 743302 - RNA, 62 nt, hsa; identical to SEQ ID NO: 253349

SEQ ID NO: 743303 - RNA, 62 nt, hsa; identical to SEQ ID NO: 253350

SEQ ID NO: 743304 - RNA, 51 nt, hsa; identical to SEQ ID NO: 103196

SEQ ID NO: 743305 - RNA, 62 nt, hsa; identical to SEQ ID NO: 253352

SEQ ID NO: 743306 - RNA, 62 nt, hsa; identical to SEQ ID NO: 253353

SEQ ID NO: 743307 - RNA, 62 nt, hsa; identical to SEQ ID NO: 253354

SEQ ID NO: 743308 - RNA, 62 nt, hsa; identical to SEQ ID NO: 253355

SEQ ID NO: 743309 - RNA, 62 nt, hsa; identical to SEQ ID NO: 253356

SEQ ID NO: 743310 - RNA, 62 nt, hsa; identical to SEQ ID NO: 253357

SEQ ID NO: 743311 - RNA, 62 nt, hsa; identical to SEQ ID NO: 253358

SEQ ID NO: 743312 - RNA, 62 nt, hsa; identical to SEQ ID NO: 253359

SEQ ID NO: 743313 - RNA, 62 nt, hsa; identical to SEQ ID NO: 253360

SEQ ID NO: 743314 - RNA, 62 nt, hsa; identical to SEQ ID NO: 253361

SEQ ID NO: 743315 - RNA, 62 nt, hsa; identical to SEQ ID NO: 253362

SEQ ID NO: 743316 - RNA, 62 nt, hsa; identical to SEQ ID NO: 253363

SEQ ID NO: 743317 - RNA, 62 nt, hsa; identical to SEQ ID NO: 253364

SEQ ID NO: 743318 - RNA, 62 nt, hsa; identical to SEQ ID NO: 253365

SEQ ID NO: 743319 - RNA, 62 nt, hsa; identical to SEQ ID NO: 253366

SEQ ID NO: 743320 - RNA, 62 nt, hsa; identical to SEQ ID NO: 253367

SEQ ID NO: 743321 - RNA, 62 nt, hsa; identical to SEQ ID NO: 253368

SEQ ID NO: 743322 - RNA, 62 nt, hsa; identical to SEQ ID NO: 253369

SEQ ID NO: 743323 - RNA, 62 nt, hsa; identical to SEQ ID NO: 253370

SEQ ID NO: 743324 - RNA, 62 nt, hsa; identical to SEQ ID NO: 253371

SEQ ID NO: 743325 - RNA, 62 nt, hsa; identical to SEQ ID NO: 253372

SEQ ID NO: 743326 - RNA, 62 nt, hsa; identical to SEQ ID NO: 253373

SEQ ID NO: 743327 - RNA, 62 nt, hsa; identical to SEQ ID NO: 253374

SEQ ID NO: 743328 - RNA, 62 nt, hsa; identical to SEQ ID NO: 253375

SEQ ID NO: 743329 - RNA, 62 nt, hsa; identical to SEQ ID NO: 253376

SEQ ID NO: 743330 - RNA, 62 nt, hsa; identical to SEQ ID NO: 253377

SEQ ID NO: 743331 - RNA, 62 nt, hsa; identical to SEQ ID NO: 253378

SEQ ID NO: 743332 - RNA, 62 nt, hsa; identical to SEQ ID NO: 253379

SEQ ID NO: 743333 - RNA, 62 nt, hsa; identical to SEQ ID NO: 253380

SEQ ID NO: 743334 - RNA, 62 nt, hsa; identical to SEQ ID NO: 253381

SEQ ID NO: 743335 - RNA, 62 nt, hsa; identical to SEQ ID NO: 253382

SEQ ID NO: 743336 - RNA, 62 nt, hsa; identical to SEQ ID NO: 253383

SEQ ID NO: 743337 - RNA, 62 nt, hsa; identical to SEQ ID NO: 253384

SEQ ID NO: 743338 - RNA, 62 nt, hsa; identical to SEQ ID NO: 253385

SEQ ID NO: 743339 - RNA, 62 nt, hsa; identical to SEQ ID NO: 253386

SEQ ID NO: 743340 - RNA, 62 nt, hsa; identical to SEQ ID NO: 253387

SEQ ID NO: 743341 - RNA, 62 nt, hsa; identical to SEQ ID NO: 253388

SEQ ID NO: 743342 - RNA, 62 nt, hsa; identical to SEQ ID NO: 253389

SEQ ID NO: 743343 - RNA, 62 nt, hsa; identical to SEQ ID NO: 253390

SEQ ID NO: 743344 - RNA, 62 nt, hsa; identical to SEQ ID NO: 253391

SEQ ID NO: 743345 - RNA, 62 nt, hsa; identical to SEQ ID NO: 253392

SEQ ID NO: 743346 - RNA, 62 nt, hsa; identical to SEQ ID NO: 253393

SEQ ID NO: 743347 - RNA, 62 nt, hsa; identical to SEQ ID NO: 253394

SEQ ID NO: 743348 - RNA, 62 nt, hsa; identical to SEQ ID NO: 253395

SEQ ID NO: 743349 - RNA, 62 nt, hsa; identical to SEQ ID NO: 253396

SEQ ID NO: 743350 - RNA, 62 nt, hsa; identical to SEQ ID NO: 253397

SEQ ID NO: 743351 - RNA, 62 nt, hsa; identical to SEQ ID NO: 253398

SEQ ID NO: 743352 - RNA, 62 nt, hsa; identical to SEQ ID NO: 253399

SEQ ID NO: 743353 - RNA, 62 nt, hsa; identical to SEQ ID NO: 253400

SEQ ID NO: 743354 - RNA, 62 nt, hsa; identical to SEQ ID NO: 253401

SEQ ID NO: 743355 - RNA, 62 nt, hsa; identical to SEQ ID NO: 253402

SEQ ID NO: 743356 - RNA, 62 nt, hsa; identical to SEQ ID NO: 253403

SEQ ID NO: 743357 - RNA, 62 nt, hsa; identical to SEQ ID NO: 253404

SEQ ID NO: 743358 - RNA, 62 nt, hsa; identical to SEQ ID NO: 253405

SEQ ID NO: 743359 - RNA, 62 nt, hsa; identical to SEQ ID NO: 253406

SEQ ID NO: 743360 - RNA, 62 nt, hsa; identical to SEQ ID NO: 253407

SEQ ID NO: 743361 - RNA, 62 nt, hsa; identical to SEQ ID NO: 253408

SEQ ID NO: 743362 - RNA, 62 nt, hsa; identical to SEQ ID NO: 253409

SEQ ID NO: 743363 - RNA, 62 nt, hsa; identical to SEQ ID NO: 253410

SEQ ID NO: 743364 - RNA, 62 nt, hsa; identical to SEQ ID NO: 253411

SEQ ID NO: 743365 - RNA, 62 nt, hsa; identical to SEQ ID NO: 253412

SEQ ID NO: 743366 - RNA, 62 nt, hsa; identical to SEQ ID NO: 253413

SEQ ID NO: 743367 - RNA, 62 nt, hsa; identical to SEQ ID NO: 253414

SEQ ID NO: 743368 - RNA, 62 nt, hsa; identical to SEQ ID NO: 253415

SEQ ID NO: 743369 - RNA, 62 nt, hsa; identical to SEQ ID NO: 253416

SEQ ID NO: 743370 - RNA, 62 nt, hsa; identical to SEQ ID NO: 253417

SEQ ID NO: 743371 - RNA, 62 nt, hsa; identical to SEQ ID NO: 253418

SEQ ID NO: 743372 - RNA, 62 nt, hsa; identical to SEQ ID NO: 253419

SEQ ID NO: 743373 - RNA, 62 nt, hsa; identical to SEQ ID NO: 253420

SEQ ID NO: 743374 - RNA, 62 nt, hsa; identical to SEQ ID NO: 253421

SEQ ID NO: 743375 - RNA, 62 nt, hsa; identical to SEQ ID NO: 253422

SEQ ID NO: 743376 - RNA, 62 nt, hsa; identical to SEQ ID NO: 253423

SEQ ID NO: 743377 - RNA, 62 nt, hsa; identical to SEQ ID NO: 253424

SEQ ID NO: 743378 - RNA, 62 nt, hsa; identical to SEQ ID NO: 253425

SEQ ID NO: 743379 - RNA, 62 nt, hsa; identical to SEQ ID NO: 253426

SEQ ID NO: 743380 - RNA, 62 nt, hsa; identical to SEQ ID NO: 253427

SEQ ID NO: 743381 - RNA, 62 nt, hsa; identical to SEQ ID NO: 253428

SEQ ID NO: 743382 - RNA, 62 nt, hsa; identical to SEQ ID NO: 253429

SEQ ID NO: 743383 - RNA, 62 nt, hsa; identical to SEQ ID NO: 253430

SEQ ID NO: 743384 - RNA, 62 nt, hsa; identical to SEQ ID NO: 253431

SEQ ID NO: 743385 - RNA, 62 nt, hsa; identical to SEQ ID NO: 253432

SEQ ID NO: 743386 - RNA, 62 nt, hsa; identical to SEQ ID NO: 253433

SEQ ID NO: 743387 - RNA, 62 nt, hsa; identical to SEQ ID NO: 253434

SEQ ID NO: 743388 - RNA, 62 nt, hsa; identical to SEQ ID NO: 253435

SEQ ID NO: 743389 - RNA, 62 nt, hsa; identical to SEQ ID NO: 253436

SEQ ID NO: 743390 - RNA, 62 nt, hsa; identical to SEQ ID NO: 253437

SEQ ID NO: 743391 - RNA, 62 nt, hsa; identical to SEQ ID NO: 253438

SEQ ID NO: 743392 - RNA, 62 nt, hsa; identical to SEQ ID NO: 253439

SEQ ID NO: 743393 - RNA, 62 nt, hsa; identical to SEQ ID NO: 253440

SEQ ID NO: 743394 - RNA, 62 nt, hsa; identical to SEQ ID NO: 253441

SEQ ID NO: 743395 - RNA, 62 nt, hsa; identical to SEQ ID NO: 253442

SEQ ID NO: 743396 - RNA, 62 nt, hsa; identical to SEQ ID NO: 253443

SEQ ID NO: 743397 - RNA, 66 nt, hsa; identical to SEQ ID NO: 253444

SEQ ID NO: 743398 - RNA, 66 nt, hsa; identical to SEQ ID NO: 253445

SEQ ID NO: 743399 - RNA, 66 nt, hsa; identical to SEQ ID NO: 253446

SEQ ID NO: 743400 - RNA, 66 nt, hsa; identical to SEQ ID NO: 253447

SEQ ID NO: 743401 - RNA, 66 nt, hsa; identical to SEQ ID NO: 253448

SEQ ID NO: 743402 - RNA, 66 nt, hsa; identical to SEQ ID NO: 253449

SEQ ID NO: 743403 - RNA, 66 nt, hsa; identical to SEQ ID NO: 253450

SEQ ID NO: 743404 - RNA, 66 nt, hsa; identical to SEQ ID NO: 253451

SEQ ID NO: 743405 - RNA, 66 nt, hsa; identical to SEQ ID NO: 253452

SEQ ID NO: 743406 - RNA, 66 nt, hsa; identical to SEQ ID NO: 253453

SEQ ID NO: 743407 - RNA, 66 nt, hsa; identical to SEQ ID NO: 253454

SEQ ID NO: 743408 - RNA, 58 nt, hsa; identical to SEQ ID NO: 102991

SEQ ID NO: 743409 - RNA, 66 nt, hsa; identical to SEQ ID NO: 253456

SEQ ID NO: 743410 - RNA, 66 nt, hsa; identical to SEQ ID NO: 253457

SEQ ID NO: 743411 - RNA, 66 nt, hsa; identical to SEQ ID NO: 253458

SEQ ID NO: 743412 - RNA, 66 nt, hsa; identical to SEQ ID NO: 253459

SEQ ID NO: 743413 - RNA, 66 nt, hsa; identical to SEQ ID NO: 253460

SEQ ID NO: 743414 - RNA, 66 nt, hsa; identical to SEQ ID NO: 253461

SEQ ID NO: 743415 - RNA, 66 nt, hsa; identical to SEQ ID NO: 253462

SEQ ID NO: 743416 - RNA, 66 nt, hsa; identical to SEQ ID NO: 253463

SEQ ID NO: 743417 - RNA, 66 nt, hsa; identical to SEQ ID NO: 253464

SEQ ID NO: 743418 - RNA, 66 nt, hsa; identical to SEQ ID NO: 253465

SEQ ID NO: 743419 - RNA, 66 nt, hsa; identical to SEQ ID NO: 253466

SEQ ID NO: 743420 - RNA, 66 nt, hsa; identical to SEQ ID NO: 253467

SEQ ID NO: 743421 - RNA, 66 nt, hsa; identical to SEQ ID NO: 253468

SEQ ID NO: 743422 - RNA, 66 nt, hsa; identical to SEQ ID NO: 253469

SEQ ID NO: 743423 - RNA, 66 nt, hsa; identical to SEQ ID NO: 253470

SEQ ID NO: 743424 - RNA, 66 nt, hsa; identical to SEQ ID NO: 253471

SEQ ID NO: 743425 - RNA, 66 nt, hsa; identical to SEQ ID NO: 253472

SEQ ID NO: 743426 - RNA, 66 nt, hsa; identical to SEQ ID NO: 253473

SEQ ID NO: 743427 - RNA, 66 nt, hsa; identical to SEQ ID NO: 253474

SEQ ID NO: 743428 - RNA, 66 nt, hsa; identical to SEQ ID NO: 253475

SEQ ID NO: 743429 - RNA, 66 nt, hsa; identical to SEQ ID NO: 253476

SEQ ID NO: 743430 - RNA, 66 nt, hsa; identical to SEQ ID NO: 253477

SEQ ID NO: 743431 - RNA, 53 nt, hsa; identical to SEQ ID NO: 103014

SEQ ID NO: 743432 - RNA, 66 nt, hsa; identical to SEQ ID NO: 253479

SEQ ID NO: 743433 - RNA, 66 nt, hsa; identical to SEQ ID NO: 253480

SEQ ID NO: 743434 - RNA, 66 nt, hsa; identical to SEQ ID NO: 253481

SEQ ID NO: 743435 - RNA, 66 nt, hsa; identical to SEQ ID NO: 253482

SEQ ID NO: 743436 - RNA, 66 nt, hsa; identical to SEQ ID NO: 253483

SEQ ID NO: 743437 - RNA, 66 nt, hsa; identical to SEQ ID NO: 253484

SEQ ID NO: 743438 - RNA, 66 nt, hsa; identical to SEQ ID NO: 253485

SEQ ID NO: 743439 - RNA, 66 nt, hsa; identical to SEQ ID NO: 253486

SEQ ID NO: 743440 - RNA, 66 nt, hsa; identical to SEQ ID NO: 253487

SEQ ID NO: 743441 - RNA, 66 nt, hsa; identical to SEQ ID NO: 253488

SEQ ID NO: 743442 - RNA, 66 nt, hsa; identical to SEQ ID NO: 253489

SEQ ID NO: 743443 - RNA, 66 nt, hsa; identical to SEQ ID NO: 253490

SEQ ID NO: 743444 - RNA, 66 nt, hsa; identical to SEQ ID NO: 253491

SEQ ID NO: 743445 - RNA, 66 nt, hsa; identical to SEQ ID NO: 253492

SEQ ID NO: 743446 - RNA, 66 nt, hsa; identical to SEQ ID NO: 253493

SEQ ID NO: 743447 - RNA, 66 nt, hsa; identical to SEQ ID NO: 253494

SEQ ID NO: 743448 - RNA, 66 nt, hsa; identical to SEQ ID NO: 253495

SEQ ID NO: 743449 - RNA, 66 nt, hsa; identical to SEQ ID NO: 253496

SEQ ID NO: 743450 - RNA, 66 nt, hsa; identical to SEQ ID NO: 253497

SEQ ID NO: 743451 - RNA, 66 nt, hsa; identical to SEQ ID NO: 253498

SEQ ID NO: 743452 - RNA, 66 nt, hsa; identical to SEQ ID NO: 253499

SEQ ID NO: 743453 - RNA, 66 nt, hsa; identical to SEQ ID NO: 253500

SEQ ID NO: 743454 - RNA, 66 nt, hsa; identical to SEQ ID NO: 253501

SEQ ID NO: 743455 - RNA, 66 nt, hsa; identical to SEQ ID NO: 253502

SEQ ID NO: 743456 - RNA, 66 nt, hsa; identical to SEQ ID NO: 253503

SEQ ID NO: 743457 - RNA, 66 nt, hsa; identical to SEQ ID NO: 253504

SEQ ID NO: 743458 - RNA, 66 nt, hsa; identical to SEQ ID NO: 253505

SEQ ID NO: 743459 - RNA, 66 nt, hsa; identical to SEQ ID NO: 253506

SEQ ID NO: 743460 - RNA, 66 nt, hsa; identical to SEQ ID NO: 253507

SEQ ID NO: 743461 - RNA, 66 nt, hsa; identical to SEQ ID NO: 253508

SEQ ID NO: 743462 - RNA, 66 nt, hsa; identical to SEQ ID NO: 253509

SEQ ID NO: 743463 - RNA, 66 nt, hsa; identical to SEQ ID NO: 253510

SEQ ID NO: 743464 - RNA, 66 nt, hsa; identical to SEQ ID NO: 253511

SEQ ID NO: 743465 - RNA, 66 nt, hsa; identical to SEQ ID NO: 253512

SEQ ID NO: 743466 - RNA, 66 nt, hsa; identical to SEQ ID NO: 253513

SEQ ID NO: 743467 - RNA, 66 nt, hsa; identical to SEQ ID NO: 253514

SEQ ID NO: 743468 - RNA, 66 nt, hsa; identical to SEQ ID NO: 253515

SEQ ID NO: 743469 - RNA, 66 nt, hsa; identical to SEQ ID NO: 253516

SEQ ID NO: 743470 - RNA, 66 nt, hsa; identical to SEQ ID NO: 253517

SEQ ID NO: 743471 - RNA, 66 nt, hsa; identical to SEQ ID NO: 253518

SEQ ID NO: 743472 - RNA, 66 nt, hsa; identical to SEQ ID NO: 253519

SEQ ID NO: 743473 - RNA, 66 nt, hsa; identical to SEQ ID NO: 253520

SEQ ID NO: 743474 - RNA, 66 nt, hsa; identical to SEQ ID NO: 253521

SEQ ID NO: 743475 - RNA, 66 nt, hsa; identical to SEQ ID NO: 253522

SEQ ID NO: 743476 - RNA, 66 nt, hsa; identical to SEQ ID NO: 253523

SEQ ID NO: 743477 - RNA, 66 nt, hsa; identical to SEQ ID NO: 253524

SEQ ID NO: 743478 - RNA, 66 nt, hsa; identical to SEQ ID NO: 253525

SEQ ID NO: 743479 - RNA, 66 nt, hsa; identical to SEQ ID NO: 253526

SEQ ID NO: 743480 - RNA, 66 nt, hsa; identical to SEQ ID NO: 253527

SEQ ID NO: 743481 - RNA, 66 nt, hsa; identical to SEQ ID NO: 253528

SEQ ID NO: 743482 - RNA, 66 nt, hsa; identical to SEQ ID NO: 253529

SEQ ID NO: 743483 - RNA, 66 nt, hsa; identical to SEQ ID NO: 253530

SEQ ID NO: 743484 - RNA, 66 nt, hsa; identical to SEQ ID NO: 253531

SEQ ID NO: 743485 - RNA, 66 nt, hsa; identical to SEQ ID NO: 253532

SEQ ID NO: 743486 - RNA, 66 nt, hsa; identical to SEQ ID NO: 253533

SEQ ID NO: 743487 - RNA, 66 nt, hsa; identical to SEQ ID NO: 253534

SEQ ID NO: 743488 - RNA, 66 nt, hsa; identical to SEQ ID NO: 253535

SEQ ID NO: 743489 - RNA, 66 nt, hsa; identical to SEQ ID NO: 253536

SEQ ID NO: 743490 - RNA, 66 nt, hsa; identical to SEQ ID NO: 253537

SEQ ID NO: 743491 - RNA, 66 nt, hsa; identical to SEQ ID NO: 253538

SEQ ID NO: 743492 - RNA, 66 nt, hsa; identical to SEQ ID NO: 253539

SEQ ID NO: 743493 - RNA, 66 nt, hsa; identical to SEQ ID NO: 253540

SEQ ID NO: 743494 - RNA, 66 nt, hsa; identical to SEQ ID NO: 253541

SEQ ID NO: 743495 - RNA, 66 nt, hsa; identical to SEQ ID NO: 253542

SEQ ID NO: 743496 - RNA, 66 nt, hsa; identical to SEQ ID NO: 253543

SEQ ID NO: 743497 - RNA, 66 nt, hsa; identical to SEQ ID NO: 253544

SEQ ID NO: 743498 - RNA, 66 nt, hsa; identical to SEQ ID NO: 253545

SEQ ID NO: 743499 - RNA, 66 nt, hsa; identical to SEQ ID NO: 253546

SEQ ID NO: 743500 - RNA, 66 nt, hsa; identical to SEQ ID NO: 253547

SEQ ID NO: 743501 - RNA, 66 nt, hsa; identical to SEQ ID NO: 253548

SEQ ID NO: 743502 - RNA, 66 nt, hsa; identical to SEQ ID NO: 253549

SEQ ID NO: 743503 - RNA, 66 nt, hsa; identical to SEQ ID NO: 253550

SEQ ID NO: 743504 - RNA, 66 nt, hsa; identical to SEQ ID NO: 253551

SEQ ID NO: 743505 - RNA, 66 nt, hsa; identical to SEQ ID NO: 253552

SEQ ID NO: 743506 - RNA, 66 nt, hsa; identical to SEQ ID NO: 253553

SEQ ID NO: 743507 - RNA, 66 nt, hsa; identical to SEQ ID NO: 253554

SEQ ID NO: 743508 - RNA, 66 nt, hsa; identical to SEQ ID NO: 253555

SEQ ID NO: 743509 - RNA, 66 nt, hsa; identical to SEQ ID NO: 253556

SEQ ID NO: 743510 - RNA, 66 nt, hsa; identical to SEQ ID NO: 253557

SEQ ID NO: 743511 - RNA, 66 nt, hsa; identical to SEQ ID NO: 253558

SEQ ID NO: 743512 - RNA, 66 nt, hsa; identical to SEQ ID NO: 253559

SEQ ID NO: 743513 - RNA, 66 nt, hsa; identical to SEQ ID NO: 253560

SEQ ID NO: 743514 - RNA, 66 nt, hsa; identical to SEQ ID NO: 253561

SEQ ID NO: 743515 - RNA, 60 nt, hsa; identical to SEQ ID NO: 103098

SEQ ID NO: 743516 - RNA, 66 nt, hsa; identical to SEQ ID NO: 253563

SEQ ID NO: 743517 - RNA, 66 nt, hsa; identical to SEQ ID NO: 253564

SEQ ID NO: 743518 - RNA, 66 nt, hsa; identical to SEQ ID NO: 253565

SEQ ID NO: 743519 - RNA, 66 nt, hsa; identical to SEQ ID NO: 253566

SEQ ID NO: 743520 - RNA, 66 nt, hsa; identical to SEQ ID NO: 253567

SEQ ID NO: 743521 - RNA, 66 nt, hsa; identical to SEQ ID NO: 253568

SEQ ID NO: 743522 - RNA, 66 nt, hsa; identical to SEQ ID NO: 253569

SEQ ID NO: 743523 - RNA, 66 nt, hsa; identical to SEQ ID NO: 253570

SEQ ID NO: 743524 - RNA, 66 nt, hsa; identical to SEQ ID NO: 253571

SEQ ID NO: 743525 - RNA, 66 nt, hsa; identical to SEQ ID NO: 253572

SEQ ID NO: 743526 - RNA, 66 nt, hsa; identical to SEQ ID NO: 253573

SEQ ID NO: 743527 - RNA, 66 nt, hsa; identical to SEQ ID NO: 253574

SEQ ID NO: 743528 - RNA, 66 nt, hsa; identical to SEQ ID NO: 253575

SEQ ID NO: 743529 - RNA, 66 nt, hsa; identical to SEQ ID NO: 253576

SEQ ID NO: 743530 - RNA, 66 nt, hsa; identical to SEQ ID NO: 253577

SEQ ID NO: 743531 - RNA, 66 nt, hsa; identical to SEQ ID NO: 253578

SEQ ID NO: 743532 - RNA, 66 nt, hsa; identical to SEQ ID NO: 253579

SEQ ID NO: 743533 - RNA, 66 nt, hsa; identical to SEQ ID NO: 253580

SEQ ID NO: 743534 - RNA, 66 nt, hsa; identical to SEQ ID NO: 253581

SEQ ID NO: 743535 - RNA, 66 nt, hsa; identical to SEQ ID NO: 253582

SEQ ID NO: 743536 - RNA, 66 nt, hsa; identical to SEQ ID NO: 253583

SEQ ID NO: 743537 - RNA, 66 nt, hsa; identical to SEQ ID NO: 253584

SEQ ID NO: 743538 - RNA, 66 nt, hsa; identical to SEQ ID NO: 253585

SEQ ID NO: 743539 - RNA, 66 nt, hsa; identical to SEQ ID NO: 253586

SEQ ID NO: 743540 - RNA, 66 nt, hsa; identical to SEQ ID NO: 253587

SEQ ID NO: 743541 - RNA, 66 nt, hsa; identical to SEQ ID NO: 253588

SEQ ID NO: 743542 - RNA, 66 nt, hsa; identical to SEQ ID NO: 253589

SEQ ID NO: 743543 - RNA, 66 nt, hsa; identical to SEQ ID NO: 253590

SEQ ID NO: 743544 - RNA, 66 nt, hsa; identical to SEQ ID NO: 253591

SEQ ID NO: 743545 - RNA, 66 nt, hsa; identical to SEQ ID NO: 253592

SEQ ID NO: 743546 - RNA, 66 nt, hsa; identical to SEQ ID NO: 253593

SEQ ID NO: 743547 - RNA, 66 nt, hsa; identical to SEQ ID NO: 253594

SEQ ID NO: 743548 - RNA, 66 nt, hsa; identical to SEQ ID NO: 253595

SEQ ID NO: 743549 - RNA, 66 nt, hsa; identical to SEQ ID NO: 253596

SEQ ID NO: 743550 - RNA, 66 nt, hsa; identical to SEQ ID NO: 253597

SEQ ID NO: 743551 - RNA, 66 nt, hsa; identical to SEQ ID NO: 253598

SEQ ID NO: 743552 - RNA, 66 nt, hsa; identical to SEQ ID NO: 253599

SEQ ID NO: 743553 - RNA, 66 nt, hsa; identical to SEQ ID NO: 253600

SEQ ID NO: 743554 - RNA, 66 nt, hsa; identical to SEQ ID NO: 253601

SEQ ID NO: 743555 - RNA, 66 nt, hsa; identical to SEQ ID NO: 253602

SEQ ID NO: 743556 - RNA, 66 nt, hsa; identical to SEQ ID NO: 253603

SEQ ID NO: 743557 - RNA, 66 nt, hsa; identical to SEQ ID NO: 253604

SEQ ID NO: 743558 - RNA, 66 nt, hsa; identical to SEQ ID NO: 253605

SEQ ID NO: 743559 - RNA, 66 nt, hsa; identical to SEQ ID NO: 253606

SEQ ID NO: 743560 - RNA, 66 nt, hsa; identical to SEQ ID NO: 253607

SEQ ID NO: 743561 - RNA, 66 nt, hsa; identical to SEQ ID NO: 253608

SEQ ID NO: 743562 - RNA, 66 nt, hsa; identical to SEQ ID NO: 253609

SEQ ID NO: 743563 - RNA, 66 nt, hsa; identical to SEQ ID NO: 253610

SEQ ID NO: 743564 - RNA, 66 nt, hsa; identical to SEQ ID NO: 253611

SEQ ID NO: 743565 - RNA, 66 nt, hsa; identical to SEQ ID NO: 253612

SEQ ID NO: 743566 - RNA, 66 nt, hsa; identical to SEQ ID NO: 253613

SEQ ID NO: 743567 - RNA, 66 nt, hsa; identical to SEQ ID NO: 253614

SEQ ID NO: 743568 - RNA, 66 nt, hsa; identical to SEQ ID NO: 253615

SEQ ID NO: 743569 - RNA, 66 nt, hsa; identical to SEQ ID NO: 253616

SEQ ID NO: 743570 - RNA, 66 nt, hsa; identical to SEQ ID NO: 253617

SEQ ID NO: 743571 - RNA, 66 nt, hsa; identical to SEQ ID NO: 253618

SEQ ID NO: 743572 - RNA, 66 nt, hsa; identical to SEQ ID NO: 253619

SEQ ID NO: 743573 - RNA, 66 nt, hsa; identical to SEQ ID NO: 253620

SEQ ID NO: 743574 - RNA, 66 nt, hsa; identical to SEQ ID NO: 253621

SEQ ID NO: 743575 - RNA, 66 nt, hsa; identical to SEQ ID NO: 253622

SEQ ID NO: 743576 - RNA, 66 nt, hsa; identical to SEQ ID NO: 253623

SEQ ID NO: 743577 - RNA, 66 nt, hsa; identical to SEQ ID NO: 253624

SEQ ID NO: 743578 - RNA, 66 nt, hsa; identical to SEQ ID NO: 253625

SEQ ID NO: 743579 - RNA, 66 nt, hsa; identical to SEQ ID NO: 253626

SEQ ID NO: 743580 - RNA, 66 nt, hsa; identical to SEQ ID NO: 253627

SEQ ID NO: 743581 - RNA, 66 nt, hsa; identical to SEQ ID NO: 253628

SEQ ID NO: 743582 - RNA, 66 nt, hsa; identical to SEQ ID NO: 253629

SEQ ID NO: 743583 - RNA, 66 nt, hsa; identical to SEQ ID NO: 253630

SEQ ID NO: 743584 - RNA, 66 nt, hsa; identical to SEQ ID NO: 253631

SEQ ID NO: 743585 - RNA, 66 nt, hsa; identical to SEQ ID NO: 253632

SEQ ID NO: 743586 - RNA, 66 nt, hsa; identical to SEQ ID NO: 253633

SEQ ID NO: 743587 - RNA, 66 nt, hsa; identical to SEQ ID NO: 253634

SEQ ID NO: 743588 - RNA, 66 nt, hsa; identical to SEQ ID NO: 253635

SEQ ID NO: 743589 - RNA, 66 nt, hsa; identical to SEQ ID NO: 253636

SEQ ID NO: 743590 - RNA, 66 nt, hsa; identical to SEQ ID NO: 253637

SEQ ID NO: 743591 - RNA, 66 nt, hsa; identical to SEQ ID NO: 253638

SEQ ID NO: 743592 - RNA, 66 nt, hsa; identical to SEQ ID NO: 253639

SEQ ID NO: 743593 - RNA, 66 nt, hsa; identical to SEQ ID NO: 253640

SEQ ID NO: 743594 - RNA, 66 nt, hsa; identical to SEQ ID NO: 253641

SEQ ID NO: 743595 - RNA, 66 nt, hsa; identical to SEQ ID NO: 253642

SEQ ID NO: 743596 - RNA, 66 nt, hsa; identical to SEQ ID NO: 253643

SEQ ID NO: 743597 - RNA, 66 nt, hsa; identical to SEQ ID NO: 253644

SEQ ID NO: 743598 - RNA, 66 nt, hsa; identical to SEQ ID NO: 253645

SEQ ID NO: 743599 - RNA, 66 nt, hsa; identical to SEQ ID NO: 253646

SEQ ID NO: 743600 - RNA, 66 nt, hsa; identical to SEQ ID NO: 253647

SEQ ID NO: 743601 - RNA, 66 nt, hsa; identical to SEQ ID NO: 253648

SEQ ID NO: 743602 - RNA, 66 nt, hsa; identical to SEQ ID NO: 253649

SEQ ID NO: 743603 - RNA, 66 nt, hsa; identical to SEQ ID NO: 253650

SEQ ID NO: 743604 - RNA, 66 nt, hsa; identical to SEQ ID NO: 253651

SEQ ID NO: 743605 - RNA, 66 nt, hsa; identical to SEQ ID NO: 253652

SEQ ID NO: 743606 - RNA, 66 nt, hsa; identical to SEQ ID NO: 253653

SEQ ID NO: 743607 - RNA, 66 nt, hsa; identical to SEQ ID NO: 253654

SEQ ID NO: 743608 - RNA, 66 nt, hsa; identical to SEQ ID NO: 253655

SEQ ID NO: 743609 - RNA, 66 nt, hsa; identical to SEQ ID NO: 253656

SEQ ID NO: 743610 - RNA, 66 nt, hsa; identical to SEQ ID NO: 253657

SEQ ID NO: 743611 - RNA, 66 nt, hsa; identical to SEQ ID NO: 253658

SEQ ID NO: 743612 - RNA, 63 nt, hsa; identical to SEQ ID NO: 103195

SEQ ID NO: 743613 - RNA, 51 nt, hsa; identical to SEQ ID NO: 103196

SEQ ID NO: 743614 - RNA, 66 nt, hsa; identical to SEQ ID NO: 253661

SEQ ID NO: 743615 - RNA, 66 nt, hsa; identical to SEQ ID NO: 253662

SEQ ID NO: 743616 - RNA, 66 nt, hsa; identical to SEQ ID NO: 253663

SEQ ID NO: 743617 - RNA, 66 nt, hsa; identical to SEQ ID NO: 253664

SEQ ID NO: 743618 - RNA, 66 nt, hsa; identical to SEQ ID NO: 253665

SEQ ID NO: 743619 - RNA, 66 nt, hsa; identical to SEQ ID NO: 253666

SEQ ID NO: 743620 - RNA, 66 nt, hsa; identical to SEQ ID NO: 253667

SEQ ID NO: 743621 - RNA, 66 nt, hsa; identical to SEQ ID NO: 253668

SEQ ID NO: 743622 - RNA, 66 nt, hsa; identical to SEQ ID NO: 253669

SEQ ID NO: 743623 - RNA, 66 nt, hsa; identical to SEQ ID NO: 253670

SEQ ID NO: 743624 - RNA, 66 nt, hsa; identical to SEQ ID NO: 253671

SEQ ID NO: 743625 - RNA, 66 nt, hsa; identical to SEQ ID NO: 253672

SEQ ID NO: 743626 - RNA, 66 nt, hsa; identical to SEQ ID NO: 253673

SEQ ID NO: 743627 - RNA, 66 nt, hsa; identical to SEQ ID NO: 253674

SEQ ID NO: 743628 - RNA, 66 nt, hsa; identical to SEQ ID NO: 253675

SEQ ID NO: 743629 - RNA, 66 nt, hsa; identical to SEQ ID NO: 253676

SEQ ID NO: 743630 - RNA, 66 nt, hsa; identical to SEQ ID NO: 253677

SEQ ID NO: 743631 - RNA, 66 nt, hsa; identical to SEQ ID NO: 253678

SEQ ID NO: 743632 - RNA, 66 nt, hsa; identical to SEQ ID NO: 253679

SEQ ID NO: 743633 - RNA, 66 nt, hsa; identical to SEQ ID NO: 253680

SEQ ID NO: 743634 - RNA, 66 nt, hsa; identical to SEQ ID NO: 253681

SEQ ID NO: 743635 - RNA, 66 nt, hsa; identical to SEQ ID NO: 253682

SEQ ID NO: 743636 - RNA, 66 nt, hsa; identical to SEQ ID NO: 253683

SEQ ID NO: 743637 - RNA, 66 nt, hsa; identical to SEQ ID NO: 253684

SEQ ID NO: 743638 - RNA, 66 nt, hsa; identical to SEQ ID NO: 253685

SEQ ID NO: 743639 - RNA, 66 nt, hsa; identical to SEQ ID NO: 253686

SEQ ID NO: 743640 - RNA, 66 nt, hsa; identical to SEQ ID NO: 253687

SEQ ID NO: 743641 - RNA, 66 nt, hsa; identical to SEQ ID NO: 253688

SEQ ID NO: 743642 - RNA, 66 nt, hsa; identical to SEQ ID NO: 253689

SEQ ID NO: 743643 - RNA, 66 nt, hsa; identical to SEQ ID NO: 253690

SEQ ID NO: 743644 - RNA, 66 nt, hsa; identical to SEQ ID NO: 253691

SEQ ID NO: 743645 - RNA, 66 nt, hsa; identical to SEQ ID NO: 253692

SEQ ID NO: 743646 - RNA, 66 nt, hsa; identical to SEQ ID NO: 253693

SEQ ID NO: 743647 - RNA, 66 nt, hsa; identical to SEQ ID NO: 253694

SEQ ID NO: 743648 - RNA, 66 nt, hsa; identical to SEQ ID NO: 253695

SEQ ID NO: 743649 - RNA, 66 nt, hsa; identical to SEQ ID NO: 253696

SEQ ID NO: 743650 - RNA, 66 nt, hsa; identical to SEQ ID NO: 253697

SEQ ID NO: 743651 - RNA, 66 nt, hsa; identical to SEQ ID NO: 253698

SEQ ID NO: 743652 - RNA, 66 nt, hsa; identical to SEQ ID NO: 253699

SEQ ID NO: 743653 - RNA, 66 nt, hsa; identical to SEQ ID NO: 253700

SEQ ID NO: 743654 - RNA, 66 nt, hsa; identical to SEQ ID NO: 253701

SEQ ID NO: 743655 - RNA, 66 nt, hsa; identical to SEQ ID NO: 253702

SEQ ID NO: 743656 - RNA, 66 nt, hsa; identical to SEQ ID NO: 253703

SEQ ID NO: 743657 - RNA, 66 nt, hsa; identical to SEQ ID NO: 253704

SEQ ID NO: 743658 - RNA, 66 nt, hsa; identical to SEQ ID NO: 253705

SEQ ID NO: 743659 - RNA, 66 nt, hsa; identical to SEQ ID NO: 253706

SEQ ID NO: 743660 - RNA, 66 nt, hsa; identical to SEQ ID NO: 253707

SEQ ID NO: 743661 - RNA, 66 nt, hsa; identical to SEQ ID NO: 253708

SEQ ID NO: 743662 - RNA, 66 nt, hsa; identical to SEQ ID NO: 253709

SEQ ID NO: 743663 - RNA, 66 nt, hsa; identical to SEQ ID NO: 253710

SEQ ID NO: 743664 - RNA, 66 nt, hsa; identical to SEQ ID NO: 253711

SEQ ID NO: 743665 - RNA, 66 nt, hsa; identical to SEQ ID NO: 253712

SEQ ID NO: 743666 - RNA, 66 nt, hsa; identical to SEQ ID NO: 253713

SEQ ID NO: 743667 - RNA, 66 nt, hsa; identical to SEQ ID NO: 253714

SEQ ID NO: 743668 - RNA, 66 nt, hsa; identical to SEQ ID NO: 253715

SEQ ID NO: 743669 - RNA, 66 nt, hsa; identical to SEQ ID NO: 253716

SEQ ID NO: 743670 - RNA, 66 nt, hsa; identical to SEQ ID NO: 253717

SEQ ID NO: 743671 - RNA, 66 nt, hsa; identical to SEQ ID NO: 253718

SEQ ID NO: 743672 - RNA, 66 nt, hsa; identical to SEQ ID NO: 253719

SEQ ID NO: 743673 - RNA, 66 nt, hsa; identical to SEQ ID NO: 253720

SEQ ID NO: 743674 - RNA, 66 nt, hsa; identical to SEQ ID NO: 253721

SEQ ID NO: 743675 - RNA, 66 nt, hsa; identical to SEQ ID NO: 253722

SEQ ID NO: 743676 - RNA, 66 nt, hsa; identical to SEQ ID NO: 253723

SEQ ID NO: 743677 - RNA, 66 nt, hsa; identical to SEQ ID NO: 253724

SEQ ID NO: 743678 - RNA, 66 nt, hsa; identical to SEQ ID NO: 253725

SEQ ID NO: 743679 - RNA, 66 nt, hsa; identical to SEQ ID NO: 253726

SEQ ID NO: 743680 - RNA, 66 nt, hsa; identical to SEQ ID NO: 253727

SEQ ID NO: 743681 - RNA, 66 nt, hsa; identical to SEQ ID NO: 253728

SEQ ID NO: 743682 - RNA, 66 nt, hsa; identical to SEQ ID NO: 253729

SEQ ID NO: 743683 - RNA, 66 nt, hsa; identical to SEQ ID NO: 253730

SEQ ID NO: 743684 - RNA, 66 nt, hsa; identical to SEQ ID NO: 253731

SEQ ID NO: 743685 - RNA, 66 nt, hsa; identical to SEQ ID NO: 253732

SEQ ID NO: 743686 - RNA, 66 nt, hsa; identical to SEQ ID NO: 253733

SEQ ID NO: 743687 - RNA, 66 nt, hsa; identical to SEQ ID NO: 253734

SEQ ID NO: 743688 - RNA, 66 nt, hsa; identical to SEQ ID NO: 253735

SEQ ID NO: 743689 - RNA, 66 nt, hsa; identical to SEQ ID NO: 253736

SEQ ID NO: 743690 - RNA, 66 nt, hsa; identical to SEQ ID NO: 253737

SEQ ID NO: 743691 - RNA, 66 nt, hsa; identical to SEQ ID NO: 253738

SEQ ID NO: 743692 - RNA, 66 nt, hsa; identical to SEQ ID NO: 253739

SEQ ID NO: 743693 - RNA, 66 nt, hsa; identical to SEQ ID NO: 253740

SEQ ID NO: 743694 - RNA, 66 nt, hsa; identical to SEQ ID NO: 253741

SEQ ID NO: 743695 - RNA, 66 nt, hsa; identical to SEQ ID NO: 253742

SEQ ID NO: 743696 - RNA, 66 nt, hsa; identical to SEQ ID NO: 253743

SEQ ID NO: 743697 - RNA, 66 nt, hsa; identical to SEQ ID NO: 253744

SEQ ID NO: 743698 - RNA, 66 nt, hsa; identical to SEQ ID NO: 253745

SEQ ID NO: 743699 - RNA, 66 nt, hsa; identical to SEQ ID NO: 253746

SEQ ID NO: 743700 - RNA, 66 nt, hsa; identical to SEQ ID NO: 253747

SEQ ID NO: 743701 - RNA, 66 nt, hsa; identical to SEQ ID NO: 253748

SEQ ID NO: 743702 - RNA, 66 nt, hsa; identical to SEQ ID NO: 253749

SEQ ID NO: 743703 - RNA, 66 nt, hsa; identical to SEQ ID NO: 253750

SEQ ID NO: 743704 - RNA, 66 nt, hsa; identical to SEQ ID NO: 253751

SEQ ID NO: 743705 - RNA, 66 nt, hsa; identical to SEQ ID NO: 253752

SEQ ID NO: 743706 - RNA, 64 nt, hsa; identical to SEQ ID NO: 275532

SEQ ID NO: 743707 - RNA, 64 nt, hsa; identical to SEQ ID NO: 275533

SEQ ID NO: 743708 - RNA, 64 nt, hsa; identical to SEQ ID NO: 275534

SEQ ID NO: 743709 - RNA, 64 nt, hsa; identical to SEQ ID NO: 275535

SEQ ID NO: 743710 - RNA, 64 nt, hsa; identical to SEQ ID NO: 275536

SEQ ID NO: 743711 - RNA, 64 nt, hsa; identical to SEQ ID NO: 275537

SEQ ID NO: 743712 - RNA, 64 nt, hsa; identical to SEQ ID NO: 275538

SEQ ID NO: 743713 - RNA, 64 nt, hsa; identical to SEQ ID NO: 275539

SEQ ID NO: 743714 - RNA, 64 nt, hsa; identical to SEQ ID NO: 275540

SEQ ID NO: 743715 - RNA, 64 nt, hsa; identical to SEQ ID NO: 275541

SEQ ID NO: 743716 - RNA, 64 nt, hsa; identical to SEQ ID NO: 275542

SEQ ID NO: 743717 - RNA, 64 nt, hsa; identical to SEQ ID NO: 275543

SEQ ID NO: 743718 - RNA, 64 nt, hsa; identical to SEQ ID NO: 275544

SEQ ID NO: 743719 - RNA, 64 nt, hsa; identical to SEQ ID NO: 275545

SEQ ID NO: 743720 - RNA, 64 nt, hsa; identical to SEQ ID NO: 157838

SEQ ID NO: 743721 - RNA, 64 nt, hsa; identical to SEQ ID NO: 157839

SEQ ID NO: 743722 - RNA, 64 nt, hsa; identical to SEQ ID NO: 157840

SEQ ID NO: 743723 - RNA, 64 nt, hsa; identical to SEQ ID NO: 157841

SEQ ID NO: 743724 - RNA, 64 nt, hsa; identical to SEQ ID NO: 157842

SEQ ID NO: 743725 - RNA, 64 nt, hsa; identical to SEQ ID NO: 157843

SEQ ID NO: 743726 - RNA, 64 nt, hsa; identical to SEQ ID NO: 157844

SEQ ID NO: 743727 - RNA, 64 nt, hsa; identical to SEQ ID NO: 157845

SEQ ID NO: 743728 - RNA, 64 nt, hsa; identical to SEQ ID NO: 157846

SEQ ID NO: 743729 - RNA, 64 nt, hsa; identical to SEQ ID NO: 157847

SEQ ID NO: 743730 - RNA, 64 nt, hsa; identical to SEQ ID NO: 157848

SEQ ID NO: 743731 - RNA, 64 nt, hsa; identical to SEQ ID NO: 157849

SEQ ID NO: 743732 - RNA, 64 nt, hsa; identical to SEQ ID NO: 157850

SEQ ID NO: 743733 - RNA, 64 nt, hsa; identical to SEQ ID NO: 157851

SEQ ID NO: 743734 - RNA, 64 nt, hsa; identical to SEQ ID NO: 157852

SEQ ID NO: 743735 - RNA, 64 nt, hsa; identical to SEQ ID NO: 157853

SEQ ID NO: 743736 - RNA, 64 nt, hsa; identical to SEQ ID NO: 157854

SEQ ID NO: 743737 - RNA, 64 nt, hsa; identical to SEQ ID NO: 157855

SEQ ID NO: 743738 - RNA, 64 nt, hsa; identical to SEQ ID NO: 157856

SEQ ID NO: 743739 - RNA, 64 nt, hsa; identical to SEQ ID NO: 157857

SEQ ID NO: 743740 - RNA, 64 nt, hsa; identical to SEQ ID NO: 157858

SEQ ID NO: 743741 - RNA, 64 nt, hsa; identical to SEQ ID NO: 157859

SEQ ID NO: 743742 - RNA, 64 nt, hsa; identical to SEQ ID NO: 157860

SEQ ID NO: 743743 - RNA, 64 nt, hsa; identical to SEQ ID NO: 157861

SEQ ID NO: 743744 - RNA, 64 nt, hsa; identical to SEQ ID NO: 157862

SEQ ID NO: 743745 - RNA, 64 nt, hsa; identical to SEQ ID NO: 157863

SEQ ID NO: 743746 - RNA, 64 nt, hsa; identical to SEQ ID NO: 157864

SEQ ID NO: 743747 - RNA, 64 nt, hsa; identical to SEQ ID NO: 157865

SEQ ID NO: 743748 - RNA, 64 nt, hsa; identical to SEQ ID NO: 157866

SEQ ID NO: 743749 - RNA, 64 nt, hsa; identical to SEQ ID NO: 157867

SEQ ID NO: 743750 - RNA, 64 nt, hsa; identical to SEQ ID NO: 157868

SEQ ID NO: 743751 - RNA, 64 nt, hsa; identical to SEQ ID NO: 157869

SEQ ID NO: 743752 - RNA, 64 nt, hsa; identical to SEQ ID NO: 157870

SEQ ID NO: 743753 - RNA, 64 nt, hsa; identical to SEQ ID NO: 157871

SEQ ID NO: 743754 - RNA, 64 nt, hsa; identical to SEQ ID NO: 157872

SEQ ID NO: 743755 - RNA, 64 nt, hsa; identical to SEQ ID NO: 157873

SEQ ID NO: 743756 - RNA, 64 nt, hsa; identical to SEQ ID NO: 157874

SEQ ID NO: 743757 - RNA, 64 nt, hsa; identical to SEQ ID NO: 157875

SEQ ID NO: 743758 - RNA, 64 nt, hsa; identical to SEQ ID NO: 157876

SEQ ID NO: 743759 - RNA, 64 nt, hsa; identical to SEQ ID NO: 157877

SEQ ID NO: 743760 - RNA, 64 nt, hsa; identical to SEQ ID NO: 157878

SEQ ID NO: 743761 - RNA, 64 nt, hsa; identical to SEQ ID NO: 157879

SEQ ID NO: 743762 - RNA, 64 nt, hsa; identical to SEQ ID NO: 157880

SEQ ID NO: 743763 - RNA, 64 nt, hsa; identical to SEQ ID NO: 157881

SEQ ID NO: 743764 - RNA, 64 nt, hsa; identical to SEQ ID NO: 157882

SEQ ID NO: 743765 - RNA, 64 nt, hsa; identical to SEQ ID NO: 157883

SEQ ID NO: 743766 - RNA, 64 nt, hsa; identical to SEQ ID NO: 157884

SEQ ID NO: 743767 - RNA, 64 nt, hsa; identical to SEQ ID NO: 157885

SEQ ID NO: 743768 - RNA, 64 nt, hsa; identical to SEQ ID NO: 157886

SEQ ID NO: 743769 - RNA, 64 nt, hsa; identical to SEQ ID NO: 157887

SEQ ID NO: 743770 - RNA, 64 nt, hsa; identical to SEQ ID NO: 157888

SEQ ID NO: 743771 - RNA, 64 nt, hsa; identical to SEQ ID NO: 157889

SEQ ID NO: 743772 - RNA, 64 nt, hsa; identical to SEQ ID NO: 248259

SEQ ID NO: 743773 - RNA, 64 nt, hsa; identical to SEQ ID NO: 248260

SEQ ID NO: 743774 - RNA, 64 nt, hsa; identical to SEQ ID NO: 248261

SEQ ID NO: 743775 - RNA, 64 nt, hsa; identical to SEQ ID NO: 248262

SEQ ID NO: 743776 - RNA, 64 nt, hsa; identical to SEQ ID NO: 248263

SEQ ID NO: 743777 - RNA, 64 nt, hsa; identical to SEQ ID NO: 248264

SEQ ID NO: 743778 - RNA, 64 nt, hsa; identical to SEQ ID NO: 248265

SEQ ID NO: 743779 - RNA, 64 nt, hsa; identical to SEQ ID NO: 248266

SEQ ID NO: 743780 - RNA, 64 nt, hsa; identical to SEQ ID NO: 248267

SEQ ID NO: 743781 - RNA, 64 nt, hsa; identical to SEQ ID NO: 248268

SEQ ID NO: 743782 - RNA, 64 nt, hsa; identical to SEQ ID NO: 248269

SEQ ID NO: 743783 - RNA, 64 nt, hsa; identical to SEQ ID NO: 248270

SEQ ID NO: 743784 - RNA, 64 nt, hsa; identical to SEQ ID NO: 248271

SEQ ID NO: 743785 - RNA, 64 nt, hsa; identical to SEQ ID NO: 248272

SEQ ID NO: 743786 - RNA, 64 nt, hsa; identical to SEQ ID NO: 248273

SEQ ID NO: 743787 - RNA, 64 nt, hsa; identical to SEQ ID NO: 248274

SEQ ID NO: 743788 - RNA, 64 nt, hsa; identical to SEQ ID NO: 248275

SEQ ID NO: 743789 - RNA, 64 nt, hsa; identical to SEQ ID NO: 248276

SEQ ID NO: 743790 - RNA, 64 nt, hsa; identical to SEQ ID NO: 248277

SEQ ID NO: 743791 - RNA, 64 nt, hsa; identical to SEQ ID NO: 248278

SEQ ID NO: 743792 - RNA, 64 nt, hsa; identical to SEQ ID NO: 248279

SEQ ID NO: 743793 - RNA, 64 nt, hsa; identical to SEQ ID NO: 248280

SEQ ID NO: 743794 - RNA, 64 nt, hsa; identical to SEQ ID NO: 248281

SEQ ID NO: 743795 - RNA, 64 nt, hsa; identical to SEQ ID NO: 248282

SEQ ID NO: 743796 - RNA, 64 nt, hsa; identical to SEQ ID NO: 248283

SEQ ID NO: 743797 - RNA, 64 nt, hsa; identical to SEQ ID NO: 248284

SEQ ID NO: 743798 - RNA, 64 nt, hsa; identical to SEQ ID NO: 248285

SEQ ID NO: 743799 - RNA, 64 nt, hsa; identical to SEQ ID NO: 248286

SEQ ID NO: 743800 - RNA, 64 nt, hsa; identical to SEQ ID NO: 248287

SEQ ID NO: 743801 - RNA, 64 nt, hsa; identical to SEQ ID NO: 248288

SEQ ID NO: 743802 - RNA, 64 nt, hsa; identical to SEQ ID NO: 248289

SEQ ID NO: 743803 - RNA, 64 nt, hsa; identical to SEQ ID NO: 248290

SEQ ID NO: 743804 - RNA, 54 nt, hsa; identical to SEQ ID NO: 248291

SEQ ID NO: 743805 - RNA, 64 nt, hsa; identical to SEQ ID NO: 248292

SEQ ID NO: 743806 - RNA, 64 nt, hsa; identical to SEQ ID NO: 248293

SEQ ID NO: 743807 - RNA, 64 nt, hsa; identical to SEQ ID NO: 248294

SEQ ID NO: 743808 - RNA, 64 nt, hsa; identical to SEQ ID NO: 248295

SEQ ID NO: 743809 - RNA, 64 nt, hsa; identical to SEQ ID NO: 248296

SEQ ID NO: 743810 - RNA, 64 nt, hsa; identical to SEQ ID NO: 248297

SEQ ID NO: 743811 - RNA, 64 nt, hsa; identical to SEQ ID NO: 248298

SEQ ID NO: 743812 - RNA, 64 nt, hsa; identical to SEQ ID NO: 248299

SEQ ID NO: 743813 - RNA, 64 nt, hsa; identical to SEQ ID NO: 79332

SEQ ID NO: 743814 - RNA, 64 nt, hsa; identical to SEQ ID NO: 79333

SEQ ID NO: 743815 - RNA, 64 nt, hsa; identical to SEQ ID NO: 79334

SEQ ID NO: 743816 - RNA, 64 nt, hsa; identical to SEQ ID NO: 79335

SEQ ID NO: 743817 - RNA, 64 nt, hsa; identical to SEQ ID NO: 79336

SEQ ID NO: 743818 - RNA, 64 nt, hsa; identical to SEQ ID NO: 79337

SEQ ID NO: 743819 - RNA, 64 nt, hsa; identical to SEQ ID NO: 79338

SEQ ID NO: 743820 - RNA, 64 nt, hsa; identical to SEQ ID NO: 79339

SEQ ID NO: 743821 - RNA, 64 nt, hsa; identical to SEQ ID NO: 79340

SEQ ID NO: 743822 - RNA, 64 nt, hsa; identical to SEQ ID NO: 79341

SEQ ID NO: 743823 - RNA, 64 nt, hsa; identical to SEQ ID NO: 79342

SEQ ID NO: 743824 - RNA, 64 nt, hsa; identical to SEQ ID NO: 79343

SEQ ID NO: 743825 - RNA, 64 nt, hsa; identical to SEQ ID NO: 79344

SEQ ID NO: 743826 - RNA, 64 nt, hsa; identical to SEQ ID NO: 79345

SEQ ID NO: 743827 - RNA, 64 nt, hsa; identical to SEQ ID NO: 79346

SEQ ID NO: 743828 - RNA, 64 nt, hsa; identical to SEQ ID NO: 79347

SEQ ID NO: 743829 - RNA, 64 nt, hsa; identical to SEQ ID NO: 172917

SEQ ID NO: 743830 - RNA, 64 nt, hsa; identical to SEQ ID NO: 172918

SEQ ID NO: 743831 - RNA, 64 nt, hsa; identical to SEQ ID NO: 172919

SEQ ID NO: 743832 - RNA, 64 nt, hsa; identical to SEQ ID NO: 172920

SEQ ID NO: 743833 - RNA, 64 nt, hsa; identical to SEQ ID NO: 172921

SEQ ID NO: 743834 - RNA, 64 nt, hsa; identical to SEQ ID NO: 172922

SEQ ID NO: 743835 - RNA, 64 nt, hsa; identical to SEQ ID NO: 172923

SEQ ID NO: 743836 - RNA, 64 nt, hsa; identical to SEQ ID NO: 172924

SEQ ID NO: 743837 - RNA, 64 nt, hsa; identical to SEQ ID NO: 172925

SEQ ID NO: 743838 - RNA, 64 nt, hsa; identical to SEQ ID NO: 172926

SEQ ID NO: 743839 - RNA, 64 nt, hsa; identical to SEQ ID NO: 172927

SEQ ID NO: 743840 - RNA, 64 nt, hsa; identical to SEQ ID NO: 172928

SEQ ID NO: 743841 - RNA, 64 nt, hsa; identical to SEQ ID NO: 172929

SEQ ID NO: 743842 - RNA, 64 nt, hsa; identical to SEQ ID NO: 172930

SEQ ID NO: 743843 - RNA, 64 nt, hsa; identical to SEQ ID NO: 172931

SEQ ID NO: 743844 - RNA, 64 nt, hsa; identical to SEQ ID NO: 172932

SEQ ID NO: 743845 - RNA, 64 nt, hsa; identical to SEQ ID NO: 172933

SEQ ID NO: 743846 - RNA, 64 nt, hsa; identical to SEQ ID NO: 172934

SEQ ID NO: 743847 - RNA, 64 nt, hsa; identical to SEQ ID NO: 172935

SEQ ID NO: 743848 - RNA, 64 nt, hsa; identical to SEQ ID NO: 172936

SEQ ID NO: 743849 - RNA, 64 nt, hsa; identical to SEQ ID NO: 172937

SEQ ID NO: 743850 - RNA, 64 nt, hsa; identical to SEQ ID NO: 172938

SEQ ID NO: 743851 - RNA, 64 nt, hsa; identical to SEQ ID NO: 172939

SEQ ID NO: 743852 - RNA, 64 nt, hsa; identical to SEQ ID NO: 172940

SEQ ID NO: 743853 - RNA, 64 nt, hsa; identical to SEQ ID NO: 172941

SEQ ID NO: 743854 - RNA, 64 nt, hsa; identical to SEQ ID NO: 172942

SEQ ID NO: 743855 - RNA, 64 nt, hsa; identical to SEQ ID NO: 172943

SEQ ID NO: 743856 - RNA, 64 nt, hsa; identical to SEQ ID NO: 172944

SEQ ID NO: 743857 - RNA, 64 nt, hsa; identical to SEQ ID NO: 172945

SEQ ID NO: 743858 - RNA, 64 nt, hsa; identical to SEQ ID NO: 172946

SEQ ID NO: 743859 - RNA, 64 nt, hsa; identical to SEQ ID NO: 172947

SEQ ID NO: 743860 - RNA, 64 nt, hsa; identical to SEQ ID NO: 172948

SEQ ID NO: 743861 - RNA, 64 nt, hsa; identical to SEQ ID NO: 172949

SEQ ID NO: 743862 - RNA, 64 nt, hsa; identical to SEQ ID NO: 172950

SEQ ID NO: 743863 - RNA, 64 nt, hsa; identical to SEQ ID NO: 172951

SEQ ID NO: 743864 - RNA, 64 nt, hsa; identical to SEQ ID NO: 172952

SEQ ID NO: 743865 - RNA, 64 nt, hsa; identical to SEQ ID NO: 172953

SEQ ID NO: 743866 - RNA, 64 nt, hsa; identical to SEQ ID NO: 172954

SEQ ID NO: 743867 - RNA, 64 nt, hsa; identical to SEQ ID NO: 172955

SEQ ID NO: 743868 - RNA, 64 nt, hsa; identical to SEQ ID NO: 172956

SEQ ID NO: 743869 - RNA, 64 nt, hsa; identical to SEQ ID NO: 172957

SEQ ID NO: 743870 - RNA, 64 nt, hsa; identical to SEQ ID NO: 172958

SEQ ID NO: 743871 - RNA, 64 nt, hsa; identical to SEQ ID NO: 172959

SEQ ID NO: 743872 - RNA, 64 nt, hsa
gauucugggucuccagauuggaacagaggauggagcuaagcagcaaagggccucccuugaauuc

SEQ ID NO: 743873 - RNA, 64 nt, hsa
uuguacuugccucuuuagcugguaugcaagauuugcuaagcaauaaucuuccgaccuuccuccc

SEQ ID NO: 743874 - RNA, 64 nt, hsa
gauuacggucccgggccaguaacagcaccugggagcuugguagaaaugcagaaucuuagccuag

SEQ ID NO: 743875 - RNA, 64 nt, hsa
ccaccccagucccucuucccaccccucucuucuagcuugguaaugaaguauauuuauuggugaa

SEQ ID NO: 743876 - RNA, 64 nt, hsa
ugugacucacagugcuaaagacucaugcuugacagcuugguaaggucaacucuguagcccugca

SEQ ID NO: 743877 - RNA, 64 nt, hsa
gaaaucuccagugugcguuggaaucaccuggagggcuugguaaaacacagauuuuugggcucca

SEQ ID NO: 743878 - RNA, 64 nt, hsa
uucacuucaaagcuaaaaaauuguuaaacuugcagcuugguauugcagagaagauuuuauaaga

SEQ ID NO: 743879 - RNA, 64 nt, hsa
ccagaguuauuggugcagaaauggcuacccgagagcuugguaaauuugccuugguuucuuaugu

SEQ ID NO: 743880 - RNA, 64 nt, hsa
aagugccuucugagcugucuaaaaguuacauugugcuugguagauuuaguguuaagugugcagu

SEQ ID NO: 743881 - RNA, 64 nt, hsa
uguauuuuaagaaaucuauacaaauuggauauaugcuugguaauucuccaguuucuaggaggua

SEQ ID NO: 743882 - RNA, 64 nt, hsa
ugaguauguguucuuuauuccuagaagccacugugcuugguagagugcaucacucaccacagcu

SEQ ID NO: 743883 - RNA, 64 nt, hsa
gcagcugguggagaugggccuggugcuccucucugcuugguaggaaugaccagggcaggaugcc

SEQ ID NO: 743884 - RNA, 60 nt, hsa
agguuucccagugggcuugaagcuugcugugcuugguauuuucaucauugugguguuugu

SEQ ID NO: 743885 - RNA, 64 nt, hsa
uaguuauuucacaguuguagcuacacaguaaguagcuugguagauaguuauugaauguauuuau

SEQ ID NO: 743886 - RNA, 64 nt, hsa
uugaguagucugcauuuuggcaacuccucuagcagcuugguagccuaguacagguuguuuuuuu

SEQ ID NO: 743887 - RNA, 64 nt, hsa
uuuguaguagacuuucaaaaugagugauuuguuagcuugguacuuuuaaguuugugguacagau

SEQ ID NO: 743888 - RNA, 64 nt, hsa
agaugucuugugucuguguggcuagauggccucugcuugguaaucuuauuuuuaggccuaaaau

SEQ ID NO: 743889 - RNA, 64 nt, hsa
uuaugguuccccugcccucucccaucuuugauuggcuugguauuuggagcuucuguuaacauua

SEQ ID NO: 743890 - RNA, 64 nt, hsa
aaacauacauuaugaagccuuuccaaaauuaggugcuugguaaucacguuaaugguauaauuuu

SEQ ID NO: 743891 - RNA, 64 nt, hsa
uguccaucuuugugugcacagagccuagcacagggcuugguagaggguauaucuagugaaugga

SEQ ID NO: 743892 - RNA, 64 nt, hsa
caaaaacccgucucgacgaaaaauacaaaaaauagcuugguaugguggcacaugccuguaaucc

SEQ ID NO: 743893 - RNA, 64 nt, hsa
ccaaagacaggagguguggcugauggguacacaugcuugguaagaguuucugcuuuauauucua

SEQ ID NO: 743894 - RNA, 64 nt, hsa
cuccuaccgccccuacccccuugguacauggcuggcuugguauuaaagaaauucacuguaaaau

SEQ ID NO: 743895 - RNA, 64 nt, hsa
gagcaagcuccugaggcugggagagacuaggaaggcuugguaggaggggaaaaaagucaggaaa

SEQ ID NO: 743896 - RNA, 64 nt, hsa
ugggcuuucuggaauccaaaccacagucuuaggggcuugguaguuuggaaaguucuuaggcacc

SEQ ID NO: 743897 - RNA, 64 nt, hsa
gcugccauagucuccacggugcccuucacagagggcuugguaguggcagaauggccaugcccag

SEQ ID NO: 743898 - RNA, 64 nt, hsa
cuucugccccagcagggcuggccgucaguccccugcuugguaguggugugggggugcagugugg

SEQ ID NO: 743899 - RNA, 64 nt, hsa
gauaaaaaaugacaaaugacugucucuugcggaugcuugguacuguaauguuaauaauagucac

SEQ ID NO: 743900 - RNA, 64 nt, hsa
aguaagcacauugcugcaaugugguacgugaauugcuugguacaaaauggccaguucacagagg

SEQ ID NO: 743901 - RNA, 64 nt, hsa
uuucgcuuucauuauuuuucuuuuuuuggcaaaggcuugguacccaaggugcgguagggggucg

SEQ ID NO: 743902 - RNA, 64 nt, hsa
auguuguugggauuuguguucuguuuuuguacuugcuugguauccguacaagggggcccucaaa

SEQ ID NO: 743903 - RNA, 64 nt, hsa
ugugccuuguuaacaauauguuugcaggcuguaugcuugguagaagucaucgccauucuccauu

SEQ ID NO: 743904 - RNA, 64 nt, hsa
uuuaaagaaaaguaacacucccauccacucauaagcuugguacaaaaacuucucuggcaguuac

SEQ ID NO: 743905 - RNA, 64 nt, hsa
ccauggcugcaguugugugauccaaggcuaguuggcuugguagcuguuggcagcaguuucccuu

SEQ ID NO: 743906 - RNA, 64 nt, hsa
uuuuucaaauaugaaagugaucacuuagcaacaugcuugguaauuuggcaucuguuaagguagg

SEQ ID NO: 743907 - RNA, 64 nt, hsa
uacauuuaaauuacuguuccuacuuaaguggugagcuugguaaccauuuucauaucaggugaua

SEQ ID NO: 743908 - RNA, 64 nt, hsa
ugagugcucagagucccugcuaauguaauuggaagcuugguacacauaagaaaaacuagagauu

SEQ ID NO: 743909 - RNA, 64 nt, hsa
uagagagagauuuguuaaaggauacaaaguuacagcuugguaggaggaauaauuucugguguuc

SEQ ID NO: 743910 - RNA, 64 nt, hsa
uuauuucuuugcauugagugaggaacauaaaauggcuugguaaaaguaauaaaaucaguacaau

SEQ ID NO: 743911 - RNA, 64 nt, hsa
uuuacauuugauuccacaauuugguuucagguaggcuugguaauagacuauauaaaccagauuu

SEQ ID NO: 743912 - RNA, 64 nt, hsa
gagauaggauugauuugcaacugauauuccuuuugcuugguaguguuuuaugacucugcugcag

SEQ ID NO: 743913 - RNA, 64 nt, hsa
ucuuuuuuaugacaacuuagaucaacuauuuuuagcuugguaaauuuuucuaaacacaauuguu

SEQ ID NO: 743914 - RNA, 64 nt, hsa
guaaaaacaauuuugucaaacaguacuccugacagcuugguaaagucuagguagaguuucugau

SEQ ID NO: 743915 - RNA, 62 nt, hsa
gcagcagcagcagugaaugacaccaaaggaccgcuugguagccacuggaacccuuuccagaa

SEQ ID NO: 743916 - RNA, 64 nt, hsa
ccaugagcagagaacugaugcgacuuguuuugcugcuugguagcacuuuaaaaaauuuuuugau

SEQ ID NO: 743917 - RNA, 64 nt, hsa
uugaaaaauugucuuuccuuaucauuggugggaggcuugguagcaaaguaacauuuuuuggaaa

SEQ ID NO: 743918 - RNA, 64 nt, hsa
gauguuguagugacaccauuuacauugaauuaaugcuugguagccuggggcuagauguggaacu

SEQ ID NO: 743919 - RNA, 64 nt, hsa
caucuucacgaacagcguuuuuaacaagauuucagcuugguagagcugacaaagcagauaaaau

SEQ ID NO: 743920 - RNA, 64 nt, hsa
aaauuagcaaagagauagucuaaauggccucucagcuugguaugugaaaaugagaucacauacu

SEQ ID NO: 743921 - RNA, 64 nt, hsa
agagcucaauuuguaccuuugcugucuugcucaagcuugguauggcaugaaaacucgacuuuau

SEQ ID NO: 743922 - RNA, 64 nt, hsa
uaguaaagcauacaaagaaucuagugugcucagggcuugguacaaugagcugaauuagauggcc

SEQ ID NO: 743923 - RNA, 64 nt, hsa
gugcccucccuguugcucuaggaggcuccugcuggcuugguagaagacagaauucgaucugccu

SEQ ID NO: 743924 - RNA, 64 nt, hsa
gagcugaaguguaaagcaaagaauagcagaagcagcuugguaggauggaaggcacgcaguggca

SEQ ID NO: 743925 - RNA, 64 nt, hsa
aagccuguuuuuccuugcaaacucaaaucugugagcuugguaccaaguccagguauaacauucc

SEQ ID NO: 743926 - RNA, 64 nt, hsa
ggucccaugaguagggcugcacaagaugcuggaggcuugguaaguuccucugggucgcagaucg

SEQ ID NO: 743927 - RNA, 64 nt, hsa
uaaauauccauguauaaaauagauagaaaacuuugcuugguaauuuaaaauuaauaaugccagu

SEQ ID NO: 743928 - RNA, 64 nt, hsa
aacuggugaguucuaauuauagcaagaaaggauggcuugguaucaguuauuacagagccccaaa

SEQ ID NO: 743929 - RNA, 64 nt, hsa
uaguagccagaauucguaaagcuguugccugggagcuugguacuuucccuccaggcagaggcuc

SEQ ID NO: 743930 - RNA, 64 nt, hsa
cuugaccacuggaugcuuugccgaaagcagcuuggcuugguagcucugggauuugccuuccuuc

SEQ ID NO: 743931 - RNA, 64 nt, hsa
cuuaccaucgagggugugguugauccuugaagcugcuugguaaaguuaucauuuccucagucuu

SEQ ID NO: 743932 - RNA, 64 nt, hsa
uacaggaaaacuccuuguuauccuuguuuccuuagcuugguaugagacagaucggauccaguuu

SEQ ID NO: 743933 - RNA, 64 nt, hsa
ccuuccuaacuggggcuuucuugacauguagguugcuugguaauaaccuuuuuguauaucacaa

SEQ ID NO: 743934 - RNA, 64 nt, hsa
aaauguaaaaguaaagaugcaggaaaaaugaauugcuugguauucauuacuucauguauaucaa

SEQ ID NO: 743935 - RNA, 64 nt, hsa
uuagcggcaggcugagcagauacuacuugguuuugcuugguaugagauacuacuguuugcuuag

SEQ ID NO: 743936 - RNA, 64 nt, hsa
guuuaaucuaaauaucuugaaagcuauauugugggcuugguaagcauuuuguuuuuucuuucuc

SEQ ID NO: 743937 - RNA, 64 nt, hsa
uaagggcagagucuaccuugaaaccaauuaagcagcuugguauucauaaauauugggauuggau

SEQ ID NO: 743938 - RNA, 64 nt, hsa
gaugcuucuaaaacagcauugauagguuaaagaagcuugguauuuuuaauuuacuucaaugauu

SEQ ID NO: 743939 - RNA, 64 nt, hsa
gccaaucuuuucacaguagagcauacuuaaggcugcuugguacugaguauacuuaaauauaacu

SEQ ID NO: 743940 - RNA, 64 nt, hsa
ucagagacuuuaagucaguugguuuuuauuagcugcuugguaugcaguaacuuggguggaggca

SEQ ID NO: 743941 - RNA, 64 nt, hsa
ucaaacugucaggcuuggguucuuguuauagaaugcuugguauagaaaaaccaugccaucauua

SEQ ID NO: 743942 - RNA, 64 nt, hsa
guacugauuugcacuuugauucacaccuuugucugcuugguaccuuaauuuuuuauaccugauu

SEQ ID NO: 743943 - RNA, 53 nt, hsa
gacaggcugacaagguuugaagggcuugguagagaaugcuggagggaaggggc

SEQ ID NO: 743944 - RNA, 64 nt, hsa
ugaaaccaaauguuaaacuauagccuuaagaaaugcuugguagaaguguccuaaugagacaaau

SEQ ID NO: 743945 - RNA, 64 nt, hsa
aaacugcugacuuaauuugcuuuuguuugcuuuagcuugguaacagcggugaauagaguguagu

SEQ ID NO: 743946 - RNA, 64 nt, hsa
auccucaugcccccuuugccacaaugguaugauggcuugguagccccucgaggcagaugcaccu

SEQ ID NO: 743947 - RNA, 59 nt, hsa
uggccucggaucuacuguagagcaccccugcuugguacagacauacucaggggcuaccg

SEQ ID NO: 743948 - RNA, 64 nt, hsa
accaccaugguuacagcggaugccccgagacucugcuugguaaacguggcagagcagaauggga

SEQ ID NO: 743949 - RNA, 64 nt, hsa
agcuagcagaucuauguggugaaaaugcacaggagcuugguagacugcgggggaaagagagagc

SEQ ID NO: 743950 - RNA, 64 nt, hsa
aagcuuuuuucagacaaaaggugugagggggcuugcuugguaugcuuaccugggcuuguguacc

SEQ ID NO: 743951 - RNA, 64 nt, hsa
uuggucuugaaaaggaaaauaaaaucacuuucuugcuugguaagcaagaagccauaucgauuuu

SEQ ID NO: 743952 - RNA, 64 nt, hsa
uugccugcuuuuauaugcauuuuuguagggaucagcuugguagacaguauuagcggagaaacac

SEQ ID NO: 743953 - RNA, 64 nt, hsa
uucacuuccuguagaagcaagaacaagcuccucugcuugguacuuagucuguguccaugugauc

SEQ ID NO: 743954 - RNA, 64 nt, hsa
gcauuauacccugcaaguucacugcaugucugaugcuugguaaaacuagucuucccuguaaaau

SEQ ID NO: 743955 - RNA, 64 nt, hsa
ugacugugugaaugauggugccagggaauccguggcuugguacacacuguuucauccaguggcc

SEQ ID NO: 743956 - RNA, 64 nt, hsa
aucauagucccuagguugcuacggcuuaucaugugcuugguaaaaggugaucgcagguucucag

SEQ ID NO: 743957 - RNA, 64 nt, hsa
ggcuaccguuuggacaguauagcucuagagcauggcuugguaaccuguuugccauggagcacua

SEQ ID NO: 743958 - RNA, 64 nt, hsa
ugcugaaaaguugcacuuuuguuacaaugcuuaugcuugguacaagcuuaugcugucuuaaauu

SEQ ID NO: 743959 - RNA, 64 nt, hsa
cuuugggggaaguugcugauugcagggcaagcuagcuugguaaggaaaaccucugcaccagcgg

SEQ ID NO: 743960 - RNA, 64 nt, hsa
gcaaccucauuuuguggccuuauuauuaaagauugcuugguagugaaaagggaagggcccagaa

SEQ ID NO: 743961 - RNA, 63 nt, hsa
acugguaacugguauccuuccaaauaaaugcauugcuugguaacaaauguuagcuuaauucag

SEQ ID NO: 743962 - RNA, 64 nt, hsa
caagucccagacuauaaauuaugaacucccauuagcuugguacuaacauauacuugauguaggu

SEQ ID NO: 743963 - RNA, 64 nt, hsa
uuuaaaacucacuugaagcacagcuggucauggggcuugguauaaaguuccuauuuccacccug

SEQ ID NO: 743964 - RNA, 64 nt, hsa
uggauugauuucuucuuucccucuauccaaaggagcuugguaagugccuuacugcagcgugucu

SEQ ID NO: 743965 - RNA, 64 nt, hsa
gggagaauccaguguuucugcuuucaguuucuuggcuugguagccucugagugaaucugaugcu

SEQ ID NO: 743966 - RNA, 64 nt, hsa
ugcuuugucuuguauguuaauugcaucuucauuggcuugguauuuccuaaauguuuaacaagaa

SEQ ID NO: 743967 - RNA, 64 nt, hsa
auauggaagcaagaacuauauaauugauuaggaugcuugguagguuuuuuucauuguucaaaua

SEQ ID NO: 743968 - RNA, 64 nt, hsa
cauugaauuauuaauuacaauuaauuacuaaaaagcuugguauguaaaauuauucuccacaaua

SEQ ID NO: 743969 - RNA, 64 nt, hsa
aacaaggucugccucuuaugacgagaaugcaacagcuugguaaaucauaaaagaaacauuuaag

SEQ ID NO: 743970 - RNA, 64 nt, hsa
gaggugacucagauagaaucugaucccauucagagcuugguaaaugucacuguacagaagacau

SEQ ID NO: 743971 - RNA, 64 nt, hsa
gaacugcugcuguuggguuuggaaugugauggaggcuugguaggguggcugguuuguaaaguuc

SEQ ID NO: 743972 - RNA, 64 nt, hsa
uauuaaaauauuuuuacaccuuugaaaauugcaggcuugguacaaagaggucugucaucuuccc

SEQ ID NO: 743973 - RNA, 64 nt, hsa
ucauugaguagagauaaucaugguauuuucaucagcuugguacuuuuugaaacgugacugcguu

SEQ ID NO: 743974 - RNA, 64 nt, hsa
uccccgaggugugguggcugcagucucaggaagagcuugguacuuguggggacuucuguuuucu

SEQ ID NO: 743975 - RNA, 64 nt, hsa
gcgcccagagcuggccucccccaacaccugcugcgcuugguaggugugguggcguuauggcagc

SEQ ID NO: 743976 - RNA, 64 nt, hsa
cuccccccgcccaccccgccgccucuaauuuauagcuugguaauaaauuucuuuucugcauuuc

SEQ ID NO: 743977 - RNA, 64 nt, hsa
ucagcacuucugcuuuccacuccaauucacacaggcuugguauuaauagaaucaaggccaagcu

SEQ ID NO: 743978 - RNA, 64 nt, hsa
ugccagaaccuucuuuuccucuagaagggauggugcuugguaaccuuaccuuuuaaaagcuggg

SEQ ID NO: 743979 - RNA, 64 nt, hsa
cugcugccaccaucacugugugaagcuuucaagagcuugguacuucccagggcuaccggcaguc

SEQ ID NO: 743980 - RNA, 64 nt, hsa
gaaaauaaaccaguucuuccaaggaaguuaaaaggcuugguauggauguuggugucagauaggu

SEQ ID NO: 743981 - RNA, 64 nt, hsa
ugauauucaaggcuuuaaaagucauuauuccugggcuugguaagugaauuuaugagauuuacug

SEQ ID NO: 743982 - RNA, 64 nt, hsa
uuugaaguucuuaauauggaaauauaccaguguagcuugguacuguauuuuuuuauauugaucu

SEQ ID NO: 743983 - RNA, 64 nt, hsa
uccugggauuucugacaacacaaaaguagaaagugcuugguauuucugucuuauacauaggaaa

SEQ ID NO: 743984 - RNA, 64 nt, hsa
uuuuguuuaauuccuugcuuuugucgacugaccugcuugguagugucugaggugaacugugggg

SEQ ID NO: 743985 - RNA, 64 nt, hsa
uaagugaccugagugggaugcauuuagggggcgggcuugguauguuguaugaauccacucucug

SEQ ID NO: 743986 - RNA, 60 nt, hsa
gcccggggcgggagcccugaaacuaaacaagcuugguacccgccgggggcggggccuaca

SEQ ID NO: 743987 - RNA, 64 nt, hsa
gcugcugcauugugggugaugacguaggacaugugcuugguacaaaaagggccugagacauucc

SEQ ID NO: 743988 - RNA, 64 nt, hsa
gauaaaacaucagguggugagguugagguuuggggcuugguagcaguugccccagucaugagau

SEQ ID NO: 743989 - RNA, 64 nt, hsa
ggggacucagcggauacuaguucuuuuaccuucugcuugguaacuuagauuaaacugagcauug

SEQ ID NO: 743990 - RNA, 64 nt, hsa
uugcacccccaccucagaguguaaucgcauuucugcuugguagaggccgagcccagcaaaggug

SEQ ID NO: 743991 - RNA, 64 nt, hsa
gaugacuccggaaaugugggaggagagaauuacugcuugguacgcagagcaccgaggccgagcc

SEQ ID NO: 743992 - RNA, 64 nt, hsa
ggagaugccccugacccuugacaaaucuaucggugcuugguaccagcaugagcuaacuuuaugg

SEQ ID NO: 743993 - RNA, 64 nt, hsa
cccucuuggcucuauaauauaagauacaacucuugcuugguauagccuaaccguauuuaugugu

SEQ ID NO: 743994 - RNA, 64 nt, hsa
agaguaaacccaugaauuugaauuuuuauauuaugcuugguacuuggaauugauauauaccuua

SEQ ID NO: 743995 - RNA, 64 nt, hsa
gcagcacauccaaggcaaccacagcugugguagagcuugguaaaagacugaagauacauuggug

SEQ ID NO: 743996 - RNA, 64 nt, hsa
accuaauguuuauaggagaaagcaaaauacaucagcuugguaguuaacacaucaaauauuucuu

SEQ ID NO: 743997 - RNA, 64 nt, hsa
guagucuaauagaacuccaaacauuguaagaauugcuugguagcauaagcucagggauaaggug

SEQ ID NO: 743998 - RNA, 64 nt, hsa; identical to SEQ ID NO: 358604

SEQ ID NO: 743999 - RNA, 64 nt, hsa; identical to SEQ ID NO: 358605

SEQ ID NO: 744000 - RNA, 64 nt, hsa; identical to SEQ ID NO: 358606

SEQ ID NO: 744001 - RNA, 64 nt, hsa; identical to SEQ ID NO: 358607

SEQ ID NO: 744002 - RNA, 64 nt, hsa; identical to SEQ ID NO: 358608

SEQ ID NO: 744003 - RNA, 64 nt, hsa; identical to SEQ ID NO: 358609

SEQ ID NO: 744004 - RNA, 64 nt, hsa; identical to SEQ ID NO: 358610

SEQ ID NO: 744005 - RNA, 64 nt, hsa; identical to SEQ ID NO: 358611

SEQ ID NO: 744006 - RNA, 64 nt, hsa; identical to SEQ ID NO: 358612

SEQ ID NO: 744007 - RNA, 64 nt, hsa; identical to SEQ ID NO: 358613

SEQ ID NO: 744008 - RNA, 64 nt, hsa; identical to SEQ ID NO: 358614

SEQ ID NO: 744009 - RNA, 64 nt, hsa; identical to SEQ ID NO: 358615

SEQ ID NO: 744010 - RNA, 64 nt, hsa; identical to SEQ ID NO: 358616

SEQ ID NO: 744011 - RNA, 64 nt, hsa; identical to SEQ ID NO: 358617

SEQ ID NO: 744012 - RNA, 64 nt, hsa; identical to SEQ ID NO: 358618

SEQ ID NO: 744013 - RNA, 64 nt, hsa; identical to SEQ ID NO: 358619

SEQ ID NO: 744014 - RNA, 64 nt, hsa; identical to SEQ ID NO: 358620

SEQ ID NO: 744015 - RNA, 64 nt, hsa; identical to SEQ ID NO: 358621

SEQ ID NO: 744016 - RNA, 64 nt, hsa; identical to SEQ ID NO: 358622

SEQ ID NO: 744017 - RNA, 64 nt, hsa; identical to SEQ ID NO: 358623

SEQ ID NO: 744018 - RNA, 64 nt, hsa; identical to SEQ ID NO: 529015

SEQ ID NO: 744019 - RNA, 64 nt, hsa; identical to SEQ ID NO: 529016

SEQ ID NO: 744020 - RNA, 64 nt, hsa; identical to SEQ ID NO: 529017

SEQ ID NO: 744021 - RNA, 64 nt, hsa; identical to SEQ ID NO: 529018

SEQ ID NO: 744022 - RNA, 64 nt, hsa; identical to SEQ ID NO: 529019

SEQ ID NO: 744023 - RNA, 64 nt, hsa; identical to SEQ ID NO: 529020

SEQ ID NO: 744024 - RNA, 64 nt, hsa; identical to SEQ ID NO: 529021

SEQ ID NO: 744025 - RNA, 64 nt, hsa; identical to SEQ ID NO: 529022

SEQ ID NO: 744026 - RNA, 64 nt, hsa; identical to SEQ ID NO: 529023

SEQ ID NO: 744027 - RNA, 64 nt, hsa; identical to SEQ ID NO: 529024

SEQ ID NO: 744028 - RNA, 64 nt, hsa; identical to SEQ ID NO: 529025

SEQ ID NO: 744029 - RNA, 64 nt, hsa; identical to SEQ ID NO: 529026

SEQ ID NO: 744030 - RNA, 64 nt, hsa; identical to SEQ ID NO: 529027

SEQ ID NO: 744031 - RNA, 64 nt, hsa; identical to SEQ ID NO: 529028

SEQ ID NO: 744032 - RNA, 64 nt, hsa; identical to SEQ ID NO: 529029

SEQ ID NO: 744033 - RNA, 64 nt, hsa; identical to SEQ ID NO: 529030

SEQ ID NO: 744034 - RNA, 64 nt, hsa; identical to SEQ ID NO: 529031

SEQ ID NO: 744035 - RNA, 64 nt, hsa; identical to SEQ ID NO: 529032

SEQ ID NO: 744036 - RNA, 64 nt, hsa; identical to SEQ ID NO: 529033

SEQ ID NO: 744037 - RNA, 64 nt, hsa; identical to SEQ ID NO: 529034

SEQ ID NO: 744038 - RNA, 64 nt, hsa; identical to SEQ ID NO: 529035

SEQ ID NO: 744039 - RNA, 64 nt, hsa; identical to SEQ ID NO: 529036

SEQ ID NO: 744040 - RNA, 64 nt, hsa; identical to SEQ ID NO: 529037

SEQ ID NO: 744041 - RNA, 64 nt, hsa; identical to SEQ ID NO: 529038

SEQ ID NO: 744042 - RNA, 64 nt, hsa; identical to SEQ ID NO: 529039

SEQ ID NO: 744043 - RNA, 64 nt, hsa; identical to SEQ ID NO: 529040

SEQ ID NO: 744044 - RNA, 64 nt, hsa; identical to SEQ ID NO: 529041

SEQ ID NO: 744045 - RNA, 64 nt, hsa; identical to SEQ ID NO: 529042

SEQ ID NO: 744046 - RNA, 64 nt, hsa; identical to SEQ ID NO: 529043

SEQ ID NO: 744047 - RNA, 64 nt, hsa; identical to SEQ ID NO: 529044

SEQ ID NO: 744048 - RNA, 64 nt, hsa; identical to SEQ ID NO: 529045

SEQ ID NO: 744049 - RNA, 64 nt, hsa; identical to SEQ ID NO: 529046

SEQ ID NO: 744050 - RNA, 64 nt, hsa; identical to SEQ ID NO: 529047

SEQ ID NO: 744051 - RNA, 64 nt, hsa; identical to SEQ ID NO: 529048

SEQ ID NO: 744052 - RNA, 64 nt, hsa; identical to SEQ ID NO: 529049

SEQ ID NO: 744053 - RNA, 64 nt, hsa; identical to SEQ ID NO: 529050

SEQ ID NO: 744054 - RNA, 64 nt, hsa; identical to SEQ ID NO: 529051

SEQ ID NO: 744055 - RNA, 64 nt, hsa; identical to SEQ ID NO: 529052

SEQ ID NO: 744056 - RNA, 64 nt, hsa; identical to SEQ ID NO: 529053

SEQ ID NO: 744057 - RNA, 64 nt, hsa; identical to SEQ ID NO: 529054

SEQ ID NO: 744058 - RNA, 64 nt, hsa; identical to SEQ ID NO: 529055

SEQ ID NO: 744059 - RNA, 64 nt, hsa; identical to SEQ ID NO: 529056

SEQ ID NO: 744060 - RNA, 64 nt, hsa; identical to SEQ ID NO: 529057

SEQ ID NO: 744061 - RNA, 64 nt, hsa; identical to SEQ ID NO: 529058

SEQ ID NO: 744062 - RNA, 64 nt, hsa; identical to SEQ ID NO: 529059

SEQ ID NO: 744063 - RNA, 64 nt, hsa; identical to SEQ ID NO: 529060

SEQ ID NO: 744064 - RNA, 64 nt, hsa; identical to SEQ ID NO: 529061

SEQ ID NO: 744065 - RNA, 64 nt, hsa; identical to SEQ ID NO: 529062

SEQ ID NO: 744066 - RNA, 64 nt, hsa; identical to SEQ ID NO: 529063

SEQ ID NO: 744067 - RNA, 64 nt, hsa; identical to SEQ ID NO: 529064

SEQ ID NO: 744068 - RNA, 64 nt, hsa; identical to SEQ ID NO: 529065

SEQ ID NO: 744069 - RNA, 64 nt, hsa; identical to SEQ ID NO: 529066

SEQ ID NO: 744070 - RNA, 64 nt, hsa; identical to SEQ ID NO: 529067

SEQ ID NO: 744071 - RNA, 64 nt, hsa; identical to SEQ ID NO: 529068

SEQ ID NO: 744072 - RNA, 64 nt, hsa; identical to SEQ ID NO: 529069

SEQ ID NO: 744073 - RNA, 64 nt, hsa; identical to SEQ ID NO: 564721

SEQ ID NO: 744074 - RNA, 64 nt, hsa; identical to SEQ ID NO: 564722

SEQ ID NO: 744075 - RNA, 64 nt, hsa; identical to SEQ ID NO: 564723

SEQ ID NO: 744076 - RNA, 64 nt, hsa; identical to SEQ ID NO: 564724

SEQ ID NO: 744077 - RNA, 64 nt, hsa; identical to SEQ ID NO: 564725

SEQ ID NO: 744078 - RNA, 64 nt, hsa; identical to SEQ ID NO: 564726

SEQ ID NO: 744079 - RNA, 64 nt, hsa; identical to SEQ ID NO: 564727

SEQ ID NO: 744080 - RNA, 64 nt, hsa; identical to SEQ ID NO: 564728

SEQ ID NO: 744081 - RNA, 64 nt, hsa; identical to SEQ ID NO: 564729

SEQ ID NO: 744082 - RNA, 64 nt, hsa; identical to SEQ ID NO: 564730

SEQ ID NO: 744083 - RNA, 64 nt, hsa; identical to SEQ ID NO: 564731

SEQ ID NO: 744084 - RNA, 64 nt, hsa; identical to SEQ ID NO: 564732

SEQ ID NO: 744085 - RNA, 64 nt, hsa; identical to SEQ ID NO: 564733

SEQ ID NO: 744086 - RNA, 64 nt, hsa; identical to SEQ ID NO: 564734

SEQ ID NO: 744087 - RNA, 64 nt, hsa; identical to SEQ ID NO: 564734

SEQ ID NO: 744088 - RNA, 64 nt, hsa; identical to SEQ ID NO: 564734

SEQ ID NO: 744089 - RNA, 64 nt, hsa; identical to SEQ ID NO: 564737

SEQ ID NO: 744090 - RNA, 64 nt, hsa; identical to SEQ ID NO: 564738

SEQ ID NO: 744091 - RNA, 64 nt, hsa; identical to SEQ ID NO: 564739

SEQ ID NO: 744092 - RNA, 64 nt, hsa; identical to SEQ ID NO: 564740

SEQ ID NO: 744093 - RNA, 64 nt, hsa; identical to SEQ ID NO: 564741

SEQ ID NO: 744094 - RNA, 64 nt, hsa; identical to SEQ ID NO: 564742

SEQ ID NO: 744095 - RNA, 64 nt, hsa
uacaccuuugggaugauaggguuguuagugacccacaggacaguauagauguuuguggauguag

SEQ ID NO: 744096 - RNA, 64 nt, hsa
aggggaagaagccagaaccccaccuggccugcccacaggacaagaaguggguaagggcaggaag

SEQ ID NO: 744097 - RNA, 64 nt, hsa
cuccucagcucuagggugaaaggcgagagguugcacaggacauggacagagcagcccuuggguu

SEQ ID NO: 744098 - RNA, 64 nt, hsa
auuugcuacacaguacccagagcagccuaucuacacaggacauuaauaaugguguacuuuaaaa

SEQ ID NO: 744099 - RNA, 64 nt, hsa
uuccuaagaggcagcauggugugguagaaagaacacaggacaagggagagagagccaaacaggc

SEQ ID NO: 744100 - RNA, 64 nt, hsa
cccuaggugaucacagaacuuagcuccuuuaacaacaggacaaugguuuuuuacccuagauguu

SEQ ID NO: 744101 - RNA, 64 nt, hsa
ccuccgguucccucucaccccauggcugugaaugacaggacaggucacacguguguuuuccauu

SEQ ID NO: 744102 - RNA, 64 nt, hsa
gagaauggaauugagaguggagacaggacacuucacaggacacuugagcacagucaagauuuua

SEQ ID NO: 744103 - RNA, 64 nt, hsa
gaagacccuacagagaauggaauugagaguggagacaggacacuucacaggacacuugagcaca

SEQ ID NO: 744104 - RNA, 64 nt, hsa
gggggguggggggacuuaucccuggccuuaggacacaggacaaaucuauuuuggauagaaaugc

SEQ ID NO: 744105 - RNA, 64 nt, hsa
uccccgugucuguggucaccauuuaggugaucauacaggacaggcugcacaucucaguauaugu

SEQ ID NO: 744106 - RNA, 64 nt, hsa; identical to SEQ ID NO: 474075

SEQ ID NO: 744107 - RNA, 64 nt, hsa; identical to SEQ ID NO: 474076

SEQ ID NO: 744108 - RNA, 64 nt, hsa; identical to SEQ ID NO: 474077

SEQ ID NO: 744109 - RNA, 64 nt, hsa; identical to SEQ ID NO: 474078

SEQ ID NO: 744110 - RNA, 64 nt, hsa; identical to SEQ ID NO: 474079

SEQ ID NO: 744111 - RNA, 64 nt, hsa; identical to SEQ ID NO: 474080

SEQ ID NO: 744112 - RNA, 64 nt, hsa; identical to SEQ ID NO: 474081

SEQ ID NO: 744113 - RNA, 64 nt, hsa; identical to SEQ ID NO: 474082

SEQ ID NO: 744114 - RNA, 64 nt, hsa; identical to SEQ ID NO: 474083

SEQ ID NO: 744115 - RNA, 64 nt, hsa; identical to SEQ ID NO: 474084

SEQ ID NO: 744116 - RNA, 64 nt, hsa
auacauuuguuauuaaauuuauuauuuaagaugguagcacuagucuuaaauuguauaaaauauc

SEQ ID NO: 744117 - RNA, 64 nt, hsa
acauguuuguuauuaaauuuauuauuaaagauaguagcacuagucuuaaauuugauauaacauc

SEQ ID NO: 744118 - RNA, 64 nt, hsa
agacuccaucuuuccaauaaaaaugagcccuauguagcacuagguuugaauucuaaaauucaaa

SEQ ID NO: 744119 - RNA, 64 nt, hsa
cauuguuccacauauugaaaaaacuguaaaauuauagcacuaacuugauuuuagaaaaugagca

SEQ ID NO: 744120 - RNA, 64 nt, hsa
gcuagcacuagcguggucuagaaugaaggccugcuagcacuagcguggacauuuuucuagcauu

SEQ ID NO: 744121 - RNA, 64 nt, hsa
uauccuguuaagcuugaguagaaugaaggccugcuagcacuagcguggucuagaaugaaggccu

SEQ ID NO: 744122 - RNA, 64 nt, hsa
ucuuaccaaaacaguuaacucuuucuuuccaaucaauuuauacaaaagaggucgcuccagcccu

SEQ ID NO: 744123 - RNA, 64 nt, hsa
uuuuauauuaaugacuauugaaagugguaauaaaaauuuauauuauaggcuucaauguuuucau

SEQ ID NO: 744124 - RNA, 64 nt, hsa
aucucuggaaauuuagaguucuagaccucugguuaauuuauaucuaauaugaagaagacaccuc

SEQ ID NO: 744125 - RNA, 64 nt, hsa
cuuuggcugaacuacaaguguaggccaccauuauaauuuauaaauacagcauacuucaaaacug

SEQ ID NO: 744126 - RNA, 64 nt, hsa
aacugguaagauuaagaagccauuaaccauuugcaauuuauauuauagucacagaaauaauuuc

SEQ ID NO: 744127 - RNA, 64 nt, hsa
cacaaaaaacaaacuuaauuuugauugaacuaauaauuuauaaacaugggaaacaagucagaag

SEQ ID NO: 744128 - RNA, 64 nt, hsa
aaugaaacuuuaauuuuacuuaauuaagaaauggaauuuauauacaaaaauauuuuccauuucc

SEQ ID NO: 744129 - RNA, 64 nt, hsa
aacccuagcugugccagcacauguucaucuuuacaauuuauauuguaaaugauuuguaucguau

SEQ ID NO: 744130 - RNA, 64 nt, hsa
cccuguauuuaaucuacuuugaucagagaaguagaauuuauaacagguuagcuaaaauugggag

SEQ ID NO: 744131 - RNA, 64 nt, hsa
cacuagaaaaauucuuuuaaaauugacagaagauaauuuauaccuuuuauggacucugaagaca

SEQ ID NO: 744132 - RNA, 64 nt, hsa
uuaucuuuagguaauauuuuauaucauagauuaaaauuuauagugaacuuuaucugugucuguc

SEQ ID NO: 744133 - RNA, 64 nt, hsa
uugaaggcauguauuuugaaaaauaucuguuacaaauuuauaauuucaagacaaauugaaucuu

SEQ ID NO: 744134 - RNA, 64 nt, hsa
aggauuuuuuuccuccccaccuucaaugacuucuaauuuauauuauccauagguuucucucccu

SEQ ID NO: 744135 - RNA, 64 nt, hsa
caaaaacauaacugaguuuuuuaaaagaggagaaaauuuauaucuggguuaaguguuuaucaua

SEQ ID NO: 744136 - RNA, 64 nt, hsa
aacauauuuguguauauuaaauaugaauuuuuaaaauuuauaaauacuauuuuccaaaaguaca

SEQ ID NO: 744137 - RNA, 64 nt, hsa
aaaauguauuucaaacuauucuuacugugcugugaauuuauaucuucuucugcaagaccugggg

SEQ ID NO: 744138 - RNA, 64 nt, hsa
cagcucuauauggauuuauacuuuuauauuuauaaauuuauaacuucauacaaauuuauaaaca

SEQ ID NO: 744139 - RNA, 64 nt, hsa
uacuuuuauauuuauaaauuuauaacuucauacaaauuuauaaacauuucuuuauaaauuguaa

SEQ ID NO: 744140 - RNA, 64 nt, hsa
uaaaauguuucauuuucauuaaaaaugaaagccaaauuuauaugccaccgauugcaggacacaa

SEQ ID NO: 744141 - RNA, 64 nt, hsa
auuuaauuaccgguuguuaaaacugguuuagcacaauuuauauuuucccucucuugccuuucuu

SEQ ID NO: 744142 - RNA, 64 nt, hsa
uuauguaugucaauguuuuugucuuuaacagcauaauuuauauugcuuuuucaaaugauguagc

SEQ ID NO: 744143 - RNA, 64 nt, hsa
uaaauaauggcaacucuuuguuuuauacauauauaauuuauaacugaaucuaaguauuagacug

SEQ ID NO: 744144 - RNA, 64 nt, hsa
uuuuaaugccagaagaaaaguuaccagaauuuauaauuuauaguaauuuuuugaucuuuuuuuu

SEQ ID NO: 744145 - RNA, 64 nt, hsa
uuguggcuuuuaaugccagaagaaaaguuaccagaauuuauaauuuauaguaauuuuuugaucu

SEQ ID NO: 744146 - RNA, 64 nt, hsa
uuaguauuuucuaaaaaaguuuagaaugugugucaauuuauaaugauuauuuuuuucuguaaag

SEQ ID NO: 744147 - RNA, 64 nt, hsa
aggacauggcacuaucuuuaaacgaaacaaagacaauuuauaauuugaauuuuaugcucccgug

SEQ ID NO: 744148 - RNA, 64 nt, hsa
uaagauauaugcacauagaagggggacuucuaggaauuuauaaccaaaauuuuaaaacuauuuu

SEQ ID NO: 744149 - RNA, 64 nt, hsa
auucugaauuuugacauuuucacacaauaaaaauaauuuauaucaauauucuguuucucuuuuc

SEQ ID NO: 744150 - RNA, 64 nt, hsa
gccuuugauuuuuuuuuuuuuguuacaguuuaguaauuuauauucaccagucacuucauauguc

SEQ ID NO: 744151 - RNA, 64 nt, hsa
auuuuuuuuuuaaguaaauaguacuuuaggccaaaauuuauaugaauauuugaucuucuugaga

SEQ ID NO: 744152 - RNA, 64 nt, hsa
ggaaacuggauauuuuuagcacgaugugcaugauaauuuauaugcuugguggcugugcugcuga

SEQ ID NO: 744153 - RNA, 64 nt, hsa
cuguuuuuaauguucuuuucaaucccaucuagauaauuuauagaaauauaacccuaauuggaca

SEQ ID NO: 744154 - RNA, 64 nt, hsa
aaauuuaugagcuuugaagauugcuaaauuaaauaauuuauagcuccaaaaacaaaaauauacu

SEQ ID NO: 744155 - RNA, 64 nt, hsa
auacuuguauaugucacagagaaaaaaaaugcaaaauuuauaauagaguuacauuaaccuuguu

SEQ ID NO: 744156 - RNA, 64 nt, hsa
ccuucuuagccauggagagcauuugugauuaauuaauuuauauaugaaauaaugguuuccauuu

SEQ ID NO: 744157 - RNA, 64 nt, hsa
caucgagaaccugaauaaaucaugccacuauauuaauuuauauuacauguuucauauuuaaauc

SEQ ID NO: 744158 - RNA, 64 nt, hsa
ucaucgcacuauggaacacaaauggaauucucuuaauuuauaagaagauaguugcaguuaaauu

SEQ ID NO: 744159 - RNA, 64 nt, hsa
ggcauaagaauuaaacauaugaacaucacaaaacaauuuauaaaaacuucuuaaauauacgcuu

SEQ ID NO: 744160 - RNA, 64 nt, hsa
uuuccugauauucauuagauuaugguguuugccuaauuuauaccgguuuucacuguauauuuua

SEQ ID NO: 744161 - RNA, 64 nt, hsa
auuaugccuucaucaaaacuuuaaaggaaaaaucaauuuauaaaaucauguaggccauuuuuau

SEQ ID NO: 744162 - RNA, 64 nt, hsa
uuggaugauccacaaaccuuaaugaacaugagaaaauuuauacuguagagaaacccuggaaaug

SEQ ID NO: 744163 - RNA, 64 nt, hsa
uuaccacauccucaaacuuuguuaaacauaagagaauuuauaccagagagaaacccuacacaug

SEQ ID NO: 744164 - RNA, 64 nt, hsa
gcuucaaggacauuggugagaguccaacagacacaauuuauacugcgacagaacuucagcauug

SEQ ID NO: 744165 - RNA, 64 nt, hsa
aggcacauuaacuguugcacuuuugaauguccaaaauuuauauuuuagaaauaauaaaaagaaa

SEQ ID NO: 744166 - RNA, 64 nt, hsa
auaugcaguaugauaccacuuuuaaaaaaagauaaauuuauagaaaaaaguuuauaugacugac

SEQ ID NO: 744167 - RNA, 64 nt, hsa
acucuauuuggaguugugcaagugagaagccccaaauuuauaagucaauauccucauucagagc

SEQ ID NO: 744168 - RNA, 64 nt, hsa
aaaaaucaaauaccuuagagauuaugaagucauuaauuuauacugaaauuggauugacuuacua

SEQ ID NO: 744169 - RNA, 64 nt, hsa
uucucagagagccuaaauucuaauacauuuuauuaauuuauacuaaucuucauauuuacuguuc

SEQ ID NO: 744170 - RNA, 64 nt, hsa
uuuaaagaaacacuaaauuaguuuaaaaugaagcaauuuauaucuuuaugcaaaaacauauguc

SEQ ID NO: 744171 - RNA, 64 nt, hsa
guuuuucuuacauaauuugcaauuucaggaauuuaauuuauaggcagaucuuuaaauacaguca

SEQ ID NO: 744172 - RNA, 64 nt, hsa
uuaaguacuaaaaagacaaggauuucuuuuaagaaauuuauagcauuuacuguguuauuuaaau

SEQ ID NO: 744173 - RNA, 64 nt, hsa
agaacauauucugaauguuuuauaaaucuuuaauaauuuauauguagguaauauuuuuguauca

SEQ ID NO: 744174 - RNA, 64 nt, hsa
uauuauuccuuccuuagaaguugauguaucagaaaauuuauaaguuauuuguauuuauauauaa

SEQ ID NO: 744175 - RNA, 64 nt, hsa
agagaguuuaauauguuuagcauuaucuuuauggaauuuauauucaccaauuucaggaaaacca

SEQ ID NO: 744176 - RNA, 64 nt, hsa
auuacaggcacgagccaccacaccuggccaaaaaaauuuauauuuuuugagacaaggucucacu

SEQ ID NO: 744177 - RNA, 64 nt, hsa
acaggcaaaagccaacacacccggccuggauaugaauuuauaauacccuacagugcaacacaag

SEQ ID NO: 744178 - RNA, 64 nt, hsa
ugcauugauacauuuuuaaauguaaguugagaaaaauuuauaagccaaagguucagaaaauuaa

SEQ ID NO: 744179 - RNA, 64 nt, hsa
uccagugucauuuugaucugcuuuucagaauggaaauuuauaauauaaauauauguuuuaauac

SEQ ID NO: 744180 - RNA, 64 nt, hsa
aaaaauuuuaaaaauuuaaauuaaaaaaauuaaaaauuuauagaaccauaucaacacugacaga

SEQ ID NO: 744181 - RNA, 64 nt, hsa
ucugcuuaugcuguggucaaggccagucauuuuuaauuuauaucagauuuauaucagacccucc

SEQ ID NO: 744182 - RNA, 64 nt, hsa
cuccuuuauaacaggguuuuacagacacuaccauaauuuauaaucauuauuuuuuacuuuuggg

SEQ ID NO: 744183 - RNA, 64 nt, hsa
gguagccaaaaauccagauauuugagaagcaggaaauuuauagcaaccaaagaaauagggcaag

SEQ ID NO: 744184 - RNA, 64 nt, hsa
cccauuaaauuaucgauuauuuuuuaaugaauugaauuuauauugagucuucaaauuaacugaa

SEQ ID NO: 744185 - RNA, 64 nt, hsa
gggcaaggcauuuuuuaacacuuuuuaaaauaaaaauuuauaccacaacuuuaggcuauugaug

SEQ ID NO: 744186 - RNA, 64 nt, hsa
uguuccuccauauuacuucuagaauuagaccaacaauuuauaaaucaaacaaacccaagagcau

SEQ ID NO: 744187 - RNA, 64 nt, hsa
caagagcauugaaauuuugauuggauuuguauugaauuuauagauuaaucugguaaaccauguc

SEQ ID NO: 744188 - RNA, 64 nt, hsa
uauaccaaaauuuaguaggcauguuuuucuaauaaauuuauauauuuguaaagaaaacaacaga

SEQ ID NO: 744189 - RNA, 64 nt, hsa
uuuuauauuauuauuccacuaggaauggcauaagaauuuauagauaaauucuuguaacauuaaa

SEQ ID NO: 744190 - RNA, 64 nt, hsa
gguuucuccccacugauauuuuacauagagucauaauuuauaugucuuauaaauuauaagucuu

SEQ ID NO: 744191 - RNA, 64 nt, hsa
aauuuauaugucuuauaaauuauaagucuuauauaauuuauaagucucccacaaucuuccaguu

SEQ ID NO: 744192 - RNA, 64 nt, hsa
auuuuucuuuuaauaguuauaugucagugagaacaauuuauaugucuuacacugagaaauaaaa

SEQ ID NO: 744193 - RNA, 64 nt, hsa
uacacccccacaggugacuuggauucagaaauacaauuuauauuucuucuuuuuaaauuguuuu

SEQ ID NO: 744194 - RNA, 64 nt, hsa
uuauggucucaauguuuuucuuacgccucauuuuaauuuauaaugaagguaaaauuaaaaugua

SEQ ID NO: 744195 - RNA, 64 nt, hsa
acugaugauacuaacaguugaugaaaugacauauaauuuauauaugaaagcuuacgcuauauug

SEQ ID NO: 744196 - RNA, 64 nt, hsa
cuaaaugcaacccauaggcagggcugaugcuuccaauuuauaaaggaucaucagguuuucuguu

SEQ ID NO: 744197 - RNA, 64 nt, hsa
acuaaaguuauuguuuucuaaguuaaauaacuauaauuuauauaucuauuaaaaagguacuucu

SEQ ID NO: 744198 - RNA, 64 nt, hsa
uuuucccaaagggcaacaaaacauacagauagcaaauuuauauuccuuuucuguuaagauaaua

SEQ ID NO: 744199 - RNA, 64 nt, hsa
gaacacauucauucagacuuugcuauuuguugucaauuuauagcugauuugaagguuuucuauu

SEQ ID NO: 744200 - RNA, 64 nt, hsa
acuccuuucuuaucuugaccauacuaauaaauauaauuuauaagcauugccauugaaggcuuaa

SEQ ID NO: 744201 - RNA, 64 nt, hsa
gaaaauauucaugcuugccaucuguucauuucuaaauuuauauucauaaaguuacaguuugaua

SEQ ID NO: 744202 - RNA, 64 nt, hsa
uuaaucaguccucacaccuuucuacacauaagauaauuuauacuggagaggaacucuauaguug

SEQ ID NO: 744203 - RNA, 64 nt, hsa
gaagcaguugcucaaauguuguucaacaccagaaaauuuauauuggagaaaagcacuguaaaug

SEQ ID NO: 744204 - RNA, 64 nt, hsa
acaguaacuuucaugacauaggauucugccgccaaauuuauaucauuaacaaugugugccuuuu

SEQ ID NO: 744205 - RNA, 64 nt, hsa
auuuuuuucuguauugauuuuaacagaaaauuucaauuuauagagguuaggaauuccaaacuac

SEQ ID NO: 744206 - RNA, 64 nt, hsa
auuguaaauacugcccuagugucuccauggaccaaauuuauauuuauaauuguagauuuuuaua

SEQ ID NO: 744207 - RNA, 64 nt, hsa
uuucuguaaaagaagagacauuaagaguuccugaaauuuauaucuggcauacggauaggcuuau

SEQ ID NO: 744208 - RNA, 64 nt, hsa
gaaggaaagguccuuaauuauuauagucuaaacaaauuuauagauuacuguuugaaguaaauaa

SEQ ID NO: 744209 - RNA, 64 nt, hsa
cacccucccuucuagcagauuuugauuuuguuucaauuuauaacuuacacuuugaaccaugggu

SEQ ID NO: 744210 - RNA, 64 nt, hsa
cacccucccuucuagcagauucuuauuuuguuugaauuuauaaacaaggcugguggcugucuac

SEQ ID NO: 744211 - RNA, 64 nt, hsa
agaauagguauuaguugguuuuuuauuauuuuuaaauuuauauagcucucauguauugaaggug

SEQ ID NO: 744212 - RNA, 64 nt, hsa
uuaaugccacugaacuguacacuuuaaaauggaaaauuuauauguauuuuuaccacaauaaaca

SEQ ID NO: 744213 - RNA, 64 nt, hsa
caguuaaguaaaaauggauaauuuauagacagauaauuuauagacagguaaaugugaguuaaau

SEQ ID NO: 744214 - RNA, 64 nt, hsa
aguuaaauuuauagacaguuaaguaaaaauggauaauuuauagacagauaauuuauagacaggu

SEQ ID NO: 744215 - RNA, 64 nt, hsa
auuuuaaaauuaauggauaauuuauagacaguuaaauuuauagacaguuaaguaaaaauggaua

SEQ ID NO: 744216 - RNA, 64 nt, hsa
cucuacuccagccaacauuuuaaaauuaauggauaauuuauagacaguuaaauuuauagacagu

SEQ ID NO: 744217 - RNA, 64 nt, hsa
aaauuugauuguacuauaaaugauuuuuguaaauaauuuauauucugcucuaauacuguacugu

SEQ ID NO: 744218 - RNA, 64 nt, hsa
aguguucaaacacuaucccuaaugccugcggcagaauuuauauacgauccauucauuggggcuc

SEQ ID NO: 744219 - RNA, 64 nt, hsa
auaugagaaauucauguacauuuuauauuuucugaauuuauaaucugugcacucccaauuuuaa

SEQ ID NO: 744220 - RNA, 64 nt, hsa
cauagauaggcaggauauuacauagguaagcaggaauuuauacauuggguaccagagcuaaauc

SEQ ID NO: 744221 - RNA, 64 nt, hsa
aagaaacacuuaacagaggcaagugcaauuuauaaauuuauaucuaaaggggaaucaugauuau

SEQ ID NO: 744222 - RNA, 64 nt, hsa
ccccacaaaagaaacacuuaacagaggcaagugcaauuuauaaauuuauaucuaaaggggaauc

SEQ ID NO: 744223 - RNA, 64 nt, hsa
uaaaauuuuuuaaauuauauuaaauuuauaaaauaauuuauaaauucauauauuaaaacaauau

SEQ ID NO: 744224 - RNA, 64 nt, hsa
ggauaacuacuuuaaaauuuuuuaaauuauauuaaauuuauaaaauaauuuauaaauucauaua

SEQ ID NO: 744225 - RNA, 64 nt, hsa
gauuccucugcugccauuugaauuagaagaaaauaauuuauaugcaugcacaggaagauauugg

SEQ ID NO: 744226 - RNA, 64 nt, hsa
caauuuuuucaaaugaaaggauucucuaauuagaaauuuauaugucagagcuguuauaaauuua

SEQ ID NO: 744227 - RNA, 64 nt, hsa
auaccacauauaaccaucaagauaccuugauuauaauuuauaggacuagaaugacagauucagg

SEQ ID NO: 744228 - RNA, 64 nt, hsa
aaucuuugaggcaguuuauguauugcugaauagcaauuuauacaagaagcuguccauaacugau

SEQ ID NO: 744229 - RNA, 64 nt, hsa
uuuguuuaaacaaucuuucaugucuugucauacaaauuuauaaaggucugcacuccuuuaucug

SEQ ID NO: 744230 - RNA, 64 nt, hsa
uacauuuaauaauaucaaagagaagaugccuguuaauuuauaauguauuugaaaauuacauguu

SEQ ID NO: 744231 - RNA, 64 nt, hsa
agcugcucuccuccacauugaaugauaucuuguuaauuuauaggcacauuugugguaauuuaua

SEQ ID NO: 744232 - RNA, 64 nt, hsa
ugauaucuuguuaauuuauaggcacauuugugguaauuuauaugucuauagaguaaguauaaga

SEQ ID NO: 744233 - RNA, 64 nt, hsa
acguuuuuccaaagaauucacagugcuccuuugcaauuuauagauuucauguugaaauauaugu

SEQ ID NO: 744234 - RNA, 64 nt, hsa
uacuaucaagaaaaaauucugugaauuaagauguaauuuauaaaauaacauuucaaugggggua

SEQ ID NO: 744235 - RNA, 64 nt, hsa
cuugacauaagagaacuauaaauuuuguuuaagcaauuuauaaaucuaaaaccugaagauguuu

SEQ ID NO: 744236 - RNA, 64 nt, hsa
uauaauguuaguuuuuucugauccauaagaagcaaauuuauaccuauuuguguauuaagcacaa

SEQ ID NO: 744237 - RNA, 64 nt, hsa
agaugcagaugauaaaacuaauuuugaacuuuuuaauuuauauaaauuauuuuauaucacuuac

SEQ ID NO: 744238 - RNA, 64 nt, hsa
cauuuuaagcuccuccuuuucuuugaaauacaauaauuuauauagaaauguguagcagcaaauu

SEQ ID NO: 744239 - RNA, 64 nt, hsa
cccucaacccuauucauuagcauuaccaugagugaauuuauaucuaauuauuuccacuugcccu

SEQ ID NO: 744240 - RNA, 64 nt, hsa
acuggaagcugcagaucuuugcuaggacgcaauaaauuuauauacuuuuugagggguucuucug

SEQ ID NO: 744241 - RNA, 64 nt, hsa
ucuucuucuccuaggauuccuaagacugcugcugaauuuauaaaaauuaaguuugugaauguga

SEQ ID NO: 744242 - RNA, 63 nt, hsa
gccauucugagccacacugaaaaggaaaaugggaauuuauaacccagugaggugagugaugag

SEQ ID NO: 744243 - RNA, 64 nt, hsa
uguuuuuuagaacccagcaguuaccuuaaagcugaauuuauauuuaguaacuucuguguuaaua

SEQ ID NO: 744244 - RNA, 64 nt, hsa
ucaaacucuuaguuuuuuuuuuuuacaacuauguaauuuauauuccauuuacauaaggauacac

SEQ ID NO: 744245 - RNA, 64 nt, hsa
aagcauagcaaaucuacuuuaaacuggauggguuaauuuauauaaacauuuucauuuuaaguug

SEQ ID NO: 744246 - RNA, 64 nt, hsa
aaaucucagguaagaaggcaaggaaggcucuguuaauuuauagcuguuuagaggggaaagcagu

SEQ ID NO: 744247 - RNA, 64 nt, hsa
uagcauauaggugauguuugcucuuguuuuuauuaauuuauauguauauuuuuuuaauuuaaca

SEQ ID NO: 744248 - RNA, 64 nt, hsa
aguacucuugguuuuuauaccauucagaucacugaauuuauaaaguacccaucuaguacuugaa

SEQ ID NO: 744249 - RNA, 64 nt, hsa
uuuugcuaucaccaaucauaguguacccaucuuuaauuuauaucagguguauaaauguacauuu

SEQ ID NO: 744250 - RNA, 64 nt, hsa
uuugacauaaguaacuuuuaaaauuugucuuaaaaauuuauacaccagcaauuuagacaaagcc

SEQ ID NO: 744251 - RNA, 64 nt, hsa
uuuauaggcuuggauguuuuuaguucugacuuugaauuuauauaaaguauuuuuauaaugacug

SEQ ID NO: 744252 - RNA, 64 nt, hsa
aguggacucucugacaaaguggguacuuucugaaaauuuauauaacuguuguugauaaggaaca

SEQ ID NO: 744253 - RNA, 64 nt, hsa
ugggauauauggaaaaaagauauuaaugcagauuaauuuauauuuguaaacaaauuuccuuaca

SEQ ID NO: 744254 - RNA, 64 nt, hsa
uuaaagaaaaacauuucuauauugaaauauauauaauuuauaaugaaaauuauaguaguuugua

SEQ ID NO: 744255 - RNA, 64 nt, hsa
guguagguuguauacuuacauuuuuucuuuccuuaauuuauacaugauccuuuuuccuuaauuu

SEQ ID NO: 744256 - RNA, 64 nt, hsa
ucuuuccuuaauuuauacaugauccuuuuuccuuaauuuauacaugauccaggcacauuugaaa

SEQ ID NO: 744257 - RNA, 64 nt, hsa
gagaaggugaguggcaauuuauaauuuaguuggcaauuuauaauagaacuuauagcuuuuaaaa

SEQ ID NO: 744258 - RNA, 64 nt, hsa
cauuugugcaacaauuuuugagaaggugaguggcaauuuauaauuuaguuggcaauuuauaaua

SEQ ID NO: 744259 - RNA, 64 nt, hsa
gauaauugcaucuuaagguacuuuagacacuaugaauuuauauauaggcaagauauucauucau

SEQ ID NO: 744260 - RNA, 64 nt, hsa
uaacuacacauuaguuauaauucugugcaguuuuaauuuauaacacuagauggcaccuguuaua

SEQ ID NO: 744261 - RNA, 64 nt, hsa
cauucaaauuccaauguguacuucauaguguaaaaauuuauauuauugugagguuuuuugucuu

SEQ ID NO: 744262 - RNA, 64 nt, hsa
ggugcuuuaagcauucagcuuccuucaggcugguaauuuauauaaucccugaaacgggcuucag

SEQ ID NO: 744263 - RNA, 64 nt, hsa
cauucaaaauauauauuuuuuuccauuuaaaacuaauuuauaaacuauguacuccugggaagau

SEQ ID NO: 744264 - RNA, 64 nt, hsa
ugagaaagaaacacuaacaaaaggaacaacgaguaauuuauaaaauuguuuaaaauguugguuu

SEQ ID NO: 744265 - RNA, 64 nt, hsa
cucugggacacauucaaagcaguguguagagggaaauuuauagcacuaaaugcccacaagagaa

SEQ ID NO: 744266 - RNA, 64 nt, hsa
caauaucaugaaaauggcccauacugcccaagguaauuuauagauucaaugccauccccaucaa

SEQ ID NO: 744267 - RNA, 64 nt, hsa
guuuggcaacagagugagacuccgucucaaaaaaaauuuauacuguacaaaaaccccacaagug

SEQ ID NO: 744268 - RNA, 64 nt, hsa
uuaagaagcccucaauucuuaacagacauaagauaauuuauacuggagagaaacucuacaaauc

SEQ ID NO: 744269 - RNA, 64 nt, hsa
gaagcaguugaucaaacuuuguucaacaucagggaauuuauauugaaaaauugugcaaauauaa

SEQ ID NO: 744270 - RNA, 64 nt, hsa
uuagccugucccuccaauuuacugcacauaagauaauuuauacuggagagaagcccuacaaaug

SEQ ID NO: 744271 - RNA, 64 nt, hsa
gaagaggucacucaaacuuuguucaacaucagggaauuuauauuggagagcugucuugcaaaug

SEQ ID NO: 744272 - RNA, 64 nt, hsa
aauuuuaauccaaauuugucuauguaaauaccagaauuuauaguagaaauauaugaggaagcga

SEQ ID NO: 744273 - RNA, 64 nt, hsa
aauucuagucuguuuucuacucuaaauuuauauuaauuuauauucaaaaggaauccugcaagua

SEQ ID NO: 744274 - RNA, 64 nt, hsa
aauacuugaaaauucuagucuguuuucuacucuaaauuuauauuaauuuauauucaaaaggaau

SEQ ID NO: 744275 - RNA, 64 nt, hsa
ucagucaagcuucauccuaugcaaaacauaggagaauuuauacaggagagaaaccucacaagug

SEQ ID NO: 744276 - RNA, 64 nt, hsa
uccauuuggaaaucacaccuuaaagacauaggagaauuuauacuggagagaaagcuuacaaaug

SEQ ID NO: 744277 - RNA, 64 nt, hsa
uaaacacagccauuauaaaaaauuaaaugauuuaaauuuauaauuaaguaaauuacauuaaaac

SEQ ID NO: 744278 - RNA, 64 nt, hsa
uugugugcaacaaacauacccuuuaucucuguaaaauuuauacacacaaaaauuaacaaaagau

SEQ ID NO: 744279 - RNA, 64 nt, hsa
aaauuaauucuuuauccagagucgggugcuuuagaauuuauaagucacuuauguguuuugcuug

SEQ ID NO: 744280 - RNA, 64 nt, hsa
gcacuuugcaaaauaguuuguacauuuauuuccuaauuuauacaugauuuuugguguuaauaua

SEQ ID NO: 744281 - RNA, 64 nt, hsa
gguuaauuaaagcuuuugguauaauuuaaaauuaaauuuauaaaugcaguugucuuguuacaag

SEQ ID NO: 744282 - RNA, 64 nt, hsa
uugauuucaaucuuagcugauaaaucuaauugguaauuuauagaacaaauauuugauaagcucc

SEQ ID NO: 744283 - RNA, 64 nt, hsa
uuaacugagugaguuaagugcaagcauaaacuaaaauuuauaugacuuugaauuuaagaaccac

SEQ ID NO: 744284 - RNA, 64 nt, hsa
ucaaugugauuuuaguauuuacaguaauaaauaaaauuuauacaaaguuucagagaacuaccaa

SEQ ID NO: 744285 - RNA, 64 nt, hsa
uucaucuuuaaccugguggauggagccaguuauuaauuuauaauaauacaugucugaaauuuga

SEQ ID NO: 744286 - RNA, 64 nt, hsa
agaguuaauaaguuaauguuauuaagcaguuaauaauuuauauguauggauauaauauaaaaug

SEQ ID NO: 744287 - RNA, 64 nt, hsa
caccaauucaaaaguuauaggauuaggaaauauaaauuuauauuuggugauuggcagccucuga

SEQ ID NO: 744288 - RNA, 64 nt, hsa; identical to SEQ ID NO: 452545

SEQ ID NO: 744289 - RNA, 64 nt, hsa; identical to SEQ ID NO: 452546

SEQ ID NO: 744290 - RNA, 64 nt, hsa; identical to SEQ ID NO: 452547

SEQ ID NO: 744291 - RNA, 64 nt, hsa; identical to SEQ ID NO: 452548

SEQ ID NO: 744292 - RNA, 64 nt, hsa; identical to SEQ ID NO: 452549

SEQ ID NO: 744293 - RNA, 64 nt, hsa; identical to SEQ ID NO: 452550

SEQ ID NO: 744294 - RNA, 64 nt, hsa; identical to SEQ ID NO: 452551

SEQ ID NO: 744295 - RNA, 64 nt, hsa; identical to SEQ ID NO: 452552

SEQ ID NO: 744296 - RNA, 64 nt, hsa; identical to SEQ ID NO: 452553

SEQ ID NO: 744297 - RNA, 64 nt, hsa; identical to SEQ ID NO: 452554

SEQ ID NO: 744298 - RNA, 64 nt, hsa; identical to SEQ ID NO: 452555

SEQ ID NO: 744299 - RNA, 64 nt, hsa; identical to SEQ ID NO: 452556

SEQ ID NO: 744300 - RNA, 64 nt, hsa; identical to SEQ ID NO: 452557

SEQ ID NO: 744301 - RNA, 64 nt, hsa; identical to SEQ ID NO: 452558

SEQ ID NO: 744302 - RNA, 64 nt, hsa; identical to SEQ ID NO: 452559

SEQ ID NO: 744303 - RNA, 64 nt, hsa; identical to SEQ ID NO: 452560

SEQ ID NO: 744304 - RNA, 64 nt, hsa; identical to SEQ ID NO: 452561

SEQ ID NO: 744305 - RNA, 64 nt, hsa; identical to SEQ ID NO: 452562

SEQ ID NO: 744306 - RNA, 64 nt, hsa; identical to SEQ ID NO: 452563

SEQ ID NO: 744307 - RNA, 64 nt, hsa; identical to SEQ ID NO: 452564

SEQ ID NO: 744308 - RNA, 64 nt, hsa; identical to SEQ ID NO: 452565

SEQ ID NO: 744309 - RNA, 64 nt, hsa; identical to SEQ ID NO: 452566

SEQ ID NO: 744310 - RNA, 64 nt, hsa; identical to SEQ ID NO: 452567

SEQ ID NO: 744311 - RNA, 64 nt, hsa; identical to SEQ ID NO: 452568

SEQ ID NO: 744312 - RNA, 64 nt, hsa; identical to SEQ ID NO: 452569

SEQ ID NO: 744313 - RNA, 64 nt, hsa; identical to SEQ ID NO: 452570

SEQ ID NO: 744314 - RNA, 64 nt, hsa; identical to SEQ ID NO: 452571

SEQ ID NO: 744315 - RNA, 64 nt, hsa; identical to SEQ ID NO: 452572

SEQ ID NO: 744316 - RNA, 64 nt, hsa; identical to SEQ ID NO: 452573

SEQ ID NO: 744317 - RNA, 64 nt, hsa; identical to SEQ ID NO: 452574

SEQ ID NO: 744318 - RNA, 64 nt, hsa; identical to SEQ ID NO: 452575

SEQ ID NO: 744319 - RNA, 64 nt, hsa; identical to SEQ ID NO: 452576

SEQ ID NO: 744320 - RNA, 64 nt, hsa; identical to SEQ ID NO: 452577

SEQ ID NO: 744321 - RNA, 64 nt, hsa; identical to SEQ ID NO: 452578

SEQ ID NO: 744322 - RNA, 64 nt, hsa; identical to SEQ ID NO: 452579

SEQ ID NO: 744323 - RNA, 64 nt, hsa; identical to SEQ ID NO: 452580

SEQ ID NO: 744324 - RNA, 64 nt, hsa; identical to SEQ ID NO: 452581

SEQ ID NO: 744325 - RNA, 64 nt, hsa; identical to SEQ ID NO: 452582

SEQ ID NO: 744326 - RNA, 64 nt, hsa; identical to SEQ ID NO: 452583

SEQ ID NO: 744327 - RNA, 64 nt, hsa; identical to SEQ ID NO: 452584

SEQ ID NO: 744328 - RNA, 64 nt, hsa; identical to SEQ ID NO: 452585

SEQ ID NO: 744329 - RNA, 64 nt, hsa; identical to SEQ ID NO: 452586

SEQ ID NO: 744330 - RNA, 64 nt, hsa; identical to SEQ ID NO: 452587

SEQ ID NO: 744331 - RNA, 64 nt, hsa; identical to SEQ ID NO: 452588

SEQ ID NO: 744332 - RNA, 61 nt, hsa; identical to SEQ ID NO: 452589

SEQ ID NO: 744333 - RNA, 64 nt, hsa; identical to SEQ ID NO: 452590

SEQ ID NO: 744334 - RNA, 64 nt, hsa; identical to SEQ ID NO: 452591

SEQ ID NO: 744335 - RNA, 64 nt, hsa; identical to SEQ ID NO: 452592

SEQ ID NO: 744336 - RNA, 64 nt, hsa; identical to SEQ ID NO: 218856

SEQ ID NO: 744337 - RNA, 64 nt, hsa; identical to SEQ ID NO: 218857

SEQ ID NO: 744338 - RNA, 64 nt, hsa; identical to SEQ ID NO: 218858

SEQ ID NO: 744339 - RNA, 64 nt, hsa; identical to SEQ ID NO: 218859

SEQ ID NO: 744340 - RNA, 64 nt, hsa; identical to SEQ ID NO: 218860

SEQ ID NO: 744341 - RNA, 64 nt, hsa; identical to SEQ ID NO: 218861

SEQ ID NO: 744342 - RNA, 64 nt, hsa; identical to SEQ ID NO: 218862

SEQ ID NO: 744343 - RNA, 64 nt, hsa; identical to SEQ ID NO: 218863

SEQ ID NO: 744344 - RNA, 64 nt, hsa; identical to SEQ ID NO: 218864

SEQ ID NO: 744345 - RNA, 64 nt, hsa; identical to SEQ ID NO: 218865

SEQ ID NO: 744346 - RNA, 64 nt, hsa; identical to SEQ ID NO: 218866

SEQ ID NO: 744347 - RNA, 64 nt, hsa; identical to SEQ ID NO: 218867

SEQ ID NO: 744348 - RNA, 64 nt, hsa; identical to SEQ ID NO: 218868

SEQ ID NO: 744349 - RNA, 64 nt, hsa; identical to SEQ ID NO: 218869

SEQ ID NO: 744350 - RNA, 64 nt, hsa; identical to SEQ ID NO: 218870

SEQ ID NO: 744351 - RNA, 64 nt, hsa; identical to SEQ ID NO: 218871

SEQ ID NO: 744352 - RNA, 64 nt, hsa; identical to SEQ ID NO: 218872

SEQ ID NO: 744353 - RNA, 64 nt, hsa; identical to SEQ ID NO: 218873

SEQ ID NO: 744354 - RNA, 64 nt, hsa; identical to SEQ ID NO: 218874

SEQ ID NO: 744355 - RNA, 64 nt, hsa; identical to SEQ ID NO: 218875

SEQ ID NO: 744356 - RNA, 64 nt, hsa; identical to SEQ ID NO: 218876

SEQ ID NO: 744357 - RNA, 64 nt, hsa; identical to SEQ ID NO: 218877

SEQ ID NO: 744358 - RNA, 64 nt, hsa; identical to SEQ ID NO: 84813

SEQ ID NO: 744359 - RNA, 64 nt, hsa; identical to SEQ ID NO: 84814

SEQ ID NO: 744360 - RNA, 64 nt, hsa; identical to SEQ ID NO: 84815

SEQ ID NO: 744361 - RNA, 64 nt, hsa; identical to SEQ ID NO: 84816

SEQ ID NO: 744362 - RNA, 64 nt, hsa; identical to SEQ ID NO: 84817

SEQ ID NO: 744363 - RNA, 64 nt, hsa; identical to SEQ ID NO: 84818

SEQ ID NO: 744364 - RNA, 64 nt, hsa; identical to SEQ ID NO: 84819

SEQ ID NO: 744365 - RNA, 64 nt, hsa; identical to SEQ ID NO: 84820

SEQ ID NO: 744366 - RNA, 64 nt, hsa; identical to SEQ ID NO: 84821

SEQ ID NO: 744367 - RNA, 64 nt, hsa; identical to SEQ ID NO: 84822

SEQ ID NO: 744368 - RNA, 64 nt, hsa; identical to SEQ ID NO: 84823

SEQ ID NO: 744369 - RNA, 64 nt, hsa; identical to SEQ ID NO: 84824

SEQ ID NO: 744370 - RNA, 64 nt, hsa; identical to SEQ ID NO: 84825

SEQ ID NO: 744371 - RNA, 64 nt, hsa; identical to SEQ ID NO: 84826

SEQ ID NO: 744372 - RNA, 64 nt, hsa; identical to SEQ ID NO: 84827

SEQ ID NO: 744373 - RNA, 64 nt, hsa; identical to SEQ ID NO: 84828

SEQ ID NO: 744374 - RNA, 64 nt, hsa; identical to SEQ ID NO: 84829

SEQ ID NO: 744375 - RNA, 64 nt, hsa; identical to SEQ ID NO: 84830

SEQ ID NO: 744376 - RNA, 64 nt, hsa; identical to SEQ ID NO: 84831

SEQ ID NO: 744377 - RNA, 64 nt, hsa; identical to SEQ ID NO: 84832

SEQ ID NO: 744378 - RNA, 64 nt, hsa; identical to SEQ ID NO: 84833

SEQ ID NO: 744379 - RNA, 64 nt, hsa; identical to SEQ ID NO: 84834

SEQ ID NO: 744380 - RNA, 64 nt, hsa; identical to SEQ ID NO: 84835

SEQ ID NO: 744381 - RNA, 64 nt, hsa; identical to SEQ ID NO: 84836

SEQ ID NO: 744382 - RNA, 64 nt, hsa; identical to SEQ ID NO: 84837

SEQ ID NO: 744383 - RNA, 64 nt, hsa; identical to SEQ ID NO: 84838

SEQ ID NO: 744384 - RNA, 64 nt, hsa; identical to SEQ ID NO: 84839

SEQ ID NO: 744385 - RNA, 64 nt, hsa; identical to SEQ ID NO: 84840

SEQ ID NO: 744386 - RNA, 64 nt, hsa; identical to SEQ ID NO: 84841

SEQ ID NO: 744387 - RNA, 64 nt, hsa; identical to SEQ ID NO: 84842

SEQ ID NO: 744388 - RNA, 64 nt, hsa; identical to SEQ ID NO: 84843

SEQ ID NO: 744389 - RNA, 64 nt, hsa; identical to SEQ ID NO: 84844

SEQ ID NO: 744390 - RNA, 64 nt, hsa; identical to SEQ ID NO: 84845

SEQ ID NO: 744391 - RNA, 64 nt, hsa; identical to SEQ ID NO: 84846

SEQ ID NO: 744392 - RNA, 64 nt, hsa; identical to SEQ ID NO: 84847

SEQ ID NO: 744393 - RNA, 64 nt, hsa; identical to SEQ ID NO: 84848

SEQ ID NO: 744394 - RNA, 64 nt, hsa; identical to SEQ ID NO: 84849

SEQ ID NO: 744395 - RNA, 64 nt, hsa; identical to SEQ ID NO: 84850

SEQ ID NO: 744396 - RNA, 64 nt, hsa; identical to SEQ ID NO: 84851

SEQ ID NO: 744397 - RNA, 64 nt, hsa; identical to SEQ ID NO: 84852

SEQ ID NO: 744398 - RNA, 64 nt, hsa; identical to SEQ ID NO: 84853

SEQ ID NO: 744399 - RNA, 64 nt, hsa; identical to SEQ ID NO: 84854

SEQ ID NO: 744400 - RNA, 64 nt, hsa; identical to SEQ ID NO: 84855

SEQ ID NO: 744401 - RNA, 64 nt, hsa; identical to SEQ ID NO: 84856

SEQ ID NO: 744402 - RNA, 64 nt, hsa; identical to SEQ ID NO: 84857

SEQ ID NO: 744403 - RNA, 64 nt, hsa; identical to SEQ ID NO: 84858

SEQ ID NO: 744404 - RNA, 64 nt, hsa; identical to SEQ ID NO: 84859

SEQ ID NO: 744405 - RNA, 64 nt, hsa; identical to SEQ ID NO: 84860

SEQ ID NO: 744406 - RNA, 64 nt, hsa
cuaagaaaccacuauuauauauuuuuucccuucagucacauagacuucagacaacucuccuauu

SEQ ID NO: 744407 - RNA, 64 nt, hsa
ccgguucaacccuaccagcuugugguaacuuacugucacauagcucugacguuuuguuguaaua

SEQ ID NO: 744408 - RNA, 64 nt, hsa
cugcccagauguugacccucacccagcgugagcugucacauaguaggagcuucuagaugcaugu

SEQ ID NO: 744409 - RNA, 64 nt, hsa
uuugaauuucugagcuaaagagucagagagauuagucacauaguugccuaaauaggagagagaa

SEQ ID NO: 744410 - RNA, 64 nt, hsa
uuucucccacuuucuaggaucauuuuuauguaaagucacauaucccaggcccucagguugaauc

SEQ ID NO: 744411 - RNA, 64 nt, hsa
cugauacucccaagagcaggccccaggggucugugucacauaucucugugugauuccuucuggu

SEQ ID NO: 744412 - RNA, 64 nt, hsa
acuguaagccuucucgacuuagacuuaaaaaguggucacauagauuaauuuugugacuuuuuag

SEQ ID NO: 744413 - RNA, 64 nt, hsa
cagugcuccccacugaaaauuaaaccuaaaaaaugucacauauugguauguuguuaaccuggua

SEQ ID NO: 744414 - RNA, 64 nt, hsa
ugugaugauuaauacaauauuaauuauaauaaaggucacauaaacuuuauaaauucauaacugg

SEQ ID NO: 744415 - RNA, 64 nt, hsa
ugcucccuucccucgucccuucccuccccgacaggucacauaacagcugcaucauugaccgcac

SEQ ID NO: 744416 - RNA, 64 nt, hsa
guauacgugugacaugcuggccucagagauucaugucacauauugaaauagcaaauagaaaugu

SEQ ID NO: 744417 - RNA, 64 nt, hsa
cuuagaugcagagagaggaaaaaacagcaacaaagucacauaaaucuuucccugacuuaguaca

SEQ ID NO: 744418 - RNA, 64 nt, hsa
aucccauggguacaaugucuuagaaagucuuuaagucacauaccaugaauuuuugcuucauuac

SEQ ID NO: 744419 - RNA, 64 nt, hsa
ugggguaaagccauguaagaagagaauagucucagucacauaugaagaggaaaauuugcagcug

SEQ ID NO: 744420 - RNA, 64 nt, hsa
ugagcaggggagaaauagcagaggggcuuggagggucacauagguagaugguaaagagaaugag

SEQ ID NO: 744421 - RNA, 64 nt, hsa
ggacucguuuauuugggacauggugggaauaaaggucacauauuggaaaauggaaaggcugaug

SEQ ID NO: 744422 - RNA, 64 nt, hsa
uacuucauuagcaagugaguuugguguuuuauaggucacauaugucuguaucuacuuagccaga

SEQ ID NO: 744423 - RNA, 64 nt, hsa
aaggaugagauuacaccuacagugacucugaguagucacauauauaagcacugcacaugagaua

SEQ ID NO: 744424 - RNA, 64 nt, hsa
uuaaucacuacaguuuuugucaaaaacaugaacagucacauacuugagagaaacugugaaugua

SEQ ID NO: 744425 - RNA, 64 nt, hsa
uguagcuuuuucuguuaaaaaugguauacaugaagucacauacuuuuuuaaaggaacacucaga

SEQ ID NO: 744426 - RNA, 64 nt, hsa
cauuuuauaacauugggcacgguacagagugauugucacauaagguacuugaagauuuauuagu

SEQ ID NO: 744427 - RNA, 64 nt, hsa
cuaucaucagaaugggcagagaugaucuugaagugucacauacacuaaaguccaaacacuaugu

SEQ ID NO: 744428 - RNA, 64 nt, hsa
ugaaugacaagaaaacaagggaaagaguuaaccugucacauagcagguuaacuuuuucaggguu

SEQ ID NO: 744429 - RNA, 64 nt, hsa
uuaucugugacuauuauauagggaucacaaaagugucacauauuagaaugcugaccuuucauau

SEQ ID NO: 744430 - RNA, 64 nt, hsa
gaauuguuguagccggugaauugagucguauucugucacauaauauuuugaagaaaacuuggcu

SEQ ID NO: 744431 - RNA, 64 nt, hsa
uuuuguaauguuuuuauguccugacucacauucugucacauacgcuuuccccuaauagucgggu

SEQ ID NO: 744432 - RNA, 64 nt, hsa
guauaugauguaacuguaucaaaaauaaaaagcugucacauauuuuguaaauuuuuaccuugua

SEQ ID NO: 744433 - RNA, 64 nt, hsa
ccagugguacuaagcacagaaacucacuauauaagucacauaggaaacuugaaaggucugagga

SEQ ID NO: 744434 - RNA, 64 nt, hsa
uuuuaguacuuguaugaaaggugugaauuagaaagucacauauauacauauguaucuuauaauc

SEQ ID NO: 744435 - RNA, 64 nt, hsa
cucuuggugaucuauucauucugugaccucaggggucacauauaaggucaguguuucucguccc

SEQ ID NO: 744436 - RNA, 64 nt, hsa
ccugaacgugccucugcgaagugugagaugaggggucacauaaccacacuguugacuaccucau

SEQ ID NO: 744437 - RNA, 64 nt, hsa
ucaauccauucuucacaagucuugguuaaagaaugucacauauuggugauagaaugaauucaac

SEQ ID NO: 744438 - RNA, 64 nt, hsa
uuuauaaagguaaaauggcaguuugaagucaaaugucacauaggcaaagcaaucaagcaccagg

SEQ ID NO: 744439 - RNA, 64 nt, hsa
uauccaaagcugaauacauucugcuuucaucuuggucacauacaauuauuuuuacaguucuccc

SEQ ID NO: 744440 - RNA, 64 nt, hsa
uuuagaaaaaucaacaaccuaacaccagauucaagucacauaaaaguguuccaauaaaauggau

SEQ ID NO: 744441 - RNA, 64 nt, hsa
agcuuccuaaaauaugaagagauuguugucuaaagucacauauugacauugagcucaguggccu

SEQ ID NO: 744442 - RNA, 64 nt, hsa
acaaauuuuaaacgaauccaaaguguucucacacgucacauacgauugagcaucuccaucuggu

SEQ ID NO: 744443 - RNA, 64 nt, hsa
auugagguucagcaaggugagagagguacccaaggucacauagcuaguuaugugagaaaguuag

SEQ ID NO: 744444 - RNA, 64 nt, hsa
augauugugcauguuuuguaugucauaguaugucgucacauaaaagggagggagcgaaaaacca

SEQ ID NO: 744445 - RNA, 64 nt, hsa
auagauuugcaguucugguuuauauaauaccaaagucacauacagguaauuucccaccauugaa

SEQ ID NO: 744446 - RNA, 64 nt, hsa
uaacuaguuucagaauuaguaaaugugagauucagucacauaauuaucagacauuccauuuguc

SEQ ID NO: 744447 - RNA, 64 nt, hsa
ggugucuaucauaugaagauaacgccuucccuaagucacauaucagaauaggaagauaugccac

SEQ ID NO: 744448 - RNA, 64 nt, hsa
ccaccaggagcagcgccugugcagaaugaacgaagucacauaggcuccuuaauuuuuuuuuuuu

SEQ ID NO: 744449 - RNA, 64 nt, hsa
uaagauggcuuauuuguauaaugguguuacuaaagucacauauaaaaguuaaacuacuuguaaa

SEQ ID NO: 744450 - RNA, 64 nt, hsa
caguguccaaaauauauaaguaaauagcuguagagucacauauaugaagugaauagcauaugug

SEQ ID NO: 744451 - RNA, 64 nt, hsa
cauugauuuuguuuugcuuguuaagcaaaggaaugucacauaccucuguccagcuuuuuaggaa

SEQ ID NO: 744452 - RNA, 64 nt, hsa
ugguugaauggcuuuucuuagugugguauuugcugucacauaguuuuuccugggugagucugcc

SEQ ID NO: 744453 - RNA, 64 nt, hsa
ugccuuugguacaacuaaauuaaaacucuugguggucacauauuguauauaaacaaaacaauau

SEQ ID NO: 744454 - RNA, 64 nt, hsa
cuucauccacaggaaacacugcucuuccucaccugucacauaaagcauuuuuuuaaaaagucag

SEQ ID NO: 744455 - RNA, 64 nt, hsa
aaaucaguuuuuuguuuaaaaaccuuguuucacugucacauaugaaaaaaauacugcauugaua

SEQ ID NO: 744456 - RNA, 64 nt, hsa
cugaugcacugauggcccugaagaagcggauccagucacauaggaaaggaggcuguguuaguga

SEQ ID NO: 744457 - RNA, 64 nt, hsa
uaucaaagccugugguacgcacugaauuuucuuugucacauaguuuugaauuucacagccuucu

SEQ ID NO: 744458 - RNA, 64 nt, hsa
cugcucugguuugcauucaaucagcccaaguugggucacauagauggguuuccuuuggguaccc

SEQ ID NO: 744459 - RNA, 64 nt, hsa
ugccaucacuggauaauguggagugacuagagaagucacauaucacuguaagguacaguuaggg

SEQ ID NO: 744460 - RNA, 64 nt, hsa
gacuucauuaugcuuuugaaaugcuuaucugccugucacauaaguuaaacuauuuaauuuguuu

SEQ ID NO: 744461 - RNA, 64 nt, hsa
uucaugaaaauggucuaaacuuauugugguaauggucacauaacaauauauuaaaaaccauuga

SEQ ID NO: 744462 - RNA, 64 nt, hsa
cggcuauuagcaucagcuguccuaagaagcaguugucacauaaaggagucuuagggacuugaaa

SEQ ID NO: 744463 - RNA, 64 nt, hsa
uuuggcaugugugugugaaauaaauauguagauagucacauauacacagacugagagauaaauu

SEQ ID NO: 744464 - RNA, 64 nt, hsa
uuagugaaguucuuuuacuguaauuggugacaaugucacauaaugaaugcuauugaaaagguua

SEQ ID NO: 744465 - RNA, 64 nt, hsa
aagauugacuggcuauuuauuauaaaguacugaagucacauagccaccuauaaaacagcauaga

SEQ ID NO: 744466 - RNA, 64 nt, hsa
uuuggugacuuuucuacacacacacacacauacagucacauagauauucuuauccuacagauau

SEQ ID NO: 744467 - RNA, 64 nt, hsa
cagaucuccucaagaaacaucaagggacuccugugucacauacuguguuuuuauuuuaacaugg

SEQ ID NO: 744468 - RNA, 64 nt, hsa
ccaguagcuauuccgauuggauauuccguucgucgucacauagcuggcuuuucucuccucauga

SEQ ID NO: 744469 - RNA, 64 nt, hsa
agaugccaaaaacaaaaaaagcaucucacugcaagucacauaaaaaugcaacgcuguaauaugg

SEQ ID NO: 744470 - RNA, 64 nt, hsa
uuucuggggauugaaaucuuuaguccuuggagcugucacauagcaggggcaaccucacacugaa

SEQ ID NO: 744471 - RNA, 64 nt, hsa
aagucuguguuccauugugccauucagguuugcugucacauaugcaucaucugaaaucauuuga

SEQ ID NO: 744472 - RNA, 64 nt, hsa
acuuaccaccuuuuccuguaguuaaaguuuuauugucacauagccacauacauucauuuacaug

SEQ ID NO: 744473 - RNA, 64 nt, hsa
aucuucucauccaccaccuucuccugcuucuccugucacauagggccucaugaaggucuuuaaa

SEQ ID NO: 744474 - RNA, 64 nt, hsa
caucaucaucgaagucuuccccaguuauaaagaggucacauagucgugugggucgaggauucug

SEQ ID NO: 744475 - RNA, 64 nt, hsa
ugcuaugcugucaugacuagggggaugauuauuagucacauagagcuugggaguaccacuggaa

SEQ ID NO: 744476 - RNA, 64 nt, hsa
ccauuucauuaggaacuuuuuuguuugaaugaaugucacauagguauccucaguaacacagaac

SEQ ID NO: 744477 - RNA, 64 nt, hsa
ucacugugggaaaauuugaugaaauauuugaacugucacauauauuaagaauacuuuaugauuu

SEQ ID NO: 744478 - RNA, 64 nt, hsa
guuuuaaaacacugaaacaguaauaguuauuggugucacauaaaacugauuuguuuuuuacagc

SEQ ID NO: 744479 - RNA, 64 nt, hsa
uacucaugucucaaguaagcuuaaacuacaacuugucacauaaaggaagucuuaaguggaguuc

SEQ ID NO: 744480 - RNA, 64 nt, hsa
gcccuuuuucaagcagauuuaugagcagauuucugucacauaagucgucuucugcuugaguauc

SEQ ID NO: 744481 - RNA, 64 nt, hsa
gggcagagacucugguauaugaaaacgucugaaagucacauauugugaaaauuugaagcuaucu

SEQ ID NO: 744482 - RNA, 64 nt, hsa
acuucaauuccugugcauuagugugaugauuucugucacauagcagcauuccgauucuauguaa

SEQ ID NO: 744483 - RNA, 64 nt, hsa
gagaaggcaagcaugugugagugaagauuagagggucacauauaacuggcuguuuucuguucuu

SEQ ID NO: 744484 - RNA, 64 nt, hsa
ccauucuucacaaagucauuuuucuaaauucugugucacauacgaugauggcauuucuggaaau

SEQ ID NO: 744485 - RNA, 64 nt, hsa
uaauaugagaaauuaagucccuaaagacauauaggucacauauuauuauugccagaugagcaua

SEQ ID NO: 744486 - RNA, 64 nt, hsa
guguguguguguguguguguguguuugugucagugucacauaaguucuccauauugccuuaugu

SEQ ID NO: 744487 - RNA, 64 nt, hsa
gaggaaauugagguucuggguauaacuuucuuuggucacauaauauuaaauuuuacaauuugag

SEQ ID NO: 744488 - RNA, 64 nt, hsa
cucagaaguugcaucauuagccaguaguaggugggucacauaguaccugguguacacaucgggg

SEQ ID NO: 744489 - RNA, 64 nt, hsa
cucuuaauuggcacccgaauguugcuguggcucagucacauaucccagggcccucgucccgagg

SEQ ID NO: 744490 - RNA, 64 nt, hsa
uucagaaguugcaucauuagccaguaguaggugggucacauaguaccugguguacacaucgggg

SEQ ID NO: 744491 - RNA, 64 nt, hsa
aauucagugucacaugaggaaguagcugucagaugucacauaauuacuuucguaauagcucaga

SEQ ID NO: 744492 - RNA, 64 nt, hsa
ugguuuauggccucgauucugcaaaccuaacagggucacauauguucucuaaugcaguccuucu

SEQ ID NO: 744493 - RNA, 64 nt, hsa
gguuugauuagcauuuccgcauccaugcaaacgagucacauauggugggacuggagccauagua

SEQ ID NO: 744494 - RNA, 64 nt, hsa
uccuugccuguguuagacaugaagggaaaaagaggucacauauugugauuuccagcuguagcau

SEQ ID NO: 744495 - RNA, 64 nt, hsa
cagccagagcuuucuauguacuguuaaaauugaggucacauauuuucuuuuguauccuggcaaa

SEQ ID NO: 744496 - RNA, 64 nt, hsa
ccucucuuccaaugaaacccuccagucuauuauagucacauagauaauggugccacguguuuuc

SEQ ID NO: 744497 - RNA, 64 nt, hsa
uucucuacaugcauaacaaacccugcuccaaucugucacauaaaagucugugacuugaaguuua

SEQ ID NO: 744498 - RNA, 64 nt, hsa
agguagaaaauaucccuacugacaguaacuaccugucacauauuucucuuaggacuuuuaaaga

SEQ ID NO: 744499 - RNA, 64 nt, hsa
ggggugaugauuugcaagagaaaauuaguggagagucacauagguaaaucauuauuuaacuuag

SEQ ID NO: 744500 - RNA, 64 nt, hsa
ggucacauuggcgccuagaacaguuaggucgcucgucacauaggcaguuaaguggagaaccagg

SEQ ID NO: 744501 - RNA, 64 nt, hsa
uaccaccagacuccuaacauagaaaacuugaauugucacauacauuuuacaguuuggacuuuua

SEQ ID NO: 744502 - RNA, 64 nt, hsa
uuugauuggcagguuaaauaacaugguuuuugaagucacauacuuaauauucuuccuaaaaacc

SEQ ID NO: 744503 - RNA, 64 nt, hsa
acacccccacaacuuuguacaaaugguuacuguagucacauaguggcacaaccaggccuagcac

SEQ ID NO: 744504 - RNA, 64 nt, hsa
agagaagaccagaugugcauagaagccagucucugucacauacaccgcagguggucaccgaguu

SEQ ID NO: 744505 - RNA, 64 nt, hsa
gccugagcccugugaaguuaaacaccugcucauggucacauagcccaggcagaagaaaaucucg

SEQ ID NO: 744506 - RNA, 64 nt, hsa
cuauucuccauacucuguaacaguugcauugacugucacauaaugcucauacuuaucuaauguu

SEQ ID NO: 744507 - RNA, 64 nt, hsa
aauccaggauggaaagaaaugcagaacuaucauagucacauacauauaagagggaugguguuuu

SEQ ID NO: 744508 - RNA, 64 nt, hsa
gcagugguuuugccuaguguuccaauuuuggaacgucacauaacaauggaacauaauaaauuuu

SEQ ID NO: 744509 - RNA, 64 nt, hsa
uugaccucauaaaagaguugagaacaucucucgugucacauacugcaggugcaucaguuacuuu

SEQ ID NO: 744510 - RNA, 64 nt, hsa
aguuggaagaggagacugggaggcagcaagaggggucacauaccagcucaggggagaauggagu

SEQ ID NO: 744511 - RNA, 64 nt, hsa
uuuagagugucugggacgcugcuguauucugaaagucacauagcacacaguaauguuaucugga

SEQ ID NO: 744512 - RNA, 64 nt, hsa
ucaguauuuucuuuuccuccuagugcuaucauuagucacauaaugaccuugauuuuauuuuagg

SEQ ID NO: 744513 - RNA, 64 nt, hsa
uuuuuggugagugcugcuuuuauaaauaugugaugucacauauuucagugacagcugauguuau

SEQ ID NO: 744514 - RNA, 64 nt, hsa
uuaccccaccccuacugauuaugaugucacugcugucacauauugucauacguggggggcuguu

SEQ ID NO: 744515 - RNA, 64 nt, hsa
cugguagggcuguguuuacagucagggccaccccgucacauauacaaaggagcugccugccugu

SEQ ID NO: 744516 - RNA, 64 nt, hsa
aauaucuauguauuuauuucgcugguucuuuguagucacauauuuuauagucuuaauaucuugu

SEQ ID NO: 744517 - RNA, 64 nt, hsa
uuuuuucuuucuuuuuuuuuuauuaugguuagcugucacauacaacuuuuuuuuuuuuugagau

SEQ ID NO: 744518 - RNA, 64 nt, hsa
aguaauucaaaagcugguauuuuucuuccuaaaugucacauagcaaaggcugcccaaaucccca

SEQ ID NO: 744519 - RNA, 64 nt, hsa
aagacaaugacacuggaaggguccggcuuggcuagucacauaucaagucccgaggcagcaacag

SEQ ID NO: 744520 - RNA, 64 nt, hsa
uaucuuuuuuuuuuuggcuggggugggggcauuggucacauaugaccaguaauugaaagacguc

SEQ ID NO: 744521 - RNA, 64 nt, hsa
gcauucaaaugggcugcugcuuagcuugcaccuugucacauagagugaucuuucccaagagaag

SEQ ID NO: 744522 - RNA, 64 nt, hsa
ccaauuccuaaaggguaaagaaggguuaaaguaggucacauauauacaguagcagcuguaaaua

SEQ ID NO: 744523 - RNA, 64 nt, hsa
ugcuacucuuaaccucccaaaaagcaguaucuaagucacauacaugaugucuugggcauuuucu

SEQ ID NO: 744524 - RNA, 64 nt, hsa
uuuucauacauacuuuacuugaauuauugcuguugucacauauuuuugccucugugaguucauc

SEQ ID NO: 744525 - RNA, 64 nt, hsa
cucaucuuuucuagguugucaacagguacuauuugucacauaacuaacuuucgaggcacuggaa

SEQ ID NO: 744526 - RNA, 64 nt, hsa
uguaaauaauagaugucaguauuuaucaugaugggucacauauagacauauguacauauuauau

SEQ ID NO: 744527 - RNA, 64 nt, hsa
gcuuuugaaucaucccuauucuguguuuuaucuagucacauaaauggauuaauuacuaauuuca

SEQ ID NO: 744528 - RNA, 64 nt, hsa
ucuuaacuuuuuauuagcucuuccuaagggaaaugucacauauuauuauuuaauuguacuuguc

SEQ ID NO: 744529 - RNA, 64 nt, hsa
aaaauuuuauauaucuccccuuccuucuccucgagucacauaauaucaguaccuuguucugguc

SEQ ID NO: 744530 - RNA, 64 nt, hsa
aaaacuauauauaucuccccuuccuucuccucaagucacauaauaucagcacuuugugcugguc

SEQ ID NO: 744531 - RNA, 64 nt, hsa
aaugaccaggagugucaucuccagaauuauuggggucacauaugucccuucccaguccaaugcc

SEQ ID NO: 744532 - RNA, 64 nt, hsa
ucuccaguguuuuccauuucucuccuucuucuuggucacauauaugccuaaaugcacagucaug

SEQ ID NO: 744533 - RNA, 64 nt, hsa
uuucuaacauaaguaagacuugauugguuuaaaagucacauaaaaugcggcacuauuucugaac

SEQ ID NO: 744534 - RNA, 64 nt, hsa
uuaguauucauuuaucaaaaaugaccuauguuuagucacauauuuguuuaguucugggaaauug

SEQ ID NO: 744535 - RNA, 64 nt, hsa
auuuuggcagaaauaagucuauaacacuauuuuugucacauaucuuuuucuuggaaaaauuuau

SEQ ID NO: 744536 - RNA, 64 nt, hsa
gggggcucccggccaccugucuugcuccuauggagucacauaagccaacgccagagccccucca

SEQ ID NO: 744537 - RNA, 64 nt, hsa
gagagugguaauucagauuuggucaacgauucuagucacauauuuuccuccaaaaguauuccuu

SEQ ID NO: 744538 - RNA, 64 nt, hsa
gggggauuguuuuuuguaaaaaugucauuaucaggucacauaaaucugccuuuauguugcauaa

SEQ ID NO: 744539 - RNA, 64 nt, hsa
uuuaaaaaucaaacgauuucuccauacgcucauagucacauauggaauuuugagaaaauaaagc

SEQ ID NO: 744540 - RNA, 64 nt, hsa
ugaggcauacaguaaggcugccugcuaguaagcagucacauaaguggguaccuauccagccauu

SEQ ID NO: 744541 - RNA, 64 nt, hsa
gcuuugcagagugccauggucaugucauucugaggucacauaacacauaaaauuaguuucuaug

SEQ ID NO: 744542 - RNA, 64 nt, hsa
ccaggggcucccuucaccucuccuggucccucaggucacauaugaaagcauuuuuacaagauag

SEQ ID NO: 744543 - RNA, 64 nt, hsa
ugcauaagaaguuaaucaccuugccagugggguggucacauauaguguucucaagcuuuacugu

SEQ ID NO: 744544 - RNA, 64 nt, hsa
aaacagaaguuuaagaccacaaguuagaagaaaggucacauauuucaaacacaacuagaugggg

SEQ ID NO: 744545 - RNA, 64 nt, hsa
uccauuccauguaccagcuuaguuaugauacuuagucacauaauuaucuuugauaaagguagag

SEQ ID NO: 744546 - RNA, 64 nt, hsa
uuuaaaaaaaaaaaaaaaagacggaaaaaaaugugucacauacuauuacauccacaccugcaua

SEQ ID NO: 744547 - RNA, 64 nt, hsa
aaacaggcccaggagauuaagugacuuggcuaaagucacauagcaaauuaguagcagagccggg

SEQ ID NO: 744548 - RNA, 64 nt, hsa
gaaaggcuuucuguuuugaucuggagcuguaagggucacauaaucaugggacugccgguggcca

SEQ ID NO: 744549 - RNA, 64 nt, hsa
ccucggcagguggcgguaaaagcgcccccaucaagucacauaacauccugccuccgagagcgcg

SEQ ID NO: 744550 - RNA, 64 nt, hsa
gcaugccauuauuagccaugaagggaauaucuuugucacauaggaauuguucagcaacagaaag

SEQ ID NO: 744551 - RNA, 64 nt, hsa
aauccaaacauguaagcacacacucacuuauuaagucacauacuuuucuaggugcuggggauug

SEQ ID NO: 744552 - RNA, 64 nt, hsa
auuagcuaacauacccucccucuccacaaccccugucacauaccuuucaggaggugacaguugu

SEQ ID NO: 744553 - RNA, 64 nt, hsa
cuggauuuuccccugaagacuuacuuauucuuccgucacauauacaaaagcaagacuuccaggu

SEQ ID NO: 744554 - RNA, 64 nt, hsa
ggagucuccccaggcugcuuuucuaggaauaccagucacauaguuuuuauuuuugugucuguga

SEQ ID NO: 744555 - RNA, 64 nt, hsa
cccaggaccugcgccauccuuuaggccgaccuuggucacauaccaaauucaauaaaacccaaua

SEQ ID NO: 744556 - RNA, 64 nt, hsa
uagcagucaucauuugucuuugaacguacccaaggucacauagcugggauuugaacugagccgu

SEQ ID NO: 744557 - RNA, 64 nt, hsa
cagacuauaaggaaauggaauuauuucccucuuugucacauaucuguaguaggauuugccaaga

SEQ ID NO: 744558 - RNA, 64 nt, hsa
uggugucagugagguggggaaaggaagucuuccugucacauaugcagguucguuuucauucuag

SEQ ID NO: 744559 - RNA, 64 nt, hsa
cggcccucuggccaccuacccgagagaucguagggucacauacauccaacuucaccacuuggcu

SEQ ID NO: 744560 - RNA, 64 nt, hsa
ucaauaagaccgggguaagggggacaggauacuugucacauauuugaagaaauuccauacagug

SEQ ID NO: 744561 - RNA, 64 nt, hsa
ugugcagcugaaauagugaucugcuucugucacugucacauagacagcccugcaugcccccugu

SEQ ID NO: 744562 - RNA, 64 nt, hsa
uaauauucagaauaguugauuaacuuucuuaagugucacauaauuuaaaaaugaaauugcuguu

SEQ ID NO: 744563 - RNA, 61 nt, hsa
uugucccaguucuuucaugagcaugaaaggagucacauagagaaaccccaugaaaguaaga

SEQ ID NO: 744564 - RNA, 64 nt, hsa
caugauacugaaugaaagacaucagaugcaaaaggucacauaguguacuguccuuuuauaugaa

SEQ ID NO: 744565 - RNA, 64 nt, hsa
gaguguggacucuggugccuccagaggggcucaggucacauaaaacuuuguauaucaacgagcu

SEQ ID NO: 744566 - RNA, 64 nt, hsa
agcaauuuccccccaacuccgauggguaggaauugucacauacccaugugacccgauaggaggc

SEQ ID NO: 744567 - RNA, 64 nt, hsa
augaaauguuuggccuuagucaaugucuaugcccgucacauaacagccgaggcaccgaggccca

SEQ ID NO: 744568 - RNA, 64 nt, hsa
agacaaaauugggagaacaaaagaaaagcgucuugucacauacagaaggucccugauaaaguua

SEQ ID NO: 744569 - RNA, 64 nt, hsa
ugagauuucaaaggcacagaaaaggaaggcaucagucacauauuagaggccccacacagggaga

SEQ ID NO: 744570 - RNA, 64 nt, hsa
auggucacagugaacuaugauuacgccaaccugggucacauagcaagacucuguuucaaaaaaa

SEQ ID NO: 744571 - RNA, 64 nt, hsa
caugauacugaaugaaagacgucagaugcaaaaggucacauaguguacuguccuuuuauacgaa

SEQ ID NO: 744572 - RNA, 64 nt, hsa
gcggagaugacgucacgcaagcaacggcgcugacgucacauaucaccguggugauggcgucacg

SEQ ID NO: 744573 - RNA, 64 nt, hsa
acugcacuguggugcuucaguggccaccagccucgucacauacaccagcaucuuucuguaccuc

SEQ ID NO: 744574 - RNA, 64 nt, hsa
aucacucaccccuguccucagagugauaaacuaagucacauacagauaaagcacugaaaacacc

SEQ ID NO: 744575 - RNA, 64 nt, hsa
aaacagcugguauuuguaucuaaaacucagauuggucacauaaaugccacggcauuccgaaguu

SEQ ID NO: 744576 - RNA, 64 nt, hsa
gacaaguucaucagaaggaaggcaguccuuagaagucacauacguugagccacguugcuccuaa

SEQ ID NO: 744577 - RNA, 64 nt, hsa
aaguugcuugaagugcauuacagguguuugugaagucacauaaucuacggggcuagggcgagag

SEQ ID NO: 744578 - RNA, 64 nt, hsa
uacugaauuuuaucaaauaccuuuuaagcauacagucacauaaugauuuuucucuucuaauuug

SEQ ID NO: 744579 - RNA, 64 nt, hsa
auccuucaaugauugauuauacuaagaauaaauggucacauauccuaaaagcuucuucaugaaa

SEQ ID NO: 744580 - RNA, 64 nt, hsa
cuuuguacucagagaagaggccucacauggcugugucacauauaaauguuggacuaaacucuua

SEQ ID NO: 744581 - RNA, 64 nt, hsa
uaaaaauucucauuacauagacgcacaagaauaugucacauaaagaaaauguguuuagaauacu

SEQ ID NO: 744582 - RNA, 64 nt, hsa
uccugaguugguugccucuccccugcucacuccagucacauagagaauugguguuucccgcagu

SEQ ID NO: 744583 - RNA, 64 nt, hsa
aucacuugagcucaggaauucgagaccagccugggucacauagcaagaccccgucucuacaaaa

SEQ ID NO: 744584 - RNA, 64 nt, hsa
guaaacuuuucuuucucuuacacaaaugauaguagucacauacacuacacacacugugccacgu

SEQ ID NO: 744585 - RNA, 64 nt, hsa
ccaaugaaaccaagaauuucucaaaauauuuaaugucacauauuauaagaaguuaccuaauccu

SEQ ID NO: 744586 - RNA, 64 nt, hsa
acacucccguuuggcccucagcacuuugggccuggucacauaccccaucccuagagugcucuuu

SEQ ID NO: 744587 - RNA, 64 nt, hsa
gacauucauaggucccaaaucugcccauucagaugucacauaauauggugggauaucaauuuac

SEQ ID NO: 744588 - RNA, 64 nt, hsa
auaacauuaaagacucugaacacccaagguuggugucacauauaaaaauuaagcugaugacuuu

SEQ ID NO: 744589 - RNA, 64 nt, hsa
uuauggugaacaaaaaaaaaaccagucucaaauggucacauacuguaugaucgcauuuauauaa

SEQ ID NO: 744590 - RNA, 64 nt, hsa
cauauguaaaaaaaaaaaaaaagggaauugacaugucacauaucaaaugaauggaaacuuuguu

SEQ ID NO: 744591 - RNA, 50 nt, hsa
guggaaacuguucgugcuaagucacauaagacauuuucuuuuuuuguugu

SEQ ID NO: 744592 - RNA, 64 nt, hsa
auaauucagaucauuuuagcuuguugcugaggaugucacauauaagacaggaucaaaccugaaa

SEQ ID NO: 744593 - RNA, 64 nt, hsa
guuuucccuuuucugaucugcauuucaacauagagucacauaaaugucccccugagaaaccaau

SEQ ID NO: 744594 - RNA, 64 nt, hsa
gcucacaaaaugaaucccuaugcuuaaugaccaggucacauaaaauccagcccacuuacagguu

SEQ ID NO: 744595 - RNA, 64 nt, hsa
uucagauugggaaauccauuccauuuugugaguugucacauaauaacagcaguggaauauguau

SEQ ID NO: 744596 - RNA, 64 nt, hsa
uuucacuggaaugaguugggagagaaaggcccucagcuuuuagagacacaaaaauccaugaagu

SEQ ID NO: 744597 - RNA, 64 nt, hsa
uucccaucccacuaauguuaguguuuuuuaauggagcuuuuauucugagaauauguguuugucu

SEQ ID NO: 744598 - RNA, 64 nt, hsa
uauuuucuauaauaauuaguacuauuuaauggugagcuuuuaaaaauguaggauagaggguaca

SEQ ID NO: 744599 - RNA, 64 nt, hsa
ggguguggcuguugaaggaaguuugcagucuugcagcuuuuauucccugugcaacaaaagauua

SEQ ID NO: 744600 - RNA, 64 nt, hsa
agggucugcuauuccugaggcugggggccagagaagcuuuuacgcauggaaaaacacuaaucau

SEQ ID NO: 744601 - RNA, 64 nt, hsa
aaauguuucuuuuauuacaaagccuauuuugaguagcuuuuaaaacugaauuuccuuuaauugg

SEQ ID NO: 744602 - RNA, 64 nt, hsa
aguuuuaauuuucuuguauauuuugcuagcuaugagcuuuuaaauaaaauugaaaguucuggaa

SEQ ID NO: 744603 - RNA, 64 nt, hsa
cugcuucauuuuucuuucuuuucuuuucuccuaaagcuuuuauuuaacagugcaaaaggaucgu

SEQ ID NO: 744604 - RNA, 64 nt, hsa
uauuuaaggaauucacuugguaguacuuugcuuuagcuuuuaaauggcuugauuuuaaaggaga

SEQ ID NO: 744605 - RNA, 64 nt, hsa
uugcuuuuuaaugcauuauaugauuguguuuggaagcuuuuacuguucuuuucagaaauacggc

SEQ ID NO: 744606 - RNA, 64 nt, hsa
aaaugcuuuaaauaguuuacuucacuuucaucugagcuuuuaccacuagacucaaggaagaaua

SEQ ID NO: 744607 - RNA, 64 nt, hsa
aaauauaaaauacauaaaagaauguacagaaaauagcuuuuauugaguaauauuacauuucauu

SEQ ID NO: 744608 - RNA, 64 nt, hsa
caagagacauuuucauaauugcuuucuagcaaucagcuuuuauuugccuuaauauaagcuuuua

SEQ ID NO: 744609 - RNA, 64 nt, hsa
uuucuagcaaucagcuuuuauuugccuuaauauaagcuuuuaagcaguuaucuaacuagugucc

SEQ ID NO: 744610 - RNA, 64 nt, hsa
ucugugauuguguguauguguguugaaacuguaaagcuuuuaugacucuaauauuaaucucuua

SEQ ID NO: 744611 - RNA, 64 nt, hsa
caaaauacaucucgccugguacaggaacauaaaaagcuuuuagaugaaaacaaaagccuuucua

SEQ ID NO: 744612 - RNA, 64 nt, hsa
ccuuugccugaaacauugaaucuuguuaaaccacagcuuuuagcuaaaaugagguauaccuaga

SEQ ID NO: 744613 - RNA, 64 nt, hsa
ggguuuuaaaagaacaguauuuuacaaaagguguagcuuuuauaagagugcagaaaagggaagg

SEQ ID NO: 744614 - RNA, 64 nt, hsa
ggugagaaaccuuacaauguaaagaauguggcacagcuuuuaacuaaucuucaaaccuuacuga

SEQ ID NO: 744615 - RNA, 64 nt, hsa
gagaggaacucuauaguugugaagaauguggcaaagcuuuuaaccaauccucauaccuuacuau

SEQ ID NO: 744616 - RNA, 64 nt, hsa
gagagaaagccuacaauugugaagaauguggcaaagcuuuuaaccuuccuuaacccuuaacugu

SEQ ID NO: 744617 - RNA, 64 nt, hsa
gaaagaaacccuacaaaugugaagucuguggcaaagcuuuuaacugauucucaacucuuacuac

SEQ ID NO: 744618 - RNA, 64 nt, hsa
gagagaaaccccacaaaugugaagaauguggcagagcuuuuaaccaguccgcaaagcucacuga

SEQ ID NO: 744619 - RNA, 64 nt, hsa
gagaaaaacccuacaaaugugaagaauguggcaaagcuuuuaaccaguccucacaccuuaugag

SEQ ID NO: 744620 - RNA, 64 nt, hsa
gagagaaacucuacaaaugugaagaauguggcaaagcuuuuaaccaagucucaacacuuacuau

SEQ ID NO: 744621 - RNA, 64 nt, hsa
uguuaaaaacaauuugcaaaccagcagaauuuuaagcuuuuaaaauaauucaauggauauacau

SEQ ID NO: 744622 - RNA, 64 nt, hsa
gaggaaaauaaccaugagcuguaucaugcuacuuagcuuuuauguaaauauuucuuaugucucc

SEQ ID NO: 744623 - RNA, 64 nt, hsa
uaaguguucagauuaacacuuuugaaauuuuuguagcuuuuagcugauuaauuagaaaaauuua

SEQ ID NO: 744624 - RNA, 64 nt, hsa
gauccauuggauuucuuuuuucuuuuugugagacagcuuuuagucuuaccugaauuuaugugug

SEQ ID NO: 744625 - RNA, 64 nt, hsa
aaagugauuggguuuucgacuuccuaucgcagggagcuuuuaagaaauauuaauuuccuauaca

SEQ ID NO: 744626 - RNA, 64 nt, hsa
uguacacaagcagugcuucgugaaugaguuucuuagcuuuuauagugcgccauguuucucaaag

SEQ ID NO: 744627 - RNA, 64 nt, hsa
uugucuaauauaucuacaguaaauguuacacuagagcuuuuauuuuccucuguagcuuuucaga

SEQ ID NO: 744628 - RNA, 64 nt, hsa
aauuaaaugcuuuaagaaauggagaaggaaaaauagcuuuuaucaauuuuuuucuccucaagau

SEQ ID NO: 744629 - RNA, 64 nt, hsa
acagucugugaagcuuacuggauaaggagagaauagcuuuuauguacugacuucauaaaagcca

SEQ ID NO: 744630 - RNA, 64 nt, hsa
uuuuuuaaucauugugcacagaagcaucauugguagcuuuuauaugcaaauggucauuucagau

SEQ ID NO: 744631 - RNA, 64 nt, hsa
ugacugaauuaagauuuaagaaugauuaaaaauaagcuuuuacuuuuuaaaaccacuugagguu

SEQ ID NO: 744632 - RNA, 64 nt, hsa
ugcugcaacucucaacauuucccuuauuugguucagcuuuuagcaaaaagggcuacaguucacc

SEQ ID NO: 744633 - RNA, 64 nt, hsa
uagagaaauccuacaaauaugaagaaugugacaaagcuuuuaaccacuucucaacccugccuac

SEQ ID NO: 744634 - RNA, 64 nt, hsa
gagauaaauuauacaaaugugaagaauguggcaaagcuuuuaacaaauccucauccauuaguaa

SEQ ID NO: 744635 - RNA, 64 nt, hsa
gagagaaacccuacaaaugugaaaaauguggcaaagcuuuuaaccaauuuucaaaccuuacuaa

SEQ ID NO: 744636 - RNA, 64 nt, hsa
gagagaaaccauacaacugugaagaauguggcaaagcuuuuaaccaguccucaaacuuuauuga

SEQ ID NO: 744637 - RNA, 64 nt, hsa
ucccggacaagaaaaauugcaaucaaaugucagcagcuuuuauuaccuuaaucuuucagggccu

SEQ ID NO: 744638 - RNA, 64 nt, hsa
uuagaauguaacagcuuuaacuugggauuuaagaagcuuuuaaaagguaauaauacucugaaag

SEQ ID NO: 744639 - RNA, 64 nt, hsa
gagcuaaacaauuccuuacauuuaccaagaggaaagcuuuuacuguguugaagcuaaaaaaaua

SEQ ID NO: 744640 - RNA, 64 nt, hsa
aaaaucuggagaaaugcuuauaaaauauacuacuagcuuuuaaguuuuaagaaagaagaacgua

SEQ ID NO: 744641 - RNA, 64 nt, hsa
ggaaaaacagaguuccuguuaagugaauaacuuuagcuuuuacaggggauuaugaucaaaagug

SEQ ID NO: 744642 - RNA, 64 nt, hsa
aaaaaagcuuuuauugguguuuucacuuugaaagagcuuuuagcaagguugugcuuuucauugu

SEQ ID NO: 744643 - RNA, 64 nt, hsa
aaacaaaaaccacaaacagacaaacaagaaaaaaagcuuuuauugguguuuucacuuugaaaga

SEQ ID NO: 744644 - RNA, 64 nt, hsa
caaacaaaaacugcagacaaacaaaaaagagaaaagcuuuuauuuguguuuucaguuugaaaga

SEQ ID NO: 744645 - RNA, 64 nt, hsa
ggaaaagaagaguuccuguuaaaugaauagcuuuagcuuuuacaggggauuaugauuaaaagug

SEQ ID NO: 744646 - RNA, 63 nt, hsa
gauaaguuccaaauauguuaagggcuuuaauacaaaaagcaaaaauugucaguguuuggauga

SEQ ID NO: 744647 - RNA, 63 nt, hsa
acaauaagaaugaaucucagaaaauauuaaggaaaaaagcaaguuugaagagaccacaugggg

SEQ ID NO: 744648 - RNA, 63 nt, hsa
caaaauaagugggaaaugagaaguuauaccaauaaaaagcauuuaaaaauuuaggggauauug

SEQ ID NO: 744649 - RNA, 63 nt, hsa
gcccacgaaaauuagucuagcauugccggggguaaaaagcacacacugguccugcagcuuauu

SEQ ID NO: 744650 - RNA, 63 nt, hsa
gacacacauuccuuugaaauccacccaguguuuaaaaagcaacuuggaaauuuacacauuagc

SEQ ID NO: 744651 - RNA, 63 nt, hsa
auccuuucuuaguuauuugcuccuugcaaauuaaaaaagcaacuaagagaaagaaaaacauug

SEQ ID NO: 744652 - RNA, 63 nt, hsa
ugugcucugccuggagcuguuuccauaugauauaaaaagcaaguguaguauuccauuacuaug

SEQ ID NO: 744653 - RNA, 63 nt, hsa
gagucccucaggaaaaaaaaaaaauucuguuuuaaaaagcaaucugauucuuagcucuugaaa

SEQ ID NO: 744654 - RNA, 63 nt, hsa
guaccugccauuuuuacuaauuuuugucuuuaaaaaaagcaaaaaagcacauugaccuaaguu

SEQ ID NO: 744655 - RNA, 63 nt, hsa
cauuuuuacuaauuuuugucuuuaaaaaaagcaaaaaagcacauugaccuaaguugaaaauua

SEQ ID NO: 744656 - RNA, 63 nt, hsa
aaagaaaaaaagguuaagcauaaaaagaaagggaaaaagcagaaacacugcagaagacacaaa

SEQ ID NO: 744657 - RNA, 63 nt, hsa
agauccagugggaaaaaaaauagcguuucacauaaaaagcauagcagcagcucugaaaagaca

SEQ ID NO: 744658 - RNA, 63 nt, hsa
aaagugaaagagaaauugaaagggaaaaaagacaaaaagcauaaggcuccaaaacgaaagcaa

SEQ ID NO: 744659 - RNA, 63 nt, hsa
ccucaaccugcuguccuccagaaagcaccaaggaaaaagcagagaaugacagcaaacagauca

SEQ ID NO: 744660 - RNA, 63 nt, hsa
aaaaaauaaaauaaauauaaaauauaggcuuuaaaaaagcauagucuuauuaaccaugucugu

SEQ ID NO: 744661 - RNA, 63 nt, hsa
agguuaagagauccuguuucauaugcuguauuuaaaaagcaacaaugauaacaacauaguaac

SEQ ID NO: 744662 - RNA, 63 nt, hsa
cauccuccugaagccuucguuuucaagacuuuuaaaaagcacuucuacuugguuuuuugauca

SEQ ID NO: 744663 - RNA, 63 nt, hsa
uacuucauaauaugugaaaaacucggaucuuuuaaaaagcaucauagaucauuuuuccauaug

SEQ ID NO: 744664 - RNA, 63 nt, hsa
caaaauguguuacaugggaagaaaaagauuaagaaaaagcaagauaauuuugaagaaggacga

SEQ ID NO: 744665 - RNA, 63 nt, hsa
aucaugaccagcaaauacucauuuuaggaaaaaaaaaagcaugaucugaaaaauacuuuuggu

SEQ ID NO: 744666 - RNA, 63 nt, hsa
cacacacgagagaucauaaccaugugaaaaggcaaaaagcauguguuugcaacaucugauaac

SEQ ID NO: 744667 - RNA, 63 nt, hsa
acugaauauaucuaaaauuuccagcaauaaaaaaaaaagcauuuaacuugcaccaagcaagaa

SEQ ID NO: 744668 - RNA, 63 nt, hsa
acaguauucuuuauuuucuggguguuauauuuaaaaaagcaaguuuggauuuuuacaccuaau

SEQ ID NO: 744669 - RNA, 63 nt, hsa
ccacuuuguccuuucugcucuugugaagaaaaaaaaaagcauuuucgaggaaagaauuaugca

SEQ ID NO: 744670 - RNA, 63 nt, hsa
augaauuaaagcaacaaaaagauauugauuggcaaaaagcaagauauaagagauucauuugcu

SEQ ID NO: 744671 - RNA, 63 nt, hsa
cuuucucuccacucuggcuuguuuucagaaccuaaaaagcagacccaaguuuccuuucuccuc

SEQ ID NO: 744672 - RNA, 63 nt, hsa
uuaauauaaaagagguaggagucuguuauuuaaaaaaagcauuaaauuuaaaaaaaaacuguc

SEQ ID NO: 744673 - RNA, 63 nt, hsa
auccaucugggcacucauuuaaaguauaucuuaaaaaagcagcagcaagguaccuugccauuu

SEQ ID NO: 744674 - RNA, 63 nt, hsa
uguuucuuagggaaaacagucugagaaaugaauaaaaagcaugaaguacgugugugugugugu

SEQ ID NO: 744675 - RNA, 63 nt, hsa
cacacaacucugagaauacccacugccagcaucaaaaagcaaagauacuaauuuuuuaagcca

SEQ ID NO: 744676 - RNA, 63 nt, hsa
uaccuuaguacccuucaccuaacaucucucgguaaaaagcagacaagaucacaaauuacagua

SEQ ID NO: 744677 - RNA, 63 nt, hsa
ugaagaaauauuuuaaggaaaccuauuugaaaaaaaaagcaaagaccauuugauaaaagccug

SEQ ID NO: 744678 - RNA, 63 nt, hsa
gaauaauagaaaaauucuacuuuaauuuccauuaaaaagcaaauagcauugacacauuuaaag

SEQ ID NO: 744679 - RNA, 63 nt, hsa
cagauuuacaaguguaagcuauaugauuucuucaaaaagcaaaagcaauauaccuaauucauu

SEQ ID NO: 744680 - RNA, 63 nt, hsa
gucaaaacuagauuggaucuugguuugaaugaaaaaaagcauaaaauauucuugcaauaauug

SEQ ID NO: 744681 - RNA, 63 nt, hsa
gggaggcugcagaagccauuucucuuuguagauaaaaagcauuaucuaugauuguuguauaau

SEQ ID NO: 744682 - RNA, 63 nt, hsa; identical to SEQ ID NO: 293179

SEQ ID NO: 744683 - RNA, 63 nt, hsa
uaaauuaaaauggcauucuuaaagauuuucuucaaaaagcaauccuaaaugaaaguguguaaa

SEQ ID NO: 744684 - RNA, 63 nt, hsa
aacuugcauuauguguuaauuuucuugcaucuaaaaaagcauagaauuccuacucacacagcu

SEQ ID NO: 744685 - RNA, 63 nt, hsa
uguguuauaugacaggacaaagcaaaaacaaacaaaaagcaagccugugaauauaauuuaauu

SEQ ID NO: 744686 - RNA, 63 nt, hsa
uguuguuuucuguggguugcgacccaugcaaucaaaaagcaaaauuuugauugagauuuuuua

SEQ ID NO: 744687 - RNA, 63 nt, hsa
ugaauaagaaaauaauguuuaaagaaaaaaaaaaaaaagcaaaccuccaaaacguggaccuaa

SEQ ID NO: 744688 - RNA, 63 nt, hsa
auaugguugaagaaucaaaacaaaagcaaaaaaaaaaagcaaaaaaagaaaagagaaaaaaag

SEQ ID NO: 744689 - RNA, 63 nt, hsa
agaauucuugaaaaguuaacguagaaaauauccaaaaagcaguauuucuagaaaguguccaaa

SEQ ID NO: 744690 - RNA, 63 nt, hsa
auauccaaaaagcaguauuucuagaaaguguccaaaaagcaguauuucuuucccuugguugug

SEQ ID NO: 744691 - RNA, 63 nt, hsa
cuuugaagagcuugaagauuugaaagauucccaaaaaagcauuuuaaaguuuacauuuaaggg

SEQ ID NO: 744692 - RNA, 63 nt, hsa
aaaccuacaucuggcuagugcuuacauuugcucaaaaagcauguuguaugaagcugacugcca

SEQ ID NO: 744693 - RNA, 63 nt, hsa
agugagagauugagaaugaugcuuaauggaucaaaaaagcaauuaggaguauguuccugauuu

SEQ ID NO: 744694 - RNA, 63 nt, hsa
uacaccuucacagccaccccagaggacuucccuaaaaagcacaaggcgccugucaucgacauu

SEQ ID NO: 744695 - RNA, 63 nt, hsa
uguugacuucucauccccgaguucuuucaggccaaaaagcaaauggauuuccaccugacaaau

SEQ ID NO: 744696 - RNA, 63 nt, hsa
auauccauggcaagcuuuguauauaaaugaacaaaaaagcaagcaaagcaaaacaauaaacua

SEQ ID NO: 744697 - RNA, 63 nt, hsa
uucauaaaacauguaacacugaucuucagauagaaaaagcaaucuguuuauuuaccuguaagg

SEQ ID NO: 744698 - RNA, 63 nt, hsa
gugagguuggaagauacccuaucuuuuuuauucaaaaagcacaaucaaucuuuuguuugaaaa

SEQ ID NO: 744699 - RNA, 53 nt, hsa; identical to SEQ ID NO: 293196

SEQ ID NO: 744700 - RNA, 63 nt, hsa
ugucuugucuaagguggaaaucuugugcuguuuaaaaagcagauuuuauucuuugccuuuugc

SEQ ID NO: 744701 - RNA, 63 nt, hsa
gaaaaaugcuggaacaugcuugauguauuauguaaaaagcauauuuaaacaaggguccucaac

SEQ ID NO: 744702 - RNA, 63 nt, hsa
auugccccuuugcagagaaaaaaaaaaacuuaaaaaaagcacaugccuacugcugccuguccc

SEQ ID NO: 744703 - RNA, 63 nt, hsa
gguuugacuggccuccagauuccaguuauuuuuaaaaagcaacuuaccacuaaauccuugagu

SEQ ID NO: 744704 - RNA, 63 nt, hsa
aaaccuuuuagugacaaaauccuaauauguggaaaaaagcauaugcauaaaggaauaauauug

SEQ ID NO: 744705 - RNA, 63 nt, hsa
uugcuuugguuggugcauuuaaguauccaacucaaaaagcauaucaaauauuuuggguacuag

SEQ ID NO: 744706 - RNA, 63 nt, hsa
ucagcauauacauuucagccaaagccauagaagaaaaagcaauaguugcuugaauuaugauca

SEQ ID NO: 744707 - RNA, 63 nt, hsa
ugaaaucagaagaacaaaaaagaagagcaagagaaaaagcaaauuugguaaguugugugugcu

SEQ ID NO: 744708 - RNA, 63 nt, hsa
ccagauuuuuuauaugucugcauguuuaaaaaaaaaaagcaacaaaagaaaaugcacucuaac

SEQ ID NO: 744709 - RNA, 63 nt, hsa
ugcugaauacuuuuuauaaugugaugauuauuaaaaaagcaaaaauuuuggucacuuccaagc

SEQ ID NO: 744710 - RNA, 63 nt, hsa
uaauaaaagaagacaaaauuuuuuaaauguuagaaaaagcagaucugucauugcaaaguaaca

SEQ ID NO: 744711 - RNA, 63 nt, hsa
auauauugguaguaauuacuguaauuauucaacaaaaagcauauccguucaaaaauuuuucca

SEQ ID NO: 744712 - RNA, 63 nt, hsa
uuuuuuccuuuguuuuaaaacugugguuuuuuaaaaaagcaauaauuaacucagaccucacua

SEQ ID NO: 744713 - RNA, 63 nt, hsa
ucuuuguuuuucuuuuuuugggggaggaggggaaaaaagcagcaauacuguguuuggaaauua

SEQ ID NO: 744714 - RNA, 63 nt, hsa
ugauaauaucacaacccagaaguaaccaccuuuaaaaagcaacccccauguaugccuauaugu

SEQ ID NO: 744715 - RNA, 63 nt, hsa
ucauagaaaacuugaaaaaugcagaaauguauaaaaaagcaaaaaugauuacugauaauauca

SEQ ID NO: 744716 - RNA, 63 nt, hsa
uauguguagauauaacuuaaauauggagcuuucaaaaagcacaaauaggcuggacaugguggc

SEQ ID NO: 744717 - RNA, 63 nt, hsa
ccugagugacagagagagauucaaaaaacaaaaaaaaagcaaaaauauacuuugcuauugggu

SEQ ID NO: 744718 - RNA, 63 nt, hsa
ggaaugagggagagaagggggcuguagaguuugaaaaagcauauucaauauuaaaauaguuuu

SEQ ID NO: 744719 - RNA, 63 nt, hsa
gacuggggaggccucagaaucauggugggaggcaaaaagcacuucuuacauggcggcagcaag

SEQ ID NO: 744720 - RNA, 63 nt, hsa
gccuugcuuuuagagaaugcccaauaaggcaagaaaaagcauaguaacuugugcuuugagagc

SEQ ID NO: 744721 - RNA, 63 nt, hsa
aaaaauuaaaacauugccauauguugaauuuuuaaaaagcacuuggagugagcgaacauuucc

SEQ ID NO: 744722 - RNA, 63 nt, hsa
aagaaauuugggacuuuuucauguugaaaggagaaaaagcacaaguucccuaguuaccauuua

SEQ ID NO: 744723 - RNA, 63 nt, hsa
uuagaaguguuaggguuagauaaaggaaaagugaaaaagcauaagaaauuugggacuuuuuca

SEQ ID NO: 744724 - RNA, 63 nt, hsa
ggauuacaagcugucucucugacaccagugguaaaaaagcaaguagaauaguuucugagucug

SEQ ID NO: 744725 - RNA, 63 nt, hsa
uaggggccauaucauucauggccaaaaaaaaccaaaaagcaaaaaacaaaaacaagucccaug

SEQ ID NO: 744726 - RNA, 63 nt, hsa
caauugucuaauuuacagcaguugugaucccacaaaaagcaaguuuauaccucagauuggggu

SEQ ID NO: 744727 - RNA, 63 nt, hsa
caguaaauccaugucuuuguuuguuuuucuauuaaaaagcaaucaagaaagauaaugugaaaa

SEQ ID NO: 744728 - RNA, 63 nt, hsa
auugacuccaaugcagaauagugagaaaucaacaaaaagcaaaauaagacaauuccagacacu

SEQ ID NO: 744729 - RNA, 63 nt, hsa
gucuggaccacuggggaaaauauuuuucuuuucaaaaagcagccccuucagucugcguuccca

SEQ ID NO: 744730 - RNA, 63 nt, hsa
aaaauuaugcagggccccuaugugggauuuuuuaaaaagcaaacugguguguauucucaugug

SEQ ID NO: 744731 - RNA, 63 nt, hsa
cgaaacucugucucaaaaaagaaaaaaaagaaaaaaaagcacgugaccuuaugaggcucucgc

SEQ ID NO: 744732 - RNA, 63 nt, hsa
uuuuacuaccucuggguuagccaaacaaccuucaaaaagcauuguuauuuagguuaaauaucu

SEQ ID NO: 744733 - RNA, 63 nt, hsa
aggaagugguguucuuuauacaucaauuauuacaaaaagcagugaauuguaagugugaggugu

SEQ ID NO: 744734 - RNA, 63 nt, hsa
gucacuaagcagaauuuagaaagagaaguuuuuaaaaagcaaacaguguaaaaaaagucaucu

SEQ ID NO: 744735 - RNA, 59 nt, hsa; identical to SEQ ID NO: 293232

SEQ ID NO: 744736 - RNA, 63 nt, hsa
aaugauuuucucugccuugagauuugcaucaagaaaaagcaccucucuucaccugaaagcuuu

SEQ ID NO: 744737 - RNA, 63 nt, hsa
ugguucugugauuuggaugucaacaacuucccuaaaaagcaccaguguguuagguucuaaugu

SEQ ID NO: 744738 - RNA, 63 nt, hsa
cuaagacaugugaggaggaaaaggaaaaaaagcaaaaagcaagggagaaaagagaaaccggga

SEQ ID NO: 744739 - RNA, 63 nt, hsa
agcaggccuaagacaugugaggaggaaaaggaaaaaaagcaaaaagcaagggagaaaagagaa

SEQ ID NO: 744740 - RNA, 63 nt, hsa
uugagcaauuucccccuaaaccaacugaaggcuaaaaagcaacaggccauugugaaccaaugc

SEQ ID NO: 744741 - RNA, 63 nt, hsa
aaaguucaacuuggugacacucuauaagauuccaaaaagcacauauuagugcagccaaguagc

SEQ ID NO: 744742 - RNA, 63 nt, hsa
aauauguguggcagugaagagaacaggucuuucaaaaagcauuugauuauuuuuuuuaaauac

SEQ ID NO: 744743 - RNA, 63 nt, hsa
uacuauugcucuuacuugaaaacuuuuuuucaaaaaaagcacaaauuaaaguaguaaauucau

SEQ ID NO: 744744 - RNA, 63 nt, hsa
acaucuuagguauaacagcacaauuucaccuugaaaaagcaccaaaauuaugguguuccugaa

SEQ ID NO: 744745 - RNA, 63 nt, hsa
ugaguauugggaaaguuaauucagauccuacucaaaaagcaucuucacauauuaaaagauuca

SEQ ID NO: 744746 - RNA, 63 nt, hsa
gagucccugaguauaaaggaaaaacagcaaaacaaaaagcaaacaaaaaaaaacugcaaaagu

SEQ ID NO: 744747 - RNA, 63 nt, hsa
uggagauggcagaagugaaagcuggccaucugcaaaaagcagauaagugaguuugaaccuuuu

SEQ ID NO: 744748 - RNA, 63 nt, hsa
aagucuuuaggagaguagaaaacacaauuaacuaaaaagcagggacaucugaaagagacguau

SEQ ID NO: 744749 - RNA, 63 nt, hsa
gguaaaagggaugcuagaaauucaacugaagaaaaaaagcaagucaaguacguauucagcauu

SEQ ID NO: 744750 - RNA, 63 nt, hsa
aaagagcucccaucugaucugcagucauuacagaaaaagcaaauauucccucaacaucagaac

SEQ ID NO: 744751 - RNA, 63 nt, hsa
uaccggacacaccucugcuccaaaggaaauccaaaaaagcaaacacaagaaaucaaaauccaa

SEQ ID NO: 744752 - RNA, 63 nt, hsa
uggcuuuaaguaaaaauccaaaaaguuuuuuuaaaaaagcaaaggaagcauacuugugaacua

SEQ ID NO: 744753 - RNA, 63 nt, hsa
auuuugucucauuugccaaaaaaaaaaaaaaaaaaaaagcaaacccccuaugguugauauugu

SEQ ID NO: 744754 - RNA, 63 nt, hsa
ucucagguaagccauuuuauaaaacaagaagauaaaaagcacuguugaggcaguguuugcuuu

SEQ ID NO: 744755 - RNA, 63 nt, hsa
uccuuugguacaaaaggguugaacgucaggcuaaaaaagcagccaugcauuuauuauuaaaca

SEQ ID NO: 744756 - RNA, 63 nt, hsa
acuaaugaaaauaauguuuucccauauauuauuaaaaagcauacagucuaaauaauaaacagu

SEQ ID NO: 744757 - RNA, 63 nt, hsa
ugaggcucuuucuauaaauacauauuguuuaaaaaaaagcaagaaaaaaaggaaaacaaagga

SEQ ID NO: 744758 - RNA, 63 nt, hsa
gcaacagagcgagacccugucuccaaaaaaaaaaaaaagcaauguuuauauuauaaaagagug

SEQ ID NO: 744759 - RNA, 63 nt, hsa
uggcaguguuuugguucagacaccuguucacagaaaaagcaugaugggaaaauauuuccugac

SEQ ID NO: 744760 - RNA, 63 nt, hsa
uuuuguaauuguguaaaaaauggaaaaaaacauaaaaagcagaauuuuaaugugaagacauuu

SEQ ID NO: 744761 - RNA, 63 nt, hsa
aggucacuuuuaugccacauuauuuuaauugcaaaaaagcaucuauauauggaggaggguggg

SEQ ID NO: 744762 - RNA, 63 nt, hsa
uuuccagcuuuaucaaagacauguuugaaaaauaaaaagcauccaagugagagcuggugagac

SEQ ID NO: 744763 - RNA, 63 nt, hsa
cugcacugcacuuauaaagcaaaucuauuagaaaaaaagcauuuuucuaaaugcucaaauguu

SEQ ID NO: 744764 - RNA, 63 nt, hsa
acugucaaguggauggauauucuagcgcucccaaaaaagcacuauggccuuauaugcagggaa

SEQ ID NO: 744765 - RNA, 63 nt, hsa
agcacuuuuuaaaacaaacaaacaaacaaaacaaaaaagcaaaccacauuuguuaucucaaau

SEQ ID NO: 744766 - RNA, 63 nt, hsa
gauaaugggcuuuguuagcacuuucaaaaaaaaaaaaagcaaaccauacuuguccacuguccu

SEQ ID NO: 744767 - RNA, 63 nt, hsa
cuuauucaaagacuagguuauuuucaacugggaaaaaagcagugcuaacaggauauuguucug

SEQ ID NO: 744768 - RNA, 63 nt, hsa
uccaccagggggaaggcuggcacaaggagaaaaaaaaagcaagcaucagcgaauaguauagug

SEQ ID NO: 744769 - RNA, 63 nt, hsa
cucuguauguuguauuugaucauauuuaaaggaaaaaagcaagcuuauaagcuuucaugaagu

SEQ ID NO: 744770 - RNA, 63 nt, hsa
gacacagccgccacucccccagucuacuucuuuaaaaagcauuuaacagguuaguauuggcau

SEQ ID NO: 744771 - RNA, 63 nt, hsa
ucaaagaaaugugaaauuaaaaagaauucuuccaaaaagcagcuuccauuaaaaugggaauuc

SEQ ID NO: 744772 - RNA, 63 nt, hsa
ggagaaguagcuuaaauucacuaauauuaauuuaaaaagcagcaugaacccucuacuuauaaa

SEQ ID NO: 744773 - RNA, 64 nt, hsa; identical to SEQ ID NO: 719950

SEQ ID NO: 744774 - RNA, 64 nt, hsa; identical to SEQ ID NO: 719951

SEQ ID NO: 744775 - RNA, 64 nt, hsa; identical to SEQ ID NO: 719952

SEQ ID NO: 744776 - RNA, 64 nt, hsa; identical to SEQ ID NO: 719953

SEQ ID NO: 744777 - RNA, 64 nt, hsa
gggcgggagagcgaugcuuggauuuuuguuuccuauuagaaaccaacaguuuuguucuaauuuc

SEQ ID NO: 744778 - RNA, 64 nt, hsa
uuuuuuuuuucuuuuuuuaggcauauguaguaauauuagaaacauuuaauuugggaaacuuuga

SEQ ID NO: 744779 - RNA, 64 nt, hsa
auacagauaaaauacauucuuuuaauucugggaaauuagaaaaaguggggugaucuuuccagga

SEQ ID NO: 744780 - RNA, 64 nt, hsa
auaaucuuacauuuaaaauuguauuccuacacauauuagaaacucuucuaauaaaugaaguaaa

SEQ ID NO: 744781 - RNA, 64 nt, hsa
uucuuguguugauuggagaauuuuucuguauguaauuagaaaaaaauguaaaacaugauuuaug

SEQ ID NO: 744782 - RNA, 64 nt, hsa
uuauuaccaaacaagguuuuguuuauaugauuguauuagaaaugcucagacuuccccagaaaug

SEQ ID NO: 744783 - RNA, 64 nt, hsa
uguggaaaauauuagaaacuucuauguggaaaauauuagaaacuacagaguuugcgauauuuag

SEQ ID NO: 744784 - RNA, 64 nt, hsa
uuggauuugcagcuguugguacuauguggaaaauauuagaaacuucuauguggaaaauauuaga

SEQ ID NO: 744785 - RNA, 64 nt, hsa
uaugcaguguguucuccaaacaugauggaacgaaauuagaaaucaauaaaauuugggaaauuca

SEQ ID NO: 744786 - RNA, 64 nt, hsa
agauuuuauuaccaaacuuauagaaauaaaaauuauuagaaagaaauacuaugaacaauugaau

SEQ ID NO: 744787 - RNA, 64 nt, hsa
uuuucugugacuaaauagcaauaauaaguggaaaauuagaaauuauuuccagguauuauauuug

SEQ ID NO: 744788 - RNA, 64 nt, hsa
ucuucagucauacagcaagacacaugagacauagauuagaaaacauguuguacaauuuuaauuu

SEQ ID NO: 744789 - RNA, 64 nt, hsa
gggaaauaucauucuuacuaugguuagaaagugaauuagaaauuucagcucaguuucuauuuua

SEQ ID NO: 744790 - RNA, 64 nt, hsa
aauugaccucuuugucagauccuuaucaccaaacauuagaaaagaucucauaacuuuauacagc

SEQ ID NO: 744791 - RNA, 64 nt, hsa
uguaaagacauuguuuuucagacuuuucagaucaauuagaaaaaugucauugcuuuaaaaucau

SEQ ID NO: 744792 - RNA, 64 nt, hsa
aaauuaagaacuuagacuuuuuuaaaacuuuuguauuagaaaugcgcauacauuuauaugaaua

SEQ ID NO: 744793 - RNA, 64 nt, hsa
ccgccaccucaaugcauugucaguaggauacauuauuagaaacuguuagggucuuucccaggac

SEQ ID NO: 744794 - RNA, 64 nt, hsa
ccgccaccucaaugcauugucaguagaauacauuauuagaaacuguuaaggucuuucccgggac

SEQ ID NO: 744795 - RNA, 64 nt, hsa
uauggacucagcuagcuguucaaugaaauugugaauuagaaacauuuuuaaaaguuuuugaaag

SEQ ID NO: 744796 - RNA, 64 nt, hsa
aagaauucuuagacuuguauuccuauuuaucuauauuagaaauauuguaugagcaaauuugcag

SEQ ID NO: 744797 - RNA, 64 nt, hsa
aagaacuucucauuuucuaucagauaagaaucacauuagaaacuaaguacaagauuagacaaca

SEQ ID NO: 744798 - RNA, 64 nt, hsa
accagcuuaauuuccuuaggaagggcucauguccauuagaaaauggagucaucuuaugugcuua

SEQ ID NO: 744799 - RNA, 64 nt, hsa
agaauccugagacugccuggaggugagguagaaaauuagaaauacuuccuaauucuucucaagg

SEQ ID NO: 744800 - RNA, 64 nt, hsa
cucuguguguguaccuguuguauguccuaaacuuauuagaaaauuuuauauacuuuuuuacaug

SEQ ID NO: 744801 - RNA, 64 nt, hsa
guguuagaucuuguaggaaaccaagauuagaaacauuagaaauuugcagaauuuaagaaauuau

SEQ ID NO: 744802 - RNA, 64 nt, hsa
acaagcuuaguguuagaucuuguaggaaaccaagauuagaaacauuagaaauuugcagaauuua

SEQ ID NO: 744803 - RNA, 64 nt, hsa
aauccucaagcaauaacaagaaaaaaggcccacaauuagaaaaauuuacauuuaaaaaaaaugu

SEQ ID NO: 744804 - RNA, 64 nt, hsa
ggauuauaauaugguucaacaaauguugaugaguauuagaaauguacauuagaaauauuagaaa

SEQ ID NO: 744805 - RNA, 64 nt, hsa
guucaacaaauguugaugaguauuagaaauguacauuagaaauauuagaaauguuuaugacuau

SEQ ID NO: 744806 - RNA, 64 nt, hsa
auguugaugaguauuagaaauguacauuagaaauauuagaaauguuuaugacuauuagaaaagu

SEQ ID NO: 744807 - RNA, 64 nt, hsa
auguacauuagaaauauuagaaauguuuaugacuauuagaaaaguacaggguauugggcguucc

SEQ ID NO: 744808 - RNA, 64 nt, hsa
auuccuuauacugaugaggcacuuuauauuuuuuauuagaaaguagaacuaauuuuagauuuuu

SEQ ID NO: 744809 - RNA, 64 nt, hsa
aggagaaacucaauacaaagacaaguacaacuccauuagaaaaauucagacagcaucuucucua

SEQ ID NO: 744810 - RNA, 64 nt, hsa
aagugcaaaacagguguucuuaucuaaaacgucaauuagaaaauuaucugcgguuguuaaucua

SEQ ID NO: 744811 - RNA, 64 nt, hsa
uauaaauaaaauuuuaaaauccuuucauaguucuauuagaaauaaguaguaaauuuugauauau

SEQ ID NO: 744812 - RNA, 64 nt, hsa
uuuaugcaggaaaccuccugcaaagcugaaacugauuagaaaauucuuuauauuuuaaaauagc

SEQ ID NO: 744813 - RNA, 64 nt, hsa
gacaucuccuagggaaugaugaaaacagcaggcuauuagaaaauuauuucauauaguucucgug

SEQ ID NO: 744814 - RNA, 64 nt, hsa
gagcuuccuaaugcauguguugcauuauugcagcauuagaaaaggagagguagcauuuuugcug

SEQ ID NO: 744815 - RNA, 64 nt, hsa
cagcacuuugauucuauguugaguuuguuucuauauuagaaaagcagcaagucaguaauccccc

SEQ ID NO: 744816 - RNA, 64 nt, hsa
gcugcagagaaacuaugcauuaggucucuuuucaauuagaaaccuuuacuauuuccaauguaug

SEQ ID NO: 744817 - RNA, 64 nt, hsa
uaaaugggguguucacagugacuuggauacaccaauuagaaauuaaauaagcaaauauauauau

SEQ ID NO: 744818 - RNA, 64 nt, hsa
agcuucagaccaaauucaaauugaauuugaauaaauuagaaauacugugcauacauaaccuucu

SEQ ID NO: 744819 - RNA, 64 nt, hsa
ucuugcccaacuaaacccagaacucaaacuuaacauuagaaaauaagguccagggccggacaca

SEQ ID NO: 744820 - RNA, 64 nt, hsa
ccacaaauggaauccucacuguauccacuaggagauuagaaauuaagguuucuucacuacuucu

SEQ ID NO: 744821 - RNA, 64 nt, hsa
aaaggcaguucugcaagauguacuaaauauguauauuagaaauuauagaaaaucauguuguccg

SEQ ID NO: 744822 - RNA, 64 nt, hsa
ccaaugcaaaauacaguugucauuaauccugcacauuagaaauuauuagaaacauauuacuuuu

SEQ ID NO: 744823 - RNA, 64 nt, hsa
auacaguugucauuaauccugcacauuagaaauuauuagaaacauauuacuuuuuaacuuuaaa

SEQ ID NO: 744824 - RNA, 64 nt, hsa
ggccaucauagcugauccuauggucaccaaaaggauuagaaagaaauauggacaacucugucca

SEQ ID NO: 744825 - RNA, 57 nt, hsa
gagaaaaaccuuaugaaugaauuggauauuagaaauuuccagccacaagucagccuc

SEQ ID NO: 744826 - RNA, 64 nt, hsa
uccagauucuggauccauaccccauaccuacugaauuagaaacucuaggggaugaauaguggug

SEQ ID NO: 744827 - RNA, 64 nt, hsa
gggaguccucagaguugcaguucaauucauuuuaauuagaaaaguaugaaagagguauaacacu

SEQ ID NO: 744828 - RNA, 64 nt, hsa
gaucuaaccuggcuuguuuagggccauaccacuaauuagaaaaucugugcuagaaccugugucu

SEQ ID NO: 744829 - RNA, 64 nt, hsa
uaaaauuuagaguauaaauugucuuauauuucaaauuagaaaaguucaaaugaaguuuaauugu

SEQ ID NO: 744830 - RNA, 64 nt, hsa
aagaaauauaccuacugcuauccguaugugguggauuagaaauguguuaaaucugcaaaaggua

SEQ ID NO: 744831 - RNA, 64 nt, hsa
gucucuguuggugguacaucuuguugaauucaauauuagaaaguauuucuuuuugggguaauau

SEQ ID NO: 744832 - RNA, 64 nt, hsa
aauuauccugaacucuucugcaaaaauggauauuauuagaaauuagaaaaaaauuacuaauuuu

SEQ ID NO: 744833 - RNA, 64 nt, hsa
cugaacucuucugcaaaaauggauauuauuagaaauuagaaaaaaauuacuaauuuuacacauu

SEQ ID NO: 744834 - RNA, 64 nt, hsa
auuuugugcaaaagcuucaaauuaaaacagcugcauuagaaaaagaggcgcuucuccccucccc

SEQ ID NO: 744835 - RNA, 64 nt, hsa
cuauuucugaauuacgaaugaaauccgaguaccuauuagaaaugaguuaugcaaauuuagaugc

SEQ ID NO: 744836 - RNA, 64 nt, hsa
agaaaugaguuaugcaaauuuagaugcaaauaacauuagaaaaaaaagauucuuccauaauuaa

SEQ ID NO: 744837 - RNA, 64 nt, hsa
gggcucaaacugagaaacauugaguuauauggcuauuagaaauccacauucuuacacaagaaag

SEQ ID NO: 744838 - RNA, 64 nt, hsa
uguauccauuaaaguaacuuuuuuaacuaugagaauuagaaaauaagggacaacagggguuaaa

SEQ ID NO: 744839 - RNA, 64 nt, hsa
uuccaaacaaaucuuucuacgcuuaaaugaucaaauuagaaaaaccaauuccuauaauuaauau

SEQ ID NO: 744840 - RNA, 64 nt, hsa
uucuugugcuugcuucggcagcauauauacugaaauuagaaaaagaaaacuuuucuuuuuuauu

SEQ ID NO: 744841 - RNA, 64 nt, hsa
ugguuugagaaacaggcugacacuauucucuuugauuagaaaauaaacucauaaaacucauaau

SEQ ID NO: 744842 - RNA, 64 nt, hsa
auccagaagccagaggauggacuaagugggagaaauuagaaaacaaaacgaacucugguugggg

SEQ ID NO: 744843 - RNA, 64 nt, hsa
aacuugaaaaucagcuuuggccaucuaccugagaauuagaaagucugauuuuuggaauuagaaa

SEQ ID NO: 744844 - RNA, 64 nt, hsa
aucuaccugagaauuagaaagucugauuuuuggaauuagaaaucaugauuguaggcugggcaca

SEQ ID NO: 744845 - RNA, 64 nt, hsa
agcugcugcucaguauugaagacuuuacaaggagauuagaaaucuuuggaaaacauaugugaug

SEQ ID NO: 744846 - RNA, 64 nt, hsa
ccuuccacccauuaaggaaacagauuuguuauaaauuagaaaugugcagguuuguuguuucaug

SEQ ID NO: 744847 - RNA, 64 nt, hsa
accccaugaaagccuugaaagugggaaagcuuucauuagaaauuugcaccucaucaugccccag

SEQ ID NO: 744848 - RNA, 64 nt, hsa
auauuuacuguggcuugauuuguaguagccaaaaauuagaaacaacugagaaagcccaucacga

SEQ ID NO: 744849 - RNA, 64 nt, hsa
gaagaagucuaauaaaucuagaaggaauuagaggauuagaaaaaucaccauuuucuagaccuua

SEQ ID NO: 744850 - RNA, 64 nt, hsa
acaaucccuguugucugaccacaguuuaaaauuaauuagaaacuaucaaaaauguggcuuaaaa

SEQ ID NO: 744851 - RNA, 64 nt, hsa
gugaauguaggaaguucuucagcacuugagcugcauuagaaauuucaugccaaaaaugaauuuc

SEQ ID NO: 744852 - RNA, 64 nt, hsa
gcuaaugaaugcagaaagaauaauagaaaauuauauuagaaaaacuauuguguaacacauaaug

SEQ ID NO: 744853 - RNA, 64 nt, hsa
gcaaccagaaguuaaggagguaaaguucuucuuuauuagaaaauuccaggcuaaugaaugcaga

SEQ ID NO: 744854 - RNA, 64 nt, hsa
aauaaauauuuauuugugcacuacaauucaaagcauuagaaacauugagaguucaagugcuguu

SEQ ID NO: 744855 - RNA, 64 nt, hsa
ucauucugugaccuuuaccauuuuuugucaaaauauuagaaacucucacacucucaguuacaaa

SEQ ID NO: 744856 - RNA, 64 nt, hsa
ugcgaucugcucaguaauauaauuugccauuuuuauuagaaauuuaauuucuucaugugauguc

SEQ ID NO: 744857 - RNA, 64 nt, hsa
uacuuuacuaaauuaauacuccuccuuuuacagaauuagaaaaguuaacauuuaucuuuaggug

SEQ ID NO: 744858 - RNA, 64 nt, hsa
cugauucacagcuuauuauccaauucaaaaauaaauuagaaaaauauaugcuuacauuuuucac

SEQ ID NO: 744859 - RNA, 64 nt, hsa
ugaaagaaaguguuaaaacugaaggccucacuuaauuagaaacgugauaaauauauggacaaau

SEQ ID NO: 744860 - RNA, 64 nt, hsa
acuugucaaacuugucaagaaugagaaaagccaaauuagaaaauccuauguccuaguuuccuua

SEQ ID NO: 744861 - RNA, 64 nt, hsa
accuuuauaaaaauauaugauucuauaaagaaucauuagaaauuaugaguggaaauucuccaga

SEQ ID NO: 744862 - RNA, 64 nt, hsa
auguucugguuuuggcccucuugcagaaagaagcauuagaaaaauuacuuuaaaaguagcuaua

SEQ ID NO: 744863 - RNA, 64 nt, hsa; identical to SEQ ID NO: 580316

SEQ ID NO: 744864 - RNA, 64 nt, hsa; identical to SEQ ID NO: 580317

SEQ ID NO: 744865 - RNA, 64 nt, hsa; identical to SEQ ID NO: 580318

SEQ ID NO: 744866 - RNA, 64 nt, hsa; identical to SEQ ID NO: 580319

SEQ ID NO: 744867 - RNA, 64 nt, hsa; identical to SEQ ID NO: 580320

SEQ ID NO: 744868 - RNA, 64 nt, hsa; identical to SEQ ID NO: 580321

SEQ ID NO: 744869 - RNA, 64 nt, hsa; identical to SEQ ID NO: 580322

SEQ ID NO: 744870 - RNA, 64 nt, hsa; identical to SEQ ID NO: 580323

SEQ ID NO: 744871 - RNA, 64 nt, hsa; identical to SEQ ID NO: 580324

SEQ ID NO: 744872 - RNA, 64 nt, hsa; identical to SEQ ID NO: 580325

SEQ ID NO: 744873 - RNA, 64 nt, hsa; identical to SEQ ID NO: 580326

SEQ ID NO: 744874 - RNA, 64 nt, hsa; identical to SEQ ID NO: 580327

SEQ ID NO: 744875 - RNA, 64 nt, hsa; identical to SEQ ID NO: 580328

SEQ ID NO: 744876 - RNA, 64 nt, hsa; identical to SEQ ID NO: 580329

SEQ ID NO: 744877 - RNA, 64 nt, hsa; identical to SEQ ID NO: 282946

SEQ ID NO: 744878 - RNA, 64 nt, hsa; identical to SEQ ID NO: 282947

SEQ ID NO: 744879 - RNA, 64 nt, hsa; identical to SEQ ID NO: 282948

SEQ ID NO: 744880 - RNA, 64 nt, hsa; identical to SEQ ID NO: 282949

SEQ ID NO: 744881 - RNA, 64 nt, hsa; identical to SEQ ID NO: 282950

SEQ ID NO: 744882 - RNA, 64 nt, hsa; identical to SEQ ID NO: 282951

SEQ ID NO: 744883 - RNA, 64 nt, hsa; identical to SEQ ID NO: 282952

SEQ ID NO: 744884 - RNA, 64 nt, hsa; identical to SEQ ID NO: 282953

SEQ ID NO: 744885 - RNA, 64 nt, hsa
ggguugggggagccccacagcuuucuggcuggccaguggcaaucuacuggccuuguccagaggc

SEQ ID NO: 744886 - RNA, 64 nt, hsa
ggggcuggcuggauguucucuuuacugaaaagacaguggcaaggaaaagcacaagugcaugagu

SEQ ID NO: 744887 - RNA, 64 nt, hsa
aacaacuacauaaaauauguuucuauuuagaugaaguggcaaacuaaucuguaguguuaaaaau

SEQ ID NO: 744888 - RNA, 64 nt, hsa
uccaauagaugagaauuuuccguaucuugaucugaguggcaaauuguaaacuuaaaauauauau

SEQ ID NO: 744889 - RNA, 64 nt, hsa
ggaaguguuuccuaggaggaaaauuccauuagagaguggcaauaggaugagguuucuucagggu

SEQ ID NO: 744890 - RNA, 64 nt, hsa
gaagcaagugaggccugacaugguugucaucacuaguggcaaaugaccuuccaaguaagcagau

SEQ ID NO: 744891 - RNA, 64 nt, hsa; identical to SEQ ID NO: 53018

SEQ ID NO: 744892 - RNA, 64 nt, hsa; identical to SEQ ID NO: 53019

SEQ ID NO: 744893 - RNA, 64 nt, hsa; identical to SEQ ID NO: 53020

SEQ ID NO: 744894 - RNA, 64 nt, hsa; identical to SEQ ID NO: 53021

SEQ ID NO: 744895 - RNA, 64 nt, hsa; identical to SEQ ID NO: 53022

SEQ ID NO: 744896 - RNA, 64 nt, hsa; identical to SEQ ID NO: 53023

SEQ ID NO: 744897 - RNA, 64 nt, hsa; identical to SEQ ID NO: 53024

SEQ ID NO: 744898 - RNA, 64 nt, hsa; identical to SEQ ID NO: 53025

SEQ ID NO: 744899 - RNA, 64 nt, hsa; identical to SEQ ID NO: 53026

SEQ ID NO: 744900 - RNA, 64 nt, hsa; identical to SEQ ID NO: 53027

SEQ ID NO: 744901 - RNA, 64 nt, hsa; identical to SEQ ID NO: 53028

SEQ ID NO: 744902 - RNA, 64 nt, hsa; identical to SEQ ID NO: 53029

SEQ ID NO: 744903 - RNA, 64 nt, hsa; identical to SEQ ID NO: 53030

SEQ ID NO: 744904 - RNA, 64 nt, hsa; identical to SEQ ID NO: 53031

SEQ ID NO: 744905 - RNA, 64 nt, hsa; identical to SEQ ID NO: 53032

SEQ ID NO: 744906 - RNA, 64 nt, hsa; identical to SEQ ID NO: 53033

SEQ ID NO: 744907 - RNA, 64 nt, hsa; identical to SEQ ID NO: 53034

SEQ ID NO: 744908 - RNA, 64 nt, hsa; identical to SEQ ID NO: 53035

SEQ ID NO: 744909 - RNA, 64 nt, hsa; identical to SEQ ID NO: 53036

SEQ ID NO: 744910 - RNA, 64 nt, hsa; identical to SEQ ID NO: 53037

SEQ ID NO: 744911 - RNA, 64 nt, hsa; identical to SEQ ID NO: 53038

SEQ ID NO: 744912 - RNA, 64 nt, hsa; identical to SEQ ID NO: 53039

SEQ ID NO: 744913 - RNA, 64 nt, hsa; identical to SEQ ID NO: 53040

SEQ ID NO: 744914 - RNA, 64 nt, hsa; identical to SEQ ID NO: 53041

SEQ ID NO: 744915 - RNA, 64 nt, hsa; identical to SEQ ID NO: 53042

SEQ ID NO: 744916 - RNA, 64 nt, hsa; identical to SEQ ID NO: 53043

SEQ ID NO: 744917 - RNA, 64 nt, hsa; identical to SEQ ID NO: 53044

SEQ ID NO: 744918 - RNA, 64 nt, hsa; identical to SEQ ID NO: 53045

SEQ ID NO: 744919 - RNA, 64 nt, hsa; identical to SEQ ID NO: 53046

SEQ ID NO: 744920 - RNA, 64 nt, hsa; identical to SEQ ID NO: 53047

SEQ ID NO: 744921 - RNA, 64 nt, hsa; identical to SEQ ID NO: 53048

SEQ ID NO: 744922 - RNA, 64 nt, hsa; identical to SEQ ID NO: 53049

SEQ ID NO: 744923 - RNA, 64 nt, hsa; identical to SEQ ID NO: 53050

SEQ ID NO: 744924 - RNA, 64 nt, hsa; identical to SEQ ID NO: 53051

SEQ ID NO: 744925 - RNA, 64 nt, hsa; identical to SEQ ID NO: 53052

SEQ ID NO: 744926 - RNA, 64 nt, hsa; identical to SEQ ID NO: 53053

SEQ ID NO: 744927 - RNA, 64 nt, hsa; identical to SEQ ID NO: 53054

SEQ ID NO: 744928 - RNA, 64 nt, hsa; identical to SEQ ID NO: 53055

SEQ ID NO: 744929 - RNA, 64 nt, hsa; identical to SEQ ID NO: 53056

SEQ ID NO: 744930 - RNA, 64 nt, hsa; identical to SEQ ID NO: 53057

SEQ ID NO: 744931 - RNA, 64 nt, hsa; identical to SEQ ID NO: 53058

SEQ ID NO: 744932 - RNA, 64 nt, hsa; identical to SEQ ID NO: 53059

SEQ ID NO: 744933 - RNA, 64 nt, hsa
cuauagaugauccauuggaguguggauggcuaaugagugugagguaucacuuaagggaguuggu

SEQ ID NO: 744934 - RNA, 64 nt, hsa
caucagggcuauuccgcagcuugcagcaagcacagagugugaccucccaggauuugcugacagc

SEQ ID NO: 744935 - RNA, 64 nt, hsa
cagaaugugagugugagagugauaaugcaggggugagugugagagggacugcguuugcauuuuu

SEQ ID NO: 744936 - RNA, 64 nt, hsa
cgccugagggugggcaugagucuugccagaaugugagugugagagugauaaugcaggggugagu

SEQ ID NO: 744937 - RNA, 64 nt, hsa
uaugaucacagagcaacggagcaaaggcuuucgggagugugaggcugcaucugcuggagcaaag

SEQ ID NO: 744938 - RNA, 64 nt, hsa
gcaccuccuccuaaaugcaggcacuugcuaggaagagugugagcuggcgucuucuguucacccu

SEQ ID NO: 744939 - RNA, 64 nt, hsa
aagcuccaagcccuuugggagccaaagugucugagagugugacccucuccuguaaaguauuuau

SEQ ID NO: 744940 - RNA, 64 nt, hsa
ccuggccaucccacgccgccugcguguggagcuggagugugaggagggcgagcugucuuucuau

SEQ ID NO: 744941 - RNA, 64 nt, hsa
cagccaggacagggccuggggugugugugagugugagugugagcgagagggugaguguggucag

SEQ ID NO: 744942 - RNA, 64 nt, hsa
ccugaccagccaggacagggccuggggugugugugagugugagugugagcgagagggugagugu

SEQ ID NO: 744943 - RNA, 64 nt, hsa
cagugucaccugugccaaccauggggugucccgugagugugaguguggcagugagaagaagcau

SEQ ID NO: 744944 - RNA, 64 nt, hsa
cauaggaaaagcuuccuugaugugagcucugggggagugugaaggaugcaucucuagcccccga

SEQ ID NO: 744945 - RNA, 64 nt, hsa
uguaugucugcaggugucugacacgcaagugugugagugugagugugagagauggggcgggggu

SEQ ID NO: 744946 - RNA, 64 nt, hsa
ucugcaggugucugacacgcaagugugugagugugagugugagagauggggcgggggugugucu

SEQ ID NO: 744947 - RNA, 64 nt, hsa
ggcuuucauccuguguccccugaccuguccaggugagugugagggcagcacugggaagcuggag

SEQ ID NO: 744948 - RNA, 64 nt, hsa
ggguucagggaacugcuugcccagggugcagugugagugugaugggccaccggggcaagaggga

SEQ ID NO: 744949 - RNA, 64 nt, hsa
uuuuacaaucuguaucuuugacaauucugggugcgagugugagagugugagcagggcuugcucc

SEQ ID NO: 744950 - RNA, 64 nt, hsa
ucuguaucuuugacaauucugggugcgagugugagagugugagcagggcuugcuccugccaacc

SEQ ID NO: 744951 - RNA, 64 nt, hsa
ggagagaagaggagagggcuuggauagaguugaggagugugaggcuguuagacuguuagauuua

SEQ ID NO: 744952 - RNA, 64 nt, hsa
ugaaaggggauuccaauaagcuugcucgcucucugagugugacuugggcuaaaggcccccuuuu

SEQ ID NO: 744953 - RNA, 64 nt, hsa; identical to SEQ ID NO: 189763

SEQ ID NO: 744954 - RNA, 64 nt, hsa; identical to SEQ ID NO: 189764

SEQ ID NO: 744955 - RNA, 64 nt, hsa; identical to SEQ ID NO: 189765

SEQ ID NO: 744956 - RNA, 64 nt, hsa; identical to SEQ ID NO: 189766

SEQ ID NO: 744957 - RNA, 64 nt, hsa; identical to SEQ ID NO: 189767

SEQ ID NO: 744958 - RNA, 64 nt, hsa; identical to SEQ ID NO: 189768

SEQ ID NO: 744959 - RNA, 64 nt, hsa; identical to SEQ ID NO: 189769

SEQ ID NO: 744960 - RNA, 64 nt, hsa; identical to SEQ ID NO: 189770

SEQ ID NO: 744961 - RNA, 64 nt, hsa; identical to SEQ ID NO: 189771

SEQ ID NO: 744962 - RNA, 64 nt, hsa; identical to SEQ ID NO: 189772

SEQ ID NO: 744963 - RNA, 64 nt, hsa; identical to SEQ ID NO: 189773

SEQ ID NO: 744964 - RNA, 64 nt, hsa; identical to SEQ ID NO: 189774

SEQ ID NO: 744965 - RNA, 64 nt, hsa; identical to SEQ ID NO: 189775

SEQ ID NO: 744966 - RNA, 64 nt, hsa; identical to SEQ ID NO: 189776

SEQ ID NO: 744967 - RNA, 64 nt, hsa; identical to SEQ ID NO: 189777

SEQ ID NO: 744968 - RNA, 64 nt, hsa; identical to SEQ ID NO: 189778

SEQ ID NO: 744969 - RNA, 64 nt, hsa; identical to SEQ ID NO: 189779

SEQ ID NO: 744970 - RNA, 64 nt, hsa; identical to SEQ ID NO: 189780

SEQ ID NO: 744971 - RNA, 64 nt, hsa; identical to SEQ ID NO: 189781

SEQ ID NO: 744972 - RNA, 64 nt, hsa; identical to SEQ ID NO: 189782

SEQ ID NO: 744973 - RNA, 64 nt, hsa; identical to SEQ ID NO: 189783

SEQ ID NO: 744974 - RNA, 64 nt, hsa; identical to SEQ ID NO: 91501

SEQ ID NO: 744975 - RNA, 64 nt, hsa; identical to SEQ ID NO: 91502

SEQ ID NO: 744976 - RNA, 64 nt, hsa; identical to SEQ ID NO: 91503

SEQ ID NO: 744977 - RNA, 64 nt, hsa; identical to SEQ ID NO: 91504

SEQ ID NO: 744978 - RNA, 64 nt, hsa; identical to SEQ ID NO: 91505

SEQ ID NO: 744979 - RNA, 64 nt, hsa; identical to SEQ ID NO: 91506

SEQ ID NO: 744980 - RNA, 64 nt, hsa; identical to SEQ ID NO: 91507

SEQ ID NO: 744981 - RNA, 64 nt, hsa; identical to SEQ ID NO: 91508

SEQ ID NO: 744982 - RNA, 64 nt, hsa; identical to SEQ ID NO: 244942

SEQ ID NO: 744983 - RNA, 64 nt, hsa; identical to SEQ ID NO: 244943

SEQ ID NO: 744984 - RNA, 64 nt, hsa; identical to SEQ ID NO: 244944

SEQ ID NO: 744985 - RNA, 64 nt, hsa; identical to SEQ ID NO: 244945

SEQ ID NO: 744986 - RNA, 64 nt, hsa; identical to SEQ ID NO: 244946

SEQ ID NO: 744987 - RNA, 64 nt, hsa; identical to SEQ ID NO: 244947

SEQ ID NO: 744988 - RNA, 64 nt, hsa; identical to SEQ ID NO: 244948

SEQ ID NO: 744989 - RNA, 64 nt, hsa; identical to SEQ ID NO: 244949

SEQ ID NO: 744990 - RNA, 64 nt, hsa; identical to SEQ ID NO: 244950

SEQ ID NO: 744991 - RNA, 64 nt, hsa; identical to SEQ ID NO: 244951

SEQ ID NO: 744992 - RNA, 64 nt, hsa; identical to SEQ ID NO: 244952

SEQ ID NO: 744993 - RNA, 64 nt, hsa; identical to SEQ ID NO: 244953

SEQ ID NO: 744994 - RNA, 64 nt, hsa; identical to SEQ ID NO: 244954

SEQ ID NO: 744995 - RNA, 64 nt, hsa; identical to SEQ ID NO: 244955

SEQ ID NO: 744996 - RNA, 64 nt, hsa; identical to SEQ ID NO: 244956

SEQ ID NO: 744997 - RNA, 64 nt, hsa; identical to SEQ ID NO: 244957

SEQ ID NO: 744998 - RNA, 64 nt, hsa; identical to SEQ ID NO: 244958

SEQ ID NO: 744999 - RNA, 64 nt, hsa; identical to SEQ ID NO: 244959

SEQ ID NO: 745000 - RNA, 64 nt, hsa; identical to SEQ ID NO: 244960

SEQ ID NO: 745001 - RNA, 64 nt, hsa; identical to SEQ ID NO: 244961

SEQ ID NO: 745002 - RNA, 64 nt, hsa; identical to SEQ ID NO: 244962

SEQ ID NO: 745003 - RNA, 64 nt, hsa; identical to SEQ ID NO: 244963

SEQ ID NO: 745004 - RNA, 64 nt, hsa; identical to SEQ ID NO: 244964

SEQ ID NO: 745005 - RNA, 64 nt, hsa; identical to SEQ ID NO: 244965

SEQ ID NO: 745006 - RNA, 64 nt, hsa; identical to SEQ ID NO: 244966

SEQ ID NO: 745007 - RNA, 64 nt, hsa; identical to SEQ ID NO: 244967

SEQ ID NO: 745008 - RNA, 64 nt, hsa; identical to SEQ ID NO: 244968

SEQ ID NO: 745009 - RNA, 64 nt, hsa; identical to SEQ ID NO: 363385

SEQ ID NO: 745010 - RNA, 64 nt, hsa; identical to SEQ ID NO: 363386

SEQ ID NO: 745011 - RNA, 64 nt, hsa; identical to SEQ ID NO: 363387

SEQ ID NO: 745012 - RNA, 64 nt, hsa; identical to SEQ ID NO: 363388

SEQ ID NO: 745013 - RNA, 64 nt, hsa; identical to SEQ ID NO: 363389

SEQ ID NO: 745014 - RNA, 64 nt, hsa; identical to SEQ ID NO: 363390

SEQ ID NO: 745015 - RNA, 64 nt, hsa; identical to SEQ ID NO: 363391

SEQ ID NO: 745016 - RNA, 64 nt, hsa; identical to SEQ ID NO: 363392

SEQ ID NO: 745017 - RNA, 64 nt, hsa; identical to SEQ ID NO: 363393

SEQ ID NO: 745018 - RNA, 64 nt, hsa; identical to SEQ ID NO: 363394

SEQ ID NO: 745019 - RNA, 64 nt, hsa; identical to SEQ ID NO: 363395

SEQ ID NO: 745020 - RNA, 64 nt, hsa; identical to SEQ ID NO: 363396

SEQ ID NO: 745021 - RNA, 64 nt, hsa; identical to SEQ ID NO: 363397

SEQ ID NO: 745022 - RNA, 64 nt, hsa; identical to SEQ ID NO: 363398

SEQ ID NO: 745023 - RNA, 64 nt, hsa; identical to SEQ ID NO: 363399

SEQ ID NO: 745024 - RNA, 64 nt, hsa; identical to SEQ ID NO: 363400

SEQ ID NO: 745025 - RNA, 64 nt, hsa; identical to SEQ ID NO: 363401

SEQ ID NO: 745026 - RNA, 64 nt, hsa; identical to SEQ ID NO: 363402

SEQ ID NO: 745027 - RNA, 64 nt, hsa; identical to SEQ ID NO: 363403

SEQ ID NO: 745028 - RNA, 64 nt, hsa; identical to SEQ ID NO: 363404

SEQ ID NO: 745029 - RNA, 64 nt, hsa; identical to SEQ ID NO: 363405

SEQ ID NO: 745030 - RNA, 64 nt, hsa; identical to SEQ ID NO: 363406

SEQ ID NO: 745031 - RNA, 64 nt, hsa; identical to SEQ ID NO: 363407

SEQ ID NO: 745032 - RNA, 64 nt, hsa; identical to SEQ ID NO: 363408

SEQ ID NO: 745033 - RNA, 64 nt, hsa; identical to SEQ ID NO: 363409

SEQ ID NO: 745034 - RNA, 64 nt, hsa; identical to SEQ ID NO: 363410

SEQ ID NO: 745035 - RNA, 64 nt, hsa; identical to SEQ ID NO: 363411

SEQ ID NO: 745036 - RNA, 64 nt, hsa; identical to SEQ ID NO: 363412

SEQ ID NO: 745037 - RNA, 64 nt, hsa; identical to SEQ ID NO: 363413

SEQ ID NO: 745038 - RNA, 64 nt, hsa; identical to SEQ ID NO: 363414

SEQ ID NO: 745039 - RNA, 64 nt, hsa; identical to SEQ ID NO: 363415

SEQ ID NO: 745040 - RNA, 64 nt, hsa; identical to SEQ ID NO: 363416

SEQ ID NO: 745041 - RNA, 64 nt, hsa; identical to SEQ ID NO: 363417

SEQ ID NO: 745042 - RNA, 64 nt, hsa; identical to SEQ ID NO: 363418

SEQ ID NO: 745043 - RNA, 64 nt, hsa; identical to SEQ ID NO: 363419

SEQ ID NO: 745044 - RNA, 64 nt, hsa; identical to SEQ ID NO: 363420

SEQ ID NO: 745045 - RNA, 64 nt, hsa; identical to SEQ ID NO: 363421

SEQ ID NO: 745046 - RNA, 64 nt, hsa; identical to SEQ ID NO: 363422

SEQ ID NO: 745047 - RNA, 64 nt, hsa; identical to SEQ ID NO: 363423

SEQ ID NO: 745048 - RNA, 64 nt, hsa; identical to SEQ ID NO: 363424

SEQ ID NO: 745049 - RNA, 64 nt, hsa; identical to SEQ ID NO: 363425

SEQ ID NO: 745050 - RNA, 64 nt, hsa; identical to SEQ ID NO: 363426

SEQ ID NO: 745051 - RNA, 64 nt, hsa; identical to SEQ ID NO: 363427

SEQ ID NO: 745052 - RNA, 64 nt, hsa; identical to SEQ ID NO: 363428

SEQ ID NO: 745053 - RNA, 64 nt, hsa; identical to SEQ ID NO: 363429

SEQ ID NO: 745054 - RNA, 64 nt, hsa; identical to SEQ ID NO: 534631

SEQ ID NO: 745055 - RNA, 64 nt, hsa; identical to SEQ ID NO: 534632

SEQ ID NO: 745056 - RNA, 64 nt, hsa; identical to SEQ ID NO: 534633

SEQ ID NO: 745057 - RNA, 64 nt, hsa; identical to SEQ ID NO: 534634

SEQ ID NO: 745058 - RNA, 64 nt, hsa; identical to SEQ ID NO: 534635

SEQ ID NO: 745059 - RNA, 64 nt, hsa; identical to SEQ ID NO: 534636

SEQ ID NO: 745060 - RNA, 64 nt, hsa; identical to SEQ ID NO: 534637

SEQ ID NO: 745061 - RNA, 64 nt, hsa; identical to SEQ ID NO: 534638

SEQ ID NO: 745062 - RNA, 64 nt, hsa; identical to SEQ ID NO: 534639

SEQ ID NO: 745063 - RNA, 64 nt, hsa; identical to SEQ ID NO: 534640

SEQ ID NO: 745064 - RNA, 64 nt, hsa; identical to SEQ ID NO: 534641

SEQ ID NO: 745065 - RNA, 64 nt, hsa; identical to SEQ ID NO: 534642

SEQ ID NO: 745066 - RNA, 64 nt, hsa; identical to SEQ ID NO: 534643

SEQ ID NO: 745067 - RNA, 64 nt, hsa; identical to SEQ ID NO: 534644

SEQ ID NO: 745068 - RNA, 64 nt, hsa; identical to SEQ ID NO: 534645

SEQ ID NO: 745069 - RNA, 64 nt, hsa; identical to SEQ ID NO: 534646

SEQ ID NO: 745070 - RNA, 64 nt, hsa; identical to SEQ ID NO: 534647

SEQ ID NO: 745071 - RNA, 64 nt, hsa; identical to SEQ ID NO: 534648

SEQ ID NO: 745072 - RNA, 64 nt, hsa; identical to SEQ ID NO: 534649

SEQ ID NO: 745073 - RNA, 64 nt, hsa; identical to SEQ ID NO: 534650

SEQ ID NO: 745074 - RNA, 64 nt, hsa; identical to SEQ ID NO: 534651

SEQ ID NO: 745075 - RNA, 64 nt, hsa; identical to SEQ ID NO: 534652

SEQ ID NO: 745076 - RNA, 64 nt, hsa; identical to SEQ ID NO: 534653

SEQ ID NO: 745077 - RNA, 64 nt, hsa; identical to SEQ ID NO: 534654

SEQ ID NO: 745078 - RNA, 64 nt, hsa; identical to SEQ ID NO: 534655

SEQ ID NO: 745079 - RNA, 64 nt, hsa; identical to SEQ ID NO: 534656

SEQ ID NO: 745080 - RNA, 64 nt, hsa; identical to SEQ ID NO: 534657

SEQ ID NO: 745081 - RNA, 64 nt, hsa; identical to SEQ ID NO: 534658

SEQ ID NO: 745082 - RNA, 64 nt, hsa; identical to SEQ ID NO: 534659

SEQ ID NO: 745083 - RNA, 64 nt, hsa; identical to SEQ ID NO: 534660

SEQ ID NO: 745084 - RNA, 64 nt, hsa; identical to SEQ ID NO: 534661

SEQ ID NO: 745085 - RNA, 64 nt, hsa; identical to SEQ ID NO: 534662

SEQ ID NO: 745086 - RNA, 64 nt, hsa; identical to SEQ ID NO: 534663

SEQ ID NO: 745087 - RNA, 64 nt, hsa; identical to SEQ ID NO: 534664

SEQ ID NO: 745088 - RNA, 64 nt, hsa; identical to SEQ ID NO: 534665

SEQ ID NO: 745089 - RNA, 64 nt, hsa; identical to SEQ ID NO: 534666

SEQ ID NO: 745090 - RNA, 64 nt, hsa; identical to SEQ ID NO: 534667

SEQ ID NO: 745091 - RNA, 64 nt, hsa; identical to SEQ ID NO: 534668

SEQ ID NO: 745092 - RNA, 64 nt, hsa; identical to SEQ ID NO: 534669

SEQ ID NO: 745093 - RNA, 64 nt, hsa; identical to SEQ ID NO: 534670

SEQ ID NO: 745094 - RNA, 64 nt, hsa; identical to SEQ ID NO: 534671

SEQ ID NO: 745095 - RNA, 64 nt, hsa; identical to SEQ ID NO: 534672

SEQ ID NO: 745096 - RNA, 64 nt, hsa; identical to SEQ ID NO: 534673

SEQ ID NO: 745097 - RNA, 64 nt, hsa; identical to SEQ ID NO: 534674

SEQ ID NO: 745098 - RNA, 64 nt, hsa; identical to SEQ ID NO: 534675

SEQ ID NO: 745099 - RNA, 64 nt, hsa; identical to SEQ ID NO: 534676

SEQ ID NO: 745100 - RNA, 64 nt, hsa; identical to SEQ ID NO: 534677

SEQ ID NO: 745101 - RNA, 64 nt, hsa; identical to SEQ ID NO: 534678

SEQ ID NO: 745102 - RNA, 64 nt, hsa; identical to SEQ ID NO: 534679

SEQ ID NO: 745103 - RNA, 64 nt, hsa; identical to SEQ ID NO: 534680

SEQ ID NO: 745104 - RNA, 64 nt, hsa; identical to SEQ ID NO: 534681

SEQ ID NO: 745105 - RNA, 64 nt, hsa; identical to SEQ ID NO: 534682

SEQ ID NO: 745106 - RNA, 64 nt, hsa; identical to SEQ ID NO: 534683

SEQ ID NO: 745107 - RNA, 64 nt, hsa; identical to SEQ ID NO: 534684

SEQ ID NO: 745108 - RNA, 64 nt, hsa; identical to SEQ ID NO: 534685

SEQ ID NO: 745109 - RNA, 64 nt, hsa; identical to SEQ ID NO: 534686

SEQ ID NO: 745110 - RNA, 64 nt, hsa; identical to SEQ ID NO: 534687

SEQ ID NO: 745111 - RNA, 64 nt, hsa; identical to SEQ ID NO: 534688

SEQ ID NO: 745112 - RNA, 64 nt, hsa; identical to SEQ ID NO: 534689

SEQ ID NO: 745113 - RNA, 64 nt, hsa; identical to SEQ ID NO: 534690

SEQ ID NO: 745114 - RNA, 64 nt, hsa; identical to SEQ ID NO: 534691

SEQ ID NO: 745115 - RNA, 64 nt, hsa; identical to SEQ ID NO: 534692

SEQ ID NO: 745116 - RNA, 64 nt, hsa; identical to SEQ ID NO: 534693

SEQ ID NO: 745117 - RNA, 64 nt, hsa; identical to SEQ ID NO: 534694

SEQ ID NO: 745118 - RNA, 64 nt, hsa; identical to SEQ ID NO: 534695

SEQ ID NO: 745119 - RNA, 64 nt, hsa; identical to SEQ ID NO: 534696

SEQ ID NO: 745120 - RNA, 64 nt, hsa; identical to SEQ ID NO: 534697

SEQ ID NO: 745121 - RNA, 64 nt, hsa; identical to SEQ ID NO: 534698

SEQ ID NO: 745122 - RNA, 64 nt, hsa; identical to SEQ ID NO: 534699

SEQ ID NO: 745123 - RNA, 64 nt, hsa; identical to SEQ ID NO: 534700

SEQ ID NO: 745124 - RNA, 64 nt, hsa; identical to SEQ ID NO: 534701

SEQ ID NO: 745125 - RNA, 64 nt, hsa; identical to SEQ ID NO: 534702

SEQ ID NO: 745126 - RNA, 64 nt, hsa; identical to SEQ ID NO: 534703

SEQ ID NO: 745127 - RNA, 64 nt, hsa; identical to SEQ ID NO: 534704

SEQ ID NO: 745128 - RNA, 64 nt, hsa; identical to SEQ ID NO: 534705

SEQ ID NO: 745129 - RNA, 64 nt, hsa; identical to SEQ ID NO: 534706

SEQ ID NO: 745130 - RNA, 64 nt, hsa; identical to SEQ ID NO: 534707

SEQ ID NO: 745131 - RNA, 64 nt, hsa; identical to SEQ ID NO: 534708

SEQ ID NO: 745132 - RNA, 64 nt, hsa; identical to SEQ ID NO: 534709

SEQ ID NO: 745133 - RNA, 64 nt, hsa; identical to SEQ ID NO: 534710

SEQ ID NO: 745134 - RNA, 64 nt, hsa; identical to SEQ ID NO: 534711

SEQ ID NO: 745135 - RNA, 64 nt, hsa; identical to SEQ ID NO: 534712

SEQ ID NO: 745136 - RNA, 64 nt, hsa; identical to SEQ ID NO: 534713

SEQ ID NO: 745137 - RNA, 64 nt, hsa; identical to SEQ ID NO: 534714

SEQ ID NO: 745138 - RNA, 64 nt, hsa; identical to SEQ ID NO: 534715

SEQ ID NO: 745139 - RNA, 64 nt, hsa; identical to SEQ ID NO: 534716

SEQ ID NO: 745140 - RNA, 64 nt, hsa; identical to SEQ ID NO: 534717

SEQ ID NO: 745141 - RNA, 64 nt, hsa; identical to SEQ ID NO: 534718

SEQ ID NO: 745142 - RNA, 64 nt, hsa; identical to SEQ ID NO: 534719

SEQ ID NO: 745143 - RNA, 64 nt, hsa; identical to SEQ ID NO: 534720

SEQ ID NO: 745144 - RNA, 64 nt, hsa; identical to SEQ ID NO: 534721

SEQ ID NO: 745145 - RNA, 64 nt, hsa; identical to SEQ ID NO: 534722

SEQ ID NO: 745146 - RNA, 64 nt, hsa; identical to SEQ ID NO: 534723

SEQ ID NO: 745147 - RNA, 64 nt, hsa; identical to SEQ ID NO: 534724

SEQ ID NO: 745148 - RNA, 64 nt, hsa; identical to SEQ ID NO: 534725

SEQ ID NO: 745149 - RNA, 64 nt, hsa; identical to SEQ ID NO: 534726

SEQ ID NO: 745150 - RNA, 64 nt, hsa; identical to SEQ ID NO: 534727

SEQ ID NO: 745151 - RNA, 64 nt, hsa; identical to SEQ ID NO: 534728

SEQ ID NO: 745152 - RNA, 64 nt, hsa; identical to SEQ ID NO: 534729

SEQ ID NO: 745153 - RNA, 64 nt, hsa; identical to SEQ ID NO: 534730

SEQ ID NO: 745154 - RNA, 64 nt, hsa; identical to SEQ ID NO: 534731

SEQ ID NO: 745155 - RNA, 64 nt, hsa; identical to SEQ ID NO: 534732

SEQ ID NO: 745156 - RNA, 64 nt, hsa; identical to SEQ ID NO: 534733

SEQ ID NO: 745157 - RNA, 64 nt, hsa; identical to SEQ ID NO: 534734

SEQ ID NO: 745158 - RNA, 64 nt, hsa; identical to SEQ ID NO: 534735

SEQ ID NO: 745159 - RNA, 64 nt, hsa; identical to SEQ ID NO: 534736

SEQ ID NO: 745160 - RNA, 64 nt, hsa; identical to SEQ ID NO: 534737

SEQ ID NO: 745161 - RNA, 64 nt, hsa; identical to SEQ ID NO: 534738

SEQ ID NO: 745162 - RNA, 64 nt, hsa; identical to SEQ ID NO: 534739

SEQ ID NO: 745163 - RNA, 64 nt, hsa; identical to SEQ ID NO: 534740

SEQ ID NO: 745164 - RNA, 64 nt, hsa; identical to SEQ ID NO: 534741

SEQ ID NO: 745165 - RNA, 64 nt, hsa; identical to SEQ ID NO: 534742

SEQ ID NO: 745166 - RNA, 64 nt, hsa; identical to SEQ ID NO: 534743

SEQ ID NO: 745167 - RNA, 64 nt, hsa; identical to SEQ ID NO: 534744

SEQ ID NO: 745168 - RNA, 64 nt, hsa; identical to SEQ ID NO: 534745

SEQ ID NO: 745169 - RNA, 64 nt, hsa; identical to SEQ ID NO: 534746

SEQ ID NO: 745170 - RNA, 64 nt, hsa; identical to SEQ ID NO: 534747

SEQ ID NO: 745171 - RNA, 64 nt, hsa; identical to SEQ ID NO: 534748

SEQ ID NO: 745172 - RNA, 64 nt, hsa; identical to SEQ ID NO: 534749

SEQ ID NO: 745173 - RNA, 64 nt, hsa; identical to SEQ ID NO: 534750

SEQ ID NO: 745174 - RNA, 64 nt, hsa; identical to SEQ ID NO: 534751

SEQ ID NO: 745175 - RNA, 64 nt, hsa; identical to SEQ ID NO: 534752

SEQ ID NO: 745176 - RNA, 64 nt, hsa; identical to SEQ ID NO: 534753

SEQ ID NO: 745177 - RNA, 64 nt, hsa; identical to SEQ ID NO: 534754

SEQ ID NO: 745178 - RNA, 64 nt, hsa; identical to SEQ ID NO: 534755

SEQ ID NO: 745179 - RNA, 64 nt, hsa; identical to SEQ ID NO: 534756

SEQ ID NO: 745180 - RNA, 64 nt, hsa; identical to SEQ ID NO: 534757

SEQ ID NO: 745181 - RNA, 64 nt, hsa; identical to SEQ ID NO: 534758

SEQ ID NO: 745182 - RNA, 64 nt, hsa; identical to SEQ ID NO: 534759

SEQ ID NO: 745183 - RNA, 64 nt, hsa; identical to SEQ ID NO: 534760

SEQ ID NO: 745184 - RNA, 64 nt, hsa; identical to SEQ ID NO: 534761

SEQ ID NO: 745185 - RNA, 64 nt, hsa; identical to SEQ ID NO: 534762

SEQ ID NO: 745186 - RNA, 64 nt, hsa; identical to SEQ ID NO: 534763

SEQ ID NO: 745187 - RNA, 64 nt, hsa; identical to SEQ ID NO: 534764

SEQ ID NO: 745188 - RNA, 64 nt, hsa; identical to SEQ ID NO: 534765

SEQ ID NO: 745189 - RNA, 64 nt, hsa; identical to SEQ ID NO: 534766

SEQ ID NO: 745190 - RNA, 64 nt, hsa; identical to SEQ ID NO: 534767

SEQ ID NO: 745191 - RNA, 64 nt, hsa; identical to SEQ ID NO: 534768

SEQ ID NO: 745192 - RNA, 64 nt, hsa; identical to SEQ ID NO: 534769

SEQ ID NO: 745193 - RNA, 64 nt, hsa; identical to SEQ ID NO: 534770

SEQ ID NO: 745194 - RNA, 63 nt, hsa; identical to SEQ ID NO: 534771

SEQ ID NO: 745195 - RNA, 64 nt, hsa; identical to SEQ ID NO: 534772

SEQ ID NO: 745196 - RNA, 64 nt, hsa; identical to SEQ ID NO: 534773

SEQ ID NO: 745197 - RNA, 64 nt, hsa; identical to SEQ ID NO: 534774

SEQ ID NO: 745198 - RNA, 64 nt, hsa; identical to SEQ ID NO: 534775

SEQ ID NO: 745199 - RNA, 64 nt, hsa; identical to SEQ ID NO: 534776

SEQ ID NO: 745200 - RNA, 64 nt, hsa; identical to SEQ ID NO: 534777

SEQ ID NO: 745201 - RNA, 64 nt, hsa; identical to SEQ ID NO: 534778

SEQ ID NO: 745202 - RNA, 64 nt, hsa; identical to SEQ ID NO: 534779

SEQ ID NO: 745203 - RNA, 64 nt, hsa; identical to SEQ ID NO: 534780

SEQ ID NO: 745204 - RNA, 64 nt, hsa; identical to SEQ ID NO: 534781

SEQ ID NO: 745205 - RNA, 64 nt, hsa; identical to SEQ ID NO: 534782

SEQ ID NO: 745206 - RNA, 64 nt, hsa; identical to SEQ ID NO: 534783

SEQ ID NO: 745207 - RNA, 64 nt, hsa; identical to SEQ ID NO: 534784

SEQ ID NO: 745208 - RNA, 63 nt, hsa; identical to SEQ ID NO: 534785

SEQ ID NO: 745209 - RNA, 64 nt, hsa; identical to SEQ ID NO: 534786

SEQ ID NO: 745210 - RNA, 64 nt, hsa; identical to SEQ ID NO: 534787

SEQ ID NO: 745211 - RNA, 64 nt, hsa; identical to SEQ ID NO: 534788

SEQ ID NO: 745212 - RNA, 64 nt, hsa; identical to SEQ ID NO: 534789

SEQ ID NO: 745213 - RNA, 64 nt, hsa; identical to SEQ ID NO: 534790

SEQ ID NO: 745214 - RNA, 64 nt, hsa; identical to SEQ ID NO: 534791

SEQ ID NO: 745215 - RNA, 64 nt, hsa; identical to SEQ ID NO: 534792

SEQ ID NO: 745216 - RNA, 64 nt, hsa; identical to SEQ ID NO: 534793

SEQ ID NO: 745217 - RNA, 64 nt, hsa; identical to SEQ ID NO: 534794

SEQ ID NO: 745218 - RNA, 64 nt, hsa; identical to SEQ ID NO: 534795

SEQ ID NO: 745219 - RNA, 64 nt, hsa; identical to SEQ ID NO: 534796

SEQ ID NO: 745220 - RNA, 64 nt, hsa; identical to SEQ ID NO: 534797

SEQ ID NO: 745221 - RNA, 64 nt, hsa; identical to SEQ ID NO: 534798

SEQ ID NO: 745222 - RNA, 64 nt, hsa; identical to SEQ ID NO: 534799

SEQ ID NO: 745223 - RNA, 64 nt, hsa; identical to SEQ ID NO: 534800

SEQ ID NO: 745224 - RNA, 64 nt, hsa; identical to SEQ ID NO: 534801

SEQ ID NO: 745225 - RNA, 64 nt, hsa; identical to SEQ ID NO: 534802

SEQ ID NO: 745226 - RNA, 64 nt, hsa; identical to SEQ ID NO: 534803

SEQ ID NO: 745227 - RNA, 64 nt, hsa; identical to SEQ ID NO: 534804

SEQ ID NO: 745228 - RNA, 64 nt, hsa; identical to SEQ ID NO: 534805

SEQ ID NO: 745229 - RNA, 64 nt, hsa; identical to SEQ ID NO: 534806

SEQ ID NO: 745230 - RNA, 64 nt, hsa; identical to SEQ ID NO: 534807

SEQ ID NO: 745231 - RNA, 64 nt, hsa; identical to SEQ ID NO: 534808

SEQ ID NO: 745232 - RNA, 64 nt, hsa; identical to SEQ ID NO: 534809

SEQ ID NO: 745233 - RNA, 64 nt, hsa; identical to SEQ ID NO: 534810

SEQ ID NO: 745234 - RNA, 64 nt, hsa; identical to SEQ ID NO: 534811

SEQ ID NO: 745235 - RNA, 64 nt, hsa; identical to SEQ ID NO: 534812

SEQ ID NO: 745236 - RNA, 64 nt, hsa; identical to SEQ ID NO: 534813

SEQ ID NO: 745237 - RNA, 64 nt, hsa; identical to SEQ ID NO: 534814

SEQ ID NO: 745238 - RNA, 64 nt, hsa; identical to SEQ ID NO: 534815

SEQ ID NO: 745239 - RNA, 64 nt, hsa; identical to SEQ ID NO: 534816

SEQ ID NO: 745240 - RNA, 64 nt, hsa; identical to SEQ ID NO: 534817

SEQ ID NO: 745241 - RNA, 64 nt, hsa; identical to SEQ ID NO: 534818

SEQ ID NO: 745242 - RNA, 64 nt, hsa; identical to SEQ ID NO: 534819

SEQ ID NO: 745243 - RNA, 64 nt, hsa; identical to SEQ ID NO: 534820

SEQ ID NO: 745244 - RNA, 64 nt, hsa; identical to SEQ ID NO: 534821

SEQ ID NO: 745245 - RNA, 64 nt, hsa; identical to SEQ ID NO: 534822

SEQ ID NO: 745246 - RNA, 64 nt, hsa; identical to SEQ ID NO: 534823

SEQ ID NO: 745247 - RNA, 64 nt, hsa; identical to SEQ ID NO: 534824

SEQ ID NO: 745248 - RNA, 64 nt, hsa; identical to SEQ ID NO: 534825

SEQ ID NO: 745249 - RNA, 64 nt, hsa; identical to SEQ ID NO: 534826

SEQ ID NO: 745250 - RNA, 64 nt, hsa; identical to SEQ ID NO: 534827

SEQ ID NO: 745251 - RNA, 64 nt, hsa; identical to SEQ ID NO: 534828

SEQ ID NO: 745252 - RNA, 64 nt, hsa; identical to SEQ ID NO: 534829

SEQ ID NO: 745253 - RNA, 64 nt, hsa; identical to SEQ ID NO: 534830

SEQ ID NO: 745254 - RNA, 64 nt, hsa; identical to SEQ ID NO: 534831

SEQ ID NO: 745255 - RNA, 64 nt, hsa; identical to SEQ ID NO: 534832

SEQ ID NO: 745256 - RNA, 64 nt, hsa; identical to SEQ ID NO: 534833

SEQ ID NO: 745257 - RNA, 64 nt, hsa; identical to SEQ ID NO: 534834

SEQ ID NO: 745258 - RNA, 64 nt, hsa; identical to SEQ ID NO: 534835

SEQ ID NO: 745259 - RNA, 64 nt, hsa; identical to SEQ ID NO: 534836

SEQ ID NO: 745260 - RNA, 64 nt, hsa; identical to SEQ ID NO: 534837

SEQ ID NO: 745261 - RNA, 64 nt, hsa; identical to SEQ ID NO: 534838

SEQ ID NO: 745262 - RNA, 64 nt, hsa; identical to SEQ ID NO: 534839

SEQ ID NO: 745263 - RNA, 64 nt, hsa; identical to SEQ ID NO: 534840

SEQ ID NO: 745264 - RNA, 64 nt, hsa; identical to SEQ ID NO: 534841

SEQ ID NO: 745265 - RNA, 64 nt, hsa; identical to SEQ ID NO: 534842

SEQ ID NO: 745266 - RNA, 64 nt, hsa; identical to SEQ ID NO: 534843

SEQ ID NO: 745267 - RNA, 64 nt, hsa; identical to SEQ ID NO: 534844

SEQ ID NO: 745268 - RNA, 64 nt, hsa; identical to SEQ ID NO: 534845

SEQ ID NO: 745269 - RNA, 64 nt, hsa; identical to SEQ ID NO: 534846

SEQ ID NO: 745270 - RNA, 64 nt, hsa; identical to SEQ ID NO: 534847

SEQ ID NO: 745271 - RNA, 64 nt, hsa; identical to SEQ ID NO: 534848

SEQ ID NO: 745272 - RNA, 64 nt, hsa; identical to SEQ ID NO: 534849

SEQ ID NO: 745273 - RNA, 64 nt, hsa; identical to SEQ ID NO: 534850

SEQ ID NO: 745274 - RNA, 64 nt, hsa; identical to SEQ ID NO: 534851

SEQ ID NO: 745275 - RNA, 64 nt, hsa; identical to SEQ ID NO: 534852

SEQ ID NO: 745276 - RNA, 64 nt, hsa; identical to SEQ ID NO: 534853

SEQ ID NO: 745277 - RNA, 64 nt, hsa; identical to SEQ ID NO: 534854

SEQ ID NO: 745278 - RNA, 64 nt, hsa; identical to SEQ ID NO: 534855

SEQ ID NO: 745279 - RNA, 64 nt, hsa; identical to SEQ ID NO: 279762

SEQ ID NO: 745280 - RNA, 64 nt, hsa; identical to SEQ ID NO: 279763

SEQ ID NO: 745281 - RNA, 64 nt, hsa; identical to SEQ ID NO: 279764

SEQ ID NO: 745282 - RNA, 64 nt, hsa; identical to SEQ ID NO: 279765

SEQ ID NO: 745283 - RNA, 64 nt, hsa; identical to SEQ ID NO: 279766

SEQ ID NO: 745284 - RNA, 64 nt, hsa; identical to SEQ ID NO: 279767

SEQ ID NO: 745285 - RNA, 64 nt, hsa; identical to SEQ ID NO: 279768

SEQ ID NO: 745286 - RNA, 64 nt, hsa; identical to SEQ ID NO: 279769

SEQ ID NO: 745287 - RNA, 64 nt, hsa; identical to SEQ ID NO: 279770

SEQ ID NO: 745288 - RNA, 64 nt, hsa; identical to SEQ ID NO: 279771

SEQ ID NO: 745289 - RNA, 64 nt, hsa; identical to SEQ ID NO: 279772

SEQ ID NO: 745290 - RNA, 64 nt, hsa; identical to SEQ ID NO: 279773

SEQ ID NO: 745291 - RNA, 64 nt, hsa; identical to SEQ ID NO: 279774

SEQ ID NO: 745292 - RNA, 64 nt, hsa; identical to SEQ ID NO: 279775

SEQ ID NO: 745293 - RNA, 63 nt, hsa
uaaagcugcagcuuucaacagguuuuaaaccuggcauuaaaauguaauggcaaaaccaauauu

SEQ ID NO: 745294 - RNA, 63 nt, hsa
gguucugucccuggagacucuggaaauccuuuugcauuaaaaggacuuuacacaccuguguaa

SEQ ID NO: 745295 - RNA, 63 nt, hsa
auaccauauacagcucagaaguuucuucuuuaggcauuaaauuuuagcaaagauaucucaucu

SEQ ID NO: 745296 - RNA, 63 nt, hsa
acaacuugucuauuaccuguuaguauuauuguugcauuaaaaaugcauauacuuuaauaaaug

SEQ ID NO: 745297 - RNA, 63 nt, hsa
uugcaguagauauccuuuugugugugugugugugcauuaaaguuguaaacgguaacaugaaac

SEQ ID NO: 745298 - RNA, 63 nt, hsa
ccuucauuaaauguauacagauuuaguuaaguagcauuaaauaggauucuuagaaguaugucc

SEQ ID NO: 745299 - RNA, 63 nt, hsa
acuucucagcuucucccauagguaguuuaacaggcauuaaaauuuguaauugaaauguugcuu

SEQ ID NO: 745300 - RNA, 63 nt, hsa
uuagccuaugguaguaauuuauguagaauaaaagcauuaaaaagaagcaaaucauuugcacuc

SEQ ID NO: 745301 - RNA, 63 nt, hsa
accuacuccccaaaaauguguggcuuugggucugcauuaaacgcuguaguccauguucaugcc

SEQ ID NO: 745302 - RNA, 63 nt, hsa
augaaaacuaauagccaaaaaaccuuugagauugcauuaaagagaagggauaaaggaccagca

SEQ ID NO: 745303 - RNA, 63 nt, hsa
gcagcuuuuguagauuuuaaauggguugugcaagcauuaaaaugcaggucuuucagaaucuag

SEQ ID NO: 745304 - RNA, 63 nt, hsa
ggacuugugcauuuauguuuguuuuaagacacugcauuaaagaaagauuugaaaaguauacac

SEQ ID NO: 745305 - RNA, 63 nt, hsa
cacaaauaaucaugcuuuuuuccuaugguuacagcauuaaacucuauuuuaaguuguuuuuga

SEQ ID NO: 745306 - RNA, 64 nt, hsa; identical to SEQ ID NO: 240065

SEQ ID NO: 745307 - RNA, 64 nt, hsa; identical to SEQ ID NO: 240066

SEQ ID NO: 745308 - RNA, 64 nt, hsa; identical to SEQ ID NO: 240067

SEQ ID NO: 745309 - RNA, 64 nt, hsa; identical to SEQ ID NO: 240068

SEQ ID NO: 745310 - RNA, 64 nt, hsa; identical to SEQ ID NO: 240069

SEQ ID NO: 745311 - RNA, 64 nt, hsa; identical to SEQ ID NO: 240070

SEQ ID NO: 745312 - RNA, 61 nt, hsa; identical to SEQ ID NO: 240071

SEQ ID NO: 745313 - RNA, 64 nt, hsa; identical to SEQ ID NO: 240072

SEQ ID NO: 745314 - RNA, 64 nt, hsa; identical to SEQ ID NO: 240073

SEQ ID NO: 745315 - RNA, 64 nt, hsa; identical to SEQ ID NO: 240074

SEQ ID NO: 745316 - RNA, 64 nt, hsa; identical to SEQ ID NO: 240075

SEQ ID NO: 745317 - RNA, 64 nt, hsa; identical to SEQ ID NO: 240076

SEQ ID NO: 745318 - RNA, 64 nt, hsa; identical to SEQ ID NO: 240077

SEQ ID NO: 745319 - RNA, 64 nt, hsa; identical to SEQ ID NO: 240078

SEQ ID NO: 745320 - RNA, 64 nt, hsa; identical to SEQ ID NO: 240079

SEQ ID NO: 745321 - RNA, 64 nt, hsa; identical to SEQ ID NO: 240080

SEQ ID NO: 745322 - RNA, 64 nt, hsa; identical to SEQ ID NO: 240081

SEQ ID NO: 745323 - RNA, 64 nt, hsa; identical to SEQ ID NO: 240082

SEQ ID NO: 745324 - RNA, 64 nt, hsa; identical to SEQ ID NO: 240083

SEQ ID NO: 745325 - RNA, 64 nt, hsa; identical to SEQ ID NO: 240084

SEQ ID NO: 745326 - RNA, 64 nt, hsa; identical to SEQ ID NO: 240085

SEQ ID NO: 745327 - RNA, 64 nt, hsa; identical to SEQ ID NO: 240086

SEQ ID NO: 745328 - RNA, 64 nt, hsa; identical to SEQ ID NO: 658151

SEQ ID NO: 745329 - RNA, 64 nt, hsa; identical to SEQ ID NO: 658152

SEQ ID NO: 745330 - RNA, 64 nt, hsa; identical to SEQ ID NO: 658153

SEQ ID NO: 745331 - RNA, 64 nt, hsa; identical to SEQ ID NO: 658154

SEQ ID NO: 745332 - RNA, 64 nt, hsa; identical to SEQ ID NO: 658155

SEQ ID NO: 745333 - RNA, 64 nt, hsa; identical to SEQ ID NO: 658156

SEQ ID NO: 745334 - RNA, 64 nt, hsa; identical to SEQ ID NO: 658157

SEQ ID NO: 745335 - RNA, 64 nt, hsa; identical to SEQ ID NO: 658158

SEQ ID NO: 745336 - RNA, 64 nt, hsa; identical to SEQ ID NO: 658159

SEQ ID NO: 745337 - RNA, 64 nt, hsa; identical to SEQ ID NO: 658160

SEQ ID NO: 745338 - RNA, 64 nt, hsa; identical to SEQ ID NO: 658161

SEQ ID NO: 745339 - RNA, 64 nt, hsa; identical to SEQ ID NO: 658162

SEQ ID NO: 745340 - RNA, 64 nt, hsa; identical to SEQ ID NO: 91216

SEQ ID NO: 745341 - RNA, 64 nt, hsa; identical to SEQ ID NO: 91217

SEQ ID NO: 745342 - RNA, 64 nt, hsa; identical to SEQ ID NO: 91218

SEQ ID NO: 745343 - RNA, 64 nt, hsa; identical to SEQ ID NO: 91219

SEQ ID NO: 745344 - RNA, 64 nt, hsa; identical to SEQ ID NO: 91220

SEQ ID NO: 745345 - RNA, 64 nt, hsa; identical to SEQ ID NO: 91221

SEQ ID NO: 745346 - RNA, 64 nt, hsa; identical to SEQ ID NO: 91222

SEQ ID NO: 745347 - RNA, 64 nt, hsa; identical to SEQ ID NO: 91223

SEQ ID NO: 745348 - RNA, 64 nt, hsa; identical to SEQ ID NO: 91224

SEQ ID NO: 745349 - RNA, 55 nt, hsa; identical to SEQ ID NO: 91225

SEQ ID NO: 745350 - RNA, 64 nt, hsa; identical to SEQ ID NO: 91226

SEQ ID NO: 745351 - RNA, 64 nt, hsa; identical to SEQ ID NO: 91227

SEQ ID NO: 745352 - RNA, 64 nt, hsa; identical to SEQ ID NO: 91228

SEQ ID NO: 745353 - RNA, 64 nt, hsa; identical to SEQ ID NO: 91229

SEQ ID NO: 745354 - RNA, 64 nt, hsa; identical to SEQ ID NO: 91230

SEQ ID NO: 745355 - RNA, 64 nt, hsa; identical to SEQ ID NO: 91231

SEQ ID NO: 745356 - RNA, 64 nt, hsa; identical to SEQ ID NO: 91232

SEQ ID NO: 745357 - RNA, 64 nt, hsa; identical to SEQ ID NO: 91233

SEQ ID NO: 745358 - RNA, 64 nt, hsa; identical to SEQ ID NO: 91234

SEQ ID NO: 745359 - RNA, 64 nt, hsa; identical to SEQ ID NO: 91235

SEQ ID NO: 745360 - RNA, 64 nt, hsa; identical to SEQ ID NO: 91236

SEQ ID NO: 745361 - RNA, 64 nt, hsa; identical to SEQ ID NO: 91237

SEQ ID NO: 745362 - RNA, 64 nt, hsa; identical to SEQ ID NO: 91238

SEQ ID NO: 745363 - RNA, 55 nt, hsa; identical to SEQ ID NO: 91239

SEQ ID NO: 745364 - RNA, 64 nt, hsa; identical to SEQ ID NO: 91240

SEQ ID NO: 745365 - RNA, 64 nt, hsa; identical to SEQ ID NO: 91241

SEQ ID NO: 745366 - RNA, 64 nt, hsa; identical to SEQ ID NO: 91242

SEQ ID NO: 745367 - RNA, 64 nt, hsa; identical to SEQ ID NO: 91243

SEQ ID NO: 745368 - RNA, 64 nt, hsa; identical to SEQ ID NO: 91244

SEQ ID NO: 745369 - RNA, 64 nt, hsa; identical to SEQ ID NO: 91245

SEQ ID NO: 745370 - RNA, 64 nt, hsa; identical to SEQ ID NO: 91246

SEQ ID NO: 745371 - RNA, 64 nt, hsa; identical to SEQ ID NO: 91247

SEQ ID NO: 745372 - RNA, 64 nt, hsa; identical to SEQ ID NO: 91248

SEQ ID NO: 745373 - RNA, 64 nt, hsa; identical to SEQ ID NO: 91249

SEQ ID NO: 745374 - RNA, 64 nt, hsa; identical to SEQ ID NO: 91250

SEQ ID NO: 745375 - RNA, 64 nt, hsa; identical to SEQ ID NO: 91251

SEQ ID NO: 745376 - RNA, 64 nt, hsa; identical to SEQ ID NO: 91252

SEQ ID NO: 745377 - RNA, 64 nt, hsa; identical to SEQ ID NO: 91253

SEQ ID NO: 745378 - RNA, 64 nt, hsa; identical to SEQ ID NO: 91254

SEQ ID NO: 745379 - RNA, 64 nt, hsa; identical to SEQ ID NO: 91255

SEQ ID NO: 745380 - RNA, 64 nt, hsa; identical to SEQ ID NO: 91256

SEQ ID NO: 745381 - RNA, 64 nt, hsa; identical to SEQ ID NO: 91257

SEQ ID NO: 745382 - RNA, 64 nt, hsa; identical to SEQ ID NO: 91258

SEQ ID NO: 745383 - RNA, 64 nt, hsa; identical to SEQ ID NO: 91259

SEQ ID NO: 745384 - RNA, 64 nt, hsa; identical to SEQ ID NO: 91260

SEQ ID NO: 745385 - RNA, 64 nt, hsa; identical to SEQ ID NO: 91261

SEQ ID NO: 745386 - RNA, 64 nt, hsa
uccugccaccuccuccgcagggcugcucccugaggccaagaagccucggcuccugcacggcacc

SEQ ID NO: 745387 - RNA, 64 nt, hsa
agagccggagagcgugcugcuggugcauggcgaggccaagaagauggaguuccugaagcagaag

SEQ ID NO: 745388 - RNA, 64 nt, hsa
uucuucucccucucaaccaucccacuaaguuauagccaagaagggaaggagacacggggauuug

SEQ ID NO: 745389 - RNA, 64 nt, hsa
uuuugggucucacucaugcuuacugaaacauugugccaagaaacucugugggauuugugucccu

SEQ ID NO: 745390 - RNA, 64 nt, hsa
aggcaaagcgccagcagcccugcacuccacgcuggccaagaaggccuuccacgcagaaugacaa

SEQ ID NO: 745391 - RNA, 64 nt, hsa
gcaaacggugucaugguuuggaauguucauuaucgccaagaaccugguuagaggcauaaagacc

SEQ ID NO: 745392 - RNA, 64 nt, hsa
caggaacggccugaaguucgagaccaguguucgugccaagaaugaucaaaggucagaagaagaa

SEQ ID NO: 745393 - RNA, 64 nt, hsa
gaugacagugaugaugaugaagaaagcaaagaaggccaagaaaguucuaguagugcugcaaaca

SEQ ID NO: 745394 - RNA, 64 nt, hsa
cacugugaguacugacauuuagaguuguuuaaaggccaagaacuggaaacagccuuuucccuau

SEQ ID NO: 745395 - RNA, 64 nt, hsa
ugugcaggauagaguguguuucauuuguucuggugccaagaaugagcgcuguacuaugguaguu

SEQ ID NO: 745396 - RNA, 64 nt, hsa
ccauacacauuuggcucaggguuaccgaagaggggccaagaaauuagaguccucagaagagaac

SEQ ID NO: 745397 - RNA, 64 nt, hsa
acaacucauggaagguaaagaaccugcaacuggagccaagaagaguaacaagccaaaugaacag

SEQ ID NO: 745398 - RNA, 64 nt, hsa
guggauaaaggcaacuugcaggagaggagagccagccaagaagaaaauuuuaaaaccaaaccuc

SEQ ID NO: 745399 - RNA, 64 nt, hsa
aaagauguuuggucucaaaaaccuuugaggaauugccaagaauggcgagugauugcuuuccuuc

SEQ ID NO: 745400 - RNA, 64 nt, hsa
uuuauuaugggaauuggcucucgcaauuauggaggccaagaagucccacagucuugcauuugca

SEQ ID NO: 745401 - RNA, 64 nt, hsa
uuuggucacaguucugaaggaaguuagggaggaagccaagaaaauaucuauugugauuaaaggu

SEQ ID NO: 745402 - RNA, 64 nt, hsa
ucaucaucaaaauucagugaaaucccaaaacagugccaagaauuuugcugaaugaaacaaucaa

SEQ ID NO: 745403 - RNA, 64 nt, hsa
aaacaagaccaaaaagacucaacagccgcuugaagccaagaacucuucaaugccagcuacugcc

SEQ ID NO: 745404 - RNA, 64 nt, hsa; identical to SEQ ID NO: 132800

SEQ ID NO: 745405 - RNA, 64 nt, hsa; identical to SEQ ID NO: 132801

SEQ ID NO: 745406 - RNA, 64 nt, hsa; identical to SEQ ID NO: 132802

SEQ ID NO: 745407 - RNA, 64 nt, hsa; identical to SEQ ID NO: 132803

SEQ ID NO: 745408 - RNA, 64 nt, hsa; identical to SEQ ID NO: 132804

SEQ ID NO: 745409 - RNA, 64 nt, hsa; identical to SEQ ID NO: 132805

SEQ ID NO: 745410 - RNA, 64 nt, hsa; identical to SEQ ID NO: 132806

SEQ ID NO: 745411 - RNA, 64 nt, hsa; identical to SEQ ID NO: 132807

SEQ ID NO: 745412 - RNA, 64 nt, hsa; identical to SEQ ID NO: 132808

SEQ ID NO: 745413 - RNA, 64 nt, hsa; identical to SEQ ID NO: 132809

SEQ ID NO: 745414 - RNA, 64 nt, hsa; identical to SEQ ID NO: 132810

SEQ ID NO: 745415 - RNA, 64 nt, hsa; identical to SEQ ID NO: 132811

SEQ ID NO: 745416 - RNA, 64 nt, hsa; identical to SEQ ID NO: 132812

SEQ ID NO: 745417 - RNA, 64 nt, hsa; identical to SEQ ID NO: 132813

SEQ ID NO: 745418 - RNA, 64 nt, hsa; identical to SEQ ID NO: 132814

SEQ ID NO: 745419 - RNA, 64 nt, hsa; identical to SEQ ID NO: 132815

SEQ ID NO: 745420 - RNA, 64 nt, hsa; identical to SEQ ID NO: 132816

SEQ ID NO: 745421 - RNA, 64 nt, hsa; identical to SEQ ID NO: 132817

SEQ ID NO: 745422 - RNA, 64 nt, hsa; identical to SEQ ID NO: 132818

SEQ ID NO: 745423 - RNA, 64 nt, hsa; identical to SEQ ID NO: 132819

SEQ ID NO: 745424 - RNA, 64 nt, hsa; identical to SEQ ID NO: 132820

SEQ ID NO: 745425 - RNA, 64 nt, hsa; identical to SEQ ID NO: 132821

SEQ ID NO: 745426 - RNA, 64 nt, hsa; identical to SEQ ID NO: 132822

SEQ ID NO: 745427 - RNA, 64 nt, hsa; identical to SEQ ID NO: 132823

SEQ ID NO: 745428 - RNA, 64 nt, hsa; identical to SEQ ID NO: 132824

SEQ ID NO: 745429 - RNA, 64 nt, hsa; identical to SEQ ID NO: 132825

SEQ ID NO: 745430 - RNA, 64 nt, hsa; identical to SEQ ID NO: 132826

SEQ ID NO: 745431 - RNA, 64 nt, hsa; identical to SEQ ID NO: 132827

SEQ ID NO: 745432 - RNA, 64 nt, hsa; identical to SEQ ID NO: 132828

SEQ ID NO: 745433 - RNA, 64 nt, hsa; identical to SEQ ID NO: 132829

SEQ ID NO: 745434 - RNA, 64 nt, hsa; identical to SEQ ID NO: 132830

SEQ ID NO: 745435 - RNA, 64 nt, hsa; identical to SEQ ID NO: 132831

SEQ ID NO: 745436 - RNA, 64 nt, hsa; identical to SEQ ID NO: 132832

SEQ ID NO: 745437 - RNA, 64 nt, hsa; identical to SEQ ID NO: 132833

SEQ ID NO: 745438 - RNA, 64 nt, hsa; identical to SEQ ID NO: 132834

SEQ ID NO: 745439 - RNA, 64 nt, hsa; identical to SEQ ID NO: 132835

SEQ ID NO: 745440 - RNA, 64 nt, hsa; identical to SEQ ID NO: 132836

SEQ ID NO: 745441 - RNA, 64 nt, hsa; identical to SEQ ID NO: 132837

SEQ ID NO: 745442 - RNA, 64 nt, hsa; identical to SEQ ID NO: 132838

SEQ ID NO: 745443 - RNA, 64 nt, hsa; identical to SEQ ID NO: 132839

SEQ ID NO: 745444 - RNA, 64 nt, hsa; identical to SEQ ID NO: 132840

SEQ ID NO: 745445 - RNA, 64 nt, hsa; identical to SEQ ID NO: 132841

SEQ ID NO: 745446 - RNA, 64 nt, hsa; identical to SEQ ID NO: 132842

SEQ ID NO: 745447 - RNA, 64 nt, hsa; identical to SEQ ID NO: 132843

SEQ ID NO: 745448 - RNA, 64 nt, hsa; identical to SEQ ID NO: 132844

SEQ ID NO: 745449 - RNA, 58 nt, hsa; identical to SEQ ID NO: 132845

SEQ ID NO: 745450 - RNA, 64 nt, hsa; identical to SEQ ID NO: 132846

SEQ ID NO: 745451 - RNA, 64 nt, hsa; identical to SEQ ID NO: 132847

SEQ ID NO: 745452 - RNA, 64 nt, hsa; identical to SEQ ID NO: 132848

SEQ ID NO: 745453 - RNA, 64 nt, hsa; identical to SEQ ID NO: 132849

SEQ ID NO: 745454 - RNA, 64 nt, hsa; identical to SEQ ID NO: 132850

SEQ ID NO: 745455 - RNA, 64 nt, hsa; identical to SEQ ID NO: 132851

SEQ ID NO: 745456 - RNA, 64 nt, hsa; identical to SEQ ID NO: 132852

SEQ ID NO: 745457 - RNA, 64 nt, hsa; identical to SEQ ID NO: 132853

SEQ ID NO: 745458 - RNA, 64 nt, hsa; identical to SEQ ID NO: 132854

SEQ ID NO: 745459 - RNA, 64 nt, hsa; identical to SEQ ID NO: 132855

SEQ ID NO: 745460 - RNA, 64 nt, hsa; identical to SEQ ID NO: 132856

SEQ ID NO: 745461 - RNA, 64 nt, hsa; identical to SEQ ID NO: 132857

SEQ ID NO: 745462 - RNA, 64 nt, hsa; identical to SEQ ID NO: 132858

SEQ ID NO: 745463 - RNA, 64 nt, hsa; identical to SEQ ID NO: 132859

SEQ ID NO: 745464 - RNA, 64 nt, hsa; identical to SEQ ID NO: 132860

SEQ ID NO: 745465 - RNA, 64 nt, hsa; identical to SEQ ID NO: 132861

SEQ ID NO: 745466 - RNA, 64 nt, hsa; identical to SEQ ID NO: 132862

SEQ ID NO: 745467 - RNA, 64 nt, hsa; identical to SEQ ID NO: 132863

SEQ ID NO: 745468 - RNA, 64 nt, hsa; identical to SEQ ID NO: 132864

SEQ ID NO: 745469 - RNA, 64 nt, hsa; identical to SEQ ID NO: 132865

SEQ ID NO: 745470 - RNA, 64 nt, hsa; identical to SEQ ID NO: 132866

SEQ ID NO: 745471 - RNA, 64 nt, hsa; identical to SEQ ID NO: 132867

SEQ ID NO: 745472 - RNA, 64 nt, hsa; identical to SEQ ID NO: 132868

SEQ ID NO: 745473 - RNA, 64 nt, hsa; identical to SEQ ID NO: 132869

SEQ ID NO: 745474 - RNA, 64 nt, hsa; identical to SEQ ID NO: 132870

SEQ ID NO: 745475 - RNA, 64 nt, hsa; identical to SEQ ID NO: 132871

SEQ ID NO: 745476 - RNA, 64 nt, hsa; identical to SEQ ID NO: 132872

SEQ ID NO: 745477 - RNA, 64 nt, hsa; identical to SEQ ID NO: 132873

SEQ ID NO: 745478 - RNA, 64 nt, hsa; identical to SEQ ID NO: 132874

SEQ ID NO: 745479 - RNA, 64 nt, hsa; identical to SEQ ID NO: 132875

SEQ ID NO: 745480 - RNA, 64 nt, hsa; identical to SEQ ID NO: 132876

SEQ ID NO: 745481 - RNA, 64 nt, hsa; identical to SEQ ID NO: 132877

SEQ ID NO: 745482 - RNA, 64 nt, hsa; identical to SEQ ID NO: 132878

SEQ ID NO: 745483 - RNA, 64 nt, hsa; identical to SEQ ID NO: 132879

SEQ ID NO: 745484 - RNA, 64 nt, hsa; identical to SEQ ID NO: 132880

SEQ ID NO: 745485 - RNA, 64 nt, hsa; identical to SEQ ID NO: 132881

SEQ ID NO: 745486 - RNA, 64 nt, hsa; identical to SEQ ID NO: 132882

SEQ ID NO: 745487 - RNA, 64 nt, hsa; identical to SEQ ID NO: 132883

SEQ ID NO: 745488 - RNA, 64 nt, hsa; identical to SEQ ID NO: 132884

SEQ ID NO: 745489 - RNA, 64 nt, hsa; identical to SEQ ID NO: 132885

SEQ ID NO: 745490 - RNA, 64 nt, hsa; identical to SEQ ID NO: 132886

SEQ ID NO: 745491 - RNA, 64 nt, hsa; identical to SEQ ID NO: 132887

SEQ ID NO: 745492 - RNA, 64 nt, hsa; identical to SEQ ID NO: 132888

SEQ ID NO: 745493 - RNA, 64 nt, hsa; identical to SEQ ID NO: 132889

SEQ ID NO: 745494 - RNA, 64 nt, hsa; identical to SEQ ID NO: 188672

SEQ ID NO: 745495 - RNA, 64 nt, hsa; identical to SEQ ID NO: 188673

SEQ ID NO: 745496 - RNA, 64 nt, hsa; identical to SEQ ID NO: 188674

SEQ ID NO: 745497 - RNA, 64 nt, hsa; identical to SEQ ID NO: 188675

SEQ ID NO: 745498 - RNA, 64 nt, hsa; identical to SEQ ID NO: 188676

SEQ ID NO: 745499 - RNA, 64 nt, hsa; identical to SEQ ID NO: 188677

SEQ ID NO: 745500 - RNA, 64 nt, hsa; identical to SEQ ID NO: 188678

SEQ ID NO: 745501 - RNA, 64 nt, hsa; identical to SEQ ID NO: 188679

SEQ ID NO: 745502 - RNA, 64 nt, hsa; identical to SEQ ID NO: 667586

SEQ ID NO: 745503 - RNA, 64 nt, hsa; identical to SEQ ID NO: 667587

SEQ ID NO: 745504 - RNA, 64 nt, hsa; identical to SEQ ID NO: 217813

SEQ ID NO: 745505 - RNA, 64 nt, hsa; identical to SEQ ID NO: 217814

SEQ ID NO: 745506 - RNA, 64 nt, hsa; identical to SEQ ID NO: 217815

SEQ ID NO: 745507 - RNA, 64 nt, hsa; identical to SEQ ID NO: 217816

SEQ ID NO: 745508 - RNA, 64 nt, hsa; identical to SEQ ID NO: 217817

SEQ ID NO: 745509 - RNA, 64 nt, hsa; identical to SEQ ID NO: 217818

SEQ ID NO: 745510 - RNA, 64 nt, hsa; identical to SEQ ID NO: 217819

SEQ ID NO: 745511 - RNA, 64 nt, hsa; identical to SEQ ID NO: 217820

SEQ ID NO: 745512 - RNA, 64 nt, hsa; identical to SEQ ID NO: 217821

SEQ ID NO: 745513 - RNA, 64 nt, hsa; identical to SEQ ID NO: 217822

SEQ ID NO: 745514 - RNA, 64 nt, hsa; identical to SEQ ID NO: 217823

SEQ ID NO: 745515 - RNA, 64 nt, hsa; identical to SEQ ID NO: 217824

SEQ ID NO: 745516 - RNA, 64 nt, hsa; identical to SEQ ID NO: 217825

SEQ ID NO: 745517 - RNA, 64 nt, hsa; identical to SEQ ID NO: 217826

SEQ ID NO: 745518 - RNA, 64 nt, hsa; identical to SEQ ID NO: 217827

SEQ ID NO: 745519 - RNA, 64 nt, hsa; identical to SEQ ID NO: 217828

SEQ ID NO: 745520 - RNA, 64 nt, hsa; identical to SEQ ID NO: 217829

SEQ ID NO: 745521 - RNA, 64 nt, hsa; identical to SEQ ID NO: 217830

SEQ ID NO: 745522 - RNA, 64 nt, hsa; identical to SEQ ID NO: 217831

SEQ ID NO: 745523 - RNA, 64 nt, hsa; identical to SEQ ID NO: 217832

SEQ ID NO: 745524 - RNA, 64 nt, hsa; identical to SEQ ID NO: 217833

SEQ ID NO: 745525 - RNA, 64 nt, hsa; identical to SEQ ID NO: 217834

SEQ ID NO: 745526 - RNA, 64 nt, hsa; identical to SEQ ID NO: 217835

SEQ ID NO: 745527 - RNA, 64 nt, hsa; identical to SEQ ID NO: 217836

SEQ ID NO: 745528 - RNA, 64 nt, hsa; identical to SEQ ID NO: 217837

SEQ ID NO: 745529 - RNA, 64 nt, hsa; identical to SEQ ID NO: 217838

SEQ ID NO: 745530 - RNA, 64 nt, hsa; identical to SEQ ID NO: 217839

SEQ ID NO: 745531 - RNA, 64 nt, hsa; identical to SEQ ID NO: 217840

SEQ ID NO: 745532 - RNA, 64 nt, hsa; identical to SEQ ID NO: 217841

SEQ ID NO: 745533 - RNA, 63 nt, hsa; identical to SEQ ID NO: 217842

SEQ ID NO: 745534 - RNA, 64 nt, hsa; identical to SEQ ID NO: 217843

SEQ ID NO: 745535 - RNA, 64 nt, hsa; identical to SEQ ID NO: 217844

SEQ ID NO: 745536 - RNA, 64 nt, hsa; identical to SEQ ID NO: 217845

SEQ ID NO: 745537 - RNA, 64 nt, hsa; identical to SEQ ID NO: 217846

SEQ ID NO: 745538 - RNA, 64 nt, hsa; identical to SEQ ID NO: 217847

SEQ ID NO: 745539 - RNA, 64 nt, hsa; identical to SEQ ID NO: 217848

SEQ ID NO: 745540 - RNA, 64 nt, hsa; identical to SEQ ID NO: 217849

SEQ ID NO: 745541 - RNA, 64 nt, hsa; identical to SEQ ID NO: 217850

SEQ ID NO: 745542 - RNA, 64 nt, hsa; identical to SEQ ID NO: 217851

SEQ ID NO: 745543 - RNA, 64 nt, hsa; identical to SEQ ID NO: 217852

SEQ ID NO: 745544 - RNA, 64 nt, hsa; identical to SEQ ID NO: 217853

SEQ ID NO: 745545 - RNA, 64 nt, hsa; identical to SEQ ID NO: 217854

SEQ ID NO: 745546 - RNA, 64 nt, hsa; identical to SEQ ID NO: 217855

SEQ ID NO: 745547 - RNA, 64 nt, hsa; identical to SEQ ID NO: 217856

SEQ ID NO: 745548 - RNA, 64 nt, hsa; identical to SEQ ID NO: 217857

SEQ ID NO: 745549 - RNA, 64 nt, hsa; identical to SEQ ID NO: 217858

SEQ ID NO: 745550 - RNA, 64 nt, hsa; identical to SEQ ID NO: 217859

SEQ ID NO: 745551 - RNA, 64 nt, hsa; identical to SEQ ID NO: 217860

SEQ ID NO: 745552 - RNA, 64 nt, hsa; identical to SEQ ID NO: 217861

SEQ ID NO: 745553 - RNA, 64 nt, hsa; identical to SEQ ID NO: 217862

SEQ ID NO: 745554 - RNA, 64 nt, hsa; identical to SEQ ID NO: 217863

SEQ ID NO: 745555 - RNA, 64 nt, hsa; identical to SEQ ID NO: 217864

SEQ ID NO: 745556 - RNA, 64 nt, hsa; identical to SEQ ID NO: 217865

SEQ ID NO: 745557 - RNA, 64 nt, hsa
cuuuuugcucuuuagaaauuucccuuuaauuuauuacauucauugcuuacuguaaagaguccag

SEQ ID NO: 745558 - RNA, 64 nt, hsa
cucuggcuucuagcugaaaacuuuuccacaguuuuacauucaugugguuuucuccacugugaac

SEQ ID NO: 745559 - RNA, 64 nt, hsa
guccaacauuucauagguaguaggggccacauauuacauucaguugcuauagguccagcaacug

SEQ ID NO: 745560 - RNA, 64 nt, hsa
auaaccuuuauuauugcuauaucuuuguggauaauacauucagguggugcugggugauuuauua

SEQ ID NO: 745561 - RNA, 64 nt, hsa
ugagaagugucuaaaaacaccaaaaagggauccguacauucaauguuuaugcaaggaaggaaag

SEQ ID NO: 745562 - RNA, 64 nt, hsa
uccacccuauauguaguauaaagaaaaguagguuuacauucaucucauuccaacuucccaguuc

SEQ ID NO: 745563 - RNA, 64 nt, hsa
auguguuuauuuaacacacacacacaccuaauacuacauucaaaguauuuuauaaauacuaacc

SEQ ID NO: 745564 - RNA, 64 nt, hsa
auguauauguuuugggguauaugugauaauuugauacauucagauaguguguaaagaucaaaua

SEQ ID NO: 745565 - RNA, 64 nt, hsa
uaauuuguuuaauaagagauggauauauuaaaauuacauucaucaaggcaugauuuuuguuuca

SEQ ID NO: 745566 - RNA, 64 nt, hsa
uaaauuaucuaccauugccuauuuacaggauaaguacauucaggacaauuuauuguaccauucu

SEQ ID NO: 745567 - RNA, 64 nt, hsa
uugcacucuugugcuaguaugucuauagugugaauacauucauaaauuucuugaucaaagcuag

SEQ ID NO: 745568 - RNA, 64 nt, hsa
uucauaaauuucuugaucaaagcuaggucaaaguuacauucauuuuaauuuugguacauaucca

SEQ ID NO: 745569 - RNA, 64 nt, hsa
uuaaaugaaggcacucaguauucuuccugaauaauacauucaguuucucacauuuuaugcuuuc

SEQ ID NO: 745570 - RNA, 64 nt, hsa
accagaggauuauaaagaagugcaaauugacuuuuacauucaacuuuaguuaaaugaaggcacu

SEQ ID NO: 745571 - RNA, 64 nt, hsa
cugggauuacaggcgugagccaccgcgcccagccuacauucacuucuaaagucuauguaauggu

SEQ ID NO: 745572 - RNA, 64 nt, hsa
uuuagaacuccaguuuucaaaucauguuugaaucuacauucacuuuuuuuuguuuucuuuuuug

SEQ ID NO: 745573 - RNA, 64 nt, hsa
cacagccacacggaaagagacuuugccucacuuuuacauucacaaacaaacaaaggagggggga

SEQ ID NO: 745574 - RNA, 64 nt, hsa
aaaacuucccuccauggcuaagagggaaaacgcuuacauucaauucuuuagucauggauggucu

SEQ ID NO: 745575 - RNA, 64 nt, hsa
ccagucaugaugaggugauguaugaauacaugcauacauucaaagcacuguuuucaaaguuaau

SEQ ID NO: 745576 - RNA, 64 nt, hsa
uuaucuuuguuguauuggcauaaucagugacuuguacauucagcaauagcauuugagcaaguuu

SEQ ID NO: 745577 - RNA, 64 nt, hsa; identical to SEQ ID NO: 323443

SEQ ID NO: 745578 - RNA, 64 nt, hsa; identical to SEQ ID NO: 323444

SEQ ID NO: 745579 - RNA, 64 nt, hsa; identical to SEQ ID NO: 323445

SEQ ID NO: 745580 - RNA, 64 nt, hsa; identical to SEQ ID NO: 323446

SEQ ID NO: 745581 - RNA, 64 nt, hsa; identical to SEQ ID NO: 323447

SEQ ID NO: 745582 - RNA, 64 nt, hsa; identical to SEQ ID NO: 323448

SEQ ID NO: 745583 - RNA, 64 nt, hsa; identical to SEQ ID NO: 323449

SEQ ID NO: 745584 - RNA, 64 nt, hsa; identical to SEQ ID NO: 323450

SEQ ID NO: 745585 - RNA, 64 nt, hsa; identical to SEQ ID NO: 323451

SEQ ID NO: 745586 - RNA, 64 nt, hsa; identical to SEQ ID NO: 323452

SEQ ID NO: 745587 - RNA, 64 nt, hsa; identical to SEQ ID NO: 104209

SEQ ID NO: 745588 - RNA, 64 nt, hsa; identical to SEQ ID NO: 104210

SEQ ID NO: 745589 - RNA, 64 nt, hsa; identical to SEQ ID NO: 104211

SEQ ID NO: 745590 - RNA, 64 nt, hsa; identical to SEQ ID NO: 104212

SEQ ID NO: 745591 - RNA, 64 nt, hsa
ugaggggaaaaaaaaaugaccuuuucuugaaauguaacuugaaaacaaaauaaaauguggaaca

SEQ ID NO: 745592 - RNA, 64 nt, hsa
cuuugggaaauggugccacucaaaagcaacuuccuaacuugaggaauaacuccuuuguaguuua

SEQ ID NO: 745593 - RNA, 64 nt, hsa
ccucccccugcuggggccucaguuuccccaucuguaacuugagaaaauagaacuagaucuguaa

SEQ ID NO: 745594 - RNA, 64 nt, hsa
gucauuuguucagauuauuuguauuuaaagucauuaacuugaucccuuucuccagacuggccau

SEQ ID NO: 745595 - RNA, 64 nt, hsa
agaagaagaaacccugagccauuaaugugucucguaacuugaggaaguucaugaauucucuggg

SEQ ID NO: 745596 - RNA, 64 nt, hsa
uuccugccagaaaguugguucuugcaaaauagauuaacuugaugacuauguguauauuggauac

SEQ ID NO: 745597 - RNA, 64 nt, hsa
aggaaagcaauaaaugaaugggcugagcugccuguaacuugagaguagaugguuugagccugag

SEQ ID NO: 745598 - RNA, 64 nt, hsa
cuaauauuuuaugugagagaaagugugagcaaacuaacuugacuuuuaaggcuaaaacuuaaca

SEQ ID NO: 745599 - RNA, 64 nt, hsa
uccacauauugaaaaaacuguaaaauuauagcacuaacuugauuuuagaaaaugagcauuuuuu

SEQ ID NO: 745600 - RNA, 64 nt, hsa
aacaacucgacaugccuaugcagccacacagugguaacuugaaggcagcacagaggugagggau

SEQ ID NO: 745601 - RNA, 64 nt, hsa
ugaugucucaaauguagagauuaucuaaaaaucguaacuugaauaccuuguaauuuuucucuua

SEQ ID NO: 745602 - RNA, 64 nt, hsa
cuuauggaaaaccuuuuguguuucugguauuuaauaacuugaagggauagcaaaauauacugug

SEQ ID NO: 745603 - RNA, 64 nt, hsa
cauuuauaugaaugaaacucccuuuuaaaccuguuaacuugaaggagaacagaaaugguauuac

SEQ ID NO: 745604 - RNA, 64 nt, hsa
acaucauuuaaaaaacccuugcuguaaaguaggauaacuugaauauucauucuaauaauuagac

SEQ ID NO: 745605 - RNA, 64 nt, hsa
uuguuuacugaaauuuguuauacuucaaaagccauaacuugaaaaauacugguggcgucgaugg

SEQ ID NO: 745606 - RNA, 64 nt, hsa
acauaugaggacaagguauacacccaguucugaauaacuugaagaacaggcuuggcaaagaagu

SEQ ID NO: 745607 - RNA, 64 nt, hsa
uuaagggggaaacuacaugaagucaccguuacaguaacuugauguguauauuaauaaaaguaau

SEQ ID NO: 745608 - RNA, 64 nt, hsa
cccuuguugacuuuucuacacugaacauuuuuuuuaacuugauuuaauaaaaauguuaauuuug

SEQ ID NO: 745609 - RNA, 64 nt, hsa
aaagaacuugaaccuauguuauaugauacaugcauaacuugagcuacacuaaaccacaugacag

SEQ ID NO: 745610 - RNA, 64 nt, hsa
auaguauauauuucaaacauaguuauguuuucucuaacuugaugaggucaugucacagaccauu

SEQ ID NO: 745611 - RNA, 64 nt, hsa; identical to SEQ ID NO: 104346

SEQ ID NO: 745612 - RNA, 64 nt, hsa; identical to SEQ ID NO: 104347

SEQ ID NO: 745613 - RNA, 64 nt, hsa; identical to SEQ ID NO: 104348

SEQ ID NO: 745614 - RNA, 64 nt, hsa; identical to SEQ ID NO: 104349

SEQ ID NO: 745615 - RNA, 64 nt, hsa; identical to SEQ ID NO: 104350

SEQ ID NO: 745616 - RNA, 64 nt, hsa; identical to SEQ ID NO: 104351

SEQ ID NO: 745617 - RNA, 64 nt, hsa; identical to SEQ ID NO: 104352

SEQ ID NO: 745618 - RNA, 64 nt, hsa; identical to SEQ ID NO: 104353

SEQ ID NO: 745619 - RNA, 64 nt, hsa; identical to SEQ ID NO: 104354

SEQ ID NO: 745620 - RNA, 64 nt, hsa; identical to SEQ ID NO: 104355

SEQ ID NO: 745621 - RNA, 64 nt, hsa; identical to SEQ ID NO: 104356

SEQ ID NO: 745622 - RNA, 64 nt, hsa; identical to SEQ ID NO: 104357

SEQ ID NO: 745623 - RNA, 64 nt, hsa; identical to SEQ ID NO: 104358

SEQ ID NO: 745624 - RNA, 64 nt, hsa; identical to SEQ ID NO: 104359

SEQ ID NO: 745625 - RNA, 64 nt, hsa; identical to SEQ ID NO: 104360

SEQ ID NO: 745626 - RNA, 64 nt, hsa; identical to SEQ ID NO: 104361

SEQ ID NO: 745627 - RNA, 64 nt, hsa; identical to SEQ ID NO: 104362

SEQ ID NO: 745628 - RNA, 64 nt, hsa; identical to SEQ ID NO: 104363

SEQ ID NO: 745629 - RNA, 64 nt, hsa; identical to SEQ ID NO: 104364

SEQ ID NO: 745630 - RNA, 64 nt, hsa; identical to SEQ ID NO: 104365

SEQ ID NO: 745631 - RNA, 64 nt, hsa; identical to SEQ ID NO: 104366

SEQ ID NO: 745632 - RNA, 64 nt, hsa; identical to SEQ ID NO: 104367

SEQ ID NO: 745633 - RNA, 64 nt, hsa; identical to SEQ ID NO: 104368

SEQ ID NO: 745634 - RNA, 64 nt, hsa; identical to SEQ ID NO: 104369

SEQ ID NO: 745635 - RNA, 64 nt, hsa; identical to SEQ ID NO: 104370

SEQ ID NO: 745636 - RNA, 64 nt, hsa; identical to SEQ ID NO: 104371

SEQ ID NO: 745637 - RNA, 64 nt, hsa; identical to SEQ ID NO: 104372

SEQ ID NO: 745638 - RNA, 64 nt, hsa; identical to SEQ ID NO: 104373

SEQ ID NO: 745639 - RNA, 64 nt, hsa; identical to SEQ ID NO: 104374

SEQ ID NO: 745640 - RNA, 64 nt, hsa; identical to SEQ ID NO: 104375

SEQ ID NO: 745641 - RNA, 64 nt, hsa; identical to SEQ ID NO: 104376

SEQ ID NO: 745642 - RNA, 64 nt, hsa; identical to SEQ ID NO: 104377

SEQ ID NO: 745643 - RNA, 64 nt, hsa; identical to SEQ ID NO: 104378

SEQ ID NO: 745644 - RNA, 64 nt, hsa; identical to SEQ ID NO: 104379

SEQ ID NO: 745645 - RNA, 64 nt, hsa; identical to SEQ ID NO: 104380

SEQ ID NO: 745646 - RNA, 64 nt, hsa; identical to SEQ ID NO: 104381

SEQ ID NO: 745647 - RNA, 64 nt, hsa; identical to SEQ ID NO: 104382

SEQ ID NO: 745648 - RNA, 64 nt, hsa; identical to SEQ ID NO: 104383

SEQ ID NO: 745649 - RNA, 64 nt, hsa; identical to SEQ ID NO: 104384

SEQ ID NO: 745650 - RNA, 64 nt, hsa; identical to SEQ ID NO: 104385

SEQ ID NO: 745651 - RNA, 64 nt, hsa; identical to SEQ ID NO: 104386

SEQ ID NO: 745652 - RNA, 64 nt, hsa; identical to SEQ ID NO: 104387

SEQ ID NO: 745653 - RNA, 64 nt, hsa; identical to SEQ ID NO: 104388

SEQ ID NO: 745654 - RNA, 64 nt, hsa; identical to SEQ ID NO: 104389

SEQ ID NO: 745655 - RNA, 64 nt, hsa; identical to SEQ ID NO: 104390

SEQ ID NO: 745656 - RNA, 64 nt, hsa; identical to SEQ ID NO: 104391

SEQ ID NO: 745657 - RNA, 64 nt, hsa; identical to SEQ ID NO: 104392

SEQ ID NO: 745658 - RNA, 64 nt, hsa; identical to SEQ ID NO: 104393

SEQ ID NO: 745659 - RNA, 64 nt, hsa; identical to SEQ ID NO: 104394

SEQ ID NO: 745660 - RNA, 64 nt, hsa; identical to SEQ ID NO: 104395

SEQ ID NO: 745661 - RNA, 64 nt, hsa; identical to SEQ ID NO: 104396

SEQ ID NO: 745662 - RNA, 64 nt, hsa; identical to SEQ ID NO: 104397

SEQ ID NO: 745663 - RNA, 64 nt, hsa; identical to SEQ ID NO: 104398

SEQ ID NO: 745664 - RNA, 64 nt, hsa; identical to SEQ ID NO: 104399

SEQ ID NO: 745665 - RNA, 64 nt, hsa; identical to SEQ ID NO: 104400

SEQ ID NO: 745666 - RNA, 64 nt, hsa; identical to SEQ ID NO: 104401

SEQ ID NO: 745667 - RNA, 64 nt, hsa; identical to SEQ ID NO: 104402

SEQ ID NO: 745668 - RNA, 64 nt, hsa; identical to SEQ ID NO: 104403

SEQ ID NO: 745669 - RNA, 64 nt, hsa; identical to SEQ ID NO: 104404

SEQ ID NO: 745670 - RNA, 64 nt, hsa; identical to SEQ ID NO: 104405

SEQ ID NO: 745671 - RNA, 64 nt, hsa; identical to SEQ ID NO: 104406

SEQ ID NO: 745672 - RNA, 64 nt, hsa; identical to SEQ ID NO: 104407

SEQ ID NO: 745673 - RNA, 64 nt, hsa; identical to SEQ ID NO: 104408

SEQ ID NO: 745674 - RNA, 64 nt, hsa; identical to SEQ ID NO: 104409

SEQ ID NO: 745675 - RNA, 64 nt, hsa; identical to SEQ ID NO: 104410

SEQ ID NO: 745676 - RNA, 64 nt, hsa; identical to SEQ ID NO: 104411

SEQ ID NO: 745677 - RNA, 64 nt, hsa; identical to SEQ ID NO: 104412

SEQ ID NO: 745678 - RNA, 64 nt, hsa; identical to SEQ ID NO: 104413

SEQ ID NO: 745679 - RNA, 64 nt, hsa; identical to SEQ ID NO: 104414

SEQ ID NO: 745680 - RNA, 64 nt, hsa; identical to SEQ ID NO: 104415

SEQ ID NO: 745681 - RNA, 64 nt, hsa; identical to SEQ ID NO: 104416

SEQ ID NO: 745682 - RNA, 64 nt, hsa; identical to SEQ ID NO: 104417

SEQ ID NO: 745683 - RNA, 64 nt, hsa; identical to SEQ ID NO: 104418

SEQ ID NO: 745684 - RNA, 64 nt, hsa; identical to SEQ ID NO: 104419

SEQ ID NO: 745685 - RNA, 64 nt, hsa; identical to SEQ ID NO: 104420

SEQ ID NO: 745686 - RNA, 64 nt, hsa; identical to SEQ ID NO: 104421

SEQ ID NO: 745687 - RNA, 64 nt, hsa; identical to SEQ ID NO: 104422

SEQ ID NO: 745688 - RNA, 64 nt, hsa; identical to SEQ ID NO: 104423

SEQ ID NO: 745689 - RNA, 64 nt, hsa; identical to SEQ ID NO: 104424

SEQ ID NO: 745690 - RNA, 64 nt, hsa; identical to SEQ ID NO: 104425

SEQ ID NO: 745691 - RNA, 62 nt, hsa
agucuccaccccuacacaaggacagaacccuccaccccuacccccaacccucagacagacuu

SEQ ID NO: 745692 - RNA, 62 nt, hsa
ugcacccuggacuucucuaauagaaaagucuccaccccuacacaaggacagaacccuccacc

SEQ ID NO: 745693 - RNA, 62 nt, hsa
cucaggccugugcccacucccuaucuccuucccaccccuacacacacacucccugcuugcag

SEQ ID NO: 745694 - RNA, 62 nt, hsa
ugcuggggcagggggugaagaacccucugucccaccccuagccaccaguguccuccaagugc

SEQ ID NO: 745695 - RNA, 62 nt, hsa
ucuggaaugcuccaguuugaucucccuucugccaccccuaccucaccccuagucacucauau

SEQ ID NO: 745696 - RNA, 62 nt, hsa
ccaguuugaucucccuucugccaccccuaccucaccccuagucacucauaucggagccugga

SEQ ID NO: 745697 - RNA, 62 nt, hsa
cuccaggggggacaauaugugccaaucaauagcaccccuacucacauacacacacaccuagc

SEQ ID NO: 745698 - RNA, 62 nt, hsa
uuuacuuuuuugguacuauaaaagcuuucugccaccccuaaacuccaggggggacaauaugu

SEQ ID NO: 745699 - RNA, 62 nt, hsa
cccuaucccugcagccugagggucccuucagccaccccuaaguccccaccugggcuccugcc

SEQ ID NO: 745700 - RNA, 62 nt, hsa
cgcccgcggucccccagcaccugcccaagccacaccccuagcuucccucccuaucccugcag

SEQ ID NO: 745701 - RNA, 65 nt, hsa
auuuccuaauuuuauuuauuucauacuguaguguacaguauuauaguucuucaauauauagauau

SEQ ID NO: 745702 - RNA, 65 nt, hsa
auuauuuucuguacuuuuuuguucauuaauuuugucaguauuacaccaaacuguuuuugcaacaa

SEQ ID NO: 745703 - RNA, 65 nt, hsa
uguuaagcucacccuguucuuugaagcacccaugucaguauuagaagaauaggcagcaguuccuu

SEQ ID NO: 745704 - RNA, 65 nt, hsa
ccuuuuuaauuuaaugugcucgcacuacaaugcaucaguauuaugauuccucuguacuuuccuuu

SEQ ID NO: 745705 - RNA, 65 nt, hsa
cgcuugaggcucagaagagccucuguccagccccucaguauuaccaugucucccucucaggggua

SEQ ID NO: 745706 - RNA, 65 nt, hsa
accaggguccuucccugccccacuuccccuuuucccaguauuacugaauagucccagcuggagag

SEQ ID NO: 745707 - RNA, 65 nt, hsa
auuaucuuacugguucaacauuuuucugauauaugcaguauuacagauauucagcaaaaguauua

SEQ ID NO: 745708 - RNA, 65 nt, hsa
guaccuguaucaaaggaauuuuaacaaagagcaaucaguauuauuggaccaaauuugguguuugu

SEQ ID NO: 745709 - RNA, 65 nt, hsa
cuuacccucuguaagauacugauucuuccuggggccaguauuaccuuguaugcaaauauuacaua

SEQ ID NO: 745710 - RNA, 65 nt, hsa
uauacagauguacuagcuaaagucucuuuaugugucaguauuaagaguaauauguagccagauua

SEQ ID NO: 745711 - RNA, 65 nt, hsa
ucaauucuguaaguggugacuuuuugagcaccuuucaguauuauguauuuguaaaaaccauuguu

SEQ ID NO: 745712 - RNA, 65 nt, hsa
uacuuguuaggaaguagcuuaauuaccccccauugcaguauuauuguuauauauauaguuaauau

SEQ ID NO: 745713 - RNA, 65 nt, hsa
caaaggaaaucgccuagcuccaggcuguguuaggacaguauuagcaugaaggcugugcgaccauc

SEQ ID NO: 745714 - RNA, 65 nt, hsa
cucauucguaccaugccaaacgcauucacucggggcaguauuaaccguucuagaaagccacuguu

SEQ ID NO: 745715 - RNA, 65 nt, hsa
ggacuugccaaacagucuuuuaugaaggaaaguuacaguauuaauuuuugaaaagguuuuuuuua

SEQ ID NO: 745716 - RNA, 65 nt, hsa
ugacccuacaacugcccugggacauuucacuguaccaguauuaacugcaaacagcaauaauuguc

SEQ ID NO: 745717 - RNA, 65 nt, hsa
cacccuuaugagaagugaagguuuuguaaacuuuccaguauuaauuugggcggguauuccccgcu

SEQ ID NO: 745718 - RNA, 65 nt, hsa
augauauuaagaucaaagggaggaagggaagacagcaguauuaauucacccuagauuacucaauu

SEQ ID NO: 745719 - RNA, 65 nt, hsa
acauaauuaaacuauuucugcuauuauuuuuaaagcaguauuauuuuauaaccaauucuaaaauu

SEQ ID NO: 745720 - RNA, 65 nt, hsa
ucauacacuucuuaaaaugugaaaaucuauguuuucaguauuaugacaguaucugcagauacuau

SEQ ID NO: 745721 - RNA, 65 nt, hsa
ggauucacuuuguguguguuagugcucuaaaguagcaguauuauuauuaaacuguccccagagua

SEQ ID NO: 745722 - RNA, 65 nt, hsa
gucaugaacuuugagaaugggcuuccuuuuugguucaguauuagugagagggagagggagaugga

SEQ ID NO: 745723 - RNA, 65 nt, hsa
cucauuuaaucuuuacuacacuccugcaacauagacaguauuauuacauucaguauuacaauggc

SEQ ID NO: 745724 - RNA, 65 nt, hsa
cuacacuccugcaacauagacaguauuauuacauucaguauuacaauggcagaaacagacagaaa

SEQ ID NO: 745725 - RNA, 65 nt, hsa
auacaauauuuauaacuauaaacuuuauagaaguacaguauuaaagucagugguacacagacauu

SEQ ID NO: 745726 - RNA, 65 nt, hsa
gguucuaaucauuucagcaguagcgucuuaaacagcaguauuacuauaagcaguugcuucaaaau

SEQ ID NO: 745727 - RNA, 65 nt, hsa
ccuucucugucucaugugugcucuucuucuuucuacaguauuauguacucuacugauaucuaaau

SEQ ID NO: 745728 - RNA, 65 nt, hsa
gacauuuugccaaaauuauuaauauaagaagcuuucaguauuagugaugucaucugucacuauag

SEQ ID NO: 745729 - RNA, 65 nt, hsa
aacaguaucuuacaaaaaacguguugcucucuucacaguauuauguguaaagucauuguuuaaag

SEQ ID NO: 745730 - RNA, 65 nt, hsa
uccauguuagcucaugguguaagaugaugucuugucaguauuacuguuuugcuaagccgcuucau

SEQ ID NO: 745731 - RNA, 64 nt, hsa; identical to SEQ ID NO: 198310

SEQ ID NO: 745732 - RNA, 64 nt, hsa; identical to SEQ ID NO: 198311

SEQ ID NO: 745733 - RNA, 64 nt, hsa; identical to SEQ ID NO: 198312

SEQ ID NO: 745734 - RNA, 64 nt, hsa; identical to SEQ ID NO: 198313

SEQ ID NO: 745735 - RNA, 64 nt, hsa; identical to SEQ ID NO: 198314

SEQ ID NO: 745736 - RNA, 64 nt, hsa; identical to SEQ ID NO: 198315

SEQ ID NO: 745737 - RNA, 64 nt, hsa; identical to SEQ ID NO: 198316

SEQ ID NO: 745738 - RNA, 64 nt, hsa; identical to SEQ ID NO: 198317

SEQ ID NO: 745739 - RNA, 64 nt, hsa; identical to SEQ ID NO: 198318

SEQ ID NO: 745740 - RNA, 64 nt, hsa; identical to SEQ ID NO: 198319

SEQ ID NO: 745741 - RNA, 64 nt, hsa; identical to SEQ ID NO: 198320

SEQ ID NO: 745742 - RNA, 64 nt, hsa; identical to SEQ ID NO: 198321

SEQ ID NO: 745743 - RNA, 64 nt, hsa; identical to SEQ ID NO: 198322

SEQ ID NO: 745744 - RNA, 64 nt, hsa; identical to SEQ ID NO: 198323

SEQ ID NO: 745745 - RNA, 64 nt, hsa; identical to SEQ ID NO: 198324

SEQ ID NO: 745746 - RNA, 64 nt, hsa; identical to SEQ ID NO: 198325

SEQ ID NO: 745747 - RNA, 64 nt, hsa; identical to SEQ ID NO: 198326

SEQ ID NO: 745748 - RNA, 64 nt, hsa; identical to SEQ ID NO: 198327

SEQ ID NO: 745749 - RNA, 64 nt, hsa; identical to SEQ ID NO: 198328

SEQ ID NO: 745750 - RNA, 64 nt, hsa; identical to SEQ ID NO: 198329

SEQ ID NO: 745751 - RNA, 64 nt, hsa; identical to SEQ ID NO: 198330

SEQ ID NO: 745752 - RNA, 64 nt, hsa; identical to SEQ ID NO: 198331

SEQ ID NO: 745753 - RNA, 64 nt, hsa
uccuguagaccugaggggucccucucucuagggucuccuguagggcuuaugacugugaauccuu

SEQ ID NO: 745754 - RNA, 64 nt, hsa
ggggccucucccucacugcuggacuggagcugggcuccuguagaccugaggggucccucucucu

SEQ ID NO: 745755 - RNA, 64 nt, hsa
ucuauccuaugaauaagaaccuggucaugcuuuacuccuguauuguuauuuuguucauuuccaa

SEQ ID NO: 745756 - RNA, 64 nt, hsa
aaaaauaaaaaaauuagcugggugugguggugcacuccuguaaucccagcuacucagaaggcug

SEQ ID NO: 745757 - RNA, 64 nt, hsa
uggccucagaccaacucucuccuguauaaucucucuccuguauaaccccaccuugccaagcuuu

SEQ ID NO: 745758 - RNA, 64 nt, hsa
uucccuugaacuguucuggccucagaccaacucucuccuguauaaucucucuccuguauaaccc

SEQ ID NO: 745759 - RNA, 64 nt, hsa
caagugguacaaagacaacgcugagggguagugacuccuguagcagcagagacgccuuggaguu

SEQ ID NO: 745760 - RNA, 64 nt, hsa
aggacuuugaccuucccagggguccacacuuuaccuccuguaucuucauacgcguguguggaug

SEQ ID NO: 745761 - RNA, 64 nt, hsa
uauuuucuuuuaguugaguuagguuuuuccccaucuccuguagagcgaauuuacauauuguauu

SEQ ID NO: 745762 - RNA, 64 nt, hsa
ucacacuguagccucuuccuuaaaauuuguggugcuccuguaacaguaagaacuaauucugaaa

SEQ ID NO: 745763 - RNA, 64 nt, hsa
aggagaaagagccuuggccuuaaggaaaucuuuacuccuguaagcaagagccaaccucacagga

SEQ ID NO: 745764 - RNA, 64 nt, hsa
ucucccuggcccaccuuauagagagcccaaagagcuccuguaagagggagaacucuaucugugg

SEQ ID NO: 745765 - RNA, 64 nt, hsa
gaccugaguagggggcagggaguucaggacaacccuccuguaaguuggggguggucugggggua

SEQ ID NO: 745766 - RNA, 64 nt, hsa
uucucuacuuuucccuaauucccucuccuccugacuccuguagacauucccaaugauacccacc

SEQ ID NO: 745767 - RNA, 64 nt, hsa; identical to SEQ ID NO: 38140

SEQ ID NO: 745768 - RNA, 64 nt, hsa; identical to SEQ ID NO: 38141

SEQ ID NO: 745769 - RNA, 64 nt, hsa; identical to SEQ ID NO: 38142

SEQ ID NO: 745770 - RNA, 64 nt, hsa; identical to SEQ ID NO: 38143

SEQ ID NO: 745771 - RNA, 64 nt, hsa; identical to SEQ ID NO: 38144

SEQ ID NO: 745772 - RNA, 64 nt, hsa; identical to SEQ ID NO: 38145

SEQ ID NO: 745773 - RNA, 64 nt, hsa; identical to SEQ ID NO: 38146

SEQ ID NO: 745774 - RNA, 64 nt, hsa; identical to SEQ ID NO: 38147

SEQ ID NO: 745775 - RNA, 64 nt, hsa; identical to SEQ ID NO: 38148

SEQ ID NO: 745776 - RNA, 64 nt, hsa; identical to SEQ ID NO: 38149

SEQ ID NO: 745777 - RNA, 64 nt, hsa; identical to SEQ ID NO: 38150

SEQ ID NO: 745778 - RNA, 64 nt, hsa; identical to SEQ ID NO: 38151

SEQ ID NO: 745779 - RNA, 64 nt, hsa; identical to SEQ ID NO: 38152

SEQ ID NO: 745780 - RNA, 64 nt, hsa; identical to SEQ ID NO: 38153

SEQ ID NO: 745781 - RNA, 64 nt, hsa; identical to SEQ ID NO: 38154

SEQ ID NO: 745782 - RNA, 64 nt, hsa; identical to SEQ ID NO: 38155

SEQ ID NO: 745783 - RNA, 64 nt, hsa; identical to SEQ ID NO: 38156

SEQ ID NO: 745784 - RNA, 64 nt, hsa; identical to SEQ ID NO: 38157

SEQ ID NO: 745785 - RNA, 64 nt, hsa; identical to SEQ ID NO: 38158

SEQ ID NO: 745786 - RNA, 64 nt, hsa; identical to SEQ ID NO: 38159

SEQ ID NO: 745787 - RNA, 64 nt, hsa; identical to SEQ ID NO: 38160

SEQ ID NO: 745788 - RNA, 64 nt, hsa; identical to SEQ ID NO: 38161

SEQ ID NO: 745789 - RNA, 64 nt, hsa; identical to SEQ ID NO: 333593

SEQ ID NO: 745790 - RNA, 64 nt, hsa; identical to SEQ ID NO: 333594

SEQ ID NO: 745791 - RNA, 64 nt, hsa; identical to SEQ ID NO: 333595

SEQ ID NO: 745792 - RNA, 64 nt, hsa; identical to SEQ ID NO: 333596

SEQ ID NO: 745793 - RNA, 64 nt, hsa; identical to SEQ ID NO: 333597

SEQ ID NO: 745794 - RNA, 64 nt, hsa; identical to SEQ ID NO: 333598

SEQ ID NO: 745795 - RNA, 64 nt, hsa; identical to SEQ ID NO: 333599

SEQ ID NO: 745796 - RNA, 64 nt, hsa; identical to SEQ ID NO: 333600

SEQ ID NO: 745797 - RNA, 64 nt, hsa; identical to SEQ ID NO: 333601

SEQ ID NO: 745798 - RNA, 64 nt, hsa; identical to SEQ ID NO: 333602

SEQ ID NO: 745799 - RNA, 64 nt, hsa; identical to SEQ ID NO: 333603

SEQ ID NO: 745800 - RNA, 64 nt, hsa; identical to SEQ ID NO: 333604

SEQ ID NO: 745801 - RNA, 64 nt, hsa; identical to SEQ ID NO: 574722

SEQ ID NO: 745802 - RNA, 64 nt, hsa; identical to SEQ ID NO: 574723

SEQ ID NO: 745803 - RNA, 64 nt, hsa; identical to SEQ ID NO: 574724

SEQ ID NO: 745804 - RNA, 64 nt, hsa; identical to SEQ ID NO: 574725

SEQ ID NO: 745805 - RNA, 64 nt, hsa; identical to SEQ ID NO: 574726

SEQ ID NO: 745806 - RNA, 64 nt, hsa; identical to SEQ ID NO: 574727

SEQ ID NO: 745807 - RNA, 64 nt, hsa; identical to SEQ ID NO: 574728

SEQ ID NO: 745808 - RNA, 64 nt, hsa; identical to SEQ ID NO: 574729

SEQ ID NO: 745809 - RNA, 64 nt, hsa; identical to SEQ ID NO: 51971

SEQ ID NO: 745810 - RNA, 64 nt, hsa; identical to SEQ ID NO: 51972

SEQ ID NO: 745811 - RNA, 64 nt, hsa; identical to SEQ ID NO: 51973

SEQ ID NO: 745812 - RNA, 64 nt, hsa; identical to SEQ ID NO: 51974

SEQ ID NO: 745813 - RNA, 64 nt, hsa; identical to SEQ ID NO: 51975

SEQ ID NO: 745814 - RNA, 64 nt, hsa; identical to SEQ ID NO: 51976

SEQ ID NO: 745815 - RNA, 52 nt, hsa; identical to SEQ ID NO: 51977

SEQ ID NO: 745816 - RNA, 64 nt, hsa; identical to SEQ ID NO: 51978

SEQ ID NO: 745817 - RNA, 64 nt, hsa; identical to SEQ ID NO: 51979

SEQ ID NO: 745818 - RNA, 64 nt, hsa; identical to SEQ ID NO: 51980

SEQ ID NO: 745819 - RNA, 64 nt, hsa; identical to SEQ ID NO: 51981

SEQ ID NO: 745820 - RNA, 64 nt, hsa; identical to SEQ ID NO: 51982

SEQ ID NO: 745821 - RNA, 64 nt, hsa; identical to SEQ ID NO: 51983

SEQ ID NO: 745822 - RNA, 64 nt, hsa; identical to SEQ ID NO: 51984

SEQ ID NO: 745823 - RNA, 64 nt, hsa; identical to SEQ ID NO: 51985

SEQ ID NO: 745824 - RNA, 64 nt, hsa; identical to SEQ ID NO: 51986

SEQ ID NO: 745825 - RNA, 64 nt, hsa; identical to SEQ ID NO: 51987

SEQ ID NO: 745826 - RNA, 64 nt, hsa; identical to SEQ ID NO: 51988

SEQ ID NO: 745827 - RNA, 64 nt, hsa; identical to SEQ ID NO: 51989

SEQ ID NO: 745828 - RNA, 64 nt, hsa; identical to SEQ ID NO: 51990

SEQ ID NO: 745829 - RNA, 64 nt, hsa; identical to SEQ ID NO: 51991

SEQ ID NO: 745830 - RNA, 64 nt, hsa; identical to SEQ ID NO: 51992

SEQ ID NO: 745831 - RNA, 64 nt, hsa; identical to SEQ ID NO: 51993

SEQ ID NO: 745832 - RNA, 64 nt, hsa; identical to SEQ ID NO: 51994

SEQ ID NO: 745833 - RNA, 64 nt, hsa; identical to SEQ ID NO: 51995

SEQ ID NO: 745834 - RNA, 64 nt, hsa; identical to SEQ ID NO: 51996

SEQ ID NO: 745835 - RNA, 64 nt, hsa; identical to SEQ ID NO: 51997

SEQ ID NO: 745836 - RNA, 64 nt, hsa; identical to SEQ ID NO: 51998

SEQ ID NO: 745837 - RNA, 64 nt, hsa; identical to SEQ ID NO: 51999

SEQ ID NO: 745838 - RNA, 64 nt, hsa; identical to SEQ ID NO: 52000

SEQ ID NO: 745839 - RNA, 64 nt, hsa; identical to SEQ ID NO: 52001

SEQ ID NO: 745840 - RNA, 64 nt, hsa; identical to SEQ ID NO: 52002

SEQ ID NO: 745841 - RNA, 64 nt, hsa; identical to SEQ ID NO: 52003

SEQ ID NO: 745842 - RNA, 64 nt, hsa; identical to SEQ ID NO: 603756

SEQ ID NO: 745843 - RNA, 64 nt, hsa; identical to SEQ ID NO: 603757

SEQ ID NO: 745844 - RNA, 64 nt, hsa; identical to SEQ ID NO: 603758

SEQ ID NO: 745845 - RNA, 64 nt, hsa; identical to SEQ ID NO: 603759

SEQ ID NO: 745846 - RNA, 64 nt, hsa; identical to SEQ ID NO: 603760

SEQ ID NO: 745847 - RNA, 64 nt, hsa; identical to SEQ ID NO: 603761

SEQ ID NO: 745848 - RNA, 64 nt, hsa; identical to SEQ ID NO: 603762

SEQ ID NO: 745849 - RNA, 64 nt, hsa; identical to SEQ ID NO: 603763

SEQ ID NO: 745850 - RNA, 64 nt, hsa; identical to SEQ ID NO: 603764

SEQ ID NO: 745851 - RNA, 64 nt, hsa; identical to SEQ ID NO: 603765

SEQ ID NO: 745852 - RNA, 64 nt, hsa; identical to SEQ ID NO: 603766

SEQ ID NO: 745853 - RNA, 64 nt, hsa; identical to SEQ ID NO: 603767

SEQ ID NO: 745854 - RNA, 64 nt, hsa; identical to SEQ ID NO: 603768

SEQ ID NO: 745855 - RNA, 64 nt, hsa; identical to SEQ ID NO: 603769

SEQ ID NO: 745856 - RNA, 64 nt, hsa; identical to SEQ ID NO: 603770

SEQ ID NO: 745857 - RNA, 64 nt, hsa; identical to SEQ ID NO: 603771

SEQ ID NO: 745858 - RNA, 64 nt, hsa; identical to SEQ ID NO: 603772

SEQ ID NO: 745859 - RNA, 64 nt, hsa; identical to SEQ ID NO: 603773

SEQ ID NO: 745860 - RNA, 64 nt, hsa; identical to SEQ ID NO: 603774

SEQ ID NO: 745861 - RNA, 64 nt, hsa; identical to SEQ ID NO: 603775

SEQ ID NO: 745862 - RNA, 64 nt, hsa; identical to SEQ ID NO: 603776

SEQ ID NO: 745863 - RNA, 64 nt, hsa; identical to SEQ ID NO: 603777

SEQ ID NO: 745864 - RNA, 64 nt, hsa; identical to SEQ ID NO: 603778

SEQ ID NO: 745865 - RNA, 64 nt, hsa; identical to SEQ ID NO: 603779

SEQ ID NO: 745866 - RNA, 64 nt, hsa; identical to SEQ ID NO: 603780

SEQ ID NO: 745867 - RNA, 64 nt, hsa; identical to SEQ ID NO: 603781

SEQ ID NO: 745868 - RNA, 64 nt, hsa; identical to SEQ ID NO: 603782

SEQ ID NO: 745869 - RNA, 64 nt, hsa; identical to SEQ ID NO: 603783

SEQ ID NO: 745870 - RNA, 64 nt, hsa; identical to SEQ ID NO: 603784

SEQ ID NO: 745871 - RNA, 64 nt, hsa; identical to SEQ ID NO: 603785

SEQ ID NO: 745872 - RNA, 64 nt, hsa
cucuuucauccagucuaguauaucacuaaaucaucauuacgauguuuggcuaucaagucauuaa

SEQ ID NO: 745873 - RNA, 64 nt, hsa
uuauacgagaaagugguauauaagucuuuguauacauuacgaccauugugauuauccauuaaau

SEQ ID NO: 745874 - RNA, 64 nt, hsa
cuucugcagugaguauggcccgaugcuuucuguggcuaaacagauguaaugggaagaaauaaaa

SEQ ID NO: 745875 - RNA, 64 nt, hsa
acaaacaaaaaacccauguguuaaaauacucagugcuaaacauggcuuaaucuuauuuuaucuu

SEQ ID NO: 745876 - RNA, 64 nt, hsa
gcaagaaacugcaggcuggaucaguaguucaacagcuaaacagucauaaaauagucauugugca

SEQ ID NO: 745877 - RNA, 64 nt, hsa
caucauacccauuuucauuacuuugauauaaggugcuaaacaaaaaaagcucuagguucuucag

SEQ ID NO: 745878 - RNA, 64 nt, hsa; identical to SEQ ID NO: 642878

SEQ ID NO: 745879 - RNA, 64 nt, hsa; identical to SEQ ID NO: 642879

SEQ ID NO: 745880 - RNA, 64 nt, hsa; identical to SEQ ID NO: 642880

SEQ ID NO: 745881 - RNA, 64 nt, hsa; identical to SEQ ID NO: 642881

SEQ ID NO: 745882 - RNA, 64 nt, hsa; identical to SEQ ID NO: 642882

SEQ ID NO: 745883 - RNA, 64 nt, hsa; identical to SEQ ID NO: 642883

SEQ ID NO: 745884 - RNA, 64 nt, hsa; identical to SEQ ID NO: 642884

SEQ ID NO: 745885 - RNA, 64 nt, hsa; identical to SEQ ID NO: 642885

SEQ ID NO: 745886 - RNA, 64 nt, hsa; identical to SEQ ID NO: 642886

SEQ ID NO: 745887 - RNA, 64 nt, hsa; identical to SEQ ID NO: 324618

SEQ ID NO: 745888 - RNA, 64 nt, hsa; identical to SEQ ID NO: 324619

SEQ ID NO: 745889 - RNA, 64 nt, hsa; identical to SEQ ID NO: 324620

SEQ ID NO: 745890 - RNA, 64 nt, hsa; identical to SEQ ID NO: 324621

SEQ ID NO: 745891 - RNA, 64 nt, hsa; identical to SEQ ID NO: 324622

SEQ ID NO: 745892 - RNA, 64 nt, hsa; identical to SEQ ID NO: 324623

SEQ ID NO: 745893 - RNA, 64 nt, hsa; identical to SEQ ID NO: 324624

SEQ ID NO: 745894 - RNA, 64 nt, hsa; identical to SEQ ID NO: 324625

SEQ ID NO: 745895 - RNA, 64 nt, hsa; identical to SEQ ID NO: 490803

SEQ ID NO: 745896 - RNA, 64 nt, hsa; identical to SEQ ID NO: 490804

SEQ ID NO: 745897 - RNA, 64 nt, hsa; identical to SEQ ID NO: 490805

SEQ ID NO: 745898 - RNA, 64 nt, hsa; identical to SEQ ID NO: 490806

SEQ ID NO: 745899 - RNA, 64 nt, hsa; identical to SEQ ID NO: 490807

SEQ ID NO: 745900 - RNA, 64 nt, hsa; identical to SEQ ID NO: 490808

SEQ ID NO: 745901 - RNA, 64 nt, hsa; identical to SEQ ID NO: 490809

SEQ ID NO: 745902 - RNA, 64 nt, hsa; identical to SEQ ID NO: 490810

SEQ ID NO: 745903 - RNA, 64 nt, hsa; identical to SEQ ID NO: 490811

SEQ ID NO: 745904 - RNA, 64 nt, hsa; identical to SEQ ID NO: 490812

SEQ ID NO: 745905 - RNA, 64 nt, hsa
uuuacagaaagucuauuucuuugaaacgaaggaaguaucgaauuuacauuaguuuuuuucauac

SEQ ID NO: 745906 - RNA, 64 nt, hsa
aacauaacucauucuagagaaaaacuuuaugaagguaucgaaugugagaaugccuucauuuauc

SEQ ID NO: 745907 - RNA, 64 nt, hsa
uuccuacuuuaccaaccucagaguauuucggcccguaucgaacuuuuguucucaguaucagccc

SEQ ID NO: 745908 - RNA, 64 nt, hsa
cuuggcuuaaucccuaaagaacccaguucugcugguaucgaauaguucagcuugguugucauug

SEQ ID NO: 745909 - RNA, 64 nt, hsa
agacugugaugagcucgucuguggaacaucacaaguaucgaaaauacaguaauggauguuuccu

SEQ ID NO: 745910 - RNA, 64 nt, hsa
uuaaucaugcuggaauuuaaaaauuguuuuacuuguaucgaaauuaaccuugauuuauaacuau

SEQ ID NO: 745911 - RNA, 64 nt, hsa
ugcagaacauacaaucaaguuugcuggaaacauuguaucgaaaccgauccaaccuagagaccau

SEQ ID NO: 745912 - RNA, 64 nt, hsa
ucugaaauuacaaacuuuaggaacuuuuccagauguaucgaauuuaauuugacauugaugucac

SEQ ID NO: 745913 - RNA, 64 nt, hsa
agcagaagggcaggcccugcaacucaggcugggaguaucgaacccucugccuagggccggaguu

SEQ ID NO: 745914 - RNA, 64 nt, hsa
uucuuccuguguagccauauacccaggcucugcaguaucgaaggaugcaaauguugacauagau

SEQ ID NO: 745915 - RNA, 64 nt, hsa
auaagugcucaauagcuugaagcccaagaaguugguaucgaaauuuguuguuuguuuaaaccca

SEQ ID NO: 745916 - RNA, 64 nt, hsa
uaaugucugcaugauauuugugcacauuuauuaaguaucgaagcuuaauaaauuauuguguccu

SEQ ID NO: 745917 - RNA, 64 nt, hsa
ugcggcguagugcccuucugcccugccugacgauguaucgaaaagaugagagugaaggagacuu

SEQ ID NO: 745918 - RNA, 64 nt, hsa
uuguacuccagcaugggugacagagacagauaguguaucgaaaaaugaaucugguaaaguuugg

SEQ ID NO: 745919 - RNA, 64 nt, hsa
agucaguuuaaaaauuguucauguuguuuggaugguaucgaaaaccagaaaccacuuuuaauaa

SEQ ID NO: 745920 - RNA, 64 nt, hsa
ccacuucucugaaggagggcuggguucugggccuguaucgaauaaacacaaaccuggauggcgc

SEQ ID NO: 745921 - RNA, 64 nt, hsa; identical to SEQ ID NO: 308450

SEQ ID NO: 745922 - RNA, 64 nt, hsa; identical to SEQ ID NO: 308451

SEQ ID NO: 745923 - RNA, 64 nt, hsa; identical to SEQ ID NO: 308452

SEQ ID NO: 745924 - RNA, 64 nt, hsa; identical to SEQ ID NO: 308453

SEQ ID NO: 745925 - RNA, 64 nt, hsa; identical to SEQ ID NO: 308454

SEQ ID NO: 745926 - RNA, 64 nt, hsa; identical to SEQ ID NO: 308455

SEQ ID NO: 745927 - RNA, 64 nt, hsa; identical to SEQ ID NO: 308456

SEQ ID NO: 745928 - RNA, 64 nt, hsa; identical to SEQ ID NO: 308457

SEQ ID NO: 745929 - RNA, 64 nt, hsa; identical to SEQ ID NO: 308458

SEQ ID NO: 745930 - RNA, 64 nt, hsa; identical to SEQ ID NO: 308459

SEQ ID NO: 745931 - RNA, 64 nt, hsa; identical to SEQ ID NO: 308460

SEQ ID NO: 745932 - RNA, 64 nt, hsa; identical to SEQ ID NO: 308461

SEQ ID NO: 745933 - RNA, 64 nt, hsa; identical to SEQ ID NO: 308462

SEQ ID NO: 745934 - RNA, 64 nt, hsa; identical to SEQ ID NO: 308463

SEQ ID NO: 745935 - RNA, 64 nt, hsa; identical to SEQ ID NO: 308464

SEQ ID NO: 745936 - RNA, 64 nt, hsa; identical to SEQ ID NO: 308465

SEQ ID NO: 745937 - RNA, 64 nt, hsa; identical to SEQ ID NO: 308466

SEQ ID NO: 745938 - RNA, 64 nt, hsa; identical to SEQ ID NO: 537396

SEQ ID NO: 745939 - RNA, 64 nt, hsa; identical to SEQ ID NO: 537397

SEQ ID NO: 745940 - RNA, 64 nt, hsa; identical to SEQ ID NO: 537398

SEQ ID NO: 745941 - RNA, 64 nt, hsa; identical to SEQ ID NO: 537399

SEQ ID NO: 745942 - RNA, 64 nt, hsa; identical to SEQ ID NO: 537400

SEQ ID NO: 745943 - RNA, 64 nt, hsa; identical to SEQ ID NO: 537401

SEQ ID NO: 745944 - RNA, 64 nt, hsa; identical to SEQ ID NO: 537402

SEQ ID NO: 745945 - RNA, 64 nt, hsa; identical to SEQ ID NO: 537403

SEQ ID NO: 745946 - RNA, 64 nt, hsa; identical to SEQ ID NO: 537404

SEQ ID NO: 745947 - RNA, 64 nt, hsa; identical to SEQ ID NO: 537405

SEQ ID NO: 745948 - RNA, 64 nt, hsa; identical to SEQ ID NO: 537406

SEQ ID NO: 745949 - RNA, 64 nt, hsa; identical to SEQ ID NO: 537407

SEQ ID NO: 745950 - RNA, 64 nt, hsa; identical to SEQ ID NO: 537408

SEQ ID NO: 745951 - RNA, 64 nt, hsa; identical to SEQ ID NO: 537409

SEQ ID NO: 745952 - RNA, 64 nt, hsa; identical to SEQ ID NO: 537410

SEQ ID NO: 745953 - RNA, 64 nt, hsa; identical to SEQ ID NO: 537411

SEQ ID NO: 745954 - RNA, 64 nt, hsa; identical to SEQ ID NO: 537412

SEQ ID NO: 745955 - RNA, 64 nt, hsa; identical to SEQ ID NO: 537413

SEQ ID NO: 745956 - RNA, 64 nt, hsa; identical to SEQ ID NO: 537414

SEQ ID NO: 745957 - RNA, 64 nt, hsa; identical to SEQ ID NO: 537415

SEQ ID NO: 745958 - RNA, 64 nt, hsa; identical to SEQ ID NO: 537416

SEQ ID NO: 745959 - RNA, 64 nt, hsa; identical to SEQ ID NO: 537417

SEQ ID NO: 745960 - RNA, 64 nt, hsa; identical to SEQ ID NO: 537418

SEQ ID NO: 745961 - RNA, 64 nt, hsa; identical to SEQ ID NO: 537419

SEQ ID NO: 745962 - RNA, 64 nt, hsa; identical to SEQ ID NO: 537420

SEQ ID NO: 745963 - RNA, 64 nt, hsa; identical to SEQ ID NO: 537421

SEQ ID NO: 745964 - RNA, 64 nt, hsa; identical to SEQ ID NO: 537422

SEQ ID NO: 745965 - RNA, 64 nt, hsa; identical to SEQ ID NO: 537423

SEQ ID NO: 745966 - RNA, 64 nt, hsa; identical to SEQ ID NO: 105404

SEQ ID NO: 745967 - RNA, 64 nt, hsa; identical to SEQ ID NO: 105405

SEQ ID NO: 745968 - RNA, 64 nt, hsa; identical to SEQ ID NO: 105406

SEQ ID NO: 745969 - RNA, 64 nt, hsa; identical to SEQ ID NO: 105407

SEQ ID NO: 745970 - RNA, 64 nt, hsa
aagaaaucuaaagugaaaauuuugcuuagaaauaaaauacgacaaguuauguuuugaguuugau

SEQ ID NO: 745971 - RNA, 64 nt, hsa
guaauccauugcaugcauuagcagcucaaagaugaaauacgaucauaucaauagguacagaaaa

SEQ ID NO: 745972 - RNA, 64 nt, hsa
aggaagaauaagagugcaccagaauaagagcgcaccagaauaagagcgcaccagcuaacaaugu

SEQ ID NO: 745973 - RNA, 64 nt, hsa
aaaaucuucucuugaaaggaagaauaagagugcaccagaauaagagcgcaccagaauaagagcg

SEQ ID NO: 745974 - RNA, 64 nt, hsa
auagcagggagugaucggggugaaauaacuugggccagaauauuauuaaacaaucaucaggcuu

SEQ ID NO: 745975 - RNA, 64 nt, hsa
auauuugugaguuguguuaucuguaauauacaucccagaauaaaggagugaauuaaauaguuua

SEQ ID NO: 745976 - RNA, 64 nt, hsa
ggaaacugaaugccauaaucucgaucaaaccgauccagaauaccgaagguauggacaggacaga

SEQ ID NO: 745977 - RNA, 64 nt, hsa
caacucaaagaggcagaagaggagaaugacuuuuccagaauagaaguggagcagugaucauuau

SEQ ID NO: 745978 - RNA, 64 nt, hsa
aacaguuaugaaaguaagugauuuuuacaugauuccagaauaacacuuguauugaccaauuuag

SEQ ID NO: 745979 - RNA, 64 nt, hsa
guacauuacacucuuguugcggggaggggauuuaccagaauacaguuuauuucgugaauucuaa

SEQ ID NO: 745980 - RNA, 64 nt, hsa
auuauuauauugcauuauuuauuuuuucuaaguuccagaauaauagugucauuauuauagacua

SEQ ID NO: 745981 - RNA, 64 nt, hsa
uauauugguaaugguuguaugugugaugcuaugcccagaauaugaaguaucuguuuuugaaauu

SEQ ID NO: 745982 - RNA, 64 nt, hsa
uuuugucuagagaccagcauguucuccccaaagaccagaauauucuaccuaaauaucaaggcca

SEQ ID NO: 745983 - RNA, 64 nt, hsa
uucuacccagagaccugcauguucucuccaacgaccagaauauucuacccaaaugucaggacca

SEQ ID NO: 745984 - RNA, 64 nt, hsa
gcccuggguaggcuugcuugaaaagugaguccuuccagaauauucucagagcugccagaaacau

SEQ ID NO: 745985 - RNA, 64 nt, hsa
agccccuggcccuggccccugcacaccaguaggcccagaauaaccgccacccuugccauccugc

SEQ ID NO: 745986 - RNA, 64 nt, hsa
guuuugcccaugugcuuggguagccuugaagucaccagaauaacuaggacucaaauucagacca

SEQ ID NO: 745987 - RNA, 64 nt, hsa
aaaccuuagggcaggaaagaacuucuaaaacauuccagaauacccgguaguuccacucuugagu

SEQ ID NO: 745988 - RNA, 64 nt, hsa
ccagauguuccugagucuggagcaagcacccaggccagaauaacagagcuuucuuaguugguga

SEQ ID NO: 745989 - RNA, 64 nt, hsa
auagccaaguagauuuggguagaggauacuauuuccagaauaguguuuagcucaccuaggggga

SEQ ID NO: 745990 - RNA, 61 nt, hsa; identical to SEQ ID NO: 490619

SEQ ID NO: 745991 - RNA, 64 nt, hsa; identical to SEQ ID NO: 490620

SEQ ID NO: 745992 - RNA, 64 nt, hsa; identical to SEQ ID NO: 490621

SEQ ID NO: 745993 - RNA, 64 nt, hsa; identical to SEQ ID NO: 490622

SEQ ID NO: 745994 - RNA, 64 nt, hsa; identical to SEQ ID NO: 490623

SEQ ID NO: 745995 - RNA, 64 nt, hsa; identical to SEQ ID NO: 490624

SEQ ID NO: 745996 - RNA, 64 nt, hsa; identical to SEQ ID NO: 490625

SEQ ID NO: 745997 - RNA, 64 nt, hsa; identical to SEQ ID NO: 490626

SEQ ID NO: 745998 - RNA, 64 nt, hsa; identical to SEQ ID NO: 490627

SEQ ID NO: 745999 - RNA, 64 nt, hsa; identical to SEQ ID NO: 490628

SEQ ID NO: 746000 - RNA, 64 nt, hsa; identical to SEQ ID NO: 490629

SEQ ID NO: 746001 - RNA, 64 nt, hsa; identical to SEQ ID NO: 490630

SEQ ID NO: 746002 - RNA, 64 nt, hsa; identical to SEQ ID NO: 490631

SEQ ID NO: 746003 - RNA, 64 nt, hsa; identical to SEQ ID NO: 490632

SEQ ID NO: 746004 - RNA, 64 nt, hsa; identical to SEQ ID NO: 490633

SEQ ID NO: 746005 - RNA, 64 nt, hsa; identical to SEQ ID NO: 490634

SEQ ID NO: 746006 - RNA, 64 nt, hsa; identical to SEQ ID NO: 490635

SEQ ID NO: 746007 - RNA, 64 nt, hsa; identical to SEQ ID NO: 490636

SEQ ID NO: 746008 - RNA, 64 nt, hsa; identical to SEQ ID NO: 520271

SEQ ID NO: 746009 - RNA, 64 nt, hsa; identical to SEQ ID NO: 520272

SEQ ID NO: 746010 - RNA, 64 nt, hsa; identical to SEQ ID NO: 520273

SEQ ID NO: 746011 - RNA, 64 nt, hsa; identical to SEQ ID NO: 520274

SEQ ID NO: 746012 - RNA, 64 nt, hsa; identical to SEQ ID NO: 520275

SEQ ID NO: 746013 - RNA, 64 nt, hsa; identical to SEQ ID NO: 520276

SEQ ID NO: 746014 - RNA, 64 nt, hsa; identical to SEQ ID NO: 520277

SEQ ID NO: 746015 - RNA, 64 nt, hsa; identical to SEQ ID NO: 520278

SEQ ID NO: 746016 - RNA, 64 nt, hsa; identical to SEQ ID NO: 520279

SEQ ID NO: 746017 - RNA, 64 nt, hsa; identical to SEQ ID NO: 520280

SEQ ID NO: 746018 - RNA, 64 nt, hsa; identical to SEQ ID NO: 520281

SEQ ID NO: 746019 - RNA, 64 nt, hsa; identical to SEQ ID NO: 520282

SEQ ID NO: 746020 - RNA, 64 nt, hsa; identical to SEQ ID NO: 520283

SEQ ID NO: 746021 - RNA, 64 nt, hsa; identical to SEQ ID NO: 520284

SEQ ID NO: 746022 - RNA, 64 nt, hsa; identical to SEQ ID NO: 520285

SEQ ID NO: 746023 - RNA, 64 nt, hsa; identical to SEQ ID NO: 520286

SEQ ID NO: 746024 - RNA, 64 nt, hsa
uauuuucauauuuuuuuguuuauuugcacaacuuuuaaaccagauuacugguuaaaauccaaca

SEQ ID NO: 746025 - RNA, 64 nt, hsa
ccaaauaaggcauuuuaauagacuguacugcuucuuaaaccagcauugcugaccagcauuauau

SEQ ID NO: 746026 - RNA, 64 nt, hsa
uugaaaagcaucccaguuaaacuagaugugauaguuaaaccagaugaaagcaugaugauccauc

SEQ ID NO: 746027 - RNA, 64 nt, hsa
cagggaaaaagggcaauguugauuaaucucaguauuaaaccacauuaaucuguaucccauuguc

SEQ ID NO: 746028 - RNA, 64 nt, hsa
guaugaauggucuagaaacauuucuauuuuuuuuuuaaaccagcaggauacaaguugcaaauga

SEQ ID NO: 746029 - RNA, 64 nt, hsa
uggcccuccguaaguuauugccauaguguaugcauuaaaccaaguccauuuugaaugaccuaaa

SEQ ID NO: 746030 - RNA, 64 nt, hsa
acacugaagcaaucaccauucugauagaaagugcuuaaaccaccacucuuaggucugcucacuc

SEQ ID NO: 746031 - RNA, 64 nt, hsa
gguaguauaauaaagguaaaugaagguacaauuuuuaaaccauuauuuucacccuguuggggua

SEQ ID NO: 746032 - RNA, 64 nt, hsa
cauauacaauguguuucaaaugcugcuuguaaaauuaaaccaucaucuagaauagaguuaauuu

SEQ ID NO: 746033 - RNA, 64 nt, hsa
uaauuuauuauaaucaagcuacaaauagguuuucuuaaaccagagaugcacugcccuugucuaa

SEQ ID NO: 746034 - RNA, 64 nt, hsa
uugcuguuguggauaggaaagacuuaaccuaaaauuaaaccagcaagaaagcauuaguaaaaau

SEQ ID NO: 746035 - RNA, 64 nt, hsa
uucuuuugcuaggugggagauuguuauaaggucuuuaaaccauuuccauuuguuucuuuaacau

SEQ ID NO: 746036 - RNA, 64 nt, hsa
cucaaggggcuccccucccgugcauggacauuuuuuaaaccaccgauuccaagaggaugaggag

SEQ ID NO: 746037 - RNA, 64 nt, hsa
gcaauugcucgcccuggagggaaccagaucauuuuuaaaccagaaauaauuuuuuuuauuauug

SEQ ID NO: 746038 - RNA, 64 nt, hsa
gaggcccuuuuauuuuuuauucugauuagccauuuuaaaccaacgaggaauaaaaagaaauccu

SEQ ID NO: 746039 - RNA, 64 nt, hsa
aaaaggcaucacuuuccuggauccaggauaauuuuuaaaccaaucaaaugaaaaaaacaaacaa

SEQ ID NO: 746040 - RNA, 64 nt, hsa
aacaaacaaacaaaaaaggaaaugucaugugagguuaaaccaguuugcauuccccuaaugugga

SEQ ID NO: 746041 - RNA, 64 nt, hsa
ucugcaaaguauuuuucagugcagguaaaauguguuaaaccauaagaguugacugaguuaaucc

SEQ ID NO: 746042 - RNA, 64 nt, hsa
uuaaucccaauugguugugcucauaugccaccuuuuaaaccaauggaaauugcuauauuugggg

SEQ ID NO: 746043 - RNA, 64 nt, hsa
aucugaguugaaugaagcugugcaaacccacccuuuaaaccauuccacccggcaguauucagcu

SEQ ID NO: 746044 - RNA, 64 nt, hsa
cauccuaugugcaugccguaagaucaguuggauauuaaaccaucaauaaaguuucacaagauuu

SEQ ID NO: 746045 - RNA, 64 nt, hsa
uucuuucaaaguuuaauacauccaauaugucaaguuaaaccauucugggauuugcaaaguuuaa

SEQ ID NO: 746046 - RNA, 64 nt, hsa
gauuugcaaaguuuaauacauccaauaugucaaguuaaaccauucugggauuugcaaaguuuaa

SEQ ID NO: 746047 - RNA, 64 nt, hsa
gauuugcaaaguuuaauacauccaauaugucaaguuaaaccauucugggauuugggaacuucuu

SEQ ID NO: 746048 - RNA, 64 nt, hsa
cuguuccucuguuuuucuuuuugauuuuuguuuuuuaaaccaaaacagacaauagcuuauuuuc

SEQ ID NO: 746049 - RNA, 64 nt, hsa
auaagcucauacccaaauucacaaagccuauuuuuuaaaccaaagcacauuuugaaugaguaug

SEQ ID NO: 746050 - RNA, 64 nt, hsa
ucaguccuuccuuccuaaucucuaauccccugaagccuaacacaguuccuaauguguuuugccu

SEQ ID NO: 746051 - RNA, 64 nt, hsa
agggcugugguuuacuccugucuaaaccccugaagccuaacacaguuccuggcacacaacaggu

SEQ ID NO: 746052 - RNA, 64 nt, hsa
agucuggguaacagagcgagacuuucuagaaaaagccuaacaaacagauaagguaggacucaac

SEQ ID NO: 746053 - RNA, 64 nt, hsa
ucaccaggagcuggacugccaucuccuuauaaaugccuaacacaggccgggucugguggcucau

SEQ ID NO: 746054 - RNA, 64 nt, hsa; identical to SEQ ID NO: 411830

SEQ ID NO: 746055 - RNA, 64 nt, hsa; identical to SEQ ID NO: 411831

SEQ ID NO: 746056 - RNA, 64 nt, hsa; identical to SEQ ID NO: 411832

SEQ ID NO: 746057 - RNA, 64 nt, hsa; identical to SEQ ID NO: 411833

SEQ ID NO: 746058 - RNA, 64 nt, hsa; identical to SEQ ID NO: 411834

SEQ ID NO: 746059 - RNA, 64 nt, hsa; identical to SEQ ID NO: 411835

SEQ ID NO: 746060 - RNA, 64 nt, hsa; identical to SEQ ID NO: 411836

SEQ ID NO: 746061 - RNA, 64 nt, hsa; identical to SEQ ID NO: 411837

SEQ ID NO: 746062 - RNA, 64 nt, hsa; identical to SEQ ID NO: 411838

SEQ ID NO: 746063 - RNA, 64 nt, hsa; identical to SEQ ID NO: 411839

SEQ ID NO: 746064 - RNA, 64 nt, hsa; identical to SEQ ID NO: 411840

SEQ ID NO: 746065 - RNA, 64 nt, hsa; identical to SEQ ID NO: 411841

SEQ ID NO: 746066 - RNA, 64 nt, hsa; identical to SEQ ID NO: 411842

SEQ ID NO: 746067 - RNA, 64 nt, hsa; identical to SEQ ID NO: 411843

SEQ ID NO: 746068 - RNA, 64 nt, hsa; identical to SEQ ID NO: 411844

SEQ ID NO: 746069 - RNA, 64 nt, hsa; identical to SEQ ID NO: 411845

SEQ ID NO: 746070 - RNA, 64 nt, hsa; identical to SEQ ID NO: 411846

SEQ ID NO: 746071 - RNA, 64 nt, hsa; identical to SEQ ID NO: 411847

SEQ ID NO: 746072 - RNA, 64 nt, hsa; identical to SEQ ID NO: 411848

SEQ ID NO: 746073 - RNA, 64 nt, hsa; identical to SEQ ID NO: 411849

SEQ ID NO: 746074 - RNA, 64 nt, hsa; identical to SEQ ID NO: 411850

SEQ ID NO: 746075 - RNA, 64 nt, hsa; identical to SEQ ID NO: 411851

SEQ ID NO: 746076 - RNA, 64 nt, hsa; identical to SEQ ID NO: 411852

SEQ ID NO: 746077 - RNA, 64 nt, hsa; identical to SEQ ID NO: 411853

SEQ ID NO: 746078 - RNA, 64 nt, hsa; identical to SEQ ID NO: 411854

SEQ ID NO: 746079 - RNA, 64 nt, hsa; identical to SEQ ID NO: 411855

SEQ ID NO: 746080 - RNA, 64 nt, hsa; identical to SEQ ID NO: 411856

SEQ ID NO: 746081 - RNA, 64 nt, hsa; identical to SEQ ID NO: 364288

SEQ ID NO: 746082 - RNA, 64 nt, hsa; identical to SEQ ID NO: 364289

SEQ ID NO: 746083 - RNA, 64 nt, hsa; identical to SEQ ID NO: 364290

SEQ ID NO: 746084 - RNA, 64 nt, hsa; identical to SEQ ID NO: 364291

SEQ ID NO: 746085 - RNA, 64 nt, hsa; identical to SEQ ID NO: 364292

SEQ ID NO: 746086 - RNA, 64 nt, hsa; identical to SEQ ID NO: 364293

SEQ ID NO: 746087 - RNA, 64 nt, hsa
gucuccagcuaaccucucaaucaggcaaacauucuucuuggaggaaucaggcaaacaucucaaa

SEQ ID NO: 746088 - RNA, 64 nt, hsa
uccuucucucccuuucucauucucauuccaccuguucuuggaacucacggagaccuacaguccc

SEQ ID NO: 746089 - RNA, 64 nt, hsa
cagagcauucuuuuccucaaaacgagcugcauaauucuuggaauuuaugucuuaccacauggug

SEQ ID NO: 746090 - RNA, 64 nt, hsa
gcuugcucaggagagggaauaacgcaggucccuuuucuuggaaggcuuguacuauggccaugac

SEQ ID NO: 746091 - RNA, 64 nt, hsa
ucccagcuagagggagauaaagagggcuaguuaguucuuggagcagcugcuuuugaggagaaaa

SEQ ID NO: 746092 - RNA, 64 nt, hsa
aauuaucauugaacauauuaaugguuauuucuuuuucuuggauuuccagaaaagccucuuaauu

SEQ ID NO: 746093 - RNA, 64 nt, hsa
guggaguguucgggaugcagggggcacuauaguguucuuggacuugucguccuggggcaguuuu

SEQ ID NO: 746094 - RNA, 64 nt, hsa
uuccuugcugugugaccuugggugagucauugucuucuuggagccucaguuucccugucuguaa

SEQ ID NO: 746095 - RNA, 64 nt, hsa
guauccugcucagaaccauucacauuuaauucaauucuuggaaaaaauuaaagcuuuuugccca

SEQ ID NO: 746096 - RNA, 64 nt, hsa
ucaugauguugcauuaauaguuguuuuugucccuuucuuggaaauguuaaugccaaaguugccu

SEQ ID NO: 746097 - RNA, 64 nt, hsa
uguaaugaugagcuugguggagaagaaugagucguucuuggaauaccuaugugcagccacuacc

SEQ ID NO: 746098 - RNA, 64 nt, hsa
agccacuacccaucucaaugucaccuuguuugcauucuuggauagcuuguauauguaguaguuu

SEQ ID NO: 746099 - RNA, 64 nt, hsa
gggaaaggccaguggcuggagaccccaugugcaguucuuggauacucugggagguguuccccuc

SEQ ID NO: 746100 - RNA, 64 nt, hsa
ucacgaugguguaugagugucaaucaucugacccuucuuggagucucauauuucguggaacucc

SEQ ID NO: 746101 - RNA, 64 nt, hsa
aaagugauuaagcaauauuucucaaaccugaugauucuuggauauuuagcuauuguccuccaaa

SEQ ID NO: 746102 - RNA, 64 nt, hsa
auguagcauaaaaugcguucagaaauuugauuuauucuuggacuguacucuucgcauggacugg

SEQ ID NO: 746103 - RNA, 64 nt, hsa
gucuggccagauucucacuugcccaucaaucucguucuuggaugauuucccucauugugaugcu

SEQ ID NO: 746104 - RNA, 64 nt, hsa
gacuguggcauucacuguccuugaguguuucaccuucuuggauaacacacgggccuucucuucu

SEQ ID NO: 746105 - RNA, 64 nt, hsa
auuaucuucucuacuuggauuaugagauaaccuuuucuuggaggaaagaaacaccgcuuuacaa

SEQ ID NO: 746106 - RNA, 64 nt, hsa
auauucagucucagucugcuauagguauuuguuauucuuggauacuacacaccugcucagacug

SEQ ID NO: 746107 - RNA, 64 nt, hsa
agccauagaagaaacuugacuaugccuggucaccuucuuggaucugcugucuaaaugauauaua

SEQ ID NO: 746108 - RNA, 64 nt, hsa
ccaguuuacuaccagaaagggcuucaguaagauauucuuggacuugauacuuucuucagauccu

SEQ ID NO: 746109 - RNA, 64 nt, hsa
uguuucucauaagcgaugucuggagugauugugguucuuggaaaagcagaaggaaaaacuaaaa

SEQ ID NO: 746110 - RNA, 64 nt, hsa
cuuacugcuaguguugcuacaucagcacugggcauucuuggagggauccugugaaguauuguua

SEQ ID NO: 746111 - RNA, 64 nt, hsa
gugcugugggccucaggcguuucugaagugcucuuucuuggauuggacaggagaucagcagcgu

SEQ ID NO: 746112 - RNA, 64 nt, hsa
gucuucccuagaccuuggcauccugugcuucuauuucuuggaauacguucuccucugaccugcc

SEQ ID NO: 746113 - RNA, 64 nt, hsa
guuuauuccagcgaugugacuuuuuucagaauauuucuuggaaucauauucagagucuggggcu

SEQ ID NO: 746114 - RNA, 64 nt, hsa
cgugcucuguucucgggguuguuccauucaugccuucuuggagggugaggguggcuugggaacc

SEQ ID NO: 746115 - RNA, 64 nt, hsa
acuaaauacaggcuuagaacuugcagaguguguauucuuggauggcugaugcaucgacuugcau

SEQ ID NO: 746116 - RNA, 64 nt, hsa
aaaucacuaguccuuauuuuuaaaggucuaugguuucuuggaaguaguuugauuguugagagag

SEQ ID NO: 746117 - RNA, 64 nt, hsa
uugaugcuguuaagguacccgggguagccauugguucuuggaucuguguuagaaugagugcuuu

SEQ ID NO: 746118 - RNA, 64 nt, hsa
agccaggccugagccccacacaggccagggcacauucuuggauuuuccauuccuuggucaugcu

SEQ ID NO: 746119 - RNA, 64 nt, hsa
gguuuaccgauggaugggcuagagaucuugucguuucuuggaagucacagggaagauugaagag

SEQ ID NO: 746120 - RNA, 64 nt, hsa
augccagaaugagcaaccucaaggaauugaacacuucuuggaaaaucuagguaauucaagcccu

SEQ ID NO: 746121 - RNA, 64 nt, hsa
uuguuuuuugauacccuugucucccugagacucuuucuuggacacguguugauguggauggcac

SEQ ID NO: 746122 - RNA, 64 nt, hsa
auuguucuauagggcuggaauauucagaguuacauucuuggaaguuucuguuuuuacuugcauc

SEQ ID NO: 746123 - RNA, 64 nt, hsa
ccucaggagagagaaaacuuagugcuuccagcccuucuuggagccuucaugguccagggguagg

SEQ ID NO: 746124 - RNA, 64 nt, hsa
caugaguugggugcagacaccuagaaggagagacuucuuggaacgcucaucccccgcuauaccu

SEQ ID NO: 746125 - RNA, 64 nt, hsa
cacugcuuuucaugcaggaguuacagacacugguuucuuggaaaauggagagaagcgcacuuug

SEQ ID NO: 746126 - RNA, 64 nt, hsa
guugcacauuuugcacugguuuauggcgauuguuuucuuggacggauaguguaaaauaaacuuc

SEQ ID NO: 746127 - RNA, 64 nt, hsa
ucugcguagaugggugacucagccuuaguuucuauucuuggaugucccaguugaaucagaaggg

SEQ ID NO: 746128 - RNA, 64 nt, hsa
gggagucuccucggcucccuccugggcccucugcuucuuggaggccgaccgcuggagacugcgg

SEQ ID NO: 746129 - RNA, 64 nt, hsa; identical to SEQ ID NO: 592636

SEQ ID NO: 746130 - RNA, 64 nt, hsa; identical to SEQ ID NO: 592637

SEQ ID NO: 746131 - RNA, 64 nt, hsa; identical to SEQ ID NO: 592638

SEQ ID NO: 746132 - RNA, 64 nt, hsa; identical to SEQ ID NO: 592639

SEQ ID NO: 746133 - RNA, 64 nt, hsa; identical to SEQ ID NO: 592640

SEQ ID NO: 746134 - RNA, 64 nt, hsa; identical to SEQ ID NO: 592641

SEQ ID NO: 746135 - RNA, 64 nt, hsa; identical to SEQ ID NO: 592642

SEQ ID NO: 746136 - RNA, 64 nt, hsa; identical to SEQ ID NO: 592643

SEQ ID NO: 746137 - RNA, 64 nt, hsa; identical to SEQ ID NO: 592644

SEQ ID NO: 746138 - RNA, 64 nt, hsa; identical to SEQ ID NO: 592645

SEQ ID NO: 746139 - RNA, 64 nt, hsa; identical to SEQ ID NO: 592646

SEQ ID NO: 746140 - RNA, 64 nt, hsa; identical to SEQ ID NO: 592647

SEQ ID NO: 746141 - RNA, 64 nt, hsa; identical to SEQ ID NO: 592648

SEQ ID NO: 746142 - RNA, 64 nt, hsa; identical to SEQ ID NO: 592649

SEQ ID NO: 746143 - RNA, 64 nt, hsa; identical to SEQ ID NO: 592650

SEQ ID NO: 746144 - RNA, 64 nt, hsa; identical to SEQ ID NO: 592651

SEQ ID NO: 746145 - RNA, 64 nt, hsa; identical to SEQ ID NO: 592652

SEQ ID NO: 746146 - RNA, 64 nt, hsa; identical to SEQ ID NO: 592653

SEQ ID NO: 746147 - RNA, 64 nt, hsa; identical to SEQ ID NO: 592654

SEQ ID NO: 746148 - RNA, 64 nt, hsa; identical to SEQ ID NO: 592655

SEQ ID NO: 746149 - RNA, 64 nt, hsa; identical to SEQ ID NO: 592656

SEQ ID NO: 746150 - RNA, 64 nt, hsa; identical to SEQ ID NO: 592657

SEQ ID NO: 746151 - RNA, 64 nt, hsa; identical to SEQ ID NO: 592658

SEQ ID NO: 746152 - RNA, 64 nt, hsa; identical to SEQ ID NO: 592659

SEQ ID NO: 746153 - RNA, 64 nt, hsa; identical to SEQ ID NO: 592660

SEQ ID NO: 746154 - RNA, 64 nt, hsa; identical to SEQ ID NO: 592661

SEQ ID NO: 746155 - RNA, 64 nt, hsa; identical to SEQ ID NO: 592662

SEQ ID NO: 746156 - RNA, 64 nt, hsa; identical to SEQ ID NO: 592663

SEQ ID NO: 746157 - RNA, 64 nt, hsa; identical to SEQ ID NO: 592664

SEQ ID NO: 746158 - RNA, 64 nt, hsa; identical to SEQ ID NO: 592665

SEQ ID NO: 746159 - RNA, 64 nt, hsa; identical to SEQ ID NO: 592666

SEQ ID NO: 746160 - RNA, 64 nt, hsa; identical to SEQ ID NO: 592667

SEQ ID NO: 746161 - RNA, 64 nt, hsa; identical to SEQ ID NO: 592668

SEQ ID NO: 746162 - RNA, 64 nt, hsa; identical to SEQ ID NO: 592669

SEQ ID NO: 746163 - RNA, 64 nt, hsa; identical to SEQ ID NO: 592670

SEQ ID NO: 746164 - RNA, 64 nt, hsa; identical to SEQ ID NO: 592671

SEQ ID NO: 746165 - RNA, 64 nt, hsa; identical to SEQ ID NO: 592672

SEQ ID NO: 746166 - RNA, 64 nt, hsa; identical to SEQ ID NO: 592673

SEQ ID NO: 746167 - RNA, 64 nt, hsa; identical to SEQ ID NO: 592674

SEQ ID NO: 746168 - RNA, 64 nt, hsa; identical to SEQ ID NO: 592675

SEQ ID NO: 746169 - RNA, 64 nt, hsa; identical to SEQ ID NO: 592676

SEQ ID NO: 746170 - RNA, 64 nt, hsa; identical to SEQ ID NO: 592677

SEQ ID NO: 746171 - RNA, 64 nt, hsa; identical to SEQ ID NO: 592678

SEQ ID NO: 746172 - RNA, 64 nt, hsa; identical to SEQ ID NO: 592679

SEQ ID NO: 746173 - RNA, 64 nt, hsa; identical to SEQ ID NO: 592680

SEQ ID NO: 746174 - RNA, 64 nt, hsa; identical to SEQ ID NO: 592681

SEQ ID NO: 746175 - RNA, 64 nt, hsa; identical to SEQ ID NO: 592682

SEQ ID NO: 746176 - RNA, 64 nt, hsa; identical to SEQ ID NO: 592683

SEQ ID NO: 746177 - RNA, 64 nt, hsa; identical to SEQ ID NO: 275105

SEQ ID NO: 746178 - RNA, 64 nt, hsa; identical to SEQ ID NO: 275106

SEQ ID NO: 746179 - RNA, 64 nt, hsa; identical to SEQ ID NO: 275107

SEQ ID NO: 746180 - RNA, 64 nt, hsa; identical to SEQ ID NO: 275108

SEQ ID NO: 746181 - RNA, 64 nt, hsa; identical to SEQ ID NO: 275109

SEQ ID NO: 746182 - RNA, 64 nt, hsa; identical to SEQ ID NO: 275110

SEQ ID NO: 746183 - RNA, 64 nt, hsa; identical to SEQ ID NO: 275111

SEQ ID NO: 746184 - RNA, 64 nt, hsa; identical to SEQ ID NO: 275112

SEQ ID NO: 746185 - RNA, 64 nt, hsa; identical to SEQ ID NO: 275113

SEQ ID NO: 746186 - RNA, 64 nt, hsa; identical to SEQ ID NO: 275114

SEQ ID NO: 746187 - RNA, 64 nt, hsa; identical to SEQ ID NO: 275115

SEQ ID NO: 746188 - RNA, 64 nt, hsa; identical to SEQ ID NO: 275116

SEQ ID NO: 746189 - RNA, 64 nt, hsa; identical to SEQ ID NO: 275117

SEQ ID NO: 746190 - RNA, 64 nt, hsa; identical to SEQ ID NO: 275118

SEQ ID NO: 746191 - RNA, 64 nt, hsa; identical to SEQ ID NO: 275119

SEQ ID NO: 746192 - RNA, 64 nt, hsa; identical to SEQ ID NO: 275120

SEQ ID NO: 746193 - RNA, 64 nt, hsa; identical to SEQ ID NO: 275121

SEQ ID NO: 746194 - RNA, 64 nt, hsa; identical to SEQ ID NO: 275122

SEQ ID NO: 746195 - RNA, 64 nt, hsa
cuucucaggaggccaggcccuucugagcggaaccguccuggagagagccugcccucguuuccag

SEQ ID NO: 746196 - RNA, 64 nt, hsa
cucccugcaugacagucccccagaaacuuagugaguccuggacuggacugaacauccagaaagc

SEQ ID NO: 746197 - RNA, 64 nt, hsa
ggggcacuccuccuacucuguggaugaugugauuguccuggaaaucgaggugaaaggcucagua

SEQ ID NO: 746198 - RNA, 64 nt, hsa
cuuggaggcccugcacugccagcaucuggagaccguccuggagcuggagguggaaaauggugcc

SEQ ID NO: 746199 - RNA, 64 nt, hsa
gaggaagcccuaauccgcccacaggaagccugcaguccuggaagcgcgagggccucaaaggccc

SEQ ID NO: 746200 - RNA, 64 nt, hsa
ccccucugucuugugaaggcagggggaaggugggguccuggagcagaccaccccgccugcccuc

SEQ ID NO: 746201 - RNA, 64 nt, hsa
ccccaaggucaccgacgaugagggcgcaccugcuguccuggagcuuccgaucucuguucgggga

SEQ ID NO: 746202 - RNA, 64 nt, hsa
ggcuggugugggcagcuguucccugccucgcaguguccuggaggcagcugucucgcagacucag

SEQ ID NO: 746203 - RNA, 64 nt, hsa
uccugcaggaugcugcauaggaaugggcagagauguccuggaugggaacaugguccuggaggug

SEQ ID NO: 746204 - RNA, 64 nt, hsa
aggaaugggcagagauguccuggaugggaacaugguccuggaggugcccuaccugcauccugcu

SEQ ID NO: 746205 - RNA, 64 nt, hsa
augaggcuguuccuugaaaauguguuguugcuguguccuggaggagacaugaguuccgagauga

SEQ ID NO: 746206 - RNA, 64 nt, hsa
ucauccggggcuuugccagagcgugcuuucaaguguccuggaaauucugcugcuucuccaagcu

SEQ ID NO: 746207 - RNA, 64 nt, hsa
agcagccacgagugucccccaugccuuggugcggguccuggaggccucuugggggugggaccuu

SEQ ID NO: 746208 - RNA, 64 nt, hsa
cacuugcagagccuugagaucaccuguuuggcagguccuggacuggggccgggcaggcaggggc

SEQ ID NO: 746209 - RNA, 64 nt, hsa
uggccucccccaucccuaggcuaaagagccaugaguccuggaggaggagaggaccccucccaaa

SEQ ID NO: 746210 - RNA, 64 nt, hsa
gggucuugugaagucugagguuuaacaguuuguuguccuggagggauuuucuuacagcgaagac

SEQ ID NO: 746211 - RNA, 64 nt, hsa
ccagccccaccaaguacgcagagacccccuugucguccuggacaccacaggggcaccugcaggc

SEQ ID NO: 746212 - RNA, 64 nt, hsa
ugaaaaaaaaaaaaggggagcagggaggcagaaaguccuggaaaaguaaauuguuuauuuuaca

SEQ ID NO: 746213 - RNA, 64 nt, hsa
ggcccgucagagucaagagaugucauccccccagggucuccaaggcauuuccacacuauuggug

SEQ ID NO: 746214 - RNA, 64 nt, hsa
acuggcccaguuuacagugaaauggagaauuucaggucuccacgucugcccaggaaagaacuuc

SEQ ID NO: 746215 - RNA, 64 nt, hsa
gcucuggcuucugugauggugcaagaggcaggauggucuccagacaccuucuugcagagugauu

SEQ ID NO: 746216 - RNA, 64 nt, hsa
uguucuggaaaggaccccauggcagacuuggcaaggucuccacuucaggggcaaacaucuccau

SEQ ID NO: 746217 - RNA, 64 nt, hsa
agcagcucacuucucuguguucugccuccccucuggucuccagaguuuuccuguccucuagagg

SEQ ID NO: 746218 - RNA, 64 nt, hsa
auucccauugcucuccuggcucacucuuacggucggucuccagugacugaagcauuccccaccc

SEQ ID NO: 746219 - RNA, 64 nt, hsa
ccugaccugccccuuccuuguuuuuccuccuacuggucuccaccaaggcuuuguuagcccccac

SEQ ID NO: 746220 - RNA, 64 nt, hsa
gccaugccagugucugugcacaucccugucuguuggucuccauggccacuguggaccgggaccc

SEQ ID NO: 746221 - RNA, 64 nt, hsa
gggcuccccggcccugggugggcggugggcagcuggucuccagggacucagugaguggcugugc

SEQ ID NO: 746222 - RNA, 64 nt, hsa
ggaugcaaagggcaggugagucaagaaccgcauaggucuccaguccccacggggcucccaggcc

SEQ ID NO: 746223 - RNA, 64 nt, hsa
gagaggcuggcacuaggggccacuggggggcuggggucuccaggggaugacuguuuucaaucuc

SEQ ID NO: 746224 - RNA, 64 nt, hsa
ccuaaggguuguaggaccuuggcagagggggccuggucuccauuagaggguguuguuuucuccu

SEQ ID NO: 746225 - RNA, 64 nt, hsa
uaguuucauugauuuaaucauaaauaauggaaauggucuccaagaaguuuuauuuuucauuuuu

SEQ ID NO: 746226 - RNA, 64 nt, hsa
ggaagaggaaggaauaacaacucagugaaaagauggucuccaguuucugaaugaaaaagcuaca

SEQ ID NO: 746227 - RNA, 64 nt, hsa
ccucccaggcacugcagaggcaccggugaggaagggucuccaggcuucacucaggguagagaaa

SEQ ID NO: 746228 - RNA, 64 nt, hsa
ugcucccaggcacugcagaggcccgguggggaagggucuccaggcuuuauuccucccaggcacu

SEQ ID NO: 746229 - RNA, 64 nt, hsa
cauaccaggugcuagggugccugcucuccuugcccugggccagcccaggauuguacgugggaga

SEQ ID NO: 746230 - RNA, 64 nt, hsa
cggggaggagccuuggaguguaauuaccugucaucugggccaccagcuccacuggccugcccgu

SEQ ID NO: 746231 - RNA, 64 nt, hsa
aacacguagacaggcuguaauauucaaaccaccucugggccaaugcauuuccaaaggaugccuu

SEQ ID NO: 746232 - RNA, 64 nt, hsa
cgauuugagccucuccggcugccagccagggggccugggccagaccagggcucuguccuuccgu

SEQ ID NO: 746233 - RNA, 64 nt, hsa
uccuggaagagcucccagaagauaaccucuccuccugggccaccuggggcaccuuaccaccgga

SEQ ID NO: 746234 - RNA, 64 nt, hsa
aaggcuccucugcuugggauucuucagacagaagcugggccagcacuguggacuccuccuggga

SEQ ID NO: 746235 - RNA, 64 nt, hsa
ucccaggggauucagagucuccagaaagauauggcugggccaacucuguugccuaccuggccug

SEQ ID NO: 746236 - RNA, 64 nt, hsa
guauaaagcuagugugacccugcucuuccagcuccugggccagcucuggaagggcuguauuugg

SEQ ID NO: 746237 - RNA, 64 nt, hsa
ccucagucugguauccagacugugaaaucagccucugggccaaggaggguccuacagacaaggu

SEQ ID NO: 746238 - RNA, 64 nt, hsa
ggugcgaagcccagaggaggcggcuugggauccucugggccaucccuggcccuguagcacagac

SEQ ID NO: 746239 - RNA, 64 nt, hsa
cagcccuggagccaucacuacucacaccgugguccugggccagggccugagaugacagugggga

SEQ ID NO: 746240 - RNA, 64 nt, hsa
agggacauggacccacgugcuugaggccuggcagcugggccaagacagauggggcuuuguggcc

SEQ ID NO: 746241 - RNA, 64 nt, hsa
cacuaggacuacuuuuuaccaaaagagaagcagucugggccagaugcccugccaggaaagggac

SEQ ID NO: 746242 - RNA, 64 nt, hsa
ucuuuucagaaggcuaaagucagaggaaugggggcugggccacucccuuggagcucucagaucu

SEQ ID NO: 746243 - RNA, 64 nt, hsa
guuucacucuguuucccaggcuggucuugaacuccugggccaugccuggccagggacaugaauu

SEQ ID NO: 746244 - RNA, 64 nt, hsa
cucuccguccucagggcugugccucugggagccacugggccaggggccccgggucgcagagagc

SEQ ID NO: 746245 - RNA, 64 nt, hsa
agggcuccucuggcccgcaguggccuggaucuaucugggccaugagugacgggcagugaccaga

SEQ ID NO: 746246 - RNA, 64 nt, hsa
ggggccuucugcugcugccacacccagcucaggccugggccagccccugcccccagcccacuga

SEQ ID NO: 746247 - RNA, 64 nt, hsa
ggaucccgcacaagcucccuucaguccuucagggcugggccaugugguugauuuuucuaaagcu

SEQ ID NO: 746248 - RNA, 64 nt, hsa
ccagacagcuucccagcaggcccuagagcccggccugggccaaugauggagggcggccgccagc

SEQ ID NO: 746249 - RNA, 64 nt, hsa
ccagcacccugucccuggagcaccucuguccugucugggccaaccuggucucccugccccaugc

SEQ ID NO: 746250 - RNA, 64 nt, hsa
ccaggggcaggccaggcauggcucagugcagucccugggccagugagaggccucccccaugccu

SEQ ID NO: 746251 - RNA, 64 nt, hsa
gcugguuguugccagguugcagcugcucuugcaucugggccagaaguccucccuccugcaggcu

SEQ ID NO: 746252 - RNA, 64 nt, hsa
cccgugucuggaugcacagaugccauggccugugcugggccaguggcugggggugcuagacacc

SEQ ID NO: 746253 - RNA, 64 nt, hsa
gugugggaaccccucugccuggcaccuggauacccugggccagguaaccugagggcaggggaga

SEQ ID NO: 746254 - RNA, 64 nt, hsa
uuuucaugucccccaccucauguuuucaccuuuucugggccaggcauagauuaaguaacuggga

SEQ ID NO: 746255 - RNA, 64 nt, hsa
ggccccagggcccaggagggacagugccuggagccugggccaggcccagcccaucugugugugu

SEQ ID NO: 746256 - RNA, 64 nt, hsa
cgcauacacacggccaugcacgcacacacugggccugggccagggccccagagcuccugccuga

SEQ ID NO: 746257 - RNA, 64 nt, hsa
ggaggagcccugugcucccagcucagaggacagucugggccagaacuggaaggagacaucuguc

SEQ ID NO: 746258 - RNA, 64 nt, hsa
ugcuguucucuguugccagggggcaggucugggccugggccaaccacguuuguuaucauggcug

SEQ ID NO: 746259 - RNA, 64 nt, hsa
uggacagauucccaccuguauguagcacgccaugcugggccagcagugucauaggaguggaggg

SEQ ID NO: 746260 - RNA, 64 nt, hsa
ugcccgccagggcucagguuccucugagcugguccugggccaggacgcaucugcauggcggugg

SEQ ID NO: 746261 - RNA, 64 nt, hsa
ugcggugggugcugccaugacagaggcugcaccccugggccagcggggcugcucacccaccucu

SEQ ID NO: 746262 - RNA, 64 nt, hsa
ggcacucagugagccuccugugccuggccccagccugggccaucucuuaggugagacaguugcc

SEQ ID NO: 746263 - RNA, 64 nt, hsa
guuaggcuagagacagaugcugguggaggaagggcugggccaccagggaucacagaccacagga

SEQ ID NO: 746264 - RNA, 64 nt, hsa
ugcugucugaguaguggccacuggggugccuucacugggccagucaacggggggcuccugccca

SEQ ID NO: 746265 - RNA, 64 nt, hsa
cugaggagggcuggagcucgggaaguuguccuuccugggccagggccguuucuggcacugggag

SEQ ID NO: 746266 - RNA, 64 nt, hsa
aggaugaggcagaggcaugaugcuuccugcucaccugggccacccucucuccaggacuugucag

SEQ ID NO: 746267 - RNA, 64 nt, hsa
augggcucuggcugcugggggagccgugucacuccugggccaugggggcaccuccugggcacuu

SEQ ID NO: 746268 - RNA, 64 nt, hsa
cacccuugauuggguuuugcacuaaagaggucagcugggccaaugauauugcuccagaccgagu

SEQ ID NO: 746269 - RNA, 64 nt, hsa
gccagggaggacacgcuccacugaccacccagagcugggccagggacucaacaauggggacaga

SEQ ID NO: 746270 - RNA, 60 nt, hsa
acacggacacgcucugcugaccacccagagcugggccagggaggacacgcuccacugacc

SEQ ID NO: 746271 - RNA, 64 nt, hsa
gggccagggcccuggguggggagguguggguucccugggccaagaccagccuuuuuccucaguu

SEQ ID NO: 746272 - RNA, 64 nt, hsa
gauggucacccagagccauagagcacccuuccuccugggccagagcuggguuaucaugguuggc

SEQ ID NO: 746273 - RNA, 64 nt, hsa
aaugguccacugagggccuccugcucugccugggcugggccaggggcuuugaggagaggguaaa

SEQ ID NO: 746274 - RNA, 64 nt, hsa
gggauguggcagcaucagugggacaagauggacacugggccacccucccaggcaccagacacag

SEQ ID NO: 746275 - RNA, 64 nt, hsa
uccuccugcuggugcuccaucccccaauaccaggcugggccaccacucugaggaggguaggagg

SEQ ID NO: 746276 - RNA, 64 nt, hsa
auuccucugggggcuggcgcaugcccaggaaagccugggccacacgggacacucucuucuuuau

SEQ ID NO: 746277 - RNA, 64 nt, hsa
uccccuuccauaccccuuccuggaucuccagugccugggccaggaaagcccucuggguuccggg

SEQ ID NO: 746278 - RNA, 64 nt, hsa
aaagcccucuggguuccgggaagccccguccacccugggccauggggccgguuggaaggauacu

SEQ ID NO: 746279 - RNA, 64 nt, hsa
ugacuagcggccaccucauuuccccccuugaccacugggccaguuggguggcuagguugccuca

SEQ ID NO: 746280 - RNA, 64 nt, hsa
agcgcauggcuccggaagcagacacaggccaggccugggccaggagucugccaggagccaggag

SEQ ID NO: 746281 - RNA, 64 nt, hsa
cccacagacucaaaguuacucuccuucccccuaccugggccagugaaauagaaagccuuucuau

SEQ ID NO: 746282 - RNA, 64 nt, hsa
gcccugaguuuccauuacugugggugggguuccccugggccaaacagugauuugucucccucaa

SEQ ID NO: 746283 - RNA, 64 nt, hsa
ugugcaauagggugggguaggggcagggaaaggacugggccagggcaggcucgggagauagauu

SEQ ID NO: 746284 - RNA, 64 nt, hsa
aucuguuuacacaucaaucugccucacugcuguucugggccauccccauagccauguuuacaug

SEQ ID NO: 746285 - RNA, 64 nt, hsa
gcgccauaggcagaggcuuauaaagaaauggguucugggccaggugugguggcucaagccugua

SEQ ID NO: 746286 - RNA, 64 nt, hsa
cgcgcccaccgcaggugggacucagguucgcccucugggccagguccuucacgaggagggagcu

SEQ ID NO: 746287 - RNA, 64 nt, hsa
ggacucugcuuccuccaggagcagcagggaagcucugggccaccucccuggauagcaggaacuu

SEQ ID NO: 746288 - RNA, 64 nt, hsa
acccacacagaagcagugcugcccggggccucaucugggccagcuuggacucugcuuccuccag

SEQ ID NO: 746289 - RNA, 64 nt, hsa
uccagccauccuccugccucagcuucccagauagcugggccacaggcgugugccaccacaccug

SEQ ID NO: 746290 - RNA, 64 nt, hsa
cucagccauggcugugugcuuuggcccugcagcucugggccaccugcugguguccaccucgucc

SEQ ID NO: 746291 - RNA, 64 nt, hsa
uggaccugauggcccccuguggcgccuugaccugcugggccaggcugcccugggacucucagcc

SEQ ID NO: 746292 - RNA, 64 nt, hsa
ccuggccagcccacuggauuggggacgggccaggcugggccaggucgggggcucagucugggag

SEQ ID NO: 746293 - RNA, 64 nt, hsa
ugugccuucagcagccccuguccucaccaugggccugggccaggugugacagaguagagguagc

SEQ ID NO: 746294 - RNA, 64 nt, hsa
uuugguucccacucagcuucugccggucggcagccugggccaggcccuuuuccugcaugugcca

SEQ ID NO: 746295 - RNA, 64 nt, hsa
cacucuuauugguaagcuauaggagacucaggaucugggccaaccucaaggugggggcuucaga

SEQ ID NO: 746296 - RNA, 64 nt, hsa
uuucagcacagaaccugaaugccaggaaaaauuccugggccaagaagcuaaagcuaaagaaacc

SEQ ID NO: 746297 - RNA, 64 nt, hsa
ccagaaaggugcuuuccuucagacggugcagggccugggccagccuuacaggucaguagacuag

SEQ ID NO: 746298 - RNA, 64 nt, hsa
augaugugacuuugaggccccaacaugacagccacugggccaccgggacccaagaagacagccc

SEQ ID NO: 746299 - RNA, 64 nt, hsa
aaguucucaguucccuccaggcuucuagaagcaucugggccagggcucauggcuggauaauuuc

SEQ ID NO: 746300 - RNA, 64 nt, hsa
cgugggcacguuuuugcaaccgguucguugauaccugggccagggaugaggacacugugcucaa

SEQ ID NO: 746301 - RNA, 64 nt, hsa
gagcucccugucucuggaaguauuuaagaaaaggcugggccaggcacgauggcucacgccugua

SEQ ID NO: 746302 - RNA, 64 nt, hsa
ucugugguugaccucucagcaagugcuauccaggcugggccaaccagacccacaauuaacugag

SEQ ID NO: 746303 - RNA, 56 nt, hsa
agcuggugccaacuuccugauggguccugggccaggccagccagggagaagacaag

SEQ ID NO: 746304 - RNA, 64 nt, hsa
cccgccuucggucuguuccuucaagcaagcuggccugggccaugugccugugaaaggcaggcuc

SEQ ID NO: 746305 - RNA, 64 nt, hsa
uucugaugaggcaaaauccuccagcuauuccugucugggccaguuuuguagguccaucugugca

SEQ ID NO: 746306 - RNA, 64 nt, hsa
acuuccuggucaagcuuauggugcuuauuuugaucugggccacuucccuccuuccagucaugag

SEQ ID NO: 746307 - RNA, 64 nt, hsa
acuccaacauugcauccuuucuggggugaagaaucugggccaaccagggguccuugggccucua

SEQ ID NO: 746308 - RNA, 64 nt, hsa
gaugcacucagcuucguguuggccaagacuccuucugggccaauggggcugccucuuuuccuuu

SEQ ID NO: 746309 - RNA, 64 nt, hsa
ccccaacccagacccccuuuucuccauguaccugcugggccagcccauuucacaggugaggaac

SEQ ID NO: 746310 - RNA, 64 nt, hsa
gggcugaacuuugggagggccccuguacuaccuccugggccaagaaacuggcacagccccacac

SEQ ID NO: 746311 - RNA, 64 nt, hsa
aaagcugagaugcugagagagauagcucccugagcugggccaucugacuucuaccucccauguu

SEQ ID NO: 746312 - RNA, 64 nt, hsa
uguccccagcaaguguaggaguggugggccugaacugggccauugaucagacuaaauaaauuaa

SEQ ID NO: 746313 - RNA, 64 nt, hsa
auggccucuuccuccucagggaccucugacugcucugggccaaagaaucucuuguuucuucucc

SEQ ID NO: 746314 - RNA, 64 nt, hsa
gguucugcucuuccaggcaggccagcaaguggcgcugggccacacuggcuucuuccugccccau

SEQ ID NO: 746315 - RNA, 64 nt, hsa
gcccggacacccauagacggugcggggggccuggcugggccagaccccaggaaggugggguaga

SEQ ID NO: 746316 - RNA, 64 nt, hsa
uugcuuuagggugucaggguccaggcugcaggggcugggccaauuuguggagaggccgggugcc

SEQ ID NO: 746317 - RNA, 64 nt, hsa
cuguuccccuagacuucucaggggccagcccagucugggccacccuuuguuucccucauccucg

SEQ ID NO: 746318 - RNA, 64 nt, hsa
auaggucugaccccaguccccacucccuuucaggcugggccacagggaguugcuggcuggccac

SEQ ID NO: 746319 - RNA, 64 nt, hsa; identical to SEQ ID NO: 172863

SEQ ID NO: 746320 - RNA, 64 nt, hsa; identical to SEQ ID NO: 172864

SEQ ID NO: 746321 - RNA, 64 nt, hsa; identical to SEQ ID NO: 172865

SEQ ID NO: 746322 - RNA, 64 nt, hsa; identical to SEQ ID NO: 172866

SEQ ID NO: 746323 - RNA, 64 nt, hsa; identical to SEQ ID NO: 172867

SEQ ID NO: 746324 - RNA, 64 nt, hsa; identical to SEQ ID NO: 172868

SEQ ID NO: 746325 - RNA, 64 nt, hsa; identical to SEQ ID NO: 172869

SEQ ID NO: 746326 - RNA, 64 nt, hsa; identical to SEQ ID NO: 172870

SEQ ID NO: 746327 - RNA, 64 nt, hsa; identical to SEQ ID NO: 172871

SEQ ID NO: 746328 - RNA, 64 nt, hsa; identical to SEQ ID NO: 172872

SEQ ID NO: 746329 - RNA, 64 nt, hsa; identical to SEQ ID NO: 172873

SEQ ID NO: 746330 - RNA, 64 nt, hsa; identical to SEQ ID NO: 172874

SEQ ID NO: 746331 - RNA, 64 nt, hsa; identical to SEQ ID NO: 172875

SEQ ID NO: 746332 - RNA, 64 nt, hsa; identical to SEQ ID NO: 172876

SEQ ID NO: 746333 - RNA, 64 nt, hsa; identical to SEQ ID NO: 172877

SEQ ID NO: 746334 - RNA, 64 nt, hsa; identical to SEQ ID NO: 172878

SEQ ID NO: 746335 - RNA, 64 nt, hsa; identical to SEQ ID NO: 172879

SEQ ID NO: 746336 - RNA, 64 nt, hsa; identical to SEQ ID NO: 172880

SEQ ID NO: 746337 - RNA, 64 nt, hsa; identical to SEQ ID NO: 172881

SEQ ID NO: 746338 - RNA, 64 nt, hsa; identical to SEQ ID NO: 172882

SEQ ID NO: 746339 - RNA, 64 nt, hsa; identical to SEQ ID NO: 172883

SEQ ID NO: 746340 - RNA, 64 nt, hsa; identical to SEQ ID NO: 172884

SEQ ID NO: 746341 - RNA, 64 nt, hsa; identical to SEQ ID NO: 172885

SEQ ID NO: 746342 - RNA, 64 nt, hsa; identical to SEQ ID NO: 172886

SEQ ID NO: 746343 - RNA, 64 nt, hsa; identical to SEQ ID NO: 172887

SEQ ID NO: 746344 - RNA, 64 nt, hsa; identical to SEQ ID NO: 172888

SEQ ID NO: 746345 - RNA, 64 nt, hsa; identical to SEQ ID NO: 172889

SEQ ID NO: 746346 - RNA, 64 nt, hsa; identical to SEQ ID NO: 172890

SEQ ID NO: 746347 - RNA, 64 nt, hsa; identical to SEQ ID NO: 172891

SEQ ID NO: 746348 - RNA, 64 nt, hsa; identical to SEQ ID NO: 172892

SEQ ID NO: 746349 - RNA, 64 nt, hsa; identical to SEQ ID NO: 172893

SEQ ID NO: 746350 - RNA, 64 nt, hsa; identical to SEQ ID NO: 172894

SEQ ID NO: 746351 - RNA, 64 nt, hsa
ggugaccguggcuggcggucacgcccucagccccuccgggcacacgugccgccugaccgggcga

SEQ ID NO: 746352 - RNA, 64 nt, hsa
uuccagcaaucuguugguuuugcaagucugaagcuccgggcagagcugagccugguauccaaug

SEQ ID NO: 746353 - RNA, 64 nt, hsa
cugaaggcgccagagacuggcggugucuuaagacuccgggcaccgccacgcgcugucaagcaac

SEQ ID NO: 746354 - RNA, 64 nt, hsa
uccuguugguguuguaagaaaaggcccaugcuuguccgggcacaguggcuuacgccuguuaaug

SEQ ID NO: 746355 - RNA, 64 nt, hsa
cgagguuggaccccagcuucuugccaccuuccccuccgggcagucagcucuccauccauccccc

SEQ ID NO: 746356 - RNA, 64 nt, hsa
ugaaaccccgucucuacuaaaaauacaaaaauuauccgggcaugguggcacaugccuguaaucu

SEQ ID NO: 746357 - RNA, 64 nt, hsa
cuuucugggaccaaagaaugggcaccugcuggaguccgggcagagcuuucucaguuguauugcu

SEQ ID NO: 746358 - RNA, 54 nt, hsa
agcccggggaucagacauagccuguccgggcaucaacccucucuggcgguggcc

SEQ ID NO: 746359 - RNA, 64 nt, hsa
gagcccccuccuccccucucuccugggcccucauuccgggcaggucccccuucacucagccccc

SEQ ID NO: 746360 - RNA, 64 nt, hsa
ccaugacugcucugggccggggguagagcuagcauccgggcauguacgagggaagagggaggca

SEQ ID NO: 746361 - RNA, 64 nt, hsa
cccccagggccuaggguugaaagccuuccccggcuccgggcauuauuuggguuuaaucucggag

SEQ ID NO: 746362 - RNA, 64 nt, hsa
gugaaaccccaucucuacuaaaauacaaaaauuauccgggcaugggggcacacaccgguaaucc

SEQ ID NO: 746363 - RNA, 64 nt, hsa
cgcccgcccucauggaccccgcugccacccgcuuuccgggcacccauccauccaggcacccaac

SEQ ID NO: 746364 - RNA, 64 nt, hsa
ugacuuuggaagaaacucuugaauacugccugcauccgggcaccauggccagguugccuaggag

SEQ ID NO: 746365 - RNA, 64 nt, hsa
aacguuagacugcaauacuaacgaccgacgccccuccgggcagagaccaccgcgccccucugcg

SEQ ID NO: 746366 - RNA, 64 nt, hsa
uuguggcguugaucuccuugcguccuugggcaucuccgggcaucagacccucucccuggcccuu

SEQ ID NO: 746367 - RNA, 64 nt, hsa
agccuucccugcagccccuccccaacaggcuugguccgggcagccugcucugcggaagguggca

SEQ ID NO: 746368 - RNA, 55 nt, hsa
uucguggggagagagcguagagguuuccgggcaguaauucuauccaacuuaaaaa

SEQ ID NO: 746369 - RNA, 64 nt, hsa
gacugucagaguggggaaccccucccauuaaagauccgggcaggacuggggacagguuggaagu

SEQ ID NO: 746370 - RNA, 64 nt, hsa
gcucuacuucauugaguaaaaucgagugagagguuccgggcagcaggaucgacgcccaguccag

SEQ ID NO: 746371 - RNA, 64 nt, hsa
uuucauucacuguucuugacuucaugaaggcuucuccgggcagucuuggugugagaagcuguuu

SEQ ID NO: 746372 - RNA, 64 nt, hsa
gagauagcugccugcuagauagccggcuuugccauccgggcauguggccacacugcccaccacc

SEQ ID NO: 746373 - RNA, 64 nt, hsa
gacuuagccgacugcgcugcuuuuucaaaacggauccgggcaaugcuucguuuucuaaaggaug

SEQ ID NO: 746374 - RNA, 64 nt, hsa
uccaggcgccaucuagcacagccuggcccugaucuccgggcagccaccaccuccucggucugcc

SEQ ID NO: 746375 - RNA, 64 nt, hsa
auccaagguguagggcccggcgcggggcgcggacuccgggcacggcuucccaggggaacgagga

SEQ ID NO: 746376 - RNA, 64 nt, hsa
aagaaaguuuauuuucgugugagaugccagccccuccgggcaggcaagggcucugaagauuugg

SEQ ID NO: 746377 - RNA, 64 nt, hsa
cauuucuccaugaugagaaggacuggaaugcuucuccgggcaggacaugguccuaggaagccug

SEQ ID NO: 746378 - RNA, 64 nt, hsa
uccccucuccucccagccaccaucguucaucugcuccgggcagaacuguguggccccugccugu

SEQ ID NO: 746379 - RNA, 64 nt, hsa
gacuucagagucuucuuccaagagcugguggaauuccgggcacggcagcgccguggcuccccac

SEQ ID NO: 746380 - RNA, 64 nt, hsa
cuggguacacugcagaagccccauccuucccgccuccgggcauaaggccccugaccacacuuca

SEQ ID NO: 746381 - RNA, 64 nt, hsa
ucuagauaccuccugagaccuccguccucugcuuuccgggcagcucucaccaccccaggccccg

SEQ ID NO: 746382 - RNA, 64 nt, hsa
gagacaucugcugcuuggcucaaacuguagucuuuccgggcacaagaaaccagaguccugccca

SEQ ID NO: 746383 - RNA, 64 nt, hsa
cauggcccucggagguccagcugggccuccugccuccgggcaggcaagguuuacacugcggaag

SEQ ID NO: 746384 - RNA, 64 nt, hsa
ggcuuggcugcagggggacgugccuaaaagacauuccgggcauuugcacuugggaaacuugccu

SEQ ID NO: 746385 - RNA, 64 nt, hsa
cucacugagaggccuggagcccacaaccuucggcuccgggcaaauggcugagauggagguuucc

SEQ ID NO: 746386 - RNA, 64 nt, hsa
ucucugugucccugcugcugccagggcuuccucuuccgggcagaaacaauaaaaccacuugugc

SEQ ID NO: 746387 - RNA, 64 nt, hsa
aaaauucacaguugagugcaucccagcauucuguuccgggcaggcauuucaggaagaccgccuu

SEQ ID NO: 746388 - RNA, 64 nt, hsa
gugggcgguggccugucuagaaugccgccgggaguccgggcauggugggcacaguucucccugc

SEQ ID NO: 746389 - RNA, 64 nt, hsa
aacccagcccauccucucaggcagagcagggugguccgggcacacugggccugccucuccagcc

SEQ ID NO: 746390 - RNA, 64 nt, hsa
acugcuagaccaaggagcccuucugcuggcccuguccgggcauaacagaaggcucgcacucuug

SEQ ID NO: 746391 - RNA, 64 nt, hsa
ccuggcucucgugugcauggacgugccugagggguccgggcacggccauacgcaggaccccugu

SEQ ID NO: 746392 - RNA, 64 nt, hsa
gaggaggacauggggagguuguggggccucaggcuccgggcaccaggggccaaccucaggcucc

SEQ ID NO: 746393 - RNA, 64 nt, hsa
ggcggaaucccgaggguggugugggggagcuccguccgggcaguuggcugcugguccugucuga

SEQ ID NO: 746394 - RNA, 64 nt, hsa
ucacccucugcagcugggagggcucuucugggcguccgggcagcugcagcugagaggacuuuca

SEQ ID NO: 746395 - RNA, 64 nt, hsa
gaaccccagaccuguuuguaucauccgggcuccuuccgggcagaaacaacugaaaaugcacuuc

SEQ ID NO: 746396 - RNA, 64 nt, hsa
aauuugucuccuacucuguguaaauauuuuucccuccgggcaggggagccaggguagagcaaag

SEQ ID NO: 746397 - RNA, 64 nt, hsa
ccccaccugccagcucuacugggcuuggagcacguccgggcaguggagggagggacacagccug

SEQ ID NO: 746398 - RNA, 64 nt, hsa
ccgaggcaggccuucggggccccuuucgccugcuuccgggcagggacgaggccugguguccucg

SEQ ID NO: 746399 - RNA, 64 nt, hsa
gguccuaacucccccaccccauaucuacguguccuccgggcauugcccucuccauggcucuggu

SEQ ID NO: 746400 - RNA, 64 nt, hsa
cuggaagguuccuuuugcccucagugccagccaauccgggcaggacccucgaagaggagaccga

SEQ ID NO: 746401 - RNA, 64 nt, hsa
ggcuggucccagcggagccgcacucuucgcccgcuccgggcaaaagcgggggcgaguguagagc

SEQ ID NO: 746402 - RNA, 64 nt, hsa
uuucuucuguauacauccagauggaucccaggcauccgggcaccacccuggugugucccuagaa

SEQ ID NO: 746403 - RNA, 64 nt, hsa
uuguaaguuaaaaagaaaaaaaaaaagaaaaaguuccgggcauuuugcaucagaaaacaacuuu

SEQ ID NO: 746404 - RNA, 64 nt, hsa
gagcaauauuuugugcugaagaccucuuuuacuuuccgggcaagugaaugucauuuuaaucaau

SEQ ID NO: 746405 - RNA, 64 nt, hsa
gcgcgccggugccgagggccgaggagcgcccggguccgggcaggugaccgcccgccucuguccu

SEQ ID NO: 746406 - RNA, 64 nt, hsa
ugaaguguggccuugucaaaggcuauggagauguuccgggcauacugcugugcucugugcuuuc

SEQ ID NO: 746407 - RNA, 64 nt, hsa
agcggacguucacaugagugggucuauagcccgcuccgggcaucaucuagacuuagcaugcauu

SEQ ID NO: 746408 - RNA, 64 nt, hsa
auggccagccaguggcaagcugccgcccccacucuccgggcaccgucuccugccugugcguccg

SEQ ID NO: 746409 - RNA, 64 nt, hsa
uccucugcccacagcagacucugucccauggcucuccgggcaguagagugugugagugcagacu

SEQ ID NO: 746410 - RNA, 64 nt, hsa
ccauaggaaugugagagggguguuugcugagcgcuccgggcacggccagagggcaagugagcau

SEQ ID NO: 746411 - RNA, 64 nt, hsa
ucuccgucugggcgcugugaguggggugggcacguccgggcagcccagugcgucugucgcacgu

SEQ ID NO: 746412 - RNA, 64 nt, hsa
cugccagcuuuugcuggcacguaggcuaccacucuccgggcaccggcuggggcccuggagcccc

SEQ ID NO: 746413 - RNA, 64 nt, hsa
guauguaacccacugugcugucaagcaucaugauuccgggcaguuuucauuuuacuguggauuu

SEQ ID NO: 746414 - RNA, 64 nt, hsa
accccgccuggagcuccuuccgcggccaccgugcuccgggcaccccgggagcuccugcaagagg

SEQ ID NO: 746415 - RNA, 64 nt, hsa
ucagcaccuggaaccuggaucacauaauagaaaagaaacgcaccaucauuccuacacuggugga

SEQ ID NO: 746416 - RNA, 64 nt, hsa
guggugagugccuucuguacagucgacugcaaaugaaacgcagaggaugggugcccagaagcac

SEQ ID NO: 746417 - RNA, 64 nt, hsa
ugccugccaagcucacacagcaggaacugagccagaaacgcagauugggcuggcucugaagcca

SEQ ID NO: 746418 - RNA, 64 nt, hsa
ugugguuccacuuccccugugcagaucgugggaugaaacgcaugggccaucgcaccugccuuug

SEQ ID NO: 746419 - RNA, 64 nt, hsa
aauacagaauggcuucugugauacuggccuugcugaaacgcaucucacugucauucuauuguuu

SEQ ID NO: 746420 - RNA, 64 nt, hsa
gugaccgagaacuuuuaagaggauagaauacauggaaacgcaaaugaguauuucggagcaugaa

SEQ ID NO: 746421 - RNA, 64 nt, hsa
cgauggacacauuccccuugggcuuuuuguaacugaaacgcaccacagaagacagggagucauc

SEQ ID NO: 746422 - RNA, 64 nt, hsa
agucagcccgaaugccugucaguuucauggaggggaaacgcaaaaccugcaguuccugaguacc

SEQ ID NO: 746423 - RNA, 64 nt, hsa
caacccuuuccugucccaggcccuacauucagcagaaacgcacuuuggacuuuuugcuuuagau

SEQ ID NO: 746424 - RNA, 64 nt, hsa
caggucuugugagcccaggaaugaaagaggagaagaaacgcaacuaccugcgcccuccgugguc

SEQ ID NO: 746425 - RNA, 64 nt, hsa
gagguuuguaaaaaguguccugugacuuaacacagaaacgcaauaaacacacacaaaauaguuu

SEQ ID NO: 746426 - RNA, 64 nt, hsa
uggcgugguauauuuaaccacgggagcgugucuggaaacgcaaacuaucauuaauuucauacua

SEQ ID NO: 746427 - RNA, 64 nt, hsa
ggaagagaucuuuuuuuacuagagaucugcagaagaaacgcaaucuucugagcacaauauggaa

SEQ ID NO: 746428 - RNA, 64 nt, hsa
acagaaagagagccucagaauggacaaugacguugaaacgcagcauuuuugaaaagggagaaag

SEQ ID NO: 746429 - RNA, 64 nt, hsa
uaccuacuuuuggagccacaggguguuuugcacugaaacgcagaacgcugcaaccaauacuguu

SEQ ID NO: 746430 - RNA, 64 nt, hsa
gcacuuucaucagauccugccuccuggagugggggaaacgcagcaccccacugguucugaggcc

SEQ ID NO: 746431 - RNA, 64 nt, hsa
cucuuagucuggcuuccaugaagcgucauggguggaaacgcauucuaguaaaaaagguaggaaa

SEQ ID NO: 746432 - RNA, 64 nt, hsa
aggugacacuguuguacaagaugucagcuuugcugaaacgcacauuaccuggaauaagugcuuu

SEQ ID NO: 746433 - RNA, 64 nt, hsa
cugagcauuugcaccucuguucauuucacacagugaaacgcaauuuuaccuaguuugcacuaua

SEQ ID NO: 746434 - RNA, 64 nt, hsa
cucuugagaaaauacacgcuuucugcauguauuagaaacgcacgagcuccaccaagucuacaau

SEQ ID NO: 746435 - RNA, 64 nt, hsa
gcugugaugcacuguggcuggugccgucuugcaugaaacgcaugagccgugagcgcccaguuca

SEQ ID NO: 746436 - RNA, 64 nt, hsa
uaauuuauuccauuucucucugugucugugccaagaaacgcaggcucugggccugccccuugcc

SEQ ID NO: 746437 - RNA, 64 nt, hsa
acuuuucauagucaaguaacucagaacuuuuauggaaacgcauuugcaaaguucuauggcuguc

SEQ ID NO: 746438 - RNA, 64 nt, hsa
cacccuuuagcuggaugcugucagaggcgauggagaaacgcaaaggugcguuaauuuuacucua

SEQ ID NO: 746439 - RNA, 64 nt, hsa
ugugcuuuugcuauguaugguauccaaguuaguugaaacgcagacacugagaucuguuugaguu

SEQ ID NO: 746440 - RNA, 64 nt, hsa
ccaaacccuucagugccaaaaacaacaacaaaaugaaacgcaaccaccaccaaccacugcgacc

SEQ ID NO: 746441 - RNA, 64 nt, hsa
uuucauccagaacuaccaccugacauuccuugcugaaacgcaucuaguuccccuguuuauucau

SEQ ID NO: 746442 - RNA, 64 nt, hsa
uuguagauugauacgcaguugugcaugggaaggggaaacgcacagcuuuauuuacuguaaagug

SEQ ID NO: 746443 - RNA, 64 nt, hsa
cauuccuuugucuucaaacugugaagcauuuacagaaacgcauccagcaagaauauugucccuu

SEQ ID NO: 746444 - RNA, 64 nt, hsa
uagaagucagagcaaacuagggucucaguauugagaaacgcagccugccagggaaucacagaga

SEQ ID NO: 746445 - RNA, 64 nt, hsa
cccaagagaauaggggagccaaggaggaaauguggaaacgcaguuguguggcccagcacgagcc

SEQ ID NO: 746446 - RNA, 64 nt, hsa
auacucaguucucaugcaggugacauucuaccaugaaacgcagaagauaagccauguuucugua

SEQ ID NO: 746447 - RNA, 64 nt, hsa
ugucuaccugcugggggcacugaccaugcugagugaaacgcagcacaagcugcuggcggaggcg

SEQ ID NO: 746448 - RNA, 64 nt, hsa
acuacgcagcagcagcaguuuccaagacgggccagaaacgcauccacagcaguggcacccgcgg

SEQ ID NO: 746449 - RNA, 64 nt, hsa
uaauuuuaaaagaaccugcccugaaaaguucuuagaaacgcagugaaagggaggaacuuguccu

SEQ ID NO: 746450 - RNA, 64 nt, hsa
gcugccuuugcaguccuuuuacuacagcuaugaagaaacgcaacaagaaacucaaugcacaaca

SEQ ID NO: 746451 - RNA, 64 nt, hsa
aaccacaagggaaaagaaaaacccaguuucuuaggaaacgcaaacgauuuauuauccagauuau

SEQ ID NO: 746452 - RNA, 64 nt, hsa
cuugugucugcugaugagagcaccacucaucugcgaaacgcacguaaaacaaagugaaccguga

SEQ ID NO: 746453 - RNA, 64 nt, hsa
uaugagucauuuuuuucaaaagaugaaaacuccagaaacgcacaggaacgaaauaccucccaga

SEQ ID NO: 746454 - RNA, 64 nt, hsa
aggccauuauuaucugcuuugacaaagccuuucugaaacgcaguguacaaugaaucuuaaugau

SEQ ID NO: 746455 - RNA, 64 nt, hsa
cccuugcuuaucuguagaaacaaauggccauggagaaacgcagagcaguccagaaccaguggca

SEQ ID NO: 746456 - RNA, 64 nt, hsa
cagcagugccauugacugcccugauguucagagagaaacgcacacaagguuugcccaugagaau

SEQ ID NO: 746457 - RNA, 64 nt, hsa
cacuccuggcuccuccagacaaauaaggagaaaggaaacgcagggagacugugugccugggugu

SEQ ID NO: 746458 - RNA, 64 nt, hsa
cucccuggcugccucaggcuucucuuacgaagaggaaacgcaaaaaaagaaaaggaaaaacccc

SEQ ID NO: 746459 - RNA, 64 nt, hsa
gauaauauaaucaacuccucugccuggguuauaagaaacgcaccugacuuaaauaacauguauu

SEQ ID NO: 746460 - RNA, 64 nt, hsa
uaauggguugaugucugaaguagcaaaucuucuggaaacgcaaacucuuuuaaggaagucccua

SEQ ID NO: 746461 - RNA, 64 nt, hsa
uaagcacuuugcugcccuccaguggcugcuugaggaaacgcagggccugguuugggagagucac

SEQ ID NO: 746462 - RNA, 64 nt, hsa
agcuaugccgacagucagcagcugauccccgacagaaacgcagcagaugcagacggugagugca

SEQ ID NO: 746463 - RNA, 64 nt, hsa
gcaaaucagagcaagagcucuuucucaagggcaagaaacgcaaacaagaaauauuugugagaug

SEQ ID NO: 746464 - RNA, 64 nt, hsa
accacggcuccuagagacgcugaccuggcucucggaaacgcaggaguccuuccugguagccagc

SEQ ID NO: 746465 - RNA, 64 nt, hsa
accgaggucggagcugugaggacuuccagaacuggaaacgcaugaacgacccagaauaccaggc

SEQ ID NO: 746466 - RNA, 64 nt, hsa
ucagcaauaugaugacugaaagggaaaaguggaggaaacgcagcugcaacugaagcggagacuc

SEQ ID NO: 746467 - RNA, 64 nt, hsa
gaaaauaaagaacucuguagcucaccaagguggagaaacgcaauucagaaaaguaauuucucca

SEQ ID NO: 746468 - RNA, 64 nt, hsa
auagccuauacagacgaacugaucuguccuucgugaaacgcaacaaagcuaguucugucuuuuc

SEQ ID NO: 746469 - RNA, 64 nt, hsa
ugaccccuugauauuugcacagggauauuucuaagaaacgcagaggccagcguuccuggccucu

SEQ ID NO: 746470 - RNA, 64 nt, hsa
acauaaaacuuuaaaaggcaacucaaagaugauggaaacgcacuuacaaguggugaccaaaauu

SEQ ID NO: 746471 - RNA, 64 nt, hsa
ucugcuucugucuugaggauaugggaagccuagagaaacgcaagcagacuggauugggauagaa

SEQ ID NO: 746472 - RNA, 64 nt, hsa
uuucuugccauaauuaacauuuaguaauuauguagaaacgcacugcuuggucaggcuuccugcc

SEQ ID NO: 746473 - RNA, 64 nt, hsa
cuccucuuccugacccucccuccccugggcagaagaaacgcauguggaccagaagacuuucccu

SEQ ID NO: 746474 - RNA, 64 nt, hsa
ccucccucucacagguucugggcggccagugagagaaacgcagugggggaggcagggagucugg

SEQ ID NO: 746475 - RNA, 64 nt, hsa
uugugauagaucagagaagagucauguugaaaacgaaacgcagggaaaccgugcaagagagaac

SEQ ID NO: 746476 - RNA, 64 nt, hsa
auaggauuuuuacucccuuuguacaguauucugagaaacgcaaauaaaagggcaacauguuucu

SEQ ID NO: 746477 - RNA, 64 nt, hsa
agcugcagggcugccagauggagaucuuggaacugaaacgcacagccagugcucuggaaauuga

SEQ ID NO: 746478 - RNA, 64 nt, hsa
cagacacacugacaccucccgaaguggaccacaagaaacgcaaagugagggaagcugguggugg

SEQ ID NO: 746479 - RNA, 64 nt, hsa
gguauucugcaggcugaaugcagucuccagacuggaaacgcagagcggcuccucacgccuaauc

SEQ ID NO: 746480 - RNA, 64 nt, hsa
cggaagugagacgggcagacggcaccugcagccugaaacgcaccgcuccugcgugcgcccccac

SEQ ID NO: 746481 - RNA, 64 nt, hsa
gggguuugucuaucuuuguuucucucaccugagagaaacgcagguguuccagaggcuuccuugc

SEQ ID NO: 746482 - RNA, 64 nt, hsa
cccgucccgucaaacaaguuucuucuuaggcuaagaaacgcaguauauacgaguaucucuauau

SEQ ID NO: 746483 - RNA, 64 nt, hsa
ucugcccacaggaggcaugcacaaucugguaggagaaacgcacaaguacagauagcuugcucuc

SEQ ID NO: 746484 - RNA, 64 nt, hsa
agcccuccuguccccaagcuuucaggcaggcacugaaacgcaccgaacuuccacgcucugcugg

SEQ ID NO: 746485 - RNA, 64 nt, hsa
ugagccgagaucacaccacugcacuccaaccugggaaacgcagugagacugugccucaaaaaaa

SEQ ID NO: 746486 - RNA, 64 nt, hsa
ucgccaggccccgauacaugaauaacaaacccaagaaacgcauccccauugugugauguguuca

SEQ ID NO: 746487 - RNA, 64 nt, hsa
aggcuccggcgcugaugcgaauacagcucacagagaaacgcaugugcuauuggagaacaggucu

SEQ ID NO: 746488 - RNA, 64 nt, hsa
aaucccuugcucaccccuuucccccgccaaauaagaaacgcaagccagaccacgaugauuguag

SEQ ID NO: 746489 - RNA, 64 nt, hsa
gcaaggaugucuaagcuaaucccgucacagaaaggaaacgcacaggcgccuaggcagaaacuug

SEQ ID NO: 746490 - RNA, 64 nt, hsa
ccggguggcagcgcccagccuggccccaagcauggaaacgcacaaccccuaaucgcccugagcu

SEQ ID NO: 746491 - RNA, 64 nt, hsa
auggacugacaggccgagagcggauggacuacaugaaacgcaagagccgcgaguaugagcagcu

SEQ ID NO: 746492 - RNA, 64 nt, hsa
aggagaggggaaagagacauucgcuugguuuagugaaacgcaggugacuuuguagcucuguggu

SEQ ID NO: 746493 - RNA, 64 nt, hsa
gucugauucgaguucucccugggaggguuuagaagaaacgcaggaacauucuggguggcgucga

SEQ ID NO: 746494 - RNA, 64 nt, hsa; identical to SEQ ID NO: 119910

SEQ ID NO: 746495 - RNA, 64 nt, hsa; identical to SEQ ID NO: 119911

SEQ ID NO: 746496 - RNA, 64 nt, hsa; identical to SEQ ID NO: 119912

SEQ ID NO: 746497 - RNA, 64 nt, hsa; identical to SEQ ID NO: 119913

SEQ ID NO: 746498 - RNA, 64 nt, hsa; identical to SEQ ID NO: 119914

SEQ ID NO: 746499 - RNA, 64 nt, hsa; identical to SEQ ID NO: 119915

SEQ ID NO: 746500 - RNA, 64 nt, hsa; identical to SEQ ID NO: 119916

SEQ ID NO: 746501 - RNA, 64 nt, hsa; identical to SEQ ID NO: 119917

SEQ ID NO: 746502 - RNA, 64 nt, hsa; identical to SEQ ID NO: 119918

SEQ ID NO: 746503 - RNA, 64 nt, hsa; identical to SEQ ID NO: 119919

SEQ ID NO: 746504 - RNA, 64 nt, hsa; identical to SEQ ID NO: 119920

SEQ ID NO: 746505 - RNA, 64 nt, hsa; identical to SEQ ID NO: 119921

SEQ ID NO: 746506 - RNA, 64 nt, hsa; identical to SEQ ID NO: 119922

SEQ ID NO: 746507 - RNA, 64 nt, hsa; identical to SEQ ID NO: 119923

SEQ ID NO: 746508 - RNA, 64 nt, hsa; identical to SEQ ID NO: 119924

SEQ ID NO: 746509 - RNA, 64 nt, hsa; identical to SEQ ID NO: 119925

SEQ ID NO: 746510 - RNA, 64 nt, hsa; identical to SEQ ID NO: 119926

SEQ ID NO: 746511 - RNA, 64 nt, hsa; identical to SEQ ID NO: 119927

SEQ ID NO: 746512 - RNA, 64 nt, hsa; identical to SEQ ID NO: 119928

SEQ ID NO: 746513 - RNA, 64 nt, hsa; identical to SEQ ID NO: 119929

SEQ ID NO: 746514 - RNA, 64 nt, hsa; identical to SEQ ID NO: 119930

SEQ ID NO: 746515 - RNA, 64 nt, hsa; identical to SEQ ID NO: 119931

SEQ ID NO: 746516 - RNA, 64 nt, hsa; identical to SEQ ID NO: 119932

SEQ ID NO: 746517 - RNA, 64 nt, hsa; identical to SEQ ID NO: 119933

SEQ ID NO: 746518 - RNA, 64 nt, hsa; identical to SEQ ID NO: 119934

SEQ ID NO: 746519 - RNA, 64 nt, hsa; identical to SEQ ID NO: 119935

SEQ ID NO: 746520 - RNA, 64 nt, hsa; identical to SEQ ID NO: 119936

SEQ ID NO: 746521 - RNA, 64 nt, hsa; identical to SEQ ID NO: 119937

SEQ ID NO: 746522 - RNA, 64 nt, hsa; identical to SEQ ID NO: 119938

SEQ ID NO: 746523 - RNA, 64 nt, hsa; identical to SEQ ID NO: 119939

SEQ ID NO: 746524 - RNA, 64 nt, hsa; identical to SEQ ID NO: 119940

SEQ ID NO: 746525 - RNA, 64 nt, hsa; identical to SEQ ID NO: 119941

SEQ ID NO: 746526 - RNA, 64 nt, hsa; identical to SEQ ID NO: 119942

SEQ ID NO: 746527 - RNA, 64 nt, hsa; identical to SEQ ID NO: 119943

SEQ ID NO: 746528 - RNA, 64 nt, hsa; identical to SEQ ID NO: 119944

SEQ ID NO: 746529 - RNA, 64 nt, hsa; identical to SEQ ID NO: 119945

SEQ ID NO: 746530 - RNA, 64 nt, hsa; identical to SEQ ID NO: 119946

SEQ ID NO: 746531 - RNA, 64 nt, hsa; identical to SEQ ID NO: 119947

SEQ ID NO: 746532 - RNA, 64 nt, hsa; identical to SEQ ID NO: 119948

SEQ ID NO: 746533 - RNA, 64 nt, hsa; identical to SEQ ID NO: 119949

SEQ ID NO: 746534 - RNA, 64 nt, hsa; identical to SEQ ID NO: 119950

SEQ ID NO: 746535 - RNA, 64 nt, hsa; identical to SEQ ID NO: 119951

SEQ ID NO: 746536 - RNA, 64 nt, hsa; identical to SEQ ID NO: 119952

SEQ ID NO: 746537 - RNA, 64 nt, hsa; identical to SEQ ID NO: 119953

SEQ ID NO: 746538 - RNA, 64 nt, hsa; identical to SEQ ID NO: 119954

SEQ ID NO: 746539 - RNA, 64 nt, hsa; identical to SEQ ID NO: 119955

SEQ ID NO: 746540 - RNA, 64 nt, hsa; identical to SEQ ID NO: 119956

SEQ ID NO: 746541 - RNA, 64 nt, hsa; identical to SEQ ID NO: 119957

SEQ ID NO: 746542 - RNA, 64 nt, hsa; identical to SEQ ID NO: 119958

SEQ ID NO: 746543 - RNA, 64 nt, hsa; identical to SEQ ID NO: 119959

SEQ ID NO: 746544 - RNA, 64 nt, hsa; identical to SEQ ID NO: 119960

SEQ ID NO: 746545 - RNA, 64 nt, hsa; identical to SEQ ID NO: 119961

SEQ ID NO: 746546 - RNA, 58 nt, hsa; identical to SEQ ID NO: 119962

SEQ ID NO: 746547 - RNA, 64 nt, hsa; identical to SEQ ID NO: 119963

SEQ ID NO: 746548 - RNA, 64 nt, hsa; identical to SEQ ID NO: 119964

SEQ ID NO: 746549 - RNA, 64 nt, hsa; identical to SEQ ID NO: 119965

SEQ ID NO: 746550 - RNA, 64 nt, hsa; identical to SEQ ID NO: 119966

SEQ ID NO: 746551 - RNA, 64 nt, hsa; identical to SEQ ID NO: 119967

SEQ ID NO: 746552 - RNA, 64 nt, hsa; identical to SEQ ID NO: 119968

SEQ ID NO: 746553 - RNA, 64 nt, hsa; identical to SEQ ID NO: 119969

SEQ ID NO: 746554 - RNA, 64 nt, hsa; identical to SEQ ID NO: 119970

SEQ ID NO: 746555 - RNA, 55 nt, hsa; identical to SEQ ID NO: 119971

SEQ ID NO: 746556 - RNA, 64 nt, hsa; identical to SEQ ID NO: 119972

SEQ ID NO: 746557 - RNA, 64 nt, hsa; identical to SEQ ID NO: 119973

SEQ ID NO: 746558 - RNA, 64 nt, hsa; identical to SEQ ID NO: 119974

SEQ ID NO: 746559 - RNA, 64 nt, hsa; identical to SEQ ID NO: 119975

SEQ ID NO: 746560 - RNA, 64 nt, hsa; identical to SEQ ID NO: 119976

SEQ ID NO: 746561 - RNA, 64 nt, hsa; identical to SEQ ID NO: 119977

SEQ ID NO: 746562 - RNA, 64 nt, hsa; identical to SEQ ID NO: 119978

SEQ ID NO: 746563 - RNA, 64 nt, hsa; identical to SEQ ID NO: 119979

SEQ ID NO: 746564 - RNA, 64 nt, hsa; identical to SEQ ID NO: 119980

SEQ ID NO: 746565 - RNA, 64 nt, hsa; identical to SEQ ID NO: 119981

SEQ ID NO: 746566 - RNA, 64 nt, hsa; identical to SEQ ID NO: 119982

SEQ ID NO: 746567 - RNA, 64 nt, hsa; identical to SEQ ID NO: 119983

SEQ ID NO: 746568 - RNA, 64 nt, hsa; identical to SEQ ID NO: 119984

SEQ ID NO: 746569 - RNA, 64 nt, hsa; identical to SEQ ID NO: 119985

SEQ ID NO: 746570 - RNA, 64 nt, hsa; identical to SEQ ID NO: 119986

SEQ ID NO: 746571 - RNA, 64 nt, hsa; identical to SEQ ID NO: 119987

SEQ ID NO: 746572 - RNA, 55 nt, hsa; identical to SEQ ID NO: 119988

SEQ ID NO: 746573 - RNA, 64 nt, hsa; identical to SEQ ID NO: 119989

SEQ ID NO: 746574 - RNA, 64 nt, hsa; identical to SEQ ID NO: 119990

SEQ ID NO: 746575 - RNA, 64 nt, hsa; identical to SEQ ID NO: 119991

SEQ ID NO: 746576 - RNA, 64 nt, hsa; identical to SEQ ID NO: 119992

SEQ ID NO: 746577 - RNA, 64 nt, hsa; identical to SEQ ID NO: 119993

SEQ ID NO: 746578 - RNA, 64 nt, hsa; identical to SEQ ID NO: 119994

SEQ ID NO: 746579 - RNA, 64 nt, hsa; identical to SEQ ID NO: 119995

SEQ ID NO: 746580 - RNA, 64 nt, hsa; identical to SEQ ID NO: 119996

SEQ ID NO: 746581 - RNA, 64 nt, hsa; identical to SEQ ID NO: 119997

SEQ ID NO: 746582 - RNA, 64 nt, hsa; identical to SEQ ID NO: 119998

SEQ ID NO: 746583 - RNA, 62 nt, hsa; identical to SEQ ID NO: 119999

SEQ ID NO: 746584 - RNA, 64 nt, hsa; identical to SEQ ID NO: 120000

SEQ ID NO: 746585 - RNA, 64 nt, hsa; identical to SEQ ID NO: 120001

SEQ ID NO: 746586 - RNA, 64 nt, hsa; identical to SEQ ID NO: 120002

SEQ ID NO: 746587 - RNA, 64 nt, hsa; identical to SEQ ID NO: 120003

SEQ ID NO: 746588 - RNA, 64 nt, hsa; identical to SEQ ID NO: 120004

SEQ ID NO: 746589 - RNA, 64 nt, hsa; identical to SEQ ID NO: 120005

SEQ ID NO: 746590 - RNA, 64 nt, hsa; identical to SEQ ID NO: 120006

SEQ ID NO: 746591 - RNA, 64 nt, hsa; identical to SEQ ID NO: 120007

SEQ ID NO: 746592 - RNA, 64 nt, hsa; identical to SEQ ID NO: 120008

SEQ ID NO: 746593 - RNA, 64 nt, hsa; identical to SEQ ID NO: 46940

SEQ ID NO: 746594 - RNA, 64 nt, hsa; identical to SEQ ID NO: 46941

SEQ ID NO: 746595 - RNA, 64 nt, hsa; identical to SEQ ID NO: 46942

SEQ ID NO: 746596 - RNA, 64 nt, hsa; identical to SEQ ID NO: 46943

SEQ ID NO: 746597 - RNA, 64 nt, hsa; identical to SEQ ID NO: 46944

SEQ ID NO: 746598 - RNA, 64 nt, hsa; identical to SEQ ID NO: 46945

SEQ ID NO: 746599 - RNA, 64 nt, hsa; identical to SEQ ID NO: 46946

SEQ ID NO: 746600 - RNA, 64 nt, hsa; identical to SEQ ID NO: 46947

SEQ ID NO: 746601 - RNA, 64 nt, hsa; identical to SEQ ID NO: 46948

SEQ ID NO: 746602 - RNA, 64 nt, hsa; identical to SEQ ID NO: 46949

SEQ ID NO: 746603 - RNA, 64 nt, hsa; identical to SEQ ID NO: 46950

SEQ ID NO: 746604 - RNA, 64 nt, hsa; identical to SEQ ID NO: 46951

SEQ ID NO: 746605 - RNA, 64 nt, hsa; identical to SEQ ID NO: 46952

SEQ ID NO: 746606 - RNA, 64 nt, hsa; identical to SEQ ID NO: 46953

SEQ ID NO: 746607 - RNA, 64 nt, hsa; identical to SEQ ID NO: 46954

SEQ ID NO: 746608 - RNA, 64 nt, hsa; identical to SEQ ID NO: 46955

SEQ ID NO: 746609 - RNA, 64 nt, hsa; identical to SEQ ID NO: 46956

SEQ ID NO: 746610 - RNA, 64 nt, hsa; identical to SEQ ID NO: 46957

SEQ ID NO: 746611 - RNA, 64 nt, hsa; identical to SEQ ID NO: 46958

SEQ ID NO: 746612 - RNA, 60 nt, hsa; identical to SEQ ID NO: 46959

SEQ ID NO: 746613 - RNA, 64 nt, hsa; identical to SEQ ID NO: 46960

SEQ ID NO: 746614 - RNA, 64 nt, hsa; identical to SEQ ID NO: 46961

SEQ ID NO: 746615 - RNA, 64 nt, hsa; identical to SEQ ID NO: 46962

SEQ ID NO: 746616 - RNA, 64 nt, hsa; identical to SEQ ID NO: 46963

SEQ ID NO: 746617 - RNA, 64 nt, hsa; identical to SEQ ID NO: 46964

SEQ ID NO: 746618 - RNA, 64 nt, hsa; identical to SEQ ID NO: 46965

SEQ ID NO: 746619 - RNA, 64 nt, hsa; identical to SEQ ID NO: 46966

SEQ ID NO: 746620 - RNA, 64 nt, hsa; identical to SEQ ID NO: 46967

SEQ ID NO: 746621 - RNA, 64 nt, hsa; identical to SEQ ID NO: 46968

SEQ ID NO: 746622 - RNA, 64 nt, hsa; identical to SEQ ID NO: 46969

SEQ ID NO: 746623 - RNA, 64 nt, hsa; identical to SEQ ID NO: 46970

SEQ ID NO: 746624 - RNA, 64 nt, hsa; identical to SEQ ID NO: 46971

SEQ ID NO: 746625 - RNA, 64 nt, hsa; identical to SEQ ID NO: 46972

SEQ ID NO: 746626 - RNA, 64 nt, hsa; identical to SEQ ID NO: 46973

SEQ ID NO: 746627 - RNA, 64 nt, hsa; identical to SEQ ID NO: 46974

SEQ ID NO: 746628 - RNA, 64 nt, hsa; identical to SEQ ID NO: 46975

SEQ ID NO: 746629 - RNA, 64 nt, hsa; identical to SEQ ID NO: 46976

SEQ ID NO: 746630 - RNA, 64 nt, hsa; identical to SEQ ID NO: 46977

SEQ ID NO: 746631 - RNA, 64 nt, hsa; identical to SEQ ID NO: 46978

SEQ ID NO: 746632 - RNA, 64 nt, hsa; identical to SEQ ID NO: 46979

SEQ ID NO: 746633 - RNA, 64 nt, hsa; identical to SEQ ID NO: 46980

SEQ ID NO: 746634 - RNA, 64 nt, hsa; identical to SEQ ID NO: 46981

SEQ ID NO: 746635 - RNA, 64 nt, hsa; identical to SEQ ID NO: 46982

SEQ ID NO: 746636 - RNA, 64 nt, hsa; identical to SEQ ID NO: 46983

SEQ ID NO: 746637 - RNA, 64 nt, hsa; identical to SEQ ID NO: 46984

SEQ ID NO: 746638 - RNA, 64 nt, hsa; identical to SEQ ID NO: 46985

SEQ ID NO: 746639 - RNA, 64 nt, hsa; identical to SEQ ID NO: 46986

SEQ ID NO: 746640 - RNA, 64 nt, hsa; identical to SEQ ID NO: 46987

SEQ ID NO: 746641 - RNA, 64 nt, hsa; identical to SEQ ID NO: 46988

SEQ ID NO: 746642 - RNA, 64 nt, hsa; identical to SEQ ID NO: 46989

SEQ ID NO: 746643 - RNA, 64 nt, hsa; identical to SEQ ID NO: 46990

SEQ ID NO: 746644 - RNA, 64 nt, hsa; identical to SEQ ID NO: 46991

SEQ ID NO: 746645 - RNA, 64 nt, hsa; identical to SEQ ID NO: 46992

SEQ ID NO: 746646 - RNA, 64 nt, hsa; identical to SEQ ID NO: 46993

SEQ ID NO: 746647 - RNA, 64 nt, hsa; identical to SEQ ID NO: 46994

SEQ ID NO: 746648 - RNA, 64 nt, hsa; identical to SEQ ID NO: 46995

SEQ ID NO: 746649 - RNA, 64 nt, hsa; identical to SEQ ID NO: 46996

SEQ ID NO: 746650 - RNA, 64 nt, hsa; identical to SEQ ID NO: 46997

SEQ ID NO: 746651 - RNA, 64 nt, hsa; identical to SEQ ID NO: 46998

SEQ ID NO: 746652 - RNA, 64 nt, hsa; identical to SEQ ID NO: 46999

SEQ ID NO: 746653 - RNA, 64 nt, hsa; identical to SEQ ID NO: 47000

SEQ ID NO: 746654 - RNA, 64 nt, hsa; identical to SEQ ID NO: 110487

SEQ ID NO: 746655 - RNA, 64 nt, hsa; identical to SEQ ID NO: 110488

SEQ ID NO: 746656 - RNA, 64 nt, hsa; identical to SEQ ID NO: 110489

SEQ ID NO: 746657 - RNA, 64 nt, hsa; identical to SEQ ID NO: 110490

SEQ ID NO: 746658 - RNA, 64 nt, hsa; identical to SEQ ID NO: 110491

SEQ ID NO: 746659 - RNA, 64 nt, hsa; identical to SEQ ID NO: 110492

SEQ ID NO: 746660 - RNA, 64 nt, hsa; identical to SEQ ID NO: 110493

SEQ ID NO: 746661 - RNA, 64 nt, hsa; identical to SEQ ID NO: 110494

SEQ ID NO: 746662 - RNA, 64 nt, hsa; identical to SEQ ID NO: 110495

SEQ ID NO: 746663 - RNA, 64 nt, hsa; identical to SEQ ID NO: 110496

SEQ ID NO: 746664 - RNA, 64 nt, hsa; identical to SEQ ID NO: 110497

SEQ ID NO: 746665 - RNA, 64 nt, hsa; identical to SEQ ID NO: 110498

SEQ ID NO: 746666 - RNA, 64 nt, hsa; identical to SEQ ID NO: 110499

SEQ ID NO: 746667 - RNA, 64 nt, hsa; identical to SEQ ID NO: 110500

SEQ ID NO: 746668 - RNA, 64 nt, hsa; identical to SEQ ID NO: 110501

SEQ ID NO: 746669 - RNA, 64 nt, hsa; identical to SEQ ID NO: 110502

SEQ ID NO: 746670 - RNA, 56 nt, hsa; identical to SEQ ID NO: 110503

SEQ ID NO: 746671 - RNA, 64 nt, hsa; identical to SEQ ID NO: 110504

SEQ ID NO: 746672 - RNA, 64 nt, hsa; identical to SEQ ID NO: 110505

SEQ ID NO: 746673 - RNA, 64 nt, hsa; identical to SEQ ID NO: 110506

SEQ ID NO: 746674 - RNA, 64 nt, hsa; identical to SEQ ID NO: 110507

SEQ ID NO: 746675 - RNA, 64 nt, hsa; identical to SEQ ID NO: 110508

SEQ ID NO: 746676 - RNA, 64 nt, hsa; identical to SEQ ID NO: 110509

SEQ ID NO: 746677 - RNA, 64 nt, hsa; identical to SEQ ID NO: 110510

SEQ ID NO: 746678 - RNA, 64 nt, hsa; identical to SEQ ID NO: 110511

SEQ ID NO: 746679 - RNA, 64 nt, hsa; identical to SEQ ID NO: 110512

SEQ ID NO: 746680 - RNA, 64 nt, hsa; identical to SEQ ID NO: 110513

SEQ ID NO: 746681 - RNA, 64 nt, hsa; identical to SEQ ID NO: 110514

SEQ ID NO: 746682 - RNA, 64 nt, hsa; identical to SEQ ID NO: 110515

SEQ ID NO: 746683 - RNA, 64 nt, hsa; identical to SEQ ID NO: 110516

SEQ ID NO: 746684 - RNA, 64 nt, hsa; identical to SEQ ID NO: 110517

SEQ ID NO: 746685 - RNA, 64 nt, hsa; identical to SEQ ID NO: 110518

SEQ ID NO: 746686 - RNA, 64 nt, hsa; identical to SEQ ID NO: 110519

SEQ ID NO: 746687 - RNA, 64 nt, hsa; identical to SEQ ID NO: 110520

SEQ ID NO: 746688 - RNA, 64 nt, hsa; identical to SEQ ID NO: 110521

SEQ ID NO: 746689 - RNA, 64 nt, hsa; identical to SEQ ID NO: 110522

SEQ ID NO: 746690 - RNA, 64 nt, hsa; identical to SEQ ID NO: 110523

SEQ ID NO: 746691 - RNA, 64 nt, hsa; identical to SEQ ID NO: 225898

SEQ ID NO: 746692 - RNA, 64 nt, hsa; identical to SEQ ID NO: 225899

SEQ ID NO: 746693 - RNA, 64 nt, hsa
gccgguuguaagccuugcacgggacagaccacacccaccgcaaccucauccccucagcacuaac

SEQ ID NO: 746694 - RNA, 64 nt, hsa
cagccucccaaguagcugggauaacaggcgcccaccaccgcacccugcuaauuuuuuguauuuu

SEQ ID NO: 746695 - RNA, 64 nt, hsa; identical to SEQ ID NO: 534306

SEQ ID NO: 746696 - RNA, 64 nt, hsa; identical to SEQ ID NO: 534307

SEQ ID NO: 746697 - RNA, 64 nt, hsa; identical to SEQ ID NO: 534308

SEQ ID NO: 746698 - RNA, 64 nt, hsa; identical to SEQ ID NO: 534309

SEQ ID NO: 746699 - RNA, 64 nt, hsa; identical to SEQ ID NO: 534310

SEQ ID NO: 746700 - RNA, 64 nt, hsa; identical to SEQ ID NO: 534311

SEQ ID NO: 746701 - RNA, 64 nt, hsa; identical to SEQ ID NO: 534312

SEQ ID NO: 746702 - RNA, 64 nt, hsa; identical to SEQ ID NO: 534313

SEQ ID NO: 746703 - RNA, 64 nt, hsa; identical to SEQ ID NO: 534314

SEQ ID NO: 746704 - RNA, 64 nt, hsa; identical to SEQ ID NO: 534315

SEQ ID NO: 746705 - RNA, 64 nt, hsa; identical to SEQ ID NO: 534316

SEQ ID NO: 746706 - RNA, 64 nt, hsa; identical to SEQ ID NO: 534317

SEQ ID NO: 746707 - RNA, 64 nt, hsa; identical to SEQ ID NO: 534318

SEQ ID NO: 746708 - RNA, 64 nt, hsa; identical to SEQ ID NO: 534319

SEQ ID NO: 746709 - RNA, 64 nt, hsa; identical to SEQ ID NO: 534320

SEQ ID NO: 746710 - RNA, 64 nt, hsa; identical to SEQ ID NO: 534321

SEQ ID NO: 746711 - RNA, 64 nt, hsa; identical to SEQ ID NO: 534322

SEQ ID NO: 746712 - RNA, 64 nt, hsa; identical to SEQ ID NO: 534323

SEQ ID NO: 746713 - RNA, 64 nt, hsa; identical to SEQ ID NO: 534324

SEQ ID NO: 746714 - RNA, 64 nt, hsa; identical to SEQ ID NO: 534325

SEQ ID NO: 746715 - RNA, 64 nt, hsa; identical to SEQ ID NO: 534326

SEQ ID NO: 746716 - RNA, 64 nt, hsa; identical to SEQ ID NO: 534327

SEQ ID NO: 746717 - RNA, 64 nt, hsa; identical to SEQ ID NO: 534328

SEQ ID NO: 746718 - RNA, 64 nt, hsa; identical to SEQ ID NO: 534329

SEQ ID NO: 746719 - RNA, 64 nt, hsa; identical to SEQ ID NO: 534330

SEQ ID NO: 746720 - RNA, 64 nt, hsa; identical to SEQ ID NO: 534331

SEQ ID NO: 746721 - RNA, 64 nt, hsa; identical to SEQ ID NO: 534332

SEQ ID NO: 746722 - RNA, 64 nt, hsa; identical to SEQ ID NO: 534333

SEQ ID NO: 746723 - RNA, 64 nt, hsa; identical to SEQ ID NO: 534334

SEQ ID NO: 746724 - RNA, 64 nt, hsa; identical to SEQ ID NO: 188813

SEQ ID NO: 746725 - RNA, 64 nt, hsa; identical to SEQ ID NO: 188814

SEQ ID NO: 746726 - RNA, 64 nt, hsa; identical to SEQ ID NO: 188815

SEQ ID NO: 746727 - RNA, 64 nt, hsa; identical to SEQ ID NO: 188816

SEQ ID NO: 746728 - RNA, 64 nt, hsa
guagaacacugagcaggacaacugaccugucuccuucacauaguccauaucaccacaaaucaca

SEQ ID NO: 746729 - RNA, 64 nt, hsa
cugaagacaauggacccacguuaggugugacacguucacauaacugugcagcacaugccgggag

SEQ ID NO: 746730 - RNA, 64 nt, hsa
guggcauuaagucuugcuuugguuaaagccuuauuucacauaauugcuaaaaacucauuuuugu

SEQ ID NO: 746731 - RNA, 64 nt, hsa
uaucagauuuacagauuuucuuugacuaauuuuuuucacauaacuuuaggauuuucgaaaguug

SEQ ID NO: 746732 - RNA, 64 nt, hsa
agaaguuauguuuuaaauaucucuguuuuaggaguucacauauaguucagcauuuauuguuuag

SEQ ID NO: 746733 - RNA, 64 nt, hsa
agagaauaaaauauguauuuaaauuuuugguguguucacauaaagggauguagcuaaaauguuu

SEQ ID NO: 746734 - RNA, 64 nt, hsa
auaaguauagauuuuaaagauaugggacuuuauuuucacauaagucaauagauguuucucuaga

SEQ ID NO: 746735 - RNA, 64 nt, hsa
uuagcaugccccuguucuuccuaacuuguaaaauuucacauaaauauauuuucaauuguguaca

SEQ ID NO: 746736 - RNA, 64 nt, hsa
aaccacugaacauuugcuuuguuuucuaaaguuguucacauauauguaauuuagcaguccaaag

SEQ ID NO: 746737 - RNA, 64 nt, hsa
uuugcuuugcuuuuuaauugaggacagccugguuuucacauacacucaaacaaucaugagucag

SEQ ID NO: 746738 - RNA, 64 nt, hsa
uucauauuuucacaugacguaaaauuuuaugugcuucacauaauuguauuuuagcaggguacau

SEQ ID NO: 746739 - RNA, 64 nt, hsa
aaccacccccuucuuuuuuguuguuguggguuuuuucacauaaacacauacauugccaauuuuc

SEQ ID NO: 746740 - RNA, 64 nt, hsa
augaaauuaaaucaaacuguuauuuuuauagcucuucacauauuaaaaagagcuuucauguaca

SEQ ID NO: 746741 - RNA, 64 nt, hsa
gagucuuugaccuuuugaacaagagaaugccauguucacauaagcaaaucguugcaagugauaa

SEQ ID NO: 746742 - RNA, 64 nt, hsa
uauaacccuaggaauuuagacaaccugaaauuuauucacauauaucaaagugagaaaaugccuc

SEQ ID NO: 746743 - RNA, 64 nt, hsa
uauucacauauaucaaagugagaaaaugccucaauucacauagauuucuucucuuuaguauaau

SEQ ID NO: 746744 - RNA, 64 nt, hsa
auagaaacauguuaaaguugguuaggaucauaucuucacauauggcccuuucugaaucaaagug

SEQ ID NO: 746745 - RNA, 64 nt, hsa
cucuugcaauuucuguugugauaguaccaucucuuucacauacuacauacaaauucccuaauaa

SEQ ID NO: 746746 - RNA, 64 nt, hsa
gaugaaauagccauggcuuauauauuuuugucuuuucacauaugauguguuuggaacccaaauu

SEQ ID NO: 746747 - RNA, 64 nt, hsa
gagguuauguccugucagggaaccagccccgauauucacauagguucuuuucuauuuucccuaa

SEQ ID NO: 746748 - RNA, 64 nt, hsa
cggucggucuccccccuccccgcccccuucucuuuucacauacagucacauugagguuuggaac

SEQ ID NO: 746749 - RNA, 64 nt, hsa
uucagacacuuguuaccauauuuuaaaaucuggcuucacauacacagagucuuugcuaugcacc

SEQ ID NO: 746750 - RNA, 64 nt, hsa
gacagacuuggucuugugagguuccaguccuuguuucacauaauaaacacuggcauggcucagc

SEQ ID NO: 746751 - RNA, 64 nt, hsa; identical to SEQ ID NO: 409645

SEQ ID NO: 746752 - RNA, 64 nt, hsa; identical to SEQ ID NO: 409646

SEQ ID NO: 746753 - RNA, 64 nt, hsa; identical to SEQ ID NO: 409647

SEQ ID NO: 746754 - RNA, 64 nt, hsa; identical to SEQ ID NO: 409648

SEQ ID NO: 746755 - RNA, 64 nt, hsa; identical to SEQ ID NO: 409649

SEQ ID NO: 746756 - RNA, 64 nt, hsa; identical to SEQ ID NO: 409650

SEQ ID NO: 746757 - RNA, 64 nt, hsa; identical to SEQ ID NO: 648080

SEQ ID NO: 746758 - RNA, 64 nt, hsa; identical to SEQ ID NO: 648081

SEQ ID NO: 746759 - RNA, 64 nt, hsa; identical to SEQ ID NO: 648082

SEQ ID NO: 746760 - RNA, 64 nt, hsa; identical to SEQ ID NO: 648083

SEQ ID NO: 746761 - RNA, 64 nt, hsa; identical to SEQ ID NO: 648084

SEQ ID NO: 746762 - RNA, 64 nt, hsa; identical to SEQ ID NO: 648085

SEQ ID NO: 746763 - RNA, 64 nt, hsa; identical to SEQ ID NO: 648086

SEQ ID NO: 746764 - RNA, 64 nt, hsa; identical to SEQ ID NO: 648087

SEQ ID NO: 746765 - RNA, 57 nt, hsa; identical to SEQ ID NO: 130560

SEQ ID NO: 746766 - RNA, 64 nt, hsa; identical to SEQ ID NO: 130561

SEQ ID NO: 746767 - RNA, 64 nt, hsa; identical to SEQ ID NO: 130562

SEQ ID NO: 746768 - RNA, 64 nt, hsa; identical to SEQ ID NO: 130563

SEQ ID NO: 746769 - RNA, 64 nt, hsa; identical to SEQ ID NO: 130564

SEQ ID NO: 746770 - RNA, 64 nt, hsa; identical to SEQ ID NO: 130565

SEQ ID NO: 746771 - RNA, 64 nt, hsa; identical to SEQ ID NO: 130566

SEQ ID NO: 746772 - RNA, 64 nt, hsa; identical to SEQ ID NO: 130567

SEQ ID NO: 746773 - RNA, 64 nt, hsa; identical to SEQ ID NO: 130568

SEQ ID NO: 746774 - RNA, 64 nt, hsa; identical to SEQ ID NO: 130569

SEQ ID NO: 746775 - RNA, 64 nt, hsa; identical to SEQ ID NO: 130570

SEQ ID NO: 746776 - RNA, 64 nt, hsa; identical to SEQ ID NO: 130571

SEQ ID NO: 746777 - RNA, 64 nt, hsa; identical to SEQ ID NO: 130572

SEQ ID NO: 746778 - RNA, 64 nt, hsa; identical to SEQ ID NO: 130573

SEQ ID NO: 746779 - RNA, 64 nt, hsa; identical to SEQ ID NO: 130574

SEQ ID NO: 746780 - RNA, 64 nt, hsa; identical to SEQ ID NO: 130575

SEQ ID NO: 746781 - RNA, 64 nt, hsa; identical to SEQ ID NO: 130576

SEQ ID NO: 746782 - RNA, 64 nt, hsa; identical to SEQ ID NO: 130577

SEQ ID NO: 746783 - RNA, 64 nt, hsa; identical to SEQ ID NO: 130578

SEQ ID NO: 746784 - RNA, 64 nt, hsa; identical to SEQ ID NO: 130579

SEQ ID NO: 746785 - RNA, 64 nt, hsa; identical to SEQ ID NO: 130580

SEQ ID NO: 746786 - RNA, 64 nt, hsa; identical to SEQ ID NO: 130581

SEQ ID NO: 746787 - RNA, 64 nt, hsa; identical to SEQ ID NO: 130582

SEQ ID NO: 746788 - RNA, 64 nt, hsa; identical to SEQ ID NO: 130583

SEQ ID NO: 746789 - RNA, 64 nt, hsa; identical to SEQ ID NO: 130584

SEQ ID NO: 746790 - RNA, 64 nt, hsa; identical to SEQ ID NO: 130585

SEQ ID NO: 746791 - RNA, 64 nt, hsa; identical to SEQ ID NO: 130586

SEQ ID NO: 746792 - RNA, 64 nt, hsa; identical to SEQ ID NO: 130587

SEQ ID NO: 746793 - RNA, 64 nt, hsa; identical to SEQ ID NO: 130588

SEQ ID NO: 746794 - RNA, 64 nt, hsa; identical to SEQ ID NO: 130589

SEQ ID NO: 746795 - RNA, 64 nt, hsa; identical to SEQ ID NO: 130590

SEQ ID NO: 746796 - RNA, 64 nt, hsa; identical to SEQ ID NO: 130591

SEQ ID NO: 746797 - RNA, 64 nt, hsa; identical to SEQ ID NO: 130592

SEQ ID NO: 746798 - RNA, 64 nt, hsa; identical to SEQ ID NO: 130593

SEQ ID NO: 746799 - RNA, 64 nt, hsa; identical to SEQ ID NO: 130594

SEQ ID NO: 746800 - RNA, 64 nt, hsa; identical to SEQ ID NO: 130595

SEQ ID NO: 746801 - RNA, 64 nt, hsa; identical to SEQ ID NO: 130596

SEQ ID NO: 746802 - RNA, 64 nt, hsa; identical to SEQ ID NO: 130597

SEQ ID NO: 746803 - RNA, 64 nt, hsa; identical to SEQ ID NO: 130598

SEQ ID NO: 746804 - RNA, 64 nt, hsa; identical to SEQ ID NO: 130599

SEQ ID NO: 746805 - RNA, 64 nt, hsa; identical to SEQ ID NO: 130600

SEQ ID NO: 746806 - RNA, 64 nt, hsa; identical to SEQ ID NO: 130601

SEQ ID NO: 746807 - RNA, 64 nt, hsa; identical to SEQ ID NO: 130602

SEQ ID NO: 746808 - RNA, 64 nt, hsa; identical to SEQ ID NO: 130603

SEQ ID NO: 746809 - RNA, 64 nt, hsa; identical to SEQ ID NO: 130604

SEQ ID NO: 746810 - RNA, 64 nt, hsa; identical to SEQ ID NO: 130605

SEQ ID NO: 746811 - RNA, 64 nt, hsa; identical to SEQ ID NO: 130606

SEQ ID NO: 746812 - RNA, 64 nt, hsa; identical to SEQ ID NO: 130607

SEQ ID NO: 746813 - RNA, 64 nt, hsa; identical to SEQ ID NO: 130608

SEQ ID NO: 746814 - RNA, 64 nt, hsa; identical to SEQ ID NO: 130609

SEQ ID NO: 746815 - RNA, 64 nt, hsa; identical to SEQ ID NO: 130610

SEQ ID NO: 746816 - RNA, 64 nt, hsa; identical to SEQ ID NO: 130611

SEQ ID NO: 746817 - RNA, 64 nt, hsa; identical to SEQ ID NO: 276360

SEQ ID NO: 746818 - RNA, 64 nt, hsa; identical to SEQ ID NO: 276361

SEQ ID NO: 746819 - RNA, 64 nt, hsa; identical to SEQ ID NO: 276362

SEQ ID NO: 746820 - RNA, 64 nt, hsa; identical to SEQ ID NO: 276363

SEQ ID NO: 746821 - RNA, 64 nt, hsa; identical to SEQ ID NO: 276364

SEQ ID NO: 746822 - RNA, 64 nt, hsa; identical to SEQ ID NO: 276365

SEQ ID NO: 746823 - RNA, 64 nt, hsa; identical to SEQ ID NO: 276366

SEQ ID NO: 746824 - RNA, 64 nt, hsa; identical to SEQ ID NO: 276367

SEQ ID NO: 746825 - RNA, 64 nt, hsa; identical to SEQ ID NO: 276368

SEQ ID NO: 746826 - RNA, 64 nt, hsa; identical to SEQ ID NO: 276369

SEQ ID NO: 746827 - RNA, 64 nt, hsa; identical to SEQ ID NO: 276370

SEQ ID NO: 746828 - RNA, 64 nt, hsa; identical to SEQ ID NO: 276371

SEQ ID NO: 746829 - RNA, 64 nt, hsa; identical to SEQ ID NO: 276372

SEQ ID NO: 746830 - RNA, 64 nt, hsa; identical to SEQ ID NO: 276373

SEQ ID NO: 746831 - RNA, 64 nt, hsa; identical to SEQ ID NO: 276374

SEQ ID NO: 746832 - RNA, 64 nt, hsa; identical to SEQ ID NO: 276375

SEQ ID NO: 746833 - RNA, 64 nt, hsa; identical to SEQ ID NO: 276376

SEQ ID NO: 746834 - RNA, 64 nt, hsa; identical to SEQ ID NO: 276377

SEQ ID NO: 746835 - RNA, 64 nt, hsa; identical to SEQ ID NO: 276378

SEQ ID NO: 746836 - RNA, 64 nt, hsa; identical to SEQ ID NO: 118026

SEQ ID NO: 746837 - RNA, 64 nt, hsa; identical to SEQ ID NO: 118027

SEQ ID NO: 746838 - RNA, 64 nt, hsa; identical to SEQ ID NO: 118028

SEQ ID NO: 746839 - RNA, 64 nt, hsa; identical to SEQ ID NO: 118029

SEQ ID NO: 746840 - RNA, 64 nt, hsa; identical to SEQ ID NO: 118030

SEQ ID NO: 746841 - RNA, 64 nt, hsa; identical to SEQ ID NO: 118031

SEQ ID NO: 746842 - RNA, 64 nt, hsa; identical to SEQ ID NO: 118032

SEQ ID NO: 746843 - RNA, 64 nt, hsa; identical to SEQ ID NO: 118033

SEQ ID NO: 746844 - RNA, 64 nt, hsa; identical to SEQ ID NO: 118034

SEQ ID NO: 746845 - RNA, 64 nt, hsa; identical to SEQ ID NO: 118035

SEQ ID NO: 746846 - RNA, 64 nt, hsa; identical to SEQ ID NO: 118036

SEQ ID NO: 746847 - RNA, 64 nt, hsa; identical to SEQ ID NO: 118037

SEQ ID NO: 746848 - RNA, 64 nt, hsa; identical to SEQ ID NO: 118038

SEQ ID NO: 746849 - RNA, 64 nt, hsa; identical to SEQ ID NO: 118039

SEQ ID NO: 746850 - RNA, 64 nt, hsa; identical to SEQ ID NO: 118040

SEQ ID NO: 746851 - RNA, 64 nt, hsa; identical to SEQ ID NO: 118041

SEQ ID NO: 746852 - RNA, 64 nt, hsa; identical to SEQ ID NO: 118042

SEQ ID NO: 746853 - RNA, 64 nt, hsa; identical to SEQ ID NO: 118043

SEQ ID NO: 746854 - RNA, 64 nt, hsa; identical to SEQ ID NO: 118044

SEQ ID NO: 746855 - RNA, 64 nt, hsa; identical to SEQ ID NO: 118045

SEQ ID NO: 746856 - RNA, 64 nt, hsa; identical to SEQ ID NO: 118046

SEQ ID NO: 746857 - RNA, 64 nt, hsa; identical to SEQ ID NO: 118047

SEQ ID NO: 746858 - RNA, 64 nt, hsa; identical to SEQ ID NO: 118048

SEQ ID NO: 746859 - RNA, 64 nt, hsa; identical to SEQ ID NO: 118049

SEQ ID NO: 746860 - RNA, 64 nt, hsa; identical to SEQ ID NO: 118050

SEQ ID NO: 746861 - RNA, 64 nt, hsa; identical to SEQ ID NO: 118051

SEQ ID NO: 746862 - RNA, 64 nt, hsa; identical to SEQ ID NO: 118052

SEQ ID NO: 746863 - RNA, 64 nt, hsa; identical to SEQ ID NO: 118053

SEQ ID NO: 746864 - RNA, 64 nt, hsa; identical to SEQ ID NO: 118054

SEQ ID NO: 746865 - RNA, 64 nt, hsa; identical to SEQ ID NO: 118055

SEQ ID NO: 746866 - RNA, 64 nt, hsa; identical to SEQ ID NO: 118056

SEQ ID NO: 746867 - RNA, 64 nt, hsa; identical to SEQ ID NO: 118057

SEQ ID NO: 746868 - RNA, 64 nt, hsa; identical to SEQ ID NO: 118058

SEQ ID NO: 746869 - RNA, 64 nt, hsa; identical to SEQ ID NO: 118059

SEQ ID NO: 746870 - RNA, 64 nt, hsa; identical to SEQ ID NO: 118060

SEQ ID NO: 746871 - RNA, 64 nt, hsa; identical to SEQ ID NO: 118061

SEQ ID NO: 746872 - RNA, 64 nt, hsa; identical to SEQ ID NO: 118062

SEQ ID NO: 746873 - RNA, 64 nt, hsa; identical to SEQ ID NO: 118063

SEQ ID NO: 746874 - RNA, 64 nt, hsa; identical to SEQ ID NO: 118064

SEQ ID NO: 746875 - RNA, 64 nt, hsa; identical to SEQ ID NO: 118065

SEQ ID NO: 746876 - RNA, 64 nt, hsa; identical to SEQ ID NO: 118066

SEQ ID NO: 746877 - RNA, 62 nt, hsa
uuauuauugguuauauacuguccauagucuccugucccuacaucauggaucauguccaccuu

SEQ ID NO: 746878 - RNA, 62 nt, hsa
cucuuagaggguggcaaaaugccuuugcccagugucccuauuuuaggcaucuuuuccuuccu

SEQ ID NO: 746879 - RNA, 64 nt, hsa; identical to SEQ ID NO: 692395

SEQ ID NO: 746880 - RNA, 64 nt, hsa; identical to SEQ ID NO: 692396

SEQ ID NO: 746881 - RNA, 64 nt, hsa; identical to SEQ ID NO: 692397

SEQ ID NO: 746882 - RNA, 64 nt, hsa; identical to SEQ ID NO: 692398

SEQ ID NO: 746883 - RNA, 64 nt, hsa; identical to SEQ ID NO: 692399

SEQ ID NO: 746884 - RNA, 64 nt, hsa; identical to SEQ ID NO: 692400

SEQ ID NO: 746885 - RNA, 64 nt, hsa; identical to SEQ ID NO: 692401

SEQ ID NO: 746886 - RNA, 64 nt, hsa; identical to SEQ ID NO: 692402

SEQ ID NO: 746887 - RNA, 64 nt, hsa; identical to SEQ ID NO: 692403

SEQ ID NO: 746888 - RNA, 64 nt, hsa; identical to SEQ ID NO: 692404

SEQ ID NO: 746889 - RNA, 64 nt, hsa; identical to SEQ ID NO: 692405

SEQ ID NO: 746890 - RNA, 64 nt, hsa; identical to SEQ ID NO: 692406

SEQ ID NO: 746891 - RNA, 64 nt, hsa; identical to SEQ ID NO: 692407

SEQ ID NO: 746892 - RNA, 64 nt, hsa; identical to SEQ ID NO: 692408

SEQ ID NO: 746893 - RNA, 64 nt, hsa; identical to SEQ ID NO: 692409

SEQ ID NO: 746894 - RNA, 64 nt, hsa; identical to SEQ ID NO: 692410

SEQ ID NO: 746895 - RNA, 64 nt, hsa; identical to SEQ ID NO: 692411

SEQ ID NO: 746896 - RNA, 64 nt, hsa; identical to SEQ ID NO: 692412

SEQ ID NO: 746897 - RNA, 64 nt, hsa; identical to SEQ ID NO: 692413

SEQ ID NO: 746898 - RNA, 64 nt, hsa; identical to SEQ ID NO: 692414

SEQ ID NO: 746899 - RNA, 64 nt, hsa; identical to SEQ ID NO: 692415

SEQ ID NO: 746900 - RNA, 64 nt, hsa; identical to SEQ ID NO: 692416

SEQ ID NO: 746901 - RNA, 64 nt, hsa; identical to SEQ ID NO: 692417

SEQ ID NO: 746902 - RNA, 64 nt, hsa; identical to SEQ ID NO: 692418

SEQ ID NO: 746903 - RNA, 64 nt, hsa; identical to SEQ ID NO: 692419

SEQ ID NO: 746904 - RNA, 64 nt, hsa; identical to SEQ ID NO: 692420

SEQ ID NO: 746905 - RNA, 64 nt, hsa; identical to SEQ ID NO: 692421

SEQ ID NO: 746906 - RNA, 64 nt, hsa; identical to SEQ ID NO: 692422

SEQ ID NO: 746907 - RNA, 64 nt, hsa; identical to SEQ ID NO: 692423

SEQ ID NO: 746908 - RNA, 64 nt, hsa; identical to SEQ ID NO: 692424

SEQ ID NO: 746909 - RNA, 64 nt, hsa; identical to SEQ ID NO: 692425

SEQ ID NO: 746910 - RNA, 64 nt, hsa; identical to SEQ ID NO: 692426

SEQ ID NO: 746911 - RNA, 64 nt, hsa; identical to SEQ ID NO: 692427

SEQ ID NO: 746912 - RNA, 64 nt, hsa; identical to SEQ ID NO: 692428

SEQ ID NO: 746913 - RNA, 64 nt, hsa; identical to SEQ ID NO: 692429

SEQ ID NO: 746914 - RNA, 64 nt, hsa; identical to SEQ ID NO: 692430

SEQ ID NO: 746915 - RNA, 64 nt, hsa; identical to SEQ ID NO: 692431

SEQ ID NO: 746916 - RNA, 64 nt, hsa; identical to SEQ ID NO: 692432

SEQ ID NO: 746917 - RNA, 64 nt, hsa; identical to SEQ ID NO: 692433

SEQ ID NO: 746918 - RNA, 63 nt, hsa
ugacuaauggugucacugcuggcaauggugauaauggauuaauuccucaaaggaagagcagaa

SEQ ID NO: 746919 - RNA, 63 nt, hsa
ugacuaauggugccacugcuggcaauggugaugauggauuaauuccuccaaggaagagcagaa

SEQ ID NO: 746920 - RNA, 63 nt, hsa
aaagugucacauauuagaaugcugaccuuucauauggauuauugugagucaucagaguuuauu

SEQ ID NO: 746921 - RNA, 63 nt, hsa
cucgugucaguagccuugugacacugaaccuggauggauuauagaggagcccucacggcugau

SEQ ID NO: 746922 - RNA, 63 nt, hsa
aaugagguuuuuugcauuccaaggaaauggcauauggauuaacuguaagaaaugaaauaagua

SEQ ID NO: 746923 - RNA, 63 nt, hsa
aucagcugccucucgaauggaagaacagugguaauggauuaacauccuauuuuguuguacuaa

SEQ ID NO: 746924 - RNA, 63 nt, hsa
guuuguugucuuauuugugguggcacucguuuaauggauuaacugagguugcucaauguucag

SEQ ID NO: 746925 - RNA, 63 nt, hsa
uuacuuagaugccagucuacuuuauaaagacaaauggauuauagacuuaaaaauagucauuuu

SEQ ID NO: 746926 - RNA, 63 nt, hsa
gccuuugucagaaaguauucucacaauuaugagauggauuauaauaaaauacuuaaauuugug

SEQ ID NO: 746927 - RNA, 63 nt, hsa
gccgagaauggucagaaagaucaguacaaccccauggauuaggcugaaacauaugaaauugcu

SEQ ID NO: 746928 - RNA, 63 nt, hsa
auuacauuuaucugaagaaaauaguacaacuuaauggauuagcuuuuggguuuaacugaauau

SEQ ID NO: 746929 - RNA, 63 nt, hsa
uaaaaauaagauauuugggguauauucaagugcauggauuaguuuuccugacaaagcauguuu

SEQ ID NO: 746930 - RNA, 63 nt, hsa
augguaucugcugcaaacaugaguagauccaugauggauuaauaaagcuugcugaaaaaaaaa

SEQ ID NO: 746931 - RNA, 63 nt, hsa
ggugauugggccaugaggucugugcccuccugaauggauuaauccauucauggauuaauggau

SEQ ID NO: 746932 - RNA, 63 nt, hsa
ggucugugcccuccugaauggauuaauccauucauggauuaauggauuauuaugaguggggga

SEQ ID NO: 746933 - RNA, 63 nt, hsa
cccuccugaauggauuaauccauucauggauuaauggauuauuaugagugggggacuggugac

SEQ ID NO: 746934 - RNA, 64 nt, hsa; identical to SEQ ID NO: 472962

SEQ ID NO: 746935 - RNA, 55 nt, hsa; identical to SEQ ID NO: 472963

SEQ ID NO: 746936 - RNA, 64 nt, hsa; identical to SEQ ID NO: 472964

SEQ ID NO: 746937 - RNA, 64 nt, hsa; identical to SEQ ID NO: 472965

SEQ ID NO: 746938 - RNA, 64 nt, hsa; identical to SEQ ID NO: 472966

SEQ ID NO: 746939 - RNA, 64 nt, hsa; identical to SEQ ID NO: 472967

SEQ ID NO: 746940 - RNA, 64 nt, hsa; identical to SEQ ID NO: 472968

SEQ ID NO: 746941 - RNA, 64 nt, hsa; identical to SEQ ID NO: 472969

SEQ ID NO: 746942 - RNA, 64 nt, hsa; identical to SEQ ID NO: 472970

SEQ ID NO: 746943 - RNA, 64 nt, hsa; identical to SEQ ID NO: 472971

SEQ ID NO: 746944 - RNA, 62 nt, hsa
gagacauguuugaugacuacguccgaacccguacgcugcacaacuggaaguucuggguggua

SEQ ID NO: 746945 - RNA, 62 nt, hsa
ccugguggcgucugcaggugagcaaagcuaccacgcugcagaagacagcugaguacauccuu

SEQ ID NO: 746946 - RNA, 62 nt, hsa
uuccuccuuuccauccuguuaaccacagugaaacgcugcaguauuuugauuuggucagugcu

SEQ ID NO: 746947 - RNA, 62 nt, hsa
uccuucuucagcagcaccucacagucagucagacgcugcaggcaccacuaucaccaggagug

SEQ ID NO: 746948 - RNA, 62 nt, hsa
aagaggcagaaaaguugguuugguuugcaguaacgcugcaacuagaaaauauaugcacuuca

SEQ ID NO: 746949 - RNA, 62 nt, hsa
uucugaaagccggcgcugcagccagaggccgcacgcugcacugucgcgacgcagagaggcuu

SEQ ID NO: 746950 - RNA, 64 nt, hsa
cgcuggaguuauuugacucgacuugcccagggucccaggucagugcuccucaaaccugaacaug

SEQ ID NO: 746951 - RNA, 64 nt, hsa
guggggcccagccauuuggcuuuucacaaguucuccaggucauucuugggcacgaucaaauuug

SEQ ID NO: 746952 - RNA, 64 nt, hsa
acgucggaucccgugggccucacaugccaggucaccaggucaccgucuccuuccaccccugcag

SEQ ID NO: 746953 - RNA, 64 nt, hsa
gcagggacacgucggaucccgugggccucacaugccaggucaccaggucaccgucuccuuccac

SEQ ID NO: 746954 - RNA, 64 nt, hsa
ugccuggugcacagugcuuagaaguaagcaauucccaggucauagcucaagaauuguuagcaaa

SEQ ID NO: 746955 - RNA, 64 nt, hsa
uaaaccuuugaguagagucucccuggaucacauaccaggucagggaggaucuguucuuccucua

SEQ ID NO: 746956 - RNA, 64 nt, hsa
uggaaccggccuggacuccucuucccaacuuccuccaggucauuucccagugugagcacaaugc

SEQ ID NO: 746957 - RNA, 64 nt, hsa
uguuauaagaggcgugggcuccccugguggcugaccaggucagcugcccuggccuugcaccccu

SEQ ID NO: 746958 - RNA, 64 nt, hsa
ucucacacuccacugcccaauagugaccucacuuccaggucaaggucuggcgucccaaaugaaa

SEQ ID NO: 746959 - RNA, 64 nt, hsa
gcucuuguugugcccccuucaagcccagauugugccaggucagcugucccuuccucuggccacc

SEQ ID NO: 746960 - RNA, 64 nt, hsa
agccgaggugcucagaaaggcucgguaaugagucccaggucauacggcuagcgaguggcgggcc

SEQ ID NO: 746961 - RNA, 64 nt, hsa
cugcauccagucuguguccuccugucuuucucauccaggucaggcauugacacuuuguaagaaa

SEQ ID NO: 746962 - RNA, 64 nt, hsa
cagauauaaaacuagcugccaacccagccuguggccaggucacugucuaccccagcccagccca

SEQ ID NO: 746963 - RNA, 64 nt, hsa
cauauuuccccuuggacacuugguuagacgccuuccaggucaggaugcacauuucuggauugug

SEQ ID NO: 746964 - RNA, 64 nt, hsa
caauuaacaucgugggucacuacagggagaaaauccaggucaugcaguuccuggcccaucaacu

SEQ ID NO: 746965 - RNA, 64 nt, hsa
ggggaggaaagccaccuugacagcccaggucccuccaggucacccacagccaguuucaggaagg

SEQ ID NO: 746966 - RNA, 64 nt, hsa
gcaacuguguuaccuuucaaguuuaucucaauaaccaggucaucagggacccauuguucucuuc

SEQ ID NO: 746967 - RNA, 64 nt, hsa
ugcucugcgggacaguccccacggccagcgacguccaggucaccaaugggauucuuuuugcucu

SEQ ID NO: 746968 - RNA, 64 nt, hsa
guagcgauagauauuuggacaucaaauuuggacaccaggucacggagaaacacaaacaccaccc

SEQ ID NO: 746969 - RNA, 64 nt, hsa
uguuuuagaagggagguggcagcauugagggaaaccaggucaccauccacccucguaacaacag

SEQ ID NO: 746970 - RNA, 64 nt, hsa
uaggcuggagugaaaguggcgcaaccucugccucccaggucaaagcaauccugccucaggcccc

SEQ ID NO: 746971 - RNA, 64 nt, hsa
augagcucacaaaaugaaucccuaugcuuaaugaccaggucacauaaaauccagcccacuuaca

SEQ ID NO: 746972 - RNA, 64 nt, hsa
ugcccccacaccccauccccagcuagcccaagcuccaggucaggaggggagggugcugggccug

SEQ ID NO: 746973 - RNA, 64 nt, hsa; identical to SEQ ID NO: 49935

SEQ ID NO: 746974 - RNA, 64 nt, hsa; identical to SEQ ID NO: 49936

SEQ ID NO: 746975 - RNA, 64 nt, hsa; identical to SEQ ID NO: 49937

SEQ ID NO: 746976 - RNA, 64 nt, hsa; identical to SEQ ID NO: 49938

SEQ ID NO: 746977 - RNA, 64 nt, hsa; identical to SEQ ID NO: 49939

SEQ ID NO: 746978 - RNA, 64 nt, hsa; identical to SEQ ID NO: 49940

SEQ ID NO: 746979 - RNA, 64 nt, hsa; identical to SEQ ID NO: 49941

SEQ ID NO: 746980 - RNA, 64 nt, hsa; identical to SEQ ID NO: 49942

SEQ ID NO: 746981 - RNA, 64 nt, hsa; identical to SEQ ID NO: 49943

SEQ ID NO: 746982 - RNA, 64 nt, hsa; identical to SEQ ID NO: 49944

SEQ ID NO: 746983 - RNA, 64 nt, hsa; identical to SEQ ID NO: 49945

SEQ ID NO: 746984 - RNA, 64 nt, hsa; identical to SEQ ID NO: 49946

SEQ ID NO: 746985 - RNA, 64 nt, hsa; identical to SEQ ID NO: 49947

SEQ ID NO: 746986 - RNA, 64 nt, hsa; identical to SEQ ID NO: 49948

SEQ ID NO: 746987 - RNA, 64 nt, hsa; identical to SEQ ID NO: 49949

SEQ ID NO: 746988 - RNA, 64 nt, hsa; identical to SEQ ID NO: 49950

SEQ ID NO: 746989 - RNA, 64 nt, hsa; identical to SEQ ID NO: 49951

SEQ ID NO: 746990 - RNA, 64 nt, hsa; identical to SEQ ID NO: 49952

SEQ ID NO: 746991 - RNA, 64 nt, hsa; identical to SEQ ID NO: 49953

SEQ ID NO: 746992 - RNA, 64 nt, hsa; identical to SEQ ID NO: 49954

SEQ ID NO: 746993 - RNA, 64 nt, hsa; identical to SEQ ID NO: 49955

SEQ ID NO: 746994 - RNA, 64 nt, hsa; identical to SEQ ID NO: 49956

SEQ ID NO: 746995 - RNA, 64 nt, hsa; identical to SEQ ID NO: 49957

SEQ ID NO: 746996 - RNA, 64 nt, hsa; identical to SEQ ID NO: 49958

SEQ ID NO: 746997 - RNA, 64 nt, hsa; identical to SEQ ID NO: 49959

SEQ ID NO: 746998 - RNA, 64 nt, hsa; identical to SEQ ID NO: 49960

SEQ ID NO: 746999 - RNA, 64 nt, hsa; identical to SEQ ID NO: 49961

SEQ ID NO: 747000 - RNA, 64 nt, hsa; identical to SEQ ID NO: 49962

SEQ ID NO: 747001 - RNA, 64 nt, hsa; identical to SEQ ID NO: 49963

SEQ ID NO: 747002 - RNA, 64 nt, hsa; identical to SEQ ID NO: 49964

SEQ ID NO: 747003 - RNA, 64 nt, hsa; identical to SEQ ID NO: 49965

SEQ ID NO: 747004 - RNA, 64 nt, hsa; identical to SEQ ID NO: 49966

SEQ ID NO: 747005 - RNA, 64 nt, hsa; identical to SEQ ID NO: 49967

SEQ ID NO: 747006 - RNA, 64 nt, hsa; identical to SEQ ID NO: 49968

SEQ ID NO: 747007 - RNA, 64 nt, hsa; identical to SEQ ID NO: 49969

SEQ ID NO: 747008 - RNA, 64 nt, hsa; identical to SEQ ID NO: 49970

SEQ ID NO: 747009 - RNA, 64 nt, hsa; identical to SEQ ID NO: 49971

SEQ ID NO: 747010 - RNA, 64 nt, hsa; identical to SEQ ID NO: 49972

SEQ ID NO: 747011 - RNA, 64 nt, hsa; identical to SEQ ID NO: 49973

SEQ ID NO: 747012 - RNA, 64 nt, hsa; identical to SEQ ID NO: 49974

SEQ ID NO: 747013 - RNA, 64 nt, hsa; identical to SEQ ID NO: 49975

SEQ ID NO: 747014 - RNA, 64 nt, hsa; identical to SEQ ID NO: 49976

SEQ ID NO: 747015 - RNA, 64 nt, hsa; identical to SEQ ID NO: 49977

SEQ ID NO: 747016 - RNA, 64 nt, hsa; identical to SEQ ID NO: 49978

SEQ ID NO: 747017 - RNA, 64 nt, hsa; identical to SEQ ID NO: 49979

SEQ ID NO: 747018 - RNA, 64 nt, hsa; identical to SEQ ID NO: 49980

SEQ ID NO: 747019 - RNA, 64 nt, hsa; identical to SEQ ID NO: 49981

SEQ ID NO: 747020 - RNA, 64 nt, hsa; identical to SEQ ID NO: 49982

SEQ ID NO: 747021 - RNA, 64 nt, hsa; identical to SEQ ID NO: 49983

SEQ ID NO: 747022 - RNA, 64 nt, hsa; identical to SEQ ID NO: 49984

SEQ ID NO: 747023 - RNA, 64 nt, hsa; identical to SEQ ID NO: 49985

SEQ ID NO: 747024 - RNA, 64 nt, hsa; identical to SEQ ID NO: 49986

SEQ ID NO: 747025 - RNA, 64 nt, hsa; identical to SEQ ID NO: 49987

SEQ ID NO: 747026 - RNA, 64 nt, hsa; identical to SEQ ID NO: 49988

SEQ ID NO: 747027 - RNA, 64 nt, hsa; identical to SEQ ID NO: 49989

SEQ ID NO: 747028 - RNA, 64 nt, hsa; identical to SEQ ID NO: 49990

SEQ ID NO: 747029 - RNA, 64 nt, hsa; identical to SEQ ID NO: 49991

SEQ ID NO: 747030 - RNA, 64 nt, hsa; identical to SEQ ID NO: 49992

SEQ ID NO: 747031 - RNA, 64 nt, hsa; identical to SEQ ID NO: 49993

SEQ ID NO: 747032 - RNA, 64 nt, hsa; identical to SEQ ID NO: 49994

SEQ ID NO: 747033 - RNA, 64 nt, hsa; identical to SEQ ID NO: 49995

SEQ ID NO: 747034 - RNA, 64 nt, hsa; identical to SEQ ID NO: 49996

SEQ ID NO: 747035 - RNA, 58 nt, hsa; identical to SEQ ID NO: 49997

SEQ ID NO: 747036 - RNA, 50 nt, hsa; identical to SEQ ID NO: 49998

SEQ ID NO: 747037 - RNA, 64 nt, hsa; identical to SEQ ID NO: 49999

SEQ ID NO: 747038 - RNA, 64 nt, hsa; identical to SEQ ID NO: 50000

SEQ ID NO: 747039 - RNA, 64 nt, hsa; identical to SEQ ID NO: 50001

SEQ ID NO: 747040 - RNA, 64 nt, hsa; identical to SEQ ID NO: 50002

SEQ ID NO: 747041 - RNA, 64 nt, hsa; identical to SEQ ID NO: 50003

SEQ ID NO: 747042 - RNA, 64 nt, hsa; identical to SEQ ID NO: 50004

SEQ ID NO: 747043 - RNA, 64 nt, hsa; identical to SEQ ID NO: 50005

SEQ ID NO: 747044 - RNA, 64 nt, hsa; identical to SEQ ID NO: 50006

SEQ ID NO: 747045 - RNA, 64 nt, hsa; identical to SEQ ID NO: 50007

SEQ ID NO: 747046 - RNA, 64 nt, hsa; identical to SEQ ID NO: 50008

SEQ ID NO: 747047 - RNA, 64 nt, hsa; identical to SEQ ID NO: 50009

SEQ ID NO: 747048 - RNA, 64 nt, hsa; identical to SEQ ID NO: 50010

SEQ ID NO: 747049 - RNA, 64 nt, hsa; identical to SEQ ID NO: 50011

SEQ ID NO: 747050 - RNA, 64 nt, hsa; identical to SEQ ID NO: 50012

SEQ ID NO: 747051 - RNA, 64 nt, hsa; identical to SEQ ID NO: 50013

SEQ ID NO: 747052 - RNA, 64 nt, hsa; identical to SEQ ID NO: 50014

SEQ ID NO: 747053 - RNA, 64 nt, hsa; identical to SEQ ID NO: 50015

SEQ ID NO: 747054 - RNA, 64 nt, hsa; identical to SEQ ID NO: 50016

SEQ ID NO: 747055 - RNA, 64 nt, hsa; identical to SEQ ID NO: 50017

SEQ ID NO: 747056 - RNA, 64 nt, hsa; identical to SEQ ID NO: 50018

SEQ ID NO: 747057 - RNA, 64 nt, hsa; identical to SEQ ID NO: 50019

SEQ ID NO: 747058 - RNA, 64 nt, hsa; identical to SEQ ID NO: 50020

SEQ ID NO: 747059 - RNA, 64 nt, hsa; identical to SEQ ID NO: 50021

SEQ ID NO: 747060 - RNA, 64 nt, hsa; identical to SEQ ID NO: 50022

SEQ ID NO: 747061 - RNA, 64 nt, hsa; identical to SEQ ID NO: 50023

SEQ ID NO: 747062 - RNA, 64 nt, hsa; identical to SEQ ID NO: 50024

SEQ ID NO: 747063 - RNA, 64 nt, hsa; identical to SEQ ID NO: 50025

SEQ ID NO: 747064 - RNA, 64 nt, hsa; identical to SEQ ID NO: 50026

SEQ ID NO: 747065 - RNA, 64 nt, hsa; identical to SEQ ID NO: 50027

SEQ ID NO: 747066 - RNA, 64 nt, hsa; identical to SEQ ID NO: 50028

SEQ ID NO: 747067 - RNA, 64 nt, hsa; identical to SEQ ID NO: 50029

SEQ ID NO: 747068 - RNA, 64 nt, hsa; identical to SEQ ID NO: 50030

SEQ ID NO: 747069 - RNA, 64 nt, hsa; identical to SEQ ID NO: 50031

SEQ ID NO: 747070 - RNA, 64 nt, hsa; identical to SEQ ID NO: 50032

SEQ ID NO: 747071 - RNA, 64 nt, hsa; identical to SEQ ID NO: 50033

SEQ ID NO: 747072 - RNA, 64 nt, hsa; identical to SEQ ID NO: 50034

SEQ ID NO: 747073 - RNA, 64 nt, hsa; identical to SEQ ID NO: 50035

SEQ ID NO: 747074 - RNA, 64 nt, hsa; identical to SEQ ID NO: 50036

SEQ ID NO: 747075 - RNA, 64 nt, hsa; identical to SEQ ID NO: 50037

SEQ ID NO: 747076 - RNA, 64 nt, hsa; identical to SEQ ID NO: 50038

SEQ ID NO: 747077 - RNA, 64 nt, hsa; identical to SEQ ID NO: 50039

SEQ ID NO: 747078 - RNA, 64 nt, hsa; identical to SEQ ID NO: 50040

SEQ ID NO: 747079 - RNA, 64 nt, hsa; identical to SEQ ID NO: 50041

SEQ ID NO: 747080 - RNA, 64 nt, hsa; identical to SEQ ID NO: 50042

SEQ ID NO: 747081 - RNA, 64 nt, hsa; identical to SEQ ID NO: 50043

SEQ ID NO: 747082 - RNA, 64 nt, hsa; identical to SEQ ID NO: 50044

SEQ ID NO: 747083 - RNA, 64 nt, hsa; identical to SEQ ID NO: 50045

SEQ ID NO: 747084 - RNA, 64 nt, hsa; identical to SEQ ID NO: 50046

SEQ ID NO: 747085 - RNA, 64 nt, hsa; identical to SEQ ID NO: 50047

SEQ ID NO: 747086 - RNA, 64 nt, hsa; identical to SEQ ID NO: 50048

SEQ ID NO: 747087 - RNA, 64 nt, hsa; identical to SEQ ID NO: 50049

SEQ ID NO: 747088 - RNA, 64 nt, hsa; identical to SEQ ID NO: 50050

SEQ ID NO: 747089 - RNA, 64 nt, hsa; identical to SEQ ID NO: 50051

SEQ ID NO: 747090 - RNA, 64 nt, hsa; identical to SEQ ID NO: 50052

SEQ ID NO: 747091 - RNA, 64 nt, hsa; identical to SEQ ID NO: 50053

SEQ ID NO: 747092 - RNA, 64 nt, hsa; identical to SEQ ID NO: 50054

SEQ ID NO: 747093 - RNA, 64 nt, hsa; identical to SEQ ID NO: 50055

SEQ ID NO: 747094 - RNA, 64 nt, hsa; identical to SEQ ID NO: 50056

SEQ ID NO: 747095 - RNA, 64 nt, hsa; identical to SEQ ID NO: 50057

SEQ ID NO: 747096 - RNA, 64 nt, hsa; identical to SEQ ID NO: 50058

SEQ ID NO: 747097 - RNA, 64 nt, hsa; identical to SEQ ID NO: 50059

SEQ ID NO: 747098 - RNA, 64 nt, hsa; identical to SEQ ID NO: 50060

SEQ ID NO: 747099 - RNA, 64 nt, hsa; identical to SEQ ID NO: 50061

SEQ ID NO: 747100 - RNA, 64 nt, hsa; identical to SEQ ID NO: 50062

SEQ ID NO: 747101 - RNA, 64 nt, hsa; identical to SEQ ID NO: 50063

SEQ ID NO: 747102 - RNA, 64 nt, hsa; identical to SEQ ID NO: 50064

SEQ ID NO: 747103 - RNA, 64 nt, hsa; identical to SEQ ID NO: 50065

SEQ ID NO: 747104 - RNA, 64 nt, hsa; identical to SEQ ID NO: 50066

SEQ ID NO: 747105 - RNA, 64 nt, hsa; identical to SEQ ID NO: 50067

SEQ ID NO: 747106 - RNA, 64 nt, hsa; identical to SEQ ID NO: 50068

SEQ ID NO: 747107 - RNA, 64 nt, hsa; identical to SEQ ID NO: 50069

SEQ ID NO: 747108 - RNA, 64 nt, hsa; identical to SEQ ID NO: 50070

SEQ ID NO: 747109 - RNA, 64 nt, hsa; identical to SEQ ID NO: 50071

SEQ ID NO: 747110 - RNA, 64 nt, hsa; identical to SEQ ID NO: 50072

SEQ ID NO: 747111 - RNA, 64 nt, hsa; identical to SEQ ID NO: 50073

SEQ ID NO: 747112 - RNA, 64 nt, hsa; identical to SEQ ID NO: 50074

SEQ ID NO: 747113 - RNA, 64 nt, hsa; identical to SEQ ID NO: 50075

SEQ ID NO: 747114 - RNA, 64 nt, hsa; identical to SEQ ID NO: 50076

SEQ ID NO: 747115 - RNA, 64 nt, hsa; identical to SEQ ID NO: 50077

SEQ ID NO: 747116 - RNA, 64 nt, hsa; identical to SEQ ID NO: 50078

SEQ ID NO: 747117 - RNA, 64 nt, hsa; identical to SEQ ID NO: 50079

SEQ ID NO: 747118 - RNA, 64 nt, hsa; identical to SEQ ID NO: 50080

SEQ ID NO: 747119 - RNA, 64 nt, hsa; identical to SEQ ID NO: 50081

SEQ ID NO: 747120 - RNA, 64 nt, hsa; identical to SEQ ID NO: 50082

SEQ ID NO: 747121 - RNA, 64 nt, hsa; identical to SEQ ID NO: 50083

SEQ ID NO: 747122 - RNA, 64 nt, hsa; identical to SEQ ID NO: 50084

SEQ ID NO: 747123 - RNA, 64 nt, hsa; identical to SEQ ID NO: 50085

SEQ ID NO: 747124 - RNA, 64 nt, hsa; identical to SEQ ID NO: 50086

SEQ ID NO: 747125 - RNA, 64 nt, hsa; identical to SEQ ID NO: 50087

SEQ ID NO: 747126 - RNA, 64 nt, hsa; identical to SEQ ID NO: 50088

SEQ ID NO: 747127 - RNA, 64 nt, hsa; identical to SEQ ID NO: 50089

SEQ ID NO: 747128 - RNA, 64 nt, hsa; identical to SEQ ID NO: 50090

SEQ ID NO: 747129 - RNA, 64 nt, hsa; identical to SEQ ID NO: 50091

SEQ ID NO: 747130 - RNA, 64 nt, hsa; identical to SEQ ID NO: 50092

SEQ ID NO: 747131 - RNA, 63 nt, hsa; identical to SEQ ID NO: 50093

SEQ ID NO: 747132 - RNA, 64 nt, hsa; identical to SEQ ID NO: 50094

SEQ ID NO: 747133 - RNA, 64 nt, hsa; identical to SEQ ID NO: 50095

SEQ ID NO: 747134 - RNA, 64 nt, hsa; identical to SEQ ID NO: 50096

SEQ ID NO: 747135 - RNA, 64 nt, hsa; identical to SEQ ID NO: 50097

SEQ ID NO: 747136 - RNA, 64 nt, hsa; identical to SEQ ID NO: 50098

SEQ ID NO: 747137 - RNA, 64 nt, hsa; identical to SEQ ID NO: 50099

SEQ ID NO: 747138 - RNA, 64 nt, hsa; identical to SEQ ID NO: 50100

SEQ ID NO: 747139 - RNA, 64 nt, hsa; identical to SEQ ID NO: 50101

SEQ ID NO: 747140 - RNA, 64 nt, hsa; identical to SEQ ID NO: 50102

SEQ ID NO: 747141 - RNA, 64 nt, hsa; identical to SEQ ID NO: 50103

SEQ ID NO: 747142 - RNA, 64 nt, hsa; identical to SEQ ID NO: 50104

SEQ ID NO: 747143 - RNA, 64 nt, hsa; identical to SEQ ID NO: 50105

SEQ ID NO: 747144 - RNA, 64 nt, hsa; identical to SEQ ID NO: 50106

SEQ ID NO: 747145 - RNA, 64 nt, hsa; identical to SEQ ID NO: 50107

SEQ ID NO: 747146 - RNA, 64 nt, hsa; identical to SEQ ID NO: 50108

SEQ ID NO: 747147 - RNA, 64 nt, hsa; identical to SEQ ID NO: 50109

SEQ ID NO: 747148 - RNA, 64 nt, hsa; identical to SEQ ID NO: 50110

SEQ ID NO: 747149 - RNA, 64 nt, hsa; identical to SEQ ID NO: 50111

SEQ ID NO: 747150 - RNA, 64 nt, hsa; identical to SEQ ID NO: 50112

SEQ ID NO: 747151 - RNA, 64 nt, hsa; identical to SEQ ID NO: 50113

SEQ ID NO: 747152 - RNA, 64 nt, hsa; identical to SEQ ID NO: 50114

SEQ ID NO: 747153 - RNA, 64 nt, hsa; identical to SEQ ID NO: 50115

SEQ ID NO: 747154 - RNA, 64 nt, hsa; identical to SEQ ID NO: 50116

SEQ ID NO: 747155 - RNA, 64 nt, hsa; identical to SEQ ID NO: 50117

SEQ ID NO: 747156 - RNA, 64 nt, hsa; identical to SEQ ID NO: 50118

SEQ ID NO: 747157 - RNA, 64 nt, hsa; identical to SEQ ID NO: 50119

SEQ ID NO: 747158 - RNA, 64 nt, hsa; identical to SEQ ID NO: 50120

SEQ ID NO: 747159 - RNA, 64 nt, hsa; identical to SEQ ID NO: 50121

SEQ ID NO: 747160 - RNA, 64 nt, hsa; identical to SEQ ID NO: 38255

SEQ ID NO: 747161 - RNA, 64 nt, hsa; identical to SEQ ID NO: 38256

SEQ ID NO: 747162 - RNA, 64 nt, hsa; identical to SEQ ID NO: 38257

SEQ ID NO: 747163 - RNA, 64 nt, hsa; identical to SEQ ID NO: 38258

SEQ ID NO: 747164 - RNA, 64 nt, hsa; identical to SEQ ID NO: 38259

SEQ ID NO: 747165 - RNA, 64 nt, hsa; identical to SEQ ID NO: 38260

SEQ ID NO: 747166 - RNA, 64 nt, hsa; identical to SEQ ID NO: 38261

SEQ ID NO: 747167 - RNA, 64 nt, hsa; identical to SEQ ID NO: 38262

SEQ ID NO: 747168 - RNA, 64 nt, hsa; identical to SEQ ID NO: 38263

SEQ ID NO: 747169 - RNA, 64 nt, hsa; identical to SEQ ID NO: 38264

SEQ ID NO: 747170 - RNA, 64 nt, hsa; identical to SEQ ID NO: 38265

SEQ ID NO: 747171 - RNA, 64 nt, hsa; identical to SEQ ID NO: 38266

SEQ ID NO: 747172 - RNA, 64 nt, hsa; identical to SEQ ID NO: 38267

SEQ ID NO: 747173 - RNA, 64 nt, hsa; identical to SEQ ID NO: 38268

SEQ ID NO: 747174 - RNA, 64 nt, hsa; identical to SEQ ID NO: 38269

SEQ ID NO: 747175 - RNA, 64 nt, hsa; identical to SEQ ID NO: 38270

SEQ ID NO: 747176 - RNA, 64 nt, hsa; identical to SEQ ID NO: 38271

SEQ ID NO: 747177 - RNA, 64 nt, hsa; identical to SEQ ID NO: 38272

SEQ ID NO: 747178 - RNA, 64 nt, hsa; identical to SEQ ID NO: 38273

SEQ ID NO: 747179 - RNA, 64 nt, hsa; identical to SEQ ID NO: 38274

SEQ ID NO: 747180 - RNA, 64 nt, hsa; identical to SEQ ID NO: 38275

SEQ ID NO: 747181 - RNA, 64 nt, hsa; identical to SEQ ID NO: 38276

SEQ ID NO: 747182 - RNA, 64 nt, hsa; identical to SEQ ID NO: 38277

SEQ ID NO: 747183 - RNA, 64 nt, hsa; identical to SEQ ID NO: 38278

SEQ ID NO: 747184 - RNA, 64 nt, hsa; identical to SEQ ID NO: 38279

SEQ ID NO: 747185 - RNA, 64 nt, hsa; identical to SEQ ID NO: 38280

SEQ ID NO: 747186 - RNA, 64 nt, hsa; identical to SEQ ID NO: 38281

SEQ ID NO: 747187 - RNA, 64 nt, hsa; identical to SEQ ID NO: 38282

SEQ ID NO: 747188 - RNA, 64 nt, hsa; identical to SEQ ID NO: 38283

SEQ ID NO: 747189 - RNA, 64 nt, hsa; identical to SEQ ID NO: 38284

SEQ ID NO: 747190 - RNA, 62 nt, hsa; identical to SEQ ID NO: 38285

SEQ ID NO: 747191 - RNA, 64 nt, hsa; identical to SEQ ID NO: 38286

SEQ ID NO: 747192 - RNA, 64 nt, hsa; identical to SEQ ID NO: 38287

SEQ ID NO: 747193 - RNA, 64 nt, hsa; identical to SEQ ID NO: 38288

SEQ ID NO: 747194 - RNA, 64 nt, hsa; identical to SEQ ID NO: 38289

SEQ ID NO: 747195 - RNA, 64 nt, hsa; identical to SEQ ID NO: 38290

SEQ ID NO: 747196 - RNA, 64 nt, hsa; identical to SEQ ID NO: 38291

SEQ ID NO: 747197 - RNA, 64 nt, hsa; identical to SEQ ID NO: 38292

SEQ ID NO: 747198 - RNA, 64 nt, hsa; identical to SEQ ID NO: 38293

SEQ ID NO: 747199 - RNA, 64 nt, hsa; identical to SEQ ID NO: 38294

SEQ ID NO: 747200 - RNA, 64 nt, hsa; identical to SEQ ID NO: 38295

SEQ ID NO: 747201 - RNA, 64 nt, hsa; identical to SEQ ID NO: 38296

SEQ ID NO: 747202 - RNA, 64 nt, hsa; identical to SEQ ID NO: 38297

SEQ ID NO: 747203 - RNA, 64 nt, hsa; identical to SEQ ID NO: 38298

SEQ ID NO: 747204 - RNA, 64 nt, hsa; identical to SEQ ID NO: 38299

SEQ ID NO: 747205 - RNA, 64 nt, hsa; identical to SEQ ID NO: 38300

SEQ ID NO: 747206 - RNA, 64 nt, hsa; identical to SEQ ID NO: 38301

SEQ ID NO: 747207 - RNA, 64 nt, hsa; identical to SEQ ID NO: 38302

SEQ ID NO: 747208 - RNA, 64 nt, hsa; identical to SEQ ID NO: 38303

SEQ ID NO: 747209 - RNA, 64 nt, hsa; identical to SEQ ID NO: 38304

SEQ ID NO: 747210 - RNA, 64 nt, hsa; identical to SEQ ID NO: 38305

SEQ ID NO: 747211 - RNA, 64 nt, hsa; identical to SEQ ID NO: 38306

SEQ ID NO: 747212 - RNA, 64 nt, hsa; identical to SEQ ID NO: 38307

SEQ ID NO: 747213 - RNA, 64 nt, hsa; identical to SEQ ID NO: 38308

SEQ ID NO: 747214 - RNA, 64 nt, hsa; identical to SEQ ID NO: 38309

SEQ ID NO: 747215 - RNA, 64 nt, hsa; identical to SEQ ID NO: 38310

SEQ ID NO: 747216 - RNA, 64 nt, hsa; identical to SEQ ID NO: 38311

SEQ ID NO: 747217 - RNA, 64 nt, hsa; identical to SEQ ID NO: 38312

SEQ ID NO: 747218 - RNA, 64 nt, hsa; identical to SEQ ID NO: 38313

SEQ ID NO: 747219 - RNA, 64 nt, hsa; identical to SEQ ID NO: 38314

SEQ ID NO: 747220 - RNA, 64 nt, hsa; identical to SEQ ID NO: 38315

SEQ ID NO: 747221 - RNA, 64 nt, hsa; identical to SEQ ID NO: 38316

SEQ ID NO: 747222 - RNA, 64 nt, hsa; identical to SEQ ID NO: 38317

SEQ ID NO: 747223 - RNA, 64 nt, hsa; identical to SEQ ID NO: 38318

SEQ ID NO: 747224 - RNA, 64 nt, hsa; identical to SEQ ID NO: 235641

SEQ ID NO: 747225 - RNA, 64 nt, hsa; identical to SEQ ID NO: 235642

SEQ ID NO: 747226 - RNA, 64 nt, hsa; identical to SEQ ID NO: 235643

SEQ ID NO: 747227 - RNA, 64 nt, hsa; identical to SEQ ID NO: 235644

SEQ ID NO: 747228 - RNA, 64 nt, hsa; identical to SEQ ID NO: 235645

SEQ ID NO: 747229 - RNA, 64 nt, hsa; identical to SEQ ID NO: 235646

SEQ ID NO: 747230 - RNA, 64 nt, hsa; identical to SEQ ID NO: 235647

SEQ ID NO: 747231 - RNA, 64 nt, hsa; identical to SEQ ID NO: 235648

SEQ ID NO: 747232 - RNA, 64 nt, hsa; identical to SEQ ID NO: 235649

SEQ ID NO: 747233 - RNA, 64 nt, hsa; identical to SEQ ID NO: 235650

SEQ ID NO: 747234 - RNA, 64 nt, hsa; identical to SEQ ID NO: 235651

SEQ ID NO: 747235 - RNA, 64 nt, hsa; identical to SEQ ID NO: 235652

SEQ ID NO: 747236 - RNA, 64 nt, hsa; identical to SEQ ID NO: 235653

SEQ ID NO: 747237 - RNA, 64 nt, hsa; identical to SEQ ID NO: 235654

SEQ ID NO: 747238 - RNA, 64 nt, hsa; identical to SEQ ID NO: 235655

SEQ ID NO: 747239 - RNA, 64 nt, hsa; identical to SEQ ID NO: 235656

SEQ ID NO: 747240 - RNA, 64 nt, hsa; identical to SEQ ID NO: 235657

SEQ ID NO: 747241 - RNA, 64 nt, hsa; identical to SEQ ID NO: 235658

SEQ ID NO: 747242 - RNA, 64 nt, hsa; identical to SEQ ID NO: 235659

SEQ ID NO: 747243 - RNA, 64 nt, hsa; identical to SEQ ID NO: 235660

SEQ ID NO: 747244 - RNA, 64 nt, hsa; identical to SEQ ID NO: 235661

SEQ ID NO: 747245 - RNA, 64 nt, hsa; identical to SEQ ID NO: 235662

SEQ ID NO: 747246 - RNA, 64 nt, hsa; identical to SEQ ID NO: 235663

SEQ ID NO: 747247 - RNA, 64 nt, hsa; identical to SEQ ID NO: 235664

SEQ ID NO: 747248 - RNA, 64 nt, hsa; identical to SEQ ID NO: 235665

SEQ ID NO: 747249 - RNA, 64 nt, hsa; identical to SEQ ID NO: 235666

SEQ ID NO: 747250 - RNA, 64 nt, hsa; identical to SEQ ID NO: 235667

SEQ ID NO: 747251 - RNA, 64 nt, hsa; identical to SEQ ID NO: 235668

SEQ ID NO: 747252 - RNA, 64 nt, hsa; identical to SEQ ID NO: 235669

SEQ ID NO: 747253 - RNA, 64 nt, hsa; identical to SEQ ID NO: 235670

SEQ ID NO: 747254 - RNA, 64 nt, hsa; identical to SEQ ID NO: 235671

SEQ ID NO: 747255 - RNA, 64 nt, hsa; identical to SEQ ID NO: 235672

SEQ ID NO: 747256 - RNA, 64 nt, hsa; identical to SEQ ID NO: 235673

SEQ ID NO: 747257 - RNA, 64 nt, hsa; identical to SEQ ID NO: 235674

SEQ ID NO: 747258 - RNA, 64 nt, hsa; identical to SEQ ID NO: 235675

SEQ ID NO: 747259 - RNA, 64 nt, hsa; identical to SEQ ID NO: 235676

SEQ ID NO: 747260 - RNA, 64 nt, hsa; identical to SEQ ID NO: 235677

SEQ ID NO: 747261 - RNA, 64 nt, hsa; identical to SEQ ID NO: 235678

SEQ ID NO: 747262 - RNA, 64 nt, hsa; identical to SEQ ID NO: 235679

SEQ ID NO: 747263 - RNA, 64 nt, hsa; identical to SEQ ID NO: 235680

SEQ ID NO: 747264 - RNA, 64 nt, hsa; identical to SEQ ID NO: 235681

SEQ ID NO: 747265 - RNA, 64 nt, hsa; identical to SEQ ID NO: 235682

SEQ ID NO: 747266 - RNA, 64 nt, hsa; identical to SEQ ID NO: 235683

SEQ ID NO: 747267 - RNA, 64 nt, hsa; identical to SEQ ID NO: 235684

SEQ ID NO: 747268 - RNA, 64 nt, hsa; identical to SEQ ID NO: 235685

SEQ ID NO: 747269 - RNA, 64 nt, hsa; identical to SEQ ID NO: 235686

SEQ ID NO: 747270 - RNA, 64 nt, hsa; identical to SEQ ID NO: 235687

SEQ ID NO: 747271 - RNA, 64 nt, hsa; identical to SEQ ID NO: 235688

SEQ ID NO: 747272 - RNA, 64 nt, hsa; identical to SEQ ID NO: 235689

SEQ ID NO: 747273 - RNA, 64 nt, hsa; identical to SEQ ID NO: 235690

SEQ ID NO: 747274 - RNA, 64 nt, hsa; identical to SEQ ID NO: 235691

SEQ ID NO: 747275 - RNA, 64 nt, hsa; identical to SEQ ID NO: 235692

SEQ ID NO: 747276 - RNA, 64 nt, hsa; identical to SEQ ID NO: 235693

SEQ ID NO: 747277 - RNA, 64 nt, hsa; identical to SEQ ID NO: 235694

SEQ ID NO: 747278 - RNA, 64 nt, hsa; identical to SEQ ID NO: 235695

SEQ ID NO: 747279 - RNA, 64 nt, hsa; identical to SEQ ID NO: 235696

SEQ ID NO: 747280 - RNA, 64 nt, hsa; identical to SEQ ID NO: 235697

SEQ ID NO: 747281 - RNA, 64 nt, hsa; identical to SEQ ID NO: 464050

SEQ ID NO: 747282 - RNA, 64 nt, hsa; identical to SEQ ID NO: 464051

SEQ ID NO: 747283 - RNA, 64 nt, hsa; identical to SEQ ID NO: 464052

SEQ ID NO: 747284 - RNA, 64 nt, hsa; identical to SEQ ID NO: 464053

SEQ ID NO: 747285 - RNA, 64 nt, hsa; identical to SEQ ID NO: 464054

SEQ ID NO: 747286 - RNA, 64 nt, hsa; identical to SEQ ID NO: 464055

SEQ ID NO: 747287 - RNA, 64 nt, hsa; identical to SEQ ID NO: 464056

SEQ ID NO: 747288 - RNA, 61 nt, hsa; identical to SEQ ID NO: 464057

SEQ ID NO: 747289 - RNA, 64 nt, hsa; identical to SEQ ID NO: 464058

SEQ ID NO: 747290 - RNA, 64 nt, hsa; identical to SEQ ID NO: 464059

SEQ ID NO: 747291 - RNA, 64 nt, hsa; identical to SEQ ID NO: 464060

SEQ ID NO: 747292 - RNA, 64 nt, hsa; identical to SEQ ID NO: 464061

SEQ ID NO: 747293 - RNA, 64 nt, hsa; identical to SEQ ID NO: 464062

SEQ ID NO: 747294 - RNA, 64 nt, hsa; identical to SEQ ID NO: 464063

SEQ ID NO: 747295 - RNA, 64 nt, hsa; identical to SEQ ID NO: 464064

SEQ ID NO: 747296 - RNA, 64 nt, hsa; identical to SEQ ID NO: 464065

SEQ ID NO: 747297 - RNA, 64 nt, hsa; identical to SEQ ID NO: 464066

SEQ ID NO: 747298 - RNA, 64 nt, hsa; identical to SEQ ID NO: 464067

SEQ ID NO: 747299 - RNA, 64 nt, hsa; identical to SEQ ID NO: 464068

SEQ ID NO: 747300 - RNA, 64 nt, hsa; identical to SEQ ID NO: 464069

SEQ ID NO: 747301 - RNA, 64 nt, hsa; identical to SEQ ID NO: 300789

SEQ ID NO: 747302 - RNA, 64 nt, hsa; identical to SEQ ID NO: 300790

SEQ ID NO: 747303 - RNA, 64 nt, hsa; identical to SEQ ID NO: 300791

SEQ ID NO: 747304 - RNA, 64 nt, hsa; identical to SEQ ID NO: 300792

SEQ ID NO: 747305 - RNA, 64 nt, hsa; identical to SEQ ID NO: 300793

SEQ ID NO: 747306 - RNA, 64 nt, hsa; identical to SEQ ID NO: 300794

SEQ ID NO: 747307 - RNA, 64 nt, hsa; identical to SEQ ID NO: 300795

SEQ ID NO: 747308 - RNA, 64 nt, hsa; identical to SEQ ID NO: 300796

SEQ ID NO: 747309 - RNA, 64 nt, hsa; identical to SEQ ID NO: 300797

SEQ ID NO: 747310 - RNA, 64 nt, hsa; identical to SEQ ID NO: 300798

SEQ ID NO: 747311 - RNA, 64 nt, hsa; identical to SEQ ID NO: 300799

SEQ ID NO: 747312 - RNA, 64 nt, hsa; identical to SEQ ID NO: 300800

SEQ ID NO: 747313 - RNA, 64 nt, hsa; identical to SEQ ID NO: 300801

SEQ ID NO: 747314 - RNA, 64 nt, hsa; identical to SEQ ID NO: 300802

SEQ ID NO: 747315 - RNA, 64 nt, hsa; identical to SEQ ID NO: 556943

SEQ ID NO: 747316 - RNA, 64 nt, hsa; identical to SEQ ID NO: 556944

SEQ ID NO: 747317 - RNA, 64 nt, hsa; identical to SEQ ID NO: 556945

SEQ ID NO: 747318 - RNA, 64 nt, hsa; identical to SEQ ID NO: 556946

SEQ ID NO: 747319 - RNA, 64 nt, hsa; identical to SEQ ID NO: 556947

SEQ ID NO: 747320 - RNA, 64 nt, hsa; identical to SEQ ID NO: 556948

SEQ ID NO: 747321 - RNA, 64 nt, hsa; identical to SEQ ID NO: 556949

SEQ ID NO: 747322 - RNA, 64 nt, hsa; identical to SEQ ID NO: 556950

SEQ ID NO: 747323 - RNA, 64 nt, hsa; identical to SEQ ID NO: 556951

SEQ ID NO: 747324 - RNA, 64 nt, hsa; identical to SEQ ID NO: 556952

SEQ ID NO: 747325 - RNA, 64 nt, hsa; identical to SEQ ID NO: 556953

SEQ ID NO: 747326 - RNA, 64 nt, hsa; identical to SEQ ID NO: 556954

SEQ ID NO: 747327 - RNA, 64 nt, hsa; identical to SEQ ID NO: 556955

SEQ ID NO: 747328 - RNA, 64 nt, hsa; identical to SEQ ID NO: 556956

SEQ ID NO: 747329 - RNA, 64 nt, hsa; identical to SEQ ID NO: 556957

SEQ ID NO: 747330 - RNA, 64 nt, hsa; identical to SEQ ID NO: 556958

SEQ ID NO: 747331 - RNA, 64 nt, hsa; identical to SEQ ID NO: 556959

SEQ ID NO: 747332 - RNA, 58 nt, hsa; identical to SEQ ID NO: 556960

SEQ ID NO: 747333 - RNA, 64 nt, hsa; identical to SEQ ID NO: 556961

SEQ ID NO: 747334 - RNA, 64 nt, hsa; identical to SEQ ID NO: 556962

SEQ ID NO: 747335 - RNA, 64 nt, hsa; identical to SEQ ID NO: 556963

SEQ ID NO: 747336 - RNA, 64 nt, hsa; identical to SEQ ID NO: 556964

SEQ ID NO: 747337 - RNA, 64 nt, hsa; identical to SEQ ID NO: 556965

SEQ ID NO: 747338 - RNA, 64 nt, hsa; identical to SEQ ID NO: 556966

SEQ ID NO: 747339 - RNA, 64 nt, hsa; identical to SEQ ID NO: 556967

SEQ ID NO: 747340 - RNA, 64 nt, hsa; identical to SEQ ID NO: 556968

SEQ ID NO: 747341 - RNA, 64 nt, hsa; identical to SEQ ID NO: 556969

SEQ ID NO: 747342 - RNA, 64 nt, hsa; identical to SEQ ID NO: 556970

SEQ ID NO: 747343 - RNA, 64 nt, hsa; identical to SEQ ID NO: 556971

SEQ ID NO: 747344 - RNA, 64 nt, hsa; identical to SEQ ID NO: 556972

SEQ ID NO: 747345 - RNA, 64 nt, hsa; identical to SEQ ID NO: 556973

SEQ ID NO: 747346 - RNA, 64 nt, hsa; identical to SEQ ID NO: 556974

SEQ ID NO: 747347 - RNA, 64 nt, hsa; identical to SEQ ID NO: 556975

SEQ ID NO: 747348 - RNA, 64 nt, hsa; identical to SEQ ID NO: 556976

SEQ ID NO: 747349 - RNA, 64 nt, hsa; identical to SEQ ID NO: 556977

SEQ ID NO: 747350 - RNA, 64 nt, hsa; identical to SEQ ID NO: 556978

SEQ ID NO: 747351 - RNA, 64 nt, hsa; identical to SEQ ID NO: 556979

SEQ ID NO: 747352 - RNA, 64 nt, hsa; identical to SEQ ID NO: 556980

SEQ ID NO: 747353 - RNA, 64 nt, hsa; identical to SEQ ID NO: 556981

SEQ ID NO: 747354 - RNA, 64 nt, hsa; identical to SEQ ID NO: 556982

SEQ ID NO: 747355 - RNA, 64 nt, hsa; identical to SEQ ID NO: 556983

SEQ ID NO: 747356 - RNA, 64 nt, hsa; identical to SEQ ID NO: 556984

SEQ ID NO: 747357 - RNA, 64 nt, hsa; identical to SEQ ID NO: 556985

SEQ ID NO: 747358 - RNA, 64 nt, hsa; identical to SEQ ID NO: 556986

SEQ ID NO: 747359 - RNA, 64 nt, hsa; identical to SEQ ID NO: 556987

SEQ ID NO: 747360 - RNA, 64 nt, hsa; identical to SEQ ID NO: 556988

SEQ ID NO: 747361 - RNA, 64 nt, hsa; identical to SEQ ID NO: 556989

SEQ ID NO: 747362 - RNA, 64 nt, hsa; identical to SEQ ID NO: 556990

SEQ ID NO: 747363 - RNA, 64 nt, hsa; identical to SEQ ID NO: 556991

SEQ ID NO: 747364 - RNA, 64 nt, hsa; identical to SEQ ID NO: 556992

SEQ ID NO: 747365 - RNA, 64 nt, hsa; identical to SEQ ID NO: 556993

SEQ ID NO: 747366 - RNA, 64 nt, hsa; identical to SEQ ID NO: 556994

SEQ ID NO: 747367 - RNA, 64 nt, hsa; identical to SEQ ID NO: 556995

SEQ ID NO: 747368 - RNA, 64 nt, hsa; identical to SEQ ID NO: 556996

SEQ ID NO: 747369 - RNA, 64 nt, hsa; identical to SEQ ID NO: 556997

SEQ ID NO: 747370 - RNA, 64 nt, hsa; identical to SEQ ID NO: 556998

SEQ ID NO: 747371 - RNA, 64 nt, hsa; identical to SEQ ID NO: 556999

SEQ ID NO: 747372 - RNA, 64 nt, hsa; identical to SEQ ID NO: 557000

SEQ ID NO: 747373 - RNA, 64 nt, hsa; identical to SEQ ID NO: 557001

SEQ ID NO: 747374 - RNA, 64 nt, hsa; identical to SEQ ID NO: 557002

SEQ ID NO: 747375 - RNA, 64 nt, hsa; identical to SEQ ID NO: 557003

SEQ ID NO: 747376 - RNA, 64 nt, hsa; identical to SEQ ID NO: 557004

SEQ ID NO: 747377 - RNA, 64 nt, hsa; identical to SEQ ID NO: 557005

SEQ ID NO: 747378 - RNA, 64 nt, hsa; identical to SEQ ID NO: 557006

SEQ ID NO: 747379 - RNA, 64 nt, hsa; identical to SEQ ID NO: 557007

SEQ ID NO: 747380 - RNA, 64 nt, hsa; identical to SEQ ID NO: 557008

SEQ ID NO: 747381 - RNA, 64 nt, hsa; identical to SEQ ID NO: 557009

SEQ ID NO: 747382 - RNA, 64 nt, hsa; identical to SEQ ID NO: 557010

SEQ ID NO: 747383 - RNA, 64 nt, hsa; identical to SEQ ID NO: 557011

SEQ ID NO: 747384 - RNA, 64 nt, hsa; identical to SEQ ID NO: 557012

SEQ ID NO: 747385 - RNA, 64 nt, hsa; identical to SEQ ID NO: 557013

SEQ ID NO: 747386 - RNA, 64 nt, hsa; identical to SEQ ID NO: 557014

SEQ ID NO: 747387 - RNA, 64 nt, hsa; identical to SEQ ID NO: 557015

SEQ ID NO: 747388 - RNA, 64 nt, hsa; identical to SEQ ID NO: 557016

SEQ ID NO: 747389 - RNA, 64 nt, hsa; identical to SEQ ID NO: 557017

SEQ ID NO: 747390 - RNA, 64 nt, hsa; identical to SEQ ID NO: 557018

SEQ ID NO: 747391 - RNA, 64 nt, hsa; identical to SEQ ID NO: 557019

SEQ ID NO: 747392 - RNA, 64 nt, hsa; identical to SEQ ID NO: 557020

SEQ ID NO: 747393 - RNA, 64 nt, hsa; identical to SEQ ID NO: 557021

SEQ ID NO: 747394 - RNA, 64 nt, hsa; identical to SEQ ID NO: 557022

SEQ ID NO: 747395 - RNA, 64 nt, hsa; identical to SEQ ID NO: 557023

SEQ ID NO: 747396 - RNA, 64 nt, hsa; identical to SEQ ID NO: 557024

SEQ ID NO: 747397 - RNA, 64 nt, hsa; identical to SEQ ID NO: 557025

SEQ ID NO: 747398 - RNA, 64 nt, hsa; identical to SEQ ID NO: 360094

SEQ ID NO: 747399 - RNA, 64 nt, hsa; identical to SEQ ID NO: 360095

SEQ ID NO: 747400 - RNA, 64 nt, hsa; identical to SEQ ID NO: 360096

SEQ ID NO: 747401 - RNA, 64 nt, hsa; identical to SEQ ID NO: 360097

SEQ ID NO: 747402 - RNA, 64 nt, hsa; identical to SEQ ID NO: 360098

SEQ ID NO: 747403 - RNA, 64 nt, hsa; identical to SEQ ID NO: 360099

SEQ ID NO: 747404 - RNA, 64 nt, hsa; identical to SEQ ID NO: 360100

SEQ ID NO: 747405 - RNA, 64 nt, hsa; identical to SEQ ID NO: 360101

SEQ ID NO: 747406 - RNA, 64 nt, hsa; identical to SEQ ID NO: 360102

SEQ ID NO: 747407 - RNA, 64 nt, hsa; identical to SEQ ID NO: 360103

SEQ ID NO: 747408 - RNA, 64 nt, hsa; identical to SEQ ID NO: 417229

SEQ ID NO: 747409 - RNA, 64 nt, hsa; identical to SEQ ID NO: 417230

SEQ ID NO: 747410 - RNA, 64 nt, hsa; identical to SEQ ID NO: 417231

SEQ ID NO: 747411 - RNA, 64 nt, hsa; identical to SEQ ID NO: 417232

SEQ ID NO: 747412 - RNA, 64 nt, hsa; identical to SEQ ID NO: 417233

SEQ ID NO: 747413 - RNA, 64 nt, hsa; identical to SEQ ID NO: 417234

SEQ ID NO: 747414 - RNA, 64 nt, hsa; identical to SEQ ID NO: 417235

SEQ ID NO: 747415 - RNA, 64 nt, hsa; identical to SEQ ID NO: 417236

SEQ ID NO: 747416 - RNA, 64 nt, hsa; identical to SEQ ID NO: 417237

SEQ ID NO: 747417 - RNA, 64 nt, hsa; identical to SEQ ID NO: 417238

SEQ ID NO: 747418 - RNA, 64 nt, hsa; identical to SEQ ID NO: 417239

SEQ ID NO: 747419 - RNA, 64 nt, hsa; identical to SEQ ID NO: 417240

SEQ ID NO: 747420 - RNA, 64 nt, hsa; identical to SEQ ID NO: 417241

SEQ ID NO: 747421 - RNA, 64 nt, hsa; identical to SEQ ID NO: 417242

SEQ ID NO: 747422 - RNA, 64 nt, hsa; identical to SEQ ID NO: 417243

SEQ ID NO: 747423 - RNA, 64 nt, hsa; identical to SEQ ID NO: 417244

SEQ ID NO: 747424 - RNA, 64 nt, hsa; identical to SEQ ID NO: 417245

SEQ ID NO: 747425 - RNA, 64 nt, hsa; identical to SEQ ID NO: 417246

SEQ ID NO: 747426 - RNA, 64 nt, hsa; identical to SEQ ID NO: 417247

SEQ ID NO: 747427 - RNA, 64 nt, hsa; identical to SEQ ID NO: 417248

SEQ ID NO: 747428 - RNA, 64 nt, hsa; identical to SEQ ID NO: 417249

SEQ ID NO: 747429 - RNA, 64 nt, hsa; identical to SEQ ID NO: 417250

SEQ ID NO: 747430 - RNA, 64 nt, hsa; identical to SEQ ID NO: 417251

SEQ ID NO: 747431 - RNA, 64 nt, hsa; identical to SEQ ID NO: 417252

SEQ ID NO: 747432 - RNA, 64 nt, hsa; identical to SEQ ID NO: 417253

SEQ ID NO: 747433 - RNA, 64 nt, hsa; identical to SEQ ID NO: 417254

SEQ ID NO: 747434 - RNA, 64 nt, hsa; identical to SEQ ID NO: 417255

SEQ ID NO: 747435 - RNA, 64 nt, hsa; identical to SEQ ID NO: 411256

SEQ ID NO: 747436 - RNA, 64 nt, hsa; identical to SEQ ID NO: 411257

SEQ ID NO: 747437 - RNA, 64 nt, hsa; identical to SEQ ID NO: 411258

SEQ ID NO: 747438 - RNA, 64 nt, hsa; identical to SEQ ID NO: 411259

SEQ ID NO: 747439 - RNA, 64 nt, hsa; identical to SEQ ID NO: 411260

SEQ ID NO: 747440 - RNA, 64 nt, hsa; identical to SEQ ID NO: 411261

SEQ ID NO: 747441 - RNA, 64 nt, hsa; identical to SEQ ID NO: 411262

SEQ ID NO: 747442 - RNA, 64 nt, hsa; identical to SEQ ID NO: 411263

SEQ ID NO: 747443 - RNA, 64 nt, hsa; identical to SEQ ID NO: 411264

SEQ ID NO: 747444 - RNA, 64 nt, hsa; identical to SEQ ID NO: 411265

SEQ ID NO: 747445 - RNA, 64 nt, hsa; identical to SEQ ID NO: 411266

SEQ ID NO: 747446 - RNA, 64 nt, hsa; identical to SEQ ID NO: 411267

SEQ ID NO: 747447 - RNA, 64 nt, hsa; identical to SEQ ID NO: 411268

SEQ ID NO: 747448 - RNA, 64 nt, hsa
aaacuaagugcagaguuuacagagugguaaauaucuauguuacauguagauuauacauauauau

SEQ ID NO: 747449 - RNA, 64 nt, hsa
acuauauucccagcagacacauuuagaaacuaagcuauguuaaccucagugcucaacuauuuga

SEQ ID NO: 747450 - RNA, 64 nt, hsa
uuuaaaggcagagaaguucucaaaguuaauucaccuauguuauuuuguguacaaguuguuauug

SEQ ID NO: 747451 - RNA, 64 nt, hsa
ugaauaaacugaauauuuuggaaacugcuaaauucuauguuaaauacugugcagaauaauggaa

SEQ ID NO: 747452 - RNA, 64 nt, hsa
aucucagggagggucucucuccauguuguugccucuauguuaguaguagacaacuguuauuacu

SEQ ID NO: 747453 - RNA, 64 nt, hsa
gggaguaggguuucauuggagcuuugugccauuucuauguuaacagcagcccccuugcaggccu

SEQ ID NO: 747454 - RNA, 64 nt, hsa; identical to SEQ ID NO: 59958

SEQ ID NO: 747455 - RNA, 64 nt, hsa; identical to SEQ ID NO: 59959

SEQ ID NO: 747456 - RNA, 64 nt, hsa; identical to SEQ ID NO: 59960

SEQ ID NO: 747457 - RNA, 64 nt, hsa; identical to SEQ ID NO: 59961

SEQ ID NO: 747458 - RNA, 64 nt, hsa; identical to SEQ ID NO: 59962

SEQ ID NO: 747459 - RNA, 64 nt, hsa; identical to SEQ ID NO: 59963

SEQ ID NO: 747460 - RNA, 64 nt, hsa; identical to SEQ ID NO: 59964

SEQ ID NO: 747461 - RNA, 64 nt, hsa; identical to SEQ ID NO: 59965

SEQ ID NO: 747462 - RNA, 64 nt, hsa; identical to SEQ ID NO: 59966

SEQ ID NO: 747463 - RNA, 64 nt, hsa; identical to SEQ ID NO: 59967

SEQ ID NO: 747464 - RNA, 64 nt, hsa; identical to SEQ ID NO: 59968

SEQ ID NO: 747465 - RNA, 64 nt, hsa; identical to SEQ ID NO: 59969

SEQ ID NO: 747466 - RNA, 64 nt, hsa; identical to SEQ ID NO: 59970

SEQ ID NO: 747467 - RNA, 64 nt, hsa; identical to SEQ ID NO: 59971

SEQ ID NO: 747468 - RNA, 64 nt, hsa; identical to SEQ ID NO: 59972

SEQ ID NO: 747469 - RNA, 64 nt, hsa; identical to SEQ ID NO: 59973

SEQ ID NO: 747470 - RNA, 64 nt, hsa; identical to SEQ ID NO: 59974

SEQ ID NO: 747471 - RNA, 64 nt, hsa; identical to SEQ ID NO: 59975

SEQ ID NO: 747472 - RNA, 64 nt, hsa; identical to SEQ ID NO: 59976

SEQ ID NO: 747473 - RNA, 64 nt, hsa; identical to SEQ ID NO: 59977

SEQ ID NO: 747474 - RNA, 64 nt, hsa; identical to SEQ ID NO: 59978

SEQ ID NO: 747475 - RNA, 64 nt, hsa; identical to SEQ ID NO: 59979

SEQ ID NO: 747476 - RNA, 64 nt, hsa; identical to SEQ ID NO: 59980

SEQ ID NO: 747477 - RNA, 64 nt, hsa; identical to SEQ ID NO: 59981

SEQ ID NO: 747478 - RNA, 64 nt, hsa; identical to SEQ ID NO: 59982

SEQ ID NO: 747479 - RNA, 64 nt, hsa; identical to SEQ ID NO: 59983

SEQ ID NO: 747480 - RNA, 64 nt, hsa; identical to SEQ ID NO: 59984

SEQ ID NO: 747481 - RNA, 64 nt, hsa; identical to SEQ ID NO: 59985

SEQ ID NO: 747482 - RNA, 64 nt, hsa; identical to SEQ ID NO: 59986

SEQ ID NO: 747483 - RNA, 64 nt, hsa; identical to SEQ ID NO: 59987

SEQ ID NO: 747484 - RNA, 64 nt, hsa; identical to SEQ ID NO: 59988

SEQ ID NO: 747485 - RNA, 64 nt, hsa; identical to SEQ ID NO: 59989

SEQ ID NO: 747486 - RNA, 64 nt, hsa; identical to SEQ ID NO: 59990

SEQ ID NO: 747487 - RNA, 64 nt, hsa; identical to SEQ ID NO: 59991

SEQ ID NO: 747488 - RNA, 64 nt, hsa; identical to SEQ ID NO: 59992

SEQ ID NO: 747489 - RNA, 64 nt, hsa; identical to SEQ ID NO: 59993

SEQ ID NO: 747490 - RNA, 64 nt, hsa; identical to SEQ ID NO: 59994

SEQ ID NO: 747491 - RNA, 64 nt, hsa; identical to SEQ ID NO: 59995

SEQ ID NO: 747492 - RNA, 64 nt, hsa; identical to SEQ ID NO: 59996

SEQ ID NO: 747493 - RNA, 64 nt, hsa; identical to SEQ ID NO: 59997

SEQ ID NO: 747494 - RNA, 64 nt, hsa; identical to SEQ ID NO: 59998

SEQ ID NO: 747495 - RNA, 64 nt, hsa; identical to SEQ ID NO: 59999

SEQ ID NO: 747496 - RNA, 64 nt, hsa; identical to SEQ ID NO: 60000

SEQ ID NO: 747497 - RNA, 64 nt, hsa; identical to SEQ ID NO: 60001

SEQ ID NO: 747498 - RNA, 64 nt, hsa; identical to SEQ ID NO: 60002

SEQ ID NO: 747499 - RNA, 64 nt, hsa; identical to SEQ ID NO: 60003

SEQ ID NO: 747500 - RNA, 64 nt, hsa; identical to SEQ ID NO: 60004

SEQ ID NO: 747501 - RNA, 64 nt, hsa; identical to SEQ ID NO: 60005

SEQ ID NO: 747502 - RNA, 64 nt, hsa; identical to SEQ ID NO: 60006

SEQ ID NO: 747503 - RNA, 64 nt, hsa; identical to SEQ ID NO: 60007

SEQ ID NO: 747504 - RNA, 64 nt, hsa; identical to SEQ ID NO: 60008

SEQ ID NO: 747505 - RNA, 64 nt, hsa; identical to SEQ ID NO: 60009

SEQ ID NO: 747506 - RNA, 64 nt, hsa; identical to SEQ ID NO: 60010

SEQ ID NO: 747507 - RNA, 64 nt, hsa; identical to SEQ ID NO: 60011

SEQ ID NO: 747508 - RNA, 64 nt, hsa
aacuugcagcuagaauugagggaagagagagaccuucuuauauuguuuuauauuguuugauacu

SEQ ID NO: 747509 - RNA, 64 nt, hsa
guugcuuguuuuucgcuuguaaauuuuuugaagcuucuuauagauucuggauauuagaucuuug

SEQ ID NO: 747510 - RNA, 64 nt, hsa
cuccuuucccucuuauuccuccuucuccucuuccuucuuauauaaugcuaguauauucucaaaa

SEQ ID NO: 747511 - RNA, 64 nt, hsa
ugucacugaaucugaccuugagaauguacauuaauucuuauauuuuacauaauguauguguugu

SEQ ID NO: 747512 - RNA, 64 nt, hsa
uaauucaaaguuuguggcauacaaccugagccuuuucuuauauaagacaagaauauguucacau

SEQ ID NO: 747513 - RNA, 64 nt, hsa
guaaccacuucauaauauacugcugaagggcuucuucuuauagcaagaacucugcacagcaacu

SEQ ID NO: 747514 - RNA, 64 nt, hsa
gcaaccacauugaauucuugugacuuaggaaagcuucuuauaguugcugacauuaauugcaaga

SEQ ID NO: 747515 - RNA, 64 nt, hsa
uugaaacugaaaaaaaauuuuacagcuacugaauuucuuauaaggaaggagugguuaguaaacu

SEQ ID NO: 747516 - RNA, 64 nt, hsa
gguuugguuugauuuugcuuggaaauaauugguuuucuuauaaaugagugaagcggugauaaaa

SEQ ID NO: 747517 - RNA, 64 nt, hsa
gcuuuggaauauguuacagucccacauuugauauuucuuauauacuuuguuuucucuaaggaga

SEQ ID NO: 747518 - RNA, 64 nt, hsa
auccugugaaaguuuguuauuuucugaguagacauucuuauagaguauugucuuuaaaaucaga

SEQ ID NO: 747519 - RNA, 64 nt, hsa
cauuuuuauguuuucuaauuuaaaaauuaauauuuucuuauagauauugugcaauaaagcugaa

SEQ ID NO: 747520 - RNA, 64 nt, hsa
acauuaaauauaaauguuuaaccaaagaaaguuguucuuauaauguaauuauaacagggauuua

SEQ ID NO: 747521 - RNA, 64 nt, hsa
caccacaaggggcucugcucuucugucugggaucuucuuauaaaguguucccaugaucauucuc

SEQ ID NO: 747522 - RNA, 64 nt, hsa
aaaugaugcaguacccauuuuucguauccugcuuuucuuauauuggaguaaaaaggacagggua

SEQ ID NO: 747523 - RNA, 64 nt, hsa
aguggaagauccugugcucuugaacuuauuuuaauucuuauaauuugcaccuauauaaacaaag

SEQ ID NO: 747524 - RNA, 64 nt, hsa
uuuaaaauguuuuuucuuugauguauuucugucuuucuuauauguaaggaguuauaaggguuau

SEQ ID NO: 747525 - RNA, 64 nt, hsa
uggcuucaaugucuauuucuuaugucuaauggaguucuuauauuacaguguuuguuuagcuaug

SEQ ID NO: 747526 - RNA, 64 nt, hsa
ugauaacaaucucuaauuugcaugggcaccacauuucuuauauuaaaagaauuaguguuuuggc

SEQ ID NO: 747527 - RNA, 64 nt, hsa
cguuaaaauuguuacuaugcagcacagaacuucauucuuauaguauucuuggguucaaccuuug

SEQ ID NO: 747528 - RNA, 64 nt, hsa
uuauaguaugaucaaguaugaaaggaacuuuaaauucuuauauuuacuuuucucucaguaaauu

SEQ ID NO: 747529 - RNA, 64 nt, hsa
aauaccauagagaaaauauuuuagaauuuaauguuucuuauauuuauguaaacuuaugacucuu

SEQ ID NO: 747530 - RNA, 64 nt, hsa
uauauccaggcuauaaauauccuuucaaaucauguucuuauaccuaauuuuagucuuucaaaug

SEQ ID NO: 747531 - RNA, 64 nt, hsa
aaguugugugccccuauagaaaauauuugagaauuucuuauacuaucaagaaaaaauucuguga

SEQ ID NO: 747532 - RNA, 64 nt, hsa
gcaucacuuuccucaguggaaaaacuuaugaaacuucuuauaagagagaguaaucucaggccgg

SEQ ID NO: 747533 - RNA, 64 nt, hsa
gcuuuuguuuugagguuauucucaaaaccuuaauuucuuauauuuucuguugacuaaggcacca

SEQ ID NO: 747534 - RNA, 64 nt, hsa
cugcauaaucuaccauucuucuccucucuuucucuucuuauacagacccucauuacuggggccc

SEQ ID NO: 747535 - RNA, 64 nt, hsa
gaugaguuuuuuuccuagagugaauacuaccccuuucuuauaauugcuguaaguauuauauuuc

SEQ ID NO: 747536 - RNA, 64 nt, hsa
guuucucacuuguuuuggaggaaaaugaugcuuauucuuauaaauuaccuucaguaacuauuca

SEQ ID NO: 747537 - RNA, 64 nt, hsa
uuguagcuguuguuuuuagauauaguccacugcauucuuauaaguucuaaauuuuauguuuauu

SEQ ID NO: 747538 - RNA, 64 nt, hsa
ccauagcuuauuaacacuaaagaaaacaauuacauucuuauacaauaaaaaggacacauuugug

SEQ ID NO: 747539 - RNA, 64 nt, hsa
gagguuuacauuaugugaauacaugcacauuuguuucuuauacagguggugugaacucuagggc

SEQ ID NO: 747540 - RNA, 64 nt, hsa
gagaacuuuucuagcuauuccaauacagaguucuuucuuauagggcuauugauauugacaccaa

SEQ ID NO: 747541 - RNA, 64 nt, hsa
aucucagcccaccaaugccaagacaaaauuauuuuucuuauacuuauuuuuuauuaaacaaaau

SEQ ID NO: 747542 - RNA, 64 nt, hsa
auguucaaaaaugauaaguaaucuggauaccuuuuucuuauacuuucuccuaggaaaacuuuaa

SEQ ID NO: 747543 - RNA, 64 nt, hsa
acacuuauggagcuaacauuuucagagauacagcuucuuauaguaacacuaaaacuuucuuccu

SEQ ID NO: 747544 - RNA, 64 nt, hsa
cuaauucuguaggacuuugaauaaugugauauuuuucuuauaauuggacccuuguguuuugaag

SEQ ID NO: 747545 - RNA, 64 nt, hsa
aaacagaauauuuauuacaaauguuagaauauauuucuuauacuaggaaucucauuugcauuug

SEQ ID NO: 747546 - RNA, 64 nt, hsa
ggccccuuucuggggguuccccaucagcccucauuucuuauaauacccugaucccagacuccaa

SEQ ID NO: 747547 - RNA, 64 nt, hsa
gugaucucaucaucauggauacucaauuuguuuuuucuuauagagaaaaugaguauauaagaca

SEQ ID NO: 747548 - RNA, 64 nt, hsa
acagaaagaagaauuucuaaaauauuggauuuacuucuuauauugagucagaugcauacuuuua

SEQ ID NO: 747549 - RNA, 64 nt, hsa; identical to SEQ ID NO: 116418

SEQ ID NO: 747550 - RNA, 64 nt, hsa; identical to SEQ ID NO: 116419

SEQ ID NO: 747551 - RNA, 64 nt, hsa; identical to SEQ ID NO: 116420

SEQ ID NO: 747552 - RNA, 64 nt, hsa; identical to SEQ ID NO: 116421

SEQ ID NO: 747553 - RNA, 64 nt, hsa; identical to SEQ ID NO: 116422

SEQ ID NO: 747554 - RNA, 64 nt, hsa; identical to SEQ ID NO: 116423

SEQ ID NO: 747555 - RNA, 64 nt, hsa; identical to SEQ ID NO: 116424

SEQ ID NO: 747556 - RNA, 64 nt, hsa; identical to SEQ ID NO: 116425

SEQ ID NO: 747557 - RNA, 64 nt, hsa; identical to SEQ ID NO: 116426

SEQ ID NO: 747558 - RNA, 64 nt, hsa; identical to SEQ ID NO: 116427

SEQ ID NO: 747559 - RNA, 64 nt, hsa; identical to SEQ ID NO: 116428

SEQ ID NO: 747560 - RNA, 64 nt, hsa; identical to SEQ ID NO: 116429

SEQ ID NO: 747561 - RNA, 64 nt, hsa; identical to SEQ ID NO: 116430

SEQ ID NO: 747562 - RNA, 64 nt, hsa; identical to SEQ ID NO: 116431

SEQ ID NO: 747563 - RNA, 64 nt, hsa; identical to SEQ ID NO: 116432

SEQ ID NO: 747564 - RNA, 64 nt, hsa; identical to SEQ ID NO: 116433

SEQ ID NO: 747565 - RNA, 64 nt, hsa; identical to SEQ ID NO: 116434

SEQ ID NO: 747566 - RNA, 64 nt, hsa; identical to SEQ ID NO: 116435

SEQ ID NO: 747567 - RNA, 64 nt, hsa; identical to SEQ ID NO: 116436

SEQ ID NO: 747568 - RNA, 64 nt, hsa; identical to SEQ ID NO: 116437

SEQ ID NO: 747569 - RNA, 64 nt, hsa; identical to SEQ ID NO: 116438

SEQ ID NO: 747570 - RNA, 64 nt, hsa; identical to SEQ ID NO: 116439

SEQ ID NO: 747571 - RNA, 64 nt, hsa; identical to SEQ ID NO: 116440

SEQ ID NO: 747572 - RNA, 64 nt, hsa; identical to SEQ ID NO: 116441

SEQ ID NO: 747573 - RNA, 64 nt, hsa; identical to SEQ ID NO: 116442

SEQ ID NO: 747574 - RNA, 64 nt, hsa; identical to SEQ ID NO: 116443

SEQ ID NO: 747575 - RNA, 64 nt, hsa; identical to SEQ ID NO: 116444

SEQ ID NO: 747576 - RNA, 64 nt, hsa; identical to SEQ ID NO: 116445

SEQ ID NO: 747577 - RNA, 64 nt, hsa; identical to SEQ ID NO: 116446

SEQ ID NO: 747578 - RNA, 64 nt, hsa; identical to SEQ ID NO: 116447

SEQ ID NO: 747579 - RNA, 64 nt, hsa; identical to SEQ ID NO: 116448

SEQ ID NO: 747580 - RNA, 64 nt, hsa; identical to SEQ ID NO: 116449

SEQ ID NO: 747581 - RNA, 64 nt, hsa; identical to SEQ ID NO: 116450

SEQ ID NO: 747582 - RNA, 64 nt, hsa; identical to SEQ ID NO: 116451

SEQ ID NO: 747583 - RNA, 64 nt, hsa; identical to SEQ ID NO: 116452

SEQ ID NO: 747584 - RNA, 64 nt, hsa; identical to SEQ ID NO: 116453

SEQ ID NO: 747585 - RNA, 64 nt, hsa; identical to SEQ ID NO: 116454

SEQ ID NO: 747586 - RNA, 64 nt, hsa; identical to SEQ ID NO: 116455

SEQ ID NO: 747587 - RNA, 64 nt, hsa; identical to SEQ ID NO: 116456

SEQ ID NO: 747588 - RNA, 64 nt, hsa; identical to SEQ ID NO: 116457

SEQ ID NO: 747589 - RNA, 64 nt, hsa; identical to SEQ ID NO: 116458

SEQ ID NO: 747590 - RNA, 64 nt, hsa; identical to SEQ ID NO: 116459

SEQ ID NO: 747591 - RNA, 64 nt, hsa; identical to SEQ ID NO: 116460

SEQ ID NO: 747592 - RNA, 64 nt, hsa; identical to SEQ ID NO: 116461

SEQ ID NO: 747593 - RNA, 64 nt, hsa; identical to SEQ ID NO: 116462

SEQ ID NO: 747594 - RNA, 64 nt, hsa; identical to SEQ ID NO: 116463

SEQ ID NO: 747595 - RNA, 64 nt, hsa; identical to SEQ ID NO: 116464

SEQ ID NO: 747596 - RNA, 64 nt, hsa; identical to SEQ ID NO: 116465

SEQ ID NO: 747597 - RNA, 64 nt, hsa; identical to SEQ ID NO: 116466

SEQ ID NO: 747598 - RNA, 64 nt, hsa; identical to SEQ ID NO: 116467

SEQ ID NO: 747599 - RNA, 64 nt, hsa; identical to SEQ ID NO: 116468

SEQ ID NO: 747600 - RNA, 64 nt, hsa; identical to SEQ ID NO: 116469

SEQ ID NO: 747601 - RNA, 64 nt, hsa; identical to SEQ ID NO: 116470

SEQ ID NO: 747602 - RNA, 64 nt, hsa; identical to SEQ ID NO: 116471

SEQ ID NO: 747603 - RNA, 64 nt, hsa; identical to SEQ ID NO: 116472

SEQ ID NO: 747604 - RNA, 64 nt, hsa; identical to SEQ ID NO: 116473

SEQ ID NO: 747605 - RNA, 64 nt, hsa; identical to SEQ ID NO: 116474

SEQ ID NO: 747606 - RNA, 64 nt, hsa; identical to SEQ ID NO: 116475

SEQ ID NO: 747607 - RNA, 64 nt, hsa; identical to SEQ ID NO: 116476

SEQ ID NO: 747608 - RNA, 64 nt, hsa; identical to SEQ ID NO: 116477

SEQ ID NO: 747609 - RNA, 64 nt, hsa; identical to SEQ ID NO: 116478

SEQ ID NO: 747610 - RNA, 64 nt, hsa; identical to SEQ ID NO: 116479

SEQ ID NO: 747611 - RNA, 64 nt, hsa; identical to SEQ ID NO: 116480

SEQ ID NO: 747612 - RNA, 64 nt, hsa; identical to SEQ ID NO: 116481

SEQ ID NO: 747613 - RNA, 64 nt, hsa; identical to SEQ ID NO: 116482

SEQ ID NO: 747614 - RNA, 64 nt, hsa; identical to SEQ ID NO: 116483

SEQ ID NO: 747615 - RNA, 64 nt, hsa; identical to SEQ ID NO: 116484

SEQ ID NO: 747616 - RNA, 64 nt, hsa; identical to SEQ ID NO: 116485

SEQ ID NO: 747617 - RNA, 64 nt, hsa; identical to SEQ ID NO: 116486

SEQ ID NO: 747618 - RNA, 64 nt, hsa; identical to SEQ ID NO: 116487

SEQ ID NO: 747619 - RNA, 64 nt, hsa; identical to SEQ ID NO: 116488

SEQ ID NO: 747620 - RNA, 64 nt, hsa; identical to SEQ ID NO: 116489

SEQ ID NO: 747621 - RNA, 64 nt, hsa; identical to SEQ ID NO: 116490

SEQ ID NO: 747622 - RNA, 64 nt, hsa; identical to SEQ ID NO: 116491

SEQ ID NO: 747623 - RNA, 64 nt, hsa; identical to SEQ ID NO: 116492

SEQ ID NO: 747624 - RNA, 64 nt, hsa; identical to SEQ ID NO: 116493

SEQ ID NO: 747625 - RNA, 64 nt, hsa; identical to SEQ ID NO: 116494

SEQ ID NO: 747626 - RNA, 64 nt, hsa; identical to SEQ ID NO: 116495

SEQ ID NO: 747627 - RNA, 64 nt, hsa; identical to SEQ ID NO: 116496

SEQ ID NO: 747628 - RNA, 64 nt, hsa; identical to SEQ ID NO: 116497

SEQ ID NO: 747629 - RNA, 64 nt, hsa; identical to SEQ ID NO: 116498

SEQ ID NO: 747630 - RNA, 64 nt, hsa; identical to SEQ ID NO: 116499

SEQ ID NO: 747631 - RNA, 64 nt, hsa; identical to SEQ ID NO: 116500

SEQ ID NO: 747632 - RNA, 64 nt, hsa; identical to SEQ ID NO: 116501

SEQ ID NO: 747633 - RNA, 64 nt, hsa; identical to SEQ ID NO: 116502

SEQ ID NO: 747634 - RNA, 64 nt, hsa; identical to SEQ ID NO: 116503

SEQ ID NO: 747635 - RNA, 64 nt, hsa; identical to SEQ ID NO: 116504

SEQ ID NO: 747636 - RNA, 64 nt, hsa; identical to SEQ ID NO: 116505

SEQ ID NO: 747637 - RNA, 64 nt, hsa; identical to SEQ ID NO: 116506

SEQ ID NO: 747638 - RNA, 64 nt, hsa; identical to SEQ ID NO: 116507

SEQ ID NO: 747639 - RNA, 64 nt, hsa; identical to SEQ ID NO: 116508

SEQ ID NO: 747640 - RNA, 64 nt, hsa; identical to SEQ ID NO: 116509

SEQ ID NO: 747641 - RNA, 64 nt, hsa; identical to SEQ ID NO: 116510

SEQ ID NO: 747642 - RNA, 64 nt, hsa; identical to SEQ ID NO: 214864

SEQ ID NO: 747643 - RNA, 64 nt, hsa; identical to SEQ ID NO: 214865

SEQ ID NO: 747644 - RNA, 64 nt, hsa; identical to SEQ ID NO: 214866

SEQ ID NO: 747645 - RNA, 64 nt, hsa; identical to SEQ ID NO: 214867

SEQ ID NO: 747646 - RNA, 64 nt, hsa; identical to SEQ ID NO: 214868

SEQ ID NO: 747647 - RNA, 64 nt, hsa; identical to SEQ ID NO: 214869

SEQ ID NO: 747648 - RNA, 64 nt, hsa; identical to SEQ ID NO: 214870

SEQ ID NO: 747649 - RNA, 64 nt, hsa; identical to SEQ ID NO: 214871

SEQ ID NO: 747650 - RNA, 64 nt, hsa; identical to SEQ ID NO: 214872

SEQ ID NO: 747651 - RNA, 64 nt, hsa; identical to SEQ ID NO: 214873

SEQ ID NO: 747652 - RNA, 64 nt, hsa; identical to SEQ ID NO: 214874

SEQ ID NO: 747653 - RNA, 64 nt, hsa; identical to SEQ ID NO: 214875

SEQ ID NO: 747654 - RNA, 64 nt, hsa; identical to SEQ ID NO: 214876

SEQ ID NO: 747655 - RNA, 64 nt, hsa; identical to SEQ ID NO: 214877

SEQ ID NO: 747656 - RNA, 64 nt, hsa; identical to SEQ ID NO: 214878

SEQ ID NO: 747657 - RNA, 64 nt, hsa; identical to SEQ ID NO: 214879

SEQ ID NO: 747658 - RNA, 64 nt, hsa; identical to SEQ ID NO: 214880

SEQ ID NO: 747659 - RNA, 64 nt, hsa; identical to SEQ ID NO: 214881

SEQ ID NO: 747660 - RNA, 64 nt, hsa; identical to SEQ ID NO: 214882

SEQ ID NO: 747661 - RNA, 64 nt, hsa; identical to SEQ ID NO: 214883

SEQ ID NO: 747662 - RNA, 64 nt, hsa; identical to SEQ ID NO: 214884

SEQ ID NO: 747663 - RNA, 64 nt, hsa; identical to SEQ ID NO: 214885

SEQ ID NO: 747664 - RNA, 64 nt, hsa; identical to SEQ ID NO: 214886

SEQ ID NO: 747665 - RNA, 64 nt, hsa; identical to SEQ ID NO: 214887

SEQ ID NO: 747666 - RNA, 64 nt, hsa; identical to SEQ ID NO: 214888

SEQ ID NO: 747667 - RNA, 64 nt, hsa; identical to SEQ ID NO: 214889

SEQ ID NO: 747668 - RNA, 64 nt, hsa; identical to SEQ ID NO: 214890

SEQ ID NO: 747669 - RNA, 64 nt, hsa; identical to SEQ ID NO: 214891

SEQ ID NO: 747670 - RNA, 64 nt, hsa; identical to SEQ ID NO: 214892

SEQ ID NO: 747671 - RNA, 64 nt, hsa; identical to SEQ ID NO: 214893

SEQ ID NO: 747672 - RNA, 64 nt, hsa; identical to SEQ ID NO: 214894

SEQ ID NO: 747673 - RNA, 64 nt, hsa; identical to SEQ ID NO: 214895

SEQ ID NO: 747674 - RNA, 64 nt, hsa; identical to SEQ ID NO: 214896

SEQ ID NO: 747675 - RNA, 64 nt, hsa; identical to SEQ ID NO: 214897

SEQ ID NO: 747676 - RNA, 62 nt, hsa
ggaaagguuuugaaaaaggaugggucccacccucccuccagagccaccaguguuagagcgga

SEQ ID NO: 747677 - RNA, 62 nt, hsa
gccccuggggaaaagcagccucccuucuccucucccuccacucccucgcucccucccucagc

SEQ ID NO: 747678 - RNA, 62 nt, hsa
gugccagcuggcaaaugagggcuggacucucuucccuccagagaccaccccgcuccuugcug

SEQ ID NO: 747679 - RNA, 62 nt, hsa
ggagggacuucccucccccucuuuuccauuucucccuccaucaccaccugcccucacauccu

SEQ ID NO: 747680 - RNA, 62 nt, hsa
cucugcuggguagagaggcacuuucagggacuucccuccagcugccucuucaucugggaaug

SEQ ID NO: 747681 - RNA, 62 nt, hsa
cuccugcccacccagggcccuuuacucucuucucccuccagaccuuccucugacccuugcug

SEQ ID NO: 747682 - RNA, 62 nt, hsa
cuuuccaucucugccugucaauaucguaccugucccuccaggcccaucucaaaucacaagga

SEQ ID NO: 747683 - RNA, 62 nt, hsa
cucccuucuccuuucuaagcccuguucuccugucccuccaucccagacauugauggggacau

SEQ ID NO: 747684 - RNA, 62 nt, hsa
cugcccuagaccuccagagaccauauuuucucucccuccauuucuacccagaccuccaggcc

SEQ ID NO: 747685 - RNA, 62 nt, hsa
auuucccuaaacgacccuuccucacauucccuucccuccaccucuccuuaccaagcacccaa

SEQ ID NO: 747686 - RNA, 62 nt, hsa
ccugaguggugaggggccacugggccccauucucccuccauggcaggaaggcgggggauuuc

SEQ ID NO: 747687 - RNA, 62 nt, hsa
uggggcuguacacacccuccagcacagacuguucccuccaagguccucuuaggucccgggag

SEQ ID NO: 747688 - RNA, 62 nt, hsa
uuucgagcucuugaccaccuccaauguguaggucccuccaggcuggggcuugggacugcuua

SEQ ID NO: 747689 - RNA, 62 nt, hsa
cuucccacagccaaagccccauccccuucauuucccuccagucccuggaggggcuucuagua

SEQ ID NO: 747690 - RNA, 62 nt, hsa
caagguaguaauaauaauuuuuccuccacaggucccuccacucauauggccucucccucccc

SEQ ID NO: 747691 - RNA, 62 nt, hsa
cugccucugugccuucucucauucuccuucucucccuccauaccccacuuuugagguucugu

SEQ ID NO: 747692 - RNA, 62 nt, hsa
ccagaguagaguguagagugugccccgugacaucccuccaucuucuccuccauuaucaucua

SEQ ID NO: 747693 - RNA, 62 nt, hsa
auguuacagcaaaucuggagccacagacagguucccuccauuggcagcccauuguguuugaa

SEQ ID NO: 747694 - RNA, 62 nt, hsa
cagccucccucccuuccagcagcgacccagcuucccuccacuuccagguggugcugggcuca

SEQ ID NO: 747695 - RNA, 62 nt, hsa
ccuugguuccuggagagugugccccuccacccucccuccagcagcccugaucacaccaugag

SEQ ID NO: 747696 - RNA, 62 nt, hsa
caaccccgaggcagccccaacuugcauuucccucccuccaggggcuauuccugucuuaggcg

SEQ ID NO: 747697 - RNA, 62 nt, hsa
caaguuaucuuuuaguuuauucugguuuggagucccuccaccaagauucaguagaagaaaua

SEQ ID NO: 747698 - RNA, 62 nt, hsa
cccuccccgcacccaccuccugucucccucccucccuccauaggaguggggggccccuagaa

SEQ ID NO: 747699 - RNA, 62 nt, hsa
caccguaguggcuaccaccucagggcagccccucccuccagcuggcggggccucagcuuccc

SEQ ID NO: 747700 - RNA, 58 nt, hsa; identical to SEQ ID NO: 111435

SEQ ID NO: 747701 - RNA, 62 nt, hsa
ggagaucaucuuguuccccuggccccccacucucccuccauguccauccaaaaaccauaaaa

SEQ ID NO: 747702 - RNA, 62 nt, hsa
gcacccaaccuguguuguugccgcccggcccuucccuccacagcucuccuuccucccgcccg

SEQ ID NO: 747703 - RNA, 62 nt, hsa
cugcucaucucugcccugaggucaccccguggucccuccacgugcccaucucucugcagugc

SEQ ID NO: 747704 - RNA, 62 nt, hsa
caccaaaucuucaucugggaauagcagcgguaucccuccacccaaguauggccaccuguuug

SEQ ID NO: 747705 - RNA, 62 nt, hsa
cagugccuuccaguauggccccaccauguuugucccuccagccucagccaagcaacaugggg

SEQ ID NO: 747706 - RNA, 62 nt, hsa
gcaaaacuucgagaaucaacaccuggagacagucccuccacugugaacaagcuuuugcagcu

SEQ ID NO: 747707 - RNA, 62 nt, hsa
gagaacaacugagggccacccggucggggccaucccuccacacucugcauccuaccccaccu

SEQ ID NO: 747708 - RNA, 62 nt, hsa
aacccugccucccugcuuccugguccagagccucccuccagugacuguggagccugagaagg

SEQ ID NO: 747709 - RNA, 62 nt, hsa
cugcucacucaagcaaaagcagccucuggccuucccuccaccgcuuugcuccaucuggcuua

SEQ ID NO: 747710 - RNA, 62 nt, hsa
uuuaauugucucaacgccucccccucccccauucccuccauuuuucucccaagaaaccugac

SEQ ID NO: 747711 - RNA, 62 nt, hsa
guuacagggaaguggucuccccaauucuccccucccuccaguauugcccccucucacuuuag

SEQ ID NO: 747712 - RNA, 62 nt, hsa
acccaguagauaaugaaccaaauuaaguucccucccuccagccagaaguuaaacaucuggga

SEQ ID NO: 747713 - RNA, 62 nt, hsa
cucaacaccaaacuggacaguagacaucaugaucccuccaguuagcucuaauuacagacccc

SEQ ID NO: 747714 - RNA, 62 nt, hsa
ggcugaggaggacaggagaagggcccagacacucccuccagugaguguccugcagcccuuau

SEQ ID NO: 747715 - RNA, 62 nt, hsa
acucccuccagugaguguccugcagcccuuauucccuccauagaaagcauccucagagcacc

SEQ ID NO: 747716 - RNA, 62 nt, hsa
gggccaaggucugggggugcuggaggccaugcucccuccaggcuugcggggagaacuucccu

SEQ ID NO: 747717 - RNA, 62 nt, hsa
acuggucccggggcuaaggaccuugcuccaagucccuccacccaugaugcugugccuuccag

SEQ ID NO: 747718 - RNA, 62 nt, hsa
ccucuccuguuucucucucuugccucccccuuucccuccauuccucugucgccucccccucu

SEQ ID NO: 747719 - RNA, 62 nt, hsa
guaaauuauccaucacuuuuguuuuaaaguggucccuccaagaauaauguggcauacacagu

SEQ ID NO: 747720 - RNA, 62 nt, hsa
ugcuccagcuugcuggauguuaccuguccucuucccuccacaagucuuggcccuuaaccuuu

SEQ ID NO: 747721 - RNA, 62 nt, hsa
ugacugacuaaagaugcuaggcgugacaccguucccuccaaaagcagaccucggaaucacug

SEQ ID NO: 747722 - RNA, 62 nt, hsa
uguguaccaagagcagcagggcagaagggcccucccuccagccuaggucagagguggggaca

SEQ ID NO: 747723 - RNA, 62 nt, hsa
agccgaaccagcacucucccggaagccuggggucccuccacaccuuggcuuuuaugacccug

SEQ ID NO: 747724 - RNA, 62 nt, hsa
caagccccaugccgugcucauccuacccccaaucccuccaauaaaccugauucugcugccca

SEQ ID NO: 747725 - RNA, 52 nt, hsa; identical to SEQ ID NO: 111460

SEQ ID NO: 747726 - RNA, 62 nt, hsa
agauccuacucuuccuuucuaaaucugagaucucccuccagggaauccgccugcagaggaca

SEQ ID NO: 747727 - RNA, 62 nt, hsa
uggcaugucagagccaggcucugccuggaggaucccuccauccggcuccugucauccccuac

SEQ ID NO: 747728 - RNA, 62 nt, hsa
ccuuugucgcucucauggcugucagauccuggucccuccacacugggugcuggggagggagg

SEQ ID NO: 747729 - RNA, 62 nt, hsa
gcuugcagacacuguuguuuuggaaaugugcuucccuccaucugaaaucucaucccuccacc

SEQ ID NO: 747730 - RNA, 62 nt, hsa
uggaaaugugcuucccuccaucugaaaucucaucccuccacccgcccacucgggcagcugug

SEQ ID NO: 747731 - RNA, 62 nt, hsa
caccccucuucccccuuccccugcgcccucccucccuccacaccuccacccguccuggggug

SEQ ID NO: 747732 - RNA, 62 nt, hsa
ggugggcgugacuucagacucucuccucucucucccuccacuccucccaacucuggccuugg

SEQ ID NO: 747733 - RNA, 64 nt, hsa
guggagguugcagugagcugagaucgugccauugugauaugaauaugccuuauaugcugauaug

SEQ ID NO: 747734 - RNA, 64 nt, hsa
ucgugccauugugauaugaauaugccuuauaugcugauaugaauaugccuuaaaauaaaguguu

SEQ ID NO: 747735 - RNA, 64 nt, hsa
guaaaguuauuagaaugguaucuguucauuuuagugauaugaagaucacaacuaacaacugaca

SEQ ID NO: 747736 - RNA, 64 nt, hsa
ucaaauucagcauggcugcagcugauuaagaaauugauaugauuauucuuugcuagccucucuu

SEQ ID NO: 747737 - RNA, 64 nt, hsa
aacauuuuagcucuauugauacucuuucuaaugcugauaugaucuugaguauaagaaaugcaua

SEQ ID NO: 747738 - RNA, 64 nt, hsa
cugugcuaaauaucaaucaagccauguauaaaugugauaugauuggcaauauguguuuacuuua

SEQ ID NO: 747739 - RNA, 64 nt, hsa
cucuugagaaagauuuaaaaugugucuaauacacugauaugaagcaguucaacuuuuuggauga

SEQ ID NO: 747740 - RNA, 64 nt, hsa
uuuguacuugucuaucuguuuaccucaguguagaugauaugaggaugguauaacuauguaaauu

SEQ ID NO: 747741 - RNA, 64 nt, hsa
uccauuugaaaaaucuugguacugcuaaauuauuugauaugaacucaauccagcauuuguagca

SEQ ID NO: 747742 - RNA, 64 nt, hsa
auuuuugucaccagcaaaacuuuucacuaauuagugauaugaaaugugauuuuuguguuguuaa

SEQ ID NO: 747743 - RNA, 64 nt, hsa
ugaagaaacuauagguauaguggugaauacucgcugauaugaaucccagaaaaaaauuuccugu

SEQ ID NO: 747744 - RNA, 64 nt, hsa
guguguccaaagaguuacuugcaacagucuuucaugauaugaggaugcccccguauuaccacuc

SEQ ID NO: 747745 - RNA, 64 nt, hsa
aaaugaagugauugcaaugccaguauaacugauaugauaugaagggggacuuaucuccugcaga

SEQ ID NO: 747746 - RNA, 64 nt, hsa
gaaaaaaaugaagugauugcaaugccaguauaacugauaugauaugaagggggacuuaucuccu

SEQ ID NO: 747747 - RNA, 64 nt, hsa
auccuggaaagugaacugggugaccuaggaccucugauaugaaugugaucugagacuaaaguuu

SEQ ID NO: 747748 - RNA, 64 nt, hsa
augauucacugaagaugaaaagauaggacggaugugauaugaaaaaaacccaaacauuuuggca

SEQ ID NO: 747749 - RNA, 64 nt, hsa
aggguccucaucuacauucucaaacaucuguggcugauaugauaugauucuuggaauuugcuuc

SEQ ID NO: 747750 - RNA, 64 nt, hsa
ccucaucuacauucucaaacaucuguggcugauaugauaugauucuuggaauuugcuucaaaau

SEQ ID NO: 747751 - RNA, 64 nt, hsa; identical to SEQ ID NO: 307447

SEQ ID NO: 747752 - RNA, 64 nt, hsa; identical to SEQ ID NO: 307448

SEQ ID NO: 747753 - RNA, 64 nt, hsa; identical to SEQ ID NO: 307449

SEQ ID NO: 747754 - RNA, 64 nt, hsa; identical to SEQ ID NO: 307450

SEQ ID NO: 747755 - RNA, 64 nt, hsa; identical to SEQ ID NO: 307451

SEQ ID NO: 747756 - RNA, 64 nt, hsa; identical to SEQ ID NO: 307452

SEQ ID NO: 747757 - RNA, 64 nt, hsa; identical to SEQ ID NO: 307453

SEQ ID NO: 747758 - RNA, 64 nt, hsa; identical to SEQ ID NO: 307454

SEQ ID NO: 747759 - RNA, 64 nt, hsa; identical to SEQ ID NO: 307455

SEQ ID NO: 747760 - RNA, 64 nt, hsa; identical to SEQ ID NO: 307456

SEQ ID NO: 747761 - RNA, 64 nt, hsa; identical to SEQ ID NO: 307457

SEQ ID NO: 747762 - RNA, 64 nt, hsa; identical to SEQ ID NO: 307458

SEQ ID NO: 747763 - RNA, 64 nt, hsa; identical to SEQ ID NO: 307459

SEQ ID NO: 747764 - RNA, 64 nt, hsa; identical to SEQ ID NO: 307460

SEQ ID NO: 747765 - RNA, 64 nt, hsa; identical to SEQ ID NO: 307461

SEQ ID NO: 747766 - RNA, 64 nt, hsa; identical to SEQ ID NO: 307462

SEQ ID NO: 747767 - RNA, 64 nt, hsa; identical to SEQ ID NO: 307463

SEQ ID NO: 747768 - RNA, 64 nt, hsa; identical to SEQ ID NO: 307464

SEQ ID NO: 747769 - RNA, 64 nt, hsa; identical to SEQ ID NO: 307465

SEQ ID NO: 747770 - RNA, 64 nt, hsa; identical to SEQ ID NO: 307466

SEQ ID NO: 747771 - RNA, 64 nt, hsa; identical to SEQ ID NO: 307467

SEQ ID NO: 747772 - RNA, 64 nt, hsa; identical to SEQ ID NO: 307468

SEQ ID NO: 747773 - RNA, 64 nt, hsa; identical to SEQ ID NO: 307469

SEQ ID NO: 747774 - RNA, 64 nt, hsa; identical to SEQ ID NO: 307470

SEQ ID NO: 747775 - RNA, 64 nt, hsa; identical to SEQ ID NO: 307471

SEQ ID NO: 747776 - RNA, 64 nt, hsa; identical to SEQ ID NO: 307472

SEQ ID NO: 747777 - RNA, 64 nt, hsa; identical to SEQ ID NO: 307473

SEQ ID NO: 747778 - RNA, 64 nt, hsa; identical to SEQ ID NO: 307474

SEQ ID NO: 747779 - RNA, 64 nt, hsa; identical to SEQ ID NO: 307475

SEQ ID NO: 747780 - RNA, 64 nt, hsa; identical to SEQ ID NO: 307476

SEQ ID NO: 747781 - RNA, 64 nt, hsa; identical to SEQ ID NO: 307477

SEQ ID NO: 747782 - RNA, 64 nt, hsa; identical to SEQ ID NO: 307478

SEQ ID NO: 747783 - RNA, 64 nt, hsa; identical to SEQ ID NO: 307479

SEQ ID NO: 747784 - RNA, 64 nt, hsa; identical to SEQ ID NO: 307480

SEQ ID NO: 747785 - RNA, 64 nt, hsa; identical to SEQ ID NO: 307481

SEQ ID NO: 747786 - RNA, 64 nt, hsa; identical to SEQ ID NO: 307482

SEQ ID NO: 747787 - RNA, 64 nt, hsa; identical to SEQ ID NO: 307483

SEQ ID NO: 747788 - RNA, 64 nt, hsa; identical to SEQ ID NO: 307484

SEQ ID NO: 747789 - RNA, 64 nt, hsa; identical to SEQ ID NO: 307485

SEQ ID NO: 747790 - RNA, 64 nt, hsa; identical to SEQ ID NO: 307486

SEQ ID NO: 747791 - RNA, 64 nt, hsa; identical to SEQ ID NO: 307487

SEQ ID NO: 747792 - RNA, 64 nt, hsa; identical to SEQ ID NO: 307488

SEQ ID NO: 747793 - RNA, 64 nt, hsa; identical to SEQ ID NO: 660864

SEQ ID NO: 747794 - RNA, 64 nt, hsa; identical to SEQ ID NO: 660865

SEQ ID NO: 747795 - RNA, 64 nt, hsa; identical to SEQ ID NO: 660866

SEQ ID NO: 747796 - RNA, 64 nt, hsa; identical to SEQ ID NO: 660867

SEQ ID NO: 747797 - RNA, 64 nt, hsa; identical to SEQ ID NO: 660868

SEQ ID NO: 747798 - RNA, 64 nt, hsa; identical to SEQ ID NO: 660869

SEQ ID NO: 747799 - RNA, 64 nt, hsa; identical to SEQ ID NO: 660870

SEQ ID NO: 747800 - RNA, 64 nt, hsa; identical to SEQ ID NO: 660871

SEQ ID NO: 747801 - RNA, 64 nt, hsa; identical to SEQ ID NO: 660872

SEQ ID NO: 747802 - RNA, 64 nt, hsa; identical to SEQ ID NO: 660873

SEQ ID NO: 747803 - RNA, 64 nt, hsa; identical to SEQ ID NO: 660874

SEQ ID NO: 747804 - RNA, 64 nt, hsa; identical to SEQ ID NO: 660875

SEQ ID NO: 747805 - RNA, 64 nt, hsa; identical to SEQ ID NO: 660876

SEQ ID NO: 747806 - RNA, 64 nt, hsa; identical to SEQ ID NO: 660877

SEQ ID NO: 747807 - RNA, 64 nt, hsa; identical to SEQ ID NO: 660878

SEQ ID NO: 747808 - RNA, 64 nt, hsa; identical to SEQ ID NO: 660879

SEQ ID NO: 747809 - RNA, 64 nt, hsa; identical to SEQ ID NO: 660880

SEQ ID NO: 747810 - RNA, 64 nt, hsa; identical to SEQ ID NO: 660881

SEQ ID NO: 747811 - RNA, 64 nt, hsa; identical to SEQ ID NO: 660882

SEQ ID NO: 747812 - RNA, 64 nt, hsa; identical to SEQ ID NO: 660883

SEQ ID NO: 747813 - RNA, 64 nt, hsa; identical to SEQ ID NO: 660884

SEQ ID NO: 747814 - RNA, 64 nt, hsa; identical to SEQ ID NO: 660885

SEQ ID NO: 747815 - RNA, 64 nt, hsa; identical to SEQ ID NO: 660886

SEQ ID NO: 747816 - RNA, 64 nt, hsa; identical to SEQ ID NO: 660887

SEQ ID NO: 747817 - RNA, 64 nt, hsa; identical to SEQ ID NO: 660888

SEQ ID NO: 747818 - RNA, 64 nt, hsa; identical to SEQ ID NO: 660889

SEQ ID NO: 747819 - RNA, 64 nt, hsa; identical to SEQ ID NO: 660890

SEQ ID NO: 747820 - RNA, 64 nt, hsa; identical to SEQ ID NO: 660891

SEQ ID NO: 747821 - RNA, 61 nt, hsa; identical to SEQ ID NO: 660892

SEQ ID NO: 747822 - RNA, 64 nt, hsa; identical to SEQ ID NO: 660893

SEQ ID NO: 747823 - RNA, 64 nt, hsa; identical to SEQ ID NO: 660894

SEQ ID NO: 747824 - RNA, 64 nt, hsa; identical to SEQ ID NO: 660895

SEQ ID NO: 747825 - RNA, 64 nt, hsa; identical to SEQ ID NO: 660896

SEQ ID NO: 747826 - RNA, 64 nt, hsa; identical to SEQ ID NO: 660897

SEQ ID NO: 747827 - RNA, 64 nt, hsa; identical to SEQ ID NO: 660898

SEQ ID NO: 747828 - RNA, 64 nt, hsa; identical to SEQ ID NO: 660899

SEQ ID NO: 747829 - RNA, 64 nt, hsa; identical to SEQ ID NO: 660900

SEQ ID NO: 747830 - RNA, 64 nt, hsa; identical to SEQ ID NO: 660901

SEQ ID NO: 747831 - RNA, 64 nt, hsa; identical to SEQ ID NO: 660902

SEQ ID NO: 747832 - RNA, 64 nt, hsa; identical to SEQ ID NO: 660903

SEQ ID NO: 747833 - RNA, 64 nt, hsa; identical to SEQ ID NO: 660904

SEQ ID NO: 747834 - RNA, 64 nt, hsa; identical to SEQ ID NO: 660905

SEQ ID NO: 747835 - RNA, 64 nt, hsa; identical to SEQ ID NO: 660906

SEQ ID NO: 747836 - RNA, 64 nt, hsa; identical to SEQ ID NO: 660907

SEQ ID NO: 747837 - RNA, 64 nt, hsa; identical to SEQ ID NO: 660908

SEQ ID NO: 747838 - RNA, 64 nt, hsa; identical to SEQ ID NO: 660909

SEQ ID NO: 747839 - RNA, 64 nt, hsa; identical to SEQ ID NO: 660910

SEQ ID NO: 747840 - RNA, 64 nt, hsa; identical to SEQ ID NO: 660911

SEQ ID NO: 747841 - RNA, 64 nt, hsa; identical to SEQ ID NO: 660912

SEQ ID NO: 747842 - RNA, 64 nt, hsa; identical to SEQ ID NO: 660913

SEQ ID NO: 747843 - RNA, 64 nt, hsa; identical to SEQ ID NO: 660914

SEQ ID NO: 747844 - RNA, 64 nt, hsa; identical to SEQ ID NO: 660915

SEQ ID NO: 747845 - RNA, 64 nt, hsa; identical to SEQ ID NO: 660916

SEQ ID NO: 747846 - RNA, 64 nt, hsa; identical to SEQ ID NO: 660917

SEQ ID NO: 747847 - RNA, 64 nt, hsa; identical to SEQ ID NO: 660918

SEQ ID NO: 747848 - RNA, 64 nt, hsa; identical to SEQ ID NO: 660919

SEQ ID NO: 747849 - RNA, 51 nt, hsa; identical to SEQ ID NO: 660920

SEQ ID NO: 747850 - RNA, 64 nt, hsa; identical to SEQ ID NO: 660921

SEQ ID NO: 747851 - RNA, 64 nt, hsa; identical to SEQ ID NO: 660922

SEQ ID NO: 747852 - RNA, 64 nt, hsa; identical to SEQ ID NO: 660923

SEQ ID NO: 747853 - RNA, 64 nt, hsa; identical to SEQ ID NO: 660924

SEQ ID NO: 747854 - RNA, 64 nt, hsa; identical to SEQ ID NO: 660925

SEQ ID NO: 747855 - RNA, 64 nt, hsa; identical to SEQ ID NO: 660926

SEQ ID NO: 747856 - RNA, 64 nt, hsa; identical to SEQ ID NO: 660927

SEQ ID NO: 747857 - RNA, 64 nt, hsa; identical to SEQ ID NO: 660928

SEQ ID NO: 747858 - RNA, 64 nt, hsa; identical to SEQ ID NO: 660929

SEQ ID NO: 747859 - RNA, 64 nt, hsa; identical to SEQ ID NO: 660930

SEQ ID NO: 747860 - RNA, 62 nt, hsa
acaagccacaaggaccaauguagguauucuccccgccccaucuucaaggcucagcgacugag

SEQ ID NO: 747861 - RNA, 62 nt, hsa
caauuguucccucuggagggguccaggugcccccgccccacaaggccgcggagccucagcag

SEQ ID NO: 747862 - RNA, 62 nt, hsa
acuucaguguuuucuacaauacuccuccugccccgccccauuaaaacaguucuuuuguuaag

SEQ ID NO: 747863 - RNA, 62 nt, hsa
gaccuggagcagucagagggcccucagucaccccgccccauuccucaccagagaaaagaauc

SEQ ID NO: 747864 - RNA, 62 nt, hsa
acuggcagccaggccugucgggccccccgacgccgccccauuucccuuccagcaaacucaac

SEQ ID NO: 747865 - RNA, 62 nt, hsa
cgcaccugcccgccucggcguucgugacucagccgccccaucccgagucgcuaaggggcugc

SEQ ID NO: 747866 - RNA, 62 nt, hsa
ccuccuugccgcuguguggggcaguccccuguccgccccaaaacccggccuuggucccuggc

SEQ ID NO: 747867 - RNA, 62 nt, hsa
ccccgccccgggcaggggggcggcgggugggcccgccccacgcacgcacgcacacucgggga

SEQ ID NO: 747868 - RNA, 62 nt, hsa
cgcccccagcccugcaugcaggugcccucgcuccgccccaucaguuccugccccugccccuc

SEQ ID NO: 747869 - RNA, 62 nt, hsa
acgcacgcacgcacacggccccgcacacagccccgccccaccccgcaaccagcccugucgac

SEQ ID NO: 747870 - RNA, 61 nt, hsa; identical to SEQ ID NO: 312339

SEQ ID NO: 747871 - RNA, 62 nt, hsa
ccucggccgugacauucggggccgggcgggacccgccccacagacuccaacuuccccuccaa

SEQ ID NO: 747872 - RNA, 62 nt, hsa
ugagagggggaagaagcggggaggaagaaaucccgccccaaacguccgcuuuccuuuucucu

SEQ ID NO: 747873 - RNA, 62 nt, hsa
gagcccucgcccccgacucucggucggccuccccgccccaggcgucacucagugaucacggg

SEQ ID NO: 747874 - RNA, 62 nt, hsa
cagagcugggcccccugggcagguuccccaccccgccccaccgcauccuucucggagcuggu

SEQ ID NO: 747875 - RNA, 62 nt, hsa
cggaccgcgggccggaaggaggcgcccccgccccgccccagagcugggcccccugggcaggu

SEQ ID NO: 747876 - RNA, 62 nt, hsa
uucauuuggggggugggagauuuuggcugaagccgccccagccuuaguccccagggccaagc

SEQ ID NO: 747877 - RNA, 62 nt, hsa
ugugaauccugugcucugcccgugaccgccccccgccccaucaaucccauugcauagguuua

SEQ ID NO: 747878 - RNA, 64 nt, hsa; identical to SEQ ID NO: 313188

SEQ ID NO: 747879 - RNA, 64 nt, hsa; identical to SEQ ID NO: 313189

SEQ ID NO: 747880 - RNA, 64 nt, hsa; identical to SEQ ID NO: 313190

SEQ ID NO: 747881 - RNA, 64 nt, hsa; identical to SEQ ID NO: 313191

SEQ ID NO: 747882 - RNA, 64 nt, hsa; identical to SEQ ID NO: 313192

SEQ ID NO: 747883 - RNA, 64 nt, hsa; identical to SEQ ID NO: 313193

SEQ ID NO: 747884 - RNA, 64 nt, hsa; identical to SEQ ID NO: 313194

SEQ ID NO: 747885 - RNA, 64 nt, hsa; identical to SEQ ID NO: 313195

SEQ ID NO: 747886 - RNA, 64 nt, hsa; identical to SEQ ID NO: 313196

SEQ ID NO: 747887 - RNA, 64 nt, hsa; identical to SEQ ID NO: 313197

SEQ ID NO: 747888 - RNA, 64 nt, hsa; identical to SEQ ID NO: 313198

SEQ ID NO: 747889 - RNA, 64 nt, hsa; identical to SEQ ID NO: 313199

SEQ ID NO: 747890 - RNA, 64 nt, hsa; identical to SEQ ID NO: 313200

SEQ ID NO: 747891 - RNA, 64 nt, hsa; identical to SEQ ID NO: 313201

SEQ ID NO: 747892 - RNA, 60 nt, hsa
aaccuggggaacuguauuuuuaaaugaagagcuauuuauauauauuauuuuuuuuuaaga

SEQ ID NO: 747893 - RNA, 60 nt, hsa
uucuaaacugcucaauuuugacucaaaggugcuauuuaccaaacacucucccuacccauu

SEQ ID NO: 747894 - RNA, 60 nt, hsa
uaccagagcaucuucuuaucuuuccacagagcuauuuacauccuggacuauauaacuuaa

SEQ ID NO: 747895 - RNA, 60 nt, hsa
auuauggcuaaaauauaugucuaacccagugcuauuuaggugaaaaugcuaauugauaaa

SEQ ID NO: 747896 - RNA, 60 nt, hsa
gaggacucucuuagaaugagugauucaccugcuauuuaaaugaauuauuuagauuuuuga

SEQ ID NO: 747897 - RNA, 60 nt, hsa
cuuagcaaacuuuugaaucuuucuuuuauugcuauuuacacauacauacacacauacaaa

SEQ ID NO: 747898 - RNA, 60 nt, hsa
guuuaaugugguaccaaacugaaaauaggagcuauuuauagauggagcagcacuuagugc

SEQ ID NO: 747899 - RNA, 60 nt, hsa
agguuagaccggcuuuugaccauauucaucgcuauuuaaaaccuguggcaaaaugaacgc

SEQ ID NO: 747900 - RNA, 60 nt, hsa
gaugcuucugggagacacccaaagggugaagcuauuuaucuguaguaaacuauuuaucug

SEQ ID NO: 747901 - RNA, 60 nt, hsa
aacacaccagugucuguucuugaugcaguugcuauuuaggaugaguuaagugccugggga

SEQ ID NO: 747902 - RNA, 60 nt, hsa
uuggugccaauaaacuacuuuuuuuguagugcuauuuaauuuugauuaaauuuagguagc

SEQ ID NO: 747903 - RNA, 60 nt, hsa
aggugugccuuguauaacugaauuuauggugcuauuuaaacaauuuuuuucuaacgugaa

SEQ ID NO: 747904 - RNA, 60 nt, hsa
uuaaauuaaguaguuuuaaucagcuuaaaagcuauuuaacccauuuuaauaagcuugcag

SEQ ID NO: 747905 - RNA, 60 nt, hsa
caaguaacucuacuaacagauguugguauagcuauuuaaagacuacuucguaaguaguau

SEQ ID NO: 747906 - RNA, 64 nt, hsa; identical to SEQ ID NO: 298084

SEQ ID NO: 747907 - RNA, 64 nt, hsa; identical to SEQ ID NO: 298085

SEQ ID NO: 747908 - RNA, 64 nt, hsa; identical to SEQ ID NO: 298086

SEQ ID NO: 747909 - RNA, 64 nt, hsa; identical to SEQ ID NO: 298087

SEQ ID NO: 747910 - RNA, 64 nt, hsa; identical to SEQ ID NO: 298088

SEQ ID NO: 747911 - RNA, 64 nt, hsa; identical to SEQ ID NO: 298089

SEQ ID NO: 747912 - RNA, 64 nt, hsa; identical to SEQ ID NO: 561895

SEQ ID NO: 747913 - RNA, 64 nt, hsa; identical to SEQ ID NO: 561896

SEQ ID NO: 747914 - RNA, 64 nt, hsa; identical to SEQ ID NO: 561897

SEQ ID NO: 747915 - RNA, 64 nt, hsa; identical to SEQ ID NO: 561898

SEQ ID NO: 747916 - RNA, 64 nt, hsa; identical to SEQ ID NO: 561899

SEQ ID NO: 747917 - RNA, 64 nt, hsa; identical to SEQ ID NO: 561900

SEQ ID NO: 747918 - RNA, 64 nt, hsa; identical to SEQ ID NO: 561901

SEQ ID NO: 747919 - RNA, 64 nt, hsa; identical to SEQ ID NO: 561902

SEQ ID NO: 747920 - RNA, 64 nt, hsa; identical to SEQ ID NO: 561903

SEQ ID NO: 747921 - RNA, 64 nt, hsa; identical to SEQ ID NO: 561904

SEQ ID NO: 747922 - RNA, 64 nt, hsa; identical to SEQ ID NO: 561905

SEQ ID NO: 747923 - RNA, 64 nt, hsa; identical to SEQ ID NO: 561906

SEQ ID NO: 747924 - RNA, 64 nt, hsa; identical to SEQ ID NO: 561907

SEQ ID NO: 747925 - RNA, 64 nt, hsa; identical to SEQ ID NO: 561908

SEQ ID NO: 747926 - RNA, 64 nt, hsa; identical to SEQ ID NO: 561909

SEQ ID NO: 747927 - RNA, 64 nt, hsa; identical to SEQ ID NO: 561910

SEQ ID NO: 747928 - RNA, 64 nt, hsa; identical to SEQ ID NO: 561911

SEQ ID NO: 747929 - RNA, 64 nt, hsa; identical to SEQ ID NO: 561912

SEQ ID NO: 747930 - RNA, 64 nt, hsa; identical to SEQ ID NO: 514253

SEQ ID NO: 747931 - RNA, 64 nt, hsa; identical to SEQ ID NO: 514254

SEQ ID NO: 747932 - RNA, 64 nt, hsa; identical to SEQ ID NO: 514255

SEQ ID NO: 747933 - RNA, 64 nt, hsa; identical to SEQ ID NO: 514256

SEQ ID NO: 747934 - RNA, 64 nt, hsa; identical to SEQ ID NO: 514257

SEQ ID NO: 747935 - RNA, 64 nt, hsa; identical to SEQ ID NO: 514258

SEQ ID NO: 747936 - RNA, 64 nt, hsa; identical to SEQ ID NO: 514259

SEQ ID NO: 747937 - RNA, 64 nt, hsa; identical to SEQ ID NO: 514260

SEQ ID NO: 747938 - RNA, 64 nt, hsa; identical to SEQ ID NO: 514261

SEQ ID NO: 747939 - RNA, 64 nt, hsa; identical to SEQ ID NO: 514262

SEQ ID NO: 747940 - RNA, 64 nt, hsa; identical to SEQ ID NO: 514263

SEQ ID NO: 747941 - RNA, 64 nt, hsa; identical to SEQ ID NO: 514264

SEQ ID NO: 747942 - RNA, 64 nt, hsa; identical to SEQ ID NO: 514265

SEQ ID NO: 747943 - RNA, 64 nt, hsa; identical to SEQ ID NO: 514266

SEQ ID NO: 747944 - RNA, 64 nt, hsa; identical to SEQ ID NO: 514267

SEQ ID NO: 747945 - RNA, 64 nt, hsa; identical to SEQ ID NO: 514268

SEQ ID NO: 747946 - RNA, 64 nt, hsa; identical to SEQ ID NO: 225411

SEQ ID NO: 747947 - RNA, 64 nt, hsa; identical to SEQ ID NO: 225412

SEQ ID NO: 747948 - RNA, 64 nt, hsa; identical to SEQ ID NO: 225413

SEQ ID NO: 747949 - RNA, 64 nt, hsa; identical to SEQ ID NO: 225414

SEQ ID NO: 747950 - RNA, 64 nt, hsa; identical to SEQ ID NO: 225415

SEQ ID NO: 747951 - RNA, 64 nt, hsa; identical to SEQ ID NO: 225416

SEQ ID NO: 747952 - RNA, 64 nt, hsa; identical to SEQ ID NO: 225417

SEQ ID NO: 747953 - RNA, 64 nt, hsa; identical to SEQ ID NO: 225418

SEQ ID NO: 747954 - RNA, 64 nt, hsa; identical to SEQ ID NO: 225419

SEQ ID NO: 747955 - RNA, 64 nt, hsa; identical to SEQ ID NO: 225420

SEQ ID NO: 747956 - RNA, 64 nt, hsa; identical to SEQ ID NO: 225421

SEQ ID NO: 747957 - RNA, 64 nt, hsa; identical to SEQ ID NO: 225422

SEQ ID NO: 747958 - RNA, 64 nt, hsa; identical to SEQ ID NO: 225423

SEQ ID NO: 747959 - RNA, 64 nt, hsa; identical to SEQ ID NO: 225424

SEQ ID NO: 747960 - RNA, 64 nt, hsa; identical to SEQ ID NO: 225425

SEQ ID NO: 747961 - RNA, 64 nt, hsa; identical to SEQ ID NO: 225426

SEQ ID NO: 747962 - RNA, 64 nt, hsa; identical to SEQ ID NO: 225427

SEQ ID NO: 747963 - RNA, 64 nt, hsa; identical to SEQ ID NO: 133971

SEQ ID NO: 747964 - RNA, 64 nt, hsa; identical to SEQ ID NO: 133972

SEQ ID NO: 747965 - RNA, 64 nt, hsa; identical to SEQ ID NO: 133973

SEQ ID NO: 747966 - RNA, 64 nt, hsa; identical to SEQ ID NO: 133974

SEQ ID NO: 747967 - RNA, 64 nt, hsa; identical to SEQ ID NO: 133975

SEQ ID NO: 747968 - RNA, 64 nt, hsa; identical to SEQ ID NO: 133976

SEQ ID NO: 747969 - RNA, 64 nt, hsa; identical to SEQ ID NO: 133977

SEQ ID NO: 747970 - RNA, 64 nt, hsa; identical to SEQ ID NO: 133978

SEQ ID NO: 747971 - RNA, 64 nt, hsa; identical to SEQ ID NO: 133979

SEQ ID NO: 747972 - RNA, 64 nt, hsa; identical to SEQ ID NO: 133980

SEQ ID NO: 747973 - RNA, 64 nt, hsa; identical to SEQ ID NO: 133981

SEQ ID NO: 747974 - RNA, 64 nt, hsa; identical to SEQ ID NO: 133982

SEQ ID NO: 747975 - RNA, 64 nt, hsa; identical to SEQ ID NO: 133983

SEQ ID NO: 747976 - RNA, 64 nt, hsa; identical to SEQ ID NO: 133984

SEQ ID NO: 747977 - RNA, 64 nt, hsa; identical to SEQ ID NO: 133985

SEQ ID NO: 747978 - RNA, 64 nt, hsa; identical to SEQ ID NO: 133986

SEQ ID NO: 747979 - RNA, 64 nt, hsa; identical to SEQ ID NO: 133987

SEQ ID NO: 747980 - RNA, 64 nt, hsa; identical to SEQ ID NO: 133988

SEQ ID NO: 747981 - RNA, 64 nt, hsa; identical to SEQ ID NO: 133989

SEQ ID NO: 747982 - RNA, 64 nt, hsa; identical to SEQ ID NO: 133990

SEQ ID NO: 747983 - RNA, 64 nt, hsa; identical to SEQ ID NO: 133991

SEQ ID NO: 747984 - RNA, 64 nt, hsa; identical to SEQ ID NO: 133992

SEQ ID NO: 747985 - RNA, 64 nt, hsa; identical to SEQ ID NO: 218520

SEQ ID NO: 747986 - RNA, 64 nt, hsa; identical to SEQ ID NO: 218521

SEQ ID NO: 747987 - RNA, 64 nt, hsa; identical to SEQ ID NO: 218522

SEQ ID NO: 747988 - RNA, 64 nt, hsa; identical to SEQ ID NO: 218523

SEQ ID NO: 747989 - RNA, 64 nt, hsa; identical to SEQ ID NO: 218524

SEQ ID NO: 747990 - RNA, 64 nt, hsa; identical to SEQ ID NO: 218525

SEQ ID NO: 747991 - RNA, 64 nt, hsa; identical to SEQ ID NO: 218526

SEQ ID NO: 747992 - RNA, 64 nt, hsa; identical to SEQ ID NO: 218527

SEQ ID NO: 747993 - RNA, 64 nt, hsa; identical to SEQ ID NO: 218528

SEQ ID NO: 747994 - RNA, 64 nt, hsa; identical to SEQ ID NO: 218529

SEQ ID NO: 747995 - RNA, 64 nt, hsa; identical to SEQ ID NO: 218530

SEQ ID NO: 747996 - RNA, 64 nt, hsa; identical to SEQ ID NO: 218531

SEQ ID NO: 747997 - RNA, 64 nt, hsa; identical to SEQ ID NO: 218532

SEQ ID NO: 747998 - RNA, 64 nt, hsa; identical to SEQ ID NO: 218533

SEQ ID NO: 747999 - RNA, 64 nt, hsa; identical to SEQ ID NO: 218534

SEQ ID NO: 748000 - RNA, 64 nt, hsa; identical to SEQ ID NO: 218535

SEQ ID NO: 748001 - RNA, 64 nt, hsa; identical to SEQ ID NO: 218536

SEQ ID NO: 748002 - RNA, 64 nt, hsa; identical to SEQ ID NO: 218537

SEQ ID NO: 748003 - RNA, 64 nt, hsa; identical to SEQ ID NO: 218538

SEQ ID NO: 748004 - RNA, 61 nt, hsa; identical to SEQ ID NO: 218539

SEQ ID NO: 748005 - RNA, 64 nt, hsa; identical to SEQ ID NO: 218540

SEQ ID NO: 748006 - RNA, 64 nt, hsa; identical to SEQ ID NO: 218541

SEQ ID NO: 748007 - RNA, 64 nt, hsa; identical to SEQ ID NO: 218542

SEQ ID NO: 748008 - RNA, 64 nt, hsa; identical to SEQ ID NO: 218543

SEQ ID NO: 748009 - RNA, 64 nt, hsa; identical to SEQ ID NO: 218544

SEQ ID NO: 748010 - RNA, 64 nt, hsa; identical to SEQ ID NO: 218545

SEQ ID NO: 748011 - RNA, 64 nt, hsa; identical to SEQ ID NO: 218546

SEQ ID NO: 748012 - RNA, 64 nt, hsa; identical to SEQ ID NO: 218547

SEQ ID NO: 748013 - RNA, 64 nt, hsa; identical to SEQ ID NO: 218548

SEQ ID NO: 748014 - RNA, 64 nt, hsa; identical to SEQ ID NO: 218549

SEQ ID NO: 748015 - RNA, 64 nt, hsa; identical to SEQ ID NO: 218550

SEQ ID NO: 748016 - RNA, 64 nt, hsa; identical to SEQ ID NO: 218551

SEQ ID NO: 748017 - RNA, 64 nt, hsa; identical to SEQ ID NO: 218552

SEQ ID NO: 748018 - RNA, 64 nt, hsa; identical to SEQ ID NO: 218553

SEQ ID NO: 748019 - RNA, 63 nt, hsa; identical to SEQ ID NO: 218554

SEQ ID NO: 748020 - RNA, 64 nt, hsa; identical to SEQ ID NO: 218555

SEQ ID NO: 748021 - RNA, 64 nt, hsa; identical to SEQ ID NO: 218556

SEQ ID NO: 748022 - RNA, 64 nt, hsa; identical to SEQ ID NO: 218557

SEQ ID NO: 748023 - RNA, 64 nt, hsa; identical to SEQ ID NO: 218558

SEQ ID NO: 748024 - RNA, 64 nt, hsa; identical to SEQ ID NO: 218559

SEQ ID NO: 748025 - RNA, 64 nt, hsa; identical to SEQ ID NO: 218560

SEQ ID NO: 748026 - RNA, 64 nt, hsa; identical to SEQ ID NO: 218561

SEQ ID NO: 748027 - RNA, 64 nt, hsa; identical to SEQ ID NO: 218562

SEQ ID NO: 748028 - RNA, 64 nt, hsa; identical to SEQ ID NO: 218563

SEQ ID NO: 748029 - RNA, 64 nt, hsa; identical to SEQ ID NO: 218564

SEQ ID NO: 748030 - RNA, 64 nt, hsa; identical to SEQ ID NO: 218565

SEQ ID NO: 748031 - RNA, 64 nt, hsa; identical to SEQ ID NO: 218566

SEQ ID NO: 748032 - RNA, 64 nt, hsa; identical to SEQ ID NO: 218567

SEQ ID NO: 748033 - RNA, 64 nt, hsa; identical to SEQ ID NO: 218568

SEQ ID NO: 748034 - RNA, 64 nt, hsa; identical to SEQ ID NO: 218569

SEQ ID NO: 748035 - RNA, 64 nt, hsa; identical to SEQ ID NO: 218570

SEQ ID NO: 748036 - RNA, 64 nt, hsa; identical to SEQ ID NO: 218571

SEQ ID NO: 748037 - RNA, 64 nt, hsa; identical to SEQ ID NO: 218572

SEQ ID NO: 748038 - RNA, 64 nt, hsa; identical to SEQ ID NO: 218573

SEQ ID NO: 748039 - RNA, 64 nt, hsa; identical to SEQ ID NO: 218574

SEQ ID NO: 748040 - RNA, 64 nt, hsa; identical to SEQ ID NO: 218575

SEQ ID NO: 748041 - RNA, 64 nt, hsa; identical to SEQ ID NO: 218576

SEQ ID NO: 748042 - RNA, 64 nt, hsa; identical to SEQ ID NO: 218577

SEQ ID NO: 748043 - RNA, 64 nt, hsa; identical to SEQ ID NO: 218578

SEQ ID NO: 748044 - RNA, 64 nt, hsa; identical to SEQ ID NO: 218579

SEQ ID NO: 748045 - RNA, 64 nt, hsa; identical to SEQ ID NO: 218580

SEQ ID NO: 748046 - RNA, 64 nt, hsa; identical to SEQ ID NO: 218581

SEQ ID NO: 748047 - RNA, 64 nt, hsa; identical to SEQ ID NO: 218582

SEQ ID NO: 748048 - RNA, 64 nt, hsa; identical to SEQ ID NO: 218583

SEQ ID NO: 748049 - RNA, 64 nt, hsa; identical to SEQ ID NO: 218584

SEQ ID NO: 748050 - RNA, 64 nt, hsa; identical to SEQ ID NO: 218585

SEQ ID NO: 748051 - RNA, 64 nt, hsa; identical to SEQ ID NO: 218586

SEQ ID NO: 748052 - RNA, 64 nt, hsa; identical to SEQ ID NO: 218587

SEQ ID NO: 748053 - RNA, 64 nt, hsa; identical to SEQ ID NO: 218588

SEQ ID NO: 748054 - RNA, 64 nt, hsa; identical to SEQ ID NO: 218589

SEQ ID NO: 748055 - RNA, 64 nt, hsa; identical to SEQ ID NO: 218590

SEQ ID NO: 748056 - RNA, 64 nt, hsa; identical to SEQ ID NO: 218591

SEQ ID NO: 748057 - RNA, 64 nt, hsa; identical to SEQ ID NO: 218592

SEQ ID NO: 748058 - RNA, 64 nt, hsa; identical to SEQ ID NO: 218593

SEQ ID NO: 748059 - RNA, 64 nt, hsa; identical to SEQ ID NO: 218594

SEQ ID NO: 748060 - RNA, 64 nt, hsa; identical to SEQ ID NO: 218595

SEQ ID NO: 748061 - RNA, 64 nt, hsa; identical to SEQ ID NO: 218596

SEQ ID NO: 748062 - RNA, 64 nt, hsa; identical to SEQ ID NO: 218597

SEQ ID NO: 748063 - RNA, 64 nt, hsa; identical to SEQ ID NO: 218598

SEQ ID NO: 748064 - RNA, 64 nt, hsa; identical to SEQ ID NO: 218599

SEQ ID NO: 748065 - RNA, 64 nt, hsa; identical to SEQ ID NO: 218600

SEQ ID NO: 748066 - RNA, 64 nt, hsa; identical to SEQ ID NO: 218601

SEQ ID NO: 748067 - RNA, 64 nt, hsa; identical to SEQ ID NO: 218602

SEQ ID NO: 748068 - RNA, 64 nt, hsa; identical to SEQ ID NO: 218603

SEQ ID NO: 748069 - RNA, 64 nt, hsa; identical to SEQ ID NO: 218604

SEQ ID NO: 748070 - RNA, 64 nt, hsa; identical to SEQ ID NO: 218605

SEQ ID NO: 748071 - RNA, 64 nt, hsa; identical to SEQ ID NO: 218606

SEQ ID NO: 748072 - RNA, 64 nt, hsa; identical to SEQ ID NO: 218607

SEQ ID NO: 748073 - RNA, 64 nt, hsa; identical to SEQ ID NO: 218608

SEQ ID NO: 748074 - RNA, 64 nt, hsa; identical to SEQ ID NO: 218609

SEQ ID NO: 748075 - RNA, 64 nt, hsa; identical to SEQ ID NO: 218610

SEQ ID NO: 748076 - RNA, 64 nt, hsa; identical to SEQ ID NO: 218611

SEQ ID NO: 748077 - RNA, 64 nt, hsa; identical to SEQ ID NO: 218612

SEQ ID NO: 748078 - RNA, 62 nt, hsa; identical to SEQ ID NO: 218613

SEQ ID NO: 748079 - RNA, 64 nt, hsa; identical to SEQ ID NO: 218614

SEQ ID NO: 748080 - RNA, 64 nt, hsa; identical to SEQ ID NO: 218615

SEQ ID NO: 748081 - RNA, 64 nt, hsa; identical to SEQ ID NO: 218616

SEQ ID NO: 748082 - RNA, 64 nt, hsa; identical to SEQ ID NO: 218617

SEQ ID NO: 748083 - RNA, 64 nt, hsa; identical to SEQ ID NO: 218618

SEQ ID NO: 748084 - RNA, 64 nt, hsa; identical to SEQ ID NO: 218619

SEQ ID NO: 748085 - RNA, 64 nt, hsa; identical to SEQ ID NO: 218620

SEQ ID NO: 748086 - RNA, 64 nt, hsa; identical to SEQ ID NO: 218621

SEQ ID NO: 748087 - RNA, 64 nt, hsa; identical to SEQ ID NO: 218622

SEQ ID NO: 748088 - RNA, 64 nt, hsa; identical to SEQ ID NO: 218623

SEQ ID NO: 748089 - RNA, 64 nt, hsa; identical to SEQ ID NO: 218624

SEQ ID NO: 748090 - RNA, 64 nt, hsa; identical to SEQ ID NO: 218625

SEQ ID NO: 748091 - RNA, 64 nt, hsa; identical to SEQ ID NO: 218626

SEQ ID NO: 748092 - RNA, 64 nt, hsa; identical to SEQ ID NO: 218627

SEQ ID NO: 748093 - RNA, 64 nt, hsa; identical to SEQ ID NO: 218628

SEQ ID NO: 748094 - RNA, 64 nt, hsa; identical to SEQ ID NO: 218629

SEQ ID NO: 748095 - RNA, 64 nt, hsa; identical to SEQ ID NO: 218630

SEQ ID NO: 748096 - RNA, 64 nt, hsa; identical to SEQ ID NO: 218631

SEQ ID NO: 748097 - RNA, 64 nt, hsa; identical to SEQ ID NO: 218632

SEQ ID NO: 748098 - RNA, 64 nt, hsa; identical to SEQ ID NO: 218633

SEQ ID NO: 748099 - RNA, 64 nt, hsa; identical to SEQ ID NO: 218634

SEQ ID NO: 748100 - RNA, 64 nt, hsa; identical to SEQ ID NO: 218635

SEQ ID NO: 748101 - RNA, 64 nt, hsa; identical to SEQ ID NO: 218636

SEQ ID NO: 748102 - RNA, 64 nt, hsa; identical to SEQ ID NO: 218637

SEQ ID NO: 748103 - RNA, 64 nt, hsa; identical to SEQ ID NO: 218638

SEQ ID NO: 748104 - RNA, 64 nt, hsa; identical to SEQ ID NO: 218639

SEQ ID NO: 748105 - RNA, 64 nt, hsa; identical to SEQ ID NO: 218640

SEQ ID NO: 748106 - RNA, 64 nt, hsa; identical to SEQ ID NO: 218641

SEQ ID NO: 748107 - RNA, 64 nt, hsa; identical to SEQ ID NO: 218642

SEQ ID NO: 748108 - RNA, 64 nt, hsa; identical to SEQ ID NO: 218643

SEQ ID NO: 748109 - RNA, 64 nt, hsa; identical to SEQ ID NO: 218644

SEQ ID NO: 748110 - RNA, 64 nt, hsa; identical to SEQ ID NO: 218645

SEQ ID NO: 748111 - RNA, 64 nt, hsa; identical to SEQ ID NO: 218646

SEQ ID NO: 748112 - RNA, 64 nt, hsa; identical to SEQ ID NO: 218647

SEQ ID NO: 748113 - RNA, 64 nt, hsa; identical to SEQ ID NO: 218648

SEQ ID NO: 748114 - RNA, 64 nt, hsa; identical to SEQ ID NO: 218649

SEQ ID NO: 748115 - RNA, 64 nt, hsa; identical to SEQ ID NO: 218650

SEQ ID NO: 748116 - RNA, 64 nt, hsa; identical to SEQ ID NO: 218651

SEQ ID NO: 748117 - RNA, 64 nt, hsa; identical to SEQ ID NO: 218652

SEQ ID NO: 748118 - RNA, 64 nt, hsa; identical to SEQ ID NO: 218653

SEQ ID NO: 748119 - RNA, 64 nt, hsa; identical to SEQ ID NO: 218654

SEQ ID NO: 748120 - RNA, 64 nt, hsa; identical to SEQ ID NO: 218655

SEQ ID NO: 748121 - RNA, 64 nt, hsa; identical to SEQ ID NO: 218656

SEQ ID NO: 748122 - RNA, 64 nt, hsa; identical to SEQ ID NO: 218657

SEQ ID NO: 748123 - RNA, 64 nt, hsa; identical to SEQ ID NO: 218658

SEQ ID NO: 748124 - RNA, 64 nt, hsa; identical to SEQ ID NO: 218659

SEQ ID NO: 748125 - RNA, 64 nt, hsa; identical to SEQ ID NO: 218660

SEQ ID NO: 748126 - RNA, 64 nt, hsa; identical to SEQ ID NO: 218661

SEQ ID NO: 748127 - RNA, 61 nt, hsa; identical to SEQ ID NO: 218662

SEQ ID NO: 748128 - RNA, 64 nt, hsa; identical to SEQ ID NO: 218663

SEQ ID NO: 748129 - RNA, 64 nt, hsa; identical to SEQ ID NO: 218664

SEQ ID NO: 748130 - RNA, 64 nt, hsa; identical to SEQ ID NO: 218665

SEQ ID NO: 748131 - RNA, 64 nt, hsa; identical to SEQ ID NO: 218666

SEQ ID NO: 748132 - RNA, 64 nt, hsa; identical to SEQ ID NO: 218667

SEQ ID NO: 748133 - RNA, 64 nt, hsa; identical to SEQ ID NO: 218668

SEQ ID NO: 748134 - RNA, 64 nt, hsa; identical to SEQ ID NO: 218669

SEQ ID NO: 748135 - RNA, 64 nt, hsa; identical to SEQ ID NO: 218670

SEQ ID NO: 748136 - RNA, 64 nt, hsa; identical to SEQ ID NO: 218671

SEQ ID NO: 748137 - RNA, 64 nt, hsa; identical to SEQ ID NO: 218672

SEQ ID NO: 748138 - RNA, 64 nt, hsa; identical to SEQ ID NO: 218673

SEQ ID NO: 748139 - RNA, 64 nt, hsa; identical to SEQ ID NO: 218674

SEQ ID NO: 748140 - RNA, 64 nt, hsa; identical to SEQ ID NO: 218675

SEQ ID NO: 748141 - RNA, 64 nt, hsa; identical to SEQ ID NO: 218676

SEQ ID NO: 748142 - RNA, 64 nt, hsa; identical to SEQ ID NO: 218677

SEQ ID NO: 748143 - RNA, 64 nt, hsa; identical to SEQ ID NO: 218678

SEQ ID NO: 748144 - RNA, 64 nt, hsa; identical to SEQ ID NO: 218679

SEQ ID NO: 748145 - RNA, 64 nt, hsa; identical to SEQ ID NO: 218680

SEQ ID NO: 748146 - RNA, 64 nt, hsa; identical to SEQ ID NO: 218681

SEQ ID NO: 748147 - RNA, 64 nt, hsa; identical to SEQ ID NO: 218682

SEQ ID NO: 748148 - RNA, 64 nt, hsa; identical to SEQ ID NO: 218683

SEQ ID NO: 748149 - RNA, 64 nt, hsa; identical to SEQ ID NO: 218684

SEQ ID NO: 748150 - RNA, 64 nt, hsa; identical to SEQ ID NO: 218685

SEQ ID NO: 748151 - RNA, 59 nt, hsa; identical to SEQ ID NO: 218686

SEQ ID NO: 748152 - RNA, 64 nt, hsa; identical to SEQ ID NO: 218687

SEQ ID NO: 748153 - RNA, 64 nt, hsa; identical to SEQ ID NO: 218688

SEQ ID NO: 748154 - RNA, 64 nt, hsa; identical to SEQ ID NO: 218689

SEQ ID NO: 748155 - RNA, 64 nt, hsa; identical to SEQ ID NO: 218690

SEQ ID NO: 748156 - RNA, 64 nt, hsa; identical to SEQ ID NO: 218691

SEQ ID NO: 748157 - RNA, 64 nt, hsa; identical to SEQ ID NO: 218692

SEQ ID NO: 748158 - RNA, 64 nt, hsa; identical to SEQ ID NO: 218693

SEQ ID NO: 748159 - RNA, 64 nt, hsa; identical to SEQ ID NO: 218694

SEQ ID NO: 748160 - RNA, 64 nt, hsa; identical to SEQ ID NO: 218695

SEQ ID NO: 748161 - RNA, 64 nt, hsa; identical to SEQ ID NO: 218696

SEQ ID NO: 748162 - RNA, 64 nt, hsa; identical to SEQ ID NO: 218697

SEQ ID NO: 748163 - RNA, 64 nt, hsa; identical to SEQ ID NO: 218698

SEQ ID NO: 748164 - RNA, 64 nt, hsa; identical to SEQ ID NO: 218699

SEQ ID NO: 748165 - RNA, 64 nt, hsa; identical to SEQ ID NO: 218700

SEQ ID NO: 748166 - RNA, 64 nt, hsa; identical to SEQ ID NO: 218701

SEQ ID NO: 748167 - RNA, 64 nt, hsa; identical to SEQ ID NO: 218702

SEQ ID NO: 748168 - RNA, 64 nt, hsa; identical to SEQ ID NO: 218703

SEQ ID NO: 748169 - RNA, 64 nt, hsa; identical to SEQ ID NO: 218704

SEQ ID NO: 748170 - RNA, 64 nt, hsa; identical to SEQ ID NO: 218705

SEQ ID NO: 748171 - RNA, 64 nt, hsa; identical to SEQ ID NO: 218706

SEQ ID NO: 748172 - RNA, 64 nt, hsa; identical to SEQ ID NO: 218707

SEQ ID NO: 748173 - RNA, 64 nt, hsa; identical to SEQ ID NO: 218708

SEQ ID NO: 748174 - RNA, 64 nt, hsa; identical to SEQ ID NO: 218709

SEQ ID NO: 748175 - RNA, 64 nt, hsa; identical to SEQ ID NO: 218710

SEQ ID NO: 748176 - RNA, 64 nt, hsa; identical to SEQ ID NO: 218711

SEQ ID NO: 748177 - RNA, 64 nt, hsa; identical to SEQ ID NO: 218712

SEQ ID NO: 748178 - RNA, 64 nt, hsa; identical to SEQ ID NO: 218713

SEQ ID NO: 748179 - RNA, 64 nt, hsa; identical to SEQ ID NO: 218714

SEQ ID NO: 748180 - RNA, 64 nt, hsa; identical to SEQ ID NO: 218715

SEQ ID NO: 748181 - RNA, 64 nt, hsa; identical to SEQ ID NO: 218716

SEQ ID NO: 748182 - RNA, 64 nt, hsa; identical to SEQ ID NO: 218717

SEQ ID NO: 748183 - RNA, 64 nt, hsa; identical to SEQ ID NO: 218718

SEQ ID NO: 748184 - RNA, 64 nt, hsa; identical to SEQ ID NO: 218719

SEQ ID NO: 748185 - RNA, 64 nt, hsa; identical to SEQ ID NO: 218720

SEQ ID NO: 748186 - RNA, 64 nt, hsa; identical to SEQ ID NO: 218721

SEQ ID NO: 748187 - RNA, 64 nt, hsa; identical to SEQ ID NO: 218722

SEQ ID NO: 748188 - RNA, 64 nt, hsa; identical to SEQ ID NO: 218723

SEQ ID NO: 748189 - RNA, 64 nt, hsa; identical to SEQ ID NO: 218724

SEQ ID NO: 748190 - RNA, 64 nt, hsa; identical to SEQ ID NO: 218725

SEQ ID NO: 748191 - RNA, 64 nt, hsa; identical to SEQ ID NO: 218726

SEQ ID NO: 748192 - RNA, 64 nt, hsa; identical to SEQ ID NO: 218727

SEQ ID NO: 748193 - RNA, 64 nt, hsa; identical to SEQ ID NO: 218728

SEQ ID NO: 748194 - RNA, 64 nt, hsa; identical to SEQ ID NO: 218729

SEQ ID NO: 748195 - RNA, 64 nt, hsa; identical to SEQ ID NO: 218730

SEQ ID NO: 748196 - RNA, 64 nt, hsa; identical to SEQ ID NO: 218731

SEQ ID NO: 748197 - RNA, 64 nt, hsa; identical to SEQ ID NO: 218732

SEQ ID NO: 748198 - RNA, 64 nt, hsa; identical to SEQ ID NO: 218733

SEQ ID NO: 748199 - RNA, 64 nt, hsa; identical to SEQ ID NO: 218734

SEQ ID NO: 748200 - RNA, 64 nt, hsa; identical to SEQ ID NO: 218735

SEQ ID NO: 748201 - RNA, 64 nt, hsa; identical to SEQ ID NO: 218736

SEQ ID NO: 748202 - RNA, 64 nt, hsa; identical to SEQ ID NO: 218737

SEQ ID NO: 748203 - RNA, 64 nt, hsa; identical to SEQ ID NO: 218738

SEQ ID NO: 748204 - RNA, 64 nt, hsa; identical to SEQ ID NO: 218739

SEQ ID NO: 748205 - RNA, 64 nt, hsa; identical to SEQ ID NO: 218740

SEQ ID NO: 748206 - RNA, 64 nt, hsa; identical to SEQ ID NO: 218741

SEQ ID NO: 748207 - RNA, 64 nt, hsa; identical to SEQ ID NO: 218742

SEQ ID NO: 748208 - RNA, 64 nt, hsa; identical to SEQ ID NO: 218743

SEQ ID NO: 748209 - RNA, 64 nt, hsa; identical to SEQ ID NO: 218744

SEQ ID NO: 748210 - RNA, 64 nt, hsa; identical to SEQ ID NO: 218745

SEQ ID NO: 748211 - RNA, 64 nt, hsa; identical to SEQ ID NO: 218746

SEQ ID NO: 748212 - RNA, 64 nt, hsa; identical to SEQ ID NO: 218747

SEQ ID NO: 748213 - RNA, 64 nt, hsa; identical to SEQ ID NO: 218748

SEQ ID NO: 748214 - RNA, 64 nt, hsa; identical to SEQ ID NO: 218749

SEQ ID NO: 748215 - RNA, 64 nt, hsa; identical to SEQ ID NO: 218750

SEQ ID NO: 748216 - RNA, 64 nt, hsa; identical to SEQ ID NO: 218751

SEQ ID NO: 748217 - RNA, 64 nt, hsa; identical to SEQ ID NO: 218752

SEQ ID NO: 748218 - RNA, 64 nt, hsa; identical to SEQ ID NO: 218753

SEQ ID NO: 748219 - RNA, 64 nt, hsa; identical to SEQ ID NO: 218754

SEQ ID NO: 748220 - RNA, 64 nt, hsa; identical to SEQ ID NO: 218755

SEQ ID NO: 748221 - RNA, 64 nt, hsa; identical to SEQ ID NO: 218756

SEQ ID NO: 748222 - RNA, 64 nt, hsa; identical to SEQ ID NO: 218757

SEQ ID NO: 748223 - RNA, 64 nt, hsa; identical to SEQ ID NO: 218758

SEQ ID NO: 748224 - RNA, 64 nt, hsa; identical to SEQ ID NO: 218759

SEQ ID NO: 748225 - RNA, 64 nt, hsa; identical to SEQ ID NO: 218760

SEQ ID NO: 748226 - RNA, 64 nt, hsa; identical to SEQ ID NO: 218761

SEQ ID NO: 748227 - RNA, 64 nt, hsa; identical to SEQ ID NO: 218762

SEQ ID NO: 748228 - RNA, 64 nt, hsa; identical to SEQ ID NO: 218763

SEQ ID NO: 748229 - RNA, 64 nt, hsa; identical to SEQ ID NO: 218764

SEQ ID NO: 748230 - RNA, 64 nt, hsa; identical to SEQ ID NO: 218765

SEQ ID NO: 748231 - RNA, 64 nt, hsa; identical to SEQ ID NO: 218766

SEQ ID NO: 748232 - RNA, 64 nt, hsa; identical to SEQ ID NO: 218767

SEQ ID NO: 748233 - RNA, 64 nt, hsa; identical to SEQ ID NO: 218768

SEQ ID NO: 748234 - RNA, 64 nt, hsa; identical to SEQ ID NO: 218769

SEQ ID NO: 748235 - RNA, 64 nt, hsa; identical to SEQ ID NO: 218770

SEQ ID NO: 748236 - RNA, 64 nt, hsa; identical to SEQ ID NO: 218771

SEQ ID NO: 748237 - RNA, 64 nt, hsa; identical to SEQ ID NO: 218772

SEQ ID NO: 748238 - RNA, 64 nt, hsa; identical to SEQ ID NO: 218773

SEQ ID NO: 748239 - RNA, 64 nt, hsa; identical to SEQ ID NO: 218774

SEQ ID NO: 748240 - RNA, 64 nt, hsa; identical to SEQ ID NO: 218775

SEQ ID NO: 748241 - RNA, 64 nt, hsa; identical to SEQ ID NO: 218776

SEQ ID NO: 748242 - RNA, 64 nt, hsa; identical to SEQ ID NO: 218777

SEQ ID NO: 748243 - RNA, 64 nt, hsa; identical to SEQ ID NO: 218778

SEQ ID NO: 748244 - RNA, 64 nt, hsa; identical to SEQ ID NO: 218779

SEQ ID NO: 748245 - RNA, 64 nt, hsa; identical to SEQ ID NO: 218780

SEQ ID NO: 748246 - RNA, 64 nt, hsa; identical to SEQ ID NO: 218781

SEQ ID NO: 748247 - RNA, 64 nt, hsa; identical to SEQ ID NO: 218782

SEQ ID NO: 748248 - RNA, 64 nt, hsa; identical to SEQ ID NO: 218783

SEQ ID NO: 748249 - RNA, 64 nt, hsa; identical to SEQ ID NO: 218784

SEQ ID NO: 748250 - RNA, 64 nt, hsa; identical to SEQ ID NO: 218785

SEQ ID NO: 748251 - RNA, 64 nt, hsa; identical to SEQ ID NO: 218786

SEQ ID NO: 748252 - RNA, 64 nt, hsa; identical to SEQ ID NO: 218787

SEQ ID NO: 748253 - RNA, 64 nt, hsa; identical to SEQ ID NO: 218788

SEQ ID NO: 748254 - RNA, 64 nt, hsa; identical to SEQ ID NO: 218789

SEQ ID NO: 748255 - RNA, 64 nt, hsa; identical to SEQ ID NO: 218790

SEQ ID NO: 748256 - RNA, 64 nt, hsa; identical to SEQ ID NO: 218791

SEQ ID NO: 748257 - RNA, 64 nt, hsa; identical to SEQ ID NO: 218792

SEQ ID NO: 748258 - RNA, 64 nt, hsa; identical to SEQ ID NO: 218793

SEQ ID NO: 748259 - RNA, 64 nt, hsa; identical to SEQ ID NO: 218794

SEQ ID NO: 748260 - RNA, 64 nt, hsa; identical to SEQ ID NO: 218795

SEQ ID NO: 748261 - RNA, 64 nt, hsa; identical to SEQ ID NO: 218796

SEQ ID NO: 748262 - RNA, 64 nt, hsa; identical to SEQ ID NO: 218797

SEQ ID NO: 748263 - RNA, 64 nt, hsa; identical to SEQ ID NO: 218798

SEQ ID NO: 748264 - RNA, 64 nt, hsa; identical to SEQ ID NO: 218799

SEQ ID NO: 748265 - RNA, 64 nt, hsa; identical to SEQ ID NO: 218800

SEQ ID NO: 748266 - RNA, 64 nt, hsa; identical to SEQ ID NO: 218801

SEQ ID NO: 748267 - RNA, 64 nt, hsa; identical to SEQ ID NO: 218802

SEQ ID NO: 748268 - RNA, 64 nt, hsa; identical to SEQ ID NO: 218803

SEQ ID NO: 748269 - RNA, 64 nt, hsa; identical to SEQ ID NO: 218804

SEQ ID NO: 748270 - RNA, 64 nt, hsa; identical to SEQ ID NO: 218805

SEQ ID NO: 748271 - RNA, 64 nt, hsa; identical to SEQ ID NO: 218806

SEQ ID NO: 748272 - RNA, 64 nt, hsa; identical to SEQ ID NO: 218807

SEQ ID NO: 748273 - RNA, 64 nt, hsa; identical to SEQ ID NO: 218808

SEQ ID NO: 748274 - RNA, 59 nt, hsa; identical to SEQ ID NO: 218809

SEQ ID NO: 748275 - RNA, 64 nt, hsa; identical to SEQ ID NO: 218810

SEQ ID NO: 748276 - RNA, 64 nt, hsa; identical to SEQ ID NO: 218811

SEQ ID NO: 748277 - RNA, 64 nt, hsa; identical to SEQ ID NO: 570585

SEQ ID NO: 748278 - RNA, 64 nt, hsa; identical to SEQ ID NO: 570586

SEQ ID NO: 748279 - RNA, 64 nt, hsa; identical to SEQ ID NO: 570587

SEQ ID NO: 748280 - RNA, 64 nt, hsa; identical to SEQ ID NO: 570588

SEQ ID NO: 748281 - RNA, 64 nt, hsa; identical to SEQ ID NO: 570589

SEQ ID NO: 748282 - RNA, 64 nt, hsa; identical to SEQ ID NO: 570590

SEQ ID NO: 748283 - RNA, 64 nt, hsa; identical to SEQ ID NO: 570591

SEQ ID NO: 748284 - RNA, 64 nt, hsa; identical to SEQ ID NO: 570592

SEQ ID NO: 748285 - RNA, 64 nt, hsa; identical to SEQ ID NO: 570593

SEQ ID NO: 748286 - RNA, 64 nt, hsa; identical to SEQ ID NO: 76092

SEQ ID NO: 748287 - RNA, 64 nt, hsa; identical to SEQ ID NO: 76093

SEQ ID NO: 748288 - RNA, 64 nt, hsa; identical to SEQ ID NO: 76094

SEQ ID NO: 748289 - RNA, 64 nt, hsa; identical to SEQ ID NO: 76095

SEQ ID NO: 748290 - RNA, 64 nt, hsa; identical to SEQ ID NO: 76096

SEQ ID NO: 748291 - RNA, 64 nt, hsa; identical to SEQ ID NO: 76097

SEQ ID NO: 748292 - RNA, 64 nt, hsa; identical to SEQ ID NO: 76098

SEQ ID NO: 748293 - RNA, 64 nt, hsa; identical to SEQ ID NO: 76099

SEQ ID NO: 748294 - RNA, 64 nt, hsa; identical to SEQ ID NO: 76100

SEQ ID NO: 748295 - RNA, 64 nt, hsa; identical to SEQ ID NO: 76101

SEQ ID NO: 748296 - RNA, 64 nt, hsa; identical to SEQ ID NO: 76102

SEQ ID NO: 748297 - RNA, 64 nt, hsa; identical to SEQ ID NO: 76103

SEQ ID NO: 748298 - RNA, 53 nt, hsa; identical to SEQ ID NO: 76104

SEQ ID NO: 748299 - RNA, 64 nt, hsa; identical to SEQ ID NO: 76105

SEQ ID NO: 748300 - RNA, 64 nt, hsa; identical to SEQ ID NO: 76106

SEQ ID NO: 748301 - RNA, 64 nt, hsa; identical to SEQ ID NO: 76107

SEQ ID NO: 748302 - RNA, 64 nt, hsa; identical to SEQ ID NO: 76108

SEQ ID NO: 748303 - RNA, 64 nt, hsa; identical to SEQ ID NO: 76109

SEQ ID NO: 748304 - RNA, 64 nt, hsa; identical to SEQ ID NO: 76110

SEQ ID NO: 748305 - RNA, 64 nt, hsa; identical to SEQ ID NO: 76111

SEQ ID NO: 748306 - RNA, 64 nt, hsa; identical to SEQ ID NO: 38562

SEQ ID NO: 748307 - RNA, 64 nt, hsa; identical to SEQ ID NO: 38563

SEQ ID NO: 748308 - RNA, 64 nt, hsa; identical to SEQ ID NO: 38564

SEQ ID NO: 748309 - RNA, 64 nt, hsa; identical to SEQ ID NO: 38565

SEQ ID NO: 748310 - RNA, 64 nt, hsa; identical to SEQ ID NO: 38566

SEQ ID NO: 748311 - RNA, 64 nt, hsa; identical to SEQ ID NO: 38567

SEQ ID NO: 748312 - RNA, 64 nt, hsa; identical to SEQ ID NO: 38568

SEQ ID NO: 748313 - RNA, 64 nt, hsa; identical to SEQ ID NO: 38569

SEQ ID NO: 748314 - RNA, 64 nt, hsa; identical to SEQ ID NO: 38570

SEQ ID NO: 748315 - RNA, 64 nt, hsa; identical to SEQ ID NO: 38571

SEQ ID NO: 748316 - RNA, 64 nt, hsa; identical to SEQ ID NO: 38572

SEQ ID NO: 748317 - RNA, 64 nt, hsa; identical to SEQ ID NO: 38573

SEQ ID NO: 748318 - RNA, 64 nt, hsa; identical to SEQ ID NO: 38574

SEQ ID NO: 748319 - RNA, 64 nt, hsa; identical to SEQ ID NO: 38575

SEQ ID NO: 748320 - RNA, 64 nt, hsa; identical to SEQ ID NO: 38576

SEQ ID NO: 748321 - RNA, 64 nt, hsa; identical to SEQ ID NO: 38577

SEQ ID NO: 748322 - RNA, 64 nt, hsa; identical to SEQ ID NO: 38578

SEQ ID NO: 748323 - RNA, 64 nt, hsa; identical to SEQ ID NO: 38579

SEQ ID NO: 748324 - RNA, 64 nt, hsa; identical to SEQ ID NO: 38580

SEQ ID NO: 748325 - RNA, 64 nt, hsa; identical to SEQ ID NO: 38581

SEQ ID NO: 748326 - RNA, 64 nt, hsa; identical to SEQ ID NO: 38582

SEQ ID NO: 748327 - RNA, 64 nt, hsa; identical to SEQ ID NO: 38583

SEQ ID NO: 748328 - RNA, 64 nt, hsa; identical to SEQ ID NO: 38584

SEQ ID NO: 748329 - RNA, 64 nt, hsa; identical to SEQ ID NO: 38585

SEQ ID NO: 748330 - RNA, 64 nt, hsa; identical to SEQ ID NO: 38586

SEQ ID NO: 748331 - RNA, 64 nt, hsa; identical to SEQ ID NO: 38587

SEQ ID NO: 748332 - RNA, 64 nt, hsa; identical to SEQ ID NO: 38588

SEQ ID NO: 748333 - RNA, 64 nt, hsa; identical to SEQ ID NO: 38589

SEQ ID NO: 748334 - RNA, 64 nt, hsa; identical to SEQ ID NO: 38590

SEQ ID NO: 748335 - RNA, 64 nt, hsa; identical to SEQ ID NO: 38591

SEQ ID NO: 748336 - RNA, 64 nt, hsa; identical to SEQ ID NO: 38592

SEQ ID NO: 748337 - RNA, 64 nt, hsa; identical to SEQ ID NO: 38593

SEQ ID NO: 748338 - RNA, 64 nt, hsa; identical to SEQ ID NO: 120942

SEQ ID NO: 748339 - RNA, 64 nt, hsa; identical to SEQ ID NO: 120943

SEQ ID NO: 748340 - RNA, 64 nt, hsa; identical to SEQ ID NO: 120944

SEQ ID NO: 748341 - RNA, 64 nt, hsa; identical to SEQ ID NO: 120945

SEQ ID NO: 748342 - RNA, 64 nt, hsa; identical to SEQ ID NO: 120946

SEQ ID NO: 748343 - RNA, 64 nt, hsa; identical to SEQ ID NO: 120947

SEQ ID NO: 748344 - RNA, 64 nt, hsa; identical to SEQ ID NO: 120948

SEQ ID NO: 748345 - RNA, 64 nt, hsa; identical to SEQ ID NO: 120949

SEQ ID NO: 748346 - RNA, 64 nt, hsa; identical to SEQ ID NO: 120950

SEQ ID NO: 748347 - RNA, 64 nt, hsa; identical to SEQ ID NO: 120951

SEQ ID NO: 748348 - RNA, 64 nt, hsa; identical to SEQ ID NO: 120952

SEQ ID NO: 748349 - RNA, 64 nt, hsa; identical to SEQ ID NO: 120953

SEQ ID NO: 748350 - RNA, 64 nt, hsa; identical to SEQ ID NO: 120954

SEQ ID NO: 748351 - RNA, 64 nt, hsa; identical to SEQ ID NO: 120955

SEQ ID NO: 748352 - RNA, 64 nt, hsa; identical to SEQ ID NO: 120956

SEQ ID NO: 748353 - RNA, 64 nt, hsa; identical to SEQ ID NO: 120957

SEQ ID NO: 748354 - RNA, 64 nt, hsa; identical to SEQ ID NO: 120958

SEQ ID NO: 748355 - RNA, 64 nt, hsa; identical to SEQ ID NO: 120959

SEQ ID NO: 748356 - RNA, 64 nt, hsa; identical to SEQ ID NO: 120960

SEQ ID NO: 748357 - RNA, 64 nt, hsa; identical to SEQ ID NO: 120961

SEQ ID NO: 748358 - RNA, 64 nt, hsa; identical to SEQ ID NO: 120962

SEQ ID NO: 748359 - RNA, 64 nt, hsa; identical to SEQ ID NO: 120963

SEQ ID NO: 748360 - RNA, 64 nt, hsa; identical to SEQ ID NO: 120964

SEQ ID NO: 748361 - RNA, 62 nt, hsa; identical to SEQ ID NO: 120965

SEQ ID NO: 748362 - RNA, 64 nt, hsa; identical to SEQ ID NO: 120966

SEQ ID NO: 748363 - RNA, 64 nt, hsa; identical to SEQ ID NO: 120967

SEQ ID NO: 748364 - RNA, 64 nt, hsa; identical to SEQ ID NO: 120968

SEQ ID NO: 748365 - RNA, 64 nt, hsa; identical to SEQ ID NO: 120969

SEQ ID NO: 748366 - RNA, 64 nt, hsa; identical to SEQ ID NO: 120970

SEQ ID NO: 748367 - RNA, 64 nt, hsa; identical to SEQ ID NO: 120971

SEQ ID NO: 748368 - RNA, 64 nt, hsa
cccaggcaccagacuuaccccaggagcaugggccacuguccauggggccuuccuugagaccuuc

SEQ ID NO: 748369 - RNA, 64 nt, hsa
ggugccauacuugguguaagccuuccuucuguccacuguccagaauguccuuuuucacacagag

SEQ ID NO: 748370 - RNA, 64 nt, hsa
ucuuuucucauguccagaguucuauccugcccccacuguccacuguagggucauccgcaaagcc

SEQ ID NO: 748371 - RNA, 64 nt, hsa
auguuggaauauuuggaauuuuaaaggaguaaagacuguccagcauuugguuuuauaauguuug

SEQ ID NO: 748372 - RNA, 64 nt, hsa
agacauaggaagccucuguuuacccugaagcaccacuguccagcccauugguucccacuggcag

SEQ ID NO: 748373 - RNA, 64 nt, hsa
ggucagugaaggucugggguagggaaacauucagacuguccauugcauggcuguggagugagac

SEQ ID NO: 748374 - RNA, 64 nt, hsa
uuacacuagcuuucugcauuuaauagguuagaauguaaauuaaaguguagcaauagcaacaaaa

SEQ ID NO: 748375 - RNA, 64 nt, hsa
aaaaauugagccuugggacgugcccauuuuuacuguaaauuaugauuccguaacugacuuguag

SEQ ID NO: 748376 - RNA, 64 nt, hsa
gcucuguuauuucuucaucugcuggggggaaaaaguaaauuacaaacaaacaaacaaagcagaa

SEQ ID NO: 748377 - RNA, 64 nt, hsa
uuaggguauaaagaucucauaagaaauguaauauguaaauuauaucuugcuuuauguuguaaaa

SEQ ID NO: 748378 - RNA, 64 nt, hsa
gugcuguugcuaugcagugugaucuuuauuuauaguaaauuauguuucauguaaaugauauauu

SEQ ID NO: 748379 - RNA, 64 nt, hsa
guuuacucauggauuuuagcuauuuuuucacuggguaaauuauacuacauuuauuuacaaauga

SEQ ID NO: 748380 - RNA, 64 nt, hsa
uauuuauuuucauuuucuguauuauauaugaaaaguaaauuaaugugaaaccuggcccagcuug

SEQ ID NO: 748381 - RNA, 64 nt, hsa
uagacacuuucauaugguucaaccuaaugacuugguaaauuauugccuugguguauuaauaaua

SEQ ID NO: 748382 - RNA, 64 nt, hsa
ugaacaccacugugauucuccaaggacgaauuacguaaauuauacuuucauacaaaggagacga

SEQ ID NO: 748383 - RNA, 64 nt, hsa
gaucuaaaacuacuagaucucaucccauucccauguaaauuaccacagaccgcaguaccggggc

SEQ ID NO: 748384 - RNA, 64 nt, hsa
auaugaaacauagauaaaacaucuuugaaauuauguaaauuauguaaauuaucaggcaaauuug

SEQ ID NO: 748385 - RNA, 64 nt, hsa
auagauaaaacaucuuugaaauuauguaaauuauguaaauuaucaggcaaauuugcauuaaauu

SEQ ID NO: 748386 - RNA, 64 nt, hsa
acgaacauauuuauugguacugaaaagagacguaguaaauuaaauagaagaaauauauuuauaa

SEQ ID NO: 748387 - RNA, 64 nt, hsa
aaugaucuguguuuaucauuagccuuguacaaauguaaauuacuaauagugauguucuuuugca

SEQ ID NO: 748388 - RNA, 64 nt, hsa
ccaguucaccuuuauuuuacguuuuauucagucuguaaauuaacuggcccuuugcaguaacuug

SEQ ID NO: 748389 - RNA, 64 nt, hsa
agaguaaaugcauuucuggaguuguuucugugauguaaauuaugaucauuauuuaagaagucaa

SEQ ID NO: 748390 - RNA, 64 nt, hsa
aguuuagauuugaauuccagcuaugugacauuggguaaauuaguaguaguccugagccucagcg

SEQ ID NO: 748391 - RNA, 64 nt, hsa
ucagagaaagaaaauauaauuuaacuuuaaagauguaaauuauauauauaguauauuauauaua

SEQ ID NO: 748392 - RNA, 64 nt, hsa
caacuauaaagcacuauguugguuuacuacuucaguaaauuauucuuagugaauuauuuucuaa

SEQ ID NO: 748393 - RNA, 64 nt, hsa
uccucccccccucucauuuucugguucaaucuuaguaaauuaacauucuggauuuaauuaguag

SEQ ID NO: 748394 - RNA, 64 nt, hsa
uauuaaaugaauucauuacucaauuaaacauuggguaaauuauuaaauguguguguaguuauag

SEQ ID NO: 748395 - RNA, 64 nt, hsa
auuguuuuuaacauuaaacaaauaugaaauuaaaguaaauuaaauuucacccuauuuaaacaua

SEQ ID NO: 748396 - RNA, 64 nt, hsa
uuaacuuuuaauacccauuuauuggcuauuuaagguaaauuauaaaaccuaaaauuaguaucag

SEQ ID NO: 748397 - RNA, 64 nt, hsa
uuaaaaaauguaugucagggugacaggcauaaaaguaaauuacccuuaacucuuuagccuuuau

SEQ ID NO: 748398 - RNA, 64 nt, hsa
aaaaacagcuuuacuucaaaagcaugugccucugguaaauuauccaucacuuuuguuuuaaagu

SEQ ID NO: 748399 - RNA, 64 nt, hsa
auguuuuucauuugauacuuuuaauuuacacuuaguaaauuaaaaguuguuuaauuuacuuggc

SEQ ID NO: 748400 - RNA, 64 nt, hsa
uuggaaacaaugauauagcaguuacucacagcuuguaaauuacaacagaaagguuccuuucaaa

SEQ ID NO: 748401 - RNA, 64 nt, hsa
uuuuauguuauaaacuugaauuuauaaagugcugguaaauuauuuuuaaugauuugagugcaug

SEQ ID NO: 748402 - RNA, 64 nt, hsa; identical to SEQ ID NO: 48305

SEQ ID NO: 748403 - RNA, 64 nt, hsa; identical to SEQ ID NO: 48306

SEQ ID NO: 748404 - RNA, 64 nt, hsa; identical to SEQ ID NO: 48307

SEQ ID NO: 748405 - RNA, 64 nt, hsa; identical to SEQ ID NO: 48308

SEQ ID NO: 748406 - RNA, 64 nt, hsa; identical to SEQ ID NO: 48309

SEQ ID NO: 748407 - RNA, 64 nt, hsa; identical to SEQ ID NO: 48310

SEQ ID NO: 748408 - RNA, 64 nt, hsa; identical to SEQ ID NO: 48311

SEQ ID NO: 748409 - RNA, 64 nt, hsa; identical to SEQ ID NO: 48312

SEQ ID NO: 748410 - RNA, 64 nt, hsa; identical to SEQ ID NO: 48313

SEQ ID NO: 748411 - RNA, 64 nt, hsa; identical to SEQ ID NO: 48314

SEQ ID NO: 748412 - RNA, 64 nt, hsa; identical to SEQ ID NO: 48315

SEQ ID NO: 748413 - RNA, 64 nt, hsa; identical to SEQ ID NO: 48316

SEQ ID NO: 748414 - RNA, 64 nt, hsa; identical to SEQ ID NO: 48317

SEQ ID NO: 748415 - RNA, 64 nt, hsa; identical to SEQ ID NO: 48318

SEQ ID NO: 748416 - RNA, 64 nt, hsa; identical to SEQ ID NO: 48319

SEQ ID NO: 748417 - RNA, 64 nt, hsa; identical to SEQ ID NO: 48320

SEQ ID NO: 748418 - RNA, 64 nt, hsa; identical to SEQ ID NO: 48321

SEQ ID NO: 748419 - RNA, 64 nt, hsa; identical to SEQ ID NO: 48322

SEQ ID NO: 748420 - RNA, 64 nt, hsa; identical to SEQ ID NO: 48323

SEQ ID NO: 748421 - RNA, 64 nt, hsa; identical to SEQ ID NO: 48324

SEQ ID NO: 748422 - RNA, 64 nt, hsa; identical to SEQ ID NO: 48325

SEQ ID NO: 748423 - RNA, 64 nt, hsa; identical to SEQ ID NO: 48326

SEQ ID NO: 748424 - RNA, 64 nt, hsa; identical to SEQ ID NO: 48327

SEQ ID NO: 748425 - RNA, 64 nt, hsa; identical to SEQ ID NO: 48328

SEQ ID NO: 748426 - RNA, 64 nt, hsa; identical to SEQ ID NO: 48329

SEQ ID NO: 748427 - RNA, 51 nt, hsa; identical to SEQ ID NO: 48330

SEQ ID NO: 748428 - RNA, 64 nt, hsa; identical to SEQ ID NO: 48331

SEQ ID NO: 748429 - RNA, 64 nt, hsa; identical to SEQ ID NO: 48332

SEQ ID NO: 748430 - RNA, 64 nt, hsa; identical to SEQ ID NO: 48333

SEQ ID NO: 748431 - RNA, 64 nt, hsa; identical to SEQ ID NO: 48334

SEQ ID NO: 748432 - RNA, 64 nt, hsa; identical to SEQ ID NO: 48335

SEQ ID NO: 748433 - RNA, 64 nt, hsa; identical to SEQ ID NO: 48336

SEQ ID NO: 748434 - RNA, 64 nt, hsa; identical to SEQ ID NO: 48337

SEQ ID NO: 748435 - RNA, 64 nt, hsa; identical to SEQ ID NO: 48338

SEQ ID NO: 748436 - RNA, 64 nt, hsa; identical to SEQ ID NO: 48339

SEQ ID NO: 748437 - RNA, 64 nt, hsa; identical to SEQ ID NO: 48340

SEQ ID NO: 748438 - RNA, 64 nt, hsa; identical to SEQ ID NO: 48341

SEQ ID NO: 748439 - RNA, 64 nt, hsa; identical to SEQ ID NO: 48342

SEQ ID NO: 748440 - RNA, 64 nt, hsa; identical to SEQ ID NO: 48343

SEQ ID NO: 748441 - RNA, 64 nt, hsa; identical to SEQ ID NO: 48344

SEQ ID NO: 748442 - RNA, 64 nt, hsa; identical to SEQ ID NO: 48345

SEQ ID NO: 748443 - RNA, 64 nt, hsa; identical to SEQ ID NO: 48346

SEQ ID NO: 748444 - RNA, 64 nt, hsa; identical to SEQ ID NO: 48347

SEQ ID NO: 748445 - RNA, 64 nt, hsa; identical to SEQ ID NO: 48348

SEQ ID NO: 748446 - RNA, 64 nt, hsa; identical to SEQ ID NO: 48349

SEQ ID NO: 748447 - RNA, 64 nt, hsa; identical to SEQ ID NO: 245118

SEQ ID NO: 748448 - RNA, 64 nt, hsa; identical to SEQ ID NO: 245119

SEQ ID NO: 748449 - RNA, 64 nt, hsa; identical to SEQ ID NO: 245120

SEQ ID NO: 748450 - RNA, 64 nt, hsa; identical to SEQ ID NO: 245121

SEQ ID NO: 748451 - RNA, 64 nt, hsa; identical to SEQ ID NO: 245122

SEQ ID NO: 748452 - RNA, 64 nt, hsa; identical to SEQ ID NO: 245123

SEQ ID NO: 748453 - RNA, 64 nt, hsa; identical to SEQ ID NO: 245124

SEQ ID NO: 748454 - RNA, 64 nt, hsa; identical to SEQ ID NO: 245125

SEQ ID NO: 748455 - RNA, 64 nt, hsa
cugcgccgcgcgggcaggcaccugugcgaccugugccccggaccugcggcgccgcccucgagcg

SEQ ID NO: 748456 - RNA, 64 nt, hsa
cgccccccaccccagcgcugucugugggucccuugccccggagcugacucgccuccagugaguc

SEQ ID NO: 748457 - RNA, 64 nt, hsa
caccacgcccuccccgcgcgccggcucaggggcugccccggaaucagcuccccggggccgccgc

SEQ ID NO: 748458 - RNA, 64 nt, hsa
gaggcugggaggccgcucggggcccagcgugccagccccggaguucagccucccgagcugcggc

SEQ ID NO: 748459 - RNA, 64 nt, hsa
cccggcgcgccugguagagccucgcuggccccgcgccccggagcccuauauuaaggccacggag

SEQ ID NO: 748460 - RNA, 64 nt, hsa
cgggauggcgcgggugguguguguguucccacgggccccggaggcccacuccgcggagggcacg

SEQ ID NO: 748461 - RNA, 57 nt, hsa
cccgcgagacgcuguacuaggcugugcgccccggaacguguccaggaggagccuggc

SEQ ID NO: 748462 - RNA, 64 nt, hsa
ucguaucacuagcuugcggccaggucaugauguggccccggaagcuggcccugcgugccaugag

SEQ ID NO: 748463 - RNA, 64 nt, hsa; identical to SEQ ID NO: 134735

SEQ ID NO: 748464 - RNA, 64 nt, hsa; identical to SEQ ID NO: 134736

SEQ ID NO: 748465 - RNA, 64 nt, hsa; identical to SEQ ID NO: 134737

SEQ ID NO: 748466 - RNA, 64 nt, hsa; identical to SEQ ID NO: 134738

SEQ ID NO: 748467 - RNA, 64 nt, hsa; identical to SEQ ID NO: 134739

SEQ ID NO: 748468 - RNA, 64 nt, hsa; identical to SEQ ID NO: 134740

SEQ ID NO: 748469 - RNA, 64 nt, hsa; identical to SEQ ID NO: 134741

SEQ ID NO: 748470 - RNA, 64 nt, hsa; identical to SEQ ID NO: 134742

SEQ ID NO: 748471 - RNA, 64 nt, hsa; identical to SEQ ID NO: 134743

SEQ ID NO: 748472 - RNA, 64 nt, hsa; identical to SEQ ID NO: 134744

SEQ ID NO: 748473 - RNA, 64 nt, hsa; identical to SEQ ID NO: 134745

SEQ ID NO: 748474 - RNA, 64 nt, hsa; identical to SEQ ID NO: 134746

SEQ ID NO: 748475 - RNA, 64 nt, hsa; identical to SEQ ID NO: 134747

SEQ ID NO: 748476 - RNA, 64 nt, hsa; identical to SEQ ID NO: 134748

SEQ ID NO: 748477 - RNA, 64 nt, hsa; identical to SEQ ID NO: 134749

SEQ ID NO: 748478 - RNA, 64 nt, hsa; identical to SEQ ID NO: 134750

SEQ ID NO: 748479 - RNA, 64 nt, hsa; identical to SEQ ID NO: 134751

SEQ ID NO: 748480 - RNA, 64 nt, hsa; identical to SEQ ID NO: 134752

SEQ ID NO: 748481 - RNA, 64 nt, hsa; identical to SEQ ID NO: 134753

SEQ ID NO: 748482 - RNA, 64 nt, hsa; identical to SEQ ID NO: 134754

SEQ ID NO: 748483 - RNA, 64 nt, hsa
uaaugauguuagauaauacucaacaugauucaguaugacaaacuuuuuugagcaccuacuuuau

SEQ ID NO: 748484 - RNA, 64 nt, hsa
acaaacuuuuuugagcaccuacuuuauauaaaacaugacaaauugcagugugauguaaucaaaa

SEQ ID NO: 748485 - RNA, 64 nt, hsa
augaauuaugaauaccgcagggcagccuucuuaaaugacaaauguaaaaaaaaaaaaaaaaaag

SEQ ID NO: 748486 - RNA, 64 nt, hsa
aagaauccauuugaagacaauguugcaauguugaaugacaaaaauaaacaguucaagugaagca

SEQ ID NO: 748487 - RNA, 64 nt, hsa
uaaguagccuuaugacaaacaguaugagauacuuaugacaaacucgcucugucacccaggcugg

SEQ ID NO: 748488 - RNA, 64 nt, hsa
ucuacauaaaucuagauacucauuaaguagccuuaugacaaacaguaugagauacuuaugacaa

SEQ ID NO: 748489 - RNA, 64 nt, hsa
caaaaagcauacaagcaaccuggucauacauaggaugacaaaauucuuucugguuguuuuuaaa

SEQ ID NO: 748490 - RNA, 64 nt, hsa
aacaguauaaaacagcccuauuucuugauaaaaaaugacaaaugacugucucuugcggaugcuu

SEQ ID NO: 748491 - RNA, 64 nt, hsa
uuuuuagaacauagaguggcauggccgugcuggaaugacaaauaacuggcgugcuuuuuuuuug

SEQ ID NO: 748492 - RNA, 64 nt, hsa
gguaaggcuaacuccugaucguuucuguagaaagaugacaaauaaagaaaaaguuauaauuauu

SEQ ID NO: 748493 - RNA, 64 nt, hsa
acugcaaaugucaucagaacuuuuugguuugcagaugacaaaaauucaacucagacuaguuuag

SEQ ID NO: 748494 - RNA, 64 nt, hsa
aaaauuugaagaaugaacaaauugaacucuuugaaugacaaagaguagacauuucucuuacugc

SEQ ID NO: 748495 - RNA, 64 nt, hsa
agggcucaaacuacucucuauugguuccaggauaaugacaaauugaaccauauguaaguaaucu

SEQ ID NO: 748496 - RNA, 64 nt, hsa
uccauugagaggaauguuuacagcaguuucaaaaaugacaaagucaguuuggagacagaaaaag

SEQ ID NO: 748497 - RNA, 64 nt, hsa
gaguaaaauccauuuccuuucucuguuucagccuaugacaaaauugauguuuacaggccugcuu

SEQ ID NO: 748498 - RNA, 64 nt, hsa
uuuccucuuuuccccgccugcacccacucugaacaugacaaaaguugccagaguuggggcauug

SEQ ID NO: 748499 - RNA, 64 nt, hsa
uagauuuuaaauguauuauugaccugagaccuuaaugacaaaucacugcuauuagacaauugaa

SEQ ID NO: 748500 - RNA, 64 nt, hsa
uaaacuuuuucagaaagaauugaguagagcaaaaaugacaaagauguguagcuguguucaauuu

SEQ ID NO: 748501 - RNA, 64 nt, hsa
acuuccccuacccugccccuccccaaaagaaaccaugacaaaccuagcuuuuaaaaaauauuuu

SEQ ID NO: 748502 - RNA, 64 nt, hsa
uuuucccuuuuuaaaaaauaccauugaaaucagcaugacaaaaauaacacuguuggcacuuaua

SEQ ID NO: 748503 - RNA, 64 nt, hsa
uucugguauuuaaaaaauaucuaggaggagcuaaaugacaaaacacagcaguguuuugagggag

SEQ ID NO: 748504 - RNA, 64 nt, hsa
cgugguacucugaagcacuugaaaaugggaagcgaugacaaaucugacuuuaaaaaaaaucuuu

SEQ ID NO: 748505 - RNA, 64 nt, hsa
gaaggaacauaccucaaaauaauaagagccaucuaugacaaaaccacagccaacaucauacuga

SEQ ID NO: 748506 - RNA, 64 nt, hsa
uaccauucuggacauaggaacggaaaaagauuucaugacaaagaucccaaaaauaauuguaacg

SEQ ID NO: 748507 - RNA, 64 nt, hsa
gaggggcauucacaaggcacaccagugcaagcagaugacaaaaaggugcagaaggcaaucuuaa

SEQ ID NO: 748508 - RNA, 64 nt, hsa
aucggcucucauucgaucgagcuauucucuuaaaaugacaaaaaguguccauaaagaggcugcu

SEQ ID NO: 748509 - RNA, 64 nt, hsa
cauaauaaaacuuggcagauucuacaagucuauuaugacaaaccaggaacuaauucuauaaugg

SEQ ID NO: 748510 - RNA, 64 nt, hsa
aggaacuacuugaaauaguaauuuguuaaaagauaugacaaaaugaaaaugcuuaaacuacaga

SEQ ID NO: 748511 - RNA, 63 nt, hsa
ggggagaggggcaaaugccuccgggacugacacuccaggcagcuuugccuucucuccccuguc

SEQ ID NO: 748512 - RNA, 63 nt, hsa
cuguccccucuccuggggcuuaaguggguugcuuccaggcagaagcagccaaggaccgauucc

SEQ ID NO: 748513 - RNA, 63 nt, hsa
guugcuuccaggcagaagcagccaaggaccgauuccaggcacuuucuguagcaaaugacugug

SEQ ID NO: 748514 - RNA, 63 nt, hsa
caggcaccagagccuugaguacuuucuccugccuccaggcauuggcucagggugaauuacaag

SEQ ID NO: 748515 - RNA, 63 nt, hsa
ugaagccuagacaaagccgccaggucuuguggcuccaggcaccagagccuugaguacuuucuc

SEQ ID NO: 748516 - RNA, 63 nt, hsa
ggagguguguggaaggcacucuuuccaccucucuccaggcauuauccccaggugcugaaaugg

SEQ ID NO: 748517 - RNA, 63 nt, hsa
ugccccacugcugcccucugcagagccaucugcuccaggcacccaccugccucugcuugcuuu

SEQ ID NO: 748518 - RNA, 63 nt, hsa
aaaucuuuaagugcacgauauaguauuguuaauuccaggcaccauguuguacaacagaucuuu

SEQ ID NO: 748519 - RNA, 63 nt, hsa
gcugaggugggagaaucuccugagccuggaagguccaggcagugagccaagauugugccacca

SEQ ID NO: 748520 - RNA, 63 nt, hsa
aaaagaaaacaaaagccagacaaacccaaguuguccaggcaaauaaacucaaaucuuugucac

SEQ ID NO: 748521 - RNA, 63 nt, hsa
aaccaacagaaguuauuuacagaaauucauauauccaggcaacacaaaacuccuuuauucaaa

SEQ ID NO: 748522 - RNA, 63 nt, hsa
ucuggaaguuauuacagggccagcuugccauauuccaggcacacguuaucaaguuugggccua

SEQ ID NO: 748523 - RNA, 63 nt, hsa
ucccuuccauaauuccccucauccaccgcccacuccaggcacucacucaaacuugcucuucaa

SEQ ID NO: 748524 - RNA, 63 nt, hsa
uuuuacaaaacgaaugcucuaaauucugaggauuccaggcaggccauccauagagaaauaacu

SEQ ID NO: 748525 - RNA, 63 nt, hsa
gcaggaaguuccaagggauguauguuuauagcauccaggcaaugaucuuuuuuuuuccacgaa

SEQ ID NO: 748526 - RNA, 63 nt, hsa
uggagcuggacagcacacgccaugccgugaagauccaggcaucuugccgggcucggggcccca

SEQ ID NO: 748527 - RNA, 63 nt, hsa
gagaugcccuagugguggcccagcuggcuggaguccaggcagccaaggugaccagccagcuga

SEQ ID NO: 748528 - RNA, 63 nt, hsa
cugauuuucacaucucuaccuggacauugagccuccaggcaccauguugaggagagaugaaaa

SEQ ID NO: 748529 - RNA, 63 nt, hsa
caggucagccggacagcuccagcagcuccacguuccaggcagccucgcccgccggcugcgcuc

SEQ ID NO: 748530 - RNA, 63 nt, hsa
ggccuguuuucagguguuccuagcauuucugccuccaggcaggacggcaggggugagcagcuu

SEQ ID NO: 748531 - RNA, 63 nt, hsa
ggggcaggaaagugagccauuccuaggcugagguccaggcagcccugccccugaagacccucu

SEQ ID NO: 748532 - RNA, 63 nt, hsa
gcuucccucaugcccuggaauacaacucagagcuccaggcagcggaaccaucuauuguuuugu

SEQ ID NO: 748533 - RNA, 63 nt, hsa
ugguauuuuuuaauuaugaaugcauauccuauuuccaggcaggcucucuuacuugaacacaaa

SEQ ID NO: 748534 - RNA, 63 nt, hsa
caccaagcucccugucacccagccauggugugguccaggcagggacaucucgguacccuuucu

SEQ ID NO: 748535 - RNA, 63 nt, hsa
uccacaaacacuccguggcugagaggcagcggauccaggcagcgaugcugagccaccuccucc

SEQ ID NO: 748536 - RNA, 63 nt, hsa
cugcucucaggaccagagaagggaaaugacuucuccaggcagaggcagaucugagucuagaac

SEQ ID NO: 748537 - RNA, 63 nt, hsa
caaagcaaaggagaguccugggagcccacaagauccaggcagaaggagauggguuuggggcug

SEQ ID NO: 748538 - RNA, 63 nt, hsa
uuuauuggggaggggagcauccuaaaaaugggguccaggcagaccccuccagaccucacacug

SEQ ID NO: 748539 - RNA, 63 nt, hsa
guucagagcauuacucucccacugugccugccauccaggcagccaugggaggcggccucccug

SEQ ID NO: 748540 - RNA, 63 nt, hsa
caagggccccuuugccuucucauccucaggaguuccaggcacaugagucaccguccauccaca

SEQ ID NO: 748541 - RNA, 63 nt, hsa
accacugggaggacguggagaggacagugaacuuccaggcaagagcuuccuucuuuugucuca

SEQ ID NO: 748542 - RNA, 63 nt, hsa
agagggaagguuaagguuggcucuggccaggauuccaggcagcagguuggagugacugguggg

SEQ ID NO: 748543 - RNA, 63 nt, hsa
cagaggaaugauggagaaucuaguguagcagccuccaggcaggauucagcacaacacugggga

SEQ ID NO: 748544 - RNA, 63 nt, hsa
uggcccuggagagugggccugggugguaccugcuccaggcagggaaacugggggcucgcccuu

SEQ ID NO: 748545 - RNA, 63 nt, hsa
gccacccacccaguuuuauaaucccgcucccucuccaggcaaccccacccaccagccuaggcc

SEQ ID NO: 748546 - RNA, 63 nt, hsa
cugucuccuuugcuacaugugaugauucugaaauccaggcagcaggcuggaauaaacgcugcu

SEQ ID NO: 748547 - RNA, 63 nt, hsa
gugcaucaguggccugguugccaggggcugggguccaggcaucuguggacucaaggaguccag

SEQ ID NO: 748548 - RNA, 63 nt, hsa
agucugagggcugcuugguguagucagguuguguccaggcaugcggagcugugagugccugca

SEQ ID NO: 748549 - RNA, 63 nt, hsa
accugcaaaugaguuaaagaagaggcgugggaauccaggcagugguuuuuccuuucggagccu

SEQ ID NO: 748550 - RNA, 63 nt, hsa
aguccaggggcaccuggcuucagguagguuugauccaggcaucaggccauugcaucuauuuuu

SEQ ID NO: 748551 - RNA, 63 nt, hsa
aaacuccaguauauuccagagucagaucuaagcuccaggcacgccugaagauguguugcuacu

SEQ ID NO: 748552 - RNA, 63 nt, hsa
cgauguaugcuuugguugacaggaaguuccuuuuccaggcaggucccguugccaccuccugcu

SEQ ID NO: 748553 - RNA, 63 nt, hsa
ugccccgaggagccaaguuugggacauuuacccuccaggcaucuguguccccucuugaagaga

SEQ ID NO: 748554 - RNA, 63 nt, hsa
cccucuugaagagaaaacacacagcuucacacauccaggcauagggggcaagcucuuggggca

SEQ ID NO: 748555 - RNA, 63 nt, hsa
caucccauuucuucuggggucugugguccauccuccaggcauccauguccaccauagaauuug

SEQ ID NO: 748556 - RNA, 63 nt, hsa
auagaccaacgcuaaagccugugcuccagagccuccaggcaauuggaucagaagucgcagcuc

SEQ ID NO: 748557 - RNA, 64 nt, hsa; identical to SEQ ID NO: 363995

SEQ ID NO: 748558 - RNA, 64 nt, hsa; identical to SEQ ID NO: 363996

SEQ ID NO: 748559 - RNA, 64 nt, hsa; identical to SEQ ID NO: 363997

SEQ ID NO: 748560 - RNA, 64 nt, hsa; identical to SEQ ID NO: 363998

SEQ ID NO: 748561 - RNA, 64 nt, hsa; identical to SEQ ID NO: 363999

SEQ ID NO: 748562 - RNA, 64 nt, hsa; identical to SEQ ID NO: 364000

SEQ ID NO: 748563 - RNA, 64 nt, hsa; identical to SEQ ID NO: 364001

SEQ ID NO: 748564 - RNA, 64 nt, hsa; identical to SEQ ID NO: 364002

SEQ ID NO: 748565 - RNA, 64 nt, hsa; identical to SEQ ID NO: 364003

SEQ ID NO: 748566 - RNA, 64 nt, hsa; identical to SEQ ID NO: 364004

SEQ ID NO: 748567 - RNA, 64 nt, hsa; identical to SEQ ID NO: 364005

SEQ ID NO: 748568 - RNA, 64 nt, hsa; identical to SEQ ID NO: 364006

SEQ ID NO: 748569 - RNA, 64 nt, hsa; identical to SEQ ID NO: 689078

SEQ ID NO: 748570 - RNA, 64 nt, hsa; identical to SEQ ID NO: 689079

SEQ ID NO: 748571 - RNA, 64 nt, hsa; identical to SEQ ID NO: 689080

SEQ ID NO: 748572 - RNA, 64 nt, hsa; identical to SEQ ID NO: 689081

SEQ ID NO: 748573 - RNA, 64 nt, hsa
ccaccuaguaacagucauuucugaaaauauguuggauagaaagucacucuuuggcaaaaguguu

SEQ ID NO: 748574 - RNA, 64 nt, hsa
auuccuuuuaguuuguugguuggcugguuugaacgauagaaauaugcagcaugcaauauaugcu

SEQ ID NO: 748575 - RNA, 64 nt, hsa
aaaugcauauuuauauguguauaccauauguggagauagaaaagaccuuuaagacaauaaaaga

SEQ ID NO: 748576 - RNA, 64 nt, hsa
aagauaaacaaaugcauaguuuucuucuaugggugauagaaacagcuuuuugaaguaaugaaaa

SEQ ID NO: 748577 - RNA, 64 nt, hsa
gacuaauaaucucuauuuauaacuaaaucauugagauagaaaaagauucccauugacuguagac

SEQ ID NO: 748578 - RNA, 64 nt, hsa
gguuggaacgcauuggcuuuuuuuuucuuguuuugauagaaauggaauuaagcaaaaguaguuu

SEQ ID NO: 748579 - RNA, 64 nt, hsa
aucuccuugagaacacugaagcaaucaccauucugauagaaagugcuuaaaccaccacucuuag

SEQ ID NO: 748580 - RNA, 64 nt, hsa
gaggcuuagaugacuucugcaggauuuauauucagauagaaaacaucaaauauuuucaggggag

SEQ ID NO: 748581 - RNA, 64 nt, hsa
ucacauucuuuucaguuggagagaauugggcuaagauagaaaauaacaugauuuguuccuuauu

SEQ ID NO: 748582 - RNA, 64 nt, hsa
ccuauucauauugcugugaaugcuuuaucuuggagauagaaaauauaaugauaaauucaucaug

SEQ ID NO: 748583 - RNA, 64 nt, hsa
ucggccuuaacuccaccugauggcaggugacccggauagaaaauggcccugcguuuagccagga

SEQ ID NO: 748584 - RNA, 64 nt, hsa
uuuuucuuuaaaugauaucacagaauuaauguuggauagaaauaucauuggauagaaaucuguu

SEQ ID NO: 748585 - RNA, 64 nt, hsa
aucacagaauuaauguuggauagaaauaucauuggauagaaaucuguuugaaggaauuuuccug

SEQ ID NO: 748586 - RNA, 64 nt, hsa
ugguuucuuggcuuuccgaaggccaugaucuagagauagaaaaaucccuacuaagucccaacag

SEQ ID NO: 748587 - RNA, 64 nt, hsa
uaggguggccauuuagucugaccugggcuauggggauagaaaagaaaucuuuggggcacugcau

SEQ ID NO: 748588 - RNA, 64 nt, hsa
uauucuuuuaaaaguuauauuuaugacuugcaaugauagaaaacuccuuccaauuaaauggcau

SEQ ID NO: 748589 - RNA, 64 nt, hsa
uaaaaccuuaacuuucuuucuccaggaggguggugauagaaacagaugguaguauuuaugaacu

SEQ ID NO: 748590 - RNA, 64 nt, hsa
aaacaucuaucaagcaacacagccccuuaucccagauagaaaagugucucaaaugcauucuacu

SEQ ID NO: 748591 - RNA, 64 nt, hsa
ugggguauaacaugaugaguacucauuagcaccugauagaaaucugaaaugugacaguagcaaa

SEQ ID NO: 748592 - RNA, 64 nt, hsa; identical to SEQ ID NO: 38237

SEQ ID NO: 748593 - RNA, 64 nt, hsa; identical to SEQ ID NO: 38238

SEQ ID NO: 748594 - RNA, 64 nt, hsa; identical to SEQ ID NO: 38239

SEQ ID NO: 748595 - RNA, 64 nt, hsa; identical to SEQ ID NO: 38240

SEQ ID NO: 748596 - RNA, 64 nt, hsa; identical to SEQ ID NO: 38241

SEQ ID NO: 748597 - RNA, 64 nt, hsa; identical to SEQ ID NO: 38242

SEQ ID NO: 748598 - RNA, 64 nt, hsa; identical to SEQ ID NO: 38243

SEQ ID NO: 748599 - RNA, 64 nt, hsa; identical to SEQ ID NO: 38244

SEQ ID NO: 748600 - RNA, 64 nt, hsa; identical to SEQ ID NO: 38245

SEQ ID NO: 748601 - RNA, 64 nt, hsa; identical to SEQ ID NO: 38246

SEQ ID NO: 748602 - RNA, 64 nt, hsa; identical to SEQ ID NO: 38247

SEQ ID NO: 748603 - RNA, 64 nt, hsa; identical to SEQ ID NO: 38248

SEQ ID NO: 748604 - RNA, 64 nt, hsa; identical to SEQ ID NO: 38249

SEQ ID NO: 748605 - RNA, 64 nt, hsa; identical to SEQ ID NO: 38250

SEQ ID NO: 748606 - RNA, 64 nt, hsa; identical to SEQ ID NO: 38251

SEQ ID NO: 748607 - RNA, 64 nt, hsa; identical to SEQ ID NO: 38252

SEQ ID NO: 748608 - RNA, 64 nt, hsa; identical to SEQ ID NO: 38253

SEQ ID NO: 748609 - RNA, 64 nt, hsa; identical to SEQ ID NO: 38254

SEQ ID NO: 748610 - RNA, 64 nt, hsa; identical to SEQ ID NO: 110144

SEQ ID NO: 748611 - RNA, 64 nt, hsa; identical to SEQ ID NO: 110145

SEQ ID NO: 748612 - RNA, 64 nt, hsa; identical to SEQ ID NO: 110146

SEQ ID NO: 748613 - RNA, 64 nt, hsa; identical to SEQ ID NO: 110147

SEQ ID NO: 748614 - RNA, 64 nt, hsa; identical to SEQ ID NO: 110148

SEQ ID NO: 748615 - RNA, 64 nt, hsa; identical to SEQ ID NO: 110149

SEQ ID NO: 748616 - RNA, 64 nt, hsa; identical to SEQ ID NO: 110150

SEQ ID NO: 748617 - RNA, 64 nt, hsa; identical to SEQ ID NO: 110151

SEQ ID NO: 748618 - RNA, 64 nt, hsa; identical to SEQ ID NO: 110152

SEQ ID NO: 748619 - RNA, 64 nt, hsa; identical to SEQ ID NO: 110153

SEQ ID NO: 748620 - RNA, 64 nt, hsa; identical to SEQ ID NO: 110154

SEQ ID NO: 748621 - RNA, 64 nt, hsa; identical to SEQ ID NO: 110155

SEQ ID NO: 748622 - RNA, 64 nt, hsa; identical to SEQ ID NO: 110156

SEQ ID NO: 748623 - RNA, 64 nt, hsa; identical to SEQ ID NO: 110157

SEQ ID NO: 748624 - RNA, 64 nt, hsa; identical to SEQ ID NO: 110158

SEQ ID NO: 748625 - RNA, 64 nt, hsa; identical to SEQ ID NO: 110159

SEQ ID NO: 748626 - RNA, 64 nt, hsa; identical to SEQ ID NO: 110160

SEQ ID NO: 748627 - RNA, 64 nt, hsa; identical to SEQ ID NO: 110161

SEQ ID NO: 748628 - RNA, 64 nt, hsa; identical to SEQ ID NO: 110162

SEQ ID NO: 748629 - RNA, 64 nt, hsa; identical to SEQ ID NO: 110163

SEQ ID NO: 748630 - RNA, 64 nt, hsa; identical to SEQ ID NO: 110164

SEQ ID NO: 748631 - RNA, 64 nt, hsa; identical to SEQ ID NO: 110165

SEQ ID NO: 748632 - RNA, 64 nt, hsa; identical to SEQ ID NO: 110166

SEQ ID NO: 748633 - RNA, 62 nt, hsa
aggaagaauaagagugcaccagaauaagagcgcaccagaauaagagcgcaccagcuaacaau

SEQ ID NO: 748634 - RNA, 62 nt, hsa
aaaaucuucucuugaaaggaagaauaagagugcaccagaauaagagcgcaccagaauaagag

SEQ ID NO: 748635 - RNA, 62 nt, hsa
ccucgagaaaagagccaagcgcaucgggagcacaccagaaaccggcccugagcacgagaaga

SEQ ID NO: 748636 - RNA, 62 nt, hsa
ucaucggacucacccgaucacagacgagcggucaccagaaucgcccgaucacagacgagcag

SEQ ID NO: 748637 - RNA, 62 nt, hsa
agauaaccuuugaagcuuauuguacuggccugcaccagaagaugucugcauuacucauugcu

SEQ ID NO: 748638 - RNA, 62 nt, hsa
guguuaugugccuguauuuuuuuaaaaugguacaccagaaaaggacuggcagucuacuucua

SEQ ID NO: 748639 - RNA, 62 nt, hsa
aaucuucagaggugcuaaauugucugccauuacaccagaaggaugccucugauaggaggaca

SEQ ID NO: 748640 - RNA, 62 nt, hsa
auagcuuuguauuuuugucauugauuaaauugcaccagaaauguuuauggaaauauuaagaa

SEQ ID NO: 748641 - RNA, 62 nt, hsa
cucuuccuacuccugagucuacacccgugcuucaccagaagacccugcaggccaugaagagc

SEQ ID NO: 748642 - RNA, 62 nt, hsa
ccaaagccaucaugggagacauccagauggcacaccagaacuuaaugcuggaucccauggga

SEQ ID NO: 748643 - RNA, 62 nt, hsa
gggccagccucucucuuuugcccugcucuccacaccagaaaugcccccaggugcuuggcugc

SEQ ID NO: 748644 - RNA, 62 nt, hsa
gaugcucuuuaagaaguucgcaccccugcugacaccagaacagcccaaaucagaguucccag

SEQ ID NO: 748645 - RNA, 62 nt, hsa
ccuccgcugcuccuuuuuggaaugcgagcucccaccagaagaagguuccggcacgaauccca

SEQ ID NO: 748646 - RNA, 62 nt, hsa
ucacucagcucacagggcgugccaggcggcaacaccagaaucuuccagaagcccagcuccac

SEQ ID NO: 748647 - RNA, 62 nt, hsa
cauuauuguagaauaagucauuguauuuuuaacaccagaaagaaccuugccgaucaccaggc

SEQ ID NO: 748648 - RNA, 62 nt, hsa
gaaacacagaaaggcaucuaaguuagagcuggcaccagaacugagaccuccagaaaucuauu

SEQ ID NO: 748649 - RNA, 62 nt, hsa
aauccuuuagccagcguuucaaccucauucaacaccagaaaguucacaguggaaaaaaucuu

SEQ ID NO: 748650 - RNA, 62 nt, hsa
aagguuucagccaaaggccuaacccuauucaacaccagaaaguuuacacuggagaaaggccu

SEQ ID NO: 748651 - RNA, 64 nt, hsa; identical to SEQ ID NO: 658151

SEQ ID NO: 748652 - RNA, 64 nt, hsa; identical to SEQ ID NO: 658152

SEQ ID NO: 748653 - RNA, 64 nt, hsa; identical to SEQ ID NO: 658153

SEQ ID NO: 748654 - RNA, 64 nt, hsa; identical to SEQ ID NO: 658154

SEQ ID NO: 748655 - RNA, 64 nt, hsa; identical to SEQ ID NO: 658155

SEQ ID NO: 748656 - RNA, 64 nt, hsa; identical to SEQ ID NO: 658156

SEQ ID NO: 748657 - RNA, 64 nt, hsa; identical to SEQ ID NO: 658157

SEQ ID NO: 748658 - RNA, 64 nt, hsa; identical to SEQ ID NO: 658158

SEQ ID NO: 748659 - RNA, 64 nt, hsa; identical to SEQ ID NO: 658159

SEQ ID NO: 748660 - RNA, 64 nt, hsa; identical to SEQ ID NO: 658160

SEQ ID NO: 748661 - RNA, 64 nt, hsa; identical to SEQ ID NO: 658161

SEQ ID NO: 748662 - RNA, 64 nt, hsa; identical to SEQ ID NO: 658162

SEQ ID NO: 748663 - RNA, 64 nt, hsa
ugcuuguuuacaacugaagaucaugcuauauuuuauauaugaagccccuaaugcaaagcucuuu

SEQ ID NO: 748664 - RNA, 64 nt, hsa
aagaaaagauguuauucugaguuuguuuuaauacauauaugaacauauaguuuuauucaauuaa

SEQ ID NO: 748665 - RNA, 64 nt, hsa
aggcuuguuucaagagguuugacagaagaaaggaauauaugaacuuaaugagaugucgacuugg

SEQ ID NO: 748666 - RNA, 64 nt, hsa
gugaggaguacaguguuuucuaauucauucaaguauauaugauuuaaaccugggcuacugacac

SEQ ID NO: 748667 - RNA, 64 nt, hsa
aacugcaauuuaaaaaguguguuugguuauuaauauauaugagacuuuuaaagaaaguuauaua

SEQ ID NO: 748668 - RNA, 64 nt, hsa
ggacaguuucccauaugaguaauuagaagugguuauauaugaugaaugcuaugcagauguuguc

SEQ ID NO: 748669 - RNA, 64 nt, hsa
uuauuuugaaagauuuauauaugaugaauucuggauauaugaccaauaaaacugaugaagcaaa

SEQ ID NO: 748670 - RNA, 64 nt, hsa
uauucuuguaauagcucauuauuuugaaagauuuauauaugaugaauucuggauauaugaccaa

SEQ ID NO: 748671 - RNA, 64 nt, hsa
ccugagauagcucugcagauaagaaaauauuuaaauauaugacaaaaaguaaaauuguacaugu

SEQ ID NO: 748672 - RNA, 64 nt, hsa
uauccacuccagugagauuaugauuuguagcuucauauaugacauguuuauauuguaaaugcac

SEQ ID NO: 748673 - RNA, 64 nt, hsa
gucucaaaaauaaauaaauaaaauagauaaauaaauauaugauuaacuaauuuuaaaaauguua

SEQ ID NO: 748674 - RNA, 64 nt, hsa
auaacuuuucuaaagccuuaagucuuaauauuaaauauaugauuagccaggcacgguggcugac

SEQ ID NO: 748675 - RNA, 64 nt, hsa
cgcuauuuaugcauaaauauuuucauuuuaaguaauauaugaaguguaaauacucgauauauaa

SEQ ID NO: 748676 - RNA, 64 nt, hsa
cccuuuguuccuaucuucuaaaggaaaguauaucauauaugaugauguaacugaucuaaucagu

SEQ ID NO: 748677 - RNA, 64 nt, hsa
gcccaaaauuugauggacuaauuauuauuuuaaaauauaugaagacaauaauucuacauguugu

SEQ ID NO: 748678 - RNA, 64 nt, hsa
accaccagguaucaaaucaacuuuuaugcagcaaauauaugauucuagugucugacuuuuguua

SEQ ID NO: 748679 - RNA, 64 nt, hsa
uggcggguaaaaaucacaaaaugcagucgaauauauauaugaaaacuugcauuaggugauaaag

SEQ ID NO: 748680 - RNA, 64 nt, hsa
aauuacaacaucaaaauaguuacaucuugugaaaauauaugauuuuuaugucaaucaagacaaa

SEQ ID NO: 748681 - RNA, 64 nt, hsa
cugcuuuauucaauaaaaaaaagaaaugaaaaagauauaugaauaugacaaaguauugcugagu

SEQ ID NO: 748682 - RNA, 64 nt, hsa
cugaauaugaauagauacagcagaggcacuccugauauaugauuuuuauccaugcgucaguuuu

SEQ ID NO: 748683 - RNA, 64 nt, hsa
uauauaugauauauaugugauauauauauaucauauauaugauauauauauauauaucacauau

SEQ ID NO: 748684 - RNA, 64 nt, hsa
ggucaccuucuuggaucugcugucuaaaugauauauauaugauauauaugugauauauauauau

SEQ ID NO: 748685 - RNA, 64 nt, hsa
augguaacuggucauauaugacagucuacugcauauauaugaaugacuaggauuaaucuggugu

SEQ ID NO: 748686 - RNA, 64 nt, hsa
aaauaugguauuauaguuuguaugguaacuggucauauaugacagucuacugcauauauaugaa

SEQ ID NO: 748687 - RNA, 64 nt, hsa
aaauccauacagugaggaaucagaguguuuauagauauaugaguugaaugcaauuuuuauuuuu

SEQ ID NO: 748688 - RNA, 64 nt, hsa
uagaaaaaucgaaagugcacagcacuuaaagggaauauaugagguuuuuuuuuuuuuaaaaaaa

SEQ ID NO: 748689 - RNA, 64 nt, hsa
auauguguguguguauguauauguacauauacauauauaugaguguauaauucuaaauuucuaa

SEQ ID NO: 748690 - RNA, 64 nt, hsa
ccaucccccacaguccuggaguaaaucaaaaucaauauaugauucuuuuaaacauuaaguuuga

SEQ ID NO: 748691 - RNA, 64 nt, hsa
acaacuuaauggauuagcuuuuggguuuaacugaauauaugaagaaauugggucugucuaaaga

SEQ ID NO: 748692 - RNA, 64 nt, hsa
aaacauacagauuccuaauucuaugacaguguacauauaugaaaauaaaugaugaaaaaagaac

SEQ ID NO: 748693 - RNA, 64 nt, hsa
agcauucuccagcaaugacaaagugccagaguguauauaugaaagcuaaggaaagcacaaaaca

SEQ ID NO: 748694 - RNA, 64 nt, hsa
uagacccuucacacaggaaaugugaacaauuguuauauaugaacacucaaaucuuuuacuguaa

SEQ ID NO: 748695 - RNA, 64 nt, hsa
gagaacgaaagccaaagugucauuuaagagagauauauaugaaaaaguaacauuaauauauaga

SEQ ID NO: 748696 - RNA, 64 nt, hsa
auauguauguauauauauauaugaaaauauauauauauaugaaaaauaaagcuuaauuguccca

SEQ ID NO: 748697 - RNA, 64 nt, hsa
gcaaauuguuuccuuuauauauguauguauauauauauaugaaaauauauauauauaugaaaaa

SEQ ID NO: 748698 - RNA, 64 nt, hsa
caguguuuauugguuaguuuuuuuuuuuacaauuauauaugaugcuauuguuugguuuuuccau

SEQ ID NO: 748699 - RNA, 64 nt, hsa
ucucacuuuaaauaauuuaaaacaaauuaaagugauauaugaguuaaaugaccaagcagacuug

SEQ ID NO: 748700 - RNA, 64 nt, hsa
uucuguacugcuauucuauauuuauuauuuuuaaauauaugacauguuuacuacuuaaacauga

SEQ ID NO: 748701 - RNA, 64 nt, hsa
aauaaauacaucacagacagaaaccuuuauaaaaauauaugauucuauaaagaaucauuagaaa

SEQ ID NO: 748702 - RNA, 64 nt, hsa
guugugacagugcuguuuggcuuuuucauucuucaaaugccaagucauccacuuuguuuuccug

SEQ ID NO: 748703 - RNA, 64 nt, hsa
uuagcaaguuggcauuaacauuuaugcuuuaauuaaaugccaguauaccuaugugugcagcagu

SEQ ID NO: 748704 - RNA, 64 nt, hsa
cagucugcccuguccuucugcucauaaccugacaaaaugccaaacuaguaagcaggauagcuga

SEQ ID NO: 748705 - RNA, 64 nt, hsa
aucuuaagcauuucacuuauuagauauuguucaaaaaugccauuuuuaauauuuguauaauacc

SEQ ID NO: 748706 - RNA, 64 nt, hsa
gccugguugggccugggcaaugggaaggagccagaaaugccaucuucacccagaaacaaagaau

SEQ ID NO: 748707 - RNA, 64 nt, hsa
uuugacagagauacugcuggaaaaauuaaaauuaaaaugccauaauagcuaccuaacaaauaua

SEQ ID NO: 748708 - RNA, 64 nt, hsa
uccugggcaacuaccuaugguucaaaaaauaaagaaaugccagaauacaaauaugaaagcucug

SEQ ID NO: 748709 - RNA, 64 nt, hsa
auucuaagacuggugcuucugcuuuugaaggggaaaaugccaauuuuuacuguaauaaguaaug

SEQ ID NO: 748710 - RNA, 64 nt, hsa
uaauguguuuuaaaauauaaagcuacauccaaagaaaugccaauaugugacauuaguaugaaau

SEQ ID NO: 748711 - RNA, 64 nt, hsa
guauagacauggugguaggaauagcaacuaauacaaaugccaauaugauaauaaaauacauuug

SEQ ID NO: 748712 - RNA, 64 nt, hsa
cagaaugauacagaguuagcagguuuuucuaaggaaaugccauucaaaugccuccuaacuuuua

SEQ ID NO: 748713 - RNA, 64 nt, hsa
cacuuuuuuuuuuucaaguaucucucuaauaacuaaaugccacuuauuugcauucuccuugugg

SEQ ID NO: 748714 - RNA, 64 nt, hsa
agcaacaguuugucuccaguccacaaucuuucaaaaaugccauuuaugcuacuacugacuguau

SEQ ID NO: 748715 - RNA, 64 nt, hsa
aaaucaggauuauauacauaagaauuccacuaagaaaugccaagauucuuaaauuugccagcgu

SEQ ID NO: 748716 - RNA, 64 nt, hsa
guuuauuuauacuauauucugcauacaguacuuuaaaugccaauuacagugcaaucuuuauuua

SEQ ID NO: 748717 - RNA, 64 nt, hsa
auguuuuuaaaaagauaagagcaucuagugcauuaaaugccaaaaaaaaaauacauuaucagug

SEQ ID NO: 748718 - RNA, 64 nt, hsa
gcauuauuagguuaauuaauccaauuaaugacccaaaugccaagguaauuuuaaauuuacauuu

SEQ ID NO: 748719 - RNA, 64 nt, hsa
auauuuuguucacacuaauaaagcuuaugcucagaaaugccauacacacacacacacacacaca

SEQ ID NO: 748720 - RNA, 64 nt, hsa
uggaauaaggaagagaagauugaccaaaccauccaaaugccaaaaagaaaaagaaaaaaaaaag

SEQ ID NO: 748721 - RNA, 64 nt, hsa
ugcgaaugccccauagcagaagucccgggaagguaaaugccaaacccagagccaugugagauuc

SEQ ID NO: 748722 - RNA, 64 nt, hsa
ucucuggcacuuugaguuaagucuaucugguauuaaaugccaaggaccuuuugcugccuaaauc

SEQ ID NO: 748723 - RNA, 64 nt, hsa
ggcuacacaauuggaagucuaagaacccauggaaaaaugccaucaaaugaauaaugccuuugua

SEQ ID NO: 748724 - RNA, 64 nt, hsa
ugagggcauugugaaaagcuuugcugugauuuaaaaaugccagcaauuuuaaucuagcaguguu

SEQ ID NO: 748725 - RNA, 64 nt, hsa
uggacaauguaacccuaaacacaucauguauuuuaaaugccaccuacauaaauaaaacauaagc

SEQ ID NO: 748726 - RNA, 64 nt, hsa
cucaguguggcuggagguugaaaugccaccaggaaaaugccacuucauaauugaaaggggaaag

SEQ ID NO: 748727 - RNA, 64 nt, hsa
uuauuagacaccugcucaguguggcuggagguugaaaugccaccaggaaaaugccacuucauaa

SEQ ID NO: 748728 - RNA, 64 nt, hsa
acaucuggguggaggaguaaauuccugugcucugaaaugccacuugguagcucuggacaaugaa

SEQ ID NO: 748729 - RNA, 64 nt, hsa
aucuuuuacuguacauucccaaggcuuuaguuuuaaaugccacugugccuuuaacaagguugua

SEQ ID NO: 748730 - RNA, 64 nt, hsa
cucagggcuuguguaauauucugggaggucauuuaaaugccagaaauggucaagcaauuauaca

SEQ ID NO: 748731 - RNA, 64 nt, hsa
guggcgcagugaugcauggccuguugacacuugaaaaugccagucuuuuggcacuucagcacau

SEQ ID NO: 748732 - RNA, 64 nt, hsa
cuuguauaaaaauggucuggucaguauagggcacaaaugccaaacaaaguauuaguguuaacac

SEQ ID NO: 748733 - RNA, 64 nt, hsa
cacuucaguagauuagucucagaauggacacuacaaaugccagcucucaccagauggccuacgu

SEQ ID NO: 748734 - RNA, 64 nt, hsa
ggcaugagaaauacaaaaauacucagauaagguaaaaugccaugaugccucugucuucuggacu

SEQ ID NO: 748735 - RNA, 64 nt, hsa
ggucuguagugucacucaaggcggugcuugauagaaaugccaagcacuucuuuuucucgcuguc

SEQ ID NO: 748736 - RNA, 64 nt, hsa
ggauauguaugaaguccaugcugucuguuaaauaaaaugccauucugcagaauuaaccauccca

SEQ ID NO: 748737 - RNA, 64 nt, hsa
auuccauggaauguuuuuaauaaguaggcaagaaaaaugccacuaaucaaagcauuaagugugu

SEQ ID NO: 748738 - RNA, 64 nt, hsa
cauccuaagaauaauaacuguaauggcaaagcggaaaugccaguuccuccuguauuccauugag

SEQ ID NO: 748739 - RNA, 64 nt, hsa
augauauuuaaaauaguucucaguugaagcagagaaaugccacugugcuaguugcccaaauguu

SEQ ID NO: 748740 - RNA, 64 nt, hsa
uuuuuuuucaaaguuugcuuaauagguuauacaaaaaugccacaguggccgcguguauauuguu

SEQ ID NO: 748741 - RNA, 64 nt, hsa
aaaaaaaaaauucugguugaagauagaggauaugaaaugccauaagacccaaucaaaugaagaa

SEQ ID NO: 748742 - RNA, 64 nt, hsa
ccgcuuugcccuugaccuggcuagggagccaaggaaaugccaugguucuuggucauaagacaca

SEQ ID NO: 748743 - RNA, 64 nt, hsa
uuggaauggaugcuacucuaggccuuaaacugagaaaugccaggcuauuguagcuauuauaucu

SEQ ID NO: 748744 - RNA, 64 nt, hsa
aacagagaaauagaggugaugcugcuaaagggagaaaugccaggcggacaaaguucagugucgg

SEQ ID NO: 748745 - RNA, 64 nt, hsa
cuuacaagcuuaaagcuugauuugaucuuuguuuaaaugccaaaauguacuuaaaugaguuacu

SEQ ID NO: 748746 - RNA, 64 nt, hsa
agcagugaagagauaaagaaaaaaaaguacaaccaaaugccagucaggcacagcagaaaccuac

SEQ ID NO: 748747 - RNA, 64 nt, hsa
guucugaugacucacaugauggggagucugaaucaaaugccaaaguagcugauguauuggacgu

SEQ ID NO: 748748 - RNA, 64 nt, hsa
ccaccaagggaguuaaccuaccugaacuaaguagaaaugccagucuuccacuacccccucccug

SEQ ID NO: 748749 - RNA, 64 nt, hsa
augggguuggggaauaggguugucuuuccuaugaaaaugccaucuguagaccuugugagucagc

SEQ ID NO: 748750 - RNA, 64 nt, hsa
uccugauuugccaccuucauuuuuccaucugcugaaaugccauuucagaauguauaaaaguacu

SEQ ID NO: 748751 - RNA, 64 nt, hsa
auuuaauauucuguuuuauacuauaaaguuaugaaaaugccaaacuuguuuauuuaauuguuuu

SEQ ID NO: 748752 - RNA, 64 nt, hsa; identical to SEQ ID NO: 271043

SEQ ID NO: 748753 - RNA, 64 nt, hsa; identical to SEQ ID NO: 271044

SEQ ID NO: 748754 - RNA, 64 nt, hsa; identical to SEQ ID NO: 271045

SEQ ID NO: 748755 - RNA, 64 nt, hsa; identical to SEQ ID NO: 271046

SEQ ID NO: 748756 - RNA, 64 nt, hsa; identical to SEQ ID NO: 271047

SEQ ID NO: 748757 - RNA, 64 nt, hsa; identical to SEQ ID NO: 271048

SEQ ID NO: 748758 - RNA, 64 nt, hsa; identical to SEQ ID NO: 271049

SEQ ID NO: 748759 - RNA, 64 nt, hsa; identical to SEQ ID NO: 271050

SEQ ID NO: 748760 - RNA, 64 nt, hsa; identical to SEQ ID NO: 271051

SEQ ID NO: 748761 - RNA, 64 nt, hsa; identical to SEQ ID NO: 271052

SEQ ID NO: 748762 - RNA, 64 nt, hsa; identical to SEQ ID NO: 271053

SEQ ID NO: 748763 - RNA, 64 nt, hsa; identical to SEQ ID NO: 271054

SEQ ID NO: 748764 - RNA, 64 nt, hsa; identical to SEQ ID NO: 271055

SEQ ID NO: 748765 - RNA, 64 nt, hsa; identical to SEQ ID NO: 271056

SEQ ID NO: 748766 - RNA, 64 nt, hsa; identical to SEQ ID NO: 271057

SEQ ID NO: 748767 - RNA, 64 nt, hsa; identical to SEQ ID NO: 271058

SEQ ID NO: 748768 - RNA, 64 nt, hsa; identical to SEQ ID NO: 271059

SEQ ID NO: 748769 - RNA, 64 nt, hsa; identical to SEQ ID NO: 271060

SEQ ID NO: 748770 - RNA, 64 nt, hsa; identical to SEQ ID NO: 271061

SEQ ID NO: 748771 - RNA, 64 nt, hsa; identical to SEQ ID NO: 271062

SEQ ID NO: 748772 - RNA, 64 nt, hsa; identical to SEQ ID NO: 271063

SEQ ID NO: 748773 - RNA, 64 nt, hsa; identical to SEQ ID NO: 271064

SEQ ID NO: 748774 - RNA, 64 nt, hsa; identical to SEQ ID NO: 271065

SEQ ID NO: 748775 - RNA, 64 nt, hsa; identical to SEQ ID NO: 271066

SEQ ID NO: 748776 - RNA, 64 nt, hsa; identical to SEQ ID NO: 271067

SEQ ID NO: 748777 - RNA, 64 nt, hsa; identical to SEQ ID NO: 271068

SEQ ID NO: 748778 - RNA, 64 nt, hsa; identical to SEQ ID NO: 237976

SEQ ID NO: 748779 - RNA, 64 nt, hsa; identical to SEQ ID NO: 237977

SEQ ID NO: 748780 - RNA, 64 nt, hsa; identical to SEQ ID NO: 237978

SEQ ID NO: 748781 - RNA, 64 nt, hsa; identical to SEQ ID NO: 237979

SEQ ID NO: 748782 - RNA, 64 nt, hsa; identical to SEQ ID NO: 237980

SEQ ID NO: 748783 - RNA, 64 nt, hsa; identical to SEQ ID NO: 237981

SEQ ID NO: 748784 - RNA, 64 nt, hsa; identical to SEQ ID NO: 237982

SEQ ID NO: 748785 - RNA, 64 nt, hsa; identical to SEQ ID NO: 237983

SEQ ID NO: 748786 - RNA, 64 nt, hsa; identical to SEQ ID NO: 237984

SEQ ID NO: 748787 - RNA, 64 nt, hsa; identical to SEQ ID NO: 237985

SEQ ID NO: 748788 - RNA, 64 nt, hsa; identical to SEQ ID NO: 237986

SEQ ID NO: 748789 - RNA, 64 nt, hsa; identical to SEQ ID NO: 237987

SEQ ID NO: 748790 - RNA, 64 nt, hsa; identical to SEQ ID NO: 237988

SEQ ID NO: 748791 - RNA, 64 nt, hsa; identical to SEQ ID NO: 237989

SEQ ID NO: 748792 - RNA, 64 nt, hsa; identical to SEQ ID NO: 237990

SEQ ID NO: 748793 - RNA, 64 nt, hsa; identical to SEQ ID NO: 237991

SEQ ID NO: 748794 - RNA, 64 nt, hsa; identical to SEQ ID NO: 237992

SEQ ID NO: 748795 - RNA, 64 nt, hsa; identical to SEQ ID NO: 237993

SEQ ID NO: 748796 - RNA, 64 nt, hsa; identical to SEQ ID NO: 237994

SEQ ID NO: 748797 - RNA, 64 nt, hsa; identical to SEQ ID NO: 237995

SEQ ID NO: 748798 - RNA, 64 nt, hsa; identical to SEQ ID NO: 237996

SEQ ID NO: 748799 - RNA, 64 nt, hsa; identical to SEQ ID NO: 237997

SEQ ID NO: 748800 - RNA, 64 nt, hsa; identical to SEQ ID NO: 237998

SEQ ID NO: 748801 - RNA, 64 nt, hsa; identical to SEQ ID NO: 237999

SEQ ID NO: 748802 - RNA, 64 nt, hsa; identical to SEQ ID NO: 238000

SEQ ID NO: 748803 - RNA, 64 nt, hsa; identical to SEQ ID NO: 238001

SEQ ID NO: 748804 - RNA, 64 nt, hsa; identical to SEQ ID NO: 238002

SEQ ID NO: 748805 - RNA, 64 nt, hsa; identical to SEQ ID NO: 238003

SEQ ID NO: 748806 - RNA, 64 nt, hsa; identical to SEQ ID NO: 238004

SEQ ID NO: 748807 - RNA, 64 nt, hsa; identical to SEQ ID NO: 238005

SEQ ID NO: 748808 - RNA, 64 nt, hsa; identical to SEQ ID NO: 238006

SEQ ID NO: 748809 - RNA, 64 nt, hsa; identical to SEQ ID NO: 238007

SEQ ID NO: 748810 - RNA, 64 nt, hsa; identical to SEQ ID NO: 238008

SEQ ID NO: 748811 - RNA, 64 nt, hsa; identical to SEQ ID NO: 238009

SEQ ID NO: 748812 - RNA, 64 nt, hsa; identical to SEQ ID NO: 238010

SEQ ID NO: 748813 - RNA, 64 nt, hsa; identical to SEQ ID NO: 238011

SEQ ID NO: 748814 - RNA, 64 nt, hsa; identical to SEQ ID NO: 238012

SEQ ID NO: 748815 - RNA, 64 nt, hsa; identical to SEQ ID NO: 238013

SEQ ID NO: 748816 - RNA, 64 nt, hsa; identical to SEQ ID NO: 238014

SEQ ID NO: 748817 - RNA, 64 nt, hsa; identical to SEQ ID NO: 238015

SEQ ID NO: 748818 - RNA, 64 nt, hsa; identical to SEQ ID NO: 238016

SEQ ID NO: 748819 - RNA, 64 nt, hsa; identical to SEQ ID NO: 238017

SEQ ID NO: 748820 - RNA, 64 nt, hsa; identical to SEQ ID NO: 238018

SEQ ID NO: 748821 - RNA, 64 nt, hsa; identical to SEQ ID NO: 238019

SEQ ID NO: 748822 - RNA, 64 nt, hsa; identical to SEQ ID NO: 238020

SEQ ID NO: 748823 - RNA, 64 nt, hsa; identical to SEQ ID NO: 238021

SEQ ID NO: 748824 - RNA, 64 nt, hsa; identical to SEQ ID NO: 238022

SEQ ID NO: 748825 - RNA, 64 nt, hsa; identical to SEQ ID NO: 238023

SEQ ID NO: 748826 - RNA, 64 nt, hsa; identical to SEQ ID NO: 238024

SEQ ID NO: 748827 - RNA, 64 nt, hsa; identical to SEQ ID NO: 238025

SEQ ID NO: 748828 - RNA, 64 nt, hsa; identical to SEQ ID NO: 283920

SEQ ID NO: 748829 - RNA, 64 nt, hsa; identical to SEQ ID NO: 283921

SEQ ID NO: 748830 - RNA, 64 nt, hsa; identical to SEQ ID NO: 283922

SEQ ID NO: 748831 - RNA, 64 nt, hsa; identical to SEQ ID NO: 283923

SEQ ID NO: 748832 - RNA, 64 nt, hsa; identical to SEQ ID NO: 283924

SEQ ID NO: 748833 - RNA, 64 nt, hsa; identical to SEQ ID NO: 283925

SEQ ID NO: 748834 - RNA, 64 nt, hsa; identical to SEQ ID NO: 283926

SEQ ID NO: 748835 - RNA, 64 nt, hsa; identical to SEQ ID NO: 283927

SEQ ID NO: 748836 - RNA, 64 nt, hsa; identical to SEQ ID NO: 283928

SEQ ID NO: 748837 - RNA, 64 nt, hsa; identical to SEQ ID NO: 283929

SEQ ID NO: 748838 - RNA, 64 nt, hsa; identical to SEQ ID NO: 283930

SEQ ID NO: 748839 - RNA, 64 nt, hsa; identical to SEQ ID NO: 283931

SEQ ID NO: 748840 - RNA, 64 nt, hsa; identical to SEQ ID NO: 283932

SEQ ID NO: 748841 - RNA, 64 nt, hsa; identical to SEQ ID NO: 283933

SEQ ID NO: 748842 - RNA, 64 nt, hsa; identical to SEQ ID NO: 283934

SEQ ID NO: 748843 - RNA, 64 nt, hsa; identical to SEQ ID NO: 283935

SEQ ID NO: 748844 - RNA, 64 nt, hsa; identical to SEQ ID NO: 283930

SEQ ID NO: 748845 - RNA, 64 nt, hsa; identical to SEQ ID NO: 283937

SEQ ID NO: 748846 - RNA, 64 nt, hsa; identical to SEQ ID NO: 283938

SEQ ID NO: 748847 - RNA, 64 nt, hsa; identical to SEQ ID NO: 283939

SEQ ID NO: 748848 - RNA, 64 nt, hsa; identical to SEQ ID NO: 283940

SEQ ID NO: 748849 - RNA, 64 nt, hsa; identical to SEQ ID NO: 283941

SEQ ID NO: 748850 - RNA, 64 nt, hsa; identical to SEQ ID NO: 283942

SEQ ID NO: 748851 - RNA, 64 nt, hsa; identical to SEQ ID NO: 283943

SEQ ID NO: 748852 - RNA, 64 nt, hsa; identical to SEQ ID NO: 283944

SEQ ID NO: 748853 - RNA, 60 nt, hsa; identical to SEQ ID NO: 283945

SEQ ID NO: 748854 - RNA, 64 nt, hsa; identical to SEQ ID NO: 283946

SEQ ID NO: 748855 - RNA, 64 nt, hsa; identical to SEQ ID NO: 283947

SEQ ID NO: 748856 - RNA, 64 nt, hsa; identical to SEQ ID NO: 283948

SEQ ID NO: 748857 - RNA, 64 nt, hsa; identical to SEQ ID NO: 283949

SEQ ID NO: 748858 - RNA, 64 nt, hsa; identical to SEQ ID NO: 283950

SEQ ID NO: 748859 - RNA, 64 nt, hsa; identical to SEQ ID NO: 283951

SEQ ID NO: 748860 - RNA, 64 nt, hsa; identical to SEQ ID NO: 283952

SEQ ID NO: 748861 - RNA, 64 nt, hsa; identical to SEQ ID NO: 283953

SEQ ID NO: 748862 - RNA, 64 nt, hsa; identical to SEQ ID NO: 283954

SEQ ID NO: 748863 - RNA, 64 nt, hsa; identical to SEQ ID NO: 283955

SEQ ID NO: 748864 - RNA, 64 nt, hsa; identical to SEQ ID NO: 283956

SEQ ID NO: 748865 - RNA, 64 nt, hsa; identical to SEQ ID NO: 283957

SEQ ID NO: 748866 - RNA, 64 nt, hsa; identical to SEQ ID NO: 283958

SEQ ID NO: 748867 - RNA, 64 nt, hsa; identical to SEQ ID NO: 283959

SEQ ID NO: 748868 - RNA, 64 nt, hsa; identical to SEQ ID NO: 283960

SEQ ID NO: 748869 - RNA, 64 nt, hsa; identical to SEQ ID NO: 283961

SEQ ID NO: 748870 - RNA, 64 nt, hsa; identical to SEQ ID NO: 283962

SEQ ID NO: 748871 - RNA, 64 nt, hsa; identical to SEQ ID NO: 283963

SEQ ID NO: 748872 - RNA, 64 nt, hsa; identical to SEQ ID NO: 283964

SEQ ID NO: 748873 - RNA, 64 nt, hsa; identical to SEQ ID NO: 283965

SEQ ID NO: 748874 - RNA, 64 nt, hsa; identical to SEQ ID NO: 283966

SEQ ID NO: 748875 - RNA, 64 nt, hsa; identical to SEQ ID NO: 283967

SEQ ID NO: 748876 - RNA, 64 nt, hsa; identical to SEQ ID NO: 283968

SEQ ID NO: 748877 - RNA, 64 nt, hsa; identical to SEQ ID NO: 283969

SEQ ID NO: 748878 - RNA, 64 nt, hsa; identical to SEQ ID NO: 283970

SEQ ID NO: 748879 - RNA, 64 nt, hsa; identical to SEQ ID NO: 283971

SEQ ID NO: 748880 - RNA, 64 nt, hsa; identical to SEQ ID NO: 283972

SEQ ID NO: 748881 - RNA, 64 nt, hsa; identical to SEQ ID NO: 283973

SEQ ID NO: 748882 - RNA, 64 nt, hsa; identical to SEQ ID NO: 283974

SEQ ID NO: 748883 - RNA, 64 nt, hsa; identical to SEQ ID NO: 283975

SEQ ID NO: 748884 - RNA, 64 nt, hsa; identical to SEQ ID NO: 283976

SEQ ID NO: 748885 - RNA, 64 nt, hsa; identical to SEQ ID NO: 283977

SEQ ID NO: 748886 - RNA, 64 nt, hsa; identical to SEQ ID NO: 283978

SEQ ID NO: 748887 - RNA, 64 nt, hsa; identical to SEQ ID NO: 283979

SEQ ID NO: 748888 - RNA, 64 nt, hsa; identical to SEQ ID NO: 283980

SEQ ID NO: 748889 - RNA, 64 nt, hsa; identical to SEQ ID NO: 283981

SEQ ID NO: 748890 - RNA, 64 nt, hsa; identical to SEQ ID NO: 283982

SEQ ID NO: 748891 - RNA, 64 nt, hsa; identical to SEQ ID NO: 283983

SEQ ID NO: 748892 - RNA, 64 nt, hsa; identical to SEQ ID NO: 283984

SEQ ID NO: 748893 - RNA, 64 nt, hsa; identical to SEQ ID NO: 302252

SEQ ID NO: 748894 - RNA, 64 nt, hsa; identical to SEQ ID NO: 302253

SEQ ID NO: 748895 - RNA, 64 nt, hsa; identical to SEQ ID NO: 302254

SEQ ID NO: 748896 - RNA, 64 nt, hsa; identical to SEQ ID NO: 302255

SEQ ID NO: 748897 - RNA, 64 nt, hsa; identical to SEQ ID NO: 302256

SEQ ID NO: 748898 - RNA, 64 nt, hsa; identical to SEQ ID NO: 302257

SEQ ID NO: 748899 - RNA, 64 nt, hsa; identical to SEQ ID NO: 302258

SEQ ID NO: 748900 - RNA, 64 nt, hsa; identical to SEQ ID NO: 302259

SEQ ID NO: 748901 - RNA, 64 nt, hsa; identical to SEQ ID NO: 302260

SEQ ID NO: 748902 - RNA, 64 nt, hsa; identical to SEQ ID NO: 302261

SEQ ID NO: 748903 - RNA, 64 nt, hsa; identical to SEQ ID NO: 302262

SEQ ID NO: 748904 - RNA, 64 nt, hsa; identical to SEQ ID NO: 302263

SEQ ID NO: 748905 - RNA, 64 nt, hsa; identical to SEQ ID NO: 302264

SEQ ID NO: 748906 - RNA, 64 nt, hsa; identical to SEQ ID NO: 302265

SEQ ID NO: 748907 - RNA, 64 nt, hsa; identical to SEQ ID NO: 302266

SEQ ID NO: 748908 - RNA, 64 nt, hsa; identical to SEQ ID NO: 302267

SEQ ID NO: 748909 - RNA, 64 nt, hsa; identical to SEQ ID NO: 302268

SEQ ID NO: 748910 - RNA, 64 nt, hsa; identical to SEQ ID NO: 302269

SEQ ID NO: 748911 - RNA, 64 nt, hsa; identical to SEQ ID NO: 302270

SEQ ID NO: 748912 - RNA, 64 nt, hsa; identical to SEQ ID NO: 302271

SEQ ID NO: 748913 - RNA, 64 nt, hsa; identical to SEQ ID NO: 302272

SEQ ID NO: 748914 - RNA, 64 nt, hsa; identical to SEQ ID NO: 302273

SEQ ID NO: 748915 - RNA, 64 nt, hsa; identical to SEQ ID NO: 355308

SEQ ID NO: 748916 - RNA, 64 nt, hsa; identical to SEQ ID NO: 355309

SEQ ID NO: 748917 - RNA, 64 nt, hsa; identical to SEQ ID NO: 355310

SEQ ID NO: 748918 - RNA, 64 nt, hsa; identical to SEQ ID NO: 355311

SEQ ID NO: 748919 - RNA, 64 nt, hsa; identical to SEQ ID NO: 355312

SEQ ID NO: 748920 - RNA, 64 nt, hsa; identical to SEQ ID NO: 355313

SEQ ID NO: 748921 - RNA, 64 nt, hsa; identical to SEQ ID NO: 355314

SEQ ID NO: 748922 - RNA, 64 nt, hsa; identical to SEQ ID NO: 355315

SEQ ID NO: 748923 - RNA, 64 nt, hsa; identical to SEQ ID NO: 355316

SEQ ID NO: 748924 - RNA, 64 nt, hsa; identical to SEQ ID NO: 355317

SEQ ID NO: 748925 - RNA, 64 nt, hsa; identical to SEQ ID NO: 355318

SEQ ID NO: 748926 - RNA, 64 nt, hsa; identical to SEQ ID NO: 355319

SEQ ID NO: 748927 - RNA, 64 nt, hsa; identical to SEQ ID NO: 355320

SEQ ID NO: 748928 - RNA, 64 nt, hsa; identical to SEQ ID NO: 355321

SEQ ID NO: 748929 - RNA, 64 nt, hsa; identical to SEQ ID NO: 355322

SEQ ID NO: 748930 - RNA, 63 nt, hsa; identical to SEQ ID NO: 355323

SEQ ID NO: 748931 - RNA, 64 nt, hsa; identical to SEQ ID NO: 355324

SEQ ID NO: 748932 - RNA, 64 nt, hsa; identical to SEQ ID NO: 355325

SEQ ID NO: 748933 - RNA, 64 nt, hsa; identical to SEQ ID NO: 355326

SEQ ID NO: 748934 - RNA, 64 nt, hsa; identical to SEQ ID NO: 355327

SEQ ID NO: 748935 - RNA, 64 nt, hsa; identical to SEQ ID NO: 355328

SEQ ID NO: 748936 - RNA, 64 nt, hsa; identical to SEQ ID NO: 355329

SEQ ID NO: 748937 - RNA, 64 nt, hsa; identical to SEQ ID NO: 355330

SEQ ID NO: 748938 - RNA, 64 nt, hsa; identical to SEQ ID NO: 355331

SEQ ID NO: 748939 - RNA, 64 nt, hsa; identical to SEQ ID NO: 355332

SEQ ID NO: 748940 - RNA, 65 nt, hsa
aacccccuuccuugccuaaggugucugaguuucuggcucuugaggcauuuccagacuugaaauuc

SEQ ID NO: 748941 - RNA, 65 nt, hsa
ggcauuuccagacuugaaauucucaucaguccauugcucuugagucuuugcagagaaccucagau

SEQ ID NO: 748942 - RNA, 65 nt, hsa
ccuuggcugaggauuguauuucagaaccaccaacugcucuugacaauuguuaacccgcuaggcuc

SEQ ID NO: 748943 - RNA, 65 nt, hsa
cuguuuacucauuggaggaacaguaccuuggcuuggcucuugacguggacagugaguaccuuacu

SEQ ID NO: 748944 - RNA, 65 nt, hsa
aaaaucaacugacuagugcaggaggcuguugauuggcucuugacugugaugcccgcaauucucaa

SEQ ID NO: 748945 - RNA, 65 nt, hsa
gugaaaauguccaucuuugggaaauuuucuacccugcucuugagccugauaacccaugccagguc

SEQ ID NO: 748946 - RNA, 64 nt, hsa; identical to SEQ ID NO: 292987

SEQ ID NO: 748947 - RNA, 65 nt, hsa
caagagcagagccaggcugugcccgagggaccccagcucuugacugcaccuguuucaugccucuc

SEQ ID NO: 748948 - RNA, 65 nt, hsa
aauauuuauuugguuaucaacugcccauggaggaggcucuugaugaucccaggucuccucgaccu

SEQ ID NO: 748949 - RNA, 65 nt, hsa
uacaaugaagacuaaaacugaacaagauguugcaugcucuugaggccauaauuugguaguguugg

SEQ ID NO: 748950 - RNA, 65 nt, hsa
aagguugucucuuccgagggccuucugaagacagggcucuugaacagacaaguggaagggcugua

SEQ ID NO: 748951 - RNA, 65 nt, hsa
agcaguaagcuugugauaaaggccaauuccagguagcucuugaaggugauagccaucuacuuucc

SEQ ID NO: 748952 - RNA, 65 nt, hsa
ccagccugaccaacgaugagcauuucuuaggcucagcucuugauacggaaacgagugucuucacu

SEQ ID NO: 748953 - RNA, 65 nt, hsa
ggggacaagugucagcaggauuggcgugugggaaagcucuugagcugggcacuggccccccggac

SEQ ID NO: 748954 - RNA, 64 nt, hsa; identical to SEQ ID NO: 96419

SEQ ID NO: 748955 - RNA, 64 nt, hsa; identical to SEQ ID NO: 96420

SEQ ID NO: 748956 - RNA, 64 nt, hsa; identical to SEQ ID NO: 96421

SEQ ID NO: 748957 - RNA, 64 nt, hsa; identical to SEQ ID NO: 96422

SEQ ID NO: 748958 - RNA, 64 nt, hsa; identical to SEQ ID NO: 96423

SEQ ID NO: 748959 - RNA, 64 nt, hsa; identical to SEQ ID NO: 96424

SEQ ID NO: 748960 - RNA, 64 nt, hsa; identical to SEQ ID NO: 96425

SEQ ID NO: 748961 - RNA, 64 nt, hsa; identical to SEQ ID NO: 96426

SEQ ID NO: 748962 - RNA, 52 nt, hsa; identical to SEQ ID NO: 96427

SEQ ID NO: 748963 - RNA, 64 nt, hsa; identical to SEQ ID NO: 96428

SEQ ID NO: 748964 - RNA, 64 nt, hsa; identical to SEQ ID NO: 96429

SEQ ID NO: 748965 - RNA, 64 nt, hsa; identical to SEQ ID NO: 96430

SEQ ID NO: 748966 - RNA, 64 nt, hsa; identical to SEQ ID NO: 96431

SEQ ID NO: 748967 - RNA, 64 nt, hsa; identical to SEQ ID NO: 96432

SEQ ID NO: 748968 - RNA, 64 nt, hsa; identical to SEQ ID NO: 96433

SEQ ID NO: 748969 - RNA, 53 nt, hsa; identical to SEQ ID NO: 96434

SEQ ID NO: 748970 - RNA, 64 nt, hsa; identical to SEQ ID NO: 96435

SEQ ID NO: 748971 - RNA, 64 nt, hsa; identical to SEQ ID NO: 96436

SEQ ID NO: 748972 - RNA, 64 nt, hsa; identical to SEQ ID NO: 96437

SEQ ID NO: 748973 - RNA, 64 nt, hsa; identical to SEQ ID NO: 96438

SEQ ID NO: 748974 - RNA, 64 nt, hsa; identical to SEQ ID NO: 96439

SEQ ID NO: 748975 - RNA, 64 nt, hsa; identical to SEQ ID NO: 96440

SEQ ID NO: 748976 - RNA, 64 nt, hsa; identical to SEQ ID NO: 96441

SEQ ID NO: 748977 - RNA, 64 nt, hsa; identical to SEQ ID NO: 96442

SEQ ID NO: 748978 - RNA, 64 nt, hsa; identical to SEQ ID NO: 96443

SEQ ID NO: 748979 - RNA, 64 nt, hsa; identical to SEQ ID NO: 96444

SEQ ID NO: 748980 - RNA, 64 nt, hsa; identical to SEQ ID NO: 96445

SEQ ID NO: 748981 - RNA, 64 nt, hsa; identical to SEQ ID NO: 96446

SEQ ID NO: 748982 - RNA, 64 nt, hsa; identical to SEQ ID NO: 96447

SEQ ID NO: 748983 - RNA, 64 nt, hsa; identical to SEQ ID NO: 96448

SEQ ID NO: 748984 - RNA, 64 nt, hsa; identical to SEQ ID NO: 96449

SEQ ID NO: 748985 - RNA, 64 nt, hsa; identical to SEQ ID NO: 96450

SEQ ID NO: 748986 - RNA, 64 nt, hsa; identical to SEQ ID NO: 96451

SEQ ID NO: 748987 - RNA, 64 nt, hsa; identical to SEQ ID NO: 96452

SEQ ID NO: 748988 - RNA, 64 nt, hsa; identical to SEQ ID NO: 96453

SEQ ID NO: 748989 - RNA, 64 nt, hsa; identical to SEQ ID NO: 96454

SEQ ID NO: 748990 - RNA, 64 nt, hsa; identical to SEQ ID NO: 96455

SEQ ID NO: 748991 - RNA, 64 nt, hsa; identical to SEQ ID NO: 96456

SEQ ID NO: 748992 - RNA, 64 nt, hsa; identical to SEQ ID NO: 96457

SEQ ID NO: 748993 - RNA, 64 nt, hsa; identical to SEQ ID NO: 96458

SEQ ID NO: 748994 - RNA, 64 nt, hsa; identical to SEQ ID NO: 96459

SEQ ID NO: 748995 - RNA, 64 nt, hsa; identical to SEQ ID NO: 96460

SEQ ID NO: 748996 - RNA, 64 nt, hsa; identical to SEQ ID NO: 96461

SEQ ID NO: 748997 - RNA, 64 nt, hsa; identical to SEQ ID NO: 96462

SEQ ID NO: 748998 - RNA, 64 nt, hsa; identical to SEQ ID NO: 96463

SEQ ID NO: 748999 - RNA, 64 nt, hsa; identical to SEQ ID NO: 96464

SEQ ID NO: 749000 - RNA, 64 nt, hsa; identical to SEQ ID NO: 96465

SEQ ID NO: 749001 - RNA, 64 nt, hsa; identical to SEQ ID NO: 96466

SEQ ID NO: 749002 - RNA, 64 nt, hsa; identical to SEQ ID NO: 96467

SEQ ID NO: 749003 - RNA, 64 nt, hsa; identical to SEQ ID NO: 96468

SEQ ID NO: 749004 - RNA, 64 nt, hsa; identical to SEQ ID NO: 96469

SEQ ID NO: 749005 - RNA, 64 nt, hsa; identical to SEQ ID NO: 96470

SEQ ID NO: 749006 - RNA, 64 nt, hsa; identical to SEQ ID NO: 96471

SEQ ID NO: 749007 - RNA, 64 nt, hsa; identical to SEQ ID NO: 96472

SEQ ID NO: 749008 - RNA, 64 nt, hsa; identical to SEQ ID NO: 96473

SEQ ID NO: 749009 - RNA, 64 nt, hsa; identical to SEQ ID NO: 96474

SEQ ID NO: 749010 - RNA, 64 nt, hsa; identical to SEQ ID NO: 96475

SEQ ID NO: 749011 - RNA, 64 nt, hsa; identical to SEQ ID NO: 96476

SEQ ID NO: 749012 - RNA, 64 nt, hsa; identical to SEQ ID NO: 96477

SEQ ID NO: 749013 - RNA, 64 nt, hsa; identical to SEQ ID NO: 96478

SEQ ID NO: 749014 - RNA, 64 nt, hsa; identical to SEQ ID NO: 96479

SEQ ID NO: 749015 - RNA, 64 nt, hsa; identical to SEQ ID NO: 96480

SEQ ID NO: 749016 - RNA, 64 nt, hsa; identical to SEQ ID NO: 96481

SEQ ID NO: 749017 - RNA, 64 nt, hsa; identical to SEQ ID NO: 96482

SEQ ID NO: 749018 - RNA, 64 nt, hsa; identical to SEQ ID NO: 96483

SEQ ID NO: 749019 - RNA, 64 nt, hsa; identical to SEQ ID NO: 96484

SEQ ID NO: 749020 - RNA, 64 nt, hsa; identical to SEQ ID NO: 96485

SEQ ID NO: 749021 - RNA, 64 nt, hsa; identical to SEQ ID NO: 96486

SEQ ID NO: 749022 - RNA, 64 nt, hsa; identical to SEQ ID NO: 96487

SEQ ID NO: 749023 - RNA, 64 nt, hsa; identical to SEQ ID NO: 96488

SEQ ID NO: 749024 - RNA, 64 nt, hsa; identical to SEQ ID NO: 96489

SEQ ID NO: 749025 - RNA, 64 nt, hsa; identical to SEQ ID NO: 96490

SEQ ID NO: 749026 - RNA, 64 nt, hsa; identical to SEQ ID NO: 96491

SEQ ID NO: 749027 - RNA, 64 nt, hsa; identical to SEQ ID NO: 96492

SEQ ID NO: 749028 - RNA, 64 nt, hsa; identical to SEQ ID NO: 96493

SEQ ID NO: 749029 - RNA, 64 nt, hsa; identical to SEQ ID NO: 96494

SEQ ID NO: 749030 - RNA, 64 nt, hsa; identical to SEQ ID NO: 96495

SEQ ID NO: 749031 - RNA, 64 nt, hsa; identical to SEQ ID NO: 96496

SEQ ID NO: 749032 - RNA, 64 nt, hsa; identical to SEQ ID NO: 96497

SEQ ID NO: 749033 - RNA, 64 nt, hsa; identical to SEQ ID NO: 96498

SEQ ID NO: 749034 - RNA, 64 nt, hsa; identical to SEQ ID NO: 96499

SEQ ID NO: 749035 - RNA, 64 nt, hsa; identical to SEQ ID NO: 96500

SEQ ID NO: 749036 - RNA, 64 nt, hsa; identical to SEQ ID NO: 96501

SEQ ID NO: 749037 - RNA, 64 nt, hsa; identical to SEQ ID NO: 96502

SEQ ID NO: 749038 - RNA, 64 nt, hsa; identical to SEQ ID NO: 96503

SEQ ID NO: 749039 - RNA, 64 nt, hsa; identical to SEQ ID NO: 96504

SEQ ID NO: 749040 - RNA, 64 nt, hsa; identical to SEQ ID NO: 96505

SEQ ID NO: 749041 - RNA, 64 nt, hsa; identical to SEQ ID NO: 96506

SEQ ID NO: 749042 - RNA, 64 nt, hsa; identical to SEQ ID NO: 96507

SEQ ID NO: 749043 - RNA, 64 nt, hsa; identical to SEQ ID NO: 96508

SEQ ID NO: 749044 - RNA, 64 nt, hsa; identical to SEQ ID NO: 96509

SEQ ID NO: 749045 - RNA, 64 nt, hsa; identical to SEQ ID NO: 96510

SEQ ID NO: 749046 - RNA, 64 nt, hsa; identical to SEQ ID NO: 96511

SEQ ID NO: 749047 - RNA, 64 nt, hsa; identical to SEQ ID NO: 96512

SEQ ID NO: 749048 - RNA, 64 nt, hsa; identical to SEQ ID NO: 96513

SEQ ID NO: 749049 - RNA, 64 nt, hsa; identical to SEQ ID NO: 96514

SEQ ID NO: 749050 - RNA, 64 nt, hsa; identical to SEQ ID NO: 96515

SEQ ID NO: 749051 - RNA, 64 nt, hsa; identical to SEQ ID NO: 96516

SEQ ID NO: 749052 - RNA, 64 nt, hsa; identical to SEQ ID NO: 96517

SEQ ID NO: 749053 - RNA, 64 nt, hsa; identical to SEQ ID NO: 96518

SEQ ID NO: 749054 - RNA, 64 nt, hsa; identical to SEQ ID NO: 96519

SEQ ID NO: 749055 - RNA, 64 nt, hsa; identical to SEQ ID NO: 96520

SEQ ID NO: 749056 - RNA, 64 nt, hsa; identical to SEQ ID NO: 96521

SEQ ID NO: 749057 - RNA, 64 nt, hsa; identical to SEQ ID NO: 96522

SEQ ID NO: 749058 - RNA, 64 nt, hsa; identical to SEQ ID NO: 96523

SEQ ID NO: 749059 - RNA, 64 nt, hsa; identical to SEQ ID NO: 96524

SEQ ID NO: 749060 - RNA, 64 nt, hsa; identical to SEQ ID NO: 96525

SEQ ID NO: 749061 - RNA, 64 nt, hsa; identical to SEQ ID NO: 96526

SEQ ID NO: 749062 - RNA, 64 nt, hsa; identical to SEQ ID NO: 96527

SEQ ID NO: 749063 - RNA, 64 nt, hsa; identical to SEQ ID NO: 96528

SEQ ID NO: 749064 - RNA, 64 nt, hsa; identical to SEQ ID NO: 96529

SEQ ID NO: 749065 - RNA, 64 nt, hsa; identical to SEQ ID NO: 96530

SEQ ID NO: 749066 - RNA, 64 nt, hsa; identical to SEQ ID NO: 96531

SEQ ID NO: 749067 - RNA, 64 nt, hsa; identical to SEQ ID NO: 96532

SEQ ID NO: 749068 - RNA, 64 nt, hsa; identical to SEQ ID NO: 96533

SEQ ID NO: 749069 - RNA, 64 nt, hsa; identical to SEQ ID NO: 96534

SEQ ID NO: 749070 - RNA, 64 nt, hsa; identical to SEQ ID NO: 96535

SEQ ID NO: 749071 - RNA, 64 nt, hsa; identical to SEQ ID NO: 96536

SEQ ID NO: 749072 - RNA, 64 nt, hsa; identical to SEQ ID NO: 96537

SEQ ID NO: 749073 - RNA, 64 nt, hsa; identical to SEQ ID NO: 96538

SEQ ID NO: 749074 - RNA, 64 nt, hsa; identical to SEQ ID NO: 96539

SEQ ID NO: 749075 - RNA, 64 nt, hsa; identical to SEQ ID NO: 96540

SEQ ID NO: 749076 - RNA, 64 nt, hsa; identical to SEQ ID NO: 96541

SEQ ID NO: 749077 - RNA, 64 nt, hsa; identical to SEQ ID NO: 96542

SEQ ID NO: 749078 - RNA, 64 nt, hsa; identical to SEQ ID NO: 96543

SEQ ID NO: 749079 - RNA, 64 nt, hsa; identical to SEQ ID NO: 96544

SEQ ID NO: 749080 - RNA, 64 nt, hsa; identical to SEQ ID NO: 96545

SEQ ID NO: 749081 - RNA, 64 nt, hsa; identical to SEQ ID NO: 96546

SEQ ID NO: 749082 - RNA, 64 nt, hsa; identical to SEQ ID NO: 96547

SEQ ID NO: 749083 - RNA, 64 nt, hsa; identical to SEQ ID NO: 96548

SEQ ID NO: 749084 - RNA, 64 nt, hsa; identical to SEQ ID NO: 96549

SEQ ID NO: 749085 - RNA, 64 nt, hsa; identical to SEQ ID NO: 96550

SEQ ID NO: 749086 - RNA, 64 nt, hsa; identical to SEQ ID NO: 96551

SEQ ID NO: 749087 - RNA, 64 nt, hsa; identical to SEQ ID NO: 96552

SEQ ID NO: 749088 - RNA, 64 nt, hsa; identical to SEQ ID NO: 96553

SEQ ID NO: 749089 - RNA, 64 nt, hsa; identical to SEQ ID NO: 96554

SEQ ID NO: 749090 - RNA, 64 nt, hsa; identical to SEQ ID NO: 96555

SEQ ID NO: 749091 - RNA, 64 nt, hsa; identical to SEQ ID NO: 96556

SEQ ID NO: 749092 - RNA, 64 nt, hsa; identical to SEQ ID NO: 96557

SEQ ID NO: 749093 - RNA, 64 nt, hsa; identical to SEQ ID NO: 96558

SEQ ID NO: 749094 - RNA, 64 nt, hsa; identical to SEQ ID NO: 96559

SEQ ID NO: 749095 - RNA, 64 nt, hsa; identical to SEQ ID NO: 96560

SEQ ID NO: 749096 - RNA, 64 nt, hsa; identical to SEQ ID NO: 96561

SEQ ID NO: 749097 - RNA, 64 nt, hsa; identical to SEQ ID NO: 96562

SEQ ID NO: 749098 - RNA, 64 nt, hsa; identical to SEQ ID NO: 96563

SEQ ID NO: 749099 - RNA, 64 nt, hsa; identical to SEQ ID NO: 96564

SEQ ID NO: 749100 - RNA, 64 nt, hsa; identical to SEQ ID NO: 96565

SEQ ID NO: 749101 - RNA, 64 nt, hsa; identical to SEQ ID NO: 96566

SEQ ID NO: 749102 - RNA, 64 nt, hsa; identical to SEQ ID NO: 96567

SEQ ID NO: 749103 - RNA, 64 nt, hsa; identical to SEQ ID NO: 96568

SEQ ID NO: 749104 - RNA, 64 nt, hsa; identical to SEQ ID NO: 96569

SEQ ID NO: 749105 - RNA, 64 nt, hsa; identical to SEQ ID NO: 96570

SEQ ID NO: 749106 - RNA, 64 nt, hsa; identical to SEQ ID NO: 96571

SEQ ID NO: 749107 - RNA, 64 nt, hsa; identical to SEQ ID NO: 96572

SEQ ID NO: 749108 - RNA, 64 nt, hsa; identical to SEQ ID NO: 96573

SEQ ID NO: 749109 - RNA, 64 nt, hsa; identical to SEQ ID NO: 96574

SEQ ID NO: 749110 - RNA, 64 nt, hsa; identical to SEQ ID NO: 96575

SEQ ID NO: 749111 - RNA, 64 nt, hsa; identical to SEQ ID NO: 96576

SEQ ID NO: 749112 - RNA, 64 nt, hsa; identical to SEQ ID NO: 96577

SEQ ID NO: 749113 - RNA, 64 nt, hsa; identical to SEQ ID NO: 96578

SEQ ID NO: 749114 - RNA, 64 nt, hsa; identical to SEQ ID NO: 96579

SEQ ID NO: 749115 - RNA, 64 nt, hsa; identical to SEQ ID NO: 96580

SEQ ID NO: 749116 - RNA, 64 nt, hsa; identical to SEQ ID NO: 96581

SEQ ID NO: 749117 - RNA, 64 nt, hsa; identical to SEQ ID NO: 96582

SEQ ID NO: 749118 - RNA, 64 nt, hsa; identical to SEQ ID NO: 96583

SEQ ID NO: 749119 - RNA, 64 nt, hsa; identical to SEQ ID NO: 96584

SEQ ID NO: 749120 - RNA, 64 nt, hsa; identical to SEQ ID NO: 96585

SEQ ID NO: 749121 - RNA, 64 nt, hsa; identical to SEQ ID NO: 96586

SEQ ID NO: 749122 - RNA, 64 nt, hsa; identical to SEQ ID NO: 96587

SEQ ID NO: 749123 - RNA, 64 nt, hsa; identical to SEQ ID NO: 96588

SEQ ID NO: 749124 - RNA, 64 nt, hsa; identical to SEQ ID NO: 96589

SEQ ID NO: 749125 - RNA, 64 nt, hsa; identical to SEQ ID NO: 96590

SEQ ID NO: 749126 - RNA, 64 nt, hsa; identical to SEQ ID NO: 96591

SEQ ID NO: 749127 - RNA, 64 nt, hsa; identical to SEQ ID NO: 96592

SEQ ID NO: 749128 - RNA, 64 nt, hsa; identical to SEQ ID NO: 96593

SEQ ID NO: 749129 - RNA, 64 nt, hsa; identical to SEQ ID NO: 96594

SEQ ID NO: 749130 - RNA, 64 nt, hsa; identical to SEQ ID NO: 96595

SEQ ID NO: 749131 - RNA, 64 nt, hsa; identical to SEQ ID NO: 96596

SEQ ID NO: 749132 - RNA, 64 nt, hsa; identical to SEQ ID NO: 96597

SEQ ID NO: 749133 - RNA, 64 nt, hsa; identical to SEQ ID NO: 96598

SEQ ID NO: 749134 - RNA, 64 nt, hsa; identical to SEQ ID NO: 96599

SEQ ID NO: 749135 - RNA, 64 nt, hsa; identical to SEQ ID NO: 96600

SEQ ID NO: 749136 - RNA, 64 nt, hsa; identical to SEQ ID NO: 96601

SEQ ID NO: 749137 - RNA, 64 nt, hsa; identical to SEQ ID NO: 96602

SEQ ID NO: 749138 - RNA, 64 nt, hsa; identical to SEQ ID NO: 96603

SEQ ID NO: 749139 - RNA, 64 nt, hsa; identical to SEQ ID NO: 96604

SEQ ID NO: 749140 - RNA, 64 nt, hsa; identical to SEQ ID NO: 96605

SEQ ID NO: 749141 - RNA, 64 nt, hsa; identical to SEQ ID NO: 96606

SEQ ID NO: 749142 - RNA, 64 nt, hsa; identical to SEQ ID NO: 96607

SEQ ID NO: 749143 - RNA, 64 nt, hsa; identical to SEQ ID NO: 96608

SEQ ID NO: 749144 - RNA, 64 nt, hsa; identical to SEQ ID NO: 96609

SEQ ID NO: 749145 - RNA, 64 nt, hsa; identical to SEQ ID NO: 96610

SEQ ID NO: 749146 - RNA, 64 nt, hsa; identical to SEQ ID NO: 96611

SEQ ID NO: 749147 - RNA, 64 nt, hsa; identical to SEQ ID NO: 96612

SEQ ID NO: 749148 - RNA, 64 nt, hsa; identical to SEQ ID NO: 96613

SEQ ID NO: 749149 - RNA, 64 nt, hsa; identical to SEQ ID NO: 96614

SEQ ID NO: 749150 - RNA, 64 nt, hsa; identical to SEQ ID NO: 96615

SEQ ID NO: 749151 - RNA, 64 nt, hsa; identical to SEQ ID NO: 96616

SEQ ID NO: 749152 - RNA, 64 nt, hsa; identical to SEQ ID NO: 96617

SEQ ID NO: 749153 - RNA, 64 nt, hsa; identical to SEQ ID NO: 96618

SEQ ID NO: 749154 - RNA, 64 nt, hsa; identical to SEQ ID NO: 96619

SEQ ID NO: 749155 - RNA, 64 nt, hsa; identical to SEQ ID NO: 96620

SEQ ID NO: 749156 - RNA, 64 nt, hsa; identical to SEQ ID NO: 96621

SEQ ID NO: 749157 - RNA, 64 nt, hsa; identical to SEQ ID NO: 96622

SEQ ID NO: 749158 - RNA, 64 nt, hsa; identical to SEQ ID NO: 96623

SEQ ID NO: 749159 - RNA, 64 nt, hsa; identical to SEQ ID NO: 96624

SEQ ID NO: 749160 - RNA, 64 nt, hsa; identical to SEQ ID NO: 96625

SEQ ID NO: 749161 - RNA, 64 nt, hsa; identical to SEQ ID NO: 96626

SEQ ID NO: 749162 - RNA, 64 nt, hsa; identical to SEQ ID NO: 96627

SEQ ID NO: 749163 - RNA, 64 nt, hsa; identical to SEQ ID NO: 96628

SEQ ID NO: 749164 - RNA, 64 nt, hsa; identical to SEQ ID NO: 96629

SEQ ID NO: 749165 - RNA, 64 nt, hsa; identical to SEQ ID NO: 96630

SEQ ID NO: 749166 - RNA, 64 nt, hsa; identical to SEQ ID NO: 96631

SEQ ID NO: 749167 - RNA, 64 nt, hsa; identical to SEQ ID NO: 96632

SEQ ID NO: 749168 - RNA, 64 nt, hsa; identical to SEQ ID NO: 96633

SEQ ID NO: 749169 - RNA, 64 nt, hsa; identical to SEQ ID NO: 96634

SEQ ID NO: 749170 - RNA, 64 nt, hsa; identical to SEQ ID NO: 96635

SEQ ID NO: 749171 - RNA, 64 nt, hsa; identical to SEQ ID NO: 96636

SEQ ID NO: 749172 - RNA, 64 nt, hsa; identical to SEQ ID NO: 96637

SEQ ID NO: 749173 - RNA, 64 nt, hsa; identical to SEQ ID NO: 96638

SEQ ID NO: 749174 - RNA, 64 nt, hsa; identical to SEQ ID NO: 96639

SEQ ID NO: 749175 - RNA, 64 nt, hsa; identical to SEQ ID NO: 96640

SEQ ID NO: 749176 - RNA, 64 nt, hsa; identical to SEQ ID NO: 96641

SEQ ID NO: 749177 - RNA, 64 nt, hsa; identical to SEQ ID NO: 96642

SEQ ID NO: 749178 - RNA, 64 nt, hsa; identical to SEQ ID NO: 96643

SEQ ID NO: 749179 - RNA, 64 nt, hsa; identical to SEQ ID NO: 96644

SEQ ID NO: 749180 - RNA, 64 nt, hsa
ggcuugucauugggcugccagugucugccaagccagcauugagcuaauccugugggaggaugag

SEQ ID NO: 749181 - RNA, 64 nt, hsa
ccccaacucuugaacgaugaugauauucagacgaagcauugauguuauggaagaaagaaagaaa

SEQ ID NO: 749182 - RNA, 64 nt, hsa
uuuuauaaagaaaauucuaucuuaugguugauugagcauugagacuuaugaaggcauuaggaua

SEQ ID NO: 749183 - RNA, 64 nt, hsa
accuaaaauuauagguagggcaggcuaagugaacagcauugaguauuuucugaaucccucauga

SEQ ID NO: 749184 - RNA, 64 nt, hsa; identical to SEQ ID NO: 414305

SEQ ID NO: 749185 - RNA, 64 nt, hsa; identical to SEQ ID NO: 414306

SEQ ID NO: 749186 - RNA, 64 nt, hsa; identical to SEQ ID NO: 189259

SEQ ID NO: 749187 - RNA, 64 nt, hsa; identical to SEQ ID NO: 189260

SEQ ID NO: 749188 - RNA, 64 nt, hsa; identical to SEQ ID NO: 189261

SEQ ID NO: 749189 - RNA, 64 nt, hsa; identical to SEQ ID NO: 189262

SEQ ID NO: 749190 - RNA, 56 nt, hsa; identical to SEQ ID NO: 189263

SEQ ID NO: 749191 - RNA, 64 nt, hsa; identical to SEQ ID NO: 189264

SEQ ID NO: 749192 - RNA, 64 nt, hsa; identical to SEQ ID NO: 189265

SEQ ID NO: 749193 - RNA, 64 nt, hsa; identical to SEQ ID NO: 189266

SEQ ID NO: 749194 - RNA, 64 nt, hsa; identical to SEQ ID NO: 189267

SEQ ID NO: 749195 - RNA, 64 nt, hsa; identical to SEQ ID NO: 189268

SEQ ID NO: 749196 - RNA, 64 nt, hsa; identical to SEQ ID NO: 189269

SEQ ID NO: 749197 - RNA, 64 nt, hsa; identical to SEQ ID NO: 189270

SEQ ID NO: 749198 - RNA, 64 nt, hsa; identical to SEQ ID NO: 189271

SEQ ID NO: 749199 - RNA, 64 nt, hsa; identical to SEQ ID NO: 189272

SEQ ID NO: 749200 - RNA, 64 nt, hsa; identical to SEQ ID NO: 189273

SEQ ID NO: 749201 - RNA, 64 nt, hsa; identical to SEQ ID NO: 189274

SEQ ID NO: 749202 - RNA, 64 nt, hsa; identical to SEQ ID NO: 189275

SEQ ID NO: 749203 - RNA, 64 nt, hsa; identical to SEQ ID NO: 189276

SEQ ID NO: 749204 - RNA, 64 nt, hsa; identical to SEQ ID NO: 189277

SEQ ID NO: 749205 - RNA, 64 nt, hsa; identical to SEQ ID NO: 189278

SEQ ID NO: 749206 - RNA, 64 nt, hsa; identical to SEQ ID NO: 189279

SEQ ID NO: 749207 - RNA, 64 nt, hsa; identical to SEQ ID NO: 189280

SEQ ID NO: 749208 - RNA, 64 nt, hsa; identical to SEQ ID NO: 61424

SEQ ID NO: 749209 - RNA, 64 nt, hsa; identical to SEQ ID NO: 61425

SEQ ID NO: 749210 - RNA, 64 nt, hsa; identical to SEQ ID NO: 61426

SEQ ID NO: 749211 - RNA, 64 nt, hsa; identical to SEQ ID NO: 61427

SEQ ID NO: 749212 - RNA, 64 nt, hsa; identical to SEQ ID NO: 61428

SEQ ID NO: 749213 - RNA, 64 nt, hsa; identical to SEQ ID NO: 61429

SEQ ID NO: 749214 - RNA, 64 nt, hsa; identical to SEQ ID NO: 61430

SEQ ID NO: 749215 - RNA, 64 nt, hsa; identical to SEQ ID NO: 61431

SEQ ID NO: 749216 - RNA, 64 nt, hsa; identical to SEQ ID NO: 61432

SEQ ID NO: 749217 - RNA, 64 nt, hsa; identical to SEQ ID NO: 61433

SEQ ID NO: 749218 - RNA, 64 nt, hsa; identical to SEQ ID NO: 114741

SEQ ID NO: 749219 - RNA, 64 nt, hsa; identical to SEQ ID NO: 114742

SEQ ID NO: 749220 - RNA, 62 nt, hsa; identical to SEQ ID NO: 114743

SEQ ID NO: 749221 - RNA, 62 nt, hsa; identical to SEQ ID NO: 114744

SEQ ID NO: 749222 - RNA, 62 nt, hsa; identical to SEQ ID NO: 114745

SEQ ID NO: 749223 - RNA, 62 nt, hsa; identical to SEQ ID NO: 114746

SEQ ID NO: 749224 - RNA, 62 nt, hsa; identical to SEQ ID NO: 114747

SEQ ID NO: 749225 - RNA, 62 nt, hsa; identical to SEQ ID NO: 114748

SEQ ID NO: 749226 - RNA, 62 nt, hsa; identical to SEQ ID NO: 114749

SEQ ID NO: 749227 - RNA, 62 nt, hsa; identical to SEQ ID NO: 114750

SEQ ID NO: 749228 - RNA, 62 nt, hsa; identical to SEQ ID NO: 114751

SEQ ID NO: 749229 - RNA, 62 nt, hsa; identical to SEQ ID NO: 114752

SEQ ID NO: 749230 - RNA, 62 nt, hsa; identical to SEQ ID NO: 114753

SEQ ID NO: 749231 - RNA, 62 nt, hsa; identical to SEQ ID NO: 114754

SEQ ID NO: 749232 - RNA, 62 nt, hsa; identical to SEQ ID NO: 114755

SEQ ID NO: 749233 - RNA, 62 nt, hsa; identical to SEQ ID NO: 114756

SEQ ID NO: 749234 - RNA, 62 nt, hsa; identical to SEQ ID NO: 114757

SEQ ID NO: 749235 - RNA, 62 nt, hsa; identical to SEQ ID NO: 114758

SEQ ID NO: 749236 - RNA, 64 nt, hsa; identical to SEQ ID NO: 189259

SEQ ID NO: 749237 - RNA, 64 nt, hsa; identical to SEQ ID NO: 189260

SEQ ID NO: 749238 - RNA, 64 nt, hsa; identical to SEQ ID NO: 189261

SEQ ID NO: 749239 - RNA, 64 nt, hsa; identical to SEQ ID NO: 189262

SEQ ID NO: 749240 - RNA, 56 nt, hsa; identical to SEQ ID NO: 189263

SEQ ID NO: 749241 - RNA, 64 nt, hsa; identical to SEQ ID NO: 189264

SEQ ID NO: 749242 - RNA, 64 nt, hsa; identical to SEQ ID NO: 189265

SEQ ID NO: 749243 - RNA, 64 nt, hsa; identical to SEQ ID NO: 189266

SEQ ID NO: 749244 - RNA, 64 nt, hsa; identical to SEQ ID NO: 189267

SEQ ID NO: 749245 - RNA, 64 nt, hsa; identical to SEQ ID NO: 189268

SEQ ID NO: 749246 - RNA, 64 nt, hsa; identical to SEQ ID NO: 189269

SEQ ID NO: 749247 - RNA, 64 nt, hsa; identical to SEQ ID NO: 189270

SEQ ID NO: 749248 - RNA, 64 nt, hsa; identical to SEQ ID NO: 189271

SEQ ID NO: 749249 - RNA, 64 nt, hsa; identical to SEQ ID NO: 189272

SEQ ID NO: 749250 - RNA, 64 nt, hsa; identical to SEQ ID NO: 189273

SEQ ID NO: 749251 - RNA, 64 nt, hsa; identical to SEQ ID NO: 189274

SEQ ID NO: 749252 - RNA, 64 nt, hsa; identical to SEQ ID NO: 189275

SEQ ID NO: 749253 - RNA, 64 nt, hsa; identical to SEQ ID NO: 189276

SEQ ID NO: 749254 - RNA, 64 nt, hsa; identical to SEQ ID NO: 189277

SEQ ID NO: 749255 - RNA, 64 nt, hsa; identical to SEQ ID NO: 189278

SEQ ID NO: 749256 - RNA, 64 nt, hsa; identical to SEQ ID NO: 189279

SEQ ID NO: 749257 - RNA, 64 nt, hsa; identical to SEQ ID NO: 189280

SEQ ID NO: 749258 - RNA, 64 nt, hsa; identical to SEQ ID NO: 97744

SEQ ID NO: 749259 - RNA, 64 nt, hsa; identical to SEQ ID NO: 97745

SEQ ID NO: 749260 - RNA, 64 nt, hsa; identical to SEQ ID NO: 97746

SEQ ID NO: 749261 - RNA, 64 nt, hsa; identical to SEQ ID NO: 97747

SEQ ID NO: 749262 - RNA, 64 nt, hsa; identical to SEQ ID NO: 97748

SEQ ID NO: 749263 - RNA, 64 nt, hsa; identical to SEQ ID NO: 97749

SEQ ID NO: 749264 - RNA, 64 nt, hsa; identical to SEQ ID NO: 97750

SEQ ID NO: 749265 - RNA, 64 nt, hsa; identical to SEQ ID NO: 97751

SEQ ID NO: 749266 - RNA, 64 nt, hsa; identical to SEQ ID NO: 97752

SEQ ID NO: 749267 - RNA, 64 nt, hsa; identical to SEQ ID NO: 97753

SEQ ID NO: 749268 - RNA, 64 nt, hsa; identical to SEQ ID NO: 97754

SEQ ID NO: 749269 - RNA, 64 nt, hsa; identical to SEQ ID NO: 97755

SEQ ID NO: 749270 - RNA, 64 nt, hsa; identical to SEQ ID NO: 97756

SEQ ID NO: 749271 - RNA, 64 nt, hsa; identical to SEQ ID NO: 97757

SEQ ID NO: 749272 - RNA, 64 nt, hsa; identical to SEQ ID NO: 97758

SEQ ID NO: 749273 - RNA, 64 nt, hsa; identical to SEQ ID NO: 97759

SEQ ID NO: 749274 - RNA, 64 nt, hsa; identical to SEQ ID NO: 97760

SEQ ID NO: 749275 - RNA, 64 nt, hsa; identical to SEQ ID NO: 97761

SEQ ID NO: 749276 - RNA, 64 nt, hsa; identical to SEQ ID NO: 97762

SEQ ID NO: 749277 - RNA, 64 nt, hsa; identical to SEQ ID NO: 97763

SEQ ID NO: 749278 - RNA, 64 nt, hsa; identical to SEQ ID NO: 97764

SEQ ID NO: 749279 - RNA, 64 nt, hsa; identical to SEQ ID NO: 97765

SEQ ID NO: 749280 - RNA, 64 nt, hsa; identical to SEQ ID NO: 97766

SEQ ID NO: 749281 - RNA, 64 nt, hsa; identical to SEQ ID NO: 97767

SEQ ID NO: 749282 - RNA, 64 nt, hsa; identical to SEQ ID NO: 97768

SEQ ID NO: 749283 - RNA, 64 nt, hsa; identical to SEQ ID NO: 97769

SEQ ID NO: 749284 - RNA, 64 nt, hsa; identical to SEQ ID NO: 97770

SEQ ID NO: 749285 - RNA, 64 nt, hsa; identical to SEQ ID NO: 97771

SEQ ID NO: 749286 - RNA, 64 nt, hsa; identical to SEQ ID NO: 97772

SEQ ID NO: 749287 - RNA, 64 nt, hsa; identical to SEQ ID NO: 97773

SEQ ID NO: 749288 - RNA, 64 nt, hsa; identical to SEQ ID NO: 97774

SEQ ID NO: 749289 - RNA, 64 nt, hsa; identical to SEQ ID NO: 97775

SEQ ID NO: 749290 - RNA, 64 nt, hsa; identical to SEQ ID NO: 97776

SEQ ID NO: 749291 - RNA, 64 nt, hsa; identical to SEQ ID NO: 97777

SEQ ID NO: 749292 - RNA, 64 nt, hsa; identical to SEQ ID NO: 97778

SEQ ID NO: 749293 - RNA, 64 nt, hsa; identical to SEQ ID NO: 97779

SEQ ID NO: 749294 - RNA, 64 nt, hsa; identical to SEQ ID NO: 97780

SEQ ID NO: 749295 - RNA, 64 nt, hsa; identical to SEQ ID NO: 97781

SEQ ID NO: 749296 - RNA, 64 nt, hsa; identical to SEQ ID NO: 97782

SEQ ID NO: 749297 - RNA, 64 nt, hsa; identical to SEQ ID NO: 97783

SEQ ID NO: 749298 - RNA, 64 nt, hsa; identical to SEQ ID NO: 97784

SEQ ID NO: 749299 - RNA, 64 nt, hsa; identical to SEQ ID NO: 97785

SEQ ID NO: 749300 - RNA, 59 nt, hsa; identical to SEQ ID NO: 76155

SEQ ID NO: 749301 - RNA, 64 nt, hsa; identical to SEQ ID NO: 76156

SEQ ID NO: 749302 - RNA, 64 nt, hsa; identical to SEQ ID NO: 76157

SEQ ID NO: 749303 - RNA, 64 nt, hsa; identical to SEQ ID NO: 76158

SEQ ID NO: 749304 - RNA, 64 nt, hsa; identical to SEQ ID NO: 76159

SEQ ID NO: 749305 - RNA, 64 nt, hsa; identical to SEQ ID NO: 76160

SEQ ID NO: 749306 - RNA, 64 nt, hsa; identical to SEQ ID NO: 76161

SEQ ID NO: 749307 - RNA, 64 nt, hsa; identical to SEQ ID NO: 76162

SEQ ID NO: 749308 - RNA, 64 nt, hsa; identical to SEQ ID NO: 76163

SEQ ID NO: 749309 - RNA, 64 nt, hsa; identical to SEQ ID NO: 76164

SEQ ID NO: 749310 - RNA, 64 nt, hsa; identical to SEQ ID NO: 76165

SEQ ID NO: 749311 - RNA, 64 nt, hsa; identical to SEQ ID NO: 76166

SEQ ID NO: 749312 - RNA, 64 nt, hsa; identical to SEQ ID NO: 76167

SEQ ID NO: 749313 - RNA, 64 nt, hsa; identical to SEQ ID NO: 76168

SEQ ID NO: 749314 - RNA, 64 nt, hsa; identical to SEQ ID NO: 76169

SEQ ID NO: 749315 - RNA, 58 nt, hsa; identical to SEQ ID NO: 76170

SEQ ID NO: 749316 - RNA, 64 nt, hsa; identical to SEQ ID NO: 76171

SEQ ID NO: 749317 - RNA, 64 nt, hsa; identical to SEQ ID NO: 76172

SEQ ID NO: 749318 - RNA, 64 nt, hsa; identical to SEQ ID NO: 76173

SEQ ID NO: 749319 - RNA, 64 nt, hsa; identical to SEQ ID NO: 76174

SEQ ID NO: 749320 - RNA, 64 nt, hsa; identical to SEQ ID NO: 76175

SEQ ID NO: 749321 - RNA, 52 nt, hsa; identical to SEQ ID NO: 76176

SEQ ID NO: 749322 - RNA, 64 nt, hsa; identical to SEQ ID NO: 76177

SEQ ID NO: 749323 - RNA, 64 nt, hsa; identical to SEQ ID NO: 76178

SEQ ID NO: 749324 - RNA, 64 nt, hsa; identical to SEQ ID NO: 76179

SEQ ID NO: 749325 - RNA, 64 nt, hsa; identical to SEQ ID NO: 76180

SEQ ID NO: 749326 - RNA, 64 nt, hsa; identical to SEQ ID NO: 76181

SEQ ID NO: 749327 - RNA, 64 nt, hsa; identical to SEQ ID NO: 76182

SEQ ID NO: 749328 - RNA, 64 nt, hsa; identical to SEQ ID NO: 76183

SEQ ID NO: 749329 - RNA, 64 nt, hsa; identical to SEQ ID NO: 76184

SEQ ID NO: 749330 - RNA, 64 nt, hsa; identical to SEQ ID NO: 76185

SEQ ID NO: 749331 - RNA, 64 nt, hsa; identical to SEQ ID NO: 76186

SEQ ID NO: 749332 - RNA, 64 nt, hsa; identical to SEQ ID NO: 76187

SEQ ID NO: 749333 - RNA, 64 nt, hsa; identical to SEQ ID NO: 76188

SEQ ID NO: 749334 - RNA, 64 nt, hsa; identical to SEQ ID NO: 76189

SEQ ID NO: 749335 - RNA, 64 nt, hsa; identical to SEQ ID NO: 76190

SEQ ID NO: 749336 - RNA, 64 nt, hsa; identical to SEQ ID NO: 76191

SEQ ID NO: 749337 - RNA, 64 nt, hsa; identical to SEQ ID NO: 76192

SEQ ID NO: 749338 - RNA, 64 nt, hsa; identical to SEQ ID NO: 76193

SEQ ID NO: 749339 - RNA, 64 nt, hsa; identical to SEQ ID NO: 76194

SEQ ID NO: 749340 - RNA, 64 nt, hsa; identical to SEQ ID NO: 76195

SEQ ID NO: 749341 - RNA, 64 nt, hsa; identical to SEQ ID NO: 76196

SEQ ID NO: 749342 - RNA, 64 nt, hsa; identical to SEQ ID NO: 76197

SEQ ID NO: 749343 - RNA, 64 nt, hsa; identical to SEQ ID NO: 76198

SEQ ID NO: 749344 - RNA, 64 nt, hsa; identical to SEQ ID NO: 76199

SEQ ID NO: 749345 - RNA, 64 nt, hsa; identical to SEQ ID NO: 76200

SEQ ID NO: 749346 - RNA, 64 nt, hsa; identical to SEQ ID NO: 76201

SEQ ID NO: 749347 - RNA, 64 nt, hsa; identical to SEQ ID NO: 76202

SEQ ID NO: 749348 - RNA, 64 nt, hsa; identical to SEQ ID NO: 76203

SEQ ID NO: 749349 - RNA, 64 nt, hsa; identical to SEQ ID NO: 76204

SEQ ID NO: 749350 - RNA, 64 nt, hsa; identical to SEQ ID NO: 76205

SEQ ID NO: 749351 - RNA, 64 nt, hsa; identical to SEQ ID NO: 76206

SEQ ID NO: 749352 - RNA, 64 nt, hsa; identical to SEQ ID NO: 76207

SEQ ID NO: 749353 - RNA, 64 nt, hsa; identical to SEQ ID NO: 76208

SEQ ID NO: 749354 - RNA, 64 nt, hsa; identical to SEQ ID NO: 76209

SEQ ID NO: 749355 - RNA, 64 nt, hsa; identical to SEQ ID NO: 76210

SEQ ID NO: 749356 - RNA, 64 nt, hsa; identical to SEQ ID NO: 76211

SEQ ID NO: 749357 - RNA, 64 nt, hsa; identical to SEQ ID NO: 76212

SEQ ID NO: 749358 - RNA, 64 nt, hsa; identical to SEQ ID NO: 76213

SEQ ID NO: 749359 - RNA, 64 nt, hsa; identical to SEQ ID NO: 76214

SEQ ID NO: 749360 - RNA, 64 nt, hsa; identical to SEQ ID NO: 76215

SEQ ID NO: 749361 - RNA, 64 nt, hsa; identical to SEQ ID NO: 76216

SEQ ID NO: 749362 - RNA, 64 nt, hsa; identical to SEQ ID NO: 76217

SEQ ID NO: 749363 - RNA, 64 nt, hsa; identical to SEQ ID NO: 76218

SEQ ID NO: 749364 - RNA, 64 nt, hsa; identical to SEQ ID NO: 76219

SEQ ID NO: 749365 - RNA, 64 nt, hsa
auggacuuugaagucagccuuugccuuugagaaaguucaagaacuaugguuggucacgucuauc

SEQ ID NO: 749366 - RNA, 64 nt, hsa
aagggauuacugguccuacagccaggagcuaauuguucaagaaguguugaacuuuaaaaagaca

SEQ ID NO: 749367 - RNA, 64 nt, hsa
gaggccgaggcaggcggauugccugagcucaggaguucaagaucagucugggcaacacgaugaa

SEQ ID NO: 749368 - RNA, 64 nt, hsa
ggaggccaaggcaggcggaucccugaguucgggaguucaagaccagccugaccaacacggagaa

SEQ ID NO: 749369 - RNA, 64 nt, hsa
aagaguacuuuaacgcccaugcguguucaagacuguucaagacuggugauuuggaguaguuuac

SEQ ID NO: 749370 - RNA, 64 nt, hsa
uguacagauaaagaguacuuuaacgcccaugcguguucaagacuguucaagacuggugauuugg

SEQ ID NO: 749371 - RNA, 64 nt, hsa
gaggcugaggcgggcagaucgcuugaggucaggaguucaagaccagcccgggcaacguggugaa

SEQ ID NO: 749372 - RNA, 64 nt, hsa
gaggccgagucagguggaucaccugaggucaggaguucaagaccagccuggccaacauggcgaa

SEQ ID NO: 749373 - RNA, 64 nt, hsa
caggccugggcuguagcaagcugucugcccuuggguucaagaaccagacuguggagccaaaggu

SEQ ID NO: 749374 - RNA, 64 nt, hsa
aggccaaguauggggcccuggcuguguucuggaaguucaagacacuuaguccuccacagugggu

SEQ ID NO: 749375 - RNA, 64 nt, hsa
aauuuacaaaauuucaguuagacaaggcaacugaguucaagagaucuguuguacagcuugguga

SEQ ID NO: 749376 - RNA, 64 nt, hsa
gaggccgaggagggcagaucacuugaggucaggaguucaagaccagccuggccaacauggcgaa

SEQ ID NO: 749377 - RNA, 64 nt, hsa
gaggcaggggcggguggaucaccugaggucaggaguucaagacuagccuggccaacauggugaa

SEQ ID NO: 749378 - RNA, 64 nt, hsa
gaggcugaggugguaggaucaccugaggucaggaguucaagaccagccuguccaacauggugaa

SEQ ID NO: 749379 - RNA, 64 nt, hsa
gaggccacuguaggaggaucaauugagccuagaaguucaagaccagccugggcaaaguagggag

SEQ ID NO: 749380 - RNA, 64 nt, hsa
gaggcugaggcagguggaucacuugagcucaggaguucaagaccagcuugggaaacauggcaaa

SEQ ID NO: 749381 - RNA, 64 nt, hsa
ugccaugucuccaauuccuaguauguaacuagagguucaagagaccccaaauuccugccauuuu

SEQ ID NO: 749382 - RNA, 64 nt, hsa
cauuccuggucuuuucacuuuagauucucuuuagguucaagaugcagauuucucaauuuggaca

SEQ ID NO: 749383 - RNA, 64 nt, hsa
gaagacaaugugggagaauggcuugagcccaggaguucaagaccggccugagcaacauagugag

SEQ ID NO: 749384 - RNA, 64 nt, hsa
gcagcugggggaggguucagggcagcaaugcugaguucaagaaaaguacuucaggcugggcaca

SEQ ID NO: 749385 - RNA, 64 nt, hsa
gaguccaaggcgggcggaucacuugaggucaggaguucaagaccagcuuggccaaggugauaaa

SEQ ID NO: 749386 - RNA, 64 nt, hsa
gaggcugaggcgggcagaucacuugaggccaggaguucaagaccagcccaaccaacauggugaa

SEQ ID NO: 749387 - RNA, 64 nt, hsa
uaauguaucuugugaaguaugguuacuaggguagguucaagagcuacaugccucuggcuuuuga

SEQ ID NO: 749388 - RNA, 64 nt, hsa
aaggccgaggcgggcagaucacugaagcucaggaguucaagaccagccugggcaacauggcgaa

SEQ ID NO: 749389 - RNA, 64 nt, hsa
gaggcuaaggcagcuggaucacuugaggccaggaguucaagaccagccuggcaaacauggugaa

SEQ ID NO: 749390 - RNA, 64 nt, hsa
gaggccaaggugagaggauaacuugaaacuaggaguucaagaccagccaaggcaacauagugag

SEQ ID NO: 749391 - RNA, 64 nt, hsa
ccagcacugagaggccgaucacuugaggucaggaguucaagaccagccuggccaacauggugaa

SEQ ID NO: 749392 - RNA, 64 nt, hsa
gaggccaagguggguggaucacuugaggccaggaguucaagaccagccuggccaacaugaugag

SEQ ID NO: 749393 - RNA, 64 nt, hsa
cacuccugauccucaaccuccaugccuaaggcugguucaagagaccacauaauaucugccuuuu

SEQ ID NO: 749394 - RNA, 64 nt, hsa
gaggcugagguggucagaucaccuaaggucaggaguucaagaccagccuggucaacauggugaa

SEQ ID NO: 749395 - RNA, 64 nt, hsa
gaggccaaggugggaggaucaguugagccccagaguucaagaccagccugggcaauguaguaag

SEQ ID NO: 749396 - RNA, 64 nt, hsa
gaggcugaggcaggcggaucaccugaggucaggaguucaagaccagccuggccaacauggugaa

SEQ ID NO: 749397 - RNA, 64 nt, hsa; identical to SEQ ID NO: 89670

SEQ ID NO: 749398 - RNA, 64 nt, hsa; identical to SEQ ID NO: 89671

SEQ ID NO: 749399 - RNA, 64 nt, hsa; identical to SEQ ID NO: 89672

SEQ ID NO: 749400 - RNA, 64 nt, hsa; identical to SEQ ID NO: 89673

SEQ ID NO: 749401 - RNA, 64 nt, hsa; identical to SEQ ID NO: 89674

SEQ ID NO: 749402 - RNA, 64 nt, hsa; identical to SEQ ID NO: 89675

SEQ ID NO: 749403 - RNA, 64 nt, hsa; identical to SEQ ID NO: 89676

SEQ ID NO: 749404 - RNA, 64 nt, hsa; identical to SEQ ID NO: 89677

SEQ ID NO: 749405 - RNA, 64 nt, hsa; identical to SEQ ID NO: 89678

SEQ ID NO: 749406 - RNA, 64 nt, hsa; identical to SEQ ID NO: 89679

SEQ ID NO: 749407 - RNA, 64 nt, hsa; identical to SEQ ID NO: 89680

SEQ ID NO: 749408 - RNA, 64 nt, hsa; identical to SEQ ID NO: 89681

SEQ ID NO: 749409 - RNA, 64 nt, hsa
augaugaaucggccaacagccagcccuugccagcugacgucacagucuaagaugggaaacugug

SEQ ID NO: 749410 - RNA, 64 nt, hsa
gguguuucagugcggagugccaagaguccuauccugacgucaggcucugggugucaaccucuga

SEQ ID NO: 749411 - RNA, 64 nt, hsa
cagcacgucgcacacagacauggggaacuuggcaugacgucacaccgagaugcagcaacgacgu

SEQ ID NO: 749412 - RNA, 64 nt, hsa
ggccgcggagaugacgucacgcaagcaacggcgcugacgucacauaucaccguggugauggcgu

SEQ ID NO: 749413 - RNA, 64 nt, hsa
acgaucccucacccagagcacacggccgcggagaugacgucacgcaagcaacggcgcugacguc

SEQ ID NO: 749414 - RNA, 64 nt, hsa; identical to SEQ ID NO: 76474

SEQ ID NO: 749415 - RNA, 64 nt, hsa; identical to SEQ ID NO: 76475

SEQ ID NO: 749416 - RNA, 64 nt, hsa; identical to SEQ ID NO: 76476

SEQ ID NO: 749417 - RNA, 64 nt, hsa; identical to SEQ ID NO: 76477

SEQ ID NO: 749418 - RNA, 64 nt, hsa; identical to SEQ ID NO: 76478

SEQ ID NO: 749419 - RNA, 64 nt, hsa; identical to SEQ ID NO: 76479

SEQ ID NO: 749420 - RNA, 64 nt, hsa; identical to SEQ ID NO: 76480

SEQ ID NO: 749421 - RNA, 64 nt, hsa; identical to SEQ ID NO: 76481

SEQ ID NO: 749422 - RNA, 64 nt, hsa; identical to SEQ ID NO: 76482

SEQ ID NO: 749423 - RNA, 64 nt, hsa; identical to SEQ ID NO: 76483

SEQ ID NO: 749424 - RNA, 64 nt, hsa; identical to SEQ ID NO: 23330

SEQ ID NO: 749425 - RNA, 64 nt, hsa; identical to SEQ ID NO: 23331

SEQ ID NO: 749426 - RNA, 64 nt, hsa; identical to SEQ ID NO: 23332

SEQ ID NO: 749427 - RNA, 64 nt, hsa; identical to SEQ ID NO: 23333

SEQ ID NO: 749428 - RNA, 64 nt, hsa; identical to SEQ ID NO: 23334

SEQ ID NO: 749429 - RNA, 64 nt, hsa; identical to SEQ ID NO: 23335

SEQ ID NO: 749430 - RNA, 64 nt, hsa; identical to SEQ ID NO: 23336

SEQ ID NO: 749431 - RNA, 64 nt, hsa; identical to SEQ ID NO: 23337

SEQ ID NO: 749432 - RNA, 64 nt, hsa; identical to SEQ ID NO: 23338

SEQ ID NO: 749433 - RNA, 64 nt, hsa; identical to SEQ ID NO: 23339

SEQ ID NO: 749434 - RNA, 64 nt, hsa; identical to SEQ ID NO: 532305

SEQ ID NO: 749435 - RNA, 64 nt, hsa; identical to SEQ ID NO: 532306

SEQ ID NO: 749436 - RNA, 64 nt, hsa; identical to SEQ ID NO: 532307

SEQ ID NO: 749437 - RNA, 64 nt, hsa; identical to SEQ ID NO: 532308

SEQ ID NO: 749438 - RNA, 64 nt, hsa; identical to SEQ ID NO: 532309

SEQ ID NO: 749439 - RNA, 57 nt, hsa; identical to SEQ ID NO: 83127

SEQ ID NO: 749440 - RNA, 64 nt, hsa; identical to SEQ ID NO: 532311

SEQ ID NO: 749441 - RNA, 64 nt, hsa; identical to SEQ ID NO: 532312

SEQ ID NO: 749442 - RNA, 64 nt, hsa; identical to SEQ ID NO: 532313

SEQ ID NO: 749443 - RNA, 64 nt, hsa; identical to SEQ ID NO: 532314

SEQ ID NO: 749444 - RNA, 64 nt, hsa; identical to SEQ ID NO: 532315

SEQ ID NO: 749445 - RNA, 64 nt, hsa; identical to SEQ ID NO: 532316

SEQ ID NO: 749446 - RNA, 64 nt, hsa; identical to SEQ ID NO: 532317

SEQ ID NO: 749447 - RNA, 64 nt, hsa; identical to SEQ ID NO: 532318

SEQ ID NO: 749448 - RNA, 59 nt, hsa; identical to SEQ ID NO: 83136

SEQ ID NO: 749449 - RNA, 64 nt, hsa; identical to SEQ ID NO: 532320

SEQ ID NO: 749450 - RNA, 64 nt, hsa; identical to SEQ ID NO: 532321

SEQ ID NO: 749451 - RNA, 64 nt, hsa; identical to SEQ ID NO: 532322

SEQ ID NO: 749452 - RNA, 64 nt, hsa; identical to SEQ ID NO: 532323

SEQ ID NO: 749453 - RNA, 64 nt, hsa; identical to SEQ ID NO: 532324

SEQ ID NO: 749454 - RNA, 64 nt, hsa; identical to SEQ ID NO: 532325

SEQ ID NO: 749455 - RNA, 64 nt, hsa; identical to SEQ ID NO: 532326

SEQ ID NO: 749456 - RNA, 64 nt, hsa; identical to SEQ ID NO: 532327

SEQ ID NO: 749457 - RNA, 64 nt, hsa; identical to SEQ ID NO: 532328

SEQ ID NO: 749458 - RNA, 64 nt, hsa; identical to SEQ ID NO: 532329

SEQ ID NO: 749459 - RNA, 64 nt, hsa; identical to SEQ ID NO: 532330

SEQ ID NO: 749460 - RNA, 64 nt, hsa; identical to SEQ ID NO: 532331

SEQ ID NO: 749461 - RNA, 64 nt, hsa; identical to SEQ ID NO: 532332

SEQ ID NO: 749462 - RNA, 64 nt, hsa; identical to SEQ ID NO: 532333

SEQ ID NO: 749463 - RNA, 64 nt, hsa; identical to SEQ ID NO: 532334

SEQ ID NO: 749464 - RNA, 64 nt, hsa; identical to SEQ ID NO: 532335

SEQ ID NO: 749465 - RNA, 64 nt, hsa; identical to SEQ ID NO: 532336

SEQ ID NO: 749466 - RNA, 64 nt, hsa; identical to SEQ ID NO: 532337

SEQ ID NO: 749467 - RNA, 64 nt, hsa; identical to SEQ ID NO: 532338

SEQ ID NO: 749468 - RNA, 64 nt, hsa
ccccgugaagguguaugccacaccuggccuuaaagagggacaggcugaagagagggacaggcac

SEQ ID NO: 749469 - RNA, 64 nt, hsa
ccacaccuggccuuaaagagggacaggcugaagagagggacaggcacuccaaaccugucuuggg

SEQ ID NO: 749470 - RNA, 64 nt, hsa
agggacagguucugucaggggugacaccaggagagagggacagguucuguugggggugacacca

SEQ ID NO: 749471 - RNA, 64 nt, hsa
agggacagguucugucgggggugacaccaggagagagggacagguucugucaggggugacacca

SEQ ID NO: 749472 - RNA, 64 nt, hsa
agggacagguucuaucaugggugacaccaggagagagggacagguucuguugggggugacaaga

SEQ ID NO: 749473 - RNA, 64 nt, hsa
gaauaacaaacugcacaaccugcaaaccaggagagagggacagguucugucaggggugacacca

SEQ ID NO: 749474 - RNA, 64 nt, hsa
aggcucgccaggcccugauccggucuguggggacgagggacacugaggagaggugcugggcacc

SEQ ID NO: 749475 - RNA, 64 nt, hsa
agcacagagagcggcuuccccauugccuucuggggagggacacagaggacagcuuccccaucgc

SEQ ID NO: 749476 - RNA, 64 nt, hsa
agcacagaggauggcuuccccauugccuucuggggagggacacagaggacggcuuccccaucgc

SEQ ID NO: 749477 - RNA, 64 nt, hsa
uuagcuggugaggaacgugcaggcacugaggcuggagggacauggagcccccucuuccagacac

SEQ ID NO: 749478 - RNA, 64 nt, hsa
ucgcccauuggacuuccugaccucuucugucuuugagggacagagaccaagcuagauccuuuuu

SEQ ID NO: 749479 - RNA, 64 nt, hsa
agcaaaguugugguucucuugcuaacuucaaggugagggacauugggcacccuaaguuugggaa

SEQ ID NO: 749480 - RNA, 64 nt, hsa
agaaggugguaccugauggucuguucugacgggugagggacagaggcaucuggaugaaaaucuc

SEQ ID NO: 749481 - RNA, 64 nt, hsa
uacauguuccuuccgaguuuucuuucgcuggaaagagggacaggggcccccacccgucaccacg

SEQ ID NO: 749482 - RNA, 64 nt, hsa
cuacugggcuuggagcacguccgggcaguggagggagggacacagccugggacaggaagccucu

SEQ ID NO: 749483 - RNA, 64 nt, hsa
ucaacaaacaaacaaaaagagccagugggggagggagggacagagacccagagggcagcgucag

SEQ ID NO: 749484 - RNA, 64 nt, hsa
gggggagaaaacuguacucuguccagacaugauagagggacagagccaaaaggauagagaaaga

SEQ ID NO: 749485 - RNA, 64 nt, hsa; identical to SEQ ID NO: 568041

SEQ ID NO: 749486 - RNA, 64 nt, hsa; identical to SEQ ID NO: 568042

SEQ ID NO: 749487 - RNA, 64 nt, hsa; identical to SEQ ID NO: 568043

SEQ ID NO: 749488 - RNA, 64 nt, hsa; identical to SEQ ID NO: 568044

SEQ ID NO: 749489 - RNA, 64 nt, hsa; identical to SEQ ID NO: 568045

SEQ ID NO: 749490 - RNA, 64 nt, hsa; identical to SEQ ID NO: 568046

SEQ ID NO: 749491 - RNA, 64 nt, hsa; identical to SEQ ID NO: 568047

SEQ ID NO: 749492 - RNA, 64 nt, hsa; identical to SEQ ID NO: 568048

SEQ ID NO: 749493 - RNA, 64 nt, hsa; identical to SEQ ID NO: 568049

SEQ ID NO: 749494 - RNA, 64 nt, hsa; identical to SEQ ID NO: 568050

SEQ ID NO: 749495 - RNA, 64 nt, hsa; identical to SEQ ID NO: 568051

SEQ ID NO: 749496 - RNA, 64 nt, hsa; identical to SEQ ID NO: 568052

SEQ ID NO: 749497 - RNA, 63 nt, hsa
auggggagggagugggccuggaucugggaccucccuccagaauuuccuccagaugggggcagu

SEQ ID NO: 749498 - RNA, 63 nt, hsa
ugggccuggaucugggaccucccuccagaauuuccuccagaugggggcagugcccagggaggg

SEQ ID NO: 749499 - RNA, 57 nt, hsa; identical to SEQ ID NO: 510926

SEQ ID NO: 749500 - RNA, 63 nt, hsa
accccugugcaaauuuuaaaaaggaacccuuuuccuccagacagauacagccccaaaccaggg

SEQ ID NO: 749501 - RNA, 63 nt, hsa
gugcauguggaaaguaucagaguaaggcucuccccuccagagcccugaguuucuuggcugcau

SEQ ID NO: 749502 - RNA, 63 nt, hsa
gcuuuccuagauccacacuuucaaagagaaaccccuccagaacucccacccugacagcccaac

SEQ ID NO: 749503 - RNA, 63 nt, hsa
agcagauuaaccccaggcagaccgauaaaaagaccuccagauaggcagacagacagauggacc

SEQ ID NO: 749504 - RNA, 63 nt, hsa
uugauggauggaccccagcuagucagacaugauccuccagauugacagacaagucccccaaau

SEQ ID NO: 749505 - RNA, 63 nt, hsa
ugccuguauuggucccuucugaccacucuccugccuccagagaaagcucugcuucacccugga

SEQ ID NO: 749506 - RNA, 63 nt, hsa
aaagccaguggcuccuuucucccuuccucuuggccuccagauuuugaaugguuccuuguucuu

SEQ ID NO: 749507 - RNA, 63 nt, hsa
ugacccuuaagugccacccuucuuggaagacccccuccagaagcauacuggaagccaccucug

SEQ ID NO: 749508 - RNA, 63 nt, hsa
uaccauucccauuuucucagccucuucucacugccuccagagaggugggugccuggguugaga

SEQ ID NO: 749509 - RNA, 63 nt, hsa
gcccacagaccugucgggugcuccugugaguggccuccagaugucuuugugcauaggcacaag

SEQ ID NO: 749510 - RNA, 63 nt, hsa
ccuggugccaacaggggcaucccggcccauaccccuccagacaggaagcauggguuugcccac

SEQ ID NO: 749511 - RNA, 63 nt, hsa
guccuuucaaggggaaaaugugaagcugaacccccuccagacacccagaauguagcaucugag

SEQ ID NO: 749512 - RNA, 63 nt, hsa
cacagcugcuggccaggguagacuuggagcuguccuccagaggggucacguguaggagugaga

SEQ ID NO: 749513 - RNA, 63 nt, hsa
aggcguccugucuucacgggggggucccgguggccuccagacguagccauuuccugacaucaa

SEQ ID NO: 749514 - RNA, 63 nt, hsa
aguaaacuggaaaugagacauugacgugcugcuccuccagaggucugcacacuccacuucaca

SEQ ID NO: 749515 - RNA, 63 nt, hsa
uucauauaccugccugagauaggcugguccucaccuccagagccagccagccccgucaggggc

SEQ ID NO: 749516 - RNA, 63 nt, hsa
agagcgagagcagagcaaacugcgcagcaggcaccuccagaaagguaaugguggcagaaccca

SEQ ID NO: 749517 - RNA, 63 nt, hsa
gagugaccguggcacuuggguguacagguaauuccuccagagcuguuugcuggcuucaggagu

SEQ ID NO: 749518 - RNA, 63 nt, hsa
uugcauucugccguguuuauagguguucacuuuccuccagagcugauuaacuacugacaugac

SEQ ID NO: 749519 - RNA, 63 nt, hsa
cuacugcuucugucccugcuggcagccucugucccuccagaacggcuaaccagagcacacugu

SEQ ID NO: 749520 - RNA, 63 nt, hsa
ggccugcccguacuccuccacccagaugagggcccuccagagccugcaggcaucuguggggaa

SEQ ID NO: 749521 - RNA, 63 nt, hsa
acugcagugaccaguggguguggcuggguccagccuccagaucuggcccgcacgaugccuugc

SEQ ID NO: 749522 - RNA, 63 nt, hsa
gucacucugaaagggaguuguggagaggagacgccuccagacucucagaaguuuugaggacug

SEQ ID NO: 749523 - RNA, 63 nt, hsa
ugucugcuggcaccuugaucuuggaccucccagccuccagaacugugagaaauaaauguguuu

SEQ ID NO: 749524 - RNA, 63 nt, hsa
cauacaacauacuuaaugcagggcuacacugaaccuccagaaucauuuuguuugcuuugaccc

SEQ ID NO: 749525 - RNA, 63 nt, hsa
gucaccaggagaugaggguuaggugugcccagcccuccagacccggccuuucugguuaacccc

SEQ ID NO: 749526 - RNA, 63 nt, hsa
ggagguuuuuaagcaguacgugccuccaaguuaccuccagaucagcaggcacaggugggcauu

SEQ ID NO: 749527 - RNA, 63 nt, hsa
acugcaaggcccaccugccccucccccacagagccuccagagcuagcugaggccaacgcaggc

SEQ ID NO: 749528 - RNA, 63 nt, hsa
agcucgagagccagacggccagacaggcagaccccuccagaggcccgccaggugggcaugguc

SEQ ID NO: 749529 - RNA, 63 nt, hsa
ugaguacuuauggcccugaaagcggccacggugccuccagauggcagguuugcaauccaagca

SEQ ID NO: 749530 - RNA, 63 nt, hsa
gauauaccugauauauuccaccaggauauccucccuccagauauacuugguucucuccaccag

SEQ ID NO: 749531 - RNA, 63 nt, hsa
caaggcgucgaggaauuggaaagauuugcacacccuccagaaaggagagacgcaaucuccccu

SEQ ID NO: 749532 - RNA, 63 nt, hsa
cgguuccucuccacgcaucucgaggcggcguuaccuccagauuccguagaguuagagucacau

SEQ ID NO: 749533 - RNA, 63 nt, hsa
gugugcuggucuaaauuaauccaucgcagugauccuccagagacagcgcucugcucauguccg

SEQ ID NO: 749534 - RNA, 63 nt, hsa
accgagaaugaggagcccucccugccccaccguccuccagagaaugcgccccuccugguuccc

SEQ ID NO: 749535 - RNA, 63 nt, hsa
gggagcauccuaaaaaugggguccaggcagaccccuccagaccucacacugccgaggaggccu

SEQ ID NO: 749536 - RNA, 63 nt, hsa
auggagccugucucaggaaggccagcugcagguccuccagaaaaucaaagaagggaagaaacu

SEQ ID NO: 749537 - RNA, 63 nt, hsa
gaggaacgguguuauggacugaauguucauguuccuccagaauucauaugcugaagccucugu

SEQ ID NO: 749538 - RNA, 63 nt, hsa
cgucugcuggcaccuugaucuugaacuucccagccuccagaacugugagaaagaaaucucuau

SEQ ID NO: 749539 - RNA, 63 nt, hsa
acuaaggugcuaggaauucguaaucauccccauccuccagagaaacccagggaggaagacugu

SEQ ID NO: 749540 - RNA, 63 nt, hsa
uugaccucaucucccgagcaauggcgccugcucccuccagaauggaacucaagcugguuuuaa

SEQ ID NO: 749541 - RNA, 63 nt, hsa
uuuggccaccaguucuucggccagcaccucugcccuccagaaccugcagccuggaggggugag

SEQ ID NO: 749542 - RNA, 63 nt, hsa
ucuucucccgucugcccugcggguugcccgccuccuccagagacuugcccaagggcccaucac

SEQ ID NO: 749543 - RNA, 63 nt, hsa
uacauugcaaagccuuacucuaaaagcucccagccuccagaggcucucaaugaagagucaccu

SEQ ID NO: 749544 - RNA, 63 nt, hsa
aagccccagguugagagaacagaggccuagggaccuccagaccauuggaaucacuguuugcca

SEQ ID NO: 749545 - RNA, 63 nt, hsa
ggccggggcaagcacuucaucggagacuuccugccuccagacgagcuggaaaaguuuauggag

SEQ ID NO: 749546 - RNA, 63 nt, hsa
agcggacgggggucccgagguggaaaccauugcccuccagaacaaccgugagaaccaggcauu

SEQ ID NO: 749547 - RNA, 63 nt, hsa
aucuccuggauucaaacaauucuccugccucagccuccagaauagcugggauuacaggcguac

SEQ ID NO: 749548 - RNA, 63 nt, hsa
cagcagaucuuggaugguccaggcucuaugugaccuccagagcaaagagaaagacuucggaca

SEQ ID NO: 749549 - RNA, 63 nt, hsa
ccagugccucaccuccagauccugcuggcaucaccuccagagcccugcaugcacuggcugaag

SEQ ID NO: 749550 - RNA, 63 nt, hsa
cuccgggugucugagaaaccacccagugccucaccuccagauccugcuggcaucaccuccaga

SEQ ID NO: 749551 - RNA, 63 nt, hsa
gcuauccugggagaucuaccugaaggagaacuaccuccagaaccgacaguuccagcaaaagca

SEQ ID NO: 749552 - RNA, 63 nt, hsa
gcgcaucccacucuaugcgaaccacaagacccuccuccagaaggcagccgcugaguucggggc

SEQ ID NO: 749553 - RNA, 63 nt, hsa
uguggaaacaaagcaggaccagcaggcacagcaccuccagaacagugccccggaugaccagag

SEQ ID NO: 749554 - RNA, 63 nt, hsa
ugcccagaggcaacccuugccagucuguuuaucccuccagauacagucucugauaguaaacuu

SEQ ID NO: 749555 - RNA, 63 nt, hsa
uucugucuggggacgaaggguuggacgggaugaccuccagaagucccuucaauuucuaguacc

SEQ ID NO: 749556 - RNA, 63 nt, hsa
gaugaccugccccaaguggugagcaagcaccaaccuccagacucagcagagugaggggguaaa

SEQ ID NO: 749557 - RNA, 64 nt, hsa
uuauuacacaagcacagccgcccagugugcacaucaugugcagacaccuuggaaaccuuuccca

SEQ ID NO: 749558 - RNA, 64 nt, hsa
ugccagugaggucagcuucugcccuccagcaauacaugugcagggguugcugcuuucccagugc

SEQ ID NO: 749559 - RNA, 64 nt, hsa
auuuuacuguggagcgcuaacaucuggaucguaacaugugcagaauguaugguaggaauguauu

SEQ ID NO: 749560 - RNA, 64 nt, hsa
agcacaaggauuaaguuggaaaagcuguaaauugcaugugcauauuugucuauuuuuucuauaa

SEQ ID NO: 749561 - RNA, 64 nt, hsa
aaugcauugaugucauuuuauuauguacauauaucaugugcauucaagcugugugacaagauau

SEQ ID NO: 749562 - RNA, 56 nt, hsa
acggugaaaguaacgucugacagaagcaugugcacuucgggaagcaggccugcauc

SEQ ID NO: 749563 - RNA, 64 nt, hsa
agguguaagcauagaugaaauaacuguccugucacaugugcagcaggccauggaguguagcggg

SEQ ID NO: 749564 - RNA, 64 nt, hsa
cuccaucgagcuguuugguuccauguguguuuaacaugugcagaaguagcuucucuguuuaagu

SEQ ID NO: 749565 - RNA, 64 nt, hsa
acauugggcaaaguugcuucuaauccuuauuucccaugugcacaagucuuuuuguauuccagcu

SEQ ID NO: 749566 - RNA, 64 nt, hsa
uauaucaucccaucugaaaaacacuaauuauugacaugugcaucuguacaauaaacuuaaaaug

SEQ ID NO: 749567 - RNA, 64 nt, hsa
caaaagcuuauaauggaacuaagguguacaugugcaugugcauggaaggauaaaagaucuaguc

SEQ ID NO: 749568 - RNA, 64 nt, hsa
uuucaccaaaagcuuauaauggaacuaagguguacaugugcaugugcauggaaggauaaaagau

SEQ ID NO: 749569 - RNA, 64 nt, hsa
uucuuuuuuuuauuauacucuaaguuuuaggguacaugugcacauugugcagguuaguuacaua

SEQ ID NO: 749570 - RNA, 64 nt, hsa
agauaaagagauagagagugaguacaugcacacucaugugcaaacccacucagagaugcauuug

SEQ ID NO: 749571 - RNA, 64 nt, hsa; identical to SEQ ID NO: 259948

SEQ ID NO: 749572 - RNA, 64 nt, hsa; identical to SEQ ID NO: 259949

SEQ ID NO: 749573 - RNA, 64 nt, hsa; identical to SEQ ID NO: 259950

SEQ ID NO: 749574 - RNA, 64 nt, hsa; identical to SEQ ID NO: 259951

SEQ ID NO: 749575 - RNA, 64 nt, hsa; identical to SEQ ID NO: 259952

SEQ ID NO: 749576 - RNA, 64 nt, hsa; identical to SEQ ID NO: 259953

SEQ ID NO: 749577 - RNA, 64 nt, hsa; identical to SEQ ID NO: 259954

SEQ ID NO: 749578 - RNA, 64 nt, hsa; identical to SEQ ID NO: 259955

SEQ ID NO: 749579 - RNA, 64 nt, hsa; identical to SEQ ID NO: 259956

SEQ ID NO: 749580 - RNA, 64 nt, hsa; identical to SEQ ID NO: 259957

SEQ ID NO: 749581 - RNA, 64 nt, hsa; identical to SEQ ID NO: 259958

SEQ ID NO: 749582 - RNA, 64 nt, hsa; identical to SEQ ID NO: 259959

SEQ ID NO: 749583 - RNA, 64 nt, hsa; identical to SEQ ID NO: 259960

SEQ ID NO: 749584 - RNA, 64 nt, hsa; identical to SEQ ID NO: 259961

SEQ ID NO: 749585 - RNA, 64 nt, hsa; identical to SEQ ID NO: 259962

SEQ ID NO: 749586 - RNA, 64 nt, hsa; identical to SEQ ID NO: 259963

SEQ ID NO: 749587 - RNA, 64 nt, hsa; identical to SEQ ID NO: 259964

SEQ ID NO: 749588 - RNA, 64 nt, hsa; identical to SEQ ID NO: 259965

SEQ ID NO: 749589 - RNA, 64 nt, hsa; identical to SEQ ID NO: 259966

SEQ ID NO: 749590 - RNA, 64 nt, hsa; identical to SEQ ID NO: 259967

SEQ ID NO: 749591 - RNA, 64 nt, hsa; identical to SEQ ID NO: 259968

SEQ ID NO: 749592 - RNA, 64 nt, hsa; identical to SEQ ID NO: 259969

SEQ ID NO: 749593 - RNA, 64 nt, hsa; identical to SEQ ID NO: 220121

SEQ ID NO: 749594 - RNA, 64 nt, hsa; identical to SEQ ID NO: 220122

SEQ ID NO: 749595 - RNA, 64 nt, hsa; identical to SEQ ID NO: 220123

SEQ ID NO: 749596 - RNA, 64 nt, hsa; identical to SEQ ID NO: 220124

SEQ ID NO: 749597 - RNA, 64 nt, hsa; identical to SEQ ID NO: 220125

SEQ ID NO: 749598 - RNA, 64 nt, hsa; identical to SEQ ID NO: 220126

SEQ ID NO: 749599 - RNA, 64 nt, hsa; identical to SEQ ID NO: 220127

SEQ ID NO: 749600 - RNA, 64 nt, hsa; identical to SEQ ID NO: 220128

SEQ ID NO: 749601 - RNA, 64 nt, hsa; identical to SEQ ID NO: 220129

SEQ ID NO: 749602 - RNA, 64 nt, hsa; identical to SEQ ID NO: 220130

SEQ ID NO: 749603 - RNA, 64 nt, hsa; identical to SEQ ID NO: 220131

SEQ ID NO: 749604 - RNA, 64 nt, hsa; identical to SEQ ID NO: 220132

SEQ ID NO: 749605 - RNA, 63 nt, hsa
caguguucaccuggugucacuuccaggcaauguucugugcagccgcucuuaguauucuuccuu

SEQ ID NO: 749606 - RNA, 63 nt, hsa
agggucccaaaagugugggugccugacuuccucucugugcagcacucucugaaucccuccuau

SEQ ID NO: 749607 - RNA, 63 nt, hsa
ugcugcuacuguuuugccauccuucuauucauaucugugcagaacacgguguuuuaagcuuga

SEQ ID NO: 749608 - RNA, 63 nt, hsa
ccuuucccaagcaucuguggcauggacauguccucugugcaguggaaggaggaggggcgaaag

SEQ ID NO: 749609 - RNA, 63 nt, hsa
agaagucuugcuguccauggugguguaggaauuucugugcaacaccucaccacgucugguuaa

SEQ ID NO: 749610 - RNA, 63 nt, hsa
uauguauuuaaagaaaaaugcaccaggauggugucugugcacgugacuauuagaggagcgucu

SEQ ID NO: 749611 - RNA, 63 nt, hsa
gguaccuguuuucaguaaaaagggguccugaguucugugcagguggaagagcuacccgagaac

SEQ ID NO: 749612 - RNA, 63 nt, hsa
cagguggaagagcuacccgagaacuaccugaguucugugcagguagagucccauuucuuaugg

SEQ ID NO: 749613 - RNA, 63 nt, hsa
gcaccuugucucccuucccaagaacaaaccauuucugugcacauccuuggaggcgagaugagc

SEQ ID NO: 749614 - RNA, 63 nt, hsa
acuucacuagagcuuacucuggagcaccuauuuucugugcacaugggagugcuccacucccua

SEQ ID NO: 749615 - RNA, 63 nt, hsa
ugccaucccuauuggagauugugaauccugcugucugugcagggcucauagugaguguucugu

SEQ ID NO: 749616 - RNA, 63 nt, hsa
uggcagggcaccccugcugggguugggggcuggucugugcauaauccuggacugugaugggaa

SEQ ID NO: 749617 - RNA, 63 nt, hsa
cucuagcccauuaauacaauacauccuaugcuuucugugcagacuggugcuuccgcagaaagg

SEQ ID NO: 749618 - RNA, 63 nt, hsa
cuaaaaggaccccaaaugguggucguugucccuucugugcaggccagcagggccccaucucua

SEQ ID NO: 749619 - RNA, 63 nt, hsa
gugcugacuucaucucccaccuagcagcaccguucugugcacaaaacccagaccuguuagcag

SEQ ID NO: 749620 - RNA, 63 nt, hsa
gccagcacacagggcagugagggagggcugucaucugugcacugcccauggacaggcuggcuc

SEQ ID NO: 749621 - RNA, 63 nt, hsa
uggaaagucaugcaaucccauuugcaggaucugucugugcacaugccucuguagagagcagca

SEQ ID NO: 749622 - RNA, 63 nt, hsa
gugaacuugucuggcuuuggcacucucugccauucugugcaggcugcaguggcuccccugccc

SEQ ID NO: 749623 - RNA, 64 nt, hsa; identical to SEQ ID NO: 676524

SEQ ID NO: 749624 - RNA, 64 nt, hsa; identical to SEQ ID NO: 676525

SEQ ID NO: 749625 - RNA, 64 nt, hsa; identical to SEQ ID NO: 676526

SEQ ID NO: 749626 - RNA, 64 nt, hsa; identical to SEQ ID NO: 676527

SEQ ID NO: 749627 - RNA, 64 nt, hsa; identical to SEQ ID NO: 676528

SEQ ID NO: 749628 - RNA, 64 nt, hsa; identical to SEQ ID NO: 676529

SEQ ID NO: 749629 - RNA, 64 nt, hsa; identical to SEQ ID NO: 676530

SEQ ID NO: 749630 - RNA, 64 nt, hsa; identical to SEQ ID NO: 676531

SEQ ID NO: 749631 - RNA, 64 nt, hsa; identical to SEQ ID NO: 676532

SEQ ID NO: 749632 - RNA, 64 nt, hsa; identical to SEQ ID NO: 676533

SEQ ID NO: 749633 - RNA, 64 nt, hsa; identical to SEQ ID NO: 676534

SEQ ID NO: 749634 - RNA, 64 nt, hsa; identical to SEQ ID NO: 676535

SEQ ID NO: 749635 - RNA, 64 nt, hsa; identical to SEQ ID NO: 676536

SEQ ID NO: 749636 - RNA, 64 nt, hsa; identical to SEQ ID NO: 676537

SEQ ID NO: 749637 - RNA, 64 nt, hsa; identical to SEQ ID NO: 676538

SEQ ID NO: 749638 - RNA, 64 nt, hsa; identical to SEQ ID NO: 676539

SEQ ID NO: 749639 - RNA, 64 nt, hsa; identical to SEQ ID NO: 676540

SEQ ID NO: 749640 - RNA, 64 nt, hsa; identical to SEQ ID NO: 676541

SEQ ID NO: 749641 - RNA, 64 nt, hsa; identical to SEQ ID NO: 676542

SEQ ID NO: 749642 - RNA, 64 nt, hsa; identical to SEQ ID NO: 676543

SEQ ID NO: 749643 - RNA, 64 nt, hsa; identical to SEQ ID NO: 676544

SEQ ID NO: 749644 - RNA, 64 nt, hsa; identical to SEQ ID NO: 676545

SEQ ID NO: 749645 - RNA, 64 nt, hsa; identical to SEQ ID NO: 676546

SEQ ID NO: 749646 - RNA, 64 nt, hsa; identical to SEQ ID NO: 676547

SEQ ID NO: 749647 - RNA, 64 nt, hsa; identical to SEQ ID NO: 676548

SEQ ID NO: 749648 - RNA, 64 nt, hsa; identical to SEQ ID NO: 676549

SEQ ID NO: 749649 - RNA, 64 nt, hsa; identical to SEQ ID NO: 676550

SEQ ID NO: 749650 - RNA, 64 nt, hsa; identical to SEQ ID NO: 676551

SEQ ID NO: 749651 - RNA, 64 nt, hsa; identical to SEQ ID NO: 676552

SEQ ID NO: 749652 - RNA, 64 nt, hsa; identical to SEQ ID NO: 676553

SEQ ID NO: 749653 - RNA, 64 nt, hsa; identical to SEQ ID NO: 676554

SEQ ID NO: 749654 - RNA, 64 nt, hsa; identical to SEQ ID NO: 676555

SEQ ID NO: 749655 - RNA, 64 nt, hsa; identical to SEQ ID NO: 676556

SEQ ID NO: 749656 - RNA, 64 nt, hsa; identical to SEQ ID NO: 676557

SEQ ID NO: 749657 - RNA, 64 nt, hsa; identical to SEQ ID NO: 676558

SEQ ID NO: 749658 - RNA, 64 nt, hsa; identical to SEQ ID NO: 676559

SEQ ID NO: 749659 - RNA, 64 nt, hsa
caucggaaucacccgaucacagacgagcagucaucggacucacccgaucacagacgagcgguca

SEQ ID NO: 749660 - RNA, 64 nt, hsa; identical to SEQ ID NO: 749659

SEQ ID NO: 749661 - RNA, 64 nt, hsa
caccggaaucgcccggucacagacgagcagucaucggacucacccgaucacagacgagcgguca

SEQ ID NO: 749662 - RNA, 64 nt, hsa
gcucccugcugaccagguccccggacucaagccccggacucaggcccccaccuggcucaccuug

SEQ ID NO: 749663 - RNA, 59 nt, hsa
cccacuuugcucccugcugaccagguccccggacucaagccccggacucaggcccccac

SEQ ID NO: 749664 - RNA, 64 nt, hsa; identical to SEQ ID NO: 310460

SEQ ID NO: 749665 - RNA, 64 nt, hsa; identical to SEQ ID NO: 310461

SEQ ID NO: 749666 - RNA, 64 nt, hsa; identical to SEQ ID NO: 310462

SEQ ID NO: 749667 - RNA, 64 nt, hsa; identical to SEQ ID NO: 310463

SEQ ID NO: 749668 - RNA, 64 nt, hsa; identical to SEQ ID NO: 310464

SEQ ID NO: 749669 - RNA, 64 nt, hsa; identical to SEQ ID NO: 310465

SEQ ID NO: 749670 - RNA, 64 nt, hsa; identical to SEQ ID NO: 310466

SEQ ID NO: 749671 - RNA, 64 nt, hsa; identical to SEQ ID NO: 310467

SEQ ID NO: 749672 - RNA, 64 nt, hsa; identical to SEQ ID NO: 310468

SEQ ID NO: 749673 - RNA, 64 nt, hsa; identical to SEQ ID NO: 310469

SEQ ID NO: 749674 - RNA, 64 nt, hsa; identical to SEQ ID NO: 310470

SEQ ID NO: 749675 - RNA, 64 nt, hsa; identical to SEQ ID NO: 310471

SEQ ID NO: 749676 - RNA, 64 nt, hsa; identical to SEQ ID NO: 310472

SEQ ID NO: 749677 - RNA, 64 nt, hsa; identical to SEQ ID NO: 310473

SEQ ID NO: 749678 - RNA, 64 nt, hsa; identical to SEQ ID NO: 310474

SEQ ID NO: 749679 - RNA, 64 nt, hsa; identical to SEQ ID NO: 310475

SEQ ID NO: 749680 - RNA, 64 nt, hsa; identical to SEQ ID NO: 310476

SEQ ID NO: 749681 - RNA, 64 nt, hsa; identical to SEQ ID NO: 310477

SEQ ID NO: 749682 - RNA, 64 nt, hsa; identical to SEQ ID NO: 310478

SEQ ID NO: 749683 - RNA, 64 nt, hsa; identical to SEQ ID NO: 310479

SEQ ID NO: 749684 - RNA, 64 nt, hsa; identical to SEQ ID NO: 310480

SEQ ID NO: 749685 - RNA, 64 nt, hsa; identical to SEQ ID NO: 310481

SEQ ID NO: 749686 - RNA, 64 nt, hsa; identical to SEQ ID NO: 310482

SEQ ID NO: 749687 - RNA, 64 nt, hsa; identical to SEQ ID NO: 310483

SEQ ID NO: 749688 - RNA, 64 nt, hsa; identical to SEQ ID NO: 310484

SEQ ID NO: 749689 - RNA, 64 nt, hsa; identical to SEQ ID NO: 310485

SEQ ID NO: 749690 - RNA, 64 nt, hsa; identical to SEQ ID NO: 310486

SEQ ID NO: 749691 - RNA, 64 nt, hsa; identical to SEQ ID NO: 310487

SEQ ID NO: 749692 - RNA, 64 nt, hsa; identical to SEQ ID NO: 310488

SEQ ID NO: 749693 - RNA, 64 nt, hsa; identical to SEQ ID NO: 310489

SEQ ID NO: 749694 - RNA, 64 nt, hsa; identical to SEQ ID NO: 310490

SEQ ID NO: 749695 - RNA, 64 nt, hsa; identical to SEQ ID NO: 310491

SEQ ID NO: 749696 - RNA, 64 nt, hsa; identical to SEQ ID NO: 310492

SEQ ID NO: 749697 - RNA, 64 nt, hsa; identical to SEQ ID NO: 310493

SEQ ID NO: 749698 - RNA, 64 nt, hsa; identical to SEQ ID NO: 310494

SEQ ID NO: 749699 - RNA, 64 nt, hsa; identical to SEQ ID NO: 310495

SEQ ID NO: 749700 - RNA, 64 nt, hsa; identical to SEQ ID NO: 310496

SEQ ID NO: 749701 - RNA, 64 nt, hsa; identical to SEQ ID NO: 310497

SEQ ID NO: 749702 - RNA, 64 nt, hsa; identical to SEQ ID NO: 310498

SEQ ID NO: 749703 - RNA, 64 nt, hsa; identical to SEQ ID NO: 310499

SEQ ID NO: 749704 - RNA, 64 nt, hsa; identical to SEQ ID NO: 310500

SEQ ID NO: 749705 - RNA, 64 nt, hsa; identical to SEQ ID NO: 310501

SEQ ID NO: 749706 - RNA, 64 nt, hsa; identical to SEQ ID NO: 310502

SEQ ID NO: 749707 - RNA, 64 nt, hsa; identical to SEQ ID NO: 310503

SEQ ID NO: 749708 - RNA, 64 nt, hsa; identical to SEQ ID NO: 310504

SEQ ID NO: 749709 - RNA, 64 nt, hsa; identical to SEQ ID NO: 310505

SEQ ID NO: 749710 - RNA, 64 nt, hsa; identical to SEQ ID NO: 310506

SEQ ID NO: 749711 - RNA, 64 nt, hsa; identical to SEQ ID NO: 310507

SEQ ID NO: 749712 - RNA, 64 nt, hsa; identical to SEQ ID NO: 310508

SEQ ID NO: 749713 - RNA, 64 nt, hsa; identical to SEQ ID NO: 310509

SEQ ID NO: 749714 - RNA, 64 nt, hsa; identical to SEQ ID NO: 310510

SEQ ID NO: 749715 - RNA, 64 nt, hsa; identical to SEQ ID NO: 310511

SEQ ID NO: 749716 - RNA, 64 nt, hsa; identical to SEQ ID NO: 310512

SEQ ID NO: 749717 - RNA, 64 nt, hsa; identical to SEQ ID NO: 310513

SEQ ID NO: 749718 - RNA, 64 nt, hsa; identical to SEQ ID NO: 310514

SEQ ID NO: 749719 - RNA, 64 nt, hsa; identical to SEQ ID NO: 310515

SEQ ID NO: 749720 - RNA, 64 nt, hsa; identical to SEQ ID NO: 310516

SEQ ID NO: 749721 - RNA, 64 nt, hsa; identical to SEQ ID NO: 310517

SEQ ID NO: 749722 - RNA, 64 nt, hsa; identical to SEQ ID NO: 310518

SEQ ID NO: 749723 - RNA, 64 nt, hsa; identical to SEQ ID NO: 310519

SEQ ID NO: 749724 - RNA, 64 nt, hsa; identical to SEQ ID NO: 310520

SEQ ID NO: 749725 - RNA, 64 nt, hsa; identical to SEQ ID NO: 310521

SEQ ID NO: 749726 - RNA, 64 nt, hsa; identical to SEQ ID NO: 310522

SEQ ID NO: 749727 - RNA, 64 nt, hsa; identical to SEQ ID NO: 310523

SEQ ID NO: 749728 - RNA, 64 nt, hsa; identical to SEQ ID NO: 310524

SEQ ID NO: 749729 - RNA, 64 nt, hsa; identical to SEQ ID NO: 310525

SEQ ID NO: 749730 - RNA, 64 nt, hsa; identical to SEQ ID NO: 310526

SEQ ID NO: 749731 - RNA, 64 nt, hsa; identical to SEQ ID NO: 310527

SEQ ID NO: 749732 - RNA, 64 nt, hsa; identical to SEQ ID NO: 310528

SEQ ID NO: 749733 - RNA, 64 nt, hsa; identical to SEQ ID NO: 310529

SEQ ID NO: 749734 - RNA, 64 nt, hsa; identical to SEQ ID NO: 310530

SEQ ID NO: 749735 - RNA, 64 nt, hsa; identical to SEQ ID NO: 310531

SEQ ID NO: 749736 - RNA, 64 nt, hsa; identical to SEQ ID NO: 310532

SEQ ID NO: 749737 - RNA, 64 nt, hsa; identical to SEQ ID NO: 310533

SEQ ID NO: 749738 - RNA, 64 nt, hsa; identical to SEQ ID NO: 310534

SEQ ID NO: 749739 - RNA, 64 nt, hsa
acuggcuccaacacugcaacauggggacauuugccaacucgaacaaaggcugagaagcagccac

SEQ ID NO: 749740 - RNA, 64 nt, hsa
ccuggccccuucuccucuggggaagaccuugucccaacucgaugggcacagccagccaaccuaa

SEQ ID NO: 749741 - RNA, 64 nt, hsa
aggccuccguggugaagacagaagcuccgugaaccaacucgaggcuggagccaagauccugccu

SEQ ID NO: 749742 - RNA, 59 nt, hsa
uuccagcuggagaggaauaaccaucccuacaacucgaggauagccaucaggagcacugu

SEQ ID NO: 749743 - RNA, 64 nt, hsa
cacacagauugcaaguauugcguaccaagugauacaacucgaaaugcaguucucaucuuccugu

SEQ ID NO: 749744 - RNA, 64 nt, hsa
uaauuuauuuccuuuugauaugcauuuauauaggcaacucgauauaggaugggagcaaacuagg

SEQ ID NO: 749745 - RNA, 64 nt, hsa
uucuucuguuaauaugucagaauguaagauuuggcaacucgauaaauuuuuuucauuuucuuuu

SEQ ID NO: 749746 - RNA, 64 nt, hsa
aucacaaaaguauauucaaaaauuauauuuugaacaacucgaaucacucauuuauuuccauauu

SEQ ID NO: 749747 - RNA, 64 nt, hsa
ugugugaaugugaggauguagacauccaucagugcaacucgagcuccauccuccuccgauuucu

SEQ ID NO: 749748 - RNA, 64 nt, hsa
aauuacuaaagaaauaaaaauaaugguguaaagccaacucgaggggaaucugaauaagcuucca

SEQ ID NO: 749749 - RNA, 64 nt, hsa
ucuaguuuuauaugaacgguuguaucaggguaaccaacucgauuugggaugaaucuuagggcac

SEQ ID NO: 749750 - RNA, 64 nt, hsa
ccaggguugcuucaaguauuuguucaugacacgucaacucgaugauuaaaauccuucaacacuu

SEQ ID NO: 749751 - RNA, 64 nt, hsa
gguaaccccuaaucaagagaggccccaagauccacaacucgagugguuaaagcuuaaaaaguga

SEQ ID NO: 749752 - RNA, 64 nt, hsa
cuuccccugaggugcaggggaagaccaaaguuugcaacucgaacugcuuucguccauguuucuc

SEQ ID NO: 749753 - RNA, 64 nt, hsa
aaacagcaccacugagaugaaucucauggcagaacaacucgacaugccuaugcagccacacagu

SEQ ID NO: 749754 - RNA, 64 nt, hsa
uacuugugugaauugaguaggggcuucaugcucacaacucgaacugacugacaauguggcaaua

SEQ ID NO: 749755 - RNA, 64 nt, hsa
ugcaggccugcuugcaggaaaugaauccagcagccaacucgaaucccccuagggcucaggcacu

SEQ ID NO: 749756 - RNA, 64 nt, hsa
ucugccagguccaugggggcuggcaucccagcuccaacucgaggagccucaguuuccucaucug

SEQ ID NO: 749757 - RNA, 64 nt, hsa
uguauauuacagauauuugucaugcugggauuuccaacucgaaucugugugaaacuuucauucc

SEQ ID NO: 749758 - RNA, 64 nt, hsa
ugagggccuucucgugagguacugacaacaccagcaacucgagagcugggaaacucaaggagga

SEQ ID NO: 749759 - RNA, 64 nt, hsa
ugcuuuuucauuuuguauacugcaaguucccaggcaacucgaauuugcaaacacagccauggau

SEQ ID NO: 749760 - RNA, 64 nt, hsa
ucgcaggaucauuucagacccgcacuucggcagccaacucgaaagcaggcgguugugugcggca

SEQ ID NO: 749761 - RNA, 64 nt, hsa
cuccucuccaauccugagggccccucccccaacccaacucgacccucccuccccucacccccaa

SEQ ID NO: 749762 - RNA, 64 nt, hsa
gccgaucaaggcucuggcauucagagaacccuugcaacucgagaagcuguuuuuauuucguuuu

SEQ ID NO: 749763 - RNA, 64 nt, hsa
cccuggagacuuugcucccugguuuccuggucaccaacucgaguguucagcccugugugcucuc

SEQ ID NO: 749764 - RNA, 64 nt, hsa
ucccgugacugacugucuuaacugagcauuuucucaacucgacucucauuucuucccugcuggu

SEQ ID NO: 749765 - RNA, 63 nt, hsa
guuauuuaagaaaaauaucuaaauauauauauuucaacucgaaguuguuuuauuuaaaggaga

SEQ ID NO: 749766 - RNA, 64 nt, hsa
caccaggaauaauccauucuuuggggccucuuuccaacucgagguuguuuucuuucaagauacu

SEQ ID NO: 749767 - RNA, 62 nt, hsa
acucucgcgauaacuguacugagauaaaguguggcaacucgagcuggcuggugauucauccu

SEQ ID NO: 749768 - RNA, 64 nt, hsa
cucuguuccagaagcccuauaagcuggagguggacaacucgauguaaauuucaugggaaaaccc

SEQ ID NO: 749769 - RNA, 64 nt, hsa; identical to SEQ ID NO: 379229

SEQ ID NO: 749770 - RNA, 64 nt, hsa; identical to SEQ ID NO: 379230

SEQ ID NO: 749771 - RNA, 64 nt, hsa; identical to SEQ ID NO: 379231

SEQ ID NO: 749772 - RNA, 64 nt, hsa; identical to SEQ ID NO: 379232

SEQ ID NO: 749773 - RNA, 64 nt, hsa; identical to SEQ ID NO: 379233

SEQ ID NO: 749774 - RNA, 64 nt, hsa; identical to SEQ ID NO: 379234

SEQ ID NO: 749775 - RNA, 64 nt, hsa; identical to SEQ ID NO: 379235

SEQ ID NO: 749776 - RNA, 64 nt, hsa; identical to SEQ ID NO: 379236

SEQ ID NO: 749777 - RNA, 64 nt, hsa; identical to SEQ ID NO: 379237

SEQ ID NO: 749778 - RNA, 64 nt, hsa; identical to SEQ ID NO: 379238

SEQ ID NO: 749779 - RNA, 64 nt, hsa; identical to SEQ ID NO: 379239

SEQ ID NO: 749780 - RNA, 64 nt, hsa; identical to SEQ ID NO: 379240

SEQ ID NO: 749781 - RNA, 64 nt, hsa; identical to SEQ ID NO: 379241

SEQ ID NO: 749782 - RNA, 64 nt, hsa; identical to SEQ ID NO: 379242

SEQ ID NO: 749783 - RNA, 64 nt, hsa; identical to SEQ ID NO: 379243

SEQ ID NO: 749784 - RNA, 64 nt, hsa; identical to SEQ ID NO: 379244

SEQ ID NO: 749785 - RNA, 64 nt, hsa; identical to SEQ ID NO: 379245

SEQ ID NO: 749786 - RNA, 64 nt, hsa; identical to SEQ ID NO: 379246

SEQ ID NO: 749787 - RNA, 64 nt, hsa; identical to SEQ ID NO: 379247

SEQ ID NO: 749788 - RNA, 64 nt, hsa; identical to SEQ ID NO: 379248

SEQ ID NO: 749789 - RNA, 64 nt, hsa; identical to SEQ ID NO: 379249

SEQ ID NO: 749790 - RNA, 64 nt, hsa; identical to SEQ ID NO: 379250

SEQ ID NO: 749791 - RNA, 64 nt, hsa; identical to SEQ ID NO: 379251

SEQ ID NO: 749792 - RNA, 64 nt, hsa; identical to SEQ ID NO: 379252

SEQ ID NO: 749793 - RNA, 64 nt, hsa; identical to SEQ ID NO: 379253

SEQ ID NO: 749794 - RNA, 64 nt, hsa; identical to SEQ ID NO: 379254

SEQ ID NO: 749795 - RNA, 64 nt, hsa; identical to SEQ ID NO: 379255

SEQ ID NO: 749796 - RNA, 64 nt, hsa; identical to SEQ ID NO: 379256

SEQ ID NO: 749797 - RNA, 64 nt, hsa; identical to SEQ ID NO: 379257

SEQ ID NO: 749798 - RNA, 64 nt, hsa; identical to SEQ ID NO: 379258

SEQ ID NO: 749799 - RNA, 64 nt, hsa; identical to SEQ ID NO: 379259

SEQ ID NO: 749800 - RNA, 64 nt, hsa; identical to SEQ ID NO: 229025

SEQ ID NO: 749801 - RNA, 64 nt, hsa; identical to SEQ ID NO: 229026

SEQ ID NO: 749802 - RNA, 64 nt, hsa; identical to SEQ ID NO: 229027

SEQ ID NO: 749803 - RNA, 64 nt, hsa; identical to SEQ ID NO: 229028

SEQ ID NO: 749804 - RNA, 64 nt, hsa; identical to SEQ ID NO: 229029

SEQ ID NO: 749805 - RNA, 64 nt, hsa; identical to SEQ ID NO: 229030

SEQ ID NO: 749806 - RNA, 64 nt, hsa; identical to SEQ ID NO: 229031

SEQ ID NO: 749807 - RNA, 64 nt, hsa; identical to SEQ ID NO: 229032

SEQ ID NO: 749808 - RNA, 64 nt, hsa; identical to SEQ ID NO: 229033

SEQ ID NO: 749809 - RNA, 64 nt, hsa; identical to SEQ ID NO: 229034

SEQ ID NO: 749810 - RNA, 64 nt, hsa; identical to SEQ ID NO: 229035

SEQ ID NO: 749811 - RNA, 64 nt, hsa; identical to SEQ ID NO: 229036

SEQ ID NO: 749812 - RNA, 64 nt, hsa; identical to SEQ ID NO: 229037

SEQ ID NO: 749813 - RNA, 64 nt, hsa; identical to SEQ ID NO: 229038

SEQ ID NO: 749814 - RNA, 64 nt, hsa; identical to SEQ ID NO: 229039

SEQ ID NO: 749815 - RNA, 64 nt, hsa; identical to SEQ ID NO: 229040

SEQ ID NO: 749816 - RNA, 64 nt, hsa; identical to SEQ ID NO: 229041

SEQ ID NO: 749817 - RNA, 64 nt, hsa; identical to SEQ ID NO: 229042

SEQ ID NO: 749818 - RNA, 64 nt, hsa; identical to SEQ ID NO: 229043

SEQ ID NO: 749819 - RNA, 64 nt, hsa; identical to SEQ ID NO: 229044

SEQ ID NO: 749820 - RNA, 64 nt, hsa; identical to SEQ ID NO: 229045

SEQ ID NO: 749821 - RNA, 64 nt, hsa; identical to SEQ ID NO: 229046

SEQ ID NO: 749822 - RNA, 64 nt, hsa; identical to SEQ ID NO: 229047

SEQ ID NO: 749823 - RNA, 64 nt, hsa; identical to SEQ ID NO: 229048

SEQ ID NO: 749824 - RNA, 64 nt, hsa; identical to SEQ ID NO: 229049

SEQ ID NO: 749825 - RNA, 64 nt, hsa; identical to SEQ ID NO: 229050

SEQ ID NO: 749826 - RNA, 64 nt, hsa; identical to SEQ ID NO: 229051

SEQ ID NO: 749827 - RNA, 64 nt, hsa; identical to SEQ ID NO: 229052

SEQ ID NO: 749828 - RNA, 64 nt, hsa; identical to SEQ ID NO: 229053

SEQ ID NO: 749829 - RNA, 64 nt, hsa; identical to SEQ ID NO: 229054

SEQ ID NO: 749830 - RNA, 64 nt, hsa
agugcggcccgggggggaggaagagggaaaaggaagauggaaggacaccaugcauuaucagaga

SEQ ID NO: 749831 - RNA, 64 nt, hsa
ugcccuacggggcccuccuucccccaccaggaacagauggaaccugccacccaggauccugauc

SEQ ID NO: 749832 - RNA, 64 nt, hsa
gacaaauauccccaagugaaauauguugcgguagagauggaauguauaaaauccgccaguagug

SEQ ID NO: 749833 - RNA, 64 nt, hsa
uaggccugcuguucccuuugcucuugauuaggagagauggaaggagaugagcucccauaacuga

SEQ ID NO: 749834 - RNA, 64 nt, hsa
agaagcacuacaccuugccuugcuguuuguccugagauggaaaaguguccuucuugcucccccu

SEQ ID NO: 749835 - RNA, 64 nt, hsa
gacagggagggaagaaugaacacuccccauuaacagauggaaaaacugaggcuuagagauagac

SEQ ID NO: 749836 - RNA, 64 nt, hsa
aaaaguggccuuagaagaagggugaagguuagauagauggaaucucugucaggggacaaacagc

SEQ ID NO: 749837 - RNA, 64 nt, hsa
caggacacauuggcaagucaagcaggaaggagggagauggaaaggggauaucagauugguuucc

SEQ ID NO: 749838 - RNA, 64 nt, hsa
cccuaugauaaagccuaaugacccauuucacaaaagauggaauuugcccuuccuagaaaauaug

SEQ ID NO: 749839 - RNA, 64 nt, hsa
ugguggcuacuggauuagacagcacgagucuggaagauggaagcuagugcagaaaccucuuguu

SEQ ID NO: 749840 - RNA, 64 nt, hsa
gcucugcaucuccugucuuuucagguuugucaucagauggaaauauuuugauaauaaauugaaa

SEQ ID NO: 749841 - RNA, 64 nt, hsa
ccaugcugcaguguucgaguggauuguaggugcaagauggaaaggauuguaggugcaagcuguc

SEQ ID NO: 749842 - RNA, 64 nt, hsa
cauccugcagguagagcagccucauuccuucacaagauggaaggcaggugaggaugucaggaug

SEQ ID NO: 749843 - RNA, 64 nt, hsa
uccuguucugcaggcaucaggaaaguugaguguaagauggaaaaagcaaacagccuauuuacaa

SEQ ID NO: 749844 - RNA, 64 nt, hsa
accguaucuuggugcagaacagauaauuauacagagauggaaugggacaaccgcaguuuuacua

SEQ ID NO: 749845 - RNA, 64 nt, hsa
auacagaaacacuccuuagcacuuuaagaaagugagauggaacugccagauuucuggaaggaga

SEQ ID NO: 749846 - RNA, 64 nt, hsa
uggggcuuaaucuuguuuaaaaaaauguaagugaagauggaaggcuggagagaaugauugcuuu

SEQ ID NO: 749847 - RNA, 64 nt, hsa
cagcuugacagagcaacuguuauugaaauauuacagauggaaagaaugaggcucagggaaguua

SEQ ID NO: 749848 - RNA, 64 nt, hsa
ucuguacuuuugcaucuguauaaaaauaucagugagauggaacuguaaauaauuguucugcuga

SEQ ID NO: 749849 - RNA, 64 nt, hsa
uguacuuuuucuuaucacauauauuuaaacuuacagauggaaauugcccaaugugcaaauuguu

SEQ ID NO: 749850 - RNA, 64 nt, hsa
ggcaguaugucucagcuggaauggaaagaaugugagauggaaccucaagucacuguuuuuacca

SEQ ID NO: 749851 - RNA, 64 nt, hsa
gaacagggagcagagagacccaacugggagccagagauggaacuucaggucuuaagugcaaauc

SEQ ID NO: 749852 - RNA, 64 nt, hsa
uuucauuuaugguaaacaucuugggcaaacccaaagauggaaagugcuuguuggguggguaagc

SEQ ID NO: 749853 - RNA, 64 nt, hsa
uaaaucugugucucuguguguauaacaaagaggaagauggaaacaauguucauggaaacugcug

SEQ ID NO: 749854 - RNA, 64 nt, hsa
guuaauuauaaaaauuaaaagauuuuuuuuuuugagauggaauauugcucuguugcccaggcug

SEQ ID NO: 749855 - RNA, 64 nt, hsa
cagaugugucuugugcccaccucuuccugagaagagauggaaguggagcugugacuaguacaag

SEQ ID NO: 749856 - RNA, 64 nt, hsa
auacauaaaaccaccaaaauacauagcuucgacaagauggaaguuuauuucucucucccauaac

SEQ ID NO: 749857 - RNA, 64 nt, hsa
gguauccagccucaagucaucauuguggccaggaagauggaauacaccaaauggacaggccugg

SEQ ID NO: 749858 - RNA, 64 nt, hsa
caaaaagaacaaaaaaaaauuuuuaaauaccacaagauggaaaaaaaaaacaaaaaaauuuaaa

SEQ ID NO: 749859 - RNA, 64 nt, hsa
acaagauggaaaaaaaaaacaaaaaaauuuaaaaagauggaauguaguguuuacauuaaagccg

SEQ ID NO: 749860 - RNA, 64 nt, hsa
cauuugguauuguuucauuuacaauuugggacuaagauggaaacacuuuuuuuauaaguuuuua

SEQ ID NO: 749861 - RNA, 64 nt, hsa
ugcuaauaugcguaaguauuaucgguaaguuacaagauggaagaagaauaacaguagggcacag

SEQ ID NO: 749862 - RNA, 64 nt, hsa
ugaaggugcauucaugggugcccuuggaaacggaagauggaauacaucaaagugaauuucuguu

SEQ ID NO: 749863 - RNA, 64 nt, hsa
guuaaaaugucuuaauguagguuguagucacuuuagauggaaaauuaccucacaucuguuuucu

SEQ ID NO: 749864 - RNA, 64 nt, hsa
aggaucucugcugucucuuggaucccaucugccuagauggaagaggauccuauccgaagcuagg

SEQ ID NO: 749865 - RNA, 64 nt, hsa
gcucagcaaacugucagggugcuggccccucugcagauggaaucagcuccaggcugacaccagc

SEQ ID NO: 749866 - RNA, 64 nt, hsa; identical to SEQ ID NO: 498200

SEQ ID NO: 749867 - RNA, 64 nt, hsa; identical to SEQ ID NO: 498201

SEQ ID NO: 749868 - RNA, 64 nt, hsa; identical to SEQ ID NO: 498202

SEQ ID NO: 749869 - RNA, 64 nt, hsa; identical to SEQ ID NO: 498203

SEQ ID NO: 749870 - RNA, 64 nt, hsa; identical to SEQ ID NO: 498204

SEQ ID NO: 749871 - RNA, 64 nt, hsa; identical to SEQ ID NO: 498205

SEQ ID NO: 749872 - RNA, 64 nt, hsa; identical to SEQ ID NO: 498206

SEQ ID NO: 749873 - RNA, 64 nt, hsa; identical to SEQ ID NO: 498207

SEQ ID NO: 749874 - RNA, 64 nt, hsa; identical to SEQ ID NO: 498208

SEQ ID NO: 749875 - RNA, 64 nt, hsa; identical to SEQ ID NO: 498209

SEQ ID NO: 749876 - RNA, 64 nt, hsa; identical to SEQ ID NO: 498210

SEQ ID NO: 749877 - RNA, 64 nt, hsa; identical to SEQ ID NO: 498211

SEQ ID NO: 749878 - RNA, 53 nt, hsa; identical to SEQ ID NO: 498212

SEQ ID NO: 749879 - RNA, 64 nt, hsa; identical to SEQ ID NO: 498213

SEQ ID NO: 749880 - RNA, 64 nt, hsa; identical to SEQ ID NO: 498214

SEQ ID NO: 749881 - RNA, 64 nt, hsa; identical to SEQ ID NO: 498215

SEQ ID NO: 749882 - RNA, 64 nt, hsa; identical to SEQ ID NO: 498216

SEQ ID NO: 749883 - RNA, 64 nt, hsa; identical to SEQ ID NO: 498217

SEQ ID NO: 749884 - RNA, 64 nt, hsa; identical to SEQ ID NO: 498218

SEQ ID NO: 749885 - RNA, 64 nt, hsa; identical to SEQ ID NO: 498219

SEQ ID NO: 749886 - RNA, 64 nt, hsa; identical to SEQ ID NO: 498220

SEQ ID NO: 749887 - RNA, 64 nt, hsa; identical to SEQ ID NO: 498221

SEQ ID NO: 749888 - RNA, 64 nt, hsa; identical to SEQ ID NO: 498222

SEQ ID NO: 749889 - RNA, 64 nt, hsa; identical to SEQ ID NO: 498223

SEQ ID NO: 749890 - RNA, 64 nt, hsa; identical to SEQ ID NO: 498224

SEQ ID NO: 749891 - RNA, 64 nt, hsa; identical to SEQ ID NO: 498225

SEQ ID NO: 749892 - RNA, 64 nt, hsa; identical to SEQ ID NO: 498226

SEQ ID NO: 749893 - RNA, 64 nt, hsa; identical to SEQ ID NO: 498227

SEQ ID NO: 749894 - RNA, 64 nt, hsa; identical to SEQ ID NO: 498228

SEQ ID NO: 749895 - RNA, 64 nt, hsa; identical to SEQ ID NO: 498229

SEQ ID NO: 749896 - RNA, 64 nt, hsa; identical to SEQ ID NO: 498230

SEQ ID NO: 749897 - RNA, 64 nt, hsa; identical to SEQ ID NO: 498231

SEQ ID NO: 749898 - RNA, 64 nt, hsa; identical to SEQ ID NO: 498232

SEQ ID NO: 749899 - RNA, 64 nt, hsa; identical to SEQ ID NO: 498233

SEQ ID NO: 749900 - RNA, 64 nt, hsa; identical to SEQ ID NO: 498234

SEQ ID NO: 749901 - RNA, 64 nt, hsa; identical to SEQ ID NO: 498235

SEQ ID NO: 749902 - RNA, 64 nt, hsa; identical to SEQ ID NO: 498236

SEQ ID NO: 749903 - RNA, 64 nt, hsa; identical to SEQ ID NO: 498237

SEQ ID NO: 749904 - RNA, 64 nt, hsa; identical to SEQ ID NO: 498238

SEQ ID NO: 749905 - RNA, 64 nt, hsa; identical to SEQ ID NO: 498239

SEQ ID NO: 749906 - RNA, 64 nt, hsa; identical to SEQ ID NO: 498240

SEQ ID NO: 749907 - RNA, 64 nt, hsa; identical to SEQ ID NO: 498241

SEQ ID NO: 749908 - RNA, 64 nt, hsa; identical to SEQ ID NO: 498242

SEQ ID NO: 749909 - RNA, 64 nt, hsa; identical to SEQ ID NO: 498243

SEQ ID NO: 749910 - RNA, 64 nt, hsa; identical to SEQ ID NO: 498244

SEQ ID NO: 749911 - RNA, 64 nt, hsa; identical to SEQ ID NO: 498245

SEQ ID NO: 749912 - RNA, 64 nt, hsa; identical to SEQ ID NO: 498246

SEQ ID NO: 749913 - RNA, 64 nt, hsa; identical to SEQ ID NO: 498247

SEQ ID NO: 749914 - RNA, 64 nt, hsa; identical to SEQ ID NO: 498248

SEQ ID NO: 749915 - RNA, 64 nt, hsa; identical to SEQ ID NO: 498249

SEQ ID NO: 749916 - RNA, 64 nt, hsa; identical to SEQ ID NO: 498250

SEQ ID NO: 749917 - RNA, 64 nt, hsa; identical to SEQ ID NO: 498251

SEQ ID NO: 749918 - RNA, 64 nt, hsa; identical to SEQ ID NO: 498252

SEQ ID NO: 749919 - RNA, 64 nt, hsa; identical to SEQ ID NO: 498253

SEQ ID NO: 749920 - RNA, 64 nt, hsa; identical to SEQ ID NO: 498254

SEQ ID NO: 749921 - RNA, 64 nt, hsa; identical to SEQ ID NO: 498255

SEQ ID NO: 749922 - RNA, 64 nt, hsa; identical to SEQ ID NO: 498256

SEQ ID NO: 749923 - RNA, 64 nt, hsa; identical to SEQ ID NO: 126692

SEQ ID NO: 749924 - RNA, 64 nt, hsa; identical to SEQ ID NO: 126693

SEQ ID NO: 749925 - RNA, 64 nt, hsa; identical to SEQ ID NO: 126694

SEQ ID NO: 749926 - RNA, 64 nt, hsa; identical to SEQ ID NO: 126695

SEQ ID NO: 749927 - RNA, 64 nt, hsa; identical to SEQ ID NO: 126696

SEQ ID NO: 749928 - RNA, 64 nt, hsa; identical to SEQ ID NO: 126697

SEQ ID NO: 749929 - RNA, 64 nt, hsa; identical to SEQ ID NO: 126698

SEQ ID NO: 749930 - RNA, 64 nt, hsa; identical to SEQ ID NO: 126699

SEQ ID NO: 749931 - RNA, 64 nt, hsa; identical to SEQ ID NO: 126700

SEQ ID NO: 749932 - RNA, 64 nt, hsa; identical to SEQ ID NO: 126701

SEQ ID NO: 749933 - RNA, 64 nt, hsa; identical to SEQ ID NO: 126702

SEQ ID NO: 749934 - RNA, 64 nt, hsa; identical to SEQ ID NO: 126703

SEQ ID NO: 749935 - RNA, 64 nt, hsa; identical to SEQ ID NO: 126704

SEQ ID NO: 749936 - RNA, 64 nt, hsa; identical to SEQ ID NO: 126705

SEQ ID NO: 749937 - RNA, 64 nt, hsa; identical to SEQ ID NO: 126706

SEQ ID NO: 749938 - RNA, 64 nt, hsa; identical to SEQ ID NO: 126707

SEQ ID NO: 749939 - RNA, 64 nt, hsa; identical to SEQ ID NO: 126708

SEQ ID NO: 749940 - RNA, 64 nt, hsa; identical to SEQ ID NO: 126709

SEQ ID NO: 749941 - RNA, 64 nt, hsa; identical to SEQ ID NO: 126710

SEQ ID NO: 749942 - RNA, 64 nt, hsa; identical to SEQ ID NO: 126711

SEQ ID NO: 749943 - RNA, 64 nt, hsa; identical to SEQ ID NO: 126712

SEQ ID NO: 749944 - RNA, 56 nt, hsa; identical to SEQ ID NO: 126713

SEQ ID NO: 749945 - RNA, 64 nt, hsa; identical to SEQ ID NO: 126714

SEQ ID NO: 749946 - RNA, 64 nt, hsa; identical to SEQ ID NO: 126715

SEQ ID NO: 749947 - RNA, 64 nt, hsa; identical to SEQ ID NO: 126716

SEQ ID NO: 749948 - RNA, 64 nt, hsa; identical to SEQ ID NO: 126717

SEQ ID NO: 749949 - RNA, 64 nt, hsa; identical to SEQ ID NO: 126718

SEQ ID NO: 749950 - RNA, 64 nt, hsa; identical to SEQ ID NO: 126719

SEQ ID NO: 749951 - RNA, 64 nt, hsa; identical to SEQ ID NO: 126720

SEQ ID NO: 749952 - RNA, 64 nt, hsa; identical to SEQ ID NO: 126721

SEQ ID NO: 749953 - RNA, 64 nt, hsa; identical to SEQ ID NO: 126722

SEQ ID NO: 749954 - RNA, 64 nt, hsa; identical to SEQ ID NO: 126723

SEQ ID NO: 749955 - RNA, 64 nt, hsa; identical to SEQ ID NO: 126724

SEQ ID NO: 749956 - RNA, 64 nt, hsa; identical to SEQ ID NO: 126725

SEQ ID NO: 749957 - RNA, 64 nt, hsa; identical to SEQ ID NO: 126726

SEQ ID NO: 749958 - RNA, 64 nt, hsa; identical to SEQ ID NO: 126727

SEQ ID NO: 749959 - RNA, 64 nt, hsa; identical to SEQ ID NO: 126728

SEQ ID NO: 749960 - RNA, 64 nt, hsa; identical to SEQ ID NO: 126729

SEQ ID NO: 749961 - RNA, 64 nt, hsa; identical to SEQ ID NO: 126730

SEQ ID NO: 749962 - RNA, 64 nt, hsa; identical to SEQ ID NO: 126731

SEQ ID NO: 749963 - RNA, 64 nt, hsa; identical to SEQ ID NO: 126732

SEQ ID NO: 749964 - RNA, 64 nt, hsa; identical to SEQ ID NO: 126733

SEQ ID NO: 749965 - RNA, 64 nt, hsa; identical to SEQ ID NO: 126734

SEQ ID NO: 749966 - RNA, 64 nt, hsa; identical to SEQ ID NO: 126735

SEQ ID NO: 749967 - RNA, 64 nt, hsa; identical to SEQ ID NO: 126736

SEQ ID NO: 749968 - RNA, 64 nt, hsa; identical to SEQ ID NO: 126737

SEQ ID NO: 749969 - RNA, 64 nt, hsa; identical to SEQ ID NO: 126738

SEQ ID NO: 749970 - RNA, 64 nt, hsa; identical to SEQ ID NO: 126739

SEQ ID NO: 749971 - RNA, 64 nt, hsa; identical to SEQ ID NO: 126740

SEQ ID NO: 749972 - RNA, 64 nt, hsa; identical to SEQ ID NO: 126741

SEQ ID NO: 749973 - RNA, 64 nt, hsa; identical to SEQ ID NO: 126742

SEQ ID NO: 749974 - RNA, 64 nt, hsa; identical to SEQ ID NO: 126743

SEQ ID NO: 749975 - RNA, 64 nt, hsa; identical to SEQ ID NO: 126744

SEQ ID NO: 749976 - RNA, 64 nt, hsa; identical to SEQ ID NO: 126745

SEQ ID NO: 749977 - RNA, 58 nt, hsa; identical to SEQ ID NO: 126746

SEQ ID NO: 749978 - RNA, 64 nt, hsa; identical to SEQ ID NO: 126747

SEQ ID NO: 749979 - RNA, 64 nt, hsa; identical to SEQ ID NO: 126748

SEQ ID NO: 749980 - RNA, 64 nt, hsa; identical to SEQ ID NO: 126749

SEQ ID NO: 749981 - RNA, 64 nt, hsa; identical to SEQ ID NO: 126750

SEQ ID NO: 749982 - RNA, 64 nt, hsa; identical to SEQ ID NO: 126751

SEQ ID NO: 749983 - RNA, 64 nt, hsa; identical to SEQ ID NO: 126752

SEQ ID NO: 749984 - RNA, 64 nt, hsa; identical to SEQ ID NO: 126753

SEQ ID NO: 749985 - RNA, 64 nt, hsa; identical to SEQ ID NO: 126754

SEQ ID NO: 749986 - RNA, 64 nt, hsa; identical to SEQ ID NO: 126755

SEQ ID NO: 749987 - RNA, 64 nt, hsa; identical to SEQ ID NO: 126756

SEQ ID NO: 749988 - RNA, 64 nt, hsa; identical to SEQ ID NO: 126757

SEQ ID NO: 749989 - RNA, 64 nt, hsa; identical to SEQ ID NO: 126758

SEQ ID NO: 749990 - RNA, 64 nt, hsa; identical to SEQ ID NO: 126759

SEQ ID NO: 749991 - RNA, 63 nt, hsa; identical to SEQ ID NO: 126760

SEQ ID NO: 749992 - RNA, 64 nt, hsa; identical to SEQ ID NO: 126761

SEQ ID NO: 749993 - RNA, 64 nt, hsa; identical to SEQ ID NO: 126762

SEQ ID NO: 749994 - RNA, 64 nt, hsa; identical to SEQ ID NO: 126763

SEQ ID NO: 749995 - RNA, 64 nt, hsa; identical to SEQ ID NO: 126764

SEQ ID NO: 749996 - RNA, 64 nt, hsa; identical to SEQ ID NO: 126765

SEQ ID NO: 749997 - RNA, 64 nt, hsa; identical to SEQ ID NO: 126766

SEQ ID NO: 749998 - RNA, 64 nt, hsa; identical to SEQ ID NO: 126767

SEQ ID NO: 749999 - RNA, 64 nt, hsa; identical to SEQ ID NO: 126768

SEQ ID NO: 750000 - RNA, 64 nt, hsa; identical to SEQ ID NO: 126769

SEQ ID NO: 750001 - RNA, 64 nt, hsa; identical to SEQ ID NO: 126770

SEQ ID NO: 750002 - RNA, 64 nt, hsa; identical to SEQ ID NO: 126771

SEQ ID NO: 750003 - RNA, 64 nt, hsa; identical to SEQ ID NO: 126772

SEQ ID NO: 750004 - RNA, 64 nt, hsa; identical to SEQ ID NO: 126773

SEQ ID NO: 750005 - RNA, 64 nt, hsa; identical to SEQ ID NO: 126774

SEQ ID NO: 750006 - RNA, 64 nt, hsa; identical to SEQ ID NO: 126775

SEQ ID NO: 750007 - RNA, 64 nt, hsa; identical to SEQ ID NO: 126776

SEQ ID NO: 750008 - RNA, 64 nt, hsa; identical to SEQ ID NO: 126777

SEQ ID NO: 750009 - RNA, 64 nt, hsa; identical to SEQ ID NO: 126778

SEQ ID NO: 750010 - RNA, 64 nt, hsa; identical to SEQ ID NO: 126779

SEQ ID NO: 750011 - RNA, 64 nt, hsa; identical to SEQ ID NO: 126780

SEQ ID NO: 750012 - RNA, 64 nt, hsa; identical to SEQ ID NO: 126781

SEQ ID NO: 750013 - RNA, 64 nt, hsa; identical to SEQ ID NO: 126782

SEQ ID NO: 750014 - RNA, 64 nt, hsa; identical to SEQ ID NO: 126783

SEQ ID NO: 750015 - RNA, 64 nt, hsa; identical to SEQ ID NO: 126784

SEQ ID NO: 750016 - RNA, 64 nt, hsa; identical to SEQ ID NO: 126785

SEQ ID NO: 750017 - RNA, 64 nt, hsa; identical to SEQ ID NO: 126786

SEQ ID NO: 750018 - RNA, 64 nt, hsa; identical to SEQ ID NO: 126787

SEQ ID NO: 750019 - RNA, 64 nt, hsa; identical to SEQ ID NO: 126788

SEQ ID NO: 750020 - RNA, 64 nt, hsa; identical to SEQ ID NO: 126789

SEQ ID NO: 750021 - RNA, 64 nt, hsa; identical to SEQ ID NO: 126790

SEQ ID NO: 750022 - RNA, 64 nt, hsa; identical to SEQ ID NO: 126791

SEQ ID NO: 750023 - RNA, 64 nt, hsa; identical to SEQ ID NO: 126792

SEQ ID NO: 750024 - RNA, 64 nt, hsa; identical to SEQ ID NO: 126793

SEQ ID NO: 750025 - RNA, 64 nt, hsa; identical to SEQ ID NO: 126794

SEQ ID NO: 750026 - RNA, 56 nt, hsa; identical to SEQ ID NO: 126795

SEQ ID NO: 750027 - RNA, 64 nt, hsa; identical to SEQ ID NO: 126796

SEQ ID NO: 750028 - RNA, 64 nt, hsa; identical to SEQ ID NO: 692060

SEQ ID NO: 750029 - RNA, 64 nt, hsa; identical to SEQ ID NO: 692061

SEQ ID NO: 750030 - RNA, 64 nt, hsa; identical to SEQ ID NO: 692062

SEQ ID NO: 750031 - RNA, 64 nt, hsa; identical to SEQ ID NO: 692063

SEQ ID NO: 750032 - RNA, 64 nt, hsa; identical to SEQ ID NO: 692064

SEQ ID NO: 750033 - RNA, 64 nt, hsa; identical to SEQ ID NO: 692065

SEQ ID NO: 750034 - RNA, 64 nt, hsa; identical to SEQ ID NO: 692066

SEQ ID NO: 750035 - RNA, 64 nt, hsa; identical to SEQ ID NO: 692067

SEQ ID NO: 750036 - RNA, 64 nt, hsa; identical to SEQ ID NO: 692068

SEQ ID NO: 750037 - RNA, 64 nt, hsa; identical to SEQ ID NO: 692069

SEQ ID NO: 750038 - RNA, 64 nt, hsa; identical to SEQ ID NO: 692070

SEQ ID NO: 750039 - RNA, 64 nt, hsa; identical to SEQ ID NO: 692071

SEQ ID NO: 750040 - RNA, 64 nt, hsa; identical to SEQ ID NO: 692072

SEQ ID NO: 750041 - RNA, 64 nt, hsa; identical to SEQ ID NO: 692073

SEQ ID NO: 750042 - RNA, 64 nt, hsa; identical to SEQ ID NO: 692074

SEQ ID NO: 750043 - RNA, 64 nt, hsa; identical to SEQ ID NO: 692075

SEQ ID NO: 750044 - RNA, 64 nt, hsa; identical to SEQ ID NO: 692076

SEQ ID NO: 750045 - RNA, 64 nt, hsa; identical to SEQ ID NO: 692077

SEQ ID NO: 750046 - RNA, 64 nt, hsa; identical to SEQ ID NO: 692078

SEQ ID NO: 750047 - RNA, 64 nt, hsa; identical to SEQ ID NO: 692079

SEQ ID NO: 750048 - RNA, 64 nt, hsa; identical to SEQ ID NO: 692080

SEQ ID NO: 750049 - RNA, 64 nt, hsa; identical to SEQ ID NO: 692081

SEQ ID NO: 750050 - RNA, 64 nt, hsa; identical to SEQ ID NO: 692082

SEQ ID NO: 750051 - RNA, 64 nt, hsa; identical to SEQ ID NO: 692083

SEQ ID NO: 750052 - RNA, 64 nt, hsa; identical to SEQ ID NO: 692084

SEQ ID NO: 750053 - RNA, 64 nt, hsa; identical to SEQ ID NO: 692085

SEQ ID NO: 750054 - RNA, 64 nt, hsa; identical to SEQ ID NO: 692086

SEQ ID NO: 750055 - RNA, 64 nt, hsa; identical to SEQ ID NO: 692087

SEQ ID NO: 750056 - RNA, 64 nt, hsa; identical to SEQ ID NO: 692088

SEQ ID NO: 750057 - RNA, 64 nt, hsa; identical to SEQ ID NO: 692089

SEQ ID NO: 750058 - RNA, 64 nt, hsa; identical to SEQ ID NO: 692090

SEQ ID NO: 750059 - RNA, 64 nt, hsa; identical to SEQ ID NO: 692091

SEQ ID NO: 750060 - RNA, 64 nt, hsa; identical to SEQ ID NO: 692092

SEQ ID NO: 750061 - RNA, 64 nt, hsa; identical to SEQ ID NO: 692093

SEQ ID NO: 750062 - RNA, 64 nt, hsa; identical to SEQ ID NO: 692094

SEQ ID NO: 750063 - RNA, 64 nt, hsa; identical to SEQ ID NO: 692095

SEQ ID NO: 750064 - RNA, 64 nt, hsa; identical to SEQ ID NO: 692096

SEQ ID NO: 750065 - RNA, 64 nt, hsa; identical to SEQ ID NO: 692097

SEQ ID NO: 750066 - RNA, 64 nt, hsa; identical to SEQ ID NO: 692098

SEQ ID NO: 750067 - RNA, 64 nt, hsa; identical to SEQ ID NO: 692099

SEQ ID NO: 750068 - RNA, 64 nt, hsa; identical to SEQ ID NO: 692100

SEQ ID NO: 750069 - RNA, 64 nt, hsa; identical to SEQ ID NO: 692101

SEQ ID NO: 750070 - RNA, 64 nt, hsa; identical to SEQ ID NO: 692102

SEQ ID NO: 750071 - RNA, 64 nt, hsa; identical to SEQ ID NO: 692103

SEQ ID NO: 750072 - RNA, 64 nt, hsa; identical to SEQ ID NO: 692104

SEQ ID NO: 750073 - RNA, 64 nt, hsa; identical to SEQ ID NO: 692105

SEQ ID NO: 750074 - RNA, 64 nt, hsa; identical to SEQ ID NO: 692106

SEQ ID NO: 750075 - RNA, 64 nt, hsa; identical to SEQ ID NO: 692107

SEQ ID NO: 750076 - RNA, 64 nt, hsa; identical to SEQ ID NO: 692108

SEQ ID NO: 750077 - RNA, 64 nt, hsa; identical to SEQ ID NO: 692109

SEQ ID NO: 750078 - RNA, 64 nt, hsa; identical to SEQ ID NO: 692110

SEQ ID NO: 750079 - RNA, 64 nt, hsa; identical to SEQ ID NO: 692111

SEQ ID NO: 750080 - RNA, 64 nt, hsa; identical to SEQ ID NO: 692112

SEQ ID NO: 750081 - RNA, 64 nt, hsa; identical to SEQ ID NO: 692113

SEQ ID NO: 750082 - RNA, 64 nt, hsa; identical to SEQ ID NO: 692114

SEQ ID NO: 750083 - RNA, 64 nt, hsa; identical to SEQ ID NO: 692115

SEQ ID NO: 750084 - RNA, 64 nt, hsa; identical to SEQ ID NO: 692116

SEQ ID NO: 750085 - RNA, 64 nt, hsa; identical to SEQ ID NO: 692117

SEQ ID NO: 750086 - RNA, 64 nt, hsa; identical to SEQ ID NO: 692118

SEQ ID NO: 750087 - RNA, 64 nt, hsa; identical to SEQ ID NO: 692119

SEQ ID NO: 750088 - RNA, 64 nt, hsa; identical to SEQ ID NO: 692120

SEQ ID NO: 750089 - RNA, 64 nt, hsa; identical to SEQ ID NO: 692121

SEQ ID NO: 750090 - RNA, 64 nt, hsa; identical to SEQ ID NO: 692122

SEQ ID NO: 750091 - RNA, 64 nt, hsa; identical to SEQ ID NO: 692123

SEQ ID NO: 750092 - RNA, 64 nt, hsa; identical to SEQ ID NO: 692124

SEQ ID NO: 750093 - RNA, 64 nt, hsa; identical to SEQ ID NO: 692125

SEQ ID NO: 750094 - RNA, 64 nt, hsa; identical to SEQ ID NO: 692126

SEQ ID NO: 750095 - RNA, 64 nt, hsa; identical to SEQ ID NO: 692127

SEQ ID NO: 750096 - RNA, 64 nt, hsa; identical to SEQ ID NO: 692128

SEQ ID NO: 750097 - RNA, 64 nt, hsa; identical to SEQ ID NO: 692129

SEQ ID NO: 750098 - RNA, 64 nt, hsa; identical to SEQ ID NO: 692130

SEQ ID NO: 750099 - RNA, 64 nt, hsa; identical to SEQ ID NO: 692131

SEQ ID NO: 750100 - RNA, 64 nt, hsa; identical to SEQ ID NO: 692132

SEQ ID NO: 750101 - RNA, 64 nt, hsa; identical to SEQ ID NO: 692133

SEQ ID NO: 750102 - RNA, 64 nt, hsa; identical to SEQ ID NO: 692134

SEQ ID NO: 750103 - RNA, 64 nt, hsa; identical to SEQ ID NO: 692135

SEQ ID NO: 750104 - RNA, 64 nt, hsa; identical to SEQ ID NO: 692136

SEQ ID NO: 750105 - RNA, 64 nt, hsa; identical to SEQ ID NO: 692137

SEQ ID NO: 750106 - RNA, 64 nt, hsa; identical to SEQ ID NO: 692138

SEQ ID NO: 750107 - RNA, 64 nt, hsa; identical to SEQ ID NO: 692139

SEQ ID NO: 750108 - RNA, 64 nt, hsa; identical to SEQ ID NO: 692140

SEQ ID NO: 750109 - RNA, 64 nt, hsa; identical to SEQ ID NO: 692141

SEQ ID NO: 750110 - RNA, 64 nt, hsa; identical to SEQ ID NO: 692142

SEQ ID NO: 750111 - RNA, 64 nt, hsa; identical to SEQ ID NO: 692143

SEQ ID NO: 750112 - RNA, 64 nt, hsa; identical to SEQ ID NO: 692144

SEQ ID NO: 750113 - RNA, 64 nt, hsa; identical to SEQ ID NO: 692145

SEQ ID NO: 750114 - RNA, 64 nt, hsa; identical to SEQ ID NO: 692146

SEQ ID NO: 750115 - RNA, 64 nt, hsa; identical to SEQ ID NO: 692147

SEQ ID NO: 750116 - RNA, 64 nt, hsa; identical to SEQ ID NO: 237917

SEQ ID NO: 750117 - RNA, 64 nt, hsa; identical to SEQ ID NO: 237918

SEQ ID NO: 750118 - RNA, 64 nt, hsa; identical to SEQ ID NO: 237919

SEQ ID NO: 750119 - RNA, 64 nt, hsa; identical to SEQ ID NO: 237920

SEQ ID NO: 750120 - RNA, 64 nt, hsa; identical to SEQ ID NO: 237921

SEQ ID NO: 750121 - RNA, 64 nt, hsa; identical to SEQ ID NO: 237922

SEQ ID NO: 750122 - RNA, 64 nt, hsa; identical to SEQ ID NO: 237923

SEQ ID NO: 750123 - RNA, 64 nt, hsa; identical to SEQ ID NO: 237924

SEQ ID NO: 750124 - RNA, 64 nt, hsa; identical to SEQ ID NO: 237925

SEQ ID NO: 750125 - RNA, 64 nt, hsa; identical to SEQ ID NO: 237926

SEQ ID NO: 750126 - RNA, 64 nt, hsa; identical to SEQ ID NO: 237927

SEQ ID NO: 750127 - RNA, 64 nt, hsa; identical to SEQ ID NO: 237928

SEQ ID NO: 750128 - RNA, 64 nt, hsa; identical to SEQ ID NO: 237927

SEQ ID NO: 750129 - RNA, 64 nt, hsa; identical to SEQ ID NO: 237930

SEQ ID NO: 750130 - RNA, 64 nt, hsa; identical to SEQ ID NO: 237931

SEQ ID NO: 750131 - RNA, 64 nt, hsa; identical to SEQ ID NO: 237932

SEQ ID NO: 750132 - RNA, 64 nt, hsa; identical to SEQ ID NO: 237933

SEQ ID NO: 750133 - RNA, 64 nt, hsa; identical to SEQ ID NO: 237934

SEQ ID NO: 750134 - RNA, 64 nt, hsa; identical to SEQ ID NO: 237935

SEQ ID NO: 750135 - RNA, 64 nt, hsa; identical to SEQ ID NO: 237936

SEQ ID NO: 750136 - RNA, 64 nt, hsa; identical to SEQ ID NO: 237937

SEQ ID NO: 750137 - RNA, 64 nt, hsa; identical to SEQ ID NO: 237938

SEQ ID NO: 750138 - RNA, 64 nt, hsa; identical to SEQ ID NO: 237939

SEQ ID NO: 750139 - RNA, 64 nt, hsa; identical to SEQ ID NO: 237940

SEQ ID NO: 750140 - RNA, 64 nt, hsa; identical to SEQ ID NO: 237941

SEQ ID NO: 750141 - RNA, 64 nt, hsa; identical to SEQ ID NO: 237942

SEQ ID NO: 750142 - RNA, 64 nt, hsa; identical to SEQ ID NO: 237943

SEQ ID NO: 750143 - RNA, 64 nt, hsa; identical to SEQ ID NO: 237944

SEQ ID NO: 750144 - RNA, 64 nt, hsa; identical to SEQ ID NO: 237945

SEQ ID NO: 750145 - RNA, 64 nt, hsa; identical to SEQ ID NO: 237946

SEQ ID NO: 750146 - RNA, 64 nt, hsa; identical to SEQ ID NO: 237947

SEQ ID NO: 750147 - RNA, 64 nt, hsa; identical to SEQ ID NO: 237948

SEQ ID NO: 750148 - RNA, 64 nt, hsa; identical to SEQ ID NO: 237949

SEQ ID NO: 750149 - RNA, 64 nt, hsa; identical to SEQ ID NO: 237950

SEQ ID NO: 750150 - RNA, 64 nt, hsa; identical to SEQ ID NO: 237951

SEQ ID NO: 750151 - RNA, 64 nt, hsa; identical to SEQ ID NO: 237952

SEQ ID NO: 750152 - RNA, 64 nt, hsa; identical to SEQ ID NO: 237953

SEQ ID NO: 750153 - RNA, 64 nt, hsa; identical to SEQ ID NO: 237954

SEQ ID NO: 750154 - RNA, 64 nt, hsa; identical to SEQ ID NO: 237955

SEQ ID NO: 750155 - RNA, 64 nt, hsa; identical to SEQ ID NO: 237956

SEQ ID NO: 750156 - RNA, 64 nt, hsa; identical to SEQ ID NO: 237957

SEQ ID NO: 750157 - RNA, 64 nt, hsa; identical to SEQ ID NO: 237958

SEQ ID NO: 750158 - RNA, 64 nt, hsa; identical to SEQ ID NO: 237959

SEQ ID NO: 750159 - RNA, 64 nt, hsa; identical to SEQ ID NO: 237960

SEQ ID NO: 750160 - RNA, 64 nt, hsa; identical to SEQ ID NO: 237961

SEQ ID NO: 750161 - RNA, 64 nt, hsa; identical to SEQ ID NO: 237962

SEQ ID NO: 750162 - RNA, 64 nt, hsa; identical to SEQ ID NO: 237963

SEQ ID NO: 750163 - RNA, 64 nt, hsa; identical to SEQ ID NO: 237964

SEQ ID NO: 750164 - RNA, 64 nt, hsa; identical to SEQ ID NO: 237965

SEQ ID NO: 750165 - RNA, 64 nt, hsa; identical to SEQ ID NO: 237966

SEQ ID NO: 750166 - RNA, 64 nt, hsa; identical to SEQ ID NO: 237967

SEQ ID NO: 750167 - RNA, 64 nt, hsa; identical to SEQ ID NO: 388598

SEQ ID NO: 750168 - RNA, 64 nt, hsa; identical to SEQ ID NO: 388599

SEQ ID NO: 750169 - RNA, 64 nt, hsa; identical to SEQ ID NO: 388600

SEQ ID NO: 750170 - RNA, 64 nt, hsa; identical to SEQ ID NO: 388601

SEQ ID NO: 750171 - RNA, 64 nt, hsa; identical to SEQ ID NO: 388602

SEQ ID NO: 750172 - RNA, 64 nt, hsa; identical to SEQ ID NO: 388603

SEQ ID NO: 750173 - RNA, 64 nt, hsa; identical to SEQ ID NO: 388604

SEQ ID NO: 750174 - RNA, 64 nt, hsa; identical to SEQ ID NO: 388605

SEQ ID NO: 750175 - RNA, 64 nt, hsa; identical to SEQ ID NO: 388606

SEQ ID NO: 750176 - RNA, 64 nt, hsa; identical to SEQ ID NO: 388607

SEQ ID NO: 750177 - RNA, 64 nt, hsa; identical to SEQ ID NO: 388608

SEQ ID NO: 750178 - RNA, 64 nt, hsa; identical to SEQ ID NO: 388609

SEQ ID NO: 750179 - RNA, 64 nt, hsa; identical to SEQ ID NO: 388610

SEQ ID NO: 750180 - RNA, 64 nt, hsa; identical to SEQ ID NO: 93186

SEQ ID NO: 750181 - RNA, 64 nt, hsa; identical to SEQ ID NO: 93187

SEQ ID NO: 750182 - RNA, 64 nt, hsa; identical to SEQ ID NO: 93188

SEQ ID NO: 750183 - RNA, 64 nt, hsa; identical to SEQ ID NO: 93189

SEQ ID NO: 750184 - RNA, 64 nt, hsa; identical to SEQ ID NO: 93190

SEQ ID NO: 750185 - RNA, 64 nt, hsa; identical to SEQ ID NO: 93191

SEQ ID NO: 750186 - RNA, 64 nt, hsa; identical to SEQ ID NO: 93192

SEQ ID NO: 750187 - RNA, 64 nt, hsa; identical to SEQ ID NO: 93193

SEQ ID NO: 750188 - RNA, 64 nt, hsa; identical to SEQ ID NO: 93194

SEQ ID NO: 750189 - RNA, 64 nt, hsa; identical to SEQ ID NO: 93195

SEQ ID NO: 750190 - RNA, 64 nt, hsa; identical to SEQ ID NO: 93196

SEQ ID NO: 750191 - RNA, 64 nt, hsa; identical to SEQ ID NO: 93197

SEQ ID NO: 750192 - RNA, 64 nt, hsa; identical to SEQ ID NO: 93198

SEQ ID NO: 750193 - RNA, 64 nt, hsa; identical to SEQ ID NO: 93199

SEQ ID NO: 750194 - RNA, 64 nt, hsa; identical to SEQ ID NO: 608232

SEQ ID NO: 750195 - RNA, 64 nt, hsa; identical to SEQ ID NO: 608233

SEQ ID NO: 750196 - RNA, 64 nt, hsa; identical to SEQ ID NO: 608234

SEQ ID NO: 750197 - RNA, 64 nt, hsa; identical to SEQ ID NO: 608235

SEQ ID NO: 750198 - RNA, 64 nt, hsa; identical to SEQ ID NO: 608236

SEQ ID NO: 750199 - RNA, 64 nt, hsa; identical to SEQ ID NO: 608237

SEQ ID NO: 750200 - RNA, 64 nt, hsa; identical to SEQ ID NO: 608238

SEQ ID NO: 750201 - RNA, 64 nt, hsa; identical to SEQ ID NO: 608239

SEQ ID NO: 750202 - RNA, 64 nt, hsa; identical to SEQ ID NO: 608240

SEQ ID NO: 750203 - RNA, 64 nt, hsa; identical to SEQ ID NO: 608241

SEQ ID NO: 750204 - RNA, 64 nt, hsa; identical to SEQ ID NO: 608242

SEQ ID NO: 750205 - RNA, 64 nt, hsa; identical to SEQ ID NO: 608243

SEQ ID NO: 750206 - RNA, 64 nt, hsa; identical to SEQ ID NO: 608244

SEQ ID NO: 750207 - RNA, 64 nt, hsa; identical to SEQ ID NO: 608245

SEQ ID NO: 750208 - RNA, 64 nt, hsa; identical to SEQ ID NO: 608246

SEQ ID NO: 750209 - RNA, 64 nt, hsa; identical to SEQ ID NO: 608247

SEQ ID NO: 750210 - RNA, 64 nt, hsa; identical to SEQ ID NO: 608248

SEQ ID NO: 750211 - RNA, 64 nt, hsa; identical to SEQ ID NO: 608249

SEQ ID NO: 750212 - RNA, 64 nt, hsa; identical to SEQ ID NO: 608250

SEQ ID NO: 750213 - RNA, 64 nt, hsa; identical to SEQ ID NO: 608251

SEQ ID NO: 750214 - RNA, 64 nt, hsa; identical to SEQ ID NO: 608252

SEQ ID NO: 750215 - RNA, 64 nt, hsa; identical to SEQ ID NO: 608253

SEQ ID NO: 750216 - RNA, 64 nt, hsa; identical to SEQ ID NO: 608254

SEQ ID NO: 750217 - RNA, 64 nt, hsa; identical to SEQ ID NO: 608255

SEQ ID NO: 750218 - RNA, 64 nt, hsa
aacgacagguggaagguuguccagagacaccuacagcguggaugcuguuccgagucagcguagg

SEQ ID NO: 750219 - RNA, 64 nt, hsa
gacagaagacggcgagggcaucgucauugcccugagcguggacacgccaccggcagccguaagg

SEQ ID NO: 750220 - RNA, 64 nt, hsa; identical to SEQ ID NO: 74512

SEQ ID NO: 750221 - RNA, 64 nt, hsa; identical to SEQ ID NO: 74513

SEQ ID NO: 750222 - RNA, 64 nt, hsa; identical to SEQ ID NO: 74514

SEQ ID NO: 750223 - RNA, 64 nt, hsa; identical to SEQ ID NO: 74515

SEQ ID NO: 750224 - RNA, 64 nt, hsa; identical to SEQ ID NO: 74516

SEQ ID NO: 750225 - RNA, 64 nt, hsa; identical to SEQ ID NO: 74517

SEQ ID NO: 750226 - RNA, 64 nt, hsa; identical to SEQ ID NO: 74518

SEQ ID NO: 750227 - RNA, 64 nt, hsa; identical to SEQ ID NO: 74519

SEQ ID NO: 750228 - RNA, 64 nt, hsa; identical to SEQ ID NO: 74520

SEQ ID NO: 750229 - RNA, 64 nt, hsa; identical to SEQ ID NO: 74521

SEQ ID NO: 750230 - RNA, 64 nt, hsa; identical to SEQ ID NO: 74522

SEQ ID NO: 750231 - RNA, 64 nt, hsa; identical to SEQ ID NO: 74523

SEQ ID NO: 750232 - RNA, 64 nt, hsa; identical to SEQ ID NO: 74524

SEQ ID NO: 750233 - RNA, 64 nt, hsa; identical to SEQ ID NO: 74525

SEQ ID NO: 750234 - RNA, 64 nt, hsa; identical to SEQ ID NO: 74526

SEQ ID NO: 750235 - RNA, 64 nt, hsa; identical to SEQ ID NO: 74527

SEQ ID NO: 750236 - RNA, 64 nt, hsa; identical to SEQ ID NO: 74528

SEQ ID NO: 750237 - RNA, 64 nt, hsa; identical to SEQ ID NO: 74529

SEQ ID NO: 750238 - RNA, 64 nt, hsa; identical to SEQ ID NO: 74530

SEQ ID NO: 750239 - RNA, 64 nt, hsa; identical to SEQ ID NO: 74531

SEQ ID NO: 750240 - RNA, 64 nt, hsa; identical to SEQ ID NO: 74532

SEQ ID NO: 750241 - RNA, 64 nt, hsa; identical to SEQ ID NO: 74533

SEQ ID NO: 750242 - RNA, 54 nt, hsa; identical to SEQ ID NO: 74534

SEQ ID NO: 750243 - RNA, 64 nt, hsa; identical to SEQ ID NO: 74535

SEQ ID NO: 750244 - RNA, 64 nt, hsa; identical to SEQ ID NO: 74536

SEQ ID NO: 750245 - RNA, 64 nt, hsa; identical to SEQ ID NO: 74537

SEQ ID NO: 750246 - RNA, 64 nt, hsa; identical to SEQ ID NO: 74538

SEQ ID NO: 750247 - RNA, 64 nt, hsa; identical to SEQ ID NO: 74539

SEQ ID NO: 750248 - RNA, 64 nt, hsa; identical to SEQ ID NO: 74540

SEQ ID NO: 750249 - RNA, 64 nt, hsa; identical to SEQ ID NO: 74541

SEQ ID NO: 750250 - RNA, 64 nt, hsa; identical to SEQ ID NO: 74542

SEQ ID NO: 750251 - RNA, 64 nt, hsa; identical to SEQ ID NO: 95596

SEQ ID NO: 750252 - RNA, 64 nt, hsa; identical to SEQ ID NO: 95597

SEQ ID NO: 750253 - RNA, 64 nt, hsa; identical to SEQ ID NO: 95598

SEQ ID NO: 750254 - RNA, 64 nt, hsa; identical to SEQ ID NO: 95599

SEQ ID NO: 750255 - RNA, 64 nt, hsa; identical to SEQ ID NO: 95600

SEQ ID NO: 750256 - RNA, 64 nt, hsa; identical to SEQ ID NO: 95601

SEQ ID NO: 750257 - RNA, 64 nt, hsa; identical to SEQ ID NO: 95602

SEQ ID NO: 750258 - RNA, 64 nt, hsa; identical to SEQ ID NO: 95603

SEQ ID NO: 750259 - RNA, 64 nt, hsa; identical to SEQ ID NO: 95604

SEQ ID NO: 750260 - RNA, 64 nt, hsa; identical to SEQ ID NO: 95605

SEQ ID NO: 750261 - RNA, 64 nt, hsa
cuggcaagucuaggugggcgggugacagggaaagcaugggcauuuuuguauugcugucacaugc

SEQ ID NO: 750262 - RNA, 64 nt, hsa
uugcaaguguggugagaggcucuacuagcaaagacaugggcaccggaguaggucccguguagca

SEQ ID NO: 750263 - RNA, 64 nt, hsa
augaugcuugggcuuaggaucuugaggccugucacaugggcagcaugugcacaggggacagagu

SEQ ID NO: 750264 - RNA, 64 nt, hsa
cggccaccaccuccuccccucaaggcaugcugagcaugggcacagacagcccaucccugcucca

SEQ ID NO: 750265 - RNA, 64 nt, hsa
ugagacaucuguacaggaagcaucccagcgcccacaugggcaugagacagucugcacugcgccu

SEQ ID NO: 750266 - RNA, 64 nt, hsa
agccagggccacgggggcccagcacgagaguccucaugggcacucacagacugcgugcuuucau

SEQ ID NO: 750267 - RNA, 64 nt, hsa
caguuggccagcuggggugagaaggccgcgaagccaugggcagacaggaaguggaggugaaugu

SEQ ID NO: 750268 - RNA, 64 nt, hsa
auacuaaagucugagccaggccccucaggcccggcaugggcagugcgaggcccauagugguggg

SEQ ID NO: 750269 - RNA, 64 nt, hsa
ugcaucaggggaugcccugagcuccacaggucuucaugggcagggguuguggguccuggugaag

SEQ ID NO: 750270 - RNA, 64 nt, hsa
gcucuccgggagccugaaccuccugacugaggaacaugggcagaacauguuuauugcacagagu

SEQ ID NO: 750271 - RNA, 64 nt, hsa
cuucugcuugcugggcuggcuggaccugugaagccaugggcagguagugcccucuugagaguca

SEQ ID NO: 750272 - RNA, 64 nt, hsa
gcuuuuccucuuugccacuggaucuucauggagacaugggcaagcauuaguggcuucagauugg

SEQ ID NO: 750273 - RNA, 64 nt, hsa
gccucaugggcagggccacagcagagagacacagcaugggcagugccuucccugccuguggggg

SEQ ID NO: 750274 - RNA, 64 nt, hsa
agagugcaaccccacccuccacaggaaauugccucaugggcagggccacagcagagagacacag

SEQ ID NO: 750275 - RNA, 64 nt, hsa
ggaggccccugcuugugcucagggaaggccucuucaugggcauguuccugcuggggcggugcgg

SEQ ID NO: 750276 - RNA, 64 nt, hsa
guccauccucccuauggcccuggccagagcucagcaugggcagggguucuggguaggacgguca

SEQ ID NO: 750277 - RNA, 64 nt, hsa
gaugccagcgaccaucagacaacguggaggcccucaugggcaauggcugagggggccgggcuga

SEQ ID NO: 750278 - RNA, 64 nt, hsa
ugcuguggccccugcagguguggcagagauggggcaugggcauuggggucuccaucagccucug

SEQ ID NO: 750279 - RNA, 64 nt, hsa
agucucccaggacccccuuuggagaugcccauggcaugggcacugcccacaggcucagccagaa

SEQ ID NO: 750280 - RNA, 64 nt, hsa
caggucucucuuguuggccagagggccugcuucccaugggcauugcaagugccaccgugcgggg

SEQ ID NO: 750281 - RNA, 64 nt, hsa
agcugcacuuguuguugauacagcauaagugaaucaugggcauuucccugagagcagugggaga

SEQ ID NO: 750282 - RNA, 64 nt, hsa
ucucguacaguugggauaggaggccauucauucccaugggcacagcuaacauuaucccccagug

SEQ ID NO: 750283 - RNA, 64 nt, hsa
guugagccuugcuggacaagugguuuguuugugugcaaaccaaacuuucuuuacccagugcaau

SEQ ID NO: 750284 - RNA, 64 nt, hsa
gucaucagucaucucuuuauggugacuucccuuugcaaaccaggcugugaccaacacaugugag

SEQ ID NO: 750285 - RNA, 64 nt, hsa
acguuucacauuaaauggugugaagcguuguuuggcaaaccaacagcuuuggcuucuggugugg

SEQ ID NO: 750286 - RNA, 64 nt, hsa
cuuuuuaaaacaaacaaacaaacaaaacaaaaaagcaaaccacauuuguuaucucaaauuuuga

SEQ ID NO: 750287 - RNA, 64 nt, hsa
augggcuuuguuagcacuuucaaaaaaaaaaaaagcaaaccauacuuguccacuguccugugcu

SEQ ID NO: 750288 - RNA, 64 nt, hsa; identical to SEQ ID NO: 681250

SEQ ID NO: 750289 - RNA, 64 nt, hsa; identical to SEQ ID NO: 681251

SEQ ID NO: 750290 - RNA, 64 nt, hsa; identical to SEQ ID NO: 681252

SEQ ID NO: 750291 - RNA, 64 nt, hsa; identical to SEQ ID NO: 681253

SEQ ID NO: 750292 - RNA, 64 nt, hsa; identical to SEQ ID NO: 681254

SEQ ID NO: 750293 - RNA, 64 nt, hsa; identical to SEQ ID NO: 681255

SEQ ID NO: 750294 - RNA, 64 nt, hsa; identical to SEQ ID NO: 681256

SEQ ID NO: 750295 - RNA, 64 nt, hsa; identical to SEQ ID NO: 681257

SEQ ID NO: 750296 - RNA, 64 nt, hsa; identical to SEQ ID NO: 681258

SEQ ID NO: 750297 - RNA, 64 nt, hsa; identical to SEQ ID NO: 681259

SEQ ID NO: 750298 - RNA, 64 nt, hsa; identical to SEQ ID NO: 681260

SEQ ID NO: 750299 - RNA, 64 nt, hsa; identical to SEQ ID NO: 681261

SEQ ID NO: 750300 - RNA, 64 nt, hsa; identical to SEQ ID NO: 681262

SEQ ID NO: 750301 - RNA, 64 nt, hsa; identical to SEQ ID NO: 681263

SEQ ID NO: 750302 - RNA, 64 nt, hsa; identical to SEQ ID NO: 681264

SEQ ID NO: 750303 - RNA, 64 nt, hsa; identical to SEQ ID NO: 681265

SEQ ID NO: 750304 - RNA, 64 nt, hsa; identical to SEQ ID NO: 681266

SEQ ID NO: 750305 - RNA, 64 nt, hsa; identical to SEQ ID NO: 681267

SEQ ID NO: 750306 - RNA, 64 nt, hsa; identical to SEQ ID NO: 681268

SEQ ID NO: 750307 - RNA, 64 nt, hsa; identical to SEQ ID NO: 681269

SEQ ID NO: 750308 - RNA, 64 nt, hsa; identical to SEQ ID NO: 681270

SEQ ID NO: 750309 - RNA, 64 nt, hsa; identical to SEQ ID NO: 681271

SEQ ID NO: 750310 - RNA, 64 nt, hsa; identical to SEQ ID NO: 681272

SEQ ID NO: 750311 - RNA, 64 nt, hsa; identical to SEQ ID NO: 681273

SEQ ID NO: 750312 - RNA, 64 nt, hsa; identical to SEQ ID NO: 681274

SEQ ID NO: 750313 - RNA, 64 nt, hsa; identical to SEQ ID NO: 681275

SEQ ID NO: 750314 - RNA, 64 nt, hsa; identical to SEQ ID NO: 681276

SEQ ID NO: 750315 - RNA, 64 nt, hsa; identical to SEQ ID NO: 681277

SEQ ID NO: 750316 - RNA, 64 nt, hsa; identical to SEQ ID NO: 681278

SEQ ID NO: 750317 - RNA, 64 nt, hsa; identical to SEQ ID NO: 681279

SEQ ID NO: 750318 - RNA, 64 nt, hsa; identical to SEQ ID NO: 681280

SEQ ID NO: 750319 - RNA, 64 nt, hsa; identical to SEQ ID NO: 681281

SEQ ID NO: 750320 - RNA, 64 nt, hsa; identical to SEQ ID NO: 681282

SEQ ID NO: 750321 - RNA, 64 nt, hsa; identical to SEQ ID NO: 681283

SEQ ID NO: 750322 - RNA, 64 nt, hsa; identical to SEQ ID NO: 681284

SEQ ID NO: 750323 - RNA, 64 nt, hsa; identical to SEQ ID NO: 681285

SEQ ID NO: 750324 - RNA, 64 nt, hsa; identical to SEQ ID NO: 681286

SEQ ID NO: 750325 - RNA, 64 nt, hsa; identical to SEQ ID NO: 681287

SEQ ID NO: 750326 - RNA, 64 nt, hsa; identical to SEQ ID NO: 681288

SEQ ID NO: 750327 - RNA, 64 nt, hsa; identical to SEQ ID NO: 681289

SEQ ID NO: 750328 - RNA, 64 nt, hsa; identical to SEQ ID NO: 115857

SEQ ID NO: 750329 - RNA, 64 nt, hsa; identical to SEQ ID NO: 115858

SEQ ID NO: 750330 - RNA, 64 nt, hsa; identical to SEQ ID NO: 115859

SEQ ID NO: 750331 - RNA, 64 nt, hsa; identical to SEQ ID NO: 115860

SEQ ID NO: 750332 - RNA, 64 nt, hsa
uuuagagggcacauuuugcuguaaaucuggaaauuugauagacuugacuguguuugugaaaacu

SEQ ID NO: 750333 - RNA, 64 nt, hsa
uauuuuauuuauuuuucccagugaaaaguguauuuugauagagaacuuuucauucuauaaauac

SEQ ID NO: 750334 - RNA, 64 nt, hsa
uaauauucuagcucucuuuauuauggaacagaucuugauagaugguuuaauuuucuccuaaaga

SEQ ID NO: 750335 - RNA, 64 nt, hsa
caguuuacagugucauucuuccacgaauagguaauugauagaguuuaugggucuuagucuuaag

SEQ ID NO: 750336 - RNA, 64 nt, hsa
aauaauucuucugucaaaggagguuaaauuuuaguugauagaguacuuaaaugcauuacuuuau

SEQ ID NO: 750337 - RNA, 64 nt, hsa
aaacuguguaguaccuuagacuuggcauuuauuuuugauagagcagagauaaaauauuuugaug

SEQ ID NO: 750338 - RNA, 64 nt, hsa
auugcuugaaaaugagugaguaccucagagaaauuugauagacucaaacagauaguaugagaaa

SEQ ID NO: 750339 - RNA, 64 nt, hsa
uugguuaagauuuugacuacuucauuauuaaaaauugauagaauuuuagcuccugagauauuua

SEQ ID NO: 750340 - RNA, 64 nt, hsa
uuucaggcuugugacucaacaaagggcuuuuccauugauagaagcaguuugggauuuguaguug

SEQ ID NO: 750341 - RNA, 64 nt, hsa
uugguuggaacgcauuggcuuuuuuuuucuuguuuugauagaaauggaauuaagcaaaaguagu

SEQ ID NO: 750342 - RNA, 64 nt, hsa
guacugccuaaaaagaguuagacucuauuggcaauugauagaguauuacccacggugcuuauua

SEQ ID NO: 750343 - RNA, 64 nt, hsa
cuuacuuucauuuauguuuauuaucuuaaagcaauugauagauuuuacaucuuugauauaaagc

SEQ ID NO: 750344 - RNA, 64 nt, hsa
agcuagucauccauaucauugaagcgcucaugauuugauagauuaaccuuucauuuuuuuaggu

SEQ ID NO: 750345 - RNA, 64 nt, hsa
aagugacacuacgcgugcaguucauuucuaguucuugauagaacugcacuuaauuuucaguagu

SEQ ID NO: 750346 - RNA, 64 nt, hsa
aucauauuacaaguacguaaggauucagggucucuugauagacuuaucauagcucuauauugaa

SEQ ID NO: 750347 - RNA, 64 nt, hsa
gaauuaaauuuaaauuuauccuccaacuaaauuuuugauagaauuaaauuuaaauuuguccucc

SEQ ID NO: 750348 - RNA, 64 nt, hsa
uggaguguuugcacaauuuaaauuugauaaauuuuugauagaauuaaauuuaaauuuauccucc

SEQ ID NO: 750349 - RNA, 64 nt, hsa
cccaacugauguggagaaaaauugauguuugauguugauagauaugcuuauaccuaauuuuuag

SEQ ID NO: 750350 - RNA, 64 nt, hsa
uuaauauauagaacuuuaccaucaccagccguaguugauagaaaauauuaguuucagaauuacc

SEQ ID NO: 750351 - RNA, 64 nt, hsa
uguggucaacauuuugauagaauuucuuuauaauuugauagagauuauauuauuuuuauuuuau

SEQ ID NO: 750352 - RNA, 64 nt, hsa
gcaaauggucugacuucuuuauguggucaacauuuugauagaauuucuuuauaauuugauagag

SEQ ID NO: 750353 - RNA, 64 nt, hsa
auacauaaagaaauguuucaguuaggcauuaaccuugauagaaucacucaguuuggugcuuuaa

SEQ ID NO: 750354 - RNA, 64 nt, hsa
gaauaugaagggauuguaaaaaacaaaauguccauugauagaccaucguguacaaguagauuuc

SEQ ID NO: 750355 - RNA, 64 nt, hsa
gugguuagucuuuuauuuuaagaagaauugagaauugauagauuuggagaugagcuuugcaaag

SEQ ID NO: 750356 - RNA, 64 nt, hsa
acagaggaaugucuuauacuucagcagcccucgguugauagaaagcacaggagauaccuuauga

SEQ ID NO: 750357 - RNA, 64 nt, hsa
augauaguuuguuuugcuauacaguacaucuauauugauagagguucauguuuaaauuauacau

SEQ ID NO: 750358 - RNA, 59 nt, hsa
cugaguuagagaagcaguagcauuugcuuuugauagaaaggacugcaguuugcuuugag

SEQ ID NO: 750359 - RNA, 64 nt, hsa
uaaauuuuauauaaauaaguuauaugaauuuuuauugauagagaguauguaagcuuuuggcauu

SEQ ID NO: 750360 - RNA, 64 nt, hsa
uucaucauagauuucaacguaagugagcuuauuguugauagaaacaugaugaccaugacaaagu

SEQ ID NO: 750361 - RNA, 64 nt, hsa; identical to SEQ ID NO: 746229

SEQ ID NO: 750362 - RNA, 64 nt, hsa; identical to SEQ ID NO: 746230

SEQ ID NO: 750363 - RNA, 64 nt, hsa; identical to SEQ ID NO: 746231

SEQ ID NO: 750364 - RNA, 64 nt, hsa; identical to SEQ ID NO: 746232

SEQ ID NO: 750365 - RNA, 64 nt, hsa; identical to SEQ ID NO: 746233

SEQ ID NO: 750366 - RNA, 64 nt, hsa; identical to SEQ ID NO: 746234

SEQ ID NO: 750367 - RNA, 64 nt, hsa; identical to SEQ ID NO: 746235

SEQ ID NO: 750368 - RNA, 64 nt, hsa; identical to SEQ ID NO: 746236

SEQ ID NO: 750369 - RNA, 64 nt, hsa; identical to SEQ ID NO: 746237

SEQ ID NO: 750370 - RNA, 64 nt, hsa; identical to SEQ ID NO: 746238

SEQ ID NO: 750371 - RNA, 64 nt, hsa; identical to SEQ ID NO: 746239

SEQ ID NO: 750372 - RNA, 64 nt, hsa; identical to SEQ ID NO: 746240

SEQ ID NO: 750373 - RNA, 64 nt, hsa; identical to SEQ ID NO: 746241

SEQ ID NO: 750374 - RNA, 64 nt, hsa; identical to SEQ ID NO: 746242

SEQ ID NO: 750375 - RNA, 64 nt, hsa; identical to SEQ ID NO: 746243

SEQ ID NO: 750376 - RNA, 64 nt, hsa; identical to SEQ ID NO: 746244

SEQ ID NO: 750377 - RNA, 64 nt, hsa; identical to SEQ ID NO: 746245

SEQ ID NO: 750378 - RNA, 64 nt, hsa; identical to SEQ ID NO: 746246

SEQ ID NO: 750379 - RNA, 64 nt, hsa; identical to SEQ ID NO: 746247

SEQ ID NO: 750380 - RNA, 64 nt, hsa; identical to SEQ ID NO: 746248

SEQ ID NO: 750381 - RNA, 64 nt, hsa; identical to SEQ ID NO: 746249

SEQ ID NO: 750382 - RNA, 64 nt, hsa; identical to SEQ ID NO: 746250

SEQ ID NO: 750383 - RNA, 64 nt, hsa; identical to SEQ ID NO: 746251

SEQ ID NO: 750384 - RNA, 64 nt, hsa; identical to SEQ ID NO: 746252

SEQ ID NO: 750385 - RNA, 64 nt, hsa; identical to SEQ ID NO: 746253

SEQ ID NO: 750386 - RNA, 64 nt, hsa; identical to SEQ ID NO: 746254

SEQ ID NO: 750387 - RNA, 64 nt, hsa; identical to SEQ ID NO: 746255

SEQ ID NO: 750388 - RNA, 64 nt, hsa; identical to SEQ ID NO: 746256

SEQ ID NO: 750389 - RNA, 64 nt, hsa; identical to SEQ ID NO: 746257

SEQ ID NO: 750390 - RNA, 64 nt, hsa; identical to SEQ ID NO: 746258

SEQ ID NO: 750391 - RNA, 64 nt, hsa; identical to SEQ ID NO: 746259

SEQ ID NO: 750392 - RNA, 64 nt, hsa; identical to SEQ ID NO: 746260

SEQ ID NO: 750393 - RNA, 64 nt, hsa; identical to SEQ ID NO: 746261

SEQ ID NO: 750394 - RNA, 64 nt, hsa; identical to SEQ ID NO: 746262

SEQ ID NO: 750395 - RNA, 64 nt, hsa; identical to SEQ ID NO: 746263

SEQ ID NO: 750396 - RNA, 64 nt, hsa; identical to SEQ ID NO: 746264

SEQ ID NO: 750397 - RNA, 64 nt, hsa; identical to SEQ ID NO: 746265

SEQ ID NO: 750398 - RNA, 64 nt, hsa; identical to SEQ ID NO: 746266

SEQ ID NO: 750399 - RNA, 64 nt, hsa; identical to SEQ ID NO: 746267

SEQ ID NO: 750400 - RNA, 64 nt, hsa; identical to SEQ ID NO: 746268

SEQ ID NO: 750401 - RNA, 64 nt, hsa; identical to SEQ ID NO: 746269

SEQ ID NO: 750402 - RNA, 60 nt, hsa; identical to SEQ ID NO: 746270

SEQ ID NO: 750403 - RNA, 64 nt, hsa; identical to SEQ ID NO: 746271

SEQ ID NO: 750404 - RNA, 64 nt, hsa; identical to SEQ ID NO: 746272

SEQ ID NO: 750405 - RNA, 64 nt, hsa; identical to SEQ ID NO: 746273

SEQ ID NO: 750406 - RNA, 64 nt, hsa; identical to SEQ ID NO: 746274

SEQ ID NO: 750407 - RNA, 64 nt, hsa; identical to SEQ ID NO: 746275

SEQ ID NO: 750408 - RNA, 64 nt, hsa; identical to SEQ ID NO: 746276

SEQ ID NO: 750409 - RNA, 64 nt, hsa; identical to SEQ ID NO: 746277

SEQ ID NO: 750410 - RNA, 64 nt, hsa; identical to SEQ ID NO: 746278

SEQ ID NO: 750411 - RNA, 64 nt, hsa; identical to SEQ ID NO: 746279

SEQ ID NO: 750412 - RNA, 64 nt, hsa; identical to SEQ ID NO: 746280

SEQ ID NO: 750413 - RNA, 64 nt, hsa; identical to SEQ ID NO: 746281

SEQ ID NO: 750414 - RNA, 64 nt, hsa; identical to SEQ ID NO: 746282

SEQ ID NO: 750415 - RNA, 64 nt, hsa; identical to SEQ ID NO: 746283

SEQ ID NO: 750416 - RNA, 64 nt, hsa; identical to SEQ ID NO: 746284

SEQ ID NO: 750417 - RNA, 64 nt, hsa; identical to SEQ ID NO: 746285

SEQ ID NO: 750418 - RNA, 64 nt, hsa; identical to SEQ ID NO: 746286

SEQ ID NO: 750419 - RNA, 64 nt, hsa; identical to SEQ ID NO: 746287

SEQ ID NO: 750420 - RNA, 64 nt, hsa; identical to SEQ ID NO: 746288

SEQ ID NO: 750421 - RNA, 64 nt, hsa; identical to SEQ ID NO: 746289

SEQ ID NO: 750422 - RNA, 64 nt, hsa; identical to SEQ ID NO: 746290

SEQ ID NO: 750423 - RNA, 64 nt, hsa; identical to SEQ ID NO: 746291

SEQ ID NO: 750424 - RNA, 64 nt, hsa; identical to SEQ ID NO: 746292

SEQ ID NO: 750425 - RNA, 64 nt, hsa; identical to SEQ ID NO: 746293

SEQ ID NO: 750426 - RNA, 64 nt, hsa; identical to SEQ ID NO: 746294

SEQ ID NO: 750427 - RNA, 64 nt, hsa; identical to SEQ ID NO: 746295

SEQ ID NO: 750428 - RNA, 64 nt, hsa; identical to SEQ ID NO: 746296

SEQ ID NO: 750429 - RNA, 64 nt, hsa; identical to SEQ ID NO: 746297

SEQ ID NO: 750430 - RNA, 64 nt, hsa; identical to SEQ ID NO: 746298

SEQ ID NO: 750431 - RNA, 64 nt, hsa; identical to SEQ ID NO: 746299

SEQ ID NO: 750432 - RNA, 64 nt, hsa; identical to SEQ ID NO: 746300

SEQ ID NO: 750433 - RNA, 64 nt, hsa; identical to SEQ ID NO: 746301

SEQ ID NO: 750434 - RNA, 64 nt, hsa; identical to SEQ ID NO: 746302

SEQ ID NO: 750435 - RNA, 56 nt, hsa; identical to SEQ ID NO: 746303

SEQ ID NO: 750436 - RNA, 64 nt, hsa; identical to SEQ ID NO: 746304

SEQ ID NO: 750437 - RNA, 64 nt, hsa; identical to SEQ ID NO: 746305

SEQ ID NO: 750438 - RNA, 64 nt, hsa; identical to SEQ ID NO: 746306

SEQ ID NO: 750439 - RNA, 64 nt, hsa; identical to SEQ ID NO: 746307

SEQ ID NO: 750440 - RNA, 64 nt, hsa; identical to SEQ ID NO: 746308

SEQ ID NO: 750441 - RNA, 64 nt, hsa; identical to SEQ ID NO: 746309

SEQ ID NO: 750442 - RNA, 64 nt, hsa; identical to SEQ ID NO: 746310

SEQ ID NO: 750443 - RNA, 64 nt, hsa; identical to SEQ ID NO: 746311

SEQ ID NO: 750444 - RNA, 64 nt, hsa; identical to SEQ ID NO: 746312

SEQ ID NO: 750445 - RNA, 64 nt, hsa; identical to SEQ ID NO: 746313

SEQ ID NO: 750446 - RNA, 64 nt, hsa; identical to SEQ ID NO: 746314

SEQ ID NO: 750447 - RNA, 64 nt, hsa; identical to SEQ ID NO: 746315

SEQ ID NO: 750448 - RNA, 64 nt, hsa; identical to SEQ ID NO: 746316

SEQ ID NO: 750449 - RNA, 64 nt, hsa; identical to SEQ ID NO: 746317

SEQ ID NO: 750450 - RNA, 64 nt, hsa; identical to SEQ ID NO: 746318

SEQ ID NO: 750451 - RNA, 62 nt, hsa
acaagacaggaagcacggucuuaggcggauggaggccugacgucccuggaguugaaagccca

SEQ ID NO: 750452 - RNA, 62 nt, hsa
uauauuugucaccagauuagagaggcgugucaaggccugaaggagcccaugugguuggauaa

SEQ ID NO: 750453 - RNA, 62 nt, hsa
caugccccacucugcugaggccagaggaagggaggccugaggggcagauugguucaugccug

SEQ ID NO: 750454 - RNA, 62 nt, hsa
augccagugacugcugcgcugugcuggucucuaggccugaacuaggugcuggcaugucuggg

SEQ ID NO: 750455 - RNA, 62 nt, hsa
ccccggacauggcccugccccuaugggacaccaggccugacucaggcagguucugcccccca

SEQ ID NO: 750456 - RNA, 62 nt, hsa
cacggccgccccacgugcugucgcucagcccgaggccugacuucucugggcugaggcugguc

SEQ ID NO: 750457 - RNA, 62 nt, hsa
gcauguccggcugaaggcugaguguccggcugaggccugagcgaguguccagccaagggcug

SEQ ID NO: 750458 - RNA, 62 nt, hsa
cccacacccaggcccgcaccgcugggagucugaggccugagugaguguuuggccgaggccug

SEQ ID NO: 750459 - RNA, 62 nt, hsa
ggcccucggugcccacgccucugcccaucuggaggccugaguaaggaguggcucagccccac

SEQ ID NO: 750460 - RNA, 62 nt, hsa
gugaaccccaugaagcugauggguuugcaggaaggccugaacaugugcacccucccagggac

SEQ ID NO: 750461 - RNA, 62 nt, hsa
gggaggaaacucaaagccgaaagcaaaauuccaggccugauucuggcuuuugagguuccugg

SEQ ID NO: 750462 - RNA, 62 nt, hsa
ucuggcuuuugagguuccugguucuugaagccaggccugacccgacucucagauggggucag

SEQ ID NO: 750463 - RNA, 62 nt, hsa
agaaugccccugaaugggaacucuaggucccaaggccugaaggguugagaacagacagcugu

SEQ ID NO: 750464 - RNA, 62 nt, hsa
gcaguuuauugauuaguccaaaucacaggcuaaggccugaucuccaggagggguaggggaga

SEQ ID NO: 750465 - RNA, 62 nt, hsa
cuggcuaggcucggcggccuuuuccaggcuucaggccugaacaaaacaggcuguuugcugug

SEQ ID NO: 750466 - RNA, 62 nt, hsa
gggagaccugcuggugcccuugcaccagggugaggccugacucacgcugcuuccccccacag

SEQ ID NO: 750467 - RNA, 62 nt, hsa
cuguagagaggccugccuccagggcuggacugaggccugagcgcuccugccgcagagcuggc

SEQ ID NO: 750468 - RNA, 62 nt, hsa
caaccuggggggcagugguguggagaagccacaggccugagauuucaucugcucuccuuccu

SEQ ID NO: 750469 - RNA, 62 nt, hsa
ccaacgccggggcuuugcauggggcccaggggaggccugagcuuggauuuacacuguaauaa

SEQ ID NO: 750470 - RNA, 62 nt, hsa
aaggacacgaggacgucaggaguggucuucacaggccugauggucucccuccucugccuccu

SEQ ID NO: 750471 - RNA, 62 nt, hsa
ugcgccaguccugcuaccucccuugccuuucgaggccugaagccagcugcccuaugggccug

SEQ ID NO: 750472 - RNA, 62 nt, hsa
auuauccuugggggcucccagggcaaggguuaaggccugaaucaugagccugcuggaagccc

SEQ ID NO: 750473 - RNA, 62 nt, hsa
cuuuucucaucaaucacugaugcugaagcugcaggccugagcccuuugucucccuggaugcu

SEQ ID NO: 750474 - RNA, 62 nt, hsa
guccaggguacaggugcgggugguggggaugaaggccugaccagggagggagaagcagguuu

SEQ ID NO: 750475 - RNA, 62 nt, hsa
cccggugggcugaggcaggggccgcugucgucaggccugagccagggugagcuggugccugc

SEQ ID NO: 750476 - RNA, 62 nt, hsa
gccucuggggugcuuggucucugcgaagucaaaggccugacagcucuguggccugggaaucc

SEQ ID NO: 750477 - RNA, 64 nt, hsa; identical to SEQ ID NO: 99218

SEQ ID NO: 750478 - RNA, 64 nt, hsa; identical to SEQ ID NO: 99219

SEQ ID NO: 750479 - RNA, 64 nt, hsa; identical to SEQ ID NO: 99220

SEQ ID NO: 750480 - RNA, 64 nt, hsa; identical to SEQ ID NO: 99221

SEQ ID NO: 750481 - RNA, 64 nt, hsa; identical to SEQ ID NO: 99222

SEQ ID NO: 750482 - RNA, 64 nt, hsa; identical to SEQ ID NO: 99223

SEQ ID NO: 750483 - RNA, 64 nt, hsa; identical to SEQ ID NO: 99224

SEQ ID NO: 750484 - RNA, 64 nt, hsa; identical to SEQ ID NO: 99225

SEQ ID NO: 750485 - RNA, 64 nt, hsa; identical to SEQ ID NO: 99226

SEQ ID NO: 750486 - RNA, 64 nt, hsa; identical to SEQ ID NO: 99227

SEQ ID NO: 750487 - RNA, 64 nt, hsa; identical to SEQ ID NO: 99228

SEQ ID NO: 750488 - RNA, 64 nt, hsa; identical to SEQ ID NO: 99229

SEQ ID NO: 750489 - RNA, 64 nt, hsa; identical to SEQ ID NO: 99230

SEQ ID NO: 750490 - RNA, 64 nt, hsa; identical to SEQ ID NO: 99231

SEQ ID NO: 750491 - RNA, 64 nt, hsa; identical to SEQ ID NO: 99232

SEQ ID NO: 750492 - RNA, 64 nt, hsa; identical to SEQ ID NO: 99233

SEQ ID NO: 750493 - RNA, 64 nt, hsa; identical to SEQ ID NO: 99234

SEQ ID NO: 750494 - RNA, 64 nt, hsa; identical to SEQ ID NO: 99235

SEQ ID NO: 750495 - RNA, 64 nt, hsa; identical to SEQ ID NO: 99236

SEQ ID NO: 750496 - RNA, 64 nt, hsa; identical to SEQ ID NO: 99237

SEQ ID NO: 750497 - RNA, 64 nt, hsa; identical to SEQ ID NO: 99238

SEQ ID NO: 750498 - RNA, 64 nt, hsa; identical to SEQ ID NO: 99239

SEQ ID NO: 750499 - RNA, 64 nt, hsa; identical to SEQ ID NO: 99240

SEQ ID NO: 750500 - RNA, 64 nt, hsa; identical to SEQ ID NO: 99241

SEQ ID NO: 750501 - RNA, 64 nt, hsa; identical to SEQ ID NO: 534582

SEQ ID NO: 750502 - RNA, 64 nt, hsa; identical to SEQ ID NO: 534583

SEQ ID NO: 750503 - RNA, 64 nt, hsa; identical to SEQ ID NO: 534584

SEQ ID NO: 750504 - RNA, 64 nt, hsa; identical to SEQ ID NO: 534585

SEQ ID NO: 750505 - RNA, 64 nt, hsa; identical to SEQ ID NO: 534586

SEQ ID NO: 750506 - RNA, 64 nt, hsa; identical to SEQ ID NO: 534587

SEQ ID NO: 750507 - RNA, 64 nt, hsa; identical to SEQ ID NO: 534588

SEQ ID NO: 750508 - RNA, 64 nt, hsa; identical to SEQ ID NO: 534589

SEQ ID NO: 750509 - RNA, 64 nt, hsa; identical to SEQ ID NO: 534590

SEQ ID NO: 750510 - RNA, 64 nt, hsa; identical to SEQ ID NO: 534591

SEQ ID NO: 750511 - RNA, 64 nt, hsa; identical to SEQ ID NO: 534592

SEQ ID NO: 750512 - RNA, 64 nt, hsa; identical to SEQ ID NO: 534593

SEQ ID NO: 750513 - RNA, 64 nt, hsa; identical to SEQ ID NO: 534594

SEQ ID NO: 750514 - RNA, 64 nt, hsa; identical to SEQ ID NO: 534595

SEQ ID NO: 750515 - RNA, 64 nt, hsa; identical to SEQ ID NO: 534596

SEQ ID NO: 750516 - RNA, 64 nt, hsa; identical to SEQ ID NO: 53255

SEQ ID NO: 750517 - RNA, 64 nt, hsa; identical to SEQ ID NO: 53256

SEQ ID NO: 750518 - RNA, 64 nt, hsa; identical to SEQ ID NO: 53257

SEQ ID NO: 750519 - RNA, 64 nt, hsa; identical to SEQ ID NO: 53258

SEQ ID NO: 750520 - RNA, 64 nt, hsa; identical to SEQ ID NO: 53259

SEQ ID NO: 750521 - RNA, 64 nt, hsa; identical to SEQ ID NO: 53260

SEQ ID NO: 750522 - RNA, 64 nt, hsa; identical to SEQ ID NO: 53261

SEQ ID NO: 750523 - RNA, 64 nt, hsa; identical to SEQ ID NO: 53262

SEQ ID NO: 750524 - RNA, 64 nt, hsa; identical to SEQ ID NO: 53263

SEQ ID NO: 750525 - RNA, 64 nt, hsa; identical to SEQ ID NO: 53264

SEQ ID NO: 750526 - RNA, 64 nt, hsa; identical to SEQ ID NO: 53265

SEQ ID NO: 750527 - RNA, 64 nt, hsa; identical to SEQ ID NO: 53266

SEQ ID NO: 750528 - RNA, 64 nt, hsa; identical to SEQ ID NO: 53267

SEQ ID NO: 750529 - RNA, 64 nt, hsa; identical to SEQ ID NO: 53268

SEQ ID NO: 750530 - RNA, 62 nt, hsa
gugucauuaggauuguugcugccagaacugauaugcaugaauggcacuuaaaauaaauauau

SEQ ID NO: 750531 - RNA, 62 nt, hsa
ccugcuguuucuguugucuuguaugucuguguaugcaugacauuuggucccuuucuuugaaa

SEQ ID NO: 750532 - RNA, 62 nt, hsa
gcucuuguuaaagauuuguuugaauauagaagaugcaugauuucuggguuuuuuuuuuuuuu

SEQ ID NO: 750533 - RNA, 62 nt, hsa
uacaggcauaagccacugcgcccagccagaagaugcaugauuucuuaggaucauaugcuguu

SEQ ID NO: 750534 - RNA, 54 nt, hsa; identical to SEQ ID NO: 102966

SEQ ID NO: 750535 - RNA, 62 nt, hsa
guucuauaaucauauuauaugcacuaaacuauaugcaugaaaguucuuugcauggauuaaug

SEQ ID NO: 750536 - RNA, 62 nt, hsa
caguuuuccuccugcucccagaauguccugugaugcaugauucuaagaacuggaagaaccug

SEQ ID NO: 750537 - RNA, 62 nt, hsa
uccagaugucagaaaagaaagcauacaugcuuaugcaugaaacaauucugcaaaaaaaggau

SEQ ID NO: 750538 - RNA, 62 nt, hsa
ucuguggaagaguaagaacauuaaaaugaaagaugcaugaugaaaaucuaaguagagaggcu

SEQ ID NO: 750539 - RNA, 62 nt, hsa
aggcucuugugguuaacugauaauauugagugaugcaugagguagguguucagaguaauauu

SEQ ID NO: 750540 - RNA, 62 nt, hsa
uucuuaaacaguauaaauaguuguaaguuugcaugcaugauggaaaaauaaaaaccuguauc

SEQ ID NO: 750541 - RNA, 62 nt, hsa
auguucugcagaauggcacuugacugcugggcaugcaugaaguuaagggcaagaaacaguau

SEQ ID NO: 750542 - RNA, 62 nt, hsa
cauaacuaugugggcaaaauagauagaauuaaaugcaugaauuuuccucagacuuauuuuau

SEQ ID NO: 750543 - RNA, 62 nt, hsa
uaauacucugacagaaaaaaaucuuggauaauaugcaugagaaaaauccuucaauaaacaca

SEQ ID NO: 750544 - RNA, 62 nt, hsa
aaucuucuuuuauuucuaggcuguacagucugaugcaugauuuuuuuauaaauauuucauac

SEQ ID NO: 750545 - RNA, 62 nt, hsa
cagaugcuuuuuuuuucuucuuaccaucauuuaugcaugacauagguaaugugacuaauuuc

SEQ ID NO: 750546 - RNA, 62 nt, hsa
aguagaaggaauuuccagauauuggaaacaguaugcaugaagacaugaaggcaagaaacagc

SEQ ID NO: 750547 - RNA, 62 nt, hsa
uuaaaaguuaaguccauucuaauuacccaaauaugcaugaauucauucuccuuuugagaagu

SEQ ID NO: 750548 - RNA, 65 nt, hsa; identical to SEQ ID NO: 489615

SEQ ID NO: 750549 - RNA, 65 nt, hsa; identical to SEQ ID NO: 489616

SEQ ID NO: 750550 - RNA, 65 nt, hsa; identical to SEQ ID NO: 489617

SEQ ID NO: 750551 - RNA, 65 nt, hsa; identical to SEQ ID NO: 489618

SEQ ID NO: 750552 - RNA, 65 nt, hsa; identical to SEQ ID NO: 489619

SEQ ID NO: 750553 - RNA, 65 nt, hsa; identical to SEQ ID NO: 489625

SEQ ID NO: 750554 - RNA, 65 nt, hsa; identical to SEQ ID NO: 489626

SEQ ID NO: 750555 - RNA, 65 nt, hsa; identical to SEQ ID NO: 489658

SEQ ID NO: 750556 - RNA, 65 nt, hsa; identical to SEQ ID NO: 489659

SEQ ID NO: 750557 - RNA, 65 nt, hsa; identical to SEQ ID NO: 489665

SEQ ID NO: 750558 - RNA, 65 nt, hsa; identical to SEQ ID NO: 489666

SEQ ID NO: 750559 - RNA, 65 nt, hsa; identical to SEQ ID NO: 489682

SEQ ID NO: 750560 - RNA, 65 nt, hsa; identical to SEQ ID NO: 489683

SEQ ID NO: 750561 - RNA, 65 nt, hsa; identical to SEQ ID NO: 489692

SEQ ID NO: 750562 - RNA, 65 nt, hsa; identical to SEQ ID NO: 489693

SEQ ID NO: 750563 - RNA, 65 nt, hsa; identical to SEQ ID NO: 489712

SEQ ID NO: 750564 - RNA, 65 nt, hsa; identical to SEQ ID NO: 489713

SEQ ID NO: 750565 - RNA, 65 nt, hsa; identical to SEQ ID NO: 489714

SEQ ID NO: 750566 - RNA, 65 nt, hsa; identical to SEQ ID NO: 489715

SEQ ID NO: 750567 - RNA, 65 nt, hsa; identical to SEQ ID NO: 489731

SEQ ID NO: 750568 - RNA, 65 nt, hsa; identical to SEQ ID NO: 489732

SEQ ID NO: 750569 - RNA, 65 nt, hsa; identical to SEQ ID NO: 489745

SEQ ID NO: 750570 - RNA, 65 nt, hsa; identical to SEQ ID NO: 489746

SEQ ID NO: 750571 - RNA, 65 nt, hsa; identical to SEQ ID NO: 489754

SEQ ID NO: 750572 - RNA, 65 nt, hsa; identical to SEQ ID NO: 489755

SEQ ID NO: 750573 - RNA, 65 nt, hsa; identical to SEQ ID NO: 489756

SEQ ID NO: 750574 - RNA, 65 nt, hsa; identical to SEQ ID NO: 489760

SEQ ID NO: 750575 - RNA, 65 nt, hsa; identical to SEQ ID NO: 489761

SEQ ID NO: 750576 - RNA, 65 nt, hsa; identical to SEQ ID NO: 489762

SEQ ID NO: 750577 - RNA, 65 nt, hsa; identical to SEQ ID NO: 489777

SEQ ID NO: 750578 - RNA, 65 nt, hsa; identical to SEQ ID NO: 489778

SEQ ID NO: 750579 - RNA, 65 nt, hsa; identical to SEQ ID NO: 489781

SEQ ID NO: 750580 - RNA, 65 nt, hsa; identical to SEQ ID NO: 489782

SEQ ID NO: 750581 - RNA, 65 nt, hsa; identical to SEQ ID NO: 489849

SEQ ID NO: 750582 - RNA, 65 nt, hsa; identical to SEQ ID NO: 489850

SEQ ID NO: 750583 - RNA, 65 nt, hsa; identical to SEQ ID NO: 489855

SEQ ID NO: 750584 - RNA, 65 nt, hsa; identical to SEQ ID NO: 489856

SEQ ID NO: 750585 - RNA, 65 nt, hsa; identical to SEQ ID NO: 489893

SEQ ID NO: 750586 - RNA, 65 nt, hsa; identical to SEQ ID NO: 489894

SEQ ID NO: 750587 - RNA, 65 nt, hsa; identical to SEQ ID NO: 489898

SEQ ID NO: 750588 - RNA, 65 nt, hsa; identical to SEQ ID NO: 489899

SEQ ID NO: 750589 - RNA, 65 nt, hsa; identical to SEQ ID NO: 489914

SEQ ID NO: 750590 - RNA, 65 nt, hsa; identical to SEQ ID NO: 489915

SEQ ID NO: 750591 - RNA, 65 nt, hsa; identical to SEQ ID NO: 489918

SEQ ID NO: 750592 - RNA, 65 nt, hsa; identical to SEQ ID NO: 489919

SEQ ID NO: 750593 - RNA, 65 nt, hsa; identical to SEQ ID NO: 489925

SEQ ID NO: 750594 - RNA, 65 nt, hsa; identical to SEQ ID NO: 489926

SEQ ID NO: 750595 - RNA, 65 nt, hsa; identical to SEQ ID NO: 489956

SEQ ID NO: 750596 - RNA, 65 nt, hsa; identical to SEQ ID NO: 489957

SEQ ID NO: 750597 - RNA, 65 nt, hsa; identical to SEQ ID NO: 490016

SEQ ID NO: 750598 - RNA, 65 nt, hsa; identical to SEQ ID NO: 490017

SEQ ID NO: 750599 - RNA, 65 nt, hsa; identical to SEQ ID NO: 490087

SEQ ID NO: 750600 - RNA, 65 nt, hsa; identical to SEQ ID NO: 490088

SEQ ID NO: 750601 - RNA, 65 nt, hsa; identical to SEQ ID NO: 490090

SEQ ID NO: 750602 - RNA, 65 nt, hsa; identical to SEQ ID NO: 490091

SEQ ID NO: 750603 - RNA, 65 nt, hsa; identical to SEQ ID NO: 490105

SEQ ID NO: 750604 - RNA, 65 nt, hsa; identical to SEQ ID NO: 490106

SEQ ID NO: 750605 - RNA, 62 nt, hsa
uaggaacaagacucccaaauccaugaaaacgcuuagugaauauauucuuaaucauuaauaaa

SEQ ID NO: 750606 - RNA, 62 nt, hsa
agaauuuguuuaacugguacuuuuauuauuuuuuagugaaagacuuuugaaaagugcccuuu

SEQ ID NO: 750607 - RNA, 62 nt, hsa
gaguauaagaaugcuuugaacaauuuguagacuuagugaaauaaaauaagaggaaagccaaa

SEQ ID NO: 750608 - RNA, 62 nt, hsa
aauacauaauuucucauguauucguguauccauuagugaauaguucaagucuguuuaagagu

SEQ ID NO: 750609 - RNA, 62 nt, hsa
uaggacucuagacaaaaccuucuauuuuagcuuuagugaauuucaaaaguaaugggucuugg

SEQ ID NO: 750610 - RNA, 62 nt, hsa
cuaaaauuuguaauuugcuaacuugauuugaguuagugaaaacugguacaguguucugcuug

SEQ ID NO: 750611 - RNA, 62 nt, hsa
cugggguuuuguaaccucugaaugauauggacuuagugaauucuaaggaacucagggggcac

SEQ ID NO: 750612 - RNA, 62 nt, hsa
caaagaaaaaucuugaacauuuaugaugucaauuagugaaaguauugaaaauacuaaauuau

SEQ ID NO: 750613 - RNA, 62 nt, hsa
gcuuugcuuuaucaguucauuccagcucccuguuagugaaggacacugcuguuagugaagga

SEQ ID NO: 750614 - RNA, 62 nt, hsa
uuccagcucccuguuagugaaggacacugcuguuagugaaggaacaaagucuaugaguccua

SEQ ID NO: 750615 - RNA, 62 nt, hsa
auacucacuuuauauguauguuucuaaaagcuuuagugaaggcugaauccaaguuucaugua

SEQ ID NO: 750616 - RNA, 62 nt, hsa
uaguguuaaguguauuuuuuucaacuaauuuuuuagugaauuuuuuuuaaacuuacagcaug

SEQ ID NO: 750617 - RNA, 62 nt, hsa
augugagagacaucucaucugcuguauuuuacuuagugaauauuguucacucuuccgugucu

SEQ ID NO: 750618 - RNA, 62 nt, hsa
guuuuaauuacaguuccauuagugccuguagauuagugaacagaaaauugcuuuggaagaga

SEQ ID NO: 750619 - RNA, 62 nt, hsa
uuagguucugugaauuuucugugcacacugaauuagugaaugcugaaugauuguugcuaggg

SEQ ID NO: 750620 - RNA, 62 nt, hsa
uacaggaaggccuauuacaaguguguuugucuuuagugaacucauaguggugacauaccuuu

SEQ ID NO: 750621 - RNA, 62 nt, hsa
auaauccucaguuuuugugaaaagcuccauuuuuagugaaauauuauuuuauagcuacuaau

SEQ ID NO: 750622 - RNA, 62 nt, hsa
uuguguauggguguuggugaacuugguuuuaauuagugaacugcugagagacagagcuauuc

SEQ ID NO: 750623 - RNA, 64 nt, hsa; identical to SEQ ID NO: 417300

SEQ ID NO: 750624 - RNA, 64 nt, hsa; identical to SEQ ID NO: 417301

SEQ ID NO: 750625 - RNA, 64 nt, hsa; identical to SEQ ID NO: 417302

SEQ ID NO: 750626 - RNA, 64 nt, hsa; identical to SEQ ID NO: 417303

SEQ ID NO: 750627 - RNA, 64 nt, hsa; identical to SEQ ID NO: 417304

SEQ ID NO: 750628 - RNA, 64 nt, hsa; identical to SEQ ID NO: 417305

SEQ ID NO: 750629 - RNA, 64 nt, hsa; identical to SEQ ID NO: 417306

SEQ ID NO: 750630 - RNA, 64 nt, hsa; identical to SEQ ID NO: 417307

SEQ ID NO: 750631 - RNA, 62 nt, hsa
caaacaaacaugauugauagcuggacagacaugcucgucaugaaaaaagaaccauuucugaa

SEQ ID NO: 750632 - RNA, 62 nt, hsa
gcuaggaucucuaacaaacgcagaaggcuuuggcucgucauuuccucuuaaaaaggaggagc

SEQ ID NO: 750633 - RNA, 62 nt, hsa
uuccucuucggcaagaggagcuuuuccagcgcgcucgucauuuccggacucucugcugcgga

SEQ ID NO: 750634 - RNA, 62 nt, hsa
aaugagcucaccauggaugaugauaccgccgugcucgucauugacaacggcucuggcaugug

SEQ ID NO: 750635 - RNA, 62 nt, hsa
gcuguagaugcugggcccagggcccuagguuugcucgucacaguguggggaagcccauuccu

SEQ ID NO: 750636 - RNA, 62 nt, hsa
ugacaccaaaaugaaccuugcuaucaagaaaugcucgucauacaguaaacucuggaugauuc

SEQ ID NO: 750637 - RNA, 62 nt, hsa
auggaugucgagggugguuuguguggagcugugcucgucagcugggucugcccucuuccccc

SEQ ID NO: 750638 - RNA, 62 nt, hsa
ccacguuuuugacaagccagcauauugccaaugcucgucaaagacauuuauguuucuuuuac

SEQ ID NO: 750639 - RNA, 62 nt, hsa
auggucacauuggcgccuagaacaguuaggucgcucgucacauaggcaguuaaguggagaac

SEQ ID NO: 750640 - RNA, 62 nt, hsa
auggggugccaguuugaaugcagucuguccaggcucgucauuggaggugaacaagcaaaccc

SEQ ID NO: 750641 - RNA, 62 nt, hsa
aacgccuacauuuaauuccugguaagagcagugcucgucaaguuucugguuuuucucugcuc

SEQ ID NO: 750642 - RNA, 62 nt, hsa
ggagcugcugcugaagggacuuguagggagaggcucgucaacaagcacuguucuggaaccuu

SEQ ID NO: 750643 - RNA, 62 nt, hsa
aaugagcucaccauggaugaugauacugccgugcucgucauugacaacggcucuggcaugug

SEQ ID NO: 750644 - RNA, 62 nt, hsa; identical to SEQ ID NO: 750643

SEQ ID NO: 750645 - RNA, 62 nt, hsa
agcgcaggcagcgcagggcuggcacgugacaggcucgucagccaccugggaacacaguucug

SEQ ID NO: 750646 - RNA, 62 nt, hsa
ggggaccucucugagcaggcucucgugaaucagcucgucaucagauggcuuuggugcauggc

SEQ ID NO: 750647 - RNA, 62 nt, hsa
gggcuuccuguguguagcccuggcauagacuugcucgucaggguguucgacucugggaugcu

SEQ ID NO: 750648 - RNA, 62 nt, hsa
cuuggggcgugguuccuguggaccccagcucagcucgucaagcugcaggggcggggcuccug

SEQ ID NO: 750649 - RNA, 62 nt, hsa
uuaaagauaauuaaaaaugaaacaaagugagugcucgucacuggguucaucagagcagugug

SEQ ID NO: 750650 - RNA, 62 nt, hsa
acccccagcugcuugugucccuccugggaucugcucgucaucauuuuuccuucccuucucca

SEQ ID NO: 750651 - RNA, 62 nt, hsa
cacuuuuuuuuuuuuuuuugagauggaauuuugcucgucacccaggcuggagugcaauugug

SEQ ID NO: 750652 - RNA, 53 nt, hsa
agaggcaaguguuggccugagacgcucgucaguucuuagaucuugggggccua

SEQ ID NO: 750653 - RNA, 62 nt, hsa
guggcuguugauuaauuugacugcuucucguugcucgucaccuccaugccaggcacugugcu

SEQ ID NO: 750654 - RNA, 62 nt, hsa
ggcacaaacuuccugagccucugaaaugggaggcucgucaauuucagaccaaccucuuuuca

SEQ ID NO: 750655 - RNA, 62 nt, hsa
ggccuagugaaggguuugugugcccagugucugcucgucaucuguggcugcaggggucagac

SEQ ID NO: 750656 - RNA, 62 nt, hsa
ucugcuucccccauucccuuccacagcucauagcucgucaucucggcccuuguccacacucu

SEQ ID NO: 750657 - RNA, 64 nt, hsa; identical to SEQ ID NO: 173300

SEQ ID NO: 750658 - RNA, 64 nt, hsa; identical to SEQ ID NO: 173301

SEQ ID NO: 750659 - RNA, 64 nt, hsa; identical to SEQ ID NO: 173302

SEQ ID NO: 750660 - RNA, 64 nt, hsa; identical to SEQ ID NO: 173303

SEQ ID NO: 750661 - RNA, 64 nt, hsa; identical to SEQ ID NO: 173304

SEQ ID NO: 750662 - RNA, 64 nt, hsa; identical to SEQ ID NO: 173305

SEQ ID NO: 750663 - RNA, 64 nt, hsa; identical to SEQ ID NO: 173306

SEQ ID NO: 750664 - RNA, 64 nt, hsa; identical to SEQ ID NO: 173307

SEQ ID NO: 750665 - RNA, 62 nt, hsa
cucuuccauuuugcagauaagucaaauaaucaacacuaaaggaggcuaaacuguugaugaau

SEQ ID NO: 750666 - RNA, 62 nt, hsa
agauuaauauggccaacccuguacacaucacuacacuaaacacugcucuagauaaacugcuc

SEQ ID NO: 750667 - RNA, 62 nt, hsa
auuuaauggccaaaugguuuuugcaagauuuaacacuaaaaagguuucaccugaucauauag

SEQ ID NO: 750668 - RNA, 62 nt, hsa
uaaguaaaccaaaaaggcuaguuuauuuuguuacacuaaagggcaggugguucuaauauuuu

SEQ ID NO: 750669 - RNA, 62 nt, hsa
gaacaaauuuucgguuacagaucagcucucaaacacuaaaguccuuaauggcaaggucuuuu

SEQ ID NO: 750670 - RNA, 62 nt, hsa
aaccagaggacauacuagucacauguuauuauacacuaaaaaauaggaagucaucuugaaag

SEQ ID NO: 750671 - RNA, 62 nt, hsa
gucucauuuugcaguaacuccuacaguguguaacacuaaaaauaagaacuaaugauggcuaa

SEQ ID NO: 750672 - RNA, 62 nt, hsa
uaacacuaaaaauaagaacuaaugauggcuaaacacuaaaguagccauucauacuuaugcau

SEQ ID NO: 750673 - RNA, 62 nt, hsa
cuuuuaaaagacacuaaauuguacucuaaaagacacuaaauuguacuaauuguacaaagguc

SEQ ID NO: 750674 - RNA, 62 nt, hsa
aauguuuuaaauauuuaggaagcuuuuaaaagacacuaaauuguacucuaaaagacacuaaa

SEQ ID NO: 750675 - RNA, 62 nt, hsa
auugaaacuucaucuagucucuuaauuuuuuaacacuaaauucaagucauuuguuuuaaguc

SEQ ID NO: 750676 - RNA, 62 nt, hsa
uccauucauaugcauggggucugaucgcaaauacacuaaauguggaguguaggaaccaaaau

SEQ ID NO: 750677 - RNA, 62 nt, hsa
gauagagcuacaaacucagcuguacaguucguacacuaaacucuucuugcuuuugcauuaua

SEQ ID NO: 750678 - RNA, 62 nt, hsa
ugcguuccuaauuuaguaaaauaaaagaauagacacuaaaaucauguugaucuauaauuaca

SEQ ID NO: 750679 - RNA, 62 nt, hsa
agcuaaagaugagaggggcucaguuuuacgcaacacuaaauucuagaaaguacuuuggccuc

SEQ ID NO: 750680 - RNA, 62 nt, hsa
gccauaugacaagccuuugugcucuauagcagacacuaaagacuggguuacauaugccucca

SEQ ID NO: 750681 - RNA, 62 nt, hsa
uauacauacauacaaacauaggcuaucuuggcacacuaaaugcuaagcacugucuuaagagg

SEQ ID NO: 750682 - RNA, 62 nt, hsa
gauuugaaguuuggggcuaugcaugaaacccaacacuaaauuuugcaagucaaguaaccaaa

SEQ ID NO: 750683 - RNA, 62 nt, hsa
uaacauuuucagagauacagcuucuuauaguaacacuaaaacuuucuuccucuuuggacuga

SEQ ID NO: 750684 - RNA, 62 nt, hsa
auucugcugacaaaaaauuuuaagccaguuuuacacuaaauguuccucagucugauuaauuu

SEQ ID NO: 750685 - RNA, 62 nt, hsa
ggugacauggugacaucuaucccuuuauuuugacacuaaaacauggacacaacuagaaagag

SEQ ID NO: 750686 - RNA, 62 nt, hsa
gaaaguauuuguuaauuaucugcuuaguauuaacacuaaauuuguagaaugacuuucagguu

SEQ ID NO: 750687 - RNA, 62 nt, hsa
agcuaaaauggcuuaacaucaugcuacacuuuacacuaaaaaucuauuacugugaguggucu

SEQ ID NO: 750688 - RNA, 62 nt, hsa
aucugagggaaaacauguucagggcuucuagaacacuaaaaaauuuggcuuaaaccaguguu

SEQ ID NO: 750689 - RNA, 64 nt, hsa
uaugaacaaugggcacgggguuuucagccacaguucccucgaggccaguguucagcaggaucau

SEQ ID NO: 750690 - RNA, 64 nt, hsa
ggucugugaggaccaauuuguggguaguucaucuucccucgauugguuaacuccuuaguuucag

SEQ ID NO: 750691 - RNA, 64 nt, hsa
ggcaagcccugggaccaagagcucucccgccuucucccucgagcagcagcaaggacccugacgc

SEQ ID NO: 750692 - RNA, 64 nt, hsa
gggcuguggccccgcggcgccgccuccucccuggucccucgaaaucguggcaucucacuucuga

SEQ ID NO: 750693 - RNA, 64 nt, hsa
gaggugcccgccaggaucuguggcccuguaacauucccucgaucuugucuucccguuccucccc

SEQ ID NO: 750694 - RNA, 64 nt, hsa
aguccuucccugcuggcagucucuucucguuggcucccucgaccugcuaucuccucugaaagcc

SEQ ID NO: 750695 - RNA, 64 nt, hsa
cugcaguccaguuuugugaugcugcuuuuacgugucccucgauaacagucagcuagacacacuc

SEQ ID NO: 750696 - RNA, 64 nt, hsa
cuaaucccucggcccaugccuccugccucuccccucccucgaugucagcauucgguucuucugu

SEQ ID NO: 750697 - RNA, 64 nt, hsa
caggagcuguccuugcugcaugcccugucacaguucccucgacucuuucaaagcuucacaucug

SEQ ID NO: 750698 - RNA, 64 nt, hsa
cuguccucauuugcauuccaagaagagcauguccucccucgagaaacagugccgccggugugau

SEQ ID NO: 750699 - RNA, 64 nt, hsa
caccacgcaugcucagugccuuuugguuucaccuucccucgacuugacccuuuccucccccagc

SEQ ID NO: 750700 - RNA, 53 nt, hsa
aagaggagccgccccuguagcacucccucgaagcugcuguucucuugucuguc

SEQ ID NO: 750701 - RNA, 64 nt, hsa
acccaacgugaugcuaugcaugucugaccgacgaucccucgaccagaaucagauucaggagcuc

SEQ ID NO: 750702 - RNA, 64 nt, hsa
uccagagaaaaaacugccuuucccuucaaagugcucccucgagguuccuuagugaguuuuguac

SEQ ID NO: 750703 - RNA, 64 nt, hsa
uuccgaggucugcguuugcaucccugucguguucucccucgagggguccuuccccagccugugg

SEQ ID NO: 750704 - RNA, 64 nt, hsa
ccuagccccccuugccccuuauuucuucccugcuucccucgaacccagagauuuuugagggaug

SEQ ID NO: 750705 - RNA, 64 nt, hsa
gcccucugaaauacucucccuccucucagagcccucccucgagagccugagugcaccaugucuu

SEQ ID NO: 750706 - RNA, 64 nt, hsa
uuccugucauuaagcaucucagaggaagcagcccucccucgauggccucuagcccagagaagcc

SEQ ID NO: 750707 - RNA, 64 nt, hsa
augggcagaccccucccuuccugggcugaccugcucccucgaggccagccugcucccuggcuga

SEQ ID NO: 750708 - RNA, 64 nt, hsa
gcugucuucucuuucuccaaucaagaaauaauaaucccucgaguuuacaaaacacuuccaaguc

SEQ ID NO: 750709 - RNA, 64 nt, hsa
ggcuccaaggugacuucuggugacagccagaucaucccucgaguccccagcgagaaagaaagca

SEQ ID NO: 750710 - RNA, 64 nt, hsa
agccccgaauuugauaguguauaaggugcuuuauucccucgaauguccauuaagcauggaauuu

SEQ ID NO: 750711 - RNA, 64 nt, hsa
uuauguugcagacuauucagacuaugaagacaguucccucgaauuuuuggaaaggugcucuucu

SEQ ID NO: 750712 - RNA, 64 nt, hsa
acaugcuuguauauagguuuuaucucugguugaaucccucgaacaauagacaguaccuuucccc

SEQ ID NO: 750713 - RNA, 57 nt, hsa
uccuagcuggaaugaucugacugcaccucccucgagcuggcucccagggcacccccg

SEQ ID NO: 750714 - RNA, 64 nt, hsa
cccacagccuggcgccagggcucacagcugccccucccucgagacuggccagcccaccucuccc

SEQ ID NO: 750715 - RNA, 64 nt, hsa
cuuugucuggagucacugggggcuuccgagggucucccucgacccucugucguccugggauggc

SEQ ID NO: 750716 - RNA, 64 nt, hsa
gcucggcaaggcaagcaagacacaccagagcucuucccucgaugccagccauucaucgacaguc

SEQ ID NO: 750717 - RNA, 64 nt, hsa
auacacagauuucaccugggagaaccucuuuuucucccucgacucuuccuacguaaacucccac

SEQ ID NO: 750718 - RNA, 64 nt, hsa
cugggccucugccccucccaacccagcccucgucucccucgacagcgccccugcugucuucccc

SEQ ID NO: 750719 - RNA, 64 nt, hsa
cuauuagucaguucuuuuauaugcugauaaaugaucccucgaguucaguuaguauucuguccag

SEQ ID NO: 750720 - RNA, 64 nt, hsa
cccaggcugccugcuacgaagcuccucaucugccucccucgaaucaagugcuacauccaauaau

SEQ ID NO: 750721 - RNA, 64 nt, hsa
gcuugcccagcugcugccugggcccccauucugcucccucgagguugcuggacaagcugcugca

SEQ ID NO: 750722 - RNA, 64 nt, hsa
cagucuaccccucuccuuucacuccuuuccucccucccucgauccccccauuuucucuauucuu

SEQ ID NO: 750723 - RNA, 64 nt, hsa
cgggcuguguaaacacagucaaaauaauucuaaaucccucgauauuuuuaaagaucuguaagua

SEQ ID NO: 750724 - RNA, 64 nt, hsa
aucgcauagaguucagagacuggaaacugaauuuucccucgacuuucacuuuguggguaaauca

SEQ ID NO: 750725 - RNA, 64 nt, hsa
cuuuugcaguugcgucugggaaggggccccggacucccucgagagaaugugcuagagacagccc

SEQ ID NO: 750726 - RNA, 64 nt, hsa
ccuuagcuuugccaaagcaacggccaccccgcacucccucgagacagagaaacggaacccacac

SEQ ID NO: 750727 - RNA, 64 nt, hsa
aacuugaccggcagaauguucugccguuuucugcucccucgacacuugauuggagggcugucga

SEQ ID NO: 750728 - RNA, 64 nt, hsa
uccugucugcccucugggucccuccucucaccucucccucgaucauauuuccccuuggacacuu

SEQ ID NO: 750729 - RNA, 64 nt, hsa
aaucucagcauuuggggaggcaaagguggaaguaucccucgaggccaagaguucaugaccagcc

SEQ ID NO: 750730 - RNA, 64 nt, hsa
ucuaagggguacuccucucauccccuuauccuucucccucgacauuuucucccucuuucuuccc

SEQ ID NO: 750731 - RNA, 64 nt, hsa
uuggcgccgagagccccugcacucaaggccacauucccucgacaacggcugcacgggcuguccg

SEQ ID NO: 750732 - RNA, 64 nt, hsa
gucaggaggcaggguuuuaucucugucuaccaucucccucgaacccacacugcaacaggaacug

SEQ ID NO: 750733 - RNA, 64 nt, hsa
ccacucaccaccauuccuuggccagccuuuugccucccucgauacucaacaaagagaagcaaag

SEQ ID NO: 750734 - RNA, 64 nt, hsa
gugcuuuggccuuugcgcugucccggggccagcuucccucgaccuggggaggccguggccugug

SEQ ID NO: 750735 - RNA, 64 nt, hsa
ggaacccccuccuccucccuggagucugccugagucccucgagccgcgagccuucgcugaagug

SEQ ID NO: 750736 - RNA, 64 nt, hsa
ccgcccccguuagcgucauaaaguccagcuugucucccucgauccaaaggccguuuucucgagg

SEQ ID NO: 750737 - RNA, 64 nt, hsa
cagaaggggcucccuguccggcccacgugcccuuucccucgacgacagucgagggcucgggcuc

SEQ ID NO: 750738 - RNA, 64 nt, hsa
aaccgggccgggcacagcguggcuacagagggucucccucgaugacgacgacgacgacgccacc

SEQ ID NO: 750739 - RNA, 64 nt, hsa
ggaaugaggccugcuccucuuguaaauacccccuucccucgaagcucccucccggugcuggggg

SEQ ID NO: 750740 - RNA, 64 nt, hsa
gggcagacgcacuguugaaucugguagccaggguucccucgaacuugggggaucuuuuuaaaag

SEQ ID NO: 750741 - RNA, 64 nt, hsa
gugcuuuaggcccaggcgggggucguggccucguucccucgacaccuccguccugcucucgccu

SEQ ID NO: 750742 - RNA, 64 nt, hsa
aguccuuuccucucugccugcccuuuccugucccucccucgaauucucucuccccguaagugau

SEQ ID NO: 750743 - RNA, 64 nt, hsa
ccagugcaguagugccaaaaggccccuucccacgucccucgagcucuguagccuggucugugca

SEQ ID NO: 750744 - RNA, 64 nt, hsa
ccuccacaccuggcccaugcuggguuuuugugcaucccucgacagcuuccaaugucagccugcu

SEQ ID NO: 750745 - RNA, 64 nt, hsa
acucugucuucagcucgggccccuccguucugucucccucgacuccaagucaggaauaccgugg

SEQ ID NO: 750746 - RNA, 64 nt, hsa
cccgcggccgcgauccggaccccaagcccacggcucccucgacucuggggcacggaaccccgcc

SEQ ID NO: 750747 - RNA, 64 nt, hsa
ggccacuauggcugcugugguuugaauauuuuuuucccucgaaaacucauguugaaacuuaacu

SEQ ID NO: 750748 - RNA, 63 nt, hsa
gggacuccucccuggggguggggcuccuaccugggggcagaacuccuaccugaaggcagggcu

SEQ ID NO: 750749 - RNA, 63 nt, hsa
ggguuuuaugguggaugaggcuucuuccuggauggggcagagcuucuccugaccagggcaagg

SEQ ID NO: 750750 - RNA, 63 nt, hsa
auagcuugggucccuuuuccugcaaggccccauggggcagaauauaauaaauauucugaguga

SEQ ID NO: 750751 - RNA, 63 nt, hsa
ugucucuacucccucucuuggaucuggggaggaggggcagagaccugggacucuguauuucua

SEQ ID NO: 750752 - RNA, 63 nt, hsa
gggcugcuggggcuaaagugccuugcugaaggaggggcagaguuaaacauuagccacaauggc

SEQ ID NO: 750753 - RNA, 63 nt, hsa
acucaacacaccuaagccaguggcccucuaggaggggcagaagagccaaccagaggguuccug

SEQ ID NO: 750754 - RNA, 63 nt, hsa
ggggaagggggacaagggucagucugucgggugggggcagaaaucaaaucagcccaaggauau

SEQ ID NO: 750755 - RNA, 63 nt, hsa
uccuguauucaggcagcucagagcagaaaguaaggggcagagucauacguguggccaggaagu

SEQ ID NO: 750756 - RNA, 63 nt, hsa
aaauaaacacauuucuaacaauacaagggaguaggggcagaccuguguugaguauuugugugg

SEQ ID NO: 750757 - RNA, 63 nt, hsa
gaguacauacugaucuuucauaauccauucagaggggcagauugagaauguuuuacacaugcu

SEQ ID NO: 750758 - RNA, 63 nt, hsa
ggucauacugccaaucuuuagacaaauggccauggggcagaggacaggggagcugagguuggu

SEQ ID NO: 750759 - RNA, 63 nt, hsa
acuuuugcacuucuccaagugcaggucacaccaggggcagacccugucgcugcguuucugaac

SEQ ID NO: 750760 - RNA, 63 nt, hsa
uuuuagguguaaaagauggagucccacggaggaggggcagagccaggaggcaguggggcugug

SEQ ID NO: 750761 - RNA, 63 nt, hsa
ccuggguacccugguggggaugcagggaaggccggggcagagaaagugaaggucgacccaggg

SEQ ID NO: 750762 - RNA, 63 nt, hsa
gcuucucaguuuugcuaacagugggagcucaacggggcagagggaggaagguccaugaugcuc

SEQ ID NO: 750763 - RNA, 63 nt, hsa
gugcucugguuuccucagcaacacuccuuguaaggggcagagacaggguccaccaacucccca

SEQ ID NO: 750764 - RNA, 63 nt, hsa
uagcaggcagcugggcauggaggugcuggggcuggggcagaugccuaauuucgcacaaugcau

SEQ ID NO: 750765 - RNA, 63 nt, hsa
cagccuacagccagaacuucugagcauccucucggggcagacccuccccguccucguggagcu

SEQ ID NO: 750766 - RNA, 63 nt, hsa
gcagcagccuggcugccuugucauggccuccugggggcagaaggcgauguggaccacgggauu

SEQ ID NO: 750767 - RNA, 63 nt, hsa
ccuuaggccacccuccucaugcccacccagcaaggggcagaggccacaggccuggaacccugg

SEQ ID NO: 750768 - RNA, 63 nt, hsa
uaaccugucaggcuggcuugguuagguuuuacuggggcagaggauagggaaucucuuauuaaa

SEQ ID NO: 750769 - RNA, 63 nt, hsa
cagcugcugaaauuagcuacucaccaagagugaggggcagagacuuccagucacugagucucc

SEQ ID NO: 750770 - RNA, 63 nt, hsa
ucaggagguuggggcagaauugcuugaacccagggggcagagguugcagugagccgagauugc

SEQ ID NO: 750771 - RNA, 63 nt, hsa
ccugugccuguaaacccagcuacucaggagguuggggcagaauugcuugaacccagggggcag

SEQ ID NO: 750772 - RNA, 63 nt, hsa
gcauugcucuaccucucccugacauuuugcuccggggcagauccaaccuuaccuggggcagca

SEQ ID NO: 750773 - RNA, 63 nt, hsa
ucuggaccaguagcccaucccgcaguuuucuugggggcagaggaaaacgcuucuuucuccucc

SEQ ID NO: 750774 - RNA, 63 nt, hsa
uagccgugcaugcacuuuguggccccuuugcaaggggcagaggguacuggaagugggaggagg

SEQ ID NO: 750775 - RNA, 63 nt, hsa
aaauauucuucugggcucaaaagcuagcuugagggggcagaugccccaggugucccagcucca

SEQ ID NO: 750776 - RNA, 63 nt, hsa
uuuuccucuuuugugagaagaugggggcuggagggggcagaguggccugugagcaagagccag

SEQ ID NO: 750777 - RNA, 63 nt, hsa
gcaagagccaggggugucccagucccagccucuggggcagagcuuguagcccuggauggccuc

SEQ ID NO: 750778 - RNA, 57 nt, hsa; identical to SEQ ID NO: 111335

SEQ ID NO: 750779 - RNA, 63 nt, hsa
auaagagauauggagaugggagggggaggacaaggggcagagaguagggucuagcuggcuauc

SEQ ID NO: 750780 - RNA, 63 nt, hsa
agaggcagguccuaaaggagggggggucuccugggggcagaccgagggucucggaggauagaa

SEQ ID NO: 750781 - RNA, 63 nt, hsa
acuuggcaagcggcugggccugacggaggccgaggggcagaccggggcuccagccagaccccu

SEQ ID NO: 750782 - RNA, 63 nt, hsa
ccuccaaucccaccggacccaggcccugggcuaggggcagagcaggccccgccccagggcaau

SEQ ID NO: 750783 - RNA, 63 nt, hsa
uauuuauuccccuuuagguuugcagaggggguaggggcagagucaggggcuggccagaggguc

SEQ ID NO: 750784 - RNA, 63 nt, hsa
cccaagauuccgagagcccugcgcucuagggcaggggcagaguuuuggaaacagugcaggcuc

SEQ ID NO: 750785 - RNA, 63 nt, hsa
aagucacuugcucaaggucaggcagcuuaggaaggggcagaucgggggcuugaacccaggugg

SEQ ID NO: 750786 - RNA, 63 nt, hsa
ccauuucuguccuuggccuugggaguagcugagggggcagacuagggaguagggcuggcaggg

SEQ ID NO: 750787 - RNA, 63 nt, hsa
ggggcagacuagggaguagggcuggcaggggagggggcagacagccucgccucgcacccuuca

SEQ ID NO: 750788 - RNA, 63 nt, hsa
uaguuuuuagcccuuuuuguuggggguggggugggggcagaggagaggcggauacagaaacuu

SEQ ID NO: 750789 - RNA, 63 nt, hsa
gacaucaggcaaggucuggagacauuuuugguuggggcagaggcaugcuccuggcaucgagug

SEQ ID NO: 750790 - RNA, 57 nt, hsa; identical to SEQ ID NO: 111347

SEQ ID NO: 750791 - RNA, 63 nt, hsa
cagcaggugccagggcuggugaggaagagcuggggggcagagguaaagcccugcaggggaggc

SEQ ID NO: 750792 - RNA, 63 nt, hsa
cuccgaaaugcugucuuucuugcucccugacugggggcagacaugguggggucuccucaggac

SEQ ID NO: 750793 - RNA, 63 nt, hsa
cccucuccagcaggcccaugggaggcuggaguuggggcagaggagaacuugcugccucggauc

SEQ ID NO: 750794 - RNA, 64 nt, hsa; identical to SEQ ID NO: 368571

SEQ ID NO: 750795 - RNA, 64 nt, hsa; identical to SEQ ID NO: 368572

SEQ ID NO: 750796 - RNA, 64 nt, hsa; identical to SEQ ID NO: 368573

SEQ ID NO: 750797 - RNA, 64 nt, hsa; identical to SEQ ID NO: 368574

SEQ ID NO: 750798 - RNA, 64 nt, hsa; identical to SEQ ID NO: 368575

SEQ ID NO: 750799 - RNA, 64 nt, hsa; identical to SEQ ID NO: 368576

SEQ ID NO: 750800 - RNA, 64 nt, hsa; identical to SEQ ID NO: 368577

SEQ ID NO: 750801 - RNA, 64 nt, hsa; identical to SEQ ID NO: 368578

SEQ ID NO: 750802 - RNA, 64 nt, hsa; identical to SEQ ID NO: 368579

SEQ ID NO: 750803 - RNA, 64 nt, hsa; identical to SEQ ID NO: 368580

SEQ ID NO: 750804 - RNA, 64 nt, hsa; identical to SEQ ID NO: 368581

SEQ ID NO: 750805 - RNA, 64 nt, hsa; identical to SEQ ID NO: 368582

SEQ ID NO: 750806 - RNA, 64 nt, hsa; identical to SEQ ID NO: 368583

SEQ ID NO: 750807 - RNA, 64 nt, hsa; identical to SEQ ID NO: 368584

SEQ ID NO: 750808 - RNA, 64 nt, hsa; identical to SEQ ID NO: 368585

SEQ ID NO: 750809 - RNA, 64 nt, hsa; identical to SEQ ID NO: 368586

SEQ ID NO: 750810 - RNA, 64 nt, hsa; identical to SEQ ID NO: 368587

SEQ ID NO: 750811 - RNA, 64 nt, hsa; identical to SEQ ID NO: 368588

SEQ ID NO: 750812 - RNA, 64 nt, hsa; identical to SEQ ID NO: 368589

SEQ ID NO: 750813 - RNA, 64 nt, hsa; identical to SEQ ID NO: 368590

SEQ ID NO: 750814 - RNA, 64 nt, hsa; identical to SEQ ID NO: 368591

SEQ ID NO: 750815 - RNA, 64 nt, hsa; identical to SEQ ID NO: 368592

SEQ ID NO: 750816 - RNA, 64 nt, hsa; identical to SEQ ID NO: 368593

SEQ ID NO: 750817 - RNA, 64 nt, hsa; identical to SEQ ID NO: 368594

SEQ ID NO: 750818 - RNA, 64 nt, hsa; identical to SEQ ID NO: 368595

SEQ ID NO: 750819 - RNA, 64 nt, hsa; identical to SEQ ID NO: 368596

SEQ ID NO: 750820 - RNA, 64 nt, hsa; identical to SEQ ID NO: 368597

SEQ ID NO: 750821 - RNA, 64 nt, hsa; identical to SEQ ID NO: 368598

SEQ ID NO: 750822 - RNA, 64 nt, hsa; identical to SEQ ID NO: 368599

SEQ ID NO: 750823 - RNA, 64 nt, hsa; identical to SEQ ID NO: 368600

SEQ ID NO: 750824 - RNA, 64 nt, hsa; identical to SEQ ID NO: 368601

SEQ ID NO: 750825 - RNA, 64 nt, hsa; identical to SEQ ID NO: 368602

SEQ ID NO: 750826 - RNA, 64 nt, hsa; identical to SEQ ID NO: 368603

SEQ ID NO: 750827 - RNA, 64 nt, hsa; identical to SEQ ID NO: 368604

SEQ ID NO: 750828 - RNA, 64 nt, hsa; identical to SEQ ID NO: 368605

SEQ ID NO: 750829 - RNA, 64 nt, hsa; identical to SEQ ID NO: 368606

SEQ ID NO: 750830 - RNA, 64 nt, hsa; identical to SEQ ID NO: 368607

SEQ ID NO: 750831 - RNA, 64 nt, hsa; identical to SEQ ID NO: 368608

SEQ ID NO: 750832 - RNA, 64 nt, hsa; identical to SEQ ID NO: 368609

SEQ ID NO: 750833 - RNA, 64 nt, hsa; identical to SEQ ID NO: 368610

SEQ ID NO: 750834 - RNA, 64 nt, hsa; identical to SEQ ID NO: 368611

SEQ ID NO: 750835 - RNA, 64 nt, hsa; identical to SEQ ID NO: 368612

SEQ ID NO: 750836 - RNA, 64 nt, hsa; identical to SEQ ID NO: 368613

SEQ ID NO: 750837 - RNA, 64 nt, hsa; identical to SEQ ID NO: 187011

SEQ ID NO: 750838 - RNA, 64 nt, hsa; identical to SEQ ID NO: 187012

SEQ ID NO: 750839 - RNA, 64 nt, hsa; identical to SEQ ID NO: 187013

SEQ ID NO: 750840 - RNA, 64 nt, hsa; identical to SEQ ID NO: 187014

SEQ ID NO: 750841 - RNA, 64 nt, hsa; identical to SEQ ID NO: 187015

SEQ ID NO: 750842 - RNA, 64 nt, hsa; identical to SEQ ID NO: 187016

SEQ ID NO: 750843 - RNA, 56 nt, hsa; identical to SEQ ID NO: 187017

SEQ ID NO: 750844 - RNA, 64 nt, hsa; identical to SEQ ID NO: 187018

SEQ ID NO: 750845 - RNA, 64 nt, hsa; identical to SEQ ID NO: 187019

SEQ ID NO: 750846 - RNA, 64 nt, hsa; identical to SEQ ID NO: 187020

SEQ ID NO: 750847 - RNA, 64 nt, hsa; identical to SEQ ID NO: 187021

SEQ ID NO: 750848 - RNA, 64 nt, hsa; identical to SEQ ID NO: 187022

SEQ ID NO: 750849 - RNA, 64 nt, hsa; identical to SEQ ID NO: 187023

SEQ ID NO: 750850 - RNA, 64 nt, hsa; identical to SEQ ID NO: 187024

SEQ ID NO: 750851 - RNA, 64 nt, hsa; identical to SEQ ID NO: 187025

SEQ ID NO: 750852 - RNA, 64 nt, hsa; identical to SEQ ID NO: 187026

SEQ ID NO: 750853 - RNA, 64 nt, hsa; identical to SEQ ID NO: 187027

SEQ ID NO: 750854 - RNA, 64 nt, hsa; identical to SEQ ID NO: 187028

SEQ ID NO: 750855 - RNA, 64 nt, hsa; identical to SEQ ID NO: 187029

SEQ ID NO: 750856 - RNA, 64 nt, hsa; identical to SEQ ID NO: 187030

SEQ ID NO: 750857 - RNA, 64 nt, hsa; identical to SEQ ID NO: 187031

SEQ ID NO: 750858 - RNA, 64 nt, hsa; identical to SEQ ID NO: 187032

SEQ ID NO: 750859 - RNA, 64 nt, hsa; identical to SEQ ID NO: 187033

SEQ ID NO: 750860 - RNA, 64 nt, hsa; identical to SEQ ID NO: 187034

SEQ ID NO: 750861 - RNA, 64 nt, hsa; identical to SEQ ID NO: 187035

SEQ ID NO: 750862 - RNA, 64 nt, hsa; identical to SEQ ID NO: 187036

SEQ ID NO: 750863 - RNA, 64 nt, hsa; identical to SEQ ID NO: 187037

SEQ ID NO: 750864 - RNA, 64 nt, hsa; identical to SEQ ID NO: 187038

SEQ ID NO: 750865 - RNA, 64 nt, hsa; identical to SEQ ID NO: 187039

SEQ ID NO: 750866 - RNA, 64 nt, hsa; identical to SEQ ID NO: 187040

SEQ ID NO: 750867 - RNA, 64 nt, hsa; identical to SEQ ID NO: 187041

SEQ ID NO: 750868 - RNA, 64 nt, hsa; identical to SEQ ID NO: 187042

SEQ ID NO: 750869 - RNA, 64 nt, hsa; identical to SEQ ID NO: 187043

SEQ ID NO: 750870 - RNA, 64 nt, hsa; identical to SEQ ID NO: 187044

SEQ ID NO: 750871 - RNA, 64 nt, hsa; identical to SEQ ID NO: 187045

SEQ ID NO: 750872 - RNA, 64 nt, hsa; identical to SEQ ID NO: 187046

SEQ ID NO: 750873 - RNA, 64 nt, hsa; identical to SEQ ID NO: 187047

SEQ ID NO: 750874 - RNA, 64 nt, hsa; identical to SEQ ID NO: 187048

SEQ ID NO: 750875 - RNA, 64 nt, hsa; identical to SEQ ID NO: 187049

SEQ ID NO: 750876 - RNA, 64 nt, hsa; identical to SEQ ID NO: 187050

SEQ ID NO: 750877 - RNA, 64 nt, hsa; identical to SEQ ID NO: 187051

SEQ ID NO: 750878 - RNA, 64 nt, hsa; identical to SEQ ID NO: 187052

SEQ ID NO: 750879 - RNA, 64 nt, hsa; identical to SEQ ID NO: 187053

SEQ ID NO: 750880 - RNA, 64 nt, hsa; identical to SEQ ID NO: 187054

SEQ ID NO: 750881 - RNA, 64 nt, hsa; identical to SEQ ID NO: 187055

SEQ ID NO: 750882 - RNA, 64 nt, hsa; identical to SEQ ID NO: 187056

SEQ ID NO: 750883 - RNA, 64 nt, hsa; identical to SEQ ID NO: 187057

SEQ ID NO: 750884 - RNA, 64 nt, hsa; identical to SEQ ID NO: 187058

SEQ ID NO: 750885 - RNA, 64 nt, hsa; identical to SEQ ID NO: 187059

SEQ ID NO: 750886 - RNA, 64 nt, hsa; identical to SEQ ID NO: 187060

SEQ ID NO: 750887 - RNA, 64 nt, hsa; identical to SEQ ID NO: 187061

SEQ ID NO: 750888 - RNA, 64 nt, hsa; identical to SEQ ID NO: 187062

SEQ ID NO: 750889 - RNA, 64 nt, hsa; identical to SEQ ID NO: 187063

SEQ ID NO: 750890 - RNA, 64 nt, hsa; identical to SEQ ID NO: 187064

SEQ ID NO: 750891 - RNA, 64 nt, hsa; identical to SEQ ID NO: 187065

SEQ ID NO: 750892 - RNA, 64 nt, hsa; identical to SEQ ID NO: 187066

SEQ ID NO: 750893 - RNA, 64 nt, hsa; identical to SEQ ID NO: 187067

SEQ ID NO: 750894 - RNA, 64 nt, hsa; identical to SEQ ID NO: 187068

SEQ ID NO: 750895 - RNA, 64 nt, hsa; identical to SEQ ID NO: 187069

SEQ ID NO: 750896 - RNA, 64 nt, hsa; identical to SEQ ID NO: 187070

SEQ ID NO: 750897 - RNA, 64 nt, hsa; identical to SEQ ID NO: 187071

SEQ ID NO: 750898 - RNA, 64 nt, hsa; identical to SEQ ID NO: 187072

SEQ ID NO: 750899 - RNA, 64 nt, hsa; identical to SEQ ID NO: 187073

SEQ ID NO: 750900 - RNA, 64 nt, hsa; identical to SEQ ID NO: 187074

SEQ ID NO: 750901 - RNA, 64 nt, hsa; identical to SEQ ID NO: 187075

SEQ ID NO: 750902 - RNA, 64 nt, hsa; identical to SEQ ID NO: 187076

SEQ ID NO: 750903 - RNA, 64 nt, hsa; identical to SEQ ID NO: 187077

SEQ ID NO: 750904 - RNA, 64 nt, hsa; identical to SEQ ID NO: 187078

SEQ ID NO: 750905 - RNA, 64 nt, hsa; identical to SEQ ID NO: 187079

SEQ ID NO: 750906 - RNA, 64 nt, hsa; identical to SEQ ID NO: 187080

SEQ ID NO: 750907 - RNA, 64 nt, hsa; identical to SEQ ID NO: 187081

SEQ ID NO: 750908 - RNA, 64 nt, hsa; identical to SEQ ID NO: 187082

SEQ ID NO: 750909 - RNA, 64 nt, hsa; identical to SEQ ID NO: 187083

SEQ ID NO: 750910 - RNA, 57 nt, hsa; identical to SEQ ID NO: 187084

SEQ ID NO: 750911 - RNA, 64 nt, hsa; identical to SEQ ID NO: 187085

SEQ ID NO: 750912 - RNA, 64 nt, hsa; identical to SEQ ID NO: 187086

SEQ ID NO: 750913 - RNA, 64 nt, hsa; identical to SEQ ID NO: 187087

SEQ ID NO: 750914 - RNA, 64 nt, hsa; identical to SEQ ID NO: 187088

SEQ ID NO: 750915 - RNA, 64 nt, hsa; identical to SEQ ID NO: 187089

SEQ ID NO: 750916 - RNA, 64 nt, hsa; identical to SEQ ID NO: 187090

SEQ ID NO: 750917 - RNA, 64 nt, hsa; identical to SEQ ID NO: 187091

SEQ ID NO: 750918 - RNA, 64 nt, hsa; identical to SEQ ID NO: 187092

SEQ ID NO: 750919 - RNA, 64 nt, hsa; identical to SEQ ID NO: 187093

SEQ ID NO: 750920 - RNA, 64 nt, hsa; identical to SEQ ID NO: 187094

SEQ ID NO: 750921 - RNA, 64 nt, hsa; identical to SEQ ID NO: 187095

SEQ ID NO: 750922 - RNA, 64 nt, hsa; identical to SEQ ID NO: 187096

SEQ ID NO: 750923 - RNA, 64 nt, hsa; identical to SEQ ID NO: 187097

SEQ ID NO: 750924 - RNA, 64 nt, hsa; identical to SEQ ID NO: 187098

SEQ ID NO: 750925 - RNA, 64 nt, hsa; identical to SEQ ID NO: 187099

SEQ ID NO: 750926 - RNA, 64 nt, hsa; identical to SEQ ID NO: 187100

SEQ ID NO: 750927 - RNA, 64 nt, hsa; identical to SEQ ID NO: 187101

SEQ ID NO: 750928 - RNA, 64 nt, hsa; identical to SEQ ID NO: 187102

SEQ ID NO: 750929 - RNA, 64 nt, hsa; identical to SEQ ID NO: 187103

SEQ ID NO: 750930 - RNA, 64 nt, hsa; identical to SEQ ID NO: 187104

SEQ ID NO: 750931 - RNA, 64 nt, hsa; identical to SEQ ID NO: 187105

SEQ ID NO: 750932 - RNA, 64 nt, hsa; identical to SEQ ID NO: 187106

SEQ ID NO: 750933 - RNA, 64 nt, hsa; identical to SEQ ID NO: 187107

SEQ ID NO: 750934 - RNA, 64 nt, hsa; identical to SEQ ID NO: 187108

SEQ ID NO: 750935 - RNA, 64 nt, hsa; identical to SEQ ID NO: 187109

SEQ ID NO: 750936 - RNA, 64 nt, hsa; identical to SEQ ID NO: 187110

SEQ ID NO: 750937 - RNA, 64 nt, hsa; identical to SEQ ID NO: 187111

SEQ ID NO: 750938 - RNA, 64 nt, hsa; identical to SEQ ID NO: 187112

SEQ ID NO: 750939 - RNA, 64 nt, hsa; identical to SEQ ID NO: 187113

SEQ ID NO: 750940 - RNA, 64 nt, hsa; identical to SEQ ID NO: 187114

SEQ ID NO: 750941 - RNA, 64 nt, hsa; identical to SEQ ID NO: 83612

SEQ ID NO: 750942 - RNA, 64 nt, hsa; identical to SEQ ID NO: 83613

SEQ ID NO: 750943 - RNA, 64 nt, hsa; identical to SEQ ID NO: 83614

SEQ ID NO: 750944 - RNA, 64 nt, hsa; identical to SEQ ID NO: 83615

SEQ ID NO: 750945 - RNA, 64 nt, hsa; identical to SEQ ID NO: 83616

SEQ ID NO: 750946 - RNA, 64 nt, hsa; identical to SEQ ID NO: 83617

SEQ ID NO: 750947 - RNA, 64 nt, hsa; identical to SEQ ID NO: 83618

SEQ ID NO: 750948 - RNA, 64 nt, hsa; identical to SEQ ID NO: 83619

SEQ ID NO: 750949 - RNA, 64 nt, hsa; identical to SEQ ID NO: 83620

SEQ ID NO: 750950 - RNA, 64 nt, hsa; identical to SEQ ID NO: 83621

SEQ ID NO: 750951 - RNA, 64 nt, hsa; identical to SEQ ID NO: 83622

SEQ ID NO: 750952 - RNA, 64 nt, hsa; identical to SEQ ID NO: 83623

SEQ ID NO: 750953 - RNA, 64 nt, hsa; identical to SEQ ID NO: 83624

SEQ ID NO: 750954 - RNA, 64 nt, hsa; identical to SEQ ID NO: 83625

SEQ ID NO: 750955 - RNA, 64 nt, hsa; identical to SEQ ID NO: 83626

SEQ ID NO: 750956 - RNA, 64 nt, hsa; identical to SEQ ID NO: 83627

SEQ ID NO: 750957 - RNA, 64 nt, hsa; identical to SEQ ID NO: 83628

SEQ ID NO: 750958 - RNA, 64 nt, hsa; identical to SEQ ID NO: 83629

SEQ ID NO: 750959 - RNA, 64 nt, hsa; identical to SEQ ID NO: 83630

SEQ ID NO: 750960 - RNA, 64 nt, hsa; identical to SEQ ID NO: 83631

SEQ ID NO: 750961 - RNA, 64 nt, hsa; identical to SEQ ID NO: 83632

SEQ ID NO: 750962 - RNA, 60 nt, hsa; identical to SEQ ID NO: 83633

SEQ ID NO: 750963 - RNA, 64 nt, hsa; identical to SEQ ID NO: 83634

SEQ ID NO: 750964 - RNA, 64 nt, hsa; identical to SEQ ID NO: 83635

SEQ ID NO: 750965 - RNA, 64 nt, hsa; identical to SEQ ID NO: 83636

SEQ ID NO: 750966 - RNA, 64 nt, hsa; identical to SEQ ID NO: 83637

SEQ ID NO: 750967 - RNA, 64 nt, hsa; identical to SEQ ID NO: 83638

SEQ ID NO: 750968 - RNA, 64 nt, hsa; identical to SEQ ID NO: 83639

SEQ ID NO: 750969 - RNA, 64 nt, hsa; identical to SEQ ID NO: 83640

SEQ ID NO: 750970 - RNA, 64 nt, hsa; identical to SEQ ID NO: 83641

SEQ ID NO: 750971 - RNA, 64 nt, hsa; identical to SEQ ID NO: 83642

SEQ ID NO: 750972 - RNA, 64 nt, hsa; identical to SEQ ID NO: 83643

SEQ ID NO: 750973 - RNA, 64 nt, hsa; identical to SEQ ID NO: 83644

SEQ ID NO: 750974 - RNA, 64 nt, hsa; identical to SEQ ID NO: 83645

SEQ ID NO: 750975 - RNA, 64 nt, hsa; identical to SEQ ID NO: 83646

SEQ ID NO: 750976 - RNA, 64 nt, hsa; identical to SEQ ID NO: 83647

SEQ ID NO: 750977 - RNA, 64 nt, hsa; identical to SEQ ID NO: 83648

SEQ ID NO: 750978 - RNA, 64 nt, hsa; identical to SEQ ID NO: 83649

SEQ ID NO: 750979 - RNA, 64 nt, hsa; identical to SEQ ID NO: 83650

SEQ ID NO: 750980 - RNA, 54 nt, hsa; identical to SEQ ID NO: 83651

SEQ ID NO: 750981 - RNA, 64 nt, hsa; identical to SEQ ID NO: 83652

SEQ ID NO: 750982 - RNA, 64 nt, hsa; identical to SEQ ID NO: 83653

SEQ ID NO: 750983 - RNA, 64 nt, hsa; identical to SEQ ID NO: 83654

SEQ ID NO: 750984 - RNA, 64 nt, hsa; identical to SEQ ID NO: 83655

SEQ ID NO: 750985 - RNA, 64 nt, hsa; identical to SEQ ID NO: 83656

SEQ ID NO: 750986 - RNA, 64 nt, hsa; identical to SEQ ID NO: 83657

SEQ ID NO: 750987 - RNA, 59 nt, hsa; identical to SEQ ID NO: 83658

SEQ ID NO: 750988 - RNA, 64 nt, hsa; identical to SEQ ID NO: 83659

SEQ ID NO: 750989 - RNA, 64 nt, hsa; identical to SEQ ID NO: 83660

SEQ ID NO: 750990 - RNA, 64 nt, hsa; identical to SEQ ID NO: 83661

SEQ ID NO: 750991 - RNA, 64 nt, hsa; identical to SEQ ID NO: 83662

SEQ ID NO: 750992 - RNA, 64 nt, hsa; identical to SEQ ID NO: 83663

SEQ ID NO: 750993 - RNA, 64 nt, hsa; identical to SEQ ID NO: 83664

SEQ ID NO: 750994 - RNA, 64 nt, hsa; identical to SEQ ID NO: 83665

SEQ ID NO: 750995 - RNA, 64 nt, hsa; identical to SEQ ID NO: 83666

SEQ ID NO: 750996 - RNA, 64 nt, hsa; identical to SEQ ID NO: 83667

SEQ ID NO: 750997 - RNA, 64 nt, hsa; identical to SEQ ID NO: 83668

SEQ ID NO: 750998 - RNA, 62 nt, hsa
uuagccaagcaguuucuuucaaagaagccagcaggcgaaaagcagggacugccacugcauuu

SEQ ID NO: 750999 - RNA, 62 nt, hsa
agggcaaaggagggugucuuggcugugcuugaaggcgaaacccugccauauccccagugcca

SEQ ID NO: 751000 - RNA, 62 nt, hsa
gauauauuauuuuauuccaagaaagaucagguaggcgaaaagaugacaggauacagagucaa

SEQ ID NO: 751001 - RNA, 62 nt, hsa
ugucugcuuagcccagcucagggguggggaagaggcgaaagcgugggggaggugagcgcagc

SEQ ID NO: 751002 - RNA, 62 nt, hsa
agaggaggccaaaaguuaaacguucuaaaaagaggcgaaaggaagcaagcaguucagaagag

SEQ ID NO: 751003 - RNA, 62 nt, hsa
ggcucuggaaagcaacuucaucccagcugcugaggcgaaauauaaaacugagacuguauaug

SEQ ID NO: 751004 - RNA, 62 nt, hsa
ccccuagacugcucgcuaguggaacacgacagaggcgaaauccugccccgucucccguggac

SEQ ID NO: 751005 - RNA, 62 nt, hsa
ccuccccuucagcugugacaucgugccugggaaggcgaaauauacccccagccccuuccaac

SEQ ID NO: 751006 - RNA, 62 nt, hsa
accagccugcagcacaccccacagccaaguagaggcgaaagcaguggcucauccuaccuguu

SEQ ID NO: 751007 - RNA, 62 nt, hsa
ggcugacacacacucgcagacgagccgccccgaggcgaaaccucgcgguuccucuucccuuc

SEQ ID NO: 751008 - RNA, 62 nt, hsa
ugcuuuguggaaagacggugugugucgugugaaggcgaaacccgguguacauaaccccuccc

SEQ ID NO: 751009 - RNA, 62 nt, hsa
ccucacaggagggccaggcauguauuccucagaggcgaaacugccaaacucuuucuccuguc

SEQ ID NO: 751010 - RNA, 62 nt, hsa
uagaugauucacuuuuugccccuagggaugagaggcgaaagccacuucucauacaagccccu

SEQ ID NO: 751011 - RNA, 62 nt, hsa
gcaugcugaugagcaaggcaggcaggucugagaggcgaaacgaaucucccggcagugcuugg

SEQ ID NO: 751012 - RNA, 62 nt, hsa
agauccagugggguccggacacugggccccgcaggcgaaagcacguuccagccaccaggagg

SEQ ID NO: 751013 - RNA, 62 nt, hsa
aggucgggaguuggagacccgccuggcuaacaaggcgaaauccugucuguacuaaaaauaca

SEQ ID NO: 751014 - RNA, 62 nt, hsa
cuuacagguaaguauugcuuccgccacugcagaggcgaaagccagugcuuugguaaaggucc

SEQ ID NO: 751015 - RNA, 62 nt, hsa
ccagacugaucugccuaaagcacgcgagaugcaggcgaaaagcagccacaccccucugccac

SEQ ID NO: 751016 - RNA, 62 nt, hsa
aaauugacuucauauacaaagccuguaauuuuaggcgaaauggaagcagaaaucuaggaagu

SEQ ID NO: 751017 - RNA, 62 nt, hsa
augaacucuagcacugguguauaugagaaggaaggcgaaagcaugacaggaaaccugccgcc

SEQ ID NO: 751018 - RNA, 62 nt, hsa
gguggccugagccgauggggccccccaggcccaggcgaaagggcagcagcauguggcccaug

SEQ ID NO: 751019 - RNA, 62 nt, hsa
caagcugauaugugccuguuucuggacaauggaggcgaaagaguggaauuucauucaaaggc

SEQ ID NO: 751020 - RNA, 62 nt, hsa
aggucaggaguucaagaccagccuggccaacaaggcgaaacccugucucuacuaaaaauaaa

SEQ ID NO: 751021 - RNA, 62 nt, hsa
gggcuagggcuggaagccaguucuaggcuuccaggcgaaagcugagggaaggaagaaacucc

SEQ ID NO: 751022 - RNA, 62 nt, hsa
agaagcuguggugauuggcccuguggucuaucaggcgaaaaccacagauucuccuucuaguu

SEQ ID NO: 751023 - RNA, 62 nt, hsa
uuggccucacucucuguaagcauauaaaccacaggcgaaagaggaugcugcauugcgaggac

SEQ ID NO: 751024 - RNA, 59 nt, hsa
gcgcccaggcuccucucugacacgccuuuaggcgaaacaugccccaagacacagggacc

SEQ ID NO: 751025 - RNA, 62 nt, hsa
agcucaggaguucgagaucauucuggccaacaaggcgaaacccugucucuaccaaaaauaca

SEQ ID NO: 751026 - RNA, 62 nt, hsa
uuuuacuaugccuguugaucuaugggaaaucuaggcgaaaguaauggggaagauuagaaaga

SEQ ID NO: 751027 - RNA, 62 nt, hsa
uuuuuaaugcuaaucuugugaaaauaauugacaggcgaaagaaaacucuauuuagaugcaua

SEQ ID NO: 751028 - RNA, 64 nt, hsa; identical to SEQ ID NO: 108245

SEQ ID NO: 751029 - RNA, 64 nt, hsa; identical to SEQ ID NO: 108246

SEQ ID NO: 751030 - RNA, 64 nt, hsa; identical to SEQ ID NO: 108247

SEQ ID NO: 751031 - RNA, 64 nt, hsa; identical to SEQ ID NO: 108248

SEQ ID NO: 751032 - RNA, 64 nt, hsa; identical to SEQ ID NO: 108249

SEQ ID NO: 751033 - RNA, 64 nt, hsa; identical to SEQ ID NO: 108250

SEQ ID NO: 751034 - RNA, 64 nt, hsa; identical to SEQ ID NO: 108251

SEQ ID NO: 751035 - RNA, 64 nt, hsa; identical to SEQ ID NO: 108252

SEQ ID NO: 751036 - RNA, 64 nt, hsa; identical to SEQ ID NO: 108253

SEQ ID NO: 751037 - RNA, 64 nt, hsa; identical to SEQ ID NO: 108254

SEQ ID NO: 751038 - RNA, 64 nt, hsa; identical to SEQ ID NO: 108255

SEQ ID NO: 751039 - RNA, 64 nt, hsa; identical to SEQ ID NO: 108256

SEQ ID NO: 751040 - RNA, 64 nt, hsa; identical to SEQ ID NO: 108257

SEQ ID NO: 751041 - RNA, 64 nt, hsa; identical to SEQ ID NO: 108258

SEQ ID NO: 751042 - RNA, 64 nt, hsa; identical to SEQ ID NO: 108259

SEQ ID NO: 751043 - RNA, 64 nt, hsa; identical to SEQ ID NO: 108260

SEQ ID NO: 751044 - RNA, 64 nt, hsa; identical to SEQ ID NO: 108261

SEQ ID NO: 751045 - RNA, 64 nt, hsa; identical to SEQ ID NO: 108262

SEQ ID NO: 751046 - RNA, 64 nt, hsa; identical to SEQ ID NO: 108263

SEQ ID NO: 751047 - RNA, 64 nt, hsa; identical to SEQ ID NO: 108264

SEQ ID NO: 751048 - RNA, 64 nt, hsa; identical to SEQ ID NO: 108265

SEQ ID NO: 751049 - RNA, 64 nt, hsa; identical to SEQ ID NO: 108266

SEQ ID NO: 751050 - RNA, 64 nt, hsa; identical to SEQ ID NO: 108267

SEQ ID NO: 751051 - RNA, 64 nt, hsa; identical to SEQ ID NO: 108268

SEQ ID NO: 751052 - RNA, 64 nt, hsa; identical to SEQ ID NO: 108269

SEQ ID NO: 751053 - RNA, 64 nt, hsa; identical to SEQ ID NO: 108270

SEQ ID NO: 751054 - RNA, 64 nt, hsa; identical to SEQ ID NO: 108271

SEQ ID NO: 751055 - RNA, 64 nt, hsa; identical to SEQ ID NO: 108272

SEQ ID NO: 751056 - RNA, 64 nt, hsa; identical to SEQ ID NO: 108273

SEQ ID NO: 751057 - RNA, 64 nt, hsa; identical to SEQ ID NO: 108274

SEQ ID NO: 751058 - RNA, 64 nt, hsa; identical to SEQ ID NO: 108275

SEQ ID NO: 751059 - RNA, 64 nt, hsa; identical to SEQ ID NO: 108276

SEQ ID NO: 751060 - RNA, 64 nt, hsa; identical to SEQ ID NO: 108277

SEQ ID NO: 751061 - RNA, 64 nt, hsa; identical to SEQ ID NO: 108278

SEQ ID NO: 751062 - RNA, 64 nt, hsa; identical to SEQ ID NO: 108279

SEQ ID NO: 751063 - RNA, 64 nt, hsa; identical to SEQ ID NO: 108280

SEQ ID NO: 751064 - RNA, 64 nt, hsa; identical to SEQ ID NO: 108281

SEQ ID NO: 751065 - RNA, 64 nt, hsa; identical to SEQ ID NO: 108282

SEQ ID NO: 751066 - RNA, 64 nt, hsa; identical to SEQ ID NO: 108283

SEQ ID NO: 751067 - RNA, 64 nt, hsa; identical to SEQ ID NO: 108284

SEQ ID NO: 751068 - RNA, 64 nt, hsa; identical to SEQ ID NO: 712932

SEQ ID NO: 751069 - RNA, 64 nt, hsa; identical to SEQ ID NO: 712933

SEQ ID NO: 751070 - RNA, 64 nt, hsa; identical to SEQ ID NO: 712934

SEQ ID NO: 751071 - RNA, 64 nt, hsa; identical to SEQ ID NO: 712935

SEQ ID NO: 751072 - RNA, 64 nt, hsa; identical to SEQ ID NO: 712936

SEQ ID NO: 751073 - RNA, 64 nt, hsa; identical to SEQ ID NO: 712937

SEQ ID NO: 751074 - RNA, 64 nt, hsa; identical to SEQ ID NO: 712938

SEQ ID NO: 751075 - RNA, 64 nt, hsa; identical to SEQ ID NO: 712939

SEQ ID NO: 751076 - RNA, 64 nt, hsa; identical to SEQ ID NO: 712940

SEQ ID NO: 751077 - RNA, 64 nt, hsa; identical to SEQ ID NO: 712941

SEQ ID NO: 751078 - RNA, 64 nt, hsa; identical to SEQ ID NO: 712942

SEQ ID NO: 751079 - RNA, 64 nt, hsa; identical to SEQ ID NO: 712943

SEQ ID NO: 751080 - RNA, 64 nt, hsa; identical to SEQ ID NO: 712944

SEQ ID NO: 751081 - RNA, 64 nt, hsa; identical to SEQ ID NO: 712945

SEQ ID NO: 751082 - RNA, 64 nt, hsa; identical to SEQ ID NO: 712946

SEQ ID NO: 751083 - RNA, 64 nt, hsa; identical to SEQ ID NO: 712947

SEQ ID NO: 751084 - RNA, 64 nt, hsa; identical to SEQ ID NO: 712948

SEQ ID NO: 751085 - RNA, 64 nt, hsa; identical to SEQ ID NO: 712949

SEQ ID NO: 751086 - RNA, 64 nt, hsa; identical to SEQ ID NO: 204913

SEQ ID NO: 751087 - RNA, 64 nt, hsa; identical to SEQ ID NO: 204914

SEQ ID NO: 751088 - RNA, 64 nt, hsa; identical to SEQ ID NO: 204915

SEQ ID NO: 751089 - RNA, 64 nt, hsa; identical to SEQ ID NO: 204916

SEQ ID NO: 751090 - RNA, 64 nt, hsa; identical to SEQ ID NO: 204917

SEQ ID NO: 751091 - RNA, 64 nt, hsa; identical to SEQ ID NO: 204918

SEQ ID NO: 751092 - RNA, 64 nt, hsa; identical to SEQ ID NO: 204919

SEQ ID NO: 751093 - RNA, 64 nt, hsa; identical to SEQ ID NO: 204920

SEQ ID NO: 751094 - RNA, 64 nt, hsa; identical to SEQ ID NO: 204921

SEQ ID NO: 751095 - RNA, 64 nt, hsa; identical to SEQ ID NO: 204922

SEQ ID NO: 751096 - RNA, 64 nt, hsa; identical to SEQ ID NO: 204923

SEQ ID NO: 751097 - RNA, 64 nt, hsa; identical to SEQ ID NO: 204924

SEQ ID NO: 751098 - RNA, 64 nt, hsa; identical to SEQ ID NO: 204925

SEQ ID NO: 751099 - RNA, 64 nt, hsa; identical to SEQ ID NO: 204926

SEQ ID NO: 751100 - RNA, 64 nt, hsa; identical to SEQ ID NO: 204927

SEQ ID NO: 751101 - RNA, 64 nt, hsa; identical to SEQ ID NO: 204928

SEQ ID NO: 751102 - RNA, 64 nt, hsa; identical to SEQ ID NO: 204929

SEQ ID NO: 751103 - RNA, 64 nt, hsa; identical to SEQ ID NO: 204930

SEQ ID NO: 751104 - RNA, 64 nt, hsa; identical to SEQ ID NO: 204931

SEQ ID NO: 751105 - RNA, 64 nt, hsa; identical to SEQ ID NO: 204932

SEQ ID NO: 751106 - RNA, 64 nt, hsa; identical to SEQ ID NO: 204933

SEQ ID NO: 751107 - RNA, 64 nt, hsa; identical to SEQ ID NO: 204934

SEQ ID NO: 751108 - RNA, 64 nt, hsa; identical to SEQ ID NO: 204935

SEQ ID NO: 751109 - RNA, 64 nt, hsa; identical to SEQ ID NO: 204936

SEQ ID NO: 751110 - RNA, 64 nt, hsa; identical to SEQ ID NO: 204937

SEQ ID NO: 751111 - RNA, 64 nt, hsa; identical to SEQ ID NO: 204938

SEQ ID NO: 751112 - RNA, 64 nt, hsa; identical to SEQ ID NO: 204939

SEQ ID NO: 751113 - RNA, 64 nt, hsa; identical to SEQ ID NO: 204940

SEQ ID NO: 751114 - RNA, 64 nt, hsa; identical to SEQ ID NO: 204941

SEQ ID NO: 751115 - RNA, 63 nt, hsa
gcugucaugguccuuugcagagcugcugcuuuuggcauucauagauaaacagcucaggcauaa

SEQ ID NO: 751116 - RNA, 63 nt, hsa
ugaaauggagaugauaacacugugucuuagguuggcauucaggucacaugaaaggugugugga

SEQ ID NO: 751117 - RNA, 63 nt, hsa
agaaucuagucuuuguaauagaaguuucccaguggcauucacuagugagaguuuuagacaaau

SEQ ID NO: 751118 - RNA, 63 nt, hsa
uuuggugaaauguccuguacagaacaguaccuuggcauucagcagcuguaauuggggaacauu

SEQ ID NO: 751119 - RNA, 63 nt, hsa
ccaccugucccaggcuguggugccacccucucuggcauucaugcagagcaaagcacuuuaacc

SEQ ID NO: 751120 - RNA, 63 nt, hsa
gcucaaacugaaagaguguggguucuaaguacaggcauucaaggcugggggaaggaaagcuac

SEQ ID NO: 751121 - RNA, 63 nt, hsa
gcuuccugcguguguaaaagucgagguauugcuggcauucagggugacaugaugguacuaaau

SEQ ID NO: 751122 - RNA, 63 nt, hsa
uaaauacuguaauauauuuauuaauauuugaaaggcauucauucaguggacagugggaauuaa

SEQ ID NO: 751123 - RNA, 63 nt, hsa
ugucagaggagccuuucgauaucuggggaacuuggcauucaacauuaaaaagcggauccaaag

SEQ ID NO: 751124 - RNA, 63 nt, hsa
ugcagucggaaguuuccuuuuccgugggagggaggcauucaucuacagacuccaacaaggccu

SEQ ID NO: 751125 - RNA, 64 nt, hsa; identical to SEQ ID NO: 744406

SEQ ID NO: 751126 - RNA, 64 nt, hsa; identical to SEQ ID NO: 744407

SEQ ID NO: 751127 - RNA, 64 nt, hsa; identical to SEQ ID NO: 744408

SEQ ID NO: 751128 - RNA, 64 nt, hsa; identical to SEQ ID NO: 744409

SEQ ID NO: 751129 - RNA, 64 nt, hsa; identical to SEQ ID NO: 744410

SEQ ID NO: 751130 - RNA, 64 nt, hsa; identical to SEQ ID NO: 744411

SEQ ID NO: 751131 - RNA, 64 nt, hsa; identical to SEQ ID NO: 744412

SEQ ID NO: 751132 - RNA, 64 nt, hsa; identical to SEQ ID NO: 744413

SEQ ID NO: 751133 - RNA, 64 nt, hsa; identical to SEQ ID NO: 744414

SEQ ID NO: 751134 - RNA, 64 nt, hsa; identical to SEQ ID NO: 744415

SEQ ID NO: 751135 - RNA, 64 nt, hsa; identical to SEQ ID NO: 744416

SEQ ID NO: 751136 - RNA, 64 nt, hsa; identical to SEQ ID NO: 744417

SEQ ID NO: 751137 - RNA, 64 nt, hsa; identical to SEQ ID NO: 744418

SEQ ID NO: 751138 - RNA, 64 nt, hsa; identical to SEQ ID NO: 744419

SEQ ID NO: 751139 - RNA, 64 nt, hsa; identical to SEQ ID NO: 744420

SEQ ID NO: 751140 - RNA, 64 nt, hsa; identical to SEQ ID NO: 744421

SEQ ID NO: 751141 - RNA, 64 nt, hsa; identical to SEQ ID NO: 744422

SEQ ID NO: 751142 - RNA, 64 nt, hsa; identical to SEQ ID NO: 744423

SEQ ID NO: 751143 - RNA, 64 nt, hsa; identical to SEQ ID NO: 744424

SEQ ID NO: 751144 - RNA, 64 nt, hsa; identical to SEQ ID NO: 744425

SEQ ID NO: 751145 - RNA, 64 nt, hsa; identical to SEQ ID NO: 744426

SEQ ID NO: 751146 - RNA, 64 nt, hsa; identical to SEQ ID NO: 744427

SEQ ID NO: 751147 - RNA, 64 nt, hsa; identical to SEQ ID NO: 744428

SEQ ID NO: 751148 - RNA, 64 nt, hsa; identical to SEQ ID NO: 744429

SEQ ID NO: 751149 - RNA, 64 nt, hsa; identical to SEQ ID NO: 744430

SEQ ID NO: 751150 - RNA, 64 nt, hsa; identical to SEQ ID NO: 744431

SEQ ID NO: 751151 - RNA, 64 nt, hsa; identical to SEQ ID NO: 744432

SEQ ID NO: 751152 - RNA, 64 nt, hsa; identical to SEQ ID NO: 744433

SEQ ID NO: 751153 - RNA, 64 nt, hsa; identical to SEQ ID NO: 744434

SEQ ID NO: 751154 - RNA, 64 nt, hsa; identical to SEQ ID NO: 744435

SEQ ID NO: 751155 - RNA, 64 nt, hsa; identical to SEQ ID NO: 744436

SEQ ID NO: 751156 - RNA, 64 nt, hsa; identical to SEQ ID NO: 744437

SEQ ID NO: 751157 - RNA, 64 nt, hsa; identical to SEQ ID NO: 744438

SEQ ID NO: 751158 - RNA, 64 nt, hsa; identical to SEQ ID NO: 744439

SEQ ID NO: 751159 - RNA, 64 nt, hsa; identical to SEQ ID NO: 744440

SEQ ID NO: 751160 - RNA, 64 nt, hsa; identical to SEQ ID NO: 744441

SEQ ID NO: 751161 - RNA, 64 nt, hsa; identical to SEQ ID NO: 744442

SEQ ID NO: 751162 - RNA, 64 nt, hsa; identical to SEQ ID NO: 744443

SEQ ID NO: 751163 - RNA, 64 nt, hsa; identical to SEQ ID NO: 744444

SEQ ID NO: 751164 - RNA, 64 nt, hsa; identical to SEQ ID NO: 744445

SEQ ID NO: 751165 - RNA, 64 nt, hsa; identical to SEQ ID NO: 744446

SEQ ID NO: 751166 - RNA, 64 nt, hsa; identical to SEQ ID NO: 744447

SEQ ID NO: 751167 - RNA, 64 nt, hsa; identical to SEQ ID NO: 744448

SEQ ID NO: 751168 - RNA, 64 nt, hsa; identical to SEQ ID NO: 744449

SEQ ID NO: 751169 - RNA, 64 nt, hsa; identical to SEQ ID NO: 744450

SEQ ID NO: 751170 - RNA, 64 nt, hsa; identical to SEQ ID NO: 744451

SEQ ID NO: 751171 - RNA, 64 nt, hsa; identical to SEQ ID NO: 744452

SEQ ID NO: 751172 - RNA, 64 nt, hsa; identical to SEQ ID NO: 744453

SEQ ID NO: 751173 - RNA, 64 nt, hsa; identical to SEQ ID NO: 744454

SEQ ID NO: 751174 - RNA, 64 nt, hsa; identical to SEQ ID NO: 744455

SEQ ID NO: 751175 - RNA, 64 nt, hsa; identical to SEQ ID NO: 744456

SEQ ID NO: 751176 - RNA, 64 nt, hsa; identical to SEQ ID NO: 744457

SEQ ID NO: 751177 - RNA, 64 nt, hsa; identical to SEQ ID NO: 744458

SEQ ID NO: 751178 - RNA, 64 nt, hsa; identical to SEQ ID NO: 744459

SEQ ID NO: 751179 - RNA, 64 nt, hsa; identical to SEQ ID NO: 744460

SEQ ID NO: 751180 - RNA, 64 nt, hsa; identical to SEQ ID NO: 744461

SEQ ID NO: 751181 - RNA, 64 nt, hsa; identical to SEQ ID NO: 744462

SEQ ID NO: 751182 - RNA, 64 nt, hsa; identical to SEQ ID NO: 744463

SEQ ID NO: 751183 - RNA, 64 nt, hsa; identical to SEQ ID NO: 744464

SEQ ID NO: 751184 - RNA, 64 nt, hsa; identical to SEQ ID NO: 744465

SEQ ID NO: 751185 - RNA, 64 nt, hsa; identical to SEQ ID NO: 744466

SEQ ID NO: 751186 - RNA, 64 nt, hsa; identical to SEQ ID NO: 744467

SEQ ID NO: 751187 - RNA, 64 nt, hsa; identical to SEQ ID NO: 744468

SEQ ID NO: 751188 - RNA, 64 nt, hsa; identical to SEQ ID NO: 744469

SEQ ID NO: 751189 - RNA, 64 nt, hsa; identical to SEQ ID NO: 744470

SEQ ID NO: 751190 - RNA, 64 nt, hsa; identical to SEQ ID NO: 744471

SEQ ID NO: 751191 - RNA, 64 nt, hsa; identical to SEQ ID NO: 744472

SEQ ID NO: 751192 - RNA, 64 nt, hsa; identical to SEQ ID NO: 744473

SEQ ID NO: 751193 - RNA, 64 nt, hsa; identical to SEQ ID NO: 744474

SEQ ID NO: 751194 - RNA, 64 nt, hsa; identical to SEQ ID NO: 744475

SEQ ID NO: 751195 - RNA, 64 nt, hsa; identical to SEQ ID NO: 744476

SEQ ID NO: 751196 - RNA, 64 nt, hsa; identical to SEQ ID NO: 744477

SEQ ID NO: 751197 - RNA, 64 nt, hsa; identical to SEQ ID NO: 744478

SEQ ID NO: 751198 - RNA, 64 nt, hsa; identical to SEQ ID NO: 744479

SEQ ID NO: 751199 - RNA, 64 nt, hsa; identical to SEQ ID NO: 744480

SEQ ID NO: 751200 - RNA, 64 nt, hsa; identical to SEQ ID NO: 744481

SEQ ID NO: 751201 - RNA, 64 nt, hsa; identical to SEQ ID NO: 744482

SEQ ID NO: 751202 - RNA, 64 nt, hsa; identical to SEQ ID NO: 744483

SEQ ID NO: 751203 - RNA, 64 nt, hsa; identical to SEQ ID NO: 744484

SEQ ID NO: 751204 - RNA, 64 nt, hsa; identical to SEQ ID NO: 744485

SEQ ID NO: 751205 - RNA, 64 nt, hsa; identical to SEQ ID NO: 744486

SEQ ID NO: 751206 - RNA, 64 nt, hsa; identical to SEQ ID NO: 744487

SEQ ID NO: 751207 - RNA, 64 nt, hsa; identical to SEQ ID NO: 744488

SEQ ID NO: 751208 - RNA, 64 nt, hsa; identical to SEQ ID NO: 744489

SEQ ID NO: 751209 - RNA, 64 nt, hsa; identical to SEQ ID NO: 744490

SEQ ID NO: 751210 - RNA, 64 nt, hsa; identical to SEQ ID NO: 744491

SEQ ID NO: 751211 - RNA, 64 nt, hsa; identical to SEQ ID NO: 744492

SEQ ID NO: 751212 - RNA, 64 nt, hsa; identical to SEQ ID NO: 744493

SEQ ID NO: 751213 - RNA, 64 nt, hsa; identical to SEQ ID NO: 744494

SEQ ID NO: 751214 - RNA, 64 nt, hsa; identical to SEQ ID NO: 744495

SEQ ID NO: 751215 - RNA, 64 nt, hsa; identical to SEQ ID NO: 744496

SEQ ID NO: 751216 - RNA, 64 nt, hsa; identical to SEQ ID NO: 744497

SEQ ID NO: 751217 - RNA, 64 nt, hsa; identical to SEQ ID NO: 744498

SEQ ID NO: 751218 - RNA, 64 nt, hsa; identical to SEQ ID NO: 744499

SEQ ID NO: 751219 - RNA, 64 nt, hsa; identical to SEQ ID NO: 744500

SEQ ID NO: 751220 - RNA, 64 nt, hsa; identical to SEQ ID NO: 744501

SEQ ID NO: 751221 - RNA, 64 nt, hsa; identical to SEQ ID NO: 744502

SEQ ID NO: 751222 - RNA, 64 nt, hsa; identical to SEQ ID NO: 744503

SEQ ID NO: 751223 - RNA, 64 nt, hsa; identical to SEQ ID NO: 744504

SEQ ID NO: 751224 - RNA, 64 nt, hsa; identical to SEQ ID NO: 744505

SEQ ID NO: 751225 - RNA, 64 nt, hsa; identical to SEQ ID NO: 744506

SEQ ID NO: 751226 - RNA, 64 nt, hsa; identical to SEQ ID NO: 744507

SEQ ID NO: 751227 - RNA, 64 nt, hsa; identical to SEQ ID NO: 744508

SEQ ID NO: 751228 - RNA, 64 nt, hsa; identical to SEQ ID NO: 744509

SEQ ID NO: 751229 - RNA, 64 nt, hsa; identical to SEQ ID NO: 744510

SEQ ID NO: 751230 - RNA, 64 nt, hsa; identical to SEQ ID NO: 744511

SEQ ID NO: 751231 - RNA, 64 nt, hsa; identical to SEQ ID NO: 744512

SEQ ID NO: 751232 - RNA, 64 nt, hsa; identical to SEQ ID NO: 744513

SEQ ID NO: 751233 - RNA, 64 nt, hsa; identical to SEQ ID NO: 744514

SEQ ID NO: 751234 - RNA, 64 nt, hsa; identical to SEQ ID NO: 744515

SEQ ID NO: 751235 - RNA, 64 nt, hsa; identical to SEQ ID NO: 744516

SEQ ID NO: 751236 - RNA, 64 nt, hsa; identical to SEQ ID NO: 744517

SEQ ID NO: 751237 - RNA, 64 nt, hsa; identical to SEQ ID NO: 744518

SEQ ID NO: 751238 - RNA, 64 nt, hsa; identical to SEQ ID NO: 744519

SEQ ID NO: 751239 - RNA, 64 nt, hsa; identical to SEQ ID NO: 744520

SEQ ID NO: 751240 - RNA, 64 nt, hsa; identical to SEQ ID NO: 744521

SEQ ID NO: 751241 - RNA, 64 nt, hsa; identical to SEQ ID NO: 744522

SEQ ID NO: 751242 - RNA, 64 nt, hsa; identical to SEQ ID NO: 744523

SEQ ID NO: 751243 - RNA, 64 nt, hsa; identical to SEQ ID NO: 744524

SEQ ID NO: 751244 - RNA, 64 nt, hsa; identical to SEQ ID NO: 744525

SEQ ID NO: 751245 - RNA, 64 nt, hsa; identical to SEQ ID NO: 744526

SEQ ID NO: 751246 - RNA, 64 nt, hsa; identical to SEQ ID NO: 744527

SEQ ID NO: 751247 - RNA, 64 nt, hsa; identical to SEQ ID NO: 744528

SEQ ID NO: 751248 - RNA, 64 nt, hsa; identical to SEQ ID NO: 744529

SEQ ID NO: 751249 - RNA, 64 nt, hsa; identical to SEQ ID NO: 744530

SEQ ID NO: 751250 - RNA, 64 nt, hsa; identical to SEQ ID NO: 744531

SEQ ID NO: 751251 - RNA, 64 nt, hsa; identical to SEQ ID NO: 744532

SEQ ID NO: 751252 - RNA, 64 nt, hsa; identical to SEQ ID NO: 744533

SEQ ID NO: 751253 - RNA, 64 nt, hsa; identical to SEQ ID NO: 744534

SEQ ID NO: 751254 - RNA, 64 nt, hsa; identical to SEQ ID NO: 744535

SEQ ID NO: 751255 - RNA, 64 nt, hsa; identical to SEQ ID NO: 744536

SEQ ID NO: 751256 - RNA, 64 nt, hsa; identical to SEQ ID NO: 744537

SEQ ID NO: 751257 - RNA, 64 nt, hsa; identical to SEQ ID NO: 744538

SEQ ID NO: 751258 - RNA, 64 nt, hsa; identical to SEQ ID NO: 744539

SEQ ID NO: 751259 - RNA, 64 nt, hsa; identical to SEQ ID NO: 744540

SEQ ID NO: 751260 - RNA, 64 nt, hsa; identical to SEQ ID NO: 744541

SEQ ID NO: 751261 - RNA, 64 nt, hsa; identical to SEQ ID NO: 744542

SEQ ID NO: 751262 - RNA, 64 nt, hsa; identical to SEQ ID NO: 744543

SEQ ID NO: 751263 - RNA, 64 nt, hsa; identical to SEQ ID NO: 744544

SEQ ID NO: 751264 - RNA, 64 nt, hsa; identical to SEQ ID NO: 744545

SEQ ID NO: 751265 - RNA, 64 nt, hsa; identical to SEQ ID NO: 744546

SEQ ID NO: 751266 - RNA, 64 nt, hsa; identical to SEQ ID NO: 744547

SEQ ID NO: 751267 - RNA, 64 nt, hsa; identical to SEQ ID NO: 744548

SEQ ID NO: 751268 - RNA, 64 nt, hsa; identical to SEQ ID NO: 744549

SEQ ID NO: 751269 - RNA, 64 nt, hsa; identical to SEQ ID NO: 744550

SEQ ID NO: 751270 - RNA, 64 nt, hsa; identical to SEQ ID NO: 744551

SEQ ID NO: 751271 - RNA, 64 nt, hsa; identical to SEQ ID NO: 744552

SEQ ID NO: 751272 - RNA, 64 nt, hsa; identical to SEQ ID NO: 744553

SEQ ID NO: 751273 - RNA, 64 nt, hsa; identical to SEQ ID NO: 744554

SEQ ID NO: 751274 - RNA, 64 nt, hsa; identical to SEQ ID NO: 744555

SEQ ID NO: 751275 - RNA, 64 nt, hsa; identical to SEQ ID NO: 744556

SEQ ID NO: 751276 - RNA, 64 nt, hsa; identical to SEQ ID NO: 744557

SEQ ID NO: 751277 - RNA, 64 nt, hsa; identical to SEQ ID NO: 744558

SEQ ID NO: 751278 - RNA, 64 nt, hsa; identical to SEQ ID NO: 744559

SEQ ID NO: 751279 - RNA, 64 nt, hsa; identical to SEQ ID NO: 744560

SEQ ID NO: 751280 - RNA, 64 nt, hsa; identical to SEQ ID NO: 744561

SEQ ID NO: 751281 - RNA, 64 nt, hsa; identical to SEQ ID NO: 744562

SEQ ID NO: 751282 - RNA, 61 nt, hsa; identical to SEQ ID NO: 744563

SEQ ID NO: 751283 - RNA, 64 nt, hsa; identical to SEQ ID NO: 744564

SEQ ID NO: 751284 - RNA, 64 nt, hsa; identical to SEQ ID NO: 744565

SEQ ID NO: 751285 - RNA, 64 nt, hsa; identical to SEQ ID NO: 744566

SEQ ID NO: 751286 - RNA, 64 nt, hsa; identical to SEQ ID NO: 744567

SEQ ID NO: 751287 - RNA, 64 nt, hsa; identical to SEQ ID NO: 744568

SEQ ID NO: 751288 - RNA, 64 nt, hsa; identical to SEQ ID NO: 744569

SEQ ID NO: 751289 - RNA, 64 nt, hsa; identical to SEQ ID NO: 744570

SEQ ID NO: 751290 - RNA, 64 nt, hsa; identical to SEQ ID NO: 744571

SEQ ID NO: 751291 - RNA, 64 nt, hsa; identical to SEQ ID NO: 744572

SEQ ID NO: 751292 - RNA, 64 nt, hsa; identical to SEQ ID NO: 744573

SEQ ID NO: 751293 - RNA, 64 nt, hsa; identical to SEQ ID NO: 744574

SEQ ID NO: 751294 - RNA, 64 nt, hsa; identical to SEQ ID NO: 744575

SEQ ID NO: 751295 - RNA, 64 nt, hsa; identical to SEQ ID NO: 744576

SEQ ID NO: 751296 - RNA, 64 nt, hsa; identical to SEQ ID NO: 744577

SEQ ID NO: 751297 - RNA, 64 nt, hsa; identical to SEQ ID NO: 744578

SEQ ID NO: 751298 - RNA, 64 nt, hsa; identical to SEQ ID NO: 744579

SEQ ID NO: 751299 - RNA, 64 nt, hsa; identical to SEQ ID NO: 744580

SEQ ID NO: 751300 - RNA, 64 nt, hsa; identical to SEQ ID NO: 744581

SEQ ID NO: 751301 - RNA, 64 nt, hsa; identical to SEQ ID NO: 744582

SEQ ID NO: 751302 - RNA, 64 nt, hsa; identical to SEQ ID NO: 744583

SEQ ID NO: 751303 - RNA, 64 nt, hsa; identical to SEQ ID NO: 744584

SEQ ID NO: 751304 - RNA, 64 nt, hsa; identical to SEQ ID NO: 744585

SEQ ID NO: 751305 - RNA, 64 nt, hsa; identical to SEQ ID NO: 744586

SEQ ID NO: 751306 - RNA, 64 nt, hsa; identical to SEQ ID NO: 744587

SEQ ID NO: 751307 - RNA, 64 nt, hsa; identical to SEQ ID NO: 744588

SEQ ID NO: 751308 - RNA, 64 nt, hsa; identical to SEQ ID NO: 744589

SEQ ID NO: 751309 - RNA, 64 nt, hsa; identical to SEQ ID NO: 744590

SEQ ID NO: 751310 - RNA, 50 nt, hsa; identical to SEQ ID NO: 744591

SEQ ID NO: 751311 - RNA, 64 nt, hsa; identical to SEQ ID NO: 744592

SEQ ID NO: 751312 - RNA, 64 nt, hsa; identical to SEQ ID NO: 744593

SEQ ID NO: 751313 - RNA, 64 nt, hsa; identical to SEQ ID NO: 744594

SEQ ID NO: 751314 - RNA, 64 nt, hsa; identical to SEQ ID NO: 744595

SEQ ID NO: 751315 - RNA, 64 nt, hsa
uauguagucuaagcauacguauacaauaaaacuaugcuauuaaaaaaaaagaagguaacugaua

SEQ ID NO: 751316 - RNA, 64 nt, hsa
guuccuccugguaggcuuacaaguguuuacuauaugcuauuaauacauuauacuuuauaacuaa

SEQ ID NO: 751317 - RNA, 64 nt, hsa
uacagaaaaaauaaaauggaugcccauguuuuauugcuauuacuaaaugucaagauuguaugcu

SEQ ID NO: 751318 - RNA, 64 nt, hsa
uguuuuauugcuauuacuaaaugucaagauuguaugcuauuaugucuuguaaauuucuuuuguu

SEQ ID NO: 751319 - RNA, 64 nt, hsa
uaaagcagccaucuuuaaaauccaggaucaucaaugcuauuaacaguaucagguaaaaaguaca

SEQ ID NO: 751320 - RNA, 64 nt, hsa
agccccaggaaaggguuuuuugagaccauauguaugcuauuaaaauauauugagauuaauacau

SEQ ID NO: 751321 - RNA, 64 nt, hsa
uuucagauaaccucucaaaaagacuuuaaaauaaugcuauuacacaaagcugcauuuaccaaaa

SEQ ID NO: 751322 - RNA, 64 nt, hsa
gucuuaaagagagaacugaagcuuuugaugaaggugcuauuaaucuagaaaggcaaacccauuu

SEQ ID NO: 751323 - RNA, 64 nt, hsa; identical to SEQ ID NO: 271043

SEQ ID NO: 751324 - RNA, 64 nt, hsa; identical to SEQ ID NO: 271044

SEQ ID NO: 751325 - RNA, 64 nt, hsa; identical to SEQ ID NO: 271045

SEQ ID NO: 751326 - RNA, 64 nt, hsa; identical to SEQ ID NO: 271046

SEQ ID NO: 751327 - RNA, 64 nt, hsa; identical to SEQ ID NO: 271047

SEQ ID NO: 751328 - RNA, 64 nt, hsa; identical to SEQ ID NO: 271048

SEQ ID NO: 751329 - RNA, 64 nt, hsa; identical to SEQ ID NO: 271049

SEQ ID NO: 751330 - RNA, 64 nt, hsa; identical to SEQ ID NO: 271050

SEQ ID NO: 751331 - RNA, 64 nt, hsa; identical to SEQ ID NO: 271051

SEQ ID NO: 751332 - RNA, 64 nt, hsa; identical to SEQ ID NO: 271052

SEQ ID NO: 751333 - RNA, 64 nt, hsa; identical to SEQ ID NO: 271053

SEQ ID NO: 751334 - RNA, 64 nt, hsa; identical to SEQ ID NO: 271054

SEQ ID NO: 751335 - RNA, 64 nt, hsa; identical to SEQ ID NO: 271055

SEQ ID NO: 751336 - RNA, 64 nt, hsa; identical to SEQ ID NO: 271056

SEQ ID NO: 751337 - RNA, 64 nt, hsa; identical to SEQ ID NO: 271057

SEQ ID NO: 751338 - RNA, 64 nt, hsa; identical to SEQ ID NO: 271058

SEQ ID NO: 751339 - RNA, 64 nt, hsa; identical to SEQ ID NO: 271059

SEQ ID NO: 751340 - RNA, 64 nt, hsa; identical to SEQ ID NO: 271060

SEQ ID NO: 751341 - RNA, 64 nt, hsa; identical to SEQ ID NO: 271061

SEQ ID NO: 751342 - RNA, 64 nt, hsa; identical to SEQ ID NO: 271062

SEQ ID NO: 751343 - RNA, 64 nt, hsa; identical to SEQ ID NO: 271063

SEQ ID NO: 751344 - RNA, 64 nt, hsa; identical to SEQ ID NO: 271064

SEQ ID NO: 751345 - RNA, 64 nt, hsa; identical to SEQ ID NO: 271065

SEQ ID NO: 751346 - RNA, 64 nt, hsa; identical to SEQ ID NO: 271066

SEQ ID NO: 751347 - RNA, 64 nt, hsa; identical to SEQ ID NO: 271067

SEQ ID NO: 751348 - RNA, 64 nt, hsa; identical to SEQ ID NO: 271068

SEQ ID NO: 751349 - RNA, 63 nt, hsa
uguucauggaugacacaauguuuuugcaaaaaaacccugaaacuauucuuuggcauugguguc

SEQ ID NO: 751350 - RNA, 63 nt, hsa
cacaauuuuucauuucaugcuuccauauauauuacccugaacuuucuaucaccacagauaaag

SEQ ID NO: 751351 - RNA, 63 nt, hsa
cucaauguugggaaaacagaugagcaacccacuacccugaagucauccaccguguagugggga

SEQ ID NO: 751352 - RNA, 63 nt, hsa
ugaggccauauuuugaguucuuaaauacuaccaacccugaacgucucaggacaaauaauucaa

SEQ ID NO: 751353 - RNA, 63 nt, hsa
gugugaaaagcuacccugaaacccaguaauucuacccugaaagugacugccugcagaaagacc

SEQ ID NO: 751354 - RNA, 63 nt, hsa
uccccagggccauaguguagagugugaaaagcuacccugaaacccaguaauucuacccugaaa

SEQ ID NO: 751355 - RNA, 63 nt, hsa
uuacaaagaggccagcuaauagcagaaaucaugacccugaaagagagaugaaauucaagcugu

SEQ ID NO: 751356 - RNA, 63 nt, hsa
ggaguuugcuuuuggcuucucacucuccaaguaacccugaauuaggcccagaauggcugaggc

SEQ ID NO: 751357 - RNA, 63 nt, hsa
uguuuuaauaauccaaaauaauuccagugccgaacccugaauuuaacauaugguagacauuca

SEQ ID NO: 751358 - RNA, 63 nt, hsa
agcagcuuugaaagcagacugagaugaguugagacccugaaucccugggcuguuguuccuguc

SEQ ID NO: 751359 - RNA, 63 nt, hsa
ccaaggccugcuuugaaaaggugcuugaaguggacccugaaaacccugaauccagcgcugggu

SEQ ID NO: 751360 - RNA, 63 nt, hsa
gcuuugaaaaggugcuugaaguggacccugaaaacccugaauccagcgcuggguaugcgaucu

SEQ ID NO: 751361 - RNA, 63 nt, hsa
gggcuuguaaacagacauaggaagccucuguuuacccugaagcaccacuguccagcccauugg

SEQ ID NO: 751362 - RNA, 63 nt, hsa
gagucuucccgaggcauccugucugugcuuccaacccugaacaagaccuuacaugagagaugg

SEQ ID NO: 751363 - RNA, 63 nt, hsa
guacuuuagugagagcugacuggcaagauaaaaacccugaaauucccagaaguuacagaugcc

SEQ ID NO: 751364 - RNA, 63 nt, hsa
gaaaaagaacacuuuugaacuauguaaugcuucacccugaaaggcaagcuaacgcuaacuucc

SEQ ID NO: 751365 - RNA, 63 nt, hsa
agaaaacaauguuaaggauguauuuauuccccuacccugaagaaaguguaggauagaauuguu

SEQ ID NO: 751366 - RNA, 63 nt, hsa
uaaccagucucaaacaugcuuaucccauuaucaacccugaaaguuugcuuguccuuuaagaua

SEQ ID NO: 751367 - RNA, 64 nt, hsa; identical to SEQ ID NO: 56766

SEQ ID NO: 751368 - RNA, 64 nt, hsa; identical to SEQ ID NO: 56767

SEQ ID NO: 751369 - RNA, 64 nt, hsa; identical to SEQ ID NO: 56768

SEQ ID NO: 751370 - RNA, 64 nt, hsa; identical to SEQ ID NO: 56769

SEQ ID NO: 751371 - RNA, 64 nt, hsa; identical to SEQ ID NO: 56770

SEQ ID NO: 751372 - RNA, 64 nt, hsa; identical to SEQ ID NO: 56771

SEQ ID NO: 751373 - RNA, 64 nt, hsa; identical to SEQ ID NO: 56772

SEQ ID NO: 751374 - RNA, 64 nt, hsa; identical to SEQ ID NO: 56773

SEQ ID NO: 751375 - RNA, 64 nt, hsa; identical to SEQ ID NO: 56774

SEQ ID NO: 751376 - RNA, 64 nt, hsa; identical to SEQ ID NO: 56775

SEQ ID NO: 751377 - RNA, 64 nt, hsa; identical to SEQ ID NO: 56776

SEQ ID NO: 751378 - RNA, 64 nt, hsa; identical to SEQ ID NO: 56777

SEQ ID NO: 751379 - RNA, 64 nt, hsa; identical to SEQ ID NO: 56778

SEQ ID NO: 751380 - RNA, 64 nt, hsa; identical to SEQ ID NO: 56779

SEQ ID NO: 751381 - RNA, 64 nt, hsa; identical to SEQ ID NO: 56780

SEQ ID NO: 751382 - RNA, 64 nt, hsa; identical to SEQ ID NO: 56781

SEQ ID NO: 751383 - RNA, 64 nt, hsa; identical to SEQ ID NO: 56782

SEQ ID NO: 751384 - RNA, 64 nt, hsa; identical to SEQ ID NO: 56783

SEQ ID NO: 751385 - RNA, 64 nt, hsa; identical to SEQ ID NO: 56784

SEQ ID NO: 751386 - RNA, 64 nt, hsa; identical to SEQ ID NO: 56785

SEQ ID NO: 751387 - RNA, 64 nt, hsa; identical to SEQ ID NO: 56786

SEQ ID NO: 751388 - RNA, 64 nt, hsa; identical to SEQ ID NO: 56787

SEQ ID NO: 751389 - RNA, 64 nt, hsa; identical to SEQ ID NO: 56788

SEQ ID NO: 751390 - RNA, 64 nt, hsa; identical to SEQ ID NO: 56789

SEQ ID NO: 751391 - RNA, 64 nt, hsa; identical to SEQ ID NO: 56790

SEQ ID NO: 751392 - RNA, 64 nt, hsa; identical to SEQ ID NO: 56791

SEQ ID NO: 751393 - RNA, 64 nt, hsa; identical to SEQ ID NO: 56792

SEQ ID NO: 751394 - RNA, 64 nt, hsa; identical to SEQ ID NO: 56793

SEQ ID NO: 751395 - RNA, 64 nt, hsa; identical to SEQ ID NO: 56794

SEQ ID NO: 751396 - RNA, 64 nt, hsa; identical to SEQ ID NO: 56795

SEQ ID NO: 751397 - RNA, 64 nt, hsa; identical to SEQ ID NO: 56796

SEQ ID NO: 751398 - RNA, 64 nt, hsa; identical to SEQ ID NO: 56797

SEQ ID NO: 751399 - RNA, 64 nt, hsa; identical to SEQ ID NO: 56798

SEQ ID NO: 751400 - RNA, 64 nt, hsa; identical to SEQ ID NO: 56799

SEQ ID NO: 751401 - RNA, 64 nt, hsa; identical to SEQ ID NO: 56800

SEQ ID NO: 751402 - RNA, 64 nt, hsa; identical to SEQ ID NO: 56801

SEQ ID NO: 751403 - RNA, 64 nt, hsa; identical to SEQ ID NO: 56802

SEQ ID NO: 751404 - RNA, 64 nt, hsa; identical to SEQ ID NO: 56803

SEQ ID NO: 751405 - RNA, 64 nt, hsa; identical to SEQ ID NO: 56804

SEQ ID NO: 751406 - RNA, 64 nt, hsa; identical to SEQ ID NO: 56805

SEQ ID NO: 751407 - RNA, 64 nt, hsa; identical to SEQ ID NO: 56806

SEQ ID NO: 751408 - RNA, 64 nt, hsa; identical to SEQ ID NO: 56807

SEQ ID NO: 751409 - RNA, 64 nt, hsa; identical to SEQ ID NO: 56808

SEQ ID NO: 751410 - RNA, 64 nt, hsa; identical to SEQ ID NO: 56809

SEQ ID NO: 751411 - RNA, 64 nt, hsa; identical to SEQ ID NO: 56810

SEQ ID NO: 751412 - RNA, 64 nt, hsa; identical to SEQ ID NO: 56811

SEQ ID NO: 751413 - RNA, 63 nt, hsa; identical to SEQ ID NO: 56812

SEQ ID NO: 751414 - RNA, 64 nt, hsa; identical to SEQ ID NO: 56813

SEQ ID NO: 751415 - RNA, 64 nt, hsa; identical to SEQ ID NO: 56814

SEQ ID NO: 751416 - RNA, 64 nt, hsa; identical to SEQ ID NO: 56815

SEQ ID NO: 751417 - RNA, 64 nt, hsa; identical to SEQ ID NO: 56816

SEQ ID NO: 751418 - RNA, 64 nt, hsa; identical to SEQ ID NO: 56817

SEQ ID NO: 751419 - RNA, 64 nt, hsa; identical to SEQ ID NO: 56818

SEQ ID NO: 751420 - RNA, 64 nt, hsa; identical to SEQ ID NO: 56819

SEQ ID NO: 751421 - RNA, 64 nt, hsa; identical to SEQ ID NO: 56820

SEQ ID NO: 751422 - RNA, 64 nt, hsa; identical to SEQ ID NO: 56821

SEQ ID NO: 751423 - RNA, 64 nt, hsa; identical to SEQ ID NO: 56822

SEQ ID NO: 751424 - RNA, 64 nt, hsa; identical to SEQ ID NO: 56823

SEQ ID NO: 751425 - RNA, 64 nt, hsa; identical to SEQ ID NO: 56824

SEQ ID NO: 751426 - RNA, 64 nt, hsa; identical to SEQ ID NO: 56825

SEQ ID NO: 751427 - RNA, 64 nt, hsa; identical to SEQ ID NO: 56826

SEQ ID NO: 751428 - RNA, 64 nt, hsa; identical to SEQ ID NO: 56827

SEQ ID NO: 751429 - RNA, 64 nt, hsa; identical to SEQ ID NO: 56828

SEQ ID NO: 751430 - RNA, 64 nt, hsa; identical to SEQ ID NO: 56829

SEQ ID NO: 751431 - RNA, 64 nt, hsa; identical to SEQ ID NO: 56830

SEQ ID NO: 751432 - RNA, 64 nt, hsa; identical to SEQ ID NO: 56831

SEQ ID NO: 751433 - RNA, 64 nt, hsa; identical to SEQ ID NO: 56832

SEQ ID NO: 751434 - RNA, 64 nt, hsa; identical to SEQ ID NO: 56833

SEQ ID NO: 751435 - RNA, 64 nt, hsa; identical to SEQ ID NO: 56834

SEQ ID NO: 751436 - RNA, 64 nt, hsa
gaagggcgaguaggggcaccuggacgcugaugguggccaggaugcucagcuggccaggagggca

SEQ ID NO: 751437 - RNA, 64 nt, hsa
accuggacgcugaugguggccaggaugcucagcuggccaggagggcagcaccugcuggggacgg

SEQ ID NO: 751438 - RNA, 64 nt, hsa
guuuguuuuggaaauaacagaaaagauauuuauuggccaggaaguuggugcugcuaagaccgag

SEQ ID NO: 751439 - RNA, 64 nt, hsa
ugcccugaagaccaccccagucuaccucggugcuggccaggaaaccuuucggcuaccucuccca

SEQ ID NO: 751440 - RNA, 64 nt, hsa
ugccugcaucugccacuuucugcuacccuagggaggccaggaggagcuucggaggaccaucgcc

SEQ ID NO: 751441 - RNA, 64 nt, hsa
aguuuagagauuugcggcaauggaccgaagaacgggccaggaaguccuccaauuuccuuugguc

SEQ ID NO: 751442 - RNA, 64 nt, hsa
uugaccucauaauggugcccacuuucucgacuuuggccaggauuuccuucaaagaaaacgacuu

SEQ ID NO: 751443 - RNA, 64 nt, hsa
uaucccucuaaggcgcaaggugaagaagcuucugggccaggaaggaaaaaaaaaugcccaccug

SEQ ID NO: 751444 - RNA, 64 nt, hsa
cacuuuggguggcugaggcagguggauuacuugaggccaggagauugagaccaguguggccaac

SEQ ID NO: 751445 - RNA, 64 nt, hsa
aaucacuugaaccuacgaggcggagguugcagugggccaggaucgugccacugcacuuuauuua

SEQ ID NO: 751446 - RNA, 64 nt, hsa
cauuuugggaggcugaggugggcagaucacuugaggccaggaguucgagaccagccuggccaac

SEQ ID NO: 751447 - RNA, 64 nt, hsa
aaagcaaauaagauuuaacaacccaagauuaagaggccaggaagagguuagacgcaaugugaaa

SEQ ID NO: 751448 - RNA, 64 nt, hsa
cagcugcacccacccugcuugaucccaccugggaggccaggacacugaggagcucugaacccag

SEQ ID NO: 751449 - RNA, 64 nt, hsa
ccacaaggcagcagaaagcgcggguccagaugagggccaggaaggggaggagagugagggccaa

SEQ ID NO: 751450 - RNA, 64 nt, hsa
aggucgugggcccagcucugacaggauguggaguggccaggaccaagacagcaagcuacgcaau

SEQ ID NO: 751451 - RNA, 64 nt, hsa
gcagccacccggccgccaaggcaggcuugggcugggccaggacacguggggugccugggacgcu

SEQ ID NO: 751452 - RNA, 64 nt, hsa
uggagguuaaaagagccuuuuggacagaaaacugggccaggaaaaggcaucucagaccacaaau

SEQ ID NO: 751453 - RNA, 64 nt, hsa
uguauuuuuaguagagacgggguuucacuguguuggccaggauggucucaaucucgaccucgug

SEQ ID NO: 751454 - RNA, 64 nt, hsa
uacugaaaugagccucguggggagcaucagagaaggccaggaagaaugguguguuucccuagac

SEQ ID NO: 751455 - RNA, 64 nt, hsa
auagcugggcuuacaggcaugagccaccacaccuggccaggauuugguuguuuaaauauaaauc

SEQ ID NO: 751456 - RNA, 64 nt, hsa
uguauuuuugguagagacgggguuucaccguguuggccaggauggucucaaucucgaccucgug

SEQ ID NO: 751457 - RNA, 64 nt, hsa; identical to SEQ ID NO: 751452

SEQ ID NO: 751458 - RNA, 64 nt, hsa
cacuuugggaggucgaggugggaggaucgcuugaggccaggaguucgagaccacccugggcaac

SEQ ID NO: 751459 - RNA, 64 nt, hsa
cgugcaggccucugcagaaggagcacuuggcccuggccaggaaccccuggaacugaggccacga

SEQ ID NO: 751460 - RNA, 64 nt, hsa
aaugcaaaagaauacauuagaaauggacaaaaguggccaggagcgguagcucauacuuguaacc

SEQ ID NO: 751461 - RNA, 64 nt, hsa
ugagggaugcugaaucucccagagagcucacacuggccaggaaugcugagaguagcagaugcuu

SEQ ID NO: 751462 - RNA, 64 nt, hsa
gcuaauauaaaaaugcuaagugaaaaaaagacuuggccaggagaaauaauuuaaaaugcacauu

SEQ ID NO: 751463 - RNA, 64 nt, hsa
ggugggccucagggaggauggggaucaagggacaggccaggagccaggaguggggaagggaggg

SEQ ID NO: 751464 - RNA, 64 nt, hsa
cugggguccccucauccacuugagggcgccugagggccaggagcagcaggcaaggagccugggu

SEQ ID NO: 751465 - RNA, 64 nt, hsa
uggugugacauccccaccagccucagaugagacgggccaggacgcccagccacagcaagcccug

SEQ ID NO: 751466 - RNA, 64 nt, hsa
ccaggcccagcgauagaucaggaggcaucauugaggccaggagcucugcccgugaccuguaucc

SEQ ID NO: 751467 - RNA, 64 nt, hsa
uacucuaucuuccauuccucgcccugcccccagaggccaggagcucugcccuugaccuguauuc

SEQ ID NO: 751468 - RNA, 64 nt, hsa
agggucugcuccugcugaggaccagcuguggcugggccaggacagaggacucaacccugcuccu

SEQ ID NO: 751469 - RNA, 64 nt, hsa
ucuacccuauggccacagcaggaggucagcccagggccaggagacacauggcuggacaaggcuu

SEQ ID NO: 751470 - RNA, 64 nt, hsa
aaaauaaaaaaaauuagcuaggcauaguaccugaggccaggagguccaggccgcaaugagaugu

SEQ ID NO: 751471 - RNA, 64 nt, hsa
cccuuuggaagguaaagacgggaggaucacuugaggccaggaguucaagaccagccugggcaac

SEQ ID NO: 751472 - RNA, 64 nt, hsa
gaggccuaccucucguuucugcccagcccucuguggccaggagcccuggcccgcaagagggaca

SEQ ID NO: 751473 - RNA, 64 nt, hsa
ggaagucccgcgaaacccggugcaucuggcacguggccaggagccaugacaggggcgcuuggga

SEQ ID NO: 751474 - RNA, 64 nt, hsa
gccaccuggucccuugugcugacucuagcacaguggccaggauccaauacgaguccagggguga

SEQ ID NO: 751475 - RNA, 64 nt, hsa
cccuugcccaaacaagaauauucuuaguuccacuggccaggauuuuccuacauagucagaacuu

SEQ ID NO: 751476 - RNA, 64 nt, hsa
acuuccucuuugagagucuggggagagaaaagguggccaggauccuaggacugaaugacucgau

SEQ ID NO: 751477 - RNA, 63 nt, hsa
gcccaggcuccaggaagugaccuugggcaguggggccaggaacacguggccugagagcugggc

SEQ ID NO: 751478 - RNA, 64 nt, hsa
ugcagaaggacuucuuccuguacaacgccuccaaggccaggagcaaaaccuacaucaacaugcg

SEQ ID NO: 751479 - RNA, 64 nt, hsa
gagcccuccaucaccuucacgcugucccaccaugggccaggaaccaaaccagcacuggguucua

SEQ ID NO: 751480 - RNA, 64 nt, hsa
gguagccgugcaggagagggcuggguggggcagaggccaggaggggaccuggugugucaccugc

SEQ ID NO: 751481 - RNA, 64 nt, hsa
ucucaggaucggauucuguuuuagaguguuucugggccaggauccgggccccugcccuccucug

SEQ ID NO: 751482 - RNA, 64 nt, hsa
uccacacagcauggggcuucagcugcuggcccaaggccaggagcgcuggguucugcagcagggc

SEQ ID NO: 751483 - RNA, 64 nt, hsa
ugcuccgggggguggaggugcuccccacaguccgggccaggacagccucaggggagagugaagg

SEQ ID NO: 751484 - RNA, 55 nt, hsa
ugcucauagagaacaagugagcuggggccaggaggcagcagccgugcagagccug

SEQ ID NO: 751485 - RNA, 64 nt, hsa
ucccggcagugcugacccugcagggcaagucaggggccaggaugcccucggaucagggccggga

SEQ ID NO: 751486 - RNA, 64 nt, hsa
cggcgguggcucacaccugcauaggcagugcuuuggccaggaggaucccuugaucccuuguggc

SEQ ID NO: 751487 - RNA, 64 nt, hsa
gugcuuuggccaggaggaucccuugaucccuuguggccaggaguugggagaccagccuggggac

SEQ ID NO: 751488 - RNA, 64 nt, hsa
gggugugacaccugcuugacagaggcagggcuguggccaggaccaaccuucaauuccauuccaa

SEQ ID NO: 751489 - RNA, 64 nt, hsa
agcacugggauuacaggcaugagccaccaugccuggccaggacauauuugaaauggggagauuu

SEQ ID NO: 751490 - RNA, 64 nt, hsa
guugugugggcugggcucuggugcccucuucccuggccaggacaccucuccuccugauucccuu

SEQ ID NO: 751491 - RNA, 64 nt, hsa
cuccugcccaucccucucuugagggagcagcaggggccaggagcuaccccaggagugggccagg

SEQ ID NO: 751492 - RNA, 64 nt, hsa
aucauggcuuuuggagggaggugaguuuagggagggccaggaccauccuccuaccccucauacc

SEQ ID NO: 751493 - RNA, 64 nt, hsa
cauauggccuauucugggcuagaccagauuugggggccaggagggaagaacuccauaugggaug

SEQ ID NO: 751494 - RNA, 64 nt, hsa
gaaaggcuggcaagugggagggagucaguggggaggccaggauagaacuagagcugguguccca

SEQ ID NO: 751495 - RNA, 64 nt, hsa
aagcagagggugagcaggggcugccccuccaccuggccaggacccccuucggcacccaguugcc

SEQ ID NO: 751496 - RNA, 64 nt, hsa
uaguccuggaaauguuugaggcuagacggggaggggccaggacccacccacugcuccuggggga

SEQ ID NO: 751497 - RNA, 64 nt, hsa
ugggcugaguucacccccagggcuggccagauggggccaggagggacagagcaaggggggugaa

SEQ ID NO: 751498 - RNA, 64 nt, hsa
auugucuuccaagauaggaagccaaguggguccaggccaggagauggggggggcgggggcagcu

SEQ ID NO: 751499 - RNA, 64 nt, hsa
ccccugaaacacugacucaggagguuugguugggggccaggagucuguuccuaaauauuccagg

SEQ ID NO: 751500 - RNA, 64 nt, hsa
cacuuuggaaggccgaggugggcagaucaucugaggccaggaguucaagaccagccuggcuaac

SEQ ID NO: 751501 - RNA, 64 nt, hsa
ucuguggggcagcggcgggcgcaggcucgacccgggccaggaggcccggggcgcugagcucagg

SEQ ID NO: 751502 - RNA, 64 nt, hsa
ggaaggugcuuuuggccccauugcgaggggccuuggccaggacuggcccuguggccaggaggcg

SEQ ID NO: 751503 - RNA, 64 nt, hsa
cauugcgaggggccuuggccaggacuggcccuguggccaggaggcgagaagguggcuguucccg

SEQ ID NO: 751504 - RNA, 64 nt, hsa
cacuuuggaaggcugaggaaggaggaucgcuugaggccaggaguuugagacuagccuaggcaac

SEQ ID NO: 751505 - RNA, 64 nt, hsa
cuacuucagaggcugagguggaaggaucacuugaggccaggaguuugaggcugcagugaguuau

SEQ ID NO: 751506 - RNA, 64 nt, hsa
aagcugugaagaagaaaaaaaccccuggccuuugggccaggaggaaucuguuacucgaauccac

SEQ ID NO: 751507 - RNA, 64 nt, hsa
gguuuugaagagucccuuaauaugugguggaacaggccaggaguuagagaaagggcuggcuucu

SEQ ID NO: 751508 - RNA, 64 nt, hsa
cagggcagccaccaggagagauaugccuggcaggggccaggacaaaaugcaaacuuuuuuuuuu

SEQ ID NO: 751509 - RNA, 64 nt, hsa
uguauuuuuaauagagaugggguuucaccauguuggccaggauggucucgaucuccugaccucu

SEQ ID NO: 751510 - RNA, 64 nt, hsa
uagagaggaggcuugaaggaaccagcaaugagaaggccaggaaaagaaagagcugaaaauggag

SEQ ID NO: 751511 - RNA, 64 nt, hsa
acccaccccacgacccgugacuacugugcaagcuggccaggagguagguggagggcaaggccac

SEQ ID NO: 751512 - RNA, 64 nt, hsa
ucccaggcaggggugaggguggccuggcccaggaggccaggaaggagggcccugucugccucca

SEQ ID NO: 751513 - RNA, 64 nt, hsa
augccaaagccccauggauucaggugcagaagagggccaggacuaggucuucugcccuuucuau

SEQ ID NO: 751514 - RNA, 64 nt, hsa
ucagcggggaaguucaccagauuucggcugcuggggccaggacaggcgucuccuagguugugcc

SEQ ID NO: 751515 - RNA, 64 nt, hsa
uagagggggagcuugcaggaaccagcaaugagaaggccaggaaaagaaagagcugaaaauggag

SEQ ID NO: 751516 - RNA, 64 nt, hsa
cagugcagccaccagggcagaaaugccgggcacaggccaggacaaaaugcagacuuuuuuuuuu

SEQ ID NO: 751517 - RNA, 64 nt, hsa
uuuucaugacaggucuauauuucuaccugggccaggccaggaaagagacuauuuaagaaaaaaa

SEQ ID NO: 751518 - RNA, 64 nt, hsa
aguaacuugccaccuuaaggcagggucauccccgggccaggaggaugagguuguccugaggggc

SEQ ID NO: 751519 - RNA, 64 nt, hsa
ggcuaaucccugcauuuccauucagggaaaaggugguagugagcauagaacugcaacaguuaua

SEQ ID NO: 751520 - RNA, 64 nt, hsa
ucugccucagaaaaaaaaaaaaauaauaaugcuggguagugaccuugugauuguuacagcuccc

SEQ ID NO: 751521 - RNA, 64 nt, hsa
augcuguuucuaugucguggaagcacuggauggggguagugagcaaaucugcccugcucagcag

SEQ ID NO: 751522 - RNA, 64 nt, hsa
ccacaagcacuuuuuuuuuuuuuaaagaaaaaaagguagugaauuuuuaaucaucuggacuuua

SEQ ID NO: 751523 - RNA, 64 nt, hsa
ccagucagaauaaugucaaagugcuuacagugcagguagugauaugugcaucuacugcagugaa

SEQ ID NO: 751524 - RNA, 64 nt, hsa
auucugcugugcaaauccaugcaaaacugacugugguagugaaaagucuguagaaaaguaaggg

SEQ ID NO: 751525 - RNA, 64 nt, hsa
aaguuaauaaauguguauguuuuguuguggguuugguagugaucugugguucuauaggguuuaa

SEQ ID NO: 751526 - RNA, 64 nt, hsa
aaugaaugcauuggcccugacaaaaaggugcuacgguagugaugaaauuauaaguagauuugua

SEQ ID NO: 751527 - RNA, 64 nt, hsa
auucauagaagggcuagaauaggagaaaaugaaagguagugaguaauucuuugauaagaugagg

SEQ ID NO: 751528 - RNA, 64 nt, hsa
ucaugacccuuucuggcagccucuuggugcucuggguagugagggaugaccagucuuguccuga

SEQ ID NO: 751529 - RNA, 64 nt, hsa
guauuugcuaaacacuaacuuaagcuaaugcuaggguagugacugagauguaaaaauagauuuu

SEQ ID NO: 751530 - RNA, 64 nt, hsa; identical to SEQ ID NO: 151176

SEQ ID NO: 751531 - RNA, 64 nt, hsa; identical to SEQ ID NO: 151177

SEQ ID NO: 751532 - RNA, 64 nt, hsa; identical to SEQ ID NO: 151178

SEQ ID NO: 751533 - RNA, 64 nt, hsa; identical to SEQ ID NO: 151179

SEQ ID NO: 751534 - RNA, 64 nt, hsa; identical to SEQ ID NO: 151180

SEQ ID NO: 751535 - RNA, 64 nt, hsa; identical to SEQ ID NO: 151181

SEQ ID NO: 751536 - RNA, 64 nt, hsa; identical to SEQ ID NO: 151182

SEQ ID NO: 751537 - RNA, 64 nt, hsa; identical to SEQ ID NO: 151183

SEQ ID NO: 751538 - RNA, 64 nt, hsa; identical to SEQ ID NO: 151184

SEQ ID NO: 751539 - RNA, 64 nt, hsa; identical to SEQ ID NO: 151185

SEQ ID NO: 751540 - RNA, 64 nt, hsa; identical to SEQ ID NO: 151186

SEQ ID NO: 751541 - RNA, 64 nt, hsa; identical to SEQ ID NO: 151187

SEQ ID NO: 751542 - RNA, 64 nt, hsa
ucugaauaacaaaugaaugcuuauugcugcaugauguaagcaaaagucauuauuuuuccuauuc

SEQ ID NO: 751543 - RNA, 64 nt, hsa
agagugauucucaccaaaaaaaguuaaacuauguuguaagcagccaacuguaaaugucuauuuu

SEQ ID NO: 751544 - RNA, 64 nt, hsa
ugagacuuugaucaccugaacuuucucuagcaaguguaagcagaauggagugugguuccaagag

SEQ ID NO: 751545 - RNA, 64 nt, hsa
ucuuuugugcucuuuuauaacuugcauuacauguuguaagcaugguccguucuauaccuuuuuc

SEQ ID NO: 751546 - RNA, 64 nt, hsa
guuaucuuagaaagacccccaaaggcuuugugauuguaagcacugucaugaucacagaaugcaa

SEQ ID NO: 751547 - RNA, 64 nt, hsa
aaaaggauuuuuuuuguuuaaaacuggauuucaauguaagcaaaugaagaaaaaaauauagauu

SEQ ID NO: 751548 - RNA, 64 nt, hsa
gugcuguaggaagauggacuguguugaucauggguguaagcaacccaguuuaagaaacauggca

SEQ ID NO: 751549 - RNA, 64 nt, hsa
auauagaguguuucuaggguaagggaccugcagguguaagcauagaugaaauaacuguccuguc

SEQ ID NO: 751550 - RNA, 64 nt, hsa
ugaaaaaucuuacacuggagagaaacccuaugaguguaagcaaugugggaaagccuuuguuucc

SEQ ID NO: 751551 - RNA, 64 nt, hsa
ugaaaggacucacacuggagagaaccccuaugaguguaagcaauuugggaaagccuucagaucu

SEQ ID NO: 751552 - RNA, 64 nt, hsa
ugaaaggaugcacagaggagagaagcucugugaauguaagcauugugggaaagcauucauaucu

SEQ ID NO: 751553 - RNA, 64 nt, hsa
caugaaagaacacacuagggagaaacccuaucaauguaagcaaugugcaaaagccuuuauuucu

SEQ ID NO: 751554 - RNA, 64 nt, hsa
uggaaggacucacacuggagaaaaacccuaugaauguaagcaguaugggaaagcguucagaccu

SEQ ID NO: 751555 - RNA, 64 nt, hsa
uaaaaggacucacaguggagaaaaacucuaugaguguaagcaaugugggaaagucuucagaucu

SEQ ID NO: 751556 - RNA, 64 nt, hsa
augaaaguugcacagaggagaggcgcccuaagaauguaagcauugugggaaagcauucauaucu

SEQ ID NO: 751557 - RNA, 64 nt, hsa
cauguaaagacacaccagaaggaaacccuaugaauguaagcaauguggcaaaagcuuucacuuc

SEQ ID NO: 751558 - RNA, 64 nt, hsa
ugaaaggacucacacuggggagaaaccguaucaauguaagcaaugugggaaagccgucagauca

SEQ ID NO: 751559 - RNA, 64 nt, hsa
uggaagcacucacacuuggcagaaacucuaugaauguaagcaguaugggaaagccuucagaucg

SEQ ID NO: 751560 - RNA, 64 nt, hsa
ugaaaggacucacacuggagagaaacccuaugaguguaagcaaugugggaaagccuucagaugu

SEQ ID NO: 751561 - RNA, 64 nt, hsa
ugaaaggacucacacuggagagaaacccuaugaguguaagcaaugugggaaagccuucagaucu

SEQ ID NO: 751562 - RNA, 64 nt, hsa
ugcugggacucacccugaagagaagcccuacgaguguaagcaaugugggaaagccuucagaucu

SEQ ID NO: 751563 - RNA, 64 nt, hsa
ugaaaaaucuuacacuggagagaaacccuaugaguguaagcaaugugggaaagccuuuauuucu

SEQ ID NO: 751564 - RNA, 64 nt, hsa
ugaaaggacucacacuggagagaaacccuaugaguguaagcaauguggaaaaaccuucagaucu

SEQ ID NO: 751565 - RNA, 64 nt, hsa
ugaaaccacucacagugcagagaaaccccaugaauguaagcaaugugggaaagcauuugaucau

SEQ ID NO: 751566 - RNA, 64 nt, hsa
ugaaagaacacguacuggggagaaacuguaugaauguaagcaguguucuaaagccuucccugau

SEQ ID NO: 751567 - RNA, 64 nt, hsa
ugaaagaacucacucuggagagaaacuauaugaauguaagcaguguucuaaagccuuucauuuu

SEQ ID NO: 751568 - RNA, 64 nt, hsa
gcugcgucagaccaguacugggaaggaggacgguuguaagcaguuguuauuuagugauauugug

SEQ ID NO: 751569 - RNA, 64 nt, hsa
auggugagguguggauaaggcuuaggugccaggcuguaagcauucugagcugggcuuguuguuu

SEQ ID NO: 751570 - RNA, 64 nt, hsa
aucgugucucaagguaguugcauaccuagucuggaguugugauuauuuucccaaaaaauguguu

SEQ ID NO: 751571 - RNA, 64 nt, hsa
aauuagcaggcugauuucuuuuuccucuuccgcuaguugugaaagacaggggaaggguguucuu

SEQ ID NO: 751572 - RNA, 64 nt, hsa
gugcauauauucauauuaaauucccauucauuugaguugugaccauuauuuuucauucacugaa

SEQ ID NO: 751573 - RNA, 64 nt, hsa
cuucauuuacuaaaucagccaguuaaugugauucaguugugaccugugggauuuuaaaauuuuc

SEQ ID NO: 751574 - RNA, 64 nt, hsa
agggcacaauagaaaccauggggcguggagcaugaguugugaauggcagggaucauucugggua

SEQ ID NO: 751575 - RNA, 64 nt, hsa
gacaacuaauuccuguuccaauucuaccuguuuuaguugugaagguaguuuuguguaauccagu

SEQ ID NO: 751576 - RNA, 64 nt, hsa
auacuuuuauuucuuccccuaucccuuccuuccuaguugugauaaacaugggagaggagugacu

SEQ ID NO: 751577 - RNA, 64 nt, hsa
gagaagaggacagaggaugugugggaaagcuggaaguugugacucucuuaccaagugcuuuccu

SEQ ID NO: 751578 - RNA, 64 nt, hsa
agagaaaguacguccauuucauuauggauuuuggaguugugagugauaggaucccaaaauucau

SEQ ID NO: 751579 - RNA, 64 nt, hsa
auauuuuaagaaguugaaagagaauuuauuuucaaguugugaguaaauccuccuuugaaauuca

SEQ ID NO: 751580 - RNA, 64 nt, hsa
aggcacagugguacugucuuuuuuguaagaugcuaguugugaaauacaauuaauugcauacagu

SEQ ID NO: 751581 - RNA, 64 nt, hsa
cauuugaagaaaaaauaaaacuguagacccuaacaguugugauauuuggugguuucauguggua

SEQ ID NO: 751582 - RNA, 64 nt, hsa
uggcuucccugagcugggguuucccugcuuguccaguugugagcuguccucgguguuaccgagg

SEQ ID NO: 751583 - RNA, 64 nt, hsa
ugaaacaauacucauaaugugaaguguuaauacuaguugugaccuuaguguuucugugcauggu

SEQ ID NO: 751584 - RNA, 64 nt, hsa
auggugucccaccugaguggccuuuagagaugugaguugugaggcacuggggaggcaggcacac

SEQ ID NO: 751585 - RNA, 64 nt, hsa
gucuccacccacaggacgccaguagcacccucuaaguugugagaacucaaaauguccccagagg

SEQ ID NO: 751586 - RNA, 64 nt, hsa; identical to SEQ ID NO: 214333

SEQ ID NO: 751587 - RNA, 64 nt, hsa; identical to SEQ ID NO: 214334

SEQ ID NO: 751588 - RNA, 64 nt, hsa; identical to SEQ ID NO: 172152

SEQ ID NO: 751589 - RNA, 64 nt, hsa; identical to SEQ ID NO: 172153

SEQ ID NO: 751590 - RNA, 64 nt, hsa; identical to SEQ ID NO: 172154

SEQ ID NO: 751591 - RNA, 64 nt, hsa; identical to SEQ ID NO: 172155

SEQ ID NO: 751592 - RNA, 64 nt, hsa; identical to SEQ ID NO: 172156

SEQ ID NO: 751593 - RNA, 64 nt, hsa; identical to SEQ ID NO: 172157

SEQ ID NO: 751594 - RNA, 64 nt, hsa; identical to SEQ ID NO: 172158

SEQ ID NO: 751595 - RNA, 64 nt, hsa; identical to SEQ ID NO: 172159

SEQ ID NO: 751596 - RNA, 64 nt, hsa; identical to SEQ ID NO: 172160

SEQ ID NO: 751597 - RNA, 64 nt, hsa; identical to SEQ ID NO: 172161

SEQ ID NO: 751598 - RNA, 64 nt, hsa; identical to SEQ ID NO: 172162

SEQ ID NO: 751599 - RNA, 64 nt, hsa; identical to SEQ ID NO: 172163

SEQ ID NO: 751600 - RNA, 64 nt, hsa; identical to SEQ ID NO: 172164

SEQ ID NO: 751601 - RNA, 64 nt, hsa; identical to SEQ ID NO: 172165

SEQ ID NO: 751602 - RNA, 64 nt, hsa; identical to SEQ ID NO: 214349

SEQ ID NO: 751603 - RNA, 64 nt, hsa; identical to SEQ ID NO: 214350

SEQ ID NO: 751604 - RNA, 64 nt, hsa; identical to SEQ ID NO: 214351

SEQ ID NO: 751605 - RNA, 64 nt, hsa; identical to SEQ ID NO: 214352

SEQ ID NO: 751606 - RNA, 64 nt, hsa; identical to SEQ ID NO: 214353

SEQ ID NO: 751607 - RNA, 64 nt, hsa; identical to SEQ ID NO: 214354

SEQ ID NO: 751608 - RNA, 64 nt, hsa; identical to SEQ ID NO: 214355

SEQ ID NO: 751609 - RNA, 64 nt, hsa; identical to SEQ ID NO: 214356

SEQ ID NO: 751610 - RNA, 64 nt, hsa; identical to SEQ ID NO: 214357

SEQ ID NO: 751611 - RNA, 64 nt, hsa; identical to SEQ ID NO: 214358

SEQ ID NO: 751612 - RNA, 50 nt, hsa; identical to SEQ ID NO: 214359

SEQ ID NO: 751613 - RNA, 64 nt, hsa; identical to SEQ ID NO: 214360

SEQ ID NO: 751614 - RNA, 64 nt, hsa; identical to SEQ ID NO: 214361

SEQ ID NO: 751615 - RNA, 64 nt, hsa; identical to SEQ ID NO: 214362

SEQ ID NO: 751616 - RNA, 64 nt, hsa; identical to SEQ ID NO: 214363

SEQ ID NO: 751617 - RNA, 64 nt, hsa; identical to SEQ ID NO: 214364

SEQ ID NO: 751618 - RNA, 64 nt, hsa; identical to SEQ ID NO: 214365

SEQ ID NO: 751619 - RNA, 64 nt, hsa; identical to SEQ ID NO: 214366

SEQ ID NO: 751620 - RNA, 64 nt, hsa; identical to SEQ ID NO: 214367

SEQ ID NO: 751621 - RNA, 64 nt, hsa; identical to SEQ ID NO: 214368

SEQ ID NO: 751622 - RNA, 64 nt, hsa; identical to SEQ ID NO: 214369

SEQ ID NO: 751623 - RNA, 64 nt, hsa; identical to SEQ ID NO: 214370

SEQ ID NO: 751624 - RNA, 64 nt, hsa; identical to SEQ ID NO: 214371

SEQ ID NO: 751625 - RNA, 64 nt, hsa; identical to SEQ ID NO: 214372

SEQ ID NO: 751626 - RNA, 64 nt, hsa; identical to SEQ ID NO: 214373

SEQ ID NO: 751627 - RNA, 64 nt, hsa; identical to SEQ ID NO: 214374

SEQ ID NO: 751628 - RNA, 64 nt, hsa; identical to SEQ ID NO: 214375

SEQ ID NO: 751629 - RNA, 64 nt, hsa; identical to SEQ ID NO: 214376

SEQ ID NO: 751630 - RNA, 64 nt, hsa; identical to SEQ ID NO: 214377

SEQ ID NO: 751631 - RNA, 64 nt, hsa; identical to SEQ ID NO: 214378

SEQ ID NO: 751632 - RNA, 64 nt, hsa; identical to SEQ ID NO: 214379

SEQ ID NO: 751633 - RNA, 64 nt, hsa; identical to SEQ ID NO: 214380

SEQ ID NO: 751634 - RNA, 64 nt, hsa; identical to SEQ ID NO: 214381

SEQ ID NO: 751635 - RNA, 64 nt, hsa; identical to SEQ ID NO: 214382

SEQ ID NO: 751636 - RNA, 64 nt, hsa; identical to SEQ ID NO: 214383

SEQ ID NO: 751637 - RNA, 64 nt, hsa; identical to SEQ ID NO: 214384

SEQ ID NO: 751638 - RNA, 64 nt, hsa; identical to SEQ ID NO: 214385

SEQ ID NO: 751639 - RNA, 64 nt, hsa; identical to SEQ ID NO: 214386

SEQ ID NO: 751640 - RNA, 64 nt, hsa; identical to SEQ ID NO: 214387

SEQ ID NO: 751641 - RNA, 64 nt, hsa; identical to SEQ ID NO: 214388

SEQ ID NO: 751642 - RNA, 64 nt, hsa; identical to SEQ ID NO: 214389

SEQ ID NO: 751643 - RNA, 64 nt, hsa; identical to SEQ ID NO: 214390

SEQ ID NO: 751644 - RNA, 64 nt, hsa; identical to SEQ ID NO: 214391

SEQ ID NO: 751645 - RNA, 64 nt, hsa; identical to SEQ ID NO: 214392

SEQ ID NO: 751646 - RNA, 64 nt, hsa; identical to SEQ ID NO: 214393

SEQ ID NO: 751647 - RNA, 64 nt, hsa; identical to SEQ ID NO: 214394

SEQ ID NO: 751648 - RNA, 64 nt, hsa; identical to SEQ ID NO: 214395

SEQ ID NO: 751649 - RNA, 64 nt, hsa; identical to SEQ ID NO: 214396

SEQ ID NO: 751650 - RNA, 64 nt, hsa; identical to SEQ ID NO: 214397

SEQ ID NO: 751651 - RNA, 64 nt, hsa; identical to SEQ ID NO: 214398

SEQ ID NO: 751652 - RNA, 64 nt, hsa; identical to SEQ ID NO: 214399

SEQ ID NO: 751653 - RNA, 64 nt, hsa; identical to SEQ ID NO: 214400

SEQ ID NO: 751654 - RNA, 64 nt, hsa; identical to SEQ ID NO: 214401

SEQ ID NO: 751655 - RNA, 64 nt, hsa; identical to SEQ ID NO: 214402

SEQ ID NO: 751656 - RNA, 64 nt, hsa; identical to SEQ ID NO: 214403

SEQ ID NO: 751657 - RNA, 64 nt, hsa; identical to SEQ ID NO: 214404

SEQ ID NO: 751658 - RNA, 64 nt, hsa; identical to SEQ ID NO: 214405

SEQ ID NO: 751659 - RNA, 64 nt, hsa; identical to SEQ ID NO: 214406

SEQ ID NO: 751660 - RNA, 64 nt, hsa; identical to SEQ ID NO: 214407

SEQ ID NO: 751661 - RNA, 64 nt, hsa; identical to SEQ ID NO: 214408

SEQ ID NO: 751662 - RNA, 64 nt, hsa; identical to SEQ ID NO: 214409

SEQ ID NO: 751663 - RNA, 64 nt, hsa; identical to SEQ ID NO: 214410

SEQ ID NO: 751664 - RNA, 64 nt, hsa; identical to SEQ ID NO: 214411

SEQ ID NO: 751665 - RNA, 64 nt, hsa; identical to SEQ ID NO: 214412

SEQ ID NO: 751666 - RNA, 64 nt, hsa; identical to SEQ ID NO: 214413

SEQ ID NO: 751667 - RNA, 64 nt, hsa; identical to SEQ ID NO: 214414

SEQ ID NO: 751668 - RNA, 64 nt, hsa; identical to SEQ ID NO: 214415

SEQ ID NO: 751669 - RNA, 64 nt, hsa; identical to SEQ ID NO: 214416

SEQ ID NO: 751670 - RNA, 64 nt, hsa; identical to SEQ ID NO: 214417

SEQ ID NO: 751671 - RNA, 64 nt, hsa; identical to SEQ ID NO: 214418

SEQ ID NO: 751672 - RNA, 64 nt, hsa; identical to SEQ ID NO: 214419

SEQ ID NO: 751673 - RNA, 64 nt, hsa; identical to SEQ ID NO: 214420

SEQ ID NO: 751674 - RNA, 64 nt, hsa; identical to SEQ ID NO: 214421

SEQ ID NO: 751675 - RNA, 64 nt, hsa; identical to SEQ ID NO: 214422

SEQ ID NO: 751676 - RNA, 64 nt, hsa; identical to SEQ ID NO: 214423

SEQ ID NO: 751677 - RNA, 64 nt, hsa; identical to SEQ ID NO: 214424

SEQ ID NO: 751678 - RNA, 64 nt, hsa; identical to SEQ ID NO: 214425

SEQ ID NO: 751679 - RNA, 64 nt, hsa; identical to SEQ ID NO: 214426

SEQ ID NO: 751680 - RNA, 64 nt, hsa; identical to SEQ ID NO: 214427

SEQ ID NO: 751681 - RNA, 64 nt, hsa; identical to SEQ ID NO: 214428

SEQ ID NO: 751682 - RNA, 64 nt, hsa; identical to SEQ ID NO: 214429

SEQ ID NO: 751683 - RNA, 62 nt, hsa; identical to SEQ ID NO: 214430

SEQ ID NO: 751684 - RNA, 64 nt, hsa; identical to SEQ ID NO: 214431

SEQ ID NO: 751685 - RNA, 64 nt, hsa; identical to SEQ ID NO: 214432

SEQ ID NO: 751686 - RNA, 64 nt, hsa; identical to SEQ ID NO: 214433

SEQ ID NO: 751687 - RNA, 64 nt, hsa; identical to SEQ ID NO: 214434

SEQ ID NO: 751688 - RNA, 64 nt, hsa; identical to SEQ ID NO: 214435

SEQ ID NO: 751689 - RNA, 64 nt, hsa; identical to SEQ ID NO: 214436

SEQ ID NO: 751690 - RNA, 53 nt, hsa; identical to SEQ ID NO: 214437

SEQ ID NO: 751691 - RNA, 64 nt, hsa; identical to SEQ ID NO: 214438

SEQ ID NO: 751692 - RNA, 64 nt, hsa; identical to SEQ ID NO: 214439

SEQ ID NO: 751693 - RNA, 64 nt, hsa; identical to SEQ ID NO: 214440

SEQ ID NO: 751694 - RNA, 64 nt, hsa; identical to SEQ ID NO: 214438

SEQ ID NO: 751695 - RNA, 64 nt, hsa; identical to SEQ ID NO: 214442

SEQ ID NO: 751696 - RNA, 64 nt, hsa; identical to SEQ ID NO: 214443

SEQ ID NO: 751697 - RNA, 64 nt, hsa; identical to SEQ ID NO: 214444

SEQ ID NO: 751698 - RNA, 64 nt, hsa; identical to SEQ ID NO: 214445

SEQ ID NO: 751699 - RNA, 64 nt, hsa; identical to SEQ ID NO: 214446

SEQ ID NO: 751700 - RNA, 64 nt, hsa; identical to SEQ ID NO: 214447

SEQ ID NO: 751701 - RNA, 64 nt, hsa; identical to SEQ ID NO: 214448

SEQ ID NO: 751702 - RNA, 64 nt, hsa; identical to SEQ ID NO: 214449

SEQ ID NO: 751703 - RNA, 64 nt, hsa; identical to SEQ ID NO: 214450

SEQ ID NO: 751704 - RNA, 64 nt, hsa; identical to SEQ ID NO: 214451

SEQ ID NO: 751705 - RNA, 64 nt, hsa; identical to SEQ ID NO: 214452

SEQ ID NO: 751706 - RNA, 64 nt, hsa; identical to SEQ ID NO: 214453

SEQ ID NO: 751707 - RNA, 64 nt, hsa; identical to SEQ ID NO: 214454

SEQ ID NO: 751708 - RNA, 64 nt, hsa; identical to SEQ ID NO: 214455

SEQ ID NO: 751709 - RNA, 64 nt, hsa; identical to SEQ ID NO: 214456

SEQ ID NO: 751710 - RNA, 64 nt, hsa; identical to SEQ ID NO: 214457

SEQ ID NO: 751711 - RNA, 64 nt, hsa; identical to SEQ ID NO: 214458

SEQ ID NO: 751712 - RNA, 64 nt, hsa; identical to SEQ ID NO: 214459

SEQ ID NO: 751713 - RNA, 64 nt, hsa; identical to SEQ ID NO: 214460

SEQ ID NO: 751714 - RNA, 63 nt, hsa; identical to SEQ ID NO: 214461

SEQ ID NO: 751715 - RNA, 64 nt, hsa; identical to SEQ ID NO: 214462

SEQ ID NO: 751716 - RNA, 64 nt, hsa; identical to SEQ ID NO: 214463

SEQ ID NO: 751717 - RNA, 64 nt, hsa; identical to SEQ ID NO: 214464

SEQ ID NO: 751718 - RNA, 64 nt, hsa; identical to SEQ ID NO: 214465

SEQ ID NO: 751719 - RNA, 64 nt, hsa; identical to SEQ ID NO: 214466

SEQ ID NO: 751720 - RNA, 64 nt, hsa; identical to SEQ ID NO: 214467

SEQ ID NO: 751721 - RNA, 64 nt, hsa; identical to SEQ ID NO: 214468

SEQ ID NO: 751722 - RNA, 64 nt, hsa; identical to SEQ ID NO: 214469

SEQ ID NO: 751723 - RNA, 64 nt, hsa; identical to SEQ ID NO: 214470

SEQ ID NO: 751724 - RNA, 64 nt, hsa; identical to SEQ ID NO: 214471

SEQ ID NO: 751725 - RNA, 64 nt, hsa; identical to SEQ ID NO: 214472

SEQ ID NO: 751726 - RNA, 64 nt, hsa; identical to SEQ ID NO: 214473

SEQ ID NO: 751727 - RNA, 64 nt, hsa; identical to SEQ ID NO: 214474

SEQ ID NO: 751728 - RNA, 64 nt, hsa; identical to SEQ ID NO: 214475

SEQ ID NO: 751729 - RNA, 64 nt, hsa; identical to SEQ ID NO: 214476

SEQ ID NO: 751730 - RNA, 64 nt, hsa; identical to SEQ ID NO: 214477

SEQ ID NO: 751731 - RNA, 64 nt, hsa; identical to SEQ ID NO: 214478

SEQ ID NO: 751732 - RNA, 64 nt, hsa; identical to SEQ ID NO: 214479

SEQ ID NO: 751733 - RNA, 64 nt, hsa; identical to SEQ ID NO: 214480

SEQ ID NO: 751734 - RNA, 64 nt, hsa; identical to SEQ ID NO: 214481

SEQ ID NO: 751735 - RNA, 64 nt, hsa; identical to SEQ ID NO: 214482

SEQ ID NO: 751736 - RNA, 64 nt, hsa; identical to SEQ ID NO: 214483

SEQ ID NO: 751737 - RNA, 64 nt, hsa; identical to SEQ ID NO: 214484

SEQ ID NO: 751738 - RNA, 64 nt, hsa; identical to SEQ ID NO: 214485

SEQ ID NO: 751739 - RNA, 64 nt, hsa; identical to SEQ ID NO: 214486

SEQ ID NO: 751740 - RNA, 64 nt, hsa; identical to SEQ ID NO: 214487

SEQ ID NO: 751741 - RNA, 64 nt, hsa; identical to SEQ ID NO: 214488

SEQ ID NO: 751742 - RNA, 64 nt, hsa; identical to SEQ ID NO: 214489

SEQ ID NO: 751743 - RNA, 64 nt, hsa; identical to SEQ ID NO: 214490

SEQ ID NO: 751744 - RNA, 64 nt, hsa; identical to SEQ ID NO: 214491

SEQ ID NO: 751745 - RNA, 64 nt, hsa; identical to SEQ ID NO: 214492

SEQ ID NO: 751746 - RNA, 64 nt, hsa; identical to SEQ ID NO: 214493

SEQ ID NO: 751747 - RNA, 64 nt, hsa; identical to SEQ ID NO: 214494

SEQ ID NO: 751748 - RNA, 64 nt, hsa; identical to SEQ ID NO: 214495

SEQ ID NO: 751749 - RNA, 64 nt, hsa; identical to SEQ ID NO: 214496

SEQ ID NO: 751750 - RNA, 64 nt, hsa; identical to SEQ ID NO: 214497

SEQ ID NO: 751751 - RNA, 64 nt, hsa; identical to SEQ ID NO: 214498

SEQ ID NO: 751752 - RNA, 64 nt, hsa; identical to SEQ ID NO: 214499

SEQ ID NO: 751753 - RNA, 64 nt, hsa; identical to SEQ ID NO: 214500

SEQ ID NO: 751754 - RNA, 64 nt, hsa; identical to SEQ ID NO: 214501

SEQ ID NO: 751755 - RNA, 64 nt, hsa; identical to SEQ ID NO: 214502

SEQ ID NO: 751756 - RNA, 64 nt, hsa; identical to SEQ ID NO: 214503

SEQ ID NO: 751757 - RNA, 64 nt, hsa; identical to SEQ ID NO: 214504

SEQ ID NO: 751758 - RNA, 64 nt, hsa; identical to SEQ ID NO: 214505

SEQ ID NO: 751759 - RNA, 64 nt, hsa; identical to SEQ ID NO: 214506

SEQ ID NO: 751760 - RNA, 64 nt, hsa; identical to SEQ ID NO: 214507

SEQ ID NO: 751761 - RNA, 64 nt, hsa; identical to SEQ ID NO: 214508

SEQ ID NO: 751762 - RNA, 64 nt, hsa; identical to SEQ ID NO: 214509

SEQ ID NO: 751763 - RNA, 64 nt, hsa; identical to SEQ ID NO: 214510

SEQ ID NO: 751764 - RNA, 64 nt, hsa; identical to SEQ ID NO: 214511

SEQ ID NO: 751765 - RNA, 64 nt, hsa; identical to SEQ ID NO: 214512

SEQ ID NO: 751766 - RNA, 64 nt, hsa; identical to SEQ ID NO: 214513

SEQ ID NO: 751767 - RNA, 64 nt, hsa; identical to SEQ ID NO: 214514

SEQ ID NO: 751768 - RNA, 64 nt, hsa; identical to SEQ ID NO: 214515

SEQ ID NO: 751769 - RNA, 64 nt, hsa; identical to SEQ ID NO: 214516

SEQ ID NO: 751770 - RNA, 64 nt, hsa; identical to SEQ ID NO: 214517

SEQ ID NO: 751771 - RNA, 64 nt, hsa; identical to SEQ ID NO: 214518

SEQ ID NO: 751772 - RNA, 64 nt, hsa; identical to SEQ ID NO: 214519

SEQ ID NO: 751773 - RNA, 64 nt, hsa; identical to SEQ ID NO: 214520

SEQ ID NO: 751774 - RNA, 64 nt, hsa; identical to SEQ ID NO: 214521

SEQ ID NO: 751775 - RNA, 64 nt, hsa; identical to SEQ ID NO: 214522

SEQ ID NO: 751776 - RNA, 64 nt, hsa; identical to SEQ ID NO: 214523

SEQ ID NO: 751777 - RNA, 64 nt, hsa; identical to SEQ ID NO: 214524

SEQ ID NO: 751778 - RNA, 64 nt, hsa; identical to SEQ ID NO: 214525

SEQ ID NO: 751779 - RNA, 64 nt, hsa; identical to SEQ ID NO: 214526

SEQ ID NO: 751780 - RNA, 64 nt, hsa; identical to SEQ ID NO: 214527

SEQ ID NO: 751781 - RNA, 64 nt, hsa; identical to SEQ ID NO: 214528

SEQ ID NO: 751782 - RNA, 64 nt, hsa; identical to SEQ ID NO: 214529

SEQ ID NO: 751783 - RNA, 64 nt, hsa; identical to SEQ ID NO: 214530

SEQ ID NO: 751784 - RNA, 64 nt, hsa; identical to SEQ ID NO: 214531

SEQ ID NO: 751785 - RNA, 64 nt, hsa; identical to SEQ ID NO: 214532

SEQ ID NO: 751786 - RNA, 64 nt, hsa; identical to SEQ ID NO: 214533

SEQ ID NO: 751787 - RNA, 64 nt, hsa; identical to SEQ ID NO: 214534

SEQ ID NO: 751788 - RNA, 64 nt, hsa; identical to SEQ ID NO: 214535

SEQ ID NO: 751789 - RNA, 64 nt, hsa; identical to SEQ ID NO: 214536

SEQ ID NO: 751790 - RNA, 64 nt, hsa; identical to SEQ ID NO: 214537

SEQ ID NO: 751791 - RNA, 64 nt, hsa; identical to SEQ ID NO: 214538

SEQ ID NO: 751792 - RNA, 64 nt, hsa; identical to SEQ ID NO: 214539

SEQ ID NO: 751793 - RNA, 64 nt, hsa; identical to SEQ ID NO: 214540

SEQ ID NO: 751794 - RNA, 62 nt, hsa; identical to SEQ ID NO: 214541

SEQ ID NO: 751795 - RNA, 62 nt, hsa; identical to SEQ ID NO: 214542

SEQ ID NO: 751796 - RNA, 62 nt, hsa; identical to SEQ ID NO: 214543

SEQ ID NO: 751797 - RNA, 62 nt, hsa; identical to SEQ ID NO: 214544

SEQ ID NO: 751798 - RNA, 62 nt, hsa; identical to SEQ ID NO: 214545

SEQ ID NO: 751799 - RNA, 62 nt, hsa; identical to SEQ ID NO: 214546

SEQ ID NO: 751800 - RNA, 62 nt, hsa; identical to SEQ ID NO: 214547

SEQ ID NO: 751801 - RNA, 62 nt, hsa; identical to SEQ ID NO: 214548

SEQ ID NO: 751802 - RNA, 62 nt, hsa; identical to SEQ ID NO: 214549

SEQ ID NO: 751803 - RNA, 62 nt, hsa; identical to SEQ ID NO: 214550

SEQ ID NO: 751804 - RNA, 62 nt, hsa; identical to SEQ ID NO: 214551

SEQ ID NO: 751805 - RNA, 62 nt, hsa; identical to SEQ ID NO: 214552

SEQ ID NO: 751806 - RNA, 62 nt, hsa; identical to SEQ ID NO: 214553

SEQ ID NO: 751807 - RNA, 62 nt, hsa; identical to SEQ ID NO: 214554

SEQ ID NO: 751808 - RNA, 62 nt, hsa; identical to SEQ ID NO: 214555

SEQ ID NO: 751809 - RNA, 62 nt, hsa; identical to SEQ ID NO: 214556

SEQ ID NO: 751810 - RNA, 62 nt, hsa; identical to SEQ ID NO: 214557

SEQ ID NO: 751811 - RNA, 62 nt, hsa; identical to SEQ ID NO: 214558

SEQ ID NO: 751812 - RNA, 62 nt, hsa; identical to SEQ ID NO: 214559

SEQ ID NO: 751813 - RNA, 62 nt, hsa; identical to SEQ ID NO: 214560

SEQ ID NO: 751814 - RNA, 62 nt, hsa; identical to SEQ ID NO: 214561

SEQ ID NO: 751815 - RNA, 54 nt, hsa; identical to SEQ ID NO: 214562

SEQ ID NO: 751816 - RNA, 62 nt, hsa; identical to SEQ ID NO: 214563

SEQ ID NO: 751817 - RNA, 62 nt, hsa; identical to SEQ ID NO: 214564

SEQ ID NO: 751818 - RNA, 62 nt, hsa; identical to SEQ ID NO: 214565

SEQ ID NO: 751819 - RNA, 62 nt, hsa; identical to SEQ ID NO: 214566

SEQ ID NO: 751820 - RNA, 62 nt, hsa; identical to SEQ ID NO: 214567

SEQ ID NO: 751821 - RNA, 62 nt, hsa; identical to SEQ ID NO: 214568

SEQ ID NO: 751822 - RNA, 62 nt, hsa; identical to SEQ ID NO: 214569

SEQ ID NO: 751823 - RNA, 62 nt, hsa; identical to SEQ ID NO: 214570

SEQ ID NO: 751824 - RNA, 62 nt, hsa; identical to SEQ ID NO: 214571

SEQ ID NO: 751825 - RNA, 62 nt, hsa; identical to SEQ ID NO: 214572

SEQ ID NO: 751826 - RNA, 62 nt, hsa; identical to SEQ ID NO: 214573

SEQ ID NO: 751827 - RNA, 62 nt, hsa; identical to SEQ ID NO: 214574

SEQ ID NO: 751828 - RNA, 62 nt, hsa; identical to SEQ ID NO: 214575

SEQ ID NO: 751829 - RNA, 62 nt, hsa; identical to SEQ ID NO: 214576

SEQ ID NO: 751830 - RNA, 62 nt, hsa; identical to SEQ ID NO: 214577

SEQ ID NO: 751831 - RNA, 62 nt, hsa; identical to SEQ ID NO: 214578

SEQ ID NO: 751832 - RNA, 62 nt, hsa; identical to SEQ ID NO: 214579

SEQ ID NO: 751833 - RNA, 62 nt, hsa; identical to SEQ ID NO: 214580

SEQ ID NO: 751834 - RNA, 62 nt, hsa; identical to SEQ ID NO: 214581

SEQ ID NO: 751835 - RNA, 62 nt, hsa; identical to SEQ ID NO: 214582

SEQ ID NO: 751836 - RNA, 62 nt, hsa; identical to SEQ ID NO: 214583

SEQ ID NO: 751837 - RNA, 62 nt, hsa; identical to SEQ ID NO: 214584

SEQ ID NO: 751838 - RNA, 62 nt, hsa; identical to SEQ ID NO: 214585

SEQ ID NO: 751839 - RNA, 62 nt, hsa; identical to SEQ ID NO: 214586

SEQ ID NO: 751840 - RNA, 62 nt, hsa; identical to SEQ ID NO: 214587

SEQ ID NO: 751841 - RNA, 62 nt, hsa; identical to SEQ ID NO: 214588

SEQ ID NO: 751842 - RNA, 62 nt, hsa; identical to SEQ ID NO: 214589

SEQ ID NO: 751843 - RNA, 62 nt, hsa; identical to SEQ ID NO: 214590

SEQ ID NO: 751844 - RNA, 62 nt, hsa; identical to SEQ ID NO: 214591

SEQ ID NO: 751845 - RNA, 62 nt, hsa; identical to SEQ ID NO: 214592

SEQ ID NO: 751846 - RNA, 62 nt, hsa; identical to SEQ ID NO: 214593

SEQ ID NO: 751847 - RNA, 62 nt, hsa; identical to SEQ ID NO: 214594

SEQ ID NO: 751848 - RNA, 62 nt, hsa; identical to SEQ ID NO: 214595

SEQ ID NO: 751849 - RNA, 62 nt, hsa; identical to SEQ ID NO: 214596

SEQ ID NO: 751850 - RNA, 62 nt, hsa; identical to SEQ ID NO: 214597

SEQ ID NO: 751851 - RNA, 62 nt, hsa; identical to SEQ ID NO: 214598

SEQ ID NO: 751852 - RNA, 62 nt, hsa; identical to SEQ ID NO: 214599

SEQ ID NO: 751853 - RNA, 62 nt, hsa; identical to SEQ ID NO: 214600

SEQ ID NO: 751854 - RNA, 62 nt, hsa; identical to SEQ ID NO: 214601

SEQ ID NO: 751855 - RNA, 62 nt, hsa; identical to SEQ ID NO: 214602

SEQ ID NO: 751856 - RNA, 62 nt, hsa; identical to SEQ ID NO: 214603

SEQ ID NO: 751857 - RNA, 62 nt, hsa; identical to SEQ ID NO: 214604

SEQ ID NO: 751858 - RNA, 62 nt, hsa; identical to SEQ ID NO: 214605

SEQ ID NO: 751859 - RNA, 62 nt, hsa; identical to SEQ ID NO: 214606

SEQ ID NO: 751860 - RNA, 62 nt, hsa; identical to SEQ ID NO: 214607

SEQ ID NO: 751861 - RNA, 62 nt, hsa; identical to SEQ ID NO: 214608

SEQ ID NO: 751862 - RNA, 62 nt, hsa; identical to SEQ ID NO: 214609

SEQ ID NO: 751863 - RNA, 62 nt, hsa; identical to SEQ ID NO: 214610

SEQ ID NO: 751864 - RNA, 62 nt, hsa; identical to SEQ ID NO: 214611

SEQ ID NO: 751865 - RNA, 62 nt, hsa; identical to SEQ ID NO: 214612

SEQ ID NO: 751866 - RNA, 62 nt, hsa; identical to SEQ ID NO: 214613

SEQ ID NO: 751867 - RNA, 62 nt, hsa; identical to SEQ ID NO: 214614

SEQ ID NO: 751868 - RNA, 62 nt, hsa; identical to SEQ ID NO: 214615

SEQ ID NO: 751869 - RNA, 62 nt, hsa; identical to SEQ ID NO: 214616

SEQ ID NO: 751870 - RNA, 62 nt, hsa; identical to SEQ ID NO: 214617

SEQ ID NO: 751871 - RNA, 62 nt, hsa; identical to SEQ ID NO: 214618

SEQ ID NO: 751872 - RNA, 62 nt, hsa; identical to SEQ ID NO: 214619

SEQ ID NO: 751873 - RNA, 62 nt, hsa; identical to SEQ ID NO: 214620

SEQ ID NO: 751874 - RNA, 62 nt, hsa; identical to SEQ ID NO: 214621

SEQ ID NO: 751875 - RNA, 62 nt, hsa; identical to SEQ ID NO: 214622

SEQ ID NO: 751876 - RNA, 62 nt, hsa; identical to SEQ ID NO: 214623

SEQ ID NO: 751877 - RNA, 62 nt, hsa; identical to SEQ ID NO: 214624

SEQ ID NO: 751878 - RNA, 62 nt, hsa; identical to SEQ ID NO: 214625

SEQ ID NO: 751879 - RNA, 62 nt, hsa; identical to SEQ ID NO: 214626

SEQ ID NO: 751880 - RNA, 62 nt, hsa; identical to SEQ ID NO: 214627

SEQ ID NO: 751881 - RNA, 62 nt, hsa; identical to SEQ ID NO: 214628

SEQ ID NO: 751882 - RNA, 62 nt, hsa; identical to SEQ ID NO: 214629

SEQ ID NO: 751883 - RNA, 62 nt, hsa; identical to SEQ ID NO: 214630

SEQ ID NO: 751884 - RNA, 62 nt, hsa; identical to SEQ ID NO: 214631

SEQ ID NO: 751885 - RNA, 62 nt, hsa; identical to SEQ ID NO: 214632

SEQ ID NO: 751886 - RNA, 62 nt, hsa; identical to SEQ ID NO: 214633

SEQ ID NO: 751887 - RNA, 62 nt, hsa; identical to SEQ ID NO: 214634

SEQ ID NO: 751888 - RNA, 62 nt, hsa; identical to SEQ ID NO: 214635

SEQ ID NO: 751889 - RNA, 62 nt, hsa; identical to SEQ ID NO: 214636

SEQ ID NO: 751890 - RNA, 62 nt, hsa; identical to SEQ ID NO: 214637

SEQ ID NO: 751891 - RNA, 62 nt, hsa; identical to SEQ ID NO: 214638

SEQ ID NO: 751892 - RNA, 62 nt, hsa; identical to SEQ ID NO: 214639

SEQ ID NO: 751893 - RNA, 62 nt, hsa; identical to SEQ ID NO: 214640

SEQ ID NO: 751894 - RNA, 62 nt, hsa; identical to SEQ ID NO: 214641

SEQ ID NO: 751895 - RNA, 62 nt, hsa; identical to SEQ ID NO: 214642

SEQ ID NO: 751896 - RNA, 62 nt, hsa; identical to SEQ ID NO: 214643

SEQ ID NO: 751897 - RNA, 62 nt, hsa; identical to SEQ ID NO: 214644

SEQ ID NO: 751898 - RNA, 62 nt, hsa; identical to SEQ ID NO: 214645

SEQ ID NO: 751899 - RNA, 62 nt, hsa; identical to SEQ ID NO: 214646

SEQ ID NO: 751900 - RNA, 62 nt, hsa; identical to SEQ ID NO: 214647

SEQ ID NO: 751901 - RNA, 62 nt, hsa; identical to SEQ ID NO: 214648

SEQ ID NO: 751902 - RNA, 62 nt, hsa; identical to SEQ ID NO: 214649

SEQ ID NO: 751903 - RNA, 62 nt, hsa; identical to SEQ ID NO: 214650

SEQ ID NO: 751904 - RNA, 62 nt, hsa; identical to SEQ ID NO: 214651

SEQ ID NO: 751905 - RNA, 62 nt, hsa; identical to SEQ ID NO: 214652

SEQ ID NO: 751906 - RNA, 62 nt, hsa; identical to SEQ ID NO: 214653

SEQ ID NO: 751907 - RNA, 62 nt, hsa; identical to SEQ ID NO: 214654

SEQ ID NO: 751908 - RNA, 62 nt, hsa; identical to SEQ ID NO: 214655

SEQ ID NO: 751909 - RNA, 62 nt, hsa; identical to SEQ ID NO: 214656

SEQ ID NO: 751910 - RNA, 62 nt, hsa; identical to SEQ ID NO: 214657

SEQ ID NO: 751911 - RNA, 62 nt, hsa; identical to SEQ ID NO: 214658

SEQ ID NO: 751912 - RNA, 62 nt, hsa; identical to SEQ ID NO: 214659

SEQ ID NO: 751913 - RNA, 62 nt, hsa; identical to SEQ ID NO: 214660

SEQ ID NO: 751914 - RNA, 62 nt, hsa; identical to SEQ ID NO: 214661

SEQ ID NO: 751915 - RNA, 62 nt, hsa; identical to SEQ ID NO: 214662

SEQ ID NO: 751916 - RNA, 62 nt, hsa; identical to SEQ ID NO: 214663

SEQ ID NO: 751917 - RNA, 62 nt, hsa; identical to SEQ ID NO: 214664

SEQ ID NO: 751918 - RNA, 62 nt, hsa; identical to SEQ ID NO: 214665

SEQ ID NO: 751919 - RNA, 62 nt, hsa; identical to SEQ ID NO: 214666

SEQ ID NO: 751920 - RNA, 62 nt, hsa; identical to SEQ ID NO: 214667

SEQ ID NO: 751921 - RNA, 62 nt, hsa; identical to SEQ ID NO: 214668

SEQ ID NO: 751922 - RNA, 62 nt, hsa; identical to SEQ ID NO: 214669

SEQ ID NO: 751923 - RNA, 62 nt, hsa; identical to SEQ ID NO: 214670

SEQ ID NO: 751924 - RNA, 62 nt, hsa; identical to SEQ ID NO: 214671

SEQ ID NO: 751925 - RNA, 61 nt, hsa; identical to SEQ ID NO: 214672

SEQ ID NO: 751926 - RNA, 61 nt, hsa; identical to SEQ ID NO: 214673

SEQ ID NO: 751927 - RNA, 61 nt, hsa; identical to SEQ ID NO: 214674

SEQ ID NO: 751928 - RNA, 61 nt, hsa; identical to SEQ ID NO: 214675

SEQ ID NO: 751929 - RNA, 61 nt, hsa; identical to SEQ ID NO: 214676

SEQ ID NO: 751930 - RNA, 61 nt, hsa; identical to SEQ ID NO: 214677

SEQ ID NO: 751931 - RNA, 61 nt, hsa; identical to SEQ ID NO: 214678

SEQ ID NO: 751932 - RNA, 61 nt, hsa; identical to SEQ ID NO: 214679

SEQ ID NO: 751933 - RNA, 61 nt, hsa; identical to SEQ ID NO: 214680

SEQ ID NO: 751934 - RNA, 61 nt, hsa; identical to SEQ ID NO: 214681

SEQ ID NO: 751935 - RNA, 61 nt, hsa; identical to SEQ ID NO: 214682

SEQ ID NO: 751936 - RNA, 61 nt, hsa; identical to SEQ ID NO: 214683

SEQ ID NO: 751937 - RNA, 61 nt, hsa; identical to SEQ ID NO: 214684

SEQ ID NO: 751938 - RNA, 55 nt, hsa; identical to SEQ ID NO: 214685

SEQ ID NO: 751939 - RNA, 61 nt, hsa; identical to SEQ ID NO: 214686

SEQ ID NO: 751940 - RNA, 61 nt, hsa; identical to SEQ ID NO: 214687

SEQ ID NO: 751941 - RNA, 61 nt, hsa; identical to SEQ ID NO: 214688

SEQ ID NO: 751942 - RNA, 61 nt, hsa; identical to SEQ ID NO: 214689

SEQ ID NO: 751943 - RNA, 61 nt, hsa; identical to SEQ ID NO: 214690

SEQ ID NO: 751944 - RNA, 61 nt, hsa; identical to SEQ ID NO: 214691

SEQ ID NO: 751945 - RNA, 61 nt, hsa; identical to SEQ ID NO: 214692

SEQ ID NO: 751946 - RNA, 61 nt, hsa; identical to SEQ ID NO: 214693

SEQ ID NO: 751947 - RNA, 61 nt, hsa; identical to SEQ ID NO: 214694

SEQ ID NO: 751948 - RNA, 61 nt, hsa; identical to SEQ ID NO: 214695

SEQ ID NO: 751949 - RNA, 61 nt, hsa; identical to SEQ ID NO: 214696

SEQ ID NO: 751950 - RNA, 61 nt, hsa; identical to SEQ ID NO: 214697

SEQ ID NO: 751951 - RNA, 61 nt, hsa; identical to SEQ ID NO: 214698

SEQ ID NO: 751952 - RNA, 61 nt, hsa; identical to SEQ ID NO: 214699

SEQ ID NO: 751953 - RNA, 61 nt, hsa; identical to SEQ ID NO: 214700

SEQ ID NO: 751954 - RNA, 61 nt, hsa; identical to SEQ ID NO: 214701

SEQ ID NO: 751955 - RNA, 61 nt, hsa; identical to SEQ ID NO: 214702

SEQ ID NO: 751956 - RNA, 61 nt, hsa; identical to SEQ ID NO: 214703

SEQ ID NO: 751957 - RNA, 61 nt, hsa; identical to SEQ ID NO: 214704

SEQ ID NO: 751958 - RNA, 61 nt, hsa; identical to SEQ ID NO: 214705

SEQ ID NO: 751959 - RNA, 61 nt, hsa; identical to SEQ ID NO: 214706

SEQ ID NO: 751960 - RNA, 61 nt, hsa; identical to SEQ ID NO: 214707

SEQ ID NO: 751961 - RNA, 61 nt, hsa; identical to SEQ ID NO: 214708

SEQ ID NO: 751962 - RNA, 61 nt, hsa; identical to SEQ ID NO: 214709

SEQ ID NO: 751963 - RNA, 61 nt, hsa; identical to SEQ ID NO: 214710

SEQ ID NO: 751964 - RNA, 61 nt, hsa; identical to SEQ ID NO: 214711

SEQ ID NO: 751965 - RNA, 61 nt, hsa; identical to SEQ ID NO: 214712

SEQ ID NO: 751966 - RNA, 61 nt, hsa; identical to SEQ ID NO: 214713

SEQ ID NO: 751967 - RNA, 61 nt, hsa; identical to SEQ ID NO: 214714

SEQ ID NO: 751968 - RNA, 61 nt, hsa; identical to SEQ ID NO: 214715

SEQ ID NO: 751969 - RNA, 61 nt, hsa; identical to SEQ ID NO: 214716

SEQ ID NO: 751970 - RNA, 61 nt, hsa; identical to SEQ ID NO: 214717

SEQ ID NO: 751971 - RNA, 61 nt, hsa; identical to SEQ ID NO: 214718

SEQ ID NO: 751972 - RNA, 61 nt, hsa; identical to SEQ ID NO: 214719

SEQ ID NO: 751973 - RNA, 61 nt, hsa; identical to SEQ ID NO: 214720

SEQ ID NO: 751974 - RNA, 61 nt, hsa; identical to SEQ ID NO: 214721

SEQ ID NO: 751975 - RNA, 61 nt, hsa; identical to SEQ ID NO: 214722

SEQ ID NO: 751976 - RNA, 61 nt, hsa; identical to SEQ ID NO: 214723

SEQ ID NO: 751977 - RNA, 61 nt, hsa; identical to SEQ ID NO: 214724

SEQ ID NO: 751978 - RNA, 61 nt, hsa; identical to SEQ ID NO: 214725

SEQ ID NO: 751979 - RNA, 61 nt, hsa; identical to SEQ ID NO: 214726

SEQ ID NO: 751980 - RNA, 61 nt, hsa; identical to SEQ ID NO: 214727

SEQ ID NO: 751981 - RNA, 61 nt, hsa; identical to SEQ ID NO: 214728

SEQ ID NO: 751982 - RNA, 61 nt, hsa; identical to SEQ ID NO: 214729

SEQ ID NO: 751983 - RNA, 61 nt, hsa; identical to SEQ ID NO: 214730

SEQ ID NO: 751984 - RNA, 61 nt, hsa; identical to SEQ ID NO: 214731

SEQ ID NO: 751985 - RNA, 61 nt, hsa; identical to SEQ ID NO: 214732

SEQ ID NO: 751986 - RNA, 61 nt, hsa; identical to SEQ ID NO: 214733

SEQ ID NO: 751987 - RNA, 61 nt, hsa; identical to SEQ ID NO: 214734

SEQ ID NO: 751988 - RNA, 61 nt, hsa; identical to SEQ ID NO: 214735

SEQ ID NO: 751989 - RNA, 61 nt, hsa; identical to SEQ ID NO: 214736

SEQ ID NO: 751990 - RNA, 61 nt, hsa; identical to SEQ ID NO: 214737

SEQ ID NO: 751991 - RNA, 61 nt, hsa; identical to SEQ ID NO: 214738

SEQ ID NO: 751992 - RNA, 61 nt, hsa; identical to SEQ ID NO: 214739

SEQ ID NO: 751993 - RNA, 61 nt, hsa; identical to SEQ ID NO: 214740

SEQ ID NO: 751994 - RNA, 61 nt, hsa; identical to SEQ ID NO: 214741

SEQ ID NO: 751995 - RNA, 61 nt, hsa; identical to SEQ ID NO: 214742

SEQ ID NO: 751996 - RNA, 61 nt, hsa; identical to SEQ ID NO: 214743

SEQ ID NO: 751997 - RNA, 61 nt, hsa; identical to SEQ ID NO: 214744

SEQ ID NO: 751998 - RNA, 61 nt, hsa; identical to SEQ ID NO: 214745

SEQ ID NO: 751999 - RNA, 61 nt, hsa; identical to SEQ ID NO: 214746

SEQ ID NO: 752000 - RNA, 61 nt, hsa; identical to SEQ ID NO: 214747

SEQ ID NO: 752001 - RNA, 61 nt, hsa; identical to SEQ ID NO: 214748

SEQ ID NO: 752002 - RNA, 61 nt, hsa; identical to SEQ ID NO: 214749

SEQ ID NO: 752003 - RNA, 61 nt, hsa; identical to SEQ ID NO: 214750

SEQ ID NO: 752004 - RNA, 61 nt, hsa; identical to SEQ ID NO: 214751

SEQ ID NO: 752005 - RNA, 61 nt, hsa; identical to SEQ ID NO: 214752

SEQ ID NO: 752006 - RNA, 61 nt, hsa; identical to SEQ ID NO: 214753

SEQ ID NO: 752007 - RNA, 61 nt, hsa; identical to SEQ ID NO: 214754

SEQ ID NO: 752008 - RNA, 61 nt, hsa; identical to SEQ ID NO: 214755

SEQ ID NO: 752009 - RNA, 61 nt, hsa; identical to SEQ ID NO: 214756

SEQ ID NO: 752010 - RNA, 61 nt, hsa; identical to SEQ ID NO: 214757

SEQ ID NO: 752011 - RNA, 61 nt, hsa; identical to SEQ ID NO: 214758

SEQ ID NO: 752012 - RNA, 61 nt, hsa; identical to SEQ ID NO: 214759

SEQ ID NO: 752013 - RNA, 61 nt, hsa; identical to SEQ ID NO: 214760

SEQ ID NO: 752014 - RNA, 61 nt, hsa; identical to SEQ ID NO: 214761

SEQ ID NO: 752015 - RNA, 61 nt, hsa; identical to SEQ ID NO: 214762

SEQ ID NO: 752016 - RNA, 61 nt, hsa; identical to SEQ ID NO: 214763

SEQ ID NO: 752017 - RNA, 61 nt, hsa; identical to SEQ ID NO: 214764

SEQ ID NO: 752018 - RNA, 61 nt, hsa; identical to SEQ ID NO: 214765

SEQ ID NO: 752019 - RNA, 61 nt, hsa; identical to SEQ ID NO: 214766

SEQ ID NO: 752020 - RNA, 61 nt, hsa; identical to SEQ ID NO: 214767

SEQ ID NO: 752021 - RNA, 61 nt, hsa; identical to SEQ ID NO: 214768

SEQ ID NO: 752022 - RNA, 61 nt, hsa; identical to SEQ ID NO: 214769

SEQ ID NO: 752023 - RNA, 61 nt, hsa; identical to SEQ ID NO: 214770

SEQ ID NO: 752024 - RNA, 61 nt, hsa; identical to SEQ ID NO: 214771

SEQ ID NO: 752025 - RNA, 61 nt, hsa; identical to SEQ ID NO: 214772

SEQ ID NO: 752026 - RNA, 61 nt, hsa; identical to SEQ ID NO: 214773

SEQ ID NO: 752027 - RNA, 61 nt, hsa; identical to SEQ ID NO: 214774

SEQ ID NO: 752028 - RNA, 61 nt, hsa; identical to SEQ ID NO: 214775

SEQ ID NO: 752029 - RNA, 61 nt, hsa; identical to SEQ ID NO: 214776

SEQ ID NO: 752030 - RNA, 61 nt, hsa; identical to SEQ ID NO: 214777

SEQ ID NO: 752031 - RNA, 61 nt, hsa; identical to SEQ ID NO: 214778

SEQ ID NO: 752032 - RNA, 61 nt, hsa; identical to SEQ ID NO: 214779

SEQ ID NO: 752033 - RNA, 61 nt, hsa; identical to SEQ ID NO: 214780

SEQ ID NO: 752034 - RNA, 61 nt, hsa; identical to SEQ ID NO: 214781

SEQ ID NO: 752035 - RNA, 61 nt, hsa; identical to SEQ ID NO: 214782

SEQ ID NO: 752036 - RNA, 61 nt, hsa; identical to SEQ ID NO: 214783

SEQ ID NO: 752037 - RNA, 58 nt, hsa; identical to SEQ ID NO: 214784

SEQ ID NO: 752038 - RNA, 61 nt, hsa; identical to SEQ ID NO: 214785

SEQ ID NO: 752039 - RNA, 61 nt, hsa; identical to SEQ ID NO: 214786

SEQ ID NO: 752040 - RNA, 61 nt, hsa; identical to SEQ ID NO: 214787

SEQ ID NO: 752041 - RNA, 61 nt, hsa; identical to SEQ ID NO: 214788

SEQ ID NO: 752042 - RNA, 61 nt, hsa; identical to SEQ ID NO: 214789

SEQ ID NO: 752043 - RNA, 61 nt, hsa; identical to SEQ ID NO: 214790

SEQ ID NO: 752044 - RNA, 61 nt, hsa; identical to SEQ ID NO: 214791

SEQ ID NO: 752045 - RNA, 61 nt, hsa; identical to SEQ ID NO: 214792

SEQ ID NO: 752046 - RNA, 61 nt, hsa; identical to SEQ ID NO: 214793

SEQ ID NO: 752047 - RNA, 61 nt, hsa; identical to SEQ ID NO: 214794

SEQ ID NO: 752048 - RNA, 61 nt, hsa; identical to SEQ ID NO: 214795

SEQ ID NO: 752049 - RNA, 61 nt, hsa; identical to SEQ ID NO: 214796

SEQ ID NO: 752050 - RNA, 61 nt, hsa; identical to SEQ ID NO: 214797

SEQ ID NO: 752051 - RNA, 61 nt, hsa; identical to SEQ ID NO: 214798

SEQ ID NO: 752052 - RNA, 61 nt, hsa; identical to SEQ ID NO: 214799

SEQ ID NO: 752053 - RNA, 61 nt, hsa; identical to SEQ ID NO: 214800

SEQ ID NO: 752054 - RNA, 61 nt, hsa; identical to SEQ ID NO: 214801

SEQ ID NO: 752055 - RNA, 61 nt, hsa; identical to SEQ ID NO: 214802

SEQ ID NO: 752056 - RNA, 61 nt, hsa; identical to SEQ ID NO: 214803

SEQ ID NO: 752057 - RNA, 61 nt, hsa; identical to SEQ ID NO: 214804

SEQ ID NO: 752058 - RNA, 61 nt, hsa; identical to SEQ ID NO: 214805

SEQ ID NO: 752059 - RNA, 61 nt, hsa; identical to SEQ ID NO: 214806

SEQ ID NO: 752060 - RNA, 61 nt, hsa; identical to SEQ ID NO: 214807

SEQ ID NO: 752061 - RNA, 61 nt, hsa; identical to SEQ ID NO: 214808

SEQ ID NO: 752062 - RNA, 61 nt, hsa; identical to SEQ ID NO: 214809

SEQ ID NO: 752063 - RNA, 61 nt, hsa; identical to SEQ ID NO: 214810

SEQ ID NO: 752064 - RNA, 61 nt, hsa; identical to SEQ ID NO: 214811

SEQ ID NO: 752065 - RNA, 61 nt, hsa; identical to SEQ ID NO: 214812

SEQ ID NO: 752066 - RNA, 61 nt, hsa; identical to SEQ ID NO: 214813

SEQ ID NO: 752067 - RNA, 61 nt, hsa; identical to SEQ ID NO: 214814

SEQ ID NO: 752068 - RNA, 61 nt, hsa; identical to SEQ ID NO: 214815

SEQ ID NO: 752069 - RNA, 61 nt, hsa; identical to SEQ ID NO: 214816

SEQ ID NO: 752070 - RNA, 61 nt, hsa; identical to SEQ ID NO: 214817

SEQ ID NO: 752071 - RNA, 61 nt, hsa; identical to SEQ ID NO: 214818

SEQ ID NO: 752072 - RNA, 61 nt, hsa; identical to SEQ ID NO: 214819

SEQ ID NO: 752073 - RNA, 61 nt, hsa; identical to SEQ ID NO: 214820

SEQ ID NO: 752074 - RNA, 61 nt, hsa; identical to SEQ ID NO: 214821

SEQ ID NO: 752075 - RNA, 61 nt, hsa; identical to SEQ ID NO: 214822

SEQ ID NO: 752076 - RNA, 61 nt, hsa; identical to SEQ ID NO: 214823

SEQ ID NO: 752077 - RNA, 61 nt, hsa; identical to SEQ ID NO: 214824

SEQ ID NO: 752078 - RNA, 61 nt, hsa; identical to SEQ ID NO: 214825

SEQ ID NO: 752079 - RNA, 58 nt, hsa; identical to SEQ ID NO: 214826

SEQ ID NO: 752080 - RNA, 61 nt, hsa; identical to SEQ ID NO: 214827

SEQ ID NO: 752081 - RNA, 61 nt, hsa; identical to SEQ ID NO: 214828

SEQ ID NO: 752082 - RNA, 61 nt, hsa; identical to SEQ ID NO: 214829

SEQ ID NO: 752083 - RNA, 61 nt, hsa; identical to SEQ ID NO: 214830

SEQ ID NO: 752084 - RNA, 61 nt, hsa; identical to SEQ ID NO: 214831

SEQ ID NO: 752085 - RNA, 61 nt, hsa; identical to SEQ ID NO: 214832

SEQ ID NO: 752086 - RNA, 61 nt, hsa; identical to SEQ ID NO: 214833

SEQ ID NO: 752087 - RNA, 61 nt, hsa; identical to SEQ ID NO: 214834

SEQ ID NO: 752088 - RNA, 61 nt, hsa; identical to SEQ ID NO: 214835

SEQ ID NO: 752089 - RNA, 61 nt, hsa; identical to SEQ ID NO: 214836

SEQ ID NO: 752090 - RNA, 61 nt, hsa; identical to SEQ ID NO: 214837

SEQ ID NO: 752091 - RNA, 61 nt, hsa; identical to SEQ ID NO: 214838

SEQ ID NO: 752092 - RNA, 61 nt, hsa; identical to SEQ ID NO: 214839

SEQ ID NO: 752093 - RNA, 64 nt, hsa; identical to SEQ ID NO: 669302

SEQ ID NO: 752094 - RNA, 64 nt, hsa; identical to SEQ ID NO: 669303

SEQ ID NO: 752095 - RNA, 64 nt, hsa; identical to SEQ ID NO: 669304

SEQ ID NO: 752096 - RNA, 64 nt, hsa; identical to SEQ ID NO: 669305

SEQ ID NO: 752097 - RNA, 64 nt, hsa; identical to SEQ ID NO: 669306

SEQ ID NO: 752098 - RNA, 64 nt, hsa; identical to SEQ ID NO: 669307

SEQ ID NO: 752099 - RNA, 64 nt, hsa; identical to SEQ ID NO: 669308

SEQ ID NO: 752100 - RNA, 64 nt, hsa; identical to SEQ ID NO: 669309

SEQ ID NO: 752101 - RNA, 64 nt, hsa; identical to SEQ ID NO: 669310

SEQ ID NO: 752102 - RNA, 64 nt, hsa; identical to SEQ ID NO: 669311

SEQ ID NO: 752103 - RNA, 64 nt, hsa; identical to SEQ ID NO: 669312

SEQ ID NO: 752104 - RNA, 64 nt, hsa; identical to SEQ ID NO: 669313

SEQ ID NO: 752105 - RNA, 62 nt, hsa
ugccuugcuuaacucuaaagcuccauguccugggccuaaaaucguauaaaaucuggauuuuu

SEQ ID NO: 752106 - RNA, 62 nt, hsa
uuaggaguugugcaacagcucuuuugagaggaggccuaaaggacaggagaaaaggucuucaa

SEQ ID NO: 752107 - RNA, 64 nt, hsa
uugguacuacauaaugacuugcuccacacaugcaguaaacuacauaaugauguacugguaaacu

SEQ ID NO: 752108 - RNA, 64 nt, hsa
ccacacaugcaguaaacuacauaaugauguacugguaaacuagaaacaaagaaugcagcaggau

SEQ ID NO: 752109 - RNA, 64 nt, hsa
cagaaugugcaagaacuuuugcauuuuaaucguuguaaacuaacagcuuaaacuauugacucua

SEQ ID NO: 752110 - RNA, 64 nt, hsa
uaaauauuuacacuaauaucaauuacauauuuugguaaacuagagagacauaauuagagaugca

SEQ ID NO: 752111 - RNA, 64 nt, hsa
gacugauguauguaaucaacuucauugggcugcaguaaacuaguggaaauuagagaguuguuuu

SEQ ID NO: 752112 - RNA, 64 nt, hsa
uggucuggucaguauugccuggcugacgugaaauguaaacuaguaggcguguuauugaucugcu

SEQ ID NO: 752113 - RNA, 64 nt, hsa
auauuaaacacaucugcaggacacauuuugccauguaaacuaacauucacugguuccagggauu

SEQ ID NO: 752114 - RNA, 64 nt, hsa
uggcagggccaagguccccacuuucuugcugacuguaaacuaaggccacuuccagcuuguagag

SEQ ID NO: 752115 - RNA, 64 nt, hsa
uugaggaaaagcacuugugugauugaauugugagguaaacuaccugauuuuuuuuuguuguuac

SEQ ID NO: 752116 - RNA, 64 nt, hsa
aguuucuguauuagucaccugccgugcacucacaguaaacuacauuacucaacugaguauuacc

SEQ ID NO: 752117 - RNA, 64 nt, hsa
uuaucuuaaaaucauauuugaagacaguaagacaguaaacuauuuuaggaagucaacccccauu

SEQ ID NO: 752118 - RNA, 64 nt, hsa
cucucccaagauucauuuaguucaaacaguauccguaaacuaggaauaaugccacaugcauuca

SEQ ID NO: 752119 - RNA, 64 nt, hsa; identical to SEQ ID NO: 110917

SEQ ID NO: 752120 - RNA, 64 nt, hsa; identical to SEQ ID NO: 110918

SEQ ID NO: 752121 - RNA, 64 nt, hsa; identical to SEQ ID NO: 110919

SEQ ID NO: 752122 - RNA, 64 nt, hsa; identical to SEQ ID NO: 110920

SEQ ID NO: 752123 - RNA, 64 nt, hsa; identical to SEQ ID NO: 110921

SEQ ID NO: 752124 - RNA, 64 nt, hsa; identical to SEQ ID NO: 110922

SEQ ID NO: 752125 - RNA, 64 nt, hsa; identical to SEQ ID NO: 110923

SEQ ID NO: 752126 - RNA, 64 nt, hsa; identical to SEQ ID NO: 110924

SEQ ID NO: 752127 - RNA, 64 nt, hsa; identical to SEQ ID NO: 110925

SEQ ID NO: 752128 - RNA, 64 nt, hsa; identical to SEQ ID NO: 110926

SEQ ID NO: 752129 - RNA, 64 nt, hsa; identical to SEQ ID NO: 110927

SEQ ID NO: 752130 - RNA, 64 nt, hsa; identical to SEQ ID NO: 110928

SEQ ID NO: 752131 - RNA, 61 nt, hsa; identical to SEQ ID NO: 110929

SEQ ID NO: 752132 - RNA, 64 nt, hsa; identical to SEQ ID NO: 110930

SEQ ID NO: 752133 - RNA, 64 nt, hsa; identical to SEQ ID NO: 110931

SEQ ID NO: 752134 - RNA, 64 nt, hsa; identical to SEQ ID NO: 110932

SEQ ID NO: 752135 - RNA, 64 nt, hsa; identical to SEQ ID NO: 110933

SEQ ID NO: 752136 - RNA, 64 nt, hsa; identical to SEQ ID NO: 110934

SEQ ID NO: 752137 - RNA, 64 nt, hsa; identical to SEQ ID NO: 110935

SEQ ID NO: 752138 - RNA, 64 nt, hsa; identical to SEQ ID NO: 110936

SEQ ID NO: 752139 - RNA, 64 nt, hsa; identical to SEQ ID NO: 110937

SEQ ID NO: 752140 - RNA, 64 nt, hsa; identical to SEQ ID NO: 110938

SEQ ID NO: 752141 - RNA, 64 nt, hsa; identical to SEQ ID NO: 110939

SEQ ID NO: 752142 - RNA, 64 nt, hsa; identical to SEQ ID NO: 110940

SEQ ID NO: 752143 - RNA, 64 nt, hsa; identical to SEQ ID NO: 110941

SEQ ID NO: 752144 - RNA, 64 nt, hsa; identical to SEQ ID NO: 110942

SEQ ID NO: 752145 - RNA, 64 nt, hsa; identical to SEQ ID NO: 110943

SEQ ID NO: 752146 - RNA, 64 nt, hsa; identical to SEQ ID NO: 110944

SEQ ID NO: 752147 - RNA, 64 nt, hsa; identical to SEQ ID NO: 110945

SEQ ID NO: 752148 - RNA, 64 nt, hsa; identical to SEQ ID NO: 110946

SEQ ID NO: 752149 - RNA, 64 nt, hsa; identical to SEQ ID NO: 110947

SEQ ID NO: 752150 - RNA, 64 nt, hsa; identical to SEQ ID NO: 110948

SEQ ID NO: 752151 - RNA, 64 nt, hsa; identical to SEQ ID NO: 110949

SEQ ID NO: 752152 - RNA, 64 nt, hsa; identical to SEQ ID NO: 110950

SEQ ID NO: 752153 - RNA, 64 nt, hsa; identical to SEQ ID NO: 110951

SEQ ID NO: 752154 - RNA, 64 nt, hsa; identical to SEQ ID NO: 110952

SEQ ID NO: 752155 - RNA, 64 nt, hsa; identical to SEQ ID NO: 110953

SEQ ID NO: 752156 - RNA, 64 nt, hsa; identical to SEQ ID NO: 110954

SEQ ID NO: 752157 - RNA, 64 nt, hsa; identical to SEQ ID NO: 110955

SEQ ID NO: 752158 - RNA, 64 nt, hsa; identical to SEQ ID NO: 110956

SEQ ID NO: 752159 - RNA, 64 nt, hsa; identical to SEQ ID NO: 110957

SEQ ID NO: 752160 - RNA, 64 nt, hsa; identical to SEQ ID NO: 110958

SEQ ID NO: 752161 - RNA, 64 nt, hsa; identical to SEQ ID NO: 665692

SEQ ID NO: 752162 - RNA, 64 nt, hsa; identical to SEQ ID NO: 665693

SEQ ID NO: 752163 - RNA, 64 nt, hsa; identical to SEQ ID NO: 665694

SEQ ID NO: 752164 - RNA, 64 nt, hsa; identical to SEQ ID NO: 665695

SEQ ID NO: 752165 - RNA, 64 nt, hsa; identical to SEQ ID NO: 81043

SEQ ID NO: 752166 - RNA, 64 nt, hsa; identical to SEQ ID NO: 81044

SEQ ID NO: 752167 - RNA, 64 nt, hsa; identical to SEQ ID NO: 81045

SEQ ID NO: 752168 - RNA, 64 nt, hsa; identical to SEQ ID NO: 81046

SEQ ID NO: 752169 - RNA, 64 nt, hsa; identical to SEQ ID NO: 81047

SEQ ID NO: 752170 - RNA, 64 nt, hsa; identical to SEQ ID NO: 81048

SEQ ID NO: 752171 - RNA, 64 nt, hsa; identical to SEQ ID NO: 81049

SEQ ID NO: 752172 - RNA, 64 nt, hsa; identical to SEQ ID NO: 81050

SEQ ID NO: 752173 - RNA, 64 nt, hsa; identical to SEQ ID NO: 81051

SEQ ID NO: 752174 - RNA, 64 nt, hsa; identical to SEQ ID NO: 81052

SEQ ID NO: 752175 - RNA, 64 nt, hsa; identical to SEQ ID NO: 81053

SEQ ID NO: 752176 - RNA, 64 nt, hsa; identical to SEQ ID NO: 81054

SEQ ID NO: 752177 - RNA, 64 nt, hsa; identical to SEQ ID NO: 81055

SEQ ID NO: 752178 - RNA, 64 nt, hsa; identical to SEQ ID NO: 81056

SEQ ID NO: 752179 - RNA, 64 nt, hsa; identical to SEQ ID NO: 81057

SEQ ID NO: 752180 - RNA, 64 nt, hsa; identical to SEQ ID NO: 81058

SEQ ID NO: 752181 - RNA, 64 nt, hsa; identical to SEQ ID NO: 81059

SEQ ID NO: 752182 - RNA, 64 nt, hsa; identical to SEQ ID NO: 81060

SEQ ID NO: 752183 - RNA, 64 nt, hsa; identical to SEQ ID NO: 81061

SEQ ID NO: 752184 - RNA, 64 nt, hsa; identical to SEQ ID NO: 81062

SEQ ID NO: 752185 - RNA, 64 nt, hsa; identical to SEQ ID NO: 81063

SEQ ID NO: 752186 - RNA, 64 nt, hsa; identical to SEQ ID NO: 81064

SEQ ID NO: 752187 - RNA, 64 nt, hsa; identical to SEQ ID NO: 81065

SEQ ID NO: 752188 - RNA, 64 nt, hsa; identical to SEQ ID NO: 81066

SEQ ID NO: 752189 - RNA, 64 nt, hsa; identical to SEQ ID NO: 81067

SEQ ID NO: 752190 - RNA, 64 nt, hsa; identical to SEQ ID NO: 81068

SEQ ID NO: 752191 - RNA, 64 nt, hsa; identical to SEQ ID NO: 81069

SEQ ID NO: 752192 - RNA, 64 nt, hsa; identical to SEQ ID NO: 81070

SEQ ID NO: 752193 - RNA, 64 nt, hsa; identical to SEQ ID NO: 81071

SEQ ID NO: 752194 - RNA, 64 nt, hsa; identical to SEQ ID NO: 81072

SEQ ID NO: 752195 - RNA, 64 nt, hsa; identical to SEQ ID NO: 81073

SEQ ID NO: 752196 - RNA, 64 nt, hsa; identical to SEQ ID NO: 81074

SEQ ID NO: 752197 - RNA, 64 nt, hsa; identical to SEQ ID NO: 81075

SEQ ID NO: 752198 - RNA, 64 nt, hsa; identical to SEQ ID NO: 81076

SEQ ID NO: 752199 - RNA, 64 nt, hsa; identical to SEQ ID NO: 81077

SEQ ID NO: 752200 - RNA, 64 nt, hsa; identical to SEQ ID NO: 81078

SEQ ID NO: 752201 - RNA, 64 nt, hsa; identical to SEQ ID NO: 81079

SEQ ID NO: 752202 - RNA, 64 nt, hsa; identical to SEQ ID NO: 81080

SEQ ID NO: 752203 - RNA, 64 nt, hsa; identical to SEQ ID NO: 81081

SEQ ID NO: 752204 - RNA, 64 nt, hsa; identical to SEQ ID NO: 81082

SEQ ID NO: 752205 - RNA, 64 nt, hsa; identical to SEQ ID NO: 81083

SEQ ID NO: 752206 - RNA, 64 nt, hsa; identical to SEQ ID NO: 81084

SEQ ID NO: 752207 - RNA, 64 nt, hsa; identical to SEQ ID NO: 81085

SEQ ID NO: 752208 - RNA, 64 nt, hsa; identical to SEQ ID NO: 81086

SEQ ID NO: 752209 - RNA, 64 nt, hsa; identical to SEQ ID NO: 81087

SEQ ID NO: 752210 - RNA, 64 nt, hsa; identical to SEQ ID NO: 81088

SEQ ID NO: 752211 - RNA, 64 nt, hsa; identical to SEQ ID NO: 81089

SEQ ID NO: 752212 - RNA, 64 nt, hsa
ccuuacuaagcugagagaugucauugcugcaggcaggacguauaggcacauguagguuugaaug

SEQ ID NO: 752213 - RNA, 64 nt, hsa
gacuuguguauauggucauaggcuuugggaagacaggacguaaaggaaaaugagagaaacaaaa

SEQ ID NO: 752214 - RNA, 64 nt, hsa
uggggcuucaagacaguaggugagagaugcugucaggacguaucuucuucauaccaaagucacu

SEQ ID NO: 752215 - RNA, 64 nt, hsa
caaagagacagacuauuaacuccacaguuaauuaaggacguauguuccauguuuauuuguuaaa

SEQ ID NO: 752216 - RNA, 64 nt, hsa
ggaaacuaagguuagaaacauuuugauuuccucuaggacguauagcuaggaaguguuacuaucu

SEQ ID NO: 752217 - RNA, 64 nt, hsa
aaucaaaaucucuccacuuucagcugucuuuuggaggacguacguaauaagguuuuaauuuagu

SEQ ID NO: 752218 - RNA, 64 nt, hsa
uugccaugucccccagacccugcuucugauacuaaggacguauccaggaguaccacaaccacca

SEQ ID NO: 752219 - RNA, 64 nt, hsa
cacauaggcgagguugagcugcuggucccagcugaggacguacuggucagccuggcuguguggc

SEQ ID NO: 752220 - RNA, 64 nt, hsa
agauuugugaauccuauaauacugcucaagcuggaggacguagaauuucacuggaucagcaaug

SEQ ID NO: 752221 - RNA, 64 nt, hsa
auggaauuuuuucaucuuauacugagcuccagaaaggacguaacuuagcauggaucaccaauca

SEQ ID NO: 752222 - RNA, 54 nt, hsa
cacgagaagagcuaggguaagagaaggacguaaacagaaccugacaccagcucc

SEQ ID NO: 752223 - RNA, 64 nt, hsa
uuaaaauucucuuuggucauugagggaccaaaaaaggacguaaaauuuacagucaaucuaugag

SEQ ID NO: 752224 - RNA, 64 nt, hsa
gucuaaaucuguaggcauuguguuguuguucuuuaggacguauuuauuuaacuugcacauuuuu

SEQ ID NO: 752225 - RNA, 64 nt, hsa
cgggacaccagugaaacuugaaccgggaagugggaggacguagagcagagaagagaacauuuuu

SEQ ID NO: 752226 - RNA, 64 nt, hsa
aagugcccaguucuugauuucuuagauacugaagaggacguagucauuucauuuaucaaauaua

SEQ ID NO: 752227 - RNA, 64 nt, hsa
accugcagaguaaacaaucucagaaguaucgacuaggacguaaauagcaguuccuuauauaaag

SEQ ID NO: 752228 - RNA, 64 nt, hsa
uuacuggaaaguuacccaauagcaugaggugaacaggacguaguuaggccuuccuguaaacaga

SEQ ID NO: 752229 - RNA, 64 nt, hsa
agacugcaaaucaaugaagguauuggcauuguuaaggacguagcguagacaacagcagucauaa

SEQ ID NO: 752230 - RNA, 64 nt, hsa
cuggauuuugcagauuuuccuguccaugcaagcaaggacguaaaauuaaaaaauuacaauuaaa

SEQ ID NO: 752231 - RNA, 64 nt, hsa
ugaggugucggaacgcugaaagcaugaggaaacgaggacguagggugugacugaaugguggcua

SEQ ID NO: 752232 - RNA, 64 nt, hsa
uuucaggagaagggagcauaaguuuacagccuacaggacguacacaauauccugcugcugggaa

SEQ ID NO: 752233 - RNA, 64 nt, hsa
caguguggccagggguggccauguaagucccaucaggacguagucaugccuccugcauuucgcu

SEQ ID NO: 752234 - RNA, 64 nt, hsa
aguaaauuaugauguccagggggagaaggaagauaggacguauuuauaauagguauauagaaca

SEQ ID NO: 752235 - RNA, 64 nt, hsa
acgagaccucuuucguuccuucuagaaggucuggaggacguagaguuauugaaaaugcagaugg

SEQ ID NO: 752236 - RNA, 64 nt, hsa
augagggacacuggccuggcccucgggucuucggaggacguagggggcuggcaugggugccgac

SEQ ID NO: 752237 - RNA, 64 nt, hsa
ugugcgugcguggcugggggaggccuuuucuuugaggacguaccucauuuccuucuuucuucug

SEQ ID NO: 752238 - RNA, 64 nt, hsa
agauaccaauagagagguuuucuuaauuaacaaaaggacguaugccauggagaaacacacccgc

SEQ ID NO: 752239 - RNA, 64 nt, hsa
gcugagggggaucugguucggcugcugucggaugaggacguagcgcucauggugcggcaggcuc

SEQ ID NO: 752240 - RNA, 64 nt, hsa; identical to SEQ ID NO: 88546

SEQ ID NO: 752241 - RNA, 64 nt, hsa; identical to SEQ ID NO: 88547

SEQ ID NO: 752242 - RNA, 51 nt, hsa; identical to SEQ ID NO: 88548

SEQ ID NO: 752243 - RNA, 64 nt, hsa; identical to SEQ ID NO: 88549

SEQ ID NO: 752244 - RNA, 64 nt, hsa; identical to SEQ ID NO: 88550

SEQ ID NO: 752245 - RNA, 64 nt, hsa; identical to SEQ ID NO: 88551

SEQ ID NO: 752246 - RNA, 64 nt, hsa; identical to SEQ ID NO: 88552

SEQ ID NO: 752247 - RNA, 64 nt, hsa; identical to SEQ ID NO: 88553

SEQ ID NO: 752248 - RNA, 64 nt, hsa; identical to SEQ ID NO: 88554

SEQ ID NO: 752249 - RNA, 64 nt, hsa; identical to SEQ ID NO: 88555

SEQ ID NO: 752250 - RNA, 64 nt, hsa; identical to SEQ ID NO: 88556

SEQ ID NO: 752251 - RNA, 64 nt, hsa; identical to SEQ ID NO: 88557

SEQ ID NO: 752252 - RNA, 64 nt, hsa; identical to SEQ ID NO: 88558

SEQ ID NO: 752253 - RNA, 64 nt, hsa; identical to SEQ ID NO: 88559

SEQ ID NO: 752254 - RNA, 64 nt, hsa; identical to SEQ ID NO: 88560

SEQ ID NO: 752255 - RNA, 64 nt, hsa; identical to SEQ ID NO: 88561

SEQ ID NO: 752256 - RNA, 64 nt, hsa; identical to SEQ ID NO: 88562

SEQ ID NO: 752257 - RNA, 64 nt, hsa; identical to SEQ ID NO: 88563

SEQ ID NO: 752258 - RNA, 64 nt, hsa; identical to SEQ ID NO: 88564

SEQ ID NO: 752259 - RNA, 64 nt, hsa; identical to SEQ ID NO: 88565

SEQ ID NO: 752260 - RNA, 64 nt, hsa; identical to SEQ ID NO: 88566

SEQ ID NO: 752261 - RNA, 64 nt, hsa; identical to SEQ ID NO: 88567

SEQ ID NO: 752262 - RNA, 64 nt, hsa; identical to SEQ ID NO: 88568

SEQ ID NO: 752263 - RNA, 64 nt, hsa; identical to SEQ ID NO: 88569

SEQ ID NO: 752264 - RNA, 64 nt, hsa; identical to SEQ ID NO: 88570

SEQ ID NO: 752265 - RNA, 64 nt, hsa; identical to SEQ ID NO: 88571

SEQ ID NO: 752266 - RNA, 64 nt, hsa; identical to SEQ ID NO: 88572

SEQ ID NO: 752267 - RNA, 64 nt, hsa; identical to SEQ ID NO: 88573

SEQ ID NO: 752268 - RNA, 64 nt, hsa; identical to SEQ ID NO: 88574

SEQ ID NO: 752269 - RNA, 64 nt, hsa; identical to SEQ ID NO: 88575

SEQ ID NO: 752270 - RNA, 64 nt, hsa; identical to SEQ ID NO: 88576

SEQ ID NO: 752271 - RNA, 64 nt, hsa; identical to SEQ ID NO: 88577

SEQ ID NO: 752272 - RNA, 64 nt, hsa; identical to SEQ ID NO: 88578

SEQ ID NO: 752273 - RNA, 64 nt, hsa; identical to SEQ ID NO: 88579

SEQ ID NO: 752274 - RNA, 64 nt, hsa; identical to SEQ ID NO: 88580

SEQ ID NO: 752275 - RNA, 64 nt, hsa; identical to SEQ ID NO: 88581

SEQ ID NO: 752276 - RNA, 64 nt, hsa; identical to SEQ ID NO: 88582

SEQ ID NO: 752277 - RNA, 64 nt, hsa; identical to SEQ ID NO: 88583

SEQ ID NO: 752278 - RNA, 64 nt, hsa; identical to SEQ ID NO: 88584

SEQ ID NO: 752279 - RNA, 64 nt, hsa; identical to SEQ ID NO: 88585

SEQ ID NO: 752280 - RNA, 64 nt, hsa; identical to SEQ ID NO: 88586

SEQ ID NO: 752281 - RNA, 64 nt, hsa; identical to SEQ ID NO: 88587

SEQ ID NO: 752282 - RNA, 64 nt, hsa; identical to SEQ ID NO: 88588

SEQ ID NO: 752283 - RNA, 64 nt, hsa; identical to SEQ ID NO: 88589

SEQ ID NO: 752284 - RNA, 64 nt, hsa; identical to SEQ ID NO: 88590

SEQ ID NO: 752285 - RNA, 64 nt, hsa; identical to SEQ ID NO: 88591

SEQ ID NO: 752286 - RNA, 64 nt, hsa; identical to SEQ ID NO: 88592

SEQ ID NO: 752287 - RNA, 64 nt, hsa; identical to SEQ ID NO: 88593

SEQ ID NO: 752288 - RNA, 64 nt, hsa; identical to SEQ ID NO: 110389

SEQ ID NO: 752289 - RNA, 64 nt, hsa; identical to SEQ ID NO: 110390

SEQ ID NO: 752290 - RNA, 64 nt, hsa; identical to SEQ ID NO: 110391

SEQ ID NO: 752291 - RNA, 64 nt, hsa; identical to SEQ ID NO: 110392

SEQ ID NO: 752292 - RNA, 64 nt, hsa; identical to SEQ ID NO: 110393

SEQ ID NO: 752293 - RNA, 63 nt, hsa; identical to SEQ ID NO: 110394

SEQ ID NO: 752294 - RNA, 60 nt, hsa; identical to SEQ ID NO: 110395

SEQ ID NO: 752295 - RNA, 64 nt, hsa; identical to SEQ ID NO: 110396

SEQ ID NO: 752296 - RNA, 64 nt, hsa; identical to SEQ ID NO: 110397

SEQ ID NO: 752297 - RNA, 64 nt, hsa; identical to SEQ ID NO: 110398

SEQ ID NO: 752298 - RNA, 64 nt, hsa; identical to SEQ ID NO: 110399

SEQ ID NO: 752299 - RNA, 64 nt, hsa; identical to SEQ ID NO: 110400

SEQ ID NO: 752300 - RNA, 64 nt, hsa; identical to SEQ ID NO: 110401

SEQ ID NO: 752301 - RNA, 58 nt, hsa; identical to SEQ ID NO: 110402

SEQ ID NO: 752302 - RNA, 64 nt, hsa; identical to SEQ ID NO: 110403

SEQ ID NO: 752303 - RNA, 64 nt, hsa; identical to SEQ ID NO: 110404

SEQ ID NO: 752304 - RNA, 64 nt, hsa; identical to SEQ ID NO: 110405

SEQ ID NO: 752305 - RNA, 64 nt, hsa; identical to SEQ ID NO: 110406

SEQ ID NO: 752306 - RNA, 64 nt, hsa; identical to SEQ ID NO: 110407

SEQ ID NO: 752307 - RNA, 64 nt, hsa; identical to SEQ ID NO: 110408

SEQ ID NO: 752308 - RNA, 64 nt, hsa; identical to SEQ ID NO: 110409

SEQ ID NO: 752309 - RNA, 64 nt, hsa; identical to SEQ ID NO: 110410

SEQ ID NO: 752310 - RNA, 64 nt, hsa; identical to SEQ ID NO: 110411

SEQ ID NO: 752311 - RNA, 64 nt, hsa; identical to SEQ ID NO: 110412

SEQ ID NO: 752312 - RNA, 64 nt, hsa; identical to SEQ ID NO: 110413

SEQ ID NO: 752313 - RNA, 64 nt, hsa; identical to SEQ ID NO: 110414

SEQ ID NO: 752314 - RNA, 64 nt, hsa; identical to SEQ ID NO: 110415

SEQ ID NO: 752315 - RNA, 64 nt, hsa; identical to SEQ ID NO: 110416

SEQ ID NO: 752316 - RNA, 64 nt, hsa; identical to SEQ ID NO: 110417

SEQ ID NO: 752317 - RNA, 64 nt, hsa; identical to SEQ ID NO: 110418

SEQ ID NO: 752318 - RNA, 64 nt, hsa; identical to SEQ ID NO: 110419

SEQ ID NO: 752319 - RNA, 64 nt, hsa; identical to SEQ ID NO: 110420

SEQ ID NO: 752320 - RNA, 64 nt, hsa; identical to SEQ ID NO: 110421

SEQ ID NO: 752321 - RNA, 64 nt, hsa; identical to SEQ ID NO: 110422

SEQ ID NO: 752322 - RNA, 64 nt, hsa; identical to SEQ ID NO: 110423

SEQ ID NO: 752323 - RNA, 64 nt, hsa; identical to SEQ ID NO: 110424

SEQ ID NO: 752324 - RNA, 64 nt, hsa; identical to SEQ ID NO: 110425

SEQ ID NO: 752325 - RNA, 64 nt, hsa; identical to SEQ ID NO: 110426

SEQ ID NO: 752326 - RNA, 64 nt, hsa; identical to SEQ ID NO: 110427

SEQ ID NO: 752327 - RNA, 64 nt, hsa; identical to SEQ ID NO: 110428

SEQ ID NO: 752328 - RNA, 64 nt, hsa; identical to SEQ ID NO: 110429

SEQ ID NO: 752329 - RNA, 64 nt, hsa; identical to SEQ ID NO: 110430

SEQ ID NO: 752330 - RNA, 64 nt, hsa; identical to SEQ ID NO: 110431

SEQ ID NO: 752331 - RNA, 64 nt, hsa; identical to SEQ ID NO: 110432

SEQ ID NO: 752332 - RNA, 64 nt, hsa; identical to SEQ ID NO: 110433

SEQ ID NO: 752333 - RNA, 64 nt, hsa; identical to SEQ ID NO: 110434

SEQ ID NO: 752334 - RNA, 64 nt, hsa; identical to SEQ ID NO: 110435

SEQ ID NO: 752335 - RNA, 64 nt, hsa; identical to SEQ ID NO: 110436

SEQ ID NO: 752336 - RNA, 64 nt, hsa; identical to SEQ ID NO: 110437

SEQ ID NO: 752337 - RNA, 64 nt, hsa; identical to SEQ ID NO: 110438

SEQ ID NO: 752338 - RNA, 64 nt, hsa; identical to SEQ ID NO: 110439

SEQ ID NO: 752339 - RNA, 64 nt, hsa; identical to SEQ ID NO: 206029

SEQ ID NO: 752340 - RNA, 64 nt, hsa; identical to SEQ ID NO: 206030

SEQ ID NO: 752341 - RNA, 64 nt, hsa; identical to SEQ ID NO: 206031

SEQ ID NO: 752342 - RNA, 64 nt, hsa; identical to SEQ ID NO: 206032

SEQ ID NO: 752343 - RNA, 64 nt, hsa; identical to SEQ ID NO: 206033

SEQ ID NO: 752344 - RNA, 64 nt, hsa; identical to SEQ ID NO: 206034

SEQ ID NO: 752345 - RNA, 64 nt, hsa; identical to SEQ ID NO: 206035

SEQ ID NO: 752346 - RNA, 64 nt, hsa; identical to SEQ ID NO: 206036

SEQ ID NO: 752347 - RNA, 64 nt, hsa; identical to SEQ ID NO: 206037

SEQ ID NO: 752348 - RNA, 64 nt, hsa; identical to SEQ ID NO: 206038

SEQ ID NO: 752349 - RNA, 64 nt, hsa; identical to SEQ ID NO: 206039

SEQ ID NO: 752350 - RNA, 64 nt, hsa; identical to SEQ ID NO: 206040

SEQ ID NO: 752351 - RNA, 64 nt, hsa; identical to SEQ ID NO: 206041

SEQ ID NO: 752352 - RNA, 64 nt, hsa; identical to SEQ ID NO: 206042

SEQ ID NO: 752353 - RNA, 64 nt, hsa; identical to SEQ ID NO: 206043

SEQ ID NO: 752354 - RNA, 64 nt, hsa; identical to SEQ ID NO: 206044

SEQ ID NO: 752355 - RNA, 64 nt, hsa; identical to SEQ ID NO: 206045

SEQ ID NO: 752356 - RNA, 64 nt, hsa; identical to SEQ ID NO: 206046

SEQ ID NO: 752357 - RNA, 64 nt, hsa; identical to SEQ ID NO: 206047

SEQ ID NO: 752358 - RNA, 64 nt, hsa; identical to SEQ ID NO: 206048

SEQ ID NO: 752359 - RNA, 64 nt, hsa; identical to SEQ ID NO: 206049

SEQ ID NO: 752360 - RNA, 64 nt, hsa; identical to SEQ ID NO: 206050

SEQ ID NO: 752361 - RNA, 64 nt, hsa; identical to SEQ ID NO: 206051

SEQ ID NO: 752362 - RNA, 64 nt, hsa; identical to SEQ ID NO: 206052

SEQ ID NO: 752363 - RNA, 64 nt, hsa; identical to SEQ ID NO: 206053

SEQ ID NO: 752364 - RNA, 64 nt, hsa; identical to SEQ ID NO: 206054

SEQ ID NO: 752365 - RNA, 64 nt, hsa; identical to SEQ ID NO: 206055

SEQ ID NO: 752366 - RNA, 64 nt, hsa; identical to SEQ ID NO: 206056

SEQ ID NO: 752367 - RNA, 64 nt, hsa; identical to SEQ ID NO: 206057

SEQ ID NO: 752368 - RNA, 64 nt, hsa; identical to SEQ ID NO: 206058

SEQ ID NO: 752369 - RNA, 64 nt, hsa; identical to SEQ ID NO: 206059

SEQ ID NO: 752370 - RNA, 64 nt, hsa; identical to SEQ ID NO: 206060

SEQ ID NO: 752371 - RNA, 64 nt, hsa; identical to SEQ ID NO: 206061

SEQ ID NO: 752372 - RNA, 64 nt, hsa; identical to SEQ ID NO: 206062

SEQ ID NO: 752373 - RNA, 64 nt, hsa; identical to SEQ ID NO: 206063

SEQ ID NO: 752374 - RNA, 64 nt, hsa; identical to SEQ ID NO: 206064

SEQ ID NO: 752375 - RNA, 64 nt, hsa; identical to SEQ ID NO: 206065

SEQ ID NO: 752376 - RNA, 64 nt, hsa; identical to SEQ ID NO: 206066

SEQ ID NO: 752377 - RNA, 64 nt, hsa; identical to SEQ ID NO: 206067

SEQ ID NO: 752378 - RNA, 64 nt, hsa; identical to SEQ ID NO: 206068

SEQ ID NO: 752379 - RNA, 64 nt, hsa; identical to SEQ ID NO: 206069

SEQ ID NO: 752380 - RNA, 64 nt, hsa; identical to SEQ ID NO: 206070

SEQ ID NO: 752381 - RNA, 64 nt, hsa; identical to SEQ ID NO: 206071

SEQ ID NO: 752382 - RNA, 64 nt, hsa; identical to SEQ ID NO: 206072

SEQ ID NO: 752383 - RNA, 64 nt, hsa; identical to SEQ ID NO: 206073

SEQ ID NO: 752384 - RNA, 64 nt, hsa; identical to SEQ ID NO: 206074

SEQ ID NO: 752385 - RNA, 64 nt, hsa; identical to SEQ ID NO: 206075

SEQ ID NO: 752386 - RNA, 64 nt, hsa; identical to SEQ ID NO: 206076

SEQ ID NO: 752387 - RNA, 64 nt, hsa; identical to SEQ ID NO: 206077

SEQ ID NO: 752388 - RNA, 64 nt, hsa; identical to SEQ ID NO: 206078

SEQ ID NO: 752389 - RNA, 64 nt, hsa; identical to SEQ ID NO: 199302

SEQ ID NO: 752390 - RNA, 64 nt, hsa; identical to SEQ ID NO: 199303

SEQ ID NO: 752391 - RNA, 64 nt, hsa; identical to SEQ ID NO: 199304

SEQ ID NO: 752392 - RNA, 64 nt, hsa; identical to SEQ ID NO: 199305

SEQ ID NO: 752393 - RNA, 64 nt, hsa; identical to SEQ ID NO: 199306

SEQ ID NO: 752394 - RNA, 64 nt, hsa; identical to SEQ ID NO: 199307

SEQ ID NO: 752395 - RNA, 64 nt, hsa; identical to SEQ ID NO: 199308

SEQ ID NO: 752396 - RNA, 64 nt, hsa; identical to SEQ ID NO: 199309

SEQ ID NO: 752397 - RNA, 64 nt, hsa; identical to SEQ ID NO: 199310

SEQ ID NO: 752398 - RNA, 64 nt, hsa; identical to SEQ ID NO: 199311

SEQ ID NO: 752399 - RNA, 64 nt, hsa
aaagacuauuuugauaaauuuauaaauauauaaaauuauguaaaaacuacacuauauuuugauu

SEQ ID NO: 752400 - RNA, 64 nt, hsa
uaugauuuaggaaucaaaaacuaaaauaaguggaauuauguaucuuuucuaaaguuaaaaaagu

SEQ ID NO: 752401 - RNA, 64 nt, hsa
auacuauuauaaguuagguugacaaaugauguugauuauguaaggauauacuuagcuacauuuu

SEQ ID NO: 752402 - RNA, 64 nt, hsa
aauauuuaacaguucaaucucaauaagaccucgcauuauguaugaauguuauucacugacuaga

SEQ ID NO: 752403 - RNA, 64 nt, hsa
gucugucauuaauaagguauuucuaaauaaacacauuauguaaggaagugccaaaauaguuauc

SEQ ID NO: 752404 - RNA, 64 nt, hsa
guuccguagucuaagauaacuaacugaauuaaaaauuauguaauacuuguggaacuuugauaaa

SEQ ID NO: 752405 - RNA, 64 nt, hsa
auuagcuuaaauaagcagcagaagguuaguuuuaauuauguagcuucuguuaauauuaaguguu

SEQ ID NO: 752406 - RNA, 64 nt, hsa
auucugcugguaaaugugacaguuaaaauggugcauuauguauauauauuauaauuuagaaaua

SEQ ID NO: 752407 - RNA, 64 nt, hsa
ugauaacauuucaaacccugaaggacagugacuuauuauguaaguucaauuuuguaaguucauu

SEQ ID NO: 752408 - RNA, 64 nt, hsa
gugacuuauuauguaaguucaauuuuguaaguucauuauguaagauccuuuuuuuuuucauaau

SEQ ID NO: 752409 - RNA, 64 nt, hsa
cguauaguauucauuuuuaaaugcaugauuguacauuauguauagacgacaauguuuuuaauuu

SEQ ID NO: 752410 - RNA, 64 nt, hsa
uucugaaaacucucauuuuaaaaacguucauuuaauuauguauuugaauuauuuuggagaugag

SEQ ID NO: 752411 - RNA, 64 nt, hsa
caggcuauauguauaagguggaugugaaacaugaauuauguaauuagagucgggucccguugug

SEQ ID NO: 752412 - RNA, 64 nt, hsa
ugcuagacacuuuucuuucccagccgaaaagccuauuauguaauuuuuacauucauaauuuuaa

SEQ ID NO: 752413 - RNA, 64 nt, hsa
uguuuuccaagcaguguaaauacuuuuuccugugauuauguauagccuuggaauggcaccuuuu

SEQ ID NO: 752414 - RNA, 64 nt, hsa
cuuguauuuuucuguauguguguauauauauauaauuauguacuucuggcaauucuaucuguau

SEQ ID NO: 752415 - RNA, 64 nt, hsa
uuuaacuaaucagaucuuuuuacaguauccauuuauuauguaaugcuucuuagaaaagaaucuu

SEQ ID NO: 752416 - RNA, 64 nt, hsa
gcuagcggcaguauucuguacaguagacacaagaauuauguacgccuuuuaucaaagacuuaag

SEQ ID NO: 752417 - RNA, 64 nt, hsa
uugaaaagacagacuaugguguaaccaugauucuauuauguauugguacgucuguagaccaaga

SEQ ID NO: 752418 - RNA, 64 nt, hsa
aucugcugaaaggacaaaugugcuugguuuuacuauuauguaaucacaacuuacuuucugcuug

SEQ ID NO: 752419 - RNA, 64 nt, hsa
aucacaacuuacuuucugcuuguaguugcuuaaaauuauguauuuugucuugggcugcaauuug

SEQ ID NO: 752420 - RNA, 64 nt, hsa
auuuuguuucuuggaacccaaugauccuaagaaaauuauguacuuuuaccugaaaauuaaaacc

SEQ ID NO: 752421 - RNA, 64 nt, hsa
augauaaucguuagucaucauuaaggaacuaaguauuauguacuccuugccuuggaauacucua

SEQ ID NO: 752422 - RNA, 64 nt, hsa
gacugauuccucauuuauaacagggaggagguggauuauguaauaucuaagagcuuuucaguuu

SEQ ID NO: 752423 - RNA, 64 nt, hsa
gaauaugguacagauuguucuauaagugaaaagcauuauguacuugaaaguaaaaaucagggca

SEQ ID NO: 752424 - RNA, 64 nt, hsa
cugaaauacuuugcuucagaauuggaauguuuauauuauguagaaaucuucaaagguagcauua

SEQ ID NO: 752425 - RNA, 64 nt, hsa
uaggaaaauauuuuauucuguaauucauguuaagauuauguaugguuugcauuuuaaggggauu

SEQ ID NO: 752426 - RNA, 64 nt, hsa
cuacaggcagaugggacuaaguguuuaugggacaauuauguacuauuuaacuuaaauauauuuu

SEQ ID NO: 752427 - RNA, 64 nt, hsa
aauguguugagcaaguugcagugcaaacacugucauuauguagagaguuuauaugcacauaaua

SEQ ID NO: 752428 - RNA, 64 nt, hsa
uauuuuaauugagcauuuauauggauaaucauacauuauguaagcccauauguauuuacaucca

SEQ ID NO: 752429 - RNA, 64 nt, hsa
aaguagaucaugcagugacauacaaagaccaaggauuauguauauuuuuauaucucugugguuu

SEQ ID NO: 752430 - RNA, 64 nt, hsa
aaaaauuuagguuuuauucauguuuaaaguauguauuauguaugcauaauuuugcuguuguuac

SEQ ID NO: 752431 - RNA, 64 nt, hsa
guaauggccauuauuguuccauuguggaaauuaaauuauguaagcuuccuaauaucauaaacau

SEQ ID NO: 752432 - RNA, 64 nt, hsa
acucuuaaauaguaccaaacauuuugaacuuuaaauuauguauuuaaagugaguguuuaagaaa

SEQ ID NO: 752433 - RNA, 64 nt, hsa
aagaaaauuuacuguaacuucuuaaucuaagaaaauuauguauuuuugucauauguauuuuguc

SEQ ID NO: 752434 - RNA, 64 nt, hsa
aauuuaccuacucuauguaugcaucuauauguguauuauguaugcgugcaugcgugcgcgcaca

SEQ ID NO: 752435 - RNA, 64 nt, hsa
uuaaaauacuuugcgccuugcuuugauaauuuguauuauguauccaaacugaaauuaucugcuu

SEQ ID NO: 752436 - RNA, 64 nt, hsa
agaagaaauuuauaaugaaaagaagaugaauuucauuauguaaacgcucaggcaugacuacgcu

SEQ ID NO: 752437 - RNA, 64 nt, hsa
aaagaauaugaaacauagauaaaacaucuuugaaauuauguaaauuauguaaauuaucaggcaa

SEQ ID NO: 752438 - RNA, 64 nt, hsa
gaaacauagauaaaacaucuuugaaauuauguaaauuauguaaauuaucaggcaaauuugcauu

SEQ ID NO: 752439 - RNA, 64 nt, hsa
cucuaauguaguuucuuugauuaccgacuacacaauuauguaccaucacaguauuaguggaaaa

SEQ ID NO: 752440 - RNA, 64 nt, hsa
aauucuccauuccuccaauguaacucuuaaaauuauuauguauguguguguguuuuacuuuuug

SEQ ID NO: 752441 - RNA, 64 nt, hsa
ucauaggauuacccucuaagugugaaaauguguaauuauguacgguauuuagaaaaagcccuua

SEQ ID NO: 752442 - RNA, 64 nt, hsa
ugcuaccugacucacaucuguaucacucagaaacauuauguaaaaaauaucaaagcaagauaag

SEQ ID NO: 752443 - RNA, 64 nt, hsa
ugccaauuauuuuaaauuacuaggauuaaaguauauuauguaugucuuuaacuucuuucuuucc

SEQ ID NO: 752444 - RNA, 64 nt, hsa
uccuacauuuuguagguuuuuuuucacugccuucauuauguaucuucucuugccuucauuauuu

SEQ ID NO: 752445 - RNA, 64 nt, hsa
uucaguucauguaguucuuuaauagaaagcugcuauuauguauauugucauuugugaaggaagu

SEQ ID NO: 752446 - RNA, 64 nt, hsa
uguuguguucuuuguauucuugagaugauaauauauuauguauuugaauuccugaaaaauggaa

SEQ ID NO: 752447 - RNA, 64 nt, hsa
acaaaaagucuggaaacuuucauaucaauaauugauuauguauuaacugaaacaaaagacuaga

SEQ ID NO: 752448 - RNA, 64 nt, hsa
aacaaaagacuagagaaagacacagugggaauugauuauguauuaacugaggaauaaaagacug

SEQ ID NO: 752449 - RNA, 64 nt, hsa
cuaaaaauuuagaaaauguuaucuuuuugcauuuauuauguaaaacuguuuuacaguaucaaaa

SEQ ID NO: 752450 - RNA, 64 nt, hsa
guggaaagagauucuuuaaaauguauaaccugccauuauguaauuugguuucauuuuauucuac

SEQ ID NO: 752451 - RNA, 64 nt, hsa
uccuguuuauuuuuccaaugcuuuucuguaauacauuauguaauuuaaaaaauauuccuuuuua

SEQ ID NO: 752452 - RNA, 64 nt, hsa
aguuucuuaauaaaugauauggcauguacuuucaauuauguagcuuuguaacuaugaauauuua

SEQ ID NO: 752453 - RNA, 64 nt, hsa
guaaugugggccaaugcauuuuggaaauguccucauuauguagaauggaaugugaaaauuauuu

SEQ ID NO: 752454 - RNA, 64 nt, hsa
cuugccuuuacuagauauucuuuacacuuguacaauuauguaguaaauguauguuuacaggguu

SEQ ID NO: 752455 - RNA, 64 nt, hsa
caaagugucugccuguguacauguacuuguauugauuauguaguucaguaagaugugcccaagu

SEQ ID NO: 752456 - RNA, 64 nt, hsa
aaguagguuaccauuuugaggcaguuggauauaaauuauguaaauauguaugauuaugauuuuu

SEQ ID NO: 752457 - RNA, 64 nt, hsa
ugcugccuuuaugguauaaaacuguaaauguaauauuauguaauuaugugaacuuuugagagag

SEQ ID NO: 752458 - RNA, 64 nt, hsa
gcuuuuuauauauuuuugauauuaauccuuugucauuauguagcagauguuuuucuuaaucuag

SEQ ID NO: 752459 - RNA, 64 nt, hsa
auuuagauguauaaugaaaaaggauaaugcaaaaauuauguaauagauaccaaauuagggaagu

SEQ ID NO: 752460 - RNA, 64 nt, hsa
aaacuauuuaagaguuuaaaagaguugcauucuuauuauguaaggaugauuuuaacaacuuuuu

SEQ ID NO: 752461 - RNA, 64 nt, hsa
acugcagcaaugauauuucagucugugaacuucuauuauguaaagaaucucuaguguacaaagg

SEQ ID NO: 752462 - RNA, 64 nt, hsa
cuauauuuauggggccauugcuuaaagauuauaaauuauguaaauacauuaauaaauucuaagu

SEQ ID NO: 752463 - RNA, 64 nt, hsa; identical to SEQ ID NO: 544427

SEQ ID NO: 752464 - RNA, 64 nt, hsa; identical to SEQ ID NO: 544428

SEQ ID NO: 752465 - RNA, 64 nt, hsa; identical to SEQ ID NO: 474087

SEQ ID NO: 752466 - RNA, 64 nt, hsa; identical to SEQ ID NO: 474088

SEQ ID NO: 752467 - RNA, 64 nt, hsa; identical to SEQ ID NO: 474089

SEQ ID NO: 752468 - RNA, 64 nt, hsa; identical to SEQ ID NO: 474090

SEQ ID NO: 752469 - RNA, 64 nt, hsa; identical to SEQ ID NO: 474091

SEQ ID NO: 752470 - RNA, 64 nt, hsa; identical to SEQ ID NO: 474092

SEQ ID NO: 752471 - RNA, 64 nt, hsa; identical to SEQ ID NO: 474093

SEQ ID NO: 752472 - RNA, 64 nt, hsa; identical to SEQ ID NO: 474094

SEQ ID NO: 752473 - RNA, 64 nt, hsa; identical to SEQ ID NO: 474095

SEQ ID NO: 752474 - RNA, 64 nt, hsa; identical to SEQ ID NO: 474096

SEQ ID NO: 752475 - RNA, 64 nt, hsa; identical to SEQ ID NO: 474097

SEQ ID NO: 752476 - RNA, 64 nt, hsa; identical to SEQ ID NO: 474098

SEQ ID NO: 752477 - RNA, 64 nt, hsa; identical to SEQ ID NO: 474099

SEQ ID NO: 752478 - RNA, 64 nt, hsa; identical to SEQ ID NO: 474100

SEQ ID NO: 752479 - RNA, 64 nt, hsa; identical to SEQ ID NO: 474101

SEQ ID NO: 752480 - RNA, 64 nt, hsa; identical to SEQ ID NO: 474102

SEQ ID NO: 752481 - RNA, 64 nt, hsa
uaccuuaaaaccaaaaugaaacacaaaaauuaauccuuaauaaugauagcaagugaucuuucuu

SEQ ID NO: 752482 - RNA, 64 nt, hsa
uuuuuuuaaaaaagcaccuuuuuuuguuguuuccccuuaauaaaagagguuucuaauuuauguu

SEQ ID NO: 752483 - RNA, 64 nt, hsa
agagugacaaaguugauucaccccuuuuuggggaccuuaauauauuuuuuaagggaugugccua

SEQ ID NO: 752484 - RNA, 64 nt, hsa
uaucuacacguguauuuuguagcugucacacuaaccuuaauaagaauucuacagcuuuggacag

SEQ ID NO: 752485 - RNA, 64 nt, hsa
gggagcuaacauuaauuaugcauguacuauauuuccuuaauaugagagauaauuuuuuaauugc

SEQ ID NO: 752486 - RNA, 64 nt, hsa
cuauuuggagauucagugcauaacuaaguauuuuccuuaauacuaaagauuuuaaauaauaaau

SEQ ID NO: 752487 - RNA, 64 nt, hsa
aauuuauuaguuaauauaucccagaaauuagaaaccuuaauauguggacguaaucuccacaguc

SEQ ID NO: 752488 - RNA, 53 nt, hsa
uucuguuucaucaaaagugacugccuuaauaagaaugguugccuuaaagaaag

SEQ ID NO: 752489 - RNA, 64 nt, hsa
ucauaauugcuuucuagcaaucagcuuuuauuugccuuaauauaagcuuuuaagcaguuaucua

SEQ ID NO: 752490 - RNA, 64 nt, hsa
ggucacugugaggcugcauauuucagaaagauguccuuaauaagggaagucauguauaagaugu

SEQ ID NO: 752491 - RNA, 64 nt, hsa
cuucccaggcugccucacuuuaugccaugacugaccuuaauauugggauauuguuaugcaauuu

SEQ ID NO: 752492 - RNA, 64 nt, hsa
uauuuuuauaauuucauggauuuaguuauacauaccuuaauaguuuuauaaaauuguugacauu

SEQ ID NO: 752493 - RNA, 64 nt, hsa
aauaugucacacuccuuaauagggaccugugacuccuuaauaaggaccugugacaugcccagca

SEQ ID NO: 752494 - RNA, 64 nt, hsa
uucuaccaagacacucaauggaauaugucacacuccuuaauagggaccugugacuccuuaauaa

SEQ ID NO: 752495 - RNA, 64 nt, hsa
uaaggaaggugagucuacuuucccugaggcuuuggggucagaguauauguuguuuggagaaaga

SEQ ID NO: 752496 - RNA, 64 nt, hsa
gauuucagggaguucccucauuuguaaaaugagggggucagagcaggugauauccauguuucuu

SEQ ID NO: 752497 - RNA, 64 nt, hsa
ugggccugauucaggugcagugggcacuccugaagggucagagcggcaucugccaggcagcccc

SEQ ID NO: 752498 - RNA, 64 nt, hsa
aggcuggacgggaggguagccuuguggcugagaggggucagacuagguggcacaggggcuccug

SEQ ID NO: 752499 - RNA, 64 nt, hsa
ggucuguguggcaggaugggggagggagucagaagggucagaugaacuggaguguagacagcau

SEQ ID NO: 752500 - RNA, 64 nt, hsa
aggugacggagcaucguggcacggcagucucaaugggucagaaacccaggccagcugggcucua

SEQ ID NO: 752501 - RNA, 64 nt, hsa
agaccuggacacaggccugcucucuuuuucuccagggucagaaacaggaccggguggaagggau

SEQ ID NO: 752502 - RNA, 64 nt, hsa
aaacaaaacaaaacaaaacuauacuugaacaaaagggucagaggaccuguauuuaagcaaauac

SEQ ID NO: 752503 - RNA, 64 nt, hsa
aaggaaaaagcuccaugugccucuuugucugcgugggucagaagaguugugcacgcagauuagc

SEQ ID NO: 752504 - RNA, 64 nt, hsa
aaaaacuauucuuagcuguacagaaacagauggugggucagauuugacucacugcccauaguuu

SEQ ID NO: 752505 - RNA, 64 nt, hsa
aagccugucuauaaaaucugguacacuaugacgagggucagauuucccauucagacgccccucu

SEQ ID NO: 752506 - RNA, 64 nt, hsa; identical to SEQ ID NO: 311803

SEQ ID NO: 752507 - RNA, 64 nt, hsa; identical to SEQ ID NO: 311804

SEQ ID NO: 752508 - RNA, 64 nt, hsa; identical to SEQ ID NO: 311805

SEQ ID NO: 752509 - RNA, 64 nt, hsa; identical to SEQ ID NO: 311806

SEQ ID NO: 752510 - RNA, 64 nt, hsa; identical to SEQ ID NO: 311807

SEQ ID NO: 752511 - RNA, 64 nt, hsa; identical to SEQ ID NO: 311808

SEQ ID NO: 752512 - RNA, 64 nt, hsa; identical to SEQ ID NO: 311809

SEQ ID NO: 752513 - RNA, 64 nt, hsa; identical to SEQ ID NO: 311810

SEQ ID NO: 752514 - RNA, 64 nt, hsa; identical to SEQ ID NO: 311811

SEQ ID NO: 752515 - RNA, 64 nt, hsa; identical to SEQ ID NO: 311812

SEQ ID NO: 752516 - RNA, 64 nt, hsa; identical to SEQ ID NO: 311813

SEQ ID NO: 752517 - RNA, 64 nt, hsa; identical to SEQ ID NO: 311814

SEQ ID NO: 752518 - RNA, 64 nt, hsa; identical to SEQ ID NO: 311815

SEQ ID NO: 752519 - RNA, 64 nt, hsa; identical to SEQ ID NO: 311816

SEQ ID NO: 752520 - RNA, 64 nt, hsa; identical to SEQ ID NO: 311817

SEQ ID NO: 752521 - RNA, 64 nt, hsa; identical to SEQ ID NO: 311818

SEQ ID NO: 752522 - RNA, 64 nt, hsa; identical to SEQ ID NO: 311819

SEQ ID NO: 752523 - RNA, 64 nt, hsa; identical to SEQ ID NO: 311820

SEQ ID NO: 752524 - RNA, 64 nt, hsa; identical to SEQ ID NO: 311821

SEQ ID NO: 752525 - RNA, 64 nt, hsa; identical to SEQ ID NO: 311822

SEQ ID NO: 752526 - RNA, 64 nt, hsa; identical to SEQ ID NO: 311823

SEQ ID NO: 752527 - RNA, 64 nt, hsa; identical to SEQ ID NO: 311824

SEQ ID NO: 752528 - RNA, 64 nt, hsa; identical to SEQ ID NO: 311825

SEQ ID NO: 752529 - RNA, 64 nt, hsa; identical to SEQ ID NO: 311824

SEQ ID NO: 752530 - RNA, 64 nt, hsa; identical to SEQ ID NO: 311824

SEQ ID NO: 752531 - RNA, 64 nt, hsa; identical to SEQ ID NO: 311828

SEQ ID NO: 752532 - RNA, 64 nt, hsa; identical to SEQ ID NO: 311829

SEQ ID NO: 752533 - RNA, 64 nt, hsa; identical to SEQ ID NO: 311830

SEQ ID NO: 752534 - RNA, 64 nt, hsa; identical to SEQ ID NO: 311831

SEQ ID NO: 752535 - RNA, 64 nt, hsa; identical to SEQ ID NO: 311832

SEQ ID NO: 752536 - RNA, 64 nt, hsa; identical to SEQ ID NO: 311833

SEQ ID NO: 752537 - RNA, 64 nt, hsa; identical to SEQ ID NO: 311834

SEQ ID NO: 752538 - RNA, 64 nt, hsa; identical to SEQ ID NO: 311835

SEQ ID NO: 752539 - RNA, 64 nt, hsa; identical to SEQ ID NO: 311836

SEQ ID NO: 752540 - RNA, 64 nt, hsa; identical to SEQ ID NO: 311837

SEQ ID NO: 752541 - RNA, 64 nt, hsa; identical to SEQ ID NO: 311838

SEQ ID NO: 752542 - RNA, 64 nt, hsa; identical to SEQ ID NO: 311839

SEQ ID NO: 752543 - RNA, 64 nt, hsa; identical to SEQ ID NO: 311840

SEQ ID NO: 752544 - RNA, 64 nt, hsa; identical to SEQ ID NO: 311841

SEQ ID NO: 752545 - RNA, 64 nt, hsa; identical to SEQ ID NO: 311842

SEQ ID NO: 752546 - RNA, 64 nt, hsa; identical to SEQ ID NO: 311843

SEQ ID NO: 752547 - RNA, 64 nt, hsa; identical to SEQ ID NO: 311844

SEQ ID NO: 752548 - RNA, 64 nt, hsa; identical to SEQ ID NO: 311845

SEQ ID NO: 752549 - RNA, 64 nt, hsa; identical to SEQ ID NO: 311846

SEQ ID NO: 752550 - RNA, 64 nt, hsa; identical to SEQ ID NO: 233973

SEQ ID NO: 752551 - RNA, 64 nt, hsa; identical to SEQ ID NO: 233974

SEQ ID NO: 752552 - RNA, 64 nt, hsa; identical to SEQ ID NO: 233975

SEQ ID NO: 752553 - RNA, 64 nt, hsa; identical to SEQ ID NO: 233976

SEQ ID NO: 752554 - RNA, 64 nt, hsa; identical to SEQ ID NO: 233977

SEQ ID NO: 752555 - RNA, 64 nt, hsa; identical to SEQ ID NO: 233978

SEQ ID NO: 752556 - RNA, 64 nt, hsa; identical to SEQ ID NO: 233979

SEQ ID NO: 752557 - RNA, 64 nt, hsa; identical to SEQ ID NO: 233980

SEQ ID NO: 752558 - RNA, 64 nt, hsa; identical to SEQ ID NO: 233981

SEQ ID NO: 752559 - RNA, 64 nt, hsa; identical to SEQ ID NO: 233982

SEQ ID NO: 752560 - RNA, 64 nt, hsa; identical to SEQ ID NO: 233983

SEQ ID NO: 752561 - RNA, 64 nt, hsa; identical to SEQ ID NO: 233984

SEQ ID NO: 752562 - RNA, 64 nt, hsa; identical to SEQ ID NO: 233985

SEQ ID NO: 752563 - RNA, 64 nt, hsa; identical to SEQ ID NO: 233986

SEQ ID NO: 752564 - RNA, 64 nt, hsa; identical to SEQ ID NO: 233987

SEQ ID NO: 752565 - RNA, 64 nt, hsa; identical to SEQ ID NO: 233988

SEQ ID NO: 752566 - RNA, 64 nt, hsa; identical to SEQ ID NO: 233989

SEQ ID NO: 752567 - RNA, 58 nt, hsa; identical to SEQ ID NO: 233990

SEQ ID NO: 752568 - RNA, 64 nt, hsa; identical to SEQ ID NO: 233991

SEQ ID NO: 752569 - RNA, 64 nt, hsa; identical to SEQ ID NO: 233992

SEQ ID NO: 752570 - RNA, 64 nt, hsa; identical to SEQ ID NO: 233993

SEQ ID NO: 752571 - RNA, 64 nt, hsa; identical to SEQ ID NO: 233994

SEQ ID NO: 752572 - RNA, 64 nt, hsa; identical to SEQ ID NO: 233995

SEQ ID NO: 752573 - RNA, 64 nt, hsa; identical to SEQ ID NO: 233996

SEQ ID NO: 752574 - RNA, 64 nt, hsa; identical to SEQ ID NO: 233997

SEQ ID NO: 752575 - RNA, 64 nt, hsa; identical to SEQ ID NO: 233998

SEQ ID NO: 752576 - RNA, 64 nt, hsa; identical to SEQ ID NO: 233999

SEQ ID NO: 752577 - RNA, 64 nt, hsa; identical to SEQ ID NO: 234000

SEQ ID NO: 752578 - RNA, 64 nt, hsa; identical to SEQ ID NO: 234001

SEQ ID NO: 752579 - RNA, 64 nt, hsa; identical to SEQ ID NO: 234002

SEQ ID NO: 752580 - RNA, 64 nt, hsa; identical to SEQ ID NO: 234003

SEQ ID NO: 752581 - RNA, 64 nt, hsa; identical to SEQ ID NO: 234004

SEQ ID NO: 752582 - RNA, 64 nt, hsa; identical to SEQ ID NO: 234005

SEQ ID NO: 752583 - RNA, 64 nt, hsa; identical to SEQ ID NO: 234006

SEQ ID NO: 752584 - RNA, 64 nt, hsa; identical to SEQ ID NO: 234007

SEQ ID NO: 752585 - RNA, 64 nt, hsa; identical to SEQ ID NO: 234008

SEQ ID NO: 752586 - RNA, 64 nt, hsa; identical to SEQ ID NO: 234009

SEQ ID NO: 752587 - RNA, 64 nt, hsa; identical to SEQ ID NO: 234010

SEQ ID NO: 752588 - RNA, 64 nt, hsa; identical to SEQ ID NO: 234011

SEQ ID NO: 752589 - RNA, 64 nt, hsa; identical to SEQ ID NO: 234012

SEQ ID NO: 752590 - RNA, 64 nt, hsa; identical to SEQ ID NO: 234013

SEQ ID NO: 752591 - RNA, 64 nt, hsa; identical to SEQ ID NO: 234014

SEQ ID NO: 752592 - RNA, 64 nt, hsa; identical to SEQ ID NO: 234015

SEQ ID NO: 752593 - RNA, 64 nt, hsa; identical to SEQ ID NO: 234016

SEQ ID NO: 752594 - RNA, 64 nt, hsa; identical to SEQ ID NO: 234017

SEQ ID NO: 752595 - RNA, 64 nt, hsa; identical to SEQ ID NO: 234018

SEQ ID NO: 752596 - RNA, 64 nt, hsa; identical to SEQ ID NO: 234019

SEQ ID NO: 752597 - RNA, 64 nt, hsa; identical to SEQ ID NO: 234020

SEQ ID NO: 752598 - RNA, 64 nt, hsa; identical to SEQ ID NO: 234021

SEQ ID NO: 752599 - RNA, 64 nt, hsa; identical to SEQ ID NO: 234022

SEQ ID NO: 752600 - RNA, 64 nt, hsa; identical to SEQ ID NO: 234023

SEQ ID NO: 752601 - RNA, 64 nt, hsa; identical to SEQ ID NO: 234024

SEQ ID NO: 752602 - RNA, 64 nt, hsa; identical to SEQ ID NO: 234025

SEQ ID NO: 752603 - RNA, 64 nt, hsa; identical to SEQ ID NO: 234026

SEQ ID NO: 752604 - RNA, 64 nt, hsa; identical to SEQ ID NO: 234027

SEQ ID NO: 752605 - RNA, 64 nt, hsa; identical to SEQ ID NO: 234028

SEQ ID NO: 752606 - RNA, 64 nt, hsa; identical to SEQ ID NO: 234029

SEQ ID NO: 752607 - RNA, 64 nt, hsa; identical to SEQ ID NO: 234030

SEQ ID NO: 752608 - RNA, 64 nt, hsa; identical to SEQ ID NO: 234031

SEQ ID NO: 752609 - RNA, 64 nt, hsa; identical to SEQ ID NO: 234032

SEQ ID NO: 752610 - RNA, 64 nt, hsa; identical to SEQ ID NO: 234033

SEQ ID NO: 752611 - RNA, 64 nt, hsa; identical to SEQ ID NO: 234034

SEQ ID NO: 752612 - RNA, 64 nt, hsa; identical to SEQ ID NO: 234035

SEQ ID NO: 752613 - RNA, 64 nt, hsa; identical to SEQ ID NO: 234036

SEQ ID NO: 752614 - RNA, 64 nt, hsa; identical to SEQ ID NO: 234037

SEQ ID NO: 752615 - RNA, 64 nt, hsa; identical to SEQ ID NO: 234038

SEQ ID NO: 752616 - RNA, 64 nt, hsa; identical to SEQ ID NO: 234039

SEQ ID NO: 752617 - RNA, 64 nt, hsa; identical to SEQ ID NO: 234040

SEQ ID NO: 752618 - RNA, 64 nt, hsa; identical to SEQ ID NO: 234041

SEQ ID NO: 752619 - RNA, 64 nt, hsa; identical to SEQ ID NO: 234042

SEQ ID NO: 752620 - RNA, 64 nt, hsa; identical to SEQ ID NO: 234043

SEQ ID NO: 752621 - RNA, 64 nt, hsa; identical to SEQ ID NO: 234044

SEQ ID NO: 752622 - RNA, 64 nt, hsa; identical to SEQ ID NO: 234045

SEQ ID NO: 752623 - RNA, 64 nt, hsa; identical to SEQ ID NO: 234046

SEQ ID NO: 752624 - RNA, 64 nt, hsa; identical to SEQ ID NO: 234047

SEQ ID NO: 752625 - RNA, 64 nt, hsa; identical to SEQ ID NO: 492612

SEQ ID NO: 752626 - RNA, 64 nt, hsa; identical to SEQ ID NO: 492613

SEQ ID NO: 752627 - RNA, 64 nt, hsa; identical to SEQ ID NO: 492614

SEQ ID NO: 752628 - RNA, 64 nt, hsa; identical to SEQ ID NO: 492615

SEQ ID NO: 752629 - RNA, 64 nt, hsa; identical to SEQ ID NO: 492616

SEQ ID NO: 752630 - RNA, 64 nt, hsa; identical to SEQ ID NO: 492617

SEQ ID NO: 752631 - RNA, 64 nt, hsa
uuaugcuucugaccuuguauggucuguaagcuugcccagaaauaagaccacuguuuugaacuac

SEQ ID NO: 752632 - RNA, 64 nt, hsa
uguuuuuuuucuuuuguaaaggcaaugagcuagucccagaaaggauccuucaguuacauacaau

SEQ ID NO: 752633 - RNA, 64 nt, hsa
acauuaccuaaaaggcacuaacaugcucagguuccccagaaagaggcguaagaagggccucucc

SEQ ID NO: 752634 - RNA, 64 nt, hsa
gcuucaaggcucacaauggaagcacugucauuuccccagaaaagcuguguucccuaugcugaac

SEQ ID NO: 752635 - RNA, 64 nt, hsa
uugccaugagauaacacaguguaaacaguagacacccagaaaucgugacuucuguguucucucc

SEQ ID NO: 752636 - RNA, 64 nt, hsa
ugagacugguuuggaucucccugcaugacagucccccagaaacuuagugaguccuggacuggac

SEQ ID NO: 752637 - RNA, 64 nt, hsa
uaaacgcaaaucuguagauucucuccucucccaucccagaaaacaaaacaaaauaaugcuuuuc

SEQ ID NO: 752638 - RNA, 64 nt, hsa
uucucuucccuaaccaaugaagcuaagugguuaucccagaaacuugucuucuaaaagggaggac

SEQ ID NO: 752639 - RNA, 64 nt, hsa
cgcugaucuucuauuuaauuccccacccaugacccccagaaagcaggagggcauugcccacauu

SEQ ID NO: 752640 - RNA, 64 nt, hsa
aauuucuuaccucacauagaugagaaaacuaacacccagaaaggagaaaugauguuauaaaaaa

SEQ ID NO: 752641 - RNA, 64 nt, hsa
caaauuccuacaguuucuggcuggcuucauuaaacccagaaagaauguucagguaacuauucac

SEQ ID NO: 752642 - RNA, 64 nt, hsa
aagagaaaaaaaagacuuguuucugaucuaauaucccagaaaaaguaacucauugcucuguuaa

SEQ ID NO: 752643 - RNA, 64 nt, hsa
gauccagaugagauacagcucagagugccacgcccccagaaagaggaaucaggcaaguacuguc

SEQ ID NO: 752644 - RNA, 64 nt, hsa
ugcauauuaauucaugcaaaaaguuagauauuagcccagaaauguuaguaacaagaaacuacug

SEQ ID NO: 752645 - RNA, 64 nt, hsa
caucuccuuccggccccacugggguccaggggugcccagaaaggagcuuccccugccugccuga

SEQ ID NO: 752646 - RNA, 64 nt, hsa
cugcugcggcagcuucagcuggcagagaggcuuucccagaaaaaaaaaaaaaaccauuuuuaaa

SEQ ID NO: 752647 - RNA, 64 nt, hsa
uuucacacccuuacaagaauaccacauuuugaaacccagaaagaccuggaaaggagcccagcau

SEQ ID NO: 752648 - RNA, 64 nt, hsa
uugucaugaccagacaagauaggaaaggggaaaccccagaaacgugcucuucaucugucagccu

SEQ ID NO: 752649 - RNA, 64 nt, hsa
ccagccccauugcacacugugcagcccauccccucccagaaauagagugacaaacucugcacuu

SEQ ID NO: 752650 - RNA, 64 nt, hsa
gagagaagggaaggggaguguccccagccaaccccccagaaacggccuuuuuuccugccucuga

SEQ ID NO: 752651 - RNA, 64 nt, hsa
uagagggcaucccucugggguagcgacagacaaucccagaaacacgcauaauacauuuccgucc

SEQ ID NO: 752652 - RNA, 64 nt, hsa
caugcccuaaagcuaguccuguaaacaauggugccccagaaagcugcaggugguguuuggagaa

SEQ ID NO: 752653 - RNA, 64 nt, hsa
uaccugggaaaucuuaacagaaagguaaugggcccccagaaauacccacagcauagugaccuca

SEQ ID NO: 752654 - RNA, 64 nt, hsa
ccuauuuaguuaauucuuucuuggcccacagucucccagaaaugauguuuugagucccuauagu

SEQ ID NO: 752655 - RNA, 64 nt, hsa
acacugauggcucaagacaaggcuggcaaacccucccagaaacaucucuggcccagaaagccuc

SEQ ID NO: 752656 - RNA, 64 nt, hsa
caaggcuggcaaacccucccagaaacaucucuggcccagaaagccucucucucccucccucucu

SEQ ID NO: 752657 - RNA, 64 nt, hsa
gaucauucccagaaacauuucccagaaaauguuucccagaaaacuagacagaaugaucauucaa

SEQ ID NO: 752658 - RNA, 64 nt, hsa
aaacaaggcagaaugaucauucccagaaacauuucccagaaaauguuucccagaaaacuagaca

SEQ ID NO: 752659 - RNA, 64 nt, hsa
cugaauuuccagaaaacaaggcagaaugaucauucccagaaacauuucccagaaaauguuuccc

SEQ ID NO: 752660 - RNA, 64 nt, hsa
gagauggguaaagcguuucuucuaaaggggucuacccagaaagcaugauuuccugcccuaaguc

SEQ ID NO: 752661 - RNA, 64 nt, hsa
gggcaaggcgcugagggaggaugcuuaggggacccccagaaacaggagucaggaaaaugaggca

SEQ ID NO: 752662 - RNA, 64 nt, hsa
caaagugucacaaugcuccuccugaugacuccuccccagaaaaccaccaaucggcuuucauuuu

SEQ ID NO: 752663 - RNA, 64 nt, hsa
cuauucuuugucacuugggugccaaacaugagagcccagaaaacugucauuuagcuggcugcag

SEQ ID NO: 752664 - RNA, 64 nt, hsa
acaggaaaauuauugacagcaaugguuucccgggcccagaaacucuggaaagauuuuguccaga

SEQ ID NO: 752665 - RNA, 64 nt, hsa
aaagaaaaaauaaaaauuaucuauaaucucagaacccagaaauagccacuauuaacauuuccua

SEQ ID NO: 752666 - RNA, 64 nt, hsa
cuuccugcaacugcacuuuaucuguggucugcugcccagaaacaucucuucucaggaaaggauc

SEQ ID NO: 752667 - RNA, 64 nt, hsa
uaugccacccuaggucaucagagcuaaaggggcucccagaaaccacugggcagcaucugccuuc

SEQ ID NO: 752668 - RNA, 64 nt, hsa
cacuucugggucuuugccugggauguugcugacacccagaaagucccaccaccugcacaugugu

SEQ ID NO: 752669 - RNA, 64 nt, hsa
agcacugcagacaggcccuggcucagaaucagagcccagaaaguggcugcagacaaaaucaaua

SEQ ID NO: 752670 - RNA, 64 nt, hsa
cauuuucaacuucaagucauugcaguuucuuuuucccagaaaacaagggguuagauguugcauu

SEQ ID NO: 752671 - RNA, 64 nt, hsa
cucuccugacuuguauuguggcagucugaacgcccccagaaaauugugccaaagaguuuagaaa

SEQ ID NO: 752672 - RNA, 64 nt, hsa
cuccugccccuguucucuuccacucuccuugcuacccagaaauccaucuaaauaccugcccuga

SEQ ID NO: 752673 - RNA, 64 nt, hsa
aauauuaugcccaguuucugccucugagggaaagcccagaaaaggacagaaacgaaguagaaag

SEQ ID NO: 752674 - RNA, 64 nt, hsa
ccacauggcccacagcuccugugcuggccagacucccagaaaauucucuauuuuuuaaguaacg

SEQ ID NO: 752675 - RNA, 64 nt, hsa
cccauaauaacccccaaauacagaccccaugucacccagaaagagauucccugaguagcaccuu

SEQ ID NO: 752676 - RNA, 64 nt, hsa
uguucacuacaacaggauagggacaucagacagccccagaaaccccuuccagaucugauauggg

SEQ ID NO: 752677 - RNA, 64 nt, hsa
aaugcuguuuuaccaagacuuuauagcagauggacccagaaagaauuuucugcuauuguguuca

SEQ ID NO: 752678 - RNA, 64 nt, hsa
ucugaguccuagagauuacauaaauaguguguagcccagaaaaguaaaauaggugucacgcugu

SEQ ID NO: 752679 - RNA, 64 nt, hsa
gacacagaauaugauucccucacugccccugccccccagaaaggagagugaaacucuuauuugc

SEQ ID NO: 752680 - RNA, 64 nt, hsa
aaaggcucaugcuuggaguggggacuggucggugcccagaaagucucuucugccacugacgccc

SEQ ID NO: 752681 - RNA, 64 nt, hsa
uggccccucccuggacugacuuuggagaccuagccccagaaagccucccuucuucuccaggucc

SEQ ID NO: 752682 - RNA, 64 nt, hsa; identical to SEQ ID NO: 652179

SEQ ID NO: 752683 - RNA, 64 nt, hsa; identical to SEQ ID NO: 652180

SEQ ID NO: 752684 - RNA, 64 nt, hsa; identical to SEQ ID NO: 652181

SEQ ID NO: 752685 - RNA, 64 nt, hsa; identical to SEQ ID NO: 652182

SEQ ID NO: 752686 - RNA, 64 nt, hsa; identical to SEQ ID NO: 652183

SEQ ID NO: 752687 - RNA, 64 nt, hsa; identical to SEQ ID NO: 652184

SEQ ID NO: 752688 - RNA, 64 nt, hsa; identical to SEQ ID NO: 652185

SEQ ID NO: 752689 - RNA, 64 nt, hsa; identical to SEQ ID NO: 652186

SEQ ID NO: 752690 - RNA, 64 nt, hsa; identical to SEQ ID NO: 652187

SEQ ID NO: 752691 - RNA, 64 nt, hsa; identical to SEQ ID NO: 652188

SEQ ID NO: 752692 - RNA, 64 nt, hsa; identical to SEQ ID NO: 652189

SEQ ID NO: 752693 - RNA, 64 nt, hsa; identical to SEQ ID NO: 652190

SEQ ID NO: 752694 - RNA, 64 nt, hsa; identical to SEQ ID NO: 292995

SEQ ID NO: 752695 - RNA, 64 nt, hsa; identical to SEQ ID NO: 292996

SEQ ID NO: 752696 - RNA, 64 nt, hsa; identical to SEQ ID NO: 292997

SEQ ID NO: 752697 - RNA, 64 nt, hsa; identical to SEQ ID NO: 292998

SEQ ID NO: 752698 - RNA, 64 nt, hsa; identical to SEQ ID NO: 292999

SEQ ID NO: 752699 - RNA, 64 nt, hsa; identical to SEQ ID NO: 293000

SEQ ID NO: 752700 - RNA, 64 nt, hsa; identical to SEQ ID NO: 293001

SEQ ID NO: 752701 - RNA, 64 nt, hsa; identical to SEQ ID NO: 293002

SEQ ID NO: 752702 - RNA, 64 nt, hsa; identical to SEQ ID NO: 293003

SEQ ID NO: 752703 - RNA, 64 nt, hsa; identical to SEQ ID NO: 293004

SEQ ID NO: 752704 - RNA, 64 nt, hsa; identical to SEQ ID NO: 293005

SEQ ID NO: 752705 - RNA, 64 nt, hsa; identical to SEQ ID NO: 293006

SEQ ID NO: 752706 - RNA, 64 nt, hsa; identical to SEQ ID NO: 293007

SEQ ID NO: 752707 - RNA, 64 nt, hsa; identical to SEQ ID NO: 293008

SEQ ID NO: 752708 - RNA, 64 nt, hsa; identical to SEQ ID NO: 293009

SEQ ID NO: 752709 - RNA, 64 nt, hsa; identical to SEQ ID NO: 293010

SEQ ID NO: 752710 - RNA, 64 nt, hsa; identical to SEQ ID NO: 293011

SEQ ID NO: 752711 - RNA, 64 nt, hsa; identical to SEQ ID NO: 293012

SEQ ID NO: 752712 - RNA, 64 nt, hsa; identical to SEQ ID NO: 293013

SEQ ID NO: 752713 - RNA, 64 nt, hsa; identical to SEQ ID NO: 293014

SEQ ID NO: 752714 - RNA, 64 nt, hsa; identical to SEQ ID NO: 293015

SEQ ID NO: 752715 - RNA, 55 nt, hsa; identical to SEQ ID NO: 293016

SEQ ID NO: 752716 - RNA, 64 nt, hsa; identical to SEQ ID NO: 293017

SEQ ID NO: 752717 - RNA, 55 nt, hsa; identical to SEQ ID NO: 293018

SEQ ID NO: 752718 - RNA, 64 nt, hsa; identical to SEQ ID NO: 293019

SEQ ID NO: 752719 - RNA, 64 nt, hsa; identical to SEQ ID NO: 293020

SEQ ID NO: 752720 - RNA, 64 nt, hsa; identical to SEQ ID NO: 293021

SEQ ID NO: 752721 - RNA, 64 nt, hsa; identical to SEQ ID NO: 293022

SEQ ID NO: 752722 - RNA, 64 nt, hsa; identical to SEQ ID NO: 293023

SEQ ID NO: 752723 - RNA, 64 nt, hsa; identical to SEQ ID NO: 293024

SEQ ID NO: 752724 - RNA, 64 nt, hsa; identical to SEQ ID NO: 293025

SEQ ID NO: 752725 - RNA, 64 nt, hsa; identical to SEQ ID NO: 293026

SEQ ID NO: 752726 - RNA, 64 nt, hsa; identical to SEQ ID NO: 293027

SEQ ID NO: 752727 - RNA, 64 nt, hsa; identical to SEQ ID NO: 293028

SEQ ID NO: 752728 - RNA, 52 nt, hsa; identical to SEQ ID NO: 293029

SEQ ID NO: 752729 - RNA, 63 nt, hsa; identical to SEQ ID NO: 293030

SEQ ID NO: 752730 - RNA, 64 nt, hsa; identical to SEQ ID NO: 293031

SEQ ID NO: 752731 - RNA, 64 nt, hsa; identical to SEQ ID NO: 293032

SEQ ID NO: 752732 - RNA, 64 nt, hsa; identical to SEQ ID NO: 293033

SEQ ID NO: 752733 - RNA, 64 nt, hsa; identical to SEQ ID NO: 293034

SEQ ID NO: 752734 - RNA, 64 nt, hsa; identical to SEQ ID NO: 293035

SEQ ID NO: 752735 - RNA, 64 nt, hsa; identical to SEQ ID NO: 293036

SEQ ID NO: 752736 - RNA, 55 nt, hsa; identical to SEQ ID NO: 293037

SEQ ID NO: 752737 - RNA, 64 nt, hsa; identical to SEQ ID NO: 293038

SEQ ID NO: 752738 - RNA, 64 nt, hsa; identical to SEQ ID NO: 293039

SEQ ID NO: 752739 - RNA, 64 nt, hsa; identical to SEQ ID NO: 293040

SEQ ID NO: 752740 - RNA, 64 nt, hsa; identical to SEQ ID NO: 293041

SEQ ID NO: 752741 - RNA, 64 nt, hsa; identical to SEQ ID NO: 293042

SEQ ID NO: 752742 - RNA, 64 nt, hsa; identical to SEQ ID NO: 293043

SEQ ID NO: 752743 - RNA, 64 nt, hsa; identical to SEQ ID NO: 293044

SEQ ID NO: 752744 - RNA, 64 nt, hsa; identical to SEQ ID NO: 293045

SEQ ID NO: 752745 - RNA, 64 nt, hsa; identical to SEQ ID NO: 293046

SEQ ID NO: 752746 - RNA, 64 nt, hsa; identical to SEQ ID NO: 293047

SEQ ID NO: 752747 - RNA, 64 nt, hsa; identical to SEQ ID NO: 293048

SEQ ID NO: 752748 - RNA, 64 nt, hsa; identical to SEQ ID NO: 293049

SEQ ID NO: 752749 - RNA, 64 nt, hsa; identical to SEQ ID NO: 293050

SEQ ID NO: 752750 - RNA, 64 nt, hsa; identical to SEQ ID NO: 293051

SEQ ID NO: 752751 - RNA, 64 nt, hsa; identical to SEQ ID NO: 293052

SEQ ID NO: 752752 - RNA, 64 nt, hsa; identical to SEQ ID NO: 414348

SEQ ID NO: 752753 - RNA, 64 nt, hsa; identical to SEQ ID NO: 414349

SEQ ID NO: 752754 - RNA, 64 nt, hsa; identical to SEQ ID NO: 414350

SEQ ID NO: 752755 - RNA, 64 nt, hsa; identical to SEQ ID NO: 414351

SEQ ID NO: 752756 - RNA, 64 nt, hsa; identical to SEQ ID NO: 414352

SEQ ID NO: 752757 - RNA, 64 nt, hsa; identical to SEQ ID NO: 414353

SEQ ID NO: 752758 - RNA, 64 nt, hsa; identical to SEQ ID NO: 414354

SEQ ID NO: 752759 - RNA, 64 nt, hsa; identical to SEQ ID NO: 414355

SEQ ID NO: 752760 - RNA, 64 nt, hsa; identical to SEQ ID NO: 414356

SEQ ID NO: 752761 - RNA, 64 nt, hsa; identical to SEQ ID NO: 414357

SEQ ID NO: 752762 - RNA, 64 nt, hsa; identical to SEQ ID NO: 414358

SEQ ID NO: 752763 - RNA, 64 nt, hsa; identical to SEQ ID NO: 414359

SEQ ID NO: 752764 - RNA, 64 nt, hsa; identical to SEQ ID NO: 414360

SEQ ID NO: 752765 - RNA, 64 nt, hsa; identical to SEQ ID NO: 414361

SEQ ID NO: 752766 - RNA, 64 nt, hsa; identical to SEQ ID NO: 414362

SEQ ID NO: 752767 - RNA, 64 nt, hsa; identical to SEQ ID NO: 583005

SEQ ID NO: 752768 - RNA, 64 nt, hsa; identical to SEQ ID NO: 583006

SEQ ID NO: 752769 - RNA, 64 nt, hsa; identical to SEQ ID NO: 583007

SEQ ID NO: 752770 - RNA, 64 nt, hsa; identical to SEQ ID NO: 583008

SEQ ID NO: 752771 - RNA, 64 nt, hsa; identical to SEQ ID NO: 583009

SEQ ID NO: 752772 - RNA, 64 nt, hsa; identical to SEQ ID NO: 583010

SEQ ID NO: 752773 - RNA, 64 nt, hsa; identical to SEQ ID NO: 583011

SEQ ID NO: 752774 - RNA, 64 nt, hsa; identical to SEQ ID NO: 583012

SEQ ID NO: 752775 - RNA, 64 nt, hsa; identical to SEQ ID NO: 583013

SEQ ID NO: 752776 - RNA, 64 nt, hsa; identical to SEQ ID NO: 583014

SEQ ID NO: 752777 - RNA, 64 nt, hsa; identical to SEQ ID NO: 583015

SEQ ID NO: 752778 - RNA, 64 nt, hsa; identical to SEQ ID NO: 583016

SEQ ID NO: 752779 - RNA, 64 nt, hsa; identical to SEQ ID NO: 583017

SEQ ID NO: 752780 - RNA, 64 nt, hsa; identical to SEQ ID NO: 583018

SEQ ID NO: 752781 - RNA, 64 nt, hsa; identical to SEQ ID NO: 583019

SEQ ID NO: 752782 - RNA, 64 nt, hsa; identical to SEQ ID NO: 583020

SEQ ID NO: 752783 - RNA, 64 nt, hsa; identical to SEQ ID NO: 583021

SEQ ID NO: 752784 - RNA, 64 nt, hsa; identical to SEQ ID NO: 583022

SEQ ID NO: 752785 - RNA, 64 nt, hsa; identical to SEQ ID NO: 583023

SEQ ID NO: 752786 - RNA, 64 nt, hsa; identical to SEQ ID NO: 583024

SEQ ID NO: 752787 - RNA, 64 nt, hsa; identical to SEQ ID NO: 583025

SEQ ID NO: 752788 - RNA, 64 nt, hsa; identical to SEQ ID NO: 583026

SEQ ID NO: 752789 - RNA, 64 nt, hsa; identical to SEQ ID NO: 583027

SEQ ID NO: 752790 - RNA, 64 nt, hsa; identical to SEQ ID NO: 583028

SEQ ID NO: 752791 - RNA, 64 nt, hsa; identical to SEQ ID NO: 583029

SEQ ID NO: 752792 - RNA, 64 nt, hsa; identical to SEQ ID NO: 583030

SEQ ID NO: 752793 - RNA, 64 nt, hsa; identical to SEQ ID NO: 583031

SEQ ID NO: 752794 - RNA, 64 nt, hsa; identical to SEQ ID NO: 583032

SEQ ID NO: 752795 - RNA, 64 nt, hsa; identical to SEQ ID NO: 583033

SEQ ID NO: 752796 - RNA, 64 nt, hsa; identical to SEQ ID NO: 583034

SEQ ID NO: 752797 - RNA, 64 nt, hsa; identical to SEQ ID NO: 583035

SEQ ID NO: 752798 - RNA, 64 nt, hsa; identical to SEQ ID NO: 583036

SEQ ID NO: 752799 - RNA, 64 nt, hsa; identical to SEQ ID NO: 583037

SEQ ID NO: 752800 - RNA, 64 nt, hsa; identical to SEQ ID NO: 583038

SEQ ID NO: 752801 - RNA, 64 nt, hsa; identical to SEQ ID NO: 583039

SEQ ID NO: 752802 - RNA, 64 nt, hsa; identical to SEQ ID NO: 583040

SEQ ID NO: 752803 - RNA, 64 nt, hsa; identical to SEQ ID NO: 583041

SEQ ID NO: 752804 - RNA, 64 nt, hsa; identical to SEQ ID NO: 583042

SEQ ID NO: 752805 - RNA, 64 nt, hsa; identical to SEQ ID NO: 583043

SEQ ID NO: 752806 - RNA, 64 nt, hsa; identical to SEQ ID NO: 583044

SEQ ID NO: 752807 - RNA, 64 nt, hsa; identical to SEQ ID NO: 583045

SEQ ID NO: 752808 - RNA, 64 nt, hsa; identical to SEQ ID NO: 583046

SEQ ID NO: 752809 - RNA, 64 nt, hsa; identical to SEQ ID NO: 583047

SEQ ID NO: 752810 - RNA, 64 nt, hsa; identical to SEQ ID NO: 583048

SEQ ID NO: 752811 - RNA, 64 nt, hsa; identical to SEQ ID NO: 583049

SEQ ID NO: 752812 - RNA, 64 nt, hsa; identical to SEQ ID NO: 583050

SEQ ID NO: 752813 - RNA, 64 nt, hsa; identical to SEQ ID NO: 583051

SEQ ID NO: 752814 - RNA, 64 nt, hsa; identical to SEQ ID NO: 583052

SEQ ID NO: 752815 - RNA, 64 nt, hsa; identical to SEQ ID NO: 583053

SEQ ID NO: 752816 - RNA, 64 nt, hsa; identical to SEQ ID NO: 583054

SEQ ID NO: 752817 - RNA, 64 nt, hsa; identical to SEQ ID NO: 583055

SEQ ID NO: 752818 - RNA, 64 nt, hsa; identical to SEQ ID NO: 583056

SEQ ID NO: 752819 - RNA, 64 nt, hsa; identical to SEQ ID NO: 583057

SEQ ID NO: 752820 - RNA, 64 nt, hsa; identical to SEQ ID NO: 583058

SEQ ID NO: 752821 - RNA, 64 nt, hsa; identical to SEQ ID NO: 583059

SEQ ID NO: 752822 - RNA, 64 nt, hsa; identical to SEQ ID NO: 583060

SEQ ID NO: 752823 - RNA, 64 nt, hsa; identical to SEQ ID NO: 583061

SEQ ID NO: 752824 - RNA, 64 nt, hsa; identical to SEQ ID NO: 583062

SEQ ID NO: 752825 - RNA, 64 nt, hsa; identical to SEQ ID NO: 583063

SEQ ID NO: 752826 - RNA, 64 nt, hsa; identical to SEQ ID NO: 583064

SEQ ID NO: 752827 - RNA, 64 nt, hsa; identical to SEQ ID NO: 583065

SEQ ID NO: 752828 - RNA, 64 nt, hsa; identical to SEQ ID NO: 262953

SEQ ID NO: 752829 - RNA, 64 nt, hsa; identical to SEQ ID NO: 262954

SEQ ID NO: 752830 - RNA, 64 nt, hsa; identical to SEQ ID NO: 262955

SEQ ID NO: 752831 - RNA, 64 nt, hsa; identical to SEQ ID NO: 262956

SEQ ID NO: 752832 - RNA, 64 nt, hsa; identical to SEQ ID NO: 262957

SEQ ID NO: 752833 - RNA, 64 nt, hsa; identical to SEQ ID NO: 262958

SEQ ID NO: 752834 - RNA, 64 nt, hsa; identical to SEQ ID NO: 262959

SEQ ID NO: 752835 - RNA, 64 nt, hsa; identical to SEQ ID NO: 262960

SEQ ID NO: 752836 - RNA, 64 nt, hsa; identical to SEQ ID NO: 262961

SEQ ID NO: 752837 - RNA, 64 nt, hsa; identical to SEQ ID NO: 262962

SEQ ID NO: 752838 - RNA, 64 nt, hsa; identical to SEQ ID NO: 262963

SEQ ID NO: 752839 - RNA, 64 nt, hsa; identical to SEQ ID NO: 262964

SEQ ID NO: 752840 - RNA, 64 nt, hsa; identical to SEQ ID NO: 262965

SEQ ID NO: 752841 - RNA, 57 nt, hsa; identical to SEQ ID NO: 262966

SEQ ID NO: 752842 - RNA, 64 nt, hsa; identical to SEQ ID NO: 276332

SEQ ID NO: 752843 - RNA, 64 nt, hsa; identical to SEQ ID NO: 276333

SEQ ID NO: 752844 - RNA, 64 nt, hsa; identical to SEQ ID NO: 276334

SEQ ID NO: 752845 - RNA, 64 nt, hsa; identical to SEQ ID NO: 276335

SEQ ID NO: 752846 - RNA, 64 nt, hsa; identical to SEQ ID NO: 276336

SEQ ID NO: 752847 - RNA, 64 nt, hsa; identical to SEQ ID NO: 276337

SEQ ID NO: 752848 - RNA, 64 nt, hsa; identical to SEQ ID NO: 276338

SEQ ID NO: 752849 - RNA, 64 nt, hsa; identical to SEQ ID NO: 276339

SEQ ID NO: 752850 - RNA, 64 nt, hsa; identical to SEQ ID NO: 276340

SEQ ID NO: 752851 - RNA, 64 nt, hsa; identical to SEQ ID NO: 276341

SEQ ID NO: 752852 - RNA, 64 nt, hsa; identical to SEQ ID NO: 276342

SEQ ID NO: 752853 - RNA, 64 nt, hsa; identical to SEQ ID NO: 276343

SEQ ID NO: 752854 - RNA, 64 nt, hsa; identical to SEQ ID NO: 276344

SEQ ID NO: 752855 - RNA, 64 nt, hsa; identical to SEQ ID NO: 276345

SEQ ID NO: 752856 - RNA, 64 nt, hsa; identical to SEQ ID NO: 276346

SEQ ID NO: 752857 - RNA, 64 nt, hsa; identical to SEQ ID NO: 276347

SEQ ID NO: 752858 - RNA, 64 nt, hsa; identical to SEQ ID NO: 276348

SEQ ID NO: 752859 - RNA, 64 nt, hsa; identical to SEQ ID NO: 276349

SEQ ID NO: 752860 - RNA, 64 nt, hsa; identical to SEQ ID NO: 276350

SEQ ID NO: 752861 - RNA, 64 nt, hsa; identical to SEQ ID NO: 276351

SEQ ID NO: 752862 - RNA, 64 nt, hsa; identical to SEQ ID NO: 276352

SEQ ID NO: 752863 - RNA, 64 nt, hsa; identical to SEQ ID NO: 276353

SEQ ID NO: 752864 - RNA, 64 nt, hsa; identical to SEQ ID NO: 276354

SEQ ID NO: 752865 - RNA, 64 nt, hsa; identical to SEQ ID NO: 276355

SEQ ID NO: 752866 - RNA, 64 nt, hsa; identical to SEQ ID NO: 276356

SEQ ID NO: 752867 - RNA, 64 nt, hsa; identical to SEQ ID NO: 276357

SEQ ID NO: 752868 - RNA, 64 nt, hsa; identical to SEQ ID NO: 276358

SEQ ID NO: 752869 - RNA, 64 nt, hsa; identical to SEQ ID NO: 276359

SEQ ID NO: 752870 - RNA, 64 nt, hsa; identical to SEQ ID NO: 147180

SEQ ID NO: 752871 - RNA, 64 nt, hsa; identical to SEQ ID NO: 147181

SEQ ID NO: 752872 - RNA, 64 nt, hsa; identical to SEQ ID NO: 147182

SEQ ID NO: 752873 - RNA, 64 nt, hsa; identical to SEQ ID NO: 147183

SEQ ID NO: 752874 - RNA, 64 nt, hsa; identical to SEQ ID NO: 147184

SEQ ID NO: 752875 - RNA, 64 nt, hsa; identical to SEQ ID NO: 147185

SEQ ID NO: 752876 - RNA, 64 nt, hsa; identical to SEQ ID NO: 147186

SEQ ID NO: 752877 - RNA, 64 nt, hsa; identical to SEQ ID NO: 147187

SEQ ID NO: 752878 - RNA, 64 nt, hsa; identical to SEQ ID NO: 147188

SEQ ID NO: 752879 - RNA, 64 nt, hsa; identical to SEQ ID NO: 147189

SEQ ID NO: 752880 - RNA, 64 nt, hsa; identical to SEQ ID NO: 147190

SEQ ID NO: 752881 - RNA, 64 nt, hsa; identical to SEQ ID NO: 147191

SEQ ID NO: 752882 - RNA, 64 nt, hsa; identical to SEQ ID NO: 147192

SEQ ID NO: 752883 - RNA, 64 nt, hsa; identical to SEQ ID NO: 147193

SEQ ID NO: 752884 - RNA, 64 nt, hsa
cuaggcaaacuacuaacaugcauugugagaaugccguguauaccucacguacuguguacuuugu

SEQ ID NO: 752885 - RNA, 64 nt, hsa
gaaagcuagaaacacuagguucuuccuguacauacguguauauaugugaacagugagauggccg

SEQ ID NO: 752886 - RNA, 55 nt, hsa
ugggcacugcaucagccugaaugaggcuggccaccugccacuuugcccugcccuc

SEQ ID NO: 752887 - RNA, 64 nt, hsa
uuugcuuggcuggggagccccccaggccagguuugcuggccauagauaccuuugggcugccugg

SEQ ID NO: 752888 - RNA, 64 nt, hsa
aauggcuccuccagagggccccucagagccaggugcuggccagaugccuugaucacagccucca

SEQ ID NO: 752889 - RNA, 64 nt, hsa
agaacaguuccccacccagcgauuagggagcugggcuggccaguacagccaguggggagugggu

SEQ ID NO: 752890 - RNA, 64 nt, hsa
cucaggcuuccugaccuaccgccaguggccccuugcuggccacccuauaggguccuccuucccu

SEQ ID NO: 752891 - RNA, 64 nt, hsa
gccucugcagcaagcagggcuucaggaggugcccgcuggccacagccagguuuucccuaagaag

SEQ ID NO: 752892 - RNA, 64 nt, hsa
acauauauacacaugcacauacacagauuuuucugcuggccaggugggccaacuggguuucccu

SEQ ID NO: 752893 - RNA, 64 nt, hsa
gaggaaggucucacaucugucucugggcacccaugcuggccagcaguuucccagggcucccugg

SEQ ID NO: 752894 - RNA, 64 nt, hsa
uuuucugugaaaugugcugcuccccuuugugcaggcuggccagccaagaguucccuuccagcuc

SEQ ID NO: 752895 - RNA, 64 nt, hsa
cauggugggauaagacaacaggcugacaaaccaagcuggccauuugguaccgugagaaaggaaa

SEQ ID NO: 752896 - RNA, 64 nt, hsa
gagugagccaaugcucaccagccccagagucagagcuggccacaggcuggcagccuccaggggc

SEQ ID NO: 752897 - RNA, 64 nt, hsa
aggcuaagccauguggcagggaccgucuugcccugcuggccacacucuggagaagcacuucuca

SEQ ID NO: 752898 - RNA, 64 nt, hsa
ggagucagggucccaagaucccaccuguauggucgcuggccagugauucuccuucugagccgug

SEQ ID NO: 752899 - RNA, 64 nt, hsa
cccugacugggggcaggggaagagacagggcacagcuggccacagggcucagccacugagcagg

SEQ ID NO: 752900 - RNA, 64 nt, hsa
gaaccacacgaaaccucaacugggggagugaggggcuggccaggucuggaggggccucaggggu

SEQ ID NO: 752901 - RNA, 64 nt, hsa
gaugcuggggcuucagcccgccgcagacuucacagcuggccacaacgagccuguagccaacggc

SEQ ID NO: 752902 - RNA, 64 nt, hsa
gccagccagucugguggagcucagcgucuggcuggcuggccagccugugggucuguugggagca

SEQ ID NO: 752903 - RNA, 64 nt, hsa
aggggugauucagagguggggaugggcagagagggcuggccacucugccucaggacuugaccuc

SEQ ID NO: 752904 - RNA, 64 nt, hsa
uuaguaaacaagcggaacauagauaauggacaaugcuggccacugccauucuguguucagaaag

SEQ ID NO: 752905 - RNA, 64 nt, hsa
cauaauacaguugugaggaauguguuguaacuuggcuggccaaguuacauguuacaguaucuuu

SEQ ID NO: 752906 - RNA, 64 nt, hsa
cauggugcaugagugaucucagccuagcgaugccgcuggccagaccgugaccaugcugccagug

SEQ ID NO: 752907 - RNA, 64 nt, hsa
uuuuauauuuuugguagagaugggguuucaccaugcuggccaggcuggucucgaacuccugacc

SEQ ID NO: 752908 - RNA, 64 nt, hsa
uuuccacggacccagcucuguggagggcaugacugcuggccagaagcuagugguccuggggccc

SEQ ID NO: 752909 - RNA, 64 nt, hsa
cccugaccucccucaccaguggaggcuggguagugcuggccaucccaaaagggcucuguccugg

SEQ ID NO: 752910 - RNA, 64 nt, hsa
ugguuccaaacaacaccaccgagaucucccucaggcuggccagguuuugcagcuggaauucucc

SEQ ID NO: 752911 - RNA, 64 nt, hsa
gaaugccacaguggauacgccagcaggccacauggcuggccaagcaauuauuauuauggauccc

SEQ ID NO: 752912 - RNA, 64 nt, hsa
agagcccacacugccagucgaggccuggcuggaggcuggccacaguggaaauucugccgagccu

SEQ ID NO: 752913 - RNA, 64 nt, hsa
ucccugcucugcugcauggggccccauggcuuuggcuggccacugaggguaggguguggaggug

SEQ ID NO: 752914 - RNA, 64 nt, hsa
uccacccaccccacgacccgugacuacugugcaagcuggccaggagguagguggagggcaaggc

SEQ ID NO: 752915 - RNA, 64 nt, hsa
accggggagaaguggggccgugguucgagggagggcuggccaggggugggacccuuaugagacu

SEQ ID NO: 752916 - RNA, 63 nt, hsa
uuucccugacuccuggugcccucucccuuuguccccccagagagacauaugcccccagagaga

SEQ ID NO: 752917 - RNA, 63 nt, hsa
cccucucccuuuguccccccagagagacauaugcccccagagagagcaaaucgaagcguggga

SEQ ID NO: 752918 - RNA, 63 nt, hsa
ugaagugauccuuaacccccaaguaaucauuaacccccagaccagccucagaacugaaggaga

SEQ ID NO: 752919 - RNA, 63 nt, hsa
gucacagggggugucgggcggaggaaagugcaucccccagagcuuggguuccucucuccucuc

SEQ ID NO: 752920 - RNA, 63 nt, hsa
cugcccuagacccugccagaaaagggggcucuucccccagagaaguggcuuggagggaacuuc

SEQ ID NO: 752921 - RNA, 63 nt, hsa
uuuggacaucuggggaaguggagauuaaccccucccccagacucgugccuugccucucaggac

SEQ ID NO: 752922 - RNA, 63 nt, hsa
acuucgagaguagcccugucuuguccccuccuacccccagauuagcaccaccccucucacucu

SEQ ID NO: 752923 - RNA, 63 nt, hsa
cuaacauaacuuauuaaaggaggggucccuccucccccagagcaguccucaacacuaugucag

SEQ ID NO: 752924 - RNA, 63 nt, hsa
agugcuggaaaugcagccacuggcagaucuggccccccagacgucaccgcagggccucugaag

SEQ ID NO: 752925 - RNA, 63 nt, hsa
ugcagggcagacagugccuggcacugaggggugcccccagaccccgcugggacuggaugugcc

SEQ ID NO: 752926 - RNA, 63 nt, hsa
cagcucugccucgcagcccccucagcaugggugcccccagaaguaagcagcucuuggacccac

SEQ ID NO: 752927 - RNA, 63 nt, hsa
gugguucagguggggucuccagaaggcugcuugcccccagagagccaucucuuccauuuuuga

SEQ ID NO: 752928 - RNA, 63 nt, hsa
aaggucugugggcucuaggcagcccggcagcagcccccagaggaacugcucccaccucuccuu

SEQ ID NO: 752929 - RNA, 63 nt, hsa
ggauccugaccugacuauccaugccauccauggcccccagacugacucugcaccuggcccuuu

SEQ ID NO: 752930 - RNA, 63 nt, hsa
ggggcugagucuucccuggccccuuggaagaggcccccagaugcccaggcucacuucaguguu

SEQ ID NO: 752931 - RNA, 63 nt, hsa
uagcuuuuagcuauaaaccacucaaagauucagcccccagaucccacagucagaacugaaucu

SEQ ID NO: 752932 - RNA, 63 nt, hsa
cucaauucucagggcuggaaugagccggcuggucccccagaaagcuggagugggguacagagu

SEQ ID NO: 752933 - RNA, 63 nt, hsa
ugggacaccaggccugacucaggcagguucugccccccagaccccacacacggccgccccacg

SEQ ID NO: 752934 - RNA, 63 nt, hsa
ccaccgggucugggcucuggaaggagccagaugcccccagaaaggugggugguggagacggca

SEQ ID NO: 752935 - RNA, 63 nt, hsa
aggcguggagguguccccaccccuuccaccugucccccagacccaaagcucucuccccacccu

SEQ ID NO: 752936 - RNA, 63 nt, hsa
uggcgggaaaacacugacugacuccuuggguuucccccagacauacuuucagagcgcuagcug

SEQ ID NO: 752937 - RNA, 63 nt, hsa
cagcccuggacugaggauggaugguuccaugagcccccagaugaaaaccuggauucgacaggg

SEQ ID NO: 752938 - RNA, 63 nt, hsa
gggcccagcuugcucagucaaggggcugccaggcccccagaaaacacuuggagccaucgggua

SEQ ID NO: 752939 - RNA, 63 nt, hsa
auucagcacgcacacaacacacaagggagagaacccccagaugagaaaauaggaaggagcaau

SEQ ID NO: 752940 - RNA, 63 nt, hsa
uccauggcaggcaucccugccuugggcugcccucccccagaccccugaccacccccugggucc

SEQ ID NO: 752941 - RNA, 63 nt, hsa
caaugagagaccaggaguagguccuaucagugccccccagaguagagagcaauaagagcccag

SEQ ID NO: 752942 - RNA, 63 nt, hsa
ucacccuccucccccauggagguuuccaggggucccccagacaugaaagaggggugagcugga

SEQ ID NO: 752943 - RNA, 63 nt, hsa
auagucacauguuuuucuuccuuguccccacggcccccagaacaacauucucccugcuggcag

SEQ ID NO: 752944 - RNA, 63 nt, hsa
ggggagccuaggcccagcuccuccgcgguuggccccccagaccauaccucugacccacccagc

SEQ ID NO: 752945 - RNA, 63 nt, hsa
ccugccacagggcacuggaauggacagcaggcgcccccagaugcagguaccucccuugguccc

SEQ ID NO: 752946 - RNA, 63 nt, hsa
acagacacugaccucagaggccccacucuggugcccccagacccugggcccccagccucuggc

SEQ ID NO: 752947 - RNA, 63 nt, hsa
aaggaaagggaagaagagaucacgaaacugggacccccagaagggaggagugggcuuugaacu

SEQ ID NO: 752948 - RNA, 63 nt, hsa
uuguggguuaugaggacacagaagucccugaggcccccagaccuggcucagccaaccuccuuc

SEQ ID NO: 752949 - RNA, 63 nt, hsa
gaggucauaauaucccucuaggacuuaccuguucccccagaucuugccuugggaccacauuug

SEQ ID NO: 752950 - RNA, 63 nt, hsa
aaucuuaacuaccuacccaaaggauuugcauuacccccagauucugugccaacaaccuuuuaa

SEQ ID NO: 752951 - RNA, 63 nt, hsa
ggccucucaucaggaucugccccccagagaccccccccagacacugcagggccuggugaugcu

SEQ ID NO: 752952 - RNA, 63 nt, hsa
aguaaaggcuccuggccucucaucaggaucugccccccagagaccccccccagacacugcagg

SEQ ID NO: 752953 - RNA, 63 nt, hsa
cugccaccugagaagauggaaaggaaggagcugcccccagagcaucaguccuugaagagcagc

SEQ ID NO: 752954 - RNA, 63 nt, hsa
gccacuuuaggauggcgaugcaggugucuuuuccccccagaucuccucuuccuucagcaaagg

SEQ ID NO: 752955 - RNA, 63 nt, hsa
gcuggggguccgcaucccuaccucagcuuaggacccccagagccaagguggcugggaucuggc

SEQ ID NO: 752956 - RNA, 63 nt, hsa
aucugugguccaggccggcaucguccuggccaccccccagaucuggugccugcuggccggccc

SEQ ID NO: 752957 - RNA, 63 nt, hsa
ugauaaauugagggcacuuguacccucccugugcccccagaagguucuuggagagaagugcaa

SEQ ID NO: 752958 - RNA, 63 nt, hsa
gccccccggagguggcagcagccccgagggacgcccccagaggaccgggaggcaccccacccu

SEQ ID NO: 752959 - RNA, 63 nt, hsa
ccaggagcucggacugcugguccuggagagcugcccccagaagaagcuggagugcauagguca

SEQ ID NO: 752960 - RNA, 63 nt, hsa
ccccaccgccauuggcauccccaccaagcuccucccccagaacccugaggccaagggggccac

SEQ ID NO: 752961 - RNA, 63 nt, hsa
auggagcagcagcaggacagacccccacgaggccccccagagaggaggaagaucccacggagg

SEQ ID NO: 752962 - RNA, 63 nt, hsa
cacugccugagggacaacagacaucagaacaaacccccagagagaaacagucaaaaucagggc

SEQ ID NO: 752963 - RNA, 63 nt, hsa
gcuucuccccccaucccagggucccacccccaacccccagagguggcccuuguuuacagugag

SEQ ID NO: 752964 - RNA, 63 nt, hsa
ggcagucaccacccagcccuuccuugggcgucucccccagagugcugucgggaccacaucugu

SEQ ID NO: 752965 - RNA, 61 nt, hsa; identical to SEQ ID NO: 88249

SEQ ID NO: 752966 - RNA, 63 nt, hsa
uagaaugccacagucccccaacccuccacagagcccccagacccaccagaacuuccacagacg

SEQ ID NO: 752967 - RNA, 63 nt, hsa
cugagcacagaccagcagcgaccucccuuccagcccccagaaagcucggucacuugaguguuu

SEQ ID NO: 752968 - RNA, 63 nt, hsa
cuccuccacucccuuuuuguaacucccuuacagcccccagacccuucuugaaacgagagccag

SEQ ID NO: 752969 - RNA, 63 nt, hsa
cagaagucgcaggcagccucucagaaaguuucacccccagaggacgaagaggucaagaaccuu

SEQ ID NO: 752970 - RNA, 63 nt, hsa
aaccccaguacugacagccuccuuaaaguuucacccccagagggagccgagacucggaaagug

SEQ ID NO: 752971 - RNA, 63 nt, hsa
cucucaggcagaugccgaggccaaguggacugacccccagauuuccuucccuuggaugcuuuc

SEQ ID NO: 752972 - RNA, 63 nt, hsa
caaagacuucauccggcaccuucuggagcgagacccccagaagagguucaccugccaacaggc

SEQ ID NO: 752973 - RNA, 64 nt, hsa; identical to SEQ ID NO: 283916

SEQ ID NO: 752974 - RNA, 64 nt, hsa; identical to SEQ ID NO: 283917

SEQ ID NO: 752975 - RNA, 64 nt, hsa; identical to SEQ ID NO: 283918

SEQ ID NO: 752976 - RNA, 64 nt, hsa; identical to SEQ ID NO: 283919

SEQ ID NO: 752977 - RNA, 64 nt, hsa; identical to SEQ ID NO: 92229

SEQ ID NO: 752978 - RNA, 64 nt, hsa; identical to SEQ ID NO: 92230

SEQ ID NO: 752979 - RNA, 64 nt, hsa; identical to SEQ ID NO: 92231

SEQ ID NO: 752980 - RNA, 64 nt, hsa; identical to SEQ ID NO: 92232

SEQ ID NO: 752981 - RNA, 64 nt, hsa; identical to SEQ ID NO: 92233

SEQ ID NO: 752982 - RNA, 64 nt, hsa; identical to SEQ ID NO: 92234

SEQ ID NO: 752983 - RNA, 64 nt, hsa; identical to SEQ ID NO: 92235

SEQ ID NO: 752984 - RNA, 64 nt, hsa; identical to SEQ ID NO: 92236

SEQ ID NO: 752985 - RNA, 64 nt, hsa; identical to SEQ ID NO: 92237

SEQ ID NO: 752986 - RNA, 64 nt, hsa; identical to SEQ ID NO: 92238

SEQ ID NO: 752987 - RNA, 64 nt, hsa; identical to SEQ ID NO: 92239

SEQ ID NO: 752988 - RNA, 64 nt, hsa; identical to SEQ ID NO: 92240

SEQ ID NO: 752989 - RNA, 64 nt, hsa; identical to SEQ ID NO: 92241

SEQ ID NO: 752990 - RNA, 64 nt, hsa; identical to SEQ ID NO: 92242

SEQ ID NO: 752991 - RNA, 64 nt, hsa; identical to SEQ ID NO: 92243

SEQ ID NO: 752992 - RNA, 64 nt, hsa; identical to SEQ ID NO: 92244

SEQ ID NO: 752993 - RNA, 64 nt, hsa; identical to SEQ ID NO: 92245

SEQ ID NO: 752994 - RNA, 64 nt, hsa; identical to SEQ ID NO: 92246

SEQ ID NO: 752995 - RNA, 64 nt, hsa; identical to SEQ ID NO: 92247

SEQ ID NO: 752996 - RNA, 64 nt, hsa; identical to SEQ ID NO: 92248

SEQ ID NO: 752997 - RNA, 64 nt, hsa; identical to SEQ ID NO: 92249

SEQ ID NO: 752998 - RNA, 64 nt, hsa; identical to SEQ ID NO: 92250

SEQ ID NO: 752999 - RNA, 64 nt, hsa; identical to SEQ ID NO: 92251

SEQ ID NO: 753000 - RNA, 64 nt, hsa; identical to SEQ ID NO: 92252

SEQ ID NO: 753001 - RNA, 64 nt, hsa; identical to SEQ ID NO: 92253

SEQ ID NO: 753002 - RNA, 64 nt, hsa; identical to SEQ ID NO: 92254

SEQ ID NO: 753003 - RNA, 64 nt, hsa; identical to SEQ ID NO: 92255

SEQ ID NO: 753004 - RNA, 64 nt, hsa; identical to SEQ ID NO: 92256

SEQ ID NO: 753005 - RNA, 64 nt, hsa; identical to SEQ ID NO: 92257

SEQ ID NO: 753006 - RNA, 64 nt, hsa; identical to SEQ ID NO: 92258

SEQ ID NO: 753007 - RNA, 64 nt, hsa; identical to SEQ ID NO: 92259

SEQ ID NO: 753008 - RNA, 64 nt, hsa; identical to SEQ ID NO: 92260

SEQ ID NO: 753009 - RNA, 64 nt, hsa; identical to SEQ ID NO: 92261

SEQ ID NO: 753010 - RNA, 64 nt, hsa; identical to SEQ ID NO: 92262

SEQ ID NO: 753011 - RNA, 64 nt, hsa; identical to SEQ ID NO: 92263

SEQ ID NO: 753012 - RNA, 64 nt, hsa; identical to SEQ ID NO: 92264

SEQ ID NO: 753013 - RNA, 64 nt, hsa; identical to SEQ ID NO: 92265

SEQ ID NO: 753014 - RNA, 64 nt, hsa; identical to SEQ ID NO: 92266

SEQ ID NO: 753015 - RNA, 64 nt, hsa; identical to SEQ ID NO: 92267

SEQ ID NO: 753016 - RNA, 64 nt, hsa; identical to SEQ ID NO: 92268

SEQ ID NO: 753017 - RNA, 64 nt, hsa; identical to SEQ ID NO: 92269

SEQ ID NO: 753018 - RNA, 61 nt, hsa; identical to SEQ ID NO: 92270

SEQ ID NO: 753019 - RNA, 64 nt, hsa; identical to SEQ ID NO: 92271

SEQ ID NO: 753020 - RNA, 64 nt, hsa; identical to SEQ ID NO: 92272

SEQ ID NO: 753021 - RNA, 64 nt, hsa; identical to SEQ ID NO: 92273

SEQ ID NO: 753022 - RNA, 64 nt, hsa; identical to SEQ ID NO: 92274

SEQ ID NO: 753023 - RNA, 64 nt, hsa; identical to SEQ ID NO: 92275

SEQ ID NO: 753024 - RNA, 64 nt, hsa; identical to SEQ ID NO: 92276

SEQ ID NO: 753025 - RNA, 64 nt, hsa; identical to SEQ ID NO: 92277

SEQ ID NO: 753026 - RNA, 64 nt, hsa; identical to SEQ ID NO: 92278

SEQ ID NO: 753027 - RNA, 64 nt, hsa; identical to SEQ ID NO: 92279

SEQ ID NO: 753028 - RNA, 64 nt, hsa; identical to SEQ ID NO: 92280

SEQ ID NO: 753029 - RNA, 64 nt, hsa; identical to SEQ ID NO: 92281

SEQ ID NO: 753030 - RNA, 64 nt, hsa; identical to SEQ ID NO: 92282

SEQ ID NO: 753031 - RNA, 64 nt, hsa; identical to SEQ ID NO: 92283

SEQ ID NO: 753032 - RNA, 64 nt, hsa; identical to SEQ ID NO: 92284

SEQ ID NO: 753033 - RNA, 64 nt, hsa; identical to SEQ ID NO: 92285

SEQ ID NO: 753034 - RNA, 64 nt, hsa; identical to SEQ ID NO: 92286

SEQ ID NO: 753035 - RNA, 64 nt, hsa; identical to SEQ ID NO: 92287

SEQ ID NO: 753036 - RNA, 64 nt, hsa; identical to SEQ ID NO: 92288

SEQ ID NO: 753037 - RNA, 64 nt, hsa; identical to SEQ ID NO: 92289

SEQ ID NO: 753038 - RNA, 62 nt, hsa; identical to SEQ ID NO: 92290

SEQ ID NO: 753039 - RNA, 64 nt, hsa; identical to SEQ ID NO: 92291

SEQ ID NO: 753040 - RNA, 64 nt, hsa; identical to SEQ ID NO: 92292

SEQ ID NO: 753041 - RNA, 64 nt, hsa; identical to SEQ ID NO: 92293

SEQ ID NO: 753042 - RNA, 64 nt, hsa; identical to SEQ ID NO: 92294

SEQ ID NO: 753043 - RNA, 64 nt, hsa; identical to SEQ ID NO: 92295

SEQ ID NO: 753044 - RNA, 64 nt, hsa; identical to SEQ ID NO: 92296

SEQ ID NO: 753045 - RNA, 64 nt, hsa; identical to SEQ ID NO: 92297

SEQ ID NO: 753046 - RNA, 64 nt, hsa; identical to SEQ ID NO: 92298

SEQ ID NO: 753047 - RNA, 64 nt, hsa; identical to SEQ ID NO: 92299

SEQ ID NO: 753048 - RNA, 64 nt, hsa; identical to SEQ ID NO: 92300

SEQ ID NO: 753049 - RNA, 64 nt, hsa; identical to SEQ ID NO: 92301

SEQ ID NO: 753050 - RNA, 64 nt, hsa; identical to SEQ ID NO: 92302

SEQ ID NO: 753051 - RNA, 64 nt, hsa; identical to SEQ ID NO: 92303

SEQ ID NO: 753052 - RNA, 64 nt, hsa; identical to SEQ ID NO: 92304

SEQ ID NO: 753053 - RNA, 64 nt, hsa; identical to SEQ ID NO: 92305

SEQ ID NO: 753054 - RNA, 64 nt, hsa; identical to SEQ ID NO: 92306

SEQ ID NO: 753055 - RNA, 64 nt, hsa; identical to SEQ ID NO: 92307

SEQ ID NO: 753056 - RNA, 64 nt, hsa; identical to SEQ ID NO: 92308

SEQ ID NO: 753057 - RNA, 64 nt, hsa; identical to SEQ ID NO: 92309

SEQ ID NO: 753058 - RNA, 64 nt, hsa; identical to SEQ ID NO: 92310

SEQ ID NO: 753059 - RNA, 64 nt, hsa; identical to SEQ ID NO: 92311

SEQ ID NO: 753060 - RNA, 64 nt, hsa; identical to SEQ ID NO: 92312

SEQ ID NO: 753061 - RNA, 64 nt, hsa; identical to SEQ ID NO: 92313

SEQ ID NO: 753062 - RNA, 64 nt, hsa; identical to SEQ ID NO: 92314

SEQ ID NO: 753063 - RNA, 64 nt, hsa; identical to SEQ ID NO: 92315

SEQ ID NO: 753064 - RNA, 64 nt, hsa; identical to SEQ ID NO: 92316

SEQ ID NO: 753065 - RNA, 64 nt, hsa; identical to SEQ ID NO: 92317

SEQ ID NO: 753066 - RNA, 64 nt, hsa; identical to SEQ ID NO: 92318

SEQ ID NO: 753067 - RNA, 64 nt, hsa; identical to SEQ ID NO: 92319

SEQ ID NO: 753068 - RNA, 64 nt, hsa; identical to SEQ ID NO: 92320

SEQ ID NO: 753069 - RNA, 64 nt, hsa; identical to SEQ ID NO: 92321

SEQ ID NO: 753070 - RNA, 64 nt, hsa; identical to SEQ ID NO: 92322

SEQ ID NO: 753071 - RNA, 64 nt, hsa; identical to SEQ ID NO: 92323

SEQ ID NO: 753072 - RNA, 64 nt, hsa; identical to SEQ ID NO: 92324

SEQ ID NO: 753073 - RNA, 64 nt, hsa; identical to SEQ ID NO: 92325

SEQ ID NO: 753074 - RNA, 64 nt, hsa; identical to SEQ ID NO: 92326

SEQ ID NO: 753075 - RNA, 64 nt, hsa; identical to SEQ ID NO: 92327

SEQ ID NO: 753076 - RNA, 64 nt, hsa; identical to SEQ ID NO: 92328

SEQ ID NO: 753077 - RNA, 64 nt, hsa; identical to SEQ ID NO: 92329

SEQ ID NO: 753078 - RNA, 64 nt, hsa; identical to SEQ ID NO: 92330

SEQ ID NO: 753079 - RNA, 64 nt, hsa; identical to SEQ ID NO: 92331

SEQ ID NO: 753080 - RNA, 64 nt, hsa; identical to SEQ ID NO: 92332

SEQ ID NO: 753081 - RNA, 64 nt, hsa; identical to SEQ ID NO: 92333

SEQ ID NO: 753082 - RNA, 64 nt, hsa; identical to SEQ ID NO: 92334

SEQ ID NO: 753083 - RNA, 64 nt, hsa; identical to SEQ ID NO: 92335

SEQ ID NO: 753084 - RNA, 64 nt, hsa; identical to SEQ ID NO: 92336

SEQ ID NO: 753085 - RNA, 64 nt, hsa; identical to SEQ ID NO: 92337

SEQ ID NO: 753086 - RNA, 64 nt, hsa; identical to SEQ ID NO: 92338

SEQ ID NO: 753087 - RNA, 64 nt, hsa; identical to SEQ ID NO: 92339

SEQ ID NO: 753088 - RNA, 64 nt, hsa; identical to SEQ ID NO: 92340

SEQ ID NO: 753089 - RNA, 64 nt, hsa; identical to SEQ ID NO: 92341

SEQ ID NO: 753090 - RNA, 64 nt, hsa; identical to SEQ ID NO: 92342

SEQ ID NO: 753091 - RNA, 64 nt, hsa; identical to SEQ ID NO: 92343

SEQ ID NO: 753092 - RNA, 64 nt, hsa; identical to SEQ ID NO: 92344

SEQ ID NO: 753093 - RNA, 64 nt, hsa; identical to SEQ ID NO: 92345

SEQ ID NO: 753094 - RNA, 64 nt, hsa; identical to SEQ ID NO: 92346

SEQ ID NO: 753095 - RNA, 64 nt, hsa; identical to SEQ ID NO: 92347

SEQ ID NO: 753096 - RNA, 64 nt, hsa; identical to SEQ ID NO: 50148

SEQ ID NO: 753097 - RNA, 64 nt, hsa; identical to SEQ ID NO: 50149

SEQ ID NO: 753098 - RNA, 64 nt, hsa; identical to SEQ ID NO: 50150

SEQ ID NO: 753099 - RNA, 64 nt, hsa; identical to SEQ ID NO: 50151

SEQ ID NO: 753100 - RNA, 64 nt, hsa; identical to SEQ ID NO: 50152

SEQ ID NO: 753101 - RNA, 64 nt, hsa; identical to SEQ ID NO: 50153

SEQ ID NO: 753102 - RNA, 64 nt, hsa; identical to SEQ ID NO: 50154

SEQ ID NO: 753103 - RNA, 64 nt, hsa; identical to SEQ ID NO: 50155

SEQ ID NO: 753104 - RNA, 64 nt, hsa; identical to SEQ ID NO: 50156

SEQ ID NO: 753105 - RNA, 64 nt, hsa; identical to SEQ ID NO: 50157

SEQ ID NO: 753106 - RNA, 64 nt, hsa; identical to SEQ ID NO: 50158

SEQ ID NO: 753107 - RNA, 64 nt, hsa; identical to SEQ ID NO: 50159

SEQ ID NO: 753108 - RNA, 64 nt, hsa; identical to SEQ ID NO: 50160

SEQ ID NO: 753109 - RNA, 64 nt, hsa; identical to SEQ ID NO: 50161

SEQ ID NO: 753110 - RNA, 64 nt, hsa; identical to SEQ ID NO: 50162

SEQ ID NO: 753111 - RNA, 64 nt, hsa; identical to SEQ ID NO: 50163

SEQ ID NO: 753112 - RNA, 64 nt, hsa; identical to SEQ ID NO: 50164

SEQ ID NO: 753113 - RNA, 64 nt, hsa; identical to SEQ ID NO: 50165

SEQ ID NO: 753114 - RNA, 64 nt, hsa; identical to SEQ ID NO: 50166

SEQ ID NO: 753115 - RNA, 64 nt, hsa; identical to SEQ ID NO: 50167

SEQ ID NO: 753116 - RNA, 64 nt, hsa; identical to SEQ ID NO: 50168

SEQ ID NO: 753117 - RNA, 64 nt, hsa; identical to SEQ ID NO: 50169

SEQ ID NO: 753118 - RNA, 64 nt, hsa; identical to SEQ ID NO: 50170

SEQ ID NO: 753119 - RNA, 64 nt, hsa; identical to SEQ ID NO: 50171

SEQ ID NO: 753120 - RNA, 64 nt, hsa; identical to SEQ ID NO: 50172

SEQ ID NO: 753121 - RNA, 64 nt, hsa; identical to SEQ ID NO: 50173

SEQ ID NO: 753122 - RNA, 64 nt, hsa; identical to SEQ ID NO: 158460

SEQ ID NO: 753123 - RNA, 64 nt, hsa; identical to SEQ ID NO: 158461

SEQ ID NO: 753124 - RNA, 64 nt, hsa; identical to SEQ ID NO: 158462

SEQ ID NO: 753125 - RNA, 64 nt, hsa; identical to SEQ ID NO: 158463

SEQ ID NO: 753126 - RNA, 64 nt, hsa; identical to SEQ ID NO: 158464

SEQ ID NO: 753127 - RNA, 64 nt, hsa; identical to SEQ ID NO: 158465

SEQ ID NO: 753128 - RNA, 64 nt, hsa; identical to SEQ ID NO: 158466

SEQ ID NO: 753129 - RNA, 64 nt, hsa; identical to SEQ ID NO: 158467

SEQ ID NO: 753130 - RNA, 64 nt, hsa; identical to SEQ ID NO: 158468

SEQ ID NO: 753131 - RNA, 64 nt, hsa; identical to SEQ ID NO: 158469

SEQ ID NO: 753132 - RNA, 64 nt, hsa; identical to SEQ ID NO: 158470

SEQ ID NO: 753133 - RNA, 64 nt, hsa
gauugcagcaacacgcucggcugcccaaacccaaggcgaagaccuugccagaguucaucaagga

SEQ ID NO: 753134 - RNA, 64 nt, hsa
auccucuucacccugcccugccugcaguugagggggcgaagaagaacccuguguucucaggaag

SEQ ID NO: 753135 - RNA, 64 nt, hsa
uuagauguacagugaagggaaaagaaaaaaaaugggcgaagagaggguggaaaauaaaaggauu

SEQ ID NO: 753136 - RNA, 64 nt, hsa
ccccaccccugcucgccccuaucgcuccagccaaggcgaagaagcacgaacgaaugucgagagg

SEQ ID NO: 753137 - RNA, 64 nt, hsa
aaaccaaacacccggacgacccucuccggugagcggcgaagacagcccgguaggcugcgucgcc

SEQ ID NO: 753138 - RNA, 64 nt, hsa
caagacugcacgugucccucuuggccuugcccagggcgaagacaccuucccugcccugguuugg

SEQ ID NO: 753139 - RNA, 64 nt, hsa
ucauuauauuuugaauuauuuauuuuacaaaaugggcgaagauauugucuuuaggauaaggcag

SEQ ID NO: 753140 - RNA, 64 nt, hsa
ccagauaaugcuacuuuauuuauacacugucuagggcgaagacccuuauuacacggaaaacggu

SEQ ID NO: 753141 - RNA, 64 nt, hsa
aaacaaaaucacaaaaccuggacaucccucaaggggcgaagaggcggccgggagacugcagaag

SEQ ID NO: 753142 - RNA, 64 nt, hsa
gcagggcucauucauugcccacuaggaucccacuggcgaagauggucuccauaucagcucucug

SEQ ID NO: 753143 - RNA, 64 nt, hsa
gucacugcucguguggucuccagcaagggauucgggcgaagacaaacggaugcacccgucuuua

SEQ ID NO: 753144 - RNA, 64 nt, hsa
gaggcugaagcaggagaauugcucaaaccugggaggcgaagauugcagugagcugaaaucacac

SEQ ID NO: 753145 - RNA, 64 nt, hsa
ugugguugaccugccuuggggagcagggcugaggggcgaagaggacauguggauauccagccag

SEQ ID NO: 753146 - RNA, 64 nt, hsa
aagggagagggaaucggagggagcagcggaaugcggcgaagacucuggacagcgagggcacagg

SEQ ID NO: 753147 - RNA, 64 nt, hsa
gagagaaaaccuuccagcagcccaguaaacugcgggcgaagagaucuacccgucucccucccuc

SEQ ID NO: 753148 - RNA, 64 nt, hsa
uuggcuugucucagggugggaagugggaggguggggcgaagaaaggauuacaccagaagauuua

SEQ ID NO: 753149 - RNA, 64 nt, hsa
cuuccaucgauuggguaguguccuucaaguggguggcgaagagccagucgggcauaugucauga

SEQ ID NO: 753150 - RNA, 64 nt, hsa
ugggagagaaccugucaaaaugucgaagaaggaaggcgaagaaucaaguaaucucuaggcaaau

SEQ ID NO: 753151 - RNA, 64 nt, hsa
aauuugacacaaaaggcaucgagaguacugacgaggcgaagauguccuuccugguagguacccc

SEQ ID NO: 753152 - RNA, 64 nt, hsa
ugcaggaggcacagggacuccgggagacucagagggcgaagagcacuggcauuuggcaugucca

SEQ ID NO: 753153 - RNA, 64 nt, hsa
agcucacucgaccuugaggaggccucccacgaagggcgaagauggccgagaugauccuaaaaau

SEQ ID NO: 753154 - RNA, 64 nt, hsa
gcugaugguugagggauggugggcagggagggagggcgaagaggcucccucuggcauuugggag

SEQ ID NO: 753155 - RNA, 64 nt, hsa
uaggaggaggcugcagcuccucguuuucagcuuuggcgaagauggauccacguuucaucuuuaa

SEQ ID NO: 753156 - RNA, 64 nt, hsa
auuuccacacuuggcuugagcacucaacccagaaggcgaagauagcuuuugguuguaggcggcu

SEQ ID NO: 753157 - RNA, 64 nt, hsa
gauccugcauguuaauggguuuaauggagagggcggcgaagaggacccgcaggcugcaaggagc

SEQ ID NO: 753158 - RNA, 64 nt, hsa
ugaagcucaggugucucacgucugggcugcaccaggcgaagagagaaauuaaagauuugagguu

SEQ ID NO: 753159 - RNA, 64 nt, hsa
aaugaaaaugucuucugaagugaagcauauuuguggcgaagaucaaauugaagauaaaauggaa

SEQ ID NO: 753160 - RNA, 64 nt, hsa
aaugaaugugcugaagcaaagugcccaugguggcggcgaagaagagaaagauguguuuuguuuu

SEQ ID NO: 753161 - RNA, 64 nt, hsa
agaaguaguuuacuuuggacuaaagaauauauugggcgaagaauagagggggagcuugcaggaa

SEQ ID NO: 753162 - RNA, 64 nt, hsa
cuuauaaggcuuucuguaaaagguacuauagaagggcgaagaaucguucaacugucaaucagcc

SEQ ID NO: 753163 - RNA, 64 nt, hsa; identical to SEQ ID NO: 264315

SEQ ID NO: 753164 - RNA, 64 nt, hsa; identical to SEQ ID NO: 264316

SEQ ID NO: 753165 - RNA, 64 nt, hsa; identical to SEQ ID NO: 264317

SEQ ID NO: 753166 - RNA, 64 nt, hsa; identical to SEQ ID NO: 264318

SEQ ID NO: 753167 - RNA, 64 nt, hsa; identical to SEQ ID NO: 264319

SEQ ID NO: 753168 - RNA, 64 nt, hsa; identical to SEQ ID NO: 264320

SEQ ID NO: 753169 - RNA, 64 nt, hsa; identical to SEQ ID NO: 264321

SEQ ID NO: 753170 - RNA, 64 nt, hsa; identical to SEQ ID NO: 264322

SEQ ID NO: 753171 - RNA, 64 nt, hsa
uuacauaacaaucuucuuugcuuuuuuggcagauaaacccaacagaggugaggcccagcuagua

SEQ ID NO: 753172 - RNA, 64 nt, hsa
ccugggaaacugaucacuucacaugccauuaauaaaacccaagaucuuuuaaaucaaaaccauu

SEQ ID NO: 753173 - RNA, 64 nt, hsa
cuaauuuacugaucuuacuacuacaaagaaaaaaaaacccaaccaaucugcaauucaaaucaga

SEQ ID NO: 753174 - RNA, 64 nt, hsa
guauuaaauacauaucauuuuuaaaaauaaaaaaaaacccaaaaauaaugcaugcauaauuuaa

SEQ ID NO: 753175 - RNA, 64 nt, hsa
gacugagagaagucagaacagagaaggggaaaaaaaacccaaaauuaugugaacaagcaaaauu

SEQ ID NO: 753176 - RNA, 64 nt, hsa
gcgaacuugaucagcuucuccaggauaaaauuaaaaacccaagcauugaucuguguacgugucc

SEQ ID NO: 753177 - RNA, 64 nt, hsa
acauuaacaaauuuuuaccuuguaaugcaggaagaaacccaagcaagcucuagucugugcuuaa

SEQ ID NO: 753178 - RNA, 64 nt, hsa
uuauuuuuaaagaaaaagaaaacaaaagccagacaaacccaaguuguccaggcaaauaaacuca

SEQ ID NO: 753179 - RNA, 64 nt, hsa
ccaguuaaggugaauauguauuguaucacaaaacaaacccaauauccagaugaauauccgagau

SEQ ID NO: 753180 - RNA, 64 nt, hsa
cacuggcucauccgcccuacuucccaucccacacaaacccaauuguaaauaacauaugacuucu

SEQ ID NO: 753181 - RNA, 64 nt, hsa
gcagguggcccuuugacuguaaaauguccuugguaaacccaaaggcuuauucuguugccugcgu

SEQ ID NO: 753182 - RNA, 64 nt, hsa
ggaacaagagugaaacucucaaaagcagaaacaaaaacccaacauauaugggcuguuagauagu

SEQ ID NO: 753183 - RNA, 64 nt, hsa
aacauguaaagaaaauaagucagcgaaaaaaaugaaacccaaaacucucugcauguacacauua

SEQ ID NO: 753184 - RNA, 64 nt, hsa
uuuuuguacauaguagcauuagguagaaaagacaaaacccaaacaccuaguuaauugagggaug

SEQ ID NO: 753185 - RNA, 64 nt, hsa
ggaagaaacacguggucaugaauagaaaaaaaacaaacccaaagguaggaaggucaaggucauu

SEQ ID NO: 753186 - RNA, 64 nt, hsa
acauuuaauucagcuuuguccaaaggaaagcuuaaaacccaauacagucuaguuuccugguucc

SEQ ID NO: 753187 - RNA, 64 nt, hsa
uguugaaaguuccuuuuugccaguuauguucaggaaacccaauaaccugaaaaaguuugacuuu

SEQ ID NO: 753188 - RNA, 64 nt, hsa
aaaacauuuauucuuuuaaauaauaauuuuuuuaaaacccaagaggucaggggauuuuauaaac

SEQ ID NO: 753189 - RNA, 64 nt, hsa
gguugggaaacucauuuacuggguccaccaaaggaaacccaauucugccauguuuuugcaaaua

SEQ ID NO: 753190 - RNA, 64 nt, hsa
uuaauucuucucuuucucauucuugcccuuugagaaacccaaguggaaucaucacuuaauuacu

SEQ ID NO: 753191 - RNA, 64 nt, hsa
ggcuguuuuuaaugcaggggcuuuucuucccuagaaacccaauucuaagcagaaaaagaaaaaa

SEQ ID NO: 753192 - RNA, 64 nt, hsa
uuuuuuaauucacaaggaccagguacaguagcugaaacccaauucagauccaccauaggauucu

SEQ ID NO: 753193 - RNA, 64 nt, hsa
uuuaggguagagcacucuuuacagaagaacucaaaaacccaauuuggauaauuuucauuaucuu

SEQ ID NO: 753194 - RNA, 64 nt, hsa
acuuugagaccagaauuacagagaagaaaaaccaaaacccaacccugcauggucaaguggugcu

SEQ ID NO: 753195 - RNA, 64 nt, hsa
aaaauugaaguuuguaugauguaagagaugagaaaaacccaacaggaaacacagacacauccuc

SEQ ID NO: 753196 - RNA, 64 nt, hsa
aagaaaaccaaaaaccaaaacaaacaaacaaaaaaaacccaacaacaacccagaacaaagcaaa

SEQ ID NO: 753197 - RNA, 64 nt, hsa
gaaaaggaaacccaagagcugccuggacacacggaaacccaacugagaacaaaauccuggcccg

SEQ ID NO: 753198 - RNA, 64 nt, hsa
cgucucaaaaaaaaaaaaagaaagaaagaaaaggaaacccaagagcugccuggacacacggaaa

SEQ ID NO: 753199 - RNA, 64 nt, hsa
guguaacaaaucagagacuaucuguucaaguagaaaacccaagagcuggccaggugugguggcu

SEQ ID NO: 753200 - RNA, 62 nt, hsa
uguggacaggagcauuuugcauauuuuccaucugaaaguaucacucaguugauagucuggaa

SEQ ID NO: 753201 - RNA, 62 nt, hsa
uaauauaaaauguuuugcuaaaucuuacaauuugaaaguaaaaauaaaccagagugaucaag

SEQ ID NO: 753202 - RNA, 62 nt, hsa
acucaagcaucaauucagcucuucuuuuggaaugaaaguauagccaaaacauaaaaaaaaaa

SEQ ID NO: 753203 - RNA, 62 nt, hsa
auguacagaggaaacuguucaaguauuggauuugaaaguaagugacuuauguuuaacagaac

SEQ ID NO: 753204 - RNA, 62 nt, hsa
agguuugcuccuagaacuggugauauaaagaaugaaaguagcuguaugagcagagcaguuca

SEQ ID NO: 753205 - RNA, 62 nt, hsa
auuuagaaacugguucuguguugaaauauaguugaaaguaaaaaaauaauugagacugaaag

SEQ ID NO: 753206 - RNA, 62 nt, hsa
ucggaauacauuaacuuccuuuguaauuuauuugaaaguaguguuaaacucauucagaucau

SEQ ID NO: 753207 - RNA, 62 nt, hsa
auuaagacacugcuaggagaagauuaagauuaugaaaguaacaguuauugauacugcuggac

SEQ ID NO: 753208 - RNA, 62 nt, hsa
aaagagaaacccaacaacuucauuccuagccaugaaaguagcacgaucauauuguacuguau

SEQ ID NO: 753209 - RNA, 62 nt, hsa
cagcagugcuauuuugagucaucccaguuuccugaaaguaaugcccagucuuccugaauccu

SEQ ID NO: 753210 - RNA, 62 nt, hsa
ugaaaaguaacagucuuuugucacagagaaucugaaaguagcagcaaagacagagggcucau

SEQ ID NO: 753211 - RNA, 62 nt, hsa
aaagggaaaacauuugggguucuaaacaguuaugaaaguaagugauuuuuacaugauuccag

SEQ ID NO: 753212 - RNA, 62 nt, hsa
aggauggauuagucaguucuuuucauuggucuugaaaguaauuuuggcuggucgcgguggcu

SEQ ID NO: 753213 - RNA, 62 nt, hsa
auauugucuccauuuaucauacaggaucauuaugaaaguaaaaugaaguaguauauaugaaa

SEQ ID NO: 753214 - RNA, 62 nt, hsa
ugaaugcuaaauauuugcaaacaaguacaucuugaaaguaaaggugacuuagagaaaagaga

SEQ ID NO: 753215 - RNA, 62 nt, hsa
aaaguauguaauacccauuuuaaaaaaccauuugaaaguagacaacuuauuccaaaauagca

SEQ ID NO: 753216 - RNA, 62 nt, hsa
aaccuuuuguuuuuuuccugaaaguuuuuaauugaaaguauuauuaguuaaagauguaaacc

SEQ ID NO: 753217 - RNA, 62 nt, hsa
gaaaaacagcaaccaccagaauagcauauaucugaaaguagucuucagcuuuaggcagaugc

SEQ ID NO: 753218 - RNA, 62 nt, hsa
gaaaaugcagcaugaaguugacauuguggaaaugaaaguaauuggguauuagaaaucugaaa

SEQ ID NO: 753219 - RNA, 62 nt, hsa
guggaaaugaaaguaauuggguauuagaaaucugaaaguacugucaucuaaaagcaauugug

SEQ ID NO: 753220 - RNA, 62 nt, hsa
uucacucuuuacuuuugaggcagccauuagguugaaaguauauauuuaucauauaaaacuug

SEQ ID NO: 753221 - RNA, 62 nt, hsa
uaaggcacuaauuuuacuuaccuauuagauuuugaaaguaucugagauauacaaaucucccu

SEQ ID NO: 753222 - RNA, 62 nt, hsa
ccacgauggauauugguucuuuaaaauauaucugaaaguaguagucagaaugaauuaugguu

SEQ ID NO: 753223 - RNA, 62 nt, hsa
gauuuccugcaggaggagcaacugaagucacaugaaaguaagcugaagcagaucaccaccga

SEQ ID NO: 753224 - RNA, 62 nt, hsa
aaccaugcuaacauuuuccuuuuagcuaguuuugaaaguaaggaacaauaccugggaaauaa

SEQ ID NO: 753225 - RNA, 62 nt, hsa
guuuucuucuuuuuucuucaccaaaaccaacaugaaaguaccacugaaguaaaacaccaacu

SEQ ID NO: 753226 - RNA, 62 nt, hsa
uguuauaugggagaacgaaaauuguuauauuuugaaaguacuuauuacauuauuuuuauuuu

SEQ ID NO: 753227 - RNA, 62 nt, hsa
gaaccaauuuuguuuuuaaaaccuuuagacucugaaaguaauauuuugacuaagaauguaaa

SEQ ID NO: 753228 - RNA, 62 nt, hsa
aguguuggaagauguaggugagaaaauauuccugaaaguagaacugaaagagacaaagagaa

SEQ ID NO: 753229 - RNA, 62 nt, hsa
uuuuaaagccucuaaguauaaaaucagugaguugaaaguaaaauuucuuauuuaaagaaccc

SEQ ID NO: 753230 - RNA, 62 nt, hsa
caagguagugaaguaauuggaaugaaggaggcugaaaguauugucuaaagugagcccagagg

SEQ ID NO: 753231 - RNA, 62 nt, hsa
auuaaaguuacuguugcauuuaggaggcuccuugaaaguaacaccuuuuccaaggacaaugg

SEQ ID NO: 753232 - RNA, 62 nt, hsa
cuuauuuauuuaauaggcugcagugucgcuuaugaaaguacgauguacaguaacuuaaugga

SEQ ID NO: 753233 - RNA, 62 nt, hsa
guagccggguucuaccacaaacagaaacagaaugaaaguagcugucaguccuuguagagagc

SEQ ID NO: 753234 - RNA, 62 nt, hsa
uagcuccccuucuucaugagcaucuguagagcugaaaguauucuggaacuuuagacagaaag

SEQ ID NO: 753235 - RNA, 62 nt, hsa
uucagguucugaauaacaauauuuuuccaaauugaaaguaaauauuccagaaguugauagcc

SEQ ID NO: 753236 - RNA, 62 nt, hsa
uuccagaugaaaacuacucuuuugguuuuguuugaaaguaagaaagggaggggaaacuuugc

SEQ ID NO: 753237 - RNA, 62 nt, hsa
ucuuuuuccuuguuuaaaggagucccucuugcugaaaguagaugauuacuauugcuguagug

SEQ ID NO: 753238 - RNA, 62 nt, hsa
acuuacuugucuccuuuagguuuucaagcacaugaaaguacucacacuggagauaaacccuu

SEQ ID NO: 753239 - RNA, 62 nt, hsa
uuuuacagaaaucauaugguagagagacucugugaaaguaaagaagguagucauggcggaga

SEQ ID NO: 753240 - RNA, 64 nt, hsa; identical to SEQ ID NO: 507092

SEQ ID NO: 753241 - RNA, 64 nt, hsa; identical to SEQ ID NO: 507093

SEQ ID NO: 753242 - RNA, 64 nt, hsa; identical to SEQ ID NO: 507094

SEQ ID NO: 753243 - RNA, 64 nt, hsa; identical to SEQ ID NO: 507095

SEQ ID NO: 753244 - RNA, 64 nt, hsa; identical to SEQ ID NO: 228081

SEQ ID NO: 753245 - RNA, 64 nt, hsa; identical to SEQ ID NO: 228082

SEQ ID NO: 753246 - RNA, 64 nt, hsa; identical to SEQ ID NO: 228083

SEQ ID NO: 753247 - RNA, 64 nt, hsa; identical to SEQ ID NO: 228084

SEQ ID NO: 753248 - RNA, 64 nt, hsa; identical to SEQ ID NO: 228085

SEQ ID NO: 753249 - RNA, 64 nt, hsa; identical to SEQ ID NO: 228086

SEQ ID NO: 753250 - RNA, 64 nt, hsa; identical to SEQ ID NO: 228087

SEQ ID NO: 753251 - RNA, 64 nt, hsa; identical to SEQ ID NO: 228088

SEQ ID NO: 753252 - RNA, 64 nt, hsa; identical to SEQ ID NO: 228089

SEQ ID NO: 753253 - RNA, 64 nt, hsa; identical to SEQ ID NO: 228090

SEQ ID NO: 753254 - RNA, 64 nt, hsa; identical to SEQ ID NO: 228091

SEQ ID NO: 753255 - RNA, 64 nt, hsa; identical to SEQ ID NO: 228092

SEQ ID NO: 753256 - RNA, 64 nt, hsa; identical to SEQ ID NO: 228093

SEQ ID NO: 753257 - RNA, 64 nt, hsa; identical to SEQ ID NO: 228094

SEQ ID NO: 753258 - RNA, 64 nt, hsa; identical to SEQ ID NO: 228095

SEQ ID NO: 753259 - RNA, 64 nt, hsa; identical to SEQ ID NO: 228096

SEQ ID NO: 753260 - RNA, 64 nt, hsa; identical to SEQ ID NO: 228097

SEQ ID NO: 753261 - RNA, 64 nt, hsa; identical to SEQ ID NO: 228098

SEQ ID NO: 753262 - RNA, 64 nt, hsa; identical to SEQ ID NO: 228099

SEQ ID NO: 753263 - RNA, 64 nt, hsa; identical to SEQ ID NO: 228100

SEQ ID NO: 753264 - RNA, 64 nt, hsa; identical to SEQ ID NO: 228101

SEQ ID NO: 753265 - RNA, 64 nt, hsa; identical to SEQ ID NO: 228102

SEQ ID NO: 753266 - RNA, 64 nt, hsa; identical to SEQ ID NO: 228103

SEQ ID NO: 753267 - RNA, 64 nt, hsa; identical to SEQ ID NO: 228104

SEQ ID NO: 753268 - RNA, 64 nt, hsa; identical to SEQ ID NO: 228105

SEQ ID NO: 753269 - RNA, 64 nt, hsa; identical to SEQ ID NO: 228106

SEQ ID NO: 753270 - RNA, 64 nt, hsa; identical to SEQ ID NO: 228107

SEQ ID NO: 753271 - RNA, 64 nt, hsa; identical to SEQ ID NO: 228108

SEQ ID NO: 753272 - RNA, 64 nt, hsa; identical to SEQ ID NO: 228109

SEQ ID NO: 753273 - RNA, 64 nt, hsa; identical to SEQ ID NO: 228110

SEQ ID NO: 753274 - RNA, 64 nt, hsa; identical to SEQ ID NO: 228111

SEQ ID NO: 753275 - RNA, 64 nt, hsa; identical to SEQ ID NO: 228112

SEQ ID NO: 753276 - RNA, 64 nt, hsa; identical to SEQ ID NO: 228113

SEQ ID NO: 753277 - RNA, 64 nt, hsa; identical to SEQ ID NO: 228114

SEQ ID NO: 753278 - RNA, 64 nt, hsa; identical to SEQ ID NO: 228115

SEQ ID NO: 753279 - RNA, 64 nt, hsa; identical to SEQ ID NO: 228116

SEQ ID NO: 753280 - RNA, 64 nt, hsa; identical to SEQ ID NO: 228117

SEQ ID NO: 753281 - RNA, 64 nt, hsa; identical to SEQ ID NO: 228118

SEQ ID NO: 753282 - RNA, 64 nt, hsa; identical to SEQ ID NO: 228119

SEQ ID NO: 753283 - RNA, 64 nt, hsa; identical to SEQ ID NO: 228120

SEQ ID NO: 753284 - RNA, 64 nt, hsa; identical to SEQ ID NO: 228121

SEQ ID NO: 753285 - RNA, 64 nt, hsa; identical to SEQ ID NO: 228122

SEQ ID NO: 753286 - RNA, 64 nt, hsa; identical to SEQ ID NO: 228123

SEQ ID NO: 753287 - RNA, 64 nt, hsa; identical to SEQ ID NO: 228124

SEQ ID NO: 753288 - RNA, 64 nt, hsa; identical to SEQ ID NO: 228125

SEQ ID NO: 753289 - RNA, 64 nt, hsa; identical to SEQ ID NO: 228126

SEQ ID NO: 753290 - RNA, 64 nt, hsa; identical to SEQ ID NO: 228127

SEQ ID NO: 753291 - RNA, 64 nt, hsa; identical to SEQ ID NO: 228128

SEQ ID NO: 753292 - RNA, 64 nt, hsa; identical to SEQ ID NO: 228129

SEQ ID NO: 753293 - RNA, 64 nt, hsa; identical to SEQ ID NO: 228130

SEQ ID NO: 753294 - RNA, 64 nt, hsa; identical to SEQ ID NO: 228131

SEQ ID NO: 753295 - RNA, 64 nt, hsa; identical to SEQ ID NO: 228132

SEQ ID NO: 753296 - RNA, 64 nt, hsa; identical to SEQ ID NO: 228133

SEQ ID NO: 753297 - RNA, 64 nt, hsa; identical to SEQ ID NO: 228134

SEQ ID NO: 753298 - RNA, 64 nt, hsa; identical to SEQ ID NO: 228135

SEQ ID NO: 753299 - RNA, 64 nt, hsa; identical to SEQ ID NO: 228136

SEQ ID NO: 753300 - RNA, 64 nt, hsa; identical to SEQ ID NO: 228137

SEQ ID NO: 753301 - RNA, 64 nt, hsa; identical to SEQ ID NO: 228138

SEQ ID NO: 753302 - RNA, 64 nt, hsa; identical to SEQ ID NO: 228139

SEQ ID NO: 753303 - RNA, 64 nt, hsa; identical to SEQ ID NO: 228140

SEQ ID NO: 753304 - RNA, 64 nt, hsa; identical to SEQ ID NO: 228141

SEQ ID NO: 753305 - RNA, 64 nt, hsa; identical to SEQ ID NO: 228142

SEQ ID NO: 753306 - RNA, 64 nt, hsa; identical to SEQ ID NO: 228143

SEQ ID NO: 753307 - RNA, 64 nt, hsa; identical to SEQ ID NO: 228144

SEQ ID NO: 753308 - RNA, 64 nt, hsa; identical to SEQ ID NO: 228145

SEQ ID NO: 753309 - RNA, 64 nt, hsa; identical to SEQ ID NO: 228146

SEQ ID NO: 753310 - RNA, 64 nt, hsa; identical to SEQ ID NO: 228147

SEQ ID NO: 753311 - RNA, 64 nt, hsa; identical to SEQ ID NO: 228148

SEQ ID NO: 753312 - RNA, 64 nt, hsa; identical to SEQ ID NO: 228149

SEQ ID NO: 753313 - RNA, 64 nt, hsa; identical to SEQ ID NO: 228150

SEQ ID NO: 753314 - RNA, 64 nt, hsa; identical to SEQ ID NO: 228151

SEQ ID NO: 753315 - RNA, 64 nt, hsa; identical to SEQ ID NO: 228152

SEQ ID NO: 753316 - RNA, 64 nt, hsa; identical to SEQ ID NO: 228153

SEQ ID NO: 753317 - RNA, 64 nt, hsa; identical to SEQ ID NO: 228154

SEQ ID NO: 753318 - RNA, 64 nt, hsa; identical to SEQ ID NO: 228155

SEQ ID NO: 753319 - RNA, 64 nt, hsa; identical to SEQ ID NO: 228156

SEQ ID NO: 753320 - RNA, 64 nt, hsa; identical to SEQ ID NO: 228157

SEQ ID NO: 753321 - RNA, 64 nt, hsa; identical to SEQ ID NO: 228158

SEQ ID NO: 753322 - RNA, 64 nt, hsa; identical to SEQ ID NO: 228159

SEQ ID NO: 753323 - RNA, 64 nt, hsa; identical to SEQ ID NO: 228160

SEQ ID NO: 753324 - RNA, 64 nt, hsa; identical to SEQ ID NO: 228161

SEQ ID NO: 753325 - RNA, 64 nt, hsa; identical to SEQ ID NO: 228162

SEQ ID NO: 753326 - RNA, 64 nt, hsa; identical to SEQ ID NO: 228163

SEQ ID NO: 753327 - RNA, 64 nt, hsa; identical to SEQ ID NO: 228164

SEQ ID NO: 753328 - RNA, 64 nt, hsa; identical to SEQ ID NO: 228165

SEQ ID NO: 753329 - RNA, 64 nt, hsa; identical to SEQ ID NO: 228166

SEQ ID NO: 753330 - RNA, 64 nt, hsa; identical to SEQ ID NO: 228167

SEQ ID NO: 753331 - RNA, 64 nt, hsa; identical to SEQ ID NO: 228168

SEQ ID NO: 753332 - RNA, 52 nt, hsa; identical to SEQ ID NO: 228169

SEQ ID NO: 753333 - RNA, 64 nt, hsa; identical to SEQ ID NO: 228170

SEQ ID NO: 753334 - RNA, 64 nt, hsa; identical to SEQ ID NO: 228171

SEQ ID NO: 753335 - RNA, 64 nt, hsa; identical to SEQ ID NO: 228172

SEQ ID NO: 753336 - RNA, 64 nt, hsa; identical to SEQ ID NO: 228173

SEQ ID NO: 753337 - RNA, 64 nt, hsa; identical to SEQ ID NO: 228174

SEQ ID NO: 753338 - RNA, 64 nt, hsa; identical to SEQ ID NO: 228175

SEQ ID NO: 753339 - RNA, 64 nt, hsa; identical to SEQ ID NO: 228176

SEQ ID NO: 753340 - RNA, 64 nt, hsa; identical to SEQ ID NO: 228177

SEQ ID NO: 753341 - RNA, 64 nt, hsa; identical to SEQ ID NO: 228178

SEQ ID NO: 753342 - RNA, 64 nt, hsa; identical to SEQ ID NO: 228179

SEQ ID NO: 753343 - RNA, 64 nt, hsa; identical to SEQ ID NO: 228180

SEQ ID NO: 753344 - RNA, 64 nt, hsa; identical to SEQ ID NO: 228181

SEQ ID NO: 753345 - RNA, 64 nt, hsa; identical to SEQ ID NO: 228182

SEQ ID NO: 753346 - RNA, 64 nt, hsa; identical to SEQ ID NO: 228183

SEQ ID NO: 753347 - RNA, 64 nt, hsa; identical to SEQ ID NO: 228184

SEQ ID NO: 753348 - RNA, 64 nt, hsa; identical to SEQ ID NO: 228185

SEQ ID NO: 753349 - RNA, 64 nt, hsa; identical to SEQ ID NO: 228186

SEQ ID NO: 753350 - RNA, 64 nt, hsa; identical to SEQ ID NO: 228187

SEQ ID NO: 753351 - RNA, 64 nt, hsa; identical to SEQ ID NO: 228188

SEQ ID NO: 753352 - RNA, 64 nt, hsa; identical to SEQ ID NO: 228189

SEQ ID NO: 753353 - RNA, 64 nt, hsa; identical to SEQ ID NO: 228190

SEQ ID NO: 753354 - RNA, 64 nt, hsa; identical to SEQ ID NO: 228191

SEQ ID NO: 753355 - RNA, 64 nt, hsa; identical to SEQ ID NO: 228192

SEQ ID NO: 753356 - RNA, 64 nt, hsa; identical to SEQ ID NO: 228193

SEQ ID NO: 753357 - RNA, 64 nt, hsa; identical to SEQ ID NO: 228194

SEQ ID NO: 753358 - RNA, 64 nt, hsa; identical to SEQ ID NO: 228195

SEQ ID NO: 753359 - RNA, 64 nt, hsa; identical to SEQ ID NO: 228196

SEQ ID NO: 753360 - RNA, 64 nt, hsa; identical to SEQ ID NO: 228197

SEQ ID NO: 753361 - RNA, 64 nt, hsa; identical to SEQ ID NO: 228198

SEQ ID NO: 753362 - RNA, 64 nt, hsa; identical to SEQ ID NO: 228199

SEQ ID NO: 753363 - RNA, 64 nt, hsa; identical to SEQ ID NO: 228200

SEQ ID NO: 753364 - RNA, 64 nt, hsa; identical to SEQ ID NO: 228201

SEQ ID NO: 753365 - RNA, 64 nt, hsa; identical to SEQ ID NO: 228202

SEQ ID NO: 753366 - RNA, 64 nt, hsa; identical to SEQ ID NO: 228203

SEQ ID NO: 753367 - RNA, 64 nt, hsa; identical to SEQ ID NO: 228204

SEQ ID NO: 753368 - RNA, 64 nt, hsa; identical to SEQ ID NO: 228205

SEQ ID NO: 753369 - RNA, 64 nt, hsa; identical to SEQ ID NO: 228206

SEQ ID NO: 753370 - RNA, 64 nt, hsa; identical to SEQ ID NO: 228207

SEQ ID NO: 753371 - RNA, 64 nt, hsa; identical to SEQ ID NO: 228208

SEQ ID NO: 753372 - RNA, 64 nt, hsa; identical to SEQ ID NO: 228209

SEQ ID NO: 753373 - RNA, 64 nt, hsa; identical to SEQ ID NO: 228210

SEQ ID NO: 753374 - RNA, 64 nt, hsa; identical to SEQ ID NO: 228211

SEQ ID NO: 753375 - RNA, 64 nt, hsa; identical to SEQ ID NO: 228212

SEQ ID NO: 753376 - RNA, 64 nt, hsa; identical to SEQ ID NO: 228213

SEQ ID NO: 753377 - RNA, 64 nt, hsa; identical to SEQ ID NO: 228214

SEQ ID NO: 753378 - RNA, 64 nt, hsa; identical to SEQ ID NO: 228215

SEQ ID NO: 753379 - RNA, 64 nt, hsa; identical to SEQ ID NO: 228216

SEQ ID NO: 753380 - RNA, 64 nt, hsa; identical to SEQ ID NO: 228217

SEQ ID NO: 753381 - RNA, 64 nt, hsa; identical to SEQ ID NO: 228218

SEQ ID NO: 753382 - RNA, 64 nt, hsa; identical to SEQ ID NO: 228219

SEQ ID NO: 753383 - RNA, 64 nt, hsa
aauuuuuuaaaauaaaacacgaauuuaauaaaauaugggaaaggcacaaaccagaagucggcau

SEQ ID NO: 753384 - RNA, 64 nt, hsa
cauugcgacauugugaaggcuuaaaugaguuuagaugggaaauagcguuguuaucgccuugggu

SEQ ID NO: 753385 - RNA, 64 nt, hsa
cguucuguaauagaaaaccugaaacgaugauugaaugggaaaaagagacuacaaaauuugucgu

SEQ ID NO: 753386 - RNA, 64 nt, hsa
ucuugugaaacuuauucacuaucacaagaauagcaugggaaagacuggcccccaugauucaauu

SEQ ID NO: 753387 - RNA, 64 nt, hsa
cuuaaaaacaacacauuauuuggaaagacaagccaugggaaagaaauauggcguuucuauuuuu

SEQ ID NO: 753388 - RNA, 64 nt, hsa
acauggugaaaacuaagugucacuaggaaaaguaaugggaaaguaaacccugcauauaugaaaa

SEQ ID NO: 753389 - RNA, 64 nt, hsa
ccacaccguagaacauauauuaaucuacuggcgaaugggaaaggagaccauuuucuuagaaagc

SEQ ID NO: 753390 - RNA, 64 nt, hsa
cauacguuaucagcaacuuccccuguucaauaguaugggaaaaauaagaugacugggaaaaaga

SEQ ID NO: 753391 - RNA, 64 nt, hsa
uuuaaggaauuaaaaguguuucuggaagucaaaaaugggaaagcaaaaaguagcuguccucccu

SEQ ID NO: 753392 - RNA, 64 nt, hsa
auuggagacuuugauuuuuuuuuuuuuuuuucacaugggaaagucuuagauuccaguagaugga

SEQ ID NO: 753393 - RNA, 64 nt, hsa
cuaauauugagugauuauuuguaaaauuaugaauaugggaaauccaucuaucuacagccuaagu

SEQ ID NO: 753394 - RNA, 64 nt, hsa
cuuccaacugcaauaaaauacuggguagaaucaaaugggaaagggguuggguggggcaauaccc

SEQ ID NO: 753395 - RNA, 64 nt, hsa
gcaaucauaagaaacaucugaauaacaacgaugaaugggaaacuaguguugaaauaggauucau

SEQ ID NO: 753396 - RNA, 64 nt, hsa
uuuuccuuuuuaauaugaguaaugcuuuauaaaaaugggaaaaaaaguauacuuaaggaucugu

SEQ ID NO: 753397 - RNA, 64 nt, hsa
auuuuuauauuuuauugcuuugaaugcucaaacuaugggaaaucuuugguaaaaauaaagacaa

SEQ ID NO: 753398 - RNA, 64 nt, hsa
caacaguggauuuaaacaagauuucuuuuuaguaaugggaaaaugcaauuaauauggaggugau

SEQ ID NO: 753399 - RNA, 64 nt, hsa
gaguccaccucagugccucgugugcucaguggucaugggaaaggagcgaaggaaccauccuugg

SEQ ID NO: 753400 - RNA, 64 nt, hsa
gaacuucccagggccccucccucaaauugucuccaugggaaacuugacccaguggcaaguugca

SEQ ID NO: 753401 - RNA, 64 nt, hsa
aaauaguaaagaaaaccaaacaaacccaggccugaugggaaaaaugauuccuuuauucuagcaa

SEQ ID NO: 753402 - RNA, 64 nt, hsa
auuccuuuauucuagcaacuuacuuucuguugguaugggaaauguuauuaauuucuauuacuaa

SEQ ID NO: 753403 - RNA, 64 nt, hsa
aauggcucauaccccgaaggcaguuccuagacacaugggaaauuucccucaccaaagagcaauu

SEQ ID NO: 753404 - RNA, 64 nt, hsa
uuucugaaugcaucaaggguacgagaacuugccaaugggaaauucauccgaguggcacuggcag

SEQ ID NO: 753405 - RNA, 64 nt, hsa
uaauucauccuguugaauugcaccaucgugaaagaugggaaaaaucgugaugauggguaagggg

SEQ ID NO: 753406 - RNA, 64 nt, hsa
ccggaaggcaauggggcaaggaaaaagaaagccuaugggaaauggcugugcucccaacauagcu

SEQ ID NO: 753407 - RNA, 64 nt, hsa
cauuuugggaauuccugcuuaacuugaaaaaaauaugggaaagacaugcagcuuucaugcccuu

SEQ ID NO: 753408 - RNA, 64 nt, hsa
uuuugguuuccgcaaaggauggauggugagcaucaugggaaagcuguaguuuagugacuuagcc

SEQ ID NO: 753409 - RNA, 64 nt, hsa
ugagacaggauuugauaagucuaggaaaagaaagaugggaaaacgggauuccuuuucagaagua

SEQ ID NO: 753410 - RNA, 64 nt, hsa
ugguuaguugaagccaauuucuggcuugacuuuuaugggaaaaguuauuuuaugucuccuaagc

SEQ ID NO: 753411 - RNA, 64 nt, hsa
aagcaggcaagacuuuuucucuguguuaggaaagaugggaaaugguuucuguaaccauuguuug

SEQ ID NO: 753412 - RNA, 64 nt, hsa
uguuuauucuauaugaauauuguuucauguuuguaugggaaaauuguagcuaaacauuucauug

SEQ ID NO: 753413 - RNA, 64 nt, hsa
acuucauauauaaugagugcuucauauuuuuguuaugggaaagcaauauauuaugcagccaguc

SEQ ID NO: 753414 - RNA, 64 nt, hsa
uuuucuuuuauguuuaaaacugaaguuuugccaaaugggaaaauuacuguuaccucuaccaucu

SEQ ID NO: 753415 - RNA, 64 nt, hsa
ggcagagaaagaagaaagaccuagaagguuguagaugggaaaucaggaaugauuugaacugaua

SEQ ID NO: 753416 - RNA, 64 nt, hsa
cgcaggcccaucgugauaaggaauuaggucacaaaugggaaauaaaucagaagcaaugaaauuc

SEQ ID NO: 753417 - RNA, 64 nt, hsa
gaaaacauuagcuuaugcuucuuuagauggaauaaugggaaaggagggaaaugggaaauggaug

SEQ ID NO: 753418 - RNA, 64 nt, hsa
gcuucuuuagauggaauaaugggaaaggagggaaaugggaaauggauggaaaugggaaaggagg

SEQ ID NO: 753419 - RNA, 64 nt, hsa
aaugggaaaggagggaaaugggaaauggauggaaaugggaaaggagggaaaauaauagcccagu

SEQ ID NO: 753420 - RNA, 64 nt, hsa
ucaagagucaagguugcgaguacaggccaagaccaugggaaaaaaagccaugcucacuggccaa

SEQ ID NO: 753421 - RNA, 64 nt, hsa
agcaguuuugcucaugacuuaccauuccagcugcaugggaaagcaaagcagaaaacagugcccc

SEQ ID NO: 753422 - RNA, 64 nt, hsa
auuucuuaaaacagugugugccaccuaaggcuggaugggaaagugcagucuuguuguucauaua

SEQ ID NO: 753423 - RNA, 64 nt, hsa
augaaguuguauaccuuuuuguguuuagagaauuaugggaaaccugguaagcaaaacuuuccuc

SEQ ID NO: 753424 - RNA, 64 nt, hsa
gcuacuaugcuucaggauugucugguuaaauaguaugggaaaaaaacugaagaguuucacauaa

SEQ ID NO: 753425 - RNA, 64 nt, hsa
uuuuagaaaagccgaacaguagauagucuccaagaugggaaacaugucgugugucugcacgccc

SEQ ID NO: 753426 - RNA, 64 nt, hsa
ugacugcuugcugccuuuaauugucuugcucucuaugggaaaaaaacaaaagggcuucagucuc

SEQ ID NO: 753427 - RNA, 64 nt, hsa
caauuuagacucuaaaaagucuuuucaaaaagaaaugggaaauaggcagacuguuuauguuaaa

SEQ ID NO: 753428 - RNA, 64 nt, hsa
agaagcugauuuugcuaaacuccuguucccuacaaugggaaaugucacaagaaugugcaaaaau

SEQ ID NO: 753429 - RNA, 64 nt, hsa
agccauuugcccagggcugcucccgagggggaugaugggaaauucagcaguguagacugacuuu

SEQ ID NO: 753430 - RNA, 64 nt, hsa
cagcuguuuuuaaaugaaugugugugaggaacagaugggaaaguugggagaucugucuacagag

SEQ ID NO: 753431 - RNA, 64 nt, hsa
ggucacuuguuagcugucacuaauaauggaauuaaugggaaacacuugauaaaugaaacuguac

SEQ ID NO: 753432 - RNA, 54 nt, hsa
ugauguauggcaaugagugagcccaugggaaacagguggagauggggaagccgu

SEQ ID NO: 753433 - RNA, 61 nt, hsa
ucuggagaaagaccuuauaaauauaagauauaugggaaacacuuuuauucugccaaguuau

SEQ ID NO: 753434 - RNA, 64 nt, hsa
cacacuuggcagaaacucuaugaauguaagcaguaugggaaagccuucagaucggcuaggauuc

SEQ ID NO: 753435 - RNA, 64 nt, hsa
ugaucauguaaauauuacacaucaaaccaaugacaugggaaaaugggagcuucuaaugaggaca

SEQ ID NO: 753436 - RNA, 64 nt, hsa
aguugauaccaaaaccugaaaaggaaacuacagaaugggaaagucauagaagaucucucacaga

SEQ ID NO: 753437 - RNA, 64 nt, hsa
caaagaauuacaugaguuaguacaugaaaaaauuaugggaaacuacaugaaauauacuguuacg

SEQ ID NO: 753438 - RNA, 64 nt, hsa
auuacacaggaaaccucuguugauauaagcgaugaugggaaaggcuauuuagccacucugcaua

SEQ ID NO: 753439 - RNA, 64 nt, hsa
accggucacauuuucuauuggcagugacugauucaugggaaagggcuuugaaggaacuacuuca

SEQ ID NO: 753440 - RNA, 64 nt, hsa
gcuaugcagcccaccuagaugagucucuucaagaaugggaaaucaaggggugacagggaguaaa

SEQ ID NO: 753441 - RNA, 64 nt, hsa
acuauuaaucuaguucaaugcccuuauuuuacagaugggaaaacugaggccuggagguaggaag

SEQ ID NO: 753442 - RNA, 64 nt, hsa
aaguacagagagccugugcugugaacccccuucaaugggaaaaagcugcaguggugauggcagg

SEQ ID NO: 753443 - RNA, 64 nt, hsa; identical to SEQ ID NO: 119910

SEQ ID NO: 753444 - RNA, 64 nt, hsa; identical to SEQ ID NO: 119911

SEQ ID NO: 753445 - RNA, 64 nt, hsa; identical to SEQ ID NO: 119912

SEQ ID NO: 753446 - RNA, 64 nt, hsa; identical to SEQ ID NO: 119913

SEQ ID NO: 753447 - RNA, 64 nt, hsa; identical to SEQ ID NO: 119914

SEQ ID NO: 753448 - RNA, 64 nt, hsa; identical to SEQ ID NO: 119915

SEQ ID NO: 753449 - RNA, 64 nt, hsa; identical to SEQ ID NO: 119916

SEQ ID NO: 753450 - RNA, 64 nt, hsa; identical to SEQ ID NO: 119917

SEQ ID NO: 753451 - RNA, 64 nt, hsa; identical to SEQ ID NO: 119918

SEQ ID NO: 753452 - RNA, 64 nt, hsa; identical to SEQ ID NO: 119919

SEQ ID NO: 753453 - RNA, 64 nt, hsa; identical to SEQ ID NO: 119920

SEQ ID NO: 753454 - RNA, 64 nt, hsa; identical to SEQ ID NO: 119921

SEQ ID NO: 753455 - RNA, 64 nt, hsa; identical to SEQ ID NO: 119922

SEQ ID NO: 753456 - RNA, 64 nt, hsa; identical to SEQ ID NO: 119923

SEQ ID NO: 753457 - RNA, 64 nt, hsa; identical to SEQ ID NO: 119924

SEQ ID NO: 753458 - RNA, 64 nt, hsa; identical to SEQ ID NO: 119925

SEQ ID NO: 753459 - RNA, 64 nt, hsa; identical to SEQ ID NO: 119926

SEQ ID NO: 753460 - RNA, 64 nt, hsa; identical to SEQ ID NO: 119927

SEQ ID NO: 753461 - RNA, 64 nt, hsa; identical to SEQ ID NO: 119928

SEQ ID NO: 753462 - RNA, 64 nt, hsa; identical to SEQ ID NO: 119929

SEQ ID NO: 753463 - RNA, 64 nt, hsa; identical to SEQ ID NO: 119930

SEQ ID NO: 753464 - RNA, 64 nt, hsa; identical to SEQ ID NO: 119931

SEQ ID NO: 753465 - RNA, 64 nt, hsa; identical to SEQ ID NO: 119932

SEQ ID NO: 753466 - RNA, 64 nt, hsa; identical to SEQ ID NO: 119933

SEQ ID NO: 753467 - RNA, 64 nt, hsa; identical to SEQ ID NO: 119934

SEQ ID NO: 753468 - RNA, 64 nt, hsa; identical to SEQ ID NO: 119935

SEQ ID NO: 753469 - RNA, 64 nt, hsa; identical to SEQ ID NO: 119936

SEQ ID NO: 753470 - RNA, 64 nt, hsa; identical to SEQ ID NO: 119937

SEQ ID NO: 753471 - RNA, 64 nt, hsa; identical to SEQ ID NO: 119938

SEQ ID NO: 753472 - RNA, 64 nt, hsa; identical to SEQ ID NO: 119939

SEQ ID NO: 753473 - RNA, 64 nt, hsa; identical to SEQ ID NO: 119940

SEQ ID NO: 753474 - RNA, 64 nt, hsa; identical to SEQ ID NO: 119941

SEQ ID NO: 753475 - RNA, 64 nt, hsa; identical to SEQ ID NO: 119942

SEQ ID NO: 753476 - RNA, 64 nt, hsa; identical to SEQ ID NO: 119943

SEQ ID NO: 753477 - RNA, 64 nt, hsa; identical to SEQ ID NO: 119944

SEQ ID NO: 753478 - RNA, 64 nt, hsa; identical to SEQ ID NO: 119945

SEQ ID NO: 753479 - RNA, 64 nt, hsa; identical to SEQ ID NO: 119946

SEQ ID NO: 753480 - RNA, 64 nt, hsa; identical to SEQ ID NO: 119947

SEQ ID NO: 753481 - RNA, 64 nt, hsa; identical to SEQ ID NO: 119948

SEQ ID NO: 753482 - RNA, 64 nt, hsa; identical to SEQ ID NO: 119949

SEQ ID NO: 753483 - RNA, 64 nt, hsa; identical to SEQ ID NO: 119950

SEQ ID NO: 753484 - RNA, 64 nt, hsa; identical to SEQ ID NO: 119951

SEQ ID NO: 753485 - RNA, 64 nt, hsa; identical to SEQ ID NO: 119952

SEQ ID NO: 753486 - RNA, 64 nt, hsa; identical to SEQ ID NO: 119953

SEQ ID NO: 753487 - RNA, 64 nt, hsa; identical to SEQ ID NO: 119954

SEQ ID NO: 753488 - RNA, 64 nt, hsa; identical to SEQ ID NO: 119955

SEQ ID NO: 753489 - RNA, 64 nt, hsa; identical to SEQ ID NO: 119956

SEQ ID NO: 753490 - RNA, 64 nt, hsa; identical to SEQ ID NO: 119957

SEQ ID NO: 753491 - RNA, 64 nt, hsa; identical to SEQ ID NO: 119958

SEQ ID NO: 753492 - RNA, 64 nt, hsa; identical to SEQ ID NO: 119959

SEQ ID NO: 753493 - RNA, 64 nt, hsa; identical to SEQ ID NO: 119960

SEQ ID NO: 753494 - RNA, 64 nt, hsa; identical to SEQ ID NO: 119961

SEQ ID NO: 753495 - RNA, 58 nt, hsa; identical to SEQ ID NO: 119962

SEQ ID NO: 753496 - RNA, 64 nt, hsa; identical to SEQ ID NO: 119963

SEQ ID NO: 753497 - RNA, 64 nt, hsa; identical to SEQ ID NO: 119964

SEQ ID NO: 753498 - RNA, 64 nt, hsa; identical to SEQ ID NO: 119965

SEQ ID NO: 753499 - RNA, 64 nt, hsa; identical to SEQ ID NO: 119966

SEQ ID NO: 753500 - RNA, 64 nt, hsa; identical to SEQ ID NO: 119967

SEQ ID NO: 753501 - RNA, 64 nt, hsa; identical to SEQ ID NO: 119968

SEQ ID NO: 753502 - RNA, 64 nt, hsa; identical to SEQ ID NO: 119969

SEQ ID NO: 753503 - RNA, 64 nt, hsa; identical to SEQ ID NO: 119970

SEQ ID NO: 753504 - RNA, 55 nt, hsa; identical to SEQ ID NO: 119971

SEQ ID NO: 753505 - RNA, 64 nt, hsa; identical to SEQ ID NO: 119972

SEQ ID NO: 753506 - RNA, 64 nt, hsa; identical to SEQ ID NO: 119973

SEQ ID NO: 753507 - RNA, 64 nt, hsa; identical to SEQ ID NO: 119974

SEQ ID NO: 753508 - RNA, 64 nt, hsa; identical to SEQ ID NO: 119975

SEQ ID NO: 753509 - RNA, 64 nt, hsa; identical to SEQ ID NO: 119976

SEQ ID NO: 753510 - RNA, 64 nt, hsa; identical to SEQ ID NO: 119977

SEQ ID NO: 753511 - RNA, 64 nt, hsa; identical to SEQ ID NO: 119978

SEQ ID NO: 753512 - RNA, 64 nt, hsa; identical to SEQ ID NO: 119979

SEQ ID NO: 753513 - RNA, 64 nt, hsa; identical to SEQ ID NO: 119980

SEQ ID NO: 753514 - RNA, 64 nt, hsa; identical to SEQ ID NO: 119981

SEQ ID NO: 753515 - RNA, 64 nt, hsa; identical to SEQ ID NO: 119982

SEQ ID NO: 753516 - RNA, 64 nt, hsa; identical to SEQ ID NO: 119983

SEQ ID NO: 753517 - RNA, 64 nt, hsa; identical to SEQ ID NO: 119984

SEQ ID NO: 753518 - RNA, 64 nt, hsa; identical to SEQ ID NO: 119985

SEQ ID NO: 753519 - RNA, 64 nt, hsa; identical to SEQ ID NO: 119986

SEQ ID NO: 753520 - RNA, 64 nt, hsa; identical to SEQ ID NO: 119987

SEQ ID NO: 753521 - RNA, 55 nt, hsa; identical to SEQ ID NO: 119988

SEQ ID NO: 753522 - RNA, 64 nt, hsa; identical to SEQ ID NO: 119989

SEQ ID NO: 753523 - RNA, 64 nt, hsa; identical to SEQ ID NO: 119990

SEQ ID NO: 753524 - RNA, 64 nt, hsa; identical to SEQ ID NO: 119991

SEQ ID NO: 753525 - RNA, 64 nt, hsa; identical to SEQ ID NO: 119992

SEQ ID NO: 753526 - RNA, 64 nt, hsa; identical to SEQ ID NO: 119993

SEQ ID NO: 753527 - RNA, 64 nt, hsa; identical to SEQ ID NO: 119994

SEQ ID NO: 753528 - RNA, 64 nt, hsa; identical to SEQ ID NO: 119995

SEQ ID NO: 753529 - RNA, 64 nt, hsa; identical to SEQ ID NO: 119996

SEQ ID NO: 753530 - RNA, 64 nt, hsa; identical to SEQ ID NO: 119997

SEQ ID NO: 753531 - RNA, 64 nt, hsa; identical to SEQ ID NO: 119998

SEQ ID NO: 753532 - RNA, 62 nt, hsa; identical to SEQ ID NO: 119999

SEQ ID NO: 753533 - RNA, 64 nt, hsa; identical to SEQ ID NO: 120000

SEQ ID NO: 753534 - RNA, 64 nt, hsa; identical to SEQ ID NO: 120001

SEQ ID NO: 753535 - RNA, 64 nt, hsa; identical to SEQ ID NO: 120002

SEQ ID NO: 753536 - RNA, 64 nt, hsa; identical to SEQ ID NO: 120003

SEQ ID NO: 753537 - RNA, 64 nt, hsa; identical to SEQ ID NO: 120004

SEQ ID NO: 753538 - RNA, 64 nt, hsa; identical to SEQ ID NO: 120005

SEQ ID NO: 753539 - RNA, 64 nt, hsa; identical to SEQ ID NO: 120006

SEQ ID NO: 753540 - RNA, 64 nt, hsa; identical to SEQ ID NO: 120007

SEQ ID NO: 753541 - RNA, 64 nt, hsa; identical to SEQ ID NO: 120008

SEQ ID NO: 753542 - RNA, 64 nt, hsa; identical to SEQ ID NO: 141261

SEQ ID NO: 753543 - RNA, 64 nt, hsa; identical to SEQ ID NO: 141262

SEQ ID NO: 753544 - RNA, 64 nt, hsa; identical to SEQ ID NO: 141263

SEQ ID NO: 753545 - RNA, 64 nt, hsa; identical to SEQ ID NO: 141264

SEQ ID NO: 753546 - RNA, 64 nt, hsa; identical to SEQ ID NO: 141265

SEQ ID NO: 753547 - RNA, 64 nt, hsa; identical to SEQ ID NO: 141266

SEQ ID NO: 753548 - RNA, 64 nt, hsa; identical to SEQ ID NO: 141267

SEQ ID NO: 753549 - RNA, 64 nt, hsa; identical to SEQ ID NO: 141268

SEQ ID NO: 753550 - RNA, 64 nt, hsa; identical to SEQ ID NO: 141269

SEQ ID NO: 753551 - RNA, 64 nt, hsa; identical to SEQ ID NO: 141270

SEQ ID NO: 753552 - RNA, 64 nt, hsa; identical to SEQ ID NO: 141271

SEQ ID NO: 753553 - RNA, 64 nt, hsa; identical to SEQ ID NO: 141272

SEQ ID NO: 753554 - RNA, 64 nt, hsa; identical to SEQ ID NO: 141273

SEQ ID NO: 753555 - RNA, 64 nt, hsa; identical to SEQ ID NO: 141274

SEQ ID NO: 753556 - RNA, 64 nt, hsa; identical to SEQ ID NO: 141275

SEQ ID NO: 753557 - RNA, 64 nt, hsa; identical to SEQ ID NO: 141276

SEQ ID NO: 753558 - RNA, 64 nt, hsa; identical to SEQ ID NO: 141277

SEQ ID NO: 753559 - RNA, 64 nt, hsa; identical to SEQ ID NO: 141278

SEQ ID NO: 753560 - RNA, 64 nt, hsa; identical to SEQ ID NO: 141279

SEQ ID NO: 753561 - RNA, 56 nt, hsa; identical to SEQ ID NO: 141280

SEQ ID NO: 753562 - RNA, 64 nt, hsa; identical to SEQ ID NO: 141281

SEQ ID NO: 753563 - RNA, 64 nt, hsa; identical to SEQ ID NO: 141282

SEQ ID NO: 753564 - RNA, 64 nt, hsa; identical to SEQ ID NO: 141283

SEQ ID NO: 753565 - RNA, 64 nt, hsa; identical to SEQ ID NO: 141284

SEQ ID NO: 753566 - RNA, 64 nt, hsa; identical to SEQ ID NO: 141285

SEQ ID NO: 753567 - RNA, 64 nt, hsa; identical to SEQ ID NO: 141286

SEQ ID NO: 753568 - RNA, 64 nt, hsa; identical to SEQ ID NO: 141287

SEQ ID NO: 753569 - RNA, 64 nt, hsa; identical to SEQ ID NO: 141288

SEQ ID NO: 753570 - RNA, 64 nt, hsa; identical to SEQ ID NO: 141289

SEQ ID NO: 753571 - RNA, 64 nt, hsa; identical to SEQ ID NO: 141290

SEQ ID NO: 753572 - RNA, 64 nt, hsa; identical to SEQ ID NO: 141291

SEQ ID NO: 753573 - RNA, 64 nt, hsa; identical to SEQ ID NO: 141292

SEQ ID NO: 753574 - RNA, 64 nt, hsa; identical to SEQ ID NO: 141293

SEQ ID NO: 753575 - RNA, 64 nt, hsa; identical to SEQ ID NO: 141294

SEQ ID NO: 753576 - RNA, 64 nt, hsa; identical to SEQ ID NO: 141295

SEQ ID NO: 753577 - RNA, 64 nt, hsa; identical to SEQ ID NO: 141296

SEQ ID NO: 753578 - RNA, 64 nt, hsa; identical to SEQ ID NO: 141297

SEQ ID NO: 753579 - RNA, 64 nt, hsa; identical to SEQ ID NO: 141298

SEQ ID NO: 753580 - RNA, 64 nt, hsa; identical to SEQ ID NO: 141299

SEQ ID NO: 753581 - RNA, 50 nt, hsa; identical to SEQ ID NO: 141300

SEQ ID NO: 753582 - RNA, 64 nt, hsa; identical to SEQ ID NO: 141301

SEQ ID NO: 753583 - RNA, 64 nt, hsa; identical to SEQ ID NO: 141302

SEQ ID NO: 753584 - RNA, 64 nt, hsa; identical to SEQ ID NO: 141303

SEQ ID NO: 753585 - RNA, 64 nt, hsa; identical to SEQ ID NO: 141304

SEQ ID NO: 753586 - RNA, 64 nt, hsa; identical to SEQ ID NO: 141305

SEQ ID NO: 753587 - RNA, 64 nt, hsa; identical to SEQ ID NO: 141306

SEQ ID NO: 753588 - RNA, 64 nt, hsa; identical to SEQ ID NO: 141307

SEQ ID NO: 753589 - RNA, 64 nt, hsa; identical to SEQ ID NO: 141308

SEQ ID NO: 753590 - RNA, 64 nt, hsa; identical to SEQ ID NO: 141309

SEQ ID NO: 753591 - RNA, 64 nt, hsa; identical to SEQ ID NO: 141310

SEQ ID NO: 753592 - RNA, 64 nt, hsa; identical to SEQ ID NO: 141311

SEQ ID NO: 753593 - RNA, 64 nt, hsa; identical to SEQ ID NO: 141312

SEQ ID NO: 753594 - RNA, 64 nt, hsa; identical to SEQ ID NO: 141313

SEQ ID NO: 753595 - RNA, 64 nt, hsa; identical to SEQ ID NO: 141314

SEQ ID NO: 753596 - RNA, 64 nt, hsa; identical to SEQ ID NO: 141315

SEQ ID NO: 753597 - RNA, 64 nt, hsa; identical to SEQ ID NO: 141316

SEQ ID NO: 753598 - RNA, 64 nt, hsa; identical to SEQ ID NO: 141317

SEQ ID NO: 753599 - RNA, 64 nt, hsa; identical to SEQ ID NO: 141318

SEQ ID NO: 753600 - RNA, 64 nt, hsa; identical to SEQ ID NO: 141319

SEQ ID NO: 753601 - RNA, 64 nt, hsa; identical to SEQ ID NO: 141320

SEQ ID NO: 753602 - RNA, 63 nt, hsa
augauuuuaaucacauucugcaaggugacaaaugucauacauuccacauugugugguagccau

SEQ ID NO: 753603 - RNA, 63 nt, hsa
ugagaacuggagagguucagugacuuuuugaaagucauacaacacagcuaaccauuaugccaa

SEQ ID NO: 753604 - RNA, 64 nt, hsa
guaagucuuaaagucugcuauuuacagagcauugaaucuguaccaauuugcaauagaaagccuu

SEQ ID NO: 753605 - RNA, 64 nt, hsa
acacauucuguuucuucauaaaaauuuuacuuaaaaucuguaacgcuagauauugacuauccuu

SEQ ID NO: 753606 - RNA, 64 nt, hsa
aaccgugugucaugucaaagugaaagacauuucaaaucuguagcauaggcuagugggcaggucc

SEQ ID NO: 753607 - RNA, 64 nt, hsa
uauuugaguuugacauuuaauaacuuugcuggaaaaucuguaaaaaagaaaaacaaguuugcua

SEQ ID NO: 753608 - RNA, 64 nt, hsa
ugaauuuucauaagaaacuuggacugcaggacuuaaucuguagucuuuagacaacaguugcuuu

SEQ ID NO: 753609 - RNA, 64 nt, hsa
uguaaaauuaaauuuuaucuuuauuucuucuaaaaaucuguauaccaggaacugaaaaucuuug

SEQ ID NO: 753610 - RNA, 64 nt, hsa
uccuuucugacccacaaaguaugaaaaguucuguaaucuguaaacucaguucuguaaucuguau

SEQ ID NO: 753611 - RNA, 64 nt, hsa
ugaaaaguucuguaaucuguaaacucaguucuguaaucuguauuauugagaugauuaauauaaa

SEQ ID NO: 753612 - RNA, 64 nt, hsa
uugucaaagaagguuuguguuuuucugcuuuugaaaucuguaucuguagugagauagcauugug

SEQ ID NO: 753613 - RNA, 64 nt, hsa
augguuacuaggcuuaauaccugggugauuacauaaucuguacaaugaacccccaugauguaag

SEQ ID NO: 753614 - RNA, 64 nt, hsa
uucacuaaaauguuuuuugucccuaaggaaaaguaaucuguaaaaauaauuuuaauuagcauaa

SEQ ID NO: 753615 - RNA, 64 nt, hsa
cauccacaaacaaacaaacaaauaacagaaacaaaaucuguaaauguuccuuuguaaaacuugu

SEQ ID NO: 753616 - RNA, 64 nt, hsa
aagcuguuuauagcuuuggaccuuuuuaguguuaaaucuguaacauuacuacacuggguaccuu

SEQ ID NO: 753617 - RNA, 64 nt, hsa
aauucaaauaauaauuaguaagcuagcaaauaguaaucuguaagcauaagcuuaugcuuaaauu

SEQ ID NO: 753618 - RNA, 64 nt, hsa
uuucaauauuagcaagacagcaugccuucaaaucaaucuguaaaacuaagaaacuuaaauuuua

SEQ ID NO: 753619 - RNA, 64 nt, hsa
cuguggauguaaagugauauuuccccaugguuuuaaucuguauuuccccaacauguaauaaggu

SEQ ID NO: 753620 - RNA, 64 nt, hsa
cuuuugcauccuacauuaauuaucuaguuuaauuaaucuguaaugcuuucgauaguguuaacuu

SEQ ID NO: 753621 - RNA, 64 nt, hsa
ggaagacugccaguauuaaaaaaauccuucugggaaucuguagguuauuucuuggaaauugcaa

SEQ ID NO: 753622 - RNA, 64 nt, hsa
gguacagaauaguugauauuaacagaaaaaaaaaaaucuguagcuucaugaauaugccacucug

SEQ ID NO: 753623 - RNA, 64 nt, hsa
ccacgacagacuuaacuguauaauuucguuguaaaaucuguaaguuguaaauauuguacauagu

SEQ ID NO: 753624 - RNA, 64 nt, hsa
aaaaucuguaaguuguaaauauuguacauaguuaaaucuguauucuguuuugaauuuuuuuaau

SEQ ID NO: 753625 - RNA, 64 nt, hsa
aagaguaaauuuuacauaaucuguacguaguucuaaucuguauauagucuuggagguuaugauu

SEQ ID NO: 753626 - RNA, 64 nt, hsa
aauaacucaugugucacaagaguaaauuuuacauaaucuguacguaguucuaaucuguauauag

SEQ ID NO: 753627 - RNA, 64 nt, hsa
agugcaucuuugccucaacuccaggauuuaggccuuaacacacuggccauucuuauguuccaga

SEQ ID NO: 753628 - RNA, 64 nt, hsa
uugucagcaagaggaggacagaauucucccagcguuaacacaaaauccaugggcaguaugaugg

SEQ ID NO: 753629 - RNA, 64 nt, hsa
cuuuauugaacuugaaugacagaacuugaaauuuuuaacacauccuucuuggugaagauuuuaa

SEQ ID NO: 753630 - RNA, 64 nt, hsa
ugaaaauauuuauauaaaaauacauuuauucugcuuaacacaaauuaaaacugacauaaaauuu

SEQ ID NO: 753631 - RNA, 64 nt, hsa
guggacagaaauguacagggagaauuacauuauuuuaacacacagaagugcaacuuucugcuuu

SEQ ID NO: 753632 - RNA, 64 nt, hsa
ugcuuauacaucuauucuauaacagugaugaauauuaacacaaaggaaauauggagaacuguua

SEQ ID NO: 753633 - RNA, 64 nt, hsa
accuuuaauuuuuccuauuugaaaagccaaccacuuaacacauuacucauagcaccuaagacag

SEQ ID NO: 753634 - RNA, 64 nt, hsa
aauuccaggagguaauuuguugauauuacaauuuuuaacacauuuaugauucugugauaauauu

SEQ ID NO: 753635 - RNA, 64 nt, hsa
ucaauccuguaaaaggguacaguccuauuguauguuaacacacugaugaugugagccugugaga

SEQ ID NO: 753636 - RNA, 64 nt, hsa
uggaacuaauucuuuauuuuugauguugugggaauuaacacaucaauggugguuaugggaacua

SEQ ID NO: 753637 - RNA, 64 nt, hsa
uggagguacuguagcuuuuagggaaaaaaaaauguuaacacaucacaggucaaguugaagucau

SEQ ID NO: 753638 - RNA, 64 nt, hsa
augagauguuuguuacucugguaaaugccacacguuaacacaauaacacccauuccugggaccg

SEQ ID NO: 753639 - RNA, 64 nt, hsa
ucuguaaaccuaaugucuguauaaauaaugagcguuaacacaguaaaauauucaauaagaaguc

SEQ ID NO: 753640 - RNA, 64 nt, hsa
ucucuuaaaugaagugcccacuaagaaguuccacuuaacacaugaauuucugccauauuaauuu

SEQ ID NO: 753641 - RNA, 64 nt, hsa
uaaaagccacugcuuuuaacaucccauuguacauuuaacacauaaaugguguuaacaucccauu

SEQ ID NO: 753642 - RNA, 64 nt, hsa
aacacauaaaugguguuaacaucccauuguacauuuaacacauaaauggccauugucuuugucu

SEQ ID NO: 753643 - RNA, 64 nt, hsa
uugcugguaaucuaauagaaucagauuaagaaaauuaacacaauuuuaccauuugacauacucu

SEQ ID NO: 753644 - RNA, 64 nt, hsa
guuuggaaacaucacucugauuguaagcugaauguuaacacacuagcugcauuguaaagaaaca

SEQ ID NO: 753645 - RNA, 64 nt, hsa
aaaggguuugugauacagcggucacuauuuucucuuaacacauaggaaaaaaguucagacaucg

SEQ ID NO: 753646 - RNA, 64 nt, hsa
ugaaagggggcagaauguucagucggucguguuuuuaacacagagucucuagaagaggugcaga

SEQ ID NO: 753647 - RNA, 64 nt, hsa
aaguauuuauuucucuuugcaagugacuauuugauuaacacauuaaaaauuuuuuaaaaauuuc

SEQ ID NO: 753648 - RNA, 64 nt, hsa
uuuugcuguaggcuaggaauacacccuuuuuaaauuaacacacuguagauccuuuuuuucuguu

SEQ ID NO: 753649 - RNA, 64 nt, hsa
gcaaugcucuccuugucaaggcauggaccagggucauucagacacauucagauacugcacugag

SEQ ID NO: 753650 - RNA, 64 nt, hsa
ccuugucaaggcauggaccagggucauucagacacauucagauacugcacugagaaggagcugg

SEQ ID NO: 753651 - RNA, 64 nt, hsa
ucaaggcugagcuuuaaugucagugucucuuagacauucagagggugaaccaccaucccuucac

SEQ ID NO: 753652 - RNA, 64 nt, hsa
guaacuggauucgauuuugggauaucuuuucucacauucagacuuacacuuaaugguguuagaa

SEQ ID NO: 753653 - RNA, 64 nt, hsa
aauuauuaauguugguucugaaacagccucuuagcauucagauuguauuuuaaauacuuaaaca

SEQ ID NO: 753654 - RNA, 64 nt, hsa
ucaugagugcauuuugaaaaagaaaaaaaguacacauucagaaucuggccaauuuaaguuugua

SEQ ID NO: 753655 - RNA, 64 nt, hsa
uuuuccuuuuggaucuggccauuggugcguguuucauucagaucaccucuggaaucucuguggu

SEQ ID NO: 753656 - RNA, 64 nt, hsa
ucuaaacacacauccgucccaacauuccccagaccauucagaaucacacagcguauuaaacacu

SEQ ID NO: 753657 - RNA, 64 nt, hsa
cccuccuuggcuacuaggagcaccuaucccauaucauucagauaaacaaugauagcuacaaagu

SEQ ID NO: 753658 - RNA, 64 nt, hsa
augauaauccuucauaauuuauuauacaauuuaucauucagaaagcaauaauuaaaaaaguuua

SEQ ID NO: 753659 - RNA, 64 nt, hsa
ccaccgcccugcccuccccaccgaguccuguggccauucagagcggccacaugacuuuugcauc

SEQ ID NO: 753660 - RNA, 64 nt, hsa
caccaauccuagacucacgugugccccagaauaacauucagacucucagcuggucuuguguuac

SEQ ID NO: 753661 - RNA, 64 nt, hsa
ugccuagcacagagcucaguggauuugauucuuccauucagauacucauagcgauugcacacuu

SEQ ID NO: 753662 - RNA, 64 nt, hsa
uaaauauuuaaaaacaguucuucucaaacauuuucauucagauagcuuucugaaaguucccuau

SEQ ID NO: 753663 - RNA, 64 nt, hsa
gaaagcaauauauuaugcagccagucuguagaaacauucagaucccucuuccuuuacucaaaua

SEQ ID NO: 753664 - RNA, 64 nt, hsa
gggugggugggugggacucaguccagagaccuaacauucagaauauagcauugguugccuauuu

SEQ ID NO: 753665 - RNA, 64 nt, hsa
ccccauuaagacucaccaggagaggucugagggccauucagaacccacuccugagugggugggu

SEQ ID NO: 753666 - RNA, 64 nt, hsa
ugcuuuaacuuucaacacuuagaaaaucuacaaacauucagaccugucuggguugguauugcca

SEQ ID NO: 753667 - RNA, 64 nt, hsa
ucaggccuucagaauuuaaggguuuuaaauauagcauucagauuguaauugguauguuuuugcc

SEQ ID NO: 753668 - RNA, 64 nt, hsa
caauauuauuuugaaauuggcuuuaaaauaaaaccauucagauugaaauucuaauuagcucauu

SEQ ID NO: 753669 - RNA, 64 nt, hsa
aauucaacuaaaguuauaaauaaagagaaaaacucauucagaaaucauggauuuuaaaaauauu

SEQ ID NO: 753670 - RNA, 64 nt, hsa
acuuuucauugcacuucuaaaauucagccuuguucauucagaaaauaaggauggauuuugugaa

SEQ ID NO: 753671 - RNA, 64 nt, hsa
ucugugauuucucacauuuuuauuugcugagaaacauucagaaaauuauuccaaaaaugaaggu

SEQ ID NO: 753672 - RNA, 64 nt, hsa
ggccaaaugaggugacucagauagaaucugaucccauucagagcuugguaaaugucacuguaca

SEQ ID NO: 753673 - RNA, 64 nt, hsa
gaggacaacaucuucaugcugugauugaagcauccauucagaacacgaggcaauauugcagucc

SEQ ID NO: 753674 - RNA, 64 nt, hsa
agacuugagauucaguugccgaucaaggcucuggcauucagagaacccuugcaacucgagaagc

SEQ ID NO: 753675 - RNA, 64 nt, hsa
gaaaauguaaaaccacaccagggaggaaaaaugacauucagaaccagcaaacacugaauuucuc

SEQ ID NO: 753676 - RNA, 64 nt, hsa
aaaaaaaccuuaaacauagucgcugucauucagacauucagagaaugguuggccacaaacaaug

SEQ ID NO: 753677 - RNA, 64 nt, hsa
auuuacaaaaaaaaaccuuaaacauagucgcugucauucagacauucagagaaugguuggccac

SEQ ID NO: 753678 - RNA, 64 nt, hsa
gggaggaagcugggcugugugguccccaugaaggcauucagaguccaccugcagacagcgagag

SEQ ID NO: 753679 - RNA, 64 nt, hsa
gcauuguucuuucagucagacaugauaugcgcaacauucagacaugauaugcgcaucauucaga

SEQ ID NO: 753680 - RNA, 64 nt, hsa
ugauaugcgcaacauucagacaugauaugcgcaucauucagacaugauaugcggggucaaguuc

SEQ ID NO: 753681 - RNA, 64 nt, hsa
ugugggucuucuacguaugucacauugauucacacauucagaaaagaggguccucacagauuuu

SEQ ID NO: 753682 - RNA, 64 nt, hsa
uccuaauuuuagcaucuuuuuuuuuuuuuacaaucauucagauugugaauucaggcucagaauu

SEQ ID NO: 753683 - RNA, 64 nt, hsa
gacugaaugcuguuaauauuucuaaaaguuucuacauucagauuauaugccugauucauaguaa

SEQ ID NO: 753684 - RNA, 64 nt, hsa
ucuugaauuaguauuucaguguuuucauuuuagacauucagacuaaaaauacaccguuuagaaa

SEQ ID NO: 753685 - RNA, 64 nt, hsa
cuuguacugaaugacacauuaccuccacacucucccggacuagguggucaacagggccacaggg

SEQ ID NO: 753686 - RNA, 64 nt, hsa
ggccgacugucugcucacccagagaccuuggacuccggacuauccauggcuccgaaucuaagug

SEQ ID NO: 753687 - RNA, 64 nt, hsa
ucauagagugagagggcuugagacccucccucaaccggacuaauuaaagaaagacacuuguguu

SEQ ID NO: 753688 - RNA, 64 nt, hsa
gauuucaugcuguucuuuguaaugauaaauguuuccggacuaaacacucuauaauacaaaucaa

SEQ ID NO: 753689 - RNA, 64 nt, hsa
aaacuuagagaaagauaaaauugauuuccuaguaccggacuacuuaaaccaggaacaagaagag

SEQ ID NO: 753690 - RNA, 64 nt, hsa
agcucagagaggcuagaugauugauuaccaagugccggacuagcaagugcuggagucgggacua

SEQ ID NO: 753691 - RNA, 64 nt, hsa
gaaauauuucccacaacuggaugcacugucguccccggacuauagacacuaccccaucaggugg

SEQ ID NO: 753692 - RNA, 64 nt, hsa
acggcaugacguggugcggggcagcguggccccaccggacuagcacaugaugaauguaaaguug

SEQ ID NO: 753693 - RNA, 64 nt, hsa; identical to SEQ ID NO: 282773

SEQ ID NO: 753694 - RNA, 64 nt, hsa; identical to SEQ ID NO: 282774

SEQ ID NO: 753695 - RNA, 64 nt, hsa; identical to SEQ ID NO: 282775

SEQ ID NO: 753696 - RNA, 64 nt, hsa; identical to SEQ ID NO: 282776

SEQ ID NO: 753697 - RNA, 64 nt, hsa; identical to SEQ ID NO: 282777

SEQ ID NO: 753698 - RNA, 64 nt, hsa; identical to SEQ ID NO: 282778

SEQ ID NO: 753699 - RNA, 64 nt, hsa; identical to SEQ ID NO: 282779

SEQ ID NO: 753700 - RNA, 64 nt, hsa; identical to SEQ ID NO: 282780

SEQ ID NO: 753701 - RNA, 64 nt, hsa; identical to SEQ ID NO: 282781

SEQ ID NO: 753702 - RNA, 64 nt, hsa; identical to SEQ ID NO: 282782

SEQ ID NO: 753703 - RNA, 64 nt, hsa; identical to SEQ ID NO: 282783

SEQ ID NO: 753704 - RNA, 54 nt, hsa; identical to SEQ ID NO: 282784

SEQ ID NO: 753705 - RNA, 64 nt, hsa; identical to SEQ ID NO: 282785

SEQ ID NO: 753706 - RNA, 64 nt, hsa; identical to SEQ ID NO: 282786

SEQ ID NO: 753707 - RNA, 64 nt, hsa; identical to SEQ ID NO: 282787

SEQ ID NO: 753708 - RNA, 64 nt, hsa; identical to SEQ ID NO: 282788

SEQ ID NO: 753709 - RNA, 64 nt, hsa; identical to SEQ ID NO: 282789

SEQ ID NO: 753710 - RNA, 64 nt, hsa; identical to SEQ ID NO: 282790

SEQ ID NO: 753711 - RNA, 64 nt, hsa; identical to SEQ ID NO: 282791

SEQ ID NO: 753712 - RNA, 64 nt, hsa; identical to SEQ ID NO: 282792

SEQ ID NO: 753713 - RNA, 64 nt, hsa; identical to SEQ ID NO: 282793

SEQ ID NO: 753714 - RNA, 64 nt, hsa; identical to SEQ ID NO: 282794

SEQ ID NO: 753715 - RNA, 64 nt, hsa; identical to SEQ ID NO: 282795

SEQ ID NO: 753716 - RNA, 64 nt, hsa; identical to SEQ ID NO: 282796

SEQ ID NO: 753717 - RNA, 64 nt, hsa; identical to SEQ ID NO: 282797

SEQ ID NO: 753718 - RNA, 64 nt, hsa; identical to SEQ ID NO: 282798

SEQ ID NO: 753719 - RNA, 64 nt, hsa; identical to SEQ ID NO: 282799

SEQ ID NO: 753720 - RNA, 64 nt, hsa; identical to SEQ ID NO: 282800

SEQ ID NO: 753721 - RNA, 64 nt, hsa; identical to SEQ ID NO: 282801

SEQ ID NO: 753722 - RNA, 64 nt, hsa; identical to SEQ ID NO: 282802

SEQ ID NO: 753723 - RNA, 64 nt, hsa; identical to SEQ ID NO: 282803

SEQ ID NO: 753724 - RNA, 64 nt, hsa; identical to SEQ ID NO: 282804

SEQ ID NO: 753725 - RNA, 64 nt, hsa; identical to SEQ ID NO: 282805

SEQ ID NO: 753726 - RNA, 64 nt, hsa; identical to SEQ ID NO: 282806

SEQ ID NO: 753727 - RNA, 64 nt, hsa; identical to SEQ ID NO: 282807

SEQ ID NO: 753728 - RNA, 64 nt, hsa; identical to SEQ ID NO: 282808

SEQ ID NO: 753729 - RNA, 64 nt, hsa; identical to SEQ ID NO: 282809

SEQ ID NO: 753730 - RNA, 64 nt, hsa; identical to SEQ ID NO: 282810

SEQ ID NO: 753731 - RNA, 64 nt, hsa; identical to SEQ ID NO: 282811

SEQ ID NO: 753732 - RNA, 64 nt, hsa; identical to SEQ ID NO: 282812

SEQ ID NO: 753733 - RNA, 64 nt, hsa; identical to SEQ ID NO: 282813

SEQ ID NO: 753734 - RNA, 64 nt, hsa; identical to SEQ ID NO: 282814

SEQ ID NO: 753735 - RNA, 64 nt, hsa; identical to SEQ ID NO: 282815

SEQ ID NO: 753736 - RNA, 64 nt, hsa; identical to SEQ ID NO: 282816

SEQ ID NO: 753737 - RNA, 64 nt, hsa; identical to SEQ ID NO: 282817

SEQ ID NO: 753738 - RNA, 64 nt, hsa; identical to SEQ ID NO: 282818

SEQ ID NO: 753739 - RNA, 64 nt, hsa; identical to SEQ ID NO: 282819

SEQ ID NO: 753740 - RNA, 64 nt, hsa; identical to SEQ ID NO: 282820

SEQ ID NO: 753741 - RNA, 64 nt, hsa; identical to SEQ ID NO: 282821

SEQ ID NO: 753742 - RNA, 64 nt, hsa; identical to SEQ ID NO: 282822

SEQ ID NO: 753743 - RNA, 64 nt, hsa; identical to SEQ ID NO: 282823

SEQ ID NO: 753744 - RNA, 64 nt, hsa; identical to SEQ ID NO: 282824

SEQ ID NO: 753745 - RNA, 64 nt, hsa; identical to SEQ ID NO: 282825

SEQ ID NO: 753746 - RNA, 64 nt, hsa; identical to SEQ ID NO: 282826

SEQ ID NO: 753747 - RNA, 64 nt, hsa; identical to SEQ ID NO: 282827

SEQ ID NO: 753748 - RNA, 64 nt, hsa; identical to SEQ ID NO: 282828

SEQ ID NO: 753749 - RNA, 64 nt, hsa; identical to SEQ ID NO: 282829

SEQ ID NO: 753750 - RNA, 64 nt, hsa; identical to SEQ ID NO: 282830

SEQ ID NO: 753751 - RNA, 64 nt, hsa; identical to SEQ ID NO: 282831

SEQ ID NO: 753752 - RNA, 64 nt, hsa; identical to SEQ ID NO: 282832

SEQ ID NO: 753753 - RNA, 64 nt, hsa; identical to SEQ ID NO: 282833

SEQ ID NO: 753754 - RNA, 53 nt, hsa; identical to SEQ ID NO: 282834

SEQ ID NO: 753755 - RNA, 64 nt, hsa; identical to SEQ ID NO: 282835

SEQ ID NO: 753756 - RNA, 64 nt, hsa; identical to SEQ ID NO: 282836

SEQ ID NO: 753757 - RNA, 64 nt, hsa; identical to SEQ ID NO: 282837

SEQ ID NO: 753758 - RNA, 64 nt, hsa; identical to SEQ ID NO: 282838

SEQ ID NO: 753759 - RNA, 64 nt, hsa; identical to SEQ ID NO: 282839

SEQ ID NO: 753760 - RNA, 64 nt, hsa; identical to SEQ ID NO: 282840

SEQ ID NO: 753761 - RNA, 64 nt, hsa; identical to SEQ ID NO: 282841

SEQ ID NO: 753762 - RNA, 64 nt, hsa; identical to SEQ ID NO: 282842

SEQ ID NO: 753763 - RNA, 64 nt, hsa; identical to SEQ ID NO: 282843

SEQ ID NO: 753764 - RNA, 64 nt, hsa; identical to SEQ ID NO: 282844

SEQ ID NO: 753765 - RNA, 64 nt, hsa; identical to SEQ ID NO: 282845

SEQ ID NO: 753766 - RNA, 64 nt, hsa; identical to SEQ ID NO: 282846

SEQ ID NO: 753767 - RNA, 53 nt, hsa; identical to SEQ ID NO: 282847

SEQ ID NO: 753768 - RNA, 64 nt, hsa; identical to SEQ ID NO: 282848

SEQ ID NO: 753769 - RNA, 64 nt, hsa; identical to SEQ ID NO: 282849

SEQ ID NO: 753770 - RNA, 64 nt, hsa; identical to SEQ ID NO: 282850

SEQ ID NO: 753771 - RNA, 64 nt, hsa; identical to SEQ ID NO: 282851

SEQ ID NO: 753772 - RNA, 64 nt, hsa; identical to SEQ ID NO: 282852

SEQ ID NO: 753773 - RNA, 64 nt, hsa; identical to SEQ ID NO: 282853

SEQ ID NO: 753774 - RNA, 64 nt, hsa; identical to SEQ ID NO: 282854

SEQ ID NO: 753775 - RNA, 64 nt, hsa; identical to SEQ ID NO: 282855

SEQ ID NO: 753776 - RNA, 64 nt, hsa; identical to SEQ ID NO: 282856

SEQ ID NO: 753777 - RNA, 64 nt, hsa; identical to SEQ ID NO: 282857

SEQ ID NO: 753778 - RNA, 64 nt, hsa; identical to SEQ ID NO: 282858

SEQ ID NO: 753779 - RNA, 64 nt, hsa; identical to SEQ ID NO: 282859

SEQ ID NO: 753780 - RNA, 64 nt, hsa; identical to SEQ ID NO: 282860

SEQ ID NO: 753781 - RNA, 64 nt, hsa; identical to SEQ ID NO: 282861

SEQ ID NO: 753782 - RNA, 64 nt, hsa; identical to SEQ ID NO: 282862

SEQ ID NO: 753783 - RNA, 64 nt, hsa; identical to SEQ ID NO: 282863

SEQ ID NO: 753784 - RNA, 64 nt, hsa; identical to SEQ ID NO: 282864

SEQ ID NO: 753785 - RNA, 64 nt, hsa; identical to SEQ ID NO: 282865

SEQ ID NO: 753786 - RNA, 64 nt, hsa; identical to SEQ ID NO: 282866

SEQ ID NO: 753787 - RNA, 64 nt, hsa; identical to SEQ ID NO: 282867

SEQ ID NO: 753788 - RNA, 64 nt, hsa; identical to SEQ ID NO: 282868

SEQ ID NO: 753789 - RNA, 64 nt, hsa; identical to SEQ ID NO: 282869

SEQ ID NO: 753790 - RNA, 64 nt, hsa; identical to SEQ ID NO: 282870

SEQ ID NO: 753791 - RNA, 64 nt, hsa; identical to SEQ ID NO: 282871

SEQ ID NO: 753792 - RNA, 64 nt, hsa; identical to SEQ ID NO: 282872

SEQ ID NO: 753793 - RNA, 64 nt, hsa; identical to SEQ ID NO: 282873

SEQ ID NO: 753794 - RNA, 64 nt, hsa; identical to SEQ ID NO: 282874

SEQ ID NO: 753795 - RNA, 64 nt, hsa; identical to SEQ ID NO: 282875

SEQ ID NO: 753796 - RNA, 64 nt, hsa; identical to SEQ ID NO: 282876

SEQ ID NO: 753797 - RNA, 64 nt, hsa; identical to SEQ ID NO: 282877

SEQ ID NO: 753798 - RNA, 64 nt, hsa; identical to SEQ ID NO: 282878

SEQ ID NO: 753799 - RNA, 64 nt, hsa; identical to SEQ ID NO: 282879

SEQ ID NO: 753800 - RNA, 64 nt, hsa; identical to SEQ ID NO: 282880

SEQ ID NO: 753801 - RNA, 64 nt, hsa; identical to SEQ ID NO: 282881

SEQ ID NO: 753802 - RNA, 64 nt, hsa; identical to SEQ ID NO: 282882

SEQ ID NO: 753803 - RNA, 64 nt, hsa; identical to SEQ ID NO: 282883

SEQ ID NO: 753804 - RNA, 64 nt, hsa; identical to SEQ ID NO: 282884

SEQ ID NO: 753805 - RNA, 64 nt, hsa; identical to SEQ ID NO: 282885

SEQ ID NO: 753806 - RNA, 64 nt, hsa; identical to SEQ ID NO: 282886

SEQ ID NO: 753807 - RNA, 64 nt, hsa; identical to SEQ ID NO: 282887

SEQ ID NO: 753808 - RNA, 64 nt, hsa; identical to SEQ ID NO: 282888

SEQ ID NO: 753809 - RNA, 64 nt, hsa; identical to SEQ ID NO: 282889

SEQ ID NO: 753810 - RNA, 64 nt, hsa; identical to SEQ ID NO: 282890

SEQ ID NO: 753811 - RNA, 64 nt, hsa; identical to SEQ ID NO: 282891

SEQ ID NO: 753812 - RNA, 64 nt, hsa; identical to SEQ ID NO: 282892

SEQ ID NO: 753813 - RNA, 64 nt, hsa; identical to SEQ ID NO: 282893

SEQ ID NO: 753814 - RNA, 64 nt, hsa; identical to SEQ ID NO: 282894

SEQ ID NO: 753815 - RNA, 64 nt, hsa; identical to SEQ ID NO: 282895

SEQ ID NO: 753816 - RNA, 64 nt, hsa; identical to SEQ ID NO: 282896

SEQ ID NO: 753817 - RNA, 64 nt, hsa; identical to SEQ ID NO: 282897

SEQ ID NO: 753818 - RNA, 64 nt, hsa; identical to SEQ ID NO: 282898

SEQ ID NO: 753819 - RNA, 64 nt, hsa; identical to SEQ ID NO: 282899

SEQ ID NO: 753820 - RNA, 64 nt, hsa; identical to SEQ ID NO: 282900

SEQ ID NO: 753821 - RNA, 64 nt, hsa; identical to SEQ ID NO: 282901

SEQ ID NO: 753822 - RNA, 64 nt, hsa; identical to SEQ ID NO: 282902

SEQ ID NO: 753823 - RNA, 64 nt, hsa; identical to SEQ ID NO: 282903

SEQ ID NO: 753824 - RNA, 64 nt, hsa; identical to SEQ ID NO: 282904

SEQ ID NO: 753825 - RNA, 64 nt, hsa; identical to SEQ ID NO: 282905

SEQ ID NO: 753826 - RNA, 64 nt, hsa; identical to SEQ ID NO: 282906

SEQ ID NO: 753827 - RNA, 64 nt, hsa; identical to SEQ ID NO: 282907

SEQ ID NO: 753828 - RNA, 64 nt, hsa; identical to SEQ ID NO: 282908

SEQ ID NO: 753829 - RNA, 64 nt, hsa; identical to SEQ ID NO: 282909

SEQ ID NO: 753830 - RNA, 64 nt, hsa; identical to SEQ ID NO: 282910

SEQ ID NO: 753831 - RNA, 64 nt, hsa; identical to SEQ ID NO: 282911

SEQ ID NO: 753832 - RNA, 62 nt, hsa
uguuuucugcuuuuacagcagcuucucucccacaccacaacuuuauuaagguauaguggaua

SEQ ID NO: 753833 - RNA, 62 nt, hsa
caacuugauauguguauauacaguaaaguguucaccacaagcaagccaauuaacauauccuc

SEQ ID NO: 753834 - RNA, 62 nt, hsa
ccucccaaacuggugagauuacaggcaugagccaccacaacuggccugaaauucuuaaagga

SEQ ID NO: 753835 - RNA, 62 nt, hsa
cagccucccaaauaacuggggccacaggugugcaccacaacucucagcuaauuuuuaaaauu

SEQ ID NO: 753836 - RNA, 62 nt, hsa
gcaaccucagcaguucccaucaaggccaccuccaccacaaccgaaaguaucaucucagggaa

SEQ ID NO: 753837 - RNA, 62 nt, hsa
ccuuucuguugcaacuaugaaugaaaacaaaacaccacaaaacagacuucacuaacacagaa

SEQ ID NO: 753838 - RNA, 62 nt, hsa
cacacaggaucacucacauauguacauguacccaccacaaacgugcaagcuccugcacacau

SEQ ID NO: 753839 - RNA, 62 nt, hsa
cagccuccugcacacgugcacauucauguguacaccacaaaugaguucccagacguguaaac

SEQ ID NO: 753840 - RNA, 62 nt, hsa
cacaggcuccuacacacaugcacacacguguacaccacaaacgagcucccagacauguaaac

SEQ ID NO: 753841 - RNA, 62 nt, hsa
ugagcucccacacguacacaugcacauguacgcaccacaaacacaugcgcaggcuccugcag

SEQ ID NO: 753842 - RNA, 64 nt, hsa; identical to SEQ ID NO: 274946

SEQ ID NO: 753843 - RNA, 64 nt, hsa; identical to SEQ ID NO: 274947

SEQ ID NO: 753844 - RNA, 64 nt, hsa; identical to SEQ ID NO: 274948

SEQ ID NO: 753845 - RNA, 64 nt, hsa; identical to SEQ ID NO: 274949

SEQ ID NO: 753846 - RNA, 64 nt, hsa; identical to SEQ ID NO: 274950

SEQ ID NO: 753847 - RNA, 64 nt, hsa; identical to SEQ ID NO: 274951

SEQ ID NO: 753848 - RNA, 64 nt, hsa; identical to SEQ ID NO: 274952

SEQ ID NO: 753849 - RNA, 64 nt, hsa; identical to SEQ ID NO: 274953

SEQ ID NO: 753850 - RNA, 64 nt, hsa; identical to SEQ ID NO: 274954

SEQ ID NO: 753851 - RNA, 64 nt, hsa; identical to SEQ ID NO: 274955

SEQ ID NO: 753852 - RNA, 64 nt, hsa; identical to SEQ ID NO: 274956

SEQ ID NO: 753853 - RNA, 64 nt, hsa; identical to SEQ ID NO: 274957

SEQ ID NO: 753854 - RNA, 64 nt, hsa; identical to SEQ ID NO: 274958

SEQ ID NO: 753855 - RNA, 64 nt, hsa; identical to SEQ ID NO: 274959

SEQ ID NO: 753856 - RNA, 64 nt, hsa; identical to SEQ ID NO: 274960

SEQ ID NO: 753857 - RNA, 64 nt, hsa; identical to SEQ ID NO: 274961

SEQ ID NO: 753858 - RNA, 64 nt, hsa; identical to SEQ ID NO: 274962

SEQ ID NO: 753859 - RNA, 64 nt, hsa; identical to SEQ ID NO: 274963

SEQ ID NO: 753860 - RNA, 64 nt, hsa; identical to SEQ ID NO: 274964

SEQ ID NO: 753861 - RNA, 64 nt, hsa; identical to SEQ ID NO: 274965

SEQ ID NO: 753862 - RNA, 64 nt, hsa; identical to SEQ ID NO: 274966

SEQ ID NO: 753863 - RNA, 64 nt, hsa; identical to SEQ ID NO: 274967

SEQ ID NO: 753864 - RNA, 64 nt, hsa; identical to SEQ ID NO: 274968

SEQ ID NO: 753865 - RNA, 64 nt, hsa; identical to SEQ ID NO: 274969

SEQ ID NO: 753866 - RNA, 64 nt, hsa; identical to SEQ ID NO: 274970

SEQ ID NO: 753867 - RNA, 64 nt, hsa; identical to SEQ ID NO: 274971

SEQ ID NO: 753868 - RNA, 64 nt, hsa; identical to SEQ ID NO: 274972

SEQ ID NO: 753869 - RNA, 64 nt, hsa; identical to SEQ ID NO: 274973

SEQ ID NO: 753870 - RNA, 64 nt, hsa; identical to SEQ ID NO: 274974

SEQ ID NO: 753871 - RNA, 64 nt, hsa; identical to SEQ ID NO: 274975

SEQ ID NO: 753872 - RNA, 64 nt, hsa; identical to SEQ ID NO: 274976

SEQ ID NO: 753873 - RNA, 64 nt, hsa; identical to SEQ ID NO: 274977

SEQ ID NO: 753874 - RNA, 64 nt, hsa; identical to SEQ ID NO: 274978

SEQ ID NO: 753875 - RNA, 64 nt, hsa; identical to SEQ ID NO: 274979

SEQ ID NO: 753876 - RNA, 64 nt, hsa; identical to SEQ ID NO: 274980

SEQ ID NO: 753877 - RNA, 64 nt, hsa; identical to SEQ ID NO: 274981

SEQ ID NO: 753878 - RNA, 59 nt, hsa; identical to SEQ ID NO: 274982

SEQ ID NO: 753879 - RNA, 64 nt, hsa
cugagucaccuucugacacgagcucccucugcuugcuuuccaggucuugaaaaucugaauucac

SEQ ID NO: 753880 - RNA, 64 nt, hsa
uugggagcccaggugguccuuggccaccauucaggcuuuccaagaagccaaccaccuuggagau

SEQ ID NO: 753881 - RNA, 64 nt, hsa
ccuuuguagggccuugcugccagggggcagggaugcuuuccagccugcagcaacagaacacuug

SEQ ID NO: 753882 - RNA, 64 nt, hsa
augccccuccagaaggaccuaggagaguaggugagcuuuccaaagugagagacgaaucuuucuu

SEQ ID NO: 753883 - RNA, 64 nt, hsa
ccaggcuucagucuucccaacuucuuacaccauugcuuuccauucuccagaacucuuuuuuccu

SEQ ID NO: 753884 - RNA, 64 nt, hsa
ccucagcucaccuucucucuucaccaugagacuggcuuuccacaaacucucaucucaggcccuc

SEQ ID NO: 753885 - RNA, 64 nt, hsa
uguggaguuugaucacacaauucauaauguugcugcuuuccauuaacuagucuugaaaugccuu

SEQ ID NO: 753886 - RNA, 64 nt, hsa
acaugucuugaauguacacauaaaggaauccaaagcuuuccauucuaacuuaaucuuugugaua

SEQ ID NO: 753887 - RNA, 64 nt, hsa
gcaagaaaccucaggccgugugaagagcagcaaagcuuuccagaaggcauaaaaggaaacuuga

SEQ ID NO: 753888 - RNA, 64 nt, hsa
gccccugcacaaggaugacucgcaaauucauaaagcuuuccauaaauauauuuauuaaaaacca

SEQ ID NO: 753889 - RNA, 64 nt, hsa
cuauagagaucuacuuuucuccuaugucuccuaggcuuuccaugauaauuagguaauacauuua

SEQ ID NO: 753890 - RNA, 64 nt, hsa
gauguauuuuaugaugcccagcuuggaaauaguugcuuuccauagucucaacuguauuguguca

SEQ ID NO: 753891 - RNA, 64 nt, hsa
gccuggcugccccuccccuccggcccucuccacugcuuuccagacacuaaccaaggcuuccagg

SEQ ID NO: 753892 - RNA, 64 nt, hsa
cugugcccugacagccgcuccugguaucagagcugcuuuccagagggcagcacagccagggccg

SEQ ID NO: 753893 - RNA, 64 nt, hsa
gggcccacaccugcuuaguuuaugaggaccggcugcuuuccagugguagcccuuuugccaugga

SEQ ID NO: 753894 - RNA, 64 nt, hsa
auucuaaguguccaccccagggaggcaaggggcugcuuuccacuguggguaccuggugaucagg

SEQ ID NO: 753895 - RNA, 64 nt, hsa
cuccaaguugcauugccucccgcgcccagauccugcuuuccauuucgagaacauaaauagauug

SEQ ID NO: 753896 - RNA, 64 nt, hsa
acaccuaagcagguagacauccgcgaggucagaugcuuuccaacaugacaccugaacaucuucc

SEQ ID NO: 753897 - RNA, 64 nt, hsa; identical to SEQ ID NO: 178825

SEQ ID NO: 753898 - RNA, 64 nt, hsa; identical to SEQ ID NO: 178826

SEQ ID NO: 753899 - RNA, 64 nt, hsa; identical to SEQ ID NO: 178827

SEQ ID NO: 753900 - RNA, 64 nt, hsa; identical to SEQ ID NO: 178828

SEQ ID NO: 753901 - RNA, 64 nt, hsa; identical to SEQ ID NO: 178829

SEQ ID NO: 753902 - RNA, 64 nt, hsa; identical to SEQ ID NO: 178830

SEQ ID NO: 753903 - RNA, 64 nt, hsa; identical to SEQ ID NO: 178831

SEQ ID NO: 753904 - RNA, 64 nt, hsa; identical to SEQ ID NO: 178832

SEQ ID NO: 753905 - RNA, 64 nt, hsa; identical to SEQ ID NO: 178833

SEQ ID NO: 753906 - RNA, 64 nt, hsa; identical to SEQ ID NO: 178834

SEQ ID NO: 753907 - RNA, 64 nt, hsa; identical to SEQ ID NO: 178835

SEQ ID NO: 753908 - RNA, 64 nt, hsa; identical to SEQ ID NO: 178836

SEQ ID NO: 753909 - RNA, 64 nt, hsa; identical to SEQ ID NO: 178837

SEQ ID NO: 753910 - RNA, 64 nt, hsa; identical to SEQ ID NO: 178838

SEQ ID NO: 753911 - RNA, 62 nt, hsa
ccaccuaaaauucauaugugacaaaauuaucucgaccuuacauaggaggagaauacuugaag

SEQ ID NO: 753912 - RNA, 62 nt, hsa
agugacauuuaaugccaucuagcuagcaauugcgaccuuaauuuaacuuuccagucuuagcu

SEQ ID NO: 753913 - RNA, 62 nt, hsa
caaggcccucagagaugaucaguccaacugaacgaccuuacaaaugaggaaaccaagauaaa

SEQ ID NO: 753914 - RNA, 62 nt, hsa
ucuaaaguaggucaucagguucacuuauuauccgaccuuaaucugggauaaagguuuuggua

SEQ ID NO: 753915 - RNA, 62 nt, hsa
ccucccugccuuagagaugaggcucagacaaacgaccuuagcacccauagccuaugccauga

SEQ ID NO: 753916 - RNA, 62 nt, hsa
agcacaguaaauaucccaaacugugaugaagccgaccuuagauuuaguaguguaagcuagaa

SEQ ID NO: 753917 - RNA, 62 nt, hsa
ccagacuuguagggaagaaaacaaugacuugacgaccuuaaaaaggguuagauugacauugc

SEQ ID NO: 753918 - RNA, 62 nt, hsa
cuguauccuuuaucccagccagucauccagcucgaccuuaugagaagguaccuugcccaggu

SEQ ID NO: 753919 - RNA, 62 nt, hsa
aaugcaggauccaaauccucaucuuacuuucccgaccuuaaggauguagcugcugcuugucc

SEQ ID NO: 753920 - RNA, 62 nt, hsa
uggagauaaaaagaagaguaaaauacacuucccgaccuuaaggaucugauacaucuaguuau

SEQ ID NO: 753921 - RNA, 62 nt, hsa
cgccacccccuccaaccacugcccucagcccccgaccuuauuuauuacccuccccucccaca

SEQ ID NO: 753922 - RNA, 62 nt, hsa
gauaaugcggguaacagacaauauaauagccccgaccuuaaacgaagcuuuuguacugcaga

SEQ ID NO: 753923 - RNA, 62 nt, hsa
gagggccacguccugggguagcuccugaccuccgaccuuauguccaaauuucacacccaugg

SEQ ID NO: 753924 - RNA, 62 nt, hsa
guucugauuucugaggagccaggacaaguuggcgaccuuacuccuccaaaacugaacacaag

SEQ ID NO: 753925 - RNA, 62 nt, hsa
uggggugccuagguugguuuccccugcacucccgaccuuagcuuauugaucccacauuucca

SEQ ID NO: 753926 - RNA, 62 nt, hsa
auccucccugccucacuccccucagccccugccgaccuuagcuuaucugggagagaaacaag

SEQ ID NO: 753927 - RNA, 62 nt, hsa
gagaagagggaggagucacgcccugaagcguacgaccuuacacuuucucaguacaagcaacu

SEQ ID NO: 753928 - RNA, 62 nt, hsa
agugcauaaggucuuuggccuucaagauccaucgaccuuaaacaggaaugcuuagcacguuu

SEQ ID NO: 753929 - RNA, 64 nt, hsa; identical to SEQ ID NO: 682747

SEQ ID NO: 753930 - RNA, 64 nt, hsa; identical to SEQ ID NO: 682748

SEQ ID NO: 753931 - RNA, 64 nt, hsa; identical to SEQ ID NO: 682749

SEQ ID NO: 753932 - RNA, 64 nt, hsa; identical to SEQ ID NO: 682750

SEQ ID NO: 753933 - RNA, 64 nt, hsa; identical to SEQ ID NO: 682751

SEQ ID NO: 753934 - RNA, 64 nt, hsa; identical to SEQ ID NO: 682752

SEQ ID NO: 753935 - RNA, 64 nt, hsa; identical to SEQ ID NO: 682753

SEQ ID NO: 753936 - RNA, 64 nt, hsa; identical to SEQ ID NO: 682754

SEQ ID NO: 753937 - RNA, 64 nt, hsa; identical to SEQ ID NO: 682755

SEQ ID NO: 753938 - RNA, 64 nt, hsa; identical to SEQ ID NO: 682756

SEQ ID NO: 753939 - RNA, 64 nt, hsa; identical to SEQ ID NO: 682757

SEQ ID NO: 753940 - RNA, 64 nt, hsa; identical to SEQ ID NO: 682758

SEQ ID NO: 753941 - RNA, 64 nt, hsa; identical to SEQ ID NO: 682759

SEQ ID NO: 753942 - RNA, 64 nt, hsa; identical to SEQ ID NO: 682760

SEQ ID NO: 753943 - RNA, 64 nt, hsa; identical to SEQ ID NO: 682761

SEQ ID NO: 753944 - RNA, 64 nt, hsa; identical to SEQ ID NO: 682762

SEQ ID NO: 753945 - RNA, 64 nt, hsa; identical to SEQ ID NO: 682763

SEQ ID NO: 753946 - RNA, 64 nt, hsa; identical to SEQ ID NO: 682764

SEQ ID NO: 753947 - RNA, 64 nt, hsa; identical to SEQ ID NO: 682765

SEQ ID NO: 753948 - RNA, 64 nt, hsa; identical to SEQ ID NO: 682766

SEQ ID NO: 753949 - RNA, 64 nt, hsa; identical to SEQ ID NO: 682767

SEQ ID NO: 753950 - RNA, 64 nt, hsa; identical to SEQ ID NO: 682768

SEQ ID NO: 753951 - RNA, 64 nt, hsa; identical to SEQ ID NO: 682769

SEQ ID NO: 753952 - RNA, 64 nt, hsa; identical to SEQ ID NO: 682770

SEQ ID NO: 753953 - RNA, 64 nt, hsa; identical to SEQ ID NO: 682771

SEQ ID NO: 753954 - RNA, 64 nt, hsa; identical to SEQ ID NO: 682772

SEQ ID NO: 753955 - RNA, 64 nt, hsa; identical to SEQ ID NO: 682773

SEQ ID NO: 753956 - RNA, 64 nt, hsa; identical to SEQ ID NO: 682774

SEQ ID NO: 753957 - RNA, 64 nt, hsa; identical to SEQ ID NO: 682775

SEQ ID NO: 753958 - RNA, 64 nt, hsa; identical to SEQ ID NO: 682776

SEQ ID NO: 753959 - RNA, 64 nt, hsa; identical to SEQ ID NO: 682777

SEQ ID NO: 753960 - RNA, 64 nt, hsa; identical to SEQ ID NO: 682778

SEQ ID NO: 753961 - RNA, 64 nt, hsa; identical to SEQ ID NO: 682779

SEQ ID NO: 753962 - RNA, 64 nt, hsa; identical to SEQ ID NO: 682780

SEQ ID NO: 753963 - RNA, 64 nt, hsa; identical to SEQ ID NO: 682781

SEQ ID NO: 753964 - RNA, 64 nt, hsa; identical to SEQ ID NO: 682782

SEQ ID NO: 753965 - RNA, 64 nt, hsa; identical to SEQ ID NO: 682783

SEQ ID NO: 753966 - RNA, 64 nt, hsa; identical to SEQ ID NO: 682784

SEQ ID NO: 753967 - RNA, 64 nt, hsa; identical to SEQ ID NO: 682785

SEQ ID NO: 753968 - RNA, 64 nt, hsa; identical to SEQ ID NO: 682786

SEQ ID NO: 753969 - RNA, 64 nt, hsa; identical to SEQ ID NO: 682787

SEQ ID NO: 753970 - RNA, 64 nt, hsa; identical to SEQ ID NO: 682788

SEQ ID NO: 753971 - RNA, 64 nt, hsa; identical to SEQ ID NO: 682789

SEQ ID NO: 753972 - RNA, 64 nt, hsa; identical to SEQ ID NO: 682790

SEQ ID NO: 753973 - RNA, 64 nt, hsa; identical to SEQ ID NO: 682791

SEQ ID NO: 753974 - RNA, 64 nt, hsa; identical to SEQ ID NO: 682792

SEQ ID NO: 753975 - RNA, 64 nt, hsa; identical to SEQ ID NO: 682793

SEQ ID NO: 753976 - RNA, 64 nt, hsa; identical to SEQ ID NO: 682794

SEQ ID NO: 753977 - RNA, 64 nt, hsa; identical to SEQ ID NO: 682795

SEQ ID NO: 753978 - RNA, 64 nt, hsa; identical to SEQ ID NO: 682796

SEQ ID NO: 753979 - RNA, 64 nt, hsa; identical to SEQ ID NO: 173300

SEQ ID NO: 753980 - RNA, 64 nt, hsa; identical to SEQ ID NO: 173301

SEQ ID NO: 753981 - RNA, 64 nt, hsa; identical to SEQ ID NO: 173302

SEQ ID NO: 753982 - RNA, 64 nt, hsa; identical to SEQ ID NO: 173303

SEQ ID NO: 753983 - RNA, 64 nt, hsa; identical to SEQ ID NO: 173304

SEQ ID NO: 753984 - RNA, 64 nt, hsa; identical to SEQ ID NO: 173305

SEQ ID NO: 753985 - RNA, 64 nt, hsa; identical to SEQ ID NO: 173306

SEQ ID NO: 753986 - RNA, 64 nt, hsa; identical to SEQ ID NO: 173307

SEQ ID NO: 753987 - RNA, 64 nt, hsa; identical to SEQ ID NO: 55280

SEQ ID NO: 753988 - RNA, 64 nt, hsa; identical to SEQ ID NO: 55281

SEQ ID NO: 753989 - RNA, 64 nt, hsa; identical to SEQ ID NO: 55282

SEQ ID NO: 753990 - RNA, 64 nt, hsa; identical to SEQ ID NO: 55283

SEQ ID NO: 753991 - RNA, 64 nt, hsa; identical to SEQ ID NO: 55284

SEQ ID NO: 753992 - RNA, 64 nt, hsa; identical to SEQ ID NO: 55285

SEQ ID NO: 753993 - RNA, 64 nt, hsa; identical to SEQ ID NO: 55286

SEQ ID NO: 753994 - RNA, 64 nt, hsa; identical to SEQ ID NO: 55287

SEQ ID NO: 753995 - RNA, 64 nt, hsa; identical to SEQ ID NO: 55288

SEQ ID NO: 753996 - RNA, 64 nt, hsa; identical to SEQ ID NO: 55289

SEQ ID NO: 753997 - RNA, 64 nt, hsa; identical to SEQ ID NO: 55290

SEQ ID NO: 753998 - RNA, 64 nt, hsa; identical to SEQ ID NO: 55291

SEQ ID NO: 753999 - RNA, 64 nt, hsa; identical to SEQ ID NO: 55292

SEQ ID NO: 754000 - RNA, 64 nt, hsa; identical to SEQ ID NO: 55293

SEQ ID NO: 754001 - RNA, 64 nt, hsa; identical to SEQ ID NO: 55294

SEQ ID NO: 754002 - RNA, 64 nt, hsa; identical to SEQ ID NO: 55295

SEQ ID NO: 754003 - RNA, 64 nt, hsa; identical to SEQ ID NO: 55296

SEQ ID NO: 754004 - RNA, 64 nt, hsa; identical to SEQ ID NO: 55297

SEQ ID NO: 754005 - RNA, 64 nt, hsa; identical to SEQ ID NO: 55298

SEQ ID NO: 754006 - RNA, 64 nt, hsa; identical to SEQ ID NO: 55299

SEQ ID NO: 754007 - RNA, 64 nt, hsa; identical to SEQ ID NO: 55300

SEQ ID NO: 754008 - RNA, 64 nt, hsa; identical to SEQ ID NO: 55301

SEQ ID NO: 754009 - RNA, 64 nt, hsa; identical to SEQ ID NO: 55302

SEQ ID NO: 754010 - RNA, 64 nt, hsa; identical to SEQ ID NO: 55303

SEQ ID NO: 754011 - RNA, 64 nt, hsa; identical to SEQ ID NO: 55304

SEQ ID NO: 754012 - RNA, 64 nt, hsa; identical to SEQ ID NO: 55305

SEQ ID NO: 754013 - RNA, 64 nt, hsa; identical to SEQ ID NO: 55306
